United States Patent 8,445,666 (RIBONUCLEIC ACID INTERFERENCE MOLECULES) - sequence listing, part 4

SEQ ID NO: 67190 - DNA, 75 bp, Mus musculus
acctatatgtgtatttcaagcatttctagacataagtctgtttgtctctgaatgtatgtgcatgagtatgtgggt

SEQ ID NO: 67191 - DNA, 110 bp, Mus musculus
gactataggtgtgttgatctgtacctgagtatgtgcatgtgtgagcatgtatgtgcatctgcatgtgagtgtgtacataaatgtgtatgtcggtatatgtgtgtctattc

SEQ ID NO: 67192 - DNA, 75 bp, Mus musculus
tagggatggggatggcaggtgtctggaacccagcccaactgggctctttggtgggtgacacactctgtgtctcta

SEQ ID NO: 67193 - DNA, 116 bp, Mus musculus
gggagccatgcagggtgacatcattaggactctcctgaggccggccggcatggacagtgatcattgtgtgctgtagggacagagagggtttctctgggatgaaaaccaaggacacc

SEQ ID NO: 67194 - DNA, 77 bp, Mus musculus
catcttcccaggctcgctgcatgccagtcataagcctctcagagcaacaagtggcaggcagtcacctgtatttgatg

SEQ ID NO: 67195 - DNA, 74 bp, Mus musculus
gtgtgtgattgtgtgtgttaaggcatgtgtgtgcacctgtgtgtgtgtgtgtgtggtaaggcacatgtatacat

SEQ ID NO: 67196 - DNA, 104 bp, Mus musculus
tgtgtgtgtttgtcttatatgaacatgtgtattttgtatatattacatatatattatatatgttgcatataatatcttatatatataatatatattaaatgcat

SEQ ID NO: 67197 - DNA, 67 bp, Mus musculus
gaaccctggatgaagtgtgtgagcagagctgcatgcacaagctcaccatcagctctctctaggggcc

SEQ ID NO: 67198 - DNA, 105 bp, Mus musculus
ctcttccctttcctgcccagctagtggccatcagctctttattaagccaatcagtgagtgaggaagttgtatgtttacaaagtactgaggcaggtgatgagccat

SEQ ID NO: 67199 - DNA, 95 bp, Mus musculus
atgcctatatgtctgtctatatgtgtgtgcatacatacatatgtgtatatgtatataagtattgttgcgcacttgtgaaattgatgaaaaaggta

SEQ ID NO: 67200 - DNA, 78 bp, Mus musculus
aggggtgtgtgcgtgtctctctctgtgtgtagacagatatggagaaggcagggcagggatggcacagtgagcaccctt

SEQ ID NO: 67201 - DNA, 66 bp, Mus musculus
gaggagagctgactctcccactctcagcatccttagatgcctgtagagagttaacatgttctcctc

SEQ ID NO: 67202 - DNA, 137 bp, Mus musculus
gtgtgcatgtatacatgtgcatatatatgtgtgcatatgtatgtacatatatgtttatatatacacctgtatgtacatatatatgtgtatatgtatatatgtgtatgcatatgtgtgtgcgtgtgtgtgtgtgtgtg

SEQ ID NO: 67203 - DNA, 75 bp, Mus musculus
gtctgcaagtgtcttgtgttcactgtctcagttctccaggagaatgaggttctgggcaataggcatagaggagat

SEQ ID NO: 67204 - DNA, 69 bp, Mus musculus
gatgtcactgccactgtctgtctgtgccaccatctgttgcaggacagagccacttaaggcagtgacatc

SEQ ID NO: 67205 - DNA, 99 bp, Mus musculus
tggagatgtggtcttcatcacatgtctaagccttgatctctctctgtgtgacaggcttggcaggagatcaggcccagaactgtgccaccaacattttta

SEQ ID NO: 67206 - DNA, 91 bp, Mus musculus
ggagactggacaatcgctttgcacattgagtacactgagttacagagcagacaacagtgagatcagagccatgcagggactttagctccag

SEQ ID NO: 67207 - DNA, 71 bp, Mus musculus
gggctggtcacagtacagtgtgaggttgaaagtctcaactctgaatctgcacacgtgcaggaccagggtcc

SEQ ID NO: 67208 - DNA, 109 bp, Mus musculus
acatgtgcatatatatgtatatgtgtatatgtgtattatacatgtgaatatgtatataagtgtatatgtatagatatgtatgtgtgtatatgtaatatgcatgtgtata

SEQ ID NO: 67209 - DNA, 77 bp, Mus musculus
gtgtgtgtgtgtgtgtgcatgtgtatgtgtgtgtgcatgagtgtgcatgtgcatgtgcgtgatgcaggtgttgggac

SEQ ID NO: 67210 - DNA, 61 bp, Mus musculus
tcagggattggaaagacggctcagcgattaagatcactgactgctcttccagaggtcctga

SEQ ID NO: 67211 - DNA, 67 bp, Mus musculus
cacacacagacacagcaagaagatagctgcttataatcaggtgtgtgtgtgtgtgtgtgtgtgtgtg

SEQ ID NO: 67212 - DNA, 65 bp, Mus musculus
cacacacacacacacacacacacacctgattataagcagctatcttcttgctgtgtctgtgtgtg

SEQ ID NO: 67213 - DNA, 66 bp, Mus musculus
ggcagctctctctgtctttcagtgtgcctggttcatagccaggactgagaagagccctatgctgcc

SEQ ID NO: 67214 - DNA, 83 bp, Mus musculus
gctctgtcactctctgcgacagtgaagggaatttggcttcggagcatctatcttaggttgggtttctattgcagtgaacaggc

SEQ ID NO: 67215 - DNA, 86 bp, Mus musculus
tctctattgagtgtgtgaactggatctctctgtctccctcagagacccgcagagattaacgaaggcccgacatgcagaagtggtga

SEQ ID NO: 67216 - DNA, 110 bp, Mus musculus
agagaggaagctgagtggaacagagccagtccccactccagtgccagctctgggggttccagactggctcagtgcctggctctggactcccctgcagcagacctatctct

SEQ ID NO: 67217 - DNA, 111 bp, Mus musculus
ttctaaaggaagtgattttccattgagcacctagagcacgcctgtgttgcctagttggttgcatagatttaagattaggcatttaagggactcatttgcttttcgaattat

SEQ ID NO: 67218 - DNA, 93 bp, Mus musculus
gggttttgtttgtgtgcttggagtcagggtctcactgtggctctggctggcctgagacctctgtgtaggataggttagcactgatatccacct

SEQ ID NO: 67219 - DNA, 64 bp, Mus musculus
cactgggagtgagtgggatttgcggtttcaaaaggccataccagacccagtctcactctctctg

SEQ ID NO: 67220 - DNA, 87 bp, Mus musculus
ggcctttctgtcactgtatctgtcacattggcatgcaatcacctgggtatgtatgttatatgtgtatgtatataatcagctgaggct

SEQ ID NO: 67221 - DNA, 75 bp, Mus musculus
cagttgactttactccagactcctaggtgagagcagcttctcccagtctagtacgtctgtctgtctgtctgtctg

SEQ ID NO: 67222 - DNA, 107 bp, Mus musculus
gaacccttaagtttccatcaacacaccaccctggctcactgtctgactggccctttacaagggacagggagaaactgaccaagggcaggaagttaacttggggtatc

SEQ ID NO: 67223 - DNA, 67 bp, Mus musculus
ggcccaagttcactctccttctcccttagcctcttcagtgttgagaggataggtgtgtggtgctgcc

SEQ ID NO: 67224 - DNA, 102 bp, Mus musculus
tgttccttgagatggagatagaatactttttttatatatatataaatttttaagatttatttattattatatctaagtacactgtagctgtcttcagatgca

SEQ ID NO: 67225 - DNA, 79 bp, Mus musculus
gtctgtctcagtgtgtcaggctgggccatgttctctttgtccagggaactcgggtaatggctgaactgatggacacgac

SEQ ID NO: 67226 - DNA, 111 bp, Mus musculus
agtaagtctttaccaaatgagctaattccctagcctcacaactacttttatttatatagaaagttaactttaggggctggagaaaaggctcagcggttaagagcactgact

SEQ ID NO: 67227 - DNA, 119 bp, Mus musculus
gtgtatatgtatatatgtgcattaagtatatgtgcatatgtgtatttctatatatgtgtacatgtgtatatgtgtatggtgtatgtgtgtacatgtgtatggtgtatgtgtgtatgtgt

SEQ ID NO: 67228 - DNA, 73 bp, Mus musculus
gaggaggatgggcagtggttaacatagtcaaagtatcaaaacatcttctgacagcctctgtgtatgacacctc

SEQ ID NO: 67229 - DNA, 114 bp, Mus musculus
ctgtctgacaaacttaaaaaaagtaaaataaataaaataaaagcttggaaatgaaaggtttttttttgtttttgtttttgttttttttgttttttttttttaacaaggattgac

SEQ ID NO: 67230 - DNA, 113 bp, Mus musculus
ttaatcttaaatactcaacttcttgttgttgtctgaatgtcataagtgattatgttgatatatactgaactagaccattccatgattacaaagaaagatgtattagagattaa

SEQ ID NO: 67231 - DNA, 119 bp, Mus musculus; identical to SEQ ID NO: 67227

SEQ ID NO: 67232 - DNA, 111 bp, Mus musculus; identical to SEQ ID NO: 67226

SEQ ID NO: 67233 - DNA, 79 bp, Mus musculus; identical to SEQ ID NO: 67225

SEQ ID NO: 67234 - DNA, 102 bp, Mus musculus; identical to SEQ ID NO: 67224

SEQ ID NO: 67235 - DNA, 95 bp, Mus musculus
ccttgacttcctgtgcctcactgtctctctggtgctgtgtttattctttaagtccacacgtaccttggggctcatagggggctgttctgttttgg

SEQ ID NO: 67236 - DNA, 84 bp, Mus musculus
tagaatgttttcagggtctatttgttgaagttacagggaccatgctccataagaatgtgttctctgtgtctgtctctgattctg

SEQ ID NO: 67237 - DNA, 72 bp, Mus musculus
tacacacacagtgccatagtgcatgcatatatatatatattatatatgcatgcatatatatgtgtgtgtgta

SEQ ID NO: 67238 - DNA, 70 bp, Mus musculus
gaagtacaggggctggagagatggctcagtggttaagagcactgactgctcttccagaggtcctgagttc

SEQ ID NO: 67239 - DNA, 106 bp, Mus musculus
gttatgtgctaccggggctggagagatggctcaggggttaagagcactggctgctcttccagaggtcctgagttcaattcccagcaaccacatggtggctcacaac

SEQ ID NO: 67240 - DNA, 100 bp, Mus musculus
tgtggggcaggaagataggagattgaagctagcctagtctacagtctctgtctcacaaaaacaagtcagaagatattgtcgaagattgttgtagctttga

SEQ ID NO: 67241 - DNA, 70 bp, Mus musculus
ctttggactgcctacaaagggagcatttagcaggctgactgaagagtgtgactggtgcgttttctcaagg

SEQ ID NO: 67242 - DNA, 111 bp, Mus musculus
ctatgtagctgagggtgaccttcaactctttttttatttttaaagatatatacatatgtgtgtatatatatatgaatatgagtacactgtggctctcttcagacacatcag

SEQ ID NO: 67243 - DNA, 118 bp, Mus musculus
aggaccctgagctggggtgtcacagaaggtaggaacgtaagaagggtcccaaatgcctgaccctctgactctctgcttccatataccccagagagccaggaccccaaagcactgtcct

SEQ ID NO: 67244 - DNA, 66 bp, Mus musculus
cgggctttggagagtccagccacaatgccagggacagaactgtggactgactctcacagtcacctg

SEQ ID NO: 67245 - DNA, 64 bp, Mus musculus
ctgcccattctctctgtctctgaggaaagctcacattgcactctcgggaaagccagacaggcag

SEQ ID NO: 67246 - DNA, 89 bp, Mus musculus
cccagaaccaggagttagtagatgtccatgggtttgttgaatgaatgaatgaatgaatgaatgaattgctgatactgttagtgtttggg

SEQ ID NO: 67247 - DNA, 119 bp, Mus musculus
gcccaggttcaattcctggccaatgtacagctttctcaagttgtcagaaaagagtgaataaagaactaaaattgcatgtggggctggagagatggctcagtggttacgagcactgaggt

SEQ ID NO: 67248 - DNA, 61 bp, Mus musculus
cttagtctggagagatgactcagtggttgggagcactgactgctcttccagaggtcctgag

SEQ ID NO: 67249 - DNA, 116 bp, Mus musculus
cgaaaagtattcatcataaaaatgcttagaagggggctggagagatggctcagtggttaagagcactgactgctcttccaatctgatgtcctcttctggtgtatgtgaagacagcg

SEQ ID NO: 67250 - DNA, 141 bp, Mus musculus
tgtatgtatatatatgtgtgtgtgtatgtatatgtatacatatgtatatatatgtgtgtatatatatgtgtatatatatgtgtgtgtgtgtgtatatatatatatatatatatatacatacatatatacacacacacacac

SEQ ID NO: 67251 - DNA, 79 bp, Mus musculus
ctgagactgggcatggtggcgaatgtctttaatcccagcccttgggaggcaggagcaggacagtctctgtgagtctgag

SEQ ID NO: 67252 - DNA, 125 bp, Mus musculus
caggagggcacaaagaaaatgaagagtggtcacaggaggctctgcctttgtgggaccaggctagatggggctctcctgctgcaggctcctatgggcaagctcccttcagaactctccttttagcc

SEQ ID NO: 67253 - DNA, 75 bp, Mus musculus
ccttggagtctgaaaaaacacactgaatctcttagagctagatctacagacagttgtgagtgaccaggcacgggg

SEQ ID NO: 67254 - DNA, 86 bp, Mus musculus
ctaccttttaaaaaactttctgtgtgtctgtgtgtccgtattaaatatgggtgtgtgcaaggaggccagaggctcacactgggtgg

SEQ ID NO: 67255 - DNA, 61 bp, Mus musculus
cgtgtgtgtacatgtgtgtacatgtgtgtgtctgtatgtgtgttgtgtgtgtgcacatgtg

SEQ ID NO: 67256 - DNA, 104 bp, Mus musculus
catgtgtgtgtgtgcacatgtgtatctgtatctgtgtgccgtgtgtgtgtacatgtgtgtacatgtgtgtgtccgtatttgtgtgttgtgtgtgtgcacatgtg

SEQ ID NO: 67257 - DNA, 103 bp, Mus musculus
aggaggtgtggttgggtaatgggacacaaactcaaagctggagacaggcagtccgtgcctcctctctccgtgtgtgtctctgttacagaggccacagcttcct

SEQ ID NO: 67258 - DNA, 59 bp, Mus musculus
ctgtctgtctgtccgtctgtctctgtgttttgtggggactgtcggaaaggcgaaggcag

SEQ ID NO: 67259 - DNA, 82 bp, Mus musculus
ctagcagtggcctaggcagaagctgtggcggtcctggggtcaagtctcagtcaccgacacactgttaggaactacgtgctgg

SEQ ID NO: 67260 - DNA, 83 bp, Mus musculus
gcttgtgaccagggattcagagccagcccaggtagcccctttttctgtttccatctctgtctctgtctgcctgtcaatctggt

SEQ ID NO: 67261 - DNA, 82 bp, Mus musculus
gggggtagtagagggggctggagagatggctcagcggttaagaacactgactgctcttccagaggtcctgagttcaattccc

SEQ ID NO: 67262 - DNA, 73 bp, Mus musculus
gaaaacttcagggagctggagagatggctcagtggttaagagcactggctgctcttccagaggtcctgagttc

SEQ ID NO: 67263 - DNA, 65 bp, Mus musculus
gccaaggggctggagagatgggtcagcagctacgagcactgactgctcttccagaggtcctgagt

SEQ ID NO: 67264 - DNA, 98 bp, Mus musculus
acacccacggggcagctcacaactgtctgtactctggctccaggagagccaatgccctcttctggccaatgcaggcactagggaactcagtgtggtgt

SEQ ID NO: 67265 - DNA, 81 bp, Mus musculus
gccaatattcttaactgctgagccatctctcgaggctccctaggtctcagagcagactgagctctcactgacaaccttggt

SEQ ID NO: 67266 - DNA, 75 bp, Mus musculus
tacacaggcgctcagaggctgtctggctgactcaccctcctaggtgaggagcactgctctctgcagcccctggtg

SEQ ID NO: 67267 - DNA, 82 bp, Mus musculus
gctggcgagttgggggcgcgctcgacagttactcgcttatttataaatgtgtctgcctctgtgtctctgtgtctctgtctgt

SEQ ID NO: 67268 - DNA, 65 bp, Mus musculus
tactctgtgtgtgtatgtgtctgtgtatgtactcacacatgtgtatatgcatacacacatgtgtg

SEQ ID NO: 67269 - DNA, 70 bp, Mus musculus
ctgtagctgatttctcaatggtgtctgtccagtggaaatctgcacagacagacagacagacagactaggg

SEQ ID NO: 67270 - DNA, 71 bp, Mus musculus
cctgatgttcatgcagagggctcaggttcaatttccagcacccactgggccactcactgtgtgactccagg

SEQ ID NO: 67271 - DNA, 77 bp, Mus musculus
gtgtgtgtccatctgtccatctgtctgtgcctgtccgtccatctgtgtcagtgtatatagagggcagaggataacac

SEQ ID NO: 67272 - DNA, 79 bp, Mus musculus
ctgtgtgtgtgtgtgtgactgttttagtggtttactcctgtgtgtgtgactgagtgcctgtgcttctgtacatacacag

SEQ ID NO: 67273 - DNA, 117 bp, Mus musculus
gtttgtctgtgattatgttataaacttgctgtatagtgagattaatttaatgtgttttcaacttttaggaacacattatctatgcttatgtatctgtttgtaaggaaaagggctgat

SEQ ID NO: 67274 - DNA, 79 bp, Mus musculus
gcggagaagagccataacagggagagcgtggttggagctgtgtgtgtgtatctgtgtgtatctctttgtgtgtgtatct

SEQ ID NO: 67275 - DNA, 93 bp, Mus musculus
gctaggagggagacggagcggctgaggatccaggcaggagcgtgcagcatctgagtcaggctcgctctctcccacaccccagagccgactgcc

SEQ ID NO: 67276 - DNA, 84 bp, Mus musculus
gtgcagcttggactgtgatgatcctatcagatcctatcagggctccccagggtgagagaggacagaggacacagcctgcttcat

SEQ ID NO: 67277 - DNA, 74 bp, Mus musculus
atgtacctggctgtgtccctgtgtgtgtgtacctgtctgtgcgggtgtgtgtgcctgtgtatgtgcctgtgtgt

SEQ ID NO: 67278 - DNA, 91 bp, Mus musculus
agcacaggggctggagagatggctcagcggttaagagcactgactgctcttctgggtcctaagtttaaatcccagaacccacatggtggct

SEQ ID NO: 67279 - DNA, 118 bp, Mus musculus
cctgattggatgtcttctttcccatgcttctaaaatgagcctggctccccctcagtactcagagagcagagacttagggagccttagtcagagcatagggccttagcaacactcctgg

SEQ ID NO: 67280 - DNA, 102 bp, Mus musculus
ctcttcttaagagtagacaagccaagtttctgagagtcactctcagaccagccaagttgcaaagagaactctgagaccagtccatctgcttgaaagaagcag

SEQ ID NO: 67281 - DNA, 86 bp, Mus musculus
ggagcacaggccccacagagaaatgttcttttgagtggagagtctgcagtacgctccctcactcactgtcactgtcttcgccggcc

SEQ ID NO: 67282 - DNA, 85 bp, Mus musculus
gcttcttctgagtttagctgtactttcccggttgcctgcctgcctgcctgcctgcggaccacaagagcagtcacttgaaaggtgc

SEQ ID NO: 67283 - DNA, 102 bp, Mus musculus
tcaagagttggtgtttctggctcagggcctctaagagtctgtggtaaagacgttgactggactacaggccagtttatccgagctaggggagtcactttcaga

SEQ ID NO: 67284 - DNA, 60 bp, Mus musculus
tggcttgtcatcacagctcaggaggccctgggtcctcttgagtctgtctgtgtctcacca

SEQ ID NO: 67285 - DNA, 76 bp, Mus musculus
tgtacagcgaagagcccacacaccctagaagatgagccaaattgggttcaaggtctctgagtctctcagttgtaca

SEQ ID NO: 67286 - DNA, 112 bp, Mus musculus
ggtaacacagccaggctgcagaagtaagccaagactcaagagagaaatgagactgtggaactacggccccttttctcctcctcagggctcacctctggacctgcttcctgcc

SEQ ID NO: 67287 - DNA, 101 bp, Mus musculus
gtgaatccacaggggctagagagatggctcagcggttaagagcactgactgctcttccagaagtcctgagttcaattcccagcaactacatggtggctcac

SEQ ID NO: 67288 - DNA, 62 bp, Mus musculus
gtatctgcatgtatgtatgtatgtatgtatgtacacgagtacaggtgcgtgcatgcagaggc

SEQ ID NO: 67289 - DNA, 73 bp, Mus musculus
gcccagctttctgtcactttctctctggaaaacctggctggccagagagtctgtgaacagcctttgtctgggt

SEQ ID NO: 67290 - DNA, 60 bp, Mus musculus
gcaaagtacagttgtctggaatatgcttatagaggcatattttccagcaattgcccttgc

SEQ ID NO: 67291 - DNA, 117 bp, Mus musculus
tgcagggcctctcaggtatgctgttgatctatggcacactctgtcaccgtctttgtctgtgtctgaggaaacaggttccagagtgtgacctgcccaaggccgtccagtcgcctagca

SEQ ID NO: 67292 - DNA, 88 bp, Mus musculus
tatgtgtgtatatgtgtgtatgtatatgtgagtctatgtgtgtatatgtatgtttgtatgtatgaatgtatgtatgtatgtgtatatg

SEQ ID NO: 67293 - DNA, 78 bp, Mus musculus
tatgtgtgtatatgtgtatgtgtgtatatatgtgtgggtgagtctgtgtatatattcatgtatgtatgtatgtatatg

SEQ ID NO: 67294 - DNA, 111 bp, Mus musculus
gtggattcatgtgtgtgtgtgtgtgtgtgtatgtatgtatatgcatgtgagtgtatatgtgtgtatgtatatatatatatgtgtgtatgtatatgtatgtatgtatgtatt

SEQ ID NO: 67295 - DNA, 71 bp, Mus musculus
gtctgtctgtctgtctgtctgtgtagcactggcgattagggcctggctgaactactcacattcagagggac

SEQ ID NO: 67296 - DNA, 57 bp, Mus musculus
ctgagaaagcagccatggggaggctcaggccatcactcactgtctctgccatctcag

SEQ ID NO: 67297 - DNA, 84 bp, Mus musculus
atctgagtgtgtgttgtacgtatctatgtatgtatgtgtgtatgcacatgcctggtcatgcatgcatgtatggaggcctgagat

SEQ ID NO: 67298 - DNA, 85 bp, Mus musculus
gacgtgcctcagtttctctctctgtcgatgagcatgatggtgtgctaatctaagatctgtgagacagggaagaagtgtgtgtgtc

SEQ ID NO: 67299 - DNA, 79 bp, Mus musculus
ctctctctctcactcccgcaagactgaattcctcgggccacatacttaggatgcttccagtgacagtgtgagcagagag

SEQ ID NO: 67300 - DNA, 88 bp, Mus musculus
gccccctcacactctggctgtgactcagataagggctcatctctttgggagtcctgctgtccacaacggggcgtggacagatgggggc

SEQ ID NO: 67301 - DNA, 119 bp, Mus musculus
tgataaagaaagacacctgggggtgctggagagatggttcagaggttaagagcactggctgctcttccagaggtcctgagttcaattcccagcaaccacatggtggctcacaaccatca

SEQ ID NO: 67302 - DNA, 106 bp, Mus musculus
ggggatggtcggtggttttattggagcagtgtattaaaatctgggactgtgttggtgactggtgaatctgtgagctgccccactcctgagccaccagcccctcccc

SEQ ID NO: 67303 - DNA, 76 bp, Mus musculus
tgtacctctctcaatagtatatgtatataattatatactatgtatataatagtgtacatgcagaagacctggtaca

SEQ ID NO: 67304 - DNA, 102 bp, Mus musculus
aactaggctgtgcttgaatttagagatccgcctgtctctgtctcccagtcctgagattaaaggcatgtgcactcttttgattttttaacacttagcatggtt

SEQ ID NO: 67305 - DNA, 119 bp, Mus musculus
gatgctttagaaggttcaagaagagggtttgagagctccagagatggctcagcggttaagagcactgactgctcttccagaggtcctgagttcaaatcccagcaaccacacagtgcctc

SEQ ID NO: 67306 - DNA, 66 bp, Mus musculus
gtgtgtgtgtgtgtgtgtgtgttttactggaatttgaacccagactctcacacaagctgcatacac

SEQ ID NO: 67307 - DNA, 88 bp, Mus musculus
tgtggtgccagagccttgactctagcagatcacccacattccgtgacttccgtgacgtgactggtagagtactggatctaatgccaca

SEQ ID NO: 67308 - DNA, 116 bp, Mus musculus
ggcttcctcaattttatgttgaccaaggctagtgtctgcagggacctcagctgtgtctgtgtgacctcggtgtctctctgtgacctggactttctcagtgcatggtgtctgagtcc

SEQ ID NO: 67309 - DNA, 74 bp, Mus musculus
gaactaacttgttaggctggagagatggctcagtggttaaaggtactgagtgctcttccagaggtcctgagttc

SEQ ID NO: 67310 - DNA, 60 bp, Mus musculus
gcctgtctgtctgtctgtctgtggtatgtgctgcacaggctccctagcagtaagacaggt

SEQ ID NO: 67311 - DNA, 89 bp, Mus musculus
ctggacagaccacagacatggccatccctggcacagtctacgtgcttgagaagcagtgtgctttgtcagtctgtctgtgtgtctaggga

SEQ ID NO: 67312 - DNA, 61 bp, Mus musculus
tattcatacatgtgtgtgctgtggtctaagcatgcacaacacacacacactgtatgtaata

SEQ ID NO: 67313 - DNA, 81 bp, Mus musculus
agtcccaaaaggtcttatgcctgcttctgactgccacctgcaccagacagacagacagacagacagacaagtgaaaggact

SEQ ID NO: 67314 - DNA, 62 bp, Mus musculus
tcacttgtctgtctgtctgtctgtctgtctggtgcaggtggcagtcagaagcaggcataaga

SEQ ID NO: 67315 - DNA, 116 bp, Mus musculus
gggactatagaagtgactcacacccatttttaaaaaaagatctatctatctatctatctatctatctatctatctatctatctatctaatgtatgtgagtacactgtagctgtctt

SEQ ID NO: 67316 - DNA, 84 bp, Mus musculus
caggaaagtcatggggtgggtgggggcttctgagaaggctctggggggctttgatggactctgagactctgtgtacctctctga

SEQ ID NO: 67317 - DNA, 66 bp, Mus musculus
gtgtgtgtagatgtgtatgtgtgtatgtgcaggtgcatgtggatatgggtgcatatgtatacatgt

SEQ ID NO: 67318 - DNA, 150 bp, Mus musculus
gtgtgtgtgtatgtgtgtatatgtgtgtgtatgtatatgtgcatatgtgtatatatgtatatgtgcatatgtatagtatatgtatatatgtatgtatatgtgtgtgcatatattatgtgtatatacgtgtgtgtatgtgtgtgtacgtat

SEQ ID NO: 67319 - DNA, 70 bp, Mus musculus
gatctcagtgactccctcactgaggccagctggagttacgggggggggggggtcatgaaaagaaggaggc

SEQ ID NO: 67320 - DNA, 68 bp, Mus musculus
attcatacagacacacatgtgtccatctgtctgtctgactatgtgtgtgtgtgtgtgtgtgtgtgtgt

SEQ ID NO: 67321 - DNA, 103 bp, Mus musculus
ggaaactctggctggagaagggactcacgtctttctgaagcttcctgtgaccctcactctcattgcacagattttcccaagtcagtccagacttccctataga

SEQ ID NO: 67322 - DNA, 79 bp, Mus musculus
ctgtctgtctgtctgtctgactgctgagagctctgtctagacaatcccaggggctcaggcaccatggcaggaggatcag

SEQ ID NO: 67323 - DNA, 78 bp, Mus musculus
tctgcacgtgtgtatgtaatgtttgtaatgcatgtatgtatgtatgtatgtacaagacctatgtgcagtgcctgtgga

SEQ ID NO: 67324 - DNA, 69 bp, Mus musculus
gtgttctagggctggagagatggctcagctgttaagctcactgactgctcttccagaggtcctgagttc

SEQ ID NO: 67325 - DNA, 103 bp, Mus musculus
gaaggctaggttaggggctggagagatgactcagtggttaggagcactgactgctcttccagaggtcctgagttcaaatcccagcaactgagtggtggctccc

SEQ ID NO: 67326 - DNA, 71 bp, Mus musculus
gtgtcttcttatgtatctatcgaactttctccttgggctggagagatggctgttcttgcagaaaaagacac

SEQ ID NO: 67327 - DNA, 77 bp, Mus musculus
ttcaatatcacactgagagttgagaggcaggactaaaatctagtttcaccttctaactcccaacagtttccattgag

SEQ ID NO: 67328 - DNA, 112 bp, Mus musculus
gacgtccacacatgctgtcctgctgttgggatggggagctgggttgaagtctcgtgtcttgtctgcctgtgtgtccccctcagaaaagggccttgtagcaagtgtagaggtt

SEQ ID NO: 67329 - DNA, 112 bp, Mus musculus
tatcaagtgtgctttttaatggctgtagagatggctcaggggttatagagcactgactgctcttccagaggtcctaagttcaattccctgcaaccacatatagatggctcac

SEQ ID NO: 67330 - DNA, 66 bp, Mus musculus
cctctgcttctggagtgctgggactgttagtgcatctagcatcagtttagagagtgcagaagctgg

SEQ ID NO: 67331 - DNA, 63 bp, Mus musculus
gataaggagacagaagactcagaggcccagaggggtagcatggggtcctctgccctcaaattc

SEQ ID NO: 67332 - DNA, 100 bp, Mus musculus
tggaacgtgtggatagtagaggatttatattatgcagtcttgctggggtcacaccctctgagacaatgatgtatttctaacagctgctacataacttcca

SEQ ID NO: 67333 - DNA, 107 bp, Mus musculus
agtgcagccggaggccttataggttgtgtctaacttcataccagagtatctttttttgtttttagacagggtcttactttgtagccatggctggcctataactcact

SEQ ID NO: 67334 - DNA, 100 bp, Mus musculus
gaaatactttccgaggctggagacttggctcagcggttaagagcactgactgctctttcagaggttctgagttcaattcccaggaatggcatggtggctc

SEQ ID NO: 67335 - DNA, 67 bp, Mus musculus
cagagacagtcactggttgttgtaactgtatctttagatcaataacttctctgacaaatgtcctctg

SEQ ID NO: 67336 - DNA, 70 bp, Mus musculus
tggtttttcgagacagggtttctctatatagctctggctgtcctggaactcactctcactctgtagacca

SEQ ID NO: 67337 - DNA, 100 bp, Mus musculus
atgcacgtgtgtatgcacgcatgtgtgtatgtgtgcatgtgtgtgtatgtttgaatgtatgtgtgcatgtgtatataagtgtatgtgtgcgtgagtgtat

SEQ ID NO: 67338 - DNA, 71 bp, Mus musculus
acccgactcacctgtctcagacatagggctccctaaaggatgtgtgtgtgtctgtgtatgtgtgtctgtgt

SEQ ID NO: 67339 - DNA, 58 bp, Mus musculus
cacatcagtactggagcagagctgggctgggtcagtcctatctctcactgactgtgtg

SEQ ID NO: 67340 - DNA, 89 bp, Mus musculus
tgatggccagttggtgtctgtgattctagtgactttggtcttgtggggacttggagttgctagggtcaaggctgttgaaagtgtcctca

SEQ ID NO: 67341 - DNA, 135 bp, Mus musculus
tctgtgatgattgggctgggatgtgcctgcctacttagtagtgatggtctggctcagtcctctgtcctggcttcattccacaggtgccttgctcccctagccctgggacagggctctacatatgaatggattcag

SEQ ID NO: 67342 - DNA, 67 bp, Mus musculus
tgtgtgtgtgtgtgtgtgtgtgtgtgcgtgcgtgaagtttgcacacatgacacagtgcacatgtaga

SEQ ID NO: 67343 - DNA, 82 bp, Mus musculus
gggccccgggtgaagggaccacctggctttgattcagacaagaccccgttctctgagccactgtgcctgtctctcccagtcc

SEQ ID NO: 67344 - DNA, 75 bp, Mus musculus
ttgtatgtcagtctttatgtctgtccctcctgctggtcagcactcctgggggagggagataggagggccatacag

SEQ ID NO: 67345 - DNA, 270 bp, Mus musculus
tatgtgtgtatatgtacatatgtatatgcatatgtatatattgaatgtgtatatatgtgtgtatgtgtgcatgtgtatgtgtatatgtgtctgtgtatatatgtatatgtgtatgtatgtgtgtctgtgtatatatgtatatattgtatgtgtatatatatatgtgtgtatatatatattatgtatatatgtatgtgtgtatctgtattatgtatatatgtatgtgtgtatctgtattatgtatatatcatatgtgtgtatatatatata

SEQ ID NO: 67346 - DNA, 73 bp, Mus musculus
atgctgaatgtcactgactctgtcccatgggatgtcacaactgtcctgggatgtagagaggtacctgtagcat

SEQ ID NO: 67347 - DNA, 84 bp, Mus musculus
gtgtgtatgtattcgtgtgtttgtgcatatgcatgtgtgcttgtgtgtatgtatgtatatgtatctgtgtgtatgcatacatat

SEQ ID NO: 67348 - DNA, 84 bp, Mus musculus
tccatctctggtgaccacatggtattatgttccttgagccaacaacctgagttcaaaagcaaactaagcaagttactagttgga

SEQ ID NO: 67349 - DNA, 115 bp, Mus musculus
ccatgctagcaggtaactggactctctgctcggtggcccgcacactctctgtctttcatctctgcccagcaagctgcgtgggctttcagtgcccagtcattaactctggccttgg

SEQ ID NO: 67350 - DNA, 85 bp, Mus musculus
cctgtgtgtctctccctgactgggtctgcgctcgggaggatccctgggaaggcgagctaaagagctagtgactaagagaacaagg

SEQ ID NO: 67351 - DNA, 74 bp, Mus musculus
tagcaagttcaagcctagactgcacgcatgggagcctgtctcactgtgtgttatatctatattattacatgctg

SEQ ID NO: 67352 - DNA, 68 bp, Mus musculus
gttctttcatacagatttatttttatatgcattggtggtttgctgcatgtgtgtctgtgtgagggtac

SEQ ID NO: 67353 - DNA, 95 bp, Mus musculus
ggtcatgtgtaacctccatctctgtcaccctgtcactttgttcataggcccattggacaatggcagggatggctggagaaagaggttgactgtcc

SEQ ID NO: 67354 - DNA, 107 bp, Mus musculus
agttcaaggctaaccttggtaacttaggagactctaattttaaaaattgaaaactgattttttttttttgagacatggtctcatgtaattcagactagcctagaact

SEQ ID NO: 67355 - DNA, 93 bp, Mus musculus
gattctgcttcagcttccaaagggctgggagtacgggtgtttactgccatgcctggctccctttatcccttcctggtgactgaatcctgggtt

SEQ ID NO: 67356 - DNA, 70 bp, Mus musculus
tggtttctgggctggagagatggctcagcggtttaaaacactgactgctcttccagaggtcctgagttca

SEQ ID NO: 67357 - DNA, 90 bp, Mus musculus
tatgtatatacacatatacatacatgtgtatatatatgtatatgtgtatatatgcatatatatacatatatatgtatatatatatacata

SEQ ID NO: 67358 - DNA, 116 bp, Mus musculus
tctttgtcatcctgttataaaatacctccccttatttatgaatatgcatgtatatatttctatacataatctttctatgggttaagtgagtagaagataagaggacagggcagagg

SEQ ID NO: 67359 - DNA, 110 bp, Mus musculus
tgcaagcactctaccattgaactacatctccagcttttgaacttcctttaagaatatttattttaccttcagttgtgtgtatgtggggggatgtacacaggagtgtagca

SEQ ID NO: 67360 - DNA, 110 bp, Mus musculus
ctgggtgtgtgattggtgtgtgatccagactagagagagaactcagtgggaagagatatttgccacaaagctctgttacctgagttggatcccggaacccacatgctagg

SEQ ID NO: 67361 - DNA, 65 bp, Mus musculus
acagaacagaacgggaggttggcaggtgtgtatgtgtgcgtgtgtctgtctgtctgtctgtctgt

SEQ ID NO: 67362 - DNA, 76 bp, Mus musculus
cagagagacacagagagacagagagagtcagagtttatgaggccctgacttttctggaactcacatgactattttg

SEQ ID NO: 67363 - DNA, 121 bp, Mus musculus
cctgacaggatttgttttcttcctatctttcctgcagccgttaggtgtctggccctctgactttggcagggaggggactgaaggacagggacagatgccaatataccatgtgaggatgcag

SEQ ID NO: 67364 - DNA, 70 bp, Mus musculus
gatatatatatatacatatacgtgtatatatcatacatatatatatatgtatggtgtatatgtatatatc

SEQ ID NO: 67365 - DNA, 78 bp, Mus musculus
ccacgtggattcaaaggtgacaccactagctgtacaattttgagccagtgggtcgctctgtgcctctgaatcccttgg

SEQ ID NO: 67366 - DNA, 111 bp, Mus musculus
gtccccagacacaaagaatggtactggggttggagagatggctcagcggttaagagcactgactgctcttccagaggtcttgagttcaatccccagcaaccacatggtggc

SEQ ID NO: 67367 - DNA, 96 bp, Mus musculus
tggcattttcaggagcctggatgggacttgacagtgagctgacttggggtcagaaagacaaatgctgcatgttcttatgggtgaccttagctgcca

SEQ ID NO: 67368 - DNA, 150 bp, Mus musculus
tatgtatgtacgtatgtatttgtatgtatgcatgcatgcatatgtatgtatgtatctatgtatattatgtatgtatgtatgtatgtatgtgtatctgtgtgtgctatgtatgtgtatatgtatgtatgcatgcatatatgtgcattgtat

SEQ ID NO: 67369 - DNA, 82 bp, Mus musculus
ggacacattgcctcccagggttcaaagtgtgcagagggctggtgctcttgctcactctgggtctcactctgggtctgggtct

SEQ ID NO: 67370 - DNA, 68 bp, Mus musculus
gtatgtatgtatgtatgtatgtatgtatgtgcagatgtatttatatatgtacacatatatgtatgtat

SEQ ID NO: 67371 - DNA, 91 bp, Mus musculus
tctgtctgactgtctgtctgtctgtcttgtatgtgcctacatgagtccgtgtacaccatgtgcatgtaggtggcccacagaagtcagggga

SEQ ID NO: 67372 - DNA, 81 bp, Mus musculus
gtctgtgtgtctgtctgtgcgtaaggcagggtcttactctgtagctcttagcctggaacacactatatggactatgctgac

SEQ ID NO: 67373 - DNA, 91 bp, Mus musculus
ggagttcttgtgacattcagcagttactggatgccggttgcatgccggattctgtccatttgatttcactgatttatctcatccgatcttc

SEQ ID NO: 67374 - DNA, 76 bp, Mus musculus
agcagtgtgtctgtgtgtctgtccttggaggatgtgtgtcctggatcatgggagggaccctggacagcacaaagct

SEQ ID NO: 67375 - DNA, 65 bp, Mus musculus
tcagactagggctggagagatggcttggtggttaagagcactgactgctcttccagaggttctga

SEQ ID NO: 67376 - DNA, 86 bp, Mus musculus
ggtatgtatgtatgtatgtatgtgtatatatatatatatatatatatatatatatatatatatatatatatatatatatatatagt

SEQ ID NO: 67377 - DNA, 85 bp, Mus musculus
ctcaaacacacagtggctctctgtcagcgtgaatgaaaacccttttggattttgtttgatgactccattgggtgaccattttgag

SEQ ID NO: 67378 - DNA, 117 bp, Mus musculus
ctgggcgcttggaagtgtttctgtgtcagctgaactgatcactgtctgtcactctttatgctcgtgggacatgctgccatgatcagttttcaatattgagtcattcccgtattccag

SEQ ID NO: 67379 - DNA, 72 bp, Mus musculus
tagaaagaagcctgtctttagagtgtcagtgacacacccacactctgaagcccatcccaattctgctttcta

SEQ ID NO: 67380 - DNA, 91 bp, Mus musculus
tttttaaggatttatttttgatcatgtatatatgtatacatgtatgtgtttttatgtgaatgtctaacatgtgtgtggatgtccttagagg

SEQ ID NO: 67381 - DNA, 115 bp, Mus musculus
ggtaattccagccaattgctatcggcacaggatgaaataaggagccacaacgtcaaactgattttttattcatattcactccttccatagacgcaagcagagggctcgaggcact

SEQ ID NO: 67382 - DNA, 100 bp, Mus musculus
acacacacataagaaattgtcaggctggacagatggctcagtggttaagaggactggctgctcttccagaggacctggtttcaattcctagcacgtctgt

SEQ ID NO: 67383 - DNA, 69 bp, Mus musculus
gctgcagtttctgctcagcctctctcccactgtttggctaaacaggagtggcaggcagtctggctcagc

SEQ ID NO: 67384 - DNA, 80 bp, Mus musculus
gaggggggacctaactgaaggaaagaggtcactagagctgtctatcactctgactccttcctgtattaccctctgctctc

SEQ ID NO: 67385 - DNA, 70 bp, Mus musculus
acttagagagagacagacagacagacagacagacagactgactgactgactgactgaggcttagctgagt

SEQ ID NO: 67386 - DNA, 91 bp, Mus musculus
ggttattggggacatgctttcagaggtgctctctggtccccagttccctctctgactgactctggcacccatgatgtgaatctcctctacc

SEQ ID NO: 67387 - DNA, 121 bp, Mus musculus
cctggcttttttcctttgcctcaagagcagtgggactagcagcctgcctgcctgcctgcctcctgcctgcgggtgagcttgctgcagcccactgggctggcacttggccctggatgccagg

SEQ ID NO: 67388 - DNA, 77 bp, Mus musculus
gtgtgtgtgcatgtgcatgtgaattctgtgcatgtgagtgtatgtgagtatgagtgtatgtgtgaatgtgtgtgcat

SEQ ID NO: 67389 - DNA, 68 bp, Mus musculus
gtatgtatgtatgtatgtatgtatatgtgtgaatctgtgtgtatttatgtgtgtacatatgtatgtat

SEQ ID NO: 67390 - DNA, 76 bp, Mus musculus
ggagaagacggcgtctgtctttctgtgactggcttaatttatttaatgtcactagctcgggctgcctccattttcc

SEQ ID NO: 67391 - DNA, 87 bp, Mus musculus
gtgtgcatgtgtgcatgtgtgtgtagacctagtacatatatatatatatatgcacatgtatatacacacacacacacacacacacac

SEQ ID NO: 67392 - DNA, 149 bp, Mus musculus
gcactgccaccattagtggttacagagaagccttgtggtgtttgtttctgagcctctcttgtgtgtgtgtgtgtgtgtgtgtgtgtatatacatgtgcatatatatatatatatgtactaggtctacacacacatgcacacatgcacac

SEQ ID NO: 67393 - DNA, 122 bp, Mus musculus
ggatagtctccgagggcatttttctgctctgaagtttctcaggagagcaggagctgggcctgcctcgctctgtgtctggctttggaaccacagtggcagtagatgcttatccaacaaaggct

SEQ ID NO: 67394 - DNA, 102 bp, Mus musculus
gccatcagatgtcacagtggtagaataagctttccatggagggtggggaccccagagtggctgtctgtctgtctttgaggtctgattgtatgcatgggagct

SEQ ID NO: 67395 - DNA, 144 bp, Mus musculus
acatttgtgtgcatgtatgcagatgtttaagtatgtgttcttgtatgtatgtatgtatgtatacacacatgtgtctatacatgtatgtatttatgcaagtgtgtgtatgcagatatgtgtgcatgttttcatctgtgtatgtat

SEQ ID NO: 67396 - DNA, 116 bp, Mus musculus
ctctccagattcaacttctgtacatatatatatatatatatgtatatatatatatatacattatatatgcatatgtgtatatatatatatgaggcggggagggaggggagattggg

SEQ ID NO: 67397 - DNA, 76 bp, Mus musculus
gtctggcaccttggaggggaagcaattagtgacctatctcggaattcgaagagcaaagattctctctctctcagac

SEQ ID NO: 67398 - DNA, 64 bp, Mus musculus
ccacgtgtatgtgtgtctctgtgtgtgcccatgcgtacacacaaatgtatgcatatatgtgtgg

SEQ ID NO: 67399 - DNA, 73 bp, Mus musculus
gtgcgtgcgtgcgtgcatgcgtgcgtgtgtgtgtgtaggatttatatacatggatgcagtgcccgtggaagcc

SEQ ID NO: 67400 - DNA, 91 bp, Mus musculus
gtacatgtgtgtgcacatgtgtgtatccatgtgtgtgttgtatgagtatgtatgtatatatgtgtatacatgtatgtgcacatgtgtgtat

SEQ ID NO: 67401 - DNA, 116 bp, Mus musculus
gggtggtaaataacaatggtacatatatatatatatatatatatatatacatatatatatatatgtgtgtatatgtgtgtgtatatatatatatatatacacagagagagacagac

SEQ ID NO: 67402 - DNA, 181 bp, Mus musculus
gtgtgtatatatctatatatacatatatatgtatgtgtgtatatatctatatatgtatatatacatatatacacacacatatgtgtatatatacatatatacacacacacatatatgtatatatatacatatatgcacacacacatatatatgtatatatatatacaatttgtggagtttg

SEQ ID NO: 67403 - DNA, 96 bp, Mus musculus
gggcaggaaagagagaaagaaagcagaatggggctgggacccactctggctgtgtcagccttcatctctccagacttaatctactcttaaaggtcc

SEQ ID NO: 67404 - DNA, 88 bp, Mus musculus
gaggaagtttggagctgggttgtgttggaacttctggggttcctcttctctgactctatgagtctgacagagtcagaacagactcctc

SEQ ID NO: 67405 - DNA, 70 bp, Mus musculus
agctctgtcacagatggcatgggactgtgggccacttacctaatctctctgtgcctctgagtcttcagct

SEQ ID NO: 67406 - DNA, 67 bp, Mus musculus
tgtgggttactctctctcagtctctcgcgtgtgaagcagagagagagagagagctgctacacccaca

SEQ ID NO: 67407 - DNA, 59 bp, Mus musculus
gcaggaaggtagagaagggggactcgcttgtgtctctctctgactctggattttactgc

SEQ ID NO: 67408 - DNA, 63 bp, Mus musculus
tcaagctctgaccctcagactctctgagaggatggagagatggctcagtggttagagaactga

SEQ ID NO: 67409 - DNA, 92 bp, Mus musculus
gtaagctttctctgtaaagctaaggctatgacaaaatcactgaagagagagttgaaagattttaagagcctgagaaacagagtacctattgc

SEQ ID NO: 67410 - DNA, 112 bp, Mus musculus
gtgtgtgtgtatggtgtatgtgtatagtgaagtgtgtgcctctgtgtgtgtgtgtgtgtgtgtgtattgtgtgtgtatggtgcagtgtatgcctgtgtgtctgtgtgtgtat

SEQ ID NO: 67411 - DNA, 87 bp, Mus musculus
ggtgatgtgctctgtgttttctagtctgtggctctcctggccctcgctcgagagggtctcagtagacacagaggatctacaatcatc

SEQ ID NO: 67412 - DNA, 92 bp, Mus musculus
cctccagcttcaacaaactttaacagcatgtatgtatgtatgtatgtatgtatgtatgtatgtcagcttaaaaatagttcccagccaggggg

SEQ ID NO: 67413 - DNA, 114 bp, Mus musculus
gcttaacttggtgctttaaaaatatcagggacctggagagatagcttagtggttaagagcactgactgctcttacagaggacctgggttctgttctcagcacccacaaggtggc

SEQ ID NO: 67414 - DNA, 120 bp, Mus musculus
catatgtatgtatatatgtatgcatgtatatatgtgtgtgtacatgtatgtatgcatgtatatacgtatgtatatacgtatgtatgtatgtatgtatgtatgtatattcttctatagtgc

SEQ ID NO: 67415 - DNA, 98 bp, Mus musculus
caagcacacgatttcaagaaaggactcttagtggtagttcctttatgcatttgctttgtaaagttatttacttttctccttctgattttgtgcccttg

SEQ ID NO: 67416 - DNA, 81 bp, Mus musculus
tgtatgtatatacatatatgtgtatgtatgtttatatgcttttatattacatgactatgtctatagatgtgtatatataca

SEQ ID NO: 67417 - DNA, 68 bp, Mus musculus
cctgctctctctctcactctgacctccaccctgtgttccaaggaatctccagtgtagcagaaggcagg

SEQ ID NO: 67418 - DNA, 83 bp, Mus musculus
tctgagtcagcctcctgggtagtttggactacagacatgtgcctgtcctgcctcccattaaagctgcctttgctgtgcttgga

SEQ ID NO: 67419 - DNA, 88 bp, Mus musculus
ctggttccctgtgaatctgaaggtgggctgctctcttctctctgttgcacccttgtcagggaggtaaagctcaccataggaaaaccag

SEQ ID NO: 67420 - DNA, 68 bp, Mus musculus
gggtataggagacagacagacagacacacacccctaactaaggtggtgagtctgatgaagccggaccc

SEQ ID NO: 67421 - DNA, 63 bp, Mus musculus
agggtccggcttcatcagactcaccaccttagttaggggtgtgtgtctgtctgtctgtctcct

SEQ ID NO: 67422 - DNA, 107 bp, Mus musculus
agtgagtaatgagccaattccagtggtgtgagagaagacactgtgctgatctaaggattaaagagcacagcgtgtgctccacccagggtggaaaaagaaggctgact

SEQ ID NO: 67423 - DNA, 123 bp, Mus musculus
tccaggacatagcttagcctgagatattatggccacccatgtttgtgggtgacatctgtcacactcactgagaaatgtctcctcattgattggtagccagtggcttgtgtccaggagtctctg

SEQ ID NO: 67424 - DNA, 84 bp, Mus musculus
agggctgagggagcctaaccgcagctggctatgtcctctgtggaaacacagacgtgagtgagtgagtgagtgcctccctgttct

SEQ ID NO: 67425 - DNA, 56 bp, Mus musculus
atgcatatgagtatgtatatatgtataaatgtgtgtatgtgcatatgagtgtgtat

SEQ ID NO: 67426 - DNA, 56 bp, Mus musculus
taacgtgccttcgtggcagcaagagccacctctgtctgtctctgtctggcaggttg

SEQ ID NO: 67427 - DNA, 114 bp, Mus musculus
gtgctttctgttaacactagcagctaatgaatgtgacagtgatgtaataaaaccttgatggtgtctctcactcccacagtcaacctctcagggcagcagagatcttttaagtac

SEQ ID NO: 67428 - DNA, 81 bp, Mus musculus
tggagtcacacagagtcattcttctctaccaggcctatgggacctttttgggggccttgactcactctcgctgtgattgta

SEQ ID NO: 67429 - DNA, 66 bp, Mus musculus
cccagagacagtacacagtgtcaactcaacccctgaggtggcattgtgctcctattctgccttggg

SEQ ID NO: 67430 - DNA, 168 bp, Mus musculus
gctgctggggagtatgtgcacacaggcatatgtgtgtgtgtgtgtgcctgcctgcatgtgtgtgtatctctgtgtgtgcatgtatgtatatttatgtatgaatgcatgtgtgtgcatgtgtttgtgtgtagggggtgtgcctgtgtgtgtgctggcaggtgcgtatgc

SEQ ID NO: 67431 - DNA, 88 bp, Mus musculus
tttcatctacagtaaaacatttttattaggaatctatgtttttaattaaacagaacatttaattaaggtgctttttaagtgggtgaaa

SEQ ID NO: 67432 - DNA, 112 bp, Mus musculus
gggaagggctctcccctggagaggagaggacagagtggaggtcagaggacaactttgtggggtcagttctctccgtccacctctgcgttctgggatattggagtcgcatcgc

SEQ ID NO: 67433 - DNA, 129 bp, Mus musculus
tatatatatgtatacatttaagtatatattgcatatatacatatatacatatatgtatatatgtatatatgtatatatatgtatatatacatatatgtatatatattgcatatatacatatatgtgtgt

SEQ ID NO: 67434 - DNA, 72 bp, Mus musculus
ctgtaacaggattctatgactctgtatggggccactgttgctctgaagagactctgggactctgtgagatgg

SEQ ID NO: 67435 - DNA, 68 bp, Mus musculus
gtatatgtatttgtatgtgttcttatgcacatatgtgtgtgcatatgtatgcatatgtgtgtgtgtac

SEQ ID NO: 67436 - DNA, 81 bp, Mus musculus
tcatgagatttcactgccacatgagtcagggccagagacactgtctcactgtgcttcctattgctgtgacaaacaccatga

SEQ ID NO: 67437 - DNA, 79 bp, Mus musculus
ggggctctatgtgcatgtacatgtgtatgtactgggtgcaagtttgcttagctgctaaccacgtgcatgcatgagcatc

SEQ ID NO: 67438 - DNA, 68 bp, Mus musculus
ctgtttctgtcacttgctctctgtctttcattagggcagcggaggagggggagcaggagagggagggg

SEQ ID NO: 67439 - DNA, 71 bp, Mus musculus
tcttgcattgccatgggacagtcaggtcatcttcccgaggacacagcctctctgcctctgagaatgagagg

SEQ ID NO: 67440 - DNA, 199 bp, Mus musculus
tatagtattatgttttgccatatatataatatatgtgtgtgtatttatgtgtatatttacacataaatgtatatgtacatatattgtgtatatataaacatgtgtttatatatacataaaaatatacacacatataaaatgtatgtatatatatacataaatgtatatgtatttatgtatataaacatatgtgttatat

SEQ ID NO: 67441 - DNA, 76 bp, Mus musculus
gcaggcaccaaactgatagctcatactaactagcatagcagcagtgttctgtaattctgtctgtctgtctgcctgc

SEQ ID NO: 67442 - DNA, 73 bp, Mus musculus
ttcctggtatttctattgtctgtttcttattattttttgtgatgaggacaggttccagaggaggactatggaa

SEQ ID NO: 67443 - DNA, 101 bp, Mus musculus
gatgcttctgatgggggctggagagatggctcagtggttaagagcactgactgctcttccatagattctgagttcaattcctagtaaccacacggtggctc

SEQ ID NO: 67444 - DNA, 64 bp, Mus musculus
gcatgcatgtacatttgtgcatacatatgtgcatgtgtgtgtatgtgtgtctgtatgtgtgtgt

SEQ ID NO: 67445 - DNA, 90 bp, Mus musculus
cagctgggatgctggccaaatattctgggcaacagaagaaacaaaaatcttcctctcttgtctgtcagagtcagtcagccctctggagtg

SEQ ID NO: 67446 - DNA, 103 bp, Mus musculus
ggagaccacagaccagagcccaggaagtgaaaagacagtgtgcagactgctgagctcacagagcaggtgcgtgccctcctcctcctccttctcctctttctcc

SEQ ID NO: 67447 - DNA, 107 bp, Mus musculus
ttccggcttcctggccaccacagggaggaggcacctgctgagagtctggacactgcctgccctgactttcatcagagccttttcttgtggcctcttcagacctggaa

SEQ ID NO: 67448 - DNA, 213 bp, Mus musculus
atagatatactccatatatatgtgtgtatacatctgtatatatatgtatgtgtgtatgcttagtgtgtatatatatacggtgtatatctatatctatctatagtatatatatatatgtatgtatatatatatactatatatgtgtatatatatctgtgtatatatatatatatgtatgtgtgtatgcttagtatataatatatatattataga

SEQ ID NO: 67449 - DNA, 86 bp, Mus musculus
atgtatatatgtatgtatgtgtatgaatatatatatatacatgtgtatatatgtatatatatatatgtatgtatatatatatatat

SEQ ID NO: 67450 - DNA, 114 bp, Mus musculus
atatacatgtatatacactgatatatatgtgtatatgtatatatatacatatatatgtgtgtgtgtgtgtgtgtgtgtgtgtatgtgtatatatatgtatacacacacacatat

SEQ ID NO: 67451 - DNA, 64 bp, Mus musculus
cacactgtcagtccctcacagctgctcccagaggcttctgggtagagatgaagctgagagagtg

SEQ ID NO: 67452 - DNA, 115 bp, Mus musculus
atgtgtatatgtgtatgtatgtgtatatgtatatatgtgtatgtatacatatatacatatatgtatatgcatgtatgcgtgtatgtgtatgcatatatgtacacatacagacaca

SEQ ID NO: 67453 - DNA, 93 bp, Mus musculus
tattagctttgtgtgtatgtatgtacatgctcacatgtgtgtgcacatatgtgtgtgtgcatgtgcatgcatgtgaggaagacagggatgatg

SEQ ID NO: 67454 - DNA, 99 bp, Mus musculus
ccagctccttcgtctcttccacaccgagcctgtgagaaccgagagtgctccacggaatcttggacagttacaggaggttagaacaggaagaggagttgg

SEQ ID NO: 67455 - DNA, 138 bp, Mus musculus
aggagggtgtcttcgccttgggatggcttctgagagtttaaaggctgaagccaagacctccttgctctctctgactcactcttccctcccaaaaatacaaagatcatggaggtggaatggaggacagggagagacaag

SEQ ID NO: 67456 - DNA, 83 bp, Mus musculus
ggcctttctttcgtctctcactcagtatctgtctattgcagctgcccctgtgaggcagaggaagtgaacaccaaaaaaggacc

SEQ ID NO: 67457 - DNA, 83 bp, Mus musculus
ggccttcaagtgtctctgaggttgttctatttcatgaaaattaaggacaaggattcatgggagagaagtctaggcagaaggcc

SEQ ID NO: 67458 - DNA, 108 bp, Mus musculus
accttgggcatcactctgccccatcagcgtctcagagtctctctaaatgagctaaagatagccagcggcggggctggaggacatggtgaggtgatgtctgcccagtgt

SEQ ID NO: 67459 - DNA, 80 bp, Mus musculus
cgcagagggttgacggacagtgtaaggcctcttcttccctttggacatgtagaacctctgtctgtctgtctctctctgtg

SEQ ID NO: 67460 - DNA, 65 bp, Mus musculus
gctctctccgtctctctctagctggctaaaattagagcctccatccaggagggggcggggaaagc

SEQ ID NO: 67461 - DNA, 61 bp, Mus musculus
tatgtatgtgcatatgtgtgtatatgtatgtttgcatgtatgtatgtgtgtactgtggatg

SEQ ID NO: 67462 - DNA, 112 bp, Mus musculus
tgtgtgcatgtgtgtattatgtgtgtatatatgtatgtttgtatgtatgtgtgtttgtgggcatgtccttatataatgtgtatgtatgtgtatgtatgtatgtatgtatgta

SEQ ID NO: 67463 - DNA, 75 bp, Mus musculus
ccagccagctctgtctgtctgtccttcccgctcactcacctcacccaaaaggaaagcacccatgggctgccctgg

SEQ ID NO: 67464 - DNA, 85 bp, Mus musculus
ttccctggagaatgcagcataaggagacctgggtcctggtttgggggctcagagtcactctctggttctgctgttcattctggaa

SEQ ID NO: 67465 - DNA, 59 bp, Mus musculus
aggaggctgagtgtgaatatagaccacgtgtgtgtctgtgtcacaccaaagtctgtcct

SEQ ID NO: 67466 - DNA, 78 bp, Mus musculus
gtgatgggactgctgtggatgcagctgtaactgccttgcctggggctgttccagtcactcactcactcactcactcac

SEQ ID NO: 67467 - DNA, 69 bp, Mus musculus
gtggaaagtgtttctgtctgtctgtctgtctggtcacagagcttgcaggagaagggtgtctcttttgac

SEQ ID NO: 67468 - DNA, 115 bp, Mus musculus
gcacccttgcaagggccaggcacgatagagcacacttgattgcatgcctgtgtggatttgcatgtgcatctgtgtttctgcatgcagccatatgtatgctcattctgtggtgtgc

SEQ ID NO: 67469 - DNA, 117 bp, Mus musculus
gtgcatatgcatgtgtgcatgtgcatgatgtgtctatgtatgtatgtatgtatatgtatgatgtgttcgcacatgtgtacatgtgtacatcctacacacttgtacatgtgtctgtat

SEQ ID NO: 67470 - DNA, 81 bp, Mus musculus
gatgtcatcagagagaccggaatagaattgcggagggattagctctgaccctgtgtgactcgctgccatctctgacacctc

SEQ ID NO: 67471 - DNA, 118 bp, Mus musculus
caccataaccaaggcagtttataagagaaaggttttatttggcctcacagttccagagagaagagtctgtggtggtttgaatgtgcttgacctagggagtagcactattgggaggtgg

SEQ ID NO: 67472 - DNA, 87 bp, Mus musculus
atgtatgtctattaattgtgcatgtaattacatgtgtatatgtgtgtgggtgcatgtatacatgtatgtagttgtgcacacatatgt

SEQ ID NO: 67473 - DNA, 77 bp, Mus musculus
gagggcctggtttgggactggcaagcggtgtgtcatctccctgtgcacattgtgtctgagtcactgtacatgtcctt

SEQ ID NO: 67474 - DNA, 107 bp, Mus musculus
tcagcattagtcatatggctcccaggctggactgaagccagagcagggtttagtgactgttgtgaatttgttgttctcttaattgtcccctctggggggcgctgtgg

SEQ ID NO: 67475 - DNA, 65 bp, Mus musculus
ggaccatgtgggagggtcaggcaggaggccaggccttgctctgttctgagcctctgtgtgtgtcc

SEQ ID NO: 67476 - DNA, 61 bp, Mus musculus
gggctgagaatgcaggcaggatgacagcgatccactgtccctctttgccactctcaaaacc

SEQ ID NO: 67477 - DNA, 132 bp, Mus musculus
tcactgaggtgggctgtgaggtttctggccctttgtcatctgccttattgtgttaagttccctctgtcgctgtgactgtgcctctcacctctgattcccattctgatgcctgggtgagcagcaggggacagc

SEQ ID NO: 67478 - DNA, 154 bp, Mus musculus
catgtgtatgtgtgtgcacatgtgcatgtgcatgtttgtgtgtgtgtgtgtgcatttgcatgtgcccatatgtgtatgagtatgtgcatgtgtgtatatgtgtgtgtacatgtatgtgtgcatgtgtatatatgtatgcacaggtcagagcaca

SEQ ID NO: 67479 - DNA, 84 bp, Mus musculus
ggaacagatcctgaaaggctgagaacagaggtccagggcacctgcctgtttctggttctgttttttttttttttttttttttcc

SEQ ID NO: 67480 - DNA, 60 bp, Mus musculus
gcctcagacaagcggtctggtctctctgagtctcagttatctgcttgttaaactgcaggc

SEQ ID NO: 67481 - DNA, 81 bp, Mus musculus
cctgtggccattggggggggggggtgtcattctgtggcgactctcgagggtcactctccatctctctgagctcctgtcagg

SEQ ID NO: 67482 - DNA, 72 bp, Mus musculus
ggtgttttgcctgcctgtgtgcctgtgtgctatgtttatgcctggtgccagtggaggccagaagagggcgcc

SEQ ID NO: 67483 - DNA, 80 bp, Mus musculus
gaaagcagtctggaggactagagaggtggctcaggggttaagagcattcactgctcttccagaggtcctgagttcaaatc

SEQ ID NO: 67484 - DNA, 77 bp, Mus musculus
cagtgtatctgtctgactctccccgcctgggtaaataagtgctgtcagcctcgagggagcacggggaggcagagctg

SEQ ID NO: 67485 - DNA, 61 bp, Mus musculus
gactactgtagtgagctcactccactgtctcagactgactgtagcgagctcactccacgtc

SEQ ID NO: 67486 - DNA, 82 bp, Mus musculus
gagtatcatagacattcatatgcatagcaaatttctgtgctgtgacattctggcatagctgtgtctgtgactgtgtgtgctc

SEQ ID NO: 67487 - DNA, 87 bp, Mus musculus
cagtgcaagttcctgctgtctgtctgtctgtctgtctgcctcaagtgcaggcagtgatttatttttatgtgtctgggtgtttggctg

SEQ ID NO: 67488 - DNA, 79 bp, Mus musculus
gctgcacaagatgagcgggtgtttgagacactctgagtgacgtctgtcatcttcaccagcatctcgagcagcgtcttca

SEQ ID NO: 67489 - DNA, 98 bp, Mus musculus
tggttacattgtgagtttgagccaatgggcctatctaaaccctgccccaggaaactgaagagagactggtgtgtgggctcggagggagagtgtatcca

SEQ ID NO: 67490 - DNA, 117 bp, Mus musculus
acagaagtttcctgatggaggctggagagatggctcagtggttaagagcactgactgctcttccagaggtcctgagttcaaatcccagcagccacatggtagctcacagccatctgt

SEQ ID NO: 67491 - DNA, 71 bp, Mus musculus
accaatattgggcctctctcaccctctctgtaaggaaggacagggcagtgaggtgggccagcaggtaaagg

SEQ ID NO: 67492 - DNA, 86 bp, Mus musculus
gtcacagggtaccaagttcagatcacagtgtgcacaaccttgagccctggctgggtcactgttgccagcgtggtactttctgtgtc

SEQ ID NO: 67493 - DNA, 88 bp, Mus musculus
ggagatctgaggtatgtgtgtctgtgactctgaaggatggaagcttgctccagatcgctatgcacactcagcatggttcagatcatct

SEQ ID NO: 67494 - DNA, 72 bp, Mus musculus
gaatgtgtccagggctggagagatggctcagtggttaagggcactgactgctcttccagaggtcttgagttc

SEQ ID NO: 67495 - DNA, 89 bp, Mus musculus
catacctgacacaaaaaatcaaatgggcagaagtgggtattttggcaaacagttcactggaatatagtctgtcatgaaaggaaggtatg

SEQ ID NO: 67496 - DNA, 116 bp, Mus musculus
tacatgggtgtatccaggtacatgtatgtctgtgtacatgtgtgtatccatgtgcatgtatgtgcatgtccatgtgcacgcatgtatctgtgtgtgtgcctgtgtgcacatgtgta

SEQ ID NO: 67497 - DNA, 63 bp, Mus musculus
cataccctctgtgagtcagacattccgtgcagctcagtcacgttgtctagctcggagcctgtg

SEQ ID NO: 67498 - DNA, 105 bp, Mus musculus
gaaaatactcctgactttagatctaggaaacaataaagttaatcaggtttggttttccaggactgtattttatgatttactggatgaagtaatagttatattttt

SEQ ID NO: 67499 - DNA, 77 bp, Mus musculus
cctgagggttcagcagttaggctaggctagctggccagtagccccagagagcctctgtctgtctcctaggcccaagg

SEQ ID NO: 67500 - DNA, 75 bp, Mus musculus
gaagttcagtacatgggctggagggatggctcagcggttaagagcactgactgctcttccagaggtcctgagttc

SEQ ID NO: 67501 - DNA, 58 bp, Mus musculus
gggtgcctggctgcctgatttgctgtaatgtgtttcagcagatcgtgactcatcaccc

SEQ ID NO: 67502 - DNA, 70 bp, Mus musculus
tacataagtgtttgaatgtgtatgcatttatgtatatctgtgagtgtatgtgcatgtgcatgcttatgtg

SEQ ID NO: 67503 - DNA, 74 bp, Mus musculus
atacatacatacatacatacacacatatgtatacatgtatatatgtatatgcatgtgtgtatatgtatatgtat

SEQ ID NO: 67504 - DNA, 91 bp, Mus musculus
gttattgtggggctggaaagatggctcagcggttaagagcactgacagctcttccagaggtcctgagttcaattcccagcaaccacatggc

SEQ ID NO: 67505 - DNA, 112 bp, Mus musculus
ggtggagtgcattcagccagcctcctttttctgtcagagcatgtggaactgaactccagggctgccgtctgcctttgaagatgttgtgactcggtttgtatatttttctact

SEQ ID NO: 67506 - DNA, 91 bp, Mus musculus
tgcatatatctgtgtgcatgtgcatgcatatatgtgtatgtgtgtatgtatgtatatgtgcgtatatgtgtatatgtgtgtgtgtatgtat

SEQ ID NO: 67507 - DNA, 68 bp, Mus musculus
gcgtgtgtgcgtgtgcatgcgtatgtgtgcgtgcatgtgtgtgtctgcgtgtgtgtgtgtgtgtgtgt

SEQ ID NO: 67508 - DNA, 93 bp, Mus musculus
ctcatgaatgggcaagcctgaggagacttcactgtctctgtccctttccggggcacactgactctgtctcctccaggactccaggcattcgag

SEQ ID NO: 67509 - DNA, 82 bp, Mus musculus
cagggctgagcacagcagtgtgccatggacagagtcctgacgtcccaggctctgtgtgtgtctaactctgagagtttccttg

SEQ ID NO: 67510 - DNA, 112 bp, Mus musculus
gactataatacttttgtgtgtgcctgtgaatcttgactggacttagctgctgggtgactgctgactgtcacactctgtcacaggcctggcattaaaaagacaaaggttagtc

SEQ ID NO: 67511 - DNA, 84 bp, Mus musculus
acagacagacacacacacacacagagagagaaaaagacagagagatagagtctgtgcctgtgtctgtgtctgtgtgtgcctgtg

SEQ ID NO: 67512 - DNA, 78 bp, Mus musculus
gggtgaggtcacctcaagctgctgcctggaacaagctttctcacctgaagcggctctgccactgacagacacacaccc

SEQ ID NO: 67513 - DNA, 63 bp, Mus musculus
ggcccctgactgtctgccactgtccgtctctagcccacccacggtgtctcacagtctggggcc

SEQ ID NO: 67514 - DNA, 84 bp, Mus musculus
gttcattcgcctgtcagtctctgtgcttgtgcgatgacagagtgcagaacctgtctgcctagcccagggagtggcctcggggac

SEQ ID NO: 67515 - DNA, 109 bp, Mus musculus
ctggtgacaccaagtgaaagcaaaggcatggctgtggtgaccacgacactggatatgtctagagtttttgttggtctctggctagatgttcctgttctgtgctgtccta

SEQ ID NO: 67516 - DNA, 106 bp, Mus musculus
gtggatacaaccttcctgatgagcagccttctagtctcagtctccacacttcagttctaaactgttgtgaagttgttgttcagttaaaaattgttgttgtatgtat

SEQ ID NO: 67517 - DNA, 117 bp, Mus musculus
gtgatagagaagccatctgtgtagaaacttcattgattgattgattgattgattgattcattcattcactcactcactcactcattctttcattcacctagcatttcttctgatctc

SEQ ID NO: 67518 - DNA, 87 bp, Mus musculus
cttaatttctgtgtgtgtctctgtgtatgtatctgtgcatgtatgtgcatgtgcatgtgcgccacagtgtatacgtggaggtcagag

SEQ ID NO: 67519 - DNA, 94 bp, Mus musculus
tgtcccactttataggagcagtaaccctctatccttaacacagtgaccacacagagtttggagccatggctgttgctgggcaaaggttgtggat

SEQ ID NO: 67520 - DNA, 90 bp, Mus musculus
gtgtacgtgggtgagtgggtgtgtatatgtgtacacatgtgtgtatttatatatgtgtccatgtgtatgcacatgtatgtccatgtgtgt

SEQ ID NO: 67521 - DNA, 106 bp, Mus musculus
tatatgtatgagtatcaagcaggcgcgcgcgcatgtgtgtgtgtgtgtgtgtgtatgtgtatatgtatgtgtgtatatgtgtatgtgtgtacatgtatgtatatat

SEQ ID NO: 67522 - DNA, 78 bp, Mus musculus
gtatatgtatgtatgtatgtatgtatgtatgtatgtgtgtgtataggtgtatatatatgcatgtgtaagtatgtatgc

SEQ ID NO: 67523 - DNA, 105 bp, Mus musculus
cacttccccagcgtcaggtcctccagtgctccttactctgagagtctctcacattagctgtgaggaaatcaagagttacattgatgacaactgctcctgagagtg

SEQ ID NO: 67524 - DNA, 64 bp, Mus musculus
tgtctgtgtctgtgtctgtgtccgtgtctgtctgcaggaggggtttgcaggtgtggccttggca

SEQ ID NO: 67525 - DNA, 78 bp, Mus musculus
ctgaccacgcagatggaaaataagcagttgctcagctcccctgaggcgtctgtctgtctgtccatgcagcgttggcag

SEQ ID NO: 67526 - DNA, 118 bp, Mus musculus
cttcatccgtttgctggtgcactcagcaagtactcaagactcagattctgtgctcagtgtcaggacacagtgaggaggaagctctctgtccccatggggctcagaatataatcaggag

SEQ ID NO: 67527 - DNA, 83 bp, Mus musculus
gtggaaggctttagttatgcttggactcctgatgaatgatccttactgggtccctgaatgccaaactttctgccatatttcac

SEQ ID NO: 67528 - DNA, 131 bp, Mus musculus
cctagactctcacacattagttaggggctctaccagtgagctagatcttcagtcccatgagaggatttttcagtggccaaagctactgtgatggatgagtctcataggaaaatacattgtagctcagtcct

SEQ ID NO: 67529 - DNA, 85 bp, Mus musculus
tgacaaatggttgttttcggttactgtttcattgtttttattacacagtaagacctatagagaggccgaggaaatggccccgtca

SEQ ID NO: 67530 - DNA, 65 bp, Mus musculus
ttgtgttccagggtctgtgagtctctcttaaatcagggaggaggggcccacagtcctggagacag

SEQ ID NO: 67531 - DNA, 115 bp, Mus musculus
gatgactcctgattatttttatttccctggtgtcatggttttggtcagttctctctcactttcaataatactgacctgtgtcaccaaaggggacttttaggtatgacagagcatt

SEQ ID NO: 67532 - DNA, 69 bp, Mus musculus
gcatgaggaaaattggtctctgtatccctgtagctctccaagtcaaggggcagaccaagaagtctgggc

SEQ ID NO: 67533 - DNA, 92 bp, Mus musculus
gtctgtctgtctgtctgtctgtgtctctccattttttccccatctgagagttttattctcctgtgaagtggtggaaagtggacagtggtggc

SEQ ID NO: 67534 - DNA, 60 bp, Mus musculus
tacctttgagatatatacatatgtgtatacatatgtgtatatatatatatctcaaaggta

SEQ ID NO: 67535 - DNA, 77 bp, Mus musculus
tggatgttctagatccgtatgtgatgtggcatggtatttcacacagtcttcacacacacggtctctgacagaaacca

SEQ ID NO: 67536 - DNA, 105 bp, Mus musculus
taagaaagctgatgtggggctggagaaatggctcagtggttaagagcactgactgctcttccagaggtcatgagttcaattcccagcaaccacatggtggcttgc

SEQ ID NO: 67537 - DNA, 90 bp, Mus musculus
tttcttagaagttactgttgaatctggctttgaggggagcaaagggatttgacggttctgagaagttagagactacacaggtgtgcttct

SEQ ID NO: 67538 - DNA, 58 bp, Mus musculus
tgtctgtctgtctgtctgtctgtaggggctacctctcagggaggataggtaggctaca

SEQ ID NO: 67539 - DNA, 113 bp, Mus musculus
ggttagaaagtgccttccatggtgctggagagatggctcagcaattaagagcactgactgctcttccagaggccctgatttcaattcccagcggcacatggtggctcacaacc

SEQ ID NO: 67540 - DNA, 102 bp, Mus musculus
gatctacatatttgggggctggagagatggctcagtggttaggagcactgactgctcttccagaggtcctgagatcaattcccagcaaccacatggtggctc

SEQ ID NO: 67541 - DNA, 111 bp, Mus musculus
gagttacccatgtcttagcaagaacacagggagagatggcttagcggtttagagcactgactgctcttccagaggtcctgagttcaattctcagcaaccacatggtggctc

SEQ ID NO: 67542 - DNA, 150 bp, Mus musculus
gccagtgctcctaactgctgagccatgactccagctctccaaataaatatatttttaaaaaataataatataagggggctggagagatggctcagcggttaagagcactcactgctcttccagaggtcctgagttcaattcccagcaacc

SEQ ID NO: 67543 - DNA, 119 bp, Mus musculus
gttgtttgcattaaaatttttaccttggagctagagagatggctcagcggttaagagcactcactgctcttccaaaggtcctgagttcaattcccagcaaccacatggtgactcacaac

SEQ ID NO: 67544 - DNA, 85 bp, Mus musculus
tggctgggattggatcgtgaccataatgtcagattttatatatttatatcggatccaacatgaggatctgattcactctaggtca

SEQ ID NO: 67545 - DNA, 73 bp, Mus musculus
ctgccgacctcaccctccgccttcaattttccttgggataagtgaagatgagagcagactgagaggagagcag

SEQ ID NO: 67546 - DNA, 61 bp, Mus musculus
acatacatatatgcatatatacacatacactacacacatgtatgtatacatgtatgtatgt

SEQ ID NO: 67547 - DNA, 96 bp, Mus musculus
gatcagcctttgttcatggtggtctgataggatgcatgggataatttcaatatttttgtatctgttgaggccttttttgtgaccaattatatggtc

SEQ ID NO: 67548 - DNA, 87 bp, Mus musculus
ccaggacattgccttctgttgtctgttcacacaactcagatcattctagtctgagtcctgtctatagcaacatgattcaggacctgg

SEQ ID NO: 67549 - DNA, 85 bp, Mus musculus; identical to SEQ ID NO: 57470

SEQ ID NO: 67550 - DNA, 89 bp, Mus musculus
ggccacttgagggctccttaaccagaatatctaagtgtattctcaagtatatttaattatcaattgggtcattgtgctttctaggggtt

SEQ ID NO: 67551 - DNA, 84 bp, Mus musculus
gtgggccctcaagaagaagcaatatgagacccacatgactatatgtcaggtgcctccagcattgtcacttactctctgtcacac

SEQ ID NO: 67552 - DNA, 120 bp, Mus musculus
catgtttgtgcatacacatatatacaaatatgtttgggtatatattgtgtatgtatatgtacatgtatatacatatacatgtgtgtgtatgtgtgtgtatttaatagatattatatccca

SEQ ID NO: 67553 - DNA, 106 bp, Mus musculus
accttagtccatggtgatctgataggatgcatgggacaatttcaatatttttgtatacgttgaggcttgttttgtgaccaattatgtggtcaattttggagaaggt

SEQ ID NO: 67554 - DNA, 74 bp, Mus musculus
gtatgtagagggcatagctcagatccatgtaggctccatgaatgccacttcagtctctgtgagcccctatgtgc

SEQ ID NO: 67555 - DNA, 75 bp, Mus musculus
ctctgtgtgtatgtgtgtctgtgtttctgtatctcttgctctctcaatctgcagtgctagacatttataccagag

SEQ ID NO: 67556 - DNA, 110 bp, Mus musculus
tagtcctgactggcttggtatttgctgtgcagaccagactggtctcaaacttacagagttctgtctgtctctgccttcaggcgtgtgtcattatgcccagtacatcatta

SEQ ID NO: 67557 - DNA, 100 bp, Mus musculus
gccatccactctgcttcggcaggggacttgaccttttctctacaagttgtgcgaggttaaactgagagaagagactaaggtgctacagaagggtggatgc

SEQ ID NO: 67558 - DNA, 92 bp, Mus musculus
gccataaggtcataaaggtcagacataagacagagttgagaacctgctgagtgcatgggttctcaccatgtctgttttcttccttcagtggc

SEQ ID NO: 67559 - DNA, 108 bp, Mus musculus
gggtagggatttttattccatatggatttgaatggagaatctctgccactctgactctggttaggttcttcaaagtcaggtacaaaacaatgggaataactctgcacc

SEQ ID NO: 67560 - DNA, 117 bp, Mus musculus
gccaagaaaaaaaagccagtacattcaaagactttcctcgaactatgaactgtaataaaataagtatttgttcttgtctgataggtgttgggggtctatgagctaggttcttaggtc

SEQ ID NO: 67561 - DNA, 88 bp, Mus musculus
tcaaactgctaatgtatgctctctctgaggcactcagagttatgagttttcctcttagaaatgctttcattgtgtcccataagtttgg

SEQ ID NO: 67562 - DNA, 75 bp, Mus musculus
cctgaatgtatgtatgtgcatctgaatgtatgtatgtatgtatgtatgtatgtatgtatgtatgtatactcttgg

SEQ ID NO: 67563 - DNA, 98 bp, Mus musculus
gatgtgtgggattctgtgttctggctcctgctgaatggatgagggagacagaagagtctgatgtggttccaggtaggggtggaagacagagatacatt

SEQ ID NO: 67564 - DNA, 77 bp, Mus musculus
ggagtctcactgtctgtctcctgtctgtccttgcatctttccttcccagtgtgaccacagggaggcagaagtcctcc

SEQ ID NO: 67565 - DNA, 72 bp, Mus musculus
aagaacagaaacattggaacagtggctagcagttcacccctttgccctctgtctcactgtgcctgatttctt

SEQ ID NO: 67566 - DNA, 88 bp, Mus musculus
tttccacagactccagaagagggtgagagttcagacagttgtgagctaccatctgagtgctgaaaatcaaacttgagtcttctggaag

SEQ ID NO: 67567 - DNA, 112 bp, Mus musculus
aatgcttcatgatggcattacaatggtacattatgacaacacagtgctgattctgacatcagaatgctccactgtcacatcttaatgttccattgttacatcacaatacatt

SEQ ID NO: 67568 - DNA, 98 bp, Mus musculus
ggtttgggggggggtggggtgacggggccgcaggggatttgggagagaaaaaaatccagtagtgtggaatgttgtttgctatccagaccaaacaaacc

SEQ ID NO: 67569 - DNA, 107 bp, Mus musculus
gggtttcttttttcttctggacccaggcacagacagcagacagtgagggcaaactctggctaactaatgatcaagttccttggggagggaggggcataagcaagccc

SEQ ID NO: 67570 - DNA, 82 bp, Mus musculus
ttttccagcccattttgagcagagactgtcagaattcagtgttaactggaaagtaagtgtgtcagactctgcttctggaaaa

SEQ ID NO: 67571 - DNA, 129 bp, Mus musculus
atatatgtatatatatatgtctatatgtatatatatatgtgtgtatatatacatatgtatatatatgtatacatacatatacatatatacacacacatacacacatacacatatatacatatatacata

SEQ ID NO: 67572 - DNA, 66 bp, Mus musculus
gagcccaggaagacctgcaagacacataaggtctgtgtgactctgtgtgtgtcattcttcttgctc

SEQ ID NO: 67573 - DNA, 85 bp, Mus musculus; identical to SEQ ID NO: 57470

SEQ ID NO: 67574 - DNA, 115 bp, Mus musculus
cctgggtcccttgatgtttttttgtttccagggttgagtgagaggaagtgctcacctgggtgagcacacagggtccagataactatattctaggcaaggatagtcatgacctggg

SEQ ID NO: 67575 - DNA, 102 bp, Mus musculus
tgtacacagggacaatccaggatgaaggtaagatgccacatgaccctctgtcagaccagttggctgtcactctgtgcctctcctcagttctcctgatgtgca

SEQ ID NO: 67576 - DNA, 80 bp, Mus musculus
tgtctttctctctctgactggaactgtggcttcagaacgtcatggcactgtggccacacctctctgtggacagaagggca

SEQ ID NO: 67577 - DNA, 91 bp, Mus musculus
ctgcttgaaagaaacattagctatgacagttgagggtgggaggaagtctctgtcactggctcagtgtatctggcccctgcttttaggacag

SEQ ID NO: 67578 - DNA, 79 bp, Mus musculus
aggtagaggtagaggtagaaggatcagaagttcaaggtcatccttggctacattgtgaattccaagccaacctggactt

SEQ ID NO: 67579 - DNA, 85 bp, Mus musculus; identical to SEQ ID NO: 60314

SEQ ID NO: 67580 - DNA, 93 bp, Mus musculus
ctccttcctggcctaggctgggggctcaagtcctggtccatatgtatatatatatatatctttccaaggtctctcctcttggtgagtgagggg

SEQ ID NO: 67581 - DNA, 98 bp, Mus musculus
tatgcatgtgtgaatgtatgcatgtatgtatgtatgcatgtgttaatgtatgcatgtatgtatatgtatgtacgtatgcatgaatgtacgcatgtatg

SEQ ID NO: 67582 - DNA, 91 bp, Mus musculus
tattctgtctgtctgctgtctgtctgtctgttatttatctatcatcctagttgaatgagtatatgggcatgagattggaggtcagagaata

SEQ ID NO: 67583 - DNA, 93 bp, Mus musculus
accaggttgtgaataggatcggtgtgacagacagacagacaagcactcagtggtgaagctgctgctgctgctacaaaatctttacctcagggt

SEQ ID NO: 67584 - DNA, 64 bp, Mus musculus
gattttgtagcagcagcagcagcttcaccactgagtgcttgtctgtctgtctgtcacaccgatc

SEQ ID NO: 67585 - DNA, 108 bp, Mus musculus
caagacttgaatctttcagaaaacacgtgaaacctatgtgcttgttttttgtttatttatttaaacctttctggctaaattctatggttttcctgacaggttagcttg

SEQ ID NO: 67586 - DNA, 76 bp, Mus musculus
agagtgagagtaaacactggggtcacacgaacacaagcatgtggctgtgtccaggttttaaatttttctttcttct

SEQ ID NO: 67587 - DNA, 93 bp, Mus musculus
atgtatggtgttatgctatttaaggagtatactttgcatgctgaacacattgtcaatttgtatgtatttttacaggcacgtaccaccatgcat

SEQ ID NO: 67588 - DNA, 96 bp, Mus musculus
agaaaatcatggtggaattctagctttctgtctatttcactcattattggagggttctaaaagtcgagtagctgctcttctgggctatgatttttt

SEQ ID NO: 67589 - DNA, 93 bp, Mus musculus; identical to SEQ ID NO: 67583

SEQ ID NO: 67590 - DNA, 64 bp, Mus musculus; identical to SEQ ID NO: 67584

SEQ ID NO: 67591 - DNA, 85 bp, Mus musculus
ttctgtctgtctgctgtctgtctgtctgttatttatctatcatcctagttgaatgagtacatgggcatgagattggaggtcagag

SEQ ID NO: 67592 - DNA, 91 bp, Mus musculus
tattctgtctgtctgctgtctgtctgtctgttatttatctatcattctagttgaatgagtatatgggcatgagattggaggtcagagaata

SEQ ID NO: 67593 - DNA, 98 bp, Mus musculus; identical to SEQ ID NO: 67581

SEQ ID NO: 67594 - DNA, 67 bp, Mus musculus
gacactgggcaggagagatagctcagcagttaagagcactgactgctcttccagaggtcctgatgtc

SEQ ID NO: 67595 - DNA, 75 bp, Mus musculus
acacacacatatatatacatatgtatatatatatacatatatatatatatgcacattgcatatgtacatgagtgt

SEQ ID NO: 67596 - DNA, 67 bp, Mus musculus; identical to SEQ ID NO: 67594

SEQ ID NO: 67597 - DNA, 91 bp, Mus musculus; identical to SEQ ID NO: 67582

SEQ ID NO: 67598 - DNA, 93 bp, Mus musculus; identical to SEQ ID NO: 67583

SEQ ID NO: 67599 - DNA, 64 bp, Mus musculus; identical to SEQ ID NO: 67584

SEQ ID NO: 67600 - DNA, 76 bp, Mus musculus; identical to SEQ ID NO: 67586

SEQ ID NO: 67601 - DNA, 93 bp, Mus musculus; identical to SEQ ID NO: 67587

SEQ ID NO: 67602 - DNA, 75 bp, Mus musculus
tgaaaaagagactgggctggagagatagctcagcagttaagagcactgactgctcttccagaggtcctgatgtca

SEQ ID NO: 67603 - DNA, 70 bp, Mus musculus
gtgtctcagattcttcactccctccaggtatccaatggtacctatggaaggggaaaggaaattgttaaac

SEQ ID NO: 67604 - DNA, 98 bp, Mus musculus
tttctttaggtatatatgtgctcatctgaatgtttttatgtgtatagaattacacattatgcccctaaaacattgagttcagcaccaaaccttggaga

SEQ ID NO: 67605 - DNA, 67 bp, Mus musculus; identical to SEQ ID NO: 67594

SEQ ID NO: 67606 - DNA, 127 bp, Mus musculus
tgtgctgtgccttgtgtggatatgcagatactgtctagacacacgcagcacagactgagcacacatggactaagtgaatactgctcaggacagagtggtgtggtgggcttgggaaccaaggctctgc

SEQ ID NO: 67607 - DNA, 74 bp, Mus musculus
ccttgcagagactactggtgtgagtgagaagagagagccccatccctcactcttgcctcggaggctctgtttgg

SEQ ID NO: 67608 - DNA, 110 bp, Mus musculus
ctagcccctgcaatccagctagggcattttctatctgagcagagtggagagttggggctgattagtcattttgtagtggagggttgctctgtgcacagtaggttgtttag

SEQ ID NO: 67609 - DNA, 81 bp, Mus musculus
gcagcagggggttggttgtgttcccaacctgctcacagcagcacctggagagtctgggttctcactttgtctctgtcttgc

SEQ ID NO: 67610 - DNA, 96 bp, Mus musculus
gggcatttacccactacaccacctcactggccctcactttatttattgtttttgagacaaggtctgttggagttggtctggtgttgctatgtgttc

SEQ ID NO: 67611 - DNA, 109 bp, Mus musculus
gtagaatgaacagctctctcccaaggtatgtatgtatgtacgtacatatgtatgcatgtaagtatgtatgtacgtatgtacatctgaaggtaggagatagaaaaactat

SEQ ID NO: 67612 - DNA, 63 bp, Mus musculus
tctccatggtgtgcctgttgagagatgcaggctcatggagcctgtgtctctctctccgtggga

SEQ ID NO: 67613 - DNA, 104 bp, Mus musculus
gagaggggctccaggtgaggaagataccgggatgcaggctcacggagcctgtgtctctctctccgtggtgtgcctgttgagggatgcaggctcacagagcctgt

SEQ ID NO: 67614 - DNA, 134 bp, Mus musculus
cagaggtgatgagtcacagagtgggcaatttccccctttccaaaaaaaagtctgtctctcacactgtctgagcttccaggatgaggcccctttgggtcactgttgtctcctggaagcataacaaggtgtctggc

SEQ ID NO: 67615 - DNA, 92 bp, Mus musculus
ctccctcccatgtcactgtgggtctgtgtgactgtgcatcaagcaaggaggcaaacagagaaccacacagatcacaggttaggaggaggggg

SEQ ID NO: 67616 - DNA, 88 bp, Mus musculus
ccctcctcctaacctgtgatctgtgtggttctctgtttgcctccttgcttgatgcacagtcacacagacccacagtgacatgggaggg

SEQ ID NO: 67617 - DNA, 97 bp, Mus musculus
tccatgtatctatctatgcatctatgtatctatctatgtatctatctatccatccatatgtggaggggtacctgggatgttccttaaaggtcacggg

SEQ ID NO: 67618 - DNA, 75 bp, Mus musculus
cctagcatgtgggctttgccagtgggctggggcaggctgtggctcagactctgactggctgcccactctgcctgg

SEQ ID NO: 67619 - DNA, 62 bp, Mus musculus
acatatacatacatgcatacatacatatatacatatatgtatgtatgtatgtatgtatatgt

SEQ ID NO: 67620 - DNA, 66 bp, Mus musculus
aggtgagcggtgaggtggggcagactgcagagctgagcaaagagcctctctcactgggtgtcacct

SEQ ID NO: 67621 - DNA, 115 bp, Mus musculus
gtatgtgtatgtatgtatgtatgtatgtatgtatgtatgcatgtatgtatgcatgtatgtatgtacatgcatgtatgtatgtgttgtatgtgtatatacatgtatgtatgtatat

SEQ ID NO: 67622 - DNA, 74 bp, Mus musculus
ggaagcagagagtgaacagagagtgggccgtgctatcgtaactcaaggccctccctcagtgacctacctgctcc

SEQ ID NO: 67623 - DNA, 77 bp, Mus musculus
aggatttcccaggagcccccattctgagcttctgtactttgacagagaggacagtgggggcactcagacgggttcct

SEQ ID NO: 67624 - DNA, 65 bp, Mus musculus
ccgcaggatgtgaggtgctttttgggtccagactcacctctcaggcagctcctctgtctctgtgg

SEQ ID NO: 67625 - DNA, 89 bp, Mus musculus
gccactgtcatccataggttttacatatatagaactataccatgttgaggtctcatgtctgtgtgttatgactgcatgtttgtctgggt

SEQ ID NO: 67626 - DNA, 106 bp, Mus musculus
gggtaattttctgtacagtgccttacggacctaagacagaattacattgtttttgaaaatgtaaattccaagatgggtaaggaaggcattcttgtcagattcacct

SEQ ID NO: 67627 - DNA, 64 bp, Mus musculus
gcattgtatgcatgtacgtgtgtaggtatgtatacaatgtatacatgtatgtatgtatacatgc

SEQ ID NO: 67628 - DNA, 68 bp, Mus musculus
gagtcgtctgtctaacactgtgtggttctttaagctgtggagaaccctgaggtgtgggaaggattctt

SEQ ID NO: 67629 - DNA, 62 bp, Mus musculus
ccacaggggaaacacaagtacacggatgagtgagttgtctgtctgtctgtctgtctgtgtgg

SEQ ID NO: 67630 - DNA, 88 bp, Mus musculus
gcctgggtttcatctcagcctctctcagtgacatcccaaagcccaggacgagtcagagtgagcaggctcatctccctgaaaccatggc

SEQ ID NO: 67631 - DNA, 113 bp, Mus musculus
tgccatctttgtggtcttcactctgtaggactgggctgacagcacacagagcccaccttctcgggttccggtggccattagctgaggtcacgttggaggcactttacggagca

SEQ ID NO: 67632 - DNA, 77 bp, Mus musculus
gcccccaagaactgctgtgttttgtattcacaggcaaatatctaagagtatgatcacagacactctctgtggctggc

SEQ ID NO: 67633 - DNA, 73 bp, Mus musculus
gcctctgattgggaagaaggcaaaggctggcttctcgggccagccttcactgctcagtatccagaaatctagc

SEQ ID NO: 67634 - DNA, 78 bp, Mus musculus
gtctggtgagggctggggggctggggaagggttagtagctcgtctaacactgacacactctccctgtggataacagac

SEQ ID NO: 67635 - DNA, 65 bp, Mus musculus
aggatgctccctactgtgtctgtctcctggcttttagggacagtggcagtgaccatggttctcct

SEQ ID NO: 67636 - DNA, 156 bp, Mus musculus
tggggttgtctccctgccagtcccctcagccccctccccaacaggggagagagaaagagacagagagagatagagagacagagacagacagacagacagacagacagacacatagagaaaggtggtatgtgtgtgtgtgtgtgtttgcacacagtc

SEQ ID NO: 67637 - DNA, 77 bp, Mus musculus
tctgcggggaggggaggcggggccagcaggtctgccccttaggatgcctgacccgctgtctgtctcccaactataga

SEQ ID NO: 67638 - DNA, 63 bp, Mus musculus
gcatacataggacaggctaagcagtgtgtgtgtgtatctgtctgtctgtgtatctgtgtgtgc

SEQ ID NO: 67639 - DNA, 78 bp, Mus musculus
atgttttataactatgtatgtgtatatatataaatataaaagtaatatgtatgcacatatgtgtgtatatatctatat

SEQ ID NO: 67640 - DNA, 116 bp, Mus musculus
gccttagtgcatggtgatctgataggatgcatgggacaatttcaatatttttgtatctgttgagacctgttttgtaacctattatgtggtcagttttggagaaggtaccatgaggt

SEQ ID NO: 67641 - DNA, 83 bp, Mus musculus
tattcatgtatgtatgtatgtatgcatgtgtatatatgtgtgtgcatgtatatatgcatgtatgcatacatgcattatgtatg

SEQ ID NO: 67642 - DNA, 112 bp, Mus musculus
agagggctcacagattccttgctgccattccaggaagggaatggtgcttcctggctgtagtctgtgtgctctctagagccgtggcttcttctctgcagctgcccgtagctcc

SEQ ID NO: 67643 - DNA, 66 bp, Mus musculus
ggagagtctgtctgtctgtctgtccttgtcactttaaaggataagcagtaaaatgacaaactttcc

SEQ ID NO: 67644 - DNA, 92 bp, Mus musculus
gccccgtgctgcctgcctgcctgcctgcctgggagccagcactttggggcaagaggtgggtgggcaggcaggaaggcagagagtacggtggc

SEQ ID NO: 67645 - DNA, 61 bp, Mus musculus
cacacttagatacacaccattttcacttttatttatctgtgagtgtgtgtgtctgtgtctg

SEQ ID NO: 67646 - DNA, 67 bp, Mus musculus
agaagaaatgacagaggcctgggaactgatgtgcagccaccagtgcggtgtgtctgtctgtctgtct

SEQ ID NO: 67647 - DNA, 62 bp, Mus musculus
tgaccagtgagtgtgaggttaggcagggccatgtgagatcctgtctgtcagtcaatcagtca

SEQ ID NO: 67648 - DNA, 116 bp, Mus musculus
tatgctttttatgtagctcttttctcagtgctgcattctttgtgtgtgtgtgtgtgtgagagagagagacagagacacacagagagagatagtactgaacgaatgactatagcata

SEQ ID NO: 67649 - DNA, 112 bp, Mus musculus
ctactcactggagttccttgagcatgcaccccgtgtctacaccctcatttatacatttatatagttacttcggggggagagacggccacacagctaggagtactaggattag

SEQ ID NO: 67650 - DNA, 89 bp, Mus musculus
aactgaagctcctttctctgtgatagctccagctgtgtcaagttgacacaaaactagacagtacagtgagagaagttgtgaacacagtt

SEQ ID NO: 67651 - DNA, 94 bp, Mus musculus
gttaatgagaatatctgtctgtctatctgtctgtgcaccacaggcatattggctgcctgctgtggtcagaatgtggtgacagatctcccagaac

SEQ ID NO: 67652 - DNA, 62 bp, Mus musculus
atagatagatagatagatagatacctatatctctatatctatctatctatctatctatctat

SEQ ID NO: 67653 - DNA, 75 bp, Mus musculus
gtattgactggggctggagggatggctcagccgttaagaacactgactgctcttccagaggtcctgagttcatat

SEQ ID NO: 67654 - DNA, 85 bp, Mus musculus
gtggcttgggaggctgaagcagaagacctgtggcgagagagaattctgtctgtctgtctgtctgtctatctatctatctatctat

SEQ ID NO: 67655 - DNA, 120 bp, Mus musculus
ctgcaaaagcacagactcttaaccactgacccacctctccagcccccacattaaaaacaagtctatttctatttttatggatgtgcctatgggtctgtgtgtgggtctaagcacatgcag

SEQ ID NO: 67656 - DNA, 77 bp, Mus musculus
gctctctgtctctgtgtgtgcatgcgcgtgcgcgtgaccacgtgaatgtgatctgtccaggcttagatcgagagagc

SEQ ID NO: 67657 - DNA, 78 bp, Mus musculus
ggagcctcatgtatgccagcctgtgctctccccctggggctgcaccctttgagagaacagtgactgggcagaggtttc

SEQ ID NO: 67658 - DNA, 75 bp, Mus musculus
ccttcagagaagggtgtcaggagagatggttagctacttgttgcaagctccaccctccttccagcctctgcctgg

SEQ ID NO: 67659 - DNA, 64 bp, Mus musculus
gagcacacagtgaagtctgcagagcaacattcagggctctgttctctccttccaccaggggctc

SEQ ID NO: 67660 - DNA, 113 bp, Mus musculus
ctctgccagctcagggcatttggccaaaagagcagagtgggacttgttgtggccaggactggctgcctgtcacccttcctgtcctgccaacgaatgccttgcctctgctagag

SEQ ID NO: 67661 - DNA, 105 bp, Mus musculus
tttttaagagttgacttggagctggagagatggctcagctgttaagagcactgactgctctttcagaggtcctgagttcaattcccaggaaccacatggtggctc

SEQ ID NO: 67662 - DNA, 69 bp, Mus musculus
gtatgtgtgtgtatgtatgtgtgtgtttgtgttgtgtgtgtatgtatgcatgtatgtatgtatatgtat

SEQ ID NO: 67663 - DNA, 91 bp, Mus musculus
gcttctggctcggtgtcttttctgtggctccctctctctggcttcaattagcattcctttaagaagaggcttgaaaggacccagttatagc

SEQ ID NO: 67664 - DNA, 122 bp, Mus musculus
tgtgcctggttggcattgccaaaggacacgatgtccccagagtcatgccagaggacagaattcagactccacagattctctgggccaatatacctccgaatagctggggttctgagatgtcc

SEQ ID NO: 67665 - DNA, 59 bp, Mus musculus
ctctctgtggctcactctcagcagttctactaggtgagactgagatagctcccggagag

SEQ ID NO: 67666 - DNA, 74 bp, Mus musculus
ggctgatgtcaggagtcttcctcaactgatctcttccttatttttttgagacagggtctctcactgattaagct

SEQ ID NO: 67667 - DNA, 67 bp, Mus musculus
tctgggtgtctctgtggctcacagcaggcctggagagggtggcagcagccacaggaacaaacccaga

SEQ ID NO: 67668 - DNA, 72 bp, Mus musculus
gggaagggcagcagggctcttgtgctttgggggtttacacggggtgtctctgagtctgtgcctttggacacc

SEQ ID NO: 67669 - DNA, 56 bp, Mus musculus
tatgtatatatatatatatatgtatatatatgtatatatgtgtgtgtgtatatata

SEQ ID NO: 67670 - DNA, 114 bp, Mus musculus
tgagggcttgttccctaatcatccatccttatcattttctgaaggttagagaagtgagtgagcaaatcatatcaacagaacccatgatgtacaagatgtgggagtggggtctcg

SEQ ID NO: 67671 - DNA, 60 bp, Mus musculus
ctctatgtgtctctctgtgtgtgtgtgcgtgcaagcacacaccatggcaagtgtgtggag

SEQ ID NO: 67672 - DNA, 84 bp, Mus musculus
tcctaatgaccgagcacacagagagctgtcccatgggtcagcctcctggctctgaccctgtctctgagtgcctgggcaggtgga

SEQ ID NO: 67673 - DNA, 105 bp, Mus musculus
ccagctgtgagtaattctttggcagtgtcttagctggttgttgtgagtattagctaaggaagcaatcagcaagtatactgccctagaagtgctgcacattgttgg

SEQ ID NO: 67674 - DNA, 62 bp, Mus musculus
tgtctgtctgtctgtctgtgtgagggtgttagaagccctggaactggagttatagacaggtg

SEQ ID NO: 67675 - DNA, 71 bp, Mus musculus
tactatgtttcatttagtgtatgtatgtatgtatgtatgtatgcatgcatgcatgcatgtatgggtgagtg

SEQ ID NO: 67676 - DNA, 99 bp, Mus musculus
gtagcaatcacggttaggtccagggagcacactgctgaaactgttaaagctgtgcagtgccaggggtccctgtactcctgaaatatggtgattgaagac

SEQ ID NO: 67677 - DNA, 67 bp, Mus musculus
catatatatatatatatatatatatatatatatatgcatgtatgtatgtatatgtatatatgtatgt

SEQ ID NO: 67678 - DNA, 81 bp, Mus musculus
ggcactagtcgagcaagcatttagacttgacctcctgacctattagacacggagtctgtgtccctgtttctcacatgtgtc

SEQ ID NO: 67679 - DNA, 75 bp, Mus musculus
gccctgccacacgcactctgtctccatggttctgtttcaggccctgctcacagtcatctgcagtcagcacagggc

SEQ ID NO: 67680 - DNA, 135 bp, Mus musculus
cgcagccagacagtcccttacatttttttttaattgtatttatttgatgtgtgtaggtgtttggcttttatgcgtgtctctgccactgtgtgcctggtgccggaggagggcaaagaagacatggaatcctatagg

SEQ ID NO: 67681 - DNA, 103 bp, Mus musculus
gagatggctcagtagttaagagcatcagctgctctcccagagggtccaggtttgatttctggcacccactcagtggctcactactctctgtaactccagtctc

SEQ ID NO: 67682 - DNA, 110 bp, Mus musculus
ggtaaaatacccatcacgggctggagagatggctcagcagttaagagcactgactgctcttccagaggtccggagttcaattcccagcaaccacatggtggctcacaacc

SEQ ID NO: 67683 - DNA, 97 bp, Mus musculus
ctctgtagtgggttctcaaggcgttacaaacagtgaggttgtagtatgaaaaaatgtctgttcacctcacattaatgatgaagaggctgttgaagag

SEQ ID NO: 67684 - DNA, 116 bp, Mus musculus
tgcttgtaaaatacctaggtgtgggttggagagatggctcagcggttaagagcactgactgctctttccaaagtcctgagttcaaatcccagcaaccacatggtggctcacaacca

SEQ ID NO: 67685 - DNA, 107 bp, Mus musculus
gtccttgtaagagttgccttgggaggtagagagatggcttagaggttaagagcactgactgctctaccagaggtcctgagttcaattcccagcaaccacatggtggc

SEQ ID NO: 67686 - DNA, 97 bp, Mus musculus
gagcaggagtggacaggtcctttcaaggtttgctgagttgcctgaagtttttataaaatgaagaaactgagcacaggagatctgtacctctttgctc

SEQ ID NO: 67687 - DNA, 78 bp, Mus musculus
aaattttggtagagtgagacagctgctgagagtcaggagacctgacctttccaatagtgattttgtttttcaagattt

SEQ ID NO: 67688 - DNA, 71 bp, Mus musculus
tgtcgggtagagtaagaggaacatattgaacttaggcaattatgcagaaatgtgtttttcttcttgtggca

SEQ ID NO: 67689 - DNA, 61 bp, Mus musculus
gcctgtaccattagggtgtgcagggagggatccctgcctgcctgcctgcctgcctgcctgc

SEQ ID NO: 67690 - DNA, 106 bp, Mus musculus
tcctgggtatatgagcaggagagagcaaggacagtggaacccacaaacacatgtgttagccacagtagtcacagtgctcactggctgaacagtttactaacaagga

SEQ ID NO: 67691 - DNA, 79 bp, Mus musculus
aggttggtgttctgtggtgtttctaacagtgggagcacggactgtctctgactcttttgctgctttcgggaccctttct

SEQ ID NO: 67692 - DNA, 85 bp, Mus musculus
ggagactcggatgctgagagacttactgactcagtcaaagcgtacacagaggacatggcaggcgaggttactttcaggagtcttt

SEQ ID NO: 67693 - DNA, 105 bp, Mus musculus
tcaggacagaattggattcaagagtggcagtctcaggctggagagatggctcagtggttaagagcactgactgctcttccaaaggtcctgagttcaaatcccagc

SEQ ID NO: 67694 - DNA, 66 bp, Mus musculus
tgacagtaagacaatgacattgtatggatgctctctgtgtgtatgtgtgtgtgtctgtctctgtca

SEQ ID NO: 67695 - DNA, 96 bp, Mus musculus
tcagaggatgtaaaaactgaacacaaactgcgtgtctcactgaatctcagggcagtgaagcagccagcgtgagttttcaaagcaggaagatgctga

SEQ ID NO: 67696 - DNA, 91 bp, Mus musculus
gcaatgacaacccctaggtgacagggaaactctgtgcttacagaagtttgtgtgaatacaggcatttcctcagaacctattctctgtgtgc

SEQ ID NO: 67697 - DNA, 117 bp, Mus musculus
gttcccagtccccacgtccaagcagttcaagttacttcaagagagaaacacattttatatataaaataacattcttgtcggagctaaccactctgtcagactgtctttatggggagc

SEQ ID NO: 67698 - DNA, 79 bp, Mus musculus
gcacttacagtcacagtcacagtaacagcggtgggcatttgtagctcattttggggaggagacaggtggatcctggtgc

SEQ ID NO: 67699 - DNA, 70 bp, Mus musculus
tccgcctgtctcactcacacaggatgacggggatgtggacattctgatggactgaggaagacaggctggg

SEQ ID NO: 67700 - DNA, 92 bp, Mus musculus
tagggccggcgattatctttcagtgtttttattttttgtctaaattcacaaattcacatagcaacactcaagaggttttgttgttgtatcta

SEQ ID NO: 67701 - DNA, 106 bp, Mus musculus
tctgtgtctgtgtgtgcacacatgtgtgtacagtcacatgcactctatagtgtatgtttttcacacccagttttgatgtggcatcctttacacagactctctcaga

SEQ ID NO: 67702 - DNA, 66 bp, Mus musculus
tgtccacactcagtctctgtctcacctgtctcgaagcaggagaggggctccctgattctttggaca

SEQ ID NO: 67703 - DNA, 88 bp, Mus musculus
tccctgaaacattgcccagtgacaaagaagacccaaacttacaagtccttggagacttccactctgcctgtctctgtgccttgaggga

SEQ ID NO: 67704 - DNA, 80 bp, Mus musculus
ctccaagtccttggtgttgggggcagaggactggccaaatgttctgctctgtcctacttgcctctctctcagactgtgag

SEQ ID NO: 67705 - DNA, 127 bp, Mus musculus
gctattctatctacttgccctggacagggctccctctctatccaggctatctaggaggtgagcagagagtgtggacacagcttatttgcccgggagcccctgctgatccacggtgctcagtgttccc

SEQ ID NO: 67706 - DNA, 115 bp, Mus musculus
atacagcatatatagtatatacacaatatatacactatagtatatacagtgtgtatgtgtatatgtgtatatatatgtatatgtgtatgtgtatatatacatatatgtgtgtgtg

SEQ ID NO: 67707 - DNA, 79 bp, Mus musculus
tccttggtctccagagtgcgttctgggaactaggtcactgggctacagtcccagacagactctgagtcaccttgaagga

SEQ ID NO: 67708 - DNA, 66 bp, Mus musculus
ggtgactcagagtctgtctgggactgtagcccagtgacctagttcccagaacgcactctggagacc

SEQ ID NO: 67709 - DNA, 58 bp, Mus musculus
cgtatgtatctatgtatgcatgcatgtatctatgtatgtgtgcatgtatgtacatatg

SEQ ID NO: 67710 - DNA, 116 bp, Mus musculus
tgtgtatgtatgtatggatatgtgcatgtatttatatgtgactgtgtgtgactatgtgtgactgtaactgtgtgactgtgtgtatgagtgtatgtatgtatatgtgcctgtatgca

SEQ ID NO: 67711 - DNA, 75 bp, Mus musculus
cactgtgtctgtccctctctgaatttggcttctgggatactataatcagatctcatagagttagagttacaagtg

SEQ ID NO: 67712 - DNA, 114 bp, Mus musculus
ggagatcctaaaaggaagatgagagtctagctcaggacctcaagaagccacagtagggagtgtggaggtgacagagttgatgtaaataaaggacttgttcctcagtaggtctcc

SEQ ID NO: 67713 - DNA, 62 bp, Mus musculus
ggctgatgctcaggcagtttagaatcaatgtgtgtgtgtctgtgtctgtctgtctgtctgcc

SEQ ID NO: 67714 - DNA, 99 bp, Mus musculus
taaaattttcatttaaattcatatatttatataatatatatgtgtgtatatatttatatattgcatattatatatttatctgtgtaaatgaatgttttg

SEQ ID NO: 67715 - DNA, 192 bp, Mus musculus
cctagtgtaggatgggtgtaggctgtgtgtacagtgagtgcagacctagtgtaggatgggtgtaggctgtgtgtatagtgagtgcagacctgttgtaggatgggtgtaggctgtgtgtacagtgagtgcagacctagtctaggatgggtgtaggctgtgtgtacagtgaatgcagacctagtgtaggatggg

SEQ ID NO: 67716 - DNA, 259 bp, Mus musculus
cagacctagtgtaggatgggtgtaggctgtgtgtacagtgagtgcagacctagtctaggatgggtgtaggctgtgtgtacagtgagtgcagacctagtctaggatgggtgtaggctgtgtgtacagtgagtgcagacctagtctaggatgggtgtaggctgtgtgtacagtgagtgcagacctagtgtaggatgggtgtagactgtgtgtacagtgagtgcagacctagtgtaggatgggtgtaggctgtgtgtacagt

SEQ ID NO: 67717 - DNA, 85 bp, Mus musculus; identical to SEQ ID NO: 57439

SEQ ID NO: 67718 - DNA, 64 bp, Mus musculus
atcttcagacagatgttaaggtgtgtgtgctcacacacacacacatatacttctttctcaggat

SEQ ID NO: 67719 - DNA, 112 bp, Mus musculus
tgcgtatgtatgtgtgtatatgtatatgtgtgtattcatgtgtatatatatgtgtgtgtgtatatctgtgtttgtgtgtgggtatatatgtgcgtgtaagtgtgtctctgta

SEQ ID NO: 67720 - DNA, 83 bp, Mus musculus
agtcagacaggtcactgaggacagaccagtgcaacaacacggccctggtctagctttatgaactaagggatatatatctgact

SEQ ID NO: 67721 - DNA, 135 bp, Mus musculus
tatacacataaacatgtttgtaaatgtgcatatttgtatatataaacatgtgtttaagtatgcatgtgtatatatgtttcagtacataatatgtttgagtataatgtgtgtatatttgaatatgtatatgtatgc

SEQ ID NO: 67722 - DNA, 91 bp, Mus musculus
gatgaagaatgatcacaggtagaccagagggaccaccaaactaagccgttccctggttccttctatctatctatctatctatctatctatc

SEQ ID NO: 67723 - DNA, 95 bp, Mus musculus
catatatatatatatatatatatatatatatacacatatatatatatgcatatatacatatatatatgcatatatatatgtgtgtgtgtatatat

SEQ ID NO: 67724 - DNA, 62 bp, Mus musculus
tacatgtgtatgtatgggcaagtgtgtgaatgtgcacatgtgtgtctgtatgtgtgtctgtg

SEQ ID NO: 67725 - DNA, 71 bp, Mus musculus
accatgtgtgtgcatatgtgtgtgtacatgtatgtgtacatgtgcatgtacatgtgcatgtgtctgtgagt

SEQ ID NO: 67726 - DNA, 112 bp, Mus musculus
ggtatacaggtaaagctatggtggtgatgacggcagtgactgtgatgagtgagatgaagatggcaaccgtgacaacagtcatgatgatgaagacgatggtaacactgatgct

SEQ ID NO: 67727 - DNA, 117 bp, Mus musculus
actgtgtatccctggctggcttggaactcacactgaagttcaggacggcctcagactcacagaagtctgtgtgctgcctctggactgcagggattaaaggcgagcgagcgccaccgt

SEQ ID NO: 67728 - DNA, 93 bp, Mus musculus
atatatgtgtgtgtatatgtatatatgtgtgtatagtatatatgtatgtgtatatatatatatacacacacatatgtatacacacacacacac

SEQ ID NO: 67729 - DNA, 73 bp, Mus musculus
actctgtctgtctctgtcatctccttctgactcctcccaggctgtcaggagtagctacagagtcttggcaagt

SEQ ID NO: 67730 - DNA, 65 bp, Mus musculus
tgctgtctctccctctgaccctgaagccagtctcaggcttgagctgtggtgggaaggaaacagca

SEQ ID NO: 67731 - DNA, 96 bp, Mus musculus
tgcacgataactcctgtctgtgctgtgttaacttaggatgttagagatgtgagtcctgtgatcagtgtgagcacagctgggcaggtgccatgggca

SEQ ID NO: 67732 - DNA, 110 bp, Mus musculus
gtttttaaaatgtttttgttggggctggagagatggctccgtggttaagagcactgactgctctttcagaggtcctgatttcaatccccagcaaccacatggtaactcac

SEQ ID NO: 67733 - DNA, 75 bp, Mus musculus
ggtgggagaagatggtggatggccatagtagtggtctgagtgtttgtgtgtctgtctgtccgtctgtcgcccatc

SEQ ID NO: 67734 - DNA, 78 bp, Mus musculus
gtggatggaaggaggaggaggagtgtggggaactgagtcaaagccagggccattccgtccatctgtctgtctgtctgt

SEQ ID NO: 67735 - DNA, 127 bp, Mus musculus
gtccggatagtagaagaacctgaggtggaaggtgtactgagggtgcccctgctcagtgccactcacggtcacactttaaagtgaggagatactgtggatgctcaaagccagtgactgggtccctgag

SEQ ID NO: 67736 - DNA, 86 bp, Mus musculus
gggtcgggctgcgggaagcggcagctgtgccatggtgagggccatgcccaggaagccatctgtctcattctgtcagctccagaccc

SEQ ID NO: 67737 - DNA, 84 bp, Mus musculus
actataaaggtgtacagggggagaggaagctgtctgggccgcacaacagtcactaaagtattcatcctacacacctatgctagt

SEQ ID NO: 67738 - DNA, 64 bp, Mus musculus
atatgtgtgtgtgcatgtgtgtgcaggtgtgtgtatatgtgcatgtgcatgcatatgtgtatgt

SEQ ID NO: 67739 - DNA, 74 bp, Mus musculus
gaaagcaggataagggctggagagatgtctcagtggttaagggcactgactgctcttccagaggtcccgagttc

SEQ ID NO: 67740 - DNA, 66 bp, Mus musculus
tacatatgcatgaatatatgcatatagtatgcatgcatgctgtgtgtacatatgtgtgtatatgta

SEQ ID NO: 67741 - DNA, 74 bp, Mus musculus
agcagaagtggcccttgtctttcccacagcggcaggctgcactctctgtgtctctgtttgaaatgggctctgct

SEQ ID NO: 67742 - DNA, 104 bp, Mus musculus
cagcacattcccaccgtggaccttgcggctcccagcagcatagagagcgcaggtccccagcagactctcagactgacagagctgcttcgcggtggcattctctg

SEQ ID NO: 67743 - DNA, 74 bp, Mus musculus
cctgtgtctgtgtctgtgtgtctgccactcgtgtgtgattaccatggaggctgggagagatcttacggacttgg

SEQ ID NO: 67744 - DNA, 94 bp, Mus musculus
accagatagctgtgtgtgtgacccagccagctgtgtgtgtgtgtgtgacccagccagctgtgagtgggggtgtgtgagatccagccaactgtgt

SEQ ID NO: 67745 - DNA, 68 bp, Mus musculus
tggggccaagagcagctgcgctggggaagtactcaggtccaaccagctgccactgtgtctctgtccca

SEQ ID NO: 67746 - DNA, 71 bp, Mus musculus
gaccagagccatctgctacacctgaccttgatgacctgatcaagacagtgtggctctgtctgtctgtggtt

SEQ ID NO: 67747 - DNA, 62 bp, Mus musculus
ggcactgtctgcctctctgtgactctgtggtcagtttcgagagaagccactgactgtcagcc

SEQ ID NO: 67748 - DNA, 70 bp, Mus musculus
acctgagactgcaggtcactgttggcacagcattctgtctgtgtctctgtccctgtctgtgtctcagtgt

SEQ ID NO: 67749 - DNA, 75 bp, Mus musculus
ggaccagccggcaggctgggtcttattacgtcaattttgtgtctctgtggctgagactcagctgtggctgagttt

SEQ ID NO: 67750 - DNA, 75 bp, Mus musculus
cgtggaggggaattgcagctgagactcgttggaaccgaagcagccgagagtgtcactctgcctgtgacagccatg

SEQ ID NO: 67751 - DNA, 60 bp, Mus musculus
tatgtgtgcatatgcatctgcacaccaacatgtatgtgtgcacctgcatgtgcctacatg

SEQ ID NO: 67752 - DNA, 74 bp, Mus musculus
gtgcatgtgtgtccctgtgtgtgtgcatgtgtgtaagtccctatgtgtgtatgtgtgtgtggtttacatgcatg

SEQ ID NO: 67753 - DNA, 74 bp, Mus musculus
tgtgtgtacatgtacaggtggcttttatatgcatgtttacttatgtatatatgtttatgtgtgcatatatatgt

SEQ ID NO: 67754 - DNA, 86 bp, Mus musculus
ggaaccaaggcaccacaggaaatgggttcaaggtgccgatgtgagtgagctcagactggcaaagaaccagagacctggtgtcttcc

SEQ ID NO: 67755 - DNA, 56 bp, Mus musculus
gtgtgcacgtgtgcgtatacacatgtgtgtgtgtgtgtctatgtctctgtgtgtgc

SEQ ID NO: 67756 - DNA, 102 bp, Mus musculus
gggggggggggggggtcatccttgaggtatgaggatgaattctgatttggaatgtcatgtgtgaaatcctgatgcgtctcagagacgcgcccacacatctct

SEQ ID NO: 67757 - DNA, 85 bp, Mus musculus
caaagttacatggggtttaagtaaatgtgcacacgtgactgctgtctgtgtgtcactgcatttgtctgcactgcatttgtctgtg

SEQ ID NO: 67758 - DNA, 61 bp, Mus musculus
cagcacaggataaagacagtaggatcttgacccgactgacactgtctgtgtcactgccctg

SEQ ID NO: 67759 - DNA, 87 bp, Mus musculus
gtgcatgtgtgcctgtgcactgtgtgcatgtgcatgtgtgtctgtgcactgtgtgcatgtgtacctgtgcattgtgtgcatgtgtgc

SEQ ID NO: 67760 - DNA, 89 bp, Mus musculus
gtgtgcatgtgtgtctgtgcactgtgtgcatgtgcatgtgtgtctgtgcactgtgtgcatgtgtacctgtgcactgtgtgcatgtgtac

SEQ ID NO: 67761 - DNA, 63 bp, Mus musculus
gtgcatgtctgcgtgtgtgtgcgtgtgtattttatgatgtactgtgcatatatgtgtgtgcat

SEQ ID NO: 67762 - DNA, 72 bp, Mus musculus
gtctgtgtctgtgtgtgtgtttcacgggagtaattacttcccctctgaaatcaggcagctgggaataaaggc

SEQ ID NO: 67763 - DNA, 72 bp, Mus musculus
acacacagtcacgctcagtgaatcacagaggatattgacaactgtgacctctgtatgtgcgtgtgcgtgtgt

SEQ ID NO: 67764 - DNA, 108 bp, Mus musculus
gaagtataccaaagtcgtgtatgtatgagagtgtgtgtgtgtgcatatgcatgtgaatgtgagcatgtatgtgagcattcatgcatatgtgtatgtgtggtgtgtgtt

SEQ ID NO: 67765 - DNA, 111 bp, Mus musculus
atctttgctattttaaatatctgctggtttgcttcagtattgagatagatttttttatttgaatttctgaatttgtgctacatttggggataaagtttaaaatgcatagat

SEQ ID NO: 67766 - DNA, 130 bp, Mus musculus
tgtcatgaaagggtaggcatgtcctaacaggagagagtgggcacttcctgacagaggagagagtgggcacttcctgacagaggagagagtgggcacttcctgacagaggagagagagtgggcacttcctg

SEQ ID NO: 67767 - DNA, 84 bp, Mus musculus
agtgtggtcctagatggaagagctcaggtgtgctatggagcctgtactcacctacacaccccttctctgtctgtctgtctgtct

SEQ ID NO: 67768 - DNA, 79 bp, Mus musculus
ggagcgagaggccagacgagggtccctgcagatgtgtctgcacagctggagccagggcactcagtctgtcagtcactcc

SEQ ID NO: 67769 - DNA, 116 bp, Mus musculus
cacaaaacaaggagacatctgaccaagtgtacaccggagatgaaagcccttgctaacgtgtaacagaatcaggatgtggagtggctcagttgataaagtgttgccttgcaaatgtg

SEQ ID NO: 67770 - DNA, 104 bp, Mus musculus
tatctgtctatctgtctctgtttgttctgtctgtctctctgtctctggaatccatacttaagagtctcagagaatgacgccagattacattagttgggtgcata

SEQ ID NO: 67771 - DNA, 59 bp, Mus musculus
ccaccttgtttgttgagacaggctctctcacagacctggagctcagtgattagaggtgg

SEQ ID NO: 67772 - DNA, 107 bp, Mus musculus
gtccctgagtcacttaaatgttctatctgagccatatgctgatttgtgttgagaatctgttgttctggttagctgtagctgaagaatcatttgtgataacaagagac

SEQ ID NO: 67773 - DNA, 105 bp, Mus musculus
ttacagttgggcaaaagattggactgggatggccgggactccggtgcagacctctgtgtgtctgagaatctggctgtatctacaaccttcctcacactgtgaccc

SEQ ID NO: 67774 - DNA, 82 bp, Mus musculus
agcagatgagcagtgagttgagtgtgaagctggcaggcagtgtcactctgtgtgtcccataaccctctccatttgttctgtt

SEQ ID NO: 67775 - DNA, 87 bp, Mus musculus
gaaagtggtctggatcactctgttttttcagaggtgtctgagtctctcagtgactgcctggacttaacaagtgcagggccatctgtc

SEQ ID NO: 67776 - DNA, 87 bp, Mus musculus
ctgggtgagttggggtgaatcctttggaggtgagagggaaggaggtcacctctgcctctgtctcacacttggacataagccacctgg

SEQ ID NO: 67777 - DNA, 106 bp, Mus musculus
gtgtctgtatgtacagattatgcatgcgtgtatgcatgtactgatatatgtatgtctgcatgtgtatatatatatatacagatatatgagtgcatagatgtatgta

SEQ ID NO: 67778 - DNA, 96 bp, Mus musculus
gctgcatattgtgattgatcaagcagatgcctgcctcacagacagtccgtcgctgcctgggggctggaggttctctctctgtcacttagtggcagc

SEQ ID NO: 67779 - DNA, 128 bp, Mus musculus
tttatattttaatgtgtgtgtacatgcatgtgtgcatgtgtgtatgtgtgcatgtgcatgtgtgtatgtgagtgtatgcatgtgcatgtgtatatgtgagtgtgtgtatgtgtgtctatgtgcatgca

SEQ ID NO: 67780 - DNA, 121 bp, Mus musculus
tagctggtgtgatgggagcttggggctgttccatttattttagcatggtgggagcagagatctgtctctctgatgagcctggagtcatagaagacagcccagcctttcactcactgtccgg

SEQ ID NO: 67781 - DNA, 91 bp, Mus musculus
gtggggtgggggcagcttgactgttggatgagtggctgagagggagctcctagcctgcacccacctctgtctgtctgtctgtcaccttgcc

SEQ ID NO: 67782 - DNA, 59 bp, Mus musculus
gaggaccacagatgaaaggactttaccaaaaagtgtggggctcactcactgtgtgcctc

SEQ ID NO: 67783 - DNA, 107 bp, Mus musculus
tcagagtcatgcttctgtctcgagatgtgagttcttggctaccactccagtgccgtgcctgcctgcctgcctgctacgctcttctctgtaatgatcatagactctga

SEQ ID NO: 67784 - DNA, 100 bp, Mus musculus
ggggaagctgagagtatagagatggggtgaaggtcagcctggggcagccaggaggactcaagcactctgcctgtcacaccttcttcggcttttaagatcc

SEQ ID NO: 67785 - DNA, 85 bp, Mus musculus
cctggtccccagtctgtctctctgtgagctcatgggcaagtggccccaggagagagccatagcagtcagaaggtgcaaagacagg

SEQ ID NO: 67786 - DNA, 83 bp, Mus musculus
tttgcttatacagacttttttatttaacagattttgtttttaattatgcgtatctgtggagtgagtgtagttgtgcgagtgag

SEQ ID NO: 67787 - DNA, 84 bp, Mus musculus
tggcaacaggctgccagttcgcggtagggaagcatcatgggagaaagtgtaatgttgtgtgctgtttgctgaagcccatcccca

SEQ ID NO: 67788 - DNA, 76 bp, Mus musculus
ctgagggtctgagcaccaggccagcatgaatgggagatgctactgtgagcctgggtctgtcgctcagtgaccatag

SEQ ID NO: 67789 - DNA, 75 bp, Mus musculus
aggctgatcatatgtgtgtgtgtgtgtgtgtgtgtgtatgtgtgtatatatgtgtatatatacatatgtgtgtct

SEQ ID NO: 67790 - DNA, 94 bp, Mus musculus
gtgattgttcttaggagtctcggaggggtaggacctcgagcagatgcctgcatctcaggctcagcgactctgactctgtggcttggggagtcat

SEQ ID NO: 67791 - DNA, 70 bp, Mus musculus
tccaggccaatggcacgaaaccctgtccagccctgaggtgtaaggacaagcgtctgtcagtctgtctgga

SEQ ID NO: 67792 - DNA, 106 bp, Mus musculus
tcttgcctttgcattgaacagcctgctctgagatgtgtgagtgcacacaccattgtgtgtttgccttgagtctcagagcagacttgggctgaggattgctggctga

SEQ ID NO: 67793 - DNA, 85 bp, Mus musculus
ggaagacagactctgagagaagagacacagaacaggtaaaggtgaccggagactgggattttgtcacacagcagtcaggccttcc

SEQ ID NO: 67794 - DNA, 62 bp, Mus musculus
gtacaatgaatatgtatgtatgtatgtatgtatgtatgtatgtatgtatatgtattgtgtac

SEQ ID NO: 67795 - DNA, 115 bp, Mus musculus
cgggctcacagtatgagtaacgaccagtggtgttcttacacagacagacagacagacagacagacagacagcaacatcagtggaggaatgccattctgctcaatggctgtgtatg

SEQ ID NO: 67796 - DNA, 117 bp, Mus musculus
caagcatggtgtctcacaactggaagttatcccctggcctccacagatgttctgtgtgacaaacacacacacagagattatggaccgatagatagatgatagatagattgattggat

SEQ ID NO: 67797 - DNA, 112 bp, Mus musculus
tgggtggccacagcaggcacatgcagagagaatcacaccagacttttttttttttaaaacgatgtctttattttaattttatgtgtatgagtgctttgactgcatctatcta

SEQ ID NO: 67798 - DNA, 89 bp, Mus musculus
gatggagccttgtgtaacggctggagcaacaggtcagcgtgtatgtcacggacactaactgactgactctatggtgagcatctcccttc

SEQ ID NO: 67799 - DNA, 72 bp, Mus musculus
gcagcatctgtgaagggatggctggattctcagagcagcgttgacagtcagtctgtccgtcacaaatgttgt

SEQ ID NO: 67800 - DNA, 61 bp, Mus musculus
gtgtgttaagtcactgttcaaacaaaacaacatttgtgacggacagactgactgtcaacgc

SEQ ID NO: 67801 - DNA, 81 bp, Mus musculus
tctgcagctctcaggctgtgtctgtctggcacccacctctccgagggccctccagacgccaataacttgttaagtggcgga

SEQ ID NO: 67802 - DNA, 70 bp, Mus musculus
ctgcctcagtcactctgtgtcctcacagcctggccagcctcagcccacagagcacagaatggctgtccgg

SEQ ID NO: 67803 - DNA, 93 bp, Mus musculus
tgttttgcatttgttttgatttgtgtgtgttggttttgcttcttattgagagagacagagacagacagacagacagacagtcagaggtagaca

SEQ ID NO: 67804 - DNA, 136 bp, Mus musculus
gtgtgcacatgcatgtgtgtgtgtgtgtgtgtgtatatatatatatatatatatgtatgtgtgtgtgcatgtgtgtttgtgagtgtgtctttctgtgtgtgtatgcatgcctgcatgtgcatgtgtaaatgtgtgt

SEQ ID NO: 67805 - DNA, 104 bp, Mus musculus
atgtatgtatgaatatgtgtatgtatgtgcatgtatgtatatatgtatgtataaatgtatgtatgcatatatgtatatatagatatacataagtatgtatatat

SEQ ID NO: 67806 - DNA, 84 bp, Mus musculus
ggacatgagtgttctgtgtgcccgggcagtggagagctgtgggtggctccctctgtgtgtccgcacagtggagtgcttgtctcc

SEQ ID NO: 67807 - DNA, 83 bp, Mus musculus
gtgtgtgtggcgtgtgcagcccacagggacaggaagcagcagctccactctctctctctgttttctatactctcctctcacac

SEQ ID NO: 67808 - DNA, 107 bp, Mus musculus
acacatgacttgggaggttaacctaaaattcaaagtctgtcaggtattctaggaagctaggttatccggcctcaccagacaataaaaatggcaacttccacagtgtc

SEQ ID NO: 67809 - DNA, 101 bp, Mus musculus
tcctctctgctcttgactgtgggttttagctgcttctggctccagccttgacttcgctgccacgaggggctgtgaactggattcgctcatctgttgaggga

SEQ ID NO: 67810 - DNA, 70 bp, Mus musculus
tcacagaggaaggacaggagaagaaggtacgttcctcagtggctctctgtctctgtgaactcctctttga

SEQ ID NO: 67811 - DNA, 84 bp, Mus musculus
tacatatatatgtacatatatgtgtgtatatatatatgtacacatatatatgtatatatgtacatgtgtgtatatgtgtatgtg

SEQ ID NO: 67812 - DNA, 80 bp, Mus musculus
tcttccactccctcactggtcttagtgtctaccgtgtctcccaaagatggtaaagaccccagtgactggagagtgtaaga

SEQ ID NO: 67813 - DNA, 82 bp, Mus musculus
catttaggtgtctatttgttcatgtgtgtaggtgtgccagggtgcatgtacaggtcagaggtcatgtccagtgtcatctttg

SEQ ID NO: 67814 - DNA, 93 bp, Mus musculus
ccttcagatgtctctctaacactctgacactgaagcttgtgggcacagagagcatttgctcagtgtcacggctcctgagacattttacccagg

SEQ ID NO: 67815 - DNA, 103 bp, Mus musculus
cacttttcagtgtgtgtgtgtgtgtgtgcatgcacatatgtgtgtatgtatctgtgtgtgtttctgtgtatatatatatctgtatatatgtgcatgtgtgcat

SEQ ID NO: 67816 - DNA, 80 bp, Mus musculus
cccttcccgagacagggactgagacgggcttcgctgctgagagatcaatggacccctctctccctgtctgagggtcaggg

SEQ ID NO: 67817 - DNA, 90 bp, Mus musculus
agctgtggggtgccatgttcagtgtatggaagccaaaagcaaagtacatttgcccagcacagacacttactcactggtaatcctggatct

SEQ ID NO: 67818 - DNA, 68 bp, Mus musculus
ggcagctgagcttcagacacggagggctttgatttcagtcagtttctctcactgagtgctaaggtgcc

SEQ ID NO: 67819 - DNA, 80 bp, Mus musculus
ggccatgcaggtggttcatggtctttgaggccagactctttgacctcacaagcttccctgtgtccctcactgcctggact

SEQ ID NO: 67820 - DNA, 60 bp, Mus musculus
atacataagtacgtacgtatgtatgtatgtatgtatgtatgtatgtatgtatgtgtgtat

SEQ ID NO: 67821 - DNA, 87 bp, Mus musculus
gtcagtggaaagccatccagacaaaaccccacagcgagctgggtgtgtgccatcttctgtctttgtctgtctgtctgtctgtctgtc

SEQ ID NO: 67822 - DNA, 56 bp, Mus musculus
gtgcatctgtgagcatgtgcatctgtacgaatttgcacatgtgcacgactgtgcac

SEQ ID NO: 67823 - DNA, 73 bp, Mus musculus
gggctgagtgaagctccccagggctggaccaatctccaatcttcagtctctgacacagttactcattgatccc

SEQ ID NO: 67824 - DNA, 110 bp, Mus musculus
aggagaggctgcctagtgcttgtggctgcctattgcagacggatcagatacgcgggttatagggtctctgtctgtctgtctcgggctactatgccttcttagccttatct

SEQ ID NO: 67825 - DNA, 111 bp, Mus musculus
tgtagtgagactaaaccttgttgacaaaggccatccttacagagtcaccacacaatcccctctgctgaccctggcaccaccttttgtcttgagggccagtcctgagctcca

SEQ ID NO: 67826 - DNA, 103 bp, Mus musculus
tgcctgcctgcctgcctcctgcctgcctgcctgcctgcctgcctgcctgccttctgcctgcctgcctgccaccaagcagacagcacaggtgcaccatgaggta

SEQ ID NO: 67827 - DNA, 79 bp, Mus musculus
cagtgccttgggtgccaaggtcagccatgtctggagagagtgagggcagaagacagggtctgggaatttcatggcattg

SEQ ID NO: 67828 - DNA, 105 bp, Mus musculus
gtacatgtgtgtgtgtgtgtgtgtatatatatatatatgttttgtgtatgtatgtatacatgtgtgtatatatgtgtgtatatatatgtgtgtatatgtgtatat

SEQ ID NO: 67829 - DNA, 76 bp, Mus musculus
tatgtatgtgtgtgtatatgtatgtgtatatgtgtgtgagtatgtgtgtatgtatgtatgtatgtgtgcatgtgtg

SEQ ID NO: 67830 - DNA, 92 bp, Mus musculus
tcctcttgcttgttgtcagagtgcagacactggcgtagacactgggcctctgtgggtgtctgtgctctggggaggggctcactttaggagga

SEQ ID NO: 67831 - DNA, 105 bp, Mus musculus
ggaggaactgtgtcaccatgggtgggctttgaggtttcaaaagcctgttccaggcccaggctcactccctctcagcctgcagaccagggtgtaacagttaactcc

SEQ ID NO: 67832 - DNA, 63 bp, Mus musculus
ggagagggcttacgggggaggggaagagctgagggcatcgtctgtccgtctgtctgtctgtct

SEQ ID NO: 67833 - DNA, 78 bp, Mus musculus
tgtgcagtcatgctagacaggcagctatgctcaggtgaaacaatgacaggtattagctgggtctctgtgtgagtgaca

SEQ ID NO: 67834 - DNA, 103 bp, Mus musculus
agccttctggggtggactgatccccacagtcactctgaccctgaggaaccctgaggtgcaagggtctgctggcttggaacactttaatcacctcagaagtgct

SEQ ID NO: 67835 - DNA, 108 bp, Mus musculus
ggggtggacttgaagagatagctgaccaggtgctgccggagacttgaactttcagagtctctctctatggctggacacagggtgctcctttctctcagggcttgttcc

SEQ ID NO: 67836 - DNA, 71 bp, Mus musculus
gggaatgagaccctggacataggggatgcaggccagctcgagcatgcatccctgtgtccctctgtctccct

SEQ ID NO: 67837 - DNA, 118 bp, Mus musculus
gcatagtgatatggttccatctgtgtctttggtgggcacctagagtggtacactgagcaagtcgatgtggtggaggcctctcccacagcaaggacatgtctgtcacctaaagctctgc

SEQ ID NO: 67838 - DNA, 134 bp, Mus musculus
ggctcacagcaaagctgtatttgtcgggagtgggggggagggatgagacccacccttgtctctggctgtgtgcgtggcttcttcttgtggtgtcttatgtgccctaaggcgtctcagcgagaacaagagccgtg

SEQ ID NO: 67839 - DNA, 103 bp, Mus musculus
gggaaggcctggcagacgacctcgggcctgatggcacactgggtctctcacccgctcacccagtgcctgacacatgctggaggctgtcagggtccctcctccc

SEQ ID NO: 67840 - DNA, 78 bp, Mus musculus
tgagcacagttctctctgtggtattgtagctgtatggatggccctcatcctcctgtctgctgctagttgctgttctca

SEQ ID NO: 67841 - DNA, 73 bp, Mus musculus
ctcaggctgtcactcactgtgtcacgctggagcccagaatggaaagagctggtcttgagtggcagctgcggag

SEQ ID NO: 67842 - DNA, 82 bp, Mus musculus
tcatgtatgcaggtgtgtcaacgagtgtagtgtttgtgttgtaaacagtcagtacactgtaaactgtcccaactctacatga

SEQ ID NO: 67843 - DNA, 57 bp, Mus musculus
acacacataatgtcctgcacatatgcatggcacacatgtgtatgtgtacatgtgtgt

SEQ ID NO: 67844 - DNA, 69 bp, Mus musculus
cctgtctctctctctgtgagggatggaatctggcagactctgcgcagaggtctcagaggcagaaacagg

SEQ ID NO: 67845 - DNA, 90 bp, Mus musculus
gaggcagagtttctgtgtgtcacactggctgtgctagatcgtgctctgcagaccagactggcctggaattcacagagatttgcctgcctt

SEQ ID NO: 67846 - DNA, 63 bp, Mus musculus
cttgacagtgagaacagtgggaccaggagcgaggcagctggtcacactgcatctgcagtcagg

SEQ ID NO: 67847 - DNA, 80 bp, Mus musculus
acctctgagtgcctcactctctcccaagcaggctttctgcttctgcctggatgggagcaggaaggaccccctactctggt

SEQ ID NO: 67848 - DNA, 114 bp, Mus musculus
ttatcagtgcaaacctttatccaccatgacatctttatagtttaagacttcaaagtttttaaatattgaatcaaaagctaagaagatggttctggaggtgaccccagctgctaa

SEQ ID NO: 67849 - DNA, 116 bp, Mus musculus
gtgacttccttattaagcatgggttatgggctggagagatggctcagcggttaagagcactgactgctcttctaaaggtcctgagttcaagtcccagaaaccacatggtggctcac

SEQ ID NO: 67850 - DNA, 86 bp, Mus musculus
cacacacacacacacacacacaccctgatttttgatttcctattttgattttatggccattggtgctctgcctgtgtgtctgtgtg

SEQ ID NO: 67851 - DNA, 128 bp, Mus musculus
atgtgtatatgtgtatgtatgtatgtatgtctgtatatatgtctgtatgtatatatatatatatatatatatatatatatatatatatatatatatatatatatatatatatatctgctgactgtatg

SEQ ID NO: 67852 - DNA, 94 bp, Mus musculus
gggataaaagcaacagaatttgtaagttactaaagtgaaactaaactagtatcaatttaaatctgtcacaactttagaatgttgcacatgtccc

SEQ ID NO: 67853 - DNA, 111 bp, Mus musculus
tactctttttgcatgcatatatgtgtatataaggaatgtgtgtatatatgtgtgtgtccatgtgcatgtgtgcgtgtccatgtgtttgtgtgttgggtgtaggtatgagtg

SEQ ID NO: 67854 - DNA, 61 bp, Mus musculus
gaagctgagacttcaggcctgagccaaaggggctctctctgtatctcacttaaagtgcttc

SEQ ID NO: 67855 - DNA, 84 bp, Mus musculus
cttggcgaccagctggctccgtcattctgtctgaccaggaaaagaatcaaagctggacacggatgaaggctggaaagccccaag

SEQ ID NO: 67856 - DNA, 71 bp, Mus musculus
gtttgcgtgtttatatttttatgtacagaggttattttgcctgtgtgtgtatctgtgtgttacatctgtgc

SEQ ID NO: 67857 - DNA, 86 bp, Mus musculus
cacagaagcagcatttacacagaagcagctctatgtcaactacccagtcactcagactttgacacagtgtctagtgtagatgtgtg

SEQ ID NO: 67858 - DNA, 116 bp, Mus musculus
gatgttcttgccttcggcacaggctcagtggtggacagtgtcaccgaggaaggtgggtgtgtgcctctctgcctccagatagcccaccatgcctacacccttgagggtttcagctc

SEQ ID NO: 67859 - DNA, 81 bp, Mus musculus
gtggccttgtaggagtgggtgtgatcttgttggaagagttgtgtcactttctgtgtgagttttaagcctcctactagctac

SEQ ID NO: 67860 - DNA, 197 bp, Mus musculus
gtcatgcatacagttcttggcagatgtgcacactgtaacacctgtgccctactgtctcagtctgtctgtgtgcagatgtgcacactgtaacacccgtgccctactgtctcagtctgtctgtgtgcagatgtgcacactgtaacacccgtgccctactgtctcagtcagtctgtgtgcagatgtgcacactgtaacac

SEQ ID NO: 67861 - DNA, 85 bp, Mus musculus
gccctgctgatggatgtcttaccagacatggttagatctggatgcatctgtctaatactgtctggtaatgccgtccatccacggc

SEQ ID NO: 67862 - DNA, 88 bp, Mus musculus
tgggcctctgtgggcatcttaccggacagtgctggatttcttggcttgactctaacactgtctggtaacgatgttcaaaggtgaccca

SEQ ID NO: 67863 - DNA, 82 bp, Mus musculus
gggcagccgtggccatcttactgggcagcattggatagtgtctgatctctaatactgcctggtaatgatgacggcggagccc

SEQ ID NO: 67864 - DNA, 98 bp, Mus musculus
ggaaaggtgcacagtagttcgtatttgatgtagtggtacttgtttaccctaaacccagtctttctgtgtcagtgactcctaccacatgaccctttgcc

SEQ ID NO: 67865 - DNA, 86 bp, Mus musculus
atcaagagggcagcctgaccatctgagttagattctcaagacccacatagtggaagagaactgattcctgcatgttgtcctctgat

SEQ ID NO: 67866 - DNA, 85 bp, Mus musculus; identical to SEQ ID NO: 57439

SEQ ID NO: 67867 - DNA, 115 bp, Mus musculus
ttccttcaacagttcaagataattttagctatcctgtttgtatggtatgtatgtgtgcatatgtatgtatttttgaatgaagctgaaaattgtcttttcaagatctgtgttggaa

SEQ ID NO: 67868 - DNA, 62 bp, Mus musculus
tgccgcagactctctgggtccctgtgtctgcatggaacggggtctctcgacgcgggtgggca

SEQ ID NO: 67869 - DNA, 82 bp, Mus musculus
gcctggttagacacattgtatttgtgactagctgggctggccaggcctggctgcttcataggtgggtggtgtttttatcagc

SEQ ID NO: 67870 - DNA, 67 bp, Mus musculus
catatatgtatatatatatatctatatatgtatgtgtgtgtatagaatatatgtatatgtgtatgtg

SEQ ID NO: 67871 - DNA, 85 bp, Mus musculus; identical to SEQ ID NO: 57439

SEQ ID NO: 67872 - DNA, 85 bp, Mus musculus; identical to SEQ ID NO: 57470

SEQ ID NO: 67873 - DNA, 117 bp, Mus musculus
agatcataagacgtcctaagtggctggagagatggctcagtggttaagagcactgactgctcttccagaggtcctgagttcaattcccagcaaccacagggtagctcacaaccatct

SEQ ID NO: 67874 - DNA, 79 bp, Mus musculus
gactttgagtaagagaaatgtgcagcagcagaagtctttgacgagactctcaggctctctgcttttccagctaatggtc

SEQ ID NO: 67875 - DNA, 85 bp, Mus musculus; identical to SEQ ID NO: 57439

SEQ ID NO: 67876 - DNA, 106 bp, Mus musculus; identical to SEQ ID NO: 58252

SEQ ID NO: 67877 - DNA, 113 bp, Mus musculus
catatatatatgtatatatgcatatatgtatatatgcatatatgcatatatatatgtatgtatgcctatatatatgtatatatgtgtatatatatatgtatatatatatatat

SEQ ID NO: 67878 - DNA, 109 bp, Mus musculus
tgtgttgaatctgaatgtatttgttaggtcgagcatcagtctttttgtagtacagagaatacaatgggttggaagtcacatcaggcaaggtacattgaagtttaccaga

SEQ ID NO: 67879 - DNA, 69 bp, Mus musculus
aacttctgctgtaggggcgagagaataaaacagggcgtcccctgatttctctctgtctctgggagagtt

SEQ ID NO: 67880 - DNA, 85 bp, Mus musculus; identical to SEQ ID NO: 58764

SEQ ID NO: 67881 - DNA, 85 bp, Mus musculus; identical to SEQ ID NO: 58764

SEQ ID NO: 67882 - DNA, 96 bp, Mus musculus
catggtgaggaatgagtttcacttgattcttctatatttgaatataatcacatttctaggtatggtttactgaagagaaacctttcctttattgtg

SEQ ID NO: 67883 - DNA, 89 bp, Mus musculus
tgcatatgtacatatatgcatatgtgtgtattggtgcatatatatatatatatatgcatatgtgtgtatatacatatgtatattttgac

SEQ ID NO: 67884 - DNA, 106 bp, Mus musculus
ttgacattgtttgtttggtttgtacctctaaaatattaggatgttgataacgtgtaaatgtttcaatttttctaattcatctatgaaaccaaatagtctatcttaa

SEQ ID NO: 67885 - DNA, 112 bp, Mus musculus
tcatgcttgcgtatatatgtatgaatatgtaatgtatgtatgaatttatatacaatgaatatataacctatgcatatatgtaataaatgaataaatatatagtgtatgtatg

SEQ ID NO: 67886 - DNA, 85 bp, Mus musculus; identical to SEQ ID NO: 57439

SEQ ID NO: 67887 - DNA, 85 bp, Mus musculus
ggccatggtggtctgataggatacatggaacaatttcaatatttttgtatctattgaggcctgttttgtgaccaattatatggtc

SEQ ID NO: 67888 - DNA, 87 bp, Mus musculus
gaattctggaattgttctgattgtgactctcagtctcttttcatcaggaccatcttgttcacattcaggatgaggtgccatgtcttc

SEQ ID NO: 67889 - DNA, 85 bp, Mus musculus; identical to SEQ ID NO: 57470

SEQ ID NO: 67890 - DNA, 105 bp, Mus musculus
gaggtgtggccttgtttgaggaaatgtgtcactgtgtgtgtgtgtgctttaaaaccctaatcctaaccaggcagtggtggcacatggctttaatcctagcacttt

SEQ ID NO: 67891 - DNA, 108 bp, Mus musculus
cctatgatttcatcttccaacacactagctaccatgcaaagaagattgagaactgaatttcttggttctgtgaactgagcgttggtgttttcgatgagattgtatagg

SEQ ID NO: 67892 - DNA, 78 bp, Mus musculus
tcttcctgtgcggttgcaaatgtcttcagttccttcactccttgttggctgtgagcatctgcatctgtatttgtcaga

SEQ ID NO: 67893 - DNA, 81 bp, Mus musculus
tcatactttatcgaagaaaatgagaataatctttttttttttcagaaggttagtgctcatccaatttcatggagtttttga

SEQ ID NO: 67894 - DNA, 95 bp, Mus musculus
agattttgttgtaaacagttgtctgactctagacatctcagggacaacccttaaagagacagttgtctgactccagacatttttatgacaactct

SEQ ID NO: 67895 - DNA, 64 bp, Mus musculus
gcttaatgcagatatagtttgtaatgacttatttgtgtcattatttctttatgtgtgtataagt

SEQ ID NO: 67896 - DNA, 105 bp, Mus musculus
aaacattaggaagttttctgctacttagaatttatgtatttagtataaatatctttatatttagttctagtacttaattctaagtattcagtataactattgttt

SEQ ID NO: 67897 - DNA, 85 bp, Mus musculus; identical to SEQ ID NO: 57470

SEQ ID NO: 67898 - DNA, 62 bp, Mus musculus
gggttaatatccacttatcaatgagttcatatcatgtgtgttctttggtgattggattacct

SEQ ID NO: 67899 - DNA, 85 bp, Mus musculus; identical to SEQ ID NO: 57439

SEQ ID NO: 67900 - DNA, 78 bp, Mus musculus
tttatatatagcttagttgatgttgtggaaggtctcagactgtctctgtcttcctatagcaaactgagctttcataga

SEQ ID NO: 67901 - DNA, 94 bp, Mus musculus
atatttatccattctatctgtcaataatgcatgtattacgtatgtatgtatgtatgtatgtatgtatgtaagtgcctagagagcggatatttat

SEQ ID NO: 67902 - DNA, 133 bp, Mus musculus
atatatatgtatattcttacacatatgtatgtatatgtatatacatacatacatgtatgtatgtatatgtatatatatatatatatatatacatatacatatatatatatatatatatgtatatatatatatg

SEQ ID NO: 67903 - DNA, 77 bp, Mus musculus
gtgtgcatgtatatatgtatgtaagtatgtatgtatgtttatgcatgcattcatgcatgcatgcagtatttgcacat

SEQ ID NO: 67904 - DNA, 68 bp, Mus musculus
tgagagtctgaggagccattttcagcaatggggaacactcactgactgtgtggtaaatgagagattca

SEQ ID NO: 67905 - DNA, 80 bp, Mus musculus
tatatacaacacacgcatatgtgtgtgtgaatatatatatatatatgtgtgtgtgtgtgtgtgtgtgtgtgtgtgtgtgt

SEQ ID NO: 67906 - DNA, 86 bp, Mus musculus
tatctatatatatatgtatatatacagatatatatagatatctatctatctatctatatctatatatatatgtgtgtgtgtgtgtg

SEQ ID NO: 67907 - DNA, 85 bp, Mus musculus; identical to SEQ ID NO: 57439

SEQ ID NO: 67908 - DNA, 112 bp, Mus musculus
ttgattttttccaaagggatcttcatgagaagtttcaaacaatccaggctgctgttaagactacagactgatctctataaactgccaggaagacccccattggtgaggacaa

SEQ ID NO: 67909 - DNA, 115 bp, Mus musculus
aattgaaccttggttattatttacttagtaggtaatatccacttataagtgaatgtatgcaatatttatttttctgtgtctgagttacctcactaaggatgacttatttttaatt

SEQ ID NO: 67910 - DNA, 85 bp, Mus musculus; identical to SEQ ID NO: 57470

SEQ ID NO: 67911 - DNA, 85 bp, Mus musculus; identical to SEQ ID NO: 57470

SEQ ID NO: 67912 - DNA, 85 bp, Mus musculus; identical to SEQ ID NO: 57439

SEQ ID NO: 67913 - DNA, 85 bp, Mus musculus; identical to SEQ ID NO: 57470

SEQ ID NO: 67914 - DNA, 85 bp, Mus musculus; identical to SEQ ID NO: 57439

SEQ ID NO: 67915 - DNA, 101 bp, Mus musculus
tcattgagctactaaggcatattaaaaataacactgcactctgtgtgtgtgtgtttcattcacaaatacagagctcttgggtgggtgcgtagcaagtgtga

SEQ ID NO: 67916 - DNA, 104 bp, Mus musculus
tagctataatatacattcagaggatctactgttgacacacgtatgcccaatgcttgctgtgtcagtgtctgtgagctcataatgtattgtgtctttcttagttg

SEQ ID NO: 67917 - DNA, 84 bp, Mus musculus
tatgtatatgtatatgtacatgtatgtatgtatgtatacatgtatatatatatatatatatatatatatatatgcatactgtat

SEQ ID NO: 67918 - DNA, 76 bp, Mus musculus
gggtccttgagactgaatttgggtcctctgcaagagaagcaagtgtttctgacctctgatctgtctctctaatccc

SEQ ID NO: 67919 - DNA, 96 bp, Mus musculus
gatcaaccttagttcgtggtgatttgataggatgcatgggataatttcaatgtttttatatctgttgaggcctgttttgtgaccaattatatggtc

SEQ ID NO: 67920 - DNA, 85 bp, Mus musculus; identical to SEQ ID NO: 57439

SEQ ID NO: 67921 - DNA, 109 bp, Mus musculus
agttctgtggattgtattctgggtattctgcacttttttttttttttttttttttttggctaatatccacttattagtgagtatataccatgcatgtccttttgggact

SEQ ID NO: 67922 - DNA, 89 bp, Mus musculus
ataaagagatagaataggtagtatttatatgttcaggcacacccatctgtctgtctgtctgtctatcatctacctacctgtctatttat

SEQ ID NO: 67923 - DNA, 104 bp, Mus musculus
tatgtgttgtcatagaaatgtaagatttttctaaatgtatatgtatatagtatacatgcatgtgagtgtacacagaggggttagaatcttctgtgactggggta

SEQ ID NO: 67924 - DNA, 102 bp, Mus musculus
ggaacatgagacagttatgtttgggggagattagcttcacgtgcttgatttataaatattttgaaaaaccagttaactctctcagtctctgtctccatctct

SEQ ID NO: 67925 - DNA, 85 bp, Mus musculus; identical to SEQ ID NO: 57439

SEQ ID NO: 67926 - DNA, 85 bp, Mus musculus; identical to SEQ ID NO: 57470

SEQ ID NO: 67927 - DNA, 85 bp, Mus musculus; identical to SEQ ID NO: 57439

SEQ ID NO: 67928 - DNA, 93 bp, Mus musculus
gtgtccaacctggtataaaaatatgagatattatatagaaagcacactatgctagctgaaaagtatttttttttaactgagtggttggtagat

SEQ ID NO: 67929 - DNA, 67 bp, Mus musculus
ggccataggcagaagaaatcactggaaaaggataacctttgtctgtctgtctgtctgtctgtctgtc

SEQ ID NO: 67930 - DNA, 118 bp, Mus musculus
tctagatttttcagttttgttgagtgtaggcttctatagtaggatctgataattttttgaattttttcagtttctgttgttatattcccattttcatttctgattttgttaatttgga

SEQ ID NO: 67931 - DNA, 85 bp, Mus musculus; identical to SEQ ID NO: 57439

SEQ ID NO: 67932 - DNA, 85 bp, Mus musculus; identical to SEQ ID NO: 57470

SEQ ID NO: 67933 - DNA, 121 bp, Mus musculus
ctatatcatatagcaccatttatttgcttatgtatatatatgtatatacatatatatatatatatgtatacatatatatatatatacataagcatcaagatagggaatagatggatagata

SEQ ID NO: 67934 - DNA, 101 bp, Mus musculus
cccaaatcaaatttgcctgagatcatgtctttgagggattttcttgattgttaattaatatagaagatcctgaggccttgagagtggcatcaaaccctggg

SEQ ID NO: 67935 - DNA, 105 bp, Mus musculus
gcttggaaaattgttttccagcctttcactctaaggaagtgtctgtctttttctctgagatgggtttcctgtaagcagcagaatgttgggtcctgtttgtgtagc

SEQ ID NO: 67936 - DNA, 85 bp, Mus musculus; identical to SEQ ID NO: 57439

SEQ ID NO: 67937 - DNA, 85 bp, Mus musculus
ggccatggtggtctgataggatacatgggacaatttcaatatttttgtatctattgaggcctgttttgtgaccaattgtatggtc

SEQ ID NO: 67938 - DNA, 112 bp, Mus musculus
gatcagtcttaggccatggtggtctgataggatacatgggacaatttcaatatttttgtatctattgaggcctgttttgtgactaattatgtggtcaattttggagaaggtc

SEQ ID NO: 67939 - DNA, 83 bp, Mus musculus
catgggacaatttcaatatttttgtatctgttgaggcctgttttgtgaccaattatatgttcaattttggagaaggtcccatg

SEQ ID NO: 67940 - DNA, 100 bp, Mus musculus
caaatatatatatatgtctatatgtgtgtgtgtgtgtatatatatatatatatatatatatatatatatatatatatgtacacatatatatgtatatgta

SEQ ID NO: 67941 - DNA, 83 bp, Mus musculus
ggccatggtggtctgataggatacatgggacaatttcaatatttttgtatcttgaggcctgttttgtgaccaattatatggtc

SEQ ID NO: 67942 - DNA, 121 bp, Mus musculus
ggccctggtatgtctaagaaagctgagcaagtcacaggtaacaagccagtgtgcagagttcctccacggcctttgtgttagttcccgcctctctgttcctgccctgactttcttcatgaca

SEQ ID NO: 67943 - DNA, 105 bp, Mus musculus
tccttttgccttcggaggctggaccattacacacccagcattgaacatgggttccagttctcttgcttgcatggtgtgatggtttgtatattcttggaccaggga

SEQ ID NO: 67944 - DNA, 77 bp, Mus musculus
tggagaaaactaattttttatttgtaagtggctgtcagttggagatagctccggggtgagaatggagtgtgtgtcca

SEQ ID NO: 67945 - DNA, 91 bp, Mus musculus
aggaagcctggtggaggaagtgagtcactaggggtgggttttgaggtttcaaaggctcaagccagactcagtgtctctctaactgctttct

SEQ ID NO: 67946 - DNA, 84 bp, Mus musculus
ggcgactggatacacagacctcctctgcttactaccctaactccattgatggttgcagagacaactgagagtccaggtcctgct

SEQ ID NO: 67947 - DNA, 62 bp, Mus musculus
cccaaaacctgcagctatccagtgtttagtgtcttggatgttgtagtaggttgaataatggg

SEQ ID NO: 67948 - DNA, 73 bp, Mus musculus
gatatagaaggaacagggaacacagatactaaatatctatatctgtatctgcatctgtatctgtgtctgtatc

SEQ ID NO: 67949 - DNA, 127 bp, Mus musculus
gcatttaaaccataatagttggggcagtttcataattggctagataaaagtaggttatctctctctgtcagtctgttctaccatatggttattgcatctgacgtagttggaaggacagggagaagcc

SEQ ID NO: 67950 - DNA, 83 bp, Mus musculus
ggcacacaactctagactgtgactgtctctttcccagaatccatcactggttaatagttcagcagggtgaagccctgtgtgcc

SEQ ID NO: 67951 - DNA, 77 bp, Mus musculus
tgtgtctgacttcctgggagttcgtgcactgtgtgaggacacagggctggacttgaaggcttctggttaattttaca

SEQ ID NO: 67952 - DNA, 105 bp, Mus musculus
gtgaagttgataattgtcctttcaaggtttgtaaagaactatgttggagtttttatgggcattgcattgatctgtacattgcttttggaggatggctatatttat

SEQ ID NO: 67953 - DNA, 78 bp, Mus musculus
accaagcttgtttactttagttaaaagaatagcaaaagagggctttttaaagcagagctgaaggacgagttgaatggt

SEQ ID NO: 67954 - DNA, 112 bp, Mus musculus
gatcagtcttaggccatggtggtctgataggatacatgggacaatttcaatatttttgtatctgttgaggcctgttttgtgaccaactatatggtcaattttggagagggtc

SEQ ID NO: 67955 - DNA, 60 bp, Mus musculus
ttggaaaggcagacataggtgggtgcatgcagccaaactcactctatcactgagttccaa

SEQ ID NO: 67956 - DNA, 85 bp, Mus musculus; identical to SEQ ID NO: 57439

SEQ ID NO: 67957 - DNA, 113 bp, Mus musculus
aacttctgatcctaataagtgcactactttcatgctacagacacccacactgacttatctgacctgtagtggttagatcagggctgctggatagaaaccagtgtttcagagtt

SEQ ID NO: 67958 - DNA, 116 bp, Mus musculus
tgagagagtgtgtgtgtgtgcatgtgttttcctttctctctgtctctctctcctgctttttattagtactggggctgagcccatggcttggcacatacaatgcgtgtgctgtatca

SEQ ID NO: 67959 - DNA, 85 bp, Mus musculus; identical to SEQ ID NO: 57470

SEQ ID NO: 67960 - DNA, 90 bp, Mus musculus
agttttctgaaaccctcacacagaggatttgtaaagaatgactctgagtctcacattattaaacatttctgtgtgatacagtctggaact

SEQ ID NO: 67961 - DNA, 101 bp, Mus musculus
tctgcttttactcacacagctctctacagaagagagagagcatacagaaacgagtgctttgttcctttagcttcttcgaggactgcgttgctgaaaccaga

SEQ ID NO: 67962 - DNA, 85 bp, Mus musculus; identical to SEQ ID NO: 57439

SEQ ID NO: 67963 - DNA, 158 bp, Mus musculus
atatagatgcagagagagggaaagatatgtgtatatctatctatatctatatctatatctatatctatctatctatctatatctgtatatatatatatatatatatatatatatatagagagagagagagagagagagagagagagagataagataga

SEQ ID NO: 67964 - DNA, 85 bp, Mus musculus
gtccatggtggtctgataggatacatgggacaatttcaatatttttgtatctgttgaagcctgttttgtgaccaattatatggtc

SEQ ID NO: 67965 - DNA, 118 bp, Mus musculus
gcaatggaagcctgctctgcttgcttcacatcctcatcagtacatgctatctcttgtgtttttgatcttagctactctgacgggtgtaagatagattctcagagttattttgatttgc

SEQ ID NO: 67966 - DNA, 74 bp, Mus musculus
tgctctgaaattgtttcactgcaggtgaggttagctgtatatataaccacagaactgtgtgtgataagggagta

SEQ ID NO: 67967 - DNA, 114 bp, Mus musculus
acttttctttcttatttcctatttgcattcctttgatcttcagttgtcatgttgttctagctagaattgcatgcattattttgaatagatgtggacgtggagagaatggacagt

SEQ ID NO: 67968 - DNA, 64 bp, Mus musculus
ctcagagtctcactttcactgtgatcctgtgattcttggaatcctgtgaacctgagattctggg

SEQ ID NO: 67969 - DNA, 96 bp, Mus musculus
gatcaatcttagtccatggtgacctgataagatgcatgggataatttcagtatttttatatctgttgaggcctgtttggtgactgattatatgatc

SEQ ID NO: 67970 - DNA, 85 bp, Mus musculus; identical to SEQ ID NO: 57439

SEQ ID NO: 67971 - DNA, 71 bp, Mus musculus
agagcatagtaatcaagatgactttatttttttgtcaaaagaaattgtgctcttccaattgctatgcatct

SEQ ID NO: 67972 - DNA, 115 bp, Mus musculus
atatatttgtatatcacataatttgtatacatgtgtttgtatatatgaaaaggcactacatgattttatgtatattcatgtaaataacatttgcattgatatatgaaaggtatat

SEQ ID NO: 67973 - DNA, 85 bp, Mus musculus; identical to SEQ ID NO: 57439

SEQ ID NO: 67974 - DNA, 79 bp, Mus musculus
gctggtttgcaaacagtgagcacagagggatcaatgaaattacaagtgaaatctgctgatgctcacaaactgctccagc

SEQ ID NO: 67975 - DNA, 123 bp, Mus musculus
tataagatatatgcaaaggacctagctcagacccgacagggcccctgtttgtcacttcagtctctgtgatcccctatgagccctgcttagttgattctgtgggtcatattcttatgatgtctt

SEQ ID NO: 67976 - DNA, 108 bp, Mus musculus
ctcagtggatatccctgggaggttctcactctgcctctcactctcgctctctctttgaagagaaatggagaagctgatctgatgggagctgaaggaggggaaactgag

SEQ ID NO: 67977 - DNA, 107 bp, Mus musculus
tatcacctcaagttctttaattgaatttaaactatatgtatatgtatacttacatgtatgcattttatgttattttaggtaaatataaagtaatgtgagtcttgata

SEQ ID NO: 67978 - DNA, 90 bp, Mus musculus
acatataggacacataagttatatgtttatatatatatatgtatatatatatatgtatatatctgtctatctatctgtcggtctgtctgt

SEQ ID NO: 67979 - DNA, 115 bp, Mus musculus
tgttcttctgtatttctttaagtgagttattaaagtccttcttttcttttcttttttttttttttcttaaaagaaccacatttaattaaggctggcttacaggttcagaggttca

SEQ ID NO: 67980 - DNA, 100 bp, Mus musculus
gtgtatgcatgtgttatatgtgtgtacagtgtatgcacccatgtgtagtgtatatatgtgtgtatgtatatgtatgtatgttcatgataagtgtatacac

SEQ ID NO: 67981 - DNA, 87 bp, Mus musculus
tgtgtatatgaatatatgtatatgatgtatatgtatacatgcataatccatgtgtgcatatatatgtatctatatatctatgtatca

SEQ ID NO: 67982 - DNA, 84 bp, Mus musculus
ggtagcaccacttgggaaaggagaagctatgtaggagctcatcactagaaaccacagattttctatttctgagcagttgttacc

SEQ ID NO: 67983 - DNA, 90 bp, Mus musculus
atgtggcaatgttgaaaagagctagggctggagattaaaagcactgactgctcttccagaggtcctgagttcaattcccagcaaccacat

SEQ ID NO: 67984 - DNA, 104 bp, Mus musculus
gaatgatgtatgtgtgcacttatcatttttatgtatatatgtatgtacctattatgtatgtatgtatgtatgtatgtatgtatgtatgtatgtatgtatctatc

SEQ ID NO: 67985 - DNA, 87 bp, Mus musculus
acagcaaagctacagattacctgataaaaagccaccatatttcagcatctttgaatgtagtgtgtcagcacatctgtcacttgctgt

SEQ ID NO: 67986 - DNA, 83 bp, Mus musculus
tttaggcatatgtgtgtctgtgtgtctgccacctgtgtatgagtgcccatggagaccagaaagaggacatgagacatcctgaa

SEQ ID NO: 67987 - DNA, 73 bp, Mus musculus
ctgggactggagagatggctcagctgttaagagcactgactgctcttccagaggtattgagttctattcccag

SEQ ID NO: 67988 - DNA, 80 bp, Mus musculus
tgtatagatgtatgtatgtatagatgtatgtatgtatgcatgtatgcatgtatacacacacacacacacacacacacaca

SEQ ID NO: 67989 - DNA, 79 bp, Mus musculus
gtgtgtgtgtgtaatggcccactatgtcaagttagtgctgctcagatctgtatgactgaggggccatccactggagcat

SEQ ID NO: 67990 - DNA, 107 bp, Mus musculus
gagttttggggctgaccatttagtagtggatgaccagctggtgtgctcttcactggggtgactgtttctctccgactctcagtgttccttagttggctgtagttctt

SEQ ID NO: 67991 - DNA, 73 bp, Mus musculus
agtattccagctctctatgaaacttttaattctctgataggagagttgactgggtcatggtgatggttctatt

SEQ ID NO: 67992 - DNA, 85 bp, Mus musculus; identical to SEQ ID NO: 57470

SEQ ID NO: 67993 - DNA, 85 bp, Mus musculus; identical to SEQ ID NO: 57470

SEQ ID NO: 67994 - DNA, 114 bp, Mus musculus
agaggcctttatgaaatcttattgtgtgcaactcttcatagaacatcttacaccacatagtaggttgtttaataagcagctttgtgcagcaagtgcaggaacaagcgggaatct

SEQ ID NO: 67995 - DNA, 85 bp, Mus musculus; identical to SEQ ID NO: 57470

SEQ ID NO: 67996 - DNA, 85 bp, Mus musculus
ggccatggtggtctgatagaatccatgggacaatttaaatatttttgtatctgttgaggcctgttttgtgaccaattatatggtc

SEQ ID NO: 67997 - DNA, 85 bp, Mus musculus; identical to SEQ ID NO: 57439

SEQ ID NO: 67998 - DNA, 119 bp, Mus musculus
cactgtctgctctccctgatcttcctcctctcactgcatctctgttcactcttcctgttcagcacagtcacctgcaagaatgttctcaagatggactgatgggatgggctgtgcacaca

SEQ ID NO: 67999 - DNA, 85 bp, Mus musculus; identical to SEQ ID NO: 57439

SEQ ID NO: 68000 - DNA, 85 bp, Mus musculus; identical to SEQ ID NO: 57439

SEQ ID NO: 68001 - DNA, 119 bp, Mus musculus; identical to SEQ ID NO: 67998

SEQ ID NO: 68002 - DNA, 85 bp, Mus musculus; identical to SEQ ID NO: 57439

SEQ ID NO: 68003 - DNA, 85 bp, Mus musculus; identical to SEQ ID NO: 57439

SEQ ID NO: 68004 - DNA, 88 bp, Mus musculus
gatcagtcttagtccatggtgatctgataggatgcatggggtaatttcaatatttttgtatctgttgaggcctgttttgtgactgatt

SEQ ID NO: 68005 - DNA, 67 bp, Mus musculus
gtggatggatgtcacatagaatatattatatctatctatgtatttatgtatctatgtatctatctat

SEQ ID NO: 68006 - DNA, 85 bp, Mus musculus; identical to SEQ ID NO: 57470

SEQ ID NO: 68007 - DNA, 85 bp, Mus musculus; identical to SEQ ID NO: 57439

SEQ ID NO: 68008 - DNA, 85 bp, Mus musculus; identical to SEQ ID NO: 57439

SEQ ID NO: 68009 - DNA, 116 bp, Mus musculus
cgggaaattggtctgaagttctctttctttgttggatctttctgtggtttagatatcagagtattatggcttcatagaatgaattgagtagagtaccttctgtttctgttttcttg

SEQ ID NO: 68010 - DNA, 117 bp, Mus musculus
agattgtaagtggcatggaaggggcctgttgattttggggaaatatatatctctaattgtctctttatttatagatatttaacatttattagtggatctatctatctatctatctct

SEQ ID NO: 68011 - DNA, 85 bp, Mus musculus; identical to SEQ ID NO: 57439

SEQ ID NO: 68012 - DNA, 84 bp, Mus musculus
agaattttgctaattttttttcaaccttggcatttttatgactacaatgaaaatagaggctgagaagtgattttgtagagatct

SEQ ID NO: 68013 - DNA, 112 bp, Mus musculus
gtatatgtatagtatatatatctatatgcacatatatgtacatatgtatatatttatatgtgcatacttgtatatgcatatatgtatatgcatataatgtatatatgtatat

SEQ ID NO: 68014 - DNA, 85 bp, Mus musculus; identical to SEQ ID NO: 58174

SEQ ID NO: 68015 - DNA, 112 bp, Mus musculus
tgtgatttattgtgtgaaatgaaggctatggtgcatgtatgtatgtatgtaagtatgtgcatttatgttctttgtctgaccaaactttagttcttgacattagtacttcaca

SEQ ID NO: 68016 - DNA, 85 bp, Mus musculus; identical to SEQ ID NO: 59783

SEQ ID NO: 68017 - DNA, 105 bp, Mus musculus
ggttatcattgtgtattgtgagcatgattttgtttggagggatgtaaactttagaactttgaattaaaaaagcagtggaatgtttaaagtgcttcttaatggacc

SEQ ID NO: 68018 - DNA, 94 bp, Mus musculus
accagcagggcattctaaaacagcaagagcaatgaatatatttgttcacatttgacaagtgtattacatgttcattttagctgcactgctaggt

SEQ ID NO: 68019 - DNA, 86 bp, Mus musculus
atttacaaccccttgatctgattcagttgtgttattgatctagctaacatttcagtcactttattgaatttatgcaaggagtagat

SEQ ID NO: 68020 - DNA, 115 bp, Mus musculus
tctgcacatgttaatagtagtgtctagtgtctccttctatatgcatgtctgtctgtctgtcttagtctacgtgtcccatttaataccgagaattgcttttttaatcatgagtagg

SEQ ID NO: 68021 - DNA, 58 bp, Mus musculus
tatatatatacatatatatgcttatgtatatgcttatgtatgtatatgtatatatatg

SEQ ID NO: 68022 - DNA, 74 bp, Mus musculus
gaacttctcttgtaggggtcagagaaaataaaacagggcgtaccccaatttctctctgtctctgggagagtttc

SEQ ID NO: 68023 - DNA, 117 bp, Mus musculus
tatatacatactctcacacacagtcacacatatatctaatatatgtgtgtatgtgtatatatgtatatatatatatgtacatatatttatatattatacgtgtgtgtgtgtatgtgt

SEQ ID NO: 68024 - DNA, 119 bp, Mus musculus
ggtgcttttcagctattcaaaattcctctgttgtgaaggtggttagtttcttgagttctttatttattttgcataattgccctttattggatgtggggttagtgaaggcttttttcccc

SEQ ID NO: 68025 - DNA, 78 bp, Mus musculus
atctatatctatatctatatatatatatatatatatatatatatatatatatatatatatcttggtattcatgttgat

SEQ ID NO: 68026 - DNA, 85 bp, Mus musculus
ggccatagtggtctgataggatacaagggacaatttcaatatttttgtatctgttgaggcctgttttgtgaccaattatatggtc

SEQ ID NO: 68027 - DNA, 118 bp, Mus musculus
gctggagtgtcttctggctaggcaggatgttttcactgggattgtagcttatttttattctttagatacaggcttccttcctaaggaaagagagtgtgcatctggatgggaggctagt

SEQ ID NO: 68028 - DNA, 99 bp, Mus musculus
ggattttggcaattgctctttcaccatatatattacaatgatcacatgatttttgtctttcactctgtgtatgtggtagattattgtaatggctattcc

SEQ ID NO: 68029 - DNA, 61 bp, Mus musculus
atatatatgcacaatacacacacatataaacattaatgtgtatgtatgtatgtatgtatgt

SEQ ID NO: 68030 - DNA, 90 bp, Mus musculus
cacatgcaccatatatatatatatatatacatatatgtatgtatatacacacacatatatgtatgtgcatgtatatgtatatatttcatg

SEQ ID NO: 68031 - DNA, 63 bp, Mus musculus
tgtgtgtgtgtattcatgtatgtatgtagtatgtatgtatgtatgtatgtatgcatgtgcaca

SEQ ID NO: 68032 - DNA, 73 bp, Mus musculus
ctcctgggggtcaatctgtctctgtgtgtaattcttgtgggtagggttgtagcacaggatctattcctgagag

SEQ ID NO: 68033 - DNA, 74 bp, Mus musculus
tccttgcctcaggtcacatagtggggcagcttctcatcccagggcagtttctcactgactctctgaagcatggg

SEQ ID NO: 68034 - DNA, 90 bp, Mus musculus
tttattctttgttcattgatcagctatgtgtgtctttgtgaattaccatgtactgactataaagctcctctgatgagtgttaagagtagg

SEQ ID NO: 68035 - DNA, 92 bp, Mus musculus
gcgataaacatctgactggctgatttttatctagctgtgactttctgttcacagtagataaagagcagtgttgttcacagtatggataaagc

SEQ ID NO: 68036 - DNA, 96 bp, Mus musculus
tgctcagtccagtggttggctgtgagcatctgcatctgcattggccagattattgcagagccgctcaggggacagctataagaggctctgaaagca

SEQ ID NO: 68037 - DNA, 85 bp, Mus musculus; identical to SEQ ID NO: 57470

SEQ ID NO: 68038 - DNA, 79 bp, Mus musculus
acttctgttagtttcactgtgtctctgtttagtttctgtttccaggatctgtccatagatgagagtggggtgttgaagt

SEQ ID NO: 68039 - DNA, 85 bp, Mus musculus; identical to SEQ ID NO: 57439

SEQ ID NO: 68040 - DNA, 81 bp, Mus musculus
ttgctttggggtgaaatgtttggtagatatctgttaaatctatttggctaataacttctgttagtttcactctgtctgtga

SEQ ID NO: 68041 - DNA, 85 bp, Mus musculus; identical to SEQ ID NO: 57439

SEQ ID NO: 68042 - DNA, 115 bp, Mus musculus
tctgtcatatatgtacatatatgtgtgtatatatatgcacatatgtatgtatatatatatatatatatatatacacacatatatgtatatatttctatgtcagatacatatatat

SEQ ID NO: 68043 - DNA, 68 bp, Mus musculus
acagaatagagggactgagggatatggaaactctttgtgtctgtgtctgtctctatgtctctgtctgt

SEQ ID NO: 68044 - DNA, 58 bp, Mus musculus
atatctatctatatgtatatctatatatacatggatatatatttatatagatggatat

SEQ ID NO: 68045 - DNA, 85 bp, Mus musculus; identical to SEQ ID NO: 57439

SEQ ID NO: 68046 - DNA, 88 bp, Mus musculus
ttcctgtctttatctgatgctttgtctgtgtattggctggtttggggtgtcaacttgacacaagatagagtcatcagagaggaaggaa

SEQ ID NO: 68047 - DNA, 79 bp, Mus musculus
tgtatgggagctagagagatgactcagtggttaagagcactgactgctcttccaaaggtcctgaattcaattcccagca

SEQ ID NO: 68048 - DNA, 98 bp, Mus musculus
ttctgtgggcacgagtaagtgaaatggggcttgagaaacctgaagacgattcaggtagaaagttgttaacattctccctacaggaattgtctagctct

SEQ ID NO: 68049 - DNA, 88 bp, Mus musculus
gatttagataaaaggatatatgcataggtatgcatgtatgtatgtatgcatatatgtgtatgtatgtaagtaactttgcaactgtgtt

SEQ ID NO: 68050 - DNA, 114 bp, Mus musculus
ccttatgctagagtgtattttatttgggtgagtaaagggtatatatatatatatatgcatgtatatatatctcctccctcataattcttttccaagaggcagacaaccttagca

SEQ ID NO: 68051 - DNA, 96 bp, Mus musculus
gtgtgtgtgtctatgtgcatgtgtatgtgtatatatatatatatgtttgtatatatatatatatttgtacatatatatgtacatatacatatatat

SEQ ID NO: 68052 - DNA, 85 bp, Mus musculus; identical to SEQ ID NO: 57439

SEQ ID NO: 68053 - DNA, 89 bp, Mus musculus
atatagtttgtgtgtgtgatatgtatgtatgtatatatgtgtatagatatacatatatatatatatacatatatatatatatatatata

SEQ ID NO: 68054 - DNA, 91 bp, Mus musculus
tgtaattctcataatttttggtatgtgcaagtgagaatacatattttcatatttttttcatgtgccgtgtgttatgacaggaatatgtaca

SEQ ID NO: 68055 - DNA, 85 bp, Mus musculus; identical to SEQ ID NO: 57439

SEQ ID NO: 68056 - DNA, 102 bp, Mus musculus
ttgcttctctaaatgagctttcaaattaccaaataaattgctgtgtttttatttaaattctctggttctgtggctcatgagagataaataaatatcaagcaa

SEQ ID NO: 68057 - DNA, 83 bp, Mus musculus
gcatgtggtgatgatagaggcactataggataatcccatacgaggttgtgtgtgttcatgtccatgtgcatatgcatgctaca

SEQ ID NO: 68058 - DNA, 69 bp, Mus musculus
gatttttaagcaatatgtattcatgtatgtatatgtatgtatgcatacatttatgtattgtgatctatc

SEQ ID NO: 68059 - DNA, 85 bp, Mus musculus
ggccatggtggtctgataggatacatgggacaatttcaatttttttgtatctgttgaggcctgttttgtgaccaattatatggtc

SEQ ID NO: 68060 - DNA, 71 bp, Mus musculus
tagcatcaagaagacagatggctgggaattgtaggacagagttccttttccactctgtctctcacaagctg

SEQ ID NO: 68061 - DNA, 85 bp, Mus musculus; identical to SEQ ID NO: 59376

SEQ ID NO: 68062 - DNA, 73 bp, Mus musculus
agtgcagaactgtgacactagagttgagctctgtgacaacagagtggggcactgtgacatcagagtgagcact

SEQ ID NO: 68063 - DNA, 107 bp, Mus musculus
ggtcgtgaatcacaccacaaagcagagaactatggtttttatatctgtattttcaaggtgctaaataaaatctgttatactctgtgttcaaggagatttactcaacc

SEQ ID NO: 68064 - DNA, 97 bp, Mus musculus
gtcatattaaaatgctagatttaagtgaatatatatatgaatatacaatcatgcatttatttatatattcatgttataaaatgtagactggtttgac

SEQ ID NO: 68065 - DNA, 101 bp, Mus musculus
cacacacacacacacacacacatatatatatatatacacacatatatatatatatatatatatatatatatatatataaatgtattgttgattctgtgttg

SEQ ID NO: 68066 - DNA, 85 bp, Mus musculus
atgtacatgagtcatatatctatatgaatatgtgactatgatattaggactatatatttatatgcttatatatgtttatgtacat

SEQ ID NO: 68067 - DNA, 114 bp, Mus musculus
tcacttgcctctatatactggagtttggtttaggttggaattacatcgattttgcatatgcaaagtaatgaatgtttacattaaccttatatactacagaagaaacactggtga

SEQ ID NO: 68068 - DNA, 72 bp, Mus musculus
ttgaaggaacacactgagcactccaaggattcatagaagtttccttccagtgctttgtaattgtttcttgaa

SEQ ID NO: 68069 - DNA, 73 bp, Mus musculus
tcccaagcagttggatagtggagggaaagagaatttaagagttctgctgtctccctcactgtgtctgctggga

SEQ ID NO: 68070 - DNA, 85 bp, Mus musculus; identical to SEQ ID NO: 57439

SEQ ID NO: 68071 - DNA, 85 bp, Mus musculus; identical to SEQ ID NO: 57470

SEQ ID NO: 68072 - DNA, 106 bp, Mus musculus
gccttagtgcatggtgatctgataggatacatgggacaatttcaatatttttgtatctgttgaggcctgttttttgacctattatatggtcagttttggagaaggt

SEQ ID NO: 68073 - DNA, 80 bp, Mus musculus
tctggtccggaaggtggccggctgtctgcgactcgccaagggtgctgcctcagagactctgtgcttccgtctgtcccaga

SEQ ID NO: 68074 - DNA, 112 bp, Mus musculus
gcattgttgcagaggcatgtcacatcaggtagggttggagttttacaaggcccatgctggtccagtgtctctctttctctaactgctgccttctttctgcagattataatgt

SEQ ID NO: 68075 - DNA, 95 bp, Mus musculus
cttactactcctgtgcactggtcacttacctcaatactggatgacaccaccgtagtagctattgtgagaagtgagtcagctgaagctgtggtgag

SEQ ID NO: 68076 - DNA, 77 bp, Mus musculus
tctctgatgtcttctgtctgggtctcatggcctgctcaagtatctccatggttagtattctctacagacatgagaga

SEQ ID NO: 68077 - DNA, 75 bp, Mus musculus
ggtatggatctcaaggtgggacagtctctgaatggcctttccttcaggctctgcttcacactgtgtctctgtatc

SEQ ID NO: 68078 - DNA, 105 bp, Mus musculus
ggagtgagtgactgtaagttgagacctctgaaacaatgagatatgttaatttttacatttcacagctaattttctcaactatttccacagtgacattaaactgcc

SEQ ID NO: 68079 - DNA, 95 bp, Mus musculus; identical to SEQ ID NO: 68075

SEQ ID NO: 68080 - DNA, 92 bp, Mus musculus
ttggtcgcagcggcctcgatatagctgtgtcaccagggaactgagaggctcctcacagaactgagtgacttggggtatcgagtttcggctaa

SEQ ID NO: 68081 - DNA, 79 bp, Mus musculus
gtgtgtgtgtgtgtgtgtgtgtgtgtgtgtgtgtgcacatggtggtaggcatgaaccatacagtacacagaaagcacac

SEQ ID NO: 68082 - DNA, 88 bp, Mus musculus
tacctaggtctattaattttctaaatatgtatataatacacatgatttgatgtacaagtgtgtttacatatgtatagatgtatgggtg

SEQ ID NO: 68083 - DNA, 87 bp, Mus musculus
caggggcatgggggaggcagtgagatggttcagcaggtatcttgatctctatctttctacctctttgtgtctgactctctctctgtc

SEQ ID NO: 68084 - DNA, 118 bp, Mus musculus
tgcatgtctttttgtatttttgtttttaccaaatacattgatagagaaaatgcatatatatatatatatgcaacagtctttataactgtgtaaatataaaatagcttatatttatgca

SEQ ID NO: 68085 - DNA, 86 bp, Mus musculus
agacaagtgtagagactcatgagaaggtgctgctctaggccgctttctggctttcacacagccactctctttctactcacctgtct

SEQ ID NO: 68086 - DNA, 101 bp, Mus musculus
ctgtgtgcagaggcagagctcttaagatgctttgctagctgtgtgtctgtgtctctgtgcagaggcagaggcagaggcagggggatgtctgggttcaaggc

SEQ ID NO: 68087 - DNA, 87 bp, Mus musculus
tcacttcattgagagaggcacagtggagaacttctcctggcatcctggctggtcctggtcactcccactgactcataatggttctgg

SEQ ID NO: 68088 - DNA, 111 bp, Mus musculus
ggaaagagcattatcattctctataataaaagttcattaaaactatatatgcatatttatatatagaagtatgccatttatagttttgttggtagttaatcatgtgattcc

SEQ ID NO: 68089 - DNA, 113 bp, Mus musculus
ttcagatctctgaattattttgcagtgttaaaatgtgtgcttcttgtttcttaagaattaaggggctggggccacctgatgctgattcttaggataatcaaagggaacctgaa

SEQ ID NO: 68090 - DNA, 85 bp, Mus musculus; identical to SEQ ID NO: 57439

SEQ ID NO: 68091 - DNA, 88 bp, Mus musculus
cttggtgctataaagttggttgtagattgggttttagcttatctaaatctagtgagtcagaacacagacagaccaatgaacacacagg

SEQ ID NO: 68092 - DNA, 62 bp, Mus musculus
tacatatgtatgtatgtatgtgtgtgtgtatgtatgtatgtatgtatgtatgtatgtatgta

SEQ ID NO: 68093 - DNA, 107 bp, Mus musculus
gtatatgatattgttactgacggtgccgctttggagggaaagagaaagacactcactctctgtcagaaactgcgaaccgtgcctttgctccatgtgttgaaatgtgc

SEQ ID NO: 68094 - DNA, 89 bp, Mus musculus
acgcccagccatgcccagccattaagctagtcaaggcatattaaaattaaatggtctgtctgtgtgtgtgtgtgtgtgtgtgtgtgtgt

SEQ ID NO: 68095 - DNA, 142 bp, Mus musculus
gtgtatgtatatgtatatgtatatgtatatgtatatgtgagtgtattgtgtatgcaggtttgtatgtgtgtacatgtgtgtatatatatatatatatatatatatatatgttcttgcctacatgtgtgaatatatgtgtgca

SEQ ID NO: 68096 - DNA, 69 bp, Mus musculus
agatgccagctttgggaacagacaaatggcaacacatccctgcctctgtgtgactgaggctggcactct

SEQ ID NO: 68097 - DNA, 85 bp, Mus musculus; identical to SEQ ID NO: 57439

SEQ ID NO: 68098 - DNA, 69 bp, Mus musculus
ggtaagagacgagcatgcttccacacactagtgtgtctgcacgtgtgaggagtcagtgtctgtgcttgc

SEQ ID NO: 68099 - DNA, 80 bp, Mus musculus
tcatcttaattgtcaccttggttgggcaaatgcctacaaaattagtgaggcacacctctgagtgtgtcagtgcgagatga

SEQ ID NO: 68100 - DNA, 85 bp, Mus musculus; identical to SEQ ID NO: 57439

SEQ ID NO: 68101 - DNA, 120 bp, Mus musculus
aatttttataagtcattcagtttttaaccttctgtacgtcagtgaagagagtcaggacatagactagacactttcaggattggatggtttggtggaaaatgtactcagatttagaaaatt

SEQ ID NO: 68102 - DNA, 82 bp, Mus musculus
tgctcactgttaggtaaattaacatctgagcttttttttttggacagtaaagcatagatgtttatattttctttagtgagta

SEQ ID NO: 68103 - DNA, 60 bp, Mus musculus
gcttggggaaggctgagaccggaagttggagtgtcagtctgtctctcctacccctgaagc

SEQ ID NO: 68104 - DNA, 73 bp, Mus musculus
tgacttccccagctgtggtgtcacactcactgactcctctctgctgtggtgtcacactcactagttgcagtta

SEQ ID NO: 68105 - DNA, 127 bp, Mus musculus
aggactgagtgggcttctggaagagtcagattagaggtgactgaaatgtcagtggctaaagtgtctctctttctctctgtatcccccatttctctcatccctacatccttttcttcctctacctccc

SEQ ID NO: 68106 - DNA, 104 bp, Mus musculus
ccctgtaattctttcagacaggaacaattatgggtcagagatgtgactgtggaatggcaaccccatctttcacttgatgtcctgtcttcctgctggaggggggg

SEQ ID NO: 68107 - DNA, 80 bp, Mus musculus
agaaaagaaaacaggtagtaggctggtttagactcattcgtattatttgtctgtctgtctgtctgtctgtctgtctgtct

SEQ ID NO: 68108 - DNA, 87 bp, Mus musculus
ccatggagggatactgcttgctgtcttgctctcaggctcactctcgctacctatgccagccagggtagcagtgtcccacccacgtgg

SEQ ID NO: 68109 - DNA, 78 bp, Mus musculus
catgacagttgtgtgtgtgtgtcagtttgacacagtcaagggacctccgtcagattgtcctacaggcagccctacatg

SEQ ID NO: 68110 - DNA, 68 bp, Mus musculus
gtctgtgtctatgtgtgtgtatgtctgtgtctatgtgagtgcacctgtgtgcacatgcaggtggagat

SEQ ID NO: 68111 - DNA, 80 bp, Mus musculus
cactctcttccagccctgaagcagcctgagtggtatgtaagcttccagaggctttcttcagcagcaacatggggagagtg

SEQ ID NO: 68112 - DNA, 74 bp, Mus musculus
gagaccagagtacaagaaaggggctgttcttcaagaacaaaatccaggtctcagtttctctctctctctgtctc

SEQ ID NO: 68113 - DNA, 102 bp, Mus musculus
tgtctgtttctttctgtacgtgtgtgtgtctatatctctgtatgtatgtctccatgtgcattcatgtggtgcataggtgtgtgtgtgtggtgaggtaaggtg

SEQ ID NO: 68114 - DNA, 74 bp, Mus musculus
ccaaagtgctgactctctccctgcctctggaacccacaggaagtgcaggattagaggtcatttttcagtatggg

SEQ ID NO: 68115 - DNA, 75 bp, Mus musculus
tcctgcagaagtctggagtttggttaccaacacatgttgggcacctcataactatctaaactctaacttgaggga

SEQ ID NO: 68116 - DNA, 82 bp, Mus musculus
tgataagaactttagagttgaagaaccaacaccgatgtcatgaacatgactaactttggttttgaagctgaagtccttatca

SEQ ID NO: 68117 - DNA, 123 bp, Mus musculus
aacatttgaagtacacaacaagcaagctgtctaagtctcacattctctctggtcaccagacctggcttacagttgggtttttgttgatgtattttgttaggtttttgtttgtttggtcagctt

SEQ ID NO: 68118 - DNA, 106 bp, Mus musculus
gcagtcaaaaataaatgtgggggctggaggatggctcagtggttaagagcactggctgctcttccagaggtcctgagttcgattcctggcagccacatggtggctc

SEQ ID NO: 68119 - DNA, 61 bp, Mus musculus
gctgataacatggccttggccaaagtgccaagcagccctgggcctcagtctgtctgtcagc

SEQ ID NO: 68120 - DNA, 74 bp, Mus musculus
tgttctccgcctgttggctactggcaaggctccagatggtggatgctctgtcagcctgagtcagagcggaaaca

SEQ ID NO: 68121 - DNA, 87 bp, Mus musculus
ggagtattagaatagttgtcgggctggagagatggctcagtggttaagagcactgactgctcttccagaggtcatgagttcgattcc

SEQ ID NO: 68122 - DNA, 103 bp, Mus musculus
tgttgagagctcggtgagctgctgtaggagcctggaagctaagaatgctgagagagagcagtgagggcggaggcctggcttgaagaagtgtcagagggaagca

SEQ ID NO: 68123 - DNA, 99 bp, Mus musculus
tggttagtgctttataagctgtctccaatggacagtcacactctgacaaagactgtgtgcatgtattttgaggggacatttaccttgaaacactcccca

SEQ ID NO: 68124 - DNA, 114 bp, Mus musculus
gctagctctttttagtattgaattgtattaggcctctagctgccatcctgtgtccctgtgtgtgtgccttatctcagctggtctgcctgagtgcccaagaccccctgagcaagc

SEQ ID NO: 68125 - DNA, 65 bp, Mus musculus
ggatagaaagaaaaaagtaaatgcagaaaggcagagactctgtctgtctgtctgtctgtctgtct

SEQ ID NO: 68126 - DNA, 83 bp, Mus musculus
ttagaaggattaggaagtgtgttactgggggtgggctttgaggtttcaaaagcccatgccagactcagtctttctctctctag

SEQ ID NO: 68127 - DNA, 90 bp, Mus musculus
ccagaaggcggcattggatctcctagaactgcagttatagatgtttgtgagcagtcagtgggtgctaggaattgaatctgggtcttctgg

SEQ ID NO: 68128 - DNA, 120 bp, Mus musculus
aggtgttgccacgtggttttagttttggtttcccaggaatgtccttctgtgtctgtctgtgtatgatatatagcacttggtcctggggggccccaagccttgtaaactaaaccttcacct

SEQ ID NO: 68129 - DNA, 83 bp, Mus musculus
ggagatgtggccttgaggagaaggtgtgtaactaggggcgagctccgagcccacactagatccgtctcactctctgtctgcca

SEQ ID NO: 68130 - DNA, 88 bp, Mus musculus
gtatgtgctctatgaagacaggagattatgatgaattaatctattttttagaatgttcaaggaatcctgtaatttagcacccgtgtac

SEQ ID NO: 68131 - DNA, 98 bp, Mus musculus
cctaacaatttattttgctgagcaaactttttgttttaattaagtcaaaattagctacttttagggctgaaaagttggctcagccattaaaaattagg

SEQ ID NO: 68132 - DNA, 66 bp, Mus musculus
gtctttctgtctgtctgtctgtctgtgcgtgagcacatgtatgtaccatatgcaggtcagaggaca

SEQ ID NO: 68133 - DNA, 87 bp, Mus musculus
agaggaaagcatcagattccttggaactggaattacagaagactgtgagctgccatatggatcctgggaattgaacctgagtcttct

SEQ ID NO: 68134 - DNA, 112 bp, Mus musculus
tgtgtgtgtttatctgcaggcctgtgtgtgtgcctatgtctgcctgtgtgcctgccaaccagcctatacattggtgaataccgtgggtcttatctgctctcttcacctcaca

SEQ ID NO: 68135 - DNA, 85 bp, Mus musculus; identical to SEQ ID NO: 57470

SEQ ID NO: 68136 - DNA, 84 bp, Mus musculus
tggcattccttctctgtcactctcacaggtgcacaaggaaaggtttggagatttgcagggtgacaagaataaaggagactacca

SEQ ID NO: 68137 - DNA, 102 bp, Mus musculus
tctgtagtacagcttgaggtctggcatggtgattcccccagagattcttttatttttgaatatcctaggtttttgctatcctagattttttgttattccaga

SEQ ID NO: 68138 - DNA, 90 bp, Mus musculus
gtgtggatgtgggagaagagacggtggagactagtgatctgggagagaatttatttgtgccactgagctcacttctacctgtacccaaac

SEQ ID NO: 68139 - DNA, 106 bp, Mus musculus
ttattaagatatattgtaaggggttggagagatggcttaacggttaagagcactgactggtgttccagaggtcctgagttcaattcccagcaatcatctataatgg

SEQ ID NO: 68140 - DNA, 116 bp, Mus musculus
gtgtatatgcatgtatgtatatgtatatgtgtgtaagtgtgtatatgtatgtatatgtatgtatacgtgtatgtggatgtatgtgtgttcatgtgtgtgtatgtgcatgtgtgtgt

SEQ ID NO: 68141 - DNA, 79 bp, Mus musculus
gacatcaagaaggacctcaggactcatctgtgatagaaacactgccactttcctgtgtcagaggaacttgtttgtagtc

SEQ ID NO: 68142 - DNA, 117 bp, Mus musculus
aagagtgttgttcagtttccacatgaatgttggctttctattatttattttgttattgaagatcagccttagtgcatggtgatctgataggatgcatgggacaatttcaatattttt

SEQ ID NO: 68143 - DNA, 88 bp, Mus musculus
agtttcacaggcttttcactctgtcctgtatttgctagcatcaaatacagtactgtgaatccagagcaggcatttgatatgtgtaatt

SEQ ID NO: 68144 - DNA, 84 bp, Mus musculus
gagtggcccagtgcctggctcagtggttggcagaggctagaaccctttagcatcccctccagagtgggacactgttgaacactc

SEQ ID NO: 68145 - DNA, 115 bp, Mus musculus
cctgaagtaagagattggatggagagatccaatttgggctgagtgttccaaggtctctcactctctgcatgatgcctgactgtgagtctgtgtatttgttctcatctgctgcagg

SEQ ID NO: 68146 - DNA, 106 bp, Mus musculus
gccttagtccatggtgatctgataggatgcatgggacaatttcaatatttttgtatctgttgaggcttgttttatgaccaattatgtgatcaattttggagaaggt

SEQ ID NO: 68147 - DNA, 85 bp, Mus musculus; identical to SEQ ID NO: 57439

SEQ ID NO: 68148 - DNA, 83 bp, Mus musculus
catgggacaatttcaatatttttgtatctgttgaggcttattttgtgtccaattatatggtcaattttggagaaggtcccgtg

SEQ ID NO: 68149 - DNA, 92 bp, Mus musculus
gcttggacagatcgtacagctgacagggagagatagctcagcggttaagagtactgactgctcttccagaggtcctgagttcaaatgccagc

SEQ ID NO: 68150 - DNA, 84 bp, Mus musculus
acagccagccagctagcagtacacacattattgttccatttgtatgaaaactgttattgtctgcctgcctgtctgtctgtctgt

SEQ ID NO: 68151 - DNA, 99 bp, Mus musculus
tatgtctatatatccatctgtctgcatatgttatatatgtatatagtatatatatatattttatatatagatatagtacagggggtggaataagaggta

SEQ ID NO: 68152 - DNA, 113 bp, Mus musculus
atatgtgtatagttaggtgcatgcatatgagtacatgtgtatatttatgtttatgtaaatgtgtgcaaatgtgtatatttctttgtatacatgtacacatgtatgtgtgtgca

SEQ ID NO: 68153 - DNA, 84 bp, Mus musculus
cctatacatgtttgaatatttatgtgtacatgtgcatattaatgtgtatatacatggatatatttatattaacttgtgtacagg

SEQ ID NO: 68154 - DNA, 144 bp, Mus musculus
gtgtgtggatgagtgtatacctgtacatatgtatgtgtgttcttgtgtgtgtatatgtctgtacatgtctatattcatgctatatatctgtatatttatgtatgcacaagtgtatatttatatgtgtatgtatgtatattcatg

SEQ ID NO: 68155 - DNA, 94 bp, Mus musculus
cactagcctttacaagctcagcttctctataaaaatagctcagcagccacccacagagaagagagtcagtgcccaaagagtaggcaaaatggtg

SEQ ID NO: 68156 - DNA, 94 bp, Mus musculus
ttgacccataggatgttttaaatatatgtatgtatgtatgtatgtatgtatgtatacacacacacacacacacacacacacacttatggaacag

SEQ ID NO: 68157 - DNA, 76 bp, Mus musculus
gggtttcagggaggcctgtttccctcactctgtctttgcttctggcaaacttagactagtgtcttcctgcaaattc

SEQ ID NO: 68158 - DNA, 128 bp, Mus musculus
taggatagtcttcgaacttcactagattacatatggagaaagttgaaaccagtgttcgtcctcttactgtctggtaaagatggggaatcaaacctgttgctaccactggcttgaaaataccaagagga

SEQ ID NO: 68159 - DNA, 120 bp, Mus musculus
gcctgggctaccatcaagggccatgcctgggtctgtggtcctgctgcagctgggggtctgtctcaatgtctgtggccagagttaccaccaaaggccaagtgtaggtctgtgatctgggct

SEQ ID NO: 68160 - DNA, 77 bp, Mus musculus
ggcgagtttgtctctgtgtctcaatttccctcttttataaggggactggccatattggatttagtagtaacttgacc

SEQ ID NO: 68161 - DNA, 62 bp, Mus musculus
atatgtatactatatatgtatatgtataatgtgtgtgtgtgtgtgtgtgtgtgtgtgtgtgt

SEQ ID NO: 68162 - DNA, 76 bp, Mus musculus
gaccttgactagagtcagagtcagagtcagagtcagagtcagagtcagagtcagagtcagagtcagagtcagagtc

SEQ ID NO: 68163 - DNA, 72 bp, Mus musculus
tgtatgtatgtatgtatgtacgtatgtatgtatgtatgtatgtatgtatgtatgtgcctgtgcatgtgtaca

SEQ ID NO: 68164 - DNA, 88 bp, Mus musculus
ccttttgttatatatagtgacactctttatatcttttgggatttattttgttccagtatgtttctctgtcactgtgataaagcactgg

SEQ ID NO: 68165 - DNA, 74 bp, Mus musculus
ttgtgagcaactgtatctgcaggagggactgcctgtgtgtctgtctgtctgggcagggtcaacagtatttgcaa

SEQ ID NO: 68166 - DNA, 85 bp, Mus musculus
ggccatggtggtctgataggatacatgggacaatttcaatatttttgtatctattgcggcctgttttgtgaccaattatatggtc

SEQ ID NO: 68167 - DNA, 85 bp, Mus musculus; identical to SEQ ID NO: 57439

SEQ ID NO: 68168 - DNA, 73 bp, Mus musculus
gtagcagatgtgcagcttgttcttcatgtaagtcccctaacagttgatcagaggctgtctctgactctgttgc

SEQ ID NO: 68169 - DNA, 114 bp, Mus musculus
ggatcagtcatcccagtcactctaggcagagtagcagcatcgtccttaacaaacactgacacactgtcacaggatgttgtgctatcatagtgaagagattggagggtcatgtct

SEQ ID NO: 68170 - DNA, 85 bp, Mus musculus; identical to SEQ ID NO: 57470

SEQ ID NO: 68171 - DNA, 77 bp, Mus musculus
tttcttttatcttcaggggctgtgcacagaactgtgaaacaacacagaatgtgtcttgaggctctgtagaaaagaaa

SEQ ID NO: 68172 - DNA, 103 bp, Mus musculus
ttggtagtgtgattgtgtgtgtgtgtgcgcgcgcatgtgtgtatgtatgtatgtatgtatgtatgtatgtatgtatgtatgtatataatcatgaatatatgaa

SEQ ID NO: 68173 - DNA, 83 bp, Mus musculus
ccagtgccacctcacagctatcttagattgagaaattagttcttattttttctaagaagagagcttttgaggtataattatgg

SEQ ID NO: 68174 - DNA, 88 bp, Mus musculus
cagatagatcaaggtatctataattttaaagtatttctatattaaacatgtggatattatgacaatatggagacccgggtcatatgtg

SEQ ID NO: 68175 - DNA, 64 bp, Mus musculus
atacacacacaaatatatatgtatgtatgtatgtatgtatgtatgtatgtatgtatgtgtgtat

SEQ ID NO: 68176 - DNA, 85 bp, Mus musculus; identical to SEQ ID NO: 57439

SEQ ID NO: 68177 - DNA, 79 bp, Mus musculus
aagaaagactcaggactgccacttcagactcactgactgggagatcctggttctgagcttgctgaggtggtgatgtgcc

SEQ ID NO: 68178 - DNA, 85 bp, Mus musculus; identical to SEQ ID NO: 57439

SEQ ID NO: 68179 - DNA, 96 bp, Mus musculus
gatcagccttagtccatggtgaactgataggctgcatgggacaatttcaatatttttgtatctgttgaggcctgttttttgaccaattatatggtc

SEQ ID NO: 68180 - DNA, 91 bp, Mus musculus
tgagaatgagagagctgaccctgtctctcacagactgcagtattgggtgagctagcagggacagtgctagagagctcaatatgctggtgtg

SEQ ID NO: 68181 - DNA, 108 bp, Mus musculus
gctccagaagggaaattctgtgtgagcaagtgactgaagactgtgagctagtagtgtactccaattctcagctgactttggcctcttgatgtaagagtctctctgtgc

SEQ ID NO: 68182 - DNA, 81 bp, Mus musculus; identical to SEQ ID NO: 63288

SEQ ID NO: 68183 - DNA, 87 bp, Mus musculus
tggcttaatttctaaggaatgtaaagttgtagacattatgcctcagtttggatagatcttatatttcttcatgaagagattgagtca

SEQ ID NO: 68184 - DNA, 79 bp, Mus musculus
gggagacacacccactctgagacaaaggggtaagggttgaggggaaaaactctgtgtgtggtgggggggagggggtcct

SEQ ID NO: 68185 - DNA, 85 bp, Mus musculus; identical to SEQ ID NO: 57439

SEQ ID NO: 68186 - DNA, 75 bp, Mus musculus
atcctttggtggagagaataggaatggacctcagggaacagctgccagtgtgcatctctctctctctgtctggat

SEQ ID NO: 68187 - DNA, 62 bp, Mus musculus
ggagagagaagtcagtgagagcttggttatgtagcatgcacaaggctctagattctgtctcc

SEQ ID NO: 68188 - DNA, 56 bp, Mus musculus
tgtgtgagtgtgaatgtgtgtgcatgcacgctcacacacacacacacagtcacaca

SEQ ID NO: 68189 - DNA, 103 bp, Mus musculus
tgcctcaaagtgtacaagagcagacggtgtgattttttagttttcataagtagattcttctgctgtggaaaacaaatcaaaagtgtgccacttacctagggca

SEQ ID NO: 68190 - DNA, 118 bp, Mus musculus
gaaagcatttgcatgtagatgtgcatgtatctctgtgtgcattcatatgtgtatgtgtgcatgtgcatatgtctttgcatgcatgtatgtctctgtgtgtgcatttgtgtgtctatgc

SEQ ID NO: 68191 - DNA, 85 bp, Mus musculus; identical to SEQ ID NO: 57470

SEQ ID NO: 68192 - DNA, 101 bp, Mus musculus
cagtaagcagtgtctctccatgatctaagcttcggtttctgtcttcaggctcctgccttgaaaccctgccatgtcttctttcaggaaaggattgttacctg

SEQ ID NO: 68193 - DNA, 74 bp, Mus musculus
gtgtgtgtgtgtgcatgtaagtgtgtatgtatgtatgtatgtacgtatatatgtacgaatgtatgtatgtatgt

SEQ ID NO: 68194 - DNA, 109 bp, Mus musculus
catcccttggaacatagcacatcaccagcaaatacatgtgaagacattaaattttattgtttcatgttcacatccagtatgttgacacaaatgcagtgagtaagagatg

SEQ ID NO: 68195 - DNA, 106 bp, Mus musculus
gtcaagttcaaaggactactgcaattatattttgagagaaattgttcttttatttttagaaaccatatatctttaaaattaatgaagaagttcttttagttttggc

SEQ ID NO: 68196 - DNA, 85 bp, Mus musculus; identical to SEQ ID NO: 57470

SEQ ID NO: 68197 - DNA, 79 bp, Mus musculus
caacaagtgcttgttgtcagaagcctggtatatctgtctcctgagaggctctgtcagtgcctgacaaaaatagaggttg

SEQ ID NO: 68198 - DNA, 143 bp, Mus musculus
gatgatactggactgaacctctgaacctgtaagccagcaccaattaaattttgtattttataagacttgcattggtcatggtgtctgttcacagaactatgacagtagtattttccaaattaaaagttaagttatggccacag

SEQ ID NO: 68199 - DNA, 106 bp, Mus musculus
gccttagtccatggtgatctgataggatgcatgggaaaatttcaatatttttgtatctgttgaggcctgttttgtgtacaattatatggtcagttttggagaaggt

SEQ ID NO: 68200 - DNA, 85 bp, Mus musculus; identical to SEQ ID NO: 57470

SEQ ID NO: 68201 - DNA, 109 bp, Mus musculus
tttctttcagccaatgtatttgaccattccacttgtgtgtacatctgtgattatttttctattttcgtcaaatgttcatcagaagaaaagcaggaagggtggtaagaga

SEQ ID NO: 68202 - DNA, 113 bp, Mus musculus
atggtgattagttttgtacatcaagtggtccatcatcggtgctcagatatatatatatatatggaagtacgcctctgatggattttctgcatgagaacactactaggattggt

SEQ ID NO: 68203 - DNA, 81 bp, Mus musculus
ggtttatttggctcacattcccatatcactgttcatcattgaagaaagtcaggacaggaacctggaatggagatcagaatc

SEQ ID NO: 68204 - DNA, 116 bp, Mus musculus
ttgagagagtaactaggaaaatagtatcatttggtgataaatcttccttgtattaaattatacatattttgatagaatattatctgcatgaacacttcttttatatcctctgtcaa

SEQ ID NO: 68205 - DNA, 106 bp, Mus musculus
gccttagtccatggtgatctgataggatgcatgggaaaatttcaatatttttgattctattgaggcctgttttgttttcaattagatggtcagttttggagaaggt

SEQ ID NO: 68206 - DNA, 85 bp, Mus musculus; identical to SEQ ID NO: 62897

SEQ ID NO: 68207 - DNA, 80 bp, Mus musculus
gtcaaagatcaagtgaccatagctgtgtggattcatctctgggtcttcaattctgttccattggtctacttgtctgtcac

SEQ ID NO: 68208 - DNA, 124 bp, Mus musculus
gatattaaaaacatattatgagaagagacattatggttaggacttatttttatgaatatcatattctgattttcttctagatattctggtgatgttctctactggttgtcactctaaaaaaatg

SEQ ID NO: 68209 - DNA, 85 bp, Mus musculus; identical to SEQ ID NO: 57439

SEQ ID NO: 68210 - DNA, 58 bp, Mus musculus
tatgtatgcataaatatatgtatgtacatatgtatgtatgtatatttctgtgtacatg

SEQ ID NO: 68211 - DNA, 81 bp, Mus musculus
attaagcatgtaaagatttttcatatttatccaatgtctgatattatgataaatagcccaaaattgtaaaacatgcttgat

SEQ ID NO: 68212 - DNA, 95 bp, Mus musculus
tctattactggatcaagcatatggtagattatttttactttttgagaaatctccagagtggttgtaccagcttgccatcccaccaaaagtgtaga

SEQ ID NO: 68213 - DNA, 88 bp, Mus musculus
tgcatatatattcatttgcatatatgcatatatatgtatatacataaatgcatacatatacatacacatacaaatgcatacatatgta

SEQ ID NO: 68214 - DNA, 96 bp, Mus musculus
gtgtggctggtaaagaatttctcctattttgtatgctgttaactttgttgattattttgtttactataaagaaactttattttcatgaagccacat

SEQ ID NO: 68215 - DNA, 95 bp, Mus musculus
tatatgagcatgtaaatatatatgtatacatatgtctgcacatgtatatatatatatatgtgtgtgtgtgtgtgtgtgtgtgtgtgtttgtgtgt

SEQ ID NO: 68216 - DNA, 91 bp, Mus musculus
tggaaaaaaaagtggctcatcagggcacaagaataatgctttataatgggtttgcactgtgtgtctatgtgtgtctacttgtatgttttta

SEQ ID NO: 68217 - DNA, 105 bp, Mus musculus
atgtttgtatgtatgttaatgtgcatgattatgtgtgtgagtatgtgtgcttgaatatgtatacttgattatatatacatgcatatatataagctacacaaatat

SEQ ID NO: 68218 - DNA, 115 bp, Mus musculus
tcctgaaaggaaagctagggctgaacgggatggatggtgagagaagaatgagaccaagacaaagtttctgttcaaggcttaatgatttaatacttgagtctaagttttaaaggga

SEQ ID NO: 68219 - DNA, 77 bp, Mus musculus
tctgacactctcggtcttactgttttcaaaggttataaagtaggattttccttgaaatggacctgagactattcaga

SEQ ID NO: 68220 - DNA, 85 bp, Mus musculus
gtcatcaggggctgagtgggtctgggagagtcagtgcatcgcaaagagatgcagacatttcagaaaactgagaccagaggaaggc

SEQ ID NO: 68221 - DNA, 78 bp, Mus musculus
aggactttaattccagagtttgcatggttatgtcattagaaaacttaattgtgtacagaactctgtctctaaagtgct

SEQ ID NO: 68222 - DNA, 90 bp, Mus musculus
gctccataccccgttctccttgtcagtgacctaccctattaatttctaggatttgtgactggaagactagagtcatggttcagatgtagc

SEQ ID NO: 68223 - DNA, 85 bp, Mus musculus
ctgtctgtctctctctctctctaggtgcctgtggaggcctgatgcctcagatcttctgcagctggagtggttgttagttgcccag

SEQ ID NO: 68224 - DNA, 104 bp, Mus musculus
ggcagaaattcttgtctcagagaggtaagctggtactttatgaaatatatgcatttcctatgaatatagtttctagtctctgtctctgactctgtctgtctgtc

SEQ ID NO: 68225 - DNA, 85 bp, Mus musculus; identical to SEQ ID NO: 57439

SEQ ID NO: 68226 - DNA, 85 bp, Mus musculus; identical to SEQ ID NO: 57439

SEQ ID NO: 68227 - DNA, 80 bp, Mus musculus
cccacaattgtcgtctgtgcttggacatgggaaggcttcttgctgttttagtgtcagaaaatgagagcacagagtgtggg

SEQ ID NO: 68228 - DNA, 115 bp, Mus musculus
ctgtgtatataatgtgtatatatatgtgtgtgtgtgtatgtatatataatatatatatgttaatatgtgtatatatatatatacatatatatatgacatacatgtgtttagtcag

SEQ ID NO: 68229 - DNA, 81 bp, Mus musculus
cttgaggagatctctagtttcgagaaacacttgagttattctactactgttttatcagggtttctttagtaatttcccaag

SEQ ID NO: 68230 - DNA, 75 bp, Mus musculus
tctgtatgtatgtatgtatgtatgtatgtatgtatgtatgtatgtatgtatttcatgtgcatgtgtgtgtgagga

SEQ ID NO: 68231 - DNA, 79 bp, Mus musculus
acatattcactgtgtgtgtgtgtgtgtgtgtgtgtgtatgtgtctgtgtacgtgcatgtgtgtgtgtgcatgtgcatat

SEQ ID NO: 68232 - DNA, 77 bp, Mus musculus
tgggaatcaactgtagtgtggagtttggcctcaaagagtggccagatcttcactgtgcttgtcagtgaatataccca

SEQ ID NO: 68233 - DNA, 85 bp, Mus musculus; identical to SEQ ID NO: 57470

SEQ ID NO: 68234 - DNA, 115 bp, Mus musculus
gtggtgttgaagagatgttggcacaggggaattcctggggaatagagagaagtgagtgtccgcaggggactacagctctctaccaggtagacgtgccggctgggctgcttgcctc

SEQ ID NO: 68235 - DNA, 83 bp, Mus musculus
tgatttatcattgccaggactggagagatagctcagcagttaagagcactgactgctcttccagaggtcctgagttcaattca

SEQ ID NO: 68236 - DNA, 56 bp, Mus musculus
ggggcttgagagatggctcagttgctaacagcactgactgctcttccagaggtcct

SEQ ID NO: 68237 - DNA, 75 bp, Mus musculus
gcagatgcagcagagtcagagtacacagaggggaccactcctggctctgtggatttccatggctttgccccctgc

SEQ ID NO: 68238 - DNA, 78 bp, Mus musculus
ggagaaggtgggactctgggggtgggctctaaggtttcaaaagtcacatcaggtccagtgtctctctgtctgccgcct

SEQ ID NO: 68239 - DNA, 81 bp, Mus musculus
tacttacatgtatgtgtgcacacacgctcacacacagatgcacaccacgagatgtgtgtgcttacactgtatatgtgcgta

SEQ ID NO: 68240 - DNA, 79 bp, Mus musculus
aacatatgtagcagatgtgctgcctggtcttcttgtgggtgccccaagaactagagcaggggctgtctctgactctgtt

SEQ ID NO: 68241 - DNA, 94 bp, Mus musculus
gtatgtatgtgtgtgtgtgcgtgtatatgtgtgtgtatatatatatatatatatatatatatatatatatatatatatatatatatatatatac

SEQ ID NO: 68242 - DNA, 110 bp, Mus musculus
gcccctgccccgacagcaaccaggttccccaggactgtctctgcctctgcctctcccaggcagctccaccaggcgcaagataccctcgaagaagctgggtcgcaggctgc

SEQ ID NO: 68243 - DNA, 76 bp, Mus musculus
acatctggactctcactgtctctgtccatcaaatgagtttacataacaggagatttgcacagtgggaggcagctgt

SEQ ID NO: 68244 - DNA, 67 bp, Mus musculus
gcagagaaacactctctgactcacttgataatatgttcagtgaagtcttagagatgtgggtcacttc

SEQ ID NO: 68245 - DNA, 92 bp, Mus musculus
ccccagtcaatcaggacaattttattattttcatagctgttttagtgatgaaggataatgagtggacttttgttgtcatcgttgtgttgggg

SEQ ID NO: 68246 - DNA, 69 bp, Mus musculus
tgttaacagtacagtctgtgctgagggcagcctggggtggtgtgaactgtacagtctgtgctgagggca

SEQ ID NO: 68247 - DNA, 59 bp, Mus musculus
agttgcataagcacaagtgagtgtggactaatgtccaacacagacttgaacttaagact

SEQ ID NO: 68248 - DNA, 60 bp, Mus musculus
gtcgggagtctggcagggagctgggagtcacctaaacccacagagtctctgagtctcgac

SEQ ID NO: 68249 - DNA, 97 bp, Mus musculus
gaataccagggggctggagagatggctcagcagttaagagcactgactgctcttccagaggccctgagttcaattctcagcaaccacatggtggctc

SEQ ID NO: 68250 - DNA, 137 bp, Mus musculus
tgtgtgtgtgtgtgtgtgtgtgtttgtgagagacagacagacagacacagacacagacagacagacagacagacagagagatgtgtgtgtacatgtgtttggagaccaggtctctgctgtatggtcttggctggtct

SEQ ID NO: 68251 - DNA, 59 bp, Mus musculus
ggggaggaggcagggtctggggtagatgggaatcagagctcaactgtgtctgtctctct

SEQ ID NO: 68252 - DNA, 73 bp, Mus musculus
tagtgtgggtgttctacagggaagtcctctgatgccctcgggcattctgtctctctctcttagaaactaactg

SEQ ID NO: 68253 - DNA, 78 bp, Mus musculus
gccctacccctctgctttttagagtggacaagttaaagaaacctctgacagtcactgtgtgacagcctggggtagtcc

SEQ ID NO: 68254 - DNA, 84 bp, Mus musculus
gggctggagagatggctcagtggtcaagagcagttatgagcactgactgctcttccagaggttctgagttcacttcctagcacc

SEQ ID NO: 68255 - DNA, 93 bp, Mus musculus
gtggtccatcacgctagccctcagaaattctttttcattttgaactggaagcattgaaacagggtctctaaagtcctagctgtcctggatctc

SEQ ID NO: 68256 - DNA, 118 bp, Mus musculus
tcccgtgttaagtcaggtttttaagaacaagctctgactggtgagatggttcagtggttaagagcactgactgctcttccagaggtcctgagttcaaatcccagaaaccacatggtgg

SEQ ID NO: 68257 - DNA, 79 bp, Mus musculus
cagagactcttctaggattgattaggggtggagtatgggcacagtgtgtgtctgtcttatctgtctgtctgtgtctctg

SEQ ID NO: 68258 - DNA, 93 bp, Mus musculus
ggtagtcgggctgttctcccagtcttcgggtgtgtgagaacggctaggagaagagctacactcacactctcggactcggttgccgcctcttcc

SEQ ID NO: 68259 - DNA, 100 bp, Mus musculus
catatatatatacatatttgtgtaaatatgttatatatgtacacacacagacacacacatatatatacatatttgtgacagttttgctatatatttaatg

SEQ ID NO: 68260 - DNA, 82 bp, Mus musculus
catgtaagttgcataatactgtgtttgttcatgtggtgttacatcactcaaactgtgcagttcacagtcagtagctcaggtg

SEQ ID NO: 68261 - DNA, 109 bp, Mus musculus
catgatgtatgtgtgtgtaccctatgtgtgcctggtgtcagaagtcagaaagcacaatattacctgaaattggagttacagagggttgtgagccaccatgtgggtcctg

SEQ ID NO: 68262 - DNA, 98 bp, Mus musculus
atgtctgcacatattcagtagcaatgtaattattttcatatatgtgtgtggtatgcatgcatgtatgtatgcatgttcaagtgtgtttgggtagatat

SEQ ID NO: 68263 - DNA, 81 bp, Mus musculus
tgcataagcgatgcctgcatgtatgtatgtatgtatgcatgcatgcatgcatgcaccacatacatgcctggtgcttgtgga

SEQ ID NO: 68264 - DNA, 81 bp, Mus musculus
gctggggtaaggagagacagagactggcagatggtaagtagtcgcttcccagatgccagtgtctgtctgtctgtctccagt

SEQ ID NO: 68265 - DNA, 71 bp, Mus musculus
catggtggctggctggtcactgaaactcattttctgcactctgactgtgagtttctgagttaaataccatg

SEQ ID NO: 68266 - DNA, 103 bp, Mus musculus
cgcggccggggccgctagctcgctcgctcgctcgctctctcgctcggcagcactcgggcggcggcggcaggagcgtcgaggagttcggctgggctcggctgcg

SEQ ID NO: 68267 - DNA, 99 bp, Mus musculus
ctttttactttaaaagtttttattacacttatgaatgtatgtatgatgtatgtatgtatgtatgtatgtatgtacatgttcaggtgttgaggttaaaag

SEQ ID NO: 68268 - DNA, 73 bp, Mus musculus
ctcataccaggatctgggtcactcactcagattcacaggaggatctgggtgttcctgcttagacgcgtattag

SEQ ID NO: 68269 - DNA, 117 bp, Mus musculus
ccagctgcctcctggggcactaaaaggcctcctgtacaatccagtttgtaagacaaggtttagacagaagggagtgtgctaagaattactttgaagtcagccttctaggggtggtgg

SEQ ID NO: 68270 - DNA, 136 bp, Mus musculus
tgtctctgtgtgtggcgatgtcagtgtgtgtgaggctcagaaactggtgtcattggtgtgtctgtcagcgtctgtcagtgggcaatttttctttaggtgtttgtttgggagaagggctgtgaccacaccgggggat

SEQ ID NO: 68271 - DNA, 84 bp, Mus musculus
tgctgtgacagactgctgtgagctgtgaggtaaaagtagacccctttctcccttaagtcactctgtcagtgttttatgacagca

SEQ ID NO: 68272 - DNA, 119 bp, Mus musculus
tcttattgtagcttgttatgccttgtttggtggatgtccctgggagggctgctctttcctgagaagagacagagcagggtggatctgggggaggagggataaagggagagactggagga

SEQ ID NO: 68273 - DNA, 67 bp, Mus musculus
cctgctgctagagagatgagagagagcaagacccagtgctaaggtgtcattacagtttggctgtagg

SEQ ID NO: 68274 - DNA, 115 bp, Mus musculus
gctccaagtctcaggcctctccatctttgctgtcccagacaggtgttcaaacatccagatgtctgagagctcaagtgtcagtaggagaggtggcaggagggagtcacagtggggt

SEQ ID NO: 68275 - DNA, 64 bp, Mus musculus
cctctgcctatccactattctctgtctgtgtctcctgggacttcaagagagaatacgcagaagg

SEQ ID NO: 68276 - DNA, 70 bp, Mus musculus
gtgcagagtgagcagaaccctggttcagtcccaaaaaagcaggggagagctgacttttctcactctgcac

SEQ ID NO: 68277 - DNA, 91 bp, Mus musculus
tgccttcacattcctgctgtgacagactgctgtgagctaaaagtagacccctttctctcttaactcactctgtcagtgttttatgacagca

SEQ ID NO: 68278 - DNA, 67 bp, Mus musculus; identical to SEQ ID NO: 68273

SEQ ID NO: 68279 - DNA, 115 bp, Mus musculus; identical to SEQ ID NO: 68274

SEQ ID NO: 68280 - DNA, 68 bp, Mus musculus
ccagtcactctctctcacaaggtgccgtgtgtggcaaataactcaagattctgaagataagtgactgg

SEQ ID NO: 68281 - DNA, 63 bp, Mus musculus
ctcagggactggagagataactcagtggttaagggaactgactgctcttccagaggtcctgag

SEQ ID NO: 68282 - DNA, 59 bp, Mus musculus
tcatctggatactttgcagccaaaatatcttcgtatttggttgcaaagtatccagatga

SEQ ID NO: 68283 - DNA, 104 bp, Mus musculus
cggatccggaggctggtggcaagctagagctccaggcaaaagctagctctctctctagctctcattctgtctcgcctctgcctctgcctctgcctctgcctctg

SEQ ID NO: 68284 - DNA, 106 bp, Mus musculus
agttcaagaagaaaaactcacatctaaagaggttagccattcggcttgttaaccttgtgttctgtggattgtagcctcggtattctgtacttttttttttttggct

SEQ ID NO: 68285 - DNA, 81 bp, Mus musculus
gtgtgtatctgtgtctgtgtgtatctgtgtctgtgcgtgtgagagagcgagagagagaacatgcacacacaattaaaacat

SEQ ID NO: 68286 - DNA, 95 bp, Mus musculus
cagagggagaataaggatagtagaacacagaatgtgcgagtaactcaaagctagacttgagattctgatgttctcttctctccttaggccagctg

SEQ ID NO: 68287 - DNA, 71 bp, Mus musculus
tggattcttggagtttttgttgggagacagccattgttggattagctggctcccagcctgtaagccatcca

SEQ ID NO: 68288 - DNA, 118 bp, Mus musculus
ggtggtggtggtggtggtggtggtattggagagatggctcagcagttaagagcactgactgctcttccagaggtcctgagttcaattcttagcaaccacatggtgactcacaaccatc

SEQ ID NO: 68289 - DNA, 111 bp, Mus musculus
gtgtatccttgttggaggaagtgtgtcactgtggggatgatgagttgtgtttttgaggttacatatgcttaggctttggtcagtgaggcatgcagtctcctttggttgcat

SEQ ID NO: 68290 - DNA, 78 bp, Mus musculus
tctgacctgtcccctggctcactttttatttttttagaggtatcctttgaaagcacagtgaggtttgatgaggtaaga

SEQ ID NO: 68291 - DNA, 102 bp, Mus musculus
ggaggaggaggaggaggaggaggaggaggaggaggaggagggctcagtggttaagagcactgactgctcttccagaggtcctgagttcaattcccagcaacc

SEQ ID NO: 68292 - DNA, 91 bp, Mus musculus
gggagataaggaaaccaatggttgagctgtagtgattgctcggcaattatgagcactgactgctcatccagaggtcctgagttcaattccc

SEQ ID NO: 68293 - DNA, 99 bp, Mus musculus
gagccattacttatgctgtcctcactgtctgacatgccctgctcatttctctctcactggtaggggtctggtttgtctctttaggccagctctggtctc

SEQ ID NO: 68294 - DNA, 110 bp, Mus musculus
agcaagtggaatatgtatatatgtgtacatatgtgaatgtatgtgtatatatgtatatatgtgtatatgtgtgctatacgtgcatatatatgtgtgtatgtgtgtgtgtg

SEQ ID NO: 68295 - DNA, 75 bp, Mus musculus
gcaggtgcacaacttggtcttcctgtgggtcccctaatagttgaagcttgggctctctctgactctgtggcctgc

SEQ ID NO: 68296 - DNA, 85 bp, Mus musculus; identical to SEQ ID NO: 57470

SEQ ID NO: 68297 - DNA, 116 bp, Mus musculus
tatcacacttgctttcatgaaaggctgtaggacaattctggggttcccctcactgtgtcagtcagagcctgaggagttgccgtcagcccttctgtagcagagcattctgactgatg

SEQ ID NO: 68298 - DNA, 113 bp, Mus musculus
tagcacccacgttgtaatagatgttcactgaagatccagttagagtgaataatgacagcagatgtgatagtacatgacttaggaacagcctaataacagcactttggaggctg

SEQ ID NO: 68299 - DNA, 84 bp, Mus musculus
tctgttagattatcccagacttgctaagagtatgttataagccaatgccggtgacgtacacacacgcactgtgggagtcataga

SEQ ID NO: 68300 - DNA, 96 bp, Mus musculus
gaatgatctgtctatttttgagagagtggggtattgcattctcacactatcactgtgtgagggtcaatactgtgatcttagttgtagtagtgtttc

SEQ ID NO: 68301 - DNA, 78 bp, Mus musculus
tctcgccgggtgcagtttgctctcgtatttagtcttttccctcctgtgtccactgagaagaaactgaggcctgtgaga

SEQ ID NO: 68302 - DNA, 74 bp, Mus musculus
ggctagaagtatgcagtaagaactcagggtgctgaggcacacccagctcacctgaccattctgccattctgacc

SEQ ID NO: 68303 - DNA, 87 bp, Mus musculus
tctgtattgggtctggtagaaggtagaggacagcaaggggaacctgagctctcactggtaaattatattcctctaaaggcaggcaga

SEQ ID NO: 68304 - DNA, 89 bp, Mus musculus
gttcaaggctcacttcagtacagagagaggtcaaggccaggtggggctgcatggaagcctctgggacaggcaaagtggggatggggagc

SEQ ID NO: 68305 - DNA, 112 bp, Mus musculus
tcctgagctaggctgcagttaccaagtatccctagtgctcaacatttgcaggctagagactcacacagtgtatcagcttaggagtgtggtaaaaccttagcctaatcaagga

SEQ ID NO: 68306 - DNA, 110 bp, Mus musculus
taaaacttttaattttgaaactttgcaaggtaaagtgatgattaagtcagtgacacagtcactaacttagagtccttttcttttccttgtttttgtttttgtttgttttg

SEQ ID NO: 68307 - DNA, 81 bp, Mus musculus
aaacaaaaacaaggaaaagaaaaggactctaagttagtgactgtgtcactgacttaatcatcactttaccttgcaaagttt

SEQ ID NO: 68308 - DNA, 102 bp, Mus musculus
tgtcaagcatgtagcagaaaggacacggattgatagatataatgagaagattccaaattttatatctatatctgcatctgcacctgtatctatatctacaca

SEQ ID NO: 68309 - DNA, 88 bp, Mus musculus
agaccgggtttctctgtgtatcagtgtctgtcctggaactcattctgagatccaggctggccttgaactaagaactctacctgcatct

SEQ ID NO: 68310 - DNA, 101 bp, Mus musculus
gtcacctaagagtgtctccatgggatctctcactactgagtcagcacagcctgacagataacaggctttgagattagagagatcttggttttcattgtgac

SEQ ID NO: 68311 - DNA, 88 bp, Mus musculus
gaatttgatttgggggactggagaggtggctcagaggttgagggtgagcgctgactgctcttccagaggtcctgagttcaattcccag

SEQ ID NO: 68312 - DNA, 60 bp, Mus musculus
atgtatgacatatatatatgtatatacatgtatgtgtatatttatatgtgtattgtgcat

SEQ ID NO: 68313 - DNA, 85 bp, Mus musculus
tcaggacagctttgagcacagagcatagaggaagccagcatgaaggttggggacttagcagctctgtgcctctcactgactctga

SEQ ID NO: 68314 - DNA, 94 bp, Mus musculus
gtgtgtatgcatgtgtgtctgtgtatctgtgtatgtgagcatgtgtgtgcatgtatgtgtgtgtgcacatgtaagcatgcatgtgtgcatgcat

SEQ ID NO: 68315 - DNA, 68 bp, Mus musculus
tgccagcaagcatcacagtgtcttagttagggtttcagttgctgtgaagagacacaatgaccttggca

SEQ ID NO: 68316 - DNA, 83 bp, Mus musculus
tgactgtctgtctgtctgtctatcatggcacgcacattcacgtgactacatgtggaggaggccatgggacaacctcggggtca

SEQ ID NO: 68317 - DNA, 83 bp, Mus musculus
gatggctcagtagttaagaacactggctacttttccagaggaccttggtctgactctcagtgcctgtgtagctatggaggctc

SEQ ID NO: 68318 - DNA, 110 bp, Mus musculus
agcagtatgagggcttagaatgctgtaccttaaaccatccccctctcaggactgtctgtctgtctgtcatggatccccctctcaggactgtctgtctgtctgtcatagct

SEQ ID NO: 68319 - DNA, 83 bp, Mus musculus
ttgactctagattccctgcagaccgtgtcactggcctttgagtagggcccagcacagagagaggactcagggcatggagccaa

SEQ ID NO: 68320 - DNA, 148 bp, Mus musculus
cttacactcattttctctctctcttacactcactttctctctctcacacacaaatacacagccacactcattcacactcacactcacactgggagagggagcatcatgagtttgtaagtgcggagtagctaggctccccagtatcccg

SEQ ID NO: 68321 - DNA, 70 bp, Mus musculus
tgtgtgtgtgtgtgtgtgtgtgtgtgtgtccgagctcatggatgtgtgcctatgtacatgcacacacaca

SEQ ID NO: 68322 - DNA, 104 bp, Mus musculus
caggccctttaatgttttcactcactttgttctctctttctctgaaataacctaagagctatggcaagggaccacggtgtgctggaacacattcctgagacctg

SEQ ID NO: 68323 - DNA, 109 bp, Mus musculus
cagtctgctgggattgggcagggcatgatctagagaagactttgtgagagagatgacactgagcagagcctttgaggaaaagcaatgtgggcaagaggaacagcaactg

SEQ ID NO: 68324 - DNA, 89 bp, Mus musculus
tctctgtgcaggtgtgtgcctgtgtgactgtctgctatgtgtacgcaggcatctgcagaagtcaggagagggcatcaaatcacatgggg

SEQ ID NO: 68325 - DNA, 102 bp, Mus musculus
gtagaaatcacatttacctaaactgcaattataacataatatttgaactgtgtaacacattcatccattaacagtgaatgcataggaaaatgtgtattctac

SEQ ID NO: 68326 - DNA, 85 bp, Mus musculus
ggatacccatcagaatcatctggataatttaaagccttgtttcctgccttaaccttgtctagagaaattcttgatgtgagaatcc

SEQ ID NO: 68327 - DNA, 116 bp, Mus musculus
cattgcatcactctggaccggtgtcttgcctggatggtatctctgtttctctctgtatttcaaattgccaaaatcagtttatccactgcaggattggcgtacaaatgaacgtaatg

SEQ ID NO: 68328 - DNA, 73 bp, Mus musculus
ggagtgtccctttccctctgactcacagtgccctcaagcaagctgggcacataagcagagagaagaagaagcc

SEQ ID NO: 68329 - DNA, 73 bp, Mus musculus
gcagggaaagatgtgcatgcttttcttgtagggtttattattattactacacattgtgtgtgtctgtctctgt

SEQ ID NO: 68330 - DNA, 74 bp, Mus musculus
tggggaagggtgtccagtctctctctgtcagccaactgctatacccaggggtagagctggcttttgttttctca

SEQ ID NO: 68331 - DNA, 98 bp, Mus musculus
ggggtccttcttgtcactctcagaggagagagagctgtgagtgctgcacccaactgttatctctgaccgccgtgtgatgtcactggaagagctgcccc

SEQ ID NO: 68332 - DNA, 80 bp, Mus musculus
ctgtctattggtgagagtggagtattgaagtctcccactgacagtgtgtgaggctcaatatgtgatttaagccctagcag

SEQ ID NO: 68333 - DNA, 61 bp, Mus musculus
gcttgcctctggtgaggatctgcaggcttctgcatcatgagagtcagcacacagtggcagc

SEQ ID NO: 68334 - DNA, 129 bp, Mus musculus
gactgttccgaagctcatcaataagtggggtggaaagcctggtgaggccatgtgggcacagtcgcacagtccctgggtcagaccccactgctcccagggctggacactcctatctgctgatgctgggct

SEQ ID NO: 68335 - DNA, 115 bp, Mus musculus
gtttgggcaaatcggtaaaagctgagagattgtgagactttgtgaactttgaagaaatgttgtctctagagaatctgcacttacattccaacatgggcttactctacacacagac

SEQ ID NO: 68336 - DNA, 71 bp, Mus musculus
cttttgcagaggactcaggtgcagttcctgctgacaggacacaggcagctgacaactgtctgcaacttgag

SEQ ID NO: 68337 - DNA, 63 bp, Mus musculus
ctctttgtcagacagaggggtctccctgggagaagagatggactcactctgtggctcagagag

SEQ ID NO: 68338 - DNA, 114 bp, Mus musculus
gagacagcaggcgcagattagcgctccagtccagcatgtttatgggattcctgtgtgagtctctgattcttgtgccttctcttgagctcttctccttctgtttgtttctcctgt

SEQ ID NO: 68339 - DNA, 100 bp, Mus musculus
gagttgagtccaagggctggagagatggctcagcggttaagagcactgactgctcttccgaaggtcctgagttcaattcccagcaatcacatggtggctc

SEQ ID NO: 68340 - DNA, 88 bp, Mus musculus
gtccttatgagacttgccttggtcatggtgtctgttcacagcagtaaaaccctaagacacactcactcaggtttccaagtattgggac

SEQ ID NO: 68341 - DNA, 168 bp, Mus musculus
gaacttctgcttccatgtggggacctgccattaatgggcagagctcagtttctcagtttctcagtttctgcttccatgtggggacctgccattaatgggcagagctcagtttctcagtttctcagtttctgcttccatgtggggacctgccattaatgggcagagctg

SEQ ID NO: 68342 - DNA, 95 bp, Mus musculus
gactgtaacgtttaacgtcactctctcactgtcatcatatctgtcttcagagattgggccagctgtgagcagcaagtggcaaatgtgttctggtt

SEQ ID NO: 68343 - DNA, 114 bp, Mus musculus
ggagggctaggagtgacttcgacttgtagatgggtgcctcctcgccaattctgtctctgtctctggcagattatgcagaaggtctgattatccctctgctccctcactctctcc

SEQ ID NO: 68344 - DNA, 60 bp, Mus musculus
tgctctgcctgtctcccacccactgagagactggggggggggtttgcacagggaagggca

SEQ ID NO: 68345 - DNA, 108 bp, Mus musculus
gcagacagaagcacaggacaggtgcctagtgaagtctcagagcctctgtgtgtgtgctgcaggtgtgtccccactggtagatgaggagccctgagtctcacagggagg

SEQ ID NO: 68346 - DNA, 75 bp, Mus musculus
ctgtctgtctgtctgtcttgctgtgacatctgtgaacatgctgtggaatgttgttgctctgcagacaggggacag

SEQ ID NO: 68347 - DNA, 65 bp, Mus musculus
gtatgtatatatgtatgcatgtatgtatgtatgtatgcgtgtatgcatgtatgtatgcatgtatg

SEQ ID NO: 68348 - DNA, 68 bp, Mus musculus
atatatatatatatatatatatacacatatatgtatgtatgtatgtatgtatgtatgtatgtatgtat

SEQ ID NO: 68349 - DNA, 109 bp, Mus musculus
tctgccttttcacatacaaagtgtctgatgaaaatactgtcactctctcaccttgttcctattgtggggaagttagaagtatgtaggcaggtaggggaaacagggtggg

SEQ ID NO: 68350 - DNA, 73 bp, Mus musculus
gctgtttatgtcagcgtgggcaaagccactgccatcttgaattccagtggctgtgatcacctgcaggagacac

SEQ ID NO: 68351 - DNA, 115 bp, Mus musculus
tgtatatgtaaggatttgaatactaagaaatatagatcacccccccacacacacacacacacccatcatatggggccagcatcttgtctcagcaggtttaagcttttgctgtgca

SEQ ID NO: 68352 - DNA, 90 bp, Mus musculus
gagggagataaaggactgagaatagtgtgggcttctaactcagtatgtgctgggcagatctctttctctcactgagcctcagtttccctt

SEQ ID NO: 68353 - DNA, 85 bp, Mus musculus
tctatgtgtctgtatctctctgtgtgtgtcttgctgccatgcttatcacaacaggctcccaggcactgagaggagggaaggcaca

SEQ ID NO: 68354 - DNA, 68 bp, Mus musculus
gctgtgcctcttgaggcggctctctctctctctgctagatgcaaatgttgcttctctgggccattagc

SEQ ID NO: 68355 - DNA, 91 bp, Mus musculus
gcttcctagacatgccccccaggccagtgagacagaggcagtcccccaaaggagactctctcaatcactctgggctgtgtcaagttgaagc

SEQ ID NO: 68356 - DNA, 66 bp, Mus musculus
aaccgggggctgaagagatggtttaatggctaagagcactgactgctctttcagaggtcctgagtt

SEQ ID NO: 68357 - DNA, 264 bp, Mus musculus
gtgtgtatgtgtatgtatgtatgtatgtgtgtgagtgtgtatatgtatgtgtgtgtatgtgtatatatgtgtgtatgtgtgtatatgtgtatatgtgtgtgcatatgtatgcatatgtgtatatgtgtgtatgtgtatgtatatgtgtgtgtgcatatgtatgcatatgtgtatatgtgtgtacacatgtgtgtatgtatatgtgtgtgtgcatatgtatgcatatgtgtatatgtgtgtacacatgtgtgtatgtgtgtatgt

SEQ ID NO: 68358 - DNA, 120 bp, Mus musculus
tttggccacttaggtgtctagaaagctctgctagcccatatactatcagctgctctgtcatcagagccagctttgctgtggcacggagctgtagacagacctggctggtgaccgagacgc

SEQ ID NO: 68359 - DNA, 83 bp, Mus musculus
gggctgtcactggtgggcctcactgggaagtgatgtgtggagtgttctctccctgtgcagagcaaagcctaagtaactggcct

SEQ ID NO: 68360 - DNA, 104 bp, Mus musculus
tttgtgagctcatgcgtgtatgtgtgtacatgtgcatatgtgagtgtgtgcacacatgtatgtgtgtgtacatgtgtgaatgtatgtgcgtgagcatgtgcaag

SEQ ID NO: 68361 - DNA, 63 bp, Mus musculus
gagcctcagtcacagtcaggagcctgagaccttgccctggctctgtgtgtctgtaagtggctt

SEQ ID NO: 68362 - DNA, 63 bp, Mus musculus
ccctccttctcccagtgtcctccgtgtctcaccgtgacagacagatgggagtgtgttcaaggg

SEQ ID NO: 68363 - DNA, 79 bp, Mus musculus
gacaataaatgccttaaaaccatggactgcctctcttcatcaggatttggcgagaggagcaatggagcaggtcttcgtc

SEQ ID NO: 68364 - DNA, 87 bp, Mus musculus
cccacagcccttctaccaattactgcaggtagaagcacactcagatgggaggtctgtggctctctgcctgccacaaaggtctctggg

SEQ ID NO: 68365 - DNA, 75 bp, Mus musculus
gttagtagtcgcagagcagaatgctgctcataatgctgccatgagcttctgactaactgtctctgagattaacac

SEQ ID NO: 68366 - DNA, 98 bp, Mus musculus
gctatttctaactttgtcttctatcacatttagtgtatctgattttattttaaaatctctgattcacttgggcttgagttttgggcagagtgttaagc

SEQ ID NO: 68367 - DNA, 70 bp, Mus musculus
tgtgtgtgtatatatatataaatatatacatacatatgtgtgtatatgtatatatgtatatacatacaca

SEQ ID NO: 68368 - DNA, 98 bp, Mus musculus
accttctcacagatgctcaaggacaacacctgacttgtctgagactgtttctctgtctatacgacaaagggtaggtgacagtcagcatctacaggggt

SEQ ID NO: 68369 - DNA, 96 bp, Mus musculus
ggttggtgtaatgtcacttgtactctaatgctaatacttgatccacgagactggttgcctcagagacaagacagtctgcacatagcccaagtgata

SEQ ID NO: 68370 - DNA, 98 bp, Mus musculus
gtatgtatgtgtatgaatgtgtatatgtatatgtatgtaatgtgtgtgagtgtatgtatgtataagtatgtgtgtatgtatgtatgagtatatgtata

SEQ ID NO: 68371 - DNA, 64 bp, Mus musculus
tctcacacacactctgtgtgcctgtgtgtgtgcacactcaggtatctgtgcaagtgtgcatgga

SEQ ID NO: 68372 - DNA, 98 bp, Mus musculus
agtatttcaggagggagctggagagatggctctgaggttaagagcactgactgctcttccagaggtcagagttcaatcccagcaaccacatgatggct

SEQ ID NO: 68373 - DNA, 92 bp, Mus musculus
tgccacttcctcttccttggtgactcacaaacaccattgaaacttgggtctatgtctctagctctgtgtgtgtgtgtctccctcctgtggta

SEQ ID NO: 68374 - DNA, 59 bp, Mus musculus
gcctgagagagtcactctccgtctggctgccttcggatgaagatgtagaactctcaggt

SEQ ID NO: 68375 - DNA, 74 bp, Mus musculus
gctgagccgggactggaggagagatccaggccacccaccaagcaaactcaatctctctgtgtgtcgccttcagc

SEQ ID NO: 68376 - DNA, 154 bp, Mus musculus
ccggcctgggagtcagacctggatttgagtcctcagtcccctcagactctctccgtgaccttgggcaagtcaccagtgtctctctgagcctcagtttcccctctgtaacagactggggttgaaataacacccatcctgcctacctcacagggtc

SEQ ID NO: 68377 - DNA, 87 bp, Mus musculus
gaagactctgaacagaggtgtgtaggcaggagacgagggtccagggccttcagctctgtctgtctgtctgtctgtgttcatggcttc

SEQ ID NO: 68378 - DNA, 65 bp, Mus musculus
atgattggagagagagaagagtggcaggagtctcactgcaagccgcctctgtcccttcagctcat

SEQ ID NO: 68379 - DNA, 93 bp, Mus musculus
ccagtgtgcccaagttgaataatgtttctcttctactttgttttttttttttttttgagacagggtttctctgtgtagctctggctgtcctgg

SEQ ID NO: 68380 - DNA, 97 bp, Mus musculus
cactgtctctggtctcctggtccgtgctgagtgaacagacagatgagccaactagtgtctggctgagtgattacggtgtgaggtcccagggactgtg

SEQ ID NO: 68381 - DNA, 61 bp, Mus musculus
gtgggctttgaggtttcagaagcccatgacaagcccaggctctctgtttctctctgcccac

SEQ ID NO: 68382 - DNA, 98 bp, Mus musculus
gggactgtaaatccatcagacagagccaaggtgggaaaaacagaggagactgaggacaaacctagaaggtgaaactgaatgaagacatacaggcaccc

SEQ ID NO: 68383 - DNA, 65 bp, Mus musculus
gtctgtctgtccctgtctgtctgttctctattatgaagaacaagaacacagatgggagaatgggc

SEQ ID NO: 68384 - DNA, 99 bp, Mus musculus
tgctcagtggtttgaactcagtgcccagccaggataaagaatcgcaaaggtgatttctcagactggctcagttctgaagttctgtgggactctgagaca

SEQ ID NO: 68385 - DNA, 110 bp, Mus musculus
gagactgtggacacacacacagtctgacagacagacagacagacagacagaatctgtggtcctgtaagcactcatctactctcaggctgctttgttgtgtttccagactc

SEQ ID NO: 68386 - DNA, 77 bp, Mus musculus
cacagataccctctacggactggatggtgacacgcccctcacacacacacacagactgtcctatggatgcatctgtg

SEQ ID NO: 68387 - DNA, 115 bp, Mus musculus
tggtgtggcccactattaactgataagaaaccagcagcttggagagtcacactcactgtcacaacaccaggggttcacggagctgagttttaaacactgaatggtctggctccca

SEQ ID NO: 68388 - DNA, 103 bp, Mus musculus
tctgttgtttgtgctgtgtgggcggtgttgtatctgccattcatcgaaccctcacttcacagatgagactgagcaaggtgaagaggcttcatgccgtcggcca

SEQ ID NO: 68389 - DNA, 94 bp, Mus musculus
gtgcctgagcctataattgtatctgtgcctctgtggctgtgtctattactctgcctatatctgtataggagcttgtatctctctctgtgtgtgc

SEQ ID NO: 68390 - DNA, 93 bp, Mus musculus
gctgggaatggccaagtcaggaaggtgttccaccggagcctcgtctggcttgtgggtggctcacaccgtgtgtgactggcttagccctgttgc

SEQ ID NO: 68391 - DNA, 86 bp, Mus musculus
ctagttctgagtccctgcctgcctcaatcactagccaggaatccctgctcttgtataggtggagctgggctgctttcagctactag

SEQ ID NO: 68392 - DNA, 70 bp, Mus musculus
atgaccacaaaaaagatggggaagaaaccctgggcaacagggtctctgtgtctgtcagctgtgaggtcat

SEQ ID NO: 68393 - DNA, 75 bp, Mus musculus
ggggtatgggagccatggcagagaggggctagcatctgttactcccactctctgactctcccggttccgtgctct

SEQ ID NO: 68394 - DNA, 58 bp, Mus musculus
ctgtccctctcagactctctcacttctcacgagagattcctagagagcaagggaacag

SEQ ID NO: 68395 - DNA, 72 bp, Mus musculus
gccacagtcacatagtcagcagctagacatgtgtgcctgacagtatgtgcgcctctgtgtgtgtctgtgtgt

SEQ ID NO: 68396 - DNA, 114 bp, Mus musculus
ggagctggtagtagtcagaagttcctcataggctgtccctgatcagagagaggtgagtggggtctcttatttcatcatcagggatggtcatggagtcttcagctttctatctct

SEQ ID NO: 68397 - DNA, 67 bp, Mus musculus
gaccctaaacaggacgagcagggagggctggacaggctgtctctggctctgtttgtcagttagagtc

SEQ ID NO: 68398 - DNA, 82 bp, Mus musculus
ttggcattccatatgaagtgcagtctgtggtctgaggatgctctcattctgccactctctagctgtgtctaaggggtgtcaa

SEQ ID NO: 68399 - DNA, 85 bp, Mus musculus
acccacacactttgtctctctccataaaaatcaaaatgtctttgtatataattatgttgggactccataaggtggcttggtgggt

SEQ ID NO: 68400 - DNA, 98 bp, Mus musculus
gcatttatctccttgtttctcagggtctagaatccagcagtgcctagctaaacactctgcctctgggtctctgatggagctgtggctaagaaggaagc

SEQ ID NO: 68401 - DNA, 101 bp, Mus musculus
atatatgtatatgtgtatatgatatatacaatatatatgatgtatatgtgtatgtgtgtatatatatgtacatatatatacacatatatgatgttcttgtg

SEQ ID NO: 68402 - DNA, 74 bp, Mus musculus
ggttggagcaacaacagcacacgtttctcacaataccctagctctgtgatgctgtgtgtctgagtgctgttgcc

SEQ ID NO: 68403 - DNA, 112 bp, Mus musculus
gttactttttgtatttacatcttaatggttaaatctgtagaaggtgactttttcatttttttttagtcatttggttcagaagattgtaatttatgtaatactttggagttac

SEQ ID NO: 68404 - DNA, 117 bp, Mus musculus
gggacggatgtatggaagcctttgaattctgctcaaatatttgttgtttgacttctttctttgtttatataaggaacattttcaggcacaggaatacagtcacttcaactctgacct

SEQ ID NO: 68405 - DNA, 96 bp, Mus musculus
atgtttctgtttggcttggctttgttttttttttttttaaacaataaggatctcctgaaattggaatgaataattcagccaagtataccaaaatat

SEQ ID NO: 68406 - DNA, 95 bp, Mus musculus
ggcaagaattgaaacccagtttccctctccttttcctatcaaaggaaaccatttgtgagaagtgactgacgaggctgggatctatcactttcgcc

SEQ ID NO: 68407 - DNA, 86 bp, Mus musculus
aggcacacatacacataagataaatggaaatgattaaaaatagcacttttaaaattaaatctctctctgtctctgtgtgtgtgtct

SEQ ID NO: 68408 - DNA, 103 bp, Mus musculus
agagaccctgactcaaaagatttatctagagagtagagagtctgggcatggtcattcatgcctttgatcccaacactctgtaggtagaggtgagtgggtctct

SEQ ID NO: 68409 - DNA, 89 bp, Mus musculus
atggctggctctttctgtacttccacaggcttgctttagccatcatcccttgaaaccaaagaagtttgtggctgactgtgagctgctgt

SEQ ID NO: 68410 - DNA, 87 bp, Mus musculus
cttgacaatctttaagagtcaaatgaagtgtgttcttgggttctcaaataatgcactttttaaaatttgacctagagatactgcagg

SEQ ID NO: 68411 - DNA, 115 bp, Mus musculus
aagcccaactcccagctcaggcagagaaaagttctcagtttttgaatatttttgttctcttcagactccccggggatttcataatgcatattaatgttgggaggataatttgctt

SEQ ID NO: 68412 - DNA, 66 bp, Mus musculus
gcgcgcgggagagagtggagtgtgtgtgcggagcgtgtgagcgcgcgtgtgtctgtctgtgtgtgc

SEQ ID NO: 68413 - DNA, 113 bp, Mus musculus
agagcatcttgggagcacacagattatgagttgaccccctgtctccacctcactctctgagtgtgagttctggggcaattgaatgacctctctgaacctccattttctcctct

SEQ ID NO: 68414 - DNA, 91 bp, Mus musculus
aggaagtcaggggcaggggtatgggggcaagaaccacggtgaaatgctgcttgctggctcactctctggctcacaattaactagacttctt

SEQ ID NO: 68415 - DNA, 58 bp, Mus musculus
ttattgggatgtatgtatgtatgtatgtatgcatgcatgcatgcatgcatggaaataa

SEQ ID NO: 68416 - DNA, 66 bp, Mus musculus
aacagggggctggagaggtggcttagtggttaagagcactgactgctcttccagaggtcccgagtt

SEQ ID NO: 68417 - DNA, 76 bp, Mus musculus
tgtcctgtgaatgtctccaaatgtgtgaccttacaaggaaagcagtcagagcagtgagaggagaggcacagagaca

SEQ ID NO: 68418 - DNA, 58 bp, Mus musculus
ggtatagctgacactgagcaagtggagacttcggcttctcactgctcactgtctcacc

SEQ ID NO: 68419 - DNA, 60 bp, Mus musculus
atatgtgtgtgtgtgtatattcatatatatacatgtgtgtatgtatgcatgtatgtatat

SEQ ID NO: 68420 - DNA, 106 bp, Mus musculus
cacatttcctgagacattgctaagagatgacacttgctgatccatatttatttctgtataaaagttgagcagctgtaggcattttcccatatcttagcagaatgtg

SEQ ID NO: 68421 - DNA, 78 bp, Mus musculus
gggaggaatttacagagacctcccatttagactgtctctccacataatgtctggctgtgggtctctgtgtctgttccc

SEQ ID NO: 68422 - DNA, 62 bp, Mus musculus
actatcacagagcagacactctcgggcgtttcccaccgcgatctgtgtgtctctgtggcagt

SEQ ID NO: 68423 - DNA, 111 bp, Mus musculus
aagcaagatgatttccaagttccagactacccttggttatgtaatgaaaactggttttaaaataattctagggctagacaggagcaaagagatttgtgggttaaagtgctt

SEQ ID NO: 68424 - DNA, 111 bp, Mus musculus
cttgcattatcctctaggcactctttcacgtgtgatgatgggtcggtcggtctgtctctagcaatctacatcagacctcattctcagtaagttgtgccgtatcacttcaag

SEQ ID NO: 68425 - DNA, 119 bp, Mus musculus
taattatatttgatgttctcctgcagtggcttcgaacaaggagagagtcagcactcaggtgatttcctgtaaacctgcttcccaccttaatttgtaaaataaaggagagctggtgattg

SEQ ID NO: 68426 - DNA, 98 bp, Mus musculus
tgaatctgtccccaaatatctagatgatggatgggtgagaaggtagacagagagacagacagacattctaatcatcagaagatttaatggatagttca

SEQ ID NO: 68427 - DNA, 116 bp, Mus musculus
tgcacagacctggtgcatacacacggaggggaaaagattgatggagagagatgagagtgtactggtgaaggagtctcctaatgattgctgtggaatgctgctttttgggtgtgaca

SEQ ID NO: 68428 - DNA, 79 bp, Mus musculus
cgagcccctggggctggaaagatggcttagagctcagtggttacgagcactgactgctcttccagaggacctgggattg

SEQ ID NO: 68429 - DNA, 78 bp, Mus musculus
gtcttgacactcactttgtagaccagactggcctcgaactcagaaatctgtctgcctctgcctctcaagtgctgggat

SEQ ID NO: 68430 - DNA, 108 bp, Mus musculus
gattgttaaaatatttggcaaagaaatttaagtgatttttttcatatgtcaattatttatatatgagaacatttgaatagttctttttctctgctatttttcactttt

SEQ ID NO: 68431 - DNA, 78 bp, Mus musculus
tttgaagtttaataaatggttagaaatcttgactgttggatgttaagatttttaccataccagattagacgtgccaga

SEQ ID NO: 68432 - DNA, 85 bp, Mus musculus
ggccatggtggtctgataggatatatgggacaatttcaatatttttgtatctattgaggcctgttttgtgaccaattatatggtc

SEQ ID NO: 68433 - DNA, 85 bp, Mus musculus; identical to SEQ ID NO: 57470

SEQ ID NO: 68434 - DNA, 79 bp, Mus musculus
tggaagacattgctatagaacctgttgctgtcacactgtcactcagccatgctcaggtgttgttatgcatgtgtgtcca

SEQ ID NO: 68435 - DNA, 85 bp, Mus musculus; identical to SEQ ID NO: 57470

SEQ ID NO: 68436 - DNA, 67 bp, Mus musculus
ctgggggtcatggcccatggcagtcactgtttgccttcaacacctccctgcctgcctgtatcctaag

SEQ ID NO: 68437 - DNA, 92 bp, Mus musculus
tgtctgtctgtatatatatatgtatatatatatatatatatatatatatatatatatatatgtatgtatgtatgtatgtatacagacagaca

SEQ ID NO: 68438 - DNA, 101 bp, Mus musculus
tctcaatttccttctcagtgtctttgtgttcagcggaatgttggctttagaagttgattggcagggtgaagcaacagaagaattgtgaaaacaaattgcga

SEQ ID NO: 68439 - DNA, 64 bp, Mus musculus
tatgtatgtgtatatagatgtgcatgtacatatatatatgtatgtatatgaaaacacatacatg

SEQ ID NO: 68440 - DNA, 117 bp, Mus musculus
gcaaatgttgtaccctcttgctgaatgagcccttttgctatagtataatgatctgctttgtatctttttacatattgtggtttaaagagcattttgttcaagtatggctataaatgt

SEQ ID NO: 68441 - DNA, 85 bp, Mus musculus; identical to SEQ ID NO: 57439

SEQ ID NO: 68442 - DNA, 85 bp, Mus musculus; identical to SEQ ID NO: 57470

SEQ ID NO: 68443 - DNA, 85 bp, Mus musculus; identical to SEQ ID NO: 57470

SEQ ID NO: 68444 - DNA, 85 bp, Mus musculus; identical to SEQ ID NO: 57439

SEQ ID NO: 68445 - DNA, 80 bp, Mus musculus
gtgtatgaatgcatgtgcatgtatgcatgcatgcaagtatgattgcatatgtatgtatgaatgtatgtagtatgtgtcac

SEQ ID NO: 68446 - DNA, 80 bp, Mus musculus
ggacatattctcatgaaacagaagaggagatactcaagaaagatacatgtgtcttcctctctttgactctcagattgttc

SEQ ID NO: 68447 - DNA, 95 bp, Mus musculus
gggtgggtgtgtatatgtgcgtatatatctgttctctctctgtttttctctttgtatgcctatgtgtctgtgtctgtgtgcatatctttgtgcct

SEQ ID NO: 68448 - DNA, 85 bp, Mus musculus; identical to SEQ ID NO: 57439

SEQ ID NO: 68449 - DNA, 62 bp, Mus musculus
gtagtctgaccctgcctctgtcacactggaaaggacaagaacagggttgtagttcagtctac

SEQ ID NO: 68450 - DNA, 118 bp, Mus musculus
gaagctttcagagtgcctttcagtgccatagaagctagtcctcagagacaagacattcaggtcagttccagctctggggcctctcatccctgtgtctgaagtatattgtgtttccagc

SEQ ID NO: 68451 - DNA, 80 bp, Mus musculus
ctggaaacttatttttgattaaaaaaaatcccaggttttttgttaacagaatagctgggactttttgacattgtttgcag

SEQ ID NO: 68452 - DNA, 85 bp, Mus musculus; identical to SEQ ID NO: 57470

SEQ ID NO: 68453 - DNA, 106 bp, Mus musculus
gccttactgcatggtgatctgataggatacatgggaaaatttcaatatttttgaatctgttgaggcctgttttgtgacctattatgtggtcaattttggagaaggt

SEQ ID NO: 68454 - DNA, 85 bp, Mus musculus
ggccatggtggtctgataggatacatgggacaatttcaatatttttgtatctgttgaggcctgttttgtgaccaactatatggtc

SEQ ID NO: 68455 - DNA, 85 bp, Mus musculus; identical to SEQ ID NO: 57439

SEQ ID NO: 68456 - DNA, 62 bp, Mus musculus
acacacatacacatctatatatatgtctatatatctatatcatctatatcgtgtgtgtgtgt

SEQ ID NO: 68457 - DNA, 83 bp, Mus musculus
ggaaggacccaaggctccagctgcatatgtagcagaggatggccttgtgtgacatcagtgagaggagagacccttggccttgt

SEQ ID NO: 68458 - DNA, 85 bp, Mus musculus; identical to SEQ ID NO: 57439

SEQ ID NO: 68459 - DNA, 103 bp, Mus musculus
acacacacacacacatttacatatatacacatatatgtgtgtgtgtgtgtgtgtgtgtatatatatatatatatatatacccacacatataaatgtatgtata

SEQ ID NO: 68460 - DNA, 70 bp, Mus musculus
taaaatcttgctagtgtatgcaatggtgtcagcgagcaatgacacaagtatacaactaagtattttttta

SEQ ID NO: 68461 - DNA, 110 bp, Mus musculus
tgtggttatatatggtatagatgcaaattttcttcttttgtttgagaatttctatatgtctgaatatgcaataaattttggagaaaggtttatgctgtgctgtgaaaaca

SEQ ID NO: 68462 - DNA, 85 bp, Mus musculus; identical to SEQ ID NO: 57439

SEQ ID NO: 68463 - DNA, 85 bp, Mus musculus; identical to SEQ ID NO: 57439

SEQ ID NO: 68464 - DNA, 115 bp, Mus musculus
tgtttagctctgttccccatttttaatggagttatttggttctctgtgtctaacttctaaagttctttttatatattggacattagccctcagtgagatgtaggattggtaaaga

SEQ ID NO: 68465 - DNA, 92 bp, Mus musculus
tctgtctgtctgtctttttcatgtatgtctgtctgtctctgtgtgtgtatttgtgtttatcctggagataaatagacggatagatagataga

SEQ ID NO: 68466 - DNA, 85 bp, Mus musculus; identical to SEQ ID NO: 57439

SEQ ID NO: 68467 - DNA, 85 bp, Mus musculus; identical to SEQ ID NO: 57470

SEQ ID NO: 68468 - DNA, 124 bp, Mus musculus
agagccaggaagcaggagtgggtgggttggtgagcagggggatcaacagttcagatattgtagatttgactaaagccacaatgaactgattttgttttcatttctctatcaccgagagccattc

SEQ ID NO: 68469 - DNA, 85 bp, Mus musculus
gatactattaacagtttagtttatgtttgtatggacacaaactctctctgtcacatacacacataaacaggggatggggtaggtc

SEQ ID NO: 68470 - DNA, 85 bp, Mus musculus; identical to SEQ ID NO: 57470

SEQ ID NO: 68471 - DNA, 105 bp, Mus musculus
tctctttgcagtgtgctatgtattatcacaatgtttatctttataacatattacagattaagattgtgtccattgtttttagcttactcattattatttaagaga

SEQ ID NO: 68472 - DNA, 71 bp, Mus musculus
cctgagaatttggtggcacttgagtgtaaaagagattcctttactccttctaagtgtctcactcactcagg

SEQ ID NO: 68473 - DNA, 109 bp, Mus musculus
agtgtatcctggtcaatcctgtaagagatacttcttggtgtcagacacacacagtaaaaacctgtggctgtgttccaaggcagactctggctttgaccatctttacatt

SEQ ID NO: 68474 - DNA, 85 bp, Mus musculus; identical to SEQ ID NO: 57439

SEQ ID NO: 68475 - DNA, 101 bp, Mus musculus
ggcacttactatggtctttgtagggtgactttgtttattaatattaagcccattggggcatatggcagctacttggattgcctcaaggatcagtttgtttc

SEQ ID NO: 68476 - DNA, 81 bp, Mus musculus
gtggcagttgtttagcatggtcttcatgtcagttccctaataattgaagggagggctgtctctgactctgtgacctgccat

SEQ ID NO: 68477 - DNA, 115 bp, Mus musculus
tcagtaggatttgttagggtccatgaatcactgaagaatgatatcccagaatcaaatagaatcaaaaggagaatgtttatttttacatgtgggtgtgtggagagccgtgccatga

SEQ ID NO: 68478 - DNA, 68 bp, Mus musculus
gcacacacacatatatatacacatatgtatatatatatatatgtatgtatgtatatatgtatgtatgt

SEQ ID NO: 68479 - DNA, 87 bp, Mus musculus
tctgtgtaagagtctcattcctaagggggggaaatcccatagaaactcttttttttttcttggaatcagaatgctggagaatataga

SEQ ID NO: 68480 - DNA, 85 bp, Mus musculus; identical to SEQ ID NO: 57470

SEQ ID NO: 68481 - DNA, 97 bp, Mus musculus
ttgctactatatgcacatatgtatttgtatgcataagtgtattcctaagtataaactttttgaatttatataacattatgtgtatatttgtcagtgg

SEQ ID NO: 68482 - DNA, 76 bp, Mus musculus
tgtggattatgttatatatgtgttacatgtatatgtatgtatatgtgtgtatatgtatgtatgtatgtattccaca

SEQ ID NO: 68483 - DNA, 116 bp, Mus musculus
gcatagttacagaattttggtttcaattattaatagtatgtttcagtgaatgttttttttattcaaatgaactacagcagctactttaaaaaccagaaataagctcgatgactagc

SEQ ID NO: 68484 - DNA, 84 bp, Mus musculus
gcaatcacactcactggctgtgtggcactctggcttaaaggtcaggagagaaagtaaacatggttacagtgcagtgcaacacgc

SEQ ID NO: 68485 - DNA, 104 bp, Mus musculus
aaggctgcaattaccctcttgtcacagtgtcacctgccagtgtggcatctggtcactgccactcactgtcccaggcactgtacagtgctattcttttgctcctt

SEQ ID NO: 68486 - DNA, 102 bp, Mus musculus
cacccatccatccatcaaaatgtgcatatttgtctatatatttgtgtgactgtatatgtctatatatgtaagcatctatgaatacttgtggagtttgttgtg

SEQ ID NO: 68487 - DNA, 87 bp, Mus musculus
gggccatttatccactgtataaaggaagactactgattttttttgagtctctgttgagaagtcagctgtaattctgataggtgttcc

SEQ ID NO: 68488 - DNA, 72 bp, Mus musculus
tctctgaaagagcagacagtgctcttaacggctgagccatctctccagcccaagaactgctttctaaaggga

SEQ ID NO: 68489 - DNA, 59 bp, Mus musculus
acagagaatgagaccacctggggtcgagccttcccacctagatggttctattgttctgt

SEQ ID NO: 68490 - DNA, 116 bp, Mus musculus
attagtgagtccataccatgtgtgttcttttgtgattgggttacctcactcaggatgatattttctagttctattcatttgcctaagaatttcatgagttctttgtttttaatagt

SEQ ID NO: 68491 - DNA, 79 bp, Mus musculus
aacttgctgcttggtcatgatgttttgtgcaggaatacaaaccctgactaagacactcactgaatgggctccacaggtt

SEQ ID NO: 68492 - DNA, 75 bp, Mus musculus
aaagagacagtctcaggttgatgtcatgtatgaagaaggtattcaatatataggtgtcaaaagacagtctgcttt

SEQ ID NO: 68493 - DNA, 152 bp, Mus musculus
ggggaggggcttgatagaggcattcagagtagggccctgtgttccaaagtctctcactctctgcatatttattatctgactgtgactctctgtatttgttcccacctgctgcagaaggaagcttctctgaggatggctgagcaaggcactga

SEQ ID NO: 68494 - DNA, 70 bp, Mus musculus
cttgcctcacccctcaccacctgtgagagttgagagagctgtcactaaggtcatgagagtgaagagcagg

SEQ ID NO: 68495 - DNA, 116 bp, Mus musculus
tatatatacatatatatgtatatacatgtgtgtgtatatatttatgtatatatatgcatatacatgtatatgtgtgtgtgtatatatatatatactttgtaaacaatgtaggcata

SEQ ID NO: 68496 - DNA, 72 bp, Mus musculus
tgtcagggtatgtgggggtctcactgtcagtcagaggatgctggtcttgacatgaaggcaaatatgatggca

SEQ ID NO: 68497 - DNA, 78 bp, Mus musculus
tggaatctctcactctcactggccttgagctcacagatccagctaggctgagtggcctgtgaggcccaagaacctgcc

SEQ ID NO: 68498 - DNA, 113 bp, Mus musculus
ctgcagggcataagacatcttcaacatttgttagagttgatcaatattttgattttataatcaatgtagaaaatattgtttcaaataaatgtgtagaaagtgcaggacagcag

SEQ ID NO: 68499 - DNA, 114 bp, Mus musculus
gcccaagtttgttcatctttgaagcaaggatggtacctgcatcagcaagaccaagtgtgtataaagctttaggtataggaattcctgcttaataagaaaccagtcgttggtagc

SEQ ID NO: 68500 - DNA, 76 bp, Mus musculus
gctttgtttctgagacagtcttgctgtataggccagctgacctcatacagtccctctgtctcagcttctcgagtgc

SEQ ID NO: 68501 - DNA, 98 bp, Mus musculus
caaagtgctcagactggcctgcagaggaagctgtacagagaccggtgggggaggggtttaagcacaggctcagttcaggtgggttctggggttatttg

SEQ ID NO: 68502 - DNA, 97 bp, Mus musculus
ccatttcctattgtgcccatactgtgtctgtgactcagtcaggatcttttcatcccttcctgtctgctgataggtcatggtgtaccacatacaatgg

SEQ ID NO: 68503 - DNA, 114 bp, Mus musculus
tgtttgcagttgtggggcactggaatctgggtgatgaacctgtacataccaccagttacacactgtgacactgtgtgtccctaggctcatgccttttcagagcttttgcagagg

SEQ ID NO: 68504 - DNA, 70 bp, Mus musculus
ggatactagagaacatgacatcgttttctgtgtactcaccccaaggagacagaagtcagtgactgtatcc

SEQ ID NO: 68505 - DNA, 85 bp, Mus musculus
agcaaatagtgcactgaatacaattgcaactgaatttttaatattcagtagtaattcctgtattaaaaaagtaagccaccttgct

SEQ ID NO: 68506 - DNA, 67 bp, Mus musculus
gatgagagccttgcgggaggtcttcaggtcagtgggcttgcacacttctctctctggcttcctggtc

SEQ ID NO: 68507 - DNA, 106 bp, Mus musculus
caggatgtagattattggttttcagatggtttactaagtcaggcagctttcttccccttgctgataacacttaggagtccatggagaactggagagaagtgttttg

SEQ ID NO: 68508 - DNA, 114 bp, Mus musculus
tgggagtgcttgaaagttcttttttcttttttttagagatttattcatttatttatttattttaaatacactgtagctgtctttagacacaccagaagagggcatcagatctca

SEQ ID NO: 68509 - DNA, 91 bp, Mus musculus
gaattaaagacctctcaagggctggaaagatggctctcagagatggagggcactgactgctcttccagaggtcctgagttcaattcccagc

SEQ ID NO: 68510 - DNA, 67 bp, Mus musculus
ggaggcaaaggtctctctctctgagttggaggctaggctggtccacagagtgagttccaaggcagcc

SEQ ID NO: 68511 - DNA, 85 bp, Mus musculus; identical to SEQ ID NO: 57470

SEQ ID NO: 68512 - DNA, 59 bp, Mus musculus
tgtgatcactcagagtcaggcttgcttcttcctgactggctctttgactctgagctaca

SEQ ID NO: 68513 - DNA, 88 bp, Mus musculus
gaagcaggcagatctctgtgagctcaaggccagcctggtctacacagtgagttccaggacaaccggggctatagagagaccctgtctc

SEQ ID NO: 68514 - DNA, 121 bp, Mus musculus
tgacagaatattctggatcagttcttgagggtcttttctggagagagctgagagtgaagaaactctttggggaaaaaaaacgggattctcatcattctaatctggctgtgaagactccaag

SEQ ID NO: 68515 - DNA, 100 bp, Mus musculus
agatctcagttactgcttcaatgccatgcctgcctgcctgcctgcctgcctactggcctagtgtcatgctctctgcatggcagtcatggactgtaagtct

SEQ ID NO: 68516 - DNA, 66 bp, Mus musculus
gcgtatttgtatgtacatgcatgtgtgtgcatgtgtgtatatatatgtatgtacctgtgagtgtgt

SEQ ID NO: 68517 - DNA, 85 bp, Mus musculus; identical to SEQ ID NO: 57439

SEQ ID NO: 68518 - DNA, 85 bp, Mus musculus; identical to SEQ ID NO: 63730

SEQ ID NO: 68519 - DNA, 85 bp, Mus musculus; identical to SEQ ID NO: 57439

SEQ ID NO: 68520 - DNA, 114 bp, Mus musculus
agacattgtagatacttataatagtgaatactatcaatgcttgtattatttatggtactatttttacaaagtatttttatagtgttcattagaccatttgatatctgcaattct

SEQ ID NO: 68521 - DNA, 78 bp, Mus musculus
tcatgtgtgtgtgcatgtgttgtgtatgtgtgcatgtgtgtctgtgcatatgcatgtgcgtatatgtgcatgcagtga

SEQ ID NO: 68522 - DNA, 73 bp, Mus musculus
cctcaattgagagaatgcctctatcagattgactggtaggccagtctgtagtcattttcttgattaatgatgg

SEQ ID NO: 68523 - DNA, 75 bp, Mus musculus
ctgccgttgtatgtgtatatgtgtatgcatatatgtatgtgtatgtatatgaatatgtatatgtaagaaactcag

SEQ ID NO: 68524 - DNA, 85 bp, Mus musculus; identical to SEQ ID NO: 57470

SEQ ID NO: 68525 - DNA, 118 bp, Mus musculus
gagttagactattgtgtactcctcttggatgtgtttgcttctttttgttctagaactttcaagtacgttgttaagttgttagtatgaggtctctccatttattttaccaatgtctctc

SEQ ID NO: 68526 - DNA, 76 bp, Mus musculus
gctctccaagttcatctctctcactgtttctttctctcaattggagggttgaacagaacgaggagaatgcaagggc

SEQ ID NO: 68527 - DNA, 66 bp, Mus musculus
ggaaagggacagatgtcagactgatgctttcccacgtccccaggtctgtcactctgtgtcctcttc

SEQ ID NO: 68528 - DNA, 62 bp, Mus musculus
tgtatatatgtacatgtgtatacttgcatacatatgtgtgtatatatatgtgtgtatatgca

SEQ ID NO: 68529 - DNA, 111 bp, Mus musculus
agacacggcatcacctgctccgtgttacaaagaacagaaatgtgagagcactcatgagatgaatgatggcaaacaggacatgtgtgtggctgccaagcagtggctgtctct

SEQ ID NO: 68530 - DNA, 112 bp, Mus musculus
gctgtccaagctgtgagggactcagaatcactcctcagttttttccagatgaggacactgaacttagagagtagagttagctgttcatccaagctcacacttaatatctagc

SEQ ID NO: 68531 - DNA, 85 bp, Mus musculus; identical to SEQ ID NO: 62497

SEQ ID NO: 68532 - DNA, 107 bp, Mus musculus
cactagaataattccttgggagttgacagaagagaatgagcagtaactggggaggctatcgtggcagccaacccctgtgtttgcaatgcaaaggaatcttcatagtg

SEQ ID NO: 68533 - DNA, 70 bp, Mus musculus
agacattttgagagtgtttgagaagcaactcctgtaaacattaggttttagcttctaaacatttatgttt

SEQ ID NO: 68534 - DNA, 82 bp, Mus musculus
ggcttggtctcacaggctcactccctctctccaagtctactgcacacaaggaattgggggagatatttggaaaggctcagct

SEQ ID NO: 68535 - DNA, 73 bp, Mus musculus
gggtcctctgtgattattctgacatcacgcctgggcagtagcctgtgagagcagagtgtgttcatcctctccc

SEQ ID NO: 68536 - DNA, 82 bp, Mus musculus
gagactatatagactaggaggagttcaggtaggctgcctgtctgtcagcctctgctccctcactatctcactatttggtgtc

SEQ ID NO: 68537 - DNA, 96 bp, Mus musculus
ggaagcaaatccaatacgctaggactcggccgtagaggtgaaatccagcgagctgcctctgactgtcggtgtctcctaagttctccgctcggttcc

SEQ ID NO: 68538 - DNA, 80 bp, Mus musculus
gctatttgtgggataatgtgtgcatgcattgtgtgtgagcacacacagctcatgtatacattatagttattacttaaggc

SEQ ID NO: 68539 - DNA, 81 bp, Mus musculus
gactcactcactgtctggctcatgatttgctaggtttcttacacctgtgtagggatgatgccacccacagtgggctgagtc

SEQ ID NO: 68540 - DNA, 86 bp, Mus musculus
ggttatctgaggagagacagttcactgaggccagaggctcccttgtgtcttaaaaatacctcagggctgcattttcctacccagcc

SEQ ID NO: 68541 - DNA, 78 bp, Mus musculus
tatgagtatgtatgtattatgcatgcatgcgtgtatatatgtacgtgtgtatgtatgtatgaatgtatttgcagcatg

SEQ ID NO: 68542 - DNA, 90 bp, Mus musculus
ggaaaatatatgctgggttgattttgtgaacaactgtggctattaaagcacacaggtgtttctatatttatttacaatgtgatatatacc

SEQ ID NO: 68543 - DNA, 82 bp, Mus musculus
gaggcattctctacagtcagcagagggatcattctgaaatttaaatatctgcctgtctctctcagactcaagagaatcactc

SEQ ID NO: 68544 - DNA, 94 bp, Mus musculus
cttgaaaagttacccattgtttgattctatttatataagtcttgaaatgacaaaattatagaaatggagaacaggtgcgtgggtggctgttagg

SEQ ID NO: 68545 - DNA, 112 bp, Mus musculus
taggacgtcacatgatatttgtggttgtatctccctgtggctttatttttatgactgctatatttatttttcatcttgctaccctggggcatatctgaccgtgtgtttccta

SEQ ID NO: 68546 - DNA, 73 bp, Mus musculus
accagaacagactagccactgaacagagagctgcctgccttggtatgttgtctgggtggaagctagttgtggt

SEQ ID NO: 68547 - DNA, 71 bp, Mus musculus
cacagtcagagcaaatgtggactgctccagtcactgtgactgtctgccttggtttgctttctcccgctatg

SEQ ID NO: 68548 - DNA, 78 bp, Mus musculus
tgtgtgtttgtgtgtgactgtgtgtgtgtgcacatgtgttttctgtgcactccaaggtgcattcacatgtggaggcca

SEQ ID NO: 68549 - DNA, 104 bp, Mus musculus
taaatggacatgcttgtcaaaccgatatgtatgtatgtatgtatgtatgtatgtatgtatgtatgtatgcatgtgtttgtttatttattatttttcaagacagg

SEQ ID NO: 68550 - DNA, 106 bp, Mus musculus
gtgtgtgtgtgtgtgtgtgtgtgtgtgtgtgtatgtgtgtgtgtgtgtgtgtgtgtgtgtatgcacaggtgtatgcgtgtttatatgtatgtgtggatctgcattc

SEQ ID NO: 68551 - DNA, 103 bp, Mus musculus
ctggtagtcagcaagttccaggcacctgcctgtctctgtgcctcacccgagcagcatgcctgatatgttggtgctgggatccaaatctttgttgtttgcatag

SEQ ID NO: 68552 - DNA, 100 bp, Mus musculus
gaggtagaggtaagcagatgtctgtgagttcgagactaggctggtcaatgaagagagtttcagaacagtcagagctgtgtatagagagagaccctgtctc

SEQ ID NO: 68553 - DNA, 94 bp, Mus musculus
acagagaaggccatagtcagaggaggacggaggtaaaaggattattcatttatttttactttttatatgtctgtctgtctgtcggtcggtctgt

SEQ ID NO: 68554 - DNA, 110 bp, Mus musculus
ctccttggctgtggtggtggcaatgtgggtttgctggcttggtcatttggttatggttctagcttgatttctattgctctgataagtatgatgacaaaaggtttggggag

SEQ ID NO: 68555 - DNA, 118 bp, Mus musculus
catttataccttctcgtataccgtatgtatgtatgtatgtatgcatgtatgtatttatttatttatttatttttgctaggatacatattatattgattggataagaactgggtaagtg

SEQ ID NO: 68556 - DNA, 76 bp, Mus musculus
gtgtgtatgtgtgtgcgtgtgtgcgtgcatgtgtgctcaagggtgcacatttgtgcatatgtgcacacatatacac

SEQ ID NO: 68557 - DNA, 119 bp, Mus musculus
cagttaaaatttgtctgcatgaggctggagagatggctcagcggttaagagcactgactgctcttccagaggtcctgagttcaattcccagcaaccacatagtagctcataaccatctg

SEQ ID NO: 68558 - DNA, 96 bp, Mus musculus
gcatatcgtctgttagcttatgtcattttgtagatgagttgaatccattaatattcaaagatattaaagagagatgactgtttgttcctgatatgt

SEQ ID NO: 68559 - DNA, 85 bp, Mus musculus; identical to SEQ ID NO: 57470

SEQ ID NO: 68560 - DNA, 87 bp, Mus musculus
atggtgcctccagtatttctatctcagagctgtgtgtggacagccaccggcaacagaatggaaaaatgatcgaatctctaggtccat

SEQ ID NO: 68561 - DNA, 96 bp, Mus musculus
ttgtctgatactcacacatgtatgtatgtatgtatgtatgtatgtatgtatgtatgtatgtatgtatgtatgcaagtgtgaacaatgttggcacaa

SEQ ID NO: 68562 - DNA, 92 bp, Mus musculus
tctcatggtctactcagtcactctgtggcactggggtttattggctttgagggcccagcattaacagattaacagataatagacccataagg

SEQ ID NO: 68563 - DNA, 64 bp, Mus musculus
gtgtgtgtgtgtgtgtgcatgtgcgtgtgcatgtgcgtgcgtgcgtgcgtgcgtgcgtgcgtgc

SEQ ID NO: 68564 - DNA, 62 bp, Mus musculus
gtgcgtgcgtgcgtgcgtgcgtgcatgtgtacgtgcgtgcatgtgtgtgtggatgtgtgtgt

SEQ ID NO: 68565 - DNA, 83 bp, Mus musculus
actactacaaatgtgtaacatatattagtgtatatatgtatatgtgtatatctgtgtgtgtatctgtgtgtttgtgtgtgtgt

SEQ ID NO: 68566 - DNA, 82 bp, Mus musculus
tggtagacatgtgttatcacaccgagctttctcttatctctgatatgcaggttatatgtgatcttgagagacttgtcttcca

SEQ ID NO: 68567 - DNA, 83 bp, Mus musculus
gctctcatcactatcttcagcctgcttctttaactgtagaattaaacttgaggctgttgaaaatgacagaagtgactgagggt

SEQ ID NO: 68568 - DNA, 76 bp, Mus musculus
cctgactaatctacagatatatgggtactgatggagagccatctctcagtctcacttatatttcagtgaagtctgg

SEQ ID NO: 68569 - DNA, 110 bp, Mus musculus
gtccatcaggatggagttgctagagagaggatttggtgagaagagagtgaccagggacccgcctccctgtcatctcagcagtttcatgtctggcactttatcaggttgac

SEQ ID NO: 68570 - DNA, 85 bp, Mus musculus; identical to SEQ ID NO: 57439

SEQ ID NO: 68571 - DNA, 90 bp, Mus musculus
acttataaccattaaacattcatgctacagcaattctaagtaggttacacctaagtgtgcgtgtgtgtgtgtgtgtgtgtgtgtgtgtgt

SEQ ID NO: 68572 - DNA, 98 bp, Mus musculus
atatatatacgtatatgtgtatatatacgtatatatatgtatatatatacatgtatatatgtatatatacgtatatatacacatgtgtgtatgtatgt

SEQ ID NO: 68573 - DNA, 92 bp, Mus musculus
actgccttacaatctcaggatgggtaatgtctgtgagatgctcactgtttgtgtctgtctaacaagaaataccctccaagagtctcaacagt

SEQ ID NO: 68574 - DNA, 85 bp, Mus musculus; identical to SEQ ID NO: 57439

SEQ ID NO: 68575 - DNA, 85 bp, Mus musculus
ggccgtggtggtctgataggatacatgggacaatttcaatatttttgtatctgttgaggcctgttttgtgaccaattatatggtc

SEQ ID NO: 68576 - DNA, 104 bp, Mus musculus
ctttcatgtgtacgtgtgcatggtatgtgtgtacagagtgtgtacatacaagtgtgtatgtgcatatgtgtatgtacacacacatgcttgcttgaatgtggagg

SEQ ID NO: 68577 - DNA, 85 bp, Mus musculus; identical to SEQ ID NO: 59716

SEQ ID NO: 68578 - DNA, 96 bp, Mus musculus
agttcctgcattcgccttgcctcccaggagaaagtacggctcacatctggtgactagactgagtcacattcactcaggctaaggagagaggggatt

SEQ ID NO: 68579 - DNA, 115 bp, Mus musculus
gtgaaggtaatgctaagagatagaaaaggttttccaggactggagtgatggctcagcggttaagagcactgactgctcttctagaggttctgagttcaatttccagcaacctcat

SEQ ID NO: 68580 - DNA, 116 bp, Mus musculus
ggttccctctgcttgctctggtggagatattgcacattactaagttgcatgttgtcacggcctcaatgcaatttagtgtgtgtgatattttcacatgagtgcatgcacacgggtct

SEQ ID NO: 68581 - DNA, 108 bp, Mus musculus
tgacatgggtgttgggaactgaactctggtcctctgaaagaacagtgtgtgctcataaccaatgagccacttctcacttttgaaaagactcatctcatactcagaaca

SEQ ID NO: 68582 - DNA, 97 bp, Mus musculus
gtataaaaagtttgatgctcgatttgacaaattacattcagatccagcacacgctctcatgtctgtgtctgtctgtcaattcctgccgactctatgc

SEQ ID NO: 68583 - DNA, 62 bp, Mus musculus
tggccacagtctctgtcagtggccgcagggtcactgttggaatcaacggggaagactggcca

SEQ ID NO: 68584 - DNA, 119 bp, Mus musculus
ccccttcctccatagctcccaagaaccaagagccagtggttttctgggagctttgatgagcaaggggaatatacgctctggtagtcaccagctagggtcctaagtgtctgccccatggc

SEQ ID NO: 68585 - DNA, 90 bp, Mus musculus
tttgacatgtagagtttgaactgtgcatggaatatccacactgaagtgtcagagcagaaactcatgcaaatagtccgagctgttttcaga

SEQ ID NO: 68586 - DNA, 89 bp, Mus musculus
gctattcaggctggagagatggctcagcggttaagagcactgactgctctttcagaggtcctgagttcaattcccagcaaccacatggt

SEQ ID NO: 68587 - DNA, 102 bp, Mus musculus
agacagctacagtgtagttatcatatatagagaataaataaattatattttttgaaaaaagaaatgtctattctgtgtattatagttgcttccatgcagtct

SEQ ID NO: 68588 - DNA, 116 bp, Mus musculus
gcctgcctttgctgccactgtgccttccctctgtgcagggctctctcaccctcacacctactcctcagtgagcttgtcttatcctctccctcagagaacacagtcagcaggcaggc

SEQ ID NO: 68589 - DNA, 62 bp, Mus musculus
agggtgagtaagtgccacagccttgtcatacttgagtgtgtcactgtgtctgaggccatcct

SEQ ID NO: 68590 - DNA, 61 bp, Mus musculus
gctccgtgaggtcgggtgctactctggctcactgggcctctgacactcaacactgacgggc

SEQ ID NO: 68591 - DNA, 64 bp, Mus musculus
gtgtatgtatgtatgtatgtatgtatgtatgtatgtatgaatgtatgtatgtatgtgcatgcac

SEQ ID NO: 68592 - DNA, 121 bp, Mus musculus
gcagggcaccagggaagggcattggaaaagggggccgggtacagagccagaagagtgtgggctctgaacggagcctggccaatctgatacaaacctcctctcagctgtgcctggagcccct

SEQ ID NO: 68593 - DNA, 85 bp, Mus musculus; identical to SEQ ID NO: 57439

SEQ ID NO: 68594 - DNA, 68 bp, Mus musculus
gtgtgtgtgtgtgtgtgtgtgtgtttttcaagaggtcagtgataacagtgagcatagcatacatacac

SEQ ID NO: 68595 - DNA, 85 bp, Mus musculus
ttgttcttatcattggtctgtgtctctgggtgtggtgacatactcactcactcatactgcactggggatacaggcaggggaatgg

SEQ ID NO: 68596 - DNA, 111 bp, Mus musculus
ctgggatactttaattttatatttatttaagtacttatatttatttatatacttatttcagtgtgtgtgtgtgtaagtgcctacaaaggatctgaaactaaattgctgcgg

SEQ ID NO: 68597 - DNA, 90 bp, Mus musculus
gtcacaagggtttatcacaatctgactgacacagatgatactggctctagacatgagcaactcactgtgtgactgtgacaaagccccgac

SEQ ID NO: 68598 - DNA, 81 bp, Mus musculus
cagctttacagtgtgtggttatgtaggtgacagagagctttcctgagcagactctgtacttgatttatcttcctgtttctg

SEQ ID NO: 68599 - DNA, 103 bp, Mus musculus
tgggggttcagctgggctggagagatggctcaaagattaaaagcactgactgctcttccagaggtcttgagttcaattctcagcagccatatgatggctctta

SEQ ID NO: 68600 - DNA, 91 bp, Mus musculus
ggaataaaaaattaactgcagggctggagagatggctcaatggttaagagcactgactgctctttcagaggtcctgagttcaattcccagc

SEQ ID NO: 68601 - DNA, 79 bp, Mus musculus
ctgtgctcagacttgttgcactactgtgggcctgtggtgaggctgaacatcatggcatcaggagtgtggggtggcgcag

SEQ ID NO: 68602 - DNA, 84 bp, Mus musculus
aggaagtgtatcactgggggtgggctttgaggtttcaaaggcccatgccaagcccagaatgtctctctcagtctctcagtttct

SEQ ID NO: 68603 - DNA, 76 bp, Mus musculus
gcacacatgtgtatgtgtatatgtgtatacatgtatgtgtgtatatatgtatgtgtgtctatatgtatgtgtgcat

SEQ ID NO: 68604 - DNA, 115 bp, Mus musculus
gcagatccaattcaagccctcttgtcacttctcccagttcccactcctctgtgtgtcactctttatctcctctgagggggggtctcaattaatgcagtggcatttgtgtttgtgc

SEQ ID NO: 68605 - DNA, 100 bp, Mus musculus
caggcttctgagccccaaaggagctgtgtcaggctccctgtgtggcccttctgttgcacacccaagctctgagcacagctctcctcttactgttctcctg

SEQ ID NO: 68606 - DNA, 81 bp, Mus musculus
tatccttggctgtcaagaacttactgtgtagaccaggctggactcacagcctctgcctctgtctcctgagtgctgggttta

SEQ ID NO: 68607 - DNA, 118 bp, Mus musculus
gaaatgacctcagcaagaaaacaagatggaggggctggagaggtggctcagcggttaagagcactgactgctcttccagaggttctgagttcaattcccagcaaccacatggtgtctc

SEQ ID NO: 68608 - DNA, 105 bp, Mus musculus
ttgtttgtttgccctgggagcctgcccagaaatgtaaacatccttctgtcctcagagaatacttacatcctcagcaactggttcctcctcctggcatccatgcaa

SEQ ID NO: 68609 - DNA, 64 bp, Mus musculus
tacatatatatgtatatgtatgtgtatgtatgtatatgtatatatgcatatactcatatatgta

SEQ ID NO: 68610 - DNA, 121 bp, Mus musculus
ttatgttttagcacattgatgttttcctgaaaatttttgcatctggtcctcacatagaacagagatagcacttgcatcttgtccgctggagggtgatatgatagagatggagacacccagc

SEQ ID NO: 68611 - DNA, 117 bp, Mus musculus
agagccagacttatggttagcttcagtgagtgtatgagctaagtggggctgactctgtgcctgtccttgttctcagaaagcggcactacagtcatcgcattctgtttctctctctct

SEQ ID NO: 68612 - DNA, 91 bp, Mus musculus
cttttccatctgtagaggctgagagaatgttcaagactggcacagttttgacaatttatatttgtgttttcaagattcacatttggaatgg

SEQ ID NO: 68613 - DNA, 85 bp, Mus musculus; identical to SEQ ID NO: 57439

SEQ ID NO: 68614 - DNA, 115 bp, Mus musculus
tccatttctcaggtggcgtaagtaaatgtctctgaaatatgcagcatgacctgtgggtaccactctctgtctctctgcgtatgtagtgcagcaggcgtcagaaccttcttaggga

SEQ ID NO: 68615 - DNA, 120 bp, Mus musculus
atctatctatctatctatctatcatctatctatctatctatctatctatctatctatctatctatagaaagaggtggttatgggataagctgtggtagaaattagtagtttagactagat

SEQ ID NO: 68616 - DNA, 67 bp, Mus musculus
acaggtgtaagcccagagtctttattggccagccagtgatgacactgggtgttcaggatcagactgt

SEQ ID NO: 68617 - DNA, 85 bp, Mus musculus; identical to SEQ ID NO: 57470

SEQ ID NO: 68618 - DNA, 97 bp, Mus musculus
agctgagccttaaagggcacacagaagagagtcaggaacaaagcgttttgctgtagataatgagtcaccattttgtagtgaagggatttgcccagct

SEQ ID NO: 68619 - DNA, 81 bp, Mus musculus
ggttgtagtctgaacagttattgattgatgacagggagcattacatgtctgtctgtctgtctgtctgtctgcctgcctgcc

SEQ ID NO: 68620 - DNA, 72 bp, Mus musculus
atatgtgtgtatgtgtacatatgcttgtgtgcacgtgtgtgtatgtgagtgagtgtgcatgtgcatgtgtgt

SEQ ID NO: 68621 - DNA, 66 bp, Mus musculus
tcatgaggtcagatgagcaatgcctgtcctgcaggtctgctggcagttctgtgtgacctcttttga

SEQ ID NO: 68622 - DNA, 129 bp, Mus musculus
cttgtagggcaggtgtccagaagtttggagctctgatccacctccagagtcttggggtcacagcctccctgtaagcgactctcctctggcaaggaaggtgtccaggggtctgggtctatctctgcctcc

SEQ ID NO: 68623 - DNA, 83 bp, Mus musculus
gtgtgcatgtgtgtctgtgagtgtgtgcatgtgcatgcgtggaagaatgtgatgtgtgtgaatacatgggtgtatatggatat

SEQ ID NO: 68624 - DNA, 94 bp, Mus musculus
acagatgaagtttgagagagaagagagagccctgatacctttataaaagaatttacaaaggcagtcaggggacttagctttttctagtcagtgt

SEQ ID NO: 68625 - DNA, 111 bp, Mus musculus
ttgtccatatgttttccaggccagctctgcctacctctgagtcctctgttctttttctatgtcacacagcctcagtgtttgccagatagccctgacctagtaataggacga

SEQ ID NO: 68626 - DNA, 166 bp, Mus musculus
cctccttttctgttttagattttgttccacctcccttcgattggttcccatgggggcaggaagaggttgtaggttgtaatggctttctggataaatgagtaggttttttttttctttctttcttcatatattgcctctattatagtgacttacatttctctggctc

SEQ ID NO: 68627 - DNA, 104 bp, Mus musculus
tgtgtgtgtgtatatatgtgtatgtatacatatatatgtgtgtatacacatacacacacacacacacacacacatatatatgtatgtatatatatatatatata

SEQ ID NO: 68628 - DNA, 63 bp, Mus musculus
gcagggcagagagttgctggcacaagcgcaggaatgtgctagttcatttttaatatttcctgc

SEQ ID NO: 68629 - DNA, 95 bp, Mus musculus
tgtgtctctgtttagtttgtgtttccactgatgagagtgagctgttgacgcctgccactattatcgtgtaggtgcaatgtgtgctttgagctata

SEQ ID NO: 68630 - DNA, 108 bp, Mus musculus
gtttttgagttacaatcaaaccaggcactgtgggcaccctctttccttagttcttccgaggacagttttgtgtctgtaaggtgatttgaaagatcttaactcaatggc

SEQ ID NO: 68631 - DNA, 67 bp, Mus musculus
aattaaggggctggagagatggctcagctgttaaaagcactgactgctcttccagaggtcctaagtt

SEQ ID NO: 68632 - DNA, 99 bp, Mus musculus
tcatgaaaggctggctaagggtcttttttttatctatttaggtgttcagagatggcaaggatagaggctggagagatggctcagtggttagaagcatgg

SEQ ID NO: 68633 - DNA, 99 bp, Mus musculus
ctttgagggctgtggcttgctttgacctgaaccacttacatgtacttatatatacttacatatacttacatgtatagtgtaagcctctgccttttaaag

SEQ ID NO: 68634 - DNA, 70 bp, Mus musculus
ggacttcaggggctggagagatggctctgaagttaagagcactgactgctcttccagagatcctgagttc

SEQ ID NO: 68635 - DNA, 72 bp, Mus musculus
gtgtctgtctgtctatatatatatgtgcatacatacatatgtatgtataagtgtatgtatataagtatgcat

SEQ ID NO: 68636 - DNA, 110 bp, Mus musculus
cagcctttaaatctggacaacttacttagatctatgggatttttaagaaaagtactataagtagaagcttgaaaagttctcaaactttggagtttgccaaccccaggctg

SEQ ID NO: 68637 - DNA, 117 bp, Mus musculus
ctggaacctgatatatagaaatggactgtatagggctgaaaagatggctcagcagttaagagcactgactgctcttccagatgtcctgagttcaattccatttgtaatgggatccag

SEQ ID NO: 68638 - DNA, 115 bp, Mus musculus
gctgctctaagaaaggcctcacacagctctgggctttgttttcttgactgtacaatgacagtactgatctatccgggcagggttacatgtgtttggttttccgaggttggaagca

SEQ ID NO: 68639 - DNA, 81 bp, Mus musculus
cacatagagaaactgtgagcagaaagttctagggaaagagaccctccccccaactgatctgtcattttgttgagctgtgtg

SEQ ID NO: 68640 - DNA, 89 bp, Mus musculus
caggtagcaatgatatcagtaagatcttcctctgtgtgtgtgtgtgtgacaatataattcacagcaagctactgatatttttctgattg

SEQ ID NO: 68641 - DNA, 85 bp, Mus musculus; identical to SEQ ID NO: 57470

SEQ ID NO: 68642 - DNA, 80 bp, Mus musculus
cagagctgtctgtctgtctgtctgtctggggtcctttacctgaatagaaagaaatcctgagaccacaatggcagtgcatg

SEQ ID NO: 68643 - DNA, 78 bp, Mus musculus
agactgtgtctgtcacactgggtgtaacttgagcctatatgacctcaaagcccaccttcacagtgacatactttgtct

SEQ ID NO: 68644 - DNA, 119 bp, Mus musculus
ccttggtcatggtgcctgatcatagcagtaaaaccctaagacactctctttctgtctgctggattataaactgagaagacagaaggactgtggctgctgccatcctctgatcttgaagg

SEQ ID NO: 68645 - DNA, 78 bp, Mus musculus
caccttgtagatcaggctggcttcaaagtcgcagagatccacctgcctctgtctctgagtgctaggattaaaagggtg

SEQ ID NO: 68646 - DNA, 72 bp, Mus musculus
gggacctttggatttggaacactgtaataattcctttggggcttttgtgtcagtgggtgttgttctgggccc

SEQ ID NO: 68647 - DNA, 64 bp, Mus musculus
gacctaggattgggctagtgagatggctcagcggttaagagcactgactgctcttccaaaggtc

SEQ ID NO: 68648 - DNA, 117 bp, Mus musculus
ccaagggatctgctacctctggactctgacactcatacagagacatacactctatctgtctgtctgtctgtctgtctgtgtgtattttttgagacagggtatcatgacgtagcttgg

SEQ ID NO: 68649 - DNA, 64 bp, Mus musculus
gactggtctctccagcatcactgactgactggtctctccagcatctctgactgactgactggtc

SEQ ID NO: 68650 - DNA, 64 bp, Mus musculus
ggtatcagtgcccatggaactggagttacatggttgtgactcactgtgtgggtgctaggaatcc

SEQ ID NO: 68651 - DNA, 76 bp, Mus musculus
ctgtgccactggctcactctctataaactaaatcagaccacaaagctgtactggtgggggtgagatcacagcatgg

SEQ ID NO: 68652 - DNA, 110 bp, Mus musculus
gaggggagggatttgatggagataacccatttagggccgagtgttccaaggtctctctcactctctgcataaggcctgggtgtaggtctctgtatttatttattcccatc

SEQ ID NO: 68653 - DNA, 77 bp, Mus musculus
gagcctcactgtcactctgacaggatttagaatcaccatggaggtgggaatttgggtgttgtctgtacaggagtttc

SEQ ID NO: 68654 - DNA, 114 bp, Mus musculus
tccttcctgcttctgcctcctgagtgctggaattagagctgtgtatcactgtgtctgtaatatgcttacgtgtttttatttctgaggatgaaggagaattaagagcaagatgga

SEQ ID NO: 68655 - DNA, 140 bp, Mus musculus
ttgcttatatatgtatatacatgtatatacatgctaatatatgtatatatgtgtgtatatgtatatacacaaatatgtatacatatgtatatatgtatatgtttacacaacatatatacacacatatatggatacatgtt

SEQ ID NO: 68656 - DNA, 102 bp, Mus musculus
tcagctttagtgcatggtgatctgataggatgcatgggacaatttcaatatttttgattctgttgaggcctattttgtgacctattatgtgctcaattttgg

SEQ ID NO: 68657 - DNA, 85 bp, Mus musculus; identical to SEQ ID NO: 57470

SEQ ID NO: 68658 - DNA, 100 bp, Mus musculus
gtttagccttagcccgtggtgatcagataggatgaatggaataatttcaatatttttgtatctgttgaggcctgttttgtgaccaattatatggtcaaat

SEQ ID NO: 68659 - DNA, 63 bp, Mus musculus
tgtctgtctgtctgtctgtcctggagctcactgtgtgacccaggctgtgctagaactcagaca

SEQ ID NO: 68660 - DNA, 77 bp, Mus musculus
acacagagccagaaaagcatcttgggagctttaaatgtatttatttcagatctcagtgtctatctgtctgtctgtgt

SEQ ID NO: 68661 - DNA, 110 bp, Mus musculus
ttgaagattagccttagcccgtggtgatcagataggatgaatgggataatttcaatatttttgtatctgttgaggcctgttttgtgaccaattgtatgctcaattttgga

SEQ ID NO: 68662 - DNA, 63 bp, Mus musculus; identical to SEQ ID NO: 68659

SEQ ID NO: 68663 - DNA, 77 bp, Mus musculus; identical to SEQ ID NO: 68660

SEQ ID NO: 68664 - DNA, 102 bp, Mus musculus
agattagccttagcccgtggtgatcagacaggatgaatgggataatttcaatatttttgtatctgttgaggcctgttttgtgaccaattatatggtcaattt

SEQ ID NO: 68665 - DNA, 101 bp, Mus musculus
catcagcaaatatgactttgaacaatacttgtatttttcattaatgatgagattatgtcttgtcaggtgaagtccaatattctcaaagtaaacagttgatg

SEQ ID NO: 68666 - DNA, 77 bp, Mus musculus; identical to SEQ ID NO: 68660

SEQ ID NO: 68667 - DNA, 94 bp, Mus musculus
gtgagaactgtggtatattctgtatatattttaaagagttcataaggctactgagcctatgacttagtaattattagcaggaaaaacattttat

SEQ ID NO: 68668 - DNA, 85 bp, Mus musculus; identical to SEQ ID NO: 57439

SEQ ID NO: 68669 - DNA, 77 bp, Mus musculus
acacagagacagaaaagcatcttgggagctttaaatgtatttatttcagatctcagtgtctatctgtctgtctgtgt

SEQ ID NO: 68670 - DNA, 63 bp, Mus musculus; identical to SEQ ID NO: 68659

SEQ ID NO: 68671 - DNA, 110 bp, Mus musculus; identical to SEQ ID NO: 68661

SEQ ID NO: 68672 - DNA, 77 bp, Mus musculus; identical to SEQ ID NO: 68660

SEQ ID NO: 68673 - DNA, 63 bp, Mus musculus; identical to SEQ ID NO: 68659

SEQ ID NO: 68674 - DNA, 63 bp, Mus musculus
tgtctgtctgtctgtctgtcctggagctcactgtgtgccccaggctgtgctagaactcagaca

SEQ ID NO: 68675 - DNA, 77 bp, Mus musculus; identical to SEQ ID NO: 68660

SEQ ID NO: 68676 - DNA, 63 bp, Mus musculus; identical to SEQ ID NO: 68659

SEQ ID NO: 68677 - DNA, 77 bp, Mus musculus; identical to SEQ ID NO: 68660

SEQ ID NO: 68678 - DNA, 110 bp, Mus musculus; identical to SEQ ID NO: 68661

SEQ ID NO: 68679 - DNA, 85 bp, Mus musculus; identical to SEQ ID NO: 57439

SEQ ID NO: 68680 - DNA, 77 bp, Mus musculus; identical to SEQ ID NO: 68660

SEQ ID NO: 68681 - DNA, 63 bp, Mus musculus; identical to SEQ ID NO: 68659

SEQ ID NO: 68682 - DNA, 76 bp, Mus musculus
acacagagccagaaaagcatcttgggagctttaatgtatttatttcagatctcagtgtctatctgtctgtctgtgt

SEQ ID NO: 68683 - DNA, 59 bp, Mus musculus
cgtctgcgacacttgagcgaggtgtcagggaactgtctcactgtctcactgtctgcacg

SEQ ID NO: 68684 - DNA, 89 bp, Mus musculus
ttctgggtcataaggaaggatcttggatacaggactcaggaggtccctcattcactcactgtcagccccacatttttcctgacacagag

SEQ ID NO: 68685 - DNA, 71 bp, Mus musculus
tggccctgagtctaagagatatcagagatggtcagcctaccagctctcacactctcatgcactcagggaca

SEQ ID NO: 68686 - DNA, 119 bp, Mus musculus
ctgagaagaaggtatattttttagctttaggataaaatgatcaacagatatatgttaaatcaattttttttataacttctgttagattcactgtgtctctgtttagtttctgtttccag

SEQ ID NO: 68687 - DNA, 99 bp, Mus musculus
tagaactcatagtgaatgaatttctgtcaccaactgtctctgacttttgaaaaaaaccatgttatgagatcttggttcagtgtcacatggagtgttcta

SEQ ID NO: 68688 - DNA, 71 bp, Mus musculus; identical to SEQ ID NO: 68685

SEQ ID NO: 68689 - DNA, 76 bp, Mus musculus
ctctaaaatacatacatacatatatacatatttatgtatttggaatatatatatgtatgtatgtatgtatttggag

SEQ ID NO: 68690 - DNA, 59 bp, Mus musculus
tgacaccagtggcagacagacagacagaccctcccttccctctctgtggctgtgtgtta

SEQ ID NO: 68691 - DNA, 82 bp, Mus musculus
gtggttgctgggatttggactcaaggcctttagaagagtggtcagtgctcttactctcggagtcatatcgtcagccccccac

SEQ ID NO: 68692 - DNA, 96 bp, Mus musculus
ttgggaccatgacttttgtgttctataccatgcagtggctggagcaggtggctccctgttgacttcagtctgtgtgtgggctcaggtctgtcctag

SEQ ID NO: 68693 - DNA, 113 bp, Mus musculus
attatagaaacaggctggagagatgactcagtggttaagggtactgactgctctttcagaggtcttgagttcagttcccagcaaccacatgatggctcacaaccatctgtaat

SEQ ID NO: 68694 - DNA, 84 bp, Mus musculus
tcttcctttcggtcagcaagttctgccaatgatacccctgcccttcttttgggagcactgttgtctgtgttagcctggtgaaga

SEQ ID NO: 68695 - DNA, 71 bp, Mus musculus
atgtggacagcatctatgtggacagctaccggctattcggtaggtattcactctgattctctgtttggcat

SEQ ID NO: 68696 - DNA, 85 bp, Mus musculus; identical to SEQ ID NO: 57439

SEQ ID NO: 68697 - DNA, 109 bp, Mus musculus
ggttggggacactggttttgcaagcagctggatccgaattccaactcagcactgtctctgtgactttgaacaaattccttaccatctctgagcctcagtttccccaact

SEQ ID NO: 68698 - DNA, 67 bp, Mus musculus
gcatgcacaagggccccaggagagcagaggccagtgtctctctctctctgtgtgtgtgtgtgtgtgt

SEQ ID NO: 68699 - DNA, 74 bp, Mus musculus
ggggctccctctgactgtcactttagctcagttggctgcagcactgcctgagtctgatagatctgaatggtttc

SEQ ID NO: 68700 - DNA, 91 bp, Mus musculus
gggaatcttgtactatctaagtgtagagcgtgtagagagtgagcacaggcatgcgcacacttattcccagtctgttcttggatgtgatgtc

SEQ ID NO: 68701 - DNA, 93 bp, Mus musculus
ccagaggggagtggaccttgcaggtaacctcagatgacagggccagtcagtcactctgtcagtgggagtacacagagctccccgaccttttgg

SEQ ID NO: 68702 - DNA, 115 bp, Mus musculus
gctccacaaagcacattacagggattttgatcaggagtacattaaatttgtaaattcatttgtggggaatttgcaaatatcctgctattaagtcttgttattcatgggcacagtg

SEQ ID NO: 68703 - DNA, 93 bp, Mus musculus
gaaaacattggctgagccaaacagaacatctgtggaccagactcagcacagccgtcagcgctgagttctctttctgtgccccagtcaggattc

SEQ ID NO: 68704 - DNA, 104 bp, Mus musculus
acatttataaaccatgggtgtgtgtgcacatgtgtgtgtgtatatgtgtatgcacgtgtttatgtgtgtgccatacatgggcacacgtgctgtggtgtgcttgt

SEQ ID NO: 68705 - DNA, 74 bp, Mus musculus
gaacttctcctgtaggggccagagagaataaaacagggtgtcccctgatttctctctgtctctgggagagtttc

SEQ ID NO: 68706 - DNA, 80 bp, Mus musculus
caaaagggagagtgtgaccaaggggactgaagatatgaatggaccttctgctggctcagtggctcgctggctctctggtg

SEQ ID NO: 68707 - DNA, 68 bp, Mus musculus
ttagctctctctgcctctgtggatggccagaagttggctgggtattcacacatctggctgtcggctag

SEQ ID NO: 68708 - DNA, 79 bp, Mus musculus
cattggggataagaacatttagtccagctgcttgtggttctccagctgcaaggcgactgtctctgtgtgtccctctgtg

SEQ ID NO: 68709 - DNA, 115 bp, Mus musculus
agagacacagagagagagagaataacaagtgatctatctatctacctacctatctatctatctatctatctatcatgtatctattgtcattgttttttttttttctttgttctct

SEQ ID NO: 68710 - DNA, 122 bp, Mus musculus
tggttctgtctgtgtctaactgtgaacctcaggcaggcttcttgtaaactgacactctctgtgggtcaaaatgggggcaggcgctgagggtaaagccaaccccacatccagccccataccac

SEQ ID NO: 68711 - DNA, 98 bp, Mus musculus
ggcatgagtcgtctccatcactccctgtgattctctcaggtaatgagctcctacactcaatgcgtgaagatagggggatgaactggaacacttgggcc

SEQ ID NO: 68712 - DNA, 107 bp, Mus musculus
tggactaaacctctggaactgtgagcagggcttcagtgaaatgtttttcttttataagaattgctgtggtcatggtgtcgcttcacagcaatagaaactaaggcaca

SEQ ID NO: 68713 - DNA, 72 bp, Mus musculus
atgtataaatgtatgtatgtatgtatgtatgtatgtatgtatgtatgtatgtatgtacgtgtgtgtgtgtgt

SEQ ID NO: 68714 - DNA, 118 bp, Mus musculus
gtggtttaaaaaatgctgctctggggctggagagatggctcagcagttaagagcactgtctgctcttccagaggtcctgagttcaattcccagcaaccatatagtgtctcacaaccat

SEQ ID NO: 68715 - DNA, 78 bp, Mus musculus
cttgtgacctttgaaagatcacaacatctctgagtctgtctctccatcaggcagcctgtgatctcttctgggtctaag

SEQ ID NO: 68716 - DNA, 116 bp, Mus musculus
ctaggttcctatgctctgctccaaagtctgctttccactgaagtgagtgagcccagaactggctcctctgcatgtcagaccaggccagaccatggagacatttagaaggtccctgg

SEQ ID NO: 68717 - DNA, 104 bp, Mus musculus
gggggtagagcctctgattgttctggactggaaaagccttggcagatggctctgtcactcagtgtaaggacttgctgccggacctccagagctattcttggcct

SEQ ID NO: 68718 - DNA, 70 bp, Mus musculus
ggctgtgctgggactctgacaggctcagtggaaagggaccatacaagccatcctcgtgcccagtgctgct

SEQ ID NO: 68719 - DNA, 69 bp, Mus musculus
atgcactggggcagagtgagtcacagtcactgccacacgcatgcccagagtcaagctggccacaggcat

SEQ ID NO: 68720 - DNA, 69 bp, Mus musculus; identical to SEQ ID NO: 68719

SEQ ID NO: 68721 - DNA, 160 bp, Mus musculus
agctacatatcttatacaattaaacatgtatgtgaaaatagggaagtcaattttaataatatatatttttattttaaattgcatttagtgtgtgtgcatgtgcatgtatatgtgtgtttttgtgtgtgtgtgtgtgtgcaggtacatgcacagagtgtgg

SEQ ID NO: 68722 - DNA, 80 bp, Mus musculus
gggcccctcccacagtccctctgtggccaggctctgtggtacagtgtctgagcaatatcgagggctgtctccaatggccc

SEQ ID NO: 68723 - DNA, 77 bp, Mus musculus
ggacgggcactgatgctcactatgacattggcaaaccactctcgagaaaagccagtgtgtctcactcagtgtgttcc

SEQ ID NO: 68724 - DNA, 138 bp, Mus musculus
tctgcctccttgtaagcttcctcatcaaatggctgcacagagatggataaggtagacggaagtgatgacagagagcagacaggcggggggtgggggtgggaaggtgcactgaggcctggtgtgtatgagttacacttc

SEQ ID NO: 68725 - DNA, 68 bp, Mus musculus
tattagtgctcacagaggatttactggtgtgcctggctctctctctgtggttgaccctggcactggta

SEQ ID NO: 68726 - DNA, 83 bp, Mus musculus
tgaggtattctgactgtagttagtctcctggccatgctatcatgtctgatccactagctacttttagagtaggactggcttca

SEQ ID NO: 68727 - DNA, 184 bp, Mus musculus
tatatatgtatatatatgtatatatatatatatatgtgtgtgtgtgtgtgtgtgcatatataacatatatatatatatatatatatgtatgtatgtatgtgcatgtatgtatatatatatatgcacatgagtgtacatgcatacctgtgtacatatatgcatatacatatagatgcatacatac

SEQ ID NO: 68728 - DNA, 90 bp, Mus musculus
ggtcaagaatgcagaccatcttgtgtaagccagggcctctttgggtggccttattttatgattatttaaacaggagacagatttgtgacc

SEQ ID NO: 68729 - DNA, 112 bp, Mus musculus
tggcaataagggatttacttcatgtttcacatttgagtccactttttacaacttgcttgtaaagttctgagagctggtctagtggcggaaaggctgaagcagtccaatgcta

SEQ ID NO: 68730 - DNA, 118 bp, Mus musculus
ggttactccatagtctggagctcgagatgagagagttaatgaaaatcacagaatagagagatctcattggccttaagtgagcattagcttggtaaaaatcctgagactctgagttgct

SEQ ID NO: 68731 - DNA, 104 bp, Mus musculus
cccataaaaagtcagaggcgttttccagggcaaaggtgacaattgactcaagtttataattttattcatgtcagtatatctgggaaaagtttatattttgaggg

SEQ ID NO: 68732 - DNA, 80 bp, Mus musculus
gtgctatctatctattttgtatctatctatatctatatctacatctatatagacaggtagataatagatagatattatgc

SEQ ID NO: 68733 - DNA, 85 bp, Mus musculus; identical to SEQ ID NO: 57439

SEQ ID NO: 68734 - DNA, 58 bp, Mus musculus
tatatgtatgtatgtatgtacgtacgtatgtatgtatgtatgtatgtatgtatgtatg

SEQ ID NO: 68735 - DNA, 81 bp, Mus musculus
gaggtttgccatttgactatctgtagaagtagaaaataatttatttctttagatagcatgggaatataagatggaaactac

SEQ ID NO: 68736 - DNA, 66 bp, Mus musculus
gttgaacatttctttgcgtgcttctcaaccatttggtattcctaggttgagaattcgttgtttagc

SEQ ID NO: 68737 - DNA, 111 bp, Mus musculus
gtgtgttttatttatatctacatttgaggagttgtatgttcctttaagtaaagaagtctgcacttttaaaggttctcggctcctttaattgtgatttattcttctgtccat

SEQ ID NO: 68738 - DNA, 67 bp, Mus musculus
agtccctctggctccagaagtgagtggggttggtggcactcactcacctctcagtctgtggctgact

SEQ ID NO: 68739 - DNA, 115 bp, Mus musculus
gcagtcctctactgtatatatgttggtgccctcatatcagctggtgaatgctgtctggctggtggtccagtgtctgcgagttctcatgggtccaggttagttgagactgctagtc

SEQ ID NO: 68740 - DNA, 84 bp, Mus musculus
ggcaaggcagtagtttaccttgggcatgtcaatgggtaatttatcttacccttgatctttcctctgtctgtctgtctgtctgtc

SEQ ID NO: 68741 - DNA, 76 bp, Mus musculus
gaaatattaattctgtgacactgtgtctcccattttactttataggagctgagtgtgcagagatgtcttgtatttc

SEQ ID NO: 68742 - DNA, 104 bp, Mus musculus
tgcttatgaaaattttaaatcctttatcagactgtctgtctacacttgaattttatttcagaaaagtgagagtgctgactaaggacatttggtttatctaagca

SEQ ID NO: 68743 - DNA, 111 bp, Mus musculus
tatttacatatatatacatatatataatacatcacaacatatatgatatgtatatctatatatgtatccacatattaagtgaatttgaatatatgtatattcatggagatg

SEQ ID NO: 68744 - DNA, 81 bp, Mus musculus
tctgtgtcattgactctgtgtcacctcacctctaacctccaagggcaggtagggttgggcagcaagtagtccagaacacag

SEQ ID NO: 68745 - DNA, 80 bp, Mus musculus
acctggactgtatgagtgaaggaagcaaaatgagtgctattagatatacactcattgtctctctcctttcaactgtgggt

SEQ ID NO: 68746 - DNA, 93 bp, Mus musculus
tccatggtgatctgataggatgcatgggacaatttcaatatttttgtatctgttgaggcctgttttgtgaccaattgtatggtcagttttgga

SEQ ID NO: 68747 - DNA, 85 bp, Mus musculus
gtatacatttgttgtaattggtatatatatgatatatgtatcctcatttgtgtgtatatatatcatactttatatatgtgtgtat

SEQ ID NO: 68748 - DNA, 70 bp, Mus musculus
gagggtcctcccagtctcactctgagacccacctgcagtgggtacaaggtggaggcacactggactgctc

SEQ ID NO: 68749 - DNA, 79 bp, Mus musculus
gggatgctagttcagctgagcagggtttcctaccaagaggctggtagaaccagctggtttctggaagactagtgattcc

SEQ ID NO: 68750 - DNA, 70 bp, Mus musculus
ggtaatcacaacacagagagctcaagcaggccatgctataccttatttgtgctctgtgtctcagatcacc

SEQ ID NO: 68751 - DNA, 108 bp, Mus musculus
gtagctagaattgattgtgtagccataatctcattttgtaaaaatctttataattgatatgaagttgaagttataatcttttatattgctacagaatgtatttgttac

SEQ ID NO: 68752 - DNA, 85 bp, Mus musculus
gaccatggtggtctgataggatacatgggacaatttcaatatttttgtatctattgaggcctgttttgtgaccaattatatggtc

SEQ ID NO: 68753 - DNA, 102 bp, Mus musculus
gatgtagccatatatagtgtgttctcaaaagatcattctagctatcaggtagaaggtagatttgtgaatgataagtttagaagagagggtgctggaggaatc

SEQ ID NO: 68754 - DNA, 89 bp, Mus musculus
gaaatgaggcagagatagagagacagagagagtcagagtcttaacataggaaattgactttcaagttttgagctattaattcttttttt

SEQ ID NO: 68755 - DNA, 110 bp, Mus musculus
cttttatgctatgtgtagctttatagaagacttttgactttgtccttccaggaatttatagaagtttgatcttttctttctagcaatggtcagtgtgtatggtatttgag

SEQ ID NO: 68756 - DNA, 105 bp, Mus musculus
tatgaagaatccattaggaccaaagtgtcaacatttggggcaattacatctggatttcattgcttatcaaagtggtttgactgtttggagcctggtgtcttagta

SEQ ID NO: 68757 - DNA, 78 bp, Mus musculus
ttctgtgggactcagtgtgtgattttctcagtgctcctggtaattatgagaagtcattacatctggaaaacaccagaa

SEQ ID NO: 68758 - DNA, 85 bp, Mus musculus; identical to SEQ ID NO: 57470

SEQ ID NO: 68759 - DNA, 69 bp, Mus musculus
gggtatgtgtgtatatgtgggtatgtatatgtacgtatgtatgtatgtatgtgtgtatgtacattgcct

SEQ ID NO: 68760 - DNA, 118 bp, Mus musculus
tatgtgcatttttgtttatgtctgtacacatatttatgtattcatgtatatacccacatatatatgtatatatatataattttataaatatataaccatacatatgaatgttttcata

SEQ ID NO: 68761 - DNA, 118 bp, Mus musculus
gcatttgtaatagcaacaaataaattctgtgtatttttacttttttgatgagaatctttttttcctttaaaaacacagaaatactataagaatgtattttcatgttaatcccaggtgt

SEQ ID NO: 68762 - DNA, 111 bp, Mus musculus
ccgttaaaggctaggctcacaaccaaaaatattctgtctttatttagtgcatttgttgttctgattattatgagtcaggaggaatttttttttctggtccagtctatttgg

SEQ ID NO: 68763 - DNA, 79 bp, Mus musculus
tctgaaaccttcttctgctctctgtgtgcacctctatatgccacaaatgtacatgcacacagacagacagacagacaga

SEQ ID NO: 68764 - DNA, 71 bp, Mus musculus
ctgtctgtctgtctgtctgtgtgcatgtacatttgtggcatatagaggtgcacacagagagcagaagaagg

SEQ ID NO: 68765 - DNA, 107 bp, Mus musculus
ctccattgatgacttcctgaaaaaaaaaactgcattaagaaagtctggaaatatttattttttatcgagtgccccaagtgacatttcagaacagtcagatttgtgag

SEQ ID NO: 68766 - DNA, 91 bp, Mus musculus
ctcactatatatatgtaaatatatatgcatatatgtaaatatatatgcatatacgtatttttatatatgcatatataggtacgtatgtgag

SEQ ID NO: 68767 - DNA, 69 bp, Mus musculus
ataaaatgcaatcccatacacatatatgtctatatatgtatatgtgtgtttctgtggatgtatgtttat

SEQ ID NO: 68768 - DNA, 131 bp, Mus musculus
cctttagccatgttgcagtttcaactgtggcgagtcaaagggaatcccatgttgatctcattttgtagttgtgtagaccgccgttggcttccgggctatatttctagcttctaacagaattctctctcgct

SEQ ID NO: 68769 - DNA, 78 bp, Mus musculus
gattttccttattgctccctgattcttgctatagaaccacatttagcagcttaggagtcagaagagaaacaggtcatc

SEQ ID NO: 68770 - DNA, 85 bp, Mus musculus; identical to SEQ ID NO: 57439

SEQ ID NO: 68771 - DNA, 72 bp, Mus musculus
gatgaggctcttcgagtcactgggactctgacagtagtatatttcatggttctagttgatgatatgcttgtc

SEQ ID NO: 68772 - DNA, 78 bp, Mus musculus
aactggtagttatgtctaattctggctctttagtggagtgatgagggagatatcagtgtagacattgattgcaaggtt

SEQ ID NO: 68773 - DNA, 67 bp, Mus musculus
tgtatgtatatgtatatgaatatatatgtatatatatatatatatatatatatatatatatatatac

SEQ ID NO: 68774 - DNA, 85 bp, Mus musculus; identical to SEQ ID NO: 57470

SEQ ID NO: 68775 - DNA, 112 bp, Mus musculus
aaaatgcataactgaaatctaattaggagtcataatcatatatatgtatatattctaccattcatatatatacatataaggttgcattccttagaaggtataaagacatttt

SEQ ID NO: 68776 - DNA, 94 bp, Mus musculus
tgtttctgattttgctagtttggatattctctctctaagtgtcagttaatgtgggtaagggtttatctatcttggtaactttcctaaagaagca

SEQ ID NO: 68777 - DNA, 105 bp, Mus musculus
aagctaaacaacagactcaaataaatgagtattttctttaaaaaatacagcaaatagattgtatactaaagatgctgtttcattcattggtctgtattaaggctt

SEQ ID NO: 68778 - DNA, 128 bp, Mus musculus
aatggcaatcaaatactcaacaaatgcttagaaaggaaatgctacaaagtggtcatctgtgattttgtaaaagtgtattagatttctgggatgaagagactttgtagccattcttatcatgtggtcat

SEQ ID NO: 68779 - DNA, 120 bp, Mus musculus
caggggagtacctttacataaaacttcatattttcctcatatttccaaatgtgtttttctttttcacagagcatgagttgaggacagatgagatatagcttttatataaagtcttattgc

SEQ ID NO: 68780 - DNA, 106 bp, Mus musculus; identical to SEQ ID NO: 57715

SEQ ID NO: 68781 - DNA, 68 bp, Mus musculus
ggaggtagcacctgtaatttataggagatactatttatctttatatccacagataagtgcagacctct

SEQ ID NO: 68782 - DNA, 114 bp, Mus musculus
ggagtgggtgggtgggggagggtgaggggacttttgggatagcattggaaatgtaatgaaataaatacctaattaaagaaagatctctctttgtgtctgtgtctctgtatctct

SEQ ID NO: 68783 - DNA, 85 bp, Mus musculus; identical to SEQ ID NO: 57439

SEQ ID NO: 68784 - DNA, 115 bp, Mus musculus
aggcactagctgggaacctcagatttttttgtcatgaaacctgtcaaaatttataattaaaattctaagctgtgcatgtgtcctttaatgaaaatccttctctcagtctatgtct

SEQ ID NO: 68785 - DNA, 92 bp, Mus musculus
ggttttataaggtcagggaggggaggaggtagaagagacagagcactgaatgagtgagatttacttttttgttttcaaactgaaataattcc

SEQ ID NO: 68786 - DNA, 87 bp, Mus musculus
gtacgtatgtacgtatgtacgtatgtacgtatgtacgcatgtacgtacgtacgtatgtatgtatgtatgtatgtatgtatgtatgta

SEQ ID NO: 68787 - DNA, 86 bp, Mus musculus
tcatatgtgtgtgtatatatatattgtatatatattgctacagtaagtatatattattgtatacatgctttcaactttatatatga

SEQ ID NO: 68788 - DNA, 70 bp, Mus musculus
cgcagattatttgtttatcatttagaacacagggtgtcagcgccatcctctaatggtgaatgtgagggcg

SEQ ID NO: 68789 - DNA, 95 bp, Mus musculus
tttcataaatacagcctgctctgtctgtgtaatgctacttgaatgtatattttcagggatagccatatggtaaagagagtatgaattttaagaga

SEQ ID NO: 68790 - DNA, 82 bp, Mus musculus
tttcctatgatgatctatactgtaatacattatgtatttatgtaaatacatgtatgtgttggtatacattaatattgagaag

SEQ ID NO: 68791 - DNA, 105 bp, Mus musculus
ttttgcataattattctaaatttattgagaagttgttacacaattcaaaagtatttttaattttttttctgtgtagggatttttcaaactatttgaaaagcaaaa

SEQ ID NO: 68792 - DNA, 61 bp, Mus musculus
gtgaactcagtgtggagacaagcccttcctttcacttaggcttcttctccacttagtccac

SEQ ID NO: 68793 - DNA, 85 bp, Mus musculus; identical to SEQ ID NO: 57439

SEQ ID NO: 68794 - DNA, 71 bp, Mus musculus
tgtgtatttccctatgactctgtgtgtgtgtgcatgcacgcgcacatgcactcatgggacagaaatggaga

SEQ ID NO: 68795 - DNA, 61 bp, Mus musculus
ttcatgtgtgtgtatatatatatgtctatggaaagtatatgtgtgttgatgcacagatgga

SEQ ID NO: 68796 - DNA, 85 bp, Mus musculus
gtatatatttatatttgtgtatatatgcatatggttataatgtatatatgtatgtatatgagtatatatgtatgtgtatatacat

SEQ ID NO: 68797 - DNA, 85 bp, Mus musculus; identical to SEQ ID NO: 57439

SEQ ID NO: 68798 - DNA, 125 bp, Mus musculus
ctgttttaaggaatgtgttcatgtgatgaaactggtttactatatttagcaaggtaacattacagagtttcttattctgtttttgtaaataagtgaactgtgattatttaaataggacagttgct

SEQ ID NO: 68799 - DNA, 83 bp, Mus musculus
gggtatggaatggatgaaaagtcagaccctaaaagcaggctaaatatctctgtgcctctctcacaaaatccgattctctaccc

SEQ ID NO: 68800 - DNA, 85 bp, Mus musculus; identical to SEQ ID NO: 57439

SEQ ID NO: 68801 - DNA, 94 bp, Mus musculus
gcagcttgaagtaagactgtagacacagtggacaagaagaagcaacaagttgttctgaattcagaattggtttggagtgatacgggcttgctgt

SEQ ID NO: 68802 - DNA, 81 bp, Mus musculus
tgaagggaaacatcacagagtgtagagtgtgacatctgatgtgtcagagattcccattctcagactgtggtgcatccctca

SEQ ID NO: 68803 - DNA, 114 bp, Mus musculus
gagtactctcttgaatgctctgaagtctaaaagaagccattttgttgtagtcatttgaaaatggatactgttgaaatggctgcctagctgacttgggatttaaatgagttactt

SEQ ID NO: 68804 - DNA, 85 bp, Mus musculus
gtccatggtggtctgataggatgcataggacaatttcaatatttttgtatctgttgaggcctgttttgtgaccaattatatggtc

SEQ ID NO: 68805 - DNA, 84 bp, Mus musculus
tctgtctgtctgtctgtctgtctgtctgtctgcctttgtatgtatgtggagagagagagagagagagagagagagagagagaga

SEQ ID NO: 68806 - DNA, 78 bp, Mus musculus
ccaaagtgtgtctctgtaactctttccatgggtgttttgttcccaattctaagaaggtgcaaagtgtccacactttgg

SEQ ID NO: 68807 - DNA, 105 bp, Mus musculus
gaattcactgtgaagtttacttttcagtttttcccgtgtcactcaatctctctcagcacccttgagtggtaggaaggactgaaggagttgctggtaaaggttttc

SEQ ID NO: 68808 - DNA, 81 bp, Mus musculus
cctttagatgctttagatgttccagttgccttcatggacatgaaagaactcatactggaaaggaatctgattaaatagagg

SEQ ID NO: 68809 - DNA, 117 bp, Mus musculus
ttttttagacaatttatttctgttttcatgtcattggtagatacataattttatatatctgtataagatctaagatctatacatgagagaatatttgtgatatttgtctttttgaga

SEQ ID NO: 68810 - DNA, 124 bp, Mus musculus
tgtgaatatatgtgtgtgtgtgtacatatatatgtatatatgtgtatatatatacacacacaatatgtgtatatatatatatatacacacaatgtatatatatatatatatatacatacatata

SEQ ID NO: 68811 - DNA, 84 bp, Mus musculus
tgggatggattgctaggtggggtagtctctggatggtccatgctttcgtcttagctccaaactctgtctctgtaactcattcca

SEQ ID NO: 68812 - DNA, 102 bp, Mus musculus
acttgaccttgttcccttactgcttttagtattctatctttatttagtgcatttgttgttctgattattatgtgtctgggggaatttcttttctggtccagt

SEQ ID NO: 68813 - DNA, 106 bp, Mus musculus
gccttagtccatggtgatctgataggatgcatgggacaatttcaatatttttgtatatgttgaggcttgttctgtgaccaactatatggtcaattttggagaaggt

SEQ ID NO: 68814 - DNA, 117 bp, Mus musculus
cagaggaagactcagcatatagctctgctgttctctgattggatagaagtctgactcactgtctccactcagaagtaaacggtggtagttgcagagacaacaaagttcttactactg

SEQ ID NO: 68815 - DNA, 85 bp, Mus musculus; identical to SEQ ID NO: 57439

SEQ ID NO: 68816 - DNA, 57 bp, Mus musculus
tgtggcctctgtctctctgagtcagctgctgggtgcagcctcatgaggacagccata

SEQ ID NO: 68817 - DNA, 65 bp, Mus musculus
gcattctctgaagactctcagactctcagcaggaagctggtaagaactgggagcttaacagaggc

SEQ ID NO: 68818 - DNA, 126 bp, Mus musculus
atgtattcatgtatgtatatatatgcatatataagtgaatgcatgtttattttgaattattgtgtatatatatatgtatatatgtatatatatatatatttaatggatatatgtctacatgaactt

SEQ ID NO: 68819 - DNA, 115 bp, Mus musculus
gtgcttgtaggagtttcatgtaaaaacttgctttgaagaaccatgaagaataatgaagtctttttatttatttcccaaagtaagtgataggcattcctcttttcctgtggatgca

SEQ ID NO: 68820 - DNA, 105 bp, Mus musculus
ggtttgaagcatgacaagtgacagctttgtgtatagtttgaagaacacattttcttattctgtattaactaattacaactgtaactgccatgtgtatgcagtacc

SEQ ID NO: 68821 - DNA, 86 bp, Mus musculus
gactggcagacagacagacagagaaagagagacagagagagagattcttggcatggctctaagtttctgcctcagtctgctcattc

SEQ ID NO: 68822 - DNA, 65 bp, Mus musculus
tgtgtatgtatgtatgtatatatgtatgtgtgtgtatgtatgtatgtatgtatgtatgtatgtac

SEQ ID NO: 68823 - DNA, 65 bp, Mus musculus
ccagctctgccatttgtttgctgtgtaaccttgaagcacagtgactcagcctctcagagtcttgg

SEQ ID NO: 68824 - DNA, 120 bp, Mus musculus
gagagaaggctgatcatgccagccttgaaaaccataatggctttctgattccatgagggcattgtactctggttgtttcttgttagcagtcatcttccctcagtccctgggcacttggtt

SEQ ID NO: 68825 - DNA, 116 bp, Mus musculus
ccctgaaacatttatttgtatcattaacttagggttagtttcatagtatttcttcaggaaatataggatgagtacactgaagatataaaagttgatgaagatgttaaaaatctggg

SEQ ID NO: 68826 - DNA, 115 bp, Mus musculus
ggtagcttttgtttgtttgttttttgtctagatgagtggaattaacttagcatctaaataagtatgttgaaaaatgccatatcatgaaggcttgaagtggtacttgggttctacc

SEQ ID NO: 68827 - DNA, 82 bp, Mus musculus
ggtctggaatgtactgactaagataggctggctggtcggggaacactaaggatctgcctgtctttctgactctctagcactg

SEQ ID NO: 68828 - DNA, 101 bp, Mus musculus
tagacaggggtgcagcaattataaatatatatgtgtgtgtgtgtgtgtgtgtgtatgcgcgcgcatacatatatatgtatgtatgtatgtatgtatgtgta

SEQ ID NO: 68829 - DNA, 109 bp, Mus musculus
aaggttaccactggtataaaatgtagaaatgcttgataattgacattttgtagttctaaggatcaagccaaaacgctcatgaatgttaagtagctgctccagtgacctt

SEQ ID NO: 68830 - DNA, 99 bp, Mus musculus
cctgtgtgtgtgtgcatgtgtattgattgtgaaaatacactagtatattactatccgtttatatttcaatattaagtatacctactccaaagatgcagg

SEQ ID NO: 68831 - DNA, 105 bp, Mus musculus
gtttgtatatatatgtttgtatttgtattcatatgtatgtatgtacatatgtatatgtgaatatatgtatatatatgtccatatctgcattcttttgaacctaaa

SEQ ID NO: 68832 - DNA, 115 bp, Mus musculus
gcagaagtgagggaagagaacgggaaccagggagatatagattggacaagacagagacctcacatccatgtctaccttgatctcatgtccaagtttacctttcgtttctgtgatt

SEQ ID NO: 68833 - DNA, 77 bp, Mus musculus
cctggaagaaggaagttttgttttttgcctggtagtcctcattctcacaggcaagacaatctatcttgtttctgtgg

SEQ ID NO: 68834 - DNA, 85 bp, Mus musculus; identical to SEQ ID NO: 57439

SEQ ID NO: 68835 - DNA, 85 bp, Mus musculus; identical to SEQ ID NO: 57470

SEQ ID NO: 68836 - DNA, 109 bp, Mus musculus
gtcagtaaagttcttatgttctctaacttcacactccagtgcactccctgtcacaggcactgtctgtactcttatgagttggtgaacagaaaagagacaggcctctgat

SEQ ID NO: 68837 - DNA, 82 bp, Mus musculus
tgtctggactgtttcttgggggagcagaaagatgggggctgacatacaaaccttcaatgtctctcattctcagttattgata

SEQ ID NO: 68838 - DNA, 101 bp, Mus musculus
gagaagtctgacggtctggatctgctgggggaacacagagagcagagaaggtctgcttgtaacttaactcacttgcaggggtctcaacccttttactcctc

SEQ ID NO: 68839 - DNA, 84 bp, Mus musculus
ggttatctgggtaggtgctgatttctgggagttcaagtgaggactgtctgtgtgattctcagaagtgcacagggtccagaggct

SEQ ID NO: 68840 - DNA, 108 bp, Mus musculus
cagttaaacaccttctatgtggaaaacaacctcctgcatgagagaagacagaggccagaaaagtttcaagttgttgtgttggggttgttatatagctgttgtctgctg

SEQ ID NO: 68841 - DNA, 96 bp, Mus musculus
gacagtcccagtaacactgtcatttttctgagaagagtgtcaggttacctggtggtaactttacacttttggaaatgaaatacttaaagatactgc

SEQ ID NO: 68842 - DNA, 83 bp, Mus musculus
tgtagatgcatgcatgtgtccatttgtgtgtatatgtatgtatgtatgtatgtatgtatgtatgtatgtatgtataagtgaga

SEQ ID NO: 68843 - DNA, 59 bp, Mus musculus
gcacctgtgtacaatatgtatatgtatgtacaagtatatatatacatgatatatagtgc

SEQ ID NO: 68844 - DNA, 114 bp, Mus musculus
ctgactgtgatcatccacttctatgtttgctaggccccggcatagtctcacaagagagagagctatatctgggtcctttcgcactgataagtggatattagcccagaaacttag

SEQ ID NO: 68845 - DNA, 56 bp, Mus musculus
cagaatgcttatgcatctgtatatttgtatatttatgcgtgtgcatgtgtattttg

SEQ ID NO: 68846 - DNA, 71 bp, Mus musculus
gacaggaattgctgagacagccagctttgttgaccaagcagatcctggactctcagttttttttcagtgtc

SEQ ID NO: 68847 - DNA, 125 bp, Mus musculus
ttcagctggcagtagagtattacctagcatgctcgaagccatgtagtctctccctgtcactgcctgtaatgtgtgatggtgtatgcctctgatgccaacactggagaggtgaaagcaggagaagc

SEQ ID NO: 68848 - DNA, 93 bp, Mus musculus
gtagttaccctgaggtattctaagagctgcaaggtgacagaagagacttagccttgtgtacctctgcacctctagtaaccttttgttttctcc

SEQ ID NO: 68849 - DNA, 90 bp, Mus musculus
tgtgtgtgtgtgtttgtgtgtgtatgttatatgtatgtgtgtatgtggtatatatatatatatatatatatatatagagagagagagaga

SEQ ID NO: 68850 - DNA, 105 bp, Mus musculus
gcgtgcatgtgtgtgtgtgtacatgtataaatatgcatatatatgtatatatatgtgtgtgtttatatgtataaatatgcatatatatctgtatatatattcgta

SEQ ID NO: 68851 - DNA, 99 bp, Mus musculus
gggactctttccctatccatctctgtgccacagtctatcaaatatatttgtcactgcttcttgattgtactaaacacactgagaaggtttcaagatccc

SEQ ID NO: 68852 - DNA, 85 bp, Mus musculus; identical to SEQ ID NO: 57439

SEQ ID NO: 68853 - DNA, 85 bp, Mus musculus; identical to SEQ ID NO: 57470

SEQ ID NO: 68854 - DNA, 111 bp, Mus musculus
attggtcaatctgtctgtctctgtaccataccatgcagttttgttttgttttgttgtttttttttttaatcacaattgccctgtagtacaggtcagggagggttatttaat

SEQ ID NO: 68855 - DNA, 90 bp, Mus musculus
tccttaatctgtggtgattagataggatgcatgggataatttcaatatttttgtatgtattaaggcctgttttgtgaccaattatatgga

SEQ ID NO: 68856 - DNA, 87 bp, Mus musculus
tatgtattcttcggcaatttaatagtgtgtgtatatgtatatatgtgtatatattcatacatatacttatgatgtttcaggaacata

SEQ ID NO: 68857 - DNA, 66 bp, Mus musculus
gagctcagtctttttctctctgaacagtctagttggtagccactgggggaaggaaggggctgtctc

SEQ ID NO: 68858 - DNA, 71 bp, Mus musculus
gtagagtagtcactttgttcttagcagcttctgagtggttgctcaagacacaaaccttgtagaatatctac

SEQ ID NO: 68859 - DNA, 111 bp, Mus musculus
atatatatatatatatatacatatatatataatttgtctatatataattgtctatatataatttgtctgtatgtataatttgtctatatgtataatttgtctatatatata

SEQ ID NO: 68860 - DNA, 70 bp, Mus musculus
gtcctggaactcactcgaggctggcctcgaactcagaaacctgcctgcctctgtctctgagtgctgggat

SEQ ID NO: 68861 - DNA, 72 bp, Mus musculus
ggagaaggaggaggaggagaaggcagctcaggagttaacaatacagagatgctccctctctgtcactctgcc

SEQ ID NO: 68862 - DNA, 68 bp, Mus musculus
acattgtgtggaatattctctggtttgggggactttcatccagagtctatacagtgttcccacaatgt

SEQ ID NO: 68863 - DNA, 71 bp, Mus musculus
tgtatgtgtatatatgtacgtatgcatgcatatgtgtatatatatctgtgtgcatgtacatatacatatat

SEQ ID NO: 68864 - DNA, 93 bp, Mus musculus
gggataatatggtagatttcttaaaggtgggatacctgtagaggatatgaaagttcaaactctctccctgtgtcttacatctgtctgttactc

SEQ ID NO: 68865 - DNA, 97 bp, Mus musculus
acagagatctaggcctagtctccagaactgtcagtttgaagcctgtcatggagtcagtctgtctgtcttttcaaggtactgtccctttcttttctgt

SEQ ID NO: 68866 - DNA, 111 bp, Mus musculus
tcagtaaaaaatgcgtatgtttttctctttagaacattgttacagttattgttgttgtattaacaacacaatcaatacaatgtcaactaattttagacttgggcttcctga

SEQ ID NO: 68867 - DNA, 66 bp, Mus musculus
ggtctagatccagcctgtgtaagctcttagtggctcactctctgagagcccgcaggaatccagatt

SEQ ID NO: 68868 - DNA, 106 bp, Mus musculus; identical to SEQ ID NO: 58252

SEQ ID NO: 68869 - DNA, 75 bp, Mus musculus
cagaaaccacagtctacagcttgtttgatgaggctggcgaagccccacagttcacactagctgttgtgcatactg

SEQ ID NO: 68870 - DNA, 98 bp, Mus musculus
atctacgtttctgttttctgaatgcaagaatgtatggcatgtgaaagagctcacagaggtgctcaacagtcttcctttctggatttagcaatgttagt

SEQ ID NO: 68871 - DNA, 90 bp, Mus musculus
agaagaccaaagcattgatggagctggagtgaggctgggtcactcaatgccagaccatgtcaggctttgatttctacagcttaccctagt

SEQ ID NO: 68872 - DNA, 109 bp, Mus musculus
gcctaaagtttttttttttgttttgttttgtttagtttttttgatgcaattctatgaagtcacaacaaacagagctcagctgtgcagtgtaagtcagatcaatataggc

SEQ ID NO: 68873 - DNA, 126 bp, Mus musculus
cattcaggggcaaactgtcaggagattagcagacagcacatcaagctgggacagaagaaacaaagcacagtaggggaaggggtgctgacctgcttggttgacaaggggttccatggctggaggctt

SEQ ID NO: 68874 - DNA, 192 bp, Mus musculus
tatatatatatatgtatataatgtgtgtgtgtatatatatatatatatatatatatacacacacatgattttatatatatacatgtatatgattatatacatatattattatatatacatatatatgattatatacatatattattatatatacatatatatatgactgtatacatgtatatgtgtataatt

SEQ ID NO: 68875 - DNA, 76 bp, Mus musculus
agccagggagacgtctctctctgtgtgtgatagtgtgtgccctggctacagacgggagttaacgacatgcttggtt

SEQ ID NO: 68876 - DNA, 85 bp, Mus musculus; identical to SEQ ID NO: 57439

SEQ ID NO: 68877 - DNA, 91 bp, Mus musculus
aagatgacttatggattgtgttagtttagtgaagtagtggttgtagcttcttttcaagttccatgatttcactatattctgtagttggctt

SEQ ID NO: 68878 - DNA, 85 bp, Mus musculus; identical to SEQ ID NO: 57439

SEQ ID NO: 68879 - DNA, 71 bp, Mus musculus
gtcaggggtgtgagatgaaagacaggagagggttgtccttttgtgaggggctgtcatctctgtcagtgtac

SEQ ID NO: 68880 - DNA, 124 bp, Mus musculus
atatatatatatatatatatatacacacgcatgtatatatgtatatatatatatatagtgtgtgtgtgtgtgtgtgtgtgtgtatgtgtgtatgtgtgtgcacacgctgtgtatgtatatatat

SEQ ID NO: 68881 - DNA, 86 bp, Mus musculus
agttgagtcagttgtgagtcagttcagaggagtggagttgaatcagtgcaacgagtgcatttggtgaactgcaattgagttcaact

SEQ ID NO: 68882 - DNA, 78 bp, Mus musculus
cacagaatgtgcatgtacatgtgtgtttgtgtgggtacacaaacacatacagtgactatgtgtgtacatttgcacctg

SEQ ID NO: 68883 - DNA, 77 bp, Mus musculus
gggccctatggcaccagtctggttgttctttcaggctcgctcctcatccagcctgcctgactgcctgtcttgggctc

SEQ ID NO: 68884 - DNA, 86 bp, Mus musculus
cataatctggttgaaggtagtatattatagaacacatattgtgaaaaatggtgtaacatgaaaatttctagctccaatcagttgtg

SEQ ID NO: 68885 - DNA, 66 bp, Mus musculus
ttccaggatcgtgtttaggactgggatggtagatagatactatttgaatttggatttgtcctggaa

SEQ ID NO: 68886 - DNA, 85 bp, Mus musculus; identical to SEQ ID NO: 57439

SEQ ID NO: 68887 - DNA, 85 bp, Mus musculus; identical to SEQ ID NO: 57470

SEQ ID NO: 68888 - DNA, 85 bp, Mus musculus; identical to SEQ ID NO: 57470

SEQ ID NO: 68889 - DNA, 111 bp, Mus musculus
ggttgatggttcagagtatgagaactccaaaggtccaggttagttgatgttgttgatcttcctgtgggatttctatcacctgggcttgcaattctttctcctcttctatca

SEQ ID NO: 68890 - DNA, 70 bp, Mus musculus
gtgtgtctatatgtatgtacatgcatacatatataggtatatgtgtatgtatacaagtatgtatgtgcac

SEQ ID NO: 68891 - DNA, 85 bp, Mus musculus; identical to SEQ ID NO: 57470

SEQ ID NO: 68892 - DNA, 85 bp, Mus musculus; identical to SEQ ID NO: 57439

SEQ ID NO: 68893 - DNA, 89 bp, Mus musculus
cggatttctctttcagtctctctctgcctcattttgagcagttttggtgttccatctgtctggtagctggttcctggggttgaattttg

SEQ ID NO: 68894 - DNA, 84 bp, Mus musculus
atgtggcatctagatgttctagaaacagtctcagtgtctcactgtatctaagacattgaaactggaaaacatttagaattatat

SEQ ID NO: 68895 - DNA, 85 bp, Mus musculus; identical to SEQ ID NO: 57470

SEQ ID NO: 68896 - DNA, 119 bp, Mus musculus
ggatttcctggatgttttgagttaggatctttttgcattttccactttctttgattgttgttctgatgttctctatggaatcttctgcatctgagattctttctccatctcttttattc

SEQ ID NO: 68897 - DNA, 80 bp, Mus musculus
acatgtatctatgtatacatgtatatatatgtacatgggaccgtacaaatgtatatatatatatgtgtgtacatatatgt

SEQ ID NO: 68898 - DNA, 119 bp, Mus musculus
aataataccaggtatgttgaaaaagccataaagtcacattatgtatgtatatgtgcatgtgcatgtgtgtgtgtccatgtgtgtatgaagttatgctatttgacaaaagccccattatt

SEQ ID NO: 68899 - DNA, 75 bp, Mus musculus
ggtttggagagatttctcagcgattaagagcagtgactgcgctttcaaaggtcctgagtttagttctcatcaacc

SEQ ID NO: 68900 - DNA, 85 bp, Mus musculus; identical to SEQ ID NO: 57470

SEQ ID NO: 68901 - DNA, 85 bp, Mus musculus; identical to SEQ ID NO: 68752

SEQ ID NO: 68902 - DNA, 100 bp, Mus musculus
gttcccccaacaactggagcagagactctccctgactctgttgcctgcctatcaagttccccttatcagtgggagagaatgtgcctagtcctgcagtgac

SEQ ID NO: 68903 - DNA, 90 bp, Mus musculus
ctataagaaagcaagctgggggctggagagatggctcagcagttaaggacactgactgctcttccagaggtcctgagttcgattccatgg

SEQ ID NO: 68904 - DNA, 85 bp, Mus musculus; identical to SEQ ID NO: 57439

SEQ ID NO: 68905 - DNA, 85 bp, Mus musculus
ggccatgttggtctgataggatgcatgggacaatttcaatatttttgtatctgttgaagcctgttttgtgaccaattatatggtc

SEQ ID NO: 68906 - DNA, 79 bp, Mus musculus
gcccttattcagtggctgtcttgtgttgaagttcctcttctcagacttacttcttccattgccattactgaataggtgt

SEQ ID NO: 68907 - DNA, 111 bp, Mus musculus
tcatttaccaatgcatacctataaacctataaatagtctttctttagattcacacagaagacacagtgggtactagactttataaagatggaggtgcgtgtggtgattaga

SEQ ID NO: 68908 - DNA, 74 bp, Mus musculus
cctctgtctctgtctctatctctacgtatcttctgtgaagaagttactgtttttgtggtttgactgggagaagg

SEQ ID NO: 68909 - DNA, 85 bp, Mus musculus; identical to SEQ ID NO: 57439

SEQ ID NO: 68910 - DNA, 115 bp, Mus musculus
gttagcagacacaaaatcttgtggtcagtttctgggcattattaaccttagaatctatagatgtaaggtaaagccaaggctcagcatcactgccctaaaggatttcagggctgac

SEQ ID NO: 68911 - DNA, 80 bp, Mus musculus
tgagtccattgatgttgagagatgttagggaccagtggtcatttgttcctgttattttggttgttagaggtggaactaca

SEQ ID NO: 68912 - DNA, 112 bp, Mus musculus
aagtgtaatgttgagttttatgttgatatcttttcataatgtaggacatatttaaaattgtttttacattagcttttctttggagtatctcctaggcaccatattacaactt

SEQ ID NO: 68913 - DNA, 87 bp, Mus musculus
tatttagtaatgtgtgtatatgtatatgtatatatatatacatgtatgtatgtacatatgtatttatatacatatatgtattcagta

SEQ ID NO: 68914 - DNA, 102 bp, Mus musculus
atttaatatacagtacacaaaacattccccaaatatgtctctgtatgtgtatgtacatgtgcatgtgtatgtgttatttgtatcatgtgtatagttttaagt

SEQ ID NO: 68915 - DNA, 111 bp, Mus musculus
cctttatatcaataactacctcactatattggtaatatggcttcttaccagtgtaactgcatgtccatatttagtagaacaacccacttatagtgtgttattgaaatatgg

SEQ ID NO: 68916 - DNA, 110 bp, Mus musculus
gttgtcttagtctgttagttgtcagggctgaagagatgcctcagcagttaagagctctgactgctcttcctgaggtcctgagttcaattcccagcaactacttggtggct

SEQ ID NO: 68917 - DNA, 106 bp, Mus musculus
tccttgataaagtctgtcagtctgtgtatatacattgataattagtgatgttaatatttatagttattattgaatgatgtgttcaaatctgacattgggtcattga

SEQ ID NO: 68918 - DNA, 94 bp, Mus musculus
tcaggttcagctacatgtgagagctaactgaaggagagctaagtaggctttagtatcaagacttctgatttagttctaaatgtggcaaatctga

SEQ ID NO: 68919 - DNA, 68 bp, Mus musculus
agaatgtaaggtgacagtctctctgtatctgtagtgaggagtcagagagagatcaatcctcgtattct

SEQ ID NO: 68920 - DNA, 113 bp, Mus musculus
gaaaggcagagttctcagaaggggcacttggacttctttgagactgactcagtctttcttctgaatatgtctactgatcctctctctgtgtctctctgtctctctgtctgttc

SEQ ID NO: 68921 - DNA, 106 bp, Mus musculus
ttggctctgaaattattgtgtggtcatcctgtggattaagaagttattgatgtatatatcaatataacttgttaattataaggttctagaattttgtttctaccag

SEQ ID NO: 68922 - DNA, 110 bp, Mus musculus
attttatgaataaaaaacccaaaggttcagaaattgctaaatcaattttatttaatgaaggataaaggtaaatattgaacctatgctaactgaatttttatttgtaaggt

SEQ ID NO: 68923 - DNA, 122 bp, Mus musculus
tgtttgtttgactatgtgcttcttctatgatgtgatctctctctctcacacactctttctccctttatagatagatagatagatagatagatagatagatagatagatagatagatagatag

SEQ ID NO: 68924 - DNA, 110 bp, Mus musculus
atcttagttataaaatgaatacacacatatgtatgtatgtgtatatatattcatatatatgatggttgagcaagcagtgacatatgagtgtggcagagtgttattagggt

SEQ ID NO: 68925 - DNA, 117 bp, Mus musculus
gctgactggatcctgacagaactctgtgtgcccagaggttttttttttattttttttattttttttttaagttactctgtagcactactcttattgtgcctgtctaaatcttctagc

SEQ ID NO: 68926 - DNA, 97 bp, Mus musculus
aagagctattgtgaaagtatatgaccatattcactcagggtcacagaacagaatgtgcccagtgatagagaatatatagaatctaagtaggcatctt

SEQ ID NO: 68927 - DNA, 85 bp, Mus musculus
gtgtgaaagtgcaggcatgtctgtgtctctctgtaaatgtccttgtcggacagggtctcttgtttgtgagtacactgcatatgcc

SEQ ID NO: 68928 - DNA, 72 bp, Mus musculus
gaaaaggctgacaggaggctctctagggtgtcctgttttatccctgtctgtctgtctgtctgtctgtctgtc

SEQ ID NO: 68929 - DNA, 68 bp, Mus musculus
gcaagtgtgtatgtatatgtgtgtgtacatgtatgtgaacatgcatgcctatatgcatgcatatgtgt

SEQ ID NO: 68930 - DNA, 81 bp, Mus musculus
gtatacacatatacatatacacacatacacacatgtatacacatatacatatacagtatgtgtatatgtatatgtgtatat

SEQ ID NO: 68931 - DNA, 101 bp, Mus musculus
tatacacatatacatatacacatactgtatatgtatatgtgtatacatgtgtgtatgtgtgtatatgtatatgtgtatacatgtgtatacatgtgtgtatg

SEQ ID NO: 68932 - DNA, 85 bp, Mus musculus; identical to SEQ ID NO: 57439

SEQ ID NO: 68933 - DNA, 111 bp, Mus musculus
tgttctggacaagtagggagtcatttcttagacatgtaaggtctctgtggtttacaatctatcacacttgctctgtctgagaggaggctatcctctgagcttttcctctca

SEQ ID NO: 68934 - DNA, 80 bp, Mus musculus
atgtgggttttagtcaatggctaaggatatgtgaagacagtttcactgtgtctgaactatgggacaggaaatatccagat

SEQ ID NO: 68935 - DNA, 82 bp, Mus musculus
ggctgtactaaggaatccaactgcatgaattcagaggcagattctgacttctcaagttgtgtaagcatccagggttaaagtc

SEQ ID NO: 68936 - DNA, 80 bp, Mus musculus
ccagctctgtgaccctcagtgagtctgccgtccggattgccgtccggattgaaggttcgccagcgggcgcagcggactgg

SEQ ID NO: 68937 - DNA, 110 bp, Mus musculus
agtataagcaagaacagagcccaagcaggtctgcaccaagtgtaatatatgtatttgtatttatgtgactcttcagtgtgtgagtgagtgactctgtgatttttatgact

SEQ ID NO: 68938 - DNA, 107 bp, Mus musculus
ttcatttttagtttaaagactatatttttatgtctctgtgtgtgtctgggcgtatgccagatgtaccagggaaatccagaaagggttttagatccactagacttgga

SEQ ID NO: 68939 - DNA, 99 bp, Mus musculus
ggaagatgtgccaatggtagttgtactactccaagccaggcagagcttccagtaacatactctttctctgactctgtgttctaccatgggctccattcc

SEQ ID NO: 68940 - DNA, 93 bp, Mus musculus
tgtatgtatgtacgtatgtatgtatgtatgtatgtatgtatatgtgcatatatgtacatatatgcatatatatatgtgtgtgtgtgtgtgtat

SEQ ID NO: 68941 - DNA, 97 bp, Mus musculus
tatcatctatctgtatgtatatctatctatctatatgtatatgtctatatctatacatacatatatacatatatatatatatatatataaatgtata

SEQ ID NO: 68942 - DNA, 84 bp, Mus musculus
ccagcccctgaagtgtatttttatataattctgcaattggtatagcttcatgcaaatctttaagaaaacacttcagtagattgg

SEQ ID NO: 68943 - DNA, 85 bp, Mus musculus; identical to SEQ ID NO: 57439

SEQ ID NO: 68944 - DNA, 64 bp, Mus musculus
acaaattgatattgaatgaatacatggatatacatatatccatgtattcttaattttaatttgt

SEQ ID NO: 68945 - DNA, 113 bp, Mus musculus
caaatcacattatttaaacattgtgcagtgcatatagtttctcagtgctgctgtcccactgtccctcactgaagcgcttgtagaaaagcaatgcatagaggtaaagtgaggtg

SEQ ID NO: 68946 - DNA, 86 bp, Mus musculus
gttcaaatgtgaaatatctataagcactgtcaggtggcaaaattattgtcttctacatttgatagtttttatttacacttttgaac

SEQ ID NO: 68947 - DNA, 85 bp, Mus musculus
ctggagtgggaagctacaggaaatagatgcacggtgattttagacatttcagtgtatttcttcttctgagatcttttcatttcag

SEQ ID NO: 68948 - DNA, 81 bp, Mus musculus
ggtgttccagaggatggcacatgaagcttctaaatacttcattcccagtgtgtgtgtgtctctgcctcctacttatgcacc

SEQ ID NO: 68949 - DNA, 104 bp, Mus musculus
gatgcttttgtaccattaacatttacctttggaattaagtgatgcctggtataagcctcagtcactgagacactactggtaaatgtggagggtgtgaagagatt

SEQ ID NO: 68950 - DNA, 100 bp, Mus musculus
ctccatgttcaggaagctgaggactctgaggtgatatgcttcttggttgtatacttttatatcaccttgacacaaattaggttcacatgaaaggatggag

SEQ ID NO: 68951 - DNA, 75 bp, Mus musculus
tatcttctctgtctctctgtgtgtgatcaacaggtatgtgcccatctgtattcatacatgaggggcaagagggtg

SEQ ID NO: 68952 - DNA, 119 bp, Mus musculus
ggatcaatttttattttttgacatacagactgccagttagatcagcaccatttattgaagattctttctttttttccattgtatatttttggcattgttttgtctaagataaagtgtct

SEQ ID NO: 68953 - DNA, 85 bp, Mus musculus; identical to SEQ ID NO: 57439

SEQ ID NO: 68954 - DNA, 85 bp, Mus musculus; identical to SEQ ID NO: 57439

SEQ ID NO: 68955 - DNA, 100 bp, Mus musculus
gcatcatacagttatggaatatatgtatatatatatatatatatgtatatatatatatatatatacatatatatgtgtgtgtgtgtctatctctatctct

SEQ ID NO: 68956 - DNA, 113 bp, Mus musculus
catattcaatacatgtatttgtgtgcgtatgtgtatatatatgtatatatgtctctctctatatatatgtacatataactatttcaagcatagatgtaaatgttttattattg

SEQ ID NO: 68957 - DNA, 102 bp, Mus musculus
catgaagccagtactgatgttggaccgagttccagcaaagctgagctgaatgttgcagtcactgttattctgtctctcactttttacattttggtctctatg

SEQ ID NO: 68958 - DNA, 96 bp, Mus musculus
gtctcagatgatcacctgatatttattttagttaacaatgggatgggttccattaactgattttgaaaatttgatacatactttcacatcagagac

SEQ ID NO: 68959 - DNA, 85 bp, Mus musculus
ggccatggtggtgtgataggatacatgggacaatttcaatatttttgtatctgttgaggcctgttttgtgaccaattatatggtc

SEQ ID NO: 68960 - DNA, 110 bp, Mus musculus
ctctttaaaatgaggggcagtgaattatcatagtaaggaagaagtcaaaatatcactttttgcatatgatatgatagtatacataagtgaccctaaaaattccaccagag

SEQ ID NO: 68961 - DNA, 108 bp, Mus musculus
tggccttattatgtgaaagttggagcacttgataaaacagggatatatatatatatatatatatatgctattttggaaatgttgaactttatttatatatagtttcca

SEQ ID NO: 68962 - DNA, 132 bp, Mus musculus
tatatatgtgtatacacacaaatacgcacacacacatatagaagtatatatatatatatatatatatgtgtgtgtgtgtgtgtgtatgtgtttatgcatatacatacacatatacatatgtatatatatata

SEQ ID NO: 68963 - DNA, 62 bp, Mus musculus
cagatggtgtttggctgtctgaggcccgcaaatggtgctgcctcagtggctctgtgcctctg

SEQ ID NO: 68964 - DNA, 86 bp, Mus musculus
gtacccttgagtagacgaaatcagattttttttctttgtgtacaagccaggagaagaagaatttcatctacaagtcaagggaatgc

SEQ ID NO: 68965 - DNA, 99 bp, Mus musculus
attcccataacctccctcctgagcagatgccagtttatatttatttaacatgtccaatgggaactgttcatcactgctcttggtagaggatgactgaat

SEQ ID NO: 68966 - DNA, 115 bp, Mus musculus
ttgctatataattttcaatatacacacacatatgcatacaggtatacaaatatatgaatgtatatgtatctgtgtgcatatgtatatgtatgtatataaatcttattagtagtag

SEQ ID NO: 68967 - DNA, 116 bp, Mus musculus
tgtttacctctgagtcccattttgaaaggggttatttgattttctagagtccaccttcttaagttctttatatatattggatattagtcccctatctgatttagaataggtaaaga

SEQ ID NO: 68968 - DNA, 104 bp, Mus musculus
aagatcagccttagtccatggtgatctgatagtatgcatgggacaatttcaatatttttgtatctgctaagaactgttttgtgaccaattatagggttaatttt

SEQ ID NO: 68969 - DNA, 92 bp, Mus musculus
tgttgtcagagggtgtttttctacttcagacaagtgaaaggtccaaacttcttttattttgaagtattctaagggctcacctcatgatttta

SEQ ID NO: 68970 - DNA, 108 bp, Mus musculus
cttatcacttgaaattgagagacaggaatgtagggagaaatagacagctttgacactgtttgtgatcacattccttagactataacatttcattttaattggatcaag

SEQ ID NO: 68971 - DNA, 85 bp, Mus musculus
tggtatgtgatagtcaaaacatgtgtctgccagtctgtcttattccaagtaaggcaacttctgcagacattaggtcattgtacta

SEQ ID NO: 68972 - DNA, 93 bp, Mus musculus
catatacaaatatgtgtatattctataaatgtatgtatatattctataaatgatatatatatgcatatgaaagtatagatgtgtgtaagtatg

SEQ ID NO: 68973 - DNA, 62 bp, Mus musculus
gtgtgtgtgtgtgtgtgtgtgcatgtatgtgtaggtatatgtatgtatgtatgtatgtgtat

SEQ ID NO: 68974 - DNA, 59 bp, Mus musculus
tcagggtctctgagtgtctggggtcaccccaggaatagtttcaggactgttatgtctga

SEQ ID NO: 68975 - DNA, 79 bp, Mus musculus
acttctgttactttcactgtgtctctgcttagtttttgtttccaggatctgtccattgatgagagtgatgtattgaagt

SEQ ID NO: 68976 - DNA, 85 bp, Mus musculus; identical to SEQ ID NO: 57439

SEQ ID NO: 68977 - DNA, 91 bp, Mus musculus
gctgtatatagacatatatgtatgtatgtgtgtatgtgtatatgtgtatatatctatacatataagtgtacaattatctctatatatatgt

SEQ ID NO: 68978 - DNA, 111 bp, Mus musculus
agtaatatgtgtgtatatgatgtacatgaatgtataaacatatgacatgatgtatgtatgcatgtatgtgcatatgtgtatatacttataatcatatatgtatatatacct

SEQ ID NO: 68979 - DNA, 109 bp, Mus musculus
tgtgactgggtgaactcacttgggatgactttttgctactattgtccatttatttgtgaatttcattattttaataaccaagtgatattccatcactccaattgtctca

SEQ ID NO: 68980 - DNA, 84 bp, Mus musculus
cattttggttggcatatccatcatttcagatacagagatttgtgatgtatcacagatgagtctgaggatataaacaacttagtg

SEQ ID NO: 68981 - DNA, 91 bp, Mus musculus
gggacctttggttggcatatccatcatttcagatacagaggtttgtgatgtatcacagatgagtctgaggatataaacaacttagtgtccc

SEQ ID NO: 68982 - DNA, 60 bp, Mus musculus
acacctaccctgccaagtggcctagcttagcatcccaggccactgtggtttgctggttgt

SEQ ID NO: 68983 - DNA, 73 bp, Mus musculus
atgttttagtagtcaggtgttgctgagtatgggcacagaacccataaaaagtagacagttagcactgaagtgt

SEQ ID NO: 68984 - DNA, 105 bp, Mus musculus
acttttcctgcaccatccaatgttttgaattctgaatatgtacttctggtcagttgtggctgaagacatggttctgataaaaaaaatggccaataccagtaaagt

SEQ ID NO: 68985 - DNA, 86 bp, Mus musculus
gtgtcattgctactctgagcaactagtttctttaaatatgggctcccatgggagaagtggttacagctcaccctagtacatgacac

SEQ ID NO: 68986 - DNA, 119 bp, Mus musculus
tcttcatctatggtaaatgaaactttggttgggtatagtagcatgggctggcatttgtgttctctcagtgtctgtataacatctgtccaagatcttctatttttcatagtctctggtga

SEQ ID NO: 68987 - DNA, 113 bp, Mus musculus
gtcacttgagattttgaccttagctattctgaggtttgtaagatataatcttagagtcatttttatttgtatttctctgattgactaaggatgttgaaaatttcttcaagtgc

SEQ ID NO: 68988 - DNA, 60 bp, Mus musculus
agtgtcaactctctgtgtctctcatctctttgtgggatagctgagttagagactgacact

SEQ ID NO: 68989 - DNA, 85 bp, Mus musculus
gtccatggtggtctgataggatgcatgggacaatttcaatatttttgtatatgttgagacctgttttgttaccaattatatggtc

SEQ ID NO: 68990 - DNA, 72 bp, Mus musculus
ggatctcagagcaggaacttgaagaagcagccatgtacacatgctgtttgctggctcactctctgactgtcc

SEQ ID NO: 68991 - DNA, 64 bp, Mus musculus
ccctactgagtcactgtgagtctccagctaataatcttccagactccagggtttctcactgggg

SEQ ID NO: 68992 - DNA, 77 bp, Mus musculus
gcatattcatgtatatgtgtgtgcatatgatgtgtgtgagtatttctgcatgtgcatgcatatgtgtgtgcatgtgt

SEQ ID NO: 68993 - DNA, 88 bp, Mus musculus
ggctgtgagtgtctgtatctctctgcatcatctgctgggtgaagtctttcagaggtcagccatgctcctgtctgcaagcataacagac

SEQ ID NO: 68994 - DNA, 110 bp, Mus musculus
gttggctttctgttaagcacttgaaaactcccgtgtcacatttcagctctcatgtatctgtctgtctttatctctctcacacggggattgcttttaacaggtaagctttc

SEQ ID NO: 68995 - DNA, 66 bp, Mus musculus
tcttcagtctgtctgtctgtgcagcggaggttctcaggtgacctctggccaggccaagcaggaagg

SEQ ID NO: 68996 - DNA, 95 bp, Mus musculus
tcatcaacaaacagtgctggaaaaactggatatccatgggaagaactttatctctatcactcactgtctatgtaaggtttccattgctgtgatga

SEQ ID NO: 68997 - DNA, 73 bp, Mus musculus
tccatatctggggtgagtagatatttattcttatatccccaggaatagtgtcatataactcctagtgtttggg

SEQ ID NO: 68998 - DNA, 85 bp, Mus musculus; identical to SEQ ID NO: 57439

SEQ ID NO: 68999 - DNA, 76 bp, Mus musculus
agattatgtgtcacactaggtgtagcttgggcataggagacctcaaagcctacactcacagtgtcacacttcctct

SEQ ID NO: 69000 - DNA, 111 bp, Mus musculus
tagaagtttctgggaattccatgccttgatcagagttctgattttgttgttctgcatagttacaaaggacaggccctggatctcccatgcatgatgaccagaaatagtctg

SEQ ID NO: 69001 - DNA, 62 bp, Mus musculus
ccagctgcctctgagcttctgggcagttctcctgtctctgcctgtgtttaagggagtgctgg

SEQ ID NO: 69002 - DNA, 168 bp, Mus musculus
tgtgtgtatatatagatatagatataggtatagatatgtgtgtgtatatgtatatatacatacatacatatatatgtatgtatatatatatatatatatatatatatatatatatatatatatacacatatatatgtgtgtgtgtgtgtgtgtgtgtgtgtgtgtata

SEQ ID NO: 69003 - DNA, 88 bp, Mus musculus
acacacacacatatatatgtgtatatatatatatatatatatatatatatatatatatatatatacatacatatatatgtatgtatgt

SEQ ID NO: 69004 - DNA, 83 bp, Mus musculus
caagacgccaattcatgctgctttgtactgggcacatggaagctaatattagtattaaaagagcatgaaaggtaattaacttg

SEQ ID NO: 69005 - DNA, 116 bp, Mus musculus
gttccaggcaggagcatggaggcagggaccatggaaaaggacaacgtgggagtttggtctctggctcagtctttcccaggttcatgcttagctagcgttcctttacagctcagaac

SEQ ID NO: 69006 - DNA, 85 bp, Mus musculus; identical to SEQ ID NO: 57470

SEQ ID NO: 69007 - DNA, 69 bp, Mus musculus
tgtagctctgtgtgtcacagtggctcaaggagggaaatgtgtagctctgtgtgtcacagtggctcaaga

SEQ ID NO: 69008 - DNA, 106 bp, Mus musculus
atatatatatatatatgcacatatatatcttctatgtaagtatatattcatgtatctatatatgcccacataatatatatatatccatccataaatgtatatatat

SEQ ID NO: 69009 - DNA, 85 bp, Mus musculus
ggccatgatggtctgataggatgcttgggacaatttcaatatttttgtatctgttgagtcctgttttgtgaccaattatatggtc

SEQ ID NO: 69010 - DNA, 141 bp, Mus musculus
atatataaacacatatatatgtatctatatatttatttatatataaatatatatagatatgtatatatgtgtctatatatttatttatatatatatttaacacatatatatgtgtctatatatgtctatatatgtgtatgt

SEQ ID NO: 69011 - DNA, 89 bp, Mus musculus
gtagagacaggtggcttcaaactcagaggctcttctttgttcattgcagaatctgatggagcatcagagatagatgtatctgtgtctac

SEQ ID NO: 69012 - DNA, 85 bp, Mus musculus; identical to SEQ ID NO: 57439

SEQ ID NO: 69013 - DNA, 85 bp, Mus musculus; identical to SEQ ID NO: 57439

SEQ ID NO: 69014 - DNA, 101 bp, Mus musculus
gaagctgtgtctccatactgctgcccacaattgaggagctgcaggttggatccctctatgggacagctctctgctgcagcagttaagatcactataagctc

SEQ ID NO: 69015 - DNA, 107 bp, Mus musculus
ggacacttgtgctacaagaaggcaatgctaacatttattctctctgtgcttctcacagcacctgaggacagaagattcaaacctaggtgccttctagaaaggtgact

SEQ ID NO: 69016 - DNA, 67 bp, Mus musculus
acattgtgtgactcactgtctgtgttctgtctcactggactcatgcaagtggtagagttgctaatgt

SEQ ID NO: 69017 - DNA, 79 bp, Mus musculus
tggacccctgaaccctatgtgcctccagaaaggcagcctcttggcgtctgtctgtggctctcaggtcctctcctctcca

SEQ ID NO: 69018 - DNA, 76 bp, Mus musculus
gagtgagggtccctggcttttagtgctctgctcacgcgaggggtttactgactctggcacactgtaactttgattc

SEQ ID NO: 69019 - DNA, 72 bp, Mus musculus
gatgagttatttattgtattttatgcatatgagcatttgcctgtatgcatgtttgtatgcctctttctcatt

SEQ ID NO: 69020 - DNA, 92 bp, Mus musculus
gtatgtggagttatttgatatcccatttgctcaaaactgggcttcggggaagaggtacagattcagcaagagcatgtcgagaattctatcac

SEQ ID NO: 69021 - DNA, 104 bp, Mus musculus
tgtatacatagttatatatgtgtgtatgtatgtatgtatatatatatatatatatatatatatatatatagaatatatatgtgtgtgtatatatgtatgcatgc

SEQ ID NO: 69022 - DNA, 101 bp, Mus musculus
gggaccatgtgatatagaactaaggtcagaagtctcgtgagtgacctcactgggggattttcttctgtatcttagtgaagcctgtggatgactgtagtccc

SEQ ID NO: 69023 - DNA, 78 bp, Mus musculus
catgtccctgtcaccctgattggctgaagctgcgtgcctggtgaggtgacgtggcctgctgtgagtggatggggactg

SEQ ID NO: 69024 - DNA, 85 bp, Mus musculus; identical to SEQ ID NO: 57470

SEQ ID NO: 69025 - DNA, 85 bp, Mus musculus; identical to SEQ ID NO: 57470

SEQ ID NO: 69026 - DNA, 94 bp, Mus musculus
ggagtctttatggtatatatatcacatatgcaatatatacatatatgtgcatatatgtgtatatgtatatatgtatacatacacatataattct

SEQ ID NO: 69027 - DNA, 103 bp, Mus musculus
ggttataggactagttggtattgaagaaccagttggggggctcttccatgaaagactatctctcccactctcagtgttccttagttgcctacagttctttgcc

SEQ ID NO: 69028 - DNA, 80 bp, Mus musculus
gtgagacagagtgacagagacagctgcttatcagaggtgtggccttaaacacacactctctatctttctctttgcctctc

SEQ ID NO: 69029 - DNA, 194 bp, Mus musculus
atgtaagagcatggtatatatatgtgtgtgtatatatatatatatatatatatatatagatatatatacacacatatatatcacacattaaatatatcacacacacatatatatgtgtatatatatgtatatgtatacatgtatatacatatatacacacacatacatacacatatatacattatatacatata

SEQ ID NO: 69030 - DNA, 112 bp, Mus musculus
gtgtgtgtgtgtgtgtgtgtgtgtgtatagccacatacatatatgcatgcacacattcatatgtatttatatatgtcatcatgcatatatgtgcacatgcacacacacatat

SEQ ID NO: 69031 - DNA, 89 bp, Mus musculus
accaagagcaatgacgacagccagtattgttttgggttctccaggacacccctgaccaacaacttgtaggttgttttgttcttactggt

SEQ ID NO: 69032 - DNA, 88 bp, Mus musculus
gcagaagtttggcagtgtccctctgtccctttggaatattttatgaagcaccgtgtttatccttccttgcagagtgctagaattcagc

SEQ ID NO: 69033 - DNA, 79 bp, Mus musculus
gtggcactgatgggtttctttagtgattatgtagattagtgtactatagaatgttatttgaaatcatacaggtggccgc

SEQ ID NO: 69034 - DNA, 66 bp, Mus musculus
ttcatactcagactgaagaatgacaggagaaatgggaaagtctcttttccttcagtctaccttgaa

SEQ ID NO: 69035 - DNA, 98 bp, Mus musculus
taccagcctcatatatatgtgtatatttaacaatatgtatatatgtatactatatgtatatatataatgtattatatatatatatgtgtgtgtgtgta

SEQ ID NO: 69036 - DNA, 105 bp, Mus musculus
actttggtggagtatgtcttctggtttcatagtaagttgtaaagtaaattctttttatccattaacaactactaagcctttatagatctcatgcctaattgaagt

SEQ ID NO: 69037 - DNA, 90 bp, Mus musculus
aggcacttcagaggggtcatatgacttgaggggggatgcttgggggatatgtgtgtctgtgtgtgtctgcctctgtgtgtgtgtgccccc

SEQ ID NO: 69038 - DNA, 98 bp, Mus musculus
gacttggtagcaagcacctgctgagctgtctcgcatacctggttttcctctctccctctctccttctgcctgcctgcctgcctgcctgcctgcctgtc

SEQ ID NO: 69039 - DNA, 88 bp, Mus musculus
ctggttggtagttctgtctctgtgagtccctgtggtccaatgttagttgacactgtaggttttctcttggtggtgttgacctctccag

SEQ ID NO: 69040 - DNA, 87 bp, Mus musculus
tgtctgtataatatgtctgtatgtctgtctatatgtatgtgtatacatacatatgtagggagatatatctatatatctatatctata

SEQ ID NO: 69041 - DNA, 85 bp, Mus musculus; identical to SEQ ID NO: 57439

SEQ ID NO: 69042 - DNA, 66 bp, Mus musculus
taggagggcctgtctgggagggtctatcctactgtgggcagtaccaaccctgggcaggtgctcctg

SEQ ID NO: 69043 - DNA, 123 bp, Mus musculus
tgtggcagctgtcctgggagaagttggagaggtgaagtgggggttggagatacacttgaaatatattcatttatgaatttctaaataaaagaacagaaattctcaaaaggggtacacagatgt

SEQ ID NO: 69044 - DNA, 80 bp, Mus musculus
tgcttgtctcacccggagtctcagtgaaagtacagtggggttttacctggattttcagagagtggagccgggagtctgca

SEQ ID NO: 69045 - DNA, 85 bp, Mus musculus
ggccatggtggtctgataggatacatgggacaatttcaatatttttgtatctgttgagccctgttttgtgaccaattatatggtc

SEQ ID NO: 69046 - DNA, 69 bp, Mus musculus
gctctctctccctctgactgcattcccatggatgggatcaagtggagttttggaaggatgattgttggc

SEQ ID NO: 69047 - DNA, 84 bp, Mus musculus
agtgagatggcttagtggataaaggagctggtgagtggatctgatggcctgctttcaatcactgggtctctgactcccacatgc

SEQ ID NO: 69048 - DNA, 116 bp, Mus musculus
cacactgtcccggttggacaaagcaggaaggtcacctggaaacctcatgtgctaccctagtgttttagatgaggacatttctaatacatccagtttccctctagctgtcagtgatg

SEQ ID NO: 69049 - DNA, 76 bp, Mus musculus
ggactccatctgctgtagactcatacggaacctgagcgtgctgcctcagtctctctctgtgagtttgtatgtgtcc

SEQ ID NO: 69050 - DNA, 128 bp, Mus musculus
gcagctgctcttgtgcccttggattgtcttgctgggatgcactttgttacctctggtgacagcctctctctgtgcgtacgtctaagagggcctgtctcgggatatctgttcctttggcaggattgtcc

SEQ ID NO: 69051 - DNA, 95 bp, Mus musculus
cccctgtcagcctgggacgggaggtggctactggagtgtttcacagccctgaggtgtctctgtgtttcactctcctgttctcaagtacaaagggg

SEQ ID NO: 69052 - DNA, 114 bp, Mus musculus
agatctatataccatttttaattgggttattttgtttgttggtgactaatttcttgagttctttatatattttggatatcagccatctgacagatataggactggtgaagatct

SEQ ID NO: 69053 - DNA, 114 bp, Mus musculus
gtgactctgctctcatctccatggttgtactttgtgttaatgagctaggactgagtacttcacagtcttttactctctgcacggcaaccagttgtggacctttaggttattcat

SEQ ID NO: 69054 - DNA, 69 bp, Mus musculus
cagaactaaatttgttcatgtataggcctctgggtagccatagctaaacacagagatgtataggttctg

SEQ ID NO: 69055 - DNA, 79 bp, Mus musculus
agctagcaggaacagagtctgcacactgcccccactgaagagtaggtggaaggagccggatctctggatcatcctggct

SEQ ID NO: 69056 - DNA, 85 bp, Mus musculus
gtaaggaagttgcatgtttttcttatgtaaagatgattgatgatctgtggaaaataagagtgggcattaaggcagctttccttac

SEQ ID NO: 69057 - DNA, 76 bp, Mus musculus
gtggtatgttgtctctgtgtgtgcatgtgtgtgtgttggatgcatgcatgtgtcaactgctcactcaagtatacat

SEQ ID NO: 69058 - DNA, 89 bp, Mus musculus
tgtttgttgctcttccagaggacccaagttcagttttcagaacccacactgggcagctcacaactgtctctctctggtgttggcaggca

SEQ ID NO: 69059 - DNA, 121 bp, Mus musculus
tgtatttgtatgtatatacatatgcatgtggatatatacacatgtatatgcatatacatacaaatatatatatacacacatgcatgtatatatatgtgtgtgtgtttctgtgtgtgtatat

SEQ ID NO: 69060 - DNA, 124 bp, Mus musculus
atatatgtatgtatgcatgtgtatatatgtgtttttgtatatatacatgtgtataaatattatatatctatgtatacatgtgtatatatgtgactatatgtatatatgtgtatattcatatgta

SEQ ID NO: 69061 - DNA, 80 bp, Mus musculus
tatgtgtgtgtgtatgtatgtatgcatgtatgtgtcacatgaatgtatcacatacatgcccgtgcgcacacacagacata

SEQ ID NO: 69062 - DNA, 191 bp, Mus musculus
gtgtatgcatgtatatacgtgtgtatatgtatatacgtgtgtgtgtctatgtatatatgtgtgtatatgtatatatatgtgtatgtatatacgtgtgtctatgtatatatgtgtgtatatgtatatatatgtgtgtgtatgtaaatacccgtgtgtgtgcatatacatgtgtgtatgtatgtatatacata

SEQ ID NO: 69063 - DNA, 70 bp, Mus musculus
aggggggtgtacatatgcacatatgtacatatgtatgtatgtatgtatgtgtctggtcatcagatcccct

SEQ ID NO: 69064 - DNA, 62 bp, Mus musculus
tctgattcacacacactgagtttggggcctgagtggaaggctcttgagtgtggaaaatcagg

SEQ ID NO: 69065 - DNA, 121 bp, Mus musculus
gctcaaataaatgagtggtaaagagacttcatgttagggttagattatttgttcttctcttagtggggaggagttagtttttaccaagggaggacagggcagacacaattattaaaaagtc

SEQ ID NO: 69066 - DNA, 116 bp, Mus musculus
gggcattgaatctttggcagcttgagttacaggcagttgtgacccacctgccccacagacacacacatacacacatcaggtggcttacaactttaactccagctgcagatgtgtct

SEQ ID NO: 69067 - DNA, 83 bp, Mus musculus
tgagaggctccgtgaatgccagttggccatcatttccactttgctgtcaaagcggaagacatttggcatgccaccaactctta

SEQ ID NO: 69068 - DNA, 108 bp, Mus musculus
tgattatgaatatgtgtgtattggcacggacagagagagagagagagagagagagagagagagctcttgtggggctttttgttgtcatatttgcaggttctaacttca

SEQ ID NO: 69069 - DNA, 115 bp, Mus musculus
ccagttactacaaataaaaaccagaaagacttgagaacacattttgtagttctgttcctcacggagttagaagctatgtctaatcgagtaatgtttggtccaatgcctgctatgg

SEQ ID NO: 69070 - DNA, 85 bp, Mus musculus; identical to SEQ ID NO: 57470

SEQ ID NO: 69071 - DNA, 71 bp, Mus musculus
ttgtatgtacttgaatgtatgtatgtatgtatgtatgtatgcatgcatgcatgcataccatgtgtgtgcag

SEQ ID NO: 69072 - DNA, 87 bp, Mus musculus; identical to SEQ ID NO: 60417

SEQ ID NO: 69073 - DNA, 73 bp, Mus musculus
cagtgacagagtcagtgtctctgtgggggatggccaaaggggcagtgccacagagaggagcacagaggaactg

SEQ ID NO: 69074 - DNA, 79 bp, Mus musculus
gcatgcatgggatggacctaggcccttgtcccttcatgtgggactcctaacagggcctgtctctgagtctgttgcctgc

SEQ ID NO: 69075 - DNA, 108 bp, Mus musculus
gtattaatatgtttgtctctatgtctctgaatctgtctctgtctctataggcaaataggtttgtagtagataacttgcctagcatgcatgagaccctaaattcaatgc

SEQ ID NO: 69076 - DNA, 124 bp, Mus musculus
cactgaggggggtcggggggggggggctttgtggtttccaaagcccaagccaggctcagtctctctctgtgcctgctgcctgagggtgaggatacacagctcgaagctacttcttcactgggcc

SEQ ID NO: 69077 - DNA, 69 bp, Mus musculus
gtgtccctgcagagcatcagtccaggaagcccatggtgcctgactgccagtctccaagccagggcacac

SEQ ID NO: 69078 - DNA, 58 bp, Mus musculus
gtgtgtatgcacgtatgcatgcatgcatgcatgcatgtatgtatgtatgtatgtgcat

SEQ ID NO: 69079 - DNA, 81 bp, Mus musculus
taaggatgccatgtggttttctgacagtctctcagattcaatctgttaggtagctgtgaaagccactcaggtttagattta

SEQ ID NO: 69080 - DNA, 91 bp, Mus musculus
ttatagtcagcagtagattttttttttttcaggaatgtcatgagttttgaggactgagaatttagggaagctttactctgtggcattgtga

SEQ ID NO: 69081 - DNA, 86 bp, Mus musculus
cagcagctgtgcttggtggttcaggcctataatccaaggtacttgggaagctgaggtaggaggatgctaagttcaaggattgactg

SEQ ID NO: 69082 - DNA, 81 bp, Mus musculus
tctgtgtatatgtctgtgtgtctgtgtgcctatgatctgcgtacatgaacataggtacttaggataactagacatgtctga

SEQ ID NO: 69083 - DNA, 99 bp, Mus musculus
catatgatgtatacatcccatgcagtactcttgctcttaaatgtatatattttcatttgtggagaagctgtacagggcagctgtgttcatcattctatg

SEQ ID NO: 69084 - DNA, 101 bp, Mus musculus
ccatccactgtttggctgtggacggtgtctgtatctgtctgagtcagcggctgggtggagcctcgaagaggacaacatgcttccgtctacaagtagaatag

SEQ ID NO: 69085 - DNA, 69 bp, Mus musculus
cttgtattctcacaacagacttctgactctgtcacctgctggcaggccaggatctgcaggttttacagg

SEQ ID NO: 69086 - DNA, 156 bp, Mus musculus
tatgcatgcatgtgtgtgttacgtgtttgtgtgtgtgtgcacacatgtatgtatgcaagtatgtgcatacgtgtgtgtgtgttatgtgtgtgtacacatgtgtgtatgaaagtatatgcatgcatgtgtgttatgtgtttgtgtgtgtgtgcacac

SEQ ID NO: 69087 - DNA, 84 bp, Mus musculus
tgtgtgtgtatttgaatatattttcatatatatacatattcaaatatatattttcaaatatattcaaatctataaacatatata

SEQ ID NO: 69088 - DNA, 85 bp, Mus musculus
tgtgtgtgtgtgtgtgtgttggaggagctatgggcgtctttgctgtcacaccctctctctttcatctgtattcatctatgctgca

SEQ ID NO: 69089 - DNA, 91 bp, Mus musculus
gctgctagtgtcaaggaaacagatttatgtgggcaccagctagttctccagagctggccacacaaaagagactgtgctgattctgggtagt

SEQ ID NO: 69090 - DNA, 78 bp, Mus musculus
cttgtcctcttctgctctgtgcccttgtttcttttctctatacccagccagagacaggagacagagagttccaacaag

SEQ ID NO: 69091 - DNA, 85 bp, Mus musculus; identical to SEQ ID NO: 57439

SEQ ID NO: 69092 - DNA, 72 bp, Mus musculus
gcatgacctgtgattttgattttaaccattttgatgggtacaaaatggaatctcagagtcattttgaattgc

SEQ ID NO: 69093 - DNA, 100 bp, Mus musculus
atatatatatgtgtgtatatatatatatatatgtgtgtgtgtgtgtatatatatgtgtgtgtgtatacatatatatatatatgtatacacacacacacac

SEQ ID NO: 69094 - DNA, 87 bp, Mus musculus
gtatgtacatatgtatatatgcatatatgtatgtatgtatgtatgtatgtatatatgatatatgtgtgtatatatgtatgtatgtat

SEQ ID NO: 69095 - DNA, 118 bp, Mus musculus
actgtcacataggcagtctgacagtagctcaggatgattgcatgttcaaaatttattgtgtagtgtgcagtctggtcttcctggtgcctccactgccatcgcctgtgtatgatccagt

SEQ ID NO: 69096 - DNA, 117 bp, Mus musculus
cgtggatcttgtatgaggtgctcagaatgtccagacatagctataacaccatgcctgtggtagattacacgatagccagaagtctcacatatgttcatgccactcttgagaattgtg

SEQ ID NO: 69097 - DNA, 80 bp, Mus musculus
tatatatatatatatatatatatatatatatatatatatatatatatgtatatgtatatgtatatgtatatgtatatgta

SEQ ID NO: 69098 - DNA, 75 bp, Mus musculus
gcagttgtatatatgtatgtatgtatgcatgtatgtatttatgtgcactgatattttgcctgtatatatgtctgt

SEQ ID NO: 69099 - DNA, 89 bp, Mus musculus
ggggaaatgattactgcatagagtctcactatgtgacacagttcctacgcactgctctgagaagcctactgtattagtcagggttctct

SEQ ID NO: 69100 - DNA, 67 bp, Mus musculus
atatgtatgcatgtatgtatgtatgtatgtatgtatgtacgtatgtatgcatgtatgtatgtatgca

SEQ ID NO: 69101 - DNA, 85 bp, Mus musculus; identical to SEQ ID NO: 57439

SEQ ID NO: 69102 - DNA, 107 bp, Mus musculus
tggagctggagggagggctggaggggagtctagagaaactgtgggctgcaggccctgtctctgcctcgctctcacatgtaaactttcctctccacgaattcttgcca

SEQ ID NO: 69103 - DNA, 85 bp, Mus musculus
ggccatggtggtctgatagaatgcatgggataatttcaatatttttgtatctgttgaggcctgttttgtgaccaattatatggtc

SEQ ID NO: 69104 - DNA, 107 bp, Mus musculus
gaaatgaacatataaaatttcacacgactaggtgaagcttttagtctctctgtgactgagctgggaataatgaacgctcatctgaattgggataaatctgttctttc

SEQ ID NO: 69105 - DNA, 91 bp, Mus musculus
ttgatagccacctgtccccaacatgtatgcctgtgctatattagatattttaaaatgacacagaatatagactgaacaggcagcctttcaa

SEQ ID NO: 69106 - DNA, 109 bp, Mus musculus
acaggtgcgaataataagatgccaggtgctcctgcctttctctcagtctgtggctgacctgcctgcggatgaatgcgaagggcctaagccagcatcgcaacgtgcctgt

SEQ ID NO: 69107 - DNA, 71 bp, Mus musculus
gccgtctagtgatttagtagtactgggattgaacccagatactttcctgctgatctatatccttagacggc

SEQ ID NO: 69108 - DNA, 85 bp, Mus musculus
tcctggtttttctccaacacttgtcattttctatgattgaagcaaaccagtggggaaagtagaatgagatgtgaggaagaaagga

SEQ ID NO: 69109 - DNA, 64 bp, Mus musculus
ttaggtgtctgcctgcctgcctgcctgtgtggatgcgggcactcttggaggtcagatctcctgg

SEQ ID NO: 69110 - DNA, 112 bp, Mus musculus
gttgaaacgttgtcatgtgtcttcaaaccatatctgctcagcttgctgtcatcagccaccagagtagtgtgcagataggacaatggaaagacacacacacacacaaatcaat

SEQ ID NO: 69111 - DNA, 79 bp, Mus musculus
actgtgtgtatgtgtgcatgaatgtatgtatgtatatatgtgtgtatatatatatgtacatgtgtatctatccgtctgt

SEQ ID NO: 69112 - DNA, 75 bp, Mus musculus
tatatgtatgtatgtatgtatgtatgtttacacatatgtatgtgtgtatgtatgtgtatctatgtatgtatgtat

SEQ ID NO: 69113 - DNA, 108 bp, Mus musculus
atatagacaaccattagccgccataccaagctatgacttatactttttaaaagttttatttatttttattttatgtgcattggtgtttgcctgtgtgtatgtctgtgt

SEQ ID NO: 69114 - DNA, 92 bp, Mus musculus
ttcatgtgcttgtgtttgcatatgtgtgtttatatgtgtttacatgtgtgaagcacctgtatgtgtaggtgtgcatacaggcatgtgagtgt

SEQ ID NO: 69115 - DNA, 91 bp, Mus musculus
cacttacggggctggagagatggctcaggggttaagagcattgactgctcttccagaggttccgagttcagttctcagcaaccacatggtg

SEQ ID NO: 69116 - DNA, 109 bp, Mus musculus
atgtgaatggcccagttggaggtgaagcctaggtgagacagtggagagagcctgctgactggctagctctgggtcattgctgctttggagtctttctgggtcttcatat

SEQ ID NO: 69117 - DNA, 80 bp, Mus musculus
ttttgttagcaatctgctagttttatgtatttatttccaaatgatacatcatgatttttacatagcagattgttatgaga

SEQ ID NO: 69118 - DNA, 122 bp, Mus musculus
gtaactccagcaccagaggaatatgactgatcaccaaggatgcctgcacatatgtgagtgcacacacacacacacacactgcgatagcttgaattcaaaatgatcctcttagtttacgtgct

SEQ ID NO: 69119 - DNA, 76 bp, Mus musculus
catgaccttctctctctcagtcaggcagtagtggactttgggacataagtgcaagtattggagaaatggtggcatg

SEQ ID NO: 69120 - DNA, 76 bp, Mus musculus
atacatgtacatgtatgtatgtatgtgtgtgtgtacatacatatacacacacatatacatatatatgtatatatat

SEQ ID NO: 69121 - DNA, 143 bp, Mus musculus
atatatgtgtgcatgtgcatgcatgcataggtgtgtgcctgtgtatgtgtatatgtgccttgtatgtctctctctctgtgtatgcatgtgtgtgtgccttgtgtgtctctctgtgtgtgagtgtgcatgtgcatgtgtgtata

SEQ ID NO: 69122 - DNA, 79 bp, Mus musculus
aatgtatctgtctgtctgtgtctgacacacacaagttctacgtggatctaatgtttggaagcagaagggaacatacatt

SEQ ID NO: 69123 - DNA, 120 bp, Mus musculus
catgggtgtcgaatcttcaattaatttctgatattctggtaagtgctctgcctctctacacaagctcagaaaattagtcagccttaatgttggaagcattgatggagactctgcatagtg

SEQ ID NO: 69124 - DNA, 69 bp, Mus musculus
gatctggcagagagggagagcagaggctacatggagcactccacacactgtcacgctctcagtcggttc

SEQ ID NO: 69125 - DNA, 76 bp, Mus musculus
ggggctggagagatggctcagtggttaggagcagtgtctgctcttccagaggtcctgagttcaattcccagccacc

SEQ ID NO: 69126 - DNA, 113 bp, Mus musculus
tgtgtgtggagataaatacatatatgtgaggtgtgtatgtgtagagactgtatgtgtacagtagtgtgtatatgtgtagaggaatgtgtgtgtatatggtgtgtctatgtgca

SEQ ID NO: 69127 - DNA, 91 bp, Mus musculus
gagagagagagagagagagagagagagagagagagagaagccaggaaagggctacatgtgtcttcctctgtcagtctctgcctgttcctcc

SEQ ID NO: 69128 - DNA, 103 bp, Mus musculus
tgtgtgtatatatatatacacacatacatatatgtgtgtatatatgtatatgtgtatatatatgcacacatacatatatgtgtgtgtgtatgtatgtgtgtgt

SEQ ID NO: 69129 - DNA, 85 bp, Mus musculus; identical to SEQ ID NO: 57470

SEQ ID NO: 69130 - DNA, 98 bp, Mus musculus
gtgggttttggtttggtttggttgtagagtcagtgtttctctgtgtaacattggctatcctgaaacttgctgcgagaccaggctggcctagaactcac

SEQ ID NO: 69131 - DNA, 98 bp, Mus musculus
cacttccatgacagtgaagccaggatgtggccttgccatttacaaggaagacttgggtgaggtagaaacttgtcccagcctgtcacatggccacagtg

SEQ ID NO: 69132 - DNA, 85 bp, Mus musculus; identical to SEQ ID NO: 57439

SEQ ID NO: 69133 - DNA, 80 bp, Mus musculus
gtggatatatatatatatatagcatatatgtatgtatatatatattgcatatatgggtggatatatatgtatgtatgtat

SEQ ID NO: 69134 - DNA, 92 bp, Mus musculus
tatctgtctagtttcatagcctgtaactctcacactcacttaaatgcacacacataggcatggaggttaggctctgagatatgaaagagatg

SEQ ID NO: 69135 - DNA, 72 bp, Mus musculus
ttcctccagagaacaatgactgctgtggggattccctgtccttccagtccatcctttttctctgataaggaa

SEQ ID NO: 69136 - DNA, 89 bp, Mus musculus
gtttctcttagagaggttccatgtgcatgtgaatggagctggctttctggcagactcactggctgtgcagtgtggagtatttgagaaac

SEQ ID NO: 69137 - DNA, 75 bp, Mus musculus
ctttgcctgtctgctcatgtgtctgtacatttattttctataaagaagggagtttctgggaacagagaggcgagg

SEQ ID NO: 69138 - DNA, 81 bp, Mus musculus
tctgaaacccagctgccctctatgtgataacttagagtgtctctctcacagttaagggtcccttagggttaaaagtttaga

SEQ ID NO: 69139 - DNA, 95 bp, Mus musculus
caacatcctgttattgaaatttctctgaatatatttgcttttttaaaacacagaagcaaatgtttggggatttttaggctcacatctttttgttg

SEQ ID NO: 69140 - DNA, 104 bp, Mus musculus
agaagcataggagaatctagaaaaggaaagctgccatttagtttcaaagtattagtagaaggctctttggaggaagcggtgtttgagttgggtcttgtggctct

SEQ ID NO: 69141 - DNA, 108 bp, Mus musculus
gcctgtgcctgtgcctgtgcctgtgtatctgtctgcctgcctgcctgcctgctgtctgcatttgtttgcttgtggaagatgaagaaaccagtctcaggtagcctatgc

SEQ ID NO: 69142 - DNA, 67 bp, Mus musculus
gcctatgtgtgtgtgtctgtgtatcatgtgtatgcctggtgccagaaacttaaagccatctgtaggc

SEQ ID NO: 69143 - DNA, 87 bp, Mus musculus
atctctgtggctatgtatgcctgttatatggaaatcagaggtgtgtatacatctctctgtgtgtatgtgtgcttgccatgtggaggt

SEQ ID NO: 69144 - DNA, 144 bp, Mus musculus
acctcttttcttctttgtgtgtatagtgtctatgcatatacatctctgtgtatgtgtgtatgtgtgcttgtgcatgtggcggtcagaggtgcgtatacacccaccccggtgtgtgtgtgtgtgtgtgtgtgtgtgtgtgtgtgt

SEQ ID NO: 69145 - DNA, 74 bp, Mus musculus
gagcagagtaagtgaggtgactgagctgtggcctcacactgcacactggcattcacactcacacacatatgctt

SEQ ID NO: 69146 - DNA, 67 bp, Mus musculus
tctcctgcatgtatgtatgtatgtatgtatatatgtataccacatatgtgcttggtgcctgtggaga

SEQ ID NO: 69147 - DNA, 68 bp, Mus musculus
gcaaggcagagagcacaggtgaagcaggaggggacgaaggactccctgacactgtcactttgagaagc

SEQ ID NO: 69148 - DNA, 69 bp, Mus musculus
tgtgtttgcagagtacctacaagaggtggtttgctcctttcactttgtgggtctctctcacgcacacac

SEQ ID NO: 69149 - DNA, 103 bp, Mus musculus
tgtaagaatgtactgtgtgggacaatagtggctcagaccctctctcaaacaaggtggaagaggacccccaaggttgttctctgacacacatacaaatcatata

SEQ ID NO: 69150 - DNA, 96 bp, Mus musculus
tggggcacagaagtgacagaggagaagtgacagagcacattgacagaggagcttcagtcctagtgaggtttgccagttatctgttgctgtgttaca

SEQ ID NO: 69151 - DNA, 79 bp, Mus musculus
gtgtgtgtgtgtgttgtggggatgggtggtggctgaggcagggtctctctatggctgtcctagaacttactatgtagac

SEQ ID NO: 69152 - DNA, 85 bp, Mus musculus
ttctacatagagacaagatgctgagctcagtgtgtgaggcactcaagaccagatactctggggcagtcaagttgggtatgcagga

SEQ ID NO: 69153 - DNA, 78 bp, Mus musculus
gggtgcacatctgtcacatgggagcttctcctatacctgcacataaaggagactctcactgtgactttttgcacaccc

SEQ ID NO: 69154 - DNA, 80 bp, Mus musculus
ttcgtagagtgcatcaagcacacacactgctttttctgtcagtctcactagcagtgtaagtcattggtgtaagtagagaa

SEQ ID NO: 69155 - DNA, 102 bp, Mus musculus
actgtgtgttttctctgctttttttgtttgaacaattgcatataatttttaaaattatagtttcttgcttattgtcagatatgtgagtgtaaaacatgtagt

SEQ ID NO: 69156 - DNA, 77 bp, Mus musculus
ggaagctcttcagggttgctgtgagaagccaggaggctgtctgattcagtctagcaccaatccaaaagaaaatgtcc

SEQ ID NO: 69157 - DNA, 93 bp, Mus musculus
tacattttagaggtgtatgtatatatatgcatatatgtatgtgtatatatatgtgtgtatgtatgtgtatctacatacgtatctatgtgtgta

SEQ ID NO: 69158 - DNA, 116 bp, Mus musculus
ggagcatgggtagcctgttaatgacccagtgcctgagcctgagtcactccctctgacaagagatctcaggtgccaataggtactcatttgggggtagaacttcctgactttctctc

SEQ ID NO: 69159 - DNA, 106 bp, Mus musculus
gatagacatgctttcactatgtatgtttgttatcattgagtgtctgtgagcgtgacttgtgagactctgtctgtttttgagtatatgtgaccgtgaatgtgtatgt

SEQ ID NO: 69160 - DNA, 112 bp, Mus musculus
gatcagtcttaggccatggtggtctgataggatacatgggaaaatttcaatatttttgtatctgttgaggcctgttttgtgaccaattatattgtcaattttggagaaggtc

SEQ ID NO: 69161 - DNA, 66 bp, Mus musculus
gtaccatgtgacttgttgatgggttttgagtctactcacactttctgcttcagagtagcatggtat

SEQ ID NO: 69162 - DNA, 97 bp, Mus musculus
ggcaaagtgcaaagactttcagctgtgctggcctgtgcatgtgcatgtgcatgtgtgtatggaagacagagatgggtgtcaggtatgctctattgct

SEQ ID NO: 69163 - DNA, 71 bp, Mus musculus
ttctgtgcttctgtgtgtgtgaaagagagagagaacatagacacacacacacacactagagagcgacagag

SEQ ID NO: 69164 - DNA, 76 bp, Mus musculus
cagacagacagacagacagacagactggcaggctgcagcatgccaggagcttcggggagatgtcaggtctgtgctg

SEQ ID NO: 69165 - DNA, 71 bp, Mus musculus
cagacctgacatctccccgaagctcctggcatgctgcagcctgccagtctgtctgtctgtctgtctgtctg

SEQ ID NO: 69166 - DNA, 111 bp, Mus musculus
gtatgtgcatatggaggacactggacaaggtgaaaggcatttggttgcagaaatatatatatatatatctgcttctggaccctttcctggagtcctctgagttgcagatgc

SEQ ID NO: 69167 - DNA, 118 bp, Mus musculus
tggtattgctcctgtaactcggaactggagaggaggcaagatgctggcatagctgttgaactgagaacctgctatgccaacatattgccatctttcctgtctgacagcagcttggcta

SEQ ID NO: 69168 - DNA, 75 bp, Mus musculus
gatacacacgggatcactacatattatatacttggaagttctcctccgtttagtgtgctgacttctgtatgtgtc

SEQ ID NO: 69169 - DNA, 88 bp, Mus musculus
cctgcacaaatgcacatatgatcagcacattactgtttttttttaaaaagccatgaagtgcggggttgggggttgggagaggtggagg

SEQ ID NO: 69170 - DNA, 85 bp, Mus musculus; identical to SEQ ID NO: 57439

SEQ ID NO: 69171 - DNA, 112 bp, Mus musculus
aagggaaattcgtctgaagttctctttctttgttggatctttgtgtggtttagatatcagagtaattgtggcttcacagaatgaattgggtagagtaccttctgtttctctt

SEQ ID NO: 69172 - DNA, 88 bp, Mus musculus
agaagggaggattactgagtgtctgtctgcctctcctctgtaacgaagtcagagggaggattactgggtgtctgtctgcctctcctct

SEQ ID NO: 69173 - DNA, 116 bp, Mus musculus
gctgagggaaagaggctaggaagcaaggattctgaataatgataacagcatgcaagttaagagatttatttgatgtgtatgactattttgcctgagtggatgcctgtgcaccttgc

SEQ ID NO: 69174 - DNA, 72 bp, Mus musculus
ggatatgtatgtatgtatgtatgtatgtatgtatgtatgtatgtatgcatgtatgtacatatgtatgcatct

SEQ ID NO: 69175 - DNA, 82 bp, Mus musculus
tatgtgcatgtgtgtggtatatgaactcatgtgcatgtgtatatatatatgtgtgtggtgtgtgcctggatatgtgtgtatg

SEQ ID NO: 69176 - DNA, 85 bp, Mus musculus; identical to SEQ ID NO: 57439

SEQ ID NO: 69177 - DNA, 104 bp, Mus musculus
gactctaaaggatgaaccttagatgaaatgcctgacagtagagagagggaacttatagagcccacctccaattggaagacaggacatcaataagggatggggtt

SEQ ID NO: 69178 - DNA, 98 bp, Mus musculus
gtgtgttttgttatggtttactgtcatatatatttactgatatatatatgcatatatatatatactgttatatgacaataaatcataataaaatttat

SEQ ID NO: 69179 - DNA, 64 bp, Mus musculus
gcaggccataggtgtgcagatcataggtgtgttcatttgtgtgcgtgcgtgcctgcctgcctgc

SEQ ID NO: 69180 - DNA, 85 bp, Mus musculus
gcagctgtgtagattggtcttcctgggggtccactgtccctgactctgtgcctacctatagatcctcttcccttaactgggctgc

SEQ ID NO: 69181 - DNA, 106 bp, Mus musculus
ggtttcatgtgggtcctgcatagctggagtggggatatcctataagctgttgcctgtctgtgagtctgtgggatatgttcttctagctgtgctgccttatttggcc

SEQ ID NO: 69182 - DNA, 97 bp, Mus musculus
gaattctaggatttatttgtgcttgtgcaagtagtatgcatgtgtgcacgtgtgcgcgtgtgtctgtgtgtgtgtagctcacaattcccaagaattc

SEQ ID NO: 69183 - DNA, 97 bp, Mus musculus
gttttaattccaccatagtactcagcagacagacagaactctgtgagttcaaggccagtttagtctgcatagtgagttccaggacagagaaggagac

SEQ ID NO: 69184 - DNA, 102 bp, Mus musculus
tcatgtttaggcataactgtgacctggctatttttttctttcatttgggaattaaccatgacttaagaagatatgattggctgtcaagttgacaaaggatga

SEQ ID NO: 69185 - DNA, 100 bp, Mus musculus
gggaatgcctttgatcttgatgtacggcgcatagctctgggaacaacacaactgtggtgtcacactgtctgcgtgcttcattacgtcgtattgttttctc

SEQ ID NO: 69186 - DNA, 100 bp, Mus musculus
gcaattgtagcagccactattttgtcatggttctgtgtatttttcattaaatatagctggtattatattccatttgatgaagtggttaggttacaatccc

SEQ ID NO: 69187 - DNA, 77 bp, Mus musculus
acatatatatgtatgtatgtatgtatgtatgtatgcatgtatgtatataatgtgtgtgtgtgtatgtgtgtgtgtgt

SEQ ID NO: 69188 - DNA, 94 bp, Mus musculus
ctggactggaaatcatatatgttgtctttgtggaaataatttgtctttatttcttcatgatataaaggtgatgtgttggatgtaaattgtctag

SEQ ID NO: 69189 - DNA, 77 bp, Mus musculus
atatgtgtatgtatatgtgcgtgtatatatatatgtatatatatgtatatatatatatatatatatatataaaacac

SEQ ID NO: 69190 - DNA, 85 bp, Mus musculus; identical to SEQ ID NO: 57439

SEQ ID NO: 69191 - DNA, 90 bp, Mus musculus
tcctgctattcccttctctaacagttaatgttctactatttttacaaataagagaatttctacttgagatattattgaaggtaggtagga

SEQ ID NO: 69192 - DNA, 95 bp, Mus musculus
atatgcatatgatatacacatgtatgtgtatattatatatatgtctatatatgtgtatatgatgaataagtatgtgtgtatgtctatgtgtgtgt

SEQ ID NO: 69193 - DNA, 75 bp, Mus musculus
ttagaggcacagaaaagagacagaggacgcacacattgaacagcccttcagtttctttgtcattctttgtcctag

SEQ ID NO: 69194 - DNA, 106 bp, Mus musculus
tgatttgaagcagggtagtagttaaatgtcagtgtttagagttcctgtagacaggaagtatatcaattttaatataaagccatttactctttatttcttcaagtga

SEQ ID NO: 69195 - DNA, 92 bp, Mus musculus; identical to SEQ ID NO: 57641

SEQ ID NO: 69196 - DNA, 75 bp, Mus musculus
gaggtggtgtgtcactgaggatgggctttgaactttcaaaagtccatgccaagctcagttttctctctctgtctc

SEQ ID NO: 69197 - DNA, 161 bp, Mus musculus
gtgttgttcagtttccacatgagtgttggctttctattattttttttgttattgaagatcagccttagtgcatggtgatctgataggatacatcggataatttcaatatttttgaatctgttgaggcctgttttgtgacctattatgtggtcaattttgga

SEQ ID NO: 69198 - DNA, 85 bp, Mus musculus
ggccatggtggtctgataggatacatggggcgatttcaatatttttgtatctattgaggcctgttttgtgaccaattatatggtc

SEQ ID NO: 69199 - DNA, 85 bp, Mus musculus
ggccatggtggtctgataggatacatgggacaatttcaatatttttgtatctgttgaggcgtgttttgtgaccaattatatggtc

SEQ ID NO: 69200 - DNA, 76 bp, Mus musculus
aggtgcatcatctctgactgaacacaaatctggcagtcctctgctgtctgtatctgtgtgtgtgtgtatgctgcct

SEQ ID NO: 69201 - DNA, 96 bp, Mus musculus
atatggctggtatataaatgtccttctttggttttaatgtagttcaatattattgaataattcaaagaaccgagacagcagtaactggaagcatat

SEQ ID NO: 69202 - DNA, 72 bp, Mus musculus
ctgtctgtctgtctgtccgtttgtgacatgcttagaaagagtcttgatcatgggggtggagggatggctcag

SEQ ID NO: 69203 - DNA, 78 bp, Mus musculus
tatgtattatatgtatatatgtatatacatatgcatatatatgtatgtagtatttactgaatgtatatatgtatatat

SEQ ID NO: 69204 - DNA, 117 bp, Mus musculus
ctgtctctgtctgtataatatgtctgtctctcttcatatatacatatgtatatatatgtgtgtgtgtgtgtgtgtgtgtgtatatatatatatatattagaaagattgtgaagtcag

SEQ ID NO: 69205 - DNA, 90 bp, Mus musculus
gcttattataaaggatctgctggcttgtgttgcagcttcatggttgtatcgttaatctttggttgtacggagcaggaggttacagttagc

SEQ ID NO: 69206 - DNA, 112 bp, Mus musculus
actgtctcccacacaagatacttctcccctcagcagattgcttaaaatgctttcatactctgagtatggttttctagctgtagaaaagaaggtgggatcaataccgcacagt

SEQ ID NO: 69207 - DNA, 106 bp, Mus musculus
gccttagtccatggtgatctgataggatgcatgggacaatttcaatatttttgtatatgttgaggcctgttttgtgaccaattatattgtcaattttggagaaggt

SEQ ID NO: 69208 - DNA, 84 bp, Mus musculus
caaaatgaaagcccagattatatttatattttgcaaataacttccagtgggaagcttgtgtattatgtttgggtttgtagtttg

SEQ ID NO: 69209 - DNA, 61 bp, Mus musculus
gagggtggggggaggaaggggggaagagggaagactctgactctgcctgcctcagaccctt

SEQ ID NO: 69210 - DNA, 85 bp, Mus musculus; identical to SEQ ID NO: 57439

SEQ ID NO: 69211 - DNA, 109 bp, Mus musculus
aacgtcagagcatatatgaatctaaacaccaataggagaggatcggcgtgtgtgtctctgtgttagagtatcataaagatgaacctcagagagaggggcttcagggcga

SEQ ID NO: 69212 - DNA, 97 bp, Mus musculus
tcttttttaagaaagaggaaccactctcactctgtatcaactcaccctggcacactgagtcactacaggactaggagcatcctctctcccactgaga

SEQ ID NO: 69213 - DNA, 85 bp, Mus musculus; identical to SEQ ID NO: 58391

SEQ ID NO: 69214 - DNA, 85 bp, Mus musculus; identical to SEQ ID NO: 57439

SEQ ID NO: 69215 - DNA, 65 bp, Mus musculus
tttagtgaggggagtgtgggtgtccaaagcctgtgggtctcactcagtcattctccaatcctgaa

SEQ ID NO: 69216 - DNA, 107 bp, Mus musculus
atttcatgagctcattttcccaaggaaagtcatatttattccagtcactgacactctggcagtatatggtgatacttgcttaccttagaagagagaagccacaagat

SEQ ID NO: 69217 - DNA, 93 bp, Mus musculus
gacacataagtgtatatttcagaggggaacattttaagtatatttatagatttatttaaaatagctattctccttaggaagtattatgctgtc

SEQ ID NO: 69218 - DNA, 117 bp, Mus musculus
aggaagtgtgtcactggggtgggctttgaggttcataggctcatgccaagtccagaggctccctctcacagcctgtgtatgaggatttagcctcagctactgctccatcacctgcct

SEQ ID NO: 69219 - DNA, 74 bp, Mus musculus
gtaacagatatgcagcatggtcttcatgtgaatcctctaacaattggaacaggggctgtctctgactctgttgc

SEQ ID NO: 69220 - DNA, 85 bp, Mus musculus
ggccatggtggtctgataggctacatgggacaatttcaatatttttgtatctgttgaggcctgttttgtgaccaattatatggtc

SEQ ID NO: 69221 - DNA, 111 bp, Mus musculus
ggaaacggtttatttggctcacacttccataatgctgttcatcactgaaggaagtcaggacaggaactcaggcagggcaggattctggaggcaggagctgatgcagagtcc

SEQ ID NO: 69222 - DNA, 73 bp, Mus musculus
ggtgtgtttcactcacagaagatagttagctcggttacatctgaggcaatctcctgtcagctagctcaacacc

SEQ ID NO: 69223 - DNA, 85 bp, Mus musculus; identical to SEQ ID NO: 57439

SEQ ID NO: 69224 - DNA, 74 bp, Mus musculus
ggatcaagtgaccatatgtgtgtggattcatctctgggtcttcaattctgttccattggtctacttgtctgtcc

SEQ ID NO: 69225 - DNA, 70 bp, Mus musculus
tgtcatatatatatgacatatatatatatgtatatatatgtatgtatgtatatatgtacatatatgtgtg

SEQ ID NO: 69226 - DNA, 115 bp, Mus musculus
actctttttctgactcctcagtggaattgtaggctttatgtattatttttaatttataaaaatattccttacattctaagagactggaacttttggtggatgttacaaccagagt

SEQ ID NO: 69227 - DNA, 83 bp, Mus musculus
gtgtgtgtgtgtgtgtgtgtgtgtgtggtcttactttataaagactgagaatgtttacacacacccattcactcacacacaca

SEQ ID NO: 69228 - DNA, 73 bp, Mus musculus
ggcagggaaggtgcccagatgtctggagcccgaaatggggtctgcctcagaatctctgtggttcctgcctgtc

SEQ ID NO: 69229 - DNA, 100 bp, Mus musculus
tttatattttctcatcagtaatttatatatatgtgtgtgtatatatatatatatatacatatatgtatatatataattaagaactagtagaaaatttaaa

SEQ ID NO: 69230 - DNA, 85 bp, Mus musculus; identical to SEQ ID NO: 57470

SEQ ID NO: 69231 - DNA, 68 bp, Mus musculus
tgtagatgatgtagatgtagatgtagatgtatatgatgtatatgtatatgtatatgtatatgagtacg

SEQ ID NO: 69232 - DNA, 114 bp, Mus musculus
catatacgtcacttctcatactttatatatatgtgtgtgtgtgtatatatatacaaatatatatgtgtgtgtgtatatgtgtatatgtatatattcatatatatgtaaagtatg

SEQ ID NO: 69233 - DNA, 117 bp, Mus musculus
ttgtggtctatcactctattatagtttgacattttcaggaaggtattttctttataacaaagtttattttctaaaatgtgaaaaatactatagttgtaccctctgtcagattcatag

SEQ ID NO: 69234 - DNA, 85 bp, Mus musculus; identical to SEQ ID NO: 57470

SEQ ID NO: 69235 - DNA, 105 bp, Mus musculus
aggattgtctctatggatttagccagtgtggaactgaagctgaaatacactagtcattttcaaattctcacatattattcatggtttgccagtgattcaaattct

SEQ ID NO: 69236 - DNA, 99 bp, Mus musculus
gtatatgtataagatgtatatgatgtatatgcatatttatatgtataatttacatatatatgtgagtatgtatatatgagtgtatgtatgtatgtatgc

SEQ ID NO: 69237 - DNA, 108 bp, Mus musculus
cctgagaggtatctgagttgtctatgccaccagtgctcccacactcacaccctcagggttggctcatctgcaactctgctactagagtcagctctattgttcctgggt

SEQ ID NO: 69238 - DNA, 98 bp, Mus musculus
gaagatatgggtcaggacctggggcagagtgagagcagacactgggaggagcttccctcatcctgagcattcttctccagcctcacctcagtattggc

SEQ ID NO: 69239 - DNA, 127 bp, Mus musculus
tcccttttgtgatatcaaggttgatctataactgcatagacctagtgagttcaacttcaagagggagtaggatcttttgttgttttgatctgacgattgagcagggcatcctctaaagtacttcctc

SEQ ID NO: 69240 - DNA, 84 bp, Mus musculus
acagagaatgtgctacttggttgatttgtttgctcatttttaaatgtatattctgacagctaggtggttgtcatttctacctgt

SEQ ID NO: 69241 - DNA, 109 bp, Mus musculus
gccttagtccatggtgatctgataggatgcatgggataatttcaatatttttgtatctgttgaggactgtcttgtgaccaattatatggtccactttggaccatgaggt

SEQ ID NO: 69242 - DNA, 117 bp, Mus musculus
cctcaaccttatctagatgctcctatttatcccccaaagtagacaacctaagagaagagactcagaagactgcggtgcaagatgaatggatgggaaagtctgataggcaaattgtgg

SEQ ID NO: 69243 - DNA, 74 bp, Mus musculus
ctctggctggctttgatcttctctgctcttgtgacactgtgactcaggcagaggaggtgacacgcagcacagag

SEQ ID NO: 69244 - DNA, 100 bp, Mus musculus
atcatactttacatatgaggcactatgttggttagtagtatctatagtttaggaatactgggcacataatttagcaaattcataattggttgagtatggt

SEQ ID NO: 69245 - DNA, 80 bp, Mus musculus
tcctgattgtgacagacaggatcactcagacatgttacatttcttgagtccagtcttgtctctgtttctaaatctctgga

SEQ ID NO: 69246 - DNA, 107 bp, Mus musculus
gatgagcatatttgcatcttacattgaaggatatgcttatttatttttacataaagaagtaaatcttggctggatatttgctattgtaggggtagtgaatgcttttc

SEQ ID NO: 69247 - DNA, 111 bp, Mus musculus
tcagctggcggcagaggtaagcagtgaactcatctctcatgtgagactcactctgtcactgactaacagactggctctaggaaaccttgaatagatgagttattgtagttc

SEQ ID NO: 69248 - DNA, 89 bp, Mus musculus
agctgagagaattcttacaattgcattattttaatcatttgcagaaataatgcaagatgtaacaatgtttttattttgtctcatgagct

SEQ ID NO: 69249 - DNA, 72 bp, Mus musculus
atatatgtattcatacacacacacacacacgtaggggctcgagtgtgtgtgtgtgtgtgtgtgtgtgtgtgt

SEQ ID NO: 69250 - DNA, 87 bp, Mus musculus
gagggtcttatacagcaacagcaactgccctaaagtgattattcaccgagacagctactttaggcagatgttgtaacgctgaccctc

SEQ ID NO: 69251 - DNA, 112 bp, Mus musculus
gagtccttcaggtaagtactcaggagtggtatagctgagtcttatagtagttctattattatttaagtttctcagaagaacccctgagatgatttttatagtggatggattt

SEQ ID NO: 69252 - DNA, 82 bp, Mus musculus
cattttgcttaaagacaggacagactgtaaggactaaattttatttttttctgaccgttagtgtctgtcatcaagcagattg

SEQ ID NO: 69253 - DNA, 80 bp, Mus musculus
tacttacatacatacacaccacacatgctatatgcagacacacatgaatatatgcatgtatgtatgtatgtatgtatgta

SEQ ID NO: 69254 - DNA, 84 bp, Mus musculus
gtttcagagagccagcagccatacagtgacttctcatcagttgaaggacagtggctgttctatttgtatagctcatcctgtaac

SEQ ID NO: 69255 - DNA, 73 bp, Mus musculus
gttgctcagtagatcaggctggccttgaactcagacatctgtctgtctctgcttcttgagtgctgagaaaaat

SEQ ID NO: 69256 - DNA, 60 bp, Mus musculus
acctttaagggcaggagagatggctcagtggttaagagcactcactgctcttccagaggt

SEQ ID NO: 69257 - DNA, 79 bp, Mus musculus
aagggctgtggtccatgagagggcacctgtcactagcctggtgtgcgtgactgacactctcactggtttctcagctctt

SEQ ID NO: 69258 - DNA, 85 bp, Mus musculus; identical to SEQ ID NO: 57439

SEQ ID NO: 69259 - DNA, 95 bp, Mus musculus
acgatcccgtggaggagagttgtggtgtatttatttaatgtattggatatctactgatactttatttgatttatacttctaatctatgggctagt

SEQ ID NO: 69260 - DNA, 88 bp, Mus musculus
agacaaacggatgaacagtccggagtccgcggccgaccgggttggccaagtccgtccgtctgtctgtctgtctgcctgagcgctctcc

SEQ ID NO: 69261 - DNA, 60 bp, Mus musculus
ccctcaccaggacactgctctttctgacattcaagtggagctgagtgtgtattggcaggg

SEQ ID NO: 69262 - DNA, 86 bp, Mus musculus
agagcgtgcatagttaactgtgtggaggaaagcagtggctgtcactcacagtctgtatttcaccatttgtcagtctaggacgttct

SEQ ID NO: 69263 - DNA, 70 bp, Mus musculus
catgtgcatgagtgggtatacgtgcacgtgtgtgtatatatatatatgttacttactattatagcacatg

SEQ ID NO: 69264 - DNA, 101 bp, Mus musculus
gtgttttttttttttttactgtaactaataagaatatttatatttcttctggtagtcttttgaattctatatttttaagttactaaagtggaagaaagtgc

SEQ ID NO: 69265 - DNA, 88 bp, Mus musculus
ggacccggtggacagctgcactttctacatatgcctgctggatagctggtgtgtgtgtgtatgtgtgtgtgtgtctgtctgtctgtct

SEQ ID NO: 69266 - DNA, 81 bp, Mus musculus
ggggattagtttgtgaacttgctgtgtcagtcactttctcccagcaagggcaggaaagttgacacactgtaactagtcttc

SEQ ID NO: 69267 - DNA, 70 bp, Mus musculus
tgttatcactgtctctgggtctgagtggcagcaactcagagctgttgttcacataggcatgtgcatctca

SEQ ID NO: 69268 - DNA, 85 bp, Mus musculus; identical to SEQ ID NO: 57439

SEQ ID NO: 69269 - DNA, 66 bp, Mus musculus
tgttgcatatacatatataaatatatatatgtgtgtgtgtatctgtgtatgtgtgtgtgtgcatgc

SEQ ID NO: 69270 - DNA, 69 bp, Mus musculus
tgagtctactctgtgactgtcactttgtcttgtgaaggcagcttgagatttcaaaaggagctggactta

SEQ ID NO: 69271 - DNA, 106 bp, Mus musculus
tccttgctgttgggttttgccaactagacttgactgaagaaagacaccttgttgtgttcttttcatcatctgtccagtaaaatggttggttgtcaggacaacggca

SEQ ID NO: 69272 - DNA, 78 bp, Mus musculus
ctagcacaaagaggtcacagagttcactctggctgagctaaaaaccttgaggggtctgtgatgttagtgtgtgatgag

SEQ ID NO: 69273 - DNA, 96 bp, Mus musculus
tgctttaccagaggtgagcttggaagtgtaaggttttgttgaatttttcattgtatttataagcgaagttactctctattcatgcctgaggtagca

SEQ ID NO: 69274 - DNA, 87 bp, Mus musculus
agagtgctctattctctgtacctctgcagtgcatgagtagctggagagcccagcacgtctgtcactgtctcagaagggagtatctct

SEQ ID NO: 69275 - DNA, 78 bp, Mus musculus
ttgtgattatcttgttcagtgtcatccacattttagctcaggctttgctctctctggatggcagcagtgggagcacaa

SEQ ID NO: 69276 - DNA, 83 bp, Mus musculus
catatatgggtgcttttgactgcatgtccatctgcatgccagaagaggacatcgtatctcactatattatgagctgccttgtg

SEQ ID NO: 69277 - DNA, 71 bp, Mus musculus
gatgtgaacagacttaagcacgggagtttgatatcaatcagctctctctgtgtgtgtctattctgtacatt

SEQ ID NO: 69278 - DNA, 104 bp, Mus musculus
tttggaggtgtgacctggttggaataggtgtgtcactgtgtgtgtgggcttaagaccctcaccctagttgcctggaagtcagtttttcactagcagcctttgga

SEQ ID NO: 69279 - DNA, 74 bp, Mus musculus
ctcataagagagagtagacattgagctccagctgtagcatgtttggctagtctgtgtctgctaattccaacggg

SEQ ID NO: 69280 - DNA, 85 bp, Mus musculus; identical to SEQ ID NO: 57470

SEQ ID NO: 69281 - DNA, 106 bp, Mus musculus
gccttagtgcatggtgatctgataggatacatgggacaatttcaatatttttgtatctgttgaggcctgttttttgacctattatgtggtcaattttggagaaggt

SEQ ID NO: 69282 - DNA, 85 bp, Mus musculus
cagtggagctgaattgacttaatttctgattttcttgaaatattcttatttttccatcagttaataagttaagaattattcattg

SEQ ID NO: 69283 - DNA, 106 bp, Mus musculus
gccttagtccatggtggtctgataggatgcatgggacaatttcaatatttttgtatctgttgaggcctgttttatgaccaattatatagtcaattttggagaaggt

SEQ ID NO: 69284 - DNA, 119 bp, Mus musculus
ttgtagtgggggtgtgtgaatgcacatgtatgcatgaatgtatgtatgtatgtatgtatgtatatatgtatgtaagtttatatgaatgcttatatagcagtagaggccaataattagaa

SEQ ID NO: 69285 - DNA, 85 bp, Mus musculus; identical to SEQ ID NO: 57439

SEQ ID NO: 69286 - DNA, 85 bp, Mus musculus; identical to SEQ ID NO: 63901

SEQ ID NO: 69287 - DNA, 82 bp, Mus musculus
agaatttgtatttaactttataatctaggttctttggtttgtacttaggatctagattctgaaagtctaattatatatttct

SEQ ID NO: 69288 - DNA, 85 bp, Mus musculus; identical to SEQ ID NO: 57439

SEQ ID NO: 69289 - DNA, 85 bp, Mus musculus; identical to SEQ ID NO: 57470

SEQ ID NO: 69290 - DNA, 81 bp, Mus musculus
taaggatgtaagggacagaggtaagtgaggagccagtgggctctcgctttgtgtcactctgcctcactccttgatcagttc

SEQ ID NO: 69291 - DNA, 120 bp, Mus musculus
ccagtaaaagggtaaagaatacatgcatgtgtatgtatgtatgtatgtatgtatgctggtatgtatgtatatatatatatatatatatatatatatatatatatatatatataaagatca

SEQ ID NO: 69292 - DNA, 70 bp, Mus musculus
cctgcctgcctgcctgcctgtctgtggattccacatccctaaatggacaatcttgtttggccttggtggg

SEQ ID NO: 69293 - DNA, 81 bp, Mus musculus; identical to SEQ ID NO: 58213

SEQ ID NO: 69294 - DNA, 85 bp, Mus musculus; identical to SEQ ID NO: 57470

SEQ ID NO: 69295 - DNA, 64 bp, Mus musculus
ggggctgagagagttcacagaggagagagagaaacttgctctaccagggtgattcgtaagctcc

SEQ ID NO: 69296 - DNA, 68 bp, Mus musculus
aaggggtcaggaggatgttaagtagccaagatgctcccttggtctcactcacggactctttttctctt

SEQ ID NO: 69297 - DNA, 119 bp, Mus musculus
tgatgaggaatttgagactactcatttttagggttatttctgaaaagtacatacagatccttgttattttgttgatcttatagcatctaggaattctttagtcttcatttgcttcatga

SEQ ID NO: 69298 - DNA, 91 bp, Mus musculus
ccaagtactttcatctctacctgcaattttccagttacacagacaattctgaagccctttgagaaatgagtgagtagagtgacccttttgg

SEQ ID NO: 69299 - DNA, 84 bp, Mus musculus
tctgctgtgagatagagtattttatacataacagggaagttaccctatgaaatgtaaagaatattgttccttaaacaagacagg

SEQ ID NO: 69300 - DNA, 69 bp, Mus musculus
gggtacacggacacacatacttgtgaggctgcagcgtctctgtgtctaagtctgtctgtctgtctgtct

SEQ ID NO: 69301 - DNA, 79 bp, Mus musculus
tacaaaatttcgtggctggatggcctttgtttcactggagtatgaggaaggctctcatcactggctcgagcaacttgta

SEQ ID NO: 69302 - DNA, 108 bp, Mus musculus
gatgtcagcaatggtcatagactatgcagacttagaggctcactcactgtctctccttgtggtgtcctgtaggcctaagaactgctggtagtgccggcccctgagatc

SEQ ID NO: 69303 - DNA, 62 bp, Mus musculus
gcctgcagatgagtgtcctggctagccagctgcccgctggctctgtctgtctctttgtgtgc

SEQ ID NO: 69304 - DNA, 91 bp, Mus musculus
gcaatgctataatccagtgtgtttagatagcatactcttttgcagcacagaagatagagagctggtaaatgaggctggaggcagaaacagc

SEQ ID NO: 69305 - DNA, 117 bp, Mus musculus
cacagtgttttcgattcttagctcccctgctttgggtggccatgaggcaagactgtctttttgtctcccattgtgcctggatagtggagggagaggcattgatggaatacactgctg

SEQ ID NO: 69306 - DNA, 73 bp, Mus musculus
tcattacaaggaagatgtcagagagggggggggaggaagtctgtctgtctgtctatgtctcactgttcagtgg

SEQ ID NO: 69307 - DNA, 75 bp, Mus musculus
tgggaatcctgggctcaagggatctctctgttgcagcctggaggacagctgagagtgtggacacaggatatccca

SEQ ID NO: 69308 - DNA, 66 bp, Mus musculus
tgaaaggactctctctctctccaacagaacacataggttagactgaaggagaagggagttatttca

SEQ ID NO: 69309 - DNA, 110 bp, Mus musculus
gctttataaaggggattgccagtcgaattcatttgctatgcatgcaggtacaggactccatctgcaacagcatctgcacaacaagagctgacaattatccattgtacagc

SEQ ID NO: 69310 - DNA, 64 bp, Mus musculus
tgtgtacgcttcagtatatctacgtatatttatatatatgtagctatgtgtatgtatgtacaca

SEQ ID NO: 69311 - DNA, 92 bp, Mus musculus
gattggagcatatacatatatttagaatatgcaagatatatgtatatacatatatattgtatgtgttctatcttctgtgtgtatgtaagatt

SEQ ID NO: 69312 - DNA, 84 bp, Mus musculus
ccatatatatatatgcatatatacatatatatgcatatatatatatatgtgtgtgtgtgtgtgtgtgcatgtttgtatatatgg

SEQ ID NO: 69313 - DNA, 85 bp, Mus musculus
tatttataaatatactttatatttatatacattttataaatatatttatagatttatatagatatgtaagtatattatatacata

SEQ ID NO: 69314 - DNA, 117 bp, Mus musculus
acatacgttcttatatatatatataagctatatgtaagtatatattattaagtatatatagtatactatgtagtgtatatatatatatgtatatatatatatatacattatatatgt

SEQ ID NO: 69315 - DNA, 123 bp, Mus musculus
agacctagtcttttggttctgcatcgtctctctcttgtggcctgtaagagtagtctgcagaaatgttaatggcagctagagtgcggtgctgccaggggccctgagaggtctgctgtgcctgag

SEQ ID NO: 69316 - DNA, 71 bp, Mus musculus
agggagaacattaatatttttataaggttcacctttttgggttgtagcaagtatttgtctatgttttccct

SEQ ID NO: 69317 - DNA, 88 bp, Mus musculus
gtaggatgccatgtatcaccaagtgacttgattgacagccaggtctgtctgtctgtctgtttctactctgggagatactggtttgtat

SEQ ID NO: 69318 - DNA, 81 bp, Mus musculus
cttatatttttaaatgttctgagttagttgttgggttggaatttgacccaaagaaagtcaggatggatgtggaagtttggg

SEQ ID NO: 69319 - DNA, 77 bp, Mus musculus
gctgacttggtttgttgtctgggagctgggcaggtttcctttcccactcgatgctttccagatcatactgtctgagc

SEQ ID NO: 69320 - DNA, 67 bp, Mus musculus
gcccaggggacatagcagggcagagggacaagagggcctctctgcctctctcacagtacctggatgc

SEQ ID NO: 69321 - DNA, 79 bp, Mus musculus
tctgatggggtttcccaaagaacctaggatagggagtttggggtctccctgtctcagcctcactgactgctcttccaga

SEQ ID NO: 69322 - DNA, 75 bp, Mus musculus
accccctctgatttggactcagtctgtccatctgtaaggatatatacatgtgagtacagtgtctgaagagggagt

SEQ ID NO: 69323 - DNA, 67 bp, Mus musculus
tcatcaaagtgctcatatagatgagagggttggctcagctctctggtgagtgtgtgcacatgtatga

SEQ ID NO: 69324 - DNA, 95 bp, Mus musculus
tatttatttttattttatttacacgaatgtttgtctgcatatatatatatatatgcctgtggaggccaggtgtctgtggaagtcagaagtgggtg

SEQ ID NO: 69325 - DNA, 78 bp, Mus musculus
gcaggtatgtgtatgtgtgcatgttcatgtatgtccacatctgcatgcaggtgaatgtgtgtgcatacatgtgtgtgt

SEQ ID NO: 69326 - DNA, 73 bp, Mus musculus
ctctctctgtttctggtttccatgaaaaggtcatgattgtttcagtgactcagacactcagaagctgtgagag

SEQ ID NO: 69327 - DNA, 81 bp, Mus musculus
caagtcaccaaactagtgagtggcagacttaacattaaacctgtgtgtctatctgtctgtgatttcacatttgttgtcttg

SEQ ID NO: 69328 - DNA, 107 bp, Mus musculus
tcctgctgtaaaacgacgtgtatgatactttggaaatatggacaatcacagaaatagaagagaatatatttttataagcaaagatcacaggcggctctcgcagagga

SEQ ID NO: 69329 - DNA, 81 bp, Mus musculus
tcaagtgactgagaggaagtttgattatttttttcaacacacttgaaaagagtttggcataactagactttcataacttgg

SEQ ID NO: 69330 - DNA, 79 bp, Mus musculus
tgcctggctctctgacttactctcttcgctctccacaatggaaagaatggaccaggatgcagagatagctaaccaggta

SEQ ID NO: 69331 - DNA, 92 bp, Mus musculus
gtcaggcactcactctaaacacaaaatgtatttatttcaatgtatggaggagaaatactttgtatttattttgagacaggtgtctataaggc

SEQ ID NO: 69332 - DNA, 95 bp, Mus musculus
cttgttcagcccatctccctagtccataaagtcaggtttggaaatgaaattttatttatacaaagagtctggggcagggaaataactgaagaggc

SEQ ID NO: 69333 - DNA, 94 bp, Mus musculus
ttctggacagctgaaggcagaagacagacagcaggatgggaatggatgttacatgtgtccctgtctgtttctgtgtgtcacgggtgggtgagaa

SEQ ID NO: 69334 - DNA, 110 bp, Mus musculus
cccctgtctcagacttgggctagaattttaaataaaaggtggtttccgagccctaggggtgcaattatatatttatttaagcttcagtttggactgtcttcacaggaagg

SEQ ID NO: 69335 - DNA, 80 bp, Mus musculus
gcgtatgtatgtgtgtgtgtgtatatatatatatatatgtatgtatatatatatatatatatatatatatatatatatgt

SEQ ID NO: 69336 - DNA, 82 bp, Mus musculus
ggataaaatattagtgcatgtagtgtgtgtgtatatatgtttatatgtgtatatatctgtgtatgtgtgtctgtgtgtatct

SEQ ID NO: 69337 - DNA, 118 bp, Mus musculus
gctatctatgggtgttaagggtcagacttagaatgcacttaagaattatgctgacctagcaaggtagtggtagtaggttccatgtctaagatccatgacctcactagctccaggtagt

SEQ ID NO: 69338 - DNA, 86 bp, Mus musculus
ggccatggtggtctgataggatacatgggacaattttcaatatttttgtatctgttgaggcctgttttgtgaccaattatatggtc

SEQ ID NO: 69339 - DNA, 83 bp, Mus musculus
attctcccaagctccatctgctgtttagctgtgggtgtctgtatctgtctgagtcagctgctgggtggagcctctcagaggat

SEQ ID NO: 69340 - DNA, 74 bp, Mus musculus
cctgggatactaaggcccagcctgagagcacagggtcctagggctactctgaggcagcctctaagcctctcagg

SEQ ID NO: 69341 - DNA, 85 bp, Mus musculus; identical to SEQ ID NO: 57439

SEQ ID NO: 69342 - DNA, 116 bp, Mus musculus
tgttcattgggaaaaggcgaagtctgataaggagatgcaaccgtttagtcttgaaaggtcaatattaattattgttaatgcatatctggatttcttttcttattttcaaactgaca

SEQ ID NO: 69343 - DNA, 120 bp, Mus musculus
tgctttaaattatctatatgttatctatacctcctaggacaatgcaaatgctatgtaaataaatattcacttgcatgctttagggaatggtgtcacaagaataatttatgtactttaatt

SEQ ID NO: 69344 - DNA, 117 bp, Mus musculus
atcaaggccacgttgtaaacactcaccagggctggatgctcaggtagttggatgtaagctgttagttgtcttatcaacttcactggagcacagggctgatgtttgtcaagcagagat

SEQ ID NO: 69345 - DNA, 73 bp, Mus musculus
tctgtccatctctctgtctgtctataagactgaatacctctggacattaaagggagagagagagagagagaga

SEQ ID NO: 69346 - DNA, 83 bp, Mus musculus
tatgtggaggctggaggcccttgatccgaacttgagctttgtacagggagataagaatggatcaatttgcattcttctacatg

SEQ ID NO: 69347 - DNA, 79 bp, Mus musculus
ggcaaacaatgacatatactctaaaagtctagttaaatggaaccagttgtctagctctcagagtctgtctttgtggtcc

SEQ ID NO: 69348 - DNA, 74 bp, Mus musculus
ctgggggcagggtctctcagtgtctttcatgggtacatgcagacacttgcaacattaggccaaatccacctcag

SEQ ID NO: 69349 - DNA, 79 bp, Mus musculus
tctgtctgtctttatctgtctctgtctcatgctttctctctcacacaaaaacatacatagatatgtacagacagacaga

SEQ ID NO: 69350 - DNA, 85 bp, Mus musculus; identical to SEQ ID NO: 57439

SEQ ID NO: 69351 - DNA, 83 bp, Mus musculus
gtgtgtatgagtgtgtatgtgtgtatgtgtgtgtgtgtgtggtgtatgtacatatgagtgtgtctgtgtgtgcctgtgtgtat

SEQ ID NO: 69352 - DNA, 61 bp, Mus musculus
gtgtgtcactgtgtgcctcctttcacagagacacagagagatcacacacacatagacacac

SEQ ID NO: 69353 - DNA, 66 bp, Mus musculus
agcagattaaccattagtgaggagagagcccttgggacatctcagactcagtgagtgttaactgct

SEQ ID NO: 69354 - DNA, 85 bp, Mus musculus; identical to SEQ ID NO: 57470

SEQ ID NO: 69355 - DNA, 117 bp, Mus musculus
ggtttgtttgtttgtttgtttgtttttatattttgtttatttatttatttttctttgcagggaaggttgcaagggtggagggcagatatgaaaggaagtgagggctgggattgggct

SEQ ID NO: 69356 - DNA, 61 bp, Mus musculus
tgacctgacatattgaggctggccactctcagtgactcagtctggatgtgaggtcaggtca

SEQ ID NO: 69357 - DNA, 80 bp, Mus musculus
cttccttcttcattttcaggttaagaaaactgactatgtctctcaatgtcagacatttatttgggagtgacaggagaaag

SEQ ID NO: 69358 - DNA, 96 bp, Mus musculus
taagcagttttaaactatttttctttctgtgaaaggagctaggaaagaattgtagtttgtattttatgaatggaaaaattagcctgggactggtta

SEQ ID NO: 69359 - DNA, 82 bp, Mus musculus
gtcaaaggacaacttgcagaagttggttctcttcttccaccatgtgggttctggggattgaactcaggttgtccatcttggc

SEQ ID NO: 69360 - DNA, 85 bp, Mus musculus; identical to SEQ ID NO: 57439

SEQ ID NO: 69361 - DNA, 75 bp, Mus musculus
cctgacaaattcacctgtcttagctagggttacaccaggaccactgaagtaagtcaggacaggaacttaaacggg

SEQ ID NO: 69362 - DNA, 73 bp, Mus musculus
gcatgcactaggaccctagagcaaagctggatccagcacctggcctctttgcactgtctgtctgtctgtctgt

SEQ ID NO: 69363 - DNA, 85 bp, Mus musculus
tctgcagagactcagagaagagagtgtccatgttttataggtaactctggagacttactcttgctatagactgatccttgataga

SEQ ID NO: 69364 - DNA, 103 bp, Mus musculus
tagctctgcctgtctctgtctcctagtgttgtacttacatgcacagccatgtctggtttttgtttgttttattttttacatgggttctggggattcaaagttg

SEQ ID NO: 69365 - DNA, 110 bp, Mus musculus
ggacacggtgactgacaggctgccctggctcagttatcacagtgctgatgctgtccattctaaaggtacagtactgtgataactgaaggatggcagccatcttgccttcc

SEQ ID NO: 69366 - DNA, 103 bp, Mus musculus
atgtatgtgtgtgtatgtatatatataagtatatatatatacatatatatgcatatatatgtattttactaaaataaaaattatgtgtgttcatatatgtgta

SEQ ID NO: 69367 - DNA, 71 bp, Mus musculus
ctttggttggtttggctggatttgatttggttcttcaagacagagcctctcactctctagacccatcagag

SEQ ID NO: 69368 - DNA, 107 bp, Mus musculus
ttgcttctttaattttatttcatggacatggatgtgtttctgcatgtatgtatgtatgtatgtatgtgccacttgcatgcctgttcctgtgaaaaccagaagagtaa

SEQ ID NO: 69369 - DNA, 100 bp, Mus musculus
tgtgtgtgtgtgtgtgtgatctgcctgtctgtctgcctctttgttctgactgagaacaaactggattcagaggataagctagtcaaatgtccaccataca

SEQ ID NO: 69370 - DNA, 87 bp, Mus musculus
gtgcagcatcctcagaagggagtgagcagaggaaagatggagcataggaaggtgctgagtccttgtgcacaggctctcttgctgcat

SEQ ID NO: 69371 - DNA, 65 bp, Mus musculus
ctgaacagacaggttgtgctgagtttctcactgactcggaccacagatgataaccttctgcccag

SEQ ID NO: 69372 - DNA, 68 bp, Mus musculus
gcatgcttgtggtgtacagacatagatgaaggtgaaataaccatatgtatgtatgtatgtatgtatgt

SEQ ID NO: 69373 - DNA, 74 bp, Mus musculus
taccaagtaagactgcacacagttcagagtgtgcaggtgcactgcgtgaactgtgggtggcagggggtgtggtg

SEQ ID NO: 69374 - DNA, 64 bp, Mus musculus
tggtgaggagatggctgcagaggagagagtgataaactctctctctctcaggctctgtacatta

SEQ ID NO: 69375 - DNA, 75 bp, Mus musculus
gtcttgaggcagacagacagacagacagacagaccccactggtcatgtctgatgaaaactgtgttgcaaaaggac

SEQ ID NO: 69376 - DNA, 108 bp, Mus musculus
caagtacctactgatgtaggtggaggaaggactggaagaggctcagtttggcagcagacagcgagcatacatccaggctaccctgcgcagagttcaagagaagacggg

SEQ ID NO: 69377 - DNA, 85 bp, Mus musculus; identical to SEQ ID NO: 57470

SEQ ID NO: 69378 - DNA, 106 bp, Mus musculus
gcatatatatatatatatctgaagcatacatatatatctgtgtgtgtatatgtatattatatatatgtgtatatataaatgtatatgtgtgtgtgtgtgtgtgtgt

SEQ ID NO: 69379 - DNA, 102 bp, Mus musculus
tttatttctgtcaagcaaagtatattaataggcctgatcagttaatattcaaaatgagtagtgaactgattaagtagttgtgtatagcctggtatttataaa

SEQ ID NO: 69380 - DNA, 88 bp, Mus musculus
atatgctgtatcaatcatatatgttcatatacatacatgcatgtatatatgaatatgtgtgtatatctatatatgtatacatgtatat

SEQ ID NO: 69381 - DNA, 73 bp, Mus musculus
gtagcttttctgggactggagagatggttcagcggttaagaccactgactgctcttccagaggtcctaagttc

SEQ ID NO: 69382 - DNA, 85 bp, Mus musculus; identical to SEQ ID NO: 57470

SEQ ID NO: 69383 - DNA, 107 bp, Mus musculus
gtgtgtgtgtgtaaatatatgtatgtatgtatgcatgtgtatatatgtgtgagtatgtatctatatgtatgtgtatatgtatgtgtgtgtatgtatgtgtataaata

SEQ ID NO: 69384 - DNA, 100 bp, Mus musculus
taaatctctaggacttatcagagtaaatgtttacatcctacagtgtagattccaatacatgctgggatgggttccttttttctagtgtctcaggaattta

SEQ ID NO: 69385 - DNA, 85 bp, Mus musculus; identical to SEQ ID NO: 57470

SEQ ID NO: 69386 - DNA, 93 bp, Mus musculus
gagtttctgttagaatctgttgcaaatgaagaaacttttggtggcctctgtagcagaacagctagaagtttgtaaactctgaccatggaactc

SEQ ID NO: 69387 - DNA, 79 bp, Mus musculus
tcaactctcatatcacacatgacacagtaaatatatatctatatatgtataattgggttatggagtgaatggaagttga

SEQ ID NO: 69388 - DNA, 75 bp, Mus musculus
agcatcggagctgaagggacctggtcggacattgcagtgctgagatgcctgcctctcccactcagagcctgtgct

SEQ ID NO: 69389 - DNA, 119 bp, Mus musculus
aatgtcatgaatatttctgctttttgttaccacctgatcaagggcacaatggaaaagcagagagttcactctctgtgtcctgggacttgacaggctgtgacttggtttccatcagcatt

SEQ ID NO: 69390 - DNA, 170 bp, Mus musculus
gtgtgtgtatgtatatatgtatgtatacatatatatattttccactgggtatatatacgtgtgtatatatatgtatgtatgtatacatatatacgtgtgtgtgtgtatatatatgtgtgtgtatatatatatatatatatatatatatatatatatatatatacccagtg

SEQ ID NO: 69391 - DNA, 67 bp, Mus musculus
gtctgctgtctgcttgggctcctgtctcagggtcctgccctgacaccctcagtgacaggcagttaac

SEQ ID NO: 69392 - DNA, 110 bp, Mus musculus
ggggtggaagaggaatttatctcacgggcagtaagacatggctgggatctcagtccaggtctgcctgtctctgtctgcttttgaagactgatccacactgaagccagcct

SEQ ID NO: 69393 - DNA, 70 bp, Mus musculus
atgtttccctggtgagaaattaggggacgataaaagcattgtgtgtcactctgactttctcacttgacat

SEQ ID NO: 69394 - DNA, 83 bp, Mus musculus
tgccagggtttgagttggactactctactgtgattcatgatcaggtcacctgaggaacacgaagtgctaagctcatctgagca

SEQ ID NO: 69395 - DNA, 89 bp, Mus musculus
gaggctcaatgactgactgactgtctcacaaagccctggaaatccaagcttggttagtgatgcagccttacgctcccagtcgctgggct

SEQ ID NO: 69396 - DNA, 103 bp, Mus musculus
gctttagctcacagcatttagggcagtttttaagattgcatatggtttgaaactatatctagcctcaatccgtgtgtcttctccttggattagagttaatggc

SEQ ID NO: 69397 - DNA, 67 bp, Mus musculus
gggtcagagtagagtgagaggcctctggctcctgattcacagccactgcccagtctgctgctggtct

SEQ ID NO: 69398 - DNA, 130 bp, Mus musculus
tcatgtatatgtgtctatgcgtgtgtgtatgtgtgtgtatgtatctatgcatgtatgtttgtatgtgtgcatctgtatgtaagtgtgtctgtgtctgtgtgtgtacatgagtgtgtgtctatgtgtgtgt

SEQ ID NO: 69399 - DNA, 86 bp, Mus musculus
agcctcaggcctccctcacgctcagtctgtcttctaccggatgtccatgtagggggcgctatggagtgaagagaagaggaaaggct

SEQ ID NO: 69400 - DNA, 84 bp, Mus musculus
caaatgttgctgtctctctgagtcagttgggggttttctgagagactcaggggctcagcgggatcagagtggcgcctacttttg

SEQ ID NO: 69401 - DNA, 78 bp, Mus musculus
gggttgcattcatacacagtacagagagagttcaagagtagagagtcctatggctgagacgtgtctggtgtgtttccc

SEQ ID NO: 69402 - DNA, 79 bp, Mus musculus
gtagggatgtatctgggggatgtacatgcaatgtaaatataggatgtgtatatgtatgtatatatgtaggcatgcgtac

SEQ ID NO: 69403 - DNA, 114 bp, Mus musculus
gatataaggtcgtgaatagagaatctgctgttttgattgtaacaagttcctcaagtgattatgattatatttgaatgagtatattccaaatttaaaattactgccttgggtgtc

SEQ ID NO: 69404 - DNA, 88 bp, Mus musculus
gtcacaccgtgtgcggccaaatatttagatcactgcgcttgtacacctggagatgacaagtgtatttgaaggtcacatgagaagtgac

SEQ ID NO: 69405 - DNA, 83 bp, Mus musculus
gatgcaagcctctgtcctctctccacctctggctaaatctcaccaccaatgccactggctcagtgagtcacagacacatcatc

SEQ ID NO: 69406 - DNA, 80 bp, Mus musculus
gagcaagcaggtttcaggctaggggaggggagactacattcctctgctggtccctctgtctgcctgtctgcctgtccctc

SEQ ID NO: 69407 - DNA, 67 bp, Mus musculus
gtgcagatccagacaatgtctaaacgaggaccgtggtcacttgtctcgctgctggtacagtctgtac

SEQ ID NO: 69408 - DNA, 89 bp, Mus musculus
ggtgctgatgcagacttgactctttgatgttctcattcccatcgggcttacgtctcagtggcatatttcagagctcagtgtatcaggcc

SEQ ID NO: 69409 - DNA, 75 bp, Mus musculus
gagtgacagtggtagtcagactttctgggcagcaatggttctgccctgttctgagtctgagtctgtgtgtgattc

SEQ ID NO: 69410 - DNA, 66 bp, Mus musculus
tgcattgaagttcaggcagcaagaggtgagatatttcagactttcttgttctgagctgttggagca

SEQ ID NO: 69411 - DNA, 58 bp, Mus musculus
tatatatatatatacatacatacatacatatgtatgtatgtatgtatgtatgtatgta

SEQ ID NO: 69412 - DNA, 76 bp, Mus musculus
gactgacaggcctcaccctgactcactgcatcagagggcacaaagcatgagggctgggacagggaccctgggtgtc

SEQ ID NO: 69413 - DNA, 88 bp, Mus musculus
gaggttgtagattctttttctttaaaaacaagtttttcagcaggacctctcctgctgtgcttgatttttagctaaagggaggggcctc

SEQ ID NO: 69414 - DNA, 70 bp, Mus musculus
gtggaagaacacagacagctcaaaatcacacagccacactgactttggaagctctgtgggcggctttcac

SEQ ID NO: 69415 - DNA, 66 bp, Mus musculus
gttttgtgtacagagtcattatgctttggatgacctcaatgtatcttgactgatgtatcacctaac

SEQ ID NO: 69416 - DNA, 167 bp, Mus musculus
gtgttgtttcgtttccacatgtgtgttggctttctattatttatttttttattgaaagatcagccttagtccatgttggtctgataggatgcatgggaaaatttcaatatttttgtatatgttgaggcctgttttgtgaccaactatgtggtcaattttggagaagg

SEQ ID NO: 69417 - DNA, 100 bp, Mus musculus
gtggttggtgatatcttcgcttctttctaagccaataattatgtatctatttatcaatgccaatgggcttggaaaagaagtgcttcatatcatctgtcat

SEQ ID NO: 69418 - DNA, 89 bp, Mus musculus
gctcggggtggggggcagggatgagacaaggtcttactatatatatatatagcccaggctgtctcaaatttgcagcaatcctcttgtgc

SEQ ID NO: 69419 - DNA, 57 bp, Mus musculus
gagcatgagagtgtatatgtatgtgtgagtgtatatatatgtgtgttgctcaggttc

SEQ ID NO: 69420 - DNA, 61 bp, Mus musculus
agggattgaacttaggttgtcaggcttggcagcaagctccctcacacactgagtcatccct

SEQ ID NO: 69421 - DNA, 63 bp, Mus musculus
gtctcttgtgactcacagactcctcaggttctcacacagaggagagtgagcatctgtagggac

SEQ ID NO: 69422 - DNA, 94 bp, Mus musculus
tgctgtggtatatgttctccaagggctggagagatggcccagtagttaagagtactgactgctcttccagaggtcctgagttcaattcctagca

SEQ ID NO: 69423 - DNA, 77 bp, Mus musculus
gttgtcatggagactgaggaccgccaggtgtctgatttagcagggcttgccagttccctctgactctgactgacagc

SEQ ID NO: 69424 - DNA, 112 bp, Mus musculus
ggaacatattaagagttgtgttggggttggggagatggctctgtggttaagagcactgactgctcttccagaggtcctaagttcaatttccagcaactgcatggtgggttac

SEQ ID NO: 69425 - DNA, 117 bp, Mus musculus
atgtatgcattatgtgatatatgcatacccatatgtgtaatgtggcatatgcatatatgtatgcatgtatgtatgtgtgatgcggtatatgcacagatatgtgtgcatgtgtgtgtg

SEQ ID NO: 69426 - DNA, 101 bp, Mus musculus
acatacatatatacatatgtatacatacacacatatatgtgtgtatatatatatatgtatatgtgtgtgtatatatatatatgtatatatatatatatata

SEQ ID NO: 69427 - DNA, 103 bp, Mus musculus
gcccgatccactccacccttagctcagagtctccctctcacagaaatatcacagtgtttatgaggtgattacaggagagaaatgagaaggaagcttacagggc

SEQ ID NO: 69428 - DNA, 73 bp, Mus musculus
ctgtgtagctcaggcagtctgtccctcccaaaggctggaattctaggcatgcatgagcacagacaatctacac

SEQ ID NO: 69429 - DNA, 110 bp, Mus musculus
gattggcacttgtcttttgtgtgtgtgtgtttgtttgtttgtttttgaggcaggagctcactctatttctgactagtattagactccatatgtaaaccaggcgctggctc

SEQ ID NO: 69430 - DNA, 82 bp, Mus musculus
gcagtgaggcacgaactgtgaacgaggggagccgctgggttggtagtaaatgctgtctccctctctacacatgttttactgc

SEQ ID NO: 69431 - DNA, 105 bp, Mus musculus
agtcaaaaaagaaggtcaaaggctggagagatggctcagaggttaagagcactggctgctcttccagaggtcctgagttcaaatctcagcaaccacatggtggct

SEQ ID NO: 69432 - DNA, 100 bp, Mus musculus
cagaggctctgccaatggcagccagtgattagagaagttactcagcagacctttctctgagggaacaaagcttaatttactggggctggcactgcctgtg

SEQ ID NO: 69433 - DNA, 97 bp, Mus musculus
gtgcatatgtctgtctgtagctatgtatgtacgtacatatgtattatgcatgtatgtatgtgtatgtatgtatatatgtatgtatagatttgtgtat

SEQ ID NO: 69434 - DNA, 64 bp, Mus musculus
ctgctttgtatgtatgtatggatgtatgtatgtacgtacgtacagtatgcatgtagaagggcag

SEQ ID NO: 69435 - DNA, 107 bp, Mus musculus
ggggcgagtgagggtgtgagagctggagaggtggctcagcggttaagagcactgactgctcttctagagggtcctaagctcagttctcagcaaccacatggaggctc

SEQ ID NO: 69436 - DNA, 103 bp, Mus musculus
ccactgagccatctctccagccccaggatgaatcctcaaccattgaaccttctctctctggttcttcattctggtgcagggagtcttaggcctggcgctatgg

SEQ ID NO: 69437 - DNA, 83 bp, Mus musculus
gcactgcatgcattcactgccctcactgcagtgcgctgcctccactgcactcactgactgcactcactgactgactgcactgc

SEQ ID NO: 69438 - DNA, 97 bp, Mus musculus
gtcagggagctgtgtgacatcctgttcttcccactggagcctacacaggacagtgagcacacaggacacaggacagtgagcacacaggacacaggac

SEQ ID NO: 69439 - DNA, 103 bp, Mus musculus
agtttaaatgaataacctggatataaatgtatacatatatgtacatggcaattaaatggatgacctgtggatataagtgtatatgtatatgcacatgacaact

SEQ ID NO: 69440 - DNA, 61 bp, Mus musculus
gcacatagacagaagccagaagaggaccccgggtgtctttctctgtcattctctgtcttgc

SEQ ID NO: 69441 - DNA, 113 bp, Mus musculus
tgtctgtctgtctgtctgcctgtgtatctctctatgtgtgtttctctgtgtatgagttgtatgtatgaaaatgtggcagggtggttttacataggcccacacacacacacaca

SEQ ID NO: 69442 - DNA, 114 bp, Mus musculus
tcctcaattcctctctgtgttttgggtgcacaggtgtatgcttgcatgtgcaactgcatgtgtgcatgtgtgcatgagtgtacatgtgtgtgtatgtgtgtagcggctggagga

SEQ ID NO: 69443 - DNA, 115 bp, Mus musculus
gtgcatgcatacatgtgttgtgtgtacatgtgcatgtgtctatctgtatgtgtgcatgagcatgtgcgtctatccaagcatgtgtgcgtgtgtgtgcacgcatgtgtgtgtgtgt

SEQ ID NO: 69444 - DNA, 82 bp, Mus musculus
cctaagttactttttttttttccagaggtggacaatgtttatatgtccatcaaactctgggaggaaaaggagtgttctgagg

SEQ ID NO: 69445 - DNA, 88 bp, Mus musculus
atatatgtatatgtatgtgtgtatatgtatgtatatgtgtatttatctatgtgtgtatgtatgtgtatatgtatatgtgtatctatgt

SEQ ID NO: 69446 - DNA, 84 bp, Mus musculus
gtgtatatgtgtatgcatgcattcacatgtacatgtgttcttatgagtacatgtatgtgtacatgtatgtgtgcatgtgtgtgc

SEQ ID NO: 69447 - DNA, 66 bp, Mus musculus
gtgccgcctgggctgcacacgtatgtatgtatgtatgtatgtatgtatgtatgtagttcgtgggac

SEQ ID NO: 69448 - DNA, 60 bp, Mus musculus
ggtcagcgactggctgtgaataggactcggcttccaggctgtcagtctcccagtctgtcc

SEQ ID NO: 69449 - DNA, 115 bp, Mus musculus
agctaaggtgatctcttacagatatgggcacaggccaatctaatctgggcaattctcagttgagactcagctctcagatgagtctatgctctttcaaggtaagaattaaagctta

SEQ ID NO: 69450 - DNA, 129 bp, Mus musculus
tagcttactgtgagtcatgctacccccgtggcaggttaccctgggaggtgtaagaaaggcagcagacagtgagctgacagacaagtcagtaggcagcaccctccatgcctctgtgttagctcctgcctg

SEQ ID NO: 69451 - DNA, 90 bp, Mus musculus
gcaggcctcctagtcctctgactctcacagtgtttctaccctgggcacactcttccatggtgatccctgaagcttcaggaaagggcttgt

SEQ ID NO: 69452 - DNA, 117 bp, Mus musculus
agccagaagagtgggtcagctccctagacctggagctacaggcagtttcagtcaccctctgtggctgctaagaagcaaatccaggtcctccagaagagcaacgagcccttaactgct

SEQ ID NO: 69453 - DNA, 84 bp, Mus musculus
tatgtgcatgtgtgttcatgtgtgcatgaacatgcaggtgtgctagtgtgtatgttcatgtgttcatatgttcatatgtacatg

SEQ ID NO: 69454 - DNA, 62 bp, Mus musculus
gctcacattcatctttcctgataggaccacaaatcagtgtctgtgcctgtcactgtgtgggc

SEQ ID NO: 69455 - DNA, 64 bp, Mus musculus
ttgtgtgtgcatgtgcaagtgtgtatgagtgtgtctgtgtgtgtgagtgcatgtgcatgtgtga

SEQ ID NO: 69456 - DNA, 73 bp, Mus musculus
caggagctgaatggcttcagtggcagcagatttcttttctctctgcctctctgtcggtctctctatgtgtctg

SEQ ID NO: 69457 - DNA, 74 bp, Mus musculus
gtgtatgtatgtatgtatgtatgtatgtatgtatgtatgtatgcatgcatgcatgtgtctgtgtgtgtgtgtgt

SEQ ID NO: 69458 - DNA, 71 bp, Mus musculus
agatacagacactgtcacagacagctttaaaaaaaaaagttggactgtaccacgtgaccctttctgtgtct

SEQ ID NO: 69459 - DNA, 110 bp, Mus musculus
tgtgctcagtacgtaggatgtatagatgtgaaattgttacatatatatgtgtatatgtatatatgtgtgtgtgtgtgtaacatatatatgggcctcaaactcccgagcca

SEQ ID NO: 69460 - DNA, 79 bp, Mus musculus
ttcagtgttggggctgagttgggacagggactcctcagcaattgagggcctctctcttgctctcagtgtccttgctggg

SEQ ID NO: 69461 - DNA, 107 bp, Mus musculus
ggggacatttagacgtgggtggtgagaagaataggtgtcaccaggacctgccacgacactgtcagtctggttctctgtgctttcttaaaatgcatgctgtggttttc

SEQ ID NO: 69462 - DNA, 100 bp, Mus musculus
cttagtatgtctgtgtgtggggtgggtactgtcactgtctgtgtagtcagagaacaacttgtaggaatcagttatcttctttaccacgtgggctcctggg

SEQ ID NO: 69463 - DNA, 80 bp, Mus musculus
aatagtatacatagagcaacactcactgtgaccaagggacactcactctcctaggctgagtgacactcactgtggctgtt

SEQ ID NO: 69464 - DNA, 56 bp, Mus musculus
ggggctggagagatggctcagctgctaagagcactgactgctcttccagaggtccc

SEQ ID NO: 69465 - DNA, 88 bp, Mus musculus
aaaaaattatttataatgctaccaggacagaattttgtgtgaactaaattaatagcttacatagttttgttttggtttttggtttttt

SEQ ID NO: 69466 - DNA, 85 bp, Mus musculus
ggcatatatatagagagatatgtagatagagacgatatatctatacatctatatctctatatctatatgtatattttgatgggcc

SEQ ID NO: 69467 - DNA, 68 bp, Mus musculus
gtgtgtgtgcctgggtatgtacacatgtatatctctgtgtgtgtatgtgtgtgcctgtgtgtatgtgt

SEQ ID NO: 69468 - DNA, 106 bp, Mus musculus
gtctcagatgaaccagaatatttttaagcttatgaaatgagaagatgtatgaaacagatactgatgcttgggtccagagtttcccagatggtctgagtgtcgaggc

SEQ ID NO: 69469 - DNA, 93 bp, Mus musculus
tttgggtctgtagtagggtagcacaacttggggtctcttcacagtgtttctctgtgtgtagcctttactgacccggaacttgctgtgtagacc

SEQ ID NO: 69470 - DNA, 63 bp, Mus musculus
gcctcccctttcaggctgcagagggccacctgagtctctgtgagtgcctggcaaagggatggc

SEQ ID NO: 69471 - DNA, 92 bp, Mus musculus
tgcccttccactaaaatagagacagccaagcctcccctttcaggctgcagagggccacttgagtctctgtgagtgcctggcaaagggatggc

SEQ ID NO: 69472 - DNA, 116 bp, Mus musculus
ggacccacacattaagattttaatgaacagtcaatttccacaaatctatttcagagacgagagtgaggattaagttggttgaggttgagggtaaggtcaggtaatagggtgtttcc

SEQ ID NO: 69473 - DNA, 85 bp, Mus musculus
agcagttaggtgctcattaacagatgaatagataaaatttgtcatgtatatatctatatctataatggagtatccctcaactgtt

SEQ ID NO: 69474 - DNA, 70 bp, Mus musculus
gtgcatatgtgtacctgtgtgtgtgtctgtatatctgtgtatttgcacatgtgtgtgcatatgtatgtgc

SEQ ID NO: 69475 - DNA, 70 bp, Mus musculus
gaaacatggaacttgacatttgctttctcttccaagaaaagaggtagcatgttgtatagtggtatgtgtc

SEQ ID NO: 69476 - DNA, 89 bp, Mus musculus
tggtttgtgttttctaactgtgctttcagaattatcaccagagcaacataaacttggaagaagatactcagcatagagagaaatagcca

SEQ ID NO: 69477 - DNA, 93 bp, Mus musculus
tttctctttatcatgtcactgactgtgtctccctcaagcatctggtagctctatggatgacactttaatttacatgtctgacatgcactgaaa

SEQ ID NO: 69478 - DNA, 84 bp, Mus musculus
gtagtcagccctgaaagcatatacatacaagcaaccctaaatgaatccagcaggttgtatgtatgtatgtatgtgagtgattat

SEQ ID NO: 69479 - DNA, 68 bp, Mus musculus
agcactgttaccatgagatgtgtgtgtgcacacatgtgcatgtgcacactcatggcttgccataggct

SEQ ID NO: 69480 - DNA, 114 bp, Mus musculus
aaattcttgaagcttggaggctagagagatggctcagcagttaagagcactgactgctcttccagaggtcctgagttcaattcctagcaactacatgatagcttacaaccattt

SEQ ID NO: 69481 - DNA, 79 bp, Mus musculus
atttctgatagtttcactgtgtctctgtttagtttctgtttccatgatctgtccattgataacagtggggtgttgaagt

SEQ ID NO: 69482 - DNA, 103 bp, Mus musculus
taagaacaattcatggggctggagagatggcttagtggttaagagcactgactgctcttccggaggtcctgagttcaattcccagaaaccacatggtggctta

SEQ ID NO: 69483 - DNA, 87 bp, Mus musculus
gcaggcatggttgaattcctcgtgaccagtccctaaagggatgatgagtctttctctgactgtgtccgtgccagaagccatcaacta

SEQ ID NO: 69484 - DNA, 111 bp, Mus musculus
gaggcattgttggtggggtgtaaggcaaggaggaaggtcagctgggtgctttctcagtctctctgagatagtaggctttcaccatagcctctggctcccaaatcttcattg

SEQ ID NO: 69485 - DNA, 94 bp, Mus musculus
tatatatatatatatatatatatatatatatatatatatatatgcatatacatatatgtgtgtgtatatgtatgtatgtatgtatatgtatgta

SEQ ID NO: 69486 - DNA, 117 bp, Mus musculus
ttgcccacagaggcagtcaaagtggtcttctcaccagaggaattccatgcctgaatatactgtctgtctcagttactgtttcttctggtagggccaagatcacctcacagtttgcag

SEQ ID NO: 69487 - DNA, 65 bp, Mus musculus
gagtggatttctagagactgagaaaagtcagtgtccaagggcacattcttgtctatggaacactc

SEQ ID NO: 69488 - DNA, 71 bp, Mus musculus
ctgaggtagacagtgagctctgagctccaagatcatcattcaggagtatccagagactctgttgagggcag

SEQ ID NO: 69489 - DNA, 62 bp, Mus musculus
gtcaaattatacatacatgcatacatacatatatatgtatgtatgtatgtatatatgttgat

SEQ ID NO: 69490 - DNA, 80 bp, Mus musculus
gagtgaggtcagtgagtgcacagaacctggggaccctacctgcctgtcccatctatgtaccacggcagtggactaaactt

SEQ ID NO: 69491 - DNA, 110 bp, Mus musculus
aacattatattgtacacatgtatgtatatatatatgtgtgtgtgtgtgtacatatatatacatatatatatttgtggatatacatatactttgctttttaaaatggtgtt

SEQ ID NO: 69492 - DNA, 86 bp, Mus musculus
tagaaactgaacttaagagcctgtgaagatggctcagctgttaagagtactgactcctcttccagaggtcctgagttcagttccta

SEQ ID NO: 69493 - DNA, 85 bp, Mus musculus; identical to SEQ ID NO: 57470

SEQ ID NO: 69494 - DNA, 92 bp, Mus musculus
acatggcctcttatttcactagtgcttaatgaatgcatatatgtatttatatgtacatatacattctgaaatataaattgtagagaccttgt

SEQ ID NO: 69495 - DNA, 111 bp, Mus musculus
tttaagatcagccttagtgcatggtgatctgataggatgtatgggacaatttcaatatttttgtatctgttgaggcctgttttgtgacctattatgtgggtcaattttgaa

SEQ ID NO: 69496 - DNA, 82 bp, Mus musculus
cctgttctcacaagtgagtcagcactccttagagaccagctctctacctatggtatttgtgtatggagcactgtggaacagg

SEQ ID NO: 69497 - DNA, 80 bp, Mus musculus
ctgtttatatatccagtctcttagtctctctttttactggtgagttgaatccattgagattaagagatattaaggaatag

SEQ ID NO: 69498 - DNA, 78 bp, Mus musculus
ccgaacttgcttcttggtcatgatgtttgtgcaggaatagaaaccctgtctaagacactcactgataaggcccattgg

SEQ ID NO: 69499 - DNA, 85 bp, Mus musculus; identical to SEQ ID NO: 57470

SEQ ID NO: 69500 - DNA, 96 bp, Mus musculus
gatcagccttaggtcatggtggtctgataggatgcatgggacaatttcaatatttttgtatctgttgaggcctgttctgtgaccaataatatggtc

SEQ ID NO: 69501 - DNA, 82 bp, Mus musculus
tccatttgctactccagagcttggccagagctgagactgctacagactcagtatctcagagtctatggagagaacatttgga

SEQ ID NO: 69502 - DNA, 94 bp, Mus musculus
gcatagagctaagcagagggtttgcaacagaggattcttgaatggccaaaagcacttaaagaaatgttcaaagtcttagtcatcagggcaatgc

SEQ ID NO: 69503 - DNA, 111 bp, Mus musculus
atgaaggggcattgtgttttgtgaaatgcttttagagcacctagtaagatgatcatgttatttttttctttgagttcatttatatagcatactatgttaatacattttcat

SEQ ID NO: 69504 - DNA, 119 bp, Mus musculus
agcatggtctaggtactggttcttagcaatatgtatgtatatatagatatcttgaaacacacacacacacacattgtatctgtgctttactatacatattccagtgtttctaatgctcc

SEQ ID NO: 69505 - DNA, 115 bp, Mus musculus
caatggccaaggtgagaggagggctagccaagtggaagagagagaacagagtcagggctggttcgagttttggtttaactcctcccctaagttatccactctcatatccacgttg

SEQ ID NO: 69506 - DNA, 65 bp, Mus musculus
cacccagcaggagcttagacagacctgactcttgaaggtgtgtctctgtctccctctgctggagg

SEQ ID NO: 69507 - DNA, 100 bp, Mus musculus
tatgtatgtatgtatgtatgtatgcatgtatgtatgcatgcatgtatgtatgcatgcatgcatgtgtgtatgtatgtatgtatgtatgtatgtatgtgta

SEQ ID NO: 69508 - DNA, 85 bp, Mus musculus; identical to SEQ ID NO: 57470

SEQ ID NO: 69509 - DNA, 82 bp, Mus musculus
ggtggctcagtgtctgagagatcacagggtccaggttaattgagactgctgttcttcctacttggttgcccttctcctcagc

SEQ ID NO: 69510 - DNA, 73 bp, Mus musculus
gctgtagtaggagagctgggttctgatagtgccataatacattggcttgtattgattatgttcttgtgcttgc

SEQ ID NO: 69511 - DNA, 77 bp, Mus musculus
gggtttctctgtgtgacactggctgtcctggaactcacttcatacaccaggctggcatttgacaacacccagctccc

SEQ ID NO: 69512 - DNA, 76 bp, Mus musculus
ggacagcctgtgggagttggttctttccttccactatgtgggcctcagggattgaactcaggtcatcaggctgaac

SEQ ID NO: 69513 - DNA, 58 bp, Mus musculus
atatatgtatgtatgtatgtatgtatgtatacacatgcacacacacacatatatatat

SEQ ID NO: 69514 - DNA, 123 bp, Mus musculus
gcaccacgggggcacaggaggagcagtgataagttgtaaagactgagaagacagaagtggatttgatgttatcatatttgaggtatttaacacctggcttctaaggacttggggccattgccc

SEQ ID NO: 69515 - DNA, 81 bp, Mus musculus
tgaagtctacagtagtgagataggtgaggtcactatgtctaatttgcatacctcatcatttacatgcaaatgagttcttca

SEQ ID NO: 69516 - DNA, 97 bp, Mus musculus
ggaaagcatttatagtccagttccaggttgctatttcattataccttagtgttttagttgtagtctttgaagctggggagctaactgtcttgggtcc

SEQ ID NO: 69517 - DNA, 118 bp, Mus musculus
tcatctcaagaagcagctaaagggcttggcctggtccaagtctgactctgtgtctggcataagcggtgaagtgcagagggaaaggtcacgggatagcctggcagagtgcaggatgtgg

SEQ ID NO: 69518 - DNA, 61 bp, Mus musculus
ctgtctctcctgggattacagatgtgtcccctctggctcactgtctctcctgggattacag

SEQ ID NO: 69519 - DNA, 72 bp, Mus musculus
gtgtgtgacttggcatgcatatatagtatgttgtgtcatgagcatgtctctgtgtgtgtttcagtcatgcat

SEQ ID NO: 69520 - DNA, 66 bp, Mus musculus
tgtgtgtatgtacatatgtgtgtatgtatatataagtgtatatatgtatatgtgtatgtatatata

SEQ ID NO: 69521 - DNA, 79 bp, Mus musculus
gagcatgcattcatacatgtgtgaatatgtgaatatatatgtatatacatatacatacacatgtatacagcctgtgctc

SEQ ID NO: 69522 - DNA, 102 bp, Mus musculus
agatttcagagcattttgggtagtggattttcagatgtgtgctcagttgactgtagatagtctccaatacagaaaatcaagagctatgaatacttctagtct

SEQ ID NO: 69523 - DNA, 90 bp, Mus musculus
gtgtgtgtgtgtgtgtgcgtgtgtgtataatgtgagcgctctcttgtatgtgtgtgttatatatatatgtatgtgtattagtgcagatgc

SEQ ID NO: 69524 - DNA, 79 bp, Mus musculus
gtcctggagtggacctggctgactggttgaggtacaaggttccctgcgacctgaacagtgatcagagtgactgtgaggc

SEQ ID NO: 69525 - DNA, 79 bp, Mus musculus
tcaagagattgtgtagttctgtttgtcttagttttcctgtttgggaaaaggggccccagacagcagcaccgcctcatga

SEQ ID NO: 69526 - DNA, 108 bp, Mus musculus
gaggaaaaaggcagagtggaggggctggagagatggctcagtggttaagagcacagactgctcttccagaggtcctgagttcaattcccagcaaccacatggtgactc

SEQ ID NO: 69527 - DNA, 99 bp, Mus musculus
gtatgctctagggggttggagagatggctcagtggttaagagcactgactgctcttccaaaggtcctgagttcaaatcccagcaaccatggtggcttgc

SEQ ID NO: 69528 - DNA, 129 bp, Mus musculus
ccctttgagtgtgcatgacatctctgttcacatgtccctgttgctttgagagttttgtgccaggctcactcaaagcctgctgccagtgtaagagcgtctgtaactctgggagattaatcgttggcttgg

SEQ ID NO: 69529 - DNA, 113 bp, Mus musculus
ccatgtgaaggagggcacggcgaatgttaaggattccataaccaacaagatttattgtctaattttagttgaagttttggtagggacatttttatgtctaagccaattacagg

SEQ ID NO: 69530 - DNA, 97 bp, Mus musculus
cttaagcactaaatgtacaaaagtgactagtcactgtgcacaaggaattcacaatcagtgtgttcaggacagtaatcaaatgacatcaatgcttatg

SEQ ID NO: 69531 - DNA, 58 bp, Mus musculus
ggaacacataggtgcagtggactgttagcctctgatagtcactgacactgtcttgtcc

SEQ ID NO: 69532 - DNA, 73 bp, Mus musculus
ccttctaatagtgccactccctgggctgagcatgtacaaatcatcacagcattctagtgtgggatggggaggg

SEQ ID NO: 69533 - DNA, 70 bp, Mus musculus
ctcacggggagtattgagttcacaggggaaggcttggcaaccttctctctgtgtctcacagacctttgag

SEQ ID NO: 69534 - DNA, 70 bp, Mus musculus
cctgtctcaggttcagctggcaaagacttgtctcccactctcccgctgtctccagtctgatgacgatagg

SEQ ID NO: 69535 - DNA, 76 bp, Mus musculus
tagggctcactctgtgttgtaaatgtaaatgtcacatatccgctattgtatcacacagaacagtgtcagtgcccta

SEQ ID NO: 69536 - DNA, 89 bp, Mus musculus
tggtcctgaactcattacagagaccaggctgacctcaaactcatagagatcctcctgcctctgtctctgcctcccaagtgctcggatta

SEQ ID NO: 69537 - DNA, 74 bp, Mus musculus
gtccccagtgcttgtctctctcagtgtgttaatctttgacgccctgtgaattgatgaggagcgcttagcgggac

SEQ ID NO: 69538 - DNA, 68 bp, Mus musculus
tgtcacccacagtgtctgtctctctcctgggaggcagaaggtagctgaagtgggatgtttgggtgata

SEQ ID NO: 69539 - DNA, 88 bp, Mus musculus
ccatgggcatgtaacccactctgaccctcactgtgggcacaagatccactctgaccctcactgtgagcgtgttactccactgcccagg

SEQ ID NO: 69540 - DNA, 80 bp, Mus musculus
gggaagccggctgcatgtcagggttagcacatggcttggaagccacccccactctgcctctgtcaaaccccgccttaccc

SEQ ID NO: 69541 - DNA, 59 bp, Mus musculus
caccaccacaacctgggtcaagttttaaggtcactctgactctgtgtgggcagatggtg

SEQ ID NO: 69542 - DNA, 65 bp, Mus musculus
gggcacacttcactttctgtgaagctcaaccctgtggtagctttccagaatcagtggcagtgcct

SEQ ID NO: 69543 - DNA, 116 bp, Mus musculus
tagtctctgtctctctctcacacacacacacacacacacatacacacacacacactaaggcgtttgtaggtatttaagactctaggtgtctggttggtgagatggctcagtgggta

SEQ ID NO: 69544 - DNA, 108 bp, Mus musculus
gtatatgtatatataactaaatatatattacatatatatgaatgtatgtgagtgtgtgtatgtgtatatatatgtatgtacatatatatatatacactcaagcttatt

SEQ ID NO: 69545 - DNA, 77 bp, Mus musculus
ggcaggaagagacccagggcctggagcaacccctcctctcctttggagcgtcagtctctgagtccctgcaccctgcc

SEQ ID NO: 69546 - DNA, 70 bp, Mus musculus
gctatgatcactgcgtctgtctgtctgtccgttgtacagaggggaggcataggtgcagggggtgtgtggc

SEQ ID NO: 69547 - DNA, 89 bp, Mus musculus
gagctggacagcctgactccggctgtgtctcagaaccatccaccatgaatgggagctgaagagccacagacaagcatcagtaacagctc

SEQ ID NO: 69548 - DNA, 106 bp, Mus musculus
atcctcactcacaggaaccttccagtccagtgtgggaaggctcaggatgacagaacagagtcagagatgcacatggggctggaagaggtctcaggagggagaggat

SEQ ID NO: 69549 - DNA, 140 bp, Mus musculus
tgcatgtatatatgtatatgtgtatgtatatatatgcatatatgtatgtatatatgtatgtgtgtatatatgtatatatgcatatgtgtatatatttatgtatatatgtatgtgtatatgtgcatatgtgtatatatgca

SEQ ID NO: 69550 - DNA, 71 bp, Mus musculus
tcactaggccccaggtgtcgtagatctgcaggtgcatggctaggagagtgagcacactgggccttatgtgg

SEQ ID NO: 69551 - DNA, 139 bp, Mus musculus
gtatatgtatgtacataagtgtatgtgtatacatgggttagtatgtgtctatgtaagtatatgtgtatatgtatatgtgtgtatgtgtgtacatgagtgtatgtatgtatatgtttgtgtaggcatatatatgtgtgta

SEQ ID NO: 69552 - DNA, 68 bp, Mus musculus
caggctggagcagtgagggacagaagtgggacaggcctcatcagcctgcctccgtgtttcccagcctg

SEQ ID NO: 69553 - DNA, 76 bp, Mus musculus
cacttgaccagcagtctctggcatctgtccccatccctctgtggttcactgtgtgactcaagactgctttcctgtg

SEQ ID NO: 69554 - DNA, 183 bp, Mus musculus
tgtgagcaatgtgagcagtgtgggcagtgtgagcagtgtgagtagtgtgagcagtgtggacagtgtgagcagtgtggacagtgtgaacagtgtgagcagtgtggacagtgtgaacagtgtgggcagtgtgagtagtgtgagcagtgtgggcagtgtgagcagtgtgggcagtgtgggcagtgt

SEQ ID NO: 69555 - DNA, 69 bp, Mus musculus
cacactcagtggctgtgtggctccagaggcggcaaagctctggtccggcagacgcaggctctgtgtttg

SEQ ID NO: 69556 - DNA, 77 bp, Mus musculus
gcctctggagccacacagccactgagtgtgtgaggtcttgcaaccttgtccattcagtgggtggaggttctgagagc

SEQ ID NO: 69557 - DNA, 72 bp, Mus musculus
gtatatatacatatatgtgtgtatatgtgtctgtatatatatgcatatatatatacatatatgtgtgtgtgc

SEQ ID NO: 69558 - DNA, 82 bp, Mus musculus
gtttttagctctctgtgtgtgtgtgtgcaatatgtgtgcctcgtgtgtacatgtgcacatatgtgcatatgaagttggggat

SEQ ID NO: 69559 - DNA, 71 bp, Mus musculus
gctctttctgtcagtgtgtctggggagacatcccaccgtttgtcccacccagcacagggacggtgaaggac

SEQ ID NO: 69560 - DNA, 68 bp, Mus musculus
ggccttggctttgtgaaccaaaccagcgaccagcttctggcttctttggtgtcacattttagcctacc

SEQ ID NO: 69561 - DNA, 100 bp, Mus musculus
tgatggttctgggattcccagggccattctctgcaggggcagagtcacacccagtctctcacctccaggagctcctgggaacctctcccagcccaagtca

SEQ ID NO: 69562 - DNA, 72 bp, Mus musculus
gacctcagattctgagttatatgtcctggccctctcccctaggggtctctctgtgtctcactggctgagctc

SEQ ID NO: 69563 - DNA, 85 bp, Mus musculus
gcattaactattccattgtcactaaacgttttctttttagagtccagtaaggaagacagttggcagtgagcaccagtggatctgc

SEQ ID NO: 69564 - DNA, 129 bp, Mus musculus
gctgtagacactggcaggaaggagacccagatggatttccactccagtctcatatcgcctggctgcctgttagccaaagcccaggtcccgggctgctgtggaccccagggctggggacagtcagctggc

SEQ ID NO: 69565 - DNA, 179 bp, Mus musculus
tgtgtgtatgtataggtgtgcatatatgtatgtatatgtgtattatgtatgtatgtgtgtatgtatatgtgtgtatatatgtgtgtgaatgtatgtgtatatatgtgtgtatgtatatgtgtatatatgtatgtgtatacatatgtgtatatgtatatatgtgcatatatttctgctac

SEQ ID NO: 69566 - DNA, 106 bp, Mus musculus
acggcctctttttcattaattattgttatacacatgtatgcatatgtgtattatgtatgtatgtatgcatgtatgtattccctcaatatagcttgctcagtctgtc

SEQ ID NO: 69567 - DNA, 59 bp, Mus musculus
ctgtgagccccaagaaccctttgctctggaaagagcaacaggatgtggtgggaacacag

SEQ ID NO: 69568 - DNA, 78 bp, Mus musculus
aagtatatggatggacaggtatatgtatatatgtgtgtacatatgtatgtgtatatatagatggatggatgtgtattt

SEQ ID NO: 69569 - DNA, 71 bp, Mus musculus
tatatgtatatgatgtatatgttgatgttgattatatattgatgtatatgtatatgatgcatgtgcatatg

SEQ ID NO: 69570 - DNA, 76 bp, Mus musculus
gtatgcatatgtatgcatatatatgtgtgtttatgtatatgaatatgctgtatatgtatgtatatatgatgtatat

SEQ ID NO: 69571 - DNA, 77 bp, Mus musculus
gtgctcagccacaccaactcgatgtgctcaggcccctctggatctgagttttgtgttagggatgctcagctgtgtgt

SEQ ID NO: 69572 - DNA, 114 bp, Mus musculus
ccctagtccacatttccatcagcctggctgtatttcacagaagacagtgactcctccttcctcatcttatctggcttgttgactgtgagaatccagcctgatccctctttaggg

SEQ ID NO: 69573 - DNA, 119 bp, Mus musculus
gctaaagagaagggggagggtcctggagagatggttcagcggtgaagagcactgactgcacttccagaggtcctgagttcaattctcagcaaccacaggttggctcacgaccatctggg

SEQ ID NO: 69574 - DNA, 92 bp, Mus musculus
atatatgtatagtattgtgtatatgtatatgtatgaatatgcatgtgtaaatgtgtatgagtatatatgtgtatatatgaatatgaatgtgt

SEQ ID NO: 69575 - DNA, 136 bp, Mus musculus
gcacatatatatgcctatgtgtatgagcatgtgtgttcatatgctcatgtgtgtgtgtatgtatgtatgtatgtgtgtatgtatgtatgtatgggtacctgtgtgtgcatgcatgtgtatgtatccatgtgtgtgt

SEQ ID NO: 69576 - DNA, 117 bp, Mus musculus
gccaatctggaggttgcttaaaagtctagaactggggactggagagatggctcagtggttaagagcactgactgctcttccagaggtactgagttcaacacccagcaatcacatggt

SEQ ID NO: 69577 - DNA, 84 bp, Mus musculus
ccctgcctgagagcctctttcccagtcagtcagtcagtcagtcagtcctccgagtgggcaaagcatgagttcacttgtgcaggg

SEQ ID NO: 69578 - DNA, 129 bp, Mus musculus
gtggtaggcacgcttctgcttctaagttctgggattgcagatcagtgccagcacacagcaaagacttttatatttttaaaactaaaaatattccttgcatgtgtgcctgagtaatatgtctgcgagcca

SEQ ID NO: 69579 - DNA, 69 bp, Mus musculus
gctgtgacagaacacctggcagaagcaacctgagagaagaaaggtctgtctgtctgtctgtctcatggc

SEQ ID NO: 69580 - DNA, 70 bp, Mus musculus
gtgtatgtatatgtgtgtgtatatgtgtgtacatgtatgtacgtgtgtgtgtgtgtgtgtgtgtgtgtgt

SEQ ID NO: 69581 - DNA, 65 bp, Mus musculus
gagggtcagacaggcacactggcaagccatcccaggttgtctgtctctgagcctgtctgtctgtt

SEQ ID NO: 69582 - DNA, 99 bp, Mus musculus
cccagtgccgcagcagctctcaaatctagtcaggtgggatccctcactctgggtctctgattaaaggtttgtcaaggagatacagtgtagtcacctggg

SEQ ID NO: 69583 - DNA, 83 bp, Mus musculus
tctctggggtctgcctgcctgccagtcagccagtctagctagcatcatatgatctgagagagaaggtggcaggcagggccaga

SEQ ID NO: 69584 - DNA, 89 bp, Mus musculus
gggtaatgatgatattgcatgtgtgtgagctctctgtgtatgtgcatgttcacatgttcggggtcatacatgtgcataaacatgtgttc

SEQ ID NO: 69585 - DNA, 58 bp, Mus musculus
gtcacacagcgaggcaggaggcatcggaggcccacctccatctctgtctctgtgtgtc

SEQ ID NO: 69586 - DNA, 70 bp, Mus musculus
tatgtatgtatgtatgcatgtatgtatgtgcctgtatgtatgtgtgcatgtgtgtgagtgtgcatgtgtg

SEQ ID NO: 69587 - DNA, 115 bp, Mus musculus
atcttgtactccggctgctactggtcagtcagggccacagaacagactcagaacagactcgggagctgaactgcgtcctcatgccagaatgttacggagttttaaagcccaaggt

SEQ ID NO: 69588 - DNA, 88 bp, Mus musculus
tatgtgtgttcattcatgtgtggtatatatatgtgtatgtatgtatgtatgtatgtgtgtatgtattatgtgtgtatgtgcatgtata

SEQ ID NO: 69589 - DNA, 77 bp, Mus musculus
gatgagacaaggcatagattctgggatgggctctctatttctgtctgtctttatatatctctctgtttctgtctctc

SEQ ID NO: 69590 - DNA, 168 bp, Mus musculus
gaccatgtgtatataggtgtgtgcgcgtgtgtttgtgagcatatgtgtttgcatgtgtgtgtgcctgtgtgcctgtgtgtctgtgtgtgtacatacatatgtatgtgtgtgcatgtgtgtgtatgtgtgtacatacgtgtgtatgtgtgtgcatgtgcatgtgtatgt

SEQ ID NO: 69591 - DNA, 67 bp, Mus musculus
gtcagtctgcctgtcagtctgtctgtccatccatccactggtcagtcagtctgtcagtatgtctgtc

SEQ ID NO: 69592 - DNA, 130 bp, Mus musculus
atatgtgtgtgcatgtgttgtgtgtgtgcacatgtatggataaatgcacatttgtgcatctgtatgtgcatgtatgtgtatgtgcacacatgtgtgtatatacatgtatgtttctgcaagtgcatgggtg

SEQ ID NO: 69593 - DNA, 124 bp, Mus musculus
gtgtgtgtatgactggagctggaggccgtgaaggaagtcagattccacacagacacacactcagacatgggaacacccagagccctgggctctttcgagcttccttactggtttctcaatctga

SEQ ID NO: 69594 - DNA, 124 bp, Mus musculus
gcattttgtgcatgtgtgtgtgcatgcgggatagtgggtatgtgcatgtgtgtatgtccatgtgcatgtgtgcatgtgtgtgtgtacacctgtctgtgtaagtatgtgtgcatgtgtgtatggg

SEQ ID NO: 69595 - DNA, 113 bp, Mus musculus
agaggtcagcaaggacaacggaagtgacgtgttatcagaagtcactctgctcacagggttctgatggctggatcgtagaacttactccttctctctcctgctgcccttcctct

SEQ ID NO: 69596 - DNA, 98 bp, Mus musculus
ggatgtatgtgtagtgtatgtatatatgtatatatgtgtgttgtgcatgggtgtgtgtggtacatatatgtgtatatgagtctatatgctgcatgtct

SEQ ID NO: 69597 - DNA, 94 bp, Mus musculus
tccaccttttgttttgtttctgagccactctctcactgagcccagagctcgcagtttctcaaagactggctgaatgagcacggcatcctcagga

SEQ ID NO: 69598 - DNA, 68 bp, Mus musculus
ggagttgcatggtgagcctcagggccactgtctctgtaccactgtctctgtctctcatctgcttctct

SEQ ID NO: 69599 - DNA, 112 bp, Mus musculus
gtatgtgcatgagatatgtgagtgcaagtgggtgtgtgcatgaggtgtgtgtagagtgtgtccatgcatgtgtgtacatgaggtgtatgtgtaagtgtgtccatgcatgtat

SEQ ID NO: 69600 - DNA, 58 bp, Mus musculus
gtcaacacagagcaatgcatttgtctcttgtggccttttgacagactctgtgtgtgac

SEQ ID NO: 69601 - DNA, 90 bp, Mus musculus
attgcatgtatgtgagaatatgtgtgtatatatatatgtggtgctttgtatgtagtatgtatgtagtacaggtggtgttttatatgtagt

SEQ ID NO: 69602 - DNA, 80 bp, Mus musculus
gcgagcgtcacagagtaacagacttagggataagttgaacctatgtatgtctgtctgtctgtctctctgtgtgttcttgc

SEQ ID NO: 69603 - DNA, 89 bp, Mus musculus
tatatgtatatgtgtgtatatgtgtgtgcatgtttgtgtgtgtatgtgtgaatgtgtatatatatatgtatatgtgtgcatgtatgtat

SEQ ID NO: 69604 - DNA, 115 bp, Mus musculus
aggcacgtcttgctaggtgtcccttgggtaaagtgctcagtcagtcggtcggtctcttagatcctggcttctcatttagtacgatgggctcaatacagaaataatctagctgctt

SEQ ID NO: 69605 - DNA, 72 bp, Mus musculus
aggactggcagccatgctgggagccaggcaggagtgtgttctacttctgctgtctgtctgtctgtctgtctt

SEQ ID NO: 69606 - DNA, 114 bp, Mus musculus
gtgtatatttttatgtgtgtatgtgcatatgtatatgtatgtatatatgtatatctgtttatatatctttatgtgtttatgcgtgtatgtacagtgtcataggaacacagacac

SEQ ID NO: 69607 - DNA, 93 bp, Mus musculus
gaacgaaaaccctcagagctggagagatggcttactggttaagagcactcagtgctcttgcagagggccgagttcagttcctaactcctgttc

SEQ ID NO: 69608 - DNA, 91 bp, Mus musculus
tatgtctgtgtgtgtctgagtgtgtctgtatctgtgtgtgtatatgtctgtgtgcatgtgcacatgtatgtatgtgcacacaagcatgtgc

SEQ ID NO: 69609 - DNA, 66 bp, Mus musculus
tatgtgcatgcccatgtatatatttatgtacacacctgtgtgtttatgtgcatgtccatgtatgta

SEQ ID NO: 69610 - DNA, 83 bp, Mus musculus
tatgtgtatgtgcatatatatgtatgtgtgtatgtgcttgagaattgtatgtgtgggcatgaatatgtgtgtgtatatgtgtg

SEQ ID NO: 69611 - DNA, 76 bp, Mus musculus
cctgtttgtgtgtgtatgcatgtatgtatacatgtatctatgtatatttgtgtgtgcatgtatacatgtttatggg

SEQ ID NO: 69612 - DNA, 65 bp, Mus musculus
tctctgtgtgtgtatgtacatatacatgtgactctctctctgtgtatgtgtacatgtacaggtga

SEQ ID NO: 69613 - DNA, 66 bp, Mus musculus
atgacagacacctgggctgcttctatagcctagctgtgggtgagcctggctctgtgtgtctgtgat

SEQ ID NO: 69614 - DNA, 91 bp, Mus musculus
tacacatatagacatatatacttgtatatgcgatatatatatataagtacatatatataagtatgtatatgcatgtatacttatgtgtgtg

SEQ ID NO: 69615 - DNA, 76 bp, Mus musculus
gtatcgctgctgaggctctttagtggctaggatgtgtgaagagtctgagctgatgctgtgcagagtccagcagaga

SEQ ID NO: 69616 - DNA, 94 bp, Mus musculus
gtgcatgtgcatgtgtgtgtgagcatgtgcatgtgtgcttgtatgcatgagtgtgcatgtgggtgggtgtttgtacacacatgtgtgcgtgtgc

SEQ ID NO: 69617 - DNA, 118 bp, Mus musculus
tctgtacctgtccccgggtctctctgtgtgtgaatctgtctgtatgtctgtccctcacaaagggcttccctctgtctttactggacagcacagaatcatctcgtgggggaggggagga

SEQ ID NO: 69618 - DNA, 107 bp, Mus musculus
cgtagctgacaactggacccctaagtgcactgacctcacaaatttttaaaaaactgttatttatttttcattgtgtgagtgttttgcctgcctgtgtgtctgtgcgc

SEQ ID NO: 69619 - DNA, 88 bp, Mus musculus
ttctggggctaggagagaggggaagtaaagactcaggcaatgtgagcttctggtctatctctgaccctgactcttactagcatgtgaa

SEQ ID NO: 69620 - DNA, 68 bp, Mus musculus
gccttggaggcacgccagtctggagacaactggtcctggaagcaggtttgtactggactgggtgaggc

SEQ ID NO: 69621 - DNA, 76 bp, Mus musculus
ctaactaactgagtgggtgactgaatgcctgactcactgattgggtgactggctgggttactgactgggtaactgg

SEQ ID NO: 69622 - DNA, 109 bp, Mus musculus
atatgtatgtgtgtatgtgcatatgatatatgtatatatgtatacatatatgtataatatgtatgtgtgcatatatatcatgtgtgtatgtatatacatgtgtatatat

SEQ ID NO: 69623 - DNA, 101 bp, Mus musculus
tgggtgggcgtgtatacgcgcgcatgtgtgcctctgtgtgtgggtaagaatgtattacacgggagaggaatagaacatgtgtcccagcaaacctcctcccg

SEQ ID NO: 69624 - DNA, 60 bp, Mus musculus
cagtcagtcagtcagtctgtcagtctgagcgcagagtacaggcgtcacctgctctgtctg

SEQ ID NO: 69625 - DNA, 68 bp, Mus musculus
ccagggtctagcctgtcagagacaggggcgccacctagaggggcctgtgagaacagagtcagctttgg

SEQ ID NO: 69626 - DNA, 111 bp, Mus musculus
agtccttcctctaactcctccattagtgtctccatgctcagtcagatgtttgactgtgagcatctgcttctgtattggtgaggcaacggcagagcctctcagggaacggct

SEQ ID NO: 69627 - DNA, 62 bp, Mus musculus
tgtatatatctgtgtgtgtaagtgcatgtctgtctgtgtgtgtatgcatgcatgtgtgtgca

SEQ ID NO: 69628 - DNA, 92 bp, Mus musculus
gagtgcattgcatatgtgtgcatgcatgtgtgtgtgcatgtgtgtgcacatgcatatgtgtctctgtgtgtgtatatgagtgtgtgtgtctc

SEQ ID NO: 69629 - DNA, 125 bp, Mus musculus
tctgctctgtctggctccctgacattacctcagccaacttgtggtagagtgggcagtgacagaggtcacagggcagaaggagtgtgaagagaaatactgagacacgagcccttcctgttactctg

SEQ ID NO: 69630 - DNA, 96 bp, Mus musculus
gactgaagctaaaatgtacagaagacagatcttgctctgctgtgttttggactgtgtgagtttctctgtgtttattaacctctttggccttcagtc

SEQ ID NO: 69631 - DNA, 76 bp, Mus musculus
gtacatgtatatgtacatatatctatatgttttgtatatatagtatatgtatgcatgtatgtatgtatgtatgtat

SEQ ID NO: 69632 - DNA, 101 bp, Mus musculus
ggtggctggggttggggtgcggggggtggctggagagatggttcagctgttaagagcactgactgctcttccagcggtcctgagttcaattcccagcaacc

SEQ ID NO: 69633 - DNA, 110 bp, Mus musculus
atatatatgtttataactgtatacctatatgtgtacaaatgcttatatgtatatgtatataagcatcagtgtgtatatatatgtgtttatgtgtatgtgagcatatatgt

SEQ ID NO: 69634 - DNA, 91 bp, Mus musculus
tccacagcactgtttatcactgaaggcagtcagggcaggaactcaagcagggcagggacttggaggcaggagctgatgcagaggccatgga

SEQ ID NO: 69635 - DNA, 131 bp, Mus musculus
tatgaatatatacatgggcagaagacatatatggcatgtgtatatatatgtgtgtatttatatatgtgcataagaatgtatatgtatatgtatatgtgtgtatatatattcttcagacataggaataatgc

SEQ ID NO: 69636 - DNA, 105 bp, Mus musculus
gaagagtcaggtatacttgaggatgaagccagagagctgcaggaggcggcccaggtgtctctccctgtctgtgtggctttgccaagtgtgtagcacctgatattc

SEQ ID NO: 69637 - DNA, 69 bp, Mus musculus
gcccactgagtctggacctgatcttggcctgtctctttctgagacaagattgtctgcactacctagggc

SEQ ID NO: 69638 - DNA, 89 bp, Mus musculus
ctgggtatgagacacgagggaggtgcctgaaggaaggttttaaggagcccagcagagcagggtctgtccctcagtccctcaccactgag

SEQ ID NO: 69639 - DNA, 89 bp, Mus musculus
gacaaagaggtagagagatccagaaaggtgagggtagtgagagctgagagccaaaccctgtcatctgtctgtctgtctgtctgtctgtt

SEQ ID NO: 69640 - DNA, 78 bp, Mus musculus
gtgtgcacatgtgtgtctctgtgtgtgtatatgcactgtgtatgagtgtatgtgtatgcagtgcatgcatgtgtgtgt

SEQ ID NO: 69641 - DNA, 102 bp, Mus musculus
agtgtgtgtacatgtcatgtgtgtacacactgtgtgtatgtgtgtgtgagtgtatgtgagtgtgtgtgtgtgcaaaccatgtgtgtgtgcacactgtgtgtg

SEQ ID NO: 69642 - DNA, 115 bp, Mus musculus
gacacagggcagtatgatggggctagacagctctctatgtgtctctctctttttcttagtgtgtttggtcacgtggaggccagaggtcaagtgttacactggctgttttcaagtt

SEQ ID NO: 69643 - DNA, 81 bp, Mus musculus
acagaaaacatctagaacaaaggtcttggtgtatgtgtgtgtttgtgcacaggtctgtctgtctgtctgtatgttttctgt

SEQ ID NO: 69644 - DNA, 94 bp, Mus musculus
ttgcagtgtagggccagccacacagtgactgagtgtgtgccgtggccctctgtggaaccacacagtgatgagtgtgtgccgtggctctctgtgg

SEQ ID NO: 69645 - DNA, 73 bp, Mus musculus
agtgtgtgagtgagtgagtgagtgtgtgtgtgtaagagcacgttcatgctgaaagcttgtcctctttcacact

SEQ ID NO: 69646 - DNA, 102 bp, Mus musculus
gagatgctggctcacctcagagtaggtcagcctcagtctgtgttttactccagaacacccctgcccccaggctgctgcctctgttcccttccagcagagctc

SEQ ID NO: 69647 - DNA, 89 bp, Mus musculus
gtgatgtggactttagtgctgagaaagcaggagagccgactggccatgctctgtagctccgggtcactgtgactctcagtatttcgttc

SEQ ID NO: 69648 - DNA, 65 bp, Mus musculus
gccaccccatgggtgtgctggagattggagcaggtgctccatcttcctcacactcactgtgtggc

SEQ ID NO: 69649 - DNA, 86 bp, Mus musculus
tgcatatctatttatgtatgtatgtatgtatatatgtatatatctatctatgtataaacctacatatctacatatttatctatgta

SEQ ID NO: 69650 - DNA, 66 bp, Mus musculus
gtgtgcctcagtgcctgacactgaggggacagccaactgcctgcagtcagggcacaggaggcatgt

SEQ ID NO: 69651 - DNA, 90 bp, Mus musculus
tatacagacagaccgtgacaaggtctcctggcctcgtgggtcaaccgctgtgtgtgtgtatgtctcagagcgtcaccttgaggtgtgtct

SEQ ID NO: 69652 - DNA, 113 bp, Mus musculus
ctatcgtgatgcagtgtgcatttgaaatcaaaggggcagattttgtatatttatttcctctatgcatttgtctcaacccgctttaactatcaacaggacacacagcctgagag

SEQ ID NO: 69653 - DNA, 71 bp, Mus musculus
gccctttatgtcttctctctgcctgtctctggcaaggccaccagcgtgaggctgagtaaggcggtgatggc

SEQ ID NO: 69654 - DNA, 83 bp, Mus musculus
gcacagtgtcccccgtgtcaccatctgacagctgtgcactgtgtcccctcactgtgtcactgtctgactgcggtgcactgtgt

SEQ ID NO: 69655 - DNA, 60 bp, Mus musculus
tgtgtcactgtctgactgctgtgcactgtgtcccccatgtcaccgtctaacagtggtgca

SEQ ID NO: 69656 - DNA, 74 bp, Mus musculus
tagatatcattgtggtggggcttggctttgaggtttcaagagctctcaccaggccctgtctgtctgtctgtctg

SEQ ID NO: 69657 - DNA, 80 bp, Mus musculus
gtatgtatgtatgtatgtatgtatacatgtatatatatatacatatatatatacatgtatatatatacatacatatatgc

SEQ ID NO: 69658 - DNA, 77 bp, Mus musculus
tatacgcatgtatacatatatatgtgtatatataaaaataaaatatatgtatatatatgtatgtgtgtgtgtgtgta

SEQ ID NO: 69659 - DNA, 109 bp, Mus musculus
accagctgtggctgtgcagtgagatgcccctctgtgtgtgtgtgtctccgtaggtgacctgccgcgcccttggaatcggggcttacctggtgaggcttggccagcgggt

SEQ ID NO: 69660 - DNA, 92 bp, Mus musculus
tttgtgtgtatatgtgtgtgcacatgtacatatgtgcatgtatattatatgcatgtgtatgtgtgcatgtgcatgtgtattgtgtgcatgag

SEQ ID NO: 69661 - DNA, 186 bp, Mus musculus
atatatgtacttctatggatatgtgtgttatatgtgtattgtgtatatgtctgtatattgtatatatatttatatgtgtatatatgtgtgtatcttatatatgtacatatgtatatgaatttatgtgtatatgtgtatattctgtatgtatatgtgtatatgaatttatgtgtgtatgtgtatata

SEQ ID NO: 69662 - DNA, 86 bp, Mus musculus
agcggtggcatgtcatggaggcaccagccttgaaaccccagccgggtcagaattctccccgtgcctcacagatgtgacttatctct

SEQ ID NO: 69663 - DNA, 113 bp, Mus musculus
ctatggaaggctccacagagcacctgggagccaggcctaacggaagcagctgctcctgtctctcccactctgttagctccccgagaatggttacactgcaggctctggaggcc

SEQ ID NO: 69664 - DNA, 70 bp, Mus musculus
tgcctgcctgcctgcctgcctgcctgcctgggcggagaccccaggccagcaaggagtgctgctgcctgca

SEQ ID NO: 69665 - DNA, 78 bp, Mus musculus
gggtgacagggcgtgcagcagtaagtgcacagtactcctccactcactgtcccactctgtctgcgccctggagcgccc

SEQ ID NO: 69666 - DNA, 98 bp, Mus musculus
gctcttgaatgtgtgtgcagacctcggtccactctgtgactcacactgaaaacagtgggattatccagagggcagtgtcagcataggctcttcagtgc

SEQ ID NO: 69667 - DNA, 95 bp, Mus musculus
tcccgtgtgcccgctgtaactctcaggctctgtgttacctgtgcaggctgtgcacggggcacagggctctgcgggcaagctgggaacacacatgg

SEQ ID NO: 69668 - DNA, 103 bp, Mus musculus
tgggggagggggggggatgattatggactgggagcccgttggaggagacatgagaggctagtctgtctgcctgtctgcctgtcccttctgtacccatgctggc

SEQ ID NO: 69669 - DNA, 69 bp, Mus musculus
agtgctgtgatgtctctgtgtctcaaagccctgtctgtaaagggagggtgggcatcagagccacttcac

SEQ ID NO: 69670 - DNA, 77 bp, Mus musculus
tctgtgtgtgtctgtgtgtgcctatgcatgttcacgtgtgtctgtatgcgtgtgcacatctgcgcagcacatgcaga

SEQ ID NO: 69671 - DNA, 80 bp, Mus musculus
tgggaagaacagggccggagagacggttcagtggttaagagcactgactgctcctccagaggtcctgagttcaattccca

SEQ ID NO: 69672 - DNA, 83 bp, Mus musculus
tatgtatgtctgtgtgtatatctgtgtgtgtctgtgtatttttgtctgtgtatgtgtatatatatgtatatatattatatatg

SEQ ID NO: 69673 - DNA, 66 bp, Mus musculus
gggggagtatgatatgcagaggaggatctcgccactgtttctctccgtctgtccgtctgtccgtcc

SEQ ID NO: 69674 - DNA, 90 bp, Mus musculus
atacttcagggcagctcggtgtagccatggggcctcagaccctgtctgtctgcctgctttgcctgctgtggctctgagtgtcccactggc

SEQ ID NO: 69675 - DNA, 81 bp, Mus musculus
gggctgccctttggctgcctctctgggagtgtgtgtggacagtggccaaaggacaccctggggagcctgggctgttagccc

SEQ ID NO: 69676 - DNA, 90 bp, Mus musculus
taagacatgggtggcccattcagagctgagtgaagtgactttgccctgcagacctcagtctctccctctgaataatgggtacaagttttg

SEQ ID NO: 69677 - DNA, 70 bp, Mus musculus
accactttgaatgtagtatgcatgcacatgagagagaccatctctgtgtgtgtgtgtgtgtgtgtgtggt

SEQ ID NO: 69678 - DNA, 63 bp, Mus musculus
ctgggagcctgcctctgagcctcagtggcctcacggctggcatgagtgtgaagcaggccctag

SEQ ID NO: 69679 - DNA, 77 bp, Mus musculus
gaacttggaaatgagagagctaggcgtgtcccgaggaaagcagagggcatcctggctctctgtatatctgtctgttc

SEQ ID NO: 69680 - DNA, 89 bp, Mus musculus
ggggcggggaactgggtctcggtctctgtttctgacagggttgtagtgtacaacctaggctggcttagaaatcatgatcttcctgcctc

SEQ ID NO: 69681 - DNA, 84 bp, Mus musculus
agctctcaggtcacagtctgtcactgagggaagggaggaaggctgctcgctgactcacttgctcctcatgactggcttagggct

SEQ ID NO: 69682 - DNA, 85 bp, Mus musculus
gttatctattgtaaagctaagtgcgggctcccaaaacctggttgtcccagagacaagagagtccccactgaagacattaggtgac

SEQ ID NO: 69683 - DNA, 81 bp, Mus musculus
gcgaagaagtttgtaacttcctgctctgtggctaagtcagcgggtaactgacactagagagaggggacacggtatttgtgc

SEQ ID NO: 69684 - DNA, 83 bp, Mus musculus
gaattgtatggttctgagggctggagagatagttcagcggttaagagcactgactgctcttccagaggtcctgagttcaattc

SEQ ID NO: 69685 - DNA, 135 bp, Mus musculus
ggccaagctggtgagtgagcaggggccccctgtcctgtgcacaaaccgcccctggcttcactctctgtggctgagagacagggtgaggacactccagctcaacttggtttaccctcacaggtctcagccacgggg

SEQ ID NO: 69686 - DNA, 90 bp, Mus musculus
ctccagcctgtatgtatgcatgtatgcatgtatgtatgtatgtatgaattatgtatgtaagtaagtttaagcatgggtgcaaatatggag

SEQ ID NO: 69687 - DNA, 64 bp, Mus musculus
gtgtatatgtatatgtatatgtatatgtgtacgtgtacgtgtacgtgtacgtgtacgtgtatat

SEQ ID NO: 69688 - DNA, 68 bp, Mus musculus
gggtctctctgtctctcccaggacctggagtttgccggctctgctagtctgggtggcctgagagaccc

SEQ ID NO: 69689 - DNA, 75 bp, Mus musculus
gggtgtactgtggacacactgagacacactatcacactgtgacacagtatgactcacagtggtactacagtttct

SEQ ID NO: 69690 - DNA, 65 bp, Mus musculus
tgagtgtgtctgtctctgtggggtggggcctgaaaaaggttctcatgtgttacagactgggctca

SEQ ID NO: 69691 - DNA, 68 bp, Mus musculus
gaaaacaggggctggggagatggctcagcgttaagagcactgactgctcttccagaggtcctgggttc

SEQ ID NO: 69692 - DNA, 116 bp, Mus musculus
ttgtatttgtgggctctgcttccctctctgtctacagtttttgcttcatggaatgtaaagatctttgattatatgacaggcatcttagaggcccagagagatgactcagcagctga

SEQ ID NO: 69693 - DNA, 79 bp, Mus musculus
actgtgagccactctgagccacacactcacagtgaggctgctgcactcacctgagctgtggggaagagatgctccctgt

SEQ ID NO: 69694 - DNA, 83 bp, Mus musculus
gcccagtcagaggaacagagggaagccactctctagagaggcccatttgcctagggaacttctgtctgtctgtctgtctaagc

SEQ ID NO: 69695 - DNA, 111 bp, Mus musculus
ttttaagtgcaccactaagtcggtcagcattgccttaatacacattgtctacagattttcttgttatcctgggtttcttggtgcctggctttgtagcagggtcatttttga

SEQ ID NO: 69696 - DNA, 105 bp, Mus musculus
gtgtgctttgtgcataatcagtaagtagtattattatattattataataatatcattattattatgttatagtaatactaagaagcctgactacacacatcactc

SEQ ID NO: 69697 - DNA, 123 bp, Mus musculus
atatatatatatgtatacacatatatgtgtatatatgtatatgtatatacacacatacatatatgtgtatatatgtatatgtatatacacacatacatatatgtgtatgtatgtatatgtgtg

SEQ ID NO: 69698 - DNA, 80 bp, Mus musculus
atatatatgtatatgatatgcatcatatgtgtatatattatatgatacatgttatatgtatatatatcatatgacacata

SEQ ID NO: 69699 - DNA, 64 bp, Mus musculus
gtgtgtgtgtgtgtgtgtgtgtctgctcatgtgtgtgtgtatacagatatatacacacatatat

SEQ ID NO: 69700 - DNA, 61 bp, Mus musculus
gctggtcaggaagtcccaggcatccccctgtctctgactccctggcactccaattacaggc

SEQ ID NO: 69701 - DNA, 80 bp, Mus musculus
tcaaatttctttgtatgtatgtatatgtgtgtgtgtgtatacatatatatgtatgtatgtatgtatgtcttgaagtttga

SEQ ID NO: 69702 - DNA, 70 bp, Mus musculus
ctgtgtgtcctacctggttgttttctcctagcccttgggggactccctgaagagacaggcagttgggaca

SEQ ID NO: 69703 - DNA, 73 bp, Mus musculus
gtctctgtgtgtgtgtgcatatgcatgtgagtatgtgtgtatatgtatgtatgtgtatatgtatgtgtgagtc

SEQ ID NO: 69704 - DNA, 76 bp, Mus musculus
tgaggacacacagcacacacagcagcaggacttagcagagctgggacctcagtggctctgtagctctctgtcctca

SEQ ID NO: 69705 - DNA, 99 bp, Mus musculus
ggaaactactcctcaggcaagaaggtcagggctggagtgatggctcagcggttaagagcactgactgctcttccagaggtcctgagttcaaatcccagc

SEQ ID NO: 69706 - DNA, 85 bp, Mus musculus
gaggctcagagctctggctgcccttgcagaggccctggatttgattccctgcacccacatggctgctcacaactctgtctaactc

SEQ ID NO: 69707 - DNA, 88 bp, Mus musculus
agtcctatgttacttgttgggctggtcttgaagtatgtatgtatgtatgtatgtatgttttgagacagggtcttatgtagccctggct

SEQ ID NO: 69708 - DNA, 65 bp, Mus musculus
gacactctctcactctgtgcttcctatatactgagagctcacagatggtcaggaagggggtgctc

SEQ ID NO: 69709 - DNA, 105 bp, Mus musculus
ccccatggtgtgtgggtgactggatcagctgtcggctgggtggaggtagcccttagacactctggctgtgaggctgggaaggcttactgatgctgatttctgggg

SEQ ID NO: 69710 - DNA, 106 bp, Mus musculus
gttctcccggggatccgcagcgacggcgctcgctcgctcgctcgctcgctagctcactcggacctcggccggcgagcgtagcgcactgcgcgtgcgcggagagggc

SEQ ID NO: 69711 - DNA, 109 bp, Mus musculus
gtttgctgagggaccagggccaagttggtttaggggtcctgagctgagatagtgggactgccaggctccctcaaagccacaaatgcttgcagccttggaacaagtctgc

SEQ ID NO: 69712 - DNA, 67 bp, Mus musculus
gaatttgggctggagagatggctcagcggttaagagcactgactgctcttccagaggtcccgagttc

SEQ ID NO: 69713 - DNA, 80 bp, Mus musculus
aagactaggcatctctttcctcagttctctctctgacactgaagagagcggacataccttacaagagatgcgtgtgtctt

SEQ ID NO: 69714 - DNA, 77 bp, Mus musculus
ctctctctcagagtctcaccaggcaaagggatgacggtccctgcagcggatcaggtgggctctgccctcaggaagag

SEQ ID NO: 69715 - DNA, 208 bp, Mus musculus
gcctgcctgcctgcctgcctgcctgcctttctcttttatttttactttctttttttaaaatgtgtattctgaggctttaactcaggtcctgctgcttgtaaggcaagcacctttctgattgttctatctccccagccctgaagaatatttctttttaatgtgaattgagagctggaaccaagaactgatgctagggcttcatgaacga

SEQ ID NO: 69716 - DNA, 112 bp, Mus musculus
aaggtttacagtaagtcatttagtcaggatttaaggggaaggtttcaggtcagccacctttgatgtggaagctcagctcagagactgtatggtgacgttaggtaatacactt

SEQ ID NO: 69717 - DNA, 104 bp, Mus musculus
gcttacatatatttaccctgcttcatatatatacgtatatatacataaatatagatagatgtatgtatatgtatgtacatatatgtgtgtgtgtatatgtgtgt

SEQ ID NO: 69718 - DNA, 87 bp, Mus musculus
catagtggggctgaagagatggctcagcggttaagagcactgactgctcttccagaagtcctgagttcaattcccagctaccacatg

SEQ ID NO: 69719 - DNA, 102 bp, Mus musculus
tatatatatgagtgtcttgcctgtatgtatgtatgtatgtatgtatgtatgtatgtatgtatgtatatgtatgtatgtatgtatatatgtatgtgtgtgtgt

SEQ ID NO: 69720 - DNA, 139 bp, Mus musculus
ggaggaagtgcgtcactgaggggtgggctttgaggtttcagatgttcaagcctggcccagtgtctctctctgtctgtggcctggggatgcaggtgcagaactctcagttgcctctccagcaccatgtctgcctgtgacc

SEQ ID NO: 69721 - DNA, 93 bp, Mus musculus
caccgaatctgggctggagagatggctcagcggttaagagcactgactgctcttccaaaggtcctgagttcaaatctcagcaaccacatggtg

SEQ ID NO: 69722 - DNA, 85 bp, Mus musculus; identical to SEQ ID NO: 57439

SEQ ID NO: 69723 - DNA, 85 bp, Mus musculus
accacagggaaatatttcataaacttataaatctatgtgtactatatatttttttgaaaggatgttgagggtatagctctgtggt

SEQ ID NO: 69724 - DNA, 74 bp, Mus musculus
agcccacactctccgtgcctcagtctcctcacatgtcaagtgggagaaaggcagccagtgcttccttttgggct

SEQ ID NO: 69725 - DNA, 59 bp, Mus musculus
tctgtctgtctgtctgtctgaaccacggtgtggcctgtggaggacaaaggacagtcaga

SEQ ID NO: 69726 - DNA, 83 bp, Mus musculus
gtgtcccaggccaggcacccacgcaccctctctggctcacgcttcccacatagggtgagtgttggcacctgaactctaggctc

SEQ ID NO: 69727 - DNA, 88 bp, Mus musculus
gtgtgtgagagagagagagagagagagagcgagcatcctggtcctgcagaacttatgggcccgcacatctgtttcttctttgacctac

SEQ ID NO: 69728 - DNA, 77 bp, Mus musculus
gggtcctttgcctcaagggaagttgatagtgcaccaagactaagtcacctgactgacactgtcagtccttgagtccc

SEQ ID NO: 69729 - DNA, 70 bp, Mus musculus
gcatgtgtgtctctgtgtgtgcatgtgtgtaatacagcaggtgctagtggatgccagaggcatcggatgc

SEQ ID NO: 69730 - DNA, 93 bp, Mus musculus
tatatgtatgtatatatgtgtgtatttatctatgtatctatatatctaagtatctatgcatgtatgtatgcattatgtatatatgtatgtatg

SEQ ID NO: 69731 - DNA, 75 bp, Mus musculus
gcagagcaggggggtggggtgggagggatgtggggaggggatgaccagatatgtcagactccaactcgatgtggc

SEQ ID NO: 69732 - DNA, 76 bp, Mus musculus
gtgctgggagttatgcctgtctcagtgagtctctagagaagttagggagatgatgcgttcattaacatgccagcat

SEQ ID NO: 69733 - DNA, 73 bp, Mus musculus
cctgctgctttcctgttttctctgtaggttttagcatcagactgacagacagacagacagacaggcagttagg

SEQ ID NO: 69734 - DNA, 87 bp, Mus musculus
ccagccggttctcactcactctttctgtctctgcctacaagaaacatggggctgtaaagacaagagtgcttcgctggaggaggctgg

SEQ ID NO: 69735 - DNA, 130 bp, Mus musculus
ataagtgtatgtgtatatgtttatgaatatgtgcatatgtgaatgtatgaatgtgtataaatgtatatgtatatgtgtgtgcatgtttatatgtatgtatgtgtatgtctgggtatacatttgtgcacat

SEQ ID NO: 69736 - DNA, 71 bp, Mus musculus
gactttgtgatcttgctctgcctgacaatcacacacagtgattgcgactagtacttctgatcattccagtc

SEQ ID NO: 69737 - DNA, 74 bp, Mus musculus
gtgtgtatatatgtgtgtgtattgagtatatattgtatatgtgtgtgtatgtgtgcatgtgcatgtgtgtgcat

SEQ ID NO: 69738 - DNA, 108 bp, Mus musculus
atatatatatatatatgtgtgtgtgtgtatgtacatatatatttttctactaattgttgtatatatgtatatatgtacatgtatatacatgtatatacatatttatat

SEQ ID NO: 69739 - DNA, 80 bp, Mus musculus
ggatacacattgcatagaatatacatgtatgtatgtatgtatgtatgtatgtatgtatgtatgtatgcatgtgtgtatct

SEQ ID NO: 69740 - DNA, 147 bp, Mus musculus
gtgtgtgtgtgtgtgtatgcatgcatgcatatatgtatgtgtatgattgtgtatatatgtgtatatatgtgtacatatatgtatatatgtgtgtgtgtatatatatatatatatatatatatatatatgagtgtgtgcacatacaca

SEQ ID NO: 69741 - DNA, 90 bp, Mus musculus
atgtatgtgtgtatgtatgtgtgtgagtgtatgtgtgtatatatctatgtgtatatgtgtatatgtatatgtctgtgtatgcatgtgtgt

SEQ ID NO: 69742 - DNA, 72 bp, Mus musculus
actcaaaagctagcaggagcccgagacagggaacatttgagtccctttgtcacaggctctctgtatctgagt

SEQ ID NO: 69743 - DNA, 137 bp, Mus musculus
tatgtgtatgaatgtgtgcatgtaggagtatgagagtgcaagcatgtgtgcagatttgtatgtgtgcatgtgcatgtgtgtatgcatgtgtgcatgagtgtgtgttcatgcatgtgtgtgtgtgtgtgtgtgtgtgt

SEQ ID NO: 69744 - DNA, 70 bp, Mus musculus
tcactggggccacagactctctattctccaggaaaaggagagagatgtgtgtcaggagggccagaagtga

SEQ ID NO: 69745 - DNA, 110 bp, Mus musculus
tacataagactgtggaccctctctcaaatctccagaacccacatgagagttagcacagagacgtgagtctgtagatgcctctctgagagaaagagagatggactaatgta

SEQ ID NO: 69746 - DNA, 75 bp, Mus musculus
aaggcattgggggtggggggacaggcacagacacacttcctctgtgtgtgcagtgactccacattcccatggctt

SEQ ID NO: 69747 - DNA, 86 bp, Mus musculus
gtctgactcagtgggcagagagcacagggagacaccaccttgtaccttcgtggttgcttccgtgcttctgtgagtgagcaccagac

SEQ ID NO: 69748 - DNA, 85 bp, Mus musculus
gtctctcagttgagtcatatgattgaagctattggcaagaaaatggtatgctggtaacatcagacagacagacagacaggcagac

SEQ ID NO: 69749 - DNA, 95 bp, Mus musculus
agtagagttctgtggatgagtctgaggtaggagcacagtggacaagcttccggcggtcagtgttctctctctgacagtatcttcagatgctttct

SEQ ID NO: 69750 - DNA, 87 bp, Mus musculus
agctcctttcccggtgactgtagactgagtgaacccggcaattaaaaccatcacagttgtgtctgctgtaatacctgtctgggagtt

SEQ ID NO: 69751 - DNA, 85 bp, Mus musculus; identical to SEQ ID NO: 57439

SEQ ID NO: 69752 - DNA, 114 bp, Mus musculus
tgggtatgtgaaattgctaattaataaggatagagagatggctcagtggttaagagcactgactgctcttccagaggtcctgagttcaattcccagcaaccacatgatggctca

SEQ ID NO: 69753 - DNA, 70 bp, Mus musculus
atggttcagaggctcagagtcatgatcccccttctcttttttttttctgtttctctgtgtctctgtctat

SEQ ID NO: 69754 - DNA, 72 bp, Mus musculus
gtgcatgtgtggtgtatgtatatatgtgtgaatgtttatatttgtatgtggaagtgtatagtatatgtgtgt

SEQ ID NO: 69755 - DNA, 67 bp, Mus musculus
ggaaccatgatggcagcctaagagttgttactgccttgagcaacttgaggggattcatctctgtttc

SEQ ID NO: 69756 - DNA, 65 bp, Mus musculus
tgtgtgtgtgtgtctgtctgtctgtctgtgtgctatgactggcagacacacagtcacaaacatac

SEQ ID NO: 69757 - DNA, 81 bp, Mus musculus
cacagaacccggtgtgagattctctgtgactcagatgaccccgccccgcccctcaggcacagagtttccatagcgtctgtg

SEQ ID NO: 69758 - DNA, 133 bp, Mus musculus
gtgtgtgtgtatgtatatatgtgtgtatgtatatttatatatgcatatatgtatatgtgtatatatgtatgtgtattatatagatgcatatatgcatctatgtgcatatatatgcatatatgtgtacatatat

SEQ ID NO: 69759 - DNA, 89 bp, Mus musculus
tctgcaggattgtggataggcaactgcaggcagacatgcaagtgtagattatttgtgtgtgcgtgcacacttctctgtatctcagcaga

SEQ ID NO: 69760 - DNA, 67 bp, Mus musculus
agaagctaaatggcagggagggaggctcctggtcaggtcaagactgtgtctctgtgtctaagtttct

SEQ ID NO: 69761 - DNA, 113 bp, Mus musculus
tgtggtattgtacatgtacctatgttgtgtgtgcatgtgtatgtatgtatgtatatatgtgtatgtgttgtgtgcatgtacatatgttgtattgtgcatgtacatatgttgta

SEQ ID NO: 69762 - DNA, 105 bp, Mus musculus
tgtatgtatatgtatatatgtgtgttacatattatatattgtatattatatattatagtatatttttatacattatatattatatatttattacatataaataca

SEQ ID NO: 69763 - DNA, 69 bp, Mus musculus
agggagaaaatgattgacacccagtgtcagggtggaagcctgcctgtctgcctgtctgtctgtctcctt

SEQ ID NO: 69764 - DNA, 68 bp, Mus musculus
acacacacactgtgtgggcatatcaacttcttttattcctttgtttgtgtgtgtgtgtgtgtgtgtgt

SEQ ID NO: 69765 - DNA, 113 bp, Mus musculus
gcgctgtcagtgtgccttatgctttgatgtagactaatgacccctcacagaagacactctggagagaactgggattttaaaatagctagctaaaggcagtacagtgtgtgtgt

SEQ ID NO: 69766 - DNA, 84 bp, Mus musculus
tgagcctgctagtctgctggagatggatgaggctgtgtgtcctgtggggccctgtctcgcgcactctgtctgctgcaagcctca

SEQ ID NO: 69767 - DNA, 84 bp, Mus musculus
caggataattttgagttagatgctagcctgggctacaatggtaccaagccagcctgggctctgagactctgtctcaaaaaactg

SEQ ID NO: 69768 - DNA, 79 bp, Mus musculus
gcaggcatcactcagtgttgcacaccccggggctagtgtgaaccatgtggtaggaagtgtgctcactgtgtgtgtgtgt

SEQ ID NO: 69769 - DNA, 80 bp, Mus musculus
gttctccctgtggctcttctaagttctaccaaatggaggggaattttcagtgggtggacaaagggagaaatggggctgac

SEQ ID NO: 69770 - DNA, 79 bp, Mus musculus
tgcatgctttcctctgacctccacatgtgtgcgtgtgaaccctccacaccagacagacagacagagagacagtcagaca

SEQ ID NO: 69771 - DNA, 81 bp, Mus musculus
ctggggctggggctcagccactagagggcgctgcctgacactgcaggaactgcatctggagctgcagccattccagcacag

SEQ ID NO: 69772 - DNA, 77 bp, Mus musculus
gtcactcatacactcagtctttcctgatgggtttttctttttaccaaaggcagaggatctgacagtgaatgaggagc

SEQ ID NO: 69773 - DNA, 109 bp, Mus musculus
cttcagtttttcagtgtcctagtcggagtagacagggaggggaagtcctgaagtcacaccacagtttgtctgtctgtctatctgtcttccacactagctatcttgggag

SEQ ID NO: 69774 - DNA, 66 bp, Mus musculus
atggggatgtatgtatatgtatatttgtaactgtgtgcatacctgtatatgtacgtgtgtctctgt

SEQ ID NO: 69775 - DNA, 127 bp, Mus musculus
gtgtgtatatatatgtgtgtgatatacatgtatatgtgagtatatatgtatgcatgtatgtatgtatgtatgcgtattaactgtgtatttgtgtatacttgtgtgtatgtatctgtatgtgtatgtg

SEQ ID NO: 69776 - DNA, 102 bp, Mus musculus
gctcttgcagaggcacggaggttggggggagggggggggcgggcggcactggctgggtccctccatcgctaccagccattatcttatccaaagctgcggagc

SEQ ID NO: 69777 - DNA, 113 bp, Mus musculus
tacatggtttgtctatttgttttaaggtaagtctggtaagtctggctcagcggttaagagcactgactgctcttccagaggtcctgagttcaattcccaacaaccccctggtg

SEQ ID NO: 69778 - DNA, 115 bp, Mus musculus
ggcacactgtaagccttatagctatgaattcaaccatgactagattatttttaaataatagttgatgaattaatagcatggttatcaatagactagtagatacagcaagtatgtc

SEQ ID NO: 69779 - DNA, 128 bp, Mus musculus
tttgtgagtgtacatatacatgtggatgggggaggggcttccagacggtatgtatggatgtgtgtggataagtgtgcatatgtattgcgaatttgtgtgatatgtgtactgtgtgagtgtctatgtac

SEQ ID NO: 69780 - DNA, 113 bp, Mus musculus
gggacgcgttcctggagtttctgggtagccgtggagctatctcagtcacagtgtctctaattgctgttgacctcagagggcctgggttactgtgagggtgctaggttgtgcac

SEQ ID NO: 69781 - DNA, 68 bp, Mus musculus
tgtctgtgtctatgtatgtatgtatgtatgtatgtatgtatgtatgtatgtgtgtgctggtgtataca

SEQ ID NO: 69782 - DNA, 74 bp, Mus musculus
attctccacatgtgtctatgtatgtatgtatatatgtgtgtgtatgtgtgtatatatgtatatatgagttgaat

SEQ ID NO: 69783 - DNA, 80 bp, Mus musculus
tatgtgtttgcatatgtatgtgtatatgtatacatatgtctctgtgtgtttgtgtatgtgtgtatatctgtgtatatgtg

SEQ ID NO: 69784 - DNA, 60 bp, Mus musculus
tctgtctctgtgtgtgtgtgttcacatgtgtgaatgtgagtacatgtatgtgtaggtggg

SEQ ID NO: 69785 - DNA, 70 bp, Mus musculus
gtatatgtatacatgtgtatatgtatatatgtgtatatgtatatatgcatatatgtatgtatatgtgtac

SEQ ID NO: 69786 - DNA, 69 bp, Mus musculus
gtgtatatgtgtatatgtatatatgtacatgtatattatgtccatatgtatttatgtatatatgtatat

SEQ ID NO: 69787 - DNA, 74 bp, Mus musculus
actgcatgtgagagatgacactcaggccataatgaacaattcctaatggcatccgtgtctgctctttccgaagt

SEQ ID NO: 69788 - DNA, 156 bp, Mus musculus
atgtggtatatgtgtgatgtgtatgtatgcatgcgtgtgtgtctatgtgtgtgtatatatatatatatatatatatatatatgtaaaacatatatatatattttatgtctctgtgtctgtgtgtggtatatgcgtgtgtatatgtatgtgtgtgtg

SEQ ID NO: 69789 - DNA, 119 bp, Mus musculus
ctcagctcggtagggtttgtatcacggagaagttgatccccaagatggacagtgtatgtatgtatgtatgtatgtatggggcagctgcctgcttgtgggacggactctggtgagaggga

SEQ ID NO: 69790 - DNA, 73 bp, Mus musculus
ggaccaggaaggaaggatgggtcacctctgtggccaccaggccattgcagagtgtctttctgtgactgtgtct

SEQ ID NO: 69791 - DNA, 75 bp, Mus musculus
gacaagtatcctggaggagaaagtcacacacacacacacagatgttgtgattttcatgtttctgggggacctttc

SEQ ID NO: 69792 - DNA, 84 bp, Mus musculus
gcctgaaacatctatcgtgtcattcagtgtctctgtgatcccagcattcaggaggctggaggaggaaaatcaggagttcaaggc

SEQ ID NO: 69793 - DNA, 72 bp, Mus musculus
tttggtcaaggctatcccttatgcatgtctctctgtctgtaagatggaggcactctggggataacaatcaaa

SEQ ID NO: 69794 - DNA, 104 bp, Mus musculus
tgaatgttaagccacggactgggtgattggcatagggttgggatgaatatgtatatatgtttattcactgctatagctgagaaagaaaccttgggggaaattca

SEQ ID NO: 69795 - DNA, 91 bp, Mus musculus
ttcagaccagagacagcgagcacagtttttgcgatcttaattatcaagttaacctctcacgggctgactgactcacttcacaggctctgaa

SEQ ID NO: 69796 - DNA, 74 bp, Mus musculus
gaattccaggccagggctggaaagatggctcagcggttaagagcactgactggtcttccaggggtcctgagttc

SEQ ID NO: 69797 - DNA, 67 bp, Mus musculus
gcctgcctgcctgcctgcctgcctgcctgcctgcctggtgaagtcaggctaccagccacaggctgca

SEQ ID NO: 69798 - DNA, 128 bp, Mus musculus
gcttactcagcagaaatgtgaaagggcgcagacaaagaaacactgtgtctttcaaagcacatctgagagaagacagtgagtgaaggccgaagccccccaagtcggcaggggcgggtcctggcagcttc

SEQ ID NO: 69799 - DNA, 59 bp, Mus musculus
ctctctgtgtcactgtatctctccgccctgtgtgaagagatctcccagtgaatctggag

SEQ ID NO: 69800 - DNA, 103 bp, Mus musculus
agcagtgacactgattccacattctgtgcctctctccctgacactgaactgtaagggggctctgcctgggcgtggcggtgtgggctctcaggtatcccatgct

SEQ ID NO: 69801 - DNA, 85 bp, Mus musculus
ggtcgtctctcctcctgagaatttgttgttttctcattggctctgctcccaagagtggagaacgaggtcagagagagagatgagc

SEQ ID NO: 69802 - DNA, 111 bp, Mus musculus
gtggatttttattgttgtttaaaaaagggggtggggggcagagagatggctcaatggttaagagcactgactgctcttccagaggtcctgagttcaattctcagtaaccac

SEQ ID NO: 69803 - DNA, 111 bp, Mus musculus
gtgaatatagttgaagaagtggtgaacctcccttgcataaagcctaattccttgattaggagtcaggagacacagggctgattccacttgggcccctgctgtgaaatttac

SEQ ID NO: 69804 - DNA, 84 bp, Mus musculus
ccatttcactgtcccatccttatgatatgtcttgacgctccagggttgtttcaagggggaacatctgggtgacatgaatcctgg

SEQ ID NO: 69805 - DNA, 105 bp, Mus musculus
gcctggtgctcacatgttggacgttctcccatcggctcctgtgtgcagacctgggtcagactgtactctctgagctcatactagttcgtagcattgagcaccagc

SEQ ID NO: 69806 - DNA, 63 bp, Mus musculus
tgctgatttttgccagagcatcggtctgcagtgcagtctccctgactctgtcaaggatccgta

SEQ ID NO: 69807 - DNA, 85 bp, Mus musculus
tcacgtcctctggtatgtctctctgtctgtctatcttttcaccgtcggcaggatgtgcctctgcttgaacatgcctctggaatga

SEQ ID NO: 69808 - DNA, 118 bp, Mus musculus
tcggtcattttgtatagttcattatgacaaacatcacgtcctctggtctgtctctctgtctgtctatcttttcaccgtcggcaggatgtgcctctgcttgaacatgcctctggactga

SEQ ID NO: 69809 - DNA, 114 bp, Mus musculus
gtcagccgactccgggctcctgtgtttcttctctttcagaactatttttggtgagtgttcagagactgcacacaccaaagtgtttgggatttgagatgcgagcctgaggatgat

SEQ ID NO: 69810 - DNA, 64 bp, Mus musculus
gtatgtatgtatgtatgtatgtatgtatgtatggacgtatggacgtatgtatgtatttatttac

SEQ ID NO: 69811 - DNA, 114 bp, Mus musculus
tgctggttcccagttgtcttgtgccttccaggtgggtgtaccgggggtccactgtgtggctctctgtccctccttccaagtcacgacgtctaacctagaatctttcctaatgca

SEQ ID NO: 69812 - DNA, 105 bp, Mus musculus
tttttccatcctagagagtcaaggaaaatggaactctctacaagaaaatctggggtttgactttctctgtgtggctctgttgaatgtctctctgggactgaagaa

SEQ ID NO: 69813 - DNA, 85 bp, Mus musculus; identical to SEQ ID NO: 57439

SEQ ID NO: 69814 - DNA, 62 bp, Mus musculus
acacacatatatatatatacacacacatatatgtatatatgtgtatatatatgtatgtgtgt

SEQ ID NO: 69815 - DNA, 84 bp, Mus musculus
tctctttggaaaactctgtcttcttctacttagaaccaagtgagtctatccttgtcttaggtgacagatgtgagccagcacaga

SEQ ID NO: 69816 - DNA, 118 bp, Mus musculus
gctctcctcacgaagaatgaccttgaactctggattcccccactttctgtctctgacacactgcgattttaagtattccccatcctccccagtctaaggtgggacctttaagaagagt

SEQ ID NO: 69817 - DNA, 65 bp, Mus musculus
gtatgcatgtgtatactgtatatatatatctgtgtatgtgtatgtgcatgtatatgcatgtgtat

SEQ ID NO: 69818 - DNA, 68 bp, Mus musculus
tctgcctctctgtgtctgtctccccctcctctgggcgtgagcatgtaagcacatacacataggtcaga

SEQ ID NO: 69819 - DNA, 94 bp, Mus musculus
ctctgaggtttctaatgctcaagcaagccaggtccgctgtctctatctcttcctgctgcctgcctgcctgcctgcctgcctgctgaacccaaag

SEQ ID NO: 69820 - DNA, 65 bp, Mus musculus
gcatgtgtgcatgtgtgtctgtgtgtatctctgaatgtgtgatatacatgtatgtgtacatgtgt

SEQ ID NO: 69821 - DNA, 94 bp, Mus musculus
gccagacatgtgtgctgggaaccaaactcaggtcctctggtactgaccaagcactctcaaacactgagtcacctctgcaacctgtcatatgggt

SEQ ID NO: 69822 - DNA, 76 bp, Mus musculus
agtacacataaaattgaaatatatgtatatatatgtatgtatatatatgtatgtatatatgtatgtatgtctgtct

SEQ ID NO: 69823 - DNA, 76 bp, Mus musculus
gtccttaccagcacccaggctgcctgtggccagtgctttgtcagcctcagacagcctgtcactgtcctctgaggac

SEQ ID NO: 69824 - DNA, 83 bp, Mus musculus
ggcaaacagaagactgtctccaggcagctaaaaggagggtctcaaagcccaccccatagtgacacagttccttcaacaaggcc

SEQ ID NO: 69825 - DNA, 85 bp, Mus musculus
ggggagaagaattttgggtttcaggcatggctggatccggagcatcaagaatgttttccactgtctgtctgtctctcattccccc

SEQ ID NO: 69826 - DNA, 79 bp, Mus musculus
caggtggaaaggacaaccgtacttagctcgccatgaagaaccatcagtgtagtccagtgtgtgtgtgtctgtctgtctg

SEQ ID NO: 69827 - DNA, 127 bp, Mus musculus
gtgtatgtgtgcatgtgtgtgcatgtgcctatgtatctttgagtggtatgtgtgtgtatacatgtttttacatatatgtatgtatatacatgtgcatacacgtgtatatacatgcatgtgctatgta

SEQ ID NO: 69828 - DNA, 120 bp, Mus musculus
tatatgggtgcatgtgtgtgtatatgtgtacctgtatgaatgtgtgtgttcatgtatgtttgtgtgcatgtgcatccatatatgtgcatgtgtgcatgtatgcatgcatgtatgtatgtg

SEQ ID NO: 69829 - DNA, 108 bp, Mus musculus
ctacctacctatctatgcatccgtccatccgtccatctgtctgtctgtctaactaccctatcatggctgtaatgatggtgatggctgtggtgattgtgatgatggtgg

SEQ ID NO: 69830 - DNA, 119 bp, Mus musculus
cttggagtgaagtgggtgttcagtagatggtgaatgcatgcatgcatgcatgaatgaatgaatgaatgaatgaatatatgttgttccctctgatgatgaaactggagagaaacctcaag

SEQ ID NO: 69831 - DNA, 99 bp, Mus musculus
cacatattcacatgtgtatgtgtatatatgtatgtatgtatgtgtgtatatcttgtatgtgtatatatgtgtgtatgtatgtgtgcatgtgtatatgtg

SEQ ID NO: 69832 - DNA, 101 bp, Mus musculus
gaagccataggtgggggctagagagagggctcaggggttaagagcactgactgctcttctgaaggtcctgagttcaattctcagcaaccacgtggtggctc

SEQ ID NO: 69833 - DNA, 139 bp, Mus musculus
acatatatgtctgtgtgtatatatatatatatatatatatatatatatatacacacacacacatatgtatacacatttatgtgtgtgtatatatgtatatgtgtgtgtacatagatacatatataaatatatacacata

SEQ ID NO: 69834 - DNA, 88 bp, Mus musculus
gcctgtgactgtcagactgtgagtcccagaggcttaactctttcttggagtcctctgatggcggccgcacagccctgctgtccagtgt

SEQ ID NO: 69835 - DNA, 107 bp, Mus musculus
ctgaagttggcccaaaggctgcatgtggctgactgggcctctgagtaacactgggactcatagataggaacccagctcttccatggtggctggggattcgaactcag

SEQ ID NO: 69836 - DNA, 110 bp, Mus musculus
gctctgtcaggggtgggggggtggactggagagatgggtcaggagttaagagcactgactgctcttccagaggtcctgagttcaattcccagcaaccacatgggcggttc

SEQ ID NO: 69837 - DNA, 137 bp, Mus musculus
tatgtgcatgtgtatatgtgggtgtgcctgtacaagtgtgtgtgtgtgcacatgcctatgtatgtgtgcatgtgcatatgtgggtgtatgttcaccagcatgagtgtgtgcatgtatgtgtgggggggtgtgcacat

SEQ ID NO: 69838 - DNA, 72 bp, Mus musculus
ttcctgtgcaatctctctagctctgtctatctaaaaaaaaagaaagaaagagagagagagagagagagagag

SEQ ID NO: 69839 - DNA, 76 bp, Mus musculus
ccccagtctggtttcttgtgtagcagggcgacttcttccagttggagcctggggtatagtgactagaatggtgggg

SEQ ID NO: 69840 - DNA, 85 bp, Mus musculus
gtgtgtttgtatgtacgtgcgtgtgcacatacatatgtgcatgtgtgtatatgtgtgtgcatgtgcatgtatgtgcattgtgtgc

SEQ ID NO: 69841 - DNA, 125 bp, Mus musculus
ggattcggatcaacaaccgagtgttggccagctgtgtatctgtgggccataattctcaatgtctctgaatctctggggttgcatctcggactagatattttaaggatgaaatggaatcatgggta

SEQ ID NO: 69842 - DNA, 66 bp, Mus musculus
gcaggctgcagaggggcagccttccaggccctgatgttggagagttgactgactctgtgtgtgtgt

SEQ ID NO: 69843 - DNA, 74 bp, Mus musculus
gccactgtggtctaggattgattgccacgccctttgcagagagcagagactcactctgtcagaagtcacagggt

SEQ ID NO: 69844 - DNA, 79 bp, Mus musculus
aagtctgggttcttctgggttctgaagtgagtgtgctcatttgttttcttatgttacagcagaggggggtcattgactt

SEQ ID NO: 69845 - DNA, 74 bp, Mus musculus
agggcaagcgataagatcagaatcacagctcttacatgtgtgctgtctgtctctgtctctctgtctctgcctct

SEQ ID NO: 69846 - DNA, 71 bp, Mus musculus
gcatgtttgtgtgttcatgtgtgtgcatgtgtgtatgtatatgtgcatgtgcatgtgtgtgcttgtcatgt

SEQ ID NO: 69847 - DNA, 65 bp, Mus musculus
tggcctcaccctctctgcctctgtcaagaatgtaggtttgatttggctgggtggtgtgggagcca

SEQ ID NO: 69848 - DNA, 79 bp, Mus musculus
ttgtgtgtctctgtgtgtctgtgtgaggctatatgcaaacatgagtgcagcgcccacagagaccagaagagggcaccag

SEQ ID NO: 69849 - DNA, 97 bp, Mus musculus
tctttatcccatttcgtgtgtatgagtgttttgtctgtgtgtatgtctgtgtaccacatgcatgaactgccctcagaggccagaataggataacaga

SEQ ID NO: 69850 - DNA, 112 bp, Mus musculus
gcctctctctgccccccccctcgtgtgtgtgtgtctatgtgtctctgtgtgtgcctgcgtgtgcacatgcacagctattacctaaagttcatgcacttgcaagagtgtccgc

SEQ ID NO: 69851 - DNA, 73 bp, Mus musculus
ttagagtcactctctgccagtcaggctaccacttgccccaggactgtttcagtggagctcagtgtacttctaa

SEQ ID NO: 69852 - DNA, 86 bp, Mus musculus
ctgacccattgcacaacctgcacagcttcatgtttatttcttcatctgtaaaatgggcttaataatagcagggtgttgtgggccag

SEQ ID NO: 69853 - DNA, 82 bp, Mus musculus
cagagcatgcatatatatatgtatgtatatgtatatgtgtatatatatatatatgtatgtatatatatatgtaaatgttctg

SEQ ID NO: 69854 - DNA, 75 bp, Mus musculus
acccaccctctctgtgactcagtttccttgggcttaaaaaggatatcattgggctggtgagatggctcagtgggt

SEQ ID NO: 69855 - DNA, 70 bp, Mus musculus
ttatgtgtgttttgcctgtatgaatatatgtatgtatgtatgcatgtatgtatgtatgtataccacatgg

SEQ ID NO: 69856 - DNA, 117 bp, Mus musculus
agtgcttcctgatgttaaaaactgaaagtaggggctggagagacagctcagcggttaagagcactgactgctcttccagaggtcctgagttcaattcccagcaatcacatggtgact

SEQ ID NO: 69857 - DNA, 114 bp, Mus musculus
cttgtttcttctccattctaggctaagtatcagagtagattctggggcagataagtttctttatatatttaacaactgcctgacttctctgaacttcttgattatgtatacaag

SEQ ID NO: 69858 - DNA, 85 bp, Mus musculus
ttatccacagagagagttgacagatgggagagaaaccttccttcctattcctcctgccttagttacttctctattactggggtaa

SEQ ID NO: 69859 - DNA, 79 bp, Mus musculus
agaacatctctcatgtttttcagaactgatcaatattttgattttattcttgtcagtgctgagtgacctgacagggtct

SEQ ID NO: 69860 - DNA, 119 bp, Mus musculus
aattatatatatgtgtgtatatatatatgtgtgtgtatattatacattatatgtatataatgtatatatatatatatatatatatatatatacacacacacacacacatatacataatt

SEQ ID NO: 69861 - DNA, 70 bp, Mus musculus
aggcagtgagaagtgtgaaccccctgcttttaccaactgaaccagcacctggcgctctctctctctgtct

SEQ ID NO: 69862 - DNA, 118 bp, Mus musculus
gtttgtgccttactactgttatatactgataatatatgtgtgtgtgtgtgtgtgtatatatatatatatacatacatatatgtgtgtatgtatgtatgtgtatatatgtatatatgta

SEQ ID NO: 69863 - DNA, 65 bp, Mus musculus
gtgtgcatgtatgtatgtatatgtatgtgtgtatatatgtgtacatatgctacatacatgcatgc

SEQ ID NO: 69864 - DNA, 121 bp, Mus musculus
gtgtgctgtatgtatggtgtgtgtgtgctatgcatgtgtaatgtgtgggatgtgtgtgtctctgtgtgtctgtatatgtatgtgtctatttatgtgtgtatgtatgtttgtgttatgcatg

SEQ ID NO: 69865 - DNA, 65 bp, Mus musculus
ggacaggaagagagatgtgagagacctgagcaccctgtttaccctttcaaggccctacttcctcc

SEQ ID NO: 69866 - DNA, 72 bp, Mus musculus
tgtgtgcatatgtgtgcacttgtgtatatgcatgtatatgtgtgtgcacttgtgtctgtgtgtatgtccata

SEQ ID NO: 69867 - DNA, 128 bp, Mus musculus
tatgtacttgtatgtaatgtgtgcatgtgtgtgtaagtgcatgcacatatgtatgtgtgcatgtgcatatatatgtgtgtgcattgtatgtgtatgcatgtgtgttgcagtatgtgtgtgtgcatgtg

SEQ ID NO: 69868 - DNA, 69 bp, Mus musculus
acgtctgtgtgtgcatgtgtgtatatgtatgtatgtgtatatatgtgtatatatgtgtgtgtgcagtgt

SEQ ID NO: 69869 - DNA, 90 bp, Mus musculus
atatatgtgtgtaagtacttgtgtatacatggatgtgcatgtgtgcaaatgcatgtgcatatgtatgtgtgcatgtgcaaagatgtgtgt

SEQ ID NO: 69870 - DNA, 107 bp, Mus musculus
cccatgggtccccaaggttattggatagagcctcacatgtggctctctctgactggctgcagacctcggatgggaaccagctgtcctgggaggagaaagcatgttgg

SEQ ID NO: 69871 - DNA, 83 bp, Mus musculus
cagcaaagttgtctgaacctgacaagttctcagtaggaaaagtctcaccaatgagcaactaggtagtgtagaatcttaggctg

SEQ ID NO: 69872 - DNA, 100 bp, Mus musculus
gtatgctacacaggctggagagatggctccgcggtcaagagcactgactgctcttccagaggtcctgagttcaatttccagcaaccacatggtggctcac

SEQ ID NO: 69873 - DNA, 111 bp, Mus musculus
ctgagtttgcccagccagtagtatctgtcagggatgtagcgcagagtctcactcactatgatgtgggttcggcgccagaagcttcctgtagcaccggctactgggactcag

SEQ ID NO: 69874 - DNA, 99 bp, Mus musculus
gtggggtaagaatcttgaaattgggctggagagatggttctgcagttaagagcactgactgctcttccagaggtcctgagttcaaattctagcaaccac

SEQ ID NO: 69875 - DNA, 68 bp, Mus musculus
ttgttttcttggtcttttaaggagacttggtcataggtgcctggctctgtctctggatcagaagataa

SEQ ID NO: 69876 - DNA, 81 bp, Mus musculus
cttagagaagtctgtcaggtcaccaggcagtgcagggaccgcctgtcgccttccctgggcacctgactcctgccctctgag

SEQ ID NO: 69877 - DNA, 72 bp, Mus musculus
gggcaaggctgagggagagtgcccaggtccctgcggattgagggttacccactctctgtgactccggagccc

SEQ ID NO: 69878 - DNA, 131 bp, Mus musculus
ggccctgttggagaaagtgtgtcactgagtgtggggtgggtttcaaaggcccaagccaacctcagtcactctctctgggctggagagatggctcagaggtcctgagttcaattcccagcaacaacatggtg

SEQ ID NO: 69879 - DNA, 116 bp, Mus musculus
cctctggtccccaggcccgggcagcccgttctgttttgctgttctgagccttcaaggtcactgaagacacagagcccacccagcagccatggtccggagctgggcagatcacaagg

SEQ ID NO: 69880 - DNA, 108 bp, Mus musculus
ggctccaccttgcatacagagtctcacaaaactgacctttggtggtccaattggggatcgttccctctgtgcctcagtttccacatctgtaccaagccctgaaaagcc

SEQ ID NO: 69881 - DNA, 91 bp, Mus musculus
agacaagtagatatggcagcctgcctgtaaccccagcaatgggcgacactgtcagggaagtcccagagcaggctgcctagcctagttgact

SEQ ID NO: 69882 - DNA, 76 bp, Mus musculus
gtatatgtatgtatatgtacacacacatatatatacatacatatatatgtatgtgtgtatatctatatctatctat

SEQ ID NO: 69883 - DNA, 69 bp, Mus musculus
ggatacgtggaggctagaggacaagtctttggagttgcttctcttgactgtactttggttaccaaagcc

SEQ ID NO: 69884 - DNA, 75 bp, Mus musculus
ctcacacatgcacacgaatgtgaatgtacacacagtcacaaacagacacactcacatgaaagcatgtgcacagag

SEQ ID NO: 69885 - DNA, 77 bp, Mus musculus
gtaaggaaagcctcacttatggcttgggggttggacagctctctgcatctccatgtggttgggtggagcttcctaac

SEQ ID NO: 69886 - DNA, 57 bp, Mus musculus
atgcatgtatgtatctatgtatgcatctatctatgtatgcatgatatatatatgtat

SEQ ID NO: 69887 - DNA, 147 bp, Mus musculus
tgcttcctggattagggtgttgtgtgtgtcagataggaccaccatgtctgtctgtctgtctatctgtctgtctgtctgcctgcctgtctttagcatcagggtggaagacctgagcaaaaaggccaggacttttctctttctatccag

SEQ ID NO: 69888 - DNA, 157 bp, Mus musculus
gggatcaaagacatgtggcactatcacttagctttaaaaattcttattaaagattaatttttgtttttatctgtctgtctgtctgtctgtccctatgtatgccaagtgagggcagttgaggtcagaagatctcctgctgctggagtatacaaagagg

SEQ ID NO: 69889 - DNA, 102 bp, Mus musculus
tatgtgtgtatttgtatgtatgtgtacatgtgtacatatgtgtatatgtatatatatgtgtgtgcatgtgtgtttacatgtgtgtatatctgtgtgcatgtg

SEQ ID NO: 69890 - DNA, 126 bp, Mus musculus
gagcacgtgtgtgttcatgaacgtgtgtgcaggcgtgcatatgtgcgtgtgtctgtgtgcacacatgtgtgtgtgtgcatgtgtgtgtctgtgtgtacatgcatgtgtgtgtgtgtgcgtgtgtgt

SEQ ID NO: 69891 - DNA, 77 bp, Mus musculus
cataagcatacctagagagtgtggtcaggtagctgtggatatgtgcgtctgtctgtccatctgtctatctagctttg

SEQ ID NO: 69892 - DNA, 90 bp, Mus musculus
gctccacttggatgggaccctctttgccacactccagctttatactcctctgccatttgtaagagttaggtgcccacaacacaagggagc

SEQ ID NO: 69893 - DNA, 111 bp, Mus musculus
gggccagtaagaagtacatgggttggactagagagatggctcagccgttaagagcactgactgctcttccagaggtcctgagttcaattcacagcaaccacatggtggctc

SEQ ID NO: 69894 - DNA, 89 bp, Mus musculus
ggacctaaggggagagagaagagagtcttggtagtcaggccttgggcactgtgctatctctatctatctatctatctatctatctatct

SEQ ID NO: 69895 - DNA, 98 bp, Mus musculus
ggagtaggagtagcattgtgtgtgcctgtgtgcctgtgtgtacgtgtgtgtgtgtgctggcatgccatggcacaagtatggaggtcaagaaggactct

SEQ ID NO: 69896 - DNA, 79 bp, Mus musculus
ggttcttgggtcattaggagtcacactgtgcctctgtatctttgttttacacacacacacctctgtgacccacagtccc

SEQ ID NO: 69897 - DNA, 77 bp, Mus musculus
gcttctgtctgtctgtctgtcttgatggtcacaccctctgtgacaaggacattgcctggacagaacaggaacacagc

SEQ ID NO: 69898 - DNA, 70 bp, Mus musculus
agggtgtgtgtggctcagtggctgagtgcttactcagcatgcatgaggcctgacttgtagacatcatcct

SEQ ID NO: 69899 - DNA, 61 bp, Mus musculus
cacctctgtgtgtgtgtctgtgcacatgtgtgttgcataggtgttcacatgtatgtgggtg

SEQ ID NO: 69900 - DNA, 129 bp, Mus musculus
gcatcaggcaggccctgccccaggagaggaaaggtccaagtgcaggtccctctgtgcctctgtggctgtgacagagcccagctgagtcccattggccacatgacaaggagacagggaagacaggctgct

SEQ ID NO: 69901 - DNA, 95 bp, Mus musculus
gttagcaagaaaagtgtgtcgtctaaacatcattctgtgtctgtgtgtgtgcacatgaacacatgagtttagacatgtatgtgtgttcccctgac

SEQ ID NO: 69902 - DNA, 75 bp, Mus musculus
cagacagacagacagacagacagacaatggggtcttgcttggaagacttcacggggtctgtttgtaagtcccttg

SEQ ID NO: 69903 - DNA, 67 bp, Mus musculus
gtgggcacactttggaatcccagccctgggtttgatccccatgactgtcactcactgtgtagcctcc

SEQ ID NO: 69904 - DNA, 68 bp, Mus musculus
cctaggtcacagtgcagtgtgagagagcccacagggagctgtgggaggtttatttctgtcgggttagg

SEQ ID NO: 69905 - DNA, 68 bp, Mus musculus
gggcagcttctggctgatgcctgcctgcctgcctgcctgcaggagggacaaagcagggaagattgttc

SEQ ID NO: 69906 - DNA, 62 bp, Mus musculus
gtgcatgtgaatggcagtcaatatatgtgtgttcatatgaatggctgtcagtgtatttgcat

SEQ ID NO: 69907 - DNA, 73 bp, Mus musculus
ctgagaaccaggtgcttgagtggctagcaggcagcttaggtctgcctcactcactcactaccttagggattgg

SEQ ID NO: 69908 - DNA, 96 bp, Mus musculus
aagttcaatgggtctggagagattgctcagtagttaagagcactgactgctcttccagaggacctgggtttgatttctagcaaccacatggaggct

SEQ ID NO: 69909 - DNA, 57 bp, Mus musculus
tgaggacatgagtgacagcgtttttattgggtcgctgtctgtctccctgtctcctca

SEQ ID NO: 69910 - DNA, 82 bp, Mus musculus
cgctgagccactccctcagtgtctgcgagctgccctggtagaagaggtcggtggcagagcagctctgggagtggatgcagtg

SEQ ID NO: 69911 - DNA, 97 bp, Mus musculus
tctcagagcacagtgacagacagacagacagacagacagggttctaaagttaagtttatatccatccggttaattgagctgttttagctttctgaga

SEQ ID NO: 69912 - DNA, 103 bp, Mus musculus
tgttctcagacctttagaagttgcattggggcctggagagatggcttggcagttaagagcactgagtgctcttccagaggtcctgagttcaattcccagcaac

SEQ ID NO: 69913 - DNA, 108 bp, Mus musculus
tgtaagaccctataactggggctggagagatggctcaatggttaagagcactgactgctcttccaaaggtcctgagttcaaattccagcaaccacatggtggctcaca

SEQ ID NO: 69914 - DNA, 67 bp, Mus musculus
gtccctgtgtctctgtgagtgagatatcccagacataaggctttggggtcttacaagagtaagtgat

SEQ ID NO: 69915 - DNA, 111 bp, Mus musculus
gctgtacatggtgaagtgtccagaggcagatcttggttggtgagctttaattgacttaatgtacttcatattacaaagaacgaaggcctatcgatctcccccttgcagcac

SEQ ID NO: 69916 - DNA, 79 bp, Mus musculus
gtctgtctctggcactgtctgataaccttctcagctcttgggttggtggaaggtagcgatcttcacattccagacggat

SEQ ID NO: 69917 - DNA, 62 bp, Mus musculus
gtgtatctatctatctatctatctatctatctatagatagataggtagacagacagacagac

SEQ ID NO: 69918 - DNA, 98 bp, Mus musculus
ttgctaagtacagttctacccctaaactctcagtccctgtctgtctgttgttttaatggaagcaaggtctcaggtcagagatgtagttctgttggtga

SEQ ID NO: 69919 - DNA, 58 bp, Mus musculus
gatggtgcttcaagaagacgaggcagagacatctctgctgtctgtctctggcactgtc

SEQ ID NO: 69920 - DNA, 110 bp, Mus musculus
gctttagatactacgttagcttatataacttttaaaaatgacttctttgtttttattttatgtgcattgatgttttccctgtaagtatgtaagtatgtaagtatgtatgt

SEQ ID NO: 69921 - DNA, 85 bp, Mus musculus
acataatggggatcacacacacagagtcactgagcctactccggcctccagttctccttgtagctgtgtggatttgaacttatgt

SEQ ID NO: 69922 - DNA, 57 bp, Mus musculus
cacacagctacaaggagaactggaggccggagtaggctcagtgactctgtgtgtgtg

SEQ ID NO: 69923 - DNA, 96 bp, Mus musculus
ctactctagcagaaaggaaaggtgttggcttagtgttgtcactctgtcccacagtcacgagaatacctttttgccttatgttttctgttatcttag

SEQ ID NO: 69924 - DNA, 122 bp, Mus musculus
ctgggtttgtgaccaatggtatacttcaggtagtaggttctcatgtctttttttttttttttttttttttggttttacaagacagggtttgcctgtgtagccttggctgtcctggaactcac

SEQ ID NO: 69925 - DNA, 72 bp, Mus musculus
gtgaactccagagacaggcatggaagcttccagaaacccctcattgcttcacacactgtctctccccaaagc

SEQ ID NO: 69926 - DNA, 67 bp, Mus musculus
gactgtgcctgtcactctctgccgacagtgtcctcttggtttcctgcagggagttaacacccacagc

SEQ ID NO: 69927 - DNA, 78 bp, Mus musculus
agggcaggggctggagagatagctcagcagttaagagcactgactgctcttccagaggtcctgagttcaaatccgagc

SEQ ID NO: 69928 - DNA, 90 bp, Mus musculus
gaatgaggggcagccagctccgggttagtgaattttgcttctgtctgtcaaagtgatcctctacctctcagagcctctgtttcctcatcc

SEQ ID NO: 69929 - DNA, 89 bp, Mus musculus
aggcggagggttgagttccgggcctggaggtactgccgatttggagtctgcagtgagagacctcagggagtctgtctgtctgtctgtct

SEQ ID NO: 69930 - DNA, 94 bp, Mus musculus
ggacaagtccatcctttcacacacacctgcagcttgctggctgctctcattcccagctccgttgtgtctgtctgtgaatggggaaactgagtcc

SEQ ID NO: 69931 - DNA, 101 bp, Mus musculus
gatatccagtcttggtgctagagaaatggctcagagcttaagggcgctgtctgctcttccagaggtcctgagttcaagtcccagcaaccacttggtggctc

SEQ ID NO: 69932 - DNA, 92 bp, Mus musculus
gcagatcatttcccaggtctggtgtcattatatcgggggaggagggggactctgccacactcacttccttgaactcctggatctgggtctgc

SEQ ID NO: 69933 - DNA, 72 bp, Mus musculus
ctgtcctctgtgtgtgtgtgtgtgtgtgtatgtatgtgtgagacagacagacagacagacaacagacaccag

SEQ ID NO: 69934 - DNA, 62 bp, Mus musculus
gggtttctctgtgtaactcagtgtatagagcaggctggccttgaactcacagagatctaccc

SEQ ID NO: 69935 - DNA, 96 bp, Mus musculus
gtcagtgttgaccaacaaggaagacaggagccggggactagctggccactagtttctcacagtcacactggcattcctgacttctggcagtatgac

SEQ ID NO: 69936 - DNA, 107 bp, Mus musculus
tgctgtcctgaattgaacatttccatgtgaggctgtgtcctgactgctgtttctctccacagtgagagggtccaagccaggcaagaatgtccagctccaggagaacg

SEQ ID NO: 69937 - DNA, 66 bp, Mus musculus
gtgttgtctgcctgtgtgtctgtgtgccgcgggtgtgcggtacctatggaggccggaagaggacac

SEQ ID NO: 69938 - DNA, 120 bp, Mus musculus
cctactgcctgcgagtacctgattctacatgccttagaggtgggacactgcctctgtgtctctgtatccttctctgccctatggcattcagaatggcactacctcccaggaatgctgagg

SEQ ID NO: 69939 - DNA, 120 bp, Mus musculus
gtgctcagggtcaagtcatagcaggggggctggagagatggctcagaggtctaagagcactgactgctcttccagaggtcctgagttcaattcccagcaaccctacggtggctcacaacc

SEQ ID NO: 69940 - DNA, 80 bp, Mus musculus
tatgtatatatgtatgtgtgtatgtatatatgcgcgtatgtatgtgtgtgtatgtatgtatacatgtatgtatatatata

SEQ ID NO: 69941 - DNA, 83 bp, Mus musculus
agtggcttgactggagagcccactttgagtgtttgccatgacttaactggctttttcctcatgactctctctgtgaggctatt

SEQ ID NO: 69942 - DNA, 107 bp, Mus musculus
acctttgttacttaaaccttatttgtatgtatgtatgtatgtgcatgtatgtatgtatgtatatatttatgtatgtaagtgcatgcccaaggaggttagaagagggt

SEQ ID NO: 69943 - DNA, 79 bp, Mus musculus
atgtgtatatgtgtatgtatatatatgtgtgtgtatatagatatgtatatatgtgtgtgtgtatgtatatatatacaca

SEQ ID NO: 69944 - DNA, 84 bp, Mus musculus
gagtagcgagagctcatatggcctctgtggtgagtgagcacacctggaacacaaatcacctcttagaagatgctctcacttctc

SEQ ID NO: 69945 - DNA, 115 bp, Mus musculus
cagaaagctatccttggggtctggagagatggctcagaggttaagagctctgactgctcttcctgaggtcctgagttcaattcccaactaccacatgatggctcacaaccatctg

SEQ ID NO: 69946 - DNA, 80 bp, Mus musculus
gcacagcgctctgacactcacagccactgttggtgtgaagagacaccgtgagcatggcaagtgtttaattgggggcttgc

SEQ ID NO: 69947 - DNA, 88 bp, Mus musculus
cagccctcctgcctgcatctcagtgtctttctctgtgcctctccagtagcataaagaaaataattgtatgcttttaacattagagctg

SEQ ID NO: 69948 - DNA, 80 bp, Mus musculus
gctgactggattggggctggagagatggctcagctgttaatgcgctgactgctcttccagaggtcctgagttcagcaagc

SEQ ID NO: 69949 - DNA, 117 bp, Mus musculus
ttttctacatgtgtgtttgtgtagcacatgcatgtgtgtgtgtctatatgtacatatacatgtatgtatgtatgtatgtatgtatgtatgtgcctggtaccctcagaagttaggaga

SEQ ID NO: 69950 - DNA, 74 bp, Mus musculus
cttcttttgtggaatatattgctatgtgttggaaaactgagacatagtagaacaatttattgtcacagataaag

SEQ ID NO: 69951 - DNA, 108 bp, Mus musculus
ctgttccaggttggcatagctagagggtagactgtgagagagtatttagtgaggagactgagcagatcttgtttttagatactatctagtgtgcaagaatgtgaggag

SEQ ID NO: 69952 - DNA, 116 bp, Mus musculus
ttgtggtacaggtctttaatctcagtactgagggaggcagagtctctctgtgagtttgaagccagcctggtctacagagtgagttctaggccagccaaggctacatagtgagaccc

SEQ ID NO: 69953 - DNA, 93 bp, Mus musculus
ggttggagagatgctttggcggttaagagtgctgactgctcttccagagaacttgggttcagttcccagcaacctacatggcagctcacaacc

SEQ ID NO: 69954 - DNA, 114 bp, Mus musculus
gagtttctcttactgtgtgtgtatatgtatgtgtgtgtgtgtatattatatatctatatattataagattatatatatatacacacacacacacacacacacacacacagtctc

SEQ ID NO: 69955 - DNA, 81 bp, Mus musculus
cgctgcaaaatgagttgtctgcagattgctatctggagggaatccttccccgaaagcctgttaatgttaaccgtagtagcg

SEQ ID NO: 69956 - DNA, 93 bp, Mus musculus
gctacgcaatgagttcaaggacaggctggagagatggctcagtggttaagagcactgactgctcttccgaaggtcctgagttcaaatcccagc

SEQ ID NO: 69957 - DNA, 111 bp, Mus musculus
cttatgtcctcccacttctggcaaaacttactcaacaaagttttcaagaatatattatttaactttttgaaatctggtaggtgaaattatccccatttgggagacaccaag

SEQ ID NO: 69958 - DNA, 70 bp, Mus musculus
ggtggctcaccagacttccgtctatcaccttggtgtgtgaacagagtgtagacggaagacagatgccact

SEQ ID NO: 69959 - DNA, 61 bp, Mus musculus
tatatatatatatatatatatatgtatgttttgcctacatgtatgtatgtgtgtatatcta

SEQ ID NO: 69960 - DNA, 68 bp, Mus musculus
agtatgtgtgtgtgtgtctgtctatgtatgtatgtgcatgggacccaaggacttcaccacactgaact

SEQ ID NO: 69961 - DNA, 112 bp, Mus musculus
ggaaacctcttctcccactcccaactctaagacccactcactggctctgtggctgggcatggcttcacagcccagtgggaaaaattgttaaggatatggctgagtcttttcc

SEQ ID NO: 69962 - DNA, 73 bp, Mus musculus
tctctgtggtatgtatatgtatgtgcacacatatgagtctgagtgtgtatgtctgtctgtctgcctgtggagg

SEQ ID NO: 69963 - DNA, 74 bp, Mus musculus
tgagagctttccagagggaagcaggagttcagcccatagcgctgggtatctgtctgtctgtctgggattttccg

SEQ ID NO: 69964 - DNA, 64 bp, Mus musculus
cagagacagggctggagagatggtggttgagagcactgactgctcttccagaggtcctgagttc

SEQ ID NO: 69965 - DNA, 89 bp, Mus musculus
gggggaaaaagaaaagcacttgggctggcgagatggctcagcaattaagagtgctgactgctcttccagaggtcctgagttcaattccc

SEQ ID NO: 69966 - DNA, 111 bp, Mus musculus
atggaaagtgtgctttatcttgggagttgtgctcaagcattagcttgctgtctgtagaatgagtgcttcggagcctgacatgaaaccatctcaagagcccacaggtcccat

SEQ ID NO: 69967 - DNA, 86 bp, Mus musculus
gttttgtttatatatgtatatgtatgtgtatgtacacatacatatattcttatatatgtgtatatatatgcttatatataaatata

SEQ ID NO: 69968 - DNA, 100 bp, Mus musculus
cttagaaacttcagttgggggggcagtgctggtgagatggctccatggttaagagcactgactgctcttccagaggtcctgagttcaattcccagcaacc

SEQ ID NO: 69969 - DNA, 79 bp, Mus musculus
cactgcacggagagaccccacttggctgatctgctcatcaagcacggtattaggtcattgtcactctctggctgttgtg

SEQ ID NO: 69970 - DNA, 72 bp, Mus musculus
acacaaatatgcatgaatgtatgtgtgtgtgtatatatatatatacacacacgtacatacatatgtatgtgt

SEQ ID NO: 69971 - DNA, 110 bp, Mus musculus
gcatgtgtgtatatgcatcacacgtgtttctgcctgtctatgtgtgcacacgtgtttctgcatgtctatgtgtgcacagtgtttctgcatgtctgtgtgtgcacaagtgt

SEQ ID NO: 69972 - DNA, 106 bp, Mus musculus
gtcatgtgagtgtgcaaaagaggacgtccggagctgtcactctctgtcttattcccttgagacagggtggccaacagcttcagacacccaacaccctctcatatgc

SEQ ID NO: 69973 - DNA, 116 bp, Mus musculus
acatgtggatagaggctagtggacactgggtgtcttcttcagtcactctctgcttcatgtttggagacagggtctctcctgaacctggagttcactgttgcagctacattagatgt

SEQ ID NO: 69974 - DNA, 76 bp, Mus musculus
gtcaggcagtgtctctcagtgtggcttcgggacagcttgagaagagctcagaagacaaagcagaggagctgctgat

SEQ ID NO: 69975 - DNA, 105 bp, Mus musculus
aggttgaaaactcatctctgtggcttggtttactatgatgatataatttataatatatgttataattattataaaattaagaatattgtgcatgttctttgacct

SEQ ID NO: 69976 - DNA, 85 bp, Mus musculus
tgtatctatgtaagtatgtatgtatgtatgtacgtatgtacctacctacctacctacctacctgctacagtcttgctatggaaca

SEQ ID NO: 69977 - DNA, 87 bp, Mus musculus
tatgtatgtatttttgtaagtatatatgtacgtatgtatgtatgtatatatgtacgtatgtatgtatgtatgtatgtatgtatgtat

SEQ ID NO: 69978 - DNA, 96 bp, Mus musculus
gatcagccttagtccatggtggtctgataggatgcatgggacaatttcaatatttttgtatctgttgaggcctattttgtgacaaattatatggtc

SEQ ID NO: 69979 - DNA, 117 bp, Mus musculus
ggaattaaaggcacataccaccattcctagcttcagtatagttctttaagcttgtttaccaaatgcagttgagaactgttaggcttggggaaggggaattgtgatcaggacagtttc

SEQ ID NO: 69980 - DNA, 80 bp, Mus musculus
tagtaccagcacccaagaggcagaggcaggcagatctctaatttgaggccttgctgtctgtctgtctgtctgtctgtcta

SEQ ID NO: 69981 - DNA, 60 bp, Mus musculus
catgtcccactgtcccactgtctgatcccgaagggcttcaaacacaagacttggcacgtg

SEQ ID NO: 69982 - DNA, 115 bp, Mus musculus
cctgccgagaccaagatgggtgtgacttcccgggtggtccccacacaacccaacctggagtcactcaccctcacactcaccttcatcaggtctgtgcaggagttgaggatcctag

SEQ ID NO: 69983 - DNA, 83 bp, Mus musculus
tggtccagagtcctgaggaagcacaggacatgtggcaagaaacagtgccacatgcacctgtgtgggtctcacgctctgtctca

SEQ ID NO: 69984 - DNA, 122 bp, Mus musculus
catatccatatatctatatctatatatatatatgtgtatatatctatatctatctatctatatgtatatatatgtgtgtgtatatatctatatgtgtgtgtgtatgtgtatatatatatata

SEQ ID NO: 69985 - DNA, 86 bp, Mus musculus
agcctgcctgtctcactccttctctctgccctgaccctacttggccctggctccctttggaaaggcagatgctgactaatcaggct

SEQ ID NO: 69986 - DNA, 81 bp, Mus musculus
ctattgtagtgagaaacttttttttttttggagacagggtttctctgtgtaaccctggctatccttgaactcactctctag

SEQ ID NO: 69987 - DNA, 58 bp, Mus musculus
ctacccagaggctgttgatgggagggttcacacagcctctctctcagtccttgggtag

SEQ ID NO: 69988 - DNA, 98 bp, Mus musculus
tggagctcactatttttggctcagtggctgaacagtgagtgcccaggagcttcttgtatccacccacttctccagcactgctgcatgccattgctccg

SEQ ID NO: 69989 - DNA, 80 bp, Mus musculus
tcccctcagctctctgtgcctcactctccccatctgtgagatggggcagtatcagggtttacagtaagtccttgtggaga

SEQ ID NO: 69990 - DNA, 104 bp, Mus musculus
tgtatgtttgactgtgtttgcatgttgtatgtgtgtctatgtatatatgtttatgtgtgaatgtgtgtatatatatgtactttccaagacagtctctgcatata

SEQ ID NO: 69991 - DNA, 100 bp, Mus musculus
gagaatcctttcagtgcagatcggccagtgtgaagtgagtgtgcaccgaacagcacgattcagattagccagttcctgcgatgttgaaatagtgattttt

SEQ ID NO: 69992 - DNA, 87 bp, Mus musculus
tctatgtatctcttctttattctgtgtgcacacatgatgtctgtgtgtcacagtgtacacacagaggtcagaggacaactctgtaga

SEQ ID NO: 69993 - DNA, 103 bp, Mus musculus
cagtgcagtggacatttacaaggaaagatgtgtggacaggaggtttactgtgagactcactgtgacaccacagcttcctcgatgaaatgttttctatgctttg

SEQ ID NO: 69994 - DNA, 95 bp, Mus musculus
gcatagaaaacatttcatcgaggaagctgtggtgtcacagtgagtctcacagtaaacctcctgtccacacatctttccttgtaaatgtccactgc

SEQ ID NO: 69995 - DNA, 95 bp, Mus musculus
catatatgtgtgtgtgtgtgtgtgtatacacataaacaatatatagtatatatatatatattacgtatatatattacacatatacattatatatg

SEQ ID NO: 69996 - DNA, 64 bp, Mus musculus
gggggatgggggggaagagatagggagggaggcctaacctctggactctgactctctgtcttac

SEQ ID NO: 69997 - DNA, 75 bp, Mus musculus
tctgtgcttgagtctgtgtctgcgtccctcgtttctctccccctttatacactgacacaggcactctcagtcaga

SEQ ID NO: 69998 - DNA, 90 bp, Mus musculus
tcttaaaaataaactcagagggctagagagatggctcagtgactaagggtcctgactgctcttccagaggtcctgagttcaattcccaga

SEQ ID NO: 69999 - DNA, 111 bp, Mus musculus
gccatcagtgctgaactaggcctctgtgaacagcccagatcagtcaggctcagttcactatctctgagtggctggtttggttttttttctccccagaccatagataagcat

SEQ ID NO: 70000 - DNA, 97 bp, Mus musculus
ggctgattcagaccttgctgccactgggaatgagaccacctggggtggagccttccgacctagctggttctattgttctgttacctgccgctcttct

SEQ ID NO: 70001 - DNA, 81 bp, Mus musculus
tctttttttttctttgttttttaagtttggcatccttatgagtatagaggcagctaagtagagacagagcagagactgaga

SEQ ID NO: 70002 - DNA, 74 bp, Mus musculus
tgaaaggaccgtcaggaagccctctgtgggcggtgttccagcccatgtgctctgagtctctgtctctcctttca

SEQ ID NO: 70003 - DNA, 121 bp, Mus musculus
tgtgtatatatatatataatatacatatatacacatatatgtgtgtgtatgtatatatatgtgtatatgtacacaatatacatatgtaatgtgtatgtatatacatatatatatgtataca

SEQ ID NO: 70004 - DNA, 69 bp, Mus musculus
ggttagagagggcaagttcaggggtgtgatgggccccaaggcctgtctgtctgtgtctcccacaagacc

SEQ ID NO: 70005 - DNA, 60 bp, Mus musculus
agtctgactagttagctggagtgagtctagctgactgactgactgactgactgactgact

SEQ ID NO: 70006 - DNA, 84 bp, Mus musculus
ggcctggtgtggtacgagccttcaatcccagcactcgggaagcagaggcaggtggatctctgagagttcaaggccaacctggtc

SEQ ID NO: 70007 - DNA, 63 bp, Mus musculus
agccttgctctgcctctgtctctgacaccctgatgggggaagggagggggggtgacaggggct

SEQ ID NO: 70008 - DNA, 109 bp, Mus musculus
atgtgtatatgcataaaaaagtgcacatgaatatatatgtgagtatgtgtatgtacgtatgtatatatgtatgttgtgtatgtgcatgtatgcatgtgtgtgtggtgtg

SEQ ID NO: 70009 - DNA, 69 bp, Mus musculus
tgtgtctgtcactgactggcaagcggcgccatagaacaagttgcctcagatcccagtgaccgagatata

SEQ ID NO: 70010 - DNA, 57 bp, Mus musculus
gtcaatttgacatagttagaatctcctgtgaagagactctcactgtgtgaaattgtc

SEQ ID NO: 70011 - DNA, 64 bp, Mus musculus
accacagagtcacactctgtttctacaaagtaatttctaaagggtagagaggtggctcagtggt

SEQ ID NO: 70012 - DNA, 86 bp, Mus musculus
gagatgctcagtgttgggggctgagttgggacagggattcatcagcacctgagggcctctctcttgctctcagtgtccttgctggg

SEQ ID NO: 70013 - DNA, 87 bp, Mus musculus
gtctccatctgcgttcatatcaggtccaagtgctacacttggggaagatggcttcactgaagtgtgtcatgactgtgtgctggggac

SEQ ID NO: 70014 - DNA, 99 bp, Mus musculus
tggttttggaaactggttctaggcagggttttttggtaatattgggttgaagaggttctaagagtctccctctgtgtctgcaggcagaattttcctcca

SEQ ID NO: 70015 - DNA, 69 bp, Mus musculus
atgtgcatgtgtgcatacatatctgtgtgtatgtggcacagacagatgcatgtgagctcacatgcacat

SEQ ID NO: 70016 - DNA, 82 bp, Mus musculus
tgcagcagtgaacatgctgagcagatggcagagagcacacagtggagtcgtcttggagcagtcatgatgtcgcaatcctgta

SEQ ID NO: 70017 - DNA, 70 bp, Mus musculus
catgatgacttatacatacatatatatatgtacatatatatatatgtgtgtatgtatgcacacccacatg

SEQ ID NO: 70018 - DNA, 69 bp, Mus musculus
acatatatatatatgtacatatatatatgtatgtataagtcatcatgtatgtgtgcatatgtgtggtgt

SEQ ID NO: 70019 - DNA, 81 bp, Mus musculus
caatgagttaagtgtgtgtggccactgtgatgtctgtctgtctgtcacaggggccagagctcaaggcagtctaactcaatg

SEQ ID NO: 70020 - DNA, 71 bp, Mus musculus
gacagagagcaacctggagtcaggggcaggctgggaacctcacagtctggctctgtggctccatgtctgtc

SEQ ID NO: 70021 - DNA, 101 bp, Mus musculus
tgaacttaagtgttgagtgactattttagatttatttttacttacatgtatgtgtatgtatgtatgtatgttcatctatgtgcagttgcccaccgaggtca

SEQ ID NO: 70022 - DNA, 93 bp, Mus musculus
agatggactctgatcctttacaaatgcagtgtgtgctgtttactgctaaaccatctgcccagattttatttgtttttgatactatgtttatct

SEQ ID NO: 70023 - DNA, 118 bp, Mus musculus
gtgatcaggatggtaatatggggatggtgtgatgttgctgctggtgatgataatgatgttgatgctggtggttgtgatgagagtgataaacactgatgttggtgatggtgatgatgat

SEQ ID NO: 70024 - DNA, 77 bp, Mus musculus
gtcctatggggatgtacacactctgtcagactctgagggcacccagcagcatgcaagtggtgcacagtcctatggac

SEQ ID NO: 70025 - DNA, 114 bp, Mus musculus
cttccgttcttcttcacagtgctggttactggttactccatcatgggcacagaactgtcagaggagaatgggagccctgttcctcacacagcttctgggatctgaagaagggag

SEQ ID NO: 70026 - DNA, 109 bp, Mus musculus
gttatttatttgtattttatgggatgaatgttttgtctgcatgtatgtatgtatgtatgtatgtatgtgcaccatgtgcatgcagtacccacagaggccagaagagggc

SEQ ID NO: 70027 - DNA, 115 bp, Mus musculus
attgtctacactttccatactttgatttcttcactgtctgccatggaaccaaagtaactttttattttctgttaagccagggagactgtgaagtcgatgattgtggcaggtcaat

SEQ ID NO: 70028 - DNA, 96 bp, Mus musculus
aaacacaaatcaactatatctgtgtgtattgtatatgtgtatatgtatatgtcatgtgtatatatgagtatgggccgtgtgtgtgagtgtgtgttt

SEQ ID NO: 70029 - DNA, 69 bp, Mus musculus
gtgtgtgtgtgtgcacatgcatgtgtgtgtgctgtgtgtgcatgtgtgtgtatgtgcaaatgcatgtgt

SEQ ID NO: 70030 - DNA, 77 bp, Mus musculus
tatatatgtgtatatatgtaaagtggctggagtttgttaagcttgagtcatccactctgcgtgtgtgtgtgtgtgtg

SEQ ID NO: 70031 - DNA, 116 bp, Mus musculus
tgggaatattgtattattgagtcattttgttgaattttagctatcttctgtctcactcagaatccagccattgaaacattaccaaagtgagttattaaacaaccagaatttattct

SEQ ID NO: 70032 - DNA, 76 bp, Mus musculus
gttcactgaacacaagaaagtcagcagtcagaaaaacctgagagctttaacataggctgcatgtgagttagtggcc

SEQ ID NO: 70033 - DNA, 80 bp, Mus musculus
cctcactggaatcatcagggttctactccatcaggtcccccaagccatcttgatgagtggaaagttgtgaggaagtcagg

SEQ ID NO: 70034 - DNA, 106 bp, Mus musculus
gtatgtatgtatgtatgtatgtatgtatgtatgcttgtgtgtttatgtatgtatgcatatgtgtgtatgtatgtatctatgtatgtatgtatgtatgtatgtgtga

SEQ ID NO: 70035 - DNA, 60 bp, Mus musculus
atgtatatgtgtatttgtgtatgtgtatttttgtatatatgtgtttgtgcatatgtgtgt

SEQ ID NO: 70036 - DNA, 119 bp, Mus musculus
tgttgctccttttattaagttgatacaagctgtcttagttaaggttccatttctgtgaagagacacaatgaccaaggcaactcttataaaagacaatatttaattggatctggctaaca

SEQ ID NO: 70037 - DNA, 121 bp, Mus musculus
tacagcaatgtgtgtgtgtgtttgcatgtgtatatatgtatttatatgtatatatatgtatttaaatgtatatatgtgtgtctatatacgtgtgtatgtgtgtaggcatatatgtatatat

SEQ ID NO: 70038 - DNA, 74 bp, Mus musculus
ggaggccagatatattgaagtaacagacaggtgcttgtgaactgtctcactgtctcatgtgtgtgttgggatcc

SEQ ID NO: 70039 - DNA, 112 bp, Mus musculus
tgtatatgtatgcatgaatatattacacatatatgtacatgtatgtatatatgtatatatacacatgtgtatatttgtatgtatatacatgtatacattacatatatgtgta

SEQ ID NO: 70040 - DNA, 115 bp, Mus musculus
tatgcaatatatgaattatatacatgtacacatatatgtaatgtatacatgtatatacatacaaatatacacatgtgtatatatacatatatacatacatgtacatatatgtgta

SEQ ID NO: 70041 - DNA, 111 bp, Mus musculus
gtgtatctgtatatgcatgcatgaatatattacatatatatgtatatgtatgtatatatgtatatatacacatgtgtatatttgtatgtatatacatgtatatggttgtaa

SEQ ID NO: 70042 - DNA, 67 bp, Mus musculus
accctgggtcaacagagtctgtgtatctgtgtgatcctgctagatcagcagttctcaacctgtgggt

SEQ ID NO: 70043 - DNA, 78 bp, Mus musculus
gattggcctgctgacatgtctgtcaggcattttcttaattgataattaatgtaggagtgtccagatgggcaggtggtc

SEQ ID NO: 70044 - DNA, 106 bp, Mus musculus
gaaatgatgttggtgttgttttctggtacccgaaggacacatcatagtgaggacacacaactgaatgtattttatatgcacttggaagcagtcaccaatacatgac

SEQ ID NO: 70045 - DNA, 73 bp, Mus musculus
tgttcatatcaggtccaagtgctacacttggggaagattgtttcactgaagtgtgtaaggactgtgtgctaca

SEQ ID NO: 70046 - DNA, 69 bp, Mus musculus
gagtctgcttgcttctctgttgctatcattagaaataatgaccaagacagatgatagaaaggagagttc

SEQ ID NO: 70047 - DNA, 113 bp, Mus musculus
tgtgaatcaaggaagtgcttggatcttttctgacccttttttatctgtctcactgacacattggccagtctttgggggtcttgaagagataagagatgtgctttggggctaca

SEQ ID NO: 70048 - DNA, 80 bp, Mus musculus
gtatgtatgtatgtatgtatgtatgtatgtatgtacatatgtatgtatgcatgtatgtatatatgtatgtacatgtgtat

SEQ ID NO: 70049 - DNA, 74 bp, Mus musculus
tatatgcatatgtatatgtgtgtgtataatatactctctctgtgtatgtgtgtatgtgtgtgtgtgtgtgtgtg

SEQ ID NO: 70050 - DNA, 68 bp, Mus musculus
gtttttgtttgtgtgactctgtgtgcatgtgcatgtgactgcagtgcccatggaggccagaggagggc

SEQ ID NO: 70051 - DNA, 64 bp, Mus musculus
atatacaaatatacacacatgtatatttatattgaagtatgtgtgtgtgcatatgtatgtgtat

SEQ ID NO: 70052 - DNA, 77 bp, Mus musculus
tttttttttctaaaaggctttcatttcttccaggaaagagagagagagggagagagagagagagagagagagagaga

SEQ ID NO: 70053 - DNA, 66 bp, Mus musculus
agtggctaatgtagacttgattgatgaatgaatgaatgaatgaatgaatggggctgattggccact

SEQ ID NO: 70054 - DNA, 83 bp, Mus musculus
gagatgcccatcagagactccaggagcagggcatatattgagagctgtgtgtgcacacaagcatcctgtaagaggaggcactc

SEQ ID NO: 70055 - DNA, 67 bp, Mus musculus
tgtatatgatgtatatgtatatgtatatgtataatgtataatgtatatgtatatgtatatgtatgca

SEQ ID NO: 70056 - DNA, 82 bp, Mus musculus
ctggttgtcccagagatgagagagtccacacatagatccaagtgacactatgtgactttactcccaagttatttctgactag

SEQ ID NO: 70057 - DNA, 211 bp, Mus musculus
atgtgcatatgtatatatggtatatgtatataagtatatatgtatgtgtgtatgtatgtgtatatgtatatattcatgtatatatgtatatctgtgtatatgtgtatatgagaatgtgtgtatatgttacacatatacatatgtgtgtatgtgtatatacatgcaattgtatatatgtatatgtctatatgtgtgtgtgcaaagtttgtgt

SEQ ID NO: 70058 - DNA, 85 bp, Mus musculus
gctatctaatgtgtgaatatgtatgtgtttgccactatgtatgtatgtatgtatgtatgtacatatgtatttgtatatgtgaagc

SEQ ID NO: 70059 - DNA, 72 bp, Mus musculus
gtgcatatgcatgtatatgtgcatgtgtatgtgcctatgcatgtatctgtgtatatgtgtgtgtatgtgtgt

SEQ ID NO: 70060 - DNA, 130 bp, Mus musculus
tgtgtgcatatgtatgtgcatatgtgtgtttgtgtgtggatatgcatttgcatgtgtgtgcatatgcatgtatatgtatatgcatgcatgtgtatgtgcatatgcatgtatctgtgtatatgtgtgtatg

SEQ ID NO: 70061 - DNA, 83 bp, Mus musculus
gttagcattggttttcatatgtatagaagtcaggaattcttgatgtcctatggtgttgcatgtgagaattttttaatgtagac

SEQ ID NO: 70062 - DNA, 79 bp, Mus musculus
cagaaagtctgtgacccacacactctgttccaggtggcctcccgaaccaccagacaagtgctgtaggctgtgatttctg

SEQ ID NO: 70063 - DNA, 81 bp, Mus musculus
gaccgagatactggcccatgattgtattatattctttgataaatagaagcttcgagctataattatgcttgctaggcggtt

SEQ ID NO: 70064 - DNA, 94 bp, Mus musculus
taataaaggattggcagaaactacctcgactgtttacatgcataattaatatgcatatgaaaggaaaagaattagggtgtgtgtcttagtatta

SEQ ID NO: 70065 - DNA, 85 bp, Mus musculus; identical to SEQ ID NO: 57439

SEQ ID NO: 70066 - DNA, 132 bp, Mus musculus
gtgtgtgcatatgtgtgcatgtacttgtgtacagtatatatgcatgtacatgcatgtgtgtgtgcatgtgcatgcatgtgtgtgtggtatgtatgcatgtgcatgtgtgtacatgtgcttgtgtacagtata

SEQ ID NO: 70067 - DNA, 92 bp, Mus musculus
gcgcatatgcttgtgtgtggtatgtattcatgtgcatgtatgtatgtgcatgtgcttctgtgtgatatgtatgcatgctcgtgcatgtgtgt

SEQ ID NO: 70068 - DNA, 110 bp, Mus musculus
ctgcaataccaggacttagacctagaggccggaggattggaagctcaaagtcacccacagtgagtgacacagtgaatttcagcccattctgggctaagacccagttacag

SEQ ID NO: 70069 - DNA, 65 bp, Mus musculus
gcatggtgtatgtgtacatacctgtatctatatgtatatatgtatctgtatacatgtcattgtgt

SEQ ID NO: 70070 - DNA, 100 bp, Mus musculus
gcatgtgtgttttgtgtgtatatgcatgtatatacataggtgtatgtatgttagtgtgcatatatatacatatatatgcatgtgtgtatgtaatgtgtat

SEQ ID NO: 70071 - DNA, 69 bp, Mus musculus
catacataggtatatatgtatgtatgtatgtatgtttgtatgtctagtgtatgtgtgttcttgtgtgtg

SEQ ID NO: 70072 - DNA, 99 bp, Mus musculus
ggtgatctatggattgactaccatctcacagactgtctctttatcaggaagaaaaatctatgtcctagatgctaagaagggggatggccaccagatacc

SEQ ID NO: 70073 - DNA, 93 bp, Mus musculus
gtgtatatgctgtgtgtgcgtgcgtgtatgcctctgagcagattatatgtatgtatgtgtgcacgtgtgcatgtgtgtgcatgtgtgtagggc

SEQ ID NO: 70074 - DNA, 85 bp, Mus musculus
ttggtgacctatcagtctctagagtcacctaggggataaatctctgggtgtgtctgtgtgagattttctagactgggttaactga

SEQ ID NO: 70075 - DNA, 83 bp, Mus musculus
ggctagacctggtaagctgtagtgtgctttcttctctgggggccagtggtatgtacataactacacagtccacttgtcttgcc

SEQ ID NO: 70076 - DNA, 61 bp, Mus musculus
agcacactcagtcagactctttgccaggtttctcggctagagtcccatgattgattttgtt

SEQ ID NO: 70077 - DNA, 106 bp, Mus musculus
acacacacatatatgtatatatatatatatgtatatatatatatatatatatttatatttatatgtacatgtacatgtatatgtatatatgtatacattgtgtgta

SEQ ID NO: 70078 - DNA, 62 bp, Mus musculus
ctgctcctatttcttaagaaaaggccaagggcctgaagtttgctgaatggttttctgagcag

SEQ ID NO: 70079 - DNA, 118 bp, Mus musculus
gtatgtatgtatgtatgcatgcatgtgtgcatgtatatgtcccttctcacttgttaggtctgtgtatatatttgtgtatacatgtatatgtacctcagccactatctctctgtgtggg

SEQ ID NO: 70080 - DNA, 73 bp, Mus musculus
tatgtatatgtatatgtatatgtatatgtatatgtatatgtatatgatgtatatgtacatgtacatgtacatg

SEQ ID NO: 70081 - DNA, 97 bp, Mus musculus
gttcagccaacataggacatatgtttgtagatgtgcctgtgccagtctgtgtgtcttacatatgctcatatatgtgtctctatgtggatatatgtac

SEQ ID NO: 70082 - DNA, 110 bp, Mus musculus
ctctcccactgctgggtgaggtcagtatgccagacagagctatttagacaggaggagagtgtgacccactctcacacacttgagtgtggaggacaggggagcatcgcttc

SEQ ID NO: 70083 - DNA, 85 bp, Mus musculus
ggatcgtgaaaatgactgagctggagaaagcttgaaacaaaaaattcattcattccctccctcggtcactcattcattcgttcac

SEQ ID NO: 70084 - DNA, 97 bp, Mus musculus
tccttctctaggttcatccctgactctcaaggttgtatctcacctgtttgtatagggtaatctgtctgtctctgagtcaatgatcaggccaggagga

SEQ ID NO: 70085 - DNA, 140 bp, Mus musculus
tatgtgtatatgtatatatgtgcatatgtgcatatgtgcatatgtgtatatgtgtatatgtgtatttgtatatatgtatatatgtatgtatacatgtatatatgtgtatatgtgtatatgtgtatatgtatatatgtata

SEQ ID NO: 70086 - DNA, 109 bp, Mus musculus
gggtccaagtgaccactcggtagaatttggattctaaattcacagccattttcttcagagagtccagcatctacttcacagtccccatgctgctttcagaggaatgggc

SEQ ID NO: 70087 - DNA, 59 bp, Mus musculus
ctgtgtgtgcaagagtctgtgtgctcacagaagagagagtcaccaggctggctacagag

SEQ ID NO: 70088 - DNA, 95 bp, Mus musculus
tacaatatatgtgtgagtgttatgtatgtgtatatgtatatattacatatatagtgtatacatatataagtatatataaacatatatatacagtg

SEQ ID NO: 70089 - DNA, 119 bp, Mus musculus
aaatttggtcacttgatcaatatccccaccttatgagctgtcagtagagagactggagaaggtatcttacttgattgcctaggaataaagattgattttctaatatcaggcccacgttt

SEQ ID NO: 70090 - DNA, 116 bp, Mus musculus
gtgtgtgtacatgtgtatgtatgcctctgtatgtatgtgtgaatctctgtgtgtgtgtgtgcgcgcgcacattagtgcatgcatgcctttgtgtatgtgtgttgaggtgcacatat

SEQ ID NO: 70091 - DNA, 72 bp, Mus musculus
gtcaagagcagagagaaatgactgaagccacactacctgctgacttttgtgtagttttcacctgttctagac

SEQ ID NO: 70092 - DNA, 69 bp, Mus musculus
agagagagagagagagagagagagagagagaaagaaagactgtctctatatgtgtctctgtgtgtgtct

SEQ ID NO: 70093 - DNA, 69 bp, Mus musculus
ctgtatgtttctatgggcacctgcacacacatgctgatgtgtgtgagctcatgtgtgtctgcatgtcag

SEQ ID NO: 70094 - DNA, 80 bp, Mus musculus
tatctacccatttgtttcatctacgtgtgcacgcacgtgtgtatgtgtgtgcatgttcatgtggagaccagaggtcaata

SEQ ID NO: 70095 - DNA, 111 bp, Mus musculus
ggataaaaggaagattttctgtatcctttgaataatgacttcacaaatatatgcatatttatatttgtgcgcatataaacaaacacatcgatgcataatcttgttacatct

SEQ ID NO: 70096 - DNA, 113 bp, Mus musculus
agaccagctgcggacccttctgataaaactttactgacaaagcaggaagttgagtgtgtctcttcagagttcctgttcagtagtggcttccagcgtctgcaggcgctgtgtct

SEQ ID NO: 70097 - DNA, 89 bp, Mus musculus
tgtttattcttgttgtaacactcacctcacctagggtgatgtgtgtctcattctcactctctggaaaggtgaagcttgcaggataaaca

SEQ ID NO: 70098 - DNA, 81 bp, Mus musculus
ttagttttgtgtatattattctacatctgtgtgtgtgcacagtgtgtatatgcagcaggtgcaggtgctggcacagactag

SEQ ID NO: 70099 - DNA, 124 bp, Mus musculus
gacgctcaggaggggctggactcttgcctctcatcacgagtgtcttcacctctctgggtcagtgtctgaggtggttggcaacctaagagcgatccctgctggctaccattcagcacctccccag

SEQ ID NO: 70100 - DNA, 109 bp, Mus musculus
ggattctttgctgctgtggctggagagatggctcggcggttaagagcactgactgctcttccagaggacctgagttcaattcccagcaaccacatggtggctcacaacc

SEQ ID NO: 70101 - DNA, 78 bp, Mus musculus
ggagactgtgtgtctcactgggtgtagcttgagcacaggagacctcaaagcccacctccatagtgacacacttcctcc

SEQ ID NO: 70102 - DNA, 81 bp, Mus musculus
ctttgcttgcagagagaccccaccacttgtggccacaccctagaaaggatgtgggcattgttctctgaattgtatgtgagg

SEQ ID NO: 70103 - DNA, 72 bp, Mus musculus
gggtagaaggcacgcctggggatgcaggcattgggagtgtgtgcgtgtgtctgtctgtctgtctgtctgtct

SEQ ID NO: 70104 - DNA, 78 bp, Mus musculus
gaagtaaaaggtgggccggagagatggctcattggttaagaccattgactgctcttccagaggtcctgagttcaattc

SEQ ID NO: 70105 - DNA, 159 bp, Mus musculus
catattagttactggtgagactttgtgaatctgtttccttgtctcccagtatgtatgatgtatgtatgtatgtatgtatgtatgtatgtatgtatgtgtatatatatggtatacacacacacatatatggcatatatatggtacatatatatggtatac

SEQ ID NO: 70106 - DNA, 84 bp, Mus musculus
gggagcgctgtcatatttagtgtctgtcagagtcactgggaggtccctggaggccccgggcaggcatgatgtgggcgtgttctc

SEQ ID NO: 70107 - DNA, 98 bp, Mus musculus
gctgcttgtacccaggggcagaggtctagagccgacaacccaggctgcacactgccttctgggtctgtctgtctgtctgtccagccatgagaagtggc

SEQ ID NO: 70108 - DNA, 104 bp, Mus musculus
ttggtgaccccaaggaaatggcccaacaacactgtgagcaatgagccactttggctctggttggacagttttgttttttaaattgaggtgtcaaggggtcccag

SEQ ID NO: 70109 - DNA, 72 bp, Mus musculus
atatgttctgggatatggacaagacactctcgcaccatggcgagcttgtctcactcactctcttgaacctgt

SEQ ID NO: 70110 - DNA, 67 bp, Mus musculus
gctgctcccgattgagcctgtgggggccactgtcatgctcactcccacacacccacagttgagcagc

SEQ ID NO: 70111 - DNA, 88 bp, Mus musculus
tcctgtggctaatgactggagagtgagtgcacaatgaacagcgttgtacattctgtgcacataatttcatcacaaggctttcccagga

SEQ ID NO: 70112 - DNA, 117 bp, Mus musculus
gtatgtgtatatatgtatatatgtgtgtgtttgtgtgcatatatgtatatgtatgtgcatatatgtatatgtgtgtattgtgcatatatgtgtatgtatatatgtatgtatatatgt

SEQ ID NO: 70113 - DNA, 62 bp, Mus musculus
gtctatacatgtgcatgtatgtgtgcatgtttgtatgtgtatatatatgtatgtgtgtgtgc

SEQ ID NO: 70114 - DNA, 105 bp, Mus musculus
cgctaagccatctcacccgcctgcaagccacgtttctaacacaacagttatggattgtaatgtagatatctggtatgtgaccccagtggggatgtgtgtgtctcg

SEQ ID NO: 70115 - DNA, 96 bp, Mus musculus
gactgggaggggtccaggagctttcccaaggggaccaagctaaggtagtgactctgcctctctcggtcccagaaagctttctgtgaccccaccagc

SEQ ID NO: 70116 - DNA, 116 bp, Mus musculus
atggtcaagaagagctgtgaggggctggagagatggcttagtggttaagagtactgactgctcttccagaggtcctgagttcaattcccagcaaccacatggtggctcccaaccat

SEQ ID NO: 70117 - DNA, 92 bp, Mus musculus
tcatctatctgtctgtctgtctatttatctatttatttatctatctatttatttatttagagctttattgtagaaaggcagggggaaagaga

SEQ ID NO: 70118 - DNA, 117 bp, Mus musculus
gcacacacacacacacacacacacacgtgtgtgtgtgtgtgtgtgtgtgtgtgtgtgtatgtatatatacatgtatatatgtatatacacatatgtatgtatatatacatgtataca

SEQ ID NO: 70119 - DNA, 75 bp, Mus musculus
gtggaaccctcagctagtgggaggctgttcccctcacagagtggccttgtctctctctctctgaaggcttttcac

SEQ ID NO: 70120 - DNA, 68 bp, Mus musculus
tctctctgtgtgtgtgtgtgcacgcgtgcgcacgcgcacgtgtgcatgcacctgtgggtacagatagg

SEQ ID NO: 70121 - DNA, 87 bp, Mus musculus
ctgagtgaggcagggcatctagacacacaggttaggttcctgggcaggtggttttggctctgtgtctgtctgtgactgcctctccag

SEQ ID NO: 70122 - DNA, 95 bp, Mus musculus
gtgggccacttaatgaatgagactctgtatctcagaggcagcaaacatgtagttgaccctttaatacagttcttcacattgtggtgaccccccac

SEQ ID NO: 70123 - DNA, 115 bp, Mus musculus
ttctgtgttttacacctgcagattcacccagcacaagatgacagaagactgtgggaagacacctgagctaagcacacacttctcttgtcactgctcggtagctgtgcagaaaaac

SEQ ID NO: 70124 - DNA, 80 bp, Mus musculus
acctgaagttcactgtgtggctgaggctagcttcgaactcttgagctctgtctctgtctccacagtgctcacgctcaggt

SEQ ID NO: 70125 - DNA, 68 bp, Mus musculus
tcatgtctgtctgtctgtctgtgtgaaggggccagatcccctggaactggaattacagacagttgtga

SEQ ID NO: 70126 - DNA, 81 bp, Mus musculus
tctctcagtccctgtgtctgtttgttttatctgtccattcggttggttgttgagggacaaagagagaagagggaggaggga

SEQ ID NO: 70127 - DNA, 120 bp, Mus musculus
cagttatccacaaaatcacacccacagtgtctgtccttactgagatgtacagaaatcacagacattttgtacaactattttaaacacactctgggtctttttatgcatgctccttcactg

SEQ ID NO: 70128 - DNA, 79 bp, Mus musculus
gcttccgtgtctcatcagctgcggcacctgaagctacagctcctctgtggtgccttggctggctctctctatggaagac

SEQ ID NO: 70129 - DNA, 70 bp, Mus musculus
gcctctctgttacactcagagtgagacacatgttcaaaattgcgtgtttccacgagagcccaggagagtc

SEQ ID NO: 70130 - DNA, 85 bp, Mus musculus; identical to SEQ ID NO: 57470

SEQ ID NO: 70131 - DNA, 63 bp, Mus musculus
gtatatatgtatatatgtatagatatatgcacaaatgtgtaaatatacatatacactatatac

SEQ ID NO: 70132 - DNA, 71 bp, Mus musculus
ctcaggctggaggggtggctcagcagctaagagcactgactgctcttccagaggtcccgagttcaaatccc

SEQ ID NO: 70133 - DNA, 57 bp, Mus musculus
gaggcggaacccagggctctaagtgctatggaagcactctgtcagtctgtctgcctc

SEQ ID NO: 70134 - DNA, 84 bp, Mus musculus
ggtgtcactgagtagccgcagtcttccctcctcaacctctaagagtgctgaggaagtaggttgtgagccagcagcctgacgacc

SEQ ID NO: 70135 - DNA, 105 bp, Mus musculus
gtcatgggggagagggtggaggtgacagtctgctcttgtcactggcctgtctgggtctgtctgtggctaatgcagagtgtggaccattagacagtccttcgtggc

SEQ ID NO: 70136 - DNA, 112 bp, Mus musculus
gggtgtgtgtgtggtgggtgggtgggtcagttcatgtgtgtgcacacacaagtgtgtgtgtacatctagagggcagagatcaacctctggtgctcttcctcaagaaatatct

SEQ ID NO: 70137 - DNA, 116 bp, Mus musculus
tctgagaaacacatgcttgggtctgaaatggcaggatgtgtgtgtgcagtccaacttcctgaattcagagagttcagacagtgcacggcagctggccagtatatgtgcgttacaga

SEQ ID NO: 70138 - DNA, 106 bp, Mus musculus
cttgacccttcccctccatggttatgggatgacagatgtgtgccagcacccctggtccagactctgcctctttatccctttagctgtttcttacaggaagatgaag

SEQ ID NO: 70139 - DNA, 74 bp, Mus musculus
tgagagagtgtctctaactcagtggttctcaacctgtgggttgagacaccggggagggttgggtgaccctttta

SEQ ID NO: 70140 - DNA, 57 bp, Mus musculus
gtgtgtgtggtgtgcatttatgggcatgtgtgtgtctgtgtgtgtatatctctgtgc

SEQ ID NO: 70141 - DNA, 68 bp, Mus musculus
tatgagaatatatgcatgagtaggtaattatgtttttattgttatcctgctctacatatgattttatg

SEQ ID NO: 70142 - DNA, 93 bp, Mus musculus
gttttggagctgggaaggaactaagcttgggtcctctgagagatcagaaagtgctctcccgactcatatatcttgttacacagctacttaaat

SEQ ID NO: 70143 - DNA, 75 bp, Mus musculus
atatatatacatatacgtatacgtatacatatacgtatacgtatatgtatatgtatacatatatatgtatatata

SEQ ID NO: 70144 - DNA, 78 bp, Mus musculus
ttcttggactctgactctcactgtgtctccttcacgagtctcttcactcctgaattctgacacaagatgggccaggaa

SEQ ID NO: 70145 - DNA, 87 bp, Mus musculus
ttcacacaaaataatttattctttgtattcagcaagactccctgaggagggaaggcaaggaagagaaattttattgaggtgtgtggg

SEQ ID NO: 70146 - DNA, 110 bp, Mus musculus
gcatggtggtcaagacccacttggttctggcagactgagagcttacagtgcagcttgctcacactggggcagagcaggaggcagagaaaggatgggatgtgtagccaggt

SEQ ID NO: 70147 - DNA, 82 bp, Mus musculus
tctggggatgtttgagggatatttgatgtcattaggaactgctcttagtcctaatcttgtcatgctctgtcactgtcacaga

SEQ ID NO: 70148 - DNA, 78 bp, Mus musculus
tcagtctgtgtgtgtgtctgtctgcctgtccacctgtctatgagtagctggaatgatggatgtgtatcacaaagctgg

SEQ ID NO: 70149 - DNA, 83 bp, Mus musculus
agacaggatctctcactgtgtgtgatcttgactctcactagagtgaagccagcagtcagcaagccccaatgatctccttgtct

SEQ ID NO: 70150 - DNA, 100 bp, Mus musculus
gtctgtgacaagttcattaagagtcttgtttttgtctgattaataattgaattaggcaaagatctatttttttttccttgagcctaatttgtttttagat

SEQ ID NO: 70151 - DNA, 107 bp, Mus musculus
tcaatacatctgactctccgtcgcaataggagattggacctgagatgcttcatcccttggattttatctttatattgatgctagagagccgggcatagtggttgtga

SEQ ID NO: 70152 - DNA, 80 bp, Mus musculus
gtgtgtgtatgtatgtgcttgtatgtgtatgtatgtgtctctctatgtgtatatgtatatctgtgtgtatatgtatgtgt

SEQ ID NO: 70153 - DNA, 115 bp, Mus musculus
gtcttaacattatgtagatgtacatggaaaatcagccaaatgagagcagagagagagcacatatctatcctcgaggactctaaactgggtgcaccatgaatttataaatgctggc

SEQ ID NO: 70154 - DNA, 77 bp, Mus musculus
gaaagtatgaatgcatgtatgtgtgggtagatgaacacatgtatgataagtatatatgtatgtatacattcatgtat

SEQ ID NO: 70155 - DNA, 78 bp, Mus musculus
tggatagatatacttatagatgcatataaatgggtagatatatatttatgtatgtgcaaataattatatttgtataca

SEQ ID NO: 70156 - DNA, 104 bp, Mus musculus
gtatatgtatctatgtatgtgtatctatctttatatgtattcatccatgtatgtgtgtctgtctatatatctatgtgtgtatatgtatatatatgcatatatat

SEQ ID NO: 70157 - DNA, 56 bp, Mus musculus
tgagctagagagagaatttagtaaactagtgtttgctgagttcactgtctctctca

SEQ ID NO: 70158 - DNA, 120 bp, Mus musculus
cattttatgtatatatgtacatatgtatatatatgcacatattacatttttatatatatacacatatgtatatgtgtatgtgtatatgtgtatattacattttatgtatacatgtatgta

SEQ ID NO: 70159 - DNA, 76 bp, Mus musculus
ctgtgtgtgtctgtgtgtgtgcaaagaactagaagccattgccacgtactttgcacttttgcactaccacgcctag

SEQ ID NO: 70160 - DNA, 104 bp, Mus musculus
tctgtgtatctgctgtgtgtctgtgtgtgtctctgtctgtatcaatgagtttaattgatcttccttacggggcaggggtgtggggttacttgaaggagtatgga

SEQ ID NO: 70161 - DNA, 69 bp, Mus musculus
agtaagatggagtcagatttaggaggactccctaggtctgtctgtctctgcgtctatctctgtctctct

SEQ ID NO: 70162 - DNA, 110 bp, Mus musculus
gtgatcattgagtagtgagttgtccagtttcccagatttccattgattaccctgttgttgaaatctatctttattttatggtaaactgataacatcagctggagtgttgt

SEQ ID NO: 70163 - DNA, 65 bp, Mus musculus
actttgttgtgtgtgtctctgagtctgttcctgcagtcttctcagaggctgcatctagcacatgt

SEQ ID NO: 70164 - DNA, 104 bp, Mus musculus
tgtgtgtttgtgtctctgtgtgtatgtatgtatatatttctgtggtttgtttaactgtatatatatctatgatacatatatgtatgcaggtatatgtgcatgta

SEQ ID NO: 70165 - DNA, 100 bp, Mus musculus
gtatctatgtatgtatgtatctatgtatctatctatctatctatctatgtatctatgtatgattgattgatggtagatattgttgccataactggtgtac

SEQ ID NO: 70166 - DNA, 71 bp, Mus musculus
atggtgagcaggccttatgtcttgttaagaagtatatagttacttccaagacgtaagtgcctctcttacat

SEQ ID NO: 70167 - DNA, 104 bp, Mus musculus
gacatgacaagtctgttccagcatagtatactcaaggaaaatttgccctttatatttgtgagtgcttgtgatatgtttgcaatatgatgctgatctgttatgtc

SEQ ID NO: 70168 - DNA, 116 bp, Mus musculus
gttaggagggggaaatctgtctgacccactggagatggatgcagggagagaagagagactgcagcagacagcctttagaacgaggggtgagactacgggattggatctggaagaac

SEQ ID NO: 70169 - DNA, 78 bp, Mus musculus
ttctgggagttggaagaaggttggattgttaaagcgcttgctgggagaatcatgaagacctgagtttgatccttagaa

SEQ ID NO: 70170 - DNA, 106 bp, Mus musculus
ggaggtggagaatacatatatggggcttgggagatggttcaatagttaagagcacttgctgctcttagataacaggcagctcaaaaccatctgtaactccatttcc

SEQ ID NO: 70171 - DNA, 99 bp, Mus musculus
acatgtttcctgtttgagaatgagtagatggtttcttggtgtatatatatatatctggaagctggctgaacacattttcatcaacatataggaaacagt

SEQ ID NO: 70172 - DNA, 84 bp, Mus musculus
ggctatcataagtattaggtttgcctcagtgcctctgactcagaggtttggagctagtggcctcaatatttttgggcttaagcc

SEQ ID NO: 70173 - DNA, 81 bp, Mus musculus
gcatgtacaccagaacttacactcacacacacaaaatcttttaaattttgtacatgtgtgtgtgtatgtgagcgtgcgtgc

SEQ ID NO: 70174 - DNA, 74 bp, Mus musculus
cagcagaaggtggggcattcttcccttccaagggataaagcactctgagtgaaggggctctgtctgtctgtctg

SEQ ID NO: 70175 - DNA, 65 bp, Mus musculus
atgtggaggtctgagatgagagtctgtagtttcctaaagggttctctgctttcagggtttctcat

SEQ ID NO: 70176 - DNA, 71 bp, Mus musculus
tacatatatgtgcatatatatgtatgtatatacaatatatacacatatacatatatatgcatttatatgta

SEQ ID NO: 70177 - DNA, 81 bp, Mus musculus; identical to SEQ ID NO: 70173

SEQ ID NO: 70178 - DNA, 108 bp, Mus musculus
ggtgcagtttggattcattaattaatatgaatgtctcttctacttccacagatctgagatatgacagagctgagggctattcaagtgcagggaatttatttcttcacc

SEQ ID NO: 70179 - DNA, 74 bp, Mus musculus; identical to SEQ ID NO: 70174

SEQ ID NO: 70180 - DNA, 105 bp, Mus musculus
catatgccttcaggaagaagaaaatgttttccttctatgttccatctgtctctctgattcagaaagagggattcgtttgcctttttcctttactgggaacttgtg

SEQ ID NO: 70181 - DNA, 91 bp, Mus musculus
gtgattgaacctaaacaacttattcccacaaacaacctaacccggaagcactctttttggtaggggaagaaggttctatgggtaagatcac

SEQ ID NO: 70182 - DNA, 79 bp, Mus musculus
atatatgtatatgtacatataggtataatgtgtatatatatacatacacatatatatctatatatacatgttcatctat

SEQ ID NO: 70183 - DNA, 93 bp, Mus musculus
cactttgctggggctggagggatggctcagtggttaagagcactgactgctcttccagaggtcctgagttcaagtctcagcaaccacatggtg

SEQ ID NO: 70184 - DNA, 89 bp, Mus musculus
gtgaaccagagatcttagtaccaagattacaaacaagcactatactgtctaacttgtttttatttttgaagctttggtactgggtttgc

SEQ ID NO: 70185 - DNA, 107 bp, Mus musculus
catgttcacatatccacacacatacatatacgtgacagaaataaatcttcgaaatgaaatgtatttttgacaattccatatatatgtgtgcatgtatatataatatg

SEQ ID NO: 70186 - DNA, 120 bp, Mus musculus
ctggagacttgtgatacatttatgctttcttgggatgacacgtattctaggagtactaggactcactgtcactctcactggcattgagaaggacattggtattttacagtataagcattc

SEQ ID NO: 70187 - DNA, 83 bp, Mus musculus
catgggacaatttcaatatttttgtatctattgaggcctgttttgtgttctattatatggtcaattttggagaaggtcccgtg

SEQ ID NO: 70188 - DNA, 75 bp, Mus musculus
tgtatatgtcaggctctgtcagagcctctcaggagacagctatatcaggctcctgtcagcatgcctgcttgtata

SEQ ID NO: 70189 - DNA, 118 bp, Mus musculus
ccatgctgtagtctttctttcttttcctgttgaccagctatgggtctctctgtgtgtgttaattgccatctacagcaaagcttatcagatgagggctgagaaattcactaagctatgg

SEQ ID NO: 70190 - DNA, 112 bp, Mus musculus
gagctctactatgtgagcctttgtgtttgttttatttttatatttctattttatttttaattaggtgtatgagattgtcaagtatatgtgtgtatggagtaggtatgtgttc

SEQ ID NO: 70191 - DNA, 87 bp, Mus musculus
gtgtgtgtatatatgtgtgtgtatatgtgtgtatatatgtgtgtatatatgtgtgtatatatgtgtgtatacacacacacacacaca

SEQ ID NO: 70192 - DNA, 94 bp, Mus musculus
tgcactgttttgactgcatgcatgtctgtgtgaggtatttatttatttatttattcattggtgttttgcatgcatgcatgtatgtatgtatgta

SEQ ID NO: 70193 - DNA, 72 bp, Mus musculus
gtgtgtgtaattgtgtttgtacatgtgagtatatatgtatatatatacatatgtacacatacatatacatac

SEQ ID NO: 70194 - DNA, 96 bp, Mus musculus
atgtacacgggcataattacacacacaatatatatgtatatatgtatgtatatgtatgtgtacatatgtatatatatacatatatactcacatgta

SEQ ID NO: 70195 - DNA, 112 bp, Mus musculus
acctagggaagtcaaggcaggcactagagtagaagccatagggaaagttactttctggctcactctctggctgtctagaacatgttagctagctttcttatacagttcaggt

SEQ ID NO: 70196 - DNA, 103 bp, Mus musculus
tagacaggattgagaagtaccagagggattagtaggcttcacccagggtgtgtctctgtgtgatagtttacagagatgactggctcacgcttgatctgaccta

SEQ ID NO: 70197 - DNA, 62 bp, Mus musculus
tatgtgtatgtatatatatgtatatatatatatatatacacacatatatatacatatacata

SEQ ID NO: 70198 - DNA, 91 bp, Mus musculus
aacaccacatagaggatgcagcccagagaactggagtcaacaatcccaaacatctttccaactctcagtgtctgtgactaaagctggtgtt

SEQ ID NO: 70199 - DNA, 73 bp, Mus musculus
tctctacccagctcagaagagatgttcctcctggctgcatgcataagagagactctttctggttgccttcaga

SEQ ID NO: 70200 - DNA, 64 bp, Mus musculus
ctgaactcagagattactgattgcagatagtctaatttgccctgtctctgtctctgagtgctgg

SEQ ID NO: 70201 - DNA, 72 bp, Mus musculus
gtccaggaagacatgcttatgagggaccccaaatgcctactacgtgtctgtctgtctgtatgtctcctagtc

SEQ ID NO: 70202 - DNA, 111 bp, Mus musculus
cctagagctacctgagaagggagtcccagtgatcgcttgcccagatcaaattgatctgtgagcatgtgcatgtggttgattgccttatttctaattcctgtaggatagccc

SEQ ID NO: 70203 - DNA, 98 bp, Mus musculus
atacacacacacatatatatatattgtatgtatacacgcatgtgcacacacgctgtatacattttatgtatatgtgtatgcctttgatgtataaatgc

SEQ ID NO: 70204 - DNA, 89 bp, Mus musculus
tctctttatatgtgtgtgtatacagtatgtatgtatgtatgtatgtatgtatgtatgtatgttactagtactgttcatctctctggagg

SEQ ID NO: 70205 - DNA, 113 bp, Mus musculus
catactgagagccaatttttaagttgttattgtcataagcacatgtatgtatgtttataagtatgtacaaatgcataaatacaacctactgagtctgtttttactgttgtgtg

SEQ ID NO: 70206 - DNA, 98 bp, Mus musculus
tacatcccagaacgtagcatggctacttaagatccattagctcagtgaggagagtgagcttatgtgtcatgaaacatccactctgcttctgcactgta

SEQ ID NO: 70207 - DNA, 71 bp, Mus musculus
ttggaggatggtagagaattgagtgtggacataaaaatagaacaccacactgctgaggttctacttgccaa

SEQ ID NO: 70208 - DNA, 90 bp, Mus musculus
agagagagacagagagagacagagagtgacagagagagagcacaacacattcatatatatggagctctctctctctctctctctctctct

SEQ ID NO: 70209 - DNA, 78 bp, Mus musculus
gagagagagagagagagagagagagctccatatatatgaatgtgttgtgctctctctctgtcactctctgtctctctc

SEQ ID NO: 70210 - DNA, 94 bp, Mus musculus
atgtatatgtatgtgtatatatatgtatatatgtgtgtgcatgtatgcagatggagacatatatatgtgtatatatacacagagacatatgtgt

SEQ ID NO: 70211 - DNA, 84 bp, Mus musculus
tcaaaactctgtgctgtgctctttgggtcagaagaaagacagatgagtctgagatctacctcaagaacacaggcatggctctga

SEQ ID NO: 70212 - DNA, 61 bp, Mus musculus
tcaacaggaggggaccaggagggaagtcaagagaagctctgtgctgtgtctctctcaatga

SEQ ID NO: 70213 - DNA, 76 bp, Mus musculus
gactggaggtacacacgtgaacagggaagagagggttgtaagtaatcaaaactgtatttgtaaatgtcttctggtc

SEQ ID NO: 70214 - DNA, 120 bp, Mus musculus
aagtgggaatgagagagagcaggaacgagtgagctagggttaagtgtttgctagtatttttcacagtagactctcagcttctagccaacacttccccttcctcatctggaccattttctc

SEQ ID NO: 70215 - DNA, 128 bp, Mus musculus
gtgtgtgtgtgtgtgtgtgtgtgtgtgtgtgtgtgtttacctgcctgtgtatgtgtaagcaagagcccaggtatgtgcaagtgcatgtgcacatttgtatgttcacatttgtatgttcatggagacca

SEQ ID NO: 70216 - DNA, 106 bp, Mus musculus
gcatatatgtgtgtggatacatgtatatgcatgtgcacttgtgtgtatatgagtatatatatatgtgtgtgtgtatgagtatatgtgtatatgtgtatatgtgtgc

SEQ ID NO: 70217 - DNA, 78 bp, Mus musculus
tttaagtacatgagattgagcctggatcccatgctcgtaaccactgagccttctctctggctcagtctcattattgaa

SEQ ID NO: 70218 - DNA, 77 bp, Mus musculus
tttatatttatatgcatgcacacatatgtatacactacatgtatatacatatgtctctgtgtgtgtgtgtgtataaa

SEQ ID NO: 70219 - DNA, 113 bp, Mus musculus
tatgtgtatttatgtgtgtacctttatatgaatatgcatgtgtatttgtgtgcatatctatatgtatatatgtgaatatatatgtgcatctatatgcacatataaacatatgt

SEQ ID NO: 70220 - DNA, 78 bp, Mus musculus
ctttgggcccccatgtgcatgtgtgcctactcacacacagacacccacacatacacataattaaaaggggctggtaag

SEQ ID NO: 70221 - DNA, 94 bp, Mus musculus
gtcattatatctgtatatctatatataattttgagacatagtttttatatgtatgtatataaattatgtaagatatacatttaatataatgtac

SEQ ID NO: 70222 - DNA, 80 bp, Mus musculus
tttgtgtcaggttgtcatgaaactacctagcactggctccatccacacttgcttgcgacagggtctctcactgacacaga

SEQ ID NO: 70223 - DNA, 82 bp, Mus musculus
agtgtgtgtgagagtgtatctctctctctctgtatatagcccatgcccatgtatggaggtcaggggacaactttgtgcaact

SEQ ID NO: 70224 - DNA, 75 bp, Mus musculus
atgtgtcgctccctgattggctgtagcccattggccgagttgtcgtcacggggaaggcagagcacatgtagtgga

SEQ ID NO: 70225 - DNA, 67 bp, Mus musculus
tacatatgggatatgtgtctgtgtgtgtatatatgtatatatttattccacatatattccaaatgta

SEQ ID NO: 70226 - DNA, 79 bp, Mus musculus
tgccatgtacaggtatatatatatatatatatatatatatatatatatatatatgtatgtatgtatgtatgtatatgca

SEQ ID NO: 70227 - DNA, 119 bp, Mus musculus
tatgccactgggggtaggctttgaggttttatgttctcaagccaggcctggtgtcactctctctccctgatgcctgctgatctggatgtagaactcttagtaccttctccaccaccatg

SEQ ID NO: 70228 - DNA, 75 bp, Mus musculus
agtctctctctctgtgtgtgtgtgtgtgcacacatgtgcacaggtgccatgccatgagtgtcaagtttcaggact

SEQ ID NO: 70229 - DNA, 62 bp, Mus musculus
tcactttgtagaccaggctggcctcagattcagagatctgtctgcctctgtctcccaagtga

SEQ ID NO: 70230 - DNA, 116 bp, Mus musculus
ccatgaccataagcgacttgggaaagaaagggcttgtgcttctacattgccttcatcactgaaggaagtgaggacaggaactcaagcacggctggaacctgatgcaggggccatgg

SEQ ID NO: 70231 - DNA, 66 bp, Mus musculus
aacatggggctggagagctggtgcagtgcttaagagcactgactgctcttccagaggttctcagtt

SEQ ID NO: 70232 - DNA, 95 bp, Mus musculus
gtctggtgttgatttgctattttaaaaggtgttatgggagctggagggctaacagtcttagtcactgttttatcgtggggaaggaacaccacgac

SEQ ID NO: 70233 - DNA, 77 bp, Mus musculus
gggcaggagagatgatggctcagcgtttccgagcactgactgctcttgcagaggacctgggttcaattcccggcacc

SEQ ID NO: 70234 - DNA, 118 bp, Mus musculus
agtgatctgtgatgcccgggaggaacatgggggactggagagagagctcagtaattaagagcactgactgctcttccagtaggcctcaggttcaattcctagcacccatatggcagct

SEQ ID NO: 70235 - DNA, 200 bp, Mus musculus
tatatacatatatatgtgtatatatatatatgtatatatatacacatacacatatatgtatgtatatgtatatatgtatgtgtatatgtgtgtatatatacatatatatatgtgtgtatatacatatatatgtgtgtatatgtatatatatgtgtgtgtatgtacacaggcatgtgtgtatatgtgtacatgtatgtaca

SEQ ID NO: 70236 - DNA, 78 bp, Mus musculus
ctgtctgtctgtctgtctgtctgtctgtatattgcatgcatgcctggtgcccttggaggacagaagaattatagatgg

SEQ ID NO: 70237 - DNA, 69 bp, Mus musculus
tctcaggctctgtctgtgtttgccctcccatgctggggttccgagcagcgttcatagccatgcctggga

SEQ ID NO: 70238 - DNA, 81 bp, Mus musculus
cagagacagagagatgacagagagacagagagaaaaagactagcatttagctagtccttgtccatcttccatcagtccatg

SEQ ID NO: 70239 - DNA, 82 bp, Mus musculus
gaagatggccatggactgatggaagatggacaaggactagctaaatgctagtctttttctctctgtctctctgtcatctctc

SEQ ID NO: 70240 - DNA, 78 bp, Mus musculus
cctgtggggcctcgtggagattttatttatttctcttgctgagcactttaatactgtttctgctgggtccgttttagg

SEQ ID NO: 70241 - DNA, 78 bp, Mus musculus
tatgtgtgtatgcatgtgtgtgcatgcttatgtgtgtgtatgtatgtatgtatgtatgtatgtatgtatgcatgtatg

SEQ ID NO: 70242 - DNA, 83 bp, Mus musculus
cccagcccaggctcacatctggagaccaaagctggctcgctggctaaacacagagcatctggatgtgaagagctgtttctggg

SEQ ID NO: 70243 - DNA, 70 bp, Mus musculus
tgaatacagggctgaagagatagaccagtggttaagagcactgactgctcttcctgaggtcctgagttca

SEQ ID NO: 70244 - DNA, 79 bp, Mus musculus
tccacaaagtgatatgtaagtatgtatgtatgtatgaatgtatgtatgcattcatggctgcagggtacatgggtgtgga

SEQ ID NO: 70245 - DNA, 112 bp, Mus musculus
tgggggtaaagcttcctcctccttctccaggcacattcagccccttatacttctctgtctccctctttcactggcagcggggggtgtcactgccagggtgtctttgccgcca

SEQ ID NO: 70246 - DNA, 114 bp, Mus musculus
cctcagtttccagtgtgcaatgaagaggggtgttcctaaatcacgactggagtggggggctcccactctctgtgcctctcagcccccacttgcacatgctcagagccagtgggg

SEQ ID NO: 70247 - DNA, 119 bp, Mus musculus
caggcttgactacatagtgagttcaaggccccacctggatctctctctctctcacacatgcacaaaagagagaaaggggggcgggggctggagagatggctcagtggttaagagcactg

SEQ ID NO: 70248 - DNA, 67 bp, Mus musculus
gaactcagagaggctggacactgcattcccgatcctgtctgtctgtctgcctgtctctctgtctctc

SEQ ID NO: 70249 - DNA, 77 bp, Mus musculus
acacacacacatacatacatgtgttttatatatatatatatatatacacatgtatgtatgtatgtatgtctgtgcac

SEQ ID NO: 70250 - DNA, 92 bp, Mus musculus
catatatgggtgctggagggatggctcagcggttaagagcactgactgctctttcagaggtcctgagttcaattctcagcaaccacatggtg

SEQ ID NO: 70251 - DNA, 122 bp, Mus musculus
gtgcctcactggggataggctttgaggtctcagcagactcacagcgttcctagttatgcacatactctcagtctgtcttttatgtgtttcctgcttgtggatcacaatgctgagctctagcc

SEQ ID NO: 70252 - DNA, 73 bp, Mus musculus
tgcggtgacacatctctctctctctgtccacatagtccctgtagtggctgtggagagaaaggcaagttttgta

SEQ ID NO: 70253 - DNA, 73 bp, Mus musculus
caagtctgctggagatgctctgtgcctgtgtgtctcaaacaagaacatcagtcgccctgtatacttggacttg

SEQ ID NO: 70254 - DNA, 72 bp, Mus musculus
cagggtctctctgtggctgtcctaaaactcactctgtagaccaggctggccttgacctcagagatctccctg

SEQ ID NO: 70255 - DNA, 108 bp, Mus musculus
ccaaagcgtagcctgagccgcaccggggtgtgctggcgctgtgggggggcttcctctcagaaggctcagagctcagggtcaggctgggtgggggaggaatcctttttg

SEQ ID NO: 70256 - DNA, 91 bp, Mus musculus
acacatatgacctcatggactggagagatggctcaatgatttagagcactgactgctcttccagaggtcttgagttcaattcccagcacca

SEQ ID NO: 70257 - DNA, 93 bp, Mus musculus
agatcagtctggggcagtcaagagcctaggagacacagtcattgacacactgtgtctgcaagtatggcctcctggtctggcaaaggactggct

SEQ ID NO: 70258 - DNA, 81 bp, Mus musculus
taccgtgggtctttccatgtcagttaatgaagccaagtcactctcagaggctgactttaagccagatagtctccgcaggtg

SEQ ID NO: 70259 - DNA, 87 bp, Mus musculus; identical to SEQ ID NO: 60417

SEQ ID NO: 70260 - DNA, 113 bp, Mus musculus
tgggactcccggtccatggaatggtgctgcccatgaaagagcctcgaggtgagaccctcactcagacactcaaatcccgggacagccgcgtacccaagaagacactgagacca

SEQ ID NO: 70261 - DNA, 83 bp, Mus musculus
ttgacatctgtctctctctgtatctggactgttaaatgtgcatgagagagaggctgagagagagagtggcagagagagagaga

SEQ ID NO: 70262 - DNA, 88 bp, Mus musculus
aggcagttctagggatccgcagggtggaaggaggaaaatcaatacccacagctgtcttccctcccgctctgtctctcagtctctgtct

SEQ ID NO: 70263 - DNA, 84 bp, Mus musculus
agaggaaagagggacagagacagtggtacatcagttataccctgggaacctgtgctcgctctctctctctccctctctctctct

SEQ ID NO: 70264 - DNA, 80 bp, Mus musculus
ccaaaggctgattgatctctgtgagtttgagccagcctggtctacagggtgagtccagagtgaccagagtggcctaaagg

SEQ ID NO: 70265 - DNA, 82 bp, Mus musculus
ttgagccatccaactgtgacagtttcagtccttctgaccacatcaaaatagagtctgaggcttctagtcctggccagttggg

SEQ ID NO: 70266 - DNA, 71 bp, Mus musculus
tgtgtatgtctgcctgtctgtgtgtctgggtaactatctgtgttaggccaccggtgggctatcaaatcaca

SEQ ID NO: 70267 - DNA, 87 bp, Mus musculus
tatatatatgtatatatgtgtatatgtatatatgtgtatgtgtgtatctgtatctatatatgtatatgtgtgtgtatgtatgtatat

SEQ ID NO: 70268 - DNA, 91 bp, Mus musculus
tgttaagaatcataatatagggctggagagacggcttagcagttaagagcacagactgctctttcagaggtcctgagttcaattcccagca

SEQ ID NO: 70269 - DNA, 107 bp, Mus musculus
acacacataaaaatcaactgtaggggctggagagatggctcagcggttaagagcagtgactgctcttccagaggtcctgagttcaaatcccagcaaccacatggtgt

SEQ ID NO: 70270 - DNA, 78 bp, Mus musculus
caccatgccctgctcctggcccgacttttcttgcagatcatacagagagaagagacagtccagttgcctagtctggtg

SEQ ID NO: 70271 - DNA, 80 bp, Mus musculus
ggttcggggagagaaaaggggaaagaaggtcagtggagggccctcactctctgtctgcttttgtgtgggtcccagggacc

SEQ ID NO: 70272 - DNA, 120 bp, Mus musculus
gacacagagtatagcagcatcttgttcagcatggtgaggaagggtctgttgtcagtgttcacagtgatgtacctgcaccacgctgctcctggctgtgatctagattttacttttctgttc

SEQ ID NO: 70273 - DNA, 113 bp, Mus musculus
gccattggtgttggggagacgactctgtagtgaggagcattggctaacctagagggaccaggtttcattccaagcacccacaaggagggtcataagtgtctgcaactccaggt

SEQ ID NO: 70274 - DNA, 84 bp, Mus musculus
cacagactgatctctgtgagctcaaagccagcctggtgtatataatgagttccaggaaagccagggctacacagaaagaccgtg

SEQ ID NO: 70275 - DNA, 60 bp, Mus musculus
ggtgaccgtctgagtggtgacatataattagtccctatctgtcacccactcagtgtgact

SEQ ID NO: 70276 - DNA, 69 bp, Mus musculus
gagaccacaggctgggtctgtggacaggagtcctcacacttccttctccaggctctctcactgtgtctt

SEQ ID NO: 70277 - DNA, 113 bp, Mus musculus
agatgggaatctgaaaagtgaggccaggcagtgccagtcctgagaagcaaaagagcctggctggctgggtcactgtttgcctttgatagcaagactgtttctagactccttct

SEQ ID NO: 70278 - DNA, 73 bp, Mus musculus
gaagccccagaggctgcctgcctggctgttgtggggacagagaagtctgagggcagacactggtgttggcttt

SEQ ID NO: 70279 - DNA, 79 bp, Mus musculus
gaaggtagacagacagacagacagacaggcaggcaggcaggcaggccggcagtaaatgctctcagtcaatatgatcttc

SEQ ID NO: 70280 - DNA, 73 bp, Mus musculus
tgaaggtgctgggcacaggggaagctcagccctctggctagggctgtgtgggtctctgtgacagaaatcttca

SEQ ID NO: 70281 - DNA, 65 bp, Mus musculus
atactagtagctgtggctgtgtagttggccttgcttcacacactgtcacagtgacatctgagtgt

SEQ ID NO: 70282 - DNA, 111 bp, Mus musculus
acttccctaacatcgagttatttataccttgggcgagtctgtcacacagtctggttgcggaacgttgccaccctttgaatcagactcctgccagtaatttctgtttacagt

SEQ ID NO: 70283 - DNA, 59 bp, Mus musculus
gtgtgcatgtatgtatgtatgtatgtatgtatgtatgtatgtatgacatgtatgtgggc

SEQ ID NO: 70284 - DNA, 83 bp, Mus musculus
accatcatgtatatctatatatgtatgcatatatatatttacatatatatgtatttacatgtggctgagtatatatggtgtgt

SEQ ID NO: 70285 - DNA, 157 bp, Mus musculus
tatagtgtgtgtgcgcgtgtgttttacatgtctatgtacatgtgtgtatgcacgtgtgtgtatatatatattatgctttgtccatgtgcacatttgtgtgtttgtgtgtttgcaaatgtatgtgtttgtatgtatatgtgtgtgcttgcatgtgtat

SEQ ID NO: 70286 - DNA, 89 bp, Mus musculus
gtgtgtgtgtgtgtgtgtgtgtgtgtatgtatgtgtatatatgtatttgcatatatatatgtatatgtgtataagtgtgtgtatgtgta

SEQ ID NO: 70287 - DNA, 99 bp, Mus musculus
agttgctttttggtcatggtgctttacatccgaggacaaaccgaggcaccctgcagtggtttctgtcagatgtttggccgtggtgacgtaagagtaact

SEQ ID NO: 70288 - DNA, 113 bp, Mus musculus
gaggccagcctggtctacaaagtgagttccaggacagtcagggctatacagagagaccctgtctcactgacttgctcacgggttcatgttcagctagctctcttatccagtcc

SEQ ID NO: 70289 - DNA, 83 bp, Mus musculus
gaactttgaatgatgacagtgtgagcagtcacggtgggctccttgaataatcctcctgtgatggtccatctttattattgttc

SEQ ID NO: 70290 - DNA, 75 bp, Mus musculus
ctgtttgcattttcagaaggtctctctggctcactctgaggccaggagctagggtaccattttagtgacagattg

SEQ ID NO: 70291 - DNA, 99 bp, Mus musculus
gatggatggcacagctagttcacggtaccacccaggtcaccagctgatgattcccactgcctgcctgtctgcctgcctactacctttaatccttccttc

SEQ ID NO: 70292 - DNA, 62 bp, Mus musculus
gagttttgcttggcttatacttccatgaagttcatcactgaaggaagtcaggacaggagctc

SEQ ID NO: 70293 - DNA, 90 bp, Mus musculus
gtgggtggtggggactgaactcagaacaccagagatccctttcagttcctgtctatccctatctgtctgtctgtctgtctgcctatctat

SEQ ID NO: 70294 - DNA, 87 bp, Mus musculus
gaccttcaaaactctaggcaggaaaaaaagagctgtgttccagatctgtgttgacactaactctctttctgcctcagagtctcggtt

SEQ ID NO: 70295 - DNA, 103 bp, Mus musculus
gctgggtgctgtaagaaaggaggctgagcaagccatgggcagccagatgctaaacagcactctgccacggtctctctgtcagctcctccctacaggtccctgt

SEQ ID NO: 70296 - DNA, 72 bp, Mus musculus
gtgttgtgggagctgctgatccaacagagagcatttggctgcctctctctctcagcatatcctctctgacat

SEQ ID NO: 70297 - DNA, 105 bp, Mus musculus
aggctctttttctgatccagccctggccttaaggtagagtaaggaggctcttatctatctgtctgtctgtctatcttgcagtgctagggatggaattcagggcct

SEQ ID NO: 70298 - DNA, 73 bp, Mus musculus
gtgtgtctgtctgtctgtctagctgttgaattcaggacctccttcatgttaggcaagcactttacagccgaac

SEQ ID NO: 70299 - DNA, 64 bp, Mus musculus
gtgcatagcaggacacgctggggcaagttctggaacttctctgagcctctgtttctctatgtat

SEQ ID NO: 70300 - DNA, 100 bp, Mus musculus
tgtgtgtgtgcatatgtgtatatgtatgtatgtatgtgtgtatatgtttatgtgtgtatgtgtgtatatgtatatgtatgtatgtgtgtgtatgtatgta

SEQ ID NO: 70301 - DNA, 66 bp, Mus musculus
tgttggcctgtggggcattttcttatattaattgatgtgaaaagagtcagtccacagtgggcggca

SEQ ID NO: 70302 - DNA, 119 bp, Mus musculus
gtggtttctgcaaaattaataaagtcctgtggtataaaggagagtatatttatttttgttttaatcatttagatatttctcacctcattgaatatatattttcttaatgtagaagttat

SEQ ID NO: 70303 - DNA, 108 bp, Mus musculus
taactaagatctactttctctttgtgaggcagagtctcaggctggccttgaacttctgatctttctgtctctgactcccaaatactgagattatgatgataaatgttg

SEQ ID NO: 70304 - DNA, 100 bp, Mus musculus
ttagaacaaatgtgagtgtgtacatgtatgcgcacgtgtgtatgtgaacacatgtttgtatgtatgtatgcgtgcatgtgcatgtttgtgttttctctgg

SEQ ID NO: 70305 - DNA, 82 bp, Mus musculus
ggctcccaagtagcccaggctagcctcagactctctgtaactgagatgactttgtagtgctgaccttcctgcctccagctgc

SEQ ID NO: 70306 - DNA, 61 bp, Mus musculus
gattggggtgggggggggctcatgggactgagtgtctcaaactctctctcctcttggaatc

SEQ ID NO: 70307 - DNA, 190 bp, Mus musculus
acacacacatatatatacatacatacatatatatacatatatacatacacatatatatgaatgtattttgttattatatatgcatgtatatatgtatatgtgtatatgtatatgtgtgtttatgtatatgtatgcatatgtgtgtatgtatgtatatgtgtatatatgtatgtatatattcattctagca

SEQ ID NO: 70308 - DNA, 107 bp, Mus musculus
ggaaaagaatggaggtgagttgcattgtgtctggtccctgtccttgtccccatctgtctgtctgtctgaccgcccatccatgcccccaccctctccacccttggttc

SEQ ID NO: 70309 - DNA, 93 bp, Mus musculus
gagagagagagggcggggggagagggagagagtctatcagtctgtctgtctgagggaggccactctcgtctctcactgaacttggagctcatc

SEQ ID NO: 70310 - DNA, 118 bp, Mus musculus
ggaatgtctatgtatttgttcctaagagcgtatttgttctgagtatggacaaatgtgtgtgtgcacacacacatacatactaactgacatgtgggctgggcctccatctggactcttc

SEQ ID NO: 70311 - DNA, 85 bp, Mus musculus
gattccaaacagcggtatctcagtggggtgacttggtggtttaatctgaccacaaagctgtctgtctgtctgtctgtctggaatc

SEQ ID NO: 70312 - DNA, 108 bp, Mus musculus
ggtgtgtctgacagctacagtgtactcataaataaaaataaataaatctttttttaaattttatttagtattatatctaagtacactgtggctgtcttcagatgcacc

SEQ ID NO: 70313 - DNA, 71 bp, Mus musculus
cagctgcccagaccctgtctctgtctctgaagacccaggtcccagtggtgaccagagctgttctgggactg

SEQ ID NO: 70314 - DNA, 125 bp, Mus musculus
ctgagtgctgagatctcaggtgtgtccatccacacccagctcccaggccccactcagtccctcactcccttcagtgtcccctaatctcccttactgtctgtttctcgagtggtgacgttgggtgg

SEQ ID NO: 70315 - DNA, 110 bp, Mus musculus
gtgtgtgtatacatacacacatatatattatatatacatatgctatatatgtatatatgtatgttatatatgtataatacacatacatacacacatgtatatatgtatgt

SEQ ID NO: 70316 - DNA, 74 bp, Mus musculus
ggggaacactctggtatttgtcgtttggggcctttgatagggactctgtttgcctcagctgctttctgtttccc

SEQ ID NO: 70317 - DNA, 82 bp, Mus musculus
tctctgtctgtctctgtctatctatctgtctgtctgtctgtctctcaagaaaaaaaggtggatggtgctgggctagcatcga

SEQ ID NO: 70318 - DNA, 79 bp, Mus musculus
acttcagttagtttcactgtgtctctgtttagtttctgcttccaggatctgtccattgatgagagtggggttttgaagt

SEQ ID NO: 70319 - DNA, 110 bp, Mus musculus
ggacagctgaacacccaccgggactggccagtgttgagaggcggagacttgggcaattgctggacgctgccctgggcattgcacttgtctcggtctgacagtgccggccc

SEQ ID NO: 70320 - DNA, 118 bp, Mus musculus
ccctcttggaccttagtcatgggggctccaaagtgctgttcgtgcaggtagtgtaattacctgacctactgctgagctagcacttcccgagcccccaggacacaacctctgatagtgg

SEQ ID NO: 70321 - DNA, 88 bp, Mus musculus
cagatagagcagactctcactgcctcaggcaggtgggaaggctcccctcattcctccctggctgcagcactcaggagctctggcactg

SEQ ID NO: 70322 - DNA, 79 bp, Mus musculus
gacagccagggctatacagagaaaccctgtctcgaaaaaaaaaaaaaaaagatacacactctgtgtgtccatgtctgtc

SEQ ID NO: 70323 - DNA, 85 bp, Mus musculus; identical to SEQ ID NO: 60314

SEQ ID NO: 70324 - DNA, 81 bp, Mus musculus
ccctggttctattctcaacattgctgaccctctgtgtctctgaaggtgagtggagaggccagagcagtgtagggccatggg

SEQ ID NO: 70325 - DNA, 129 bp, Mus musculus
caaaatgtggttgagaatatagattttgcctggagagatggctcagaggttaagagcacagagtgctcttctagagaatatagattttatgtaagtctttgctgttggccccttttgatgtttctctct

SEQ ID NO: 70326 - DNA, 85 bp, Mus musculus; identical to SEQ ID NO: 57470

SEQ ID NO: 70327 - DNA, 114 bp, Mus musculus
ttaaattaatagttgttaattaaaaattatgaattgattaactgatcattaatgcatcaattaatcattatatttgatcatttatgaatattaataacagcaattaccatttaa

SEQ ID NO: 70328 - DNA, 83 bp, Mus musculus
gggatgggggaggggctggagagatggctaagtggttaagagcactgactgctcttccagaggtcctgagttcaattcccagc

SEQ ID NO: 70329 - DNA, 88 bp, Mus musculus
tatatatatatatatatatatatatatatatacatatatgtgcacatatgtatatgtatatgtatatgtatatatgtatgtatgtgta

SEQ ID NO: 70330 - DNA, 120 bp, Mus musculus
ggcacatgggacaggtggctggatggaccattttcaggagcttcgaggagacagagtggacagtgcgagtgaggagtggcttcagtttgtgtttagaaaggtgttaaagtcgtgggaatg

SEQ ID NO: 70331 - DNA, 64 bp, Mus musculus
agacagagactctcactgagagctgcagtttattcagtgggctaggccagtgaggggtctgcct

SEQ ID NO: 70332 - DNA, 116 bp, Mus musculus
gaccttcctcacagtcaaggaagcaagcggggagcatggaggatggtgcttgctagccgggtctctggctcactccctcactcaagtttaattagctttcttgttcagtggaggtt

SEQ ID NO: 70333 - DNA, 111 bp, Mus musculus
ccacctccctgaaggaaaagctgagcctttgtttggagacagtcacaccctcacaccctccagaggaaagaatgatgtccccagactaggtggagatgcagcagggagtgg

SEQ ID NO: 70334 - DNA, 72 bp, Mus musculus
gacaactttcaggaatcagttctcctctttggctttaactttgtgggttctgaggattgaagtcaggttgtc

SEQ ID NO: 70335 - DNA, 120 bp, Mus musculus
tgataaatgccagtgaagcttaacagaactgaagccatcacgttgtgagtaacaccatcagtaagtgaaggagatgttatatttacaaatgatcttcaggagctaagctgggatcagtgg

SEQ ID NO: 70336 - DNA, 112 bp, Mus musculus
ggctcagcttcttgtgtaggctctggggattgaactcagactctcagactttcaatgaaaacacttcactgtctgagctggcccccaaccccaggatggaagtttctctgcc

SEQ ID NO: 70337 - DNA, 56 bp, Mus musculus
ggaggcctcaggtgggtagagggtgtggctacacagactgcctctctctggctttc

SEQ ID NO: 70338 - DNA, 109 bp, Mus musculus
ggagatgatcgtgaagtctgtgtgagcagctgagtagtgagtcgccagaaggcagccgctcgctcgctcgctcgctcactcgggctgtctagaacagcacggcagggcc

SEQ ID NO: 70339 - DNA, 110 bp, Mus musculus
tatgtgtgcctgtatgtacctgtgtgcacctctgtatgttcacctctgtgtgtgcctcagtgtgtgcctatgtgttcttatgtgtatttgtgtgtctataggtatctgta

SEQ ID NO: 70340 - DNA, 68 bp, Mus musculus
gtgtatacatgtgtgtgtgtgtatgtatgtatgcatgtatgtatatatgtatgtatgtgtgtgtgtgc

SEQ ID NO: 70341 - DNA, 67 bp, Mus musculus
gtatgtgtgtatgtatgtatgtgcaggacagatgtgtgtgtatgtatgtatgtatgtatgtatgtgc

SEQ ID NO: 70342 - DNA, 66 bp, Mus musculus
aggtggaggggaactggccctgttctgctgtgggctctgacagacagacagacacactttccacct

SEQ ID NO: 70343 - DNA, 64 bp, Mus musculus
ggtgtcttctctagagaaggagtccactggagccatcaactgtatttcttcatgagaggacact

SEQ ID NO: 70344 - DNA, 92 bp, Mus musculus
agtcagtggaactgctattagacagggcagctctgaagtccaagatccaggaccccaatcgtctgtttgtctgtctgtctgtctgtctgtct

SEQ ID NO: 70345 - DNA, 92 bp, Mus musculus
agcttccctgttggcccactgtgccctcctctgtggctgtgttcaggtcaaggcctgcagccctcaagtggggtgcagcaacttctctggct

SEQ ID NO: 70346 - DNA, 80 bp, Mus musculus
gatgaacttctatgtctggctttatattggttctgggatccaacccctggtgggcaagcttgtgtggctagagcttcgtt

SEQ ID NO: 70347 - DNA, 101 bp, Mus musculus
gggagaccactggggctgcagagatggctcagcagttaagagcactgactgctcttccagaggtcctgagttcaatttccagcaaccacatggtggctcgc

SEQ ID NO: 70348 - DNA, 110 bp, Mus musculus
gttaaaatccacacacaggggctgcagagatggctcagcggttaagagcactgactgctctttcagaggtcctgagttcaattcccagcaaccacatggtggttcacaac

SEQ ID NO: 70349 - DNA, 114 bp, Mus musculus
agatgtaaaaatttatatgagtataagagggtcttgtctatatgtttatatgtgtacctcatgcacgcctggtgcttgcacataccagaagagggtgtcatatgctctgcagct

SEQ ID NO: 70350 - DNA, 74 bp, Mus musculus
gcagacactgagggggaggggagaggagccaggagggagccttccaggtctctccctctgtgtgtgtcctctgt

SEQ ID NO: 70351 - DNA, 112 bp, Mus musculus
ctgtgcagagctggacggggtggccactatccctgtcctccaggagctcacgtatgcctgcctgtgagcgcctcggcgacagagccggtgtccacccctgcactgtccacag

SEQ ID NO: 70352 - DNA, 108 bp, Mus musculus
gcactgtaccttgccatcctgtccaccctgtcatcttcagacccagaggacagttctctctgagtgtcccaagtagcaggaaggttgactgatgagtcggaggtgtgc

SEQ ID NO: 70353 - DNA, 116 bp, Mus musculus
cagatgtctctgtgtacccatgtgtgcatgtggatgttcgttgcatatgtatgtgagcatgtggatgtgcactccacatgtgtgcatgtgcatacacacatatttttagagggctg

SEQ ID NO: 70354 - DNA, 90 bp, Mus musculus
gaggcaggcagatctctgtgagctcaaggccagcctggttttcagagtgagttccaggctagctggggctaaacagagaaaccctgtctc

SEQ ID NO: 70355 - DNA, 66 bp, Mus musculus
ggtcagctgagtgtctctgagtgtaggtaaaagttgcctgctgccaagcctgacagtctgagttcc

SEQ ID NO: 70356 - DNA, 58 bp, Mus musculus
atgtatgtgcttatgtgtatgtatgtatgtatgtatgtgcacgtgtatgtatatatgt

SEQ ID NO: 70357 - DNA, 90 bp, Mus musculus
atataaacaagtaacagtacacagagtgcaccacaggttgtacttatgcttttatggagtgtgtgtgtgtgtgtgtgtgtgtgtgtgtgt

SEQ ID NO: 70358 - DNA, 115 bp, Mus musculus
gtgatctagtcaggggtggacagccagataggcaggtggtagagtcagaggaagtgtctctgtctctgtgcctgtgcctgtttctctggccttcaaagccacaaccattcatcat

SEQ ID NO: 70359 - DNA, 119 bp, Mus musculus
tggcagcaagcgccttcgtccacccacctatctcatccaatccctagaaggttcttctaaaatattttttattttaatttcctgtgtatgggtaggtctgtctgtctgtctgcatgcca

SEQ ID NO: 70360 - DNA, 89 bp, Mus musculus
ggtgtgcttgaagacagctacagtgtacttacttataacaatcaataaatctttgggtctgagtgagtggggctggagcaagcgggacc

SEQ ID NO: 70361 - DNA, 107 bp, Mus musculus
tgctggatagatcggcatgacttcaatttggtcacatcttgaggtgttctagagtgtcagcactgagctatccccaccaaatccctctccccaaccccaagtcagca

SEQ ID NO: 70362 - DNA, 126 bp, Mus musculus
acaggtaggtgggagggatgtggatgtagctgcgacctgccccccaggtctgtctctctgtgaggccttcatctccttatctgggaattggaggtggggagcaggagagaggcaggaatgcagggc

SEQ ID NO: 70363 - DNA, 73 bp, Mus musculus
gcacagcagaggttcctgccctgaggcagtccctctctctgggtggccgagtgtggctgagcctttgctgagt

SEQ ID NO: 70364 - DNA, 64 bp, Mus musculus
gctgtattgagagaacaggggacgtcagagagccactctgcctgtccctcactttcaatcctgc

SEQ ID NO: 70365 - DNA, 67 bp, Mus musculus
agatgaacacacacacacacagatatatatacatatatatatatatctgtgtgtgtgtgtcacttct

SEQ ID NO: 70366 - DNA, 82 bp, Mus musculus
gtgggctgttcctgttgttgtcttctcactctctcactgagcagagctccatagaagtggggggatttcggggcttgctcac

SEQ ID NO: 70367 - DNA, 90 bp, Mus musculus
ttatgtatgtgcttgtatatgtgcatgtgtgtgcatatgcatgtgtttgtgtatatgcacatacatgcatgtatctaagtatgtatgtag

SEQ ID NO: 70368 - DNA, 73 bp, Mus musculus
catgtgtgtgcatgtgcatgtgtgagtgtgtgcaaatgtttgtgtgtgcacgcgcacatgcatgtgtgtgcat

SEQ ID NO: 70369 - DNA, 85 bp, Mus musculus
ctggtgcctgtgggggtcagaagagagtgaccagtcccctgggactgcagttatggatggttctgagccaccctgtgggtgctgg

SEQ ID NO: 70370 - DNA, 58 bp, Mus musculus
ctgttgacactacagtggctgccatccccaccctggctcacactgtcagtgtgtgcag

SEQ ID NO: 70371 - DNA, 77 bp, Mus musculus
tttctgggtatagctggaagacaccacagccctgccatactgaggcatcacctctgtgtctatctctgtcctaggaa

SEQ ID NO: 70372 - DNA, 71 bp, Mus musculus
gatgacagaagattgacagcactggcaagaatggagctccatcagcctggctgctgtgagtgactgtcctc

SEQ ID NO: 70373 - DNA, 83 bp, Mus musculus
cagggaagaggtatgtgtatgcacacatgatgaggttatgcctattggtctctgattgtctctgtgtgtgaaccctctctttg

SEQ ID NO: 70374 - DNA, 88 bp, Mus musculus
cgttacccaaaagagactactcagtgtgcaaactagagctgaggtgctctgccgggtgcaggaagctggggactatgctggggatatg

SEQ ID NO: 70375 - DNA, 112 bp, Mus musculus
ttgcccttgctttttgtgctttgccaggttctctgtaagaccagtgacaacagaggctgcactgggcctagagggctgtcactgtgggactagaggggtggtagcaagggta

SEQ ID NO: 70376 - DNA, 70 bp, Mus musculus
tagagtcagggtctctcactgactcagctaggctggctggccagtgagttccagagagcccgtgtctctg

SEQ ID NO: 70377 - DNA, 66 bp, Mus musculus
ctgactgtccctctgacaggggctgccgtgttaagcctgggccctgtgttcagacaggaccttgag

SEQ ID NO: 70378 - DNA, 110 bp, Mus musculus
catttccccagggaaggggtgagcgccaggagggtctgacagatgacaggcaccacatggtcactgaaacctacctgtgacagaagcaccctcccagtgccagggatctg

SEQ ID NO: 70379 - DNA, 82 bp, Mus musculus
tctccaggcatgggtcgctgacaccgacttactaacacagccagtggcagaagacacagttgactcatgcacaggttggaga

SEQ ID NO: 70380 - DNA, 95 bp, Mus musculus
gcaaccttttcctggctcagtgtccgttttttgtgctctcccagactgacctaaagcccgagagtacagtgtgagcatacaggtatgtggggtgt

SEQ ID NO: 70381 - DNA, 80 bp, Mus musculus
atactactagtgtatgtgtgtctgtgactctctctgtgtgttatggggagaagggtagacgagccatagcacgagtgtgg

SEQ ID NO: 70382 - DNA, 128 bp, Mus musculus
tggctgccttcttatggacaggcaggttgtcaccaaagtctgtgctctccctgtctgtctgtccatctgtgaccatcatctctcagagtccttgtcccctagggtctgagtgctgatggtgaatggtg

SEQ ID NO: 70383 - DNA, 102 bp, Mus musculus
ggtttcctgttgcctttactgtgatagccagtcctgggaaggagactgtgtcagttgtctccctctctgtgtggtgtgagcaccaaggcagtaggctctgct

SEQ ID NO: 70384 - DNA, 70 bp, Mus musculus
gtgctgtctagagaggacaaggtgcggattcctaacacaggcacacacactgtcacgctctgaactccac

SEQ ID NO: 70385 - DNA, 93 bp, Mus musculus
gaccagccaggactacgtggtaagacgctgtctgcaaaacaagtaggaacccacacatgcaccgtctcacacactgtcacttccaagctggtc

SEQ ID NO: 70386 - DNA, 97 bp, Mus musculus
ggaggcaggcagagacacacagcacagtgtgcacacttcatttgtatcttatgtgtgcttacacgctcgctctcagtcagtctctcagtctctctct

SEQ ID NO: 70387 - DNA, 84 bp, Mus musculus
ggtttttgagacaggatttttctgtgtatccttgactgtcctggaacaatctctctctcactcacagagatctctgtctctgcc

SEQ ID NO: 70388 - DNA, 67 bp, Mus musculus
tacattcagctcacatttctctctgtgtgcgtgtacacatggggaccagaggtttgtgtcaggtgtg

SEQ ID NO: 70389 - DNA, 76 bp, Mus musculus
tcccagtcatccacgttgctgtccagctcgtcagtgtccacccctgagagaacagacaatagactgacccctggga

SEQ ID NO: 70390 - DNA, 82 bp, Mus musculus
gcctgagcattgtcttatgaagcaactcagtaacctccctggtgaccaacagggacactgtgtgtgtctcacagagcctggc

SEQ ID NO: 70391 - DNA, 79 bp, Mus musculus
gggtaggggccacgaagataagggctggagtagaggggtcccctttgctccatctctctctctctctgtctatctatct

SEQ ID NO: 70392 - DNA, 98 bp, Mus musculus
ggagagctgcagcagtggcagggtcagtctcagtctctgcatggagagagccgagcatctgaggtgtggagaaccagggtggctctgtagtagcctct

SEQ ID NO: 70393 - DNA, 84 bp, Mus musculus
ggtgaagcagaagggagcatgggtgaggcagacaggaaagtgagaagtaagcagagcccatcactgactctctgacgctgtgct

SEQ ID NO: 70394 - DNA, 83 bp, Mus musculus
gctgtctgcctgcttgcctgcctgcctgcagaggaacatgcctccaatcatgtgccaaggccaggtagtgagtgtgcaagagt

SEQ ID NO: 70395 - DNA, 91 bp, Mus musculus
tctgtagatcttgccatagcctttctgcttctccaggtctccgtgggccactggtgagatggctctggaagaaatcacagaagagaactgc

SEQ ID NO: 70396 - DNA, 72 bp, Mus musculus
gtgcctctctcactctctgcgtgtcggtatcaagtgaactttgtacattccggggggcggtgggagaggggc

SEQ ID NO: 70397 - DNA, 80 bp, Mus musculus
aaccttataaaactgagagggagcaggagagatggttcaccagttaagagcactgtctgctcttccagaggacgcaggtt

SEQ ID NO: 70398 - DNA, 65 bp, Mus musculus
gttttctgagacagtctctcactgagccgagagctcaccatggttagactgactggctagagagc

SEQ ID NO: 70399 - DNA, 107 bp, Mus musculus
gggtgcaggtccccaccgcctgtgcatcatccccttattctgcctattttcctgcaaagttgagagaacacggtgagcaaaggtgggggtcctggtgtgcgactggc

SEQ ID NO: 70400 - DNA, 87 bp, Mus musculus
tctttatcaaagatatttgttgaccagatatagagatgtatttttaaatatctttactgatcaaggcagcagggctatggatggaga

SEQ ID NO: 70401 - DNA, 114 bp, Mus musculus
gcccttcagtggagagaccaagcctgcagaggttagatgcatgcagaggatcagagaacactgtgacccacggctgcaaacttcctgcagggaaaagttgctttaagggtgggc

SEQ ID NO: 70402 - DNA, 99 bp, Mus musculus
tcttttaggcttttgactttggctgcctgcctgcctgtctgtgtgccttggccatttgcagcagtggcagggtttggttcggagttagacattaaggga

SEQ ID NO: 70403 - DNA, 231 bp, Mus musculus
tatgtatatatatgtatatgtgtgtacatgtgtgtatgtgtatatatgtatatgtgtgtacatgtgtgtatgtgtatatatgtatatgtgtgtacatgtgtgtatgtatatatatatatatgtatatgtgtgtatgtgtatatatgtatatgtgtgtacatgtgtatatgtatatatatatatgtatatgcgtgtgtacatgtgtgtatgtgtatatatgtatatatgtgt

SEQ ID NO: 70404 - DNA, 79 bp, Mus musculus
gtgtgtacatatgtgcatgtgtatatatgtgtgtacatgtgtgtatatgtatatatgtcatatgtatatgtgtatacat

SEQ ID NO: 70405 - DNA, 125 bp, Mus musculus
acagaatatatgtatatattcttgaatatatgtgtgtatgtgtatatatgtatatgtgtatatatgtgtgtatgtgtatgcacatattcatgcatatgtatatatatatgtatgtatacatatat

SEQ ID NO: 70406 - DNA, 75 bp, Mus musculus
tggttctctctatgtgtgcaagtgtgtgtgtgagctcatatgcacactcacacacacacttgcatacacaagcca

SEQ ID NO: 70407 - DNA, 106 bp, Mus musculus
gtggggaagtcaaggcaggaaccagaggcagctaattacgtcatgtttacagtcaagacacagaacagtgagtgctgaatcttagtactcagctcattttctctat

SEQ ID NO: 70408 - DNA, 83 bp, Mus musculus
tccagtgttttatgtcacggtcactgtcacacctcggcatctgtagtggtaagttggcaggtgggtgtcacgtgactcctgga

SEQ ID NO: 70409 - DNA, 96 bp, Mus musculus
tgtgtgtatgtttatgtatgtatatgtatttgtgtacatgcattttgtgtgtatatgtatatctgtgtatgtatatattttatgcatatagtatat

SEQ ID NO: 70410 - DNA, 75 bp, Mus musculus
atatatgtgtgtgtgtgtagacatgtgagtttatatgtctgtaggatgtatgtgtctatatttgtatatgtgtgt

SEQ ID NO: 70411 - DNA, 77 bp, Mus musculus
gtatgtggtatatgtgtgtatatgtatatatatatatatatatatatatatatatatatattcatgtttctgtgtat

SEQ ID NO: 70412 - DNA, 129 bp, Mus musculus
tgcacatgtatgtgcttatacacaggaatatgagagtgtgtgcatgtgtgcatgtgtgcatgaatgtgtgcaagtgcatgtgtgtgcatatggtgtgcatatacagtgtgtgtgtacattcgtgtatat

SEQ ID NO: 70413 - DNA, 65 bp, Mus musculus
acgtgctgttctctgtgtgtctgtgactgctggaaactgaacgcaggtcttcaggaacagtaagt

SEQ ID NO: 70414 - DNA, 68 bp, Mus musculus
gagaggggggctggagagatggctcagcggttactagcactgactgctcttccagaggtcctgagttc

SEQ ID NO: 70415 - DNA, 82 bp, Mus musculus
gcaaggttaggctacatgacaagaccctctctctcacacacacacacatgaaagagaaaacagagggtggtactgataatgc

SEQ ID NO: 70416 - DNA, 85 bp, Mus musculus; identical to SEQ ID NO: 57439

SEQ ID NO: 70417 - DNA, 97 bp, Mus musculus
gtgagatgggcatttttaggctgtaattatgagtgaattctgacaatatttatttttcagtgcttggcttatttcacttgcctcactgcaatctaac

SEQ ID NO: 70418 - DNA, 81 bp, Mus musculus
gcattagtctgacatgagtgagtgcacacagacgtataaagtctgggtctgaggtgtgcataggactcgtgtgttgtttgc

SEQ ID NO: 70419 - DNA, 75 bp, Mus musculus
tctgactcagtgtgtgtgtgtgtacatatatgtataatacatataattatatatgtacatatccatacatgcaga

SEQ ID NO: 70420 - DNA, 114 bp, Mus musculus
gagttctgagagattagagtgtgcaccttcacacctggatttttgacatgagttctgaggattgaactcaggtcatgccaagtcactgtgccaactgagccatctcccctgctc

SEQ ID NO: 70421 - DNA, 64 bp, Mus musculus
gggtttctgtgctcagattgcatcctgtagtctacctgacaggaatgtgtgagcacaggcatcc

SEQ ID NO: 70422 - DNA, 69 bp, Mus musculus
actgactctgtgtgtgtgtgtgtgcgcgcgcatgtgtgtgtgtgtgcatgtgtgcatgtacctgtttgt

SEQ ID NO: 70423 - DNA, 105 bp, Mus musculus
gctcttgtgtctccttaggctccttcagtctgtgacagtttcccagacttgtctttttgtaaacgtgagagttctgagggaagttggctgggtgttttgtagagc

SEQ ID NO: 70424 - DNA, 94 bp, Mus musculus
gtatatatgtctgtgtatgtatatgagtatatatgtatatatacacttatacacatatacatatgcatatatacatatacataaacatgtatgc

SEQ ID NO: 70425 - DNA, 115 bp, Mus musculus
tatgagaatgtgtactgtgcatgtttggatttgcatgaatgcatgcacacatatatttatgtgtgcaaatgcatgtggatgtgttaatgtgtctgtgtacatgtgtacacacatg

SEQ ID NO: 70426 - DNA, 66 bp, Mus musculus
ggaactgccaggcactcctccatagctgagctctgttactagctcactgcagtgtgtgacagctcc

SEQ ID NO: 70427 - DNA, 85 bp, Mus musculus; identical to SEQ ID NO: 57439

SEQ ID NO: 70428 - DNA, 83 bp, Mus musculus
gatgactgtcctcagggtgtctctgtggctcagctgcaagtccccacagctgaagacctagtaagcgccccactatcctcatc

SEQ ID NO: 70429 - DNA, 71 bp, Mus musculus
gtgtacacacagtctttgtctctctgttctggggagctcagagatcagggatgacttaggagtgggtatat

SEQ ID NO: 70430 - DNA, 120 bp, Mus musculus
atggctccctgtatacttgactatgtgtgtgctcatgtatatgtgtgtgtgtgcatgtgcatgtatgtgcatctgtgtgcatttgcatgtggagtcacaggtggaagttcggtgtcatgc

SEQ ID NO: 70431 - DNA, 95 bp, Mus musculus
tcgccagactggccagcatgttctcaggctctgcctgtctgtgccccagaattggggcttcagacacacactagctttatacgtggtactggtga

SEQ ID NO: 70432 - DNA, 74 bp, Mus musculus
gcaaggcttggcagcctgcctgtattccagccttggaaggcagagacaggatttcccagagctaacaggctagc

SEQ ID NO: 70433 - DNA, 81 bp, Mus musculus
cctactgagacatgtgaaggcacgtgactctgattcactctcaccctcgcctttcctgtatctcactgcatgtctctcagg

SEQ ID NO: 70434 - DNA, 115 bp, Mus musculus
acatgcatgtatgtgtgtgtgtactgacatgcatgtgtgcatgtgcatgcatatgtgtgttctgacatgcacatgtgcatgtgtgtgtatgtgtgtgtgctgatatgcatgtgtg

SEQ ID NO: 70435 - DNA, 115 bp, Mus musculus
ctgcatgtctctgagttggaggtgggacaggtgactgccaggaccagtgggtactatctcactgtctggctctgcctaccatgttccccaaatctctgcttgttgttacctgaag

SEQ ID NO: 70436 - DNA, 117 bp, Mus musculus
gtgtgtgtgtgtgtgtgcacgctcatatgagtatgcctatgttaacctatgtgtatatatatatctatatctgagtgtggagtgtattcttgtgtgtgtgtgtgtgtgtgtgtgtgt

SEQ ID NO: 70437 - DNA, 71 bp, Mus musculus
gcttgttcatgtgtgtgcatgtccatgtgtacaggcacaggtacacatgtgtgcatgcacatgatggaggc

SEQ ID NO: 70438 - DNA, 113 bp, Mus musculus
gctgtacatgcctgaggccccatggcctttgtcttggctgccatcttgatcacagaagaaagagtcccttagcctatgcaagaggtgatcaggtctctcctttgccagtaagc

SEQ ID NO: 70439 - DNA, 83 bp, Mus musculus
gtatgtgtgtgtgtacatgcatatgtaaatgtatgtatttatacatgtgtataaacacatgtatgtatttatgtatgcatgtg

SEQ ID NO: 70440 - DNA, 71 bp, Mus musculus
gctgtagactcacttactagccgtcagtcattttaacacattgtgacacgctctctgtgagactatccagc

SEQ ID NO: 70441 - DNA, 85 bp, Mus musculus
tctggggtcaggttcaaggtagtatggtgggcttctgctccagtgggaattaggggcaaatcttactgtgaattgagctctcaga

SEQ ID NO: 70442 - DNA, 69 bp, Mus musculus
gtgtaaggaagtaatagggccatagctgtgcttttaggggcactgtcacactgttactgtctcaggcat

SEQ ID NO: 70443 - DNA, 62 bp, Mus musculus
acagttaagacggaaggaggatagaactgggttttggacctggctctctcagtctctgctgt

SEQ ID NO: 70444 - DNA, 71 bp, Mus musculus
gagactgtctctcactgaccctagcactcaccagttcagccatgcctgctggccagtgagacccaggactc

SEQ ID NO: 70445 - DNA, 88 bp, Mus musculus
tatgcatgtgtatgtatatatgtacatgtgtatgtatatatgtatgtatgtgtgcatgtgtgtatgcatgtatgtgtgcatgtgtgta

SEQ ID NO: 70446 - DNA, 113 bp, Mus musculus
cagaggctgggtagcccatccctggctggctgtatgctgaagaaatggagaacaaaaacactcactctgtgagtctgctgctgccggcctggatgattcctggtgagctgctg

SEQ ID NO: 70447 - DNA, 108 bp, Mus musculus
ggggtagggggagctgtaggagacctggagtggagaggattaacatatgttgcatgtatgatattttgtttttgaatcaggctctcactatgtgtctctgtctaacct

SEQ ID NO: 70448 - DNA, 78 bp, Mus musculus
tcccttgagacagggtctctcactgaatctggagctcggctagcagccatcagttcgtctgccctggcagcactggga

SEQ ID NO: 70449 - DNA, 80 bp, Mus musculus
cttagtgcagggctggagagatggttcagcggttaagagcactgactgctcttccagaggtcctgagttcaattcccagc

SEQ ID NO: 70450 - DNA, 117 bp, Mus musculus
gctgtcatcagacacgtgctagatggcttgtagacgcttgcttgcagacgtgtagagctgacagtgcacagacacaagaagtcatcttagaaaacgtgactgatgggttctcccagt

SEQ ID NO: 70451 - DNA, 119 bp, Mus musculus
tattataatgcgaagtgtgggccctcaaggcctggttgttccagagacaagagagtctgcatgtagacccaagtgtttctctgtgaccttgcccccaagttatttctgattggtgaata

SEQ ID NO: 70452 - DNA, 94 bp, Mus musculus
ctgaagttatggctggttctgagctgtcctgtgagtgctggggatggaacccaggtgctctgaagtgtgtgagctctggggctgcagacttgag

SEQ ID NO: 70453 - DNA, 76 bp, Mus musculus
gagtggggctctggcacccatgggctgtatgtcctaagacggggcacgcactctctgtggggctcagtgtctcatc

SEQ ID NO: 70454 - DNA, 62 bp, Mus musculus
gctcttgttggagtggagagcataggaagacatcaggtgtcctgctctgtcactctctgggt

SEQ ID NO: 70455 - DNA, 61 bp, Mus musculus
tgtgctcgctctcagtctgtgtgcctggctcctgtgtactgcagacttaactgcaggctca

SEQ ID NO: 70456 - DNA, 132 bp, Mus musculus
ccaccatcaactgtgactctgctatggaatgttctagaatgtagacgtgtgccccactccctgtctgtgacactcagagcttatgtagttggtaaggcttttcatggtggctttgggtcttgtggatgagga

SEQ ID NO: 70457 - DNA, 87 bp, Mus musculus
cacgtgccaccagtctctgtgtctgagaccagctgtgggtatggcacttgctgctggggcctcagaaaggggaggcgcctggaatgt

SEQ ID NO: 70458 - DNA, 121 bp, Mus musculus
ccaattaaatgttgcctttataagagttgtcttggggctggtgagatggctcagtggttaagagcactgactgctcttccaaaggtctcgagttcaaatcccagcaaccacatggtggctc

SEQ ID NO: 70459 - DNA, 67 bp, Mus musculus
ccactgagagctagagagataactcagtgttcattaacattaagagcactggctgctcttccagagg

SEQ ID NO: 70460 - DNA, 73 bp, Mus musculus
gctgtagcagtgggtgtgactcagtgtctgcctgctgtcaggcatggcacaggaatagccatacccactcagc

SEQ ID NO: 70461 - DNA, 81 bp, Mus musculus
gggctacagtggaaccaaaggaggcgagtgatacatcagcacaagccctgactctcactcggtgcctcagctgctgagcct

SEQ ID NO: 70462 - DNA, 108 bp, Mus musculus
tagaaactgaggacactgagagcaaatctttacaatatgacatgtacatctatttatttatttgtcaccttattgtggatatgaaattgccttcatcccagcatgcta

SEQ ID NO: 70463 - DNA, 73 bp, Mus musculus
gtcctagaacttgctatgtagaccaggctggtcttaagagatcagtctgtctctgcctcccaagtgctaggac

SEQ ID NO: 70464 - DNA, 97 bp, Mus musculus
cagatgaagtcagaacaacccaatacttcctctaatcccagcataaatgcagacagaagagagaaaccacttggtttgttctgtatcaccttatctg

SEQ ID NO: 70465 - DNA, 80 bp, Mus musculus
gctagaggaagtgtgtgactagggggtagatttgggttttcaaatactcaagtcaggcccagtctctctctccctgctgc

SEQ ID NO: 70466 - DNA, 106 bp, Mus musculus
cttaggttgtttttaatcttagccattctgatgagtataagatagaatcttggttgttttgatttgcatttccctgatggctaagaattttgaacatttctttaag

SEQ ID NO: 70467 - DNA, 102 bp, Mus musculus
gagccatctcaccagctccccagaaagatttcttaagtgcttgtttctcacacacaaacactcattgaggaaaatctgctggagtatgggagatttttgttt

SEQ ID NO: 70468 - DNA, 75 bp, Mus musculus
gcagggaggccagctattccagtggctgagctctgaacccatttatggtcacacactgtctgtctgtctgtctgt

SEQ ID NO: 70469 - DNA, 86 bp, Mus musculus
tggtggctcacaaccatctgtaatgagatctgatgctgtctgaagacagtgacagtgtactcacatacgtgatcactgagtaacta

SEQ ID NO: 70470 - DNA, 87 bp, Mus musculus
gtgacatccaagaagactaaagagagagacctgaggggtttgccctgttttaaagtctcctttggtgtgtgtctggtatgtgtgcac

SEQ ID NO: 70471 - DNA, 66 bp, Mus musculus
gccctgtctgtctgtctgtctgtctatcttggagacaaggtctcaaataggctgatctcaaatggc

SEQ ID NO: 70472 - DNA, 82 bp, Mus musculus
agcctttgcagctttttcttaatgtcgggagcggactgaccaatgaaggccatggctacagtggctctctgcccctctgaca

SEQ ID NO: 70473 - DNA, 69 bp, Mus musculus
gtctgtgtctctctctgtgtatgtgtgtatataaatttaatatatacagtgtgcatagactaccacagc

SEQ ID NO: 70474 - DNA, 94 bp, Mus musculus
ggtactaaggggctggagagatggctcagtggttaagagcactgactgctcttccgaaggtactgagttcaattctcagcaaccacatggtggc

SEQ ID NO: 70475 - DNA, 109 bp, Mus musculus
cacactgtctgtgtggctatgtgttcacatgggagctattgtcacactgtctgtgtgggtgcatgagcacagctgcctttagaggccagaggcgccatgttcccccaga

SEQ ID NO: 70476 - DNA, 69 bp, Mus musculus
gtcagaggtgcgcctgtctctgtctctcagcactgggaataaaagcatgaggcgctgccaccgcctggc

SEQ ID NO: 70477 - DNA, 129 bp, Mus musculus
ggcatttgttttttaggagtgtgtatgtgtgtatgtgtgtgtgtgtgtgtgtgtgtgtacatggtgttcatgtgaaccatgcacatttgtgtgtgtgcatgtgcatgcagaggccagagatcacactca

SEQ ID NO: 70478 - DNA, 83 bp, Mus musculus
tgagacaggacatgctgacccctgcctaaggactgggacagttctcatcctccagaccttgacagtcactgtcactgtcctca

SEQ ID NO: 70479 - DNA, 114 bp, Mus musculus
cctgccggacttttggtcgtttctacctggggctgtaagagttcagagtgtggtgaggcaccttaaaacgcactgagcgtgtggttttaggaggttacagcaggtgctgtcggg

SEQ ID NO: 70480 - DNA, 122 bp, Mus musculus
ggcgcagaagtcgctggggggggggggggggaatggggatggggggcggggacactgcctggctgcctctgtccctggccagctgcctctgcatcctgtcccagcagctctcatcccagttc

SEQ ID NO: 70481 - DNA, 117 bp, Mus musculus
atatatatatatatacacacatacatatatatgtatatgtatatgtatatatacatatatatgtatatatacacacacacatacatatatacatatacgtatacatatacatatata

SEQ ID NO: 70482 - DNA, 100 bp, Mus musculus
atatgtatacgtatatgtatatatgtatgtgtgtgtgtatatatacatatatatgtatatatacatatacatatacatatatatgtatgtgtgtatatat

SEQ ID NO: 70483 - DNA, 88 bp, Mus musculus
tgtgcatgtatgtgcatgtgtacctacctgcttacacatgtacacctctacacaaaagcacacacacacacacacacacacacacaca

SEQ ID NO: 70484 - DNA, 66 bp, Mus musculus
gcacagggaggagtgggcagagagaggggtaggatgcttgaccgtctgtctgtctgtctgtctgtc

SEQ ID NO: 70485 - DNA, 88 bp, Mus musculus
tatatgcacacacacatatatatgtgtatatgcacatatatgtatatatacacatatatgtatatatatgtgtgtatgcatatacata

SEQ ID NO: 70486 - DNA, 83 bp, Mus musculus
gttttatatacatatatatgtatgtatatgtgtgtgcatgtatatgtatatatgtgtatctatgtgtatgtatgtatatatgc

SEQ ID NO: 70487 - DNA, 95 bp, Mus musculus
ctgccaagtgcctgctgtaagcctgatgtgatcctatgtccacagatgatagtgtggaaaacatggcaacatggggtccctcacaggtagggtgg

SEQ ID NO: 70488 - DNA, 105 bp, Mus musculus
ttatttgtttgtctatctgtttgtttattttaatgtacactgtgtacttatttttttataagtacactgacgctatcttcagacacaccagaagagggcatctga

SEQ ID NO: 70489 - DNA, 81 bp, Mus musculus
gaatttggaattcaggggctggagagatggctcagcggttaagagcactgactgctctaccagaggtcctgagttcaattc

SEQ ID NO: 70490 - DNA, 82 bp, Mus musculus
gttgggagtgtgattgtctgtcacactgacagttccctcaaactagatagagcccgtctgccagatacacacacacacacac

SEQ ID NO: 70491 - DNA, 78 bp, Mus musculus
gtctgtctgtctgtctgtctgtctgagggcctggccatggagctcaggctggtatgaaactcattaactagtccaggc

SEQ ID NO: 70492 - DNA, 88 bp, Mus musculus
ggatgtggcaacacaagccctgagcagggtacctcttctaacttcatggattaaacagtctgactcagtggctgcgtaccacaaagcc

SEQ ID NO: 70493 - DNA, 100 bp, Mus musculus
tttggagagatgtcttaactgttaagagtgtgtgcagtcagccgggtgtggtggtgcacgcctttaatcccagcacttaggaggcaggcggatttctgag

SEQ ID NO: 70494 - DNA, 86 bp, Mus musculus
agagaatgcatatgttttggcacagacagcttaacgggactctctgtccctgtgctggagactggcacaaaacaggctccgtatct

SEQ ID NO: 70495 - DNA, 70 bp, Mus musculus
catgatatatacactctctgcataggctctatacatatatacctgtgtctgtgaggagagtgggtagatg

SEQ ID NO: 70496 - DNA, 78 bp, Mus musculus
gggtgtgtctgtgtctgagtgaagagcattatagctgagggagcattctgagcataggtctgaggcaagagtgtgccc

SEQ ID NO: 70497 - DNA, 101 bp, Mus musculus
gaattcgggagtctaaagctctaggttccaatctgagttgtaccatttcctacatctgtgtctctgtgtgtgccttcccagagcctccttttccccagttt

SEQ ID NO: 70498 - DNA, 95 bp, Mus musculus
agccccctaaacagctggagatagctcagcagttgagagcactgactgctcttccagagatcctgagttcaattcccagcaatcacatggtggct

SEQ ID NO: 70499 - DNA, 89 bp, Mus musculus
gatcaggagaggggtactgtgctgttgcccacagtctgctttagaagcagtctttaagagtgacacacacagtctgaccattcataatc

SEQ ID NO: 70500 - DNA, 70 bp, Mus musculus
tctgggggtcacacaagtgagaggtcacacagtgaggcatcacagtgggcaggctatacttactgctaga

SEQ ID NO: 70501 - DNA, 113 bp, Mus musculus
gggagtccaactgtctctatgatcctgtgattctgggatcctgtgatcctgagaccctgagaccctgagaccctgaggtgtcagaacttctgggagtcaagctgcctttgggt

SEQ ID NO: 70502 - DNA, 76 bp, Mus musculus
atatatatgtatatgtgtatgtatgtatgtatgtatgtatgtatgtatgtatgtatgtatgtgtgtatgtgtatgt

SEQ ID NO: 70503 - DNA, 96 bp, Mus musculus
ggatgaataagaaacaaagtatattgttaatttattaaaattttattctttgagaatttcatatatgtacacaatatattttgtatatatacatcc

SEQ ID NO: 70504 - DNA, 85 bp, Mus musculus
cagaaaagattagaagtaccccaccattaagctagccaaggcatattgaaattagctggtgtgtgtgtgtgtgtctgtctgtctg

SEQ ID NO: 70505 - DNA, 118 bp, Mus musculus
cagcactaaatggacttgtatctgcatctatatctgcatctgcatctgcatatgtatatatgtatattgttgagaggaggtggggcaatagaagttggagaagggatggagattggtg

SEQ ID NO: 70506 - DNA, 85 bp, Mus musculus; identical to SEQ ID NO: 57439

SEQ ID NO: 70507 - DNA, 85 bp, Mus musculus; identical to SEQ ID NO: 57439

SEQ ID NO: 70508 - DNA, 121 bp, Mus musculus
tacttgacctttttcccttactgcttttagtattcaatctttatttagtgcatttgttgttctgattattatgtgttggaatgaatatttttctggtccagtctatttggggttctgtagg

SEQ ID NO: 70509 - DNA, 85 bp, Mus musculus
aagttgtagatgatgtttggctcagggtctctgtcttagtcagggtttctattcctgcacaaacatcatgaccaaaatgcaagtt

SEQ ID NO: 70510 - DNA, 77 bp, Mus musculus
acctgacaacctgagttcaattcccaacatctatgtgatagaatagaagaatgaatttccacaggttgtcttctggt

SEQ ID NO: 70511 - DNA, 85 bp, Mus musculus
aagttgtagatgatgtttggctcagggtctctgtcttagtcagggtttctattcctgcacaaacatcatgaccaaactgcaagtt

SEQ ID NO: 70512 - DNA, 110 bp, Mus musculus
agctgtgtcaagttgacacaaaactagccagtacagtctgataggatgcatgggacaatttcaatatttttgtatctgttgaggcctgttttgtgaccaattatatggtt

SEQ ID NO: 70513 - DNA, 100 bp, Mus musculus
gatattgtaaactatgagtgttacagactcactgtcagaatccaggatgcttcatccttatgataacagtggtgctgtgggcatgcaggcttgcttcttc

SEQ ID NO: 70514 - DNA, 84 bp, Mus musculus
acactgtgtgactgtctctgtgtgcttacttgttctcttcaaataattaggattaattagcacacggaacttcatgtctggtgt

SEQ ID NO: 70515 - DNA, 95 bp, Mus musculus
gttaattaatgtttctcctatttttgagtgcatgcatgtgtgtgtgtgcacacatggatgtgtgcattcctgtgtatgggtggcctgagaataac

SEQ ID NO: 70516 - DNA, 61 bp, Mus musculus
gctccatccactgtttggctatgggtgtctgtatctgtctgagtcagctgttaggtggagc

SEQ ID NO: 70517 - DNA, 65 bp, Mus musculus
tctggccctggatagacacagcatcaagtctttcgggctggatctctgtgactgtctattacgga

SEQ ID NO: 70518 - DNA, 117 bp, Mus musculus
gctcctttcacaagctcaggatcctctcggggttgcttgtctccctgtggctctgtctcagaagctggcctcggagccagagtctcctgcctcccagaggcatcctgctctgagggc

SEQ ID NO: 70519 - DNA, 78 bp, Mus musculus
gtaaaagtggatttaagtgtccttgggactaagggctagagagagagctcagaggctaagagcacttgctgctcttgc

SEQ ID NO: 70520 - DNA, 68 bp, Mus musculus
agagtgagaactcactctagagactcacaattcccctccagtcgtgtctgtctctgtgagttaagtct

SEQ ID NO: 70521 - DNA, 89 bp, Mus musculus
cttttcctctccttaagttgattcaggccatagaatttgtcacagcacccacgatgaagctagaataggatattaaggaggtgaatgag

SEQ ID NO: 70522 - DNA, 112 bp, Mus musculus
tcaagatcagtggatgctcttgcagaggacctgggttcggttcccggcactcacacagtgacttagaactgtcctcaactcccaatccaggggatccaacaccctcatctga

SEQ ID NO: 70523 - DNA, 66 bp, Mus musculus
ggtgtcagctgtatgtgtggggaggcacaggcaggttgtctatgtctctgacacagtgcgattacc

SEQ ID NO: 70524 - DNA, 119 bp, Mus musculus
ttggacctgttgttcaaggtgtttcctaccagacttctcctcggccgtggggaacactgaacactgtgtgctccgttctgagtgacatgggatagacactgctgttcatcggagtttaa

SEQ ID NO: 70525 - DNA, 84 bp, Mus musculus
gccagtgctgcttcctgtaggcgccattttaccatggaggaaatgccacacaggtgagtgaggtgactgtcagtgctcactgtc

SEQ ID NO: 70526 - DNA, 96 bp, Mus musculus
ttttaggagtagaaagcgtttacagccgacacttggcaggacggacagtcttctgctctgtgggtgagtgtctgtgtctgagtctgtcccttagga

SEQ ID NO: 70527 - DNA, 76 bp, Mus musculus
ggtttctctgtgtgactgtggctgtcttgggaacttgctctgtagaccaggctcacctaaaactcagagatttgcc

SEQ ID NO: 70528 - DNA, 116 bp, Mus musculus
actctgtaggtcaggctggtctctacatcagagtttcctgcctctgtctctgcctccctgctgggattaaggcatgcaagtactggtgtgatctccactttcagcaagttctcagg

SEQ ID NO: 70529 - DNA, 111 bp, Mus musculus
tgccttttaaaggacttcagcaactgatgatcccctgcctgtactaaaccgtgcatttattttttttaaacagtgcagttatgagggttgcaagaaggcctttaagaagca

SEQ ID NO: 70530 - DNA, 108 bp, Mus musculus
gagatactctaattgggttcatactgaagaatgttagcagaaaagtattgaaaggtttttttgtttgtttgttttttgtttttgttttttttcgagtcagggtttctc

SEQ ID NO: 70531 - DNA, 129 bp, Mus musculus
ccaggtcacgtcatgcatctcatctcaagggaggatgtggggaaagcctgggagctgacacaactcacttagctccctactcgcttgcctgtgggctgggaatggaagcctgactgaggaaaagctccc

SEQ ID NO: 70532 - DNA, 60 bp, Mus musculus
gcctctctgcctctctgcctctgcctcccacgtgctagggttaaagttccccagtgaggc

SEQ ID NO: 70533 - DNA, 120 bp, Mus musculus
gtatgggatgctgtatgggatacaggaaagacttggggctccacctttatgtgtctggtaatgaccctaagatggcgttcatcatccatagattccagaccactaatagtggggtcttag

SEQ ID NO: 70534 - DNA, 64 bp, Mus musculus
tatgtatgtgtatatgtatacatgtatgtttgtgtacatatatgtgtgcatgcatatgtgcata

SEQ ID NO: 70535 - DNA, 88 bp, Mus musculus
ttctctcccccagtctcccactctctgaaatccctgagctcaagaccacaggagggagtgagggaaggagagagagagagagagagag

SEQ ID NO: 70536 - DNA, 74 bp, Mus musculus
gtagcagatgtacagcttggtcttcatttgggtccttcaacaattggaactggggctgtctctgactctgttgc

SEQ ID NO: 70537 - DNA, 100 bp, Mus musculus
tgtgtgtctggtacccatggaggccagaagaggacactgtatgcctctggaactagagtgaagggcagttgtaaagtcactgtgtgggtgctagaaacca

SEQ ID NO: 70538 - DNA, 105 bp, Mus musculus
tgtatatgtatatgtgtatgtatatatgtattgatgtatacacacacacacacacacacatacatacacatatacatatacatatatacaaaatacacatataca

SEQ ID NO: 70539 - DNA, 118 bp, Mus musculus
tgtccaaggggaaacttggagtagtgtctacctcctgctcagtgtctcagccactctctccattctgctggagcgaagactccaggaatctgggcacatccttccccttgctggtaca

SEQ ID NO: 70540 - DNA, 97 bp, Mus musculus
tttgtgagcctcagtaacatgctggatttgagagactggggcaaatctaggtgccatcagctagtgccttctattgttctaactactgacttaaaaa

SEQ ID NO: 70541 - DNA, 89 bp, Mus musculus
agaggctgtaccaacgcgaggtgctcaccgggagggttgaaaggcaggtggttcactctctcggagtctggcagttggcagaggtctct

SEQ ID NO: 70542 - DNA, 117 bp, Mus musculus
gtaaaatatagctacaaaaggaaggggtgagaggacttaaatacaggacatggatatatatttctattttgtctcataggttggttttaattttttcttcatcttctgtgactttac

SEQ ID NO: 70543 - DNA, 77 bp, Mus musculus
cctggatggtcctggatgtgtctgggcatttcccagccccctcttctgcctcagtctctgtctccatgcccatcagg

SEQ ID NO: 70544 - DNA, 115 bp, Mus musculus
cccagagcaacagggacaaccaacagtgggttgaagttgtgtgctccaatcagatttctctctctctgagttgacttatttcagccctctgttatggtgacagaaggcatcaggg

SEQ ID NO: 70545 - DNA, 117 bp, Mus musculus
ctgtctggacatttggttctgtgtcccgccaagttatgtgatcgatatcctgacctcaggggctctgtctgtctgaggcgaggcacaccctgtggagacgacagcgccatggacaga

SEQ ID NO: 70546 - DNA, 72 bp, Mus musculus
cagtggaggccagaagtggatcagatcccctagatgtggctctgggaaccacgcttctctgtctgtcatctg

SEQ ID NO: 70547 - DNA, 70 bp, Mus musculus
tcacgtttccagtgggagctatgcaggctgcagcgggagaactgtcagccacagtctcactcagcagtga

SEQ ID NO: 70548 - DNA, 124 bp, Mus musculus
gactccctctgacagtgagctacgtggcatgctttgtgactgttagaaggattgggagcacattgatgtgagtgaccacagaggcttcgaagtagaatggtggtcctagatgcgaagttctttc

SEQ ID NO: 70549 - DNA, 89 bp, Mus musculus
gcctaccctgtatgtatgtatgtatgtatgtgagacaatgtttctgtgtaaccccagctgtcctagaacttactgtagatcagggtggc

SEQ ID NO: 70550 - DNA, 57 bp, Mus musculus
ggaaggaatcgtgatgtgagtgagcacagagcacacctccagcagcagatttcttcc

SEQ ID NO: 70551 - DNA, 110 bp, Mus musculus
acagagagagaaaaagagaaaagagagagagagagagacagagagacacgaggagcatggttacttgtaagaatcactgtgactttactgagcctctctgtcacagtctc

SEQ ID NO: 70552 - DNA, 114 bp, Mus musculus
gaggtttatgccagaaatggttatagtacccgatacttagattcaactctttttgtatttgttaaatctggtaataactggttctcctaaccataattacattctgattacttc

SEQ ID NO: 70553 - DNA, 77 bp, Mus musculus
actcacaaccatctgtaatgggatctgatgccctctgctggtgtgtctgaagacagagtactcaggtgtgtgtgtgt

SEQ ID NO: 70554 - DNA, 118 bp, Mus musculus
ccagcccactaaagactggatcaagggaagtgagataattctgcagaaactcttagtgagcagagagtgaggatttgcaagggtggcttaagaaacaatttcatatttggttttctgg

SEQ ID NO: 70555 - DNA, 118 bp, Mus musculus
gaaggcactcgggacacagttgtaaggaccctttctagagtgactccttcttgaaagctgaagtgagtgtggtctgcgagcatggtaagtggaaggttctagatgtctgtcggatagc

SEQ ID NO: 70556 - DNA, 86 bp, Mus musculus
gtctgtctgtctatctgtctgtccatagtctatcttgtatacaaataagtatatgaaggattacaaggacctgatggcgttctggc

SEQ ID NO: 70557 - DNA, 73 bp, Mus musculus
atctagaccaaccatctccatccattagatgcagaggtatcagcgagggtggagagagaggacagtctgtggt

SEQ ID NO: 70558 - DNA, 63 bp, Mus musculus
agtcaagactaggatccactgggagggacacatgctgtctgtctttctgtgcctggcttacct

SEQ ID NO: 70559 - DNA, 89 bp, Mus musculus
cagctgtggagaggagggactctctgtggctcagctgcctgcaaactgagcagggggctccagagtcccgtcccccacccccacccctg

SEQ ID NO: 70560 - DNA, 96 bp, Mus musculus
tcactggagaaaggaaactggagcagaacacagaagtgtgtgatcacccaagaaggtcgtctttaactctgtgacctcagctaaaggccgtcatga

SEQ ID NO: 70561 - DNA, 71 bp, Mus musculus
gaaatgggaagggctggagagatggctcagaggttgagagccctgactgctcttccagaggtcctgagttc

SEQ ID NO: 70562 - DNA, 74 bp, Mus musculus
catgtcccagaattcacaggcagttttgagcaggcagcagcgtctgtgcaactctcctgttgaatgggctcatg

SEQ ID NO: 70563 - DNA, 115 bp, Mus musculus
gccaccctcatggtcctaggctgaggcacccagctgttctgagtagtgtgtgtggactccgtgtgtcccgagagcagtctgaggtgagcctgctggatggccactgggacttggt

SEQ ID NO: 70564 - DNA, 97 bp, Mus musculus
catttttctcttactaacaattatttttagatgttctattgatcatatatgaaatgatagtttatttacttattataaggttagtgagcataaaatg

SEQ ID NO: 70565 - DNA, 96 bp, Mus musculus
gctaagatattgagcctttgctcttgggctggagagatggctcagtggttaagagcactgactgctcttccagaggtccggagtttaattcctagc

SEQ ID NO: 70566 - DNA, 61 bp, Mus musculus
ggccatgtctagcagcaatgcatgctgtaaccatagcatctgtgtctctctgccactggcc

SEQ ID NO: 70567 - DNA, 100 bp, Mus musculus
tccttttgcggcccacctttctctttggtaatcaaggtgacttattcttctttttagactagttttttttttttttcccggcgaggtctgggctcctgga

SEQ ID NO: 70568 - DNA, 66 bp, Mus musculus
gtatgttgtattatgtatgtatgtgtgtatgtatgtatgtatgtatgtatgtagtattgattgtac

SEQ ID NO: 70569 - DNA, 71 bp, Mus musculus
gggcaggacgtgaggcagagctgggatgtgcaccgaggggtcacagccgtgtgcttttcttctgatcatgt

SEQ ID NO: 70570 - DNA, 57 bp, Mus musculus
tatgtatatatgtatgtatatatacatataatgtgtgtgtatatatgtatgtatgtg

SEQ ID NO: 70571 - DNA, 64 bp, Mus musculus
gctcagtcacagctgaggctgggaacagtgtcagtcactgtgttcccggtagctagctatgagt

SEQ ID NO: 70572 - DNA, 91 bp, Mus musculus
gtcttggaacttgctgtgtagatcagactggctttgaactcacagagatctgtctgcctctctgcctctccaatgctggcgagctaaagat

SEQ ID NO: 70573 - DNA, 64 bp, Mus musculus
gcttggggctggagagctagctcagcagttaagcgcactgactgctcttccagagatcccgagt

SEQ ID NO: 70574 - DNA, 105 bp, Mus musculus
catgtgtatgtactacatatataaagcatatatgtctgtacatataaataacatgttttatttatatacttaggatatatattatacatttcatttatatacatg

SEQ ID NO: 70575 - DNA, 104 bp, Mus musculus
aatatccagttactgagttttatctttgaagtcctaaagtgcgtatatgttcagtgtctcactgtgtgttttcttgggtgcattactcattgtgacgagatgtt

SEQ ID NO: 70576 - DNA, 74 bp, Mus musculus
catatgagtgtgtatatatgcgtgtgcagctgggtgtctcagtgtatgtctgtgtgtctgtgtgtgcatctgtg

SEQ ID NO: 70577 - DNA, 66 bp, Mus musculus
gtatgtgtatttgtatgtgtatgtatgtgtgcttgtgtatgtatgcatgtgtgcttgtgtgtgtat

SEQ ID NO: 70578 - DNA, 68 bp, Mus musculus
cctcggacagggagagatcaggcatgtatgtatatgaatgtgtgcatgtatttttctatttgttcagg

SEQ ID NO: 70579 - DNA, 67 bp, Mus musculus
cccagctgtgtgatgtctgggaccagctttcaaaagagacttgacctgggacgtgagctaccctggg

SEQ ID NO: 70580 - DNA, 115 bp, Mus musculus
tggttgctagtgttgtgaaatgcatcagagaggtgtggtctgagaggctcactcccacagagcctctgcacacccttcctgtgcagcttgctttgtctgtgcatctctactgcca

SEQ ID NO: 70581 - DNA, 116 bp, Mus musculus
ggggacagttactcactagctttgcagtctcgggcaacactgtctctggctccgtggatgccacatgagggacattatgaagctctggtgatgcggagcacttgtcactgggtgcc

SEQ ID NO: 70582 - DNA, 121 bp, Mus musculus
cacccttgctcccttccccctttccctctttatctcctgtctttgtcccttatccctgcctctgtccctctgtggcaaatcgtcttcttgggctgagaatatcgagttgggtgtcttgagc

SEQ ID NO: 70583 - DNA, 76 bp, Mus musculus
gctgagagttctacatcttgttctgaagacagacaggagactgtctcctacgtggctaagaggagggtctcaaagc

SEQ ID NO: 70584 - DNA, 75 bp, Mus musculus
gtgtgtgcgcgcacatacttcaacaaacacatctgtaactctgcgtgtctgtgtgtgtctgtgtgtgcgtactac

SEQ ID NO: 70585 - DNA, 93 bp, Mus musculus
agaaaaagtgaggcatttcattacatacgaacgtatgtatgtatgtatgtgcgtgcatgtgcgtgtgtgtaattttccttaaaaaaaagttct

SEQ ID NO: 70586 - DNA, 116 bp, Mus musculus
tgtgttcctttataagagttgtggtttggctggagagatggctcagcggttaagagcactgactgctcttccagaggttctgagctcaaatcccagcacccacatggtggctcaca

SEQ ID NO: 70587 - DNA, 110 bp, Mus musculus
tgagttctgagagcaaggtagtatgacactaagacactaagaagagagaagtgaatttcttgttacttgctcttccatcttttctgcacctcagcactcagtggccctca

SEQ ID NO: 70588 - DNA, 114 bp, Mus musculus
tggtataaatgtggccttttgggctggagagatgactcagaggttaagagcgctgactgcacttccagaggtcctgagttcaattcctagcacccacatggtggctcacaacca

SEQ ID NO: 70589 - DNA, 102 bp, Mus musculus
gagtgacatcagactgtagagatggcttcgtggttaagaagagcactgactgctcttccagagatcctgagttcaattcctagcaacctcacgatggctcac

SEQ ID NO: 70590 - DNA, 100 bp, Mus musculus
tcaaagagagactctctctctctcttacacacacacacacacacacacacacacacacacacacacaaataaaaaggggggagggggaggaggaagatga

SEQ ID NO: 70591 - DNA, 74 bp, Mus musculus
cccaggcagccaagctgactagatttgtgggtaaggcagcgcctcactcacactctgagagccaggaagcaggg

SEQ ID NO: 70592 - DNA, 71 bp, Mus musculus
gctgtcaggtccaggaaagaggagagaggtcccggtcctgccggggtctctctgagcctgagcaggatggc

SEQ ID NO: 70593 - DNA, 82 bp, Mus musculus
gcttgtggcttaagatgtgagttctgccaggtccacttcccacctggcgccatggactctcaccctctgacactgtaagcca

SEQ ID NO: 70594 - DNA, 98 bp, Mus musculus
atgtttatatgatatatgtatatgtgtgcatatatgtgtgtgtgtatatatacatgtgtatatatatatatatacatatatatatctgtctatctatc

SEQ ID NO: 70595 - DNA, 108 bp, Mus musculus
atatgtgtgtgtgtatatatatatatatgtatatatgttctagtatatattggctctagtatatatatacatatatacacatatacacatatacacatatacacatat

SEQ ID NO: 70596 - DNA, 99 bp, Mus musculus
acaaaggattgggtaagtactggctgatctctggggaaatggcaggtgtttgcctgcatctgtctgtctgtttgtctgtctgtctgtctgtctgtctgt

SEQ ID NO: 70597 - DNA, 103 bp, Mus musculus
ggcggagggtactggacttagtgtagagcaagctgggccctaagaaaaacatgttcctgctcttgctccagccttgacttctgtgtcttaattcttcttctcc

SEQ ID NO: 70598 - DNA, 58 bp, Mus musculus
gcaggctgtgggaggcccagtgctgtctgtctgtctgtctgtctgtctgcctgcctgc

SEQ ID NO: 70599 - DNA, 91 bp, Mus musculus
tggccttagagtcagggttaggcttcagtcactctaactgtgacctgatgggaacagaaagccagactgcaagtaatgacatgataggtgg

SEQ ID NO: 70600 - DNA, 99 bp, Mus musculus
caaatggcctaccccgtcccccacttagtcagtccctgtgtcacaggctgagaagtacacagtccacctgatcagacagctgctgagttatgccaattg

SEQ ID NO: 70601 - DNA, 85 bp, Mus musculus
gttcacagtctccgttgccagaagagaaagtgctgagtttttacgtgcactaacttttgtagtgtaggatgacagaggctgggat

SEQ ID NO: 70602 - DNA, 65 bp, Mus musculus
gagacatggatcaagttcctatttcgaagtttcataatttttgaaaacaggatcttgtatgtctc

SEQ ID NO: 70603 - DNA, 92 bp, Mus musculus
gcctgggatgaaagatggaacagaagacagaaagctcaggtgacagccatcactgcttgcattcagcctgcctgtccagaccccactggagc

SEQ ID NO: 70604 - DNA, 72 bp, Mus musculus
ccactcttattctgtctgcttttcctgagggggcatacaccccctcccccaaagaagaggaggattctgtgg

SEQ ID NO: 70605 - DNA, 72 bp, Mus musculus
ctgtgtatatgtttatctatatctcactcacatctctctagaggtgggggtgggagagagagatacacacag

SEQ ID NO: 70606 - DNA, 72 bp, Mus musculus
ctgtgtgtatctctctctcccacccccacctctagagagatgtgagtgagatatagataaacatatacacag

SEQ ID NO: 70607 - DNA, 71 bp, Mus musculus
tgaattggggggctggagagatggctcagcgcttaagagcactgactgctcttccagaggtcctgagttca

SEQ ID NO: 70608 - DNA, 61 bp, Mus musculus
cctggggctggagagatggctcagcgattaagggcactgactgctcttccagaggaccagg

SEQ ID NO: 70609 - DNA, 70 bp, Mus musculus
gagagagatggtcaagagagggtaatggcaatggatagaatccagtcaatatctcagtgtctgttctctt

SEQ ID NO: 70610 - DNA, 75 bp, Mus musculus
aagccaccacagggtgagatcgagttgtcccatttagggctaagaactctacagtctctcgttgtctgtgtgttt

SEQ ID NO: 70611 - DNA, 111 bp, Mus musculus
aggcaccacatgacagaagttggatgggtattttgggctgagtctctgtccctcacacagagaaaattctgtgcaataaacagatctggatcttctatgtcttgaagcact

SEQ ID NO: 70612 - DNA, 170 bp, Mus musculus
ggggtgtatgtgtgtgtgtgtatgtatatatgtgtatatgtatatgtgtgtatatgtatgtatgtctctgtgtatatgtatgtgtgtatactatgtatgtatatatatatatatgtgtgggtatgtatgtatatatgtgtatatgtatatgtgtgtatatgtatgtatgc

SEQ ID NO: 70613 - DNA, 75 bp, Mus musculus
gtggaaccagagattctatgtatgtatgtatgtatgtatgtatgcatgcatgcatgcatctatctatctatctat

SEQ ID NO: 70614 - DNA, 77 bp, Mus musculus
tcttctccagggttcagtgtcagttctgtttctgtagttgtgaggaaacaccatgacccagagcaacttgggaaaga

SEQ ID NO: 70615 - DNA, 62 bp, Mus musculus
tgtctgtctgtctgtctgtctgtgtccttttaaactgggccagggatcagtagacacaaaca

SEQ ID NO: 70616 - DNA, 82 bp, Mus musculus
gagtctgtgggactgagtctgtgggggagggttgctgagagatctaaacagttctgcgagcccgcgccttggtgcgcttctc

SEQ ID NO: 70617 - DNA, 70 bp, Mus musculus
catatgtatgtatgtatgtatgtatgtgtgtgtatatatatatatacacatatatatgtatatatatata

SEQ ID NO: 70618 - DNA, 79 bp, Mus musculus
gtctgtctgtctgtctgtctgtgtgtgtgtccatgtgcaaatgtatgctatggcacatatatgaaagtcagaagacagc

SEQ ID NO: 70619 - DNA, 72 bp, Mus musculus
gcatacatacatttacacttaatccatttaattcaatttactttaactggagatgtatgcatgtatgtatgt

SEQ ID NO: 70620 - DNA, 77 bp, Mus musculus
gagggctggagagatgactcagtggttaagaggactgactgctcttccagaggtcctgagttcaattcccagccacc

SEQ ID NO: 70621 - DNA, 93 bp, Mus musculus
ttaagtcgtgttctgagagtagatagaaagctgtagtgtctaatcacgtggacacagtgtcctgaaaggctaccgtcatgaacacctacttaa

SEQ ID NO: 70622 - DNA, 65 bp, Mus musculus
ggggctgtaaagcagcaggtgccagcatgagggcagcctggctggctggctgagtgacaggcctc

SEQ ID NO: 70623 - DNA, 113 bp, Mus musculus
tgccatgcttcccaccatgatgataatggactgaacctctgaatctgtaagccagccccaattaattattttctttagaagagttgccttggtcatggtgtctattcacagca

SEQ ID NO: 70624 - DNA, 99 bp, Mus musculus
ttagttgcttgtacctgatctagccattcaggcttttgactggattgcctctgagttgaacggaatgaagcctggcaggtagggtgtgaccgtgtctgg

SEQ ID NO: 70625 - DNA, 93 bp, Mus musculus
tggaatgaaggagtcaggatattacagatgacagagatacgtgttcagggatatgttctctggcacaggatatttttcttctcctttgcttta

SEQ ID NO: 70626 - DNA, 78 bp, Mus musculus
cattatatatgtatatgtatgttgtatatatgtgtatatatacatacacacacacatatatatgtatatatatggctg

SEQ ID NO: 70627 - DNA, 80 bp, Mus musculus
ccagggtaactgtaggggtaagggggtttgccctccaaatgtggggctacctcactctctctatcttagttgtggtcctg

SEQ ID NO: 70628 - DNA, 102 bp, Mus musculus
ggtcctaacatttcctactttacacagctgctgtgagccagatgtgagagtgcagactgaaatctcagcagttttcaggtgaaacctaggagtcgtgggttc

SEQ ID NO: 70629 - DNA, 124 bp, Mus musculus
gaaccaaaggtccaagaatgctatcaaatagcatcagaggcctacagctgagatctctccctgtctgtcacccgtctctctgatgtttccactgaagtaatttttggtttccagcctagccttt

SEQ ID NO: 70630 - DNA, 106 bp, Mus musculus
gtgtaagaatgtcatcattggtgctggagatggttcagaggttaagagcactgactgctcttgcagaggacctgggttcatttgcagcaaccacatggtggctcac

SEQ ID NO: 70631 - DNA, 117 bp, Mus musculus
tggaagagcaattagtggtattaatcacccagccatctctccagcctgatatacttttttttaaatgtacataaattggaagtactttgtggctttaaaaaaggcccactaattcca

SEQ ID NO: 70632 - DNA, 76 bp, Mus musculus
tcagatgttcacaggtcagagcactgagtgtagacatagcccctcttctctctgccacctgctgacccacatgtga

SEQ ID NO: 70633 - DNA, 69 bp, Mus musculus
tgtaatttaagcatatgtgtgtatacagtatatatagtatatatgtatgcatatatgtatgtatgtaca

SEQ ID NO: 70634 - DNA, 79 bp, Mus musculus
gtgtgtgtgtatgtgttaagtgtgtatgtatgtatgtgtgtgtatgtatatatatgtgcatgtgcatgtgtgtgcatat

SEQ ID NO: 70635 - DNA, 115 bp, Mus musculus
ccatatcttgtgtcatgttgaaataaaactagggctggagagatggcttagtggttaagagcactgactgctcttccagaggtcctgagttcaaatcccagcaaccacatggtgg

SEQ ID NO: 70636 - DNA, 104 bp, Mus musculus
gtggagtcaaagccatggtttatggtcagctgatagaactgacagaccacttctggctgtaattggtctaggttctgagttctgttatcaccagggcacaccgc

SEQ ID NO: 70637 - DNA, 89 bp, Mus musculus
tacatatatatcatgcgtgtgtgtatatatatgtaacatatatatgaatgaaatacatatatgaatatatatatgtgagtgtatgtgta

SEQ ID NO: 70638 - DNA, 74 bp, Mus musculus
gtatatatctgcatgtgtgggtatgagtgtacatgtctgtgtatatgtctgtgtccctctgtgtgtgtgtgtat

SEQ ID NO: 70639 - DNA, 108 bp, Mus musculus
cccgcctactgatattttcttcctttgatttttatttattttttggatctgcactgcaggacacagaccctagagaggagatagtgaggacaaacctttagttgctgg

SEQ ID NO: 70640 - DNA, 83 bp, Mus musculus
gttagggggccttgaggttgttggttctctccttccattatatgggttctggggatcaaactcagtttgtcaggttttgtagc

SEQ ID NO: 70641 - DNA, 108 bp, Mus musculus
gttgaaaggtggcactgaaaagtgaagatttgcttctagggatctgtcattcagtagagaactggacagaagtgtgtgagggcaatttcaaggcaggcgtcactaagc

SEQ ID NO: 70642 - DNA, 86 bp, Mus musculus
cactggggtctatatagataactcattagcatggagaactccaggtttttaatgctatgtgactggtttttatggtcccctcagtg

SEQ ID NO: 70643 - DNA, 93 bp, Mus musculus
tccatggtgatctgataggatgcatgggacaatttcaatatttttgtatatgttgaagcttgttttgtgaccaattatgtggtcaattttgga

SEQ ID NO: 70644 - DNA, 116 bp, Mus musculus
gcttctgtgcttcctacttccagtccccattccagtctctttaaactcaatgtattttctttaaataatgaatcccagagctacaacttggggatggaggaagtgggggggggggc

SEQ ID NO: 70645 - DNA, 98 bp, Mus musculus
agcactcttttctgctttgactctgtaggtaatgtgtgtgttgtcacagtctctgtgagtttatacacatatcagccttggtgtgtctgcatgatgct

SEQ ID NO: 70646 - DNA, 108 bp, Mus musculus
ccaagtcaagagtctggcagggagctgggagtcacctaagcctcaggtgtgtgcccactgtgtctctgggtctcaacttgctctactttaccaaacttcctggcatgg

SEQ ID NO: 70647 - DNA, 85 bp, Mus musculus
ggccatggtggtttgataggatacatgggacaatttcaatatttttgtatctgttgaggtctgttttgtgaccaattatatggtc

SEQ ID NO: 70648 - DNA, 106 bp, Mus musculus
gcactgttctctatgtctctgtcactcatcacaacatccattagtaatcagtgttgataccccacaatgtatgaaggtttgagtggcagttttcatggtattatgc

SEQ ID NO: 70649 - DNA, 106 bp, Mus musculus
gcactgttctctatgtctctgtcactctttcccacatccattagtaatcagtgttgatacctcacaatgtataaaggtttgagtggcagttttcatggtattatgc

SEQ ID NO: 70650 - DNA, 116 bp, Mus musculus; identical to SEQ ID NO: 65855

SEQ ID NO: 70651 - DNA, 100 bp, Mus musculus
tgctatgaggaatttttctggtcatgtctaattggtgtaatatgtattctttgtacatgtttatatttcatttcatagtttgagaaactcttcttctgca

SEQ ID NO: 70652 - DNA, 106 bp, Mus musculus
gccttagtgcatggtgatctgatagaatgcatgggacaatttcaatatttttgtatctgttgaggcctgttttgtgacctattatgtggtcaattttggagaaggt

SEQ ID NO: 70653 - DNA, 95 bp, Mus musculus
tatgtatatatatataatatatatacatatatgtataaattatatgtttatacatatatgtatatgaattgtatatattgcctatattgtatata

SEQ ID NO: 70654 - DNA, 79 bp, Mus musculus
gggaagccagggatgaagttagattctgcgtactcaaggccaaggtctgagcctgtctctctcacaccttctctgtcct

SEQ ID NO: 70655 - DNA, 123 bp, Mus musculus
tactgatacatatatatatatatatgtatatatatatatgtatatatatatatatatatatttatatatatatatttatatatacatatatatgtgtgtgaatgtgcatgtgtatgtatgtat

SEQ ID NO: 70656 - DNA, 105 bp, Mus musculus
tcaataatggcagtgaggtttctatgtaatgctataagcttccttaaagaatgaaaagctctttatatatatgtgtctgcagggacctcttctggacaactggga

SEQ ID NO: 70657 - DNA, 102 bp, Mus musculus
gtgactttgaaatgatcttaacctatttgactttatctagttctatttctcataaacagaaaaggtagagcaatctggccagattcattgcatcataatcac

SEQ ID NO: 70658 - DNA, 81 bp, Mus musculus
catggggatagagaaggagcagtttggggtctctgggcctcatggagaccagagacaacaggttctctctcagtctctctg

SEQ ID NO: 70659 - DNA, 80 bp, Mus musculus
gtagtgagtcagtggtggaaggcagagtggtgagtgagttcaggtgagctcagttgagtgcagttcaattgagtggttgc

SEQ ID NO: 70660 - DNA, 76 bp, Mus musculus
tgcaaaagatgtgaggcaaagaagacaaaggcagaattgcctggagttcttaaactgtctcactgtctttgatgta

SEQ ID NO: 70661 - DNA, 85 bp, Mus musculus; identical to SEQ ID NO: 57439

SEQ ID NO: 70662 - DNA, 111 bp, Mus musculus
agaatttacaaaataatgttggatatgtttacatatgcatgctttcaaagtaattgaattacacacgtgcataaaaatatataattccaacatatatatacaagaaatttt

SEQ ID NO: 70663 - DNA, 76 bp, Mus musculus
actaggatcttactgtcgctgtctgtctatatggtgtacacttatgcagagatgtgcaaatatttaagattctggt

SEQ ID NO: 70664 - DNA, 76 bp, Mus musculus
tggtttcagttaaaagatcaatgttgactgtccattttttggggagtcagcagcctgacagttgacattgaggtca

SEQ ID NO: 70665 - DNA, 116 bp, Mus musculus
tatatgtatgtatatgcatgatttgttcatcaaagactagctcaatgcatttcttatgtaatattcaagaataatttagtgtcagtgagagtaagtcatgcacagagatcaatata

SEQ ID NO: 70666 - DNA, 59 bp, Mus musculus
ttatgtacattatatatgtatatatatacatctatgtatgtgtgtatgtgtgtggataa

SEQ ID NO: 70667 - DNA, 72 bp, Mus musculus
tagataactaattggagtgctccttgctggagaagactatttctctcactctcagtactccttagttatcta

SEQ ID NO: 70668 - DNA, 100 bp, Mus musculus
ggtccttccaacgccctgggtttgttttcctgggaaatgcctgtctccctctctgtcaaactatgcccagcacagcagatcctgtggctcctaccttgcc

SEQ ID NO: 70669 - DNA, 85 bp, Mus musculus; identical to SEQ ID NO: 57439

SEQ ID NO: 70670 - DNA, 106 bp, Mus musculus
cctgcttggaggaagcaggctgattttactttggctctctgcctcagagccactatcctgtctcttttcacagcaggagagctcagagcctgtgagctgagaagta

SEQ ID NO: 70671 - DNA, 86 bp, Mus musculus
atgtccccttatgtgtgtatatgtatatatgtatatgtgtatatatgtatatgtatatgtgtatatatgtacacatatatgtgcat

SEQ ID NO: 70672 - DNA, 85 bp, Mus musculus
ggtaaataagccagacagttgtggcacctgcctttaatcccagtacttgggaggcagaggcaggctgatttctgagttagaggcc

SEQ ID NO: 70673 - DNA, 110 bp, Mus musculus
ggcagcaccatcccatgggttcaacagtgtatgaaagaagaatctgagctgaccaccagttcacattcatctcaccatacttcctgactgtggatgccatgagtcctgtc

SEQ ID NO: 70674 - DNA, 98 bp, Mus musculus
gctcatgctttagattttgcatctaaattctatggaccttgaatatatatatattcagtatatatatactggccttggtgcagctaaaagcatctagc

SEQ ID NO: 70675 - DNA, 89 bp, Mus musculus
tgaatgtgtttgagagaagatagtgagcagagacagatcttatcttgtttatccaatctgtgatctggttatttttttttaacaagtca

SEQ ID NO: 70676 - DNA, 85 bp, Mus musculus; identical to SEQ ID NO: 57470

SEQ ID NO: 70677 - DNA, 70 bp, Mus musculus
agaactattgagaatttcatcttctcttaacaccttttaagatatgcaatggagatgattctcaatttct

SEQ ID NO: 70678 - DNA, 60 bp, Mus musculus
ctctctctctctctctctctccaccctgtatatgtgtttgagagacagagacagagacag

SEQ ID NO: 70679 - DNA, 85 bp, Mus musculus
gtccatggtggtctgataggatgcatgggacaatttcaatatttttgtatctgttgaggcctattttgtgaccaattatatggtc

SEQ ID NO: 70680 - DNA, 76 bp, Mus musculus
atgcttatatatgttcatatgcatgttgtatataatgtatatacatgtgtgtgtgtgtctgtttgtgtgtgtgtat

SEQ ID NO: 70681 - DNA, 80 bp, Mus musculus
acatatatatggatatatgaatgtatatacatatatatgttttgtatgtgtatactcatatgtatatatttatatgtatg

SEQ ID NO: 70682 - DNA, 80 bp, Mus musculus
tatatatgtatatctgtatgtatatatgtatgtgtatatgtatgtatatatatatgtgtgtatatgcatatgtgtatatg

SEQ ID NO: 70683 - DNA, 85 bp, Mus musculus; identical to SEQ ID NO: 57470

SEQ ID NO: 70684 - DNA, 87 bp, Mus musculus
tgctcacagtagatatgcttatggatctgagtaggactaagtaattatttattttacatggttattaggcagctactgaggccagca

SEQ ID NO: 70685 - DNA, 113 bp, Mus musculus
atgcatatatatgcatatatatatatttagtatgtgtggagttatatatgtttatatgtatgtgtgtatatatatgcatatacacacaaacatcatacatacatacatatata

SEQ ID NO: 70686 - DNA, 70 bp, Mus musculus
gctgaagcacactcactctatctcatgcaatgagactagcctcgtggtgtgcaagagctgagtggccagc

SEQ ID NO: 70687 - DNA, 86 bp, Mus musculus
atgttttcaatacaggcagcaggagattctgaagttcttttcaaaatgaaaccactctgtctgcctgtctgtctgctctgcaacat

SEQ ID NO: 70688 - DNA, 104 bp, Mus musculus
tcatctcaaaagcagtgcagaggaatggtgtggtatatgagttgatgccttccactcagactgactctgtatcacatccctggatctgtgtgggtaatttatga

SEQ ID NO: 70689 - DNA, 103 bp, Mus musculus
cagaggacctcgctcagacccttataagctccgtttctcactttagtctctgtgagcctctgtgggttctacttagttggttctgtgtggctgtgttctcctg

SEQ ID NO: 70690 - DNA, 77 bp, Mus musculus
catggtgatatccttctgcagatgagatgctctgcccctctgctaggcagagagactcactgtcagtttccatgacc

SEQ ID NO: 70691 - DNA, 117 bp, Mus musculus
tttggggttttttagagtattattttgagcaactacttagcaaagttagatttctttttttaaatcactgaaagcttttctagtgtggtggctcatgtttataatctgagcctggga

SEQ ID NO: 70692 - DNA, 71 bp, Mus musculus
ttttacagtgcatttttagcctacctgcactaggtgacaggagagacaggcctgacaaatgccaggtgaga

SEQ ID NO: 70693 - DNA, 102 bp, Mus musculus
gctgctattctgccagtgcagacaaccaccttaggggatgactgaattttttttttaaaagagctacagttttgtcttatggtattttgccagtctagaagt

SEQ ID NO: 70694 - DNA, 119 bp, Mus musculus
gtctctctttgttgtttactcttgtgcactccagctggctggagaacttccgggggagtctccgtctgtctcccgctgactcataggtgcgcagtaccgatcctagagaagatgtgcgg

SEQ ID NO: 70695 - DNA, 99 bp, Mus musculus
tgagtttcacttcagggacacaagcttggccaatatttttctatgctgtctgtaacctttcacagtacagagtgagcaaggtcctagttcattaactca

SEQ ID NO: 70696 - DNA, 76 bp, Mus musculus
acagattgatgtcttcaaatgacagacaaaaactatggccactatcatcggtctgtctgtctgtttgtctgtctgt

SEQ ID NO: 70697 - DNA, 101 bp, Mus musculus
aagtcaacaggagcatcacgcaggtcatggctgaacacaggctgcagaccagctgcagagggaatcagaaaatgataagggctttgaaggagaagttgctt

SEQ ID NO: 70698 - DNA, 113 bp, Mus musculus
atgatgttagaggttgtggaactgatgagtgttcggatcatcatagtgacgatatcattgttattttgttgttctaaaattattagtaacagttatatctttgactatttcat

SEQ ID NO: 70699 - DNA, 78 bp, Mus musculus
tctgtctgtcactcaccccgtgtctgctgtgtagaattacaatgtaacagcctttcaagggcggtgaggactggcaga

SEQ ID NO: 70700 - DNA, 99 bp, Mus musculus
aggcagtttggggagcataagttttcaattataagttgaagtataaatttgttttattttttgagtgaaagtaatttgaagaactatgcagtactgttt

SEQ ID NO: 70701 - DNA, 81 bp, Mus musculus
ggctttggaagtagaaatatattcatatatatgtggacatatgtgtatatgtatatgtctatgtgtttgtgaggcagggtt

SEQ ID NO: 70702 - DNA, 104 bp, Mus musculus
gcttactttgcctcagtgtggctgacagaaacaacccaagggattatttatttgtttatcaccttgttcatgtgtgtgggatgccagtggaggtcagagtaggt

SEQ ID NO: 70703 - DNA, 96 bp, Mus musculus
ccttagcttctcaatgggctggactggttggtcagggttctttagggacactctgtccctgtcctcctctactgggttacaggcttgtggactgaa

SEQ ID NO: 70704 - DNA, 56 bp, Mus musculus
gtatgtatgtatatatgtatgcatgtatctatgtatatacacatatacacacatac

SEQ ID NO: 70705 - DNA, 90 bp, Mus musculus
tttctaggctcctaaacctctgtctctcagtgcttcccagcaattaagagcaaagcatggaaggggacagcaggagttggggcagggagg

SEQ ID NO: 70706 - DNA, 56 bp, Mus musculus
attctctgtgtgtgtctctcatctgtttgtaaaagggaagagaactggcagagaat

SEQ ID NO: 70707 - DNA, 84 bp, Mus musculus
acaagctgtatgtatgtatgtatgtgtgtgtgtatgtatatatacatatatatacatatacatatgtgtgtatatgtatattgt

SEQ ID NO: 70708 - DNA, 97 bp, Mus musculus
atatatatatgctatatatacactatatatacatatatatgtatgtatatatacatatatatatgtgtgtgtatgtatatatacatatatatgtata

SEQ ID NO: 70709 - DNA, 65 bp, Mus musculus
gctgatgaagtctacaacattttaatagatggctcgtgtcattttgttgtattcttctatacagc

SEQ ID NO: 70710 - DNA, 97 bp, Mus musculus
gattcctcatgggctggtgtgatggctcagcggttaagagctctgactgctcttccaaaggtcctgagttcaaatcccagcaaccacatggtggctc

SEQ ID NO: 70711 - DNA, 109 bp, Mus musculus
cataaatctataatacatacatcgtttccatagagagtagacacagagctctaaaccttatgcagtgacctgtgtattgagctcagtgggggcagttttatgagtggat

SEQ ID NO: 70712 - DNA, 82 bp, Mus musculus
gtgatcatgtttcctgtgtgtatgtgtgtctgtatatatgcatatatatactcacatatgtaatatatatttaaaatggcac

SEQ ID NO: 70713 - DNA, 99 bp, Mus musculus
gcatttgtggatagtattaaaacttaatcataatgtattttaatatacttgtatcgccttcatcaatatttgaaatacagatggtatactgccaggtgc

SEQ ID NO: 70714 - DNA, 97 bp, Mus musculus
tacagttgctggatgagtgagttaacccagaaaagctgttaaatgaccttccccagctcgtctgtctgtctgtgccactaccacacatctgtctgtg

SEQ ID NO: 70715 - DNA, 90 bp, Mus musculus
gtgtatgtatatatatgcatgtgtgtatataagtatgtatatgtgtatatatatatacatatacacacacacatatatatacacatatac

SEQ ID NO: 70716 - DNA, 62 bp, Mus musculus
agtgtgtggagacactcagcagaaagaaaatctgtgttttatctctctgtgtctctgacact

SEQ ID NO: 70717 - DNA, 115 bp, Mus musculus
gttttgccattgtactgtaatatcttagaactgggcataataaatgagcctcaagttatccaggaaagcattttatcagatgtcttagtgaggatctccactactgtgaagagac

SEQ ID NO: 70718 - DNA, 64 bp, Mus musculus
ggtaaggaatggatgcagagaagatgattcttggctgagtccgtgctctgtctgtctgtccccc

SEQ ID NO: 70719 - DNA, 85 bp, Mus musculus; identical to SEQ ID NO: 57439

SEQ ID NO: 70720 - DNA, 95 bp, Mus musculus
tcctggtccactctcttttaaacatgtaactagatagagagcactttaacagcaaagtgctctattgtccttactttaaaagtcttcaaccatga

SEQ ID NO: 70721 - DNA, 77 bp, Mus musculus
tgtgtatgttatatataccatatatatgatatatgtgtatatttatactttatatgtgtgtgtgttataactatgta

SEQ ID NO: 70722 - DNA, 115 bp, Mus musculus
tctctatgggtatcacttcacactggcacatctaagcccagcaggactaagcacactctctcccactgaggccaaactaggcagtgtaggtaggggaaggggatccaatagcagg

SEQ ID NO: 70723 - DNA, 109 bp, Mus musculus
ttttctattaatgggacaaagcaccataatcaaagcaacgtatagaagaaagtatttaacttggggctcgtatctgcagcgggttagtgcatgatcaccatgtggggag

SEQ ID NO: 70724 - DNA, 94 bp, Mus musculus
gctgttttgttgttagtactgtctctgaagagctcatgaatcataaggatttagtcacagaatttagtgtgcagaaggaactgcaaatcacagt

SEQ ID NO: 70725 - DNA, 92 bp, Mus musculus
agccattctgactggtgtgaggtggaatctcagggttattttgatttgcatttccctgatgactagggattttgaacatttctttaggtgct

SEQ ID NO: 70726 - DNA, 76 bp, Mus musculus
aggggggagaaagcctgcaggtaggctacatagtccaaattatttatatgctgtctgtctgtctatctgtctgtct

SEQ ID NO: 70727 - DNA, 90 bp, Mus musculus
ttctcagtgcagctcatatttgccaggacttgttgccaggaccacatgtaactttgtagatgtcttagggttttattgctgtgaagagaa

SEQ ID NO: 70728 - DNA, 74 bp, Mus musculus
ctcactgagtcctcattctgtcagtcaaccacacctaggcaccgtcaagtatggttgatccaccagtgagactc

SEQ ID NO: 70729 - DNA, 120 bp, Mus musculus
gtccttatatggccgtgggtgcatgggtggggagagtcttggtttgtaaagtacagaagtatgaaaggagacctgcatatatgtgacaagctcatgggatcaggctggatatgcatggct

SEQ ID NO: 70730 - DNA, 75 bp, Mus musculus
aagtgtaatgtgcaagttttatacattattaacaaataagcttgtttttaatgtgtgaaaagtgagtgagcactt

SEQ ID NO: 70731 - DNA, 81 bp, Mus musculus
aacaagcacacactctgtctctctgatggtttgaatatgcttggcccaaggagtggcactaggaggagatgtagccttgtt

SEQ ID NO: 70732 - DNA, 89 bp, Mus musculus
atgcatatatagtatacatgtgtatattcatatatatatacacaaatacacacatatatgtttctatccatatgtatctatatatgtat

SEQ ID NO: 70733 - DNA, 66 bp, Mus musculus
gttgtctctgtcagtctttcacacatagtttccttgaagactagtgggatgattgaggagaaagac

SEQ ID NO: 70734 - DNA, 86 bp, Mus musculus
cagagggatcaatgtgggggaagggtcattctgtcttctgccttcaagtttgcacagtactctctctccctgtgtgggtgtctctg

SEQ ID NO: 70735 - DNA, 87 bp, Mus musculus
tatcatgaggagtccactgaatactgatcttagttgctggctacaaatatcctcagggtatgagattcttgttcttggtgcatgatg

SEQ ID NO: 70736 - DNA, 107 bp, Mus musculus
tacagtacttttgaatacctgaaattgaggccactgattattttatttataaagcaaggactatgacgagatgctcactcctggctcaggtagtaaaaatatctgtg

SEQ ID NO: 70737 - DNA, 85 bp, Mus musculus
tgagatttttcttttggttttgagggggcttattttgttgttttattttaaacagagcctcactcagtttctctgactggtctca

SEQ ID NO: 70738 - DNA, 142 bp, Mus musculus
tgtgtatgtgtatatgtgtatatgtgtgtgtatgtgtatatgtgtatgtgtgtgtatgtatatatgtgtatatgtatatgtgtgtgtatgtgtaatgtgtatatgtgtgtgtatgtgtatatgtgtatgtgtgtgtatgtat

SEQ ID NO: 70739 - DNA, 83 bp, Mus musculus
ctagagtttaacagaacagattttgtactttgagactctgagtcaggggtcaactcaaaggactttatgctttgtaactgtgg

SEQ ID NO: 70740 - DNA, 93 bp, Mus musculus
tatatagagagagagagagagagagagagagagacttaattgtgcaagagtattttattttttttgtgtatacttctttctttaatttgtata

SEQ ID NO: 70741 - DNA, 70 bp, Mus musculus
gttgagagaatgagagcaatgttcaatgggaaagaataattcctagatataactctaatttctctaggac

SEQ ID NO: 70742 - DNA, 74 bp, Mus musculus
gggacagtgtctcactgagtggcttggaactcctcattactgaccaggctagtcctgaattcagatctgtctcc

SEQ ID NO: 70743 - DNA, 78 bp, Mus musculus
ggtaaagagttgagagagagctcttgacaatggtgctgttgctcctatgtgtcctttgccatcttttatatcttgacc

SEQ ID NO: 70744 - DNA, 103 bp, Mus musculus
gaaagcaatgttgagagctggagagatggctcagcggttaagagcactgactgctcttccagaggtcctgagttcaaatcccagcaatcacatggtggctcac

SEQ ID NO: 70745 - DNA, 72 bp, Mus musculus
cccttcattctctctctgtctctcactgggaacccagggaaggctgcctttcatgggggaggaagaagcagg

SEQ ID NO: 70746 - DNA, 82 bp, Mus musculus
ggctataactgtgactgtgtgattgtggctgtgatggtggctgaaactgtgactgtgtgactgtggctgtgtgactgtggct

SEQ ID NO: 70747 - DNA, 171 bp, Mus musculus
gtggctgtaactatgtgactggctgtgattgtgactgtgtggctgtgactgtgtgactgtgcctgtgtgactgtggctgtgactgtggctgtgactgtgactgtactaactgagttctggccttgatggtgctgatttgtcttcacagcaagtcctccagccacccttaca

SEQ ID NO: 70748 - DNA, 59 bp, Mus musculus
gatctgtgtcagtgtctcactcaggggcatcttgaagtaagtatcactgactgagggtc

SEQ ID NO: 70749 - DNA, 80 bp, Mus musculus
ttgcacaggagtgagagaagagacacaggtcctgctgaggcagccatgtcagagtcgctccatctccctcctgtaggcaa

SEQ ID NO: 70750 - DNA, 88 bp, Mus musculus
ctaagttattgttgtgtgattgttggtttaaagcattatataagtcaaagtacactgcagcctactgagcacatagacagtggtttag

SEQ ID NO: 70751 - DNA, 87 bp, Mus musculus
agtgacggcattgtcctgagagtgcacacagacttagatgaggggagaccattctgggggattctgaagcatgaggttggccttgct

SEQ ID NO: 70752 - DNA, 129 bp, Mus musculus
gtttgcatcagcacaatcgtattgctcaatgcacagtgaagggtcatggagacgtctgtgtcagcagtcagagtgcagaaacagcaagcagtgcccggccttctcgtcacagaggtcagctcatcgccc

SEQ ID NO: 70753 - DNA, 70 bp, Mus musculus
cacagagagagagagagagagagagagagattgtctatcatctgtctgtctgtctgtctgtctgtctgtg

SEQ ID NO: 70754 - DNA, 68 bp, Mus musculus
ctaggtggagcctgagcacaggagactttcaaagcccagtctctctgtgacacttttcctccaactag

SEQ ID NO: 70755 - DNA, 64 bp, Mus musculus
tgtctctctgtctcactgcgtgtgcatgttggtacatccgtatgcactcaggagaaaggagaca

SEQ ID NO: 70756 - DNA, 121 bp, Mus musculus
gtgtccaccgaaggctgtcaaccacatggatgtgatcctgagttaaccaactttcagactctctatctcagccttgctagctcagaactccacatggtacctgtgtgcatgaagaattttc

SEQ ID NO: 70757 - DNA, 101 bp, Mus musculus
ggacacagaccacagagtcagctaagcaggaaccatagtgtctcactgagtctgcctgggactgtgctaggccctctgcatatatatcatggtggtgtagc

SEQ ID NO: 70758 - DNA, 81 bp, Mus musculus
ctgctgtgtttctctctgcctcttgctgtgtatccaagggcccatgtgtcaaggctgaggtccaatgggagggatgagcag

SEQ ID NO: 70759 - DNA, 121 bp, Mus musculus
gtgttgggcagaaccaggccagcctgagagggtcaagcagaggtgtccagggactctgtctcactgtgtacatcccgtgaccacagagctgagtcaggatggtcagagcaggtgggcggag

SEQ ID NO: 70760 - DNA, 81 bp, Mus musculus
agattttggagctctgagtcagtgtctccgtgaggtaagaactggccagcaagaccaccagggctgagagtagcagtgtgt

SEQ ID NO: 70761 - DNA, 98 bp, Mus musculus
tatacatattaatgtatggcttccttgatatgtatagaagtcagctgtcactactttggattcttctgttggcatgtgcatgtatggtagtgtgtatg

SEQ ID NO: 70762 - DNA, 66 bp, Mus musculus
agcctgggctagtggcagtgtacacctcaaacatgggatgaacactcagtagtcactctctcagct

SEQ ID NO: 70763 - DNA, 67 bp, Mus musculus
cgcgtgtgtacactcaggtgcatgtgtgcattacgtatgtatgcatgtatgtatgtgtgcacgtgtg

SEQ ID NO: 70764 - DNA, 115 bp, Mus musculus
tgtgtcattagatctagagcttgctgagtggactggactgatggccagcaaaccccagggtctctgcctctgtctttccagtgagggattgcacaggctctcagtgtgggataca

SEQ ID NO: 70765 - DNA, 92 bp, Mus musculus
ggcagcggcggtgacatattgcgtttggacataaggcaccgtgatctggacgtgccgttcactcactttctgtcacctgttccatcccagtg

SEQ ID NO: 70766 - DNA, 117 bp, Mus musculus
ttggagtcttttatcgtttgcccctcccctcgagacaatcagctcctcagcactgtgtcagtctgtgtgtgagcctgtgagtcctgggtactgcacagggaggcccacaggctccag

SEQ ID NO: 70767 - DNA, 116 bp, Mus musculus
ggactttgcccagccagctgatatacttaccaaggcctcctgatctctgcctggatacttgtctggctccacccagtgtcttgtgtgagagagcagagcacggcctccatatcagt

SEQ ID NO: 70768 - DNA, 92 bp, Mus musculus
ctcaggggaggggtcctacagtggatgacatagtggtttttttaagaggaagagagatatcagtcagcacactggccctgcctcatcatgag

SEQ ID NO: 70769 - DNA, 58 bp, Mus musculus
ctcgcctgtgtctcactgtctgcctggttctggcctcgctgcttgagcactgtgtgag

SEQ ID NO: 70770 - DNA, 128 bp, Mus musculus
gtgcatgtgtgtgcttgtgtgtgcatgtgtgtgtatgcatgcgtgtatgtgtgtacatgtgtgtgtgcatgagcatgtgtgtatgtgtgtgcatgtatgtatgtgcacatgtgtgtgcttgtgtgtat

SEQ ID NO: 70771 - DNA, 65 bp, Mus musculus
tggcttcctgtcctgtctctgtctctgcttcctggtctgcagagatctgaacaagcagcttgtca

SEQ ID NO: 70772 - DNA, 122 bp, Mus musculus
gtatgtatgtatttatatgtatatatacacacacatatatttgtatgtatgtatgcatgtatgtagtatgtatgcatatatatatatatatatatatatatatgtaaatgtatgtgtgatac

SEQ ID NO: 70773 - DNA, 104 bp, Mus musculus
tcttggattccacttgttgagatggtgtggtgcctgtctgtctgtgactggttcatttcagttggctagtgggctctaggatcatccatgttgtttataaatgg

SEQ ID NO: 70774 - DNA, 119 bp, Mus musculus
gacgggtatctatattaatcctgttatctcaccatgctattcagccaagactttttttttttaaatccgtgatgtctggtagagcaatgggacatatgtaaggagaaaattctgcgtcc

SEQ ID NO: 70775 - DNA, 68 bp, Mus musculus
ccatcccacactggtgatggggatgataataatgataatcatcatcatcatcagggctgacaagatgg

SEQ ID NO: 70776 - DNA, 92 bp, Mus musculus
ggatctcacctctccctttgtatctctgactggtttggaactcgctagttccttggtacggggtttgactgcagaagccagagagggcggcc

SEQ ID NO: 70777 - DNA, 82 bp, Mus musculus
ctctgtctctgtgggtctctgtgggtcaggccttgctttacaaagggaagacaaatgagatgaattgaattgggagacaagg

SEQ ID NO: 70778 - DNA, 108 bp, Mus musculus
catgatgtgtctgtgtggttgtttagaggctagaagaggatgttggatgaattgtctgacataaatgctggggactgaaattcaggccatctggaagagcaggaagtg

SEQ ID NO: 70779 - DNA, 106 bp, Mus musculus
ctggcttctgagggcacctgatagactctgaatccactctctctctcatacacagagagagggagggagggggagagggacaggggaagggagggaaagaggtcag

SEQ ID NO: 70780 - DNA, 58 bp, Mus musculus
ggataggctccctgagtgtcctactgatggtcagagaacattctcagcaagcagatcc

SEQ ID NO: 70781 - DNA, 79 bp, Mus musculus
atgtgttggctccccttactgtctcactctatctgccactcccttcagtctggaagtgtcagcaatgagggcaatatgt

SEQ ID NO: 70782 - DNA, 109 bp, Mus musculus
gaaagcacagcctgggaggcagggactggagatggctcaggggttaagagcactgactgctcttccagaggacccaggtttgattcccagcacccacctggtggctcac

SEQ ID NO: 70783 - DNA, 98 bp, Mus musculus
aggtctatagccttggaacccctcctgcaatgctgtccaactgctgggctgaaacagaattcacagtgtacatggtggggtctgctgcctctaagagc

SEQ ID NO: 70784 - DNA, 88 bp, Mus musculus
gctctattctcacctgagaagtgaattgagcagaatctgagagtgtagacttccaacagaataatttatttctttatgaacatggagt

SEQ ID NO: 70785 - DNA, 58 bp, Mus musculus
ctctggtgtctgtgtgtacttgtgctcacatgcacacactcacacatgcacataagag

SEQ ID NO: 70786 - DNA, 101 bp, Mus musculus
agtatacattttatgtgtgtgtatatatgtatgtgtgtatatatgtatatatatacatgtatatatatacatatatgtgtatatatatataatttgtggct

SEQ ID NO: 70787 - DNA, 57 bp, Mus musculus
ggaggcagggtgtgaggtgtcaaaagcccatgccatgtcaagtctctctctgtctct

SEQ ID NO: 70788 - DNA, 75 bp, Mus musculus
gtgtgtagatgtatatgtagctatgcatgtatgtgcatgtgtgcatgctctgtctgtgtgtctgaatctatatat

SEQ ID NO: 70789 - DNA, 78 bp, Mus musculus
gtttctgaatatgtgtatgtgactatttgtgtctctctgtgtgtaagaatacatatatttgtgtatatatgtggaagc

SEQ ID NO: 70790 - DNA, 81 bp, Mus musculus
gtatgcctgtgcatgtgcatgtatgtataaatgtcgtgtgtataagtgtgtgtttgtgcctgtgtgtatatgtgtgtatat

SEQ ID NO: 70791 - DNA, 91 bp, Mus musculus
agacaatggttggtcttcactgtcagtctgactggatttagattcatctcctagattcctaactggaggcgaaatgtgaccaactacttct

SEQ ID NO: 70792 - DNA, 120 bp, Mus musculus
ctcatgctaaggaacaaaggtagcatggtctctgctcttccccctccactcactgtcacacaggcacacagcatgacaggatgaccccaggacacagtgctatccatcttctaatgggat

SEQ ID NO: 70793 - DNA, 107 bp, Mus musculus
aggtgttccaggttggaagatcagagcgcattgtgtgtatgtatgtatgtatgtatgtatgtattatatactatatatgtgtgatggtataataataaaaaacattt

SEQ ID NO: 70794 - DNA, 87 bp, Mus musculus
cctttatgagttgccttggtcatggtgtctcttcacagcaatggaaaccctaactaagacacatgactcaatgcacacatttgatgg

SEQ ID NO: 70795 - DNA, 60 bp, Mus musculus
gtttcctagcttcttggtatgtgcttccagggaggtacatgacagaagaaagtgtgaagc

SEQ ID NO: 70796 - DNA, 56 bp, Mus musculus
agagtcaggactctccaggctctgggcccctcctctgtctgaagagtctgaactct

SEQ ID NO: 70797 - DNA, 87 bp, Mus musculus
ctttatatccatacatagcagctcagtatctctgtctgtcctttggggtcaaccatagaggtctgggactggagagagacaaaaagc

SEQ ID NO: 70798 - DNA, 77 bp, Mus musculus
ctgtcaacctacagcatctgcttctgtctctgcctctcttgacgctaatagaaagaaacagatttgctctctgacag

SEQ ID NO: 70799 - DNA, 78 bp, Mus musculus
ggtagatgaggtcatgtgtctgtctgtctctccacccctggagcaggcagctggcttggatgcaacagctcatttact

SEQ ID NO: 70800 - DNA, 104 bp, Mus musculus
ggtaagcttggggatagcagtgtgttgtaaagacagaagacactctgcatatgcaaatatttctactgcctatagaacacatgggtgtcatttccaaggcaacc

SEQ ID NO: 70801 - DNA, 85 bp, Mus musculus; identical to SEQ ID NO: 57439

SEQ ID NO: 70802 - DNA, 87 bp, Mus musculus
ccatgtatgctgtcactctgtgggtctgcatgctttagacaaggcaggtaggtatgtggctcataaacagactgggagcaaggaagg

SEQ ID NO: 70803 - DNA, 90 bp, Mus musculus
ttaggaattgtgtcctggggcctgggtagcattgatctgattttgtagttaagattccactaagcaggagttgcagagacactgtcctgg

SEQ ID NO: 70804 - DNA, 69 bp, Mus musculus
cttgaggacaggcttcctggaagctcagattgggcatctgtcactctctctaggagactgtcactcaag

SEQ ID NO: 70805 - DNA, 88 bp, Mus musculus
gcagagccacccagcagctccttctgtaatgcacattgttttggtaaattgtcatgtgctgtctgagtcactgagaggctggctctgt

SEQ ID NO: 70806 - DNA, 71 bp, Mus musculus
catgttctaagtgtgtagtgtgtgtgcacatgtatttgtatatgtgtacatacatacgttttgtgtgtgtg

SEQ ID NO: 70807 - DNA, 91 bp, Mus musculus
gagttaataaggggaagtcaagagagagagagagagagagttaaagatgattccaacaactcactgctcagtcactctgagtctgcaactc

SEQ ID NO: 70808 - DNA, 62 bp, Mus musculus
tatgtatgtatgtatgtatgtatgtatataatcattatatatatgtatatattatatatata

SEQ ID NO: 70809 - DNA, 107 bp, Mus musculus
gagcaagcttgagtttatgtgttagttttggtttgtctctggctcacattctctcagagaatttgaagtttccagacattccactgagggacactcactcaattgtc

SEQ ID NO: 70810 - DNA, 99 bp, Mus musculus
agtcacatgagaacagatttggaagggatagagtgagacatggcctttggggtaaagggacagtgacactgtgtctcagccctggactgagtgatgact

SEQ ID NO: 70811 - DNA, 97 bp, Mus musculus
catatatacatacacatatattatatatatttgtgcatgtgcatgtatgtatgtatgtgtgtatgtatgtgtgtatgtatgtatgtatgtatgtgtg

SEQ ID NO: 70812 - DNA, 69 bp, Mus musculus
tccacagaacagtctctgcagaggtagtctctgttaagggaacaatgtctgtagagagtagtctctgga

SEQ ID NO: 70813 - DNA, 70 bp, Mus musculus
ctcagccctcccactgtggcactgacagcccagctaagcccgggccttcatgcaaaggcgaggagctagg

SEQ ID NO: 70814 - DNA, 85 bp, Mus musculus
gtaatggcagttgttatttggggctcactggtgtgtgcttctctgatatagcaaatagcagagagactgcacacagctctgttgc

SEQ ID NO: 70815 - DNA, 79 bp, Mus musculus
ataatgcttgaatgtagagccagacaggcagactccctcaagaggagaagtgtctgtgtgtctgtgtgcatgagtttgt

SEQ ID NO: 70816 - DNA, 76 bp, Mus musculus
tgctaattgaaaggttaatcaagggctggaagagcgctgactgctcttccagaggtcctgagttcaattcccagca

SEQ ID NO: 70817 - DNA, 75 bp, Mus musculus
gggcgctggggagatggctcagcggttaagagcactgactgctcttccaaaggccgagttcaaatcccagaaacc

SEQ ID NO: 70818 - DNA, 100 bp, Mus musculus
gttaactgcaggggctggagagatggctcagaagttaagagcacagactgctcttccagatgtcctgagttcaattcctagcaaccacttggtggtttac

SEQ ID NO: 70819 - DNA, 99 bp, Mus musculus
aacactgaaaaggctaagccagcaaatatttgagagagtgtatgtatgtatgtatgtatgtatctctgaggtccagtgtttgcctagcttgtgtaggtt

SEQ ID NO: 70820 - DNA, 177 bp, Mus musculus
catgtatgtatgtatgtatgtgtatatatatgtatgtgtgtatatgtatatatatatgtatgtatgcatgtgtatatatatgtatgtatgcatgtgtatatatatgtatgtatgcatgtgtatatatatgtatgtgtgtgtatatgtatatatgtatgtatgtatgtatgtatgtat

SEQ ID NO: 70821 - DNA, 93 bp, Mus musculus
acatgttcctagtcactctcgagtttgggcagggtatcttgggccttctcaaagcctgtctggtaacgaggatctggcagaatgggcacaagt

SEQ ID NO: 70822 - DNA, 67 bp, Mus musculus
acacagaagtggacagccactgtgagtctgtgggttggaagattcagtggtgtcatagtgcctgtgt

SEQ ID NO: 70823 - DNA, 83 bp, Mus musculus; identical to SEQ ID NO: 70739

SEQ ID NO: 70824 - DNA, 105 bp, Mus musculus
acacatatgtgggtgtatatttatatatacatgtgtgtacatatatgtgaattgtgtataggtatgtatgcatgtgtgtatgcatgtgtatatgcatgtgtgtgt

SEQ ID NO: 70825 - DNA, 109 bp, Mus musculus
tctgtacattcatacagatctgtggatctgtacatctgtgggtctgtgaatctgtggatctatggatctattggatctgtggttctgtggctctgtgggtctgtggttc

SEQ ID NO: 70826 - DNA, 69 bp, Mus musculus
agctgtgtgcctatccatctaaggtctcacactctgtgtgagatgaactaagtgagagagtccacagct

SEQ ID NO: 70827 - DNA, 105 bp, Mus musculus
gggacttcaggctgtgctcctccatccctggagcagtgtccagcagcttcacatagcctggcacccactctgcgtcagtgtggggtaagcccagtcgaaactccc

SEQ ID NO: 70828 - DNA, 73 bp, Mus musculus
taggaggatctagagagacagctcagtggagaagagcactggctgctctagcagaagtcctgggttcagttcc

SEQ ID NO: 70829 - DNA, 71 bp, Mus musculus
tactgctgacaatctctctctcacaggaggtggggaagccccctggacccttgactgagattgcagctgtg

SEQ ID NO: 70830 - DNA, 67 bp, Mus musculus
ggtcttactgtctctgactgtggcttgtccctcctgcaagcctgtgtgtcagtactcctggaagatc

SEQ ID NO: 70831 - DNA, 109 bp, Mus musculus
tgaaacagtttgatttgtcactgtataaaagtgatttggattgattgttcaggtacatatctgtgtctttctgtctcatttcccagagtcttaaagttgtgctgtatta

SEQ ID NO: 70832 - DNA, 90 bp, Mus musculus
tgcgacatagagactagaggtatagggtataagcaagatatagggtagatttagtttgtcttgactctcattcaggtttgtttatgtgca

SEQ ID NO: 70833 - DNA, 106 bp, Mus musculus
gagtcacctgtgaagagggaacttcaactgagaaactgcatctacaagtttagcctgtgggcatgtctatggagtatttttcttgtttaatcatatgggagggccc

SEQ ID NO: 70834 - DNA, 78 bp, Mus musculus
atgtatatgtgtccgcatgtatatgtatatatgtatgaacatacatgtgtccatgtgtgcatgtttgtacgtgtgtgt

SEQ ID NO: 70835 - DNA, 60 bp, Mus musculus
gagttagagccaggagccaccagtcccccagctctccaggacagcctctgtctgtgactc

SEQ ID NO: 70836 - DNA, 87 bp, Mus musculus
ggctcactggtgccgtctgtgtgtcagtttgtctgtctgtctttcacgcacatgcaagcacacatgcacgcatacacactcatgatc

SEQ ID NO: 70837 - DNA, 77 bp, Mus musculus
catatgaatatgcatgtatatatgcacatatacatattcatgtatatatgtatgtatgcatgtatattggttttttg

SEQ ID NO: 70838 - DNA, 108 bp, Mus musculus
caggccaagaggcctgccttgcctttgtgtttttctatacagaacactgaagactcagagctctgtccatggtcctgttataaagcaaaagcaggtgctgtttttctg

SEQ ID NO: 70839 - DNA, 100 bp, Mus musculus
ggtagctgtatgaggactctctggggttagcttgcatagaaataactggaacacatgtgattctcttgtggaggctctctggaaggcatgtggcggtgct

SEQ ID NO: 70840 - DNA, 89 bp, Mus musculus
ctagagtgtgctgtttcagctacaatgggaagccagcaagctgggtctgcctctctctgtttctcagtgctgggattagccacacctgg

SEQ ID NO: 70841 - DNA, 72 bp, Mus musculus
ctggtgacattttctgttgtcttgtctgggagagctcctgatatctagtgagaagacagagatgtcactcag

SEQ ID NO: 70842 - DNA, 103 bp, Mus musculus
tttatatgtatatctatatacatgtacatatatatgtatacacacacatgctatatatgtgtatatatgtatatgtatatatatacacagatacacagagaga

SEQ ID NO: 70843 - DNA, 95 bp, Mus musculus
accctccaccatcgtcgttctgactgaccacagagaggtgagcagggccatgaatctcagtggtgttcatctacttctggtcacaggaccagggt

SEQ ID NO: 70844 - DNA, 99 bp, Mus musculus
gaggcaggcgaatttctgagtttgaggccagcctggtctacagagtgagtacagagtgagttccaggacagccacgactacacagagaaaccctgtctt

SEQ ID NO: 70845 - DNA, 110 bp, Mus musculus
gaatgtgacctgctcagagccttttctctttacagccacactcagtcactataacctgagccctccatgacttaaagagaaaacctatagcctttagggccatcatcttt

SEQ ID NO: 70846 - DNA, 67 bp, Mus musculus
ggggttccaaagagttgccagtgaggccaggcagacccagctctactctgtctttggattaggctcc

SEQ ID NO: 70847 - DNA, 68 bp, Mus musculus
catataagctcagcactgactctgtgtgtgtccagcattgaccctcggtggctagcttcacatgtgtg

SEQ ID NO: 70848 - DNA, 91 bp, Mus musculus
gggaggtcataacacatccctggacaagtttgatagcctatgttctcagtatctaaagagaagaatgtcagtaaagtcgatgagtcttccc

SEQ ID NO: 70849 - DNA, 82 bp, Mus musculus
tgatttttcattttttaccctaaacacctttttgtagagagacaactgtctgttcagaggtggttcacaggctggagaatca

SEQ ID NO: 70850 - DNA, 112 bp, Mus musculus
cccaacattgtcagagtgaaattggggtgatgactcagcgagtaaagcactcactctgtgagtgtaaggcccagacttagtgctcccaggacccacacaagtgtcaggtggg

SEQ ID NO: 70851 - DNA, 92 bp, Mus musculus
gcattgagacaagacaatttacagtctacacagtgagctcccaggccagcagaaagcaccatgtatacttaaggattgtctgtatcatagtg

SEQ ID NO: 70852 - DNA, 114 bp, Mus musculus
tccttgaccaaggtatcatgagtagagtgttgttcagcttccacgtgaatgttggctttctattatttatgtttttattgaagatcagccttagttcgtgatgatctgatagga

SEQ ID NO: 70853 - DNA, 145 bp, Mus musculus
tacacagataagtaatgcattttaagtactctctatgtcaggtggtatgatataagggcttttgtgtatatatatatgtgtgtatatacatatatgtatatatatatatatatgtatattagagacagggcttttgtatgtatat

SEQ ID NO: 70854 - DNA, 101 bp, Mus musculus
gcctgtgtttgaaaactgaagttattgtagttactgtattttttttgatacaaatcctttgcagaaaacagaacttgtgatattttctttcagtatatggc

SEQ ID NO: 70855 - DNA, 83 bp, Mus musculus
ggcttgttcagagttctcaaacagcagacaaatcttggaggcttacttctgtgtgttgatgagacttgagagtgtgagcagcc

SEQ ID NO: 70856 - DNA, 57 bp, Mus musculus
gctgacactgtgtgatgtgacagaggagaacccttcctgtgagcatcctgtcccagc

SEQ ID NO: 70857 - DNA, 99 bp, Mus musculus
tgggttgcctcttagagtgtccatgtctgtctgtctgtctttattcctaggggatacattggtcctgatggaaaacctgggtgttttgactgcttccta

SEQ ID NO: 70858 - DNA, 76 bp, Mus musculus
ctcagaggccagaagagggtgtcagactccctgtgactggggttatagatggttgtaaactattgtgtgtgctgag

SEQ ID NO: 70859 - DNA, 100 bp, Mus musculus
gtgatctcttcagcattgtccttttttgttcattccatatgaattgtaagacagttatttttatttctatgaagaatgagatgattttgtttgggattgc

SEQ ID NO: 70860 - DNA, 115 bp, Mus musculus
tgcatttagcagtgtgtgtttgtgtgtgtgtgtgtgtgcgcacgcgtatgtatgtatgtatgtatgtatgcaacaacacttaatataaaggaggctatgaagttgaaacagggca

SEQ ID NO: 70861 - DNA, 76 bp, Mus musculus
ctagagacagcttgagttcaggaggtgagggagtgtcagaacactgtgaccttcaggataacccttaaggctctgg

SEQ ID NO: 70862 - DNA, 116 bp, Mus musculus
attctatagggagtagagggtgggattggggctaaatgatgtacattgattacactggatgaattcaggagataacttaactttctgccctgtaactttatcattaactatagagt

SEQ ID NO: 70863 - DNA, 72 bp, Mus musculus
actattgctctgtagtacagcttgaggtcacggatggtattcatcagaagtgctttagttgttgagaatagt

SEQ ID NO: 70864 - DNA, 69 bp, Mus musculus
tatgttttagagatcatggaaaggtgagatctactgtgtttgtgtgtctcacttatttcactcagcatg

SEQ ID NO: 70865 - DNA, 99 bp, Mus musculus
ccatttggtccattaacttctgttagtttcactgtgtctctgtttagtttgtgttaccgtgatgtactggctagttttatgtcaacttgacacagctgg

SEQ ID NO: 70866 - DNA, 98 bp, Mus musculus
tcttcagaaagatataaagtgacagatgactgctaggtaggtaagttgcagtagcacttcactcactcagactcatttttctgttgtctttaggagga

SEQ ID NO: 70867 - DNA, 118 bp, Mus musculus
ggacctctggaagtacaagttagtgttcttaaccactgagccatctctccagtctctgtctctggttcttgagagggctgtttgagttgtttctggacccttgcttcactgagggccc

SEQ ID NO: 70868 - DNA, 71 bp, Mus musculus
gtgtcagggagtgaggacttgcctaagtctcaggtgtgtgcccactgagtctctgggtctcaacctggcac

SEQ ID NO: 70869 - DNA, 105 bp, Mus musculus
aagctgaggtcacattgacaaagacaattttccaccaagatgacactccaccttaaaacagaagtgattatcttgtaggaaccaggtgtcactggcctcactctt

SEQ ID NO: 70870 - DNA, 102 bp, Mus musculus
tggccagggcacacagccactctgacctcggctctgcctctctgtctctttgtagtctttgcagtgagcaaatgaagtcctttctgtggtaggtgctggtca

SEQ ID NO: 70871 - DNA, 84 bp, Mus musculus
gaataggtaggaagagagtgggcagccttgtctagtccctgatttgactctcactttcacactcactttctcttccagcctctc

SEQ ID NO: 70872 - DNA, 58 bp, Mus musculus
atgtatgtatgtatgtatgtatacatggataaatgtatgcatgtatgtgtgtatgcat

SEQ ID NO: 70873 - DNA, 77 bp, Mus musculus
cagagtttcagtactcatgtgggcaaggagatggcaaaaaaatgacagacactgacacacagagagtgctgtatctg

SEQ ID NO: 70874 - DNA, 68 bp, Mus musculus
cttattacatgtgttatgtgtgtgtgtatatatatatatacacacacaccacagcatactgtcagagg

SEQ ID NO: 70875 - DNA, 113 bp, Mus musculus
gtagaatcaatagaaattatattctgcttagaatttagagtctatataggaaactatttttctagttgagatctctagactactataggaaaataataccaccatgaacatac

SEQ ID NO: 70876 - DNA, 138 bp, Mus musculus
gtggccttgttggaggtgtgtcataggggagtgggctctgaggtttcaaaagcccaagcccagctcagtctctgtttctctgcctcctgcctaggctactaagctctaggctactgcagccccatacatgcctgctga

SEQ ID NO: 70877 - DNA, 117 bp, Mus musculus
catcaaaacaaacctgctacagaggctggagagctggctcagcagttaagagcactgactgctcttccagaggtcttgagttcaaatcccagcaaccatctataataggatctgatg

SEQ ID NO: 70878 - DNA, 102 bp, Mus musculus
gcttcctcagtgcagaagttacaggcatatatgacccccaatcttttattttgtattaaaggtgatttatgtccattgtaaggtgtgtgtgtgtgagggtgc

SEQ ID NO: 70879 - DNA, 83 bp, Mus musculus
gggacaccggtcctgacagtcgaggtgggacccggtggctccatcctctgatttctgtctctgactttagggtttgtttgctc

SEQ ID NO: 70880 - DNA, 102 bp, Mus musculus
ggcacatacttagcatgtaggaggtcctgggtttgattcacagcactacataaactgtgtggtaatgtagacctaggatcacagcgcatgggaggaggtggc

SEQ ID NO: 70881 - DNA, 78 bp, Mus musculus
tctgtgagtctgtgtgtgtgcatattgtgtgggaacatcagtgcctgtgtaccacatcatgcactcagagctcagagg

SEQ ID NO: 70882 - DNA, 71 bp, Mus musculus
gccctgtcttgtctctctgtgtacttttcaaaagccaaccttgatcacatagcactgtctggaggcagggt

SEQ ID NO: 70883 - DNA, 81 bp, Mus musculus
tctgtctgtctgtctgtctgtctgtctgtgtatcaaggagtgatggcacttgtaagcccagcattagggaggcagaaacag

SEQ ID NO: 70884 - DNA, 56 bp, Mus musculus
actgggtagggaacataggggacatttaaaactgaagtcactgtgctctgtctagt

SEQ ID NO: 70885 - DNA, 81 bp, Mus musculus
gctccggcctgactgactgaggctctgactgaggctccataggcagccatcttctgtcagtctcagtccatctgcacgagc

SEQ ID NO: 70886 - DNA, 95 bp, Mus musculus
atacattatatatgtgtgtatatgtacgtgtatttgaatgtatgtatgtatgtatgtatatgtgtgtatacatatgcatatgtacgtctgtatat

SEQ ID NO: 70887 - DNA, 75 bp, Mus musculus
tgctgcctaggtgagtgcctggctctttttttttttttttttatggactctgggcattgatctcaggttccagca

SEQ ID NO: 70888 - DNA, 76 bp, Mus musculus
cagtgtgaagtagaaccctttagccatctccagagagaaggtggaaatgtctgatgggaaagttctctgccacctg

SEQ ID NO: 70889 - DNA, 136 bp, Mus musculus
atgtgtgtatgtatgtatgtgtgtatgtatatgcgtgtatgtgtatgtatgtgtgtatgtatgtgtatatgtatatgtgtgttgcctgtgtgtatatgtatattgcttctgtgtatgtgtgtatgtatgtatgtat

SEQ ID NO: 70890 - DNA, 110 bp, Mus musculus
gggtttctggtttcctggccccatgtctctgtgtcacctgggatgaggctggcaacgcctgagagaaaatagagtggtctcaaggaaaagggtggggcaaaggcctgccc

SEQ ID NO: 70891 - DNA, 78 bp, Mus musculus
gtgtgtgcacatgcatgtatgtgtaaatgtgagtgagcacacatgcataagcacatgccccccaacatgagcacatgc

SEQ ID NO: 70892 - DNA, 76 bp, Mus musculus
gtgtgtgcaaaagcatgtggaggctaaaggacaacctttactgtccatcttgtttttattgtttttgttttaagac

SEQ ID NO: 70893 - DNA, 74 bp, Mus musculus
ttgtggccaatccctcacgataagactggataagtgagagagcctctcactcagtcatcctcgagtggccacag

SEQ ID NO: 70894 - DNA, 81 bp, Mus musculus
ggcaggccacagatgttagagcagagtgtgtgcagaaactgtggcttccacctctgcggggtggacatctgtaggtgagcc

SEQ ID NO: 70895 - DNA, 106 bp, Mus musculus
ttgggctggagagatggttcattggctaagagtatttgttgttcttatagaggacctaggtttggtgcccaacatccatatggtggcttacaaccatctaactcca

SEQ ID NO: 70896 - DNA, 56 bp, Mus musculus
tatgtatgtatgtatatatatgtgtgtgtgtatgtatgtatgtatatatatgtatg

SEQ ID NO: 70897 - DNA, 74 bp, Mus musculus
ggaggaagtgttccactgggggttggctttgagtttgagatgctcatgccagacccagtgtctcactctcttcc

SEQ ID NO: 70898 - DNA, 78 bp, Mus musculus
cagtgtcgctggctgctctatctgtcacaactcaaagggttaagggagaggtaggcgtgcagaaacagctgctcactg

SEQ ID NO: 70899 - DNA, 86 bp, Mus musculus
aggtgtgcaccatcaggcactctgtgtgtctgctttcaggcggcatcctaccttgaaggaaaacttgaacagagcccgtgagacct

SEQ ID NO: 70900 - DNA, 70 bp, Mus musculus
cagaagcacttggactgtcatgagggctcggcaggtaagggctgccaagctgacagtctgtctgacactg

SEQ ID NO: 70901 - DNA, 88 bp, Mus musculus
attctaagttgatagtctctgtctgtgtttctggcttccttctgatgcttcacactgggctagagctgaactcttggctgcaaagagt

SEQ ID NO: 70902 - DNA, 57 bp, Mus musculus
gactaggatagctgagaaaactgccaggtccaggtagtatctcagtctctctgtgtc

SEQ ID NO: 70903 - DNA, 73 bp, Mus musculus
ggaatgacagagaggaagatgaattctgagcacagttatccttgtgtctgtctgtctgtctgtctgtctgtct

SEQ ID NO: 70904 - DNA, 99 bp, Mus musculus
cagaccctcaaaagagtagcaagtctcaacctcgagggagccgaggaagccctcaagccagtcagtctctctgtgggaagctttttgtttgtttgtttg

SEQ ID NO: 70905 - DNA, 57 bp, Mus musculus
ggcggtgagccttacttgagatttttagattgagaagttcaggtaagtcaaatggcc

SEQ ID NO: 70906 - DNA, 60 bp, Mus musculus
gtcagaaaagagaatgcagggggtcaggaagtggttactctgtctttttctcagtctgac

SEQ ID NO: 70907 - DNA, 96 bp, Mus musculus
atgaagatggattctatagcttaagggcctaggatctggtgtgctctcagtcacacagagtgtaggtgccaccaggctataaagtacatgtgacat

SEQ ID NO: 70908 - DNA, 82 bp, Mus musculus
gctacttggagcaggcgtggagtggaggaatgctcgcctaggggagcaatctccctctctcagtgttttctgcttagatggc

SEQ ID NO: 70909 - DNA, 70 bp, Mus musculus
gtctgtctgtctgactgtctgggtacaggcacttgagtgcaggtgctggaaaatttcagaggccttggat

SEQ ID NO: 70910 - DNA, 65 bp, Mus musculus
ctgtctgtctgtctgtctgtctgtatcatggtgaaggttgtgatgtagataaggagagaactcag

SEQ ID NO: 70911 - DNA, 118 bp, Mus musculus
gcagaggcaagaggatctctgtggggctggagagatggctcagcagttaagagcaatgactgctcttccagaggtcctgagttcgattcccagcaaccacgtggtggctcacaactgt

SEQ ID NO: 70912 - DNA, 82 bp, Mus musculus
tccttagcactacacagtgagctcaaggccagtctgaactattaaagactgtgtgtatgcatgcacatgtgtggcagaggga

SEQ ID NO: 70913 - DNA, 106 bp, Mus musculus
gccttagtccatggtgatctgataggatgcatgggacaatttcaatatttttgtatctgttgaggcctgttttgtgtccaatcatctggtcgattttggagaaggt

SEQ ID NO: 70914 - DNA, 84 bp, Mus musculus
tggggctgatcagagtgagcagaggtcctaaaaattcaattcccaataaccacatgaaggctcacaaccatctgaacagcttca

SEQ ID NO: 70915 - DNA, 96 bp, Mus musculus
catgagatagacacatgctcatcctggagtatattgctgaggtttgagcttgttttcttgacacccaatctactaccagagtattgctgtattatg

SEQ ID NO: 70916 - DNA, 108 bp, Mus musculus
atacatatatgtgtatgtgtgtatatacatatatatatgtgagtatatatatgtgtgtgtgtatatatacatatatatgtgtgtatatatacgtgtgtgtgtgtgtgt

SEQ ID NO: 70917 - DNA, 82 bp, Mus musculus
ggaagcgtgggcttgctgtcaccagatttttttttaatttgtccagaagaataagaaatctggtttgtttgtgtatgttttt

SEQ ID NO: 70918 - DNA, 110 bp, Mus musculus
ggttggctttatgctcgttcttacagtttctggaacagacagcttcctaagggcatttccttatctaggtgtttgacaggctcaattggattagctctgaagggacaatt

SEQ ID NO: 70919 - DNA, 72 bp, Mus musculus
ccagcatgccctgcctcacagtctctgacaggaatggttatatggagcctgtttcagtcagaagggagctgg

SEQ ID NO: 70920 - DNA, 73 bp, Mus musculus
gctggtagctctgtgacactgagagcctggggcagccgcttgcatttcattgtacaaggaagtgataccggac

SEQ ID NO: 70921 - DNA, 59 bp, Mus musculus
gtgtctgtctgtctgtctgtctttctcatacagagagagagagatcagagagatcttgc

SEQ ID NO: 70922 - DNA, 88 bp, Mus musculus
ggtgaccttagcatccccacaggctctcacagtctgtcatctctctattgggtacattgtggagctaaatgtgctgcttggagtctct

SEQ ID NO: 70923 - DNA, 118 bp, Mus musculus
cacctggtgagaggccacctccaggccctgtgaccactggtgtataggtaatttctttttatttgtaagtggaattgggtgaggtgaagaaagggcttgacagggtgagaaaggacat

SEQ ID NO: 70924 - DNA, 195 bp, Mus musculus
cagtctcacatgctctacatatgtgtatatgtatatgtgtgtatgtatatgtgtgtatgagtgtgagcatgtgtgtatgtatgtatgtttgtatgtttgtatgtttgtatgtatgtatgtatgtatgtatgtatgtatgtgtatgtatgtgttgctcctgagctgcagcaagctcgactgacacagaattcacat

SEQ ID NO: 70925 - DNA, 126 bp, Mus musculus
gcctgcccagagtttgacgttgttatgtgccgaggcaagtatactggtgactatcagactacactgagagcagagctgctgacatctcttaggatgccttacatttgaggtgggcagcagccgtgc

SEQ ID NO: 70926 - DNA, 105 bp, Mus musculus
ggcctggccaggtaagattaactggagtctggatttgggctgtggagtttctttctctgtctctgatcttggttttcaaattaatttttcccactgtcctttacc

SEQ ID NO: 70927 - DNA, 96 bp, Mus musculus
ctccgtgagatcagaggccatatgaggcaggcagaaggagctcagagaatgtgtgccgactccctgtctctcaggctgattcctagggtttcagag

SEQ ID NO: 70928 - DNA, 118 bp, Mus musculus
tatatgtatatgtgtgtcctatgtatatgtatatgcgtatatgtccatgtgtgtctctgtatgtgtatatgtatgtgggtgtattgcatgtgtgtatatgttgtatatgtgttgtgtg

SEQ ID NO: 70929 - DNA, 76 bp, Mus musculus
agctgagaggacctactgtgcacagccagggtcaggagctgagaggactgactgtgcacagccagggtcagaagct

SEQ ID NO: 70930 - DNA, 123 bp, Mus musculus
tcaagcattacttacccatgcatgcattatcctctcatctctttcaatttaaacacagagaattgtttttctaggttttgaggtcatggatgccaggacattagtgagtgttcgtgattaagt

SEQ ID NO: 70931 - DNA, 79 bp, Mus musculus
gaaacaaactgtacacaatcgtgtgcacacacacacacacacagtaggggagcaggatatgtgtgcatatttttgtttc

SEQ ID NO: 70932 - DNA, 114 bp, Mus musculus
tctttggctgatgttcccagggcactctacaggagcaacaaatgcactttaagtcactgtcactgtatcttgtgtgtctcctggctttgtaacccacatttcttcctctagaga

SEQ ID NO: 70933 - DNA, 106 bp, Mus musculus
attctgtactttttgagtagttgtgtatatgtatatggtatatggtatatatgtatatgtatgtagtgtttgtatatatgtagttgacatgccctgaggatggaat

SEQ ID NO: 70934 - DNA, 66 bp, Mus musculus
acagagaactctgtgtggacagatggtgacagaagatatggagtgtctgggccaggagaactctgt

SEQ ID NO: 70935 - DNA, 75 bp, Mus musculus
attctagctccgctacctttctagattccatctatgagtaagatcatgatgagtctctctgtgtctggctggggt

SEQ ID NO: 70936 - DNA, 57 bp, Mus musculus
cacctaatgtatatataaacccaaccccactctgggtgtgtgtgtcacatgttggtg

SEQ ID NO: 70937 - DNA, 71 bp, Mus musculus
catgaattatgtgtggaggtcaaaggacaacttttgcaagttggttctatccttctcccatgtgcagcatg

SEQ ID NO: 70938 - DNA, 114 bp, Mus musculus
acacgcagggaaacacacatacaaataaaatcaataaacctaaatgatttttttttaataaactggtttttttggtttgtgtatgtgactttttttgttgttttaagactgggt

SEQ ID NO: 70939 - DNA, 98 bp, Mus musculus
tttgtccttaaagtcgctgtcatataatcagagatgtgtttttctaggaatttatcccaagaattcattggttatatggctatataattatgttcaag

SEQ ID NO: 70940 - DNA, 88 bp, Mus musculus
ggagagcagatgtcaactttgtcttttttttctagagccattcactttcttttttgagacagagtctctcattgtcttggagctttcc

SEQ ID NO: 70941 - DNA, 85 bp, Mus musculus
ggccatggtggtctgataggatacataggacaatttcaatatttttgtatctgttgaggcctgttttgtgaccaattatatggtc

SEQ ID NO: 70942 - DNA, 105 bp, Mus musculus
ctttcttgccgactggagggcctgctgcctcgagagagtgtgcagagatgggcccggtcatctgcaagcctttcatggcagtccccttctaaagtagggaggagg

SEQ ID NO: 70943 - DNA, 74 bp, Mus musculus
aacaggtacctctctgaatctcagtttctctatctgctcaatgggtataagagaaatagatcagatgtgctgtt

SEQ ID NO: 70944 - DNA, 58 bp, Mus musculus
ctccactgtaggaatgagaaggatggatccaaatcacactctctctctctcctgggag

SEQ ID NO: 70945 - DNA, 112 bp, Mus musculus
gttgttaagagtacttactggggctggagagatggctcagtggttaagagcactgactgctcttccaaaggtcctgagttcaaatctcagcaaccacatggtggctcacaac

SEQ ID NO: 70946 - DNA, 60 bp, Mus musculus
cacagagatgtgagagtgtgcacatgcctgggcttatgtgcatgtgtgcacgtgcctgtg

SEQ ID NO: 70947 - DNA, 84 bp, Mus musculus
acatgtatatatttatctgtatttaaaggtgtatatttatgttcatgtgtgtgcacttctatacatttatgcttgtatacatgt

SEQ ID NO: 70948 - DNA, 80 bp, Mus musculus
ctcttgcagtctcacagtctttctctgtcagagggactagctacctcactcacagaaagcgaaaggaaggctggtaagag

SEQ ID NO: 70949 - DNA, 121 bp, Mus musculus
gctttccttcggctggccaagtgggccctcagacccctatgagaaagaggtgtctggctggctgaaacccagagccccaaagccttttacagctaagctggtagatctggggctcctcagc

SEQ ID NO: 70950 - DNA, 76 bp, Mus musculus
tgagatttgttgtggatgtgccattacagtgaaaagccccagtgtcagtcactcacatggtcatcctgtcttctca

SEQ ID NO: 70951 - DNA, 84 bp, Mus musculus
tcccacatgtttctgggtgtcattctctctctctcgtgtgtgtgtgggggggtgggggtataagtcagagtataacttatggga

SEQ ID NO: 70952 - DNA, 80 bp, Mus musculus
ttgtcactcactgactccttctccacttgagtaccgggaccctgaattctccctcgggttgagggactgactgagtccag

SEQ ID NO: 70953 - DNA, 84 bp, Mus musculus
tcaaaggagttggagagatggcccagaagtagagtgctcgctgctcttgcagaggactcgagttcatttccagtacccacatga

SEQ ID NO: 70954 - DNA, 117 bp, Mus musculus
agctggagagcttggaggaagagtagctgagagtctgggggagtcagagcacactgaggactaagccctcacctccctgccttctctcctgctacctccatcgcagcctggctcccc

SEQ ID NO: 70955 - DNA, 98 bp, Mus musculus
gggctttagtgtggtgagtcagaacatcgtggcagggaatacgtgggggaagtaaggtgtctctctgtggctgtgtagaggctgagaaacaagagccc

SEQ ID NO: 70956 - DNA, 85 bp, Mus musculus
ggccatggtggtctgataggattcatgagacaatttcaatatttttgtatctattgaggcctgttttgtgaccaattatatggtc

SEQ ID NO: 70957 - DNA, 90 bp, Mus musculus
ggaaaacctcatctcaggctagcaggacagtcttacttccagccacactgactctcaggctgtaagttctaccttgggattcggtggtct

SEQ ID NO: 70958 - DNA, 87 bp, Mus musculus
cgctcttctgccatctgtctctgtctccacgcttgtcctcaagagaggaggacatagaataagcagatggatggctggacagacgtg

SEQ ID NO: 70959 - DNA, 66 bp, Mus musculus
atcctgggacgcacagagagagcaggagcaggacatctgagtctcacagtgcttctactttaggat

SEQ ID NO: 70960 - DNA, 93 bp, Mus musculus
tggcaaattctgccattactttcaatgtctttgaaaaggttatcaaggcccagcctggtctgtggcattgtgtgatggcaacccaagatgtca

SEQ ID NO: 70961 - DNA, 79 bp, Mus musculus
aggtggcatgttttttctagtgtttggcagtagctgccattgctcctgtttgacacaagagtctgagcacaccccatct

SEQ ID NO: 70962 - DNA, 71 bp, Mus musculus
gcactgactgctcttccagaggtcctgagaccatattatggctcacaaccatctgcaatgggatcagatgc

SEQ ID NO: 70963 - DNA, 72 bp, Mus musculus
tgaagaggcagtgccagctttattattctcttgaacagacatacaatatggctgtgtgtatctgtgtcttta

SEQ ID NO: 70964 - DNA, 97 bp, Mus musculus
gcgcagccaggggctggagagatggctcagtggttaagagcactgactgctcttccagaggccctgagttcaattctcagcaaccacatggtggctc

SEQ ID NO: 70965 - DNA, 101 bp, Mus musculus
ttttttgaaataatttattttatgaacataagtgtgcttgagtatatatgtatgtatgtatatatagcacattcatgcaggagtatgaggaggtcagaaga

SEQ ID NO: 70966 - DNA, 82 bp, Mus musculus
ggtgatttcctgcagctttggcgtctctgtttctgcctctagtttcttttcggagacactgtgtccctctgcagaagtttct

SEQ ID NO: 70967 - DNA, 78 bp, Mus musculus
gtgtgtgtactagactgtatgtggatgtgcatgtgctgtggcgcgtgtgtgtgtgtgtgtgtgtgtgtgtgtgtgtgt

SEQ ID NO: 70968 - DNA, 108 bp, Mus musculus
tgcggactacagcatacatcctgccaactgcagcatcacaccagacacagcacactaacactagcaggtgtctactgatggcagtggccctgacctgccccctcccca

SEQ ID NO: 70969 - DNA, 75 bp, Mus musculus
gctcctatgactcagagaaatttgggaggctgtccagacagccaactgtctctgtcactgtcatagtctaggagc

SEQ ID NO: 70970 - DNA, 89 bp, Mus musculus
cttggaaaggcataagactcactaggccacttcccatggttatattaacaactattgacagaagagactgtggaattgcctgattcaag

SEQ ID NO: 70971 - DNA, 80 bp, Mus musculus
gcctgctgcctgtgcatcaggatgtaaagctctcagctgctgctccagtgccatgcctgcctgcctgcctgcctgcctgc

SEQ ID NO: 70972 - DNA, 87 bp, Mus musculus
ccctggcagccagactcgagccggcggggaacagcgcgcccaagctgagggagtgtggtttcctgattgtcctggctaaagcctggg

SEQ ID NO: 70973 - DNA, 65 bp, Mus musculus
tctggtcactgtactgagtgagctggccccacccttccactccagctcttcacagcagtggcagg

SEQ ID NO: 70974 - DNA, 71 bp, Mus musculus
gccactgtctctgtgtctcttgtgcagttgaaagctcctgcccctgagatcacatgagcagagacagttgt

SEQ ID NO: 70975 - DNA, 88 bp, Mus musculus
gctcctgacagtatcctcattccacttcaaagaaggtgatgaatatcagtatctccatgtggaactgcttcaactgtggcaaggtagc

SEQ ID NO: 70976 - DNA, 79 bp, Mus musculus
gacatacatacctatgagtggaatgatctttggtgtcgatgggagtccttgaggttaactgctcagatgctggtatgtc

SEQ ID NO: 70977 - DNA, 92 bp, Mus musculus
gctaggtgagaaagtgctttgtcagcactgggtacagatggaaaagcatgatggcctaccctctgtgtgtgtgactggctgtttctgcctgc

SEQ ID NO: 70978 - DNA, 103 bp, Mus musculus
ggttgctgttgcagtggtaggtggatagctcagcttgtccctaactgggccactcagtggacacagagcacaggtacttcctgctgtctgcacggttctcacc

SEQ ID NO: 70979 - DNA, 104 bp, Mus musculus
ttgtgcaggaatagaaaccctgactaagacaactatattccgtttttagaactttaaatgaacattaaggttgtaaaggaagggaacatgttttattctgccaa

SEQ ID NO: 70980 - DNA, 88 bp, Mus musculus
tgaagtaagtaaggggaaagggtgggattctatcttatttttatctgaaaatagaaggaacatatcacactcttcttgttctcttcac

SEQ ID NO: 70981 - DNA, 124 bp, Mus musculus
tatgtgtgtgtgtatatatatatacatatatatacatacatacacatgtatatgtatatatacatacacacacatatatatattcatgtatatatatatatatgtatattcatgtatatatatg

SEQ ID NO: 70982 - DNA, 104 bp, Mus musculus
aatggttagacatacaggctttgccctagtgctgatagattatatataaatgtctatttcttatttagtatgacactaggtgtcagaactactgtttgggtatt

SEQ ID NO: 70983 - DNA, 76 bp, Mus musculus
gcttgtccattctgctactgccattcctatcacccataaagagagacagagtgacagagaagatagacagacaagc

SEQ ID NO: 70984 - DNA, 64 bp, Mus musculus
gtctatcttctctgtcactctgtctctctttatgggtgataggaatggcagtagcagaatggac

SEQ ID NO: 70985 - DNA, 79 bp, Mus musculus
gcctgcccagagactgtggggctggccggccagtgtcatctcacactgcctcacacccaccttctactagtgccaaagc

SEQ ID NO: 70986 - DNA, 77 bp, Mus musculus
gccggcacacttccctctcactctctcgatgtctgtgcagcaaggaacatcagagtgtcttggctctgtgtgtttgt

SEQ ID NO: 70987 - DNA, 128 bp, Mus musculus
cagctctggggtcaggggatgccctgtggtggattctgaatttctgtgtatgtgcaactgcatggggaacaggcagattattgggcacatgagactaggctgtctgaatcttccttgagagactccct

SEQ ID NO: 70988 - DNA, 76 bp, Mus musculus
atggttggtgtctgagtcactggctgagacttgccacattctcagagcaagtctaggctgagcaggcaggaagtat

SEQ ID NO: 70989 - DNA, 92 bp, Mus musculus
gcaagctggataactatctcactctgtctctcaaaaatccccccaccgacggggaaagttaagtaagggctggagggattgtctggttttgt

SEQ ID NO: 70990 - DNA, 87 bp, Mus musculus
gagacgagggagaatgagtcttctagaaagtcaggttttactaaaagtggattactgtctgtctgtctgtctgtctgtctgtgtctt

SEQ ID NO: 70991 - DNA, 117 bp, Mus musculus
agctgtcttccagcagggtcgtggggatatggatgacctagtatctaccctgaggttgactgactgtctctgcctggcaatctagagtcacccctcctgcaggtttaatctgtagct

SEQ ID NO: 70992 - DNA, 80 bp, Mus musculus
gttggctgctcttgatggtgtagatcaagtggggcagcttgtctgactcactgattgtcatagtcagctggtggctcagc

SEQ ID NO: 70993 - DNA, 128 bp, Mus musculus
tgttgtatgtatgtgtgtatgtatgtatgtatgcatgtatgtatgtatgtatgtatgtatgtatgcatgtgtgtgtatatatgtatgtatgcatgtggatgtatgtatgtatgcatgtatgtatgtat

SEQ ID NO: 70994 - DNA, 101 bp, Mus musculus
ggcaccaggccagtgatgaaggctgcatgggtggaatgtggacagatgtctgcctggagtctggtgggtcacccagagctggtactgaatctctgaatctg

SEQ ID NO: 70995 - DNA, 108 bp, Mus musculus
agatcgtcagccagggcaagctttggaacctgctgggcttgggcacaaactcatcagctctgagtccaggcttcagtggcagaaagcagttttgtcggccgtccatct

SEQ ID NO: 70996 - DNA, 87 bp, Mus musculus
gaaggctcctgccggagtctaagtgtggtgcagggaccagctcagggcactgggaatccactgtctgtctctctggccacttccttc

SEQ ID NO: 70997 - DNA, 98 bp, Mus musculus
tgtgtgtatacactcacatatgtgtaatatgtgtgtgcatatatatgtgactgtgtgtggtgtgtgtacacataagtctgtgtaggtgagcatgtata

SEQ ID NO: 70998 - DNA, 63 bp, Mus musculus
gcagctctatcccagctcactctgttcctctctgccagggcagagtactgagcaagttgctgc

SEQ ID NO: 70999 - DNA, 114 bp, Mus musculus
gaggacaaagctttagaagtcttaagccattttgacgtttacatttcagagccattatgtgttagtcgacaggtttaaaattgcattccaagactcaaagaagggtgtgttctt

SEQ ID NO: 71000 - DNA, 89 bp, Mus musculus
gcatttgtttcagcttgcagctctcattctctgtctatcactgagggatgccagggcaggaacctgaaggcaggagctgatgcagaggc

SEQ ID NO: 71001 - DNA, 74 bp, Mus musculus
ggcacattgtcctggctgatggctgtatgtccctgctgtgactctcaggccctcactgtcacctggtggctgcc

SEQ ID NO: 71002 - DNA, 73 bp, Mus musculus
gttcccgactagttgtcagtgtttggaatagggtgtggagacagacagacagacagacattaaggtcaagaac

SEQ ID NO: 71003 - DNA, 98 bp, Mus musculus
catgtttggagcacctttggagagtatctactgcatcatgtgttacagtcactcactgttttctgcaatactttcccaatatttcaaaactctgcatg

SEQ ID NO: 71004 - DNA, 57 bp, Mus musculus
ccagagtggctggctctctgggcctgactacgggaacctggagtcagcttccttagg

SEQ ID NO: 71005 - DNA, 71 bp, Mus musculus
ccctgctcttcatacacatctctatctgtctgctccctgctcagcagccttgggtggatgtggttgcaggg

SEQ ID NO: 71006 - DNA, 70 bp, Mus musculus
cccagtgcctgtgtgtggaagggctgaaggccccattctatgactctctcttcctcacttctgagctggg

SEQ ID NO: 71007 - DNA, 64 bp, Mus musculus
tgggtaaaatggagaaagtgagttgagcactaatgtttgctcatctctctctctgtgtttccta

SEQ ID NO: 71008 - DNA, 76 bp, Mus musculus
gccatcctagccagagttggacacagaagtgactctgccagcatgtctcaaaactactgtactgactgttaggagc

SEQ ID NO: 71009 - DNA, 94 bp, Mus musculus
cgggacctgccagtaagggtgtgatgtgaagcttggggcacggatctcaaaactgccacagatgacagccagcttagttgggaggagaaacccg

SEQ ID NO: 71010 - DNA, 115 bp, Mus musculus
tccccccgctaggacaagcagactcaaggctgtcagggtttaaactgggtaccacactctttctctcaatgcctggaccctcacaatgccctagaatggatgttccggggatggg

SEQ ID NO: 71011 - DNA, 83 bp, Mus musculus
gttagtgcatgcccagcatagccctggaggtctagagtcctttcccagactctggctctgtccctgtgcccatcccctttaac

SEQ ID NO: 71012 - DNA, 76 bp, Mus musculus
cagaaactaagctggaagggctcggcgcttaagagcactgactgctcttccagaggtcctgagttcaattcccagc

SEQ ID NO: 71013 - DNA, 72 bp, Mus musculus
aagggacactgctggtgtgtatgtggacagtctgggattcagagatgttggagacagaacacagtgttcttt

SEQ ID NO: 71014 - DNA, 105 bp, Mus musculus
acaacacatggctctgatccacaagggagctgagttctaggtgagagagaagtgagtcaccagagaagcaagtatggccccctgagtgttgcaagtgtgtgaggt

SEQ ID NO: 71015 - DNA, 63 bp, Mus musculus
aggcaggctgtgtctctctctgcctgctctgtatagctggctctgcagtctgaaagcctggct

SEQ ID NO: 71016 - DNA, 82 bp, Mus musculus
ctgtgagtggagactgcacagaatcctggggggtgggggtgttctcaatctctctctgcctctgtgagtgtccattaaccag

SEQ ID NO: 71017 - DNA, 88 bp, Mus musculus
atgtgtgtatgtatatatgtatgtatgatatatggatgtgtgtatgtatatatgtatgtatgatatatggatgtgtgtatgtatgtat

SEQ ID NO: 71018 - DNA, 74 bp, Mus musculus
aggatgaagtcaagcaaaccagggctagtcttctatgtgtgtgtcctacctctgtgtgtgtgtgtctgagtcct

SEQ ID NO: 71019 - DNA, 135 bp, Mus musculus
gctagaggagctgagagttctacatcttgattcaaaaggcagcaggaggagactatgtcacactggtagacttgagaatatatatgagacctcaaagtaccagctccacagtgacacacttcctctaacaaagcc

SEQ ID NO: 71020 - DNA, 127 bp, Mus musculus
gggggagatacctgggggctccgtagtttgctctagacttctgggaagcctctagagcattctctccctctgtgtatctgttccctggggcaaaagaaacccctacaaagttcagaggcaaagaggg

SEQ ID NO: 71021 - DNA, 68 bp, Mus musculus
tgcctgtctttctgtctgtcagatggaggcacaagggttcttcatccagctgagctcagagaggggca

SEQ ID NO: 71022 - DNA, 118 bp, Mus musculus
gcttgatggggcagctgtgtagctgagagcagaagtgtgtttgtgtgtgcctgtcagcctgactgtgtgtgagggaatgtgtgagcccgctggtgtgaggctatgtgactgtgtgagt

SEQ ID NO: 71023 - DNA, 126 bp, Mus musculus
gaggcatcagtagtgaaaactgtggccaggatctgaagatagcaggcctgagtctgaagttactgtgctctcacccagctgagctctctaaggaggacagacaatgcccgctggggaaatggaggc

SEQ ID NO: 71024 - DNA, 118 bp, Mus musculus
gctcagacctcggcagggaccagtttggaagtcattgctctctgggtgagactgtctgagtgacaggctctgaaagttggagccatgcactccaaggagaaggccagagacagtgagt

SEQ ID NO: 71025 - DNA, 117 bp, Mus musculus
tccctgtgtgctgtggcccatggcagctccaccctgcaaccctcagtctctctgcgtcttaaccagagccatgactcgtggggacagatggcctctggattagtgggtctcagggga

SEQ ID NO: 71026 - DNA, 120 bp, Mus musculus
tatgtgtgtgtgtgtctgtgttaagtatgtgccacataaatttgtatgtgtgtgtgtgtctgtgtaagtatgtgccacataagtttgtatgtgtgtgtctgtgtaagtatatgccacata

SEQ ID NO: 71027 - DNA, 129 bp, Mus musculus
tatgtgccacataagtttgtatgtgtgtgtaagtatatgccacataagtttgtatgtgtgtgtgtgtgtctgtgtaagtacgtgccacataagtttgtatgtgtgtgtgtctgtgtaagtatatgccac

SEQ ID NO: 71028 - DNA, 118 bp, Mus musculus
ttgtgtctctgtccctctcatattttaggtctgactccaacctagcaaagccagagagggagagagtcagggtgactactttgggcaccactgccttgagctggcttctgtcactctt

SEQ ID NO: 71029 - DNA, 63 bp, Mus musculus
acattatatatataagtgcgtatatgtatacgtgtatatatgtatgtatgtatgtatgtatgt

SEQ ID NO: 71030 - DNA, 120 bp, Mus musculus
acgcatatatatatacatatatgtatatatatatgtatatatatatgtatatatatgtatatatatacatatatatgtgtgtgtgtatatgtatgtgtatatatatatgtatatgtgtat

SEQ ID NO: 71031 - DNA, 85 bp, Mus musculus
ggtattctatatgtcaaactcagtagagcaaagacagtgtccacacatgggacagcatcatgctgctgcttgaacctgaaagacc

SEQ ID NO: 71032 - DNA, 112 bp, Mus musculus
cctgtcccgtgagtcttctaagccctgctaccccgcttcaccatgtggaagtgcttcttagagtcaccactatggtgagcaggacaggggctactgggtgcaaatgggcatg

SEQ ID NO: 71033 - DNA, 61 bp, Mus musculus
ctgcatgtgtctgtgtgtctcaccctgcctggtggcatgtttttctcatggaggcaagtag

SEQ ID NO: 71034 - DNA, 125 bp, Mus musculus
gctctgccctgtgcatctgtgagttctgcatgggaggggctccaggagtggagagtgagcagacaggaggcagggacaacacttggagtgtccttgtcatttgcgggactgctctgctaggcgcc

SEQ ID NO: 71035 - DNA, 117 bp, Mus musculus
cagtccatgtgtctgtgtgggatacttcctattcaagccaagccacagtggccactctgcctgtcactcagaggcctggagtgggtagaagtatatgtctagcctccatgtcctgac

SEQ ID NO: 71036 - DNA, 59 bp, Mus musculus
gtgcctgcctactgccgtgacggtcatggactcaccctctgacactgtaggcaagccac

SEQ ID NO: 71037 - DNA, 81 bp, Mus musculus
tgcggttacacctgactctgctctcccagctgcaggctgaggcttgccctgagctgcgatctgtctctgtgtctgactgta

SEQ ID NO: 71038 - DNA, 101 bp, Mus musculus
tggacatagagttggcaagaattgacagacaaacgcagacacaagagagtgtgttgaatctgaatgtgttttgtcaaatcaagcatcaaactttttataca

SEQ ID NO: 71039 - DNA, 95 bp, Mus musculus
agactctcagcattttctctgtgactcactgtgtcagctggatgtgtgactgactaattctaacagtgacaggtaaagatagctgggctttgtct

SEQ ID NO: 71040 - DNA, 78 bp, Mus musculus
cacgactcagactcacacagaggctcagcgccctgagagacaatggtgtgtgtgtgtgtgtgtgtgtgtgtgtgtgtg

SEQ ID NO: 71041 - DNA, 85 bp, Mus musculus
tacatgcttcccatgtctaaatgttttgcatgtctgaatgttttgcattttaaatgtaaacatgttttgcatttagatgtatgta

SEQ ID NO: 71042 - DNA, 90 bp, Mus musculus
ctgggttgcagctatctttcagtttttgctggtgaatggtgaggagggctttgcaggtaagctaggaggttgaatagtggtgtcactcag

SEQ ID NO: 71043 - DNA, 69 bp, Mus musculus
ctgtctctgagcattggaagacagatacagtcacacactgtgcctgtctgcctacttccctgaggacag

SEQ ID NO: 71044 - DNA, 77 bp, Mus musculus
cctgtcactcacactcaaagtgctctgaaggccacacacaaaagggacaagccagagagcaatgtgaactgtacagg

SEQ ID NO: 71045 - DNA, 118 bp, Mus musculus
cacatttatgcgtttcctgctggcctgggggctgctctactgagttctctgagagcagacttgtctcagtgactaaacaggcaaagccctatgcagaccacagggggtgatgaggagg

SEQ ID NO: 71046 - DNA, 84 bp, Mus musculus
gtgggttaaggagaggtgtgtgactctctgggagtccctgggagcccagagctgatcgctgcaatgaggctcctgttctctcac

SEQ ID NO: 71047 - DNA, 116 bp, Mus musculus
gatggggaagatacaggtgaatgggggcacaaggaaacacaggtgacagtggacagatggctgcctccacccaaatgtttgctctgcccccctaattcatgtgttggaatctaatc

SEQ ID NO: 71048 - DNA, 70 bp, Mus musculus
tacagtgtgtgtgtgtgtgtgcgcgcgcgcgtgcagtgtatgtgtatgtgtatatgcatgtgcatctgtg

SEQ ID NO: 71049 - DNA, 90 bp, Mus musculus
gggttcaatgttacaggccattctgtcactctgtgggtcataggaaggagctggaagcctgtgagctgggagaatggtgtgttggaagac

SEQ ID NO: 71050 - DNA, 116 bp, Mus musculus
gtaggacattttcgagactgtctgggctgtagagatctccagctggctccatgggtccctctctcagtcctgggctgttggacttctttcagtgtcatggcagacagcctccttgc

SEQ ID NO: 71051 - DNA, 116 bp, Mus musculus; identical to SEQ ID NO: 71050

SEQ ID NO: 71052 - DNA, 140 bp, Mus musculus
gtgtatgtatatgtatgtatgtgtgtgtgtatatatatatgtgtgtgtatatatacatatatacgtatgtatatatgtatatatgtatatatatatatgtatatatatatatatatatatatatatatatatatatatat

SEQ ID NO: 71053 - DNA, 81 bp, Mus musculus
tagtcagtcagtcagtcagtcagtcagtcagtcagtcagtcagcctgcctgcctgtctgcctgtctgtctgcctgcctact

SEQ ID NO: 71054 - DNA, 106 bp, Mus musculus
gcttgcccacatctggaggcatcggggatcagagacaagacagaaagcagggctgttctatcatcctcaagtcttgcactcagcattccacttcttccaggcaggc

SEQ ID NO: 71055 - DNA, 85 bp, Mus musculus
tcagctgtgccagagacctgagatcagggaggccccagcgtacctatgggggtgactctgagactctcagcagtggaaaatatga

SEQ ID NO: 71056 - DNA, 154 bp, Mus musculus
gtcctatgatcttagagatatgtgatcagctttttattttgattttataggggattacagttaaatgattggttgagtctcagaagagtctctggactttggacttttaagattattgagactactatggactgtggggacttttgaagttgga

SEQ ID NO: 71057 - DNA, 111 bp, Mus musculus
atgtatgcccacatgtgtatatatagatatatctatgtgtatatgtatatatagatatacacatagatatatctatacctatatatacatatataaatatggatatatcta

SEQ ID NO: 71058 - DNA, 58 bp, Mus musculus
gtatagatatatctatgtgtatatctatatatacatatacacatagatatatctatat

SEQ ID NO: 71059 - DNA, 116 bp, Mus musculus
aagatggacaccaagcccttctactgagcttgccacccagggctcacttggaggtctctccagtttctctcacatggtttcagcaagattagtgaaaacatggctaaccccttttt

SEQ ID NO: 71060 - DNA, 85 bp, Mus musculus; identical to SEQ ID NO: 57470

SEQ ID NO: 71061 - DNA, 80 bp, Mus musculus
gctatatatgtatgtatgtatatatgtatgtatatacacttattttatacatatatgtatttatctatattatatatagt

SEQ ID NO: 71062 - DNA, 84 bp, Mus musculus
aggagagccaacagtcagcctgtttctctgtggggctacttggcttttggattcatgaagattgcttggcttaattcagttcct

SEQ ID NO: 71063 - DNA, 109 bp, Mus musculus
gcagccttgagaaggcttgctctcatcgctcttcctcactgacaggctctgtgattggcaccagtggaagcctagcattgattagtttccatgacagctttgcctctgt

SEQ ID NO: 71064 - DNA, 118 bp, Mus musculus
gtaaacacacacagacactgagatatgcatatgtatgtatatatatatatatatatatatacatatatatatatatatatacatacatatatatattatacaggtaatacacagaggc

SEQ ID NO: 71065 - DNA, 99 bp, Mus musculus
ctttgactgactccctaagctgtgttgtgaggattgaagtggggttcccaggttatgcacagccagggacactccccaaagtcagcctccccgcacggt

SEQ ID NO: 71066 - DNA, 95 bp, Mus musculus
tctgtctgtctgtctctctctcacacacacgcacacacacacacacacacacacacacacacacacacacacagagagagagagagagagagaga

SEQ ID NO: 71067 - DNA, 79 bp, Mus musculus
gatgtgggaaatctctcaaggtctcacccatagataaactacatcaatggtgctgagagaagagagtcttctccaggtt

SEQ ID NO: 71068 - DNA, 103 bp, Mus musculus
ggagagcaccctggggcagaggtctggagatgggaaagccaggctgtgtgggctggaaaacttttgtttttatttacgagactgatttgtgtatgttaaggcc

SEQ ID NO: 71069 - DNA, 95 bp, Mus musculus
tgtgtgtgtgtgtgtatgtatatatatgtatatatatatatatatatgtgtgtatatatatatatatatatatgtatatatatatatatatatat

SEQ ID NO: 71070 - DNA, 112 bp, Mus musculus
cctgtcgccaccctgagccagctgttaggtcggtgagacagactctctgtcttgctagagactccctgtcttcaccgagagctaaagagataggcccagtttggggtccagg

SEQ ID NO: 71071 - DNA, 91 bp, Mus musculus
ctgggactggaggagtgtggacattgtcctggaaggggagtgacagatgagactggagagtctcttaggcaggggcacaagtaaggatcag

SEQ ID NO: 71072 - DNA, 81 bp, Mus musculus
ggtctcgctctgtgtctgtcatcctcccatagtcagacatggtgtggctaaaaaagaggaagaaagcatgagagtggtgtc

SEQ ID NO: 71073 - DNA, 94 bp, Mus musculus
ccgttttggatttcgttgacgattacttaaaaagtatttcattttcttctaaaggtcaaatgtggtatttcataagagatgcaatttagaatgg

SEQ ID NO: 71074 - DNA, 112 bp, Mus musculus
tggcctataggtggagactatcagagatcttttcagcacctgcctataatttgtatattttcatataagtttgggtaaagctgttatgatgtctgttgttttattttggtga

SEQ ID NO: 71075 - DNA, 72 bp, Mus musculus
gaggggaacccaagtccacagggggtgaggatgcggtcggtctctctctctgtgtccgtgtgagttgctgtc

SEQ ID NO: 71076 - DNA, 68 bp, Mus musculus; identical to SEQ ID NO: 68929

SEQ ID NO: 71077 - DNA, 72 bp, Mus musculus; identical to SEQ ID NO: 68928

SEQ ID NO: 71078 - DNA, 85 bp, Mus musculus; identical to SEQ ID NO: 68927

SEQ ID NO: 71079 - DNA, 97 bp, Mus musculus; identical to SEQ ID NO: 68926

SEQ ID NO: 71080 - DNA, 108 bp, Mus musculus
gacgggtacctgggacgggtggaggtggggttggggctgacctagggaaaggctgttcctgtgtggctctcagagtctcctttcatctcagccaggtgtgtaactgtt

SEQ ID NO: 71081 - DNA, 77 bp, Mus musculus
gtctgtccctcactcccactcttgaacctggcatctactccctgtgtccaggttcacagtggggtagacaaggggca

SEQ ID NO: 71082 - DNA, 85 bp, Mus musculus
gtccatggtggtctgataggatgcatgggacaatttcaatatttttgtatctattgaggcctgttttgtgaccaattatatggtc

SEQ ID NO: 71083 - DNA, 88 bp, Mus musculus
taacagctttgtgtgtcttatcccatgtgtcctttggcagcctgatgctgtaggagccacagagcacagtgagcacaattgcctgtta

SEQ ID NO: 71084 - DNA, 109 bp, Mus musculus
tattaaaatcctttatattgggctgaagagatgactcagtggttaagagcactgactgctcttccaaaggctctgagttcaattctcagtaaccacgtgggatctgatg

SEQ ID NO: 71085 - DNA, 81 bp, Mus musculus
gtgagactctgactctgtgatacagtttccatgatgtcatcatccatgaggaggtgggagcagcttctttggaggactcac

SEQ ID NO: 71086 - DNA, 89 bp, Mus musculus
gaatggaaatatataagtgagcatgtgtgaatctatatatgaatttatgtgagattatgcatatttgcttatgtaaaagtttttccttc

SEQ ID NO: 71087 - DNA, 84 bp, Mus musculus
gtgtgtgtagcgtatatatatatatatgtctgtagcgtatatatatgtgtgtgtagcatatatatatatatatacagtctgtgt

SEQ ID NO: 71088 - DNA, 67 bp, Mus musculus
gcccacgcacatggctgacagagtcatcagagatcctgtaagagttcagtcagtgtctgtgtgaggt

SEQ ID NO: 71089 - DNA, 107 bp, Mus musculus
tgaccagtcccaggagcccagtagtctgcacttgctcctctgtgagatgacggtgaggacagtctcagtgaggaccaatgtggatcctagtagctccttagccatca

SEQ ID NO: 71090 - DNA, 87 bp, Mus musculus
gcaagcttggtagattcagtattcatccttcactcttcagttttctcaggtcctgaaactgctggattcaagccacaccaagctcac

SEQ ID NO: 71091 - DNA, 97 bp, Mus musculus
cagagtagtacctgccattctggatgttgtatttttattcttgagattgtcaagattgctgttacctattctctcagaatgagcaccacttgatctg

SEQ ID NO: 71092 - DNA, 80 bp, Mus musculus
ctcattgtcctctgtccactgtctctgtgcttctctgatgtccccacagatccaggctgtgtgtcagcttaggccaggag

SEQ ID NO: 71093 - DNA, 85 bp, Mus musculus; identical to SEQ ID NO: 57470

SEQ ID NO: 71094 - DNA, 98 bp, Mus musculus
ccacagagactccactgatgagagatgagcaagaaaccaggcagaggtagatgtatctatcatttcccccataaaccctcagtttacagtgtcagtgg

SEQ ID NO: 71095 - DNA, 84 bp, Mus musculus
gtatattttttatttttatagctattataactagagttttctttatagtttctctagttcattattgctgtttagaaaatgtgc

SEQ ID NO: 71096 - DNA, 167 bp, Mus musculus
gtgtgtgtgtgtgtgtgtgtgtgtatatatgtgtttgtgtgtgtgtgtgtatacatatatatgtatatatatacacacacatataagtatatatgtatatatatatgtgtgtgtgtatatatatacatgcgtgtgtgtttataagtgtgtgtgtgtgtgtgtgtgta

SEQ ID NO: 71097 - DNA, 93 bp, Mus musculus
acatttcaaaagaataatttctgtatctacatctttgtgcatgtgcatgtgtgtgtacatgtgtgtgtagatcagaagacagtttgcaggtgt

SEQ ID NO: 71098 - DNA, 85 bp, Mus musculus; identical to SEQ ID NO: 57439

SEQ ID NO: 71099 - DNA, 82 bp, Mus musculus
ttaggtgtgagttagtgtttaccaccccatatgtaaagcaggtttcatgctggtgagtcacacactcagatttacattctaa

SEQ ID NO: 71100 - DNA, 117 bp, Mus musculus
tattaccagttggaacatcctctgggtatatgcccaggagaggtattgctggatcttctggtagtactatgtttaattttctgaggaatgaccagactgacttccagagtggttgta

SEQ ID NO: 71101 - DNA, 119 bp, Mus musculus
gtgtgtgtgtgtgtgtgaacatgattcttgtatccatgtgccattgtcagttttcttttctaggtgtatggtgaatggtatacttcgagacacatatgacattggatcctgttgtgata

SEQ ID NO: 71102 - DNA, 56 bp, Mus musculus
atatacatatatatgtatacacatatacagataagtgtgtatatatatgtgtatat

SEQ ID NO: 71103 - DNA, 85 bp, Mus musculus
ctatgtgttctctttatagggcacttgatagcaggtagtttgcttcttatgactgagcaggtgacactaaagagtgagcccatgg

SEQ ID NO: 71104 - DNA, 82 bp, Mus musculus
tctctgatgtgtctggaaacctctctctcaaactcacacagtgacattgtgggaagagccaggctccagtgtcacatagaga

SEQ ID NO: 71105 - DNA, 81 bp, Mus musculus
ctaattgaggtgacgcagtggaatcacgggtagtgtgggagtcatggggctaatggagtcactttgcttatctttctgtag

SEQ ID NO: 71106 - DNA, 89 bp, Mus musculus
cagtcaggactaaacatcagacttgatggcgtggacatcagacttggatgtttattctcattttgaaaatctgtgtttgaaaaagattg

SEQ ID NO: 71107 - DNA, 78 bp, Mus musculus
ggtaaaggccaattgtgttctctgagatcgtgaaggctctaccctttagtcacagaggactgactgagcagataaacc

SEQ ID NO: 71108 - DNA, 143 bp, Mus musculus
atagatgtatgtatgtatgtatgtatgtatgtatgtatgtatgtatgtaattatgtatgtatgtttgtatgtttgtatgtatgtatgtgtatgcatgtatatgtgtgtatatatatatgtatccacacacatataaacataca

SEQ ID NO: 71109 - DNA, 91 bp, Mus musculus
tataatgaagctagcacagaacatagaaagctttctgtctcattcacttgagtgtagaagtttcaagtctgtgccatcttccctagttatg

SEQ ID NO: 71110 - DNA, 116 bp, Mus musculus
atatatatatatatatatatatatatatacacatatatatatatatttatcatacacacatgtatatatgtatatgtgtatgtgtctatatatatatatatatatatatatatata

SEQ ID NO: 71111 - DNA, 116 bp, Mus musculus
tgtgagattgtgtgtttgtatgatgtatatgtatacacacatatttaggtatgtatataaatatacatatgaatataagtttgtgtatatgttatatcatattattatatctggga

SEQ ID NO: 71112 - DNA, 105 bp, Mus musculus
agtattctggattttttgtttttccagatgaatttgagaattctctctctctgtgaagaattgagttggaattttaatgggattgcataaaatctgtagattgct

SEQ ID NO: 71113 - DNA, 105 bp, Mus musculus
cttcacaggtaagaagacaattggccttatgttcctttgtttcattgctacacagtttgtaaatgtcagagcaataacagtgcttgctcttgcttgtcctggagg

SEQ ID NO: 71114 - DNA, 118 bp, Mus musculus
gtgtgtgtgtgtgtgtgtgtgtgtgtgtgtatatacatatatatatatatatatatatatatatatacatatatatatatataatgtgtatgtgtgtgtgtctgtatgtgtctgtgtg

SEQ ID NO: 71115 - DNA, 110 bp, Mus musculus
aaatgtactatttgatatgagtttagagttggaggagagatgtgaggtagaaatgttatctatctatctatctatctatctatctatctatctgttatattagtatattt

SEQ ID NO: 71116 - DNA, 73 bp, Mus musculus
aggaggctaggaagtggtatgtatagtatactaggcatattgcctttatttgtatacgttcttcatgtctttt

SEQ ID NO: 71117 - DNA, 85 bp, Mus musculus; identical to SEQ ID NO: 57439

SEQ ID NO: 71118 - DNA, 119 bp, Mus musculus
gctgtgctataatctggtgtctttctatttcccgctgaataaggagctaaatatgtatttctatttttgctactaattaaatgtgcatgacatagttgagaacagagactgcactatgc

SEQ ID NO: 71119 - DNA, 112 bp, Mus musculus
ctgtgggactgagagggtgaacctttgtggacacactgaacaaacagtgcagaacagtatttgcatggttgcatgtcaggttgtgctttcttccttacctagttccatccag

SEQ ID NO: 71120 - DNA, 117 bp, Mus musculus
tcagcctttagtccatgatgatctgataggatgcatgggacaatttcaatatttttgtatctgttgaggcctgttttctgagcaattatatggtcaattttggagaaggaaccatga

SEQ ID NO: 71121 - DNA, 92 bp, Mus musculus
catctatctgagagtactgagttatctcagataattttaaaatattttaaatgtatcattgggaactaagactggtgttctgagacagcttg

SEQ ID NO: 71122 - DNA, 116 bp, Mus musculus
gttgttctctgtgcatcactgaaaatttaatgagatgttatctttctaattttatatgtaaggcattggaatctcagagcttaacatcttttatcctagtcacagggctactcagc

SEQ ID NO: 71123 - DNA, 95 bp, Mus musculus
atatatatatatatatatatatatatatatatatatatatatatgtgtgtgtgtgtgtgtatgtgtgtgtgtgtaatgcatgtgtatgtatatat

SEQ ID NO: 71124 - DNA, 70 bp, Mus musculus
acgtcactataatttccacttaaacatgggtaagagcagactgtgtggatgtggatgtggaagtagatgt

SEQ ID NO: 71125 - DNA, 107 bp, Mus musculus
gttaatataaattcctccaattatgcaatgtgtgtgcatacatgtgtgtatctctgtgtgtgcattgtgtgtgttttcatttttgtattcttaggaattgctttcac

SEQ ID NO: 71126 - DNA, 71 bp, Mus musculus
gccttcagacagaccacagtcagggctttcctaagccttcagccattctgattcacgcctgtctggagagc

SEQ ID NO: 71127 - DNA, 85 bp, Mus musculus
gtccatggtggtctgataggatgcatgggacaatttaaatatttttgtatctgttgaggcctgttttgtgaccaataatatggtc

SEQ ID NO: 71128 - DNA, 119 bp, Mus musculus
ttggaattttgatggggatttcactgaatctctagattgattttggcacaatgtttgtttttactatattaatcctgccaatccatgagcatcagagatctttccatcttctgagatct

SEQ ID NO: 71129 - DNA, 68 bp, Mus musculus
cactaggaaaatacagggtggatttcaggcccctcctggccccgtgactgtcactcattcacttagtg

SEQ ID NO: 71130 - DNA, 92 bp, Mus musculus
actccactgttcttcctggccctgaaggcccactggctgagggctgagttgtctgtctctcaagcctcttccttcccacaaacacactgagt

SEQ ID NO: 71131 - DNA, 66 bp, Mus musculus
actcaactcagcacatatatatatatatatatatgtgtgtgtgtgtgtgtgtgtgcatgtctgagt

SEQ ID NO: 71132 - DNA, 78 bp, Mus musculus
ggaggaacacagaaatgtagatagtacttatttatttttcctaagtatttgattgcatttcttgattagtgtttattc

SEQ ID NO: 71133 - DNA, 58 bp, Mus musculus
ctaagatcactcccactgagtcttgagagtcacctcccaaggttctgggactttttag

SEQ ID NO: 71134 - DNA, 85 bp, Mus musculus; identical to SEQ ID NO: 57439

SEQ ID NO: 71135 - DNA, 85 bp, Mus musculus; identical to SEQ ID NO: 64855

SEQ ID NO: 71136 - DNA, 65 bp, Mus musculus
atggccttgacaaggagctgaaataaatggaatacatttttgacagtgcctctgtctgtgaccat

SEQ ID NO: 71137 - DNA, 69 bp, Mus musculus
agaagactataccctaggtacagggtactgctcccatgatgcagttctctctgtgtgtatgtgtcttct

SEQ ID NO: 71138 - DNA, 64 bp, Mus musculus
ccagtgtctctcactgagcctgtggaccactgacttggccaagttggctggcaggatccactgg

SEQ ID NO: 71139 - DNA, 85 bp, Mus musculus; identical to SEQ ID NO: 57470

SEQ ID NO: 71140 - DNA, 74 bp, Mus musculus
gttggaggaagtgtgtcactggaattggactctgaggtttcagaagcccgtgtcagtctctggctctctctcac

SEQ ID NO: 71141 - DNA, 86 bp, Mus musculus
ggggagaatcggttgccttggagtgatgttgagtgaacacacattttactagacacactctgtgacaggcattctgacaagcaccc

SEQ ID NO: 71142 - DNA, 83 bp, Mus musculus
ttgagacagatgaattggagcacatgcggtccaggtggggcactagtttgcctgatctttgcctgtgtctcactctgtgttgg

SEQ ID NO: 71143 - DNA, 96 bp, Mus musculus
gtcagtgggtatgggggtgtctttgagctgatacagtttgttcagattgaccacaaactgcatgtccttgtccaaggacttttgttcaaaccaggc

SEQ ID NO: 71144 - DNA, 116 bp, Mus musculus
gtcaaaggcaaacatgggtgtacattttcctaagcaaagagtcagtgtcttcgtttatttttttaaaaagctgctaattttttatttatatgtgtagtgtatgcttgtttgacttt

SEQ ID NO: 71145 - DNA, 68 bp, Mus musculus
atatactatatcatatacacattatatacatttatgatatgtatgtatttgtatatatatatgtatat

SEQ ID NO: 71146 - DNA, 70 bp, Mus musculus
acatgcacattcatatgtaaatttatttatatggctgtatatctatatatctatatgtctatgtgtatgt

SEQ ID NO: 71147 - DNA, 56 bp, Mus musculus
atgtgtgtgtgtatatgtatatatacatacatatacatatatatatacatacatat

SEQ ID NO: 71148 - DNA, 128 bp, Mus musculus
aatgttttttcttgcccagcttactgagtgttcagattgctatggcctctgccattctagagttctcattttgtaggtcagaagtgtggcaaagactacgaagcattctgagaaatagaagcttaaga

SEQ ID NO: 71149 - DNA, 70 bp, Mus musculus
agtgaccatagatgtgtggattcatctctgggtattcaatcctgttccattggtctacttatctgtcact

SEQ ID NO: 71150 - DNA, 99 bp, Mus musculus
tcaatagatagctaaatgaagactctgagatatcacactactcatttaagatcatgcagttggtaacaaggagtctacatccagacttttcatctttga

SEQ ID NO: 71151 - DNA, 102 bp, Mus musculus
tctatatctatctatacacacacacacatgtatatatatatatatatatatatatatatatatatacatatatatgtgtatgtatatataaagagagagaga

SEQ ID NO: 71152 - DNA, 102 bp, Mus musculus
tctctctctctttatatatacatacacatatatatgtatatatatatatatatatatatatatatatatatacatgtgtgtgtgtgtatagatagatataga

SEQ ID NO: 71153 - DNA, 68 bp, Mus musculus
ggtcctttcaccaagacatatgtatgtatgtatgtatgtatgtatgtatgtaggtgtgtgtatgttcc

SEQ ID NO: 71154 - DNA, 109 bp, Mus musculus
tgcaatggtatttgccttctaatgaactttatagtttgaaatgaagtatcttagaaagacactgtttttcaaagaaaataaaggagtaggaaaaggtgtggcttgtgca

SEQ ID NO: 71155 - DNA, 57 bp, Mus musculus
tacatgtgtatgtacatgcctctctctctccacggtatgcatgtatgtatgtatgta

SEQ ID NO: 71156 - DNA, 78 bp, Mus musculus
ctgtgttaaagattctgcaagtccaactgactgattagaacttcgtgattatggtgtgttggaatattgcagatgcag

SEQ ID NO: 71157 - DNA, 118 bp, Mus musculus
gggggacatgggagagggagaggccacagaataatcatggggtgactctagctgagagaactaacagtgggggatatggattctgacgtgactacttcctatagccaggccggactcc

SEQ ID NO: 71158 - DNA, 74 bp, Mus musculus
aagacagaaatatatatgtatatatgtatacgtatatatatatatatatacaggtatataaaatattttgtttt

SEQ ID NO: 71159 - DNA, 85 bp, Mus musculus; identical to SEQ ID NO: 57439

SEQ ID NO: 71160 - DNA, 76 bp, Mus musculus
aatacataaaaatgcctatgtatatatgtatgtatgtgcatacagatgtatgaatgcatgggtagatggatgtatt

SEQ ID NO: 71161 - DNA, 87 bp, Mus musculus
atcttcaaagaaagtcactgtctgtctgtaatactgaaggtaagacctcaacttttagagttagaagagtggttttactatcaagat

SEQ ID NO: 71162 - DNA, 76 bp, Mus musculus
gtcaagaccaatttactgtagagatttcatgttttagaaggaagtccttctcagagactctgtcattggttcacac

SEQ ID NO: 71163 - DNA, 96 bp, Mus musculus
gatcagccttaggccatgatggtctgataggatgcatgggacaatttcaatatttttgtatcagttgaggcctgttttatggccaattatatggtc

SEQ ID NO: 71164 - DNA, 85 bp, Mus musculus; identical to SEQ ID NO: 57470

SEQ ID NO: 71165 - DNA, 101 bp, Mus musculus
ccagtgtctaccattggggatggtggttgcggtgattagtggacattctgagcgtcacattcacacccactgtctgtaactgaaggtgttctagcagctgg

SEQ ID NO: 71166 - DNA, 93 bp, Mus musculus
tcttcgacaagggagctaaaaccatccagtgtgaagaaagacagcattttcaacaattggtgctggcacaactggttgttatcatgtagaaga

SEQ ID NO: 71167 - DNA, 107 bp, Mus musculus
tatacatgtatgtatgtgggtatatatatatatatatatatatacacatatatatgtgtgtttgtgcgtgtgtatgtgcgtgtgtgtgtatacatatatatatatat

SEQ ID NO: 71168 - DNA, 69 bp, Mus musculus
tcctcacacactcactgtgaagtacactcaccaggaaacgactgggttgtgctagtgattctctaagga

SEQ ID NO: 71169 - DNA, 111 bp, Mus musculus
gcttttggagggcattaggtcatggattgtgtatcttgagattctgggagcccagtctctcccagtctctctgctccagtttgagacgtaactgtctacttctacataagc

SEQ ID NO: 71170 - DNA, 85 bp, Mus musculus; identical to SEQ ID NO: 57470

SEQ ID NO: 71171 - DNA, 115 bp, Mus musculus
ccttaaattaaaaagattacctcctgggctggagagatggctcagcagttaagagcactgactgctcttccagacatcctgagttcaattgtggctcacaacaatctgtaatggg

SEQ ID NO: 71172 - DNA, 63 bp, Mus musculus
gtgtagcgtgaacttgtgcaggtcttgggcatgctgtcacaatctctgtgagttcatgtgcat

SEQ ID NO: 71173 - DNA, 76 bp, Mus musculus
gagcagaagtaggcacacagaagacagtcaagacataaagcagaacaccgtctgatgtcatcgtctggcctggctc

SEQ ID NO: 71174 - DNA, 70 bp, Mus musculus
gtgttttccatggtaactcacactctgtcatcctcatgcatgaactgagtcctgagacttggctaaacac

SEQ ID NO: 71175 - DNA, 124 bp, Mus musculus
acacgtctaaggcctggtacccagcactaaaaaggaacagtttctgtgagtgaggtgagagtgaccaggactgtctgtgtgctcttgatttctctgttatttataaaaagcagatctttactgt

SEQ ID NO: 71176 - DNA, 105 bp, Mus musculus
tggcagtttgaaggttgaggctggtactcatgtccatgcttattatatttatttgtgaactatgtagtgccgacctataaaaagcttcctgagaacatacagcca

SEQ ID NO: 71177 - DNA, 78 bp, Mus musculus
gtataagtgttgtgtttgcatgtatattacatatgtatgtatgtatgtatgtatgtgcaccaggtatgagcttagtac

SEQ ID NO: 71178 - DNA, 119 bp, Mus musculus
gccggactaagacctgaatgtcaaaagcaaagccatgtctctattgatgagtcattttgttcttcgcaggaggagctatatttatcagatatgtgaacattttctatctcaggcaaagt

SEQ ID NO: 71179 - DNA, 86 bp, Mus musculus
gctgtagggggtgggtcagaatagtgttattgtttttctaaactaaaaaaggttctaggagaggaggtgacgtccaatgtctaagc

SEQ ID NO: 71180 - DNA, 97 bp, Mus musculus
gtatcaaagctttccctgtgtgtgtgttcatacatgtttatattttttctgtaacactggctatgtgaagacttcacacagactcaggctctggccc

SEQ ID NO: 71181 - DNA, 76 bp, Mus musculus
tgagtcagaacgtgggggagtcctcacattgtgggtctttcactatcactcactgactttcacacgtttcctttca

SEQ ID NO: 71182 - DNA, 64 bp, Mus musculus
gctcagtcagccagtctgttggagatgccatagcacagtatcacacacactgggtgtcttaagc

SEQ ID NO: 71183 - DNA, 85 bp, Mus musculus
gtacatatgtatatatctgtgtacatgtatgtatgtctatatttatgcttacatgctgtatgtacatatctgtatatatgtgtat

SEQ ID NO: 71184 - DNA, 76 bp, Mus musculus
gttatcctgtgtgtgtgtctgtgtctgagcactcgtgttcgagtgatatgggacttgtacagaggtcagcgggcag

SEQ ID NO: 71185 - DNA, 116 bp, Mus musculus
tatgtgtctctgtgtgtatatatgtgtgtatatatgtgtgtatatatgtatgtatgtgtctctgtatgtgagtttatgcacatgtttgtatgtgtctgtgtgtgtatttgcattta

SEQ ID NO: 71186 - DNA, 71 bp, Mus musculus
gacagtgagtgtgcactgtgtgtgtctgtgtaaggctgggagctgtcactcacacagcacagcttgctctc

SEQ ID NO: 71187 - DNA, 81 bp, Mus musculus
gttgctattttgaattgagattctgttgttctggtcagctggggctggaaagacagccataattaacaagagacagacaac

SEQ ID NO: 71188 - DNA, 107 bp, Mus musculus
tgaggccccccagctatggtttttggtaaagataggctttgaggtcattttgtttttcaaatatccctcccaccatagtctctgtatccaccatcatgggatgctca

SEQ ID NO: 71189 - DNA, 95 bp, Mus musculus
gagagaaggtatagatacttattaaacacagaaagaaacagtttttttttaaagatttatttattttatgtatgtgagtacactgtcactctctt

SEQ ID NO: 71190 - DNA, 84 bp, Mus musculus
ctgttatatgcacatgcatacacagtcatgtatttatatgcatgcccatgtgcatgtctctctgtgtgtatgtacatttaatag

SEQ ID NO: 71191 - DNA, 80 bp, Mus musculus
gctttcaagtctcactgagaatataggtcttgtggagtagattataactttctctgtatctcagtgtcattcagatgagc

SEQ ID NO: 71192 - DNA, 85 bp, Mus musculus; identical to SEQ ID NO: 57439

SEQ ID NO: 71193 - DNA, 71 bp, Mus musculus
tgtggagattcagatagcaaggaacagagtgacagccagcattctgtcactgtgtctttctaatttgcaca

SEQ ID NO: 71194 - DNA, 83 bp, Mus musculus
gtagctagctgaaaccggaaaaggaggctcagctcatgggttacccgggctcaaggtctctctctgtgtttatgtctggctcc

SEQ ID NO: 71195 - DNA, 81 bp, Mus musculus
ggagagttactaggaagagcagagaagtgattttcttttagaccctaatttgttatcttctctggttctggttctctctct

SEQ ID NO: 71196 - DNA, 72 bp, Mus musculus
agcaggtacaacttctttagaacagttgactgcacagtgcacctcagtatgacatgaagaagaagtattgct

SEQ ID NO: 71197 - DNA, 66 bp, Mus musculus
cctccccaaacagtgccaccaagtggggactaattgtttatatttatgagcctgaggtaggggagg

SEQ ID NO: 71198 - DNA, 72 bp, Mus musculus
acagtgcctatgaagagtctgttaacaggacaagcttaatgaacattgtgagcagacaattggtgggcttgt

SEQ ID NO: 71199 - DNA, 83 bp, Mus musculus
aacatgatgcagggcttgtgaagttggatgagagtagacagtggggtaagagatctaattcacccagctctgagtcttctgtt

SEQ ID NO: 71200 - DNA, 81 bp, Mus musculus
ttacgggggatttttgccagagtaattatttttcaattcaacaataatgagaaattaccatggcaaccattcatcacgtgg

SEQ ID NO: 71201 - DNA, 60 bp, Mus musculus
gtgtgtgtgtgtgtgtgtgtgtgtaagagagagagacagagacatattgcacacacacac

SEQ ID NO: 71202 - DNA, 85 bp, Mus musculus; identical to SEQ ID NO: 57470

SEQ ID NO: 71203 - DNA, 78 bp, Mus musculus
tgactcctgtctctgtgtctgtgcccaacacaggagatcccctgtaaggctgtactgtgcttgtgagaatcagggtca

SEQ ID NO: 71204 - DNA, 69 bp, Mus musculus; identical to SEQ ID NO: 71168

SEQ ID NO: 71205 - DNA, 63 bp, Mus musculus
tgcttgctgataggagcctgatatagctgtcttctgagaggctctgtcagtgcctgacaagta

SEQ ID NO: 71206 - DNA, 81 bp, Mus musculus
catgggctgtagggtggataacttggatgctttctgtctctcttacactgaaacctaaggaattcccatcacagttgcatg

SEQ ID NO: 71207 - DNA, 118 bp, Mus musculus
ctggatggttttagctcccttgtcaaagatcaggtgaccataggtgtgtggattcatctctgggtcttcattctgttccattggtctacttgtctgtcactataccagtaccatgcag

SEQ ID NO: 71208 - DNA, 97 bp, Mus musculus
tgtagctttgtggcacaggatcagctctgggtgtagacagagaccagaagactcctgtctcaggcaaccccttggttcctgtgtcctcagggttcca

SEQ ID NO: 71209 - DNA, 81 bp, Mus musculus
gtataattgtgaatgtgcgtatgattgcatgcatatatgtatgaatgtatgtgtgtgattgtatacatgtacgtattgaac

SEQ ID NO: 71210 - DNA, 76 bp, Mus musculus
ttgccttcttagtttatatatgtctctttgtctagttttacattctgcagatgaagttgcagtggacttatggcag

SEQ ID NO: 71211 - DNA, 85 bp, Mus musculus; identical to SEQ ID NO: 69220

SEQ ID NO: 71212 - DNA, 112 bp, Mus musculus
gagcctttattcaccagggtttgctatattctacaaggttgaaaactaaggactagggactgtgctcagtgggtagcgtgtttgcctagcatgtagaaatcctggtttgctc

SEQ ID NO: 71213 - DNA, 101 bp, Mus musculus
tcactttagaacgtctgcaacagcatgaggtgaaaatgaaacacaagtaaaatgaaactatattttattcttcgtgaaacttgtacacatgttctaggtga

SEQ ID NO: 71214 - DNA, 90 bp, Mus musculus
tggtggtggttttttgggaaggacccccctgtggggcagtctcttccttctctgcttcacactttgtctctgtaactccatccatggcta

SEQ ID NO: 71215 - DNA, 92 bp, Mus musculus
cttgtgggtcatatttgcaaatactctcactcactgatattaatttgtaactcccaaatcaatgctagagtgattttgtagttatttacagg

SEQ ID NO: 71216 - DNA, 65 bp, Mus musculus
acatgacaagtatgcatgtgcatgtgcatgtgtgcgtgtgtacatgtttgtgtgtgtgtgtgtgt

SEQ ID NO: 71217 - DNA, 86 bp, Mus musculus
tgttttctcatctgctaaaaatgattatatatatgcatatatatgtacatataatatgtataaaatcttagagcagagggaacaca

SEQ ID NO: 71218 - DNA, 86 bp, Mus musculus
ctagagttattccatcagtctgtgtattagtgagtggaaaagttgattccatctatctatgcatggaaaagtagaatctagtttgg

SEQ ID NO: 71219 - DNA, 85 bp, Mus musculus
tggaattgcatcttatgtatcattatatttctatcagtgtgacaactcataaatgatagatttatttgcaataattggctctcca

SEQ ID NO: 71220 - DNA, 75 bp, Mus musculus
ctctttacagttcatatggatggccatgcacttgcatggcagaaagtgcctggatccctgaatcactgttgggag

SEQ ID NO: 71221 - DNA, 89 bp, Mus musculus
gaaagccatttactgtaaacatgcttgactctgtgggtgttgtaaaggctaaggggatgggaggcatgttttaaaggaagagagctatc

SEQ ID NO: 71222 - DNA, 121 bp, Mus musculus
cacagtatatatgtatatgtatttgatgtatatggtatgtgtgtgtatatatatgtatatacatatatatacatatatatacacacacatatacacacatagatatacatatatgtgtgtg

SEQ ID NO: 71223 - DNA, 85 bp, Mus musculus; identical to SEQ ID NO: 57439

SEQ ID NO: 71224 - DNA, 85 bp, Mus musculus; identical to SEQ ID NO: 57470

SEQ ID NO: 71225 - DNA, 76 bp, Mus musculus
gcagaaatgaccaggcagttgaatcaccaaatcctcccccaggataagtgacagctgacaaaagtcagaaagctgt

SEQ ID NO: 71226 - DNA, 122 bp, Mus musculus
tgttggcagttttatagaaggatatggcaggcattcttcaagtgagggctgtgttctctctgggtcttatgccaaggaagcttcaagctaggtaccttgatagatactctgtgcatatcttt

SEQ ID NO: 71227 - DNA, 90 bp, Mus musculus
atgtatatgtatgtatgtatatgtatatacatctatatatgatatatctgctatatataggcctaatatatgttatacatacatggatat

SEQ ID NO: 71228 - DNA, 108 bp, Mus musculus
tatatgagcatatatgtacatgtgaatatatgtatatacatatatgtatgtatataaacatgtatatatgtgtgtgtacatatacatatacatatacatatacatata

SEQ ID NO: 71229 - DNA, 91 bp, Mus musculus
gagaaatggcccctataggctgaggtatgtatgtatgtatgtatgtatgtatgtacgtatgtatgtattttcaccttgactactgttcttc

SEQ ID NO: 71230 - DNA, 107 bp, Mus musculus
taaaatagacttcccattgcaatgttataaatggtcctaactttaatcaaagattcattttatttatgtgtgggctatttgcaacagtcaatgtattatttatttta

SEQ ID NO: 71231 - DNA, 97 bp, Mus musculus
ctttttcgcccctccatgcttaaaagaatggctgtatgcagacagtgaggagtcagccagctgacagcaattcaaagagattggtttaaagagaaag

SEQ ID NO: 71232 - DNA, 117 bp, Mus musculus
tacagtagtaagatagctctacctaatgaaacccttgactgtgagaataaactctttttttttttttcaagacagggtttctctgtgtagcctggctgtcctggacctcactctgta

SEQ ID NO: 71233 - DNA, 110 bp, Mus musculus
tgtatgcatgcaagtatgtatgtatgtatgtatgtatgcatgtgaatgcacacacacccgcacaatcacacacacacacacacacacacacacacacacacacacacaca

SEQ ID NO: 71234 - DNA, 123 bp, Mus musculus
tgtatgtttgtatgtatgtatgtatgtatgtatgtatgtatatgtatatacatgtatgtgtatatatatgtgtgtgtgcgtatacatatatatgtatatatacatacatatgtgtatgtatcc

SEQ ID NO: 71235 - DNA, 86 bp, Mus musculus
gggtcatgaagaacagttgagactcagcactgtgagaggccatggaaggccattgttgaaggtgcggtctcagatggcctaggact

SEQ ID NO: 71236 - DNA, 85 bp, Mus musculus; identical to SEQ ID NO: 57470

SEQ ID NO: 71237 - DNA, 92 bp, Mus musculus
tgtatgcatatatacgcatattttatatctgaaatatatattatataataatatatattatatgttatatgtgaaaggtaggggcagataca

SEQ ID NO: 71238 - DNA, 94 bp, Mus musculus
cagcatgctttttgttctgccttcgatgttaagcaatgcatagaattttgacatacccttcacgtggaaggaatccaacttctgagaattgttg

SEQ ID NO: 71239 - DNA, 101 bp, Mus musculus
tatgtatatatatgtgtgtgtatgaatatacatgtacatacgtatatacgtatatatgtgtgtatatatatatatatatatatatatatatatatatatgc

SEQ ID NO: 71240 - DNA, 69 bp, Mus musculus
gggatgatttattgcttcactctcactcttactatgtggggggttgatgtgaatttatgtctttgtccc

SEQ ID NO: 71241 - DNA, 116 bp, Mus musculus
ggacttcagatccagtggagggtcctgttggtgacctgtgggtgtctgaagactctgagcccaaactacccaggtgctggcagggaccagaagggacttgtacccctgatcaggcc

SEQ ID NO: 71242 - DNA, 116 bp, Mus musculus
aagaacattatttgaccacacaatgtgattaagatatatatatatatatatatatatatatatatatatatatatatatatatatatatatatgttgtgatggtttgtatatgctt

SEQ ID NO: 71243 - DNA, 71 bp, Mus musculus
tggattggaattgcatttggcatttttctactgtgtctcagtggaaatctatgtctcagtctctcaattta

SEQ ID NO: 71244 - DNA, 85 bp, Mus musculus; identical to SEQ ID NO: 57439

SEQ ID NO: 71245 - DNA, 101 bp, Mus musculus
agcatgtctgaggaaatggtttgacaactctttacaaatatctggtcagtattaagctatctgagtgtatctgtctgtgagatttttttctgacttatgtt

SEQ ID NO: 71246 - DNA, 71 bp, Mus musculus
gcactgagtagagagatttgacagaaatagttcttttaggactgggtgtgtcaatgtctctcatactctgc

SEQ ID NO: 71247 - DNA, 67 bp, Mus musculus
tgaagctttggtaatgcctctgtcagtattctgcacagtgctgacttctgagtgactcagagctcca

SEQ ID NO: 71248 - DNA, 98 bp, Mus musculus
tatatacatgcatatgtatatatatatgtatgatacacacatgtatatatgcatatgtacatgtatatatgtatgtatgtatgtatgtgtgtgtgtat

SEQ ID NO: 71249 - DNA, 82 bp, Mus musculus
gccagaaagtcctgcttgattaatagatttttatcaatataaacacttcccagatagaaatttgacagaggcaggaatcagc

SEQ ID NO: 71250 - DNA, 75 bp, Mus musculus
gcatcacagcatgtatgtatgtatgtatgtatgtatgtatgcatgcatgtatgtatagtgagtgtgtgtgtgtgc

SEQ ID NO: 71251 - DNA, 65 bp, Mus musculus
aatttggggctggagagatgcctcatgtttaagagaactgactgctcttccagaggtcctgagtt

SEQ ID NO: 71252 - DNA, 98 bp, Mus musculus
gcatatgtgtgtatatatgtatgtatgcatgtgtgtatatacagtatttgaactaacatatatgtaagtatatatacatgtatatatattatataaac

SEQ ID NO: 71253 - DNA, 88 bp, Mus musculus
gcgagattttctgttgtgcttgatctaaccatgtgcttgcgaggtatgagaaaaacatggttccgtcaagcaccatggaacgtcacgc

SEQ ID NO: 71254 - DNA, 96 bp, Mus musculus
gttgtgtgtatgtctatatgtgtgtgcatgcattatgtctatataatttagaaataatgaatatatgaatattttatatacttgtatatatacaac

SEQ ID NO: 71255 - DNA, 91 bp, Mus musculus
gcagtgtttcgagtacatgcagctgctaccgtgggacactgtgactgcctgtctcaatgctgtccaatgaggggctatgatttggatctgc

SEQ ID NO: 71256 - DNA, 64 bp, Mus musculus
tgggaatatatatgtgtgtatatatatatatacatatatacatacacacacatatatgtattca

SEQ ID NO: 71257 - DNA, 66 bp, Mus musculus
atatgtgtatctgcatgtatatgtatatatgtatgtatgtgtatgtatatatgtatctgtgtgtat

SEQ ID NO: 71258 - DNA, 69 bp, Mus musculus
aacttgggctggagagatggctcagcagttaagagcactgactgactgctcttccagaggtcctgagtt

SEQ ID NO: 71259 - DNA, 89 bp, Mus musculus
ggaaatatttactgttgtgtactaattttcatgttcagttggtcccaaagtattaatgagagtttcctgcatttcacagttataactcc

SEQ ID NO: 71260 - DNA, 90 bp, Mus musculus
ggcttagcttttcagtagacactgagctttgaagatggcaaaataagcagtgctttgaacaactatgctcagtatcttaatgcatgagcc

SEQ ID NO: 71261 - DNA, 69 bp, Mus musculus
ttgagtgtcactaaatttcttaaattttgtataaacagtatgttgtttgtgagaaaacagtgacctcaa

SEQ ID NO: 71262 - DNA, 114 bp, Mus musculus
actgtagactgcacccttagactgtaatttgacataatcccttccattctgaacatgcttcagtcaggcattgggtagccagcatacaggtcttgtttgcttagcactacatgt

SEQ ID NO: 71263 - DNA, 71 bp, Mus musculus
gtgtgtctctgtcactgtgcttgttcctcgaggcaaggcagcctgttgaaacctaggcatagtgtgactgc

SEQ ID NO: 71264 - DNA, 79 bp, Mus musculus
tatatcaaatatgtgatatacatacacataccacatatatatgtgtatatgtatatgtatgtatatatatgaaatgatg

SEQ ID NO: 71265 - DNA, 100 bp, Mus musculus
tttaaaggtagataatccactaacatggaagtttattatatttatatgcataccacagtatatgtatgattcatgttaggagttctcactagtgtttaaa

SEQ ID NO: 71266 - DNA, 73 bp, Mus musculus
ctgattctctcttaccctcacacttagtctatatttttgcttcaggtagtggtggttaggactgaggatccag

SEQ ID NO: 71267 - DNA, 75 bp, Mus musculus
cctcagtgaaccagggaccaggaagtgagcaagagatcctaattgtctcttcactgattcactggctcactcagg

SEQ ID NO: 71268 - DNA, 103 bp, Mus musculus
aagagcaagcaagtagtcaaataggcctgtatgcaaacagttctctgcactttactttttgtttatatggttcactgtttgagttcctgccttgacttctttt

SEQ ID NO: 71269 - DNA, 118 bp, Mus musculus
gatcagatgcacagagagaggagctggagagggctgtgagacagaactgtttttcttgttaaagagaataagagatagtttattctggagccattaactacagcctgtgtagccgggc

SEQ ID NO: 71270 - DNA, 66 bp, Mus musculus
gcgatattcacagatgagtgtctgctatggacgcatacatagagcactgattacagtggctgtcac

SEQ ID NO: 71271 - DNA, 114 bp, Mus musculus
ctaactgtggcaataagagggtgggctgggtggttttcctgtgttaccagtcagagagcagacatggatgaaagaaaccaggctgaccataatcctataaacctgtccagtaag

SEQ ID NO: 71272 - DNA, 72 bp, Mus musculus
tatatatcatatatatgaacatatatatcatatgtgtatatgtgtgtgtgtatgtatgtatgtatgtatatg

SEQ ID NO: 71273 - DNA, 96 bp, Mus musculus
gatcatccttagtccatggtgatcagataggatgcataggataatttcaatatttttgtatctgtggaggcctattttgtgaccaattatatggtc

SEQ ID NO: 71274 - DNA, 99 bp, Mus musculus
cattgactataagatgctccactttgactctatacatttttatcatgaaatcaatttttgaatattaatgtagtcattctggttgtcctatggttaatg

SEQ ID NO: 71275 - DNA, 113 bp, Mus musculus
tcgtgggaatgtggtgttcatatcttcgtaggcatgtgtgttcatgtgtgtgactctctgagtttaactagaggtgattgtgtgactatgggtatgtgcttatctagtgacga

SEQ ID NO: 71276 - DNA, 114 bp, Mus musculus
atacaatataaatatcagtttgaaatcccgattcctgtagtcagtgtgtctgtctcagtttctgacctgcaaattgaagtgataattgaattgttgggtgatatgattgtatat

SEQ ID NO: 71277 - DNA, 85 bp, Mus musculus; identical to SEQ ID NO: 57439

SEQ ID NO: 71278 - DNA, 78 bp, Mus musculus
cagttcagtgtctctgagcctctgtgagcccaggttagttgattctgtgggttttcttgtggttgagacaaacatttg

SEQ ID NO: 71279 - DNA, 102 bp, Mus musculus
ggagaactgaaacctttggtgaatgggtacatttaacattggtctggatctgttctcagaaccaatgtattgatgtgtgtagaaattctagaattaatcttt

SEQ ID NO: 71280 - DNA, 115 bp, Mus musculus
ggtctgttcagtgcactggctcagaccagcaggaactcatgccaggcagaagtgcctgaggtctgttcagtgcactggctcagaccagcaggaactcatgccaggcagagttcct

SEQ ID NO: 71281 - DNA, 101 bp, Mus musculus
taagcttatcatttctcttcatgctagaagaccaaagtgtaaagaaatctctaaaacatttcagagtgattttctttgtttgatatggggaattgagttta

SEQ ID NO: 71282 - DNA, 72 bp, Mus musculus
gcgcagctgccgactgcagaggagagatagcaaaaaatgaatccattttctttctgtgtctggtaagctagc

SEQ ID NO: 71283 - DNA, 82 bp, Mus musculus
ggtattacatgtagactagcctctgactaaagcctgtttaagtctaggcccgatgtcagtctcttagtctctgtcagctgcc

SEQ ID NO: 71284 - DNA, 77 bp, Mus musculus
gtgctatcacttgagtttttgattttaagcattctgaatagagtaaggtggaatctcagagtcattttgatatgcat

SEQ ID NO: 71285 - DNA, 58 bp, Mus musculus
aaacagaaggctgtgtgcacacatgtttgtgcatgtgtgtgtgtatgtgtgtgtgttt

SEQ ID NO: 71286 - DNA, 75 bp, Mus musculus
gtgtgtgtgtgtgtgtgtgtgtgcatgtgtattgttaactctatttgtcatgcacctgtgtatacatgtgcacac

SEQ ID NO: 71287 - DNA, 85 bp, Mus musculus; identical to SEQ ID NO: 57439

SEQ ID NO: 71288 - DNA, 69 bp, Mus musculus
gtatatataatgcatatatttatgtatatagtgtgtatgcataaatatataaatatatagtatatatac

SEQ ID NO: 71289 - DNA, 89 bp, Mus musculus
ctcagaaagcactagaaccaaagctccaggctctcacaggacactgagcacactggagctgaagcctgggtcctgaactgacttctgag

SEQ ID NO: 71290 - DNA, 85 bp, Mus musculus; identical to SEQ ID NO: 57470

SEQ ID NO: 71291 - DNA, 73 bp, Mus musculus
catgtaaacaatatacataagcacatgtaattataacatatataatgtttatgtatgtatgtatgtatgcatg

SEQ ID NO: 71292 - DNA, 107 bp, Mus musculus
tattttgtcctttaatgttgtttctttgtattcatgtccatgcacatgtattatatctctgtgtgtgcatgtccatgtgtgtgcaggggcctgtggagggtagagtg

SEQ ID NO: 71293 - DNA, 126 bp, Mus musculus
acatatatgtatatgtgtatatgtatgtgtatatatgtatgtgtgtatatacatatatatatacatatatatatatatgtatgtgtatatatatatatatatatatatatatatttacttacttac

SEQ ID NO: 71294 - DNA, 143 bp, Mus musculus
gacagaaaagaaaacagctgcccaaggtgttaagagtctggtccaaggttgcacaggaatagactgagaatagagagagagcagctgttgactctgtctcactgttagctcttccccacttggtgaggacctggagccagact

SEQ ID NO: 71295 - DNA, 84 bp, Mus musculus
gggtctgaaactctctctctctctttgttgagtcttactgttgttcagctattggaatagtttgaggagttttggtattagctc

SEQ ID NO: 71296 - DNA, 90 bp, Mus musculus
atttacagttgatttctatacttttaaaagaactatgttgttaggaaatgcactagctagagacttgggacaggggaggctactgtgagt

SEQ ID NO: 71297 - DNA, 72 bp, Mus musculus
aagctctctcactctgtgcatgtctggcaatgggtctctgtacttgtttcggtctgccataggaggaagctt

SEQ ID NO: 71298 - DNA, 69 bp, Mus musculus
gtatatatatatatgtgtgtgtgtgtacatgtatatttatgtacatatatgtatatatataacaagtac

SEQ ID NO: 71299 - DNA, 75 bp, Mus musculus
gtgggtgaggatgggttcatgtatgtatgtgtatttatatcatatagtgcatgtgtaatagactaactcatctat

SEQ ID NO: 71300 - DNA, 63 bp, Mus musculus
ccacaagggccttgtatgtatatatatatgtatgtatgtatgtgtgcatgtgtgtgtcagtgg

SEQ ID NO: 71301 - DNA, 99 bp, Mus musculus
agacaaggtcagagatcttgctatttgaaagtagaccattgtgcatctctgatttgtttctatgtttatttcatttggctctagatctaatctgtgttt

SEQ ID NO: 71302 - DNA, 145 bp, Mus musculus
aggttgttctcgagaaactgagagcaaggaacattgatgaagacaacacccacacctcactgaactcagagaagtcacactggtgattcttgcgctttctcttgggactctttcttctgacggtttgtcttgtctaactttgatg

SEQ ID NO: 71303 - DNA, 118 bp, Mus musculus
gagacggaacttataaggctctgagtctccatttctattgtagcttttcactttctgtcagtggctgtgctgtgaggagatggggaaacctgggcacacactcttaacaatccttctc

SEQ ID NO: 71304 - DNA, 60 bp, Mus musculus
tgtgtgtggatatgtatatgtgtatgtatatgtacacacacacacacacacacacacaca

SEQ ID NO: 71305 - DNA, 117 bp, Mus musculus
agtcacctgggaaaggagtctcaatggagggactgcccagatcagactggcttgtgtctgtctgtgtctgtggggagttgttttgatatatgggaaggctctgatccctgggcggct

SEQ ID NO: 71306 - DNA, 78 bp, Mus musculus
ggaaagcaaaggggctggagagatggctcagtggttaagagcgctgactgctcttccagaggtcccgagttcaattcc

SEQ ID NO: 71307 - DNA, 82 bp, Mus musculus
aagatatgaacgacatagggttaacagtgtctctgcctctctggggtaagatttgggttgatgcagtagtgatttatgcctt

SEQ ID NO: 71308 - DNA, 68 bp, Mus musculus
gtgacctcactcacactcagcattcagaggctctggcatccatcctctgtggagtgagtgcagggtac

SEQ ID NO: 71309 - DNA, 111 bp, Mus musculus
gggctgtgaggcaagggaggggatacctttcaagaccaggcatgaatcttggagtaaacaagcttcactctgccctggtgtgtgggttttaactcttcctcatgctcagag

SEQ ID NO: 71310 - DNA, 77 bp, Mus musculus
gactctacagtgttctagtcctgtgattcccccatcatgtcagttacatgagtgtgatgacagtgacctctgaggtc

SEQ ID NO: 71311 - DNA, 71 bp, Mus musculus
ctgtgcctcatgtttccaccagccatggcctcctccctctctggctgtctgtggtttctgcatcagcacag

SEQ ID NO: 71312 - DNA, 95 bp, Mus musculus
gcatcagctgagatgaaatgtctaaggaagtctttaatctgggccttgaataggatgacaggagtgactgtggacagttctataactcactgtgc

SEQ ID NO: 71313 - DNA, 97 bp, Mus musculus
tctgtgtgtctgtgtgtgtgcctatgtgtgtctctgtgtgtatatgtgagagagagagacagagaaagacaaagagacagaaagtcagagagacaga

SEQ ID NO: 71314 - DNA, 71 bp, Mus musculus
ggaagcagtgaacttggctagctcttggcttctcattcagtcaagactcacagctgatggatgctgctccc

SEQ ID NO: 71315 - DNA, 85 bp, Mus musculus
gggctatattagaaagtgagcagagagtgagctagcaaccaccattcctctgtggtttctgcttgaattcctgccccttctgtcc

SEQ ID NO: 71316 - DNA, 103 bp, Mus musculus
gtgtctttgtcatgtatgtggtgtacgtgtatgtatgtatgtatgtatgctaccaatgcctgtgagagagctgcaagcaggggaggtggtatttgcaattaca

SEQ ID NO: 71317 - DNA, 106 bp, Mus musculus
cccctgacctatgtgtgtgcccttgtgaatccctgagaccctgagtggcttgaggattcagaggatggaatgtagagagcatataaattagaaataagaactgggg

SEQ ID NO: 71318 - DNA, 113 bp, Mus musculus
tctaatcttaaagttagcctctccagtcttggcagcatgttacacattttgtacttgttaaatcatgagtggaaggttttccatgtaatataagcattaagttggaacaggct

SEQ ID NO: 71319 - DNA, 85 bp, Mus musculus
agatatatatgtatatatgcatatatgtatatacatatgtgtgtatatgtatgcatatatatattatgtgtgtgtgtgtgtatgt

SEQ ID NO: 71320 - DNA, 81 bp, Mus musculus
gttagaatgaggatgaagatggagagaccagaaaataaagtttttcattaaatgatctctgtgctactgacttattctgat

SEQ ID NO: 71321 - DNA, 123 bp, Mus musculus
acccttttctcatctctttgggctcacatactcagacacagacaccatttttaaagatgtatcttgttagaacatggagtttgatgggagttatttacaggagcatgggtctgggatgggggg

SEQ ID NO: 71322 - DNA, 78 bp, Mus musculus
agcattcagttttcattgtcctctcttgtctgggatattgatctgtttgcagtgtctctacacagtgagctgtctgtt

SEQ ID NO: 71323 - DNA, 58 bp, Mus musculus
gtgagggagctcttgtgtgtgcaggcaccaggcttctgtgtgtacagggtgccttcat

SEQ ID NO: 71324 - DNA, 62 bp, Mus musculus
ctgtggtgtgtgagcagacctgcacaggagcactgtggtgtgtgtgcctcagacacacacag

SEQ ID NO: 71325 - DNA, 134 bp, Mus musculus
gctaggagacagtgtttgtctctggtttctgcttcaagctccagagagagaaatagtttactctgaggctctgtgactgtctggagagctttgcttagtggtggaagacatctcacagtctggtatgcagcctc

SEQ ID NO: 71326 - DNA, 117 bp, Mus musculus
actgatgagaatgggaggaaaggtggggggggggcgtgctgaagagctggcttagcggttaagagcacagactgctcttccagaggtcctgagtttaattcccagcaatcatatggt

SEQ ID NO: 71327 - DNA, 84 bp, Mus musculus
gtggttgttgggacttaattttgaggagctctggtcaacctgctcactctggtcggccccactcactcagtccctgcttgctcc

SEQ ID NO: 71328 - DNA, 89 bp, Mus musculus
aatagattggagatatttcaagtctgtgtgtctctgtgtgtcagtaaggagtatacaagtcagcatatcctcggtatcttttacctgtt

SEQ ID NO: 71329 - DNA, 62 bp, Mus musculus
ttctgggctaggtgactgacttgagtgtggtcacatgttccaggctaggaatttagtaggaa

SEQ ID NO: 71330 - DNA, 110 bp, Mus musculus
ccaacttctcgcttcatcagccatcgatcacctccattgattgtggtgagagctgtgtccctgtcactcatacatgctggggagggggttgaatctgtgaggcaggttgg

SEQ ID NO: 71331 - DNA, 90 bp, Mus musculus
tgagagcctgaaaagacccaaaggcagaggaaggagggactcatcccttttggcttcctgcctgcctgcctgcctgtgctgggactctca

SEQ ID NO: 71332 - DNA, 85 bp, Mus musculus; identical to SEQ ID NO: 57470

SEQ ID NO: 71333 - DNA, 79 bp, Mus musculus
gatgtgggccactgctgtctcactgtctgtcacctaacacccaaacaggtgcagggactcagacaggtggcacttgatc

SEQ ID NO: 71334 - DNA, 83 bp, Mus musculus
gagaatagggttgggaaagatggctcagtggttaggagcactgactgctcttccagaggtcctgagttcaattcccagcaacc

SEQ ID NO: 71335 - DNA, 106 bp, Mus musculus
ctgtggaagatataaatatctatctatctatctatctatctatctatctatctaggtagagagagagagagagagagagagagagagagatatgtttctgacatag

SEQ ID NO: 71336 - DNA, 70 bp, Mus musculus
tatatacatacacatatgtatgtgtgtatatatacatatatatctgtatgtgtatatatatatgtatata

SEQ ID NO: 71337 - DNA, 56 bp, Mus musculus
cacacacacacacacatacatacatatatatgtatatatgtgtgaatgtgtgtgtg

SEQ ID NO: 71338 - DNA, 80 bp, Mus musculus
gtaagtaaagaccttgtcacatgagtgtgaggaccaggattaggatcccacattaaatctaggtggtcatggtggcctac

SEQ ID NO: 71339 - DNA, 96 bp, Mus musculus
ctatgcacagtggcatagagctgtgacgtgaagaagcaaggtgacatttatcaagtcactgaatctctgtgtggctcagtttgcgctgtacgatag

SEQ ID NO: 71340 - DNA, 72 bp, Mus musculus
cctggggtgttgccatggtcaccaaggataagtacctctactgctcttgaccctgtgtctctgcctctctgg

SEQ ID NO: 71341 - DNA, 103 bp, Mus musculus
aggaccacagtgaggggaacacagaagtcctgtagatattgtttgtttgtttatttgttttttttccatacagggtttctttgtgtatccctgactatcctgg

SEQ ID NO: 71342 - DNA, 57 bp, Mus musculus
tcatatgagtgtgtgtgtgcacgtgcatgtggtgtatgtgtgcatgctcatgtatga

SEQ ID NO: 71343 - DNA, 74 bp, Mus musculus
agatcctaggagtttgttagtcaggctactgagacagacagacagacggacagacagactcactaggttgatct

SEQ ID NO: 71344 - DNA, 118 bp, Mus musculus
gagatctttgttaattatctccacagctgttatctatagatattcgaggacgtgttgttagtagggagtgttgtatggtgaaagcatgtggatttggggtttggaagcgtttgatttc

SEQ ID NO: 71345 - DNA, 96 bp, Mus musculus
gatagcaagcctcggggacagggtcctctgtgtgtcactgtatcccacgtgaatgggattttgattccactcaggaccctatcaagaaggaatatc

SEQ ID NO: 71346 - DNA, 112 bp, Mus musculus
ggttttagaataagattatacatggcttttagagagttactgtctctctgtctctatcctggtaaggagtggcggtttgggatgctaagcttagaaaatctgttcccagatc

SEQ ID NO: 71347 - DNA, 85 bp, Mus musculus; identical to SEQ ID NO: 57470

SEQ ID NO: 71348 - DNA, 82 bp, Mus musculus
tatataaataattatatataatataaagaaatatatatggaatatacatatgtatgtatgtatgtatgtgagtatatatata

SEQ ID NO: 71349 - DNA, 117 bp, Mus musculus
gggcattctcttccctgttatttggtgactacagttcatctatgtatatattttagaaagtgtctacactgtaggtgttcctgtggtttttcaaatggcccttagtgttagttgccc

SEQ ID NO: 71350 - DNA, 77 bp, Mus musculus
gggagaaagggcggagagaacgtgttgggcactgagccagtgtggagaaaagtgtcctcagtctctgtttctttccc

SEQ ID NO: 71351 - DNA, 92 bp, Mus musculus
gcctctttcatcccaggtctcttttctttgtgactgtgtctgtactgtgtctcatatggtcttctagaagacctgatttgattccacatggc

SEQ ID NO: 71352 - DNA, 69 bp, Mus musculus
cttgtgtgtgtgtatgtatatgtgtatatatatgtatgtatgtatgtatgtatgtatgtatgtttcagg

SEQ ID NO: 71353 - DNA, 111 bp, Mus musculus
gctcataattatcacctccccgtccacttgttgaagtttacaccagtgtctttgactgactgagtgtaacctggaacctagaaataattgtggggtgtaccagttgccagt

SEQ ID NO: 71354 - DNA, 120 bp, Mus musculus
gacgctttctttccaatctggctttccctaggtgagatccataggccagtcctggtgtgggtgtcttcacatcttcatatctgtgcagtgccatcgttacttgatataagtcggagcagg

SEQ ID NO: 71355 - DNA, 111 bp, Mus musculus
gtatatatacgaatcttattttcagtggtaacgctttttgtatttaattttttatctccaataaagaattaaattgtttagcgacctgaaaattgaaaattttctctgtac

SEQ ID NO: 71356 - DNA, 69 bp, Mus musculus
agtgttgaaggtcttgctgggtgaggtagcagggaacactgtcagtcactgagtaagaagtttcagcct

SEQ ID NO: 71357 - DNA, 85 bp, Mus musculus; identical to SEQ ID NO: 57470

SEQ ID NO: 71358 - DNA, 99 bp, Mus musculus
agacgaggcagaaagtagtagcaaaagataatagcaaatagagtagtgagtgacttcacttcaagaaaaggctttcttggtacataccctggcttttct

SEQ ID NO: 71359 - DNA, 83 bp, Mus musculus
agtagagatttgtagattatgggttgtatgtgtttgttcccatatagacagacagacacacatatacacacactctctctatt

SEQ ID NO: 71360 - DNA, 85 bp, Mus musculus; identical to SEQ ID NO: 57470

SEQ ID NO: 71361 - DNA, 87 bp, Mus musculus
tttaggaaacctacgttctggagatacatggttcaatagttacaagcaatgtctgatcttttagaggatgtgggttttattcttagg

SEQ ID NO: 71362 - DNA, 100 bp, Mus musculus
gcttaggtcttctactgccttgaatccacattaacagatcatagctaggatttctcagtctctgtatgttttatgttattcagcagttcagagaaaaggc

SEQ ID NO: 71363 - DNA, 112 bp, Mus musculus
cacgttatttcctgacttgaatttggaatgatggtgcctataaaaactgtcacgggcagttctgtgaacagtgactgtagacatggactaaggaggccaggactgagcagtg

SEQ ID NO: 71364 - DNA, 115 bp, Mus musculus
ctggatcttggtcccaagtgtgacctttctacctcttggaacactgccagctaaataatagagtactgaaattcatgtggttaatgaagtcaaacacttgactctataagtccag

SEQ ID NO: 71365 - DNA, 87 bp, Mus musculus
gtgcatatgtgtttggtactgctctctgtcgggctgtctttctctctcacattgcatgccttttagaatgcatatgtgcatgtgtac

SEQ ID NO: 71366 - DNA, 81 bp, Mus musculus
agatatgcagcttggtcttcatgtgtgtcccccagcaattggagtgggggctgcctctgactcagactctgttccttgtct

SEQ ID NO: 71367 - DNA, 119 bp, Mus musculus
gtagtaaatgctgtatgtggtcaaaatatttggagtagacctgactgctgtctggactctcagtctctcatggtacagtacatttggacacttcaatgtccccacatcacgttgattat

SEQ ID NO: 71368 - DNA, 94 bp, Mus musculus
attatacacacatgaacatatctatatttatctatctagttagagatagatagatagatagatagatagatagatagatagatagatagatgat

SEQ ID NO: 71369 - DNA, 95 bp, Mus musculus
gagatactagtattgatagtgataaagggtggggagatatctatctatctatctatctatctatctatctatctatccatctatctatctatctc

SEQ ID NO: 71370 - DNA, 102 bp, Mus musculus
caggatattgggccacaagactctgttatttttacataaattaaggaaacaaatctgattttcttttagtctaatagagctgatggagtctctaaaacactg

SEQ ID NO: 71371 - DNA, 91 bp, Mus musculus
aaatatgtctacagtcttctcactcactgtgtgttctgaaaacttacctctaaattcaaagcatactgtgctgctactggaggctatattt

SEQ ID NO: 71372 - DNA, 90 bp, Mus musculus
tccagatgagtttagagatcaatgactgctcagatattgtgctgtaaagtgtatcacatatatctgtagtctccatttcctttatttgga

SEQ ID NO: 71373 - DNA, 79 bp, Mus musculus
gggagttggagctggagagatggcttagtggttaagagcactgactgctcttccagaggttctgagttcaattcccagc

SEQ ID NO: 71374 - DNA, 116 bp, Mus musculus
gcaagaactttcaagaagagtttcaagtatgtgcatttgatggtcaatcaatgtctagtgattttgaagaaatagggggtacaaatgttagaagctttaatgcaattttgaattgc

SEQ ID NO: 71375 - DNA, 79 bp, Mus musculus
acagtggaactcttagcttattgtttgtatggtttggctcttctcccatgaagaacctgcagaaagctgccttccttgt

SEQ ID NO: 71376 - DNA, 100 bp, Mus musculus
ggaatgaggacacctaatgcattgatggaagaaaattatatgtttgtaccacatgtgtgtctgtttgtctatgtcctttatgtgtgagtgtgtatattct

SEQ ID NO: 71377 - DNA, 72 bp, Mus musculus
gtgtgtgtgtgtgtgtgtgtgtgtgtgtgttaatgacctaaatgtacatgcatggatgtatgtatgtatgca

SEQ ID NO: 71378 - DNA, 102 bp, Mus musculus
tgcagtgctgggcgaaagggtcatgggtgtcagttgagtgagtgcagtgcagtgggtttgatttcatcaagtgttcatacggctcagtgtaggacagcagca

SEQ ID NO: 71379 - DNA, 90 bp, Mus musculus
agcaagcagacacaagggcactgcattgggtttctaatctaaagtgacagaacacagtgaaggaagaagccctgccgacctggcttagtt

SEQ ID NO: 71380 - DNA, 81 bp, Mus musculus
ggcagtggagaggagaggctttgaagctgagatatgctcttctccagttatgctcatctatctcctctctcactgtctctc

SEQ ID NO: 71381 - DNA, 71 bp, Mus musculus
gcccttgggccactgtgcctctgtgccactgagccactgagccacagagccacagagctaggcctagtggc

SEQ ID NO: 71382 - DNA, 66 bp, Mus musculus
atgtatatgtatatgcatatgtatatgtatatgcatatgcatatgtatatgtatatgtatatgcat

SEQ ID NO: 71383 - DNA, 106 bp, Mus musculus
ggattgaaatggtcttctgtctctggagtgtgtgaagttactctgcagactactaaaagagaaatatagataacaacacagccacagaaactttgacctacaatct

SEQ ID NO: 71384 - DNA, 127 bp, Mus musculus
gaggcaggaactgaagcagaagtcgtggaggaggaaggcttactgtcttgctccgcctacttttctcagcctgctttgtagtcgaacccagaaccacatagggtttgcccccacacaatgggctggg

SEQ ID NO: 71385 - DNA, 170 bp, Mus musculus
gcaaatccagtctgttagcttatgtctttttataggtgagttgagtccattaatattgagagacattaaagagagatgacagttggttcctgttttttttattttttttttaaagatggcttttgtgctgtggctctctgcttttgagtttgtagtgagatgcttaatat

SEQ ID NO: 71386 - DNA, 209 bp, Mus musculus
gactatgtatatatgtatatatgcatatatatgcatatatgcatatatatgtatatatgtatatgtatatatgtgtatatatgtatatgtgtgtgtgtatacctgttagagcatgtttacaaatttttaaaaatatttaatacatatttaatatgtgtaatattaaatatacatatatttaaaaatatgtaatatgtacatatatacat

SEQ ID NO: 71387 - DNA, 85 bp, Mus musculus; identical to SEQ ID NO: 57439

SEQ ID NO: 71388 - DNA, 128 bp, Mus musculus
atgtaaatacatacatacacatatatgtatacatgtgtatgtaaatgtgtatatgtatatatgtatataggtatactcatatatacctatatgcatatattaaataatatatatgatgcatacatatg

SEQ ID NO: 71389 - DNA, 121 bp, Mus musculus
gggctcactatttgacattggataatctatcaaggttgtcctgtagagaactagttcacttcactttctctcagcagccattgattaatcataactatttatttaagggtggagctttgtg

SEQ ID NO: 71390 - DNA, 75 bp, Mus musculus
gtgccatctgtacaaggcagtgtgacctttcacccacagtctctcacactgctctagaatttctgcagttggcac

SEQ ID NO: 71391 - DNA, 87 bp, Mus musculus
agatggcctaaaactcagagttgtgtctgcctcagtctcaaagaactggggaaaaaagtcaccacaagatgagtttttaattactct

SEQ ID NO: 71392 - DNA, 118 bp, Mus musculus
ggaggaggacgaggagagatgacgatgaggacttgtatttaaattctgtgtgtgtctgtgaatgggaatttgcatgtgtaaatacagtgctcatgagttcaaaggaggccgccaatcc

SEQ ID NO: 71393 - DNA, 60 bp, Mus musculus
cagcagttgaatagccttccagactgcacaatggcagtgtggtttgctgtttgatgagtg

SEQ ID NO: 71394 - DNA, 122 bp, Mus musculus
gaacatatactttggcagtaggcatatatttaccattagcatgtacacacatactctatatatttatgtgtcagtgtatggttggagaaataacaatgtgtgtttctatagtgaaattatat

SEQ ID NO: 71395 - DNA, 117 bp, Mus musculus
gtctgaaaaaaataggaaggatggttgtgtttacatgtatgtttatatgtgtgttcatatgttgtgtatgtttgcatttatacttatatgtaaatgtgcttatggtcttcttaaggc

SEQ ID NO: 71396 - DNA, 85 bp, Mus musculus; identical to SEQ ID NO: 57439

SEQ ID NO: 71397 - DNA, 85 bp, Mus musculus; identical to SEQ ID NO: 57470

SEQ ID NO: 71398 - DNA, 100 bp, Mus musculus
gctctatatattttaaatatgtatgtatgtatatgtacatatatatatgcacacacatatatatgtatatatatacacacatatatatgtatatatatgc

SEQ ID NO: 71399 - DNA, 68 bp, Mus musculus
tatatatacatatatatgtgtgtatatatatacatatatatgtgtgtgcatatatatatgtacatata

SEQ ID NO: 71400 - DNA, 95 bp, Mus musculus
gttttcttgctttctaaatatatatacatatacatatatatacatatatgtatatatgtgtgtatatatatgtatatatagagagatagatatac

SEQ ID NO: 71401 - DNA, 85 bp, Mus musculus
ggccatggtggtctgataggataaatgggacaatttcaatatttttgtatctgttgaggcctgttttgtgaccaattatatggtc

SEQ ID NO: 71402 - DNA, 85 bp, Mus musculus
ctggggaaaagaaagaaaagattgaagaatggcattgacttaagagtgaagatgatcattttgatcttcatcttgttatctctag

SEQ ID NO: 71403 - DNA, 85 bp, Mus musculus; identical to SEQ ID NO: 57439

SEQ ID NO: 71404 - DNA, 118 bp, Mus musculus
agacccagaaataaacccacacacttatggacacttgatctttgacaaagaagccaaacttatgcaatgttaaaaagaaagcatcttcaataaatggtgctggtgtagctggtagtct

SEQ ID NO: 71405 - DNA, 69 bp, Mus musculus
gagaggtactgcaagtctatctgaggctcttatcaacatggtatagagagactgaagagactacctctt

SEQ ID NO: 71406 - DNA, 85 bp, Mus musculus; identical to SEQ ID NO: 57439

SEQ ID NO: 71407 - DNA, 96 bp, Mus musculus
cttttatttgtctaagtctatttctgtctggtaaggaagttgaaattgatcatgccttgactttgtgggccagcagagaaccatgacattccagag

SEQ ID NO: 71408 - DNA, 63 bp, Mus musculus
agcattgttattgagggtgacatgggggaagttatctcgttcactctgagtgtctcacttgct

SEQ ID NO: 71409 - DNA, 56 bp, Mus musculus
gtgtgtgagcatgtatgtgtatatatatatatatatacacatgcatgcacacacac

SEQ ID NO: 71410 - DNA, 120 bp, Mus musculus
gttcctagtctctttccctctctggtggtatttgttgtcactaaagatagctctgaatctcactgtcaaagagaatgaaattggtcagtgcagtctcttgacactttagccctacctaga

SEQ ID NO: 71411 - DNA, 100 bp, Mus musculus
tgtgtgtgtatgtatatatgtatatccatgtgtgtatttatatgtgtatgtacacacatgtatatttatatatatgtaaacatatatacatatatacaca

SEQ ID NO: 71412 - DNA, 74 bp, Mus musculus
ttgaggaagactatgtttttaattattatccatcgtgagtgggtgtagtaagaggcggaggcagtatacctcga

SEQ ID NO: 71413 - DNA, 83 bp, Mus musculus
tggatttggggggttatgtttatgctggataaagagagataatataatctctctatatctatatatgaatatgtctatatcta

SEQ ID NO: 71414 - DNA, 80 bp, Mus musculus
ttgaagctggagagagaaaagtgtgtgctctgtgtaggcaatcccttctgtcaatgcaagagagaacaaacatgcttcaa

SEQ ID NO: 71415 - DNA, 85 bp, Mus musculus
gaccatggtggtctgataggatacatgggacaatttcaatatttttgtatctattgaggcctgttttgttaccaattatatggtc

SEQ ID NO: 71416 - DNA, 81 bp, Mus musculus
gctctgttcagtttttggcttccttatgtgacatggggcctaggtcaacatttgggggtctaaatatttacttttctaagc

SEQ ID NO: 71417 - DNA, 85 bp, Mus musculus; identical to SEQ ID NO: 57439

SEQ ID NO: 71418 - DNA, 83 bp, Mus musculus
gtgagttagtgagagacctggaaatgacatatgtaggcaatgacaccaacatctgtttttcttattttcaaacactgttgcac

SEQ ID NO: 71419 - DNA, 93 bp, Mus musculus
cagacatattcatgtgcgcatgttattttcatttaaaattattttattataattatctgtgtgtggatgtccatgtgcatatgtgtgagcctg

SEQ ID NO: 71420 - DNA, 85 bp, Mus musculus; identical to SEQ ID NO: 57439

SEQ ID NO: 71421 - DNA, 95 bp, Mus musculus
aagagcccttagaatgtgaatgttcaggttggcttttgctgttctctcattagctaattcagagccagctttgaacatgtgtattaaaatctctt

SEQ ID NO: 71422 - DNA, 78 bp, Mus musculus
tccagaagcactgtctctttcacactgtggtgctttcctggaatagcgtggtgcccaaggacatggacagcctctgga

SEQ ID NO: 71423 - DNA, 106 bp, Mus musculus
tccttttgttgtcgaattgctatggctagggctagggcttcaagtactatgttgaatagataggaaggaagtgggcagccttgtctagtacttgattttagtggga

SEQ ID NO: 71424 - DNA, 56 bp, Mus musculus
atatatgcacacatatatgtctatatatatatagacatgtatatttgtgtatatat

SEQ ID NO: 71425 - DNA, 115 bp, Mus musculus
ggtttagtccctgagagttctaggatgtctggttggttgatattatgttcttcatatgaggttgcaaaccccttcagctccttcagtccttcccctaactcctccctgctcagtc

SEQ ID NO: 71426 - DNA, 58 bp, Mus musculus
tcattcagaagaaactgatgtagctttgtgggagctctgaattagttcttttgaaaga

SEQ ID NO: 71427 - DNA, 96 bp, Mus musculus
gatcagccttaggccatggtggtctgataggatgcatgggacaatttcaatatttttgtatctggtgaggcctgttttgtgacctattatgtggtc

SEQ ID NO: 71428 - DNA, 111 bp, Mus musculus
atgtattatgactagacattggatatttatgcagtatgtatatattactatatatatagtatgtatacatatatagatatatagattattcaattgctgtttatattatat

SEQ ID NO: 71429 - DNA, 60 bp, Mus musculus
tatgtatatgtatatatacatatgtatatgcatatatatgtatatgtatgtgtatacata

SEQ ID NO: 71430 - DNA, 75 bp, Mus musculus
ttctgtcagtttcactctgtctctgtttagtttctgtttccaggatctgtccattgatgagagtggggtgttgaa

SEQ ID NO: 71431 - DNA, 75 bp, Mus musculus
gtcatggtatcatatatattaccttcacataccaatgccatatggttgaaggttctatggaagcaccatcttgac

SEQ ID NO: 71432 - DNA, 91 bp, Mus musculus
ctcccaaatgaataaatgtcgatagcatatatatatgtatatatatatatataaatgcaaatgtaagcatttatgagtatttttgtgggag

SEQ ID NO: 71433 - DNA, 94 bp, Mus musculus
gactagaagcaacagttgacatagggactttcagaagcactggctttcttctgaagcaacttcctcattcctgcttctggttgtgtctatttaa

SEQ ID NO: 71434 - DNA, 72 bp, Mus musculus
tcttctatttcagctatgatggagtgactaatgattttcttgaattgggccagacactgttgacatggaaga

SEQ ID NO: 71435 - DNA, 90 bp, Mus musculus
gccatctgagatattacatgaatttttgattttctgtctagagaagttatatgacttcaggtgtgagtttcatcctgtaataaatctggc

SEQ ID NO: 71436 - DNA, 111 bp, Mus musculus
ttcttttagaagtttatgctatagtatatatgatatttttagaatttttatttatgtgtgatttattctcaggtattatatttgatcatatatataaaataaatgaaagaa

SEQ ID NO: 71437 - DNA, 85 bp, Mus musculus; identical to SEQ ID NO: 57439

SEQ ID NO: 71438 - DNA, 63 bp, Mus musculus
agtacagttcttggttggtggtctctgtaagaagtgtgtgatcagaccaacctatgctgttct

SEQ ID NO: 71439 - DNA, 118 bp, Mus musculus
tagaacaacaaaaaatgtagatatatatgtatgtgtgtgtgtgaatatatatatatatatatatatatatatatatatatatatatatatatatatattgttgtggttgttagttttg

SEQ ID NO: 71440 - DNA, 79 bp, Mus musculus
ctgtgattctgtcagcctgtgtcagcactcctgggagaacagctctctcactgcaagataagggcacagaatgctacag

SEQ ID NO: 71441 - DNA, 115 bp, Mus musculus
gataattggctgcatgcatctgcatttgtatgggtcaggctctggcacagtctctctggggacagctataccaggctcttgtcagcaagtgcttcttggcatcagcaatagtgtt

SEQ ID NO: 71442 - DNA, 67 bp, Mus musculus
tgtatgtgtgtgtggcatatgtatatgtatgtatttatgcatgtgtgtatgaatgtatttatgtata

SEQ ID NO: 71443 - DNA, 113 bp, Mus musculus
atatgtatatatatgtgtgtgtatatatatacatatatatatgtatatatatatatgtgtgtgtgtatatatatatatatatatatatatatatatatatatatatacataca

SEQ ID NO: 71444 - DNA, 70 bp, Mus musculus
ggccatggggatatatgtgcatgactctctctgactcctagaaggggaggatatgtatcctgatgtggtc

SEQ ID NO: 71445 - DNA, 85 bp, Mus musculus; identical to SEQ ID NO: 57439

SEQ ID NO: 71446 - DNA, 131 bp, Mus musculus
agccacgataccatatatatatatgtgtgtgtgtgtgtgtgtgtgtgtgtgtgtgtgtgtgtttgtaaatatgcatacatatatcaatatatttgtattcatatatgtatgcatatatattccccatgtca

SEQ ID NO: 71447 - DNA, 69 bp, Mus musculus
agggacacatggctccagttgcttatgtaaccaaggatgaccttgttggatgttaattggagaggccct

SEQ ID NO: 71448 - DNA, 75 bp, Mus musculus
ggcaggtgccaacaagagtctgctgacaggagcctgatatagttgtctcctgcgtggctctgtcagtgcctggca

SEQ ID NO: 71449 - DNA, 95 bp, Mus musculus
gagaagagggttttattacatgaggttgaaaattttagtatgacataaaaattttcaaagatttttatatatgaaactctggtttcaaccttctc

SEQ ID NO: 71450 - DNA, 85 bp, Mus musculus; identical to SEQ ID NO: 57470

SEQ ID NO: 71451 - DNA, 66 bp, Mus musculus
tttgtcgcagactctctgggtccctgtgtctgcatggaacggggtttctcgatgagggttggcaaa

SEQ ID NO: 71452 - DNA, 90 bp, Mus musculus
ggaacttggtcaggaatagatttaagtacctactatttttaattatgaaaactgctggggttctttaatctgctcaaatttaccagtttt

SEQ ID NO: 71453 - DNA, 84 bp, Mus musculus
gtcctgttatttattagttgctcaatgtggacaatatatttagttataataccataaaattatctgagcaacagaaaccagggc

SEQ ID NO: 71454 - DNA, 112 bp, Mus musculus
ctgtaatgaatgataaataccattagacttaggtgtataatatatacatacacgttatgtgtgtttatatattcattttagctatagtctctataaagcaattatatttatt

SEQ ID NO: 71455 - DNA, 84 bp, Mus musculus
atgtacataaatatatatacacacaatatatatatacatatttctcgtatgtatgtatgtatgtatgtaacctattgtgtatat

SEQ ID NO: 71456 - DNA, 105 bp, Mus musculus
acctggaaactgttgctgcgggtaggaggctggaaactgttgctgactcactgcctctgcctcaggccaggtggcaagtcagcttctgatggtagggcagcttct

SEQ ID NO: 71457 - DNA, 67 bp, Mus musculus
atatatattgtatgtgtatgtgtgtatatgtacatatatatatatttatatgcatttgaatgtatat

SEQ ID NO: 71458 - DNA, 85 bp, Mus musculus; identical to SEQ ID NO: 57439

SEQ ID NO: 71459 - DNA, 99 bp, Mus musculus
ttatgttgcaaatgttgtcagatattttaattagtactgaatttgatgtttttaagggtcagtgactaagaatattaaaagataataatgggaagataa

SEQ ID NO: 71460 - DNA, 94 bp, Mus musculus
atgcagctgttaaaactcagtggtactctacatagaagataaatctggttacatctatctttgtatgtatgtatgagtgtatgcatgtatgtat

SEQ ID NO: 71461 - DNA, 93 bp, Mus musculus
cctgatgttacctttgggtctctgtatctgtctcctatccctggaaaaagcctctctggagacagttatcagttaacccaggttcctctctgg

SEQ ID NO: 71462 - DNA, 76 bp, Mus musculus
agaaatatatgtatgtatgtgtgtatttatgtatatatgcatgtatgtatgtaggtatgtatgcatatgtgtttct

SEQ ID NO: 71463 - DNA, 94 bp, Mus musculus
acacacacacacacacacacacacacatacatatgttagacagttccatataaatacatacatatgtgtgtgtgagtctctgtgggtgtgtcta

SEQ ID NO: 71464 - DNA, 111 bp, Mus musculus
tatatatatgtatatacatagatgcatatgtaaatatatagtatttatagtatatataatatatatatatatatacttgtgtgtgtgtgtgtgtgtgtgtgtaaaagtgaa

SEQ ID NO: 71465 - DNA, 85 bp, Mus musculus; identical to SEQ ID NO: 57439

SEQ ID NO: 71466 - DNA, 104 bp, Mus musculus
tcttggtgtgcttcatttttatatactttaaagggattttattagtcactatttttcttttaaaaaagaaagagcagtgtgtctctttcatggagaacttcaga

SEQ ID NO: 71467 - DNA, 85 bp, Mus musculus; identical to SEQ ID NO: 57470

SEQ ID NO: 71468 - DNA, 107 bp, Mus musculus
tacagagactcaagttcatagtttccagaatgataatgaccagcattttatatgtatatcttatggtataatattctttatagtaggaggctgcttctctatctgtg

SEQ ID NO: 71469 - DNA, 84 bp, Mus musculus
tggttctcacttggtagaccaggctggcctcgaactcagaaaccatcctgtctctgcctccctgcctcccaagtgctggggcta

SEQ ID NO: 71470 - DNA, 90 bp, Mus musculus
ggactctgaaacatttgagtagcttgtctcatgcctcaggccatgtgtcccactgagaacagagtaagcacttcagagacaacagcttcc

SEQ ID NO: 71471 - DNA, 85 bp, Mus musculus
gtccatggtggtctgataggatgcatgggacaatttcaatatttttgtatctgttgagccctgttttgtgaccaattatatggtc

SEQ ID NO: 71472 - DNA, 85 bp, Mus musculus; identical to SEQ ID NO: 57439

SEQ ID NO: 71473 - DNA, 85 bp, Mus musculus; identical to SEQ ID NO: 57439

SEQ ID NO: 71474 - DNA, 75 bp, Mus musculus
atctctgctataatgtctgtgtcaatctgtcttcctcaaaggagtgcagagatgaagacaaacatgtacaatgat

SEQ ID NO: 71475 - DNA, 78 bp, Mus musculus
gacaagagcctagagacagaaatggaagccaagaccacagagagtggctgcttcccactggctctcactgcctgggtc

SEQ ID NO: 71476 - DNA, 85 bp, Mus musculus; identical to SEQ ID NO: 70679

SEQ ID NO: 71477 - DNA, 85 bp, Mus musculus
ctgtctctgtttctgtctctgactctctctcttacacacacacacacacacacagagagagagagagagagagagagagagagag

SEQ ID NO: 71478 - DNA, 104 bp, Mus musculus
gctgggttggtgtcttgccttaccagcagacttcactgtctattcagtacagattgtgtgagaagacagtgagtgtgcatggtataaactgtccaatcccgggc

SEQ ID NO: 71479 - DNA, 63 bp, Mus musculus
catgctgtgactctcacacaacggcagacatccctagtgtgtgtgtgtgtgtgtgtgtgtgtg

SEQ ID NO: 71480 - DNA, 70 bp, Mus musculus
ggcagatgtagaactctttgcaaggcaggctatatgctttcctgtctctgtctctgtctctgcctctgcc

SEQ ID NO: 71481 - DNA, 162 bp, Mus musculus
tgtatatgtgtatgtgtagctagagttatatatgctctacatacatatatgtgtatatatatgtatagtagagatactatatatagcatctctgtgtatttatatatatatacacacacacggggggggcatatttctttctgcatgtgtgtgtgcgtgtgt

SEQ ID NO: 71482 - DNA, 77 bp, Mus musculus
ggaccgtactgatactcacacacatagcttatctgtgagaacacactcaggttatgtgtacagcctcttagccgttc

SEQ ID NO: 71483 - DNA, 70 bp, Mus musculus
atgcacacacatatgtatgtgtgtatatatgtatgtatgtatatatgtatgtatgtatgcatatcatagt

SEQ ID NO: 71484 - DNA, 85 bp, Mus musculus; identical to SEQ ID NO: 57439

SEQ ID NO: 71485 - DNA, 109 bp, Mus musculus
acaggaagacaactgctgaacgttcacatacacactaagtctaaatttgcagaatatgcaaatggaatcttataaacatggtgagttttggatagagactgtatcttgt

SEQ ID NO: 71486 - DNA, 82 bp, Mus musculus
caaggactaagaggttgtggagtagaattcttgaacctctaattcttaattctcccatctctcagcctcactcagtttcttg

SEQ ID NO: 71487 - DNA, 102 bp, Mus musculus
ccagtgtaattttgagaaacgttctggataaacattaagggatgatctacaagctacatatctctatatgtttttcaattttgagttcaacagagatactgg

SEQ ID NO: 71488 - DNA, 84 bp, Mus musculus
tagagcccacctaccttcgctctagtgactcagtatccatcacttagatagatacttttacaaatgcaggtgggtgcacttctg

SEQ ID NO: 71489 - DNA, 80 bp, Mus musculus
ttttgcaagcgttagtgtgtccatgcatgtatgtatgtaagtgcaccatctccatgcaggtgaccctggagctctcagag

SEQ ID NO: 71490 - DNA, 114 bp, Mus musculus
tatgggtgtatgtgaatatgtgtataggtatgtacgtatttatctatctatgtatatatgtatatatctaaatatgtatatatctatatatctgaatatctatatgtataatct

SEQ ID NO: 71491 - DNA, 118 bp, Mus musculus
gcattagtccgtgatgatctgataggaggatgcccgggataatttcaatatttttgtatctgttgaggcctgttttatgaccaattatatcatcaattttgagaaggtaccatgatgt

SEQ ID NO: 71492 - DNA, 78 bp, Mus musculus
tgaccaacacaggggtcatgttgagtcttttcctctgctgtctcctttaaccttcagactcaccctctgtgactgtca

SEQ ID NO: 71493 - DNA, 80 bp, Mus musculus
gacatagggctaaagagatagctcagtggttcagagcactgactgctcttccagaggtcctgagttcatttcccatttcc

SEQ ID NO: 71494 - DNA, 94 bp, Mus musculus
ggtgctggagaggtggcagagagttctatatctgcatctacatctgcgacagagagacactgcacctagcgtgagcatttgaaaccccaaagcc

SEQ ID NO: 71495 - DNA, 73 bp, Mus musculus
cacacacacacacaacttttgacatggtgtgctttctggcattacacccatgtgtcatctgtgtctgtctgtg

SEQ ID NO: 71496 - DNA, 117 bp, Mus musculus
gcggaggctggaaagatggctctgcagttgagagtactgactgctcttccagaggtcctgagttcacttcccagcaaccacatggtggctcacaaccatctgtaatgagattcagtg

SEQ ID NO: 71497 - DNA, 108 bp, Mus musculus
gttttttgttctgaccctctctctgtctttacatcttgttgttcatatatatatatatatatatatatagagagagagagagagagagagagagagagagagagagat

SEQ ID NO: 71498 - DNA, 75 bp, Mus musculus
ctggggttcaaggagggctgagaggctaggatgggtgtgtgtaggtcactctctctctttgatttagtactttag

SEQ ID NO: 71499 - DNA, 73 bp, Mus musculus
tctgtctgtcggtctgtctgtctctttctcaataaaacaggggaaggtgacagcagtatttttggaagataga

SEQ ID NO: 71500 - DNA, 103 bp, Mus musculus
gcttcttgtctgccatctcaggagcaactttgtcctccctgatgtctgcctcactacacgtgcagaacaatagagccaagcagccctgactggaagtctctgc

SEQ ID NO: 71501 - DNA, 160 bp, Mus musculus
gtatatatgtgcatatatacctaccatatctctatgtgtgtgtgtgcatatatatacatatatatacacacacacatagagagaatatatatgtatatatgcatataaatacatagatatatggtaggtatatatgcacatatatatggtagatatgtgt

SEQ ID NO: 71502 - DNA, 182 bp, Mus musculus
gcctgtactgtatacccttagtggatcagaatacatggatatacatacacaatatgtatgtatgtatgtatgtatgtatgtatgtatgtatgtatctacacacacacagtcacgtatatatgtatgtatgtatgtatgtatgtatgtatatatatccatgtggtgagtgcccttgttcatac

SEQ ID NO: 71503 - DNA, 108 bp, Mus musculus
gtgtgtatgtgcgtgtatgggtgtgtatgtatgtgtgtgtgtatgtgtgtgtgtgcatgtgtatgtatatgtatgtatgtggatgtccttgtgcatgtatgtatttat

SEQ ID NO: 71504 - DNA, 64 bp, Mus musculus
cagaatccctgtggctattcttgtctcccaccaggagctaagagagcagacaatggacaagctg

SEQ ID NO: 71505 - DNA, 76 bp, Mus musculus
agtcctggatctgggcctgagaggtctccgagatggtcagctcattgactctcacacactcatgcccgtggggtct

SEQ ID NO: 71506 - DNA, 68 bp, Mus musculus
acacaggacatgtaagagtgtgtgatataggaacactcttacactcttctctgtgtgtgtgcctgtgt

SEQ ID NO: 71507 - DNA, 116 bp, Mus musculus
ttagcaatactgtacttgttgggaggatgagtccgtaccgggaagttttctgtctaattctatttgttttaacaacaaaacctcgggtggattcctcacacaggacaatttgctga

SEQ ID NO: 71508 - DNA, 75 bp, Mus musculus
tttccttttagcttgattacataggaattctaggacaaacctggatgttttccttgtgatgatcagcagaggaaa

SEQ ID NO: 71509 - DNA, 75 bp, Mus musculus
ttgtgtcccacagtgagtgagtgtgacagttacaccctttttcggtgtaactggttaattttaggtgtaatacaa

SEQ ID NO: 71510 - DNA, 65 bp, Mus musculus
caagaagagcctgagcagacacttggcgagatgcaggagtctgtgactcactggcttttaccttg

SEQ ID NO: 71511 - DNA, 115 bp, Mus musculus
tggaattcaaccacccgaagactccggtatttagttttgtaagtctagttttatatttttaaaaacctgatataacaacaaataaacaaggtgcaggtgtttgggagactttcca

SEQ ID NO: 71512 - DNA, 92 bp, Mus musculus
gccttggtagggtcgattgaaagacagatttcaccaccattcttaacatttcttggaggtgtgagtctctctgacagtcacagtatgtgggt

SEQ ID NO: 71513 - DNA, 95 bp, Mus musculus
ctgtggatcaagctggggtctgcaggcttgtgtgacaggcactttgtagactagatgcctggctcacacacacacagtacttgaggtgtccatag

SEQ ID NO: 71514 - DNA, 85 bp, Mus musculus; identical to SEQ ID NO: 57439

SEQ ID NO: 71515 - DNA, 83 bp, Mus musculus
gtatgtgtgtgcaagtatgtattatgtacgtaagtatgtatgtatgcttgtatgtatgtatgtacatgtgtgcatacacctat

SEQ ID NO: 71516 - DNA, 75 bp, Mus musculus
gactgaggcaaacaattataaatatattgattactagctcatggtagagccagggctagcagtgtgttcctcttc

SEQ ID NO: 71517 - DNA, 115 bp, Mus musculus
tctcacagaacagacagcacacaattctttcaaagattgccttgtttttatttatttattttacacttatgtttatttggtatgtgtgttggggggggcatgtgggttctgtgga

SEQ ID NO: 71518 - DNA, 87 bp, Mus musculus
agtgaaatctctgatttactgagattgttgatgtctgctagctggagctgagaagttagcaattattaagaagagaccagcttcact

SEQ ID NO: 71519 - DNA, 66 bp, Mus musculus
tcagctggtgttctggtgttgggggagctgtaggtcagctctctcatagtcactgactcttcttga

SEQ ID NO: 71520 - DNA, 117 bp, Mus musculus
tgttagtttggtcaagaaacaacatatctctgggtctgaatttttttctctataaaatgaagaattttcacacgaagatcttggtgattgcttctagtgttttatgacttgtattca

SEQ ID NO: 71521 - DNA, 114 bp, Mus musculus
ggttttaaggagaaaaaccgattcctaaagggaggtaatgatgatttgtccgtctgtctatctgtcggttcgcttatctagtatacctgctctaccccaggaatggtttaaccc

SEQ ID NO: 71522 - DNA, 86 bp, Mus musculus
tgtatatgtatgtgtatgtgtatctgtgtatgtatatgtgaatacacacacacacacacacacacacacacacacacacacacaca

SEQ ID NO: 71523 - DNA, 68 bp, Mus musculus
gtctctctttctcactgtctgtcacactatatgaagagatagataggtagatagtgagttggatagat

SEQ ID NO: 71524 - DNA, 98 bp, Mus musculus
cagcatggtatgagagtttctactacagaggcctggctttgaggtccctttctgtgtttgctaaaggactgtagctaccctgtgaacttgactatctg

SEQ ID NO: 71525 - DNA, 127 bp, Mus musculus
gtggtgcgaatgtgtctatttcagtgactcattttgaagtcagtattctgcttgtgtttctcactgtgtgtgttcacgtgcgtgctacagagtgcttgtgaaggtccatttgtgggataggcatgca

SEQ ID NO: 71526 - DNA, 93 bp, Mus musculus
gctccttaagaatggtattttagggttggagagatggctcagcggttaagagcactgagtgctctttcagaggtctagagttcagttcccagc

SEQ ID NO: 71527 - DNA, 90 bp, Mus musculus
gggtttgttcccgtgtctctgtcactgtcttagatggcagcctctgtaatgtggtgaggacagtgattctcctaggatacagaatgaccc

SEQ ID NO: 71528 - DNA, 58 bp, Mus musculus
gcacaggtggagagtttggagggtgacttttgggagtcattctctctttctgtcacgc

SEQ ID NO: 71529 - DNA, 81 bp, Mus musculus
gtatgtatgtatatgtatgcatgtatatatatatgcatgtattttatgtatatattatatgtatgtatgtattgtatgtat

SEQ ID NO: 71530 - DNA, 118 bp, Mus musculus
gattaaaggtgtatgccaccatatctggcaattggtggatttctaatttttagatttaaatctaaataacagtgttaggtaaactttgtcattaatatgtaagctgtatatttgtatc

SEQ ID NO: 71531 - DNA, 62 bp, Mus musculus
tggggcctcactgtgtcactgggactgacctggaatttgcagtgtagatcaggatggcttca

SEQ ID NO: 71532 - DNA, 88 bp, Mus musculus
ggcagtaattgtgtgtgtgcatgtgtatgtccatgtgtgtactctggtacatggcatggccgagggcagaggacagcgtttaggagtc

SEQ ID NO: 71533 - DNA, 114 bp, Mus musculus
tggtacaagagcttcaggagtggctagagagatggctcagcggttaagagcactgactgctcttccagaggtcctgagttcaattcccagcaaccacatgatggctcacaacca

SEQ ID NO: 71534 - DNA, 73 bp, Mus musculus
gttatcctagactcactttgtagagcaggctggcctcacactctgcctctgcctcctgagtgctggggctaac

SEQ ID NO: 71535 - DNA, 73 bp, Mus musculus
tttgaactggggctggagagatggctcagcggttaagagcactgactgctcttctgaaggtcctgagttcaaa

SEQ ID NO: 71536 - DNA, 91 bp, Mus musculus
cactttacaggctgaagagctggctcagcggttaagagcactgactgctcttgcacaagtcctgagttcaattcccaacaaccacagggtg

SEQ ID NO: 71537 - DNA, 96 bp, Mus musculus
gggctgggagggatggctcagtggttaagagcactgactgctcttccagaagtcctgcaaaaagtgctttttaatagctctccatctcttcagtcc

SEQ ID NO: 71538 - DNA, 76 bp, Mus musculus
tcagagccgactgactcgagaaagaagagctcagaccagcagccctgggctgctctcccagagtctgtcactctgg

SEQ ID NO: 71539 - DNA, 77 bp, Mus musculus
cccacagttccccagactacaggctctcacactcacagtggccaaaggggcatctgtggtcaaaagactgtacaggg

SEQ ID NO: 71540 - DNA, 78 bp, Mus musculus
tctattaaatgtgtgagtctcactttgtccctcaattgtttgggattaaaggtggtgcatgcctacatttcagtcaga

SEQ ID NO: 71541 - DNA, 74 bp, Mus musculus
aggaagtgtgtcactgggggggtggactttagggttttgaaaacccatgccagtctcagtgtctctctcttctt

SEQ ID NO: 71542 - DNA, 60 bp, Mus musculus
acacacacacacacacacacacacatatgtatatatgtgtgtgtgtatgtatatgtatgt

SEQ ID NO: 71543 - DNA, 89 bp, Mus musculus
ctccttctatctatttaatgtgactgtactgttgctgtcttcagacacaccagacaaggacatcagatcccatttcagatggttgtgag

SEQ ID NO: 71544 - DNA, 98 bp, Mus musculus
tatatatgtctctctgtatatgtctctctgtatatgagggtgtctgtctctctgtgtatgtgtccagggatgtatgtgggtgtctgtgtgcgtgtgtg

SEQ ID NO: 71545 - DNA, 118 bp, Mus musculus
ggaagctcatgaagttaaaaattttttagggggctggagagatggttcagtggttaagagcactgactgctcttccagaggtcctgagttcaattcccatggtggctcatgaacatct

SEQ ID NO: 71546 - DNA, 74 bp, Mus musculus
ggctgtgggtctctggctcagttctgctccaggaagctgcttcggaaagtgagcccgtaaggaaccgagcagtc

SEQ ID NO: 71547 - DNA, 97 bp, Mus musculus
tctgtctaatccttgtttcttgtctggttatctagctcaaactatctttgatttgagatccttttgcccaaggtttcttgactgatgggattacagg

SEQ ID NO: 71548 - DNA, 108 bp, Mus musculus
ccagagcagagggccgagtccgcggctgccgtcgtaggctgtgggtcagtcgcactgactgaaacgctgagatgatgagtgtgcgtttctctgttgtcgagcaaaggg

SEQ ID NO: 71549 - DNA, 75 bp, Mus musculus
atgcatgtgtgcatgtgcatttgcatgtgtgtgcacgcatgtgtgcatgtgtgtgttgtatatgcacatatgcat

SEQ ID NO: 71550 - DNA, 82 bp, Mus musculus
gagagagagagagcatgtgtgtgtatatatatgtatatatgtgtacatacatacatatgtacacacagtttgtttctctttt

SEQ ID NO: 71551 - DNA, 95 bp, Mus musculus
cactattccaggctggagagagggtggctcagcagttaagagcactgtctgctcttccagaggtcttgagttcaattcccagcaaccacatggtg

SEQ ID NO: 71552 - DNA, 86 bp, Mus musculus
accaagttcgtcactgattacaaaagaaatgcacagaagagagaaataaagaggtgcagattgtctgatgagtgtgagaacttggt

SEQ ID NO: 71553 - DNA, 69 bp, Mus musculus
ccttctgggccttgaaatgcagtggggtgcgggtgagaagaggtctgactgggactctgtctaaggagg

SEQ ID NO: 71554 - DNA, 64 bp, Mus musculus
agcatcttcagatactcagtgagtcttcggggagtctgccctgctcactctgtataagtcagct

SEQ ID NO: 71555 - DNA, 67 bp, Mus musculus
gtgtgtaggggccagaggaggacactgaaattcttcctctatgttctctctctgtgtctgtgtctat

SEQ ID NO: 71556 - DNA, 88 bp, Mus musculus
ctgccggtctgtctgtctgtctgtctgtctgtgagccgccataaaagcataaccaacctaagcagcaacaggctgacactagcagata

SEQ ID NO: 71557 - DNA, 80 bp, Mus musculus
gtctacgctcacatctctctgtctctgtccacggccattcacgtttaaccagggctctttgcaatgagtgtagcgtaggc

SEQ ID NO: 71558 - DNA, 103 bp, Mus musculus
ctctctctgtctgtctgtctatctgtctgtctgtctgtctgtctgcaggatattattctctggaagatttcagtgagatccctaggcttcctcctagaatgag

SEQ ID NO: 71559 - DNA, 101 bp, Mus musculus
agggaaagttctgtctgtctgtctgtctgtctgtcagccctgaagtgttcctggacactggggtttgaatttctgagtgaaatgctgcacagagatgccct

SEQ ID NO: 71560 - DNA, 110 bp, Mus musculus
agggtttattcggctgatgcttccacatccttagtccatcactgaaggcagtcaggacagtgatgcaaacagggcaagaatctggaggcagaagctgatgcagaggcctt

SEQ ID NO: 71561 - DNA, 78 bp, Mus musculus
tactcagagctctgcctgtctgactctctgcctgtcctgagcacagagacacacccggcttagcggatttgtagcttt

SEQ ID NO: 71562 - DNA, 62 bp, Mus musculus
accatcagcatgagcatgtgaaagtgtgatttaagaattcctttcctgctgggcgtggtggt

SEQ ID NO: 71563 - DNA, 118 bp, Mus musculus
gaaagagtcagatgggacctttttaacttccaaaatctgttaagctgactttttcttttattttagaagcatgagtaaggctactgaaatttggaagccagttttgtcagggtgtttc

SEQ ID NO: 71564 - DNA, 99 bp, Mus musculus
acaattgtgtactcctgggaggtctagctgatttgtgctctaggtcaagttcttttctgagttgttggtgtaactttctggtctaccactattcattgt

SEQ ID NO: 71565 - DNA, 108 bp, Mus musculus
caaccatccaaaagagtgaaggctgtcctggccatgttgtccaccatgtctcttgagatgtctccacattggactggggcttagtatttcaccctacagatgtggttg

SEQ ID NO: 71566 - DNA, 87 bp, Mus musculus
agtcaaacctgggcctcactctagtgaattctttcctgaccccaggcatgagagactatcactcactggcttagtgactgaatggcc

SEQ ID NO: 71567 - DNA, 64 bp, Mus musculus
cggtggctgcctgtaagccagatggactgggggagtgtctcagacagctagctcggtgccactg

SEQ ID NO: 71568 - DNA, 68 bp, Mus musculus
ctctcacacagtcactcatccccaatgtcggagcccccagtggtcgatggcagttcttgtgtgatgag

SEQ ID NO: 71569 - DNA, 97 bp, Mus musculus
tatatttatttagtgtgtatatatatacagatgtatgtgtttatatatgtatgtacatatgtatatctatgtatgtatgcgtgatgtatgtgtatat

SEQ ID NO: 71570 - DNA, 79 bp, Mus musculus
tgtatgtatgtatgtatgtacatatatgtgtgtgtataattttatacattgcataggtgtgtgtatatacatatatata

SEQ ID NO: 71571 - DNA, 85 bp, Mus musculus; identical to SEQ ID NO: 57470

SEQ ID NO: 71572 - DNA, 96 bp, Mus musculus
tcatggaaccatctctccggcaccttaaaaaattattcatgtgtatgtgtctgtgtctatgtgaatgtatgatgtatgtgagtgtggtacccatgg

SEQ ID NO: 71573 - DNA, 81 bp, Mus musculus
gtttggcaaatgtgtgtgtgtctgcatgtgcatgtataggtttgtatagatcagagaataaccatgggccattttccagac

SEQ ID NO: 71574 - DNA, 99 bp, Mus musculus
catgatctgtccattgctgagaactgggtgttgaagtctcccactattattatgtggggtatgatgtgtgctttgagctttagtaaagtttcttttatg

SEQ ID NO: 71575 - DNA, 74 bp, Mus musculus
gggggtggggtgggggtgggctttgagatttgaaaagctcaaaccaggtccagagtctgtctctctctgctgcc

SEQ ID NO: 71576 - DNA, 86 bp, Mus musculus
gccactatatgtatatatatttctgtgtaatatgttgaagtttatttggagttttaaacagagggcccattctgttcataagtggc

SEQ ID NO: 71577 - DNA, 108 bp, Mus musculus
tcaagttgaccaagaatatccatcacagtagggaattttgagagtgaagacactgaatttttttctttcagtagattttgatctgaggataaatggaagtcaaagaga

SEQ ID NO: 71578 - DNA, 65 bp, Mus musculus
tctgtgtgagtgcatgtgcatgtttatcagtgggtacctgcacccatgcacacgctgaggccgga

SEQ ID NO: 71579 - DNA, 81 bp, Mus musculus
gcctgtggagtaggatgtaaagttctaagttactgccccaacaccatagcttgccactcctgctctcctacgatcatgggc

SEQ ID NO: 71580 - DNA, 102 bp, Mus musculus
ctgtaatgggatttgatgccctcttctggtgtgtctgaagacagtgtactcatataaataaataagtaaagtacttccacatagtacagggatgcattgcag

SEQ ID NO: 71581 - DNA, 109 bp, Mus musculus
tctccatgtgcctcgctctggggtgtctagcaccaacatcctctggggttttaaccttatctctcagacactgtgacacagctgttctctttctcggagccacgggaga

SEQ ID NO: 71582 - DNA, 83 bp, Mus musculus
gtttctcaggggacagaaaatagtgtcatgagtggctgcagaggccaatgccagccactctcagtgtgtccccatgggtatgc

SEQ ID NO: 71583 - DNA, 81 bp, Mus musculus
gcatcagtagtgactgaggacaagggcttagctgctttgttttatcagagactttcaagaacttcctaaggctgctggagc

SEQ ID NO: 71584 - DNA, 77 bp, Mus musculus
ctggcagagaggcaaagcaagactggggtggaccctgggtggcctcacccactctccctgtgctaccccttgggcag

SEQ ID NO: 71585 - DNA, 74 bp, Mus musculus
gcaaaagtgtgtgtgtgtgtgtgtgtacacgtctctctgtgtttgtgtatgtatgtatatgtatatgtgtgtgt

SEQ ID NO: 71586 - DNA, 83 bp, Mus musculus
aagttatcctgactgtgtgtctctgaaacagaaattgagcaaaaaagatttctaggagagaaaaaaatgcagcaggctacctt

SEQ ID NO: 71587 - DNA, 63 bp, Mus musculus
gatgagtctgtgcagagggcagagtgagcacacactcctctgcagacactgacaggcacaatc

SEQ ID NO: 71588 - DNA, 85 bp, Mus musculus; identical to SEQ ID NO: 57470

SEQ ID NO: 71589 - DNA, 64 bp, Mus musculus
tctccgtcactcagactgtgggatttgcaagagtcatttatggcagtctgtgtggggctagaga

SEQ ID NO: 71590 - DNA, 90 bp, Mus musculus
aaaggtttccggtggagagagaaaacagagggttctcatttctgtcttcttagtcccctcctcaattgtaccatcctccatagaaccttt

SEQ ID NO: 71591 - DNA, 118 bp, Mus musculus
ttgcccaaccttacaatagatataaaatattggcacaagagtaaaaacttcttatatatgcatatatatatatatagtctgtagtgtcaattgagatatagaaccttaggaattgcaa

SEQ ID NO: 71592 - DNA, 83 bp, Mus musculus
gcaccctgctttttataaattaacagaatgcagacactttttttttcttaagaaaaatgtggttagatttattagacaggggc

SEQ ID NO: 71593 - DNA, 79 bp, Mus musculus
ctttctgtttctgtgtcactctaagtgctgtgcatcaggtgtgtctgacaactatccaggggactcggagcacattgag

SEQ ID NO: 71594 - DNA, 108 bp, Mus musculus
gtctcctctgtcatctctctccatatgtgtgtgtgtatatatatatatatatatatatatatatatatatatatatatatatatattcagagggctgccatatctggc

SEQ ID NO: 71595 - DNA, 114 bp, Mus musculus
gcaaactgtaggcaccgagaaacgagctctctttgtgtgactgtgttactctgtgaaagactggattcaactgtgacttcactcagagaagctctttctaggtagtgatttggc

SEQ ID NO: 71596 - DNA, 132 bp, Mus musculus
tatataccatatatatatgtatatataccatatatatatatatatatacatatatatatatatatatatacacacacacacacatacattatagatatgtgtgtgtgtctctgtgtgagtgtgtctgtgtgt

SEQ ID NO: 71597 - DNA, 115 bp, Mus musculus
tataatgtatgtgtgtgtgtgtgtatatatatatatatatatatgtatatatatatatatatatggtatatatacatatatatatggtatatataccataaatatacacattata

SEQ ID NO: 71598 - DNA, 117 bp, Mus musculus
aaaatttcactgacatttatatgtatatacatgtgacatgttttatctatctatctatctatctatctatctacctatgtatatgcatgtatatacatatacacatatttaaatttt

SEQ ID NO: 71599 - DNA, 85 bp, Mus musculus; identical to SEQ ID NO: 57439

SEQ ID NO: 71600 - DNA, 92 bp, Mus musculus
tctatatatcatatatatgtatttcatatatacttcatatatatctgtatatatatcatatatatgtatgtctatatgtatatgaaatgaga

SEQ ID NO: 71601 - DNA, 118 bp, Mus musculus
catgtttgtatgtatatatgtgtgtgtatatatgtatatgtatacatggcatatatgcatataacatgcgtggctagtgtgtgtgtgttattctgtgtgtgtgtgtgtgtgtgtgtgt

SEQ ID NO: 71602 - DNA, 85 bp, Mus musculus; identical to SEQ ID NO: 57439

SEQ ID NO: 71603 - DNA, 107 bp, Mus musculus
gcatatatatgtacatgtgtatatatatatatatatgtgtgtgtgtgtgtgtgtgtgtgtgtgtgtgtgtgtgtatgtagcatatattcacatgcatatacacacat

SEQ ID NO: 71604 - DNA, 118 bp, Mus musculus
tagaatgattcaaggtatgttgacgacagtgtgtatgctacaggttccatgcatatagtatgttattttgtagaagggacttgagtatgtattgggacctcagaatgttctggaatta

SEQ ID NO: 71605 - DNA, 87 bp, Mus musculus
ctgtctctctgactatcaggcagggaagcattttatgattataattttataatgcagaagtccaaagccagggtgttcatgagcaga

SEQ ID NO: 71606 - DNA, 108 bp, Mus musculus
atatatgtatatatacacactatatatatgtatactgtatatatacatatgtgtatatgtatatgtatactgtatatgtatactgtatatatatacatatatatagtg

SEQ ID NO: 71607 - DNA, 115 bp, Mus musculus
gtcttagaatatctctgttacaaattaaaaactcatatgtatgtatgtatatatgtatgtatgtatgtatgtatgtatgtatgtatctgtatatgaaatactgatgacattaaga

SEQ ID NO: 71608 - DNA, 113 bp, Mus musculus
tgtatgtatgtatctatctatgtatggatgtgcatatgcatatatatatgtatatgtacatatatacaaatacaattttatatatatatatatatatatatatatatatatat

SEQ ID NO: 71609 - DNA, 65 bp, Mus musculus
tatgttttatacatgcatatctatatatgtatatatacatatacatgtatgtatgtatgataatg

SEQ ID NO: 71610 - DNA, 108 bp, Mus musculus
tagcttttttaaaaaaaatctagtttgattgtttgtctgcttgttgcttgttttctaaaaagaaagagtgtagtacccaattaaatatttgaatttttctagtggctg

SEQ ID NO: 71611 - DNA, 115 bp, Mus musculus
ctataacatggttttatttttaattaccaaactgtgattcattttttctttatcttcccacatgagattatgagtgtgaatatatacagtgaaggctttgagatctggtctgtag

SEQ ID NO: 71612 - DNA, 85 bp, Mus musculus; identical to SEQ ID NO: 57470

SEQ ID NO: 71613 - DNA, 71 bp, Mus musculus
tacaagtagaatgcaaaggtatctatagttcattattaaataatgactgggagctaagcatctcacttgta

SEQ ID NO: 71614 - DNA, 81 bp, Mus musculus
cagacattaggcagatgccaacaagagcctgctgaggagatcctgatatagttgtctcctgtgaggctctgtcagtgtctg

SEQ ID NO: 71615 - DNA, 113 bp, Mus musculus
tgttacatttgtgtagcttggttttgtgggactcataacagtcttagtaggaactgtctctgacactgtttattgtctttgggtccctttctgggttgccttgtcttgtctca

SEQ ID NO: 71616 - DNA, 85 bp, Mus musculus; identical to SEQ ID NO: 57439

SEQ ID NO: 71617 - DNA, 70 bp, Mus musculus
atctttagggtgtgtccttgctcattggttaaacatttctgagaacatcctcaaagacacacccagagat

SEQ ID NO: 71618 - DNA, 79 bp, Mus musculus
acaacaggttatatgtatatatgtatgtgtgtgtatacatatataattttatacatatgtaggtatgtaacaggtatgt

SEQ ID NO: 71619 - DNA, 76 bp, Mus musculus
gtagcaggggaaaggtgacattgatatctgtacatatttcagacttgagtcagtttcactctttctctgaatgctg

SEQ ID NO: 71620 - DNA, 115 bp, Mus musculus
tatagcaaatgcttttacctgctgagccattttgaagatcttgtatatttatacttaaagttgaatgttatagcagaccttcaattgactcttgcttctttaaagtttatctata

SEQ ID NO: 71621 - DNA, 118 bp, Mus musculus
agaatgatttactgagtattttgttttgttttgttttatcctgttttgctttttttttttttaaaaaaaagccactagacaggacaaaatgcattctgcactatactgtaaagactct

SEQ ID NO: 71622 - DNA, 88 bp, Mus musculus
gagcagatgtgcagcttggtctttgtatgggttccctaacaactgaggtggaggctctctctgactctgttgcctgcttttggagccc

SEQ ID NO: 71623 - DNA, 61 bp, Mus musculus
gctccatccattgtttgactgtgggtgtctgtttctgtctgagtcagctgatgggtggagc

SEQ ID NO: 71624 - DNA, 98 bp, Mus musculus
agaatcaatacttggaacatcaaaagaaaagccacaaatttatgttttttctttttttctggtggcttctctttcctgagatgcttcagtgtccgtct

SEQ ID NO: 71625 - DNA, 68 bp, Mus musculus
tatacctacatctacatatgtacctgcatctattcatatctatgtatgtatgtatgtttgtatgtatg

SEQ ID NO: 71626 - DNA, 56 bp, Mus musculus
ttcacttagggtctgggagacttagcaaaagcagaggctctcagtctctgtcagaa

SEQ ID NO: 71627 - DNA, 93 bp, Mus musculus
tggaggttgacgtagatattacattggagatgaatgttatggtcccttatttaccatactttgattatttatgtttcttgctgttaatttcca

SEQ ID NO: 71628 - DNA, 76 bp, Mus musculus
gctattatagctatttgaattttttttctaacaggttttctgaatttggttggaaaactcaagagctatatcaagc

SEQ ID NO: 71629 - DNA, 99 bp, Mus musculus
gcaagagtggctcctcacatctcccccttttcttttatttaaaaggcaacaggccacccagtactgagagaggagatagaggtcaaatccccagtctgc

SEQ ID NO: 71630 - DNA, 85 bp, Mus musculus; identical to SEQ ID NO: 57439

SEQ ID NO: 71631 - DNA, 100 bp, Mus musculus
caacatctgctgtcatctgagtttttgatcttagccattctgattggagaaaggtagaaggttgttttgatttgcatttccctgatgactaagaatgttg

SEQ ID NO: 71632 - DNA, 117 bp, Mus musculus
gtgcagctaacttgtcaatttttgctgtgcagattgagactgctttttttatttttcaacatgaaacacagaacaacaatcattcaatcatccaagcaaaaacaaacacgagttgac

SEQ ID NO: 71633 - DNA, 73 bp, Mus musculus
gtatgtatgtatgtatgtatgtatgtatgtatgtggtgaacatgcttatatgtgtgcctgtgtgtgttcatat

SEQ ID NO: 71634 - DNA, 114 bp, Mus musculus
acatatataggtatatgtgtatgtatataactatgcatgaacacttgtgaaattgttgagacaggtggttaagcccagtaaaagtatgtgtgtctgcgcatgtttatgtatgtg

SEQ ID NO: 71635 - DNA, 73 bp, Mus musculus
agatagagtttagcagagatagagatagctatttaatgtctatctatctgtctgtctgtctatctatctatct

SEQ ID NO: 71636 - DNA, 85 bp, Mus musculus; identical to SEQ ID NO: 57470

SEQ ID NO: 71637 - DNA, 74 bp, Mus musculus
gtagcagatttgaaccttggtctttatgtgggtcctctcacaattggaacagggactgtctctgactctgttgc

SEQ ID NO: 71638 - DNA, 70 bp, Mus musculus
ggatgggtttatttggtttacatttccttccctgttcatcactgaaggaagtcaggacaggaactcaaac

SEQ ID NO: 71639 - DNA, 112 bp, Mus musculus
ctgccacatgttccctcttttttatggatcctagctcaaaatctttatatttaagtatataccatgaattaactataggacgtataaaatagagagggggtatactgggaag

SEQ ID NO: 71640 - DNA, 59 bp, Mus musculus
taagactatgcctattctatgccacctagtaggatgtatagcaatgggtgtttttctta

SEQ ID NO: 71641 - DNA, 89 bp, Mus musculus
gattttaatgtaactctgctcttttgagagccattttgaagagcggtcaagaaccttggctataaaattaagcagcttacattggattc

SEQ ID NO: 71642 - DNA, 85 bp, Mus musculus; identical to SEQ ID NO: 57439

SEQ ID NO: 71643 - DNA, 110 bp, Mus musculus
gtacctttggtgaaaattttgtgttggaattaagcaattcttttgatgtatctatttatgtaggcagtgttgttgggaggagtgctaagggcagagtgagacagctggac

SEQ ID NO: 71644 - DNA, 57 bp, Mus musculus
tccagtttagtgtttttgtagtactcctgagtgtgccaacaagggccttcaactgga

SEQ ID NO: 71645 - DNA, 78 bp, Mus musculus
ctgtctctctctctctgtaccagtactacccaattattattactattgctctgtagtatggcttgagattagggatgg

SEQ ID NO: 71646 - DNA, 90 bp, Mus musculus
tatgtatgtatgtatgtgtgtatatgtatatgtgtctgtgtatgtttgtgtgtttgtgtgtatgtatgtatgtatgtatgtatgtgtatg

SEQ ID NO: 71647 - DNA, 69 bp, Mus musculus
ttgcagagcttctagattgattactaaatagaggtacttgtatggtaggtgtctagacaggctttggaa

SEQ ID NO: 71648 - DNA, 75 bp, Mus musculus
atgcagaaatgagtatcacatgtagctgcaaatgaaaatccatcagcctttaaggctatatttttatttctgtat

SEQ ID NO: 71649 - DNA, 99 bp, Mus musculus
tcagcatatatcatatgctatgatatatatctatgatatctatatctatctatctatctatctatctatctatctatctatcatagaagtgtgtgctga

SEQ ID NO: 71650 - DNA, 86 bp, Mus musculus
ctgcctacgagctctaagatagaagtacttggaagtaaagattagttagtttggtcacttcatctcatggccctattgcttggcag

SEQ ID NO: 71651 - DNA, 77 bp, Mus musculus
ggcagagagagggacatgatgaagcttgaatacttgcctttgctgttaaggccagtcatcgattctttctatgtgtc

SEQ ID NO: 71652 - DNA, 119 bp, Mus musculus
tatgggtaagtatcttgagaataataacttgtgttttgtgtatgtgattagacgtgtgtatatatttatatacatacacacatacatactcacacacatatatatacacatatgcatat

SEQ ID NO: 71653 - DNA, 60 bp, Mus musculus
tgtgtgtgagtatgtatgtgtgtatgtatataaatatatacacacgtctaatcacataca

SEQ ID NO: 71654 - DNA, 85 bp, Mus musculus; identical to SEQ ID NO: 57439

SEQ ID NO: 71655 - DNA, 68 bp, Mus musculus
ttccctgcttggtagttcagaatcatttagtatatatgaatctttttgaattggccagcaagaaggaa

SEQ ID NO: 71656 - DNA, 113 bp, Mus musculus
gacaaagctaaaataatgtcagtagggctggagagatggctcagcggttaagagcactgactgctcttccagaggtcctgagttcaattcccagtgaccacatggtggctctc

SEQ ID NO: 71657 - DNA, 87 bp, Mus musculus
atcctgggtttcgaagcagattcttgatttggaagcggagtatttatttctcttttgtgtgagggatcattttgtgtactgtgggat

SEQ ID NO: 71658 - DNA, 95 bp, Mus musculus
actcatggttagactgtgggagaacggtgagcatcagggcacgccctctgagtggctctgtgtcaccggcacccgtgacagtctttccctgttgt

SEQ ID NO: 71659 - DNA, 116 bp, Mus musculus
aatgcttccttcagtcaccatatgcatgccttgagattcattgaagtgcgtggacaagagttctgattatcttggtgcaaaatgcaaaatggattgactgatcgatcccagtcgtt

SEQ ID NO: 71660 - DNA, 60 bp, Mus musculus
tatctatatgtgtgtgtacatatatattcatttgtatatgtgtatatgtatatatgtata

SEQ ID NO: 71661 - DNA, 101 bp, Mus musculus
ggactacagagtaattcacaaggccggcccgggagcttcagaaaaggccgtttgtttatttgctctgtctgtctgtctgtgtggtgctgaggagtcagcct

SEQ ID NO: 71662 - DNA, 76 bp, Mus musculus
ggggccctggactgtatcagagtgaagaaaagtagccgaggactgaccactgtgagcagtcattcctgtgggctct

SEQ ID NO: 71663 - DNA, 117 bp, Mus musculus
ggacccaactggtttgaatggaagtatataaatgagcatgcatgaatctatatatgaatttatgtgagattatgcatatttgcttattaaaagtttttccttctgcaagtgttattc

SEQ ID NO: 71664 - DNA, 84 bp, Mus musculus
cagatgggggggggtgatgtaggaatgtgatttttttttttccttgcctggcttgtttattctcctggggtctctctgtctctg

SEQ ID NO: 71665 - DNA, 118 bp, Mus musculus
atggggatgtctgtctgtctgtctatctccatgtgatctgtattttttttttttcttcctaacacttcatatcttcatgagagtagaaataattagaatcatgattcaactctcccat

SEQ ID NO: 71666 - DNA, 90 bp, Mus musculus
ggggtatatataagtttgttaggggctggagagatggctcagtggttaagcgcactgactgctcttccagaggtcctgagttcaattccc

SEQ ID NO: 71667 - DNA, 70 bp, Mus musculus
ttccagcacttgggaggtagaggcaggcgattttatgagttcgaggcctgagtgactgagtgactgagaa

SEQ ID NO: 71668 - DNA, 63 bp, Mus musculus
gtacatgaattatatatatatatacatatacatatgtatatgtataagtatatgtataagtat

SEQ ID NO: 71669 - DNA, 80 bp, Mus musculus
gcagatttgtttttgttttaatcccaggtgtgggctatggggttgcttccgattgtccacagccgctgactatgatttgc

SEQ ID NO: 71670 - DNA, 104 bp, Mus musculus
tgatgactgctgaggtggatggagcaggtccaggtcccacagagccggttagtaacacagggctcttctgtctctctcacttccagcttcagcaccagtcagca

SEQ ID NO: 71671 - DNA, 119 bp, Mus musculus
tcctggagctcactgtgtagaccaacctggcctcagactcacagagatatgtatctgtctgactgtctcggtctctggatgtggggattaaagctgtgtagcattgctggctccaagga

SEQ ID NO: 71672 - DNA, 71 bp, Mus musculus
gcagaaacagatggtgactcacactttgacaattggaactcttgtgtctgtctgcctgtctgtctgtctgc

SEQ ID NO: 71673 - DNA, 90 bp, Mus musculus
tccaatttatgctaagcacacacacacactgagagacccgtgttgtagcccttggagtcacatgtgtatagagtgttcagtaaacatgga

SEQ ID NO: 71674 - DNA, 87 bp, Mus musculus
aggacagctcagagacctgagtgtgtgcacagctctcctaggctgacaactgcaggcaccaggttccagctctcctccgtgctgtcc

SEQ ID NO: 71675 - DNA, 73 bp, Mus musculus
ggcagagacatgagagagagacctgcctgcactattgtagaagcataggctaccagggccctcctgctttgtc

SEQ ID NO: 71676 - DNA, 75 bp, Mus musculus
gagggtaataagagcctgactgtgtgcacctgtccccatgagatagagtctcactatgtcactctcgttgtcctc

SEQ ID NO: 71677 - DNA, 92 bp, Mus musculus
gtatgtgagaatgtgcaagtatatatgtgaacacatatgagtatatatgtgtgtctctgtgtgtatgtatgtaaatatatgttagcataaac

SEQ ID NO: 71678 - DNA, 75 bp, Mus musculus
tctctctctctctctctctctctctgtcctgagattacttttctacagttcaaagtggaggagacagtcctggga

SEQ ID NO: 71679 - DNA, 81 bp, Mus musculus
caccatcaaccccatgtgtgagtgtatgtgaatgtgcacatgaatgcacacacgcacacattcacacactcatacacagtg

SEQ ID NO: 71680 - DNA, 79 bp, Mus musculus
tttataatggactagcaaagcactgcacagacacacactctcaattagacctgtgtggtttttgtttccagcatatgaa

SEQ ID NO: 71681 - DNA, 126 bp, Mus musculus
tgcaaacctctgagaaccggaaagttcagtgattgcctggcttgccccaggactaaatatcacagggagcttagacctcagcggtgcacttaactttctcccaagtccctttgcaggccacctcac

SEQ ID NO: 71682 - DNA, 82 bp, Mus musculus
atgacgtagtgcagcctctgtagagagtcagctgtgtccagtggtcaccagagtcagcacttgacagaggcggcctcttcat

SEQ ID NO: 71683 - DNA, 71 bp, Mus musculus
tatgtatgtatatatgtatagatacatataaatcttacatatgtatgtgtatatatgtgtatacacacata

SEQ ID NO: 71684 - DNA, 74 bp, Mus musculus
gtgtatgtgtatgtgtatatgtatgtatgtatgtatatatacacacacacatatatatgcacacgcgcacacat

SEQ ID NO: 71685 - DNA, 78 bp, Mus musculus
atatacattattattttttgcttgtatgtgtgcatgtgcatgtatgcattcgagtgtgtgtgtgcacacacacatgca

SEQ ID NO: 71686 - DNA, 112 bp, Mus musculus
tttgactgagtatctggtctgtaattatttatagcctttgaatggggcacagagaggacagtcagggcagaaccctatgtttgacataggataccatgtttccgctgtactc

SEQ ID NO: 71687 - DNA, 60 bp, Mus musculus
tatgtatgtatgtatgtatgcgtgcatgaatttatgcatgcattcatatgtatggacgtg

SEQ ID NO: 71688 - DNA, 167 bp, Mus musculus
ggtgtatgtatatatatgtgtgtgtaatgtgtatgtatatgtgtgtgtctctgtgtgtgtatgatgtatatgtatatgtgtgtgatgtgtatgtatatgtgtgtatctctgtgtgtatgtatatgtgtgtgtgatatgtatatgtgtgtgtgagtgtatatgcagag

SEQ ID NO: 71689 - DNA, 116 bp, Mus musculus
ttgaatgcaggtgctcacagctaaacaagtgattggtgcttctaaagatggcttctctctccgtctttcactctggtccctacatccttggctgccaggccaaactgaacgtttaa

SEQ ID NO: 71690 - DNA, 72 bp, Mus musculus
ggcctatatgttgaaagcatggtcttcaatcaatggcccccattgagaggtagttgattctttagatagggc

SEQ ID NO: 71691 - DNA, 80 bp, Mus musculus
tggaggggagagaaaaggccttctctgagaatctcagtgttagggctcttttaggagagggccttctctgaaaatcttta

SEQ ID NO: 71692 - DNA, 114 bp, Mus musculus
cttgtgtcccatgtatgtacccatgtgtgtgtgcacacatgtatgcatctgtgtgcatgtgcatgtttatgtgtctgtattcgcatgtgtgtgtgcatgtgtggagggcagaag

SEQ ID NO: 71693 - DNA, 116 bp, Mus musculus
ggagggctgcatcgtgttggagctgcagccatgtccatggtggagactggaccacgccttggctctgtctctgcctccgtctgcaaagctgcggtcgtcatacactgcatcccttc

SEQ ID NO: 71694 - DNA, 73 bp, Mus musculus
ctgcatctctgtgtatgtgtctgtgtgtgtatgtgtgcatatgtgactgcatgtgtgtgtacgctgggatgag

SEQ ID NO: 71695 - DNA, 78 bp, Mus musculus
gtgtgtacatgtgtatatgtgtgtatgtgtgtatatgtctgtgtgtatatatgtatatatgtgtatgagtgtgtatat

SEQ ID NO: 71696 - DNA, 99 bp, Mus musculus
tgtagcccaggtgggctttgaacatgtggcagtccctctgactcagcctctcgagtgctggattacactgcaccacacccagatttcaacctgtctaca

SEQ ID NO: 71697 - DNA, 74 bp, Mus musculus
gtgcaaacaccaagtgcatctcatgcccagatcttggttttaagatgtatgtatgtatgtatgtatgtatgtat

SEQ ID NO: 71698 - DNA, 87 bp, Mus musculus
tgtgtgtgtgcatgtgtatgtgcatgtgtgtgtgcatgtgcatccatgtatgtgcatgtgcatccatgtatgtgcacatgtgtgtac

SEQ ID NO: 71699 - DNA, 114 bp, Mus musculus
ccaaagccagggagaacagtggtaagccctctgcagaaccatgtctggtctcaggggacacactctgtctcagccatgacccttgcagcttctggaccatcccccttgcattgg

SEQ ID NO: 71700 - DNA, 81 bp, Mus musculus
accagcttttccctgtctcagtgtctgtgtaccttcctaactacccatcagcacattaggggctcatgcaggagagtgggt

SEQ ID NO: 71701 - DNA, 120 bp, Mus musculus
gtatgtatgtatgtatgtatgtgtgtccgcgtgtgtctggatgcatatgcctgtatgtatgtatgtatgtatgtccgcgtgtgtcgggatgcacatgcctgtatgtatgtatgtatgtat

SEQ ID NO: 71702 - DNA, 76 bp, Mus musculus
gcatgtatgtatgtatgtatgtatgttcacgtgtgtcgggatgcatatgcctgtatgtatgtatgtatgtccatgt

SEQ ID NO: 71703 - DNA, 218 bp, Mus musculus
gtatatatgtatgtatgtccacctgtgtcgggatgcatatgcctgtatgtatgtatgtatgtatgttcacgtgtgtcgggatgcatatgcctgtatgtatgtatgtatgtatgtatgtccgcgtgtgtcgggatgcatatgcctatatgtatgtatgtatgtatgtatgtccacgtgtgtcgggatgcatatgcctatatgtatgtatgtatgtatgt

SEQ ID NO: 71704 - DNA, 62 bp, Mus musculus
tgcatatgtatatctatatgtatatctatgtagatatacatatatatacatacacatatgca

SEQ ID NO: 71705 - DNA, 94 bp, Mus musculus
ggcacttcctcacagcttgtactgattttctaaatctgttccacggtcaataggaaacagcattgttaaattacaggggccagttgggaatgcc

SEQ ID NO: 71706 - DNA, 100 bp, Mus musculus
ttgtatttgtgtatttaggaattctctctctctcaatgaaaaaagaggcaatggcactaaggagaggcttttgggaaggtttgaatggaggaaagggcaa

SEQ ID NO: 71707 - DNA, 111 bp, Mus musculus
cttatgtctaaaaaagaggagatggcagaaaagtgtttaatttatagtctacaactttctggatgtgttctggttaattgtttctgctattgtcactaggtttatgaaagg

SEQ ID NO: 71708 - DNA, 116 bp, Mus musculus
ggcccagaccggaaggaacttgtgtcactggttgaatggagttcctgggtgcctggatcccactggtcccagttacttccagtattgggacagatgttgtgtcctcctcacctctg

SEQ ID NO: 71709 - DNA, 115 bp, Mus musculus
aggtcctgagtagattatattagctctttgcacgagtctttcactgtctgctatacacgagcagacttcctgtgaaaggcatcatctcaaacagtgtgtggctggctgtgttcct

SEQ ID NO: 71710 - DNA, 91 bp, Mus musculus
gggtgaggtgaggtctgatgatttacagttcctatagagagggtacctcccctgccttctttggaaagtaatgttctatccactcccatcc

SEQ ID NO: 71711 - DNA, 111 bp, Mus musculus
tatgtttgtctaagtgtatttgtatgtgtgtatctgttcatgtatgtatgcatgtgtgtgcatatgtgcatgtatgtgtacatatgtgtgtgtgctagaaccaatttcatg

SEQ ID NO: 71712 - DNA, 83 bp, Mus musculus
tgagctacagagagagcagagagagtggagagagccgcaggagcctctcagctctcaggttctgttctttcagagtcagccca

SEQ ID NO: 71713 - DNA, 118 bp, Mus musculus
tatgtgtatatatatacatgtgtatacatgtatatatgtatgtatatacatatatatacacacacatatatgtatgtatatatacacacatatatatttatgtatgtatgtgtgtgtg

SEQ ID NO: 71714 - DNA, 60 bp, Mus musculus
tagagggacagaagacgagtttctgtgctgatgttctgtctctgtctgtctgtctgtctg

SEQ ID NO: 71715 - DNA, 77 bp, Mus musculus
gtgtggatgtggtgtctctcactctctcaaaatgatgcaccatcaatgtgacaaagcaagacgcacagcacctacac

SEQ ID NO: 71716 - DNA, 91 bp, Mus musculus
catgtgtatacatatgtattatatacatgtgtatatattgtatacatggtatacatatatatatatatatatatatatatatatatatatg

SEQ ID NO: 71717 - DNA, 76 bp, Mus musculus
tgtgtgtgtgtgtgtgtgtgtgtgctatacgtgtctcttttgtggctgagcatgacacagtcattcactctctgca

SEQ ID NO: 71718 - DNA, 58 bp, Mus musculus
gctgagaatacagcccagagccctacacaagctaggtgggttctctctctctctcagc

SEQ ID NO: 71719 - DNA, 91 bp, Mus musculus
gcccagcctggagtggtgctgtatcctgctaattcactacctaggaatcagagagcagggtgaggttgatctttgtgaactccaggtcagc

SEQ ID NO: 71720 - DNA, 67 bp, Mus musculus
ttgcttttgagacagtgtctcactctgtagcccaggcgagttttgagacagtgtctcactctgtagc

SEQ ID NO: 71721 - DNA, 109 bp, Mus musculus
tattagtgcagctaagaataaaggatatattgaatgagagtagagaaagtggacaccttgtcgtactcttggctctagtcaaaatgctctaagtttctttccacttgtg

SEQ ID NO: 71722 - DNA, 57 bp, Mus musculus
gatttctgagcaccttctctgcaagaggagagcctgtctgcagagagtgttctgatc

SEQ ID NO: 71723 - DNA, 68 bp, Mus musculus
tctctctctctctgtgggttgaggcatggagtcctaatgtgtgaggctttccttggagtgggagatga

SEQ ID NO: 71724 - DNA, 87 bp, Mus musculus
catctgtttgagacaggctctctctatgtagttctatttttcctggaacttgataatcacgtagaccaggctggcctcaaactggtg

SEQ ID NO: 71725 - DNA, 88 bp, Mus musculus
gtatacatatatgtatatatgtatgtctatgtatgtctatatatgtgtacatatatatgtatgtatatgtatattatgatataataga

SEQ ID NO: 71726 - DNA, 81 bp, Mus musculus
ggaggcttctgtcatggggtcactctggcaaattcttactccggattagtctgccttgcctgaccctctgtctgtccctcc

SEQ ID NO: 71727 - DNA, 118 bp, Mus musculus
aatgtttaaaataagataagacagccagagctgtcccatgtgtcataattattcttgaatattaaaataagatgcaaatgtctaagatctggccattgtttatgtctttcctctcatt

SEQ ID NO: 71728 - DNA, 73 bp, Mus musculus
cagtcaggccgcaggctcttctccctctgttgtgtctcctgacacagaaggctgtgaagagagcaccctagtg

SEQ ID NO: 71729 - DNA, 81 bp, Mus musculus
tcctatcccagagtcttcactgcacagtgccctctacagaggtgctggcctgtgccacagtcccactctgggcctctgggg

SEQ ID NO: 71730 - DNA, 78 bp, Mus musculus
tatatatatacatatacatagctaacatggctgagaatttgtagatctcattcgtgtatatgtatatgtatatgtata

SEQ ID NO: 71731 - DNA, 112 bp, Mus musculus
aaatgctggggtgtactgaaagtggtgacttggtgaagtggagagatggggttgccccctgtctgcctctctgtctttgctgcccgattattttcttcttttccctgtattt

SEQ ID NO: 71732 - DNA, 66 bp, Mus musculus
gtaaggtggcgttacaatctttctttttttgaagaaagaaactgaaaagcctaagaagagccttgc

SEQ ID NO: 71733 - DNA, 88 bp, Mus musculus
tgtcttcgttgcttctggaagtgaaaagtgaccaaatgaacaatgttatcaggggtcacattcacactcacagtaggcatcggggagg

SEQ ID NO: 71734 - DNA, 106 bp, Mus musculus
cctcactgctttaatgttctgtctttagttagtgaatttgttgttctgattattatgtgtcgggaggaatttcttttctggtccagtctatttgaagttctgtagg

SEQ ID NO: 71735 - DNA, 74 bp, Mus musculus
atagacacatccatacagaagaggttgcaaaatcccatgtcaggatctgtctctctgtctgtctgtctgtctgt

SEQ ID NO: 71736 - DNA, 119 bp, Mus musculus
tatgtatatgtggggatgtatataattatatatatatatgtatgtatatatatgcatatgtgtatatacatatatacatacacacatgtatgtgtatatgtatatgtatatgtatatgt

SEQ ID NO: 71737 - DNA, 117 bp, Mus musculus
tttttttcgcattataaaaaaattaaggggctggtgagatggctaagcggttaagagtactgactgctcttccagaggtcatgagttcaaattaatttggaaggcttgaggaggaag

SEQ ID NO: 71738 - DNA, 118 bp, Mus musculus
gtccccagaagggagctggcatggcagtgttacaggagcagagtctgaagagagtgtggttttcgcagcgcctccatgttgcccacctccctggcctcactggggctctgccaagtga

SEQ ID NO: 71739 - DNA, 89 bp, Mus musculus
ggaggacatgaacacacacgatgagcacgggggctcctcagcattgggcgttaagatggcttcctgtctgtctgtctgtctgtctgtct

SEQ ID NO: 71740 - DNA, 74 bp, Mus musculus
atgtgtgtgtgtatatatatatgtatgtagatatatatacacatatatatatctacatacacacacacacacat

SEQ ID NO: 71741 - DNA, 78 bp, Mus musculus
ggtccaggaaggagcctggcgtctcttacctagtgctgctgacagagagaagagagtctcctgcttcccaaatgttcc

SEQ ID NO: 71742 - DNA, 90 bp, Mus musculus
gtgtgtccacttgtgcaggcatcagagaaggacattgggtattttcctctgttgctgtctgtctcattctatttaggtggagtctctcac

SEQ ID NO: 71743 - DNA, 75 bp, Mus musculus
gtgtgtatatgtatatacatacatatatacacatacatatatacatgtgtgtatatgtatatacatatatatata

SEQ ID NO: 71744 - DNA, 116 bp, Mus musculus
tatatatatatgtatatacatatacacacatgtatatatgtatgtgtatatatgtatgtatatacatatacacacctgtatatatgtatgtgtatatatatatgtatgtatatata

SEQ ID NO: 71745 - DNA, 71 bp, Mus musculus
gaggaagtgtgtcactggggttgggctttggggttctcagtgctccagccagactctgtgtctctctcttc

SEQ ID NO: 71746 - DNA, 80 bp, Mus musculus
gtggatgccagattcatcaaagcaccagtgggtcactgtcactgtcactgtcactctggctttgaagagttttcgtttgt

SEQ ID NO: 71747 - DNA, 157 bp, Mus musculus
ggatgagcagacagtgctcttaaccattgagccatctctccagcccctatgatttattttcttttcattatgttaatgtatgtgtctctgtgtgtgagagcaaatgtccagcaagtccagaaaaggtctttggataccctggaaatatagttacaca

SEQ ID NO: 71748 - DNA, 116 bp, Mus musculus
gtcagttcatgccagctcgggctacataggatgaccctgtctgtctcactctctaagaaggggaggaggcaaggctctatctctggaggtggctggtgtcaggatggaaaagggat

SEQ ID NO: 71749 - DNA, 105 bp, Mus musculus
cagagctcttttcattgagagcctgctgcctgcctggctgtttcagtctcctttgtggagcctgggggactgtgaaagatggcaggaaagctttaggctcctctg

SEQ ID NO: 71750 - DNA, 164 bp, Mus musculus
atatgtgtgtatgtgtatatgtgtatgtaaatatgtatatatgtgtatatgcatatatgcttatatgtgtatatgtatatatgtatacatgtatgtatatatgtatgtatatgtgtatatatgtatctgtgtatatgcttatatgtgtatatgtatatatgtac

SEQ ID NO: 71751 - DNA, 94 bp, Mus musculus
gtctgtgtctatgtctgtctgtctgtctctccttccatgttggaaaggaccacataccaaggaactaagatagcttgcgagcagtatctcatac

SEQ ID NO: 71752 - DNA, 110 bp, Mus musculus
gaatctcaaagatggacatggaaggtggggtggtgctggggtgggtggggaggccactgagtctctgtttctctttccaggcagctacactgaacacatctctgtttttc

SEQ ID NO: 71753 - DNA, 82 bp, Mus musculus
tcactgtccgcacttggtgtgtgtctgcaacagcatgtggcctttgtctagcttttcagagttttgcccggggtgggcggga

SEQ ID NO: 71754 - DNA, 98 bp, Mus musculus
gaagcagctggggtctggagagatggctcagcggttaagagcactgactgctcttccataggtcctgagttcaattcccagcaaccacatagtgattc

SEQ ID NO: 71755 - DNA, 88 bp, Mus musculus
gctagggagatgtatcagtgggtgacattgcttgatgcacaatccacaggacatcaagcataacagcatcagcatctgcaatcccagt

SEQ ID NO: 71756 - DNA, 113 bp, Mus musculus
cactaaaagttcaataaagctaagtacacccatctcagtatctgcatctgcttgtcttagacatcagaaggctgaggcaggagagggagtgctaggctggccagggttttgtg

SEQ ID NO: 71757 - DNA, 71 bp, Mus musculus
gcatttggaggcaagaggcaggtttagagctgcaactttgagagtctgtctgtctgcctgcctgcatatgc

SEQ ID NO: 71758 - DNA, 81 bp, Mus musculus
gagtttggttccaggggcctggagggatggctcagcggttaagaacactgactgctcttccagaggtcctgagttcaattc

SEQ ID NO: 71759 - DNA, 81 bp, Mus musculus
gcaggggaaagtcaggtctcactgagaaagtgacaagaattccaaggaaggctgtatgtctgtctctctgtgtgtccctgt

SEQ ID NO: 71760 - DNA, 68 bp, Mus musculus
tgccaggaaagagcttggtgaggtctgtttatgcaaatttatgtctgtccaactctctgtctctggta

SEQ ID NO: 71761 - DNA, 113 bp, Mus musculus
ggcatgattgggttatctcttgcccacctgcagacagcataagggattttgagtggtttcttctctgttttcatgcgggagcccaaggaagtacaatcagccaagtgttccct

SEQ ID NO: 71762 - DNA, 85 bp, Mus musculus; identical to SEQ ID NO: 57439

SEQ ID NO: 71763 - DNA, 89 bp, Mus musculus
ctcagctctttgctctgtctgtctctgcctgacacatttagttctatatctcaattgtgctggaaagagagagtgcagtggggtctggg

SEQ ID NO: 71764 - DNA, 121 bp, Mus musculus
ggctattgatatatatatatatatatatatgtgtgtgtgtgtgtgtgtgtgtgtgtgtgtatgcccttgtcatatgtatgtatatgtatatatgtatgtatatatgtatatgcatatatat

SEQ ID NO: 71765 - DNA, 85 bp, Mus musculus; identical to SEQ ID NO: 57470

SEQ ID NO: 71766 - DNA, 84 bp, Mus musculus
ccgccagaggagaggcgtctgcgcaaagggctctgaccaccagagcaggtgagagagctatcttgtgtcccatgtcccttgagg

SEQ ID NO: 71767 - DNA, 105 bp, Mus musculus
gccagtcttgtttctctggtatgtttatcatgtttatatctatttgtgtacatctttggtggtggactccaattcttgttaatgtgcatccagtaagtctgaggc

SEQ ID NO: 71768 - DNA, 74 bp, Mus musculus
ggctgaagagatgactcagcggttaagagcactgactgctcttccaaagatccttagttcaaatcccagcagcc

SEQ ID NO: 71769 - DNA, 78 bp, Mus musculus
tgctgctgtctgtctgtgtgcgtgtgagggatttactagaaatgctggcctggcaacaacacagatacattatccgca

SEQ ID NO: 71770 - DNA, 85 bp, Mus musculus; identical to SEQ ID NO: 59761

SEQ ID NO: 71771 - DNA, 84 bp, Mus musculus
atatgatgaacatatacttatatgcatgtatatacatatgtgtgtatatatatatgtgtgtgtgtgtatatatatatatcatat

SEQ ID NO: 71772 - DNA, 85 bp, Mus musculus; identical to SEQ ID NO: 57470

SEQ ID NO: 71773 - DNA, 112 bp, Mus musculus
tagtgtctgggcttggtgattgtatatggggtggatgctcagttgtgtcagtctctggatggtcattccttcagtctctgcttcacactttgtctgtgtaactccttccatg

SEQ ID NO: 71774 - DNA, 87 bp, Mus musculus
acacacacacactcacttccttcagctatatatatatatatatatatatatatatatatatagctgaaggaagtgaatggttaatgt

SEQ ID NO: 71775 - DNA, 84 bp, Mus musculus
tatgcatatgtgtatatatgtgtatgtatatgtatatatgtgtatgtatatatgtgtatgtatatgtatgtatgtatatgtatg

SEQ ID NO: 71776 - DNA, 85 bp, Mus musculus; identical to SEQ ID NO: 57470

SEQ ID NO: 71777 - DNA, 101 bp, Mus musculus
gttaacccagtcccagtaagatgataaggtagttggaagtagagtagtatcaggtggactcttcaatggtttcataacctgcaaaacaattggaggttaac

SEQ ID NO: 71778 - DNA, 116 bp, Mus musculus
atgtctgtcaagttgtactgtattatgcaggcaaaactggaatgctcagaatatttatttctatttcatgacattactactgtgtgcttatgatttcagtattattttaagggcat

SEQ ID NO: 71779 - DNA, 115 bp, Mus musculus
agaatcacaggatcattttgatttgcattttctgatgatttaggatgttgaatgtttctttaagtgcttctgggtcattggagattactttgttgataattctctgtttagctct

SEQ ID NO: 71780 - DNA, 86 bp, Mus musculus
tcttgccaactgagtatctctagtgctacctgccctcagtgtctgtgactgaaacctgtctctcttgtgatactcgttgtgtcaga

SEQ ID NO: 71781 - DNA, 93 bp, Mus musculus
tctatgtgtgtgtgtgtgtgtatatgtatatatatatatatatatatatatatatatatatatatatatatatatatatatatgtatatgaga

SEQ ID NO: 71782 - DNA, 95 bp, Mus musculus
tgattaaagtgagttctttaactttattttgtgcatatatatatatatatatatatatatatatatatatcacttagagaaacgacatgtaatca

SEQ ID NO: 71783 - DNA, 117 bp, Mus musculus
ggttatatagcttgttgtacttatgagatttctagcattgggagcagggactgtctgtgtgtctttttcctgtattctggatagtcttgttcagcactgattcgagaatatgtgtct

SEQ ID NO: 71784 - DNA, 78 bp, Mus musculus
gtctgtggctcactctatgtgtgataaaaaaaaaacactcagtgtctttgttttcatcatttgtgctgtgacataggc

SEQ ID NO: 71785 - DNA, 131 bp, Mus musculus
gtatatgtatatgtatatgtatatgtataatgtatattgtatatgtatatgtaatatgtatattgtatatgtatatgtatatgtatatgaatcgcatgtatatgtatatgtatatgatgtatatgtattat

SEQ ID NO: 71786 - DNA, 85 bp, Mus musculus; identical to SEQ ID NO: 63114

SEQ ID NO: 71787 - DNA, 98 bp, Mus musculus
gtcagagcaaacaccatggcagtcagtgtcagtgactgagtaattactcaataattctgctattgttggctagggaaatgtggtgactttgctattga

SEQ ID NO: 71788 - DNA, 89 bp, Mus musculus
gcaggcatttataggcatctcattgtatgctgattatttttttatgagtgagaaaagctactgtcttgacatacctgtgagccaccagc

SEQ ID NO: 71789 - DNA, 107 bp, Mus musculus
ggctgatatagtgtgacaaaaatagttttccaattttgacattatgtttatttcttaatgagcattctgaatgtgagctacacttcacatttcttatagattttgcc

SEQ ID NO: 71790 - DNA, 85 bp, Mus musculus; identical to SEQ ID NO: 57439

SEQ ID NO: 71791 - DNA, 98 bp, Mus musculus
gcacaaaagtagtatagctcagtcatattgaagatttgcttcaagttcctcaaggaatattcttattgattttcatagtgactgtgccaatttgtgct

SEQ ID NO: 71792 - DNA, 85 bp, Mus musculus; identical to SEQ ID NO: 57439

SEQ ID NO: 71793 - DNA, 74 bp, Mus musculus
ggttctgtgagactgatcacagtgagtgtgcttccagcccatgtcacactgggactgtgtgtcagcatagaatc

SEQ ID NO: 71794 - DNA, 118 bp, Mus musculus
ctgcaagctacagtaataactggtattcaatggttcagtttgtgctcatggtacctgtatgacacagatgatacagaggagtccaaccactgtgtgattagatttaagttcccctgta

SEQ ID NO: 71795 - DNA, 110 bp, Mus musculus
ttcttaaatttaaccttaaatgaaattaatgcatgaagattttatatatatgcatatatatatatatgcatatgcatatattcctgtatgagtagcatgttggaaaagag

SEQ ID NO: 71796 - DNA, 111 bp, Mus musculus
tgttcttgaagatagtgcttttcttagaaactcttggacactctagattgtgagcacagacactcataaattcttgtccaaagaaggaaatttttctattggtcaaggtca

SEQ ID NO: 71797 - DNA, 83 bp, Mus musculus
tatatgtacatgtgtatataagtatataagtagataatgtacacgattctatatgtatatatatatgtgtgtgtgtatatgta

SEQ ID NO: 71798 - DNA, 111 bp, Mus musculus
gtgtacttgtgtacatgtgtatacatgtaatgtgtgtatatatatatatatttatatgtatatatatgtttatgcatttgtatatgtatgcataaattcatatatgtatat

SEQ ID NO: 71799 - DNA, 118 bp, Mus musculus
tgagggtcaggaaatgtaacctttagaatattgacttattttggacaaccgttgcaagtatagagggcaatgttgtcagttaatacctagagatttacatgatagttaggcattctca

SEQ ID NO: 71800 - DNA, 85 bp, Mus musculus; identical to SEQ ID NO: 57439

SEQ ID NO: 71801 - DNA, 90 bp, Mus musculus
tatatattgaatattagtgtgcatatatatatgtttatgtatcaagtttgatatatatgcagttatatatacatatataacatatatgta

SEQ ID NO: 71802 - DNA, 80 bp, Mus musculus
ttagggtaatggatggaataagtacttatgtgcattcttgcatgcacatatatttttgttttagtacagtaaatacttga

SEQ ID NO: 71803 - DNA, 100 bp, Mus musculus
cattatgaattataggttcagagtagtgtgtgtgttcatgtgtgtatatttgtgccatataattattttactactctgtaaatgtgacgttttcattgtg

SEQ ID NO: 71804 - DNA, 85 bp, Mus musculus; identical to SEQ ID NO: 57470

SEQ ID NO: 71805 - DNA, 69 bp, Mus musculus
gtgcaaattcagaggtccacagagatgagctacagagagagctatctgtggcactgtctgacagtgtgc

SEQ ID NO: 71806 - DNA, 116 bp, Mus musculus
gctgtgagaaagatactgtttccctactgcaagatctcgataacagttctttgtaactttttattctatgagcttaatgtcagatatagcatttattggtaatagtttcacaatgc

SEQ ID NO: 71807 - DNA, 120 bp, Mus musculus
gtgtttatattatgttaggttatagaggatatatatatatatatatatatatatatatatatatatacatatatatatatatacatatatatatcttatcatgaaacaaatataaatata

SEQ ID NO: 71808 - DNA, 85 bp, Mus musculus; identical to SEQ ID NO: 57439

SEQ ID NO: 71809 - DNA, 85 bp, Mus musculus; identical to SEQ ID NO: 57439

SEQ ID NO: 71810 - DNA, 103 bp, Mus musculus
agcttttaatattctatctgtatttgatgaatttgttgttctgattattatgtgtcagggggaatttcttttctggtccagtctatttggagttttttaggct

SEQ ID NO: 71811 - DNA, 81 bp, Mus musculus
agaagtcatgggaaagacctagctgatagtgtaaccagaaaaactgtgactctctctgagagcattttcccaaaggcatct

SEQ ID NO: 71812 - DNA, 85 bp, Mus musculus
gaccatggtggtctgataggatacatgggacaatttcaatatttttgtatctgttaaggcctgttttgtgaccaattatatggtc

SEQ ID NO: 71813 - DNA, 112 bp, Mus musculus
aagagccccatgaaatccagatggagagaattgatggagacaagccatttaagctggtgagtttcacagtctctcactccctacacaattgtctgtctgtgggtctgttttt

SEQ ID NO: 71814 - DNA, 113 bp, Mus musculus
ggaaaactcacataattctgaaaatttatttgaactgataattatatatttttcctaggagatttggaatatcagttcccttttgaaatgaataatttggggctatattttcc

SEQ ID NO: 71815 - DNA, 116 bp, Mus musculus
tagacttttgagtgcaaaaacataacttaccactgcatttcttcactgtatttgattatattattcaggtatttatagatgtatagtcatagttagacttgctgaatagaagacta

SEQ ID NO: 71816 - DNA, 85 bp, Mus musculus; identical to SEQ ID NO: 57439

SEQ ID NO: 71817 - DNA, 63 bp, Mus musculus
cccattcaacttgttttttaatatttgcatatgtccatgtgtgagtacagagatgagtgaggg

SEQ ID NO: 71818 - DNA, 78 bp, Mus musculus
atgctaattaaaccttattgagagttcctggggccacactggccagggaataaattttactttgttttagtatggcat

SEQ ID NO: 71819 - DNA, 98 bp, Mus musculus
tgttaccataagcatgtatgtatgtatgtaaacacatatatgtatgtatgtatgtatgtatgtatgtaaacacatacatgtgtgtatgtatgtaaaca

SEQ ID NO: 71820 - DNA, 97 bp, Mus musculus
gggtaggcctgtggctagcatggtggtcctcatatctctctctgtcttcttaccccacgatggcaggtagagaggactctgtgtgtctatggctctc

SEQ ID NO: 71821 - DNA, 56 bp, Mus musculus
tgaatttttgcacacatatgtgtgtgcatgcacacatgagtgtgtgcacagattca

SEQ ID NO: 71822 - DNA, 99 bp, Mus musculus
tttgtgaagaaaaacacatgatgtggtaggttgtttagattgtgtacttataagtagcgtataagaaagccttacagaatgtttctgtttctttacagg

SEQ ID NO: 71823 - DNA, 103 bp, Mus musculus
tgtctgtgtggtatatcattatatatatgtgtatgtgtgtcgtaatgttatatacgttattatattacataatattttatattatatatattattcaatgaca

SEQ ID NO: 71824 - DNA, 82 bp, Mus musculus
tatgcaacagaatgatttgacatccattctgttaatctatatctttttattgtggaattgatgttggttgtactggtgtgtg

SEQ ID NO: 71825 - DNA, 113 bp, Mus musculus
attcatttgatagtacgtttttaaggagcattgctaaaatcattagaatcaaaactactttcttttttgtaagccagtgctacaaaccttaggcatcactgtaatagatgagt

SEQ ID NO: 71826 - DNA, 117 bp, Mus musculus
cagtattttcaccaggagacaaaaataatcagtgtatacacattatacatgtttgtatatattatgcaagtgtaaattgtaagtgtagttggttatgtgttatctgtccacagtctg

SEQ ID NO: 71827 - DNA, 115 bp, Mus musculus
tcgagttccagcctttgttgtctgagcagtcaatgaactgatttatttgcagagagatgactcagtgcttatgaattgtatttccatccctgttcatttttgtctggtgagtcgg

SEQ ID NO: 71828 - DNA, 76 bp, Mus musculus
gcaggtcccaggcagatgacaggtcctattccttcctgcaaaggaaaaaatatctctcagtctctgtctgacctgt

SEQ ID NO: 71829 - DNA, 149 bp, Mus musculus
tatatgcacatatcctctgcctccccctcacatatatatatatgtgtgtgtgtgtgtgtgtgtgtgtgtgtgtgcatgtatatatgtgtgtaagagtatatgtatatacatatatgtgtgtgtatatgtatgtgtatatatacatattt

SEQ ID NO: 71830 - DNA, 85 bp, Mus musculus; identical to SEQ ID NO: 57439

SEQ ID NO: 71831 - DNA, 80 bp, Mus musculus
ttgcatgtgctggaaaagcattggactgctgatcagaaccgagggctcccatttgcttcacacagactctcactatgcag

SEQ ID NO: 71832 - DNA, 110 bp, Mus musculus
gcatggaacgtgcttgatcaactgattacatatcacagaagccctgattatctgtatttcttcttcaaatgtgttttatgttagtgagacagcaccagccgaatttatgc

SEQ ID NO: 71833 - DNA, 81 bp, Mus musculus
ctgatttatttgtatatattcttgggaggagctggggttgagcacagctacagctttccaacaatgcagtaaatattttag

SEQ ID NO: 71834 - DNA, 96 bp, Mus musculus
gatcagccttagtccatggttgtctgataggatgcatggtacaatttcaatatatttgtatctgttgaggcctgttttgtgaccaattatatggtc

SEQ ID NO: 71835 - DNA, 112 bp, Mus musculus
aatgagaattttctgtcatatatatatatatgtatatatatatatatgcataactatctagaaacatttacatatatatgtatatatgcatactgtagcattggacctcatt

SEQ ID NO: 71836 - DNA, 57 bp, Mus musculus
tttatgaacagtctctctctggctctctgtaagtgagctagattggctgtctgtgag

SEQ ID NO: 71837 - DNA, 82 bp, Mus musculus
aaacatgatataagggcagtgcctgtcttgggttttttttttttaatactacgatgatcagtgcctgtctttgtcagtgttt

SEQ ID NO: 71838 - DNA, 85 bp, Mus musculus; identical to SEQ ID NO: 57470

SEQ ID NO: 71839 - DNA, 99 bp, Mus musculus
ttgtggatgccaacaagtgcttgctgacaggagcctgatatagctgtctcttgagaggctctgtcagtgcctgacaaatacagaagtggatgttcacag

SEQ ID NO: 71840 - DNA, 77 bp, Mus musculus
cttctgtggtattccattgaggcaggcctttgaaataacattcactggaataatcagtggatttaccatgatggaag

SEQ ID NO: 71841 - DNA, 76 bp, Mus musculus
atacatacacacacacatacacacacacgtatgtatgtatgtatgtatgtatgtatgtatgtatgtatgtatgtat

SEQ ID NO: 71842 - DNA, 94 bp, Mus musculus
gcatgtaattttagaactcttctctgtgacactctgtatttgatcctaccaactgcagctcacagttacatcactcatctggaacattgcatgt

SEQ ID NO: 71843 - DNA, 71 bp, Mus musculus
ctggtctttctgactctgactgtggcttgtccttcctgcaagcctgtatgtcagcatttgtgggagaccag

SEQ ID NO: 71844 - DNA, 102 bp, Mus musculus
aagtagatggctaataaatcattcacaaatgaacttacatgtgatttactagaaatgttttagtcatcacataaaagtttttgtgctagtttaatgcaactt

SEQ ID NO: 71845 - DNA, 62 bp, Mus musculus
ctgtgtatgggtgtttggcatgcatatatatgtatatatatgtctgtgtactctgtgcatgg

SEQ ID NO: 71846 - DNA, 85 bp, Mus musculus; identical to SEQ ID NO: 60991

SEQ ID NO: 71847 - DNA, 116 bp, Mus musculus
ttgagaagtcttaatcttgttaaaggcttacactctcataatttgattgttgattctttcattatataacatgcaacatatgaagcatgccatgtgcaggagactgagtttttcaa

SEQ ID NO: 71848 - DNA, 106 bp, Mus musculus
gtgatatcattatctcataggtttcccctgatttctgtgtcactgtccccacataccacaaatgacaggtacttgtgaataagcttgatttggtaaagtatatcat

SEQ ID NO: 71849 - DNA, 56 bp, Mus musculus
gtatgtacatatgtatgcatgtatgcatgtatgcatgtatgtaaatatgtatgtat

SEQ ID NO: 71850 - DNA, 87 bp, Mus musculus
ttgggcttggtgatatgtaaagaagtttttaataggagtgatttagctatgttgtgatcttttttttcatttccatatgaagctcaa

SEQ ID NO: 71851 - DNA, 62 bp, Mus musculus
ggcataatcatctgataaagttgttgtgattggagaacgactagctagatgacagatatgcc

SEQ ID NO: 71852 - DNA, 90 bp, Mus musculus
agttttctgatcaccaaggactttgaacatttctttgggtgcttctcagccatccgagattcctctgttctgaattcttggtttagttct

SEQ ID NO: 71853 - DNA, 103 bp, Mus musculus
gtgtctttgtgggatggtgaaatatcttttgggtatttatccaggagtagatcttgaggtagaagtatgcatagttttctgaaaaacccccacatggattttc

SEQ ID NO: 71854 - DNA, 135 bp, Mus musculus
catattaatgtatatatacacatatatgtgcatgttgtttctatatatgtatacatgtgtatatatgtgtatgcatatatgtatatatacatatatatgaacaacagaaatgtgtgtatatatacacatatatgt

SEQ ID NO: 71855 - DNA, 117 bp, Mus musculus
agcactggtagtgcgtgcctctaatctcagcattggacaggcagagacaggcagagacaggcagagacaagcagatcaatgtgaattggaggccagctagtctacataacaagttct

SEQ ID NO: 71856 - DNA, 109 bp, Mus musculus
gtgtatgtgcatgtgcatgtgtctatgtatatataattatatatatataatatatatatatatatatatgtacatatacatacatacatacatacatacatacatacac

SEQ ID NO: 71857 - DNA, 93 bp, Mus musculus
tgtatgtatgtatgtatgtatgtatatgtacatatatatatatatatatattatatatatataattatatatacatagacacatgcacatgca

SEQ ID NO: 71858 - DNA, 101 bp, Mus musculus
gttgtctagattattcaattatattggaaatagtatgtttaaagttttgccaatgatctactttttaactatctcaatatgattaagagttctatgacaat

SEQ ID NO: 71859 - DNA, 106 bp, Mus musculus
ccctgctgcataagatgcagagtgttggagaaacagagcagacagagaccaccaagagaacaaggctgcctgaaacaactatgcaaaacttatatgattcctaggg

SEQ ID NO: 71860 - DNA, 69 bp, Mus musculus
tccatggggtcctcatttacagtggagtgttctaacatttctcactctctgtctgatgttacctgtgga

SEQ ID NO: 71861 - DNA, 64 bp, Mus musculus
tatatacatatatatatatacgtgtatgtatatgtatgtatatgtgtatgtatatgtgtatgtg

SEQ ID NO: 71862 - DNA, 66 bp, Mus musculus
tttcaggacatgagaagagagtgagctctatagaattgctgtggggacactagtctcattttgggg

SEQ ID NO: 71863 - DNA, 88 bp, Mus musculus
tttcttgattcacactgatttggttttggtatggaaaaattctcttgtttgaattttaatatatcttagcaactgtgaataaatgaaa

SEQ ID NO: 71864 - DNA, 112 bp, Mus musculus
gatatactttctcttcctgtccatagctgaactaactaatgttctcattttgttcttatcaggtccaaaggacaccccatttttcaactgtgtacaggacaaagagtctatc

SEQ ID NO: 71865 - DNA, 112 bp, Mus musculus
atatgtatgtgtgtgtatatatatgatatatgtgtgtatgtgtgtatatgtatatataatgtatatatatatatatatatatatgtgtgtgtgtgtgtgtgtgtgtgtgtgt

SEQ ID NO: 71866 - DNA, 75 bp, Mus musculus
gcactcactgtctctgactggagtctgttcctcctgttatcttggttgggtcagaactccttagagtccagttgt

SEQ ID NO: 71867 - DNA, 89 bp, Mus musculus
caactgagcatctagtctttatatataattgtcaaatggataaattaaaccaattctttgactttaatataaggacaatgttttttgtt

SEQ ID NO: 71868 - DNA, 66 bp, Mus musculus
ttatgaatgtgtgtgtgcatgttcatgtgtgtacctacaggttgatgtgtgcatgcttgtttgtga

SEQ ID NO: 71869 - DNA, 80 bp, Mus musculus
atgcataagtatacatgtataatatacacccatgtgacacatatatgtttgattatatacatatgtatacatgtatgcat

SEQ ID NO: 71870 - DNA, 90 bp, Mus musculus
tacactatatatacatatatatgtataaacacatatatacatatatatgtatatgtatgtatatatgtgtgtgtatatgtatgtatatat

SEQ ID NO: 71871 - DNA, 95 bp, Mus musculus
ttccttcatctatattctagataaaatattaaagcatgttaaggaaattttggaatttgcttgattactttagtttcataagttaggagagggag

SEQ ID NO: 71872 - DNA, 80 bp, Mus musculus
gcggagtgcgcggcgaccagggcgaaccggcgactgcacccgcgcggcgctcgctcgctcgctcgctcgctcgctcctgc

SEQ ID NO: 71873 - DNA, 64 bp, Mus musculus
tttcagtatgtatatgtttgtgtatatatgtgtacatatgtccatttctgtatgcatacagaag

SEQ ID NO: 71874 - DNA, 109 bp, Mus musculus
tacatatatatatgtatatgtatgtgagtatatatatatatatatatatatatatatatatgtatatatatatatatatatatatatatacacacatatgtatatatgt

SEQ ID NO: 71875 - DNA, 106 bp, Mus musculus
ataaattgaacttctggaggactattatcttttaaagcttataaaagcatatatatatatatatgtcagtatatatttaaagctatgttgtacagattcaatatat

SEQ ID NO: 71876 - DNA, 69 bp, Mus musculus
gcatatgtgtgtgtctctgtgtgtgctcacatgtgcacatgtgtgagggggtgttgcacacttgtgtgt

SEQ ID NO: 71877 - DNA, 85 bp, Mus musculus
ggccatggtggtctgataggatacatgtgacaatttcaatatttttgaatctgttgaggcctgttttgtgaccaattatatggtc

SEQ ID NO: 71878 - DNA, 84 bp, Mus musculus
gtatatgtgtgtatatgtatatatcataaatattatatatgtactcttgtatatataagtatatatgtgtgtgcatacaaatat

SEQ ID NO: 71879 - DNA, 90 bp, Mus musculus
tgcaaacatactatctggtaacccaattaagcatattgtttgaaaaatgatttggctgggtgataacataaacaagcagataatgttgca

SEQ ID NO: 71880 - DNA, 84 bp, Mus musculus
gggagtggtagtggacaggggcagtctgaggtctttgggactcacagaagtcagagataacaggttttctgtctcagatatccc

SEQ ID NO: 71881 - DNA, 106 bp, Mus musculus
gccttagtgcatggtgatctgataggatgcatgggacaatttcaatatttttgtatatgttgacgattgttttgtgaccaattatgtggtcaattttggagaaggt

SEQ ID NO: 71882 - DNA, 66 bp, Mus musculus
atgtatatatgaatgatatgatatatatatgtatatgtgtatatacatatatatacatatatacat

SEQ ID NO: 71883 - DNA, 85 bp, Mus musculus; identical to SEQ ID NO: 57470

SEQ ID NO: 71884 - DNA, 85 bp, Mus musculus; identical to SEQ ID NO: 57470

SEQ ID NO: 71885 - DNA, 85 bp, Mus musculus; identical to SEQ ID NO: 57470

SEQ ID NO: 71886 - DNA, 108 bp, Mus musculus
gccatctgtccaacccttcattcccatttatgctaaagaaatctcagatatcgtcttacatacaacttttattttgtttttcttgtaatagggaagaccagagatggc

SEQ ID NO: 71887 - DNA, 109 bp, Mus musculus
tatatgtatacgtatacgtatacgtatacgtatacgtatacgtatacgtatacgtatacgtatatgtatatgtatattatatgtatatgtatatgtatatgtatatgta

SEQ ID NO: 71888 - DNA, 118 bp, Mus musculus
attggtgacacaagagaatcagaaactgaacactggtataaagccacagaagtctgtctctctctctgccattggtggccacgtggtcctgggaaggaacaggcactttcctgaggct

SEQ ID NO: 71889 - DNA, 109 bp, Mus musculus
gttgagatctttgttcctttcggacttgagttttgggcaaataaatatgaatttatttccattttctgcatccagagctcaagttagaccagcaacattggttgaagat

SEQ ID NO: 71890 - DNA, 89 bp, Mus musculus
gcagaagactcaacacagaagcatgcaggctccgtgattgccacttcagtctctgggagcacctatgagtcctgtttagttgattctgt

SEQ ID NO: 71891 - DNA, 97 bp, Mus musculus
tgtgactcaatggtaactgtgaaatagcacatttaagacaggtctctcaaaacactgaggagagagtgcccaacacagtctataatagtttatcaca

SEQ ID NO: 71892 - DNA, 84 bp, Mus musculus
catgggacaatttcaatatttttgtatctgttgaggcctgttttgtggccaattatatggtcgattttggagaaggttcccgtg

SEQ ID NO: 71893 - DNA, 72 bp, Mus musculus
cattcatatatatatatgcatgtgtatatatatgtgtatgtgtatatatatatgtatgtgtatatgtgtgtg

SEQ ID NO: 71894 - DNA, 85 bp, Mus musculus; identical to SEQ ID NO: 57470

SEQ ID NO: 71895 - DNA, 87 bp, Mus musculus
gaccttcatttctttttttatggcagctgacttcttacaaagtaaatgatctgagagaagaaagtgaccataagggaaatcagtgtc

SEQ ID NO: 71896 - DNA, 76 bp, Mus musculus
tgtgtacatatacacatatatatgtatgtatatatacacacatacaaacatacatgtatacatgtgtgtgtacaca

SEQ ID NO: 71897 - DNA, 89 bp, Mus musculus
gtacattctgtgtatatatatatatatatatatatatatatatatacacatatatatatgtatgtatatgtgtatatatatttgtatgt

SEQ ID NO: 71898 - DNA, 87 bp, Mus musculus
cgtgccaattaaaaaccttcaggacaaaggctgtatatgcatcgtgtcaggacacagagcagagtcaggctaggtagagttggtgtg

SEQ ID NO: 71899 - DNA, 59 bp, Mus musculus
gcactggtatgtgtgtatatatatatatgtgtgtatatatgtgtacacaacacatatgc

SEQ ID NO: 71900 - DNA, 90 bp, Mus musculus
tttattatatgaggtgcttacagtgcagttagtgtctggttgctctaaaaatctcaacagcaagcactgcacatagcaacagttagtgaa

SEQ ID NO: 71901 - DNA, 97 bp, Mus musculus
ttctctagtgttagctggtctttctgtctctgactgtggcttgtccctcctgcaagtttgtgtgtcagtactcagagaccagttctttcttggagga

SEQ ID NO: 71902 - DNA, 114 bp, Mus musculus
gatcagccttaatccgtagtgatctgataggatgcatgggacaatttcaatatttttgtatgtattgaggcctgttttttgaccaattatatagtcaattttggagaaggtatc

SEQ ID NO: 71903 - DNA, 79 bp, Mus musculus
acttctgtcagtttcactgtgtctctgtttagcttctgtttccaggatctgtccattgatgagagtggggtgttgaagt

SEQ ID NO: 71904 - DNA, 93 bp, Mus musculus
tgggggtcgggggggggggactggagagatggctcagcggttaaaaacactgagtgctcttccagaggtcctgagttcaattcccagcaacca

SEQ ID NO: 71905 - DNA, 70 bp, Mus musculus
tcagctgggataggttcagtctagatgcttgagtatactgtggcatcttcctctctctgtccctcactga

SEQ ID NO: 71906 - DNA, 118 bp, Mus musculus
ggaacttggtaacattattcatatagttctagcttcgttgccattcagagtggaagagttctggggtcgggcaggtttacacgaaggttataggcaatgaatagtcgggtcaggttcc

SEQ ID NO: 71907 - DNA, 59 bp, Mus musculus
ccattgggatccccatgctcaggccaatggttggctgtgagcatctgcatctggattgg

SEQ ID NO: 71908 - DNA, 60 bp, Mus musculus
gtatatatgtgtgtatgcatgtatgtatgtgtgtatatatatgtatggttatgtgtgtgc

SEQ ID NO: 71909 - DNA, 97 bp, Mus musculus
atatttactaaaatatgtaaaggtttttaaaacaagattgtatcatttttttaaaaggttgtacaataagtgaagacctatttacattattaaatat

SEQ ID NO: 71910 - DNA, 85 bp, Mus musculus; identical to SEQ ID NO: 57439

SEQ ID NO: 71911 - DNA, 62 bp, Mus musculus
tatatgtatatatgtatatatgtatatatgtgtgtatgtacgtatatatgtatgtatatatg

SEQ ID NO: 71912 - DNA, 84 bp, Mus musculus
ggaaaagtgaagtacaggggctggagagatggctgtgaggtaaagagcactggctgctcttccagaggtcctgagttcaaatcc

SEQ ID NO: 71913 - DNA, 117 bp, Mus musculus
ctgcagtgctgcccctcctcagctttgctttgttgtgttgtgcctgagctttctaggctgactgggtgacttgagattttgcagttgagctgggtttggagggctaatttactatag

SEQ ID NO: 71914 - DNA, 100 bp, Mus musculus
tgaattagataattcttgaggtttttttttactgtgagattacagagagatctactccacagtatgtgtataaggattgcctttgaggaattaaaattta

SEQ ID NO: 71915 - DNA, 106 bp, Mus musculus; identical to SEQ ID NO: 62964

SEQ ID NO: 71916 - DNA, 104 bp, Mus musculus
atgatgatatttcattctttggacaagaaagaggaatttatagatcagtcagtttgatgatgaaagttttttcttatactaatgatattgttttgtttcatcat

SEQ ID NO: 71917 - DNA, 94 bp, Mus musculus
ctgtctgaatttagtctggggaagagtagagattcagctcagaaaagagcagcaaatctgaggaacacttactaactccaggtcaagtagatgg

SEQ ID NO: 71918 - DNA, 78 bp, Mus musculus
agtgcaaatgtaacctctctgaagaaactgagatcaaagacccttgttcagttttcttggagtattttcacctgcact

SEQ ID NO: 71919 - DNA, 115 bp, Mus musculus
tcacatggagtttattgaatagcctgatactactgctctggtggagtcagcttgacagatgaaagtctggaagctttctctgaggaaaagagtttcaaggaaacttcctcctgga

SEQ ID NO: 71920 - DNA, 87 bp, Mus musculus
tgtccatggtggtctgataggatgcatgggacaatttcaatatttttgtttctgttgaggcctgttttgtgaccaattatatggtca

SEQ ID NO: 71921 - DNA, 75 bp, Mus musculus
ttttctttcagtgtctgtgtgactgatttggtgggattcacggtcagcacacaactccattttactagaggaaaa

SEQ ID NO: 71922 - DNA, 112 bp, Mus musculus
gatcagtcttaggccatggtggtctgataggatacatgggacaatttcaatatttttgtatctgttgaggcctgttttgtgaccaattgtatggtcaattttggagaaggtc

SEQ ID NO: 71923 - DNA, 101 bp, Mus musculus
tgagtatagaagtagaacccccaaaattatttgaatatatgtcaatgcacacatgcatgttcagtatccaaggcagaaggggaaattacatctactgtcca

SEQ ID NO: 71924 - DNA, 85 bp, Mus musculus; identical to SEQ ID NO: 57470

SEQ ID NO: 71925 - DNA, 71 bp, Mus musculus
gggtgcccttgtgtttagaattgagatatcatcttggtagattttttttcattgatgaatacatagttccc

SEQ ID NO: 71926 - DNA, 90 bp, Mus musculus
tgatgtttatgcgttactcttcgtgggtttcatcaaacactggcttcgaaaagagattaccactggaatgatgtaaggctgggggcatta

SEQ ID NO: 71927 - DNA, 69 bp, Mus musculus
gggagtggtatagtgatattcttgtagaaatatttccaattttctaaggaaaatcattaattgatttcc

SEQ ID NO: 71928 - DNA, 90 bp, Mus musculus
ttaggaatacatgttatgtatgtatttatgcatatgtgtgtatgctatgtatgtatgcatgtttgtatgtattatgtatgtatcaattaa

SEQ ID NO: 71929 - DNA, 90 bp, Mus musculus
tatatatatatatatatatatatatatacatgtatatatatacatacatgtatatgtatatgtatatgtatatgtatatgtatatataca

SEQ ID NO: 71930 - DNA, 85 bp, Mus musculus; identical to SEQ ID NO: 57439

SEQ ID NO: 71931 - DNA, 131 bp, Mus musculus
cagttaattattactattgtgctatgaactgagtacacaatgtttaaatgatgtgcacaggacagagtgagcagagtggcagtgagtattgtaacaagatacttgggtctgtgaatgtcaatgggaatatt

SEQ ID NO: 71932 - DNA, 76 bp, Mus musculus
ttaaatttctgtgtgtctctgagtgtgtgtatgtccatgtacacatataagtacaccctataatgcaggagtggaa

SEQ ID NO: 71933 - DNA, 105 bp, Mus musculus
tgggagtttgtatctgtggcatttggagtgctctcatctgtatcagttagggaggtaactgtagcatttggagtactctcatctgtatcagttggcgaggtagca

SEQ ID NO: 71934 - DNA, 85 bp, Mus musculus; identical to SEQ ID NO: 57439

SEQ ID NO: 71935 - DNA, 73 bp, Mus musculus
tgtactactgtgattttcctaaggacagaaaaataaaaccagattttttttctttagtaatgcaggtggtaca

SEQ ID NO: 71936 - DNA, 109 bp, Mus musculus
tcttttaacttctgtagattcatgtgtatattaaacaaactttgtatttgtgtaattcccatagtaatatgaatgctttgtaatataggtgctatggattattgaagga

SEQ ID NO: 71937 - DNA, 72 bp, Mus musculus
tgtgtatatgtatgtatgtatgtatgtatgcatgtatgtgtatatatgtgagtgtatgcatatatgtgtgta

SEQ ID NO: 71938 - DNA, 119 bp, Mus musculus
tgtatatgtgtgtgtgtatatatatgtgtatgtgtgtatgtgtgtgtgcatgtgtatatgtatatgtgtgtatgtatgtatgtgtgtatatgtgtgtatgtgtgtgcatgtgtatatgt

SEQ ID NO: 71939 - DNA, 85 bp, Mus musculus; identical to SEQ ID NO: 57470

SEQ ID NO: 71940 - DNA, 92 bp, Mus musculus
gagcctcaggatttactttgtggaaggagagagcaggactcctggaagttatcttctctctcacacactcacacagaataagaaggagtctt

SEQ ID NO: 71941 - DNA, 102 bp, Mus musculus
tacatttatatctgtatatgtgtatatgtatatgtatatatgtacatatgtatatgtgtatatgtatatgtgtatctgtatatgtgtacataggtataaatg

SEQ ID NO: 71942 - DNA, 84 bp, Mus musculus
gagacaggaaactggggctggagcggtggctcagtggttaagggcactgactgctcttccagtgtcctgagttcaattcccagc

SEQ ID NO: 71943 - DNA, 73 bp, Mus musculus
gaaaggagggcctggagagatggcttagaggttaaaagcactgactgactgctcttgcagaggtcctgagttc

SEQ ID NO: 71944 - DNA, 63 bp, Mus musculus
tctcaacaactctctctctctcttttgggaagaaattagagtaggaggagttaggcagtgaga

SEQ ID NO: 71945 - DNA, 117 bp, Mus musculus
agacatctttaagtggtgcttatgacaacatggggcaggggtgtttggatttgagatgagagagtggactggataacaagatggagtgtgttgtgggtgaaggatttgagagatgct

SEQ ID NO: 71946 - DNA, 95 bp, Mus musculus
tctgagtgtgcctctgtgtgtgtgtgtatgtaagtatgtatgtatatatgaagtatgtatgtacaagcacatatgaaccacagtacacacttgga

SEQ ID NO: 71947 - DNA, 107 bp, Mus musculus
gagttagaaatgcacacacatgggctgggaagatagctcgatggttaagagcactgactgctcttccagaggccctgagttcaattcccagcacctcgtggtggctc

SEQ ID NO: 71948 - DNA, 99 bp, Mus musculus
agtgtgtgtcaacagaaaactagccagcactgcattaaaggttcagtcctctcatctctgtgcctctaacagtctgttgttctctgaagtctcagcatt

SEQ ID NO: 71949 - DNA, 85 bp, Mus musculus; identical to SEQ ID NO: 57439

SEQ ID NO: 71950 - DNA, 76 bp, Mus musculus
ggagttggagagatggctcagtggttaggagcactgactgctcttccagaggtcctgagctcaattcccagcaacc

SEQ ID NO: 71951 - DNA, 77 bp, Mus musculus
cctcagcttcatgacccttttctgtatatgttattctgtttagctttgctcacatgtacacatggttagagctgtgg

SEQ ID NO: 71952 - DNA, 138 bp, Mus musculus
atatatatgtgtgtgtgtgtgtgtgtgtatacatatgtgtgtatgtgtgtacatatatgtgtgtgtatatatatgtatgtatgtatatgtgtatatatatatgtgtgtgtgtatatatatacacatatgtatatatat

SEQ ID NO: 71953 - DNA, 115 bp, Mus musculus
gtatatacgtgtgtatgagtgtgtatatgcagaggtttgtgtgtatacatttgtgaatttttttcaatgtatgggggaagaatgtgtgtgtatatacgtatatgtatgtgtgtat

SEQ ID NO: 71954 - DNA, 119 bp, Mus musculus
atgtacttatacacatatacacatatatactatatacatgtataatatttgcatatatacatatgtatatataaatctgatactagtatgtgtgtatatatatgtgtatatatatatac

SEQ ID NO: 71955 - DNA, 85 bp, Mus musculus
gtttgaatggaggcagtccccatccggttgtggttgaaggttgaaatgctttaatgagcaagaggaagtggtttgccttacaagc

SEQ ID NO: 71956 - DNA, 93 bp, Mus musculus
cggatgcctccagtacggagtgtagtgtggatggagcccactgtcaagtggaaggccaccccactccccactttgggaacttgactgtgtgtg

SEQ ID NO: 71957 - DNA, 70 bp, Mus musculus
agatcaagtgaccataggtgtgtggattcatctctgggtcttcaagtctgttccattggtctacttgtct

SEQ ID NO: 71958 - DNA, 85 bp, Mus musculus
taccaattctcttgccactgtgcctgtgacagtgctcactttagcctctgcggcatgggcagtgacgtggctgggcttgtgcgta

SEQ ID NO: 71959 - DNA, 131 bp, Mus musculus
ttgtgtgtgtatgtgtatttataaatgtatgtgttgtacatatgtatatatatatgtatatgtatatgtgcatatatacatatgtatatatatatacacacacagagtacaatagattaatgttatgtaag

SEQ ID NO: 71960 - DNA, 91 bp, Mus musculus
gggctttattagatagtatacagcttctatggagaacattgtcagcccagtggcatagtgtctgtctgtctgtctgtctgtctgtctgtct

SEQ ID NO: 71961 - DNA, 109 bp, Mus musculus
ctagctttattctgtggataataatgtctaatctttgtcttttttaatctatgaaatgaggaccatgtgagaaagacattgtttaacctgtaagattggggaagactag

SEQ ID NO: 71962 - DNA, 106 bp, Mus musculus
tgaacaaagtgacagtaaattcagaaaatctctcctttagttctttacatagtttttaaaaatgtagatacttggaatagattatctaatatagtctcagtgttca

SEQ ID NO: 71963 - DNA, 97 bp, Mus musculus
cttttttttaggtatatatatatatatatatatatatatatatatatatatatatatatataatttatgtgtatgtgtgcatgtgtacctgcatgag

SEQ ID NO: 71964 - DNA, 85 bp, Mus musculus; identical to SEQ ID NO: 57439

SEQ ID NO: 71965 - DNA, 67 bp, Mus musculus
tacagtgcccctggaggcctctggcaagctgccatgtatgttctgaggtttgaatccaggtcctgta

SEQ ID NO: 71966 - DNA, 84 bp, Mus musculus
tgagggggttagagttcatgaccactggtgaggagcatggctgcaggtgggctagcacacagtggagtgtgaggtgacagctca

SEQ ID NO: 71967 - DNA, 116 bp, Mus musculus
gagggagggagggaaggaaaagtgggttttcaactgagtgtatactaggacttacaggtttttttttctttaaagtagggagacatttaatccatttcattttcaccttttcctct

SEQ ID NO: 71968 - DNA, 112 bp, Mus musculus
tagttggtgcgtctctcccttgtggccacccctgatctctgcagtcagtggctgtgtctctgccagctcttctgcagagcatctattgtggctccctctccatcactgacta

SEQ ID NO: 71969 - DNA, 113 bp, Mus musculus
tacacagaaaatttatgtacacaaatgagtttcatatgttctttgataaattgacaaactaattctgtctggttttcatgtaacccaggtgtgtgtgtgtgtgtgtgtgtgtg

SEQ ID NO: 71970 - DNA, 97 bp, Mus musculus
gatgaagaggtgtatgctaccagagggatgggactcaaggttgtctcctggcttccacatgagctctctctgtctctatgttgcactgtcttcctct

SEQ ID NO: 71971 - DNA, 92 bp, Mus musculus
ttaagaaatactaagctgatgcagagtgaagagtgtgtgaaaagcagtggtgcagcttggcttgaactcgttctccagcttgggatccttaa

SEQ ID NO: 71972 - DNA, 76 bp, Mus musculus
cctttcctggagagagaatctggagcccacatctaacttgttaagtctggaatcttattttttatttctggaaagg

SEQ ID NO: 71973 - DNA, 95 bp, Mus musculus
tctagaactagcaaagccacaaagacagaagagtgtgcacagggctactgagaagtagtcaactagtttcttttgggcaatgaactatttctgga

SEQ ID NO: 71974 - DNA, 117 bp, Mus musculus
tttataagatccgtgggtgcggggctggagagatggctcagcagctaagagcactgactgctcttccagaggtcctgagttcaaatcccaggctcacaaccatctgttatggagtct

SEQ ID NO: 71975 - DNA, 119 bp, Mus musculus
cagcaaccagagtgcgactgcagaatttagaagctaggcactttgaattatattattatatctagttcaacacggtgtcttagttactgagattctgccctcgaaagttattgaaatgg

SEQ ID NO: 71976 - DNA, 81 bp, Mus musculus
atgtatttcaagagaagacaataataagctcactgcctcttagacccacaggctgtattgtctctgagtctctctgtacat

SEQ ID NO: 71977 - DNA, 136 bp, Mus musculus
gagtctctctgtacatatgcctctgtctcttagtccatgctctctgtctcttagacacacaggctgtattgtctctgagtctctctgtacatatgcctctgtctcttagtaccatgggctatattgtctctgagtc

SEQ ID NO: 71978 - DNA, 77 bp, Mus musculus
tatgtatgtatatatgtatgtatgcatataaataattataagtgtatattattatatatgtatacatatatgtgtat

SEQ ID NO: 71979 - DNA, 107 bp, Mus musculus
ctcttagtccatgcctctgtctcttagacacacaggctgtattgtctctgagtctctctgtacatatgcctctgtttcttagtcccatgggctacattcgctctgag

SEQ ID NO: 71980 - DNA, 88 bp, Mus musculus
agcctgatatctcagtgtcttcgttttccagtctgaggccctgtggcaccttcagtgggtcacagagtgtcactgagtttctatcgct

SEQ ID NO: 71981 - DNA, 67 bp, Mus musculus
ctcagtgacactctgtgacccactgaaggtgccacagggcctcagactggaaaacgaagacactgag

SEQ ID NO: 71982 - DNA, 83 bp, Mus musculus
gtgaaacaataggtcacagagagtccatttagtgcaatagtggtagtaagttcttttctatggactgtgacctgtcatgtcac

SEQ ID NO: 71983 - DNA, 75 bp, Mus musculus
gtgtcacaggagagtgaagtcacctatgggttctaactgtttctgtggggatgactctgtctagggcctgaacac

SEQ ID NO: 71984 - DNA, 113 bp, Mus musculus
ggagaggtttgcaggtgtgtctactgggacaggggtccatagctctgaatttttaaaattgaagctacattttcttttcccttgtattattatctgattatggttgtctttcc

SEQ ID NO: 71985 - DNA, 85 bp, Mus musculus; identical to SEQ ID NO: 57439

SEQ ID NO: 71986 - DNA, 85 bp, Mus musculus; identical to SEQ ID NO: 57470

SEQ ID NO: 71987 - DNA, 85 bp, Mus musculus; identical to SEQ ID NO: 57470

SEQ ID NO: 71988 - DNA, 71 bp, Mus musculus
tatctccctgctaagaaattccttacctctagaaacagagagcagtgagagaggtcagatggagggaggta

SEQ ID NO: 71989 - DNA, 100 bp, Mus musculus
ctatcttactgtctgtttatagttattctatatatttgtacatatgcttgtgtatatatgagctgatgtatacatgtggaagccaggagtcagtgtctag

SEQ ID NO: 71990 - DNA, 110 bp, Mus musculus
catgggaaactaacttgtttttgttttcttttatgtcatttagcgtataaactatgatactttattctttatttgaatgacacgggacagcaaagaactctagctctctg

SEQ ID NO: 71991 - DNA, 118 bp, Mus musculus
gtgtgacttcctttgggcttgtcctggtgaaagtgcactgaacacactaggctcacagggtgtccttgttcagtcctgccccctccaggagtctcaagctgcaagggttaggttgtat

SEQ ID NO: 71992 - DNA, 69 bp, Mus musculus
gtgatgggaacatactgtggtgtcaggcttacccaggtctgtctgactctacgtctctgtgtctgtcac

SEQ ID NO: 71993 - DNA, 85 bp, Mus musculus; identical to SEQ ID NO: 57470

SEQ ID NO: 71994 - DNA, 66 bp, Mus musculus
ccgtggggacactgggcagggggaaggtgatggcacactcactccctggctcagtgtcactaatgg

SEQ ID NO: 71995 - DNA, 78 bp, Mus musculus
tttactatcctgtgtgtgtgtggaaaccttgggaatcagaaaggcacccagcaaaccagacagaagacacagagtgaa

SEQ ID NO: 71996 - DNA, 116 bp, Mus musculus
gggaatagtcaatccgacctggcttgaatgggtctccaaaaactaatgatcctgtgtgaagacagtgaccttaagaagagatgatacaaggcaggtttacaaccaaggctgtaact

SEQ ID NO: 71997 - DNA, 113 bp, Mus musculus
ttcttttactcactccatgatctctcctcagtaccacccctgtgatcttttgtaaagacacatcagacagtggccaacgactatgaagaatgtcaactatgagtgactgagaa

SEQ ID NO: 71998 - DNA, 76 bp, Mus musculus
tccttcaggcaaggtcatcaggaagagagggacaatttgccctgagttctctctctttcagagtgtctgtctggga

SEQ ID NO: 71999 - DNA, 114 bp, Mus musculus
tcaaaagcagaaaaatgtatttggcaaagtccattctcacactcacacactttatagtaacaaacatgctagggagctttgaggggaccatgctggtcactttgttgtatatga

SEQ ID NO: 72000 - DNA, 85 bp, Mus musculus; identical to SEQ ID NO: 57439

SEQ ID NO: 72001 - DNA, 58 bp, Mus musculus
acataggtatgtatgtatgtatgtatgcatgtatgcatgcatgcatgtatgttaatgt

SEQ ID NO: 72002 - DNA, 96 bp, Mus musculus
acagagacgcttagctctcactttaagaagctgaaatctccaacaggatgaggtgttagagaatatagagagcaaaggaaataaaatggtctttgt

SEQ ID NO: 72003 - DNA, 102 bp, Mus musculus
ggcctcagcagccctctgtgtcctctcaatctctgtctttcattcctttaaaaccagtatcatgcagggacgattacacattgcctactctagctgctggct

SEQ ID NO: 72004 - DNA, 99 bp, Mus musculus
ctgggtctctcttctttcttttctgctgctaagaaaatgaacagtgaatcacatgaacagatcctacacagacagctgagagggaatgaattgactgag

SEQ ID NO: 72005 - DNA, 92 bp, Mus musculus
cagccctggtgacctctcttctgattctctctgcagggcagtcttttctgaagtgttcctgtagattatatcataaagcactcaccttcctg

SEQ ID NO: 72006 - DNA, 70 bp, Mus musculus
tgtatgtgtatggtgtatgtatgtatgtatgtatgtatgtatgtatgtatgtggatgcccatggaggtca

SEQ ID NO: 72007 - DNA, 118 bp, Mus musculus
aggaacaaaagcagaagacgaagcttgcatgcctggtctgagtctgtctctctctgcttcctggatgccatgaggtaggcagtgctcctgggccatgcccttccaccatgatgtttct

SEQ ID NO: 72008 - DNA, 105 bp, Mus musculus
gggcgtttcagagcttacactaacactacaatgcactctgttacacacacacactgtgcatcatcaaaatctctgttttgttactacgataggcggggcatgctc

SEQ ID NO: 72009 - DNA, 90 bp, Mus musculus
tatgtgtgtatgtgtatatatgtatgtatgcatatttgtgtttgtacatgagtttatgtatatctatgtatgcaagtgtgtgtgtgtgtg

SEQ ID NO: 72010 - DNA, 93 bp, Mus musculus
gttctaaagagggaaagggtaaggtttttggcagatgttggcgagagctctgttcattccctggctcactctctgcttctggacatctcagcc

SEQ ID NO: 72011 - DNA, 86 bp, Mus musculus
gggaaacagacagaattcagcaaataaaatagatgggtatctatctatgtatctatctatatatgtgtctgtctgtctgtcagcct

SEQ ID NO: 72012 - DNA, 80 bp, Mus musculus
gcagatctctgtgagtttgaggccaatcttgtctacatagtgagtttcaggacagccagggctacacaaagaaaccctgt

SEQ ID NO: 72013 - DNA, 141 bp, Mus musculus
gtaccacactccagcaactgagctacatccttagctcagttctgtgtgcgtgtgtgcgtgcgcgtgcgtgtgcatttgcatgtgcatgtgtaatatgtgtgcgtgcatttgtacatacgtgtacatgttcctatttgtgta

SEQ ID NO: 72014 - DNA, 68 bp, Mus musculus
gtatgtatgtatatgtgtgtatgtgtatatgtgtatatatgtatacatatatgtatatacatatatac

SEQ ID NO: 72015 - DNA, 133 bp, Mus musculus
tcccttggtcatggtgtctgtttacagcagcaaaaccctaactaagacagacagacagacagacagacagacagggatgatggcttctctcagtgacaggacactagcctaccactcatgatgctctgctctg

SEQ ID NO: 72016 - DNA, 75 bp, Mus musculus
gctcagatgtaaaaggtcctgaaaacatggttgagacccctttctccaaggagtgaggattgttgtgtcgaaggc

SEQ ID NO: 72017 - DNA, 71 bp, Mus musculus
ccacttttagtgtacagagatgttatgtactttcatgtcattggtcatctgtccctgtgtcacaggaaggg

SEQ ID NO: 72018 - DNA, 82 bp, Mus musculus
gttacatacatatatacttacaaatatagcctgctctgtttatttagtgttgttcctctgtctgtgtgtgtgtagggctgac

SEQ ID NO: 72019 - DNA, 88 bp, Mus musculus
tggggctagcaatacacagaactcagagtgctctttatatgagtgagcaattatgaacactttggaaatctttgcaaatgcctcccca

SEQ ID NO: 72020 - DNA, 121 bp, Mus musculus
gagagatggctcagcaattaagagggctcaatgcaggctgtagagatggctcagtggttaagagcactgactgctcctccagagatcctgagttcaactccaagcaaccacatggtggctc

SEQ ID NO: 72021 - DNA, 85 bp, Mus musculus
tatctgtgtgtgtgagctcatgtgtgtgtgttcatgtgtgcatgcctacatgcatatgtttatatatgtttgtgttcgtgtattc

SEQ ID NO: 72022 - DNA, 64 bp, Mus musculus
gaaaagggaaaaccaggcaagaaaggaggaggaagcttgtctgtctgtctgtctctcccgtgtc

SEQ ID NO: 72023 - DNA, 81 bp, Mus musculus
gagtatcagcatgtatgtatgtccatgtgcatgtggcaggaaggtgtgatctgctggatgtgggtgctgggaactgaactc

SEQ ID NO: 72024 - DNA, 120 bp, Mus musculus
agcgctggtgcacatgttagatcccagcaattgggaggcagaggcaggtgactctctctgagcctgagggcagcagcctggccaacagtgttgagttctaagacagtcagggctacacag

SEQ ID NO: 72025 - DNA, 115 bp, Mus musculus
tctaatctctgcctctgtgtctgtctttctcatctcagtctctgtatgtctgtctgctgtacctcatgagtcatttaaagaaatatatatgtaggatcacagggctcccaatgga

SEQ ID NO: 72026 - DNA, 110 bp, Mus musculus
tgaccttaacagaagtaatttcgggctggagagatggctcagcggttaagagcactgagtgctcttccaaaggtcctgagttataatcccagcaactacatggtggctca

SEQ ID NO: 72027 - DNA, 77 bp, Mus musculus
ggggatcttgggctggagagatggcttagtggttaagagcactgactgctctttcagaggccctgagttcaattccc

SEQ ID NO: 72028 - DNA, 86 bp, Mus musculus
cagacagatctctgtgagctcaaggccagcctggtctatggtgtgagttccaggacagccagggctacacagagaaatcctgtctg

SEQ ID NO: 72029 - DNA, 112 bp, Mus musculus
aactgatggattggaaggaggatattccggagagaatttttgttgttgttaatacaatatttttctgttaattctttgggaatattatacatgcatacaatgcattttggtt

SEQ ID NO: 72030 - DNA, 116 bp, Mus musculus
caggccatgattgtggtatatagactcttaggtgcaaaacacctaagaaaataattttttttattttatgtatataggtgttttgcctgcatgtatgcatatcatatgtgtgtctg

SEQ ID NO: 72031 - DNA, 92 bp, Mus musculus
ctcccagcttcaagcccggtttactctaaataagttttttcttctttatgtaaaaagagagggttgagacctgactggccaagggaagtgag

SEQ ID NO: 72032 - DNA, 102 bp, Mus musculus
gaaacatattgtgggggctggagagatggctcagtggttaagagcactgactgctcttccaaaggtcctgagttcaattcccagcaaaccacatggtggctc

SEQ ID NO: 72033 - DNA, 88 bp, Mus musculus
tccagcgcaatttactatctctctctgtgcctcagttgatttatctgtcaaatgggaataatgggagtacttcaaaggggtgtcgtga

SEQ ID NO: 72034 - DNA, 108 bp, Mus musculus
atatatatgtatgtatatatatatatatgtatgtatatatgtgtgtgtgcatatatatatatgtatatatgtgtgtgtgtgtgtgtgtgtgtgtgtgtgtgtgtgtgt

SEQ ID NO: 72035 - DNA, 62 bp, Mus musculus
cgtgcctgtgtgtgcgtatgcgtccgtgtgtgtgcatgcgtgtgtgcgtgcctctgtgtgtg

SEQ ID NO: 72036 - DNA, 72 bp, Mus musculus
tatctgtatatatgtgtgtgcttatgtgtgtgtttatgtctatatgtatatgtatgtatgtgtgtatatatg

SEQ ID NO: 72037 - DNA, 93 bp, Mus musculus
cacaagcttgtccacactcctcagagactcactctctcccagcggtatttgggtatggagtgctttgtctcaggatctgctctgggtgctgtg

SEQ ID NO: 72038 - DNA, 122 bp, Mus musculus
attggcatgactcagcaggagggattatactaggagaagttctttgctgtgcctctctctgtgcctatgtgtcagtactcctgagagatcagttttctctgggagaaatttgggtaaggaga

SEQ ID NO: 72039 - DNA, 77 bp, Mus musculus
ctgtgctcattacctctcccttggatgtcatacacacactctgtgtattatatgcagaggtataattgtcgaaacag

SEQ ID NO: 72040 - DNA, 77 bp, Mus musculus
tctaagtgcatgtgtaggtttgtgtgtgtgtggtgtcccattcatatcacacacattatgaacacattgaactgtga

SEQ ID NO: 72041 - DNA, 72 bp, Mus musculus
ggatggagtcatgtacacagaagtgggtcagcaaagcattgtgtgataaacactctctgtgactcttcattc

SEQ ID NO: 72042 - DNA, 61 bp, Mus musculus
ttgtgcttcgaggttgggacctatatttaattttatatgtcacttaaacttgagagcacaa

SEQ ID NO: 72043 - DNA, 85 bp, Mus musculus; identical to SEQ ID NO: 57470

SEQ ID NO: 72044 - DNA, 124 bp, Mus musculus
ctcttgttgggttcccttctacatccttgacatggagatgtttgccttgacttacagcatcttgttttgtcctgtctggctgtcatctctggggaggagtgtttctgtgtatctggagaagtta

SEQ ID NO: 72045 - DNA, 98 bp, Mus musculus
actgataccccatgtggaatagacccacacaagccctgagaattctactttagtctactttagtctctctctgtgtgtgttagttctcctgtgtttgt

SEQ ID NO: 72046 - DNA, 99 bp, Mus musculus
tgcatggtggtattgagacaaacaggttgatcagtggaagtgaattgattatccacacacccatggtcccttgatttttgacaaagccaaaaccagaca

SEQ ID NO: 72047 - DNA, 85 bp, Mus musculus; identical to SEQ ID NO: 57470

SEQ ID NO: 72048 - DNA, 124 bp, Mus musculus; identical to SEQ ID NO: 72044

SEQ ID NO: 72049 - DNA, 85 bp, Mus musculus; identical to SEQ ID NO: 64855

SEQ ID NO: 72050 - DNA, 99 bp, Mus musculus; identical to SEQ ID NO: 72046

SEQ ID NO: 72051 - DNA, 99 bp, Mus musculus; identical to SEQ ID NO: 72046

SEQ ID NO: 72052 - DNA, 124 bp, Mus musculus; identical to SEQ ID NO: 72044

SEQ ID NO: 72053 - DNA, 112 bp, Mus musculus
agtgagggcacagtgagagaggttcccacacaggtgagagtctgcacagtgggccttgactggagcacaggaaggccttcccatcctccaagtgtgtcgggccttgatgaac

SEQ ID NO: 72054 - DNA, 85 bp, Mus musculus; identical to SEQ ID NO: 57439

SEQ ID NO: 72055 - DNA, 85 bp, Mus musculus; identical to SEQ ID NO: 57439

SEQ ID NO: 72056 - DNA, 91 bp, Mus musculus
cctgctaagattcagataacatggcagataatcactgtctctgtggctctggggacattccttaatctctgtgaacctctgtttttccagg

SEQ ID NO: 72057 - DNA, 97 bp, Mus musculus
tcaaggtgaagataggttggttttaatgttctactgtattgtttctaacgacaaaatcacagttgctatctagggcctatctcacttttcacttcga

SEQ ID NO: 72058 - DNA, 104 bp, Mus musculus
ctctgtaactcctaccatgggtattttttatcaggcacttgaagtttttttaatttctaatgagaagagtggatagagaatgaaatatttcttgggatagggag

SEQ ID NO: 72059 - DNA, 85 bp, Mus musculus; identical to SEQ ID NO: 57439

SEQ ID NO: 72060 - DNA, 114 bp, Mus musculus
ggctgctgcatattttatctgataagagaaaatttgggcatttttagattgtgctatgtatttttttaaatgttcaatatgatttctggtaattgtcttaagaactggagtgtt

SEQ ID NO: 72061 - DNA, 95 bp, Mus musculus
attcatgtggtcagagaaaatacataattttgtatttttcaactttgttgagaaatgtttagtagtgtaatatattatggactattctggtgaat

SEQ ID NO: 72062 - DNA, 58 bp, Mus musculus
ccagccaagtgagaagacacagacctcttaaggaggtagcctgtttacccttggcagg

SEQ ID NO: 72063 - DNA, 85 bp, Mus musculus; identical to SEQ ID NO: 57439

SEQ ID NO: 72064 - DNA, 92 bp, Mus musculus
gcccaggaggaaagacacttgccactggctgtgatcagctgggtcatcttgccagccattgctaggtgatgttctcctaagactcacagggt

SEQ ID NO: 72065 - DNA, 86 bp, Mus musculus
ctctggctctgacactctctctaccacaccttcaacaatatccctgagctttggggtggggaatggagaaagagaggcagagagag

SEQ ID NO: 72066 - DNA, 128 bp, Mus musculus
atatacatatacataaatatatacatatatagacgtgtatatatctgtgtgtatgtgtatgtatatgtatgtgtatgtatatatgtatatatacacacacacacatatatatataatatatatccata

SEQ ID NO: 72067 - DNA, 82 bp, Mus musculus
aggcgcatgcttcagagcaacctcctaatgctggcattgcaggagtgtattgccctctcattgtctgtctgtctgcttgcct

SEQ ID NO: 72068 - DNA, 69 bp, Mus musculus
aggccactgatatagtggcaaccttggacaaaaatgtccctacttctctgtctttgtgtcagtctgtct

SEQ ID NO: 72069 - DNA, 81 bp, Mus musculus
gcacatgttagactcaccctgtcagtcacttctccctgaggtctaatggcagttgtgataagaggtgaaagctagctgtgc

SEQ ID NO: 72070 - DNA, 85 bp, Mus musculus
ttcctctgatggccatctatgcctccttcagcgagggatcgttcttggttaatgtggtgtggtagctggtagaaatcttgaggga

SEQ ID NO: 72071 - DNA, 76 bp, Mus musculus
tccaaagtctggtctctgtctctctgcccagccattggctgccagcaacttgatttaccgatcagaaccaactggg

SEQ ID NO: 72072 - DNA, 84 bp, Mus musculus
actcagggtaaagccaaagatctgtgagtggtgctcaggggtggaaccggagcacagcgtgactgtctctgtggccctctgtgt

SEQ ID NO: 72073 - DNA, 68 bp, Mus musculus
aacttgtcctacaagatgatctgacaaattgtcagaactgtgtgagatcttttcctgggaaacaagtt

SEQ ID NO: 72074 - DNA, 72 bp, Mus musculus
gtgtgcgtatgtgtgcatgtatttgtatgtatctatgtatgtatatgcatgtgtgtgtgtgtgtgtgtgtgt

SEQ ID NO: 72075 - DNA, 130 bp, Mus musculus
tatgtatgtaagtgtatgtgtattatgtgtgcatgtgtgtatatgtgtgtacgtgtgtgtatgtgcatgtgtatgtgtatatgtatatgtgtgtatgtgtatgtaagtgtatgtgtgtctttgtacgtat

SEQ ID NO: 72076 - DNA, 95 bp, Mus musculus
tttttgcttccaggatgaaacagtttttctatttgaaataatattgacaattaattgtcaaattgaaagtactttttctaggagggaaccagaaa

SEQ ID NO: 72077 - DNA, 65 bp, Mus musculus
tcatggtcaggtcttatcacaccagtagaaattctaactaagactctgtgtgtatctgactgtga

SEQ ID NO: 72078 - DNA, 72 bp, Mus musculus
ggtagaggaggtagctcaccagctagacagcagctactgtctcacagactgtctttactctccgtgtttacc

SEQ ID NO: 72079 - DNA, 64 bp, Mus musculus
atgtgtgtgtgcatgtgtgtgtgtgcatttgtatatgtgtgtgtgcatgtgcatttgtatatat

SEQ ID NO: 72080 - DNA, 79 bp, Mus musculus
taatgttgatcgattagagctgtagctcagaattcagggcctgagctatggctacaaacatctttctctgtcagcttta

SEQ ID NO: 72081 - DNA, 80 bp, Mus musculus
ggttgctttgtaatgttgaatgttttagaatgtgtgtgattcattctagataatcagttgaatttagtgacaaagtttcc

SEQ ID NO: 72082 - DNA, 102 bp, Mus musculus
gctttggttgagttgtccctctgtctgtatgtctgtggttgttaaatgaatcaaaaactatccctagcagacatttatagtgcaggttcatcattacagagc

SEQ ID NO: 72083 - DNA, 76 bp, Mus musculus
aggtcagagctcaggtgtgggattgggagtttctaaagggatcctgggtagttctgacactctcagtctgtggcct

SEQ ID NO: 72084 - DNA, 110 bp, Mus musculus
agatatagatagatctatatagatctatagatagatatctctcatctatctatctatctatctatctatctatctatctatctatctatgggtctagatagcatctatct

SEQ ID NO: 72085 - DNA, 105 bp, Mus musculus
gccagaatgctctgggtgatctgtctgtcctctgtctgtctgtcttcatcctctacaacactggagttatagacgcatgatgatgctttgtttttgggttttggt

SEQ ID NO: 72086 - DNA, 126 bp, Mus musculus
atggtggtgatagtctgtgtgcacgtgtgtgtatatacatgcatatgggcatgtgtgtgtgcatgtgcatgtatacatacatgcatgtatacatgtgtgtgcatgttcatgcatgtatgtgtgtgc

SEQ ID NO: 72087 - DNA, 88 bp, Mus musculus
ggtttgagtgagaatgtactccataagcttagatgcgcgcgtgtatgcctgtgcgtgtgtgtctgtctgcctgtgcatctatctgtct

SEQ ID NO: 72088 - DNA, 88 bp, Mus musculus
aggtaaaggattgatgttcccctgttccactccagacacacaacccccctctgtgcttctgtgtgcaggcttctatcccgacctctgc

SEQ ID NO: 72089 - DNA, 72 bp, Mus musculus
atatatacatatatgtgtgtgtgtgtgtgtatatatatatatatatatatatgcatgcatctatctatctat

SEQ ID NO: 72090 - DNA, 118 bp, Mus musculus
gcagggccaaaatcaaggggcttcaaacctgtaagtgttctaagtctctctctcagtcagcgatcgagaagggaaaggatgctgtagaggaaggacaggagtctcatggccaagatgc

SEQ ID NO: 72091 - DNA, 74 bp, Mus musculus
tgagggcagagaggtgtgcaacagataggagttcctgggtaccctgactagtctcaagctcactctgactctgg

SEQ ID NO: 72092 - DNA, 98 bp, Mus musculus
aggtaccattgagtagagtgttgttcagtttccacgtgaatgttgtctttctattatttttgttgttattgatgatcagccttgctccatggtgatct

SEQ ID NO: 72093 - DNA, 83 bp, Mus musculus
agggagatgctccgtgttggggaccgagttgggacagggactcctcagcaactgaggacctctctcttgctctcagtgtcctt

SEQ ID NO: 72094 - DNA, 108 bp, Mus musculus
tccacagtctgacagaccaaggagctcacagtgtatctctgagtctttctctgagacctctctccttgacccatagatgccccccttctcattgtctttccttgtggg

SEQ ID NO: 72095 - DNA, 122 bp, Mus musculus
catcctatgtgtgtgtgtatgtatgtatgtatgtatgtatgtatgtatgtatgtatgtatgcatgtgtgtgtatgtgtgtatgtatgtatgtgtgcgtatgtatgtatgtgtatatgtatgt

SEQ ID NO: 72096 - DNA, 86 bp, Mus musculus
tgtcatggttttgggaaagcctcagaagggagaggatttgccttaaagactaatattctgagttctctttctctcagctcttgacg

SEQ ID NO: 72097 - DNA, 150 bp, Mus musculus
cactgtggctcacaaccatctgcaatggaagccgatgctctcttctggtgtgtgtctgaagacagtgacaatgtattcatatacataaaataaataaataaatctttaaaaatatttttaaatttcattttgtgtatgtgagactgtgtc

SEQ ID NO: 72098 - DNA, 85 bp, Mus musculus
caaggacagaaaggaaaggaagtctgaaaaaggcagttacagtcttgccacagagaacagagtgagcactttcttactggtcttg

SEQ ID NO: 72099 - DNA, 77 bp, Mus musculus
gggatggatccccaggtggggcagtctctggatggtcattccttcagtctctgctccacactgtgtctctctatctc

SEQ ID NO: 72100 - DNA, 57 bp, Mus musculus
atgtatgtatgtatgtatgtatgtatgtgttgtgcatgcgtgtgtgcatgtgtgtgt

SEQ ID NO: 72101 - DNA, 98 bp, Mus musculus
gttctagacttggtttatttggttttctagatgattttttatatatggcaaatataaatagatcgtgtagtctttgctagagtttctcctgctatgac

SEQ ID NO: 72102 - DNA, 69 bp, Mus musculus
acaaatgtgggtgacacatgtgagtgttgactacaatgacaagcactcatttgttacatctagaattgt

SEQ ID NO: 72103 - DNA, 95 bp, Mus musculus
tagcgtatttcgataccgtcaactatactatgcttccttttactcttctgaaggtattgagagagtacagtgtgaacagttttgaacacatgcta

SEQ ID NO: 72104 - DNA, 86 bp, Mus musculus
ttattttcttgcacttcctcaggatagtgtgaagtgatttcaggagatgatttgatgctccagggatgagtgccaagagaggatga

SEQ ID NO: 72105 - DNA, 98 bp, Mus musculus
tgtgtgtgtgtgtgtgtgtgtataattccagaagagaaatgattttgatgatagggtcataattctttgggggatcagcactgtttttaaacatttca

SEQ ID NO: 72106 - DNA, 97 bp, Mus musculus
ggagtgagtgatcatataggactatttgaaggggtggagaggtggctcagtgattaagagcactgactgctcttccagaggtcctgagttcaattcc

SEQ ID NO: 72107 - DNA, 133 bp, Mus musculus
atgtatatgtgtatgaatgcgtgtatgtatgcattatgtatacatatatgtatgcatgtatacatgtttgtatatgtgtatgtgtgcattatgtatgcatacaactatgtatgaatgtatttatgcatgcatg

SEQ ID NO: 72108 - DNA, 75 bp, Mus musculus
cacactctgtgtatttacataggtgagtatatatgtgtgtatgtgtgtgtatctgtgtgtctgtgtgtctgtgtg

SEQ ID NO: 72109 - DNA, 103 bp, Mus musculus
tcacatagaactaacagtggagtgcggaagtcagctgaaatgtgccactcttacatgtgtctctctttgtgactctgtggctttatcccaggcacttgatttc

SEQ ID NO: 72110 - DNA, 91 bp, Mus musculus
tatatatagtatgtagtatatatttttgctattacacatatgtatataagtatatatatgtgtattatatacatatattttcctatgtata

SEQ ID NO: 72111 - DNA, 85 bp, Mus musculus
acagtggcctctttatcactcctcagatgatgctgtgagaacagtgtcatcagaaggagtctgagtggtagaaagaagttagtgt

SEQ ID NO: 72112 - DNA, 68 bp, Mus musculus
gtgtgtgtgtgtgtgtacatatatgtatatatattctatgtatgcatgtatgtgtgtatattatatat

SEQ ID NO: 72113 - DNA, 120 bp, Mus musculus
ttgaggttctccatgcagatgagatcagctggtacctgtctgtggctgtactacttcactgaacacagtgatctctaattccgtgcacagtgtcacacaggatttcattttccctcagcc

SEQ ID NO: 72114 - DNA, 82 bp, Mus musculus
gctggccagccatgtgactcactgtgactcattgaatagaataagtggatgagttcagttacaagctggttggggaactagc

SEQ ID NO: 72115 - DNA, 77 bp, Mus musculus
gactggggtgtgaagagatggctcagaggttaagagcactgactgctcttccaaaggttctgagttcaattcctagc

SEQ ID NO: 72116 - DNA, 89 bp, Mus musculus
ttagtggtttgtgtagctcctactcattcctccactgtcagtatctgtgtgcatagaagaggagtggcctacatatctgttatcattaa

SEQ ID NO: 72117 - DNA, 85 bp, Mus musculus; identical to SEQ ID NO: 57470

SEQ ID NO: 72118 - DNA, 67 bp, Mus musculus
gtattcaagttgcacggagactaccaacgctgccacggttgtcacagtctctgagtgactgagatac

SEQ ID NO: 72119 - DNA, 102 bp, Mus musculus
actaggtatgtattcatttagttgctaatcgctgactctgaatgatacaacttgatacaactcagagagcacaggagttggcgactttcttttgcaattagt

SEQ ID NO: 72120 - DNA, 84 bp, Mus musculus
cccgccccgtctctgtgtgtgtgtgtatgaatatgtgtgcgcacgcggtgtatacatgcatatgcacatgggctgtgtgggtgc

SEQ ID NO: 72121 - DNA, 73 bp, Mus musculus
accactaggattctcaggttaggactttgctcttaaaattcggagagtgagactacagagacagttcagtggt

SEQ ID NO: 72122 - DNA, 104 bp, Mus musculus
tatacatgtgtgtgtatatatgtgtgtgtgtatatatatgtgtgtatatatgtgtgtgtgtgtatatatgtgtgtatatatatgtgtgtatatatatgtgtgtg

SEQ ID NO: 72123 - DNA, 75 bp, Mus musculus
tacgatgcctcacagggattgtgcataccccttacactgtatgagtgtgtgtatatctgtgtgtgcatttgtgtg

SEQ ID NO: 72124 - DNA, 60 bp, Mus musculus
tccttgtgttttctgtctgtctgactgtggcagccaagagtgaagggcaggaacagagga

SEQ ID NO: 72125 - DNA, 108 bp, Mus musculus
cacaggctggaatgggtctgtctctgagccctactgtggacactggctttcagttctgcctgcttctctgtcactcactctaagatctgtccctttttctctcctgtg

SEQ ID NO: 72126 - DNA, 92 bp, Mus musculus
tatggaatgaatatatatatatatacatacatatatatatagtataatatagatgcatgtatatgtatgtgtatataatatatgtgactata

SEQ ID NO: 72127 - DNA, 89 bp, Mus musculus
ctctctttacttggctgtgttttattatatttatttacttaccgtgtgtgtatgtatgtgacacagtaaaggtatgacagaagacagcc

SEQ ID NO: 72128 - DNA, 110 bp, Mus musculus
gttaagattcataaatggggactggagagatggctcagcggttaagagcactggctgctcttccagaggtcctgagttcaactcccagaatccacatggtggctcacaac

SEQ ID NO: 72129 - DNA, 277 bp, Mus musculus
tgtatatgtatatatgtatgtatatataagtgtgtgtatgtgtatatatatgtttatatatgtgcatatgtatatatgtgtgtgtatatatgtgaatatatgtatatgtgtatgtaggtatatatgtgtgtacatgtatgtagatgtgtgtatgtgtatatgtgtatatatatatgtatatatatgtgaatatatatatgtgtggatggatacatgtgtatgtttctatgtgtatatatgtgtatatgtatatatgtgtgtctatctatctatctat

SEQ ID NO: 72130 - DNA, 67 bp, Mus musculus
ggactgcatccagtcactgttgctatgcacctttgtgctccagcaccttctgtgactctgtctctcc

SEQ ID NO: 72131 - DNA, 77 bp, Mus musculus
ctcccagttttgtctgtctgtctgtcaacatcattcatggaatcttttgatgtatggagtcagacttcctaatggag

SEQ ID NO: 72132 - DNA, 94 bp, Mus musculus
tagatatagatatatacatatatgtgtatatatatgtatatatattacagtgtatattatattataaaaatatgtatgtgtatatctatagata

SEQ ID NO: 72133 - DNA, 109 bp, Mus musculus
tgttgtaaaatccttgtaaatgaattgtgtatgtgtgtctgtctgtctgtgtgtgcctacagaagccagaggagggcaccagataaccccggagctggattcacaggca

SEQ ID NO: 72134 - DNA, 86 bp, Mus musculus
gtatacatgtatgtgtgcatgtgcatgtgtgtgtgtgcgtgtggtaacaaagagtgtgtgtccatgcatatgtatctgtgtgcgtg

SEQ ID NO: 72135 - DNA, 85 bp, Mus musculus; identical to SEQ ID NO: 57470

SEQ ID NO: 72136 - DNA, 108 bp, Mus musculus
ggagcgaacacagacagtagacgtgacctgtgaaagaggatttttaagctaatgtttttctagttctaattctgtcagggagtttttggtgttggtggtaaactttcc

SEQ ID NO: 72137 - DNA, 133 bp, Mus musculus
tctaactgggtaggctgtcaaggctcagggctccagaccaacattccaataagcaggggtcaggtagaagctactgttctttaaagcccaactcaggccctaggacagagtcacttcctctggggatggtggt

SEQ ID NO: 72138 - DNA, 61 bp, Mus musculus
tatgtgtgtatatctgtgtgtgcaggggatgtgtgtgtgcacacatggatgtgggagcata

SEQ ID NO: 72139 - DNA, 67 bp, Mus musculus
caccttttgtctctctctgagtgtaggaggtactttcctactggagttttgggagagtgtgtgtgtg

SEQ ID NO: 72140 - DNA, 90 bp, Mus musculus
tgtaccaagaaccatgattagaaagcactcttaactggtgaggcatctctctagcatgtctgtctgtctgtctgtctgcctcttgagaca

SEQ ID NO: 72141 - DNA, 89 bp, Mus musculus
ctgttgacaagagggaaggcaggctgcacatagctctgagctcgcctcacacagctcagagcgtgcctctttcccagagatgaaaacag

SEQ ID NO: 72142 - DNA, 92 bp, Mus musculus
ttctgtacagtgtcttaccaatctaagacagaattacattgtttttgaaaatgtaaattccaaaatggataaggaaggcattcttgtcagaa

SEQ ID NO: 72143 - DNA, 60 bp, Mus musculus
tgtgtatgtgtgtgtgcatacaagtatgtgtaggtatgtgtgtgtacatgtgcatgtgta

SEQ ID NO: 72144 - DNA, 100 bp, Mus musculus
aggaggatcatgaactggaagccactggcctgaggggcaaagaaactgattttgttcatttgtttaaatcacatggcatctggttttctagatctgccct

SEQ ID NO: 72145 - DNA, 68 bp, Mus musculus
cttagagttagatggtgtttgcctttattcctagaacttggaggcagaggtagatggatctctgtgag

SEQ ID NO: 72146 - DNA, 87 bp, Mus musculus
ggggaacagagccacactgagtgactgagagaaaggtctggaaaggactctgctgctgccacactccaagccatgggcttcttcctt

SEQ ID NO: 72147 - DNA, 64 bp, Mus musculus
tgtgtgtgtgtgtgtgtgtgtgtgtgtttgcctgtgccagccacacactcatgcgtgtgccaca

SEQ ID NO: 72148 - DNA, 99 bp, Mus musculus
ggacagctgttggttataccagggatcactgcctgtctccgtccctctactgctggagtgacagatggtggctgctgccctaagctgatacataggtcc

SEQ ID NO: 72149 - DNA, 115 bp, Mus musculus
agatttaagagtactggtggactggagagatggctcagcagttaagagcactgactgctcttccagaggtcctgagttcaattcccagcaaccacatggtggctcacaaccatct

SEQ ID NO: 72150 - DNA, 74 bp, Mus musculus
gcgggctctgttcactgagagaagctgtcaaggcagacttgcaccaaccccactgtcactgacacacagcctgt

SEQ ID NO: 72151 - DNA, 102 bp, Mus musculus
tgggccacgcctactggtgatatggaagaaggaagttttcgctcattgcctgctaactctccctctcagtggcaagtccattccttcactgtaattagaggc

SEQ ID NO: 72152 - DNA, 99 bp, Mus musculus
tgttgtctgattgcacatgtatatgcatggatatacacatatatgtacacacatatacatgtatatagatatatgtacatacacaaacacagatgcaca

SEQ ID NO: 72153 - DNA, 115 bp, Mus musculus
agtctccaggttaaaaatgttgaactctggggctggagagatggctcagcagttaagagcactgactgctcttccagacgtcctgagttcaagtcccagcaacgatatggtggct

SEQ ID NO: 72154 - DNA, 112 bp, Mus musculus
agctcctacaaataaatccttagcaccctgcctgagtctctgtctatgtcactgctatgaagagtcgccataaccaagacaccgtaggaaagaaagcatttaactgggggct

SEQ ID NO: 72155 - DNA, 93 bp, Mus musculus
accctaaagttagacataccacactgtgcacacatcctgttggtcgccttttgtgttagtaaaaagtgcttgctgtccagatgactactgggt

SEQ ID NO: 72156 - DNA, 60 bp, Mus musculus
agcggggactgcgggcggggtcggcagccgcgcccggctcaccgtgtctgagtctgtgtt

SEQ ID NO: 72157 - DNA, 70 bp, Mus musculus
tgatgatggggctggaggagtagctcagcagctaagagcactgactgctcttccagaggtcctaagttca

SEQ ID NO: 72158 - DNA, 70 bp, Mus musculus
gtacgtgtatatgtgtgtgcatgtgcatgtgtgcatgtgtatgtgtgcaagcacacacgtatacacatgc

SEQ ID NO: 72159 - DNA, 89 bp, Mus musculus
ggtatatagattgtatgtatgtatgtatgtatgtatgtatgtatgcatgtatgtatatatgtatatttagagagaacaatataaatacc

SEQ ID NO: 72160 - DNA, 84 bp, Mus musculus
atagatagatatagattaggtatagatatagatgatctatctatctatctatctatctatctatctatctatctatctatctat

SEQ ID NO: 72161 - DNA, 169 bp, Mus musculus
gcatatagtaagtatatgtgtatatgtatatatgcatgtatatatatgtgtgtatgtatgtccctatgtatgcatgtgtatatatgtgtatgtgtatatgtatatgtgtatgtatgtgtgtatgcatgtatgtgtgtgtgcgtatatatatttatgtatgtgtgtacat

SEQ ID NO: 72162 - DNA, 105 bp, Mus musculus
tgggtattccgagcttctgggctaatgtccactcatcagtgagtgcatactgtgtgtgttctattgtgattgggttatctaggagagactcttatggaatgtcta

SEQ ID NO: 72163 - DNA, 89 bp, Mus musculus
agagacagagagacagagacaaacagagagacacacagagagatacttgtctccccctcagcctttccactgtcttgatcttggtcttt

SEQ ID NO: 72164 - DNA, 64 bp, Mus musculus
gtatctgtgtgtgtgtgcacgtgcatgtgtgtatgcatgtgcatgtgtctgtatacatttatgc

SEQ ID NO: 72165 - DNA, 80 bp, Mus musculus
ctgtctgagactgtgactcataacgcaccttttcctcttataaatgcattgttttatgtgtcttccacggtgatagacag

SEQ ID NO: 72166 - DNA, 64 bp, Mus musculus
cccgacttcagtctattggttgggtgtaagtatctgtgtctgtctcagtcagtggctgataggg

SEQ ID NO: 72167 - DNA, 128 bp, Mus musculus
tctcatttatgaaaagtctgtgaaaagagattgtaggatatctttgaaaagtcctaatcttatttatagttaaatgtagatgagaggcatgagaaaaaatatatttcctcaatcacaatttagaactt

SEQ ID NO: 72168 - DNA, 132 bp, Mus musculus
acagattatggcagagtcggggtttaaacccacacactgcaagtgggtaactctgtgtaactctctccttctgttcactatcttgacttcatagaaagaaaagaattcatgccagggtctttctttacccac

SEQ ID NO: 72169 - DNA, 91 bp, Mus musculus
gtatatatgtatgtataatgtgaatatatgtatatgtgtgcacatatgtgtatattatatgtgtatgtatatatgtatgtattatatgtat

SEQ ID NO: 72170 - DNA, 148 bp, Mus musculus
atatatacatatatatgtatatatacatacacatattatgtatatatacatatgtgtatatgtatagatacatacacacatatgtatacacacatatacatgtatagatacatacacatatatgtatatatacatatgtgtatatgta

SEQ ID NO: 72171 - DNA, 82 bp, Mus musculus
caatggctgacaggggctggaggctgaggatagggggtcaccgtggctcagactcagtctcacaaggtaaggtctcccagtg

SEQ ID NO: 72172 - DNA, 85 bp, Mus musculus; identical to SEQ ID NO: 58391

SEQ ID NO: 72173 - DNA, 94 bp, Mus musculus
gtttcttaaacaaaagccctgccagctcacaactgtcactctgacacaaggccaagtgatgggtgggtagcatagacagggtggataaagaaac

SEQ ID NO: 72174 - DNA, 64 bp, Mus musculus
tcctgccctgcctgcctgcctgcctgcgacctgcagaaggaccagaggccaggcctgggtggga

SEQ ID NO: 72175 - DNA, 68 bp, Mus musculus
actccactggatgacgcctgttccagtgcaaatggaacgctggtcacagtcgctctcacggtggttgt

SEQ ID NO: 72176 - DNA, 139 bp, Mus musculus
ctttatcagtggtgaagacatctaacggagggcatactcctggtgtttgtgttcacatgtgagtcagaagagacagaggcctgtgtacaggaggggtgctggagctcccggcaacccttctcctaacagttctgtgtct

SEQ ID NO: 72177 - DNA, 70 bp, Mus musculus
gcctcacaccacaactcagccacacgttggctctacaggactgtggcctctggctctgtgggactgtggc

SEQ ID NO: 72178 - DNA, 108 bp, Mus musculus
gtgtgtgtatgggagtgtgtgtatgcacatgtgtgtgtgtgtgaatctgtgtgtgtatgttcacacgtgtatgtatgtgtgtgcctatgggagtgtctgtatgcacac

SEQ ID NO: 72179 - DNA, 60 bp, Mus musculus
cctctcaggcacactcagaggctaacctgagcagacagccctcccagctgtgcccagagg

SEQ ID NO: 72180 - DNA, 110 bp, Mus musculus
tgctaagtactggcccgacagaaagatctgggtgcagtccagacgcacattctctcacacacaccaaactttgcttacccggattctctgacagtttaaagtggctagca

SEQ ID NO: 72181 - DNA, 73 bp, Mus musculus
ctgcaggcattctgtctgtctctgtggcccacactgcaggtctcagcgagcaggaaccagatgtgctctccag

SEQ ID NO: 72182 - DNA, 92 bp, Mus musculus
ggcagagggggctggatagatggctcagtggttaagagcacaggctgctcttccagaggtcctgagttcaaatctcagcaaccacatgtgct

SEQ ID NO: 72183 - DNA, 119 bp, Mus musculus
tggtagatgccttcagaggatagaagagaccatcagatgccctgaaacagttacagatgattgtgagctgtgcgtggatgctgaggaattggtcctgggtcccctggaataatggtcca

SEQ ID NO: 72184 - DNA, 58 bp, Mus musculus
gtggaagaagagagcagagtgaggactcacgtcttacagctctgtctgtggattctac

SEQ ID NO: 72185 - DNA, 83 bp, Mus musculus
tttttgagtcagggtctctctctgtatagccttggttgttgtgaaacttgctctatagaccaggctggccactaggtcagaga

SEQ ID NO: 72186 - DNA, 105 bp, Mus musculus
tttgatcaagttgcaatatatatatgtgtatatatacatatttcctgtattttacgactatatataaatatgtatacatatatattcatgaaattatagaacaaa

SEQ ID NO: 72187 - DNA, 73 bp, Mus musculus
gaaaatgtttgagggctggaaagatggctcagcagttaagagtgctgtctgctcttccagaggtcttaagttc

SEQ ID NO: 72188 - DNA, 111 bp, Mus musculus
cttaatcagattgacagttaagggtagaacctgagaggaggaacagtagacagcagtttggtgagagaaatctttagagacaaggtagtacatgaattgagtctgatggag

SEQ ID NO: 72189 - DNA, 85 bp, Mus musculus; identical to SEQ ID NO: 57439

SEQ ID NO: 72190 - DNA, 99 bp, Mus musculus
tatgtatggtgtgcatgctgtatgtatatgtatttgaatattacgtatgtggcatgtacatacatgtgtaatgtgtgtgtgaatgtacgtgtggatgcg

SEQ ID NO: 72191 - DNA, 82 bp, Mus musculus
ggggcttggacaggaggtttcaggcagggctctttttattatctgcattaaaaacactgtctgtctgtctgcctgtcccccc

SEQ ID NO: 72192 - DNA, 111 bp, Mus musculus
cacgagttccagatgacaagtgatgcttgaagtttccatgtctgctaatttatttttgattataacaatgggtatcttctaaaatataaacatcatttgctgggccaagtg

SEQ ID NO: 72193 - DNA, 167 bp, Mus musculus
gtataacattagggtgaactttgagatatcaaaagcccttgctaggctctctgtctctgtctctgcctttatctctgcctctgtcttctctgtcttctctctatatatatacatatatatagagagatagatagatagatagatagatagatagatagatagataga

SEQ ID NO: 72194 - DNA, 84 bp, Mus musculus
tatctatctatctatctatctatctatctctctatatatatgtatatatatagagagaagacagagaagacagaggcagagata

SEQ ID NO: 72195 - DNA, 82 bp, Mus musculus
tgtatatgtatatgtatatgtatatgtatgatagacatataccatgtatatgtgtatatatacatatataaatacatataca

SEQ ID NO: 72196 - DNA, 64 bp, Mus musculus
ggctggggtcataggaaggctacaggctgggcttgcttcctgtctggctccctgtgtcctggct

SEQ ID NO: 72197 - DNA, 77 bp, Mus musculus
gtgtgtgtgtgtgtgtgtgtgtgtttcctgatctccaatgatatgaggagtctctgccactcactcccactgacaca

SEQ ID NO: 72198 - DNA, 106 bp, Mus musculus
tgtagctcctcagtcctgagaaaatggccctggaaaatcagacagaagaaagttaggagacttctgcagctgtttgtcctgggagcacttatctggagaagccaca

SEQ ID NO: 72199 - DNA, 91 bp, Mus musculus
cacatgggcaccttgtcttctgtatatgttctggacacctgtgacatgcatggtatcaggtccaggggctacagagaggtgacatcatgtg

SEQ ID NO: 72200 - DNA, 71 bp, Mus musculus
gtctgtctgtaggtttgtatgcatgtatgtatgtgtgaaatatatatgcatgcatacttatgaagttggac

SEQ ID NO: 72201 - DNA, 79 bp, Mus musculus
ccaggttgccagccaatcacacagaaggatgtagatcttccatgccagtgtttgcctcagcctgtgtctgactccctgg

SEQ ID NO: 72202 - DNA, 79 bp, Mus musculus
ctggctgtgcctggaacatttgtgggatagtgagtgaggcgcattctctctctgcctctgtggactgggtactggctgg

SEQ ID NO: 72203 - DNA, 108 bp, Mus musculus
cctggcagggaatctggcagggagtggggagtcgcctaagtctcaggtgtgtgcccactgagtctctgggtctcaacctgctctaccttaccgagcttcctggcatgg

SEQ ID NO: 72204 - DNA, 85 bp, Mus musculus
ctgtccctatgtctgtctgtctgtctctaccaaagggctttgctctgtatttactgagcagcacagaaaatgaggcatgggaaag

SEQ ID NO: 72205 - DNA, 82 bp, Mus musculus
gtcaacctgatggaactgaaatcacctaggagacacctctgtgagtgtgtctgtgaggatgttttgagagatcagagaagac

SEQ ID NO: 72206 - DNA, 112 bp, Mus musculus
ttcaagttagacatcttcctgttcctgcctcctgagtgctgggattacaggtgcactctaccacacccagctttgaggaccacttctttcatgggccagagatgtctctgag

SEQ ID NO: 72207 - DNA, 101 bp, Mus musculus
gataccacagtagagggctggagagatggctcagaggttaagagcactgactgctcttccagaggtcctgagttcaaaccccagcaaccacatggtggttc

SEQ ID NO: 72208 - DNA, 81 bp, Mus musculus
gccaaggcttgggagagacccagaatgtcccttagcaatcttccagctatgggttctaggtagtttagttgtaggcatggt

SEQ ID NO: 72209 - DNA, 85 bp, Mus musculus
ttagctgactgggtggccagatacctagtagctgacagctggatgctgattgactgactgactgactggctgactgactggctga

SEQ ID NO: 72210 - DNA, 72 bp, Mus musculus
tcaagcatctacagcgcgagcttggtgtgtgtgtgtgcccgtgcggacctgtctgtgtgtgtctgtgcatga

SEQ ID NO: 72211 - DNA, 115 bp, Mus musculus
tggaggtggaaaggagacatggctaccatgtttggggttggcctggacacaaaagagacagtagtcacatctgtgctaaaactccccccaaccaaccgtgtctttcctgcttgta

SEQ ID NO: 72212 - DNA, 94 bp, Mus musculus
gcgacctcacacagacagaaatcacagtactctaatatccacttttgtctatcaggtcactgctgaaagaaagcctttgtatttgtgaggaagc

SEQ ID NO: 72213 - DNA, 114 bp, Mus musculus
gccacagaaagaagtggctagtgactgagtatctattggtgattttcacttaatgactagtgattatctactggtgatgggtacttaaggactagttattgcatatctactggt

SEQ ID NO: 72214 - DNA, 91 bp, Mus musculus
gctccttcctggaagaaagggtcactgcctctctgtcccaccagtcctgggcacaccctgggaaagatgtggctccttcactgggtggtgt

SEQ ID NO: 72215 - DNA, 63 bp, Mus musculus
ctggtctccctctccctgtctgtggctctgcatagagtggactggggtacctagggacactag

SEQ ID NO: 72216 - DNA, 94 bp, Mus musculus
tatatgtgtatgtgtgtatgtgtaaatgtgtatatgaatatatgtgtatatgcatatttatgtatatatgtatatatacacacatgtgtgtata

SEQ ID NO: 72217 - DNA, 87 bp, Mus musculus
accatggtcccagggggcatctctggctactcacgtcaggctgttcctcactgcctctgagtctccagttctgcctctcttcattgt

SEQ ID NO: 72218 - DNA, 116 bp, Mus musculus
aggtctgataaaaggcttttctgagtagtgtcttttagctatctacttgtctctggtaatgaagatcagaggtggcagtgactgaagacatccagaaggcacatgagggaggactt

SEQ ID NO: 72219 - DNA, 80 bp, Mus musculus
gtctagcctatggctcattgactgacaatggtctcatctgctggcggtttgtcacggtcagtgagtcacatggtgttgac

SEQ ID NO: 72220 - DNA, 83 bp, Mus musculus
gagacacatttctccctgtcacactgtctttccccttgaagtcatgatcctggcagagattgtgtgtaggaggcctgtgactc

SEQ ID NO: 72221 - DNA, 91 bp, Mus musculus
atgtgtcattatgctggaactttttttacatttttaagtggttaaaaatagcataagaaggtagtaccttgggtctggcatggtggcacat

SEQ ID NO: 72222 - DNA, 72 bp, Mus musculus
tggactgtgagaacacagtgtggggaaaagctgttctacagcaagaaactcttaaaactgtgacgcacacca

SEQ ID NO: 72223 - DNA, 93 bp, Mus musculus
ggatagccttgaacgtttggtaatcctcctgtctcagtatctgcagtggtgaaatgacaggagtgagtcaccacacctagctactggctctcc

SEQ ID NO: 72224 - DNA, 77 bp, Mus musculus
tcaagatctaggctttcactctgagttctcccgtgaaacaagagaatgagctcaagttgcctggccatggcttttga

SEQ ID NO: 72225 - DNA, 96 bp, Mus musculus
tgtcctttataagaggtcccttggtcatggtgtctgttcacagcaataaaaccctaagacagacagacagacagacagacactataatatctgaca

SEQ ID NO: 72226 - DNA, 85 bp, Mus musculus; identical to SEQ ID NO: 57439

SEQ ID NO: 72227 - DNA, 111 bp, Mus musculus
ggatatgtgtgtgtgaatatatatacatatatatatatatatacatatatatatacacatacatatacacacacatatatatgcatatatgtatgtatgtatatatgtatg

SEQ ID NO: 72228 - DNA, 108 bp, Mus musculus
ggacagtgaatggccttcgaaggctgctggaagagaagtcattatcttcagtgatgtagtcacaggtaagtgactctggctctacctgacagtgccacacccatgtcc

SEQ ID NO: 72229 - DNA, 74 bp, Mus musculus
gcctgtctgtgtctgtgtctgtgtgtacctgcacatctcagcttgtatgcagaagacaagtctctggagttggt

SEQ ID NO: 72230 - DNA, 81 bp, Mus musculus
tacatatacatataggaatatatattcatacatatatttatatgtgttcatatatgtatatgtatatgtatgtgtatgtgt

SEQ ID NO: 72231 - DNA, 74 bp, Mus musculus
ttcacacacgctgagtctgtgggagccatacctattcaaaccaccacagtgggctctatgaacagctgtttgaa

SEQ ID NO: 72232 - DNA, 109 bp, Mus musculus
ctgtttttcttttgttttgttagttcgtgcattgtggtaggacaacactagacattcgttgctttcaggatgtttactgagcatcatcttaaatagaagagggatacag

SEQ ID NO: 72233 - DNA, 119 bp, Mus musculus
tgcttcctgttcccagagacacagatgctcagaagcagaaccaatgaaacctctgccttggtctctgtttgcctgatctcaatccccctcctgtgcttcttggggacaagaccattgca

SEQ ID NO: 72234 - DNA, 69 bp, Mus musculus
gccactcactctgccagtgactcatgcaggggtggtgctgctgcaagctctggggtcagtttgaggggc

SEQ ID NO: 72235 - DNA, 86 bp, Mus musculus
tacatatgtgtgtatctctctccctcatatatagatatctatatctatatatgtatatagataagcagatacataggtagatagta

SEQ ID NO: 72236 - DNA, 86 bp, Mus musculus
tatataatatgcatatacacacatacatatactacatatatacatatgtatgtatgcatgtgtgtatgcacatatatccatatata

SEQ ID NO: 72237 - DNA, 175 bp, Mus musculus
gtgatatcttgggaggaggggggatggtagtgtggtttctctctctctccctctttctttcttcccttttacaggctatattgtgactcttcaatgacagaacacaatgacctctcagaccctagcccctttgaaggtatccagttgtcttgagcaatatgcacaaatagcctgt

SEQ ID NO: 72238 - DNA, 58 bp, Mus musculus
ctggattagggtcccctagacaacacacctcagtgtgtgtctgtgagagtatttccag

SEQ ID NO: 72239 - DNA, 77 bp, Mus musculus
tacatatgtatgaatgtgtgtagtatatgtgtgtgtgtccatctatgtatgaatctatgtatgcccatatgtatgta

SEQ ID NO: 72240 - DNA, 62 bp, Mus musculus
agcagacctgggagactggctctctgagtttcagtggtcagagcagtctctgcaggcaagct

SEQ ID NO: 72241 - DNA, 81 bp, Mus musculus
tgccttgagcttgagcagatctcatgtatgctgtcacatcacagtgagttcatgtatgaaatagtcctgttttgtctggca

SEQ ID NO: 72242 - DNA, 85 bp, Mus musculus; identical to SEQ ID NO: 57439

SEQ ID NO: 72243 - DNA, 102 bp, Mus musculus
atctgttggtcgagatgtatcactgggaggtggggggtgggttttgagctttaaaagccatactcagtctcattctctctggctcctacttgtttatcagat

SEQ ID NO: 72244 - DNA, 85 bp, Mus musculus; identical to SEQ ID NO: 57470

SEQ ID NO: 72245 - DNA, 88 bp, Mus musculus
ttggagctagaagtatgccattagtcactgtatggattatttagtagtatgtagtctgttaaaacagtgtgagtataatgtggcccag

SEQ ID NO: 72246 - DNA, 85 bp, Mus musculus; identical to SEQ ID NO: 57439

SEQ ID NO: 72247 - DNA, 75 bp, Mus musculus
gtgatgctgagattctgggtgtgtcagaggttttggcagtcaactttctctgagactctgagatactggtgtggc

SEQ ID NO: 72248 - DNA, 69 bp, Mus musculus
ggctacaaatggttattaggcccattgttgcacattaattgtgtagctggatttgaaatcctgtgtgtc

SEQ ID NO: 72249 - DNA, 75 bp, Mus musculus
tttgagaagaacgctgtgtcgtcgctcttttctgctggtcggagacagaagtgacaggagacattttttttcaag

SEQ ID NO: 72250 - DNA, 87 bp, Mus musculus
tgcaacatatatatatatatatatatatgtctgagataacatggcaccgttataacatatatatgtacatatatatatgtgtgtgta

SEQ ID NO: 72251 - DNA, 77 bp, Mus musculus
aggccagacacacagaacagtttgattctatttatataaagtcccaggatagaaaaaattcttctgtgatatggcct

SEQ ID NO: 72252 - DNA, 86 bp, Mus musculus
ggccatggtggtctgataggatacatgggacaatttcaatatttttgtatctgttggaggcctgttttgtgaccaattatatggtc

SEQ ID NO: 72253 - DNA, 65 bp, Mus musculus
ctgtctgtctgtctgtctatttattgaggggtataacctctctaattcacctgactggccaacag

SEQ ID NO: 72254 - DNA, 77 bp, Mus musculus
ttgcagatgccaacaagagcttgctgacaggaggctgatatagctgtctcctgagaggctctgtcagtgcctgacaa

SEQ ID NO: 72255 - DNA, 85 bp, Mus musculus; identical to SEQ ID NO: 57439

SEQ ID NO: 72256 - DNA, 84 bp, Mus musculus
cagcaacagcagtggcagcaaatgatgatttttcttttattaaaagagtcggttttcatttgattagtctgcactgagcagctg

SEQ ID NO: 72257 - DNA, 103 bp, Mus musculus
taggtaaagttctgtgaataaattgaacaatgagttctgtttttcaagtaaggggtcaccatttacttgaatattaactcagaaaatgtcaactgaattccta

SEQ ID NO: 72258 - DNA, 85 bp, Mus musculus; identical to SEQ ID NO: 57470

SEQ ID NO: 72259 - DNA, 90 bp, Mus musculus
gtttacatatccagtctgttactttatatctttttaatggagaattaagtccattgccattaagagatattaaggaatagtgattgttgc

SEQ ID NO: 72260 - DNA, 94 bp, Mus musculus
catacatacaaatatatatgtatgtatgtatgtatgtatgtgcatgtatgtatgtatgtatgtatgtatatgtattatgtatatatatcctttg

SEQ ID NO: 72261 - DNA, 82 bp, Mus musculus
gtgtgtgtgtgtgtgtgtgtgtgtgtgtgcgctcataaagaaaatccttatgaaagactcacactttatttatatttcaggc

SEQ ID NO: 72262 - DNA, 140 bp, Mus musculus
tcagtttgagtttggtaattaaatagtctcttaagtatagttggagaggaaaatgaatgtttttgttttcttttgctgctgacataagacattctgatcagaagtagcctggtggaaagaaggatttttttttttccaat

SEQ ID NO: 72263 - DNA, 125 bp, Mus musculus
gttttcttcatctgcgggagacatcttggatcccagactccacctagactactctgcacagaggataggtatctgtctgacccaggagggggttgcctgagcatctgtgggagacatcttggatc

SEQ ID NO: 72264 - DNA, 110 bp, Mus musculus
cagactagacaattatcttcaatatacccaagtatatatatgtgcattatatgattttatatatatatgcacatatatatgtatatatagaaaatagatgctgtctgtct

SEQ ID NO: 72265 - DNA, 70 bp, Mus musculus
tgtctgtctgtctgtctgtctgtctaactatctcctatgagatagagatagacatatacatatatagata

SEQ ID NO: 72266 - DNA, 77 bp, Mus musculus
ttctgaagttagaagcagcagtctcagcttcagccccaggaaagtctgtgaccctgactgtgtctgacttctctgaa

SEQ ID NO: 72267 - DNA, 62 bp, Mus musculus
agaagtcagacacagtcagggtcacagactttcctggggctgaagctgagactgctgcttct

SEQ ID NO: 72268 - DNA, 182 bp, Mus musculus
gcatttctgtattcatattcctttccaaaattatatatgtgtgtatgtatgtatgtatatatacatatttatatgtgtgtctatgtgtttgtgtcatatatatcataagatatatatatatatatatacacacacacatatatatatatatatatacatttatacacatacatacacacata

SEQ ID NO: 72269 - DNA, 89 bp, Mus musculus
tggcccttagtctaagtcttctgtttatgttattcaagagaaaattccattggtggtgtttggtagaagacttatagtctagattgcta

SEQ ID NO: 72270 - DNA, 112 bp, Mus musculus; identical to SEQ ID NO: 57513

SEQ ID NO: 72271 - DNA, 117 bp, Mus musculus
gttgccctggctgtccttgaacttgttatgtaaagtaggctggatatgaactcatagagatctgtctgtttctgtctcctgagtattccattaaatgtagaccacagtaggcccaac

SEQ ID NO: 72272 - DNA, 99 bp, Mus musculus
gcatatatatgtatatatatgtgtgtgtgtgtatatacatatatatgtatatatgtatatacgtatatatgtatacacacacacacacacacacataca

SEQ ID NO: 72273 - DNA, 85 bp, Mus musculus
ggtacatcatgaagttgtatgccatatgttcaagatgctggtcctgcctgtatcagtgaagactctgtgcacacagatgatcacc

SEQ ID NO: 72274 - DNA, 91 bp, Mus musculus
ccaattgtccacaatgcataattagaactgagcctatcctgccttaggtagttggttttattcagataattgtgtattagtaacaggttgg

SEQ ID NO: 72275 - DNA, 100 bp, Mus musculus
ccttgaactgatgatcctccaatctctacctcacctccagattatataattatatctgttattagccctggtttatttggggatgtggatcaatctgagg

SEQ ID NO: 72276 - DNA, 66 bp, Mus musculus
atatatatacatatatatgtgtatatatacatatttacatgtgtttatatgtgtttgtatatatat

SEQ ID NO: 72277 - DNA, 95 bp, Mus musculus
tggtgatcagaggtcagttcagtgtctagttttcaggagccatccaccttgtttttctgaaagactctctcacttagctagcctctgggctgcca

SEQ ID NO: 72278 - DNA, 85 bp, Mus musculus; identical to SEQ ID NO: 57439

SEQ ID NO: 72279 - DNA, 116 bp, Mus musculus
tatacattttcatatacttatcaatcacaaacctaaggatatctagctgttacagtgtacctcttttgcagaattgtaaaagttggttcaagtgtgtgtgtgtgtgtgtgtgtgtg

SEQ ID NO: 72280 - DNA, 66 bp, Mus musculus
gtgtgtgtgtgtgtgtgtatacatatgtatatatgtgtatatatgtgtatatatacatatgtatat

SEQ ID NO: 72281 - DNA, 58 bp, Mus musculus
atacattcatatatatatacatatacacatgtatatgtatatgtatatgtatatgtat

SEQ ID NO: 72282 - DNA, 115 bp, Mus musculus
aaatgtgtggctccttttttaactattgtaatttttagatgtattcataatagaaagtatagaattttctactatcagctagcatatgaaggcagtgggactgggagaagaattt

SEQ ID NO: 72283 - DNA, 100 bp, Mus musculus
ataattggtattgcatgcacatatatatgtatatatacatacatacatatatatatatatatatatatatatatcattcagtgcatataatgctatgtgt

SEQ ID NO: 72284 - DNA, 85 bp, Mus musculus; identical to SEQ ID NO: 57439

SEQ ID NO: 72285 - DNA, 116 bp, Mus musculus
atattacattattttacagtgcttttgaagacatttagttgtgaaatttctatccatacagtagagaattttttgatgtctcctgaaagagttataacactgtgtataacaaatat

SEQ ID NO: 72286 - DNA, 69 bp, Mus musculus
gcttgctgacaggagcctgatatagctgtctcctgagagtctctgtcagtgcctgacaaatacagaagt

SEQ ID NO: 72287 - DNA, 97 bp, Mus musculus
gggagtctgcctagctattccagagtctacatccaatcctacacgtgctcacctgcaggtgagctccaaggatgatttggtggaaatgggctttccc

SEQ ID NO: 72288 - DNA, 85 bp, Mus musculus; identical to SEQ ID NO: 57470

SEQ ID NO: 72289 - DNA, 157 bp, Mus musculus
tgtatgtatatatatatatatatatatatatatgtgtgtgtgtatatatatgtgtgtgtgtgtgtatatatatatacatatatatatatatatatatatatatatatatatatatatatatgtgtatgtgtgtgtgcatgtgcatggacatctatgt

SEQ ID NO: 72290 - DNA, 78 bp, Mus musculus; identical to SEQ ID NO: 63566

SEQ ID NO: 72291 - DNA, 107 bp, Mus musculus
gtccagtgggagagtgcttctctagctttcatgaacccgagctcagttcctcaacaccccatgaactgcaactggaagtgcaattgctataaatcccaaggtaggac

SEQ ID NO: 72292 - DNA, 83 bp, Mus musculus
gcaaggaaaagaagtgtggatgaaagggtagactgtgggacactctgacacagtttctacacaatgtttttttttttctttgt

SEQ ID NO: 72293 - DNA, 85 bp, Mus musculus; identical to SEQ ID NO: 57439

SEQ ID NO: 72294 - DNA, 69 bp, Mus musculus
tgagtatatatgcatatgtacatatacgtaagattttatatatacatatatgtacatatatgtatgcca

SEQ ID NO: 72295 - DNA, 118 bp, Mus musculus
caatatatgttttactattagtggagatttaattcaggatttttgtgtttggtaaacaagcactttgtcatgaaattatacttccaacattaattttttttaagacagcattttattg

SEQ ID NO: 72296 - DNA, 97 bp, Mus musculus
ttccagtgttgatagatcatatatataccataaggaatattttaaagaaaagagttcctcttaggtacagaagtgattttgtttttaaaactgtggg

SEQ ID NO: 72297 - DNA, 60 bp, Mus musculus
gctctcagactcactgtcatacaccatgcaggggtagaggaccgtggcgccctgagtagc

SEQ ID NO: 72298 - DNA, 109 bp, Mus musculus
ctctgtctctgtttctcagtccctctgtctgcccccttctctctctcacacacacactcacagagagagacagaaagacagagagagacaaagagagacagagacagag

SEQ ID NO: 72299 - DNA, 115 bp, Mus musculus
accatttttgtattcatggactctgccacaagtatttgttaccaaaagatctaaaggtaaatatatatgtttttcaaaaggtgacaatcttgctgccttaggagaccagtggtat

SEQ ID NO: 72300 - DNA, 100 bp, Mus musculus
gctattgaagatcagccttagtccatggtgatcagataggatgcatgggataatttcaatatttttgtatctgtcaactttggaggaggtaacatgtggc

SEQ ID NO: 72301 - DNA, 113 bp, Mus musculus
gtgtgcatttggtttttgaaaagtcattttgatgatgattgaaaaggtcatgatttttttttttttaattcttagatacccaggagtggccacttaaatagccatttgctagc

SEQ ID NO: 72302 - DNA, 84 bp, Mus musculus
ttccaacttcagtgtctatttctttttctataccagaactcttctctgtgatggtaggggagatatttacagcgtgaggaggaa

SEQ ID NO: 72303 - DNA, 106 bp, Mus musculus
gccttagtgcatggtgatctgataggatgcatgggacaatttcaatatttttgtatctgttgaggcctgttttgtgacttattatgtggtcaattttggagaaggt

SEQ ID NO: 72304 - DNA, 115 bp, Mus musculus
atctccattagttcactgttctgtcaagcagttgccaaatactgactatttatatttataaaagctgtactcttggcacaggaatggacaacagtgcttgcaactgcttggaggt

SEQ ID NO: 72305 - DNA, 103 bp, Mus musculus
agatgcatcctatccattcagctatccttcagaagacaagagatttttttttactaaaggctttgtgttcactggggaggggtgtgtgtgtgtgtgtgtgtgt

SEQ ID NO: 72306 - DNA, 85 bp, Mus musculus; identical to SEQ ID NO: 57470

SEQ ID NO: 72307 - DNA, 77 bp, Mus musculus
tttcccagacagaaaatagagtccacaagctgggcaccaccctctactcatgtctgtatagtctgaaacctgggaaa

SEQ ID NO: 72308 - DNA, 116 bp, Mus musculus
atgtaggagcacactgtcttttgtccatccatatatcacaggtcttcctgacgcacagtctgtgtgggtgactcacttgtaggtgtggatgatggatgaaagattacatattcaca

SEQ ID NO: 72309 - DNA, 68 bp, Mus musculus
cctgtctgtctatctgtctgtctgtctgtctcatggtgggggggggggtgccagagccttgcaacagg

SEQ ID NO: 72310 - DNA, 86 bp, Mus musculus
tgctacatgaattaatgagaccaatgactctatatggtcccacaataatctgcttgccatgtgtctctgtctcagttttggcagca

SEQ ID NO: 72311 - DNA, 76 bp, Mus musculus
aggggcccctgacttcagtctaattgttgggtgtaagtatctatctctgtctcagtcagctgctgttaggacctct

SEQ ID NO: 72312 - DNA, 111 bp, Mus musculus
tgatcccagaacagttttaagtgaagcatgcagagatgcaggtagtaaaagatttgttagtctctcacactgtaacatctcatcattttcacttgaaaaagaatggggtca

SEQ ID NO: 72313 - DNA, 117 bp, Mus musculus
ctagttattgtctgtatttacggctcccctgaagtgcctgacagatatatttatttaatctttgctgtattcttgtctgtagagtcaaattaaagggggagtagtggacagctggac

SEQ ID NO: 72314 - DNA, 85 bp, Mus musculus; identical to SEQ ID NO: 63165

SEQ ID NO: 72315 - DNA, 85 bp, Mus musculus; identical to SEQ ID NO: 57439

SEQ ID NO: 72316 - DNA, 67 bp, Mus musculus
aactcgagtgtgagaggagacagtgtcccttcagggcattgtgtttcttctccttttaaacaaggtt

SEQ ID NO: 72317 - DNA, 85 bp, Mus musculus; identical to SEQ ID NO: 57439

SEQ ID NO: 72318 - DNA, 114 bp, Mus musculus
gaaagcatagcttggcccttcttcaaagcatgtaaacatatgcatacatacaattatgtatgtatatttgtacctgttttttatttaggcaaagtgatagaataacatgccttt

SEQ ID NO: 72319 - DNA, 76 bp, Mus musculus
ataggatcctcatatgaatcagaacactctgaaactatctttcagggtgtctctgtgtcttagtcaaggtttctat

SEQ ID NO: 72320 - DNA, 110 bp, Mus musculus
gcgaatctagatgtgagctcatcccagtgtgaccattttgacactagacagtgtgcttcataaagctgttaccagttcaataaatcatgactggccatgtcttctttggt

SEQ ID NO: 72321 - DNA, 85 bp, Mus musculus; identical to SEQ ID NO: 63858

SEQ ID NO: 72322 - DNA, 85 bp, Mus musculus; identical to SEQ ID NO: 57470

SEQ ID NO: 72323 - DNA, 90 bp, Mus musculus
gggcacagtacagaggagcttattaagtcagtggttctaggtatggcaccaggcttcattctctgatctgtctctctttggtgcatgtcc

SEQ ID NO: 72324 - DNA, 86 bp, Mus musculus
ggtactcagaatcatggaaagattacattggtcatgacacttttgtcatgctcactcctgtctgtctgtctgtctgtctgtctgcc

SEQ ID NO: 72325 - DNA, 102 bp, Mus musculus
gtatatttgtgtgtgcatatgtgtatttgagtgtttgtgtatctttatgtctgtgtgtgtctctctgggtatgtttgtatgtctgtgtatatgcatgtgtgc

SEQ ID NO: 72326 - DNA, 81 bp, Mus musculus
atgtatatatgtatatatgtctgtctgtctatatgcatgtgcatacataggtagatgtataggtgtatgtgtatgtatata

SEQ ID NO: 72327 - DNA, 84 bp, Mus musculus
atttatttaatgtatatgagcactctgtctgtctgcctggaggccagaagacagcgtcagatctcaatatagatggttctgagt

SEQ ID NO: 72328 - DNA, 85 bp, Mus musculus
catgtccagcttgaccatgtctcacctctgagccatcactgcgctctcgctgactgtttcactgagtcatgatatgctgtctgtg

SEQ ID NO: 72329 - DNA, 73 bp, Mus musculus
tttttaaggtctgaactggcttcctctgtgtagaaatggacggtgaggtagaacgttgcaggatccttgagga

SEQ ID NO: 72330 - DNA, 75 bp, Mus musculus
ctgaccacagtcagtctcacacaccgcatgtcactgctgtccttatgtgtgctgtggcattgtctaattgggagg

SEQ ID NO: 72331 - DNA, 83 bp, Mus musculus
ggttgagtaagtaaagaagtctgttgatctgggaggaccttttgtcatttccctgttggcctgacttgcctctactcatcagc

SEQ ID NO: 72332 - DNA, 72 bp, Mus musculus
agagagctaagtggaaggttccagtacacgcatgctctaatgtatcagcaactgcatcttctaacagctcct

SEQ ID NO: 72333 - DNA, 64 bp, Mus musculus
ctattgtctgtctgtctgtctgtctacctatctatctatagacaggctctcgcatagaaaatag

SEQ ID NO: 72334 - DNA, 108 bp, Mus musculus
gccagggggggggcacactggagtgacccacctgcacgattgtgtgtgcgtgcctgtgtgcctgcttgcctgcgtgcctgcttgcctgctctggcaggtgtttgggca

SEQ ID NO: 72335 - DNA, 89 bp, Mus musculus
gtatgtgattatcaggaatcaggttgtttacttgagagatttttcagtctctttgtcattggtaagcaagaatactactaattgtatgc

SEQ ID NO: 72336 - DNA, 82 bp, Mus musculus
gagtatgtttgtggatgtgcatgtggaggctagagaaggatctagaagaacctatatcatctccaccttatgtcctgagaca

SEQ ID NO: 72337 - DNA, 93 bp, Mus musculus
gtgcttagcatatgtgtgtgtaggggtatgtaagtatgtatgtatgtatgtatgtatgtatgtatgtatgtatgtatgtatgtatgtaagtac

SEQ ID NO: 72338 - DNA, 74 bp, Mus musculus
tttttgttgtcagcacattggtgacaggagccactgattcccaagtgtatcccacccagtgtctatagtagaaa

SEQ ID NO: 72339 - DNA, 73 bp, Mus musculus
atggccactgcctatcagcaatgactatcagtgactatcactgactatcagtgtcatggttgaacagagccat

SEQ ID NO: 72340 - DNA, 134 bp, Mus musculus
tcatctctacctggagagtgcagaagcagctcttccataacgctcagtgaggatgctgacttctctcactctcaggctcacagctagagtatgaatcccaggctgtcccacccctgatcttttatgtcacctgc

SEQ ID NO: 72341 - DNA, 78 bp, Mus musculus
gctgactggctgactctttctcaccgctgtgaactctttgttaatcctctctcaggtagtggagagtgtctgcccagc

SEQ ID NO: 72342 - DNA, 58 bp, Mus musculus
cccaagctcaagcccagcgggtggggtcagagcctggctggctggctggctggctggg

SEQ ID NO: 72343 - DNA, 86 bp, Mus musculus
caggttctgttgaaaatccctgtcccacgatgtgctgagtagtctgtctcccagtggctcacacacagtgattcagaagctgcctg

SEQ ID NO: 72344 - DNA, 120 bp, Mus musculus
atgtaaaagtatgtgtgcatgtgtttatatatgcattctacatgtgtgcatttatttatgtatatctatgcatgcatttgtgaaagtgtgtgtgcatgcgcgtgtgcgtgtgcgtgtgca

SEQ ID NO: 72345 - DNA, 71 bp, Mus musculus
ctgtgtccgtgtcactgccgctctgctccccacccgagggagcaaaagtccgctggatgactggcacacag

SEQ ID NO: 72346 - DNA, 76 bp, Mus musculus
atatatatgtgcatgtgtatgtatatatatatgtgcatatatgtgtatgtgtgtatatatacacacacatatatat

SEQ ID NO: 72347 - DNA, 84 bp, Mus musculus
gcagtccagggtacaaattctttttggctggaggaaagaggtgcctccctgcctgcctgcctgcctgctgcctgcctctgaggc

SEQ ID NO: 72348 - DNA, 110 bp, Mus musculus
cggctgagcttctcagtctggcttctcagccatgaggtgaggtgtggtggggcgatttcctctccgtgactcagtggctcaactcccccaacagacgggatctctagctg

SEQ ID NO: 72349 - DNA, 74 bp, Mus musculus
agtatttagagtggaaatgagttttaatcctgaagcctgcggtgtagggtggctccctctctgtcagtaatact

SEQ ID NO: 72350 - DNA, 94 bp, Mus musculus
ttcctcttatatctgtgtctctgtgtgtgtccctaacaaaaggctttgctctgtcttcactgaacagcacagaaagcatcacatgggaaaggaa

SEQ ID NO: 72351 - DNA, 106 bp, Mus musculus
ggctaatactgcaagttgaaaccattattacttttttctttgtgctacagaggattgatcttagggtcccacatgtggctggccaaaggctctatcccttagacaa

SEQ ID NO: 72352 - DNA, 73 bp, Mus musculus
gctctccctaacagactcagtgactgactcagtccccctgcagtctgggtcagtctgtgactgtgtggctggc

SEQ ID NO: 72353 - DNA, 63 bp, Mus musculus
tgcacatatgcttatatgtatgtatatatgtatgtatgtatgtatgatgtgtggttatgtgta

SEQ ID NO: 72354 - DNA, 103 bp, Mus musculus
gccctcgtgttgccagatgttgttcatgccgcaggggaagaattgtcttactcagcttgtaccttgtatgcaataataccaatcccccgggtaagatgagctc

SEQ ID NO: 72355 - DNA, 68 bp, Mus musculus
acacacacacacacacatatgcatatacacatatatatgtacatatgtatacatgtatgtgtatgtgt

SEQ ID NO: 72356 - DNA, 85 bp, Mus musculus; identical to SEQ ID NO: 57470

SEQ ID NO: 72357 - DNA, 118 bp, Mus musculus
gattccaccaaaggttcttttatccttgagaagagtttttgctgtcctagattttttgttattctagatgaatttgcagattgctctttctaattcgttgaagaattgagttggaatt

SEQ ID NO: 72358 - DNA, 70 bp, Mus musculus
gtatatatgtatgtatgtatgtatgtatgtatgtatgtatgtatgtatatatgtatgtgtatatgtatgt

SEQ ID NO: 72359 - DNA, 75 bp, Mus musculus
cttctgtagagtgtcagctcagggagagactggcttttcttgtatttatttttagctgaaacttgaagacagagg

SEQ ID NO: 72360 - DNA, 85 bp, Mus musculus
gttccatatatatgtagtatatatactatatatgcaattatgtatatttatacatatgtatatttgtactttatatatagcatac

SEQ ID NO: 72361 - DNA, 68 bp, Mus musculus
agtgagtaataagtagtactccttttagtgaaatacagaatatagacaggagtgctaggaagctcact

SEQ ID NO: 72362 - DNA, 83 bp, Mus musculus
catgggacaatttcaatatttttgtatctgttgaggcctgtttcgtgaccaattatatgttcaattttggagaaggtcccgtg

SEQ ID NO: 72363 - DNA, 68 bp, Mus musculus
gtctcaggctctgtctcccacttcctgcttggcatgtagacacctaaggggaaacatagacttgggac

SEQ ID NO: 72364 - DNA, 85 bp, Mus musculus; identical to SEQ ID NO: 57439

SEQ ID NO: 72365 - DNA, 97 bp, Mus musculus
ttcatcataactttagtgcaaatgtgtatatgatataaacttttgtttatatacaatgaaatttatgacactttaaatgcacaatgagttacttgga

SEQ ID NO: 72366 - DNA, 71 bp, Mus musculus
tacaaatacatgtgcgttttgcatgtgtatgaatgtgtttgtgcatgtgcttgtctctatgtatgtttgtg

SEQ ID NO: 72367 - DNA, 81 bp, Mus musculus
aactctaggcaggatccaggatcacgggaagtttagacttttgtctcaaaaatctctgtctctgtctctgatgtttaagtt

SEQ ID NO: 72368 - DNA, 85 bp, Mus musculus; identical to SEQ ID NO: 57470

SEQ ID NO: 72369 - DNA, 69 bp, Mus musculus
gttagggccctcaatctcagtcctgctgttggctcagagcatctgcatctgtattggtgaggctctggc

SEQ ID NO: 72370 - DNA, 134 bp, Mus musculus
gtacaagtgcagatagtgtgatgtgagcagcagtgagttccataaagaactgtgtgtgcatgtgcatgtatgtgtgaatatatatatatatatgctatattatatacaaacatataacatacacatagatatat

SEQ ID NO: 72371 - DNA, 77 bp, Mus musculus
gagggtgtgctaaggagtgtggtccatgtgatagacattttcctaacagtctccgtcactgacaactcaggtccttc

SEQ ID NO: 72372 - DNA, 87 bp, Mus musculus
tgccatggcatttcctgagctcagacagaaaggatttgatggaaagcttccttttagaatgtctggctctgagtctctgcatctgta

SEQ ID NO: 72373 - DNA, 102 bp, Mus musculus
tcagtcttaggccatggtggtctgataggatacatgggacaatttcaatatttttgtatctattgaggcctgttttgtgaccaactatatggtcaattttgg

SEQ ID NO: 72374 - DNA, 95 bp, Mus musculus
gtgtgttcaagaagtgtttgtaatcttatcacactcatgttggagaagttaagaactatttctttaaatgtagtgaagtttgttactttccacac

SEQ ID NO: 72375 - DNA, 151 bp, Mus musculus
tgcacatacatacagatacataatatagacacacacacatatgtgtatatatatatatgtatatatatgtatatgcatatatgtatatatatacatacacatatacacacacacatatatatgtatatgtatatatgtatatgtatatgta

SEQ ID NO: 72376 - DNA, 105 bp, Mus musculus
tacatatacatatacatatatacatatacatatatatgtgtgtgtgtatatgtgtatgtatatatatacatatatgcatatacatatatatacatatatatatat

SEQ ID NO: 72377 - DNA, 78 bp, Mus musculus
aaggctatatgaggtggccacttcaggctccatatcattccagctaggagtctcaatctgagtcacactcatagcctt

SEQ ID NO: 72378 - DNA, 94 bp, Mus musculus
agaattaatgtatgtgtataggtaagtacgtacgtatgtatgtattcatgtatgtatgtattcatgtatgtatgtatgtatgtatattcactct

SEQ ID NO: 72379 - DNA, 59 bp, Mus musculus
ctcactgatttttattttatattcactggcctacgctagtgctaaatggaaagagtgag

SEQ ID NO: 72380 - DNA, 90 bp, Mus musculus
gtgcagccagtctgtacattgaggatgtgctctgtgtttgaatcccaaactgaggtagagagcaatgaagacagggatggagaggggtat

SEQ ID NO: 72381 - DNA, 89 bp, Mus musculus
tctgagaatttctgagtgtaagagcatttgcatgtggtgtattcatgagtgtatacatgtacatatgcttacaccgaggtcagagttct

SEQ ID NO: 72382 - DNA, 60 bp, Mus musculus
ctctctatctctctcaatttctctctacaaataaagagagagagggggagggagggggag

SEQ ID NO: 72383 - DNA, 86 bp, Mus musculus
gaagttaccctgggtcaccttgttggcagaggcagttctcaggtctgtgctgagttctctctgtttctaggcatgttatttgcttc

SEQ ID NO: 72384 - DNA, 92 bp, Mus musculus
tgtttattcagcttacacttccacattgctgttcatcactgaaggaagtcagcactggaactcaagcaggtcaggaagcaggagcagatgca

SEQ ID NO: 72385 - DNA, 91 bp, Mus musculus
ccagatttggggactagagagacagctcagtttttaagagcactgactgctcttccagaggtcctgagttcaattctcagcacccacatgg

SEQ ID NO: 72386 - DNA, 78 bp, Mus musculus
cactggctgggacttcaagaacaaggttgaataggtagggagaaagtgggcaaccttgtctagtccccgattttagtg

SEQ ID NO: 72387 - DNA, 90 bp, Mus musculus
ggggaaagcaggcattagttcatttagtcagtttcagatatttattaattaatcttgctgctaagaactattctaggcactggtggtctt

SEQ ID NO: 72388 - DNA, 110 bp, Mus musculus
aatcgaagttagtagtcagatatggaattggtgtgtgtatttctgggtaggtaatttttttcattaatgatatagatctcctcatttgtagatactagctgtctgtgatt

SEQ ID NO: 72389 - DNA, 148 bp, Mus musculus
tccccagtgtattaactagttttttatttctgtaacaaaacaacatgtcccaggtaattcagagaaacaagaggttatttggggactagagagatggctcagtggttaagagcactgactgctcttccagaggtcctcagttcaattc

SEQ ID NO: 72390 - DNA, 74 bp, Mus musculus
ctaggtgtctgagaggttggccctggggcttacaatctggcctcactgtgggtctcgtctctctctgtgtcttg

SEQ ID NO: 72391 - DNA, 87 bp, Mus musculus
gtgtgcatttgtgaatgtgtgtctctgtgtgtgtgtaagagagagacagagacacagagagagacatagagagagacagaaacacac

SEQ ID NO: 72392 - DNA, 117 bp, Mus musculus
tgctgttagcaattagataaacttctatagtcagtaattaagatgtgtgaaaaaagacagtgtacagggtgcttgcatattttatttatacttttgtttccatgggtgttttaagca

SEQ ID NO: 72393 - DNA, 106 bp, Mus musculus
gccttaatccatgatgatctgacaggaagcatgggacaatttcaatatttttgtatctgttgaggcctgttttgtgaccaattgtatagccaattttggagaaggt

SEQ ID NO: 72394 - DNA, 106 bp, Mus musculus
gatggcatcctattttctcaatagccacctttgcaattgtctgctccctgatcaaagtgtgcacaggcagaggtcagctgtatatcagaagatttcgtttgccatc

SEQ ID NO: 72395 - DNA, 103 bp, Mus musculus
atacagaaaacagaaccactgcaacatttttacagtatatatatatttttttacagtatatatatatatatgtgtgtgtgtgtgtgtgtgtgtgtgtgtgtgt

SEQ ID NO: 72396 - DNA, 85 bp, Mus musculus; identical to SEQ ID NO: 57439

SEQ ID NO: 72397 - DNA, 141 bp, Mus musculus
atatttatacagatatcacacacaaacatatatatatatatgtgtgtgtgtatatatatatatatatatatatgtgtgtgtgtgtgtgtgtgtgtgtatatatatatatatatatatatacatatatgtgaatatcttatg

SEQ ID NO: 72398 - DNA, 85 bp, Mus musculus; identical to SEQ ID NO: 57439

SEQ ID NO: 72399 - DNA, 85 bp, Mus musculus
tcacagacagctgacagctcatggtgccagcctcctcaggactgcaaacccatagaaaagaaagtaaactgttcatgtctagtga

SEQ ID NO: 72400 - DNA, 147 bp, Mus musculus
atatatatacatatatatagttttacatttatctatatgtatatatatgtgtatatatgtgtatatatatgtatatacatgtatatatatatatgtgtgtgtgtatatatacgtatatacacgtatatatatgtgtatatatatgtg

SEQ ID NO: 72401 - DNA, 160 bp, Mus musculus
gcaataaaataagcatggagattcaagagcatattgtcacatggaaaaagccaatgtgtgtgtgtgtgtgtgtgtgtgtgtgtgtgcgtgtgtgtacgtatgtatgtatgtatgtatgtatgtatgtatgtatgtatgtatgattccagttgcatgccat

SEQ ID NO: 72402 - DNA, 57 bp, Mus musculus
tatgtatataatatatatatatacatgtatgtatgtatgtatgtatgtatgtatgta

SEQ ID NO: 72403 - DNA, 113 bp, Mus musculus
cagtccaaattaaataaggcaccgattcactctcctgcttagttttggtcaatttgacacaaatgagagtggtctgggaaatgtgaataaagcctttgctttattaatgattg

SEQ ID NO: 72404 - DNA, 72 bp, Mus musculus
cacacacacacacacacacacacacacacacacacacgtgtgtgtgtgtgtatgtatatgtatgtgtatgtg

SEQ ID NO: 72405 - DNA, 118 bp, Mus musculus
tccccacacagagtgggctagcctcaggaaaaagcccttgatttcattgactcattttgttgttttgagacaagtttttgctgtgtagctctgactagtacagatctggttgtgaaga

SEQ ID NO: 72406 - DNA, 78 bp, Mus musculus
gggcagggtgtcagtgatgctttgggggtctatcaggttgaacttggtcgaacttagtctgtcactgacaccctgtct

SEQ ID NO: 72407 - DNA, 100 bp, Mus musculus
tgcattggaagcatttatccctccacagtgctgacaggttctgacacagtgacttaagagaggcagcactctgggctttgaaagataaaccagctgtacc

SEQ ID NO: 72408 - DNA, 90 bp, Mus musculus
tgcactaggaggagaaatagacttgagacagattcatgaccaaaggaaagcattctaggtcaggtccagggataaggccacaggtgtgca

SEQ ID NO: 72409 - DNA, 85 bp, Mus musculus; identical to SEQ ID NO: 57470

SEQ ID NO: 72410 - DNA, 107 bp, Mus musculus
tgaggtcacttaagacttgagactggggcgggagagatggctcagtggttaagagcactgactgctcttccagaggtcctgagttcaattcccagcatggtggctca

SEQ ID NO: 72411 - DNA, 118 bp, Mus musculus
taagataagcaaatgaattttaagagctacctgtagaacactgtgctaaggcagtcttcctctcaggctgtctcactgccccaggtcccttctctgagaatcactgctggcaattttg

SEQ ID NO: 72412 - DNA, 90 bp, Mus musculus
gcatagtgtgcacatatgtgtgtatgtatatatgcatgtatgtatgcatatatgtatgtatgtatgaatgtatgtgcaaagctcctatgc

SEQ ID NO: 72413 - DNA, 72 bp, Mus musculus
tgattctgtgtatgtatgtgtgcatgtgtatgtgtgcatgtgtgtatgtgtgtgtggcactcagtggaatca

SEQ ID NO: 72414 - DNA, 69 bp, Mus musculus
ttagattattggaagggaacttggagttggctcggtcagagtcctctgtctccctgtctctgggtctga

SEQ ID NO: 72415 - DNA, 101 bp, Mus musculus
atagtcaatgctcttaaccactgagccatctctccagccccagtctctctctcttttaaagtggcttttctaagagagtttctctgtgtagccttggctgt

SEQ ID NO: 72416 - DNA, 76 bp, Mus musculus
ttacagctgtgtgtgtgcacaggctgagtgcaggagttggaacactactggagaggagagcaacaggcagttgtag

SEQ ID NO: 72417 - DNA, 100 bp, Mus musculus
taccatctcacagttttgtgctggagagatagttcagtggttaagagcactgactgctcttccagatttcctgaattcaatttccagcaaccacatggtg

SEQ ID NO: 72418 - DNA, 84 bp, Mus musculus
gaagtgtgtcattgggggatgggctttgaggtttcaaaagcccatgccaaacccagagtctctatctctctccgcccacagatc

SEQ ID NO: 72419 - DNA, 99 bp, Mus musculus
gatgtctgagcaggtgagtagcacttctcttacagtcctgaccccctgaaaccatgtttaaaagtcagatgtgagtgagcactcaacatgtgtgatccc

SEQ ID NO: 72420 - DNA, 93 bp, Mus musculus
gtgcattactatgcccagttctgtttttatgacctaaaaactaccgaatgtagtatgtgtgtgtggtataggtgaaggttgatggtggtacac

SEQ ID NO: 72421 - DNA, 66 bp, Mus musculus
gagtgacaaaggcaggtagacccagggtagagttgattgttctctggctgcttgaccccagcactc

SEQ ID NO: 72422 - DNA, 67 bp, Mus musculus
ttcgtgtctgtctgtctgcgtctctgtgagtatgcaggtgcccacaggaaccggaagaggtcatgga

SEQ ID NO: 72423 - DNA, 90 bp, Mus musculus
gagtcccatgccaggagatcctctcacattccagtctcagatgggcagtgtttacctctcagagctgagtgagctctttgctgcagattc

SEQ ID NO: 72424 - DNA, 77 bp, Mus musculus
tgcgttcaatggctcgctcccagtttgccttgaccatgtattcctctggaagctgggagtagcagtattagaatgta

SEQ ID NO: 72425 - DNA, 59 bp, Mus musculus
ggccccctcgacatctcggcgtggtctcgttagagtcaccacacagagagctctgggcc

SEQ ID NO: 72426 - DNA, 88 bp, Mus musculus
tcacagcctcattgcagaagaagtgtttttagggctggagagatggttcagccattaagagcactgactgctcttccagaggttctga

SEQ ID NO: 72427 - DNA, 64 bp, Mus musculus
atgcatgtgtgtatatatgtatgtacatctgtgggggtgtacacgtgtgtgtgagtgcgtgtgt

SEQ ID NO: 72428 - DNA, 123 bp, Mus musculus
ccacagtgtgtgagcttgccgatgcatacactagctgccacatctcctcagaagagacagtggacagactgtggtagtgggagggcagcttctgtttgcattgggctgtggctcagaactctg

SEQ ID NO: 72429 - DNA, 123 bp, Mus musculus
acacatgtggcttaccttggcatatatgtatgtatgtatgtatatatatatatatatatatatatatatatgtatatacacacatatgtgtgtgtatgtgtatgtatgtatatatgtgtgtat

SEQ ID NO: 72430 - DNA, 109 bp, Mus musculus
agtgtgagtgtgtgcatgtgtgcatgtttgtgcctatgtgcatgtgtgtgtgcatatgcatgtgcatgcgtgcatgtgtgtgcaggtgtgcacatgccatactgcatat

SEQ ID NO: 72431 - DNA, 72 bp, Mus musculus
caaccctgggactcacttcttgtgcagagctggacttccagtccaggcttctgtgtctgtctcccatgtctg

SEQ ID NO: 72432 - DNA, 118 bp, Mus musculus
ctgctgagaatctcatgaacaggaatggcaggcttgctcttcgcacaggtacaaatcacagtttcccacttgggtgttggctcagggctgtgttcctctgtgagtgagtaaagtaggt

SEQ ID NO: 72433 - DNA, 85 bp, Mus musculus
tatgcgtgcatttgtgcgtgtgcgtgtgtgcgtgtgcgtgtacatgtgtgcatgcgtgtatgtgcatgaacatgtgtatgtatgc

SEQ ID NO: 72434 - DNA, 87 bp, Mus musculus
tatgtgcatgatgtatatatgtgtgatatatgtgtatttaagtgactatgtatgtatatgtatatgatatatgtaagtatgtatatg

SEQ ID NO: 72435 - DNA, 76 bp, Mus musculus
gagctcaaacagaagcttgaagcagaagcacagaggaaggctgctttctggctcactcgctgacaggctggggctt

SEQ ID NO: 72436 - DNA, 67 bp, Mus musculus
tgtgattctttccacatctgtgtgaataaatctttatttaaagatgtttggaaagcaaagagttgca

SEQ ID NO: 72437 - DNA, 70 bp, Mus musculus
ctcaatgggtgaggtgcgctggtgaattctcagcatcgacatttccatcagtctgtgagtcactcaggag

SEQ ID NO: 72438 - DNA, 109 bp, Mus musculus
gcagaatgcaggctcctcaggcttgcttctgtgtctcttctggttgtgggttgtactcactcccactgtgggactcacatgccacgtgccctgagggacctgtgactgc

SEQ ID NO: 72439 - DNA, 65 bp, Mus musculus
gaagggatctgtgagggaactgaacactctgctcctcagatgtcagtctcacaggttgtcgtttc

SEQ ID NO: 72440 - DNA, 86 bp, Mus musculus
catgtgtatatgtatacatgtgtgtataggtatgtgtgtttatgtgcatatatatgtgtgtgcatacatgcatgtgtatatatgtg

SEQ ID NO: 72441 - DNA, 73 bp, Mus musculus
ggatccactggtggcgggggggggggggtgcgcatgtgtgtgcatgcatgcctgcctgcctgcctgtctgtct

SEQ ID NO: 72442 - DNA, 73 bp, Mus musculus
gggtggacttggagatttcaaaagcctacaccaggcccagtgtctgtgtgtctgtctgtctgtctgtctgctt

SEQ ID NO: 72443 - DNA, 103 bp, Mus musculus
agcgcatgtatatgtgtgtgcatgtatgtgtgcatgtgtatgtgcacatatgtatgcatgtgtttgcatatatgtatgtgcatacatgcacgctattttggct

SEQ ID NO: 72444 - DNA, 82 bp, Mus musculus
cttctcagagccttagttttgcttgtctagcaaatgggtatgattttccatctcagtgagcagagaggctgttgtatgagga

SEQ ID NO: 72445 - DNA, 76 bp, Mus musculus
cctggagcttgctctgtagaccaggctggccttgaactaacagagatctgtctgtgtctgcctctaaagtgccggg

SEQ ID NO: 72446 - DNA, 66 bp, Mus musculus
cacagtctctggtgagaagtgagactggacagggtcttgtcctcatttttctctgtagtctctgtg

SEQ ID NO: 72447 - DNA, 113 bp, Mus musculus
cagaggacagagggtagagattgtggctcctgccccagtcagggtcactctgagccactacctcaggcaggacagttatcagccattcgtgattgtttctccctgtgactctg

SEQ ID NO: 72448 - DNA, 85 bp, Mus musculus; identical to SEQ ID NO: 57439

SEQ ID NO: 72449 - DNA, 60 bp, Mus musculus
caacacacttcagggcggggacagggtcctgcactgcccgtcactgtgtcagtgtgtctg

SEQ ID NO: 72450 - DNA, 92 bp, Mus musculus
gcctccttggagaccgagccactctctgcctctcaggaaatggggccctccttttaagagggaagaagtttagccagatccagcttggaggc

SEQ ID NO: 72451 - DNA, 106 bp, Mus musculus
ggagtggctggggtaaaggcacttagagcagcacacagtctcactctgttttaaacaggattggattcctaaggtggtgctcgttgagagctgactctgctgctgt

SEQ ID NO: 72452 - DNA, 101 bp, Mus musculus
gccagcagaaattagaagagagcctatgtctgtaaagaaaagcttcttgacagagcagtgtgagctcggagctggcttgcctgcggttaactgtgcctttc

SEQ ID NO: 72453 - DNA, 114 bp, Mus musculus
gagtgtaagcgggttttcatggtggcaagtttggaagtgagcggagagagggcacacagcaagtaaaggtgtgcttgtctctacatcactggcctgcaggatctgttcacgggc

SEQ ID NO: 72454 - DNA, 65 bp, Mus musculus
gccgtagggtgtagctccttttcagtgtcctggactccatcagaaacactcactgcctctggggc

SEQ ID NO: 72455 - DNA, 76 bp, Mus musculus
ctctctctgtatctctctgtatctctcttttctagagacaaaggttagagggcagccagaaggcatgcaggtggag

SEQ ID NO: 72456 - DNA, 113 bp, Mus musculus
gctttattgtttcatcctagcattgggtaatacttcattctataacacagggtcactgtgtccctgaaccaattggggtaaactttacagacagagaaggacgtgaacaaagc

SEQ ID NO: 72457 - DNA, 116 bp, Mus musculus
tagaactcactgtctcagctagtagtttgctccggagactccctgtctgtgcctcccacacactaggtttacagacaggctcccatacccacctggctgttttctcggtgagtctg

SEQ ID NO: 72458 - DNA, 93 bp, Mus musculus
ctcacgaggacagtcaccctgtcagtcacactcggctctccaggagggtgaccggtcctcagccgagacccctcactctgtccctgagtccgc

SEQ ID NO: 72459 - DNA, 76 bp, Mus musculus
gtgtgtgagtgtctgtgtgtgcgtgtgcatgcatgtttgtatgaatgtgtgtgtgtgaccctaggagttcatgcat

SEQ ID NO: 72460 - DNA, 73 bp, Mus musculus
tctctgtcctgggacatcttgtgtctgtagactatgccttgaagacacagaacagtctgagtgaatccaggga

SEQ ID NO: 72461 - DNA, 94 bp, Mus musculus
ttatataatgtagcaagtatacatgtttgtatttttagagctgttttacagctattaatataaactctgtaaattatagttcctgcatatgtaa

SEQ ID NO: 72462 - DNA, 79 bp, Mus musculus
tttgcccttccattacacaaggcttgatctgtggctggactacaggaacagcactagattagggcttggtagggacaga

SEQ ID NO: 72463 - DNA, 56 bp, Mus musculus
ctgttgctgctgtagggatagttgcagtttctctgtcactcagacagcagtggcag

SEQ ID NO: 72464 - DNA, 117 bp, Mus musculus
agctctatggggtttggtttgtggtagtgagattgttttgaacctttatttctttttatagctaatagcatcttttatagctaatctgctttgctctggagctcaaaccctcagtgt

SEQ ID NO: 72465 - DNA, 72 bp, Mus musculus
tgtactccaggggctggagagatggctcagctgtgaatagcactgactgctcatccagaggtcctgagttca

SEQ ID NO: 72466 - DNA, 107 bp, Mus musculus
atcttagtcgtggacacctaagaccctgtaaactatagaagtgagatgttttcagaacaactaagatggcatggttgtgctgggatgggggtgctcagcacggaggt

SEQ ID NO: 72467 - DNA, 87 bp, Mus musculus
tatgtgtgtgtacatgtatgtatgtatatacatatacacacatatgtgtgtgtgtattctataatatacaccatatatatacacata

SEQ ID NO: 72468 - DNA, 67 bp, Mus musculus
ctacatagatatcatatatatgtatgtatatatgtgtatatgtgtatatatatggtgtatattatag

SEQ ID NO: 72469 - DNA, 56 bp, Mus musculus
ggcgatggggggcaaggcaagggaaggtctgaggcctgggtgtctctctcactgtc

SEQ ID NO: 72470 - DNA, 85 bp, Mus musculus; identical to SEQ ID NO: 57439

SEQ ID NO: 72471 - DNA, 67 bp, Mus musculus
gaactagggctggagagatggctcagaggttaaggacactgactgctcttccagaggtcctgatttc

SEQ ID NO: 72472 - DNA, 96 bp, Mus musculus
gggaggaggaagaaggaggtagaacaggatcctcaagagatatttcctgatcaagtccagctctgtctgtctgtctgtctatctacttatctatcc

SEQ ID NO: 72473 - DNA, 103 bp, Mus musculus
tgtgtatatatatatatatatatatatatgtatgtatgcaaacatatatgtatgtatgtatgtatgtatgtatatatacatatttttttacatatatatatat

SEQ ID NO: 72474 - DNA, 77 bp, Mus musculus
cagatcagaagacagagagcaaagatggaggagccagatgcccaggttgtctgctacatgatagtgtcttctgtatg

SEQ ID NO: 72475 - DNA, 102 bp, Mus musculus
agatcagtgaagatgagccaagagctgcatggtgagtgaagtcagtgaagaccagtgaagccttacaaggtgtagcaatgtaagagtatcctttcactgtct

SEQ ID NO: 72476 - DNA, 85 bp, Mus musculus
atcatgtcttttctgaatcatttggtatgtagtagaatgactagataatttattatttaactgagacttttgagagaaggcagat

SEQ ID NO: 72477 - DNA, 81 bp, Mus musculus
gccggcgaagagatggcaaagagattgtgctccgccctttacttcctgtgtcacagactctctgtctatttccctacctgc

SEQ ID NO: 72478 - DNA, 57 bp, Mus musculus
gcagggttgtcattggctcagggaatccaactccctcactgtctgtgacatccctgc

SEQ ID NO: 72479 - DNA, 85 bp, Mus musculus; identical to SEQ ID NO: 57439

SEQ ID NO: 72480 - DNA, 72 bp, Mus musculus
ccagaaagctgaacaagcacagactgggagactggctctcttactctgtcattgctcttcatcagcaagtgg

SEQ ID NO: 72481 - DNA, 92 bp, Mus musculus
atctctagcaagtggaactccatgaatgctcaacctctcagatgtcctcccatctctgactgtgtgcttggatccaccgcagtgcttttgat

SEQ ID NO: 72482 - DNA, 94 bp, Mus musculus
tgattttccaggaatgctactatgtcttttgtgatggaccatgctgttctgtccataactatacaagtttgttgtagaggcctgaatgagatca

SEQ ID NO: 72483 - DNA, 66 bp, Mus musculus
gcactgggagtggctgtgttcagtacaaagtcatctacatagtgatacagcatgctctccacatgt

SEQ ID NO: 72484 - DNA, 64 bp, Mus musculus
gtgtgtgtttgtgtgcatgtgtacgtatatttatgtatatgtatatacatatgtaaatatatac

SEQ ID NO: 72485 - DNA, 105 bp, Mus musculus
atctctaaacaccccagactgacgctaggacagaaagtcactctctgacagtggggccccattgccaaggaaaactttcattcagctcaatgaatatagagaggt

SEQ ID NO: 72486 - DNA, 87 bp, Mus musculus
tgatggtctctttcactgtgtcagtgaatgtaaagtctattctgggtagttttaggataagcattcaaacatgtgtggagaccctca

SEQ ID NO: 72487 - DNA, 85 bp, Mus musculus; identical to SEQ ID NO: 58391

SEQ ID NO: 72488 - DNA, 108 bp, Mus musculus
tcagtgggacccaaggaatggcatgtcatatgcacaggctgatggagagtgaagtgacaaagcacacctgctgagctggtgactgtcctaccttgtgcttctcatgga

SEQ ID NO: 72489 - DNA, 93 bp, Mus musculus
cacacacatgcatatgaaaaagaatatatataattgtgtgtgcacacatgtgtatgttaatgtatatatgtatatacatgtgtgtgccagata

SEQ ID NO: 72490 - DNA, 85 bp, Mus musculus
gtgactgggtgttacacatgctcccaagctcacagtctgtcactcagatttgtggctagtagaacgtggtacacacagtagttgc

SEQ ID NO: 72491 - DNA, 91 bp, Mus musculus
gtgtcagtaccctgtgacctgcagccctggtgacagcaggtctgagagaaaagtgtgcacatagtggctagtaggacagaaaaactgtcac

SEQ ID NO: 72492 - DNA, 114 bp, Mus musculus
tacttgatctacctgtgtgatgattttatttgtgagctcatgacaaaaggctttaaaagatttttttttcaaggcaagaaagtcagttcaaattattgcaaggatttcaaagtg

SEQ ID NO: 72493 - DNA, 100 bp, Mus musculus
tttgtatgtgggccttatggaggctcctgggatatttttcagatctactccaggtcagaatgtctcactgagactctaataggccttactcaggaacaag

SEQ ID NO: 72494 - DNA, 76 bp, Mus musculus
gatagacaataagaaagacattaagaaagttataccattcacattaacctactatatgtctgtctgtctgtctgtc

SEQ ID NO: 72495 - DNA, 111 bp, Mus musculus
ggacatctaaaccattactcttctggctcagaatgaagcttgtttagtataattagttggcgattttgtgagtgggaatgttctgccagaagtgttctgtgtttagaggac

SEQ ID NO: 72496 - DNA, 115 bp, Mus musculus
agcaagagttgcaagtactcttaactgctgagccagcgatttacatttatatatatttgagacaggacatcagtgtgtaatcctgattggctttgagctagcaactcttcctgct

SEQ ID NO: 72497 - DNA, 77 bp, Mus musculus
tcggatctgcagtgagaagccagagagcacaggatgctggtgctcagatcgctctctctcctctttgttcagtccga

SEQ ID NO: 72498 - DNA, 88 bp, Mus musculus
gcttctcattctcaggttcccaagggcacctcaggatggctgtgctctcacttcctctctgagtcctttgcctgttaccgactggagc

SEQ ID NO: 72499 - DNA, 84 bp, Mus musculus
gagagacagttcgcagatttgtttaaggagcagtgacaattcggatcccagattcactctcaggctctgatctaatcctctctc

SEQ ID NO: 72500 - DNA, 78 bp, Mus musculus
gggagcctgagacagcagtgagggtggcatgggtgttcctttcctggtctcttcagtcacactctgtcttggattctt

SEQ ID NO: 72501 - DNA, 125 bp, Mus musculus
gtttacagagtgagccgttgtgagcagcttcgctggtgcacagccaggctccctctctgagtgaaacttttcccacactggccacagagatagggtgtctctcccgtgtggacttttccatgcag

SEQ ID NO: 72502 - DNA, 68 bp, Mus musculus
gttgttagagggggttggagagagcagttaagggcactgactgctcttcctgaggtcctgtgttcaac

SEQ ID NO: 72503 - DNA, 126 bp, Mus musculus
gatgggtggggagggacaacctcaggctaacgctccaaaggcaatggtgagtttctgtctgtcactccctccacacatcagatagcagattacaggtgggtaggtgtcaggtaagcctcctcttgc

SEQ ID NO: 72504 - DNA, 77 bp, Mus musculus
gtcagtcagtagtatagtccttgcttaccacgtgcaagggtcctgggtgcccttgtctgtctgtctgtctgtctgtc

SEQ ID NO: 72505 - DNA, 112 bp, Mus musculus
atgagatatctcactgaccttttcatgtaaagtccatacttaaaattctttatttacttattcattttatgtgtatgaatgctttacctgtgtgtatgtctgtgtatcacgt

SEQ ID NO: 72506 - DNA, 72 bp, Mus musculus
tgtctcattctctgcatattgtttggctttacatctctgtatttgttcttctctgctgcaggaggatgagca

SEQ ID NO: 72507 - DNA, 82 bp, Mus musculus
tacatgtatgtatgtatgtatgtatatatgtatatagatatgtatgtaggtatgtacatacatgtgtatgtatgtgtgtgca

SEQ ID NO: 72508 - DNA, 57 bp, Mus musculus
caggtgtgtgtgcgtgtgtgtatgcattgtatgtatgtatgtatgtacatacatgtg

SEQ ID NO: 72509 - DNA, 72 bp, Mus musculus
catcactctgagtctctgtgtttccatttctggcaacccacccaagagtgcccgcccaggggctgagttctg

SEQ ID NO: 72510 - DNA, 118 bp, Mus musculus
ccaggtcacacagaagaagtttgcattgtatgctacctgtgttagcatttagagagaagaaagactgcaacttttgacaggaagcagccagtcgggctttagcaacagtggaagaggg

SEQ ID NO: 72511 - DNA, 109 bp, Mus musculus
gtgtgctcatcaagcactgaggtgttgcagcaggaggaaggagaccacttcagtctctgacagtctctgaagcaggagctgggacccagcctcttcttgggatgcaggc

SEQ ID NO: 72512 - DNA, 91 bp, Mus musculus
agatggctgctctgtgtgtgtgtgcatgtgtatgtgtgcgtgtgcatacatgtgtgtatgtgtctaaatatgtgcctatgcgtgtgcatat

SEQ ID NO: 72513 - DNA, 88 bp, Mus musculus
gagtatatttgtgtatgtgtccctgtgtgtcttgctgtatgtgtctctctgtgtatagtgtagatatatgtatatgggcaatatgttc

SEQ ID NO: 72514 - DNA, 104 bp, Mus musculus
acgattattttgtgcttatattcccagggctgactgcagagcgtgagctcactcattttatctggagctttgcatgtttgtttgtgtaagaaagaaaaaaatgt

SEQ ID NO: 72515 - DNA, 97 bp, Mus musculus
cttggtgtatcgagtttgcttctgtgcatacacatgagacagtgcactctgttggtcatggtttgatgcagtgcttcagaagtctctgctagctaag

SEQ ID NO: 72516 - DNA, 87 bp, Mus musculus
ttaatgttctgttacactcactcactcatatgcgagcgtatacaccttggcaagtgtgtggaagtcgggtgctaatgggagtgttga

SEQ ID NO: 72517 - DNA, 109 bp, Mus musculus
atctttagcactctaatttttgaaacaggttctctcgctgactcactggttagactagccgaccaggaagcccccggagccttcttgtctccagttcctgcactaggat

SEQ ID NO: 72518 - DNA, 60 bp, Mus musculus
ggagactgactctgtcacagacccctactggggagagctctgttgccaagtcttccctcc

SEQ ID NO: 72519 - DNA, 67 bp, Mus musculus
gggggtagagagacttgtagagtggctcgctctgcctgcctgtctgtctgtctgtctgtctgctctc

SEQ ID NO: 72520 - DNA, 72 bp, Mus musculus
tatgggctctaggaggtggcacactgctggatggtgcccaggcttgtgtgcctgtctgcctgttttctcgta

SEQ ID NO: 72521 - DNA, 90 bp, Mus musculus
agcaagatgtatgacacagtatatatgaacagtgaagattgagagctgtgatccagaatttacaatatatatgaagtgggtatgcttgct

SEQ ID NO: 72522 - DNA, 66 bp, Mus musculus
tctgatgaggagccacagtgaggaaggccaattatagtcttctgtctcactgtctttgacatcagg

SEQ ID NO: 72523 - DNA, 83 bp, Mus musculus
gagagtcaccaaggttaacatgctagtcctgcccttcctctcacgctggaagctcctcacagatgacagtgtgccttgctctc

SEQ ID NO: 72524 - DNA, 93 bp, Mus musculus
tgccaaaggcgaagcccattggaggtgtgggctggggggaggctgtttctcggatgctcagtatacagtgtggagaggggtgtgcacacggca

SEQ ID NO: 72525 - DNA, 59 bp, Mus musculus
agatggatgggatcccactcagtataggctcctcacttctgagtgtctcttgtctttct

SEQ ID NO: 72526 - DNA, 70 bp, Mus musculus
caatgtcactgtgaaactctgtcactgctctcaaagaaggccaggtcaggcaagttacagtggctctttg

SEQ ID NO: 72527 - DNA, 110 bp, Mus musculus
gagccgtggtttcagacatatctctgtctctcactgagtatccagtttgattttttttttttttggtaaattctagttggaggatattgtgtggttgaaaacaaactgcc

SEQ ID NO: 72528 - DNA, 67 bp, Mus musculus
ttccactctggcacctctcctggagctggcccgcactgagaccagacagaggtgactgatgagggaa

SEQ ID NO: 72529 - DNA, 78 bp, Mus musculus
tatgcatgtgcatgtatataatatgtatgtatgtatgtgatatatatgtgtgcatatgtgtgtgcatgtgtatgtatg

SEQ ID NO: 72530 - DNA, 81 bp, Mus musculus
ctggaggaaaggaatgtattgcggcatcagagcaagcttttctgtacacatctgtgtgtctgtccttgcttcattccctag

SEQ ID NO: 72531 - DNA, 90 bp, Mus musculus
tcaccgaaataacaacttgaaggtcactctctgtgtgccagggccgctcagtcatcaggcaggcgagtgtgcagacaggaaaggcggtgg

SEQ ID NO: 72532 - DNA, 107 bp, Mus musculus
cagaatctcacgagatctcagtagttgagatatcccagcaacaggcgatacagacacactgtgtgccagttgggtaactaactctagagctctccaccaagggtctg

SEQ ID NO: 72533 - DNA, 76 bp, Mus musculus
tgatgacattggctgtcctgtttaccgcttccggacagacagacagacagacagacagaccacatcatatgcatca

SEQ ID NO: 72534 - DNA, 84 bp, Mus musculus
gactgaggggctgctctgctcctggggatatctggccttgtgaaagacacagcagtgtcaggggacaaagagcacctcaaggtc

SEQ ID NO: 72535 - DNA, 78 bp, Mus musculus
gagccagagggatgaggccgcaccacaggcctgttgggcacccgccgtcactgccagtctcagagattctgactgttc

SEQ ID NO: 72536 - DNA, 78 bp, Mus musculus
ttcatagttgttcacagaaaacacagagaagcggccctagtactccgcatcctgtgtttgcagtgacaatgttatgga

SEQ ID NO: 72537 - DNA, 73 bp, Mus musculus
tctctgtgagtgtgtctccattatcattactgccaaatgtattcttcaggagtccctcagacgctctcagagg

SEQ ID NO: 72538 - DNA, 114 bp, Mus musculus
gggtctaaagagtaaagatgtctgtagggctaagctccctctgaggatgggacccactctgcctgtcctacattcctggaaaatcttggccttgaacacatctgcaaaatgcct

SEQ ID NO: 72539 - DNA, 69 bp, Mus musculus
tgatactctgatactctgtctttgagagggaagactgcgttttctttggaggctagataatcggaggca

SEQ ID NO: 72540 - DNA, 111 bp, Mus musculus
tagctcactctggtcaactctgctcgctcagtccctgcttgctccaacccaaagatttatttattatacattagtacactgtagctgtcttcagatgcaccagaagaggtg

SEQ ID NO: 72541 - DNA, 113 bp, Mus musculus
ggggaggggatgggttatcgcacaactctcaggtcacactcacttcctcactgagggaagccagggagagaattcagagtagggacctggagtcgggaactgatgcaaacacc

SEQ ID NO: 72542 - DNA, 73 bp, Mus musculus
gggagcaacctcagtcatcaggcagacaggaggtgccttcgctgctacgctcactcgctgcctcactggcccc

SEQ ID NO: 72543 - DNA, 101 bp, Mus musculus
ggtggtggtggtgtatgtttaactgaaatagctgagatcaatgtgaaagcaactaactgaaagggctgtacctttagttatctcatgtagggcctagcact

SEQ ID NO: 72544 - DNA, 72 bp, Mus musculus
acatatatatacacacacatatatataaaactgtatgatacacgatatatatgtgtatatgtatatatgtgt

SEQ ID NO: 72545 - DNA, 107 bp, Mus musculus
ggatgtcaatatatatgtataaatacatacacacatgcacacatatatatacttatgtatgtatgtatatatgtatgtataaggaatgtataaacttaacaaaatcc

SEQ ID NO: 72546 - DNA, 124 bp, Mus musculus
gttctgtcttctggctgtcctgtgcaaccttaggcaaggtcctgttcctcactggatctctctctgtgccctgagaagcaaagggaaccaggtgacccagggactttgtgttgtcttgcagcta

SEQ ID NO: 72547 - DNA, 85 bp, Mus musculus; identical to SEQ ID NO: 63243

SEQ ID NO: 72548 - DNA, 96 bp, Mus musculus
ggattagtagttaagagcactgactgctcttccagaggacctgggtttgactcccagcacccacatagtagctcttgctcttgtaactcttgctcc

SEQ ID NO: 72549 - DNA, 62 bp, Mus musculus
acgggcagagtccatgcacggctgcagtgtgcaagcctgtagctgtcattctctctgtgtgt

SEQ ID NO: 72550 - DNA, 111 bp, Mus musculus
acagaagaaagacagtgagtgggaagggatttcattttattttaaatctttttttaaaaaaaaagatttatttaatgtatatgagtacactgtagctgtactgatggttgt

SEQ ID NO: 72551 - DNA, 108 bp, Mus musculus
tgtcagatgactgcatgctgggggaggacagtgccaccgctctgcctgctactgtggttgtcagtagagcctgaggtctgtccaaagctcagacaagacaggatggca

SEQ ID NO: 72552 - DNA, 83 bp, Mus musculus
agcttggaggaggggctggagagatggctcagtggttaagcgcactgactgctcttccagaggtcctgagttcaaatcccagc

SEQ ID NO: 72553 - DNA, 106 bp, Mus musculus
agcttaggatgtgttgtctgggactggagagatggttcaatggttaagagcactgactgctctttcagaggtcctgagttcaattcccagcaaccacatggtggct

SEQ ID NO: 72554 - DNA, 66 bp, Mus musculus
acacaaatcttaacacacacacacacccagtgagtcccctctgtgtgtgtgtctgtgcatgtgtgt

SEQ ID NO: 72555 - DNA, 78 bp, Mus musculus
aattggaatataggggctgaagagacggctcattggttaagagcactgactgctctttcagaggtcctgagttcaatt

SEQ ID NO: 72556 - DNA, 115 bp, Mus musculus
tgttaggattttgtttggcttgactttaggtatgtcttatgtgtacagtcacaatcactgtgggtttatatgtgccctgattccctgatgttgtccaccaactgagaaactttca

SEQ ID NO: 72557 - DNA, 102 bp, Mus musculus
cttgcctggtctctctttatttggctgtgtttattgaattttattttgaattttaaaaataagtgaaggcatttatttaaggaatagatgaggccaggtgag

SEQ ID NO: 72558 - DNA, 94 bp, Mus musculus
gcacagatgaaacatagtaagtagggctgaagagatggctcagtggttaagcgcactgactgctcttccagaggtcctgagttcaaatcccagc

SEQ ID NO: 72559 - DNA, 79 bp, Mus musculus
tctctgtgagtctgtgagtctggaaccagcctggccaacaaagcaagttctaggtaggacagccagggctatatagaga

SEQ ID NO: 72560 - DNA, 93 bp, Mus musculus
ccagactacaagcttgtaatcaggttgtctctctgactctaaggcagcactgggactgggatgtggtgtggtggggggagggacagttcttga

SEQ ID NO: 72561 - DNA, 64 bp, Mus musculus
tatgtatgtatatatgtatgtatgcatgtgtgtatgcatgtgtgtatgcatgtgtgtatgcatg

SEQ ID NO: 72562 - DNA, 90 bp, Mus musculus
ggatgagtttggaagactggtatgtgagggagtgttcattttatctatatatccatacatacattatgtacctgtttgtgaaaagtgtcc

SEQ ID NO: 72563 - DNA, 90 bp, Mus musculus
acacatgtgctaattattctctgtcactctgtctctctctcagagagagagagagagagagagagagagagagagagagagtgtgtgtgt

SEQ ID NO: 72564 - DNA, 87 bp, Mus musculus
gtgtgagtctgtctctgcctgtctgcctgcctgcatgtgagtgtagatatccacagaggccagagaggatattggaccttctggagc

SEQ ID NO: 72565 - DNA, 83 bp, Mus musculus
gttagatgtctcagactggagagatggttcagtggttaagagcactgactgctcttccagaggtcctgagtgtagtttctagc

SEQ ID NO: 72566 - DNA, 112 bp, Mus musculus
tctagaactttattatgactttgtaactacaaacatattataagaatattaaccatatcagtttatttttatgaaaatagggtattgttatatagttgtcctggagctcaga

SEQ ID NO: 72567 - DNA, 77 bp, Mus musculus
ggaggtgctgggtgaggtagctgtttgaggtataccccctctgaagaacaaatgcttgctgctttctcttcatgtcc

SEQ ID NO: 72568 - DNA, 93 bp, Mus musculus
ccacttcttccagagtggcacacggtgtgtgctcttcagaagtttcacactgtcttttactgtcacaaaagtggtatttctggaacacatgct

SEQ ID NO: 72569 - DNA, 73 bp, Mus musculus
gtggagagggaagtaatgtgtctgtctttgactctatccctccatagaactgacaggacatggacctcctcat

SEQ ID NO: 72570 - DNA, 111 bp, Mus musculus
gcagtgcatgtagcagtcacacacgttatcgtgtgtttagtgaaaaacctaacagaggagtgtgaggtgaggacatacgctggatgggtggctgtaaggtagatggaactc

SEQ ID NO: 72571 - DNA, 75 bp, Mus musculus
gaattggagctacagagagttgtgagccagcactgtaggtgctggaaatcaaacctctgcaagaatagccatctc

SEQ ID NO: 72572 - DNA, 85 bp, Mus musculus
ggccatggtggtctgataggatacatgggataaattcaatatttttgtatctgttgaggcctgttttgtgaccaattatatggtc

SEQ ID NO: 72573 - DNA, 87 bp, Mus musculus
acacatacgcagacaaataagtaaatctttttttaaaaaagactcttctttttaaaaagatttattcatttttatgtgcattagtgt

SEQ ID NO: 72574 - DNA, 112 bp, Mus musculus
tgagtgcaatcagaagaggctttctcgggttggagagatggctcagcggttaagagcactgactgctcttccagaggtcctgagttcaattcctcttctggtgtgtgtctga

SEQ ID NO: 72575 - DNA, 80 bp, Mus musculus
ggctgcgatattaccaactctccagtgaacagaatggtatgatttcagacagggtctctcactatggagtcttagtggcc

SEQ ID NO: 72576 - DNA, 73 bp, Mus musculus
ggacttaaagccactgcttagtgcagtctgctctccagtcacactgtccctctgagcaatcacggcgatgtcc

SEQ ID NO: 72577 - DNA, 115 bp, Mus musculus
tcaagggtatgatgacagagtaggggcaaagggaatctgtgtacacagtgggcacacaggcacatcccactatggttccttggtttccgtgcctgcttctaacccagaccactga

SEQ ID NO: 72578 - DNA, 83 bp, Mus musculus
tcacctgctgtccctctgataagccatctcttactcatccacctacagagtcagtacagagtggcctcaggtcagctgcgtga

SEQ ID NO: 72579 - DNA, 81 bp, Mus musculus
actgagcttggtagtgaggacacagtacacactgagcttggtagtgaggacactgtacacactgagcttggtagtgaggac

SEQ ID NO: 72580 - DNA, 66 bp, Mus musculus
ggacacagtacacactgagcttggtagtgaggacacagtacacactgagctcttggtagtgaggac

SEQ ID NO: 72581 - DNA, 82 bp, Mus musculus
ctgtctgtctgtctgtctgtctgtctgcctcacacacacacagagagagaggggggggcagagacagagagacagagagcag

SEQ ID NO: 72582 - DNA, 74 bp, Mus musculus
agcctttaatagtggagttttgaattatggaggcacttcacatgtgtgcctctctctttgtcttagttagggct

SEQ ID NO: 72583 - DNA, 115 bp, Mus musculus
gaggaagagctgagtcagctggtggccaggagccaggacccaggacagagtctgactatctcacaggcctgtgtccttgctgattcctgctgttgctggctctgccctgctcctt

SEQ ID NO: 72584 - DNA, 67 bp, Mus musculus
gtgtgcatatatgcatatacattgtatatgtttgcatgtgtgcatgtgtgtgtgtgtgtgtgtgtgt

SEQ ID NO: 72585 - DNA, 86 bp, Mus musculus
ctgagggtaggtctgtgtcacccgacagctgagtacctctgcccacccgccttctctcagcctcagtgtcatgccctgcttctcag

SEQ ID NO: 72586 - DNA, 112 bp, Mus musculus
tgtagtctatattttgaattcatcagagtttattttccaaggatattgtactatttatatataagtcttataagtccatattttttctgatgagcattgtacttttgctata

SEQ ID NO: 72587 - DNA, 115 bp, Mus musculus
gatgtatagcttggtcttcctgtgggtcccctaacaattggagcagaggctgtctctctgactctgttgtctgcattgggtcctgttcccctaactggactgcctggccggcttc

SEQ ID NO: 72588 - DNA, 121 bp, Mus musculus
gatgtacagttggggccctcagaagcccagaacttttgccagcacaacaagaaaggggacatcctctctctgtgcctcagtttcttcagtacggtctgagggatgcactgtcaaatcccag

SEQ ID NO: 72589 - DNA, 107 bp, Mus musculus
actaataaagctacatgggtgggttttatcctgtcctagaaagtttttttttaaacaaaagagataacctgaaagtgcgcaaaaccaactctgtggaattgttgcgt

SEQ ID NO: 72590 - DNA, 115 bp, Mus musculus
gccagccagtgaccaggccaagttggtccctgggcaggcacccatctctgacactatcactgatgctatgttttgcttgcagacaggaacctagcatggctgtcctctgagaggc

SEQ ID NO: 72591 - DNA, 141 bp, Mus musculus
catatatatgtatatatatgtatgcatacatatatgtatatatatgtatgcatatatgtgtgtattaaatatatattatataattattacataataatattacataatatatgtaaataaatatatatgttaaatatatat

SEQ ID NO: 72592 - DNA, 99 bp, Mus musculus
tgggtctccaaacaaagaagcacagggtgacaggcacagagccttcgtcggatctgacaagtgtgtgtgcactagatccttgtcatggtatggggccta

SEQ ID NO: 72593 - DNA, 76 bp, Mus musculus
ttggatattccccttttgtgagagaccacactgtggaaaactaagtcccgcagttactctcaccctaaagatccgg

SEQ ID NO: 72594 - DNA, 77 bp, Mus musculus
tggggtttgttagcaggctgggaaagactgcaaatgctcctgcatctgtcactttctgagtctgttcatctattcca

SEQ ID NO: 72595 - DNA, 100 bp, Mus musculus
taaggcttattcatcaagatcaggatggatatgttgaaggtaagctttttttatctgtttataacaaatcctcttgttcaaaaggcatggcttggcagta

SEQ ID NO: 72596 - DNA, 68 bp, Mus musculus
tctcagttttcagttttagggtgccatacaacttggattctgagtcaccctctctgacttgcctggga

SEQ ID NO: 72597 - DNA, 80 bp, Mus musculus
ggtggatccccaggtggggcagtttctggatggcctttcttctagtctctgctctacactctgtctctgtaactccttcc

SEQ ID NO: 72598 - DNA, 76 bp, Mus musculus
gatctcactctgtaagaccaggctggcctcaaagtcctagagatctgtctgcctgtgcctctcaagtgctgggatt

SEQ ID NO: 72599 - DNA, 67 bp, Mus musculus
tctcaggtgtcagttctagggtgccatgcaacttggattctgagtcaccctctctgactggcctgga

SEQ ID NO: 72600 - DNA, 110 bp, Mus musculus
ttgaagatcaaccttagtacatggtggtctgataggatgcatgggacaatttcaatatttttgtatctgttgaggcctgttttgtgaccaattatgcggtcagttttgga

SEQ ID NO: 72601 - DNA, 109 bp, Mus musculus
tcagccttaatacatggtggtctgataggatgcatgggacaatttcaatatttttgtatctgttgaggcctgttttgtgaccaattatgtgttcaattttggagaaggt

SEQ ID NO: 72602 - DNA, 66 bp, Mus musculus
gacatcttggttcagagactccgccgaaagtagtcttcacaggtgagagtgtggactacagaagtt

SEQ ID NO: 72603 - DNA, 107 bp, Mus musculus
ttcaaggtgcttctcagccattcggtattcctcagttgtgaatttgtttagctctgaacctcatttttaatggggttatttgaatttctggagttcagcttcttgag

SEQ ID NO: 72604 - DNA, 83 bp, Mus musculus
catatttgtgcacatctgtgtatgcacatatgccatggtgtgcttgtggtgtgtatatgtgcatgtgcttgtgcttttgtatg

SEQ ID NO: 72605 - DNA, 79 bp, Mus musculus
tgtctctctttttttcttgaactgtaactgtagataagacttcatgtactgcattgaatgagaatagagagagtggaca

SEQ ID NO: 72606 - DNA, 166 bp, Mus musculus
tatgcatgcatgtatgtatgcttatatgcatgtatgcatgtatgtatgtatgcatgtatgtatgcatgtatgtatgcatgcatgtatgtatgtatgcatgcatgtgtgtatgtttgtatgcatgtatgtatgtatgtatgtatgcatgtatctatttttttgtata

SEQ ID NO: 72607 - DNA, 108 bp, Mus musculus
gcgacatccccacaagcatcccaaatggcctgggtgggagagcatgcaggtcacgtcaccagtgctctctgctctttctccagtctggctgccacgtggaattgttgt

SEQ ID NO: 72608 - DNA, 61 bp, Mus musculus
caagcttgtgtctgccagcattgatgttcttgcgtccagtagggctgacaatgtcagtttg

SEQ ID NO: 72609 - DNA, 110 bp, Mus musculus
ctcatgcctgcatatatatatatatatgtatatatatatatacatatacatatatatatgtgtgtgtatatgtatacatgtgtgtatatgtatatatgtatatgtgtgtg

SEQ ID NO: 72610 - DNA, 69 bp, Mus musculus
gtatgtatgtatgcatgtatgtatgtatgtatgatgtatgtatgtatgtatgtatgtatacatatttat

SEQ ID NO: 72611 - DNA, 107 bp, Mus musculus
aggtttatggaaaatcctggaagagctgtggatgtatgtatgtatgtatgtatgtacctatgtacatatgtatctatctacatatctatctatgcatctatctacct

SEQ ID NO: 72612 - DNA, 94 bp, Mus musculus
tgggggggggcgttgtttgtgttgttttagcatagaaatcttggttgagacagtctcactctgtggtagtagatacaaggaacgcaaccttgta

SEQ ID NO: 72613 - DNA, 104 bp, Mus musculus
tcaaaactatgttcttcagggctggagagatgactcagaggttaagagcactggctgctcttccagaggtcctgagtataattcccagcgaccacatagtgtga

SEQ ID NO: 72614 - DNA, 180 bp, Mus musculus
gtattttgcctgcatgccagcatgtatgtatgtgtgtatgtatgtatgtatacatatatgtatatgtgtaaaatacatatgtgtgtatatatatgttatatatatatatacatataaacattatatatatatcatatatataatatacatatgcatacacacatatgatatataaaatac

SEQ ID NO: 72615 - DNA, 109 bp, Mus musculus
atgagtgttttacatgcatttgtgtggtgtgcatatatatatatatatatatatatatatatatatatgtcattgtggcaccccacaccagtgcgtgtaaaacacacat

SEQ ID NO: 72616 - DNA, 103 bp, Mus musculus
ggtccgtcatgccagtgttaagcacagggaactctgctgttgtcctacagcaaatgggcggcagacacaagacagtgcccagaagctcacaggccaacgggcc

SEQ ID NO: 72617 - DNA, 131 bp, Mus musculus
gaaggctcttgagaattcagagactctagatcactgctctgtagttttgcttcctggcagagagatgagagtgagttcattaagtcactttgaacatttttttattcaccaaggagatgcaaattaaacta

SEQ ID NO: 72618 - DNA, 102 bp, Mus musculus
gcaggtgtagttatatgttcccatttgggaaaaaagagaccactaagactcaaaggaatttctctttttctttttgaggagctattactgtataacccaggc

SEQ ID NO: 72619 - DNA, 85 bp, Mus musculus; identical to SEQ ID NO: 57470

SEQ ID NO: 72620 - DNA, 117 bp, Mus musculus
tgcgatgtgtcctgggagaagggttaagcaacaagctaagagaacactgagtgctgtgatctccataaattccaacctcattctcaggcttgcttcctcttttcaagcattagtgta

SEQ ID NO: 72621 - DNA, 119 bp, Mus musculus
gtggtggtggctagcagacagacattatgctaaagtgatggactatgaatagaaatatttatctgttattgtatatgtgtctttaatattttggcagtttggaagttatttatgtatac

SEQ ID NO: 72622 - DNA, 85 bp, Mus musculus
ggccatggtggtctgacaggatacatgggacaatttcaatatttttgtatctgttgaggcctgttttgtgaccaattatatggtc

SEQ ID NO: 72623 - DNA, 115 bp, Mus musculus
gtatatacataatgtattatgtatatatgcaaagatatgtaatatatgtgtgtgtatatatatatgcatatatatatgtaacatggctatatgtatatgatatatacatatatac

SEQ ID NO: 72624 - DNA, 79 bp, Mus musculus
ggtaagtttgtggcactgtggtagagtattgctttgcagacaccatgctctaagttcagtctcctaaggtgctggcacc

SEQ ID NO: 72625 - DNA, 79 bp, Mus musculus; identical to SEQ ID NO: 72624

SEQ ID NO: 72626 - DNA, 69 bp, Mus musculus
agggtgctgcctcagtggctctgtgcttctgtctgttcccagaagctgtccggttctcaggcgcaccct

SEQ ID NO: 72627 - DNA, 70 bp, Mus musculus
gctgctacactctcctagagtcagcaagacatctatctggcttcttctgtctctgagagtctctgttgca

SEQ ID NO: 72628 - DNA, 82 bp, Mus musculus
agattggccgaattaacactgcaagatatatatatatatatatatatatatatatatatatatgcataattctcatcaacct

SEQ ID NO: 72629 - DNA, 69 bp, Mus musculus
tcctgcatttaggtccctgtgctcagtccaatatttggctctgagcatctgcatctgtattggtcagga

SEQ ID NO: 72630 - DNA, 85 bp, Mus musculus
ggccatggtggtcagataggatacatgggacaatttcaatatttttgtatctgttgaggcctgttttgtgaccaattatatggtc

SEQ ID NO: 72631 - DNA, 79 bp, Mus musculus
acttctgttagtttcactgtgtctctgtttagtttctgtttccaggatctgtccattgatgagagtggggtgttgaagt

SEQ ID NO: 72632 - DNA, 90 bp, Mus musculus
tatatggaatggactcccatgcggggcagtctctgtatgacatttcctttggtctcttatacacacattgtctctgtatttcctcctgta

SEQ ID NO: 72633 - DNA, 100 bp, Mus musculus
tgatttaggtgtctctggctggagctcactcctcctatgagtctgttagtctctgtcagcactcctgggagatcagctctctcctgagtcccatgggtca

SEQ ID NO: 72634 - DNA, 85 bp, Mus musculus; identical to SEQ ID NO: 57470

SEQ ID NO: 72635 - DNA, 86 bp, Mus musculus
gtatgcacatatatgcacactcacacacagtatctcagtgaggaataagaatcagcattgtatgtgtgagccatagatgtggaaac

SEQ ID NO: 72636 - DNA, 90 bp, Mus musculus
gctagtgggcagagagatggagtgaggattggtataaaatgtatctatatatctctagtgacctgcttcctccaattctaacccatttcc

SEQ ID NO: 72637 - DNA, 103 bp, Mus musculus
gaggtttaatgaggacaaaggttttaagataaataactttccattagtaacaatgtatttgaaaaggattttgatctagagccttttgtatttattatttctc

SEQ ID NO: 72638 - DNA, 107 bp, Mus musculus
ctgtgagcttttgacttaggtgctgtgactcttcagcagtgtctgtcactgagtaaatctgctgaggatgtggctggtgattgagcttttgagttgaagcctgagag

SEQ ID NO: 72639 - DNA, 68 bp, Mus musculus
catcagctccaaggtccatgtgagagtgcatatgcccttctgtctctcactgcctgtgagagtccatg

SEQ ID NO: 72640 - DNA, 80 bp, Mus musculus
gggctcagaagtatgaaccagacactagatttctgtttttttgagacagggttctcactgtgtctctctggctggcctgg

SEQ ID NO: 72641 - DNA, 103 bp, Mus musculus
gatgcagagtcttgctatctagccaagggtgttgaggtactccgatgtgtagtttaagatacccttgaactttcagtaatcctcctgcctcagcctcctgagc

SEQ ID NO: 72642 - DNA, 97 bp, Mus musculus
cccaaggtcatggaaagaaattaggagatatgtgtgtgtgtgtgtgactcacagaagaaacagagatgcctatcaatgcctgttctttttgcctggg

SEQ ID NO: 72643 - DNA, 58 bp, Mus musculus
gcacgaatggtgggagggactgcctggccatctgcctttctctctgtctcacctgtgc

SEQ ID NO: 72644 - DNA, 116 bp, Mus musculus
tcttggttgtatttttgaaacagggtctcactttgtagcccaggctgtcctagaactcactctgcagactagactgggctccaaatcatgccaatcctgccgccttagcctccaga

SEQ ID NO: 72645 - DNA, 102 bp, Mus musculus
cgtgatgaaaactgactaaacctctgatcctgtaagccagctccaatgaaatgtttttctttataagagttgccttggtcatggtgtcttttcatagccatg

SEQ ID NO: 72646 - DNA, 97 bp, Mus musculus
gctggtttgtatagggtgactctcattttgtctgtccttgaggttttcagtgtgaggaggggcagaggaatggttaatcttgttttggaagcttagt

SEQ ID NO: 72647 - DNA, 100 bp, Mus musculus
gatttgcccatggctctctggctctctggctctctggctctctgattttggaggtaaagggcagtcagcagtcctggctgtctttatctgacaaatacag

SEQ ID NO: 72648 - DNA, 87 bp, Mus musculus
gtgagttcgaggccaccctgatctacagagtgagttccaggacagccaggactacttactcagtgtaactctgtctcggacccccac

SEQ ID NO: 72649 - DNA, 72 bp, Mus musculus
gaaggggagggcacagaagagatggctcagcggttaagagcactgactgctcttccagaggtcctggtattc

SEQ ID NO: 72650 - DNA, 109 bp, Mus musculus
tattggctggctctgggtccatcttccagtgcagtgttggatggttgaagtatgaagctcctaacactgtctggtaaagatggcccccgggtcagttccttcagcagtg

SEQ ID NO: 72651 - DNA, 115 bp, Mus musculus
gaaggtggactggttgggtaggggccctcgtcttacccagcagtgtttgggtgctggttgggagtctctaatactgccgggtaatgatggaggcccctgtcccagtgtcatcggc

SEQ ID NO: 72652 - DNA, 76 bp, Mus musculus
ggggacagtcaggggagaagacgggatcagcctttctccctgagtccctcaatgctccccctttgagggctgcccc

SEQ ID NO: 72653 - DNA, 119 bp, Mus musculus
ggggttggtgggttctaggcccaggtagttattgtcctgccgaaaatttgagagtcagagaagtttgagagtagaagtctggccaggcatagtggcacacgcctttaataccagcactc

SEQ ID NO: 72654 - DNA, 117 bp, Mus musculus
tgtagtcctggctgtcctggaactcactttgtagaccaggctggcctcgaactcagaaatctgcctgcctctgtctttgcctcccaagtgctgggattaaagccgtgcgccactaca

SEQ ID NO: 72655 - DNA, 65 bp, Mus musculus
ctgcctggaagagggtgactccgtgtttgggacaccaattctggcaccaaaacttttctactcag

SEQ ID NO: 72656 - DNA, 103 bp, Mus musculus
gctcagggactgctgcccagaagaagacaggctcactcactttcatccaggttgatgtagtcctgccgctcttcctggtcccctgtgcggtggtttcgggagc

SEQ ID NO: 72657 - DNA, 116 bp, Mus musculus
gcctccctggagtactgggattaaatgcatgtgccaccatacacaacttgtcattttctttttaagactttaagttgggtgtggtagtacacagatttagtctcagcacaagaggc

SEQ ID NO: 72658 - DNA, 62 bp, Mus musculus
ggttcctcaagctaaagctttctgattccttgtagggatgaaggttgtatggtttggtaacc

SEQ ID NO: 72659 - DNA, 112 bp, Mus musculus
ggtaccacgtctgctcctgggctcactcactacctgttaggggccacgtctgctcccgggctcactcactccctgttaggtaccacgtctgcccctgggctcactcactatc

SEQ ID NO: 72660 - DNA, 116 bp, Mus musculus
gttttttaagattttattttattttgtgtctgggtgttttgcctgcatgtgtgtctgtatgtcacatgcatgttgtacccatagaggccagaagagggcatcggatccactggaac

SEQ ID NO: 72661 - DNA, 70 bp, Mus musculus
gtctgtctgtatttgtctgtctgtctgttatggagttacataataagtggtttggggagtaaaggcaggc

SEQ ID NO: 72662 - DNA, 126 bp, Mus musculus
tctaggctccaagttcagctctgtcatttaacctgtgcctggccttggttgacttctgattttgttctccctaaactgggggtgggggtggggggtgagacggggaccagaaagatggttagcaga

SEQ ID NO: 72663 - DNA, 72 bp, Mus musculus
tagtgtgtgtgtgtctctctctctccacatgccacggtgcatgtgtggaggttagagaacaaattcacattg

SEQ ID NO: 72664 - DNA, 58 bp, Mus musculus
aggggctgtagcactggtcgatgctttggttcgtgcgtcacacagtgactcagtgctt

SEQ ID NO: 72665 - DNA, 82 bp, Mus musculus
ctatgctgggaggagaaccattgagctgctttaggcatatcaaaatataaaggctgtgtgtgtctctcttattcaggaatag

SEQ ID NO: 72666 - DNA, 138 bp, Mus musculus
atacatatatatatatatgtatgtgtgtgtgtgtgtgtgtgtgtgtgtgtgtgtgtgtgtgtatgtgtataaaacatatatatgtatatatacatgtatgtatatatacatatacataaatatttctaatacacatat

SEQ ID NO: 72667 - DNA, 85 bp, Mus musculus
atacatacgcataatgtgtgtgtatatatatatacatatatgtgtgtatatatatatatatacacacatatatatgtgtgtgtgt

SEQ ID NO: 72668 - DNA, 68 bp, Mus musculus
ctgcctgcctgcctgcctgcctggggagtggggccgctctgcagaggtatggagacggctactggggg

SEQ ID NO: 72669 - DNA, 147 bp, Mus musculus
tgagatggcacccgtggaagaagagtcgtttatgctgggctaactggcttgaacaaatgacttcctctgtctgtgcctctgtctcacttgtggagagtgcctgcctcatgggtggtgggaggactgactccggttgttattgcaggt

SEQ ID NO: 72670 - DNA, 111 bp, Mus musculus
acatatgtatacatatgtatgtgtatataggtatatacatatgtgtgtatatgtatgtatatatgtgtgtatgtgtatacatatatacatatatacacacacacacacaca

SEQ ID NO: 72671 - DNA, 114 bp, Mus musculus
gtagatcctgggggctccctggctgtctgggtgggctgtaccatcggcgcagtgttctctgggtcctgcctctccctggcccagcgttatccctgagacctgcctttttctccc

SEQ ID NO: 72672 - DNA, 82 bp, Mus musculus
caggtgaatctctgtgagtttgaggccagcctggtctatacaatgagttccaggacaaccagagcaatgtagagaggccctg

SEQ ID NO: 72673 - DNA, 76 bp, Mus musculus
ggttgcatttatacattggtgcatacacatatgcacatatatgtatatgtatatgtatatgtatatatgtatcaat

SEQ ID NO: 72674 - DNA, 163 bp, Mus musculus
tatgtatatgtatgttcagtgtatgtatgtgcatgtatgtgtgtatgtatgttcatgtgtgtgtggatgtgcatgtatgtgtgtatgtatgtgcatgtgtgtatgttcatgtgtgtgtatgtgcatgtatgtatgtgtatgtatgtgcatgtgtgtatgtatg

SEQ ID NO: 72675 - DNA, 99 bp, Mus musculus
atcttgaagcttccttttgagacctccctcggaggtgcctgtcaatcacactgagtgaagggacagctgaggaggactctctggggaggtgttctcgat

SEQ ID NO: 72676 - DNA, 107 bp, Mus musculus
ccacacagaccccaggtgtacctttctcgtgtcagcacactgtgagctcactttccaggagttcccaaagttgacggggtcttcctccacctggaggctgctagtgg

SEQ ID NO: 72677 - DNA, 110 bp, Mus musculus
gggcaagtaggaggcccgagcccagtgaggatgaatctcgggaatcaggagataaggctgtgtctcactcagtcacagggaattcagaatcactctctgcctcttgcctg

SEQ ID NO: 72678 - DNA, 106 bp, Mus musculus; identical to SEQ ID NO: 65977

SEQ ID NO: 72679 - DNA, 94 bp, Mus musculus
gatatgtgtcatccaggatatgtcagtctgtatatttatctatatatgtatctatgtatatatatatgtatctgtatatctatcaacctatatc

SEQ ID NO: 72680 - DNA, 92 bp, Mus musculus
atgagtatgtacatatgtgtatatgtgtacacatgtgagtatatgtgtttatgttcttgtgtatgagtatgtatgtatatgtgtgtatgagt

SEQ ID NO: 72681 - DNA, 70 bp, Mus musculus
ctttctctgcgtctgtcactgtcactggcagggcccttgctagtggctggagaggaggaaaaggaggagg

SEQ ID NO: 72682 - DNA, 82 bp, Mus musculus
agtttgtggccatgaggtgggtgggacagagaagaactagtagtcctctgtctgtctgtctgtctgccacctgggctgtgct

SEQ ID NO: 72683 - DNA, 120 bp, Mus musculus
cagaaagttcagtatctcaagcaggcaaaggacatcctttgtctgtggctgatttgtgtctctctgtgagcagcttgccttcctggcctagagttgaaggctagctgcatagattaccaa

SEQ ID NO: 72684 - DNA, 70 bp, Mus musculus
tgtgtgtgtatatatatatatgtgtgtgtgtacatatatacatatatgtgtgtacatatatacatatata

SEQ ID NO: 72685 - DNA, 131 bp, Mus musculus
gtattgcatgtatgtatatctgtgtgtatatgtacgtacgtatgtatgtatgtatgtatgcatgtatgtatatgtgacatatatgtatatatgtgtgtattatgtatgtatgtatgtatgtatgtatgtat

SEQ ID NO: 72686 - DNA, 94 bp, Mus musculus
tctatgtacaggggggtttctgaaggcattctctgagccactgacacccacacagagggttagagaagagcccccagtcctttttgtgaatgga

SEQ ID NO: 72687 - DNA, 97 bp, Mus musculus
gctatgaccacagcaactcttataaaggaaaacatttaactggggttggctttcagtccgatgtttagtccattatcatctgtgcagaaagaatggt

SEQ ID NO: 72688 - DNA, 86 bp, Mus musculus
agaatttacccagtcctcaaggctagagattaattcttaaagtttgctgaaattcagtggatttttctctgctctgggagcagtct

SEQ ID NO: 72689 - DNA, 90 bp, Mus musculus
gaggcttctgtggccacttgtagactgggtggtgtgggtttcaatgtttttaattaaaccatccaaggatctagaaagccatgaagtgtt

SEQ ID NO: 72690 - DNA, 76 bp, Mus musculus
attctggacagcaagtcccaaatgcctcagagttttccaaatgcaggagcgctgtggatgacttgtgttttaggat

SEQ ID NO: 72691 - DNA, 112 bp, Mus musculus
ttggtctgggactagaatttagagtgtgaaagctttggtttcggttttcataatcacactagagagtgagatttgtacacaccaaaacactgctaaaaaaatccttcgccga

SEQ ID NO: 72692 - DNA, 106 bp, Mus musculus; identical to SEQ ID NO: 58252

SEQ ID NO: 72693 - DNA, 101 bp, Mus musculus
tcctccatagtctcctgtttttgagtagttggtcctcagtggtgatgctgtctaaagagaaggtgcagctttgtaggaggaaatgtgttactagggatggg

SEQ ID NO: 72694 - DNA, 198 bp, Mus musculus
tatgtatgcatgcatgcatgtatgtatgtatatatgtatgagtgtgcatgagtgtgtgtgtatgtatgtatgtatgtatgtatgcatgtgtgtatatgtatatgtgtgtatgtatgtgtgtgtatgtatgtatgtatgtatgcatgtgtgtatatgtatatgtgtgtgtatgtatgtgtgtgtatatatgtatgtgtg

SEQ ID NO: 72695 - DNA, 97 bp, Mus musculus
tctatcatctatctatctatctatctatctatctacctagctataacatattaatatacaggtaaatatgtatataggtaaataagaggggtgagga

SEQ ID NO: 72696 - DNA, 88 bp, Mus musculus
agcaggcagaaatggcagtggcagtggagtgctggggccatggtgaattccacattggctgtctggctgcctgactcccctgctactg

SEQ ID NO: 72697 - DNA, 82 bp, Mus musculus
ttttactcagaacagtgctatggcatggtatcaaatgacttctgagatatacagtgctgtcagtagtgattttgatgtagaa

SEQ ID NO: 72698 - DNA, 116 bp, Mus musculus
gcccttctgtctccctgaatgtctgtcttaggagtcatgcctcctgtgtgggactaatttgggtcagtgacttgagggtgctgagagccacattgtctctgagcctgtctcttaac

SEQ ID NO: 72699 - DNA, 150 bp, Mus musculus
atacatatgtatgtatgcaggtatatacatgtatatgtgtatcatgtatattatgtatgtatatacatatatgtacatctgcatatgtgtgtagtgtatatatatatacatatgtatgtatatgtatatatatgtatatgtgaacatatg

SEQ ID NO: 72700 - DNA, 107 bp, Mus musculus
gccatgctaggctcctgtctgcaagcacaacatggcatcagtattagtgtcaggttttggtgcccacccatgtgatgaatcccaagttgggccagacattggatggc

SEQ ID NO: 72701 - DNA, 106 bp, Mus musculus
ggttgctcatcatatatatgtatgtgtatatgtgtatatgtatatgtgtgtgcattcatgtgtgtatgtaatatatatgtgtgtgtaatatatagtacatcatata

SEQ ID NO: 72702 - DNA, 78 bp, Mus musculus
gagggagagctggctttgtcttatacactgttcagtttcagagaaaacagtgaccagtcagggctaattcttctctcc

SEQ ID NO: 72703 - DNA, 125 bp, Mus musculus
cagattgagtttgagggtgccagatgttaagtcatggtcaaggcagagctctgggctcttgtctcagtgtgaccctgtgctggcaaaggctaaaagaacaatgtcctaactgtgtctcgagggcc

SEQ ID NO: 72704 - DNA, 73 bp, Mus musculus
tgtctttgggcaagaaggagagagacaaacgctgcttgtcagctcagtctctctttctgttcagtccgggaca

SEQ ID NO: 72705 - DNA, 63 bp, Mus musculus
agaggaagtgtgtcactgggtttgaggcttcaaaagcccaagccagtctcactggctctctct

SEQ ID NO: 72706 - DNA, 80 bp, Mus musculus
tgcttcaatagaacatccaagaaaggaggatttattttcgctcactgttgtggggaatgttgactctcctggatgaggca

SEQ ID NO: 72707 - DNA, 93 bp, Mus musculus
atatacatatgacattatatatatcatgttaaatatatacatatatgtatgtatatgtgtatatatacgttgtatatatacgtatgtgtatgt

SEQ ID NO: 72708 - DNA, 106 bp, Mus musculus
gtatgtatgtatgtatgatgtatgtacgtgtatatatatatatatatatatgtatatatatatatatatatatatatatatatatatatatatatatcttctttgc

SEQ ID NO: 72709 - DNA, 84 bp, Mus musculus
gggtcctctgaaagcagccggtgcctttaactgctgggtcatctttccagcccactactcagtgtctgtttctctcaaaggcct

SEQ ID NO: 72710 - DNA, 65 bp, Mus musculus
atgtgtatatgtgcatatgtatatatatatgtgtgtgtatgtaatatatgtgtatatgtatacat

SEQ ID NO: 72711 - DNA, 112 bp, Mus musculus
tggagtacattgttcagcctcctagacagtcgtctcaaccagaaactctctgtctcaaagagtgaggcagagagtggtgaggaggacactcaaggggggcatttggcttcca

SEQ ID NO: 72712 - DNA, 84 bp, Mus musculus
gccccccttgagtgtcctcctcaccactctctgcctcactctttgagacagagagtttctggttgagacgactgtctaggaggc

SEQ ID NO: 72713 - DNA, 68 bp, Mus musculus
ttgccacaggatgtcacacaacacagagagtgcagctttccctgttccagatgacaaggccagggcag

SEQ ID NO: 72714 - DNA, 90 bp, Mus musculus
tcagagggcaacttacagaagtttgttctctgggtctcagtgtgtcagttccgggagcgagcgagcatctgttgttagcattttttctga

SEQ ID NO: 72715 - DNA, 75 bp, Mus musculus
gtctctctgtctgtgtgtgtgcgagcgagagtgcatgtgcgtgcgcgcgtgtgtgctcacacattcgttttggac

SEQ ID NO: 72716 - DNA, 85 bp, Mus musculus; identical to SEQ ID NO: 58391

SEQ ID NO: 72717 - DNA, 64 bp, Mus musculus
gtatgtatgtatgtatgtatgtatgtatgtatgtatgcatgcatgcatgtatgtatgtatgtat

SEQ ID NO: 72718 - DNA, 79 bp, Mus musculus
ctctggaacaaccacagtgctcttgctgtgtggcccctttgcggtggctactaggaaggctgactgggttagcttagag

SEQ ID NO: 72719 - DNA, 95 bp, Mus musculus
ggtgggcaggagtctgagagcaacctgggctacacagtgagatctccctttttacatatgtgtgtgtgtctgtctatcttatctatctgtctatc

SEQ ID NO: 72720 - DNA, 69 bp, Mus musculus
ccttttcattttatatgtatgagtgtttatgtaccatgagcatgcggtacctgtggataccagaagagg

SEQ ID NO: 72721 - DNA, 75 bp, Mus musculus
ctccattgtgctgactcctaaaggtgtcgctgtctctcagtatcatcacacaggaccgatgttccagctcaggag

SEQ ID NO: 72722 - DNA, 60 bp, Mus musculus
gcccatctttctgacggactgagtcagtctccagcgagctcacagcgtccagagtgtggc

SEQ ID NO: 72723 - DNA, 114 bp, Mus musculus
gtcaaagaaacatactatagtgagcctacggaaaagacaggagagagtgcacagcgcacgcaggcggacacgggcacctactttctgagggcacattccagttcgttcttctgc

SEQ ID NO: 72724 - DNA, 80 bp, Mus musculus
gtgtgtgtgtgggtgggtgcgcacatgtgtgtgcttgtgtatgtgtgtgtagttagagtgcacaattgccacacacatat

SEQ ID NO: 72725 - DNA, 111 bp, Mus musculus
tggcaagctgggtctcattcatctgtttattctgaggggcttagaaatgctttgaagtaaagatgcttctgtctaaaacctcattaaatgtgaattttctttcagtgttca

SEQ ID NO: 72726 - DNA, 67 bp, Mus musculus
ggtggggtaagaggcagaggtagctgtttctcttaggatgctctgcctctgtgtctctgaaaacacc

SEQ ID NO: 72727 - DNA, 56 bp, Mus musculus
gccatggtcacagggtctgcactggccacagtcactcacactgtgtgatctttggc

SEQ ID NO: 72728 - DNA, 109 bp, Mus musculus
ccagtcatgttcctggaggcagtgggagcaatgcagacacaaatcacagataacttgctagccttagtgatggtgcttcctcccgacctcgcagagcagatgaaactgg

SEQ ID NO: 72729 - DNA, 98 bp, Mus musculus
gtgtgtgtgatgtgtgtgtgtacagtgtgtacatataggtatatatatatatatatatgtgcacatgtatgtatatatgtgtatgtatatgtatacat

SEQ ID NO: 72730 - DNA, 87 bp, Mus musculus
ggtagtagcatggctgagtccttaggtagtagcataggtcttgcttgaaaaatatgtttctatatattaaggatatgtccaaactcc

SEQ ID NO: 72731 - DNA, 67 bp, Mus musculus
tgtggtattaagtggagcaggagcgtgaggtgttcgcacactcatcctgtctctcactgtctccgca

SEQ ID NO: 72732 - DNA, 56 bp, Mus musculus
gcatgtatgtgtgtatgtatgtacgtatgaatgtatgtatgtatgtatgtatgtgt

SEQ ID NO: 72733 - DNA, 129 bp, Mus musculus
acttcaaaggggcctggtttcatgggagaagggaggagcagcctgaggacagatgagagacagctctgaagggccaatgaagacaccaggcaggtggatgaggtacactgtagctggctccagttgtcc

SEQ ID NO: 72734 - DNA, 107 bp, Mus musculus
gctctctagaggagtgactggggctggagagatggctcagtggttaagagcactgactgctcctccagaggtcctgagttcaattcccagcaaccacatggtggctc

SEQ ID NO: 72735 - DNA, 122 bp, Mus musculus
ttgatcctgactgtggcaaactggctcctgaatctcagggattctcctgtgtctttctctcattgacagtagaatctctgacattacagacatgggccacttcgttcaacacgtgtgtctag

SEQ ID NO: 72736 - DNA, 60 bp, Mus musculus
ttagggttgaagagctggctcagtggttaagagtgctgactgctcttccagaggtcctga

SEQ ID NO: 72737 - DNA, 115 bp, Mus musculus
gtagatgcataggatcagttagttggcagagtgcttaccaagcatgcgtgaggtcctaggttcagtgctttgccccacataaactgggcatgatctgggctgtatgagagtctat

SEQ ID NO: 72738 - DNA, 73 bp, Mus musculus
gagggtggctgatggcagatggaggagaggtggggaggccactctcatactgtccctctctggccagcacctc

SEQ ID NO: 72739 - DNA, 104 bp, Mus musculus
gtcaatgagcaaggatgttaaggtagaaataagtttgacatctcatgccccagaaggacagacagacagacagacattttaccctaaaccttgtgcacattgat

SEQ ID NO: 72740 - DNA, 85 bp, Mus musculus
ctcacaggcatagccagaggacagggattctgtcagatcagacagttaacaatgtgatgtcacctgtgtgtgtagtgtatgtgtg

SEQ ID NO: 72741 - DNA, 70 bp, Mus musculus
acacacacacacacagcatgtatcatatatacaagtatatgtatgtatgtacgtatgtatgtatgtgagt

SEQ ID NO: 72742 - DNA, 78 bp, Mus musculus
tattatttttaattaaaaaaacattaacactgtacaattttagagtacagtgttacatgttgataattgcatctaatg

SEQ ID NO: 72743 - DNA, 79 bp, Mus musculus
tgtgtatgtatgtgtgtatgtatatgtatgtgtatgtgtgtatatatatgtatatgtacatatatatgtatatatatac

SEQ ID NO: 72744 - DNA, 72 bp, Mus musculus
actctcactctctctgtgctggggagcagggccacccttatttacctcctcggtggatgagacgacaggagt

SEQ ID NO: 72745 - DNA, 104 bp, Mus musculus
tgagctggcaggcaagataggaggtggttatgagtaacacatttttaaaatttgtacttctcatccctacatttttctgttatcttaaaccttatgctgtctta

SEQ ID NO: 72746 - DNA, 58 bp, Mus musculus
gtgtgtgtgtgtgtgtgtacgtacatatgtatgtatgtatgcatgtatgtttgtatac

SEQ ID NO: 72747 - DNA, 95 bp, Mus musculus
gttgactgccgcagaccctctgggtccctttgtctgtgtggacagttctctgggtgcagatggtcaaggagtcggtgggtgacagacagaccaac

SEQ ID NO: 72748 - DNA, 109 bp, Mus musculus
gtgtgtgtgtgtgtgtgtgtgtatactgaatatatatgtatacatatataagtactgaatatatatgtatacatatataagtactgaatatatatatataataattcat

SEQ ID NO: 72749 - DNA, 69 bp, Mus musculus
gcaagggcatcactcagtccagtggctgcgttctcattttcatcgcagtggctctcttgtgatcctagc

SEQ ID NO: 72750 - DNA, 116 bp, Mus musculus
ttcatactccttttattttcatggaaagtttggcaaatttttagaaaaggggacattcaaaagatgtatctttttaaagcttaattttccccaatcatggaaagaagaactgtgaa

SEQ ID NO: 72751 - DNA, 103 bp, Mus musculus
ctgtctggagcgtatctgtcccacaggaaaacatcattgactataggttccacaatgatgtctgtaactctgtctccatcccgggaaaagtctgtcacagcag

SEQ ID NO: 72752 - DNA, 119 bp, Mus musculus
acttaaaagcaatggttccatttgtattcaagaaggtttgtttctagttccatactatttcaaaaggatcaaccaggaatcagaccattttgagtgagaatgttccaaacatattaagt

SEQ ID NO: 72753 - DNA, 131 bp, Mus musculus
atatacatatatctgcatatatacatttatatgtatatttccatatatatgtgtgtgtgtatatatatgtatgtttgcatatatatatgtatatatgtatatgtatatatatgtgtgtgtgtaaacatata

SEQ ID NO: 72754 - DNA, 113 bp, Mus musculus
gtgtgtgtgtgtgtgtgtgtgtacatatatatatactgtgtatgtatatatatatacatatgtacatatatatacatatatacctatatatatacatacatatatacatatat

SEQ ID NO: 72755 - DNA, 103 bp, Mus musculus
atatcttttatttgatacttatagacacaaatgtgcaagtatgtttatcaatatatattcattgggcgtgggtgggtaggggaacagggcgcagggagggtat

SEQ ID NO: 72756 - DNA, 114 bp, Mus musculus
gctttggataagaatatgcttcaagcatcaccactgcctgatttcaatgtttattattaaactatagcatccaaaatagttcagtggtcatggtaggaaaatagacagagaagc

SEQ ID NO: 72757 - DNA, 110 bp, Mus musculus
caggaaaatgaacctaatgttgagtgtgtatttgatgtctttgataaacataggttgtcaacttatttagatctggaacggaataaaggccagggtgcgggacatgcctg

SEQ ID NO: 72758 - DNA, 111 bp, Mus musculus
gtggcttgatgaagaagctcgaaaaggtcggaaacacactgacagacactcagcttctagggatacttgtccagtgttgtttctgcttctttgcttttgtgtatttcccat

SEQ ID NO: 72759 - DNA, 85 bp, Mus musculus; identical to SEQ ID NO: 57439

SEQ ID NO: 72760 - DNA, 76 bp, Mus musculus
gctgtctctcactgtgtggctacagcagtttctcagcctactgggcagggtatctcagtagtcccagtgtggcagt

SEQ ID NO: 72761 - DNA, 94 bp, Mus musculus
acatttaacagcatatcttttgattagaattatttttatgtgcatgtgtctgtgcatgagcatgtgtctgtggttgtgatgtctgtgagaatgt

SEQ ID NO: 72762 - DNA, 116 bp, Mus musculus
gccttagtccatggtgatctgataggatgcatgggacaatttcaatatttttgtatatgctgaggcttgttttgtgactgattatgtggtcaactttggagaagctaccatgaggt

SEQ ID NO: 72763 - DNA, 70 bp, Mus musculus
gtagagggagtgggctgataaagacatttcatttttacttgagtgctccagtgtctctcactctctgtat

SEQ ID NO: 72764 - DNA, 90 bp, Mus musculus
ggatcctgccaagactagtgtacacaggtgagagtgtggacttcagaagtccctgttttgggctttcatcttctgccaggaggcaggtcc

SEQ ID NO: 72765 - DNA, 109 bp, Mus musculus
tgacaaaacatacatatgtatgtgtgtgtgtgtgtatatatatatatatatatatatggtatataatactcttcacacacatatgtcaatatatatgtatgttacttca

SEQ ID NO: 72766 - DNA, 85 bp, Mus musculus; identical to SEQ ID NO: 57470

SEQ ID NO: 72767 - DNA, 119 bp, Mus musculus
gcatatacacatatatatttatacatatatatatatatagagacacacaatatatatatatatgtgtgtgtgtacatatgtatatgtatttttgtatgtttatgtgtggttttggttgc

SEQ ID NO: 72768 - DNA, 76 bp, Mus musculus
cctcattcactgtgacactgacagagttgcaacatttacacacaatggtgaaactcccttgtctgttacagggagg

SEQ ID NO: 72769 - DNA, 104 bp, Mus musculus
gaaagtaaacaacttgagatgatgtgaaatgattgaatgatcatgacagatacactgagtctctcagacattcatgtgatatttttttatttttgttcacttac

SEQ ID NO: 72770 - DNA, 89 bp, Mus musculus
catatacataaacatatatgtacatatatatttacatgtatatgtacacatatatgtacatatatatacatatgtaaatgcacatatat

SEQ ID NO: 72771 - DNA, 80 bp, Mus musculus
gctgactgtgagcatcagcatctgtattggtcaggctctgtaagcctctcaggagacagtcatgccatgctcctgtcagc

SEQ ID NO: 72772 - DNA, 70 bp, Mus musculus
catatgtatgtatgtatgtatgtatgtatgtatgtatgtacgtatgtgtgtatgtatgtgtgtgtgtgtg

SEQ ID NO: 72773 - DNA, 85 bp, Mus musculus; identical to SEQ ID NO: 57470

SEQ ID NO: 72774 - DNA, 112 bp, Mus musculus
gtagagtgaagtccaatttccaggtcagtgttggatttctgttatttatgtttttattgaagatcagctttagtccatcgtgatctgataaaatgcatgggataatttctat

SEQ ID NO: 72775 - DNA, 78 bp, Mus musculus
ggattctctgttgagcttaatgatttgagtgttgtgtaaaggtttcgcagcattcattatatttataaggttagatcc

SEQ ID NO: 72776 - DNA, 89 bp, Mus musculus
atatggtacatttttatgccatatatatatatatatatatatatacatatatatatatatatatatatatatatatatgtaatacatat

SEQ ID NO: 72777 - DNA, 69 bp, Mus musculus
tggtgatctgataggatgcatgggataatttcaatatttttgtatctgttgagtcctgttttgtgacca

SEQ ID NO: 72778 - DNA, 108 bp, Mus musculus
aggacacagcctatagactggggtctgcctgagacacagccagcagagtctggcactctgactttgattgtctgcttcatggcttcctccaccttccgaagaagtcct

SEQ ID NO: 72779 - DNA, 85 bp, Mus musculus; identical to SEQ ID NO: 65137

SEQ ID NO: 72780 - DNA, 81 bp, Mus musculus
tgatctgtctgtcactgtccctgtactatgcagtttttatcacaattcctatgtagtacagcttgaggtcaggcatggtga

SEQ ID NO: 72781 - DNA, 95 bp, Mus musculus
ctcaagaagggggaccattgcctactgattgtatgtatgtatgtatgtatgtatgtatgtatgtatgtatgtatgtatgtctccatgttcttcag

SEQ ID NO: 72782 - DNA, 84 bp, Mus musculus
tgcatggtcatcactgaacattcagagctgaacatgataccatgttgaaagttctgtcattctaggtaggtgagggtcactgta

SEQ ID NO: 72783 - DNA, 77 bp, Mus musculus
tgaatagataggagagagtgagcagtcttgtcttgtccctaattttagtaggattgcttcaagtttccctatattta

SEQ ID NO: 72784 - DNA, 85 bp, Mus musculus; identical to SEQ ID NO: 59783

SEQ ID NO: 72785 - DNA, 116 bp, Mus musculus
ttttgtctgtgattttgttggcccattctataggaaagtgtctgaagtcactgagtagaaagttagaacagtgttggaccctgtaagaaaagagagaaacacagttatatgtggaa

SEQ ID NO: 72786 - DNA, 89 bp, Mus musculus
tataaaaagtattctaaatatcctatgtatgtatgtatgtatgtatgtatgtatgtatgtatgtcatgatagatggaggctttgctgta

SEQ ID NO: 72787 - DNA, 85 bp, Mus musculus; identical to SEQ ID NO: 57439

SEQ ID NO: 72788 - DNA, 106 bp, Mus musculus
gctttagttcatgatgatctgataggatgcatgggacaatttcaatatttttgtatctgttgaggcctgttttgtgaacaattatatggacagttttggagaaggt

SEQ ID NO: 72789 - DNA, 85 bp, Mus musculus; identical to SEQ ID NO: 63859

SEQ ID NO: 72790 - DNA, 78 bp, Mus musculus
atgccatgtgtcaataagtggatccttttcatgtctcctagacataattatgtctatttttaagatactatgaggcat

SEQ ID NO: 72791 - DNA, 85 bp, Mus musculus
ggctatggtggtctgataggatacatgggacaatttcaatatttttgaatatgttgagacctgttttgtgaccaattatatggtc

SEQ ID NO: 72792 - DNA, 85 bp, Mus musculus; identical to SEQ ID NO: 57439

SEQ ID NO: 72793 - DNA, 111 bp, Mus musculus
agctaagacgtgaatgtgttgacaaaggaaattgctggatggttaactctcacaaagtgtctcagtgactgttttctccaaaatattgtgcacatcaacttcaaatgggct

SEQ ID NO: 72794 - DNA, 112 bp, Mus musculus
aggtgatgaggatgagatgcctcacagaatgtgagtggcagggacagctttctcaatctcactgtcacacacacactctcacactataggctgcctcacctaaaacctcacc

SEQ ID NO: 72795 - DNA, 85 bp, Mus musculus; identical to SEQ ID NO: 57439

SEQ ID NO: 72796 - DNA, 77 bp, Mus musculus
gtgtgtgtttctttatgtatgtatataaatacatatgtaagtatatagtatgtatttaagtatgcatgaacacatat

SEQ ID NO: 72797 - DNA, 75 bp, Mus musculus
gggtctcagaggaagcttgactgccaagaactctgacacacacagaatctcagcatcacaggatcccagaatccc

SEQ ID NO: 72798 - DNA, 106 bp, Mus musculus
acacatatacatatatacatatatatgtacacacacacaatatatatatatttctgtgtggatgtttctgtgtggatgtgtatgtatatgtgtgcttgtcttgtgt

SEQ ID NO: 72799 - DNA, 85 bp, Mus musculus; identical to SEQ ID NO: 57439

SEQ ID NO: 72800 - DNA, 116 bp, Mus musculus
gccttagtgcatggtgatctgataggatgcatgggacaatttcaatatttttgtatctgttgaggcctgttttgtgacctattatgtggtcaatttttgagaaggtaccatgaggt

SEQ ID NO: 72801 - DNA, 75 bp, Mus musculus; identical to SEQ ID NO: 72797

SEQ ID NO: 72802 - DNA, 112 bp, Mus musculus
aatggaaattggtctgaagttctctttctttgttaggtctttgtgtggtttagatatcagagtaattgtggcttcatagaatgaattgggtagagtaccttttgtttctatt

SEQ ID NO: 72803 - DNA, 131 bp, Mus musculus
caacctcaatatgaatacataaggcttagtgcaagaccatacaggggctgtgattgttgtgtcagtctctgtgagcctctatgagttctggttggttcattctgtaggccattttcttggggtgtcataga

SEQ ID NO: 72804 - DNA, 131 bp, Mus musculus; identical to SEQ ID NO: 72803

SEQ ID NO: 72805 - DNA, 79 bp, Mus musculus
gcaactgggtctctgaggctccgagtatccctgctgagagaaaaaagtgagggctgcagagctccagtctgaggcttgc

SEQ ID NO: 72806 - DNA, 114 bp, Mus musculus
ttgtttctgaagtttgaatgggagtcattgaaagggagggagacatatttgatggaagtgaactgtttttcttttatgcagggagattattcaaattggatctcttagaaataa

SEQ ID NO: 72807 - DNA, 106 bp, Mus musculus
gccttagtgcatggtgatctgataggatgcatgggacaatttcaatatttttgtatctgttgaagcctgttttgtgacctattatgtggtcaattttggaaaaggt

SEQ ID NO: 72808 - DNA, 116 bp, Mus musculus; identical to SEQ ID NO: 72800

SEQ ID NO: 72809 - DNA, 82 bp, Mus musculus
tggtattggtcccccagaagtgagagcagagagagcccacaccctcttcatcctgcatctccttcacctcattccttctcca

SEQ ID NO: 72810 - DNA, 95 bp, Mus musculus
ggttgctaaggcagctgcttgaatgtgtgacctggtatttgtcttatgcagagaaaacacactgaacagtgcagctagccacaggtggacaagcc

SEQ ID NO: 72811 - DNA, 85 bp, Mus musculus; identical to SEQ ID NO: 62497

SEQ ID NO: 72812 - DNA, 103 bp, Mus musculus
ggtcatccacgtcagagggaaaacttagaaaccagcacttctcactcacagtgtctcaggttttcatttcccactgtgaggccgcttcaaatgaactctaagt

SEQ ID NO: 72813 - DNA, 68 bp, Mus musculus
gcatcttctcagcgaggctggaaaacaggaagtcttagtgatctttctgtctctgtctcactctttgc

SEQ ID NO: 72814 - DNA, 113 bp, Mus musculus
gggctgagtgtcccaaggtctctctttctctgcataatgtctgactgagtgggtctctgtatttgtttctatttgctgcagaggaagcctctatgatgacagctgagcaagcc

SEQ ID NO: 72815 - DNA, 93 bp, Mus musculus
ggcctctatcattctgacatgaatgtcagcacacacctcctcacggtggtactcttccgcatgttctttgacattcgtgcaatgctattagcc

SEQ ID NO: 72816 - DNA, 65 bp, Mus musculus
gtcttactctctcattctgtcttactcccttgtgagacagggtctcactgaacttggagttaggc

SEQ ID NO: 72817 - DNA, 65 bp, Mus musculus
tgagcatcagtctctgtgtccctgtgagaacacctcagcaccccaggggttcagggttgggctca

SEQ ID NO: 72818 - DNA, 108 bp, Mus musculus
taaatcactgttttgtaatcgtacgtaaagcttggacaagtctctctctctcttttaaacagaaattattctttagcttttgtacgtacgtacatcaacagcagtttg

SEQ ID NO: 72819 - DNA, 106 bp, Mus musculus
gtgttttcctgttttacatctaatggcaatgtctttttcatacataatcaaacaagtgactgtagtatgtgaccactttataacctttagaagggaactggaccac

SEQ ID NO: 72820 - DNA, 111 bp, Mus musculus
cctgctctcagcagcaatggctgaggtttttgtagaatggtgattttgtacttgaaagcatgtcccttagcgtgcagatcatcgtgaactctgagttatagcggaagtagg

SEQ ID NO: 72821 - DNA, 70 bp, Mus musculus
tgtggtgtttcctccaaggtctgattggctaaatctaaattctgtgagtctgaagcctgagagcactgca

SEQ ID NO: 72822 - DNA, 106 bp, Mus musculus
catctactgtcacgcctgcgctctacctctagtcatttgtttttgttcttgagataaggtttcatgaactcaatattgagctgagtttgatcttggctttctgatg

SEQ ID NO: 72823 - DNA, 213 bp, Mus musculus
tatatatatgtatgtatatatacatatatatgtgtgtgtgtgtgtgtgtgctgtatgtatatatatatatatatatatatatatatatatgcatgtgtgtatatatatgtgtatatatgtatgtatgtgtatatatatatatgcatgtgtgtatatatatgtgtgtatatatatatatatatatatatatatatatatatatatatatataca

SEQ ID NO: 72824 - DNA, 57 bp, Mus musculus
ctctcatccttttgctaaagttacatcccctattggagtgactgagcagagagagag

SEQ ID NO: 72825 - DNA, 78 bp, Mus musculus
cccaagtaagtaagtttctttttctaattccctgctgctatttgcaggagtgaattctaaaaggccatcagctctggg

SEQ ID NO: 72826 - DNA, 123 bp, Mus musculus
gctttccacagaggcctgagggcttgagaaaacaggcatgccaagtctgtgagaagagagtgtggcccagtaactacaagagggagtgcgaaagctctgggtgggagcttgcctgatgcagtc

SEQ ID NO: 72827 - DNA, 157 bp, Mus musculus
gtatatatgtgtatgtatgtatatttgtgtgtttatgtgtatataggtgcacatatgtatttggaatgtatatatgtgtgtatatatgtatatatgtgtacatgtgtgtagaatatatgtgtacatatgtatatatgtttatatatgtgatgtgtat

SEQ ID NO: 72828 - DNA, 113 bp, Mus musculus
gtgcccagtgtgtgtatatatgtacgagtgatgtgtgtgtatatgaatgtatatatatgtattggtgacttagtatgttgtatgtgtgtgttgcatgtgtgcacatgtgtgtg

SEQ ID NO: 72829 - DNA, 85 bp, Mus musculus
gctttaagagaactgatttacttgctgttgataaaactccgtaaaaactccacgttcatgcctgtattcccagttcttgagaggc

SEQ ID NO: 72830 - DNA, 77 bp, Mus musculus
tttaggaagatgagctgaaggcctgctggcataagtatatcctgtgtagcttgtagctctcgctctctctctctgaa

SEQ ID NO: 72831 - DNA, 103 bp, Mus musculus
gagaaaccctggctggcagctggagagatagttcagtggttaagagcactgactgctctttcacaggtcctgagcttaattcccagcaaccacatggcagctc

SEQ ID NO: 72832 - DNA, 89 bp, Mus musculus
gggtggttagagaagacagccagggggtgtgaactaaaactcctgaaaaggagttgtgtggcagactctgactgactgatttagaactt

SEQ ID NO: 72833 - DNA, 99 bp, Mus musculus
ccaggtctggtccctttcaagtcctccaggtcaaggagcagtctgtttaggtgaccctgacactccctgacactgtccaccccacttgccctgctctgg

SEQ ID NO: 72834 - DNA, 92 bp, Mus musculus
accgtagagatgtttcggggagatgtgtctctgtgagtctctcgtggtttttaacatggttcggggactctttctgcagacatctgactggt

SEQ ID NO: 72835 - DNA, 85 bp, Mus musculus
ttggctgaatgaatggaagtggtcaccgaggggaggaagaagtcgctcactgtcacaatctctgacacacagcctatttagtcaa

SEQ ID NO: 72836 - DNA, 86 bp, Mus musculus
gcagagagtgcctgtctgtctacagagtgcctgtccatggagtgtctatctacagaaagtatctgtctgcctgtctgcctgtctgt

SEQ ID NO: 72837 - DNA, 103 bp, Mus musculus
gtcctgtgaagtcatgtgagagaggaatggatagatgaatgaagattagctttctctggtttctctgttcccttcttatctcgtgaatggtgtttgacagttc

SEQ ID NO: 72838 - DNA, 101 bp, Mus musculus
gccatatgtatacaagcatatatatgaaaagatgtttgaataattacctaaaaattaggcaaatgggttatgttaatgtgtgtgtgtgtgtgtgtgtgtgt

SEQ ID NO: 72839 - DNA, 103 bp, Mus musculus
acagtcacatgtctggcccacatctgggtctctctatgcctgttaaaaaaaataatgccaggtagaaaacacctcccatgggctccatgtcaccacctgctgt

SEQ ID NO: 72840 - DNA, 110 bp, Mus musculus
gagtgggtgttatatgttctagtttatggggacaggttcagagaagattctgaggatagtatagggagatgtcatcagcaaaacttgaaagaaatgaagcagacctaagc

SEQ ID NO: 72841 - DNA, 58 bp, Mus musculus
gtgtgtatgtatatatgtatgtatgtgggtatatgtatgtatgtgtgtatgtatgcat

SEQ ID NO: 72842 - DNA, 82 bp, Mus musculus
aaatctacttctgtccctctgacacccagatctagctccctaagcaggaggagtgtccaagtgaggactcagagctgtgttt

SEQ ID NO: 72843 - DNA, 103 bp, Mus musculus
gtatgtatgtgtgtatatgcatgtatatatgtgtatgtacatcagtatatgtgtttatatatgtatatatatgtatgtgtacataaaaatgtgtatgtgtgca

SEQ ID NO: 72844 - DNA, 74 bp, Mus musculus
ggcctgcagtcagtgtaacagatgggttccctctcatgtcatgagtctcaatctggatcagtcactggttggcc

SEQ ID NO: 72845 - DNA, 64 bp, Mus musculus
atctctgcctctctgggtccctgtggaatggcaaattaccccaaaggcttcagagaaaggaggt

SEQ ID NO: 72846 - DNA, 72 bp, Mus musculus
gcccagtggctgtctctgtctctgcctgctgcctacggatcagcatgtaaagctctcagctactcctctagc

SEQ ID NO: 72847 - DNA, 76 bp, Mus musculus
ggagattggctctgtggtatttactccggcatcggtccaccccggtgagctgtgactcccacagactcatatttct

SEQ ID NO: 72848 - DNA, 110 bp, Mus musculus
gactagaatcgtcagtgctactcagtctggttgatgtagaagacccaagtgctctagtagtacttgtttattaatttcttatactgcaggtagtgccgtgttgctttgtc

SEQ ID NO: 72849 - DNA, 105 bp, Mus musculus
catatatatatatatatatatatatatatatatatatccatatataagtatatatacatgtatatgtaagtatggatgcatatgaatatatatatgtgtgtgtgt

SEQ ID NO: 72850 - DNA, 109 bp, Mus musculus
gtatatgaagaaaaacacagtgcatgtatttacttcacctctcagcttctctcactctatattgtatttctgaggggcagctacattgcacttcgtctgccttagttac

SEQ ID NO: 72851 - DNA, 64 bp, Mus musculus
tgtgctctgatgtgtgtctatgtgtagctgcactcacagggatagacaaacacgtacaggtaca

SEQ ID NO: 72852 - DNA, 75 bp, Mus musculus
agtcaggagtgtgatgctgatagtgtgggctgagcaaggtgactctgacactggctctcagcatgctttgtgatt

SEQ ID NO: 72853 - DNA, 81 bp, Mus musculus
ttctcagatcacactctgtcactgagggaatttggggcagaaactcaaagcaggaacctggaggcagaaagtgaagcagaa

SEQ ID NO: 72854 - DNA, 56 bp, Mus musculus
gctggggggagctggaggagggctgcactggctccctctctcagactaatttctgc

SEQ ID NO: 72855 - DNA, 117 bp, Mus musculus
gggaaggattcggaggtgtggccttgtagaaataggtgtgactggatgaggggggttccctgtgtctgtctctctccctcatacttgtggattaagacataagctctcagctgctcc

SEQ ID NO: 72856 - DNA, 74 bp, Mus musculus
agaggaagtatgtcactggaagtgaactttgaagtttcagatgctcaagtcagattcagtgtgtgtctctctct

SEQ ID NO: 72857 - DNA, 109 bp, Mus musculus
ggatcccagagcgcgctgtgcatgacgggagtaggcagcagggcttgtgggaaatgtagtctggcgacaccgccctgctctccattcctgtaatggctgctttcggtcc

SEQ ID NO: 72858 - DNA, 75 bp, Mus musculus
gtgtcctaaaattagtaagaagaaagtgaggtgagcatcaccacctgtcactctctgtctcctgactatggatac

SEQ ID NO: 72859 - DNA, 72 bp, Mus musculus
gtccctgagtggaggcccagagagaccactgtgtgaaaggggttgtggactctccctccctgactaagttgc

SEQ ID NO: 72860 - DNA, 81 bp, Mus musculus
gccctgactgtcttggaactcacttggtagtccagggaggcctttacactctgcctgcctctgtctctcaagtgttggggc

SEQ ID NO: 72861 - DNA, 114 bp, Mus musculus
gagcaggagactaatttgtaaaactcatcgccttgagtcagcagagagggaggaggtgaagtcactgctcccatctgccaatgactgtcatgtttgagcttttgttttgtgttt

SEQ ID NO: 72862 - DNA, 66 bp, Mus musculus
ctgaggaatgtctcagtcactctgcttccgtccagcccaagaggcaaagcatttggacattcttag

SEQ ID NO: 72863 - DNA, 72 bp, Mus musculus
agaacactgactgctcttccagaggacctgggtttgattttccagctcccttgtggcagctcacaactgtct

SEQ ID NO: 72864 - DNA, 103 bp, Mus musculus
taagaaattatctgggggctggagagatggctcagtggttaagagcattgactgctcttccagaggtcctgagttcaaatctcagcaaccacagggtggctta

SEQ ID NO: 72865 - DNA, 77 bp, Mus musculus
ggaggagatcctggcctgtgtaagagtggagagagtgagctgagtccaatcatgcatgcattccttgtttctgcttc

SEQ ID NO: 72866 - DNA, 94 bp, Mus musculus
actggccatggatttgacccggcacagtgaagcctgtgtgctctgccacacacagttctttcctgtagctgtgtctcatgaaccatgacacagt

SEQ ID NO: 72867 - DNA, 137 bp, Mus musculus
gccagcgcagccaggatggccagagggagcaggctcttcatggtgtctcgggtgtcctgtgagtctgcctctgtgtctggcgcagcagcagcagcagaggggagaggctcctacatgctgctggggaaggctgggct

SEQ ID NO: 72868 - DNA, 60 bp, Mus musculus
tgttggtgagagtttatgtgtctaccttctgacatttctatgagacacactctcacagca

SEQ ID NO: 72869 - DNA, 59 bp, Mus musculus
ctctgtgtgtccgtgtctctgtatgttcttttgagtgctacaaaggccggaaaacagtg

SEQ ID NO: 72870 - DNA, 123 bp, Mus musculus
aggtttcagagttgaaggagaaggctgaggagagatggagtccagggtctgttagaattcactcactctgagtctccttctgtgcctggtcccttttcccctcagcaaggaatttcttttcac

SEQ ID NO: 72871 - DNA, 98 bp, Mus musculus
gcacataggaatgaaaatgacttaaggcagctggagagatggcttagtggttaagagcactgactgctcttccagaggtctggagctcaattcccagc

SEQ ID NO: 72872 - DNA, 96 bp, Mus musculus
ggctggaccccaaagctataagctttctgagggaggagactaacacattagcagtgtctctgcctctctccgttttgctccatgctggcttccacc

SEQ ID NO: 72873 - DNA, 96 bp, Mus musculus
catggtggtctgaaagtatgcatgggacaatttcaatatttttgtatctgttggggcctgttttgtgaccaattatattttggagaaggtaccatg

SEQ ID NO: 72874 - DNA, 85 bp, Mus musculus; identical to SEQ ID NO: 57439

SEQ ID NO: 72875 - DNA, 78 bp, Mus musculus
ctgagtgtctcagctgctctgacaaaggtggtagttcctactatgccagacgtcagactctcagcctctgactctcag

SEQ ID NO: 72876 - DNA, 116 bp, Mus musculus
gcacagcctgctggttatgacagtgaagtgagtgtgtatctgcgtgtgtctgtgtgtgtgcgcgcacacgtgcatgcacacgcaccagtcaactcactgggcttagcggactatgc

SEQ ID NO: 72877 - DNA, 73 bp, Mus musculus
tatgaatgtatgcatgtatgcatgtatgtatgtatgtatatatgcatgcatgcatgtatgtatgtttatgttt

SEQ ID NO: 72878 - DNA, 114 bp, Mus musculus
gtcataagaatgtaactgaattgtattgctgtgcatatgatatgtatacatatatgtgtatatatatccatatatattatgttgttatatattcgtgtctaatgcttctaagac

SEQ ID NO: 72879 - DNA, 98 bp, Mus musculus
ggagcactgtatactcagaaaaaaaatgcacgatttaattgaactttcttgaaaataggcagttaaaaagtgttctgagttacaagatattttgttct

SEQ ID NO: 72880 - DNA, 106 bp, Mus musculus
atttgtgtgtgtgcatgtatgtgtgtgtatgtatgtgcacaagtatgtatgtgtgtatgtgcatgtgtacatatgtgtgcatgtgtatatgtatatgtgcatgaat

SEQ ID NO: 72881 - DNA, 105 bp, Mus musculus
ggagacatctgtatagtataaggctgttgcctgtttgctgggtcagtctctcgctctgtccctgctccagccatcagctctttattcctcaaattccatgcttcc

SEQ ID NO: 72882 - DNA, 115 bp, Mus musculus
gagtaatatggtggtagaaagggctgtaccttgacaaagttaataacaactgtctaaacttagttaattattttaaaagcatagcccctttattttccagattcacacattgctc

SEQ ID NO: 72883 - DNA, 108 bp, Mus musculus
ggtgaggacctaccattgaaaggaattgaatacagtggttaagagcactcactgctcttccagacgacctgagttcaattcccagcaaccacatggtggctcacaacc

SEQ ID NO: 72884 - DNA, 81 bp, Mus musculus
aggggtatgtgtgaatgtgtgtgtgtgggaggggggtatgtacatgtgtccatacctgtctgcctgtcagtctgtgtctct

SEQ ID NO: 72885 - DNA, 115 bp, Mus musculus
ctcctcaccacaaagggccaaggcggagttacaacgaggacagagagccaaatggcacacactctctgtgttagacctcatgggccactcagagcttagactttgtgactaggtg

SEQ ID NO: 72886 - DNA, 94 bp, Mus musculus
tctcccttcgcactcccagtaatgtccactgtctctgagtgcgtgtgagtgcagacatggggatacagtgacatactcctctgcagatcagaga

SEQ ID NO: 72887 - DNA, 95 bp, Mus musculus
tgtcactgtatccccatgtctgcactcacacgcactcagagacagtggacattactgggagtgcgaagggagatgtaagaagtggctctctggca

SEQ ID NO: 72888 - DNA, 86 bp, Mus musculus
gcctactttcgtcttgttttcgtatgtatgtatgtatgtatgtatgtatgtatgtatgtatgtatgtatgtattccatgtgtgtgc

SEQ ID NO: 72889 - DNA, 61 bp, Mus musculus
gcccatgaatgtgtgtctctgtgtgtatagatgagtgcaggtgcctacagaggccaggggc

SEQ ID NO: 72890 - DNA, 132 bp, Mus musculus
ctgtgtggccctctatgtgatgatccagaccagttatgactcacaaaggtgggggacacacaggtctgagagcagacactgaggaccttgcattgctctcttgggctgcttccccctctcagagtagagctc

SEQ ID NO: 72891 - DNA, 102 bp, Mus musculus
gtgtgtgtgtgtgtgtgtgtgcataagcatgagcatatgcttatatgtgtgtctctgtgtgtgcatatgcttgtgtgtatgtatgtctatgcgtgtatatgt

SEQ ID NO: 72892 - DNA, 60 bp, Mus musculus
tgctgtgtgattctctgtcattcttcttcctgatttccatgacagacagtaaatgcagca

SEQ ID NO: 72893 - DNA, 80 bp, Mus musculus
acacatgcacatatgcacatatgtacatatgtatatgtacatatgtatatatgtatatatgcaaatatatgtgtgtgtgt

SEQ ID NO: 72894 - DNA, 83 bp, Mus musculus
gggaaggattttatagagacctccaaatagactccccatccccctctgtctaatgtctggctgtcagtctctgcatctgtccc

SEQ ID NO: 72895 - DNA, 80 bp, Mus musculus
agcaacagaaacaggtgtggatgccagagaaatgacgcactattgtttggcaggatgggaacacttcagtttttcatgct

SEQ ID NO: 72896 - DNA, 70 bp, Mus musculus
gtattgtatgtatgtatgtatatatgtgtatatgtgtgtgtatgtatgtatgtatgggtacatatagtat

SEQ ID NO: 72897 - DNA, 100 bp, Mus musculus
tgtgctcatatatgtgtatgtatgtattgtgtatgtgtagtatgtgtgtgtatgtgcaagtacatgtgtgtgtatgtatatgtgtatgtgtgtatgtata

SEQ ID NO: 72898 - DNA, 85 bp, Mus musculus; identical to SEQ ID NO: 57439

SEQ ID NO: 72899 - DNA, 77 bp, Mus musculus
tgccccaggttctcttctctctgtgtgtgccaggaaggctccaggaagctgtgtgagaaaatcgagaagcaagggca

SEQ ID NO: 72900 - DNA, 76 bp, Mus musculus
tttgggggtttagctacctggagacaggaagacaagtggatggaacgactgggtcaggtagtaaaatgttaacaag

SEQ ID NO: 72901 - DNA, 103 bp, Mus musculus
gccaccacacccagctctttcaagactttttaaagaatatggctgagaggctgtggctgtgtctatggctgacgctgtgactgtggctgtgactgtggctgtg

SEQ ID NO: 72902 - DNA, 86 bp, Mus musculus
gctcaagccctgaaaatgagtccaagattttgaaaattagtctatataatttaatttacactgctggattttgtttctgcttgagt

SEQ ID NO: 72903 - DNA, 99 bp, Mus musculus
ctgttcactgatttacaagccgaagaaatgcaagatgaatattttatggaaaaggaatgtattgagttgcttgggaatgttcaacatcagtgagtctag

SEQ ID NO: 72904 - DNA, 85 bp, Mus musculus; identical to SEQ ID NO: 57470

SEQ ID NO: 72905 - DNA, 177 bp, Mus musculus
atatgtgtgtatatatgtatgtttatagatatatatgtatgtatatatatacgtatattgtgtgtttacatatgtgtgtatatatatgtttataggtatatatatacatatatatatacacacacataaatgtgtgtatgtgtgtttatatatgtgtgtatatatgtatatttatag

SEQ ID NO: 72906 - DNA, 59 bp, Mus musculus
caggaactctcactggggctcactgactgtcagtgactccctgagatctgatgtttctg

SEQ ID NO: 72907 - DNA, 91 bp, Mus musculus
gcaagtctgaggctgttcaatattgaaacagtgacttgaatatcactaagtggagaaacagtcactctgtgtgaggggtccaaggcactgc

SEQ ID NO: 72908 - DNA, 121 bp, Mus musculus
gcggctgagagccagggcttccttcagctcgggctcctcgcacactgctggggtaagttgtcaggagccaggaccaagagagacatcccccggactgcagttgcctaaaagaaggacacct

SEQ ID NO: 72909 - DNA, 88 bp, Mus musculus
tgtgtttgatatatgttgtgtgtgtatatgattgtatatgactatatctgtgtttgtgtgcatgtgcatatgtgtgtgactgatcaca

SEQ ID NO: 72910 - DNA, 59 bp, Mus musculus
tgtacaatgtatatatgtatatatgtgtgtacacacatatgtatatatgtatatgtaca

SEQ ID NO: 72911 - DNA, 62 bp, Mus musculus
ctgtgtgagtctgacataggtcctccgcacacacacatgcacactgtgtgagtctgacatag

SEQ ID NO: 72912 - DNA, 76 bp, Mus musculus
cacacacatgcacactgtgtgagtctgacataggtcctctgcacacacacatgcacactgtgtgagtctgacatag

SEQ ID NO: 72913 - DNA, 85 bp, Mus musculus; identical to SEQ ID NO: 57470

SEQ ID NO: 72914 - DNA, 76 bp, Mus musculus
tgtatgtatatgtgtatatgtgtatatgtgtatatgtgtatatatgtatatatacatgtatatatgtatgcataca

SEQ ID NO: 72915 - DNA, 86 bp, Mus musculus
cttatttaatggaaattaaggagcacatcgctcagactctcacagtcattgtattgagcatgtgcactacaattgatatgattaag

SEQ ID NO: 72916 - DNA, 110 bp, Mus musculus
atatatacacacatatatatatatatatgtgtgtgtgtgtgtgtatccacatatatatatgtatatatgtatatatacatacatatatacatatatatgtgtgtgtatat

SEQ ID NO: 72917 - DNA, 76 bp, Mus musculus
gcctcctctccatttccattcctgtaattctttcagataggaacaattatgggtcagagatgtgactgtggatggc

SEQ ID NO: 72918 - DNA, 112 bp, Mus musculus
gctttttatgtataagttcatatcatatcttagaggtcacttgattcattttattttatgatacatgttatataagaaaatgatagaattgcttttttttgcatgtgggagt

SEQ ID NO: 72919 - DNA, 83 bp, Mus musculus
ctgcgagtatctgcttagttaagggtttgagcatctggagccactctcactctgtgcttagaataactctctggatcttgtgg

SEQ ID NO: 72920 - DNA, 110 bp, Mus musculus
catttattacacagatgtacatatgtatatatatatatatatatatatagtatgtatgtgtgtaaatatatttgtatatataatatatgtgctatgtataaatgctacgt

SEQ ID NO: 72921 - DNA, 110 bp, Mus musculus
ttggcagcttcattgtggatgctgggaatctatcccaagtcctctgtgagagcagtcagtgctcttaactatttagatgtccctctagctccaggatgccacgttgttga

SEQ ID NO: 72922 - DNA, 85 bp, Mus musculus
ggccatggtggtctgataggatgattgggacaatttcaatatttttgtatctgttgaggcctgttttgtgaccaattatatggtc

SEQ ID NO: 72923 - DNA, 72 bp, Mus musculus
ttcaaatgttatggcctgaaagtatttaagaagattgattcaatctgacttctctctcaggctctgactgaa

SEQ ID NO: 72924 - DNA, 82 bp, Mus musculus
atatacatatatatatgcattaaaactcacacctacatgtatacatatgtaaatgtatgtatatgtatatgtatatgtatgt

SEQ ID NO: 72925 - DNA, 117 bp, Mus musculus
agagaaaaaggcaactttatggtgacagtaaagatgctttcagtccatgttcatatttattattttgaagacttcagatcatttaattaagtcaccttatcttttgcctttaattct

SEQ ID NO: 72926 - DNA, 73 bp, Mus musculus
tgtatgtgtgtgtgcatatgcatgtgtgttgatctttatataaccacatggtatttcacatatcaaaagtgca

SEQ ID NO: 72927 - DNA, 93 bp, Mus musculus
gtatgtgtgcatgtatgtatgtatgtatgtatgtatgtatgtatgtatgtatatgtatatgtatatgtgtgtatgcgtatatgtatatgcatg

SEQ ID NO: 72928 - DNA, 76 bp, Mus musculus
tcatttatttttacctctatgcatataggtctgtatatatgtatgtacatatgtatgcatgtgtggttttgtatga

SEQ ID NO: 72929 - DNA, 73 bp, Mus musculus
ctgtgtgtctgtctgtctgtccctggaagccagaagaggatgttggatttcctggagctagaggcaaatgcag

SEQ ID NO: 72930 - DNA, 70 bp, Mus musculus
aggcagtctacagggaatagtgataaacaccgatgccagagtcgtgtcactcacactgtcttgtctgcct

SEQ ID NO: 72931 - DNA, 59 bp, Mus musculus
tgtctctgtctgtctgtctgtgtgtcagagaaagagagagagagagagagagagagaga

SEQ ID NO: 72932 - DNA, 118 bp, Mus musculus
ggccatccaccggcgcacaagcagcctatcatctctgtctctgactctgactctccctatccctatagccataagttaccaacagctcttcagctaggactttgtgagcctctctgcc

SEQ ID NO: 72933 - DNA, 85 bp, Mus musculus
ctgtgctttagaaattgaataaagtctgggtcccagtggaaagcttcagttccatctacccgtgtctgtctgtctgtcagcacag

SEQ ID NO: 72934 - DNA, 79 bp, Mus musculus
atacagttctgggcttgggccttgagagatcaacgcaccaccccacgttttactctctctgtctctgcttcgagtgtat

SEQ ID NO: 72935 - DNA, 79 bp, Mus musculus; identical to SEQ ID NO: 72934

SEQ ID NO: 72936 - DNA, 82 bp, Mus musculus
atcctctgctacttgtaatcagagagcacacacccaggggtagggaagctatctgtgttgctcagtagcaggatagaaggat

SEQ ID NO: 72937 - DNA, 92 bp, Mus musculus
tctgcccctgtgcagtatgaaatgatgtttgattttaggccgaggtcatgattccagaatgagataattagtttcctgtttccatgggctga

SEQ ID NO: 72938 - DNA, 73 bp, Mus musculus
tggatgcacaggggctggagagatggctcagtggttaagagtactgactgctcttccagagatcctgggttca

SEQ ID NO: 72939 - DNA, 85 bp, Mus musculus
ggtttctgttcaaagggaagtgataagagatacagagaagataagatcaatgtttatagttttattatccttcaggacagcaatc

SEQ ID NO: 72940 - DNA, 111 bp, Mus musculus
atatgtgtttagggctaaatttttgctattagataagtagggggctcatccctaggggaagattcagtctcgctctctcagaagccaaaaattgcctgtagatcttcatat

SEQ ID NO: 72941 - DNA, 114 bp, Mus musculus
atatattgggttcctctgaaagtcatgtacaagtgagacctgccagggccctgacaatcactgagacactctgaaggatttctatgaacatgacagagtggaatagcactgtgt

SEQ ID NO: 72942 - DNA, 75 bp, Mus musculus
acagttctgacagcaggatgccttgcttatttatttttcatgaatccctagaaggcatgctctgaaggaaaatgt

SEQ ID NO: 72943 - DNA, 79 bp, Mus musculus
ggtcactggacatagtgtgttcacactgggctttagggagtcactggacatagtgtgctcacactaggctttggggatc

SEQ ID NO: 72944 - DNA, 83 bp, Mus musculus
gtcagtgacttcccaaagcccagtgtgaacacactgtccagtgacccccccaatgcccagtgtgagcacactatgtcagtgac

SEQ ID NO: 72945 - DNA, 127 bp, Mus musculus
atatgtgtgtatgcatgtgtgtacatgtgtatgtgtgtatgtatatatgcattatgcatgtatatatgcatgtatgtatgtatgcatgcatgcatgcatgtatgtatgtatgtatgtaagtgtacac

SEQ ID NO: 72946 - DNA, 100 bp, Mus musculus
gtatgtatatgtgtatatctgtatacgtgtatgtatgtgtatatatgtatatatgagtatatgtgcatgtgtatatgtgtatatttctacatatgcatat

SEQ ID NO: 72947 - DNA, 86 bp, Mus musculus
gcccagagctgatgcaatgagactgagtgggttttgatgacaccaaatcacccctgggattcactctcactgagccagtctcttgc

SEQ ID NO: 72948 - DNA, 82 bp, Mus musculus
gtttgaggtcagtgttgatgcttgactgtcgcagctggtgtccttcattcctgatgatttctctgtatcactgactgtatcc

SEQ ID NO: 72949 - DNA, 106 bp, Mus musculus
tgtatatgtatatgtatgtatgtatgtatgtatgtatgtatgtatgtatgtatatgtgtatatatacatatacatacatatatatatatttacacatgtaaataca

SEQ ID NO: 72950 - DNA, 76 bp, Mus musculus
ctgctggtattgctgtcactgtagggagtgaggactccaaggaaggagtgctttctgcagcctgactgcatagcag

SEQ ID NO: 72951 - DNA, 114 bp, Mus musculus
tgacagctgagctggaaggatggggcagcagtgaggagcccctacctggcagctcacaactgtctgtgactctaattgcaggggatctgtgccctcttccagcctgttcaggct

SEQ ID NO: 72952 - DNA, 62 bp, Mus musculus
tgtatatgcatatgtatgtatatatgtatatcccaatatatatatgcacatgtaaatgtaca

SEQ ID NO: 72953 - DNA, 105 bp, Mus musculus
tgatggagataatataagctcccatggtttgtgagtttcagaggcagcaaacaagcccagtgtgtctgagtctgtgcttcatccctatggacagctatcacatca

SEQ ID NO: 72954 - DNA, 65 bp, Mus musculus
accctctgagccatagctgaagcatttttttttttaaaagaagcattagccagctgggcagtggt

SEQ ID NO: 72955 - DNA, 85 bp, Mus musculus; identical to SEQ ID NO: 57439

SEQ ID NO: 72956 - DNA, 84 bp, Mus musculus
gataaagggtctgattccatggtaattctcatgttttactcactatgagcatttcaatgccaatggaagatctgactcagtgtc

SEQ ID NO: 72957 - DNA, 89 bp, Mus musculus
gtctgttcaggggatgggccagaccagaaggaacacgtgccactggtcaggcagagttcctgggtgcctgggtcccactgttcacagtc

SEQ ID NO: 72958 - DNA, 72 bp, Mus musculus
tgtggcatatgcatatgtatatatgcttatatataatatatatatgcatgtatgtgtgtatacatgcacata

SEQ ID NO: 72959 - DNA, 101 bp, Mus musculus
gtgtatatgtatatacatatatgtatttgtatatattatatatacatatataatatgtatttgtgcactatatatatatatgtgtgtgtatgcatgtgtat

SEQ ID NO: 72960 - DNA, 117 bp, Mus musculus
aaatgaagggaaaggggctgctgttgaccgaagaggcatgtttatctctgactcactcacattattggctccaggcagagagcagatgtaggtcatcaggaggcaaccgtggcgttt

SEQ ID NO: 72961 - DNA, 112 bp, Mus musculus
cagtgaccgccaaagggcctcaatatcattgcatgaaggaagtcagtttctatatgtgtgtcagtaggaacaagctatattcagatcatagcaaggtaaacctagtggactg

SEQ ID NO: 72962 - DNA, 109 bp, Mus musculus
gctgatctctgtgggtttcttgtaaaatgagaggtttagaatatacaagtcttcaggatttggaaatgatatgaatattttgttacgtggaaagtgttagatgattgac

SEQ ID NO: 72963 - DNA, 127 bp, Mus musculus
ccatgtgcttcatatatatatatatgtgtgtgtgtgtgcatttgtgaatgtatgtgggtctgtgtatatatatatgtgtgtgtttgtgtttgtatgtgtgtgtatatatatgtatttttgtgttcat

SEQ ID NO: 72964 - DNA, 104 bp, Mus musculus
ccataaaaggcttataaggtgttttggtgttcagtgagatggccttctgtcttgtacgtacagacacacacacactggcacacacacacagagcctgggtttgg

SEQ ID NO: 72965 - DNA, 89 bp, Mus musculus
gtagatgcttgggggctgaagagatggcttggtggttaagagcactgactgctcttccagaggtcctgagttcaattcccaacaaccac

SEQ ID NO: 72966 - DNA, 116 bp, Mus musculus
ggttgctttaagtgctctgtatgtgtgctgaatgctttaggcagtctctgtatctcagttggtagagtgactgcttaacatgcatgaagccccaggttaggtcatctgtgaaaact

SEQ ID NO: 72967 - DNA, 96 bp, Mus musculus
tccaggctgcgcatttaatctgagtgtgtctctcagttcttactgttcaacggtgatttatgaagaagatgcctaacgaatcttgtcagtttcggg

SEQ ID NO: 72968 - DNA, 79 bp, Mus musculus
acttctgttagtttcactgtgtctctgtttagtttctgttttcaggatctgtccattgatgagagtggggtattgaagt

SEQ ID NO: 72969 - DNA, 93 bp, Mus musculus
agggaaaacaagcatgcatgtgtctctgtctgtgaaaattcatgctgtatttacacaatacagacagaagtttggtggaagtttgaattctct

SEQ ID NO: 72970 - DNA, 84 bp, Mus musculus
tgtgtgctggcagaagagagattgcaaagacataaatctatgtttcagttattgtagacataagcctctgcatttgggcacaca

SEQ ID NO: 72971 - DNA, 120 bp, Mus musculus
gaagtgttccttttctccacatcctcaccagcgtgtgctttcacttgagtttttgatcttggtataagatggaatctcagggttgttttgctttgtttttctgtaatgactaaggacttt

SEQ ID NO: 72972 - DNA, 85 bp, Mus musculus
ggccatggtggtctgataggatacatgggacaatttcaatatttttgtatctgttgaggcctattttgtgaccaagtatatggtc

SEQ ID NO: 72973 - DNA, 88 bp, Mus musculus
aagaaatacacaacatatttaatatgtacatatatcatatgtatgtatgtatgtattatgcatatatgtgtgtctgtgtgttatgctt

SEQ ID NO: 72974 - DNA, 86 bp, Mus musculus
gtggtttttgtcatgagacacagacactgtacgtcggagataaagtgggatccctccctgtctgtatgtctgtgtgtcttgttcac

SEQ ID NO: 72975 - DNA, 110 bp, Mus musculus
ttcttttatggagatttagtgatatacatgtaaatgttttttaagttattttattgaacttcaatatttacatgaacgtataatccttttttaaagtctccgtgccagaa

SEQ ID NO: 72976 - DNA, 121 bp, Mus musculus
catctacttatctatcactatatttcaagcacaatgtatatatatatatatatatatgtgtgtgtgtgtgtgtgtgtatgtaagtatatgtatttatacatacatgtacacatacacacac

SEQ ID NO: 72977 - DNA, 82 bp, Mus musculus
gagaggaacatcatgacatgctgtcacctgtgcatagcatggccactgcacacacagtctcacagcaactctggttactttc

SEQ ID NO: 72978 - DNA, 62 bp, Mus musculus
ggtgtcttctcatgaagtaaaagaatgtaattggtacaatctcagaaatcagtgaggacacc

SEQ ID NO: 72979 - DNA, 79 bp, Mus musculus
gtgtatgtatatatgtcaatattatgtacatacatatgtgtgtaggaatatgtgtatgtatataagtatgtatgtgcac

SEQ ID NO: 72980 - DNA, 71 bp, Mus musculus
ggaactgcagtgattccccacctgggcaggctgagccacaatcctccaggtgacagatcagacacagctct

SEQ ID NO: 72981 - DNA, 130 bp, Mus musculus
gcatgtgcaagtgtgtgcatgtgtgtgtgtatgtaccagtgtgtgcatatgtgtgtgtgcatgtgcaagtgtgtgcccatatgtgtatgtatgtgcaagcatgtgcatgtatatgtgtgcatgtgccagt

SEQ ID NO: 72982 - DNA, 112 bp, Mus musculus
tggaaactttattgttttatttttgaagttttattgtatctgagtgtgtatttaattatattcattcagctggacatgcattgtacttcaggatgaagtgtattatttttca

SEQ ID NO: 72983 - DNA, 97 bp, Mus musculus
atgaggaaaggtgtggtctgggtgtgtctgggtgtaacagaggttgatctctttgtatttgtatttctcaaggatggctaaatttcccttttcttgt

SEQ ID NO: 72984 - DNA, 142 bp, Mus musculus
gcccaagggcagctgtgtcctgggacccctgcctgtgtgcctgtgtgcccaagggcagctgtgtcctggggcccctgcctgtgtgcctgtgtgtccaagggcagctgttctcactgcactgcagctcagcaacagggaaagg

SEQ ID NO: 72985 - DNA, 72 bp, Mus musculus
ggtgttctgtctgtatttctgtctgtgtaccacatccatgcctggtgcccagagaggagagaaggcggcact

SEQ ID NO: 72986 - DNA, 70 bp, Mus musculus
cttttagaaacgtttcctgcgatactctttattgtttttaaaaaacagtttggagttaagtttctggaag

SEQ ID NO: 72987 - DNA, 110 bp, Mus musculus
ctcttcagatgagggttctctgaaacgtgcagagtgaagataggcaggagcgagtgcttgtcctgtataatatactggggtgctcagaggaacagagcagcatcttagag

SEQ ID NO: 72988 - DNA, 77 bp, Mus musculus
tgtctctgggtgtgtgtctctatatgtgtatttatgtgtctatatgtgtgtatgcaggtacactcctttaagtgaca

SEQ ID NO: 72989 - DNA, 63 bp, Mus musculus
gagacagaagttcctcaggttagagaccctatgccctggcatctctctctatctctctgtctc

SEQ ID NO: 72990 - DNA, 74 bp, Mus musculus
ctttcatctctgtcagtctgtcatctacctgggtcagggtggacacagggtgggtgggagggatggagggagag

SEQ ID NO: 72991 - DNA, 106 bp, Mus musculus
gatcaaaaccttttgcctgctgaagttggcatgtccagcctgtagaatgtctgcactcagggggataaataacaagtcagcaggttaaacctaaggttctctgatt

SEQ ID NO: 72992 - DNA, 62 bp, Mus musculus
tgtgaatgacagcggcatctgagagagccaccacagctcagtgtgcctgtgactcagtcaca

SEQ ID NO: 72993 - DNA, 117 bp, Mus musculus
acattaagttccttgacaagctctgggattcctagagctgtccacagatctgagtgtgtactcattccctgggggtgtgctcttgagggaagggtggggtgcctgcccggaaatctg

SEQ ID NO: 72994 - DNA, 95 bp, Mus musculus
gtcttcatgtaagactcctaaccgtggaagcagccagtgtctctgactctgttgttttggggacactttgcctctaggccccgttaggagaagat

SEQ ID NO: 72995 - DNA, 83 bp, Mus musculus
atatgcacactcacatgcacactcacagacacctacatgtgtgtgttcgtgtgcgtgcatgtgtgtgtgtgtgtgtgtgtgta

SEQ ID NO: 72996 - DNA, 75 bp, Mus musculus
gcgttccagcaccagatgacttggaaacagaccccacccactaggaatctgtctctgactcagggcctggttttc

SEQ ID NO: 72997 - DNA, 88 bp, Mus musculus
ggatgaaaagcagaatttgtcagtgaggggatggagcgagaggttgagtccttttgcctctctcactgtctctatgccacaattattc

SEQ ID NO: 72998 - DNA, 85 bp, Mus musculus
ggatgttcatgaacaacagtgtcccagaagttctgcctcccgggctttctcactctcacactgaattgtccactcatgaagggac

SEQ ID NO: 72999 - DNA, 107 bp, Mus musculus
gaggactgtcaacatgacacacgcatggctaatctgagactagagtctcaatcaggcatggtctagatagcattggcacctgtgtgtgcccgtggaggattttcttc

SEQ ID NO: 73000 - DNA, 71 bp, Mus musculus
tttctctcaagtctgtggccttggaagtctgtactctattcatcagagtctctatctgacttgatgggaaa

SEQ ID NO: 73001 - DNA, 105 bp, Mus musculus
cgggaggagtgggctaatgaggctgcagcactgtcagatccaggccctctcaagacagtcccagtcagtcagtaaggtgtgaggccatctgccctgaccctcccg

SEQ ID NO: 73002 - DNA, 85 bp, Mus musculus; identical to SEQ ID NO: 57439

SEQ ID NO: 73003 - DNA, 66 bp, Mus musculus
gggcagtggaaaagaggctgcaggatgggcatatctgcctgtctgtttctctgtgtccatctgtct

SEQ ID NO: 73004 - DNA, 71 bp, Mus musculus
gttcccggtccagcatgtctccctgtgtgcccatggtgctttccggcgatctctgtgactgactgggtgac

SEQ ID NO: 73005 - DNA, 92 bp, Mus musculus
aaggaaagtagtgctacgttaaagaactcctgttggagtaaaacaacccaccaggaaatttacttttttttattggacactgcctatcactt

SEQ ID NO: 73006 - DNA, 97 bp, Mus musculus
gtgtttatgtttgagtgacaggtgcagcaggaattgggtgtctcattaaagacacctcagggcctcactgtctctctgtcaggaaacatacagacac

SEQ ID NO: 73007 - DNA, 81 bp, Mus musculus
tgacacacatatatgacataatatgacatatatatgacatatatgtatatatatgtcatattaattctatatgaaatgtta

SEQ ID NO: 73008 - DNA, 95 bp, Mus musculus
gccacaatgcagagtgctgcacttcctttctaaagagaattcacaaaatagtcaattagaaggcagtgaaattagcagaatgttagcaagtgagc

SEQ ID NO: 73009 - DNA, 118 bp, Mus musculus
gagttagatctgatatttctctattcagagttgtaatcttttactaacagttcatctttatttttaaaaagtcagtgaaagattcatttgaaccacatgttatctttgtaaatgattc

SEQ ID NO: 73010 - DNA, 76 bp, Mus musculus
cttgttgcagaggctgataagcttgggttcaccctgccacacacagggtagaaagaagacagccagcagccagctg

SEQ ID NO: 73011 - DNA, 141 bp, Mus musculus
gtgtgtgtgtgtgtgtgtgtgtgtgtgtgcgtgcgcgcgcgcacgccacaaatgtgcttacactctcactctgtctccttcatacacatttgttcctccactctgaggaccacagtgagagaaccaagtgagaagcgagac

SEQ ID NO: 73012 - DNA, 87 bp, Mus musculus
gcaagcaaattcaaatatatatttatcttttaagcctatatatatgtgtgggtgcctgaatgatgtgtgtgtgcacattgtgagtgc

SEQ ID NO: 73013 - DNA, 101 bp, Mus musculus
gcatggcatgtggcacacacagatcacagatcacactctgcagtgttgcatgatggaagaatggggactgtgacctaagtatactggaccgtatgtcaagc

SEQ ID NO: 73014 - DNA, 118 bp, Mus musculus
tattcctcccacaaacatttagactaagcagtttctcagccgaattcaggcaggagtgagttgagtgagagcaggaggtagtgtgtggtctgaatttgaatcctacatgtcaggaata

SEQ ID NO: 73015 - DNA, 87 bp, Mus musculus
atggtgtaaggtttgtatggtagtctctcccaggctcacacgatctgtcccaggcttgcacgatctaccacgagctcaataaaacat

SEQ ID NO: 73016 - DNA, 78 bp, Mus musculus
gtttgctgtgtctgccacacacagagtgtgtccctggcttcccagtaacttttgtgaaggaggcacgacacgtaatac

SEQ ID NO: 73017 - DNA, 85 bp, Mus musculus; identical to SEQ ID NO: 57470

SEQ ID NO: 73018 - DNA, 135 bp, Mus musculus
atatatgtatgaatgtatgtatgaatatatgaatgcatgtgtatttgtatgtaagtatgtataaatatatgtgtgtatgaatgtatgtatgaattcatgtatgtatgaatatatgaatgcatgtgtatatgtatg

SEQ ID NO: 73019 - DNA, 110 bp, Mus musculus
gtgtactgcagtgtgtaccaagcagggtttatgctgggctctcacagtctgtgataaagtagaaaggctcagccagatagaaggatgagtggatagatagacagatagac

SEQ ID NO: 73020 - DNA, 85 bp, Mus musculus
tcatatatttagtgtgtgtgtgcgtgcctgcgtgtgtgtgcacacatgtgcatatctgctggtgccacagatgctagaagaggga

SEQ ID NO: 73021 - DNA, 64 bp, Mus musculus
gcgcgtgtgtgtctgtgtgtctatgtgtctgtgagaattagtgtatacaaggcacccacagtgt

SEQ ID NO: 73022 - DNA, 117 bp, Mus musculus
gtatgtatgaatgtatgcatgtatatatatatatatatatatatatatatatatgtatatatatgcatatatgtgtgtgtgtgatgtgtgcatgtgtatgtgcatgagtatgcatat

SEQ ID NO: 73023 - DNA, 129 bp, Mus musculus
atctgtgaagttccccgtggcaaccctcagcttgtggaagggggctttccatttgctgtctgtctgtctgtctgtcttcaggattgactctgtgcacccggagtaggacagagtccactcaagactcgc

SEQ ID NO: 73024 - DNA, 96 bp, Mus musculus
agaaacaactgcccccgaaatactgagtcatgcagcaggttcttggttcagtcaggaagtctgtgtgtctcagtcactcttgcatagcttgactct

SEQ ID NO: 73025 - DNA, 74 bp, Mus musculus
ggactttgcagaagttagctggttgtcttttagtgttccttaaaattggtagatcggtacttctgctttttgcc

SEQ ID NO: 73026 - DNA, 68 bp, Mus musculus
gtgtgtgtatgatttgtgaatgtcagtgtgtgcacactcacactgatattcagtatttgtacatgtgt

SEQ ID NO: 73027 - DNA, 106 bp, Mus musculus
ggtaagaatgtgtatgtgtatataggcgtataggtaggggtatgtatgtgtatatgtatatgtatgtatgtgtgtatgtatgtatatatgtgcatatgtgtgtatt

SEQ ID NO: 73028 - DNA, 114 bp, Mus musculus
tcgtgggggcgaagagcagctttccacagtttgccagttggtgagacaagactttccctttggatttctttctgtatgatttggaaagctacaatattttaaagcaattcatgg

SEQ ID NO: 73029 - DNA, 84 bp, Mus musculus
tccacaatcgccggtgctcacttgtggcttcactcactgtcagagagaggaagaccgccaagtgcaaacaacagtgagagggga

SEQ ID NO: 73030 - DNA, 84 bp, Mus musculus
tcccctctcactgttgtttgcacttggcggtcttcctctctctgacagtgagtgaagccacaagtgagcaccggcgattgtgga

SEQ ID NO: 73031 - DNA, 70 bp, Mus musculus
gcatgtatgtatgtatgtacatgtatatgcataggtatgtacatgcacacatatttgcatctatacatgc

SEQ ID NO: 73032 - DNA, 106 bp, Mus musculus
ttgtgcctgtgtgtatatgtacacatgtatgtatgtatacttgtatgtgtatatatatgtatgtatgtgtatgtatatgcatatgtatatgtgcatatataaacaa

SEQ ID NO: 73033 - DNA, 85 bp, Mus musculus
tgggcccatggcagaggtggggtgggagatgtgggggcagtgagggcatgcaatgtttccctgactctgtctttctgtgtttcca

SEQ ID NO: 73034 - DNA, 78 bp, Mus musculus
gcatatatgtatgtgtatacatttatatacatatatgtatatgtgtatatgaatatatatatgtgtgtgtgtgtacat

SEQ ID NO: 73035 - DNA, 84 bp, Mus musculus
gtttgttgtcccagagctgaagagatggctcagtggttaagagcactgactgctcttccagaggtcctgagttcaattcccagc

SEQ ID NO: 73036 - DNA, 98 bp, Mus musculus
aaagccctcattttatgagacacctcaggatatgtgtgggtgtatatatatatatatttccaccataggaatgggttgaattaggttgagttggtttt

SEQ ID NO: 73037 - DNA, 204 bp, Mus musculus
cctagtgcctgcatagttcacaaagcatcagatcctccagacctggagctacagacagttgtgagtcaccagtggcttctgggaacagaactggagctacagacagttgtgagtcaccagtggcttctgggaacagaactggagctacagacagttgtgagtcaccagtggcttctgggaacagaactggagctacagacagtt

SEQ ID NO: 73038 - DNA, 67 bp, Mus musculus
cacttgtgagtcaccagtgggtgctgggaacagaaccggagttacagacagttgtgagtcaccagtg

SEQ ID NO: 73039 - DNA, 89 bp, Mus musculus
ccggagctacagacagttgtgagtcaccagtgggtgctgggaacagaaccggagctacagagacttgtgagtcaccagtgggtgctagg

SEQ ID NO: 73040 - DNA, 66 bp, Mus musculus
cagagggagaaaactgcccattttcttccagggaactcgaggggtgtgtatgtgtctgtctctctg

SEQ ID NO: 73041 - DNA, 108 bp, Mus musculus
tcaagtggtaacgtaggaaagcctttgaagatccctcatgtgctctgtcagtgtctgcgtgtgaaactgcttgaggcctctttagtgctgtgtgcgtgaacactgtga

SEQ ID NO: 73042 - DNA, 81 bp, Mus musculus
tgtgggacacagagggcggcagcatattatgggctggaatgtgttatttttccacctctaagtctccctcactttcttaca

SEQ ID NO: 73043 - DNA, 112 bp, Mus musculus
gtcttcactgtgcagccatcccttgggctcctatgtctcactctctgtcagatccggcaggtgtggcagaagtcaccaggagcttggccatggaaactgcccctgtaaggat

SEQ ID NO: 73044 - DNA, 85 bp, Mus musculus
agcttttgtttgtctgagacagggtctggggccccaggcatctgactgtctctgcgtcactagctctgggatggcccacatgccc

SEQ ID NO: 73045 - DNA, 80 bp, Mus musculus
ttggccttcattccagaacgactctccagaaagtttgtgcccctttacacagacactgcgtctctcagagagaagcccaa

SEQ ID NO: 73046 - DNA, 100 bp, Mus musculus
gcatatatattcattatacatatacataagtatatatatatgtatgtatgtgtatatatatacttttgtgtgtgtgtgtgtgtgtgtgtgtgtgtgtgtg

SEQ ID NO: 73047 - DNA, 76 bp, Mus musculus
ggccaactggcaggagccggttctctccttccaccatctgagccctggatggaactctcactctcagtctgtggtc

SEQ ID NO: 73048 - DNA, 75 bp, Mus musculus
actaactgcttcttggttgtagtgtttgcttgtctgtttaagacggtctgagcatttaggcctggctagtctggt

SEQ ID NO: 73049 - DNA, 102 bp, Mus musculus
cagaagcaaaaactgagtggcatggcacatggtgtggccttgcagaagtggaatcgtttgtatgtgtctgtctgtctgtcaatgtccctcatggcgggctgt

SEQ ID NO: 73050 - DNA, 96 bp, Mus musculus
tcagaactgggacatgggcatggactgtcacattcagcccccagggccttttatctgtgtgtgtctcagtcacccagatgcctgttccttccttga

SEQ ID NO: 73051 - DNA, 60 bp, Mus musculus
atcagtctattggtgagaatggagtattgaagtcacccactctcactgtgtgaggttgat

SEQ ID NO: 73052 - DNA, 85 bp, Mus musculus
gatgctcaattcgaaaattacactcagatctcacaggacctctcctgtgtgtgtctgtttgtcattcatccacgctttgcccatc

SEQ ID NO: 73053 - DNA, 106 bp, Mus musculus
cagatcctagttgattctgcttgcttcctcttgggaagagtagtgagtgtccactgaggtttgctagggttgactcatagtcactcatgggctccagcttccagag

SEQ ID NO: 73054 - DNA, 97 bp, Mus musculus
aactctttgtctgggtgctgggtgtttgaacatgggtcctgatgtttgcacggcagacactctcagccactgagtcacctccccagcaccaggagtt

SEQ ID NO: 73055 - DNA, 104 bp, Mus musculus
tgcacgcagttcatgaagagcagtgtatgtatatgacgtgtgtcagtgtgtgtgacacgcaatacactcctaacttactctgactggcattgccctagtgtgca

SEQ ID NO: 73056 - DNA, 75 bp, Mus musculus
tggccacacagtccatacaaacgccatgctacccctgagcatccaggacagcagagtctgtagaaagtgaggaca

SEQ ID NO: 73057 - DNA, 79 bp, Mus musculus
ggagggagggaggaaagggaggagggagggagaaagtatgtctgtctctgtgtctgtgtgtctttgtctctgtgcctct

SEQ ID NO: 73058 - DNA, 74 bp, Mus musculus
gacactgcagccacagtcaggaagaagagagccatgaatgcctgagctccctgcctgcctctttgcatacagtc

SEQ ID NO: 73059 - DNA, 91 bp, Mus musculus
agtggtgtgtgcaaagggcttccaggtgaggatggcgtgacacagactatctcacacacgccagactgggttgagaagtcaggagacggct

SEQ ID NO: 73060 - DNA, 110 bp, Mus musculus
tgtgataaaggcatctcatttatggccagggtctctcactgtctgcttgttgtcagtggggaatctctgtattgattatgctctattgcaagaagcttgttgggtgaggg

SEQ ID NO: 73061 - DNA, 93 bp, Mus musculus
gtctcagagcttttctcatgtagacagaacagatatatattaacctatcttgttgatattgccaatctctctctgtctgtctgtagccaagat

SEQ ID NO: 73062 - DNA, 112 bp, Mus musculus
tgctttcatgataacctgacgggacagaggaaacagttgtgtgtgtccacacacggtctaggacaacacaaaaaacaacatcctagctgtggggaaaagttgtgggtgagca

SEQ ID NO: 73063 - DNA, 87 bp, Mus musculus
cgctgtgcgggaccaaggtgcagtcagtgctgaggaagaaagacagtagacagactgctcaccttagagttcagatctgtgtcagcg

SEQ ID NO: 73064 - DNA, 114 bp, Mus musculus
ctatcctattttctacactatttcaatacttttctatgtgtctgtttctctcaggagaaagaagaatgtcactgtcaggaagtatatgatagatgctgttaaaataaaggatgg

SEQ ID NO: 73065 - DNA, 58 bp, Mus musculus
tgtacagatgtacatatatttgtatatacaagtatatatgtatttgtgcatttgtata

SEQ ID NO: 73066 - DNA, 119 bp, Mus musculus
tccgtgcttctggtggagaaaagttgaccagccacgtgagatctcaaaacagagtggccacacagaccactcctacaggcaggtagtcaggggcatttagcagtggctagatgtacgga

SEQ ID NO: 73067 - DNA, 95 bp, Mus musculus
gaacctgagttacagagagctgtgtgcttcatggaggtgctgggaattgaacctagtgatctgtgagagcagacagtgctcttaaccgcagggac

SEQ ID NO: 73068 - DNA, 92 bp, Mus musculus
tatatgtgtgtgtatatgtacatatatgtatatgtatgtatgtatatatatatatatatatatacatatatatatatatacatacatatgta

SEQ ID NO: 73069 - DNA, 59 bp, Mus musculus
ttggacagtgctgtagctcaccacaggacagtgctgtagctcactcacagtctgtccga

SEQ ID NO: 73070 - DNA, 123 bp, Mus musculus
ctttggcgcagtttaagtccactatggagggaggcatggcggctccacgggagctcacatctcagtgggtcaggaactgcatctagagaagactggagctagcatagactctgccccagggag

SEQ ID NO: 73071 - DNA, 84 bp, Mus musculus
tatatgtatgtatatatatgtgtgtatgtgtatatgtgtgtatatacatgtgtgcatgtatatgtatgtatatgtgtgtgtgtg

SEQ ID NO: 73072 - DNA, 71 bp, Mus musculus
gcagcgttggagtgagatgtcaccgagagggctccatccagggctctctcagtccctctcagaatgcgggc

SEQ ID NO: 73073 - DNA, 109 bp, Mus musculus
tggctctataccatatcccaccatcctgacagatctgacacaggcactcaggggctgtgtttttgcttcgatctgttcttatcaggatgtgggcccaggaccaccacca

SEQ ID NO: 73074 - DNA, 100 bp, Mus musculus
gctgagacttgcattgtaatctatttgtaaaaatcccttgggctacagagaagaatgtgtgtactttggtttttagataggatgctctgaagatgtctgc

SEQ ID NO: 73075 - DNA, 64 bp, Mus musculus
gatcttcatctgtgtgtctcactctcagtagcatggtgggtgagatgtaataaaagctgaaatc

SEQ ID NO: 73076 - DNA, 80 bp, Mus musculus
tgagtgtgacaggtgaatgtgactagacagccagactctaagcatggcatcaagtccacacaccacacctgccccaccca

SEQ ID NO: 73077 - DNA, 78 bp, Mus musculus
ggctgaatctgcactatagatcatgggaggaaggagatgctcgactcttgtgtttatcatgatctggtgcagagtgct

SEQ ID NO: 73078 - DNA, 73 bp, Mus musculus
ctgggaaggcaggtggccatgttgcttatgcccttaagaagcagagagtaatcagagagcaggtctgttctag

SEQ ID NO: 73079 - DNA, 74 bp, Mus musculus
caaatgtagtgagactcccagtctcaaagtttaaaagtaaaaagtgggctggggatatgtttcaatatgtattg

SEQ ID NO: 73080 - DNA, 86 bp, Mus musculus
tcggctgcacataactgatgagtgtgcacactaattccagcaaggacatttgctgtctgtctgtctgtatctcattatgctcctga

SEQ ID NO: 73081 - DNA, 113 bp, Mus musculus
gggcccagaaaggagctggaagtctgcacaaggggctgagtgcagagtcagctgagagggtacaggtgacagtttgcatggaacagactcacccctgatacagccagaggctc

SEQ ID NO: 73082 - DNA, 114 bp, Mus musculus
ttatttgtgtgtgtatgtatgcatgtgtgtctatctttctgtctgtctgtctatgtgtcatgtgccatggcaaaggtctagaggtcagagaacgtggtgctcaaactcaggtgg

SEQ ID NO: 73083 - DNA, 60 bp, Mus musculus
gtctctgggactctctccctgcctgcaccccatggcttggcagtgggagggtctctggac

SEQ ID NO: 73084 - DNA, 85 bp, Mus musculus
aggccgcagaggcgcacacacaggagagaaaggccaatcagcgtggctgtgttggcgcgggctccctctgtgacactctgtgctt

SEQ ID NO: 73085 - DNA, 112 bp, Mus musculus
cctcaggccccggtggttgaatacactagtctctgtctcaggccctggtggttgaacacactagtctctgtctcaggccccggtggttgaacacactagtctccgtctcagg

SEQ ID NO: 73086 - DNA, 93 bp, Mus musculus
ccaaatctggggaggaaagggtttgtctgcctacacttccatatcattgttcatcactgaaggaagtcaggacaggaactcacgcaggacagg

SEQ ID NO: 73087 - DNA, 117 bp, Mus musculus
gtgtttctgcttgatccagttgtttctgaaagaattcacagtccaagtctagtctgggtccaggatagtgcttcattgatgaatcctgtcaaacttggtaggcatgaaaggtgtcac

SEQ ID NO: 73088 - DNA, 63 bp, Mus musculus
gctctcttcacactcagtcagggatcccagcaactctgtgtccctgcttgaggaagcagcagc

SEQ ID NO: 73089 - DNA, 76 bp, Mus musculus
gcagaaaggtgcatgtatatatgaatgaacggatagagttagctagttgtatatgtatgtatatatgtatgtatgt

SEQ ID NO: 73090 - DNA, 77 bp, Mus musculus
ccttttgcctgtatgtatgtatgtatgtatgtatgtatgtgctccaagtacatgcttgctgtctgcagagttcatgg

SEQ ID NO: 73091 - DNA, 96 bp, Mus musculus
ggctgttaccagcattcagattcagaactcatgaccaccaacttaaagagtgtgggtgttaagactggaatgttctctggttgaatgttttcagcc

SEQ ID NO: 73092 - DNA, 72 bp, Mus musculus
gttatctgaaagtgtctgtctctttgtctatgtctggtgatatgtattcaaagggacaatgcccagagccac

SEQ ID NO: 73093 - DNA, 96 bp, Mus musculus
ctctgcatactggagtagcaggtactcacttacccagagctatctgtctctatttctaactgcggagccactctgggctcctgcctctggttttgt

SEQ ID NO: 73094 - DNA, 89 bp, Mus musculus
tctcaggcagcgctgcccagggattacagttgctggcctcagagctcagcctcacaacctctgactcactgtgcatgttctgcctatga

SEQ ID NO: 73095 - DNA, 123 bp, Mus musculus
cacacatacatatatgtatatgtgtatgcatacatgtaacatatgtgttatatatagtattatatatattaaccatacatgtatgtgctgtatatagtatatacatttgtatatatattatac

SEQ ID NO: 73096 - DNA, 80 bp, Mus musculus
agccttcccagtaactgtgatgttacagatggggaagtgaggttatccgtctgtctgtccgtccgtccgctggggttgct

SEQ ID NO: 73097 - DNA, 115 bp, Mus musculus
ggttcctggctcactagtacaagcaacttggaactgggcttgtcacaccaacgtagagaaatcagagtgtgcacactatgctaacagttttaagcagcattgagaaccgggtccc

SEQ ID NO: 73098 - DNA, 71 bp, Mus musculus
gggtctatgttagagtagactgagacgacagagtctatgggctagtcctcagtcagtgctggcactgagct

SEQ ID NO: 73099 - DNA, 65 bp, Mus musculus
cagggcactggctctgtggcatggtacaggttgactccctgtctctgcctcactgccaacatctg

SEQ ID NO: 73100 - DNA, 59 bp, Mus musculus
gtcccgtgttgtatgcatagtgcctgactcagcctctgtcagtcagctttacatgggac

SEQ ID NO: 73101 - DNA, 64 bp, Mus musculus
agaggtctgcagaactgaggtaatttgccaggtaggccagtgtgttctctgtctctcagcctct

SEQ ID NO: 73102 - DNA, 73 bp, Mus musculus
tctggtgggcagccatacatatgctaaatagatagatgtgtctgtctgtctgtctgtctgtctgtctgtcaga

SEQ ID NO: 73103 - DNA, 84 bp, Mus musculus
catctccctgtgtattgcggcagtcccagggactgatgggtaaacacatgcagctttgtattgcggcagccccagggactgatg

SEQ ID NO: 73104 - DNA, 90 bp, Mus musculus
ctggaatcctgaccagagtcagcttggcttgtgtgctgcaccatctcgtggtgcctctctgtctctgacattcttctccctccattccag

SEQ ID NO: 73105 - DNA, 104 bp, Mus musculus
cttctggtggcagcccagtaaaatgatgtggaggagggaagcttacactttttgcctgctttccctcactctcactggcaagttcatccactctgctgctgaag

SEQ ID NO: 73106 - DNA, 85 bp, Mus musculus
gaaaggtagttgtgagccaggagagtaagccagccagcagaatttctcatggtgtctgcctcagtccctgccttgacttcccttc

SEQ ID NO: 73107 - DNA, 82 bp, Mus musculus
gatctgacttttgtccctctgcctcagtcgctcgctgcctgtgggctgttcctgaaggattaggcagacaatggtttggatt

SEQ ID NO: 73108 - DNA, 87 bp, Mus musculus
gcaagctttgaacagtgtagagagtgaggaccctttctgttgattttgagaaaatgttcttagttccttatttagtttaatgctggc

SEQ ID NO: 73109 - DNA, 92 bp, Mus musculus
tgagggtggaatggagatgcaggtcctctgtggtggtgtgagatgtctgagagctgactgtggtgccacaggcctgtaatcccagcactcca

SEQ ID NO: 73110 - DNA, 64 bp, Mus musculus
ctttactgaggattcccttccatcacactcactgtgactggaatggcatgaaatctcagtatag

SEQ ID NO: 73111 - DNA, 110 bp, Mus musculus
agatctgttttcctgccccatgatgggtgtgtgaaacagggtgcctacggctgtctctcagtctctttatagttacctgtcttgtgcctggggtgtgtgagaagctgtct

SEQ ID NO: 73112 - DNA, 89 bp, Mus musculus
tgggtgtggccttgtaagaggagatgtgttgttgggggtggactccagggtctcaaaagccaggctcagtctcactctgtctctgcatc

SEQ ID NO: 73113 - DNA, 119 bp, Mus musculus
ctttgaaaatccctacagactttaagactgaaaaagaaagcaagaaagatattctgtaaaagtggaattttgtctgggtgaagctaagtagttgtgggtggagtagagatcgaaagaag

SEQ ID NO: 73114 - DNA, 72 bp, Mus musculus
ctgtggctgtcgattctatcactcatgcctacaatttctgtctgtgtcagtgataaaactcacagaacacag

SEQ ID NO: 73115 - DNA, 116 bp, Mus musculus
ggcagggagtgggcatgagggagcagtgtgaatgagctggcctatcagatactctcagagtctttgtaatcagctcttattttcacatgttgactccagcataatcatcaattgct

SEQ ID NO: 73116 - DNA, 91 bp, Mus musculus
ggtgggtaaaacacctgctgtgcaagtgtgaggccctgagattagacccctgtcacccactcactggcacaggaggttgctgccgcctgcc

SEQ ID NO: 73117 - DNA, 79 bp, Mus musculus
gtgtgtgtgtgtgtgtgtgaggtgtcagcttcagtactcctgtcttctcagtctctaaccttcaccacagctcagatgc

SEQ ID NO: 73118 - DNA, 80 bp, Mus musculus
gtgtgtgccaccactctgcagtgtgtgtgtgtgtgtgtgtgtgtgtgtgccaccactctgcagtgtgtgtgtgtgtgtgt

SEQ ID NO: 73119 - DNA, 117 bp, Mus musculus
aggaaataaagctattgatgttgtttcattatatagtcctattgtaaagactcattctaaatatttatgtttatatctatagatttgtgttgcttttcaaccttagcggtgtttctt

SEQ ID NO: 73120 - DNA, 75 bp, Mus musculus
ggtcagtcatactgcatctgcatttctgcattctggaagcagagtgagcaggaagtgggacagagctatgaaacc

SEQ ID NO: 73121 - DNA, 80 bp, Mus musculus
ggggccaggggttggaagagagaaaattgcagtggaactgggagggggtgctgtgtgtctctgtctttctctgtggaacc

SEQ ID NO: 73122 - DNA, 68 bp, Mus musculus
gctctctctctctctctccctccctccgcccccccccccgtgtgtgtgagagagacagagacagagac

SEQ ID NO: 73123 - DNA, 75 bp, Mus musculus
gtgactgagggaagagactgtggtcaccatgattctgtagttggatttgtgtcattggtaagttctctcagttcc

SEQ ID NO: 73124 - DNA, 109 bp, Mus musculus
catgattgcactttaaatagtgctattgttgaaaatatacaaatcccgacacagtacagagagtgctcatgggtttgtgatgtaacatacaggaagtaactatggtgca

SEQ ID NO: 73125 - DNA, 65 bp, Mus musculus
gtctctgagaaaggagattgagatgctccaggaccacacccagtctgtctccttctctcagccac

SEQ ID NO: 73126 - DNA, 56 bp, Mus musculus
tatgtgtgtgcatgtatatgtgtatatatgtgtatacatgtgcatgtgtgtacatg

SEQ ID NO: 73127 - DNA, 88 bp, Mus musculus
gtgaccctttaatacagtttttcatgttgtggtgactcccaaccataaaattatctttgtcactacttcataactgtgatttggctac

SEQ ID NO: 73128 - DNA, 85 bp, Mus musculus
ggccatggtggtctgataggatacatgggacaatttcaatatttttgtatctgttgaggcccgttttgtgaccaattatatggtc

SEQ ID NO: 73129 - DNA, 80 bp, Mus musculus
atgtatatatatgtgtctacatttagatggatagtaaatatgtatatgtgtgtatcgattgtctacatatgtgtgtatat

SEQ ID NO: 73130 - DNA, 109 bp, Mus musculus
gcatgaattttgcactctgcatgagtacttgtatgtatatatgtatataagtatgtatgtgatcagtagattgtattatatgaatgtgtgcatgtgtgtttatgagtat

SEQ ID NO: 73131 - DNA, 60 bp, Mus musculus
gtgtgtatgtgcatttgcatgtgtacctgtgtgtgtgcacatgcatttgtgtgtgtgcat

SEQ ID NO: 73132 - DNA, 62 bp, Mus musculus
tatgtacatatgcatatatacaattatgcacatgtgcatctatgtatatgtttatgtatata

SEQ ID NO: 73133 - DNA, 119 bp, Mus musculus
ggcccctgcaggatgtgctgtgctcctaagctgagatggaagttttcatcatgagtgactgatgaaagattgctgtgtcattttccagtgtggcctcagaatgaccagggacaactgcc

SEQ ID NO: 73134 - DNA, 71 bp, Mus musculus
acatgaaaggaaaggtgtacaaagcatgcctgtgtgtgcatgtgtgtgtgtgtgcatgttcatgtgcatgt

SEQ ID NO: 73135 - DNA, 77 bp, Mus musculus
gtcctccaatgtggcttggtgaagctgttttctgtacttctgtaaaatggtaacagtgagaagagagactggtgggc

SEQ ID NO: 73136 - DNA, 116 bp, Mus musculus
catgtaagatctttcagtatttgtctttctattttacttaatatatataatgttttagaaattcattcatatatgttgttgtgaaagataggattcttctgattttgttttgtttg

SEQ ID NO: 73137 - DNA, 66 bp, Mus musculus
gtattcacagagagacccatgcttttcactgattatgtggacacatgtgtgtctatctctgtgtgc

SEQ ID NO: 73138 - DNA, 98 bp, Mus musculus
gagtagaacaggggctggagatatggctcagaggttaagagcactgactgctctttcagaagtcctgagttcaatttctagcaaccacatggtggctc

SEQ ID NO: 73139 - DNA, 87 bp, Mus musculus
gatttatttcatttccatgtatgtatgtatgtatgtatgtatgtatgtatgtatgtatgcatgcatgtgcatgtgactgcaattgtc

SEQ ID NO: 73140 - DNA, 93 bp, Mus musculus
ttacttgaggggctggagagatggctcagtggttaagagcactgactgctcttccaaaggtcctgagttcaaatcccagcaaccacatagtag

SEQ ID NO: 73141 - DNA, 66 bp, Mus musculus
tgcatatatctatatatatgtgtatatatgtgtatatatgtacatatatatgtacataatatgaca

SEQ ID NO: 73142 - DNA, 70 bp, Mus musculus
gctgctgtacactgggaggctgcctgtttgacactgcgtttaccacaggaccagatatccctttggtagt

SEQ ID NO: 73143 - DNA, 116 bp, Mus musculus
agagagagaaagagagagagagagagatactcctagcactttgaccatattatctcccaactcacacacacactctgcttaggattctatccttggttcttttctcattctcttct

SEQ ID NO: 73144 - DNA, 100 bp, Mus musculus
tgcatttctgacccattctgacagctggcaaaggacacaacagagaaatatttttttttctttttggtggggggtggggggagaactgggatggagggta

SEQ ID NO: 73145 - DNA, 78 bp, Mus musculus
gtaagttcagtttcataagcctaatttttatatctttagtatctttaaagagaataaattgggttttgtgactattac

SEQ ID NO: 73146 - DNA, 66 bp, Mus musculus
ccagacgtagagacagctcagagtgtccaaagtgaacatgaccagactgagctgggtcatgtaagg

SEQ ID NO: 73147 - DNA, 73 bp, Mus musculus
taggaacagatatcagaggctgctttcataaaggctgcttcagtcctttagaaagcaaccccttttgttcttg

SEQ ID NO: 73148 - DNA, 73 bp, Mus musculus; identical to SEQ ID NO: 73147

SEQ ID NO: 73149 - DNA, 118 bp, Mus musculus
gacatgcctattacatatttgtatgacatcacaagtcactggaagagcctccaaatagtcaatttctttttgagaagatttcagtgtctttgtcttgacagataggttagaattagtc

SEQ ID NO: 73150 - DNA, 105 bp, Mus musculus
gctatccataatctcatagccaaaaatgtaagtcatgtgattttcttgaaacactcacccaaatcataacacttaagttgcttctccttggcatgacttggtggc

SEQ ID NO: 73151 - DNA, 95 bp, Mus musculus
acctggtctggacaaacagagcaatgtagtaaggccctgtctcaaactcgcacacacacagaggtttttgtttttgttgttttagctgaccatgt

SEQ ID NO: 73152 - DNA, 90 bp, Mus musculus
gccctggagcatcatgtttgtatagaattaagtacatcctctcccactgaggccagacacgtgctccctctgcttacactgtgccagggc

SEQ ID NO: 73153 - DNA, 95 bp, Mus musculus
gcttattagaatctcttgccaacattctgtctccctctgcagtataaattgttagggcagttgtgagaatagagtgagtggacttttttcaaagc

SEQ ID NO: 73154 - DNA, 70 bp, Mus musculus
agcaatggattgtgactctcaagtcccatgctacaaaaaaggagagcatgagagtctcactgtcactgtt

SEQ ID NO: 73155 - DNA, 97 bp, Mus musculus
tctttaagcagtgttccataaatttgaatatatttcaatatcgtgcttcaggtaaaatcaggaagtcttatataaattttgagacatatgcttatga

SEQ ID NO: 73156 - DNA, 85 bp, Mus musculus; identical to SEQ ID NO: 57439

SEQ ID NO: 73157 - DNA, 89 bp, Mus musculus
tagctatgatttgtagaagagagtgaccaccagctctggtgtatgtacactatgatttcctgactctttctctctatctgctcattcta

SEQ ID NO: 73158 - DNA, 112 bp, Mus musculus
gttgaattcagttcattgcagtacagttgaattcagttgagttcctgtcgctctgttcaggtcatagagtcaggtactcagtgcagttcagtttgtggcattgagaggcagc

SEQ ID NO: 73159 - DNA, 90 bp, Mus musculus
tatgcatatatgtgtatgtatatatgtgtatatgtgcatattccctatatgtatatattttatacatgtatatatgtatgtatatgtgtg

SEQ ID NO: 73160 - DNA, 81 bp, Mus musculus
cccaccaggtgtctccctccctctcagcttgtggttgctttcttctccctcccaagtgggactgaggcatcctcacttggg

SEQ ID NO: 73161 - DNA, 103 bp, Mus musculus
ctggaccattctgagtagtgatgatgttctccttgcttcctttaaccaagctgtaataggatgaaatgtaataggatgggtgatcattaaaagaagattctgg

SEQ ID NO: 73162 - DNA, 90 bp, Mus musculus
gtttgaaaatgcttggcccagggagagacactactagaagacatggcttcgttggaaaaagtgtgtcactctgtgggtgggttttcagat

SEQ ID NO: 73163 - DNA, 111 bp, Mus musculus
gttatatatgtgtaagactcagctatatatatatatacatatatatatatatatatatatacatatatatatatatatatatactgtagtatatatagtatataacatata

SEQ ID NO: 73164 - DNA, 65 bp, Mus musculus
gcccaggtgctccacatgacttagtagagtactttgagtgtctcagtgtctgtgtcatctgtggc

SEQ ID NO: 73165 - DNA, 153 bp, Mus musculus
atatacaattcatatacatatgtatatatgtgtacacacatatgtatatatgtatgtgtttgtgcgtgtgtgtatatatatgtgtatatatacatgtgtgtgtgtgtgtatatatatatatatatatatactgtcagtctctatatactatac

SEQ ID NO: 73166 - DNA, 99 bp, Mus musculus
gaacaataaatactaatgacacatgaatatatgaatatatatgcatatatatgtgtatatatgtatatacatctgcatgtatattagcatttgaacttc

SEQ ID NO: 73167 - DNA, 89 bp, Mus musculus
cttctttcattaaatgtatttctttaaatatacatactctgaaagccgagaactttatatttatctagcaagtcaatttagtgaagaag

SEQ ID NO: 73168 - DNA, 90 bp, Mus musculus
tgttgttgtttttgaaaatacagaaaatttcatggagtattttaattgtagtttatcaagtttaatttatgtttatcaagaataatgaca

SEQ ID NO: 73169 - DNA, 115 bp, Mus musculus
ggaaaacagccgctcaagaatatgttagagaggttttacaagaatatttttattaactatgttgtacttaatgttttcatccatttcatgatgcttcttcttgttggctagatcc

SEQ ID NO: 73170 - DNA, 106 bp, Mus musculus
gccttactccatggtgatcagataggatgcatgggataatttcaatatttttgtatctgttgaggcctgttttgtgaacaattatgtggtcaaacttggaggaggt

SEQ ID NO: 73171 - DNA, 113 bp, Mus musculus
cagctccctcaatcctttgctcagcagtcttcctcaagtctcccctagtcaggttcacaccctgctttcttgacttccagggcattgttaggtatttacaaagttgactgttg

SEQ ID NO: 73172 - DNA, 110 bp, Mus musculus
aggaattatggtggtgctcatattaggatagggcaagtagttgcttacaaagttaaatagcctgtgccactatgttgtcttccttatactttgagctactatttcttcct

SEQ ID NO: 73173 - DNA, 127 bp, Mus musculus
tacttcttctctcgtcatggaacctcatcttccttggatttgtgcactccctttgcacactgtcacagtctctttgagctcatatgttccagtcctgttgtatctgtaaagccttgtttccttggag

SEQ ID NO: 73174 - DNA, 69 bp, Mus musculus
gaatttaagggctggagagatggctcagtggttaagggcactgactgctcttccagaggtcctgagttc

SEQ ID NO: 73175 - DNA, 68 bp, Mus musculus
ggacttgaggctggagagatggctcagtggttaagagtgctgactgctcttccagaggtcctgagttc

SEQ ID NO: 73176 - DNA, 69 bp, Mus musculus
tctatgatcagtgaagtgactgagcccttcctggacctctgggctgtcatggacactgagcaatgtaga

SEQ ID NO: 73177 - DNA, 79 bp, Mus musculus
tctctgtgagactgtccctgtgtttctatctaacaaatggcttcatttattgaatgacacagaaaacatcacatgggga

SEQ ID NO: 73178 - DNA, 96 bp, Mus musculus
tagctatatgtgtgtgtgtgtatatatgtatatatacatatgtgtatgtgtgtatgtatatatatacacacacaaatacatagatacatatatctg

SEQ ID NO: 73179 - DNA, 74 bp, Mus musculus
gtttttgatcctagttgcttgtgactcggagagaagccatgttctcactcagtctcactgcagagacaagaaac

SEQ ID NO: 73180 - DNA, 79 bp, Mus musculus
gtgaccacttgtgtctctttcaccttgcccgggtccactgttgatcccagctatggtgtctgtgacagagaaaggatac

SEQ ID NO: 73181 - DNA, 140 bp, Mus musculus
aaaattgggtcgtgagccttctttcctatttcctaggactttgggaattcatatgggggagggtttggaagactagtgttttagggatatgtagactgtgaagaaagatgtcttctagtgtttttcctggtacatcccaa

SEQ ID NO: 73182 - DNA, 85 bp, Mus musculus
gtcgaggctgatgtaaggtgattggttatagataagcagctgtgttaactaagaaaccagggtccttctgtgtcattgccagggc

SEQ ID NO: 73183 - DNA, 73 bp, Mus musculus
tctctctctctttctctctgtgtacgtgggtttactttttttgtgtgtgggtacatggaggtcagaagtgaga

SEQ ID NO: 73184 - DNA, 68 bp, Mus musculus
gtggccacaggagctttcttctgctgaagccatccacatcaggaactaggttgagagcttttgtccac

SEQ ID NO: 73185 - DNA, 66 bp, Mus musculus
ttctatccctcagatgcccagggaggactgaggcctccttaccttctctctgtgtctgtgatggaa

SEQ ID NO: 73186 - DNA, 60 bp, Mus musculus
tccagtgttagggtttctgttgctgtgaagacacagtgaccacagactctcataaaggga

SEQ ID NO: 73187 - DNA, 80 bp, Mus musculus
tttatctatctatatgtatatgtgtgtgtggttagatagatagatagatagaaagatagatagatagatagatagataga

SEQ ID NO: 73188 - DNA, 100 bp, Mus musculus
aggacacgatgtgtttgttcactcttgggctgttctgctactctcttctctgtctatcagagtctagcacatgcccagagattggagaatacaatgttct

SEQ ID NO: 73189 - DNA, 85 bp, Mus musculus
cccagctgactgcctctctctttctgcactgttcttaaatagcctccctttcctgctcatgagagttgggcagatcctatttggg

SEQ ID NO: 73190 - DNA, 72 bp, Mus musculus
cttgggtctgaactgtctcagcacaggggcagttgtccttagaatctgctgcaaagaccgttctgacaagag

SEQ ID NO: 73191 - DNA, 56 bp, Mus musculus
acacatacacacacacatatgtatgtatgtatgcatgcatgtatgtatgtatgtgt

SEQ ID NO: 73192 - DNA, 112 bp, Mus musculus
atatggatatgtatgtatgtatatatgtgtgtttgtatatacatatacatacacacacacacacacacacacacacacacacacacatatatatatatatatatatatatat

SEQ ID NO: 73193 - DNA, 109 bp, Mus musculus
agctcatctggaaactattaattgctatccttgatttctgaatttctaaatcagtgattttattgttatgttaagtgaaggaagcctttacttggttttacagaaggtt

SEQ ID NO: 73194 - DNA, 114 bp, Mus musculus
gggatcgagggtagactgctttttaagaggttctccaattgtttaccttggactgatgtcacaaatgacagaaaacatgtaattttggcttttaaatctgttttatttggtctt

SEQ ID NO: 73195 - DNA, 109 bp, Mus musculus
tgtcctgtgggtaggcaaggatatttaagagagtaatcagactgagcagaaggacaaaccctgagaatgttaagctgtataaagaattaaaagttgatgctgctggaca

SEQ ID NO: 73196 - DNA, 94 bp, Mus musculus
cctacattccccctctctccatgaactagagtgtgagctctctgagatcaaggactcagctactctattccagcccctagagcacagaaatggg

SEQ ID NO: 73197 - DNA, 76 bp, Mus musculus
tccttcatggccagaaggcatactccgtcaggaacctgctcctcctggccctgtgtaactctctgacagtgaagga

SEQ ID NO: 73198 - DNA, 106 bp, Mus musculus
tttcaagctgtgtccctgattctttatctgctctgtctgtttgtgtcaggattgtttcacagttggagccagaagtctaatacagtgggaaaagaatgtcagagct

SEQ ID NO: 73199 - DNA, 87 bp, Mus musculus
gcactacagacaagccttagggattggctcttagagaacagagagtggaaaagggtcatgcacagcctatctggttttctctggtgc

SEQ ID NO: 73200 - DNA, 85 bp, Mus musculus; identical to SEQ ID NO: 65558

SEQ ID NO: 73201 - DNA, 106 bp, Mus musculus
gtgttcatatctaaaattttgttatgagtatatgtatatatatggatatatatacagatatggatatatatatggatatgtgtgtatatggatatatatatatatg

SEQ ID NO: 73202 - DNA, 95 bp, Mus musculus
gagcctctctccttcctgcctcatagcatggtgcttgatgtatgcacttttgatatctctcttgcactctctgagacagttgatgagtgtagctt

SEQ ID NO: 73203 - DNA, 114 bp, Mus musculus
gaggcccagtggaaaggatgttgggtcagggaagtggcttatgaaggagatagtctcactctctttctgtttcctggtcccaacatgctgagcagccatattaaaaggtgtttc

SEQ ID NO: 73204 - DNA, 86 bp, Mus musculus
gaaggattctcatgtttctttgggtgctctctctctctctcccgagactagagtggggggggggggtccctgaaagggggtcttac

SEQ ID NO: 73205 - DNA, 85 bp, Mus musculus; identical to SEQ ID NO: 57470

SEQ ID NO: 73206 - DNA, 119 bp, Mus musculus
ttctgcgaagtttcaggagtcagtgtttttgctgttgtcgttttaccccggtgcttccatttttatttttaaagtacagcaaagtaaaatatttaggaaaaagcctgctgagagtggga

SEQ ID NO: 73207 - DNA, 85 bp, Mus musculus
gctttgcatacatattacagtttacagacttgtgtttttgaaggatttcggagaatgtgtctctgtgtgtatgtgtttctcaagc

SEQ ID NO: 73208 - DNA, 93 bp, Mus musculus
aaattgggacttccgtcacttgctgtcaaattactcaatgtctctcagagtcaatgactggtttaacagtaaagtggtaagtagggacaattt

SEQ ID NO: 73209 - DNA, 194 bp, Mus musculus
tccttgaccaaggtatcattgagaagagtgttgttcagtttccacgtgaatgttggatttctattatttattttgttattgaagatcagctttagtccatgatgatctgataggatgcatgaaacaatttcaatatttttgtatatgttcaggcttgttttgtgaccaattatgtggtcaattttagagaaggt

SEQ ID NO: 73210 - DNA, 86 bp, Mus musculus
gtgtgtatgtatatatatatgtacatgtgtgtatatgtatttgtgtatgaatatatgtgtgtatgttagtatgtgtgtatgtatat

SEQ ID NO: 73211 - DNA, 82 bp, Mus musculus
tttcctcagtctcctctccatttctatccctataattctttcagacagaaacaattatgggtcagagatgtgactgtggaaa

SEQ ID NO: 73212 - DNA, 84 bp, Mus musculus
tgtctaatgatcctactgctagagcagcctctactggtacctttctgaccactggatagctgctgacagtagatagactggata

SEQ ID NO: 73213 - DNA, 117 bp, Mus musculus
aggttgcttattagttgaagctctagtagttattaaattgaaattaaaagatatatattagttttgttggttttttttttttaaattattgtgagagttacactggtgcagtgtctt

SEQ ID NO: 73214 - DNA, 85 bp, Mus musculus; identical to SEQ ID NO: 57470

SEQ ID NO: 73215 - DNA, 84 bp, Mus musculus
caggccttatacctcgaactgatcgcctattgatttaaagtctgttctctgtctttaaatctctgggagaggaatactggtttg

SEQ ID NO: 73216 - DNA, 91 bp, Mus musculus
cagaaccaatttcagtgtgtgtgtgtgtgtctatgtatatatcaattatttgattttgatcatttatatttccatacattgaacaagtctg

SEQ ID NO: 73217 - DNA, 88 bp, Mus musculus
ctcaagtaatagagatcagtgaagacagagatgagagatgcataaaacattgcatgtctagctagtcaagccatcaatgttctttgag

SEQ ID NO: 73218 - DNA, 85 bp, Mus musculus; identical to SEQ ID NO: 58391

SEQ ID NO: 73219 - DNA, 113 bp, Mus musculus
tgtatgcttttgtcttgttgtctgagtgactgaatgttctgtgtttcttgttgaaaaataaaaatggctaaaactttatctgctggttcaacaaagaccaagagtggcctaca

SEQ ID NO: 73220 - DNA, 90 bp, Mus musculus
agttgatggagacaatacatttagagcagaaggtttctcatcttctgtatattatctggctctgaatttttatatttgttcccatctgct

SEQ ID NO: 73221 - DNA, 95 bp, Mus musculus
acactaaacaacatggtaaggatacatagaggtcctgtttaggctgtctcagtttctgtgaatctatatttgttttgatcatgtagatttagagt

SEQ ID NO: 73222 - DNA, 70 bp, Mus musculus
tggcacaaggagcttctagaatatcccagagacctgggatgttggaagtgctcagaattcagtgtgcaca

SEQ ID NO: 73223 - DNA, 94 bp, Mus musculus
aatattttgaatatatctgagtatatacatatatattcaatgatttaaatatatacatgcatatatatgcatataatgcagaattcaaagcatt

SEQ ID NO: 73224 - DNA, 84 bp, Mus musculus
tttgaattctgcattatatgcatatatatgcatgtatatatttaaatcattgaatatatatgtatatactcagatatattcaaa

SEQ ID NO: 73225 - DNA, 90 bp, Mus musculus
gagttacctcactcagaatgatattttctagttcatttcatttagctgcaaagctcatgatgacctggttttaatagctgagtagtattc

SEQ ID NO: 73226 - DNA, 97 bp, Mus musculus
ccaagcaaatgtgaatttgaaaaatactgtagtgataaagagtaacatatattttattaaatgtcatgtaacagtgtttacttcatacaatgtaggg

SEQ ID NO: 73227 - DNA, 70 bp, Mus musculus
tattgtagagattatatatatatgtgtgtgtgtgtatatatatacatatatatatatgatatttatcatg

SEQ ID NO: 73228 - DNA, 85 bp, Mus musculus; identical to SEQ ID NO: 57439

SEQ ID NO: 73229 - DNA, 72 bp, Mus musculus
gcatttctgcatttcttttgtatagattttagactgctttctgtaccaaagaccctagaatgtaggggttgc

SEQ ID NO: 73230 - DNA, 113 bp, Mus musculus
atatacatatatattctctgatatttacatgtatataatattctgtttctgaaacaggaaatatttaatatatatatgtatatacatacacacatacacatatatatgtatat

SEQ ID NO: 73231 - DNA, 85 bp, Mus musculus; identical to SEQ ID NO: 58391

SEQ ID NO: 73232 - DNA, 65 bp, Mus musculus
acactcaccaatgtgttgagtatatatgtgcgtgagtgtgtatgtgactgtgactgtgtgagtgt

SEQ ID NO: 73233 - DNA, 80 bp, Mus musculus
ggcttcactctacactgaaggactatgggcaattaattgtcactagagacagtggatttattttcttcagttgtatagtc

SEQ ID NO: 73234 - DNA, 103 bp, Mus musculus
caagcctcatcatttcagccacaagtgttttatacttgtctgattatttttaaatgtgttcagataagtaaaaattcatatgtagctagatacatccctattg

SEQ ID NO: 73235 - DNA, 78 bp, Mus musculus
tttctctatttctgtacacacacgcacacacacacatatgtatatatatatgtgtgtgcatgtacagaaatagagaaa

SEQ ID NO: 73236 - DNA, 99 bp, Mus musculus
caggaaattgacagaggatttctggattaacatttttgaggtgggtgggtgcacagtcattttctgagagcttaacttgagtgagtctttacaatcctg

SEQ ID NO: 73237 - DNA, 112 bp, Mus musculus
tctccttgtagcttctttgtttggaacatgccatctggggtaatatccagtcctgtgttactctagacattttctacttgttatttctaggctgaataggttttttggggga

SEQ ID NO: 73238 - DNA, 98 bp, Mus musculus
ttcctgtttcacataattaactgtaggtcagtaattttaatgcttatttagtatttcattatgtaaatcactgttatttacaaattatgtgtttggag

SEQ ID NO: 73239 - DNA, 63 bp, Mus musculus
gtgtgtgtgtgtgtgtgtgcatgtatataaatgtgattgtatatgttacatgcgtatgtacat

SEQ ID NO: 73240 - DNA, 68 bp, Mus musculus
aagcagagctcagtgaagactgagtggaataacctcccactctactcatgttttgggaagttctgctt

SEQ ID NO: 73241 - DNA, 90 bp, Mus musculus
gtgtgtgtatatgtaatgtgacgggaatgtgtatgtatataaatatatatacatatatatacatatttatacatatatatgtatatatat

SEQ ID NO: 73242 - DNA, 88 bp, Mus musculus
gctgcatgcctacgaaggtcagagaagagagtgtgtcaagcatatagaggactaggctcttttctcagtttcttagatgtgtgctggc

SEQ ID NO: 73243 - DNA, 122 bp, Mus musculus
gggatttgaaaggagccacaaaagaaaaccatcatgcatgtatttaaattaatagacagaatattttattttatgcatgtaaatatggtagttctttccattggcctttcttccttcctttc

SEQ ID NO: 73244 - DNA, 85 bp, Mus musculus
tgcatatgtatcacggagtctgcttttgtgattttatgggattcctaacaagtatgactctgcatctgcatctctttcttgtgca

SEQ ID NO: 73245 - DNA, 78 bp, Mus musculus
gatgctgttgtagatgccaacaagtgcttcctgacagaagcctgacaggagactctcttgagaggctctgccagtacc

SEQ ID NO: 73246 - DNA, 67 bp, Mus musculus
gctggagagatggctcagcggttaagagcactgactgctcttccaaagcccgagttcaaatcccagt

SEQ ID NO: 73247 - DNA, 115 bp, Mus musculus
ggctagtaccagaatgggatggtttatataagaaagtagactgaacatagacagcaagccagtaagtagtgcccctctatagcctctgcttcacttcagaccttcagttcttgcc

SEQ ID NO: 73248 - DNA, 78 bp, Mus musculus
ccaaggatggagcaggaaatcaatggtgagaagcctctctctgtatctctcccaggtttcttctgttcttctcattgg

SEQ ID NO: 73249 - DNA, 108 bp, Mus musculus
aagaaacattgtggggaagtgtgaatggcaaggtgggaggtggaagctgactcaccacacaaccagctttctctcacaaacattcgctacttctcttgactgcggctt

SEQ ID NO: 73250 - DNA, 103 bp, Mus musculus
gcataaagttcatgttacatgcaattaaggcatagaaaagaatgtaaagtacaaactttaaggtgaatcttgtgttatgtagtagatgcacacagagaaatgt

SEQ ID NO: 73251 - DNA, 77 bp, Mus musculus
gtagtgaacgaattagaaaacttcccattactctatcaactgagaactgggtgagtctctgtttctgtgatagctgc

SEQ ID NO: 73252 - DNA, 107 bp, Mus musculus
tggccgtgggaacaaggtaacagcgctcttctttatgtgggtgctggcatcattgttgtgactcgctttaagaaggagctggtaactgtgtatctgatgcttggcca

SEQ ID NO: 73253 - DNA, 70 bp, Mus musculus
gcttcctatggggcctagggagacggctcagcagttaagagcactgactgctcttccagaggttctgagt

SEQ ID NO: 73254 - DNA, 85 bp, Mus musculus
ggccatggtggtctgacaggatacatgggacaatttcaatatttttgtatctattgaggcctgttttgtgaccaattatatggtc

SEQ ID NO: 73255 - DNA, 101 bp, Mus musculus
gagagctgtacattctagtcattcagtagcatgtgacatttgagttgctgacaccgtgactcactcgttaaatatgtagtagacggagctagacagagatc

SEQ ID NO: 73256 - DNA, 87 bp, Mus musculus
atatatgaccacagtctctcagacacttacttcttacgtgtcatactttgtgagacatggtgagtcctgagacggacttttgtgtat

SEQ ID NO: 73257 - DNA, 80 bp, Mus musculus
ctcagtgttgggggccgagttgagatagggattcctcagcaaccgagggcctctctcttgctctcagtgtccttgctggg

SEQ ID NO: 73258 - DNA, 89 bp, Mus musculus
gtatatgatgtatatgtatatgtgtatatgtaatgtgtatacatgtatatatgaatatatatgtacatatgtgtatatatatcatatat

SEQ ID NO: 73259 - DNA, 107 bp, Mus musculus
gtcttaggccatggtggtctgataggatacatgggacaatttcaatatttttgtatctgttgaggcctgttttgtgaccaattatattgtcaattttggagaagggc

SEQ ID NO: 73260 - DNA, 59 bp, Mus musculus
tcagactgaagagatggctcagtggttaagagcactgactgctcttccagaggtcctga

SEQ ID NO: 73261 - DNA, 70 bp, Mus musculus
gcatgtatgtatgcaagcatgtaggcatgcatgtaagcgtgcatggatgcatgtatgtatgtaagcatgt

SEQ ID NO: 73262 - DNA, 70 bp, Mus musculus
atgtatgcatctatctatctatctatctatctatctatggatagatgtaaggatgtatttatgtatgtat

SEQ ID NO: 73263 - DNA, 154 bp, Mus musculus
atatatgtatgtatttgtgtatatacatatatacatatatgtgtatatatgtatatatgtgtgtatacatatatatgtatatatacacatatatagtgtgtatatgtatatatatacatatataacatatatatgtatatatatgtatatatgt

SEQ ID NO: 73264 - DNA, 85 bp, Mus musculus
ccgtctgtctgtctatttgtctgtctccctatcttctgtgtgtgcccatgacacatatgaggaagcctgtagacatacctgctgg

SEQ ID NO: 73265 - DNA, 77 bp, Mus musculus
gctttggtcaagcaaggtcccttctccagtgggcatcagactaagtgcagagagatgtcagggacgagacgtagagc

SEQ ID NO: 73266 - DNA, 85 bp, Mus musculus; identical to SEQ ID NO: 57470

SEQ ID NO: 73267 - DNA, 79 bp, Mus musculus
gtttaaagaatagagacttattgagctcgggttgttggaggctcaccaaccaaacagcataattctagttcttgtgagc

SEQ ID NO: 73268 - DNA, 70 bp, Mus musculus
agctggtgtctgtagactgagtgctggctaggaggagctggggctctcgtgggaactgcggctaatggct

SEQ ID NO: 73269 - DNA, 64 bp, Mus musculus
atatatatgtatacacacacatatgtgtatatatatgtatatatgtgtgtgtatgtgtatatat

SEQ ID NO: 73270 - DNA, 99 bp, Mus musculus
gctttcatggatcattttaatatcactggctccctgtaaggcagaatccttccttttcaaacgaggaagctagcattacaaaacagtggtccagtttgc

SEQ ID NO: 73271 - DNA, 115 bp, Mus musculus
ttatatatatatgtgtgtgtgtatatatatgtgcatatatatatatacatatatatgtgtgtgtatgtgtatatatacatgtctatatgtatatatatattcaatttgtatatgg

SEQ ID NO: 73272 - DNA, 85 bp, Mus musculus; identical to SEQ ID NO: 57439

SEQ ID NO: 73273 - DNA, 77 bp, Mus musculus
ataggaatttagtcaggtgtagagatgtcagagctctgagtcagagactctgccaggctgagaacaggcgggcctat

SEQ ID NO: 73274 - DNA, 69 bp, Mus musculus
ttctgaggggctaaagcctgtggtagacttgacattcatgtgtaagcagcaataggggtaggcctagaa

SEQ ID NO: 73275 - DNA, 77 bp, Mus musculus
gcataagccctgttgtgcctggaagatgctgtttccttggagtcatccaccatctctggctctctcagtgtttctgc

SEQ ID NO: 73276 - DNA, 104 bp, Mus musculus
gtgctttgagatatctttttgccatccgtggttagtgtctcagtcactcttctgttgctgggaagagacaccatgaccacggcaactcttataaaggaaagcat

SEQ ID NO: 73277 - DNA, 85 bp, Mus musculus; identical to SEQ ID NO: 63608

SEQ ID NO: 73278 - DNA, 91 bp, Mus musculus
tggtgagcaggaaacctgccttctgtctctcagagtgtcatttctggggaagaaaataggtacccataaacaccaagagagaagacagagg

SEQ ID NO: 73279 - DNA, 73 bp, Mus musculus
ggcagggaaggtgcccagatgtctggagcccgaaacagggactgtctcagaatctctgtggctcctgcctgtc

SEQ ID NO: 73280 - DNA, 159 bp, Mus musculus
ctctctgtctctctgtttctctgtctctctatcacacacacacatacacagagagagagagacagagacagagatacagagagagagacagaggagagagaggggggggcatgtactggaatcgcacacaatacatttcttcttccatgatgttctgtc

SEQ ID NO: 73281 - DNA, 62 bp, Mus musculus
gtgtgccttgtctgtctgtctttagcacttacataactgtcagtgtcagtgactgggtccac

SEQ ID NO: 73282 - DNA, 105 bp, Mus musculus
gaatatgaatgccctatagaaggagagggagtaaaccttctccacctttattgttcaggggaatgtaggtatactcactctgcataggtagactgcttcactttc

SEQ ID NO: 73283 - DNA, 89 bp, Mus musculus
actggtagggtctatgaaggaagaggttgatggttgcgatgaattggaaccaggtccctgacctctctttcctaagaaaccataccggt

SEQ ID NO: 73284 - DNA, 103 bp, Mus musculus
agcaataaactcagagccttgaatttgctatttggcccttaactcacaagcttagttgtcttggaccattttataacagtaatacaaggactgggtctaagct

SEQ ID NO: 73285 - DNA, 85 bp, Mus musculus; identical to SEQ ID NO: 57470

SEQ ID NO: 73286 - DNA, 73 bp, Mus musculus
acatgaaaaattctgtctgactgcctgtgtcatttaaagtgacaacatccagtcgcaatatttttgagcatgt

SEQ ID NO: 73287 - DNA, 93 bp, Mus musculus
agatatatatgtatgtatatatgtatgtatgtatatatgtatgcatgcatctgtatatacatatacatatatatatatgtgtgtgtgtgtgtg

SEQ ID NO: 73288 - DNA, 140 bp, Mus musculus
acacacacacacacacatatatatacacatatgtatatatatatgtgtgtgtgtgtgtacagttgttaaatatttttaaatatattctattgtatagacatatgcatatatagttaaaatataaaacatcaaatgagtat

SEQ ID NO: 73289 - DNA, 85 bp, Mus musculus; identical to SEQ ID NO: 57470

SEQ ID NO: 73290 - DNA, 85 bp, Mus musculus; identical to SEQ ID NO: 57470

SEQ ID NO: 73291 - DNA, 117 bp, Mus musculus
tgcagaaaacacagcctagtctaaatagagttggcaaatcatcactgtgagttgagattttcttgtaacaattatttgaccatatatttagttattgtgttttaaccaaatgatgca

SEQ ID NO: 73292 - DNA, 74 bp, Mus musculus
tatgtatgtatgcatgtatgtgtatatgtatatgtgtatgtatatgtgtatacatgtatatatgtatatacata

SEQ ID NO: 73293 - DNA, 96 bp, Mus musculus
gagagtgcttacactgtgtcttgaacggcacactgctttacctgactgacagacagacagtgtctacttaactgacacactacctgggcatatttc

SEQ ID NO: 73294 - DNA, 126 bp, Mus musculus
gtgtgttactgtgaggtgggttttggggtctcctatgctcaagcttcacagtgtggcacacagtctctttctgttgcctgaggatgaagatatagagcttttactcctctagtaccaggtctgcca

SEQ ID NO: 73295 - DNA, 111 bp, Mus musculus
gatacagggggcagagcatgaggatttagggtgtagtagtatttaaataattgattcataacttatgctcctactattaaaatatagtccttgaattttgcttgaaggatc

SEQ ID NO: 73296 - DNA, 80 bp, Mus musculus
gcatgtatgtatgtatgtatagatgtaagtaagcatataaataaatatatacatatatatacataaaataacatatatgt

SEQ ID NO: 73297 - DNA, 107 bp, Mus musculus
acagaaatcatatgaatacatacatatatatatatatatatatatatatatatatatatatatatatatatatatatgacctatgaacagtgtatgaagactgctgt

SEQ ID NO: 73298 - DNA, 85 bp, Mus musculus; identical to SEQ ID NO: 59663

SEQ ID NO: 73299 - DNA, 107 bp, Mus musculus
agtaggcttgtgtttcaagaggttggttttagacatgacactatttggaagaggtagtagaatctttaaaatgcgatgcctagtgagagatccaggattaaaatact

SEQ ID NO: 73300 - DNA, 112 bp, Mus musculus
cgtcttcatacagtcagtgagtgctattacctaatggatgagaagtgatattgatgtgtcttcactacttgtgtctttgtaggtaagtgcagtgacaacttatttcaagatg

SEQ ID NO: 73301 - DNA, 96 bp, Mus musculus
gcaaaatgaaggaaaactaatagaactgacagagcacagtgattaaatcaaacattaaattctgaaggaaacttttggttttcttttaggtttagc

SEQ ID NO: 73302 - DNA, 114 bp, Mus musculus
tgaatcctctcaagttctaactgttgtaacactggtagaaattacttaattttttatgtaacacaggattctacagtgcaaagacacatttggccttgttctagtatgggttta

SEQ ID NO: 73303 - DNA, 104 bp, Mus musculus
aagatcatccttagtccatggtgatctgataggatgcttgggacaatttcaatatttttgtatatgctgaggcttgttttgtgaccaattatgtggttgatttt

SEQ ID NO: 73304 - DNA, 100 bp, Mus musculus
attctctgactgtgggcctttgtattcgttaccatctattgcagaaggaagcttctctgaagacagtgagcaaggcactaatctatcagtatagcagaat

SEQ ID NO: 73305 - DNA, 81 bp, Mus musculus
cagaattgttttaatcagagtaaacagagagcagcctaatactggctgaatatttgaattcactctggagaatattgtctg

SEQ ID NO: 73306 - DNA, 85 bp, Mus musculus; identical to SEQ ID NO: 57439

SEQ ID NO: 73307 - DNA, 106 bp, Mus musculus
cattttagaagcatgttttattctatagctgcatgttctttctatgtatttgaatatcagtattctgggaggaacagtggaatagttgagagaagggcttcaagtg

SEQ ID NO: 73308 - DNA, 64 bp, Mus musculus
ccagagagagctctctcaagcagactacagaaccaaaaactgtatacagagagcagtctcgagg

SEQ ID NO: 73309 - DNA, 72 bp, Mus musculus
ggcctgatgacagagatgactgagggtgcagagtgaagaagcaatagcatcctattcctctatatgtctgct

SEQ ID NO: 73310 - DNA, 167 bp, Mus musculus
atccaggttttttagttttgtttaatataggcttttgtaataggatctgatgatttttttttatttcctcagtttctgttatgtctccttttcatttctgattttgttaattaggatactgtccctgttgccctctggtttgtctggctaagggtttatgtatcctg

SEQ ID NO: 73311 - DNA, 78 bp, Mus musculus
tcccattattcaacacagcggggtttgatgagcagagacagtctgtggttttagagctttattgtagaaatgcaggga

SEQ ID NO: 73312 - DNA, 85 bp, Mus musculus; identical to SEQ ID NO: 57439

SEQ ID NO: 73313 - DNA, 98 bp, Mus musculus
agagaaaagaaacacaaagagtgacaagtcagacactgtctctgcttttcatcaaggtcaataatgttttgcttttatctctctgtgatctatgttct

SEQ ID NO: 73314 - DNA, 103 bp, Mus musculus
gtgcttgctggcaggagcttgatatagctgtcccctgagaggctctgtcagtgcctgacaaatacagaaggggatgctcacagccatccactggacggagcac

SEQ ID NO: 73315 - DNA, 99 bp, Mus musculus
accagcttgctgtgctttctattcagttatgttacctatgtctaatatatatatatatatgggtatcatatatgaatgacccaaggaggtattatggtt

SEQ ID NO: 73316 - DNA, 70 bp, Mus musculus
tatgtatatatgtatgtatgtgtgtgtatgtatgtgtgtatgtatgtatgcatgtgtgagtatgtatgta

SEQ ID NO: 73317 - DNA, 85 bp, Mus musculus; identical to SEQ ID NO: 68059

SEQ ID NO: 73318 - DNA, 85 bp, Mus musculus; identical to SEQ ID NO: 57439

SEQ ID NO: 73319 - DNA, 100 bp, Mus musculus
gtgtgcatatgtgtgtatgtatgtgtgcatgatatttgcatgtgtgtgtgcatgtgcatgtatgagtgcctatatctatgtgtgtgtaccacatacatgc

SEQ ID NO: 73320 - DNA, 79 bp, Mus musculus
gcacagagttacaagggttttctgtggctatgaagaatgtaaagaacattctagtactacaacaccttcagctgtttgt

SEQ ID NO: 73321 - DNA, 60 bp, Mus musculus
gctctccctctgacagacactggtaaattggagagagtgtggctctggtatagggagagc

SEQ ID NO: 73322 - DNA, 112 bp, Mus musculus
tatgtgtgtacatgtgtgagcatgtatgtatatttgtatgtatgtatgtatgtatgtatgtatgtatgtatatgtgtgtgcatgtatgtgtctttatgtgtgtatatatatg

SEQ ID NO: 73323 - DNA, 88 bp, Mus musculus
ccatttatttctatgtatgtgtctgtctctgtatgccacatgtgtgtggataccctaagagcccagaagcgagtgttgggtgccttgg

SEQ ID NO: 73324 - DNA, 85 bp, Mus musculus; identical to SEQ ID NO: 57470

SEQ ID NO: 73325 - DNA, 85 bp, Mus musculus; identical to SEQ ID NO: 57439

SEQ ID NO: 73326 - DNA, 113 bp, Mus musculus
cttatgtgtatatgtgatggctttgttaatgtgaactagggaaactgtcccactcagtcactgggatagtgacttttccatagagaaactgctttccgagccttccacagaag

SEQ ID NO: 73327 - DNA, 95 bp, Mus musculus
atgcatgcgatgtgtgtgtgtgtatatgcatgtatgtatgtatgtatacatgcatatatatatatgtatatatatatgcacacacagtcacacat

SEQ ID NO: 73328 - DNA, 118 bp, Mus musculus
tggcgctgtgtggttaaagtaatggactcaaggtagcaagatgtattgacacaagagagtttggaaacttcataatctcacggctcaattgtattgactttggtgtctactctaatca

SEQ ID NO: 73329 - DNA, 88 bp, Mus musculus
gagggcaaaggagaacccagtgctgtgactccattgatttgtatcatatgttaggcattaagtgactttgtaattctctgattctctc

SEQ ID NO: 73330 - DNA, 84 bp, Mus musculus
cagatggtattctctctgactcagtgtaatttcttttaggcctgtggagctgaaagaattgctgatagagtaagaaactctctg

SEQ ID NO: 73331 - DNA, 63 bp, Mus musculus
gcaacttggtctttgtacatgtctcccaacaaatggaccaggggctgtctctgactctgttgc

SEQ ID NO: 73332 - DNA, 70 bp, Mus musculus
tttcaaaagtttcctctgctttgcggaggtgaaacgtcagaactctgagagcagtaaggttcctttggga

SEQ ID NO: 73333 - DNA, 120 bp, Mus musculus
tttgagatttgagtgaggacagagtagtctgtttatgttgttggcttgcttgtttttttttttttttttaaatacaagagtctaatgtgtaggctgtcttcaaactccttttacctcaga

SEQ ID NO: 73334 - DNA, 93 bp, Mus musculus
cagatggtcataaactaagtactgacaaggttgggctagacctcgaaatgctttcagtgtgttgtttcctgtgagtgcagagtttgaccgctg

SEQ ID NO: 73335 - DNA, 113 bp, Mus musculus
atgagagattccacttactttaaaacacatcatttttcatatgccactgttcattatatatttaactgagggagggggtaatatggaagttttaagaatcaagtaagtgtcat

SEQ ID NO: 73336 - DNA, 80 bp, Mus musculus
gtctgtctgtccatctgtccctctgttactttgctttctcaccttttctggcttaatagatgggctggaatgagtcaggc

SEQ ID NO: 73337 - DNA, 85 bp, Mus musculus; identical to SEQ ID NO: 57439

SEQ ID NO: 73338 - DNA, 70 bp, Mus musculus
aagggtggaagaagatcttgactgggccctggagagagagagctcagaggctaagagctcttgcaaactt

SEQ ID NO: 73339 - DNA, 67 bp, Mus musculus
gggctcccaacctcccagagcagctgtgtgaacttaggagagtcagtcgctcagtgtctctgtgtcc

SEQ ID NO: 73340 - DNA, 122 bp, Mus musculus
ttagtcctttcagcacctggcctaggtttggtcagcgagcagacgaccttagccgatcagagctgagagtgctgaaggtccctaagcctgctgctgtgcctcctgtgcacacttattttgct

SEQ ID NO: 73341 - DNA, 67 bp, Mus musculus
aggctgtgggcaaatagcacctgtctgccaaggggcctttccagtgtgtctgtctgtctgtctgtct

SEQ ID NO: 73342 - DNA, 92 bp, Mus musculus
tatatacacatatatatgtgtaaatatagtatatatacatgtatgtatatatatatgtgtgtatatacatgtgtatatatgttatatatatg

SEQ ID NO: 73343 - DNA, 111 bp, Mus musculus
gatgctaaacatttcaaacttggggctggagggatggctcagtggttaggagcactgactgctcttccagagatcctgagttcaattcccagcacccacatggggtggctc

SEQ ID NO: 73344 - DNA, 60 bp, Mus musculus
gtgtgtgtgtgtgcatgtgtatatgtatatatatacatatacacatatacacatatacac

SEQ ID NO: 73345 - DNA, 105 bp, Mus musculus
gtgggtaaaagaaagatcttttttgtggcaaagatagctaaatacaaacaaaactatgatttttcttttttactccaaaactgatctttctactgtgatatccac

SEQ ID NO: 73346 - DNA, 112 bp, Mus musculus
ctctcacactcacacatacattctcacactcacattctctctcttacacacacacacaccatatacatagaaagagaactgtgagaggaggaaagatgtctagtaggaagag

SEQ ID NO: 73347 - DNA, 117 bp, Mus musculus
cttcccacagctgtctcctttggatctttttgcggtctgggcttgctgttctctcgacagtagtcaggaagcccttaccccaaaaagtatctacgggaggcttggtctacaggggag

SEQ ID NO: 73348 - DNA, 109 bp, Mus musculus
gtcacacacacacacacacacacacacacacacacacacacacagagtttaagatgttagataactctgtgtgtgtgtgtgtgagcgtgtgcatgtgtggtatgtgtgc

SEQ ID NO: 73349 - DNA, 109 bp, Mus musculus
ggggagcttgggtagtttcctggtttgcctgggatattaggagtgatggaaggaccacccaaccacagtcagtctctcagaccacagtgctgagtttcccctgttctct

SEQ ID NO: 73350 - DNA, 112 bp, Mus musculus
gtctgtatagggagatgcaagtcaggggccctgctccccacggagcagctgtgctctctctctctcaggcagggctcagatgtgctggggaggccatgctatccagagagta

SEQ ID NO: 73351 - DNA, 97 bp, Mus musculus
gagtggaggctaggctggtttacactgtagtttcaggacagccagcaagggctttatattgagagtctcagtcagtcagtcagtcagtcagtcagtc

SEQ ID NO: 73352 - DNA, 84 bp, Mus musculus
ttaggggtttttcttctattctcatcaaggggtcacagactcttactcccaaacagatgacagtagactcagaggaatctgtga

SEQ ID NO: 73353 - DNA, 92 bp, Mus musculus
ggcacaggccaggaatcataagatgcttgcctcttccaggtatgtatgtatttatgtacgtatgtatgcatgcatgtatgtgctggctggtt

SEQ ID NO: 73354 - DNA, 155 bp, Mus musculus
atatgtatatatgtatgtatgtataatgtgtgtcacacacacacatatgtatacatgtatatatgtgtacatgtgtgtatatatgtatatatatgtgtgtgtgtatatatacatatatatatatatatatatatatatatacatatatgtgttta

SEQ ID NO: 73355 - DNA, 118 bp, Mus musculus
gtacaactaactctcattttctttttaagtgtgtttgtatgcatgtatgtatgtatgtgtatatatatatatatgtgcgaacatgtatgcgtgtatatgtgtgagtgtatgtatgtat

SEQ ID NO: 73356 - DNA, 117 bp, Mus musculus
ttgggggtgcgatgaaggtagctctttgttctgactgatagagtagattatataataatgtctctactattcatgccggtccctgagtacgtctgactttaacataggctttcccaa

SEQ ID NO: 73357 - DNA, 83 bp, Mus musculus
ttgttaggtgtgggactcctagcagagggagcagaggctgtctctgactcctttggctgcctgtcaagtaaatacattaataa

SEQ ID NO: 73358 - DNA, 83 bp, Mus musculus
agatatatataggggcatgtatgaggctctctgttgaatccacagaaccacaaaagtgtctgtgcctgtgtctgtgtctgtct

SEQ ID NO: 73359 - DNA, 98 bp, Mus musculus
tactgtctattgttttatcagtctgtcagtctctgaaatggggatactcacattcagccagcctatcttacttacagactatcttataatctgcagtg

SEQ ID NO: 73360 - DNA, 75 bp, Mus musculus
gtctcgtgggagggcttactttcactttcttccagaaagcctgtggggagagagtagtcagtgaggactgtagac

SEQ ID NO: 73361 - DNA, 95 bp, Mus musculus
acagttcagaattaggctactgtctgtcagtctctctcttggatgtacttagcaagatttgaggcttcatcatgaggtggtcatgccttagctgt

SEQ ID NO: 73362 - DNA, 97 bp, Mus musculus
gtaataataaaacaaaaaagcaagtgagagcagagagtgttgtgtgatgctcaaacaatgtccctcctccagctctccatttttctgtatgttatgc

SEQ ID NO: 73363 - DNA, 66 bp, Mus musculus
tctgtgtgtgtctgtgtgtgcctgagtatatcccacagtactcaagtacaggacaattttcaaaga

SEQ ID NO: 73364 - DNA, 87 bp, Mus musculus
tgccttctcagtctgtgtcaagttgacagttaaagctcagtaggactgtgtctctgtcacaatacagtacaaagctgtagctaggca

SEQ ID NO: 73365 - DNA, 83 bp, Mus musculus
gttttcatttatgatgagtgtagagagtttgctgagcagctgctcagtgataggctctgtccctttgcaatggaagtggagat

SEQ ID NO: 73366 - DNA, 150 bp, Mus musculus
cttactggtctggctgctggaggcctcccaccatttttggcaatggtagaactcacaccggtaaggtaatgggacccggtggttctagacttgccaactatggtgtaagtgctgagctgctgaaggtctgcaccgtgccggaacctgccg

SEQ ID NO: 73367 - DNA, 118 bp, Mus musculus
ggcctgttccagtaccatctgcttggccgattttggcactagcacatttttgcttgtgtctctccgctgtgagcaatcatgtgtagtgccaatatgggaaaagcgggctgctgcggcc

SEQ ID NO: 73368 - DNA, 155 bp, Mus musculus
caggagaaggcagctgacccctctgcagggtctgcaggctggagagtgtgactcctgtcctgtgtatggcactggtagaattcactgtgaacagtctcagtcagtgaattaccgaagggccataaacagagcagagacagatccgcgagcacctt

SEQ ID NO: 73369 - DNA, 79 bp, Mus musculus
tccagcatagtaaccacacactctctctctctctcagttacggccccaggatggagggagggctggtctactcactgga

SEQ ID NO: 73370 - DNA, 95 bp, Mus musculus
tgtggggcttggtctcagtgtgtgactgggagtggatctgcatgtccaactttgagtagaaggtcagtgagcacatcctacacccagggtcacac

SEQ ID NO: 73371 - DNA, 115 bp, Mus musculus
ccttgaggggcaggagacatggctcagcagttaagagcactgactgctcttccagaggtcccaagttagatttccagcaaccacatggtggctcacaaccatctgtaatgggatc

SEQ ID NO: 73372 - DNA, 80 bp, Mus musculus
ccaggacaatgagccagtcagatttctctgctgggaatgtgaaactggcagactgaagagactgagccaattagccctgg

SEQ ID NO: 73373 - DNA, 93 bp, Mus musculus
cctcgagtagggaagggatacagcaacagaaataggtgagtgggcagctgccctgccctgtgctctctgtcagtctcggtcacttgcatttgg

SEQ ID NO: 73374 - DNA, 134 bp, Mus musculus
gtaatttgctctatacctttaagaccgtcctctctctctctctctcaaaaaaaaaaaaagggctggagagatggctcagtggttaagagcactgactgctcttccagaggtcctgagttcaattcccagcaacc

SEQ ID NO: 73375 - DNA, 88 bp, Mus musculus
gtggttcctctgagggcagggcagaggagggggctgatctgtctctgtctctctctgccccccacccccccgcccccagctctgccat

SEQ ID NO: 73376 - DNA, 65 bp, Mus musculus
tctgtgtgtgtgcaagtgtgtgtgcacatgtgtatgtgcatgagacagacagacagacagacaga

SEQ ID NO: 73377 - DNA, 76 bp, Mus musculus
tcccagagtccagagttcagagcccttcctgaactttatagggagcagggctgagagctctctattgactctagga

SEQ ID NO: 73378 - DNA, 88 bp, Mus musculus
ggggactaaagaaacgtgcatgtactgacctcaggatgtacctgggaagtttgttgggttttgtttttttgtttttttttttttcccc

SEQ ID NO: 73379 - DNA, 108 bp, Mus musculus
accacccaagtggagtgaatggcttgtgaggttttgttatctgtgttttaggctgagaagactgatctgcaaacagttgctgagacttaaaaccatgttctgtgtggt

SEQ ID NO: 73380 - DNA, 107 bp, Mus musculus
tcatgtctagctgtagctacagaactgtaccccgggactctgtgtgcctgtgcgtgcataggctcacatgctccatgcagacactgtggagttggtgagggacagga

SEQ ID NO: 73381 - DNA, 122 bp, Mus musculus
ggctgagccagcagtggaggaggtcagaacattctgcttaaaaatgtcacaagaaactgaggtgtttttatttttaaagctggatgtggtttaatcaagctggaatttccaacctgaagttt

SEQ ID NO: 73382 - DNA, 83 bp, Mus musculus
gtctgcacgttggctgggttttgttttgcagggaaatggaaagttcattttttttttcactgtaagctttgttgatttgaggc

SEQ ID NO: 73383 - DNA, 115 bp, Mus musculus
gattggaaaagatttcttttgggcgggggtcaagagcaataacgaaaaatgtttgtttttcgtaaaccgtttttcattattgctcctgaccccctctcatgggttatagccagtc

SEQ ID NO: 73384 - DNA, 118 bp, Mus musculus
tcacacagacctaggccatctttagatgttattccttgccagagaagtcattttgttgtattaaaattcctctctaatgtggtatgtctgaatacctatatgtggtatgtgcgtgtga

SEQ ID NO: 73385 - DNA, 67 bp, Mus musculus
tgtgtcctctgtcactaatgggagtggggatgtattaagcagagctatagatgagacagagcacaca

SEQ ID NO: 73386 - DNA, 94 bp, Mus musculus
aaaggcaaactctatcatgaatttggtatgcaactttgcaatttaggttgcagactttcaactttatatgaatttatatggagatactgctttt

SEQ ID NO: 73387 - DNA, 96 bp, Mus musculus
ggaaatgctccctcagacctctgctgtacccgttatgtaataaacctcttgtctaaagggcttggtctctctctgtgtctgtgggttcatctgtcc

SEQ ID NO: 73388 - DNA, 100 bp, Mus musculus
ctcttgtgaccccttagaggatgactgatttcttttggtgttcagagtcaatagaattttctagcaccatctgaaatcggttataatgattggggaagag

SEQ ID NO: 73389 - DNA, 111 bp, Mus musculus
cagacgacaaagcttcttcaggaagctggtttcatatggtggtttagatttaaatagtgattgtctagcaccatttgaaatcagtgttcttggtggagaactacttcgctg

SEQ ID NO: 73390 - DNA, 89 bp, Mus musculus
tctggatgtcacgtggtctcactgctgttgtcactcactacacacagacagacacagacacacagagacacacacttgttacctccaga

SEQ ID NO: 73391 - DNA, 71 bp, Mus musculus
tataggcgcagttaggctgggctggccacagggttctggaggtaacaagtgtgtgtctctgtgtgtctgtg

SEQ ID NO: 73392 - DNA, 60 bp, Mus musculus
attactcggtcactctttccatgaagtgcagtgacatttccgtggatgaagtgaagtgat

SEQ ID NO: 73393 - DNA, 65 bp, Mus musculus
ggcgtggcgcaggggttgtggcaggaatggttttgcctcccctcacaatctctctgtgtgtcccc

SEQ ID NO: 73394 - DNA, 77 bp, Mus musculus
ctctgcccccatatgtatgaaatgtgtgtgcgcacacatacacacacacagacacatgcacaatgggatggtttgag

SEQ ID NO: 73395 - DNA, 56 bp, Mus musculus
cagggtctctcactgggtcagacttcactaagctgtctggcccctgagctccactg

SEQ ID NO: 73396 - DNA, 78 bp, Mus musculus
acttctgttagtttcactgtgtctctgtttagtttctgtttccaggatctgtccattgatgaagtggggtgttgaagt

SEQ ID NO: 73397 - DNA, 92 bp, Mus musculus
gagctcacagtccactgggggttcttgtgagatcccagatatctagactcctgagagactcacacagacagaaggatggattaaaggggctc

SEQ ID NO: 73398 - DNA, 114 bp, Mus musculus
gtgtgactgttaatcttaattgtcagcttggtgggatttagaatcagcctggctctgtcagtgagaggttatctagatcagctttactgagagtggaagattcaccctcaaggc

SEQ ID NO: 73399 - DNA, 78 bp, Mus musculus
gtgaccctgaccaacttccagagaggttaagaagagtaggcaaaagctgaattcctaactctcatcagtgtctgtcac

SEQ ID NO: 73400 - DNA, 114 bp, Mus musculus
cacagacctaggccatctgtagatgttattccttgccagagaagtcattttgttgtattaaaattcctctctaatgtggtatgtctgaatacctatatgtggtatgtgcatgtg

SEQ ID NO: 73401 - DNA, 65 bp, Mus musculus
ggaaaactgagtgtcacacactgtaaatgtccctaagacatgagcacagtgtgaggccactcacc

SEQ ID NO: 73402 - DNA, 120 bp, Mus musculus
acaggcttgcttcattccttccaacccttttccttttctccttatgtttaggttttgagctaagatatatatatataaggttgaggacataatggtagtgtatgttttggtatagtttgt

SEQ ID NO: 73403 - DNA, 92 bp, Mus musculus
gtacacacacacacactcgcgcacacacacagtgtgtgtgtgcatgtgtgtgtgtgtatagtgtatagagaaacagacagacagacagacac

SEQ ID NO: 73404 - DNA, 78 bp, Mus musculus
gggctgactccctgtgtggcagccagttcaagtatcaaaactctctgctgggcttgaggctcacacgcacgacagttc

SEQ ID NO: 73405 - DNA, 72 bp, Mus musculus
ggaaggaccaggtgagtgttttcttactctaggtagcccagttacccaatgtgtctctcactcggtccctcc

SEQ ID NO: 73406 - DNA, 87 bp, Mus musculus
tgctcttggtcctgacctctgtccgagctccagtgtcacaaatgggacctccagatatgactctgactgtgtcacgggtctttagca

SEQ ID NO: 73407 - DNA, 62 bp, Mus musculus
tctgtgtctgtgggtctgtctgctccatggacgtcaggagcattggaccccctggaactgga

SEQ ID NO: 73408 - DNA, 58 bp, Mus musculus
agggttggggtgggagaggttgtcacagaggacatctatgtctctcagtctcagctgt

SEQ ID NO: 73409 - DNA, 116 bp, Mus musculus
cacttggatttgaagctaatacagttctcagggaaaggctgacagaagacacatagctctgggctctgcttctgaatgcctcttccagagaatcgtgtggggctctgaaacagatg

SEQ ID NO: 73410 - DNA, 93 bp, Mus musculus
tccatgttgatctgataggatgcatgggacaatttcaatatttttgtatatgttgaggcctgttttgtgaccaattatatggtcaattttgga

SEQ ID NO: 73411 - DNA, 115 bp, Mus musculus
gcttcttgaagtgctttgtctgcagatatgagaaaggctcctctgtctgtttcagtgaggaaactggcaggagacgagggcttcctgtttgctccacactgctggtctctggagc

SEQ ID NO: 73412 - DNA, 80 bp, Mus musculus
gcacctacatgcaaagggtgtgtggggcagtgtcaccaaggggtccctgtccctgtctctctttgtttctctgtctctgt

SEQ ID NO: 73413 - DNA, 102 bp, Mus musculus
ggcacagggatgctgggaccagaagtcagagctattgaaatgggagaaacacttagtagaacagttattttatttttaaagcagactcccaggagaaaggct

SEQ ID NO: 73414 - DNA, 90 bp, Mus musculus
gtaacagtaaaaatgttctacttctgtctctgtttctgtcatcaacttcatgacacaaaacaacccggaggaggaaagggtttattttgc

SEQ ID NO: 73415 - DNA, 73 bp, Mus musculus
tcaatgtattggatagcattctgagaatttgtgttaaggatgtgaagactcagaatctgcttctgggcaggga

SEQ ID NO: 73416 - DNA, 87 bp, Mus musculus
gtgtgtgtgtgtatgtgtgtgtgtgtacatatatggttgtatgtatttgtgtatatgcacacacacattctctcattcatttatgca

SEQ ID NO: 73417 - DNA, 125 bp, Mus musculus
agacagagagagagacagagacacagagatagacagagacagacagacagacagacagacagagagaaacacacacaacagttgtctgtgttttcagccctcctctttgctaatgggtttttctc

SEQ ID NO: 73418 - DNA, 93 bp, Mus musculus
agacaagagagcagacaggaaatgtatgcttagaggaacaaaatctctcctcctcatccttctaacacactcagtctgtctgtctctctgtct

SEQ ID NO: 73419 - DNA, 73 bp, Mus musculus
catggtttaactagactcagcaaagcctagaggatctctctggctctgtgggtctctgggaaggaagaacatg

SEQ ID NO: 73420 - DNA, 88 bp, Mus musculus
cagaatcacaaaattctgagtgttagcatatggagtgatgcatataagggtcaccaggagctttgtcactctctcagtttttgttctg

SEQ ID NO: 73421 - DNA, 77 bp, Mus musculus
taggaggctagtactccttaagcttatcacactgtgcctgtctgtgacccttaagcttatcacactgtgcctgtctg

SEQ ID NO: 73422 - DNA, 85 bp, Mus musculus
gtgtgcacatgcatatgcatgtgtgtatgcgtgtgtgatgtgagtgttcaaatgtgtgtgagtgtgtgtatatgtatgtgcgtgt

SEQ ID NO: 73423 - DNA, 60 bp, Mus musculus
gttcaagatggacagggtacatcttgtatatataggatgtctgtctgtctgtctgtctgc

SEQ ID NO: 73424 - DNA, 76 bp, Mus musculus
agagcgagagagaagtgtgcgccttctgtgaccctctgggaactgaatagagactgcacacagtgctgctgcctct

SEQ ID NO: 73425 - DNA, 90 bp, Mus musculus
ccctcttgctgctcttgcagagaacatgagtttagttcccagcacccacactgtggctgctcacaactgtctgtgattccagctccaggg

SEQ ID NO: 73426 - DNA, 116 bp, Mus musculus
gtgtgtatatatgtgtgtatatgtgtgtgtatgtatgtatgtatgtatatgtatatatgtccatatatatgcatgtgtatctatatgtgtatatgtctggatatgtatatgtgtat

SEQ ID NO: 73427 - DNA, 59 bp, Mus musculus
cagacttttgagagaacagtgagaggagagagccctttgctgtgcgcagcaggggtttg

SEQ ID NO: 73428 - DNA, 62 bp, Mus musculus
gaatggtgcagatggggattgcttggatgcagtgcactgtcctgtctctgtctcaccacttc

SEQ ID NO: 73429 - DNA, 91 bp, Mus musculus
atgagatgaatgcaaattgatgaactattgatttttacttatcaagctgtaacacttagaaaatgatagtctcaagcagcaatcacctcgt

SEQ ID NO: 73430 - DNA, 68 bp, Mus musculus
ttttgtgtatgagtggggggggcagtgtatacacacgaatgcagtgctcacagagctcagagaggaag

SEQ ID NO: 73431 - DNA, 118 bp, Mus musculus
gcattaacttgtacctaggggcctcttttcagcttgtatgtatgtatgtatgtatgtatgtacatatgtagtatttatgtacatatggtctcatagtcctgggattacaggtgttggc

SEQ ID NO: 73432 - DNA, 91 bp, Mus musculus
gtaggttgggaatgtgaacagtggtcacagagtgtctgcagtcagggagctgagtgagatgaggtgtgaacagtggtcacagtgtatctgc

SEQ ID NO: 73433 - DNA, 267 bp, Mus musculus
tagatagatagacacacacacatatatacatatagacacacgcatatatatgtgtatatatatacatttatatatgcgtgtgtctatatatgtgtgtatgtgtgtatatacatatatttatgtatatacatatatgtgtgtatatgtatatacatatatgtgtgtaaatatatgtatatacatatatatgtgtatatatatatatatatatatatatgcatgcgcacgtgtgtgtgtgtgtgtgtgtgtgtgtgtgtgtgtgtgtgt

SEQ ID NO: 73434 - DNA, 171 bp, Mus musculus
tatacatatatttacacacatatatgtatatacatatacacacatatatgtatatacataaatatatgtatatacacacatacacacatatatagacacacgcatatataaatgtatatatatacacatatatatgcgtgtgtctatatgtatatatgtgtgtgtgtctat

SEQ ID NO: 73435 - DNA, 90 bp, Mus musculus
gaaacaaagacaatggtgtgtgtgtgtgtgtgtgtgtgtaagacagacagacagacagacagacagacagacagacagacagagacattc

SEQ ID NO: 73436 - DNA, 94 bp, Mus musculus
cttctgtgaagtcaccttgagctgtccttggttaaaatacatctgtgagccaaaatgcagagacaatacactcaggagagtggaagcacagaag

SEQ ID NO: 73437 - DNA, 85 bp, Mus musculus; identical to SEQ ID NO: 66064

SEQ ID NO: 73438 - DNA, 85 bp, Mus musculus; identical to SEQ ID NO: 57439

SEQ ID NO: 73439 - DNA, 101 bp, Mus musculus
tatttcaattattataatcattgaagcatcatgtgtagtgattttcttgacagtttaaatgagaagaatatgtgaatgtatgctttaggatatttggggtg

SEQ ID NO: 73440 - DNA, 79 bp, Mus musculus
gtgggagggaggtgttggctttgtttgctttggtttgatttttcaaggcagggtatctctgtgtccctctgtgtccctc

SEQ ID NO: 73441 - DNA, 93 bp, Mus musculus
ttcagcctaagaatgtgtctgcttgtttatgtgggacaggctctgtctgtctgtctgggctctgaggtacccacaccacaggtgattgctgga

SEQ ID NO: 73442 - DNA, 114 bp, Mus musculus
tcaattgactctgaaattattgtgtgggcatcttgtgatttgagaatttattgatatataaatctgactgattacttattagcttctacagttttgatttactggattaaggga

SEQ ID NO: 73443 - DNA, 76 bp, Mus musculus
tgagatgactcaagagtgtgtggcctgtgatgcaacctggatttgcacatgcacaccaaccatgtgggtgatctga

SEQ ID NO: 73444 - DNA, 74 bp, Mus musculus
atatatacatatatatgtgcatatatatgtgcatatacatatatacatatatatgtgcatatatatatatatat

SEQ ID NO: 73445 - DNA, 84 bp, Mus musculus
tggctagccttgagacactgactggagactgcctttacacgtgtctgcagcttctagcctctgtgtctctcagagcctctgcca

SEQ ID NO: 73446 - DNA, 91 bp, Mus musculus
gcgagcacacacacacacacacacacacacacacagctttgacaagaacacagagcacagagtgtgctgggaaatgtgggtgaggcagctt

SEQ ID NO: 73447 - DNA, 73 bp, Mus musculus
cttcccctgagtctctgttagtcattgtattctctcgcagaaatggagaagcaggctaacacacctggggaag

SEQ ID NO: 73448 - DNA, 105 bp, Mus musculus
ttactgcaccaaggagggacgacatagaagttagcaagccagggactgtttctgtcacagtgtatgagtgtctgtatgtgtgacagtgagtgactgtgtgagtgt

SEQ ID NO: 73449 - DNA, 109 bp, Mus musculus
ttgaaaagccaatgtgaacggctagagagacggctcagaggttaagagcactgactgctcttccagaggtcttgagttcaattctcagcaaccacatggtggctggcaa

SEQ ID NO: 73450 - DNA, 89 bp, Mus musculus
agccaggagtcaaggtcacagctgagtcagagcacagagagactggaggcctatcaccctctgctctaccaggaaggatctgccttact

SEQ ID NO: 73451 - DNA, 67 bp, Mus musculus
ggctctcaggagagaagattgtcagcagaagtaagagaccttactagggctagctctttccttagcc

SEQ ID NO: 73452 - DNA, 60 bp, Mus musculus
gttgctcagtcccatttcctgctcacatctctgtgtctagtggatagaggctgagacaat

SEQ ID NO: 73453 - DNA, 117 bp, Mus musculus
cgtgctgccagcagtgcgcgtgcaggggggcggggctttcagcctggacctcagtgcctctgagtggctggaagcaattccttgtcccagtgatggcgcagctgttgctgttttatg

SEQ ID NO: 73454 - DNA, 85 bp, Mus musculus; identical to SEQ ID NO: 57470

SEQ ID NO: 73455 - DNA, 98 bp, Mus musculus
tcagtgcgcgtgcaggggggcggggctttcagcctggacctcagtgcctctgagtggctggaagcaattccttgtcccagtgctggtgcagccattga

SEQ ID NO: 73456 - DNA, 89 bp, Mus musculus
gtcagtagagctaggcatgttcgctgcgagtgctatggagtggtcttctgtccatgctctgtcgctctgtcacagcttgtggtgctgat

SEQ ID NO: 73457 - DNA, 74 bp, Mus musculus
actgaggtgccctgagagaagatggtctccacataggcgtgagtaatcatggtcttttgagaaatcacttcagt

SEQ ID NO: 73458 - DNA, 117 bp, Mus musculus
gccgagtacctaactgagtgttggatgtggtctgtaccttgccagaggaagtagattgtttagtctggtttaagcacaggatcaggcagatgcaagacagggataaagagtggcggc

SEQ ID NO: 73459 - DNA, 85 bp, Mus musculus
actgcactatcacatatgcatgtatgtatgtatgtatgtatgtgcatatatatgtatatatacaatttttatgtgtatgtgtggt

SEQ ID NO: 73460 - DNA, 68 bp, Mus musculus
gtctgtgtctgactctgacagcactatccggtttgttctgcagtgacaagctcaggacctgcacaggc

SEQ ID NO: 73461 - DNA, 100 bp, Mus musculus
gtctgtgtgtctgcatgcatgcatgcatgtatgtatgtatgtatgtatgtatgtatgtatgtatgtatgtatctgcctgcctgcctgcctgcctgcctgc

SEQ ID NO: 73462 - DNA, 79 bp, Mus musculus
gagtcatgggtgacccacacactctctagaagtcgtgagtaaaacacatatcctctaggagtcgatggttgaccctctc

SEQ ID NO: 73463 - DNA, 67 bp, Mus musculus
cccacagtagatggagaagccaaacacgaagaggttcctggatgaattcatgtccacatactgtggg

SEQ ID NO: 73464 - DNA, 64 bp, Mus musculus
tgtgtgtgcatgtgactctgcgcatgtgtgtgaatgtgtgtatgtgtgagcatgtgcatgtgca

SEQ ID NO: 73465 - DNA, 128 bp, Mus musculus
ttcctcctagagagtccaggaaggatggtgtttcattatcccaacttgcagtgtcttgtggctccctccctccatggctccagtgtgcatcctggaggaattgtgccttctgctcccgaaccccaagt

SEQ ID NO: 73466 - DNA, 108 bp, Mus musculus
ggatgagtaggttgttgggtgtgtgggttgttagttgggtgaatagatagacagatagatagacagacagacagacagacagacagacagacagacagacagacagac

SEQ ID NO: 73467 - DNA, 130 bp, Mus musculus
agacaagcacaacacaatttcttagtcttatgctctaatctaagtacagtgtcactctgagacttaagaagtgaagagaagagactcaggactcggctgtttactgcacttgaagaggacctaaactcag

SEQ ID NO: 73468 - DNA, 77 bp, Mus musculus
ggagtgaggcagcatgatcttggaattcaagaatgactctgtgtgtgtctgtctgtctgtctgtctgcctgcctgcc

SEQ ID NO: 73469 - DNA, 78 bp, Mus musculus
atggagttttctgatcttgtatttgaacaatgggagatgacatttatttgtttaaattctagagcatgaaatctccat

SEQ ID NO: 73470 - DNA, 115 bp, Mus musculus
tgtatgatgggggcttgctagttgtgaaattctaattatcctcttcagagttatgagtgggtcagttgtgatggaaaaaggtagatggacatttcaaagtcctcgtaattttgca

SEQ ID NO: 73471 - DNA, 67 bp, Mus musculus
gcattctactactagctagaatagttggttgtttaaaaataccaactctgctaggcagtggtggcgc

SEQ ID NO: 73472 - DNA, 170 bp, Mus musculus
ggctgtgtttataaatttatgtatgtacagatatatgcatatatgtatatatacatatatacacacatatcatatatacatatacatatgtacacacatacatcatatatatgtatatgtgtgtatatgtatatgtgtatgtatgtatgtatatatattacatatatata

SEQ ID NO: 73473 - DNA, 97 bp, Mus musculus
gggtgtgtgcgagaagcaggtgactgatgttagagaggagctggaggtggtaagatgttagctgagagagcaggagcatgggaggtgacagggaccc

SEQ ID NO: 73474 - DNA, 111 bp, Mus musculus
tgtacacatggatacacacatgaaaagatgttcttaaatataattgtttattctatgaagaagacatttcttttttaagatttatttatttattttatgtatgtgagtaca

SEQ ID NO: 73475 - DNA, 62 bp, Mus musculus
atgtatatgtgtatatgtatgtatatatacatggatatatgtgtacgtgtatatgtgtatat

SEQ ID NO: 73476 - DNA, 74 bp, Mus musculus
atatgtgtgtatacacacacacacacacacacacacacacacacacatatatgtgtgtgtgtatatatatatat

SEQ ID NO: 73477 - DNA, 120 bp, Mus musculus
tgggagagccatgcttagggatgatgacagaagaggattcagcagcagctcatgtctcccagaagactgtgagctctttcagatgatgcactagttctcagtgcttggggactgattgag

SEQ ID NO: 73478 - DNA, 73 bp, Mus musculus
ctctctgttgagtggctaattattctcagactctgtgtctcatgctgggaatcggccctcaaggagcagggag

SEQ ID NO: 73479 - DNA, 113 bp, Mus musculus
aatggaccattagggatgagctgggactttcagcaaacgtctggcctgtgtgtatcagtgagttaccatgatgtgatctcctggtttagtcttaatggctcattgcttttggt

SEQ ID NO: 73480 - DNA, 83 bp, Mus musculus
tcatgagagaaatgagtgtgtacagtttctaaacattcctctatagaaatagttggtaaagttatacacttatgacctcaaga

SEQ ID NO: 73481 - DNA, 111 bp, Mus musculus
ccaccaagctttattcccgatattatggactgcttttaaatgtatagaactttctgaaaaacagaagagcattggttaaatatgatttcttggacaaaggataattgaggg

SEQ ID NO: 73482 - DNA, 82 bp, Mus musculus
gggctcctctccatttccatccctgtaattctttcagacaagaacaattatgggtcagagatgtgactgtggaatggcaacc

SEQ ID NO: 73483 - DNA, 112 bp, Mus musculus
gcataatactgatataaactggaagtgcactccggagaacttatgtctgtgtattagtatgtatatgtatatgtgtctctccatgtgttctgtgtcatatgtgtgaaggtgc

SEQ ID NO: 73484 - DNA, 101 bp, Mus musculus
cattttatagtgtatcagattcttttagaagttatatgtatatataatgcatatatatacaaacatatatgttctactagaatgcatgatatctagttatg

SEQ ID NO: 73485 - DNA, 79 bp, Mus musculus
tatcatgcattctagtagaacatatatgtttgtatatatatgcattatatatacatataacttctaaaagaatctgata

SEQ ID NO: 73486 - DNA, 85 bp, Mus musculus; identical to SEQ ID NO: 57439

SEQ ID NO: 73487 - DNA, 71 bp, Mus musculus
agatatatatgtatgtgtatatatgcatgtatgtaatacatataaatatatgtgtttgtatatgtgtatct

SEQ ID NO: 73488 - DNA, 84 bp, Mus musculus
tttggggattatatgagaatggctacactaactctgttctatgcagaaagaagcatggagagtttagtctttttgttcttcagg

SEQ ID NO: 73489 - DNA, 112 bp, Mus musculus
gctgaatggtgtcttggaggctggaatgtgtgttctcagaagagactttcatcatctcagatgtctttgaaatttgaggttacaggaacaggcgagtgtggcactggggagt

SEQ ID NO: 73490 - DNA, 70 bp, Mus musculus
gtagcagatgtgcagctttttctccatttgagtccactaatagagcaaaggctgtctctgtctctgttgc

SEQ ID NO: 73491 - DNA, 119 bp, Mus musculus
tgcgatgcttaaagtttgaaaaataaaagtggtatgggctccatgatactagatttgagtgagcacacacagagtattgactctacagaatttttattgaaagagacaccaaggctcca

SEQ ID NO: 73492 - DNA, 56 bp, Mus musculus
catatatatgtgtatgtatatgtatatatatacacatacatacacacacatatatg

SEQ ID NO: 73493 - DNA, 106 bp, Mus musculus
cacataaatgtgtgtgtatgtgtatatgtgtatatatatatataatgtatacatatacatatatgtgtgtgtatgtatgtgtatatatatacatatacatacacat

SEQ ID NO: 73494 - DNA, 78 bp, Mus musculus
ttttgcatccaagtgtgtatgtgtagccacctatgtgggtttacacgtgtgtaaatgtgtgtgcatgtggatgtggaa

SEQ ID NO: 73495 - DNA, 85 bp, Mus musculus; identical to SEQ ID NO: 57470

SEQ ID NO: 73496 - DNA, 118 bp, Mus musculus
agcgttatgaagagaggtggaactagggactcaagggtagagaggagacccagctctctcacacatacactcttgcccttggggctggtttacacctccaccacacaccatcacagct

SEQ ID NO: 73497 - DNA, 117 bp, Mus musculus
gtcaatgtcctcactgtcttgtcagattaaaggggcttgtgtaccagtgacacacacactgagaccaggaagaaatgtattttcccttttgtgtatcaatccattgcagttctttgc

SEQ ID NO: 73498 - DNA, 90 bp, Mus musculus
aaggctgtcaaattcacagtactctaatgcaataatggctgtagctaagtcatttttttttttgctagagtatcaatatttacaaggctt

SEQ ID NO: 73499 - DNA, 116 bp, Mus musculus
tgttgagtggtctccagtgttcacagtctcattttgtccttgctactgagtttcttctactcatacctatagcattgggtgtcacaaatgaacaggaacatggctcttcattcaca

SEQ ID NO: 73500 - DNA, 85 bp, Mus musculus; identical to SEQ ID NO: 57439

SEQ ID NO: 73501 - DNA, 119 bp, Mus musculus
acagtctgaacctgcatggcatttacactgtcatatgagtatctatttatatattatgtgtctcattcaatgtatatatgtattcagcataactggcatgcacaggtaacacagactgt

SEQ ID NO: 73502 - DNA, 79 bp, Mus musculus
ccaaatgcttattctccatttggtctctcctcttactggaaacaggtcacccagagcgtgtcagatgaaggtgagcagg

SEQ ID NO: 73503 - DNA, 65 bp, Mus musculus
tcggtggttaagagcattgactgctcttccagaggtccagagttcaattctcaaaaatcacacga

SEQ ID NO: 73504 - DNA, 120 bp, Mus musculus
gcctgaatgtgataattagcagttttgcaattgttcagatggaagtggaaactcaagactttctaggtccatttgttttctaatcaacaattctaagcttttacctaattagcaatggtc

SEQ ID NO: 73505 - DNA, 87 bp, Mus musculus
cacatgagtactaaatatatgtatatatgtgtatatatgtatatgtgtatatgtgcatatgtatatatgtgtatatgtatagtattc

SEQ ID NO: 73506 - DNA, 96 bp, Mus musculus
gatcagccttagtccatggtgatctgataggatgcatgggataatttcaatatttttgtatctgtggaggcctgttttgtgactgattatatggtc

SEQ ID NO: 73507 - DNA, 79 bp, Mus musculus
acttctgttagtttcactgtgtctctgtttagtttctgtttccaggatctgtccattggtgagagtggggtgttgaagt

SEQ ID NO: 73508 - DNA, 116 bp, Mus musculus
ggggataccattcatcctgctttggcttctctgtggttgacatttgatttttttttcatgaagtatgttggcattaaatgtctttataacttggagctcagagtagcaatatcttc

SEQ ID NO: 73509 - DNA, 136 bp, Mus musculus
tctgttaaagagtttctgtcctgaaggaaaatgcctcctcgtggctccttgatctgtccttcacatctgaatatgttgttttagcagagctgcacatgctcagctccccttgacaagggaagttgtcaagggcagg

SEQ ID NO: 73510 - DNA, 91 bp, Mus musculus
ccaggttcattctgtctttctgtgcatgatactgcagatattttatatttatctcacccttagtatagggatgaagtctgatggaccctgg

SEQ ID NO: 73511 - DNA, 94 bp, Mus musculus
ctcttctgcatggatgctgtgatggaaagagaaggggtgtggctatgagtcacagtcactgtgctttgtcccagcactccatggattacaagag

SEQ ID NO: 73512 - DNA, 125 bp, Mus musculus
cagcaccctcacatgggctaacagctgtctctaactctagttccagggagtcagacaccctctgtgaatgggttctgtatgcgtgcagtgcacagacatcagtgcaggcaaaacacctatacaca

SEQ ID NO: 73513 - DNA, 81 bp, Mus musculus
gggctgactagtctctgggacacctgggatcaagacttgactatcttttggatctttctcacagaatcagtctctgagccc

SEQ ID NO: 73514 - DNA, 67 bp, Mus musculus
cgcgcgcgcaggtgcttgtgtaggtatgtgttcatggtgtgtatgtgtgcatgtacatgtgtgtgtg

SEQ ID NO: 73515 - DNA, 114 bp, Mus musculus
ggtggacagggcatagtagatcagggccgcccagctcctgacagaagacagagagaaagtcagacaggataggatggaccatgataagataatacccttcaaaaataggttccc

SEQ ID NO: 73516 - DNA, 117 bp, Mus musculus
gctttaatgatgagatgtctttctgtgctttgttttacttattttttgttattgtttgttttattttctatggtggtggggagacgttgcaagagcagagggcaaatacaagggggt

SEQ ID NO: 73517 - DNA, 101 bp, Mus musculus
tatacacatttatgcatgtgcattttgtacctatgtgtatatgtatatatgtgtgtacctgtgtgaatatgtgcacatatgcatatatgtatatatctgtg

SEQ ID NO: 73518 - DNA, 87 bp, Mus musculus
tgtatgtatgtgtgtatatgtatatatgtatgtatatatatatatatatatatatatatatatatatatacatatacacacacatac

SEQ ID NO: 73519 - DNA, 138 bp, Mus musculus
ggaattcatgtctgagtctggtatggacagttttaggtcccacgtccgtctggcccccgcactgtcccactctcagtcttggtgctccagttgtgctttctcttgcccttggcagggcaggcacatgtgccacgggtg

SEQ ID NO: 73520 - DNA, 90 bp, Mus musculus
ggttagtggttaggataacacaggagacatgacaatgtggacgcttgcagctctctcctctcagtctgtctctgttgtcctggcctctcc

SEQ ID NO: 73521 - DNA, 107 bp, Mus musculus
ggttcccatttcttggctgttgtgaataacagtgctgtgagtatgtgagccaacctctgactcactggctctgtgtcctttggatctgtacccttgaggtgattgct

SEQ ID NO: 73522 - DNA, 113 bp, Mus musculus
tttgatttttaaatatatgatttttttccagagcctgtcagtcagtcagtgtgagaaccacaattggaggagtgagtatgattataggaaaggcagaagatgcaagagacaga

SEQ ID NO: 73523 - DNA, 70 bp, Mus musculus
atatgtgtgactgcaaatatgtgtatgtgtatgttggaatgtgtgtgtgcatgtggttgtgtgcatatgt

SEQ ID NO: 73524 - DNA, 72 bp, Mus musculus
gctcgccattgtttacttcatgacctgctctgccattaggtgtgacaggtgtgtgtgtgtgtgtgtgtgtgt

SEQ ID NO: 73525 - DNA, 115 bp, Mus musculus
gttgaataagatgccaagatgtttgactggagagatggctcagcagttaagagcactgactgctcttccagaggtcctgagttcaaatcccagcacctacatggtggttcacaac

SEQ ID NO: 73526 - DNA, 86 bp, Mus musculus
ggaccaggtgtagtagagttagcttcctggccttccctctggggagaaccattttctctagctccttttgtatttcccattggtcc

SEQ ID NO: 73527 - DNA, 64 bp, Mus musculus
ttgcaggtgctgggggacagccttgttgatagagtgtctgtctgtctgtctgtctgccttgcag

SEQ ID NO: 73528 - DNA, 92 bp, Mus musculus
tgtatataaatctgtgtcccccacactctacgtgtgaatgtgtacatgtgtgtgtatgtctctctctacgtgtgtgtctgtgactgtgtgca

SEQ ID NO: 73529 - DNA, 83 bp, Mus musculus
tgcgtgtgcacgtatgtgagtgctcgtgcgtgttgtatgtagaggtcaaccttaggtgtatgtgcatgtgtatgtgcatagta

SEQ ID NO: 73530 - DNA, 117 bp, Mus musculus
gaaggactgcagcatgggacacctggcctgggctgatgtcagagacaagagtgagagcttcttcagctgtcgcctgcaccaggatacagacagacctactcctcagctgtgccttcc

SEQ ID NO: 73531 - DNA, 66 bp, Mus musculus
ctgtgtccctgtgtccctgtgtgttctggcagagggcggcgagattcacaatactcaggacatcag

SEQ ID NO: 73532 - DNA, 105 bp, Mus musculus
agtttttattttatgtatataggtgtttcccctgtgtctgtctgtctgtgcacatgtgtggagtgactggggaggccagaggagggtgttgggtattttgaaact

SEQ ID NO: 73533 - DNA, 91 bp, Mus musculus
gctgcttgatgtgggtgctgggagttcagcctgggttgtctgtcaccacagagtcagctctctagccccagtacagatttttaaattcggc

SEQ ID NO: 73534 - DNA, 120 bp, Mus musculus
ggtggtctgggagcttctaggaggaacttgcttctggctgtgcctctcggagtggcggctgtgcctctctgagtggctctgagtggcagaaacttcccatgggcttaggtggtggtggcc

SEQ ID NO: 73535 - DNA, 75 bp, Mus musculus
gtgcgtgctgacagccgctgtgcttggtatcagttctgagctgacggttcacactgtggctgtctcccaggacac

SEQ ID NO: 73536 - DNA, 76 bp, Mus musculus
gcagggtctgacatcatcatcatcatcctcgagggctcactggctgggctcacagaggcatgggtggagctcttgc

SEQ ID NO: 73537 - DNA, 72 bp, Mus musculus
gaaagggaggcagatctgtgtgaggtcagggtcagcatggtctacacagggagctggaggacaacccgagtc

SEQ ID NO: 73538 - DNA, 116 bp, Mus musculus
tctgttgcttactatcatgcactccatgacctttacacaacgtacttaagcacttgttttgtgtctcagtttctctcaggttgtaaaatggggtaatacatcatttaaagcacggg

SEQ ID NO: 73539 - DNA, 81 bp, Mus musculus
gaatgagctctttaggggctagagagatagcttagtggttaagagtactgactgctcttccagaggtcctgagttcaattc

SEQ ID NO: 73540 - DNA, 106 bp, Mus musculus
gtatgtgcatcatgtatgtatgtgtatgtatttatgtgttgtgtgtgtatgcattgtgtatgtaatgtatgtatgtatgtatgtatgtatgtatgtatgtatgtat

SEQ ID NO: 73541 - DNA, 106 bp, Mus musculus
agagttttctcagtttgcacatgtcctctgttagaagaaagcactgtcgtcaaacatgtttttcattattttgataaggctggtgtgtttgctcagtgtttactct

SEQ ID NO: 73542 - DNA, 74 bp, Mus musculus
gttgggctagagagatgactcagaggttaagaacactgtgtgctcttccagaggtcctgagttctgttcccagc

SEQ ID NO: 73543 - DNA, 107 bp, Mus musculus
tgtaatatagaaaagttaataatattcaaggttagacaactagacaatatttatttttttaaagtcctagttattactagcttttggtgtgtgactatctatataca

SEQ ID NO: 73544 - DNA, 74 bp, Mus musculus
ttgataaagcaaatatctcagtgcctgcccccagaggaagtgcaacaggggcagagagatgactgtgtggtgaa

SEQ ID NO: 73545 - DNA, 116 bp, Mus musculus
aggcccaaattgtttattcctgattagatgtaatgctgttcattattcatcacaagtggttttgatgatgataattttcatgcttgcagtcattactaaatgttcagctaaagcct

SEQ ID NO: 73546 - DNA, 93 bp, Mus musculus
gcaggatccaaaactccctctcactgtcagaatcaagtcagaaactttcttaatgtttgattggagaaggtcaaggtccattgtggatgctgt

SEQ ID NO: 73547 - DNA, 119 bp, Mus musculus
gggaaggagggactgggaccttttggatgctattggtagggatagtgctacattccaggtgtcctgactagtcactcactcaccaggcactttaaaacctagggtcagttactgctctc

SEQ ID NO: 73548 - DNA, 83 bp, Mus musculus
gcaccagatcctagagggtctttgagtgggctaagatgaatgtcacatgcagacagacccagagtccctgtgagactgggagc

SEQ ID NO: 73549 - DNA, 77 bp, Mus musculus
gccctgggaatgttgagtgggatgtggccagcagcatagcccaagtgcctttgaccacagaatcctccttcaggggc

SEQ ID NO: 73550 - DNA, 80 bp, Mus musculus
tgtttgagacacggtctctcactgggcctggggctcacagctggctggcctgtgattctgagaatccatctgtctccaca

SEQ ID NO: 73551 - DNA, 81 bp, Mus musculus
caccctctcagccactctgactaagtccctttgggcagccttgcccctgggtggggtcagatgcactgagactgtagggtg

SEQ ID NO: 73552 - DNA, 92 bp, Mus musculus
atacatatatgtacatatatacacacacacacacacacatacacactaacatacatatagacacatgtgtctatatatgtatatatgtgtgt

SEQ ID NO: 73553 - DNA, 117 bp, Mus musculus
tccacgtggttgctgaaacacagtctggaaggacagtggccttctctctctgtgtgtgtgataaagtgggagggctctaaagcatgacgctcagagatgggaccgcttttggaacac

SEQ ID NO: 73554 - DNA, 60 bp, Mus musculus
ctctgtgtatgtgtctctatgtatgtgtgtctgcccaaacatcaggatacatgtgtggag

SEQ ID NO: 73555 - DNA, 69 bp, Mus musculus
gctgactccatgtgactctctatctctgatctagaccagaggtggttctttagtaacagggtcctaagt

SEQ ID NO: 73556 - DNA, 95 bp, Mus musculus
ttagtttgtttagctgttgagacagggtctcactgtgtgtccctggctggtctgggactcacagaaatgacctgtttctgcttcctgcatgctag

SEQ ID NO: 73557 - DNA, 102 bp, Mus musculus
atttttattatgcaagaattattttgtagcatatgctatgtttatttagccatcgtttgatggacatttggcttgtgtttatgtaattcatatactaaaaat

SEQ ID NO: 73558 - DNA, 94 bp, Mus musculus
aggtgggtcagtgtgacacagtatcctgttaatggaacattctgtctgtctgtctatctaagaaagggtctcactgtgaagccttgacaggcct

SEQ ID NO: 73559 - DNA, 120 bp, Mus musculus
gtggtggctggggtttgctgattggcccgtgaaatacagtgacttcagcccgtagcccccagactggctgtgtcactctaaaccctcaagcctcagaatcctccatttctttcttcagcc

SEQ ID NO: 73560 - DNA, 85 bp, Mus musculus; identical to SEQ ID NO: 57470

SEQ ID NO: 73561 - DNA, 80 bp, Mus musculus
ggcttattgaggggctggttaagagcactcagcggttaagagcactgactgctcttccagaggtcccgagttcaattccc

SEQ ID NO: 73562 - DNA, 81 bp, Mus musculus
tggtagggctggagagatgactcagaggttaagagccctgactgctcttccagaggtcctgagttcaattcccagcaacca

SEQ ID NO: 73563 - DNA, 90 bp, Mus musculus
tcttgatctttagttagtaagtaagtaagtaagtagataattgttgttgttacttccaatatcaagactattgactatgtagtatcaaga

SEQ ID NO: 73564 - DNA, 120 bp, Mus musculus
tggtggtggtggtggtggtgggtgctggagagatggctctgcggttaagagcactgactgctcttccaaaggtcctgagttcaaatcccagcatctacatggtggctcacaaccatccat

SEQ ID NO: 73565 - DNA, 108 bp, Mus musculus
gggttaagaaaggcatggtcagggctggagagatggctcagccattaagagcactgactgctcttccaaaggtcctgagttcaaatcccagcaaccatgtgatggctc

SEQ ID NO: 73566 - DNA, 98 bp, Mus musculus
gcttttgtgtgtcctctggagattcagattcaggttggccagcttgcatggcaagtgcttttctggctgagctattcccccgtgttcctttcaaaagc

SEQ ID NO: 73567 - DNA, 73 bp, Mus musculus
cagacctgccgatctcaagatgagatttttccgggtttggacacatcttgatcttgatcttgcttcaggcctg

SEQ ID NO: 73568 - DNA, 65 bp, Mus musculus
tctagaggcagctgggattggccaggctgctctgagcctctgtctgtgttccttgtgcttctggg

SEQ ID NO: 73569 - DNA, 112 bp, Mus musculus
tgtacagccagcaagttattgttaaagaatcatgcatgggctagagaggtggctcagactgctcttccagaggtcctgagttcgattcccagcaaccacatggtggctcaca

SEQ ID NO: 73570 - DNA, 115 bp, Mus musculus
ggtagagtagcctggtgaggattcggggtgccactcactggtgaaacacttgcacatgacatgtgacactttctcctcagtgtgcaaaaatcaatcatcaatcagtccctcagcc

SEQ ID NO: 73571 - DNA, 99 bp, Mus musculus
gtagacttgtccagtgtagacttgttgtctgcagctgctgtgccacgcctgtcatctgagtgtgatcagacagtgcgagcaacataatgctgaccctgc

SEQ ID NO: 73572 - DNA, 119 bp, Mus musculus
tctggtgtgagcagaactgtctacttgggaatttctcttttgagtctctgagtctgtggctcagctcaagtgttggactgcctggaagaggtggatgggtgaattgtggggcgcctgga

SEQ ID NO: 73573 - DNA, 85 bp, Mus musculus; identical to SEQ ID NO: 57439

SEQ ID NO: 73574 - DNA, 113 bp, Mus musculus
ctatagtacttggtgagaaagtgcataaattatgtgtagggtgtgaggacatggggctgtggacagcattcagagagacaccatcctagagagttatgcttcccaaactgtag

SEQ ID NO: 73575 - DNA, 100 bp, Mus musculus
cttaacacagtagtcatcaacaccaacagaccattaggacattatttatagattaataatctctgcatgaaactgtttcattcggaggctctgtgatgag

SEQ ID NO: 73576 - DNA, 98 bp, Mus musculus
tccttagtactgcatgtatgtatgtatgtatgtatgtatgtatacacacatatacatacatacaaatataaatatgaatgtatgcattgtaagaggga

SEQ ID NO: 73577 - DNA, 60 bp, Mus musculus
tctgacagttgtcactgaggtctggttgtcacagaagagattcctggtggcattgtcaga

SEQ ID NO: 73578 - DNA, 76 bp, Mus musculus
tgttgacatatattatgtatgttgatatatgttatatatatcaatatatcacagttatcttagtataatgtcaaca

SEQ ID NO: 73579 - DNA, 93 bp, Mus musculus
gcaggaaagagccaagacaggaaataatcactaaggacattcttgccacttcccaatgatctatttctctcagctaagctcacctttcactgt

SEQ ID NO: 73580 - DNA, 96 bp, Mus musculus
ggatctttctcagagtagtgtcaggctgtgtgtctctgtatctgttcccatctgctgcaggatgaagcttctctgatgatggctgagcaaggaact

SEQ ID NO: 73581 - DNA, 85 bp, Mus musculus; identical to SEQ ID NO: 57470

SEQ ID NO: 73582 - DNA, 94 bp, Mus musculus
atgtaaatatctaaaattgtatatctatatatgtatatgtgtgtatacatacatatatatgaatacatgtatatatgcatatattcatacacaa

SEQ ID NO: 73583 - DNA, 70 bp, Mus musculus
gcatgtgtatttatatatatgagttgtatagcatatatatatatacagcatatatatagtatatatatgt

SEQ ID NO: 73584 - DNA, 97 bp, Mus musculus
gcagcaggtcgcgtgtagtaaagaaggatggttctgcctgccctctatctctgtctgtgtgtatctctctccctctttagtgtgtgtgtgtgtgtgt

SEQ ID NO: 73585 - DNA, 71 bp, Mus musculus
gaggccatgatggatgaaccaccaatagagggagaacatctctctgtatttgtctctctatctcttgtctc

SEQ ID NO: 73586 - DNA, 64 bp, Mus musculus
ctggggagaagaagtttgaactggtttctgtgtctagctagtgttcttgatcttcttctaacag

SEQ ID NO: 73587 - DNA, 181 bp, Mus musculus
tgtgtgtatatggtgtatatgtgtatgtgcatatattgtgtctatctctgtgtatgtatgtattgtgtcttgagtgggcatatatatgtatatatacatatatatatacatatacatatatgtatatattgtatatatgtacatgtttatgtatgtgggtatgtgtgtattgtgtgtgtgt

SEQ ID NO: 73588 - DNA, 83 bp, Mus musculus
accctttctccctctgtctcagagaatgggaagcagaaggcttgtcatttctcaacccagctgatagaactagttaaaggtgt

SEQ ID NO: 73589 - DNA, 85 bp, Mus musculus; identical to SEQ ID NO: 57439

SEQ ID NO: 73590 - DNA, 59 bp, Mus musculus
gtcagaagtttgtgagcagaaagaaagtgcctgtaccatgctgtggctaagcttctggc

SEQ ID NO: 73591 - DNA, 115 bp, Mus musculus
tcagtgagtgaatatcatgtgtgttcttttgtgattgggttacctcattcaggatattttctagttctgttgatttgcctaaacgctttatgagttcatcatttttaatagctga

SEQ ID NO: 73592 - DNA, 68 bp, Mus musculus
tctatctgtctctgtctgtctgtctatacaggtcatatacataggtagatgatagatagaagatagat

SEQ ID NO: 73593 - DNA, 79 bp, Mus musculus
ttctggaatgtgtgaaggagctggtgctgcagatccaaagctgcaggatatatatatatatagttcactatacagagaa

SEQ ID NO: 73594 - DNA, 77 bp, Mus musculus
cagtctctactaggctttctcagtcccaggtatgtaacataaatgacagggacactgactcagtacttgtagagttg

SEQ ID NO: 73595 - DNA, 126 bp, Mus musculus
tatatatatatatattatgtatgtgtgtgtgtatatatatatatatatatatacatttatatatgtatacatatgtgtgtatatgtgaatatatatgtgtgtacatatatatgtaaatactatata

SEQ ID NO: 73596 - DNA, 106 bp, Mus musculus
tgcacataacatgagtagaatatcctgaatgaacttttaaaaatgaggaacttactagtggtcattttgttgttcacttcaacatacttctctgtgaatatgtgca

SEQ ID NO: 73597 - DNA, 112 bp, Mus musculus
ctgttgccagaaatctcggcatttactctgagttctgtcttctgtgcctctctcaccgcgtctgcaccaatctgggagaattcagatgtagctgagctcagcctgtcaccag

SEQ ID NO: 73598 - DNA, 85 bp, Mus musculus; identical to SEQ ID NO: 57439

SEQ ID NO: 73599 - DNA, 85 bp, Mus musculus; identical to SEQ ID NO: 58710

SEQ ID NO: 73600 - DNA, 115 bp, Mus musculus
tgaagatcatccttagtccgtgatgatctgataggatgcttggataatttcaatatttttgtatctgagtcctgttttgtgaagaattatatggtaaattttggagaaggtttca

SEQ ID NO: 73601 - DNA, 85 bp, Mus musculus; identical to SEQ ID NO: 57439

SEQ ID NO: 73602 - DNA, 92 bp, Mus musculus
gtttcaattgaacacatctctccttttcttatcacaggaagcaccccttcttgtgagaatgactagtgaaaatgtagcgaatcaaaggggac

SEQ ID NO: 73603 - DNA, 74 bp, Mus musculus
gaggatttcagatgctttatatgtgaatgtatacatactaatgtgtgtgcagagagagcagaatgttgtcgttc

SEQ ID NO: 73604 - DNA, 85 bp, Mus musculus; identical to SEQ ID NO: 57439

SEQ ID NO: 73605 - DNA, 85 bp, Mus musculus; identical to SEQ ID NO: 57470

SEQ ID NO: 73606 - DNA, 85 bp, Mus musculus; identical to SEQ ID NO: 57470

SEQ ID NO: 73607 - DNA, 104 bp, Mus musculus
aagtcagctttaatgtacacagtgtcatttcctacggctggaaacctgtgacactcacagaatctgctccatcgtgaattaatacacagggtctacactggctt

SEQ ID NO: 73608 - DNA, 85 bp, Mus musculus; identical to SEQ ID NO: 57470

SEQ ID NO: 73609 - DNA, 85 bp, Mus musculus; identical to SEQ ID NO: 57470

SEQ ID NO: 73610 - DNA, 80 bp, Mus musculus
tggctgtgtctctgtccctctatcaaggtctctgggaaggcttattaagcaaggatggggttgcaggagagatgtggtca

SEQ ID NO: 73611 - DNA, 83 bp, Mus musculus
tctgctttgcttctggagttgagccaccaatgccacagccctgtcagatgagtgtgacctcaaagccctcagtatctagcagg

SEQ ID NO: 73612 - DNA, 100 bp, Mus musculus
ggctttgcggcgtccctgggtagaatggatcttcatgatagcagccacaatgtgggcataggacagagagaccagagagcagggtatcatcagcaccacc

SEQ ID NO: 73613 - DNA, 70 bp, Mus musculus
gccagtctgaccagtgtcagtgtctcacaggccacatggttgagcacattgtgcccacaggtaggaaggc

SEQ ID NO: 73614 - DNA, 114 bp, Mus musculus
cagttctagatctatcatttaagagggttttgcttttggacgtggtggttaaattctttattaattatgagcccctgtgacaagtgagctttatagtccctctgcataggattg

SEQ ID NO: 73615 - DNA, 80 bp, Mus musculus
acatacatatatacacagacacacacacactatatatatatatatagtgtgtgtgtgtctgtgtctctgtgtgtgtgtgt

SEQ ID NO: 73616 - DNA, 108 bp, Mus musculus
ttcctcaatctggttgtcatttgtatacagaaggactattgatatttttcttttttagataatcttatgtcaagccattttgctcaaagtacttattaggtgtaggag

SEQ ID NO: 73617 - DNA, 85 bp, Mus musculus; identical to SEQ ID NO: 57470

SEQ ID NO: 73618 - DNA, 108 bp, Mus musculus
aactcttccagaagactcctgaactctggttaatgtgtagctctgggtctctgtatctgtttccataggctgctgcatacccaaagttcttttttctttatttaagtt

SEQ ID NO: 73619 - DNA, 100 bp, Mus musculus
ggacaattttggcaagagagtaaatagtttggagaaatggggaaatatatttaattatttaacatcgtctcaaatggacaagttttgtcagtcacagtct

SEQ ID NO: 73620 - DNA, 64 bp, Mus musculus
gtgtgttcatgaatgtgtgtacatgtatgttcagatgcatgtatatatatattcatatgcatat

SEQ ID NO: 73621 - DNA, 78 bp, Mus musculus
gccatcatgtctggtagttacttgaagctgactcacactgagagtccagagagttgactgggagaaatagacaatggc

SEQ ID NO: 73622 - DNA, 67 bp, Mus musculus
ttctaggcttgtccccagctctgagaccatgtaaatctatacatagttttagataacaaatctagga

SEQ ID NO: 73623 - DNA, 104 bp, Mus musculus
gctgtgacttttttgggagtgggttggatgaggaggggtaggggttctcaccctttctatgtctgtctgtctttttcaactgtagcttccttgccctttacagt

SEQ ID NO: 73624 - DNA, 79 bp, Mus musculus
gtgtgtgtatgtgtgtgtgtatacatgtatatttctaaatatagtgtgtgtgtgtgtgtgtgtgtgtgtgtgtgtgtgt

SEQ ID NO: 73625 - DNA, 91 bp, Mus musculus
atacatatatatatatatcatacatatatatatatgcatacatatatatacatatgtatgtatgtatatgtatatgtatatgtatataatg

SEQ ID NO: 73626 - DNA, 91 bp, Mus musculus
ttcatgctcattaaactttgttattatgtatgcatatggttagtaattctggaccagcatactgttttgattaagttgttaatgacttgaa

SEQ ID NO: 73627 - DNA, 66 bp, Mus musculus
ttctagagaagtacctattgacatgacaagacagtcactgtctctgggtgtattcttaaattggga

SEQ ID NO: 73628 - DNA, 70 bp, Mus musculus
gtgggctttctgtgacactgtctgtgttgtctgggaccccgccaatgtaggtatgaatgtccagagcccc

SEQ ID NO: 73629 - DNA, 117 bp, Mus musculus
tcacggtgtgcaagaaagatggccgttctggtgagggttttagcgtgcagacaaaagctttctgtcaccctgtgtccctctagcagctcacgcctacatttgctaagtcagtgagcc

SEQ ID NO: 73630 - DNA, 89 bp, Mus musculus
ggtagatgatgttaggagacaatctgtgagaatctctctctttaaaccacatggatcctcaagattgaactcagttcatcaggtttggc

SEQ ID NO: 73631 - DNA, 93 bp, Mus musculus
cagcaacactggtacacatgtagtttggaaaatgtggtatggaacaggaaaggtccagttctgacagatgacacagggcagtaaacagggctg

SEQ ID NO: 73632 - DNA, 85 bp, Mus musculus; identical to SEQ ID NO: 57439

SEQ ID NO: 73633 - DNA, 77 bp, Mus musculus
ctctctctctctctctctctctctctatgtatgtatgcatgtatgtatgtaaggagagattagagagtgatcttggg

SEQ ID NO: 73634 - DNA, 85 bp, Mus musculus; identical to SEQ ID NO: 57470

SEQ ID NO: 73635 - DNA, 109 bp, Mus musculus
ccttccctgtccgaggagagtttgcatcctgggagttctctgacaccctgactcagaagagagctggtctcccaggagtgataaaagaggctaatagacttacaggagg

SEQ ID NO: 73636 - DNA, 92 bp, Mus musculus
ggtagaaaactgactgtggcaaggcttcatttgaggagttgattgctcagatttgaaagtgaggacagttgctacatttggtaggctttgcc

SEQ ID NO: 73637 - DNA, 93 bp, Mus musculus
attgcaaacaaaactagtatgaaaatggatatcatttgttaaaaatgaatataggtgaagtttattttattttatgtagtgtgtgtgtgtgat

SEQ ID NO: 73638 - DNA, 77 bp, Mus musculus
atatgctgttccctctggcatgtttatatttatatgcatttctaatttatgtatatgagtgttttgcctgcacatat

SEQ ID NO: 73639 - DNA, 64 bp, Mus musculus
catatgtatgtatgtatgtatgtatgtatgtatgtatgtatatgtatatgtgtatatatatatg

SEQ ID NO: 73640 - DNA, 85 bp, Mus musculus; identical to SEQ ID NO: 57470

SEQ ID NO: 73641 - DNA, 109 bp, Mus musculus
gcaaaggggtctttcaatctttttctaactgttactttttcttactttatgcctgattatatggtcaaatttgagaaagttctgtgagatgctgagaagaatcttttgt

SEQ ID NO: 73642 - DNA, 106 bp, Mus musculus
gccttagtccatggtgatctgataggatgcatgggacaatttcaatatttttgtatctattgaggcttgttttgtgtccaattatgtggtcaattttggagaaggt

SEQ ID NO: 73643 - DNA, 117 bp, Mus musculus
gtttctgtctccatgaattgtccattgatgaaatgtccatgggacaatttcaatatttttgtatctattgaggcttgttttgtgtccaattatgtggtcaattttggagagaggtac

SEQ ID NO: 73644 - DNA, 106 bp, Mus musculus; identical to SEQ ID NO: 73642

SEQ ID NO: 73645 - DNA, 116 bp, Mus musculus
gtttctgtctccatgaattgtccattgatgaaatgtccatgggacaatttcaatatttttgtatctattgaggcttgttttgtgtccaattatgtggtcaattttggagaaggtac

SEQ ID NO: 73646 - DNA, 62 bp, Mus musculus
gaagtgaagagtttggtatacacatcccatttatggttgagtgtctcaaagtctctcacttt

SEQ ID NO: 73647 - DNA, 85 bp, Mus musculus; identical to SEQ ID NO: 57470

SEQ ID NO: 73648 - DNA, 119 bp, Mus musculus
tcctattgtagttttcactttcaatttcctaatgacaaatgaggataaatatctttttgatatatatatatcgggcatttgcattcctctgattgatgggtaacttacttgtggttgga

SEQ ID NO: 73649 - DNA, 85 bp, Mus musculus; identical to SEQ ID NO: 57439

SEQ ID NO: 73650 - DNA, 91 bp, Mus musculus
tgtctgtgtgtgtcttgtgtacctgtgttcctgtgtgtgcctgtgtggctgtctgttatgtagtggactttggtaagaccatgaactgaga

SEQ ID NO: 73651 - DNA, 117 bp, Mus musculus
atcattttctgttggctttattattacaagagaagaattctgaagacagtctgcacagccgaggaagctgttcttcctttcagatatttattttgaaaaattgttccaactagtgat

SEQ ID NO: 73652 - DNA, 97 bp, Mus musculus
gtataaaaagtttgatgctcgatttgacaaatgacattcagttccagcacattctctcgtgtctgtgtctgtctgtcaattcccgccgactctgtgc

SEQ ID NO: 73653 - DNA, 108 bp, Mus musculus
ggaaggggagacgaagcatgtaggctagaagcaatcctgcagtgttacaacaatgtgttgacagtagagtgattgcactagattctgaatggaacacgccatctatcc

SEQ ID NO: 73654 - DNA, 88 bp, Mus musculus
ttagaatgcatgaatatttttataaatcaaaagcaatctgggatagacagttgccttagtgtttaaagaatatttattgctcttctag

SEQ ID NO: 73655 - DNA, 91 bp, Mus musculus
tccatggtgatctgataggatgcatgggacaatttcaatatttttatctgttgaggcctgttttgtgaccaattatatggtcagttttgga

SEQ ID NO: 73656 - DNA, 95 bp, Mus musculus
gtctctggttggagcttatttctcttgtgattctgtcagcctctgtcagcagacctgggggtctagttctctcctgagtctcagtggttagagtc

SEQ ID NO: 73657 - DNA, 118 bp, Mus musculus
gaatctagcatcatctggaaggcaagcctctgtctgtgcctctgagcgattatttgaatgaattgaagtgagtggatacagcttaaaagtggatagcaccttcctcgaacttgggttc

SEQ ID NO: 73658 - DNA, 82 bp, Mus musculus
tttttaaactgtgtttttgttgatgtctacatttaatatcaaatgcagacatagataggagtcattaatcctggtttaagaa

SEQ ID NO: 73659 - DNA, 75 bp, Mus musculus
ggtcaaattgtgtagagtcactatcagcaagcactgacaggataggctctctggtagactacacacagcatgact

SEQ ID NO: 73660 - DNA, 86 bp, Mus musculus
caccttgtatgtgtgtgtctcagtgtatatgtcatcatatgtatatctatgtgtgtgtgtatctgtgtgtctaatgtgtgagtgtg

SEQ ID NO: 73661 - DNA, 100 bp, Mus musculus
agctcattgcttatgctttcactcagtttaaaactctctttctctctcaaactcttcctctagaatataaatgttttaaattgagaaagtttagctggct

SEQ ID NO: 73662 - DNA, 85 bp, Mus musculus; identical to SEQ ID NO: 57439

SEQ ID NO: 73663 - DNA, 93 bp, Mus musculus
gagtggattttaatggctaaacttagcagacagaaaacacacagctgtaacttttgtgactgctcttagtaaggataccattgggttcagctt

SEQ ID NO: 73664 - DNA, 83 bp, Mus musculus
ttgggtgaaagcatgaggcaagcattgtccagaaactaaatgttcaaactatcctctgtccctgtctgtctctgttgacttga

SEQ ID NO: 73665 - DNA, 114 bp, Mus musculus
gattaaataatattctatgagataaacatgtacgtatatatccatatgtatttatgtttcttaattcgtgtgtgtatatgtatgtgtgtgaaacattatccttatttattaatc

SEQ ID NO: 73666 - DNA, 87 bp, Mus musculus
tgtcactgtgtatattggctctgtgaatcactgtgtttaactagggttgtctgcccagacatggacttggagctttgcactggtgca

SEQ ID NO: 73667 - DNA, 86 bp, Mus musculus
tgtgtgagtgtgtgtgtgtatgtatgaactatctatatatatatgaactatctatatatatgaacttgcacacacacacacacaca

SEQ ID NO: 73668 - DNA, 118 bp, Mus musculus
caggtatgatctacctcccacacctgcacagcaccaaattggtgatcatctcagacaaactcactctctgggccctatgacgctggtctggtggtgggtttggcttgtttctcacctg

SEQ ID NO: 73669 - DNA, 85 bp, Mus musculus; identical to SEQ ID NO: 57439

SEQ ID NO: 73670 - DNA, 188 bp, Mus musculus
tacatacatacatacatatgtgtgtatacatacatatatacatatatatgtgtgtatgtatgtatatacatatattattcacacacacacatatgtgtgtgtgtatgaataatatatgtatatacatacatacacacatatatatgtatatatgtatgtatacacacatatgtatgtatgtatgtatg

SEQ ID NO: 73671 - DNA, 76 bp, Mus musculus
tatctatctatctatctatctatctatctatctatctatctatctatagatatagatgatataggtatagatgata

SEQ ID NO: 73672 - DNA, 126 bp, Mus musculus
tgcttcaggttgatggtgtccagtcaggagttgaggcatgtccactgtaagcttccttgtctcgctggtggatgaagttctctcgtgagaggctcctttacccccaagcacagtggtttggagtgg

SEQ ID NO: 73673 - DNA, 65 bp, Mus musculus
cctctgtctctctctctgtatgtgtatatacatatatatatatatatatgttttgaagacagagg

SEQ ID NO: 73674 - DNA, 122 bp, Mus musculus
ctattcccatagcttagtacagatctcagacatcatcaaagaagtttattggtatagcttacttgtagatttcttttgttgatgtagaagtttatttgtagctgaagatgtacttgtagatg

SEQ ID NO: 73675 - DNA, 76 bp, Mus musculus
tgtctagtggtcacagaagacactctggagatgcattgttcctatgcatcatccttgctttaccaattgctgcaca

SEQ ID NO: 73676 - DNA, 117 bp, Mus musculus
aatataagtatcttttgaagtatgtgtgtatatatatatgtgtatgtatatatctatctaatatgcatacatatatgcacatttatatatttttagctaaacatatttctatgtatt

SEQ ID NO: 73677 - DNA, 75 bp, Mus musculus
tgtctgtaatgtatgatatatatctatatatctgtctgcatatacacatatgtatgtgtatcatgcattcagata

SEQ ID NO: 73678 - DNA, 90 bp, Mus musculus
gcacattctctgaagtctttagtttttgatgttgtcggggccatccattgtgtgtttcgaattgaagtgctgagaatttgggagttatgc

SEQ ID NO: 73679 - DNA, 117 bp, Mus musculus
tgtgcctgggagaggaaacagatctgagctgggattctccttttcggtcactctctcactgagcacaggggtgcatgggaaatcccgaatgctgggtgctgttctcatgccctgcca

SEQ ID NO: 73680 - DNA, 67 bp, Mus musculus
agtctctcagagctgtcagtgctgagagggcctgcgagaaagctgccctcagctacagttggtgact

SEQ ID NO: 73681 - DNA, 89 bp, Mus musculus
ggcagagtgcttgaggaagtgggatgtacagagaggagaaagctggcagtttcaggctatctcctgtccctcttactccacccaaggcc

SEQ ID NO: 73682 - DNA, 71 bp, Mus musculus
gtgggctgtctctacagcacgaggagacatggtagcagtgacacccagtctctttctctttaacagtgcat

SEQ ID NO: 73683 - DNA, 83 bp, Mus musculus
attgagcatatatacacatatacatatacattatacatatgcatatgtatatgtgtgtatgtatatgtataatatttcaatgt

SEQ ID NO: 73684 - DNA, 105 bp, Mus musculus
tgagtccacctaacatatacagtgaccgctgaggataacttgatacagtttggtttctatgtatgtatgaatgtttggtttctacttggtcactaggtaaattta

SEQ ID NO: 73685 - DNA, 116 bp, Mus musculus
gcatagatggatagacaaatagatagactgatgatagacagacagacagacagacagatagatgtatatgtagcatgttgtttagcatgggctttttaaaactacacactacatgt

SEQ ID NO: 73686 - DNA, 106 bp, Mus musculus
gctttgtgggggacacatgaaagtttgagaaccagtgtagtttggtgtatgctttaagaacgtgttaaaaactacacggttgtgagacagtggtcagttttagggt

SEQ ID NO: 73687 - DNA, 97 bp, Mus musculus
gggtgcgagatctagaagcagaagtcacaggtagttgtgagtcacactgtgtgggtgctaggaactgattttaccttgggtcctctgagaagcagcc

SEQ ID NO: 73688 - DNA, 76 bp, Mus musculus
gcactggattggagagaggactcagcggctaagagcactgactgctcttccagaggtcctgacttcaattcccagc

SEQ ID NO: 73689 - DNA, 60 bp, Mus musculus
tgtcgggagcggactgaccaatgaaggccatggctacagcggctctctgtccctctgaca

SEQ ID NO: 73690 - DNA, 90 bp, Mus musculus
ctggaggatggctgacccattaagaagacctgggttcagttcccagttcccacacagtgtctctctcataaggtgtatccatacctccag

SEQ ID NO: 73691 - DNA, 73 bp, Mus musculus
tgttgtctgtctgtctgtgtatagtcatcagaatggatggtaaatgacccagacggttcttgacagattaata

SEQ ID NO: 73692 - DNA, 73 bp, Mus musculus
tatatatgtattcatgtttgtgtggaaatatatgtgtgttatatatttacatatatatgtatatacatatata

SEQ ID NO: 73693 - DNA, 76 bp, Mus musculus
ctgtccaaacaagagggggaagatagtcctagtgagaaggtctcacggtctgtaagtgtgttcttgcctggggtag

SEQ ID NO: 73694 - DNA, 89 bp, Mus musculus
gtgcacacttgggaggcagaggtagttggatctctgtgaggccagcttggtctacacagtccaggatgccaccccctcccaccttccac

SEQ ID NO: 73695 - DNA, 85 bp, Mus musculus; identical to SEQ ID NO: 57470

SEQ ID NO: 73696 - DNA, 87 bp, Mus musculus
tggaggccttgtaagtcagtgtccacactgcctgtagaggcgaggtctgtggaaactgattttaagaacacagacgaggcccatcca

SEQ ID NO: 73697 - DNA, 80 bp, Mus musculus
gccgctgagtgaactgtgtgagcccagatggaggctgtagcaagcctccctctgccagctctccctgtcagctcccaggt

SEQ ID NO: 73698 - DNA, 86 bp, Mus musculus
gtggcaatggctgagcagaggcactcacagtcaccccctgtgtcacagctgtggggtggagctgtcagcctatcatacatccccac

SEQ ID NO: 73699 - DNA, 67 bp, Mus musculus
caggaagtgtggggggcctgagtgctgagttggtggctggtggcagtctctcccactctttctcctg

SEQ ID NO: 73700 - DNA, 62 bp, Mus musculus
gggttttaagagatcacagaactggacagcactgtccctctgtccctctgtaggaacttccc

SEQ ID NO: 73701 - DNA, 98 bp, Mus musculus
gagatcaggagaagaggagacaggagcagggactcatgctgatgctctggaggatgactgcttactgactcactctcaacattagctcccaaaccctc

SEQ ID NO: 73702 - DNA, 81 bp, Mus musculus
aggtgttggggaaaagaaaaggagtaacatgcaggaattatctgcttgccctgtctgtctgtctgtctgtctgtagctctt

SEQ ID NO: 73703 - DNA, 92 bp, Mus musculus
taagatgtggggctggagagatagctcagcgattaagagcactgactgctcttccaaaggtcctgagttcaaatcccagcaaccacatggtg

SEQ ID NO: 73704 - DNA, 77 bp, Mus musculus
ggagactgactgtcacactgggtgtaacttgagcataggagacttcaatggctgccccacagtgacacacttcctcc

SEQ ID NO: 73705 - DNA, 106 bp, Mus musculus
ttttagagcattaaattatgtgttctgtattatttagtaagtatactattatctaataatgtatgtactaatttaaatgcatagctcctatgtcagtgttcttaaa

SEQ ID NO: 73706 - DNA, 71 bp, Mus musculus
ttctgaatgtgtatatgtatacttgtgtgtatatgtatgtgtatatgtatgtatatgtatgtacactagaa

SEQ ID NO: 73707 - DNA, 111 bp, Mus musculus
ctggtagtgttccaactctcactgtcatggactccagtatgatggccagctgtcactcattctgtcttccctggcatctgtttagttatggacgtctactgcagaactgac

SEQ ID NO: 73708 - DNA, 64 bp, Mus musculus
tcagagcatcatgaatacagaaaatgtgatgtcagaagttttctgtttttcatattgtctctga

SEQ ID NO: 73709 - DNA, 74 bp, Mus musculus
ctgggtctcactgagtctgacaaatgggatggccactgagctcctgggatccacctatttactctctctcccag

SEQ ID NO: 73710 - DNA, 87 bp, Mus musculus
ggtggtggaccctgcagtgtgcagagtcactgagaggcctcagcccttcacacatgctgactgctgtcactgtcattagtcctggct

SEQ ID NO: 73711 - DNA, 65 bp, Mus musculus
gtgaggagtgagtcatgggagcacctcgctggctgtgaatgtctctctgtgtttcaattcttgac

SEQ ID NO: 73712 - DNA, 80 bp, Mus musculus
gaggggaaaggaagcagcgcaagacactggagtcctctaccaggtgagttttcagtgtctgagactctctgttcactctc

SEQ ID NO: 73713 - DNA, 68 bp, Mus musculus
tgagtctcgctttctctctgaaagaactcacaggctccggagtttcctttaagaggtgaaaaggctca

SEQ ID NO: 73714 - DNA, 68 bp, Mus musculus
aggattcagctggaggctcggaatgaagctcctgtcccagcgcttgttctgagtacctgatgtgacct

SEQ ID NO: 73715 - DNA, 83 bp, Mus musculus
tctgtctgtctgtctgtctgtctgcacactcgcacatgcaagtacacgcatatgcgcgcgcacgcctgcttatagtagccaga

SEQ ID NO: 73716 - DNA, 83 bp, Mus musculus
gcataatgttatatatcatatatgtatatatatgtatgtgtatatatatatatacatgctacacagatgtatagtagttgtgc

SEQ ID NO: 73717 - DNA, 95 bp, Mus musculus
tctttgggagtgatcttctttgtcttaaattagatcatcatcagagtctctgtatctatcaaatttagagctgagaggaccctattctgaaaaga

SEQ ID NO: 73718 - DNA, 83 bp, Mus musculus
gcccttacagacagactgagagagagtggctggggtggggctctcacaaatcaaccgctgtctctcactgttttaataaaggc

SEQ ID NO: 73719 - DNA, 83 bp, Mus musculus
gcctttattaaaacagtgagagacagcggttgatttgtgagagccccaccccagccactctctctcagtctgtctgtaagggc

SEQ ID NO: 73720 - DNA, 77 bp, Mus musculus
ctgtgactcaaacactctcacagaagattctcctgcatagtttgtgaggcaggtatggtgagatttttgagtgatgg

SEQ ID NO: 73721 - DNA, 90 bp, Mus musculus
gtatatgtatatgtatatgtacatacatacacacacacacacacacacacacacacatatatatatatgtatatatatatatatatatat

SEQ ID NO: 73722 - DNA, 70 bp, Mus musculus
tgtgtgtgtgtgtgtgtgtgtgtgtgtgtgtatgtatctatgtatgtatatgtgcatacactcctgaaca

SEQ ID NO: 73723 - DNA, 78 bp, Mus musculus
atggtaggctattttatatgtgtaaaatcattatatatgtatacatgcatataagcacataatgtatatgtgtaccat

SEQ ID NO: 73724 - DNA, 83 bp, Mus musculus
gtgtggtggtggctcagtcagcctgtctgactgggatcaagcctggaaccaaggtgagaggggaaggacagaccgaacttcac

SEQ ID NO: 73725 - DNA, 113 bp, Mus musculus
cgggcacaaaaggatgcctttgagagaacactggatgcggctcctcagacagactctgtctgtgttcttctggccagtttcatttcatttttagctcaagtcccacgttcctg

SEQ ID NO: 73726 - DNA, 104 bp, Mus musculus
ctcatgaacctcctgccactttccagtcacactcactgatttagcgggctagtgacctcttctggggaacagggcttttggtggtgtagagttctgggtcttgg

SEQ ID NO: 73727 - DNA, 85 bp, Mus musculus; identical to SEQ ID NO: 57470

SEQ ID NO: 73728 - DNA, 85 bp, Mus musculus; identical to SEQ ID NO: 71082

SEQ ID NO: 73729 - DNA, 68 bp, Mus musculus
actcagattcatcatcacgatctgcacacttatcctgtgcatgtattttagggatggagaatctaggt

SEQ ID NO: 73730 - DNA, 83 bp, Mus musculus
atgtgggctggagagatggctcagtggttaagagcactgactgctcttccagagaccctgagttcagttcccagcaactacat

SEQ ID NO: 73731 - DNA, 74 bp, Mus musculus
cataaaggtatttccattacaatttcataactgtatatttgctactgatatgaattgtaatgtaaatatctgtg

SEQ ID NO: 73732 - DNA, 67 bp, Mus musculus
gagtctgtctgtctgtctgcgtgtctgtatgtatagcacacgcctgacttgcccagcagtcagatcc

SEQ ID NO: 73733 - DNA, 70 bp, Mus musculus
tagtcagacactagccaggccaggaacaagagaatctgtctgtctgtctgtctgtctgtctgtctgtctg

SEQ ID NO: 73734 - DNA, 113 bp, Mus musculus
acattgttgagactgtgatagactatggggacttttgaagttagactaaatgcatttgttatgtctacaagcatgtgggggccagggagtggaatgtggtggtttgaataggt

SEQ ID NO: 73735 - DNA, 110 bp, Mus musculus
ttgggtccttgaccttagtgtgctggctcacagagggacagtgaagacagacatcacacgcgttactgtgtcagtgagctccagtagagactgtggtgtcaaccacccaa

SEQ ID NO: 73736 - DNA, 88 bp, Mus musculus
gtttctggcatggatgcaggcagagaaagattttttttctttaagtggtcatgaaaagacatcttaatggtgtgctgtggcttgaagc

SEQ ID NO: 73737 - DNA, 86 bp, Mus musculus
accagtaaggataggctctcagctaaacagctgtctttttattagacttctgggtggctgctaagtcagtctgtctctgtctcggt

SEQ ID NO: 73738 - DNA, 71 bp, Mus musculus
gaactacatgtatatatgtatatgtatgtatgtacacatatacatgtgtgtgtgtgtgtgtgtgtgtgttt

SEQ ID NO: 73739 - DNA, 60 bp, Mus musculus
tgtctgtttatgtatacatatatatatatatatatatatatatatatatatagagagaga

SEQ ID NO: 73740 - DNA, 74 bp, Mus musculus
atgcacatgcaaacttatatacatacacatattcctacatatttatgtatgtatgtatgtgtataatgtatata

SEQ ID NO: 73741 - DNA, 118 bp, Mus musculus
tcttgagaataggggctggagagattgcccagaggttaagagcactgactgctgttccagaggtcatgagtttaaatcccagcaatcacgtggtggctcacagccatctgtaatgaga

SEQ ID NO: 73742 - DNA, 91 bp, Mus musculus
ccatgagtgctttgcctgtatgtctgtctgtctgtgtactacatccatacctggtgcttgagagtccagaagagggcatcagatctcctgg

SEQ ID NO: 73743 - DNA, 79 bp, Mus musculus
gctctaccacttacttgctccacttcatggcacccagggtctctgagtgtctggggttgtttcaggtaatctcaggagt

SEQ ID NO: 73744 - DNA, 118 bp, Mus musculus
tttcagaactctgttgtcttactgtcaaagggagctgggaaggctggcactgtctttgactcacacgggtcttgccatgtaaatccagcccctctaagaggacagctgtcatcttaaa

SEQ ID NO: 73745 - DNA, 63 bp, Mus musculus
tgtatgtgagtacactgttgctctcttcagatgaaccagaagagagcatcagatctcattaca

SEQ ID NO: 73746 - DNA, 88 bp, Mus musculus
tatatatgtgcatgtatatatgtatatatgtgtatgtatgtctgtctacgtatatatatgtgtgtgtgtatgtacatgtatatatgtg

SEQ ID NO: 73747 - DNA, 77 bp, Mus musculus
cagggacccaggctcaatccttgcctctgtcacttagtgtgtgactgtagggagttgctaatcacctctgagtctct

SEQ ID NO: 73748 - DNA, 102 bp, Mus musculus
ataatataatatatactacataatatatatgaactatatatagtattatatataatactattaatattttataaaatatatgtgtagtatatatggtattat

SEQ ID NO: 73749 - DNA, 86 bp, Mus musculus
aaaaggtgctgaaatgtctgcagttggtagtgacacctgagaactgagtgtgcacgcccaccccatacatgaggagcaagcctttt

SEQ ID NO: 73750 - DNA, 113 bp, Mus musculus
ggctgaccagttggtactggataaccaattagtgaactctttttttttttttttgtcaaagacaaaattagtgggatggtgagagagtgcctaaatccagtttggacacagcc

SEQ ID NO: 73751 - DNA, 85 bp, Mus musculus
gtttctctcctagcttagtttgggtgtgtttctaggtggaggtttatatcctctgtctcagactcactttttgcaggatggtagc

SEQ ID NO: 73752 - DNA, 109 bp, Mus musculus
ggtgaagggagacctatttatgttcaaatataaatctgttttttattcatacaaaatcgttagtgtcaccaagttgcagatacaaacacaagtaggatttctctctacc

SEQ ID NO: 73753 - DNA, 84 bp, Mus musculus
tatctgtctatctatttgtgtgtatgtatgtatgtatgtatgtatgtatgtatatgcacatacatgtgcacatgcatgcagatg

SEQ ID NO: 73754 - DNA, 117 bp, Mus musculus
gaggaagacagccagtttggtcttttgagacaaagttctgagacactccgactctgagtatgatagaagtcagtgcactacagaactttgtctctagaggctgtggtcgccgcctcc

SEQ ID NO: 73755 - DNA, 107 bp, Mus musculus
gctctccagacgcatggtctccaggttgtcagccactcactgactgtttacattctaaagaaggctggttatgggcggcgatgatggttgctcttggggtctctgtg

SEQ ID NO: 73756 - DNA, 69 bp, Mus musculus
cagcttccctggaccatctgtggctctgtgagtctcctgcatagcctctccaggctacagtcagtgctg

SEQ ID NO: 73757 - DNA, 67 bp, Mus musculus
tactggttagattctccaaaggaaaaatctggcttcttcctagaggttcaaggtagaattgctagta

SEQ ID NO: 73758 - DNA, 79 bp, Mus musculus; identical to SEQ ID NO: 72631

SEQ ID NO: 73759 - DNA, 128 bp, Mus musculus
cacatatatatgtatgtatatatgtgtgtgtatacatatacatatatgtgtgtatgccctatatgtttatatgtgtatatatgcatgtatgtatgtatgtattctatatgtctttatatatgtatatg

SEQ ID NO: 73760 - DNA, 116 bp, Mus musculus
ccttgttggtattctgtgatgaacagagcctggcattaattacattcttctttaaaagttttcaagaatgtataagctgagaacttcgtgagtttgtcacagtcaatcacataagg

SEQ ID NO: 73761 - DNA, 69 bp, Mus musculus
gctggtaaggttccactttagagagagcacactttgcccttctgctctcctgttgatggttctttgggc

SEQ ID NO: 73762 - DNA, 111 bp, Mus musculus
gatagccaatgctgtggtgaatcattcactaagatacctgcatgacctgggtttgaggacagaactcagactgcagatttcaaatgttagtgtttcacctgtgtgtatgtc

SEQ ID NO: 73763 - DNA, 92 bp, Mus musculus
cacaccaggcaatgagctatttttatttagctatttttatttatttctgcaggaaataagtctaattaaactgtggtcagtgtgtgtgtgtg

SEQ ID NO: 73764 - DNA, 99 bp, Mus musculus
tctgggttctggtcctgttctctgcttcctgacctgctaccatgtgaacagtctctgccgcacactcccactgtcacagacagaattgtcccaccctga

SEQ ID NO: 73765 - DNA, 94 bp, Mus musculus
actccattacaaccgaggggagactgggcagcaggtacctggccttctggtcactgttcacatttgtcacagtctgaatttcttctggtgagta

SEQ ID NO: 73766 - DNA, 80 bp, Mus musculus
gactctgtaagcctttaggaattgtcatttcaggacagaaaatgtttttttttctagatgtatgtttgtaatacagagtt

SEQ ID NO: 73767 - DNA, 73 bp, Mus musculus
tgttttgttttcaagacagggtctctctgtcttagaactcactagaccaggctgtccttgaactcacagagca

SEQ ID NO: 73768 - DNA, 75 bp, Mus musculus
gcctctcactgtgtctgtgtgtctttgtacttgagcacattagcagagatcaaaggacaacttgtgggacttggt

SEQ ID NO: 73769 - DNA, 96 bp, Mus musculus
gggctagttactttcccactggccacccccagttttccttcagccgatggctgggtccctgtgtgggatgcccaacctaagctgtttgtttgtttg

SEQ ID NO: 73770 - DNA, 58 bp, Mus musculus
gggctagactgtgaatggcttcagaagagatctgcagtctttgactctgtctatgtct

SEQ ID NO: 73771 - DNA, 119 bp, Mus musculus
gccaccacgcagaggttatacagtgctgggaactgagcccagggctttgtgcatgacaggcacactctctgccagctgagttgcatccccagccctactgtgccttcagcatgtgtggt

SEQ ID NO: 73772 - DNA, 78 bp, Mus musculus
gggaagagtgatgagagtcagcatccaggccagacaaagccctgagacagaaatgctgtgcttttatacaataaaacc

SEQ ID NO: 73773 - DNA, 84 bp, Mus musculus
ggtctcgatgagaattgatttattgagcagagctgtgttccagcatgcttatatatatttttaagttcactcattgccctggct

SEQ ID NO: 73774 - DNA, 80 bp, Mus musculus
gggaaattagctagggtggagagatggttcagcggttaagagcactgactgctcttccagaggtcctaagttcaattccc

SEQ ID NO: 73775 - DNA, 79 bp, Mus musculus
gtatgtatgtatgtatgtatgtatgtatatatacatatatatatacatatatatatatatatatacatacacacacaca

SEQ ID NO: 73776 - DNA, 116 bp, Mus musculus; identical to SEQ ID NO: 65855

SEQ ID NO: 73777 - DNA, 113 bp, Mus musculus
atggaagttgagcatgaaattaacagagtatttgaaattggtgaaggaaagatttttatttcattaagtggacttttaaaaaagatttgtttttgtttcatgtgtacttgtat

SEQ ID NO: 73778 - DNA, 72 bp, Mus musculus
gctggagagatggctcaggggttaagagcactgactgctgctcttccagaggtcctgagttcaattcccagc

SEQ ID NO: 73779 - DNA, 80 bp, Mus musculus
gctttttgttgttgttgttgttgttagctagtgcaggtctttgtacatgctacagacagacagacagacagacagacagc

SEQ ID NO: 73780 - DNA, 58 bp, Mus musculus
taggatgtctgtatatatatgtgtatatgtgcttatatacatatatacatacatctta

SEQ ID NO: 73781 - DNA, 92 bp, Mus musculus
gccttgttagaggtatgtcactggaggtaggttttgaggtttcaaaaacccatatcaagcccagtctctgtttctctctgcctataacttgc

SEQ ID NO: 73782 - DNA, 94 bp, Mus musculus
ggcaggagttcagtaactgttgtgattttaaactttttcaaaagaaatggtggagaaactaaagatggcaccagggtaagagtgtcttccttcc

SEQ ID NO: 73783 - DNA, 65 bp, Mus musculus
ttatatatatatgtgtgtgtgtgtatatatacatatatgtatatatatatgcatatattatatgg

SEQ ID NO: 73784 - DNA, 121 bp, Mus musculus
aaggagctggggcctaactgggaggagggtgtggtatgaatgaatgaatgaatgaatgaatgaatgaatgaacgtgtaatgtatacaatgacttccaggactggtcttgtgccttcagctc

SEQ ID NO: 73785 - DNA, 79 bp, Mus musculus
ggtatgtatgtatgtatgtatgtatgtatgtacgtacgtatgtatgtatgcatgcatgcatgtatgtatcatcatcatc

SEQ ID NO: 73786 - DNA, 95 bp, Mus musculus
catcctcatcagagagatctgttaaagcctaattgtgctgtggtcactaaggcttctcataagacactgcctctctctctctctgtgtgtgtgtg

SEQ ID NO: 73787 - DNA, 94 bp, Mus musculus
tggttcataacttctgttagtttcactctgtctctgtttagtttctgtttccatgaactgtccattgctgagagtgggatgttgaagtctccca

SEQ ID NO: 73788 - DNA, 92 bp, Mus musculus
tctgtctgtctgtctgtctgtctgtctatcatctattctgggtgcctgtgtgtgtgacagagagagagagagagagagagaaggggggagag

SEQ ID NO: 73789 - DNA, 85 bp, Mus musculus; identical to SEQ ID NO: 57439

SEQ ID NO: 73790 - DNA, 88 bp, Mus musculus
ttgaacaggaacaagattatatatttatcatctgacacggtttaagacctggatgatttgtgttcttttgttcagatatgctgtacga

SEQ ID NO: 73791 - DNA, 113 bp, Mus musculus
atgaggtcagtatatatatatatatatatatatatatatatatatatatacacacacatatgtgtatatatgtgtgtatatatgtatgtatatgtcctgtctaggttcctgat

SEQ ID NO: 73792 - DNA, 75 bp, Mus musculus
aagcaggggctttctttccttgtctgcatcatctctaaggagaggttctgagaagagagagaaggcttaaagttt

SEQ ID NO: 73793 - DNA, 78 bp, Mus musculus
tatgtgaatgtgtgcatacatgagtgtatgtataaatgtatgtttgtgcatatatttacatggaggttttgcacatgt

SEQ ID NO: 73794 - DNA, 117 bp, Mus musculus
ggatctgcagtttgcttctgaagtgtttttccacagtcatgttctgagcattgaagtctcctggtaatgctacttgaggaagtgtggactctttaggaagtgggacctggtaggtct

SEQ ID NO: 73795 - DNA, 86 bp, Mus musculus
tgtgtcacagtctgactctgggacagacacattgtgtcacagtctgactctgggacagacacattgtgtcacagtctgactctggg

SEQ ID NO: 73796 - DNA, 85 bp, Mus musculus; identical to SEQ ID NO: 57439

SEQ ID NO: 73797 - DNA, 74 bp, Mus musculus
gtgtatgtgtgtgtatgtatgtatgtatgtatacatatgtgtgcatatgtatgtatgtatgtatgcacatgtgt

SEQ ID NO: 73798 - DNA, 112 bp, Mus musculus
tctagggatatcaagctgctctacctggcaacttatgcaccaaggacagccgagtgatctcggtctctgtctctctgtctgaaaattgtcaactcccagcagatacctttga

SEQ ID NO: 73799 - DNA, 93 bp, Mus musculus
tatgttattatgaatatatactatgaatatatatatccatgcatatatacatatatatgcatatatatatgtatgctgagggatttaaacata

SEQ ID NO: 73800 - DNA, 114 bp, Mus musculus
gggaggacccggctgaaattttggcaagggccgcagagtgggccccacctaaacactgacagaacacacggtcctggtccaagctgttccacagatgtgagctgggtgcctccc

SEQ ID NO: 73801 - DNA, 112 bp, Mus musculus
aagatcaggaggggcagggttctcctgaagggctagactatagatattgtagttttagaggcagcaagcatatggtctctatagtaactccttctctctgcagctgtatttt

SEQ ID NO: 73802 - DNA, 112 bp, Mus musculus
ccagagggcaccatgagagagaaggcagatggacagccgtgctgattagagagagcgcacagaggggcctgtcgactgtcctgacttattcacgaaccctaagctaacctgg

SEQ ID NO: 73803 - DNA, 72 bp, Mus musculus
gtgtgtgtgtgtgcatgtgtgcgcgcatgtgtgtgtgtgtatctgtgtatatgtatgtgtgtctgtgtatgt

SEQ ID NO: 73804 - DNA, 73 bp, Mus musculus
gtttagtcactctgttatgtcattttcttgttgagcagtttatcaaggggagtgatggagccatgtgctgaac

SEQ ID NO: 73805 - DNA, 63 bp, Mus musculus
tttctggcttcttaatatatatacacacacacatgtgtgtgtgtgtgtgagagagagagagag

SEQ ID NO: 73806 - DNA, 116 bp, Mus musculus
cgatttcccaatcctaattgtcttttcctttctctcagatatacttcagagtctctgtgtctctggaaattaatcactatttgagagattaattggaattttaaggttattaattg

SEQ ID NO: 73807 - DNA, 82 bp, Mus musculus
agtaggctcagaggcctgagtagacagtgacgtcaccactggtataaccagagtgaggtgagtgcgggccaatgggtctgct

SEQ ID NO: 73808 - DNA, 95 bp, Mus musculus
gagatgatgaccctgtgacaaggaccgggagacccttcaccctcactgacaagacctcaggctctctctgtctcatatcgcagccacctttgctc

SEQ ID NO: 73809 - DNA, 107 bp, Mus musculus
tcttgttaattcccgttcctggtttgagctgctcccagccatgttcatgactctagcctgtctgcacactgtctaagctgtccacataggatatgaggtgctataga

SEQ ID NO: 73810 - DNA, 97 bp, Mus musculus
gcttgtggattctgtgtctgacacgggagggagacaaagtcaaccaagtcactagactgcagactggtttcccaactgtgcaagaactgagagaggt

SEQ ID NO: 73811 - DNA, 117 bp, Mus musculus
tcgctgactaggagagatgcaggaatcgttgttgctgatctcgcccaacacccctgacactcgcacactgtcggaacaacctggggttggcagcacggtccgctcaggtggcaggga

SEQ ID NO: 73812 - DNA, 105 bp, Mus musculus
gtatgggggcgtgtataagatgttgggtgtgtatgtatgtaagtgtgcatgtgcatatatgtatgtatgtgtgtgtgatacatctaagcatgactcatgcctttg

SEQ ID NO: 73813 - DNA, 80 bp, Mus musculus
ggggtctgtctgtctgtctcagctttgggtctgtctgctgtctgtagataagctcttccctgagcagctgggtggaatcc

SEQ ID NO: 73814 - DNA, 84 bp, Mus musculus
ggatggggaaggtcagtgagaaaggagacagcgaggtggcgggcacatgcacctctctcctctctagcctgactggtctctttc

SEQ ID NO: 73815 - DNA, 94 bp, Mus musculus
gtctgccttgctgtgctgagtaatagatttagggtctgcctaactcacagagtagacagagatagagcttggcctccaaacgtgtgctgcggac

SEQ ID NO: 73816 - DNA, 78 bp, Mus musculus
gcacacacacaagcccatgtgcacacctagtacattacatcatgctaacatgtgttcactgcgtctctgtgtgtctgt

SEQ ID NO: 73817 - DNA, 114 bp, Mus musculus
tttgattttttattttacagagtttcaaagttaaagagattttctgagtctcagaagagactctgaacttacacttttgaacagttttggaactgttaaagacaacaaattgag

SEQ ID NO: 73818 - DNA, 106 bp, Mus musculus
gtttcccaaaaaaagaaaaaaaaaaagtcacatgacacaacagagtctccagcgaaagcagaattccctgtttcagtcatctcttcttcttcttttttgaaaaaac

SEQ ID NO: 73819 - DNA, 94 bp, Mus musculus
gctatggctgccactagaatgcctgcctccgcaggctgggaggggtcacatctgtctcactgtggaacgggtaggctcgggtgtgcgcacaggc

SEQ ID NO: 73820 - DNA, 78 bp, Mus musculus
gccatggtgatgtctgacaggctccaggcatctttctcttgggggtggatgcgtaggaggacagtaagaaactaaggc

SEQ ID NO: 73821 - DNA, 102 bp, Mus musculus
gtttccttgggtggatctcatcttcttgtcttcacctcttcagtgatcacagccaggtctcggaggttgaactgcgggtggactgctcagagtgaaggaggc

SEQ ID NO: 73822 - DNA, 94 bp, Mus musculus
cctgaactattgtaagtcttttgcctgagcagcatgcagatagctgcgtgtgttcaccaggaagaaggtgaaagctagttgtagttttaaaagg

SEQ ID NO: 73823 - DNA, 81 bp, Mus musculus
gtctgaaagtgactgtggtgatagacttgtgcatggagccctggctgcctctcacactcactcggcctttgttgttttggc

SEQ ID NO: 73824 - DNA, 73 bp, Mus musculus
gtgcagcagagacctgcagccagcacacagtgcttgtgacaacagcaccctttgcctctgagtcactctgtat

SEQ ID NO: 73825 - DNA, 117 bp, Mus musculus
ggaacagtctttaaaagtcaaaggggggctggagaaatggctcaggggtcaagagcactgactgctcttccagaggtcctgagttcaattcccagcaaccacatgatggcttgtctg

SEQ ID NO: 73826 - DNA, 84 bp, Mus musculus
actgagagcaggtgttatggtgtcactctcacaaactgagggagctttccaaggacattttataggaccaggttttatcttagt

SEQ ID NO: 73827 - DNA, 79 bp, Mus musculus
tgtctcactgtcaggcctccacacactgtgtaacagttactatttctctgtcagtgtgtctgggccacggtgctagtca

SEQ ID NO: 73828 - DNA, 93 bp, Mus musculus
accaatattgggctggagagatggctcagcggttaagagcactgactgctcttccgaaggtcctgagttcaaatctcagcaaccacatggtgg

SEQ ID NO: 73829 - DNA, 69 bp, Mus musculus
cttcattaaatctactagagggagcctttctctctctctgagaaagaatccactttgtgtttcctgaag

SEQ ID NO: 73830 - DNA, 69 bp, Mus musculus
ttgcctaatctcatgtcacagccacacttgaggatgggaagtgctctgtgtgggtggcagtgcctgcag

SEQ ID NO: 73831 - DNA, 110 bp, Mus musculus
ggccccagcctgggcaggtggggttccaggctggttggaggaaacagggtaagagctctctctctctgagcctcctcaggctcagtcattcccctttgcctttcatggcc

SEQ ID NO: 73832 - DNA, 58 bp, Mus musculus
agagctggtcggagtaggctttggaatcttccctgtctctgtctctgtctcagtctct

SEQ ID NO: 73833 - DNA, 65 bp, Mus musculus
tctggagcacgaatgtgtgtgcatgcacacgtgagtgtgtgcgtgcgtgcgtgcgtggcactgga

SEQ ID NO: 73834 - DNA, 115 bp, Mus musculus
ggtatacccagatttgtggagctcctaggcccatgctgagagaagtgacataggactgggcaccaaggctacttttccctctcctcttgccagaggccttccagaaagctctgca

SEQ ID NO: 73835 - DNA, 77 bp, Mus musculus
gaacaaagctgcttggttgtgtgactgtgtgtctgtgtggggcagggaacactgcacacatttttatagccctactc

SEQ ID NO: 73836 - DNA, 84 bp, Mus musculus
cagtcagtcagtcagtcagtcactaaacacagtttatgccgcccaagagtgtgccgcatggtttacctgacaaggtgacaactg

SEQ ID NO: 73837 - DNA, 90 bp, Mus musculus
tatacacatatatgtatgtacatacatatatgtgtgtatgtatatgtatgtgtatatatatgtatgtatgtatatatgtatatacatata

SEQ ID NO: 73838 - DNA, 60 bp, Mus musculus
ggtctgtctgtctgtctgtctgtctggatctctgccctctatggcaggcaaagaaaggtc

SEQ ID NO: 73839 - DNA, 117 bp, Mus musculus
ggggatcaagagacggaacctcgggagccacacttccctctggctcactgtctctggcagctccagtctcaccagagcagcagctgcatggctgtgatgctcacagtggtgtgtggt

SEQ ID NO: 73840 - DNA, 97 bp, Mus musculus
catgaactccatcagggaagaagctaaagacagaagtgggaaactaacagaaacacaaagtcacacacactctgtcatgggatctctgcatagcatg

SEQ ID NO: 73841 - DNA, 83 bp, Mus musculus
ccgttcctcatacaaggttgtcttgtttaggttaacacaagagtagtgcctagtcttactgcaacttgatatgtcatggttgg

SEQ ID NO: 73842 - DNA, 62 bp, Mus musculus
tgactgaacaaattgctttgtctttagcctggtcacactgtggctgagacactggcaggtca

SEQ ID NO: 73843 - DNA, 71 bp, Mus musculus
gcatctgctctgcactctgtctctgacagcccacaaatagtgttcaagtcagccccagaggcagccagtgt

SEQ ID NO: 73844 - DNA, 96 bp, Mus musculus
tcatactttggaaagcctgttttgcaaattcttctgtgtctgtgtgtcttaaaagggaggggcaatgctttccttggtgatgggatgtagggagga

SEQ ID NO: 73845 - DNA, 116 bp, Mus musculus
cagtgaggggtcaggaagactgaatctaactgctgttttcccattttgtagttgtgacatcctggccaggtctcattgtataacaggcatgctacaaagactgaatgtgatgaagc

SEQ ID NO: 73846 - DNA, 96 bp, Mus musculus
tgagtgtcacatctcaggatatccttgaacaaacttttagaattttacttcttgtgaaattttgcctcttcaaagctatcttctgatttttactca

SEQ ID NO: 73847 - DNA, 117 bp, Mus musculus
ctctgtgacctcaggccttctgctgtctctccaggtatagcatatgtattagacagaaatgtgtatgaagactgggagaagactgttcaggaagcagtagcctatcaggtagatgag

SEQ ID NO: 73848 - DNA, 75 bp, Mus musculus
gatatgttttcctgactctcagcacaaaggcggggcttccctctggtgtgactgacagtctgtaacagaagtatc

SEQ ID NO: 73849 - DNA, 105 bp, Mus musculus
gaaaatgaaagagttagggtctcagatgtctacctcagcaggaaaagctgttttcaactcagtgtatatctgtctgtctgtctgtctcctatttctctctttttc

SEQ ID NO: 73850 - DNA, 113 bp, Mus musculus
gtaggatactcaggagacctcgtcatgcactgaaaccattgactggaatcaaccaatttttaaatatttctagaagggtttctctgatgacagttgggtcagagttctctttc

SEQ ID NO: 73851 - DNA, 116 bp, Mus musculus
agtatgttgggcattgtgtagcctttaactccagcacttgtcagacagaggtgacagagctctgtaagtttgaagccagttgggtctacatagtgaatttcagaccaactaggact

SEQ ID NO: 73852 - DNA, 70 bp, Mus musculus
gcacagatgtgtgtgtgcacataagcacatatttaaatgtgtgtgtgtgtgtgtgtgtgtgtgtgtgtgt

SEQ ID NO: 73853 - DNA, 80 bp, Mus musculus
tagcacagagcaaaccttcagtacttctgaagaggagtctatgatttttcttttaaatgctgatgttgatgctttaacta

SEQ ID NO: 73854 - DNA, 146 bp, Mus musculus
atataaataaatatatatgtatatatgtgggtgcataaatttgtatatacatatgtacatatatatgcttgtatatatgcatatatgtgtatataaatatgtacacaaacacatatatgcatatatacaagtatatatatgtacat

SEQ ID NO: 73855 - DNA, 117 bp, Mus musculus
gttttcatccatgctggcgtgggctctggtgatgcaggtgtctctgagtcttttttattcttatatgaaaccccagtaatactcattggtttcccaagttggactttgttagaatcc

SEQ ID NO: 73856 - DNA, 107 bp, Mus musculus
tgtgtgaatccccgtgcggctagagaaacatcagtctatttgtttattagtaatgggagagggatgaaactggtcagttcttctggtgatattggatagctcatgca

SEQ ID NO: 73857 - DNA, 76 bp, Mus musculus
cacagggacagacacactcactgagaagagggagcaacttcctccaatttcttttcatcgatatgtcagcctggtg

SEQ ID NO: 73858 - DNA, 85 bp, Mus musculus
ggccatggtggtctgataggatagatgggacaatttcaatatttttgtatctgttgaggcctgttttgtgaccaattatatggtc

SEQ ID NO: 73859 - DNA, 83 bp, Mus musculus
gcattcatacatggagagtgactgttgactgtgaggaaccaagtatgggggtttcttcagttatatgtttttctacaggatgt

SEQ ID NO: 73860 - DNA, 77 bp, Mus musculus
ataggtttgattcaagtcagtctgaaattggttgagatcccatctctgcctgtctgcctgtctgcctgtctgcctgt

SEQ ID NO: 73861 - DNA, 104 bp, Mus musculus
ccgtaagaatgcttggcactgctatttatctcttctgattattttttgttcaaaaaatattttgtcagatgttaggatagctgctctctttcttgttctgttgg

SEQ ID NO: 73862 - DNA, 97 bp, Mus musculus
ggtctgaagttctctatctttgttggatctttctgtggtttagatatcagagtaattgtgggcttcatagaatgagttgggtagagtaccttctact

SEQ ID NO: 73863 - DNA, 103 bp, Mus musculus
aaagaatttatggctatattctggtgtgttttttaaacttatctaaagctaagtttttatctgtttttaatgagagagaacatattggatgtttaatttcttt

SEQ ID NO: 73864 - DNA, 106 bp, Mus musculus
tacatccacttatacccatagtgattatacaattaatagagtgtagaaagtgaactaatggtctctcactgtatctgtgtcttcagttctaggttctggggatgta

SEQ ID NO: 73865 - DNA, 63 bp, Mus musculus
gccctgtgctggcttattttctgtcaacttgacagaagctacagtcctcaaaaagcaaggggc

SEQ ID NO: 73866 - DNA, 77 bp, Mus musculus
tccatgtaatagcttgaatggctaaggtcttcatctcctgagatttttgaagacttattcttgttgctgacagtgga

SEQ ID NO: 73867 - DNA, 79 bp, Mus musculus
acttctgttagtttcactgtgtctctgtttaggttctgtttccaggatctgtccattgatgagagtggggtgttgaagt

SEQ ID NO: 73868 - DNA, 99 bp, Mus musculus
taagtgagctgtggcattcctcagagctttgaggattggcaagttgagagaaaacagtgtaggcttttagtggcgggagtttgaatgcatgtttatttg

SEQ ID NO: 73869 - DNA, 68 bp, Mus musculus
tgactgtgtgtctgtgtcttttatctaagcattcaagggaagctgggagggggccggtagcatggtca

SEQ ID NO: 73870 - DNA, 108 bp, Mus musculus
gtggatggcaggttgtacagcccaaatctctgatctatgaaaagatttttttctatatactgtctttcaaagtccagaagacggctttaacatgtggctgtcatccat

SEQ ID NO: 73871 - DNA, 83 bp, Mus musculus
ttggcagaaagtggtgaaggcaaagggacaagagtattaaccccctagtgactctgttcttttgagtggctagcgtctgccag

SEQ ID NO: 73872 - DNA, 93 bp, Mus musculus
tccatggtgacctgttaggatgcatgggacaatttcaatatttttgtatctgttgaggcttgttttatgaccaattatatggtcaattttgga

SEQ ID NO: 73873 - DNA, 82 bp, Mus musculus
gtgttcattgtgtacctgtatgcatgtatgtatgtgtgtgcacagatgaagtatgtatgtatgtatgtatacacatggaggc

SEQ ID NO: 73874 - DNA, 79 bp, Mus musculus
acttctgttagtttcactgtgtctctgtttaggttctgtttctaggatctgtccattgatgagagtggggtgttgaagt

SEQ ID NO: 73875 - DNA, 92 bp, Mus musculus
ctattccactgatgtacctgtctgtctctgtatcagtattatgcggatttttatcacaattgctgtgtagaacatctcgaggtcaggaatgg

SEQ ID NO: 73876 - DNA, 82 bp, Mus musculus
gatgtgtttcttggaggcagcaggtatttgaaaattgtttcttgatacattcactcagtctgtgacctttgagaggagaatt

SEQ ID NO: 73877 - DNA, 85 bp, Mus musculus; identical to SEQ ID NO: 57439

SEQ ID NO: 73878 - DNA, 85 bp, Mus musculus; identical to SEQ ID NO: 57439

SEQ ID NO: 73879 - DNA, 79 bp, Mus musculus
tatatatgtatatatacatatatatgtactatatatacatacatatatatatatatgtatgtgtatatgtagatatgta

SEQ ID NO: 73880 - DNA, 89 bp, Mus musculus
gagatgtatttcttgtaggagtcatgctgatcacaagtgcatatatagtgattatcttgttcagacaccagaggcactgcaggcatctt

SEQ ID NO: 73881 - DNA, 100 bp, Mus musculus
gttcctcattttgtaattggtttatttgtattttttaaagtatatagttccttgagttctttatatattttagatactagccctctattggatgtggaat

SEQ ID NO: 73882 - DNA, 95 bp, Mus musculus
agaaagtggagccttgctgagagaagtgagccaccagggtccggctgtgacgatgtatatcttgtcctcacttcctctctgtctctctgcttcct

SEQ ID NO: 73883 - DNA, 91 bp, Mus musculus
accttctttctgtcactctcttactatcacagcctggtatgtaggagtctagaaaccaatgctgacagtaggtaaggaaggaaggagaggt

SEQ ID NO: 73884 - DNA, 118 bp, Mus musculus
gatgttagaaatatcagtgtcagggctggagagatggctcagtggttaggagcactgactgctcttccagaggtcctgagtacaaatcccagcaaccacatgatggctcacaaccatc

SEQ ID NO: 73885 - DNA, 85 bp, Mus musculus; identical to SEQ ID NO: 57470

SEQ ID NO: 73886 - DNA, 104 bp, Mus musculus
cacagggaatatccacagaacacatcctttagtcctcaatgtttttttctttgaaaaattctgcccctggtgtggatttattttgctggactgttcctacagtg

SEQ ID NO: 73887 - DNA, 87 bp, Mus musculus
gtcaaatgatataaacacatccaaggaagaccgaaaagctgtgaaagctcagatgctgtctgtccttgtctgtctctaacatttgat

SEQ ID NO: 73888 - DNA, 94 bp, Mus musculus
gatggacaataggagtgtttgtatatatgtatatgatgtaatacgtatgtatattatgtatgtgtacatatatgtatattacttcatgttcctc

SEQ ID NO: 73889 - DNA, 106 bp, Mus musculus
ctggataaaatttcctatgtgtgttgcttcctactagcttatatactttaaaaggtactgtactgcttcagtggatatgccaacattcacagagcttttcttctag

SEQ ID NO: 73890 - DNA, 76 bp, Mus musculus
tgagattctttttatattctagtcactaaataaatatatttagaacactggaagaaatgtgaacagtgatgtctca

SEQ ID NO: 73891 - DNA, 190 bp, Mus musculus
catatgtgtgtatatgtgtatatacatgaatgtgtgtatatatatatatgtatatatgtgaatacgtgtatatatgtatacatgtgaatatgtatatgtgtgtaaatacatatatgtttatatatatttgttgtgtataaatatgtgtatggatatatgtgcatatgtgtgtaaatatgtatatgtgtat

SEQ ID NO: 73892 - DNA, 116 bp, Mus musculus
ttatatggcaaagggagataagttgtggttacacggaggcaggcatattctcagtgctctctgaatctgtcagattttgatgtagtcacagaccttgtctaaaagttaaggtatag

SEQ ID NO: 73893 - DNA, 96 bp, Mus musculus
gatcagtcttagtctctggtgatctgttaggatgcatgggattatttgaatatttttgcatgttttgaggcctgttttgtgactaatgatatggtc

SEQ ID NO: 73894 - DNA, 85 bp, Mus musculus; identical to SEQ ID NO: 57439

SEQ ID NO: 73895 - DNA, 82 bp, Mus musculus
cggtacgactggggggccctgttctataaggaccttgttgggcccaacgagtgtcaccgccgggtctctcactgtcagtctg

SEQ ID NO: 73896 - DNA, 89 bp, Mus musculus
ctgggaggaaaatgtcttggaggaactcttagaaaggaataatttatgtctagccctttcctgtcattctctctcatactgtttcccag

SEQ ID NO: 73897 - DNA, 100 bp, Mus musculus
agactccctagtaacaagacatagaagtgtatacatgtatgtgcattaaaacatgttggttgtttcatggatgtgtgcaatcatttttgggggggggtct

SEQ ID NO: 73898 - DNA, 91 bp, Mus musculus
gggcgtggctgtttaatattagtatgtagcctctggtgtgacaatcactgactcacctggaaggtcatacactcaacagtatatgtacagc

SEQ ID NO: 73899 - DNA, 86 bp, Mus musculus
ttaagagtgaggaataagagagcagagaggggcctaactgcccctttaaaagtatgctgctatatatattttttcttgctaagtaa

SEQ ID NO: 73900 - DNA, 101 bp, Mus musculus
agtctccctagtaacaaaacttagaagtgtatacatgtatgtgcattaaaacatgttggttgtttcatggatgtgtgcaatcattttttgggggggggtct

SEQ ID NO: 73901 - DNA, 85 bp, Mus musculus; identical to SEQ ID NO: 57439

SEQ ID NO: 73902 - DNA, 92 bp, Mus musculus
tctaaagaagctagatgaatgcatgggacaatttcaatatttttgtatatgttgaggcttgttctgtgaccaattatgtggtcaattttaga

SEQ ID NO: 73903 - DNA, 109 bp, Mus musculus
tttggggagaaagaggggaaggcagggagtccttaggaaccggggcatcgataattgatgacagctgagactgaggattcgcaggaggcttagttttgattttgcgaga

SEQ ID NO: 73904 - DNA, 66 bp, Mus musculus
ggagagagagagtgatgtttctcataaataataaatgtattctaaagaaatatttatctcctttcc

SEQ ID NO: 73905 - DNA, 86 bp, Mus musculus
tatgcttccacagttctgtgtctgataatcttgaataagtgaagtcactttgttctggttatcaggtacagccttgtgtgtgtgtg

SEQ ID NO: 73906 - DNA, 114 bp, Mus musculus
ttggtggtaagattttatgtttggggactggagagatggcttagtggttaagagcactgactgctcttccaaaggacaggggctcacagcacccacatggcagtttacaaacag

SEQ ID NO: 73907 - DNA, 87 bp, Mus musculus
attgaaaacagggctggagagatggctcagcagttgacagcactgtctgacatcactgatggctcttccaaaggtcctgagttcaat

SEQ ID NO: 73908 - DNA, 108 bp, Mus musculus
tactttttatgggagctttacatgaacaactgctggaatgaagaataaatgaactagtgttattatttttctttctagacatttatgtctggaatttgatgagatgta

SEQ ID NO: 73909 - DNA, 85 bp, Mus musculus; identical to SEQ ID NO: 57439

SEQ ID NO: 73910 - DNA, 81 bp, Mus musculus
cctcctaggatgtgtcgctccctgattggctgcagcccattggcccagttgtcatcacgagaaaggcagaacacgtggagg

SEQ ID NO: 73911 - DNA, 113 bp, Mus musculus
cagtaattcatagacaatagatggtgatagatagataatatatacatgtatctatatatgttcatatatgcatatgtaatcaaactcttaactctattcaaatgaacgaactg

SEQ ID NO: 73912 - DNA, 90 bp, Mus musculus
ctgctgatcactatgtgcaactgcaagtggtttttttctgaagtaaactttaaagcaaatgcagttatttcattgttaagtgaacagcag

SEQ ID NO: 73913 - DNA, 77 bp, Mus musculus
ctctgtgaaccatgaagtgaatgtctgaggtcaatatcagatatcttcttcagtcattttctacttctgtttttgag

SEQ ID NO: 73914 - DNA, 108 bp, Mus musculus
agctaaatgctttcttttataagttgcctttgtctcttcacagcaatggaaagtaaccaagtctccattttctgtaaaaagaagcatctttgatgagggctgttagct

SEQ ID NO: 73915 - DNA, 81 bp, Mus musculus
acacacacacatatgtgtatatatatatatatatatatatatgtatgtatgtatatatgcataaacacacatggtgtaagt

SEQ ID NO: 73916 - DNA, 85 bp, Mus musculus; identical to SEQ ID NO: 57439

SEQ ID NO: 73917 - DNA, 96 bp, Mus musculus
gatcagctttagttcatagtgatctgatagcatgcatgggataatttcaatatttttgtatctcttgaggcttgttttgttaccaattatatggtc

SEQ ID NO: 73918 - DNA, 99 bp, Mus musculus
atgtgtgtgtatctgtgtctctttgtgtgcgtatgaaatatatgtatttatatttactacatatattaatatttatatcagatataaatatatttatat

SEQ ID NO: 73919 - DNA, 107 bp, Mus musculus
taacaattgtttatagttcatagtatgtaattcttttctttgcattatgatatagaatggaatgaagactggagtgtatttgcatacaagagatatatgctttgttg

SEQ ID NO: 73920 - DNA, 103 bp, Mus musculus
acatatacacacacacacatatatgtatatatgtatgtgtatatatatgtgtgtgtgtatatgtatgtatgtatgtatgtatatgcatatatatgtgtatata

SEQ ID NO: 73921 - DNA, 72 bp, Mus musculus
gctgtagatatatcagctgtgttatagatgtgtccacttggggtggacttgccacagtctgtgtatctctgt

SEQ ID NO: 73922 - DNA, 114 bp, Mus musculus
tgtgtgtgtgtgtattctatgtatataaaaacatcatatatatatacatatatatgtgtatgtgtgtgtattctatgtatatataaatgcatcatatatatacacatatatgtg

SEQ ID NO: 73923 - DNA, 97 bp, Mus musculus
tgtgttgctagaatgaaagccagtccttgcacattctgagtacacagtctgacactgagttacagagttaggtctaactttcagagtaagtaacaca

SEQ ID NO: 73924 - DNA, 89 bp, Mus musculus
agagtatctgcttaatgattctctaggtttcctcagtgactgtggttgtgccacacttttcacttgtgattttgttcatttagatctct

SEQ ID NO: 73925 - DNA, 85 bp, Mus musculus; identical to SEQ ID NO: 57439

SEQ ID NO: 73926 - DNA, 107 bp, Mus musculus
acatatatggatatgtatgtatatatgtgtatatatgtgtgtgcgtgtgtatataatacatatatatacatatatatatatggatatgtaatgtatatgttatgcat

SEQ ID NO: 73927 - DNA, 116 bp, Mus musculus
aggacagtggttttctatctgaatatatgtgtgtatgtatgtatgtatgtatgtatgtatgtatgtatgcatgcatgcatgcatgtatttagtaataggatctctcacttaagctt

SEQ ID NO: 73928 - DNA, 105 bp, Mus musculus
cgtcttagaagttgatattgcatcttgccacttttctgaatttgttaatcttttgaaattttcagatggactttgggtgaattcatatgtcatctactaacagcg

SEQ ID NO: 73929 - DNA, 91 bp, Mus musculus
ggtaagtgtgaggaagttcagtgtaccatgataaattatttttttgcttaaaatctttattatgaaccacattaaattccttcattttatc

SEQ ID NO: 73930 - DNA, 79 bp, Mus musculus
agtgtttcacagtggctgttatataaactaaattccacttggggatccatcccatgtacagtcactaaacccagacact

SEQ ID NO: 73931 - DNA, 85 bp, Mus musculus; identical to SEQ ID NO: 57470

SEQ ID NO: 73932 - DNA, 83 bp, Mus musculus
ttggttaattcactacatctacattgtgtgttggtatatacatatatatttaatgtatacatgtgacagtagtaattaactaa

SEQ ID NO: 73933 - DNA, 81 bp, Mus musculus
tctgaatatgtatgtatgtatatatatgcatatatatacatatatatgcatatgtataaatgttgacatatatgatgtaga

SEQ ID NO: 73934 - DNA, 95 bp, Mus musculus
tcccatcacaaagcattattagacagaagacagacaggtctccttacatctcattgaatttgttccatgttagtcatctactactaggcttggga

SEQ ID NO: 73935 - DNA, 95 bp, Mus musculus
tgtatgtgatgtgtgtgcatgtgaatctgtatgtgcatgtgcacatatatgtatatatgtatatgcaaatttatatgtacaactatatgcatata

SEQ ID NO: 73936 - DNA, 56 bp, Mus musculus
tccatccactgtttggctctggtgtctgtatctgtctgagtcagctactggatgga

SEQ ID NO: 73937 - DNA, 105 bp, Mus musculus
ggagggaccaataagaataccaggggttcattgcatagctagctagctgtaccagcaagccaagctctgtctctgtcactccttggagccctatttataccctcc

SEQ ID NO: 73938 - DNA, 71 bp, Mus musculus
gtcctgcagtcagaaagtaagaagaagcaaaggaggaattctgcttactctcttgctctctgtggttagat

SEQ ID NO: 73939 - DNA, 92 bp, Mus musculus
gtgaccctagcgaggactagtagtaatggaggatagggaatcagcaatggtcatcctctgtatccaactgagttgttggccgagagagtcat

SEQ ID NO: 73940 - DNA, 106 bp, Mus musculus; identical to SEQ ID NO: 57611

SEQ ID NO: 73941 - DNA, 117 bp, Mus musculus
atttatatatattggaaataacatttggaggtactaagtgctaagattttcacagaacaaagtcagtacataatcttatttaccaagcaaaactgttagttcttctgtagaatagat

SEQ ID NO: 73942 - DNA, 94 bp, Mus musculus
tggacattatggctgttctttttttgtttatttttttaatctttttagttgagcagattgagaaacaaataagagagccatctctggatgtcta

SEQ ID NO: 73943 - DNA, 116 bp, Mus musculus
gattaaaagtgggattgttggggctggagaaatgactcagtggataagagcactggctgctcttccagaggtcctgagttcaattcccagcaactacatggtggctcattactatc

SEQ ID NO: 73944 - DNA, 83 bp, Mus musculus
gaagtaattccactgaagtcagagatgagacaaggatgttcatcaccccatccctttttattattgtgcttgaagtggtactc

SEQ ID NO: 73945 - DNA, 85 bp, Mus musculus; identical to SEQ ID NO: 57439

SEQ ID NO: 73946 - DNA, 96 bp, Mus musculus
ggtgtcagcatttggaagctgatcatgggaatgatctctggatatggcaatcactagatggtccatcctttcatcacacttccaaattttgtctct

SEQ ID NO: 73947 - DNA, 113 bp, Mus musculus
gcagcatgaggcatgtgttacatctcatggaatgagccttaagcagtcagataggggctggtcactcctgtaactgttatgctactcttccaacacagtatatgtatgtgtgt

SEQ ID NO: 73948 - DNA, 57 bp, Mus musculus
gtatatgtatatatctatatatacatgcaatgtatgtatatatgtgtgtatgtatat

SEQ ID NO: 73949 - DNA, 87 bp, Mus musculus
taggtagcaccttgtgggaggaagtgtgttccttggaatttaaggtttcaaaggattcacccagtgtctctcactccctgctgccta

SEQ ID NO: 73950 - DNA, 112 bp, Mus musculus
acccctacagttctaacagttattcatgatgaggtagattagtatgttcatctgtacattagatgacagaagagactgaggcagcgtggtggaagctttaagaaacagcggt

SEQ ID NO: 73951 - DNA, 85 bp, Mus musculus; identical to SEQ ID NO: 58391

SEQ ID NO: 73952 - DNA, 102 bp, Mus musculus
tagataagtttgtgtatgtgtgtgtgtctgtagttgcatgtaaactagtatatagactagcttatatgtttgcaaaatatactacttattctactttatcta

SEQ ID NO: 73953 - DNA, 95 bp, Mus musculus
gtttctgtaagtaggtcatgtgtgtctctctgtgtgtacatgaccatcatgtatgcatatatatatgcacatatgagtgcatttgaagaaggaat

SEQ ID NO: 73954 - DNA, 85 bp, Mus musculus; identical to SEQ ID NO: 57439

SEQ ID NO: 73955 - DNA, 90 bp, Mus musculus
cagtgttttatgaaagttgattatagtctccaaatgtaatatatttttcattgttaatagactgtggttctcttacatatttagcacctg

SEQ ID NO: 73956 - DNA, 91 bp, Mus musculus
cagaattattttggaaagagttcttgatgaaatatttgtgaatattaagagatatcacagatgttagaaagcacttttcactgaaaatctg

SEQ ID NO: 73957 - DNA, 74 bp, Mus musculus
tctttctaactatctatggatatatataaacacacacatgtgtgtgtatatatatgtgtgttgatatataaaga

SEQ ID NO: 73958 - DNA, 81 bp, Mus musculus
tatgtatgtatgtatgtatgaatgtatgtatgtatgcatgtatgcatgcattatgtatttatgcatttaagtatgtatgtg

SEQ ID NO: 73959 - DNA, 85 bp, Mus musculus; identical to SEQ ID NO: 59744

SEQ ID NO: 73960 - DNA, 118 bp, Mus musculus
ggaagatgatcaacattcaaggaaggtttttagtcttcaatcctatctgtcattctctgtcagattagggcagctttcacctttcacaaaagaagcttcattttctgacagacacaga

SEQ ID NO: 73961 - DNA, 103 bp, Mus musculus
atatatatatacacatatatatgtctatgtatgtatatctctatttctatctctatctattatctatgtatgtatgtatgtatgtatgtatgtatgtatgtat

SEQ ID NO: 73962 - DNA, 96 bp, Mus musculus
atttaaaaacaaactcttcatagcatcgtaatttatttttatcttaaaacaaattttaagtggtattttgtgatgttgaaggttgtaattttgaat

SEQ ID NO: 73963 - DNA, 77 bp, Mus musculus
gtcccaaattggacaagctgccttgcttcaagcttttagatcttatggggcatggagactgtatagactgtggagac

SEQ ID NO: 73964 - DNA, 72 bp, Mus musculus
ttatgtgcatgtgtatgtgtgtgtgtcaatgtctgtgtgtgtgtgggcacacacatatgtgtgtgtgtgtgg

SEQ ID NO: 73965 - DNA, 85 bp, Mus musculus; identical to SEQ ID NO: 57439

SEQ ID NO: 73966 - DNA, 85 bp, Mus musculus; identical to SEQ ID NO: 57470

SEQ ID NO: 73967 - DNA, 104 bp, Mus musculus
ggactggtacagatcttgtacttagcaaatatttgaaaatggatatattaatgcatgagtgaatacatgtttgttttaaagtactttattgatactttatgtct

SEQ ID NO: 73968 - DNA, 119 bp, Mus musculus
atggatacaaaagtcattatgggactggagagatggctcagaggttaagagcactgactgctcttgcaaaggtcctgagttcaattccagcagccacatggtggctcacaaccgtctgt

SEQ ID NO: 73969 - DNA, 65 bp, Mus musculus
ggcgacagtacagtgtgagcattgacatccattgcagggcttcctttttctgtctttttgtcgct

SEQ ID NO: 73970 - DNA, 85 bp, Mus musculus; identical to SEQ ID NO: 57470

SEQ ID NO: 73971 - DNA, 101 bp, Mus musculus
tagggtaaggggaggggctggtgagatggctcagcggttaagagcactgactgctcttccaaaggtcctgagttcaaatcccagcaaccacatggtggctc

SEQ ID NO: 73972 - DNA, 101 bp, Mus musculus; identical to SEQ ID NO: 73971

SEQ ID NO: 73973 - DNA, 131 bp, Mus musculus
gctttcccctaattcagccacaggggtcagcagcttctgtccattgattgggtgcaaacatctgtctctgactctttcagctgcttgttgggtcctaggagggcagtcacgctaggtccctttatgtgagt

SEQ ID NO: 73974 - DNA, 79 bp, Mus musculus
gcatctgcagtcacttgagtttttgatgttagccattctgactggtgtgaggtggaatctcagggttgttttgatatgc

SEQ ID NO: 73975 - DNA, 85 bp, Mus musculus; identical to SEQ ID NO: 57439

SEQ ID NO: 73976 - DNA, 74 bp, Mus musculus
gcgttttttctctcagtgtatttctctgtgctcaaaaaaagcagagagagattacaaagtgtgctttaaagcgt

SEQ ID NO: 73977 - DNA, 80 bp, Mus musculus
aggaagtgtgtcacaggggtggggtggggtctttgaggttgcaaatgctcaagccagacccactgtctctcaaacttcct

SEQ ID NO: 73978 - DNA, 108 bp, Mus musculus
ataggcctccagagaattaaataaataggcctcaagagaattaaaatgtatgtatgtatgtatgcatgtatgtattgtctgtgtctgtctgtctgtctgtctgtctgt

SEQ ID NO: 73979 - DNA, 85 bp, Mus musculus; identical to SEQ ID NO: 57470

SEQ ID NO: 73980 - DNA, 85 bp, Mus musculus; identical to SEQ ID NO: 57439

SEQ ID NO: 73981 - DNA, 107 bp, Mus musculus
cagtttaggtcatgtctgggtttgtggtcctgctgcagctggggtctgtgtcagtgtctgtgatccaagctcccccagaggccaagtaaatgtctatggtcacactg

SEQ ID NO: 73982 - DNA, 96 bp, Mus musculus
agtgttcaacagtgctgaagagattgctcagcagataagagcactgagtgctcttccagagacctgggtctgattttcagcatccacatgatggct

SEQ ID NO: 73983 - DNA, 98 bp, Mus musculus
ccaaaacctgtgtgaggctggagaaagagtactgtggttaagagcactgactgctcttccagaggtcctgaattcagtttccagcaaccacatggtgg

SEQ ID NO: 73984 - DNA, 85 bp, Mus musculus; identical to SEQ ID NO: 57439

SEQ ID NO: 73985 - DNA, 91 bp, Mus musculus
ctttctcttccttggagcattcttctctggctgctgcagcttgacaccaaaatcagttccagttgacggtaggggaatttagggaggtaag

SEQ ID NO: 73986 - DNA, 61 bp, Mus musculus
cccctgtgaaatctctttggctggcactagggttcattcccagcatgagattcctgggggg

SEQ ID NO: 73987 - DNA, 168 bp, Mus musculus
atatacatgtgtgtttgtgaatgtatatgtgtgatatatgcatgtgaacatgtgtgtatatatgtgtttatgtatgtatatatgtgtatgtgtatataagtgtgtgcatatatttgtgtatatgtacatgtgtgtatacatttgtatatatgggtgtatgtatatgtg

SEQ ID NO: 73988 - DNA, 85 bp, Mus musculus
atatggggaagaaaatctcggactttttattgtattttaaaacaaatccaagcccctaggtctgagactcatggctttcttctat

SEQ ID NO: 73989 - DNA, 83 bp, Mus musculus
ggtaggcaagtctctcctgtgagtcctgagcccttcagatgggctctcttaggacaagagaagtgataatgttcttgtttgcc

SEQ ID NO: 73990 - DNA, 87 bp, Mus musculus
tttctggttttgtgaggctcattgggtcaattaaggagatgtgatttttttcatatgacagatgaggcccaagccccaagaaagagg

SEQ ID NO: 73991 - DNA, 85 bp, Mus musculus; identical to SEQ ID NO: 57470

SEQ ID NO: 73992 - DNA, 118 bp, Mus musculus
aagtggtatatatatatatatatatatatatatatatatatatatatatatatagcaatcacttgatttatatatgtgtatacatatatgtatatatttccatatgtgtatgttctcc

SEQ ID NO: 73993 - DNA, 85 bp, Mus musculus
ctcatttgcagaagagtacagtcactggctgcctctcacactcccctgacaggcaatgttttgtctgcatttttttctgtctgag

SEQ ID NO: 73994 - DNA, 78 bp, Mus musculus
gggcatcagagactgagtacacagtggccttgggaactccaaacatggcaagggatggcttctcaggatttgaagcct

SEQ ID NO: 73995 - DNA, 70 bp, Mus musculus
gagtgacaggacacacatgagacagtgaacacatgcagacagcagtgccatccatgagtgtttcttcacc

SEQ ID NO: 73996 - DNA, 113 bp, Mus musculus
aagtttacaagtgagcatgtggttttgagaaaggggtggcttgcaaacttatgttcaaaatatttatttgttactgccataaagcacctccaagaaaacagttcatagaattt

SEQ ID NO: 73997 - DNA, 110 bp, Mus musculus
ttgaagatcagacttagtgcatggtgatctgataggatacatgggaaaatttcaatatttttgaatctgttgaggcctgttttgtgacctattatgtggtcaattttgga

SEQ ID NO: 73998 - DNA, 106 bp, Mus musculus
gccttagtccatggtgatctgataggatgcattggacaatttcaatatttttgtatagattgaggcttgttctgtgaccaattatgtggtcaattttggagaaggt

SEQ ID NO: 73999 - DNA, 99 bp, Mus musculus
tatatatatatgtacatatgtgtatatatatatgtgtgtgtgtatgtgtatatgcatatgcatatatgtgtatatatgtgtgtatgtacatgcatatgt

SEQ ID NO: 74000 - DNA, 62 bp, Mus musculus
ctctcactgtacctctctgtctcctgagcacagatttctgagggagaaaggaagagtgaggg

SEQ ID NO: 74001 - DNA, 105 bp, Mus musculus
ccccaagagtatgagtaatctattacatatgtatatatctatatatgattcaaaatactcactcatgtgtattgtatatgtacatatgtttaataccttgtgtgg

SEQ ID NO: 74002 - DNA, 88 bp, Mus musculus
tagattctctctcagagactctgtcttacttgagacaattcagtttcttttgtgaaaggacagataattctcctgagaatgagtacta

SEQ ID NO: 74003 - DNA, 101 bp, Mus musculus
gtgtgcatagagctggtgagaatttacagacagacagagacaggagagagtgtgctggatctgaatgtattttgtccaaatgaacaccagacttttaatac

SEQ ID NO: 74004 - DNA, 85 bp, Mus musculus; identical to SEQ ID NO: 57439

SEQ ID NO: 74005 - DNA, 84 bp, Mus musculus
gtagccagaggccttgcaccagactgatgattcattgcaatgatcatatgcgtgtgaagctgtttgggaaaaaatagatactgc

SEQ ID NO: 74006 - DNA, 85 bp, Mus musculus; identical to SEQ ID NO: 66812

SEQ ID NO: 74007 - DNA, 73 bp, Mus musculus
gatagtgtgtgtgtgtgtgtgtgtgtgcgtgtgtatgtatatgcatgtatgtatgtatttatgtgacattatt

SEQ ID NO: 74008 - DNA, 67 bp, Mus musculus
ggttcttcaatgaaggtgtctcacactctgtgaatggtggccaggtctagagttccttctgaagacc

SEQ ID NO: 74009 - DNA, 116 bp, Mus musculus
gattacagaagcctaaggagagctagcatgtatacatactcagatgcaggcttgattgcgctcatcaaaagtgtcaatctatagttagcattatcctcacagagcgaatgaacatc

SEQ ID NO: 74010 - DNA, 93 bp, Mus musculus
gataatggactctgaaactctgaaacctctgaaactgtaagccagccccaattaaatgtttttcttttaaagagtttctatggtcattgtgtc

SEQ ID NO: 74011 - DNA, 117 bp, Mus musculus
tgtttccatattggtgctgactaacatatgcacatccacctttattatttttgtatagacacacaattaattcagtggaaatgatgttgtgttgtacagaacttttagtgagaaaca

SEQ ID NO: 74012 - DNA, 118 bp, Mus musculus
aggttctcaggccaaaggttgtaggtcagaggaactccgtgcagagttcaggaagtgagtgtagtgagtgtggacaggggacttctgcccttgtgagtgtgggtggcctggagtccct

SEQ ID NO: 74013 - DNA, 68 bp, Mus musculus
gctggagagatggctcagaggttaagagcactgactgctcttccagaggtcttgagttcattcccagc

SEQ ID NO: 74014 - DNA, 84 bp, Mus musculus
agggtgacagatgtctgtgagttcaggatcagcctggtctacatagaaatttccgggatagctagaaccacacagtgagaccct

SEQ ID NO: 74015 - DNA, 109 bp, Mus musculus
cccagattggatgccttctgcaaatatggagggtagtggttgggtgcatactctctgccacactctctgtgttaaatattggtcttgcactttttatttcctccctggg

SEQ ID NO: 74016 - DNA, 83 bp, Mus musculus
ttacgtgtatatacatatatatatatgtgcatatatatatatatatggtatatgtatatggtatatgtatgtatatatagtgg

SEQ ID NO: 74017 - DNA, 100 bp, Mus musculus
aggtttcacagtacgggcttgcagaagagccagcagggctttctggctctctccgagtcacacgtcacaggtgctatttacagagctgccccaggggtcc

SEQ ID NO: 74018 - DNA, 117 bp, Mus musculus
tgagtgtaaagaagtgcccactggggctggagagatggctcaatagttaagagcactgactgctcttacagaggtcgtgagttcaattcccagcaaccacatggtggttcacaacca

SEQ ID NO: 74019 - DNA, 82 bp, Mus musculus
gctggctgatgtgagagtccacaagaagagggaatatgggagcctctcttcctggaatatatctcataatctcaccaccagc

SEQ ID NO: 74020 - DNA, 74 bp, Mus musculus
gaatacttgcaaagacagaatttagagtccagagtattttacagcctggatataaacgtctgctaaaagtattt

SEQ ID NO: 74021 - DNA, 59 bp, Mus musculus
ggcttggtcttcatatgagacagtgggagctggggctgtctctgactctgttgcctgcc

SEQ ID NO: 74022 - DNA, 79 bp, Mus musculus
gccagactttgataaagggggtttcttgtgatcaaacaattttaattattgttttccatctattactttgaggtttggc

SEQ ID NO: 74023 - DNA, 66 bp, Mus musculus
cattggaaggctctctcagactaacagtcactggggacatgctacgggtgaaggggccaaataatg

SEQ ID NO: 74024 - DNA, 76 bp, Mus musculus
gtgtcaaaagacttggtcacatgtcctgagttttagaaatgacttttcagaacatagtgaggacaagttggtgaac

SEQ ID NO: 74025 - DNA, 81 bp, Mus musculus
gcatcatttctgagtgaacacagactgggctgtcctctactgtatgtgtgttgggggcctcatatcagctgtgtgtggtgt

SEQ ID NO: 74026 - DNA, 88 bp, Mus musculus
ccatcgatctacctgtctgtcactgtatcagtgccatgaagtttttatcacaattgctctgtagtacagcttgaggtcagagatggtg

SEQ ID NO: 74027 - DNA, 86 bp, Mus musculus
acacacacatgcacacacatatgtgtatgtgtatatatatatatgtatatatatatatatatatatatgtgtgtgtgtgtatgtgt

SEQ ID NO: 74028 - DNA, 120 bp, Mus musculus
tcaggatcggtggaagccatcttcattctggcacttcgctgaaagtagtcttcacaggtgagagtgtgcactacagacactaacagcttctgtgtcaggctggagccacagagcttttga

SEQ ID NO: 74029 - DNA, 98 bp, Mus musculus
aggaaaactttagaggaaaatgcatttttgttatacatttaacaagcattatcccaagacacaataacaaagatagtagtgccactagaccatttcct

SEQ ID NO: 74030 - DNA, 85 bp, Mus musculus
ggctatggtggtctgataggatacatgggacaatttcaatatttttgtatctgttgaggcctgttttgtgaccaattgtatggtc

SEQ ID NO: 74031 - DNA, 96 bp, Mus musculus
tgaggcagatggaatatcattgtcattatagctgatgaggtaataaatgcatgacacttagactgtagacaatgagctcatactccaaagcgctca

SEQ ID NO: 74032 - DNA, 81 bp, Mus musculus
tggtgatgtgataggatgcatgggacaatttcaatatttttgtatatgttgaggcctgttttgtgaccaattatatggtca

SEQ ID NO: 74033 - DNA, 85 bp, Mus musculus
tatttatgctgctattgaagatcagccgtattctgtggtgatcacatagaatgcatgggaaattttcaatatttttgtatctgtg

SEQ ID NO: 74034 - DNA, 85 bp, Mus musculus
gtccatggtggtctgataggatgcacgggacaatttcaatatttttgtatctgttgaggcctgttttgtgaccaattatatggtc

SEQ ID NO: 74035 - DNA, 114 bp, Mus musculus
tttctggttgcaggtgagcaagggttggcgagaattgacagacatagacacaagagagtgtgctgaatctgaatgtattttgtccaaatgaacaccagacttgtaatacagaag

SEQ ID NO: 74036 - DNA, 97 bp, Mus musculus
ggtgttcattccccaacaaggctgacttgtctggcagaagtgggagaggacatgcctaattctgcagagactggttgcaacagagtggggtgatacc

SEQ ID NO: 74037 - DNA, 108 bp, Mus musculus
agttaaaatatagagacattcaacagagattttctgtttccagggttcttgtgaaaacagagtgtccacaaagctgtcaagatgattctctgtttcctcctcctagct

SEQ ID NO: 74038 - DNA, 100 bp, Mus musculus
gtctctgtcttattttaagactgtgtttgtacagatgttcatgattttttttttatttttcatcatgtaatgtaacatccattaaaatagtatcagtgat

SEQ ID NO: 74039 - DNA, 78 bp, Mus musculus
ctgtgtctgtctctgtcagctgcttgtcgggcctctcggagggcagtcatgctaggctcctgtgtgagcacagcatag

SEQ ID NO: 74040 - DNA, 82 bp, Mus musculus
ccactaactctttcacagacgacactgacctcagtacaatacttggctctaagtgtctaaatctgtctcagttagctgctgg

SEQ ID NO: 74041 - DNA, 75 bp, Mus musculus
cctcagatgtgtcgctccctgattggctgcagcccatcgaccgagttgtcgtcacggggaaggcagagcacacgg

SEQ ID NO: 74042 - DNA, 105 bp, Mus musculus
ccagtttcatcattttggagttccttgtatggactcccagacccacctctgcttatcttcagtctctgtctgcatcttcatgtgagtcttcaaagagaaaatagg

SEQ ID NO: 74043 - DNA, 116 bp, Mus musculus
gctggaggtggagggacttctacatcttgatctaaaggcagcatagaaatggagagaagtatttcactctgggtgtagtttgaccatttaagacctcaaagccctgcttcctctgt

SEQ ID NO: 74044 - DNA, 72 bp, Mus musculus
tatgattgtgcacatgtatgtatatatatgtgtgtatgtatgtggatatgtatctatgtgtgtataactgta

SEQ ID NO: 74045 - DNA, 84 bp, Mus musculus
tctgtgtctctctgtgtctcatttttctctgtgtgtacataagagagtgagagacagacagagaagtagacagacagacagaca

SEQ ID NO: 74046 - DNA, 79 bp, Mus musculus
tgagagagtgttgtggtcattatgttcttctcttctagtgatggaaaatgagatgagtacaaagggcttcaccctttca

SEQ ID NO: 74047 - DNA, 103 bp, Mus musculus
tcaaaaaattcttcattacatatgatctaaatacatagatattgtataaacatttatttatgtgttatgcagaaatatctcatgaatgtgaagttaatgttga

SEQ ID NO: 74048 - DNA, 87 bp, Mus musculus
acttgcaaactcctttaagatacacatgtgatgttgtagtaaattttctgctgacaccaacttcctgtgtgtgaaacaggagcaggt

SEQ ID NO: 74049 - DNA, 63 bp, Mus musculus
aagaaccatgctgtcagatgagagagagccactttttcattgggctgtggccagtggtgactt

SEQ ID NO: 74050 - DNA, 77 bp, Mus musculus
cctgttgttaggttgttaagtattctaactcatctcaatggttggtctttaacttagaaggtggcaatctactcagg

SEQ ID NO: 74051 - DNA, 76 bp, Mus musculus
ctctcacctggaacccagagcagcagcacccatagcaggattgtgtctgtctccatctctgagaactagatgagag

SEQ ID NO: 74052 - DNA, 69 bp, Mus musculus
cagacacaacagtgaagtcactgaggtcacttctcatacagatcttacctgtactccattttgtgtctg

SEQ ID NO: 74053 - DNA, 90 bp, Mus musculus
ggcactgtgtgtttgagacaagatctcactttgtagttctgactagcttcaaactcatggagatctacctgcttctgctttcactgtgct

SEQ ID NO: 74054 - DNA, 92 bp, Mus musculus
ttctctctctgtctctgtctgtctgtctgtctctcatacacacacatacgcagagagagagagaaagagagagagagagggagagagagaga

SEQ ID NO: 74055 - DNA, 83 bp, Mus musculus
agcagagattgtcgactggagagatggctcagcagttaagagctgtgactgctcttccagaggtcttgagttcaattcccagc

SEQ ID NO: 74056 - DNA, 67 bp, Mus musculus
tagtgtgtgtgtgtgtgtgtgtgtgtacatgtgtgtgtatacacaccaaaattttactcagacactg

SEQ ID NO: 74057 - DNA, 98 bp, Mus musculus
ggtgtactcctttgatatcagcacttgagaggcagaggcaggcagatctctgtgagctcaaggccagtctggtctacagagtgagttccaggacagcc

SEQ ID NO: 74058 - DNA, 119 bp, Mus musculus
cttgttgcatgtaggttctgggaatcaaactcaagacttctgacagaacagccagtgctcttaaccactgagccctctctccagccaagtgtgcaagttttaccatcctagagagcagg

SEQ ID NO: 74059 - DNA, 60 bp, Mus musculus
gtacttgtgtgcacagatacacatgtatgagagagtgcatgtacatgtgcatgtctgtgc

SEQ ID NO: 74060 - DNA, 84 bp, Mus musculus
cgtgtgcgtgtgcctgtgactgtgtatatgtgtatgtatgtgactgtgtgtgtgcatgtgcatgtgactatgtgtgtgcatgtg

SEQ ID NO: 74061 - DNA, 77 bp, Mus musculus
aagtagctgaccaacacagaacaaagtcagtggtgtatttgtggacattttgtttcttttgctttggttggcttctt

SEQ ID NO: 74062 - DNA, 92 bp, Mus musculus
gtatgtgtgtttatgtatgtacatatggatatgtagtgacatgtatataaatatatgcatacatacaagtgtacacatgtacaaacacatac

SEQ ID NO: 74063 - DNA, 108 bp, Mus musculus
gaacattggtcaggattgtagcctatcacactctgtctctctggtatatgtacaagcatggggttggcgtatggttggccttgaatcaatgtttgctagaaagtgagt

SEQ ID NO: 74064 - DNA, 59 bp, Mus musculus
gtcactcagcatctgcttctgcatcttcaaagaagactgggaagggggtgtctttggac

SEQ ID NO: 74065 - DNA, 101 bp, Mus musculus
gtttgttttattttgttttgtttttgtgtagccctggctggcctggaactcactctctgcctgcctctacctcccaagtataggatcaaaggtgtgcatgc

SEQ ID NO: 74066 - DNA, 102 bp, Mus musculus
ttttatttttctatggagagattaaaattgagttcagattttgttgaggtgaaaaaattttcaagtggcttcaagttgtttctttagtatggaaagatgaag

SEQ ID NO: 74067 - DNA, 78 bp, Mus musculus
ctgcctgcctgcctgcctgtctgtccatctgtctgctgggggatgtaacaagcgtggggtcaggaaagggaaggacag

SEQ ID NO: 74068 - DNA, 106 bp, Mus musculus
gtatgtatgtgtactattgtcccatactgtgtgtgcatgtctatgtgcattttcatgtgtgtaattgggtgcatgcatgccacagaatgtccacataatggtgcat

SEQ ID NO: 74069 - DNA, 77 bp, Mus musculus
tgggctggagagatggctcagtggttaagagcactgactgctcttccaagggatctgagttcaaatcttagcaacca

SEQ ID NO: 74070 - DNA, 76 bp, Mus musculus
tccactgttttggtgtcagtgtctgtatctgtctgtaaatataacagagtgtcagggattggtgcttgcccgtggg

SEQ ID NO: 74071 - DNA, 116 bp, Mus musculus
gtcaaatgctttatatgtagatacaaaactttactacagtgaatatatatttgtctctatataaatgagttctcactatgtagtgatatattttgtatctatatctatagaatgac

SEQ ID NO: 74072 - DNA, 80 bp, Mus musculus
ctggaagagagctggcctcccaggagtgtggacatgcctgtgagcacagtgagaccatcacttctgaaagaccctcccag

SEQ ID NO: 74073 - DNA, 59 bp, Mus musculus
cacccagtgcagatctgtgcgtgccctgtgaatgctgccacagtctgtttctgtgagtg

SEQ ID NO: 74074 - DNA, 59 bp, Mus musculus
cacacacacacacacaaatatataatataatatatataatgtgtatatatgtgtgtgtg

SEQ ID NO: 74075 - DNA, 64 bp, Mus musculus
tgggcagtctctctaaggtctgtctctctcacaagatggggcatcctagagcgggggcatccca

SEQ ID NO: 74076 - DNA, 118 bp, Mus musculus
cttggtagtcgcagatgtgagcacgcttagggagtaggtggtcggagatgaactggagacagtgcagagtgaggagaggaactactcggggagaggggaggcccacagtgtcaccagg

SEQ ID NO: 74077 - DNA, 88 bp, Mus musculus
atgtgtgtatgcacgtatgtatgaatgtatgtatgcatatgtgtatctgtatgtgtgcatgcatgtgtgtgtgtgtgtgtgtgtgtgt

SEQ ID NO: 74078 - DNA, 86 bp, Mus musculus
attggatcccatgacagacagttgtgagccaccaggtggttgctaggaatcgtggttgctcttaacctctgagccatctctccagt

SEQ ID NO: 74079 - DNA, 110 bp, Mus musculus
taactttttaaaaacagttttaatgatttatttatttttattttatatgcattggtgttttgcctctgtgtatgtctgtgaaggtatcacatcacctggaactggagtta

SEQ ID NO: 74080 - DNA, 57 bp, Mus musculus
cttctctgggtctctgagtctgatgcatattcagggttagccagagtctaagtgaag

SEQ ID NO: 74081 - DNA, 88 bp, Mus musculus
ggaaatatttcaagaggcctgagaaggacataaggtaaactgactctctctattactgtctgtcttactctttccgctttgtgtttct

SEQ ID NO: 74082 - DNA, 75 bp, Mus musculus
ccatgtatgtatgtatgtacgtatgtatgtatgtattatgtatgtatgtacatatgtatgtatatataggcatgg

SEQ ID NO: 74083 - DNA, 68 bp, Mus musculus
ccaattattcttctgtctagggcagatagtgagacattgcctgtctgtctgtctctggatggttggaa

SEQ ID NO: 74084 - DNA, 97 bp, Mus musculus
gccctgcatgctcagacatgagacccatctctgttgcaagaactcactgtgcttaggatgtggatggttcagaagggtggctgtgtagagttggggt

SEQ ID NO: 74085 - DNA, 65 bp, Mus musculus
actcagggtgccagcctgcctgtgtggcctgtagggctaaggaaatggagaggtgtctcttgagt

SEQ ID NO: 74086 - DNA, 115 bp, Mus musculus
gtaggttgatgttagatgtctccctcaatcattctccacatttttttttcttgagacagagtctctcacagaatctggagttcaattgtgaaagatcagctggcttccaagctcc

SEQ ID NO: 74087 - DNA, 80 bp, Mus musculus
cagtctctttgtctctgagaatggggacaacatgcccatgtcctatatgcccccagaagtgtcgggaatggggaggactg

SEQ ID NO: 74088 - DNA, 111 bp, Mus musculus
gccaggtcccttggctgggacagttgtgggcagagctggaaggcttgtcctgcaggccatctgtggctgtggctgcggctgtgcggagtcagggcagcacaatggtcaggc

SEQ ID NO: 74089 - DNA, 104 bp, Mus musculus
ggagttgggagtgctgacttgcaatatgttgctggaatttaagggctaaactgttcctcctgcctcagcaacaggaagtgtatttttctgttttctccctttct

SEQ ID NO: 74090 - DNA, 78 bp, Mus musculus
gctccttcagcctctctctggctctgagtcatacctaggccatagacgagacatggcagaagtgacaagagcccttga

SEQ ID NO: 74091 - DNA, 115 bp, Mus musculus
gtgtgtgtgtgcctgagggcagaggggttaggttctctggtgagttgcagacagttgtgagacacctgatgtgggtgctgggagctggacccttctatgcaagagtagcacgtgc

SEQ ID NO: 74092 - DNA, 85 bp, Mus musculus
ccttaacattaacaagtgcgggcactggagaaatgggcaagtggtaaagagtactgactgctcttccagaggacccatgttgagg

SEQ ID NO: 74093 - DNA, 78 bp, Mus musculus
tcatggattgtagcttgctttattagcttagtcgtgttttttactctttgtctgtaaggtaaagtacatctaccatga

SEQ ID NO: 74094 - DNA, 112 bp, Mus musculus
gctccaaggcatctgatgctgttctggcctctacttgcagaaacccacactcagacacacaaaatacacaggagagggagggaggagaggaagggagggaggaagggggggt

SEQ ID NO: 74095 - DNA, 116 bp, Mus musculus
ctgtgtatttgagacctggtctacagaatgggttccagaacagccagggctacacaagtttcagtctctgcctgtctgtctgtgtctcaaaaaaaattccaaggttcaattctcag

SEQ ID NO: 74096 - DNA, 117 bp, Mus musculus
gctcagtatgcactgggctctgagtcagtccccagcaggtacacacacacacacacacacacacacacacacacacacggggaggaaatagcttagtcagtacagtgcttgccttgc

SEQ ID NO: 74097 - DNA, 98 bp, Mus musculus
gtagttaaaatctttttgttgttgttttcatttttgagacagggtctcactcactgtgtagctagattggcttcaacttacagagatgcccctgcctc

SEQ ID NO: 74098 - DNA, 102 bp, Mus musculus
tcaatcttaggccatggtggtctgataggatacatgggacaatttcaatatttttgtatctgttgaggcctgttttatgaccaattatatggtcaattttgg

SEQ ID NO: 74099 - DNA, 77 bp, Mus musculus
ggaggaaatgtgtcatttggggtaggctttggggtaggtttcaaaatcttaagccacactcaatgtctctctccttc

SEQ ID NO: 74100 - DNA, 89 bp, Mus musculus
agtaggtggtaggtagataaatactgctgtaaattttgtgtatggttttctagaattcgaatgaatagatttatgtatctcacacctct

SEQ ID NO: 74101 - DNA, 74 bp, Mus musculus
gtctctctgtctgtctgtctgtgtatcacttgtggggctggtgtatgcaatgaagaactgtagtcagagtctgc

SEQ ID NO: 74102 - DNA, 81 bp, Mus musculus
gtaggtggaggtgtatcactgggaatgggcgttgaggttgcaaaagcccacaccaggcccagtgtctcactctctgcctgc

SEQ ID NO: 74103 - DNA, 109 bp, Mus musculus
cctcctggagaggaggctgagagagacataagagtttatcccaaccactgagtatcactcacagacaactggtgtgtccttcctacccctcagtcctacaagatggagg

SEQ ID NO: 74104 - DNA, 91 bp, Mus musculus
ccttggtagctgtcaggctgactcagaggctcacattctgttatgcacatgctggaaggtgaaccccatgttgcctgaaacggcctcgagg

SEQ ID NO: 74105 - DNA, 62 bp, Mus musculus
atacatgcatgcatgtgtgcatctatgtgtctacgtaaatatgtatgtatgtatgtgtgtat

SEQ ID NO: 74106 - DNA, 74 bp, Mus musculus
gtccgtccactaactggattgcactggatccttgcgagaagagtctccatacagtctctgagtcagtggaagac

SEQ ID NO: 74107 - DNA, 64 bp, Mus musculus
atatatatatatatatatatatacacatatatacatatgtgtatatatatgtatgtgtatatat

SEQ ID NO: 74108 - DNA, 106 bp, Mus musculus
ctttttttcactcctaaactttgttgtctttctgtttaacctatcgtgattgtgtgagatgatggtgtatggtgagtcaggagggagcagagagaggaagacagag

SEQ ID NO: 74109 - DNA, 85 bp, Mus musculus
gcagggaggatgtaggtagtattgctaaatacaattaattctgatttttcatggtttagtgatggggtacctaaagccagtctgt

SEQ ID NO: 74110 - DNA, 114 bp, Mus musculus
ctggggcctgtccttcctgtgatcctggttgagtcagaactcctcagagttcagctgtctctgtgattctgtgatcctgggatcctgagttgctggatgtgtcagagctcccag

SEQ ID NO: 74111 - DNA, 84 bp, Mus musculus
gcgtgtgcatgtgcatgtgcatgtgtgcgtgcgtgcatgcatgtgtgtgcctgtgtgtgtgcgtgtgcgtgtgcatgtgtgtgc

SEQ ID NO: 74112 - DNA, 111 bp, Mus musculus
taaacaatgaaacaatgcgactcaaggtctggaaactcttctcctaagcaaaattcatatgtcagcatgcttttttccagggtgtctatcttgtccgcatgttctagttta

SEQ ID NO: 74113 - DNA, 81 bp, Mus musculus
ctggcagtgaggcaaatgcgtggaaaaggcagtgctttcctatgggccctgctctggcaaactctctgcttcactgaacag

SEQ ID NO: 74114 - DNA, 108 bp, Mus musculus
gctatatggattgagtgtatgcatatgcactcacatgtgtgtgtgtactcatgtgtgagggaacacatctacacatgtgtatgtatgtgtggaggacagggtgatggt

SEQ ID NO: 74115 - DNA, 70 bp, Mus musculus
ggacttggagagcttgatcacacagtatggccattacatgtccattctctgtgtctttctctccatttct

SEQ ID NO: 74116 - DNA, 85 bp, Mus musculus; identical to SEQ ID NO: 57439

SEQ ID NO: 74117 - DNA, 73 bp, Mus musculus
ttcatgggtaggtccagagtgacaggagtaacagtccttggaactagtcactcacactctctatttctgtgaa

SEQ ID NO: 74118 - DNA, 85 bp, Mus musculus; identical to SEQ ID NO: 57439

SEQ ID NO: 74119 - DNA, 111 bp, Mus musculus
agatctggtactagcatggccacccaagggagtgggttgtagtaagacagaacaatgatagtatagtttttttctcagccctagacttgactgtgctaaaaagccacatct

SEQ ID NO: 74120 - DNA, 113 bp, Mus musculus
acaataatagtttaatagagagctgggatctctgtttgcctttcgtttgaatagttgtatctaaaggagagtcagagttcctgcaaggaatatgtcttttataagctttatgt

SEQ ID NO: 74121 - DNA, 96 bp, Mus musculus
gaccagccttagtctgtggtgatctgataggatgcgtggggttatttcaatatttttgtatctgtcgaggcttgttttgtgaccgattatatggtc

SEQ ID NO: 74122 - DNA, 87 bp, Mus musculus
tatctatatcacttgtgtgtatgtatgtgtgtgtgtatatatatatatatatgtgtgtgtgtgtatatatatatgtgtgtgtgtata

SEQ ID NO: 74123 - DNA, 58 bp, Mus musculus
tccagcaggacagaggctctaccaagctctagagcgagtgtctctgggtctgtctgga

SEQ ID NO: 74124 - DNA, 103 bp, Mus musculus
atgtaccctcaaagtgagttatgtttgaaaatgttaattatatctagcaaatttatgtttcttgtattgcagttcagacagtgtcatcagcatggagtgtcat

SEQ ID NO: 74125 - DNA, 86 bp, Mus musculus
gtgtccaaaagagacagaggagagtgtggggctcctgaaactggcgtgacagacaattttaagccattctgtggatgctgggacac

SEQ ID NO: 74126 - DNA, 105 bp, Mus musculus
actattaaggaatttaaaatactccaagtcaatgagtgacatataatttttcattgtttgatattctatttactttgagtgttctattaaattactttattatgt

SEQ ID NO: 74127 - DNA, 106 bp, Mus musculus
gttccctatatatgtatgtatgtatatgtatatatacatatatatatgtatatgtgtgtatatatatgtatgtatatatatatatatatatataatatgtctatgc

SEQ ID NO: 74128 - DNA, 83 bp, Mus musculus
tctcctgtgtgtgtgtctgtctgtcattcatccacgctttgcccacccgtatcgagagaccccgttccacgcagacacaggga

SEQ ID NO: 74129 - DNA, 96 bp, Mus musculus
cagtcctgtagagcttgagtacttactcacttactcactgggtacttactcacggtacccagtcctgtagagctagtctggggtccttgttggctg

SEQ ID NO: 74130 - DNA, 106 bp, Mus musculus
gcctttgtccatggtgatctgataggatgcatgggacaatttcaatatttttgtatctgctgaggcttgttttgtgaccaattatgtgctcaattttggagaaggt

SEQ ID NO: 74131 - DNA, 75 bp, Mus musculus
ctgtctgtctctctgtctgtctgtctgtctgtctgcctgtacaagtgtgcagatgccaccagagtggacttacag

SEQ ID NO: 74132 - DNA, 85 bp, Mus musculus; identical to SEQ ID NO: 57470

SEQ ID NO: 74133 - DNA, 109 bp, Mus musculus
ccctcttctttccaccttgtgctgtctctggttatcatgcagtcaataatcaaagttttttgtatattttccaataattttggcagtgagaatgtttcctgaaggaggg

SEQ ID NO: 74134 - DNA, 116 bp, Mus musculus
gagtcaatttgcatttttctacatgctgaccaccagttaaactagcaccatttgttaacaatgctatcttttttccactggatggttttagcacctttgtcaaagatcaagtgacc

SEQ ID NO: 74135 - DNA, 85 bp, Mus musculus; identical to SEQ ID NO: 57439

SEQ ID NO: 74136 - DNA, 116 bp, Mus musculus
ggagagaagaaatgtttctatgtttttttgaactataataaaagaggattgagaaagtgattaatatttcatttttttccatctttgaaaatatatgggtatattgagagtgctct

SEQ ID NO: 74137 - DNA, 84 bp, Mus musculus
ggccatggtggtctgataggatacatgggacaatttcaatatttttgtatctgtgaggcctgttttgtgaccaattatatggtc

SEQ ID NO: 74138 - DNA, 72 bp, Mus musculus
acatcaagtgaccataggtgtgtggattcatctctgggtcttcaattatgttccattggtctacttgtctgt

SEQ ID NO: 74139 - DNA, 130 bp, Mus musculus
tacatttacttgatatatatacatatgtatatatatatatacatatatatatatatatatatatatatatatatatatatatatatatatatatatataatatgggtgtatctgtgtgtctgtgtgtata

SEQ ID NO: 74140 - DNA, 115 bp, Mus musculus
gaaggataatgccatcactctgacatttcaacacttaaggtcagatgacatctcattttgaagtagacatcatctatcatggtggaattgaggcaggttgattaatgttgctttt

SEQ ID NO: 74141 - DNA, 101 bp, Mus musculus
ggcaaatgactcaaggagaagaattgtgggggtatatacatatgagaataaacattctctctctgtctttatggttctctatctctctttccttccacccc

SEQ ID NO: 74142 - DNA, 60 bp, Mus musculus
gtcttctgtctctgtctctgtctctataagagagacagagagacagagagacagagagac

SEQ ID NO: 74143 - DNA, 95 bp, Mus musculus
ctcactacaagaattatactgtgctgttctctggactctgaatgactctcacatattgagatttggttcataagcaagcagtgaagtttggtggg

SEQ ID NO: 74144 - DNA, 85 bp, Mus musculus; identical to SEQ ID NO: 57470

SEQ ID NO: 74145 - DNA, 116 bp, Mus musculus
cactgtttatgtctctgtgtgtgtgtatatatatatatatatatatatatatatatatatatatatatatatatatatatacatatatacacatataatgtttaataagaaaagtg

SEQ ID NO: 74146 - DNA, 77 bp, Mus musculus
attaatatatattaacaatattaatatatatacacatatatacacatatgtgtgtatgtatatgtatatattagtat

SEQ ID NO: 74147 - DNA, 89 bp, Mus musculus
gtacaattcagaattaaaagagttcagagtttcttgttgggtactcttccaaacccagatatttgggtttttttgtccattagtagtac

SEQ ID NO: 74148 - DNA, 104 bp, Mus musculus
gtgtttgtgtgtgtgtgcgtgtgtgtgcatgtgcgcatggcatttatgtgtgcatacatgtgtatatgtatatgtgtctgtcctatgtactcacactacattac

SEQ ID NO: 74149 - DNA, 95 bp, Mus musculus
ttctctaaatatgcatatttctcattaaacaacatatatgtgtatatatttgtctttgtaggtatatattcatgtgagggtatgaacctggagaa

SEQ ID NO: 74150 - DNA, 88 bp, Mus musculus
gttagcacaatagatagagagcacagaccctcatcttgtttttgaatttatggaaatgctttgggtttctctgttaggtgatgttggc

SEQ ID NO: 74151 - DNA, 85 bp, Mus musculus
agaatgtgtacttactgagcatttaatgtgtttatatttgctattggtgtttaaacactaaatgagaggaagttaaatacattct

SEQ ID NO: 74152 - DNA, 117 bp, Mus musculus
gaacaagctctaccagagacaactatctatatctatatctatatctatatctatatctatatctatatctatatatctaacaagatgatcatgtggtttttgtctttgagtttgttt

SEQ ID NO: 74153 - DNA, 84 bp, Mus musculus
gtatgtttaatggatatagaaaaagcatatgtattgtatacatatgtgcataagcatatgcttgtgatatatacacatatatac

SEQ ID NO: 74154 - DNA, 68 bp, Mus musculus
tagcagatctccgtgctgccttctaactcggtggtcttcagagaggcagagaagctgctgatctgttg

SEQ ID NO: 74155 - DNA, 100 bp, Mus musculus
ttactgtcatgagaaagagaacttcataaatgtttttatatgattcacaggagtctggaatatgatggagatgtaactttctcatttttttcatgtgtaa

SEQ ID NO: 74156 - DNA, 85 bp, Mus musculus; identical to SEQ ID NO: 57439

SEQ ID NO: 74157 - DNA, 80 bp, Mus musculus
gactaacggattgcttatgacatgcacccagaagagagagttgaactctactgatgaagttgtcacgggctcttgaagtt

SEQ ID NO: 74158 - DNA, 59 bp, Mus musculus
tgtggaacagagggaaatatgttgaccagaggtggatctttccctctgtgtctgacaca

SEQ ID NO: 74159 - DNA, 85 bp, Mus musculus
ggccatggtggtctgataggatacatgggacaatttcaatatttttgtatctattgaggcctgttgtgtgaccaattatatggtc

SEQ ID NO: 74160 - DNA, 85 bp, Mus musculus
ggccatggtggtctgataggatacatgggacaatttcaatatttttgtatctgttgaggcctgttgtgtgaccaattatatggtc

SEQ ID NO: 74161 - DNA, 111 bp, Mus musculus
gtcttccagagctggtctgagatggatctctagtgcaggtgtgagaaatcagacaggtcatactgctttcccatgaagtccatccttcagtaccgaatggttactgatgat

SEQ ID NO: 74162 - DNA, 123 bp, Mus musculus
atctatatgtgtatagtgtagaagtatatatatatatgaatatgcatatgtgtatgtatatatgtgtgtatatatgtggatatatgtatatatgtgtatatgtgtaggtgtgtatgtatatat

SEQ ID NO: 74163 - DNA, 81 bp, Mus musculus
atacatatgtacatgtataaggttgtatgcattaaaaaatagaatcatgttttatatatacatatatgtgtacatatatat

SEQ ID NO: 74164 - DNA, 85 bp, Mus musculus
gtccatggtggtctgataggattcactggataatttcaatatttttgtatctgttgaggtctgttttgtgaccaattatatggtc

SEQ ID NO: 74165 - DNA, 85 bp, Mus musculus; identical to SEQ ID NO: 57439

SEQ ID NO: 74166 - DNA, 104 bp, Mus musculus
gtatgtttaatccttggtaatatatacatatatatatatatgtatatatatatatatatatatatatatatatatatactcttgaaaaatatttttaaatatat

SEQ ID NO: 74167 - DNA, 79 bp, Mus musculus
cttctgcaacattgaagagctgcctatgagaggcaccctagtgcatcaaggtagagtggaaagatcaatgggcaagaag

SEQ ID NO: 74168 - DNA, 93 bp, Mus musculus
ttatagtcagagccagaactgagttcttagagaaaaatagtgattatttttctaaattaagattaaatggtgagttttgcctaagacatatgg

SEQ ID NO: 74169 - DNA, 101 bp, Mus musculus
gatttactagttgggttgagttgaaaacttttattttataaatgctatggctcagttcctggaggtagaataattttctctcacagtcactttagttaatc

SEQ ID NO: 74170 - DNA, 85 bp, Mus musculus; identical to SEQ ID NO: 57439

SEQ ID NO: 74171 - DNA, 112 bp, Mus musculus
agtaaggttatatatatatatatatatatgcatatatatgagtgtatgtataatttatatacatatatgtatatgtatacatatacatattctttacttatatagaattgct

SEQ ID NO: 74172 - DNA, 96 bp, Mus musculus
tatataagtaaagaatatgtatatgtatacatatacatatatgtatataaattatacatacactcatatatatgcatatatatatatatatatata

SEQ ID NO: 74173 - DNA, 110 bp, Mus musculus
gcttctggagagagagagagagagagagagagagagagagagagagagagagtaagttttctttgcaaatgtagctcttcccaaaggtttatggctctatacccaaaagt

SEQ ID NO: 74174 - DNA, 112 bp, Mus musculus
gcagataattactgttgatatgtttcccctgctctattttttcctatgtgaatgtatttataacaacaaaaaatgcaggctgaaactgtaagtcacttggtagtgtgttcgc

SEQ ID NO: 74175 - DNA, 70 bp, Mus musculus
gagaagagcaatgagagaagtgagtgcggaggctcaagacagctgcactggctttttgcatctcattttc

SEQ ID NO: 74176 - DNA, 74 bp, Mus musculus
cgtggtagccttgcccgggctcagacaagcagcccagcggctgccctgcctgcctgcctgcctgcgttaccatg

SEQ ID NO: 74177 - DNA, 70 bp, Mus musculus
tatggacaggtgattagacagatgacagcggccagacacggagctgaaagtggtgatcacaagaaccata

SEQ ID NO: 74178 - DNA, 110 bp, Mus musculus
ttggttaatccactgggtcctgatcctgagtgctgacttggttagttaaaagatacaatttgtttcatttttataactatagatacatttttatggtcctttgtgtccaa

SEQ ID NO: 74179 - DNA, 59 bp, Mus musculus
cacacacacacacacacacacacacacacagagtgtgtgtgtttctgtgtgtgtgtatg

SEQ ID NO: 74180 - DNA, 84 bp, Mus musculus
cagagtgtgttcttgagtaagagtgacagacatactcccagagagaactctttctctgtttctctcactcaggaaaagaagctg

SEQ ID NO: 74181 - DNA, 60 bp, Mus musculus
ggtatgtatatgcatatgtgtatgtatgtatgtatgtatgtatgtatgtatgtatgtatt

SEQ ID NO: 74182 - DNA, 78 bp, Mus musculus
caaaacacaggtatgtatcacttcccaaatgaccacagtcacattcaggtttggaatgaaccatatctgtatgttttg

SEQ ID NO: 74183 - DNA, 78 bp, Mus musculus
catctcattttcactctctctgaaactggtcagccaggagaagaggagagctagggttggtgggggtggaggagtatg

SEQ ID NO: 74184 - DNA, 61 bp, Mus musculus
tctcactcccactctcagggtatctgtcttcccgggtcaaaccctgatggtttagtgatga

SEQ ID NO: 74185 - DNA, 116 bp, Mus musculus
catttcaaaggagcgtttgtccaggaaataaatgtgaatgcatttgatatgtattagtgtatattcctcttatagcatacatttacattggagtttttttttatcccacaggaatg

SEQ ID NO: 74186 - DNA, 119 bp, Mus musculus
accacagcatggaaagtgtggtgagcagggaagccccctctatctgaaaagctggcaagagaaaactgtctgaagagagagaggaggttttgtttaagggtgtggccgctggagggttg

SEQ ID NO: 74187 - DNA, 85 bp, Mus musculus; identical to SEQ ID NO: 57439

SEQ ID NO: 74188 - DNA, 67 bp, Mus musculus
tatatatgtgtgtgcatatatatgtatatatactacaatatgtgtatatgtacaatatatatgtaca

SEQ ID NO: 74189 - DNA, 96 bp, Mus musculus
gtcttgttgatgtgtatattctatatgtatatgaatgtacatatatataaactcacatacatacatacacacatacataagacaaatatacacatc

SEQ ID NO: 74190 - DNA, 77 bp, Mus musculus
gttaatgtatgtatggtcacacatgtttgcatgtatgtggatatttgtatacatgtatgtggaagacagaaattgac

SEQ ID NO: 74191 - DNA, 85 bp, Mus musculus; identical to SEQ ID NO: 57439

SEQ ID NO: 74192 - DNA, 159 bp, Mus musculus
agctgatttctgagggtttcttgtgaggtagtatgtatgtatgtatgtatgtatgtatgtatgtatgtatgtatgtatttatgtgttctggggattgaagtcagagcttcatgcttgatggtggaagctgagacattttgctgacctatatgctatgaa

SEQ ID NO: 74193 - DNA, 63 bp, Mus musculus
ggaatgtcagagttctctgatgttttgcctggcaccagattcactgagagactctctgcttcc

SEQ ID NO: 74194 - DNA, 88 bp, Mus musculus
tacatatatacatgtatgtatgtatgtatgtgtgtgtatatatatatatcttgacatgtatgcatatatatgcatttgtgtatgtgta

SEQ ID NO: 74195 - DNA, 115 bp, Mus musculus
tggtatgaaatcttaaaagggggctggagagatggcttagtggttaagagcactgactgctcttccagaggtactaagttcaattcccaccaaccacatgatagatcaacaacca

SEQ ID NO: 74196 - DNA, 85 bp, Mus musculus; identical to SEQ ID NO: 57470

SEQ ID NO: 74197 - DNA, 104 bp, Mus musculus
agatagacctaaatgttcctaccccccacaaacttaaatacttaaaaattatttcagtatatattaagctcttgtatagtgggactgctattaggttcttttct

SEQ ID NO: 74198 - DNA, 80 bp, Mus musculus
ccatgattttgagagaacacaaaagagagaatatctgtatttgttcttcacattatctatgtgggctttgaagatcagag

SEQ ID NO: 74199 - DNA, 116 bp, Mus musculus
aggaaggaaaaaccagtcatggttgggaatatggtgaagagagaacatgttgagcagaccagtctcttctgtctcctttgactaattctgcagccaacactaattctccccttctt

SEQ ID NO: 74200 - DNA, 85 bp, Mus musculus; identical to SEQ ID NO: 57470

SEQ ID NO: 74201 - DNA, 85 bp, Mus musculus; identical to SEQ ID NO: 57439

SEQ ID NO: 74202 - DNA, 89 bp, Mus musculus
ccagataataaatgggttctttacttggcttttaaaacagccttgggaaggctgtttctctcacagtcagtaatgttctattaagatgg

SEQ ID NO: 74203 - DNA, 126 bp, Mus musculus
gggagctctggggggggggtgtctacttggttgatattgttgttctggcttgttggttaagagcactgactgctcttccagaggtcctgagttcaattcccagcaaccacatggtggctcacaacc

SEQ ID NO: 74204 - DNA, 85 bp, Mus musculus; identical to SEQ ID NO: 57439

SEQ ID NO: 74205 - DNA, 85 bp, Mus musculus
ggccatggtggtctgataggacacatgggacaatttcaatatttttgtatctattgaggcctgttttgtgaccaattatatggtc

SEQ ID NO: 74206 - DNA, 128 bp, Mus musculus
gtctgatgcttgagttgtaaaattacactcagattccacacgaactctcctgtgtgtgtgtctgtctgtcgctcatccacgttttgcccacccacatcgagagaccccgttccacgcagacacaggga

SEQ ID NO: 74207 - DNA, 88 bp, Mus musculus
agggaaaatcctgccatattgtgaaatctcagtctgtacaaaggaccttcctatgtgtctcactgacagtgacaggacaaatttcctt

SEQ ID NO: 74208 - DNA, 120 bp, Mus musculus
ccatgtaagtatgtggctgcatttctgagctgataacactgtaaggaaatttgtcctgtcactgtcagtgagacacataggaaggtcctttgtacagactgagatttcacaatatggcag

SEQ ID NO: 74209 - DNA, 155 bp, Mus musculus
gcatgcacaaattcatatatatatatgtactaacacacatatgtatatgtgtatgtatatgtatgtatgtatacacacatatgtatatgtatatatgtgtgtgtatatatatatatatatatatatatatatatatacatatatatatatattca

SEQ ID NO: 74210 - DNA, 105 bp, Mus musculus
atgtacaaactatgtaatatataacatataatatgtataatatatatgtgtgtatatatacatatatatattgcattgtataagcatatattcatgtttgaacat

SEQ ID NO: 74211 - DNA, 85 bp, Mus musculus; identical to SEQ ID NO: 57470

SEQ ID NO: 74212 - DNA, 73 bp, Mus musculus
atatatatatgcatgcacaccaaatatataaataaatacatatatgtatgtttgtatgtatgtatgtatgtat

SEQ ID NO: 74213 - DNA, 72 bp, Mus musculus
atgtgtttatgtatatgtttctatatatgtgtatatgttcatatatacatctatatgggtatacaagcatat

SEQ ID NO: 74214 - DNA, 70 bp, Mus musculus
tgtgtgtcagtctgtctgtctgtctatatgtctgtgtagggcatgtatatgatatataaattgtcatata

SEQ ID NO: 74215 - DNA, 114 bp, Mus musculus
aatgaactatgtttatgtatataatttcagatgttttatatgtgtgtatatgaatattaaatatatatgtgtgtaatgtggtatatttgaagcttatattaacatgtctttatt

SEQ ID NO: 74216 - DNA, 104 bp, Mus musculus
gtcaattccatttattagttatgcatcaacagtggtaaggaaaatagaacattgtaatcaatttttattctaccattttgagcatcaagaatagtgtgtgtgtc

SEQ ID NO: 74217 - DNA, 85 bp, Mus musculus; identical to SEQ ID NO: 57439

SEQ ID NO: 74218 - DNA, 79 bp, Mus musculus
acttctgttagtttcactgtgtctctgtttagtttctgtttccaggatctgtccattgatgaaagtggagtgttgaagt

SEQ ID NO: 74219 - DNA, 91 bp, Mus musculus
tctctatgtgggcttgaggattggagttcaggtccttgtgttctcatgaaaatcacacaacacagtgaccaatctacccaaccccaagaga

SEQ ID NO: 74220 - DNA, 84 bp, Mus musculus
gtctttgactgtggatgtgatgtgaattcctatgactgtcctgcagtgatggactgtaacctggaatcatattctatagaagat

SEQ ID NO: 74221 - DNA, 107 bp, Mus musculus
taatcatgggtgaatctcaatgtgtatgtgtgcatgtgcatgtgcgtgcgtgtgtgtgtgtgtgtgtgtgtgtgtgtgtgtgtgtttgtgtgaggttgctatggttg

SEQ ID NO: 74222 - DNA, 88 bp, Mus musculus
acaagggcaacaggttctgttttaaaagaatagtttcaaagggttctctaactctctctgtgtgggatgtctgtgcctgtgttcttgt

SEQ ID NO: 74223 - DNA, 86 bp, Mus musculus
ctgagtttgaactccaaacctacattaaaggcagacacagtggtgaggaactgtagtctcaactttggaaagatggaggtctgcag

SEQ ID NO: 74224 - DNA, 108 bp, Mus musculus
tggatcgaatccctaactggaaaggctaattaatccataacttagtttgaaagtattggattaaacctagctcatgatttctttctttttaaaaaagattcatgtcca

SEQ ID NO: 74225 - DNA, 101 bp, Mus musculus
agtcaagccttttgttgctgtgacagatgcttaagagaaattatttaaaggctgaaagatgtgtgtgatctcagagcctcagttacagcagggtgtgtact

SEQ ID NO: 74226 - DNA, 102 bp, Mus musculus
tatatgaatgtatgtttgtatgcatgtatataagtatattgcatgtatgcatgtatgtatatatgtatgcatatatgtatataaatctattattttatatat

SEQ ID NO: 74227 - DNA, 81 bp, Mus musculus
acacacacactcacactcacacacacactgtctcgcacacgcgcacaccctctctctctgtgtgtgtctgtgtgtgtgtgt

SEQ ID NO: 74228 - DNA, 108 bp, Mus musculus
ctctgtatattttgtaataaatttatgcatgcttatatgaaaatgcagctagtaagattttttagaactatgtattttatatgaatgcatatacatatgtatacaagg

SEQ ID NO: 74229 - DNA, 89 bp, Mus musculus
atagaggagcttaatatttttatcattgtaaaacagtttgtgatggtgacaaatacaagttgttgcatagtgaatgttttctgttctat

SEQ ID NO: 74230 - DNA, 77 bp, Mus musculus
tgtctatgtatgtatgtatctgtgtgcatttaaatatatataacatataattacacagacacgtgcaaacatttaca

SEQ ID NO: 74231 - DNA, 86 bp, Mus musculus
ctaatatcataaggatgtatgtatgtatgtatgtatgtatgtatgtatgtatgtatgtatgtatgtataaatagatggataaatag

SEQ ID NO: 74232 - DNA, 92 bp, Mus musculus
cagtgaagaaatggacttgccagccaaagtacaggtaagcatatcctgcttatttaactgtctgtctgtctgtctgtctgtctgtctgtctt

SEQ ID NO: 74233 - DNA, 78 bp, Mus musculus
tgtgtacatatgtatgtatatgtgtatgtgtacatgtgtgtatatgtgtacatgcatgtgtatgtgcatgtgtatgta

SEQ ID NO: 74234 - DNA, 79 bp, Mus musculus
catgaatatgtgcatacttgtgtatgtttatatgtttatatcttttatgtgcatatatacatctatgtaagtatacatg

SEQ ID NO: 74235 - DNA, 131 bp, Mus musculus
tacacatttatgtttgtgtgcatagataggtatatttatatatgtctctatatatgtatatttcaatgtatatataaatgtgtgtttattcatatgtacatatgtatttaaatgtatattaatgtttacta

SEQ ID NO: 74236 - DNA, 174 bp, Mus musculus
atgtttgtgtacgtatgcatatttatgtttgtgtacatgcatatatttatgtttatgtaagtgtgtatatacttgtgtgtataaatgtgtatttgtttacatgtatatatttatggtttgtacatgtatctttgtgtatgtaaatgtgtatatgtttgtgtgcataatttatat

SEQ ID NO: 74237 - DNA, 116 bp, Mus musculus
gtgtttctcctctgctcttatcagtgtgaggtgtgtacatatgtatgggtgcttgtgggtgagcaagggcacgtgtatgccatgtgcaatagcaatttaaggccaggggataacat

SEQ ID NO: 74238 - DNA, 74 bp, Mus musculus
atagggctcccaatggaggagctagagaaagtagccaaggagctactttttttttgtttagtgcagagttctat

SEQ ID NO: 74239 - DNA, 65 bp, Mus musculus
catttcctaccatgcactgtgagtgagagataatgagtttcttgttctctttgcatctaggagtg

SEQ ID NO: 74240 - DNA, 66 bp, Mus musculus
tatttatacatatatacatatatacatatatatgtatgtaagtatgtatgtatgtatgtgtatata

SEQ ID NO: 74241 - DNA, 108 bp, Mus musculus
aggtattcctttaagatatttctgacaaaagccttgcaatctatttttcattatagattcctagttgagaagacaatagaggcacagaaagcagtcacaaacatacct

SEQ ID NO: 74242 - DNA, 72 bp, Mus musculus
tggcttgtgttcacagtggctttgaaggactgtttatcactccacctccagtgcctcactgtgtctcagcta

SEQ ID NO: 74243 - DNA, 68 bp, Mus musculus
gtgcatgcttatgtgtgcctttatgtgtctatgccaagatatgtcattgtatgtatgtatgtatgtat

SEQ ID NO: 74244 - DNA, 108 bp, Mus musculus
gaggtgagttcttctgaaaggggtgaatagtaaactttttgttgttatgtttaatcttgcttttcaaaacaaggtctcactatgtacccaaggctagaactttacctc

SEQ ID NO: 74245 - DNA, 77 bp, Mus musculus
tgttacacactcactgactagttaggagcctactctttatcagattggtgcctgtagttctgcagtgattgtgttca

SEQ ID NO: 74246 - DNA, 70 bp, Mus musculus
ccttccccattgcagtccccaggctcagtcggatggttgactgtgagtatctgcatctgtattggtcagg

SEQ ID NO: 74247 - DNA, 95 bp, Mus musculus
agattcttgttcattatgcttcttggttagagatgattacagatttcttctatgaaagaatttattttctaattatgcatatgtgtgcatagtct

SEQ ID NO: 74248 - DNA, 105 bp, Mus musculus
catacatacatacatatatacatatatataatatattttatatatacaatacatataataatatgttatttatattgtgtgtatgtatatgtgtgtgcgtgtgtg

SEQ ID NO: 74249 - DNA, 85 bp, Mus musculus
gtccatggtggtctgataggttgcatgggacaatttcaatatttttgtatctgttgaggcctgttttgtgaccaattatatggtc

SEQ ID NO: 74250 - DNA, 105 bp, Mus musculus
tttctgagagagagagagagagagaggcatatacctgtgtatgtatgcatgtatgtatgtatatatgtattatgtgtatgcacatactcacatagagcctagaga

SEQ ID NO: 74251 - DNA, 115 bp, Mus musculus
ggcacaactttcagaggttaggctagagagacccctgactggcccattctggtccacccttccctctgtctcacactctcaaatctgcagctttctccaatatctgaagttggct

SEQ ID NO: 74252 - DNA, 85 bp, Mus musculus; identical to SEQ ID NO: 57439

SEQ ID NO: 74253 - DNA, 106 bp, Mus musculus
aagaaaggcatcatatggttcctgtttctttattttcatgtcttcagagacaacagattctgtcagacactcttttacctcaagaagcatgactcatccttttctt

SEQ ID NO: 74254 - DNA, 85 bp, Mus musculus; identical to SEQ ID NO: 57439

SEQ ID NO: 74255 - DNA, 95 bp, Mus musculus
gggcttgagtgaagcccactcttctgtgtgtctctgaaggagtttccagagagcattaactgagtggattttaacagctccattctctcaggctc

SEQ ID NO: 74256 - DNA, 73 bp, Mus musculus
ggtcgggcaggtcagtgggcacgtgtcatcccagcacttgggaagaaggtgctcactgtcagtcagtctagcc

SEQ ID NO: 74257 - DNA, 62 bp, Mus musculus
tgtttgtttgtttgttgaactagccaaggaatcccttgcttagtgaacacagcgagctctca

SEQ ID NO: 74258 - DNA, 117 bp, Mus musculus
ttgggtgggtctttcagtggggagaaggggaaaggcaaatggctgagaacagagtgaagaggcacaaggtagtctgagtgcatgcctgggactctagcaagggggattgtgacctgg

SEQ ID NO: 74259 - DNA, 85 bp, Mus musculus
ggccatggtggtctgataggatacatgggacaatttcaatatttttgtatctgttgaggcctgttttgtgacctattatgtggtc

SEQ ID NO: 74260 - DNA, 69 bp, Mus musculus
gaaggggggatggtagtgtggggactggagagagttttacaactctctctctctcttaatcaacttttt

SEQ ID NO: 74261 - DNA, 112 bp, Mus musculus
gtccagctgatggaagcaggtcactggaggtgggccattgcgtctctgacactctctctgttctcagatatgagcagcctctaccacatgctcctgctgccatggtctgagc

SEQ ID NO: 74262 - DNA, 85 bp, Mus musculus; identical to SEQ ID NO: 57470

SEQ ID NO: 74263 - DNA, 125 bp, Mus musculus
gaaggcatggtgggagcaagaggcagctggtcacatcccacccacagtcagaaaaaagagagtagacagtgagtgagctgggctgtaacaggcctgcctccagtgacccagttctatcaatgctc

SEQ ID NO: 74264 - DNA, 121 bp, Mus musculus
aatttcttccctttttatgtgtgtagctgttttgcctgtgtgtctgtctgtctgtctgtgtgccacatgtgtgcagtgcctgtggaagctaaaagattccctagggctggagttacagaca

SEQ ID NO: 74265 - DNA, 74 bp, Mus musculus
ggagaagatgtgtttctgagggtggtgggttttaaggtttcaaaagcccaggctctctgtctctatctgtctct

SEQ ID NO: 74266 - DNA, 86 bp, Mus musculus
gtatatggatgactgtgtatgattacttttgtatgtatataattatgtgtatatatgagagtttgtacatgtgtttgactgtatat

SEQ ID NO: 74267 - DNA, 88 bp, Mus musculus
cacacgtgatatatatatatatatgtctacatatagatatatatacctatatctatatatatatctgtgtgtgtatgtgtgtgtgtgt

SEQ ID NO: 74268 - DNA, 81 bp, Mus musculus
tcattttgaccacctggggagagggcacagtaggcaggcctgtcaactctgtgtgtcactgtacagtgtgtgtgggaatgg

SEQ ID NO: 74269 - DNA, 87 bp, Mus musculus
ctgtttttgatggaattttgactggctggatcttgttcatagcttgtgcaggcaaccatagctgttatgagttcacgtgagtaacag

SEQ ID NO: 74270 - DNA, 117 bp, Mus musculus
tgggaacagaatttgttgaggatgagagagttctgagaatagagagtagagtgtttgcacaactttatgaacttaactagaaccactatatcatttgtttaaaatagttaaatctca

SEQ ID NO: 74271 - DNA, 83 bp, Mus musculus
tgattatgactaaagtcactttgtagttgtgaggaccttaacataaagagccacataaatgctaaaggatcttgtcctggtta

SEQ ID NO: 74272 - DNA, 71 bp, Mus musculus
ttatgcaatgagcccttggcttccccttattccacaggtacactgtggaacagtctgtggctcactcatag

SEQ ID NO: 74273 - DNA, 75 bp, Mus musculus
agtgatttgcctgtatgtatgtatgtatgtatgtgcaccagccacatatatatagtgtatacgtggcagatccct

SEQ ID NO: 74274 - DNA, 77 bp, Mus musculus
ccaggagaagggagacccagacacccactttatttatttaattttgagacagggtccctctgtgtgtccctggctgg

SEQ ID NO: 74275 - DNA, 119 bp, Mus musculus
ccgtcaatccagcatgtgcctgtgtgcctggcctcagcccatcattctgttctctgtcactgacagccttagctgtgaggatggtgttgggaaccacgggcccacactcctgatggcac

SEQ ID NO: 74276 - DNA, 121 bp, Mus musculus
ggggcaggtgaaatgaggaacgggccacggcatgtaccatttggggatgcgtgtgtgtctgcacctgcatgtgcgcgtatgtgtcttgaagattgggacttgtggagtagacatcttcctc

SEQ ID NO: 74277 - DNA, 114 bp, Mus musculus
ggctttctgtgtggctgacatcggttcaccagtactgaactagtccacaatacaactgtatatgtagttttctcttctccctgctggggccaccatcagtccagtcagagaaac

SEQ ID NO: 74278 - DNA, 71 bp, Mus musculus
tgcctgcatttatgtctgtgtagtgtatatgtgtgtatgcagacagtgtccacagaggccagaacagggca

SEQ ID NO: 74279 - DNA, 76 bp, Mus musculus
acatagagttcagtgaggacagagagtattgagacagcatctcatgtaacacacgctggcctcaaactccccatgt

SEQ ID NO: 74280 - DNA, 71 bp, Mus musculus
gaagaggtgcgtcactgggtgtgggctttgaggtttcaaaagaccatgccagacccagtctcactctcttt

SEQ ID NO: 74281 - DNA, 124 bp, Mus musculus
cactgtagtacaagggccagccagggccttgggctgagctaaagcactctctggctctctggctctctgtttcagtggacttcttcctcactgtcttttaactggtgaggtggaagcaggagca

SEQ ID NO: 74282 - DNA, 77 bp, Mus musculus
tgagtgacaggtggttgtgcgacaccatgtgggtgcacctctcaaacccagattctctgcaagaccaagtgttctca

SEQ ID NO: 74283 - DNA, 77 bp, Mus musculus
gtgagaagaacaaatagaagtcttctcactggggctcgagagacggctcagtggctaagagtatttgttgttcttat

SEQ ID NO: 74284 - DNA, 91 bp, Mus musculus
tttgtttcagctgtctgtctgtctgtctgtcctcagaggaagccaagccaggacctcaaggcatgaacttggaggcaggaacaggagcaga

SEQ ID NO: 74285 - DNA, 84 bp, Mus musculus
cagccaggatgtgtccagtctgagcacacaggctatgagctggttgggctgtgaacgggtggagaaacagaaagtccttggctg

SEQ ID NO: 74286 - DNA, 60 bp, Mus musculus
ctgggcctgtctctctctgaatctcctgtgggacatgggggagagagtgtataggctttg

SEQ ID NO: 74287 - DNA, 70 bp, Mus musculus
ctgggggcagtgcacaaggggaatggtcttccagatctggctgggaggcactagccctcgcttccttgag

SEQ ID NO: 74288 - DNA, 77 bp, Mus musculus
cagacagacagacagagagatgtgcctgggagccagcaagatgactcagtgggtaaaggctcttgtcaggaatactg

SEQ ID NO: 74289 - DNA, 77 bp, Mus musculus
gcagcgcttgagaagtattcaccttactgtgctgtcaaaagtggtcagaagtgagggaggagaggccaggagtttgc

SEQ ID NO: 74290 - DNA, 73 bp, Mus musculus
ggagagaaagaaaggaagtcaacaggaaaggcttctccatcctaaagccttggaactctctctctctctctct

SEQ ID NO: 74291 - DNA, 106 bp, Mus musculus
acgtgatgacatacccaaatatatatatatatgtgtgtgtgtatgtatatacatatatatatatatatatgtacatatatatatgtgtgtgtgcgtgtgtgcatgt

SEQ ID NO: 74292 - DNA, 80 bp, Mus musculus
tcagcacgggctcaagcacagccgcggcgcagagccccgaaacagcgctcgctcgctcgctcgctcggacctgaagggcc

SEQ ID NO: 74293 - DNA, 71 bp, Mus musculus
gcactgtgactgccatagaagaggcagtattgatattgtccacactgtctctctgtgtggggtgcatatgc

SEQ ID NO: 74294 - DNA, 62 bp, Mus musculus
gagtggtggtgagtctctgtgactgaatttgccaagtgcagtctctgactcacctgttactc

SEQ ID NO: 74295 - DNA, 91 bp, Mus musculus
cacttataattagtcagtgtgcctgcctgcctgcctgctgcctcctccacaggcaggaagtcttctctcgttttgctgttgtctcaaagtg

SEQ ID NO: 74296 - DNA, 120 bp, Mus musculus
gcccggaaccctgggactcagctctgccaggctcagtcctccagctgcagccgtcgctggagacagtctcagtctgtcagctccagctgctgctcagggatccctggccctgcggactcc

SEQ ID NO: 74297 - DNA, 93 bp, Mus musculus
ctcctgtatgtcaaccccctctctgtctgtctccacctctctagatccctttcttgcacaatgacctgacagagcagaggaactcaacagtag

SEQ ID NO: 74298 - DNA, 120 bp, Mus musculus
tgtctgtatatatatttgtatacatatatgtatgtatatatgtatatataagtatatatatacacatacatatgtgtatgtgtgtatatatatgtgtgtatatatatatatgtgtatata

SEQ ID NO: 74299 - DNA, 65 bp, Mus musculus
tgccatggatggggtggcccaggtacagaggggatacttctcccagtccctcactgcctctggca

SEQ ID NO: 74300 - DNA, 92 bp, Mus musculus
ggagctttgcttcttgtagacacatagtcactctcccactatgtctctggtggccaagcatagggctttgtggtctgggtagatcttgctcc

SEQ ID NO: 74301 - DNA, 64 bp, Mus musculus
gtctgcctgcctccctctgtgtgtcaccgtggagaaaagaacacaagagccagggtagaaaggc

SEQ ID NO: 74302 - DNA, 118 bp, Mus musculus
gggaggtatgctggctgaaagtgtgagattcaaaccacctcctccctgtctctctcggcctcacagccaccctgatgaacaagagttcttttatctgggcctgctcctcagtgagtcc

SEQ ID NO: 74303 - DNA, 115 bp, Mus musculus
ggggttgcacaggcttctgggaggtgaccttgaggagagagagtgcctggctgccagactgggtggtcggaacttagccagagttctatcttcaccaccgctcacagtgaacttc

SEQ ID NO: 74304 - DNA, 110 bp, Mus musculus
gagtagaacaagctttgctaagttttagggcagacagaaaagacagtgcactagaagactgttgcatccagctgtctatggaagctgtctgtccagggccagctgctgcc

SEQ ID NO: 74305 - DNA, 87 bp, Mus musculus
agtctaagtcctctaattaattctttacatgtatgtatttatcagagcagaatgcacatgcatgtagaggtcagagcacaaatgact

SEQ ID NO: 74306 - DNA, 94 bp, Mus musculus
cagcttgttgggtgttcctgttgtgtgtacatcgctgagtgtgctcactcaaactgagtcactgtgatagcgcagggtggccactcttgtgctg

SEQ ID NO: 74307 - DNA, 78 bp, Mus musculus
gtctctgtgtctctgtctgcctgccccccacccccatccccctgtatacccaacaggtaagtcagagacaggctaggc

SEQ ID NO: 74308 - DNA, 69 bp, Mus musculus
ctctgtctgtctgtctgtctgtctgcctgcctgagagagagagagagagagagagagagagagagagag

SEQ ID NO: 74309 - DNA, 102 bp, Mus musculus
catgggaggtgtctgcggtgtgtgcttgagttgtgtgtgtgtgtgcaggagagatcagacagaaagcgtataagacacatccaatctccgttgacttccctg

SEQ ID NO: 74310 - DNA, 117 bp, Mus musculus
gccaggacctgtgtgtgggtgtgggagtcctgtgccagggaggcactcccccggggaagtctctctctctctgctaaggacatcccattgccctcttccaaccacagagtcaggttc

SEQ ID NO: 74311 - DNA, 74 bp, Mus musculus
tgtatgtatatatgtatgcatgcatgtatgtatatatgtatgaatgtatgtatgcatgcatgtatgtatgaata

SEQ ID NO: 74312 - DNA, 68 bp, Mus musculus
atatgtatgtgcattaaagaggtgtatatgtgctaaggctctgtgtatctctgtgtgtgtgtgcatgt

SEQ ID NO: 74313 - DNA, 93 bp, Mus musculus
gtatgtctatgtatatgcatgtgtggcattttttatgcttgtatatgttttatttgcgtgtgtaagtatatatttgtgtatacatgattttgc

SEQ ID NO: 74314 - DNA, 97 bp, Mus musculus
cactctagttctttcctgggtaaggctgtctccgtgtctccgtgttttcactggtacgaaacacagagcatatttattctaggataaaactggggcg

SEQ ID NO: 74315 - DNA, 90 bp, Mus musculus
gagatgaagaaagagcccacactctgactctggcagttgaaggaacagagcaaggagggtgaggacgtgtctgggcttcacaaatcatcc

SEQ ID NO: 74316 - DNA, 91 bp, Mus musculus
gctggagaaggcggggtagcctggcatccacgatgtgaatgagccagcgttctctctcacactgggactgccagggactgcagctgtgggc

SEQ ID NO: 74317 - DNA, 68 bp, Mus musculus
gagcttggaacccccttgacttggctgggctagctgaccagtgtccctgcctctctggttctggggtt

SEQ ID NO: 74318 - DNA, 83 bp, Mus musculus
gctcagagctctgcagctcaaagatctccaagtccttttccttcgtggagaaggaaagaggctgagagaacagacactgcagc

SEQ ID NO: 74319 - DNA, 57 bp, Mus musculus
tgtgggagtgggagcccagaaggcaaagtgccctctgtctctcagccactcaccaca

SEQ ID NO: 74320 - DNA, 106 bp, Mus musculus
caccacggtagatgcaggaagacaggtgagagtgaggagataggggccagacagtcggtctctgtgcctcctattaaccgcgtaggattgagcatcgttgtgagtg

SEQ ID NO: 74321 - DNA, 106 bp, Mus musculus
ggccagagcctgaggtggtttcagtacactctccctccctctgtctggttgactaattttgccagccaccagccccaggtgagagaccacagcattgccctttgcc

SEQ ID NO: 74322 - DNA, 70 bp, Mus musculus
gggtggaatcatttctttgctctgtctgagatgaatatttgttcatgtcaccccaagaaaagttccactc

SEQ ID NO: 74323 - DNA, 81 bp, Mus musculus
tactctcagtctgtttctgtcactgggccgtttctcctgcccatctggctgtcttcggccctggacaccactagcttagta

SEQ ID NO: 74324 - DNA, 75 bp, Mus musculus
tgcaggacatttggtttgattgatgttataatttcctgcagcagcactgaaatgagtgtccagacatggcctgta

SEQ ID NO: 74325 - DNA, 105 bp, Mus musculus
accttctatcgttcatggcctcccaccttaatcaatctcttatgtgaggtgctttggtgctttcttaagaagaatgttatttagaagccaagatctgcacagggt

SEQ ID NO: 74326 - DNA, 88 bp, Mus musculus
tagtgtcactgaacactgtcaccacagctgcacctgggaagtgactaacttcactcagtgagtcagcagatctggcattcaggaactg

SEQ ID NO: 74327 - DNA, 77 bp, Mus musculus
agcagcaggtcagatgtgcatcttacagaaaccgtgcagaaagcagtgtgagagaatggagtgaccagaatggtgct

SEQ ID NO: 74328 - DNA, 96 bp, Mus musculus
cctggtgattgaggatcaagatataaacagtcagacactggcccagcaccatgcctgcctgcctgcctgccatatttttagccatcatgttcatgg

SEQ ID NO: 74329 - DNA, 89 bp, Mus musculus
tcacactagagaagcaactctagatagttcttgccagcctttattttgcctgtctgtctgtctgcctgtatctgtgtctctgtgtgtga

SEQ ID NO: 74330 - DNA, 85 bp, Mus musculus
aactccttttatccatagaaatcatgccccaggctagtagtacaaactgctgtttctgagttattatttctatataaaagctgtt

SEQ ID NO: 74331 - DNA, 72 bp, Mus musculus
gtgaccttggaggctggctggctcaccttccagtttcctagggagagtcagtcactgcctctgcctgatcat

SEQ ID NO: 74332 - DNA, 116 bp, Mus musculus
tctgttgtctgtggtgtttgaatggtaggggtcttcattgtgctgtggttgtagggtgcgttctgtgactgtcagcttagctcctcctatccttactgattggttgatttttcagg

SEQ ID NO: 74333 - DNA, 56 bp, Mus musculus
atgactatgtatgtgtatatgtgtatatatatacacatatacatatgtatatgcat

SEQ ID NO: 74334 - DNA, 105 bp, Mus musculus
cccttgtttgattcccagaagccacatagaaagtcactatctgcatctccaggtccaggggatctgactccctattcttggcttctgtaagcaccagacacacgg

SEQ ID NO: 74335 - DNA, 77 bp, Mus musculus
gttttgtattagggctggagagatggcttagtggttaagagcacagactgttcttcctaaggtcctgagttcaaagc

SEQ ID NO: 74336 - DNA, 82 bp, Mus musculus
gatataaggcctgaagagatggctcagcggttaagagcactgactgctcttccagaggtcctgagttcaattcccagcaacc

SEQ ID NO: 74337 - DNA, 105 bp, Mus musculus
cctcccacctgctgcttgtctgctgggcactggtaagtaagaggcagagacacacactctgcccctccgtcaccatctgtggcagacaagaaagctggtcacagg

SEQ ID NO: 74338 - DNA, 117 bp, Mus musculus
gtttggttttggttttggtttttggtctggttttggttttttgagacagagtctctctgtgtaacatccctggctatcttggaactcactttgtagaccaggctggcatcgaataca

SEQ ID NO: 74339 - DNA, 70 bp, Mus musculus
gagacagaatctctcactgagacctcatgctaggctttctagctagtgagccccagagatcacctgtctt

SEQ ID NO: 74340 - DNA, 113 bp, Mus musculus
ccttggaccagcaaggggccccccaaagcatctctcctattggtgaggggtatcagtccagagaagagacttagctgaggcggggactcacactcctcctgctagcaccaagg

SEQ ID NO: 74341 - DNA, 115 bp, Mus musculus
cctggatctaggcctcttgctccccactcaatcaaagagtaggagagtcagaacactgggggcagggagcagggtgtgaggtcagtgatgagtgaccctttcctgaggcccaagg

SEQ ID NO: 74342 - DNA, 134 bp, Mus musculus
ttaagctcatggtttgtctgctggctggcacctgtaatcctgggacttgggaggcagaggaagaaggatcacaagtttgaggccagcctgtgctacatagttccaggctagcctgagttacatgcaaggaggca

SEQ ID NO: 74343 - DNA, 117 bp, Mus musculus
cttgtagaagagtgtgaaaggttacaatggatgaaagaagatctgagctgatccttaggcagacagaactttgtgaggtccacattggcctgcctggtctacaagcagttccaggcc

SEQ ID NO: 74344 - DNA, 76 bp, Mus musculus
gcctttgtgatccattgttttatgagttattgcttgtagcttgtaaactcatctggcatcggggattaacctgggc

SEQ ID NO: 74345 - DNA, 87 bp, Mus musculus
agctgagaacctgagggattagtctggttttcatttttgagacagggtctcacactatgactcagaactcacagagattctcctgct

SEQ ID NO: 74346 - DNA, 74 bp, Mus musculus
atatatgtatgtatgtatgtatgtatgtatatatatgtatgtatatacttgcatgcatgcatgtatgcatgtat

SEQ ID NO: 74347 - DNA, 118 bp, Mus musculus
tcagatatttgatgattctcctgcttcagcttcactgagctttgaacagcagtgatattgatgttctgtttagatcaaagctagagatatagggtgctcatattctaaagtagcatgg

SEQ ID NO: 74348 - DNA, 86 bp, Mus musculus
ccttctgctttggtcttgttattttgagacagtgcctcatgtagcctaaaatggcctcagtctctgactcactatatagctgaggg

SEQ ID NO: 74349 - DNA, 80 bp, Mus musculus
tgtatgcatattgtatgtatgtgtgtgtttatgtctgtgcccatgtatatggatgtgtctgtattgcctgtgtgtatgca

SEQ ID NO: 74350 - DNA, 83 bp, Mus musculus
atgtttgtatgcatgtgtgtgtacaggtgtatatatgcttatatatttgtatatatacattgagactagaggctcacagacat

SEQ ID NO: 74351 - DNA, 117 bp, Mus musculus
ggaactgataagaagcagggcatcttgtaggtcaaggctagcccccaggagcaaggagactgaggagagagggtggacactggtggagctgcagatgtccggtgatggatggggtct

SEQ ID NO: 74352 - DNA, 83 bp, Mus musculus
gcacctgtgtgtgcatatgtgtgcctatgtgtgatgcctgtaggtacctgtgtgtgcctgtgtgtgtctgtgtgtgtgtgtgc

SEQ ID NO: 74353 - DNA, 74 bp, Mus musculus
ggaaaggtggatggcacttgaagatgcctgaggttgacctctggccccatgtctgtctgtctgtctgtctctct

SEQ ID NO: 74354 - DNA, 117 bp, Mus musculus
tacatatatgtgtatgtacattgtgtatatgcatgtgtgtatgtgcatgtatgtgtgtatatgtatatgtatgtatatgcttgtgtgttatatgtatgtgcatgtagtatgtgtgta

SEQ ID NO: 74355 - DNA, 66 bp, Mus musculus
ggagcccgtccacatcacgtgttggggacagacagcagtctgtctgtcagtgtgagtaatggttcc

SEQ ID NO: 74356 - DNA, 67 bp, Mus musculus
gagacagagcattgggtatggaggaaaggaacatggctccccttctccacttctgtctctctgtctc

SEQ ID NO: 74357 - DNA, 98 bp, Mus musculus
gaggagggctgcttcaagaggactgtgagaccagacagggtcacataacgagatctggtctcaatgactgtccccccccccccaagtaaaaccgcctc

SEQ ID NO: 74358 - DNA, 63 bp, Mus musculus
atttgggctggagagatggctcagcagttaagaatgctgactgctcttccagaggtcctgagt

SEQ ID NO: 74359 - DNA, 81 bp, Mus musculus
aaaagaaatctcactatggaagctatggtacatctcacggtgtcgtggaagctgtgctatgtcacacagtgtcaccctttt

SEQ ID NO: 74360 - DNA, 132 bp, Mus musculus
gtagtggtgatgcatgcctttaatcccactgctcaagaggctaaggcaggcagatctctgtgagctcaaggccagcctggtctacagagggagttccaggacagccaagactacacagagaaaccctgtctt

SEQ ID NO: 74361 - DNA, 104 bp, Mus musculus
gaaagttcacaggggggctggagaaatggctcggaggttaagagcactgactgctcttccagaagtcctgagttcaattcccagcaaccatctgtgataccatc

SEQ ID NO: 74362 - DNA, 83 bp, Mus musculus
tctctctgtatctctgtgtgtatgtggtgtgtaaatctgtgtgtccatgtatgtggtgtgtgtgtaagagagagacagagaga

SEQ ID NO: 74363 - DNA, 72 bp, Mus musculus
ttgggacaagaagaatacagtgagcacagtgagtacaaattcaacctgtgctacagtgagagtctagctcaa

SEQ ID NO: 74364 - DNA, 103 bp, Mus musculus
tagacacacagggaaagaagtaaaggaaatcttaaaaacagctgtgtatttttaaatttagtctgtgtgtgtctgtatgtgtctctgtgtctctgtgtgtgta

SEQ ID NO: 74365 - DNA, 97 bp, Mus musculus
ggtttcctccacagattgaggcaaacagtgagcacagagcagtctctctctctgaggcctcagctttgccagagacctcagatcctgccagctgtgt

SEQ ID NO: 74366 - DNA, 116 bp, Mus musculus
tcaatgtccccagtgtccccaatgtcccgtttcccctcatgtttgcttatgacattatttttgtttattagctgttggggcaaatcagcttgtggttgggtgacttattgacaggg

SEQ ID NO: 74367 - DNA, 103 bp, Mus musculus
gttttctgtgtgcctttctgaattagcagtactccctcagtctcactgcttctggtttgctatggacttagacgctgttagagttgtgtgctacaaaggagac

SEQ ID NO: 74368 - DNA, 81 bp, Mus musculus
ttgtagtttctttggaaggttcttgattcagtagagattcagggtgtctctgactctggctgtaagttccaagagtggcag

SEQ ID NO: 74369 - DNA, 106 bp, Mus musculus
tgccatgtaaggaatcagaactgtggggttggagatggctcagcacttgggagcactgactgctcttccagaggactgggattcgattcccagcaaccacatggcg

SEQ ID NO: 74370 - DNA, 81 bp, Mus musculus
gcactaactcacacactctatgtagcctaggttaacctttagctcatagctttgactgtgcctcccgagtgctgcagtgtg

SEQ ID NO: 74371 - DNA, 85 bp, Mus musculus
gggtatgcatagaaaacaataggggtctctgtctgcctgtccgttggtcagtcggtctgtctctgtatctctcccctgtaccccc

SEQ ID NO: 74372 - DNA, 110 bp, Mus musculus
gcacagggtgatgttggtgtgttgagacactgaaactgggagacgatcagctcagtgctgtctggtcactcactgtcagctcagtcactaccccggggtcctgttggagc

SEQ ID NO: 74373 - DNA, 82 bp, Mus musculus
tggttagcaagactgagctgtataatccaaaactgctccaacaggaccccggggtagtgactgagctgacagtgagtgacca

SEQ ID NO: 74374 - DNA, 89 bp, Mus musculus
ctgaatggctgggagaaaaagtagacatatatgtgtatgtatgtatgtatgtatgtatgtatgtatgagttcactgtagctgtcttcag

SEQ ID NO: 74375 - DNA, 127 bp, Mus musculus
tctgggtgttgtgggactggctgtggagtttgaacccaaggtctgctcaggtcactggctcagatcagaaggaacccgtgccactggttgggtggggatcctgggtgcctgggtcttgctggtccca

SEQ ID NO: 74376 - DNA, 74 bp, Mus musculus
tcaggattcctcacaaagccctcactctgacactgacatcttcagaccagtcagagaaggctgtgtctggctgg

SEQ ID NO: 74377 - DNA, 67 bp, Mus musculus
caggctctaggaagctctgtgtctcacggttctctctgtctgcctgagtcactgcttcttagttctg

SEQ ID NO: 74378 - DNA, 164 bp, Mus musculus
ctctcagcagtgaagcccctctgtgagttgacctaggtactcctaggtattctgtgacagcactgagaagagagtggggacaaacaggcaggtctccaagtacagactaatgttttttttttaatggctctggaatgtggctgaacctcccatcaaagcatctt

SEQ ID NO: 74379 - DNA, 107 bp, Mus musculus
agagggtaggctcctcagaataaatgtaacatgtagatctctgtgtcttagtcacattgacctttacaaatgtcatgtttctttacttcacaaatggctatctctct

SEQ ID NO: 74380 - DNA, 68 bp, Mus musculus
gcaaaaccacgtgtgcctgcgtgcgtgcgtgcatgcgcgcgtgcgtgcgtgcgtgcgtgcgtgcgtgc

SEQ ID NO: 74381 - DNA, 100 bp, Mus musculus
tgcagtctgtttttggctaactgctcttactgaagtgtgttagcagaggatatggttttctgtgattacaagctcatcctgagaaagtcttaggactgca

SEQ ID NO: 74382 - DNA, 82 bp, Mus musculus
gggcagtgggatgcaagttcagttcaaaacaaagagatttaaacagaaatctctctgtcactgagtctttccagtcctcact

SEQ ID NO: 74383 - DNA, 78 bp, Mus musculus
gtcactgtgcgcatgccggtccctgtcacactccctctatctcctctcacggggcatgcggtgtctgatagcagtgat

SEQ ID NO: 74384 - DNA, 114 bp, Mus musculus
atttcctggggctggaacgaagatcctttgtgctttcccaatgactttcacacacaatgactcaaactattggttaaactgagcacagaacagcatcagcgtcccctaagaagt

SEQ ID NO: 74385 - DNA, 77 bp, Mus musculus
gtgtgtgtctatgtctgtgtgtgtgtcagtgtctatatatggcatgatacataatgatagctatcaataagccacat

SEQ ID NO: 74386 - DNA, 98 bp, Mus musculus
aggatcccaaatcttattctgcgactcataggggttcgtctctgtgtctctgtgagagacgaaagcctggagattgaagtatgaatccatcaggtcct

SEQ ID NO: 74387 - DNA, 119 bp, Mus musculus
agccagggattcctgatgcctgtgtctctggtctcgtgtgaggtaaggtctcatttttatttttaaatgctgcttcaagtagggaattctgagtgtcaggtcagtcagcacaaactgct

SEQ ID NO: 74388 - DNA, 82 bp, Mus musculus
gtccaggaatttcctttgcagaccaggctgacctggagatccacctgcctgtctccctgtgtgctagaaagaaattatggac

SEQ ID NO: 74389 - DNA, 115 bp, Mus musculus
tatgaatgcatccagagttcagagcttttaagggtgttttgttctctctcagtcactcttgttttttgaggcagagtcttactctataaccaatcttggctaggatcttaccgtg

SEQ ID NO: 74390 - DNA, 114 bp, Mus musculus
catgaaaataatgagcagctcgagaagggagttagtattggcttattcagaagtctgtgtccagaggaaagtctagtttccaaactacaactgcacattagtcacacagtcatg

SEQ ID NO: 74391 - DNA, 82 bp, Mus musculus
gcccttaactgaacagagcagagctcagcatgacccagccaagaggctggagcgttcctgtctgtggctctgtgcctgtggc

SEQ ID NO: 74392 - DNA, 77 bp, Mus musculus
gggtgggctttgctttcaaaagcccaggccagacccatgtgtctctgtcagcctgtggatcagcatgtagctcactc

SEQ ID NO: 74393 - DNA, 76 bp, Mus musculus
ggaaaggcagggctttagtctgtgtgtctgtctgtgttccatgaacccagtagtttaaacagcagcagtgtattcc

SEQ ID NO: 74394 - DNA, 90 bp, Mus musculus
gttaagaattgttgctgaggggctggagagatggctcagtggttaagagcactgactgctcttccagaggtcctgagttcaaatcccagc

SEQ ID NO: 74395 - DNA, 83 bp, Mus musculus
tcgcgtgcaaacagtaagtagttttgttttctgggccatatagtctggtttgcaactacactactgttactgttgtactgtga

SEQ ID NO: 74396 - DNA, 60 bp, Mus musculus
gtgcacgcgtgtgcacacacacacacaagtatttatgtgtgtctgtctgtctgtgtgtac

SEQ ID NO: 74397 - DNA, 77 bp, Mus musculus
cctgcagaaggagctcccaggtgtggggaggtgtagtcagtacctctcactctcagacttcctccggcctctgcggg

SEQ ID NO: 74398 - DNA, 76 bp, Mus musculus
ttgggtctctgtgactctgtgcctccttctcacaaagccctggagatgacaacgagggtcctctcagatcacccaa

SEQ ID NO: 74399 - DNA, 84 bp, Mus musculus
agctggacaatatttcattatgtaaatgaaccatgttttctgtatccattcttagatagacatggatctggattgtttccagct

SEQ ID NO: 74400 - DNA, 88 bp, Mus musculus
ggtatcagtatggatatagttagtatacatggaagggtacatttgtatctttatcctgtctagggggctatgtccagtggggaggacc

SEQ ID NO: 74401 - DNA, 72 bp, Mus musculus
ggctagagtcaccactttggtagtggtcagccacagaggtggatggttgaattcatagtggtgtgggaagtc

SEQ ID NO: 74402 - DNA, 79 bp, Mus musculus
tatctctctgtgtgtcacctaacagtcataattaagattttttctttttttttacaaaggtggtgcatagcagttgatg

SEQ ID NO: 74403 - DNA, 59 bp, Mus musculus
gcacccagaccattctctcagagatacactctatctctgtcagcatgtgtctctggtgc

SEQ ID NO: 74404 - DNA, 114 bp, Mus musculus
tcagaatgtgacattgaagactctggcaaagctagcgtctcagagacaaagcatttctagctgtttctgactttgagaagttggctttaggtgggatctcgatgatgatcctga

SEQ ID NO: 74405 - DNA, 85 bp, Mus musculus; identical to SEQ ID NO: 57439

SEQ ID NO: 74406 - DNA, 59 bp, Mus musculus
tctcctgaggctgaggtagaaggatcatgaggtcaagatctagtggggctgcagagaga

SEQ ID NO: 74407 - DNA, 82 bp, Mus musculus
cactggggcatgggggacggggggggggggggggggggacgacgggttgcccagcctcactctgagtctctctggtttggtg

SEQ ID NO: 74408 - DNA, 86 bp, Mus musculus
gcgtatatatgtgtgtgtatgcatgcatgtatgtatgtgcgtatgtatgtgcataggcatgtatgtatgtaggcatgtatgtatgt

SEQ ID NO: 74409 - DNA, 72 bp, Mus musculus
caaagggcagcattagtggcttggatgctgggcagcggagtccatgtctgtctctgccactgacttcctttg

SEQ ID NO: 74410 - DNA, 88 bp, Mus musculus
caggagagtcctttgccctcattgtctgtctgtctgtccatccacatgcctctgttatacaatggggatgatgctaaggaagctgctg

SEQ ID NO: 74411 - DNA, 95 bp, Mus musculus
gtttattttggaaagagcaaaattagtagtctttttgatgaacttcatcactcattaatctgctacaggtactgtttttttttttttaaataaac

SEQ ID NO: 74412 - DNA, 68 bp, Mus musculus
ctgagcagaagacaccctgtctgaggagcttccacttagagcatgtcactctcggtgtctctgctcag

SEQ ID NO: 74413 - DNA, 134 bp, Mus musculus
tgtgtatagatgaatatatatatgtgtgtatataagttatgtatacaggtatatgtgtataggtgtatatatatatatatatatatatatatatgcttatgtgtataggtatatgtatagaggtatatgtgtat

SEQ ID NO: 74414 - DNA, 90 bp, Mus musculus
cacgcagccttccttgactctctttctctgagcaaagtgttaatgggcttggcactgcttagtgttggagatcagatgagatctggtgtg

SEQ ID NO: 74415 - DNA, 62 bp, Mus musculus
gaggtgtttctgaagttttgtcagctcgttctctctggctgtgtgagcctctctaagccctc

SEQ ID NO: 74416 - DNA, 66 bp, Mus musculus
gtcaggcacttggaggacttgggtagtgcaccttttaatgtaaactactaagttcttggcttggcc

SEQ ID NO: 74417 - DNA, 85 bp, Mus musculus; identical to SEQ ID NO: 57439

SEQ ID NO: 74418 - DNA, 87 bp, Mus musculus
gttactctttgggaatgatctctgggtgcctttcctgccctcttcatgcagcactttctcccagtctctctccatcagtgttgtgac

SEQ ID NO: 74419 - DNA, 56 bp, Mus musculus
tgtatgtgtgactgtgtctgtgtgtatctttgcatgcaggtgcacttgcagctaca

SEQ ID NO: 74420 - DNA, 85 bp, Mus musculus; identical to SEQ ID NO: 57439

SEQ ID NO: 74421 - DNA, 85 bp, Mus musculus; identical to SEQ ID NO: 57439

SEQ ID NO: 74422 - DNA, 85 bp, Mus musculus; identical to SEQ ID NO: 57470

SEQ ID NO: 74423 - DNA, 106 bp, Mus musculus
gccttagtgcatggtgatctgataggatgcattggacaatttcaatatttttgtatatgttgaggcttgttttgtgaccaattatgtggtcaattttggagaaggt

SEQ ID NO: 74424 - DNA, 70 bp, Mus musculus
gtcaggaatctagagaagtatcaaacatcgtttatggaaacagggtgtgtatactcctatagagcctgtc

SEQ ID NO: 74425 - DNA, 70 bp, Mus musculus
gtcaggaatctagagaagtatcaaacatcatttatggaaacagggtgtgtatactcttatagagcctgtc

SEQ ID NO: 74426 - DNA, 107 bp, Mus musculus
agatgaaattgaaatataagttttaaaatccagattttctagtaaagaaatctgttttttttttaagaagtctggtaaatgaggcatgtggtattttggttgtttct

SEQ ID NO: 74427 - DNA, 85 bp, Mus musculus; identical to SEQ ID NO: 57470

SEQ ID NO: 74428 - DNA, 105 bp, Mus musculus
gccttagtgcatggtgatctgataggatacatgggacaatttcaatatttttgaatctttgaggcctgttttgtgacctattatatggtcaattttggagaaggt

SEQ ID NO: 74429 - DNA, 79 bp, Mus musculus
acttctgttagtttcactgtgtctctgtttagtttctgtttccaggatctgtccattgatgagagtgaggtgctgaagt

SEQ ID NO: 74430 - DNA, 105 bp, Mus musculus
ggcatctgtggcatcaaccccgctggtcctgctattcccttcagaagactgtcagctgtcagttccaaagctcacttcagatgacctggtgatgtcaaagctgcc

SEQ ID NO: 74431 - DNA, 117 bp, Mus musculus
tccatgactcctagggcacaatgtgccttccagtttctgagagactgacacactgcctcaggaagtgcagtattcaggcctctctgcttcaatgtatgttccctcagaagtcaagga

SEQ ID NO: 74432 - DNA, 75 bp, Mus musculus
ttctgagggaacatacattgaagcagagaggcctgaatactgcacttcctgaggcagtgtgtcagtctctcagaa

SEQ ID NO: 74433 - DNA, 74 bp, Mus musculus
gtttgtgcagtatttgtgtagtcctgattagccagctccacctggcagtctcagtctttctgtgcagcatgaat

SEQ ID NO: 74434 - DNA, 61 bp, Mus musculus
gcagtaccttcagacttacagactctctctaccttgggtagctgtgagccatgaatattgc

SEQ ID NO: 74435 - DNA, 102 bp, Mus musculus
gaaattttcatgagggactggagagatggttcagcggttaagagcactgactgctcttccaaaggtcctgagttcaaatctccagcaaccacatggtggttc

SEQ ID NO: 74436 - DNA, 117 bp, Mus musculus
ccccacactcttcagggatgcccctaaatcgcgtgtgccaggcagtgggagccaaactcagtcagtgcctcacagataagattcctgggaaggtgagagctccctgggagacggagg

SEQ ID NO: 74437 - DNA, 113 bp, Mus musculus
gcagccactcggtcgggtgctgtggcggtgttgtggacctcatgtcagtggtcagaagtgaatgaggacacctttattcacaagattcctgcagcctccaatcttccgggcgc

SEQ ID NO: 74438 - DNA, 112 bp, Mus musculus
cggccccacccacctttgcagtctgattcctccctgtcccccagtggcagaactgtccctctgtgcctgcctctgactggcttcgggatgagccaggggccaaggaaggctg

SEQ ID NO: 74439 - DNA, 108 bp, Mus musculus
gagtgacccttagccatgtcccacacacccgaggcagtctgtgggtctgtcacttcaaataggactgccaggcccaaggacctacatgcagcttggatggctgtcacc

SEQ ID NO: 74440 - DNA, 78 bp, Mus musculus
gtgtatgtgcacatgtgcattcatgtgcatgtgtgtgtgtgctcacatgtgtgtgtgtatgcacatgtgcatgtgtgc

SEQ ID NO: 74441 - DNA, 79 bp, Mus musculus
atctttttctctggctctctcactgtggggcaccatgcaagcctctgcagacccctctggagggatgctctggacagat

SEQ ID NO: 74442 - DNA, 114 bp, Mus musculus
gtgtataggaatagcaaagccaatgtaggacagatggactaagcaggacacagttgtcagtgacctgtgggttctggctgtagcttgcacagtggtgagttggctcctatatgt

SEQ ID NO: 74443 - DNA, 95 bp, Mus musculus
ttatgtctctagtgcatctgtctaattcacacattctctgcctctccaaggcagggaccttgtatgttgcccttttgcattgcatgatgaggtga

SEQ ID NO: 74444 - DNA, 106 bp, Mus musculus
ggatcattatatctatatgcatatgtatacgtctgtatccttgtgtatgtatgtatacatatatttatctatgtatctatgtatctatcgatgtatctgtgtatct

SEQ ID NO: 74445 - DNA, 63 bp, Mus musculus
ggttccgttgggctctgggtctaggatgtaggcaggatgagacttgagaggctgcacagggcc

SEQ ID NO: 74446 - DNA, 80 bp, Mus musculus
tgagcgtatgggatcatgaggtgtctatccagcgtgttgtaggccctgggataatggttcctctgtgtgtctgtgcctca

SEQ ID NO: 74447 - DNA, 81 bp, Mus musculus
tggctacacagcacctgaggggctgacacaggaagatgctgcaagttgcctcagtccctgtcagcctcactgatgttgcca

SEQ ID NO: 74448 - DNA, 64 bp, Mus musculus
atgtacatattatatatgtgtgtgtatatacattatagtgcacaatatatgtatatatgtacat

SEQ ID NO: 74449 - DNA, 103 bp, Mus musculus
ttgaggcagggtgctaggcacttctaccactcaatctgctccaaagtatatgatcccagagtgaccacagacagtgctttgcatcaagttcatcctgcagcag

SEQ ID NO: 74450 - DNA, 66 bp, Mus musculus
ctgtctgtctcagtgactgtgagctggatgaattgaatcccatatatacactgtggggacaggtgg

SEQ ID NO: 74451 - DNA, 109 bp, Mus musculus
ggctgtcgaggagggaaatggacacagacccactcagactcaaaactgttaagtcctgcgtgtaagtcatgtgttctttgtaactgtgtctgtctgtatctgagtgggt

SEQ ID NO: 74452 - DNA, 71 bp, Mus musculus
tagtgaggagtggtccagggtccctgtgtggccaccagctgttggttggctctctgtgtctctctgtgcta

SEQ ID NO: 74453 - DNA, 74 bp, Mus musculus
tgaaaaagtcaggggctggaaagatggtgcagtggttaagagtactgactgctcttccagaggtcctgagttca

SEQ ID NO: 74454 - DNA, 114 bp, Mus musculus
gtgtggatgtcagagggcaactttggcagttggttctctctttccaccttgtgggttctggggattgaactctgggtaggagccttggcgatgagcagccctgctggtctgtgc

SEQ ID NO: 74455 - DNA, 63 bp, Mus musculus
accacgcatgtgtgagggcccacatcacctgtctgtgtgtgtgtctctctctctctgcctggt

SEQ ID NO: 74456 - DNA, 90 bp, Mus musculus
ggctttgttggaggaagtgtgtcactagggatgggctattaggtttcaatactgaagccaggcccactgtcactctctcttcctgctgcc

SEQ ID NO: 74457 - DNA, 118 bp, Mus musculus
caggaaagtgcagcagtccttaggctgcaaccacaaagggaagtggcaaacacaatagctgactgtgcctctctctctctgcttgtgcaccaagatcaggactcacactaatgcttgc

SEQ ID NO: 74458 - DNA, 105 bp, Mus musculus
gactcacccctggcgcctgactggtgtgagaagagtgtctgtagagacctgggcaaggagtctgtgggagacacaccacacccgttaagccacttagggagagtc

SEQ ID NO: 74459 - DNA, 81 bp, Mus musculus
gcatgcagctgtttccctctgtgcctgcctccttgtctgcaaattagggtctgaaatgagggtgtaacagtggaagcctgc

SEQ ID NO: 74460 - DNA, 68 bp, Mus musculus
tttctcagtctcactgcctggtagccacgcaggacactctgtgtgtctgtggcgatgaggccgaggaa

SEQ ID NO: 74461 - DNA, 70 bp, Mus musculus
ctgttgggtttctagtgcctgcttggggcaaggctccctgtctctctgggtctcaggtccccatctgcag

SEQ ID NO: 74462 - DNA, 97 bp, Mus musculus
cttggcttgtgtggtatcctgagtccctctctgtgtggcatctcctttgccaaggccagctagggaaataagaaaaaaacaattattcacagcctag

SEQ ID NO: 74463 - DNA, 100 bp, Mus musculus
ggaaagcccaggggctggagggtgggtgacgagctgcctggcaccctgaatctcacatcgggccaagcgagcttattcagtttttgtctttttcattttt

SEQ ID NO: 74464 - DNA, 91 bp, Mus musculus
cagctcctgcttctcctggatatgtgacctcaggcaagggacgcaccctctctgagcctcagttctgtatctggaagatgtaggaagtctg

SEQ ID NO: 74465 - DNA, 90 bp, Mus musculus
agccagagccgcatggtcactctctgagtctctgagctgtttggctccagagtgtggatgccggggaggctggtcagctgggcttttgct

SEQ ID NO: 74466 - DNA, 85 bp, Mus musculus; identical to SEQ ID NO: 57439

SEQ ID NO: 74467 - DNA, 80 bp, Mus musculus
ccaaggtggctgtgcagagatagaaagagggcagcaattatagcctctgggcagctctctgtgtctcagagctactgagg

SEQ ID NO: 74468 - DNA, 69 bp, Mus musculus
ggaataaacagagaggagaaagactggggcattcattcatatgtgttagtctgtcactcagtgatgtcc

SEQ ID NO: 74469 - DNA, 87 bp, Mus musculus
tagtggtagtctttttctagtagtcttggtctcagtttctcacagcaagcagagacagactccctagagacccaggggctaccactg

SEQ ID NO: 74470 - DNA, 71 bp, Mus musculus
ggaaagagcgagcctccacgttagaattaccacctgagagactgatgtgagagggcacagcctactgttcc

SEQ ID NO: 74471 - DNA, 86 bp, Mus musculus
gtcacacatgctctctgagcctctcatttatactcctgctctagggtcaggtagtcagagataaacaggtgctcagtttgtgtcat

SEQ ID NO: 74472 - DNA, 69 bp, Mus musculus
aggattcgtgtgagcgtctctctctgggagtgtcctgtacatctcaagaggcaaagtctccactttcct

SEQ ID NO: 74473 - DNA, 81 bp, Mus musculus
ggatctcgccttcagagctggagagatggctcagcagtccagagtgctcactgctctaccagagaatccaaggtcagttcc

SEQ ID NO: 74474 - DNA, 85 bp, Mus musculus
tatttacttgaaatatgacattaagtatattctgaaagtagtatccatactaattataggatttctttttatatttctgtgaata

SEQ ID NO: 74475 - DNA, 70 bp, Mus musculus
ttgtgagtgtctgtcccactgtgtctggcatccctagtgaagtcatcccagagagcaggacaggctccga

SEQ ID NO: 74476 - DNA, 99 bp, Mus musculus
tcctacattgggtatgagtgccagcaagccacacagacccactgatacagagggccgctcttatctgtctgaggcaagctggcctcttactggtcagga

SEQ ID NO: 74477 - DNA, 63 bp, Mus musculus
gacagtgactctgggatctggagtcttaattgtttagatctcagtcactcagtggcacttgtc

SEQ ID NO: 74478 - DNA, 84 bp, Mus musculus
ggtgtctctgtgtgtgcctctgtgtgttttaacccctgaccaccttcttcacaccctttggatctgcagacatctgagttcacc

SEQ ID NO: 74479 - DNA, 96 bp, Mus musculus
gaccaacaaatgttgggatgagtgggactccagaaaaaagcaaagggtctctttctttctctctctgtctcactctgtctctttcttgtctctgtc

SEQ ID NO: 74480 - DNA, 100 bp, Mus musculus
tctgatgcttaggaagctaaaagagaactcacagagcacagtagaagcctccacatagaagcaagctgttcagttctcttttactcctaggtcccttaga

SEQ ID NO: 74481 - DNA, 63 bp, Mus musculus
ctgcagactgggtcactgggtcactggaccaaagacagaggttgttggctcagatccatgcag

SEQ ID NO: 74482 - DNA, 110 bp, Mus musculus
gctggcccacccccgtgtctggtctcaccctctttcactcagacacacagagggtgtaggttgaaggaaaggaggagagaggaagaaagagaggaggatgtaaaaatagc

SEQ ID NO: 74483 - DNA, 119 bp, Mus musculus
cctgaaagagtcagagagtgggatgagaagatgtggggaaaggcattgcgagaaagagggaagagtgtgtgctgagatcccgagtcaggaggtcatcatcagaaggacaaacgtgaagg

SEQ ID NO: 74484 - DNA, 70 bp, Mus musculus
gtcctgcttcatgagtcagtgagtctgtgggagttacttaaaggaatatgactgactcaggatcggctgc

SEQ ID NO: 74485 - DNA, 107 bp, Mus musculus
ggctacaaacacaggcttagtgaggtctgcggagctcagggtctctcagtcagaaccacatgagatttcagagaatcccagactcgcagcatcctgccgatgtggct

SEQ ID NO: 74486 - DNA, 85 bp, Mus musculus
gcctgcaggtgataagtaatgatgaagactgaagctggctgcccctccacccctactgtctcacacacacacacttaacgcaggc

SEQ ID NO: 74487 - DNA, 91 bp, Mus musculus
gatagaatttgcttattggatgaatagattttttttgcctttttaaaaaaaaaaagactttatttatgtatgtaagtacactgttgctatc

SEQ ID NO: 74488 - DNA, 85 bp, Mus musculus
tatacgtgtgtgtgtgtatatatatgtgtgtatacatatatatatgtatatgtgtgtgtatacatatatatatgtatatatatac

SEQ ID NO: 74489 - DNA, 106 bp, Mus musculus
taactttggtttttgttattgggctgtgagtgaggacagttaacagtaagactccctcttactgtcaatggttttctcttaataatcctatgtccatttcctgtta

SEQ ID NO: 74490 - DNA, 71 bp, Mus musculus
agtcactttgatctctgactgtcacctccactcttggatggtagccaccttcacagtcagcatctgtgact

SEQ ID NO: 74491 - DNA, 85 bp, Mus musculus; identical to SEQ ID NO: 57439

SEQ ID NO: 74492 - DNA, 85 bp, Mus musculus; identical to SEQ ID NO: 57439

SEQ ID NO: 74493 - DNA, 78 bp, Mus musculus
tatgaataaacatgtgtgcatttatatttatgtgttatatgtaaatatgattatacatgtttataaatatgtatacat

SEQ ID NO: 74494 - DNA, 93 bp, Mus musculus
tctggatgaaagcggtttacagacttaagagacagtgcataatgttcccttgttagctttggatctttggttccatgatcctacttcaccaga

SEQ ID NO: 74495 - DNA, 156 bp, Mus musculus
cctttaagctagtctgataactctctacacccttcctcgtatgtatgtatgtgtgtgtatgtatgtatgtatgtatgtatgcatgtatgtatgtatgtcaattctgttccttaagggaaccctgattaatacagcatttatatcttacgtgtagac

SEQ ID NO: 74496 - DNA, 94 bp, Mus musculus
gcggctggcaggacacagtcaagtcagagagcactggcctgggctctcaaatgttagtgcttcctgtttcctgaactagtcagtcgtgccaggc

SEQ ID NO: 74497 - DNA, 91 bp, Mus musculus
ttctctaactgcccgctttcttcagtcagcatgtgtagaaagttttcctgcaatctgagcatcactgaagacagtttgcagccttagagaa

SEQ ID NO: 74498 - DNA, 112 bp, Mus musculus
atggtgtacttgacattctccttttggttgcatctgaattactgggtagtaagtaatctagtatctagatgtgtcaccatttattgtgaatgattgaaggtaggtataacat

SEQ ID NO: 74499 - DNA, 82 bp, Mus musculus
tcagctcctgcttcctgacctgcttgagttccagttctgacttcctttggtgatgaacagtagtgtggaaagtgtaagctga

SEQ ID NO: 74500 - DNA, 89 bp, Mus musculus
ctgctcaggacagtaagagcctaggtcctcacattgctgccaagcataatctgttggacacactcagaatctctctggtaccgatgcag

SEQ ID NO: 74501 - DNA, 96 bp, Mus musculus
gtgtgtatataaatcttacatgtatgtatatatatgtgtgtgtatatatacatacatatacatatatatatatacatatatatatatacacacaca

SEQ ID NO: 74502 - DNA, 85 bp, Mus musculus
gcttgtgatgtgtgcagacctcttctaagactgcagctgggaggcagtacctctgtcagtcacagtgtgatgagagctggcaggc

SEQ ID NO: 74503 - DNA, 85 bp, Mus musculus
tgtctgtctgtctgtctgtctgtctgtctgcatatagatacatacatttatatgcatacatttatattagacacatatattgata

SEQ ID NO: 74504 - DNA, 74 bp, Mus musculus
cacatgcagtgcaaggaagagtgtgcttgtgcgcacacgcacacacacactgaaagttcttcatcttgattgtg

SEQ ID NO: 74505 - DNA, 84 bp, Mus musculus
tgtgggagcatgtgtctaatcaagaagccatctctcagggcttgagagatggctcagtggttaagagcacagactgctcttcca

SEQ ID NO: 74506 - DNA, 85 bp, Mus musculus; identical to SEQ ID NO: 57470

SEQ ID NO: 74507 - DNA, 76 bp, Mus musculus
catatatatgtatgaatatacacatatatgtgtgtgtgtgtctgtgtgtatgtacatacatatatatgctggtttc

SEQ ID NO: 74508 - DNA, 110 bp, Mus musculus
acccatactatgttatagggtttaattgctagtattttcttgaaagattttgtatctttatttacaagagatatttgtccacatcatcccaacatacacacagtttgggt

SEQ ID NO: 74509 - DNA, 93 bp, Mus musculus
gtctgggaatgtgtatggtaggaatagatcgtgctggtggtaagtcgcccagtcacaccctctcacggtctcagtttctcctgttcccactgc

SEQ ID NO: 74510 - DNA, 92 bp, Mus musculus
ccaagaacatctcaacagctacatgagacactattggagaaaccccctttttggtagtgttgtcttcttgttctgcagtaggatgtcagtgg

SEQ ID NO: 74511 - DNA, 125 bp, Mus musculus
tatatgtatgtgtatgtgtatgtgtatgtgcgtgtgtgcgtgcatgtgtatatatatatatatgtgtgtgtgtgtacatgtatatacatatataaatatatttgtgcatatttatttgtatatat

SEQ ID NO: 74512 - DNA, 90 bp, Mus musculus
gacatagttttgcatagggaagtgtaggctggcatttatggtcttttgtaacttgtagaacatcagtgtaagctctctggctttctagtc

SEQ ID NO: 74513 - DNA, 61 bp, Mus musculus
cacagagtgactcagtgcctcccacagggaaggggggtgcttcttttcagtgagtcctgtg

SEQ ID NO: 74514 - DNA, 81 bp, Mus musculus
tgctacagagtcacagtaactcagtcactgcacagggtacaccagagctaagaaagtgcttttgagttgtgattctttgca

SEQ ID NO: 74515 - DNA, 106 bp, Mus musculus
tatttttgctggtagctgctatgcatacgatatatatacatatatatgtatataaacatatatgtgtatctatattttagtgggtagagaatgaaaggtgaaagtg

SEQ ID NO: 74516 - DNA, 104 bp, Mus musculus
tttagtaatgagatgcagttaattgctcagaagagtctgtcctcactcgaccctagggacaaagtctgacaactcaggggtaataggactaaaatcgtattaaa

SEQ ID NO: 74517 - DNA, 115 bp, Mus musculus
cttctctggcccagtttctcaagatttctccctaggaatttgtctatctcactgtctgaattaactacaggtacatcctaggcctagcatcaagaacacctgacgccgattagaa

SEQ ID NO: 74518 - DNA, 90 bp, Mus musculus
taagctatatgtatgtatatgtgtgtgtgtgtatatatatgtatatacacatatacctagatattacatatgtgattttaagtaagctta

SEQ ID NO: 74519 - DNA, 70 bp, Mus musculus
atgtatggatatatgtgtgtatgtacgtatgtacttatgtatgtatgtatgtatgtatctatctatctat

SEQ ID NO: 74520 - DNA, 112 bp, Mus musculus
tagtcagaagtatcaacagtgttgagactttgagttacaagtcttcattttttttaaaaatgagactttagaactagtaagcgactttggtgtatcatgctaagtctgactg

SEQ ID NO: 74521 - DNA, 81 bp, Mus musculus
gaggatggtgagattggatgtcaaacttcatggggattcgacatagaataaccaggacagtcattttctgtctcccacgtc

SEQ ID NO: 74522 - DNA, 71 bp, Mus musculus
gaaagaatagtctcttttatatcatggggaatcttactgattttttatttagcaaagagactccttttttc

SEQ ID NO: 74523 - DNA, 86 bp, Mus musculus
ttggaatcctggactatatataaggagaaagtagaccgagcacacacactctctctgcttcctgattgtgagtgcagtgtgaccag

SEQ ID NO: 74524 - DNA, 101 bp, Mus musculus
ttcttgttccttactgatgacttttctgtaatgttatattgctagtttcaaatgaggacatgtaagaacacagccagcagagccccagagggggtcaggaa

SEQ ID NO: 74525 - DNA, 82 bp, Mus musculus
tagaatatgtattggggctggagagatggctcagcagttaagagcccagactgctcttccagaggaccaaagttcaattcta

SEQ ID NO: 74526 - DNA, 81 bp, Mus musculus
gttgtagcaggggttcagttttaagtctcatctatgagtttgggcagactgtagagtgagttcagagagagccttggcaac

SEQ ID NO: 74527 - DNA, 62 bp, Mus musculus
ctgggggacctcactgactctctgggactttgaaggacctgagaggccagcagctctcccag

SEQ ID NO: 74528 - DNA, 84 bp, Mus musculus
gtatgtagcttgtctgtagttagtctccacattagctgtgttggtatttgacatttctaagggagggaatcagagccagtatgc

SEQ ID NO: 74529 - DNA, 63 bp, Mus musculus
taggtgattctgtctctctggcagtcttaagatttcttaagatacccccagagggcacaccta

SEQ ID NO: 74530 - DNA, 119 bp, Mus musculus
gagtgatactgtaaattgtaatgtctgtccctttggctacataaacagaagaggaatgtatttttctttaaaaatgggttagttggtcatttagaataaaagcactataattcacactc

SEQ ID NO: 74531 - DNA, 109 bp, Mus musculus
cttaccctccagagtaaaggtgtctgtccgagaaggctctgaccacgagagcaggtaagagagcaatcttgtgtccggtgtccctctgagaccagtctgtgcaggtgag

SEQ ID NO: 74532 - DNA, 81 bp, Mus musculus
taacggatggttccatggcacagaaggaagccgtgtgtcctccagcacaccgctgtccgtgtcactggctcacacacgtta

SEQ ID NO: 74533 - DNA, 75 bp, Mus musculus
tctttgagtccctgattatatttttttctgtcctaagtgatgacatttgaaaaaataaattcttggattcaggga

SEQ ID NO: 74534 - DNA, 105 bp, Mus musculus
ttccccctttctatttttatgcctgtgtctttctgtgtctctcacatctttctttcaaaaatataggggaagagaagtggagggagagggaacacaccagggatg

SEQ ID NO: 74535 - DNA, 84 bp, Mus musculus
ctctgtttctgcctttgtatcgttgtctctgtctatctctttcatatacagacatgtgaatactgtacagtagtaggtgtagag

SEQ ID NO: 74536 - DNA, 67 bp, Mus musculus
gagtattctgggagggcagccattggtcttaactgctcaagacaggttctctctcactgtgtatctc

SEQ ID NO: 74537 - DNA, 103 bp, Mus musculus
acagtacctcttccatttactgcatcatgtttacatatcaggacacagattcaactcactgttctaactggctgtggaatatggtacaagaaggaggcactgt

SEQ ID NO: 74538 - DNA, 78 bp, Mus musculus
tgtttcctgttttcgggttagtgagcataggacacgaaagtgtgtgactgcacctggatctgaagcctacaggggacg

SEQ ID NO: 74539 - DNA, 117 bp, Mus musculus
cctgaccttgtatgtgtatatgtgtatatatgtgtatatatgtgtatatatgtgtatatatgtgtatatatgtgtatatatgtgtatatatgtgtatatgtgtgttgcaggggtggg

SEQ ID NO: 74540 - DNA, 114 bp, Mus musculus
tcaatgtatgtgtgaaggtacctgtgtgtatgtaaagtgggggtgtatgtgtctgcatgtgcatgtatgtgtgtgcatgactatgagtgtgcaagtacatgtatatgtgcttga

SEQ ID NO: 74541 - DNA, 113 bp, Mus musculus
agaactgtgagttagggagctggagaaatggctcagcagttaagagcactgactgctcttcctgaggtcctgagttcaaatcccagcaaccacatggtggctcacaaccatct

SEQ ID NO: 74542 - DNA, 100 bp, Mus musculus
ttcccaaagcagagtcaccatcagtgtaagatgaccagtgagcattgttgacaggagacagtgaagacaccagattgcatgaatggtgggcatttgggag

SEQ ID NO: 74543 - DNA, 72 bp, Mus musculus
tggcagggagctggaagttgcctaggcctcaggtgtgtgagtctctgggtctcaacctgctctatcttacca

SEQ ID NO: 74544 - DNA, 105 bp, Mus musculus
ccgggcctattacacagtattggattccacaggtgacaagagagtgaacacagcattggacgcctcgagtgaatcaaatcaggaaagcttgtgctgcagggaagg

SEQ ID NO: 74545 - DNA, 85 bp, Mus musculus
ggcgaacatctttctctgtcagtgtatgaaggctaaaactgcaaaacccacaatgagctcatacttgggagcaggaagtgttgcc

SEQ ID NO: 74546 - DNA, 84 bp, Mus musculus
tatctgtctgtctgtctgtctgtagaatagggggcatgaatctcgagccaaggaaggatgctttcagagagtactgataaggtg

SEQ ID NO: 74547 - DNA, 115 bp, Mus musculus
cattcatatatgtgtttatatgtatgtttgtatatatatacatatatatatatacacacacacatatatacatgtgttgatgaatgtgtatgtatatatatgtgtgtgtgtgtat

SEQ ID NO: 74548 - DNA, 93 bp, Mus musculus
ggcatagatcatacacgttactctcaccagccccagctcagcctgactgtactgcggtctgttgtgagccagcagcctgtgtgtggaaatgct

SEQ ID NO: 74549 - DNA, 95 bp, Mus musculus
accctggaacccaatgatgactcctgcagcctgttgtcctctggtcttctctattctgatctcgctctcagtgtgtctgtcattacccagggttc

SEQ ID NO: 74550 - DNA, 103 bp, Mus musculus
cttttaaagtatggttccattcggagttgggcacttcatgatcccaagatggccaccagacctgagaacagacagtgctcacttctggccacttacttagaag

SEQ ID NO: 74551 - DNA, 113 bp, Mus musculus
tccgtgtatacagtcaggcttaaagagtcaaagccttttttctctctttcacattgagacaagagtctcaggacagaaccctaactggccttgaacttgctgtgtagagcaga

SEQ ID NO: 74552 - DNA, 90 bp, Mus musculus
cttccagaggccatggctcagtggtttagtgtaggtgagtgttctagactctctcagcttctggatctgggagatagatagctagcttac

SEQ ID NO: 74553 - DNA, 128 bp, Mus musculus
ggctgggatctgaacatggtcggactctttgggaagtcattttcccttgatctctgctgtctgtctgtctgtctgtctgtctgtctgtctctgctctcttcatgtagaggtcagaagacaaccttggc

SEQ ID NO: 74554 - DNA, 84 bp, Mus musculus; identical to SEQ ID NO: 59736

SEQ ID NO: 74555 - DNA, 85 bp, Mus musculus
ggccttttggtctctttcatgtcccagtcatgaggtggacagttctctctgcctcacatacctgttatgagatagccttcagtcc

SEQ ID NO: 74556 - DNA, 90 bp, Mus musculus
caaggcctaggaacctgtctgtctctgtctctcaagctctgggattctacatacttcaccacagctgggatggaactccagtcctccttg

SEQ ID NO: 74557 - DNA, 80 bp, Mus musculus
gcgagagctcttcctcagtggacagaatcctatgtggaatgcattcataagggagagaagggagtgttcactagctctgc

SEQ ID NO: 74558 - DNA, 77 bp, Mus musculus
agagtttgaaatggtcacatacggagatgtgatgccccagggtttatgatgtagatgtggtcactgtcactcactct

SEQ ID NO: 74559 - DNA, 106 bp, Mus musculus
gttaactggatggtagtccatgaatgtgcaatatagttacaaagtatattatacatgctataggtatatatgcacatgtatttaaagtactataaataaggttgat

SEQ ID NO: 74560 - DNA, 67 bp, Mus musculus
tatttagcatgtgtatgtgcatgcatgtctatgtgtgggtatgtgtgcatgtgtatgtgcatgagtg

SEQ ID NO: 74561 - DNA, 78 bp, Mus musculus
gcacaccttcaaatccagctctgagcagcatgcctctcattagtgatgattgtcagctatcgttgggtacagtagtgc

SEQ ID NO: 74562 - DNA, 114 bp, Mus musculus
gcatctgttcagttaaagtctctggatttctgggtttctgaggagagagaagtttgtgagcacacagctctttcataaaaaagtaagtgggtctgacaaagactggcagagtgt

SEQ ID NO: 74563 - DNA, 94 bp, Mus musculus
gtgtgtatgtgtcagtcttcatgcttttgtctgtctgtatatatgtgtgtatatgtgtctgatttcatgtatgtgtgactgtatgtgtatctat

SEQ ID NO: 74564 - DNA, 116 bp, Mus musculus
tgcatgccgctgtctaagagtgttatgttcaagtattttccgacattttagttatttagctgacagtagaaagtaacctgatcaagactcctaggctctatgggctcagggataca

SEQ ID NO: 74565 - DNA, 130 bp, Mus musculus
tgtttgggtggagtagtctgtagatatctgaagttcatttgacctatctaaatttcaactgtgattttcttgttcttcagttttggcctggatagcatgtctattgatgaaaataggtgtttctctaatc

SEQ ID NO: 74566 - DNA, 91 bp, Mus musculus
taccaagggctgcttggtgtatttagcacacagaaggtgctcactcacattctgagtgacatacatgtaaatggcagttcctctctgggta

SEQ ID NO: 74567 - DNA, 83 bp, Mus musculus
gtaaccaagagtgtctcggagactgagtcgattcacatgattgtttgattcactaagtatttaagatacactgaaatggttac

SEQ ID NO: 74568 - DNA, 85 bp, Mus musculus; identical to SEQ ID NO: 57439

SEQ ID NO: 74569 - DNA, 73 bp, Mus musculus
caggtccaggttcacagtgtagtgtgaggacagctgtgatagagggatatactgcgctgtgctccaggaactg

SEQ ID NO: 74570 - DNA, 92 bp, Mus musculus; identical to SEQ ID NO: 57641

SEQ ID NO: 74571 - DNA, 87 bp, Mus musculus
ccagcagcatcaggtaggattctgtgaagcctgctgagaggtgatccccacacagaagttagacagcactctacactgaaaggttgg

SEQ ID NO: 74572 - DNA, 114 bp, Mus musculus
ctgggcagttcttcagttgaggttcgctcttcccaggtgactctaggttttgtcaagttgacaactgaatttgaatatgtcaccaggactggtgaagcacatctgctattccag

SEQ ID NO: 74573 - DNA, 114 bp, Mus musculus
tactattctattcctttttaaaatacttcagtctgtctgcctgtctgtctgtgaaggtgtcacggtgtttaagtgaggtcagctccactgtgtggactgggatggaactcggtg

SEQ ID NO: 74574 - DNA, 90 bp, Mus musculus
gtatatgaatatttatacatgtgtgcataatattacatgaatgtatgtatattcatttatatttatgaatatgtatgtatgtatgtgtgc

SEQ ID NO: 74575 - DNA, 89 bp, Mus musculus
ctgggtgaggaataaaacctacgcctgtgtttaaggttctagcttctattcttcctgactttggactcactggtgcctcctctctccag

SEQ ID NO: 74576 - DNA, 85 bp, Mus musculus; identical to SEQ ID NO: 57470

SEQ ID NO: 74577 - DNA, 96 bp, Mus musculus
gagtcaagttcttctaaatgtcaaatactgaccacagacgctgtgtcagtcacattcatttctggtcagtctttcagatgtctaaagaaaatactt

SEQ ID NO: 74578 - DNA, 82 bp, Mus musculus
gtgtgtatatatatgtgtatacacacacacacacatatatatatatatgtgtgtgtgtgtgtgtgtgtgtgtgtgtgtgtat

SEQ ID NO: 74579 - DNA, 93 bp, Mus musculus
tcactgaatagcacagcttaatgtatctacttatctgtccttgaaatagaaggatatatatgtatatcaatatattcactggtttattcagga

SEQ ID NO: 74580 - DNA, 102 bp, Mus musculus
tacatatattatatacacatatgtgtatatatgcatatatacatgtgtatgtaatgtatatatgtatatatgtgtgtatatacatagatgtatatatatgta

SEQ ID NO: 74581 - DNA, 69 bp, Mus musculus
gagacaggaggatccctgggttttgctggctaccaacctagctgcagagtctctgagaatctctctctc

SEQ ID NO: 74582 - DNA, 80 bp, Mus musculus
gttttctcatgagtctgagcacataggcatgtactggggtagggggtcatgattggtgggtggaaaccttgtgagaggat

SEQ ID NO: 74583 - DNA, 82 bp, Mus musculus
gaatatatatgtacatgtgcattaatatacacacatatatatgtatgtgtgtatgtatatttatacatgtatatatatattc

SEQ ID NO: 74584 - DNA, 117 bp, Mus musculus
atgtgcgtgcatgcatatgtgtgtgtatatgtgtatatatatatatatatatatatatatatatatatatatatgtatatatatatacagtagcatacccagaagcagattttacat

SEQ ID NO: 74585 - DNA, 92 bp, Mus musculus
tgcatttacatatatatatcatatatgtgtataatatatgtacaatatatgtatatataaacacattttatgcatatatatatgtgtgtgta

SEQ ID NO: 74586 - DNA, 84 bp, Mus musculus
gtaaatgcatgctatatattgtgtatatatatgtatcatgtatcatatacatgtatacacatatattatatgtgtgcattctgc

SEQ ID NO: 74587 - DNA, 86 bp, Mus musculus
atacatacatacatacatacatacatacacacatacacacatacatacacacatatgtttgtatgtatgtatatgtatgtgtttat

SEQ ID NO: 74588 - DNA, 85 bp, Mus musculus; identical to SEQ ID NO: 57439

SEQ ID NO: 74589 - DNA, 110 bp, Mus musculus
ctctgcttgaacatacaccacacacacacacacagaatttcatgtgcatttgttatttttatttcatgctgttgctgttgctgtgtgctctgtgtctgtatatcttagag

SEQ ID NO: 74590 - DNA, 89 bp, Mus musculus
ggacttatttgagtatgtgtgggatacttagagcctgcttgctggaactttgctctaaccattttatttatatgtctgtctgtgggtct

SEQ ID NO: 74591 - DNA, 60 bp, Mus musculus
gtggatctcttatctgcactttggttaccagataaccacagtgcacttactctgatacac

SEQ ID NO: 74592 - DNA, 90 bp, Mus musculus
ttgttgttctgactcatattgttgttctgactcattctctgtgaaggacaggagtagataggatgacagaagacaattagatgctaggca

SEQ ID NO: 74593 - DNA, 148 bp, Mus musculus
catatatatatatatacatatatatatatatacatatatgtgtgtatatatatatgtgtgtgtgtatacatatgtatatgtatacacatatacatatatgtgtatatgtatttgtatatatatatatacatgtagtggttgtatagtg

SEQ ID NO: 74594 - DNA, 80 bp, Mus musculus
gcaatatctcagtggctgatctgatgagggcacacctcagttatgccttcctctgaattagcaagagaaactgagagggc

SEQ ID NO: 74595 - DNA, 113 bp, Mus musculus
ttcccccacagggatgccacaaaccagagcttggtgttaaaatgtgtccttttcatatctgtatttcattttaaacatagtcatcgagtttgatttgcgaaggctggggagag

SEQ ID NO: 74596 - DNA, 89 bp, Mus musculus
tgaaagtgctcttttacacaatcatatatatatatgtatatgtgtgtatatacatatataatttatatatatatgaaactgctctttta

SEQ ID NO: 74597 - DNA, 93 bp, Mus musculus
acaaaacaacaaatcaaacagaaaccattttattttgtgtgtatgtgtgcatgcatggtgtgtgtgtgtgtgtgtgtgtgtgtgtgtgtgtgt

SEQ ID NO: 74598 - DNA, 70 bp, Mus musculus
gtgggtgctgtgaagagagtcacctcacaggactgctgtccgaatgggatgggtcattctcagcatgcgc

SEQ ID NO: 74599 - DNA, 71 bp, Mus musculus
tgagcataggggctggagagatggctcagcggttacaagcactgactgctcttccagaggtcctgagttca

SEQ ID NO: 74600 - DNA, 119 bp, Mus musculus
gcctttaggcaggtgagtaaggaagtatatttaggagttggagagatggctcagtcgttaagagcactgactgctcttccagaggtcctgagttcatttctgagcaaccatgtggtggc

SEQ ID NO: 74601 - DNA, 74 bp, Mus musculus
ggaagtaagagcaacgcatgttcagagaacactgactgctggtcacctgtcttaagtgctgtaactcctcttcc

SEQ ID NO: 74602 - DNA, 87 bp, Mus musculus
gaagtcctctatctttgttggctctttccatggtttagttatcagtgtatttctggcttcatggaatgagttgagtagagtaccttc

SEQ ID NO: 74603 - DNA, 111 bp, Mus musculus
gtgggctgagtggtgagagagaggtaagtgtggtgttcatatttgaatttcacacacacacacacacacacacacacacacacacacacacacacacacacacacaaaccc

SEQ ID NO: 74604 - DNA, 67 bp, Mus musculus
ctctcctctctgcctgtcagtctctctgagggctatttgccctccatgacacatccgagatggtgag

SEQ ID NO: 74605 - DNA, 74 bp, Mus musculus
tgagtgctctgggtctctgtccctgtgtgtgaagtggacttcaaacacggtgttcaaaggcctctttgtcttta

SEQ ID NO: 74606 - DNA, 76 bp, Mus musculus
ggtcctagtttagtgagtaattactgtataccattcgctggttacattctttacactcactgtctcacttggagcc

SEQ ID NO: 74607 - DNA, 113 bp, Mus musculus
gtgtgtgtgtgtgtgtttgctccaaggttcacatctggaggtcagaggacaactgttgtgattttgttcttgccatctaccatgtgtaacctagggtgtccaccccaacacac

SEQ ID NO: 74608 - DNA, 79 bp, Mus musculus
gaattgtcccaagactggtttggcattgaaattccgggctggaagacctggaggcctcagaactgtgtctgtgaaattc

SEQ ID NO: 74609 - DNA, 91 bp, Mus musculus
aacagtatatacatacatattgtatatacatatgtgtatatgtgcatgtgtatatgtgtgcatattgtatatgtatatgtgtatatatgtt

SEQ ID NO: 74610 - DNA, 57 bp, Mus musculus
ggggaaacagcagctggatgtgcagtcttaagacaactccagctcagggctacaccc

SEQ ID NO: 74611 - DNA, 134 bp, Mus musculus
atgatcaaatggtttttattcttttaatttgtttatatggtgaattacattgacatatatttttgtatattgaaccatcctgcatcagtgagttgaagcctacttggtcatgatggatggtatttttgatgtgc

SEQ ID NO: 74612 - DNA, 86 bp, Mus musculus
cctccatgtgtttatctgtctctctctgtgtttgcacacatgcatgtgtgtgcagacacatatgtgacacaacatacatgtggcgg

SEQ ID NO: 74613 - DNA, 116 bp, Mus musculus
gagagagagagagagagagagagagagagagagagagagagagagagaatgcgcgcgtgtgtgtgcacacagagttctgttgcgctatcccctttagaaacctttattcagctgtc

SEQ ID NO: 74614 - DNA, 89 bp, Mus musculus
ataaggctggatattttgttgtggctagtaatgcaattactatttttgtgtaatgcttacataacaaatgtaaacaagaaaggctttgt

SEQ ID NO: 74615 - DNA, 79 bp, Mus musculus
ctgtttttgtttgggacagtcactctcactgaagcaggccctccctgatatcaatggtgtggctggcccatgagtccag

SEQ ID NO: 74616 - DNA, 89 bp, Mus musculus
cagacattatggccagtgctcactgtgcctgtgacagtgaaaagttatatagctaaagaggaggtgggttgtgctgccacttatgtctg

SEQ ID NO: 74617 - DNA, 101 bp, Mus musculus
tagaggattagactcattgcttggtagaaaattttagtttatcaatttgaaaaagacaagggttctgacacaaggtattctgacacaagtgtattcctctg

SEQ ID NO: 74618 - DNA, 133 bp, Mus musculus
ttagtttccttcttggggttagactgtgtgcattgcatgaagaatgagggtctgtgatttgtgtatttcttgtcctcttgaacacacgactgaaaaatagtattctttttttttttgagagtttagtttactc

SEQ ID NO: 74619 - DNA, 64 bp, Mus musculus
atcttagccgttgttctagtcattatatttttatgtcatgactttagcagattatggctgtggt

SEQ ID NO: 74620 - DNA, 82 bp, Mus musculus
gtatgtatgtatgtatgtatgtatgcatgtatgtatgtatgtacatacgtacgtatgtatgcacacacacacatacacacat

SEQ ID NO: 74621 - DNA, 96 bp, Mus musculus
tctcagctctaggaccccatttggtgcagaccaccccagaccctgtgcactctgcctcagtctctgtgaggtactctgtgctgtggtgagtttaga

SEQ ID NO: 74622 - DNA, 114 bp, Mus musculus
gtggctcacaagcgtttaggaaatttgataggatgcattctgattttgtaattcagtgacatagatatgtgaaaggaaggcaacgttagatgatcagaaagtctgctttgctat

SEQ ID NO: 74623 - DNA, 72 bp, Mus musculus
acatgtgtatatatgtatgtgtatatgtatatatgtgtaaatgtttgtgtatatgtttgtatgtatgtatgt

SEQ ID NO: 74624 - DNA, 86 bp, Mus musculus
tccagaggtggggaggtgcagtctgaggttcctgaggaactgccagagtcaggctcagactctcaggcactatagacaccactgga

SEQ ID NO: 74625 - DNA, 76 bp, Mus musculus
ccaggcagggagacacacacagtgacccagggcagtgctgcccagtgccctgactgtcaagagtttcactccctgg

SEQ ID NO: 74626 - DNA, 60 bp, Mus musculus
cactgagggagggctctgaggtttcaaaagcccacaggaggctcagtgcctctctctgtg

SEQ ID NO: 74627 - DNA, 120 bp, Mus musculus
tccaaactgcagcttgtcctggctcaatactattccactatgtttatgcagcacttttttttttttaaaccacagaatagagtttattcagggcatggggaggggagataagagggcagt

SEQ ID NO: 74628 - DNA, 76 bp, Mus musculus
ctggcgtacacacatcttactctctcgccctctgaaattttagcatgggtggtgtaatagaatatgtgcataccgg

SEQ ID NO: 74629 - DNA, 109 bp, Mus musculus
ttaggccagtgctctccaatgctagcataattaaaatctttaacagtttagcaaagtaaagatgtttggctgatcacgttgagatgattatctagccattgtattctaa

SEQ ID NO: 74630 - DNA, 87 bp, Mus musculus
gttgttcagattccacctgaatgttggcttttcattatttatttttttattgaagataagccttagtccatggtgatctgataggat

SEQ ID NO: 74631 - DNA, 73 bp, Mus musculus
tgtatatgtgtatatatatgtgtgtatgtatatatatatatatatatatatatatatatatatatatatatat

SEQ ID NO: 74632 - DNA, 85 bp, Mus musculus; identical to SEQ ID NO: 57470

SEQ ID NO: 74633 - DNA, 79 bp, Mus musculus
ctgtctgtctgtctgtctgtgtacacaggtgcatatatttttgtatatgcatatggtgtgccctagagaacaactttag

SEQ ID NO: 74634 - DNA, 69 bp, Mus musculus
gccctttttgtatgtatatatgtctgtttgcatgtttgtgggtacgcatgtctgtgtgtgtctaagggc

SEQ ID NO: 74635 - DNA, 57 bp, Mus musculus
aggccgttctgggaggccagaaaacagtggccttgctgcctgtctcccagattccct

SEQ ID NO: 74636 - DNA, 108 bp, Mus musculus
agaatttcgcccttggcaatattttcttcctcatgcctgtgtgctctgcttcgaatttacttttgtcagggagctttgaaggaaaagccttgctggggggataatttt

SEQ ID NO: 74637 - DNA, 85 bp, Mus musculus; identical to SEQ ID NO: 57439

SEQ ID NO: 74638 - DNA, 76 bp, Mus musculus
catccctataggtggcagcaaatggggcagcaagtgactgcctgtctgtctgtctgtctagctacctctttgggtg

SEQ ID NO: 74639 - DNA, 56 bp, Mus musculus
aggtgctgtgtgtgtgtgcacgtgcgcatgtgtgcgtgtgtgcctgcctgcctcct

SEQ ID NO: 74640 - DNA, 92 bp, Mus musculus
tctcagacagtggatacaagcgcagacttgtttatatgtttaaaactcaatcaaattaggggggatatgtgtgcaaatgtgtcactctggga

SEQ ID NO: 74641 - DNA, 99 bp, Mus musculus
gccattggacaaccccgatgattggtgtgtgtatgtgaggaagtccatgtcagtggctctctcacattttagcccctgtacctgacggttgtcctgcgc

SEQ ID NO: 74642 - DNA, 98 bp, Mus musculus
ttgcttaggagtgaagtgcaggggctggatagatggctcagtggttaagagcactgactgctcttccagaggttctgagttcagttcccagcaaccac

SEQ ID NO: 74643 - DNA, 118 bp, Mus musculus
gggatcgagcagcttgttgggtttaagctctggaggaaactggttcaccttctctctggcagcctcatagagacccatgcaatccccatcctctcctggctgaatctgcaagtcactc

SEQ ID NO: 74644 - DNA, 135 bp, Mus musculus
cccaaagcgcacatgcaccactgttgaatcccagctgacaggcatttgagttgttcccaacttttgggctttagtgtatcctgctgctgtgagaagtgtctgtgctgagcctttttgtggacatgtcattgagtc

SEQ ID NO: 74645 - DNA, 124 bp, Mus musculus
tgaaccccaaaaggtattataaaagctcaagggagtgtgggtgccatgtagaaatgacacacagactctcttagattagtctcctctccatgttcagcttctttggacagctcattccctgctt

SEQ ID NO: 74646 - DNA, 166 bp, Mus musculus
gtgcatatatgcaaatatgcacatatatatgtgtatatgtatatgtatgtatatatgtgtgtatatacatgtatatgtgtatgtgtatatgtatatgtgtgtgtgtatatatatatatatatatatatatatatgtgcatgtgtctgtgtgcctgtatatatatat

SEQ ID NO: 74647 - DNA, 72 bp, Mus musculus
aatttgttgtgataccatttccatgtgtttatttatctaattgtttatatggagagtgggtttcactaggtt

SEQ ID NO: 74648 - DNA, 98 bp, Mus musculus
ctggcatgtgttggctacgtggatttaactgttaaccagtaaaagcaacacaaagtgcagcagtgacttgtcagttttctctacccagcactaaccag

SEQ ID NO: 74649 - DNA, 110 bp, Mus musculus
gttgcaaacttgcaggtttcctggccttaagaggccaatgtcagatcagagtcaccatacgaagattactacagcttccagaggctacacaggtcttgctcatacacagc

SEQ ID NO: 74650 - DNA, 116 bp, Mus musculus
gggaagtgatatggtttggggggtttggcttcatttgtgtgttttgagacagcctcactctgtatcacaggctggccttaaactcacaactgccttcctgccttagcctgctgact

SEQ ID NO: 74651 - DNA, 60 bp, Mus musculus
cttgagacagggtctctcactgaatttggagttaggagacaggagaagccctagagcaag

SEQ ID NO: 74652 - DNA, 57 bp, Mus musculus
agacaatgtgtgtgaatatgtatgtatgtatgtatgtatatgtgtatgtgcatgtct

SEQ ID NO: 74653 - DNA, 90 bp, Mus musculus
acaaccatcctgactctctgactctgactgtatatctgcatgtgtataggtgtgtgtgcaagtatatattgtagtacgtggttatgttgt

SEQ ID NO: 74654 - DNA, 58 bp, Mus musculus
gtatctctgtgtggttatgagcatgtgagcacagatgccagcagcagacagaaggtat

SEQ ID NO: 74655 - DNA, 109 bp, Mus musculus
ggtaaacaggaatatgtcaatgtatatatgctatgtacacagagaagtatctgagctcatctgcttatctgctctggggaagtattagtgcaaatgacatcttaatacc

SEQ ID NO: 74656 - DNA, 115 bp, Mus musculus
tgaagtgccagaaacttaatggctttattttatcacaaggcttatactgtctggttttgtgggtcaacttgacagaagctagatatagaagctagaaacagaagctaggcattca

SEQ ID NO: 74657 - DNA, 98 bp, Mus musculus
gatcagtcttaggcacatggtggttctgataggatacatgggacaatttcaatatttttgtatctattgagacctgttttgtgaccaattatatggtc

SEQ ID NO: 74658 - DNA, 82 bp, Mus musculus
ctgtgcattggatttctcttagggtgggcccgggaggtcaaaggtgagatgtctcttcactctgtgtaacggccaatcgcag

SEQ ID NO: 74659 - DNA, 97 bp, Mus musculus
cactaggtccctttctcccgaagcagcaaggactgctgacagacactctcatacaagctcggagttttttctgttctggtcagtaagtaacctcttg

SEQ ID NO: 74660 - DNA, 104 bp, Mus musculus
gtcatcctgttggccagtttctttgcacatctggtcacccaagcccccaccccctgtgtgtctgtctgtctgtctgtctgtcatggtttggctctcttattggc

SEQ ID NO: 74661 - DNA, 74 bp, Mus musculus
gggtaaacagatggacaaagaagaaagtatttcagttctcattcattcattctgtctgtctgtctgtctctccc

SEQ ID NO: 74662 - DNA, 97 bp, Mus musculus
agataatcaggagtggtgccaatcactgttgaagagaaagttcttgtatttttttaaaagcgttgactaaatggcaaaagaatatttctgtatatct

SEQ ID NO: 74663 - DNA, 111 bp, Mus musculus
ctgttggttggtggggtgttggatctccacggtaggatcttgcccggctgagatgggagtgttcagacttggtccgatcagaatgtggtgcctatgctcatatctcgaggg

SEQ ID NO: 74664 - DNA, 117 bp, Mus musculus
cctgtctcaggtcaggagtcaggaaatgttgcagggatagccaatgacctagttgcttgttattttgatggttcaaatatccactggagtctttatgagttcaccctcccggactgg

SEQ ID NO: 74665 - DNA, 71 bp, Mus musculus
gtcttggttccttttctattgctgtgagaagctaccatggagcttgtgacttcagagagtgagctcaagat

SEQ ID NO: 74666 - DNA, 75 bp, Mus musculus
cctaattatctactcagtgagtcagtcagtcagcattctgtgtacctgcctgcccctgagaatggtagtactggg

SEQ ID NO: 74667 - DNA, 95 bp, Mus musculus
ggtttatttttctgtgcatggattttctgtatgtatgtatgtatgtatgtatgtatgtgtaccatatgccaaggaaaccatgagggtttcagatc

SEQ ID NO: 74668 - DNA, 83 bp, Mus musculus
tttgatattagcattgcagattgatgaatacagcacagaagtggtctggcaaatttatctgtctgtctgtctatttggtcaga

SEQ ID NO: 74669 - DNA, 86 bp, Mus musculus
tttggtctagtttcttaggttttctaggtctcaatttcccatctgtaaagggagagtaacagagggcttagggtttttggagtaaa

SEQ ID NO: 74670 - DNA, 88 bp, Mus musculus
tgagagttttcttgggtataatagcaaggctgccatttctgttctctcagggtctgtctgacattttcccaggatctactagctttca

SEQ ID NO: 74671 - DNA, 88 bp, Mus musculus
aggcatacacacattatacaaaatatgtgcatgatatatgctatgtatgtatgtatgtatgtatgtatgtatgtatgtatgtatacct

SEQ ID NO: 74672 - DNA, 100 bp, Mus musculus
aggagcacttcagtttccttgtggctctcactgacacagtccctgcccagccggcctgtgactatttagcaggggtttgtgagctctgataccgcttcct

SEQ ID NO: 74673 - DNA, 87 bp, Mus musculus
atggattggctctgcttggctgaagttctggactggagacattttcatgtctcagccagtctcagccagtctcaaagctgttctcat

SEQ ID NO: 74674 - DNA, 68 bp, Mus musculus
gaccctactcatggtcctgctgtcatctagccaagaccagaccaactcagagacctgactgaggagtc

SEQ ID NO: 74675 - DNA, 66 bp, Mus musculus
tacttgtctctcttccctttttaggcttcaggctaatggggcataagtctagagagagcatgagta

SEQ ID NO: 74676 - DNA, 87 bp, Mus musculus
taaggacccaaagtgacttctccctctctcagtctggtctgacagcatcatttcacaacacaaagagggtagaaatacaggtcctta

SEQ ID NO: 74677 - DNA, 102 bp, Mus musculus
agttatttgtcttgagaccttgaagtggaagccagaggtttaattgattgaaagagtcagagttgagagagaccttttttttccatctaaagaagaatgatt

SEQ ID NO: 74678 - DNA, 67 bp, Mus musculus
ttgctgctcttagtgctgtgggtatcttacagaaaccaggttactcactcactcagacatgcagcaa

SEQ ID NO: 74679 - DNA, 75 bp, Mus musculus
taagtactcaggggttacagagcctgatgatgcacagaagaatgaagttagactcacactcttactgagtgcttg

SEQ ID NO: 74680 - DNA, 83 bp, Mus musculus
aggctgcctatggtcgtaaaccttctcaaaggtcaggggattgtcactgacactctgggagactttgggccaggccagagcct

SEQ ID NO: 74681 - DNA, 63 bp, Mus musculus
ggggggggttgcatgtggaagccagaggacaaaacccattgtcttcctctgtcactctctgcc

SEQ ID NO: 74682 - DNA, 85 bp, Mus musculus; identical to SEQ ID NO: 57439

SEQ ID NO: 74683 - DNA, 117 bp, Mus musculus
tcagccttcttcaggacaaggaaaattgtgggttattttcattatggatttctctctgggtcttctttatttctgtcccatgtgtaataggcctctttgtcctggaggtcagactga

SEQ ID NO: 74684 - DNA, 88 bp, Mus musculus
gcacatccaagccccagtcacactggatatgtttacaagcttctgtgttcctgtgtcattgctgatggactgtgatttggctgtgtgc

SEQ ID NO: 74685 - DNA, 89 bp, Mus musculus
ggatgaaggacatcactggaggagggctctgagagtgtgtagcctcatttcacttccagtcccctctctctctctgactgtctctctct

SEQ ID NO: 74686 - DNA, 89 bp, Mus musculus
ctcattcaactatcacaggtagccagcaggtttcacattgacagaactgtgtgtgatctcacgggatctgagatagagcacaggatgag

SEQ ID NO: 74687 - DNA, 114 bp, Mus musculus
gctgtagcatgtaatgtgtaaagttgtgggaggccattgctgccttttcttctccagtgtctctctttgtgtttccagaaagagtagcttgtgcctctcagattacctgcttgt

SEQ ID NO: 74688 - DNA, 117 bp, Mus musculus
ttgcttgcctctatcttcttagtcatactctgctgtctcctgatgggtagactgaactgagaaaggactgaaagtcccagtggagacagccaatgtcagggatgatggatggagcag

SEQ ID NO: 74689 - DNA, 86 bp, Mus musculus
acatacacatggataagatattatatatttctgtcttcaaagtcctttggtccagatagagtggtagtgaagtgaccgtggtgagt

SEQ ID NO: 74690 - DNA, 73 bp, Mus musculus
cagcacatcttactgtcagaagacacactcacactcagcccagttgagtgtacttctaactgtgagcttcctg

SEQ ID NO: 74691 - DNA, 117 bp, Mus musculus
gtcttcttgtcaatacagatatttctttctgtgtatttctgtatttcttattgatttaaaaaaatccactgacaaatgaagattgtatgtatgtatgtgtgttgattcatggctaga

SEQ ID NO: 74692 - DNA, 91 bp, Mus musculus
gccagcatagacaaccactgcttagactgaaggctgagtgcagacaggacatttcctttttgagttttagttaaagagaggtgatgatggc

SEQ ID NO: 74693 - DNA, 116 bp, Mus musculus
gcattctgatgaatcaaaattctttgtgtgatcaggaggagcagcagaaagcagagaacagagtctgcagttggcaactcctgcagtggttgtgtttggatgaacaggtgggatgt

SEQ ID NO: 74694 - DNA, 100 bp, Mus musculus
gtactgttgaagctttggggggacataggaagatggtatggaatcaatagtttttttcagctggcagtttataaactcctttttctgtagatttctgtac

SEQ ID NO: 74695 - DNA, 96 bp, Mus musculus
gattctttgtgtgtgtgtataatatatatatatgtgtgtacatatatatatatatatatatatatatataatacacacacaaaaatatcttatata

SEQ ID NO: 74696 - DNA, 93 bp, Mus musculus
agttgtttcaggtttgtcttttgctgaacggggagggggttgagggtgctctaggcattttgttgtttacaaagaggcagcttcctaatggct

SEQ ID NO: 74697 - DNA, 68 bp, Mus musculus
gcacagtgtgtctctgacactgtgtgcagacccaagcggtattgattggtgtctatgacaaactgtgt

SEQ ID NO: 74698 - DNA, 93 bp, Mus musculus
aaagtctgaagaggttttgaaaagtgtttgttacagtatgtttctttttcatataaatttgagctttccttttcaaataaatcgacagacttt

SEQ ID NO: 74699 - DNA, 118 bp, Mus musculus
ctcatgttcgttggactaacatatttctttgtgttcagctatccaaaatatttacatatatgtatatatgtacttattcagctgattcttgaaatatctaatgacatacacacatgag

SEQ ID NO: 74700 - DNA, 82 bp, Mus musculus
atggctgcaaacacatgaattaacttgttttaagctactaagttttgcaatggtcaaaatttttcattgtttttgtagccat

SEQ ID NO: 74701 - DNA, 69 bp, Mus musculus
tgtgtctgtgtctgtctgtctgtctgtctgcctgtcaagggcatgtcttagtagaagggcgggggtgca

SEQ ID NO: 74702 - DNA, 81 bp, Mus musculus
gggctgtgagtggtgggggtctgtgtccacagcactgctcagtcacttccactctcagtgttgccctgcatgtttctcaca

SEQ ID NO: 74703 - DNA, 120 bp, Mus musculus
acatatgcaagttttacaaagtataatttcacagaattttttacagtagatagtgagctataagttcttatttattgttgttactcttacagattgatgttatttgggggttttatatgt

SEQ ID NO: 74704 - DNA, 75 bp, Mus musculus
atgtgtatatgtgtttgtgtgtatatatatatgtttgtgtctgtatgtgtgtatgtatgatgtgcatgtgcatgt

SEQ ID NO: 74705 - DNA, 89 bp, Mus musculus
gagtgacatataacctttaagtagcactgagtctatttaaatttctttttagtgggcatttaagtgctttttaaggacagtaatcattt

SEQ ID NO: 74706 - DNA, 69 bp, Mus musculus; identical to SEQ ID NO: 34755

SEQ ID NO: 74707 - DNA, 72 bp, Mus musculus
aagtgaggtcatttctctctctccctttgacccaaagcagcaatgaggagaaatgagtgcagaccctggctt

SEQ ID NO: 74708 - DNA, 106 bp, Mus musculus
caaattcaaagaattatatatgtatatatatatgtgtgtgtatatatatatgtgtgtgtgtttgtgtgtatagtgtacatactatataattatgtatatgtatata

SEQ ID NO: 74709 - DNA, 79 bp, Mus musculus
ccaggatgagcaaagtgtgaggagacaggcaggagcaagcaaccctccattttgtctaccaataccctgtgtttctttg

SEQ ID NO: 74710 - DNA, 84 bp, Mus musculus
ccagaaatgactgaacagagagagcttcattcaacaaaaggaatttgggtccatttgcttcagctctgctcactggacagtcat

SEQ ID NO: 74711 - DNA, 76 bp, Mus musculus
acacacatacacataaatgtatatgtatacacataaatgtatatgtatatacatatacatacaatactatgtatgt

SEQ ID NO: 74712 - DNA, 127 bp, Mus musculus
ccagctggagtttagtggacacgcccgtgtcatgtcatccaggctgtccttgaactcctctctggtcttgctgtctggctgagtgctgggctaacagtgctggcattgacagtgggcactgacaagg

SEQ ID NO: 74713 - DNA, 62 bp, Mus musculus
gccaggactgagagatggctcggtggttaatagcactgactgctcttccagaggtcctgagt

SEQ ID NO: 74714 - DNA, 83 bp, Mus musculus
ttaggataagagtagaatgtgaggactggagaggtggctcagtggttgagagcactgactactcttccagaggtcctgagttc

SEQ ID NO: 74715 - DNA, 62 bp, Mus musculus
gaagcagagagagacacacgaatgctggcacttagcactctcgctcgctcgctctctgtctc

SEQ ID NO: 74716 - DNA, 88 bp, Mus musculus
tcaccactggctggagagactcagcggttaagagcactgactgctcttccagaggtcctgagttcaattcccagcaaccacatggtgg

SEQ ID NO: 74717 - DNA, 62 bp, Mus musculus
cagttggggggtgagcccttgaaggccatactttgcctgtctctgtctctgcttcctggctg

SEQ ID NO: 74718 - DNA, 85 bp, Mus musculus
gtgggaggaggtgtgtcactggggatgggctttaaggtttcaaaagattattgctgttcccagtgtctctccctctgactcctgc

SEQ ID NO: 74719 - DNA, 88 bp, Mus musculus
cagctgttcctggcacactcaggctctgtgaagttctagctttgttgtcttgggccatattgcagagggcgggggcgggggggggatg

SEQ ID NO: 74720 - DNA, 81 bp, Mus musculus
gaagtcaatgctctgtctgcctgtctctcaccatagagggggtttctctaaagggagtggagattggggaaaagagtcttc

SEQ ID NO: 74721 - DNA, 85 bp, Mus musculus
ccccctttgaatatatgtttatcttattggctcctctagagaaccctggccaaggatcctcaagtgacataacaattaaggaagg

SEQ ID NO: 74722 - DNA, 82 bp, Mus musculus
tatgtatatataatatgtatacataatgtatatacatactatatatagtgtgtatatgtgtgtatatatatgtgtgtgtgta

SEQ ID NO: 74723 - DNA, 103 bp, Mus musculus
agcacatgctttaaaaaaattgtatgtatgtgtgcatgtgcatgtgtgtgaacacacacttgcatgtgtcccagtgcatgcgttcaggttaaccccaggtgtt

SEQ ID NO: 74724 - DNA, 85 bp, Mus musculus; identical to SEQ ID NO: 57439

SEQ ID NO: 74725 - DNA, 95 bp, Mus musculus
atgtgtttgggtatcagattgccaggggatagatatatgattattaatctttattgtccaacctgcctgcattcagagtcccataggagacacat

SEQ ID NO: 74726 - DNA, 80 bp, Mus musculus
ttcatgagttttagtcccttgcaggagtgatgctgaaggggaaccctgagcaaaactgactccagagactgagctctgaa

SEQ ID NO: 74727 - DNA, 91 bp, Mus musculus
agatgactctttataggccaggccatttagcttttgtgtgagaggagactttttttttttttagcctagatgctcggtctcttttttatct

SEQ ID NO: 74728 - DNA, 99 bp, Mus musculus
gtgcctatctctgctacatcactctgtctgtctctatgtttatttctataatgaacacagaatctgaaatggtgtggcctttttgtggttcagatgcac

SEQ ID NO: 74729 - DNA, 85 bp, Mus musculus; identical to SEQ ID NO: 57470

SEQ ID NO: 74730 - DNA, 119 bp, Mus musculus
gcagggaagagacctgctatggtgggatggcatggggcctaggggtgatcagagtctgtgtctccctcaaagttgcatgtagaaattgaatctcctgtgtgtgtggttgtggtttgggc

SEQ ID NO: 74731 - DNA, 127 bp, Mus musculus
gtcaatagcttctcaactagcagtgtctcgggaaccctttttccatccacactggaatgttgactggcttgatcttgtacaggtaaccacaggtactgtggccatatcctgtacaaaaacaaaaaca

SEQ ID NO: 74732 - DNA, 101 bp, Mus musculus
gaacactccctgaaggtgctggagagatggctcagtggttaagagcactggctgctcttccagaggtcctgagttcaattcccagcaccacctggtggttc

SEQ ID NO: 74733 - DNA, 85 bp, Mus musculus
tcatctggaccacaaggtgcccacatattcagttaaacatgctgtgtgtgcctgagtgggtgggtctacttagttattaatatgg

SEQ ID NO: 74734 - DNA, 72 bp, Mus musculus
tggagaaaaagcagaaaatggagccaggctacaaaatctcaaggcctagctcacagtaactctctttctcta

SEQ ID NO: 74735 - DNA, 73 bp, Mus musculus
aatgactctgatggatgagtgagtgatgttctaagtaatacgtgtcatctctgtctcactctgtcttgtcatt

SEQ ID NO: 74736 - DNA, 67 bp, Mus musculus
cttccagaacttactggcttcctcagttctgtgtcttagagcctgactgagcaaagtctgctgggag

SEQ ID NO: 74737 - DNA, 82 bp, Mus musculus
atgttatttggcttatgtgtgtgcatgtgtgtgtgcatgtgcatgtgcctgtgcgtgcgtgcatgcgtgcgtgcgtgcgtgc

SEQ ID NO: 74738 - DNA, 64 bp, Mus musculus
tctgtctgcctgtctgtgtgtctatgtgtctgtgtgttcaggacatatttcacaggtacacaga

SEQ ID NO: 74739 - DNA, 82 bp, Mus musculus
atggcccccatagattcatatatttgaatatttgtacataggaaatggtattttaaggaagtgtggctttgttgggggaagt

SEQ ID NO: 74740 - DNA, 114 bp, Mus musculus
tctgctaatgtcaggctttacaacgctgcagtataaatgaccacatttctctctctctgaatttgtaaacgtcttatcaacaacggcatggggtggacgtgtgaattttacaga

SEQ ID NO: 74741 - DNA, 79 bp, Mus musculus
tgagctctgtcagtgagagtttggaaggaataatctctctgaactcaaacttcatccagctctctctgactcagtctta

SEQ ID NO: 74742 - DNA, 95 bp, Mus musculus
gtcccttcggatatcgggacttgtgtggccaagaccaatgtgaggcatgggtagggtcgcccatctgtctctctgtccgcggggctcgagatccc

SEQ ID NO: 74743 - DNA, 66 bp, Mus musculus
agctggctgtctctgacttgacatgggtggtcagttgcacttactgtctgtctgtctggccacgct

SEQ ID NO: 74744 - DNA, 62 bp, Mus musculus
gagtccagactaggagttgaagggtggtgactacaaagactgtctgagtctctgtctggctc

SEQ ID NO: 74745 - DNA, 87 bp, Mus musculus
tcgtttaggaagtggggcctctctgaaggaaggggaacactacaaacttgcccttattccagtctcagtctctctgctttctaagga

SEQ ID NO: 74746 - DNA, 77 bp, Mus musculus
ccagagggtaggctcaggtagaaggttgatagtaccactctggtatcttcatctgtctttgactgtctccatgttgg

SEQ ID NO: 74747 - DNA, 121 bp, Mus musculus
cccagctaattcctctccttctccctaagccatcactagtctgtgtctacagattttcctgttctggacactttagaaatgcttacgtcgtagaatataaaatcaagcagggtgtggtggt

SEQ ID NO: 74748 - DNA, 99 bp, Mus musculus
accctgttactgaacttgaagactcctggtccatccacatctctccagtctgactctgactctttgattcccagcattctcagggttagtcatcagggt

SEQ ID NO: 74749 - DNA, 126 bp, Mus musculus
tgtgtggatgcatgtgtggatgcctgtgtagatgtgtacaaaatgtgcatatgtatatatgtatgtgtatgtgtgtatatgcaagtgtgtggtatacatatatgtgtatgtgtatacatgcatatg

SEQ ID NO: 74750 - DNA, 82 bp, Mus musculus
gtggtttcctgacagcccaccaaagggagctctcttctctgagactgcaccctggtggtgactgtggtcttgggttgaccac

SEQ ID NO: 74751 - DNA, 118 bp, Mus musculus
atccaggttgcttctatggctattccatcttatgctcttgggtctctctgatggtgacagaggtgacagaggacatcagatgactttgatgaacacagatccagtcaactggcaggat

SEQ ID NO: 74752 - DNA, 83 bp, Mus musculus
gagggagagagagagagagagagagggtgcggttattatgggggttagaggacaacttcagaaatctcttctttttctacctt

SEQ ID NO: 74753 - DNA, 86 bp, Mus musculus
ggtatttgcttcactgatgtagccctggtgcaaaatcctcagtggaattttgtctggcttgagcttgcacaggtcttgcgcatacc

SEQ ID NO: 74754 - DNA, 71 bp, Mus musculus
gcttcagttgggtgtgagctcaggggtggaacctgcccaggcgccaagctgctgtacacaaccttgccagc

SEQ ID NO: 74755 - DNA, 117 bp, Mus musculus
gaatccttgagaacaccaggagctgctgtagaaccataggaaagagcacagagagagcagaggggcatgggatggcagaagtgatgcttctcctggcacttcacctcaggaacattc

SEQ ID NO: 74756 - DNA, 95 bp, Mus musculus
taggaggcacagcctaggtagatcagaggaggtgtgcccttgaagaagatattgggacccttgtctgtctgtctgtcggtctgtctgtctgtctg

SEQ ID NO: 74757 - DNA, 69 bp, Mus musculus
gtaccaggaatgtctgagacacacagtctgggctgccagcatttcccagtgtttcaggatcctgaaggc

SEQ ID NO: 74758 - DNA, 87 bp, Mus musculus
atgcttctccttgttctccaggtccctctcacacactgactgtctcaccttgtcttagggccctggggacatcaggcgcccaagtat

SEQ ID NO: 74759 - DNA, 80 bp, Mus musculus
gtgtgtggtgtgtgagagagtcagagaggctccatggagcaggtgtctgagcacactcagtctcactcagagttagacac

SEQ ID NO: 74760 - DNA, 74 bp, Mus musculus
tcctagactgggcaggaaggggaaagggacttggtaccagcactcactgctctctctctctccccaggctgggg

SEQ ID NO: 74761 - DNA, 69 bp, Mus musculus
aggcctgtttcctgggagagcctggaatcctataactgataaggatacagagacagaagagacagggct

SEQ ID NO: 74762 - DNA, 89 bp, Mus musculus
agacagcccacaaattttgctctgcctgcctctcttctacatctgaagcaatgtagagaagtatgcagcgcatggcatgcatggtgtct

SEQ ID NO: 74763 - DNA, 141 bp, Mus musculus
tatatggcagtgtgtgtatatatatatatatatatatatatatatatatatatatatgtatatgtaatgtgtttatataagtatatatatgtgcatgtatatatgtatatatgtgtatatatatgtgtgtgtgtgtatata

SEQ ID NO: 74764 - DNA, 85 bp, Mus musculus
gcctacacctgtgtgacactgactcagaaaatctaaactaaaaagatttaaaagcatggagggtctgagggtgtagctcagtggc

SEQ ID NO: 74765 - DNA, 85 bp, Mus musculus; identical to SEQ ID NO: 62895

SEQ ID NO: 74766 - DNA, 146 bp, Mus musculus
gttacgagattacaagtgtaccatcaccattcagagtctgtatttaatttttaaaaaaaaatgctttatggggctggagagatgggtaagtggttaagagcactgactgctcttacagaggtcctcagttcagttctcagcaagta

SEQ ID NO: 74767 - DNA, 66 bp, Mus musculus
acagagttcaaggtcacccttagctatctaaccaattagagccagcctggctgcctgagaccctgt

SEQ ID NO: 74768 - DNA, 112 bp, Mus musculus
atgtgcagtcaaagtcatcacctatgtgtgcctgtgtctgtctgtgcctgtgcctgtacaggcagggcaaaggctgaaaggttaagcaacactgtgactgttggttcctcgt

SEQ ID NO: 74769 - DNA, 69 bp, Mus musculus
gcacacacacaaatgtggaagtcagcgggctgtgtgtggtcagttctctccttccacatttatgtgggc

SEQ ID NO: 74770 - DNA, 97 bp, Mus musculus
tcatttctggcagttctctgaagtctgctcattgtttttggtttcccagttgggaatatcatagggtaaatagggcaactgagttttgcatcaatga

SEQ ID NO: 74771 - DNA, 74 bp, Mus musculus
taccattaggtgtgtacatatgtatgtgtgcatgagcgtgagtgcacacgcacacgtgtgcgtgcatgtgtgtg

SEQ ID NO: 74772 - DNA, 115 bp, Mus musculus
tgcctctctgcctctctgcctctctgcccctctgcccctctgcctctctgcctctgcctgcttccagagtgctgtggttagacaggcaccatagcctggcaggcatcaaggccga

SEQ ID NO: 74773 - DNA, 59 bp, Mus musculus
gtctgtctctctgtgtgtgtctgtgcactatggtgcatgtgtggaggtcagaggacagc

SEQ ID NO: 74774 - DNA, 114 bp, Mus musculus
gtggagtaacagagaggggaagggaatcacccaggtgcatatagctagagttccaatgcaaagtgtctgtgtgtctgtctgtctgtccgtccatccacccatctccctacctat

SEQ ID NO: 74775 - DNA, 65 bp, Mus musculus
tagagagggtctctcactgactcagtgggcctggctggacagtgaacttcagggatccatctctg

SEQ ID NO: 74776 - DNA, 67 bp, Mus musculus
gacaggccggcagatgatcccttcagtattgtcattggacactctgactgactatctgcagtgtgtc

SEQ ID NO: 74777 - DNA, 74 bp, Mus musculus
gggaggggggtcagtgcatggagagaggcaaaaggtcacaggtagctgtctttctctgccactctctctctgcc

SEQ ID NO: 74778 - DNA, 60 bp, Mus musculus
atgtatgtatgtatgtatgtaggtatgtaggtatgtatgtatgtatgtatgtatgtgcat

SEQ ID NO: 74779 - DNA, 85 bp, Mus musculus
aggaacacagcatgagttacagcaccctactgagtgaccagttaaagtgtggtcagaacagagtcagcactcatctgcaggtcct

SEQ ID NO: 74780 - DNA, 82 bp, Mus musculus
gaaaacacacacacacacacacacatatatatttcattatttatgaatgcgcatgtctgtgtgtgggtatgtgcctgttttt

SEQ ID NO: 74781 - DNA, 114 bp, Mus musculus
gaatgaatgacgggaaggggagtggaggtgatatatgtgtgttattatatattatttatatataatacattgcatatgacatatgtatatgtaacttttttggttttttggttt

SEQ ID NO: 74782 - DNA, 110 bp, Mus musculus
ggaggatttggtggtgaatatggttaacatacatgatatattttgtaaaaaacatcttaccaaacctatctattgctgaggacataaatatatgccaataaaaatccttc

SEQ ID NO: 74783 - DNA, 73 bp, Mus musculus
gtctgtcagtctctctgtctgggtttgtgcacatgcatgcagtgcccacagtggccagaagggggcagaagat

SEQ ID NO: 74784 - DNA, 93 bp, Mus musculus
cttagatatgaaactattaaatgcggctagagagatggctcagtggttaagagcactgactgctcttccagaggtctttagttcaattcccag

SEQ ID NO: 74785 - DNA, 98 bp, Mus musculus
ggagaagggccatggaaaaacactgaatatagagagcagttttaaatggaaacattttgttcctttgcttacattgttgttgaaaatggttttacttt

SEQ ID NO: 74786 - DNA, 81 bp, Mus musculus
gtccatgagcaaagatgaaggtcaggggagaatgttgggtctcctctgtgactctctgcctttattcttttgtgttgggac

SEQ ID NO: 74787 - DNA, 87 bp, Mus musculus
gagattactatatgtatgtgtgcgcacatgtgtacatgcatgtttttatgtgtatataacttgtggatatgtatgtgtgtgtgtctc

SEQ ID NO: 74788 - DNA, 78 bp, Mus musculus
ttcttgtgtgtgcatttagtggcaggctgtggggtcctttggaacccatgagtgtctgtctgtgtgtattgacatgaa

SEQ ID NO: 74789 - DNA, 81 bp, Mus musculus
gaagtgggtaagggtggtctggagagagagtttagaggttacaagaactgactgctcttccagaggtcctgagttcaaatc

SEQ ID NO: 74790 - DNA, 93 bp, Mus musculus
acctccaggaatttgaggccagcctagtctacatagtgtgtctcaggccatcctggaccacacactgagacactgtctaaaagagatggaggt

SEQ ID NO: 74791 - DNA, 57 bp, Mus musculus
gtaagcctctgtgtgtctctgacccccagcactggggtttgagatgtggatggctac

SEQ ID NO: 74792 - DNA, 139 bp, Mus musculus
gcctcctccaggcttcacctttccttctctctttgcttcctactgcagtgcctgggtgcagagacacaagagagtcagctgcagggtcttctagtctcgatgaggggtgcagtgagatggcagatttggctcctcgcag

SEQ ID NO: 74793 - DNA, 85 bp, Mus musculus; identical to SEQ ID NO: 57439

SEQ ID NO: 74794 - DNA, 89 bp, Mus musculus
ggtgccttttcacaggtacaagttcacctgtgcctatgtcctgcagactgatgaatggtcaggtgactgaacactgtgtgctaggtgcc

SEQ ID NO: 74795 - DNA, 75 bp, Mus musculus
gtgtgtgtgtgtgtgtgcgctcatgcacgtgtgcgtgtgcatttgtgtgtgtgagagagagagacagacagacac

SEQ ID NO: 74796 - DNA, 80 bp, Mus musculus
tgatttggagattggagatcagtttgtttcattaccagtcaacagaaaattgactgaacagacatacctccctccagtca

SEQ ID NO: 74797 - DNA, 112 bp, Mus musculus
gtcatccctctatgcacagagttaaaactaaaataagtcttctatatgtttatacatttattagtgaagatgtagagatttattgcttggttatcaaattgggagtaatgac

SEQ ID NO: 74798 - DNA, 107 bp, Mus musculus
cccaggattgcaactagaggtgtgaatctgaagatagagagcagaggggataatgtggacctcattgctgcttggtttgtgactgtcccaccaggcaggggattggg

SEQ ID NO: 74799 - DNA, 100 bp, Mus musculus
tacttttacgacatttttctagtccattgttcttcaataagcttgaatggcttaaattttggggtgcacagtttctgggacatgtctccatttttaggta

SEQ ID NO: 74800 - DNA, 78 bp, Mus musculus
gcatgtatggtttgtacacagatatgagtgtgtgcagatatgaacacttgtgattcatgtacagatgtgagtatgtgt

SEQ ID NO: 74801 - DNA, 71 bp, Mus musculus
actggttagtcagtctctttgtgtctccatctcttcatctgcaaatggggacaatgaaactggcctctagt

SEQ ID NO: 74802 - DNA, 83 bp, Mus musculus
aatgtgacatggtgttcagcctcagtgcaagtattttggtggatttcagagcacggcagctggggctgtcagtcagtcacatt

SEQ ID NO: 74803 - DNA, 81 bp, Mus musculus
tttcttgggctctcattttctctgtgacaattcacctgaattgagtcaaagagagagggaaagttcactttttggtggaaa

SEQ ID NO: 74804 - DNA, 88 bp, Mus musculus
ggggaagaggagcgccaaccccctgtcccaccccagaaaccgaatggcttctggctcagtctctctctcctcacagatcaatttcctc

SEQ ID NO: 74805 - DNA, 126 bp, Mus musculus
tctcggctttctgtctccacacactgatgaatggtggatgcctctctacaggaaccagacagtcagtgtctcagatctagcctggatgctgatgatactagatactgtgactcatcctctctcagt

SEQ ID NO: 74806 - DNA, 84 bp, Mus musculus
ttttagatgtgttcctggatttggtttgagagtattttattgagtacttttatatcaatgttcataagagaaatcagtctgaag

SEQ ID NO: 74807 - DNA, 100 bp, Mus musculus
gcatagtcctagttgtagagctatgaatgaacttgttactcacggagtctcactctgtgagtctctgtcgctctcctgctcagcatttgggatcctgtgt

SEQ ID NO: 74808 - DNA, 118 bp, Mus musculus
ggaataggcttgggagaattatagtcaacaggtataaagtcctacaggagacattttcttgttttaagaagagtgatgtgggctgtagatgaggaccaaagtttgtatcccagcaccc

SEQ ID NO: 74809 - DNA, 83 bp, Mus musculus
cacagtcaaagcagggccagtcactcagtcgctctgctttcacagctggtctgtaatctggtggctggcttcagttggctgtg

SEQ ID NO: 74810 - DNA, 88 bp, Mus musculus
gaccaaggattgaatttttacctcgtttgctcctcagtgatgcagggcaagtcacagagcacagaggggagtcaagagagacttggtt

SEQ ID NO: 74811 - DNA, 116 bp, Mus musculus
agacaactggacatagcactgacctataaatatagcagaatatcattaggaatcaatatttatttattgactggcatgtttggttctaccctaggtctctaggctatctagtttct

SEQ ID NO: 74812 - DNA, 112 bp, Mus musculus
cccatctcaagagctttggaaagacattgtccccagatgccaacttgagaatgactcaggctgactctctggcttggggtttgtcgttcagtggtcttcgaacttatatggg

SEQ ID NO: 74813 - DNA, 85 bp, Mus musculus
gtccattgtggtctgataggatgcatgggtcaatttcaatatttttgtatctgttgaagcctgttttgtgaccaattatatggtc

SEQ ID NO: 74814 - DNA, 87 bp, Mus musculus
gatacaaagtcaggcttggtgacacatgctcataattttaactactcaagaggctgaggtaggtgcttgtggagctggacctgtatc

SEQ ID NO: 74815 - DNA, 93 bp, Mus musculus
tctttcttcagtgtcttaaagttttttattatacaaatcgatcacttgcttgattagttattccagtatattttttgaggccattgtgaaaga

SEQ ID NO: 74816 - DNA, 87 bp, Mus musculus
ttgaaattcggcttcttgggctggagagatggctcagtgattaagcgtactgactgctcttacagaggtcctgagttcaattcccaa

SEQ ID NO: 74817 - DNA, 70 bp, Mus musculus
tctatctatctatctatctatctatctatctaatcaatttagagtggtaggaaggtctgggaaagatgga

SEQ ID NO: 74818 - DNA, 109 bp, Mus musculus
cagaatatgtaaatgatgcttagattcaacaatacactttgatttttttaataaactaaagatttgagcagatcaaagatggcagataagtacatgaacatgtattctg

SEQ ID NO: 74819 - DNA, 75 bp, Mus musculus
ttctgattggacatgtggtcatcagtgatggggcagatgaaatagccctcatcatcgtcactgtctgtgtcagag

SEQ ID NO: 74820 - DNA, 65 bp, Mus musculus
aggttgtcaggattgatgggaggtgcctttacctgctggggcatcttgtcagctcctaataatct

SEQ ID NO: 74821 - DNA, 89 bp, Mus musculus
gctgggattacagagttgtgagctgtctgagctgtagctgtctgagctgactgagcacagtctcttaactactgagccatcccataagc

SEQ ID NO: 74822 - DNA, 57 bp, Mus musculus
tggcctcacaggggagagagagcagcagagctagctgtcactgtcactgtcagtcca

SEQ ID NO: 74823 - DNA, 91 bp, Mus musculus
tccagtctccgcctccccatctctccatagaggagctagtgttagacactcacactctatgtccagcttctatgtgggcgctgggattgga

SEQ ID NO: 74824 - DNA, 107 bp, Mus musculus
tggggagtacaaagccagcctgggctataagaagacccagctttttattttttttaaggacaagaaaaggaactagacttgtagctccatggtacagggcttctcca

SEQ ID NO: 74825 - DNA, 68 bp, Mus musculus
ctgttgtgtcccagtgtctgagtctgtgtgtacgccaggactcgggggtgagggtgggggcgctgcgg

SEQ ID NO: 74826 - DNA, 130 bp, Mus musculus
tacatttatgtatctatgtatctatctttatgtatatgtgtatatgtatatgtgtatgtgtgtgtgtgagtgtgtgtgtatatatgtatatgtgtatatatgtgtgtgtgtgtctatatatatatatata

SEQ ID NO: 74827 - DNA, 72 bp, Mus musculus
gaccattgagtctttcattgagtttttgttgatgtcaacactaatgacacagagatgaacagagctcaggtc

SEQ ID NO: 74828 - DNA, 85 bp, Mus musculus; identical to SEQ ID NO: 57470

SEQ ID NO: 74829 - DNA, 135 bp, Mus musculus
gtgtatgcatgtgtatgtatgtatttgtatgtgtgtgtgcgtgtatgtatgcatgcatgtatgtgtgcatgtgtatgtatgtatatatgtgcatgtgcgtatgtaagtatgtatgtgcatgtgtgtgaatgtatg

SEQ ID NO: 74830 - DNA, 91 bp, Mus musculus
ttccgtatgagcaggcataccctaccagatctcagtccatctctgactaacaatgagaagtctgccattgcttagtgctaatgatatggaa

SEQ ID NO: 74831 - DNA, 102 bp, Mus musculus
ccacgtgcactgtgtaagctgtttcgtgtcttcggagatgcctgtgactcaatcacactctgagggtctctaagatgtgaaactggccaagtagcagcgagg

SEQ ID NO: 74832 - DNA, 115 bp, Mus musculus
gagttaagactcatctgtggggctggggagatggctcagtggttaagagcactgactgctcttccagaggtcctgagttcaattcccagcaaccacaaggtggctcacaaccctc

SEQ ID NO: 74833 - DNA, 83 bp, Mus musculus
cccaagggcacactctaaattctgttagtaaactgtacaaattttatcaacttctgaatttgatgtcgtgaaagtccctcggg

SEQ ID NO: 74834 - DNA, 118 bp, Mus musculus
agaggacagccttcctcaggctttgtctaccttgttttgagacagtctcactgacatccttgccagttaggctaggatggccattgagtctcaggtatctgcctgactgcctgcctct

SEQ ID NO: 74835 - DNA, 97 bp, Mus musculus
cagggaaatgaggcttcactagaggaagcagtcgttgggacgggaccttgcttctactcactcactgtctgtctgcctttgttggcacctgaccctg

SEQ ID NO: 74836 - DNA, 84 bp, Mus musculus
gccagtgagacactctgtcttactagcttactcatcaatgaaatggggctggagagatgaggcgtagtggataaagtgtttggc

SEQ ID NO: 74837 - DNA, 113 bp, Mus musculus
gccatgtatatgtatgtgtgtgtgtatatatataaatatatatatatatatatatatatatatatatatgcctcatatgtatgtatgtatatatgtatgtatacatgtatgta

SEQ ID NO: 74838 - DNA, 109 bp, Mus musculus
gaagtacttgctctctttgtagcccacaggctcctggtgacccataaccctgcagtgtctctgtgtgtgtcttacccagtctgcgtgtttcactgagtagaagcccttc

SEQ ID NO: 74839 - DNA, 105 bp, Mus musculus
tccaaatatctggggggaaatgtttggtttaaagctagaacaaggggataaggatgtagcttggttagttttatgtaaacttgacacagtcgtctgagaggtggg

SEQ ID NO: 74840 - DNA, 58 bp, Mus musculus
ggccaggaagtccagagcaggggctggaagccgctgtctcactgtgtctcactgtgtc

SEQ ID NO: 74841 - DNA, 104 bp, Mus musculus
gtagtgtagagacatgcatataggcaaaacacccacgcataatttttttaattatgtcaatcaagtttgcctatggccatgtcagtaagtcatttctaaattgc

SEQ ID NO: 74842 - DNA, 102 bp, Mus musculus
tgtcacattgatgattatagttgtgactctgtgtcacagtaagcaggtataactgtgtgtctctgtcacagtaactggttatagttgtgggtctctgttaca

SEQ ID NO: 74843 - DNA, 109 bp, Mus musculus
tcttatcaactttgattggctcgagaagcatctagattagtggagctcacctctgagtgagtctgtgggtgcctccaaagctaattcacagcatgggagttctgatcta

SEQ ID NO: 74844 - DNA, 96 bp, Mus musculus
tctgtctgtctcctcaggagctgaggcatgtgctccttgctctgactctcacacactggatacagtgccaagcgtttgggggtaactgattataga

SEQ ID NO: 74845 - DNA, 80 bp, Mus musculus
ccttattgatattagagaacagatgcctttggtatgatagcagcatggtggttattctaacagcatcttcatctgtgagg

SEQ ID NO: 74846 - DNA, 84 bp, Mus musculus
ctgactgattgattgatgtcacagaaatcactacggatctattaaacacagttgtgtgtgtgtgatgtcacagaaatcagtgag

SEQ ID NO: 74847 - DNA, 71 bp, Mus musculus
ctgggcttcaagagactcgttgtcattcagtggctgtgtgccccaagtcacgtactgtctcagtgactcag

SEQ ID NO: 74848 - DNA, 60 bp, Mus musculus
agttgttagacagtacgtgtgggacatggtcccgcacgcacactcagtctgtctgttact

SEQ ID NO: 74849 - DNA, 79 bp, Mus musculus
gtccccaagatgctgtgacactctctctctttgctggttctatctagagagggaaagccttgtgctagactgtgggagc

SEQ ID NO: 74850 - DNA, 85 bp, Mus musculus; identical to SEQ ID NO: 57439

SEQ ID NO: 74851 - DNA, 108 bp, Mus musculus
tgtagctcagttatcagagtcctcacctagtgtgcatgagttctgattttggtctctagcattacgtaaaccaggcataaaatttggggctcaggtggtagaggtaga

SEQ ID NO: 74852 - DNA, 107 bp, Mus musculus
gttgaacattccagattaataccaaatcaatcttcctagaaagtccagcagagacacactctctctggatccttctggaaatgtgtgggattatatctggtttaaac

SEQ ID NO: 74853 - DNA, 90 bp, Mus musculus
aagtgtgtgtgactgtgccaggctctttacatgagttctggggattgaactcaggtctcaatgcttgcctagcaagcactttagcaactt

SEQ ID NO: 74854 - DNA, 80 bp, Mus musculus
catttgaaatgtaatgtagaatcagggtcctttgggacctggctagagtgaccatgtggttccaggaacagtgccaaatg

SEQ ID NO: 74855 - DNA, 69 bp, Mus musculus
ataaatacacagctgtatgtatgtatgtatgtgtgtgtgtgcgaatatgcaggtacagtgtggatttgt

SEQ ID NO: 74856 - DNA, 58 bp, Mus musculus
gtatgtatgtatgtgtgcatgtgtatgtgtatatacacataaacatatacgtagaggc

SEQ ID NO: 74857 - DNA, 77 bp, Mus musculus
gcatatcaaatatttttttttgagacagggtctcatgtagttcgggctggtctcaaactagttgggtatttgagggt

SEQ ID NO: 74858 - DNA, 75 bp, Mus musculus
tctatctatctatctatctatctatgtacgtacgtatgcatgcatgcacgcacatgtaagaggatagtttgtggg

SEQ ID NO: 74859 - DNA, 190 bp, Mus musculus
atatatgtaagtcatatatgtatgtatatatacatatatatatgtatatataaagagtatacatatatatacatatatgtgtgtatgtatgtatatatacatatatagagagtatacatatatgtgtgtatatatgtgtgtatgtatatatgtgtgtgtgtatatatatatatatatatatatatatata

SEQ ID NO: 74860 - DNA, 114 bp, Mus musculus
gccttgtctagcctcaataggagaggaggtacctagtcttactgcaacttcatatgccatggctggttgatatccatgggaggcctgacctttactgaagagaaagagaagagt

SEQ ID NO: 74861 - DNA, 110 bp, Mus musculus
gctgtgtgttttgagaaatctctttccacatgttgccagtctgtgattctctgaatctgtttctgtctgctgtaggaggattcttctctgatgataagcgaaaaacacac

SEQ ID NO: 74862 - DNA, 86 bp, Mus musculus
tgcctggattgaggaacttctctgtgtcactctttgcctgagaaagaatgcaatgaaatttagaatggtttcttattctccatgca

SEQ ID NO: 74863 - DNA, 118 bp, Mus musculus
aacagccacaaaataacggagaggtgcagaacagcaagagccagtcaggtgagtgaagacagttctgacagaactcactggcagtgagggaatgttgtcatctatagtttgtggtgtt

SEQ ID NO: 74864 - DNA, 105 bp, Mus musculus
gtatacttcatttacacttggaatgttgaccggcttccccaggacaaacagcctgcctgcctgcctgcctgggatttcaaggttctcactgtgaaacgtatgtac

SEQ ID NO: 74865 - DNA, 74 bp, Mus musculus
ctgctctctgtgggtgtgactggctgcgtgtatataagagctctatgtgcttgcctggtgccctaggaggccgg

SEQ ID NO: 74866 - DNA, 92 bp, Mus musculus
tgtctgtctgtctgtctatcctgtctgtgtatgtgtgtctctgtgtgtgttgtgttatggatcagattcagggttttgcaattagacaaaca

SEQ ID NO: 74867 - DNA, 57 bp, Mus musculus
gggagagtctttcctatgagtcttggattcccagggtctgtgtgtgactcccatccc

SEQ ID NO: 74868 - DNA, 92 bp, Mus musculus
tatatgcagcaatacagagtgattgggagggagaagagtctgtgcatagtaggttcttggaacttaaacaatccttaatattattgtatgtg

SEQ ID NO: 74869 - DNA, 128 bp, Mus musculus
ggttttaatttttttaatgatttttaaaaattttacatgcattggtgttttgtcagcatgtgtatctgcatgtagatctctggaaatggaattatagatagttgtgagccgccatgtgggtgctagga

SEQ ID NO: 74870 - DNA, 72 bp, Mus musculus
ggtgtgacctggttggagtaggtgtgtcactgtgggtatgggcttaacactctcactctaagtcagtcttcc

SEQ ID NO: 74871 - DNA, 107 bp, Mus musculus
tctgtgtgttctacatgtaactgtgtctttgtgtatgtgtgtatatctgtgtctatatgtctgacccacacaaagagctttgttctatatttactgaacaccacaga

SEQ ID NO: 74872 - DNA, 104 bp, Mus musculus
acctgtctctgctctgctcccaggaccaggattttaagaacatagcactatatcaagttttctgtctctgtctctgaaatgggttctgaggattgaattcaggt

SEQ ID NO: 74873 - DNA, 119 bp, Mus musculus
gtatctagcttgggccaagcacatgtagcagacactgtcagtatgaaagagatgaacagtgattttcttcttaagaatttgcagtgtaattggggcaaggtggcaaacatagaggcaga

SEQ ID NO: 74874 - DNA, 100 bp, Mus musculus
cattagcatgtgaagctgtttggggggggggggggaacacacacacactatgtgacacactgtagcttccagtgctgctatgacaagcaaacatgtgatg

SEQ ID NO: 74875 - DNA, 61 bp, Mus musculus
aggataggaagggcagcagcagagtttatgtggctcttgctgtgtgcctctctctcatcct

SEQ ID NO: 74876 - DNA, 79 bp, Mus musculus
gcctgagaggaaggccagaggcaggatagctttaatagaagaggaggtgcctagtcttactgcaacttgatgtcatggc

SEQ ID NO: 74877 - DNA, 76 bp, Mus musculus
ggatatatattcatatgtaatgtatgtatatatgtacacacacatacatgtatatgtatgtatatatgtataatct

SEQ ID NO: 74878 - DNA, 85 bp, Mus musculus; identical to SEQ ID NO: 57439

SEQ ID NO: 74879 - DNA, 85 bp, Mus musculus
gctggaagaagtgtgtcactggggtggacttcaaggtctcagatgctcaagtcaggctcagtgtctctctctatcttcctgttgc

SEQ ID NO: 74880 - DNA, 79 bp, Mus musculus
ttcctggatttggctaacatgactggtcagcaagctccagggatcttggtgtctctgtctcagtctcagcctccaggaa

SEQ ID NO: 74881 - DNA, 75 bp, Mus musculus
tattgatgagagcatttccgaagccagctgttcgaagcagcatgtgcagcaggagagagtgagctctcatccata

SEQ ID NO: 74882 - DNA, 82 bp, Mus musculus
accttaataatgtttctttttatgaatgtagttgcctttgcacttggggcatagatgttcagaattgagacatcatcttggt

SEQ ID NO: 74883 - DNA, 114 bp, Mus musculus
ttcacttatattcgggaagcaggtgtggtcacatggacctagatggcgccctggaccattgtcaggctccgtgaatcccacatgttactgccttgcccgagcatgcgcagtgag

SEQ ID NO: 74884 - DNA, 74 bp, Mus musculus
tgcagaagtgctcgctcgtgatgcagttctggtccaaatccgaaggtctgagaacagagtgagcttatgctgta

SEQ ID NO: 74885 - DNA, 77 bp, Mus musculus
agaaatacccttcctgtcagtgtcaatgactctgagataatcagagatagcactgtctgggagatgaaggtgtgtct

SEQ ID NO: 74886 - DNA, 95 bp, Mus musculus
gctgtatgtggggctggtaagatggctcagctgttaagagcactgactgctcttccagaagtcctgagttcaattcccagcaaccacatggtggc

SEQ ID NO: 74887 - DNA, 73 bp, Mus musculus
tgtcctcatgagagcctgactaaaggaccagagaagatctctattctgtagacagcttgctttgaagaggaca

SEQ ID NO: 74888 - DNA, 85 bp, Mus musculus
gaattctgagtgatttgagtgagatgtacacacatgcatgtgcatgtgtatagtctgttatttcatcagtcactttccatgattc

SEQ ID NO: 74889 - DNA, 84 bp, Mus musculus
gtgattcacagtggcagaaagtgatagatcatcccccacaccatctctgctctgtctttcactcactcctgccctgctgctcgc

SEQ ID NO: 74890 - DNA, 82 bp, Mus musculus
cagctcctctttagacctttgtggtaccacttgtttaagtatgagatggacacacagtctcactgttaatgaagagaagttg

SEQ ID NO: 74891 - DNA, 83 bp, Mus musculus
gcacagatgacattcaggtgtcacttgtttctgtaaatagctgtttatgggaacatgaccactgccactcactatgtctgtgt

SEQ ID NO: 74892 - DNA, 82 bp, Mus musculus
caagctgtcagtggctctcacagcctgtagcttggtgcccagtaaaggcacaaatgttatagttgtattgtcctagcacttg

SEQ ID NO: 74893 - DNA, 85 bp, Mus musculus; identical to SEQ ID NO: 60144

SEQ ID NO: 74894 - DNA, 63 bp, Mus musculus
gcacttgtatgtgagcatctgcatgtgtaagaatacacatttacatgcatctacatataaggc

SEQ ID NO: 74895 - DNA, 88 bp, Mus musculus
tgattaatctgagttttttctcacttcccacacagaatagactctgagctgtcaacctgctgggagagtgaagaattctcttacttca

SEQ ID NO: 74896 - DNA, 135 bp, Mus musculus
ggagcctgattctggcagctaaagaaaagtggaagactccagaagttcacatggcagacagactctggctctgtgatgggaagacggtagctctctgtggcatccaatgcctgacacacagcttttgtgctgcca

SEQ ID NO: 74897 - DNA, 85 bp, Mus musculus; identical to SEQ ID NO: 58391

SEQ ID NO: 74898 - DNA, 68 bp, Mus musculus
gtgtgaatgtgtgtgtatatacatatatatatgtatgtatgtatgtatatataggaatacatttatat

SEQ ID NO: 74899 - DNA, 60 bp, Mus musculus
acatatacaaacatataatatatatgaactacatatatatgtatatgtatatgtgtatgt

SEQ ID NO: 74900 - DNA, 103 bp, Mus musculus
ggggtaaatgtctcttctgcccaggctggtccctctgacacactcttactctcccgagagggttttgtttcaggattcttcgcctttgatcgattttcactcc

SEQ ID NO: 74901 - DNA, 79 bp, Mus musculus
tcctggtttatagacactgtttttttctgtattcttacaagagagaagtcagaaggtctctgggctctttttagaagga

SEQ ID NO: 74902 - DNA, 85 bp, Mus musculus
tgtagatgtgtgtgcatgtaattgtgtgtatgtttatatgtatatgtgtaagcttacatatatatgcatgtgtattgtgtttaca

SEQ ID NO: 74903 - DNA, 147 bp, Mus musculus
gccaaagcaatatgtatgtgtgtgtgtctgtgtctgagtatacatgtgttcatgcatatgtgtgtatgtttatatatatatatgtatttatgtgcttgcatgtacatgtgtatacacactcatgcatatgtatgtttatgggtgtgc

SEQ ID NO: 74904 - DNA, 106 bp, Mus musculus
tcatggcctctcactgagccatcttcccagctttttgaagcagagtctctcactgaatctggagtccattggcttggctgcagtggtaaccagtgagctgcagtga

SEQ ID NO: 74905 - DNA, 78 bp, Mus musculus
ggtgtaaaatctcttttgaggatgtattggtggggtctaggtgcccgtccccagtcagttactctctgtgttttgacc

SEQ ID NO: 74906 - DNA, 115 bp, Mus musculus
ccagggtgaagatggcaggattcagtgcttgcatttattgtacccatgagatgctgagacatctgagtgtgcacggccaagctgggggcactgatctgaggtcaagtgactttgg

SEQ ID NO: 74907 - DNA, 139 bp, Mus musculus
ggctaggaaggagctgctctgggatttgaatggagattgtttgagctcatccttccaggccactctgtctccctgtgagacttgctactcttggtgggatgtaggaagctttgtggggggtacaaacacatgccatggg

SEQ ID NO: 74908 - DNA, 89 bp, Mus musculus
ggctacccagctatgtctaaaacccagagtgctggtcacactcatagtctctggaaaagatggtcaagttaaaagagcttgggctagcc

SEQ ID NO: 74909 - DNA, 83 bp, Mus musculus
ttgcgaatcctacctgggcagcctgttcagctttatctgtcttgcctggcatttacttctctcaggctctcagtctggtgcag

SEQ ID NO: 74910 - DNA, 81 bp, Mus musculus
atgacacactcacacagtgacacccccccctctttttcttataaaaacagaagggggggataacaatgtatgatccgtcgt

SEQ ID NO: 74911 - DNA, 290 bp, Mus musculus
tgtgcatatatatgtatatatgtgtgtatgtacatgtatgcatatatagtatgtgtatatatgagtatatgtatatgtgtatatatgtgtatatgtatatatatgtgtgtatatgagtatatatatgtgtgtatatgtatatgtatatatgtgtgtgttgtgcatgtgcgtatatatacagtatgtatatatgtatatatgtgaatatatgtgtgtatgtatatatattgtgtgtatatatatatatatacatgtctgtatgaatgtgtgtgtgtgtgtgtgtgtgtgtg

SEQ ID NO: 74912 - DNA, 56 bp, Mus musculus
ctgcctgtctgtctgtctgtctgtttctctcaacagacagacagacagacagacag

SEQ ID NO: 74913 - DNA, 94 bp, Mus musculus
ggaatatatatatatatatatatatatatatatatatatacacacacacacatatacatatatatgtatatgtatatatcattgtatataatct

SEQ ID NO: 74914 - DNA, 56 bp, Mus musculus
tatatacaatgatatatacatatacatatatatgtatatgtgtgtgtgtgtatata

SEQ ID NO: 74915 - DNA, 72 bp, Mus musculus
tctggatgctcctgagcactggatctgcagacttggttttgccctaggcacagtactcacagagcacctaga

SEQ ID NO: 74916 - DNA, 79 bp, Mus musculus
accttcttcattgagtgagcagccatcgatgtggccctgggcctctctgggtctctgtttcttgatctgctaagtaggt

SEQ ID NO: 74917 - DNA, 120 bp, Mus musculus
cagcccactgtgtccttagacccattgcagatgaagagagggccttcccagccagcctgtatgcctgcccagggcagcccctcagtcctgtagctgagcgacagcacgccagaggggttg

SEQ ID NO: 74918 - DNA, 84 bp, Mus musculus
gaggctcttggatggcagtgatcctgagggctcttagtgacagtgcacacagagcacaagggttaagtgattctccaaagcctt

SEQ ID NO: 74919 - DNA, 76 bp, Mus musculus
tcattgatattcttacccttggctgacttcattccctctcgggtttgctctcagacccactgtcagagttcattga

SEQ ID NO: 74920 - DNA, 115 bp, Mus musculus
gcaggactgcaaagctgcagcaggtgaactataaaagtttctctcagtcattctcacaataatgaagggcagggatacaaacatagtatccttacttggcagtcgaagtctatgt

SEQ ID NO: 74921 - DNA, 65 bp, Mus musculus
tgtgtgtgtgtgcttctgcatgtgtgtatgtgcgtgcacaagtgtgaagaagtcagagatagaca

SEQ ID NO: 74922 - DNA, 110 bp, Mus musculus
tcagcagctcagcacggttgccttcagggcagtctgtgtcttctgtatctgtctcctcagaacatatcaagaggctgacagcccctggcgtgccgtgcccactgtggtga

SEQ ID NO: 74923 - DNA, 73 bp, Mus musculus
atgtctgcatatgtatgtatttctgtgtatgtgtctttatttgtatatgtagtgtatgcatatatgtgttcat

SEQ ID NO: 74924 - DNA, 76 bp, Mus musculus
ctctagagactggagagatggctcagtggttagagcactgactgctcttccagaggtcctgagttcaattcccagc

SEQ ID NO: 74925 - DNA, 66 bp, Mus musculus
ctgtcattggctctgatggtgctggggacatttcttccagtaggagagattagagagagatgacag

SEQ ID NO: 74926 - DNA, 129 bp, Mus musculus
agattgataaagtaatttttcctaaagccatcactattacattgcatggtaggctgtgcctgtgtggttagcagggtgggtgctgtctgttgctgaagagagatgagtctattctcctgtgttaattgc

SEQ ID NO: 74927 - DNA, 114 bp, Mus musculus
aagtacaaagaaggtagcaaaaaaaggagagtaagtacctaaaatcagtatttttgtttaaaaagtggtagtgatagttttcgctcttgttttctgtgcttgtcatttgttctt

SEQ ID NO: 74928 - DNA, 90 bp, Mus musculus
aggcatggccttggtgaaggaggtggactcagagattttagaggctcataccagcctccgtctctcactttctctctgcccagtgcctgt

SEQ ID NO: 74929 - DNA, 72 bp, Mus musculus
aagttattcttttgttttgagacagtttctcatataactcagaatggtctcaaactcaactcggagtggctt

SEQ ID NO: 74930 - DNA, 100 bp, Mus musculus
ctctgtgtgtgtgcgtgggcgagtgtgcatgtctgtgtgtatgtgtctgctatgcatgtgtgggcattcgtgagagagggagagagcacgcgcaagagag

SEQ ID NO: 74931 - DNA, 79 bp, Mus musculus
gctcccctcattctgagagatgacagacagcctctaaatgcctatcaggggctggtgaaatggctcagtgggtaagagc

SEQ ID NO: 74932 - DNA, 113 bp, Mus musculus
gagctccgcccctcggcccctaactgtgatgcagctgatgctctgactctgtctctttctggaccgtgtacagcttgctctccagtgtcactccagggatccacatggagctt

SEQ ID NO: 74933 - DNA, 64 bp, Mus musculus
actgtctccatggcaacttcgctggccttaatccatgcagccagtgaatttacctgagagcagt

SEQ ID NO: 74934 - DNA, 113 bp, Mus musculus
gagatgaaagggaggccggtggccctggagagcatggtgggaaggaggatgggtctgtctctctgaccctgcccatgtgattccaagaactcaccatcctgacaggcagtctc

SEQ ID NO: 74935 - DNA, 84 bp, Mus musculus
atgtatgtatgtatgtatgtatttgtatgagttattggactactttatttcagccatgcagtgtgtgtgtgtgtgtgtgtgtgt

SEQ ID NO: 74936 - DNA, 92 bp, Mus musculus
gtatctgtgtatctgtgtctgtgtgcctgagtgtgtgcgcatatctttcactgatgacagcactcagaggaaagactagagacccaagagac

SEQ ID NO: 74937 - DNA, 84 bp, Mus musculus
gtgcctgaattgaggaacttctctgtgtcactctttgcctgagaaagaatgcaatgaaattcggaatggtttcttattctccac

SEQ ID NO: 74938 - DNA, 90 bp, Mus musculus
cagcccccttacctgtctgtctgtctgtctgtctatctatttttaaaaatggtcgtggtagagcaagatgctccaaactgggtgggactg

SEQ ID NO: 74939 - DNA, 124 bp, Mus musculus
ctgtctgtctgtctgtctgtctgcctgcctatctatctatctatctatctatctatctatctatctattcatccatcaatgttttgcaagaccagaccttaagccaggcatggcagcacacaca

SEQ ID NO: 74940 - DNA, 107 bp, Mus musculus
aggctcccttaactgctgagacagctctccagctaccactcagacagagtctcactgtgtagtcatggctgtctatgtagatcaagttggcctagaactcacagtga

SEQ ID NO: 74941 - DNA, 79 bp, Mus musculus
cttgatctacatagacagccatgactacacagtgagactctgtctgagtggtagctggagagctgtctcagcagttaag

SEQ ID NO: 74942 - DNA, 79 bp, Mus musculus
gcccagcttaggatacttttttttttcttgcaagggggtacagttgaactcctcaagactgcagttgcttggctgggac

SEQ ID NO: 74943 - DNA, 73 bp, Mus musculus
agtgcactgtaagcattgcactgtgaggtgttttattctaaaacagacaggacacagtgctcttacacagcct

SEQ ID NO: 74944 - DNA, 72 bp, Mus musculus
ggccaagtgactaagggcagtaggaggggtgggtagagaactaggcaaactctctgcctctgagtctgtgcc

SEQ ID NO: 74945 - DNA, 115 bp, Mus musculus
tgctgggattaaaggcgtgtgccaccactgcccggataaggtatttttaaggtttatttttatttatgtgcgtgtgtctgtgtgagtgagtgccacttgtgtgccgatgcccaca

SEQ ID NO: 74946 - DNA, 104 bp, Mus musculus
atatatgtgtgtatgtatatatatatatatatatatatatatatatataatatatatatgtatgtatacatatatgtgtgtgtatgtatatatatattagtaca

SEQ ID NO: 74947 - DNA, 91 bp, Mus musculus
gccagtcggggaaccagaagcagattacttgaaagaaggcggctcctcaccctctctcgcactgtgcagctgcagctggccttgactttgc

SEQ ID NO: 74948 - DNA, 135 bp, Mus musculus
ctgaaggacaccgtgaaatggcttgttcctatctgtgccttcagggaacacaccatctactcaggctgctttcttcaggaaatcttcttggctggagtgagcacccctaagctgagatccctgcaggccactgag

SEQ ID NO: 74949 - DNA, 107 bp, Mus musculus
ctgtttcaaattgctggacaaggggctggagagatggctcagtaggttaagaccactgactgctcttccagaggacccaggttcaattcccagcacccacatggcag

SEQ ID NO: 74950 - DNA, 75 bp, Mus musculus
ccgagttctctggcactctcaggcagtggcaccgacccgtcccgcaggtagttgagaattgtgccaaagtggcgg

SEQ ID NO: 74951 - DNA, 105 bp, Mus musculus
gagagctcccagtgacttaaggcagatgaagctagtcataagacagtgagctgtccattgtccgtcttctcctttgcattattttctctggagaaaccagctgtt

SEQ ID NO: 74952 - DNA, 90 bp, Mus musculus
ccctagaggtatagtagatccgaagcacagggttcccagacaggtcgatcatcttgtgactctcactgcctcgcaccacagaacttgggg

SEQ ID NO: 74953 - DNA, 110 bp, Mus musculus
ggctgcctaaatgtctctcccagtttcccactaggtcccctccttacacttgtcctcgacagtcagaagagagtgcccttggctcaggagcagtgacatcctccttagtt

SEQ ID NO: 74954 - DNA, 165 bp, Mus musculus
gtgtgcttgcatgtggtatgcatggttatgtgtgcatctgcatgtggtatgcaaggctatgtgtgcatatgcatatggatgcttgaggatgaagctgagactctgcctcagtcactcttgtaccttacacactgaggtaaggtctcaataaaacccagagcttcc

SEQ ID NO: 74955 - DNA, 76 bp, Mus musculus
ggggttgaagaaatgactcagtggttaggagcactgactgctcttccagaggtcctgagttcaattcccagcaacc

SEQ ID NO: 74956 - DNA, 66 bp, Mus musculus
gagtgtgtgctcacctgcatatgtgtacatgtgatgcatgtgtgtgtgtgtcatgagtgtgtgctc

SEQ ID NO: 74957 - DNA, 74 bp, Mus musculus
cttgggtatcagctcctggatgtgagctgctttggagtgcaaagatgtctggttttggctgagggatgcttggg

SEQ ID NO: 74958 - DNA, 62 bp, Mus musculus
gtgcacatatgtatgaatgtatgcatgtatgtatatacatgtatgcatatgtttgtgtgcat

SEQ ID NO: 74959 - DNA, 83 bp, Mus musculus
ccagtcagtctagtggggtagatgctgtgggactcagaaaagagagaccagagcaggggagctgcactgtggctgtacattgg

SEQ ID NO: 74960 - DNA, 92 bp, Mus musculus
gctggaggagcaggcttggagacctcagagagagaacagactttggactcaaatcaattctgtctccagttttccttgggagccacaccagt

SEQ ID NO: 74961 - DNA, 124 bp, Mus musculus
gacatctgagaggcgggggggggggggtgaggggctggagagatggctcagtggttaagagcactgactgctcttccaaaggtcctgagtaatgagatctgacgccctcttctggtgcatctga

SEQ ID NO: 74962 - DNA, 73 bp, Mus musculus
ttgctcgagctgcactgtctggggaggtgggacagccttgctatctctctctctatctctgctatgggaggaa

SEQ ID NO: 74963 - DNA, 112 bp, Mus musculus
caatggggcgtggggggcagtgagcacaaggatgggccaattctgagtttctagatctgagatccaggaaaaggcgggggcaggatttttgacttctgtctgagggacgttg

SEQ ID NO: 74964 - DNA, 99 bp, Mus musculus
gtcatagtcactctgtctgttctccgctttagaaagggcttgcattcttgtagaaatgaaagaaaaaaagaaagtggaagaaagagtcagattctagac

SEQ ID NO: 74965 - DNA, 114 bp, Mus musculus
gaccagaagagttgccttatgggaaatgtttgactaactgctgatgttctgcgtagaagagagaagactgacaggtagcagcggtcctaagtttttctggggccttccagagtc

SEQ ID NO: 74966 - DNA, 81 bp, Mus musculus
ggtatgtattcacttatatgtgggaagcagatggcgccctggaccattgtcaggctccgtgaatcccacatgtttactgcc

SEQ ID NO: 74967 - DNA, 96 bp, Mus musculus
gttctggcccccatgtgcacactattattgtttattattactgtgtgctcaagcatgtggattctaggacggtgtgtgtgtgtgtggggggggggc

SEQ ID NO: 74968 - DNA, 71 bp, Mus musculus
gtgtgtctatctatctgtctgtctgtgttgggcatcgggctatacacagactgcctggtctctagtcgagc

SEQ ID NO: 74969 - DNA, 80 bp, Mus musculus
catggaccacttgacctgttgggatggtaaagcaggtgactgtgtgcagacaggatcctgatgatggttgtgagtcagtg

SEQ ID NO: 74970 - DNA, 70 bp, Mus musculus
ccacctcccagtgcctcgcactgtctctcagtagatggccaataaacagagagcaggaagaggcgggtgg

SEQ ID NO: 74971 - DNA, 84 bp, Mus musculus
gctctgtctctctctctgtgtatgtggggtgtctatatgtgtatgtatgtccatgttcctgtgtcgctgggtagacatgtgagt

SEQ ID NO: 74972 - DNA, 110 bp, Mus musculus
agaactaacattctggggctggggagatggctcagtggttaagagcactgactgctcttccagaggacctgagttcaattcctagaaaccacatggtggctcatgggtct

SEQ ID NO: 74973 - DNA, 88 bp, Mus musculus
catagtaagaccttgttacccttgtcataaataaaatgtaaattacaagatgtaactttattttattttcagacagggtcttgtcatg

SEQ ID NO: 74974 - DNA, 118 bp, Mus musculus
tgtgagtaataagtgtaattttgtgggctggagagatggctcagcggttaagagcactgactgctcttccagaggtcctgagttcaaatcacagcaaccacatggtggcttacaacca

SEQ ID NO: 74975 - DNA, 72 bp, Mus musculus
aatagaacacatacatacatacatacatacatacatgtatgtatgtatgtatatatgtagatgggatttatt

SEQ ID NO: 74976 - DNA, 89 bp, Mus musculus
gttcctccctataaattttgagagccagcttttgttgtgtttagcttatgggcactttggacagtctgtaactctctgatagcaggaat

SEQ ID NO: 74977 - DNA, 90 bp, Mus musculus
ggcgcctgtcccacgcgaggacagaaggaagtgagcacaccggaagcccgctgttggattagttgctatttctcccgtcccaccaggccc

SEQ ID NO: 74978 - DNA, 82 bp, Mus musculus
aggcactgactgctcttccagaggtcctgagttcaattcccagcaaccacatggtgactcacaaccatctgtagtagggtct

SEQ ID NO: 74979 - DNA, 100 bp, Mus musculus
gattccccttgcctgtccatctgtctgcctgtctgtctgtctccagggtttctctgtgtcgccctagaattaactctgtagaccaggctgccctgaactc

SEQ ID NO: 74980 - DNA, 80 bp, Mus musculus
tgtgtgtgtagagatggctcagcggttaagagcactgactgctcttccagaggtcctgagttcaaatcccagcaaccaca

SEQ ID NO: 74981 - DNA, 78 bp, Mus musculus
cactatgtgggctgtgagtgcctggggccctggggcctgggtggaaggagggaggcagtcagtcagtccctcacggtg

SEQ ID NO: 74982 - DNA, 117 bp, Mus musculus
gtaggcggtaggtgcaatatcagacgttcagtatcagggctggagagatggctcagtggttaagagcactgactgctcttccagctgatgccctcttctggtgtatctgaagacagc

SEQ ID NO: 74983 - DNA, 99 bp, Mus musculus
ggacttccattggggctggagagatggctcagcgggtaagagcactgactgctcttccagaggtcctgagttcaattcacagcaaccacatggtggctc

SEQ ID NO: 74984 - DNA, 76 bp, Mus musculus
gaattcagagatctggggctggagagatggctcagtggttaagaatactgactgctcttccagaggtcctgagttc

SEQ ID NO: 74985 - DNA, 94 bp, Mus musculus
aggtgttttgctaagggtagactttgaggtttcacaagcccacacaaacccaatcccctcctcagcctctctgtctgtctctagctctctgtct

SEQ ID NO: 74986 - DNA, 74 bp, Mus musculus
atttgtctagactagctgttgagcagccccagggatgctcttatctctgcctctccaacgctgggatagcaggt

SEQ ID NO: 74987 - DNA, 75 bp, Mus musculus
tgtttctgtgtgtctttgtgtgtctgggtatgtgcatgtgtgtgcgcatgtgtaggtctatggccagagttgtca

SEQ ID NO: 74988 - DNA, 82 bp, Mus musculus
tctctctccctctctgtgtctgtgttgtatgtgtgtgctcgcgtgcccacacatgcgcacatgtggggtttgggggcagaga

SEQ ID NO: 74989 - DNA, 115 bp, Mus musculus
gcatgtaccaccactcccaaccaccatttctttttaaagacgtgtgtgtgtatgtgtgcacactgacacactgacatatagatctcaagtaatggatttttaggtatgaacaagc

SEQ ID NO: 74990 - DNA, 121 bp, Mus musculus
cctgggttccatcgctgcacccacatagtccgtagctcagttctaaggaatttcagtgctctcttctgactgcctcaggtactgtacacatgtggggaatagacatacatgcaggcagaac

SEQ ID NO: 74991 - DNA, 105 bp, Mus musculus
agcatatttcctagtgcctggattgaggaacttctctgtgtcactctttgcctgagaaagaatgcaatgaaaattggaatggtttcttattctccatgcaatgct

SEQ ID NO: 74992 - DNA, 114 bp, Mus musculus
cacacacacagagtctctgctgacagctacatgtgtggatggtcacacacacacacacacacacacacacacacacacacacacacagagtctctgctgacagctacatgtgtg

SEQ ID NO: 74993 - DNA, 104 bp, Mus musculus
tccagagagtgtgttgagcacagttctaaggctgttcctttgctctctgactcacagcgactttccagaagggttaatggaaccctgctgaatgctttcctgga

SEQ ID NO: 74994 - DNA, 80 bp, Mus musculus
tgaccagggtctgggaaggtcttctctcagcaaaaactttctttgccaggagctaagtggctctctccctccgtggctca

SEQ ID NO: 74995 - DNA, 120 bp, Mus musculus
agactggaaagtagcaaggtaacggtgctggagagatggctcagtggttaggagcactgactgctcttccagaggtcctgggttcaattctcaacatggtggctcacaaccgtctgtagt

SEQ ID NO: 74996 - DNA, 85 bp, Mus musculus
tgctttgaaaaaggagtctagggctggagagatggcttacgagcactgactgctcttccagaggtcctgagttcaaatcccagca

SEQ ID NO: 74997 - DNA, 70 bp, Mus musculus
actcactgtgtagatcaggctggcctcaaacttaaaggatccacctgcctctgcctctctgcctctgagt

SEQ ID NO: 74998 - DNA, 85 bp, Mus musculus; identical to SEQ ID NO: 57470

SEQ ID NO: 74999 - DNA, 118 bp, Mus musculus
caggacaagcagcactttgaaccactgagctgtcagttctacatttctttttgatttgaaatagggtctcactatgtagtcctggcagtcctgaaactcagagatctgcctgcccctg

SEQ ID NO: 75000 - DNA, 108 bp, Mus musculus
ccagagggtcttttattgttgagaatagtttttgttatcctaggtttttttgctattctaggtgaatttgcaaattgccctttctaactcagtgaagacttgagttgg

SEQ ID NO: 75001 - DNA, 81 bp, Mus musculus
gtgcaggtgctcacagagcctagaagagagcatccagtcctctggagctgaagttgtagacagttgtgagccaccaggcat

SEQ ID NO: 75002 - DNA, 61 bp, Mus musculus
agccaggtttagttgtaggttgaattgtagctttatgagttagtcctggaggaatctggct

SEQ ID NO: 75003 - DNA, 102 bp, Mus musculus
ccataatatataaagagaggaccatacagactccatgattgtcacttcagtctctgtgagctcctatgagtccctataagtctctgtgagccatgttcttgg

SEQ ID NO: 75004 - DNA, 102 bp, Mus musculus
tgtccaaaaagcgacacacctctcagaatatgtccccactgtcgacttgtatttgagacttgagactgtggacttttgaggaatttctgtctttgtgtgaca

SEQ ID NO: 75005 - DNA, 82 bp, Mus musculus
cgacctcttgcttttacatcgatctgtgtctcagtgtctcattgggagacatctcgaagtaagtaccactgttcgagggtcg

SEQ ID NO: 75006 - DNA, 79 bp, Mus musculus
gagtgtgtatgtgcatgtatatatgtgtgtgcatatgtgtatgtgtgagtgtgtgtgtgtgtgtatgtatgtgtgtctc

SEQ ID NO: 75007 - DNA, 85 bp, Mus musculus; identical to SEQ ID NO: 57470

SEQ ID NO: 75008 - DNA, 96 bp, Mus musculus
acatgcatacagttgtgtgtatgtgtgcatgtacatgtatatttgtacaattgaatgtaggtaagcatatacatatgtacagctgagagtgtatgt

SEQ ID NO: 75009 - DNA, 64 bp, Mus musculus
ccagtaaacacagaaactgccctctgcaggaacctgtcctgccagtcacactgagtgaggctgg

SEQ ID NO: 75010 - DNA, 66 bp, Mus musculus
gtgcctgtgagcatgtgtatgtgcacatatgtctgcctctgtgtatgtgtgtgtgttcatgtgtgt

SEQ ID NO: 75011 - DNA, 160 bp, Mus musculus
acatatatatatacatatatatgtgtatatatatacacatatgtgtatgtatgtatatatgtatatatatacatatgtgtatgtatgtatatatgtatatatatacatatgtgtatgtatgtatatatatgtgtgtgtatatatatctatatatatatac

SEQ ID NO: 75012 - DNA, 57 bp, Mus musculus
ggcagggctggagagattggtcagtgggtaagagtgctcactgctcttccagaggtc

SEQ ID NO: 75013 - DNA, 73 bp, Mus musculus
gcctcaggaaagctccagacagcagagactgtggtgttttcatctccgttttgttctggttacttttcttggc

SEQ ID NO: 75014 - DNA, 63 bp, Mus musculus
ggtgatgctgtctgtctgtctgtccatctgtcccggtggggaaggcatgcagatgagcactcc

SEQ ID NO: 75015 - DNA, 77 bp, Mus musculus
caggtgaagcctgtccttgtgtcacctgactcacacagcactgtagagtgaagagacacaggtgacacactgccctg

SEQ ID NO: 75016 - DNA, 114 bp, Mus musculus
tgtggtgcaaaggaaccaaagagccaaggtctccttgctaagtccggtgacatgctctgtcactgtagctgtgacactggcgaagaactggctttagggtctttgtctgccagg

SEQ ID NO: 75017 - DNA, 65 bp, Mus musculus
tcggtggtcctctatctgagagaagcccacagacaggctctctctgtgtgtttggagtgccccgg

SEQ ID NO: 75018 - DNA, 70 bp, Mus musculus
gctggctcactggctcactgactggctcactggcttacagggtcactggctcacgggctcactggctggc

SEQ ID NO: 75019 - DNA, 98 bp, Mus musculus
gctacgttttcatagtagcttcataggaaatactcggatacacttttttttttaattgatgcagaatcccatgtattccaggctggctttgatgtagc

SEQ ID NO: 75020 - DNA, 108 bp, Mus musculus
cctgcttccacacagtgctcaacccctgccatacagagatcttggctgcattcaacaatagtcaaattcttcatgtgacaattccctgagtttgcccaggaaggcatg

SEQ ID NO: 75021 - DNA, 84 bp, Mus musculus
cggaagttgtgtgtgattgttctcagctgggtgggttcactgcctccctccctcagtctgtaatcctcagctcatatatctccg

SEQ ID NO: 75022 - DNA, 92 bp, Mus musculus
gccagagggggaaagggacttgtgatcttcctaaaggatgaaggaaagcttctcctgagagagaacacactggccttgatagtcactcatgc

SEQ ID NO: 75023 - DNA, 87 bp, Mus musculus
tgaagaggttcatctatgtaattcttactgacaaccatttcaacaggactggcaggttttagagagaagagactgactactttttca

SEQ ID NO: 75024 - DNA, 70 bp, Mus musculus
tatatgtttatgaatatatgtgcttgtgtgtgtatgtatacatatacatatacatatacatatacatata

SEQ ID NO: 75025 - DNA, 107 bp, Mus musculus
atgtgtatgtacgtatgcatgtatatgcatgtgtgtatgtatgtgtatgtatgtatgtatgtatgtatgcatgtatgtatgtatctctggtatacttgcatgtatgt

SEQ ID NO: 75026 - DNA, 68 bp, Mus musculus
atatatgtgtgtatgtatatatatatatgtatgtatatacatatgtgtgtgtatatatatatgtatgt

SEQ ID NO: 75027 - DNA, 56 bp, Mus musculus
tatacatgcatgtgcatatatatatatatgtatgtgtgtatgtgcatgtttgtata

SEQ ID NO: 75028 - DNA, 79 bp, Mus musculus
gtcaattctaagccactgtctgcctgtctcccgtgctcccagggagtggagtatacagcagtcagtcttcctgttcgac

SEQ ID NO: 75029 - DNA, 86 bp, Mus musculus; identical to SEQ ID NO: 74862

SEQ ID NO: 75030 - DNA, 99 bp, Mus musculus
gctgtgcgttttgagaaatctctttccacatgttgccagtctgtgattctctgaatctgtttctgtctgctgtaggaggattcttctctgatgataagc

SEQ ID NO: 75031 - DNA, 72 bp, Mus musculus
aaataggttgagctggtagtttctaaggcttgctagtagcaagtcagaatagagtcaccacacagctagttt

SEQ ID NO: 75032 - DNA, 102 bp, Mus musculus
tctatatatctatctatctatctctatatatatatgtatatatgtatatatatatgtatatatatatatatatatagagagagagagagagagagagagaga

SEQ ID NO: 75033 - DNA, 93 bp, Mus musculus
catttttgtgcatgtatgatgtatatgtatgtatatgtatatgtatgatgtatatgtatgtatatgtatatatatgatgtatatgtatgtatg

SEQ ID NO: 75034 - DNA, 105 bp, Mus musculus
ctcaaccggagagcgtagcaagtctgagcttcttgaggggatcatgagtgaatttgtttttgtcctcaagcaaaaggctacagtagcaacctttccactagtggg

SEQ ID NO: 75035 - DNA, 68 bp, Mus musculus
aacttaggaggctagagagatggttcagtgcttaagagcactgactgctcttccagaggtcctgagtt

SEQ ID NO: 75036 - DNA, 85 bp, Mus musculus
cgcagatgcacacttgtgcatgcgtatctatgtacagtgcacacacacacaattacatggaatgatatgtatacatgtatctttg

SEQ ID NO: 75037 - DNA, 101 bp, Mus musculus
gatctctaagagctaagagttagtcctggcctgtctgtccatctggatgtggtaccgtctgggtgtagtgctgacagatctctactcttaggctaagagtc

SEQ ID NO: 75038 - DNA, 84 bp, Mus musculus; identical to SEQ ID NO: 74935

SEQ ID NO: 75039 - DNA, 97 bp, Mus musculus
catgcaggtcaatagcgagcagggaaatatggaaattcattgaaaacattttttaatgtaggaaattccctttcatgtgcacgtgtgcatgtgcgtg

SEQ ID NO: 75040 - DNA, 119 bp, Mus musculus
taagcatttctcccatagcagctgcccaggagaaagcgaggctgggtggtctctctcactgtctgtcctggggtgagctgggtttaggatggtgccagcaaggctctgacaccatgtct

SEQ ID NO: 75041 - DNA, 69 bp, Mus musculus
ttggtgttcctcttctgaactctttgtaacaaggagactcctcggtgaagacagagaggacaacactga

SEQ ID NO: 75042 - DNA, 67 bp, Mus musculus
actctcctacgcttggccgcactacctcatccccacacatgtgctcagtgtgtgtctgtgtaagagt

SEQ ID NO: 75043 - DNA, 89 bp, Mus musculus
tagtatcagcagtgagcagactgcgtgtacagagggcgctattggaatggggaatgtggcaagcaaagtattgtagactgagtgaacta

SEQ ID NO: 75044 - DNA, 86 bp, Mus musculus
gaggtgttgtgggagaatatacacggacactcaatgacatagaatgtacatgtctgtgtctgtgtgtcagtgtccacatctgtctc

SEQ ID NO: 75045 - DNA, 74 bp, Mus musculus
gagacagatgtggacactgacacacagacacacacatgtacattctatgtcattgagtgtccatgtatattctc

SEQ ID NO: 75046 - DNA, 82 bp, Mus musculus
gactttgctcatggctgtaaatccatctgcatctgtgcctcatggccagtgtgctgaagatgtcttagagacatgaatagtc

SEQ ID NO: 75047 - DNA, 93 bp, Mus musculus
tccatgatgatctgataggatgcataggacaatttcaatatttttgtatctgttgaagcctgttttgtgaccaattatatggtcagttttgga

SEQ ID NO: 75048 - DNA, 129 bp, Mus musculus
ctgctgagttcctctgaggccagaggtacttagggccttgtcctaaaacagcaggggattaagtaaagcagctttggttcgaactccacaggaattcagtagctctaactttcagcctgctagttgaag

SEQ ID NO: 75049 - DNA, 69 bp, Mus musculus
agtatatatacacacatacatatatacatatatgtgcatatatgtgtatatatatgtgtgtgtatatct

SEQ ID NO: 75050 - DNA, 64 bp, Mus musculus
atatacacacacatatatatacacatatatgcacatatatgtatatatgtatgtgtgtatatat

SEQ ID NO: 75051 - DNA, 85 bp, Mus musculus
tttcacagaaggcagagagctctgaagcctcactagagagacttggaacatctttggtggtcagggtttcttagcctactgggaa

SEQ ID NO: 75052 - DNA, 82 bp, Mus musculus
gacccagctatctctgtaattgcccagtgggcacatgaacagagtgaccacagtggcagagatggaggttatgtatgggctc

SEQ ID NO: 75053 - DNA, 107 bp, Mus musculus
cccatattttgtcagattttatggatatttaaaatatgtacttacatatatcttatttgtacatatatatatttgaagttatctagaatctagttgggatgcaaggg

SEQ ID NO: 75054 - DNA, 81 bp, Mus musculus
agcctcacaggagacagctatatcaggctcctttcagcaaaatcttgctggcatatgtaatagtgtctgcttttggtggct

SEQ ID NO: 75055 - DNA, 74 bp, Mus musculus
gtttggtcttttgagaacaggtctcactcacactgtagctctgattggtcttgtattctctttgtagaccaagc

SEQ ID NO: 75056 - DNA, 85 bp, Mus musculus; identical to SEQ ID NO: 57439

SEQ ID NO: 75057 - DNA, 107 bp, Mus musculus
aaacatctggactacttgtaagactttgtcttgagtttatgttgtcttcagcacagctgaggatgaacgttttcttggaagttccttgcgggggaactgggatgttt

SEQ ID NO: 75058 - DNA, 116 bp, Mus musculus
tctggcgagcaatcaaaatcctgcagtatttattcccggttttacaagctactgatgagaggaagtagcttgtaaacggtgaagcaagtctgcacctctttgcctcacattgtaga

SEQ ID NO: 75059 - DNA, 113 bp, Mus musculus
accttatcaatgtgagtgtactccaatgttcaagaatagatggcagctgtatattacctccctctgtggctctctccttcagttctggagacagggatctcaccaaacctggt

SEQ ID NO: 75060 - DNA, 115 bp, Mus musculus
ttcacttatatgtgggaagcaggtgtggtcacatggacctagatggcgccctggaccattgtcaggctccgtgaatcccacatgtttactgccttgcccgagcatgcacagtgag

SEQ ID NO: 75061 - DNA, 78 bp, Mus musculus
cttaagctatttggggtagttagagaggtttcctttcagcgaggcacctggctacattgctttggaacgagcgctaag

SEQ ID NO: 75062 - DNA, 82 bp, Mus musculus
tcagaaaccagagctctctgtcaccctctgtggatcttacggggggggggggtgagaagggagagcatctctgtccatctga

SEQ ID NO: 75063 - DNA, 84 bp, Mus musculus
gcctggattgaggaacatctctgtgtcactctttgcctgagaaagaatgcaatgaaattcagaatggtttcttattctccatgc

SEQ ID NO: 75064 - DNA, 82 bp, Mus musculus
ggagggggagttgtggttggagaggtagctcagcagttaagagcactgactgctcttccagaggttctgaagttcaattccc

SEQ ID NO: 75065 - DNA, 75 bp, Mus musculus
cagttctatagccagaggatgaggaggagccaggggccccaggcttcttgtcctcagagactctgtgcctgactg

SEQ ID NO: 75066 - DNA, 70 bp, Mus musculus
gtctgtctgtctgtctgtctgtgggcttatgcacatgtgtgcagatgcctgtggaggccagaagatggat

SEQ ID NO: 75067 - DNA, 88 bp, Mus musculus
ccaggacacaaatgaggcccagagagaagcttgaaaatctacgatgcctcgaaactctgagagtctctctgtggccacactgacttgg

SEQ ID NO: 75068 - DNA, 73 bp, Mus musculus
tgctgtgtccctctctgcctgtttcctaagtcccaaagccaggaggaagcccactagaggctgagggttggta

SEQ ID NO: 75069 - DNA, 115 bp, Mus musculus
tcctttggtgtttgttcaagacatgcatgatcatgtatgcatatatatatgtatgtatacatatatatatatgtatgtatgtatatatatatgttgatgttggcattctaggggg

SEQ ID NO: 75070 - DNA, 77 bp, Mus musculus
agggactggctgagggctggctctgcctcttcaggatgtcagaggttggctgaagggtcagactctctctgtgccct

SEQ ID NO: 75071 - DNA, 74 bp, Mus musculus
gtttctgtccctgtctgtgtgtctctccttgtaacataccacacagagagacagacacacaggcacacagatgc

SEQ ID NO: 75072 - DNA, 124 bp, Mus musculus
gcatggtgagattgaggcttgtggtttggggttactcctggttgtgtgtcttcctcctgctgtctgtagtgagtgaacaccccaactcaggagttcattggattaatggaatgatgccactttc

SEQ ID NO: 75073 - DNA, 105 bp, Mus musculus
agcatatttcctagtgcctggattgaggaacttctctgtgtcactctttgcctgagaaagaatgcaatgaaatttggaatggtttcttattctccatgcaatgct

SEQ ID NO: 75074 - DNA, 121 bp, Mus musculus
gtgtctatgcatgtgttcatacatgtttgcttatatgtatgtatgtatgtatgtatgtatgtgcatgtgtgtatatgtgtgcatgtgctcatgtgtgcgcatgtatgtatgtgtgtataca

SEQ ID NO: 75075 - DNA, 102 bp, Mus musculus
gtttgaggcagctgctaacatcatgtccaccatcaggaagcagagagctgactgctagagctcagttctctttctgattttcattctgtccagcactcaggc

SEQ ID NO: 75076 - DNA, 87 bp, Mus musculus
gtagctgtttctccacatctggtactaggttcaagtgttttccctttttgagtctctggcttctagggcaaggttaggagtggttac

SEQ ID NO: 75077 - DNA, 75 bp, Mus musculus
gcctccaaggggccacagtgtctgccagccacaaagacaactagtccttaagtctgtcagtctgtccctgagggc

SEQ ID NO: 75078 - DNA, 86 bp, Mus musculus
cagtgggcatattctcgagtggagagcgggggaggggggtgatggagttaggcctaactcactccctctctcttgggaaccagctg

SEQ ID NO: 75079 - DNA, 131 bp, Mus musculus
ctggtatggagattggaagtcagaaatcaggatgtcataggtttataccctttgctgagtctgaatctgtctggcctaggcttatagcttctggtggcttttggtgctcttttggtgttctataattggct

SEQ ID NO: 75080 - DNA, 78 bp, Mus musculus
agagagaccagagcagcccttgataggaagttagtcacaagcttatatttatttatctgtctgtctgcctgtctgtct

SEQ ID NO: 75081 - DNA, 76 bp, Mus musculus
tggaaggagagtgtcactagaggtgggctttgaggtttcaaaaacccatggcaatcccagagtcagtctctgtcta

SEQ ID NO: 75082 - DNA, 114 bp, Mus musculus
tcctctctgtgtctcatatccaccatggactaggaactctattttttttttttttactcagaagtcaatagtcaccaaacctcattgtgggttgtcaagatttcaagggtaggg

SEQ ID NO: 75083 - DNA, 71 bp, Mus musculus
aggagagcttttatcacagccaagctgagagccaggaccttctatctcactgtctgtgtggctaaaatcct

SEQ ID NO: 75084 - DNA, 115 bp, Mus musculus; identical to SEQ ID NO: 75060

SEQ ID NO: 75085 - DNA, 66 bp, Mus musculus
gtgtgcttgtgcatatgtatatgtgtaaatgcttgtaaatatgtatgtgtgcatgtgtaagtgcat

SEQ ID NO: 75086 - DNA, 71 bp, Mus musculus
ggggtggtggctgtgaaatctgtctctgtgcccgtgacaggtaaggatggggctgtcacacacactgtctt

SEQ ID NO: 75087 - DNA, 83 bp, Mus musculus
atggggagggagtttcagagttgcagaggtaggggcttggagtcagccagctgtctgtctgtctgtctgtctgtctgtctgta

SEQ ID NO: 75088 - DNA, 66 bp, Mus musculus
gagtgagggctcgcgctcaccaacttctgaaacttacagtagtgactgtgcagtgttgtgcttacc

SEQ ID NO: 75089 - DNA, 58 bp, Mus musculus
gtgcatgtacaggtacacatgtgtgatcatattcaggtgtgtgtgtgtgtgtgtgtgt

SEQ ID NO: 75090 - DNA, 88 bp, Mus musculus
gggctctgcacaaacaaaagcagtgtctgctgccgtcatggcttttttgcacagtctgcagtgtatcactctgtctgagctagcgcct

SEQ ID NO: 75091 - DNA, 99 bp, Mus musculus
cagggaggtcgaagagggcactgaattccccagagcttgagatatagacaattttgagtcactgtgtgtgtgcctgaaatcaaactcaggtctcctctg

SEQ ID NO: 75092 - DNA, 120 bp, Mus musculus
tctgtggtcagggcagcaggactggctcctataaaatgttaatctgctgtacgtgtctctttctctcaaagagtagatggtcagaaacttaaggctcagtccttgagcctcagctttgga

SEQ ID NO: 75093 - DNA, 112 bp, Mus musculus
aggactgtctcttggtgtcagtgagtagggtgtatgtctgtgattctgtgtctttaaaaggtgtagagagaatgcagggtggtctctctggcatagttctacagactgggcc

SEQ ID NO: 75094 - DNA, 107 bp, Mus musculus
tcatttttccttttgctttgtttttgagacagtcgctctcattgtatagtgtggtcgaggctgatctctgacttgctatgagcctaagctgacctctaatttcagag

SEQ ID NO: 75095 - DNA, 65 bp, Mus musculus
gtgtgtgtagtgcatgtatgcatgtgtatataaatgtgcacatgtatgtttgttcatgtgtgtat

SEQ ID NO: 75096 - DNA, 96 bp, Mus musculus
acccactgtctaccagactctctgtggctgtctttcaagcacctcacaggtgttattaggcatgctacgtggtgacaattgtttggtccagttggt

SEQ ID NO: 75097 - DNA, 99 bp, Mus musculus
ttcatttcaatggactcagtgcccacagacaaccccagccctctggcatgagtcagctgtggctctcactgtgcctttgtgatctgagtgcgtggggtt

SEQ ID NO: 75098 - DNA, 62 bp, Mus musculus
tggacagagtccctgcctcccagaatacctcccattctggaatcggtcccgggggctctcca

SEQ ID NO: 75099 - DNA, 87 bp, Mus musculus
tgccagagcctcggatggaccaccataagagggcagcttagattggcatgccgtctgtctgtctgtctgtctgtctatttgccatct

SEQ ID NO: 75100 - DNA, 106 bp, Mus musculus
gggtgtctttccagtgtacccaggcttcatcagtgagagttcaagtcatggccacaatggctctctcacagtcacagcctaaaaccaccccggaaagcagctaccc

SEQ ID NO: 75101 - DNA, 64 bp, Mus musculus
ggattgcagggagatagagtgattccagggttgtttgcctgggctctgtccgtctgtctgtctg

SEQ ID NO: 75102 - DNA, 84 bp, Mus musculus
atccctcagttctgtgtgagcacagagctccaactttcctgccccaacctctctgatgtctctgctcacagacctgatactgat

SEQ ID NO: 75103 - DNA, 110 bp, Mus musculus
ctgacttcccaggggcttctagatgctcaggaccacgcacacccatgccagaagacaatggggtgacattctgaggaaccgccaagaagaaaaccaataaaggaatgcag

SEQ ID NO: 75104 - DNA, 93 bp, Mus musculus
gggatcgtgtctggaaccactgttacagactagagactggctcatctccagcggagaatgtctgtgtgtctctctgtgttcagtgacactccc

SEQ ID NO: 75105 - DNA, 78 bp, Mus musculus
cactcagctcttgtgattggctagtttctggtggtcctcagatctctctggctccctgactggccaacaatctgagtg

SEQ ID NO: 75106 - DNA, 79 bp, Mus musculus
gtcctttgtccagactgcagagcatggtgtaagggtctgtttgtctgctcacaagtgtctctgtttttcagaaggacaa

SEQ ID NO: 75107 - DNA, 70 bp, Mus musculus
tatatatatgtgtgtgtatatgtatgtatatatatgtatgtataagtatatatgcgtgcatgtatatatg

SEQ ID NO: 75108 - DNA, 116 bp, Mus musculus
tgtgtaactccgtgggagaggtggttgcctagcatgcacgaggctccaggtttcattccacacaaatgctgctgctctctgcatctcctcttacctgagcatcatggaggtcagca

SEQ ID NO: 75109 - DNA, 62 bp, Mus musculus
gtcagtctgcagagactgaggactgggctgctgtcagtgtcctgatcactatgcgggttggc

SEQ ID NO: 75110 - DNA, 104 bp, Mus musculus
gccttctggactctggtgtgtggacttcataattagtatgtgcatctattctgaatttctatttatcataccataactgtgtctccatgtactttatgaaaggt

SEQ ID NO: 75111 - DNA, 84 bp, Mus musculus; identical to SEQ ID NO: 74935

SEQ ID NO: 75112 - DNA, 73 bp, Mus musculus
actgtgtgtctgtctgtctcccagctgcctgtgatggcactggcttctgctccactttggcaggcgcagcagt

SEQ ID NO: 75113 - DNA, 78 bp, Mus musculus
ccagggttttgttgctgtgcagacgaaaaggcaaggtctatgacacagtctgtcttaatgcatctggatttatcctgg

SEQ ID NO: 75114 - DNA, 84 bp, Mus musculus; identical to SEQ ID NO: 74937

SEQ ID NO: 75115 - DNA, 64 bp, Mus musculus
gctgggaactgtggatattggacaggcttcctcactgtgggaccctgagtgtctctgtcccagc

SEQ ID NO: 75116 - DNA, 68 bp, Mus musculus
acacacacgtatatataacatatgtgtatgtatatatgatatatatgtgtgtatatatatgtgtgtgt

SEQ ID NO: 75117 - DNA, 122 bp, Mus musculus
gcactcactttagaatcagtgatgtttagggatttggttttgagacagcctcactctctagctcaggatggcctatcaactgggcatcactctgaaacctgtagtgtgaaactgggtaaaat

SEQ ID NO: 75118 - DNA, 85 bp, Mus musculus; identical to SEQ ID NO: 57439

SEQ ID NO: 75119 - DNA, 70 bp, Mus musculus
cacatatacatatatacatatatatacatatatacacatatatacatgtgtatgtatatatgtatgtatg

SEQ ID NO: 75120 - DNA, 70 bp, Mus musculus
tggctgacagagtcctagtgctgtgtctgtctttgtgagcagctgctcagcgctttgttgctgtctgcca

SEQ ID NO: 75121 - DNA, 85 bp, Mus musculus; identical to SEQ ID NO: 57470

SEQ ID NO: 75122 - DNA, 71 bp, Mus musculus
tgtgtatatagtatatatatatatgtatgtgcatatatgtgtatatatatgtgtgtgtatacatatacata

SEQ ID NO: 75123 - DNA, 82 bp, Mus musculus
aggttgtttttataattgcagtgagatgagtctgaggtttgggtctgaagactactttagacacatttcaaagggatgacct

SEQ ID NO: 75124 - DNA, 80 bp, Mus musculus
tatatatatatatatatatatatatatatatatatatatatatgtatatgtatatgtgtgtgtgtgtgtgtgtgtgtgta

SEQ ID NO: 75125 - DNA, 75 bp, Mus musculus
gtctgtctgtctgtctttccagtgggtgtctcttttcggtatggaagagctgatacatgaagggcagcagcaaac

SEQ ID NO: 75126 - DNA, 124 bp, Mus musculus
gagcccaggctgccatgttctgattgctctgattttcaccagctttattttggagcagtggtaggaggttgttgagtttttgcttcattgcttagtaataagtttgggttctcttcacatgtgt

SEQ ID NO: 75127 - DNA, 71 bp, Mus musculus
ggtagtctgagagagatgggtatacactgaatatatatatattctgaatacactttcctttcccccctgcc

SEQ ID NO: 75128 - DNA, 116 bp, Mus musculus
agagggtgagacagcaagcaagtcctctacagctcctgtcatgagttcctgccttgattccccacaaggatgaattgtgacctggaagtgtgagccaaataaactctctcctctct

SEQ ID NO: 75129 - DNA, 61 bp, Mus musculus
ggcctgagtcagtggggaatttctgtgaaagcagcagagatctctctctctctctgaggcc

SEQ ID NO: 75130 - DNA, 81 bp, Mus musculus; identical to SEQ ID NO: 74966

SEQ ID NO: 75131 - DNA, 135 bp, Mus musculus
tggtctccaagtatcggtgttcacataggctcaaacaactcagatgtgtctggatgactcacagcctctcactaatattttactagggaggccaagggtgggaaagcctcactgggcaaagctgagaatgaagag

SEQ ID NO: 75132 - DNA, 102 bp, Mus musculus
gctcttggagcccatttggtgcagagcctctgcaggcaggctttgtgcaccacactgcctcagtctctgtgagtgagttcatacgcacatcagtcctcttgc

SEQ ID NO: 75133 - DNA, 79 bp, Mus musculus
tagctcagagcttgttctatgttgagttgggcacatagaggtcatgtgttcccagcagaagctaaagagggctcagctg

SEQ ID NO: 75134 - DNA, 102 bp, Mus musculus
ctgcgacctggaaggcacagagccagcagtgaggagaggcagggctcacaatcactgtgtccctgaaccccactgcaggcatgtcccagcaggaactcccag

SEQ ID NO: 75135 - DNA, 82 bp, Mus musculus
atatgcagtacatatcatgtctagaagagtgtcaggtcccctggaactggacttacagagagttgtgagagagctgccatat

SEQ ID NO: 75136 - DNA, 116 bp, Mus musculus
ttcttttcaccttgctctctttcttccatctgtgacgttagtgtgtgtgtgtctgtcagaaagaacatgtcagattggattacagaagccctaagagggcattgtatcttctggaa

SEQ ID NO: 75137 - DNA, 62 bp, Mus musculus
ctcactgtctcagtctctgcacctgctctctactgcagtctaggatgagaccttgttgtgag

SEQ ID NO: 75138 - DNA, 118 bp, Mus musculus
ctgaggggaggaatttgatggagccctcccactcgggaccgagtgttccaaagtctctcactctctgaacattgtccagttgtgggtctctgaatcatttctgatctccttcctgtag

SEQ ID NO: 75139 - DNA, 118 bp, Mus musculus
gcctctgattctctctgtattatttatctctgtgcagggtttttatcttctaaagttttagattataaataaatccttccatagattaaaaatggttgaaaagagctctgttcaatgc

SEQ ID NO: 75140 - DNA, 92 bp, Mus musculus
gggcctctcactgagttcagaggttactgtgtaggctagcctgactctccatactgccccagtctctgcctctcatacatggcctccccagc

SEQ ID NO: 75141 - DNA, 85 bp, Mus musculus
ggaaaccaggcctctgtcacatgggactttgagagcatactagtgaagcccactgtagccggtctcttctgtgtcagtctgttcc

SEQ ID NO: 75142 - DNA, 77 bp, Mus musculus
tcaggaagctgttcaggaagggagatcggagaccagtgaaatttaggatgcctctctgcctgtgtggctcagtgtga

SEQ ID NO: 75143 - DNA, 98 bp, Mus musculus
tccatgtgccagaatcctggcctgaattaagtggagagagtgagcagagtaccagatccatctctctctgtggatgtggatatggacgtggacgtgga

SEQ ID NO: 75144 - DNA, 77 bp, Mus musculus
ggagctttttatccattgctcatgatggtgactattggtttgtcatgaatagtctttatcttgttgatagatgttcc

SEQ ID NO: 75145 - DNA, 109 bp, Mus musculus
tgaaatctatctgtataggtttttcatttttaggccgaatgggatttgctccatggtctctttctcagtccgtctttggaagatccttaatttaggtatgttgatttca

SEQ ID NO: 75146 - DNA, 81 bp, Mus musculus
gtttgactcagtctgtctcagctttggttgcatcacatctgtggactaggctgcactgcttgctgtgggaagacatgagca

SEQ ID NO: 75147 - DNA, 87 bp, Mus musculus
tcagagtgccaaggcaggtgagaggtgaagcctggccaagttcctcgcacatcatgatcaggctcactcactggctgagggagctga

SEQ ID NO: 75148 - DNA, 125 bp, Mus musculus
tatgtgtatttgtgatatgtatgtgtgtatatgcatgtgatatatatacatatatatatatatatacatatatgtgtatatatacatatgtatatatattctatatatgtttataattctagtgc

SEQ ID NO: 75149 - DNA, 76 bp, Mus musculus
gctggtctgattagaagctggacctcttggggaccatgacaagatgctttgtgggaggctccctgtatccttcagc

SEQ ID NO: 75150 - DNA, 105 bp, Mus musculus
ggatctatgcttttaaagaaattctgtactatatttgttaatttatcttcgaagggtgagggcgcacaggtggaggtcagagagtaacttgtggaagtcagatct

SEQ ID NO: 75151 - DNA, 108 bp, Mus musculus
ttggggcaaggcaggctgtaaatcagagctgaagctgcgctttacatcttactgttattgtacatgtgtcgggcagttttcaggagtgataagtggcctctgtcctga

SEQ ID NO: 75152 - DNA, 68 bp, Mus musculus
cgggtggcaaacacagggcatgctgtccgcactgcacagaggacagtgtggactgaagagccaacctg

SEQ ID NO: 75153 - DNA, 101 bp, Mus musculus
gtcccaaacatgcaggatagccaggactgctagctctcctccttcaggacaggtgacagtgtggtgagctggttctttagtgctcagcctattgctggggc

SEQ ID NO: 75154 - DNA, 88 bp, Mus musculus
cagacagggcaccacacagtgtgtagccttaccagtgtcagactcagtctgagtctagagggttgcataaatagtaaggcttagtctg

SEQ ID NO: 75155 - DNA, 96 bp, Mus musculus
tctttgcctgcctttcactttaaaactgctgccagtcgcctcccctcctctgagcagtgaagagagaggtcagagagcaccagttgtgcatgaaag

SEQ ID NO: 75156 - DNA, 61 bp, Mus musculus
gtgtctcctgtgggactgtgtgtgtgtgcgcaagcacacacacacacacacacacacacac

SEQ ID NO: 75157 - DNA, 85 bp, Mus musculus; identical to SEQ ID NO: 57470

SEQ ID NO: 75158 - DNA, 57 bp, Mus musculus
acagtattagagcatgttcatgtggagcctccagtctgtctatgctgttagtactgt

SEQ ID NO: 75159 - DNA, 115 bp, Mus musculus
catcaaaggctgatgtaactccctccatgttaagggtgagtgaactgagactggataaagaccagattggctgagatacccagcaggaaaatggagcagataggctgcccggatg

SEQ ID NO: 75160 - DNA, 60 bp, Mus musculus
tgaataccagtgtgtgaaactctctcttaggacaagaggagtcatcacataggcaattca

SEQ ID NO: 75161 - DNA, 75 bp, Mus musculus
gccatctagagcatacgtgtgtaggccttcagcatcctgcctgagtctctgtcagtttgtatgtgcattaatggt

SEQ ID NO: 75162 - DNA, 77 bp, Mus musculus
caagcgtgtgaagtgtgtgtgctcagcttctgcaggaagtgggaagcaaagccaaactcacactacctctgtgcttg

SEQ ID NO: 75163 - DNA, 80 bp, Mus musculus
atatgtatgtatgtgtgtgtaatgtatgtgatgtatatgatgtatacgatcatgtatatgtgtatgtatatgtatatata

SEQ ID NO: 75164 - DNA, 115 bp, Mus musculus
catgtgctttgctttcagggtctgttgatgtttcttgtaaaagtggcaggatgcacactgaagtgagagcgctcattgccactgaattgcgcacttgaaaactgtgacagtttcc

SEQ ID NO: 75165 - DNA, 111 bp, Mus musculus
gaggagtcggaattctaaaccagtttggaggagtctatatttgtaaatcaattttaaaatgcaaatgttttgttcctaaatatggacaaactacttagaagctgaaatatc

SEQ ID NO: 75166 - DNA, 119 bp, Mus musculus
acatgtgtgtgtatgtatgtatgtatgcatgtgcatgtgtgtgtatatgtatgcatgtgtgtgcatatatgtgtgtatatatgtgtgtgtgcatgtatgtatatatgtatgtatgtata

SEQ ID NO: 75167 - DNA, 114 bp, Mus musculus
atagcaacttttattggtgactattctggagatgtcaggagaactgcagaacggtgccatttcacagtcagcattcacttgccatatgcagcaggctctaagaaaaggttttgt

SEQ ID NO: 75168 - DNA, 75 bp, Mus musculus
gcttcaccacaaggtagactgtgagcttcaccacaagttggtggtttgggtcacagcactgagtgtggactgagt

SEQ ID NO: 75169 - DNA, 79 bp, Mus musculus
ttcatggctctgcaggatgggaagtattgggaagttacaaatgtgagccttgtgtctttgttcttcactttgccgtgga

SEQ ID NO: 75170 - DNA, 85 bp, Mus musculus
gggttgctgcatgggcatcctcacacgctctcacactgggctcctattgtcagagatgggtctggggatgaggctgtcagagctc

SEQ ID NO: 75171 - DNA, 98 bp, Mus musculus
gcacattcatgtgcatgtgtgtatatgcctgtgcatgcatgtgtatttgtgtatgtgcatgtatgtatgtatgtatgtgtgcatatgttttgatgtgt

SEQ ID NO: 75172 - DNA, 68 bp, Mus musculus
gtcagactctctgagtcccaggcaggaggcagggaagggaacggtgtggggagcagggtatatgtgac

SEQ ID NO: 75173 - DNA, 69 bp, Mus musculus
tgctcgtcaacatacgaccagggacttctggtgaatgccatcactccctgtgtgtctgaccaaagagca

SEQ ID NO: 75174 - DNA, 68 bp, Mus musculus
gtatacatgttcacatgtgtatgtgtatatgtgtaatgtgtgtatacaatgtttgtgtgcatgtgtat

SEQ ID NO: 75175 - DNA, 62 bp, Mus musculus
gtatgcatgtatgtgtatgtgcatgtttatgtgtaggggtgtacttgcctctgtgtgcatat

SEQ ID NO: 75176 - DNA, 92 bp, Mus musculus
ttggtcgcggcggcctcgaaggagctgtgtcaccagggaactgagaggctcctcacagaactgagtgacttggggtatcgagttttggctaa

SEQ ID NO: 75177 - DNA, 76 bp, Mus musculus
gttcactggatccctggcttgggttcaggagatgggccccctcctcacatctctctgagcctgccactcagttaac

SEQ ID NO: 75178 - DNA, 112 bp, Mus musculus
gtcccgggatcctaacacccacgtttacagatgagagagagcacaggcaggggaggtcgcttgtagaaggccacacacacagtaaatgacaggtctgggatttgaagagggc

SEQ ID NO: 75179 - DNA, 70 bp, Mus musculus
tgacctgcctggctgcctctatgtgtgcacgtagggttctatgaacaacatggggctctgagtcaggtca

SEQ ID NO: 75180 - DNA, 76 bp, Mus musculus
gaggttcacacaggctctcctcattcaccgtctcatctaaggctttgatcaggatcactctgtccctgtgattctc

SEQ ID NO: 75181 - DNA, 117 bp, Mus musculus
gctgaggatatgaggaggggcaatcactgccaccaccactcagaggacagagtggacagcacttggggccttctgagaggaggggccgagggagcccaacctcattcctgccacagt

SEQ ID NO: 75182 - DNA, 63 bp, Mus musculus
agattggtgagaggtgacaaggtttggcgagtgtgctctttgtctctcagtctcagcatgtct

SEQ ID NO: 75183 - DNA, 74 bp, Mus musculus
gggaaaggtttgatgaaaacactgaggcactgagtgctcagaagtctctcactctgtgcacatcgtccagtccc

SEQ ID NO: 75184 - DNA, 105 bp, Mus musculus
atttcaaaattggtttatcctatcccataatagttcttctagatttactttatatatatgttagtgagtggaggcgggctactgtgtgattgcagtacctgaggt

SEQ ID NO: 75185 - DNA, 105 bp, Mus musculus; identical to SEQ ID NO: 75073

SEQ ID NO: 75186 - DNA, 60 bp, Mus musculus
tcactggaagggctggagagatggctcagcatttaagaccactgactgctcttccagagg

SEQ ID NO: 75187 - DNA, 62 bp, Mus musculus
tgcacagtggatgatggaacggcagtgactgacttactctgtgtttgtgtgtccctgttgca

SEQ ID NO: 75188 - DNA, 71 bp, Mus musculus
tcgggtaacgtgctagtgtgaagaccaacgatgggccacagcctcacagtgtctcactggatttggcctga

SEQ ID NO: 75189 - DNA, 78 bp, Mus musculus
ctctctctgtctcactggtctacacatctgtcttcatgattgctgtagcatgctagtaagtcctgggagcggggaggg

SEQ ID NO: 75190 - DNA, 128 bp, Mus musculus
agtgctgtctcagaacagggcaggcgtgaggcttgctcacaatgctaacccacatgcgacaggctgagtcactgaaacagtgggcagtgagaagggtaacagccactggaatggtgatgcgtagcgca

SEQ ID NO: 75191 - DNA, 108 bp, Mus musculus
cctaggcacacacatacaaaggcaggcttggtggctcgagctgtgccaggccatggaggctgacagcacagagggagcttgaccactgtcatttgcacagaacctggg

SEQ ID NO: 75192 - DNA, 135 bp, Mus musculus
ccaacttttacatagacactgggcataggaactcaggtcttcacgcctgctcagtgtggtagtagtttgaatagtaatggccccataggttcatgtgtgactgcttggctcataggagtggcactattaggaggc

SEQ ID NO: 75193 - DNA, 78 bp, Mus musculus
tggattgaggaacttctctgtgtcactctttgcctgagaaagaatgcaatgaaattcagaatggtttcttattctcca

SEQ ID NO: 75194 - DNA, 73 bp, Mus musculus
gctgctgtcattatgccacatgcagctttctactgctacagtcagaagaaagactgcactttagggactgggc

SEQ ID NO: 75195 - DNA, 113 bp, Mus musculus
tctgctcacgcattgaagagctttagaagtctcttgaagctggagaagcagggctgctgctgtgtggtctgccggagacctgtgacccaaggagctgatggtgcagagcttga

SEQ ID NO: 75196 - DNA, 68 bp, Mus musculus
gtatcaggggctggagagatgggtcagtggttgggagcactgactgctcttccagaggtcctgagttc

SEQ ID NO: 75197 - DNA, 86 bp, Mus musculus
gcaggttctaaaaccacgtgctaggagtaggagccctgcccctgggcagcctcagctctgtctctgagtgcttggttggagcttgt

SEQ ID NO: 75198 - DNA, 66 bp, Mus musculus
gccatagctccaacactgggcctagtccagagagactctgcccctgtgtgtgtgtgacctgtgtgt

SEQ ID NO: 75199 - DNA, 101 bp, Mus musculus
aggactcagagcttctcatctgtagggtatcctggagccagaggccatggctgcccacagaagagtgacaggactcctgcctcctggaatagataaaaccc

SEQ ID NO: 75200 - DNA, 79 bp, Mus musculus
acttctgttagtttcactgtgtctctgtttagtttctgtttccaggatctgtccattgatgaaagtggggtgttgaagt

SEQ ID NO: 75201 - DNA, 85 bp, Mus musculus; identical to SEQ ID NO: 57470

SEQ ID NO: 75202 - DNA, 84 bp, Mus musculus
gggagggaagcacatactggttacagcagattctccagcccagttccttgtcctctgagacctctctgtgtgtctgtcccttcc

SEQ ID NO: 75203 - DNA, 72 bp, Mus musculus
acagtggagatagaccacaagtgtgggcctttgaagtacagcccagtcctaattctgtctgtctctcactgt

SEQ ID NO: 75204 - DNA, 111 bp, Mus musculus
cttgggacaagagtcaagacactccattattaaattaccccaagtcatttttggtttggaatgatatgatgtatggatgccaattcctgtagcttggcttcttaaactaag

SEQ ID NO: 75205 - DNA, 77 bp, Mus musculus
gtgtcccatgtgcagatagatggtgggacactgagatgttcctgtccactgcctccatctctgtgcctctgtgacac

SEQ ID NO: 75206 - DNA, 107 bp, Mus musculus
gaatactggttctgaagtctaccaaatactacggtgtgttttagcctaactcagtctctgtctggcatcctataagtagttgtgggtgactaggaattatgtcattt

SEQ ID NO: 75207 - DNA, 111 bp, Mus musculus
gaggtcagaggtgaggagtcaaggctgcctttccatgagtaaaagggatttcatgtgtcaactcacagccagctctgtatggaagccactggctatcatcacctctctccc

SEQ ID NO: 75208 - DNA, 91 bp, Mus musculus
agaggttactgtgttcctctaacttctggaatatgggctctggctgagttcaggatgaaacttgggtgggaatgatcagtacctggcctct

SEQ ID NO: 75209 - DNA, 111 bp, Mus musculus
tgctgctttgtctagagtccccttgatctctagcactgggtctctctttcttagtattgtaggaggaagaggaaccagcaagctacgtggtcaggaataagatagacagca

SEQ ID NO: 75210 - DNA, 104 bp, Mus musculus
ggctggcacagtgttcagaggtgtgtggagagcagaacggctctggggctctgctgtccctctgtctgcccctctaccttcagctctgaaacactctggttgtc

SEQ ID NO: 75211 - DNA, 112 bp, Mus musculus
gtgtttccagcaagtacccagtactcgccatgtgttcccaatgatatcacttgctctcagactcactgggacagaatgtggattcagtattgttcaggctttgtggacagat

SEQ ID NO: 75212 - DNA, 89 bp, Mus musculus
cttcggggaggatcttttcatcttgttctgctcctcaccctctaagctgggtgtctatttgacttgctggattagaaatctttctggag

SEQ ID NO: 75213 - DNA, 107 bp, Mus musculus
gtaggtactgtgggtactgggaagctgatgtctgtgggtgggtgcctctttgcatagccaagaaacgctctctaattgcttttatctcttaccagatgccccaggac

SEQ ID NO: 75214 - DNA, 94 bp, Mus musculus
ccagtggtttctgatgcctgatgagtaagcccaggttagggattctgtttgtctgagcctctgtctctccatcagtatcttgtgtggcttctgg

SEQ ID NO: 75215 - DNA, 95 bp, Mus musculus
cagcatggggccaaggcagagtcgatattaagtcaatgtttttaaatgaacaaattatttttaaatgacttaaacgttcccttgtttatcagctg

SEQ ID NO: 75216 - DNA, 66 bp, Mus musculus
ggtaggacgaagggctcagcgtacactgtgaggacagaggctctgtatgctggcctccttcttact

SEQ ID NO: 75217 - DNA, 112 bp, Mus musculus
gtgtatatgaatatatgagtgtacatgtttatataagtattcatgtatgtatgtgagtgtatgtgtgtgtatgatatgcatatatgtaagcatgtgtgtgctttgtgtatat

SEQ ID NO: 75218 - DNA, 99 bp, Mus musculus
gctcacctggatggggcttgaggtgttttaccaataagtagactagatgcatttatatatttatttcccagaaagcaggagcacgtcacacaggagagc

SEQ ID NO: 75219 - DNA, 97 bp, Mus musculus
gtaccttacctgctcagtcagtcactctatcaggcttcctgtggattttttttttctttagaaagttctgttaaagcatttggccatatagtggtgc

SEQ ID NO: 75220 - DNA, 80 bp, Mus musculus
gcccattgaagacagtctgcaaacatggccactgtgccacggtgactctgtaaagtagcccctgttcagaggtgatgggc

SEQ ID NO: 75221 - DNA, 83 bp, Mus musculus
actattattcataagcacactgagtgataaagaaaaaggtgttaaatgctaattgctggctctgtcactgtgtgcctggtagt

SEQ ID NO: 75222 - DNA, 83 bp, Mus musculus
ccgagacaagtaccactctcctttacatgacagaagacactgaactattgatcccctggctgtgtggagactggagtgctggg

SEQ ID NO: 75223 - DNA, 90 bp, Mus musculus
gatgtctatttatctgtctgactctgtgcctggccaggtagcctgtacttcttggcaaagtagcggctagagtgatggtatctgacactc

SEQ ID NO: 75224 - DNA, 75 bp, Mus musculus
tgtctgtctctatgagtctggctccgaggagatgtccatcctccagcatggcaccaaggcttagtagagagagca

SEQ ID NO: 75225 - DNA, 93 bp, Mus musculus
caccatagactcagcagactctcactatgtcacaagcaatttattaaaagcataataattggtatgtgcaataagtgagctggagtgatggtg

SEQ ID NO: 75226 - DNA, 84 bp, Mus musculus
ttgtacattatttttgtgtatatggtcatgtttgtgtgtgcaggtacaccatgcatgcacacatgtctgtgtgtatatgtgcag

SEQ ID NO: 75227 - DNA, 89 bp, Mus musculus
catcaactgccccagatcacagcaggagacttggatagccagtaggcacagcaggattccagtctcagtcactctgaaaaggtaggatg

SEQ ID NO: 75228 - DNA, 89 bp, Mus musculus
gcctgcctgcctgcctgtctgcctgcctgatttctgagctaattctggggctcagctatttgccaggctccccaggacacagagaaggc

SEQ ID NO: 75229 - DNA, 85 bp, Mus musculus
cagtctgctgccttctttcccctgatcacagtttaaatgtgccatcattgtaggtagacagggaagtaggagagcgtgaagactg

SEQ ID NO: 75230 - DNA, 81 bp, Mus musculus
agctgcctatcatgagtggaatgttatatggcccaccaagtgattgtgtacagcaacaatccactatcaagtgaaagggct

SEQ ID NO: 75231 - DNA, 80 bp, Mus musculus
ctcagtgatgggggctgagttgggacagggactcctcagcaacttagggcctctctcttgctctcagtgtccttgctggg

SEQ ID NO: 75232 - DNA, 110 bp, Mus musculus
ggtacagggacagcccacttcatatctgttccagcctctctcaggctgtctgtgaggaagctcagaagagtctagagtcctttggtggtgaactggtttgtctgacaacc

SEQ ID NO: 75233 - DNA, 193 bp, Mus musculus
atgtatatatgtgtgtgtgtataatatatatatatatatatatatatatatatatatatatatatatatatacacacattatacacacacatatgtgtgtgtgtgtagagtatatatatatgtgtgtgtgtgtatccacacatatatatacattatatacgtgtatatatatatatacacatacatacatatg

SEQ ID NO: 75234 - DNA, 117 bp, Mus musculus
ggaatgcctttggctctggggctggagaagtccatggcacgttgctgagtctcttgtcttgagtcacagtcagctgctcccagattgctgctgctcccagttctcactggctgttcc

SEQ ID NO: 75235 - DNA, 71 bp, Mus musculus
agtgtcaccgggacagctgtgggggttcaggtccgcatgacttgacagatgacagaagtcagtgtgacact

SEQ ID NO: 75236 - DNA, 79 bp, Mus musculus
tggacctgagagctgagagtggccacacccagctgggctgaggcttctgtggggtgggggcatctctgggactgggcca

SEQ ID NO: 75237 - DNA, 72 bp, Mus musculus
ccaggtgacaggtgctgggcagagctagagttctcccttattctcactctgactctgttcccttctaccagg

SEQ ID NO: 75238 - DNA, 72 bp, Mus musculus
gatgacacaggctggcaatgtgcagcctgcttagtgcttctctgctcatgtctgtctgcctgtctgtctgtc

SEQ ID NO: 75239 - DNA, 95 bp, Mus musculus
gggtcagctggcatctctgaagaagtggcatttgaggagtgatatagccttctcccactctctctgtctttaagcagataggccatcttctacct

SEQ ID NO: 75240 - DNA, 93 bp, Mus musculus
gcttcctcaggaaagagctgtgagcctaggaccggtgagaaacacactcagggtctctggaattggtactgtgaggcaagacagctgcctagc

SEQ ID NO: 75241 - DNA, 108 bp, Mus musculus
ggtcagtctgtgtacgcagcagcaagtgaggactgacatttagctctgactcatgttgagtcacagtacaaagtgtggacttcataggtgcgtgtgcaccgcctgagc

SEQ ID NO: 75242 - DNA, 71 bp, Mus musculus
ccacagaaatgacagaggacagaggagtttgtggctttaaagtgagcttttgttgctgttaattactgtgg

SEQ ID NO: 75243 - DNA, 60 bp, Mus musculus
gcgcctctgcctctgcctctgcctctctgcctctggagtggtgagatttaaggtgtgcgc

SEQ ID NO: 75244 - DNA, 76 bp, Mus musculus
ctggcactactttgatgaacaaaagaggaagatacgtgtttgtttagagctgtcatctgtgtgagtcaggagccag

SEQ ID NO: 75245 - DNA, 91 bp, Mus musculus
ggctttgctccttgggggcttccttgaagactgccgaggaggaggtctctacactcctgtcctctgtgtctgtctccagcgatctcaggct

SEQ ID NO: 75246 - DNA, 59 bp, Mus musculus
gaactcagatccctagcagcagctcctgcaagcctgtctgtctgtctgtctctgagttc

SEQ ID NO: 75247 - DNA, 66 bp, Mus musculus
gcagtctctgtctgtctcctctttggactctgttctctgcgaaacccacaagaggaggacagctgt

SEQ ID NO: 75248 - DNA, 72 bp, Mus musculus
tgtggctctctcttagcctctgctgatgccaccagctggacagagctccctggtaagtgagacttccccaca

SEQ ID NO: 75249 - DNA, 66 bp, Mus musculus
tagtctgtctgacaccagacatgtgggcacagagtcttggtctctgtctgtctgtctgactgactg

SEQ ID NO: 75250 - DNA, 66 bp, Mus musculus
ttaggcactcgactgacagtcatttgccactttcatcaggatgggtggctgtctctcagtccctga

SEQ ID NO: 75251 - DNA, 108 bp, Mus musculus
actgttctgtctctcatcccatttatctgtgtgtctgtctgtccctgccatgtggggactgtatctgaggacattcatggtgagtggcctattagtcagtggagcagt

SEQ ID NO: 75252 - DNA, 89 bp, Mus musculus
gtcactctgatgggctcctgtggtagcagccttgatagcccagtgctgtcacctatcatttgcttgagaccacggtcctcacagacgac

SEQ ID NO: 75253 - DNA, 68 bp, Mus musculus
tcagctctgagtacccagtgtgcacagcctctacatataggctgcacagagggctgcttagtccctgg

SEQ ID NO: 75254 - DNA, 115 bp, Mus musculus
tggcccgcacattctcgctggctgttcctttttcctatgcatatacttctttgtggatctggtctaaagaggtatagcgcatgggaagatggagcagtgagatcttccccaccca

SEQ ID NO: 75255 - DNA, 91 bp, Mus musculus
accaccgggcctatgctgagtcacttttcagagctccagtcagtagggcagtgtccctgtctctggctctgtcagcactggtccccgtggt

SEQ ID NO: 75256 - DNA, 93 bp, Mus musculus
gcttgacacagttccagccaagctgagtggaatgctgagcttgctgtcgttctgtctgtctctcagttttaggttttggtttctgtgtgttgt

SEQ ID NO: 75257 - DNA, 66 bp, Mus musculus
gatagagctctctctctgtgagactaggctggggcctagcaaacacataagtagatgctcacagtc

SEQ ID NO: 75258 - DNA, 83 bp, Mus musculus
ctcggccatcacagtgactctgtccctccctcagccgaagggcatcctggagacctgacagggagaaactctgatgggcagag

SEQ ID NO: 75259 - DNA, 85 bp, Mus musculus; identical to SEQ ID NO: 57470

SEQ ID NO: 75260 - DNA, 56 bp, Mus musculus
tctctctgtctctcaaacataagtcgtctcactggcaatggggaggggaggagggg

SEQ ID NO: 75261 - DNA, 106 bp, Mus musculus
gccttagtccatgttggtctgataggaggcatgggacaatttcaatatttttgtatctgttgaggcctgttttgtgaccaactatatggtcaattttggagaaggt

SEQ ID NO: 75262 - DNA, 75 bp, Mus musculus
acagtaggaataccaaataaagggaaaggagaaatggctgtcctaaaagctctgtgtgtgtgtgtgactatctgt

SEQ ID NO: 75263 - DNA, 85 bp, Mus musculus
ggccatggtggtctgatagcacgcatgggacaatttcaatatttttgtatctgttgaggcctgttttgtgaccaattatatggtc

SEQ ID NO: 75264 - DNA, 85 bp, Mus musculus; identical to SEQ ID NO: 57470

SEQ ID NO: 75265 - DNA, 113 bp, Mus musculus
ctcggttttgtactcagtcctcagtccaaccctcaatcccctcatctatacactgaggaacaaggatgtcaagcttgccctgagaagactcttgccctctttctaaaattaag

SEQ ID NO: 75266 - DNA, 77 bp, Mus musculus
gcctattgtcagtagttcctcaggtagaagtggctcatgagctgtgccctgccggacagacagacagacagacaggc

SEQ ID NO: 75267 - DNA, 73 bp, Mus musculus
agatccatctctctgactcattgtcttacctgaagtatatgcacttggtagatcctgagtagagtcctggtct

SEQ ID NO: 75268 - DNA, 70 bp, Mus musculus
tgtcactgttactctgactatctgggggacctgtttatctcatccccttctttagtaagggcagcatgca

SEQ ID NO: 75269 - DNA, 105 bp, Mus musculus
tatacacacatacacatatacacacatatatatgcatatatatgaatgtatatacatatatatgcatatactgcatgtgtgtgcacatatacatatgtgaatata

SEQ ID NO: 75270 - DNA, 117 bp, Mus musculus
atattcatgagggaaattgatctgaagttttctttcttcattgggtctttaggtggtttagatatcagagtaattgtggctttatagaatgaattaggtagtgttccttctgtttat

SEQ ID NO: 75271 - DNA, 87 bp, Mus musculus
agcaggttctatttaagggagccaggctcacacatctccttctgaccagcctgtgagaacagcgtgtggcttgcccccttctagctc

SEQ ID NO: 75272 - DNA, 81 bp, Mus musculus
ggtgactgacagtctcagtgtccttatctgatagctgccataatcagaagaactgggcccatatactgagtaccacagacc

SEQ ID NO: 75273 - DNA, 84 bp, Mus musculus
atcagccactgccggtcagtgtccctcagtgactccagcacagggtgcatgagctgtggggacagagacagacagttaactggt

SEQ ID NO: 75274 - DNA, 80 bp, Mus musculus
ttcttattcatgtatatgtgtatagtgtgcgttcatgtgtgtttgtgcatgttcacatgtttgtgcaaatgcatgtggaa

SEQ ID NO: 75275 - DNA, 67 bp, Mus musculus
gtgccattccctgggccaagcatattcaaaccaccacagtgtgtgtgtgtgtccctgggccaagcat

SEQ ID NO: 75276 - DNA, 123 bp, Mus musculus
tgtgtgtgcgcatgtgtgtgtgcatatttgttcgtgtgtgagtatgtgtgcatgtgcatgtgtgtctgtatatatgtgtgtgcatgagtgtgtgcgtgaatgtgtgtgcatgtgtatgtgtgt

SEQ ID NO: 75277 - DNA, 110 bp, Mus musculus
ccaaagcggtgctggcctttagtctcaagactgcagtctcagtctctctgacaacaggaaagaacatttgaaggacagtggtaagggtggtgaaggtgaaagagaattgg

SEQ ID NO: 75278 - DNA, 82 bp, Mus musculus
ggtcagaggcagacaggcagtggcactaagtgaatgttctcaagtcacttctcctctctgtgtgtcacatgcccctggcttc

SEQ ID NO: 75279 - DNA, 70 bp, Mus musculus
tggtcacttcccactgcccatccctgacctgaaataagcctgtgagatgtgtgtgagaagggaggggcca

SEQ ID NO: 75280 - DNA, 73 bp, Mus musculus
gcatgtgtatgcatgtatgtatgcatgtatgtgcatgtgtgtgcatgtatgtatgcatgtatgtgcatgtgta

SEQ ID NO: 75281 - DNA, 103 bp, Mus musculus
tttttaaaatttttagtttgaatttgaaatgacaggcaggactggtggggtgtgtctaatcccactgtctgtgtgtctcccaggtttagggaaaagagaaaaa

SEQ ID NO: 75282 - DNA, 115 bp, Mus musculus
tggcactggagagatggctcaacagttaagagcactgactgctcttccagaggtcctgagttcaaatcccagcaaccacatggtgactcaccaccatctgtaatggtatcaatgc

SEQ ID NO: 75283 - DNA, 67 bp, Mus musculus
ctgggagtggcatgagcaaatgccagcgagggcttcctacgtcacattccctgtctgtcactgtcag

SEQ ID NO: 75284 - DNA, 85 bp, Mus musculus
gccaaagagccaggtgtggtggtgcaggcctttgaatcccagcacttgggaggcagatgcaggcagatctctgtgagctcaaggc

SEQ ID NO: 75285 - DNA, 79 bp, Mus musculus
ggccggaagcagaatagagtctgtcctgtgtcccaggtgtgggaacctcacaggactctctctgtgtgccacagaggcc

SEQ ID NO: 75286 - DNA, 117 bp, Mus musculus
gccggggcagtccctccaggctcaggacagccactgcccaccgcacactgcgttgctccggacccactgtgcgtgtgacagcggctgatctgtccctgggcagcgcgaacccctggc

SEQ ID NO: 75287 - DNA, 69 bp, Mus musculus
ggacccttctggcagaggagatccggttccggttcacagttgccctcactctctcactctgccgtgtcc

SEQ ID NO: 75288 - DNA, 90 bp, Mus musculus
cagaagttaagagcactgactgctcttccagaggtcccagattcaattcccagtccccacatggaagctcagaactgtctataacttctg

SEQ ID NO: 75289 - DNA, 85 bp, Mus musculus
gggtagagtggggagacagaagagagccagcaatacatgagacccattgggagtgctggctgctcaggggctcctctttctactt

SEQ ID NO: 75290 - DNA, 117 bp, Mus musculus
gggcctctcacagaaagggccttcacagacagggcctctctcagacagggtcactctcagacatggtgtctcacagacaaggcctctcacatacagggcctcttataggcaaggcct

SEQ ID NO: 75291 - DNA, 83 bp, Mus musculus
ctggttggagtaagtgtgccactgtgagcgtgagctttaagacccttgtcctagctgcctgaatgccagtcttctcctatcag

SEQ ID NO: 75292 - DNA, 105 bp, Mus musculus
ggtttatttgccatacacttccatatcacagttcatcacagaagagagtcaggacaggcactcaagcagatcaagaacctggaagcagaagctgatgcagaggcc

SEQ ID NO: 75293 - DNA, 78 bp, Mus musculus
gtatctatctgtatgagtattttgcctgcatgtatatatgtatatcatatgtgtgcctgatgctcttggaagagatac

SEQ ID NO: 75294 - DNA, 101 bp, Mus musculus
ctggaaaatggagacaggagaattaagaagctcaaagtcaggttgtctcagcagttaagagcactgactgctcttccagaggtcctgagttcaattcccag

SEQ ID NO: 75295 - DNA, 80 bp, Mus musculus
gcacagtatggctatgagaatctttatctttttttttttttttggcttttcgagacagggtttctctgtatagccctggc

SEQ ID NO: 75296 - DNA, 90 bp, Mus musculus
tccaccaacctgtggtttatagaagtggctctgactctgtcttttttctcagacggaaagagacgtgagtgtgaggcagcgggcagtgga

SEQ ID NO: 75297 - DNA, 80 bp, Mus musculus
tggaagaagggtgtctcgctctcactccttcacctgcttgccgtgtgggactgagtaactgctagatccttggacttcca

SEQ ID NO: 75298 - DNA, 80 bp, Mus musculus
gccacaggtggggaaaatgcaggtgattttctagttgtgtaaaattatgatggtattatgaatgaatgtcttcatgtggc

SEQ ID NO: 75299 - DNA, 105 bp, Mus musculus
aatagtcatagctcacaataagtacattcagctgagaagtgcaggtatcactctgactgactgttcatgctaagtgtgacataatgtgtataaaccacctctgtt

SEQ ID NO: 75300 - DNA, 74 bp, Mus musculus
tctgtatgtctgtgtgtgtctgtgtatgtatatgtgtgtagatatatcatgtgaaggtgctcacagaagccagg

SEQ ID NO: 75301 - DNA, 89 bp, Mus musculus
tcgctccagtctctctgactaatcatgaccttctgttctgtgtctatatgtctcgggtcatgacaagacagacattaggcttaagggac

SEQ ID NO: 75302 - DNA, 65 bp, Mus musculus
ggttgaggaaagtcagaattcacagagcagaaagcagagtgactggcttggcgtgcatcctctcc

SEQ ID NO: 75303 - DNA, 87 bp, Mus musculus
gttcatcaacccttcttcatcctcacggtgtctcagcaaactatagaagattgatggtggctgccagaggagaaagggagacagagc

SEQ ID NO: 75304 - DNA, 93 bp, Mus musculus
aggtctggtcaacagaggccaaagcagaatgaagagagtgagcagaagacacgtataaagctgcctctcagagcggggcctgtgaagactcct

SEQ ID NO: 75305 - DNA, 97 bp, Mus musculus
cttctgaacaggtctagtgctgacagctcccttctgatgtatatgtgtgtacattcattgctgtagtatgcagataccttcaggggcaccaaggacc

SEQ ID NO: 75306 - DNA, 65 bp, Mus musculus
ctggagagtgagtgctcagtgtcctaaggagctgcagggccaaatgagcaggttcattctactag

SEQ ID NO: 75307 - DNA, 100 bp, Mus musculus
tgagttcacaatgagtattggtttctttgtccccctctgaagttgtgtcacttctgggagctgggtacataggaatgtttagaattctctgttgtactca

SEQ ID NO: 75308 - DNA, 75 bp, Mus musculus
gctgtgatgcaaagaaaggaggctgagaaagaatcacactgtcacagtcagccttcattgtcactctgacacagc

SEQ ID NO: 75309 - DNA, 63 bp, Mus musculus
gcctgcattgagccttcacccttacattctagtctctttggtgtgagaagatactctgcaggc

SEQ ID NO: 75310 - DNA, 113 bp, Mus musculus
gtgacctgtgagtcacaggtttcaggtcagaggaggaagccaccaatgttacagactgatgagagtgagtgctgaggtgggcaaatggagcctgaaacccaggaggcaggcac

SEQ ID NO: 75311 - DNA, 80 bp, Mus musculus
aggtcactgtcatccacagacagacagacagacagatggaagctctcttctgctctgggtggaacctgagcatgagacct

SEQ ID NO: 75312 - DNA, 60 bp, Mus musculus
ctgtgatctagaagttgatgctggaagacacacactttcagtctggatctttagacatag

SEQ ID NO: 75313 - DNA, 57 bp, Mus musculus
acagagagacagagacagagacagagagagactgtgtccatgtgtctgtgtgtctgt

SEQ ID NO: 75314 - DNA, 83 bp, Mus musculus
gtgactcctttgccagcgaggcaaccactttacccactgagccatgactgttcaggcagggtctctcactgggtgggactcac

SEQ ID NO: 75315 - DNA, 90 bp, Mus musculus
ctcagagaatgggatgtcttatcagagaggcaaagggagagccaaatggcagaagtcacggtgtcaccctctgactgacattcctgggag

SEQ ID NO: 75316 - DNA, 115 bp, Mus musculus
ctgtacctccacagctcttctgtgccctgagtgtgtccttggtctttgtgtaacactcacacactatgatccagcccctgggcacccttccctcctggcactatgggtaggacag

SEQ ID NO: 75317 - DNA, 67 bp, Mus musculus
acacacactcagacacacactgagacagatgcattaaaacatagtcacaatctcagctgggtgtggt

SEQ ID NO: 75318 - DNA, 104 bp, Mus musculus
gcctgagaatagacctttagcctgagtgagtaccagtagaatgttttagacaacagtgagagcacacataaggcctacaaacccagggaagaactgtcacaggc

SEQ ID NO: 75319 - DNA, 61 bp, Mus musculus
tgtatgtatatatatgtgtgtgcatatatatatatatatatatatatatatatatatatat

SEQ ID NO: 75320 - DNA, 116 bp, Mus musculus
tgaggtataaggtggtctccagaattaactgggaattaatgctctctcacagtctcactagagtctagtgacttccccaggtttgaagtaggttctaaggacctccctgtgtctca

SEQ ID NO: 75321 - DNA, 138 bp, Mus musculus
ctcccagaattctcatttgaaggactgttcccagactttcctggattccaggctatggctcagtcagtctgtcattcttgagggtgtttaggttcctgggagaattccttgtgcctcttcaggctggctgactgactg

SEQ ID NO: 75322 - DNA, 86 bp, Mus musculus
cattaaccaagaaactgcaccacaaacttgcctacaggccaatctgctgggaagttttctcagtggtgattctctctccccagatg

SEQ ID NO: 75323 - DNA, 72 bp, Mus musculus
atgtgttgtgcacccaggcgtccatgtcagtcctgagaaaactgtctgcctgcctggctgccataatcacgt

SEQ ID NO: 75324 - DNA, 62 bp, Mus musculus
tgtgcatatatgtgtatatgtttgcatataggtatatgtgtgtatatatttgtatgtgcaca

SEQ ID NO: 75325 - DNA, 79 bp, Mus musculus
cagagtctcactgtgtgagctctggcctgccagaaactcactcaatagaccaggctggcctcaaactcacagagatctg

SEQ ID NO: 75326 - DNA, 78 bp, Mus musculus
ctattctcaatatctgtctctgactcagtgcccagattgcacatgtattgagatagatagagcccacgatgaggatgg

SEQ ID NO: 75327 - DNA, 73 bp, Mus musculus
cccaacagcctctgtctgtctcccacctctgtcccatcaccatggattagaggggctagagggggctgaaggg

SEQ ID NO: 75328 - DNA, 75 bp, Mus musculus
cagatatttttgtatgtctatatgtatattcatatatatatgtatatgtatgtatgtatataatacaagtatttg

SEQ ID NO: 75329 - DNA, 114 bp, Mus musculus
gatgggtgtgggcacatccatgccactgcgcatgtgtgggtcagtagcggcatccactgtctctttttgtctctatgtggagtctgggatcgaacacagctcactagtcttgtc

SEQ ID NO: 75330 - DNA, 83 bp, Mus musculus
ccatcacagacacacccactggctcatctgatcgaggctaagattcccttcccaggtgattctgggttgtttcaagttgatgg

SEQ ID NO: 75331 - DNA, 83 bp, Mus musculus
gaggcagctgactctctctgactttgaggccagcctggtcttacctatctagagccaggcaagccagaggaagtctttgtctc

SEQ ID NO: 75332 - DNA, 91 bp, Mus musculus
tgggtttctagaaaggctgttcctggtgaccaaaagcagtgagcagcctctcaggctctcactgtgatctgcaggcagctgttgtatccca

SEQ ID NO: 75333 - DNA, 111 bp, Mus musculus
ggtaagagagcaggtgcagctgggcagagcacatccagcctgaaacagctcacctgtgactcagcctgtgactcagcctgcccaagtagtcacctgtggaatctgatgatc

SEQ ID NO: 75334 - DNA, 63 bp, Mus musculus
tgcattacttagtcagggggatcatccctgcgagggctaagtctccctctctgagcctttgta

SEQ ID NO: 75335 - DNA, 106 bp, Mus musculus
ggagtaccagcatctcagatgttgttcccatagctgaaggaacacctctaataactttcctgactctctctgtgtggatcagaagcctctaagaccctgagcctct

SEQ ID NO: 75336 - DNA, 97 bp, Mus musculus
gccaaggtcagaaagatttactcctctactttcttctaagagtttaaagtttttacatttaaaaaaaaggggggggtaattcatttttgtatgtggt

SEQ ID NO: 75337 - DNA, 123 bp, Mus musculus
ctttgcacacaactctgtattattatctctctcactctatgtctttaagttttttttttttttttttttttttttttcactgctagactggaacgcggggtagtctgtgtgctagagatgtgc

SEQ ID NO: 75338 - DNA, 87 bp, Mus musculus
ggagaacatcctgaactcacagggagcattgatgagaactccaaagccatcctcatccttaatgacaggtgacaggaggccttctcc

SEQ ID NO: 75339 - DNA, 90 bp, Mus musculus
tacatacctgctctctcagtccctctctgtgggtgtttaagatgaggacttgtaatactacctcctgagatgtgcgtgagcttgtttgtg

SEQ ID NO: 75340 - DNA, 93 bp, Mus musculus
tacctggaagaactccctgggtccctgtagcccatccaggaatctctgccctttgccaggatggaggtcaggggctgactggtgaagcaggtg

SEQ ID NO: 75341 - DNA, 121 bp, Mus musculus
cccagttcctcccttttctgatctgctgagctggggtgtgcatgcagcaaaggagatctgattttcatgttgtggcctgtgacttgaccctactcggctgcaaggtagagaggtggggtgg

SEQ ID NO: 75342 - DNA, 63 bp, Mus musculus
gccttggtcagcatgctgtctgtgactacgttgagagtacagagactgaataccagcccaggc

SEQ ID NO: 75343 - DNA, 113 bp, Mus musculus
ctgtactcctgctgaggcaatggttactgtgagcatgatcagctaggctagagtgcattgaagttaggcccagttcttccttccagtcccatgctcccagaagtaagatatag

SEQ ID NO: 75344 - DNA, 88 bp, Mus musculus
gcagctgcaggacaacttgagggacctggcttgatcgtcctgtcatgtgagacccagggttcaggctcagaccgaatgtcatcactgt

SEQ ID NO: 75345 - DNA, 83 bp, Mus musculus
tatgggacaatttcaatatttttgtatctgttgaggcctgttttgtgaccaattatatagtcaattttggagaaggtcccatg

SEQ ID NO: 75346 - DNA, 70 bp, Mus musculus
ggtgaggttgtatgtatgtatgtatgtatgtatgtatgtatgtatgtatgtattaagatatggccttatt

SEQ ID NO: 75347 - DNA, 117 bp, Mus musculus
cttcagtgtgctgtgaaccctttgcccacaacaatcatagtcccatttgtgtgactctctcactggccatgaaggtactagatggggtggaacactagctaaactctcaaactgcag

SEQ ID NO: 75348 - DNA, 87 bp, Mus musculus
gtgcacactcttacccactgagccagctccgtagcctaagtacacaggcttgagtgtgagctttgtggatggcagcatttgtgtcac

SEQ ID NO: 75349 - DNA, 78 bp, Mus musculus
gaataattccagggctggagagatggctcagcggttaagagcactgactgctcttctgaaggtcctgaggtcaaattc

SEQ ID NO: 75350 - DNA, 69 bp, Mus musculus
gctggagagatgactcagaggttaagagcactggctgctcttccagaggtcctgagttccattcccagc

SEQ ID NO: 75351 - DNA, 107 bp, Mus musculus
atgataagtaacacagcacacagccattcaggatgagactgctgtctctctctctcaccaggacccagctcatcctcctttggtcgtggcatcagcttctacatcat

SEQ ID NO: 75352 - DNA, 69 bp, Mus musculus
gtggcctggttggcagacagagcttcctgtctctgcttccgaagccagctgtctctgtctcagtcccac

SEQ ID NO: 75353 - DNA, 91 bp, Mus musculus
cctgaaatgtgtatatgtgtgcctgtgtgtgtgcctgtgtgcatgtgtgtgtatgtgtgcctgtgtgcatgtatatgtatgtgtgtgaggg

SEQ ID NO: 75354 - DNA, 93 bp, Mus musculus
cgctatcctcttaactctgtgtgtgtctgagtgcctggactgtacacatgagctacgggcatgagctacgggcatgagctacgggcatgagcg

SEQ ID NO: 75355 - DNA, 60 bp, Mus musculus
tctgtgtgagtctctgtttcattcagccagctgcagcagggtggaacgagacagtgtaga

SEQ ID NO: 75356 - DNA, 138 bp, Mus musculus
cactgacatgttctgcaggagcagtgtctcagctcagaaaatgggctcaccactgcccctctggccctgtctctgagtcactagcacgatccttttccactacaagaggaaggcagttcttgtgttccaggcccccag

SEQ ID NO: 75357 - DNA, 85 bp, Mus musculus
ggtagaaggcttcaagcagtggtcactctcagactgtgcctttgatgaagcatatctggggattagggccaaactggggccaacc

SEQ ID NO: 75358 - DNA, 87 bp, Mus musculus
gtctgagaggagccctgagagaagtgagagagatcctgtttcatatggaggaggaaaacaaactgtgattgctttagggcctcaggc

SEQ ID NO: 75359 - DNA, 83 bp, Mus musculus
ctgagtgggccacacttgcaatcactgtctttatttcatattaattaaagacaagtgagctactaggaagaatggttgcttgg

SEQ ID NO: 75360 - DNA, 64 bp, Mus musculus
gagctggtgagttggaacacaagcgtgacacctgtgacactctctgtgtctggcttctctcttc

SEQ ID NO: 75361 - DNA, 100 bp, Mus musculus
tcccaattcttttggcccttttggtagtttgctctgagactgtctcacacacacagctcacacagtcagcctgagatagggggaaagttcacccagagga

SEQ ID NO: 75362 - DNA, 86 bp, Mus musculus
catgactgggtggttttctgagcataaaatgggggactccctttctcactggggctcccctgtctgcctgtctctgcctgagagtg

SEQ ID NO: 75363 - DNA, 79 bp, Mus musculus
ggtctgagccgcctccccatccttgagtgtttggatttctgtttgttaatgtgcagggtctcactctgtggctcagact

SEQ ID NO: 75364 - DNA, 63 bp, Mus musculus
cagtgagagagctcagtgggcagaggcactggccagcaagtctgaaaacagagttcctccctg

SEQ ID NO: 75365 - DNA, 74 bp, Mus musculus
tatatgtatgagtgttttgcatgtatgaatgtatgtatatgtgcatgtatgcatgtaatgtaactatatatgta

SEQ ID NO: 75366 - DNA, 90 bp, Mus musculus
gaaaggagttcaaggtcacttcagttacactcagcttgaggccaacctaggttacatctgggctacaagaaaccgtgtcttaaacccttc

SEQ ID NO: 75367 - DNA, 77 bp, Mus musculus
gtggtttgccagacatcacacaggttgaaacagagggcagctctccagcctgcttgcctgcctgtctgcctgactgc

SEQ ID NO: 75368 - DNA, 76 bp, Mus musculus
aggatcagggggtgtgtgcgatggccgtacagactccgtccctctgacaccatttctctcatactctctcattcct

SEQ ID NO: 75369 - DNA, 79 bp, Mus musculus
tcagatcagactgaggtcacagggaaggggtggccagtgacaaccaccctgtataccctgccccaccagtcctctctga

SEQ ID NO: 75370 - DNA, 121 bp, Mus musculus
catatacatgagaatgagatctgtctgcctgcctgtctgcctatttatttattcattaattaagttagttagttagaatgtgtgggcatgaaggtgaagggacaattttcctcatggtatg

SEQ ID NO: 75371 - DNA, 65 bp, Mus musculus
gagtgcctgtgtcaggccgggctgtcaggcagtcagtggctcagtgtgggattggacaggggctc

SEQ ID NO: 75372 - DNA, 68 bp, Mus musculus
ggtggctgtgtgtctgtccctctgtccgccgctgtaccgctaggaagggggggggggatgcaggcgct

SEQ ID NO: 75373 - DNA, 91 bp, Mus musculus
catcttcccctagccctggtctctgctctctgtgacaccttgatgaggacacaatcatggatgtcccttggtgcaggcactactgtggatg

SEQ ID NO: 75374 - DNA, 123 bp, Mus musculus
gagaactgaggggccaacagttcctgctgaccagtgctgcagggtgagggtccctggatgccagtcttcgaagccagcgtctaacctggacttatgtcacagtacccgtgggcttgttccagg

SEQ ID NO: 75375 - DNA, 66 bp, Mus musculus
tggctggctctgaagacagacatgctgcccatctgtgcgttctctgtctgtgtgtgatgcctgcca

SEQ ID NO: 75376 - DNA, 99 bp, Mus musculus
tccacgatttagctgctctcagaacaggaagagctgaagggcgcagaacacatgtatcaccctttgtctctgagtctcacctgacccacagctctggga

SEQ ID NO: 75377 - DNA, 97 bp, Mus musculus
gctagaacatgcaactgtcggctcgtttctctctgcctgtgagtgtgggtgtgatgtcatcagctgcttcaggttctgctcccttgagtttccggca

SEQ ID NO: 75378 - DNA, 86 bp, Mus musculus
gcatccctacagtacagatgaggaaaacaagcgctgaactgcctaagaatgggtcattctgtcttcctctctctgagtatggatgc

SEQ ID NO: 75379 - DNA, 108 bp, Mus musculus
gggatcattttgcgaaatgacagagcagagtctcctgtgtcgacagatgctttttatatttataaagcaggagctgcctctttttctttctttcttttttttttttcc

SEQ ID NO: 75380 - DNA, 92 bp, Mus musculus
cctaggtgagagctgacagtgtgcagacaggcttgctttgagggaaaccaaataggcactgacccaggttgtactgaaggttatcatttagg

SEQ ID NO: 75381 - DNA, 87 bp, Mus musculus
ggcctaaatagaacacactgagctctcagacacctgaggacatgcttaggagggctgtcattggccctccccagtcattctcatgtc

SEQ ID NO: 75382 - DNA, 71 bp, Mus musculus
tgcagagacctgggtagacatctaacctccacatctatgagcgagacagggtgggtgtctctctctctgta

SEQ ID NO: 75383 - DNA, 79 bp, Mus musculus
tcttggcgtcccgctgacacctggtcatggatctctagaagccttgatccctgcctgcctgtgagcgaaactgcgggga

SEQ ID NO: 75384 - DNA, 99 bp, Mus musculus
taggcaccccaagactccagagtatagggctagtctggggcctactggctttgcccagccactgtctctggctctggtcccttggcctattgatgcctg

SEQ ID NO: 75385 - DNA, 95 bp, Mus musculus
tgtgagtgaatgactgactgactgactgagtgagtgaatggatgaatggcccctcacctctagggttctaaggtcactgggagttattgctcata

SEQ ID NO: 75386 - DNA, 80 bp, Mus musculus
ggccaggcttcaggaatggagtcactcacagtgtcacggaagtggcatctggacgggtttgctacagactgactctggct

SEQ ID NO: 75387 - DNA, 81 bp, Mus musculus
gtgtccttgtctgtaaactgaggcaggtgcatgcagtctgctttctgtgtgtcactgtctgctgtttacattgctgtccac

SEQ ID NO: 75388 - DNA, 87 bp, Mus musculus
ccttgcccagtggagagagctcccttggcacgggctaagactgtgccctctgcctgtgtgccaggctctcttctcttccaggcaagg

SEQ ID NO: 75389 - DNA, 61 bp, Mus musculus
gactgtctcatgacttcacactggccgtttctgggctcagtcagtgggtcagtgactcgtc

SEQ ID NO: 75390 - DNA, 124 bp, Mus musculus
gcatgtgtgtttatgtgtatatatatatatgtttgtgttgtgtatgtgtgtatgcatatgtgtatatatgtgtatatgtatatatatgtatgtgtgaatgtatgtgtacatatgtatatgtgtg

SEQ ID NO: 75391 - DNA, 81 bp, Mus musculus
aggtttttttggcttgcacttccacacacttttcatcactgaagggagtgagggcaggaacataagcagggcaaggaacct

SEQ ID NO: 75392 - DNA, 73 bp, Mus musculus
cagtggtcctgttgcttgttatggagggcttgcttaagagagctgtgtagataacagaaaagagtgatctctg

SEQ ID NO: 75393 - DNA, 65 bp, Mus musculus
agatgattgggcaacggggggtgcaggggtgtgtctgtgtcctctgtcactctgtgtgtctgtct

SEQ ID NO: 75394 - DNA, 71 bp, Mus musculus
gtctcactgtgtcactgtggctagcccggaactcactatgtagaccaggctggcctcaaactcaaagagat

SEQ ID NO: 75395 - DNA, 74 bp, Mus musculus
cggggtcactggagtctgtgagggagcttcgtgaacacatctgtgtccttgttctctctgtgtgtgtctctctg

SEQ ID NO: 75396 - DNA, 58 bp, Mus musculus
gctaggagggcagctcagtgggcagcgtacctgcctgcctgcctgcctgcctgcctgc

SEQ ID NO: 75397 - DNA, 77 bp, Mus musculus
gggttccagaaattaagctcagatttgggggcaaggaatctccctcactccctcactgagccatcttgctggccccc

SEQ ID NO: 75398 - DNA, 117 bp, Mus musculus
ctgggattctcttctgccccctccacacttttactgtatatatatggatatatacatttttataaatgtatcacccgtgtgtgcttggtgcccagagatgccagaagagggctttgg

SEQ ID NO: 75399 - DNA, 69 bp, Mus musculus
cagtagcacagacacacacagatacacacctatgtcttgtgtcttcatctgtgtgtgtgtgtgtgtgtg

SEQ ID NO: 75400 - DNA, 107 bp, Mus musculus
agccttgttcccatcccctggcacctgctccttccttgcctggctggctctgtctcacaaagtggctgcagctggggtgacaggcccaggcactgaggcatggggct

SEQ ID NO: 75401 - DNA, 90 bp, Mus musculus
cgtatgtatgtatgtatgtatatacatatatgtatgtgtgtatatatgtatatgtgtatatacatagacatatatatgcacatatatata

SEQ ID NO: 75402 - DNA, 63 bp, Mus musculus
gagatggggttttcacagggccgagcctatccaaggcctgtgtctgtcagtgattctgttctc

SEQ ID NO: 75403 - DNA, 58 bp, Mus musculus
tttgtttctcgcacactgtgtgagtcccacggggccgcttggtacggggagtagcgag

SEQ ID NO: 75404 - DNA, 101 bp, Mus musculus
ggttttaaatacttttgtgtgtgtgtaggaatgttttgcccctgtgtgcgtctgtgtgccacatgcatgcctacagaggtcagaagagggtgtctgatccc

SEQ ID NO: 75405 - DNA, 117 bp, Mus musculus
ggcagcccccatgtgggtaccgggccaggtaggcagcaaacaggaagcaggtgtgagtagactggcaccaggcacactggctggagttggccaggcagtcctcacaggtcagccgtc

SEQ ID NO: 75406 - DNA, 62 bp, Mus musculus
tatacatatatacatgcatacatacatatatatatgtatatgtgtgtgtgtatatatgtata

SEQ ID NO: 75407 - DNA, 105 bp, Mus musculus
tatgtatgtatgtatgtatgtatgtatgtatgtatgtatgtatgtatgtatatgtgtatgtgtgcccatgtgtaatttatatatgagcatattttgtgtgtgtgc

SEQ ID NO: 75408 - DNA, 96 bp, Mus musculus
ctgcctcccctgagctgagccctgggagtccgaggctctagcaattgcttaccaccttccagagtctcactctcagacccctcccttagtttacag

SEQ ID NO: 75409 - DNA, 86 bp, Mus musculus
ggaagtcctgcttgaaccttccacctgttataggtatgagccaccgtgcctgtctttctgtgtcaggttttgatttagaagttacc

SEQ ID NO: 75410 - DNA, 73 bp, Mus musculus
gggctacatagtgagttgcaggtcaggtcagggctacagagtggaactctgtctcaacctctctcattcaccc

SEQ ID NO: 75411 - DNA, 79 bp, Mus musculus
catgactctagtctcttactgtcattttcttattctgtgttatacatgagagatgaggtgaaggagatcaagggttctg

SEQ ID NO: 75412 - DNA, 70 bp, Mus musculus
caacctttgacttcagtgaagtggatgcgctatttaacaaagtgtctctatcactcagtggcacaggttg

SEQ ID NO: 75413 - DNA, 106 bp, Mus musculus
ggtggctgatttctgcccttgtccaaagaatctgcctgaggctacttgaagagttgtgaattaatagttttggtggagaagatttccagacagcctagcattgacc

SEQ ID NO: 75414 - DNA, 91 bp, Mus musculus
ggtggagtggcataggcctgtatttccagctacttggggcttgggaaaaaagatgagtgtgagctgagaagttcaggctggcatgaatatc

SEQ ID NO: 75415 - DNA, 81 bp, Mus musculus
ggagagaaagataagcagacagggtcagaatgcagatgacggagtggcatctgtgtgacacagtctcactatctagtgccc

SEQ ID NO: 75416 - DNA, 101 bp, Mus musculus
catcatcagaatctataagaataggacagggaaggggtgctgtgaaacagcagcagcatgtggcatagtaccaccctggcttgatggtgcccatgatgatg

SEQ ID NO: 75417 - DNA, 90 bp, Mus musculus
tgtgtgtgtgtctatctaggcatgtgtctgtgtgtgtatctgtgtatgtgtctgtataggcatgtgtctgtgtctctctgtgtatgtgta

SEQ ID NO: 75418 - DNA, 84 bp, Mus musculus
gtgtgtctgtctaggcatgtgtctgtgtgtctgtgtattcgtgagagtggagcatgtgctgggcatgtgtgaggaaggaagggc

SEQ ID NO: 75419 - DNA, 86 bp, Mus musculus
gcccggggggtgggggggggggaggtgcacaagggtggagggcactgctctcctcctcactgactctgtccttcatccctggaggt

SEQ ID NO: 75420 - DNA, 121 bp, Mus musculus
gtgcatatatgtgtgtatatgtatgtatttatatatttgtgtgtatgtatatatatgtatatatatatgtgtgtgtgtgtatatatatatatatatatatatatgtatatatatataaaac

SEQ ID NO: 75421 - DNA, 91 bp, Mus musculus
tatgtgtgtgtgttcatgcgtgtgtggggggtgtgtgtatgtgcatgtgtatttgtgtctatgactgtgtgtgtgtgaatgtatgtgtgtg

SEQ ID NO: 75422 - DNA, 112 bp, Mus musculus
tacgtgtatatgtttatatgtatctattgactatgtatctattcattgtgtatttatgtatatgtacatatatatgtactatctaattaggtatctatcatgtatgtatgta

SEQ ID NO: 75423 - DNA, 73 bp, Mus musculus
gtattgtagagtaggggagaaagcctgggttacctaaggtcctatatctctatctccatctccatctgcatac

SEQ ID NO: 75424 - DNA, 72 bp, Mus musculus
ggcagctttacacttgtactttctgcattcaagaagctgaggtagaagattgttgcaagttcagggtctgcc

SEQ ID NO: 75425 - DNA, 85 bp, Mus musculus; identical to SEQ ID NO: 60314

SEQ ID NO: 75426 - DNA, 73 bp, Mus musculus
gaacttctgctgtagaggcagagagaataaagcagggcttccctcaaattctctctgtctctgggagagtttc

SEQ ID NO: 75427 - DNA, 64 bp, Mus musculus
cttctactgtagagccagagagaatagagcagggcatcacctgatttctctctgtctctggaag

SEQ ID NO: 75428 - DNA, 71 bp, Mus musculus
tggagaccagcctgtctgtgcatagcccagtgccccacactcccggagtctgtgtcattgactctgtgcca

SEQ ID NO: 75429 - DNA, 79 bp, Mus musculus
acttctcttagtttcactgtgtctctgtttagtttctgtttccaggatctgtccattgatgagagtggtgtgttgaagt

SEQ ID NO: 75430 - DNA, 174 bp, Mus musculus
cacttggggctggagagatggctcagtggttaagagcactgactgctcttccagaggatccagatttgattcccagcacccacatggcaactcacaactgtctgtaactcaagtttcaggggatctgacaccctcacacagaaatatgtgcaggcaagaaaccaattgcacatg

SEQ ID NO: 75431 - DNA, 93 bp, Mus musculus
ggctgtcgttggcacctcagtctcagtatctgaaaggccagcacagcggtcaggtagacggggtagtctgagtgtgccaaggagaaggaagct

SEQ ID NO: 75432 - DNA, 120 bp, Mus musculus
aaggcttcgggggaccctgggagaatgtcctcagatcttgctctggcctgtcacccagtgtcactctgccttgcggggtcctactttgggttggtatgtagtcctagtttatgagctctc

SEQ ID NO: 75433 - DNA, 69 bp, Mus musculus
gggcccctctggagtaggcgttctcacctcctgagcccagaggagctgtgagaagttacagaggagccc

SEQ ID NO: 75434 - DNA, 116 bp, Mus musculus
tttcattcatatgaattatacacacactctttctatatatatctctatctatctatctatctatctatctatctatctatctatcgagagaaagtgtgtgtacatgtgctttgaga

SEQ ID NO: 75435 - DNA, 69 bp, Mus musculus
tggaactctttatgtagaccaggctggtcttgaactcacagagatctgcctgtctctgcctctgtgcca

SEQ ID NO: 75436 - DNA, 72 bp, Mus musculus
tgctgggttccttcaagggctctccttaatattttttgagacagaggctctctctgaatctggaactcagca

SEQ ID NO: 75437 - DNA, 90 bp, Mus musculus
catatacatacctggtgtctacaaaagtcagaggcatcagatctcccgggagagttactgacagttgtgagccaccacgtaggtgctgtg

SEQ ID NO: 75438 - DNA, 91 bp, Mus musculus
catggaggggggtgctggagagatggctcagaggttaagagcactgactgctcttccataggtcctgagttcaattcccagcaaccacatg

SEQ ID NO: 75439 - DNA, 120 bp, Mus musculus
ggatggtgagctgggagcccttgagctcgagacccccggatgccctctagggtccattctggctcactcagccactctccaggacagctgctgggatcaaagagctcagggcctggcctc

SEQ ID NO: 75440 - DNA, 118 bp, Mus musculus
gctgcaaagattttgcaactccttggacaccagcctctgtagggcctttgtaggtagaacacgctagagagtcagcacagtaaggcaggaggatcaggagttcaaggttgttcttggc

SEQ ID NO: 75441 - DNA, 71 bp, Mus musculus
gcagtccagtcagctgaatgcatggtgtgtgtggttaggagaatatgccagcgctcactctgactgactgt

SEQ ID NO: 75442 - DNA, 103 bp, Mus musculus
gaaaaggaaccaggaccttggtcaagccccaggacaactctaggcctcagacaagtgtgtgtgcagtaggttcctcgggctgtcagagcttttgagacttttc

SEQ ID NO: 75443 - DNA, 87 bp, Mus musculus
gaatgcctgtgtgtgtgtgtgtgtgtgtgtgtgcgcgcgcgcgcgtgtgtgcgcgtgtgcactcgcacacactcacagaggtgggca

SEQ ID NO: 75444 - DNA, 74 bp, Mus musculus
tgcatctgtatatgtatatgtatgtatatacgtatatatgtatgtatgtatatatgtatgtgtgtgtgtgtgta

SEQ ID NO: 75445 - DNA, 79 bp, Mus musculus; identical to SEQ ID NO: 72631

SEQ ID NO: 75446 - DNA, 109 bp, Mus musculus
ggctgatgtaggaaagggcaaaatgctatgtctatttttttttaagaaagggtctctagtaaacaaaagctggacatgaagtcactgtatacctatactacatacaact

SEQ ID NO: 75447 - DNA, 73 bp, Mus musculus
gatgttgagagatatcagtgagcagtgttttttgatttctcttactttgttgtgctggtgtatctttctcatc

SEQ ID NO: 75448 - DNA, 62 bp, Mus musculus
actagattacttggttggttgtctttggcaacagagacagagtctgactcagtccctctagt

SEQ ID NO: 75449 - DNA, 79 bp, Mus musculus
gctaaggtgtcactggctcagtgaggctgtccctggtcacccttccaggatccctttcctgttgcccctcctcctctgc

SEQ ID NO: 75450 - DNA, 122 bp, Mus musculus
tcagagaggcagggaggcgggagcgctgattgtcgatctgcagagaggtgacagtggtcagactcctgtgtgatctctccttcagaccttcatctccttcactgaaatccccagctctagcc

SEQ ID NO: 75451 - DNA, 69 bp, Mus musculus
ctgtcattgtctctgtctctccacagccaccatgtgggtgctgggaactgaacacaggtcctctgaaag

SEQ ID NO: 75452 - DNA, 103 bp, Mus musculus
gtgatctgcaaatgaaacacagcagaggccaggctgagtggagacagcccaccctgtcaccactctgtctctgcctcagactgtgcccagttacagagagcac

SEQ ID NO: 75453 - DNA, 83 bp, Mus musculus
tctgagatgactgtgagatcagatggtggctgcaccccaggagctatggaaaactctggtcttgaaagagtgctgtctttaga

SEQ ID NO: 75454 - DNA, 73 bp, Mus musculus
gcgtcactcagactgtgactgagctggccgacattctgttggctgttttaatgtacacagctgctgggggtgc

SEQ ID NO: 75455 - DNA, 90 bp, Mus musculus
caacaatgtctgctgaggtgtcactggctcagtgaggctgtccctggtcaccctttcagtagccctttcctgttgcccctcctcctctgc

SEQ ID NO: 75456 - DNA, 69 bp, Mus musculus
gagtcagggactctcactgagcctgagctggccagttcggccggcctgtctggtcagtgtttctgtctt

SEQ ID NO: 75457 - DNA, 81 bp, Mus musculus
tgtctgtcagtctgtccatgtctctttccagggatgcctgggagtggttgggaggggacgaagggggcagctgatcagtca

SEQ ID NO: 75458 - DNA, 69 bp, Mus musculus
tgctctagccttctgagtactggcatcagaggcctgtgccactctgcctgactcaaattggtctgttca

SEQ ID NO: 75459 - DNA, 77 bp, Mus musculus
gggttctagagagagaactcagtgtgtaaagcacctgcctggcaagcttgaggacctgagtttagctcccagaaccc

SEQ ID NO: 75460 - DNA, 93 bp, Mus musculus
gttactccgaatgtctgatctgagtgtctgcacactgggctgtgacccggggtgcaggtgcccgtgcggatatactccatttctaaggatgac

SEQ ID NO: 75461 - DNA, 77 bp, Mus musculus
ccccagatagtcactgagtgtctgtgtgtgtcagaccctgctcaaggtgctaggggcgggacgctcagaggaagggg

SEQ ID NO: 75462 - DNA, 115 bp, Mus musculus
ctaccattgttgtttaagatgttaccttttggggctggagagatggctcagtggttaagagcactgactgctcttccgaaggtcctgggttcaaatcccagcaaccacatggtgg

SEQ ID NO: 75463 - DNA, 89 bp, Mus musculus
gtatcagtaacaacagagagatcagactagatggcaggtgaggaccagcacccatggttatcttctgacttccccatgtgtcatggtat

SEQ ID NO: 75464 - DNA, 73 bp, Mus musculus
atatatatgtatgtatgtatgtatgtatgtatatacacacacacatacatacatatatgatatatatatatat

SEQ ID NO: 75465 - DNA, 101 bp, Mus musculus
gccttggctgtcctggaactcactctgtagaccaggctggcctctacctatagagatctgcctgcctctgtctctgcctcctgagtgctgggattaaaggc

SEQ ID NO: 75466 - DNA, 80 bp, Mus musculus
accgcagagcacggccagccacgtgtggactccgtgtagactcacgtcctcaacggtcacacagcctgtgtctctgaggt

SEQ ID NO: 75467 - DNA, 89 bp, Mus musculus
gtatctagagaccagcctctgtgagtgcctgtgaggaactatcttgactgcattcattgatgcatctatgtgggtgggatcctggaggc

SEQ ID NO: 75468 - DNA, 95 bp, Mus musculus
ttagactcagggatcactctccctcactgtctctctcctacctagtgttagggagaagaaatccggggtgggggtggggtgggggtaaagggtga

SEQ ID NO: 75469 - DNA, 116 bp, Mus musculus
ttgagctaaacacaatcattttcatttccttttttgagacagtctgtctctcttgctcacttgaacttatgatccttctgtctcaaaccccttgattaaagatgggtgttattcaa

SEQ ID NO: 75470 - DNA, 78 bp, Mus musculus
tccacctgcctctgcctcccaagtgctattatatatttttatgaggatgttacagtggggttagtagcagtaggaggc

SEQ ID NO: 75471 - DNA, 90 bp, Mus musculus
gtcctgagcaggggagcaggacaaggtcacagcctgcagagctccctgccctgccacctctgtctctgtctggctgctctgacgcctgtg

SEQ ID NO: 75472 - DNA, 94 bp, Mus musculus
tggagctggagggatggctcagtggttaagaacactggctgttttgtctgcctggaggtgttgttggccagggagagattcttcctagcagcca

SEQ ID NO: 75473 - DNA, 62 bp, Mus musculus
agggacagtgactgtgtctctcttagtgataattcaatacagagagacttagtccagtctct

SEQ ID NO: 75474 - DNA, 101 bp, Mus musculus
ggcagaactcagaggctgaggtctcacactgtctcacacattattctctgctcccctgcagctgagtattgacagttgctgggtcggctccttctactgtc

SEQ ID NO: 75475 - DNA, 91 bp, Mus musculus
tctgtctatctgtctgtctgtctgtctataaagctaaggcccagtaaagttggccaacttgggcatagtcacacagataggatagtataga

SEQ ID NO: 75476 - DNA, 118 bp, Mus musculus
gtcgcgtgtcccactcccctcacctgccagtctaccagcaccagagacaacctgtcagaagtgagaaatctgaggagagactatgatgcaaggacttctgggagcaggtcaagccggc

SEQ ID NO: 75477 - DNA, 73 bp, Mus musculus
tgggatggatgtttgggtgcctgtgcccgggaagggcttccctcctctgacgagtgtctgtgtctgtcttcca

SEQ ID NO: 75478 - DNA, 85 bp, Mus musculus
ggctttggcccatgggtgctgtgtgtgaaaacaggcctgtattctgctcaggttctatcagacgctcacactgtcagttaatgcc

SEQ ID NO: 75479 - DNA, 86 bp, Mus musculus
gtaagaattagacaggggctggagagacggctcagcggttaagagcactgactgctcgtccagaggacctgagttcaattcccagc

SEQ ID NO: 75480 - DNA, 68 bp, Mus musculus
gggggtggggtgggggagggatggaggatctcgcagtcgttcacacacgctcactcacacgcacttcc

SEQ ID NO: 75481 - DNA, 64 bp, Mus musculus
ggtacttgagggatgctacggggaccagtttgaggctgcttaggagtgtctctctgtgagtgtc

SEQ ID NO: 75482 - DNA, 62 bp, Mus musculus
ttagggggctggagagatggctcagaggttgagagcgctgactgctcttccagaggtcctga

SEQ ID NO: 75483 - DNA, 88 bp, Mus musculus
tgtctgtgtactctggctggagagatagctcagtggttaagagccatctgactgctcttccagaggtcctgagttcaagtcccaggca

SEQ ID NO: 75484 - DNA, 85 bp, Mus musculus; identical to SEQ ID NO: 57470

SEQ ID NO: 75485 - DNA, 66 bp, Mus musculus
aggatctagtggaggagccctcttttggataaaagccattttgtctctgagactctcacaggtcct

SEQ ID NO: 75486 - DNA, 101 bp, Mus musculus; identical to SEQ ID NO: 75474

SEQ ID NO: 75487 - DNA, 77 bp, Mus musculus
tgtatgtatgtgtatgtatgtatgtgtgtatgtgtatgtatgtatgtatgtatgtatgtgtgtatactatgtgtaca

SEQ ID NO: 75488 - DNA, 113 bp, Mus musculus
ggttgttaagtggggggagctgggcatggtgatacacacacacatacttgtgacatgtatgtatgtatgtatgtatgtatacatgtgtctcaagcaaactgtcataattaatt

SEQ ID NO: 75489 - DNA, 79 bp, Mus musculus
cttagcggtcctctatgagttcagtcagagctgtgaggaagaagtgctgtggaagaagatcttgtaaggagccgctcag

SEQ ID NO: 75490 - DNA, 78 bp, Mus musculus
gggctcaggggtggagagatggctcagctgttaagagcactgactgctcttccagaggtcctgagttcaaatcccagc

SEQ ID NO: 75491 - DNA, 118 bp, Mus musculus
ggtgtttgtaataagctctgcagtggggctggagagatggctcagtggttaagagcactgactgctctttcagaggtcctgagttcaattcccagtaactacatggtggctcacagcc

SEQ ID NO: 75492 - DNA, 76 bp, Mus musculus
gaggcacgatgactgtgtgctgcttggtctctgtcaatctgacagaagctagagtcacctgggaatggagagcctc

SEQ ID NO: 75493 - DNA, 95 bp, Mus musculus
acatagcatgtatatgtaactataacatatattacatatgatataagcatatcatatgtaagtaatacttatgtagtatgcatatataattatgt

SEQ ID NO: 75494 - DNA, 90 bp, Mus musculus
gaattcatcctggtgtcaaaccctatgagtgtggagagtgtgggcaggcctttatccgtggctctcagctcattgaccactaccgagttc

SEQ ID NO: 75495 - DNA, 122 bp, Mus musculus
aggggctgctgatgtcagggtgggggaggaggtctggccgagtgctgacttcacactgtgtctgatgtgtctggcagtggggatgtggggtcactccttgtgcataactgctggcagcattc

SEQ ID NO: 75496 - DNA, 71 bp, Mus musculus
tgttggccaccttagttttgagatagggtcagctccaggcatcccctgtctctgactccctggcactagca

SEQ ID NO: 75497 - DNA, 82 bp, Mus musculus
gccggtgccagtgtctctcagtcactttccactatgtgacagagtctcccattgaacctggctagggtggctggtgagtgag

SEQ ID NO: 75498 - DNA, 103 bp, Mus musculus
tatatgatgatgtgtgtatgtatctatgacaatgtatatatatatgtatgtgtgatgatgtatgtgtatgtatgatgatgatgtatgcatgtatgatgatgtg

SEQ ID NO: 75499 - DNA, 91 bp, Mus musculus
cattagttttgtgtgtgtatatatatatgtgtgtatgtgtgtatgtatgtattatgtatatatgtacaatactgtatgtatacatgtatga

SEQ ID NO: 75500 - DNA, 93 bp, Mus musculus
ctgtctgtctgtctgcctgcctgcctgcctgaaagtgcagtttgagagaagtcagggtaaagtgagggttggagttaggaaataagcagacag

SEQ ID NO: 75501 - DNA, 110 bp, Mus musculus
gaaagcaacatatgagaggtttatttttgctcacatttagagactacagtgtgtcctggcagggaaggcacagtagctctgtggtggtaggagcggaaggtgttgctttt

SEQ ID NO: 75502 - DNA, 117 bp, Mus musculus
tctctccagatttcagtgaagtaaacagtgtttggaaaggtttttgttatgtccatctctctctctcagaaaccgaatcctcggacttaggtctcacagagtctgtctggcttcaga

SEQ ID NO: 75503 - DNA, 76 bp, Mus musculus
ggtgtgctacagatttctctgtgtgtctatgtgtgtatctacatatgtatatgcatatgtatctgtattgtaaccc

SEQ ID NO: 75504 - DNA, 80 bp, Mus musculus
ctgtcaggtatcagtgtcagcacagagcgtgggccgtgagcagtaacggagatggtgaggctgcctgacctgcctcacag

SEQ ID NO: 75505 - DNA, 95 bp, Mus musculus
gttactgcttgttctgttgtggttttcgtcatgggacagactgtgtgtgtgtcaaccctttgtttctgactgtggactcggactgacgttaggac

SEQ ID NO: 75506 - DNA, 116 bp, Mus musculus
ctggaagagcaaccagtgctcttaactgccgagccatctctccagccccataatatatttttttaagtacttaggaaagatagttcaatggtttagagcacttactgctcttgcag

SEQ ID NO: 75507 - DNA, 85 bp, Mus musculus
gctgaggaacgctaacacagaaggctgcacaggggaggaggacacacacactgtcaccctcactgtgtgcccaggtgttcacagc

SEQ ID NO: 75508 - DNA, 75 bp, Mus musculus
gggatgtgggcaggtgtgtttgcagaggccagaggaggacactgagtattctctatcactctctgccttactccc

SEQ ID NO: 75509 - DNA, 86 bp, Mus musculus
gttggcctgatgatgcttgtattctaatgctgatattagttgctcaagactggttacactagagacaagagagtctgcaggtagat

SEQ ID NO: 75510 - DNA, 85 bp, Mus musculus
tctctgtcctgtgtgtctctgtatcgctcatcggggcactaccacgtgaccgagcccaggaagaaaaggacaacagaggaagaga

SEQ ID NO: 75511 - DNA, 116 bp, Mus musculus
agccagaggttgggaagggtgggcttggaggtatgggagagcctctctgtgactctcggaggaatgggaaggagggaggtggtttgcagatggagccacctggacaatggtaggct

SEQ ID NO: 75512 - DNA, 75 bp, Mus musculus
ctgctatctctgcctcagtctctctcctcacttgcagccctggaagctggtgaccagctagctgagtcagctcag

SEQ ID NO: 75513 - DNA, 83 bp, Mus musculus
tctgtggctgtgaaagtccctggctttggctgtgttggctgtcacctctctcacggtgccactcagactcacttggtcccaga

SEQ ID NO: 75514 - DNA, 82 bp, Mus musculus
cattcagaacatacagaacaaaacagggtacatggtcagcatgcccttcgctgagccaagtcactctctgtgtcaatgattg

SEQ ID NO: 75515 - DNA, 92 bp, Mus musculus
tctcagagcattactcttggccgggagctcctcggccctgccacagttggaacagtacagacagagctcaggagcccagagtaggtcatgga

SEQ ID NO: 75516 - DNA, 89 bp, Mus musculus
tgtctctctctctcccttctttctctctctctctttctctctctctggctagaaaaggtgtggcaggaaagggagggagggaaaaggca

SEQ ID NO: 75517 - DNA, 106 bp, Mus musculus
gccttagtgcatggtgatctgataggatgcatgggacaatttcaatatttttgtatatgttgaggcttgttttgtgaccaattatgtggtcaattttggagaaggt

SEQ ID NO: 75518 - DNA, 69 bp, Mus musculus
aatgatttctgaagtcactgaggtcagggtaactgcccctgactgccagttgatgcttagagagccatt

SEQ ID NO: 75519 - DNA, 117 bp, Mus musculus
tggatcaattcacattcttctacatgataaacgccagttgtttcagcaccatttgttggaaatgctgtctttttttaactgatgtgtttagcttccttgtcaaagatcaagtgacca

SEQ ID NO: 75520 - DNA, 85 bp, Mus musculus
ggccatggtggtctgataggatgcataggacaatttcaatatttttgtatctgttgaggcctgttttgtgaccaattatatggtc

SEQ ID NO: 75521 - DNA, 75 bp, Mus musculus
ttttatcgtgagtctctatgtgtctggttaggggcaggaattgtgctcctacccaccactgaagcttgtctgaga

SEQ ID NO: 75522 - DNA, 117 bp, Mus musculus
ccactcactgctctcaccacatggactgtactgttcaaacctttttgagatatggttactgacagagttgagagaggagaagctgtgcaggacaacaggaatgagctaccttggagt

SEQ ID NO: 75523 - DNA, 100 bp, Mus musculus
gatcagccttagtctgtggtgatctgataggatgcataggataatttcaatatttttgtatctgtggaggcctgttttgtaaccaattctatggtcaatt

SEQ ID NO: 75524 - DNA, 74 bp, Mus musculus
ctctgcccagatgatcaggaccagggagacttccttgagtaagtttctctgtttctgtcaccaagtgcaaggag

SEQ ID NO: 75525 - DNA, 91 bp, Mus musculus
accttatgattttcataattgtcataatgttattcaatttatatctatgagaaggagtcatttattggacaaaaaaggggaattttgaggt

SEQ ID NO: 75526 - DNA, 91 bp, Mus musculus; identical to SEQ ID NO: 75525

SEQ ID NO: 75527 - DNA, 57 bp, Mus musculus
gtttctctctatctcagtgaatgggcttaagcagtccattgccaaggtgggtggaac

SEQ ID NO: 75528 - DNA, 98 bp, Mus musculus
ttacacacacacacaaacacacacaaacacacaaaaatacacacacacatatttctgtgtatttatgtatatgtgcatgtgtatatgtatgtgtataa

SEQ ID NO: 75529 - DNA, 100 bp, Mus musculus
gaacaacaacatggaattgcacagatggctcattggctaagagcactgactgctctttcagagatcctgagttcaattctaagcaaacacatggtgtgtc

SEQ ID NO: 75530 - DNA, 73 bp, Mus musculus
catgggacaatttcaatatttttgtatctgttgaggcctgttttgtgaccaattatatggagaaggtcccgtg

SEQ ID NO: 75531 - DNA, 92 bp, Mus musculus
ttggtcgcggcggcctcgaaggagctgtgtcaccagggaactgagaggctcctcacagaactgagtgacttggggcatcgagtttcggctaa

SEQ ID NO: 75532 - DNA, 112 bp, Mus musculus
gtgtccctgatgaaaaaattttgaggaatttcattctgatgttaacacatctttatagcatattgaatgatttaattccaccattttttataattcattgtctcttgggtac

SEQ ID NO: 75533 - DNA, 73 bp, Mus musculus; identical to SEQ ID NO: 75530

SEQ ID NO: 75534 - DNA, 117 bp, Mus musculus
gatggtgttttggaattcttcaggctctgttgttatgtctccctttcatttctgattttgttaatcatgatgctgtccatgtgccctttactgagtctggctaagggtttatctatc

SEQ ID NO: 75535 - DNA, 92 bp, Mus musculus; identical to SEQ ID NO: 57641

SEQ ID NO: 75536 - DNA, 73 bp, Mus musculus; identical to SEQ ID NO: 75530

SEQ ID NO: 75537 - DNA, 58 bp, Mus musculus
agcctcatcacagtagagtgtcaggtaggcatacatacctgtccattctgtggaggct

SEQ ID NO: 75538 - DNA, 76 bp, Mus musculus
tctctcacaatgtcactccatcataggtttctatagcttcagagacactcatgagctaagcagatataatgagagg

SEQ ID NO: 75539 - DNA, 82 bp, Mus musculus
acagaaaattctagatgtctgttcatgtgtttgtgtacttgtgtatgtgcctgtgtatggacagtggtactaagatgtatgt

SEQ ID NO: 75540 - DNA, 100 bp, Mus musculus
gaaaaacaacatggaattgcacagatagctcaatggttaagagcactgactgctctttcagagatcctgagttcaattcaaagcaaacacatggtgtctc

SEQ ID NO: 75541 - DNA, 92 bp, Mus musculus; identical to SEQ ID NO: 57641

SEQ ID NO: 75542 - DNA, 119 bp, Mus musculus
tttggagtcattcagaacaacaacatggaactggacagatggctcagtggttaagagcactgactgctctttcatagatcctgagttctatttccagcaagcacatggtgactcacaaa

SEQ ID NO: 75543 - DNA, 85 bp, Mus musculus; identical to SEQ ID NO: 57470

SEQ ID NO: 75544 - DNA, 85 bp, Mus musculus; identical to SEQ ID NO: 57470

SEQ ID NO: 75545 - DNA, 107 bp, Mus musculus
gtacatagtagaagggcaacaggagattgtagaagatagagagcagaggctctgccctgccccttaagtactcaccatacaatgctcagccctgccacactgggtac

SEQ ID NO: 75546 - DNA, 85 bp, Mus musculus; identical to SEQ ID NO: 59376

SEQ ID NO: 75547 - DNA, 113 bp, Mus musculus
tgcgttagatactctgtggtgctgggaatcaatcctgggtcttcagagagagcagaaagtgctctgaaccacagagacaactttccagacctctagagacttttttgtttgca

SEQ ID NO: 75548 - DNA, 83 bp, Mus musculus
gtgcgtgagagagagagagagagagagagagagagagagagagagagagagtgtttctcacaatctctctccttccacagcat

SEQ ID NO: 75549 - DNA, 106 bp, Mus musculus
gccttagtccatggtgatctgataggatgcatgggacaatttcaatatttttgtatctgttgaggcttgttttttgtccaattatgtggtcaattttggagaaggt

SEQ ID NO: 75550 - DNA, 83 bp, Mus musculus; identical to SEQ ID NO: 75548

SEQ ID NO: 75551 - DNA, 106 bp, Mus musculus; identical to SEQ ID NO: 75549

SEQ ID NO: 75552 - DNA, 80 bp, Mus musculus
gtctgcccttgatcaaggacacagggtaggcacaggtacaaggctctgggtctgtcagtgtctgaggagacaggggagac

SEQ ID NO: 75553 - DNA, 122 bp, Mus musculus
ccaggcatgtacatggagcacacacatatatacagacaaaacattcatacatataaaaatttttttaaaaaatgaaatgtgtgtatatgtgcatgtccttgtgggtgtctggaagctagcca

SEQ ID NO: 75554 - DNA, 139 bp, Mus musculus
acatatacagtgtaaacatatacagtgtatacatatatgtgtgtgtatatgtatgtctatatatgtatgtgtgtgtgtatatatatatatatatatacatactcatatgtgtgtgtatgtatgtatatgtgtgtgtgtg

SEQ ID NO: 75555 - DNA, 98 bp, Mus musculus
gctgtgacacagctttagcaatattcctgtcctttggctctctgcctcactgtctgcaatgatccctgagcttcaggtgcaggagctgtgttatcagt

SEQ ID NO: 75556 - DNA, 65 bp, Mus musculus
tatatatatgtacacacacacacatacatgtattatatatatgcgtatgtatgtatatatatatg

SEQ ID NO: 75557 - DNA, 77 bp, Mus musculus
ctcactctggctctctcactctggctctccctctcaggggaaaaaaagagagagagagagagagagagagagatgcc

SEQ ID NO: 75558 - DNA, 108 bp, Mus musculus
atatactactaagtagcagtgtagggattttaagttttcttgaataattttctttttaaaagatttttattttaggtatattagcgttttgcctgtatgtatgtatat

SEQ ID NO: 75559 - DNA, 94 bp, Mus musculus
cctcaaactcagatatctgtctgcctctgcctctcaagtgctaggatagaagaagaaggaggaggaggagggggagggggagggggggaggagg

SEQ ID NO: 75560 - DNA, 71 bp, Mus musculus
atgcacacactaaagtgtgaccagaggcagatgttacagactctcagctatccactgtgcggtgtgtgtgt

SEQ ID NO: 75561 - DNA, 70 bp, Mus musculus
tgcatgtttgtatgtgtatgtgcatgtgtttatatatgtgtgtatatgtatatacatatatggatatgta

SEQ ID NO: 75562 - DNA, 86 bp, Mus musculus
gttgttctggggctggagagatggttcactggttaagagcactgactgctcttccagaggtcatgaattcaaatcccagcaacagc

SEQ ID NO: 75563 - DNA, 76 bp, Mus musculus
gtatctatatgtatatatcttatatgtatgtgtgatatatgtacgtatatatgtatgagtatgtgcatatgcatat

SEQ ID NO: 75564 - DNA, 64 bp, Mus musculus
gtgtgtgtgaatgtctgtgtgtgtgtgagaatgtcacatacacagagagtatgtgagtgtgtgt

SEQ ID NO: 75565 - DNA, 82 bp, Mus musculus
gtactcaaatgtttgtaggagggctggtgagatggctcattggttaagatcactgactgctcttccagaggtcctgagttca

SEQ ID NO: 75566 - DNA, 83 bp, Mus musculus
ggtgtgtgttttcagctcggaccagctggtttctgtgactgtctgtgtcttatctcggttttccgggcctgattatctagatt

SEQ ID NO: 75567 - DNA, 89 bp, Mus musculus
gtaaagttgtgtgtgcatgtgtgtgtgcatgtgtgtgtgtacatgtgtgtgtgcatgtgtgtgtgcatgtgcatgcatgctaaatatac

SEQ ID NO: 75568 - DNA, 116 bp, Mus musculus
tacatgtatttttttgtacagatatggtgtgttaggtatgtatatatgtgtgtagatgtatacacatatggtatacatcatggcatatacctgagtgtgtatgggtgacacatgta

SEQ ID NO: 75569 - DNA, 94 bp, Mus musculus
tcttcatcatgtacatgcagtgcttgtagataccagaagagggcgtcataacccctggaacagatgtctgtgagctgacatgtggatgctggga

SEQ ID NO: 75570 - DNA, 70 bp, Mus musculus
gcgggctctctgctatttcctctgtccactcccacccagagtacacagtgaccagagagctgacccccgt

SEQ ID NO: 75571 - DNA, 60 bp, Mus musculus
gcaggtaggtagaacaggccaatgctatgcaagcacagcagtgtctgtctgtctgtctgt

SEQ ID NO: 75572 - DNA, 87 bp, Mus musculus
ggatgctattgcaccactgcaggtgatccctgacactcccctctctgtgggtgtctgggtctgtgcctgcgtgtatgcatatgcacc

SEQ ID NO: 75573 - DNA, 94 bp, Mus musculus
taaggatgtgtggctttgcagatttgagtgtgagcacaggcacctgcatttatctgagagtctatgccaaaccagactgtggggtttgtttttg

SEQ ID NO: 75574 - DNA, 92 bp, Mus musculus
gtgtggccctgagtagatgtgtatatgtacatgtgagtgtacatttgtatgaacatgtctgtatgtgtgcacatatatatttatgaccatgc

SEQ ID NO: 75575 - DNA, 89 bp, Mus musculus
gtggttggcctgggagggtctgtcctgtggatgtctttagccctgagctggtccaccacagccactctgttcctctcagacatatctat

SEQ ID NO: 75576 - DNA, 109 bp, Mus musculus
tacacacttaaaagtaatcactggggccagagagagagatgactcagtggttaagagcactgcctactcttacattaattctggttttagttttagcacttacttggta

SEQ ID NO: 75577 - DNA, 77 bp, Mus musculus
ctcagactgagctcacagggtgtaagttcctgctgccaagactaaggacctgactgatcacctgggcccacactgtg

SEQ ID NO: 75578 - DNA, 111 bp, Mus musculus
tatatatacacacacactatagacaatgaatatatagactatatgtatatatatggattacatgtacatatatagactatatatatatatatatatgtgtgtgtatatata

SEQ ID NO: 75579 - DNA, 59 bp, Mus musculus
gtgtgtgtgtgtgtgtgtgtgttacatacatgtataacattcaacactcacactcatgc

SEQ ID NO: 75580 - DNA, 71 bp, Mus musculus
gtgaactagaccactctgtctctctgccagccccttgctttctcatgcagaggtgagacagaaagattcac

SEQ ID NO: 75581 - DNA, 86 bp, Mus musculus
ggcacgaatgtgaagaagtttctagatagggttaactgagatgaggagactcaacataagcttgtagttggagctggtccatggct

SEQ ID NO: 75582 - DNA, 75 bp, Mus musculus
atatgtatgtatatgtatatatgtgtgtatacatgtgttatatatggatatagatgtatacatatacacacatgt

SEQ ID NO: 75583 - DNA, 91 bp, Mus musculus
gatgaaacgaggcagtgagcagacagagcacacggtgactgacagaccttccagcctctgctccccttgctgctctgctcatcagggcctc

SEQ ID NO: 75584 - DNA, 73 bp, Mus musculus
atatataggttatacatatgtatatatatgtacatatatatatatgtgtgtgtgtgtctgtgtatgtgtgtgt

SEQ ID NO: 75585 - DNA, 89 bp, Mus musculus
gggaggaaaggaggggactggagagatggctcagcggttaagagcactgactgctcttccagaggtcctgagttcaattcccagcaacc

SEQ ID NO: 75586 - DNA, 90 bp, Mus musculus
tgctatatatgtatatcaatatatgtatatacgtatccatatgtatctgtatgtatctatatgtgtctatatgtaatggagtattacgca

SEQ ID NO: 75587 - DNA, 103 bp, Mus musculus
ttgtgtgacccagtcctggggtttctggcctggtgctatcccaggctcaccctgtctgtcactcccaactgctagaacttgctctttgccctggcgttaccag

SEQ ID NO: 75588 - DNA, 94 bp, Mus musculus
cttttattattttaagtgtaatctctctgtctctcagctgagcttcaggctaactttgagctcactgtgcagttaatgaccttaacttctgaag

SEQ ID NO: 75589 - DNA, 92 bp, Mus musculus
ggccttgaggggttactgtgtgaatgaagagagtctgctttggtgactaaaacagtagttctcaacctgtgggccatgaccactttggggtc

SEQ ID NO: 75590 - DNA, 78 bp, Mus musculus
gatatggaatagaggggcaaagggcaagaggaagacatcccatgtcaacctctgactctgactctctctctctctctc

SEQ ID NO: 75591 - DNA, 84 bp, Mus musculus
ggttggtttggctttttaagacagggttcctcagtgtagctttggctgtcctagaactcactctgcatacagaccagactggcc

SEQ ID NO: 75592 - DNA, 65 bp, Mus musculus
gctgtctggctgtctggctggctgtctgtgtgagtttatgtgcactgcttggaagccagaagagc

SEQ ID NO: 75593 - DNA, 112 bp, Mus musculus
ctggggctctgtatgtccgtccgtccgtccgtccatctgactccctctcttcctctcttgtcagtactggaaattgaacctaagaccttgcacatactgagccacatcccag

SEQ ID NO: 75594 - DNA, 92 bp, Mus musculus
tggaaggcagaagcacctggcaccatgcagtcggaactagaggggtctcacggtggctcgctggatggctcaggggggagcatttgccacca

SEQ ID NO: 75595 - DNA, 96 bp, Mus musculus
gatcccctggaactggacttaggttgtgagctgtcatgtgccttttccgttgttttctatgtactgattttgttgttttgggtccaggactggatt

SEQ ID NO: 75596 - DNA, 82 bp, Mus musculus
ccaagtgatctcctcacttggtacatatttatgtgtctctctgtgtatgccacatgagtgcagtgcctgaggaggccagagg

SEQ ID NO: 75597 - DNA, 70 bp, Mus musculus
ttcccacagtctctctgaccctcggtttttcaagctgggaaatggagaggataagactgctccatgggaa

SEQ ID NO: 75598 - DNA, 82 bp, Mus musculus
catttcccaccttgtgcctggccactagacccccaagtgaaccacactctgtccctgtgagcctgcccccggtgccaatatg

SEQ ID NO: 75599 - DNA, 127 bp, Mus musculus
agacagacgtagagttgtccaactcccccaagggttattgcagattgctacttctgtctctcacactctcctacctggtgagctaatatcctggagggtgacatcacaggctggagagatctgaaag

SEQ ID NO: 75600 - DNA, 59 bp, Mus musculus
ggctggctggctggctggctggctggctacctgcctgcctgcctgcctgcctgccttcc

SEQ ID NO: 75601 - DNA, 74 bp, Mus musculus
gaaaatctggttttgagtctcactggctgtgtttatgaatctagtcaatgccactccagacacaacagattttt

SEQ ID NO: 75602 - DNA, 110 bp, Mus musculus
gtggtggaaagtgaaagttggggcttgattggaagaagtaggttgcttaggaatatgccctagatgggaatatcttctccccagggccctctctgcttcctgtccactgt

SEQ ID NO: 75603 - DNA, 65 bp, Mus musculus
atgtgtgcatatatatatatatatgcatatatgtatatgtatatacactatgtatgtgtacacat

SEQ ID NO: 75604 - DNA, 111 bp, Mus musculus
acatgtggcttcacttttcacaatagctaagatgtggaaccagcctagatacccctcaacagaatggataagggaaggcatgacatgtttgttgttgttgttgttgtttgt

SEQ ID NO: 75605 - DNA, 89 bp, Mus musculus
tgctcaatgttgggggcagagttgggatagggactcctcagcaaccgaggacctctctcttgctctcagtgtcctggctagggtgggta

SEQ ID NO: 75606 - DNA, 84 bp, Mus musculus
gcttcatgtatagtgtgtgtgtgtgtgtgtgtgtgtgttagtgtatgtgtgtgtgtgcatgcatgtgtgtgcatgtgcatgtgt

SEQ ID NO: 75607 - DNA, 100 bp, Mus musculus
atatatatgtgtgtgtatatatatatatatatgtatatgtaaaaccctctacaatccccccactatacatatatatgtgtgtgtgagtgtctgtgtatgt

SEQ ID NO: 75608 - DNA, 80 bp, Mus musculus
ccctgttgtctgtctctgtctgtgcttgggaggatccaggtaaacctctgtgagaattttaataacccagacctcaggtg

SEQ ID NO: 75609 - DNA, 117 bp, Mus musculus
cttagggaaggtgggtggctagggtcattgcagagcttcctggagtctttacatagtgataaggtatctttagaagtctgattgtgttacccctcagtggctcatagctccatggag

SEQ ID NO: 75610 - DNA, 134 bp, Mus musculus
gagggtgagtggatcagtagatggatgggcaggtggttagacggatggcgagagctactcctgatagtctcactctcagttacagcatgtctataacagctcagagaacatgctggcagaacccaagagactgt

SEQ ID NO: 75611 - DNA, 60 bp, Mus musculus
atgtatgtatatgtatgtatatatatgtatgtatgtgtatgtatatgcatgtatatgcat

SEQ ID NO: 75612 - DNA, 109 bp, Mus musculus
gtgactctctacagaaacctgctgctgtccctcagaagcagacaaggactcgagacctctgcctccctgtttggcactgcggattctggacggtttcctgagagtgagc

SEQ ID NO: 75613 - DNA, 106 bp, Mus musculus
gagaggaaggcttcagtccattccagggcaacccttgattatgagcagagattgttgccattttgttcttgagtttgccttgagcatgttcctgaatgtgagtacc

SEQ ID NO: 75614 - DNA, 109 bp, Mus musculus
gtctcttctacatgataggacagaaaaataataatgtcattttatttatagctggggtggcccctttatgagagtcatacaagtttctgccaagtggagtaggtcagat

SEQ ID NO: 75615 - DNA, 98 bp, Mus musculus
ttttgcttaattttaatgtggctaacttaagatggttgtatagtaaatttatgcaactgatcacagttattaaattaccgcatctgcaaaggaagcaa

SEQ ID NO: 75616 - DNA, 117 bp, Mus musculus
tgggttgattagactggtctggctggctaagcagtgcctcctctctctctctcattgttcccttgatatcccttctgaaaggacatacttggtcagtgaagcaggcctcctccccca

SEQ ID NO: 75617 - DNA, 74 bp, Mus musculus
gtcaggtgatctgtacagctgtgtgggaaccctgggcatttggaggggtgggactcactcagtggctgcctgac

SEQ ID NO: 75618 - DNA, 62 bp, Mus musculus
tgtatatgtgtgtgtatgtatatatgtatgtatgtatgtatgtatgtatgtgtgtgtatata

SEQ ID NO: 75619 - DNA, 100 bp, Mus musculus
tcacaggcaagttagctctactctctgtgcctcagtgtcttcatatataaaaagataacgctgtttcctcacagacggttttggagagaaagtttgttga

SEQ ID NO: 75620 - DNA, 82 bp, Mus musculus
ggtggccagtgccagtcagtaaatcagtcggattttaattaccggacagatgacagggtgcaatgacaggtcgcagtccacc

SEQ ID NO: 75621 - DNA, 76 bp, Mus musculus
ccaacgaacatgattgtgcctctgacactctctggttccttgtgagccctgaggttggcaacatcagtgtttgtgg

SEQ ID NO: 75622 - DNA, 69 bp, Mus musculus
gaatgtgtgtgcaacatatatgtatgaatgagtttttctttatgtatgtatgcttgtgtatgtatgttc

SEQ ID NO: 75623 - DNA, 99 bp, Mus musculus
aggctgccataaaccctagaaacttgaagctgtcagtctgtggctctgtcaatcacacggcgctcgcaaaggctcaaattcattaggcgggaaaagcct

SEQ ID NO: 75624 - DNA, 69 bp, Mus musculus
taagctctggtgatgcgtgccagctatctgacactctgagtgaaggttacctggtacttcctgagcttg

SEQ ID NO: 75625 - DNA, 113 bp, Mus musculus
agattaccagcatgagaaaagagaggcaaatcaaaattcaatctaaactaaaattgaaaatgtcaatttgaatttgtgatgtagtttctcttgaggatttagaggggtgttct

SEQ ID NO: 75626 - DNA, 86 bp, Mus musculus
tgaagtgaccggccgctgtgagatgctctgtgctgggaattgaactcacactctctgccagtcatctctctatcccctcaagttca

SEQ ID NO: 75627 - DNA, 147 bp, Mus musculus
gtgtgtgtgtgtgcatatacatgcatttgtatatatgcatttgtatatatgtatttgtatatatgcatgtgtatatgtgtatatgtatatgtgtgtatgtgtgcatgcgcatgtctatgtgtatgtgtatggatatatgtattcagg

SEQ ID NO: 75628 - DNA, 119 bp, Mus musculus
tgtgcatgtgcatatgtatatgtatgtatatgtatgtatgtgtatgtatgtgtatatatgtgtatatatgtgtatatatatgtatatatgtgtatatatgtgtgtgtgtatatatatat

SEQ ID NO: 75629 - DNA, 105 bp, Mus musculus
cagtggtaagaaagctgccagtgaaggtgtcgtgtgttcagcctgggtgtgatgaaaatgtgtctcccgctgtctctctgccactgggattttttttttttactg

SEQ ID NO: 75630 - DNA, 81 bp, Mus musculus
atatatatacatatatacatacacacatatatatattatatacccatatgtatgtatgtatatatgtatgtatgtatgtat

SEQ ID NO: 75631 - DNA, 91 bp, Mus musculus
gactcacctgtgacatatcaaatggcagttactgtgacgttggccttctgccgttgttgccttctgtctctgtctgtctgtctggtctgtt

SEQ ID NO: 75632 - DNA, 108 bp, Mus musculus
cacaaacaaaagccctttaggacccattcaggttacggagctgcagagagtgagaagagacagctctgtaagagggtaaaggtgggtggagggcttcctgaacctgtg

SEQ ID NO: 75633 - DNA, 98 bp, Mus musculus
ggacaagggtgggttctccttgtaccccacccagccagtttcagtctctatgtcacagaagcatctgggcggtggtggtggaggagggcagcagtgcc

SEQ ID NO: 75634 - DNA, 74 bp, Mus musculus
atgtatgtgtgtgtatatatatatatgtatatatatatatatgtttatatgtgtatatattcacacacatatat

SEQ ID NO: 75635 - DNA, 66 bp, Mus musculus
ctcagtgtcttctctctctgtgtccccaccccctgattcctggaagcagagagaagagactctcag

SEQ ID NO: 75636 - DNA, 86 bp, Mus musculus
aggctcacacactggtgtgtactgtaaatattactgtggctctgtgactgtcatggtgtgtgttaggagtatgaatgtgttagcct

SEQ ID NO: 75637 - DNA, 59 bp, Mus musculus
ccagtctatctgcatctgcatgaggagtggtccccagtctgcatctgcatgaggagtgg

SEQ ID NO: 75638 - DNA, 96 bp, Mus musculus
gggacctggtaggaatttgactatgtctgcctgacaaacatctgtagtgatggaggtgcagacagacagacagacagacagatcactgctcatcct

SEQ ID NO: 75639 - DNA, 59 bp, Mus musculus
tgtctgtctgtctgtctgcacctccatcactacagatgtttgtcaggcagacatagtca

SEQ ID NO: 75640 - DNA, 69 bp, Mus musculus
gtatgtatgtacgtatgtatgtatgtatgtatgtactgtatgcatgaatggatgtatgtacgtatgtat

SEQ ID NO: 75641 - DNA, 75 bp, Mus musculus
agggtgggactcaggtgtctgtctctcgctcccaccacctggggagaccaggctctacacgtgtcagtctgtcct

SEQ ID NO: 75642 - DNA, 84 bp, Mus musculus
gctcggtccagggagtggcactattagaaggggtggccctgttggagtaggtgtgtcactgtgtgtgtgggctttaagactctc

SEQ ID NO: 75643 - DNA, 82 bp, Mus musculus
gggatttattttgtatgtatgcatgtgtgtgcatgcatgtgcgcgtgcatgtgtttacacatgaagatcagagaccaatctc

SEQ ID NO: 75644 - DNA, 80 bp, Mus musculus
ctcatgggaatgcacatatgtgtacagtacttatgtgtatatgttcatgtgtgtatacatgagggtgttcatatgtgtgt

SEQ ID NO: 75645 - DNA, 115 bp, Mus musculus
tgccttttccatctcctctgccaccttccatgattttcctcctatactgacattagtgacagctcagatgggccttggggaagatggatggaccctagaggaagtggacctggta

SEQ ID NO: 75646 - DNA, 128 bp, Mus musculus
tgaagcacatttaatcacattgccactcactagggatatcataattaatatttgggtgagagcaagaaggttgtgttgttcacaagttattttaagtattatttattcttaggaagcatgaggaaggg

SEQ ID NO: 75647 - DNA, 116 bp, Mus musculus
ttagggatgaggtgtggcatcagaggcttgcttttagatcccagagtgactcactccctgagaagggtgcacttcaacatggtccaaggcagctggaagggcaccccatctgcagg

SEQ ID NO: 75648 - DNA, 70 bp, Mus musculus
gtttgtccagctccagtctgcttgcttgtctctagcatcttcaggaagtaggttgcagagttgtacagat

SEQ ID NO: 75649 - DNA, 108 bp, Mus musculus
tggaagaaggaagctgggtctctgtttgcctgcttgcttgctctcactctcactggcaagtctgctccttcattggcattagggactgactacctagttgagattcca

SEQ ID NO: 75650 - DNA, 84 bp, Mus musculus
atatatgtatgattatcactatatatgtattgtgtgtatatatatacatatatatgtgtgtgtattcatatgtcatatatttga

SEQ ID NO: 75651 - DNA, 117 bp, Mus musculus
gtggcctaaggatatgatacaccagaggaactccagagaaccccagactgttgtctgctgattggagtcggggctggatactgacaccttcctggtcatctttttctaattaggaac

SEQ ID NO: 75652 - DNA, 85 bp, Mus musculus; identical to SEQ ID NO: 57439

SEQ ID NO: 75653 - DNA, 99 bp, Mus musculus
cagccgtgggtttaaagagatgagtgatcagagtgtggaggacggacgacttacagccataccaccctgagcacgcctactctcacgctctagctgatc

SEQ ID NO: 75654 - DNA, 70 bp, Mus musculus
agttgtcatgctcagtgttactctgtctcagggtttcaccctgtgaagagacaccatgacaatgacaact

SEQ ID NO: 75655 - DNA, 102 bp, Mus musculus
tgtgcctttcaaatgtcagaatgtattaaatagtaaattcatgaggtatagcagtctcagtggtagtagtttgttagatattcttgaaccatatatggcata

SEQ ID NO: 75656 - DNA, 85 bp, Mus musculus; identical to SEQ ID NO: 57439

SEQ ID NO: 75657 - DNA, 112 bp, Mus musculus
aatggtttaccatgttcaaacagctttggattaggcctggtacaaattatgtttaaatattatcttgccattaccatggctattcttctctgtttatactgtggtggcgatt

SEQ ID NO: 75658 - DNA, 72 bp, Mus musculus
tgtttgctaagcactatagtagggagcatggccagatgccctgtgctggctctcactgtgtcaatgtatcca

SEQ ID NO: 75659 - DNA, 95 bp, Mus musculus
cttctgaacctcttttagaagcaagaatatgcatactagtttcagagggctgaaaataatttatgattatcatcttgttattagaaagggagagg

SEQ ID NO: 75660 - DNA, 65 bp, Mus musculus
ggcctagatcagtctctcacaggctccctggttggctcatcagtctctgtgagtccctctgggtc

SEQ ID NO: 75661 - DNA, 91 bp, Mus musculus
ggagcaaaggggaaagacagatcagcgccagggatagaacacattaaagacatctgttctgtctctgaatctgtgtattatcttcatatcc

SEQ ID NO: 75662 - DNA, 89 bp, Mus musculus
aggcaggaccctggatggaattaaaggggcaaaggagaaatatctttatttctgtataaaatctctcagtttctccctcactcctgctt

SEQ ID NO: 75663 - DNA, 85 bp, Mus musculus; identical to SEQ ID NO: 57439

SEQ ID NO: 75664 - DNA, 87 bp, Mus musculus
cgaggtaaagtacactccctgactcgctcacaaggagagcacgctgctaagaagtgctttgttagtctggggtaagctgtataggtg

SEQ ID NO: 75665 - DNA, 116 bp, Mus musculus
tgcatgaggtgtctacatgcatgtgtgtgcaaatacatatgagtttgtatatgtgtgttcatatgggagcaatcatgtatgtatttgtgcatgtgtgcacattttcccaacatgta

SEQ ID NO: 75666 - DNA, 66 bp, Mus musculus
tgaacttcacggtagagagtgatctcaggcctctgcctacagttgttcaataaagcgtgaagttca

SEQ ID NO: 75667 - DNA, 79 bp, Mus musculus
tgtacagagtctccacacatggccctctttataagtctccggctcacagagcaggccatgagtgaaatagactatgaca

SEQ ID NO: 75668 - DNA, 111 bp, Mus musculus
ttacatgaaagagcccagcccactgtccttggtatgacccctgccgctaagaagtggttttaggttgtgtacaaaagcaagcagaaaaggccataaattttaagtcagtaa

SEQ ID NO: 75669 - DNA, 80 bp, Mus musculus
ctagagccctggctttatcagtggattaatctgtggatgaattcatattttgatgcattattgagattgggtttagctgg

SEQ ID NO: 75670 - DNA, 95 bp, Mus musculus
gaaggagaggattgcctgtcagaagtgggtcactaggtgtggatatctgctttcatatctatctatctatctatctatctatctatctatctatc

SEQ ID NO: 75671 - DNA, 85 bp, Mus musculus
aggggcagaaactgaagcagagactgtggagggaagagtgctgcctactggcctgctccctgtaactctctcagcctgtgtctct

SEQ ID NO: 75672 - DNA, 102 bp, Mus musculus
tatcatggtgtttgagatagcataaacttctaaagagagcaggcagactagagacagtttctgcttagtaaaggaaaatactatctgtgcaggcaccaggta

SEQ ID NO: 75673 - DNA, 112 bp, Mus musculus
taggtagcatttcataaaactctcaccaatcctgaggcacttacattccctctaacactctctggctatgttccctaagccataggaggggggagttggtatcgaagtccta

SEQ ID NO: 75674 - DNA, 114 bp, Mus musculus
attggtcctctgatggttcaagttcaatggcaattgatggggggggggtgtctctcttagtcagtttttcactgtgtcaaaactgggaaatcgacttatgaggaagacggtttt

SEQ ID NO: 75675 - DNA, 139 bp, Mus musculus
tcccttggtcccaagagataggacattgtctcccgcagatgaattgaaatctatcttctcaaaatgtttttttttcattctcagagtccctttcttgagcctaggagggaatgtgtgtgctctaaatgttttgatgaag

SEQ ID NO: 75676 - DNA, 61 bp, Mus musculus
ccaggatgtaaagtcaactctcaggtgagagatcagagtccctgggagcctgtctgcctgg

SEQ ID NO: 75677 - DNA, 89 bp, Mus musculus
ggctattgtctgtgtgtacagtgtgtgctgatgggataaattctgttggaatgtgacatcatatgcacattataaacagaagcactgcc

SEQ ID NO: 75678 - DNA, 103 bp, Mus musculus
gaagctgtaccatataatgctggtttactgtatccctcatggttcacagattgatgagagtgaggattacttttattttttcagtagtatccatagcaccttc

SEQ ID NO: 75679 - DNA, 71 bp, Mus musculus
ggtggggcatctgctgaggagaaaggtcaattgggtgctctctctgcctgtctgattggcagactttcacc

SEQ ID NO: 75680 - DNA, 67 bp, Mus musculus
cctcctgtgagtctgttagtctctgtcagcactcctggcagaccagctccctcctgagtccaggggg

SEQ ID NO: 75681 - DNA, 68 bp, Mus musculus
agcaatgcacctccatgtgtactctttggttggtggtttaatcactgggagctttgaggggtgtggct

SEQ ID NO: 75682 - DNA, 85 bp, Mus musculus
ggccatggtggtctgataggatacgtgggacaatttcaatatttttgtatctgttgaggcctgttttgtgaccaattatatggtc

SEQ ID NO: 75683 - DNA, 85 bp, Mus musculus; identical to SEQ ID NO: 57439

SEQ ID NO: 75684 - DNA, 84 bp, Mus musculus
ggccatggtggtctgatgggatacatggacaatttcaatatttttgtatctgttgaggcctgttttgtgaccaattatatggtc

SEQ ID NO: 75685 - DNA, 110 bp, Mus musculus
gtccatggtggtctgataggatgcatgggacaatttcaatatttttgtatctgttgcctattttgtgacgaattatatggtcaattttggagaaggtcccgtgaggttct

SEQ ID NO: 75686 - DNA, 80 bp, Mus musculus
gacttcagttagtttcactgagtctctgtttagtttctattttcatgatctgtcactgatgagagtgaggttttgaagtc

SEQ ID NO: 75687 - DNA, 85 bp, Mus musculus; identical to SEQ ID NO: 57439

SEQ ID NO: 75688 - DNA, 112 bp, Mus musculus
aggaataaaactgatgcctatctgatgatggctgaataatatatttatctatgttcatagcagaatatatttaggtgtcatattttgatataggtagcattggcttttacct

SEQ ID NO: 75689 - DNA, 96 bp, Mus musculus
gatcagccttagtctgtggtgatcttataggatgcatgggataatttcaatatttttgtatctattgagacctgttttgtcaccaattatatggtc

SEQ ID NO: 75690 - DNA, 84 bp, Mus musculus
tcgcggcggcctcaaagagctgtgtcaccaggggaactgagaggctcctcacagaactgagtgacttggggtatcgagtttcgg

SEQ ID NO: 75691 - DNA, 86 bp, Mus musculus
agctgtgagtatctgtctctgtgtttgtcaggccctggcctgttgaaactttgtcactgagtatatggtcaattttgaaaaaggct

SEQ ID NO: 75692 - DNA, 79 bp, Mus musculus
ttgccttggtcatgatgtctgttcacagcagtaaaaccctaactaatactctgaggaagagatgtctgtgagttggtaa

SEQ ID NO: 75693 - DNA, 79 bp, Mus musculus
ggggtaggctgcgaagtttgaaaatcacacagcagatgaagttattctgtgtgtgtatctgtctgtctgtctctgcctc

SEQ ID NO: 75694 - DNA, 92 bp, Mus musculus; identical to SEQ ID NO: 57641

SEQ ID NO: 75695 - DNA, 90 bp, Mus musculus
ggaaatgtataaatgaataaatgagcatgcatgaatttgtatatgaatttatgtgagattatgcatattcgcttatgtaaaagtttttcc

SEQ ID NO: 75696 - DNA, 109 bp, Mus musculus
tggctaagatgaaaaacctaggaggctagagagatgctcagcagttaggagcactgactgctcttacagaggtcctgagttcaattcccagcaaccacatgatggacca

SEQ ID NO: 75697 - DNA, 102 bp, Mus musculus
ttaaaattataaaaacattgggatagcaaaatcgagtagaactgagtaggaattgcttctacactagtgtatttgatttagggatagtgtttataatggtga

SEQ ID NO: 75698 - DNA, 96 bp, Mus musculus
catcccacctgactcctggtgtctgtctgtctgtcatgagtgaggtatctgctggcaagtgctccagagtgcaggcattggaggcagaactggatg

SEQ ID NO: 75699 - DNA, 81 bp, Mus musculus
catcaccgcgtttcacggcagagtatattgcaaaaccaatgaatagattttagatgttatgcgttcgtgagaagtgtgatg

SEQ ID NO: 75700 - DNA, 88 bp, Mus musculus
tccccaggaatgagatcacagaactgagtgaccacagaagaggaacttcccacccacgtgtcacctgatctgttaaggctcttggaga

SEQ ID NO: 75701 - DNA, 75 bp, Mus musculus
gggtgtgtctgtgtgtctgtcttcaagtttcccacaggctcctgtgtttgaagcttgactcactgtggtgcttct

SEQ ID NO: 75702 - DNA, 89 bp, Mus musculus
tgtagattaggggacagttgtgggtctggactcaaagtgccttcataacaaccaagcctggtcccccaacagtcttaaaccttatcaca

SEQ ID NO: 75703 - DNA, 73 bp, Mus musculus
atagggtgactctcactctgtctgtccttgtggattttagtgtgaggtggggcaggggaattgttaatcttgt

SEQ ID NO: 75704 - DNA, 111 bp, Mus musculus
gagcagtgtgggcacttgtggggcttggtctcagtgtctgactgggtgtgcatctgcatgtccgaccttgagtagaaggccatcctacacccagggtcacacaacaagttc

SEQ ID NO: 75705 - DNA, 108 bp, Mus musculus
tgtcacacaaaaccagccagtgcacaactcaacatgagttctgattgtaaagcaggaattatgactggcagctatgttgggttgtagtactaagactgtgctgtgaca

SEQ ID NO: 75706 - DNA, 98 bp, Mus musculus
tgcttccttctctatgcttttgtcctttctttctctcttacctaatgttagagtgttgagagtgtagaaaaagggtacagaagggtggaagcaagaag

SEQ ID NO: 75707 - DNA, 76 bp, Mus musculus
gccttggctcgctccctgttcctgtcaccttctctctttgtggaaaatgacagagctgctggggagaaactggggc

SEQ ID NO: 75708 - DNA, 67 bp, Mus musculus
acagctggggatgatcagatggtgatgggtgatcagttgctttgcattgtcctctggatccagctgt

SEQ ID NO: 75709 - DNA, 111 bp, Mus musculus
ggttgctggcctgaagtcacgttcactaataccttccttatatctgtctctctcagtttccagtctaggctttagggtggtgggggttgaatcgtgactctattcatatcc

SEQ ID NO: 75710 - DNA, 60 bp, Mus musculus
ggagcactgtccctctctgagaatgctgaagataacttcagtctctccagaacttgctct

SEQ ID NO: 75711 - DNA, 136 bp, Mus musculus
tggatttcagggctgacacctggcttgctgagtggtagcttggcctaaccaaggagacattagactctgagcacaaagctgaccctagacggcagactgggagacagcagaggagtcaaggtctggggctgcatgg

SEQ ID NO: 75712 - DNA, 96 bp, Mus musculus
acatcagagtgtcttcctggccatctctcactgtgtgtctcttccttggaactctgacaacatctgtctgggtctgggtctcatgtgttctcttgt

SEQ ID NO: 75713 - DNA, 65 bp, Mus musculus
caatatgtatgtatgtatgtatgtatgtacgtatgtatgtatgtatgtgtgtgtgtgtgtttgtg

SEQ ID NO: 75714 - DNA, 63 bp, Mus musculus
agagtgaggtagagagagagatggggtaactgcagttatctctctgactctccttcccagttt

SEQ ID NO: 75715 - DNA, 94 bp, Mus musculus
atgtgtccctctatctgtggctccagctttctgtctctctgtccccagacagcactcagggatttgggctaggtagcagttgggggtggggtgt

SEQ ID NO: 75716 - DNA, 108 bp, Mus musculus
agcatgtttggtgaaatgtttgctgcccagttatggggacctgagtttactctctgacacccacacaaaagccttggctgggcagtgcatctttctaatcccattgtt

SEQ ID NO: 75717 - DNA, 73 bp, Mus musculus
gtgtccctggggggatgaggcctcagatgttctagccatgtttagtggctcactctctctctcttcctgatgt

SEQ ID NO: 75718 - DNA, 89 bp, Mus musculus
ggagggacatcctggagggtggctcggtcagtggctccatctgcaacgggccctggcccagctctcccctcaggtcctcttgtcactcc

SEQ ID NO: 75719 - DNA, 70 bp, Mus musculus
acacactctgtgagtctcatcccacctgtctccctggggccaggaggtgtgctggatcctgagagtgtgt

SEQ ID NO: 75720 - DNA, 80 bp, Mus musculus
ggtggaaagccagctgtggtggtacatattttaagatttatttatcatatgtaagtacactgtagctgtcttcagacact

SEQ ID NO: 75721 - DNA, 58 bp, Mus musculus
gcatggacagacaagtgtgtgtgcatgcatgagtgcatagacatgtgtgtgtgtgtgt

SEQ ID NO: 75722 - DNA, 106 bp, Mus musculus
gaggccaggagagagcattaaatcccttgagacagaagttagagaccgctatgaactgccatgtgggcactagaacttaactgctgagccacctctccagtccctc

SEQ ID NO: 75723 - DNA, 120 bp, Mus musculus
gctgagagtagatcacccatgttctccctggacccctgcagggagcataagcttgtgtctgagtctctgcctctgtccctggtcctgaggctgagatggttttgccagacagagggtggc

SEQ ID NO: 75724 - DNA, 77 bp, Mus musculus
gtgacacaagtgagtcaccaaagaagcccagaaattctactttatccatggcctctatggtgcttttcagtgatcat

SEQ ID NO: 75725 - DNA, 78 bp, Mus musculus
gtcctagaactcactctgcagaccaggctggcctcgaactcagaaatctgcctgcctctgcctcctgcgtgctgggat

SEQ ID NO: 75726 - DNA, 90 bp, Mus musculus
acgactgccaggcagaagggcgggtccagtgtcagtctctgacacatcgagaggaacagactgcacactgtgtgagcctcactggagcgt

SEQ ID NO: 75727 - DNA, 92 bp, Mus musculus
cctctgggggagagagagggaaagaggctgagccctctgttcggtgggctccaaagactgcagcctgctctagctctcaccgtccatggagg

SEQ ID NO: 75728 - DNA, 88 bp, Mus musculus
tgtaagcatttcttttaaggtatgattagaactttctacaactgcttgccctgtaggattgtgtggtatacctgcagtgtgctctata

SEQ ID NO: 75729 - DNA, 68 bp, Mus musculus
gacgcaatcacagacaatggaggcctccgtgaggcccacactcactgtctccttgttgtccatggctc

SEQ ID NO: 75730 - DNA, 75 bp, Mus musculus
ccttataaagtgggtgtgtccctctgtgggtgtgcccttggggaggcaccaagcttctaaaatcactttcctggg

SEQ ID NO: 75731 - DNA, 85 bp, Mus musculus; identical to SEQ ID NO: 57439

SEQ ID NO: 75732 - DNA, 84 bp, Mus musculus
gggggcaagactcagaggatttgtgaacatgcccaggacaacctggggggacccacacgtttctctctctgtctccacagtcct

SEQ ID NO: 75733 - DNA, 75 bp, Mus musculus
gtcccctgctctgtctgtctgtctgtctgtctatctgtgggtggggggaaggatactgtgaggagatggaggagc

SEQ ID NO: 75734 - DNA, 85 bp, Mus musculus; identical to SEQ ID NO: 57439

SEQ ID NO: 75735 - DNA, 116 bp, Mus musculus
ggtgggagggagggaagagaaatgccagctctaactcagtgtccccaaagtctctgtctctttctcaaggccctggcctcctgagcattctggcttctgtcttcctgggctcccct

SEQ ID NO: 75736 - DNA, 82 bp, Mus musculus
ctgttgggctctgagtctatgtctctggttcttggcagaaattgggtacttagagattttgaatattggggcctacaagcag

SEQ ID NO: 75737 - DNA, 126 bp, Mus musculus
atgggagccagaagagtccaggtcaaactggggtacagcatcctggaagggtcagggtgacagaagagactctgtgctggaaggtgcctgtgaccgcttgtgctgcccgtctgcctcagactcctc

SEQ ID NO: 75738 - DNA, 65 bp, Mus musculus
tcagtgggagaccccggtttcatctcagcagctgcccacttctttgagactggctctctcactgg

SEQ ID NO: 75739 - DNA, 79 bp, Mus musculus
gagcctttctgcctccctcgccacagtctaagttccttccctgggtctgactgtgagtgattctggcttatatgggctt

SEQ ID NO: 75740 - DNA, 78 bp, Mus musculus
ggctggcagggtcagtagctggtcaggctctcttctctctctctgggtcagaagacctcctctgctcaactctgagcc

SEQ ID NO: 75741 - DNA, 86 bp, Mus musculus
gagtgtgagatcacctggatctggagtggcagacagttgtgagtgggcagctctgctgatttccctgtgtcgatctgtttttagtc

SEQ ID NO: 75742 - DNA, 114 bp, Mus musculus
ttgggccacacatggaaaatactagactctagattcatgttgatggtctttctaaaggaaagattctttatatttctttgcattgattctttgtattattccctttgtttctaa

SEQ ID NO: 75743 - DNA, 103 bp, Mus musculus
tgtcctctttcctcttctgaaagtcctgcctggctacagaaggtggtcacttgagtctctatcacccagtgtcaggcccaagcagtcttctgaagagaggata

SEQ ID NO: 75744 - DNA, 81 bp, Mus musculus
gtggattggagagatgactcggctgttaaaagagcactgactgctcttgcagaggtcctgagttcaattcccagcaaccac

SEQ ID NO: 75745 - DNA, 93 bp, Mus musculus
tctggaaggtgacatgtggaggcccagacaggactttggagttctggtcagcctgtctgtctgggtctgtgtcagtgaacctgtctttctaga

SEQ ID NO: 75746 - DNA, 68 bp, Mus musculus
gaaaccagggctggagaggcagttcagtggttgagagcactgactgctcttccagaggtcctgagttc

SEQ ID NO: 75747 - DNA, 63 bp, Mus musculus
gcttctgagacactcactctcattaacaaccaagccaggagatgggggttgggtcttggaagc

SEQ ID NO: 75748 - DNA, 58 bp, Mus musculus
tcgagggggctggagagatggctcaatggttaagagcactgactgctcctcctcctga

SEQ ID NO: 75749 - DNA, 67 bp, Mus musculus
ggcagaggctctatcactgagtcacactccagtgccccactggaggattctaggcaggggctctccc

SEQ ID NO: 75750 - DNA, 67 bp, Mus musculus
gggtcaagttatggggcagagtcaggaaagacaaggccctccctgactctctgcctcttaaaagctc

SEQ ID NO: 75751 - DNA, 73 bp, Mus musculus
tggggctagactgttcagtcagggattggcagacagaaagtactgtgtgtctctgactgttttctctgtccca

SEQ ID NO: 75752 - DNA, 72 bp, Mus musculus
gtgagcgcgcgtgtatgtatgtatgtatgtatgtatgtatgtattatgtatgtatgtatgtgtgtgcacaca

SEQ ID NO: 75753 - DNA, 77 bp, Mus musculus
gcagtttggctatatggattgtggggttgtcttagacagggtttctcctgctgtgacaaaacactgtgaccaaaagc

SEQ ID NO: 75754 - DNA, 83 bp, Mus musculus
atagttggatacaagagctgacagaggagacattggtaataaagcagagaatttcctccgtgggccaagtgccttctaattgt

SEQ ID NO: 75755 - DNA, 79 bp, Mus musculus
cctgggccattcccccagccactgtctttctctgaggcacaccctcagaacgctagacagtggagcggggaacaccagg

SEQ ID NO: 75756 - DNA, 76 bp, Mus musculus
gccccctctgattttctctggatctctgactccctctgcctcgggggtcttggtctttggctctctctctattggc

SEQ ID NO: 75757 - DNA, 60 bp, Mus musculus
atgccaagtcaagagaggtgggctaggacctgtgctgtctacctgtctcactctgtgtat

SEQ ID NO: 75758 - DNA, 78 bp, Mus musculus
ctgtgcttgaaccccagttcacttggccagacagaactgtgtttgcagaggagttaagggaaaggttgatcaggccag

SEQ ID NO: 75759 - DNA, 126 bp, Mus musculus
catattagtatatgtgcatgtgtgtgtatgtatgtatgtatgtgtatacatgtgtgagtgcatatgcatgtgcctgtgtgtgcgagtgtgtgtgtgcatgtatgtacatgtgtgcatgtgtgcatg

SEQ ID NO: 75760 - DNA, 78 bp, Mus musculus
ccttcgtggctttgtaactttagacacctgactcggtgctctgagtctgtttctgtgtgcacagtgaggatcacaagg

SEQ ID NO: 75761 - DNA, 90 bp, Mus musculus
gtgaggttgtgtgtatgagcatctgcatctgtgttcctgcctgtgcttgagagtgggggcacgggggggggggtctggaggtggccaagc

SEQ ID NO: 75762 - DNA, 84 bp, Mus musculus
ctgacccagcactcaggaggcagaggccggtgggtctttgggttcaaggacagcctggcctgtgagtcagtgtctgtctgtcag

SEQ ID NO: 75763 - DNA, 109 bp, Mus musculus
cactggtgttttcccttcatgtctgtgtaagagagtcagatccactgggacttgagttacagacagttgtgagtcaccacgtgggtactgggaattgaactcgggtcct

SEQ ID NO: 75764 - DNA, 85 bp, Mus musculus
acatcaaaatgaagaagctgttttctgggagtacttagaccttgaagaaaccattgtagagaacagtgattgctctctgtgatgt

SEQ ID NO: 75765 - DNA, 70 bp, Mus musculus
ccaagtgctaggcttacagatgagtgacaccacatctggcttggctgttactcattataagaactcttgg

SEQ ID NO: 75766 - DNA, 98 bp, Mus musculus
aactccatagggggactggagagatggctcagaggttaagagcactgtctgctcttccagaggtcctgagttcaattcccagtgaccacatggtggtt

SEQ ID NO: 75767 - DNA, 65 bp, Mus musculus
tcagctgctcaattagcactcctaatggactgccttgctctccatcagtgcctgtgtgagcctgg

SEQ ID NO: 75768 - DNA, 112 bp, Mus musculus
gactgtctcagttaccaactgtctccgatgtgtcaggccctgtgtttgtcactgagtgagaagacacagtggtcctagcccgatgttgtttatagtttataggagagctgtc

SEQ ID NO: 75769 - DNA, 119 bp, Mus musculus
gagaccgtgcggactacgcccacccctgcctcatgctcgggctttggtaaagctcagtacagagagtgctctgccatgggcctgaagagggactggtggcattttggctggcaactctc

SEQ ID NO: 75770 - DNA, 65 bp, Mus musculus
cacacaaacacaaacacatgtatgtatgtatatatatcacatgcatgcatgtgtgtctggggatg

SEQ ID NO: 75771 - DNA, 77 bp, Mus musculus
gagtttaggatgactggcaaggcttctggggtctcagcctcagtttctctgtctgtgaaatggtctattaattgctt

SEQ ID NO: 75772 - DNA, 78 bp, Mus musculus
cccagtggcaggctgtttctgagggtagggttgggttgcccgctgtgggcactgactccctctgtcacctgcagtggg

SEQ ID NO: 75773 - DNA, 69 bp, Mus musculus
gtgatgtcagcagtagggatgctgactattctaagggctaagtcacaccctcccactgtctgaatttgc

SEQ ID NO: 75774 - DNA, 100 bp, Mus musculus
gagcacatgggttgggctggggagacggctcagtggttaagagcactgactgctcttccagaggtcctgagttcaattctcagcaaccacatggtggctc

SEQ ID NO: 75775 - DNA, 73 bp, Mus musculus
cactctctctctcactgctatgccattccttgtcaccatgtgacaggacatggagaatgccagagtgagcatg

SEQ ID NO: 75776 - DNA, 71 bp, Mus musculus
atatgtatgtatgtgtgtatgcatgtacatatatatgtgtgtgtgtatgtatgtatgtatgtatgtatgta

SEQ ID NO: 75777 - DNA, 70 bp, Mus musculus
ggcctactctctgtggctctgtggttcccctggccccacaagagagggtaaaagacagaattagtggggc

SEQ ID NO: 75778 - DNA, 82 bp, Mus musculus
ggcacacagaggctctgtctgtctgtctccgccccacacctgaatgcagagacagtgtgaccaaacacctcatgctcctgcc

SEQ ID NO: 75779 - DNA, 114 bp, Mus musculus
ctgcgtttcctgtttcctgtgtgttgtgactaccagcgatcatctcagacattctctctgtgaactctatggtcagtcctcccagccaactcttcctcagtgatgggactgaag

SEQ ID NO: 75780 - DNA, 85 bp, Mus musculus
cctctgcaagtgagcctgcaacagagattcctgttggtgaccacctgcagtgggtcactgacacagccactcactgggcctttgg

SEQ ID NO: 75781 - DNA, 87 bp, Mus musculus
gcagccaggcctccagctgggtcagcagctcctaaccctcacctccacctctcagtgaagccgctgtctgtctgtctgtctgtctgt

SEQ ID NO: 75782 - DNA, 60 bp, Mus musculus
ttctggctgtatctctgtctctgtctctatctgtgggggagcacgggggactggtgagag

SEQ ID NO: 75783 - DNA, 81 bp, Mus musculus
cttcacagtctctgagactcagaattcagagtcatgaggggtgtgctctgcagctgtctgatgctctcagtcaccttgaag

SEQ ID NO: 75784 - DNA, 73 bp, Mus musculus
taccctgagtccagtcgccctctgtgcctctgtgcacgtgggaagagcacctggaggtacctggatcaatgta

SEQ ID NO: 75785 - DNA, 118 bp, Mus musculus
acagtataaatagtatcatctgggctggaaagatggctcagcggttaagagcactgactgctcttcgagggtcctgagttcaatttcagaaaccacatggtggctcacaaccatctgt

SEQ ID NO: 75786 - DNA, 119 bp, Mus musculus
gtatgtatgtgcttatgtgtatgtgtgtgtgcacagggacatgtgggcatgtgtgtatatatgtgtatatatatgtcttgtgtgtatatgtgtgcatgcatgagtgtgtgtgtataagt

SEQ ID NO: 75787 - DNA, 118 bp, Mus musculus
gccctgtgttcactgtgcctgtgggttgggatcttgtgagggctgtgtcatctgtctcactgtcgcacagattcttctcttggttccttaagcaggtgatgaatagttaacaaggagc

SEQ ID NO: 75788 - DNA, 61 bp, Mus musculus
ggaaccggaggccacggaggaatgctgcttactggctcactctctgtggcttgcttagtcc

SEQ ID NO: 75789 - DNA, 69 bp, Mus musculus
gctgaagagatggctcagtggttaggagcactgactgctcttccagaggtcctgagttcaattcccagc

SEQ ID NO: 75790 - DNA, 82 bp, Mus musculus
cggggtctcactctatgtctctggagcatactatgaagaccaggttggcctcaaactcacagagatctgacagacaccactg

SEQ ID NO: 75791 - DNA, 86 bp, Mus musculus
ggagactctattgtgccactctgcttctcactcactgtaataaacactaggtcgtggggaaagggtcactaggattataagtcttc

SEQ ID NO: 75792 - DNA, 64 bp, Mus musculus
ccacctctgtgagtctgtgagagtctgggcgccccagcatcacagagagtgcacaacaggctgg

SEQ ID NO: 75793 - DNA, 113 bp, Mus musculus
gttaactaaagcctcagaagtcagaatcgtagcaggcagagaggttaggtggttcagaaactagcactttatgctgttcttgtttcaaaagactcacacttggctcccagaac

SEQ ID NO: 75794 - DNA, 64 bp, Mus musculus
gcacccagaagcacattaaagacatactgaaaaggccgggtgtgtctgtctgtgtctgtggtgc

SEQ ID NO: 75795 - DNA, 62 bp, Mus musculus
agagcatggatggaggatgcactggcctggagtgtcccagtcactgtgtcttctcctgcttt

SEQ ID NO: 75796 - DNA, 138 bp, Mus musculus
ctgagccatctcaccagcccttttttttttttttttttttttttggttatataagaattactggggctggaaagatggttcagcggttaagagcactgactgctcttccagacgtcctccattcaattcccagcaacc

SEQ ID NO: 75797 - DNA, 65 bp, Mus musculus
gcatcattaggtggaatgatagcttttcctccatgcctagctgtctgtttctctctgcatggtgc

SEQ ID NO: 75798 - DNA, 116 bp, Mus musculus
gtgcaccataagagtgcctagtgttggggactggagagatggctcagccgttaagagcactgactgctcttccagaggtcctgagttcaattcccagcaactacatggtggctcac

SEQ ID NO: 75799 - DNA, 99 bp, Mus musculus
gctgtacttaagaaactaggctttgggctggagagagagatggctcggcagttaagagcacagactgctcttccagaagtcctgagttcaattcccagc

SEQ ID NO: 75800 - DNA, 109 bp, Mus musculus
caccagaagagagcatcagatcccattacagatagttgtgagtcaccacatggatgctgggaattgaactcaggacctctgggagcacatttggtgctcttaactgctg

SEQ ID NO: 75801 - DNA, 72 bp, Mus musculus
gagctccagggctcactttctcaaaaagcctaggaagataacttggcagttaagagagagcacttgctgctc

SEQ ID NO: 75802 - DNA, 60 bp, Mus musculus
tgggtcacagaggacagtgtgtgctctgaactattgagccatctctccagtctggactta

SEQ ID NO: 75803 - DNA, 67 bp, Mus musculus
cattgcgagactggagtgaggctcagtgattatagctgagtttactgagttcttcctgtgtgcgaag

SEQ ID NO: 75804 - DNA, 79 bp, Mus musculus
tgcatatatttatctatgtatataggatacatatgtacatacatatcgtatatatacatgcataggatatatatataca

SEQ ID NO: 75805 - DNA, 79 bp, Mus musculus; identical to SEQ ID NO: 75804

SEQ ID NO: 75806 - DNA, 75 bp, Mus musculus
ggtttgacagcgctaggagagcatcagaggtggagcctgccaccctatcggtctgacactcccactgttgctacc

SEQ ID NO: 75807 - DNA, 105 bp, Mus musculus
gtatatacatacattgaagatatatatacatatatatatccatatatatatgtatatatatggatatatatgtggatatatgtgtgtgtgtgtgtgtgtgtatac

SEQ ID NO: 75808 - DNA, 83 bp, Mus musculus
gtcacatagacacacagactcacacacatgcatccatgcatccatgcatagtggtgccaagtgtcctgcaggtgctgtttgac

SEQ ID NO: 75809 - DNA, 91 bp, Mus musculus
gtcaaacagcaccttcaggacacttggcaccactatgcatggatgcatgtatgcatgtgtgtgagtctgtgtgtctatgtgactgtgtgac

SEQ ID NO: 75810 - DNA, 114 bp, Mus musculus
tacgggagttatttatgtctttcttaaagtcatctatcatcatcaatcatcatcatcataatcatcatcatcatcataggtgactttaattaagagtcatgcttttcttgtgtg

SEQ ID NO: 75811 - DNA, 104 bp, Mus musculus
gctatctatatgtacatctacatctacatctatctatctatatatctatcctaggtatgtatatatatagggtatgtatgtatgtatcctatgtacatagatac

SEQ ID NO: 75812 - DNA, 70 bp, Mus musculus
tgacagagcaagaggatgtgcactgaagttatctcaggtctgctggaacactgtgtgcattctctggtca

SEQ ID NO: 75813 - DNA, 88 bp, Mus musculus
gtgccaacaggacacttggaaccaccatttgtgggtgcatgcatgggtgcatgtatcacgtgtgtgagtctgtgtgtctgtgtggtgc

SEQ ID NO: 75814 - DNA, 64 bp, Mus musculus
cacagagtctgcagacaccggcaaggtaccacaggacactataaggtatcttaagacctctgtg

SEQ ID NO: 75815 - DNA, 87 bp, Mus musculus
gggaccaccatgcatgggtgcatatatgcatgtgtctgagtctgtgtgtctatgtgacagtgcctgtgcctgtgtctgtggtgtctt

SEQ ID NO: 75816 - DNA, 124 bp, Mus musculus
acagagccttcaggacacttgccaccaccaggattgggtgcatatatgcatgtgtctgagtctgtgtgtctgtgtgactgtacctgtgcctgtgtgtgtgcctgagcctgtgcccctctgtgtt

SEQ ID NO: 75817 - DNA, 74 bp, Mus musculus
gaacttctgttgtaggggccagagagaataacacagggcatcccctcatatctctctgtctctgggagagtttc

SEQ ID NO: 75818 - DNA, 81 bp, Mus musculus
atatatgtgtatttacatatatgtgtatttacatatatagtacatatatgtatttacatatgtatgtatttacttatatat

SEQ ID NO: 75819 - DNA, 82 bp, Mus musculus
gtgtagaatagtgttgaaatcattggcacaggaaaagtcttcctgaacagaacaatgatagcacaggcactatgaacaacac

SEQ ID NO: 75820 - DNA, 85 bp, Mus musculus; identical to SEQ ID NO: 57439

SEQ ID NO: 75821 - DNA, 111 bp, Mus musculus
tggttgtgttttcctgtttttatgtaaggacttgtaactctttagcagtgttcttctgtatttctttaagtgagttattaaagtccttcctgttgtcctgtaccatcatca

SEQ ID NO: 75822 - DNA, 85 bp, Mus musculus
gtgtgtgtgtgtgtgtgtgtgtgtttccttactcggctatgtattctgtaatctatgagacaacacagtcaggtaacatacacac

SEQ ID NO: 75823 - DNA, 83 bp, Mus musculus
catgggacaatttcaatatttttgtatctgttgaggcctgttttgtgaacaattatacagtcaattttggagaaggtcccgtg

SEQ ID NO: 75824 - DNA, 65 bp, Mus musculus
gagcactccctgtgacactgactctcgctcactacctgagcagctgtcttcgtcagggtcagttc

SEQ ID NO: 75825 - DNA, 78 bp, Mus musculus
cagtgaggatgtgtgtgtgtgtgtgtgtgtgtggggtaaacccgggcatagtcattgcatagtcacactttctcactg

SEQ ID NO: 75826 - DNA, 85 bp, Mus musculus; identical to SEQ ID NO: 57439

SEQ ID NO: 75827 - DNA, 183 bp, Mus musculus
catatatatatatattttatatatatatatatatgtatgtatgtgtgtatatatacatatatgtatatgtatgtgtgtatatatatgtatgtatgtatatatatacatatatgtatatgtatatgtatgtatgtatatatatatatatatatatatatatatatatatatatatatatgctta

SEQ ID NO: 75828 - DNA, 140 bp, Mus musculus
gtggtcagtagctcatggggagttgtccctctaactagaggagcagctgtcatagggaaggtgtctgtagtgtgtgtgcgtctgtgtgtctgtgtgtatgcatgcacatatgcacatggatgggggcatgcacctttacc

SEQ ID NO: 75829 - DNA, 117 bp, Mus musculus
ggtaagatggctcactggtaaaggtgcatgcccccatccatgtgcatatgtgcatgcatacacacagacacacagacgcacacacactacagacaccttccctatgacagctgctcc

SEQ ID NO: 75830 - DNA, 82 bp, Mus musculus
atgtatatatgtatatctttgtgtatgtgtatatgtatatctttgtgtatgtgtatatgtgtatatgtatacctgtgtacat

SEQ ID NO: 75831 - DNA, 83 bp, Mus musculus
gtctctggctttcaccctaccttgagaatttgttgtagagttgctgaacctaaggaatagatctccagtgaatagtcagggtc

SEQ ID NO: 75832 - DNA, 59 bp, Mus musculus
cactctctctctctctcagctctctggtcttgggtagattgccagtctggggaggagtg

SEQ ID NO: 75833 - DNA, 74 bp, Mus musculus
gaacacctctagggggcgggagagatggcttagcagttaagagcactgactgctcttccagaggttctgagttc

SEQ ID NO: 75834 - DNA, 70 bp, Mus musculus
tggtgtacagcccaacgcaggtgattatcttacagtcctgtcttctaatcactgactctgactgtcacca

SEQ ID NO: 75835 - DNA, 111 bp, Mus musculus
atcttgggttctataagaaagcaggctgagggctggagagatggctcagtggttaagagcactgactgctctttcagaggtcctgagttcaattctcagcaaccacatggt

SEQ ID NO: 75836 - DNA, 69 bp, Mus musculus
gggaacagacagcagccctcatacacctccattgctgggggagcctcagttgtctgtctgtctgtaccc

SEQ ID NO: 75837 - DNA, 93 bp, Mus musculus
atgtatgtatgtatgtatgtatgtatgtatgtatatgtgtgtatatacacacaatatatatatatacatatacatacacacacacatatatat

SEQ ID NO: 75838 - DNA, 109 bp, Mus musculus
caggaccccagtgtgatcgctcttcagttttgtgaaccctcaagcagggtgacttactcacactgtgaaagtgtgtttacaggctcaaagagcaaccacttaggctctg

SEQ ID NO: 75839 - DNA, 62 bp, Mus musculus
tatgtatgtatatatgtgtgtatatgtatgtatgtacgtatacatgtatgtatgcatatatg

SEQ ID NO: 75840 - DNA, 111 bp, Mus musculus
gaccttttcccctgactgccctgaatattctatctttatatagtgcatttgttgttctgattattatatatctggaggaatttcttttcgggtccagtctatttcgagttc

SEQ ID NO: 75841 - DNA, 116 bp, Mus musculus
cctctaccaaaaatattatatgtacatatatatacatatatataaatttatatacatacacacatatatgcatatatatacatatatatgtatatatctaatgttttgtaggatgg

SEQ ID NO: 75842 - DNA, 93 bp, Mus musculus
tgttttgtatgatatgtgtatgtgcatgtatgtatgtatgtatgtatgcacacatatatcatatatgcatatgtataatatataatacataca

SEQ ID NO: 75843 - DNA, 77 bp, Mus musculus
cttgggtagaagaaacaaacagatctctgtgtgagttccaggctagccaggtttacacagtcagagtctctctcagg

SEQ ID NO: 75844 - DNA, 93 bp, Mus musculus
gatggtatgcagactcactttctgcatctggacctgaacatctggaaaaggtcattgcggattggtgggaacaatctgtctgctgctgccgtc

SEQ ID NO: 75845 - DNA, 74 bp, Mus musculus
gctctatgggtgtatggctgtctcctttacattttacgttagtgaagtttcagagcagacaacagtcattgagt

SEQ ID NO: 75846 - DNA, 87 bp, Mus musculus
ggatctcttctactatttccttacacgtgtgcctgtgtgtgtctgtgtgcatgtatgtgcaggtgcatgtgggagcctgaagagtcc

SEQ ID NO: 75847 - DNA, 95 bp, Mus musculus
tacataaattatgcatgacatatgcgtaatatgtatgtatatataaaaattctatatatagtttgtgtgtatatgttttgtgtgtaatttgtgta

SEQ ID NO: 75848 - DNA, 59 bp, Mus musculus
actctctatctctcacactccacctggaggaaagacaaccaggtggagggacatagtgt

SEQ ID NO: 75849 - DNA, 98 bp, Mus musculus
gtggcagcgacgtggtagtagtagtttgtatggttctgtgtgtacatggtgtgcatactgcatccatataaatgcacaggtgcacacacccatgccac

SEQ ID NO: 75850 - DNA, 92 bp, Mus musculus
aacaggtcagataccctgtggaagggtggaaagcacacattctctctccctttctgagtaattaattccttcttcttcctggtatccgtgtt

SEQ ID NO: 75851 - DNA, 120 bp, Mus musculus
catatatatatatatatatgtatatatatatatatatatatacatacacacatatacatatatatgatatacatatatatcatatctatgtatatatatgtgtgtgtgtatacatttata

SEQ ID NO: 75852 - DNA, 110 bp, Mus musculus
tcaatctctaaagagtaaaaggagcagattggttcattatttttaagtgtctcagtctgtgacttcactgcctttcgctttgacggaggctgagcatcatgacagagcac

SEQ ID NO: 75853 - DNA, 85 bp, Mus musculus; identical to SEQ ID NO: 63901

SEQ ID NO: 75854 - DNA, 107 bp, Mus musculus
gcatatagtacaggcgagtccagaacttcctatgcagtgtaagtggtacgggagccactgattctctctctgccttacactccaaagtgtttggattgcaggtgtgt

SEQ ID NO: 75855 - DNA, 88 bp, Mus musculus
cgagagtgtgagctgctgaaggactaagagtaagagtgtgactgtgttgagccagaccttgactctgagtcagtgtatgaacttcttg

SEQ ID NO: 75856 - DNA, 82 bp, Mus musculus
ttacacattacatattacatagcatataccatatatgtatgtatatatacatatacgtgtgtgtgtgtgtatgtgtgtgtga

SEQ ID NO: 75857 - DNA, 65 bp, Mus musculus
tgcccctgtgcatgtatattggccacttctctccctgtgtgtgtgcctttgtccgtgtacatgta

SEQ ID NO: 75858 - DNA, 113 bp, Mus musculus
ggtcaagtgagtagtttgaattctgcaggagtgattaggtgccctgtgacactgtgtgcctgtccagaacttagcaaccctgcctgagtcatgatagttatctaaaaatggtc

SEQ ID NO: 75859 - DNA, 65 bp, Mus musculus
gtcatatatatattacatataacatacacatatagatatatgtgtatgtatgtttatatatgtgc

SEQ ID NO: 75860 - DNA, 79 bp, Mus musculus
catctgctgttggtggggaggctagctggttcagccactctggaaatcagtgagagctttcaagagctaagagtaaatg

SEQ ID NO: 75861 - DNA, 111 bp, Mus musculus
gtagcaaatgtgcaatttgggtgtcatgtgggtcccctaaccatttgagcagggactgtctctgactctgttacttgactttggatacttttttttttttagcttgactgc

SEQ ID NO: 75862 - DNA, 85 bp, Mus musculus
cctctactctagttaagggaaaatgtttggcagggctctgagtgagagtctttcagattttgtttatgtgactggtagatggcag

SEQ ID NO: 75863 - DNA, 105 bp, Mus musculus
ttgtaggtatataagtgtgtctctgtgtatacatgcatgtataaatgtgtgtttgtgtatctgtatatgtttatgtgtatatgggtgtggtacagtataaagcag

SEQ ID NO: 75864 - DNA, 66 bp, Mus musculus
cttggtgtagtatagactccacattgcttacctgttttgtggtctgtaactttctttcccactaag

SEQ ID NO: 75865 - DNA, 84 bp, Mus musculus
tgctcaagagaatatgttgttcagtccagacaaataccctctgcctcagcagacacgagtcactgaagggccagccttagagca

SEQ ID NO: 75866 - DNA, 123 bp, Mus musculus
tatgcatatatatgtatacaggacatgtatgtttgtatttacacatgtatgtatatatgtatgtatataggtatatatttatatacttgtgaatatatatctatgtatatatgtgtgtgtgca

SEQ ID NO: 75867 - DNA, 116 bp, Mus musculus
ttccagatgttttaaaaaataaattccttttgtctacatgcatgtatctatgtaagtgtgcatgtgaacatatggacatatgcatgttcaggtaactggagttagacagttgtgag

SEQ ID NO: 75868 - DNA, 110 bp, Mus musculus
acatctatcattccattagtaattaggccatggatttgaaatctgagttgttgccatcttgttatggtaaggctgaggcaagtgtcatgcatgatgggaagcagtgatgt

SEQ ID NO: 75869 - DNA, 81 bp, Mus musculus
gtgcacagatggcagagagaagacacagaggttacagaaaagccacactggtctatccttgccttctgccttcttcagcac

SEQ ID NO: 75870 - DNA, 115 bp, Mus musculus
gtgtatgtgcatatgtgtatatgtgtgtgagtgcatatgtgtgcctatacatggttgtatgtgtggatgtccatgtgtatatattgcacatgtaggtgcacatgtgtgggtacat

SEQ ID NO: 75871 - DNA, 76 bp, Mus musculus
gggacagtgaacagtctcagcattggctccaagatgcctgagtgggcaagcagagtcagctggcactgagagtccc

SEQ ID NO: 75872 - DNA, 112 bp, Mus musculus
gatcagtcttaggccatgatggtctgataggatacatgggacaatttcaatatttttgtatctgttgaggcctgttttgtgaccaattgtatggtcaattttggagaaggtc

SEQ ID NO: 75873 - DNA, 80 bp, Mus musculus
actgcagcacagagtaaatcatgttcaaacccaatcatagagctatgagatgcattaaataattctgtgttgttttcagt

SEQ ID NO: 75874 - DNA, 115 bp, Mus musculus
agaactccaaaatctctagttctcattcctgtagtttctctctgcctgtgtcccagtgctgggaaatgcagaatgagcaacctgccctgccatggactagactcagtcagtctct

SEQ ID NO: 75875 - DNA, 80 bp, Mus musculus
tttgcatgtatgtatgtatgtatgtatgtatgtatacatatggtttatatgatatagatatagatgcgatacagagcaaa

SEQ ID NO: 75876 - DNA, 85 bp, Mus musculus; identical to SEQ ID NO: 57439

SEQ ID NO: 75877 - DNA, 115 bp, Mus musculus
catgtatatgtacatatatataaaataactgatgtttaaacatacattgcatttaattatttgtatatcatatgttctttttgtgggttttgtacatgtgtatattgtgctaatg

SEQ ID NO: 75878 - DNA, 106 bp, Mus musculus
gtctggacagatggctcagaggttaaaatcactgactgctcttccagaggtcctgagttcaatttctagcaatcagatgttggctcacagccatctgtaatgggat

SEQ ID NO: 75879 - DNA, 179 bp, Mus musculus
aagctaaagatgcaaggcaggaacttaaggcagagacatggaggagtgatgcttccaaggtgactctctggctcactcttgttttccaagctttatatgttaatatatatatatatatatatatatatatatatatatatatatatatatttattccctgttcatttatgtgtgtaagc

SEQ ID NO: 75880 - DNA, 78 bp, Mus musculus
acatggaagtaaatgacacttgagactgtggactcatagagttacattttctcatgtgtaatttgtgatattgcatgt

SEQ ID NO: 75881 - DNA, 112 bp, Mus musculus
atctgtaattcataaaatcatctgtgttcatgatcttgattgaaaagaagtagaattcctgagattatttacttttgaattcagatccattcacagcccctatgacacagat

SEQ ID NO: 75882 - DNA, 111 bp, Mus musculus; identical to SEQ ID NO: 75840

SEQ ID NO: 75883 - DNA, 85 bp, Mus musculus; identical to SEQ ID NO: 71082

SEQ ID NO: 75884 - DNA, 69 bp, Mus musculus
agggggagcagggcattaagcagcatttttgaaaggcctctgcttctgcttctgcttctgcttctgcct

SEQ ID NO: 75885 - DNA, 78 bp, Mus musculus
cattgtctacagagatttgagtgtgcactgggtgttttgttctgaagccacacacctgcagattcactgtagaaagtg

SEQ ID NO: 75886 - DNA, 163 bp, Mus musculus
tgctatatatatgtatatgtatgtagtgtgtatgtatatatgtacatacatacacacatatatatatgtatatatatatacatgtatatatatatatatatatatatatatatatatatatatatatatacacacacacacacacatatacatgtatactgtg

SEQ ID NO: 75887 - DNA, 96 bp, Mus musculus
ggctagctgcatgattttactgcctcagcatcactgggctttgagtggcagtgatattgatgttctgtttaagccaaagttagtgtgttggcatgc

SEQ ID NO: 75888 - DNA, 102 bp, Mus musculus
tacagggggagattacatatatatatgtatatatatatacatatatatatatatatatatatatatatatatatatatatatatcttgatgatgcttttgtg

SEQ ID NO: 75889 - DNA, 123 bp, Mus musculus
tgcctttgtgtatgtgcatgtgtatgtatgtgtgagagaatgacacacacacacacacagtgaaacagagacagagacacagaaagagactgttctcacattgctgtgtcatgtgtgtaagtg

SEQ ID NO: 75890 - DNA, 72 bp, Mus musculus
ctgggaatggtgatgcaggggaccaggttctgagctgtatcactacttgctcattctgtgtcagtgtctcag

SEQ ID NO: 75891 - DNA, 85 bp, Mus musculus; identical to SEQ ID NO: 57439

SEQ ID NO: 75892 - DNA, 82 bp, Mus musculus
atctgtgtatctatcttctgtcataaagatatatatacatataatatatattatatatgtctgataagttagataggcagat

SEQ ID NO: 75893 - DNA, 95 bp, Mus musculus
acctttgttggggggaattcaagttgtctcaaaagagaaagtatcattttttttttctgagcctctctaatgttctcaggcctgaactgaatggt

SEQ ID NO: 75894 - DNA, 110 bp, Mus musculus
gtgaaggatagatcactataatatatttttagcctgtatttttgtgtatgttactcatatgttgaaaagtattgaaaatattagctaagtgaatctggtaaagtattcat

SEQ ID NO: 75895 - DNA, 94 bp, Mus musculus
tcatgtcttagttagggtttccattgctttgtaaagaactttgaaaactttgaaaaggtaactattataaagggaaacatttaattgggtctgg

SEQ ID NO: 75896 - DNA, 67 bp, Mus musculus
atgtatgtatgtgtgtatacacttgtggaattgtttgtccaaccagtgtgtgtgtgtgtgtgtgtgt

SEQ ID NO: 75897 - DNA, 96 bp, Mus musculus
ctgacataatagatctctgttaaaaactcattgactgagtgtgatgtatacattgtatttcattataagaagttaatgagtgtgtctgttgttcag

SEQ ID NO: 75898 - DNA, 186 bp, Mus musculus
tgcatgtgtaagcgtgcattacatatgtagattaccttttggtatttataagtatctgtatatatatgtgcatattatgtgtatgcttatgcatgcaatgtatatttgtgtgtatttgtgtgtatctattatttatatgtatatgtctacatgcaaggattgtatttgtgtgcatgtgtatgtgta

SEQ ID NO: 75899 - DNA, 78 bp, Mus musculus
gttccattcttcatcccagagtggtgagctgacttttctctgtctttcagaatacactagggattggagactatgaat

SEQ ID NO: 75900 - DNA, 107 bp, Mus musculus
ctaaaggtaagttaaatcctgtctgtgtgcatgtcttgtggctgtcactcactctgacactgctcagcaattaggcaatagaaggaaatatcacttgagaagtttag

SEQ ID NO: 75901 - DNA, 108 bp, Mus musculus
agtgtctatcaatgtcatctccctgtgagaggtatagatgatcctatttattaatttatccataggcttatatatgcctgttttgtagtgactgtttggtagaacact

SEQ ID NO: 75902 - DNA, 114 bp, Mus musculus
ggagagtggaggtcctctggacaggttggctgcttaggatagctttgcatgccccagagaactcagtgagcaggcaaaataggtgaaggcagggaagctaacctctatggttcc

SEQ ID NO: 75903 - DNA, 97 bp, Mus musculus
gtatgtaatatgtacgtacatatacatttatgcatatatgcttaatatatgactatatgtatatatgtgtgtaatatatgtatatgtacagacacac

SEQ ID NO: 75904 - DNA, 85 bp, Mus musculus; identical to SEQ ID NO: 57439

SEQ ID NO: 75905 - DNA, 59 bp, Mus musculus
gccccttcacttttacaccatgcctcctgtgttgtgaggtctgttgtgtgcctgggtgc

SEQ ID NO: 75906 - DNA, 87 bp, Mus musculus
gcttcataacttctgttagtttcactgtgtctctgtttagtttctgtttctaggatctgtccattgatgagagtggcatgttgaagt

SEQ ID NO: 75907 - DNA, 102 bp, Mus musculus
tgttgctagtagctattggatggagcctagtagaattgtctgtatatttatttatctgtaaatatgatggtagcaaatctgatccagtttccccaagcaaca

SEQ ID NO: 75908 - DNA, 71 bp, Mus musculus
agtgttgacataaatagtagtgatatatacatatatgtatatatatgtgtgtgtctctttgtgtgaatatt

SEQ ID NO: 75909 - DNA, 97 bp, Mus musculus
aagcagacttcctatggcacctagctctcactggcactctcactagccttaaggctttactgggagacacagctctggttgtgtctagaagttgttt

SEQ ID NO: 75910 - DNA, 113 bp, Mus musculus
cagagatgtgatctctctatcacacacataatatacatatagtgtgtgtgtctgtctgtctgtgtctgtgtgtctctatgtgtgcacacgctctaatcgggcactagagagat

SEQ ID NO: 75911 - DNA, 139 bp, Mus musculus
cattatatgtatgcatgtatgtatgtatgtatattttatatatatatatatatacatatacacacacatatatatacatacacgcacgcacacacacacatatattgcatgtatgtatatgtatgtgtatatatatatg

SEQ ID NO: 75912 - DNA, 106 bp, Mus musculus
ctgtaggatatctgaggagactattcatctttcgtttgctgtaaatccattgtttgaatttatattgaaattgttgataattgtttagtccttatgtagtctgtgg

SEQ ID NO: 75913 - DNA, 86 bp, Mus musculus
attgaaatagaatcacataatacatatatgtgtgtatatacatatatttatatacatgtcatgtgtgtaaatgtgctgagtttgat

SEQ ID NO: 75914 - DNA, 93 bp, Mus musculus
taaataatgtatacatagatgtatatacatacatatacacatatatgtatatgtgtgtatatatgtatatatatgcatatacatatatattta

SEQ ID NO: 75915 - DNA, 111 bp, Mus musculus
gctttgttcggtgcaaggcatggtcttgtgagatatttagggttgttgtttaataataaaacatttggctattttaagtctcaagtcactttgctgctgtagctgacctgc

SEQ ID NO: 75916 - DNA, 93 bp, Mus musculus; identical to SEQ ID NO: 75914

SEQ ID NO: 75917 - DNA, 111 bp, Mus musculus; identical to SEQ ID NO: 75915

SEQ ID NO: 75918 - DNA, 118 bp, Mus musculus
catttagatatatgtgtatgtttcttggtacagtacgtttgtgtgtatgtgcatatgatatgtgtgtatatttttctatgtttcgtatgtttatgggttatgtgtatattgcagagtg

SEQ ID NO: 75919 - DNA, 115 bp, Mus musculus
ggccagatatcaagattgatccagagcggagtaacaggaccatggctatagataaagcttgggcttgaaggttgtattggttctaaactagttgggtctacttgtgtttctgctc

SEQ ID NO: 75920 - DNA, 76 bp, Mus musculus
ctcctctatctagcatggggtgggtgggcatggggagaccctcactgcctgtctccctgtgattgcttcttgggag

SEQ ID NO: 75921 - DNA, 85 bp, Mus musculus; identical to SEQ ID NO: 57439

SEQ ID NO: 75922 - DNA, 85 bp, Mus musculus; identical to SEQ ID NO: 57470

SEQ ID NO: 75923 - DNA, 117 bp, Mus musculus
tcttatactaaaaatgctgttattgggctcatagaggctcacagaaactgttgagacaaacacacactctgtatgggtttgagctaggtcctttgataatacatatggttgtgcagg

SEQ ID NO: 75924 - DNA, 84 bp, Mus musculus
tgatccatgtgtgttgctggtctctccactctcttcgtatgggatctcttgctgagtgaggagacagagccttcaatgtgggca

SEQ ID NO: 75925 - DNA, 76 bp, Mus musculus
gtatataggtatatgcaaatgtatacatatacatacacacatatataaatatatatttgcttatatatttgtatat

SEQ ID NO: 75926 - DNA, 80 bp, Mus musculus
tggctttcgcatcctgtcacagtctatcactgagggcagtcagggcaggaatatggaggcaggaactgaagcaaaagcca

SEQ ID NO: 75927 - DNA, 59 bp, Mus musculus
gcggtgtgcagctccaagctcagactgggtctctcactgagcaaatgctgagcacttgc

SEQ ID NO: 75928 - DNA, 77 bp, Mus musculus
ggttatcatgtgggtctcccaacagttggagcagaagctgtctctgactcagactctgttgcctgcctatggatccc

SEQ ID NO: 75929 - DNA, 106 bp, Mus musculus
gtaaggtgatgatgctcgactctagactctctctcggtcagtggctcgcctttcctagttattcaatactgggagggggttattagtaagtgtaaattaagattac

SEQ ID NO: 75930 - DNA, 106 bp, Mus musculus
gctacttgggaaggggatcaatgcttagggcatgtagtaagcagaggccagggacactgctaaacaacctacagtctacagaacagcttcctttaatatacccagc

SEQ ID NO: 75931 - DNA, 112 bp, Mus musculus
atggtgatgtgaatggtgggaaacaggaacgatatgtactgttgacaggaaagtactcagaggattcaaaggctgcatatggtagatgctcactgtagtacccatgcttaca

SEQ ID NO: 75932 - DNA, 107 bp, Mus musculus
gttatataataaggttgcttcaacagaatgttactctaaagtctcatttttttttaaaagggtggaatagatggctcagttcataaaagtccttattattgtcgagc

SEQ ID NO: 75933 - DNA, 89 bp, Mus musculus
tctgtatctgtgtctgtttctgtctctcttgattgctttgtggcctgtaacatgatcagattttagagatgggtggagtattctataga

SEQ ID NO: 75934 - DNA, 86 bp, Mus musculus
gctcagacttttggtttcttgtatttcctttgaaaaaaaatgaaactttttttttttctgggaagggtagcagccctcaactgggc

SEQ ID NO: 75935 - DNA, 61 bp, Mus musculus
cagcaggccagaggtggacatcagctctctgtttctgtctgtctgtctgtctgtctgtctg

SEQ ID NO: 75936 - DNA, 105 bp, Mus musculus
atgtatgtgtgtatgtatgaatgaatgtattatgtatttatgtatgtatgtatgtatatatgtatgtatgcatgtatgtattatccatccatatctatcatctat

SEQ ID NO: 75937 - DNA, 85 bp, Mus musculus; identical to SEQ ID NO: 57470

SEQ ID NO: 75938 - DNA, 80 bp, Mus musculus
ggagcagtctgaggctgtaaatgttgtaacccagaattactgattaagagacacttcagtgtgctcagacagtttgcttc

SEQ ID NO: 75939 - DNA, 110 bp, Mus musculus
ctaatggtcactaatctatagtcctagacagaacccagggatttggaaaatatattttagttttcaatactctgtaaaacaccatggaggctagagagatggctcaatag

SEQ ID NO: 75940 - DNA, 72 bp, Mus musculus
acaagtactctctgtctctctgacatattcttgaaatactaagaggtttgcagagtgtgtgcaggtatttgt

SEQ ID NO: 75941 - DNA, 117 bp, Mus musculus
tgtatatatatacatatacatatacacacatacatatatatacccacatatatttgtgtgtatgtatatatgtgtatatatgtacatgtatagatatatgaaatggtcatatatatg

SEQ ID NO: 75942 - DNA, 93 bp, Mus musculus
gtataatacacacacacacacacacacacacacacacacacatatatgtgtatgtatgtatgtatgtatgtatgtatgtaagtatgtatgtat

SEQ ID NO: 75943 - DNA, 65 bp, Mus musculus
tctgagtctgtgtggtatagttgagctagtcagtctgccaactctcccacacacaccccaccaga

SEQ ID NO: 75944 - DNA, 85 bp, Mus musculus; identical to SEQ ID NO: 57439

SEQ ID NO: 75945 - DNA, 79 bp, Mus musculus
acatatatgtatatactatgtacatatatatgtatatatgtgtatatatacatatttatgcatgtgtgtagatgtatgt

SEQ ID NO: 75946 - DNA, 81 bp, Mus musculus
ggcagagtctcagtatgcatgttgctagatagtgtcccctagacatgatagggaacatacactcatgcactctgtctctcc

SEQ ID NO: 75947 - DNA, 93 bp, Mus musculus
catatatgtatatatgtgtatatgtatgtatatgtatatatatacatatatatgcatgtgtatatgtatgtgtatatatttgtatgtatatgc

SEQ ID NO: 75948 - DNA, 94 bp, Mus musculus
gggacctcagcataaccacagagatttgagcttactctgaccatcaaatcctggtggagagagaagatacagtggtgtttagtgtacgtgtcct

SEQ ID NO: 75949 - DNA, 78 bp, Mus musculus
gcttctctgcctctcacactgtataacccaaggtaacaggcataggaaagtaaccatggtatctggtcagaggcaagc

SEQ ID NO: 75950 - DNA, 64 bp, Mus musculus
gccctaagtgtgataggagaaaattgaggcccaccaacctcaatttttgttgttctcttagagc

SEQ ID NO: 75951 - DNA, 105 bp, Mus musculus
gaggacctagtgcagacccatgcaggctccatgattgccacttcagtctctgtgagcccctatgagccctgcttagttgactcatccagacttgatatggggatt

SEQ ID NO: 75952 - DNA, 111 bp, Mus musculus
atgtacataaatatacacatatgtacatatgtatatatgtgtgtgtgtacatttgtatatatgtataaatatatatatatgtatatgtgtgtatatatgtatgtgcatatg

SEQ ID NO: 75953 - DNA, 97 bp, Mus musculus
tttggaagagtccagtcccattgaatatatctatattttagctcccacaattaaggctcaagaaatatagtagaagaggggctggaaagattctaag

SEQ ID NO: 75954 - DNA, 62 bp, Mus musculus
gggagctgagagaagtcacagaggctctccatatcaggcaggggttagtgacttcggtttcc

SEQ ID NO: 75955 - DNA, 68 bp, Mus musculus
gttagccactctgacacatgaaactatgcagtcttctactgcatgatgctcatgttccagtccctgat

SEQ ID NO: 75956 - DNA, 85 bp, Mus musculus; identical to SEQ ID NO: 57439

SEQ ID NO: 75957 - DNA, 108 bp, Mus musculus
ttactggtgactaagcttttaaatctatgacactgtggggaccattcttaaattgatattcaatttatttatgaagtagtctcttgtgttttttagttgaactattga

SEQ ID NO: 75958 - DNA, 64 bp, Mus musculus
gagaggggagcagttcggggtctctgggcctcacagaagccagagatgacaggttctcagtctc

SEQ ID NO: 75959 - DNA, 111 bp, Mus musculus
tcaaatcagactaataattcattcaatggacatttgcaaatgtagatgtgtggagacacagacagacacactgcagcttccatggtgagatgttttctctgctttgtttga

SEQ ID NO: 75960 - DNA, 110 bp, Mus musculus
actctcaattacagcatatggattctctcttaataaaccatgctattgagactcacattctcactgctggtagaaatgtctcctatgttggaagttttatgattgagagt

SEQ ID NO: 75961 - DNA, 76 bp, Mus musculus
gacaggcagatctctgaattcttttgaaatgttaagaaaactgagcttgtctcagaagaatcagagggctggggtc

SEQ ID NO: 75962 - DNA, 84 bp, Mus musculus
ggccttgtgggagaaagtgtgttacttggggtgggctttgaggttctttagaacctaagtgggtcactgtctctttctgttgcc

SEQ ID NO: 75963 - DNA, 117 bp, Mus musculus
gcagggagatgtatgtctggagctaagtaggggagcagaaacgtgacattttttttgtatataaatcctggtgataattttgactttaatattaagtgcaaagggaggcctttcagc

SEQ ID NO: 75964 - DNA, 115 bp, Mus musculus
gagagcctctggatttgatttctagtgctactgaatgaatgaatgaatgaatgaatgaatgaatgaatgaatcatgtgattagacagtttttaactaggagcgactctcaagagg

SEQ ID NO: 75965 - DNA, 75 bp, Mus musculus
gatgcaggagaggaagacaggaaggccttgggctatacacacttttgctggggttccctgtctctctgtctcatc

SEQ ID NO: 75966 - DNA, 71 bp, Mus musculus
tatgtgtatgtatatgtagggggtgtacatatatgtatatatgtagtactctatatatgtttatacatata

SEQ ID NO: 75967 - DNA, 118 bp, Mus musculus
tctaccttgggactggttggagctcttggtgctactgcaatgttgtaaatgactgtgagagaaaagagtgaaaactttttccaggagaaagggcctggatggtatcaactgctgtcac

SEQ ID NO: 75968 - DNA, 84 bp, Mus musculus
agcattgcatctctctaactcatatgctgctgagaacaggtctcattcatctgagtagtgtgtgaggaaaggtgaggactggct

SEQ ID NO: 75969 - DNA, 85 bp, Mus musculus; identical to SEQ ID NO: 57470

SEQ ID NO: 75970 - DNA, 85 bp, Mus musculus; identical to SEQ ID NO: 57439

SEQ ID NO: 75971 - DNA, 115 bp, Mus musculus
tccagcttgtttcttcagaccatttgcttggaaaattgttttccagacttttactctgaggtaatgtctgtctttttccctgagatggttttcctgtaagcagcaacatgttggg

SEQ ID NO: 75972 - DNA, 80 bp, Mus musculus
aacagctccagagaagtaacctccagatgtgccaatctcttctcacagacacagacacagacacttctactggatctgtt

SEQ ID NO: 75973 - DNA, 89 bp, Mus musculus
gggcggctcctcacatctccccccttttcttttatttaaaaggcaacaggccacccagtactgagagtggagatagaggtcaaatcccc

SEQ ID NO: 75974 - DNA, 116 bp, Mus musculus
tgtcttccaaaaatctgcaggggctgtattctgagctgttatcattctcattctgggacgtgggttgattgaactgctgctgactaaaacaccatttgtaatcatgatggaagaga

SEQ ID NO: 75975 - DNA, 95 bp, Mus musculus
tatatgtatatatgtatatgtatatatgtatattatatgtgtacatatatatgtgtatatatatgtatatgtacatatgtatatgtatatatatg

SEQ ID NO: 75976 - DNA, 78 bp, Mus musculus
tgtccacttggttgtgcatacatgtgttctttctgctttttgcatattatgaatacaactatgaacactttgtgtaca

SEQ ID NO: 75977 - DNA, 103 bp, Mus musculus
taattttgggaaacagtaggtaaggatttcctagaagacatatataatcattctactagtattatatgtttatctataaacttaacctaacaggccaaaattg

SEQ ID NO: 75978 - DNA, 103 bp, Mus musculus
tgttagcattataccttcttaaatagtcattttctttttgtgttgataaactttaattttctattcagtagtggtggctggtataggaagctgaatgttcaca

SEQ ID NO: 75979 - DNA, 83 bp, Mus musculus
tatgtatgtaaagtgtaccttatgtattatataatatatatatatatttgtgtttgtgtacatatattcattttatatatata

SEQ ID NO: 75980 - DNA, 85 bp, Mus musculus; identical to SEQ ID NO: 57439

SEQ ID NO: 75981 - DNA, 112 bp, Mus musculus
gatcagtcttaggccatggtggtctgataggatacatgggacaatttcaatatttttgtatctgttgaggcctattttgtgaccaactatatggtcaattttggagaaggtc

SEQ ID NO: 75982 - DNA, 93 bp, Mus musculus
gggttcagaatagtgtcatcagaatgtggggaatgtagtaagctactgaagtcgacttacgtattcctaaatattctttatgtaattgagccc

SEQ ID NO: 75983 - DNA, 85 bp, Mus musculus; identical to SEQ ID NO: 57439

SEQ ID NO: 75984 - DNA, 117 bp, Mus musculus
gactctaagacattgccccatttctgcagttggaagtcctacaagaacacaaagctagacaaccaaaatattcatgtaaaggacctaactcagatccatacagcatccattgtggtc

SEQ ID NO: 75985 - DNA, 83 bp, Mus musculus
tagagtgtggtagtttcaatatatttttctaaagagtggtaccactttgaggtagggtttagttgaaaaagggtactactttg

SEQ ID NO: 75986 - DNA, 114 bp, Mus musculus
ggtctcaatggagagctgactatctgcttttctcggaaacttcttcacagatctctgtctggaatcctgagaagagtaaaaaagtgatgattccacgattaaatatttgaggtt

SEQ ID NO: 75987 - DNA, 82 bp, Mus musculus
caagttcagagcttgttctttttactcattagtgcagccagctggatatagctgttactgcagttagagtgttctgagtatg

SEQ ID NO: 75988 - DNA, 98 bp, Mus musculus
tatataagaggtcaaaacgttggagtttacttgttctatagtatgcatgcattcgagcatgaagactagagtttttgttctttgaatcttcatatgta

SEQ ID NO: 75989 - DNA, 90 bp, Mus musculus
ctttcaaacggctatctgtagtgcatgccatatgtctatatgagtgcttcttggaaattttgtacttgtgatagtagggaaagcattata

SEQ ID NO: 75990 - DNA, 115 bp, Mus musculus; identical to SEQ ID NO: 59579

SEQ ID NO: 75991 - DNA, 71 bp, Mus musculus
gtatgataggattcatgggacaatttcaatatttttgtatgtgttgagacctgttttgtgaccaattatat

SEQ ID NO: 75992 - DNA, 84 bp, Mus musculus
acataaaaatgatgagaatgtgcatatatatatgtatatatacatatatatgcatatatatattcatttctaacatagatatgt

SEQ ID NO: 75993 - DNA, 115 bp, Mus musculus
aagattggtggatttatgatgtggagggtatggcagagtcttcagtgttgcttatttttttttaagctatacatgttcttctcacaggtcaacagcataaaaacagtcatttctt

SEQ ID NO: 75994 - DNA, 56 bp, Mus musculus
atctatctatctatttatctatctatatctatatatagatagatatagatatagat

SEQ ID NO: 75995 - DNA, 89 bp, Mus musculus
acacacacatgtacacacaaatattcatatagttgcacatgtatgctgtatgtgggcctgtatgtatgtatgtatgtatgtatgtatgt

SEQ ID NO: 75996 - DNA, 78 bp, Mus musculus
gggcttgcaggtctgctcttgagtaggctttctggagctgcttccacacagtctcactcacttgagtgccttgagcct

SEQ ID NO: 75997 - DNA, 110 bp, Mus musculus
atatgtggattcatatatgtacatatatatgtatatatgtatatgtgtatatgtgtgtgtgtatttaccgctatatatacatatatatgtgtctgtatatatatatatat

SEQ ID NO: 75998 - DNA, 115 bp, Mus musculus
gtgtttctgtttgtctatgtgcatgtatatattcatatgatgtatgagtatatgtatatgaatatatgtctgtgtttaggtgtgtgtatataaatgattttttttttagaatgac

SEQ ID NO: 75999 - DNA, 106 bp, Mus musculus
ttctctgcagccagggtttttaccagtcaggctcctggctagattccaggtaccagctggtacctgatctagccaaagcctgactgtaagccctgaacacaaagga

SEQ ID NO: 76000 - DNA, 81 bp, Mus musculus
gttcagaagtcagtatgaggagtgtgcttccatccagctctaccttcatatttgagacacactctgtcactgaatctagac

SEQ ID NO: 76001 - DNA, 75 bp, Mus musculus
tagattcagtgacagagtgtgtctcaaatatgaaggtagagctggatggaagcacactcctcatactgacttctg

SEQ ID NO: 76002 - DNA, 78 bp, Mus musculus
ggtttttaccagtcaggctcctggctagattccaggtaccaactggtacctgatctagccaaagcctgactgtaagct

SEQ ID NO: 76003 - DNA, 72 bp, Mus musculus
tgtatgtatatatatgtgtgcatatttgtgtgtatatatacatatatatgcatatatacacatatacatata

SEQ ID NO: 76004 - DNA, 116 bp, Mus musculus
tgtatatgaatatatatatgtgtgtatgtatatggctagaacctatatatgtatagttcaagtgatatatatatatatatatatatatatatatatatatatataaatgtatcagt

SEQ ID NO: 76005 - DNA, 72 bp, Mus musculus
atgctgttgaagatgctacctctccagggtcgaattgtacccaggcagagcttgtagattctcagaaagcgt

SEQ ID NO: 76006 - DNA, 112 bp, Mus musculus
catttcacgttctgaaattgtacatccacaataaaatctctgaatttttatttctgtagtatagaaataaaggcaggtgttcataattaaagatggcagttttgctgtaatg

SEQ ID NO: 76007 - DNA, 92 bp, Mus musculus
ccaggcttacctctcgaggtccgcgacactcaagcaaagtggcggggaactgtctcactgtctgcgtggtacctctcgaatccgttgtctgg

SEQ ID NO: 76008 - DNA, 69 bp, Mus musculus
catgcaacttggtcttcattgggcttccctaaaaataaaagcaggggctgtctctgactctgttgcctg

SEQ ID NO: 76009 - DNA, 103 bp, Mus musculus
cacaaaactaacagctacaacaaatatacagaggacctgatgcaaactcatgcaggcatctgtctctgtgagttaatatggacctggcttagttgatccagtg

SEQ ID NO: 76010 - DNA, 111 bp, Mus musculus
ggcatacttaaccaatttcatagacgtctaatgttgtttgaatgaattgagtgttcaaaatcatcaaaataagattatgcaactcaggagtgttgggaaaaactggtatct

SEQ ID NO: 76011 - DNA, 85 bp, Mus musculus; identical to SEQ ID NO: 68752

SEQ ID NO: 76012 - DNA, 108 bp, Mus musculus
catacatacatacatacatacatacatacatacatatatacatatatatatacatgcacatatacataaacatatatctatgtatatgtatgtatgtaagtatgcatg

SEQ ID NO: 76013 - DNA, 104 bp, Mus musculus
tgaagtgccccttcttgtcttttttgataattttgggttggaagtcaattttattctatatttgaatgactactccagcttttttattcagactgatggcctca

SEQ ID NO: 76014 - DNA, 92 bp, Mus musculus; identical to SEQ ID NO: 57641

SEQ ID NO: 76015 - DNA, 85 bp, Mus musculus
ctggatcccatgtggtagatgctagaaactttaattttatattcacaggaaatgtatagaagtctctatgtcctactggatctag

SEQ ID NO: 76016 - DNA, 109 bp, Mus musculus
ctggatggttttagctcgcttgacaaagatcaagtgaccataggtgtgtggattcatctctggatcttcaattctgttccattggtctacttgtctgtcactataccag

SEQ ID NO: 76017 - DNA, 104 bp, Mus musculus
tctacatgtatgtatctatttatatatgtatgcctgaatatatatatatatacatatatatgtatatatacatatatatatgtcggtctgtatacctatgtgtg

SEQ ID NO: 76018 - DNA, 116 bp, Mus musculus
gtttcttcagcagtgctctttttcccttcatagaggttagttactgaaccatgtcctttcatttcagattatctagttctcttctctatgtgtcatgggacagatctgccaggaac

SEQ ID NO: 76019 - DNA, 103 bp, Mus musculus
ccagtagaaatactttctcaactgtggagcgctgctcagtgactgcctctctgtcatgctgcttttattgttagggtttatattgagttagtcttttaactgg

SEQ ID NO: 76020 - DNA, 85 bp, Mus musculus; identical to SEQ ID NO: 57439

SEQ ID NO: 76021 - DNA, 117 bp, Mus musculus
gcctctcaaatcctcaccacctcctcttccatctggatctactctctttctgtctctcattagaaaataggtggggtgggggccagtgggggagggggagggggatcctgatctggt

SEQ ID NO: 76022 - DNA, 72 bp, Mus musculus
ctgctgacattttgctgtctctgacagtcagtgccactcacctggtcacagctgcagtccagcccacagcag

SEQ ID NO: 76023 - DNA, 108 bp, Mus musculus
ccaaagaatcatggcattgccagcctctagtcaacggttctggtgtttgagacacactgtgcctgtgtacctactgctggttttctttgggcttttcaataacgtggt

SEQ ID NO: 76024 - DNA, 58 bp, Mus musculus
atgcagacatacacagtagtctgggtactctcccatgcctctgtggctctgtctctat

SEQ ID NO: 76025 - DNA, 92 bp, Mus musculus
aatataaggagcacacaaacttgggaatgagcatactataaatctgtatctatagtaatttttattcttaagtgatagtacatttttgtgtt

SEQ ID NO: 76026 - DNA, 85 bp, Mus musculus; identical to SEQ ID NO: 58391

SEQ ID NO: 76027 - DNA, 85 bp, Mus musculus; identical to SEQ ID NO: 58391

SEQ ID NO: 76028 - DNA, 85 bp, Mus musculus; identical to SEQ ID NO: 58391

SEQ ID NO: 76029 - DNA, 93 bp, Mus musculus
catacatagtacatctatcatacatccatctatgtatgtatgtatgtatgtatgtatgcatgcatgtatgcatgtacgtatatatgtatgtat

SEQ ID NO: 76030 - DNA, 100 bp, Mus musculus
gtatacaattatatatatattatacattatatacacacatatatatgtatatatatacatatatatgtgtgtgtgtgtgtatatatacacacaattatac

SEQ ID NO: 76031 - DNA, 84 bp, Mus musculus
cacaacaccatgagagtagcttaacacatcatttaaggaaatggaatgaatatttgttgtatgtaagcgatacacatggtggtg

SEQ ID NO: 76032 - DNA, 85 bp, Mus musculus; identical to SEQ ID NO: 57470

SEQ ID NO: 76033 - DNA, 75 bp, Mus musculus
gagagttgacagactgtcagactctttctaggtagccagcactagaatcttcagatgtatttcagttgtcttctc

SEQ ID NO: 76034 - DNA, 79 bp, Mus musculus
tctgggtccctcccagtctgtgggtctctgtgccattggggtaccacaccagactgtcaccttcagggggagattcaga

SEQ ID NO: 76035 - DNA, 114 bp, Mus musculus
tttggataattatgatcgctggcggcatcctttgcaagctcacagttgtttctgaggttgttttaagttactgtgagggagagggcttggtcagaggacaacagtgcttctggg

SEQ ID NO: 76036 - DNA, 79 bp, Mus musculus
ttgtctgtatgtctatgtgcatgcatgtgtatatgtgtgtgagtgtgtatatatatatgtgtgtgagagtgagagagag

SEQ ID NO: 76037 - DNA, 92 bp, Mus musculus
ctctgtggtctgttccctgagtcagtcagtatgtgtctgctcaggaaaaacagtcagtgcccgattgcctcacatgggaactggctacagag

SEQ ID NO: 76038 - DNA, 85 bp, Mus musculus
tgagaccatggtgttgacaagtctggctcctgggaggccactctccttggcctgcagacagctgcccacttgttacctggtcaca

SEQ ID NO: 76039 - DNA, 105 bp, Mus musculus
tgcagtttctccagtagagatcccagcccaccagatcccagctttctgtccatgtgtctctctgtctggcccatttctgaagctgcactggaggtggcatcctac

SEQ ID NO: 76040 - DNA, 111 bp, Mus musculus
ccacagcaccgatcatttaaaaacaatctgtgtgacaattagaaaaccctaagtactaagtggatgtcaattgtaaagacttgtagttaattgggtaggctgcgataatgg

SEQ ID NO: 76041 - DNA, 109 bp, Mus musculus
ttctgcttggacctgtgacctgtgggcttccctttgtcatcctttgcctaggcctctgagtgaggcaaggacagcaaaggggggctcagtggtcacctctactgcagag

SEQ ID NO: 76042 - DNA, 126 bp, Mus musculus
tgcatgattagcaggtgtgtatgtatatgtatgtgtgtgattagcaggtctgtgtgcatgtgcatgtgtgtgattagcaggtgtgtgtgcatgtgcatgtgtgggattagcaggtatatgtgtgtg

SEQ ID NO: 76043 - DNA, 104 bp, Mus musculus
tgtgtgattagcaggtgtgtatgtatatgtatgtgtgtgattagcaggtctgtgtgcatgtgcatgtgtgtgattagcaggtgtgtgtgcatgtgcatgtgagt

SEQ ID NO: 76044 - DNA, 87 bp, Mus musculus
tgtgtgattagcaggtgtgtgtgtgcatgtgcatgtgtgggattagcaggtgtgtgtgcatgtgcatgtgcatgtgtgggattagca

SEQ ID NO: 76045 - DNA, 57 bp, Mus musculus
caggtgtgtgtgcatgtgcatgtgtgtgattagcaggtgtgtgtgcatgtgcatgtg

SEQ ID NO: 76046 - DNA, 60 bp, Mus musculus
tctttaacacagtcactgtctgaaagaaagaatcttccaagacaggagtgtgttcaaaga

SEQ ID NO: 76047 - DNA, 72 bp, Mus musculus
acagagatcagacatatccatgcatgtgtgtccccctcccctctctctgtgtctgtgtgtctgtctctctgt

SEQ ID NO: 76048 - DNA, 118 bp, Mus musculus
gagtgttatgcacttgtgtgtctattgattatctatctatctatctatctatctatctatctatctatctatctatcatctatctgtctatcaaaagcacacctgtgctaacagaatc

SEQ ID NO: 76049 - DNA, 62 bp, Mus musculus
cacacacacacccagagctccagaactgagtgtagaaagtcagttctctgagtgttcttgtg

SEQ ID NO: 76050 - DNA, 82 bp, Mus musculus
ggcaaagcctgcacgggagacccacatcctcagaccagagccactctggctgtgacactggtcttctgttcacgcagcttcc

SEQ ID NO: 76051 - DNA, 83 bp, Mus musculus
aagagcaagcaatggaaagcaaagaagtaagcagcactcccccagggctgctgacttagttcctgcctccaggttcctgcctt

SEQ ID NO: 76052 - DNA, 85 bp, Mus musculus; identical to SEQ ID NO: 57439

SEQ ID NO: 76053 - DNA, 85 bp, Mus musculus; identical to SEQ ID NO: 57439

SEQ ID NO: 76054 - DNA, 89 bp, Mus musculus
gtatgtatgtgtctgtgtgtgtgtgtgtatgtgtatatatatatatatgtatatatatatatatatatatatatataaatacataatat

SEQ ID NO: 76055 - DNA, 79 bp, Mus musculus; identical to SEQ ID NO: 72631

SEQ ID NO: 76056 - DNA, 83 bp, Mus musculus
catgtgtgtttggaggatgtgttgctaagtggatgcagacatcatttcctttgtatctgtatatatttctctgtttacatctg

SEQ ID NO: 76057 - DNA, 102 bp, Mus musculus
gctcggccgtgtcagaggctgtgtttcctgttgatttatgtgctgtcacagaattaattgagtctggacacagggtctcattttcttggacatgtagcgggt

SEQ ID NO: 76058 - DNA, 75 bp, Mus musculus
tcattaactgcatcacagatgacactgagggctagattaatgcattgagatgtctatgtatgcagttcattatga

SEQ ID NO: 76059 - DNA, 91 bp, Mus musculus
ggctctcagtgagcaggctgggatagaagggtgggtgcccctccgatacggggcttctgatacactctgtctctctctcatctggagctga

SEQ ID NO: 76060 - DNA, 77 bp, Mus musculus
atagtttgttgaatctgcagatgcagaaccttcagctgtgaagggctggttgtgtaagtagagtgtgaagaaactgt

SEQ ID NO: 76061 - DNA, 88 bp, Mus musculus
tctacctgtctgtctgtctgtctgtctgtgcctgtgcatgtataggtgcatatgcatgtgtcaggccgcatgtgaggaggtcaggaga

SEQ ID NO: 76062 - DNA, 60 bp, Mus musculus
gaggcagagtctctcaccggaacgctctgattaggttctgggtctgtctgtctctgcctc

SEQ ID NO: 76063 - DNA, 95 bp, Mus musculus
tactggcttgaatgtttacaagcttgagaatttcctttgagttctcagaacacagtctgctcacttggaacccacaagcttcttattggttagta

SEQ ID NO: 76064 - DNA, 109 bp, Mus musculus
tcttggtcagcttgatgggatttagaatcgctttagacaagactgattctctctctttcttagtagccattgtctttagctcttcactcagttgctgggccttatgaga

SEQ ID NO: 76065 - DNA, 72 bp, Mus musculus
acatacacacacatacacacacacatacatatacatacacacatatatgtatgtatgtatgtatgtgtatgt

SEQ ID NO: 76066 - DNA, 89 bp, Mus musculus
ggggcggttgatagcactctgtcacagtggcagtgtagtcaaagcagcagacagagcagtgtgaccacagagacctatggcactggccc

SEQ ID NO: 76067 - DNA, 57 bp, Mus musculus
gtatgtatgtgtgtgtatatatatatgtatacatatatatatacacacacaacatat

SEQ ID NO: 76068 - DNA, 90 bp, Mus musculus
gttaagaatggtctctagggggctggagagatagattagtggttaagagcactgtctgctcttcctgaggtcctgagttcaattcccagc

SEQ ID NO: 76069 - DNA, 69 bp, Mus musculus
tgtgctatatgcatgtgtgtgtgtatatatatatatatatacatatatatatatacatgtatgtatata

SEQ ID NO: 76070 - DNA, 84 bp, Mus musculus
gtgtgtgtgtatgtgtatatgtgtgtgtgtgtatatatatatatatgtatatacatacatatatacatatacatatggttgcac

SEQ ID NO: 76071 - DNA, 56 bp, Mus musculus
gtgcaaccatatgtatatgtatatatgtatgtatatacatatatatatatatacac

SEQ ID NO: 76072 - DNA, 69 bp, Mus musculus
gtgtgtgcatgtgcacgtgcatgtgcatgtgtgccttcacacactcatgcacacacacagggcacacac

SEQ ID NO: 76073 - DNA, 81 bp, Mus musculus
ctataactgtgccctggttcttccctcttggaaaaagatataacttgctttttattttatagagggaaacccacagttgag

SEQ ID NO: 76074 - DNA, 97 bp, Mus musculus
gacacatgttcagggctctgtcagaggagtgagtgaacactatgcctttcctggaccctctctcagattcttctctcagcttcttgaaatctgtgtc

SEQ ID NO: 76075 - DNA, 69 bp, Mus musculus
gaaaacaggggctggagggatggctcagcagttaagggcactgactgctcttccagaggtcctgagttc

SEQ ID NO: 76076 - DNA, 62 bp, Mus musculus
gagctgactgctcttgcagaggacttggtttcggttcgcagcacccacatggcaggcagctc

SEQ ID NO: 76077 - DNA, 73 bp, Mus musculus
gcggtgggcatggctgcaggttctgcttctcagtgctgaagccagcctgaggtgactctgtctgtgccaccgt

SEQ ID NO: 76078 - DNA, 92 bp, Mus musculus
ctgccagagtcagttgccaggagcattctcaggaggggaggccaggccttgctctctgagactctctgtggcccacctggacactctggtag

SEQ ID NO: 76079 - DNA, 85 bp, Mus musculus
tttatgtctatactatgtgtgtgtatatttatgtatatactatatgtatgtgtgtgtgtgtaaatacacttgtttggtccataaa

SEQ ID NO: 76080 - DNA, 93 bp, Mus musculus
gtagatttgtgagtgtagagctgcccagaagtctgtttgtaaatctgatgtcagaagtgaggctactgggacagggctctgtgaccacagtgc

SEQ ID NO: 76081 - DNA, 110 bp, Mus musculus
ggagatgtctgctttctgaattattctgttggttgttttgtgtgtgtgtgcgcacacacacacactgtgagcttacctataatttcaggaaggcctgactgactcactcc

SEQ ID NO: 76082 - DNA, 75 bp, Mus musculus
ccatccatctatttatttgtttgtatgtgtgtgtacacatgtgcatgtgcgcatgcctttgtgtctacgtggagg

SEQ ID NO: 76083 - DNA, 82 bp, Mus musculus
gacatagacacagtacatctatatatctatatatctacaccattgaaaaattgtgtgtgtgtgtgtgtgtgtgtgtgtgttg

SEQ ID NO: 76084 - DNA, 91 bp, Mus musculus
aaacagtggcagagtcagaaactagagccttgtacaggctatacccttggcttccttggcctgtctgtctgacagtcagctgccatagttt

SEQ ID NO: 76085 - DNA, 73 bp, Mus musculus; identical to SEQ ID NO: 67545

SEQ ID NO: 76086 - DNA, 112 bp, Mus musculus
caggatttccagcccctgatgaaaacccagacattcttttcaaccccagccgcatctctgtgtggctcactggttgggaccagaatgctggttgttaggcttggactctgcc

SEQ ID NO: 76087 - DNA, 83 bp, Mus musculus
gatactcagccttgtctgagagaagccagactccactcagagtctgcccacatctacttctgtcagcctttggcatgagcctc

SEQ ID NO: 76088 - DNA, 103 bp, Mus musculus
agcaacatcactgagtggaaatcttctggccagtatttcctcagagtcatcacagagagctgtggtccagagggggccaaggctgccactcatgttggcagct

SEQ ID NO: 76089 - DNA, 105 bp, Mus musculus
ctggtgagtaagtgaggggattgaggaagcaagtggctgctgagggcagacagacagacagacagacactgcagtccacagtgttcttcatgcagcaaatcccag

SEQ ID NO: 76090 - DNA, 76 bp, Mus musculus
cacatagtgaggtcagggtcagccttagatacctggtgagaccatctcagaaagggtggctctgtctgtctgtctg

SEQ ID NO: 76091 - DNA, 83 bp, Mus musculus
tggctctggcgtagctcactgtagaaagagaggtggggccgaaggcggggctctcgagtgtaggagatgtaggtcagaggtca

SEQ ID NO: 76092 - DNA, 70 bp, Mus musculus
ggttgaatgtgtggataggggtgtggggggatagggctgtgtctgtgtgtctctgtgagtgtacttgact

SEQ ID NO: 76093 - DNA, 87 bp, Mus musculus
tgtgtggatatgtgtggatgtatggatgtatgtatatatgtatgtatgtatatgcatgctgagagtacatgccctcccctttacata

SEQ ID NO: 76094 - DNA, 82 bp, Mus musculus
agatctttgtctgtctcagaatgcatctgttcttgtttgcctgaggggatggagcccggatactgagaagaaagagagctct

SEQ ID NO: 76095 - DNA, 75 bp, Mus musculus
ggtgtctgacgatgtgtggaattatgtctggatctttaattcaattgcattggtcaacatatctgtttttatgcc

SEQ ID NO: 76096 - DNA, 108 bp, Mus musculus
gccccgactataacccctgcattcttagctcctgtggacttacacacacacacacacacacacacacacacacacacacacacagtgcttgtagaattgggtgtgggc

SEQ ID NO: 76097 - DNA, 91 bp, Mus musculus
agaatgcgtgacagagactctaagctcaggcatctgagtctctgtgagactcggttacctctgaatgttggctgctttgtcgcttgcttct

SEQ ID NO: 76098 - DNA, 85 bp, Mus musculus
tcattacaatgggtgtgtatgtgtgtgaggccagagatctgagtcaggttcagcctcagtcactcacaatgttattgttgtttga

SEQ ID NO: 76099 - DNA, 79 bp, Mus musculus
tatatatacacatacacatatatatatatatatatatgcactccatatatatatgtatgtatatgtatgtgtatgtata

SEQ ID NO: 76100 - DNA, 108 bp, Mus musculus
acaatactttgcagctgccaggatggggtaagggcctgagctctgggaaatcaaggccccacactctcaaactcacagctctggcacaaagctgatagaaggggttgt

SEQ ID NO: 76101 - DNA, 65 bp, Mus musculus
gctgccctagggcttggagaggctgggagggtttctctcactgtctcagatcccacaggagtggt

SEQ ID NO: 76102 - DNA, 96 bp, Mus musculus
ccacaaacctcagagcagatggcagtgggacacttgtggccccaacaaccactccttgtttccctctgtctgactcctgacttctctgggctgtgg

SEQ ID NO: 76103 - DNA, 79 bp, Mus musculus
tgagagactatgaacgctgagtggagacagcagagagccatactgctctgactctccatgtatgtgtctcactctctca

SEQ ID NO: 76104 - DNA, 79 bp, Mus musculus
tctgtgatcctgattgtgtcagaactcagagtccagctgtctctgggattctgtgattctgtgatcctgagatcctggg

SEQ ID NO: 76105 - DNA, 116 bp, Mus musculus
taagtcctaagtttaatagtagtgctccatatgaacgacctgccttcattcccatcagcgttcgcttgttgatactgatgcacaggatcacaggtagagcaagagcttaatattta

SEQ ID NO: 76106 - DNA, 67 bp, Mus musculus
tgagatacagtctcaggaagacaacaaacatcaagttctggcttttggtctgtctgtctgtctctca

SEQ ID NO: 76107 - DNA, 99 bp, Mus musculus
gcatgttcagtatggaaggatggtatcactgggaagtttgtagaggttttaagaacagcttctgcaagctcagtagactcttcacagtactgaaaatgt

SEQ ID NO: 76108 - DNA, 81 bp, Mus musculus
ggagatctggctcttattataacgctccatgtctgcaaatattaattttgtctgtcagtgtgtctgagccaagggatgtcc

SEQ ID NO: 76109 - DNA, 132 bp, Mus musculus
ttgaggggaggagggaaaggacagcattcctgagtgcacagcccctctttaggcttgtgactttcttcatatgtgtcccaaggagcccatcactcactcagcaggtatgtgaccacaagccctgtgctactt

SEQ ID NO: 76110 - DNA, 94 bp, Mus musculus
ggccagagtcgggaaaggatgaggcacactgctgagtgaggttgcttccggtgacttcacacacactgagcctgtgctgcccctgtggctggtt

SEQ ID NO: 76111 - DNA, 109 bp, Mus musculus
gtgtgtatgtatatatgtgtgtgtatatatatatgtgtgtgtgtgtgtgtgtatgtgtgtgtatatatacatgtatatgtatgtatatatgtgtgtatacatatatatg

SEQ ID NO: 76112 - DNA, 102 bp, Mus musculus
tggggtcgcccataaccaagatagagagacaagcaagtgagctcacaggcctgatgtcccgggcagaggagctttatcttactgtatctctaggcattcccg

SEQ ID NO: 76113 - DNA, 88 bp, Mus musculus
gtctggttgttctagtcagggtgccattccatacgtcccagatctgtgtctgtgtgtgttatgggacagcatatgttacatgccaggc

SEQ ID NO: 76114 - DNA, 69 bp, Mus musculus
agggatgtaagcatactactcacagtatttattttagttattactgtgtgtgtgtgtgtgtgtgtgtgt

SEQ ID NO: 76115 - DNA, 77 bp, Mus musculus
gccctgtggacagcaggacacagacagggactttaaacatgcctttcttgtctgcttcctggagtgtctcactgggc

SEQ ID NO: 76116 - DNA, 62 bp, Mus musculus
cagtggccaactttgtgttgtggacacaggaggtattctgagagaccacagacaggacactg

SEQ ID NO: 76117 - DNA, 96 bp, Mus musculus
gatcagccttagtccgtggtgatcagataggatgcatgggataatttcaatatttttgtatctgttgaggcctgttttgtgaccaactatatggtc

SEQ ID NO: 76118 - DNA, 116 bp, Mus musculus
taggaatatctgtagttccggattctcagtgtcgtgctatttatttatttatttatttatttatttatttattttactttcttggccaaatctgagagtggattgcagattaactg

SEQ ID NO: 76119 - DNA, 107 bp, Mus musculus
tctgtagttccggattctcagtgtcatgctagtgctatttatttatttatttatttatttatttatttattttactttcttggccaaatctgagagtggattgcaga

SEQ ID NO: 76120 - DNA, 115 bp, Mus musculus
gctctcctgttgctgctctaaccactcctgaggtcagggagcccaggaagatggaatgacagcctctctcacccacttgaggagttcttggagctgggttaaggattgaaatggc

SEQ ID NO: 76121 - DNA, 104 bp, Mus musculus
ctgtgcccatggcaaagagtagtccctccgtagcctggatttctttttctggagtttgagaagagagaggccacagtcacgcagtgcttttgtaaagggtatgg

SEQ ID NO: 76122 - DNA, 75 bp, Mus musculus
catctttagcactcagtgactgtcagacattctgggactctcagatgccccagtagaaaccaggctctggagatg

SEQ ID NO: 76123 - DNA, 66 bp, Mus musculus
tgtgtgtgtgtatttatgtatatatgtgtgtatatgtatgtatgtatgcatgtatatatgtatgta

SEQ ID NO: 76124 - DNA, 154 bp, Mus musculus
atatgtgtatatatgtgtatgtatatatgcatgtgtatgtgtatatatatatatgtgtgtgtatatatgtgtatacacacactgttatatatatgtgtgtgtgtatatatatgtatgtatgtatatatatatatatatatatatatatatacac

SEQ ID NO: 76125 - DNA, 60 bp, Mus musculus
gcatgctaaaagtgaactgtgagtgcacacgcgtgcgcacacagacacacacaagtacgc

SEQ ID NO: 76126 - DNA, 90 bp, Mus musculus
cactgatggtgttttgccgctgtgtatgtctctgtgagaatgtccgatcctctggaactggagttatagacagttgtgagatgccatgtg

SEQ ID NO: 76127 - DNA, 78 bp, Mus musculus
tagcattgctgtgatctgagtgtggtcacactggctcccaggagtccttgtgatagatacctggtcctcagagatcta

SEQ ID NO: 76128 - DNA, 89 bp, Mus musculus
tagactgagcacagcccccacctacctgcctttttgcctatcatcatgctatttagccagtgttcagatgtgtgtgtgtgaccagtcta

SEQ ID NO: 76129 - DNA, 69 bp, Mus musculus
gaggcagacaggtctctgacagttgtgggtcagccttggctacatactgagactctgtctcaaagtcct

SEQ ID NO: 76130 - DNA, 83 bp, Mus musculus
tgtctgtgtctgtgtgtctgtcctttctccatccctcactgcctcagtcagggtttcaggacaaagccacactgcatgtgaca

SEQ ID NO: 76131 - DNA, 74 bp, Mus musculus
atatatatatatatatatacacacacatatatatatatgtatgtatgtatgtatatgtatatgtatatgtatat

SEQ ID NO: 76132 - DNA, 137 bp, Mus musculus
atacatattatgtgtgtgtgtgtatgtatataagtatatacatacatatatatgtgtgtgtatatatatataagtatatatatgtgtgtgtgtgtgtgtattcccaaatataaacgtatatgtgtgtatattatgta

SEQ ID NO: 76133 - DNA, 91 bp, Mus musculus
aaggggcctagttttgttggtacacggtgatcccttagtagattcctgctttcctgtctgtgaatctctgtgtataggacatacactcctt

SEQ ID NO: 76134 - DNA, 75 bp, Mus musculus
caccagactgtgagtctgtgtcacattttcttgattcatgattgatgagggaaggcctggcaactgcatgtggtg

SEQ ID NO: 76135 - DNA, 84 bp, Mus musculus
gccagtttcccaggctcagtctgtgactccttcacaccactagaaacgggttacatataaatgaatgccttacatgaaacttgc

SEQ ID NO: 76136 - DNA, 81 bp, Mus musculus
ggtgactttcactgtggaacttgttttggaacatagagaagccccagttctgggtacaagtgaccctgaatgaaacacact

SEQ ID NO: 76137 - DNA, 100 bp, Mus musculus
agctagtcaacattctagaaagacaacagagtgaggacattggctatcctggtggctgatcctcttttgtcatttgctatttgtgttgctttgggctagc

SEQ ID NO: 76138 - DNA, 69 bp, Mus musculus
tggaagcttcatttggtgatgagagatgtccaactgggactctgtctccctcattatttgatgattcca

SEQ ID NO: 76139 - DNA, 64 bp, Mus musculus
gctagatggggcactgggtgaatcagctctgatgtctgcatcacactcattcagtctctcaagc

SEQ ID NO: 76140 - DNA, 74 bp, Mus musculus
gttacaagtgtgtgtgtgtatatatatgtatgtatatgtatacatatatacccatacacacacatatatgtgat

SEQ ID NO: 76141 - DNA, 83 bp, Mus musculus
tatgtatttgtatgtatgtatgtatatgtgtatatatacacacatatatacacatacacacacatatatacatacatacaaat

SEQ ID NO: 76142 - DNA, 85 bp, Mus musculus
gcttggctatgatgtgtttggatatatagctttgactgaaatgcttggctatgatgtgcttggatgtatagctttgagattaggc

SEQ ID NO: 76143 - DNA, 117 bp, Mus musculus
gcgtttctcatatttcaaatggaaatgcccatctatatctagtgtgtttcttgatgagattaatctgaagctatgtactgataaagttgaaagccattctgagaatggggatcatgt

SEQ ID NO: 76144 - DNA, 57 bp, Mus musculus
tcacccaggtaaacaggagggtagggggctgactcactttcagtctgcctgtggtga

SEQ ID NO: 76145 - DNA, 64 bp, Mus musculus
atgtgtgtatgtatgtatgtatgtatgtatgtatgtatgtatgaatatatgtatgtatgcacat

SEQ ID NO: 76146 - DNA, 105 bp, Mus musculus
ctgctgggattggaaatgactcagggtctctgacactcactcagaaacaacctggagaggatagctgggtgctaggctgtggtggcactgaggaaaccaaagcgg

SEQ ID NO: 76147 - DNA, 88 bp, Mus musculus
gagtttgcatatacatacatgtatatatccatatatgtatgtatgcacctatatatgtatgaatgtatttatgtgtatttgtatactc

SEQ ID NO: 76148 - DNA, 113 bp, Mus musculus
atggtttattcatgtatgcatgtttgtatatatatatatatatatgtatatatatgcatgtatgtatgtatgtattatgtatgcatgtatgtatgtatttcattttatcgtgc

SEQ ID NO: 76149 - DNA, 78 bp, Mus musculus
tctctctctctttccctgtctgtatgtgtgcatgcatgcttagatggtgtatgcacatgtacagaggccagaggagga

SEQ ID NO: 76150 - DNA, 112 bp, Mus musculus
aggggtccttgacctggcctgtattttttggaaaatgttagttagtaaataagtttattacttattttaatgtggaaaagtatctagtgtgctttgccttaaagactcccct

SEQ ID NO: 76151 - DNA, 97 bp, Mus musculus
gcatgcgtgggggtgtgactctacttcagaactcattttcaccgatgctgacacaaaagacagtcctcggagatctgtctgtcaaaacccaaagtgc

SEQ ID NO: 76152 - DNA, 77 bp, Mus musculus
tgtatatatatgtgtgtgtatatatgtatatatgtgtatatatatgcatatatatgtatatatgtgtatacacacac

SEQ ID NO: 76153 - DNA, 105 bp, Mus musculus
ggcctcttgatggtgttccatggaaaacagatactgtgtgaccatcctcccttcctgacgctctgtctgtcatatggttgtcaacactcacaggagaaagctgcc

SEQ ID NO: 76154 - DNA, 93 bp, Mus musculus
tctataaggttagttgggttcaggtcatcatttgcattgagacagcagactgaggtcatgctagatgaactggctctaaactgagcttctaga

SEQ ID NO: 76155 - DNA, 85 bp, Mus musculus
gtccatggtggtctgataggatgcatggaacaatttcaatatttttgtatctgttgaggcctgttttgagaccaattatatggtc

SEQ ID NO: 76156 - DNA, 94 bp, Mus musculus
gactttataactggggtattgatgtgacagagctgacagtggtttggggagacttgtggaaggactttggaactttgggttggttggaagagtt

SEQ ID NO: 76157 - DNA, 91 bp, Mus musculus
atacatatacaaacaaacatacatgaacacacacatgcatattgtgtgtgtatgtgtatgtatgtatgtatgtatgtatgtatgtatgtat

SEQ ID NO: 76158 - DNA, 117 bp, Mus musculus
tagagcaaatgtgtcactggggggccctttgtggtttcaaaaatccaagccagtctcagtatctctctcttcctgctgccagaggatccacatgtagctctctcggatacttctcta

SEQ ID NO: 76159 - DNA, 86 bp, Mus musculus
gcagtggacaatgtcctagtatgtgggtttcttagtatggctcatgtgagaataaagagagcagttaggggcagattgttagatgc

SEQ ID NO: 76160 - DNA, 99 bp, Mus musculus
gtgtagcaccaaggttactccatgatgccagtaaagtcagtcgtgaataatgtatttatatttgctttcggggataggaatggcggtggggttgtatgc

SEQ ID NO: 76161 - DNA, 69 bp, Mus musculus
actggttgtgtgcacatgtgcgtgtgtgcacgtgcacacacacacacacacacacacacacatttcagt

SEQ ID NO: 76162 - DNA, 105 bp, Mus musculus
cccgtatgtattttgcccgtacttgagagatgtaaaatttctacagctcatcataaaaacatagattttttttataactcctcaaatatatgcatgtgaaatggg

SEQ ID NO: 76163 - DNA, 72 bp, Mus musculus
tgccacccggggcctgtagtgtacagcaactgtggtgcatatcacactcacagtgactcagaatctggagca

SEQ ID NO: 76164 - DNA, 61 bp, Mus musculus
catatgtatatacagtttatgtatatatacatattatatgtatgtaatgtatgtatgtatg

SEQ ID NO: 76165 - DNA, 81 bp, Mus musculus
gggtatttggctggagctagaaggaggcatgtaatctctgaaaagcctctctctaattctctgtgtctaccagcccagaac

SEQ ID NO: 76166 - DNA, 73 bp, Mus musculus
gcatatgtgtgtgtgtgtgcatgtgtgaatatatttgtgtatatatgtgtgtacactttgtatatgtatgcat

SEQ ID NO: 76167 - DNA, 117 bp, Mus musculus
cagtaggcatgggtatagagctattcactggaacaattcatcagcagctagatcactgtagatagtgactcattcagtcatcagctatggaattgagtccctccctactcacaactg

SEQ ID NO: 76168 - DNA, 79 bp, Mus musculus
tatgtgcatgtacatgtgcaagtgcgcatgcgtgtacatgaatgtggtgtgtgtgtatctgtgtgtgtgtgtgtgtgtg

SEQ ID NO: 76169 - DNA, 79 bp, Mus musculus
ttaacgtgtgtgtgtgtgtgtgtgtgcacatgcctgtgcacatgtgcgtgtaagacagacagacagacagataggttaa

SEQ ID NO: 76170 - DNA, 81 bp, Mus musculus
gtgagttgtgattttcttgttaccatgctgtaaattttcagtatttttttctattctggtaagaaattgcacaactaatgc

SEQ ID NO: 76171 - DNA, 85 bp, Mus musculus; identical to SEQ ID NO: 57439

SEQ ID NO: 76172 - DNA, 67 bp, Mus musculus
cctcttttgatgcatgtatgtgtgtgttcatgttcatgtgtgtgcatgtgcatgtggagagcagagg

SEQ ID NO: 76173 - DNA, 69 bp, Mus musculus
ttgtaacagagtctctcactgaaactggagctaggccagtggcaagatcgagagaacttcctgtcccaa

SEQ ID NO: 76174 - DNA, 79 bp, Mus musculus
gtggcctggagagatgactcagtggttaagagcactggctgctcttccagaggtcctgagttcaattcccagcaaccac

SEQ ID NO: 76175 - DNA, 74 bp, Mus musculus
gctcatctattaagtcgagatggggctacctattaaatttcctgtgtcagcctcagtctcactatatgctgagc

SEQ ID NO: 76176 - DNA, 64 bp, Mus musculus
aggcacaacctcagcggaatgtgttctccttctcagaatacagactggacttgcatgtgtgcct

SEQ ID NO: 76177 - DNA, 59 bp, Mus musculus
tgtatgtgtgcatgtgcatgtgtgttcaagtgtgtgtacttgcacgtgtactatgtaca

SEQ ID NO: 76178 - DNA, 89 bp, Mus musculus
ctgtatccagtcagtctagagagacattctggatcatataaacgataccatatctctgaaacagatgttgcattctaggatggaagcag

SEQ ID NO: 76179 - DNA, 115 bp, Mus musculus
tctaaaggaatgggctgctcagttctaccatttacagaaggttttactgttagcatttaatgatttttattaaacaagcagaggaagcttctaaggtagtaagtttccatgtagg

SEQ ID NO: 76180 - DNA, 75 bp, Mus musculus
gggctggagagatggctcagtggttaagagcactgactgctcttccaaaggtactgagttcaattcccagaaatc

SEQ ID NO: 76181 - DNA, 77 bp, Mus musculus
gacagctgtcagatatgagcctccagcatagggagttgagtcagtgtgtctctgggttaaagatcgcagagctagtc

SEQ ID NO: 76182 - DNA, 81 bp, Mus musculus
actgttttgatggaggtgtgaggtgaaatggtatctgccaaatatttttatatgatttcatgttacacctaaaagaatagt

SEQ ID NO: 76183 - DNA, 104 bp, Mus musculus
gataaagcaagagagtcggggatgcaagtgcagagacgagacagaggacaccgtagtgggaactgcttgttctttaccttagtgtgccctctcctagttctaac

SEQ ID NO: 76184 - DNA, 88 bp, Mus musculus
gtgtgcatatgtgtgtgcaaagtgtatatatgtgcattatgcatgtgtgtatgtgcatgtgtatatgtgtgtacatgcatgtgcatat

SEQ ID NO: 76185 - DNA, 81 bp, Mus musculus
tcagggacttaaggagcccactgcaggaagacagctaggttttattgttgctctgtcagcctgagtgagtttggtggttga

SEQ ID NO: 76186 - DNA, 112 bp, Mus musculus
gactgaaaacattattaactgagtttgtaaatgaatccttcaggtacttatcttaactctctgtgtctctttgttcactgcaaattatcagcctaggataatttattcggtt

SEQ ID NO: 76187 - DNA, 103 bp, Mus musculus
atcctttctgaaccttgatctgtttgtctgtctgcctgcatgcctgcctgcctagcaggaacgaggtgagttaccgtggcatagaaacatgatctcagatgat

SEQ ID NO: 76188 - DNA, 68 bp, Mus musculus
ctatggtgttgtctgtggttttcagagttggcaaaaagctgtggaatgattagaagaaagagccgtgg

SEQ ID NO: 76189 - DNA, 62 bp, Mus musculus
gtggtatgtatgtatacatgcatatatttatgtatttatgtatgtacatatgtatgtatcat

SEQ ID NO: 76190 - DNA, 85 bp, Mus musculus; identical to SEQ ID NO: 57439

SEQ ID NO: 76191 - DNA, 124 bp, Mus musculus
gattataattggtgccagtttacacaaagagcgagatggagatgcagtcatttcaaagacttctgatttaggtcttgcctgtctgcaatgttactctagagtgttggttttaacctagtccagt

SEQ ID NO: 76192 - DNA, 65 bp, Mus musculus
caagcatgtatgtatgtattatgtatgtatgtatgtatgtatgtatgtatgaatgtgcatgtatg

SEQ ID NO: 76193 - DNA, 81 bp, Mus musculus
gagtgtgtgtgtgcatgtgcttgtgcacatgcgtgcctgtgttcatgtgtgtgtgtgtgtgtgtgcacatcaataatactt

SEQ ID NO: 76194 - DNA, 110 bp, Mus musculus
ctggactgggttagctcatattgtacatatatatatgtgtgtatatatatatatatgtaatatatatatacatatatatatatacatctatatgcagatgcattgtttag

SEQ ID NO: 76195 - DNA, 83 bp, Mus musculus
ttgtgtatgtttctgtgtgtgtacttttgtgtgtgtatatatgtatgtatgtatgtacatatgtataagagaaagatgtgtga

SEQ ID NO: 76196 - DNA, 81 bp, Mus musculus
tctatgatgagaacttcaagtctctgaagaaagaaatcgaagcagatctcagaagattgaaagctctcccatgctcatgga

SEQ ID NO: 76197 - DNA, 81 bp, Mus musculus
gatctatctgtctgtctctgtaccagtacagtttttaccacaattgttctgtagtacagcttgaggtcaggcatggtgatt

SEQ ID NO: 76198 - DNA, 76 bp, Mus musculus
gagagtgtagccttccaatgttgtgcatttatgtgttcatataaatgtatatgtagttgtgaaaggtgcaaacatc

SEQ ID NO: 76199 - DNA, 69 bp, Mus musculus
ggggctagaaagatgactcagtggttaagagcactggctgctcttccagaggtcctgagttcaattccc

SEQ ID NO: 76200 - DNA, 112 bp, Mus musculus
gtatatcatatatatgtatgtatgtatgtatatgtgtgtatgtatatatatatatgagtatacacacacacacacacacacacatatatatatatatatatatatttaccca

SEQ ID NO: 76201 - DNA, 104 bp, Mus musculus
agttgtacctctatagcagcctggggctgacatctggagactggatttctctctgtgatattcactgagtctctaatttgaggccagaggttgaggatacagct

SEQ ID NO: 76202 - DNA, 76 bp, Mus musculus
tgatgtgtatatataagtatgtgtgttcatatatgtatgtgcatatatgtatatgtatatatatatatatatatga

SEQ ID NO: 76203 - DNA, 64 bp, Mus musculus
ctgtatgtatgtatgtatatatgtatgtatgcatgtaggtattggcatgtgtatgtgaatgcag

SEQ ID NO: 76204 - DNA, 114 bp, Mus musculus
tatgtgacaaggaaatcagaagagttgggataacttttatattttcacctttcaggtacgaggttgtatagagcaaatgtaaaccatagatctccctggctgttcctttacata

SEQ ID NO: 76205 - DNA, 96 bp, Mus musculus
ccaaaactcaccgaacaacttgttctgcgcattgactttcccgaaatgtatgacagagaaaacagtgaggagaattttagaggtgggctcttttgg

SEQ ID NO: 76206 - DNA, 71 bp, Mus musculus
ctgagcctgtcactataatgtctgcctcctggtataatattggcagacaaatgagttggcattttcctcag

SEQ ID NO: 76207 - DNA, 85 bp, Mus musculus; identical to SEQ ID NO: 57439

SEQ ID NO: 76208 - DNA, 85 bp, Mus musculus
ctgatacagttgggaggttgtagactctttggaaagtgggtcttagtataagaccctggccactgtctgtctctctgcttgtcag

SEQ ID NO: 76209 - DNA, 69 bp, Mus musculus
tacacacacacacacagacatatacactggcacatgcacgtacatgtgcaagtttgtggtgtgtgtgtg

SEQ ID NO: 76210 - DNA, 68 bp, Mus musculus
gcagagaccagaggcttgggatctcctacagttggatttgtagatagttgtaagccaccagtcggagc

SEQ ID NO: 76211 - DNA, 68 bp, Mus musculus
cagagagagacagaacgagacagagagggacagagagtcacactcacagtgtgttaatctcatttctg

SEQ ID NO: 76212 - DNA, 85 bp, Mus musculus; identical to SEQ ID NO: 57470

SEQ ID NO: 76213 - DNA, 74 bp, Mus musculus
gtgtgtgtgtctgtgtgtacatgtgtgcatgcatgcttatgtgcatttgtacatgtgacacatagactatctgc

SEQ ID NO: 76214 - DNA, 58 bp, Mus musculus
tctatctatctatctatctagtgcacgtgcgtgtgcgagagagagagagagagagaga

SEQ ID NO: 76215 - DNA, 80 bp, Mus musculus
gtgtgtgtgtgtgtgtgtgtgtgtgtgccaagtgctgctaagagcacaagcttgagccaccactatcagaatgactatgc

SEQ ID NO: 76216 - DNA, 93 bp, Mus musculus
acagagaaaaaaaatatgatgaataatatatattatatattagatataatttacataatgttgtattgtttattatatattattttattttgt

SEQ ID NO: 76217 - DNA, 109 bp, Mus musculus
gtctgtctgagtgcctagagattcagatgtgagtctgcctcatactctctctcctaaatgaaacatccttatttctagatctaaggtaattttattaatttttatagat

SEQ ID NO: 76218 - DNA, 115 bp, Mus musculus
ggaaagaatcttccctcaagagaagggccaataggcttcagaggtataaccttaggttactatctttgtattttagatttgtctaggtaggctatgagaggtgagtatgctgtct

SEQ ID NO: 76219 - DNA, 80 bp, Mus musculus
atatatatatatatacatacatgtatatatatgtatatatacacatacatgtatatatatgtgtgtatatgtatatatat

SEQ ID NO: 76220 - DNA, 75 bp, Mus musculus
caggaggagagagaagtcacagacatgaattagcttcttttcatgcatgtaaagatgcctgtctgtcctttcctg

SEQ ID NO: 76221 - DNA, 95 bp, Mus musculus
aatagttccttcatttgtgctccattcacatcttggcttccctgacactctctgtcagtgatgaagacaggatgtgtcacactgtaatgactgtt

SEQ ID NO: 76222 - DNA, 85 bp, Mus musculus; identical to SEQ ID NO: 62497

SEQ ID NO: 76223 - DNA, 115 bp, Mus musculus
ggacatgcgatgtttggaaagagtgtaagtataatccaaaacatagtggctgacactctcacactggtttgccttgtaacccttgcaacactttggaggtcattgccaatgattc

SEQ ID NO: 76224 - DNA, 106 bp, Mus musculus
tcaacttcaccttgtctttccttgattccgttcatcttgtttttctcagacagagcctctcactgacctggaactagccaaggaagccaagctgcgtgaacagtga

SEQ ID NO: 76225 - DNA, 175 bp, Mus musculus
gtgtgcatatatatgtgtgtatgtatgtatatgtgtgtatgtgtgtgtatctgtgtgtcatatatatacacacacacacacatatatatatacacacatatatatgtatatatatatatatatatatatacatatacatatatatgtagtgtttgtgtgtgtgtattctcactga

SEQ ID NO: 76226 - DNA, 71 bp, Mus musculus
atatatgtatatgtgtatatgtatatgaatatatgtatgtgtatatgtatatatgtatacatgtgtatatg

SEQ ID NO: 76227 - DNA, 139 bp, Mus musculus
atagatagatagagatgtagatatagatatgtatgtatatatgcatagatatttatagatatatgtatatatacttgatatatgtatgcatatatgtgtggatatgtatgtatatatgtatagatatatgtatatatac

SEQ ID NO: 76228 - DNA, 85 bp, Mus musculus; identical to SEQ ID NO: 57470

SEQ ID NO: 76229 - DNA, 97 bp, Mus musculus
ccctaattaccacataacctctctgtcacactatgtcagtctctggtaacttgaacattctaatggctgtacgatggtgtcagggatggtgtcaggg

SEQ ID NO: 76230 - DNA, 80 bp, Mus musculus
agtgggttcaggtgtgcattcacgtgttagcaaaagtgtgtgcgtgtgtgtgcatgtgcatgtgcgtgtgtgttcaggct

SEQ ID NO: 76231 - DNA, 70 bp, Mus musculus
ctcgagcgcactgagagtctcctatgcactgggcaccaggccctgtcagtctctcagatagcagcttggg

SEQ ID NO: 76232 - DNA, 133 bp, Mus musculus
ggacccatctgcctggctttacacataactgacatcagagctggtgtccagaaggtcacctagttgcttgtttggttccagtaaggctctgaacggaaggtccctaacccagagcaaggatacaggccaagca

SEQ ID NO: 76233 - DNA, 85 bp, Mus musculus; identical to SEQ ID NO: 57470

SEQ ID NO: 76234 - DNA, 121 bp, Mus musculus
tatgtatgtgtgtgtgtatatatgagtatatgtgtatatgtgtatatatacatatatatacacatacacacacacacgtatatgtgtatatatatatatatatatatatatatatatattc

SEQ ID NO: 76235 - DNA, 116 bp, Mus musculus
atatatatatatatatatatatacacatatacgtgtgtgtgtgtatgtgtatatatatgtatatatacacatatacacatatactcatatatacacacacacatacatacatatat

SEQ ID NO: 76236 - DNA, 89 bp, Mus musculus
ggtagggcggatgccatgcttacttccggctgtcggtctgtgtgtctggcctgtaagggtggaaggcagtgaggtgtctgtcgtctgct

SEQ ID NO: 76237 - DNA, 118 bp, Mus musculus
cagtcttaccatcagtgccgggctcgaagcttgaggcgcagagttagtaggtagctttctttacctcttgtccttgtcaaccctcaggaactttgatcatagcacagacagtagcatg

SEQ ID NO: 76238 - DNA, 104 bp, Mus musculus
agggaagaagagccagaagggaaaaggtgaggtcagagcatgcctgacaagacagagagctctgatgctaagtcttgtctctagcctgtgactttgggctggcc

SEQ ID NO: 76239 - DNA, 64 bp, Mus musculus
gagttagaaactgagaatttacttccgatccttcctttgcagtgactctcagaccctctgactc

SEQ ID NO: 76240 - DNA, 69 bp, Mus musculus
gtgcctgactgttgagtgagtgcttagggcccaagcgagctcaggctctcaagttcacacagcaagcac

SEQ ID NO: 76241 - DNA, 84 bp, Mus musculus
gcaccttaagtctgagtgctccagtcttccttgtgcatgacagttgctctgagttaagtctgagtgctcccatcttccttgtgc

SEQ ID NO: 76242 - DNA, 103 bp, Mus musculus
agtctggccccaagtgtcctactgtcccagtctggccccaagtgtcccactgtcactgcctcttagtgctgggattataagtgcatctcactgtgcctggatt

SEQ ID NO: 76243 - DNA, 89 bp, Mus musculus
tatgttttacattttgtgtatatatgtatggatgtgtgtgtatatatacacacacacattttacgtatgtatgtatgtatgtatgcatg

SEQ ID NO: 76244 - DNA, 67 bp, Mus musculus
tgtgtctgtctgtctgtccacattaagtgtcacagcacttaatgtacacaggaggtgaaaggacaca

SEQ ID NO: 76245 - DNA, 81 bp, Mus musculus
ggcagtgccactgactgtgtcccagaatggcactgggctcatctcaggctgaattctgacagggtaaacagaaggattgct

SEQ ID NO: 76246 - DNA, 76 bp, Mus musculus
gcattgcctgtattctgaggggctgcacggagtgctcccagcctatctgacaccctctttgacacttagggcgtgt

SEQ ID NO: 76247 - DNA, 87 bp, Mus musculus
tgtctgtctgtctgtatttgtgtgattccgtgtatctatgtgtgtgtctgtctgtgtgctgaaatcatagaagtagagtagttggca

SEQ ID NO: 76248 - DNA, 103 bp, Mus musculus
gacacaatactgtcagctggcatccttgaaagcgggctcagtctgttcttttttttttttttgagacactgcctgccaaagacctgctctgaagtctgtcagt

SEQ ID NO: 76249 - DNA, 97 bp, Mus musculus
gacctgctgctttgagtcactgggctgggtcagtgcggctgcactgaggcagcaacaagaagagagatagcacagtgactgggtgaggagtggggtc

SEQ ID NO: 76250 - DNA, 73 bp, Mus musculus
gtatgtatgtatgtatgtatgtatgtatgtatgtatctgtggcatatgtgtgtgcatatgtgtgcgtgcgtgc

SEQ ID NO: 76251 - DNA, 105 bp, Mus musculus
acagccaagtctgcaattcagagcagcttacaaatgttctcctcagaaagacacgacacaggcagcattgaaggaaagcatctaagaagcagacagagtggtagt

SEQ ID NO: 76252 - DNA, 114 bp, Mus musculus
gggtgctgttttgtcttttgccatacagaagattttcagttttgtgagatcctatttattaattattgatcctagtgcctgagctgttggtgttctgttcagaaagttgtctcc

SEQ ID NO: 76253 - DNA, 63 bp, Mus musculus
tgtgtatgtgcatgtatatatgtatattatgtgtgtgtgtgtctgtatatctgtatatgtgca

SEQ ID NO: 76254 - DNA, 95 bp, Mus musculus
cttactactcctgtgcactagtcacttacctcaatgctggatgacaccactgtagtagctattgtgagaagtgagtcagctgaagctgtggtgag

SEQ ID NO: 76255 - DNA, 92 bp, Mus musculus
tgctctttgcctttcttcagctacacattttcactttctactgttcgtgtgtgtagagtgtgagcatgtgtgtgtgtggggggggggaggca

SEQ ID NO: 76256 - DNA, 109 bp, Mus musculus
acacacacatatatacatataaatgtatatatacatgtatatatacgtgtatatatgtatgtgtatatatatatgtatatatatatatatatatatatatatatatata

SEQ ID NO: 76257 - DNA, 77 bp, Mus musculus
catacatatatacacgtatatatacatgtatatatacatttatatgtatatatgtgtgtgtctgtgtctgtatgtat

SEQ ID NO: 76258 - DNA, 95 bp, Mus musculus
tgggctcataaatatcaagttagcctatctttgagtgtcaggtaagaatgtttgattttaaaaattgcagtggaagttgctaatttggaagtcca

SEQ ID NO: 76259 - DNA, 78 bp, Mus musculus
gggattctggtgaaagcatgcctgactcttttggtgagaccaagtcagtggtggtcagttctgtttttgtcagttccc

SEQ ID NO: 76260 - DNA, 85 bp, Mus musculus; identical to SEQ ID NO: 63165

SEQ ID NO: 76261 - DNA, 117 bp, Mus musculus
attcagagagggccgtcttccctcagttaagcctccctggaaactctctcactggcacactagaggtgtgtctaggtgattccaaattgatgctgaagatgaaccttttccaggagt

SEQ ID NO: 76262 - DNA, 102 bp, Mus musculus
ggttatagagatgacagtttgttgttgtttttgttttgtttttttgctttttaatttaaggagctgaaaatgccagggcagctcactccctctctcagtgcc

SEQ ID NO: 76263 - DNA, 116 bp, Mus musculus
cagcttaagcttgaacctgtatgggaaactctacaccaagtatcagtgcatgtggaaatgcatgtgtgctttaaggtgcttgttgtgtgggtgcataaaggtgcctgtagaggccg

SEQ ID NO: 76264 - DNA, 86 bp, Mus musculus
gcttgccgctttggctgggctggctggctatcatgctctggggatctgtctgtctgtcactgccctccaatactggggctttaagc

SEQ ID NO: 76265 - DNA, 75 bp, Mus musculus
cccctgtacttgctctcagtggaatccttcccattctgggacccggcttctttcttccagagcaatgtgcaaagg

SEQ ID NO: 76266 - DNA, 109 bp, Mus musculus
ctgtttcttccttttttcccatgtgaacacagtgagttaatgttgagtctttgtttttcattattactcatctctttgtctttttagttggcctgctgaggatgggcgg

SEQ ID NO: 76267 - DNA, 118 bp, Mus musculus
gccttcaggacttggaggttataagaaggaaaggggtacttgcagcatatcatatctgtttttgggctttatctttaactctcaaaagccttgcatctcctagaggccaaccaccaag

SEQ ID NO: 76268 - DNA, 74 bp, Mus musculus
tgtctgcgggaacgcgcacacacatgcatgtttctatgtatgggtgcatgtgtgtgtggttgtggtaaaaggca

SEQ ID NO: 76269 - DNA, 111 bp, Mus musculus
ctagacctctctatgttcaatgagctgtgaggatggcattctcagcaaccgaccccattgtcagtttagagagagcacttctttgacctagcatcatcctgggctgtttag

SEQ ID NO: 76270 - DNA, 69 bp, Mus musculus
gttgtgtctcagaccctctcattctgcaaaacaacttttttgtatggcaggacagaggttgtaaacaac

SEQ ID NO: 76271 - DNA, 88 bp, Mus musculus
ttgtcttcttgccatggtttgtgtcctcccagccaagaacctttgtggcaggaggcttgattcccatggtgaccctattaggagatgg

SEQ ID NO: 76272 - DNA, 79 bp, Mus musculus
ttgactttaggtttggcttcttatttgttttagtcacaggcagccttcgcaggacagaggagtgagagctgagggtcga

SEQ ID NO: 76273 - DNA, 111 bp, Mus musculus
tgtttctgctatgtatatatgtatacatatttatgtgtatgtatatgtataaatacatacataggaacatatatatatgcatatatatattcatttatatgtatatatatg

SEQ ID NO: 76274 - DNA, 85 bp, Mus musculus; identical to SEQ ID NO: 57439

SEQ ID NO: 76275 - DNA, 57 bp, Mus musculus
taacctgcttctcataggacatgttagtgcaatgttctgtgctttgaagaaaggtta

SEQ ID NO: 76276 - DNA, 63 bp, Mus musculus
tctatcaaagtctgtttcatatctatgtttattttaaacatagatatgttattgaattgtgga

SEQ ID NO: 76277 - DNA, 86 bp, Mus musculus
tatgcattctagtgtcttttcattgcttatcttcctgataaaacaagaaggaggggggggggaggaaggaaggaaagaaggaagta

SEQ ID NO: 76278 - DNA, 124 bp, Mus musculus
gagggacagaaagattggaagagccagagtatcagatgtctgctgtgaggtaggatgttctatacttgggaagctgcatgcccctgcccccaaaatctcaacatgattgcctaaacaagacctg

SEQ ID NO: 76279 - DNA, 75 bp, Mus musculus
tgtcagtctctctttgtgttacactccactgctgcatttctaatggagggtaactctactcagagttgactggca

SEQ ID NO: 76280 - DNA, 124 bp, Mus musculus
gggaaatgtagtcttacagttggggacctaaattgcagagtgagttagcagtctttgccacaagagagtgtgctcacactttatttcgtatgcagctttatttttttgatatttttctgtaagc

SEQ ID NO: 76281 - DNA, 107 bp, Mus musculus
cacacctgtctgtctgtctatctattgatctatctgtctgtctgtctatctatgataatcatatcagggaggctataaatctgagagaggggacacaaaaagggctg

SEQ ID NO: 76282 - DNA, 98 bp, Mus musculus
tgaggaagaaataatgcctcagtaggcactagttacagagcacaaaccctgtcaggcaatgagctaagtgattttcttacattcattacgctgcctca

SEQ ID NO: 76283 - DNA, 103 bp, Mus musculus
ggcccagcagaacaagcctacagttacctctagtgaaactgttcttttcagtcaccccacagacagtcactgagcacatgctggcagaatctggaccctggcc

SEQ ID NO: 76284 - DNA, 119 bp, Mus musculus
tgagaactgtctgaggataacatgaaaaggtcactgctgtcttgcttcatgatttctgtttatatatttgtcgcttaagatacagcactgacttcttgtttaaggacttggctgagttc

SEQ ID NO: 76285 - DNA, 62 bp, Mus musculus
ttgcactgtgactgtcactgagactttctgggatggagaactgtgatgaggagcaggtgcaa

SEQ ID NO: 76286 - DNA, 92 bp, Mus musculus
tcttacataattacaggttcagttactctccctgacactgtggtccaacaggtgatgtcaaagtaagagttggaaaggtatatttagtaagg

SEQ ID NO: 76287 - DNA, 78 bp, Mus musculus
ggaaagatgaggggctggagagattgctcagtggttaagagcactgactgctcttccagaggtcctgagttcaattcc

SEQ ID NO: 76288 - DNA, 92 bp, Mus musculus
acaaagacacacaaacgtgtatatatgtatatatatgcacatgtatatatatgtgtgtatatatgcatgtacatatatttgtgtatatttgt

SEQ ID NO: 76289 - DNA, 97 bp, Mus musculus
acctaagtatctaactgagcacagagaagacagtctggagcctaactaaagccttcactctcactaactggtatttatggtacaggaggtactcggt

SEQ ID NO: 76290 - DNA, 94 bp, Mus musculus
cttccaggccaattttattgctttatatttactggtttgtctgttcatttttgagacagtgtcactgtgtatgtagtccaggctggcctgcaag

SEQ ID NO: 76291 - DNA, 77 bp, Mus musculus
ggtcaaaagtacgtgtgcctgaggttgggagagcctccctgcaggcttctttccctgcaagcattttatcactgtct

SEQ ID NO: 76292 - DNA, 70 bp, Mus musculus
gagggcatcagaagagcagccaaagcttttaaccactgagctgtctgtctgtccgtctgttgatgttctt

SEQ ID NO: 76293 - DNA, 94 bp, Mus musculus
gcctaattcaggctggagagatggctcagcggttaagagcactgactgctctttcgaagatcctgagttcaaatcccagcgaccacatgatggc

SEQ ID NO: 76294 - DNA, 85 bp, Mus musculus; identical to SEQ ID NO: 57470

SEQ ID NO: 76295 - DNA, 122 bp, Mus musculus
tttccacctgtagaataaggtctccaagcacaagctttcagctcccttatctctgagtggagactgaggtctccaaagggacggggctctccctcctcccttccagcctcccctagtcccat

SEQ ID NO: 76296 - DNA, 86 bp, Mus musculus
gagagaagacaactagtctgcaatgctgcaggtccagggcagagggccaatggggactgtttggattgtaaggaagtcagactctc

SEQ ID NO: 76297 - DNA, 74 bp, Mus musculus
gtgaatgtgtgcctgtgtgtgtgtctgtgccttggcatgtgtgtggaggtcactgggcaactcaggcaagtcac

SEQ ID NO: 76298 - DNA, 85 bp, Mus musculus; identical to SEQ ID NO: 57439

SEQ ID NO: 76299 - DNA, 85 bp, Mus musculus; identical to SEQ ID NO: 57470

SEQ ID NO: 76300 - DNA, 85 bp, Mus musculus; identical to SEQ ID NO: 57439

SEQ ID NO: 76301 - DNA, 112 bp, Mus musculus
gatcagtcttaggccatggtggtctgataggatacatgggacaatttcaatatttttgtatctgttgaggcctgttttgtgaccaactatatggtcaattttggagaaggtc

SEQ ID NO: 76302 - DNA, 119 bp, Mus musculus
ctttgttgctttctatctctctctatgtctctctttcacacacacacacacacacacacacacacacacacacacacacacagagagagagagagagagagagaggtagaggtagagag

SEQ ID NO: 76303 - DNA, 68 bp, Mus musculus
agggtaattcaggggttcaaagctctgtctctcctctgggcttcacagctctgtctctgtctgaccct

SEQ ID NO: 76304 - DNA, 68 bp, Mus musculus
agatgtgaagactggtaagcaaagctgcagctgggaagctgtctagctgtctatcattctctctctct

SEQ ID NO: 76305 - DNA, 60 bp, Mus musculus
gtttgttgagacagagtttctctatgtagccctggctgtcctagaactcactctgcagac

SEQ ID NO: 76306 - DNA, 85 bp, Mus musculus
ttgtgtctctccatgtctctgaatctctctctctcacacacacacacacagagagagagagagaaagagagagagagagagagag

SEQ ID NO: 76307 - DNA, 68 bp, Mus musculus
gtctgtcaccctgtctgtttctttctgtctgtcatttcagtagatagataaatagatagatgatagat

SEQ ID NO: 76308 - DNA, 80 bp, Mus musculus
gaccaggctcattcactgtcacagccactttctcactgtcccagcacaggtgagtgactgagacacagttaggtcttgtc

SEQ ID NO: 76309 - DNA, 85 bp, Mus musculus; identical to SEQ ID NO: 57439

SEQ ID NO: 76310 - DNA, 78 bp, Mus musculus
agactggtgtgatattacactcagattcaagaagcttatgctctctcgtgtcttgtctgtttgtcactcaccgactct

SEQ ID NO: 76311 - DNA, 85 bp, Mus musculus; identical to SEQ ID NO: 57439

SEQ ID NO: 76312 - DNA, 72 bp, Mus musculus
atacacacacacacacaaacacgcgcgcgcgcgcgcgtgcgcgcatgtgtgtgtctgtctgtctgtctgtgt

SEQ ID NO: 76313 - DNA, 85 bp, Mus musculus
tacttattcagactttctatttctgtgtcatgacagagtagaatattatttctgctttgaaatagaaataaatgttcaaaaagta

SEQ ID NO: 76314 - DNA, 82 bp, Mus musculus
gtgtatgtgcatatgcatgtggtgtgtgagtatgtgtctgtatgattggtgtttgtgtgtgtgtgtgtgtgtgtgtgtgtgt

SEQ ID NO: 76315 - DNA, 100 bp, Mus musculus
ggggattaactttaagtttgggctagagagcacagctgcagtcttctttcctcccagagtcactgtgtgagttctctttgagcctctggctttcttcttc

SEQ ID NO: 76316 - DNA, 103 bp, Mus musculus
tttattttaaaatgattgttatgtttaattctgtgtctatatatatgtttgagtaacatgtacatgaagaccagaggaagacaactaacccattgggaatgga

SEQ ID NO: 76317 - DNA, 108 bp, Mus musculus
acccaagagtcaggaaagttgctaataatgaatgagttcaccagagatatcaatatttgtatttgtgtggtgaactccatgatgatgttttctgagcctcgtgatggt

SEQ ID NO: 76318 - DNA, 96 bp, Mus musculus
aaagttcatgttcaagtgtgggagtcttaatttttattgaataattcaattaaatctcactaaaaggaggagacatttacatttgatattaacttt

SEQ ID NO: 76319 - DNA, 97 bp, Mus musculus
tatatgctgaattaaatttatgacaagatattggttatctgtatatatttgtatgtgtaggtaggtatgtgtatttgtatgtgtatgacagtgtgtg

SEQ ID NO: 76320 - DNA, 81 bp, Mus musculus
gtttctgacactctggctctcttacctgtgtcaaaaagaccacgagacaagggaaggagagtttaagttgttctgaggaac

SEQ ID NO: 76321 - DNA, 84 bp, Mus musculus
gatctaactggctatctttttgtagaagaattaaaatagacccattatttgtcaccttgtacaaagagcaagtccaagtggatc

SEQ ID NO: 76322 - DNA, 80 bp, Mus musculus
aatatattgagtcagtattgattggggcccagtaataaattgttactgtgttttagataatatttgatttaatttttatt

SEQ ID NO: 76323 - DNA, 68 bp, Mus musculus
tgtatatgtatatatgtatgtatatgtatacacacaaatatacacatacacatacatatgcatacaca

SEQ ID NO: 76324 - DNA, 102 bp, Mus musculus
tatacatatatatgtatatatgtgtgtgtatgtatggacatatgtatgtatatgcacatgtacatgtatatatgtatatatccatctcaatataaatatatg

SEQ ID NO: 76325 - DNA, 89 bp, Mus musculus
gggtcagaaaccaagagattttgttgatgtacttgcttttcctgagctcgtttacattcaagaatagtctcatggcatatctgcttccc

SEQ ID NO: 76326 - DNA, 108 bp, Mus musculus
ttcttgagctatgtggattatgagagaaacacaattccctaccaggaggaagtcaagggaatatgttgttctctttacatgcaaatatcttaattacagctcataggg

SEQ ID NO: 76327 - DNA, 74 bp, Mus musculus
gtggtgtgtcactgtcactgtgatgtcaagatcacaaggtcaggatcttcatagaagacaaagttccacagtac

SEQ ID NO: 76328 - DNA, 92 bp, Mus musculus
tttaggtgatggagttagtagaaagcatatgaactaaagttggcatttgacaagtgtgcttctgtctctctctgtaagatctgcatcctaaa

SEQ ID NO: 76329 - DNA, 63 bp, Mus musculus
agaaaatggcctgaggttgctcagggtcaccaccagtctgcctcagtctgcctcagtctgcca

SEQ ID NO: 76330 - DNA, 90 bp, Mus musculus
cttgctaaggaatggagtggaactgagattaatgatgaccccaaaacagccaagggactaaactcattttctaaatctgtccttaacaag

SEQ ID NO: 76331 - DNA, 114 bp, Mus musculus
aggacagctgccggtgtgtaagaggtactgtttggatagagtggttctgggcaactctgcctcacacagtctcttgtttctctctactgtgccatgatcttggataagctgctt

SEQ ID NO: 76332 - DNA, 108 bp, Mus musculus
cataaatgtatttcatgttcagacttgagtctcagccccaggatatatcattatatatatgcaaatattctcatggctgaaagctgtctgagactcaaagcacttgtg

SEQ ID NO: 76333 - DNA, 116 bp, Mus musculus
gtcacccagatctgctggtgacccagagtgatagctaagccagagtcaactgtcactctctgagccagactctggtctggcctctgctttggaaagcataagtccttgttggtggc

SEQ ID NO: 76334 - DNA, 58 bp, Mus musculus
gtgcacacatgcacctgtgcacatgcctatgtatgtatgtatgtatgtatgtatgtat

SEQ ID NO: 76335 - DNA, 87 bp, Mus musculus
gtttgaaatatacatctatttttctcctcgactaattgagattctctctgcctgtcactgtgaggaaagggtgtgaacgtttggaac

SEQ ID NO: 76336 - DNA, 108 bp, Mus musculus
ttgaaagcaaccagtgggggctggagagatggctcagcggttaagagcactgactgctcttccaaaggttctgagttcaaatctcagcaaccacatggtggcttacaa

SEQ ID NO: 76337 - DNA, 85 bp, Mus musculus
cccataaatgacatgagtttgttctttgtggctaggtagcactccattgtgtatacatactacactctctgtgttcatctgtggg

SEQ ID NO: 76338 - DNA, 97 bp, Mus musculus
tgtggatgccaacaagtgcttgctgacaggagcctgatatagctgtctcctgagaggctctgtcagtgcctgacaattgcagaaatggatgctcaca

SEQ ID NO: 76339 - DNA, 94 bp, Mus musculus
gtgatgggtgtggcccttgaggcttctctctgttctctttgcctgctgctctcagaccaagagtgaagagtgagcgctcacacagcaccatcat

SEQ ID NO: 76340 - DNA, 112 bp, Mus musculus
cctatatgtgcatctatgtatttctgtgtatgagtctgtgtatgtgtgtgtatgagtgtctctgtgtgtgtatgagactgaggcttgaacctagaaccttgcacatgctagg

SEQ ID NO: 76341 - DNA, 91 bp, Mus musculus
gggcctgcctgtcgcttctctctcagtccctctctaccaagtggggaaaaagcaccggggtgagggaaacatcaaggaagagacagtgtcc

SEQ ID NO: 76342 - DNA, 90 bp, Mus musculus
ggatcttgagaaagaactgaagtgaaaacagtttacaaatcagcttactaattttctcaatgtctcactctcagtttttgcattcagacc

SEQ ID NO: 76343 - DNA, 102 bp, Mus musculus
gacaacatcactggggactggagagatggctcaacagttaagagcactgactgctcttccagaggtccctgagttcaattcccagcaaccacatggtggctc

SEQ ID NO: 76344 - DNA, 59 bp, Mus musculus
agaggagaggtggaggggtccagcgcccgtctgcctggactctctctctctctctctct

SEQ ID NO: 76345 - DNA, 86 bp, Mus musculus
ggccagccccgtttggaagactagtgattttgttgttgtgtctctgtatccaacaacaagtcccagtctgccacatggtgctggtc

SEQ ID NO: 76346 - DNA, 107 bp, Mus musculus
ggcaggcactgccacagtcaaacacctcaggtttggggtgaggtgggaccagacgtgaatccctcagaccctaactttatctgttgaactgtgttttgtgttgtgtt

SEQ ID NO: 76347 - DNA, 78 bp, Mus musculus
atatatgtatttgtgtatgtgtatatgtatatgtacatatgtgtttgtatatatgtatgtatgtatgtatgtatgtat

SEQ ID NO: 76348 - DNA, 95 bp, Mus musculus
gctctccaagggatctcctgaaaagccttggttttctttgtttctttttcttttaaccaggccaccccttttctcttgatcctgctttggtatgc

SEQ ID NO: 76349 - DNA, 106 bp, Mus musculus
tattacttttcttgttgctgtggtgaacaagaacagaaggtttgctttggttcacagttcagagtagacagtctgctctgctgatgccgtagaagggagagtggtg

SEQ ID NO: 76350 - DNA, 65 bp, Mus musculus
gggtcactacagaacgagagcagggagggacacactgtctctatgtaatcttgaacttctgatcc

SEQ ID NO: 76351 - DNA, 105 bp, Mus musculus
ggggggcaagaacttgaccttgagttttgtgtgcactcctgtaattccatcatttgggagacagacagacagagtcaacaggaccaggagttctgggtcattctc

SEQ ID NO: 76352 - DNA, 98 bp, Mus musculus
gaaagtagcacaagggctggagagatgggtcagtgggtaagagcactggctgctcttccagaggtcctgagtttgattcccagcaactacatggttac

SEQ ID NO: 76353 - DNA, 101 bp, Mus musculus
gccctgaatggcctggaactcactgtatagacctagttagctttgaacttacagagctctctgcctgtctctgcccctctggagtgctgggttaaaggtgt

SEQ ID NO: 76354 - DNA, 86 bp, Mus musculus
ggttctgaactcactgtctctgtccttgccacctttcacaggggttttgggggaaggggcgagatagctatagaggtctaagaacc

SEQ ID NO: 76355 - DNA, 89 bp, Mus musculus
gagagaggtttaagtagtcagcacaaaggttgggaagggttgggtaagatttctggatggctttgaaggccaagatttgaaactctgtc

SEQ ID NO: 76356 - DNA, 117 bp, Mus musculus
ggtatgctacaccttgaaggagcttgagaaccattaacaaaacacagtggtagactagtcatattggtgagtccctctgatggattgtacatgctcagcccaaggagtggcactatt

SEQ ID NO: 76357 - DNA, 120 bp, Mus musculus
ctccagccccctgcctgctttgcccttctttgctgagcaacttaagaggctctctgtatctcacttggggacgtctgttgcttgatcaagaaaggaacgcggtctcatggatcttgggag

SEQ ID NO: 76358 - DNA, 85 bp, Mus musculus; identical to SEQ ID NO: 58391

SEQ ID NO: 76359 - DNA, 76 bp, Mus musculus
ccagaggtggagctggtatgcttttgatggcctgctgggaactggcttcattctgctctgcctgccttacctctcg

SEQ ID NO: 76360 - DNA, 118 bp, Mus musculus
agggagagaactgatgccaaggtacgtctgaccttgtgctggctagttttatgtcaacttgacactagctagtcaccacactggcctgggggcaagcctgttgagcattttcctgact

SEQ ID NO: 76361 - DNA, 94 bp, Mus musculus
gggcagagcagctggcttgggaacatggggacagctggaattctgagtgtctgtgcctgtgtctatgccacagctgtcgtaaaggagtctgcct

SEQ ID NO: 76362 - DNA, 89 bp, Mus musculus
gaggaggaggaggtgtagcatcaggcacccagacaaacttgctgtgtggtgagagatgtcagagtccagtgggcacatgcctcctaggc

SEQ ID NO: 76363 - DNA, 95 bp, Mus musculus
tccagggagtctcaaaccctcacactgacagatacatgtaaaaaaaaatttttttttttagacaggatatctctgtgtagccttgctgtcctgga

SEQ ID NO: 76364 - DNA, 90 bp, Mus musculus
gggccctgcccgagcctgcccatgtctgtgtgtctgtgtgcctatgcgcacggaaccttgaggcctgtccaggcttgtgcaggagtgcct

SEQ ID NO: 76365 - DNA, 81 bp, Mus musculus
gctgaaagaagtgtgtcactggggctgggccttgaggtttcagatgcccaagccaggttcagtgacactctctctccctgc

SEQ ID NO: 76366 - DNA, 79 bp, Mus musculus
ttcaactaggccttgacagagttgagagttgttagtgatgtttgcgggacagtccagcaaggttaagtgtagaggggga

SEQ ID NO: 76367 - DNA, 83 bp, Mus musculus
gagggaattcagaccatataccagtgggatttagaaaattcaagacctctgacaccctctcagtgtggatgtaataagccctc

SEQ ID NO: 76368 - DNA, 81 bp, Mus musculus
cagggatcagtgagaggctcaggtaaggacccgctgggagcctggtatggggatttgggggagcctcactcactcactctg

SEQ ID NO: 76369 - DNA, 68 bp, Mus musculus
caaagatagcatctcagtcacactgtgtgccagatcctggctccgggtggccaccaaggtgctctgtg

SEQ ID NO: 76370 - DNA, 58 bp, Mus musculus
gtgtgtgtgtgtgtgtgtgtgtgtattcatgtgtgcatatgcatgtgtgtgcatgcat

SEQ ID NO: 76371 - DNA, 56 bp, Mus musculus
gtccaggtcactgttggctgtagtaagtttgagacagtggagacagtggacttgac

SEQ ID NO: 76372 - DNA, 75 bp, Mus musculus
tacacctagttcatacatatatatatgtatgtgtatatatgtatacgtgtgtgtgtgtgtgtatgtgtatgtgtg

SEQ ID NO: 76373 - DNA, 118 bp, Mus musculus
gtggattaggatttcaacatgtggggctggagagaccgctcagcggttaagagcactgactgctcttccgaaggtcctgagttcaattcccggcaaccacatgatggctcacaaccat

SEQ ID NO: 76374 - DNA, 82 bp, Mus musculus
ctgccttgagtccttgcctggctccctcagtgacagactgtgacatggaaacaggaaaaggaaatacaccttctccaggcag

SEQ ID NO: 76375 - DNA, 67 bp, Mus musculus
ttccatgtcacagtctgtcactgagggagccaggcaaggactcaaggcaggagcctgtaggcaggaa

SEQ ID NO: 76376 - DNA, 56 bp, Mus musculus
tgtctgtctgtctgtctgatgtgtgggacctggcgcaacacacagatcagaggaca

SEQ ID NO: 76377 - DNA, 74 bp, Mus musculus
gaacttctcctgtaggggccagggagaataaaacagggcatcctccgatttctctctgtctctgggagagtttc

SEQ ID NO: 76378 - DNA, 69 bp, Mus musculus
gagaaaccttacgggctttgccttctcttttcttttttagaagacagggtttgtctgtctgtctgtctc

SEQ ID NO: 76379 - DNA, 101 bp, Mus musculus
tccgtactttggaaagagcatgctggcaatcatgatgatctggttggcacaagtgagaatagagattatgatgatcaaaaaagtgttatcacaggtgggga

SEQ ID NO: 76380 - DNA, 67 bp, Mus musculus
ctggagagatgtctcagaggttaagagcactggctgctcttccagaggtcctgagttcaattcccag

SEQ ID NO: 76381 - DNA, 79 bp, Mus musculus
aggaactagcagctacacaaccacacttcaagggactttaacctttctgtatgtgctggttagtgttgcttgtcagcct

SEQ ID NO: 76382 - DNA, 116 bp, Mus musculus
atctggtcctgggttgtttttggttgggagactattaatgactatttctatttctttatgggattggggactgtttagaatgttaatctgattttgatttaaccatggtacctggt

SEQ ID NO: 76383 - DNA, 88 bp, Mus musculus
tgtatatcctacataatttcttattgtgttgaaatcaaagtccatataaaggacagaaattcagcaaggagccatttgaaggagtaca

SEQ ID NO: 76384 - DNA, 79 bp, Mus musculus; identical to SEQ ID NO: 76381

SEQ ID NO: 76385 - DNA, 86 bp, Mus musculus
aggcggtcttaggtggatgggtgctggtaagtaggggtcacattctcggtggtctcttctctgagtgttaccccagagacgagcct

SEQ ID NO: 76386 - DNA, 79 bp, Mus musculus
gctgaggaccatctgtgcgtgtgtcagggggcagctcagaaaagccccttctttcactggtgcatactcctgtcccagc

SEQ ID NO: 76387 - DNA, 101 bp, Mus musculus
tgtttacgagtggatcgagctgctgctgctaacctgtgaactaaactgccaattttcagacaacacagactggagttgtttcaaagaaccatttctaaaca

SEQ ID NO: 76388 - DNA, 90 bp, Mus musculus
ggaggtcctgcttctgggtgtctctgtgtgagtgcacgcatgtatatgggtgtgctatgttgggaaccaaaagtcaacctcagggcttcc

SEQ ID NO: 76389 - DNA, 80 bp, Mus musculus
agctgtctgaagagactggacggttccagtgccccgggccctccggaggcactgtccctgtcactcagctcagcttcaga

SEQ ID NO: 76390 - DNA, 79 bp, Mus musculus
ggactcgggggtggtactcatgcagctttgttgaggcccttttgatctcagggagattgcatgtgtagtcacatgatct

SEQ ID NO: 76391 - DNA, 73 bp, Mus musculus
tatatatgtgtatgtatgtgtgtatatatgtgtatcttatatgtgtgtgtatatatgtatgtatatgtgtgtg

SEQ ID NO: 76392 - DNA, 59 bp, Mus musculus
tacatatgtgtatatatgtatgtatatcttatatgtgtgtatatgtatgtatatatgtg

SEQ ID NO: 76393 - DNA, 91 bp, Mus musculus
gcagcgaaagtaccagtgaagggaggtggtgagaaggagatgttattctctcccactgctgtctgctctacctgagatgctgagttgttgt

SEQ ID NO: 76394 - DNA, 116 bp, Mus musculus
ttccctggcagaggccccccagtgtggaagggaggctgtgtcagcctgcagagcagacaggagttagagagctgacacacgcatttaatgaacctggggacatttgcagttaggaa

SEQ ID NO: 76395 - DNA, 104 bp, Mus musculus
gagcacatcagccttccatggattcctgggtttttgggtccgtggagtctctcacccactctcaaatgtgctcaaagacctcctgccctaataggaacttgctt

SEQ ID NO: 76396 - DNA, 71 bp, Mus musculus
caggagtctgcctgtctctgtcccttcctcacctcccagggttgggttataggcacatgcggctgcacctg

SEQ ID NO: 76397 - DNA, 63 bp, Mus musculus
gggtttgagtagtctgtctgtctgtctgcttaaaagcatgacaatgatggctataaaggaccc

SEQ ID NO: 76398 - DNA, 94 bp, Mus musculus
agtttcaggggctggagagatggctcaatggttaagagcactgactgctcttccagaggttctgagttcaattcccagcaaccacatggttact

SEQ ID NO: 76399 - DNA, 104 bp, Mus musculus
atatatgtatgtatgtatgtatgtatgtatgtatgtatgtatgtatgatatagacatagattcacacacacatatatgtgtgtatatatgtgtgtatacataca

SEQ ID NO: 76400 - DNA, 69 bp, Mus musculus
gcctgtggatcaggatgtaggactctcagctacttctccaacgccatgtctgcctgtgtgccacagtgc

SEQ ID NO: 76401 - DNA, 83 bp, Mus musculus
cccatcagaacactgtgagctttctagtaacatggcagctgggctccaaacaggaatgatcgaagtgagagagatctggtggg

SEQ ID NO: 76402 - DNA, 85 bp, Mus musculus
gggaggagtggttccctctctgctgagcccaggctcctgtctctctcactccctcagcacagaggtcattcattcacattccttc

SEQ ID NO: 76403 - DNA, 68 bp, Mus musculus
gtctctgagacaggctcagttcagtgggaagtattgatcctgaccacagccatgcctgtttcagatac

SEQ ID NO: 76404 - DNA, 82 bp, Mus musculus
gagtggtgtggcagatgtgtgcatgtgtttgtgtgtgtgcacatgagtgtgcacagtgagcacatgacttctattatcattt

SEQ ID NO: 76405 - DNA, 68 bp, Mus musculus
cagttagaagctaggtatcagggaagtggatatctgtccctctgtctctgtctctgtctctgtctctg

SEQ ID NO: 76406 - DNA, 97 bp, Mus musculus
caatctgctcagactgtactttattactgtatgtatgtatgtatgtatgtatgtatgtatgtaagaaagtatgttttacaggaactgacccactttg

SEQ ID NO: 76407 - DNA, 73 bp, Mus musculus
gcacacatgcatatatacacatatgtgcatgtatcatgtatgtatgtatgtatgtatgattatgtatgtgtgc

SEQ ID NO: 76408 - DNA, 83 bp, Mus musculus
acatacattatgtatgtatatatgtgtatatgtatatgcacatgcttatatgtatatacacttatgcatatatagtgatgtgt

SEQ ID NO: 76409 - DNA, 75 bp, Mus musculus
acgagtctctctgagtctgactacttgtccagcatcctgtattttaaaggatgtggtagatgagtcaggatttgt

SEQ ID NO: 76410 - DNA, 81 bp, Mus musculus
aggtctcagaactcccctgtgctgacactctgactgtgaagatgaaaaaaccaaggtctcaggcagggaagcatcttgcct

SEQ ID NO: 76411 - DNA, 75 bp, Mus musculus
atactcatccagatttattgtttatatatcgttaagtatgaaactgtcttgtataacattgtttggggtgagtgt

SEQ ID NO: 76412 - DNA, 94 bp, Mus musculus
cagctgtgacagagcctggcacagtgactctgttcctcactctcttttgagacacgggcagccacctgctgtgtagactttggtatagaaaatg

SEQ ID NO: 76413 - DNA, 135 bp, Mus musculus
agggattgattcttgaccatgggatgggtctcaagttgagccagtcattagttggtcagtccctcagtctctgctttatctttgtccctgcacttcttgtaggcaagaaacatttgggtcaaagattttatgggc

SEQ ID NO: 76414 - DNA, 69 bp, Mus musculus
gtgtgtctgtgagtgtctgtgtttatgtgcctctgtgtgtggggtgtgtgggcatgggtgtagttgcat

SEQ ID NO: 76415 - DNA, 113 bp, Mus musculus
ggtcattaagcattgccaggaggttacatcaatatgtgtgcaggtaaggtgccacagtagacactgacctgtcatgtgactgagcggtggcctcttgcttgtttatgttgact

SEQ ID NO: 76416 - DNA, 104 bp, Mus musculus
acttaatcagttggttctcacttaggctgtggggcaggaagacacatcagagtgaactcagtttcctcttgatccctttgtgaacctagcctcagctatttagt

SEQ ID NO: 76417 - DNA, 107 bp, Mus musculus
gtcctcaaattccttggagggaaaggtaaggagaagacaggtgtggatgctgcatttgcctccctccctgaatctcttccccagcacccacactggccagggaagac

SEQ ID NO: 76418 - DNA, 71 bp, Mus musculus
tggtgtgtgagtcttcagagtaggtcttcctttcccagtgagatctgtctgaagcactctcacagacacca

SEQ ID NO: 76419 - DNA, 62 bp, Mus musculus
gactggaatgtggcctcagtgactggaggactttggttttactgagtggtaatgttgtagtc

SEQ ID NO: 76420 - DNA, 66 bp, Mus musculus
gtgtgtgtgtgtgtgtgtgtgtgtgtgtgcgtgtgcgcatgcatgtgcatgtgcatgtgtatgtgt

SEQ ID NO: 76421 - DNA, 106 bp, Mus musculus
gcaactaagggatattaaacttttaatactgatcttttaaaacatggtttttaattttttctaaaccccagtatcagatatgggaagtccccactcctgtagtagt

SEQ ID NO: 76422 - DNA, 107 bp, Mus musculus
tagagacagacagacagacagacagacagagacagagagacagagacagagaaccctagtgtctcctcttcaattttagtttgcttgttatggccagctggtttttg

SEQ ID NO: 76423 - DNA, 63 bp, Mus musculus
cacatgtacttctgagtgacactcagtgaggctcagagtggttattctggaagatacatgatg

SEQ ID NO: 76424 - DNA, 105 bp, Mus musculus
ttccagggcagggacaggacattgtcaaactcactcctctgagagatcacagagcagatggaaagcagtgaattgaaacctacttccttcttcctgtccctagaa

SEQ ID NO: 76425 - DNA, 81 bp, Mus musculus
tgctctatgcatagatgtatgattgcatgtgttatatgtgagtataatgtatgcatatttgtatgtttatattcatgagca

SEQ ID NO: 76426 - DNA, 134 bp, Mus musculus
tgcattttttgcatatatgtgtgtgtgtgtgtgtgtgtgcatgtatgtatatatatatatatatatatatatatatatatatacacatatatatgtgtgtgtgtatgtatatgtgtgtgtgtatgtatatgtgt

SEQ ID NO: 76427 - DNA, 85 bp, Mus musculus
ggccatggtggtctgataggatacatgggacaatttcaatatttttgtatctattaaggcctgttttgtgaccaattatatggtc

SEQ ID NO: 76428 - DNA, 84 bp, Mus musculus
atatatatatatatatatatatacatacatatacacacacataattgtgtatgtgcatatgtgtatatgtatatatgtgtgtgt

SEQ ID NO: 76429 - DNA, 100 bp, Mus musculus
gagacttgaggctccaaagagggaggcatggtgggggggggggggttagcatcctccctctctatatctctgtccctctgtgtgtgtgtctttctgtctc

SEQ ID NO: 76430 - DNA, 85 bp, Mus musculus; identical to SEQ ID NO: 57470

SEQ ID NO: 76431 - DNA, 105 bp, Mus musculus
ctaatgcgggctgtggctcacggtcaccaaggacagcagagagtgaggagaggtgcactgagcttttgagtggtgattttgtgacacggttatgacagcacctag

SEQ ID NO: 76432 - DNA, 90 bp, Mus musculus
ttagcatgtgccccatgtcacgctctctcagtaacaccctaccccttcgagtttctgattttgcttcttagagcaagcatgggaggttga

SEQ ID NO: 76433 - DNA, 80 bp, Mus musculus
atgtatatgcatttatatgtatatatgtacatatatacatgcatgtgtatgtttatgtatatgtgtttatgcatatatat

SEQ ID NO: 76434 - DNA, 97 bp, Mus musculus
ggcctcctgcccttcaccattgaggtatgctgagggctgtgtgtggagcctgtgcagacagtgttcagttctgagatgggaggaggggcagggagtt

SEQ ID NO: 76435 - DNA, 85 bp, Mus musculus
ggccatggtggtctgataggattcatgggataatttcaatatttttgtatctgttgaggtctgttttgtgaccaattatatggtc

SEQ ID NO: 76436 - DNA, 114 bp, Mus musculus
gataggtgctgagggtctcttgtgttctggaaggtctccttcttctatgtcatcatctttctgtcaggagagagggagcattaacctgtcatcagagacgctctctgcacttgc

SEQ ID NO: 76437 - DNA, 95 bp, Mus musculus
acagcttctcctcaggaattttatttttaagtttttttaaataatgtcagaagcttggaagtaatttttctttttaaaaggactgaattcgctgt

SEQ ID NO: 76438 - DNA, 124 bp, Mus musculus
ggtggatacagaaggtctgctagtctcaggactcccttggactccgtccacaggtcttctctctgcctctgactcatttttctgttgtggataagtaaccatatctctgagcctcaaagatcct

SEQ ID NO: 76439 - DNA, 63 bp, Mus musculus
actctgctgtgtgtgtctgtgtatatatgatgtatatgtgtcatatatacatggtctgtgagt

SEQ ID NO: 76440 - DNA, 116 bp, Mus musculus
caaactatattattcagctagcatcaatgctcttgggattgaatttatctatatatagtgtttggctcctaagaatctcttcccagccctgtgcagtgaaaaacatgggtagtttg

SEQ ID NO: 76441 - DNA, 105 bp, Mus musculus
atagttggtgtgctctcagagcaaacacaggtcactggatcccagccttcctgcatgtgtgtccgtgtgtctgtcctttcttcattctctcagtaccccagtcat

SEQ ID NO: 76442 - DNA, 63 bp, Mus musculus
tatatgtacatatatatacatacatgcattatgtaccaatatgtaaatatgtatgtgcatata

SEQ ID NO: 76443 - DNA, 104 bp, Mus musculus
ctttgtggtgaagaagctattcagcatgtgctggacgagagataagtcagagtagacaatgtgttcttatgattcagaggggtgttgaatgacggactggagag

SEQ ID NO: 76444 - DNA, 96 bp, Mus musculus
ggaagtcagggcaggaacgtggagcagaagcgagaggggccaccattcacaggctcactcactggctcattctcagctagctttcttattcagccc

SEQ ID NO: 76445 - DNA, 88 bp, Mus musculus
gtgtgtgcgtgtgcatgtgtgtgcctgcatgagtgtgtgtgtgtgtacgcatgtgtgcttgtgtgcatgtgcatgtgcatgtgtatgt

SEQ ID NO: 76446 - DNA, 64 bp, Mus musculus
aaacatcagtgtgacatgtgacagaggccacaccaggctgtgtctaaagtgtcttcatgtgttt

SEQ ID NO: 76447 - DNA, 85 bp, Mus musculus; identical to SEQ ID NO: 57439

SEQ ID NO: 76448 - DNA, 104 bp, Mus musculus
cagatccacctctcagatgtccattggagccagacaagcagggggagttcctgtctctctctgtgtggttgctcaggattatgtgacatggtttgtgaggggga

SEQ ID NO: 76449 - DNA, 88 bp, Mus musculus
gcatcagaggatggaatggtggtgtttattttccataatttgcataaaccacggccccatctccctctgtccctgactctattcctgc

SEQ ID NO: 76450 - DNA, 62 bp, Mus musculus
agtgactcacacagactgtatgtagctgcaagccaccagcttggctgtctctgggagtgatt

SEQ ID NO: 76451 - DNA, 85 bp, Mus musculus
ggccatggtggtctgataggatacatgggacaattacaatatttttgtatctattgaggcctgttttgtgaccaattatatggtc

SEQ ID NO: 76452 - DNA, 116 bp, Mus musculus
ttgaagatcagccttattcggtggtgatctgacaggttgaatgggataatttcaatatttttgtatcagtggaggcctgttttgtgaccaattgtatagtcatttttggaggaggt

SEQ ID NO: 76453 - DNA, 71 bp, Mus musculus
catacactatctgtccaaagttcaaagggcaaggaacctaaagtgacactgtttgaagagattagtgtgtg

SEQ ID NO: 76454 - DNA, 103 bp, Mus musculus
gtgcttttatttctgcatctgcaattctattccattgatcaaagtgtctgtctctgtgccaatactatgcaatttttattactattgctctgtagtaaagcat

SEQ ID NO: 76455 - DNA, 120 bp, Mus musculus
gggtcttcaattctattctgttgatctacctgtgtgttactgttgccggaacatgaatttttttttatcacaattgctctgtagtactttaggtcaggtggaagatggcagggctggcct

SEQ ID NO: 76456 - DNA, 87 bp, Mus musculus
taggttagggaagatttttctatatttttgatgaaggttcttgctgggccttttatttcagaaatgtcactctcttctataactcta

SEQ ID NO: 76457 - DNA, 80 bp, Mus musculus
ctccttgaaggcagtcaattttgttccttgttggaggcagggagacctcctgtgtctctgactctcaatgaccttctgag

SEQ ID NO: 76458 - DNA, 81 bp, Mus musculus
ccgcctaggatgtgtcgctccctgattggctgcagcccatcggcccagttgtcatcacgagaaaggcagaacacgtggcgg

SEQ ID NO: 76459 - DNA, 113 bp, Mus musculus
ttatgtgatcagttttggataagttatcatgatgtcctgggaagaaagtatatatatttttgctttaggatgacatgttatataaatatctgttagatccatttggttcataa

SEQ ID NO: 76460 - DNA, 92 bp, Mus musculus; identical to SEQ ID NO: 75176

SEQ ID NO: 76461 - DNA, 66 bp, Mus musculus
ccagcctcagtctgcctctctcaatccgtggaaattaggggtttcggcaggtgggcatggagttgg

SEQ ID NO: 76462 - DNA, 83 bp, Mus musculus
gaccacaagtgaggcccagaaagaaccagaccgaaaggagcagtggtcttgtcactctttctgtcattcatgctgttctggtt

SEQ ID NO: 76463 - DNA, 82 bp, Mus musculus
cagttctctcagtctctggctctcagactaggaacctacaaaaggcaggtccccctggcagtaaggcagtcctgagaacctg

SEQ ID NO: 76464 - DNA, 68 bp, Mus musculus
tggctgctttctctagcttctccattgggggccctgtgttccatctgatagaagactgtgagcatcca

SEQ ID NO: 76465 - DNA, 102 bp, Mus musculus
attattatctttgtggggctggagagatggctcagcgggtaagagcactgactgctcttccagaggtcctgagttcaatttccagcaaacacatagtgtggt

SEQ ID NO: 76466 - DNA, 85 bp, Mus musculus; identical to SEQ ID NO: 57439

SEQ ID NO: 76467 - DNA, 85 bp, Mus musculus; identical to SEQ ID NO: 57439

SEQ ID NO: 76468 - DNA, 84 bp, Mus musculus
agtactgagagtggagatagaggtcaaatccccagtgtgcaaaaataggggcattacacaaaaccttctcccaggctcatcact

SEQ ID NO: 76469 - DNA, 80 bp, Mus musculus
tgagagtccccagcctctagcttatgtttggatatgggtctctgtgtctctctgagtcagctgttgggaggaatctctta

SEQ ID NO: 76470 - DNA, 106 bp, Mus musculus
gagtcaatttcttaatggtgtggccacttagtttcaattatgctttttggaaatttcaaaatttttattgattctttgtggatttcatatcatgcactccagtctc

SEQ ID NO: 76471 - DNA, 136 bp, Mus musculus
aggatggacctccaagttgggcagactgtgcatggtcattccttcagtctttgctccacactttgtctctgtatctctgtccattggtatttagttctcccttctaagaaggactgaagtatccacacattggtct

SEQ ID NO: 76472 - DNA, 100 bp, Mus musculus
catttaatgtgtatatatatatgtgtatatatatatatatatatatatatatatatatatatgtgtgtgtgtgtgtgtgtgtgtgtgtgtgtgtgtgtgt

SEQ ID NO: 76473 - DNA, 108 bp, Mus musculus
ttgtgtatgatatacggtcatgttctatgatttttttcatatatacatacatatgtatatctgtaatgagtgatgaggaaaaaaatagagtgacagtgagagacatgg

SEQ ID NO: 76474 - DNA, 95 bp, Mus musculus
tgagccaatttctccatgatttttctatgcattttctggggaatgatctctctttcctacagaaaatgccaattatcttaacactaattgtctta

SEQ ID NO: 76475 - DNA, 85 bp, Mus musculus; identical to SEQ ID NO: 57470

SEQ ID NO: 76476 - DNA, 81 bp, Mus musculus
atgtatctatatctgtgtatatatatatgtatatgtgtatacatatatatatatatatatatatatatatatatatataga

SEQ ID NO: 76477 - DNA, 80 bp, Mus musculus
gtctgctcagatgagagtgtggactacagaagctaacagcttctgggacagacagaagccacacagcttctgagacagac

SEQ ID NO: 76478 - DNA, 152 bp, Mus musculus
tacatagtcacacacacacatcacacatagtatatatatatatctgtgtgtgcgtgtgcatgtacatatgtatatatatatatgtgtgtatatatatacacatatatatatattgcattcacactacatatggattataaattatatatata

SEQ ID NO: 76479 - DNA, 69 bp, Mus musculus
tatgttctagatctggacagccagaaggcacataggatcttatctctctctcactgtccctggaatgtg

SEQ ID NO: 76480 - DNA, 91 bp, Mus musculus
ccggttccatcatatatccatcagaatgactatgatcaaaaactcaagagacagtgcattctggcaagaatcaaggatgtggagcaaaagg

SEQ ID NO: 76481 - DNA, 71 bp, Mus musculus
tagagcactgtctctgtgtctgcctgtagtagactaaagactacttcagatacacattatataaagctcta

SEQ ID NO: 76482 - DNA, 84 bp, Mus musculus
tagccacgcatggattgagctttcaattcagagatattttcaggcaagtgtttttgttgatgttgaaatgtgaaatccaggtta

SEQ ID NO: 76483 - DNA, 103 bp, Mus musculus
gcacaccagtatcagggtggaccgtatggagctgccatttttatgagtcagtaaccatcaaatgtcagccattttgtacagttcaacctgtaacaagtgttgc

SEQ ID NO: 76484 - DNA, 93 bp, Mus musculus
ctgtgttacacactctaataatacacaacttgtaaactaaaatagtaagtacatttgcattttagggtacttacattgtagtgggggactcag

SEQ ID NO: 76485 - DNA, 166 bp, Mus musculus
tatatctatatctatatctctatatatatgcacatatatatgtgtgtgtatgtatatatatgtatatatgtgtgtgatatacatatatcatatgtatatacatatattatgtaaatatgtacacatatataatgtatgtgtatatgcatatatgtgtatgtacatg

SEQ ID NO: 76486 - DNA, 93 bp, Mus musculus
agcttctcactgaagctggagctaggcaggtagacagaaaatcgagtgattttatttttgtctctgtcacacttcctgcacagaactgaggtt

SEQ ID NO: 76487 - DNA, 101 bp, Mus musculus
tgaagatcagccttggtccatggtgatctgataggatgcatgggaaaatttcaatatttttgtatcttatgaggcctgtattttgaccaattatgtgttca

SEQ ID NO: 76488 - DNA, 85 bp, Mus musculus; identical to SEQ ID NO: 57439

SEQ ID NO: 76489 - DNA, 85 bp, Mus musculus
atgtgtgtctatatatatatgtgtatgtttgtatgtatatatacatatatatgaatatatatgtgaagatatatatatatatcca

SEQ ID NO: 76490 - DNA, 91 bp, Mus musculus
agagtcgttttaggaaggtcatatataatgagatattgtatatgtatttaagtatcttatctctattttatacatgaaattatttgactct

SEQ ID NO: 76491 - DNA, 77 bp, Mus musculus
ttactgttagccattgtaatgggattaaaatgaaaccacagtacagttttaatttatatttctgtgatggccagtga

SEQ ID NO: 76492 - DNA, 80 bp, Mus musculus
aaatctctaggcttcttagtatcttctggcttacagttgatttctcacaggcagcctgattggctaggtggttttgattt

SEQ ID NO: 76493 - DNA, 77 bp, Mus musculus
atagcattttgtatgcatgtacatatgtatgtacgtatgtatgtatgtatgtatgtatgtatatatacaaaatctat

SEQ ID NO: 76494 - DNA, 91 bp, Mus musculus
ttgtgctgttacattgaatgaatcatactttacaagccatgattttatttttatgcttgagtaatattcacatggtgaacaatgggcataa

SEQ ID NO: 76495 - DNA, 69 bp, Mus musculus
cagattggcatgggctctgaagtaggtggagcagatgctgcagctagacagaagtgtgtgtgtagtctg

SEQ ID NO: 76496 - DNA, 109 bp, Mus musculus
gtgtatgtatttacacatatacatgtataaaacaatcatatgtatatatatatatatatacatatatatatgtgcatatatacataaatgtgtgtgtttgtgtgtgcat

SEQ ID NO: 76497 - DNA, 84 bp, Mus musculus
ctttgatttcttagaagcgagtggagaactgctttcttgacccttcactcaggtctgacaggttcttgtttttaaaattcagag

SEQ ID NO: 76498 - DNA, 75 bp, Mus musculus
cagtcacacacacatacacatacatgcattcagccacccacctgatcccatgaatatgtatgcaattgtgtattg

SEQ ID NO: 76499 - DNA, 119 bp, Mus musculus
tgtgagccaccctggacagcaagcaggtctaacttattttgtagagagaaactccaaacccaaatcttcttcctcccaagtaccttgaacatctccatgtattctagggcccatcgtca

SEQ ID NO: 76500 - DNA, 67 bp, Mus musculus
atgtgtgtgtgtctgtgtgtatgtgttgcttgcttctccatgtacatgtgcataggcatgtggacat

SEQ ID NO: 76501 - DNA, 84 bp, Mus musculus
gtagaatgtctgtgcagatcttcacccacacacactgtctgaataaagactcagtgggcacgctgacagaaacatttcccctgc

SEQ ID NO: 76502 - DNA, 85 bp, Mus musculus; identical to SEQ ID NO: 57439

SEQ ID NO: 76503 - DNA, 110 bp, Mus musculus
gttgccatggtgaacactgtgtttatccctcctctgcccatcactaagagcatctggatctctagggtcaggtgatgagaagagttgaatgcatttggttcagtgtcaat

SEQ ID NO: 76504 - DNA, 88 bp, Mus musculus
caggtgagccaagagatagcaaccatatgtgaactataaagtactagatttgcttgtagcttgtaaatatcacctggctttacacctg

SEQ ID NO: 76505 - DNA, 94 bp, Mus musculus
gtccccaagctctacccactgttgagctgtgggtgtctgtatctgtctgagtcagctgctgggtggagcctctcagaggacagccatgctagac

SEQ ID NO: 76506 - DNA, 60 bp, Mus musculus
tgcatatatgtatgtatatgtatgtgtatatatacacatacatatacacacacatacaca

SEQ ID NO: 76507 - DNA, 114 bp, Mus musculus
tttgcttagatatttagtttggataagttaatgcagtatgcttaaagatggattaactgaagactgcagtttcattttaagcacactttttgagttagaaaacatctaagcaga

SEQ ID NO: 76508 - DNA, 82 bp, Mus musculus
agctcattgtgtgagagcaaagatttgaagtaaacttcccttcaggggcatttgctaattttttattacataatgtaaggct

SEQ ID NO: 76509 - DNA, 98 bp, Mus musculus
gggattcatggaaaaccacagtgagggctagagagatgatggctcagcggttaagagcactcactgctcttccaaaggtcctgagtttaattcccagc

SEQ ID NO: 76510 - DNA, 110 bp, Mus musculus
agaagaagcagttgtttgatgctctgaaagccaggtgtaagaacatgaacactcagatactgtcactcacttgttgccacacctgttagcatgcgacagcagctggatct

SEQ ID NO: 76511 - DNA, 99 bp, Mus musculus
gagatatgatgtgtgcttgggagatggctcagcagttaagagcactgactgctcttccaggggtcctgagttcaattccccgcaaccacatggtagctc

SEQ ID NO: 76512 - DNA, 110 bp, Mus musculus
cactgccatgtgccctgccaagcttgatgcaagagtgtaagttggctccacagactactttctctctctgtgtatcaagagtgtaagtgttaaatgctctcttggttttg

SEQ ID NO: 76513 - DNA, 85 bp, Mus musculus; identical to SEQ ID NO: 57439

SEQ ID NO: 76514 - DNA, 112 bp, Mus musculus
tgcaatggccaacaaatcaaaggctcctttcccaccctctctgtgaaactggcattcagaaaacagagagcagataataaaaggaatctttggtagaggtggcaaaaatgca

SEQ ID NO: 76515 - DNA, 83 bp, Mus musculus
gagaaggtaggagctagcccagctgaagtgggaagttgtggtcagatatcacagagcagacactagctgtctcactacaattc

SEQ ID NO: 76516 - DNA, 76 bp, Mus musculus
ttcccaggacctgtctgtctctgcctctcccctagcgttggggttaaagtcaagagctttatatgggtcatgggga

SEQ ID NO: 76517 - DNA, 112 bp, Mus musculus
cagactgggtaaactgggaactccaagtcacacaggatgtgcatgatggaagtggtttcagtcacacactcaccctgctcattcaattgattcccgagctagcccagctttg

SEQ ID NO: 76518 - DNA, 97 bp, Mus musculus
tgggttttgtttgcattgcatttcctgcacctagaagaatcacatggcaagtgggcactgaatttttttctttgtgaaatgaatggatttatcccca

SEQ ID NO: 76519 - DNA, 81 bp, Mus musculus
caaaggaattgctaaaagctcatgttttgatctaaaaccacaaggcagagagaaaacactgggaacagagtgagtcttttg

SEQ ID NO: 76520 - DNA, 132 bp, Mus musculus
gggagtatttctttttttttttttttttttttttggtttttggttttgagacagggtctcatgtggcccaggctagtctcccactccctctgtcgctgagaatgcccagcccctgcctcctgactgctggcc

SEQ ID NO: 76521 - DNA, 65 bp, Mus musculus
attagggattatgcctgtggtacgaatgcgaggcaagcactctgccactgagtcacattcctaat

SEQ ID NO: 76522 - DNA, 70 bp, Mus musculus
agatatatatatatatatatatatatacatatacatatatgtgtatgtgtatgtatatatatgtgtgtct

SEQ ID NO: 76523 - DNA, 115 bp, Mus musculus
ggaaatgattgaaagcaggaaatgagtaagaacaaagtgtgtatgtatgtatgtatgtatgtatgtatgtacgtccgttgatgcccatcatattgtctgcttattttgtctttcc

SEQ ID NO: 76524 - DNA, 63 bp, Mus musculus
tgtgtgtgtatgtatgcatgtatgcatgttatgtatgtatgtatgcatgtatctgtgtatgta

SEQ ID NO: 76525 - DNA, 114 bp, Mus musculus
aggaagtgtgcagtgtagactgttatagtgttgaaagaagtgtgtgtgctcacaaaaataccttagagtgtatatactaactcattccctttgtttgtctctggattacttctt

SEQ ID NO: 76526 - DNA, 80 bp, Mus musculus
cttctgtaacatcaaaatcgatagattttttttctaaattaaagcaaagaacttcaaaagatttattgagggtgcaggag

SEQ ID NO: 76527 - DNA, 79 bp, Mus musculus
tgaggggaggtgcctagtcttactgctacttgatatgccatgtttggttgatattcataggaggcctgcccttttctta

SEQ ID NO: 76528 - DNA, 119 bp, Mus musculus
gattgcagcttggttatcattggcttaacaggtaatatccaaatataagctagtatgtaatatactttgtttttatgtctgagatacctcgcctaaggatgattattcatagttccatc

SEQ ID NO: 76529 - DNA, 113 bp, Mus musculus
gagctgccattgtctcagaaccactcccagttagagagatgacagtgttgactctgtgcctgggctgactggtcactcctgcttgtttagctgtgatgtggtggggctcaggc

SEQ ID NO: 76530 - DNA, 109 bp, Mus musculus
aagacatgtagaacatatatttatatactttttcatctcttcttaaagacatgagtaaaaatggtttgtaaggaagaatgttatagaaataattgcagctacctgtctt

SEQ ID NO: 76531 - DNA, 95 bp, Mus musculus
ggagatgcttacagaatctcagaagagagtcatcagttttttattaggggcatggtgtctgttcaacctagtttgctttctgtgcctttttttcc

SEQ ID NO: 76532 - DNA, 99 bp, Mus musculus
tgtcaggttttgtcttctgtgctcacttgccccctccctgactccatttcccatacaggagaaactccaagtgcatgtagagacagccagaatccaaca

SEQ ID NO: 76533 - DNA, 71 bp, Mus musculus
tggaagtgaggagaggttactggccaggtgcttcaagctcttttgctagggaactctctctctctctttta

SEQ ID NO: 76534 - DNA, 69 bp, Mus musculus
tgtgtgtatgtgtgcatgcatatatgtgtatataatgtatatatgtatgtgtatacacacacacacaca

SEQ ID NO: 76535 - DNA, 100 bp, Mus musculus
gtctgtctgtctgtctgtctatctatctatctatctatctatctagacaaggtctcgttatgtagttctggttagcttggaacagcccatgtagaccagc

SEQ ID NO: 76536 - DNA, 109 bp, Mus musculus
aatgtaaagtcttactttctgtttctagttattgttccatttcaaatgtcccataggatagtagagaagtatgaactataaaatatttattcggaaagagaggcccatt

SEQ ID NO: 76537 - DNA, 112 bp, Mus musculus
tttcagagctcagtttctgtgtgtgtgcactggaaataattagcatgtaaagtatttatatttccaatttctagatgcacaagattgcttcaagatacttttttttttgaaa

SEQ ID NO: 76538 - DNA, 113 bp, Mus musculus
gtgctcagtacaatggttggctgtgagcatctgcctctgtatttgtcaggctctgtcagagcctctcaggagacagctagatcaggctcctgtcagcatgcacttcttggcat

SEQ ID NO: 76539 - DNA, 82 bp, Mus musculus
ggtgtgtgtgatataaatcaaaagccaaggaaagccagaacatgtatgtgtgcttctgagttcttggtgataccacaacatc

SEQ ID NO: 76540 - DNA, 65 bp, Mus musculus
tggcactgtgggatagactgtgggactatgggactgtggcactatgggtctgtgtgactgtggca

SEQ ID NO: 76541 - DNA, 106 bp, Mus musculus
tgtgggtctgtgggtctgtgtgactgtggcactgtggcactgtgggtctgtgggtctgtatgactgtggcactatgggactgtggcactgtggcagatgaggcaga

SEQ ID NO: 76542 - DNA, 105 bp, Mus musculus
ccatttgtgtgtgtatgtgtatgtatatatatatgtatgaatatatatgtatacatacatatatatgtgtgtatatatatgtatatataggtatgtatatgtatg

SEQ ID NO: 76543 - DNA, 143 bp, Mus musculus
acgtgcgtgtgtgtatgtatatatgtgtatatatacatatgtatatatatatatatatgtgcatgtgtatatatgtatatatgtacacatgtatatatgcatatacacacatatatacatatatatacatatatatatatata

SEQ ID NO: 76544 - DNA, 109 bp, Mus musculus
ttcatacattgtgaataaaattatttctcaacttgtcaatttgattaagtgaggttttccttatttgttttgttttcactgtcttgaaaaatttccacaataatatgaa

SEQ ID NO: 76545 - DNA, 85 bp, Mus musculus; identical to SEQ ID NO: 57439

SEQ ID NO: 76546 - DNA, 83 bp, Mus musculus
gtgagtgcataccatgtaaggtatgtccttctgggtctaggttacctcactcaggatgacattttctagttctattcatttgc

SEQ ID NO: 76547 - DNA, 65 bp, Mus musculus
gtctcagaagagagtgtgcagacttctgatcaaaggcagactgtggctgcaggttctcgtgaaac

SEQ ID NO: 76548 - DNA, 104 bp, Mus musculus
ttgtcactgtctatgtatgtatgtatgtatgtatgtatgtatgtatgcatgtatgtatgtatgcatgtgcatgccataacacacatgtgaaagccaggggataa

SEQ ID NO: 76549 - DNA, 93 bp, Mus musculus
gatttgctgctgttgttgttgttatatttttgtttgtacttctgggacatagtacagacagagcacataagaatcatacaacagctgtgtttc

SEQ ID NO: 76550 - DNA, 85 bp, Mus musculus; identical to SEQ ID NO: 57482

SEQ ID NO: 76551 - DNA, 113 bp, Mus musculus
atttacttcaaatagtgatttgacttgatttagtcattgtatttatttgatattcataatgtgtcaagtgagcaagaatgacattttcctggtcacagtctaatgaggggagt

SEQ ID NO: 76552 - DNA, 80 bp, Mus musculus
tatatatatatatatacacacatatatatacatatatgtgtgtgtataaatgtgtatatatgtatgtatatatgtgtata

SEQ ID NO: 76553 - DNA, 93 bp, Mus musculus
gtttattatatgtatatttgtgtgcctgcattttatatatatatatgcatatatatgtatcatgtgtgtatgcctgagtgtatgtatgtgtac

SEQ ID NO: 76554 - DNA, 95 bp, Mus musculus
tctgagtattattgtggatgtaaactgagaacactgtcagtctcttctgatactacatatctcggccttgactcttaactcttttaatgcccaga

SEQ ID NO: 76555 - DNA, 85 bp, Mus musculus; identical to SEQ ID NO: 57439

SEQ ID NO: 76556 - DNA, 82 bp, Mus musculus
atggctgctctgaaccaggcactggagcagaagatacagtggtttcagactgaggctccctgtttggctgtagagtttctat

SEQ ID NO: 76557 - DNA, 97 bp, Mus musculus
cagttggtaaggctcttttgctgagaatgccatttatttttgtcactgaacacagagaagtcaaactggtgaccaacaagaggctttgcttctactg

SEQ ID NO: 76558 - DNA, 103 bp, Mus musculus
tggacttcagacgtgctatccttcataattgcattcataaatcctttaaaaggaatctctttttctttatgtatattcagttgggaggatgtcttcttatcca

SEQ ID NO: 76559 - DNA, 79 bp, Mus musculus
gtgtgggtgtgggtcccagtcagtgtgtcagtgtgtcaagcgtgtgtccggacaccctaggtctgggctgtccccacgc

SEQ ID NO: 76560 - DNA, 83 bp, Mus musculus
gtgtgtgtgtgagaaatggctcagtggttaagagcactgactgctcttccagaggtcctgagttcaaatcccagcaaccacat

SEQ ID NO: 76561 - DNA, 88 bp, Mus musculus
gtctatgtgtgtctagactgtgtgctattgtatatgtgtccatctggactgcgtgtaatgtgtctgtctgtctttgtatgtatggtac

SEQ ID NO: 76562 - DNA, 86 bp, Mus musculus
tgtctgtctgtctgtctgtctgtctgcccgccttttatttgtgaatccagagctcttgggtgggtacagagtgcatgcaggagcca

SEQ ID NO: 76563 - DNA, 69 bp, Mus musculus
cagcgtctctaactgactgtgtgtcttgctgatcggctagactagctggtcaggaaacgctgcatgtca

SEQ ID NO: 76564 - DNA, 95 bp, Mus musculus
aggcaggaacttaacgataagaagtttgaagcagagaccatgggggaaatgctgcttcctggttcactctctgtctcactactaggtttgtgctt

SEQ ID NO: 76565 - DNA, 61 bp, Mus musculus
tcagctttctgtactgagtgaggtgagaggtggctgctttcatcagaatagaactggctga

SEQ ID NO: 76566 - DNA, 87 bp, Mus musculus
gcagtgggtctatttgtctttaaaatgacctctgaggcactcgtatagttatagaggcagaagagactgaccagaaccagagaatgc

SEQ ID NO: 76567 - DNA, 99 bp, Mus musculus
ttgtcaggtctctctgtctttcatctgtctgtctttatgtctacttacttatggtggcggaagaggtagagagggaaggaataagagagggtatgagga

SEQ ID NO: 76568 - DNA, 85 bp, Mus musculus; identical to SEQ ID NO: 57470

SEQ ID NO: 76569 - DNA, 85 bp, Mus musculus
ggccatggtggtctgataggatacatgggacattttcaatatttttgtatctgttgaggcctgttttgtgaccaattatatggtc

SEQ ID NO: 76570 - DNA, 117 bp, Mus musculus
agactctttctcatactgaaagtaacagtatttctttgcacaaacattagtgattatcatgttgattgttaaaatgacagtgttaaagaaaaaaacaaattagtatttatggagttt

SEQ ID NO: 76571 - DNA, 101 bp, Mus musculus
gggcatgatgctattattaaaatgggtctcaggctttaaggtcagaatagactttaacattgtctgtgactctcacttatttaaatgtttgcatctactcc

SEQ ID NO: 76572 - DNA, 74 bp, Mus musculus
ggtgtatctgttacagcaactgcatgagaacctggaaattcccaccactgtgctggctgactggcagtctcact

SEQ ID NO: 76573 - DNA, 81 bp, Mus musculus
tgtgtacgtgtgcatgtggatgtgcatatatgcatgcaatgtgtatatacatgtatatagtacatatatgcatgcaatgtg

SEQ ID NO: 76574 - DNA, 107 bp, Mus musculus
agcttctgcatatatgcccaggagaggtattgatggaccctcaggtagtactatgttcagttttctgaagaaccatcagactgatttccagagtggttgtacaagct

SEQ ID NO: 76575 - DNA, 85 bp, Mus musculus; identical to SEQ ID NO: 57470

SEQ ID NO: 76576 - DNA, 77 bp, Mus musculus
gaggaactgattcaagtgatagagcagaagttaaaaatgattctgaagcttctgaaacatcataaaatgggtacctc

SEQ ID NO: 76577 - DNA, 118 bp, Mus musculus
gaaagaaaaccagagcagaaacacaagcgaagaacctagaggttggaagtaaagtagaaagtacagaggagtcctgcctatatggcttacattcattgtttgctcaggctgccttctt

SEQ ID NO: 76578 - DNA, 84 bp, Mus musculus
taacttctccatggtcattgaatttctagtcaatcagcatgtgtattggctagttttgtgtcaacttgacacaggttggagtta

SEQ ID NO: 76579 - DNA, 88 bp, Mus musculus
tgtgtgtgactgttttcctgtctgcctgtctgcctgtctgccatggctgtgcaggtcctcacaatgaacagaggagggtgttatacca

SEQ ID NO: 76580 - DNA, 90 bp, Mus musculus
gccattgaaactgtatgctgagctctgaattgtgtgtatatatatatatacaatgaaacagtctaattgtgcatcccagtaactaatggc

SEQ ID NO: 76581 - DNA, 114 bp, Mus musculus
caggacagtggaggatgaaatcataaagtcaaagagcaccagcagcaaattctatggatattctatgaattgttttagcatagcagaatttgaattgagagctgccatgttttg

SEQ ID NO: 76582 - DNA, 118 bp, Mus musculus
tcatgaattaggcttagaacgatgactcaaggatttcattgtatgacagatgacactgtgctcatgtcatgatagtgtcaatgatgatctgacccggtcataggaactgaaattctga

SEQ ID NO: 76583 - DNA, 106 bp, Mus musculus
tgacttgctcttgacactgcctttaatctgtgagctatgaaatgcaaagaaatctagtgtgctctcctctccctccatctgtgtgtggctgtcaggcgagtagtca

SEQ ID NO: 76584 - DNA, 99 bp, Mus musculus
gccacagtttggagaagtagataagaataatttttatttattcacaagtgtgagaaaactaaatatttatatatgtcttaccttcatttatgctgttgt

SEQ ID NO: 76585 - DNA, 101 bp, Mus musculus
gaaagaaagaggtgatttctaacatatcgactggcagaaagaaatgtatttctatttctgataggggatgagactgttgaattctttgaactcttgctgtc

SEQ ID NO: 76586 - DNA, 85 bp, Mus musculus; identical to SEQ ID NO: 57439

SEQ ID NO: 76587 - DNA, 121 bp, Mus musculus
agaagaagaataacatttatatgtatatatgtgtgtgcatatatatatgtgtgtgtgtgtgcatatatatatatatatatatatatatatatatattcatgcctataaattctgtttcttt

SEQ ID NO: 76588 - DNA, 98 bp, Mus musculus
gagaattaagaagggaaacacatgtgagtaagcacacacagagattatagcattggagtgggtagcctgaaacatatgatttccctcatcgatagctc

SEQ ID NO: 76589 - DNA, 70 bp, Mus musculus
ccaggacttccatggcctacttgtctgtgtggtgtcagaaagggcagcgcagtgttgtgtgggtcctggg

SEQ ID NO: 76590 - DNA, 85 bp, Mus musculus; identical to SEQ ID NO: 57439

SEQ ID NO: 76591 - DNA, 56 bp, Mus musculus
ccagcacacatacaagctgtgtacacatatttgtaaacatgtttgtatgtgtgtgg

SEQ ID NO: 76592 - DNA, 89 bp, Mus musculus
attgtttctaattgctctagcctgtgggactactctttgtatacaaatacagtcatattttctatggtattctaggatttagaaacagt

SEQ ID NO: 76593 - DNA, 70 bp, Mus musculus
acttcatgctgtttactctcatctcaagatctggagccagaaatgacagatgagagagtgtgtgtgatgt

SEQ ID NO: 76594 - DNA, 116 bp, Mus musculus
atgtgtgtgtatttgtgtgcatgtgtatgtatgtgtgtggtatgtgtatatgtatatgtgtatacatgtgtgtatgtatatgtatgtgtattttgtatgtgtgtgcatgtgtgtgc

SEQ ID NO: 76595 - DNA, 71 bp, Mus musculus
cactggtaatccatgcttaagtgtttcatagaaatgatctatgaagccacgcagtcctggaatttactgtg

SEQ ID NO: 76596 - DNA, 91 bp, Mus musculus
tgcagtcattctatctcctttatttttcactaaatctagaagcctagacaggtcactggagtgtgtgagtctgtgtgtctgaatgtgtgta

SEQ ID NO: 76597 - DNA, 102 bp, Mus musculus
aaatctcataagcagccttcatttaaattctcattttgtagatgaggaaacttagataccaaaggcctaagcaatttgtctgaggccgtaaatttgacattt

SEQ ID NO: 76598 - DNA, 85 bp, Mus musculus; identical to SEQ ID NO: 57470

SEQ ID NO: 76599 - DNA, 105 bp, Mus musculus
gagggattgttagtgaataaaataagatgtcaagaggcaatcagtggctttgatgattggagtctcagtgtctcacaggttaaatattccatggcttagtccttt

SEQ ID NO: 76600 - DNA, 84 bp, Mus musculus
cttgtgctcaactgatgagtgtgtgcagaggaccagtggtctctgcatgtttctatttctcattatttactctgaacgctctgg

SEQ ID NO: 76601 - DNA, 62 bp, Mus musculus
ggtgtagctgagacattttctgtgacacagggcagcccctctgttctgtctttgtctgcact

SEQ ID NO: 76602 - DNA, 103 bp, Mus musculus
ggcatgctcctatttcctttatgggattgttgtttgggctaagttgaaatcaatatttcatttttgtacctcaaacatttcccagcacaatgtgggtgctgtt

SEQ ID NO: 76603 - DNA, 74 bp, Mus musculus
gggtgagcagacagaggacacagagctgggattcctgcctgcattgttctttcctccactgtaacaagccatcc

SEQ ID NO: 76604 - DNA, 86 bp, Mus musculus
gacagctttctagggacagagtcatggattgagttataagtataagatgtgtaaaaatgagtagtctgtctgtctgtctgtctgtc

SEQ ID NO: 76605 - DNA, 89 bp, Mus musculus
ccatactacagctttcttcactggctaagatccttttgatcctgcaacaggcatcacagaagatactatgctgaggcatgtgggtgtgg

SEQ ID NO: 76606 - DNA, 56 bp, Mus musculus
gggtgtctgaggctggggactcactgagtgagtcacactcaagtctgagctcatcc

SEQ ID NO: 76607 - DNA, 71 bp, Mus musculus
tcatccagtctcactgtctcagagtgcctttgaaaacccaggcaggttcccgaggcatgcctattggatgg

SEQ ID NO: 76608 - DNA, 84 bp, Mus musculus
tcgtgctttgcctggctgcctgtaggtctgattaagggtgttagatcccacggaactggattcacagtcagtcgtgagctgcga

SEQ ID NO: 76609 - DNA, 93 bp, Mus musculus
gcgtgtgtgcgcgagtgtgtctcgctcgctcactcgctcgccctgtgtgtaagagagcgagggagggggacgaaggcaggcaggcgagcaggc

SEQ ID NO: 76610 - DNA, 65 bp, Mus musculus
tctgaatgtatatatgtatgtatgcatgcatgcaagcatgcatagaggcatgaatgtatcccaga

SEQ ID NO: 76611 - DNA, 63 bp, Mus musculus
ttgggaatatgtgggctgggggggggggcatgcacattcagtctctctcagtcctactcctag

SEQ ID NO: 76612 - DNA, 86 bp, Mus musculus
ccacactctgagaatggtgaaggcaaggtaaaactcagctcactttctctgtcttatccagtccaaaggccactctcagggaatgg

SEQ ID NO: 76613 - DNA, 117 bp, Mus musculus
gcagacctgaagagttaggagctgtccggtggtctgtgggggttctagccttctgtctgtctgtgtggcagctatacctccatcaggacctgatcccactgagtcataaggtcgtgt

SEQ ID NO: 76614 - DNA, 56 bp, Mus musculus
gagtacaagggcctctctgtgtctgaatgtcaggcctcagggagagtgctgtagtc

SEQ ID NO: 76615 - DNA, 106 bp, Mus musculus
gagctgtcccccagctgagagttgctgtgctccatcattcatggtcaggagtgagtctctctccctgtggctctgctccacccagagagcccgcatcagccttggg

SEQ ID NO: 76616 - DNA, 115 bp, Mus musculus
gtcacaggctggacagctacaaggagatggtcccttgggtcacatgctgtctctctgtcttataagtaaatgaccccggcggatctcagccaatgtcaggcagccagtatgggac

SEQ ID NO: 76617 - DNA, 88 bp, Mus musculus
gtgactgtgatgatggagttaagacgtgaggagttcttggcagggaacagccactctgtgacactctacctatcattatggctggcac

SEQ ID NO: 76618 - DNA, 73 bp, Mus musculus
ctcacacagtctctcatatacacaataatagttaagaaaattgtgtggggtgactttgtcgggattgggtggg

SEQ ID NO: 76619 - DNA, 117 bp, Mus musculus
atgattagagtctagggagactgggcagggtaaacaccaaggttttcacagtgggtgatctttcttttgctgtaaatccatggacactttgttgttgttgctcttatctttgctcat

SEQ ID NO: 76620 - DNA, 101 bp, Mus musculus
acatattatgtatgtatgtatgtatgtatgtatgtatgtatgtatgtacgtatgtatatacatatacatatatatgtatatatatatgtgtgtgtatgtgt

SEQ ID NO: 76621 - DNA, 68 bp, Mus musculus
gtgtgtgtgcgtgcatgcatgtgtgtctatgtgagtatgtatgcatgtatgtatgtgtgtatatatgt

SEQ ID NO: 76622 - DNA, 113 bp, Mus musculus
atggggtagatatgatcttatttcaatctatacatgtatgaaattgtcaaaaataaaaaagtctttaattttaattttaattatgtgggaagtgagggtgagtaggtgcacgt

SEQ ID NO: 76623 - DNA, 74 bp, Mus musculus
ggtgggacctgggagctgtgggtgctcagtgagcctctggcgttgactggccaatctttctcctcagtgccacc

SEQ ID NO: 76624 - DNA, 110 bp, Mus musculus
ggagagaaaaacaaagaatgcaggcaggaggcagtcgcactctctgtggcagcacaggctggcctcagctggtcatcttcccgactgcaggcattttcatgtccatttct

SEQ ID NO: 76625 - DNA, 75 bp, Mus musculus
ggtatcactctgtgtctctgtggataccaactaggaaaagtgtaggctggtatccagagcatgggctgtggtttc

SEQ ID NO: 76626 - DNA, 117 bp, Mus musculus
ttggggcatacatggcgtgctctggggtgtctgcagaggtcagaggatggatctgtggggtcagttctctccctctggctttaatgtgggttccagggatgaagcgcagatctccag

SEQ ID NO: 76627 - DNA, 104 bp, Mus musculus
tgtgcggtaccatggtctggagagaaggctcagttggttaagagcactgactgctcttccagtggtcccgagttcaaatcccagcaaccacatggtggctcaca

SEQ ID NO: 76628 - DNA, 106 bp, Mus musculus
gtgtatatatgtgtgtgaatgtgtgtgagtgtatatgtgtatatgtatatgtgtatgagtatatatatgtgtgtgtatatatgcatatttgtctatgtgtgtatat

SEQ ID NO: 76629 - DNA, 102 bp, Mus musculus
ggtggaggcccaatggtgatgtgagaggctgcctgattcccagcgataggagtgtgctcgaatgtccccggaacacagcttcttgttccctctaaccctact

SEQ ID NO: 76630 - DNA, 113 bp, Mus musculus
caggagtcagttctctgcttcagccagatcactggacttggtgataaccgttggcaccctctctggctcttactggtaccaacagtgaaaatgttgaagctaaggttcttgct

SEQ ID NO: 76631 - DNA, 101 bp, Mus musculus
atttatttatggtatgtgttagtgtgcttgcctatctgtctgtctgagtgcatgtaaggggggtgggagggctggggggcagtcagctaccagaagagagt

SEQ ID NO: 76632 - DNA, 61 bp, Mus musculus
atcctagaactcactctggagactagagagcaacctgcctcggcctcctgagtgctgggat

SEQ ID NO: 76633 - DNA, 115 bp, Mus musculus
tgctgggataaaaggcatgtgccaccacgctccagcttctatttttcattttaaagtgttaatgtgctttattattgtgaatgtgcatgggggaagagggtcacatgccacagca

SEQ ID NO: 76634 - DNA, 63 bp, Mus musculus
tgtgtgtgtgtgtgtgtgcatgtacgtgtgagtgatgtgtgtgtacacttcccacagcataca

SEQ ID NO: 76635 - DNA, 82 bp, Mus musculus
tctcatctctgtttcccctctgactctctcactttaggacactacggggcgggagagggcgggggggtgggggggggggaga

SEQ ID NO: 76636 - DNA, 91 bp, Mus musculus
tgttattaaataatatcaggggctggagagatggctcagaagttaagagcactgactgctcttccagaggtcctgagttcaattactagca

SEQ ID NO: 76637 - DNA, 72 bp, Mus musculus
gtgtatgtatgtatgtatgtatgtatgtatgtgtgtatgtatgtgtgtatgtgcatgtgtgtgtgtgtgtgt

SEQ ID NO: 76638 - DNA, 84 bp, Mus musculus
cagaaaggaatccccacctggcactgtgaacctggtcacaagcccctgcctcaggccacagaccacagtgaggacttactgctg

SEQ ID NO: 76639 - DNA, 103 bp, Mus musculus
gaccccagagatagggctggagagatgactcagtggttaagagcactgactgctcttccagaggtcctgagttcaattcccagcaaccatctgtaatgggatc

SEQ ID NO: 76640 - DNA, 114 bp, Mus musculus
atgcaacagaggcagggtcatacacaaatagtttgcatctgaactgcatgactagtgtttgtgtagaactggtttgttgtataagtcccagactaggagtgtaaagctcttggc

SEQ ID NO: 76641 - DNA, 87 bp, Mus musculus
ccctctgctcagcctctttatccagtctgtctctgtctcctgggaagccttaggctggctggtcagaagagctgtggtgtggaaggg

SEQ ID NO: 76642 - DNA, 79 bp, Mus musculus
ccaggtcaagaggtcctaggatgaaatgcatggtatatgtatcagccagaagtattctccttttcacgtgtgtacttgg

SEQ ID NO: 76643 - DNA, 144 bp, Mus musculus
tatgtttgatgtgtgtatgtatgtatatacatatacgcatgcatgcatacatatacacacatatttatatgtatatacatatatgtatacatacacatacatatatatatatatatacatatatatgtgcgtgagtgtgtatat

SEQ ID NO: 76644 - DNA, 119 bp, Mus musculus
ggacagtgcttgcctagcatgtgaaaagtgctacagagatggctcagcggttaagagcactgactgctcttccagaggtcctgagttcaattcccagctaccacatggtggctcacacc

SEQ ID NO: 76645 - DNA, 108 bp, Mus musculus
gtcagctttgtgcatagtggagattcttagtgtaaaaggagtggcccctctcagcttctctctctatctcacaagagaacctattttactagtgtcacctgcagagac

SEQ ID NO: 76646 - DNA, 74 bp, Mus musculus
agttgccgccttgtcgattgggctctggatgctccaacctgtgtctctcccactctgtgtaggctcatgctact

SEQ ID NO: 76647 - DNA, 56 bp, Mus musculus
agccaggctctgtgcctcagtccttggagagctagagactgaggcacaaagaggtt

SEQ ID NO: 76648 - DNA, 85 bp, Mus musculus
catttctgctgtgacagatgattgtgtgctcggcaaggtttctggcaaaaagaacacagtcaaggggatgtggaatgcagcaatg

SEQ ID NO: 76649 - DNA, 76 bp, Mus musculus
gaaagtgcctgggtacagctggccctcgggagatcttgagtcttctagagggcctctgtatcactcagacacttcc

SEQ ID NO: 76650 - DNA, 70 bp, Mus musculus
gttagtgttgttgctatgggtgagagggggccctaacaatctctcccactcacacccagcgaggcttagc

SEQ ID NO: 76651 - DNA, 94 bp, Mus musculus
gttcccccacctccctgctcctgtgtccgtctgtctgtcttggtagtgtatgctcagcacaccggtcctagggtaggggagcaggcagggggaa

SEQ ID NO: 76652 - DNA, 76 bp, Mus musculus
cctctttgtaagcacacagtctctcagtccctgtggtttgaggcccttggagtctgatgcctgaggctgggaccct

SEQ ID NO: 76653 - DNA, 63 bp, Mus musculus
acatgtgagctgtcaggggtctgcgtttgtacacacagacacacacactcacagcgtctgtgt

SEQ ID NO: 76654 - DNA, 86 bp, Mus musculus
ccagagatgtggacaaaagtctcctttctgtgtgtacacatatacacactcagacacacaggcacatttgtagacacactcatagg

SEQ ID NO: 76655 - DNA, 64 bp, Mus musculus
cttggacctctctgctcaagctgacaccctgctgtccctgtaggcagctcagaggccttccaag

SEQ ID NO: 76656 - DNA, 81 bp, Mus musculus
gtatttatatctatatcatctatatatgtatctatacctatgtgtgtagatcacacatatatatgatatccatgtagggac

SEQ ID NO: 76657 - DNA, 78 bp, Mus musculus
cctccacctctcagcctgtgtctgactcctgctaaatcctagtccctgaagctgacatcagagctggggggtgacagg

SEQ ID NO: 76658 - DNA, 62 bp, Mus musculus
catgtctgtgaagtgtgtgaggacatgtgtactgccagctcacaggtatctttgcagacatg

SEQ ID NO: 76659 - DNA, 103 bp, Mus musculus
aagtagatctagctccaataactatctggtcatgttaaacaaagcactttcccatagaactgtgtcactgaccctctgataattgtctgctaatcatctattt

SEQ ID NO: 76660 - DNA, 88 bp, Mus musculus
ggtgatgggacgccggaggtcgaggtctaggagccccgaggcgactccgggttgtctgactgtctgtccgtgcccccgctttttctcc

SEQ ID NO: 76661 - DNA, 88 bp, Mus musculus
ggatttttttttcttgaggttctcacaagtgctaaaatgcctcaggcgagagactgatgagagtctgcaattatccaaggcgaggtcc

SEQ ID NO: 76662 - DNA, 78 bp, Mus musculus
taagaaaatggatgtgagaaggcagagtgcacagtgaaatgataattgttaagctcgtgccattactagttcctctta

SEQ ID NO: 76663 - DNA, 71 bp, Mus musculus
gcatctctcactggcacctgaccttcaccaattaagttaggctggtcagtcactgtgtctctgagatctgc

SEQ ID NO: 76664 - DNA, 86 bp, Mus musculus
ggcctctagctggctgtaggtcccttatcagtgtcatcaatgcccgggtctgccaaggtgcctgcctgcctctaaacaatggggct

SEQ ID NO: 76665 - DNA, 111 bp, Mus musculus
tagctgttgacgggtgtgttgcctgcagtaaacagactagctgtcgatggcctgcagtgaacagactagctgttgatggcttgcagtgagcagactagctgtcgatggctg

SEQ ID NO: 76666 - DNA, 73 bp, Mus musculus
gggagtttggtttgtttcaaaaacagctacagccagaaggttgtcttgtttgaatgcagtgaacagatcttcc

SEQ ID NO: 76667 - DNA, 97 bp, Mus musculus
gagggcaaatttttgtttgagtgcctgagttcagttctttttggtaggaacctgggagcaaaattgttattgccaggcagtggtggagaatgccttt

SEQ ID NO: 76668 - DNA, 69 bp, Mus musculus
gttttgcctgtgtgtatctctgtgtgagggtgttggttcacctggaactggagtaacacagctgtgagc

SEQ ID NO: 76669 - DNA, 90 bp, Mus musculus
gcagcactaaattcagaaggtagagatcagctcattttaaagaaacttttaaaaagagacagattttcttcttctgactataatgtgagc

SEQ ID NO: 76670 - DNA, 116 bp, Mus musculus
tgcttactgtcgtaatgaccatggactcactctccgaagctgagcaagccccggttaaatattttcttttataggttgccttggctatggtgtctcttcatagcgatagaaaagta

SEQ ID NO: 76671 - DNA, 82 bp, Mus musculus
agtccaatggttggctgagagcatctgcatctgtatttgtcaggctctggcagagcctctcaggagacagctatatcaggct

SEQ ID NO: 76672 - DNA, 85 bp, Mus musculus
taccatgatggtggcagactctaactctctgaaacagtaagccccaaataaactgtttctttgataagctgccttggtggtggtg

SEQ ID NO: 76673 - DNA, 73 bp, Mus musculus
tcttgcagagggaggaatgtggactgcagtgtctgtcctcacttttagtcccacctctgtctctctgagcaga

SEQ ID NO: 76674 - DNA, 84 bp, Mus musculus
tcagatcctgggagaagtcaggaggtggacctggagagatggctcagtggtttagagcactgactgctcttgcagaggacctgg

SEQ ID NO: 76675 - DNA, 72 bp, Mus musculus
ccttcaagtgactcactggctctcactgtccctgtgctgggaagtgaaggtagggctggagtcaggcctggg

SEQ ID NO: 76676 - DNA, 74 bp, Mus musculus
ttcttagggcatggtccaggcttgctcatttgcctcagtaagaagccttctgcctgtgacactgcctctctgaa

SEQ ID NO: 76677 - DNA, 56 bp, Mus musculus
tccgtcagtcagtcagtccgtccgtctgcagcacccacccagctggctgacacggg

SEQ ID NO: 76678 - DNA, 80 bp, Mus musculus
cacagcccatacagccctgagtcctggcttcctcttatagatactgagaggagagagtggacttggatgaaaaggccttg

SEQ ID NO: 76679 - DNA, 69 bp, Mus musculus
acactctcacacagacacacatgctggcaaaacaccaatgtgtgtgtgtgtgtgtgtgtgtgtgtgaga

SEQ ID NO: 76680 - DNA, 76 bp, Mus musculus
gggcagctgctgagacaacagagtctggtatgtgtggtacccccataccacagtctgtcaggtggaaggagttccc

SEQ ID NO: 76681 - DNA, 69 bp, Mus musculus
gagaaagttcactggcagctggagaaggtgaagtcatggagggctccctggcagaagctgaacttactc

SEQ ID NO: 76682 - DNA, 83 bp, Mus musculus
gatttcacaatatttattgttaattaatctgaaaacagttatttataactgactccagaggagtgacagtaggctgtgggatt

SEQ ID NO: 76683 - DNA, 61 bp, Mus musculus
ggagggaaggggagatgaggtgcagcctgtcacttcctgtcaccctctgtcactcctactc

SEQ ID NO: 76684 - DNA, 71 bp, Mus musculus
gtctgtctgtctgtctgtctgtccatctgaggttggactctcatggctctggagagagcacagatctcgac

SEQ ID NO: 76685 - DNA, 96 bp, Mus musculus
ggtcctgtggctgggtctctaggcacgagcttctgcacctccctgctcccaccagtagaggtctctgcctcactcactggctccaagctgcaagcc

SEQ ID NO: 76686 - DNA, 78 bp, Mus musculus
cttggtattgtagtgacagaagtgacccagcacagcatcagctatgggtcctgttttttttgggacatccatgccaag

SEQ ID NO: 76687 - DNA, 108 bp, Mus musculus
aagaccgtgagtaggagggaacctggggccctatgcacacacctctgtatctctctgtttgacacaggagtttgtgtgtgtggtgctggcacgtgaacctaaggtctt

SEQ ID NO: 76688 - DNA, 63 bp, Mus musculus
aggagccatgtcatctggaactcatgacaatatttttatgtatgtcatgagtcttgaaatcct

SEQ ID NO: 76689 - DNA, 59 bp, Mus musculus
cagatccagaagtgtttttcttgaagtgaacacttctgagaatgcacttgctgattttg

SEQ ID NO: 76690 - DNA, 134 bp, Mus musculus
cttcagtggaccaaagacagtcctccaggttttccatggtttccagtgttccaaggtctctcactctctgcatcatgtctggccgatggatctctgtatttgttctcatctgctgcagaaggaagtctctctgg

SEQ ID NO: 76691 - DNA, 72 bp, Mus musculus
caaagagacagagtctctcactgagcctggagctgactagaggctagtggccctagaacctgcctatctttg

SEQ ID NO: 76692 - DNA, 73 bp, Mus musculus
agtcacagagctattgagtgctggggtagggttcagaactggctctttctctgagtcgctatgctgctggact

SEQ ID NO: 76693 - DNA, 111 bp, Mus musculus
ggagattcctgcgctgagcagctcttatctagatggcaactttgaggagccgtttgatgtcaggctcgatgttgatggtctggaagctgcggctgtagcgacggaagggct

SEQ ID NO: 76694 - DNA, 99 bp, Mus musculus
tctgttgttatgtctcccttttcacttctgaatttgttaatttgggtactgtctctgtgccctctgtttagtctgactaagggtttttatatcttttga

SEQ ID NO: 76695 - DNA, 111 bp, Mus musculus; identical to SEQ ID NO: 76693

SEQ ID NO: 76696 - DNA, 104 bp, Mus musculus
gtcttgctgcaaatctttatttatttgaaagacaatgcatttcaaatgtatctgtatttatttgaaggataatgaatttcaaatgtaaaggtggtacctaggac

SEQ ID NO: 76697 - DNA, 113 bp, Mus musculus
tgaactttcatgaaattatgctttttacatgaattaatgacttacagtagtgattttaaagaattcctgacttgattcaagtaattttaagaagatagttgatagaaagttta

SEQ ID NO: 76698 - DNA, 93 bp, Mus musculus
tcatgctgacactcagaaggaaatgcccagtgacctagcctaactgtggctctcatggcattacactggctgctttcatgagttgttgggaga

SEQ ID NO: 76699 - DNA, 120 bp, Mus musculus
ctctttcaagttctattttatctttcaagaactatctatctatctatctatctatctatctatctatctatctggggtggggagaggttaagtgtgaaagtcagagacaatttgtgggag

SEQ ID NO: 76700 - DNA, 77 bp, Mus musculus
gcagtgatttcttcgcttcagtgagccgccctgaactctgacttctcttctggccactgaagacagagagcaaaagc

SEQ ID NO: 76701 - DNA, 67 bp, Mus musculus
ggattacagtactccaagcagacctgaagggcatcctccctctgtctgtctgtctgtctgtctgtct

SEQ ID NO: 76702 - DNA, 76 bp, Mus musculus
cctctgtctgtgtgtgtgtgcctgcttgtttatctgcttatcatgagcatgtagtgccctcagaggccagaagagg

SEQ ID NO: 76703 - DNA, 73 bp, Mus musculus
tcacatttagcaagcatcttttatgtatgtatgtatgcatgtatgtatatatgtatgtatgtatgtcatgtga

SEQ ID NO: 76704 - DNA, 72 bp, Mus musculus
gcaagtcctgtgtgaaaagagcaggtcaggggtcacaaagatgtgacaattgtgtgtgtacaggtgggttgc

SEQ ID NO: 76705 - DNA, 85 bp, Mus musculus
gtagatgatggataagtatacacatccataagtacacatttatatgtatatatacatatgtctgtatatacatatcctctttagc

SEQ ID NO: 76706 - DNA, 77 bp, Mus musculus
tgtgcaaagctcattcaagtcagaagatacagagtatattaacattcactgtagcttctttgtgaatggctttcaga

SEQ ID NO: 76707 - DNA, 72 bp, Mus musculus
ttaaattgtgtgtgtctgtgtgcctgtgtgtaagaagaattttaggctaggggtagcagcacatgcctttaa

SEQ ID NO: 76708 - DNA, 72 bp, Mus musculus
acactcacacatactacacactctatgcatatatatttacaatatgtttagtctgtgtgtgtgtgtctgtgt

SEQ ID NO: 76709 - DNA, 82 bp, Mus musculus
gctgccagagagcagagtgtggacagcttggagtgctttgggtctaaggtatgctgaatccagtgccagccatcttggcagc

SEQ ID NO: 76710 - DNA, 81 bp, Mus musculus
atggatcctcaggtggggcagtctctggatggtcgttccttcagcctctgctctgaactttgtctctgtaactctttccat

SEQ ID NO: 76711 - DNA, 83 bp, Mus musculus
acaaaaaaagccctaatattggggagggggggaaccaccacaccagatatctctctctctctcatattacttattttatgtgt

SEQ ID NO: 76712 - DNA, 61 bp, Mus musculus
cccaagatgattctttgttgttgtgtcctatggaagggaccaaagctgtgtcctctttggg

SEQ ID NO: 76713 - DNA, 65 bp, Mus musculus
atttctcagtagtgtgtgatgagtggtagcatcctcattttacaaataaactaagactgagagat

SEQ ID NO: 76714 - DNA, 100 bp, Mus musculus
ggacagaaatttgagacaggaacttgaatgcaggagctgatgaggaaaggtaattgtcagctctgtctctttgtctccgtatctatcaatatatctgtct

SEQ ID NO: 76715 - DNA, 106 bp, Mus musculus
tgtgggacggggtggggggggagggaggagagagagagagagagagagagagagagagagagagagagagagagagagagactgtctgcctgcctgcctgcctagg

SEQ ID NO: 76716 - DNA, 72 bp, Mus musculus
cgtgcgtgcctgcctgcctgtctgattgtactgcctccagctcaccagaggatggccatgggtccttgcatg

SEQ ID NO: 76717 - DNA, 62 bp, Mus musculus
ggagctactgagatgacagtggtcagtcactctgagaaccattctggctgccactgtgctcc

SEQ ID NO: 76718 - DNA, 66 bp, Mus musculus
ggtctgtctgtctgtctctgtgtatgtgtgttcatttgcctgaggagaacaagatagcgctggatc

SEQ ID NO: 76719 - DNA, 89 bp, Mus musculus
gtgcagagtactgggtttactgtgtacagatggtgtgagcgtgcctgtgtgccacagtgactttgccatggagtgcagccgggttccac

SEQ ID NO: 76720 - DNA, 80 bp, Mus musculus
gatcaggaggagttcaagaccatcctcagctacatggtgattttaagggtagcttgggattcactggatttttgtctgtc

SEQ ID NO: 76721 - DNA, 86 bp, Mus musculus
tggttttttgagaaagcaatctatataattttatgttcataggggaagagaattatgagcagctggttatgtctgtactcagtcca

SEQ ID NO: 76722 - DNA, 86 bp, Mus musculus
tggccagccagtggtcaaggaatggctggagggcaagtagccatctctctttctctctgaattccaccctgtggccactaagagct

SEQ ID NO: 76723 - DNA, 84 bp, Mus musculus
ggcatgcctggtgtacatggtgctgaggactgagctcatggcttctgccagctgactcacattctcagtcccactccagaatcc

SEQ ID NO: 76724 - DNA, 89 bp, Mus musculus
taaggattgtctgtctgcctgtctgcttgcaacacagtttcactgtatatccctggctgtagaccactgtgtagaccaggctggccttg

SEQ ID NO: 76725 - DNA, 75 bp, Mus musculus
tcactcagagagagagagagagagagagagagtcctgaatctaatctctttcttttgtttcttctttgagcatga

SEQ ID NO: 76726 - DNA, 113 bp, Mus musculus
ccatgttgttgaatgttacctatattttaaaatttctgagtaatatttcattatatgaatattccatatgttgtttattatttggtggacatttaggttgtttttcaccttgg

SEQ ID NO: 76727 - DNA, 112 bp, Mus musculus
tccaggctagcctagaattcctcttcttgtctcagcctgggattaagacatgtgtcagtcaccctgtctggcacacaatgtagttttagagtaacaagaaaattccactgga

SEQ ID NO: 76728 - DNA, 82 bp, Mus musculus
tgcacttagtgagaagtcactgtggtcagggcactaagcttagcactccctgctcagtgactcgctcccctgtaatagtgta

SEQ ID NO: 76729 - DNA, 79 bp, Mus musculus
caggcatctgagatgtttgggtcattccacactgaatgcatgtgtgtgccaagtgtgagtctctgtgtttctgtgtctg

SEQ ID NO: 76730 - DNA, 67 bp, Mus musculus
ccaagctgtcaatcatcagggcaacctgtgtctctcagcctaggtctgcctctgtctgtctctttgg

SEQ ID NO: 76731 - DNA, 97 bp, Mus musculus
ggacaggcgcaggtgtattctacagtgcacgtgtctccagtgtggctcggaggctggagacgcggccctgttggagtaacaactgaagccagagtct

SEQ ID NO: 76732 - DNA, 92 bp, Mus musculus
ccagggagtggcactattaggaggtatggtcttgttggaggaagtgtgtcactgtgactgtgggctttaaggtccttgtcccatcttcctgg

SEQ ID NO: 76733 - DNA, 116 bp, Mus musculus
atcttggttttgtcagaactcctcagagtccagctgtctctgtgattctgtgattctgtgattctgtgattctgtgattctgtgattctgtgattctgtgattctgtgatcctggg

SEQ ID NO: 76734 - DNA, 66 bp, Mus musculus
ggcattagaggagaaggctgcagggttgaagtctctctctctgagaagtctcttgtcttgagggcc

SEQ ID NO: 76735 - DNA, 85 bp, Mus musculus
tgtgtgtggtctcactgtgattgtctctgatttgtttcagccttctctgcagctccatcacagccctggttgcagtccacgtcca

SEQ ID NO: 76736 - DNA, 94 bp, Mus musculus
tcatccacggccagataaccagagctcaatctagagccaagagagactcactcattgactcatgaaatgaaggttctgagggctggcaagatgg

SEQ ID NO: 76737 - DNA, 79 bp, Mus musculus
ctggcaggaccaggagaaacaggtaggtgggtggaggatctctgtttttgtatttatctgttctggaaggtccctacag

SEQ ID NO: 76738 - DNA, 62 bp, Mus musculus
actatgtctgtatctgtgtgtcagtgtccgtaccagggtgttcatacagaagtcagaagagt

SEQ ID NO: 76739 - DNA, 62 bp, Mus musculus
tctgtctgtctgtctgtttatagccagccagccagctagttttgtttgcggggaggggcagg

SEQ ID NO: 76740 - DNA, 104 bp, Mus musculus
gaaacacagacttgtgggggctggagagatggctcagaggttaagagcactgactgctcttccagaggtcctgagttcaattcctagtaaccacatggtggctc

SEQ ID NO: 76741 - DNA, 56 bp, Mus musculus
ggagagatggcttagcagttaggagcacagagcactgactgctcttccagagctcc

SEQ ID NO: 76742 - DNA, 67 bp, Mus musculus
gcagacactgagggggaggggagaggagccaggagggagccttccaggtctctccctctgtgtgtgt

SEQ ID NO: 76743 - DNA, 89 bp, Mus musculus
aaaacagctcagagtggaaacactagaaagagatctactgcactcagtcactgcatctctgtttggcttctagatgataatgctgtttt

SEQ ID NO: 76744 - DNA, 82 bp, Mus musculus
cggtgactgtatgggtacactcactggctgagtgggtataggttaagaatcttggcggcctggtgtagcaaccccagcactg

SEQ ID NO: 76745 - DNA, 67 bp, Mus musculus; identical to SEQ ID NO: 76742

SEQ ID NO: 76746 - DNA, 89 bp, Mus musculus; identical to SEQ ID NO: 76743

SEQ ID NO: 76747 - DNA, 82 bp, Mus musculus; identical to SEQ ID NO: 76744

SEQ ID NO: 76748 - DNA, 96 bp, Mus musculus
gtgtgaggttttgagttcaattctctatctatctatctatctatctatctatctatctatctatctatctatggaattgaactcatgacctcatat

SEQ ID NO: 76749 - DNA, 106 bp, Mus musculus
gctcgttcagtccctttcctgctctggcccaggaagttatttattattatacataagtacactgtagctgacttcagtgttaccagaagaggcaccagaagagagc

SEQ ID NO: 76750 - DNA, 103 bp, Mus musculus
tgtacttattgtttacgcctatgaggctgtgcgtgtctctgtgtgtctgcggtacaagtgcagaaatcagaagacaacttgcaggcatctccctccaccaggc

SEQ ID NO: 76751 - DNA, 63 bp, Mus musculus
ccaagcaaagcagagcctcagggaagcttgtgtatctatctgtctgtgtggctctgtgcttgg

SEQ ID NO: 76752 - DNA, 119 bp, Mus musculus
actaagtgtcttcaaaaagttctcatacgggctggtgagatggctcagtgggtaagagcactgactgctcttcctgaagtccttaaagtcctgtgttcaaactccagcaaccacatggt

SEQ ID NO: 76753 - DNA, 73 bp, Mus musculus
tagctgagaattggtcagaattggctcttccatagcctagcatggaagaggtactaggtccaattccccacta

SEQ ID NO: 76754 - DNA, 69 bp, Mus musculus
agggcctcagtcagactcatagagactctgatattgtcacttcagtctctgtgagctcctatgagccct

SEQ ID NO: 76755 - DNA, 115 bp, Mus musculus
gcctgatagttgcagaagctttccacattcatgttcatctgtatctcagtgagtcagtgagaggcaatctactcagcatgcgatttgtgtgtagctttccagattagtcatatgc

SEQ ID NO: 76756 - DNA, 123 bp, Mus musculus
cactattgcagatgccaacaagattttgctggcagaagcctgatatagctgtctcctgtgaggctctgtcagtgcctggcaaatatagaagtagatgctcacagtcatccattggacagagct

SEQ ID NO: 76757 - DNA, 118 bp, Mus musculus
gctatggagtttagggagccgttatccatgctgtatgggaaattttcaatgtatgtatatttgaaaacaatttttccccatttttattaggtatttagctcatttacatttccaatgc

SEQ ID NO: 76758 - DNA, 85 bp, Mus musculus
ggccatggtggtctgataggatgcatgggacgatttcaatatttttatatctgttgaggcctgttttgtgaccaattatatggtc

SEQ ID NO: 76759 - DNA, 106 bp, Mus musculus
cttactgcttttaatattctgtctttatttagtgcatttgttgttctgattattatgtgtcgggaggaatttcttttgtggtccagtctatttggagttctgtagg

SEQ ID NO: 76760 - DNA, 85 bp, Mus musculus; identical to SEQ ID NO: 57439

SEQ ID NO: 76761 - DNA, 88 bp, Mus musculus
atatataaaaaatacacatacaagctatactaaatgaactcaaaagtatgcatttatatatttgtttgtgtctgtattttatgtgtat

SEQ ID NO: 76762 - DNA, 85 bp, Mus musculus; identical to SEQ ID NO: 58722

SEQ ID NO: 76763 - DNA, 76 bp, Mus musculus
gcatatatatgtatgtatgtatgtacatatgtgtgtgtttctatttgtgtgtacatatgtgcatgttcatgtgtgt

SEQ ID NO: 76764 - DNA, 85 bp, Mus musculus; identical to SEQ ID NO: 57439

SEQ ID NO: 76765 - DNA, 68 bp, Mus musculus
tatacatatgcatgtgtatctcacagtctctctctctctatatatgtgtgtgtgtgtgtgtgtgtgtg

SEQ ID NO: 76766 - DNA, 76 bp, Mus musculus
tgagcaccttggggagaacagaaacacctgggttactctttcagtctctgagtggctgtgcttcttcaattgttta

SEQ ID NO: 76767 - DNA, 106 bp, Mus musculus
gccttagtgcatggtgatctgataggatacatgggacaattttaatatttttgaatctgttgaggcctgatttgtgacctattatgtgggcaattttggagaaggt

SEQ ID NO: 76768 - DNA, 85 bp, Mus musculus; identical to SEQ ID NO: 57470

SEQ ID NO: 76769 - DNA, 106 bp, Mus musculus; identical to SEQ ID NO: 63491

SEQ ID NO: 76770 - DNA, 111 bp, Mus musculus
tatacatatatatatgtaaacaggaaaatatatatgtgcatatatatacatatgtatgtatatatatgtacatttgtatatgtacaaatatacatatgtataaaaatatgc

SEQ ID NO: 76771 - DNA, 116 bp, Mus musculus
tgatgtgggaatgtgcctggagccaaataggaagaaggtagaaaggaattctatcagtaactaactgactgactcattcattcatttcttcatttgttcattcattcagtcagtca

SEQ ID NO: 76772 - DNA, 72 bp, Mus musculus
gctgccactgagaatgagaccacctggggtggagccttccaacctagatggttctattgttctgtcacctgc

SEQ ID NO: 76773 - DNA, 86 bp, Mus musculus
gtgtctctccttggcttaaggccttgtgaaagctctgttctcccttcagggcattggtttcactccctttctgtctcagttcccac

SEQ ID NO: 76774 - DNA, 72 bp, Mus musculus
atacacatatatacatacacatatatacaaatatcataaggatatttgtataaaagtatgttataagtgtat

SEQ ID NO: 76775 - DNA, 81 bp, Mus musculus
atgcatatcaatgttattttttatacaatacatggtgcctatttggcctatgaagtgagataaatgaatttgtatatgcat

SEQ ID NO: 76776 - DNA, 100 bp, Mus musculus
gagaaaaaatgtcaggctggagagatggctcagcggttaagagcactgactgctcttctgaaggtcctgagttcaaattccagcactcatatggtggctc

SEQ ID NO: 76777 - DNA, 145 bp, Mus musculus
atgtatgtatgtatgtatgtatatatgtatatgtgtgtgtgtataacctgtaattcagtgtatgtatgtatgtatgtatgtatgtatgtatgtatgtatatatgtatatgtgtgtgtgtataacctgtaattcagcatgcagcac

SEQ ID NO: 76778 - DNA, 107 bp, Mus musculus
accatacgtagaagaagaggaaaaggggctggagagatggcacagtggttaagagcactgactgctcttccagagatcctgagttcgattcccagcaaccacatggt

SEQ ID NO: 76779 - DNA, 109 bp, Mus musculus
gctgagagaagagacataggaggtgtttaggtttccttgccttgggactataagaagagagagagagagagagagagagagagagagaacctccatgccttagaacagt

SEQ ID NO: 76780 - DNA, 64 bp, Mus musculus
ggttgtcattgagcatctgcctctgtatttgtcagtctctggcagagtctctcaggagacagcc

SEQ ID NO: 76781 - DNA, 96 bp, Mus musculus
ctgggttatagggatgaggtataaggttgtatacaaggcctttgatgagtgttctatcacccacgattccagtgtcttagccctctctctgtctgg

SEQ ID NO: 76782 - DNA, 85 bp, Mus musculus
ggccatggtggtctgataggatatatggaacaatttcaatatttttgtatctgttgaggcctgttttgtgaccaattatatggtc

SEQ ID NO: 76783 - DNA, 94 bp, Mus musculus
gtacatatgtatgtatatgtaaatgtgtgtatactgatatagatatttgtatatatattaatatacatagggatatatgtatgtatgtatgtat

SEQ ID NO: 76784 - DNA, 79 bp, Mus musculus
gtctttgctgagtgactctctgagaatgatcccttggatgtggataaaattgcccagggtgttggtacaggttaaagac

SEQ ID NO: 76785 - DNA, 85 bp, Mus musculus; identical to SEQ ID NO: 57470

SEQ ID NO: 76786 - DNA, 112 bp, Mus musculus
gtagagctatatggatggcagatagatatgaagctacagactgtatgatgtataatcgttgtattgttgtttcattccctctatccctatatatctacatactgcatatcca

SEQ ID NO: 76787 - DNA, 76 bp, Mus musculus
gagtcagtccttatgacactgagtaagcagtctgttgctctcagacagtctcagactgtcaccttctgagtggctc

SEQ ID NO: 76788 - DNA, 94 bp, Mus musculus
ggcctttatcataataggtgtgtttgtgtgcatgtgtatgtgttaacatatatggtcgatacatgtatatacacatttcaaatggttgtgggtt

SEQ ID NO: 76789 - DNA, 91 bp, Mus musculus
ggtggctatggtaatgaaacatttgactgatgagagggtactgggaagagggtcttcttttggctgatgcttccaattaactgtacctgcc

SEQ ID NO: 76790 - DNA, 102 bp, Mus musculus
gtcactatgggtattggtgtatgattttgagtgatgaatctgagcaaattgtcatattgatccccttcccacttgatatctatcaccagagtctgcagtcac

SEQ ID NO: 76791 - DNA, 76 bp, Mus musculus
cagctgtctctgtgattctgtgattccaggatcctgtgatcctgtgattctgggtgtgatcctgggagacaagctg

SEQ ID NO: 76792 - DNA, 107 bp, Mus musculus
gtttgatgtctgcagatatgatggatacctatttggggcagtctctggatggcctttccttcagtctctgtttcactctttgtccctgcatttctttagataggaac

SEQ ID NO: 76793 - DNA, 73 bp, Mus musculus
taccttgtgaagtaggcaaaggaaggaattttagagatgagtcagattcagaagctagcagtttcacagggta

SEQ ID NO: 76794 - DNA, 65 bp, Mus musculus
acatgtgtatgcatctgtgtgtatcgtgtatatgtatgtgtatatatgtatgtgtgtgtgcatgt

SEQ ID NO: 76795 - DNA, 85 bp, Mus musculus
gagtagtatgctctggtctcatctctgtggctgtgataaaatatcctgacaaaaaatacctgagaagagaaagggtttagtagtc

SEQ ID NO: 76796 - DNA, 85 bp, Mus musculus
tgtcagctaatgcactcttcctacttctggtgtctgacactcacagacagctcacaccattgggttggggtgcatttagaaagca

SEQ ID NO: 76797 - DNA, 80 bp, Mus musculus
ggttgttctgcctgtctgtctgtctgtgcaccatgtgataatgtagaaaccacggaagccagaaaaaggcatcgaatccc

SEQ ID NO: 76798 - DNA, 92 bp, Mus musculus
ttggtcgaggcggcctcgaaggagctgtgtcaccagggaactgagaggctcctcacagaactgagtgacttggggtatcgagtttcggctaa

SEQ ID NO: 76799 - DNA, 119 bp, Mus musculus
caccttggcgaacacatttatttaatataggggtggggtattgctgtctctgtcagtgtgtatagggtggtagggagacaaccagagggacttctgaagtaagaggctgttctggcccc

SEQ ID NO: 76800 - DNA, 125 bp, Mus musculus
tgtgtccatgtatgtatgtatgtgtgtgtgtatgtgtatatatatatatatatatatatatatatatatatatatatatatatatatatatatatatatatgcacacaaaattaatataaatata

SEQ ID NO: 76801 - DNA, 97 bp, Mus musculus
gtctgactgtctgtctgtctgtctgtctgtctgcctgatgcccatggaaaccagcataaagcataattcctagactggaattacagatggttgtgat

SEQ ID NO: 76802 - DNA, 125 bp, Mus musculus
ggctcacagtgccctcggcgcgggccgccgtctgtctgcgctcgctcgaccgtcggtcggtccgtccgtctgtccgccaccgccgcaggggcgccgcctcctgcacagccaccccgcggaggatg

SEQ ID NO: 76803 - DNA, 90 bp, Mus musculus
ggctttgccagacgatctgggggagacatcttggttcctggacaccaccgagcctagacttcacaggtgagagtgtggactgcagaagct

SEQ ID NO: 76804 - DNA, 68 bp, Mus musculus
aggatgctgcctcagagactctgtggctctgcctgtcccagaagctgtccggttctgtggtacaccct

SEQ ID NO: 76805 - DNA, 96 bp, Mus musculus
gatcagccttagtttgtggtgatctgataggatgcatagaataatttcaatatttttgtaactgttgaggcctgttttgtcaccaattatatggtc

SEQ ID NO: 76806 - DNA, 65 bp, Mus musculus
gagtatacaatatatataggctatgtatgtatgtatgcatgcatgtatgtatgaatgtatatctc

SEQ ID NO: 76807 - DNA, 117 bp, Mus musculus
ggagcctgtccctcctgtgatcctggttgtgtcagcactcctcagaatccagctgtctctgtgaccctgtgattctagtgtccaatgaccctgagatcctggatgtgtcagagctcc

SEQ ID NO: 76808 - DNA, 94 bp, Mus musculus
ccattatatatgtatgtatgtatgtatgtatgtatgtatatgtgtatatatatatatatatatatatatatatatatatatatatacacactgg

SEQ ID NO: 76809 - DNA, 102 bp, Mus musculus
tttctaactgccctagctagaacttcaagtactatgttgaatagatagggagagagttacacagccttgtctagtccttgattttagtgggcttacaagaag

SEQ ID NO: 76810 - DNA, 112 bp, Mus musculus
tggacgaacccaatttatatcacctagcaatttctggaaatcatttaatgtttttaaatgatctttacgtgattctatcttttgaggtgtaataaaatgtggagtaactcca

SEQ ID NO: 76811 - DNA, 85 bp, Mus musculus
cacacacacacacacacacacacacacatacacacacacagatatatatgtatgtgtgtctgtctgtctgtctgtctgtgtgtgt

SEQ ID NO: 76812 - DNA, 63 bp, Mus musculus
gtgccagagactgcagtttgtgacctcagaggtacatagaagagaggtcagctacagtggcat

SEQ ID NO: 76813 - DNA, 85 bp, Mus musculus
gctttctcacctgtctatggacaaggaaggagatgatgttaatattggtcattcatagcttgagtagacattttgttcaggaagc

SEQ ID NO: 76814 - DNA, 81 bp, Mus musculus
aggggagtgagtctgtctgtctgtcatggtggtgggtctccatccatctgttgtggggatggattggtatctctctctctt

SEQ ID NO: 76815 - DNA, 92 bp, Mus musculus
gggttatttggttttctgacgtcttaacttcttgagttctttgtatagtttggatattagctctctgtcagatgtggggttagccaagatct

SEQ ID NO: 76816 - DNA, 115 bp, Mus musculus
gcagatgagaataaatacagagacccacacccagacattatacaggagtaagaaactttttttttcaagacagggtttctctgtatagtcctggctgtcctggaactcactttgt

SEQ ID NO: 76817 - DNA, 79 bp, Mus musculus
tcacagaagagagtgtggaaggattgtaggacccagaggtctaggttctctgctgtatgattatcttctttctatgtga

SEQ ID NO: 76818 - DNA, 68 bp, Mus musculus
tgcttacatcctggtctgtggtgagaaaacagactgtgcatgcccatggaccaggtgactgtagtgca

SEQ ID NO: 76819 - DNA, 91 bp, Mus musculus
tttgcatctttttattcattccccttatttactcagtgcttaaagcacaatagtgcttgataatgtttgaatagatgtaagaagagtggat

SEQ ID NO: 76820 - DNA, 116 bp, Mus musculus
ctgatgactaatggcatagtgattaaaaatcagcgggctctggggtgtaaagaactactttatttatatatgtgccatggaacaaatcacataacttccatgcatgtctgtttcag

SEQ ID NO: 76821 - DNA, 81 bp, Mus musculus
gccatttggactgtgtgtgagcgtgtctgtgtgtgtgtatctgtgtatacacatgcacatgcaaacgtagaggccagaggt

SEQ ID NO: 76822 - DNA, 85 bp, Mus musculus; identical to SEQ ID NO: 57470

SEQ ID NO: 76823 - DNA, 103 bp, Mus musculus
cctccgtgtaccagtcctgccaggggagatgtctccagggagtgctctgtctctgagactcagggaagatctccattttctctctagtgactgtcaaaggtgg

SEQ ID NO: 76824 - DNA, 81 bp, Mus musculus
gggggagcaagaaaggggaaatagagacttgtgaattattaatatccattgtctctccatctctctgtctctgtctctgtc

SEQ ID NO: 76825 - DNA, 85 bp, Mus musculus; identical to SEQ ID NO: 57439

SEQ ID NO: 76826 - DNA, 108 bp, Mus musculus
attgatctgcatgtgtagaagattgacatttgcatgtaatgttcattttatatgtataagcatatgcatttgtttacttatatatacattcattctccctcgttcagt

SEQ ID NO: 76827 - DNA, 102 bp, Mus musculus
catgaacacaacaggagatctttctgtcttataatagtctttatttctttctttaaagacttgaagttatttgaggctatcatgaaaggtattgttttcttg

SEQ ID NO: 76828 - DNA, 83 bp, Mus musculus
gcagaggaaagaccactgagcttcaggtgaattagccagtgagagctgacttcattcagttgtgtgactctgtgtctccctgt

SEQ ID NO: 76829 - DNA, 94 bp, Mus musculus
acacacatatatgtatatatatatacacatatacatacacatatgtacgtatgtatgtatgtgtgtgtgattatatatatatataaaatgttgt

SEQ ID NO: 76830 - DNA, 99 bp, Mus musculus
ggatgttcatgggcttctcttttttttaggttagagaaattttcttctacatttttgttgaagatatttactggtcctttaagttgggaatcttcattc

SEQ ID NO: 76831 - DNA, 118 bp, Mus musculus
gacattgggcccaaatgtgagaggtcagtgtgctcaaggatctcctgcaaatatatatatatatatatatatatatttggtttttgaggcagggtttctctgtatagtcctggctgtc

SEQ ID NO: 76832 - DNA, 85 bp, Mus musculus; identical to SEQ ID NO: 58391

SEQ ID NO: 76833 - DNA, 78 bp, Mus musculus
gtcttgtgatggctcagtgtcccagtgtaggggaatgccagggcagggaggcagaagtgggtgagcagatgcataagc

SEQ ID NO: 76834 - DNA, 76 bp, Mus musculus
tgggttccccatgaacatgggagtcttcaaagcccacctatgcagtgacagactctctctaacaaggacacaccta

SEQ ID NO: 76835 - DNA, 106 bp, Mus musculus
gtgtggttactaacagtaatggattgaatttaacgtgcctagtttttatatctcttttgaaaatctgttatttgtatttagtttatatgagtgttgcccgccatac

SEQ ID NO: 76836 - DNA, 93 bp, Mus musculus
tccatgttgatctgataggatgcatgggacaatttcaatatttttgtatctgttgaggagtgttttgtgacacattatatggtcagttttgga

SEQ ID NO: 76837 - DNA, 79 bp, Mus musculus
atatgtatatatataatgtcaaatatatatataaaatgatgtcaaatatatgtatgtatgtatgtatgtatgtatgtat

SEQ ID NO: 76838 - DNA, 72 bp, Mus musculus
gtaacaggtatagcatcatattcatggggatgccctaattattggagcagaggctatctctcactctgttac

SEQ ID NO: 76839 - DNA, 116 bp, Mus musculus
gccttagtgcatggtgatctgataggatacatgggacaatttcaatatttttgtatctgttgaggcctgttttgtgacctattatgtggtcagttttggagaaggtaccatgaggt

SEQ ID NO: 76840 - DNA, 115 bp, Mus musculus
aggtgttcatcaaagactgatggaaaaggcggaggtgggacttgcagagtctctgactgacaaactgcctgacttccatgtctctgccaaagactccatcagcctcagtgtgcct

SEQ ID NO: 76841 - DNA, 96 bp, Mus musculus
atagtatatataaacagtatacaatatatacatatatatgtgcatatacagtatatatatatatatgtatatatgtatatctatctatctatctat

SEQ ID NO: 76842 - DNA, 104 bp, Mus musculus
gcttatatatgtatactatgtgcatttgtatacatatatttgcatgtgaagattatattaatatatgcatataaatgcctacttgagtatgtaacctattgagc

SEQ ID NO: 76843 - DNA, 86 bp, Mus musculus
gtccatggtggtctgataggatgcatgggataatttcaatatattttgtatctgttgaggcctgtttcgtgaccaattatatggtc

SEQ ID NO: 76844 - DNA, 113 bp, Mus musculus
tgtgtgtatgtatgtatgtgtgtgtgtatgtgcctgtacatgcatgtgtgtctgtatgtgactgtgtgtgtgtatgcataaatgtgtgcatgtatgtgtacacatagtatcac

SEQ ID NO: 76845 - DNA, 70 bp, Mus musculus
tgtctgtctgtctgtctgtctgtttattaacctatatatctatatagccaggcatgacagcatgcaccca

SEQ ID NO: 76846 - DNA, 75 bp, Mus musculus
ggagacagctgctgcagccaggctgcctggtttggtctcctaaccatggctgccgcgctgactcactctgtcacc

SEQ ID NO: 76847 - DNA, 81 bp, Mus musculus
gttgtctgaagtttgacagcactttgatttatagaggtagcattttctctatgctgggtagtgctggaggttcagctagat

SEQ ID NO: 76848 - DNA, 100 bp, Mus musculus
agctaccttctgggctagagagatgatggctcagcgattaagagcacagattgctcttccagaggtcctgagttcaattcccagccaccacatggtggct

SEQ ID NO: 76849 - DNA, 78 bp, Mus musculus
gatgaagggatggcaggatagcagtggaagagtgaatcaaactgcctcgctgttttctgtctgcctcagtcactcttc

SEQ ID NO: 76850 - DNA, 109 bp, Mus musculus
tcccttggtgttagctccaatagaggcatacggctaagacttggagtagattgaggtttgctgagtgactgactgactgtctcgagcctgcatagacaagctcaaggga

SEQ ID NO: 76851 - DNA, 66 bp, Mus musculus
gttcaacagagtaggcagagagggcttgcctagagctctatacctctgtcaaggaccacatggaac

SEQ ID NO: 76852 - DNA, 79 bp, Mus musculus
cctcccaaggtcaggactctgctagatttgcccagacttataaggagctctgagcttgtaggttcttgactctacaagg

SEQ ID NO: 76853 - DNA, 75 bp, Mus musculus
tcgtagggcacatcctacccttggtcagattcacccacactgatcagagagagaggactgtgtggccacctaaga

SEQ ID NO: 76854 - DNA, 113 bp, Mus musculus
ctgcctgctctgggttcttcacctctgtctgtctgcctgcctcagtctatctatatttattcattgtctggtatgtagtagcacttgcttgtcctggcctacatgtaaagcag

SEQ ID NO: 76855 - DNA, 86 bp, Mus musculus
ggagagggtgggggcaggcatggaggatatgcttaaagtacgttgtatacttatgttaaaatgtccttatgtaacccaacgtctgc

SEQ ID NO: 76856 - DNA, 120 bp, Mus musculus
agatggactaatagatatcagagttgaaagtattgaaagattaaaagaagatatatcttcatctaagtatctatctatctatctatctatctatctatctatctatctatctatctatct

SEQ ID NO: 76857 - DNA, 96 bp, Mus musculus
gaagtgtattagagatatttgctgagatatttgcttgtaggctagagccttaaattatgaaaccagtatggtctacaccaatatttcttatgtttt

SEQ ID NO: 76858 - DNA, 74 bp, Mus musculus
ttgaggcagtgtgtccagccctggcattaatcaatcagacttgagtgaacagagtggctacagattgcctacag

SEQ ID NO: 76859 - DNA, 118 bp, Mus musculus
tgcatgctaagcaagcactgccaaatatgctatatttccagaattttggagtttttaataggttttttcttttctttttttttgttttggagtgtgtgtgtgtgtgtgtgtgtgtgta

SEQ ID NO: 76860 - DNA, 111 bp, Mus musculus
ctgatataccagttcatagtttgaattgaactacttcctagtttcatggattattttttctttgaaatggaatgaaatatgtgttcagtctatctgctgattttgtattag

SEQ ID NO: 76861 - DNA, 117 bp, Mus musculus
gagttaggtgtctgggactggagagacagtgacaactggagcggtgtcagcaactaagagcactgactgctcttccagaggtcctgagttcaattcctagcaaccacatggtggctc

SEQ ID NO: 76862 - DNA, 58 bp, Mus musculus
gagtgcagtctctgagggggtagagcacagcgcttcctcactcactgtgtctgtactc

SEQ ID NO: 76863 - DNA, 71 bp, Mus musculus
agtaggtcactgggggtgggggccttaaaggtcatatcaggcctctggttgtcacactctctctgcttact

SEQ ID NO: 76864 - DNA, 98 bp, Mus musculus
tccaggcctctcttgtacttattgctacatatatatgagtatatctaaatgtttatgtttatacacatgtattgtccaatatttaggctcaatctgga

SEQ ID NO: 76865 - DNA, 97 bp, Mus musculus
catgttttaattataggagaatctctagagtgatggctacattttttttctaaagttaaagaaaagtaccattgcttcttctttaagcaaaacgatg

SEQ ID NO: 76866 - DNA, 69 bp, Mus musculus
gggctttgtgcatgtgtggctgtgtggatgtacttgtatgtgtgtgtgcctctgtgtgtgcctgtgcct

SEQ ID NO: 76867 - DNA, 91 bp, Mus musculus
gagagctttccattctgagacagagaagacagtcagcacctccactcagctggcatctgccccgcctgccccgccctctcagaggagcctt

SEQ ID NO: 76868 - DNA, 73 bp, Mus musculus
gtttctctgtgcctctctggctgtcctggaacttgctctgtacaccaggctggcctggaacccacagagatac

SEQ ID NO: 76869 - DNA, 93 bp, Mus musculus
gggcttttcagctgcgagtgtccctttttgttgtgtttttaatcatcgttggaatgaggaatgaagtaagagagcagccacatccaggagctc

SEQ ID NO: 76870 - DNA, 73 bp, Mus musculus
gaagccaggtcagaaaagcaggagtggcagtccttagaggcacaaatctgactggctgtctgcctcctggctc

SEQ ID NO: 76871 - DNA, 83 bp, Mus musculus
cagttcactactactcctaccaacctacagccctactctctgggaaggaagatgggacaaagatgagagaagagtgtgagctg

SEQ ID NO: 76872 - DNA, 138 bp, Mus musculus
tcagagatttcttcttgtggtgggttcatgcctcttgaagcatagggagaaggctttgtctcacacactctcactgtcaagtagtcccgcttttgtttctgaccatttagattggtgttggtatgtgtaataagacaa

SEQ ID NO: 76873 - DNA, 108 bp, Mus musculus
cgtgagatttttgtttaggttatatattcacatatatgtatatatatacatacacttactgtacatatatgtgtgtttattactttgtgacataaaatgtgttttgtg

SEQ ID NO: 76874 - DNA, 107 bp, Mus musculus
atgttagaatccaggtctctgtctgctgtctcattattgatgtgactttattttttaattacggggcatctgactagtgattcgaatcacagagtttgtcgtgacgt

SEQ ID NO: 76875 - DNA, 101 bp, Mus musculus
gccgagaaaggctcctcaaaagagccttcagagaagtcactgaacaaacaaaaacagtggagtgtgcttgttttgggggggcccatggggcttttttcagc

SEQ ID NO: 76876 - DNA, 113 bp, Mus musculus
gtgccttacctttattatcctaagatctgcgccatgctatgttctctctcccagactgtctcgctttgggttggaccttggcatcgtgtggaagtgaagctgctatcaggtgc

SEQ ID NO: 76877 - DNA, 118 bp, Mus musculus
ccgagtgctgggattaaaggcgtgcaccaccatgctcggctagaacacttacttttttaatcattaaagtaaatttttacacagggtgtggtggtgcacgcccttaatcccagccagg

SEQ ID NO: 76878 - DNA, 92 bp, Mus musculus
gagtgatggtgacacattcttttaatcccagcacagccagggctatacagagaaaccctgtctgtctgtccgtctgtctgcctctctcactc

SEQ ID NO: 76879 - DNA, 114 bp, Mus musculus
gcttcagagatgtgatttgtcccaagttacagtagctagtttagaaccaagattatctctgcctgtctgtctgtctgtatctatctgttttgagacaggatctctctacatagc

SEQ ID NO: 76880 - DNA, 114 bp, Mus musculus
ggactagagttcgcagctatgtccagcgaatgtggcaaagagtagttagttagcacagccttaaccttacttgatctgttcagtattcaaacgaaatggaagttgctctagttt

SEQ ID NO: 76881 - DNA, 63 bp, Mus musculus
gtgcttaagtgtgcacttaggttactgtgccacagcagtagtcctgtgtgtgtgctctggcat

SEQ ID NO: 76882 - DNA, 98 bp, Mus musculus
ggcctctgacagacacggctgctgctcagggatatgcacatactatttttttcttagaaaataattgtatgcctgctgctgctgctgctgctgctgct

SEQ ID NO: 76883 - DNA, 97 bp, Mus musculus
cgtgttgcttggtaggtgggctaagaccatggtacagggctcttttccaaaaagagaagagagataccacagacacagcctccacgtgtgtggcacg

SEQ ID NO: 76884 - DNA, 94 bp, Mus musculus
gtcgtttggtgtgaacagagtaactttgtgtctcatgagagtagtgagtcacatcactccttcactggcacagtcctcttaaccacttcttgac

SEQ ID NO: 76885 - DNA, 57 bp, Mus musculus
caggctggagagacggctcggtgattaagagtactgactgctcttccagaggccctg

SEQ ID NO: 76886 - DNA, 81 bp, Mus musculus
tgtgtctctgtctgtctgtctgctcgcatgtgagtgctgcatgtttgcatgccacagtgtgcatgtagaggtcagaacaca

SEQ ID NO: 76887 - DNA, 82 bp, Mus musculus
ccaggtgccctgtctctgtctcactgtgtccaggattctaatccccagtcccctgctttggctcagagctcaggagtgcagg

SEQ ID NO: 76888 - DNA, 103 bp, Mus musculus
ccacagaaagaaaatagtgtgactgaagagatggctcagagtttaagagcactgactgctcttccagaggtcctgagttcaattcccagcaaccacttggtgg

SEQ ID NO: 76889 - DNA, 95 bp, Mus musculus
gggcttaaagagtttggcttattggaagagaacatgctgtctgctcctgggggaatgcctctctgacacagtgtcacccttatatactgaagccc

SEQ ID NO: 76890 - DNA, 74 bp, Mus musculus
atcctaggtactcaaagaggatgagtgtcacacaagtctgtaacactctgtgtcatttgtgtgaagtttgggat

SEQ ID NO: 76891 - DNA, 73 bp, Mus musculus
tagaacttgctatatagaccaggctggctttgaactcacagagctctgtctgactctgcctcttcaagtgctg

SEQ ID NO: 76892 - DNA, 83 bp, Mus musculus
cagaataaccatctgagggcaacaagaaggtagtttagttgaacatgactaagtagctatgttggttcaaacttcagagtctg

SEQ ID NO: 76893 - DNA, 87 bp, Mus musculus
gtgtgcatgtatgtgagcatgtgcatgtggaattaacgatgcattaatcgttattttagttatgtgcatttgcatgtgtctgtgcat

SEQ ID NO: 76894 - DNA, 92 bp, Mus musculus
tacaatgcagctcttgggatgtaaacagagaatgcctagtatgtagtaaagtaaatatgctaatattttccattccacttactgttctggta

SEQ ID NO: 76895 - DNA, 112 bp, Mus musculus
gcttatcacggttcccatctcttctatgcattgtctgttcagaagtttcattttctatttgtaaaatctcttaaaagactatgcatgattctgaatttggtgttaggtctgt

SEQ ID NO: 76896 - DNA, 58 bp, Mus musculus
gttggtactgtagggaggtcagctgagtgctttctctgcctctctgacacatccacac

SEQ ID NO: 76897 - DNA, 197 bp, Mus musculus
gtgtgcgtgcatgtgcacgtggatgagtatgtgtgtgaatgtgagtgtgtgtgcatgtgcacgtggatgagtatgatgtggatatgagtgtgtgtgcatgtgcacgtggatgagtatgatgtggatgtgagtgtgtgtgcatgtgcacgtggatgagtctgatgtggatgtgagtgtgtgtgcatgtgcacgtggat

SEQ ID NO: 76898 - DNA, 67 bp, Mus musculus
gtgtgtgtgcatgtgcacatggatgagtctgatgtggatgtgagtgtgtgtgcatgtgcacgtggat

SEQ ID NO: 76899 - DNA, 83 bp, Mus musculus
atagtgggaagtgtttgggagagtggccttcggggggtatactctagtactctctctctgtctttctgactctgtctctctat

SEQ ID NO: 76900 - DNA, 104 bp, Mus musculus
gggccacgctaatgtaggcttggctcttagtcaaatatgtctggttgtccttctaatgagacacacagacacacagaaggagcaggcagaaatcagtggtgctc

SEQ ID NO: 76901 - DNA, 106 bp, Mus musculus
attgtctcttacttcttaaatagtgacaggttttggtctgtttctatttaaatttgaactgtggctatacattaggtttctgtcattgtaacagaatattggcaat

SEQ ID NO: 76902 - DNA, 106 bp, Mus musculus
cagagaccagaggaagaattaggtgtgctgctctgtcactctgtcatttccttcagacaggatctctcagtaagtatggcactccctgttgttcctatgctgactg

SEQ ID NO: 76903 - DNA, 115 bp, Mus musculus
gtgttgccgtggctggcctgaagcctgctatataaattgggctgatcttgaacacatgtctgtctgtcttctaaatgctaagatgtggtggtatgagccagcacacctggtttat

SEQ ID NO: 76904 - DNA, 75 bp, Mus musculus
gtcagggcagacttgtttaaggctgaaaatggtgtctatcctagggacattgtctgaagacacactgctcctagc

SEQ ID NO: 76905 - DNA, 73 bp, Mus musculus
gatgctgatgggaaagatgcagtggagttagtgcacctgggcagtgccactcactgtctttcttctgagaatc

SEQ ID NO: 76906 - DNA, 92 bp, Mus musculus
gctcaaggcaccaacagtttcactctgggataagtgagccagagacctctctgtctctaagtgtctaagagaattctgatgccagtagatgc

SEQ ID NO: 76907 - DNA, 67 bp, Mus musculus
ctctgggtatgtttcttctctgcctccagttctacacatgagggtggggagggaaacaaccctgcag

SEQ ID NO: 76908 - DNA, 110 bp, Mus musculus
tttctctatatgttatatagagtaatatacatgtatatatttatatatgcatatatatatatggataaatgtgcatagatcatgtatatggagtactcatacgagagaga

SEQ ID NO: 76909 - DNA, 102 bp, Mus musculus
aaatggaagcttctagaaagttgtcagtagatgatgagataagaaatgttttccatttatctatctatgtatctatctatgtatctatctatgtatctattt

SEQ ID NO: 76910 - DNA, 112 bp, Mus musculus
gtggttagagaaagtatctgggacaggaacaggctaggtctggtactgtagtgaggttcttgaagcccttccttgacatatcttggctctgtttgtcactttctcatacttc

SEQ ID NO: 76911 - DNA, 104 bp, Mus musculus
gtatttgcctgacagctatcttggtgccctgggtggagtctatcgcagtgctagaaatctcacaggaccacattagaattctgctgacaaggatgggtaaatat

SEQ ID NO: 76912 - DNA, 75 bp, Mus musculus
gcatatatgtgagcatgtattatgtgcatgcatatgtgtgtttgtgcatgtgtaagtgcattcactaatatatgc

SEQ ID NO: 76913 - DNA, 91 bp, Mus musculus
cttgctgcaccactgtctgtgccactgacagtctgtctccacacagagatgcctggctaaagcactggcccatgaaaaatatgtttgtaag

SEQ ID NO: 76914 - DNA, 76 bp, Mus musculus
acaggcacacacagtctgacatggtctaggaactactttcaattcccatcaggaccgtgtactttgtgttgtttgt

SEQ ID NO: 76915 - DNA, 113 bp, Mus musculus
gcttcttcactggtccactccattaagggaatgtggtctatgagtctctctgagtacctgtgcgcagaggctactgtcacatgacccgaagtggattactaagcgacagatgt

SEQ ID NO: 76916 - DNA, 114 bp, Mus musculus
gtgacttattcagccaatatgatggaatagcactcttgttcagaaattgtctccttggtttatttatttttagacaatgttttactatgtagccctggctggcctagaactcac

SEQ ID NO: 76917 - DNA, 75 bp, Mus musculus
tgtatgtatgtatatgtgtatatgtgtgtgtatatatgtgcatgtatatatgtacatatatataaatatacatgc

SEQ ID NO: 76918 - DNA, 82 bp, Mus musculus
gtgtagggctggagagatggctcagtggttaagagcaccgactgctcttgcagaggtcctgagttcaattcccagcaaccac

SEQ ID NO: 76919 - DNA, 91 bp, Mus musculus
tttagtccaggatactctagttcacaatcctgttgtctcagtctctcaagcactggaattacagctgtgtaccacaatgcctagctctgaa

SEQ ID NO: 76920 - DNA, 132 bp, Mus musculus
atcagagaatggctttaaatttctcatctcctgcctccacctcccgagtgctgggatgacagatttgtgtgagcacagctggtgtgggcagtgctgggcatggaagccagggcacatgtcaggcaggctctc

SEQ ID NO: 76921 - DNA, 95 bp, Mus musculus
ggtgtgagttgacaggtcacaatatgtccagagtcagtagacagagaggtgaatgctggtactcagcccacaccctccgttttatttagtctagg

SEQ ID NO: 76922 - DNA, 83 bp, Mus musculus
cctgggaaccacacactctctgtgtcagccctgctgagggaatacttgaaagcaaggggaagaccccagagtgtgctctgagg

SEQ ID NO: 76923 - DNA, 82 bp, Mus musculus
ctgtgtgacacactgtgacacagcatagcttcctcaatgagcgtttttgtttgtttgctttgtgtgtgtgtgtgtggggggg

SEQ ID NO: 76924 - DNA, 96 bp, Mus musculus
ttaatccacatctaccctgacaatatttatatttctgtcttggacaaccacagccaagataaggagatttaatctgttggcacaagagctggttga

SEQ ID NO: 76925 - DNA, 129 bp, Mus musculus
gtccagcaggcaggcaggcaggcttcgtgcgctcattcacactgaaactgttgtctgggaccaggtgtgataaaccatgtgccaccagtagagtctttcagagtagggagagttgcgatttctgagttt

SEQ ID NO: 76926 - DNA, 84 bp, Mus musculus
tcctcttaactgagccatctctctagctccctctctctgtttcttgacaagagaaagactgactaccttggctctgtgagagga

SEQ ID NO: 76927 - DNA, 111 bp, Mus musculus
tatccactctgcctttccttctgcaaaagggttccccaggcccatagtgtctgtggctgttgtttctggaggtttgggagggaggctgcagaaggcacggttcagcgggtg

SEQ ID NO: 76928 - DNA, 93 bp, Mus musculus
ttgtcctggaactgggtctgtgtagatcaggctggtttcaaacccatagaaatcagtctgtctctgcctctgcctccagagtgctgggatcaa

SEQ ID NO: 76929 - DNA, 63 bp, Mus musculus
tgggactcagtctatagatcaggtgggcctcaaactcagagatctgtctgtatctgactccca

SEQ ID NO: 76930 - DNA, 95 bp, Mus musculus
tctctctagcccccgactcatatttttaacacataatttgataatttgttcatcaaatgataatgtgagtaggtccagagaagagggaagagaga

SEQ ID NO: 76931 - DNA, 121 bp, Mus musculus
acacacacacacacacacacacacgtatatatacacatacatatatatgtatatatgtgtgttgtgtatatatgtgtatacatgtacatgtttgcgtatatatatatatatatatatacag

SEQ ID NO: 76932 - DNA, 74 bp, Mus musculus
tatttgaaatatatgacactgtggtagtgttttaaattctagagacacaccagagtgatctatgtgtgcaaatg

SEQ ID NO: 76933 - DNA, 95 bp, Mus musculus
gaacattcttggatcttatttgctgtttcattaaatatatatgtcaatttaattaaagttggcatctcaacagcactgagctttcccatatgttc

SEQ ID NO: 76934 - DNA, 107 bp, Mus musculus
tctatctatctatctaggtttatatgtgtatatatatatgtgtgttttgtttatatatataaacaaacatatgaatgtacatgtataagcatgtgtgtgcagataga

SEQ ID NO: 76935 - DNA, 62 bp, Mus musculus
acactcacacatgcacacacacacatgcacgcgcgtgtgtgtatgtatatatgtatatgtgt

SEQ ID NO: 76936 - DNA, 114 bp, Mus musculus
gcaaagccattgcagtagacacagaattttaaaaatgtttgcccagtattgaagtttaaggtagaaaaccaagacttctctgctataacattttggatggtttacacatggagc

SEQ ID NO: 76937 - DNA, 115 bp, Mus musculus
ggacaaagacaagagcacacttcatactttaagatattgtccaataatgaaaaagcttgaatacctattttcattataattatgcagttttgtgatagtgaattctgtcatgttc

SEQ ID NO: 76938 - DNA, 112 bp, Mus musculus
gccttagttaatggaggtctgattggatgcatgggaaaatttcaatatttttgtatctgttgaggcctattttgtgtccaattatatggttaattttgaagaaggtcccgtg

SEQ ID NO: 76939 - DNA, 85 bp, Mus musculus; identical to SEQ ID NO: 57439

SEQ ID NO: 76940 - DNA, 88 bp, Mus musculus
ttccattagctgctgggagaaacacaaaggatatccaaagaaatgaagctttgcagatggatgtgtagcactgtgcagaattttggaa

SEQ ID NO: 76941 - DNA, 80 bp, Mus musculus
tgtggaagacagaaaaaagtatgtaaatatgtggtcatctggcaaacagttgtgaagtacttgctctgtaaactttcaca

SEQ ID NO: 76942 - DNA, 114 bp, Mus musculus
cagataggatagcagttccaaattagtggtcaggcttcctgcatctgtctctctgtgagatattgggacacttgccaggagtttggcacttttactctttgactataattattt

SEQ ID NO: 76943 - DNA, 95 bp, Mus musculus
gcagattgctgagaaagtgctgtaaattgcatgtctgttcatatttaataattgtagtgttgcagactgtctagtatttaataatagtaatttgt

SEQ ID NO: 76944 - DNA, 123 bp, Mus musculus
taggcaaggtatggggccagctctcctgggtattgcaggaagtgaggagcagggccagctctctggctctcagtgaccctagggcgatctttcttgcctgctgtagatggtaaggggctaggg

SEQ ID NO: 76945 - DNA, 109 bp, Mus musculus
gaataaacttaagagcagagcagagcagagttttgaaaatagtttgtataatttctactcattttgtttttaacacaatactgaaaaatatttgcattatggtttgttt

SEQ ID NO: 76946 - DNA, 90 bp, Mus musculus
aggatgcatgaccagcacttgatgacccatagaagctgaactcaatgccatcttcagaggattcttgtctcacaatgccatgtgcatgct

SEQ ID NO: 76947 - DNA, 63 bp, Mus musculus
gtatgtgtgtgtgtatgtgtgtgtgtcttataagagagagacacagagtgagaatatacatat

SEQ ID NO: 76948 - DNA, 83 bp, Mus musculus
catgcatttagactttctggtctgagaagctgaacatagaaaataatctttgtttattattagaccaaaacatttggtggatg

SEQ ID NO: 76949 - DNA, 78 bp, Mus musculus
tatgtatgtatgtatgtatgtatgtatattggtatatggatgctgtgtggtgtgtgtgtgtgtgtgtgtgtgtgtgtg

SEQ ID NO: 76950 - DNA, 85 bp, Mus musculus
gttggctgtctgttgtgttattccctggcagaaaggaattgtattcagggtatgcaaatggattgatattatgagtcatgttggc

SEQ ID NO: 76951 - DNA, 73 bp, Mus musculus
tatgtatatatatgtgtgtgtgtatatccatctatatctgtatttatatgcatatatatatatatatatatat

SEQ ID NO: 76952 - DNA, 91 bp, Mus musculus
tgttaactagggcaagcagcaaagactgtgggaaatatgtccagtccagttcacaaatcacagggactttgctgtcacagacctggataca

SEQ ID NO: 76953 - DNA, 113 bp, Mus musculus
tcgatggtagagatcaagcaattccaagagcttcaaaatgaatggagaatgtgtatacacactttttttttttttttgagatttgaactaccttgttttgttttggccatgga

SEQ ID NO: 76954 - DNA, 97 bp, Mus musculus
tgtgcttgtgtgtatgtatacatgtgtatgtatgtgtgtgaatgcctgtatatgtgtgtatgtgcatgtgcatatgtgtgtatgccacctgggtaca

SEQ ID NO: 76955 - DNA, 85 bp, Mus musculus; identical to SEQ ID NO: 57439

SEQ ID NO: 76956 - DNA, 80 bp, Mus musculus
atggggatgggaagaatggtataggtgtccatttaaaggccgagtgtccatcagtcactcattctctctgcatcaaccat

SEQ ID NO: 76957 - DNA, 130 bp, Mus musculus
tctccttttgttgtctaattgctctagataggactttgagtactatattaagcaagtagagagagaggagacagccttttctagtccctgattttagtggtattccttcaagtttctctctatttagttt

SEQ ID NO: 76958 - DNA, 115 bp, Mus musculus
ttatatatatatatacatatatatataaaaaactaaaattatatatactcacaaatatgtgtgtgtgtgtctgtgtatgtgtgtctgtgtgtatctgtgtatatatgttgtgtag

SEQ ID NO: 76959 - DNA, 110 bp, Mus musculus
cctatttaaatatccagatagtctgtgtgaacatttgtttttcatttgattaaagcaattggaaataatgcaattatcacctgcaagaacatctgtttggtgcatatagg

SEQ ID NO: 76960 - DNA, 66 bp, Mus musculus
gtatgtatgtatgtgtgtatatatgtatgtaggtaggtatatgtatgtatgtatgtatgtatgtat

SEQ ID NO: 76961 - DNA, 85 bp, Mus musculus; identical to SEQ ID NO: 57439

SEQ ID NO: 76962 - DNA, 121 bp, Mus musculus
ctctgaacccatatacacaattaacattatatgaagtcaagcattgttattttatacataaaatagcaatgaaaattagccatgattttgaggagaatggggaagggtatattccaggttt

SEQ ID NO: 76963 - DNA, 94 bp, Mus musculus
ctgttacccggttgccttgtggagtactgtactttgtattttctgaaaataaagagagggcacacacacacacacactgcagcatagaaaatag

SEQ ID NO: 76964 - DNA, 113 bp, Mus musculus
tcttgatacaattatggattctgattgtttagacatacaatgtaaacaagtatgaggattatttttttgtattggttgtttctagatggattctgtgagctatgattgtcaga

SEQ ID NO: 76965 - DNA, 68 bp, Mus musculus
tgtatgtatgtgtgtatctgtgtgggcatgtatgtatgtgtatgtacacacacacacacacacacaca

SEQ ID NO: 76966 - DNA, 66 bp, Mus musculus
gtgtgtgcctgtgtgtgtgcctgtgtatacctgtgtgtgtgcacctgtgtgtacctgtgtgtgtgc

SEQ ID NO: 76967 - DNA, 72 bp, Mus musculus
gagtgtggcttgttataggtccacagccatttggaattccaccaactgtggatttgcaatgtatacacattt

SEQ ID NO: 76968 - DNA, 73 bp, Mus musculus
ggggcagcagcttctgtccattgggtgggtgaaaatatctgtctctcactctttcagctgcttgttaggtcct

SEQ ID NO: 76969 - DNA, 89 bp, Mus musculus
cacacacagacacacacacatagacacacacacacagaggggagaaaagagaaagaatgtgtatatatgtatgtgtgagtctgtgtgtg

SEQ ID NO: 76970 - DNA, 88 bp, Mus musculus
atacacatttgatgtatatatgtatatatcatgtatgtatataatatatcattacataatgtatgtgtgtgtgtgtgtgtgtgtgtgt

SEQ ID NO: 76971 - DNA, 102 bp, Mus musculus
aacatataacatattcaatcatatatatatatatatatacacacacatatatatgtgcatatatatatatgtatagtttgtccattgaggatttatattgtt

SEQ ID NO: 76972 - DNA, 67 bp, Mus musculus
gtctcctgagaggctctgacagtgtctgacaaatacagaggtggatgctctcagccaatcattggac

SEQ ID NO: 76973 - DNA, 106 bp, Mus musculus
gtagaaacatcactatggggttggagagatggctcagcggttaagagcactgactgctctgacagaggtcctgagttcaattcccagcaactacatggtggctcac

SEQ ID NO: 76974 - DNA, 94 bp, Mus musculus
gagtaccaggctgttcctcaaaagatcttttcaattgtctgttcaatgaattatgatttcagttgagacagtttcagaggacagcacaaggctc

SEQ ID NO: 76975 - DNA, 96 bp, Mus musculus
cttctattgggttgccatgtccaacctcaacatgatagattttgcttcatcttagtatatattattttctcatgtttggttgttacctcttagaag

SEQ ID NO: 76976 - DNA, 110 bp, Mus musculus
tgttgttacatgctcatatgtatatttgtgtgtttatatgtataggtatatatgcatatgtgtatatatgtatatatatacacacacatatacatacacatacacacaca

SEQ ID NO: 76977 - DNA, 96 bp, Mus musculus
tgtgtatgtgtctctgtgtgtatatgttttatagtttatatatttggggtctccactatatatatatatatatatatatatatatatatatatata

SEQ ID NO: 76978 - DNA, 85 bp, Mus musculus; identical to SEQ ID NO: 57470

SEQ ID NO: 76979 - DNA, 71 bp, Mus musculus
cactgtgagccagtgggtgacctcatcctatctgaacctcttcagaactcagtcaccagactatcatagtg

SEQ ID NO: 76980 - DNA, 97 bp, Mus musculus
gggtttttagctgtattttttgttttgttttcttttttcttttgtttctcagaatgagtgaagagacagagaacatccagtggcgctttgcttgccc

SEQ ID NO: 76981 - DNA, 104 bp, Mus musculus
tctatcactgtcatatactctctctctcacacacacacagacatgcatacaaaagatacacacacacacacacacagagagagagagagagagagagagagaga

SEQ ID NO: 76982 - DNA, 65 bp, Mus musculus
gacccaggaccagcagataaagaagaggtatgagacgtgtctgtctgtctgcctgtctgcctgtc

SEQ ID NO: 76983 - DNA, 96 bp, Mus musculus
agtgagtgaaacgtttccttttacgaccagatcttgttccaggcttctctgccaggagggaggaatgcaggctagaagtgaggaatgggtaccact

SEQ ID NO: 76984 - DNA, 85 bp, Mus musculus
ctctaaagcaaattggccatttctcactgagccaggcagatagtctgtgtgcctctcagtgactgtggctaaaaatgcacaggag

SEQ ID NO: 76985 - DNA, 109 bp, Mus musculus
gatgcaagacatggcagtgagtcttcctgatcaactagtcaccagccaacacgccagctggtgacagatgtatgagtggacctgttgagatcaactgaactgtcgcatt

SEQ ID NO: 76986 - DNA, 100 bp, Mus musculus
ctgttgcattgtaagctcatgatgagaagacattttgttcatctctaatcaacattacctagcatgtcttcaacatccatggagcataggtgttaaacag

SEQ ID NO: 76987 - DNA, 73 bp, Mus musculus
tgggcaggagcttgttgagacactagactgagtagctaattagctccagagatctgtgtgtctctctctccca

SEQ ID NO: 76988 - DNA, 81 bp, Mus musculus
cctttttgtatgtgtatatgttcttacatgtgtatgtgaataaggatgtacaggtacatatatatatatattctgataagg

SEQ ID NO: 76989 - DNA, 62 bp, Mus musculus
catatagggaggtgccatggagggaactgctgttctttctccactgtctctctctctctgtg

SEQ ID NO: 76990 - DNA, 133 bp, Mus musculus
caacaactgatggtgaagggggaaagatgcaagctcaggattaaccagggtagagtctttatctgcaactccatcttgttggcctgtggagaggactaaagaagcctaaggtgtggaagcttttattctgagt

SEQ ID NO: 76991 - DNA, 86 bp, Mus musculus
atgaggacctattgacagtggatgacttctgggagggaagagtcagttttccttcatcggcaaatcactctatcaggtggtcccgt

SEQ ID NO: 76992 - DNA, 112 bp, Mus musculus
tgcccaggggcaggagagtgagacatagggaagggtagaggctgactctcactgtctgcctggggcgagacaggagccaactgtctctgttgggcctgatcagtagacagtg

SEQ ID NO: 76993 - DNA, 69 bp, Mus musculus
atctatgtatatatgtatatagtatgcatatctatcatctatgtgtgtatgtatgtatgtatacatgat

SEQ ID NO: 76994 - DNA, 77 bp, Mus musculus; identical to SEQ ID NO: 67623

SEQ ID NO: 76995 - DNA, 57 bp, Mus musculus
ctcagtggtgctcagtctctgtctctaagagatagacttgattgaggtgcaattggg

SEQ ID NO: 76996 - DNA, 105 bp, Mus musculus
gtggaatgagacaccctaaatgtaggtggcgccattccatggtctggagtccctgactgaatagagtaagcttacaccaacattccaatatttgtctctctttgc

SEQ ID NO: 76997 - DNA, 117 bp, Mus musculus
gagagagaagatcactggtggaggccatgttatccaaagatttctgtatttgttcatgcaacaagctgaaacagtctagcgctggatggctgaggctttcttaagtgctgtcttctc

SEQ ID NO: 76998 - DNA, 77 bp, Mus musculus
acagctctgtgtgccctgaggagaatgaaggagctgctttctgtcattctcactcacccactggcccatcctcctgt

SEQ ID NO: 76999 - DNA, 92 bp, Mus musculus
gatctgataggtaagacagtctctctctgtcccctacctggaggcttccctgggcacagctggggtatacttgggaggttctaccttggatc

SEQ ID NO: 77000 - DNA, 115 bp, Mus musculus
gctatgcgaacctgttaaaacccaaatggggctggagagacagctcagcggttaagagcactgactgctcttccagaggtcccgagttcaatttttagcaaccagttggtgtggc

SEQ ID NO: 77001 - DNA, 108 bp, Mus musculus
gtgtctctggttttacgtggagttccttgatccacttagacttgaggtttgtacaggggtaagaatggatcaattcacattcttccacatgataaccgccagttgtgc

SEQ ID NO: 77002 - DNA, 73 bp, Mus musculus
ggctgcaaaggtgtaggtagaactctcagctccttctccagcaccctgtctgcctgtctgcctgcatgctgcc

SEQ ID NO: 77003 - DNA, 109 bp, Mus musculus
agtagccctgactggcctagaactcgtgtgtagaccaggctggcctcaggcttatggctttctgtctgtctctgcctccctgagtgctgtgccaccaagcttggctcct

SEQ ID NO: 77004 - DNA, 88 bp, Mus musculus
aaagtacactaacagcctgacaggagagagggaccaacaggaactgttcatggataaagggtgttctgagaggatggaagtgtggttt

SEQ ID NO: 77005 - DNA, 73 bp, Mus musculus
tgagtacagcaccagcctcagttttgtttttgagacagtctctcactatgtaacctaggctggttttgaacca

SEQ ID NO: 77006 - DNA, 75 bp, Mus musculus
gggctgaagagatgactcagtggttaagagcactgactgctctaccagaggtcctgagttcaattcccagcaacc

SEQ ID NO: 77007 - DNA, 74 bp, Mus musculus
gggagcacttcagcgggaggaggtcaagcagggtgcagccctcagtgccagcctctctctctctaaaggctctc

SEQ ID NO: 77008 - DNA, 100 bp, Mus musculus
tgtgtgtatgtgaaggtgattactctgtgtgtgtgtgtgtggcaggatagttgttcagcccaggtcagcaggtcagcccagaggaacaaatgtgcatagg

SEQ ID NO: 77009 - DNA, 77 bp, Mus musculus
gagcctacccagaaacacacacatacagcaatctttatttcaggggttgttgtctgggtggagcaaatggaaggctc

SEQ ID NO: 77010 - DNA, 83 bp, Mus musculus
agtaggagacagaatcaacgggatttctaaacaaaggcctcagcaagaaataggatgttcgttgatttgtttagatacctatt

SEQ ID NO: 77011 - DNA, 89 bp, Mus musculus
gcacacatgtgcatgcatgtgtgtgcatatgcatgtatgtatctatgagtacatgaatgtgtgtgcctgtgtgtgtgtgtgtgtgtgtg

SEQ ID NO: 77012 - DNA, 76 bp, Mus musculus
gctatgtaagcaggcagcttggtggggcagggcaggagagctgcactgactagacagaagagagccagcatttagc

SEQ ID NO: 77013 - DNA, 68 bp, Mus musculus
cctcagatcctgggtgtgtcagagcttctgggagtcaagctgcctctgagaccctgagaccctggggt

SEQ ID NO: 77014 - DNA, 85 bp, Mus musculus
agtaagattccctatctgctcagtgaacctcaatgctacgactctggtggagtcagcttgacagatgaaagtctggaagcttact

SEQ ID NO: 77015 - DNA, 111 bp, Mus musculus
gagggcccattctgagctagaacatttgccacgacccaaggagtaaaggaagccactaggatgtatagttgtttggaggctcaggggttgacaactgtcctatctcccctc

SEQ ID NO: 77016 - DNA, 89 bp, Mus musculus
gcttgctacaggatactgctctttcctttattacagagagcagacactgagaaggactttgtaaacagagggtaggttcctgtaaaggc

SEQ ID NO: 77017 - DNA, 114 bp, Mus musculus
atgtgtacaaggccctgggtaaaacaaaacaagaaggactggagagatggctcagtggttaagagcactgactgctcttccagaggtcccgagttcaattcccagcaaccacat

SEQ ID NO: 77018 - DNA, 94 bp, Mus musculus
gatggtgatgtttataggagagagttggggtctggcacccagagatcttagggatcccacgctcagtctctcaatcccatggttcaggggcgtc

SEQ ID NO: 77019 - DNA, 61 bp, Mus musculus
ctcagtgtcactggagaaggggaacgtgtgagtagcacacccagactcagtgtcactggag

SEQ ID NO: 77020 - DNA, 74 bp, Mus musculus
ttctgctgctgctgcagtacccgttcccgacaagtccgatactcaagggcaaactctctcagtgtgtggcagaa

SEQ ID NO: 77021 - DNA, 78 bp, Mus musculus
gtctctcactctgactgtcttcacattgctaagggataaccccaaagccttcgtggggcaaacctagagctcagagac

SEQ ID NO: 77022 - DNA, 57 bp, Mus musculus
ccacggctcactcaccctttcagacagttccagctctgagcacagtgagcacagtgg

SEQ ID NO: 77023 - DNA, 74 bp, Mus musculus
gtagcacatattgttcaggttggtctgtaacagctttgttgaaaggcagtgtggaaagctggatatggtggtac

SEQ ID NO: 77024 - DNA, 69 bp, Mus musculus
gcatgtacctgtgggtctctctgtgactttggaggctgaggccgggggatcagtggaatcctggagtgc

SEQ ID NO: 77025 - DNA, 96 bp, Mus musculus
gtggattctgtcacactgtgtcatgtggattctgtcacactgtctgtgtcatgtggactctgtcacactgtctgtgtcatgtggactctgtcacac

SEQ ID NO: 77026 - DNA, 97 bp, Mus musculus
ctggttagactctgaggggctttaggtcaggtctgtgtcaatagctttagcatatgagtaaagagagagtgctgagggtgtggtcagggaactctgc

SEQ ID NO: 77027 - DNA, 81 bp, Mus musculus
ggaaagtacaagtgctgagaggtctaagtgtgcaggggagcctggctcacggcccacacattcactcgcactcacacgtcc

SEQ ID NO: 77028 - DNA, 83 bp, Mus musculus
ggctggctggatccttgggttttcatttctatgtgttacattctctagatatataccattgactgacttttaggttcagggtc

SEQ ID NO: 77029 - DNA, 103 bp, Mus musculus
gcatggaggctgcacagcaacatgtcattttggctatagtttttatgtattttgcaaagatcatcaaaatatactcattggtatggaatgtgagcgtgtatgc

SEQ ID NO: 77030 - DNA, 117 bp, Mus musculus
aatgtccactaagtagaaagctgatcaatgtttatatgtataaacacatgcatatatatatatacatatgtatatatatggttatatatagttattggttcctacttagtggatatt

SEQ ID NO: 77031 - DNA, 69 bp, Mus musculus
cacatagtctctctggctctgtgtcctggtgtcttagcctggtgtcttagttagggttttactgctgtg

SEQ ID NO: 77032 - DNA, 65 bp, Mus musculus
gtctgtgaggctgtctcactcagtgcaggatagaccaaggcactgagtgacatcatttcttgggc

SEQ ID NO: 77033 - DNA, 68 bp, Mus musculus
tatgtgtatgtgtgtgcctgtgtatatgtgcctatttgtgcatttatgtatgtatgtatgtatgtatg

SEQ ID NO: 77034 - DNA, 62 bp, Mus musculus
gttactcagggtgggctttggggtttcaattgttcaagccaggcccactgtctgtctgtcgc

SEQ ID NO: 77035 - DNA, 79 bp, Mus musculus
acctgctgagacatcaagattctcttgccagcctggaagatcttgagggctgtgtggttgacttgtgaaactgcctggt

SEQ ID NO: 77036 - DNA, 64 bp, Mus musculus
ggaggtgggctttgggatgtaaaagctcctatcaggcgcagtctcactctctctgcctgctgcc

SEQ ID NO: 77037 - DNA, 115 bp, Mus musculus
acccttctccttccaccttagaagcacgtggaattctcaggtagaagcatgaatacattttgtttcttcccctgaaagtcattccatgcacttcttggctcatgaacagtggggt

SEQ ID NO: 77038 - DNA, 87 bp, Mus musculus
gttgaggagacaagtgcagagagaagatacagagggaccaaaccggagctgtctctctgagtatgctctgctctgaatcatgccagc

SEQ ID NO: 77039 - DNA, 118 bp, Mus musculus
aacagatgagacacagctcaaacagctattactcggcaaactaaattgtcataaattttatatataaaatagaaaaatggggtttatggagctgatggcattgagttgcacttaggtt

SEQ ID NO: 77040 - DNA, 112 bp, Mus musculus
atgactgtctccaaactttgttttcttctcacaagatgtatttttctttactaaacagagttcatgaattgcttatttgtgtgagaggtaaatgcaaatagacttaggtcat

SEQ ID NO: 77041 - DNA, 69 bp, Mus musculus
gtgtgtgtctgtctgtctctctttctctgtacatctgtaagatagggagagacacagagagacagagac

SEQ ID NO: 77042 - DNA, 68 bp, Mus musculus
tctcagtctctgtctctctgtgtctctccctatcttacagatgtacagagaaagagagacagacagac

SEQ ID NO: 77043 - DNA, 111 bp, Mus musculus
ggagtattaatgtttaaggatgctgcatacagattctgtccttcaaaagatttttttgtttttcaagacagggtttctctgtgtagccatggctgtcctggaactcactct

SEQ ID NO: 77044 - DNA, 95 bp, Mus musculus
ccacgaacaggctggagagatgatggctcagcagttaagagcactgactgctcttccagagggcccaagttcaatccccagcaaccacatggtgg

SEQ ID NO: 77045 - DNA, 91 bp, Mus musculus
gtgtgagactgtatctgtctgcctgagtgggtgtgcatgtggctaccttcagagtccactattactagtgcggataggcaccatcttagac

SEQ ID NO: 77046 - DNA, 71 bp, Mus musculus
ctcattccctcactgtactgactggttttgtgtcaacttgacagaagctagagtcatcagagagagaagag

SEQ ID NO: 77047 - DNA, 90 bp, Mus musculus
gcctcatcatctaaagcagacactctctctctgtaccattcgcgctgcccacactaggccctgctagagttctgtgtctgtgtgaaaggt

SEQ ID NO: 77048 - DNA, 99 bp, Mus musculus
cagtcctgaagcaggtccagctgctcacaccggacggcactgtcctctggagacaggacagagaccagactatgaagcttgaccaggtcccaggtattg

SEQ ID NO: 77049 - DNA, 90 bp, Mus musculus
tacatgcatctgtgtctgtgcatgtgcatgtatgtgcacatgtgtgtgtgcccatgcatgcacacctgtgcatggatacgtgtgtgtgtg

SEQ ID NO: 77050 - DNA, 115 bp, Mus musculus
ggtgagcaagggagaggcaggtagagcagagagatcgagaactgagtgtggacacaagagagatggagccacacaagagccactcctgcctcccaaggccactcccttagtgacc

SEQ ID NO: 77051 - DNA, 86 bp, Mus musculus
agaaagatccaggatgctgactcctgacagacacctagagcatcggagattctctcagagtcagtcacactccttaggatcttact

SEQ ID NO: 77052 - DNA, 56 bp, Mus musculus
gcctcagaaaggcaggatgtcctcaacaccaccctgtcagcatctctctctgaggc

SEQ ID NO: 77053 - DNA, 97 bp, Mus musculus
tgcagcatcagcctggagacctgccctgcaccagcccccacatctctctgtctctgagcaggatggtggagccaggtgagtatgtggcacctggctg

SEQ ID NO: 77054 - DNA, 62 bp, Mus musculus
agggtcactcagtgcctcagcctggctatgcaggctgacaagaaagcaccaagaggctccct

SEQ ID NO: 77055 - DNA, 115 bp, Mus musculus
ccaggaagggccatctcctaggaggagcttttatttggggtacagggggcgcaggatccttctgttctgtctgtctctgctcgcctagattgagtgcatgtccttcagtaagtgg

SEQ ID NO: 77056 - DNA, 67 bp, Mus musculus
tcatggtggggaaggcatggcggcaggtggaggaagctcactggtcacactgagtcctcagccagga

SEQ ID NO: 77057 - DNA, 56 bp, Mus musculus
tgtgtgtgtgtgtgtgtgtgcatgcatgtatgtatgtatgcatgtatgcatatgca

SEQ ID NO: 77058 - DNA, 100 bp, Mus musculus
ctgtcttcttgctgagaaattaaatcatgaggggatagatgtcaacaaaacataccagacaggaaaatattccttcaggttttctatctgggcagctcag

SEQ ID NO: 77059 - DNA, 157 bp, Mus musculus
tctatgcatttgtgtatgtgtgtgtatgcatgtgtgatagtgtgtatgtaactgtgcatgtgcatgcatgtgtatgtgcatgtgtatgcctgtgtgtgtgagtgtgtgtgtatgtacttgtgcatgtgtgtgcatttgtgtgtatgtgtgtatgcat

SEQ ID NO: 77060 - DNA, 108 bp, Mus musculus
atgtatgtgtatatgtgtatgtttgtatgtgtgtgtatgtatgtatgtatgcatgcatgcatgtgcatgtgcatgtgtgtgtgtatgtatgtatgtatgtatgtcata

SEQ ID NO: 77061 - DNA, 99 bp, Mus musculus
aaccccagcaactatcaaaagaaccctgggttttcagtctgtctgtctgtaaaatgggtagattcacattgcctcagtgggtattatagaggtttggtt

SEQ ID NO: 77062 - DNA, 85 bp, Mus musculus
ggaaaacactcatagtagggctggggagatggctcagtggttacgaagcactgactgctcttccagaggtcctgagttcaattcc

SEQ ID NO: 77063 - DNA, 131 bp, Mus musculus
tagagaattaggtccatcttctcccactgaggccagagcaggcggtcctctgctatatatatatatataatgccaggaacctcgggctggcctgtgtacagttggtggctcagtgtctgggagctccctgg

SEQ ID NO: 77064 - DNA, 123 bp, Mus musculus
tatgtgtgtgcctgtatgtgtgtgtatgcctgtgtgtatgtgtgtctgtgtgcctgtgtgtgtgcctatatgtgtgtatgtttgtgtgcctttgtgtacctgtgtgcatgtgtgtgcctatat

SEQ ID NO: 77065 - DNA, 85 bp, Mus musculus
gagacagacagacacacagacagagatagggatagcctctctgccaaaggctagaattccccactgctagtgtttggtattgctc

SEQ ID NO: 77066 - DNA, 89 bp, Mus musculus
caatgcatacagtgcatatatatgtgtgtgtatgtattatgtatgagacacacacacatacatgtactattatcatctgtgtgtgcttg

SEQ ID NO: 77067 - DNA, 76 bp, Mus musculus
agcctcaccccctgagtggagagagagagctgacccctgcagcttgtcctctagccttcacacttgcccagtggct

SEQ ID NO: 77068 - DNA, 112 bp, Mus musculus
gccctgtgtgtctctctctgtgtcctgccagtggttttaccctatggtaggttacgtcatgctgttctaccacagggtagaaccacggacagggtactggagcaccctctgc

SEQ ID NO: 77069 - DNA, 75 bp, Mus musculus
tgcatatacacatatacatatatgtatatatacacgaatatgtatatgtatgtatatgtattatgtgtgtgtcca

SEQ ID NO: 77070 - DNA, 84 bp, Mus musculus
cagatgtctctagcactgtctgtctgattttttgagacagggtctcagtgaatctagagcttaccatataggctagacaccatg

SEQ ID NO: 77071 - DNA, 138 bp, Mus musculus
atatatgtgtgtgtatatatacatgtatgtgtgtatatgtgtgtgtatatacatatatatgtatgtatatatgtatatgtatgtgtatatatatatacatgtatgtgtatatatatgtgtgtgtacatatgtatgtat

SEQ ID NO: 77072 - DNA, 70 bp, Mus musculus
aggctctaaagggaggctgcctctaacccagtgagggttctcccttcaccctccagtctctcttttgtct

SEQ ID NO: 77073 - DNA, 112 bp, Mus musculus
tcttccagctgtgatggctgtatgaatgattgctgctgatgttatgtgtgtatgtatgtatgtatgtagtacgcatgtgcttggtcacgatggacagaatcgacacgggaga

SEQ ID NO: 77074 - DNA, 105 bp, Mus musculus
gactgaaggtttatatatatacacatacatatatacatatgtatatatgtatatatgtgtatatacatatatacaaatgtatatatatatatatgacatttattc

SEQ ID NO: 77075 - DNA, 94 bp, Mus musculus
gagtggcctgggtgcaggctggctctgtgtctgcctcttattcccctgaaataggagcagacatgaagcgcccattgcacagacccctgccacc

SEQ ID NO: 77076 - DNA, 71 bp, Mus musculus
ggagagcagtgagttgactgaggtgggtgctgggaagcaaactcctctacaaaaacactctcactctcacc

SEQ ID NO: 77077 - DNA, 114 bp, Mus musculus
agtgtgtgtgtgtatacaacatatgtacatatatacacatatatgtttgtatgtgtatatatatgtatgtatattatatatgtatatacacacacattatatatatatatacaa

SEQ ID NO: 77078 - DNA, 98 bp, Mus musculus
catgcatgtatatatacatggaagcttcatattatatatatgtgtatatttatgtttatatatatatggaagcttctacagtattatgtttccatatg

SEQ ID NO: 77079 - DNA, 117 bp, Mus musculus
ggtatatatatgctatgccactgcagggtgtatatatgctatgtctctgcagggtgtatacacactctgtctctgtggggtatatacatgttctgtatctgtgaggtatatgtcact

SEQ ID NO: 77080 - DNA, 83 bp, Mus musculus
tacaagctacttggaaatatgtgtgtgactgtatctctgtgagtatacatgtctacaggcacacatacagccagatgtttgta

SEQ ID NO: 77081 - DNA, 62 bp, Mus musculus
gtttgctgatgggcaaactgaaagactctgtctgactctgccattcatttgcctgtgcaaac

SEQ ID NO: 77082 - DNA, 82 bp, Mus musculus
catctctcatatttgcctctgtctctgtgtgtatatgtgtgtttacatccgtgtatatacgatgcttgcatatatgttcatg

SEQ ID NO: 77083 - DNA, 68 bp, Mus musculus
ctgtttcctgggatttgtgtcacctcacatgtgtgtgtgtgtgacacacttactacaccatgatgcag

SEQ ID NO: 77084 - DNA, 85 bp, Mus musculus; identical to SEQ ID NO: 57439

SEQ ID NO: 77085 - DNA, 101 bp, Mus musculus
ggcacacatgctggccttgaactctccgtctgtctctcccaccatgttaattactattccctttggtcaggctgagaaaacagcctcgctgcattagtgct

SEQ ID NO: 77086 - DNA, 93 bp, Mus musculus
ctgaagaaggcatttccttcctgggtgagagctcagagagtgctggaaaggcacatgagcctcagttgccactggaaaggggaagtctgtaag

SEQ ID NO: 77087 - DNA, 112 bp, Mus musculus
gtacacatgtacataggcattatgtgtgtgtgtgcacacatctgtgtgtgtatgcacatatctgtgtgtgtatgtgttgtatgtgtgtgcacacatctgtgtgtgtacacac

SEQ ID NO: 77088 - DNA, 117 bp, Mus musculus
tccaatttaacaggatcattatttctgacattaaagttctgagaatagtcacatgcccagaagcaatttttttttttaaaccagctaatcccagaaataagaaactgccatgaggga

SEQ ID NO: 77089 - DNA, 102 bp, Mus musculus
tagtaataataagaatttagagaggaagtaagactcctgagactttctgattttttttaatacaaagagagtcttttctagaactttctctctttgtgacta

SEQ ID NO: 77090 - DNA, 74 bp, Mus musculus
gtgcatgtatgtgcttgtgcactcatgtgtgcttgtttatgtatgtatgtatgtatgtatgtatgtgtgtgtat

SEQ ID NO: 77091 - DNA, 107 bp, Mus musculus
cctctctagaatccgatacatgaagtactatgttcttataagttgccttgccagggctgtttatttatctttataagacttcgaggattgcatgggtggcagaaagg

SEQ ID NO: 77092 - DNA, 67 bp, Mus musculus
tatttatgtgtgtatgtgaatggtgaatgtgagtctatattcatgtgtgtatatatgtatatgaata

SEQ ID NO: 77093 - DNA, 65 bp, Mus musculus
ggagctgagagttgaggattggttgggtttcgaagactctcatcctctcacactctctaccatcc

SEQ ID NO: 77094 - DNA, 89 bp, Mus musculus
cctccccctgccccgtgcccccatatcttggagaggcagcgctgctctgtctctctcacatatgacttccccatgggtccattttaagg

SEQ ID NO: 77095 - DNA, 116 bp, Mus musculus
ccaagtctgctgcttgaaggagccaatggaaagagaagctcaatggttttctagctgaaaggaacagtgtaagccatggggtttgggactggcttgagggacagggaagaggcaga

SEQ ID NO: 77096 - DNA, 125 bp, Mus musculus
gtgtcagggcaaagagtgtgcagcagtgtgaacaagggtgttcacagtctctgtgagtgtgtgtgtgcatgggcatgtgtgtatacatgcgtgtatgcatgaatgtgtgccatgtgcatgcatgt

SEQ ID NO: 77097 - DNA, 67 bp, Mus musculus
gttgagtgggaaacagggaagcggtcagggataagccccttagacttcacactgtctgtcactctac

SEQ ID NO: 77098 - DNA, 64 bp, Mus musculus
gtgcatatacacatatgtatgtgtgtgtgtatatacatatatatgtatatatgtgtatgtgtgt

SEQ ID NO: 77099 - DNA, 70 bp, Mus musculus
acatgtgtatatgtttgcatgtatgtatgtatgtatattcaccacatgcatctatgaatgaaccacatgt

SEQ ID NO: 77100 - DNA, 86 bp, Mus musculus
acatacatatatatgtatatgtatgtatgtgtatatataagtatgtatgtgtgtacatatatgtgtgtgtatatatgtatgtgtgt

SEQ ID NO: 77101 - DNA, 219 bp, Mus musculus
gcatgctgatttatatgtgtgtgtgtatgtgtgtgtgtgtgtgtatatatatatatatatatatatatatatatatatatacacatatatattgtgtgtatgtgtatatatgtatatatgtgcatgtgtataggtatatatatatacatatatatatatgtatgtgtgtatgtatgtgtatatatgtacatgtatatatgtgtatatatgtgtatgtat

SEQ ID NO: 77102 - DNA, 115 bp, Mus musculus
atttgtgtgctcctgaacaacagccaggaagtcctggcctgatactcaagagtcactgctgagtctcagagtctcagttcatgggtgactggcaatggttggagcagtgacaaat

SEQ ID NO: 77103 - DNA, 72 bp, Mus musculus
ctttagcttgcttaggaattggcgacagaaacgtgttgttcctatggcctgtctgtctgtctgagactagag

SEQ ID NO: 77104 - DNA, 117 bp, Mus musculus
gctctttacagtttaacatgatttatttatcggttttgtgtgtggctgtgcatgtatgtatgtatgcatgtatgtaccgtgaacacatgggaaaatcagaggacaggctttggaagt

SEQ ID NO: 77105 - DNA, 175 bp, Mus musculus
atgaatgtatgcatgtatatatgcatatatgtgtgtatattgtgtatatatgcgtgcatatatgcatgtatgtatatattatgatgtgtatgtatgcatgcatgtatgtatgtaagtatgttgtacctgtatgcatgtatgtatatatgttgtgtatgtatgcatacatgtatgt

SEQ ID NO: 77106 - DNA, 57 bp, Mus musculus
tctgtctctctgtctctcactcacacacacacacagagagagagagagagagagaga

SEQ ID NO: 77107 - DNA, 73 bp, Mus musculus
tccagctgtctctgtgaccctgtgattctgggattctgtgtcctgagattctgggtgtgtcagagctcctggg

SEQ ID NO: 77108 - DNA, 86 bp, Mus musculus
gggggtgggggtgggggtgggggtgggggtgggggtggtgcgtgaaccaataaccagtgctcagtctcagtctcggtttcggttct

SEQ ID NO: 77109 - DNA, 63 bp, Mus musculus
catgcatatgtgtgtgtatatatatatatatgtgtgtgtgtatgtatatatatatgaaaagtg

SEQ ID NO: 77110 - DNA, 77 bp, Mus musculus
agtcagacttcagtgtgcatatgtgtgcacatgtgtttgtgcatgcgtgcacgtgtgtgtgtgtgtgtctgtctcac

SEQ ID NO: 77111 - DNA, 80 bp, Mus musculus
catatatatgtatatgtatgtgtatgtatatgatgtatatgtatatatacacataaacacacatagagagcatgtatttg

SEQ ID NO: 77112 - DNA, 93 bp, Mus musculus
ctccattcctttatgtcacccactgaccctcagtgacagtgcaaccatcacacttgcctaggatccagagtgggtaacaacagccaaagagtg

SEQ ID NO: 77113 - DNA, 145 bp, Mus musculus
gtatgcagatatgtgtacatatatgtgtgtttgtatacatgtatgtatatgatatgtgtgtatatatgtatgtatgtgtgtatgtgtatatgtgtgtgtatatgcatatataggtatatatgtatatatatgtatgtaagtatat

SEQ ID NO: 77114 - DNA, 68 bp, Mus musculus
aggagtctgtctctggcactgtgtgaccatggcagctgagcacaccagtcgtgacagtgacacaccct

SEQ ID NO: 77115 - DNA, 84 bp, Mus musculus
gtaaataatatgctacacgttgcttatattatacttggttgtataatgcaaccaagtgtactgtatatgttgtatactgtatat

SEQ ID NO: 77116 - DNA, 68 bp, Mus musculus
gaactgagggttggggagatggctcagcggttaagagtgctgactgctcttccagaggacctaagttc

SEQ ID NO: 77117 - DNA, 154 bp, Mus musculus
gtatgtatgtatgtagcatgtatgtatgcatgcatgtatgtagcatgtatgtatgtagcatgtatgtatgtatgtatgtagcatgtatgtatgtgtgtatgatgtgtgtatgtatgtagcatgtatgtatgtatgtatgtatgatggtgcacac

SEQ ID NO: 77118 - DNA, 104 bp, Mus musculus
ttttgttggtgatgttctggtttgtcgagacagggtctctctgtgtatccctggctgccctgaaactctctcttatagaccaggctggtctcaaactcacagga

SEQ ID NO: 77119 - DNA, 71 bp, Mus musculus
gatgccaccaaccctgaggtagaaggaagtactgactcccagagctcagcttctcaggacacagttacatc

SEQ ID NO: 77120 - DNA, 97 bp, Mus musculus
gtctgcctgcctgccttcctgtctgtcttcctgcctgtctgtctggaatagaccagactaggactagccctagaattctggaattcaccctgcagac

SEQ ID NO: 77121 - DNA, 100 bp, Mus musculus
acactgggacccagtcccactgtctgtactatgaacacactgggactctgccccactgtctgtctgcaccatgtacacactgggacccagtttccagtgt

SEQ ID NO: 77122 - DNA, 86 bp, Mus musculus
ggcagtaggactgtgtccacaggaagcaggaggatgctggcgctcagttctctctctgtgagcctgggccatgggctggggctgcc

SEQ ID NO: 77123 - DNA, 114 bp, Mus musculus
aattccttcgtttttattttatgtttggatgttcgcctgcctgcctgcctgcctgcgtgtgcatgacctgtgtgcctgtgccctcaggcaggttggatccttggagccggagtt

SEQ ID NO: 77124 - DNA, 81 bp, Mus musculus
gagagtaaggatatggaatgtacaaatgtgtaaggagtgttttgcctgtacatatttgagcatactacatatgtgtctgtt

SEQ ID NO: 77125 - DNA, 81 bp, Mus musculus
tctggtgggccagagatgtctgtgaggagaacgggacaattctgagcctgtttcctggaccagcacactgggccttcctga

SEQ ID NO: 77126 - DNA, 77 bp, Mus musculus
gtggatttatgaatgaatgaatgaatgaatgtgagctttgctataaatattctgtctcattcttcaattaatttcac

SEQ ID NO: 77127 - DNA, 74 bp, Mus musculus
gtctgtcttgtctctctgtgtccatgtgcaatgtatgtgcatatgtctatggaagccagaagagtgggtcagat

SEQ ID NO: 77128 - DNA, 97 bp, Mus musculus
agatgtgtaaaaataataacctgatagccccggggactcacagatcccactctgttgtctatgtctcagtgcaagttcatttgtggttttagcatct

SEQ ID NO: 77129 - DNA, 63 bp, Mus musculus
ggcagctgctcacagtagagagtgtcctgggcagagcacaacatccccttgggcgaagcttcc

SEQ ID NO: 77130 - DNA, 74 bp, Mus musculus
gtgtgtgtgcatatgtatatgtgtgtctgtctgtgtgtgaatgtgtatgtgcatatgtgcgtgtgtgtatacat

SEQ ID NO: 77131 - DNA, 109 bp, Mus musculus
gtatcagcggcaggcagcgccctctagcattacagctatcacaaaagactgaggtcactcgctgggtatgatgatagtgtgtgtgcttgttgtgtgagtgttgagaagc

SEQ ID NO: 77132 - DNA, 74 bp, Mus musculus
gctcagcagttgagagtgtgcactgatctagctcaggggttgagagtgtgcactgatctagctcagcggttgag

SEQ ID NO: 77133 - DNA, 88 bp, Mus musculus
atgtgcatgtatatatgaatgcatgtatgtatatatgaatgtatatacatgtatgtatatatgaatgtgtgtgtatgtgtaattatat

SEQ ID NO: 77134 - DNA, 69 bp, Mus musculus
gattgtatgtctgtgtgtctgtctgtatgtatgtccatgcatatgcagaagccagaggttgatgtggtc

SEQ ID NO: 77135 - DNA, 110 bp, Mus musculus
tgttggggaggtcaagggagcctcacactgactatggcctatatatatatatttttggctaagatctgatgtaatggatgatcttccttgatttttagaatcacccagga

SEQ ID NO: 77136 - DNA, 56 bp, Mus musculus
gcgtgcgtgcgtgcgtgcgtgcgtgcgtgtgcatgcgcgtgcgtgtgcgtgtgtgt

SEQ ID NO: 77137 - DNA, 117 bp, Mus musculus
gtttgaattgtcaggttttcaggtatgagatggtagtgagtggcagtgcctctggcacagtgactgtgtcagggacctggtgcgcactccccttctcccccaaggtttcacacaaac

SEQ ID NO: 77138 - DNA, 114 bp, Mus musculus
gttgtcggtcacaaaggctaggggatgaaggggagaatgcgaggctgcctggctgccaggatcctggtttcctgtcatgctaatttggattaaaaaccttaaaatattaccccc

SEQ ID NO: 77139 - DNA, 117 bp, Mus musculus
atagagatgaaactgtttatatttaaatcttagagttgggagaggctctaatttttatttaagattttttaaaactctctctctgtggggtatgtgtgagtgagtgtgtgtgtgtgt

SEQ ID NO: 77140 - DNA, 69 bp, Mus musculus
gcctacatgtctgtctgtctgtctgtgcagcagctggagttatagatggttgtgaactgggatgtgggt

SEQ ID NO: 77141 - DNA, 78 bp, Mus musculus
tttccggctctcaagaaaggctgggagcagccaacatcctggctatcagccctctctctctccctgtgagccagggaa

SEQ ID NO: 77142 - DNA, 115 bp, Mus musculus
agaaaccataggaagcctggagatactatgtgaatcaaccaggttttcatttctgagtttttagacatgaaaatatttgtcacggttaatgttctgtttggctttttttttttct

SEQ ID NO: 77143 - DNA, 62 bp, Mus musculus
ggcagcagagtgtgtgacattctgaagagcacagagaatcagtggctcacacagtctctgcc

SEQ ID NO: 77144 - DNA, 65 bp, Mus musculus
ggcagggtctctctgagccagtgctggcttatactggctaatctagatatccagaaagcccagcc

SEQ ID NO: 77145 - DNA, 73 bp, Mus musculus
ggctctctctctctctctgatgtagcccaggctggcctggagttggctatgcagcaggggatgatgctgaacc

SEQ ID NO: 77146 - DNA, 109 bp, Mus musculus
tatagttgtttggcctgtatgtatttctgtgagttatgtgtgcctggtgcccacagagtccagacagagcacaatagatcccccaagactgcagttactaacagctgtg

SEQ ID NO: 77147 - DNA, 112 bp, Mus musculus
gtgattaagaacaccgggtgtgggttggagagatggctcagtggttaagagcactgactgctcttccagaggtcctgagttcaaatcccagcaaccacatggtggtaaccat

SEQ ID NO: 77148 - DNA, 94 bp, Mus musculus
acaagagttatggttgtgttaggaagtgtgtcgggttgaaagtcatcgattctgactgacacactcactgtttttctaacccaggaccttttgt

SEQ ID NO: 77149 - DNA, 100 bp, Mus musculus
gcagtcctgcagatcacagtacagagtcagcacagtgcatgcagaacatcgtctcctgcctttgaccatgtttgttatttgtatgggttaaatctcctgc

SEQ ID NO: 77150 - DNA, 73 bp, Mus musculus
acttgacaggaatctgtctgcagagactggctaataagaatttcagtactgtggagattggaatgctgcaggt

SEQ ID NO: 77151 - DNA, 66 bp, Mus musculus
gagctgtctgcctgtctcactgttgcccatggtgtagaacttggggcagttatctagttacagctc

SEQ ID NO: 77152 - DNA, 79 bp, Mus musculus
tgatggcagagatgtaagtgagctgtcagggagccacctgttgccatgccttccctctcagcgtcacctcatgctgtca

SEQ ID NO: 77153 - DNA, 119 bp, Mus musculus
ggtagcaaataagacaagatatgtgggagctggagagatggctcagcgattaagagcactgactgctcttccagatggcctgagttcaattcccagcaaccacatggtggctcacaacc

SEQ ID NO: 77154 - DNA, 83 bp, Mus musculus
tataccttgctctccctgtctgtctgcctgtcagggaatttgtctgacatacctaccctttcaagacagggtttctctgtgta

SEQ ID NO: 77155 - DNA, 64 bp, Mus musculus
catgcccacttctctctgtgacaggattgggtaccacttgagcctggcacagatttggcgcatg

SEQ ID NO: 77156 - DNA, 113 bp, Mus musculus
gtggggagacgcttgtcttcatgtgggctctgcttgacttctgggccctgacactctttctgtgtgtgatccccagcaagctgcccagactttgtgaacgtcagggtccctgc

SEQ ID NO: 77157 - DNA, 81 bp, Mus musculus
agtaagtctgtgcatctgcatctgtgtctcctcgctgtaccttactcacttcagactggatagcagagctcagcattagct

SEQ ID NO: 77158 - DNA, 132 bp, Mus musculus
cagtctggtctgcatactgaaacccagtctcaaagggggaagaataatggaggtgcacagagaagactgacaccagggtcactgttagataggatgaagcgtcagtctctatcctctgttccccaggcctgg

SEQ ID NO: 77159 - DNA, 61 bp, Mus musculus
tgggacccgcagccgctaggttctgaggcgattctgagactcacagtgggtgtgtgaccta

SEQ ID NO: 77160 - DNA, 58 bp, Mus musculus
tgctcacactcactcacacacacgcacgcacactggagtgtgtgtagagtttgtggca

SEQ ID NO: 77161 - DNA, 69 bp, Mus musculus
caggcgagaaagcagccaatggccactccacctgagatctctcatggctggtggctctctctctctctg

SEQ ID NO: 77162 - DNA, 78 bp, Mus musculus
gaatacaaaagcaggctggagagatggctcagcgtttaagagcactgactgctcttccagaggtcctgacttcaattc

SEQ ID NO: 77163 - DNA, 89 bp, Mus musculus
cagggtttctctgtgtgtctctggctgtcttggacttgctctgcagacctggctgtccttgaactcacagagatccatccacccccctg

SEQ ID NO: 77164 - DNA, 77 bp, Mus musculus
gttggcttttgattccaatgtcttttatgactgccctggtttcctgtaagttattgtgacagccgggacatgccaac

SEQ ID NO: 77165 - DNA, 106 bp, Mus musculus
gatgctcagaactaaggaaagcagtgcgtgcgtgcgtgcgtgcgtgcttgtatgcgtgggtgcatgtgtgttcgcgcgcatgtttggggttgtatgttttggtatc

SEQ ID NO: 77166 - DNA, 93 bp, Mus musculus
accaagatgccctgctgcctgttttctgagacacagtctcagtcacataccccgggatggctgtgactttgtgacagcagcttttatcttggt

SEQ ID NO: 77167 - DNA, 113 bp, Mus musculus
agttggatcctgtgtttttcagggttctctggaggagcagagcttatggggtgactcattttctctctgtctaggaagggatttattggaatgacttactggctaatccaact

SEQ ID NO: 77168 - DNA, 79 bp, Mus musculus
agccacgtgtctgagtctgtgggtcttcattttatatcactcagaactatgagagtgggcctagagagatggcttagtg

SEQ ID NO: 77169 - DNA, 110 bp, Mus musculus
tgtgtgtgtgtgtgtatgtgtgtgtatatgtatatatatatatatatacatatacacatgtatgtatatattatatgtgtgtatatatacatatatatgcatacatacat

SEQ ID NO: 77170 - DNA, 62 bp, Mus musculus
gtctgtgtgtctgtctgcctcagtgttccacctttggaatttctagtgacaagacaaaagac

SEQ ID NO: 77171 - DNA, 102 bp, Mus musculus
caaaggtaggcagatctctgaattcatttgcaatgttaagaaaaaatgtgcttgcagtctttttttaatagtcaaggggctaaggtcaaaacttactgattg

SEQ ID NO: 77172 - DNA, 99 bp, Mus musculus
atctgtttttttttcctgttctgggagcccacctgggacactgaattatatttatctattatgtcttcatagggtcctcttgagctgacagattctcag

SEQ ID NO: 77173 - DNA, 62 bp, Mus musculus
caagggtctggagagatggttcaacagttgagagcactgtaacaccaactccagaggatttg

SEQ ID NO: 77174 - DNA, 112 bp, Mus musculus
ggggcctttatgtgagcccagagctgatgaccacagccttgtgccactgcctctgtctgactggaatccagctgtgcaggaggctgcagcaggctcactgtgagaagatcct

SEQ ID NO: 77175 - DNA, 77 bp, Mus musculus
gctgcgacttttccaagatgcaatcaaatcaatgttaccagaaagatatttatttgtattctagaagaagatgcagc

SEQ ID NO: 77176 - DNA, 89 bp, Mus musculus
gtgtgtgaatatgtacatgtgtgaatatatgtgtatacatctgtgagaatgtgtatatgaatatacatatgtgtgtgtgtgtggtgcat

SEQ ID NO: 77177 - DNA, 118 bp, Mus musculus
caggatgtattcttttaagtgatatgtatagtgtatgcatatatatatatatatatatatatatatatatatatatatatatgcatatatctatgtctatctttctgtctgtctgtct

SEQ ID NO: 77178 - DNA, 85 bp, Mus musculus; identical to SEQ ID NO: 57439

SEQ ID NO: 77179 - DNA, 90 bp, Mus musculus
taagcactggagagaaataggaggtctcactgaatatttttaaatgttttctgtggaaggccatgccatcatttcctgccagagtgttta

SEQ ID NO: 77180 - DNA, 110 bp, Mus musculus
gaggatttgatagtcaccatctctttcctctgcctgactagactctcagagactctgattcaaactctgtaacaggttttggatgtgaagggctcagaaatggaatcctc

SEQ ID NO: 77181 - DNA, 77 bp, Mus musculus
ctgcctgtctgtctgtctgtcttcatgctcgctcctgtttttaaaggacctgtgaagatctcggcatggtggagcag

SEQ ID NO: 77182 - DNA, 83 bp, Mus musculus
cagtttctaacacctagaccaggtggccaaaacttcagagagatctgactctctgggcctctgtatctggcttgtagtatctg

SEQ ID NO: 77183 - DNA, 86 bp, Mus musculus
ttgccatctgtggtgtctctgaaacttccaatgccattgaactgtttcataacactctaagtgacagatgacagagaggatggtga

SEQ ID NO: 77184 - DNA, 85 bp, Mus musculus
caagcatacatacatacttatatatatgtatgtatgtatacatataattatatgtatgtatgtatgtatgtatgtatgtatgtat

SEQ ID NO: 77185 - DNA, 67 bp, Mus musculus
gtgtatatacacatacatatatacatatgtgtatgcaaatatacaatgtgtatatgtatatatgcat

SEQ ID NO: 77186 - DNA, 62 bp, Mus musculus
gtgtgcatgtgcgtgtgcgtgcatgcgtgagtgcatgcgtgcgtgcctgcgtgcgtgcgtgc

SEQ ID NO: 77187 - DNA, 110 bp, Mus musculus
ggtctagatgggacatccagatgatctgcatcagaaatgactctgaatcttttattttgtttttgttttgttttctgtaagtatgcaatttatctctttcaatttggggc

SEQ ID NO: 77188 - DNA, 93 bp, Mus musculus
atatatacatacatatgtgtatatatgcatatacacacataacacacatacatatatatgtaaatatatacatatgtgtgtgtatatatatat

SEQ ID NO: 77189 - DNA, 102 bp, Mus musculus
gttacccttgcacagatttctaataaaccttgttagagagcacagcagggcagggctgagtctctcacagtgtttattgtgagtctctgcttggggcttggc

SEQ ID NO: 77190 - DNA, 126 bp, Mus musculus
atatatatacatatatatatgtgtgtgtatatatctatgtgtgtgtgtatatatatatatatatatatatatatatatatatatatatatgtgtgtgtgtgtgtgtgtgtgtgtgtgtgtgtatac

SEQ ID NO: 77191 - DNA, 95 bp, Mus musculus
tctgctatttaaagttagttcttaggatctgagagcctggaaggtaaggaactttgatattatcagaacacactgagctgaccaaagataatgga

SEQ ID NO: 77192 - DNA, 100 bp, Mus musculus
tgcatgtgtgtgtatgtgcatgtgcttgtatgtgtgtctgtgtgtctaagtatgtatgtgtatgtcagagtatgagtgaatgtgtgtatgtctatgtgta

SEQ ID NO: 77193 - DNA, 119 bp, Mus musculus
tatgtatgcatatatattatatgtgtatatgtatattatattatatattatatatctatacattatataatacatcatgtatatgtatatgtgtatatatatgtatatagacatacata

SEQ ID NO: 77194 - DNA, 89 bp, Mus musculus
cagtcactgaataagtctctctctcagtctcagtagatttcttcatatgatgcagtcagggagggggagggtggcttatgaaacttctg

SEQ ID NO: 77195 - DNA, 81 bp, Mus musculus
ccctgtgttccatccaatagatgactgtgagcattcacttctgtatttgccaggcactgtgggtaggggagcaaggcaggg

SEQ ID NO: 77196 - DNA, 114 bp, Mus musculus
ccttctttaagtggtttaggccaggcaatttgtctcagcaccaagaaaatttattaatattctcagtgctgatattgtggtcattcctatttcttaccatttctaagacattgg

SEQ ID NO: 77197 - DNA, 117 bp, Mus musculus
gaaaactgtgagaagcaggatggagccatttggttccagcgcagtgtgcgccatgtgctagcttgttgtatagttgtgtgagcgcttgtcccgtctctctattctgcttctgttctc

SEQ ID NO: 77198 - DNA, 110 bp, Mus musculus
ctgtattgatgaatgagtatcaaattgtcaaggctgaaatgtttgcctgcttgacttacttcaaggaatgtaaaagccccacccacagtgatagccagagcgtgagtaag

SEQ ID NO: 77199 - DNA, 98 bp, Mus musculus
ttgttcatgatctaagcactacttaaaaagcagtgtgcatatgcatgtgcatgtgtgtatgtgtatgtgaaagtgtaggtatgtagaggtcagaacaa

SEQ ID NO: 77200 - DNA, 76 bp, Mus musculus
gcattcataattgtgtgtacatatgtttatatatttctctgtgtgtgtgtgtatgtgtgtgtgtgtgtgtgtgtgt

SEQ ID NO: 77201 - DNA, 104 bp, Mus musculus
atgtcatggttaccaaaaatggaaatatatgtgtgtatgtatatgtgtgtgtgtatcaagcaatgggatacagcgagcaatgggtgcatggtggtgactggcgt

SEQ ID NO: 77202 - DNA, 104 bp, Mus musculus
acacacacatatatggtaggtatggtatatatatacacatacatatatatgtatatatatatgtgtgtgtgtatgtgtgtgtgtgtatgtgtgtgtctatgtgt

SEQ ID NO: 77203 - DNA, 62 bp, Mus musculus
tctgtctgtctgtctgtatgcatgtgagtgcaggtgccccataggtcagagagtgtttcaga

SEQ ID NO: 77204 - DNA, 65 bp, Mus musculus
tcaggctgtctgtctctgtgtgcctgtctgtcacaggtacacaggcacacagcagtgaaatagcc

SEQ ID NO: 77205 - DNA, 84 bp, Mus musculus
tttgtgcatatgtatagacatgtgtgggtacatgcctgtttatgcttgtgtgtatgtatgtatacatgtgtgtatatgcacaga

SEQ ID NO: 77206 - DNA, 76 bp, Mus musculus
acacacatacatatatatgtatatgtatgtgtgtgaggatctgaattctcatatatatgtatgtatgtatgtgtgt

SEQ ID NO: 77207 - DNA, 89 bp, Mus musculus
gtgtatatgtatatatgtgtgtgtgcttgtgcatatatatgtgcttatgtgtgtgtgtgcttgtacatgtgtgttgtgtgcttatgcat

SEQ ID NO: 77208 - DNA, 97 bp, Mus musculus
atatatatatatatatatgaacatatatatatatacacatatatatgtatttctatatatgtgtataatgtatatatgtgtgtgtatgtgtgtgtat

SEQ ID NO: 77209 - DNA, 92 bp, Mus musculus
gttggccagtgaggcccagaggtctgtctgtctgtctctatttttgcagtaggggaaatacaagcatgtactactgtccctagcttttaaac

SEQ ID NO: 77210 - DNA, 72 bp, Mus musculus
gtgtgtgtatgtatgtatgtatgtatgtatgtatgtttgtattatgtttgtatgctcttgccatatacacac

SEQ ID NO: 77211 - DNA, 61 bp, Mus musculus
tatatctgcatatatatgtatatgtatgtatatatgcatatatgtgtgtgtgaatgatata

SEQ ID NO: 77212 - DNA, 100 bp, Mus musculus
caggtagaattttctgattatgctgatgagtaatatcttcaagaaactcacttgagagtgtgcacacagctgcaggatggccaggggatgctgaaacttg

SEQ ID NO: 77213 - DNA, 65 bp, Mus musculus
gctctgggcctggagagatggctcggcggttaagatcactgactgctcttccagaggtcctgggt

SEQ ID NO: 77214 - DNA, 80 bp, Mus musculus
gtctgacacactgagtctttgggcttggatcctgtcactttctggccaggaagcccaacacagagacttctggattaggc

SEQ ID NO: 77215 - DNA, 105 bp, Mus musculus
gtctcaacttgagcatctttaagagcaaagagtcagtcaatagaagtctgaagaaaagaggcttctcagacggaattcccagcctttaattcaactccctgaacc

SEQ ID NO: 77216 - DNA, 84 bp, Mus musculus
gtctcagttccggccagcctccccgctcagctcacactctctctcagctctgtgtgaggtgatggagctctcccattgctaggc

SEQ ID NO: 77217 - DNA, 78 bp, Mus musculus
tggtaggactttgtcacagtggctgtagaaagtgtaacattagttctcactattccgcagtatgactgtgcaaaacca

SEQ ID NO: 77218 - DNA, 114 bp, Mus musculus
ccatgataagcatgtggatgtcagaggacaatcttgggagtcagtctttgtctctcaccttatttgagacaacattctttggttgttcatttctggataccccagcttctgagg

SEQ ID NO: 77219 - DNA, 76 bp, Mus musculus
cttttgacatactctatagagtgttagtggagaactcagacatgacactgacctcagtaagagtcttggttgagag

SEQ ID NO: 77220 - DNA, 96 bp, Mus musculus
gctcagcacacggggtggagaattgtgctctatggattttacacagacccactcactctgtaacttgagcattctcttggaactggaccacagtgc

SEQ ID NO: 77221 - DNA, 78 bp, Mus musculus
tatgtatatgtatatgtatatgtatatgtatatgtatatatacatacatatatatgtatatatacacacacatacata

SEQ ID NO: 77222 - DNA, 99 bp, Mus musculus
ggtatctggtagtgtgactgtcctgacgagcatcaagatattttacagaaatacctgtgcccgtctctctggctctcagaccagtgaaacaaagtaacc

SEQ ID NO: 77223 - DNA, 87 bp, Mus musculus
gtgtgtactgtgtgtatgcatatgtatagtacgtatgtatatgtatatatacatatatatgcatgtgagcaaaacaccagtacacat

SEQ ID NO: 77224 - DNA, 68 bp, Mus musculus
gtgcctccttcagtgcctggctgtgtccctcacgggagggatgccctgtcactggtgacaggtggttc

SEQ ID NO: 77225 - DNA, 107 bp, Mus musculus
gaactctggggtacagaacgagtaaggcatgatgtgcaaggcatgagccacgctgcccgctctgtctctctcagtgtttgtttatccggctgtctaacttctctttc

SEQ ID NO: 77226 - DNA, 78 bp, Mus musculus
gccctctctctcatgatgacttgctaagaggcagtctctctctctatgtagttctagtttaaatacaagatagagggt

SEQ ID NO: 77227 - DNA, 72 bp, Mus musculus
gtttcacttatccacacaggaagctttcatgtacggaggcgcagagagaagtctgtctggaggttgtgggac

SEQ ID NO: 77228 - DNA, 79 bp, Mus musculus
ttctccaagtcccaggcagcgcccggtatcacacagtggccacagctcactgtctgtcaggctggtttggtacagagaa

SEQ ID NO: 77229 - DNA, 74 bp, Mus musculus
gtggatacatacatacatacatgcataccatacatacatccttccttcatgtatgtatgtatgtatgtgtacat

SEQ ID NO: 77230 - DNA, 84 bp, Mus musculus
actgagcccatggtgatttgagtcaggagagactggcctgacccgggcttgagtctcggtgcccaccatagccaccgttcatgt

SEQ ID NO: 77231 - DNA, 83 bp, Mus musculus
gcagaagctgcagttggccattgagctagactggctggccagtaaacccgagggacccttctgtctgtctctgcctctctagc

SEQ ID NO: 77232 - DNA, 73 bp, Mus musculus
ggccctcagatgtccctagactggaaaactcagatctgagaagtgagactggtcaacatcctggagtcttgcc

SEQ ID NO: 77233 - DNA, 117 bp, Mus musculus
ctggaacagtttccctggaagagtcttacagaggtttgttttatttttttttctagctagttttatcccatgacaagatgaaagaggaaatccttctggtgggcctggagatgcttg

SEQ ID NO: 77234 - DNA, 140 bp, Mus musculus
atagcgacaatgtttgtatatatatatatatatatattgtgtatatatgtgtgcattgtatatatgtgtgtacattgtgtgtgtgtatatatatatatatgcatatgtgtgtgtatatatatatatatatatatatatag

SEQ ID NO: 77235 - DNA, 84 bp, Mus musculus
tcagttggtagtaggatggaaagtttaaatggaaatcatctgaaccataccaggtgttctttcagaccatctactgacaactga

SEQ ID NO: 77236 - DNA, 89 bp, Mus musculus
gtttgggctcatacattttacttttatttttttccctaaaggtttgtttttactttacatgtatgagtatttaatgtgtgagtttatgc

SEQ ID NO: 77237 - DNA, 91 bp, Mus musculus
tgtgtgcatctatgtgtctgtgtgtgtgtgtgtatgtgtgtatctgtgcctgtgtgtgtatttgtgtgactaaaggtgcatgggtgccaca

SEQ ID NO: 77238 - DNA, 83 bp, Mus musculus
ggtaatcccaggcagagaatcagagtgacattgcctatttccactcaggcaagtcagtgtctctctctctcccggtgctggcc

SEQ ID NO: 77239 - DNA, 68 bp, Mus musculus
ccgggagagagagagacactgacttgcctgagtggaaataggcaatgtcactctgattctctgcctgg

SEQ ID NO: 77240 - DNA, 68 bp, Mus musculus
gtgtgtagggggagttagaacaggtttggctctggtgagctcatctgtgtgtgtgtctctgtatgtgt

SEQ ID NO: 77241 - DNA, 78 bp, Mus musculus
gggatttatacaggtgacgagttctcacttctcagtctgtccggaagctgagaacagagaacgttcatgccctttcct

SEQ ID NO: 77242 - DNA, 133 bp, Mus musculus
gacatggttgcctgaggatgggcgcacatatgtgagtgcagaggtgtgtgcaccataagcatgagcatgtggatgtggagaaccatctcaggtcgtactcctcacgtgtcatccaccatttgctttctgaggc

SEQ ID NO: 77243 - DNA, 114 bp, Mus musculus
gttgttctcacctgttgagccatctctccagccccctttatatgtttttattagcatatattagttaaagtaggtgatggttttgatgatggcattctcaggttcgtttataat

SEQ ID NO: 77244 - DNA, 99 bp, Mus musculus
ggccttcatctttttacacacagtatgtgtgcatgtgcttgtctatatatgcattcaggtgcagggatgtgtgtgtgtgtgtgtgtgtgtgtgtaggcc

SEQ ID NO: 77245 - DNA, 97 bp, Mus musculus
tggcatggaaggatccgggttctctcgtcagatgtgagtgagggaaaacttatagagaaacattgacttggagacactgaatcgacattcaaggcca

SEQ ID NO: 77246 - DNA, 79 bp, Mus musculus
tctttgtgtgtgtagctgtacatgtgtgtgctcatgtatatgctggtacagatgtgtgcacatatgtacaggtcaaaga

SEQ ID NO: 77247 - DNA, 74 bp, Mus musculus
ccaggcctcagggagtggtgggttgcagggagctggctgacactcccattctctgtctgttactcttgggctgg

SEQ ID NO: 77248 - DNA, 71 bp, Mus musculus
tgagggtcatggaggcagaggcctggtaaagccgtgcaaagccagactctctcgctcacacaggactctga

SEQ ID NO: 77249 - DNA, 82 bp, Mus musculus
ggcctctaacagtcacaggcgcctatgttctgtagccatcttgtggcaagacaacagtgctctggacaatccatagacggcc

SEQ ID NO: 77250 - DNA, 84 bp, Mus musculus
tttcttgttttcagagaagacactctgcttattcgctccttgttgcgtgcacccaagcaaggttttattttctgaaattggaaa

SEQ ID NO: 77251 - DNA, 110 bp, Mus musculus
gtgcatgggaacatatgcatttaatggtaaagataaataattcttgccgtttggccaaaattgattattttttcttcttcccttacatgttgtgattttcttgttggcac

SEQ ID NO: 77252 - DNA, 100 bp, Mus musculus
ggtcattgatgcggtgagtgtggcctctcatctcccacagtctcacagggtctgtgaggcctgccggtgaaggtgcatccttgttctgcacaggacggcc

SEQ ID NO: 77253 - DNA, 107 bp, Mus musculus
tttcttagaaaagtgtcacttcgggaccctacccagcaactcagggtgtcacacactctcttggatatcctctctgccactagggttctgacattctatttaggaag

SEQ ID NO: 77254 - DNA, 95 bp, Mus musculus
actcacaaattcactgtcaggctaaccagcaatgaagagtgctatgtaaaataccctctctcatcttcagctgaaatctgtggcgtggtgtgagt

SEQ ID NO: 77255 - DNA, 68 bp, Mus musculus
cacacacacacacacacacggcagcctggtgaagcccagagctttgtcatgtgatgtaagcatgagtg

SEQ ID NO: 77256 - DNA, 95 bp, Mus musculus
aggttatgctataagctggtctcagactcacagagtctgcttctgctcctccccagtgctggacctgaaagactcctgcccccagctagctactt

SEQ ID NO: 77257 - DNA, 79 bp, Mus musculus
gccctgaggaagtaggttggattgtatgaaagtgacacaggttgtcgagagagacgaatctgccttccttgattagggt

SEQ ID NO: 77258 - DNA, 88 bp, Mus musculus
tttaactggaggatggggatggacgagggaagctctgtctgtctgtttctaataagtccagtcagacaagcttaaaagggaagactca

SEQ ID NO: 77259 - DNA, 164 bp, Mus musculus
tatgtgtatataatgtatgtatatataatgttcatatatgtgtgtgtctgtataatgtgtctatatgtatatatgtatataatgttcatatatgtgtgcatgtataatatatgtatatgtgtctatataatgttcatatatgtgtgtatttaatgtatgtgtat

SEQ ID NO: 77260 - DNA, 86 bp, Mus musculus
gtggcattccctctctgtatctctctgcgctcctctcctgagtcatttgagaggaggtttgagacttgcagtcccaaggactccac

SEQ ID NO: 77261 - DNA, 111 bp, Mus musculus
gctggattgaagacctgagtatcagaaatccagattctggcagtattagaagatctatctatctatctatctatctatctatctatctatgtcttaggaactctcaaaggc

SEQ ID NO: 77262 - DNA, 71 bp, Mus musculus
aagagaacggagtggcggctgctctcgactctttgtagcggggtctcagagggtctcactctgagtgtctt

SEQ ID NO: 77263 - DNA, 69 bp, Mus musculus
tatatgtgtgtatatctctgttgcaaatatgtgtatgtatatatgtatgagagtatgtatgtgtatgta

SEQ ID NO: 77264 - DNA, 112 bp, Mus musculus
gcctgaaggatatacaggaaatagtgttggagactcacttgggtgctcagttctgtcttcctaggctcataggtggaaggttgagagctgtgggtagagtgttcagaaatgt

SEQ ID NO: 77265 - DNA, 110 bp, Mus musculus
cacaaatgcatatgtatatgtgtatgtgcatatatatgtatatatatgtgtgtgcatatatatacacattatatataatagcacatatgatatatatgtatgtattaatg

SEQ ID NO: 77266 - DNA, 67 bp, Mus musculus
caactcgaatgtagtcactcgtgggagaaacggctcctgcctcagtcaccctctgacacttgggttg

SEQ ID NO: 77267 - DNA, 114 bp, Mus musculus
gcacatatacatatgtatatgcatatgtatgtgtatatatatgtgcgtgtgtgtgtgtatatatatatatatatgtatatgcacatgtatgtgtatatgtatgtatgtatgtgt

SEQ ID NO: 77268 - DNA, 79 bp, Mus musculus
gtgctttctaaccttgttgatgtcattttttttttaaagacaaggtgctcatcaaagacagagaggtgagagagagaac

SEQ ID NO: 77269 - DNA, 113 bp, Mus musculus
tatatatatgtgtgtatatatgtatatgtgcatatgtgtatatatatatatatatatatatatatatatatatatatatatgagtatgtatgtatgtatgtatgtatgtatat

SEQ ID NO: 77270 - DNA, 106 bp, Mus musculus
ttggtatcagattttatgtatatatctatgtacgtatgtgtgtatgtatgatgtatgtatgtatgtatgtatgtatgtgttttattcttcagatcagctttactaa

SEQ ID NO: 77271 - DNA, 80 bp, Mus musculus
actgcacccagagtgtgccgagtaggctgggctgattggccagcaagctctaatccccctgcctctgtctctgtctcagt

SEQ ID NO: 77272 - DNA, 66 bp, Mus musculus
gacagatgagagactcagcccccacccccgtgtgtgtgtgtgtgtctgtctgtctgtctgtctgtc

SEQ ID NO: 77273 - DNA, 108 bp, Mus musculus
gcatgagacagaaaacgacagggactggagagatggctcagtggttaagagcactgactgctcttccagaggtcctgagttcaattcccagcaaccccatgatggctc

SEQ ID NO: 77274 - DNA, 86 bp, Mus musculus
ttagggagatatgaattaatggatgaatgaatgaatgaatccatccatcaatccatccatccatccatctaatctaatctacctaa

SEQ ID NO: 77275 - DNA, 80 bp, Mus musculus
acacgtgtatatacaacatcatagccacacctgtgcacatattagggtgggtgggtctgtctgtctgtatgtatgtatgt

SEQ ID NO: 77276 - DNA, 68 bp, Mus musculus
tgcatatatatgtctctgtgtgcatatgtatacgtgtttgtatatgtatgtgtatatatgtatatgca

SEQ ID NO: 77277 - DNA, 73 bp, Mus musculus
gggtgccctggaccagatgcaggcctcgtgcatgctgcacgcccggcccatgctagtgttgctaggtggatcc

SEQ ID NO: 77278 - DNA, 57 bp, Mus musculus
tgtgtgcctgtgtctgtgtatgtgtgcccacacatgtatatcagaggttggtatgga

SEQ ID NO: 77279 - DNA, 74 bp, Mus musculus
agtctcagagtggatcatgagcctgtgtcctccagccacgttctgagtctctgggtgcctgtccctctgaggct

SEQ ID NO: 77280 - DNA, 57 bp, Mus musculus
cacgagagctggggctaacggaaggggattcactctctgtgacttagtgactcagtg

SEQ ID NO: 77281 - DNA, 83 bp, Mus musculus
gtcccctctgcctgtctcagtgtcccattctggagtcctgtgtcatctgcagcactccctggaagcagagcatcctgagtgac

SEQ ID NO: 77282 - DNA, 76 bp, Mus musculus
ggattaaagacttgagccaccatgacccgctgtgaagtcattttcactgtggctcagttctggtgctgtcggatct

SEQ ID NO: 77283 - DNA, 113 bp, Mus musculus
ctgagcaagcagagttgaccagagcaagtggggctgatcggagtgagcagaggtcctaaaaattcaattcccaacaactacatgaaggctcacaaccatctgtacagctacag

SEQ ID NO: 77284 - DNA, 108 bp, Mus musculus
ggtggctggtgattgtgactcccagatctactcttcagagctgggaggttgcctgtgtgcctggctggctcagaggggcttgggaaggtctgggtcctggccatcact

SEQ ID NO: 77285 - DNA, 97 bp, Mus musculus
gtctgagagttgaatgttcctttagactttatgtttattgcttttataaaatggtggtaaaaatacacatactatagaattgatcgctctctcagtc

SEQ ID NO: 77286 - DNA, 135 bp, Mus musculus
aatgtgtgtgcccttgtcccctgctgtatgggagggcagtagggagttagtggtttcctctgtttatatgtctctgctttggttctgagtccatgatagcactggacgggacagcgttgagggtcttattgattc

SEQ ID NO: 77287 - DNA, 77 bp, Mus musculus
gcaaaagcactgttgatggagggccagatggtagctctttggggctcctagagccacactcactcagtttctgttgc

SEQ ID NO: 77288 - DNA, 84 bp, Mus musculus
ggcctggaggagtccctgacccactgtctctttatctgtccctgtgggcctaaggatcagtgaaggaatgacttggataggacc

SEQ ID NO: 77289 - DNA, 74 bp, Mus musculus
atgtatgtgtatgtgcatgtgtatgtatgtaatttcatggatatatatatacatatatgcatatatacatacat

SEQ ID NO: 77290 - DNA, 90 bp, Mus musculus
tggatatgtgtgtgtgtgtgtatgtatgtatatatgcatatatgtatatatatatccatgaaattacatacatacacatgcacatacaca

SEQ ID NO: 77291 - DNA, 81 bp, Mus musculus
tatcatggggctgactttgtgaatgtttgtaacagggccgatggagggttcttcatagggtgtctctcagcctctcagata

SEQ ID NO: 77292 - DNA, 111 bp, Mus musculus
ttagcctttcttgctgtctttcctcagtgatatatcgtatccacacatgtccatttgtttacatgtatatgtctattattggctagggatctatgcaaaaagaaacactaa

SEQ ID NO: 77293 - DNA, 81 bp, Mus musculus
gggaatcagattgaggcactgtgtctaatctctgtctcaacccctgtgcggcctttactctgtgtctatctctgtcttctc

SEQ ID NO: 77294 - DNA, 65 bp, Mus musculus
acagggtagactgagtcagaattgagcagagcactggttctgacagcttctctcagtctgattgt

SEQ ID NO: 77295 - DNA, 110 bp, Mus musculus
cagatgcatacataggaatatatatatgtgtatatatacatatatatatatatatatatatatatatatatatgtgtgtgtgtgtgtgtgtgtgtgtgtgtgtgtgtgtg

SEQ ID NO: 77296 - DNA, 83 bp, Mus musculus
gcatgtctgtggtatatgcatgtgtgagcatgtatatgtgcttgtatgtatgtatgcatgtatgtgtatgtatctatgtttgc

SEQ ID NO: 77297 - DNA, 82 bp, Mus musculus
ggaatgcacagagatgaccattagatgactcgttggtgtgtgcttccctggcaaacgctctgtccctcactctcagcatccc

SEQ ID NO: 77298 - DNA, 117 bp, Mus musculus
ctcttcatggccagcgcttgctttccgtcgctggggatctaatatctgagatgagacactctcacatagtcagaccacggattgacagcaccgagtgagaagccgcaggagtgggga

SEQ ID NO: 77299 - DNA, 73 bp, Mus musculus
aaaagtgactgtcatctggagacgtttttgcccatcaggggacagatgacagtggccagagagagacactttt

SEQ ID NO: 77300 - DNA, 83 bp, Mus musculus
gtggcaaaacctgactaactgcctcctatcttcaatttcgccttagcggatacatgaaggcacacagtcagtcagtcacccac

SEQ ID NO: 77301 - DNA, 102 bp, Mus musculus
gttggtgttccaggccctggctagccagagcactttgaggcgaggagtccctaggctgatctcagtttgttcatgtgtgcaaggggccttttcttgactgac

SEQ ID NO: 77302 - DNA, 118 bp, Mus musculus
agggaagtcaccttgggtcgatgcagaatgcttgaaaggcttgtctgagagagattttttttttctctaacaccagtcactttcactgctatattggagtttactattgtattttttt

SEQ ID NO: 77303 - DNA, 94 bp, Mus musculus
tgattcattatcagaaaatgtttgatttggataccaattttatatatttacaaagtgagagttgcccaaatttttatttgatgaaagggagtca

SEQ ID NO: 77304 - DNA, 71 bp, Mus musculus
agggcttctgcactggctggtttcgtgtgtcaacttgacacaagctagtcagcagagaggaaggagcctct

SEQ ID NO: 77305 - DNA, 71 bp, Mus musculus
gcatgatactggaatgaaaataagtttgctgcttgttctcacaggtgtgtgggtattttcctaggatcagc

SEQ ID NO: 77306 - DNA, 112 bp, Mus musculus
agttcatctatcttggatcaaggtccgatgatcagccagtctctgtccctgtgaataatagacagtccctggctgctccaagttcatatcctgtccttcaggtagcaccact

SEQ ID NO: 77307 - DNA, 73 bp, Mus musculus
gtgtatatatatatatctatatgtgtgtgtgagtaggagcttggggaaggatgtggggtgtgtgtgtgtgtgt

SEQ ID NO: 77308 - DNA, 167 bp, Mus musculus
gtacttgtggcaggaaatgtgatatatatatatatatatatatatatatatgcacgtgcttgtggcaggctatgtgtgtatgtatgtatgtatgtatgtatgtatgtatgtatatatgtatgcaggtgcttgtggcagggtgtgtgtgtgtatgtatgtatgtatgt

SEQ ID NO: 77309 - DNA, 78 bp, Mus musculus
gggttaggttacattctgcatctgcttctgcttgtcttcagggctaggcggagccacggcagggtcttgacagggccc

SEQ ID NO: 77310 - DNA, 60 bp, Mus musculus
ggaagcagagaggtggactgtggtgctcatcttgttctcgctctctgtctctctgtctct

SEQ ID NO: 77311 - DNA, 75 bp, Mus musculus
gactagacagattccctgactcactccctgattcagtcattgcttgagtagtgtctgtctgtctgtctgtctgtc

SEQ ID NO: 77312 - DNA, 82 bp, Mus musculus
tatatacacatatatatgtgtgtgtgtgtatatatatatatacatgtatgtatatgtatacacacatatgtatgtgtgtata

SEQ ID NO: 77313 - DNA, 83 bp, Mus musculus
gtggatgccactgccagacttctgcagcttctctcccaaatactatatgcgaagcttaaagggagtcaagggcctgtgtccac

SEQ ID NO: 77314 - DNA, 99 bp, Mus musculus
ctcacgggtatctagctatggtttgggtcgggtccaggcacagccttgaattaaaggttgagacagatgactcagagctcagtaagaaatgcaggcgag

SEQ ID NO: 77315 - DNA, 83 bp, Mus musculus
cactgactgctcttccagaggtcctgagttcaaatcccagcaactacatggtggctcacaaccgtctgtaatggccttcagtg

SEQ ID NO: 77316 - DNA, 74 bp, Mus musculus
gatgttctcccagagggatatgtgtgtgcacatgcaagtacatgtgtgtgtgtgtgtctatctgtgtgtgtatc

SEQ ID NO: 77317 - DNA, 138 bp, Mus musculus
agccccgggagctgaagtacccttgctcctctgattgtaaaggttttcaacacaaatgtaagtctgagaagagagtgaccaggagtgagccctggaggctgctgtgtgtatcgatctatctcagaaggacaggcttgg

SEQ ID NO: 77318 - DNA, 58 bp, Mus musculus
gcatacaggagcgagagcaaggaagcctgcctgcctgcctgcctggctgcctgtctgc

SEQ ID NO: 77319 - DNA, 82 bp, Mus musculus
ccaggtctatccctatacagcctgaagtgttggctcggtaaagaatcaagagagtcagcaatgtgggctttcagggactgga

SEQ ID NO: 77320 - DNA, 59 bp, Mus musculus
ttgttcagatacttgctgacaggagctgtctcctgagagtctctgtcagtgcctgacaa

SEQ ID NO: 77321 - DNA, 101 bp, Mus musculus
gtctggtttacgtggctgtctcctgagcggtgtctgtagtcagtgtgcttctgtcaccaggccttcggcacttgggttcagtgagtgtgtcatagcaggac

SEQ ID NO: 77322 - DNA, 136 bp, Mus musculus
gtcttgaggcagcgtcaagtttgctgtcggctgggcctggagtgtggcctaaggcagagagacagtagacacagtcctggaagagacacagtggggtctggggttggagtttcagagccaccctcccccagtctgt

SEQ ID NO: 77323 - DNA, 86 bp, Mus musculus
tggctggagaggctggagaaatgattcacgagtgcgcactctgtgggggtaaatactcagtgactggctctgtcatcctcctgtca

SEQ ID NO: 77324 - DNA, 81 bp, Mus musculus
agagaagaaacttgagatgaagagatggctcagtagttaatagcactgactgctcttccagaggtcctgagttcaattcct

SEQ ID NO: 77325 - DNA, 76 bp, Mus musculus
gagcacctctggagaaatgtcgataggggctcaaatcaatactagtctctgtttgtcactgtttctccgtgtgctt

SEQ ID NO: 77326 - DNA, 118 bp, Mus musculus
gagcctcaagtgatggggcaggagggttggtgatcaagttgtctcacagtcatttactctcagcaccttgactgcttaggtctttgttgctgactactgtccaccgcaaaagaaactc

SEQ ID NO: 77327 - DNA, 68 bp, Mus musculus
tctgtgtgtgtctttgtctcagtgtatgtgtgtgcacacacatgtgtgcaatgcccaaggagttcaga

SEQ ID NO: 77328 - DNA, 103 bp, Mus musculus
tatatatgtatgtgtatgtatgtgtatatatgtatgtgtgtattgtatatgtgtgtatatatgtgtatgtatatgtgtatgtgtgttaacacatgtatgtgta

SEQ ID NO: 77329 - DNA, 92 bp, Mus musculus
gtgtgtatacgtgtatgtgtgtatgtatatatgtgtatatatatgtgtgtgtatgtatatatgtgtatatatgtgtgtgtatgtatatatgt

SEQ ID NO: 77330 - DNA, 62 bp, Mus musculus
tatatgtgtatatatgtatgtgtgtgtatttatgtgtgtatatgtgtgtatgtatgtatgtg

SEQ ID NO: 77331 - DNA, 134 bp, Mus musculus
tatgtatgtgtacctattcatatatgtgtgtatatatgtgtgtgtatatatgtgtatatgtatgtatgtatatatgtgggtatatgtatgcataagtgttatgtatttatgtatgtatatgtatgtatgtgtac

SEQ ID NO: 77332 - DNA, 113 bp, Mus musculus
acagtttaagaaagatactttattatatgtgtatgtgtgcatatgcatgtgtatatgtgtgtatgcctgtgtatgcctatgtatgtatgtgtatgtgtgtgaatgtgtgtgtg

SEQ ID NO: 77333 - DNA, 78 bp, Mus musculus
taaatatggccagtttaacacactataggcagaattggtcctgacactgcaagtagatgtgttaggctgccaagttta

SEQ ID NO: 77334 - DNA, 83 bp, Mus musculus
gactttgagtggtacctgtgtcttcatcatgacatcgtgttgggtgtgaaggtttcaggagacagagtgcagtcactggagtc

SEQ ID NO: 77335 - DNA, 74 bp, Mus musculus
gtttggctctgggtctctgagtctgtgtcagtcagctgctggctggagcctctcagagaacagttatgctaggc

SEQ ID NO: 77336 - DNA, 74 bp, Mus musculus
atggtatgagagtggagaaattggaccgagcatagcaagcatgcctttgtctatttctctctgctcttgactat

SEQ ID NO: 77337 - DNA, 76 bp, Mus musculus
gacaccttgaagatggttggtgtgggccttgtcggttgagcgcggggatcacactcactctgattctgtgtttaag

SEQ ID NO: 77338 - DNA, 67 bp, Mus musculus
tctgtctgtctgtctgtctgtctgtgtaagcatatgctacatgtataggggtgaccacctaggcaga

SEQ ID NO: 77339 - DNA, 61 bp, Mus musculus
tacaagtggtcattgcctgtagagtcacatacatggatgtgacttgagagtgaccactgtg

SEQ ID NO: 77340 - DNA, 79 bp, Mus musculus
acacactcactgtctgcttgccttctccagtccccgccccagatcccagcaggtggtaagcagacagagttatgtgtgt

SEQ ID NO: 77341 - DNA, 89 bp, Mus musculus
gaggagaaataagccctgtcactggagagatggcactgcattttagagcactgactgctcttgcaggggacctgggttcagttctcagc

SEQ ID NO: 77342 - DNA, 69 bp, Mus musculus
tgggggagggtccatagagtgtgctctctgtggctccttccagtctcacactgtctgtctcctcctcca

SEQ ID NO: 77343 - DNA, 92 bp, Mus musculus
gcacatacacacgcatacgtatgcaaacacacagacatgtgcatgcacacacacgctttgtctgtctgtctgtccgtctgtctgtctctgtc

SEQ ID NO: 77344 - DNA, 83 bp, Mus musculus
gcctggctccaaagatctgtgctatgatctcagaccctccctgtgaccctgcatggctatcctcaggctgtgtgagctgaggc

SEQ ID NO: 77345 - DNA, 72 bp, Mus musculus
aagaggttccctaaagctctgtcacttgtcaggtatctccacaggtcttagagaataaagagagaacacctt

SEQ ID NO: 77346 - DNA, 75 bp, Mus musculus
ttgaattttgggggcctggagagatggcttagtggttaagagcactgactgctcttccagaggccccaagttcaa

SEQ ID NO: 77347 - DNA, 70 bp, Mus musculus
tgcatgggaggacagagtgtggcactgggcagtgagctgcactctgtatcgctctgagtctcacagtgca

SEQ ID NO: 77348 - DNA, 89 bp, Mus musculus
agagcatagatctgaatgagtcccatgaggttgttctgtccttgaatatttttatatgcagagccttgagcgaactccttcctgtgtct

SEQ ID NO: 77349 - DNA, 66 bp, Mus musculus
gggcagaccaagggcagacttggtaaggtctactcctgtgtctgtatctgtgtctgtctgggtctg

SEQ ID NO: 77350 - DNA, 75 bp, Mus musculus
gattgtagctgggcacagaccactcgggaacctcacactgcctgctcccccagtctgtctgtctctgtctctgtc

SEQ ID NO: 77351 - DNA, 111 bp, Mus musculus
acatctagctgtaggctgtagcacacccgaagctcttctaacttctgtttctgtgtcctgggctgtggagatcgatgagcagagtctgggtggctttcatcatagagatgt

SEQ ID NO: 77352 - DNA, 69 bp, Mus musculus
gacatgtctggctgcatgagtggaggcatgctctctgagactcccactcaggtacagctggttatagtc

SEQ ID NO: 77353 - DNA, 147 bp, Mus musculus
tatatgcacacacatatacatacacacatacatatgtatatatacatatatatacacacatacatatgtatatatatatatgtgtgtgtatgtgtgtgtgtgtgtgtgtgtgtgtatatatatatatatatatatatatatattgca

SEQ ID NO: 77354 - DNA, 75 bp, Mus musculus
gcctaccctctctgtgtctgtgtgtcatctcctgggtgctagtgcccggctagtgtaaatataatggaaggtggc

SEQ ID NO: 77355 - DNA, 108 bp, Mus musculus
tctaccttcaaaggcccaactggaggcaacactaggcctaaaaaagtgtgagccagactctgtctcacacccacaggcctgccgatgcccacagattacaaaggtaga

SEQ ID NO: 77356 - DNA, 66 bp, Mus musculus
tttatggtcttaaggacagatggcatggctaccatctgagtgcttctctctgtctatgactgtgag

SEQ ID NO: 77357 - DNA, 72 bp, Mus musculus
ttgtcactgtgcacactaggaggtggctccttgctgctcacagcgctggcctcccagtctgcgtctgacagt

SEQ ID NO: 77358 - DNA, 115 bp, Mus musculus
atgtagtatgtgtgtgtgtatatatatacacacatatctatgtatataacatatatgtatatatgttagtatatactgagcagctgtatgtgtgtgcacatgcatgtgcatgcat

SEQ ID NO: 77359 - DNA, 113 bp, Mus musculus
agccaaatgagaagatgtccatggtacataaagaaatgaaatgtatagaccacatatatgtatgtatatatgctatatatcacagaatttatacatattcttagcctgaggct

SEQ ID NO: 77360 - DNA, 64 bp, Mus musculus
tctatcactgagtcattaaggcctgaccttcctctcagctctctgtgtgagctcagatgatagg

SEQ ID NO: 77361 - DNA, 58 bp, Mus musculus
gcagatcagatgtgagctctcagctactgttgcagtacctgcctgcctgcctgtctgc

SEQ ID NO: 77362 - DNA, 76 bp, Mus musculus
gtcttgcatctgtctctctgtgtctgtctgttacacacatcccataactgctggcactttgggagaccagccagac

SEQ ID NO: 77363 - DNA, 75 bp, Mus musculus
ggctggtgtgagcacacagtgtggtgggttcaggagctgggccccagggacaccatgcagtctgtgctccgcccc

SEQ ID NO: 77364 - DNA, 87 bp, Mus musculus
ggctgagctgctgcttagggttgcagtctcgggggtctgctcagtgtgaccacacaggctgtgtccctggagggatggggttcagcc

SEQ ID NO: 77365 - DNA, 59 bp, Mus musculus
tgtatctgcatgtgcatctgtgcatgagcatgtgtgtgcagtgtgtgcatgtatgtgca

SEQ ID NO: 77366 - DNA, 61 bp, Mus musculus
gtgtgtgtctgtgtgtgtgtatgcattgtgggtctgtgtgtgcacacgtgtgtgtgtgtgt

SEQ ID NO: 77367 - DNA, 99 bp, Mus musculus
gctgtgctgtgtgaccttgggcaggtctgccagagtctctgtttctgtatgtgtgagatgaggatggttgtggttgataaagtgacaggatacagaagc

SEQ ID NO: 77368 - DNA, 93 bp, Mus musculus
gcaggcctggggtggctggaacagtgaagttgttgtggagaaaggtcaggtcacaagttggtctcttctggcccactgcttgctgcttttagc

SEQ ID NO: 77369 - DNA, 100 bp, Mus musculus
gtgtgtgtgcttgtgaggtcaggctgtggaagttggttgtgtttctaccacaaggggctgtgaactcagatcatcaggcctggcagcaagtgctaggaac

SEQ ID NO: 77370 - DNA, 71 bp, Mus musculus
cttctgcctctgtgtctcagttcctcagaatctaatcctgggatctgcagccagccaacttctagcagagg

SEQ ID NO: 77371 - DNA, 103 bp, Mus musculus
gggtgtggccctggtggagtaggtgtggctctgttggagtaggtgtgtcactgtgtgtgtgggctttaagaccctcatcctagctgcctagaggccagtattc

SEQ ID NO: 77372 - DNA, 120 bp, Mus musculus
ttgtttgtttgttttagttttagtttgcaaagtggtggttttgtcacagcatcttctttcttgtcttgagacagagcctcactgtgtcaccatggctggcttgggaactcacaatgtagc

SEQ ID NO: 77373 - DNA, 74 bp, Mus musculus
gagggaattaatcacaccacagacctgtcagcccactcacccctgagtcccagagtctgtctgacacatctctc

SEQ ID NO: 77374 - DNA, 194 bp, Mus musculus
atatatatgactgtatatgtatgttatatatatgactgtatatgtgtgtgtatatacatatatatacatatacatatatatatatatatatggctgtgtgtatatattgtgtatatgtgtgtatatatatatgactctgtgtatatatatatatatatatatatatatatatatatatacaattctgtgtgtgt

SEQ ID NO: 77375 - DNA, 89 bp, Mus musculus
tcactatgcacagtgtggtctctcctggctttgctgaatgagacaccctgccaccctgaaagccaggtgccacattaatggatggctgg

SEQ ID NO: 77376 - DNA, 72 bp, Mus musculus
tgagcggagagtggacaccctctacatgtggcaggagaggtaggggaaggatgcgtgtctgtctgtctgtca

SEQ ID NO: 77377 - DNA, 120 bp, Mus musculus
tgagacactgaggctgctcgatggctgcaaatcctgtccctgtgctcacacagcctctctgcctggctggggatgagggcaggagcgagttactggctcatcagagcataggtgtgtcag

SEQ ID NO: 77378 - DNA, 90 bp, Mus musculus
ggatggcagttatgactaacagagtagacttgacaaatgttgcctgcctgagcctgttgtcagtctgtctgtctgtctgtctgtctgtct

SEQ ID NO: 77379 - DNA, 109 bp, Mus musculus
gcctgctggggagtgaagtgtcccaggggcagaacccgctggtcaaaccctaatttggcctgtgtgaacatagagaggtgaacccatgtggtcgcacactttccttggc

SEQ ID NO: 77380 - DNA, 91 bp, Mus musculus
tatatatgtatgtatgcatgtgtgtatgtatatgtgtatacatatatacctgtatacatattatatatacatatataatcacatatatgta

SEQ ID NO: 77381 - DNA, 155 bp, Mus musculus
gtatatacatatatgtgtgtgtctgtgtgtgtgtgtgcattatgtacatatataatcatatatgtgtatataatatacatacatatataatcatatgtgtatatgtacatatatatatgcataaatgtgatacatatatgtatacatgttatata

SEQ ID NO: 77382 - DNA, 115 bp, Mus musculus
ggaggtcagaagggacagtttccaggagttggttatcttcttccaccaggagttctggggattgaactcaggtcctccagcttgctggctctagacttacatcattcctgcctcc

SEQ ID NO: 77383 - DNA, 65 bp, Mus musculus
agggttgacagaagagaggaagctggcttacatgttactagtctctctctctcttgctcagtttt

SEQ ID NO: 77384 - DNA, 84 bp, Mus musculus
gaatgacaggggctggagagatggtttagtggttaagagcactgactgctcttccagaggtcctgagttcaattcccagcaccc

SEQ ID NO: 77385 - DNA, 82 bp, Mus musculus
gcatgcatgtgtgcttgtctgcatgtgtccatgtgtgcatttgtttatgcatacatgtgtgtgtgcttgtgcatgtgtatgc

SEQ ID NO: 77386 - DNA, 67 bp, Mus musculus
gttgttgactgtgtttgagaagagagactgggcaaagctctgtctctctgtctctgcaccaagcggc

SEQ ID NO: 77387 - DNA, 109 bp, Mus musculus
tctatccatctgtctgtgctgtatttgagtgcttgggaactcagtacatggttctgtctgtgtatctgtgtgtctgtctgcgggtctgtgctgtataggagtgcttggg

SEQ ID NO: 77388 - DNA, 82 bp, Mus musculus
caggtgaacagacatttgccaagcagaggaggagccatgttgaatgtgagtgtcatgtctgtctgtctgtctgtctgtctgt

SEQ ID NO: 77389 - DNA, 80 bp, Mus musculus
gggattgcacagggttctgagctgggactgaattaaaatcttgttgtccccgtcccggtctgtcagtctgtcatcgtccc

SEQ ID NO: 77390 - DNA, 78 bp, Mus musculus
tgaccccagcacagtgtgagcacagtgtgagcaaacaaaggacatgtggcacggcaatgcacaatgaagctgggctca

SEQ ID NO: 77391 - DNA, 127 bp, Mus musculus
gtatatgtgtgagtgtgcgcatgcatttgtgcatgtgcctatgtgtgtttgtatgtatgcatgtgtgtgcattgcgcgtgtgtgtatatgtgtgtgtgtatatgtgtgtgtgtgtgtgtgtatgtgt

SEQ ID NO: 77392 - DNA, 70 bp, Mus musculus
tcgaggttagagggaaaggtcgaggtccgcgggaaagggctcttgctcctctgtatcactctgactgtgg

SEQ ID NO: 77393 - DNA, 126 bp, Mus musculus
tgtgtgtatgtgtgtctggtatgtgtgtatgtgtgtctggtgtgtgtgtatatgtgtctgtctatgtatgtgtgcatgtgcttgtatgtatgtgtatttagtagaatctcaatatatagccctgga

SEQ ID NO: 77394 - DNA, 61 bp, Mus musculus
gtctgtctgtctgtctgtctgcctgtctgtgttctgcagactggagaaggcaaaagaggac

SEQ ID NO: 77395 - DNA, 58 bp, Mus musculus
cctgcctgcctgcctgcctgtcagtctacagctggcaaggtggaggcatcttcgcggg

SEQ ID NO: 77396 - DNA, 99 bp, Mus musculus
gtagtgggcaggctgcctggtgctgccctggctgcagcccttagcctttctagcttcagtctctagtcagagtgctcacagcaggtgccccgtccctat

SEQ ID NO: 77397 - DNA, 95 bp, Mus musculus
tgcatcgatgagatgtgccaccccagctcaccccgttcacagctgccaagtcaggtacagtgtccctcagtggctgaatgaagtcttattctgta

SEQ ID NO: 77398 - DNA, 75 bp, Mus musculus
agacaggatggaagtcagggcctggcccatgctgcctcctccactaagcacagctttctctgtctctctctgtct

SEQ ID NO: 77399 - DNA, 69 bp, Mus musculus
gtttgagatcagcgggaaacgcacagagaaacgagagtgctctctctgtattccgtggcagcttggtgc

SEQ ID NO: 77400 - DNA, 119 bp, Mus musculus
gtagtgttttgaggtctgtgtgcaggggagtgttggcagcccagtcctccctccctggctgcctgatagacactactcatcttggttagcaacttggttagtggctcatctcggctagc

SEQ ID NO: 77401 - DNA, 85 bp, Mus musculus
gcaaggagtttaggggtgaggccagggtggggactatggagaaagtgactctctcagaggctcacgtgtggctatgcgtggtgac

SEQ ID NO: 77402 - DNA, 88 bp, Mus musculus
cctgtgcccatgggcaggactgggtctctctgtggcagttgcttcttgggggtcacaggtgagtcttccagccagcctggccttcagg

SEQ ID NO: 77403 - DNA, 120 bp, Mus musculus
ggagattaaagacttgaattgtgggtcagtgggctccaggctgcagggctgcctctgtgccagactacctgcctgtttccagctgtgtgaccttcagcaagcgacttcacctctctggtc

SEQ ID NO: 77404 - DNA, 106 bp, Mus musculus
gaaatgcaacttagtatcactcatgtgaccacatgtcatgggatctggaagagagaagagacagacccgtgtgctgggagacatgggggaaggcttggggggcttc

SEQ ID NO: 77405 - DNA, 104 bp, Mus musculus
caacatcttggaccagtgacccagcactccctgagttctgcagcatccacacttgtggatgagaataccaagtcctggggaggctaaatactgactcaaagttg

SEQ ID NO: 77406 - DNA, 88 bp, Mus musculus
gtcttcatgttattttttgagacagtgtctctcactgagcctggagctcatgagttagctaactgtctagccaacgagctctgaggat

SEQ ID NO: 77407 - DNA, 118 bp, Mus musculus
aagcaaaatgaggccacctgtccagcccagagcagaaggagaggccggagttgtttttcagtgtgtctgtctgtccttctgttccacttgtggacagagcaggagcctgagacccctt

SEQ ID NO: 77408 - DNA, 81 bp, Mus musculus
tcagtgtgtgtgtgtcagtgtgtgtgtataggggaagcatgaagcaacccagatggtcagaggagtggataaacacatgga

SEQ ID NO: 77409 - DNA, 60 bp, Mus musculus
cctgcttgcctgcctgcctgcctgcctgcgccacacgcttgcacgcagaggcatacatgg

SEQ ID NO: 77410 - DNA, 88 bp, Mus musculus
atgttgcccacccagccacatctgccatgaggacccaccaaggcccagcacaggcctctcgctcactcgctcgctgtggagggcgcgt

SEQ ID NO: 77411 - DNA, 70 bp, Mus musculus
gtgtgtgtgtgtgtgtgtgtgtgtgtgtgtgcacacgtgtgtgcgcatgtgtgtgcatgtgtatgtgcat

SEQ ID NO: 77412 - DNA, 89 bp, Mus musculus
gaatgcctgcttacacagtgggtttgcactctctgagtctctctctgaatcatgtgagcgcacacacatccatgtgtttgtgtgtattc

SEQ ID NO: 77413 - DNA, 118 bp, Mus musculus
tgcacagacggatgtatgcacagatggatatgtgcacggacagatgaatgtgtgcacagacacatggatgtgtgcacagacaggcagatgtgtgcatggatagatggatgtgtgtgca

SEQ ID NO: 77414 - DNA, 71 bp, Mus musculus
gggattgaagggtcagggcagggaagagttggtactgcaccaaaaaacctggctccctgtctgccagtccc

SEQ ID NO: 77415 - DNA, 102 bp, Mus musculus
ccggcagagagccctgggggggaaataggaatggcagtctctgtgactctgggaagtcagagtcctctggctgggagctgtagcccttcctggctcagtggg

SEQ ID NO: 77416 - DNA, 122 bp, Mus musculus
gaagggtgggctgggtttgcagtgtcttctagctgtgtgacctcaggcaacggctcaccctctctgtgcctgagttctttcttaacgcttttgagacttgcagtagacttcttaggtcaccc

SEQ ID NO: 77417 - DNA, 59 bp, Mus musculus
ggcactggcccagagcagtagcagaaacccaacggtctgtctgtctctctgtttcagcc

SEQ ID NO: 77418 - DNA, 91 bp, Mus musculus
ctggccattgctatcaatctcacagacaggagtgtgagctcagagtggtcactggcttgcctgttcttctgtcagacagcatctagaccag

SEQ ID NO: 77419 - DNA, 61 bp, Mus musculus
gattgtgtgtgtgtgtgtgtgtctaagagagacagagagacagacagacagacagacagac

SEQ ID NO: 77420 - DNA, 157 bp, Mus musculus
tgtatgtatgtatatcctcttataggattatatataactatatacaggattttatatataactatatagtattatgtgtaactgtatatgtgattttatatatataactaaatataggattatatataactatatataggattgtatacattatata

SEQ ID NO: 77421 - DNA, 116 bp, Mus musculus
agagtgtttagaagaaactatcagggtagacattgggttctggaggtccacactgctcttactataagtttatgggcctctaattcaccaacacccctgaggcctttacactgtac

SEQ ID NO: 77422 - DNA, 177 bp, Mus musculus
gccgtcacagggacagtccatgacaaggaaacgtgagatgagtggggctctctctctctctctctctttgtgtgtatgtgtgcctatctgtctgcctgtctgcctgcctgcctgtcttcccactgaggccaccttgaatccatctccctgctcaggtggcaggatggatcctccaga

SEQ ID NO: 77423 - DNA, 66 bp, Mus musculus
ggccagagttagcacgttgggagggatagagcctcaacttccacaacagtgtgagcactcgtgacc

SEQ ID NO: 77424 - DNA, 117 bp, Mus musculus
tcatgcaggtgtacatgcaaatagagtattcatgtataaataaataaatcttttttaaaatatttatttatttgttttatgcatatgagtgcactgtagctgtacagatgattgtga

SEQ ID NO: 77425 - DNA, 94 bp, Mus musculus
agcatggagacctactctcgactgtgctcagtgtcagagcagagagtgagctgtgtgtcctgcacaggcagagcatcaagagaggcagaatgtt

SEQ ID NO: 77426 - DNA, 68 bp, Mus musculus
ttgcacaccgtgttcactatggctctgttcacaacagccccgtcatggaaactgaagactgagtgcag

SEQ ID NO: 77427 - DNA, 108 bp, Mus musculus
gggactcctggtgctggctgatgatgacagatgccaggctgctgagagtgagcacagtctacaggacagcctgcagtgtgctccacacggccagcaccacggctgccc

SEQ ID NO: 77428 - DNA, 66 bp, Mus musculus
cctgctctgttctgactgtgtgagctgtgtgagcccacgcagtacaagcctgtcagggtagagagg

SEQ ID NO: 77429 - DNA, 74 bp, Mus musculus
tttgtgcatgtttatatgtatgtatgtatgtatgtatgtatatatgtatgtatgtgcatgtatgtgtgtacagg

SEQ ID NO: 77430 - DNA, 84 bp, Mus musculus
ctgaagttacagacagttgtgagcctccacgtgggtgctgagaatcagaccttagtcctttggaagagcaattggtgctcttag

SEQ ID NO: 77431 - DNA, 121 bp, Mus musculus
ggggcagggaaaggattgtagacgaacgcttcagagtggcaggcttcacacacaagacagagcacacgtaggcaggcaggactgacaagctattgagacatgagccctgtctcctggagag

SEQ ID NO: 77432 - DNA, 208 bp, Mus musculus
gtccccgtggaggtttcaggggtctctgtgtatccctgtggaggtccccagagtgactctgtgtgtctctgtgaaggtttcaggggtctctgtgtgtccccatggaggtccccagggtctctgtgtggcctcatggaggtttcaggggtctctctgtgtccctgtgggggaccccagagctccaggtgcccctgcatccttttcagtc

SEQ ID NO: 77433 - DNA, 66 bp, Mus musculus
acacatacatatatgtatatatatacatacatacacacatacatatacatacatatgtgtgtgtgt

SEQ ID NO: 77434 - DNA, 144 bp, Mus musculus
gtgtgtgattttgtgtgtatgtgtgtatatatatatatatatatatatatatttgtgcatgtatatatatatatacatatatatatacacacacacacaatataccatatagtatagtgtgtgtatgtatttatatatgtgtgt

SEQ ID NO: 77435 - DNA, 114 bp, Mus musculus
ggatcctagtccagtcggtccaataggacaaaagctggctgtgtctctgactgagactggttaggcagtctctcatatagctgcttttgtatccttaggaagacctggaggccc

SEQ ID NO: 77436 - DNA, 131 bp, Mus musculus
gcaggtaggtgtgtgcaggtaggtgtgcaggtgtgtgtgcaggcatgtgtatgcaggagtgtgtgcaagtgtatgtgcaggcatgtgtgtgcaggtgtgtgtgcaggcctcagcaggtccttaggtgctgc

SEQ ID NO: 77437 - DNA, 98 bp, Mus musculus
agccctagaatggggctggagggatggctcagtggttaagagcactggctgctcttccagaggtcctgagttcaattcccagcaaccacatggtggct

SEQ ID NO: 77438 - DNA, 78 bp, Mus musculus
aggtggggaagacgtgaaggtgccaagatgacaggtgtcattcactctgtgtgtgggacctgagggattctgacactt

SEQ ID NO: 77439 - DNA, 73 bp, Mus musculus
tcctctgactttatctctcacttttaaaaataagcgtttgagggcttggggaggtaactcagtggtgagggga

SEQ ID NO: 77440 - DNA, 81 bp, Mus musculus
ctgtcctgtgagctacaaactgaaggtcctggtgtggccagcctagcttctcctgagcctctctccctggctctcagacag

SEQ ID NO: 77441 - DNA, 84 bp, Mus musculus
tcatctttgtcttgctgctgggtctgtctctctgcctcaagccctttgaaaatgcagctgtacctctcagcagaggctgggtga

SEQ ID NO: 77442 - DNA, 82 bp, Mus musculus
ctcctgtctctgtctcacacccagtcctgaggttatagacacattgctgtacccagaacagggtgaaggagctgggcaggag

SEQ ID NO: 77443 - DNA, 96 bp, Mus musculus
ggaagggtgtccagtgtgtcacactcagtcagtatttagtcttcaaccatcaagatgtagtaacaaaagcctagtggtggcacacacctctaatcc

SEQ ID NO: 77444 - DNA, 122 bp, Mus musculus
ccaccctaccccacagtggctctgagatcccagttccctcctcacagatctgtctgaggagacagcgcgtctctgacacctcattgctgggaggtggctgctgtgtcccgggctctactgtg

SEQ ID NO: 77445 - DNA, 63 bp, Mus musculus
cagacagacagacagacagacagaccccgctcctcttggttctgtctgaaatcttgatgtctg

SEQ ID NO: 77446 - DNA, 63 bp, Mus musculus
cagacatcaagatttcagacagaaccaagaggagcggggtctgtctgtctgtctgtctgtctg

SEQ ID NO: 77447 - DNA, 80 bp, Mus musculus
gggttcacctcagcctgatcaagaccccgtcaggtgggctggcactgtctgactggctctctacagaccctggtggggcc

SEQ ID NO: 77448 - DNA, 80 bp, Mus musculus
tggaagaagggagtctcactctcactccttcgcctgcttgccgtgtgggactgagtaactgctagatccttggacttcca

SEQ ID NO: 77449 - DNA, 67 bp, Mus musculus
gtgtgtgtatggctggctatctgtgtctatgtgtctgtatgtaggtcagaggtcagccatcatccac

SEQ ID NO: 77450 - DNA, 91 bp, Mus musculus
gagaatccactgggcgtctgcgcatggcgttggtgtgtgtgggtgtgtatgcacatatgcgtgcctgcctgtgtgggtgtgtgagatactc

SEQ ID NO: 77451 - DNA, 79 bp, Mus musculus
gcctctctcggctcccagaagaccgggtttccttggtcctcgaccacatcactcctgtctctccctgtgagtctctggc

SEQ ID NO: 77452 - DNA, 56 bp, Mus musculus
gagccatcggtgtcacagagtgactagctaagtgtcactgacagactgtgtggctc

SEQ ID NO: 77453 - DNA, 86 bp, Mus musculus
ggttggctttttttttttttttttaatattcctgaaagtcttgagatgaaaccctatggaaagaaacgaagactgagtggccaacc

SEQ ID NO: 77454 - DNA, 85 bp, Mus musculus
gagtaactatttgaaaggtctgagcattaggaaggttgagaactgctgcataatcgtgtctgatgtcagagagcttagttggctc

SEQ ID NO: 77455 - DNA, 59 bp, Mus musculus
acgtgcagatgccagcaagagcaagcacacggtggctatgtgcatgagcaagtgcatgt

SEQ ID NO: 77456 - DNA, 110 bp, Mus musculus
ggccaaactcttccctcacctccaatctgcctccttcccacctgtgtcttgaaaactctgtgactcacagactcagaatgcagaaaggccacaggaatcatcagggtgcc

SEQ ID NO: 77457 - DNA, 92 bp, Mus musculus
ctcttttgcacgtgtatgagtgggtgatatgtgtctatgtctgtgtgttcatgtgtgtgtaggcacataagtttaagtgcgtgtgtattgag

SEQ ID NO: 77458 - DNA, 120 bp, Mus musculus
tgggcttaagatagcacctacaggggctagagagatggctcaatggttaagagcagtgactgctcttccagaggtcctgagttcaattcccagcacccacatggtggctcacaactatct

SEQ ID NO: 77459 - DNA, 81 bp, Mus musculus
gctctctgcctcatgcttgcagatcaggtgtaagctactgctccagtggcaccatgcctgcctgcctgcctgcctgcctgc

SEQ ID NO: 77460 - DNA, 61 bp, Mus musculus
gcctgtctgtgactgtctgcctctccaagctgagggtgcagagctagtgtgtggagcaggt

SEQ ID NO: 77461 - DNA, 71 bp, Mus musculus
cctacatatatgtatgtatatatgtgtgcatatacacacatatacaccaaacatacacacatatacccagg

SEQ ID NO: 77462 - DNA, 121 bp, Mus musculus
ccaatgtttttattttgagatggtcacggagtttcttcttcctacctgccctctttaccttctaagaactgagtgtggacaggaagaatacaaagcctggacccaagctctgaattgtggc

SEQ ID NO: 77463 - DNA, 78 bp, Mus musculus
gggaaaggctgaggagtggtacccacagtttcaatgaggatggccaagagactctgtgactctgtctccgcaaccccc

SEQ ID NO: 77464 - DNA, 122 bp, Mus musculus
gctgccgcagctccacagggcccagagtgaactagaagccaggctggctggctggctggctggctggccgccacccaccctgcaaggcgctctgccctggggcctttgcacctgctcctggc

SEQ ID NO: 77465 - DNA, 76 bp, Mus musculus
ctgctagagatgaggctctctctcagtgtcagtgactagtcccccaaagtactgctgagacccatctttcctgcag

SEQ ID NO: 77466 - DNA, 91 bp, Mus musculus
ccttgggtgtctgtatctgtctgagtcagtggctgggtggagcctctcagaggacagctatgctagactcctttctgcaagcacaacaggg

SEQ ID NO: 77467 - DNA, 111 bp, Mus musculus
cagaattcatcatacacatgtctgaaattctgtctcagagaggagagtgaggaggactcagtcaaactcaacttccctgctgcctagttcatgattgtttgattctgtctg

SEQ ID NO: 77468 - DNA, 82 bp, Mus musculus
gagcaagtggttgatggagatggagacttatctgatgggctgacaacagggtattacactgtgtctctcacagctactgctc

SEQ ID NO: 77469 - DNA, 62 bp, Mus musculus
cagaatcgcctagcacccagataaggtgacatcacacttctctgtgtgtttatgtttgtctg

SEQ ID NO: 77470 - DNA, 82 bp, Mus musculus
actagatgatggagttagagtgacggctcagtggttaagagcactgactgctcttccagaggtctcacattctattttcagt

SEQ ID NO: 77471 - DNA, 101 bp, Mus musculus
acagatgagaactcacctttctccagactttccagacccaagaaaaacaggacgaatggagagacagtctgtatctctgtctgtgtctgtctgtctgtctg

SEQ ID NO: 77472 - DNA, 114 bp, Mus musculus
gtcctgtggtttacattttcgagggagatgtgggcagcttacttcagagaggacacagtgttcaggaaagtgacaggttcagatcagagaagcctcgaagtggtcagacagggc

SEQ ID NO: 77473 - DNA, 72 bp, Mus musculus
tggggactggagagatggctcagctgttaagagcactgactgctcttccagaggtaataagttctattccca

SEQ ID NO: 77474 - DNA, 118 bp, Mus musculus
ggtttttgggttttcgttttggttttttggcttttcaagacagggtttctctgtgtctctggctgtcctggaacctgctctatagaccaggctggcctcgaactcacagagatccgcc

SEQ ID NO: 77475 - DNA, 63 bp, Mus musculus
cgtgtggatgacatgtctggttgactctgggataacctgtctgtctgtctgtctgtctgcatg

SEQ ID NO: 77476 - DNA, 73 bp, Mus musculus
gaactcacatctgggctggagaggtggctcaggggttaagaacactgactgctcttccagaggtcctgagttc

SEQ ID NO: 77477 - DNA, 130 bp, Mus musculus
gtgtgtgtgtgtgtgtatatacatacatatatatatatatatatatatatatatatatatgtatatatatatatatatatgcctgtctgtgtgagagagtatatgtatatgtgtctctgtatgtgtgtat

SEQ ID NO: 77478 - DNA, 86 bp, Mus musculus
ctatctgtgctgacctctctctgtgtgttatttccagcggcacccaaagccacgtgttactcagtgagacgcctgggtaggtccac

SEQ ID NO: 77479 - DNA, 115 bp, Mus musculus
catctgggagtccactgcttgagattaacagcacatgcgcagaaatggacaggggtcatctcagtctcacactgtgaaaagtggttggtgcgacagcgagtgagcaaacagggtg

SEQ ID NO: 77480 - DNA, 100 bp, Mus musculus
agataaacatcaggggctggagagatggctcagcggttaagagcactgactgctcttccagaggtcctgagttcaattcccagcaaccacatgtttggct

SEQ ID NO: 77481 - DNA, 100 bp, Mus musculus
atacagttccaaatttatatacatacatacatatatatatatatgtgtgtgtatatatatatataatgtgtgtatgttatgtgtatatatatgtgtgtat

SEQ ID NO: 77482 - DNA, 95 bp, Mus musculus
gttagaggaagtgtgtcactgagggtgggctttgagtttcagaggctcaagccaggccccagtctgtctctgtctctctcccactgctgcctacc

SEQ ID NO: 77483 - DNA, 64 bp, Mus musculus
tggggagatctctaaggtctgccctgcgcaggacagcagacagcagacagcgtggagtctacca

SEQ ID NO: 77484 - DNA, 81 bp, Mus musculus
gaatggcctcacactcaaaatctcactgcttcaaaggaaagtcagttttccccgtgcagtgtcactgggacagaaccgttc

SEQ ID NO: 77485 - DNA, 71 bp, Mus musculus
tgtcagacactggctctgagaattagggcaatggatagtaacccagagtgtgagagccatgagtcttgata

SEQ ID NO: 77486 - DNA, 76 bp, Mus musculus
gctctgtagctgacagtagagagaggtgagccaagtctgggcacctctatctgttccattactgtgggttcatggt

SEQ ID NO: 77487 - DNA, 84 bp, Mus musculus
ccttacataggtagggcattctacccatgtgtgcatgtgtgtttatgtgtgcactggtgtgtgtgtgtgtctatgtatgtatgg

SEQ ID NO: 77488 - DNA, 92 bp, Mus musculus
gaggagacctgggccccggtcatggtgattcattttgagctccttaccgggcagagtggctctcacagtgacacaggctacagggttggctt

SEQ ID NO: 77489 - DNA, 84 bp, Mus musculus
ctgcctttggcagaacacagtgagcagtgttgtccagaaatgaagacacctaggaatgagtgctttgtggtactataaagggag

SEQ ID NO: 77490 - DNA, 69 bp, Mus musculus
agtacaggatagctgtgaggaagccatgacttcgagagaacgctgcacctcactggctgtctctcagct

SEQ ID NO: 77491 - DNA, 118 bp, Mus musculus
gtcaggaggatgcggtactggcactgggtatccgtgtagttggcttttggtttcagtctgtttggcattttgagccagcatctcgctgtgcagtctaggtagacctcatgcccacgac

SEQ ID NO: 77492 - DNA, 65 bp, Mus musculus
gggtttcagctgctcacagtgctctgcaggcaggaagcagagagatgtttgagagaagaagcacc

SEQ ID NO: 77493 - DNA, 69 bp, Mus musculus
gcccctctctttatggagcttcctgttagatactttgtcacaacaatgaagaaacagagcagagtgggc

SEQ ID NO: 77494 - DNA, 73 bp, Mus musculus
agagtgttcctcaatgtctctggcactcagtgcctgttatggcctcaaatgccaggatctgggaggtcccttt

SEQ ID NO: 77495 - DNA, 79 bp, Mus musculus
tgtgtcctgctcagtgtgtgtttctgttctctgcaagaacaggagtagagttcccaggccccacatacagcagctcaca

SEQ ID NO: 77496 - DNA, 86 bp, Mus musculus
gctcctcaagctggcactctgcgtgacacactctgttcagagccttcacctggcctgggctgtgatgatgttgcccgcacacgagc

SEQ ID NO: 77497 - DNA, 63 bp, Mus musculus
gtcaacctggcaggatgtacagtcaccgtggaaacacatctctgggtgtgtctgcgaggggac

SEQ ID NO: 77498 - DNA, 82 bp, Mus musculus
gtgatgtgacacgctgcctcacactcttgtcttcctcgctgtgttggactcttaaagttgtgagtcaacgtaaatccgttat

SEQ ID NO: 77499 - DNA, 73 bp, Mus musculus
gcacagagcacgtgtaccggctgactctgtttctgtgtccccacagagcaagtgtgctggctgactctgttgc

SEQ ID NO: 77500 - DNA, 92 bp, Mus musculus
tggtgcctccacccatcggaacactgtgctctaagtgggatccacgtgcctccctctctgtgtcactatgtctctatgccaactgaacacca

SEQ ID NO: 77501 - DNA, 89 bp, Mus musculus
tgacagtgtaaaggatggctctcaatctctccctgtgactctcctctggaagagggacagacacatgaagagatagccacccaccttca

SEQ ID NO: 77502 - DNA, 59 bp, Mus musculus
ggctcagatgtctgaacctcactgtgtgagtcacacgctcaggcaggacggtgtgagtc

SEQ ID NO: 77503 - DNA, 129 bp, Mus musculus
ggttcattgccccatcctgtggctcgttctgcctggttctcagctctctgtacctggctgcctgcctgtctgtgtgggttgggctcaggtgtaggcctcacttagagggcagggccaggctggagtgga

SEQ ID NO: 77504 - DNA, 97 bp, Mus musculus
ctgctcgtcacttgtgaagcagcgtgtctctgccctcgtgagatggtgtgtctctcagtgcctgtgcggtggtttctcgctagtgtgacagatgcag

SEQ ID NO: 77505 - DNA, 108 bp, Mus musculus
gtatgtgtctatgtgtgtatgtatatatgtgtgtatgtatgtatgtatgtatgtgtctatgtgtgtatgtatgtatgtgcctatgtgtgtatgtatgtatttatgtat

SEQ ID NO: 77506 - DNA, 78 bp, Mus musculus
gttttttgttttgttttactgtaagtttccttctaatgttgcagagagagagacagacagacagacagaccgatagac

SEQ ID NO: 77507 - DNA, 72 bp, Mus musculus
tatatatgtgtgtgatacatgtatatatacactatatagtgtatatatatattatgtgtttatatatgtgta

SEQ ID NO: 77508 - DNA, 76 bp, Mus musculus
acacacatatatatgtgtgtatatatatatatatacatatatatatatatatagtgtatacacataccatgtgtgt

SEQ ID NO: 77509 - DNA, 215 bp, Mus musculus
atatatatatatatagtgtgtacacataccatgtgttgtgtgtttgtatgtctctgtgtgtgtgtatatatatatatatatatatatatatatatactgctatatagtatgtgtgtgtgtgtatatatatatattgctatatagtatgtgtgtgtgtatatatatatatatatagtatacacataccatgtgtgtgtttatatatatatgtatgt

SEQ ID NO: 77510 - DNA, 129 bp, Mus musculus
catatgtgtttatatgtgtgtgtgtagtatatatacatatcatgtgttttatatatatatatatatgcatacacatgtgtatatatgaatatatataccactatatagtgtgtgtatacacataccata

SEQ ID NO: 77511 - DNA, 66 bp, Mus musculus
atagccttactcttggtcagtgtatggtttccccaccaaacacagcctctgtgagtgtctggctgt

SEQ ID NO: 77512 - DNA, 63 bp, Mus musculus
ctgcctgtcagcctgagaggacacagttccatgctgtgtgacactgtcagcctgagaggacag

SEQ ID NO: 77513 - DNA, 101 bp, Mus musculus
ttgttatgtttcttaatatgttttttctgcacatctgtctttatgtctatatttacatatatttgcatggaatttacatatgtgcatatgaaatatagcaa

SEQ ID NO: 77514 - DNA, 103 bp, Mus musculus
cacatttgggacaccatgtgtctctcagtcacatttgggacaccctgtgtctctcagtcacatttgggacaccctgtgtctcttttgtgcagcatcacttggt

SEQ ID NO: 77515 - DNA, 75 bp, Mus musculus
gggacaccctgtgtctctcagtcacatttgggacaccctgtgtctctcagtcacatttgggacaccctgcgtctc

SEQ ID NO: 77516 - DNA, 56 bp, Mus musculus
tgcaacaggaaggggagccaggggaggccgtctgtggtgacttctgtctgtctgca

SEQ ID NO: 77517 - DNA, 84 bp, Mus musculus
cagctgcctctctgtgtccctgtcttgtggcttctcagggctatgttgcctgtcctgtcattatcagggtgcattccagtgctg

SEQ ID NO: 77518 - DNA, 77 bp, Mus musculus
gtttagtgaatgacacccacagtcacacagggaagagtccttccctggtaacatgtgatttggtcatgaatatgaac

SEQ ID NO: 77519 - DNA, 93 bp, Mus musculus
ggtccatttgccttgttctctcatgtctcagttcaactctcatttagcatgtgacagtagactgagagctgagatctctgaccagttgatacc

SEQ ID NO: 77520 - DNA, 60 bp, Mus musculus
gtatatatgtatgtatgtatatatgtatatatgtatatatgtatatatgtatatatgtat

SEQ ID NO: 77521 - DNA, 84 bp, Mus musculus
ccagtctccctctctctggcacactggacaggtttgaaaggctagggggcaggtattggcacaaggggggtcggggggggggag

SEQ ID NO: 77522 - DNA, 116 bp, Mus musculus
gtacgcatgccatagacacgaactaaatgcataaatcaactaggaaataaataagcgtaattttaagatttatttattttatgtgagtgttttgcctgtgtgtatgtctgtgtatg

SEQ ID NO: 77523 - DNA, 111 bp, Mus musculus
gctgagagcagtgcgtcctgtctcaggagcctcgaatctccgagacttctgggtcacctcactcactgtctccatccccagcggcccccagagatgaggacatgccccagc

SEQ ID NO: 77524 - DNA, 97 bp, Mus musculus
cactgtgagatcctgtctcaaatatatatatatgcatgtatatataagcatgtacatatatgcatgtatacatatgcatacacacatggtttctgtg

SEQ ID NO: 77525 - DNA, 82 bp, Mus musculus
tctgtatgtgtgcatgtgtatagggaaatatggtgtgtgtataggaagatgtgtgtgtacatgtgcatgtgtatgcataaga

SEQ ID NO: 77526 - DNA, 109 bp, Mus musculus
cacacctgcagcccagcgagcccagcctgaatttgttctgatgcttcacagacacacccagtgacgcacagcagtgcatgttctgggcgcctcagctccattcattgtg

SEQ ID NO: 77527 - DNA, 64 bp, Mus musculus
ggatccttgaatggatgtatgtatgtatggatggatgcatgcatgcatgcattcatatagatcc

SEQ ID NO: 77528 - DNA, 82 bp, Mus musculus
tctgcctacctgtctgtctgtctgcctgcctcagtttccaggcctctgggatctgggtaggtaacggcttctggttaagagc

SEQ ID NO: 77529 - DNA, 114 bp, Mus musculus
gctgcccgttggctcatggtggtgtcacctggcaggtggcaggtgagagacctgtatcttacagtctgactgactgcgccagcgctttatagacacccagtgagcaactgtagt

SEQ ID NO: 77530 - DNA, 93 bp, Mus musculus
ggacaggacactgacgggaccacggggcactcacactgtcactcttccggctttttgattgacaggtttgtttaggactcagtgtagctttcc

SEQ ID NO: 77531 - DNA, 114 bp, Mus musculus
gagtactttatatttgaatatatatacacatatatgtatatatatatatataattttatttatatatatgtaaatatatatgtgtaatatatgtgtgtaaatgtgtatgtattt

SEQ ID NO: 77532 - DNA, 71 bp, Mus musculus
agagacagggtctctcactggctcagaacctctaacctgctagccagcaagccccaaagatctgtatctct

SEQ ID NO: 77533 - DNA, 88 bp, Mus musculus
tagtgttactgtgaagatgatagtgaggtagcttgttgtatttatttacaaaccagtgccactttaaaacactttacagatgtttctg

SEQ ID NO: 77534 - DNA, 99 bp, Mus musculus
ttgtgcatgtacttgcccagccttgcctttggacaattcacagtctactctcagccaaggtatattgttgaaccatgaggctattgtctgtgctcacag

SEQ ID NO: 77535 - DNA, 69 bp, Mus musculus
gtatgtgtctgtctgtctgtctgtctgtctgtctgcgtgatggtgacagggatagctagaagagggtgc

SEQ ID NO: 77536 - DNA, 92 bp, Mus musculus
gtctgtctgtctgtctgtctgtctgtgtgcctggggggttcaatgctctttccacatgccagctctggctcatggtgcaggcatgtgagggc

SEQ ID NO: 77537 - DNA, 63 bp, Mus musculus
tgcctgtgtatgtgtgcatatatatatgcatttccatatgtgcgtgtgcatgtgcatggtgta

SEQ ID NO: 77538 - DNA, 106 bp, Mus musculus
ggctacatgtgtatttgtgtggtgtgtgtacatacggctacatgtatgtgtgtatgcttatgtttgtgtatctttgaacatttgtgtatatgtttgcatatgtgta

SEQ ID NO: 77539 - DNA, 83 bp, Mus musculus
tggcacagggcctcacaggtgtctctctcagtttcagtgatggtcccagggacatgggtagacacaggactggctctgctcta

SEQ ID NO: 77540 - DNA, 82 bp, Mus musculus
agctgagatacctgaacgctcttgccttgtcccctctgggccttgttttcccaggaccagtgtcagtctgtctgtctgagct

SEQ ID NO: 77541 - DNA, 114 bp, Mus musculus
gagggttatatgtcattggcaggactgcagttggggaagtgtctgtctgtctgtcagtagttatgctccaggagtcctaagatgatcctctctccctctctgcctttctctgtc

SEQ ID NO: 77542 - DNA, 100 bp, Mus musculus
gcagactctgtgcactcggtaaagcctagctcgtgctgatctctgtgtctctgcctttctggagaccacatctcaaacagcttttgctaatccagtttgc

SEQ ID NO: 77543 - DNA, 74 bp, Mus musculus
gaatgtgtgtgcatgtatatgtgtgtatgtatatgtgtatgcatgtatgtatttatgtatatgcatatgtattt

SEQ ID NO: 77544 - DNA, 115 bp, Mus musculus
atgtatatatgtgtgtatatatgcatatgtgtatatgtgtttgtatgcatatatgtgtacatatatatatatgtatgtgtgtgcatgtatatgtctgtgtgtgtgtgtatgtgta

SEQ ID NO: 77545 - DNA, 109 bp, Mus musculus
agcaccccacaggctggagagatggctcagaggttaagagcactgactgctcttccagcggtcctgagttcaattcctgagttcaattcccagcaaacacatggtgact

SEQ ID NO: 77546 - DNA, 88 bp, Mus musculus
aatgacttactggagacattggattatatatatttctgtgcttttacattttaatgtctgtgaccctgtgttctctcctaagaccatt

SEQ ID NO: 77547 - DNA, 85 bp, Mus musculus
tacatgtatacatgtaatacatgtgtatatatcattatgcctatgcaggaatgatcatgtatgtatgtgtgcatgtgtatgtgta

SEQ ID NO: 77548 - DNA, 73 bp, Mus musculus
caggatgctgatcttcaagagtttgtgtgatgctgggcaagatgctcagtctctctgtggctcagtttccctg

SEQ ID NO: 77549 - DNA, 116 bp, Mus musculus
atcctagcattagaaaactggagaaaagagaatccctggagctgacagcagacagtctggtcaaactggcgagcttcagattcaggaagagcctatctcaaaatgatgatggtgat

SEQ ID NO: 77550 - DNA, 79 bp, Mus musculus
tgggtagatttgaacctctgcctgaggcttgaccagagcagggagagcctcaggctgtgactgtctctcagacaaccca

SEQ ID NO: 77551 - DNA, 98 bp, Mus musculus
ggatagagtggccagccttgatcctgacccaggagaaatagttgtggctgagtcccctctgtctgtgtgtgtatcctgctcacagtcctgagccacag

SEQ ID NO: 77552 - DNA, 115 bp, Mus musculus
agctcagattctcagtgcccactgctcccacacctgtgtggctcacttgtcatcttctggagaggcagaaagaagccagtggattcttggggggtggggggggcactggacagct

SEQ ID NO: 77553 - DNA, 73 bp, Mus musculus
aacagagaagtctgtcagtcactgattccatgctatagttcccaggctggaccacgtgcttagggtctctgtt

SEQ ID NO: 77554 - DNA, 113 bp, Mus musculus
gttggagaaccactcaccctgcttatgtgctcctggctagggaagactgtctctcccactgttagcttccttagttgcctgcagttctttgtctagggtgagacctcttgagc

SEQ ID NO: 77555 - DNA, 77 bp, Mus musculus
tcctgaccttgctgtgtagaccacactggccttgaattccgcggatcctgtctgtctctgcctcccaagtgttggga

SEQ ID NO: 77556 - DNA, 96 bp, Mus musculus
gttgtggccggaggggtggctgagtggttaagagccctgactgctctttcagagatctttacttcaattcccagcacccacatggcagctcacagc

SEQ ID NO: 77557 - DNA, 87 bp, Mus musculus
gctcacctgccctcatgtttttttctcttaatctttatgttttttaaaaagaaaaagagcaggagagatggctccgaggttaagagc

SEQ ID NO: 77558 - DNA, 89 bp, Mus musculus
tgtttctgtcacccctgtgggtctcacactcccaccctgtcccacctcagcagctgtggctggagtcccgagtccccacagcagcaaca

SEQ ID NO: 77559 - DNA, 75 bp, Mus musculus
gcacacacacacacacacgcacacacatatgcatgcacacacgcatgtatacctctgtgcacatgacatgtatgc

SEQ ID NO: 77560 - DNA, 71 bp, Mus musculus
gcctgtctctcacactcaaaggctcacttgatcttgacccagatgtgggcactgagtgttgagtgattagt

SEQ ID NO: 77561 - DNA, 65 bp, Mus musculus
ttccagaggtgagactccagtgtctctgtttcactcaaagaggcctgtggtgctaaatgatggaa

SEQ ID NO: 77562 - DNA, 67 bp, Mus musculus
ccgtctctgtgtttctgtgagtgggacatccaggacataaggctcttcaggtcttacagagccacgg

SEQ ID NO: 77563 - DNA, 59 bp, Mus musculus
ggcaggatgattagtttggaaataaaggaggccctcctgggtctgacttttctcttgct

SEQ ID NO: 77564 - DNA, 73 bp, Mus musculus
gtgtgaacgtctctgtctgtcagtgtctctgtgtaacatacacaggaagttccacttgatcttcaggccacac

SEQ ID NO: 77565 - DNA, 151 bp, Mus musculus
atatatacatgtatgtgtatgtatgtatgtatgtatgtatgtatatacatatgtagtagagaattgtgtgtatatatatacatatatatatatatgtatatatatatacgcacacacacacacacacacacacacacatgtatatatatac

SEQ ID NO: 77566 - DNA, 84 bp, Mus musculus
tatacatatatgtgtatgtgtgtgtatacctatatatgtatatatgtgaatatatattcacacatacatacacatagatgtata

SEQ ID NO: 77567 - DNA, 82 bp, Mus musculus
acctagagctcaccaagtaagcaaggctgccaggttgctgagccccagagctgccagcctccctcactctgtgattccaggt

SEQ ID NO: 77568 - DNA, 201 bp, Mus musculus
atctcggacagttgtcattgtgacaggctgggaacagacaccagatctccctcagtagagagagaggtcactgtatctgagctgagccacagtgacacaaagaccatttggagatatatatacatatatatatatgaatatatatatatatatatatattcatatacatatatatattcatatacatatatatattcatat

SEQ ID NO: 77569 - DNA, 73 bp, Mus musculus
gtgacgtaaccgctggtttcggcagaggcatgaggtcctccctgtatgccagtagaattcagtttcatgttgc

SEQ ID NO: 77570 - DNA, 146 bp, Mus musculus
catatatgtgtgatatgtgtgtttgtgcatgtgcatgtatgtatatatgtacatgtgtgtatatgtatatgtgtgtatgtgtgtatgtatatatgtatatgtgtaaatgcatatatgtatttgcatgtgtatgtgtgtgtgtgcac

SEQ ID NO: 77571 - DNA, 79 bp, Mus musculus
gcctgtctctctctctctcgggcatagaaccaaggtggccaagccatgtgctttaagccgaggcagtcagcagtacagc

SEQ ID NO: 77572 - DNA, 111 bp, Mus musculus
tcttttagtcctttaattctctgatgtaaagatgtatatatatatatatatatatatatatatatatatatatcccaaatctttaccatctcaaaagaaaaggcagataga

SEQ ID NO: 77573 - DNA, 79 bp, Mus musculus
gctttggtaatgaagagatagcagtgatctctgtcttgtttccccaagagagattttgttcttgtcatttttaccaggc

SEQ ID NO: 77574 - DNA, 69 bp, Mus musculus
cggatggtgagctcggtctcagtgaagcacacctgggtgcctccaccagcctgagtctctcccactctg

SEQ ID NO: 77575 - DNA, 68 bp, Mus musculus
gtgtatgggtagcctgtgaggaggggataggtcactaccaatgctgacagcatgttctatccatgagc

SEQ ID NO: 77576 - DNA, 102 bp, Mus musculus
ggacaccatgtgcttcatcagtaccatccaggcagagagactggaacgaggcatgacctaatttctgtgtgtgtgaccacgctggtgacgacaaggtgatct

SEQ ID NO: 77577 - DNA, 90 bp, Mus musculus
gttcactcttatgtgtgtgtgtatgtctgtgtgtgcttgtgtgcccatgtgtacatgcatgtaagatgcacgtgtgtgcatatgtatata

SEQ ID NO: 77578 - DNA, 83 bp, Mus musculus
cctaaagtgtgtgtgtgtgcatgtgcatgcgcatgtatgtgttacatgtgtatgaatacatatatctatgtatgcatgtaagg

SEQ ID NO: 77579 - DNA, 84 bp, Mus musculus
actcccacagatatatccgctagctagtctgggcaatctctcaattgagaggcccctcttgagtgactgtagactgtgttgagt

SEQ ID NO: 77580 - DNA, 73 bp, Mus musculus
ctgagtgaagagtctgtgcatttagacaaaactgcagtccttgctgcaaaattgcacccgctccctcactaag

SEQ ID NO: 77581 - DNA, 78 bp, Mus musculus
ttctcagaagggtctgaggtcagcaaacttgatcccttctatgtatggtgtcatctgaatttcagtcccacatgggaa

SEQ ID NO: 77582 - DNA, 97 bp, Mus musculus
agatgggctgagggaatgactggctcagtgggtctctgtcacacacaagggcagagggttccacacagtggccgcatatactgtcatagcaccatct

SEQ ID NO: 77583 - DNA, 98 bp, Mus musculus
gtgtctgtccctccagcttcctgtgactctgtctctgcctcccattcctccatagggatcttctgggattccagatgcttgtcatgggttctggggac

SEQ ID NO: 77584 - DNA, 116 bp, Mus musculus
agaagtggggtcaagggccaagttcctgacagatgtcttgctctattagtggcacctgtgtacacactagagagacaggacagtgagaaagactgcagccatagaattagacttct

SEQ ID NO: 77585 - DNA, 116 bp, Mus musculus
tgcactgccttgggtgttttacacacacaatagcaatccatagtattgagtctcactgtaaaacttgatttattttatttgtatggagtgtgtggtatacgtgacccgtgtatgta

SEQ ID NO: 77586 - DNA, 107 bp, Mus musculus
atttatccatttcatatgtaaatatatggatatgtaatgatatatgtaaatatgtgtgtatatttatccattatatatctattatgtgttccatttaaaggctagat

SEQ ID NO: 77587 - DNA, 106 bp, Mus musculus
gccttagtccatggtgatctgataggatgcatgggacaatttcaatatttttgtatatgttgaggcttgttttgtggccaattatgtggtcaattttggagaaggt

SEQ ID NO: 77588 - DNA, 122 bp, Mus musculus
caggaattacaataaaggcaatacctaacatgtgcccatcacacacagtaggtgctttgtgtgtgtctgtatctgtgtgtgtgtgtgcgcgcgcgcgcgcatgtgagcacgcatgtgtatgg

SEQ ID NO: 77589 - DNA, 84 bp, Mus musculus
acctgtatcatccgccacaccacagtgagtgattcttaagagagagttagggcagactgtctgtgtgtgtgcctgtatatttgt

SEQ ID NO: 77590 - DNA, 117 bp, Mus musculus
ggaaggggatcactaaggttgtgggcttgtagattatacaggtttcaggttcttttctgagtaccatgctccctgaactctaaagatgtgtgagcctctgcatggtaaacttctccc

SEQ ID NO: 77591 - DNA, 126 bp, Mus musculus
catgcatgtgtgaatgtacatgtgtatatatgtacatgtatgctcatgtgtgtgcatctgcatgtgtgaatgtacatgtgtatatgtacatgtatgttcatgtgtgcatatgcacgtgtgagtgta

SEQ ID NO: 77592 - DNA, 98 bp, Mus musculus
ggcttgcatggtagacttgcagagagagagaacagtgtctgggacagcaactgctccaacacagtgcctagcatgtcacaggtccccaggcacttgct

SEQ ID NO: 77593 - DNA, 125 bp, Mus musculus
agtatatgtacatgtgtatgtgtatgtgtaatatataatgctatatatgtaatatataatactatatatgtatatgtgtaatatatactatatatgtgtactatataacactatatatactatat

SEQ ID NO: 77594 - DNA, 112 bp, Mus musculus
tatgtgtatgtattcctgtggtgtttgtgtgtgtgtgtgtatgtatatatatgtatatatatacacatatatatgtgtatatgtatgtatgtgtatatatatacacacacac

SEQ ID NO: 77595 - DNA, 88 bp, Mus musculus
gcatgcacactgcacactggctggctgtttgcctggatactgatccctgatcctggttgcacagtatacactggttttctatgcttgc

SEQ ID NO: 77596 - DNA, 69 bp, Mus musculus
gtgtgcgtgcatatcatatgtgtgtgtgtatccttgtgtatatatgtgtctctgtgtgtgcctgtgtat

SEQ ID NO: 77597 - DNA, 94 bp, Mus musculus
cagtgccactcatttgatgtcactcagacacacactggcatgactgccttccctgtttccttgactgatagctaggtactgtgagtaagcactg

SEQ ID NO: 77598 - DNA, 82 bp, Mus musculus
tgtgtctgcaggtgcagatttgtgggagcatatatgtatgtgtgtgctcgtgtgtgtgcctctctctgtgtgtgcaggtaca

SEQ ID NO: 77599 - DNA, 107 bp, Mus musculus
gccggtgcctggctgcatagaacccacttggagcagagtgatgacagtgctcactccctccaggcatcttctcctcaactcccttttgttctcagctaggccctggt

SEQ ID NO: 77600 - DNA, 81 bp, Mus musculus
gcttgttgagatgtgaagagccagctgtgtactccacagctatggatcttgtcacacctgcagtcttctcagtccctgagc

SEQ ID NO: 77601 - DNA, 89 bp, Mus musculus
gggcttattgggagaaatggtatgtccaggcttctgcacaatgggaaagaaccctgtctgtctgtctgtcactactttagcatcagccc

SEQ ID NO: 77602 - DNA, 59 bp, Mus musculus
gggggcacagtggcagtgtctgtccttctctcatcaggtgggaggcactggcagccccc

SEQ ID NO: 77603 - DNA, 97 bp, Mus musculus
gggctccacactgcagccattgctgctgctgctggggttcccatgaggggaaggtgagaggctctcacagtatcagatgagtgcagtgtaggtgaac

SEQ ID NO: 77604 - DNA, 59 bp, Mus musculus
ggactgggctctcacacacgtgaggatgcatatctgtcactgtctgagtgttcagtgcc

SEQ ID NO: 77605 - DNA, 89 bp, Mus musculus
ggcatgaacttgccctaggccaggtctgagtcagcagagagtggcctcccacctccatacaggctgagccagccagcctaggtcctgct

SEQ ID NO: 77606 - DNA, 79 bp, Mus musculus
ccatgtttgtttttcaagagtttttatttatgtttctgacttgaatttcataggaaactgttggaaagttttagcttgg

SEQ ID NO: 77607 - DNA, 103 bp, Mus musculus
ggcctggcagaggatacagaagtcaagactgcacagcctggactatcctgagtcagactctgtcaggcttggtgttgtctgccattttttcctgctgtgggct

SEQ ID NO: 77608 - DNA, 79 bp, Mus musculus
agagactgaggtttgttgtgtggaacagtgggaaattcagtgtcctggtgagttcagtgacagcagggaccacagctct

SEQ ID NO: 77609 - DNA, 92 bp, Mus musculus
atatgtatatgtatacatgtgtgtgtatatatgtatatatgtacatatgtacatatatgtgtgtatatatgtgcgtgtgtgtatgtatgtgt

SEQ ID NO: 77610 - DNA, 100 bp, Mus musculus
tgtgtatgtatatatgtgtgtgtatgtatatatatacatatatatgtgtgtatgtatatatatgtgtgtatatatatatatatatatatatatatagaga

SEQ ID NO: 77611 - DNA, 64 bp, Mus musculus
aatctctcagactcagacactgagccaccaaacaggcagcttatacctgagctgttctgaggtt

SEQ ID NO: 77612 - DNA, 56 bp, Mus musculus
ctcagaacagctcaggtataagctgcctgtttggtggctcagtgtctgagtctgag

SEQ ID NO: 77613 - DNA, 85 bp, Mus musculus; identical to SEQ ID NO: 57439

SEQ ID NO: 77614 - DNA, 76 bp, Mus musculus
gtatgtatgtatgtatgtatgtggtgccatggttggtatagccctgtgtcactcgtgtgtgtgtgtgtgtgtgtat

SEQ ID NO: 77615 - DNA, 73 bp, Mus musculus
ctgagtctgtctgagtctgtctctcattattccagtttcaatctggatgaaagcattttctgaaagatttcag

SEQ ID NO: 77616 - DNA, 79 bp, Mus musculus
agtttacactgtgcttgtttagcctggtgaggccctgggctcaatctcccaggcactgaacaaactgagcacagtagct

SEQ ID NO: 77617 - DNA, 80 bp, Mus musculus
tgcactcgcttatgtgtgtatgtgtgcatgtgtatgtgcttgtgtgcattcacatgtatgtgagcatgcatgtgtgtgca

SEQ ID NO: 77618 - DNA, 62 bp, Mus musculus
tggaagccaagcgcaggatggtggcgaggcactcgcttcccactctcactgcctgtgttcca

SEQ ID NO: 77619 - DNA, 70 bp, Mus musculus
gtcattctccagcttattttttgagacagtctctcactgattcagatagactagctggctgcagaattcc

SEQ ID NO: 77620 - DNA, 85 bp, Mus musculus
atatatatttgtatatttatatatacatatgtacgtacgtacgtacgtatgtatgtatgtatgtatgtatgtatttcagtgtcac

SEQ ID NO: 77621 - DNA, 75 bp, Mus musculus
acacacacacacatgcatacacaggcacacagacactcattcacacacatgtgcacagatgcatgttgtgtgagt

SEQ ID NO: 77622 - DNA, 84 bp, Mus musculus
ggtggcagagagtgtttttgttgttctaattcccttaaagtctgcctatgtttgccctagaacgatggatccaggctggttacc

SEQ ID NO: 77623 - DNA, 89 bp, Mus musculus
tgggttttatatctgcattccatgcttttatttatttgtaatacaacttgagagctctcagtgcaatgtggaaaatttagaaacaccca

SEQ ID NO: 77624 - DNA, 85 bp, Mus musculus
aggttttatggtttcctcactgtagtcagagtggagaataatgcattttactaagcgattcacaggagagtgaccaattgcacct

SEQ ID NO: 77625 - DNA, 122 bp, Mus musculus
gctgactcctgtttggtgttttgctagtggattggattgctgacagtgaagattgagaccaccccaaagaactacttctaaacaggtccacatccccctaaccctgttagctatcttcctcc

SEQ ID NO: 77626 - DNA, 98 bp, Mus musculus
tggctgttaggttgagtatcagtttctagaaggtcgtgctcatgctttggcttgggtcaggaagttggatgctaactgagccgcaggaagaacagcta

SEQ ID NO: 77627 - DNA, 76 bp, Mus musculus
tacccaatgtagagtctagttttgattaagtgagtttggggtaatacacagactcactgtcagtctgatatgggta

SEQ ID NO: 77628 - DNA, 96 bp, Mus musculus
cctaaactgaaaattcattgtatggcaagagaatctgcatgtgtatgtgtatatatagtgcacatgtatgtgtgtgtgtatgatggaggatgatgg

SEQ ID NO: 77629 - DNA, 92 bp, Mus musculus
ttcatgctggcttgtaatgactgccagtccctcaggcatacttgtgtggttcagcaatagtggagagagggaggacagtgagccagtttgaa

SEQ ID NO: 77630 - DNA, 72 bp, Mus musculus
tcagactcagtcagtccctcagccctcgggatgttgcccaatgggacctgctggaccaatggtatggtctga

SEQ ID NO: 77631 - DNA, 78 bp, Mus musculus
tgttttgtgtatgtttacatgtgtgtgaagatttgcattaagtgtgcaggagcatgtgcatgtggatgttagaagata

SEQ ID NO: 77632 - DNA, 80 bp, Mus musculus
aacttgacacaagatagtcatctgggaagggaaaagcttaactgagaaaatgcctccatcagattgtcttgtggcatgtt

SEQ ID NO: 77633 - DNA, 73 bp, Mus musculus
gcatcttgctaaatagtcaaagctggccctgaaaattccacccagtctctgtctgtgtagcagctggaattgc

SEQ ID NO: 77634 - DNA, 118 bp, Mus musculus
agatgtgctcatttgcccgaacacatgtgcccctcacacatgctctctctcacacacagaatgttcattataagagcctgtactggcacagtgatggtagcaggtcagtcacacatct

SEQ ID NO: 77635 - DNA, 90 bp, Mus musculus
gagcttcatgtggtctgtgaattgtatcttgggtattccaagcttctggactaatatttatttatcaatgagtgcataccatgtgtattc

SEQ ID NO: 77636 - DNA, 85 bp, Mus musculus; identical to SEQ ID NO: 57470

SEQ ID NO: 77637 - DNA, 82 bp, Mus musculus
aggtgagaagctgtctgcatgttgtgtcattggagaagaatgaagtgaggctccaggccctgtgtgagaggcaggtctgcct

SEQ ID NO: 77638 - DNA, 79 bp, Mus musculus
tgatctgataggatgcatgggataatttcaatatttttgtatctgttgaggcctgttttgtgcaccaattatatggtca

SEQ ID NO: 77639 - DNA, 60 bp, Mus musculus
ggctgtaggggtgaaacccaggttgtcagacttggagcagacaccctcgctcactgagcc

SEQ ID NO: 77640 - DNA, 104 bp, Mus musculus
gagaatgtgtttagacatttagtatttttatatatcagtttgtatatgtttaatataatataaaattaatgtggaaatactatatgacattacatatgtagttc

SEQ ID NO: 77641 - DNA, 80 bp, Mus musculus
cagggccaggcacattgaagctagaagatatgaaagatttcctccatgaagtttaaaatctgtctcagtgtctgtctctg

SEQ ID NO: 77642 - DNA, 103 bp, Mus musculus
ttggcatgggcgaggggtgagcagcgaaggttctggagctggggggcacgagtgtgactcccccagtctcagtcttcagatgtcacacagctccaagtgtcaa

SEQ ID NO: 77643 - DNA, 84 bp, Mus musculus
ctgtgacgagattgctctgggtctctggaagacagtgtcacctgatcctgctgtgttcactgtcactgacaccctctcctacag

SEQ ID NO: 77644 - DNA, 96 bp, Mus musculus
ggccagtgggataaccctctcagggtcactaaaggccagtgggacaaccctctctgggtcagtgactcagacctgcatgggtccttctcagtggcc

SEQ ID NO: 77645 - DNA, 108 bp, Mus musculus
atttacactaaacggtcaggtaagagttcgacatttttaattattcatgagttctgccacaggcagaaagagggaaatgtaaggaacactgacgatttccatgtaaat

SEQ ID NO: 77646 - DNA, 102 bp, Mus musculus
taccgtaaggtcacctgtgagagcttctgcagagggtttgtcactctctgtgactccctccttgggctcctccttatgtgtttacagaggatttttgtggtg

SEQ ID NO: 77647 - DNA, 90 bp, Mus musculus
agcatttggtgccgtcgagttttacaaacgggtttaatttaccgtccctgttgacggcaggtgtctgtctgtttgtgtgcctgttgctct

SEQ ID NO: 77648 - DNA, 71 bp, Mus musculus
ctggacagtagtgtgggtgcagctctgagcccatccactcctgggcggagctagtacatcatgcctcccag

SEQ ID NO: 77649 - DNA, 85 bp, Mus musculus
gtaggttataaagcacgtgcacggtgatgtcagaaggaaacccattattttatatgactaacacacactctgttttacaagctgc

SEQ ID NO: 77650 - DNA, 85 bp, Mus musculus
tctatctctgtgtttctgtaactgtgtccctgtgtctctggctatgtgtgcatgcgtgcatatgcatggaggaagagggacagag

SEQ ID NO: 77651 - DNA, 63 bp, Mus musculus
ctgcagtcagagactgcagagtgtgtccagcaatggagatgagcctggaatctgggactgtag

SEQ ID NO: 77652 - DNA, 75 bp, Mus musculus
acagagtgagaactaagccagagttatacagcgataccctggatcctgtctgtctctctgtgtctctgtctctgt

SEQ ID NO: 77653 - DNA, 107 bp, Mus musculus
gtagcagccactcctgttgtgctgtgtggccctgtcacagtccccctgatgagttgaatctgcatcaggaactctctgttgcagggaaggctaaggatggtttttgc

SEQ ID NO: 77654 - DNA, 70 bp, Mus musculus
ctgtgtggggtagtgccacagcagagcagcgtgcttctctgttgctctctcactgtggctgacaaggcag

SEQ ID NO: 77655 - DNA, 67 bp, Mus musculus
ggctgcagtgtcatgacagacgctgtggagtgaatgaacttcgcacagtcagacagactctgcctcc

SEQ ID NO: 77656 - DNA, 66 bp, Mus musculus
aaagtgtagtcacagtgccaggcactgcgctcaaccagggcgaggcctgtctgtgtctgactcttt

SEQ ID NO: 77657 - DNA, 80 bp, Mus musculus
ggctgttcccaccagagctggggtggtgcacacatgcgtgcacgaatgcacacacacacacacacactggaaacacatcc

SEQ ID NO: 77658 - DNA, 78 bp, Mus musculus
ctgtctgtctgtctgtgtctcagaaggacctgtgcttacttggggtcttttgaagtctttagacaacctacatctcag

SEQ ID NO: 77659 - DNA, 100 bp, Mus musculus
gtgccacacatagttagaacccacagcccatatgtatgtatgtatgtatgtatgtatgtatgtatgtatgtatagtgtgtatgttctaaatgtgctccat

SEQ ID NO: 77660 - DNA, 65 bp, Mus musculus
gtatatgtatatatatgtgtgtgacacacacacacacacacacacacatatgtagtcacatatat

SEQ ID NO: 77661 - DNA, 100 bp, Mus musculus
tatactatatatgtgcacatgtaggtatatatgttttatatactatatgtatatatacatgttataccttatatactatatatgtgtgcatatatgtgta

SEQ ID NO: 77662 - DNA, 100 bp, Mus musculus
gctaggggaatccagggccggggctgcactggcatagaactgcctgggcccccactgctgtcctgtctgtgtgtgtctgtctctctctgtctctctttgt

SEQ ID NO: 77663 - DNA, 118 bp, Mus musculus
gagaacaccactggatcaagggtcagaactggggctggagagatgggtcagcggttaagagcactgactgctctttcaaaggtcctgagttcaaatccaagcaaccacgtggtggctc

SEQ ID NO: 77664 - DNA, 78 bp, Mus musculus
aggccttccttatctggtgcagcctgtgtccctcactctctcccgtggacacacagagctaaggttctggaaatgcct

SEQ ID NO: 77665 - DNA, 72 bp, Mus musculus
acatgtgtatatctatgtgtatgcatatagtagtgtctaagtgtatatatatctatatgtctgcacacatgt

SEQ ID NO: 77666 - DNA, 73 bp, Mus musculus
gctccatgcctgagaacccagagcttcctgcgctctcacaggctcactctgggtctgggcatctccttggggc

SEQ ID NO: 77667 - DNA, 86 bp, Mus musculus
gaaatatcagtcaagggccctggagctcagatctgaccaggctgtcagtctgtttcactgtcttccacggagtctccttttgtttc

SEQ ID NO: 77668 - DNA, 94 bp, Mus musculus
gtgtatgtatatgtatatatacatatgtgtgtatatgtgtatatgtgtgttatgtatatgtgtgtgtatatatatatatgtatacatatatgga

SEQ ID NO: 77669 - DNA, 86 bp, Mus musculus
gtatgtatgtatgtatgtatgtatgtatgtatgtatgtatgcatgtgtgcatgcatgtgtatgtgtatatgtatatgtttatatac

SEQ ID NO: 77670 - DNA, 96 bp, Mus musculus
ggagagaatagggctctatgtatgtatgtatgtatgtatgtatgtatgtatgtatgtatgtacgtatgtatgtatggtctggcagcctttgcctcc

SEQ ID NO: 77671 - DNA, 84 bp, Mus musculus
gtgtatgtgtgagtatgtatgtatgtatgtgtgcatatgtgtgaaggtgtgtgcatgtgtgtatgtgtgtgtgcatgtgtatat

SEQ ID NO: 77672 - DNA, 82 bp, Mus musculus
tggtgagagactggtacacagtgatagtcaacattgttctcatctccagctatctacaagttactgtctgtcagtcagtcca

SEQ ID NO: 77673 - DNA, 86 bp, Mus musculus
agggcaggtctccgttctcagacaagtggcattcttacataaagtacttgggtgacgctgcctctcacacacactgatttcgccct

SEQ ID NO: 77674 - DNA, 64 bp, Mus musculus
ggcagagttaatctgtgtgggtcacaggtcccacccaacttctgtgacactcacactttttgtc

SEQ ID NO: 77675 - DNA, 85 bp, Mus musculus; identical to SEQ ID NO: 57439

SEQ ID NO: 77676 - DNA, 96 bp, Mus musculus
ggcagtgtggacagtcctcccatgaggtataaagttgtgtttgtcaggcctctcaagcacacacttacacactcacaggaaaatataccttctgcc

SEQ ID NO: 77677 - DNA, 60 bp, Mus musculus
tgaggactggagagatggctcagcagtttagaggactgactgctcttccagaggtcctga

SEQ ID NO: 77678 - DNA, 82 bp, Mus musculus
gtatacatatatgtgtgtgtatgcatgtgtatatttataatatttaaattatatatacatatattctatatatcatgtatac

SEQ ID NO: 77679 - DNA, 78 bp, Mus musculus
cgcttctgtatatgtatatgtgtatgtatatgtatcttctgtatataatgtgtgtatatatgtacatatgtatatgtg

SEQ ID NO: 77680 - DNA, 120 bp, Mus musculus
aggatcatctgagagaaggcttctgggcatacttgtacaagatcatcttgatttatattgattgatgtgggaagatctattttaattgtgggcagagctattccttggacaagagatcct

SEQ ID NO: 77681 - DNA, 92 bp, Mus musculus
gcagatgcatatatatgtctgtatatgtatgtgtatatatatgtaaatatacatatatacagacatagatatatgcattacatgtatacgca

SEQ ID NO: 77682 - DNA, 67 bp, Mus musculus
ctaagttgagtctgactcagtccctgcttcctgcaggattgagatacttcatagactttaaacatag

SEQ ID NO: 77683 - DNA, 75 bp, Mus musculus
gtctatgtgtctctgtgtgtgtctctgtgtgtatgtgtgcacacacatgcgtgtgcgctcacataaatatatgac

SEQ ID NO: 77684 - DNA, 108 bp, Mus musculus
gtacctctgtctgtctttctctcactgtctttcttcttctttcctccttttacacacacacacagagagagacagacagacaggcagacagacaggcagagagacaga

SEQ ID NO: 77685 - DNA, 105 bp, Mus musculus
gtctctctgcctgtctgtctgcctgtctgtctgtctctctctgtgtgtgtgtgtaaaaggaggaaagaagaagaaagacagtgagagaaagacagacagaggtac

SEQ ID NO: 77686 - DNA, 127 bp, Mus musculus
atgtgtgtgtgtatgtgtatatatatgtctctgtgtgtgtgtgtattacatgtgagtgtttatgtatgtatgtatatatatatatatatatatatatatatatatatatatacatacacatatattc

SEQ ID NO: 77687 - DNA, 80 bp, Mus musculus
tggaagaagggactctcgctctcactccttcacctgcttgccatgtgggactgagtaactactagatccttggacttcca

SEQ ID NO: 77688 - DNA, 66 bp, Mus musculus
aagtccttgctctgcagcctctatgtctgtcacactcactgatgatatgagcctacagggaggctt

SEQ ID NO: 77689 - DNA, 131 bp, Mus musculus
tatatgtatctcatatatgtatatatgtatatgcatatgtatgtgtatgtgtgtatgtatgtgtatgtatatgtatgtgtatacatacacatacatacacaaatatacatatacatcatatacatatatat

SEQ ID NO: 77690 - DNA, 76 bp, Mus musculus
gcatggtcagatgactgtgtgttattttctcaagcaaggtacattgaaaggaaaagagcaccaggaatcatggtgt

SEQ ID NO: 77691 - DNA, 79 bp, Mus musculus
gcctcagtcacacagacagagtcaagaactggtggcatggctatccatagggtttgtgtgtgtgtgtgtgtgtgtgtgt

SEQ ID NO: 77692 - DNA, 70 bp, Mus musculus
atattccatcatagatagatgtatgtgtggacaagtgtgtgtctgtgtgtgtctctctgtgagtttgtgt

SEQ ID NO: 77693 - DNA, 66 bp, Mus musculus
gcatacttcctgagacagacactctgtcccaggcagctgggaagatgtagtggaaaaggagagggc

SEQ ID NO: 77694 - DNA, 70 bp, Mus musculus
gacacctgttctgggatagcaagaggtctgttcagctgtgtctgtgtcagtgactgttctagccagggtt

SEQ ID NO: 77695 - DNA, 72 bp, Mus musculus
cctgaaagatgctcagtccactgggcttacatgtgtgtactgctcacactggctcagactggctcacacagg

SEQ ID NO: 77696 - DNA, 98 bp, Mus musculus
ggctatatcacagctggacaagccttggtttctttccttgcctcctaataccatggataggctgagctacaaggttgtaagactcccgtgagagagcc

SEQ ID NO: 77697 - DNA, 136 bp, Mus musculus
aatgagggagagagagggggaaggtggaaactgggaggagtaaacatgtttgaaaacaggaattattttaaattatttaaatctatctttctgtcatctgcccttttctcagtcattatctctctctcatctatct

SEQ ID NO: 77698 - DNA, 85 bp, Mus musculus; identical to SEQ ID NO: 57439

SEQ ID NO: 77699 - DNA, 95 bp, Mus musculus
aagttttcagccaatcttaatttatgtgtcttgttgaaattctacatgttggttaggtggcattgataaatatgacactggagggtcgggaattt

SEQ ID NO: 77700 - DNA, 85 bp, Mus musculus
tcacactcatacagccaggactttacccatggatccacttgtgccaactcggtctagctgtgtgtgtgtctctgtctgtgtgtga

SEQ ID NO: 77701 - DNA, 110 bp, Mus musculus
aaataactgggcacattttctattcaaggggcttatgcatttgtcacccaggtttcatgagaatttgggaagactgtgtgagttccacactgaagaaaagtaagagattt

SEQ ID NO: 77702 - DNA, 88 bp, Mus musculus
gcaaggcttttgcatctgtgatgagcttctctcactgactcatatacatgagcgtgcttggaacagttatagttcagatttcattgcc

SEQ ID NO: 77703 - DNA, 87 bp, Mus musculus
tcctactcagagcctcactctctgcttcagattatagccctgccaagaatcgggcaggttggaggcaggagatgctactaaaaggga

SEQ ID NO: 77704 - DNA, 94 bp, Mus musculus
agttcctgagacctaatcctgagagcacctggccatctgtgagtgtgcctggagtcactgtctcaggcactctctgttcacattacagtctagc

SEQ ID NO: 77705 - DNA, 101 bp, Mus musculus
gctctctgacccaatttgtttatactgattttgatgatctaacttaaggtgaggaagaatttatctcatgaatttgttcagaactaagaagttggaagagc

SEQ ID NO: 77706 - DNA, 87 bp, Mus musculus
gggttttgttgctgctgctgctgctgtttggtaattgtttgtaaaatttgcacatcgattctcacagtggctgtaccagttagacct

SEQ ID NO: 77707 - DNA, 104 bp, Mus musculus
cagcaaggagctcccattgctggactgcctcgtgttgatagatggtggagcttctctcactaaatctctctgctacatcccagttctggaagatttcgctgctg

SEQ ID NO: 77708 - DNA, 85 bp, Mus musculus; identical to SEQ ID NO: 57470

SEQ ID NO: 77709 - DNA, 81 bp, Mus musculus
ggcttagtttttttatattactgaaatcgtttatctattttttaattatgatttctcagtgtcggtgttggaacccaagcc

SEQ ID NO: 77710 - DNA, 85 bp, Mus musculus; identical to SEQ ID NO: 69220

SEQ ID NO: 77711 - DNA, 81 bp, Mus musculus
tctgatctttctaacagtgtttgaggagattgtctggcctctgtgttaattacctctgtgtcactgtgacatattgtcaga

SEQ ID NO: 77712 - DNA, 85 bp, Mus musculus; identical to SEQ ID NO: 57439

SEQ ID NO: 77713 - DNA, 65 bp, Mus musculus
gagcttgaaggagaaaccacggaggaacatcgcttgctggctcgttccctgtttcactcaggttc

SEQ ID NO: 77714 - DNA, 114 bp, Mus musculus
gcatgtgtgtatgtatgtgcatatgtgcatttatatattcaagtatctgtgtatatgtgagtatatatttatgtgtgtgtatgtatgcatgcatgtgtatatgtatatgtatgt

SEQ ID NO: 77715 - DNA, 95 bp, Mus musculus
gtgggaaagtctatagtgcatttgcttgatccatgattgatgggagaggacacaactcactgtggacagtgtcacctctgggaaggtggtcagca

SEQ ID NO: 77716 - DNA, 115 bp, Mus musculus
agtgaagaactggttcttgaagtttcagaggaacataaataggacattgagacttctaatgtgttatttttgtttacaaatctttggtttctttctgggtctggataatttcact

SEQ ID NO: 77717 - DNA, 56 bp, Mus musculus
tgtatgtatgtatgtatgtatgtatgtatacatacattcatacttgcactcataca

SEQ ID NO: 77718 - DNA, 73 bp, Mus musculus
atctgtacagtcacacacagtctcagaatgttgcattttagacttgagacggtttaaatgtaaatgtgcagat

SEQ ID NO: 77719 - DNA, 115 bp, Mus musculus
gcaccatgtcagttggcttcctctgtaaattactgcctgcaattctagatcagtgtttcttaatgtgtaggagttgaatgatccttttatagtggtaggatattagatattctgc

SEQ ID NO: 77720 - DNA, 89 bp, Mus musculus
ggctgtgcagggactccgttttatcctccccaactctcagcctctgactaagacccctgaggatgatatttggtccctaacccctggcc

SEQ ID NO: 77721 - DNA, 96 bp, Mus musculus
gatcagccttagtccatggtcatttaataggatgcatgggacaatttcaatatttttgtatctgttgaggcctgttttgtgaccaattatatggtc

SEQ ID NO: 77722 - DNA, 75 bp, Mus musculus
atacacatgtgtgtatgttcatgtataagtatatggtcttgtatatgtatgtgagtatgagcatgtgtatgtgtg

SEQ ID NO: 77723 - DNA, 57 bp, Mus musculus
tcctggggacattagatgccttagactgggctccagtctctgtctgtctggccaggg

SEQ ID NO: 77724 - DNA, 73 bp, Mus musculus
tgtatgtatgcatgcatgtatgtatgctgtacatatgtatgtatgtatgcatgtatgtatgcatgtccatgca

SEQ ID NO: 77725 - DNA, 68 bp, Mus musculus
gctggaggtctacaggactgaggatgtgcacgatagtgatacacagtcagtctctgaggacacatagt

SEQ ID NO: 77726 - DNA, 81 bp, Mus musculus
tctgtgtctatctgtctgtctgtatgtatgtatgcatgtatgtgtgtatgtatgtatgtatatcaaacatgaagggccaga

SEQ ID NO: 77727 - DNA, 93 bp, Mus musculus
agctatgcaggatctaaggtgacataaggcctggtctgcagaggccatttatttctgtcagtctgtctgtccatctttagtagtgctcaagct

SEQ ID NO: 77728 - DNA, 78 bp, Mus musculus
ctactgcttctacaatgaaatttatttttcattgttggtagagaggctggaagggtggagggcaggtatgaggggtgg

SEQ ID NO: 77729 - DNA, 73 bp, Mus musculus
cactgtaccatcactgtgtgtctctctctgtgtgtactggggatagaaagatcaccaggtgctgggtgtggtg

SEQ ID NO: 77730 - DNA, 85 bp, Mus musculus; identical to SEQ ID NO: 57439

SEQ ID NO: 77731 - DNA, 89 bp, Mus musculus
atagggctttctcggccttcctggtgagtgaatcatacctggtgtcttacacactggatgaattcagttcaaggttgcatatgccttgt

SEQ ID NO: 77732 - DNA, 91 bp, Mus musculus
tttcattttgaagtatatgtgcatgttcatgtgttgtgtgcattcagacttgctgcgatttgcgtgtctgtgcatgtgtgcatgggtgaga

SEQ ID NO: 77733 - DNA, 91 bp, Mus musculus
gcggctgttctgctattgatttacccatttctgtcttctaaaaataacaggaacataagatagaagtcgctgagcacagggggagtgccgt

SEQ ID NO: 77734 - DNA, 98 bp, Mus musculus
caaaatgatgtatatatatatatattcatatatacatacacatacaattacacatgtgtgtatgtatatatgtatgtatatgtgtggataccattctg

SEQ ID NO: 77735 - DNA, 107 bp, Mus musculus
atctgtatatatgtgtacacacatgagcctatatgtgtatatatatattcatgtagtgtatgtgtgttcagatatttgcatatatatgtatgcacatgtgtgaggct

SEQ ID NO: 77736 - DNA, 105 bp, Mus musculus
gttgttgttgttgttgttggggactggagagatggctcagtggttaagagcactgactgctcttccagaggtcctgaattcaattcccagcaactgcatagtgac

SEQ ID NO: 77737 - DNA, 62 bp, Mus musculus
gggtgtatctgtctgtgtgtctgtgtgtacatatagaatatactggaagcaacaggtcatcc

SEQ ID NO: 77738 - DNA, 100 bp, Mus musculus
tggcttgtacttgcctttgatgatgtacatctgaatatatatacatatatatgtgtgtgtgtgtgtgcgtgtgtgtgtgcgtgtgtgcatattcaagcca

SEQ ID NO: 77739 - DNA, 111 bp, Mus musculus
attccagtttcacacttccacatattgcctcctccgtgtctctgtttctgtatctcccttgatgtcagaagggagagatgatttggagctcactggaatcagaacactgga

SEQ ID NO: 77740 - DNA, 94 bp, Mus musculus
agtgtctgagtttggtgattatatatgggatggatcccctggtagggcagtttctgctccacactctgtctctgtaatttctttcatggatatt

SEQ ID NO: 77741 - DNA, 93 bp, Mus musculus
gcacgatttggctgtgagctggctctgtctggctgtgtgtatgacccttctccatgcctcaggatgatgacagccctagacagccttgtctgt

SEQ ID NO: 77742 - DNA, 68 bp, Mus musculus
gctgtggggctatttgtgactctctagggcttgaggaaagcacagagtcagcagtgaggtgcacttgt

SEQ ID NO: 77743 - DNA, 76 bp, Mus musculus
gggaagaggcaagtgattgcagatgtcttggctctcactggtgctgtgtctctctctgtatcacctgcatgatccc

SEQ ID NO: 77744 - DNA, 106 bp, Mus musculus
gaagaggatgaagcagggctaagccttaaaaaagtatcagaggtttagatatgtaatgtaatgtaaatgtgatgctgggaggactgtgcctatcttcaagaatttc

SEQ ID NO: 77745 - DNA, 119 bp, Mus musculus
gcacacttaaagcagaagagggtgccagatgacatgggactgcaattatagatggtagtgagcaaagttgtgtggatgctgtaaaccaaccctaaattctctgcgagagtatcaagtgt

SEQ ID NO: 77746 - DNA, 85 bp, Mus musculus; identical to SEQ ID NO: 57470

SEQ ID NO: 77747 - DNA, 83 bp, Mus musculus
ctgtggccagagtagggagagaagagactgagaagtctgtaataatgggcactgagaatctctcagtctatgtatggtcaagg

SEQ ID NO: 77748 - DNA, 116 bp, Mus musculus
tgttccctttggcttttataatcatcctcagctttttttctctttttttcagactgtaaatgagatgtgagagagcagagatggagatgatgattctgatagagtgagattttaca

SEQ ID NO: 77749 - DNA, 64 bp, Mus musculus
catgtacatctctctgtgtgtgtctatatgagtagtgtatgacataggagcgcaggtgtccatg

SEQ ID NO: 77750 - DNA, 72 bp, Mus musculus
aggaaggccattgactctctgtgtgacagtttccttggaaatactacacagacctctcctcagttccttcct

SEQ ID NO: 77751 - DNA, 59 bp, Mus musculus
agagagagaagtgagtgatgggaaccaagaggctcgccaccggctcatctcatcttttt

SEQ ID NO: 77752 - DNA, 69 bp, Mus musculus
gtatgtatgtatgtatgtatagtatatacgaatgtatgtatgtatgtatgtatgtgtgtgtgtatgtat

SEQ ID NO: 77753 - DNA, 109 bp, Mus musculus
gagcaagtgttctgtctttcaattatagatctttatcactgtacattgaatgctcaaggcagtcttatatcttccagtgatttgaccggaactagattcattttgcctc

SEQ ID NO: 77754 - DNA, 96 bp, Mus musculus
tcagtatatgcatattctatatatatgtatatttcctatgtatttatatgctatgtgctatgtagtgagtgttgtgtgtatgtgtgtgctttgtgc

SEQ ID NO: 77755 - DNA, 70 bp, Mus musculus
ctgtgtggcttgaacttgtgcaggtcctgtgcatgctgtcacagtctctgtgggtttgagtgtgcatcag

SEQ ID NO: 77756 - DNA, 108 bp, Mus musculus
gtgtgagcgcatccctgaggctcctacgtatgctccagccagaagtgatagagctcagagttggctggagccttctatgccatcctgggttttgtgctgcttaaaaac

SEQ ID NO: 77757 - DNA, 79 bp, Mus musculus
gggtggggagatggggtagggatgagaggctttgaggttccaagaacccatgccaggctcagtctgtctctctctgcct

SEQ ID NO: 77758 - DNA, 76 bp, Mus musculus
gtacatgatatacatgaatatgtatatggtgtatataaatatgtatatgatgtataagaatatgtatatgatgtat

SEQ ID NO: 77759 - DNA, 65 bp, Mus musculus
ccggagatgcctccaagcctcttttaaggcagagtcttggcctcagaggctctctgtttctctgg

SEQ ID NO: 77760 - DNA, 97 bp, Mus musculus
gtaggccttgaaatatgataatatacactcttactgcctgttgtgtatctgtgttgcaatgtatgtaagtatgtgtgttgcatgtttgagaacctat

SEQ ID NO: 77761 - DNA, 86 bp, Mus musculus
gaagcacatgactgaagattcaaagctgacatccacaaacaagaggacatatgtgatgtttgtctgtctggctctgggtttgcttc

SEQ ID NO: 77762 - DNA, 75 bp, Mus musculus
actgtgtgaggggctagagagatggctcagtggttaaaaagcactgactgctcttccagaggtcctgagctcagt

SEQ ID NO: 77763 - DNA, 119 bp, Mus musculus
cttgcatatcttcttcaaggttagtcgtgttagttagaatataaaatacaggagtgtagtgagtttgatgataattaaatgtattaacctaaaattacaattgaaggaaagatggtggg

SEQ ID NO: 77764 - DNA, 93 bp, Mus musculus
tccatggtgatctgataggatgcatgggacaatttcaatatttttgtatatgttgaggcttgttttgtgaccgattatgtggtcaattttgga

SEQ ID NO: 77765 - DNA, 75 bp, Mus musculus
aaatgaagtgtgtggatttgtaatgcaatcaaaagatcaaatgctatccttgaataaaatccaaatacttcattt

SEQ ID NO: 77766 - DNA, 87 bp, Mus musculus
gttcctgtctgtctgcctgcctgtctgtgttaataggtatatttgtgaagagaaagatcctagagaggccctgtagttagaaagaat

SEQ ID NO: 77767 - DNA, 76 bp, Mus musculus
ctgcctgcctgcctgtttgtctgtcggtgtatatggggatatttttgaagggaaggacaatagagaggccgtgcag

SEQ ID NO: 77768 - DNA, 109 bp, Mus musculus
gcagaatttgctcctccctgaaggtggacaaacatacaaacacctgttgcatacgagctgtgtgagctagtagtttcttttctcttcttcagaattataaaatccttgc

SEQ ID NO: 77769 - DNA, 117 bp, Mus musculus
gcaggtgagtcaagggaacagggttgtcccacattgaaatgagagatagctccctatagcccccctctctctgtatctctctctctgtatctctgtatctctctgtctctctgtctc

SEQ ID NO: 77770 - DNA, 105 bp, Mus musculus
gagtctctagagtagatggacgagattaggatgtagtgacagacagacagacacacaagagaggtgttaaatctgaatgtaatttttcagtcgagcctcagactt

SEQ ID NO: 77771 - DNA, 110 bp, Mus musculus
atcagccttaatccgtggtgatctgataggatacatgggataatttcaatatttttagatctgttgagacctgttgtatgaccaattatattgtcaattttggggaaggt

SEQ ID NO: 77772 - DNA, 110 bp, Mus musculus
gcatacaccactacacacttacagagagagagagacagagagagagagagagagatgtcagtgtgaatctataaatatatttcatgtgaggaatgaggttggtgtatgac

SEQ ID NO: 77773 - DNA, 85 bp, Mus musculus; identical to SEQ ID NO: 57470

SEQ ID NO: 77774 - DNA, 80 bp, Mus musculus
ttcatgtcccattatacatgtatatatttagatataaatagatatctatctatctctctatatatatgtatgtgtgtgaa

SEQ ID NO: 77775 - DNA, 86 bp, Mus musculus
actctttatgctgaagatatatctttgtatattatagatctgtatattatacattattgccaagagatatacctcagtaggtgagt

SEQ ID NO: 77776 - DNA, 62 bp, Mus musculus
cagagggaaggacggaggcaaatctactgtgtggtctgtctgtctgtctgactgtctgtctg

SEQ ID NO: 77777 - DNA, 85 bp, Mus musculus; identical to SEQ ID NO: 57470

SEQ ID NO: 77778 - DNA, 82 bp, Mus musculus
gtggaggcagagagtttcaggccagtttaggctacatagtgagtaccagcccaatttggtctcagactgactctgtctcaac

SEQ ID NO: 77779 - DNA, 82 bp, Mus musculus
tacacacatatgtatgtatgtatgtatatacgtatgtatgtatgtatgtatgtatatatgtatgtatgtatgtgtgtgtgta

SEQ ID NO: 77780 - DNA, 93 bp, Mus musculus
gaaagaagtgtgtcactgagggtgggcactgagcttttgaaatgacaccaggttcagtcgctcagtgtctctctgtcactgtcactgtctctc

SEQ ID NO: 77781 - DNA, 76 bp, Mus musculus
gtgacagtgacagagagacactgagcgactgaacctggtgtcatttcaaaagctcagtgcccaccctcagtgacac

SEQ ID NO: 77782 - DNA, 61 bp, Mus musculus
cctctctttccatatgtatatgtgtgtgtttacatatgtgtgtatatatgcattttagagg

SEQ ID NO: 77783 - DNA, 91 bp, Mus musculus
gcccttaaggtttgtttccctagtgagactccattagagaaaattaatttttcatttgcaagtggttatcaactggagatagcttctgggt

SEQ ID NO: 77784 - DNA, 106 bp, Mus musculus
tgcccaggggctgtgagttttcatccttctctctcagtgattcagtgcattttagatgtactctgatgagttttgtgtgggcaggtcctggactctgtcccaggca

SEQ ID NO: 77785 - DNA, 67 bp, Mus musculus
ctgtgtgtgtgtgtatatatatatatggctgcatctgctgtatgtatccctgtgaaacttcacacag

SEQ ID NO: 77786 - DNA, 76 bp, Mus musculus
gaatgtatggatctgtgtgtgtgtgtttatctgtatatgtataagaaaaaatatatatatttagatcttaccattt

SEQ ID NO: 77787 - DNA, 117 bp, Mus musculus
aaattgaataatgctttttatctcacagctattgttaattggaagagattgtatatatttatgatatgcattatatttttgtagcaatattgtggaatagctagatccaactaattt

SEQ ID NO: 77788 - DNA, 103 bp, Mus musculus
gtagtggtaatatacaaggttcctgcatttgatttgggacatgagtttaagcatgtctccgtgtctctctgtcgctgtgttctccctctctttaaaccaacgc

SEQ ID NO: 77789 - DNA, 101 bp, Mus musculus
gaaggtgagtctgatgtgtgcagagatgagtgtgttcacagtgacctgggttagtccgccctgtgacctcctctttccttcctgcctgcctgcctgcctcc

SEQ ID NO: 77790 - DNA, 118 bp, Mus musculus
tatacatatgcatagatatatgtatgctttctgtatgtatatatgcatgaatgtatgtttctacttgtatatgtgtatagataagtgtgtgattactgtatgtatgtttgtatgtatg

SEQ ID NO: 77791 - DNA, 78 bp, Mus musculus
cagctttctgtctctgtgtgtgatgtcagctcaggtgaccctagcactctcatgctggccgcacacgtgggcttgctg

SEQ ID NO: 77792 - DNA, 65 bp, Mus musculus
cacacacacacacacacacatctctatctctatagcgcacacgtgtgtgtatgtatatgtgtgtg

SEQ ID NO: 77793 - DNA, 97 bp, Mus musculus
ggaaagaatgaaagtgagttgggagctggcgagatggctcagtgggtaagagcactgactgctcttccagagatcccgagttcaaattccagcaacc

SEQ ID NO: 77794 - DNA, 119 bp, Mus musculus
ggacctggcttcctgagaagaaattcctgtccagggctgagctaggagtcacatcactgtcctgtctgactctctcagaagcagctgcaggaattctattcctggcaagtcatggtgcc

SEQ ID NO: 77795 - DNA, 76 bp, Mus musculus
catcaatatatgaatgcattgatctacctatgtatatatgtatgtatgtatgtatgtatgtattcatgtgtgtatg

SEQ ID NO: 77796 - DNA, 64 bp, Mus musculus
ggagctgtctgtctgtctgtctgggagctgtagccgataggtacagacaatggaaagcagcttc

SEQ ID NO: 77797 - DNA, 84 bp, Mus musculus
attttgatgcctctggaaagcagagaaggttgggcagtgtgttatccagactgacagtagcctgtgagcccagggtaggaaaat

SEQ ID NO: 77798 - DNA, 83 bp, Mus musculus
tactgatcgctttccctcctcgctctgtcttctgtagggagcagaggaaacccggagtgagtgagtgagtgagtgagtgagtg

SEQ ID NO: 77799 - DNA, 75 bp, Mus musculus
gttttaatagttgtagtactttaaagtctttgaagctttctgttcagagtatagagtgttgacaactacaagaac

SEQ ID NO: 77800 - DNA, 90 bp, Mus musculus
catctgtctgcctatctatctatctatctatctatggtatttaatgaggtatatagtgggtagattgtgggatatagcggagcagtattg

SEQ ID NO: 77801 - DNA, 79 bp, Mus musculus
gacacacaggcagtgtctctgtctactagagctgagccagccactgggcttgaggcaagcgagaaaaaggcctgtgttc

SEQ ID NO: 77802 - DNA, 106 bp, Mus musculus
gctgtgttcctaggttctctaagaaagcaggctgatggctggagagatggctcagaggttaagagcactgactgctcttccagaggtcctaagttcagttcccagc

SEQ ID NO: 77803 - DNA, 69 bp, Mus musculus
catgtgggcacagaggcaggaggatgcccacctgcacaggtgactgtctcctgtctctctcacttgcct

SEQ ID NO: 77804 - DNA, 106 bp, Mus musculus
tctctgtcacctcagtttctgagaggttggcctcactcctctgcctgtgtctgtctgaagaacagggacttggggtagaacctgcagaaaaagagaggacaaggga

SEQ ID NO: 77805 - DNA, 106 bp, Mus musculus
gcatgccagatttgctgtgctactgagcaaataagtccttctcataattttgtttttaaaatacactttaagggctagagagatagctcagtggttgactgattgc

SEQ ID NO: 77806 - DNA, 80 bp, Mus musculus
tgcagtgagagactgagtactcagtgaggagtgtaatgtcttcatccagcccctcccctcgaggctcagggagctatgta

SEQ ID NO: 77807 - DNA, 78 bp, Mus musculus
gcctgcctgacagttgagtatgtgatcttcagcttagcatgctctgagcttaggtcattcccaccgtcagagcagtgc

SEQ ID NO: 77808 - DNA, 75 bp, Mus musculus
tgtccctgactctgtgtcttagtcagggtttctattcctgcacaaacatcatgaccaagaagcaagttggggagg

SEQ ID NO: 77809 - DNA, 93 bp, Mus musculus
acagtggtgtagacagtgtgcagacagtagtgtagacagtgtgtagacagtgtgcagacagtagtgtagacagtgtgtagacagtgtgcagac

SEQ ID NO: 77810 - DNA, 78 bp, Mus musculus
cggctctagactctcagcctcacacagtggctgcatcaccagtctctcttgttctaaggcttcaagattctgggactg

SEQ ID NO: 77811 - DNA, 88 bp, Mus musculus
gaaagcgaggcttagctggagaaactggctggcaatcacgaggctctttgctcaatcatctctctctgtctctatctgtctctctctc

SEQ ID NO: 77812 - DNA, 117 bp, Mus musculus
acagggcatagcaccatttgtagaggtcagaggacaatttgtgggagtttgtttttttctttttatcacgtgggccccagaaatcaaattcagattgacagggttggaggccagtgt

SEQ ID NO: 77813 - DNA, 80 bp, Mus musculus
ggaaacaggactgaagctgagaacatggaggtatgcggcctactggatcactctctctgactcaagattagcctgctgcc

SEQ ID NO: 77814 - DNA, 99 bp, Mus musculus
gggttgaataaaaagccgcttccctggggttctgtgtctcactctgaatcaggaaccacatgagattccaccatgaacccactagaagggcttcagttc

SEQ ID NO: 77815 - DNA, 73 bp, Mus musculus
cagagctgaacacaaggtacagcagctgggtgtctgacccatgcagtgctgagttgtgtgtctgggacctttg

SEQ ID NO: 77816 - DNA, 90 bp, Mus musculus
gggcagaaagatcagggtcagcagcattgcatccacacctgaaaagcacttggtatttaaatgtctgtctgtctgtctgtctgtctgtct

SEQ ID NO: 77817 - DNA, 76 bp, Mus musculus
cagatatgtagcttggtcttataatgggttccctaacaattggaggggaggctgtctctgactctgttacctgctg

SEQ ID NO: 77818 - DNA, 102 bp, Mus musculus
caaaaaccaaactctacgggctctgtaatctttaagttacaatggtttctgattttgttgtactgtatgaaataaaagtcatgtagtgtgtgtgtgtgtttg

SEQ ID NO: 77819 - DNA, 85 bp, Mus musculus; identical to SEQ ID NO: 57439

SEQ ID NO: 77820 - DNA, 67 bp, Mus musculus
gggcggtgcagaagctgacagaagggatggatcttcactccttactctcagtcactgagaggagccc

SEQ ID NO: 77821 - DNA, 96 bp, Mus musculus
gtatatatgtatatatgtgtatatgtgtgtgtatatgtgtatatgtatgtgtatatatgtatatgtgtgtatatgtatatgtgtatatatgtatat

SEQ ID NO: 77822 - DNA, 150 bp, Mus musculus
tacatgtgtgtatgtgtacatgtgtgtatgtgtatatgtatatgtgtatatatgtatgtgtgtatatatgtatgtatacatgtacatacatatatatatatacatttgtgtgtgtatatacatatatatgaatgtatgtatatatatgta

SEQ ID NO: 77823 - DNA, 70 bp, Mus musculus
atgtatatatatatatgtatgtacatgtatacatacatatatacacacatacatatatacacatatacat

SEQ ID NO: 77824 - DNA, 74 bp, Mus musculus
aacatacatgtgtgcatgttagtgtgtgtgtacgtgtccgcgtgcgtgtgcatgtgcatgtgtgtgagtgtgtt

SEQ ID NO: 77825 - DNA, 71 bp, Mus musculus
ggagtaggtgtgtcactgtgggcatgggctttaagatccttgtcctagctgcctgtaagccactcttctcc

SEQ ID NO: 77826 - DNA, 59 bp, Mus musculus
gtctctctctctctgtgtatgtgtgtgtgaacatgtgtcatcccatggggggagggtgc

SEQ ID NO: 77827 - DNA, 97 bp, Mus musculus
ctcaggtacttgagacccaagtgtcctgctgagagtttagagtgaggagtttttaaaaccatatcctggtatctcactggggttttggggaagtgag

SEQ ID NO: 77828 - DNA, 70 bp, Mus musculus
gcatgtgcatgtgcatgtgcatgtatacatgtgtgaatttgtgtgtgtgtgtgtgtgtgtgtgtgtgtgt

SEQ ID NO: 77829 - DNA, 68 bp, Mus musculus
gtatgactgtgcatgcatatacatacatttttacttgtatatgtgtgtgcttgtgcatgtatatgtac

SEQ ID NO: 77830 - DNA, 98 bp, Mus musculus
tgtatggagtttgtgtgagtgtttgcatgtgcatccgtatgtaatctgtatgtctgtgtatgtttgcttatgaatctgtatgcattctgccattctct

SEQ ID NO: 77831 - DNA, 87 bp, Mus musculus
tatagttctgcatatgtaaaatgtttggtgaatatgtggagtggagactgttcagagagtgcatccttatatagccacagaactata

SEQ ID NO: 77832 - DNA, 72 bp, Mus musculus
ctctctgtctctggggggtatgcatgtgcatgcacgtgtgcatatgtgtgtgtgtgtccctctgtctctggg

SEQ ID NO: 77833 - DNA, 83 bp, Mus musculus
cactgtctctgtgtgtgtgtgcatgtaatgcagctgttcttagtttgtaagagcgatagccatgtcatatccggaagacagtg

SEQ ID NO: 77834 - DNA, 75 bp, Mus musculus
tactttgtgtgcatgtatgtatatagtatatgtatctatatatgtgtatctatatatgtgtgtgtgtgcatggtg

SEQ ID NO: 77835 - DNA, 121 bp, Mus musculus
cctgcttgcttctccgtcccttgccactgtgtatatcctctcactagaatgtgtgctctcaagagtggggacacctcggccatgccaggcacacctgagtcagtgttgatactgtcccctc

SEQ ID NO: 77836 - DNA, 71 bp, Mus musculus; identical to SEQ ID NO: 67675

SEQ ID NO: 77837 - DNA, 63 bp, Mus musculus
gccgccggatcacactgctgtgatcattttgatggtactcacacagtgtgtctctgtacaggt

SEQ ID NO: 77838 - DNA, 101 bp, Mus musculus
catttgttttgtgtgagcatgtatgtgcaggtctgtgtgtgtgctcatgtacacacaagtcacagtgcacatatggaggttaaaggacaatttgcagaatg

SEQ ID NO: 77839 - DNA, 76 bp, Mus musculus
gagggaagagttggattgtttggtattcaagctgtcatggcttgctctgtggaagcggaatagaacagtccccctc

SEQ ID NO: 77840 - DNA, 137 bp, Mus musculus
gagtttggggatgttgatctttaccagccctgactgtcatcgcacgtttgtcctgtcctaactgtcactcactgtttatcccccactcaagactggtcttaggcaaaccacttggcgagggctgcttcgggcaggtg

SEQ ID NO: 77841 - DNA, 74 bp, Mus musculus
gtgtgtgtgtctatctgtctgtctgttttctgtccttccgtagtcagtcagtcagtcagttctggcagtcaggc

SEQ ID NO: 77842 - DNA, 60 bp, Mus musculus
gtaccccttcgctattacttggtacaatattgtattcaaaagaagtaagcagaaggggac

SEQ ID NO: 77843 - DNA, 119 bp, Mus musculus
tagtgctttgccttctttatagcccctactttaaagactttctttgactctgaagtcttactcagtgagtctctgggtgtaagagaaggttggggcatcttgagtcgtggcttgtgctg

SEQ ID NO: 77844 - DNA, 93 bp, Mus musculus
tggaggcaaggcatttaagagttcaaggctgggggctggagagctggctcagcagttaagagcactgactgctcttccagaggtcctgggttc

SEQ ID NO: 77845 - DNA, 98 bp, Mus musculus
acaggttcacagctacactgtgtacagttaggggattaaataattttccactaatgggttgacaccctgcctctatccctgtggtgcttagattctgt

SEQ ID NO: 77846 - DNA, 108 bp, Mus musculus
atggctgtgtgtggggctggagaaatgactcagtgattaagagcactgactgctcttccagaggtcctgagttcaaatcccagtaaccacatggtggctcacaaccat

SEQ ID NO: 77847 - DNA, 82 bp, Mus musculus
cacattaactcattcggtctgtctgtctgtctgtgtgtgcgcacacataaatgcatgtagaagtcaaggacaatttgatgtg

SEQ ID NO: 77848 - DNA, 83 bp, Mus musculus
gacacattaattgtacagatgggcttcattgtattgtttccacaatgcataaataatgcactgacactgtctgtctgtctgtc

SEQ ID NO: 77849 - DNA, 64 bp, Mus musculus
ggaggagtgtgtcactagagggctttgcggctttgtcatgcccagtctctctcactctgcctcc

SEQ ID NO: 77850 - DNA, 58 bp, Mus musculus
gaggacacaggttcagctctgagcaccgatattgcagctcacagctgtctgtgactcc

SEQ ID NO: 77851 - DNA, 88 bp, Mus musculus
aggtatgctgatgtagtatatatatttatagaaggggatgttgtagtttcctgttataggagtggtgataagacattagaaagtagct

SEQ ID NO: 77852 - DNA, 104 bp, Mus musculus
tttgttcattttgtttcatccttatgttttgtctttttttaatttacctatgtgtttccttaagagagagagaaagaaagaaagcatgggattagaaggataaa

SEQ ID NO: 77853 - DNA, 69 bp, Mus musculus
gtatgtatgtatgtatgtatgtatgtatgtatgtattgtgtgtgggtatgtatgtatgtatgtgtgtat

SEQ ID NO: 77854 - DNA, 106 bp, Mus musculus
ctgcactcctggacatggatccagatgacagtagaatgagagcagaaacgtcaccatcactgccaacacttgtcattgctgggttgaaagaagcgatggagtgcag

SEQ ID NO: 77855 - DNA, 88 bp, Mus musculus
ctggacaagcagttagggacctcagtcctgggagaagctcactctccctctctcagcaggcaccaggtgtctatacttctttgtctag

SEQ ID NO: 77856 - DNA, 74 bp, Mus musculus
gtctgttgcctgtccacagaagctcagagagggaatggcattcttcttcagctctgagagacagacagacagac

SEQ ID NO: 77857 - DNA, 74 bp, Mus musculus
gttctaggatggctgggactatattgagagagactctgtctcaaacaaacaaataagagtccagatcctagagc

SEQ ID NO: 77858 - DNA, 60 bp, Mus musculus
gtgtacatgtgtgtatgtatgtatacatgtatgtgtatacatgtgtgcatgtgtgtgtgt

SEQ ID NO: 77859 - DNA, 73 bp, Mus musculus
cccatgagcttctgggaaactctcacagtctgtgttccaggtcgtcttgggcagctctgggtctccttgaagc

SEQ ID NO: 77860 - DNA, 90 bp, Mus musculus
ctccgtgtgtgtgtgtgtgtgtgtgtgtgtgcatatatatgtatatatacaaatatatgtatgcagaaagtatatatatatatatgagag

SEQ ID NO: 77861 - DNA, 109 bp, Mus musculus
tggatagaaaattgcctctcaggaagctgcatctagaaggttttaaaaaatggtagaaaatcctgtctttgaatataaattgggtgccggcccctgtggtttttacaca

SEQ ID NO: 77862 - DNA, 67 bp, Mus musculus
tacagaacaaattgggaggaagctgagtagggcaacttgcaactcagtgagtctcagtctttttgta

SEQ ID NO: 77863 - DNA, 61 bp, Mus musculus
agtatcggcagtgggacagatgtaggggggtatctgtctgtctgtctgtctgtctgtgtct

SEQ ID NO: 77864 - DNA, 57 bp, Mus musculus
cctagcactcaggaggcagaggctggcctctgtgtgtctgactctgtgtgtctgagg

SEQ ID NO: 77865 - DNA, 120 bp, Mus musculus
agttgttaactcagaaggcagaatgaggagactccctggggtagccatggtccctgtttcccactgaagagtcctttcatggtccttaatgattctccttatgtataagtgaccactgtc

SEQ ID NO: 77866 - DNA, 75 bp, Mus musculus
cgtcacatcaattaccacacggtctcctgctgcctccttctgagggactgactgtgtctaattcctagtgtgatg

SEQ ID NO: 77867 - DNA, 83 bp, Mus musculus
catgtatgtacaagtgcatgtgtgttatgtgcatgtatatataagtgtgtgtatatatatatgtgttatgtgcatgtatgtac

SEQ ID NO: 77868 - DNA, 109 bp, Mus musculus
aaatgggcggtgatacatggttttgtttctgctttattctaacccagtcatctatgtttgtttttgtgtcaggagaaacaactttgaggccgccaatcaccttccattt

SEQ ID NO: 77869 - DNA, 73 bp, Mus musculus
tgagggtgcacacttcagctgacagtcatctagcaatctgttagaagcagtgtcacctgtctgtctctcactc

SEQ ID NO: 77870 - DNA, 86 bp, Mus musculus
tgaatctgcccttcgacacccagatgcgacttaggaagctaagggtctcctgtctctaagtctgtctcatttgtctaatagactca

SEQ ID NO: 77871 - DNA, 88 bp, Mus musculus
ctttcagagaactgtgtctctgagtcacatctcaagtcggaaaggacaggaggctgaatagagtcagagggaaagggggcaaagagag

SEQ ID NO: 77872 - DNA, 90 bp, Mus musculus
gggagtaaaaacttatggtttccggctggagagatggctcagcggttaagagcactgactgctcttccagaggtcctgagttcaattccc

SEQ ID NO: 77873 - DNA, 63 bp, Mus musculus
gctgtgtgccgtagggtgtttgcttctgttggggcagccctgtctagctcactggctgacagc

SEQ ID NO: 77874 - DNA, 66 bp, Mus musculus
atacggggaaaggttgggacaggcattggaagaagattgtctgtctgtctctctgtctctctgtat

SEQ ID NO: 77875 - DNA, 69 bp, Mus musculus
gtcttctgagaacactggctccagacaggcagtgtcagacctggtctggtagagcccttgcagtaggat

SEQ ID NO: 77876 - DNA, 81 bp, Mus musculus
agattccaggacagctgggactgcacagaaaaaccctgtaaaaatatccatttgtctgtctgtctatctgcctgtctgtct

SEQ ID NO: 77877 - DNA, 74 bp, Mus musculus
gaaggaaggaacctgactggagagatggctcagcggttgaaagcactgactgctcttccagaggtcctgagttc

SEQ ID NO: 77878 - DNA, 96 bp, Mus musculus
ccaattattgctattatgtttgcctgcctgactgcctgcatgtcctatgtaggactcattgtctaaggagagcagatgtacatcactgggctatga

SEQ ID NO: 77879 - DNA, 78 bp, Mus musculus
ttgggcttagacctggtgtagttaggaccctaggattaacattatcttcagttgtgtgcacactccggtgaggcctga

SEQ ID NO: 77880 - DNA, 86 bp, Mus musculus
ggccatggtgatctgataggataacatgggacaatttcaatatttttgtatctgttgaggcctgttttgtgaccaattatatggtc

SEQ ID NO: 77881 - DNA, 90 bp, Mus musculus
aagagactgaggatgagaagtgttttagttatatctatgatgatggtggactaatgaacaaaaatacagcaatttcctctccagttcctt

SEQ ID NO: 77882 - DNA, 61 bp, Mus musculus
tacatatatacatacatacacatacacatatatattgtgtgagtgcatgtggatatgtgtg

SEQ ID NO: 77883 - DNA, 85 bp, Mus musculus; identical to SEQ ID NO: 57439

SEQ ID NO: 77884 - DNA, 98 bp, Mus musculus
ggcgccccaaataggaaaccccagagacattctggattcagcttgttttgagttgagtctgaaatgcccctcacaggttcttgctgttgatgcttgcc

SEQ ID NO: 77885 - DNA, 111 bp, Mus musculus
gtaaatgtattgacttgcaattgttttttactctatgactgtctcagtcagggtttcaattcctgcagaaacatcatgaccaagaagcaagttggggaggaaagggtttat

SEQ ID NO: 77886 - DNA, 85 bp, Mus musculus; identical to SEQ ID NO: 57470

SEQ ID NO: 77887 - DNA, 110 bp, Mus musculus
ttccacttgcctaagcagaggacgtgtgtgacttggacttgtgtaggtcttaagtaggctgtcacagtctctgtgagtttatatatgcatcagctttgtggcattgggaa

SEQ ID NO: 77888 - DNA, 95 bp, Mus musculus
ggagagcatgaagttgtatgagtatgtatgcatggatgtgtatttatataaatgtatgtgagtttatgcatatttgcttgtgtaaaagtttttcc

SEQ ID NO: 77889 - DNA, 85 bp, Mus musculus; identical to SEQ ID NO: 57470

SEQ ID NO: 77890 - DNA, 75 bp, Mus musculus
tatatagctataaatagatattatgtagatatatagttgtatatatctatatacatatacatatatagctattta

SEQ ID NO: 77891 - DNA, 143 bp, Mus musculus
tatatacatatatatctacatatatataaatatttatcatatataaatatatgtatgtgtatatatatgatatatatatatgtgtgtgtacatatgtatatttatatatatatatatatgtgcctctctctctctcacacaca

SEQ ID NO: 77892 - DNA, 89 bp, Mus musculus
tcatatttagcggacatgagtgattttgatattgtcttgcacacagcttacagataaaggcattgtttcccttaccttcgggaatatga

SEQ ID NO: 77893 - DNA, 100 bp, Mus musculus
ggtgctgtaggttgatgtgtgtgacagccttgctttgactactggacagtatttcacagctctcctctctatcagtcagctattacattctttccacacc

SEQ ID NO: 77894 - DNA, 79 bp, Mus musculus
tagggtgaagtgtgagtggacagaatggctgtgtatcctctaagatgagtctttctgcttctgaaagaggtttgcccta

SEQ ID NO: 77895 - DNA, 79 bp, Mus musculus
gtgtatctatgtatatgtgtgcatatatatatacatatatgtatgcatatatatgtatatatgtgtgtttatctatgta

SEQ ID NO: 77896 - DNA, 85 bp, Mus musculus; identical to SEQ ID NO: 57439

SEQ ID NO: 77897 - DNA, 118 bp, Mus musculus
cttagaggtaattgcggtcacattatttattatatctggtaatagtctgtacttaatttttaattgtacacacattaatcctaaatattccatagtgagtctatagtggactcttaag

SEQ ID NO: 77898 - DNA, 72 bp, Mus musculus
tacttgaacatcacagatgtcactctgtgagggaaagaatgctgcagcagagagtggcttggattgcaagtg

SEQ ID NO: 77899 - DNA, 79 bp, Mus musculus
ctgagtactgtatttggaaactggtcgttcacatgattgtcatagtctttgtctcagtcagtgttctattgcagtgaag

SEQ ID NO: 77900 - DNA, 60 bp, Mus musculus
ccagagaggcacagagagtacactgtcacctggcaggatgcttttcatatgcttcccagg

SEQ ID NO: 77901 - DNA, 94 bp, Mus musculus
gagtatggggctggagagatggctcagcggttaagagcactgactgctctttcagaggtcctgagttcgattctcagcaaccacatgatagctc

SEQ ID NO: 77902 - DNA, 75 bp, Mus musculus
tgattatatatctatatgtctatatgagtatgtctataatatatagatatagacatatagatatagatatattca

SEQ ID NO: 77903 - DNA, 67 bp, Mus musculus
atatatctatatctatatgtctatatctatatattatagacatactcatatagacatatagatatat

SEQ ID NO: 77904 - DNA, 67 bp, Mus musculus
ggtcagcaggaaggaccaggaggaacaccaggagaagttctcatctgtggctctctcactgaagatc

SEQ ID NO: 77905 - DNA, 74 bp, Mus musculus
gtatgtgtgtgtatatatatgtatatgtgtgtatatatatacacacacacatacatacacacatacacacatac

SEQ ID NO: 77906 - DNA, 109 bp, Mus musculus
agagaaacatgacttttactgctactgcatggaacaagattttttttttttctcaaagagagacaagatcaggattcctcagtagtggactttagtagccacattcttt

SEQ ID NO: 77907 - DNA, 79 bp, Mus musculus
aagatcagtgaagatgtgagatccccgagccttgtacagctagctgtatgagcaagctctgtctctgtcactccatctt

SEQ ID NO: 77908 - DNA, 82 bp, Mus musculus
gattaggaggtgtgtcataggcgtgggaattgagacttaacaagcatcacaccgtttctagtgtgttctctgcctcctggtt

SEQ ID NO: 77909 - DNA, 58 bp, Mus musculus
tatgtatgtatgtatgtatgtatgcatgtatctatgtatgcatgtatgtatgtatgta

SEQ ID NO: 77910 - DNA, 83 bp, Mus musculus
catactattcagactgaccagacagtgaggaatcctgctttaaagtcaaggggagctagtttgacctcagtttggaagctatg

SEQ ID NO: 77911 - DNA, 60 bp, Mus musculus
ttattattattattattattattattattattatgatgatgatgatgatgatgatgatga

SEQ ID NO: 77912 - DNA, 85 bp, Mus musculus; identical to SEQ ID NO: 57439

SEQ ID NO: 77913 - DNA, 84 bp, Mus musculus
taaagcttatctcagcttgctttgaagagataaggctgcacactccattgctcttagccacttttcagagagcttgtggcttta

SEQ ID NO: 77914 - DNA, 85 bp, Mus musculus; identical to SEQ ID NO: 57439

SEQ ID NO: 77915 - DNA, 105 bp, Mus musculus
gcaactttatatatatatgcacacatatgtatatatgtatgtatatatacatatatatgtatatatcttcagtgctattaattaccaactagtatatgataatgc

SEQ ID NO: 77916 - DNA, 74 bp, Mus musculus
gtatatatgtatgtgtgcatgtatgtatgtatgtatgaatgaatgtatgcatatgtgtatgtatttatgtgtat

SEQ ID NO: 77917 - DNA, 108 bp, Mus musculus
tgggtgcatgaattatggaagtgtacatgtgagtgtgtatgtgcatctgttgtgtttataaatgtaggtgtgccacagcgcatgttttgaggtcatatgtcaagctcg

SEQ ID NO: 77918 - DNA, 103 bp, Mus musculus
gagctgtgtacgtctttgtgtgagtgatgcttgtctgttgtgagactgcctgtaaatgatgtctctgtctgtgtgtctgtcattaacaaaggtcttcactctc

SEQ ID NO: 77919 - DNA, 119 bp, Mus musculus
agagagagacagagacagagacacagagacacagaggcagaggcagagatagagagactgacagagacagagagagtctgaccttgtaaaatgagcttgtcagcattcttttcctttct

SEQ ID NO: 77920 - DNA, 85 bp, Mus musculus; identical to SEQ ID NO: 57439

SEQ ID NO: 77921 - DNA, 63 bp, Mus musculus
tgtctgtctgtctgtctctatgtatgtatgtatgtatgtatgttggcaggcaggctgtagaga

SEQ ID NO: 77922 - DNA, 62 bp, Mus musculus
agatcaagtggccataggtgtgtggattcatctctgggtcttcaattctgttccattggtct

SEQ ID NO: 77923 - DNA, 79 bp, Mus musculus
tgtaagcattctcttctcactgtcattcagtctgatggtgtgacctcagaatgtgaaggagatcctcatatgtcttgca

SEQ ID NO: 77924 - DNA, 116 bp, Mus musculus
atgcatttgcttgcctagtgtatgtacatatttatatatttatactattacaagtgatgtgtatatatgtaaatatacatatatgtgcatgtatatgtatatatacacatatatat

SEQ ID NO: 77925 - DNA, 58 bp, Mus musculus
tgtctgcaccctgtactcatggcagcaagggcatgctgctgtaagaagagtgtgagca

SEQ ID NO: 77926 - DNA, 114 bp, Mus musculus
tgcatggacaattaaaaatagatatacatatatttatatatatatgcatgtatatgcctatgtatacatatatgtctatatatacatatgtgtatatttgtgtatatgcacaca

SEQ ID NO: 77927 - DNA, 85 bp, Mus musculus
ggccatggtggtctgataggatacatgggacaatttcaatatttttgtatctgttgcggcctgttttgtgaccaattatatggtc

SEQ ID NO: 77928 - DNA, 68 bp, Mus musculus
cacacacgcacacgcacacgcacacgcacacgcacacgcgcgtgcgtgcgtgcgtgcgtgcgtgcgtg

SEQ ID NO: 77929 - DNA, 80 bp, Mus musculus
atatatatgtgtgtgtgtgtgtgtgtatctatacctatatatgtatgtatatatacacatggatatatacatatatgtgt

SEQ ID NO: 77930 - DNA, 114 bp, Mus musculus
agtggaagatggggagtccagccaaacatgaaagctgcacacttgctgaccagacactgaacagtgacagctaacattgttgcctgaggaaaggacattctgattgcttcaact

SEQ ID NO: 77931 - DNA, 132 bp, Mus musculus
gcatgctgtaacataggaaaatgaagcaaatgcctcatgacttcccatcttttctctatgagcatttcatttctatgtctggggtctgctgcatttggtgtgagaagacatgcgcgtgaaggatttagcatg

SEQ ID NO: 77932 - DNA, 73 bp, Mus musculus
gcatatatactcatatgtgtgtgtgtatgtgtataggtgtatatgtatatatcaatatatatgatgtatatgt

SEQ ID NO: 77933 - DNA, 71 bp, Mus musculus
tcatttttttgtgtgcatgtaggttgtatgtatgtatgtatgtatgtatgtatgcatgtatgtatgtatga

SEQ ID NO: 77934 - DNA, 79 bp, Mus musculus
tgtatgtatgcatgtatgtatgtatgtatgtatgtatgtatgtatgtatgtatgtatatgagtacactgtagctgtaca

SEQ ID NO: 77935 - DNA, 85 bp, Mus musculus
gccagcagctgcatgccaagtgtttaatacataagccttttgggaacatacttcgtatctaaatcacagtgagctatgtgctggc

SEQ ID NO: 77936 - DNA, 100 bp, Mus musculus
tctgcataggaaagctttgtactgtgagaatagagttcttgagattttgatgtaatgttagttattcttttattgctgtgacaaaacaccatgatgtagg

SEQ ID NO: 77937 - DNA, 83 bp, Mus musculus
attttctaattacgtgtctctctgaatgtctgtatgtattcatgtgaacgtatggatgcaggtatctgtgggacccagaagat

SEQ ID NO: 77938 - DNA, 99 bp, Mus musculus
gatgtattcctttaaagagtttccaatatatgcagggagccacatacttagaaaacatgtgtatctctctgtgtgttattctacacagacatctacatc

SEQ ID NO: 77939 - DNA, 134 bp, Mus musculus
gcagagccaatgagatcaatctgctacactcagaggctgaggtttgtgctatgctattcactctcagtctgtgtaaagtattttcggtggcatttgcacaaattataacattgcctagtagtgcttttctcaga

SEQ ID NO: 77940 - DNA, 62 bp, Mus musculus
tcaggcagtacttggccagtcttcagtggtagagcctgctgtcagtctgtctgtgcttctga

SEQ ID NO: 77941 - DNA, 85 bp, Mus musculus; identical to SEQ ID NO: 57470

SEQ ID NO: 77942 - DNA, 56 bp, Mus musculus
aacaagactccatagtccaggaaaacaagtccaacctggtaggtggttgttttgtt

SEQ ID NO: 77943 - DNA, 75 bp, Mus musculus
gtctctctctgtgtctgtctctgtcatacttgctttgcctgttaatagagggcacttcttatacagcagaggagc

SEQ ID NO: 77944 - DNA, 85 bp, Mus musculus; identical to SEQ ID NO: 57439

SEQ ID NO: 77945 - DNA, 141 bp, Mus musculus
gtgtattaagtgggattaccttgaatgggctttgagtcttctcaaaagttgatgtagttcacaggaagtaggttgtaaaggaagaatggccatgcttggtgccactgcattgtgcacattttgactgagatgggaaagctt

SEQ ID NO: 77946 - DNA, 108 bp, Mus musculus
ataggagatatatgaatatgtgtatgtgtgtatgtatatatgtatatatacacacatatatgtatatatacacatacatgcacatatatagtctgtatttatgtatac

SEQ ID NO: 77947 - DNA, 72 bp, Mus musculus
taatatttatgtgcatgtgcatgtatatgtatatgatatatgtgatatgtatgcacatgtaaatgtgtatta

SEQ ID NO: 77948 - DNA, 81 bp, Mus musculus
ctattatatatgtgtatgtatgtatatacatatagatgatacatacatagatagatgatacatacatagatagatagatag

SEQ ID NO: 77949 - DNA, 115 bp, Mus musculus
tgtgtatgtctgagtgagtgtgtgtgtctgtttgtgtgtgcttaagatttcattgaatttttatgtttctatatgaatctgggccatgtgtgtggaagtgactagggcatccaga

SEQ ID NO: 77950 - DNA, 60 bp, Mus musculus
gtgtccgactgtgtctctgatttcatgggcatgagcatgaaatgaggaaaatgttggcat

SEQ ID NO: 77951 - DNA, 70 bp, Mus musculus
tccattgtcatatgtatgtatgtatgtatgtatgtatctatgtatgcatgcatgtatgtatttatgtgga

SEQ ID NO: 77952 - DNA, 85 bp, Mus musculus; identical to SEQ ID NO: 66071

SEQ ID NO: 77953 - DNA, 81 bp, Mus musculus
ttttgtctgtctaacactgagtcatcttccctctccctcagcaaggagagagaggcattggggagcttctgacagtcaaga

SEQ ID NO: 77954 - DNA, 117 bp, Mus musculus
tatgggtgtgtatatgtaagtatgcatgaataattgtagagttgagacacaaacaggtggttgggcttgactggagtgtgtttgtgtatgactgtgtgtgtgtgtgtgtgtgtgtgt

SEQ ID NO: 77955 - DNA, 115 bp, Mus musculus
cagacttagtccatgttggtctgataggatacatgggacaatttcaatatttttgtatctgttgagacctgttttgtgtcaaattatatggtcaatttttggagaaggtaccatg

SEQ ID NO: 77956 - DNA, 166 bp, Mus musculus
tgtatgtatgtgtgcgtatgtatgtatgtgtgtgtgtatatatatatatgtatgtatgtatatatatatgtgtgtgtgtgtgtgagataaagcctcaatgaataactttatatatgtatgtgtatgcatgtatgtattcctcaaggaatcatacacacacacacac

SEQ ID NO: 77957 - DNA, 106 bp, Mus musculus
cacacacataacacacaggcatgcatgcaagcaaagcactacacacatatatttatgttttaatgcaagtgttctggttgctgtatgtgtgtgcagtacctgcgtg

SEQ ID NO: 77958 - DNA, 85 bp, Mus musculus; identical to SEQ ID NO: 57470

SEQ ID NO: 77959 - DNA, 85 bp, Mus musculus; identical to SEQ ID NO: 57470

SEQ ID NO: 77960 - DNA, 111 bp, Mus musculus
tcaggaagtctggctgccttcttcatgagagccacatctgtatttattattgtgtcttctatatacttcttcggcttatgtggataaggtttttatgcctaaaggctctga

SEQ ID NO: 77961 - DNA, 59 bp, Mus musculus
cagcgcagagctgtggaaacacactgttacgtgtgtacggtgtgtacactctctctctg

SEQ ID NO: 77962 - DNA, 92 bp, Mus musculus
acatatacagatatagtgaggatatgactatgatctatgtgcctattctgtgattatggtatgtaaacttgtatactgattctgttcaatgt

SEQ ID NO: 77963 - DNA, 74 bp, Mus musculus
atatgtatataactaagtatgtatgtatatatgtgtgtgtatacatatatatctgcatttatgttaaaatatgt

SEQ ID NO: 77964 - DNA, 108 bp, Mus musculus
ttgaagattgtttctctgtatgtatatatgtatgcatgtatgtatgtctgcctgtatgtatgtatatatgtatatgcaccatgtgcatgcagtggctatccaagtcag

SEQ ID NO: 77965 - DNA, 72 bp, Mus musculus
tccagcttaggccagacaagtcagctatggagactgagctgtctgctgtgtgtgtgtgtctttcattctgga

SEQ ID NO: 77966 - DNA, 111 bp, Mus musculus
ccaaaacgttagcgtgtgtgtcttggccatggttcctgtatggttgtgactgtggatgtgtcagaagacagtgagaagtcaatgcgccttttaaacgtccgtttgtattgg

SEQ ID NO: 77967 - DNA, 76 bp, Mus musculus
ccacttatacttgtttacacatggacatctgtttattcaggctgggatctgtctgtgtgtgagggaggacatgtgg

SEQ ID NO: 77968 - DNA, 64 bp, Mus musculus
cgtgtgcatgtgttcatgtgtgtatgtgtgtgtatgtgtgtacctgcatgtgcatgtgcatgtg

SEQ ID NO: 77969 - DNA, 68 bp, Mus musculus
cacactcattcactctctcttacttgccccaggagggcagggcgggagggggtggggtgggaagggtg

SEQ ID NO: 77970 - DNA, 108 bp, Mus musculus
agaggagaggttgaaaggaaaggcaggaatgagtcacttatttcctttcatctcccactcagtcactctcttctgctaagcactcttttcattttttcctttccaccc

SEQ ID NO: 77971 - DNA, 76 bp, Mus musculus
cttgttatgcatggtgggggagggggagctaaagccaggcccagtgtctctctctccctgctgcatgccaatcagg

SEQ ID NO: 77972 - DNA, 92 bp, Mus musculus
gcgagactatttacaatgacctgtggtttggcagaagtgactgggcactgtcccttttaagagctggttcttgtattgctaattcgtctcac

SEQ ID NO: 77973 - DNA, 96 bp, Mus musculus
agtaccaccaggtcatctgattcacacactctctttgtgctgagaccggaagacccagagtctatggctggggctggagagagagaggtggcctgg

SEQ ID NO: 77974 - DNA, 81 bp, Mus musculus
catgtgctggagtagagagatgactcagagcactggctgctttttccagaggtcctgagttcaattcccagcaaccatatg

SEQ ID NO: 77975 - DNA, 90 bp, Mus musculus
gagcaactgcttgtggtacagttgagtcagaggacacgcttcctttaaagatggcggagaactttcactgtgagaacactggcagccttc

SEQ ID NO: 77976 - DNA, 108 bp, Mus musculus
gtctcaccttttgagttcttaagccttcctgcagggaagtgttagctctggaaaagagagatgagacagagttcatgaacatcacctgtgtgtaggcagggataggac

SEQ ID NO: 77977 - DNA, 68 bp, Mus musculus
cctgtcccagtcaggagaaacagagcactggaggacggtggcttcttaagtattcacctggggacggg

SEQ ID NO: 77978 - DNA, 105 bp, Mus musculus
atctttagccttttatttatttatttgtgtgtgtgtgtgttcatgtatgtatgtatgtatgtatgtatgtatgcatagacatgtgttgtgaccagaggacttggt

SEQ ID NO: 77979 - DNA, 115 bp, Mus musculus
tgacacaccgaaaaaaaaagatctgggctggagagatgatggctcaggggttaagagcactgactgctcatccaaaggtcctgagttcaattcccagcaaccacatggtggctca

SEQ ID NO: 77980 - DNA, 69 bp, Mus musculus
gagcacagacatacaagtgactcagcacatggtcatgaagttgggctgggggcacttggtgttgtgatc

SEQ ID NO: 77981 - DNA, 88 bp, Mus musculus
ttgagtgctagtatctattaagcatatctgaattagacagtctgtgtctgtttttaattatttgctctagattgtatctagcaaacaa

SEQ ID NO: 77982 - DNA, 83 bp, Mus musculus
tatggaatcatggtgtgctgtgtgtgactcactccttgttttaccaccatctgagtcggccatcagcccatccattatctgtg

SEQ ID NO: 77983 - DNA, 79 bp, Mus musculus
aagtttatgagtcagtgtttctctgtgtagccttggctgtcctgccactcactctgtagaccaagctggcctcgaactt

SEQ ID NO: 77984 - DNA, 115 bp, Mus musculus
gtctatatgtggcctatatgtatatgtgtgtgtgtgtatatatatatgtgtgtgtgtatatatacatatatatattttacatatatatatatatatattagtagagttagatgac

SEQ ID NO: 77985 - DNA, 97 bp, Mus musculus
tataaatacatttactaatggtttaaactgggcatgtgtttttctaattgtgtcagtgtgggacatatctaggcttccatctgtatgtgtggctgta

SEQ ID NO: 77986 - DNA, 107 bp, Mus musculus
aggattgatagtccctatgtccggctgaaattgatcatctttgctatgttaagtagatagtagtattagtgtcaaagagcatccggattattgtgattcagatctct

SEQ ID NO: 77987 - DNA, 79 bp, Mus musculus
atcagttgtggcatatccacgcagagtagaattcagcaggagagagaacatactgtgttctgtggatgagtcacgtgat

SEQ ID NO: 77988 - DNA, 72 bp, Mus musculus
agaaagagagaaggaaagatggtagagattcagtgtatctgtctatctatctatctatctatctatctatct

SEQ ID NO: 77989 - DNA, 111 bp, Mus musculus
gtgtatgtgtgtgtatacatgtgtgtgcacatgtgtatgcatatgcgtgtgtgtgtatatatgtgtatatgtatatgtgtgcatgtgtgtgtgtgtgagcgtgtaagccat

SEQ ID NO: 77990 - DNA, 130 bp, Mus musculus
tgtgtgtacatgctatgtgtgtgcacatatatgtctatgtgttcatacatatgtgtatatatatgtatatacgtgctatgtgtttacatgcatgtatgtttgtatgtgtgtgtacatatgtatgtatgtg

SEQ ID NO: 77991 - DNA, 97 bp, Mus musculus
tgcaaacacatgcattgccactgctgctccgggcttctgagtgcacgcgtacatgtgtgcctgtatgcctgtgtgtgtgcgtgtgtgcatgtgtgca

SEQ ID NO: 77992 - DNA, 93 bp, Mus musculus
ctcatatatatgtatatatatgtgtatatatgtatacatgtatatgtgtatatatatgtatatatacatgtatatgtgtatatataacacata

SEQ ID NO: 77993 - DNA, 80 bp, Mus musculus
cagcatcagctggaaattgcactacacagagccccacctctgctcagagttcggaatgaagagttgtgatgttgatgttg

SEQ ID NO: 77994 - DNA, 116 bp, Mus musculus
tatgtgcatatgtgcatatgtgcatatgtgcatatatgtatatatgtatatatgtatatatgtatatacgtatataagtatatacgtacatacgtacatacgtacatacgtacata

SEQ ID NO: 77995 - DNA, 94 bp, Mus musculus
tttgctatggcccggctcctctcacctccacacctccacccctgcaagattgtctgagatgagagtgagcaatagagaaggaactcatagcaag

SEQ ID NO: 77996 - DNA, 91 bp, Mus musculus
tcagaaagggagatactgagacagaggctagccaacctgctcacattgagtagccagcgagtgatgtctgtctgtctgtctgtctgtctga

SEQ ID NO: 77997 - DNA, 77 bp, Mus musculus
gtctgtggtgtgatgtctcagaggtagaacagtgcgacttgggaagacacagctgacactgaggtcagaaaacagat

SEQ ID NO: 77998 - DNA, 94 bp, Mus musculus
catgtgtgtatgagtgtttatgtacgtacgtacatctgtgtgtttgactgtgggtgttcatgtatgtatatgagtgtgtaagtgtgtgcatatg

SEQ ID NO: 77999 - DNA, 78 bp, Mus musculus
ttctcactggtcttagtgtcttcttcctgcctcccgcgggtttgcacatggactttgggccttataatcctaggagag

SEQ ID NO: 78000 - DNA, 107 bp, Mus musculus
gtgtgtgtgtgtgtgtgtgtgtgtgttataagcatatgtgtatatatatatatatatatatatatatatatatatatatatatatatatgtgtgtgtgtgtatgctt

SEQ ID NO: 78001 - DNA, 69 bp, Mus musculus
ggtgagtgggtttgaccagggctcttgatctgtacaggacttgagtctgtgtctgactcccagcttagc

SEQ ID NO: 78002 - DNA, 76 bp, Mus musculus
tggttgagagcacatactgctcttgcagaggtcctgagttcgagtcccattgcctgtgttgtacagctcctaacca

SEQ ID NO: 78003 - DNA, 102 bp, Mus musculus
gtattttaaatagtaagattgcatatgcaaattatatgtatacatgtgcgtatgcgtgtatatatatatgtatgtatgcatgtattatgtggtatagtttgt

SEQ ID NO: 78004 - DNA, 69 bp, Mus musculus
gacattcttcctgtgagagcaggcgggagagatggctcagcagtctgctcttccagaggtcctgagttc

SEQ ID NO: 78005 - DNA, 71 bp, Mus musculus
ggctgggcctgtggcactcactgcctgtgatcccagcacctaagaggctgtgacaggggcatcaggaagcc

SEQ ID NO: 78006 - DNA, 70 bp, Mus musculus
catctctctctctctgcaggtgtgtatgtttgtgtttatttataatatctatcctagggttggagagatg

SEQ ID NO: 78007 - DNA, 66 bp, Mus musculus
tcttagtccactgtgtgtcacagtgtctgactcctgctgtcaacattgtgggatgggtcttttaga

SEQ ID NO: 78008 - DNA, 63 bp, Mus musculus
acacgggctggagagatggctcagcggttaagagcactgactgctcttccagaggtcccgagt

SEQ ID NO: 78009 - DNA, 127 bp, Mus musculus
actgatggagggtcttgatgggcttctctaccaaagtgtgggagtcagaggccttgtctcactcagtctgtggaaactgggctcagttattttgtgctggttcagtagccaccatctgttctcagca

SEQ ID NO: 78010 - DNA, 93 bp, Mus musculus
ctggggtcctgagctgaattttgaaaaaagggggattaggggagctgaaagccagtgcttctctcactgcttctcgatttatggatagaagga

SEQ ID NO: 78011 - DNA, 98 bp, Mus musculus
tatatatatatatacacatacatatatacacactcacatatatatataaatatatacatatatacgtatatatacacgtgtgtgtatatatatatata

SEQ ID NO: 78012 - DNA, 106 bp, Mus musculus
tataagagaggtgtgtatatatatatatacacacacgtgtatatatacgtatatatgtatatatttatatatatatgtgagtgtgtatatatgtatgtgtatatat

SEQ ID NO: 78013 - DNA, 115 bp, Mus musculus
ggttctataagaaagcaggctgagggctggagagatggctcagcagttaagagcactgactgctcttccagaggtcctgagttcaaatcccacaaccacatgctggctcacaacc

SEQ ID NO: 78014 - DNA, 79 bp, Mus musculus
tggtctgtatgtatgtgttcatgtgtatatgtatatatgtgtatgtatgtgcgtatactgagctgaatatttagtatca

SEQ ID NO: 78015 - DNA, 68 bp, Mus musculus
tatatgtgcatgtgcgtatgtgcatattacatgcatatgttttatacatatatgtatatgtatatgta

SEQ ID NO: 78016 - DNA, 118 bp, Mus musculus
tgctgttcagtagagaggggtcctggggagagagaggagctgagatgggtccagccaggccttccactgtctccctcacaccctgcatccctccacagtctgctcacctcaatccgca

SEQ ID NO: 78017 - DNA, 94 bp, Mus musculus
cattgtctctggctgttcttattggatggacattgtctctggctgttcttattgaatagacattgtctctggctgttcggactttggggcgatg

SEQ ID NO: 78018 - DNA, 74 bp, Mus musculus
cgggcgctcttaagtgcagagccctttccagcttgctgtctgtctgcctgcctgcctgcctgcctgcctgcctg

SEQ ID NO: 78019 - DNA, 74 bp, Mus musculus
cagggcagcagggctggaagttgggagggcaccttgctacggtacctgtggcactgtcactctgtagctcccag

SEQ ID NO: 78020 - DNA, 85 bp, Mus musculus; identical to SEQ ID NO: 57439

SEQ ID NO: 78021 - DNA, 85 bp, Mus musculus; identical to SEQ ID NO: 57439

SEQ ID NO: 78022 - DNA, 117 bp, Mus musculus
gggcttaaaatgattgactatgagctggagaaatggctcagtggttaagagcactgactgctcttccaaaagaccctggttcaattctcagtacttacatagtggctcacaagcact

SEQ ID NO: 78023 - DNA, 98 bp, Mus musculus
attgatcctggagtgagccaagatcaaggtttttatttgtaagtccattaacataaataggatgaggtagtaccttgtgctcattaaagggaatcaat

SEQ ID NO: 78024 - DNA, 113 bp, Mus musculus
aggacaataaaggcgaattggaaatgtgtgaatctggcagtctgagtctctctattagaagagaatgatgctcgtggcagcatttcacctggccgaccgcccttcatttacct

SEQ ID NO: 78025 - DNA, 172 bp, Mus musculus
atagattttatgtaagacagttgggctgatatacgagcgtgtgttaagtaaagacttatttatttattttatctgtgtggatgtttagtctgcctgtctgcctgtctgtctgtctgtacagaagaggttgtgggatgcccaggaaatggagttacagacagttgttagtggc

SEQ ID NO: 78026 - DNA, 75 bp, Mus musculus
cacacacacaccagagagtctgctctgtgttggcgaactcctcctgtgcatggggccttccttggagtgtggttg

SEQ ID NO: 78027 - DNA, 95 bp, Mus musculus
cagtttcaccatcgctccagactctctttatctcaagtacatcactttccatcgaaggttgctgggactctgggagaactgggttcaggtttgga

SEQ ID NO: 78028 - DNA, 118 bp, Mus musculus
gtgtatgatacatgtgtgtacaatatatatatatgtgtgtgtgtaaaatatatacatgtgtatatatatatattacatatacatacatatatatatatacacacatgtatacacacac

SEQ ID NO: 78029 - DNA, 90 bp, Mus musculus
tcaaatctcacagagatacatctgaattctccttcaagatggaatggcaaagaattgaaatcaaatgtagtttcttttacagagatttgg

SEQ ID NO: 78030 - DNA, 87 bp, Mus musculus
tatgaaggtatgtatgtatgtatgtatgtatccatatattctcatggggtgtgtgctcatgtatgtatattgctatacatgctcata

SEQ ID NO: 78031 - DNA, 102 bp, Mus musculus
gttcttccccttgatcatccgtcctcacttaagcttcagctatttcagttgtgattttgatgagcaaaaatgaatgaccaagttgcactaatgggagaggac

SEQ ID NO: 78032 - DNA, 79 bp, Mus musculus
ttggaggaagtgtgtcatgttgggtaggctttgaggtttcagatgcttaagccaggcccagtgtcactctctgtttcag

SEQ ID NO: 78033 - DNA, 116 bp, Mus musculus
gagtatagtcttcactgttgacacatgggccttgttccatttgttctgctgtgtgtagagagtgtgcagtttctcccacagaatgtgctcagcatgtgttcaccctaacccaactc

SEQ ID NO: 78034 - DNA, 134 bp, Mus musculus
agatcctcttagaccccagtttccttgtaattacacagggagggactgaagatggtctccgtgcgtctctgtctctcatcctctgcattttaagcaatgctgcccaggtttagagacgagaagacaggtacctc

SEQ ID NO: 78035 - DNA, 75 bp, Mus musculus
gcacagggtggacatgtcatgtcatgatctgctcatagaatgcataggtgtgagtgtgcatgttcatgtgcgtgc

SEQ ID NO: 78036 - DNA, 79 bp, Mus musculus
ggagatgctcagtgttgggggccgagttaggatagggactcctcagcaaccgagggtctctctcttgctctcagtgtcc

SEQ ID NO: 78037 - DNA, 101 bp, Mus musculus
taggtgtgtatgtgtatgtatatgtgtgtctgtatgattatatgtgtgtatatatatatgtgtgtgtatgtatgtatgtgtgtatgagtatatatggatac

SEQ ID NO: 78038 - DNA, 86 bp, Mus musculus
ctcagacacagacacatagagagaaagagagacagagagagagagagagagacttattccctatttcttcctttctatggattgag

SEQ ID NO: 78039 - DNA, 74 bp, Mus musculus
tctgtctgtctgtctgtctgtcgtgagatttatctttaggagttgactcaaatggtagcaggctagcagatggg

SEQ ID NO: 78040 - DNA, 120 bp, Mus musculus
gtaaggggatggtgagacgtggtcagattcagggtacagtgagagtgagaagagtcagaggtgagtgccctttcattccctcccctccctgtccctccccccttctcctctcccttctac

SEQ ID NO: 78041 - DNA, 87 bp, Mus musculus
ctccacattctctgttgaccatcagacctttggttcatggcctcctcaacttgtaggaactgagatgtcacagagctcatgcaggag

SEQ ID NO: 78042 - DNA, 93 bp, Mus musculus
gtgaacatgtgccatgttcttcagatgctcttatatatgtatgtatgtaaatatatatgtgtatatgcatatttgtagactggcagtgtttgc

SEQ ID NO: 78043 - DNA, 78 bp, Mus musculus
gcatgcatgtgtgtatatgtgtgtatgtgtgtgtatgtgtgtgtatgcatgtatgtatatatgtatatgtgtgtatgt

SEQ ID NO: 78044 - DNA, 79 bp, Mus musculus
tttacagattaacatgcatggatacaacagtaacatctgagtgcagatgtatgtatgtatgtatgtatgtgcatgtaaa

SEQ ID NO: 78045 - DNA, 65 bp, Mus musculus
tcttgtacctaccgggagtctgactctaagggatctctagagacagatgcaggaaggttgataga

SEQ ID NO: 78046 - DNA, 194 bp, Mus musculus
tatatatatatatttgtgaactttatatacatatggactatatatatatatatgactttatagagagagatggagtttatatatatatatgtgtatatatatatatgtatatgtgtgtatatatatgtatatatatatgggctacatatatatggactttgtgtgtgtctgtgtgtgtgtgtctgtgtgtgtgt

SEQ ID NO: 78047 - DNA, 90 bp, Mus musculus
gtaggccagagttcagcaccagatgtctgtctcagtagcacacctccttaacttttgagacaggctctctcactgaacttagagcttgtc

SEQ ID NO: 78048 - DNA, 93 bp, Mus musculus
tccatggtgatctgataggatgcatgggacaatttcaatatttttgtatctattgaggcttgttttgtgactaattatatggtcaaatttggg

SEQ ID NO: 78049 - DNA, 67 bp, Mus musculus
aagtctagggctggagagatggctcagcagttcagagcactgactggtcttccagaggtcctgagtt

SEQ ID NO: 78050 - DNA, 105 bp, Mus musculus
tgaagtgagttattgagaagccagaaaaacaaatattccaggaatgtatatatttatgtactaggatgtgttctttgggatattcctaatgaggcacgattgtca

SEQ ID NO: 78051 - DNA, 118 bp, Mus musculus
ctgtcacaaatgaggtcttcatgtgggtcccccaacaactggagcaaggactgtctctgactctgttgtctgcctgcgggtcccacttcactaactaggatgccttgtctggtctcag

SEQ ID NO: 78052 - DNA, 96 bp, Mus musculus
gattatatatgtacatatgtatgtatgtatctatatatgtgtgtgtgtgcgtgtatatgtataatatgtatactttatatgtatatgtgtgtgtca

SEQ ID NO: 78053 - DNA, 103 bp, Mus musculus
gagttgccatggtcaggggctggagagatggctcagtggttaagagcactggctgctcttccagaggacctgggttcaatttccagcacccacatgtcagctc

SEQ ID NO: 78054 - DNA, 92 bp, Mus musculus
ctggtcccagaccatttcctgccctgtggctttggagcctgtagtgagacaatacattagacagagcacagtgtggtggtcttgggacttag

SEQ ID NO: 78055 - DNA, 91 bp, Mus musculus
tgcttgctgttggactgtagagatggctcagcagttaagagcactgactgctcttccagatggtcctgagttcaacatccagcaaccagta

SEQ ID NO: 78056 - DNA, 85 bp, Mus musculus; identical to SEQ ID NO: 57439

SEQ ID NO: 78057 - DNA, 105 bp, Mus musculus
gatatatatatcagaatatatatatatatataatgtgtgtgtatctatgtatatatctatgaatatatctatgtatatatctatgaatatatatatatatacaca

SEQ ID NO: 78058 - DNA, 96 bp, Mus musculus
gatcagccttagtccatggttatctgacaggatgcatgggacaatttcaatatttttgtatctgttgaggcctgttttgtgaccaattatatggtc

SEQ ID NO: 78059 - DNA, 107 bp, Mus musculus
ccaagatatcattgacaagagtgttgttctgtttccatttgaatattggctttcttttatttattttgttattgaagatcagccttagtccatggtgatctgatagg

SEQ ID NO: 78060 - DNA, 112 bp, Mus musculus
gatccaggttttctgctgaagatgtttttcccacggccgagtcagtcccactcagtgtgttgagaatggtgaatcaggaaaggtgaaggccaatcccggcggatactggaac

SEQ ID NO: 78061 - DNA, 72 bp, Mus musculus
gggccttgatcagagaaaaatttgtcttggcctcattatttctctcgccatctagtctctctctgtcagccc

SEQ ID NO: 78062 - DNA, 79 bp, Mus musculus
tcatatctttttttgcactctcatttatatgtgtttgtgtaggcatacatacaagaaacgagagagagagagagagaga

SEQ ID NO: 78063 - DNA, 85 bp, Mus musculus; identical to SEQ ID NO: 57439

SEQ ID NO: 78064 - DNA, 92 bp, Mus musculus
atgtattatgcatatatatacatgtaaatatatatgtaaacatccctgtgtgtgtgtgtgtgtgtttgtgtgtgtttgtgtgtgtgttgtgt

SEQ ID NO: 78065 - DNA, 82 bp, Mus musculus
gtgtgctgtgtgtatatgcatatataagtgtacaatgtgtatttatgtgtatttctatatgtgtatgtgcattgttgtgtac

SEQ ID NO: 78066 - DNA, 93 bp, Mus musculus
tccatggtggtgtgataggatgcatgggacaatttcaatatttttgtatctgttgaggcctgttttatgaccaattatatggtcaattttgga

SEQ ID NO: 78067 - DNA, 85 bp, Mus musculus
gaccatggtggtctgataggatacatgggacaatttcaatatttttgtatctgttgaggcctgttttgtgaccaattatatggtc

SEQ ID NO: 78068 - DNA, 69 bp, Mus musculus
ggctgacagaagagacattggtggtaaaggagagaatttcctccttgggccaagtgccttctaatcatc

SEQ ID NO: 78069 - DNA, 78 bp, Mus musculus
tcctgtcttcattagacatgagcattctgactctctgacacatgtcaagttcatgttcatgctttcttggagatgaga

SEQ ID NO: 78070 - DNA, 85 bp, Mus musculus; identical to SEQ ID NO: 57439

SEQ ID NO: 78071 - DNA, 72 bp, Mus musculus
gtgcatgtatgtgtgcataagtgtgcatgtatatatgcatgtatatgtgtatgtgcatctgtatgtgcatgt

SEQ ID NO: 78072 - DNA, 75 bp, Mus musculus
cagtttcagaaactgggtagtaagaggttttaaaagtttggagtacctctctctgtctctatgtctctgtctctg

SEQ ID NO: 78073 - DNA, 97 bp, Mus musculus
tgttgctgctaagtttactgttatgtatcctaggagagaactgggtaggtttgcccaccagaggctctctcactcaaactgaacttcacatctaaca

SEQ ID NO: 78074 - DNA, 96 bp, Mus musculus
gatcagccttagtccgtggtggtctgataggatacatgggataatttcaatatttttgtatctgttgaggcctgttttgtgaccaattttatgatc

SEQ ID NO: 78075 - DNA, 96 bp, Mus musculus
gtatccccaagcttcatctattttttggctgtgagtgtctatatatatatatatatgtctgaatcaggtgctgggtggagcctctcagaggacaac

SEQ ID NO: 78076 - DNA, 103 bp, Mus musculus
agacactcacagccaaaaaatagatgaagcttggggatactgttttttttaaatattctttaaaaaaatggagcatgtgtccttcttaatggttggaacatct

SEQ ID NO: 78077 - DNA, 113 bp, Mus musculus
ggaagtccggcagaatcacagaaaaatggagcccttgtttatgacaaactggcaaacagaacagtcagtggacagttagctttgttagtagaaagaaactagctgaaccgacc

SEQ ID NO: 78078 - DNA, 71 bp, Mus musculus
gttgtgattgggccataaagatatggattttaaagaaataaatgtcatgatctgtaatggctaatcatcac

SEQ ID NO: 78079 - DNA, 116 bp, Mus musculus
cttgctggaattttgttctaaccactcagtatgtgaatgtctatatttctctctatatatctatatgtatgcatgtatgtatgaagttattgaactctgccttttgtttcagtcag

SEQ ID NO: 78080 - DNA, 77 bp, Mus musculus
ccacaaaggctgtgggatttgaagcacggggttggtgtggtaacgaccggctagtgagaactgagtgagctgggtgg

SEQ ID NO: 78081 - DNA, 111 bp, Mus musculus
ataggcacagccatttccccttccctaccccagtatttttattcattatcaatggtaaactttgttgatagtaagtaataatgatagctacattagaacttggttgtctat

SEQ ID NO: 78082 - DNA, 108 bp, Mus musculus
aatgaccctttggcatgagacctcaaccatacacaaagtatctttttctttttcttattttatttgtgtgtgtgtgtatcaggtcaagctcagagccttatgtacatt

SEQ ID NO: 78083 - DNA, 83 bp, Mus musculus
ggcagttattgccacagaagggcaaaccactatctcaaaaagagatgtgtgcagtttggtcttcatgtggacccttaacagcc

SEQ ID NO: 78084 - DNA, 123 bp, Mus musculus
cacacccccccctctctctatatatatatatatatatgtgtgtgtgtgtgtgtgtgtgtgtgtgtgtgtgtgtgtgtgtgtgcatgtgcatgtccatgtgtctctgtgtgtgcacacatatac

SEQ ID NO: 78085 - DNA, 125 bp, Mus musculus
atatacatatacatatacatgtatatgtatatatatgtgtgtctgtgtataaggtatgtatatatttataaataatattatgaataaaatatacatatacctgatctgtctatatctacatacat

SEQ ID NO: 78086 - DNA, 112 bp, Mus musculus
agacaagcacattagtattctgtaaggaatcatggaggaactcatatggaaattgtttctttataaagtatgtttccagttcctatattttaatgcttaaagagttttgttt

SEQ ID NO: 78087 - DNA, 106 bp, Mus musculus
gccttagtgcatggtgatctgataagatgcatgggacaatttcaatatttttgtatctgttgaggcctgttttgtgatcaattgtgtagtcaattttggagaaggt

SEQ ID NO: 78088 - DNA, 114 bp, Mus musculus
acattcttccactcagttatccagtttttgtttgagtcagaagagagtgagtaccattttgatagtatatattgacaggaacaagatgacatgagttgtataattggtcaatgt

SEQ ID NO: 78089 - DNA, 85 bp, Mus musculus; identical to SEQ ID NO: 63858

SEQ ID NO: 78090 - DNA, 116 bp, Mus musculus
acagagaaaagatatcccccccctttcaggtcagaatccatcactgagagaagtcagagcagagactaagggcagaaacttggagacatggatgacagaggaatgatgcttgttgt

SEQ ID NO: 78091 - DNA, 72 bp, Mus musculus
gtatatgtaatatatatgtgcttatgtatatatacatattatatgtatatatgtacatatatacacatatat

SEQ ID NO: 78092 - DNA, 70 bp, Mus musculus
gggtgacacaggtagttgtttgggtggcttaagtcagtagagatttgtctgtctgtctgcctgtctcctc

SEQ ID NO: 78093 - DNA, 85 bp, Mus musculus; identical to SEQ ID NO: 57439

SEQ ID NO: 78094 - DNA, 77 bp, Mus musculus
ttgcagatgccaacaagattttgctgacaggagcctgacatagctgtctcctgtcagactctgccagtgtctgtcaa

SEQ ID NO: 78095 - DNA, 106 bp, Mus musculus
tgcaaatgtcctgcctttgagtcgagctgtttggttatatttttctatagtatctttaaaggtcagtgtttgctttgtagcagactctacagccttggaacatgca

SEQ ID NO: 78096 - DNA, 87 bp, Mus musculus
tgggtgtgttgtgtactttgagaactgttttagatgaatttatctcatctttataagatgatctcggggtaggttctattacactta

SEQ ID NO: 78097 - DNA, 87 bp, Mus musculus
tgttagaagacttgaattggtgctcaactttgttatgattactaagtttatttataactttgagtcaatcgagtactttttcttaca

SEQ ID NO: 78098 - DNA, 91 bp, Mus musculus
tgcatccttcatgagtatctgtatgtatatgtatgtatgtatgtacacatatatacacacaaatatgtacatatatatatacacacatgta

SEQ ID NO: 78099 - DNA, 113 bp, Mus musculus
atatgttacttgacctttttcccttactgcttttaatattcagtctttgtttagtgcatttgttgttctgattattatgtgttgggaggaatttcttctctggtccaatatat

SEQ ID NO: 78100 - DNA, 111 bp, Mus musculus
tgagacgtgtaaaagaaatatgtatcggctttcggaatgctactgtttgtttttatctttctaaaaagaacctgcagtgtcagcattttgtgaagtagctttgaagtctca

SEQ ID NO: 78101 - DNA, 89 bp, Mus musculus
taggaaaagccactgtgactttcttctctgtctctcagtcatggatccctgagagcctggaagaagccaggtcatgagcctatagcctg

SEQ ID NO: 78102 - DNA, 97 bp, Mus musculus
atatgcacgtgatgtatatgacgcatatatatatgtgtgtgtatgtgtatatatgtatatgatgtatatgtgtgtgtacatatacatatgtgtatat

SEQ ID NO: 78103 - DNA, 93 bp, Mus musculus
tgagtaatctgttttcatgcacacgagaagagggaatcagatttcatcacagatgattgtgagccaccatgtgcttgctgggaactgaactca

SEQ ID NO: 78104 - DNA, 85 bp, Mus musculus; identical to SEQ ID NO: 57470

SEQ ID NO: 78105 - DNA, 117 bp, Mus musculus
agaatccacctcccttcctgctgggctgtgtccttgggcagtgtgtacagactgaggtgagtctgccacgtggagggcctgctgcatatgccaggctgagcttttcttggtggcaac

SEQ ID NO: 78106 - DNA, 90 bp, Mus musculus
gggatattaccagaggagattatggaatggaaagaagaattatttgtgttctgctaccagtgtgtaggaagttctgtctgtgagtacccc

SEQ ID NO: 78107 - DNA, 100 bp, Mus musculus
gagggagggagaagggggagggtaagagtcagctggtgaaggaaatgcgcagtgccgggtcctctgtcactcagtctcttccggttatgtacttcatctc

SEQ ID NO: 78108 - DNA, 77 bp, Mus musculus
gcagacagttttcaggagttgggtctcttctttcaccttggggtttagggctcagactcagactgtgagacttgtgc

SEQ ID NO: 78109 - DNA, 107 bp, Mus musculus
gcccttagtgcatggtgatctgataggatgcatgggacaatttcaatatttttgtatctgttgaggcctgttttgtgacctattatgtggtccattttggagaaggt

SEQ ID NO: 78110 - DNA, 107 bp, Mus musculus; identical to SEQ ID NO: 78109

SEQ ID NO: 78111 - DNA, 98 bp, Mus musculus
gggggctaagttgagacagggactcctcagcaactgagggcctctctcttgctctcagtgtccttgctggggtgaatggtctagggtttcttactcct

SEQ ID NO: 78112 - DNA, 88 bp, Mus musculus
tccaccttagtgcctgtctgccatcatgtactgcctcagaaacttccctagtcagagaacacagtgaagacagccatgccaggcagga

SEQ ID NO: 78113 - DNA, 82 bp, Mus musculus
agctccaagccatctttgtgtctgtgtgtgtgtatgtgcgcgctcacacatacacagacacacacacatctccaacagagtt

SEQ ID NO: 78114 - DNA, 85 bp, Mus musculus
catattctaggcaggtttcttctgaccatcgagtatgcaataaaaacccctcccactcactctcagagaaacctcctctgatctg

SEQ ID NO: 78115 - DNA, 63 bp, Mus musculus
catatgatatgatatgtgtgtgcatatatatatttatatgatacatatatgtaatataatatg

SEQ ID NO: 78116 - DNA, 84 bp, Mus musculus
ccctaagtaactagagctggtgggatcacagagcttgttttttacctgtctatctgtctgtctgcctgcctgcctgcactgggg

SEQ ID NO: 78117 - DNA, 99 bp, Mus musculus
atggatatgtgtatgtgtgtatgtatatatctatatatgtacacatgtatatgtatatgtgtgtacatgtataaatatatgtctatgtgtatgtacata

SEQ ID NO: 78118 - DNA, 74 bp, Mus musculus
gcatgtgtatatgtatgtgtgcctgtgtgcctgtgttagtgagcctgcatatgtgtgtgtgtgtgtgcacgtgc

SEQ ID NO: 78119 - DNA, 96 bp, Mus musculus
gatcctctttttcttcagaggacaacatatcctggcactagtgcttgctcgctctgtctgtatgtctgtatattgtctgtctgtctgttgagtgtc

SEQ ID NO: 78120 - DNA, 113 bp, Mus musculus
gttataagaaagttacatttggggagctagacagatggctcagtggttaagagcactcactgctcttccaaaggtcctgagttcaattcccagcatctgcaatgtgatctgac

SEQ ID NO: 78121 - DNA, 90 bp, Mus musculus
accattgagtgcgtgtgtgtttgtatatatatacatatatgcatatgtgcatatatgcatatatacatatatacgtgtatatatatgtgt

SEQ ID NO: 78122 - DNA, 85 bp, Mus musculus; identical to SEQ ID NO: 57439

SEQ ID NO: 78123 - DNA, 77 bp, Mus musculus
tgtcctaactgtgcaaatgtatatgtatatgtatgtattacctatacatatacatatgtttgtattacctatagata

SEQ ID NO: 78124 - DNA, 99 bp, Mus musculus
tagaggcatgttgccaataatagaagaggcagaacaatgagcaaacctatggtctgtccacagaaaagagtgttctcagatgcttggcggagtgccctg

SEQ ID NO: 78125 - DNA, 85 bp, Mus musculus; identical to SEQ ID NO: 57439

SEQ ID NO: 78126 - DNA, 80 bp, Mus musculus
gctatctgatgaagagacaatgaatttgtaattgcctgagtatagggagtgcatatttatttttgttctagtccagaagc

SEQ ID NO: 78127 - DNA, 85 bp, Mus musculus; identical to SEQ ID NO: 57470

SEQ ID NO: 78128 - DNA, 94 bp, Mus musculus
tgggttacctcactcaggatgataatttctagttccatccagttgcctaagaattacatgaatttatcattttcaatagctgagtagtactcca

SEQ ID NO: 78129 - DNA, 118 bp, Mus musculus
gctgtcctggaattcactctgtagaccaggctgacctcaaactcacagagatttgcctgcctctgtctctgcctctacctcagcctctgcctcccaagtgctgatattaaaggtgtgc

SEQ ID NO: 78130 - DNA, 59 bp, Mus musculus
gaggagagtgctgtacttctgcagaaactcagttctgagcctctgtgagtcactctatc

SEQ ID NO: 78131 - DNA, 116 bp, Mus musculus
ggggtgggggggatagatttgatagagacatctccttgaggactgagtgtttcaatgtctctcactctctccatattatctggctgggggtctctgcatttgttcccatctgctgc

SEQ ID NO: 78132 - DNA, 82 bp, Mus musculus
tttttgtttgtttgttttcctgacaggagcctgatatagctgtctcctgagaggctctgtcagtgcctgacaaatacagaag

SEQ ID NO: 78133 - DNA, 79 bp, Mus musculus
ttttggcccacctctacaattaaaggggaacatttgtgttcatcacactggatgttctcattgtgttctattgtcaaag

SEQ ID NO: 78134 - DNA, 87 bp, Mus musculus
tatttgtggtttaagatatgttacctctgtttttatttttgttaagcaaaatcagaaaatatttgtgactattaaaaaccatttata

SEQ ID NO: 78135 - DNA, 85 bp, Mus musculus; identical to SEQ ID NO: 57439

SEQ ID NO: 78136 - DNA, 88 bp, Mus musculus
atatatatgagcatatatagagaacatatatgtgtgtacatatatatgtatatacatatatgttcatatagtatatgtaaatgtatgt

SEQ ID NO: 78137 - DNA, 85 bp, Mus musculus
tggaggtgtggcattgttggagtaggcatggcatcactggcttacccatgctatacctaattctctctcactgtttctctctcca

SEQ ID NO: 78138 - DNA, 140 bp, Mus musculus
gtgtctgtgtgtgtctgtgcgtgtgtgttcctacagaaaagaatatcaatatggtaatagttagtaaagttatatgtatgtatatatacataatacatattgtacatatgtatacatatatattatactctattctctgt

SEQ ID NO: 78139 - DNA, 85 bp, Mus musculus; identical to SEQ ID NO: 57439

SEQ ID NO: 78140 - DNA, 85 bp, Mus musculus; identical to SEQ ID NO: 57439

SEQ ID NO: 78141 - DNA, 112 bp, Mus musculus
ttaggaaatattctgagtctaaaagttgtagcatgtttctgatgtgtatgtatgtaagtatgtatgtatgtatgtatgtatgtacgatgaaggcatgggaaaaagaacctga

SEQ ID NO: 78142 - DNA, 104 bp, Mus musculus
agagaagggaatggttgtattaaaagtatggtgtcactgagggtcacatccgtggcacagaggacagtgtgggcagaaataatacacgttgatttccattctct

SEQ ID NO: 78143 - DNA, 69 bp, Mus musculus
tctgaaacctatataaagagctgttcacatgtagggacatacagagtgacagttcactgtgtacacaga

SEQ ID NO: 78144 - DNA, 97 bp, Mus musculus
tgtgctgataacctgagagacatgtagaatgtaaaggtgtatgatcaatggtgtgcctttgaaaaatacttctacattaacacacggtttcatcaca

SEQ ID NO: 78145 - DNA, 84 bp, Mus musculus
gtgtgtgtatgtgtgtatatgtgtatgtatatgtgtgtgtatatgcgtgtgtatatatgtgtgtatatatgtgtgtatatgtgt

SEQ ID NO: 78146 - DNA, 85 bp, Mus musculus; identical to SEQ ID NO: 57439

SEQ ID NO: 78147 - DNA, 85 bp, Mus musculus
taagtgtgtatgtgtgtgcatgtatgtatgtatgtatgtatgtatatatgtatgtatgtgtatgtgtccccacccagcatatttg

SEQ ID NO: 78148 - DNA, 112 bp, Mus musculus
cagtaatataggagttgacacatgcaagtgcttagtgtgtaggtcaatgagtaaataaatgaatttattttatctatctatctatctatctgtctgtctgtctgtctgtctg

SEQ ID NO: 78149 - DNA, 76 bp, Mus musculus
taggcttgcctctctttctttcctcacttcagctgcttcaaaggctaaagacagtgagtggtgagagtgaagtctg

SEQ ID NO: 78150 - DNA, 85 bp, Mus musculus; identical to SEQ ID NO: 60314

SEQ ID NO: 78151 - DNA, 87 bp, Mus musculus
gttaatccactggcaatagtttgtcaattcagagctctcgggagttttgagttcacttaatttcattctgtttttaatggtatcgac

SEQ ID NO: 78152 - DNA, 85 bp, Mus musculus; identical to SEQ ID NO: 57439

SEQ ID NO: 78153 - DNA, 80 bp, Mus musculus
ttgtatggtaatgctaagtgtgaaccctgctagacctggttgctccagagacaagtgagtctgcacatagacccatgtga

SEQ ID NO: 78154 - DNA, 65 bp, Mus musculus
ctctgtgtgtctctgactgtcctggaactcactatgttgaccaggctcccctagaactcacagag

SEQ ID NO: 78155 - DNA, 82 bp, Mus musculus
gttggcttcagtcttctgctacggtgctctaagctatttgaactagggccccttgctctctcagtcagactggcaggttaac

SEQ ID NO: 78156 - DNA, 71 bp, Mus musculus
ctaaattatgaatgtagtatgtatgtatgtatgtatgtatgtatgtacatgtgtgcgtatgatgtcattag

SEQ ID NO: 78157 - DNA, 103 bp, Mus musculus
atgtatgtatgtatgtatgtatatgtatatatcatatatcacagtcatatatatatatatatatatatatatatatatatatatatatatatatatatatccc

SEQ ID NO: 78158 - DNA, 65 bp, Mus musculus
cattatataaaacatatgtatatatatttatgtatgtacatatgtatgtatatatgtatatattg

SEQ ID NO: 78159 - DNA, 90 bp, Mus musculus
ggagtacaggtttctcttgcagacatcacaggtttgattatcaggacctctcactgcttctctgtgtaactgttttaactgcttccctcc

SEQ ID NO: 78160 - DNA, 85 bp, Mus musculus; identical to SEQ ID NO: 57439

SEQ ID NO: 78161 - DNA, 58 bp, Mus musculus
tgccagaagagagggaggactctgaccccagtggatcagagttccagacttctggaca

SEQ ID NO: 78162 - DNA, 114 bp, Mus musculus
ttatataggaacacaccaggagcttcaggaaagtgtggaaaaaatatatttatatattatataaatatatattccatatcttcctgaagctcctctgtgtgtgtgtgtgtataa

SEQ ID NO: 78163 - DNA, 85 bp, Mus musculus; identical to SEQ ID NO: 57470

SEQ ID NO: 78164 - DNA, 95 bp, Mus musculus
tgaatgttttgcctgtatgtatatgtatgtatgtatgtatgtacataaatacgtatgtacatacatacgtacagggtgcatgcctggtacactca

SEQ ID NO: 78165 - DNA, 85 bp, Mus musculus; identical to SEQ ID NO: 57470

SEQ ID NO: 78166 - DNA, 56 bp, Mus musculus
gaattatatatatatatatgcatatacatatgcatatatatatatatgtagttgtc

SEQ ID NO: 78167 - DNA, 112 bp, Mus musculus
attagaaaggctgagaaccagtgctctattagtatatatatatatatatatatatatatatatatatatatatatatcactatatatgaacagtcttctcactgtctctgat

SEQ ID NO: 78168 - DNA, 110 bp, Mus musculus
ttatttgcccaaactcaatatataatatagaagttagctacaatatttgttatacagatatgctgagagaactgttactatatcattttacatgaggaagaggagaatgg

SEQ ID NO: 78169 - DNA, 109 bp, Mus musculus
agataactatatatatatatatatatatatatatatatatatatatacacatatatgtgtatatatgtatatatgtgtgtatatatatgcatatatctatatagttatt

SEQ ID NO: 78170 - DNA, 85 bp, Mus musculus; identical to SEQ ID NO: 60314

SEQ ID NO: 78171 - DNA, 90 bp, Mus musculus
ggagaacctgtggaaaacaacggtcctgaccataaacttttgccttaagtcaaaatatcagaactcaatttgtttttcaatagcttctct

SEQ ID NO: 78172 - DNA, 118 bp, Mus musculus
ggaaaagcattgagaaaactatccctttatttaatatgtgtgtgtatgtatctatgtatgtgtgtatatatgtgtgtatatatattcagtaaattaggtattgaaaaatgtacaaccc

SEQ ID NO: 78173 - DNA, 79 bp, Mus musculus
ctaggaacccaggaggaagggatgaatctaaaaatagagttactttagttttaggattgcaaatcactggagttcccag

SEQ ID NO: 78174 - DNA, 107 bp, Mus musculus
ggctttgttgagctatctcttgggtggtggaagattattgcttgattttatctataaaattatgcatttatatttagaactgagatagctttattcattaatttgtc

SEQ ID NO: 78175 - DNA, 85 bp, Mus musculus; identical to SEQ ID NO: 59744

SEQ ID NO: 78176 - DNA, 67 bp, Mus musculus
ggccttactgggggaggtatatctctaagagtggtctttgaggtttcagtctctctgtatcagtgcc

SEQ ID NO: 78177 - DNA, 102 bp, Mus musculus
ctgaaggtctatcagaatgactctttgaagcttcagagtggctttcagaggctctctgtgtcaggctattatggtgtttttcatgtctctttgccttttcag

SEQ ID NO: 78178 - DNA, 94 bp, Mus musculus
cagagggaactcagagcccagtggggagaactgcagaagacatctgtatgtctgtctgcctgcctgcctttctgtctttctgtctgtctgtctg

SEQ ID NO: 78179 - DNA, 72 bp, Mus musculus
gcacatacacacatatatgcatatatatatatatatatatatatatatagtttgcgaatgttgtatatgtgt

SEQ ID NO: 78180 - DNA, 69 bp, Mus musculus
catggttgggcagcccattcacttctggaaccaattttcgggtggctcctgtgatctgtctctgtcatg

SEQ ID NO: 78181 - DNA, 105 bp, Mus musculus
gtcttagtgttctattgctctgaagaaatgtgtgtgcatgttcagagagtcagacacaggcatacacacacagacacacacatacaaacatagacacacaaaggc

SEQ ID NO: 78182 - DNA, 68 bp, Mus musculus
acgctgtgcgcacatcctgctgtgagggcattttctcggtctctctgacagacatgtgtcactggtgt

SEQ ID NO: 78183 - DNA, 77 bp, Mus musculus
tgtgtttcttacattgtgagctcgaggaacagacacacacactgtctgtgataccatctagaaatggaggaaacgca

SEQ ID NO: 78184 - DNA, 82 bp, Mus musculus
tgagtggtacagactcccagagttcactggtgagccagacactaatcagtgagctctgtgttcactggaagactgtgactca

SEQ ID NO: 78185 - DNA, 89 bp, Mus musculus
ggagaagatgcaaagatgggcctagttctactgcaactgcaacaggatatgccaaggtgggttgatatcggtgggaggcccccttctct

SEQ ID NO: 78186 - DNA, 100 bp, Mus musculus
ccttagagttgtatcctctcatatctgtataaattttcagaaatccctgtctaggtgtgaagtcagtgtgcagaaatgaaaggtgtgatttagtgtgagg

SEQ ID NO: 78187 - DNA, 92 bp, Mus musculus
agtctcagcttgcagtcccagcaggtgaacctgggcctgcaggcttcattcctcacagtccagatcaatagctggaattacaggctgacatt

SEQ ID NO: 78188 - DNA, 75 bp, Mus musculus
ccttcatctctgagttctctctgtgtgagtggcaggcacctgtcaccactgagagcctcagtgtaggagtgaggg

SEQ ID NO: 78189 - DNA, 117 bp, Mus musculus
ccaggtttgcaggttctcagaaatccacctaaatcaatcaatcaatcaatcaatcaatcaatcaatcaatcaatcaaaccagactatgtggagtctctggaggaactcctggagatc

SEQ ID NO: 78190 - DNA, 90 bp, Mus musculus
gtgcatgtgtgtgtctctctgtgtgtgcatgtttgtgtgtgtatgtatatgtgtgttgatgtgtgtgtgcatgtgtgtgtgtgcatgtgt

SEQ ID NO: 78191 - DNA, 92 bp, Mus musculus
gccttttatgtgatgtgtgtgttcatttatatatatatatgcatgtttatgtaacacacatatataacataggtatatcatatatacacata

SEQ ID NO: 78192 - DNA, 96 bp, Mus musculus
ctataagattgtagctgcatttggacacagggtgttagccagcctacagttgaccacgctcacactgtgtctgtatatctgcttgcccgtttatgg

SEQ ID NO: 78193 - DNA, 77 bp, Mus musculus
gggtatgtatgtatgtatgtatttatttgtgtgtgtgacatacatgtgtaatatatgtgtgtatatgaaatgtactc

SEQ ID NO: 78194 - DNA, 88 bp, Mus musculus
gaattgtaatgtaggggctggagagatggctcagtggttaagagtactgctgactgctcttcctgaggtcctgagttcaattcccagc

SEQ ID NO: 78195 - DNA, 74 bp, Mus musculus
cagtgtaattcccgcaatggcgggagagcagcttccgatggatggaatgtctctctcgctctgttttatttctg

SEQ ID NO: 78196 - DNA, 89 bp, Mus musculus
gaatatagattctttctactgaatatattaaaattctatattcatttaaaattctggatatattcagtataagggaagctgccttattc

SEQ ID NO: 78197 - DNA, 88 bp, Mus musculus
tctcagcactctggaggcagatctcagtgagctcaaggccggcctacagggctacataagagggaccttcctctagacatttttgaga

SEQ ID NO: 78198 - DNA, 82 bp, Mus musculus
gggacactctctgtttttctctggctgtaagaacacacgaatcatataagttaatctcacagcttcacaggggacttgtcct

SEQ ID NO: 78199 - DNA, 78 bp, Mus musculus
atgtattgagtgatgtatgtgtatatatgtatatgtattgagtatgtatgtgtatatatgtatatgtattgagtatgt

SEQ ID NO: 78200 - DNA, 217 bp, Mus musculus
ggcttttgcttcatatttatcgtgagtatggacagggatgtgtgtgtgtgcatgtgtgtgtgcatgtgcatgtgtgtgtgtaaatatgtaattatgacataagtgtttagctgagcccaactggaatgaatgaatatgtatgaatatatgcatgatttgtatatgaatttatgtgagtttatgcatatttacttgtttaaaagtttttccttctgct

SEQ ID NO: 78201 - DNA, 107 bp, Mus musculus
gacaggaggattttcttttctgatccaatctgtttggtgttctgtaagcttcttgtatgtttatagtcatctctttctttaggctggaaaagttttcttctatggtt

SEQ ID NO: 78202 - DNA, 117 bp, Mus musculus
atggttataaggaatcagtgagaggttggagagaaggctcaatggttaagagcactgactgctcttccagaggtcctgagtttaattcccagcaaccacatggtggctcacaaccat

SEQ ID NO: 78203 - DNA, 97 bp, Mus musculus
gcaatggaagctgcactgtgctgtctgacctcagtgtcagaaggaacgaattctccagctgacagacagacagacagacacggtgcttgcacatagc

SEQ ID NO: 78204 - DNA, 64 bp, Mus musculus
gtgtctgtctgtctgtctgtcagctggagaattcgttccttctgacactgaggtcagacagcac

SEQ ID NO: 78205 - DNA, 153 bp, Mus musculus
tatacatacacacacacacacacatatatatcatacaagcatgtgtgtatatatatatacttgtatgtgtgtatatatacttgtatgtgtgtatgtatatatgtatatatacatacatatatatacatatatatatatatacatacctgtatg

SEQ ID NO: 78206 - DNA, 121 bp, Mus musculus
tggacttttggatggttctgagctgctatgtggatgctgggagctgaacctgggtgttatctgacagaccagtgagtgctcttaactgctgagccttctttttgcttttttattaaacaaa

SEQ ID NO: 78207 - DNA, 110 bp, Mus musculus
ctagggatctggatttcttaagcctataaataagccgtagacgtttatatatatataaacagtctgacactaaactctaggctcctaagcccacatctaattacatctag

SEQ ID NO: 78208 - DNA, 77 bp, Mus musculus
gctcacccacacacttactgtcacgcccatcagacgtgaggagagtgtaagctggtgtgtgtgtgtgtgtgtgtgtg

SEQ ID NO: 78209 - DNA, 109 bp, Mus musculus
ctggcctattctcctgtctccacctcccatcttgtagcaggagtgctgtgaatacagagatgtgagtcaccacatagggcagtggttctcagcattcctgatgctgcaa

SEQ ID NO: 78210 - DNA, 101 bp, Mus musculus
agaagtgttgttcagtttccacgtgaatgttggctttctattatttattttgttattgaagatcagccttagtccatgcatgggacaatttcaatattttt

SEQ ID NO: 78211 - DNA, 118 bp, Mus musculus
agccactctttaactgtgggttcttacaggcactatctgtgtttgcacctgtcttgtgtctatctctgcgtcctaatcttgtgccttgtaaggacaagagttatattggattagggct

SEQ ID NO: 78212 - DNA, 92 bp, Mus musculus
acatatgaatgtatgcacacacacatatatacatatatgtatatatgtatgtatatgtgtatatatatgtgtgtgtgtatatatatgtgtgt

SEQ ID NO: 78213 - DNA, 116 bp, Mus musculus
gggtgtgtggatagggatctcttcaggagagttaggacaataggtatttaagcagggtgtgtgtaactctctctatgagtacatcttggcaaaccagagaaactgaagacacactc

SEQ ID NO: 78214 - DNA, 81 bp, Mus musculus
gaaagagacagagcagacagtggctaggacagcatgacagtcacgtctgtacatgctctggcagagttggcagtctccttc

SEQ ID NO: 78215 - DNA, 65 bp, Mus musculus
atgtgcgtgtaagtatgtatgtatatatacatattgtaaatatacatgtatgtccatgcgtatat

SEQ ID NO: 78216 - DNA, 62 bp, Mus musculus
tacctgcagaggcctcagatcccttggagctggagttaaggacagttgtgagcctccaggta

SEQ ID NO: 78217 - DNA, 91 bp, Mus musculus
gcacttcattttaagattagactaaaaagctagggtgaattgtaggatatggatgttctctgtctctctcagtttttctgtctgtctgtgt

SEQ ID NO: 78218 - DNA, 65 bp, Mus musculus
gtgaggatgctgtgaggattcttgagtggtcctacttcatccatctgcttgcacagttacctgac

SEQ ID NO: 78219 - DNA, 56 bp, Mus musculus
ggggctggcactgtgtctcactgggatatcctgcagaggcacagcagggcagctgc

SEQ ID NO: 78220 - DNA, 116 bp, Mus musculus
ttctggacaggtgggtaaagagtcagcgagaaatgacaaacaaatacaggacacaagagagtgtgctgtatctgaatgtaatttgtcaaattgagcatcaaactttttatacagaa

SEQ ID NO: 78221 - DNA, 118 bp, Mus musculus
tgcttcattacatggatcagtgcccataagaccaaaagcccttggtaatttttattttacataatgagggataatgagctattggaaggaaatattgctggccctggagtcagaagca

SEQ ID NO: 78222 - DNA, 86 bp, Mus musculus
gttcatggttatgtatggcggtgaggaaggaacacactctcattctctgtgtgcagattccgttctcagtgtctttgctattgagc

SEQ ID NO: 78223 - DNA, 80 bp, Mus musculus
catatatacatgtgcatacatatatgtgtatatatgtacatatatgtgtgtatatatacatatataaaatggtgtgtgtg

SEQ ID NO: 78224 - DNA, 85 bp, Mus musculus; identical to SEQ ID NO: 57439

SEQ ID NO: 78225 - DNA, 72 bp, Mus musculus
cagtcagactggatcaggagtctgacctggagtcattctttctgcctcacactctctgttccagaatggatg

SEQ ID NO: 78226 - DNA, 86 bp, Mus musculus
tctgtccgcgcgtatctctgtgtgtatgtctctcagagcgactgtatgagtgagtctgcgaacatatatctatatgtatggggggg

SEQ ID NO: 78227 - DNA, 82 bp, Mus musculus
tatgtctgtttgtctatatgtatatttaaacatatgtgtgtaggtatatgtgtatgtttgtaagtatggatgaacacttgtg

SEQ ID NO: 78228 - DNA, 83 bp, Mus musculus
ggcatctggctcattcagttctgactccactgcacatgacaaagctggcctgttgtgtctcagactgtctgacccataaagcc

SEQ ID NO: 78229 - DNA, 62 bp, Mus musculus
ctggtgcgtgcgtgcgtgcgtgcgtgcgtgttcgtgtgtgtgtctgctgcatgtgtgtctgg

SEQ ID NO: 78230 - DNA, 92 bp, Mus musculus
ggttagaggcagtggggttgacgtcagacttaagttccagtttgttctctagtctctcagtctgtctatgttgtccccatttcatatctacc

SEQ ID NO: 78231 - DNA, 80 bp, Mus musculus
gtacatatagcagatatgcaacttggtcttcactggggactcctaacaactggagctgagtttgtctttgtctctgttac

SEQ ID NO: 78232 - DNA, 111 bp, Mus musculus
tctgagcgtctgactctcctcaggaacatgtttttgacagagtttttcattttaaaaattgataaacttttccatctgacgtgactgaataaggaagaaaggttgaatagg

SEQ ID NO: 78233 - DNA, 78 bp, Mus musculus
gttgtagcctagctagtgaggtcctgggtatgctaacctgtgtgtctcagtcattcatctgtaagctctgggctctgc

SEQ ID NO: 78234 - DNA, 104 bp, Mus musculus
gaaggccacatgatggggctgaggagatggctcagtggttaagagcactgactgctcttccaaaggtcctgaggtcaaatcccagcaaccacggggtggctcac

SEQ ID NO: 78235 - DNA, 58 bp, Mus musculus
atgcattatgtgtatgtatgtatgtatgtatgtgcatatatgcatatactttctgtat

SEQ ID NO: 78236 - DNA, 77 bp, Mus musculus
tctctgaagcactctctgtccctgagctcaatgctcctgttatgggcttactcgggctcttgaatgcgtgtcagaga

SEQ ID NO: 78237 - DNA, 81 bp, Mus musculus
ggtcatgtgtctgtgtgtctgtctgcatgcaaaggccatctcctaggtgtctgctatgttctcttaaaagacattttagcc

SEQ ID NO: 78238 - DNA, 122 bp, Mus musculus
tatatatatatatatatatatatatatacatacacacacacacacacacacacacacatatatatgtgtgtgtgtgtatgtatgcatgtatatgtatatatgtgtatgtatatgtgtgtgtg

SEQ ID NO: 78239 - DNA, 67 bp, Mus musculus
gcatctatgtgcactgggggtgcaggacacacaaatgtgtgaatgtctctctgtgtgtactcttggc

SEQ ID NO: 78240 - DNA, 94 bp, Mus musculus
cggctgtctgtctgtctgtctgcttatttatttatttatttattttcatagtttatgtgaaaagtagtggtaagcaagctatggcccagagctg

SEQ ID NO: 78241 - DNA, 79 bp, Mus musculus
gcacacagattctgacacttactgtctgggtgacgtgacatcagcggggtggttactcagtgtctctgggtctctgtgc

SEQ ID NO: 78242 - DNA, 118 bp, Mus musculus
gtgctttctgccaagcctggttgtcagagttcaatccctggggcccactgaagagagtgaactgtctgagcactgtagtatatggacggacacacacaggaatgcacgcacacatgca

SEQ ID NO: 78243 - DNA, 85 bp, Mus musculus
aatgaagcatcttctcaagacacagagtcagctgctctcgctgagggacctatgctggcttctctgtctctctcaacatttcatt

SEQ ID NO: 78244 - DNA, 160 bp, Mus musculus
ggaatataatgtatgcatatgtatatgtgtgcgtgtatgcgcatatgtatatatatgtgtgtctgtatctctatatatgtatgtatgtatgcatgtatatatatatatatatatatatatatatatatatatatagtagaatgagcatatatattatata

SEQ ID NO: 78245 - DNA, 71 bp, Mus musculus
gatggttgtgagccttcatgtggttcttggaaattgaattttttttttaagaacctctgctcgcttcagtc

SEQ ID NO: 78246 - DNA, 113 bp, Mus musculus
tgttgagttataagaatgaacatgggctggagagatggctcagtggttaagagcactgactgctcttccagaagtcctgagttcaattcccagcaaccacatggtggctcaca

SEQ ID NO: 78247 - DNA, 103 bp, Mus musculus
ctgtctgtctgtatctgtctctctgtatctgtctgtctgtctgtgtctagctagcacatcgatcagatgtttaatggagtatcttttatttggtcttggacag

SEQ ID NO: 78248 - DNA, 117 bp, Mus musculus
atgtttgaaaaacccatatggggggctggagagatggctcagcggttaagagcactgactgctcttccagaggtcctgagttcaattcccagaaaccacatggtggtttacaaccat

SEQ ID NO: 78249 - DNA, 71 bp, Mus musculus
tatttataatatagattgcgttgtatgcagtgtatttactgtataacatgatgcatatatatatatatata

SEQ ID NO: 78250 - DNA, 93 bp, Mus musculus
tgggtggagtgaaaaagacaatttgatctttttaattaaagttttcctacctaaaacgaaaactgatgtaagaaagacccaaagctctattca

SEQ ID NO: 78251 - DNA, 79 bp, Mus musculus
tcaatttcaaagccccaaagacagctggtgcggaaggtcactgaacactcacagttgctttgtggctttggaatcgtga

SEQ ID NO: 78252 - DNA, 73 bp, Mus musculus
tataaacatatatgacacatatataaatccatacatatgtcatatagtatgtatgtgtgtctgtgtgtctgta

SEQ ID NO: 78253 - DNA, 82 bp, Mus musculus
caggctagttcctatgagaggtttgttgtgtgcacccactacctaggaagctgacaaaacccttctccgtaggataggtctg

SEQ ID NO: 78254 - DNA, 84 bp, Mus musculus
gtgttgtaactcccaccttcgtgaagtctgtgagcacaccggagtgatgacaaataaggagacacgaatgggaaaagatggcat

SEQ ID NO: 78255 - DNA, 82 bp, Mus musculus
ccaggagacagggcctgggattcttctcatttttgcaggatgacagaggtgagagagaacacttgggaaatgaaaagtttgg

SEQ ID NO: 78256 - DNA, 74 bp, Mus musculus
atcagtcagtcagtcagtcagtcaatcaatcagtcaatagatagatagatagatagatagatagatagatagat

SEQ ID NO: 78257 - DNA, 116 bp, Mus musculus
gtagacaaaggttctgctcagtagtaaaggctaaaaaatctatctctctttggtaaccaagagaagcttgatgatttcaaatattcacagctgcagtagagaaaatgtatatatac

SEQ ID NO: 78258 - DNA, 106 bp, Mus musculus
gtatgtgtgtgttcttatgtgagcatatatatatatatatgcatatgtatatgtctatgtatacatatatacacatgtatatatacagacatatggatatgtatat

SEQ ID NO: 78259 - DNA, 78 bp, Mus musculus
tatgtctgtatatatacatgtgtatatatgtatacatagacatatacatatgcatatatatatatatatgctcacata

SEQ ID NO: 78260 - DNA, 58 bp, Mus musculus
cagggctggagagatggctcagctgctaagagcgctgactgctcttccagaggtcctg

SEQ ID NO: 78261 - DNA, 72 bp, Mus musculus
atagacagacagatagaggtagatagagatagatctatatatctctatctatctatctatctatctatctat

SEQ ID NO: 78262 - DNA, 107 bp, Mus musculus
tacccattatagatatacaacctgtatctagatttatatatttatgtgggcttattatcctgttttagtcacctccataagggtgctctttgttatgtctaccggtg

SEQ ID NO: 78263 - DNA, 87 bp, Mus musculus
agtcagcattcttttgaaagcaatgtagtctgacagtaactcggcatttagagatgtttactgttcaagcattaaggaaggctggct

SEQ ID NO: 78264 - DNA, 96 bp, Mus musculus
tgtttctgagtgagttcaagaaaatttgataggaagtttgctgatttactgagtagcttagatgtttttttcttatgatgcttcacttcaagagcg

SEQ ID NO: 78265 - DNA, 65 bp, Mus musculus
gcccaccctgttcctttagtctccttacatctctgaggcagtcaggagacagagagaagttgggc

SEQ ID NO: 78266 - DNA, 85 bp, Mus musculus; identical to SEQ ID NO: 57470

SEQ ID NO: 78267 - DNA, 89 bp, Mus musculus
tggtatatatgtatataggtatatagatatatgtatatgtattcctatatctatagctatacatatatgtatatatatcaatatctgta

SEQ ID NO: 78268 - DNA, 85 bp, Mus musculus
ctgtatctatatctatatataatctacatctatattcatacctaccaatatagatagagatagatatgtgtagatatagatatag

SEQ ID NO: 78269 - DNA, 117 bp, Mus musculus
tctatatctacacatatctatctctatctatattggtaggtatgaatatagatgtagattatatatagatatagatacagatgtaaatgtaggtatagacataggtatagatataga

SEQ ID NO: 78270 - DNA, 78 bp, Mus musculus
tctatctatctgtctgtctgtctatctatctatgatttatctacacacacagacagagatgacagagagcgagagaga

SEQ ID NO: 78271 - DNA, 96 bp, Mus musculus
agagagagaaatatgtttgaaaaatgtcataaagaatcaatactttataattatataatatattttgaccttattttcaagtatgactctctctct

SEQ ID NO: 78272 - DNA, 60 bp, Mus musculus
tatatacatatatatgtatatgtatatgatgtatatgtatatatgcatatgtatcatgta

SEQ ID NO: 78273 - DNA, 109 bp, Mus musculus
tgccaggtgtttcaggagaggctaaggaaggaggtgacagaagacactgagcgtgtttagactcaactcactgggttataacaagagggctgctgggtactctgtacct

SEQ ID NO: 78274 - DNA, 130 bp, Mus musculus
ttggttactgtgctctttgaaatattttgttccattgttgtcaggaagtcagtgttatatttttatatcaagtgttttctcttggcactcagtggtattgattttgtggccaaagggatatgatcaatga

SEQ ID NO: 78275 - DNA, 109 bp, Mus musculus
tatatatatgaatatatcaaaatcaccgtgtgtgtgtatatatatatatatgcatatatgtgtgtgtgtgtgtgtgtgtgtgtattatttgtaagtaaaacaggcttgg

SEQ ID NO: 78276 - DNA, 62 bp, Mus musculus
tatacatacacacatatacatgcacacacacatatatatgtatgtatatatgtgtgtgtata

SEQ ID NO: 78277 - DNA, 117 bp, Mus musculus
ttcactagtttttcccttagacaatgagcttcctgaaagcatggatttattttacttattaatgaacttccagtgctgtttcgagggcctcggttattctttataaatgctgcagaa

SEQ ID NO: 78278 - DNA, 69 bp, Mus musculus
tgtctttggtgagctacagctgactcaaagtgcccttcaggaactgagaggtgagactcagcagagaca

SEQ ID NO: 78279 - DNA, 126 bp, Mus musculus
cctcaggcgttagtagaaatcctaggcttatggaatccagaagaagagtagagtgcacatagctaagtatgtggcagctgtggattcttaatcaggaggcaggaggcaggaggcaggattcatcgc

SEQ ID NO: 78280 - DNA, 105 bp, Mus musculus
tcctttgacgagtatgaagtgtcattccttatcttttttgataacttcaggttgaaagttgattttatttgatatagaataggcactccagcctgtttcttggga

SEQ ID NO: 78281 - DNA, 76 bp, Mus musculus
gcatatatgtggatgagtacgtcagtgtgtcaatctgtgtgtcagtgtagatatgtgtgtgtttccatgtgtgtgt

SEQ ID NO: 78282 - DNA, 87 bp, Mus musculus
atatatatgcatatatacatatatatgggtaggtattatatatatattaatatattaggtattatatacatgtatatacatatatat

SEQ ID NO: 78283 - DNA, 76 bp, Mus musculus
tttatactattaaggggtattgtgaaaggtgttttttccctgaattctttcacagtctctttgtcatttgtataag

SEQ ID NO: 78284 - DNA, 85 bp, Mus musculus
gtttgatgctcgatttgacaaattacattcagatccacactcccttgtgttgagtctgagtctgtctgtcaattccctccgacgc

SEQ ID NO: 78285 - DNA, 92 bp, Mus musculus
gtgcgcatgtgtgcttctgtatgtgtgtgcatatgcatgtgcacatacctgtgtatgtgtgtgtgtatgtgtgtgcgtgcacaaatgtgcat

SEQ ID NO: 78286 - DNA, 106 bp, Mus musculus
ttgtagcattttcaagttgagagaaggaatggagttgttactctcttactctgtgttgcatggaatggaagagctaatagctaatttggaatgagagtgctttcaa

SEQ ID NO: 78287 - DNA, 92 bp, Mus musculus; identical to SEQ ID NO: 57641

SEQ ID NO: 78288 - DNA, 97 bp, Mus musculus
attttagtaacagtgaatacgtctgtgtcactctgtctggtactgctcaagcccagaatggcaagtgatatttttatttcatttttcatattaaaat

SEQ ID NO: 78289 - DNA, 83 bp, Mus musculus
atatatatatgtatacatgtatgtatatgcaaatttatataagtatatatatatatgtatatacatatatgtatgtatgtata

SEQ ID NO: 78290 - DNA, 70 bp, Mus musculus
tcccagaaaatatgctgctactgtagtctgcacattcacctgtgcagactagtctctgaggtttccggga

SEQ ID NO: 78291 - DNA, 112 bp, Mus musculus
acatgtgtatatatacatatatgtgtgtatataaatatatgtatacacacatatatgtatatgtgtgtatatatatatgtatatgtgtgtgtgtgtgtgtgtgtgtgtgtgt

SEQ ID NO: 78292 - DNA, 111 bp, Mus musculus
gggtgcagtgaaaagcagaggatgggactcgttatgtctctgaatcagacagggtaacacagaagacagaagacactgagaacatctgctgaaatatgaatgatcgtaccc

SEQ ID NO: 78293 - DNA, 85 bp, Mus musculus; identical to SEQ ID NO: 57439

SEQ ID NO: 78294 - DNA, 93 bp, Mus musculus
tcattgctctgcctttatcttgtctatttgaattttttctatgcccattagcattttcagaattgaaaagaaaagaaagatgtggaagtgaga

SEQ ID NO: 78295 - DNA, 85 bp, Mus musculus; identical to SEQ ID NO: 57470

SEQ ID NO: 78296 - DNA, 116 bp, Mus musculus
tggcatgtggaacagtgtgtgctaattacttgtggggtgtgctttgtgtttctctcaatcagtcactctgaaaggagaataatatgacactgattggcttatactgacctcaacca

SEQ ID NO: 78297 - DNA, 119 bp, Mus musculus
aagtgtgtcactaggggtgggctttgaggtttttaatgcttatgccaggtacaggctctctgtctctgcctatggatgagtatgtagctctcatctactgctccagcacctgcttacat

SEQ ID NO: 78298 - DNA, 95 bp, Mus musculus
tgaataactgaacatacacacaaatgtgtatgtatgtatatacattatgtatgtatgtatgtatgtatgtatgtatgcatatgttactaaattta

SEQ ID NO: 78299 - DNA, 115 bp, Mus musculus
tccttgacctaggtatcattgagaagagtgctgttcagtttccccatgaatgttagctttctattatttattttgttattaaagatcagccttagtccatggtgatctgatagga

SEQ ID NO: 78300 - DNA, 82 bp, Mus musculus
atgtatgtatgtgtatgtttatgtatatatgatatgcatattaacatgttttatatatacatatatatgcatgtatttatat

SEQ ID NO: 78301 - DNA, 131 bp, Mus musculus
tgtatatgtgtgtgtgttcacatgttggcacatgtgtgtgtttgtatgtggaatgtatatgtatatgcatattatatgtatattatatgtatattatatgtatatgcatattatatgtatatcatatgcat

SEQ ID NO: 78302 - DNA, 95 bp, Mus musculus
tctttatgtggttattcatttatattttgcctactttgtatatgtatatgaatatgtatatgagagtatgtgcatatatgtggtatgcatggaga

SEQ ID NO: 78303 - DNA, 85 bp, Mus musculus; identical to SEQ ID NO: 57470

SEQ ID NO: 78304 - DNA, 71 bp, Mus musculus
tcttcttgtgggtcaccaacaactggagcatgaactatgcctgagtctgtctgtgtgtgcctgcctgtgga

SEQ ID NO: 78305 - DNA, 85 bp, Mus musculus
cccattctgttcatactgtctgactctgggtctttgtacttcttataacaggctataggaggaagcttctctgatgaaagctggg

SEQ ID NO: 78306 - DNA, 93 bp, Mus musculus
atggttcctggagagctgttgctcatctatgttggagacccaaagaagctggttctaatatcagagaagaaacacagcagcaacagggtacat

SEQ ID NO: 78307 - DNA, 156 bp, Mus musculus
tatgtgtgtatgtgtgtatatgtgtatatgtgtatatatgcatatgtgtatatgtatatatttatatatgtgtatgtgtatatgtgtgtatatgtgtgtgtgtatacatacatatatatgtatatatgcatgtatctatatatgtgtatattccca

SEQ ID NO: 78308 - DNA, 77 bp, Mus musculus
gaactgcagcagagtggtttttatagctcagtactgtttgtgtcataattttcttttgatttctctagctgcacttc

SEQ ID NO: 78309 - DNA, 77 bp, Mus musculus
cacaaaacctccatagatacaagtaaagaagttagtaattgaatttcagtgaagtgtatgtttggatgttgtatgtg

SEQ ID NO: 78310 - DNA, 102 bp, Mus musculus
ggcacatattgctgggagcatgattatttatatctgtttagtatttatatgactaaagtaaagattagataatgaagattatcaattgtgactagggtggtc

SEQ ID NO: 78311 - DNA, 101 bp, Mus musculus
ctttttggttttattactggcttattggctgcacattgtagctatcaattttgagttcttctcagttgtgtgtgtggtcatgcttttaatgtgtccttaag

SEQ ID NO: 78312 - DNA, 85 bp, Mus musculus; identical to SEQ ID NO: 57470

SEQ ID NO: 78313 - DNA, 86 bp, Mus musculus
ggcacccctttgagattgggcagggctttgattgtgtctctagttatatcataatagtgaagtctgactgctcacactcagaagct

SEQ ID NO: 78314 - DNA, 70 bp, Mus musculus
tgtgtatttgctcatgtgtgtataaatttatatacccatatgtatatttgtatgtacatgtacacacaca

SEQ ID NO: 78315 - DNA, 81 bp, Mus musculus
tctgtttgtttctgtaccaatacatctagtttttatcattattgataaaaactattatctgtagtacagcttgagttcaga

SEQ ID NO: 78316 - DNA, 85 bp, Mus musculus
gtccatggtggtctaatagggtgcatgggacaatttcaatatttttgtatctgttgaggcctgttttgtgaccaattatatggtc

SEQ ID NO: 78317 - DNA, 81 bp, Mus musculus
gcctagactaaagattttcttgatcttgaaaaacagaaatttgttttccttatagagaagaaccaatgtccttgtctaggc

SEQ ID NO: 78318 - DNA, 61 bp, Mus musculus
ggacaccaactgatgcagttccagtaggccctacacatgctgtctcagtctctgagtgttc

SEQ ID NO: 78319 - DNA, 120 bp, Mus musculus
tggaagagttgtgtcttagcagttgaaagtttagacttcaaaatatatgtaaatttttttattatattggaatatttaaatagagcagtggttaatagtaaacttgacacatcttttcta

SEQ ID NO: 78320 - DNA, 110 bp, Mus musculus
ttatatatatatatatatatatatacacacatatatgaatatataatctatctatctagttatctatatctatatatatgtgtgtgtattacatatgatatataatatag

SEQ ID NO: 78321 - DNA, 94 bp, Mus musculus
gaccagccttagtctgtggcgatctgatagatgcatggaataatttcaatatttttgtatctgttgggcttgttttgtgaccaattatatggtc

SEQ ID NO: 78322 - DNA, 116 bp, Mus musculus
tttctcatgtccatttggagttttaaaggcacatattcaaatgttttgtttcaacatgaaatgctttgaatatatatttcttcctttccaatccatatccaaaggtcaagagcaga

SEQ ID NO: 78323 - DNA, 101 bp, Mus musculus
caccatgtagctgctatatattttcagtcatatatatgtacatatcatatgtatataaattttacaatgctgctagatatattgtattgcagttatgtgtg

SEQ ID NO: 78324 - DNA, 107 bp, Mus musculus
aagtatagtatatgatattctcagatatgcaatatttttctaatgttttatttcttatataataaaaatataaatgttatcacatatgctgatcatatattttactt

SEQ ID NO: 78325 - DNA, 106 bp, Mus musculus; identical to SEQ ID NO: 70652

SEQ ID NO: 78326 - DNA, 85 bp, Mus musculus; identical to SEQ ID NO: 57439

SEQ ID NO: 78327 - DNA, 85 bp, Mus musculus; identical to SEQ ID NO: 57439

SEQ ID NO: 78328 - DNA, 100 bp, Mus musculus
aatgagagaatggactttttgagaacacaacgttatttttttatatatactatttgtgtgaaatctacttctgtgatcccacaaatctatttttttcatt

SEQ ID NO: 78329 - DNA, 85 bp, Mus musculus; identical to SEQ ID NO: 57470

SEQ ID NO: 78330 - DNA, 109 bp, Mus musculus
ctgctgtgaggctgtctctctgtgtgtttgtactccccacaaaacactcacgcttacacacacacatagacacacacacatagacatacagagagagagagagagagag

SEQ ID NO: 78331 - DNA, 66 bp, Mus musculus
tgtatgtatatgtatatgtatacatatacgtgtacatgtatgtgtatgcgtatgcatatgtataca

SEQ ID NO: 78332 - DNA, 97 bp, Mus musculus
gtagaaggatctgatggtgttttaaatttcttcaggatctgttgttatgtctcccttttcatttctgattttgttaattaggatgctttccttgtgc

SEQ ID NO: 78333 - DNA, 107 bp, Mus musculus
acctgtgtgtgtacatgtgtgcattgtgaacatgtgtgtgtgtgtgtgtgtgtgcgtgcacatatgtgtataagtgtgtgagtgtacatgagcacatatgtgtttgt

SEQ ID NO: 78334 - DNA, 83 bp, Mus musculus; identical to SEQ ID NO: 66794

SEQ ID NO: 78335 - DNA, 93 bp, Mus musculus
ggtatcgttcagctcatctttagaagacctatgttatcctatgttaagtaatttctaatatgggatgtgtctggaatgggttcgtttcatacc

SEQ ID NO: 78336 - DNA, 85 bp, Mus musculus
gtccatggtggtctgataggatgcatgggacaatttcaatatttttgtatctgttgagtcctgttttgtgaccaattatatggtc

SEQ ID NO: 78337 - DNA, 95 bp, Mus musculus
tgttctttcaagttcattctggtccatataccaagtgtgctatttcttttcttggtatctttgtttatatgtttcagtagttcacttgaaaaaca

SEQ ID NO: 78338 - DNA, 106 bp, Mus musculus
tggtgggaagagctctgtggtcctgaaagctccccattcttcatctcgtgctgtggctgcaggtagaagattgtgagcacttttgggtccagggaagattgtgcca

SEQ ID NO: 78339 - DNA, 71 bp, Mus musculus
acctaaccaagaactgcaaggagctatggggacgtggttaacactgtctctctcagtgatttctttaaggt

SEQ ID NO: 78340 - DNA, 89 bp, Mus musculus
gggggagatgtacaacccaagaattttatatttttgatgcataggctatgcctgcttcagacatatgaaactgagttgttttctaatcc

SEQ ID NO: 78341 - DNA, 118 bp, Mus musculus
acttgatgggtggtaaacgttattatgtttctagtaactgaggtaggacttagaaaacatgaatgttttttagttttcatcagtggttagttaaggatgtgtttagttgttgttgggt

SEQ ID NO: 78342 - DNA, 110 bp, Mus musculus
ccaaggttttatatatatatatgtgtttatatttatatgtgtatatatgtattaacatacacacatatgtatgtgtatgtgtatatgtatcttgatagaacctgatttgg

SEQ ID NO: 78343 - DNA, 110 bp, Mus musculus
tgattagaatcattggtaggaacttattacttgttcttcagaaaactagtgattgtgaagttgttaataactctgagaattttctaaggtaataataaataccaaaatca

SEQ ID NO: 78344 - DNA, 113 bp, Mus musculus
ggcttcaggtgttgtttataaacaaaaacaatatatatgcatatttacatgtatatatgtatttacatatatacacacacatacattgtttctgtttaaaaacaactgaagcc

SEQ ID NO: 78345 - DNA, 85 bp, Mus musculus; identical to SEQ ID NO: 57439

SEQ ID NO: 78346 - DNA, 77 bp, Mus musculus
tgtgtatatgtatgtatgtatatgtatatgtatgtatatatatagcatatatgtatatagcaaatagtatatatata

SEQ ID NO: 78347 - DNA, 95 bp, Mus musculus
aagatgcaaggcaggaacttaaggcagagacatggaggaatgatgcttgtaaggtgactctctggctcactcttattttccaagcttcatatttt

SEQ ID NO: 78348 - DNA, 109 bp, Mus musculus
actaacccagcaatttaaacatttttattttcagaagagctgagctgaatctaactgctaggttgtttagatttgattgtagctagtgcatttgttttggtccattagt

SEQ ID NO: 78349 - DNA, 68 bp, Mus musculus
ggagtgaaaagttcccttactccaccagcaactctctgccctggtggagtctcactgtctctgtctct

SEQ ID NO: 78350 - DNA, 85 bp, Mus musculus; identical to SEQ ID NO: 57439

SEQ ID NO: 78351 - DNA, 92 bp, Mus musculus
tggatgtagcattgtgaattttcaaatggctatggaagaaaactcagtatcagagtcttctgtttatttgcttctgcaatgttttcattcca

SEQ ID NO: 78352 - DNA, 97 bp, Mus musculus
atgtatctatctatgtatctagctaatctatagatgtctatagttagatatatttagatatattttatctatcaaatatttagatgtctatagatta

SEQ ID NO: 78353 - DNA, 79 bp, Mus musculus
aggcttgtggggagagatttgatggacattccatttagaactgagtgtgccagtgtctccctctctctccataatgtct

SEQ ID NO: 78354 - DNA, 83 bp, Mus musculus
catgggacaatttcaatatttttgtatctgttgaggcctgttttgtgaccaattatatgatcaattttggagaaggtcccatg

SEQ ID NO: 78355 - DNA, 96 bp, Mus musculus
gatcagccttagtccatggtgatctgataggatgcatgggacaatttcaatatttttgtatctgttcaggcctgtttggttaccaattatatggtc

SEQ ID NO: 78356 - DNA, 109 bp, Mus musculus
aagcgagaaagcaggctgtctccagcttttggtcttttgagttatctttatttaaatatgataatctgaaagtagagagcaattgaggacaaatttgttcccttcactt

SEQ ID NO: 78357 - DNA, 124 bp, Mus musculus
tataaatcagtagtattgggctggagagatggctcataggctaagagtactgactgctcttccagaggtcatgagttcaaatcccaccaagcacatggtggcttataaccatctgtaatgagag

SEQ ID NO: 78358 - DNA, 88 bp, Mus musculus
aggatcatagtgaagtaatagagctttcagacctgcataataaatatgtaattcaaaactttggtctctctgtctctctgtgtgtctt

SEQ ID NO: 78359 - DNA, 99 bp, Mus musculus
agttcttggaggttagcatgagcttcttggttgtataatctttaagagccacacaaatattcctctggttgctcaatgtttagccttgatcaaagaact

SEQ ID NO: 78360 - DNA, 110 bp, Mus musculus
agtcttgagactcagagttcacattttttattgattaacaattaatgcttctttttatttatttgttttcattttggatgtgtttattttgttttctaggttttgggcct

SEQ ID NO: 78361 - DNA, 91 bp, Mus musculus
gtttgctctttgttgtttgtcgttctgaatacttacatgtcttgggtgtgggattcaagactgacactgactcagactatgaagataagac

SEQ ID NO: 78362 - DNA, 116 bp, Mus musculus
gggtctatattatagaatatatatatatatatatatatatacatatatatatatatatatatatatgtacatatgtatacatatgtatatacatatattctctataaaatctatct

SEQ ID NO: 78363 - DNA, 98 bp, Mus musculus
ttatagagaatatatgtatatacatatgtatacatatgtacatatatatatatatatatatatatgtatatatatatatatatatatatattctataa

SEQ ID NO: 78364 - DNA, 119 bp, Mus musculus
agtgaaagataacctatgtactgtgatttgatcaatagcaaaaattttggtgagtcctcacatagctagttgttatttaacttgtaaattatatcacaacttttgtttgtttattcatt

SEQ ID NO: 78365 - DNA, 98 bp, Mus musculus
atcaagctatctatctatcagcctggcagagattgattgcaggttccatgcttgctgcttcagtctctgtaagtctatgtgagccctgtttagttgat

SEQ ID NO: 78366 - DNA, 134 bp, Mus musculus
tatatatatatatatatatatatacatatatatgtatatatacatatatacatatatatgtatatatacatatatatgtgtgtgtatgtatgtatatatatatgtatgcatgtatatatatatatatatatata

SEQ ID NO: 78367 - DNA, 116 bp, Mus musculus
atgagggtttaaatctaactgctctgcgatgacaataaattatagcagctatttcagaaatgtgtggaatcttgtcttggctctagagcgaaccaactaagattacaactccttgt

SEQ ID NO: 78368 - DNA, 71 bp, Mus musculus
ttcagggacagcatcctctcactctcaatgagtccaaccccaacacagtggaggtggctgtcagcactgaa

SEQ ID NO: 78369 - DNA, 84 bp, Mus musculus
cacacacacacaaacacacacacacacacacactttacttatttctatgtgtatatgtatgtgtgtgcattttgtttataagtg

SEQ ID NO: 78370 - DNA, 132 bp, Mus musculus
tgtgtttgatatatatataaatatatatatatatgtgtgtgtatgtatacacatatatgtatatatgtatatatggatacatatatgtatatgtgtatatatgtacatatgaatatatgtatgtttatctat

SEQ ID NO: 78371 - DNA, 109 bp, Mus musculus
ggtagcaaagctcttgtgggttcttttccaccccaatgtgtttttcttgttgtcataaagcaaagagcaagggcagtgtatgtttcccatctgacaagagaacgctacc

SEQ ID NO: 78372 - DNA, 67 bp, Mus musculus
tgcatatcaaaacagaattggctttcagttcttctgtctgccaatcagactctgtctctgaaatgta

SEQ ID NO: 78373 - DNA, 113 bp, Mus musculus
cctgtgtctttgaactcttccaggagggctgaggacagagaggctcagttctgatctaggggtcaccacttagcctgtgtttctcagtgcagacctgggatcctgggagtggg

SEQ ID NO: 78374 - DNA, 82 bp, Mus musculus
gattggtttctcatcattgtttgactctgtgagtgtgtgtgtgtgcacgcgctcgggtgcatgcattgctggggaacaaatc

SEQ ID NO: 78375 - DNA, 71 bp, Mus musculus
cctgcttctctgctggggccctggcaaactaccattgtgtgttctgtctcagtgagtttgactattgtagg

SEQ ID NO: 78376 - DNA, 85 bp, Mus musculus; identical to SEQ ID NO: 57439

SEQ ID NO: 78377 - DNA, 112 bp, Mus musculus
gttggtagttgagtccctgggagctctgaaaggtctggttagttggctcagcagttaagagcactgactgctcttccagaggtcctgattcaattcccagcaaccacagggt

SEQ ID NO: 78378 - DNA, 100 bp, Mus musculus
ttccattcacactgcttttttggagtctgcactgtagaagtcttttttttttttttttcccaagacagagtttctctgtgtagccttggctgtcctggaa

SEQ ID NO: 78379 - DNA, 81 bp, Mus musculus
agaagtggagggacagagagcagagtgtgtggaagatgccgtagagcccaggcagttctccaggtgatcctgctatttctc

SEQ ID NO: 78380 - DNA, 142 bp, Mus musculus
tatataagacacacatattatacatgtgtatatgtatatatatgtatacaggtatacatatgttttatttattttacgtgtgtgtgtgtgtgtgtgtgtgtatacacataagtaacaacatgtgtgtagaggtcacagaaca

SEQ ID NO: 78381 - DNA, 84 bp, Mus musculus
tcctcatctacccattgagatgactggtgtacttatatgaggaagacaaatgaggaatctgtctctctcagtgtgtacagagga

SEQ ID NO: 78382 - DNA, 104 bp, Mus musculus
gtatttatatatacatataggtatatgtgtatgtgtgtatatatacatataggtatatatatatatatatatatatatatatatttatatttatatttatttat

SEQ ID NO: 78383 - DNA, 115 bp, Mus musculus
ctttggagctgtgtataccctcatttcatatgttgaaatcctggcctctaagactgtcaggttagtatgtgggcctttgggaattcattgggtcagggagagcaaagtcagtaag

SEQ ID NO: 78384 - DNA, 56 bp, Mus musculus
catatatatgtatgtatgcatgtatgaatgtatatatgtatgtatatatgtgtgtg

SEQ ID NO: 78385 - DNA, 92 bp, Mus musculus
agagccacaagctatgatgatagatttagatctgtgttctggaagctcttacacagtcagagtctcaccatgagtagcattgaatcccctct

SEQ ID NO: 78386 - DNA, 84 bp, Mus musculus
gcatctgtgtctgtgtccgtgtgtgtctgtgtaggtgtgcatatatgtgcatgtgtgcaagtgcatgtgcttagaagatcacat

SEQ ID NO: 78387 - DNA, 87 bp, Mus musculus
cggaagccgagtacaacagattgtcaggctctggacgcttctgtatgctgtggaagagctgagaacagagtgtggaccctcgggccg

SEQ ID NO: 78388 - DNA, 81 bp, Mus musculus
tcttcctggcaggacttccctctgagatgtcatttgcctggctgctctcatgtcactctctaagtctctgcttcgtgaaga

SEQ ID NO: 78389 - DNA, 62 bp, Mus musculus
ggaaatgccagccggagagaggtggtgggaactcacccagtctcagtctctgtggtgttttc

SEQ ID NO: 78390 - DNA, 76 bp, Mus musculus
ggcatctagggagtggagatgggagggttgctggagcttgctgtcagccagctcacttcacagtcactgagagacc

SEQ ID NO: 78391 - DNA, 119 bp, Mus musculus
gtgtgtgtgtgtgtgtgtgtttggtgtgtgtatgtgtgggttcagatgtgtgatatctatctatctatctatctatctatctatctatccatccatccatccatccaaccatctatcat

SEQ ID NO: 78392 - DNA, 57 bp, Mus musculus
tgtctctgacatcagagacagtggacacctgatctgatgtctctgatgtcttggaca

SEQ ID NO: 78393 - DNA, 94 bp, Mus musculus
caaggtcactaattacattactgaatatctatttttcatgtgtcttctatgactggttggcatggataaaaggctgttattgtagttggctttg

SEQ ID NO: 78394 - DNA, 78 bp, Mus musculus
catatccatatacatacacatatacatatattttttaccatgtatgtagtgtgtgcgtgtgtgtgtgtgtgtgtgtgt

SEQ ID NO: 78395 - DNA, 119 bp, Mus musculus
atgtttgttgaaggtatgatttttaactgcaaaatgtctccttatattctagtactactcacaagtttgtgaggagaaagataagttttgcatactctgaatttgtggctgacaaagat

SEQ ID NO: 78396 - DNA, 112 bp, Mus musculus
aagtgtgtatacatagatttgatttaagactggggtggctagggaatattgcctcattaaattggtcattttgttgttgagtgcagagtctatacccttaaaatatatattt

SEQ ID NO: 78397 - DNA, 112 bp, Mus musculus
tatatctttatgtatatgtgtgtgtatatatacatacatatatatatgtatatatatatgtatatatatatgtgtgtgtgtatatgtatgtatgtatgtatatatgtatata

SEQ ID NO: 78398 - DNA, 107 bp, Mus musculus
ttagttgaccttgagctctattacatgtatgtatgtatgtatgtatgcattgtgcatatataaatttatttatagtatgtatttatgagtgtgcttatgtctactga

SEQ ID NO: 78399 - DNA, 95 bp, Mus musculus
tgatttgagtcctaaagggtataactgagaagaaagagagctgaatgtaagggtgtaagcattctttctctctgtggatttgacttgctctttca

SEQ ID NO: 78400 - DNA, 113 bp, Mus musculus
tcatggtttcccccatcgagtaatggattcaagctgcagttataaaagtgcccactcagtgtgtgtctgggaccgccaactgacagtgacattcttgactggagtcaacctga

SEQ ID NO: 78401 - DNA, 85 bp, Mus musculus; identical to SEQ ID NO: 57439

SEQ ID NO: 78402 - DNA, 98 bp, Mus musculus
gtatatacataaaatatattatatagtatatgtgttatatatcacgagtattacatatgatttaatatgtatacattaatgtatacatatgtatatat

SEQ ID NO: 78403 - DNA, 95 bp, Mus musculus
gttcaggaaggtggtcttagtagagggttttaggtgattttgagatatcacccatgtgtcttcctctctctgtctataagttgaataggctttcc

SEQ ID NO: 78404 - DNA, 85 bp, Mus musculus; identical to SEQ ID NO: 57470

SEQ ID NO: 78405 - DNA, 85 bp, Mus musculus
tatacatatgtatatatgtatatgtatacgtatacctatatgtatatgtatacgtatatgtatatgtatatgtgtatatatatat

SEQ ID NO: 78406 - DNA, 115 bp, Mus musculus
agtttattggctacatcttcacgacctatctagatacctcattagcatggaacattctgtttttgtaaatgtgatcattggtaaagtccctatgtggggaatgtggtcatgaatt

SEQ ID NO: 78407 - DNA, 104 bp, Mus musculus
tatatatatatatatatatatatatatatatatatatatatatatatatatatatatatatgtatatatatatatgtatatatatatgtatatatatatatata

SEQ ID NO: 78408 - DNA, 92 bp, Mus musculus
tgtctttacatacatatatatttatgtatacaccaatgtatatgtacatacatatatacatgtttatagatatataagtattccaaagcaca

SEQ ID NO: 78409 - DNA, 86 bp, Mus musculus
agggatttttgtgcttcctctttaaggtcttctacctgtttagcagtgttctactgtatttcttgaagtgagttattaaagtcctt

SEQ ID NO: 78410 - DNA, 87 bp, Mus musculus
ccctcctgaatgcaccagagacctgggagatgggagactctcagactctcagactcttagatgaaatggctgacagtagtgagaggg

SEQ ID NO: 78411 - DNA, 118 bp, Mus musculus
ttgtttttaaaaattagaactttagaactgtaaaccttcaaatatactttgagcaaatatattgttttatttcaaagttattgggacagttttaaaatttaaagaaatgaaagaacag

SEQ ID NO: 78412 - DNA, 67 bp, Mus musculus
gaagaacaagattatctgcattaactactgtatttcactgttgaaattgtagctagttttgttcttt

SEQ ID NO: 78413 - DNA, 76 bp, Mus musculus
cttctgttagtttctctgtgtctctggttagtttctgtttccagaatctgtccattgatgagaggggttgttgaag

SEQ ID NO: 78414 - DNA, 110 bp, Mus musculus
cctcttcgagccttaatgaggggaaattcctagtcaaactgcaacttgatatgtcatgtttggttgttattcatgggggcctacactcttctgtagggaaatgaaacagg

SEQ ID NO: 78415 - DNA, 85 bp, Mus musculus
ggccatggtggtctgataggatacatgcgacaatttcaatatttttgtatctgttgaggcctgttttgtgaccaattatatggtc

SEQ ID NO: 78416 - DNA, 85 bp, Mus musculus; identical to SEQ ID NO: 57439

SEQ ID NO: 78417 - DNA, 85 bp, Mus musculus; identical to SEQ ID NO: 57439

SEQ ID NO: 78418 - DNA, 85 bp, Mus musculus; identical to SEQ ID NO: 58391

SEQ ID NO: 78419 - DNA, 116 bp, Mus musculus
agttggaagacagaatgggaaggcagagagtgatgtagttatcttttaattttaaaaatttaaaacataaatctgtgttactagttactgtgtttgtctctcagtgtaataggact

SEQ ID NO: 78420 - DNA, 116 bp, Mus musculus; identical to SEQ ID NO: 78419

SEQ ID NO: 78421 - DNA, 76 bp, Mus musculus
aaggatgtacctctgtggctgccgtgctttctctatctatgcagagtactgagtgaacacagtggtacttctcctt

SEQ ID NO: 78422 - DNA, 115 bp, Mus musculus
ttacatttgccaagatatctaaatgcctttataatttgataaatgacattttcttcttgaaaatgtgtttaaagctttaaatgtagtatgaatgtgttttatgtaatgaatgtaa

SEQ ID NO: 78423 - DNA, 81 bp, Mus musculus
gcaaagaatctagtagttctattcagaaggctgctctgcagtcctgaaggagtaggttctaaagtagtaggttctaatggc

SEQ ID NO: 78424 - DNA, 62 bp, Mus musculus
ttgcagtcactcagtccagccctgtcagttcccagcaagggtagagagatgagtgagtgcag

SEQ ID NO: 78425 - DNA, 115 bp, Mus musculus
tatatatgcgtgtgtgtatatatgtatatatacacacacatacatgatatatatgtatgtatgtatatatatatatgatatatatatatatatatatatataccctcatatgtta

SEQ ID NO: 78426 - DNA, 67 bp, Mus musculus
tctcaagtgagatcatcgtgaattgtctagagaacccttaaatgcaattcagtgttcttacaagaga

SEQ ID NO: 78427 - DNA, 56 bp, Mus musculus
ggtgacacattgaatgcatcagaagcatggtgtgcatgacatctctctgtgtcacc

SEQ ID NO: 78428 - DNA, 86 bp, Mus musculus
agcctgcagtactggagtgattgtatgctgggtagagtgggggtgctcactcctctgttctctgtgtgcaagcatggtgtggggct

SEQ ID NO: 78429 - DNA, 104 bp, Mus musculus
ggaattattgaacatgttgttgtctgtattatttctatgtatgtatgtatgtatgcatgtatgtacatatattcattagataacacatgtaatcttatattttc

SEQ ID NO: 78430 - DNA, 73 bp, Mus musculus
gaggagagagaaaagtctggggatattgtcttaaattgaacagatgagagaacattctcaggccacatccctc

SEQ ID NO: 78431 - DNA, 66 bp, Mus musculus
cggtgcctccctccctgttaggccatgatgcgcactgtcagaagtccccaagcagggaagtcaccg

SEQ ID NO: 78432 - DNA, 59 bp, Mus musculus
agtgtctgtctgtctgtctcaacctggcaattctgtgaggtgagaatagcacaggcact

SEQ ID NO: 78433 - DNA, 77 bp, Mus musculus
ggtgatgatctgaaattgaacggtagcttcccagatgtagaagcatattgtatgtttcaaatataacctacattacc

SEQ ID NO: 78434 - DNA, 77 bp, Mus musculus; identical to SEQ ID NO: 78433

SEQ ID NO: 78435 - DNA, 116 bp, Mus musculus
gtgaccagcaattaagccaatgaggcaggttgaaattgaacaacgtgtatatatgtatatatatgtctgtgtttttcatccgcaggtccaatattctctaggcaggggctggtagc

SEQ ID NO: 78436 - DNA, 99 bp, Mus musculus
gtgtataagtgtgtgtgtatgtagtgtgtgtcctgtgtgggggagacagacagacagacagacagacagacatcactgtgttcacaggcacttatgtac

SEQ ID NO: 78437 - DNA, 78 bp, Mus musculus
tctctctctctctcggtttgttagaaattgctcttttaagggctgggcagtttctaatataaccaaggccctgtgaga

SEQ ID NO: 78438 - DNA, 74 bp, Mus musculus
tgtacatgcagataagtcattcatacatataaaaaataaataaacatatgtatgtatgtatgtatgtatgtata

SEQ ID NO: 78439 - DNA, 79 bp, Mus musculus
tgtggcatatgtatgtgtgtgtatatatatatatatatatatatatatatatatatatatatatatatatgcacacata

SEQ ID NO: 78440 - DNA, 66 bp, Mus musculus
tgtgtgtgtctctatgtgtgtgtatatgtataatatatataatatacaatatagtgtacatatata

SEQ ID NO: 78441 - DNA, 99 bp, Mus musculus
agccgtctttccagcccttagacctctagtttgtttctttttatgtcaggcttttctgattagcttcaagtggaggttctaaataacagaaaaacagtt

SEQ ID NO: 78442 - DNA, 101 bp, Mus musculus
ccatggtagagatgtggacaatgcggaggcacttgtgcattttgcttccaggtgtcccaagtcactgtctgtctgtgcctgtgggactgggaagccaggca

SEQ ID NO: 78443 - DNA, 68 bp, Mus musculus
gatgttcctgacagtgtcccagtctggaggcacttgaaccttccctgagtgacactgtctctgtcctc

SEQ ID NO: 78444 - DNA, 102 bp, Mus musculus
tccatggtacagctgtatacaaatgatgtctagtcagtagagagtgagcgtaataaactaatgctgactggtgacgtcaaaaccaaaggaagaaactgtgga

SEQ ID NO: 78445 - DNA, 85 bp, Mus musculus
gcagtatacctcccaatgttcctgcattggtatctgtctacagacagacaaggacagtgacaggacagagagaggtgagcgatgc

SEQ ID NO: 78446 - DNA, 92 bp, Mus musculus
ctactcctgttgctttgctatatggatatgatgtcaaaccgccttctaaatatttgtatctatattcatagatttgggtggctctggagtag

SEQ ID NO: 78447 - DNA, 90 bp, Mus musculus
atgtacgtatgtacgtatgtatgtatgtatatatgtatgtatgtatatatgtatatatatatgcatatatgtatatacgtatatatatgt

SEQ ID NO: 78448 - DNA, 96 bp, Mus musculus
gaccagctttagtccgttctgatcagataggatgcatgggataatttcaatatttttgtatctcttgatgcctgttttgtaaccaattatatggtc

SEQ ID NO: 78449 - DNA, 95 bp, Mus musculus
ttcacaatgattctttatgtacattttttttgtagtctgtgctgacaaatcacagagtacatgttaagtgtgaacactggaatagtcttgatgaa

SEQ ID NO: 78450 - DNA, 85 bp, Mus musculus; identical to SEQ ID NO: 57439

SEQ ID NO: 78451 - DNA, 113 bp, Mus musculus
gcacatgtcatgtatgcatatatacatatatgtgtgtatatatatgaatgtatgcatgtgcatacgtatatatgtatatttgtatatgtgtatagatttgtatatgtgtgtat

SEQ ID NO: 78452 - DNA, 115 bp, Mus musculus
gtattcatatatatatatatacatatacataaatacatatgtgacatatatatatatatatatatatatatatgtttgtgtgtgtgtatatgagtgtacatatgtgtgtgtgtat

SEQ ID NO: 78453 - DNA, 60 bp, Mus musculus
gtgacaaggttttactactttggacacatgtcagtgtgctgagtggtatttgtttgtcac

SEQ ID NO: 78454 - DNA, 74 bp, Mus musculus
gtatgtatttatgtatgtatgtatgtatgtatgtgtgtgtatatatgtatgtatgtatgtatgtatgtatgtat

SEQ ID NO: 78455 - DNA, 112 bp, Mus musculus
gaagaaatgtgggagtcaaatgctttgttatctgttgccctgtaaattggctaatttacatatcacagtgaatttgtagaatttgactcattacaattggatttttttcttc

SEQ ID NO: 78456 - DNA, 98 bp, Mus musculus
tgtatgtataaataaatatatataaatactcatgtatataatatattttatataactttatatgcatatacatgtatgtatatgtatttctacatata

SEQ ID NO: 78457 - DNA, 85 bp, Mus musculus; identical to SEQ ID NO: 57439

SEQ ID NO: 78458 - DNA, 88 bp, Mus musculus
tatgggatggatccacaggtggggcagtccctggatgacctttccttcagtttctgcttcagactttgtctctgaatctcttcccatg

SEQ ID NO: 78459 - DNA, 85 bp, Mus musculus; identical to SEQ ID NO: 57439

SEQ ID NO: 78460 - DNA, 68 bp, Mus musculus
tgtgagggaggctcctcacactggtcaacagatttacactatctctcagactgagaggcttcttcaca

SEQ ID NO: 78461 - DNA, 76 bp, Mus musculus
tatatatatatatatatatatatatatatatacacatatatatgtatgtatgtatatgtgtatgtatgtatatata

SEQ ID NO: 78462 - DNA, 108 bp, Mus musculus
gagttaaaattgtgatgttagggtttgtgaatggaaagtatacaagactgttctagaggaagatttcatgtccctaaaacattctttatgtcatatactctattactc

SEQ ID NO: 78463 - DNA, 91 bp, Mus musculus
atgtttaagtaatgttcatatgtttgtatatatatgtacatgttcatatatatatatatatatatactcatttttattccttaatattcat

SEQ ID NO: 78464 - DNA, 85 bp, Mus musculus
gcctgtagagatgagatttcaagatgttaacttgaaagatggtatcaagttaatttcttcatgtctcttgactctaatatttggt

SEQ ID NO: 78465 - DNA, 67 bp, Mus musculus
gtccaatgggtggctgtaagcattcacatctgtataggtcaggctctgtcacagcctctcaggggac

SEQ ID NO: 78466 - DNA, 109 bp, Mus musculus
ggttgaatcattgcaagagtcagaaatgtaaggagtttcttgtgatattgtatctatagaaatatgagaagttactcccattatctcacaaacatgacagatgttagct

SEQ ID NO: 78467 - DNA, 85 bp, Mus musculus; identical to SEQ ID NO: 57439

SEQ ID NO: 78468 - DNA, 79 bp, Mus musculus
tgtaatgtatatgtatatgtgtgtatatgtgtatatctatatatatatatagatagatagatatataaatctgattgca

SEQ ID NO: 78469 - DNA, 78 bp, Mus musculus
cacacacatatgtatatatgtgtatatatgtatatatctgcatgtatatgtatatgtaagtgtatgtgtatgtgtgtg

SEQ ID NO: 78470 - DNA, 85 bp, Mus musculus; identical to SEQ ID NO: 57439

SEQ ID NO: 78471 - DNA, 85 bp, Mus musculus; identical to SEQ ID NO: 57439

SEQ ID NO: 78472 - DNA, 114 bp, Mus musculus
gaagtattttaaaaagctctttttatgggaggccttgagcatatgaaagctgttcatttttattatttggactcaatgctggaaggctgtgtcaatggtctttgtgagataatc

SEQ ID NO: 78473 - DNA, 201 bp, Mus musculus
cattatgtgttttatgcatgtttgtgtgtgtgtgtgtgtgtgtgtgtatatatatataatcatttatatatgaatacatgtgtatatatatagtcatgtatatgtgtgtgtgtgtatatatatataatcatgtatatatgtatacatgtatatatatagaatcatgtatatatatatatatatatataaatataatcatga

SEQ ID NO: 78474 - DNA, 93 bp, Mus musculus
gctttctaaattgttgcaatgtcattttttattttgtacatctgtatgtgtccatatgtcagtatatattgtgagtgcaatgcaaatggaggc

SEQ ID NO: 78475 - DNA, 117 bp, Mus musculus
tatataaataatatatctaataatatgctatatgttatgtaatatatgactattattatgtattatatattatgttacataatttatataattatatatgttgtatttaattatata

SEQ ID NO: 78476 - DNA, 85 bp, Mus musculus; identical to SEQ ID NO: 57470

SEQ ID NO: 78477 - DNA, 121 bp, Mus musculus
gtcatgttattttaggattggtacacaatgtgctctttaagaatacgacactttctctgtcactatgatttctgcacccagtaccgagaagaggctgacagtttgatacgtaggatggaga

SEQ ID NO: 78478 - DNA, 63 bp, Mus musculus
tttgtggtctatgcatatagtatgtcaagaaaatgataaagacaaatgtcatagaaccacaga

SEQ ID NO: 78479 - DNA, 107 bp, Mus musculus
cttctgtgtttgctaggcccctgcatagtctcacaagagagagagctttatctgggtcctttcagcaaaatcttgctagtatatgcaatggtgtcagcgtttggaag

SEQ ID NO: 78480 - DNA, 187 bp, Mus musculus
gtgtatatgtatatatatacatgcgtgtgtgaatgtgtgtatacatttataaatatatatgtgtgtgtatatttatatataaatatacatttatatatatgaatatatttatttgtgtgtatatatatatatataaatgtacatgtatttatgtatataaatgtatgtgtctgtgtcggtgtgtgtg

SEQ ID NO: 78481 - DNA, 87 bp, Mus musculus
cagactcaacaaggactagatctgctgatgattttaaaaataccaccttctactagccctcagtcaggctgtctgtgttatggtttg

SEQ ID NO: 78482 - DNA, 110 bp, Mus musculus
gtgtgtatgcatatatgtaaatgtgagtatgtgtatgcatgttagcatatgtgtatgtgcatgtgcttgtatctataggcatgtgagtgtatgtacatgtgtgtgcatgt

SEQ ID NO: 78483 - DNA, 61 bp, Mus musculus
gggccttagggaagtaaggagggaaatgatggtgtgtccctctgcctctgtgtctgtgcct

SEQ ID NO: 78484 - DNA, 68 bp, Mus musculus
catgtgcatgtgtgcgtgtgcatgtgcatgtgcgtgtgtgtgtatgtgcatgcattcaagggcacatg

SEQ ID NO: 78485 - DNA, 111 bp, Mus musculus
gatttcagagcgttgtaaccttcttgtgggtgctgggaacttggtctatctgcaacagtaactgagctaattttctagctcctttccaaaattgtaataactttctttgtc

SEQ ID NO: 78486 - DNA, 115 bp, Mus musculus
tatttcaggattgaatcagaatgccaaacgaaatcctttgtctaattcatgagcagagtctttttttttttttccaggatatcacagaagatgagtggtataggtcctgcttgta

SEQ ID NO: 78487 - DNA, 68 bp, Mus musculus
gcaaaagggggctcattcctgggagaggctaactctccctctctcagtagtcactggttgcctttagt

SEQ ID NO: 78488 - DNA, 116 bp, Mus musculus
ctctctgcaacagcgccttccatactgtttagttagggtccccatcactgtgaacagacaccgtgaccaaggcaactcttataaagaaaaacatttaattggggctgggttatgag

SEQ ID NO: 78489 - DNA, 88 bp, Mus musculus
agtctggtgtttgtttggacattacgttcagatccagcacactctcttgtgtctgtgtctgtctgtcaattcccgctgactctatgcc

SEQ ID NO: 78490 - DNA, 86 bp, Mus musculus
gggctacaagactgggctaaaacggtatttagttatgacttgtttttgagccagggtgtatctgtctgtctgtctgtctgtctccc

SEQ ID NO: 78491 - DNA, 74 bp, Mus musculus
ggaggttgaggcagggaggttgcttggagttctaggtcaacgtaggtgacagtactgtctcagaacaaaactct

SEQ ID NO: 78492 - DNA, 85 bp, Mus musculus
ggagtaggtgtgtcactggagggtgggctttgaggtttcaaatgctcaagccaggcccaccgtctgtctctctcttcctgctgcc

SEQ ID NO: 78493 - DNA, 78 bp, Mus musculus
tgatgtgcgcacgtgtgcgtgcgtgcgtgcgtgtgcgtgtgcgcgtgcgcgtgcgtgcgtgcgtgcgtgcgtgcgtga

SEQ ID NO: 78494 - DNA, 72 bp, Mus musculus
gctgtgacatacggagatgacctggtacaggtccatgctggtcctgggcttgctgtctcagtctctgtgagc

SEQ ID NO: 78495 - DNA, 115 bp, Mus musculus
tggccttctgaccctgagaaggaatcgctaaggcagctcacactgagaacaaagtgatagcaagttaccaggaaaggcagagtgtgtgtgctatggtggtgttctaaggtagcca

SEQ ID NO: 78496 - DNA, 114 bp, Mus musculus
acacagacactcacacactgaaacaggagtgaaagaaatctttttaaaagtttttagacttttaaatttttctttaaaaattttcttgtcttgtcttgtcttgtcttgtcttgt

SEQ ID NO: 78497 - DNA, 118 bp, Mus musculus
atgtgtttctatatgtatgtgtgtgtacatatatatatacatacacacatacacacacacacacacacacacacacatatatatatatatacacacatacatacatatacatacatat

SEQ ID NO: 78498 - DNA, 81 bp, Mus musculus
tctctctgttgtttgtatatgtatacaatgtatgtctgggtgtctgtatctctctgtgtgtatatagagacaacatgggga

SEQ ID NO: 78499 - DNA, 93 bp, Mus musculus
gtgtgcttgtgtctcctggcaattgagggtttttatttatatatctgatgttatgtagaaatattcaaatagctacagaccaatgaagcgcat

SEQ ID NO: 78500 - DNA, 110 bp, Mus musculus
ttgaagatcagccttagtgcatggtgatctgataggatacatgggacaatttcaatatttttgtatctgttgaggcctgttttgtgaccaattatgtggtcaattttcag

SEQ ID NO: 78501 - DNA, 72 bp, Mus musculus
atataagagatatgcatataatatatatatacatatgtatgtatatatatgtgtgtgtgtatgtatatatat

SEQ ID NO: 78502 - DNA, 100 bp, Mus musculus
cttaacccctttgtagctattctgtaatatatatgtgtgtgcatatgcatgtgtatatatgtatagtgtaacatattatcttagagtactaataattaag

SEQ ID NO: 78503 - DNA, 87 bp, Mus musculus
tacatatcgtatgtatgtatgtatgtatgtatgtgtatatgtatacatatatacatgtatatatatacacacatatatacatatgtg

SEQ ID NO: 78504 - DNA, 85 bp, Mus musculus; identical to SEQ ID NO: 57470

SEQ ID NO: 78505 - DNA, 111 bp, Mus musculus
cacacacactgagaagtaagcaaaacaaattttgcaggtgtttacttttgagactataagcttgttaagttgttaagttctttcagtgtcctcttgctaggtgtgggttat

SEQ ID NO: 78506 - DNA, 85 bp, Mus musculus; identical to SEQ ID NO: 57439

SEQ ID NO: 78507 - DNA, 60 bp, Mus musculus
gtgtgtaggtaatcttgtatgtgtgtgtatatatatatatacatatgattgcatatatat

SEQ ID NO: 78508 - DNA, 79 bp, Mus musculus
agccctaaagagtgcaaaggagctgtctaagtcattcatggaagtgataatcagtcagctcactgagtgctctagggtt

SEQ ID NO: 78509 - DNA, 66 bp, Mus musculus
ggttccttcagcatctgcatgtgctctgctccaaaatcaagatgtgcatgttggttttgcagaacc

SEQ ID NO: 78510 - DNA, 85 bp, Mus musculus; identical to SEQ ID NO: 57470

SEQ ID NO: 78511 - DNA, 95 bp, Mus musculus
gtgagtgtgtgtatgtaagtgtgttcacatctgcacactcgtgtgtgagcattcttgtatgtgtgcatgtgttcatactcaaggtgtatgctggc

SEQ ID NO: 78512 - DNA, 116 bp, Mus musculus
ctgttgttatagactctttctgagggcatgagaggcataaatcagaatcgcgttcactatttttttttattgcaaaaatacactcatgaaaagttctgagagaagcagatgcacag

SEQ ID NO: 78513 - DNA, 92 bp, Mus musculus
ttggtaccagggatggaaataatctctaattattgaccttctgtcagattatatacaggagaatgaacaaagattgctttcctttccatcaa

SEQ ID NO: 78514 - DNA, 111 bp, Mus musculus
aagacagacagacagacagacagacagacagacagacagacagacagacagacacagattcatgtctggttcctgctctgccagtcactgctcatggagttcctggtactt

SEQ ID NO: 78515 - DNA, 68 bp, Mus musculus
gcagtgactggcagagcaggaaccagacatgaatctgtgtctgtctgtctgtctgtctgtctgtctgt

SEQ ID NO: 78516 - DNA, 81 bp, Mus musculus
atctgagacactgcctccctcaaagacctgtgtcgaaggcttggttcctagtacaacattgttcagaggggtagattagat

SEQ ID NO: 78517 - DNA, 105 bp, Mus musculus
tgtgtctttgactatatcccttgttcccctacatgcctccttttaatgtatttatatctaaatactcataaaggcagcaggtacttgatgcatactcatgacata

SEQ ID NO: 78518 - DNA, 100 bp, Mus musculus
aggataaaagaaccctttacgttttgttgtctgagtcactatctcagtgcgttcggtactgggttttggttctagggctttttgataaaggaaactaaag

SEQ ID NO: 78519 - DNA, 97 bp, Mus musculus
tgtaggagccccgacagtggcagtgaaagtgggaatgagaggtgtctgactctgtctcatgctctctggacccttttcatctcactgggttttctca

SEQ ID NO: 78520 - DNA, 75 bp, Mus musculus
tgggagctgaggtgtgggtggaaaatcctgcgattatgtcctcacttgctctttcactcactctttcactcacta

SEQ ID NO: 78521 - DNA, 112 bp, Mus musculus
attctgtttgtgctagaagaaaatttctaataagatttcgtggcatgactagtctcagaagaatgagacgtcatgtcatgactgagaactgttcccatttacatacatgagt

SEQ ID NO: 78522 - DNA, 115 bp, Mus musculus
gaatgtcactgctttctgcccttgtcctaaaaatctgccagaggctacattgaatagttttgaattaatggctttgacagaagagatttaaagacaggctagtattgactatgtc

SEQ ID NO: 78523 - DNA, 85 bp, Mus musculus; identical to SEQ ID NO: 57439

SEQ ID NO: 78524 - DNA, 110 bp, Mus musculus
ttctgcttacacttgctttgaggaagcttttatttttgttcttttgatttatttagttatatctcttatatacaatgtaaagtagtagctacagtgtaagtgagcctgaa

SEQ ID NO: 78525 - DNA, 107 bp, Mus musculus
ggcattaaattttcttggtagtggagttacaaagtgctatatgcattgcttatatatatataaacaattatgcatgatgtatttttcattattgagcattggatgct

SEQ ID NO: 78526 - DNA, 94 bp, Mus musculus
gatcagccttagtccatggtgatttgataggatgcattggacaatttcaatatttttgtatctgttgagcctgtttgttaccaattatatggtc

SEQ ID NO: 78527 - DNA, 83 bp, Mus musculus
tggaactgtatctcagaaatgtgtttatatattttgctacctgcatctttaagataaaagcacatcttcttgagagaccccca

SEQ ID NO: 78528 - DNA, 100 bp, Mus musculus
tatagaaagaacttggacagagcatcaggaggtatacataattaaacagccctgataaagatgtgatcttgttgttcatttttgaagttctggttctgta

SEQ ID NO: 78529 - DNA, 85 bp, Mus musculus; identical to SEQ ID NO: 57470

SEQ ID NO: 78530 - DNA, 70 bp, Mus musculus
caagctagttggatttattgtttactcaaagagaacaacctcatggtaacagtcagtaccagctctcttg

SEQ ID NO: 78531 - DNA, 119 bp, Mus musculus
gcgattttccaggaccttcagtgtgatcatctgaccctttcagcccaggagtgtaaagaagtgtgatcatctggtccttctaccccaggagtgcaatacttgtcaggacacagggtttt

SEQ ID NO: 78532 - DNA, 80 bp, Mus musculus
agtaagcattgatcctctgggactctgggactctgggactcaggatctcccaggatcagagttacaggcgaatgtgaact

SEQ ID NO: 78533 - DNA, 80 bp, Mus musculus
tgtggtgcttgtgtgaatgtttctgtgtgtatgtctgtgagtggtgcatgcatgccacacctcattcgtgggaatccagg

SEQ ID NO: 78534 - DNA, 94 bp, Mus musculus
tgttccttttgtggacatattttatatatacatacatacatacatgcacatgtgtgtgtatatctgtgtgtctgtgtgtgccacaacagcctca

SEQ ID NO: 78535 - DNA, 84 bp, Mus musculus
ctgttgtggcacacacagacacacagatatacacacacatgtgcatgtatgtatgtatgtatatataaaatatgtccacaaaag

SEQ ID NO: 78536 - DNA, 76 bp, Mus musculus
catgttctgaggattgaagtcagaacctcagttttgcacaccaagcacttgactgactgagttatcccctagcatg

SEQ ID NO: 78537 - DNA, 94 bp, Mus musculus
ttcactcatgtgttctgtttttatgctttgaagaattctttttttctggatcattatttctttttttgcaataaaaacaggaacatgaaatgaa

SEQ ID NO: 78538 - DNA, 105 bp, Mus musculus
acatgctgtagcttttaggctttaaactggttgttttctctgcctagaatgtatttcattttttgtactggtatggctagttttcttcaagtcttgctcaaatgt

SEQ ID NO: 78539 - DNA, 106 bp, Mus musculus
agaaaccagcagtgtaattttcatttgacacaggaagtaaatatctgtggtcacttgtcagacagattttgtactgcctgctgtatgagaaactattctaaagtct

SEQ ID NO: 78540 - DNA, 89 bp, Mus musculus
gggaaggggtttgatatagacagccagcttagggctgagtgttccaaggcctctcattctgtctggctgtgtgtctctatttttttccc

SEQ ID NO: 78541 - DNA, 71 bp, Mus musculus
gcctgagagtgaggataaaggaccaaggtggctgtgctccgtgtcacccagactctctgtccttctcgtgc

SEQ ID NO: 78542 - DNA, 94 bp, Mus musculus
cagactctgctttaatcacagaatccgtgcaggcatcacacccctgtccagtgttcacttggctgaagatttctggattataaaacagcttctg

SEQ ID NO: 78543 - DNA, 118 bp, Mus musculus
ggtgtcaaacattcagattctgtgtttgtctatgacatatgcatgtattatatatttatgcatgtatgtataaacatgtatgcctcaagggacaatcttaggtgtcaggtgtggctct

SEQ ID NO: 78544 - DNA, 98 bp, Mus musculus
gcattgaaaccagttagttcatttaattcttgtgagaattcagtgaggtcaatgttgcctcattattcttgcaaataaagaaacaaatggaaagatgc

SEQ ID NO: 78545 - DNA, 68 bp, Mus musculus
gattgagcctccctgaaacttctgtctttgtttatcatacaagtgagaagcctgagggaggcctggtt

SEQ ID NO: 78546 - DNA, 110 bp, Mus musculus
agttgacacaaaactagccagtacactcagtttccactgttatgtctcccttttcacttctgattttgttggtttggatactgtctctgtaccctctggttagtttggct

SEQ ID NO: 78547 - DNA, 97 bp, Mus musculus
ttggcttccattttaggaagacagaatttcacattcctgcaatggagacagggcggttcacactttgtctctctgaaatgcagctgattgtgtgttt

SEQ ID NO: 78548 - DNA, 76 bp, Mus musculus
tgctcacctgtctctctgttaggtcaggtggtgtcaagaatcacctgtgctaatggggcagatttggtctattgca

SEQ ID NO: 78549 - DNA, 113 bp, Mus musculus
gtgtagcagtggtgatgggatggggtgagccaggagacaggatcagatcttttctctccactgactccctgtgaccctggcacgagccacccctttttatcatctgatttcac

SEQ ID NO: 78550 - DNA, 85 bp, Mus musculus; identical to SEQ ID NO: 57439

SEQ ID NO: 78551 - DNA, 102 bp, Mus musculus
gcagggctctgagcctggtgaccagaaacaagtggctccttgagacaaaggatggagtctctgggtctctgtctgttcacatgtctggaccagataatttgc

SEQ ID NO: 78552 - DNA, 85 bp, Mus musculus
ggacctctggaagagcagtcagtgctcttaaccaccaagccatctctccagcgccatctgatttttttttttccatacaaggtcc

SEQ ID NO: 78553 - DNA, 63 bp, Mus musculus
tatctgtgtgtatatgtacatatatgtgtatgcaatatatatgtgtatatgtatatatgtgta

SEQ ID NO: 78554 - DNA, 85 bp, Mus musculus; identical to SEQ ID NO: 57439

SEQ ID NO: 78555 - DNA, 82 bp, Mus musculus
gtatatatgtgtatgtatatatatgtatgtgtatatatatgtgtatatgtatatatatatatatatatatatatatataaca

SEQ ID NO: 78556 - DNA, 60 bp, Mus musculus
atatacacacacgtatatatatgtatatatacatatacatgtgtgtgtgtgtgtgtgtgt

SEQ ID NO: 78557 - DNA, 118 bp, Mus musculus
ttcaggtattttgtcacagtgaccaaccaaaagttgattagcatgtgtgtggtagaatcttgaattctaataggaagttatggtaatttgaatggaacctttgtaaggcagacttgga

SEQ ID NO: 78558 - DNA, 96 bp, Mus musculus
atatatatttatgtgcatatgtatgtatatgggtatatatgtgcatatatgtgtatatatgcatatatattttcatgagtgtgcatattttaacat

SEQ ID NO: 78559 - DNA, 91 bp, Mus musculus
gcatttatgtatgtatgtgtgtatatatatgtatatatgtacgaatgttttatgtaaatgtatgcagtgtgtgtgtgtgtgtgtgtgtgta

SEQ ID NO: 78560 - DNA, 75 bp, Mus musculus
gtgtggtgtgtgtgtgtgtatgtgtatataagtgtgtacatgtggtgtgtatgtgtgcatgtgcatgtgtggtgt

SEQ ID NO: 78561 - DNA, 91 bp, Mus musculus
agagacatccatgtctgtttcactgtgtggctgggagccagaaccaccggggcctctgggtgtgtcttgttggcacagcctgtatagtggg

SEQ ID NO: 78562 - DNA, 57 bp, Mus musculus
agagagagagaaagagagagagagagtgtgtctgtctgtctgtctgtctgtctgtct

SEQ ID NO: 78563 - DNA, 115 bp, Mus musculus
gcatttctctgtttagtttttgtctgaatgacatgtctattggtgaaaggtgggtatttaagtctcccactctcagtatgtgagggtcattatgtgatttaagctgtagtagtgt

SEQ ID NO: 78564 - DNA, 79 bp, Mus musculus
gatagggaatattcgtcactgactccaagtagagggtgcagtgataatcactgcctgctttgaacaggtattaattatc

SEQ ID NO: 78565 - DNA, 167 bp, Mus musculus
actatatatgtacatatatatatccatacatatatatgtgtgcgtatgtatgtatatatatatagttaaatatatgtatatatttatgtatatgaatgtatttatctatatatctataaatgtatatatgtctataaattatatatttctgtacataaatatatata

SEQ ID NO: 78566 - DNA, 89 bp, Mus musculus
gaaggcatgacctctttccatccagtcagcaagtatttagcaaggaaatactaagttctgtgtctgtgtgagtgggcaaaaatgtcttc

SEQ ID NO: 78567 - DNA, 133 bp, Mus musculus
atacatgaccatatatatgtgtgtgtgtgtgtgtgtatatatatttatatatagatatagatagatatgtatctatatagatatgtgtgtgtgtatatatatattcatatagttaaagcaatatcttatatat

SEQ ID NO: 78568 - DNA, 81 bp, Mus musculus
gcaggagattatatggtaactcaagctaaaggttaaatctgaacattgatctgaacatctgaatcttgatcattctcctgc

SEQ ID NO: 78569 - DNA, 102 bp, Mus musculus
gagagtagtggaacgaaggaaaactgtggtcaggatgcagatgaaagaataatctatttttcttttcgtccccatatttttatttaattttttatctctttc

SEQ ID NO: 78570 - DNA, 66 bp, Mus musculus
gtctgcatctgcaactgcttgtgatagcgtgatctgtgtttacctatcaaatggtgacatgcagac

SEQ ID NO: 78571 - DNA, 90 bp, Mus musculus
gtggtgaatgagaaaaaggagtgaactgaggtgtgtcagtgtgtgtctatgtgtctgtctacctgtgtattcgtccaagctcattcctat

SEQ ID NO: 78572 - DNA, 104 bp, Mus musculus
tgtaggtttggtgggggctggagagatggctcagtggttaggagcactgactgctcttccagaggtcctgagttcaattcccagcaaccacatggtgactcaca

SEQ ID NO: 78573 - DNA, 79 bp, Mus musculus
ctcttatattgttctcactgaggctctgactctgccaaacaggtgagtgcaacagggctggactgaaacaacagaggag

SEQ ID NO: 78574 - DNA, 115 bp, Mus musculus
ggtgtcagcctacacatataaaagacactgaagaaggaagctctctcattttgtcagcttactctgtctctggctggcaagctaattcctttgctttagagcttaggtttcgacc

SEQ ID NO: 78575 - DNA, 86 bp, Mus musculus
ctcttaattgtggcttcatagaatgattttggtagagtactgtattagtcagggttctctagagtcacagaagttacagatactgg

SEQ ID NO: 78576 - DNA, 121 bp, Mus musculus
gtggtatggttcaatggttaagaacacagatgctggtctggagagatggctcagcggttaagagcactgactgctcttccagaggtcctgagttcaaatcccaacaactacatggtggctc

SEQ ID NO: 78577 - DNA, 78 bp, Mus musculus
ggaaatggcagccagacacactctggctgtgacagtcccaaagaaggagctggcacaagggccagagctgctgttacc

SEQ ID NO: 78578 - DNA, 71 bp, Mus musculus
tgtctgtctgtctgtctgtctgtgggtgcccttcctgggaactttttacacaggtagaatcagacagcaca

SEQ ID NO: 78579 - DNA, 67 bp, Mus musculus
gctccatacagaatcaggtctgcatcccttgagatgctcagttccatatttgattttgttttgaggc

SEQ ID NO: 78580 - DNA, 64 bp, Mus musculus
ctagcacacaggaggcaaaggcaggtggatggatctcttgtcagtttgttctactgcgttctag

SEQ ID NO: 78581 - DNA, 80 bp, Mus musculus
agtggcatggtgggcagaggctgaccagccagcatctggctggcttcctgattcccacatgacagctatacgtgcacact

SEQ ID NO: 78582 - DNA, 72 bp, Mus musculus
tctctccctctctgactgctttctgctgtactaggggcgtattttagaataagtcacagtgataggctgagg

SEQ ID NO: 78583 - DNA, 84 bp, Mus musculus
gtgctggcaggtggaggaggattaggtcaaacccacagtgtgtctgtctttgtctctgtctcactcattcacacatgcacgcac

SEQ ID NO: 78584 - DNA, 79 bp, Mus musculus
tgcctcagactgaagactgacagcagcattataggagtgagccactatgcctgtcctttgtccccactttagctaggta

SEQ ID NO: 78585 - DNA, 66 bp, Mus musculus
tgtgtgtgcacgcatgtgtgtgtgtatatatatatatatgtacacacacacacacacacacacaca

SEQ ID NO: 78586 - DNA, 74 bp, Mus musculus
cacacacacacacacacacatgtatatgatcttatccaatctgacaatttgctttgtgtgagtaggtgtgtgtg

SEQ ID NO: 78587 - DNA, 65 bp, Mus musculus
tctcttgcacccccatacactcacagccagctgtctggcagtcagtctgtgtctgtgctgggaga

SEQ ID NO: 78588 - DNA, 87 bp, Mus musculus
gtatttcacagttgtgtaggatcaggaggaaacaaatctgtcacacagtccttctgagaagatagtgtgcatagctccatgaaatcc

SEQ ID NO: 78589 - DNA, 85 bp, Mus musculus
gctctgaactgtgtctctcagtcactgtccctgtgagcctggcaccactgtgttcctcacagcagctgagttacagaaaatgagt

SEQ ID NO: 78590 - DNA, 80 bp, Mus musculus
gggccaagttgggacagggactcctcagcaaccgagagcctctctcttgctctcagtgtccttgctgcggcgggtggttc

SEQ ID NO: 78591 - DNA, 75 bp, Mus musculus
gaaaccaaggggcagactgaagagatggctcagatggttaaaagcactgactgctcttccagaggtcctgagttc

SEQ ID NO: 78592 - DNA, 92 bp, Mus musculus
ggaacacagtcagcagactgaactggggtgggagagaggagagagtgggcaaaggtgaccctcagaggtcatgactggaataacagggttct

SEQ ID NO: 78593 - DNA, 74 bp, Mus musculus
agtcctgaggtgacagagatgacaggcctccccatcccacttgaaacaagctctctcactgtgtcgcccaggct

SEQ ID NO: 78594 - DNA, 108 bp, Mus musculus
catagcattattaagaaaagaactgtagaggccggagagatggctcagccgttaagagcgctgactgctctttcagaggtcctgagttcaattcctagcaatgacatg

SEQ ID NO: 78595 - DNA, 75 bp, Mus musculus
gtgaattctttgacccacagatatgtgtgtgtctgtctctctgtatgcatgcatgtgtgtgtgtccatcttttgc

SEQ ID NO: 78596 - DNA, 83 bp, Mus musculus
ttgggaggctgaggcaggcagaactctgtgagctcaaggccagcctggtctacagagtaaaacctgtctccaaaccaaaccaa

SEQ ID NO: 78597 - DNA, 137 bp, Mus musculus
tacacttaccccctcccctgtgtgtgtgtgtgtgtgtacgtgcgcatgtgcatgagtgtgcttctgtgtggaggacagatgtcagcctcgagtttaattcctcaagagacatctacctcgttttcgggaaaaagcat

SEQ ID NO: 78598 - DNA, 76 bp, Mus musculus
gtcacctgtcagggggcctctgggacacactctgactcctgcatcctgaatgctgtccaggcaccagagagctgat

SEQ ID NO: 78599 - DNA, 95 bp, Mus musculus
tgagatacatgtggctactgtcacacccagtgacagttagactccttgctaatgtcctgatctgggtggacacctgggctctacaaaagatctca

SEQ ID NO: 78600 - DNA, 77 bp, Mus musculus
tcctgcctaagaatgtggggaccaggtggccactgaccacacagggaacacactgaccactcagttctaacacaggg

SEQ ID NO: 78601 - DNA, 95 bp, Mus musculus
gtcccacagtcaatctgtcagcctgtgtcactgaaaggccggtggcggcaaatgcccacaggcaaagtggccagcctgcagtgaccaagtggcac

SEQ ID NO: 78602 - DNA, 96 bp, Mus musculus
gccatcagcccccaagtggccccagacagacctctcccctctcactgtccgtctgggtggaggttccttgaagctgagtctttgggtgctcttgcc

SEQ ID NO: 78603 - DNA, 116 bp, Mus musculus
cctatccctgagccttgctgtgtgcctgcagggcagatgtggtgtctctgggctccctgcccctcactcactcactcagctaagccaggcttcactatgccggaccgtgaaatagg

SEQ ID NO: 78604 - DNA, 114 bp, Mus musculus
ggtcaagagtgggacattatggggctggagagatggctcagcggttaagagcactgactgctcttccagaggtcctgagttcaattcccagcaaccacacggtggctcacaacc

SEQ ID NO: 78605 - DNA, 96 bp, Mus musculus
gtgtccactctggctcaccatctcctgggattacagatgtgtccactctggctcactgtctcccctgggattaaaaatgtgtccaatgtggctcac

SEQ ID NO: 78606 - DNA, 79 bp, Mus musculus
tgtgtccaatctggtgcactctcttctgtgaataacagaggtatccactctggcttacagatgtctgcactatggatca

SEQ ID NO: 78607 - DNA, 85 bp, Mus musculus; identical to SEQ ID NO: 62902

SEQ ID NO: 78608 - DNA, 68 bp, Mus musculus
agggtgctgcctcagtggctctgtggctctgcctgtcccagaagctgtccggttctgtggtgcaccct

SEQ ID NO: 78609 - DNA, 91 bp, Mus musculus
gtgtatgtgtgtgtgtttgtacacctaaatgtacatatgtaagatgcatgtgtatttgtatgtgtatatgtatatatacacacacatatat

SEQ ID NO: 78610 - DNA, 96 bp, Mus musculus
gatcagccttagtccatggtggtctgataggatgcatgggacaatttcaatatttttgtatctgttgaggcctgttttgtggacaattatatggtc

SEQ ID NO: 78611 - DNA, 92 bp, Mus musculus
tcatttgtgggctggagagatggctcagaggttaacagcactgactgctcttccagaggttctaagttcaattcccagcaaccacatggtgg

SEQ ID NO: 78612 - DNA, 80 bp, Mus musculus
cagaggacccagagttgagttcccagcacagacctagggcagctcacagtctgctgtaactccaactccatgtaaatctg

SEQ ID NO: 78613 - DNA, 79 bp, Mus musculus
gagctttttaggttttcaatttgtatgtgtatgtacatacatacacacaagcccacgagtggaagctagaggacagctt

SEQ ID NO: 78614 - DNA, 111 bp, Mus musculus
gtatactggggggaatgtgtatgtgtgtgtgtacatgtatgtatgtatgtatgtatgtatgaatatatgaatgaatgcatgtgtatggggcattaacagctttacctgtac

SEQ ID NO: 78615 - DNA, 119 bp, Mus musculus
gagtgtgcactcttccactacagtcagtgtgcaaggacactagcgacatgtgagtgtgcactctcccaccacagtcggtgtgcaaggacactagcgacatgtgagtgtgcactctccca

SEQ ID NO: 78616 - DNA, 86 bp, Mus musculus
gtgaggactagtgacgcagagcaaagggaaccactgtcagtgggctcactttcacactctttctaaacgtcataaaagatcctgac

SEQ ID NO: 78617 - DNA, 101 bp, Mus musculus
cttatcctcagggatatatatatatatatatatatatatatatatatatatatatatatatatatatatatatatatatagtatctgtgtgtggttatgag

SEQ ID NO: 78618 - DNA, 130 bp, Mus musculus
gcttggttctctcggtgtctttagtgaccgctggcaggctgccgtgcagagggtcaggtcagtgtgcagacagaggaggcgtccacaaattctcctatcctccttttgcagctgtctcttgacttagtgt

SEQ ID NO: 78619 - DNA, 117 bp, Mus musculus
ccagcagtaaacgctacctgggacccactgtgtggagtgtattgttttctttattttaagatatattttgaattatacatatgcacgtgtgtgcctgtgtgcgtgcgtgtatgttgg

SEQ ID NO: 78620 - DNA, 113 bp, Mus musculus
tcaagtgagatagatggtgaggctataggcactgttaacatatatctttagtatatatatatatagcaatgtattaatgtactatgtatacagtgaaccacaatcaaaactga

SEQ ID NO: 78621 - DNA, 79 bp, Mus musculus
gggcttcgatgaggtgggctggggcctcctgggtcgggggaggcagccaacctgaccctgcctcactgaggctctggct

SEQ ID NO: 78622 - DNA, 66 bp, Mus musculus
gtgtgtgtatagctgtggataggtgcagggaggtccagacaccctcactctgtcctagtaccaggc

SEQ ID NO: 78623 - DNA, 114 bp, Mus musculus
agcaggtgggatggctcagtgggaactcagggatctgagctcagtctctgtcacccacagcagaaggcgagagctgattcctgcaatattttctctggcttctatacacgtgct

SEQ ID NO: 78624 - DNA, 96 bp, Mus musculus
gccattaggtttggtggcaagaagtctgctgaggcatctcccactttgttgagacagactctcttactgaaactgagcacacagattggctggcca

SEQ ID NO: 78625 - DNA, 82 bp, Mus musculus
gaagaaagggggggggggtagagagatggcttattgcttaagagcactgactgctcttccagaggtcctgagttcaattccc

SEQ ID NO: 78626 - DNA, 56 bp, Mus musculus
gctacagggctcccctcactcctcagatgcctctgtgtgactcagagcctcttagt

SEQ ID NO: 78627 - DNA, 90 bp, Mus musculus
gaagcatgttaatagtccaatctgcctgcctgcctgccagccaatgttacctgcctgagcattcattgtagcagttctcttacttgcttc

SEQ ID NO: 78628 - DNA, 84 bp, Mus musculus
catgggacaatttcaatatttttgtatctgttgaggcctgttttgttaccaattatatggtcaatattggagaaggtccccatg

SEQ ID NO: 78629 - DNA, 117 bp, Mus musculus
gcgggagggaacagaggcacaaccccaagtcactcacactggctgacttaatttttttctgttaagattactgattgaccatgtcaggggtggggggggtgcatgtgcaatgcctgc

SEQ ID NO: 78630 - DNA, 62 bp, Mus musculus
acagtttccagcatgacagaagtgtgtgtgtggccacacctgtcagtctctgtcctgactgt

SEQ ID NO: 78631 - DNA, 119 bp, Mus musculus
ggagggaacagaggcacaacctcaagtcactcacactggctgacttaattttttttctgttaagattactaattgaccatgtcagggggtggggtgggggggagatgtgcagtgcctgc

SEQ ID NO: 78632 - DNA, 74 bp, Mus musculus
acatgtatgtatgtatgtatgtatgtacgtgtgtgtatgtatgtatgtatgtgtgtgtgtgtgtgtgtgtgtgt

SEQ ID NO: 78633 - DNA, 86 bp, Mus musculus
ggggagagggtctcatgtagctccaggttgtgtcccactcactgtgtagctgaggatgatgaccttgaactcttgatcctctgccc

SEQ ID NO: 78634 - DNA, 85 bp, Mus musculus
ggagtccctgaaggtggcttctctgcctctcagggcctggggttctgcagggttttgaagagacgtggtggctgcacaggagtcc

SEQ ID NO: 78635 - DNA, 123 bp, Mus musculus
tccttccactgtgtgtccagggaatcaggcccctactgctgttctgtgagaggctctctctgtgtgcgaggctctccttacacagccccgaagcttgtgactcccttagttctggatgttaag

SEQ ID NO: 78636 - DNA, 86 bp, Mus musculus; identical to SEQ ID NO: 72974

SEQ ID NO: 78637 - DNA, 62 bp, Mus musculus
cctggagagggctttggggattgcactccctcttgggtgggtgcctcttagccaagggtagg

SEQ ID NO: 78638 - DNA, 89 bp, Mus musculus
ggacagagtccagagtccagagccagatgtcatgtgtgtgtgtgtgcaagagagacggggtcgggggttgagacatggtttctctgtgt

SEQ ID NO: 78639 - DNA, 115 bp, Mus musculus
ctgctctgctctcttggacttcttgagagctgttgcctgttggactcagtgtctctgtgtgagagtgctcagatgtgtgcaactgcatgcacacagaggccacagaagtacatca

SEQ ID NO: 78640 - DNA, 100 bp, Mus musculus
agccatctcgccagcccggatacttacttttgagttagatgtactgcataaacaatttcatctctctgagtctcagtttctcccaggtggagacagtgct

SEQ ID NO: 78641 - DNA, 113 bp, Mus musculus
tcctaggccgccttcttccttcctatcttttgtcagtcctgcaggtactgtatatacagaatttctttatgacatgagatcctttcacaggaccagtgcctcttgtctagtga

SEQ ID NO: 78642 - DNA, 78 bp, Mus musculus
tagagaaggtatgtcactgggggtgagttttgaggtttcaaaagtccaagccaagccctgagtgtctgtctctctctg

SEQ ID NO: 78643 - DNA, 63 bp, Mus musculus
tatgtatatatttttttgctggagatatatatatatatatatctccagcaaaacacgtgcata

SEQ ID NO: 78644 - DNA, 84 bp, Mus musculus
tgcctgtctgtctctgtgtgtgggggtatgccttgattgtttttttttttttttaaataaggaggacccagccagaacatggta

SEQ ID NO: 78645 - DNA, 66 bp, Mus musculus
caagactgaggcaggagtattgtggctttgaggccagtttgagttacacactgagactctgtcttg

SEQ ID NO: 78646 - DNA, 71 bp, Mus musculus
agggcattcaacacagtactgggaagagatactttatttcagtcattctctgtggctgtgttaaataacct

SEQ ID NO: 78647 - DNA, 74 bp, Mus musculus
atatagtcatagctatatatgtatatttgtgtatatataaacatacgtatgtatagtcttagctactactatat

SEQ ID NO: 78648 - DNA, 117 bp, Mus musculus
taaggtgaggctcagagttcagagtggcccaggagccttcagccatctgtcactcactcagttccactactccacagggctcttggtgccgcccccattccattaaaacagcttacc

SEQ ID NO: 78649 - DNA, 78 bp, Mus musculus
accgggctcagtcagcctctctcaatctgcagaaattatgggttccggcagagtgggcattgagttggtgagaaaagg

SEQ ID NO: 78650 - DNA, 86 bp, Mus musculus
acggatggcacaacattgtaggttagtctttgacacacatatatatatatatatgtcaaagactaacctacaatgtgtgtgtgtgt

SEQ ID NO: 78651 - DNA, 81 bp, Mus musculus
tttttgctatctatatatatgtgaatgtttgcttgtatgtatatatatatatgcaccatgtacatacagtactggcagaaa

SEQ ID NO: 78652 - DNA, 76 bp, Mus musculus
tcagaatggagtagaggttccgtttgtggcttgcttcttagagtgcacacacacactctgactctatgcatgctga

SEQ ID NO: 78653 - DNA, 89 bp, Mus musculus
tggagagagagagagagagagagagagagagagagagagaatatttctgtgtatatatgtctatgtctgtctgtctgtatctatgtctc

SEQ ID NO: 78654 - DNA, 87 bp, Mus musculus
gaatccatccagagtccaggtcactgctttagtatttgggagcctactcccatgtgtctggctgtctgttcctctgtccatctgttc

SEQ ID NO: 78655 - DNA, 89 bp, Mus musculus
gcctcacttatggtagactcagggaaggctgaaaaagaaacataagtctctgacattctgtgtctgagtttctctggccatcagggggt

SEQ ID NO: 78656 - DNA, 78 bp, Mus musculus
gctcagcttgtgggaggagggatttgagtcatttctcttgaggagatatgtaataatctttctagaagccaaagcaag

SEQ ID NO: 78657 - DNA, 84 bp, Mus musculus
gtggatcagtaggtcagtgggtcagtgagtcagtggatccagtggaacattgtcaacccacatattttttgctgccaagtctac

SEQ ID NO: 78658 - DNA, 88 bp, Mus musculus
gctcttgggtggatctgatgatggtatgtaaagtatcaagtatagatgttttctgccaacataccttatgaagatgataatcaagtgc

SEQ ID NO: 78659 - DNA, 79 bp, Mus musculus; identical to SEQ ID NO: 72631

SEQ ID NO: 78660 - DNA, 112 bp, Mus musculus
cactggatttgtgtttgtcttgatagtcactggacaggatccaggctctcactgtctcacagctgtccacccatggattattgcaggtattaacaattgtcattttctagtg

SEQ ID NO: 78661 - DNA, 81 bp, Mus musculus
gcagctcaattagtagagttcttggcttacaggaaggagttgggctacttctctaggaccatatgaaaacagtgtagttgc

SEQ ID NO: 78662 - DNA, 85 bp, Mus musculus; identical to SEQ ID NO: 57439

SEQ ID NO: 78663 - DNA, 93 bp, Mus musculus
gcctgcttcttggtgacaaagcaaatagtttttttttcattgactacaagaaagaaatatgcattctggctatcactttgactgacatagggc

SEQ ID NO: 78664 - DNA, 74 bp, Mus musculus
gtttgactgtgtgtctctgcatctgcttcagtaagctgctggatggagactctcagaggaccttttagccaagc

SEQ ID NO: 78665 - DNA, 117 bp, Mus musculus
ctcgggtgtgattgcctgtgaaaatggttttatttgatgttctttgtggagctttgtcaagctccatttgaaataacaagggccttcctttctgttgctcctgctcatgctgaagag

SEQ ID NO: 78666 - DNA, 110 bp, Mus musculus
agataatagatggatggcagtgtgtgggtaaatgcatggattgaatgaacaagagaactcatttagttctattggtgcctttgcctaagtgttatgattcatgaaaatct

SEQ ID NO: 78667 - DNA, 85 bp, Mus musculus; identical to SEQ ID NO: 57439

SEQ ID NO: 78668 - DNA, 85 bp, Mus musculus; identical to SEQ ID NO: 57439

SEQ ID NO: 78669 - DNA, 96 bp, Mus musculus
gatcagctttagtgtgtggtgatctgataggaatcattggataatttcaatatttttgtatctgttgaggcctgttttgtgaccaattatatggtc

SEQ ID NO: 78670 - DNA, 79 bp, Mus musculus
acttctgttagtttcactgtgtctctgtttagtttctgtttccaggatctatccattgatgacagtggggtgttgaagt

SEQ ID NO: 78671 - DNA, 79 bp, Mus musculus; identical to SEQ ID NO: 78670

SEQ ID NO: 78672 - DNA, 111 bp, Mus musculus
ccttgtaaggctcttataacttcaatatatacaataggtgtgtctagttttgggtcatgtgagaagaaagagaccaacttgttcgaagttagaattccttttagtacaggg

SEQ ID NO: 78673 - DNA, 66 bp, Mus musculus
tgtgcttgtgtgtgcatatgcacacaggtgcttgttcatctgtgtgtgcatgtgcacgtggagata

SEQ ID NO: 78674 - DNA, 95 bp, Mus musculus
catttactgtaacagggtcttagattctaagaagccctgatgttaaaggcaacttaacagagatcagagatagctaagagcctgggagatggatg

SEQ ID NO: 78675 - DNA, 85 bp, Mus musculus; identical to SEQ ID NO: 57439

SEQ ID NO: 78676 - DNA, 85 bp, Mus musculus; identical to SEQ ID NO: 57439

SEQ ID NO: 78677 - DNA, 67 bp, Mus musculus
gtctctgtatctctgtgtatgatgtatgcttgtatgcatgcacagccatacatatgcatgcagaagc

SEQ ID NO: 78678 - DNA, 69 bp, Mus musculus
gaggaccattgtctcttttctgatggagaagtgagaggttagggacacagaagagagacagtggtactt

SEQ ID NO: 78679 - DNA, 92 bp, Mus musculus
atgtgatgtgtgtgtagtgtatgtatatgtgtgcatgtgtgttgtatgtatgtatacatgtatgtgtgtgcatgtggtatgtgttttctcat

SEQ ID NO: 78680 - DNA, 59 bp, Mus musculus
tatgtatgtatgtatgtatgtatgtaacaaatgtatatatgtatgtatgtatatatgta

SEQ ID NO: 78681 - DNA, 89 bp, Mus musculus
gatttgcattttctgatggctacggatgttgattgaacatttttttaagtgtttttcagccatttgtattgagaattcttgtttagatc

SEQ ID NO: 78682 - DNA, 85 bp, Mus musculus; identical to SEQ ID NO: 57439

SEQ ID NO: 78683 - DNA, 110 bp, Mus musculus
caggcagcacttccatcatctttatatgtgttcattgtttagatgtgtgttcaacaaaccatccctgtctgactgagttggtgttcacatggtgtgtggggtgactcctg

SEQ ID NO: 78684 - DNA, 106 bp, Mus musculus
aaatctttctggatatatatacatacatatatatatatacacacatatatatatatgtatatatatgtgtgtgtatatatatatgtatatatccccaggaagtttt

SEQ ID NO: 78685 - DNA, 106 bp, Mus musculus; identical to SEQ ID NO: 63491

SEQ ID NO: 78686 - DNA, 105 bp, Mus musculus
tggtggtctcactgagaatactattctattccataaaaattactgatattctagtaattattatggaatataagtaaatgtagtgtgttagtaatatgttcacca

SEQ ID NO: 78687 - DNA, 96 bp, Mus musculus
ctggtaggttgttcctacctcagcagttaatgctgctgtgtgatgggaatgcggacagacaggcagacagacagacagacaagcaagtgctttagg

SEQ ID NO: 78688 - DNA, 85 bp, Mus musculus
tcctaaagcacttgcttgtctgtctgtctgtctgcctgtctgtccgcattcccatcacacagcagcattaactgctgaggtagga

SEQ ID NO: 78689 - DNA, 114 bp, Mus musculus
cctggttccattcttaattattaaataccaactctgaaagatattttttcaatattaagaaaagtatatcttatagtaattggattcatgattcattaacaggaatggttatgg

SEQ ID NO: 78690 - DNA, 118 bp, Mus musculus
atttttgtatctgttgagccctgttttgtgaccaattatatgctcaatttttgatatttatttttcaggagtgatacatgggccatggctcacaggtcagagagcaacatacaagagt

SEQ ID NO: 78691 - DNA, 76 bp, Mus musculus
ggtatgctatgtgtatatatgtatatgtgtgtaaatgcttgttatatgtgtgtatatgtatgtatatatgtgtacc

SEQ ID NO: 78692 - DNA, 85 bp, Mus musculus
ggccatggtggtctgataggaaacatgggacaatttcaatatttttgtatctgttgaggcctgttttgtgaccaattatatggtc

SEQ ID NO: 78693 - DNA, 85 bp, Mus musculus
gtccatggtggtctgataggatgtatgatacaatttcaatatttttgtatctgttgaggcctgatttgtgaccaattatatggtc

SEQ ID NO: 78694 - DNA, 65 bp, Mus musculus
ggagtagatgaggttttcttgttgtcttgaagcaaagaggatgggatcaagatcacagtttaccc

SEQ ID NO: 78695 - DNA, 64 bp, Mus musculus
atgtatgtatgtatgtgtgtatgtatatgccatggtgtgtgtgtgtgtgtgtgtgtgtgtgtgt

SEQ ID NO: 78696 - DNA, 80 bp, Mus musculus
ttgtgagtggtcatgtcaaggccagtggagaagtggtttgggcttttattctgtcactttctgactgtgttcataagcaa

SEQ ID NO: 78697 - DNA, 104 bp, Mus musculus
ctggtttctattcccagctttatcactgttagatatttggcaaatggtgtatgtctctgtgtctgtcttcctgtgtcaaagtgctcactcataatacagactag

SEQ ID NO: 78698 - DNA, 79 bp, Mus musculus
tctcagaagggagtgtgcacaggtgaaagccctgggaaaggcaggaggtttctgtccctgctacacacaccagatgaga

SEQ ID NO: 78699 - DNA, 88 bp, Mus musculus
tggtataactgggccgtattatagtacatgtacatgcacaactgagtggtctcagcatgttgtatctatatttatgcaaatatacaca

SEQ ID NO: 78700 - DNA, 83 bp, Mus musculus
ggctgtagcccttttcactgccctcttatattgttctagaagttctgagaacagtgacaggaattgcatgtggtggaccagcc

SEQ ID NO: 78701 - DNA, 71 bp, Mus musculus
tttggatctcatttcttcagtggatagttgtcaggggaggaagtcctccattgaagtaagaaagagacagg

SEQ ID NO: 78702 - DNA, 121 bp, Mus musculus
ttggcaaatccctgaagattcccattgtcctgtagagtggaggtaaaggaaactacagaagtttgtgccaaattctttctagttgaatgggctccgttttcttcatgtcaatggttcttta

SEQ ID NO: 78703 - DNA, 113 bp, Mus musculus
gtgcatgtatctgtgtatgtgtgctcacatgtgtgtgtgtgcacgtatctgtgtatgtgcgctcacatgtgtgtgtgtgtgcatgtatgtttatgtgtgtatgcatgcatgtg

SEQ ID NO: 78704 - DNA, 98 bp, Mus musculus
cttcctcacacattattagactagttattatgtagttttccttacacaatgcttgtattcatgaagctacatgaatagctacataaaggtacatgaag

SEQ ID NO: 78705 - DNA, 75 bp, Mus musculus
ggtttactatggaatattgcaggtgataatggagaccagaggactactggtatgttgtctgcaagctggagtacc

SEQ ID NO: 78706 - DNA, 89 bp, Mus musculus
tgtggtgatctgataggatacatgggataatttcaatatttttatagctgttgaggcctgttttatggtcaattttatggtcaactata

SEQ ID NO: 78707 - DNA, 74 bp, Mus musculus
ggtcttcagagatgagaacattcacataaatgactctgtctcagtgttagatgtaagtgggctcactccagact

SEQ ID NO: 78708 - DNA, 56 bp, Mus musculus
atgtatgtagatggacataccatatatatggtatcaatctgtctgtctgtctacgt

SEQ ID NO: 78709 - DNA, 63 bp, Mus musculus
ttacacatatgtatgtatgtatcatgcatgtatgtatgtatgtatatatgtatgtatgtgtaa

SEQ ID NO: 78710 - DNA, 87 bp, Mus musculus
aagtcaggctttcttgtatgtgattgatgttctttgtatatatttaacagaagaacttcggccagctcatcactactagttaggctt

SEQ ID NO: 78711 - DNA, 68 bp, Mus musculus
ggttgatcacagtacagtgtgtgcagcagtcctgctactccactctgcagctctggcttgtaacagcc

SEQ ID NO: 78712 - DNA, 110 bp, Mus musculus
tcttctctttcatacgggggatttggctggcttgaacataggaaggcactgtgcacactgtcgcagtctctgtgaggccatactgtatcagccctgttgtatctggaaga

SEQ ID NO: 78713 - DNA, 66 bp, Mus musculus
tggatagaccacagcctgaataatggctggctttattgatggcctttcagtcagtctgtctgtcca

SEQ ID NO: 78714 - DNA, 113 bp, Mus musculus
ctatcatgtgcaagatctgggcaaatgtctttgcattggctttccctctattttgttagtggaagtgatatgttttaaagcatgagatcaggtcttttgggctgggcatgtag

SEQ ID NO: 78715 - DNA, 88 bp, Mus musculus
tctgtctgcctatctctctgtctgtatatgtttgtgtatatacataaaatgtctcatgtgtgcaggtctaaggcgatcagaagagggg

SEQ ID NO: 78716 - DNA, 119 bp, Mus musculus
agacagttcactagtgccctgcaagcaaggaaggaatttcaaattcacaggagacacagaggagtgacaactggaggctgactgcattacttcacttgcaagtacgactgtgatggttt

SEQ ID NO: 78717 - DNA, 72 bp, Mus musculus
ggtccaacagtgtcagtgtcacctggaccatatagtgtggctctcttgaggtgaacccatagacctgggacc

SEQ ID NO: 78718 - DNA, 81 bp, Mus musculus
tgatctgataggatgcatgggacaatttcaatatttttgtatctgttgaggcctgttttatgacaaattattttgtggtca

SEQ ID NO: 78719 - DNA, 116 bp, Mus musculus
ttcctttcagaaagaaaaggccaaggttcatgttcgccctgaggaagatacatgctttcaaagtttttcaagctgtagattttaggtcgtcataaaggacttttagatgaagggaa

SEQ ID NO: 78720 - DNA, 108 bp, Mus musculus
gcatgttaaggatgtggagagtgcaggccagctactggtgactcacactgctttagaattcagtgttcatgagcatgctgtgctctgcttctcagaagtacggtgtgc

SEQ ID NO: 78721 - DNA, 108 bp, Mus musculus
aaaacatagcatatgggtgacttcatgctgcatgggagccaatgttcactggattgaagactggagaaagggctgcttgataagatggaggctttgttttgttttgtt

SEQ ID NO: 78722 - DNA, 85 bp, Mus musculus; identical to SEQ ID NO: 57439

SEQ ID NO: 78723 - DNA, 101 bp, Mus musculus
gtgaagtatgcatacttttgcaagtttaatacatttatttataagttaacattttaaaagtttgtgtgaatgtgtgtgtgtgtgtgtgtgcaatgcatctc

SEQ ID NO: 78724 - DNA, 67 bp, Mus musculus
cgttgtcattctctgtgaggtaatcaactgggctacagacatggtgggccacatgaagaatgcaatg

SEQ ID NO: 78725 - DNA, 78 bp, Mus musculus
tctctatctatctatctatctatctaccatctgtcatccatctctgaaggatgtaggtagtaaagtggttaggagaga

SEQ ID NO: 78726 - DNA, 63 bp, Mus musculus
tgggtcagagatgtgactgaggaatgggaaaccccatccctcacttaatgtcctgtcttccta

SEQ ID NO: 78727 - DNA, 108 bp, Mus musculus
atcatttattatataattttagtttagtgtattatgtgcatatgtatatatgtatgtataagcagatgtatattgttagatataatttttggttgataatattatgat

SEQ ID NO: 78728 - DNA, 70 bp, Mus musculus
gtcagttttttataggtagagtagtgtaaatgatacacaggtgtgctggctacttctctgccaagttgac

SEQ ID NO: 78729 - DNA, 89 bp, Mus musculus
gcttcagaggttccctccctctctctcactgagtgattgcctgcctgcagctttcttctgtagggatgagttggggtggacccgatggc

SEQ ID NO: 78730 - DNA, 63 bp, Mus musculus
gggctgaggtagcagaatgaaccttgttttgttttttcgagacagggtttctctgtgtagccc

SEQ ID NO: 78731 - DNA, 74 bp, Mus musculus
gagatggggctggagaggtggcttattggttaggaacactgactgctcttccagaggtcctgagttcaattctc

SEQ ID NO: 78732 - DNA, 92 bp, Mus musculus
aatagatcctcaaggtctaacaccaggcccaggtacgtccatacaactctgtctatgtctgtgcctgcaagcctagagacctaaactctatt

SEQ ID NO: 78733 - DNA, 113 bp, Mus musculus
catttgaaaaggtaccacaggggctggagagatggctcagcagttaagagcactgactgctcttccagaggtcctgagttcaaatcccagtaaccacatggtgaggtcggatg

SEQ ID NO: 78734 - DNA, 91 bp, Mus musculus
ggaagtgaagtgctgtgtgtcctgtaagtgggtgtgtaacatggaagcactgctcttccttctctgccaccaggatctgctctcagtgcat

SEQ ID NO: 78735 - DNA, 91 bp, Mus musculus
aagctgaggctcgtctttgtctctgtgtatgtgtcttgcaaatgcactggattttgcagcactcattgcttgagtacgaggcttcttcagt

SEQ ID NO: 78736 - DNA, 95 bp, Mus musculus
gctacagctacaggctgaggacagttggctaagaagtgattttgttgctgtgataaatctgtgtagccaattgtatctcaagctagttacagagc

SEQ ID NO: 78737 - DNA, 84 bp, Mus musculus
tgtgtgcatgagtatgtgtgtgcatatgcatgtgtatgtgtgtgcatatatacatgtgtatgcatatgtatacgtatgtgcata

SEQ ID NO: 78738 - DNA, 75 bp, Mus musculus
tactttgtgactttgggtgtcttctggccacattcttctatgacttccctgagaagacacactggacacagagtg

SEQ ID NO: 78739 - DNA, 85 bp, Mus musculus; identical to SEQ ID NO: 57439

SEQ ID NO: 78740 - DNA, 65 bp, Mus musculus
gggaaagatccaaaagggaaagggaagatttttttttcttcttctagaattttgtctttcttccc

SEQ ID NO: 78741 - DNA, 97 bp, Mus musculus
tctaagagtgactactctattcttgtctctctgtctgtgcgtgttagagccccaacagcaaacagggggcacactggcacctgtgatcaatcttaga

SEQ ID NO: 78742 - DNA, 91 bp, Mus musculus
gcagtttgtaggcgaataggtatgattgttccaataaaactttatttataagattaggtggaacacagtatatgtctgtctataatctagc

SEQ ID NO: 78743 - DNA, 117 bp, Mus musculus
cagtggtatctcttcaaagtgaatttttaaacagctcatttgtatgacatcagcaaggatatgttttgaatagaagtagcatggttttgaaaaatccccagtttggaagaattactg

SEQ ID NO: 78744 - DNA, 111 bp, Mus musculus
gcagctttgtaaggacacctatatatacactatgtaaatgtgtgtgagcacgtatgtaaacatatatgtaaatgtgtatcgcatgtgtagggtgcatgcatgtgtggatgc

SEQ ID NO: 78745 - DNA, 88 bp, Mus musculus
acataaagagggaaaacagaaaaggatgcgtcgcctcacaaaaggtactcagtgaagggaacgggtctctctctctctctctgactgt

SEQ ID NO: 78746 - DNA, 124 bp, Mus musculus
gtcttcccggtcccccacccctatgaggagagcagctgtttctcaccgtgatgctctctgtctatctcactggaggaccaaaatgacagcaccaacgaaacatggacaaaatagatctctcctc

SEQ ID NO: 78747 - DNA, 102 bp, Mus musculus
gcaaggaacatttgcaggtaaagttgtttgggcaaaggggtgtactgtgtgacacacggacacactgtgacatactgcagcgtccatggaagggtggtttgt

SEQ ID NO: 78748 - DNA, 88 bp, Mus musculus
ttccagcagaattatgagactgtacaaacagggacaaccttaactctcttctaatttttgtctctggaagacttgtgagaccctggaa

SEQ ID NO: 78749 - DNA, 85 bp, Mus musculus
gaccatggtggtctgataggaagcatgggacaatttcaatatttttgtatctgttgaggcctgttttgtgaccaattatatggtc

SEQ ID NO: 78750 - DNA, 81 bp, Mus musculus
tatttatttatttatttatttatttatttatttatttatttattgagtgagtgagtgagtgagtgagtgagtgagtgagtg

SEQ ID NO: 78751 - DNA, 79 bp, Mus musculus
acttctgtaagtttcactgtgtctctgtttagcttctgtttccaggatctgtccattgatgagagtggggtgttgaagt

SEQ ID NO: 78752 - DNA, 88 bp, Mus musculus
ccaggataggtagatacctcagcacagtgtctttctccctcacactcacagttagtctttcttatgaggtaatatgtatttgtcatgg

SEQ ID NO: 78753 - DNA, 104 bp, Mus musculus
agcctgctgcttcctgggacccccccccaagaacactggagaagagtacctgcaacctcaggcactcagtctcacactctgacaaagtcccatggcaaactgct

SEQ ID NO: 78754 - DNA, 91 bp, Mus musculus
gtgtgtgtctgtgtgtgtgtgtatctgtgtgtgtgtgtgtgcccatgggacagcactggcatctagaaaatgatcacttaaagactggcat

SEQ ID NO: 78755 - DNA, 64 bp, Mus musculus
ctggcctcggggtgcagagagtagtgggcatcggtgcaaggacagtcactttcactctgagcag

SEQ ID NO: 78756 - DNA, 60 bp, Mus musculus
gagtggtgttgagtggtttaattaagctcagtgacgtgagccagtcactcacactcattc

SEQ ID NO: 78757 - DNA, 102 bp, Mus musculus
atcaatatttatatataatcaataatatcaatatacaagatacactagtatatatatgtatgtgtatatatagatagatagattatagatatagatatagat

SEQ ID NO: 78758 - DNA, 89 bp, Mus musculus
ctctggtctatgagaatgaggaaaatgccatgtggagtcaggaaatgtccaggtctcactctgccactcgctcatttttgcctcttggg

SEQ ID NO: 78759 - DNA, 85 bp, Mus musculus
gtccatggtggtctgataggataaatgggacaatttcaatatttttgtatctgttgaggcctgttttgtgaccaattatatggtc

SEQ ID NO: 78760 - DNA, 93 bp, Mus musculus
gctgtggtgtccgtatggagcaaagatggagtggcaagtgtgtctgttactcacagtgtagcttcctcctgtgcgagtgacgtgtgcaccagc

SEQ ID NO: 78761 - DNA, 93 bp, Mus musculus
tttactcaaacagacttacttttagtacttttagttttcaactaggtgctcgccactgaagactgagaggagaaatttatgttttacagtaaa

SEQ ID NO: 78762 - DNA, 108 bp, Mus musculus
aggtgtaaggacgtgggttcaatcctcgacactacagtgaatgaatgaatgaatgaatgaatgagtagaagctgagtccccgaggagtagaaggagcttatgggccct

SEQ ID NO: 78763 - DNA, 78 bp, Mus musculus
acagtgaggatgcagtgtgcacaatgaagatgcagtatggactgtgaggattcagtgtggacagtgggggtgcagtgt

SEQ ID NO: 78764 - DNA, 58 bp, Mus musculus
ctctgtgcctgtgtgcctgtgtgcctgtgtgaagcaattataaagcatatggacagag

SEQ ID NO: 78765 - DNA, 82 bp, Mus musculus
gggtgttattcagaaaagtcacagtttggtcttagagtctcactcagtcttgaccttagaacttgaaaattgaaaagcacct

SEQ ID NO: 78766 - DNA, 78 bp, Mus musculus
gtgtatgtatgtatgtgtgtatgtacgtatgtatgtatatattatgtacgtatgtatgtatgtatgtattatgtatgt

SEQ ID NO: 78767 - DNA, 119 bp, Mus musculus
catgtgtatatgtgtgtatgcatgtgtgtgtgggtatgttcgtgtgtatatatgtgtatatatgtgtatatatgtggggggtatgttcatgtgtatatgtgtgtgcatgtgtgtgcgtg

SEQ ID NO: 78768 - DNA, 101 bp, Mus musculus
tcttctgtgggactggagttcactaagaggaagcaggagaatgggtaacttactctctctaactctcctttacaagtcttttctcgttgcaacattctgga

SEQ ID NO: 78769 - DNA, 61 bp, Mus musculus
cgtctgactctgtgtctctgctgtctggatgtctgaagctgggggcaataggtgttgggtg

SEQ ID NO: 78770 - DNA, 113 bp, Mus musculus
ggggttcttggctgtaacttgggcttggtggggaattaaaatgagtgaactgagtcaggagccactgtagcgtccttgtgtgccccaccagtccatggttcactggggatgtc

SEQ ID NO: 78771 - DNA, 70 bp, Mus musculus
gccttccatgttgctctgtaactctgagccactctgtgtttagttgggtcgggctgggccaatgagaagc

SEQ ID NO: 78772 - DNA, 78 bp, Mus musculus
gtgtaggtgtgcatgtatatgtatgtgtatatatgtatatgtatgtgtgtgtatgtatgtgtacatgtatgtgtgtgt

SEQ ID NO: 78773 - DNA, 108 bp, Mus musculus
aggaaaattatcaatgagttggtatgtagtttattcttatatttatcatgattaatttgcatggagccaaattattaagcaacttcagactgacttattgtagaccct

SEQ ID NO: 78774 - DNA, 120 bp, Mus musculus
gtgtgtgtgtatgtgtatgtatgtgtatataacatgtatatatgtatatatacacatgttatgtatatatatatatatacatgtatatatgtatatatatgtgtgtgtgtgtgtgtatgt

SEQ ID NO: 78775 - DNA, 68 bp, Mus musculus
gacacagagtcacccagtgtctggctctcacttgctctgtggagctcagtttactgtaattttgtgtt

SEQ ID NO: 78776 - DNA, 73 bp, Mus musculus
gagaccccagagagttaggactgtgaactctgttatcagattcttgatgatcctgatttgtctgtggacactc

SEQ ID NO: 78777 - DNA, 71 bp, Mus musculus
gagcagaaggatggatgtgacaatttctacccagtggtggtctgactctgtcacacagcattgtttgactc

SEQ ID NO: 78778 - DNA, 68 bp, Mus musculus
tgtgtatgtatatgtatgtgtatatgtatgtatttgtgtatacatgtatatatgtgtgtaggtagata

SEQ ID NO: 78779 - DNA, 99 bp, Mus musculus
tgtgtgtgtgtgtgtaaatatgtacatgtatgtgtatgtatatgtgcatatgcatgtatatgtgtatttgtgtttatacgatatatgtgtgtgcatgta

SEQ ID NO: 78780 - DNA, 84 bp, Mus musculus
gtcttccttctatatggatatctatagtgaaggtcggttgttatacatgtttctttataaatattagatgtaggttggaaagac

SEQ ID NO: 78781 - DNA, 85 bp, Mus musculus
ttaacctggagccttacaacgtctctgaaagctaggtattagtctatttttatagatgatgaagattttaagtctcagaggttaa

SEQ ID NO: 78782 - DNA, 106 bp, Mus musculus
ttctgcttaaacatttttctcctattctatagataatttgtatttgtcagagataacaaagaatgttaaattatggtgaggtttttaggagacaaatgaaagtgaa

SEQ ID NO: 78783 - DNA, 113 bp, Mus musculus
gctgcggcaaccctcctggatcagaatgatgaactaatctgcagattgtctgttgccaaactgttgtcagcagattggtcatttgtaaaactgactctgcattgtttctcagt

SEQ ID NO: 78784 - DNA, 102 bp, Mus musculus
ggtcactgttatagataacaatatgtatacatggttctgtctctgaagaagtctgtataggcaagctccatgacatctgtggtggttttaatatgcgtggcc

SEQ ID NO: 78785 - DNA, 75 bp, Mus musculus
ggagcacagacacatcagctctgacaaactgaagtcgtgaagacacaggtcagagaacagagtgtgctgatgcct

SEQ ID NO: 78786 - DNA, 79 bp, Mus musculus
ttcaagttgatttgtcagtcattttgtcacagcagtgagaaaaatgatgaatgtgatgggtatgtaagaacaacttgag

SEQ ID NO: 78787 - DNA, 82 bp, Mus musculus
agagcaaaggctgtgatggctttgtgtgatgtgtctgaggtcagcaccacccagcacatctccatcattacatgtttgcttt

SEQ ID NO: 78788 - DNA, 88 bp, Mus musculus
atatatgtatgtacatatacatatatatgtacatgtctatatatgtgtatatgtatatgtgtatgtatatgtatagtgtttcatgtgt

SEQ ID NO: 78789 - DNA, 88 bp, Mus musculus; identical to SEQ ID NO: 78788

SEQ ID NO: 78790 - DNA, 111 bp, Mus musculus
gaaaccactgtatgtcctggtttttatctagtgtcttgataatctgagcaccactctggggctgagtgtactgagtgtgcagctaaataccaacatttttcaaagtatgtc

SEQ ID NO: 78791 - DNA, 79 bp, Mus musculus
acttctgttagtttcactctgtctctgtttagcttctgtttccaggatctgtccattgatgagagtggggtgttgaagt

SEQ ID NO: 78792 - DNA, 71 bp, Mus musculus
actagccagagatgagagagtccacacttaagatgataagtgaccctgccctcaagttatttctgattggt

SEQ ID NO: 78793 - DNA, 109 bp, Mus musculus
atatatatatatgtgtgtgtgtgtgtctatgtatgtatatatatgtgtgtatgtgtgtctatatatgtgtatatatgtgtatgtgtatctgtgtatatatatatgtgta

SEQ ID NO: 78794 - DNA, 84 bp, Mus musculus
gtatgtttatgtgtatgtgtgtgtgtgtgtgtgtgtgtgtgtgagcgcgcacacatgtgcacatgtctacatacacatgcatat

SEQ ID NO: 78795 - DNA, 88 bp, Mus musculus
atatgtatatgtattatacacacacacacatattttatatatatacatatatatacatatatatgtgtgtgtatatatatgtatatat

SEQ ID NO: 78796 - DNA, 81 bp, Mus musculus
tctctctctcacatgtaatacatatgtgtgtatgtatatatgtatatacatatatacatatagatgaatgatagctagaga

SEQ ID NO: 78797 - DNA, 60 bp, Mus musculus
gtatgaatgtatatatgtatgtatgtatctatatggatatacatacatggatacccatgc

SEQ ID NO: 78798 - DNA, 100 bp, Mus musculus
ctttatcattgcacatatgtatgtataaatgtatgaatgtattatagtgatacagagttatatttgtttatatatatgtatatttatatgtataataagg

SEQ ID NO: 78799 - DNA, 106 bp, Mus musculus
atactatgaaccatctctgcatccctgggttgatgtatatttgattatcaaagatgatcattttgatgtattcttggattcattttgcaagaattttattgagtat

SEQ ID NO: 78800 - DNA, 107 bp, Mus musculus
tcctgcacacactgcagacgagagtatacatggtgagggaagtttgagaaattattctgtttcaatttgtatgaataactatgaactctcatctcaagggggcaaga

SEQ ID NO: 78801 - DNA, 71 bp, Mus musculus
ttcaggagcatcaatgatatctccttggaagagaatctcattttctcttatagaatgtattgatgtctgaa

SEQ ID NO: 78802 - DNA, 71 bp, Mus musculus
tgaactctgcctctctctggccctccatagcctaatgtgctcacgtcagaacttgggatttgcagagtgca

SEQ ID NO: 78803 - DNA, 85 bp, Mus musculus; identical to SEQ ID NO: 57439

SEQ ID NO: 78804 - DNA, 116 bp, Mus musculus
gagtaagtgaagttgctgagagtgagctaatcaaccaatcctccacttgcacatgcctgacagatgtgagacaggagcgactgaaggggatcatactccagctacaaagaatattc

SEQ ID NO: 78805 - DNA, 107 bp, Mus musculus
ctgatctttctcatttcatttctgcagtgaagacaatgggtattgtgttggataaagtgctgacagtggacatcaatgttttccagatcctgaaagaaagcatacag

SEQ ID NO: 78806 - DNA, 117 bp, Mus musculus
gcctgactacataaaaaggggaatgtgagctcagtacaagcactcattgctttctgcttcttttctatagaggcaagaagaccagtgctttcaagttcccactgcggttgcttctct

SEQ ID NO: 78807 - DNA, 93 bp, Mus musculus
ggattgacttctgtatctgaatctctctgcttctcattccatccatccacacaggaagctaggactcaaagagagataggaggagaagaatct

SEQ ID NO: 78808 - DNA, 96 bp, Mus musculus
catggccagcttagagtgtgactgactcagtgcctccctgtcctatagggactgtggaagcaaatgtgtttgaaaacactttaaataaaagacatg

SEQ ID NO: 78809 - DNA, 89 bp, Mus musculus
gtctgtctcagtcaggatgagttttgtttttctagcatggaggaagttggctctaaacacaatgtcaccaagtggctgagattaatggc

SEQ ID NO: 78810 - DNA, 83 bp, Mus musculus
gaatctaaaactgagtgctggctgtgtatgttgtaaatgccctcctcaacacatgctggcagcctctgcatcacgatctgttc

SEQ ID NO: 78811 - DNA, 70 bp, Mus musculus
ctaatctctctgcctctctgtaactttctctccatataaataaaagacagacagacagacagagagatag

SEQ ID NO: 78812 - DNA, 57 bp, Mus musculus
ctctgtctgtctgtctgtcttttatttatatggagagaaagttacagagaggcagag

SEQ ID NO: 78813 - DNA, 83 bp, Mus musculus
gtgctgaaacacagacggaggtcagtgtctcacactctgctactaaaagggttgacatgctgaatcctctggaagacagccac

SEQ ID NO: 78814 - DNA, 85 bp, Mus musculus; identical to SEQ ID NO: 57439

SEQ ID NO: 78815 - DNA, 128 bp, Mus musculus
tgcgcgtgcaaggaggagcttagtatgatgtcaaagctcctgggctccccttgcaacgctcactctgtctctcttcctgggcgtcagcgacctctgctgggcctcaaattcaggcttcgacagttgcg

SEQ ID NO: 78816 - DNA, 97 bp, Mus musculus
ggtaagttccgagcccaggggaggggcagttttccacatagactttctccttagctcaccctgctttgatctgggatcttgcctgctgtggatgtcc

SEQ ID NO: 78817 - DNA, 98 bp, Mus musculus
tagctacagatctaatgggatggtcttaaagaaaagtgtggttgttatatgcatgagatacactcagacactcacacactgggaccaatctgttgttg

SEQ ID NO: 78818 - DNA, 97 bp, Mus musculus
cctcttcagcaactgccaagggtctgtctgtctgtctgtcttcactggcactacagttgacctgactcaagcatgcagaggcaagccctcactgcag

SEQ ID NO: 78819 - DNA, 81 bp, Mus musculus
cctctgcatgcttgagtcaggtcaactgtagtgccagtgaagacagacagacagacagacccttggcagttgctgaagagg

SEQ ID NO: 78820 - DNA, 79 bp, Mus musculus
gctgactccctctgtgactgatgtcgcctgctctgcagagccctgcacagttggactgtggtgcggaaggctagtgggt

SEQ ID NO: 78821 - DNA, 110 bp, Mus musculus
ctggaggccactgctatgtattaataagtggactgaaatatttggcagcaggttgctcacttctgtctgtattagcagtgcacttttggatcatcaaagtggagtgccag

SEQ ID NO: 78822 - DNA, 119 bp, Mus musculus
gaaccatatattgagattgctgtcagagataagcatgcatactcaccattagaaatgcaaagtatttaaatatgtacaagggtatcacggatgctttctctcatattcttatagtgttc

SEQ ID NO: 78823 - DNA, 82 bp, Mus musculus
tacagctctctgactcagagcagccttcagtccccacaacaggggacctcagagcctgcattttatgtttcaatctgctgtg

SEQ ID NO: 78824 - DNA, 82 bp, Mus musculus
gtgtttatatgtgcatatgcatgtttatatatcaatgaatatatctgtatttgtatgcttatgtatgtgttcatatgagcat

SEQ ID NO: 78825 - DNA, 66 bp, Mus musculus
gtgcgtgcatgtgtgcatgtgcgtgcatgtacacatacacacacacacacacacacacacacacac

SEQ ID NO: 78826 - DNA, 87 bp, Mus musculus
ggggtctgcacccacaagactgacgtggagggggctcagcggtgggaagcactgactgctcttccagaggtcctgagttcaattccc

SEQ ID NO: 78827 - DNA, 92 bp, Mus musculus
ggacactgatggagcaggaaggtcagctgggtgctttctctgcctctctgagttagccggcttccaccacagcatctggctcctgagtgttc

SEQ ID NO: 78828 - DNA, 117 bp, Mus musculus
gcccatgttgaggccgaagcaccagagggtctcttgtcagcctggtggaatagtcaacacagacaagaaagacagcaggcagcagagtcccatgtgcagatggagatcagagagggc

SEQ ID NO: 78829 - DNA, 98 bp, Mus musculus
ttaggatgtagaagcaggaagaccacaagttcaaggcctgcctgagccacatgtctcagttgactgccaggagctgtctgattgaagctatcttttaa

SEQ ID NO: 78830 - DNA, 88 bp, Mus musculus
tgactgtctgtctatatgtctgtctgtctgtgcttgtgggtatgtttataggtatccgtggtggccagagtcattggatcccccagca

SEQ ID NO: 78831 - DNA, 115 bp, Mus musculus
gtagaaaatgctacatgaacattttgattatatgtgtatattatacatctgtgtctctatatatttgtgtgtatatacatgtgtttctattatgtgcatgtagatatgtgtgtat

SEQ ID NO: 78832 - DNA, 95 bp, Mus musculus
gattgtggtcaaaacatgacacctgagagtgtgcagagctgtgaggtcaggggtctggaatttggatttttatgtcaagtttgaggaacaccttc

SEQ ID NO: 78833 - DNA, 61 bp, Mus musculus
tgcagactcaagctttgcctcccgctggaaaaggacctgggtcacagtgtctgagtctgta

SEQ ID NO: 78834 - DNA, 72 bp, Mus musculus
aacttaatgactaggttggagagatggctcagctgttaaaagcactgactgctcttccagaggtcctgagtt

SEQ ID NO: 78835 - DNA, 81 bp, Mus musculus
gtggtgactgattagagagagctgagaatgaaagcgatgtcaatcactgttatgctgtgacttctgtgatttgtcacttac

SEQ ID NO: 78836 - DNA, 87 bp, Mus musculus
ccaagggtttgggggaacattcaacctgtcggtgagtttgggcagctcagacaaaccatcgaccgttgagtggaccccgaggcctgg

SEQ ID NO: 78837 - DNA, 112 bp, Mus musculus
gcccccctcactgtgcctcggacggctggggttcctggggatgggatttgatgccagtcacaaatcacattgccagggatttccaactgaccctgtgctctgccttgggggc

SEQ ID NO: 78838 - DNA, 79 bp, Mus musculus
ctgaggagcagggcttagctgcttgtgagcaaggtccacagcaaagtcgtgttcacagtggctaagttccgccccctgg

SEQ ID NO: 78839 - DNA, 117 bp, Mus musculus
ggctctgcctctctccgggctccgcctcccgtgcctactgagctgaaacagttgattccagtgcactggctcagttcagcaggaacaggagtccagccccctaggagctggcaaccc

SEQ ID NO: 78840 - DNA, 70 bp, Mus musculus
acatctgtctgtgtctgtgtgagtttatgtcaccacaagtgtacaggtgtccacagaggccagaaggtgt

SEQ ID NO: 78841 - DNA, 126 bp, Mus musculus
ggcatttcctcaggcaagtctcctattcccagatgtcacttagctgtgtgaagctgacagaagatagccagcacaatgcctttttgctatgtgattcggtagatggagcctggagtcctcttgacc

SEQ ID NO: 78842 - DNA, 111 bp, Mus musculus
tgggactttaaaagatgatatgtgggctggagagatggcttaggggttaagagcattgactgctcttccagaggtcctaggttcaatttccagtaaccacatggtggctca

SEQ ID NO: 78843 - DNA, 68 bp, Mus musculus
caaaatacctgaggcagtaagcaggtaaggaggaaaagcctattctgactcactgtctcagggatttg

SEQ ID NO: 78844 - DNA, 136 bp, Mus musculus
tacatgtatgtatatgcatgtgtgtatatgcatgtatgtgtgtatatgtgtgcatgtatgttcatgcatgtatgtgtgtatatatgtttgtatgtatgtatgaatgtggatgagtgcagtgccatagtgtgcatgt

SEQ ID NO: 78845 - DNA, 161 bp, Mus musculus
acatatgtatgttgtacaaatatatatatatatatatatatatatatatatatacacacacatatatatatgtatatatatacacacacacatatgtatgtatatatgtatacacacacacatatatatatacacacatatatgtgtgtatatgtatgtat

SEQ ID NO: 78846 - DNA, 80 bp, Mus musculus
atatacatatatatataaagacctcccctttaaattttatatatataaaatttaagacgtgtgtgtgtgtgtgtgtgtgt

SEQ ID NO: 78847 - DNA, 77 bp, Mus musculus
gtgtattcatgtgtatgtatgtatatgcatatatatgtatgtatgtatgtatgtatgtatgtgcatgtgtaggacgc

SEQ ID NO: 78848 - DNA, 73 bp, Mus musculus
tctgatcagtggattaaagtctggatctacagggtaggacaggcatcgagactttacagactccaccattaga

SEQ ID NO: 78849 - DNA, 80 bp, Mus musculus
gctcaaaggggtcagggtgtgcatgtgtgtgcatatgtgtgtgtgtgtgtgcatatgcatgtgtgtgagtgtagttgtgc

SEQ ID NO: 78850 - DNA, 80 bp, Mus musculus
gcatctgatttctggcctgcctctacaacctgaatcctgtcctcccagggcagggactgttgtctgtctgtctgtcttgc

SEQ ID NO: 78851 - DNA, 105 bp, Mus musculus
aggggataagagtgccgcctaataatactctcttgagccagttcagagcttggggcgtgtgtcagtcaggagagagggcggtaacaagcatcccctgagctgtgg

SEQ ID NO: 78852 - DNA, 90 bp, Mus musculus
taacaaaggtcacatttcatggcaggggaactagggtggagatggctggcagcctctgtcactgaatttcttgtctgagttccattgtta

SEQ ID NO: 78853 - DNA, 93 bp, Mus musculus
ggtcaggccaccggacaggtgagtccagagggcgcaggaggccctgtagcctcatctctttgtctgtgtgtctgtctctctgtctgtctgtcc

SEQ ID NO: 78854 - DNA, 113 bp, Mus musculus
cctggattcaggcccttggaaatgctagacacaactgctggcaaattatggcaccagccaacattgccaggagtggatttgtctgtaaagaaggcaggactatgggcagcagg

SEQ ID NO: 78855 - DNA, 111 bp, Mus musculus
gccagagaagctgactgctaagtttctagtgcagggatcaggtagtattatgtatcatttactaagaggagagaggatgggatcttatgtagggggaagaagggaaatggt

SEQ ID NO: 78856 - DNA, 114 bp, Mus musculus
tgaaagggttgtaagaattgggaagtgtgtcgctggaggttggctttgaggttcaaagtctctctctctctctcaggatgtttctctcagttattggaccagctcctgccttca

SEQ ID NO: 78857 - DNA, 71 bp, Mus musculus
agctgcatgaagatgaaagcatagggcgggcgcgtgagtcaatgtgtggctgtctgtgtgtctgtgcggct

SEQ ID NO: 78858 - DNA, 80 bp, Mus musculus
aggccctacaaacagaccctctctggctgacttcagatccctgcccagctcagtgcaggctgggtctcaaggaactgggc

SEQ ID NO: 78859 - DNA, 128 bp, Mus musculus
gagccatctcgccagctgtatcagtttttgtgtttaaagctgtgtgcaaccatgctctctactgtttctgccagcagcctgcccggcagctttgtttgcagggtctgaacaatgggtcagatgtttgt

SEQ ID NO: 78860 - DNA, 73 bp, Mus musculus
gcattcatgtgtgcattcatgtttgggtcaagaggctgtgtggtgctacttgtcgctgagtgatagatggggc

SEQ ID NO: 78861 - DNA, 88 bp, Mus musculus
gtgtgactccggagtgtgttaatcacactttctgacactaaaatcaatgcctcagatggttgagtgcactaaggcgaaatagtcacgc

SEQ ID NO: 78862 - DNA, 94 bp, Mus musculus
cttgtgtgcagatctctgtatttgcctacatgtatataaatgtatatatgcatatatgtactcatgtatataaatctagattctgcatctagag

SEQ ID NO: 78863 - DNA, 88 bp, Mus musculus
cacagccctgtcagatgagtgtgacctcaaagcccttcgtgtgcttgggatccagcaggccatattagtcatttggcagaagcatgtg

SEQ ID NO: 78864 - DNA, 85 bp, Mus musculus
gtccatggtggtctgataggatgcatggaacaatttcaatatttttgtatctgttgaggcctgttttgtgaccaattatatggtc

SEQ ID NO: 78865 - DNA, 67 bp, Mus musculus
cacacacacacacatatatacatacataacacatgtatatatgtatgtatatatgtatgtatgtatg

SEQ ID NO: 78866 - DNA, 102 bp, Mus musculus
agatccttgaacatattcatagtagctcttgggaagtccttgtcttctgcttcagctatattgcacttctcagggcctgctgtagtagggttgctgggttct

SEQ ID NO: 78867 - DNA, 84 bp, Mus musculus
tgtatgggccctgggagctgaactcatcactgcgcttgggagcaagcacctttatccactgagtatctcactggctcttgtaca

SEQ ID NO: 78868 - DNA, 85 bp, Mus musculus; identical to SEQ ID NO: 57439

SEQ ID NO: 78869 - DNA, 76 bp, Mus musculus
gggccaagttctctgtgtttctgccttgtctatctcgcactcagccactgagagagtgacaggctgagtttggccc

SEQ ID NO: 78870 - DNA, 103 bp, Mus musculus
agaggggttggagagctggctccatggttaagagcactgtctgctcttccagaggaccaggctttgatatttagcacccacatggcagctcacaatcacctgt

SEQ ID NO: 78871 - DNA, 79 bp, Mus musculus
tatagtgatatccatatgagtgcttggggacatggaaagttatgacttgacactgtgtcacactgtgtgtcacactgtg

SEQ ID NO: 78872 - DNA, 101 bp, Mus musculus
gaactgcctgtctggggctggagagatggctcagcggttaagagcactaactgctcttccagaggtcctgagttcaattctcagcaaccacatggtggctc

SEQ ID NO: 78873 - DNA, 81 bp, Mus musculus
actgttttcactgtgtgtctgtgtgcaaggacaggagcacacctcacttcacacctgtagacagtcaacaacagcatgcag

SEQ ID NO: 78874 - DNA, 89 bp, Mus musculus
ttgtccgtggtgatctgataggagacatgggataatttcaatatttttgtatctattgaggcctgttttgtgtccgattatatggccaa

SEQ ID NO: 78875 - DNA, 70 bp, Mus musculus
catgtatatatatgtgtgtgaatatatatgtatatatacatatatgtgtgtatatatatgtatgaatatg

SEQ ID NO: 78876 - DNA, 62 bp, Mus musculus
caccttagatctctgcatgctgccacagtctctgtggtcagatgtgtgtcagtcctgttgtg

SEQ ID NO: 78877 - DNA, 113 bp, Mus musculus
aagtttttttttaacatttcatttatttatagtgtgtgtgcatatgcatgtgtatatatgtgtgagtatgtatacatgtaccacacatgatattgaaggctagaagacaactt

SEQ ID NO: 78878 - DNA, 70 bp, Mus musculus
gctcatgcatatgtatatgtatatatatgtatgtgtgtatatatgtatacaagtatatatatgtttgtgt

SEQ ID NO: 78879 - DNA, 85 bp, Mus musculus; identical to SEQ ID NO: 57439

SEQ ID NO: 78880 - DNA, 116 bp, Mus musculus
gccggggagagggcaatcccagttcccagcagttttctgttggggatcctcaccctccctctcagaggctctgtttagggctgtgcaggtacaccctgctcatgctgctggagagg

SEQ ID NO: 78881 - DNA, 83 bp, Mus musculus
ttcatccagtctttctatatatatttagaagcatcagggcttgcctgaagttctgactagatatgtctgaagggttggatgaa

SEQ ID NO: 78882 - DNA, 117 bp, Mus musculus
tctctttgctgaatgcctacaagtctagcgccataagcaggagcctcgctgagtgggtcgctgagacacccactctgaagctaacaccctggctctgcttcttgtaagggatgggga

SEQ ID NO: 78883 - DNA, 88 bp, Mus musculus
ctctggtcctctgagagagcagccagtgctctcatgctgagcatccttacatcctgaggcactgagcttttaatggggagaaacgggg

SEQ ID NO: 78884 - DNA, 61 bp, Mus musculus
tgcagattctctctggctctttctatgtggccccagtggtttagagtcacacaaatctgca

SEQ ID NO: 78885 - DNA, 68 bp, Mus musculus
caccccctcacttcatggaagcacagtgccaactgagaacagctctctctgactctgagtaaggggtg

SEQ ID NO: 78886 - DNA, 79 bp, Mus musculus
ctggggtagaaagaggctgctagatgaattcagacatgtgagaagatggtgtttgagaggtcaagtcatgcccccccag

SEQ ID NO: 78887 - DNA, 74 bp, Mus musculus
agtggagcctcatgtttatagagtggagccttagggcaccctttctctgtctctgtctctctgtctctctcgct

SEQ ID NO: 78888 - DNA, 135 bp, Mus musculus
gaaatactgtcggataatgataacatttttggatttaatattttatatttgcaggtatgtaaagaagaatctacttagatcctccaaagtctttatttacttgatagtgcaaattcatatcatccattgtggtgt

SEQ ID NO: 78889 - DNA, 82 bp, Mus musculus
tatgtgtatatgtatatatgtgtatgtgtatatatgaatgtgttcatgtatacatgtatgtatatgtgtacatgtgtatgtg

SEQ ID NO: 78890 - DNA, 82 bp, Mus musculus
gcatgtgtttgtgtatatatatatacgtatttatgtatgtatgtatgtatgtatgtatgtatatgtgtgtgtgttcgtgtgt

SEQ ID NO: 78891 - DNA, 82 bp, Mus musculus
tggtcacttaattataaatatatgcagatgtaaatgcatgtatgtatgtatatgtgcatatgtttttccaatgggtttttca

SEQ ID NO: 78892 - DNA, 88 bp, Mus musculus
tcagggcaccagcccagacagaccagaagaaacccatgccactgatctggcagagtccctgtatgcctgggtcccactggtcccttga

SEQ ID NO: 78893 - DNA, 110 bp, Mus musculus
cccatcaggagatgaacagagccttctaggtggccatacttacgtgatctctcctgaatttgttgatgatccagcctgctgggaagctgtttgtcatctgtccctagggg

SEQ ID NO: 78894 - DNA, 66 bp, Mus musculus
cctggtgggcacagttgatgagtaagctgttaaactgcttgggcactgctgtgtgtgcacacaagg

SEQ ID NO: 78895 - DNA, 99 bp, Mus musculus
tagacaggtggtgatggtgatggtgatggtgatggtgatggtgatggtgatgatgatgatgctgctgctgctgctgccgccgctgcactgccgatgctg

SEQ ID NO: 78896 - DNA, 84 bp, Mus musculus
caccagtccttccaccccggttctctctgtctgtcagtgccacaaagcttgacacagctgatgggaagggtgtgacgtatggtg

SEQ ID NO: 78897 - DNA, 88 bp, Mus musculus
ggggtgggactgtgcacttaaagcagataagagaaccctggttggtctgtctctctctggatttctctctgtgtgtctgtctctctcc

SEQ ID NO: 78898 - DNA, 78 bp, Mus musculus
tacatatgtatgtatgcatgtatgtattcatgtatgtatgcattcatttatatatgcatatatgtattcatttatgta

SEQ ID NO: 78899 - DNA, 106 bp, Mus musculus
ggctgacctttgggaggattttgaacaagcagccaaaaatccctaaggcagaagttcatctctctctctctcagccgttttctgccctggggtgggggtggccagc

SEQ ID NO: 78900 - DNA, 95 bp, Mus musculus
tgcccactgccatttatttctgcatcactcacagtagctaagaaacacaactgatttagatgacagcaacaaaacaaataaagaacatgtgggca

SEQ ID NO: 78901 - DNA, 109 bp, Mus musculus
tgcttcatattctctttcatctacggatcccagctttcaatttttctgtgtggttatgaggaggtgagtgtatgtgtagaccacaaaactagaaagaggacaagagggg

SEQ ID NO: 78902 - DNA, 105 bp, Mus musculus
cagtcacgatgcagaccaatctcatagcctagagtcacattctccatctccttctgagggtcgctactctgctggcactgtgtttggtttgttttttgttttttg

SEQ ID NO: 78903 - DNA, 88 bp, Mus musculus
cagctgctgagccagtccccagcctcagcgttcttgtcagctcgaggagcactccttctgtcgctgtctctgtctgcctctgctcttg

SEQ ID NO: 78904 - DNA, 82 bp, Mus musculus
ggagagaaagcaaagagaggcagacaggcaggctggcctctgagcattggggctgctgtgtctgtctgactctttgtacttc

SEQ ID NO: 78905 - DNA, 71 bp, Mus musculus
aagggcagatcaatgctgaagagagtggcctgctttgcccctggattttcagacgaatgttctctgttctt

SEQ ID NO: 78906 - DNA, 144 bp, Mus musculus
atgtctatatatgtatgtatgtctatatatgtgtgtatatatatgtgtgtgtatgtctatatatgtatgtatgtccatgtatgtatgtatatatgtgtgtatgtatatatgtgtgtatgtattatatatataatgtataggtac

SEQ ID NO: 78907 - DNA, 109 bp, Mus musculus
gtttttacctctatttttttatttttaattatgtgtatatgtgtgtctctgtgtgtgggcgtgcacatgtgagtcgaggtgtccacagaggacagaggacagagagcac

SEQ ID NO: 78908 - DNA, 114 bp, Mus musculus
cactcagtgacacaccgcaggttttgttactgttgttttatttttagattttgttttcttttgggggggagtttgcaagggtggaggggttatgggggtatggggagatgagtg

SEQ ID NO: 78909 - DNA, 104 bp, Mus musculus
cacagagaaatgccttccgttcgctggtatgtgaccatcacagtgggaagacggctgagagaagacactgggtccatgaggcaggaagcatctcaaacaatgtg

SEQ ID NO: 78910 - DNA, 81 bp, Mus musculus
gagacaactgagcaaaggtgacatgtgcctttccaagcttagcttgggaaaatatttgagtgtttgttcatgagtgtcctc

SEQ ID NO: 78911 - DNA, 62 bp, Mus musculus
tgtgtgtatatgtgtttgcatgtgtatatatctatatatgtgtgtgaatgtatatgtgtgca

SEQ ID NO: 78912 - DNA, 114 bp, Mus musculus
ttctgcctgttgtttcgttctggatctcagcgtctgttttcatctgctgctgggtgggtcctctcagaagaaagacagctgtgctaggctcctgtcagcaagcacagcagagta

SEQ ID NO: 78913 - DNA, 77 bp, Mus musculus
ttcaaaggctggaagatgaaagccctccccttggatgtggctagaaacttcatcctcggtctctctctgtctttgaa

SEQ ID NO: 78914 - DNA, 117 bp, Mus musculus
gggccatcctggctgtggttgggagtgggacccatcagtcaagatctgggccatcagaaacctcacagaaaactgactccaaagcttcccaactttgtttgcagctcggtttgatct

SEQ ID NO: 78915 - DNA, 94 bp, Mus musculus
atctctgagactgcagtgctgagctgtgtgtgtgtctgccacccctctgtgcgtgcactgccagtgtcagtgatgctgcatgggtgggaggaac

SEQ ID NO: 78916 - DNA, 99 bp, Mus musculus
cagagggccctgtcaatcaggcagtactctcttacactctgcctctgtcctccttgcggcaagtgtctaagagatgtctactgtacacaaagctagctg

SEQ ID NO: 78917 - DNA, 119 bp, Mus musculus
tctgggttgcatgctaggtggtcaggaggtcctagtcagtgcgtgaatgaatgaatgaatgaatgagtgaatgaatgagtgagagacttccggaggaagggcctaagaacagatcgagg

SEQ ID NO: 78918 - DNA, 73 bp, Mus musculus
cagggagaatgctaagagtacacaccaggctgagaagatagggtctgaagtctgcctgcagtcagcatccctg

SEQ ID NO: 78919 - DNA, 79 bp, Mus musculus
tgtctaaatgggcaggtgaagagtagtggataaatgggagtatgcactgctctctctctgtgtgtgtgtgtgatagata

SEQ ID NO: 78920 - DNA, 63 bp, Mus musculus
gtcacaggagcagaagacaggctaggacggggagacctgatcctgtgtctgtgtcactgtgat

SEQ ID NO: 78921 - DNA, 76 bp, Mus musculus
agtgctgtgggatgagacagacatgggtgtagggatactgtgtggccctcaccctgtgtctggctctctcaggact

SEQ ID NO: 78922 - DNA, 86 bp, Mus musculus
gcctgcctgcctgcctgcctgcctgccatgcctgcttgcctatctacttggtgtttcaggacaaggtttctccatgtagccttggc

SEQ ID NO: 78923 - DNA, 91 bp, Mus musculus
tatgtgtatggatattttgcctgcatgtgtatatgtatgtatgtatgtttatacatatgtatgtatgtatgtatatatgctacatgtgtgc

SEQ ID NO: 78924 - DNA, 72 bp, Mus musculus
ttgtctcaaggggatggagagatggctcagcgttaagagcactgactgctcttccagaggtcctgagttcag

SEQ ID NO: 78925 - DNA, 237 bp, Mus musculus
ccacttctgcctcctgagtgctgggattaaagatatatattagatataatataatgatatattatatattatatatatgcaagatttatttattctcctgggtagtgctggtacatgactatatatatatacatatacacacacatatatatgtatgtatatatatatgtgtatatataatgtatatatatatgtgtgtgtgtgtgtgtgtgtgtatatatatatacatactttgtg

SEQ ID NO: 78926 - DNA, 87 bp, Mus musculus
acacacatatatatatacattatatatacacatatatatatacatacatatatatgtgtgtgtatatgtatatatatatagtcatgt

SEQ ID NO: 78927 - DNA, 85 bp, Mus musculus
ggcctatgggcatgtctttgggggcattttcttgattgttaaatgatggaggaggtcctgacccactgtgggtgtgttctaggtt

SEQ ID NO: 78928 - DNA, 106 bp, Mus musculus
ttggttataggaggtatagcaactgtgtaaagaaataatgaggctatcacagactctgtctgagcttgttagattgtgtcactttgtatctgatcctgtgtgtcag

SEQ ID NO: 78929 - DNA, 106 bp, Mus musculus
tgattttggtcacttggtttaatgtttatcagtttttatcagttatatttgtctttttaaaaagctggtattaggggctggtgagatggctcagtggttaagagca

SEQ ID NO: 78930 - DNA, 97 bp, Mus musculus
gttgctacggaaattaaatttgggggctgcagagatggatgagcagttaagggcactgactgctcttccagaggtcctgagttcaattcccagcaac

SEQ ID NO: 78931 - DNA, 61 bp, Mus musculus
ggacagagacaaaggaggctctgctcgctgtctgcttgctctcgctctcactctctagtcc

SEQ ID NO: 78932 - DNA, 72 bp, Mus musculus
acagccaagggctctgacacacacagtaactcagtattcagatgatgagcaaggtggtctaggtcctcctgt

SEQ ID NO: 78933 - DNA, 70 bp, Mus musculus
tgtacgtatgtatgtatgtatgtatgtatgtgcctaggtatgtgcatggacaccacatggatgcagtgca

SEQ ID NO: 78934 - DNA, 90 bp, Mus musculus
gggccctcaggtcactgctctgtgtgtctgcctgtcaggataagaagttgaggacagatgcagccaattagctggcctttcaagtggtcc

SEQ ID NO: 78935 - DNA, 67 bp, Mus musculus
ggcctccctgactgtagtttctgtggtcacgttggagtgaccctttaaagagctcaccagtggggct

SEQ ID NO: 78936 - DNA, 105 bp, Mus musculus
atctttgcagttagctggcttctagcctccaggtcttccgtctgtgtctgtccccctctcagaataactctctgtcacctacaggaccagctgctgccatatgat

SEQ ID NO: 78937 - DNA, 91 bp, Mus musculus
gtcgatcttaatagcagaccgggatgcctgggtccctgcctgcctgtggtggccacagtagtggggtcgtgcatccaccctagagaatgac

SEQ ID NO: 78938 - DNA, 77 bp, Mus musculus
aggaagaagacaggcaggtgaggatgccacccacttccggggataccactcctctctcccctgccaacccttgtcct

SEQ ID NO: 78939 - DNA, 110 bp, Mus musculus
ggatattctttccctagaacaaatgaccacaaatgaggagatttgaggcaggttctggggactgaagtctggcacccggatacagtaaggttatgtttcttctgaggtca

SEQ ID NO: 78940 - DNA, 113 bp, Mus musculus
tccatctcctagcaaccaatatggctatccttctgaatagatgccacactcacagtgagtgtgtaacctttatgtagacacgtgggcaaatttagcacttgggactcatgcga

SEQ ID NO: 78941 - DNA, 72 bp, Mus musculus
gttagcatactttgtcactcactctatgccaggagattgtcagatggcctgtgaggtcaggatgtgtcttgc

SEQ ID NO: 78942 - DNA, 80 bp, Mus musculus
cgggagcccaaaacagaaaagggacagtagtgagtgacccctctcgggtcgttcacacctgccctactcaccatggcccg

SEQ ID NO: 78943 - DNA, 113 bp, Mus musculus
gtttttgagggtcaagacagctgacagcaaattatttgagcttttgtttatctgaaattatatttatcttgttctaataagctgggatcttgctgtatcctgaaatgctcaag

SEQ ID NO: 78944 - DNA, 106 bp, Mus musculus
gccttagtccatggtgatctgataggatgcatgggacaatttcaatatttttgtatacgttgaggcttgttttgtgaccaattatgtggtcagttttggagaaggc

SEQ ID NO: 78945 - DNA, 64 bp, Mus musculus
tgtattgctctgcatgtatgtatgtatgtatgtatgtatgcatgcatgtatgtgtagctgtaca

SEQ ID NO: 78946 - DNA, 68 bp, Mus musculus
ccagacagtgcctgtggtctaggctgggactggatgtagcagcaaagacagtcacactgcctgtctgg

SEQ ID NO: 78947 - DNA, 82 bp, Mus musculus
atatgtatagctaatacatataagtatatacacacttaaaaacacatatatcaatatatctatatgtatagctaatacatat

SEQ ID NO: 78948 - DNA, 72 bp, Mus musculus
taccataggcttccaggtctctgtggctcagtccatctggacggctgaccagactgggaaaaacctctggtg

SEQ ID NO: 78949 - DNA, 165 bp, Mus musculus
atatctatatctatataggtatatgtgtatatgtatatatgtgtatatgtatatatgtatatgcatatatgtatatgtgtatatgcatatatatttatatgtgtgtatgtatatatgtgtgtatgcatatgtgcatatacacatcaatgcatcatatatcatata

SEQ ID NO: 78950 - DNA, 97 bp, Mus musculus
tctgcactatattgccctgtcagtctcactgattcttataagggaagccctagtgttgactttcagtgcagacaggaagggaggagccagctgtaga

SEQ ID NO: 78951 - DNA, 68 bp, Mus musculus
ggtcccttaaggagagcatgcaggagccatctgtagatctgtggcactctgagcctctctctgggatc

SEQ ID NO: 78952 - DNA, 67 bp, Mus musculus
gagtcaggttctcgctgtcatcctggctggctgcagtctcactgtcagtcagactgatttctgactc

SEQ ID NO: 78953 - DNA, 83 bp, Mus musculus
gtgaccctcttcttgttagatcgatctgctgaggaacatggacaaaagctctctctatctctctaatgtagaagacgggacat

SEQ ID NO: 78954 - DNA, 103 bp, Mus musculus
gtgtgtgtatgtatcagtgtgtgtgtgaatgtatgtattgtgtgtgcatgagttgtgtgtgtgtataaattgtgtgtttatgtatcagtgtgtgtgaatatgt

SEQ ID NO: 78955 - DNA, 75 bp, Mus musculus
tctgtatgtatgtatgtatgtattgtatgtatatatttatgtaggtgtgtgcatgaatgcatagatgtttgtgga

SEQ ID NO: 78956 - DNA, 89 bp, Mus musculus
gtgtctatctggagagtgataacctccacggattgttcccaggctttgctgctcttccctctgtcactggctgcctctcctcctgacat

SEQ ID NO: 78957 - DNA, 63 bp, Mus musculus
gctgtcactgacactgtgtaatttgctgtggacacagcgcaacatagtgcttctctagagggc

SEQ ID NO: 78958 - DNA, 103 bp, Mus musculus
aggttattctaagtgagagcagccagatatagaaagacaagcattgcatgatataattcatatatacatagtttttaaagtcaggtcttatttagatcagcct

SEQ ID NO: 78959 - DNA, 73 bp, Mus musculus
gggaaggtgcacagttttctctctgtcattctgcacacggcggtagtgatgaaccttgattacagtgcacacc

SEQ ID NO: 78960 - DNA, 116 bp, Mus musculus
ctaccagtgtcttgttaaatggtcatgttgtcaatctacctcctaaatatttatgtttatacatatagggttgtgttgctctcaactttgatcgaaaaactttttttcttgggtag

SEQ ID NO: 78961 - DNA, 69 bp, Mus musculus
ggcaagaaatcatggctttgaggcatgaggtcagccccagcttctctgtctctcagtctgtctctttcc

SEQ ID NO: 78962 - DNA, 103 bp, Mus musculus
ctccctatttaagtagtatattcacttttcttgccttgggacatcagcacctctggctctcagagtctcagagtatctataatggagatagttagatagatag

SEQ ID NO: 78963 - DNA, 120 bp, Mus musculus
gtaggctggctcagacctggatgccactgagaatgagaccacctggggtggagccttcccacctagatggttctattgtttggtcacgtagctgttcttttctgagacactgttacctgc

SEQ ID NO: 78964 - DNA, 92 bp, Mus musculus
atgtatgtatgtatgtgtatatatatgtatgtgtgtgtatacacaaattattacatacatacatacatacatacatacatacatacatacat

SEQ ID NO: 78965 - DNA, 125 bp, Mus musculus
catatacatatacatatacatatacacacacgtgtgtgtgtgtgtgcgcgtgtgtgtgatcatctgtgtctgtctgtctgtctgtacatatgagcttgtggatgtggaggttcatacttaggtgt

SEQ ID NO: 78966 - DNA, 69 bp, Mus musculus
gattcaggtctgttccagaactctgtgagctgactaggactcagagtctctcagacagttatttgaatc

SEQ ID NO: 78967 - DNA, 154 bp, Mus musculus
atatgtatgtgtatatatatatatgtgtgtgtgtgtatatgtgtttgtgcatgtttgcatacatgtatatatatatgtgtatatgtttgtgtatatatacatatatatgcatatatgtatgtatgtatgtatacatacatatatatacatgtgt

SEQ ID NO: 78968 - DNA, 117 bp, Mus musculus
tgtattatgcatatgtatatatacatgtgttttatttatatgtatatatgttatatatatgtgtgtatatatatatatatgtgtgtgtgtgtgtgtgtgtgtaacatgcagagtaaa

SEQ ID NO: 78969 - DNA, 85 bp, Mus musculus; identical to SEQ ID NO: 57439

SEQ ID NO: 78970 - DNA, 97 bp, Mus musculus
tcagtcctgtgggctaaatatatacacactggctgtgtctgtggttgaaactgcacctaagatgcaggagaagatgtgcggtgttgggttgagaagg

SEQ ID NO: 78971 - DNA, 95 bp, Mus musculus
gtgttcagctgcatacggtaactctgtctctcagattcagacgtctaatatgaacggtctgagtttctgtgaggctgctggtgctgctgctgcat

SEQ ID NO: 78972 - DNA, 95 bp, Mus musculus
gggttaaaaagcttcaggcagggatggatgaagatggttgactctgtcgtcaggtagctgtctctgtccatctctcacctctgctctccccaccc

SEQ ID NO: 78973 - DNA, 65 bp, Mus musculus
tataataagtttatatagctgtttgttatgagtatatgacagacactgtgtgcttcttgtatata

SEQ ID NO: 78974 - DNA, 85 bp, Mus musculus
gcgtcatctgtctatgtatgtatgtatgtatgtatgtatgtatgtatgtatgtatgtatgtatgtatctatgcatctgtctgacc

SEQ ID NO: 78975 - DNA, 67 bp, Mus musculus
ttgtatctgtcagtctgtctctatgtgtcttgtcagctcaagaagttcaagagacactgctatgcaa

SEQ ID NO: 78976 - DNA, 86 bp, Mus musculus
gaggcttgaaactttctagagcagttctctccctctctctgggaaggatagaggagtgctggcagcctaagagagttagagacctt

SEQ ID NO: 78977 - DNA, 64 bp, Mus musculus
tgtatgtatgtatgtgtgtatatacatatgtatgtatgtatgtacctatgtatgcatgcatata

SEQ ID NO: 78978 - DNA, 77 bp, Mus musculus
ctgaaatccacccagactgtctctgtatctccccttatctgattcctatcgcagaccatagttggagtggaccacag

SEQ ID NO: 78979 - DNA, 61 bp, Mus musculus
gcgatggacacagtgatccaaattgccaggaagcccatgcagtgacactgtgtgtgtgtgt

SEQ ID NO: 78980 - DNA, 79 bp, Mus musculus
tctgtgtctctgtgtgtgtctgtatgtaggtgtgtgccggtgactgtgtgtacctacagaggacaaaacaaggcattga

SEQ ID NO: 78981 - DNA, 57 bp, Mus musculus
taggctggagagatagcttagtcgtcaagaccactgactgctcttccagagggcctg

SEQ ID NO: 78982 - DNA, 88 bp, Mus musculus
aggaactcaggatcacattaaatgcacacactccgtcactgtgaatactacagctctgtgctgctatggcttgatgttggaagttctt

SEQ ID NO: 78983 - DNA, 109 bp, Mus musculus
cacctgcctcgctgagaactaagaaaagctgggtgggtttggctggagcccagagagaaggcagacagcccccaacccagagttcagatggcttggtgacgagtcagtg

SEQ ID NO: 78984 - DNA, 112 bp, Mus musculus
ccacagatacacattcattcacaagggcagcctgtcggaagtgagatcagaagagacacattctggctcctagcattccacagagcacatgatcaggagtggtttctgcagg

SEQ ID NO: 78985 - DNA, 134 bp, Mus musculus
gggaagctgaaggcaggaggattaagagtttgaggtcaggctggagagatggctcagcggttaagagcactgactgctcttccagaggtcctgagttcaattcccagcaaccacatggtggctcacaaccatct

SEQ ID NO: 78986 - DNA, 66 bp, Mus musculus
tggcagcctataaagaggacatggaagaagggagcatgctctcttttgctctcactctcactgtca

SEQ ID NO: 78987 - DNA, 74 bp, Mus musculus
ctgcatgtatgtatgtgcatcatatatgtatagatgattcgactgcatgtatgtatgtatgtatgtatgtgcag

SEQ ID NO: 78988 - DNA, 98 bp, Mus musculus
gggatgtgtcattgtgggcaggctttgaggtttcaaaagactagccatattctgagtctctctctctgcctcatgcttgtggatcaagatgtaagccc

SEQ ID NO: 78989 - DNA, 79 bp, Mus musculus
ttgtgcagtttcagttcagagtctggagacaaggcttttctcacttctccatctctagactcctgaggaacatgcggag

SEQ ID NO: 78990 - DNA, 112 bp, Mus musculus
gtccaggcttaggactcttgacggtagagcctcacccttccctgactcagtctctgcctggacatccctgcagaacgtcatgaacttcaggcgctctcgtttggctcatacc

SEQ ID NO: 78991 - DNA, 65 bp, Mus musculus
gtgtgtctgtgtgtgcacacatgtggagtgctgtgtgtgtgtgtgtgtgtgtgaatgtggcatgc

SEQ ID NO: 78992 - DNA, 65 bp, Mus musculus
attctcccgttgtgtgtctgtgtgtctcagcacgtgtgtggaggtcagaggcatcttggcagagt

SEQ ID NO: 78993 - DNA, 108 bp, Mus musculus
cttgaggacaagaaactcgactagaaaatgggcaaggtgtctgtacacagtgtgtattagtactggcggccctctatgttttcagtagagtatttgctgttcctctgg

SEQ ID NO: 78994 - DNA, 126 bp, Mus musculus
ccaccacgagagccagtgagggacaagagatgctaccagagtcctgcgtgtcacactgtggctctctaggggaagtccagcagtcctggcatagttctttgcaactcgagtcaaacagcctgtggt

SEQ ID NO: 78995 - DNA, 76 bp, Mus musculus
gtcagtctctcagtcactgggttttgtgtaccagttacttgaaagcgctggtgtttcttagctctgactgctgtac

SEQ ID NO: 78996 - DNA, 67 bp, Mus musculus
aggctggtgagaggtgtctttatcactcttgatcctaatttttatgacagtgtctctcactgagcct

SEQ ID NO: 78997 - DNA, 70 bp, Mus musculus
ggcacagagatttgacagaacacaagctgcctggcttgcctctttgctggtgactgtcttcttcctgtcc

SEQ ID NO: 78998 - DNA, 124 bp, Mus musculus
ggaggtcagggaaggaacttggagcagaaactctggaagaacgctgcttgctgcctcgttctctgcctggctctctcagatagtctagggccacctgcctaaggatgaggctgcccatagtggc

SEQ ID NO: 78999 - DNA, 80 bp, Mus musculus
tctagttctatattaattttaaagcgtgtgcatgcatattcacgtgtgtatgtgtgcatgtgcatgtatgtgagagcagg

SEQ ID NO: 79000 - DNA, 78 bp, Mus musculus
aggaaaaaatggcacgcaagagatggctgccacacccttgaattgattcccttagtcactcagtgtgtctgttttctt

SEQ ID NO: 79001 - DNA, 117 bp, Mus musculus
tattcttggagattggtccatctggagctgttgatacaatcttacctaagacaataggttgtaaagataaattttttagcattactaatccagcgttgccaatacccatggagaatg

SEQ ID NO: 79002 - DNA, 82 bp, Mus musculus
atttgtgtatgtgtttatgtgcatatatgtatatacatgtctatatatgtatgtgtatatatgtgtatgttcacacatgagt

SEQ ID NO: 79003 - DNA, 70 bp, Mus musculus
caagtggcaacagccatgactccagagaccccaacagttgtgtctgtctgtctgtctgtctgtctgcttg

SEQ ID NO: 79004 - DNA, 73 bp, Mus musculus
gggcacacacagactctgaatctagaaacagctgacatcagctgtcctggagggcaatgaggagcacacaccc

SEQ ID NO: 79005 - DNA, 106 bp, Mus musculus
ccagcgagtctgggaaagctgagccgcatagcaatctctcaaacgattcctgggcattgctatttattgctatgtgagtctaatatttcacagtctttctgcctgg

SEQ ID NO: 79006 - DNA, 82 bp, Mus musculus
gctcgtgtgtgcgtgtgtgcgtgcgtgcatgtgtgcttccgtgtttgtgtatgagtgcgtgcgtacttacgtgtatacgagc

SEQ ID NO: 79007 - DNA, 79 bp, Mus musculus
gactgtagtacagatgtccagactataactgtccaaccctgggaggttgtggttccttcacactgtctctctgctagtt

SEQ ID NO: 79008 - DNA, 74 bp, Mus musculus
atgtgtatatatgtatgtatatatgtacatacacatatacatgtatgtatgtatgtatgtatgtatgtgtgtgt

SEQ ID NO: 79009 - DNA, 65 bp, Mus musculus
ctgtgtctctgtgtctcccggtcacacactgctgcccgttctctctgacagagatcacgacacag

SEQ ID NO: 79010 - DNA, 90 bp, Mus musculus
cccagcaccaggctatcacttctgacaggctgtgtgtctgcattaaccgttgcccacggcaggaagaagcagctctgatgaaggctgagg

SEQ ID NO: 79011 - DNA, 98 bp, Mus musculus
tctcaactccttggttgattatggcctctgatgcatgccaatatgtattaatattgttattattattgtcatcatcatcatcatcatggtgtctgaga

SEQ ID NO: 79012 - DNA, 86 bp, Mus musculus
gtgtatatgtgtatatgtgtgtatgtgtgtatatatatgtgtgtgtatatatgtatatatacatatatatgtatgtgtgtataaac

SEQ ID NO: 79013 - DNA, 90 bp, Mus musculus
tattctttggagggctgtagtagtatttgaactttgcgtgggaaacccatttaatgttcagtggactgttctgtgggaccttggaaaata

SEQ ID NO: 79014 - DNA, 85 bp, Mus musculus
ggggttccggagtttgttcagggacaatgttttatttttctattgaaactcgagacggtgtgatccaggggatactgagagctct

SEQ ID NO: 79015 - DNA, 76 bp, Mus musculus
gcccgaattgtaggcagtttgagttgagttacctgggcaaataaacttctctcaactttggtttgcttgcaggggc

SEQ ID NO: 79016 - DNA, 67 bp, Mus musculus
cagggagtagtgtctgtctgtctgtccagtaggtttcttccttctgagcctagcgactctggccctg

SEQ ID NO: 79017 - DNA, 105 bp, Mus musculus
ggaacaggagccctaggtcctaagaggatggcagaggatctgagagtgtgaggtcacagtgtagaggaagaagcgaacatctgggtgtgtctggggcagagttct

SEQ ID NO: 79018 - DNA, 70 bp, Mus musculus
gtatgtctgtatgtatatatgtatatatgtatgtatatatgcatgtgtatatgtatatatgcatgtatat

SEQ ID NO: 79019 - DNA, 93 bp, Mus musculus
gtggccatgtcacttactattgctgccattgagttactctaacagtgtatgctaaaccagattgactgtaaatagcaggaatgtattgcccac

SEQ ID NO: 79020 - DNA, 105 bp, Mus musculus
gccatccctagaatggtacctaaaaggatctgcttagaaatttctgccttggaggtgaggtttgaccttgtttactgagatagccacaggcacacagtggggggc

SEQ ID NO: 79021 - DNA, 67 bp, Mus musculus
gggctgaatatgtgctcacggagggacgtgattgttgtgtgactgtgtgtgagtgtgtgggaagtct

SEQ ID NO: 79022 - DNA, 102 bp, Mus musculus
gctctggaaagctgggattgcaggtatatgctgccatgcccaaccaactatttatttatttgatcatggaaacgatgccctcaatgtcctgtctctcttagt

SEQ ID NO: 79023 - DNA, 81 bp, Mus musculus
aggaaggattctgtgcagataccatggggaggatgggggctctgtgggagctgcagtgtttctttttttaattaacagagt

SEQ ID NO: 79024 - DNA, 106 bp, Mus musculus
tctgatacttccactccacactaagctttcaccacaaatgacacagtcacacagtgacttccctttttcttataaaaagcagatgatggagatgtggggcattggg

SEQ ID NO: 79025 - DNA, 85 bp, Mus musculus; identical to SEQ ID NO: 57439

SEQ ID NO: 79026 - DNA, 94 bp, Mus musculus
agtcacagcattaggaaggttgagaatcaccatcctagggtaacctgaaatggtgactgaagtctctgtgtactgcctacctcagatggtgact

SEQ ID NO: 79027 - DNA, 139 bp, Mus musculus
tgtatgtatgtatatgtatatatgtatagatgatacatattatctatacatatataggcttatatatgtatatataatacatattattatacaccttatatatacacctatatatgtatatataagtgtatatatgtat

SEQ ID NO: 79028 - DNA, 69 bp, Mus musculus
gactcagaagcaagcagcagagagtctcaaaggcaaacctcacagtctgtctgttactctgtgtctcag

SEQ ID NO: 79029 - DNA, 64 bp, Mus musculus
aacagttctcactgtagaagttggatctggaaattgtatctaaagttctacattgtcagctgtt

SEQ ID NO: 79030 - DNA, 82 bp, Mus musculus
tagccctaagtagcatgtgcctctgagtctcactctccctgggctgggaactcctggaaggcatggaccattgattgggctg

SEQ ID NO: 79031 - DNA, 92 bp, Mus musculus
tacggtggctgctatggaccattggcattccttagtgtgtgggtacatctcgacacttacagtctctgcctctaaatagccattttcctgta

SEQ ID NO: 79032 - DNA, 69 bp, Mus musculus
gtggagcatggctgatccaaaacatctcatacatctgtggttctctgggtctctgcttcagtgctgtgc

SEQ ID NO: 79033 - DNA, 113 bp, Mus musculus
gaggaagtttacgctacagattaccagcaaagacagggactcaggtcagttttgggagaactgagaactgagacaggagaacctagtctagctccaactgaagcccctccctc

SEQ ID NO: 79034 - DNA, 80 bp, Mus musculus
tgtgtacgtgtatatgtgtgaatatgttgatgtgtattgatgtctatgtatatgttgatatgtgtgtgtgtttgcatgtg

SEQ ID NO: 79035 - DNA, 71 bp, Mus musculus
cctgctcagtatcctcctgatgctgagtttaagaaatgagagatggaccaagcagagagaaatgagacagg

SEQ ID NO: 79036 - DNA, 99 bp, Mus musculus
tgggtttcatttcctcaaaagtcttttagtggggcttttaactagttcagcagttaagagcactgactgctcttccagaggtcctgagttcaattccca

SEQ ID NO: 79037 - DNA, 63 bp, Mus musculus
ggggatggctcagtgggtaagattatatatatttttcccatgaggatctgagttcaaatcccc

SEQ ID NO: 79038 - DNA, 76 bp, Mus musculus
tatttcccatggtttccagtgtcaatgtgcattttacagagctggcattgactctggcagtgtctctgggttgatg

SEQ ID NO: 79039 - DNA, 86 bp, Mus musculus
gtgggatttgatgctctcttctgtctctgtggcaaccatatgcatgtggtgcactgcacagacagacatacaagcaaaacacccac

SEQ ID NO: 79040 - DNA, 67 bp, Mus musculus
gctcagattgagaaatgtttgcgtttgggttgacactgagctcagaggggagcaacctcagcgaagc

SEQ ID NO: 79041 - DNA, 78 bp, Mus musculus; identical to SEQ ID NO: 65175

SEQ ID NO: 79042 - DNA, 71 bp, Mus musculus
cttggctaagcatttcagggaccttagggcagtgttgtctgtgactgaggaatggaagagctgggttcagg

SEQ ID NO: 79043 - DNA, 88 bp, Mus musculus
gacggaggaagagcccttgggaatgtatgtccacgtatccaccgtggtcatgacgtactctctcagtatgtgttatttcactccgctc

SEQ ID NO: 79044 - DNA, 105 bp, Mus musculus
tagcagatgctaaaggccaatacagaagttccagagccccagttcagcagtcactcactctggcagtgggagctcagtgccctttgtctttccctcgtcaggctg

SEQ ID NO: 79045 - DNA, 77 bp, Mus musculus
tcttggaacttgctgtgtcgatcaggttgtctctcatctctcagagatcacttgtgtctgcctcctgggttctggga

SEQ ID NO: 79046 - DNA, 100 bp, Mus musculus
gtatctggggggttgggtgggtggagggtgtggaaagatgactcagcggttgagagcactgactgctcttccagaggtcctaagttcaattcccagaaac

SEQ ID NO: 79047 - DNA, 78 bp, Mus musculus
catggatgctctgccactgtttctctgtgcatccctgggagggggctttacagaggacggaggaggatgttgagcctg

SEQ ID NO: 79048 - DNA, 96 bp, Mus musculus
agctgtgtgatagagcatctgccttctgtgtgtgtgagacccgggttccatccccagctcaggagcggagagtgggtgagagtgggtgtactggct

SEQ ID NO: 79049 - DNA, 75 bp, Mus musculus
gaggtatgcaaagagacagcagtgagtgagcagtgtgagcccctaactcacactctctctctctctctctctctc

SEQ ID NO: 79050 - DNA, 92 bp, Mus musculus
gctagcaattagaagtcaggtgagagtggtgggtgagcagagaggccctgtgctcaggatgatggagagcttccagactgttatgggcatgc

SEQ ID NO: 79051 - DNA, 76 bp, Mus musculus
gccactttccagacagaacacactgtgcctggcactcttagagatgcaccatggtacagtggtcactagaagtggc

SEQ ID NO: 79052 - DNA, 89 bp, Mus musculus
aggttatttgtgggttgcattacaagtttaggaactgccagggttatacaaaaccctgcctgcctgactgcctgcctgtctgtctatct

SEQ ID NO: 79053 - DNA, 103 bp, Mus musculus
gagagacagagacagacagattttggttttttttttttattaattaattatttatttatttggttttttggagacagggtttctctgtatagttctggctgtc

SEQ ID NO: 79054 - DNA, 97 bp, Mus musculus
ccaagggatgctgagagttgctgtgtaaacatcctactccctcttcattaggcaggtgtccattacctatagtactcactcaatgacacacctctgg

SEQ ID NO: 79055 - DNA, 66 bp, Mus musculus
gcctgcctgccagtgtgtcagtgccaacacacccagtgtctctcgctcgctcgctggctcgcttgt

SEQ ID NO: 79056 - DNA, 94 bp, Mus musculus
atactatataatacacatataatatgctgtatatatacatgtgtatatatacatatatatgtgtgtatatatgtgtgtgtatgtatgtatgtat

SEQ ID NO: 79057 - DNA, 96 bp, Mus musculus
tgttataaaaatgcaatggttggtctgttgaaaacctgagccgtagccaagtgaacagaggctgcacagacccagcagccactccatggcagggca

SEQ ID NO: 79058 - DNA, 118 bp, Mus musculus
gatgaaccaaagctcatttctggggctggagagataactcagcaggtaagagcactgagtgctcttccagaggtcctgagttcaaatcccagcaaccacatggtggctcacaaccatc

SEQ ID NO: 79059 - DNA, 116 bp, Mus musculus
gttgtccttataagagttgtcttggggctggagaaatggctcagtggttaagagcactgactgctcttccagaggtcctgagttcaaatcccagcaaccacatggtggctcacaac

SEQ ID NO: 79060 - DNA, 92 bp, Mus musculus
ggctggtgttggttccactgctcagtgaagagactgaggctcagagaggagcaggggccaagtcagagcagagacagtgacaacaataagcc

SEQ ID NO: 79061 - DNA, 69 bp, Mus musculus
cgtggagctttgagtttgcacactcactctggctcgcagcatggggaggcaaatctactggcgtccacg

SEQ ID NO: 79062 - DNA, 70 bp, Mus musculus
gctgaggctcactggggccaagaattatggcttatttgctactctctgagtctctttgtcttaccacagc

SEQ ID NO: 79063 - DNA, 96 bp, Mus musculus
gagctgagtagagactaacacacagcctgaggctctttctctcaggctcaaggtgctctgaggagagaggaggctaggcatgaagtcctactgctc

SEQ ID NO: 79064 - DNA, 62 bp, Mus musculus
catacatatatacttatatgtatgtacacatatatgtgtatgtatatatatgtatgtgtatg

SEQ ID NO: 79065 - DNA, 87 bp, Mus musculus
catacatatatatacatacacatatatgtgtacatacatataagtatatatgtatgtgtgtgtatatatatttcaaaagctcgtgtg

SEQ ID NO: 79066 - DNA, 88 bp, Mus musculus
ttctagtatttagaaggtagagtcagcaggacaagtttcagggcagtcttgtctggccctggctctataacgactctaaattaaagaa

SEQ ID NO: 79067 - DNA, 93 bp, Mus musculus
accagccagccacacagaccccggctctagttcctaacaggcaatgtgcctgtcctctctgactcagagtctcggcccgtgtgatgacttggt

SEQ ID NO: 79068 - DNA, 74 bp, Mus musculus
gcctctgaactgcatggaggtacagctcctggtaccctctaggtctgtctgtccctctgtccccagtaggaggt

SEQ ID NO: 79069 - DNA, 63 bp, Mus musculus
tatgtgtgtgtatatatgtatatgtatgtatgtagtgtatatatgcatgtgtgtgtatatatg

SEQ ID NO: 79070 - DNA, 142 bp, Mus musculus
acgtgtatatatgtgttatgtgtgcgtgtgtgtatgtatgtgtgtatatatgtatgtatatgtattatatgtatatgcatgtgtgtatatgtgcatgtgtgtgcatgtatgtatgcatgtgtgtgtgtgcatgtgcatgtgt

SEQ ID NO: 79071 - DNA, 69 bp, Mus musculus
tccacgtcagtgggtctctgtgtgtgcacaccccaacaccgagcacacacagaccccgctgcctgtggg

SEQ ID NO: 79072 - DNA, 85 bp, Mus musculus
tgggggcggggtgtgtgaatcagggagtccttgtctgcctaatggaggagactctgagctccctctcagtcacactcccacacta

SEQ ID NO: 79073 - DNA, 95 bp, Mus musculus
caggcagttgtgaagactcaagcctgtgacctctgtactctggggcatgcaacagaaagatcacaggctccatatgagcctctgagggacgcctg

SEQ ID NO: 79074 - DNA, 64 bp, Mus musculus
gcctcaggactgtgaaaccagaccccgctcaggaaggctctgaggctcacacactcagcgaggc

SEQ ID NO: 79075 - DNA, 104 bp, Mus musculus
ctcaggaagtagaattaggagtcaggaggatcaggctggagagatggctcagcggttaagagcactgactgctcttcctaaaggtcctgagttcaaatcccagc

SEQ ID NO: 79076 - DNA, 92 bp, Mus musculus
gactttgctcaaccttgttggtcagcacagaaagcaaggtctgtagtgagtcagctgagctttaggctgaacaactcgaggaaggggaggtt

SEQ ID NO: 79077 - DNA, 96 bp, Mus musculus
ttatgtagaatcaggaatgtcttatttaacccccattgtgacaaggaaactcacacacacactcggtgacaaggcagcatttccgtgtcagtataa

SEQ ID NO: 79078 - DNA, 78 bp, Mus musculus
tgggggaaccatggcaacaggtcacattgcatctgcagccagaagtgaatgatggtgggtctgtctgtctgtctctta

SEQ ID NO: 79079 - DNA, 87 bp, Mus musculus
ttggtgtctttgctccattttctgccaagtgtccccatgaagctgggccagcctcacactctgcgtctgttgagttgagatgaccaa

SEQ ID NO: 79080 - DNA, 71 bp, Mus musculus
gggcacaggatagctgggggaggagggagcccccacagctttccctctgactctctctacccctctgaccc

SEQ ID NO: 79081 - DNA, 88 bp, Mus musculus
ggtagcctgtatctggaagtccaggacttgtgaggtaggaggttgagaagttcacagccaggctagtctgggcaacagagattctatc

SEQ ID NO: 79082 - DNA, 97 bp, Mus musculus
tactcaaggaggcaaaggtaggggtgtctctgtgagtctgaggccagcacggtctacagagtgagcagagtgggttctggccagtaagtccatagta

SEQ ID NO: 79083 - DNA, 101 bp, Mus musculus
atggcagcgagttaaggatgtgggggtggcgggatggagaaaggcctcttttatttttggttttattcaattttgtacttttcctttaataagtttgtgat

SEQ ID NO: 79084 - DNA, 114 bp, Mus musculus
cttcaatcctttgtttgttttatttggttggttggtgggtttttgttttttgtcttttgtttttgaaacaaggtctctcactgtggctctggatgccaggaactggatatgtag

SEQ ID NO: 79085 - DNA, 66 bp, Mus musculus
gtgtctgtgtgttcatgtgcatgtgtatgtccgtgtgcgcatgcgcacatggtagccacaggtcac

SEQ ID NO: 79086 - DNA, 109 bp, Mus musculus
ctgacatggcactacatctttttttttttttaactgtaactgtgattttgatgttatgttacattttgtacatatgaatgaaaaactgatgttaagacaggccatgcag

SEQ ID NO: 79087 - DNA, 87 bp, Mus musculus
ttgtaggagtggaaaatcactggagagacggctcagcagttaagagcactgactgctcttccagagttttgagttcaatcccagcaa

SEQ ID NO: 79088 - DNA, 83 bp, Mus musculus
gtagcagtggacacagacactagacactgtcatctgggccacagctgcctctgatgcagagtgaaggctgctgccactgctgc

SEQ ID NO: 79089 - DNA, 85 bp, Mus musculus; identical to SEQ ID NO: 57439

SEQ ID NO: 79090 - DNA, 85 bp, Mus musculus
gccccttgaagggtagaccagtatttttgttgtactgaggaagccattttctcctaggaagtacatgggactgcttttgataagc

SEQ ID NO: 79091 - DNA, 119 bp, Mus musculus
ggtgaattgaatggctgaccccttcctctttccttcatttgctttgcactgattttttttttaaacttagccaaccatgaatgattgtgaagtagagggggtaaagacacggtgaccat

SEQ ID NO: 79092 - DNA, 118 bp, Mus musculus
cttttctcagatgtttctttaaaattaatagacagacagacagacagacagacagacactggaaagctaggcgtggtggtgtgtatctgcacttgggaggtagaggcaggcggatcag

SEQ ID NO: 79093 - DNA, 64 bp, Mus musculus
tggtgtgtgtgtgtgcctctgtgtgtgtgtagacatgtatgcagtggtacacatgtgtggacca

SEQ ID NO: 79094 - DNA, 127 bp, Mus musculus
agagttgccttggtcatggtgtctgttcacagcagaaaaaccctagctaagacagtgtggttgtaggttctctagccctaggtacttggtttggtttccagtactgggcacgataatcctcctgcta

SEQ ID NO: 79095 - DNA, 114 bp, Mus musculus
gaaggaaatggaaaagttcaggcttccaggaccacccttgtttattctctcgatgtctagagactccatcaggttggaaattggccagttgtgcaggatatgactatttttttc

SEQ ID NO: 79096 - DNA, 195 bp, Mus musculus
gtatgcacacatgtgtatctatatacatatgtctctctatatgtatatatgtatgcatgtatgtgtgtatgtgtgtatatggctatatggatataattgtatatgtatatctgtgtatgtgtatatgtatatatatgaatgtatatgcgtatatatgtataaattatatttacataagtatgtaatatatacata

SEQ ID NO: 79097 - DNA, 86 bp, Mus musculus
ggccatggtggtctgataggatacatgggacaatttcaatatttttgtatctgttgaggccctattttgtgaccaattatatggtc

SEQ ID NO: 79098 - DNA, 85 bp, Mus musculus; identical to SEQ ID NO: 57439

SEQ ID NO: 79099 - DNA, 114 bp, Mus musculus
gtttttatatttatgcttctaagtctctcttctaagtcagaagtttgtcaccactctgcatggtatcttgtttagccttgagagaggaacttttatgctgttaggtccttaaat

SEQ ID NO: 79100 - DNA, 76 bp, Mus musculus
ggggatcttccatcaactcctgcatgttgtcctctgactttcagtcattcacagtatcaggggtggggggatctcc

SEQ ID NO: 79101 - DNA, 63 bp, Mus musculus
tcacaacaactaaatggtaagtggggtacatgtatgtatgtatatatttgctatttagtttga

SEQ ID NO: 79102 - DNA, 85 bp, Mus musculus; identical to SEQ ID NO: 57470

SEQ ID NO: 79103 - DNA, 67 bp, Mus musculus
cacctctctatgtctgtctcatattcaggctcagagatgtgctttaacttgagaatctagaaaggtg

SEQ ID NO: 79104 - DNA, 85 bp, Mus musculus; identical to SEQ ID NO: 78692

SEQ ID NO: 79105 - DNA, 101 bp, Mus musculus
ggcttttcctgagaattgtctactacaggttatctccagagtttctatggaatgaagagacacagcacagagaattgagtagatggtgttatcgtcaagct

SEQ ID NO: 79106 - DNA, 124 bp, Mus musculus
tgtgtgtgtatgtaagtatatgatatggatatgtatatgtgtgtgtatgtatatgtatatatacatgacatacatgatatataaatgacacacatatgatatatatatatgtatatatatatat

SEQ ID NO: 79107 - DNA, 133 bp, Mus musculus
cagaaacctagagtaagcagatccactgaagagagtggaggttttccatctgggagcctgctgagtgtgtctgtgtgtatatacaagggtgagacgatacacaaagattactatttaaaggttctttaaaaac

SEQ ID NO: 79108 - DNA, 132 bp, Mus musculus
gtgttgttctcagacttgtcctggtgacttgaagaaaatctttgtacaactgactgggtctgagtcagcatctgtatgtgaggactgagtgaggagtttctacctagctcctcgcatacattagagtggctc

SEQ ID NO: 79109 - DNA, 81 bp, Mus musculus
ctttgatctatctgtctgtctctgtaccattaccatgcagtttttatcacaattgctctgtagtacagcttgaggtcaggg

SEQ ID NO: 79110 - DNA, 104 bp, Mus musculus
tctatctatctatctatggttggttttctacattaatttgtttgttcattatatatatatactgatcaatgtgctgtggggagaatcccaaagtgggagcagga

SEQ ID NO: 79111 - DNA, 102 bp, Mus musculus
tatacatagatgatggataaatgatacataagtaatatattttaaaagtttatcattattgatatttacgtatttatgtgtctatctgtgtgtctgtgtatg

SEQ ID NO: 79112 - DNA, 103 bp, Mus musculus
catatgtatgtatgtatgtatgtatgtatgtatgtatgtatgtatgtgtatgtacatatgtgtgtgtatgtatgtatatatgccgtgtatgtatatatataca

SEQ ID NO: 79113 - DNA, 86 bp, Mus musculus
atatatttgtatgtatatatatatatatatttatatattatacacactaatgttacatatatgtacatataagcatatatatatat

SEQ ID NO: 79114 - DNA, 88 bp, Mus musculus
tccataaacttgtgatgtggttaggagcttggtactgattgacagatgccatttggttgtatagtttcttcaaatgctgcaggctgga

SEQ ID NO: 79115 - DNA, 71 bp, Mus musculus
ggaggaagtatttcaataggggtggtcttgagctttcagaatctcaagccaggctcactgtcactctctct

SEQ ID NO: 79116 - DNA, 84 bp, Mus musculus
atttctgttcgactaagattctgacaggagcctgctatagctgtctcctgagaggctctgtcagagtctgacaaacacagaggt

SEQ ID NO: 79117 - DNA, 80 bp, Mus musculus
tatacatataatgtatgtatagtagacatatatatgtataaagacatatataaatgtatatacatatatacacatgtata

SEQ ID NO: 79118 - DNA, 85 bp, Mus musculus; identical to SEQ ID NO: 57439

SEQ ID NO: 79119 - DNA, 85 bp, Mus musculus; identical to SEQ ID NO: 57439

SEQ ID NO: 79120 - DNA, 65 bp, Mus musculus
ttgtatatatgtatatgtgcttttatgtatacgagatatatatatatatatgtatgtgtatgcaa

SEQ ID NO: 79121 - DNA, 76 bp, Mus musculus
agcaacagagagaaaggatgaagacagtaaggaagctgacttctctctaagtctgatatcttttcttgcatatgct

SEQ ID NO: 79122 - DNA, 65 bp, Mus musculus
ggatattttatacatatatatctacgtatagatatatatgtatgtatgtatgtatgtatatacac

SEQ ID NO: 79123 - DNA, 93 bp, Mus musculus
tctagcttaacagcttgagaggagttttctctgccttgcaagaaaaatcccaaaccagaggagagagagcacagtttgagatgttttggtaga

SEQ ID NO: 79124 - DNA, 204 bp, Mus musculus
acataatatatatatatacacatacatatatatacatatatacatacatatatatgtatgtgtgtatatatatatgtgtgtgtgtgtgtatatgtatgtatatatatgtatatatatgtatatatatgtatatatatgtatatatatgtatatatatgtatatatatgtatatatatacatacatatgtatatatatatataca

SEQ ID NO: 79125 - DNA, 79 bp, Mus musculus
gtctgtctgtctgtctgtctctttgtctgtctgtctcatatattacccattagtaagcagagagacagaggaaacaagc

SEQ ID NO: 79126 - DNA, 92 bp, Mus musculus
tgtatcacaggcattccccatgatctaaataattgcatgacaaaaccttaactgtgtctgtgtgtgtgtatggggctgtgcagctgagtgca

SEQ ID NO: 79127 - DNA, 91 bp, Mus musculus
tgtgtgtgtgtgtgtgtgtgtgtgtgtgtgcctgtttctgtctgtatgtctctctgtagcacctccacatgcacaagaggacacatgcaca

SEQ ID NO: 79128 - DNA, 93 bp, Mus musculus
aaggtcagagactgtataaattataattcaaatgtctgacattcactctctatgttacagtgtttggtaaatttgtgcatgtgtctagatctt

SEQ ID NO: 79129 - DNA, 142 bp, Mus musculus
tatatgtgtatgtatatgtgtatatggatatatgtgtatatttatacatgtatatccacatattgtatatatgtatatatgtgcatatatgtatatgtttatatgtgttcatgtgtgtatatgtatataggtatatatgcag

SEQ ID NO: 79130 - DNA, 69 bp, Mus musculus
cccagagagtttcattaccgagctgagtctgtctaagtgagggattccttctgcttaaagtgaagtggg

SEQ ID NO: 79131 - DNA, 116 bp, Mus musculus
gagagattactatcttgctttttctagggtgtggtttccgtccttgtattggtttttttttctgttattatcctttgaagggctggattcctggaaagataatgtgtgaatttgtt

SEQ ID NO: 79132 - DNA, 117 bp, Mus musculus
gaaatgtgtgaacccacaattctgcataccatttcgctcccatgaaaaatatatacgtatatatgtatatattacatagatctaaattttatgcagaattgtgggttcacacatttc

SEQ ID NO: 79133 - DNA, 87 bp, Mus musculus
gcagtagttatctggctccaaactcgccaagcttattagagggactctgagcctctgagactgtgagattggtataagataacatgc

SEQ ID NO: 79134 - DNA, 64 bp, Mus musculus
aacttatgtgtttttgcatatgatttgtatattatgcatatgtatatgcatgaatttatgagtt

SEQ ID NO: 79135 - DNA, 109 bp, Mus musculus
tatgtcatatataatggtgtatgtacacattatgtttatatgtatgtatgtatgtatgtaagtatgtatgtgtgtatgaacgtatgtatgcatgtgtgaggatttcata

SEQ ID NO: 79136 - DNA, 119 bp, Mus musculus
ggcgttgacattttggtatggcagactgcggttatgggcctactgattattattatatttctctagtagaagaatgtggttgagagtccgacctttcctcctcggggtgtctggaggcc

SEQ ID NO: 79137 - DNA, 77 bp, Mus musculus
tgtagatatatgtgtatatgggtatatatgtatatacatatatgtgtgtgtatatatattcatacatatgtatcaca

SEQ ID NO: 79138 - DNA, 73 bp, Mus musculus
tttgcatgcatatggctgtaatattcatgtatatatttatatgcaagtactcagaccaatgtgtgtatgtgaa

SEQ ID NO: 79139 - DNA, 75 bp, Mus musculus
gattatacatattcatacatacatacatacatacatacaatgtgtgtgagtgtctgtgtttgtatatgcgtattc

SEQ ID NO: 79140 - DNA, 95 bp, Mus musculus
gtgccatagtctaaggtgctgtgtgaagacagtgaggtctttaagagattggggatctgtaatggtttgtatatgctctgccaagacagtagcac

SEQ ID NO: 79141 - DNA, 98 bp, Mus musculus
atatctaattacatatattattaattatattatatattatatttatttgaactcaattataataatgatgatgttgttgatgatgatggtggtggtat

SEQ ID NO: 79142 - DNA, 147 bp, Mus musculus
tgctctacttgcatgtgtgtgtgtgtctgtatctgtgtgtgtctgtgtatgtatgtatgtatgtatgtatgtatgtgtatgtatgtgtatgtatgtatgtatgtatatgtatgtatgtatgcatgcgtgcatgtgtgtgtgtgtgtg

SEQ ID NO: 79143 - DNA, 85 bp, Mus musculus; identical to SEQ ID NO: 57439

SEQ ID NO: 79144 - DNA, 85 bp, Mus musculus; identical to SEQ ID NO: 57470

SEQ ID NO: 79145 - DNA, 77 bp, Mus musculus
cccagcaatgaaatcaacacatcacttttggaggcagatctgctgtgccagatcacatgtctcagtctcatattggg

SEQ ID NO: 79146 - DNA, 105 bp, Mus musculus
cctctaatagtttgaggtatgtgggggcgtgaatgtgtatgtgtgtgggtgtatgcacacattttatatatatatgtcattcagaagatacttcaagtagtaagg

SEQ ID NO: 79147 - DNA, 108 bp, Mus musculus
gaagtgctttcctgtgtttgtgtctggttgtgttccacaagttctaagaccctttcctgtcagaagcctgtctgcacttcatgccactcactctccttagagcaagtc

SEQ ID NO: 79148 - DNA, 108 bp, Mus musculus
tgggcattttttccctaagctgtatcattgaattttggacctagaaaaatgtttctttataaatatgacatttttagaggctagagagatgactatgcttcttgtcca

SEQ ID NO: 79149 - DNA, 99 bp, Mus musculus
tccaattcatcaattatgtcatagaaatatatgtatgtatgtatgtatgtatgtatgtatgtgtgtgtatattaagtctgttgatgcctaccaattgga

SEQ ID NO: 79150 - DNA, 65 bp, Mus musculus
gtatacatataagtgtatatgtatgtgtgtgtatatatatatatgcacttgtgtataatgtatat

SEQ ID NO: 79151 - DNA, 85 bp, Mus musculus; identical to SEQ ID NO: 57470

SEQ ID NO: 79152 - DNA, 119 bp, Mus musculus
ccaggtctgctctgaaaaacatcctcaagtggcaggaatttctcccttcataatctccctctgtgtgtctcagggtgtcactgcttctgatgagtccacagcagagtcccttgtcccgg

SEQ ID NO: 79153 - DNA, 116 bp, Mus musculus
agcatctctgggattcctgtggcttcattatttttgcacttgacaatgaatgtttgtatatttatcttcaaacaagcctttgagccttcttcagatcattatttatccacagtgtt

SEQ ID NO: 79154 - DNA, 101 bp, Mus musculus
ttaattggtaaaattttgtgtacatatatacatatacacatatgtatatgtaactatatacatatatatgtaatatatgtcacagatgggtagatggttag

SEQ ID NO: 79155 - DNA, 68 bp, Mus musculus
tgtgacatatattacatatatatgtatatagttacatatacatatgtgtatatgtatatatgtacaca

SEQ ID NO: 79156 - DNA, 85 bp, Mus musculus; identical to SEQ ID NO: 57439

SEQ ID NO: 79157 - DNA, 84 bp, Mus musculus
ccatagcataaacatgtgtgcacataggtatgcatgcagttacatgcacaggcttgtatatggtatacacacaagaaagcatgg

SEQ ID NO: 79158 - DNA, 82 bp, Mus musculus
ctctctctcagtgcctgtgtcaggaagggttctcggggccacccctctttcttaagttcttggctgtactgaaaaatgagag

SEQ ID NO: 79159 - DNA, 83 bp, Mus musculus
ggacagtgaggtgacagtgaggtgacctgttagacagtactgctgcattctccgtgtcccctttctctgacctgtccttccac

SEQ ID NO: 79160 - DNA, 86 bp, Mus musculus
gtctttttgttgctgctaaatgatgaggaagctcaccctgatgggagagataaagaatagattctgcaagagcaagtggtatggat

SEQ ID NO: 79161 - DNA, 84 bp, Mus musculus
gatttctgcatcatatacttacaaaggattgtaatgaactttccaaaaagttcattagatcatgatatttggtgcagtgacatc

SEQ ID NO: 79162 - DNA, 78 bp, Mus musculus
tcgcttgttttgaggctctgtcactgaatctgtgtctccagggagacaccctctgctgcactttgcctttaacaagga

SEQ ID NO: 79163 - DNA, 111 bp, Mus musculus
ataatggactaaagctctggaactgtaagctggcgccaattaaatgtttttctttataagagttgctgtgatcatggtgtctcttcacagcaatgaaagcctaaccaatat

SEQ ID NO: 79164 - DNA, 72 bp, Mus musculus
cttatagttctgttttgacattttgatattttgatattcaaaatatcaaggaaggaagctttgaatggtgag

SEQ ID NO: 79165 - DNA, 79 bp, Mus musculus
aaataaggataggactggagagatggctcagaggttaagagtgctgactactcttccagaggtcctgatttcaattcct

SEQ ID NO: 79166 - DNA, 81 bp, Mus musculus
tactgaaccaaaggaagaccaaaagccagcagggtccaaagtctgtgtcccacgtctgtctgtctgtctgtggtcaaagtg

SEQ ID NO: 79167 - DNA, 60 bp, Mus musculus
gaagtgtgatacttgaaagggacaaagtcaggagccagcctgagtccctgagtggcactc

SEQ ID NO: 79168 - DNA, 93 bp, Mus musculus
atgtggtttgtgtatatgtgtacttgtgtatgtatgtatgtatgcatgtgtatgtatttgtatgtatgtatgtgtgtgtgtgcatctctgtat

SEQ ID NO: 79169 - DNA, 77 bp, Mus musculus
ctgtctgcctgtctccctgtctgtctatgtatgccacatgtctgcaggtgtgcacagaagtcagacagcagcatcag

SEQ ID NO: 79170 - DNA, 69 bp, Mus musculus
aacatactatatatatgtatatatatatatatatatatatatatatatgtgtgcatatatatatatgtt

SEQ ID NO: 79171 - DNA, 72 bp, Mus musculus
agagatgggctttgaggctttaaaagaaacaacaggcccaatgtctctctgtgtctctgtgagcctgtgtct

SEQ ID NO: 79172 - DNA, 64 bp, Mus musculus
gttcattcatatatgcatgtatgcatgtattcatatatgcatgtatgtatgtatgttctggtac

SEQ ID NO: 79173 - DNA, 112 bp, Mus musculus
catctttccacaagtctttttcttgtattcatatctttgtgggtgtctgtgtatgtgtgtgtcacactgaatttaacaatggctatgagaacattcagcttattggggagtg

SEQ ID NO: 79174 - DNA, 66 bp, Mus musculus
atatatatacatgtatatataaatatatttatgtatgggtatgtgtgtgtatgcatgtatgtgtgt

SEQ ID NO: 79175 - DNA, 64 bp, Mus musculus
gtgccaacccagacactctgtgtgactgtgaacttcacagcgcagcagagcaaagaggcaggcc

SEQ ID NO: 79176 - DNA, 61 bp, Mus musculus
gcctgcctctttgctctgctgcgctgtgaagttcacagtcacacagagtgtctgggttggc

SEQ ID NO: 79177 - DNA, 73 bp, Mus musculus
cagagcatatacagaccatcaaatttctcaatagcttgcctctatattttgggacagggtctgtgtctctctg

SEQ ID NO: 79178 - DNA, 84 bp, Mus musculus
aggaagttgctcagtggttgtctagtgcatccatttctagcatggaaaggaaaaatggagtgggcaagtacaagctaaagtctt

SEQ ID NO: 79179 - DNA, 87 bp, Mus musculus
tggttccttgctctctcagcaccagcttagctctaactaattttatatttagtcaactagcactttgttgagtggttcagggctcca

SEQ ID NO: 79180 - DNA, 96 bp, Mus musculus
tggaaaaaaatctgcatttctgactctctcttaaataatcaaaagaactttgattatttgatttgacataagtcgtccatgtggacaccatctcca

SEQ ID NO: 79181 - DNA, 100 bp, Mus musculus
tttttttttttagccctatatatatatattagcacccacatctcacctgactgggatgtgtctgtgtctgtcacaagtatattccttctgtggaaaagga

SEQ ID NO: 79182 - DNA, 106 bp, Mus musculus
gagagagagagagagagagagagagagagagagagagagagagatcaattaattctataattgtctgttctttgcagcttaggttttttgtttttttttttttttt

SEQ ID NO: 79183 - DNA, 112 bp, Mus musculus
tgttttacagaagagaaaaagatgaggctcacatccatcagccaaggtcaggacttagactctgacactctggctttggctccaagctcttggtctgctgtaattttaaaca

SEQ ID NO: 79184 - DNA, 69 bp, Mus musculus
gacgtccctcaagagagtgaggaaaggccttggcatggctgatttgcactttacttgagggaataagtt

SEQ ID NO: 79185 - DNA, 78 bp, Mus musculus
ggcagtgtgacatcacagaggctctggacatcacaaccctcctggtgagagtacagactctgctatgcagcagttgct

SEQ ID NO: 79186 - DNA, 108 bp, Mus musculus
tatgtatatgcatatataataggaatgcatgcatgtatatgtatttatatgtacatatatgtatttatatatctatatatgcatgtgtgtacatatatgtatataaca

SEQ ID NO: 79187 - DNA, 74 bp, Mus musculus
tgtgtctgtgtgtgtgagtgtgcatgtgcgtgcgcgtacgcgcacatacacacacacacacacacacacacaca

SEQ ID NO: 79188 - DNA, 85 bp, Mus musculus
ccagtgtctgcttggctgtctgtctctctgccccaaagacatcttcagtagggtagcacaagacttagggctcaagtcatcctgg

SEQ ID NO: 79189 - DNA, 88 bp, Mus musculus
aacatcgtttgctctagtttctgaaagatacagtacagtctcagtgactgtcaccatcctgtagtactacagcaagtcagaacttgtt

SEQ ID NO: 79190 - DNA, 72 bp, Mus musculus
gcacctaaaatagatgctcagtgagtgtttgcttgaatgaaaacatgaatgttgagtatataatttaggggc

SEQ ID NO: 79191 - DNA, 85 bp, Mus musculus
aggcttctcggtgtagctgggtctctcactctcttagcccagtatctctgtgtgggagaggtgactccttggcacatgaagacct

SEQ ID NO: 79192 - DNA, 80 bp, Mus musculus
acagacagtcagagagacaaagagacacacagagagacacagagaggtgtttacatgtgtgttcatgtgtggctgtgtgt

SEQ ID NO: 79193 - DNA, 58 bp, Mus musculus
atatatgtatgtacatgtatgtatgtgtatatatatacatacatgtatatatatatat

SEQ ID NO: 79194 - DNA, 70 bp, Mus musculus
taaagtgtgtttcctgttggcagtggatggagtctattttttttttatccaggctgacaattcagctttg

SEQ ID NO: 79195 - DNA, 75 bp, Mus musculus
accttaaagacaggtatcctgtgtgttttagctgcagtctatcactgtatgtctcacacacagtattttcttggt

SEQ ID NO: 79196 - DNA, 73 bp, Mus musculus
gcttggcatcactgaatatatgtctgatgaatggccatgccatcagtagattctgtgcattgcattgcgaagc

SEQ ID NO: 79197 - DNA, 115 bp, Mus musculus
attttatatataatagttgaggtatctgacactgccgaaacactgtctctctcttgctcattttgtcaaggaaggtaggaaagaggctttggcaaggctgcaacttgtaaggaat

SEQ ID NO: 79198 - DNA, 94 bp, Mus musculus
tgtttgtgagagtgtgtgtgtgtgtctgcctgtgtgtgattattcatcccattggttctgttactctgacagacaaatactctgaaccctgaca

SEQ ID NO: 79199 - DNA, 111 bp, Mus musculus
tgaaagtgactgccctgactctcaaggcaataaagcagagagtgacagaggatgacacccactgtctctccttctctagactgtacagacatgcagaggcattcacactca

SEQ ID NO: 79200 - DNA, 99 bp, Mus musculus
agggaggattagggggtgtggcctatgggaagaggctttgagattctaaaagcccatagttctctctttctctctgtcactgttctctctgttctctct

SEQ ID NO: 79201 - DNA, 121 bp, Mus musculus
ggagagcttttcagatcagatctgggatgtccagttatattgacatttgggagtatgtctgtccctgtctccgtctgtttcaggttgccctaacagaatagcagagactggatcagctata

SEQ ID NO: 79202 - DNA, 87 bp, Mus musculus
ggagtaggggggtgtcactttgaagtttcaaaagcccactctgggcctaatctgtctctgtttcagtgtgtgtgtctgtctgtctct

SEQ ID NO: 79203 - DNA, 116 bp, Mus musculus
cctaagaatattattattatagttttccctgcatatgtgtgtatatatgtgtatacatgtttgtatgtatgtgtacatgccatagtgtagggattttttaaaaaattttccaatgg

SEQ ID NO: 79204 - DNA, 114 bp, Mus musculus
gtgctttgaaaagcctacaacttgggctggagagatggctcagcagttaagagcactgactgctcttccagaggtcctgagttcaaatcccagcaaccacatggtggctcacaa

SEQ ID NO: 79205 - DNA, 77 bp, Mus musculus
ggaagaccctgtgatcactccctgtgtgtctctagtccaccgagcacgaggggaaggagcgaagtaagggcaagttc

SEQ ID NO: 79206 - DNA, 95 bp, Mus musculus
ctgggctctgaggctggctgcgtgcctgactccctgctggagggaggcaagcttcatcttgagcactgggtgagtctgcctgcttcctcctggga

SEQ ID NO: 79207 - DNA, 107 bp, Mus musculus
tgtttgtctttgaggaaattactacacaatgctgtccatgctgtgatagagaagactgtgcacaaagtataaggacaggggatagataaggaggaggaaggggaagg

SEQ ID NO: 79208 - DNA, 104 bp, Mus musculus
tgtgcatacacacacctgtacacctgtgtgtgcacacacacacacatgcacacacacgctcatgtacacatgcgcacacacatatgtatacctgtatgtgcaca

SEQ ID NO: 79209 - DNA, 63 bp, Mus musculus
catgctcaaagggacttatgtacagatgtcctgttctgttttgtcagtctctgtgtgtgcatg

SEQ ID NO: 79210 - DNA, 85 bp, Mus musculus; identical to SEQ ID NO: 57439

SEQ ID NO: 79211 - DNA, 61 bp, Mus musculus
tccactcgctcactcaccggcactctctttcaagagtaagaggtgggatgtgttcagtgga

SEQ ID NO: 79212 - DNA, 68 bp, Mus musculus
gcccgagtcattgtataggctaggatggcaataagccacaggattctgcctatctctgtctctctggt

SEQ ID NO: 79213 - DNA, 74 bp, Mus musculus
catgatggaggcaaggaaggaaggcaaggccaggatgagaaaggtgtctgtctctgtctgtgtttactgtcatg

SEQ ID NO: 79214 - DNA, 88 bp, Mus musculus
ggcctggaaagacagttctcagcactcgccctcccttctgtggacactccccacaggcgtcagtctcagactgtctttctctaaggcc

SEQ ID NO: 79215 - DNA, 92 bp, Mus musculus
ttccttagaaaggaattgaatttcaattgcaacatgaagatcagagattttgttgttaactttgaattgagaagcaaaagtgcttggagggg

SEQ ID NO: 79216 - DNA, 126 bp, Mus musculus
gtctatgcctgtgtctgtgcctgtgtttgtgcctctgtgcatctgtgtatctgtgtctatgtctgtgtgtgctgatgtgatctgatgcagaccctgggaagacagagtgtagggccaggctcagac

SEQ ID NO: 79217 - DNA, 99 bp, Mus musculus
gatgtctcctgggggctggagagatggctccatggttaagagcactgactgctcttccagaggtcctgagttcaattttcagcaaccacatggtggctc

SEQ ID NO: 79218 - DNA, 57 bp, Mus musculus
tgtctgtcatgctagtccaggggatctgtctccctcacacagacaagcatgcaggca

SEQ ID NO: 79219 - DNA, 89 bp, Mus musculus
aagcctctcctctttgtcactgtgtctcttttccagaagacaggacttccttatctctgagatatatggtgcccagacaccttgggctt

SEQ ID NO: 79220 - DNA, 116 bp, Mus musculus
ctgaggctcccgtgcagtacctctggtacttgatggtgtcactgctgtgtctgaggtcaggtcccacatagtcacaatccttgagttccctcaagagtgttctgtcttccacttag

SEQ ID NO: 79221 - DNA, 78 bp, Mus musculus
cccacagccaaagtgcacacagatactttgtagccacatagacagaagattctcagcagagtgggtgtgccgcctggg

SEQ ID NO: 79222 - DNA, 92 bp, Mus musculus
gccggtcttgttgcatcagcagtcagaaagcagagagaaatgagtgtcagggctcggctagctttctcctttgatggagcccagggaatggc

SEQ ID NO: 79223 - DNA, 72 bp, Mus musculus
cgctatttagcagaacactggctcagttcaggggaattctgaaagagatcaggcagctgcattctgagagcg

SEQ ID NO: 79224 - DNA, 117 bp, Mus musculus
tagatgaagagtagctaaggggctggagagatggctcagtggttaagagcactgactgctcttccaaaggtcctgagttcaattcccagcaaccacatggtggctcaaaaccatctg

SEQ ID NO: 79225 - DNA, 84 bp, Mus musculus
tttgtatacaagtgtgtgtgtatatataggtatgtgtatgttcaggtaggtgtatgtgtgtgtgtctgtatacaagtttgtgtg

SEQ ID NO: 79226 - DNA, 101 bp, Mus musculus
caggacatcaactgttgcacactaaggcaattagggataggggtatgtgtgtctgtgtctgtgtcggctgggatgggatatgtagcgtggggggaggtatg

SEQ ID NO: 79227 - DNA, 70 bp, Mus musculus
tgtgtgtatgtatatgtatatgtatgtatgtatgtatgtatgtatgtatgtatgtatgtatatgcataca

SEQ ID NO: 79228 - DNA, 116 bp, Mus musculus
gatttgatgagtaaatgaacgaatgaaacagtttccatagtcagagagagagagagagagatcccatttctccttatgatttctcactgcccctttgttctgacttccctaggatc

SEQ ID NO: 79229 - DNA, 67 bp, Mus musculus
agtcagaacaaaggggcagtgagaaatcataaggagaaatgggatctctctctctctctctctgact

SEQ ID NO: 79230 - DNA, 134 bp, Mus musculus
agtagtggggtgagataacagtcagtgtgggcaccggaccccctccatcccgctgtgtgaccctctcactcactgctgcactagcatcccagttgcgtgcttctccccacgtaataatgagggatgcgggtcag

SEQ ID NO: 79231 - DNA, 117 bp, Mus musculus
tcatatgtatatacatgcacacatatgcatgtatgtatataaaatgtgtatatgtatgtgtgtatgtatgtatgcatgagtgtgtgtgtatgtatgtatgtgtgtacatatacatat

SEQ ID NO: 79232 - DNA, 75 bp, Mus musculus
atacatacacacatatacacacacacacacatatatatatatacatatatatgtaatgtatatatgtatatgtat

SEQ ID NO: 79233 - DNA, 102 bp, Mus musculus
gcatgacactgtggcatgtacatgcccacactcgcatgtgtgacttacacaagtaacgtacacacagatgtatgtgtgcacacacatgcacatatagtatgc

SEQ ID NO: 79234 - DNA, 80 bp, Mus musculus
taggataggcacacatatgtaggagggagagagatatagaagatctttgtatttttctctctacattttgcttctaccta

SEQ ID NO: 79235 - DNA, 100 bp, Mus musculus
gaatttttttttaaacactgctacaacatttgcctgctacaggcagtgccatggctctgtctgtctgacacaatggaatgcaccatctctaaaatatttc

SEQ ID NO: 79236 - DNA, 103 bp, Mus musculus
gggaggtacgtgtttcctggtggacactcagcaaattgattgtgtcagaacaaagagagctgaccacagttcaacagcttcccctggagccaggcttcttctc

SEQ ID NO: 79237 - DNA, 89 bp, Mus musculus
tgctggagttctcactgactctcttccctgttttgagaagagacttagcactgagcagagggatcgaggtatcattgagaatcccagca

SEQ ID NO: 79238 - DNA, 64 bp, Mus musculus
tatgtatgtgtgtgcatgtatgtgcatgtatgtgaatgtatgtgcatgtgcttgtctgtgtgtg

SEQ ID NO: 79239 - DNA, 78 bp, Mus musculus
ccaggttatggagaccagcccagaggaacggggctggcagtgcctcagggcccgtctctctcacaggctctatcttgg

SEQ ID NO: 79240 - DNA, 73 bp, Mus musculus
aagtgtcaaattattgaagaatgggttaaagccacccaatggggggctttgggacatttcagagtcaacattt

SEQ ID NO: 79241 - DNA, 96 bp, Mus musculus
ggaagaattgcctccatcagactggtctgtgagcatatctatggagcatttttttttaattcatgtagaatgtcccagacctctgtaggcaatgcc

SEQ ID NO: 79242 - DNA, 70 bp, Mus musculus
ggggagactgggcacaaggtgagacattaccagacacccctggttgttttcactatgtgtctctctctct

SEQ ID NO: 79243 - DNA, 71 bp, Mus musculus
gtgtgtgtgtatgtatgtatgtgtgtatgcatgtattatgcatgtatgtatatatgtatgtacacacatat

SEQ ID NO: 79244 - DNA, 114 bp, Mus musculus
gaggatgaggcctggtaattagcagcagtaatgcgctctgtcactgtgcctgtcccagccatggactagcacatgtgtcctgccatgtttgctctctgaacgtcggtgcccttc

SEQ ID NO: 79245 - DNA, 93 bp, Mus musculus
gcacccatgtggcagctcacaactgtctgtgtaactccaattccaggggatccgataccctcacacagacatgtgtaggcaaaatacaaatgc

SEQ ID NO: 79246 - DNA, 77 bp, Mus musculus
gggccaagagattgtgaggacacagcgggccaccagcactaggctgatgggcactgtgttactgcctgctctatcct

SEQ ID NO: 79247 - DNA, 81 bp, Mus musculus
ggcttgcgccaccaccacccagagagacagctcagcggttaagagctctgactgctcttccagaggtcctgagttcaagtc

SEQ ID NO: 79248 - DNA, 93 bp, Mus musculus
ggagccacgacataaaaggagagaattcgctcctgcaagtcaccttctgacctctgtgtgcgtgtgtgcctctgtgtgtgtgtgtgtgcctct

SEQ ID NO: 79249 - DNA, 75 bp, Mus musculus
agacatgcagcttggtcttcatgagagtctcctgacagcagggtcaggcactgtctctgactatattgcctgcct

SEQ ID NO: 79250 - DNA, 112 bp, Mus musculus
tgtctctgtctcagtctctctccatatatatatatatatgtgtgtgtgttatataaatatacatatattatttttattttaagtatgtgtttgctaggctgaagcatataca

SEQ ID NO: 79251 - DNA, 72 bp, Mus musculus
catcgcacaacttgaagaaatcacagttctgattttcaggggagagaggagtctgtgtgcacttgtgtaatg

SEQ ID NO: 79252 - DNA, 122 bp, Mus musculus
ctgtctgtctgtgcgcacatgcatgttattcacatgtgcatgttttggatttcttttgtttttttttcaattttaaagatgtatttattttatgtatgtgagtacactgtaactgtcagaca

SEQ ID NO: 79253 - DNA, 100 bp, Mus musculus
ggtgggccgcctaaagatactttctgattttcatgttgaataattcttccttctgatctttctatctcttggctatttttagattgcaagtgtgtccacc

SEQ ID NO: 79254 - DNA, 93 bp, Mus musculus
tctgttttctcactcataaaatattttgtttcatattagctgtgacattctaggcacctatggaacaaatatgttgttgtatgtaaggtcaga

SEQ ID NO: 79255 - DNA, 163 bp, Mus musculus
tatatacatatatacatatatatatgtatatatgtatacatacatacacatatatacatatatatgtatatatgtgtgtgtgcatatatgtatatatgtgtatatatatatatatatatatattacacacatatatatgtaaaacattatgtatattatatat

SEQ ID NO: 79256 - DNA, 134 bp, Mus musculus
acatatatacatatatatgtatatatgtgtatgtatgtatacatatatacatatatatatgtatatatgtatatatgtatatatatgtgtgtgtatatatatatatatatatatatatatatatatatatatat

SEQ ID NO: 79257 - DNA, 107 bp, Mus musculus
ggcatctgggaagatagaggtaccattcactgcatggaccccactagaggaaggatgggtgatagaagacagtgagcttggattggggatattgactctgagatgtc

SEQ ID NO: 79258 - DNA, 71 bp, Mus musculus
tcagagagggcataaacgaggtctgtagccttgggagaccatgcggctgacactcagtggctctgctctga

SEQ ID NO: 79259 - DNA, 114 bp, Mus musculus
gttttctaagcaaaaggcttatctaacaaattttccatgcttaaggtgagaaaaactgagaaattagattttttttcaagatgcctcaaacagaaaaataagtcttagggaaac

SEQ ID NO: 79260 - DNA, 74 bp, Mus musculus
ccagcgtatatgtgtgtatagtatgtgatgtatatatgtatgtatgtgtacatatgtgcatgtgtgtaggttgg

SEQ ID NO: 79261 - DNA, 68 bp, Mus musculus
gatactgactttgtaagaattgcacaaggccactagaaggtctctgtgtttctctgtctgtctctatc

SEQ ID NO: 79262 - DNA, 88 bp, Mus musculus
caagcctgaatggtcccccagaaacccagcttctaaagtggtattcacaccctcagcctctgtctctgggaggattatttttagtgtg

SEQ ID NO: 79263 - DNA, 101 bp, Mus musculus
tatatatatgtatatatatataattcttatatatatgtgtgtgtgtatatatatatatacacatacatacacatatacatgaatatatatgcatatacata

SEQ ID NO: 79264 - DNA, 89 bp, Mus musculus
gtatatgcatatatattcatgtatatgtgtatgtatgtgtatatatatatatacacacacacatatatataagaattatatatatatac

SEQ ID NO: 79265 - DNA, 87 bp, Mus musculus
gggattgatgcttacccgtgggatggatctcaagttgggccagtcactggctggccattctctcagtctctgtaacatctttgtccc

SEQ ID NO: 79266 - DNA, 85 bp, Mus musculus; identical to SEQ ID NO: 57470

SEQ ID NO: 79267 - DNA, 67 bp, Mus musculus
cctgagtgaagaaatagagctctggcagtcccagaactcttgtctctgacctctaatgcatctcagg

SEQ ID NO: 79268 - DNA, 85 bp, Mus musculus; identical to SEQ ID NO: 57439

SEQ ID NO: 79269 - DNA, 80 bp, Mus musculus
actttccctcactgtctcacacagactttcctctgagaggaggcacaaggatttggggtaacacagtgacacacaagagt

SEQ ID NO: 79270 - DNA, 112 bp, Mus musculus
ctgtgtgtgtgtttgtgtgtgtgtgtgaattgtgtattgtgtgtgtttgcatgtggaatagacagacagacacacagagacactgaaagagacagagacagatggataagca

SEQ ID NO: 79271 - DNA, 100 bp, Mus musculus
tctgtttgtctctatatatgtatatatatatatatatatatacatacatacatgtgtaggtgtaggtgtgtatatgtaagtatgcatggacacttacaga

SEQ ID NO: 79272 - DNA, 72 bp, Mus musculus
gtgtgtgtatgtgtgtgtgtgtgtgtgtgtgtatgtgtgtgtgtacgtgtatgtgtatatgtatgtgtgtgt

SEQ ID NO: 79273 - DNA, 76 bp, Mus musculus
atgttgagtggagttcaccatgaagccctcagcagggtctttctttgtgagattcactgactgactctctcaatat

SEQ ID NO: 79274 - DNA, 75 bp, Mus musculus
ggcctgtgtttatctgagtgcatgcaacagaagagagcgccacctcagctgtgtgtctctcagtgacaaatggcc

SEQ ID NO: 79275 - DNA, 68 bp, Mus musculus
gttgtggcttgcccagggccaaatgagctgtcactcagtcactggtagagctcagcatggaacccagg

SEQ ID NO: 79276 - DNA, 83 bp, Mus musculus
ggtgatcctacacagatgaggagctcagagaccctcacagtagctacagtgtgtctggctctctgcctcgtttctatgttacc

SEQ ID NO: 79277 - DNA, 101 bp, Mus musculus
gtgagcgagggattttcctgggctgtctcctctctgccagactgtcacgctcttgttctgtgtttaccgtctcatgcctacagaaaatgtgtctttgccat

SEQ ID NO: 79278 - DNA, 105 bp, Mus musculus
tgaaatggttttagtactgataggcactgccatcactgatcagtctcagactctcactggggttaagagatggtttaaagcccagccctacaaaatctctaatca

SEQ ID NO: 79279 - DNA, 79 bp, Mus musculus
gaagccttaatgactctctctgtgacactaatgatagataaccttcatggctggccaaggagtgggtgtgaagagcttc

SEQ ID NO: 79280 - DNA, 91 bp, Mus musculus
ccctgggcgtggaagggatgcagttgaacaggtcctttgccctaggctgagaataatttgtctgtatctctctatcactttgagtctgggg

SEQ ID NO: 79281 - DNA, 86 bp, Mus musculus
aaatgggattgtggaatatgataactctgtgtttagtgcttcgaggaacatgtctactgtttttcatgttttacaagttctgattt

SEQ ID NO: 79282 - DNA, 80 bp, Mus musculus
aggggcttattctcagtcacagttttgtgttgcagttcatcatggtgagagatgcatgatgacagaagagtgaggccact

SEQ ID NO: 79283 - DNA, 104 bp, Mus musculus
catgcagggttgataagcacatgtcagagttttatccgaattattagttcatctatgagcaattccatgtggatctgagaaacctaacgtgtataaccagtggc

SEQ ID NO: 79284 - DNA, 140 bp, Mus musculus
cctagagcccctcacaccctcacgatggaagaagggcccacaggggccgccccaggcctcactgttctctatggctttttattcctatgtgattctattgctcgctcatatagggattggagccgtggcgtacggtgagg

SEQ ID NO: 79285 - DNA, 90 bp, Mus musculus
tccaggctgaggtagtagtttgtacagtttgagggtctatgataccacccggtacaggagataactgtacaggccactgccttgccagga

SEQ ID NO: 79286 - DNA, 65 bp, Mus musculus
accacaatttatatattttgtaacactggccacctctggtcctggttgtaggagcttgttgtggt

SEQ ID NO: 79287 - DNA, 94 bp, Mus musculus
gacctaagacaggcccccaggctcagtgtgtgtgtgagtacccactcacatgtagaaccgtggcattgctgccttaggggctgtgtctgcattc

SEQ ID NO: 79288 - DNA, 81 bp, Mus musculus
ctgcttcagcctgtcttctgttagtgtcagtcgctgttccagaatggacactgtctgcaaaagaaaaggtatcaggctcag

SEQ ID NO: 79289 - DNA, 114 bp, Mus musculus
agaaggaagtacatgggaaggtctgcatttggcgtgactgactctctgcctgtggcttgtgtgctttgcctctggctgtgttacttaaacccagtctttcccagatcacctact

SEQ ID NO: 79290 - DNA, 71 bp, Mus musculus
ctcctctcagttactctctggctctggccctctggcctccatgatcatagcatagcgtggagaagaaggag

SEQ ID NO: 79291 - DNA, 78 bp, Mus musculus
cgaggcaggctggaatttcatcactgtggaggaatgagccctcattctcacagtgtctctcctcttcgaattccttcc

SEQ ID NO: 79292 - DNA, 133 bp, Mus musculus
gggatttagaaagtagacaggttttaggggaaaaggaccagagcccttgtgatggtgactgtctctatctgtgaacctagaggggatttcgacttaaatttttatctcacatcctgatcttctacagcaaatg

SEQ ID NO: 79293 - DNA, 117 bp, Mus musculus
ggaacccagaaagaatatgtagcatggattaagaaaagtggtgtaagactatatgtttataatttaagagtaagtcaaaagccatgtagtgattcctgacaaacctcttgaggtttc

SEQ ID NO: 79294 - DNA, 100 bp, Mus musculus
catattattgactaagagcaggccctctcaccctctgactccggatcctcttccctccttagagtttgagaaggccttatgccgccctggtcctgatgtg

SEQ ID NO: 79295 - DNA, 64 bp, Mus musculus
gatatatatatatatatatatatatatatatatatatatatgtatgtatgtatatgtatatatt

SEQ ID NO: 79296 - DNA, 62 bp, Mus musculus
ctcaccaagccagctgggctgcctacagagtcccagggtctgtctgcctctctggcactgag

SEQ ID NO: 79297 - DNA, 97 bp, Mus musculus
agaactctgtgggggggggtagagccaagaagatcaggagctcaaggtcatctttggctctctatgtctgtctgtctatctatctatctatctatct

SEQ ID NO: 79298 - DNA, 82 bp, Mus musculus
agcgaaggttgtgggaagtagggatggggtacttagtggcaaacaggttaaacactttatatttaactttcataacagtgct

SEQ ID NO: 79299 - DNA, 84 bp, Mus musculus
tgagatcaaacagaatttgggtagtatgtgggatggtgtaatgtgttgtctatatgtctgtttctgtcagtctgtttgcactca

SEQ ID NO: 79300 - DNA, 89 bp, Mus musculus
tggctgcctagggcagagacaagtgagtcagctgaattgaagaaaattaatgtacagtcatcctttgttctgtcacaagaggggcacca

SEQ ID NO: 79301 - DNA, 76 bp, Mus musculus
ggacatgagtgcatgagccagctctctctgtctctgccagggttacagcactgagctctcagacgtactcatctct

SEQ ID NO: 79302 - DNA, 112 bp, Mus musculus
agttacaggtatttgtgaactgggtgctgggaattaaacccaggtcctctgaaagagcatcaggagctcctatatgttgagccagtcccttcctcaatgataccttgtgagt

SEQ ID NO: 79303 - DNA, 85 bp, Mus musculus
cagcctggaggcacagtgtctgtggctctctctgcatcttatggattgcattgaataaataaagtcacacaccacctttgggatg

SEQ ID NO: 79304 - DNA, 73 bp, Mus musculus
gttatggttattggctttttttttttttttgtgggggagttcctcacagtaagagtgaaggctgtctctgact

SEQ ID NO: 79305 - DNA, 103 bp, Mus musculus
ggggatgaggggaggatctttgtgaggggaagaggagggactggtattaggatgtaaagttaatagttttttttttttttaaagaagcacctcaatttctctc

SEQ ID NO: 79306 - DNA, 79 bp, Mus musculus
ctacagccatcttggagggtagagactgagcagtgtgaacaccattaatccgagctaagattctctaagtaagctgtag

SEQ ID NO: 79307 - DNA, 103 bp, Mus musculus
tgtctgtgaatttcatgatgtgattttttttaaaaacagctgagtaatactctattgtgtaaatatatcattttaaaaaaatccattctttggttgagggaca

SEQ ID NO: 79308 - DNA, 114 bp, Mus musculus
cagagggtactggacttctgaaatagattgtgacactagattgggggagagtgtatgtgaattttttttctaaaaaagagagctataattatcagagtttcagagatagatctg

SEQ ID NO: 79309 - DNA, 85 bp, Mus musculus; identical to SEQ ID NO: 57470

SEQ ID NO: 79310 - DNA, 93 bp, Mus musculus
tatatcagtgtattctagcatagacattatgtatatatgtgtatatattacatgtgtgtatgcttatatatgtgtatacccatattatataat

SEQ ID NO: 79311 - DNA, 76 bp, Mus musculus
gtggagagtagttaacacagacacttaggtgtaggacaaagtgctatgaataagctgactgtgagcactcagccgc

SEQ ID NO: 79312 - DNA, 85 bp, Mus musculus; identical to SEQ ID NO: 57439

SEQ ID NO: 79313 - DNA, 109 bp, Mus musculus
gcaattcactgtggccactgggcaaaggcactgatgggacattaggcagtgataaaacactgcctctctcagagcctgacttagcctaccatggataccgctcacttgc

SEQ ID NO: 79314 - DNA, 82 bp, Mus musculus
cagtctagctacggttaatggtgggtgacgcgtgtctgtctgggcctctgaataagtctccatctctctgtggctctccctg

SEQ ID NO: 79315 - DNA, 72 bp, Mus musculus
ggagcaggtctcccaactctctctgtcacttatccacagcgcggatttgagccacagcgcagggtctggtcc

SEQ ID NO: 79316 - DNA, 66 bp, Mus musculus
gcggaatctgtcagtgactccctcggtgccggctgtgagggaggagttaaaaccgatatgtgacgt

SEQ ID NO: 79317 - DNA, 87 bp, Mus musculus
gatccccaagggctgaactcctgaactgatgaggtgtgcgtgacacgcacacactcagcttcagattccaacagaccccggtggctc

SEQ ID NO: 79318 - DNA, 78 bp, Mus musculus
gtacttgtgcttagacactgcagcaatgtggaatatgtaaacaccagtcatattgttgtattcttatgctcattctac

SEQ ID NO: 79319 - DNA, 114 bp, Mus musculus
aggctggcaggtaaggaggctggcaggggattaagatgtcagtcttgagctgtcagtctgtcactatgagtgtgaggtggtgctgttgggtactatccagatctggggagcagg

SEQ ID NO: 79320 - DNA, 94 bp, Mus musculus
ggagctgttcttggctgggtctcagcagttcctcctttcttgggaaacagctgagtgaggagagagagattgagtcctttccctagaagtctcc

SEQ ID NO: 79321 - DNA, 111 bp, Mus musculus
agagagcaacctgcttctgtcttgaagtgctgggattaaaggtgtacatcactggctgcctggctgccttttttccccctaccattaagagtcataggtttgatgctttct

SEQ ID NO: 79322 - DNA, 70 bp, Mus musculus
agtattcttgtatgtatgtatgtgtgtatgtatgtatgtatgtatgtatgtatgtatgtatgtgagtgct

SEQ ID NO: 79323 - DNA, 99 bp, Mus musculus
gcccagcctggccttgaacttatgactgtctaactcactctcctgattctgagattacaagagtgagtcaccatatttgacaggttctaatttctgggt

SEQ ID NO: 79324 - DNA, 80 bp, Mus musculus
tatatatctgtatgtatctatctatgtatatgtttatctctttgcatgtatgtgtataggcatgtatgtgcatttatgtg

SEQ ID NO: 79325 - DNA, 103 bp, Mus musculus
ggtgaaggggggctctttggtggtgggaggcttcactgggacgggcacatgtctagtgagggaaagttgtctgggaagaggagtctgttcattgagatgaggc

SEQ ID NO: 79326 - DNA, 116 bp, Mus musculus
tcctacctacctacctctgttgttggccttactgttggtagcagttgatggtctctgtagatagtctgaagagtccctcaaattgatcctgggcccactgtggggtggggggagga

SEQ ID NO: 79327 - DNA, 69 bp, Mus musculus
agctactctgcctgtctcactgccgctctgtgacagtaccagagtagcagagtgaggagccagttagct

SEQ ID NO: 79328 - DNA, 79 bp, Mus musculus
tgaaaaagtgatttctggggctggagagatggtttggtcgttaatagcactgactgctcttccagaggtcctgagttca

SEQ ID NO: 79329 - DNA, 84 bp, Mus musculus
gcacacacgcactcacgctctccatttctctctcacacacacagaatgtggggacaaggattgggttggggtgatggtatgagc

SEQ ID NO: 79330 - DNA, 72 bp, Mus musculus
ctgccctgcatccctgtcggcaccacactgctcatctctcaggagagctctgacagcagtgagtgagggcag

SEQ ID NO: 79331 - DNA, 63 bp, Mus musculus
tgacagcagtgagtgagggcaagtgcggtccattcagaggatcggccatgagtcctggtgtca

SEQ ID NO: 79332 - DNA, 67 bp, Mus musculus
gatatagggctggagagatagctcagcggttaagagcactgactgctcttccagaggtcctgaattc

SEQ ID NO: 79333 - DNA, 115 bp, Mus musculus
ggtagaaaggaggtacacattggggctggagagatggctcagcggttaagagcactgactgctcttccagaggtcctgagttcaattcccagcacccacatggtggctcacaacc

SEQ ID NO: 79334 - DNA, 58 bp, Mus musculus
cctgcctgcctgcctgcctgcctgcctgcctctggcagattctggacacaggtacagg

SEQ ID NO: 79335 - DNA, 92 bp, Mus musculus
agatctataaagtaagcaggagaaactgcaggccatgattctttttaaataaagtgtgaatttctgtgatttcccctccttgttacagatct

SEQ ID NO: 79336 - DNA, 66 bp, Mus musculus
ggccaggggctggagagatggctcagtggttaaaggcactgactgctcttccagaggtcctgagtt

SEQ ID NO: 79337 - DNA, 125 bp, Mus musculus
aactgtcagcaaggactcaaggtcacaaagggtgaaactgtgacaagtctgaaaagtctcacttgagagagagaccacagagtccagttttatgttgtgtgtcatgatggttaatcttggttgtc

SEQ ID NO: 79338 - DNA, 123 bp, Mus musculus
ggctcctcactggttgcagtagcccacacggtagcaacgggtacagcgcttcagcttttcttcttctgattgctgcttccgctggcaggctgcgcacttggagatagggatgctgggtacctg

SEQ ID NO: 79339 - DNA, 92 bp, Mus musculus
ggcaataacaaactaaacttgggaggcagaggtaggtggatctctaggagtttaaggccagcttggtctacaaggtgagttccagaaaagcc

SEQ ID NO: 79340 - DNA, 85 bp, Mus musculus
cagtgattacagctcgtttgaataggcttcacttttaacaaatgacagttctttggattgaagctgggcaaggactgtaccactg

SEQ ID NO: 79341 - DNA, 60 bp, Mus musculus
actgtctgtctgtctgtctgtctgtctccctgggggctcagctaaggagattgaggcagt

SEQ ID NO: 79342 - DNA, 94 bp, Mus musculus
tgctctttttagaggcagtgtatagagaaggctgcaggggaaacgtatcccaaatatgtctttttgtttttcactactatctcaagaataagca

SEQ ID NO: 79343 - DNA, 69 bp, Mus musculus
gtctgtgtgtctctgtgtatctgtactggtttgtgcatgtcagtactaaaagagagcaatgactcagat

SEQ ID NO: 79344 - DNA, 96 bp, Mus musculus
cgtcttccccattctggaaagtgtactggacgcggccattggcatgggcatccctgtcagtggctgagatctgcaggacactagtgaaaggtggcg

SEQ ID NO: 79345 - DNA, 80 bp, Mus musculus
ttcagtgtctgtgtttgtgtgcatgtgcatatacctatatttgaatacggttcctgcacatgccagaagaatgtgttgga

SEQ ID NO: 79346 - DNA, 79 bp, Mus musculus
gaatatgcagggggtggtgactgataacaggggtggcggtccccatctcactgactctcaccaaccacgctgacccatc

SEQ ID NO: 79347 - DNA, 71 bp, Mus musculus
gtaagtctgtgactgtggaaggggtcagggatgaggctttcctaggtccctccctccctgtttgggctcac

SEQ ID NO: 79348 - DNA, 100 bp, Mus musculus
gaattcctctgtggggctggagagatgacttagcggttaagagcactgactgctcttccagaggtcctgagttcaattcccataaaccacatggtggctc

SEQ ID NO: 79349 - DNA, 79 bp, Mus musculus
gtggtacaggagcgtctcagaggccccttgaaggactctcagcctcagtgtgtctctgtgtatcaagctgctcatgccc

SEQ ID NO: 79350 - DNA, 109 bp, Mus musculus
gtggatgctagcaagtgcttactgacaggagcctgatatagctctctcctgagaggctctgtctgtgcctgacaaatacagaagtggatgctcactcacagccatccat

SEQ ID NO: 79351 - DNA, 77 bp, Mus musculus
caggggcaggagctcaccctctgattcacctctccctgcaggcaccaagggtgaggcagtctgtggctcccaccctg

SEQ ID NO: 79352 - DNA, 79 bp, Mus musculus
tgagcttggagaagagccatggattaagagcacacactgctgttctagcaggtttgagttcctctgcctataaagctta

SEQ ID NO: 79353 - DNA, 85 bp, Mus musculus; identical to SEQ ID NO: 57439

SEQ ID NO: 79354 - DNA, 73 bp, Mus musculus
agctccctgactgactgactctctaggtaagggaactgtatgactggagacccagcactcaggacactgagct

SEQ ID NO: 79355 - DNA, 62 bp, Mus musculus
acacacacacacacacacacacgtgtgtgtgtgtgcgcatgtgtgtgtgtgtgtgtgtgtgt

SEQ ID NO: 79356 - DNA, 72 bp, Mus musculus
gtatgtatgcacacatctgtgtgcatgtatgtatgtatgtatgtatgtgcacatctgtgtgtgtgtgtgtat

SEQ ID NO: 79357 - DNA, 109 bp, Mus musculus
atgtatctgtttgctattctataggttggcacttctgtaggtcaagagaagcaactgagtccctgagacactaacatgtcagagctgaatagacaggtcggagtaacat

SEQ ID NO: 79358 - DNA, 81 bp, Mus musculus
gcactcagtgtgcactaccatatttggccatttatttttatgtttttaagtgtgtcactgtgtgtgtgtgtcactgtgtgt

SEQ ID NO: 79359 - DNA, 80 bp, Mus musculus
aggctggcctcaaagtcagagatgcacctgcctctgcctccagagtgctgaattaatggtgtgtgcctgactccctgcct

SEQ ID NO: 79360 - DNA, 62 bp, Mus musculus
gtttagagaggagggattttatggaaacctgcaatttagactccgtgtctctctctctgaat

SEQ ID NO: 79361 - DNA, 115 bp, Mus musculus
tgtgataagcactgtcatagacatgtatgttactttgcaaagctgagaactatctttgtagttttccaggtttggaaatacgtccataagatacatatgaacttaatttgttgca

SEQ ID NO: 79362 - DNA, 111 bp, Mus musculus
cctgcccaggcatggagactcctgagtttgtggccctgccctgtctgagtgtctgagtgagtgtgtgggcaggattcacttcgagccagccactcccaggcacacaggagc

SEQ ID NO: 79363 - DNA, 103 bp, Mus musculus
aagatggctgttttgaggaaaatgattttctaagatggcacattaatcttctaacatttcactgccattttgaagctcctttcaaaacttcagagccatgctt

SEQ ID NO: 79364 - DNA, 97 bp, Mus musculus
gaattctagcaagtaggcggcagcaacaacaggatgggaagagcggtaggtctgtctgtctgtctgtcagcaggtaaagcctccccagctgggtgtc

SEQ ID NO: 79365 - DNA, 60 bp, Mus musculus
gcttctgagaagagcctgagcacttgccttggctcatgctctccgttccatgtccagagc

SEQ ID NO: 79366 - DNA, 91 bp, Mus musculus
gtaaccgggtagcctccctggggaacaaaatgctgtgtgaagctacacatctggtcattctctgagtccctctgtatgtaaccctggttgc

SEQ ID NO: 79367 - DNA, 109 bp, Mus musculus
acctctgagctgttgctcctgcaccgcacctttacatttaagcctatgcactgtgtgtgtgagtcagtgtgttcgggtgaatagagtgcctgagaaacaagcttcaggt

SEQ ID NO: 79368 - DNA, 116 bp, Mus musculus
cagtgaatcaccccctgcatttaggtatgcgtccatgaggatactttggaagtgacacactctgtctctgtgtcatttttctcaggacagcgcctttggatatgagtggtaacctg

SEQ ID NO: 79369 - DNA, 68 bp, Mus musculus
ttacagacagacacactgtgcgatttgggtctatttctcaggtatttctctgtgtgtgtggtgtgtaa

SEQ ID NO: 79370 - DNA, 83 bp, Mus musculus
gggagcatctttctatactgaacacttgagagccgccctctgcagactccaggctctctctgtgtcccagtgtcttctcgggt

SEQ ID NO: 79371 - DNA, 118 bp, Mus musculus
aagatcagccttaatccatgatgatctgataggatgcatgggacaatttcaatatttttgtatctgttgatgactgttttgtaaccaattatattgtcaactttggagaaggtatctt

SEQ ID NO: 79372 - DNA, 72 bp, Mus musculus
ggtaatagccagttcctcctccactgtgctcagaagccagtgtccacagagtgaggccccgctgctatggcc

SEQ ID NO: 79373 - DNA, 82 bp, Mus musculus
tgtcgggctggaaagatggctcaggggttaagagcactgactgctgttccaaacgtcctaagttcaattcccagcacccaca

SEQ ID NO: 79374 - DNA, 80 bp, Mus musculus
gaatagcagaggggctggggagacggctcggtgggtaagagcactgactgctctttcagaggttctgagttcaattccca

SEQ ID NO: 79375 - DNA, 93 bp, Mus musculus
ggtattctgcccatgcgacatctcgaattgagttgaggggctgcctccctctctgattgccagtttcccagatgtgcaaaacccagcaaagcc

SEQ ID NO: 79376 - DNA, 71 bp, Mus musculus
ctctctgtctctgtctctgtggcctaagagtcctgagatgaccactgcggactctgactagagacctggag

SEQ ID NO: 79377 - DNA, 89 bp, Mus musculus
ctccctcagtcagagctatgggtcccctctctcagtcaggctgtggtgtactggggttcagctgtgatcttggagcctgggcttatgac

SEQ ID NO: 79378 - DNA, 105 bp, Mus musculus
ttatatagttattgatagtatatatacacactcacatatatgtatatatgtgtatatatatatatatatatatagtttatatagaactttctggtaacattataa

SEQ ID NO: 79379 - DNA, 81 bp, Mus musculus
ctggtctctaggcctcagtcttccttttgtaaaatgggtatgtagtagaagtgaggatgacaagagtgtcagcagacacag

SEQ ID NO: 79380 - DNA, 72 bp, Mus musculus
gtctctgactctgtctctgtcacctccaggatcctcttcctggctctcaggttcagaaggaaagcatgtgac

SEQ ID NO: 79381 - DNA, 77 bp, Mus musculus
ggaagggtttgggctggtgagctggctcagtgggtaaggacactgactgctcttccagaggtcctgagttcaattcc

SEQ ID NO: 79382 - DNA, 78 bp, Mus musculus
tttatctgtgtatatgtacatgtctgtttctgtgtgtgactgcttgtctgcggatctgtgggtgtgtctgagggtgga

SEQ ID NO: 79383 - DNA, 107 bp, Mus musculus
tgacacacacacacacatgcatatatatacatatgtattatattatattatattatattatattatattatattatattatatatgtgcatactcttttctggttca

SEQ ID NO: 79384 - DNA, 86 bp, Mus musculus
gggtcacccttggaatttgaccttgggcaggtgttttcctctctcacaacctgtctgtgtatctctaaggtggttgggagtgaccc

SEQ ID NO: 79385 - DNA, 73 bp, Mus musculus
atagggtgactctcattttgtctgtccttgaggtttttagtgagaggcagggcaggggaattgctaatcttgt

SEQ ID NO: 79386 - DNA, 90 bp, Mus musculus
tcctgttgggaaagacagataaaagggtttagtcacacacacacacagagtcacagagtgagtgagcaaatcttcaaggggctaacagga

SEQ ID NO: 79387 - DNA, 92 bp, Mus musculus
tcaggcagtgctaagagtaaagggtgtgagaccacacactcagctttcatgggacttttgtttgaattttgagactgtgtctcaagtagccc

SEQ ID NO: 79388 - DNA, 91 bp, Mus musculus
gctgttaaatgttcttttaagggctgaagagatagctcagaggttaagagctctgactgctcttccagaggtcctgagttcaattcccagc

SEQ ID NO: 79389 - DNA, 96 bp, Mus musculus
tccagaagaaggggttgtatgtagcatggcatgcgttctgcatgaagtaatgcactcacacagtctgaaacttatgaaacatctttcttgactgga

SEQ ID NO: 79390 - DNA, 120 bp, Mus musculus
tctgtaaatatggaaaagatatttttacaaaacagtgtttttaaatgctttgtgatacatttttatctttgagtaagcttgtttaaaaacttgtgagaatgctgaagaaccattgtagga

SEQ ID NO: 79391 - DNA, 78 bp, Mus musculus
gtctgtctgtctgtctgtctgtcgtgcatggctacttttaaagagtagtggagtattgaggacagaggcaagcaaggc

SEQ ID NO: 79392 - DNA, 92 bp, Mus musculus
gtgtgtgtgtatatgtatacaattagaaattatatatatatattatttatatatatataatttctaattgttatttgtgtgtgtgtatgtat

SEQ ID NO: 79393 - DNA, 87 bp, Mus musculus
tctgtctgtctgtttgtctatctgtgcctgtgtctgtgtctgtatatatacaccatgtgtatgaaggtgcatgaagagaccagaaga

SEQ ID NO: 79394 - DNA, 99 bp, Mus musculus
gagacaatgtttatgtggggttcatatatatatatacatatatatgcatatatatgcatatatatgtgtgtatatatatatgcatatatatattctttc

SEQ ID NO: 79395 - DNA, 63 bp, Mus musculus
gtatccatgtatccatgtatgtatgcatgatgcatgcatgcatgtatgtatgtatgtgtgtat

SEQ ID NO: 79396 - DNA, 98 bp, Mus musculus
tctctctcagcctgtgtattctaccaagtcctgagacacacacacacccaatgccaaatgtaattagggcagaattgcgtacagatggctgggaaggg

SEQ ID NO: 79397 - DNA, 64 bp, Mus musculus
cctggcccagtccgcagaagcatggagtgcaggaatctctctatctgagtctgtgggtgccatg

SEQ ID NO: 79398 - DNA, 116 bp, Mus musculus
tgctccctgccatgatgacagtggactcaatctctgaaactataaacaaggtccagttaaatgctttttttgtttagaaataagattttccttggtcatggtgtttcttcccagca

SEQ ID NO: 79399 - DNA, 94 bp, Mus musculus
atatatatgtatgtatgtatgtatatttgtgtgtatcatacaaattgaaacatatgtatgtatgtatgtatgtatatgtgtgtgtcatacaaat

SEQ ID NO: 79400 - DNA, 62 bp, Mus musculus
tgtctgtgtctgtgtgtctgtgtatgtgtgcgttgctatgcataggtacacaagcatgtaca

SEQ ID NO: 79401 - DNA, 71 bp, Mus musculus
cacgtgtgtatgtatgtatatatgtatgtatgtatgcatgtatgtatgtatgcatgtatgtgtgtatgaca

SEQ ID NO: 79402 - DNA, 117 bp, Mus musculus
tagcttcaacctgatctaattgctgttctctatcaggttatgataggaaggaagccatatatattttttaatcaagtctatagctcagtgagaagcataggagatggaaggctgggc

SEQ ID NO: 79403 - DNA, 63 bp, Mus musculus
actgatgagacacagtaagaactcaggaacccgtttccttgattctctctgtgactcattagt

SEQ ID NO: 79404 - DNA, 140 bp, Mus musculus
atacatatatatgtgtgtatacatatatgtattttgtatagaggtacatatgtgggggagtatatatatgtatctatatgtgtatgtatatacatatatatgtgtgtatgtgtatatatgtacatgtgtatatggatatg

SEQ ID NO: 79405 - DNA, 120 bp, Mus musculus
ggagctggctgccatgggagttctccatcaggaaagaggagagagcatggcttgatcagtttctctcacactgtctcttttccttggtgttactggaagagagaggagatgatggagtca

SEQ ID NO: 79406 - DNA, 78 bp, Mus musculus
ggagtgagagtgtgcatgtatgtatgtatgtatgtatgtatgtatgtatgtatgtatgcatgccatggtacatatgcc

SEQ ID NO: 79407 - DNA, 82 bp, Mus musculus
aattctagtactgatatgcaggctggggtggaggttgtcacaggagctcactagccagacagtctgtctcaatcaaggagtt

SEQ ID NO: 79408 - DNA, 105 bp, Mus musculus
gtatatgtatatgtatatatgtacatatgtgtatatgtgtatatatgtatgtatatatgtatatatatgtgaaatatgtgtgtgtacatatatacacatatacat

SEQ ID NO: 79409 - DNA, 56 bp, Mus musculus
ggtgtgtctctgtgtgtgtgtctgtgtatgtagagcagacaacacacttgcatgtc

SEQ ID NO: 79410 - DNA, 85 bp, Mus musculus
tgtgcagtgggaaggggggccgatgcactgtaagagagtgagtagcaggtctcacagtgaaccggtctctttccctactgtgtca

SEQ ID NO: 79411 - DNA, 95 bp, Mus musculus
gtctgtatttttgcatgtatgtgggctcagctgtgtgtctgtatatgtgtgcacatctttgcatgcatgcatgggtacaacctcatgagtgtgac

SEQ ID NO: 79412 - DNA, 93 bp, Mus musculus
atgtagttagtgttttgcgggcaataggacccaagaggtgtgtcttcctctgtcagtgtctgtgccccccaccacctccgagagactgagcat

SEQ ID NO: 79413 - DNA, 86 bp, Mus musculus
gtctctgtctctgtgtgtgtgtgtgtgtgtgtgtgtgtgtgcgtgtgtgtgtgtgttcacatgccatagtgcatatggtggaggtc

SEQ ID NO: 79414 - DNA, 68 bp, Mus musculus
ggtctcagctgtagttggctgaagatgccttggcacatacaagacacttagctcacagtctgttggcc

SEQ ID NO: 79415 - DNA, 118 bp, Mus musculus
actgcttagataaaactagcttcacttcttcctccatgtctccatttggtgcctgggactgtttatggcactccaagatagctacaagatgtttgaatgctgcctgggactgtttagt

SEQ ID NO: 79416 - DNA, 92 bp, Mus musculus
tcacacagaactataaatagacagctattacttgtctgttaaaagcatttttatatttttaaagactgacaatatagctgtttactgtttga

SEQ ID NO: 79417 - DNA, 113 bp, Mus musculus
taacagacaagtaatagctgtctatttatagttctgtgtgatatttttatctatgtatacattgtagagagtcagccaagctgatgaatatatagccatcacctcttttgttg

SEQ ID NO: 79418 - DNA, 85 bp, Mus musculus; identical to SEQ ID NO: 57439

SEQ ID NO: 79419 - DNA, 108 bp, Mus musculus
ttctctattttagcacccgtgagaaacagtgaccaacaattctctcaaagactcagtcagtctgagggtcaccaacgcactgcaatctcattggagcctctgtaggaa

SEQ ID NO: 79420 - DNA, 116 bp, Mus musculus
cggatgcagaagaacaccctagcctcacactacacttagcagccaggtcacttctatcactgtgagtgggagcagaggccttgtgtgtattgggtgctctgtgcttctgcactgcc

SEQ ID NO: 79421 - DNA, 91 bp, Mus musculus
catcagtttttgttttatagatacatatatatgtatgtgtatatatatatgtatatgtgtgtgtgtctgtaatatatgtgaaacatgtatg

SEQ ID NO: 79422 - DNA, 75 bp, Mus musculus
gaggccaggaatgtgtcaaaggtgtccctgtacagaatctcagagaggctgttgtataaacagatttgtggaatc

SEQ ID NO: 79423 - DNA, 100 bp, Mus musculus
tgtataggtgcatgtgtgtgtacaaatatatatatgcctatgtatgtgaaggtgaatacatatatatatatttgtgcatgtatatatgaatgtggtgaca

SEQ ID NO: 79424 - DNA, 69 bp, Mus musculus
gagtcatatgtcattgtgagatgccatgagggtgctcagaaccaaactcaggctctctgtgagagtcac

SEQ ID NO: 79425 - DNA, 73 bp, Mus musculus
tgtatatgtgtttgtgtttaatgcataatgtatgtatacatacatatgtgttgcatgcacatctatatgtgca

SEQ ID NO: 79426 - DNA, 114 bp, Mus musculus
tttctaacttataccaccactcctggtcatctattgttttgtgaagtgtaaattctgtcatatgtatttgaattttacaaaggaaaggaaatggtcaaaggtacaaggaaggga

SEQ ID NO: 79427 - DNA, 82 bp, Mus musculus
gtatgtatatatatatatatatatatatatatatatatatatatatatatgtatatgtatatgtatatgtatatgtatatgc

SEQ ID NO: 79428 - DNA, 81 bp, Mus musculus
tatgcatgtatgtatgtatgtatacatgcaagcatgtattatgtatatatgcatgtgtgtattatgtatgtatgtatgtgt

SEQ ID NO: 79429 - DNA, 85 bp, Mus musculus; identical to SEQ ID NO: 57470

SEQ ID NO: 79430 - DNA, 77 bp, Mus musculus
taacttctgttagtttcactgtgtctctgtttagtttctgtttccaggatctgcccattgataagagtggggagtta

SEQ ID NO: 79431 - DNA, 70 bp, Mus musculus
cagttgattcaggactcctcagagtccagctttctctgtgattctgtgattctgggatcctgtgaacctg

SEQ ID NO: 79432 - DNA, 109 bp, Mus musculus
gaaattctgtacttgttcccaaatagtgtgtgtatacatgtgtagtgtatgtgttcttttgcgaggatgctcgtgtatatgtatgtgtatagggatgagtacagagctc

SEQ ID NO: 79433 - DNA, 115 bp, Mus musculus
gctgagggcaccatgacaatgtgttgaggcttcaaatgcttctagaagtctgagatcagtgacagtccagaccatctatgggattgaggaagtagcagttggtggtggcagtggt

SEQ ID NO: 79434 - DNA, 84 bp, Mus musculus
gtgtatgtgtgtatgtgtgtatatgtgtctatgtgtatgttcatgtatgtgtgtatgtgcatgtgtatatttgtgtatatgtgc

SEQ ID NO: 79435 - DNA, 75 bp, Mus musculus
attgcagaacaagccaaaaatcaagactagacattttgttgttctgtgtttcagtcttgatttaggctttgcaat

SEQ ID NO: 79436 - DNA, 91 bp, Mus musculus
gactactcgttagctgtcctctgacttttccatgcactgtggaacttgcacacccacacacatgagagagcacacacatgctcgcgtggtc

SEQ ID NO: 79437 - DNA, 120 bp, Mus musculus
tctttaagactcattttattttattactttatgtatatgagtgtatgtatgtatgtatgtatgtatgtatgtatgtatgtataccatgtgggtgtgttggatggctgtggaggttggaag

SEQ ID NO: 79438 - DNA, 74 bp, Mus musculus
ggccaaggttctagaaagcttttagttaaaatgcaaatccactgaagattgtgagctgtgccagggttggggcc

SEQ ID NO: 79439 - DNA, 98 bp, Mus musculus
gtatgcatatgtgtgtatgtgtgtgcatgtgcaagtatggtgagtgtgcatgtgcatgtgtgtatatgtgtgtgtgcgtgtatgtacatgtgcagcat

SEQ ID NO: 79440 - DNA, 73 bp, Mus musculus
gccccaaggataacactgagtctctaaaggccttgggcatcccactgtgcctctgagcctcagtttctctagc

SEQ ID NO: 79441 - DNA, 80 bp, Mus musculus
agaggtcaagctcttctcagtgtggaatctagtctcctcctagctgcctttggatcaagatgtagaaagcttgactcttt

SEQ ID NO: 79442 - DNA, 119 bp, Mus musculus
cataatgtatatacatatagacagacagacagacacatatatgtatatatatacatacacagacatgtgtatatatatgtgtgtgtgtatatatatatatacacatatgaatatatgtc

SEQ ID NO: 79443 - DNA, 61 bp, Mus musculus
gaatgaataaggaccataagcaaggactccagtgggtggggtctctgtggctctctcattt

SEQ ID NO: 79444 - DNA, 80 bp, Mus musculus
tatctagctttgacccaatctttcaggcagtcctcgaggcataaatggtaccgtgggtctgtctgactctgagctggatg

SEQ ID NO: 79445 - DNA, 93 bp, Mus musculus
tcctaattggaaaagagatcagtgcatttgttgttatattcttgttctttgagatgacagcttctgcttgcctctgcctccccagtgttggga

SEQ ID NO: 79446 - DNA, 85 bp, Mus musculus
cagtacagtagacctgcacctcgatgatggtctctggaacctgcttccccagggtccatgattctgcctctctcactctctcctg

SEQ ID NO: 79447 - DNA, 111 bp, Mus musculus
ggatttgatggctctctccacataatagtgtctggctgtgaatctctctggctgttcttatctgctgtcagagggagcctctctgttgatgactggataaggtactgatct

SEQ ID NO: 79448 - DNA, 63 bp, Mus musculus
gctgccagaggtgagtagcctctgccatcacacactcaggctgcctcactccaggcacaaagc

SEQ ID NO: 79449 - DNA, 91 bp, Mus musculus
tctcctactctctgtctgtctctgtgtgtgcatgccttggcttgcatgccttgacatgtatacggaggccagaagacagtatagtagttgg

SEQ ID NO: 79450 - DNA, 77 bp, Mus musculus
cagggtctcactctgtcaccctggctggcctatagaacttgtcatacagaccaggctccctcacaggggtcttcctg

SEQ ID NO: 79451 - DNA, 79 bp, Mus musculus
tatgttcatttatatatgtacattatatatctatgtatatatgcttatatatacatgtgtgtaaacatatatgtacgta

SEQ ID NO: 79452 - DNA, 116 bp, Mus musculus
atacctttataaacttctgttgtgtgtgtatatatatttgtacacacacacacacagacacatatgtgtgtctgtgtgcctgtgtgtatgcacacaacagaagtttataaaggtat

SEQ ID NO: 79453 - DNA, 69 bp, Mus musculus
tgggaacaattagaaagctcaatcataggccgaggtaaaagcacgacctgtgtctgtctgtctgtccca

SEQ ID NO: 79454 - DNA, 59 bp, Mus musculus
actgtaggcctcctgaaggagtggctgttaaacactctgtctcaggaacaagtgacagt

SEQ ID NO: 79455 - DNA, 68 bp, Mus musculus
ccttgcacttacagtattttatttttgactttgccctgagctttgttactcactgtgtctgtgcaggg

SEQ ID NO: 79456 - DNA, 65 bp, Mus musculus
cttgacttctgtttgtctgtctgactctcagctggggatcagacactggcctcatgcagagcagg

SEQ ID NO: 79457 - DNA, 116 bp, Mus musculus
agtttccctttgtctgaatgaaatgagcgctgcttctcagcctctcactcactgctttccttgggtgactccaagaggttaagccctctgttcgtatgtttgttcctttagtgact

SEQ ID NO: 79458 - DNA, 72 bp, Mus musculus
ggagggcgtggcacagaggagactgagcacacgcaagtctcagtgctgatctgatgcacaccgcgacactcc

SEQ ID NO: 79459 - DNA, 83 bp, Mus musculus
tctgtctgtctgtctatctctgaagtgtatgtgagtatgcatgacacagtgcttatgtagagttcagaggacagttttgtgga

SEQ ID NO: 79460 - DNA, 66 bp, Mus musculus
aatttaggggctggagagatggctcagtggttaaagcactgactgctcttccagaggtcctgagtt

SEQ ID NO: 79461 - DNA, 63 bp, Mus musculus
tgtgcttgtatgtgtacacatctggggacacatgtgtcactctgtgtgtgtgtgtgcatgtca

SEQ ID NO: 79462 - DNA, 63 bp, Mus musculus; identical to SEQ ID NO: 79461

SEQ ID NO: 79463 - DNA, 84 bp, Mus musculus
aagtcagagcaggagctcaagcaagaactgaagcagaaatcacggaggaaggctgcttactggctcactcactggctctggctt

SEQ ID NO: 79464 - DNA, 80 bp, Mus musculus
aggccccacagtcagtcactcactgccctgccacaggaaacctgagcagagggtgttggggatgggctgctgcagggtct

SEQ ID NO: 79465 - DNA, 106 bp, Mus musculus
gcaaaactttgcttacatttagagtcttacaaaaaggaatttatggaggtatatatatttttaaagcttttcctgtagtagatttgtggatgatatcgcaagtggc

SEQ ID NO: 79466 - DNA, 93 bp, Mus musculus
cacagacccggagctggagagatggctcagtggttaagagcactgactgctcttccagagatcatgagttcaaatcccagcaaccacatggtg

SEQ ID NO: 79467 - DNA, 132 bp, Mus musculus
agggtatgtgtatatgtatgtgtgtgtatatatatatatatatatatatatatatatatatatatatatatatacatacatacatacatacatattttacaaaagggtatgtgtatatgtatgtatgtatat

SEQ ID NO: 79468 - DNA, 80 bp, Mus musculus
tgggagctaggttgacaggcctgaagcagcacagccttctgggagctgggttgacaggcctgaagcagcatgactcacta

SEQ ID NO: 79469 - DNA, 191 bp, Mus musculus
gagtgtgtccatgtatgtatatatgtatgtatgtatatatccatgtatatatatccatgtatgtatgaatccatgtatatatccatgtatgtatgcatgtatgtatgtatataatccatgtatatatgtatgaatccatgtatatatccatgtatgtaggtatgtatccatgtatgtttgctatacttggg

SEQ ID NO: 79470 - DNA, 105 bp, Mus musculus
ggcagactgtccccactggacctgaagctgtctcactgactgtccaggaaccctcaggattctgtctctgtctgtgcggcctcctaggtgctggggcgagccgcc

SEQ ID NO: 79471 - DNA, 91 bp, Mus musculus
tttatttaaatatatttaattatataagcatgtatgtgcatatatatgtgtgtgtgtagatatatgtatatgtatatgtatatataatgaa

SEQ ID NO: 79472 - DNA, 121 bp, Mus musculus
tctctctctttttttttcccctctaaccgtctctttctacattctggtagctgggctctgcatcactcagtgtctctgcccagggtgaatggaccgatcgggattctggggtgacagggag

SEQ ID NO: 79473 - DNA, 120 bp, Mus musculus
caggaccccactggaagctgctcgccactgtttgctttatttgaacccaaggcctgacaaacttgacagatgacagccagcagggggtcacgttttctcctttcgccatgtgggatcctg

SEQ ID NO: 79474 - DNA, 87 bp, Mus musculus
tctccaggttgtctctgacacacgcacacgcaagtaaacagcaccagccagtgtttcttatggtagtggtgaaagaggcagaagaga

SEQ ID NO: 79475 - DNA, 132 bp, Mus musculus
tgtgaggaggggacacagcctctccagtctctgtggaggactgtgaggaatcctgtgtggcacactcagtcagtgttttttcttagaaagactatgtctggctgaagctcaaaatacacatctccacctgac

SEQ ID NO: 79476 - DNA, 76 bp, Mus musculus
gtatctgagagggctggagggatggctcagcggttaagcgcactgagtgctcttccagaggtcctgagttcaatac

SEQ ID NO: 79477 - DNA, 91 bp, Mus musculus
cactatgtagcctgaaactatgtagaccaggctggcctcaaactcacagagatctgtctgtgtctgcctcccagggttggggttaaaggtg

SEQ ID NO: 79478 - DNA, 63 bp, Mus musculus
gtgtgtatacagaggccagtggaggatgtctagtgtcctgctctgtcactctgtctaccttac

SEQ ID NO: 79479 - DNA, 95 bp, Mus musculus
catgatgtatgcatgcatgcatgcatgtatgtatgtatgcatgcatgcatgtatgtatgcatgtatgcatgtatgtatgtgtgcatgtgtgtatg

SEQ ID NO: 79480 - DNA, 70 bp, Mus musculus
tctatgtgtgtgtgtgtctatgtatgtgtgtctctgtgtataagcatacaagccacactactcagatgga

SEQ ID NO: 79481 - DNA, 58 bp, Mus musculus
agacagagggcaaatagatgctgagtagtctatcatctatctatctgtctgtctgtct

SEQ ID NO: 79482 - DNA, 69 bp, Mus musculus
cggaaaggggaggaactggggggctgtggtggtgacctgctgtctcactgtctttgtggctctcttctg

SEQ ID NO: 79483 - DNA, 59 bp, Mus musculus
accttgaacttctgaccctctgtctgacccatcttcagagctaggggtagaggcttggt

SEQ ID NO: 79484 - DNA, 74 bp, Mus musculus
tggaggaagtgtgtcactgggggcaggccttgaggtttcagaagcccaagccaggctcagtggctctctctcta

SEQ ID NO: 79485 - DNA, 100 bp, Mus musculus
tatatgccccagtgtatatatacatgtgtgtgtatatatacatatatatgcatatgtgtacatatacacatgaatatgtatatatacacatatgcatata

SEQ ID NO: 79486 - DNA, 80 bp, Mus musculus
gctgtgctgtgtgtgtatgtgtgtgtgctgtgtgtgcatgaatgtgtgtgccgtgtatgcatgcatatgtgctgtgctgt

SEQ ID NO: 79487 - DNA, 90 bp, Mus musculus
gggtgggaggaggcagggatagagagatggctctgaggttaagagcactggctgctcttgcagaggtcctggattccattcccaacaccc

SEQ ID NO: 79488 - DNA, 85 bp, Mus musculus
ggccatggtggtctgataggatgcatgggaaaatttcaatatttttgtatctgttgaggcctgttttgtgaccaattatatggtc

SEQ ID NO: 79489 - DNA, 146 bp, Mus musculus
gcatatatatgtgtgtgcatatgtgcatatgtatatgtatatatgtgtatgtctgcatgtatgtttatatgaatatgcatgtatgtgtttatatgtatgtgtgcatgtttgtacttatatgtgtatatgtatgcatatatgtatgt

SEQ ID NO: 79490 - DNA, 75 bp, Mus musculus
cagtgtgtgtgcatgtgtcatacacacacattctcttccgagtgtgtgcatgtgtgtgctgtatgcacacacctg

SEQ ID NO: 79491 - DNA, 60 bp, Mus musculus
ctgccttagtgtctctcactgttgctgtggtaaaatacagacaggagaaacttaagggag

SEQ ID NO: 79492 - DNA, 97 bp, Mus musculus
cctccagtacctagagagtctgttctgttgcatgggctttctcatgtaggttgttatctatggtcttatctatgtaaaatgggggctttgctggtac

SEQ ID NO: 79493 - DNA, 78 bp, Mus musculus
gaaatgtgcatgtgtgtatctctgtgtgtgggcacgtgtgccatgtcacgtgtgcgcatgtgtggaggtcagaaggca

SEQ ID NO: 79494 - DNA, 72 bp, Mus musculus
tttctcaggcactgtctgtctgcatactgccatgctccctggccatgttgataatggactaagcctctgaaa

SEQ ID NO: 79495 - DNA, 109 bp, Mus musculus
tctcttatgtgaaaaagtggaaggtcaaaagccatggtatgtatagaacttagaactaggatactaggcatctagtggggatattgaatcatttcctacatgtaagagg

SEQ ID NO: 79496 - DNA, 81 bp, Mus musculus
tagttagaactcagccagcagacaggatcagtaaggtggtggacatgctgagcactggggctggggctggggctggggctg

SEQ ID NO: 79497 - DNA, 92 bp, Mus musculus
agattcacttctctctccgactctctgtggctgggattaattaccaccatacccaactatattctaggatgtctaagagattctctggatct

SEQ ID NO: 79498 - DNA, 118 bp, Mus musculus
gctagcaggcctggatatgtaagaaagcaggctgagcaagctgtgaggagcaagccagtgaacagagttcctccacggattctgcctgtgttcctgcttcaaggttcctgccttgagt

SEQ ID NO: 79499 - DNA, 72 bp, Mus musculus
tgtatatatatatgtgtatgcacacatacatgtatgtatgtatgtatgtatgcatgcatgcatgtgtatgca

SEQ ID NO: 79500 - DNA, 71 bp, Mus musculus
tggcatatcaggggcaagtgggtgagcttcttgtgactgtcaggacccagactctgtctctaacaatgcca

SEQ ID NO: 79501 - DNA, 120 bp, Mus musculus
gtttgtctctgcctgtctggcactgggttacaggcatcgctgcacctgacttggatgtgctggggatacaaactcacactctcagtcttgcatgacaggtgaggtatctactgagccatc

SEQ ID NO: 79502 - DNA, 113 bp, Mus musculus
atgtaaatccattaagcttccagtatccatctcatctgtaaacctgtcagaggagactgagctgtttaccctcaggtcgatgtgacacctgtgagctcttgaaacaactacat

SEQ ID NO: 79503 - DNA, 76 bp, Mus musculus
tgtgtgactggacaccgatgtctgctgagctgcacaggaaacagtgagcacagatgctatccacctcttccacata

SEQ ID NO: 79504 - DNA, 60 bp, Mus musculus
ggttaacgaatgagtggataggcttgtgaacattcactcagtctgtcatattccttggcc

SEQ ID NO: 79505 - DNA, 79 bp, Mus musculus
tctgtctctcaaactctctctgcaatgtttgttagagttttcggtggcctatcttgctcagagactctagagtcggaga

SEQ ID NO: 79506 - DNA, 100 bp, Mus musculus
ctctctcactctcaaatttcagattctttttttatttttttaattgttactcgagtatacagagagagagagagagagagagagagagagagagagagag

SEQ ID NO: 79507 - DNA, 70 bp, Mus musculus
ggcatgtagcaggtagataggttaaaaaaaaaaaaagacctgccaatctctgtctgtctgtctgactgcc

SEQ ID NO: 79508 - DNA, 146 bp, Mus musculus
acaagcatgtgcgagcatgtatgtgtgtgtgtatgtgtgtgtgtgtgtgtgtgtgtatgtatgtttaaggtcacgtttgtgcaggtacatgtgtgtttgtaaatgtgtgttcacatacgcacccatatgtatgaaggacagagcac

SEQ ID NO: 79509 - DNA, 100 bp, Mus musculus
tggctgtcctgaaactcattctgtagaccaagctggccttgaactcacagagatctgtctgtttctgtctccagagtgctggggttaaaggtatgtgcca

SEQ ID NO: 79510 - DNA, 75 bp, Mus musculus
caggcgatcctccgcatagtgtttctgtccctcagtctctctttctgtaaagttactgtgctaaagaattgcttg

SEQ ID NO: 79511 - DNA, 70 bp, Mus musculus
gaatatctggggctgaaaagatggcttagtggttgagagcactgactgctctttcagaggtcctgagttc

SEQ ID NO: 79512 - DNA, 85 bp, Mus musculus
ctgaggcagaaactagggagtggaaactgaagcagagactgtggagggtctctgcctactgtctcactctctgtgactccctcag

SEQ ID NO: 79513 - DNA, 112 bp, Mus musculus
gctactcctcccattccccacattcagtggcctccttatctactgttgtctgctcataatcagcagcaggtgacagggaagccagccagggaactgggagagaaggatgggc

SEQ ID NO: 79514 - DNA, 61 bp, Mus musculus
gcactgaggatgaagcaggcatgtggtgagctagtgccaggctgcctgtctccctcgaagc

SEQ ID NO: 79515 - DNA, 58 bp, Mus musculus
tatgtatgtatgtatgtatgtgtgtgtgtgagcatgtgtgcttgtgtgtacatgcgtg

SEQ ID NO: 79516 - DNA, 79 bp, Mus musculus
tgtgttcatgtgtatatatgtatgaagggcaggtgtcaaggcacggtctgcctctcacacacacttgctcgttgagaca

SEQ ID NO: 79517 - DNA, 105 bp, Mus musculus
gcactacttaaggctctttgatctcagggcatacagactttctgggtttttgctttctttgtttgtattttgtttgtttgtttttcctgaagccttgactgttgt

SEQ ID NO: 79518 - DNA, 69 bp, Mus musculus
tctgctttcagtctttgtctgtcactgagggaagtcaaggcaggagctagaggcaggaactgaagcaga

SEQ ID NO: 79519 - DNA, 84 bp, Mus musculus
ggatacaatttggggaatgttggctgtctgctctgtcagagatgctctgtgactcagtcactgttttcccagttatagttctcc

SEQ ID NO: 79520 - DNA, 78 bp, Mus musculus
catgtgtctctctctgtgtgtgtgtatctgtgtatgcatgcacgtgcacacgcacgtacatatatacatgtgaacatg

SEQ ID NO: 79521 - DNA, 68 bp, Mus musculus
tatatgtataatatctagattatgtgatgtatgtatatatatcatataatctagatttaaaacaaatg

SEQ ID NO: 79522 - DNA, 75 bp, Mus musculus
ctctccccttagccaatgatgtaagcaagcaagaactcagtgttccctccctgagtcagtggctgagcagctgag

SEQ ID NO: 79523 - DNA, 75 bp, Mus musculus
agcagcttagagactctgttcctgtctctctctgctcacaggcatttgcagtgacaggaaacagattcagttgct

SEQ ID NO: 79524 - DNA, 76 bp, Mus musculus
cacctagcttttaattttgtatgtatatattgtgtgtctgcacacttgtgtgtgtgcatttggttgtgcacatgtg

SEQ ID NO: 79525 - DNA, 67 bp, Mus musculus
tatatgtatatgtatatgatgtatatgtacatatgtgtgtatatatatatcatatagtatatgtatg

SEQ ID NO: 79526 - DNA, 114 bp, Mus musculus
gggagagagctactgaaatacttccgatgagggcagtggactaagtacatataaataattgtgtcttgatatgcaactgttacttgctggagtgtttgttgtttggccgttcct

SEQ ID NO: 79527 - DNA, 84 bp, Mus musculus
gcatgagagtaggtaggtatgtatgtatgtatgtaggtatgtatgtatctgtgtatatgtgtatgtgtgtgtgtgtatatatgt

SEQ ID NO: 79528 - DNA, 125 bp, Mus musculus
tatgtatacatatatgcatgtatatattcatgtatgtatgaatttgtatatgtatgtattcatgtatgcatacatgcatgtgcacatggatgtgtatatgcatgtatgtacatgtgtgtatgcat

SEQ ID NO: 79529 - DNA, 68 bp, Mus musculus
atatatcatgcatatgtgtatgtatatacatatagtatgtatacatatatacatatgtatacatgtat

SEQ ID NO: 79530 - DNA, 75 bp, Mus musculus
cacttgcatgaacattgtggtgaggtgagttttgagtgagaactcaggaatacttggtgaacagtggtgtagctg

SEQ ID NO: 79531 - DNA, 87 bp, Mus musculus
agacagctttgctgacataaatatgtgctcataggcagaagtcttgcctgagagcggaacatgatttattttctttcaatgcagtct

SEQ ID NO: 79532 - DNA, 114 bp, Mus musculus
gtatgtgtgaatatgtgtatggagatatgtgtgtgaatatatgtatgtgtgtgaatttgtatatgtgtttgaatatgtgtggatacgtgtattgtgtgagtgtatatgtgtgtg

SEQ ID NO: 79533 - DNA, 92 bp, Mus musculus
gtgtgtgttcatgtgcatgcatgggcatgtgcatctgtgtatctgtgtctgtgtgtatgtgcctgagtgtgtgtgtgtgcatgtgcatgcat

SEQ ID NO: 79534 - DNA, 297 bp, Mus musculus
gtgcatgtatgtgcctgagtgtgtgtgtgcatgtgcatgcatgggcatgtgcatctgtgtatctgtgtctgtgtgtatgtgcctgagtatgtgtgtgtgcatgtgcatgcatgggcatgtgcatctgtgtatctgtgtgtgtgtgtgtatgtgtgtgtgtgtgtgcacgcatgtatatctgtgtgtgcatgtatgtgtctgagtgtgtgtgtgcatgtgcatgcatgggcatgtgcatctgtgtatctgtgtgtgtgtgtgtatgtgtgtgtgtgtgcacgcatgtatatctgtgtg

SEQ ID NO: 79535 - DNA, 102 bp, Mus musculus
gtgtctgagtgtgtgtgtgcatgtgcatgcatgggcatgtgcatctgtgtatctgtgtgtgtgtgtatgaatatgttcaagttccagtatagatttggatac

SEQ ID NO: 79536 - DNA, 91 bp, Mus musculus
gtgttgttcagtttccacgtgagttttggctttctgttattttttttgttattgaagatcagccttagtgcatggtgatctgataggatac

SEQ ID NO: 79537 - DNA, 106 bp, Mus musculus
cagacttcagaagtagcagcagtcttcacagggttgttctgaaacattgtaacgttttttattttagaagtagcaccagactgcatagggttattctacaacactg

SEQ ID NO: 79538 - DNA, 117 bp, Mus musculus
gtccttgaaggcaaatggcgtgcaagcacagatggccaaggtaagcctgctcagacaagagagtctgtgcacacggtctgcctttgtgtgtgtgtatctgtgtgcaatcagagggcc

SEQ ID NO: 79539 - DNA, 127 bp, Mus musculus
cacacacacacacacatgtgtacgtgtgtgtatgtgtatatatatgtatatgtatatatatatatatatatatatatatatatatatatgtgtgtgtgtgtgtgtgtgtgtgtgtgcgtatgtgtat

SEQ ID NO: 79540 - DNA, 85 bp, Mus musculus; identical to SEQ ID NO: 57439

SEQ ID NO: 79541 - DNA, 82 bp, Mus musculus
agcaggcaagagaggaaacaagtggggagccagggatgtagtcctgggccaaccttagctctcctgactctctctctctgct

SEQ ID NO: 79542 - DNA, 78 bp, Mus musculus
caggaatccagaaaagggcatcacatccttggtagccccaaaattacagaagtttgtgagctgtcatgtgggttcctg

SEQ ID NO: 79543 - DNA, 72 bp, Mus musculus
ggtgagctaaggctgcaaaacaggagatgtggttttccaaatgagctgtgtctgtctctcagcaagagcacc

SEQ ID NO: 79544 - DNA, 85 bp, Mus musculus
gtgtattctcatgggagggtgtctgtgtgcctgtgttcatgtgtctgggtatatggtgggtatactggtttctattgttgtgcac

SEQ ID NO: 79545 - DNA, 65 bp, Mus musculus
gtggaacacagcacctgtctctctctgtttcttgactatggaggcaatgagatgaggtctttcac

SEQ ID NO: 79546 - DNA, 84 bp, Mus musculus
gtgtgtgtgtgtgtgtgtgtgtgtgtatgtatgtatgtacgtatgtatgtatgtatgtacgtatgcatgtatgtatgtatgtgt

SEQ ID NO: 79547 - DNA, 90 bp, Mus musculus
ggagagattttgaaaaatggttttggctatagtatatcactttatatatatcaaaggcatgctgtggtgattttttcttatctaaaatcc

SEQ ID NO: 79548 - DNA, 82 bp, Mus musculus
agactctgtgtgtgcatgtgcttgtgagtgagtgcacatgagtgcacatgagtgcacacgagtacaggtaccagcagagact

SEQ ID NO: 79549 - DNA, 66 bp, Mus musculus
tgtatgtatgtatgtatgtatgtatgtgtatatatatatatatatatatatacacacatacacaca

SEQ ID NO: 79550 - DNA, 67 bp, Mus musculus
tctctgagcaggcttctttctccccacttggttttgttttgttgtggtgagaggagtctggtttcga

SEQ ID NO: 79551 - DNA, 102 bp, Mus musculus
gcttgtaaagactcctgtgacacatgtgtgaacctctaggtgaatccacacatcactgtgtgtcactgtgccaaacatgtgaattcaggacatttgccaagc

SEQ ID NO: 79552 - DNA, 91 bp, Mus musculus
taggaatcaaacatttacaatctagatcttatcattctaacaatgttttattttttaggatcactaagaatagaatgtaaaacaattcctg

SEQ ID NO: 79553 - DNA, 58 bp, Mus musculus
agactgaagattgtgcagccttaacagaatatctgtctgtctgtctgtctgtcagtct

SEQ ID NO: 79554 - DNA, 87 bp, Mus musculus
ctctctctgtatgtatgtatgtatgtaagtatgcatatgtatgtatgtatatgcatatatacaaaactatacatatatataggatag

SEQ ID NO: 79555 - DNA, 93 bp, Mus musculus
tccatggtggtctaataggatgcatgggacaatttcaatatttttgtatctgttgaggcctgttttgtgacctattatatggtcagttttgga

SEQ ID NO: 79556 - DNA, 88 bp, Mus musculus
tgttgaaaatgggtggttgctttttctatttatttactagagaatacactcaataggtaggggtgaggagagacatctagtaaaggca

SEQ ID NO: 79557 - DNA, 93 bp, Mus musculus
ccattcaaaagtgtcagaagagagtgacctgataccattatttaaattaagatatggttaatgtaactcactcattcctgcgctattcagtgg

SEQ ID NO: 79558 - DNA, 75 bp, Mus musculus
actacagcacatgtatgtatgtatgcacatgcatggccagtgtgtgtgtgtatgtgtgtgtgtgtgtgtgtgtgt

SEQ ID NO: 79559 - DNA, 247 bp, Mus musculus
gctccagcagcatgccagcatgcctgcctgcctgcctgctgcctgctgcctgctgcctgcctgcctgcctgcctgcctgctgcctgctgcctgctgcctgctgcctgctgcctgctgcctgctgcctgctgcctgctgcctgctgcctgctgcctgctgcctgcctgctgcctgcctgcctgctgctgcctgcctgcctgcctgcctgcctgctgtctgcctgctgcctgcctgcctgcctgcctgc

SEQ ID NO: 79560 - DNA, 97 bp, Mus musculus
catgtgaccagcactgtaatcgggactatcacccagggaagcgcctctgagcttctcattgttagtctctctgactctgtctccaggtaacctcatg

SEQ ID NO: 79561 - DNA, 81 bp, Mus musculus
agacttataaaactggcagagatcagcatgtgagggcttgcttcctgcttacccatgatctctctgtctctgtctctgtct

SEQ ID NO: 79562 - DNA, 84 bp, Mus musculus
tgtatacacacacacacactgtatatatacacacacacacacacacatatatgtatatatatatgtatatatgtgtgttataca

SEQ ID NO: 79563 - DNA, 101 bp, Mus musculus
atatgcatactgtgagtgtgtatgaatatatgcatgtatgtgtatgtgtgggcacacatgtgtgtctttatgtttgtgcacatggctgagggtatgcttgt

SEQ ID NO: 79564 - DNA, 67 bp, Mus musculus
gcatgcatgcatgtatgtatgtatttatgtatggagttcgcacatattcatacatatgtatgcatgt

SEQ ID NO: 79565 - DNA, 62 bp, Mus musculus
agcagctgagaattgtaatacttgggtgcatacttgtcattctgtgtttctgtctcactgct

SEQ ID NO: 79566 - DNA, 73 bp, Mus musculus
gacagattaaaatgaagactgaggctctgagttgccaaggaatacagggctctctctctctcatttttgcttc

SEQ ID NO: 79567 - DNA, 117 bp, Mus musculus
ggctgtttgactctgtaaaactgaatccagtgatcagagagagtgatgagagtggagagcagaggcccttagaatgaaatgagttttggattatttttcagtgtggtggtagcagtt

SEQ ID NO: 79568 - DNA, 96 bp, Mus musculus
tgtatatacacacatatgcacatatatacacgtatatgtgtatatatgtatatataatctataaatgcatatatgtgtgtgtatatatacatgtat

SEQ ID NO: 79569 - DNA, 85 bp, Mus musculus
gcacctggttcacaacctgggccttaggaagggctccggggagcactggctcctggtttcattcctgccttggctgtgagtgtgc

SEQ ID NO: 79570 - DNA, 62 bp, Mus musculus
tatgtgtatgtgtatgtatgtatgtatgtatgtatgtatgtatgtatgtatgtgtgtgtgta

SEQ ID NO: 79571 - DNA, 92 bp, Mus musculus
cttcaagttcatcaggtgcttagcacagcctcctttgttctgttctcagaatctcgttggtgaggagctaatgcatttttaaccaactcaag

SEQ ID NO: 79572 - DNA, 72 bp, Mus musculus
tggtaagagttgatgtctttacaacttcttagtcaacataagagaagagagtgaaatcactaactctgccca

SEQ ID NO: 79573 - DNA, 107 bp, Mus musculus
ccaaggtccatgacttcagtagctcaaggtaggtggttagggttctagtaccaggcatgatttccctcttgttgagtaagccttaagtccaattatagagatgttgg

SEQ ID NO: 79574 - DNA, 84 bp, Mus musculus
attactccggtacttgcgctgtctcagtcactgaattctgggcagagaagaaagtggcactgatcagcttgggcacggtttaat

SEQ ID NO: 79575 - DNA, 96 bp, Mus musculus
catgcacatgtgtgtaataggtgatccagtcaatacatagactcaggttcttgctgtctcactctcttgcactgaattatgttgaatgctgccatg

SEQ ID NO: 79576 - DNA, 114 bp, Mus musculus
tctctatgctattgtttcaagttttaagatttaaaatcatttttaagtaaaatgtttgtatatacaaatttaaagtgcaatttgaattctaagacttgaattaatgactattga

SEQ ID NO: 79577 - DNA, 70 bp, Mus musculus
gcagcagctcctgggcaaggtggacctgggcttgcctgtctgtctgtctgtctgtctatctgtctgttgc

SEQ ID NO: 79578 - DNA, 93 bp, Mus musculus
caggctcactgccagcctgctctaatgtgtgcacacacaggctcactgtcagcctgttgtaatgtgtgcacacacaggctctctgccagcctg

SEQ ID NO: 79579 - DNA, 102 bp, Mus musculus
gcctgttgtagtgtgtgcacacacagactcactgtcagcctgttgtaatgtgtgcacacacaggctcactgtcagcctgttgtaatgtgtgcacacacaggc

SEQ ID NO: 79580 - DNA, 96 bp, Mus musculus
acacaggctcagtgctggcctgttgtaatgtatgcacacacaggctcactgtcagcctgttgtaatgtgtgcacacacaggctcactgccagcctg

SEQ ID NO: 79581 - DNA, 115 bp, Mus musculus
tgtgtgcacacatgctcatagccagcctgttgtaatgtatgcacacacagactcactgtcagcatgttgtaatgtgtgcacacacagattcactgtcagcatgttgtaatgtgtg

SEQ ID NO: 79582 - DNA, 68 bp, Mus musculus
gtatatatgtacgtatgtatatatgtatgtatgtacgtatgtatatatgtatgtatgtatgtatgtat

SEQ ID NO: 79583 - DNA, 119 bp, Mus musculus
ccttttggcaagcttctatctccaagaaatgtatattatgtttcctaacagtagtgaaattgcagttatgaagtagcaatgaaatgattctgtggttggggggtcaccacaacatgagg

SEQ ID NO: 79584 - DNA, 62 bp, Mus musculus
cctgccactcgctctcttgagttggaccaataactgtgttcctaattctgtgcgggtggggg

SEQ ID NO: 79585 - DNA, 70 bp, Mus musculus
tttctggttgtctctctgacactgggactcctccagatggacagtccctctgcagtgttgccacctgagg

SEQ ID NO: 79586 - DNA, 74 bp, Mus musculus
ttgaaggctttgtttggtagaagagaactagattctcataaatgtttctatctgtctgtctgcctgcctgtcag

SEQ ID NO: 79587 - DNA, 59 bp, Mus musculus
actgactgatcagagagggcccagcccattgtgggtggggccatccctgggccagtggt

SEQ ID NO: 79588 - DNA, 75 bp, Mus musculus
ctgtcattgtctctgtctctgtccccagttcagttgtgagaaggagaggggagggggagagggggatggggagag

SEQ ID NO: 79589 - DNA, 79 bp, Mus musculus
ggagtgaatgaatgaatgaatgaatgagtgaaggagtaaaagctgcctgctacacatttactatacagctccaagctcc

SEQ ID NO: 79590 - DNA, 88 bp, Mus musculus
ttcagatgtccagcactgcgtgatgatatcctggcgtgtgctcttggagcattgtgactgtcagtcttgatcggatgtggactctgag

SEQ ID NO: 79591 - DNA, 84 bp, Mus musculus
tgccggcatcctgtcagagtctctgcctgcctcccagatgctggggctgcagatgaacgcagcactcctggctttatgtaagca

SEQ ID NO: 79592 - DNA, 107 bp, Mus musculus
gggagctggaagagcttgtgggagcggcagttctagcaagagactgagctgtgtggagctagccccctactgtaagagctgcattgctttaagctgggttcagcctc

SEQ ID NO: 79593 - DNA, 77 bp, Mus musculus
atgcatgtgtgtattatgtatgtatgcatgtgtgtatttatgtatatgtgtgtatgtgtgtatgtatatgtatgcat

SEQ ID NO: 79594 - DNA, 80 bp, Mus musculus
gcatctatgtgtgtctctctttctaaatccttggaggtcaaatattaatagagatagaagacagcacaatggtaaggtgc

SEQ ID NO: 79595 - DNA, 77 bp, Mus musculus
tgttacaagtatgtatgtatgtatgtatgtatgtatgtatgtacgtacgtatatgcatgcgtgcgtgagtgtgtgca

SEQ ID NO: 79596 - DNA, 71 bp, Mus musculus
tgcagacaggttggctttcagtgcacaggagcccagtgtgtgctctgagagcacagagagcccagtgtgca

SEQ ID NO: 79597 - DNA, 117 bp, Mus musculus
ggcatatgtttttattttgaaaataagtgaaaggctgaagagatggctcagcaattaagagcactgactgctcttccagaggtccttagttcaattcccagtaaccacatggtggct

SEQ ID NO: 79598 - DNA, 88 bp, Mus musculus
cagtactgttcttgagctgtgagtcctggagctgggctagcgacctgaccttctcctccagctcactcctctgtctctccagctgctg

SEQ ID NO: 79599 - DNA, 69 bp, Mus musculus
caggcaagtgtgaggtagatccagacacgcccatggctggggctgactctgtcactcatttgtcccctg

SEQ ID NO: 79600 - DNA, 78 bp, Mus musculus
gatgaaccccaggtcacagcctctctgtctgttgttaactatataggagcagagacgaggtgctcagcttgctttgtt

SEQ ID NO: 79601 - DNA, 83 bp, Mus musculus
tgtgtgtgtgcacatatacacaggtgtgtaaaggccagacagctgtgatggttagtgcctctgtgtgtgtgtgtgtgtacata

SEQ ID NO: 79602 - DNA, 115 bp, Mus musculus
gacaaagtacatttctgccaccttgcacctttccgtatgctgttaaaagttaattcttattgttattgtgttggagaggctcacattaggacagcgttgtggaatgggttctgtc

SEQ ID NO: 79603 - DNA, 71 bp, Mus musculus
ccatacttaaatactggccaggcactggctttcagtggctcagcttctgacagatgggtgtgtggagatgg

SEQ ID NO: 79604 - DNA, 69 bp, Mus musculus
gtgagatccccttggctggagtccagacttgttcacagtatagagtgtggtttagcaacaggatctctc

SEQ ID NO: 79605 - DNA, 73 bp, Mus musculus
gctggggacagatgtgagagaacacgggccaagcagcttggctcttaacttctctgccatctctatgctcagc

SEQ ID NO: 79606 - DNA, 110 bp, Mus musculus
tcaatgaaccctcctgatgtcaagcctggccttggcacctgcctgctggcctgctggcctgcctgcctgcctggctctgtgctttctgccatgatggtcctggactctga

SEQ ID NO: 79607 - DNA, 65 bp, Mus musculus
gacagctagagacctggtgtcaccgtgtgcccagaacacctctgatgtctgtctctctgtctgtc

SEQ ID NO: 79608 - DNA, 113 bp, Mus musculus
tccagggtactctattccccttccaggcccagagacagcacagagtgacctgacctcccagcctgcaggtgctcatacctcccatgggctgtccagcggtcagctttttgttg

SEQ ID NO: 79609 - DNA, 103 bp, Mus musculus
ggcaacaataatttccccaacggagtctcactgagtctctgccacactccagggcaggcttcgtgtcagggagtcattgaccaacacagaggactccatgggg

SEQ ID NO: 79610 - DNA, 72 bp, Mus musculus
ctgttgtggaaggcctggccacactgagctctctctctgagtctgtctgtctgtctgtcttctcactgacag

SEQ ID NO: 79611 - DNA, 78 bp, Mus musculus
acacacacacacacacacacacacacagttcttttcaaccccgagatgtatgtatgtatatgtgtgtatatgtgtagt

SEQ ID NO: 79612 - DNA, 63 bp, Mus musculus
ctggctccaactgtgtctcacgggtgactctaaagtgaactgtgagagctcagatgcagctag

SEQ ID NO: 79613 - DNA, 114 bp, Mus musculus
gaggccctggcgaaggccgtggcctcgttcaagtaatccaggataggctgtgcaggtcccaaggggcctattcttggttacttgcacggggacgcgggcctggacgccggcatc

SEQ ID NO: 79614 - DNA, 82 bp, Mus musculus
agtgttgtgacgcttccgatcctcacgttcacactttgctcgggttggaggctcagctctctctctctctcagcgtgtgagc

SEQ ID NO: 79615 - DNA, 80 bp, Mus musculus
gcagacagacagacagacagtcgtgcttcagggagccagccccagggttgctgaccagtgtgtggctatcctgtgtaagc

SEQ ID NO: 79616 - DNA, 101 bp, Mus musculus
gaatctatcatctggggctggagagatggctcagcggttaagagcactgactgctcttccaaaggtcgtgagttcagatcccagcaatcacatgatggctc

SEQ ID NO: 79617 - DNA, 83 bp, Mus musculus
caagcagtctgtgtgtgtctctgtgtgattacgtgttaatgaggcatttatcataccagccggactttaatgtggcttccttg

SEQ ID NO: 79618 - DNA, 77 bp, Mus musculus
gggggctggggagatagctcagtgtagaatgtgtgctgagtgaacactagcaacctgagtttggatccccagccccc

SEQ ID NO: 79619 - DNA, 110 bp, Mus musculus
ctgtagctgtcttcagacactccagaagagggcatcagattatttatttatttatttatttatttatttattatatgtaagtacactgtagctgtcttcagacactccag

SEQ ID NO: 79620 - DNA, 84 bp, Mus musculus
gcttatttgtctgcgcttgtctgtgtgtctgtgtgccatgtgtgagcaggaacctacagacaccagaagacagcatcggattgc

SEQ ID NO: 79621 - DNA, 101 bp, Mus musculus
cttgtcttgcatctaggagctggatgtctgtctttatcactctcccctttatttggagggaataaactctcactgaacctggagctcacagatttgactag

SEQ ID NO: 79622 - DNA, 90 bp, Mus musculus
tggttcagcacgtcctggaatgagatgggtctgtgctcacttctctgtctaaagataagatgccccgtaaatttaaggatgtacatacta

SEQ ID NO: 79623 - DNA, 108 bp, Mus musculus
agccaaggacacttgattccagagggacacactgatgccaggtgccaggaatgcctctgatgtggctgctggcttcagtgccagccaagggcaaactacacagaaagc

SEQ ID NO: 79624 - DNA, 85 bp, Mus musculus
tcggtttagagcattgactgctcttccagaggtcctgagttcaaatcccagaaaccacatggtggctcacaattatctgtaccga

SEQ ID NO: 79625 - DNA, 140 bp, Mus musculus
gatagtgtgtgtgtgtgtgtgtgtgtgtgatgtatgtccgtgtacatggatatgcacatacgtgtctgtgtacctctctgtgtgtatctatgtctatgtccacacgtgtgcaggagtcactggaggtcagaagggcttgt

SEQ ID NO: 79626 - DNA, 113 bp, Mus musculus
ccataggttgggggtggggagaagaaaaggcatgatgaaggcccaaagccacctctctctgcctctgtatcagcccagatgtgctccagaccatgcctccccagctgtgatgg

SEQ ID NO: 79627 - DNA, 79 bp, Mus musculus
ggtgagagttactgagggcctagtttcccacagtttggtctctcacaatctgtgtgctttctttcagtattgttttatt

SEQ ID NO: 79628 - DNA, 61 bp, Mus musculus
ctgtctctcactctgggacccagcaggactcagaatctgccaaggtcaagggtgggggcgg

SEQ ID NO: 79629 - DNA, 90 bp, Mus musculus
gtcctggggggatggacctctggagaagtaattagtcccacccccggttttctaccccctctccctgtgagtgtctgtgcctccctatgc

SEQ ID NO: 79630 - DNA, 62 bp, Mus musculus
agtgggacatgcagagagacagagaagttggccatgactctctctttctgactctgaccact

SEQ ID NO: 79631 - DNA, 73 bp, Mus musculus
acatgagagagacagagacacagagatacaaaggcatgattgtttgtattcctgcgtgtgtgtgtgtgtgtgt

SEQ ID NO: 79632 - DNA, 72 bp, Mus musculus
gtgtgtgaggctgtggctctttccaaacctgggtatttcagggatgagtgagaagagactcggatcagacac

SEQ ID NO: 79633 - DNA, 89 bp, Mus musculus
gcttacctctgtggctctcatgggttcagagccaatcagtgttggcctctggatcacatctgatatacttgactttgccacatgctagc

SEQ ID NO: 79634 - DNA, 76 bp, Mus musculus
ttgggctgagctagcttgtgggcaagcaggggatctttctgtctctgcctcactagagctggcattataagcacaa

SEQ ID NO: 79635 - DNA, 110 bp, Mus musculus
ccatcctctgtcgtttcaggctggggcttgttatttagagagctttgtgtctttgtgtcaggctgagatcaagcccctttgtaaccatattccattgaaatcagaggtgg

SEQ ID NO: 79636 - DNA, 70 bp, Mus musculus
gctttcttggttagactggaagccagaaagtcccagagatcctctggcctctctctgtctctcttggagc

SEQ ID NO: 79637 - DNA, 95 bp, Mus musculus
agtcactaactggctggagagtggctcagcagttaagagcactgactgctcttccagaggtcctgagttcaaatcccagcaaccatatggtggct

SEQ ID NO: 79638 - DNA, 73 bp, Mus musculus
tacagtatgtatgtgtatatatgtgtgtatatatatgtgtgtgtgtatatatgtgtgtaaatatatgtgtgta

SEQ ID NO: 79639 - DNA, 151 bp, Mus musculus
gtgtatgtatgtgtatatatgtgtgtgtgtatatatgtgtgtaaatatatgtgtgtatgtatgtgtatatatatatgtgtgtgtgtgtatatatatgtgtgtgtaaatatatgtgtgtatgtatgtgtatatatatgtgtgtgtatgtgta

SEQ ID NO: 79640 - DNA, 155 bp, Mus musculus
gtgtgtatatatatgtgtgtgtaaatatatgtgtgtatgtatgtgtatatatatgtgtgtgtatgtatgtgtatatatgtgtgtatatatatgtgtgtgtgtatatatgtgtgtaaatatatgtgtgtatgtatgtgtatatatatgtgtgtgtg

SEQ ID NO: 79641 - DNA, 89 bp, Mus musculus
tcaaagatatgagcccatactacgctggttcttttttttttaaatatgattttatttaaaattatgtgcatgtgggtttgtgtgtggga

SEQ ID NO: 79642 - DNA, 67 bp, Mus musculus
tctgtctgtctgtctgtctgtctgttcttgtgggcaaggtgagaacctggaggaggcagaggaagga

SEQ ID NO: 79643 - DNA, 84 bp, Mus musculus
cttaaccttgttattcagactagatcccttattggtgcttccatatttcttaaggtttccagactgtctgactgacactttaag

SEQ ID NO: 79644 - DNA, 77 bp, Mus musculus
acctaaacgtgtttgctggatctgactgtctctgtccgatggacacagatgctcagttcccatgcctggctgtgggt

SEQ ID NO: 79645 - DNA, 69 bp, Mus musculus
gtcaacatgagggagggagtgtccaaggaaacaggaataaggctgtcccactctctgacttgtgaaggc

SEQ ID NO: 79646 - DNA, 116 bp, Mus musculus
tcttctaagatgtagggtcactcacttgctccattctgactctattgttctggatcatttcagaatttgttgatgtcgaatgagatcctgtgtgatgttcactttctggctgggga

SEQ ID NO: 79647 - DNA, 99 bp, Mus musculus
tattgtgtgctgaggggctgtgtgtgtgtgtgtagagtgtgtactgtgtgcatactgtgtgtgtgctgtgtgtatgtagtgtgtgagctgtgtgcatac

SEQ ID NO: 79648 - DNA, 100 bp, Mus musculus
actccataacactgattgaaatctgatggctgtcttctctgcctcggcctactccagaacgagcatttcagaagccactcctgtctcagacactgtgagt

SEQ ID NO: 79649 - DNA, 138 bp, Mus musculus
atgcaaagagatattttcagtaagacatgccaataatactcttttaatttctatttatatattttatggggtgtctgtctgtctgtgtctgtgtgtgtacatgcatgtgtgtccacacggcggcacatgtagtcaaca

SEQ ID NO: 79650 - DNA, 81 bp, Mus musculus
cacttcgccgaaagtgctctctgtgctccgttggggccatttatagacctcttgagtctcagtcagtcttttgtagatatg

SEQ ID NO: 79651 - DNA, 97 bp, Mus musculus
cacatatgtgcatggatgcacccaccggcatgtgcgtgcatgtgtacacatacacacatactcacgctcacacacagtcatccttggctacatagtg

SEQ ID NO: 79652 - DNA, 111 bp, Mus musculus
atgatggtaggggaggcgtggtcatgggagttaaaggcagctggacactttgtatccacagtcagaaagcagagaggtcagtgcaggacctgtttcctgtttccttctcat

SEQ ID NO: 79653 - DNA, 85 bp, Mus musculus
agaaggattaggaagtgtggagtgggtgtggccttggtggcatgggtgtgtcactggggtggtctgtctgtctgtctgtctgtct

SEQ ID NO: 79654 - DNA, 118 bp, Mus musculus
tctctccagatgttcgtacgtgtctcgccttgggtcccccctagaagcaaaccttggctcacagatgagtgtgaggtagcttatgaggaggtccagaacgtgctgagggtaggggaga

SEQ ID NO: 79655 - DNA, 88 bp, Mus musculus
ccaccataactcagctgcaaattgtttttatattaatcgacaaattgagtatttaactaaaagaatttgtgtggtgtggtgtggtgtg

SEQ ID NO: 79656 - DNA, 106 bp, Mus musculus
gggagaaggtgaaggaagcgcttctctctgggtgcctttagctcctctggatgagtattcagtagtgagaggggacagagtcagggttgccttcgcacagtctccc

SEQ ID NO: 79657 - DNA, 105 bp, Mus musculus
aaagttgtcattgtctggaggattaatcagtcattcactgtcaggtactgttgttaggtaagggctgaagtgggtctgttgtttagagcatctacgggtggcttt

SEQ ID NO: 79658 - DNA, 88 bp, Mus musculus
ctcctttttcagagacagtgtctctctgtgtagttcgggctggtctggaactcacaatgagccagcctctgcctcctgaatgctgggg

SEQ ID NO: 79659 - DNA, 66 bp, Mus musculus
cacacacacacatatgtatgtatatatgtataatgtgtgcatacacatgcatatgtgaatgatgtg

SEQ ID NO: 79660 - DNA, 68 bp, Mus musculus
cacactcagtctcacagtatacacccctgcaatcctagcactcgggtgtgtgtgtgtgtgtgtgtgtg

SEQ ID NO: 79661 - DNA, 70 bp, Mus musculus
gtatgtatgcgtgcatgtgcatgtatatgtgtgtggatgtgtgtgtgcatgtatgagtgtgtgtgtgtgc

SEQ ID NO: 79662 - DNA, 56 bp, Mus musculus
ctctgtgggtgtctctcaggctctgttccagggataccgtgagacattccctagag

SEQ ID NO: 79663 - DNA, 109 bp, Mus musculus
gcatgtgtatatgtatatatgtgtttgtatatgtgtgagagtgtgtatgtggacatgtgttttatatatctatatatgtgtttttatgtatgtgtatgagtgcatatgt

SEQ ID NO: 79664 - DNA, 61 bp, Mus musculus
tgggtgggctgagtcaagcaagacagctctgagtgactgtggctgactattgcctcaaaca

SEQ ID NO: 79665 - DNA, 68 bp, Mus musculus
tctgggggaaagcaaaggattgggagaactggacacctgtctgtctgtctgtctgtccgtcctccagg

SEQ ID NO: 79666 - DNA, 66 bp, Mus musculus
gtgaatgtggttctgtatctctctgtctctctctctggggggtgggggaggtaggccctccttctc

SEQ ID NO: 79667 - DNA, 76 bp, Mus musculus
gcaggcagagacagggcgtccttggggtcaagctgggtggctagaccagcaaagtcagggagctttgaggtccagc

SEQ ID NO: 79668 - DNA, 114 bp, Mus musculus
ttcaaaccacagttttccacatacacacctacggagtgctgcattggtatattatttctttaaaatgtgccttctttgtaatgctccttcagtgagctggagggatggtctgag

SEQ ID NO: 79669 - DNA, 111 bp, Mus musculus
ggggagggaatgaggacacaaaaaagacaaagccaatcactgaccacacgtagatggtagtattctaaacttatttcaccttggcttgcttttgaactttgatctcttgtc

SEQ ID NO: 79670 - DNA, 100 bp, Mus musculus
ccaggcagaagcagatgtgaaggagatgcaagagaagctgtgagccccacatgctccttgtcagcagacactgtgctgtgtatggcctgtggtcactggc

SEQ ID NO: 79671 - DNA, 70 bp, Mus musculus
gtttcccaaaatctgtggcctttgcctgtcacctcttggtggctactggctgtcactgtcagtgtctagc

SEQ ID NO: 79672 - DNA, 77 bp, Mus musculus
cagtcagtgcctctctgtctgtctcacagcggccaggccccctcctctgtgtcagcttctctcagtaggccttgctg

SEQ ID NO: 79673 - DNA, 100 bp, Mus musculus
agggaagcaagtgagtgagtgaaagtagagtacatgcagagacagacagacagacagacatatctgtggtagttaaccttccttgacaacttgatgcctt

SEQ ID NO: 79674 - DNA, 95 bp, Mus musculus
cgcttcttgcacaggctcaggcgctcaggctctgaatctgctttcctctccagcagacacaacagagtgagtaaggaactactgtgaccggagcg

SEQ ID NO: 79675 - DNA, 76 bp, Mus musculus
aggcccggagtcacagtatagtgtcaggactcagcacctgctgggaggcggggctgtgctgtgctaccccggggct

SEQ ID NO: 79676 - DNA, 117 bp, Mus musculus
atctgagctacatgcctgctcactctcacctcatctcccgaaagccgtgcgtgcgtgcgtgcgtgcgtgcgtgcgtgtggtcttcaaaggagagaagtgtggctcgtaagtccagat

SEQ ID NO: 79677 - DNA, 80 bp, Mus musculus
ctgagggtgcacacactgagctgagggtgcacacacagagctggaggtgcacacactgagctgggggagcacacactgag

SEQ ID NO: 79678 - DNA, 146 bp, Mus musculus
gtgcacacactgagctgagggtgcacacactgagctgagggtgcacacactgagctgagggtgcacacactgagctggaggtgcacacactgagctgagggtgcacacacagagctggaggtgcacacactgagctgagggtgcac

SEQ ID NO: 79679 - DNA, 64 bp, Mus musculus
agctggaggtgcacacactgagctggaggtacacacactgagctgagggtgcacacactgagct

SEQ ID NO: 79680 - DNA, 250 bp, Mus musculus
ctggaggtgcacacactgagctgagggtgcacacactgagctgagggtgcacacactgagctgggggggcacacacagagctggaggtgcacacactgagctgagggtgcacacactgagctgagggtgcacatactgagctggggtgcatacactgagctggaggtgcacacactgagctgagggtgcacacactgggctggggggcatacactgagctggaggtgcgcacactgagctgagggtgcac

SEQ ID NO: 79681 - DNA, 95 bp, Mus musculus
taccatgatcagatgaggtctaggaccccacagcccctctgttgatggagccagagatgtgtttttcatggtatttggctgaaaccgagtagttg

SEQ ID NO: 79682 - DNA, 85 bp, Mus musculus
cactcactcactgtgtgtgtgtgtgcacacatctgggcacatatgtgctatggtgtgcattcagagattcagaggacaatttgtg

SEQ ID NO: 79683 - DNA, 118 bp, Mus musculus
tgtcccttgtccctggctcagtcccggtcatggagggagaggttctaagtgtgcatgtgcatttgctgttgactcctgtttggttatattctcaggggggtggggagggacgatgaca

SEQ ID NO: 79684 - DNA, 67 bp, Mus musculus
ctggggatgagcactgactctcttcaaggcttgtggtagaagcatggattagtgttttcttttctag

SEQ ID NO: 79685 - DNA, 116 bp, Mus musculus
ttaagcagtgtgtgtgtggttctgcatcccgcctctgtggctcactgtatgcttttggttttgaaatccctccagttcacaaggtctggatccctgtttgcccagcactggtttaa

SEQ ID NO: 79686 - DNA, 58 bp, Mus musculus
acagatatagggcaagatgtatgtgtgggtgtgcctacgtgtctctctctgtgtctgt

SEQ ID NO: 79687 - DNA, 95 bp, Mus musculus
ctgtgtgtcagggcaggctgactcctgcttggctgccaccctctgtttcactggagatcggcatgccaggccaggtgtgatcactggtgcaacag

SEQ ID NO: 79688 - DNA, 91 bp, Mus musculus
gggaactctttgattgtttgtgtggtcctgggtttggaactttgtgtacaatgacaagtactctctcagtgagtcatacttcctgcttccc

SEQ ID NO: 79689 - DNA, 86 bp, Mus musculus
tcgggttagcacacccctaaagactctctcaagtcaagagacatatctcctcgggagagagacattctggttggctggcttcctga

SEQ ID NO: 79690 - DNA, 63 bp, Mus musculus
ctgggtggggactgtctctgactctgggtaaggcccacagcatatagagttccacaactctag

SEQ ID NO: 79691 - DNA, 75 bp, Mus musculus
atgtgtgtgtacatatacatgtatgtacatataatgtatgtatatatgcatgtatgtgtatatgtagatacacat

SEQ ID NO: 79692 - DNA, 64 bp, Mus musculus
aggaggctgccaggcatggacgggggagtctgtctctgtctctgtatttggttttttgtttttt

SEQ ID NO: 79693 - DNA, 85 bp, Mus musculus; identical to SEQ ID NO: 57470

SEQ ID NO: 79694 - DNA, 73 bp, Mus musculus
gaatgagggaaggggctggagagatggctcagtagttaagagtactgactgctcttccagaggtcctgagttc

SEQ ID NO: 79695 - DNA, 110 bp, Mus musculus
gcaccaaagcaggagctggggtggctgggctggcattccctgtgaagtgtgggtgctcacagctgggacacagaggaatgagctaccaccctgcacacctggccatggtc

SEQ ID NO: 79696 - DNA, 93 bp, Mus musculus
cactgtctttctgctctgagaactaacagtgctcaggagccttatacaaatgaggctgcacagtatttatttcatagatgccttatttcagtg

SEQ ID NO: 79697 - DNA, 74 bp, Mus musculus
atctcctcaccacctgtggactggcacgcaaattactctctgtgcctcagtctctgcatctgtgtaatggggat

SEQ ID NO: 79698 - DNA, 117 bp, Mus musculus
tttgtgatcattaggagtgattttcaagtgtcccaatctagttggccatcacaaatgtgtctcccactctctggttgtctttcttactctcaaattacagaagcctggcttcacaag

SEQ ID NO: 79699 - DNA, 72 bp, Mus musculus
tcatcatttctttggatgacttctcatttttttcaaagagtggaggaagggccaagtcctgaaggaatgtga

SEQ ID NO: 79700 - DNA, 104 bp, Mus musculus
ttctgattggatgaggtggggtggagctagaaggaggtgagttggtgtgagtagcaagttttgtttagcccttgccctaggtagaagccggtagtagtgaagag

SEQ ID NO: 79701 - DNA, 104 bp, Mus musculus; identical to SEQ ID NO: 79700

SEQ ID NO: 79702 - DNA, 116 bp, Mus musculus
gccttagtgcatggtgatctgataggatgcatgggacaatttcaatatttttgtatctgttgaggcctgttttgtgacctattatgtggtcagttttggagaaggtaccatgaggt

SEQ ID NO: 79703 - DNA, 113 bp, Mus musculus
gcaggcatttatctattcgtctgtctatctatctatctatctatctatctatctatctatccatttatctttagcataggttcttagaatgtagctcaggttctcttgcttgc

SEQ ID NO: 79704 - DNA, 60 bp, Mus musculus
tatgtgtgtgtatatgtgtacatgtgtgtgtgtgcatgtgtgtgtctgtgtgcgtgtgtg

SEQ ID NO: 79705 - DNA, 63 bp, Mus musculus
gtatctgtgtctatatctgtgtttgtgctcctgagtacaggtacccagagggatgtcagatac

SEQ ID NO: 79706 - DNA, 106 bp, Mus musculus
gcctttgtccttgatgatctgataggatgcatgggataatttcaatatttttgtaactgttgaggcctcttttgtgacagattatatgttcagttttggataaggt

SEQ ID NO: 79707 - DNA, 73 bp, Mus musculus
accttagtagtgtagaccacacagcagagtaatagcggcatgctctgtctgtctgtctgctctagtagcaggt

SEQ ID NO: 79708 - DNA, 65 bp, Mus musculus
gaggcccagggcacttgagatggcagggagtccctgtctctgtctgtgtgcctgtttggtgtgtc

SEQ ID NO: 79709 - DNA, 76 bp, Mus musculus
gagtctctctcactcgacagaagctgtggcggctctgcctcttcccgtcactgagtcttgtgagtttgatcatctc

SEQ ID NO: 79710 - DNA, 88 bp, Mus musculus
tggggcactacatacattaagttggaggttatagggcattacatacattaagctgctcactgacagctttcatgagcactgggcctca

SEQ ID NO: 79711 - DNA, 103 bp, Mus musculus
tgaaacagcttgttcaggctggagagatggctcagtggttaagagcactgactgctcttccaggggtcctgagttcaactcccagcaaccacatggtggctca

SEQ ID NO: 79712 - DNA, 85 bp, Mus musculus; identical to SEQ ID NO: 57439

SEQ ID NO: 79713 - DNA, 119 bp, Mus musculus
tcagctcagttttagatctgtatgtgttgttgctgctggtaatccaaccctagaatatatatttttatttctaggcccaagagcagtggttcacaacccatggattacaaccaatctgg

SEQ ID NO: 79714 - DNA, 82 bp, Mus musculus
atgagtcttgtgaggtttgtagccaccttgccagtagctctttgcagctgaaccaaaacaaaagcagacccacttaacacat

SEQ ID NO: 79715 - DNA, 116 bp, Mus musculus
tcctgtagtttaattgctgtccggttcttgagaaagatgtctgataggatggctcaggtgtgctgtcttctcagactcattccttacctacatgagaactgtcagtcctgtcaggg

SEQ ID NO: 79716 - DNA, 90 bp, Mus musculus
ggtccatgtccacacagtctctctgtgtaacattttactatagttttgtaagatgttccgtttaaggggtctgtgtgtgcacagtggatc

SEQ ID NO: 79717 - DNA, 108 bp, Mus musculus
tagatagagtctgattgttctataggggttgaggcctgtctgtgtttctgactccacagaaaccaaactgccttctcatcttcctcactggggccagataactggata

SEQ ID NO: 79718 - DNA, 69 bp, Mus musculus
acacagagagagagagacagagagagagacacagagagagagcatctgtgtctctttatctctgtgtgt

SEQ ID NO: 79719 - DNA, 71 bp, Mus musculus
agggtagagatggagggaggcagcgtagccaggagagccagctttgggtctccctcactctcataggccct

SEQ ID NO: 79720 - DNA, 92 bp, Mus musculus
aatgtggatttttgcaagagaacagaccatagggcctcttagtggcacactctctctatgtggcctttgtttactgaggtacggttggcatt

SEQ ID NO: 79721 - DNA, 98 bp, Mus musculus
gtggttttattctctatctccatctgtgtggcttggaggcaggccttggcttttcttggtctcagtctctccatctgtgaaatggagattaaacctac

SEQ ID NO: 79722 - DNA, 75 bp, Mus musculus
ggaactctgtcaggctgcctgtctgccttgctgctggaggtataatggctgctcaggagagacagaacaaagtcc

SEQ ID NO: 79723 - DNA, 94 bp, Mus musculus
cagtggcccaggggaggcccactgaagcctgctaatgctgagaagacagtttctccatcaggatctggatcaagccttgcctacctagtgactg

SEQ ID NO: 79724 - DNA, 98 bp, Mus musculus
ctgtgcacactgatcacactgtgcagctcacttcacactgtgcacactgatcacactgtgcagcccacttcacactgtgcacactgatcacactgtgc

SEQ ID NO: 79725 - DNA, 80 bp, Mus musculus
gggatacgttaaggagaggagatgagtaagggctgaactatcttccttgctgtccatctgtctgtctgagacaggttctc

SEQ ID NO: 79726 - DNA, 84 bp, Mus musculus
gggacagtttgaaaagtgattttggagagagctcagcggttaagagcactgactgctcttccagaggtcctgagttcagttccc

SEQ ID NO: 79727 - DNA, 83 bp, Mus musculus
gtgctaaaggggtagcaatacattctatatttgatacattttattaaagagaatgtatctctgcatgtgctttcctggcccac

SEQ ID NO: 79728 - DNA, 123 bp, Mus musculus
aagctcaaattcaggtcatctttccagtccctggtatagtaattttcatccaaggaagttttctttagaaaattagattatcgtggagtttaggagaggcactgtacaggtttatggattaga

SEQ ID NO: 79729 - DNA, 61 bp, Mus musculus
ggttgtctgacacgctcagagtcttgcttcccttggcgattctgggacctgccaggttatc

SEQ ID NO: 79730 - DNA, 84 bp, Mus musculus
ttactcctttttgatcacttccattaatctagaattaattgtatgatggatagagagtacagtgagtgcaaaaaaaggtagtaa

SEQ ID NO: 79731 - DNA, 75 bp, Mus musculus
tggctcagcagtagacttctgctctctcttaattcaccagtgagaagacactgagtaaggtcacctgctgagtca

SEQ ID NO: 79732 - DNA, 78 bp, Mus musculus
gaagataaagtcagtctctctgtgtcttcgtaagtggggagaggtccgttctctacttctggggaaaggagactcttc

SEQ ID NO: 79733 - DNA, 70 bp, Mus musculus
gtgtgtgtgtgtgtgtgtgtgtgtgtgtgtacgtgcctgtacacacgtgtactgacacacacatgagcac

SEQ ID NO: 79734 - DNA, 110 bp, Mus musculus
ttgaagatcagccttagtgcatggtgatctgataggatgcatgggtcaatttcaatatttttgtatctgtggaggcctgttttgtgacctattatgtggtcaattttgga

SEQ ID NO: 79735 - DNA, 67 bp, Mus musculus
tcagagtcaggctctgactctcaggcaccacagatgcctctgggcactgcagaagagcctgttctga

SEQ ID NO: 79736 - DNA, 90 bp, Mus musculus
ggtcacatgtatgtatgtatgtatgcatatatgcatgtatgtatgtatgtatatatgtatgtatgtatatatgtatgtaaacagaatccc

SEQ ID NO: 79737 - DNA, 76 bp, Mus musculus
gctctctctcactcagtgctatggcccccttcaggtttcaggaggtggggcaaggaagccctggaaaggaaacagc

SEQ ID NO: 79738 - DNA, 79 bp, Mus musculus
cttctgctaatggcaggtgttagaacaggaccactgtgtgacagccgggtctctgatagtcactgtctgtgggtagagg

SEQ ID NO: 79739 - DNA, 79 bp, Mus musculus; identical to SEQ ID NO: 79738

SEQ ID NO: 79740 - DNA, 85 bp, Mus musculus; identical to SEQ ID NO: 57439

SEQ ID NO: 79741 - DNA, 67 bp, Mus musculus
gtcgcggcaggactggacagtggcagtatgggaatctcccactctgtatctaacttgtattagggac

SEQ ID NO: 79742 - DNA, 93 bp, Mus musculus
tccatgttgatctgataggttgcatgagacaatttcaatatttttgtatctattgaggcatgttttgtgaccaatcatatggtccaatttgga

SEQ ID NO: 79743 - DNA, 116 bp, Mus musculus
gtttggtttatggtttgatttagttttgtttggtttgcttgtaaccaatggattaaaatttgtacagaggtatgtagtcatccagataactgtggcaaaccaactagggaccacac

SEQ ID NO: 79744 - DNA, 112 bp, Mus musculus
gccttagtccatggtggtctaataggatgcatgggacaatttcaatatttttgtatctgttgaggcctgttttgtgaccaattgtatagtcaattttggaaaaggtcccgtg

SEQ ID NO: 79745 - DNA, 112 bp, Mus musculus
cccttttccataactgagctgcctaactccaatagatgttcctagtcttactgcaactggatatgccaaggctaggtgatatttataggaggcctcagttttctgagaaggg

SEQ ID NO: 79746 - DNA, 68 bp, Mus musculus
tatgtgaatatatatgtatatgtgtatatatatatgtatatatacacatatacatatatgtgtgtgtg

SEQ ID NO: 79747 - DNA, 66 bp, Mus musculus
ctggttgggtgggtccctgtgtccctgctcctgcttgttattagacgcgttctcacgaccggccag

SEQ ID NO: 79748 - DNA, 77 bp, Mus musculus
gtgcatcacaaaagtgcatcccaattccatgtttctcatagaaatcaatgtgtgattgtacatgtgtgtgtgtgtgc

SEQ ID NO: 79749 - DNA, 104 bp, Mus musculus
gaggagctccttcctgtcttagcaagacagttcagtggtaagagggaaggagtccaattgcaatggattgaaaagtagataggaagaagttacagtaactcctc

SEQ ID NO: 79750 - DNA, 63 bp, Mus musculus
ccacagccacacttcccatgggagaacacatttatgtgtatgttcatgatggagcacctgtgg

SEQ ID NO: 79751 - DNA, 116 bp, Mus musculus
ggcaagtgtcaaagccagtgggtcggctgctgcggaaaggctgtgttcctctgtgggtctgtcagctgagggaaagctctgtgctctgcactgtgggcccattctgtgtctgagtc

SEQ ID NO: 79752 - DNA, 83 bp, Mus musculus
gaactgccactcttcctgtctgtctgtcccagtggtctccatgtcaaggccctgccctggatctgcctgaagccctgcaggcc

SEQ ID NO: 79753 - DNA, 127 bp, Mus musculus
cagagggcaccagggtgtgcatgtgttacagcactgtcactgtgattatgtcagagacacacacactggcaggactgctgaaagccactgtccatatcaaatgctgccttttgtgagcttctcagac

SEQ ID NO: 79754 - DNA, 71 bp, Mus musculus
gagaactgctgtcttcagtctgtgttagaatctggaaaaagtagattttaacaacagtgaaagactgtctc

SEQ ID NO: 79755 - DNA, 106 bp, Mus musculus
gccttaggccatggtggtctgataggatacatgggacaatttcaatatttttgtatctgttgaggcctgttttgtgaccaattatattgtcagttttggagaaggt

SEQ ID NO: 79756 - DNA, 61 bp, Mus musculus
ggttttatgtatatgtatatgtgtatgtaaatgcatgcaaaatatccatttacataaaatt

SEQ ID NO: 79757 - DNA, 79 bp, Mus musculus
tacatgtggtttgtattgaatataaattgggctatatatatttgtttctatagtttgtattgaatacagattatgtgta

SEQ ID NO: 79758 - DNA, 99 bp, Mus musculus
gtttttttaaacacagaggcacatagaatgaccagtggtgacagtcagagtcacagaatggaattggagttttgagtgtccctgctcatctagaaattc

SEQ ID NO: 79759 - DNA, 66 bp, Mus musculus
tcaccaattcactgttgtcttctgagtcagactgagacactgattcacagacactgaatctggtgg

SEQ ID NO: 79760 - DNA, 112 bp, Mus musculus
tttactgatctctatgaacttagggcaatttatggcacactgcaggccctgattgtttcaatgtaagcaagtaagtgaatgaggatctaaatggtacatggagactagtaag

SEQ ID NO: 79761 - DNA, 76 bp, Mus musculus
gcatgttcatgtgtgtgcatatatgtgtgtgtgcatgtgtatgtatgtatgcatgtgtgtgtgtgcatgtgcatgt

SEQ ID NO: 79762 - DNA, 80 bp, Mus musculus
ggaggtcatgcatgtgtgtgcatgtgcatgtggaggtcatgcatgtgcatgtgtgtgcatgtgcatatgtgtgtgagccc

SEQ ID NO: 79763 - DNA, 87 bp, Mus musculus
gcactgttgtctaggtgtttgcagttctgttcagctgtgtgctggaaggtgtcagcagactgaatagtgtgtggagactgtgctgga

SEQ ID NO: 79764 - DNA, 91 bp, Mus musculus
atgtctgctcaaaccctaagcctgtaggaggacgtactctgtgcctcagtgcctccatattaaaagagcttggggagcttttaggagacgt

SEQ ID NO: 79765 - DNA, 116 bp, Mus musculus
tgcctcatccagccttgatatgagggcttgtgcctagtcttactgcatctagttatgctgtgttcagttgacatcactgggaagcctgctcttttctgaagggaaatggaggagca

SEQ ID NO: 79766 - DNA, 105 bp, Mus musculus
agaaaccatctaggggttggagagatggctcagtggttaagagctgaaaatctgactgctcttccagaggtcctgagttcaattcccagcaaccacatggtggct

SEQ ID NO: 79767 - DNA, 61 bp, Mus musculus
tgagtgcagagagtgagcacaggcagaggggctggccctgtttaagcatgctttccactca

SEQ ID NO: 79768 - DNA, 80 bp, Mus musculus
gtttcagcttttgactcacagtactgtttttgaagtaaccattgacggaaggcttctggaacatgacagtagctgtaaac

SEQ ID NO: 79769 - DNA, 118 bp, Mus musculus
gctgcctgggctcacagcacttccccctcaatagctaagtgacactgggtaaacacttcagcctctctgtgcctcagtgtccgcatctgagaaatggattgtgcctattccttacggc

SEQ ID NO: 79770 - DNA, 77 bp, Mus musculus
cttctcatgttgctgtgcaccatgtctgggctggtctatggaccagacagaggacactgtgctctgggattgaaaag

SEQ ID NO: 79771 - DNA, 91 bp, Mus musculus
ctgttcatagagatagagaatttagctcaatggtataacacttgcctagcaagtgcaaggacctgggttcagtcctcagttctaggagcag

SEQ ID NO: 79772 - DNA, 62 bp, Mus musculus
ggtgtgtgtgcatgtgcatatgtatgtgtgtgtatatacatacatgtgtgtgcatgtatggt

SEQ ID NO: 79773 - DNA, 69 bp, Mus musculus
tgaacttttgtgtgtgcaaaagcatgtgtatgtgtatgatatatgtgttaggtatatgtatagggttca

SEQ ID NO: 79774 - DNA, 72 bp, Mus musculus
gtgtgtgcgtgtgtgtgcacgtgcatgtgtacgtgggcatgtgcgtatgcatgtgcgtgtgcatgtgcgtgt

SEQ ID NO: 79775 - DNA, 76 bp, Mus musculus
gctggtatcagtaggcagtcggtgttagtcagtgtcagtcaggcagtgttagtcactgtcagtcttagtagtcagt

SEQ ID NO: 79776 - DNA, 100 bp, Mus musculus
ccactcaagaggctcccctgatgtttttgttctccacccttctttagtgtctctctctcagaagctcactcagaatgctggagtggttataaatacatta

SEQ ID NO: 79777 - DNA, 99 bp, Mus musculus
agggccatttgttctgtggcagtggacaaggagtatgcaagtggaatcttaattatattgattttcaaaatgccattaaagggctagcaagaaggctct

SEQ ID NO: 79778 - DNA, 86 bp, Mus musculus
gccaaagagaaaaatgactgtctggtctgttccccaaggctttgtgtaatgggaagggaaactgaagaatgtcatcacacatgggc

SEQ ID NO: 79779 - DNA, 74 bp, Mus musculus
tggagtacccggcttctactttgggtgccagcaccaacaacaatggtttgggaaaggtagaagacagtagttga

SEQ ID NO: 79780 - DNA, 118 bp, Mus musculus
caatgtcatgtagtgggtaaggggtcaattgacagggttcatctcccattgttgctgacagacgacactggcctcagacttgagcacactcacctgaccctcctgagtacttttattg

SEQ ID NO: 79781 - DNA, 104 bp, Mus musculus
tacatttacttattatatatgtatatatgtatgtatgtacacgtgtgcatgtatctgtatacatgtgtatatgtatttgtgtacacacacacacacatatatat

SEQ ID NO: 79782 - DNA, 61 bp, Mus musculus
tcagctctgaggatggaggccagagaccctgttccagtctcactctgtctctctgaactga

SEQ ID NO: 79783 - DNA, 69 bp, Mus musculus
ccattgtgtcttagagtctcgattgttgtgtggtttgagccacacagtcttataaagactttccaatgg

SEQ ID NO: 79784 - DNA, 69 bp, Mus musculus
caacctccttatagacttgaatcacgcacatggtcactcagtgcatttatctctgcatcaaggaggttg

SEQ ID NO: 79785 - DNA, 85 bp, Mus musculus
aagtctagcctgagttgtggaaagctagctgctgtgtcagtgagtgtgtcaaacacagcgcttaccatgatgtgggctttcactt

SEQ ID NO: 79786 - DNA, 87 bp, Mus musculus
atgcataaatggtgtgtgtgtcagtgtgtgcatgcatgtgcatgagtgtgtgcgtgtgtgtgtgcctgtgtacatgtgtatgtgtgt

SEQ ID NO: 79787 - DNA, 108 bp, Mus musculus
gtgtatgtttgtgtgcatgtgtacatgcatgtgtttgttcatgtgtgtgtgcacgcacacactcttgcacactcacatgcatgtgtgcatgcatgcaggtagagccac

SEQ ID NO: 79788 - DNA, 93 bp, Mus musculus
tcacccctcgggttggagagagagctcaatggttaagagcactgactgctcttccagaggtcctgagttcaaatcccagcaaccacatggtgg

SEQ ID NO: 79789 - DNA, 116 bp, Mus musculus
tgaggttaagtgggttcagtgctggcatgactcaactgcattgttctgagtgtcactgtgtcaccagcacagtggaagtggctgaggatgacaggcactgacataggtccttagct

SEQ ID NO: 79790 - DNA, 72 bp, Mus musculus
acattccatacatacacaatatctatatatgtgtatatatatgtgtgtgtgtgtgtgtgtgtgtgtgtgtgt

SEQ ID NO: 79791 - DNA, 102 bp, Mus musculus
ggcctgcccagaggtccttctcctgggtgattctagatctcaagttgacagttgagagtgaccatcgcaggtactgataaggaaggaccctagggatagtcc

SEQ ID NO: 79792 - DNA, 101 bp, Mus musculus
caggataggtttgatgaggggcctgaacgcttaggagagttgtcagggaggaggctggctgaggaaatcctggtggaggtagctgcttgcctgtgtgcctg

SEQ ID NO: 79793 - DNA, 97 bp, Mus musculus
ggcacaaaggcttttgactgctgttccaatgcactggtaatgttacacactgtcacactgtcattgtgctgatgcaggactcagaggctaacatacc

SEQ ID NO: 79794 - DNA, 68 bp, Mus musculus
gatagttacagttagttacagaagttagtgagcacaccacagtgtgctctgaaggactgctgctcatc

SEQ ID NO: 79795 - DNA, 84 bp, Mus musculus
gctggagagagtagtgactgtgtagaagggaaaggcttacctactccaggggcccctccctctggctgtcccagcctcatccag

SEQ ID NO: 79796 - DNA, 57 bp, Mus musculus
tcactgtgacagtggtgaccagtgaaggcatccctcagtgtctcactgtgacagtgg

SEQ ID NO: 79797 - DNA, 110 bp, Mus musculus
gctgccttgtttctggagagttccaggttctgtgtgtagagtgtgtgctgagcatggcagagtaacacactctctgtgtgagcatggggcagtgcaaaaagtaaggaggc

SEQ ID NO: 79798 - DNA, 61 bp, Mus musculus
atatacattcatatatatatatatatatatacatgtatgtatgtatgtatgtatgtatgta

SEQ ID NO: 79799 - DNA, 67 bp, Mus musculus
tggtaatgagtctggagactgagagcacccatcctcctggttgcacctgtcacagatgacgtaacta

SEQ ID NO: 79800 - DNA, 70 bp, Mus musculus
ctgttgtagctggtaaggtgatgtcatatggatatccatttggcctcatcagtttatgatgttgtgaaag

SEQ ID NO: 79801 - DNA, 70 bp, Mus musculus
taggaagcggcttccctcactggctgtttgtctgggcctccctcactgacagtttgtctgtctctttcta

SEQ ID NO: 79802 - DNA, 102 bp, Mus musculus
attcatggtaagggttttgcgtgagaattctatttgtaattctgataaattctaatgataataattagtggttttaggcagaaaccttctgagaacatgaat

SEQ ID NO: 79803 - DNA, 75 bp, Mus musculus
acaaagggaatgtcaataaataagctgagtgtgtgacatctgatatctcagactcacactctgctattcctttgt

SEQ ID NO: 79804 - DNA, 70 bp, Mus musculus
tgattatcatttgtataaatatatatgtgtgtctgggcacatgtgtatgtgtatatgtttgtgaaagtta

SEQ ID NO: 79805 - DNA, 96 bp, Mus musculus
ttctgtgaaaatcaatgactatatagattttactatgaaaaatattgtatattttatcattattgtaaattgttctgtgtggcctttttatcagga

SEQ ID NO: 79806 - DNA, 68 bp, Mus musculus
tcttactcagaagtgagagtgaacaggaagaaggagcacagtgaggttcattctcattctgagtcaga

SEQ ID NO: 79807 - DNA, 118 bp, Mus musculus
gctctatctttccattactgggaagttgcacttagatcatcttgatacatgtatatattttagtaatcttgtactgtattatgtttctatacaactcccgatggcccttaattttagc

SEQ ID NO: 79808 - DNA, 81 bp, Mus musculus
aggcagagaactagagaagtcaggagtttgggaactaacagttacttttcagttttctttgactagtttagttttctttct

SEQ ID NO: 79809 - DNA, 85 bp, Mus musculus; identical to SEQ ID NO: 57439

SEQ ID NO: 79810 - DNA, 89 bp, Mus musculus
gacagtaatggagagatgacagtgtggacaacaatgcagaagctgtgatcatagtacagaattgagtcttcactgtggtacacaaagtc

SEQ ID NO: 79811 - DNA, 96 bp, Mus musculus
gtgagaacagttttgaaagagctagtcatatcataccgcaagcaggaacagagaacaatgaatgcatgcatgttagtgcttagcttgctttctcac

SEQ ID NO: 79812 - DNA, 67 bp, Mus musculus
tctgctgttctcttcccgacttctagagtattgattatatgaagacagaagtctgagagaattcaga

SEQ ID NO: 79813 - DNA, 105 bp, Mus musculus
gaaccttagggtggcagctttacatgtggagttatctctgtgctctcatcaaattgtatgtatttattttcagctttacctgtgcttatctcccttacaaagttt

SEQ ID NO: 79814 - DNA, 85 bp, Mus musculus; identical to SEQ ID NO: 78864

SEQ ID NO: 79815 - DNA, 74 bp, Mus musculus
tgcctgcctgtggatcctgttccccttactaaactgcctcactgggtctctgtgagagaggattcctgcagtca

SEQ ID NO: 79816 - DNA, 66 bp, Mus musculus
gctttgaaattaagcatgtggagtacccgtggttcagtctgggtgtctctcacttagttttagggc

SEQ ID NO: 79817 - DNA, 85 bp, Mus musculus
ccaaacttgacacatgactgtgaacttctctacagttagcaatggagcttagcttggaggttgtatggtttcaaagtcaacgtgg

SEQ ID NO: 79818 - DNA, 85 bp, Mus musculus; identical to SEQ ID NO: 57439

SEQ ID NO: 79819 - DNA, 69 bp, Mus musculus
atgtgtatatatatatatatatatatatatgtatatatgcatgtggtatgtatgtatgtatgtatgtat

SEQ ID NO: 79820 - DNA, 85 bp, Mus musculus; identical to SEQ ID NO: 60991

SEQ ID NO: 79821 - DNA, 102 bp, Mus musculus
ctttttataatttttattgcatgcatatatttatactcatatatattatttcatatagtatgtacagtcagagaaatgtgtgtgctcacatgttttaaatag

SEQ ID NO: 79822 - DNA, 70 bp, Mus musculus
gagagactgaaggagctgagggtgtttgcagccacatggagagagcaacactgtcagtcagtcagccctc

SEQ ID NO: 79823 - DNA, 64 bp, Mus musculus
atgtatgcatatatatatgcatatgtatgtatgtatgtatgtatgtatgtatgtatgtgtatgt

SEQ ID NO: 79824 - DNA, 114 bp, Mus musculus
gggggcgctgtgatccatccaatagctgactgtgagcatccacttctgtatttgttgttccacttatagggttgcagaccccttagctacttgggtactttctctagctccttc

SEQ ID NO: 79825 - DNA, 94 bp, Mus musculus
ggcttacagtttcagaactttaatccattatcatcatggagggatgcatagcagaacccaggcagaagtgattgtggaaagggagctgggagct

SEQ ID NO: 79826 - DNA, 85 bp, Mus musculus; identical to SEQ ID NO: 57439

SEQ ID NO: 79827 - DNA, 93 bp, Mus musculus
tatatgtgaataaaatccatatatatgtatatgtgtatatatatatgtatatgtgtgcatatgtatatgtgtgtatttttatatatatgtata

SEQ ID NO: 79828 - DNA, 88 bp, Mus musculus
ggattatacatatatgtatatatgtatatatatgtataagtatatatatatatatatatatatatacacacaaatatacatataatcc

SEQ ID NO: 79829 - DNA, 78 bp, Mus musculus
ccagatgtctgatcacattgttagcttttagattagtggaagctaatggtatgtcaagaacacactgttagattttgg

SEQ ID NO: 79830 - DNA, 85 bp, Mus musculus; identical to SEQ ID NO: 57439

SEQ ID NO: 79831 - DNA, 83 bp, Mus musculus
ggaaaaggttccccaggtggggaagtctctagatgaacattccttcagtctctgctctgactttgtctctgtaaatcctttct

SEQ ID NO: 79832 - DNA, 102 bp, Mus musculus
tctcaacttcatatggtctataagttgtatcatgggtattccaagattttttttctaatatccactgataagtttgtaaataccgtgtgtgctcttttgtga

SEQ ID NO: 79833 - DNA, 85 bp, Mus musculus; identical to SEQ ID NO: 57470

SEQ ID NO: 79834 - DNA, 118 bp, Mus musculus
ttacactttttgtgggattattcagtgggaataggggggtgtctctgtctctgactctttcgcttgaatttaggagccctttcctcctactgaattgccttagccatcctggatgtga

SEQ ID NO: 79835 - DNA, 83 bp, Mus musculus
gaggtgggagtgatgggttctgatgattgtgagcagtcttattttctgttagtaagattcttatgtttgccttttgccatctt

SEQ ID NO: 79836 - DNA, 71 bp, Mus musculus
agatatatgtatatgtgcatgtgtatatgtatatgatgtgtatatataaatatgtatgtgtatatgtattt

SEQ ID NO: 79837 - DNA, 63 bp, Mus musculus
ggggggagagagagagaggagagagagagagagacttataatcaactctctgtgtctctgtgt

SEQ ID NO: 79838 - DNA, 75 bp, Mus musculus
cacgattcagaatatatatatatatacacacacacatacatatatatgtatgtgtgtgtgtgtatttggattatg

SEQ ID NO: 79839 - DNA, 89 bp, Mus musculus
gtaggaagagggcttgttatgcctgttgaataatggtatatatctttattttgctatgacagagaaatgccagctctctgtagttctat

SEQ ID NO: 79840 - DNA, 109 bp, Mus musculus
tccatttctgttgttatgcctccattttcatttctgattttgttcatttggatactgtctctgaacccttagcagaaagaatggaaacaagcaacctcaggaaatagga

SEQ ID NO: 79841 - DNA, 95 bp, Mus musculus
tctatttacacacacacaaaattctgtatatatatgtatatatatgtacatatatgaatatatgtatatatacagaattttgtgtgtgtattaga

SEQ ID NO: 79842 - DNA, 85 bp, Mus musculus
gtccatggtggtctgataggatgcatgggataatttcaatatttttgtatctattgaggcctgtattgtgaccaattatatgttc

SEQ ID NO: 79843 - DNA, 87 bp, Mus musculus
gggctaatattcactcatcagtgagtgcataccacgtgttttcttttgtaactgggtcacctcactcaggatgatattttttagttc

SEQ ID NO: 79844 - DNA, 75 bp, Mus musculus
cttgatctccatttgttttcttatttctctagctcgaacttgagtactatgttgaatagataagtggagagttag

SEQ ID NO: 79845 - DNA, 85 bp, Mus musculus; identical to SEQ ID NO: 57439

SEQ ID NO: 79846 - DNA, 128 bp, Mus musculus
acattttgatacacatatacaaacacaaacatgtgtgtgtgtgtgtgtgtgtgtgtgtgtgtgtgtgtgtgtgtgttagggtttctgaaggaacagagcttatagaatgtatatatacatacacatat

SEQ ID NO: 79847 - DNA, 78 bp, Mus musculus
gtcctagaactcactctgcagaccaggatgtcctcgacctctgaaatctgcctgcgtttgcctccagagtgctgggat

SEQ ID NO: 79848 - DNA, 85 bp, Mus musculus; identical to SEQ ID NO: 57470

SEQ ID NO: 79849 - DNA, 85 bp, Mus musculus; identical to SEQ ID NO: 57439

SEQ ID NO: 79850 - DNA, 139 bp, Mus musculus
tctgtggttccatgttctgcttcctcccttgaggtgtccaggtgctgctgtacaccaggtgggagaagacagagagcccagagctggtgggtcagtcggatcttggtcaggctgggattgctgagtggggtgacttggc

SEQ ID NO: 79851 - DNA, 84 bp, Mus musculus
gttcatatgaatatatgtatgtatgtatgtatgtatgtatgtatgtatgtatgagcaccgcatacctgtcatgttcatatgaat

SEQ ID NO: 79852 - DNA, 94 bp, Mus musculus
gctgtcctggaactcaccctgtagaccacagactgttctggaacttacagagatccacctgcctctgtctctgcctctcgagtgctaggaaggt

SEQ ID NO: 79853 - DNA, 99 bp, Mus musculus
gaaatggggggggggggattgttggggagagaacactaatttatcaatcttcttaatagttaattctatgatttttaataatctagctttccacatttc

SEQ ID NO: 79854 - DNA, 72 bp, Mus musculus
gagtgatatttttttcttaattaaaagtggaaagacccacttttaatctttgaggtatgaagatatagtctc

SEQ ID NO: 79855 - DNA, 84 bp, Mus musculus
tgtgtatatatgtgtatgtgtgtatatatatgtatacatgaataatatatgtatatagcatatatatacgtgtatatatatatg

SEQ ID NO: 79856 - DNA, 83 bp, Mus musculus
attcccgagcgctcagggcctcaggctcctattgcctgacacagggggcaggcaatatgactgactgactgacagccaggagt

SEQ ID NO: 79857 - DNA, 57 bp, Mus musculus
ctgtctctgtctcactctctgtgtatgtgtgtgtgttgggggtggggtcagagttgg

SEQ ID NO: 79858 - DNA, 88 bp, Mus musculus
tctgaacacctcaacatgtcctagagcttcatgcatgccaggtgacactgtgtctcactttgtgttctctggggctggttgggtcagg

SEQ ID NO: 79859 - DNA, 74 bp, Mus musculus
acagtgggggcagggtgacccgaggaccagtgtgatgacagataggagttgtgggtctgtctgtgactggctgt

SEQ ID NO: 79860 - DNA, 60 bp, Mus musculus
cccgcttccactctgagtggggtgacaggcatgcactaccacactcactgtgactgccgg

SEQ ID NO: 79861 - DNA, 83 bp, Mus musculus
cacacatgtgccacactctcacacacacaataatgaatatatatatatatgtgtgtgtgtgtgtgtgtgtgtgtgtgtgtgtg

SEQ ID NO: 79862 - DNA, 63 bp, Mus musculus
cctacagcaggaagctttctggctgactcaggtcatggcagtcagaagtgagtgtgctccagg

SEQ ID NO: 79863 - DNA, 71 bp, Mus musculus
gctgagtctgactcagtgtgatttcagcagcataggaatgtatggtgagttcaggggatcgtggtctcagc

SEQ ID NO: 79864 - DNA, 63 bp, Mus musculus
taggaggccagtctgggctgtgtagcaagaccatgtctgcctgcctgcctgcctgcctgcctg

SEQ ID NO: 79865 - DNA, 62 bp, Mus musculus
gggtatgtctcagtacagtgtctgtcacacaagtgtccgtcagactctgaccccgagcaccc

SEQ ID NO: 79866 - DNA, 67 bp, Mus musculus
ggccctggttaaccagtcctgacatgtatgctcaataaagtgcctctctctgactgagactggggct

SEQ ID NO: 79867 - DNA, 71 bp, Mus musculus
gaggaggcactgaagtagatatatattcctggtccctggagtctgtctctgtctctgtgtctgtctgtctc

SEQ ID NO: 79868 - DNA, 116 bp, Mus musculus
gagactagttttttgcctcagtttccagttagttgcccctctctttcagtctctctttcggaagaatcactttgtatcgaaggaaagggacattaactgcaaagtccaggtgtctc

SEQ ID NO: 79869 - DNA, 81 bp, Mus musculus
gagaactgaagggaggcttagcactgctttaatcccagcacaagggtggcagaggtagtaggtagagtccttatgagttcc

SEQ ID NO: 79870 - DNA, 86 bp, Mus musculus
ggaagagaaagagaaagaagtctgcagagatggctcagtggttaagagcactgactgctcttccagaggtcctgagttcaatttcc

SEQ ID NO: 79871 - DNA, 154 bp, Mus musculus
tacatatatgtatgtgtgtatgtatatatatatgtatacatgtgtacatatgtgtgtgtatatatatatgtatacatgtgtgtatatgtgtgtgtatatatatatgtatacacacacacacacacacacgtatccatatgagaacacacataca

SEQ ID NO: 79872 - DNA, 119 bp, Mus musculus
gctgaggaactgaacagccatccccgccatcccagtgttcagactacctgttcaggaggctgggacatgtacagtagtctgcacattggttaggctgggcttgggccagcagcaacagt

SEQ ID NO: 79873 - DNA, 111 bp, Mus musculus
gattgaaagcagcataggcagctggagagatggctcagaggttaagagcactaactgctcttccagaggtcctgagttcaattcccagcaaccacatggtggctcacaacc

SEQ ID NO: 79874 - DNA, 83 bp, Mus musculus
gcttgctgactgatgtgagtaacctcagagctgtgtagagaaaaacagatctgtggagctcattagccatcatgtctaaaagt

SEQ ID NO: 79875 - DNA, 83 bp, Mus musculus
ggctctgagctcaccttagaatctatttgaaaaggatccacctgtcctggttaagagacagatttcatcttgggcttcatgcc

SEQ ID NO: 79876 - DNA, 114 bp, Mus musculus
agctcttgggtttggatacgagaggtcttagcatctggtagacataggggagggtgtcacacagtgactcagagcaaatattctcattttatttattcatttacttaaaggact

SEQ ID NO: 79877 - DNA, 79 bp, Mus musculus
caggcccagccactgacgctgaggcatctaaggacctccaatgagttcagttgtgtgcctgtgtgtgtgcctgtgcctg

SEQ ID NO: 79878 - DNA, 100 bp, Mus musculus
ctggtagctaacgtgtttagctggcacaggaccttggtttcatccccagcatggaagagaagacagttagctgtcccagtttgtacacaatagataacag

SEQ ID NO: 79879 - DNA, 115 bp, Mus musculus
tgggatgaccttgaactcctgagtctcctgcacacacctcccaagtgctgtgtgtgcctctgtgtctggtttatgtggtggtaggaatagaacacagggcttcttgcaagtctca

SEQ ID NO: 79880 - DNA, 105 bp, Mus musculus
tgagcatgtgaatttgcacgtctcctggtatgagtgtagacagaggtcagagaacaactttgacattcagttctttctaccatgtggattcagggactcgaattc

SEQ ID NO: 79881 - DNA, 123 bp, Mus musculus
atgtatctatgtctgtgaatgcatctatgtgtgtatgtatctaagtgtatgtgtgtgtgcatgtgcatgcttgtgtctagttatgtgtgtgcatgcatgtacgtatgtgggtgtgtaccatat

SEQ ID NO: 79882 - DNA, 78 bp, Mus musculus
ccgatcagaggattaatctgtgcctttcgagccaacgcgtgggaggctcgaaagagtcagggtggcctccaggaaagg

SEQ ID NO: 79883 - DNA, 127 bp, Mus musculus
gtatatgtgtatatccatatatgtgtctgttcatgtatgtatgtatccatgcatctacccatgtatgtatgtatgtacgtactatgtacttatgtatgtatatgtatgcatccacctatctctgtat

SEQ ID NO: 79884 - DNA, 76 bp, Mus musculus
tctgtatagccctggctgtcctggaactcactctgaagtttcttcagagaagaaactcagcggcctcgaactcaga

SEQ ID NO: 79885 - DNA, 106 bp, Mus musculus
tgcttctgaccaaaaaggcctcggatctgtccctaagaagacagagagcacacaaagcttgcctgtccttaggactacaggactgtctaggaagtggtgaggaaca

SEQ ID NO: 79886 - DNA, 69 bp, Mus musculus
gacacctgtgtccctgtgtcagtcctacgtggtctagaacacaatagtatatttgaggccccaggtgtc

SEQ ID NO: 79887 - DNA, 70 bp, Mus musculus
tatatagtatatgtatatatatatatatatatatctttgtatgtatatatgtatatatatataatttgtg

SEQ ID NO: 79888 - DNA, 85 bp, Mus musculus
ggacagccaggctatatagagaaagagagaaagcctgtcttgaacaaagaaggatctgtatgtctgtctttctgtctgtctgtct

SEQ ID NO: 79889 - DNA, 122 bp, Mus musculus
tgagatggcaatggtcagagacagaggtggagtcagttgcaggcccacaaattaaaagtttttcattttaggtttgaaaaaactttcatctcctgctttagtataaaccatatcacaagcta

SEQ ID NO: 79890 - DNA, 85 bp, Mus musculus
gtatggattctttcctgtctttgaagggacttggaactatgtaaagttttaccacagggttacatttcacagggatcttctgtac

SEQ ID NO: 79891 - DNA, 71 bp, Mus musculus
gcttttgcatcgatctgtgtctcagtgtctcactcgggggcatctcgaagtatcactagtggatcgagggt

SEQ ID NO: 79892 - DNA, 74 bp, Mus musculus
gtatgtatatgtatgagtcgctcggtcagtctctaggaatttacagtggatatagtgactcatgtttataatgc

SEQ ID NO: 79893 - DNA, 68 bp, Mus musculus
ggggtgctctactttatcacctgctcaaacatctgggaatgtcttgagactcaaagtgttggtacccc

SEQ ID NO: 79894 - DNA, 65 bp, Mus musculus
actcgggtcctctgggagatgagtgtgtgctctcgactgccacaccctctctatggcccatgggt

SEQ ID NO: 79895 - DNA, 73 bp, Mus musculus
ttgtttataagcttatctctttgtcccgttgctataaaagtgttctcaggattgaagtgagcttgctgaacaa

SEQ ID NO: 79896 - DNA, 89 bp, Mus musculus
tatgtatatatgtatgtatgctgtactatgtatgtgtgtgtgtatgtatgtgcatgtgaatgtatgtatgtatgtatgtatgtgtgtgc

SEQ ID NO: 79897 - DNA, 98 bp, Mus musculus
atgtcttggcacgtgtgtgcatgtgtgtgtgcttgtgcatgtgtgtacatgtgtgtgtatgtataagtatgtgtatatgtgtctatatgtgtatatat

SEQ ID NO: 79898 - DNA, 102 bp, Mus musculus
gcttatttgtaaaggatttcactgctcctttaatatctctctttcagtgactgagaagcactggattcagatcaagcagatgcaattatccttaacagcagc

SEQ ID NO: 79899 - DNA, 74 bp, Mus musculus
gtctgtctgtctgtctgtactcacatgcacccctgcatacacacacgtgctgtaatctgcaggcagataaagat

SEQ ID NO: 79900 - DNA, 139 bp, Mus musculus
tgcatatatacacatacatatatgtgtgtatatgtgtttatgtatatacgcatatatatgtatatatgtgtatatgtatatatgtacacacacacatatatatacatgtatatgtatatatacgtatatatatacacac

SEQ ID NO: 79901 - DNA, 70 bp, Mus musculus
tatgtgcatgtatatatgtatatatgtgtgtgcctatgtgtatacatgtgtgcatatgtgtatgtgtgtg

SEQ ID NO: 79902 - DNA, 78 bp, Mus musculus
gagtgctagagctctctaagtctgttatctcagtctgtttttcagacagcacacacagacgtaaagaagctgtagatc

SEQ ID NO: 79903 - DNA, 58 bp, Mus musculus
ctgtctctctctctgtgtgtgtgtgtagggagggagagagagagagagagagagagag

SEQ ID NO: 79904 - DNA, 79 bp, Mus musculus
gctggtcagagtgcagagagtctgtccacagagtgctcagctacaaatgggacacttgtactgcacccttatgcaccgc

SEQ ID NO: 79905 - DNA, 135 bp, Mus musculus
tgtgtaggaaaacacacaagcatgtatatatgcgcacagcacacatatatgaattaatgtatatgtatgtatgtatgtatgtatgtatgcatgcatgtgtgtgtgtgtatgcatgtgtgtgtgtgtgtatgcatg

SEQ ID NO: 79906 - DNA, 85 bp, Mus musculus; identical to SEQ ID NO: 57439

SEQ ID NO: 79907 - DNA, 116 bp, Mus musculus
gatctggttatagtctagcttagcgcagactcccattcttgtctcctgtgtctcagacactgagatcgcagtgtgcaccagcatggccatctgaatgagaacggcacccacaggtt

SEQ ID NO: 79908 - DNA, 93 bp, Mus musculus
gtctgtgtgtattctgtttctgcttcttatcctctcatacaatttttttctttgattcctaggatgggacaagtacaaagcacctcactgggc

SEQ ID NO: 79909 - DNA, 109 bp, Mus musculus
tacatagttgagaatatatatgtgtatatatgtgtgtgcatatatatgtatatatgtgtatatatgtatatgcgtatgtatatatacatatattgaacttagatattta

SEQ ID NO: 79910 - DNA, 81 bp, Mus musculus
cagctctaaggggcttgtcgctttggagggaaatggtggcctatatctgtctctgtccctcaaacactgtccctggagttg

SEQ ID NO: 79911 - DNA, 83 bp, Mus musculus
acattaagttctgagtctctctgagacttgatttagaaaggtgagaacttactaaagtcaaggtcatgggctagatttattgt

SEQ ID NO: 79912 - DNA, 79 bp, Mus musculus
ggaagaaactgactctctcacaaagacaaatgatgcctggggactagttaggtttgagtgatgagggaaagcaattgcc

SEQ ID NO: 79913 - DNA, 119 bp, Mus musculus
tataatcttatcatttacacagaacatctgcaattcttttcagagttgactatcattttgatttttaatgatcatcagtgatgaaaatgattgtgtgtatgtgtgtgtgtgtgtgtgtg

SEQ ID NO: 79914 - DNA, 73 bp, Mus musculus
tgccttcctcagaatctctcactgtgttgggtgattcaactccagctctcagtgagatctagaattcagtgca

SEQ ID NO: 79915 - DNA, 67 bp, Mus musculus
cagcccacggtcacagtctctgactgctctctagccagtctgttttggttctgtgaatgtggggctg

SEQ ID NO: 79916 - DNA, 85 bp, Mus musculus; identical to SEQ ID NO: 57439

SEQ ID NO: 79917 - DNA, 105 bp, Mus musculus
tacatgcatgtgtgtatgagtctacttgagtatgtttatgggtgcatatatgaatgtatgtatgaatgtgtgatgaatgtgaatacatgcaagtatgtgtatgtg

SEQ ID NO: 79918 - DNA, 90 bp, Mus musculus
ggcacatatgatgacatggactaagaatctagttctaatttgcctataaatttctctctgtttctctcagtctctgtctgtctgtctgcc

SEQ ID NO: 79919 - DNA, 62 bp, Mus musculus
acacacacacacacacacatgtgcgcacttttgaatgtatacatgtatgtatgtgtgtgtgt

SEQ ID NO: 79920 - DNA, 77 bp, Mus musculus
tctggtctcactactcagactctctctttcaggatgagtccacggtgagtggatggccagatggaggtgatagggtc

SEQ ID NO: 79921 - DNA, 83 bp, Mus musculus
cagtccatggccttagaatcctgaagtacctgggatgagtcctttgagctccctcacccagctttgatctgcacagccagctg

SEQ ID NO: 79922 - DNA, 85 bp, Mus musculus; identical to SEQ ID NO: 57470

SEQ ID NO: 79923 - DNA, 65 bp, Mus musculus
cctgtgtgtgtctctttctgtgcgtctgtgtgagggggggggagcaaggaagggaaggagggagg

SEQ ID NO: 79924 - DNA, 56 bp, Mus musculus
tatgtatgtatgtatgtgtgtatgtatgtatgcatgcatatatgcatgcatgcatg

SEQ ID NO: 79925 - DNA, 86 bp, Mus musculus
cctgtgtcagcttctggaagtggtgctcaagacaggacagccatctgtctctgtcagtgtgccccctctgaagagctgtgcctggg

SEQ ID NO: 79926 - DNA, 85 bp, Mus musculus
catacgtatgtctgtacatgtgtatatatgtatatatatacatatatatgtgtgtgtgtatgtatatatgtgagacatgtgtgtg

SEQ ID NO: 79927 - DNA, 98 bp, Mus musculus
ctgtccatttcccaaaagaggcaaaccagagagctccacagggctcccagcagcctgttggtgagagaaatctcagtggtggttgaggaatagagcag

SEQ ID NO: 79928 - DNA, 79 bp, Mus musculus
ctggccatgtgtgtgtgctcatgtgtgtgtgtgtttatatacatgcatgcatgaacatgtctttgcctgtgaatgtcag

SEQ ID NO: 79929 - DNA, 117 bp, Mus musculus
tggcaagtctctgggtttgtttgtttggttttttttttggtttgtttgtttgtttttggttttgttttttaattaatgattgacgtgagaagattcagaccactgtgggtggtgcca

SEQ ID NO: 79930 - DNA, 76 bp, Mus musculus
cccaagtctttgaggggtgtgagtggtatcctggtgagagcacagctctgccactcagtttctctcagcacttggg

SEQ ID NO: 79931 - DNA, 72 bp, Mus musculus
atatatatgtgtgtgtgtgtgtctatatgtatatatatatatatatatatacacacatatacacatatgtat

SEQ ID NO: 79932 - DNA, 111 bp, Mus musculus
gatcatatctccgagtgcttcgtgttctgcccaagcagagatccctgcagacacatctgactgtagactttgtgttcataaacatggtatacacactcagttatacaaatc

SEQ ID NO: 79933 - DNA, 67 bp, Mus musculus
tatttactgtgtgtgcacacccacacacatgcatgcatgtgtgtatatgtgcatgtgtatgtgcatg

SEQ ID NO: 79934 - DNA, 101 bp, Mus musculus
ttgtttcttattttctaatgacctctggcccagaagagagtctccactcaagttgtggggtggaacatattgataaggagaggagttggaattgggaatag

SEQ ID NO: 79935 - DNA, 93 bp, Mus musculus
cagaaatcctagatcatataggttgaaaaggaaagcctagaattagcattggtgtgtttccttttctaattataggtgtgatatggccacctg

SEQ ID NO: 79936 - DNA, 65 bp, Mus musculus
ccagttctctctgaatatcctgtctgtgaggagacacagagcaaggaacagatcagaggctctgg

SEQ ID NO: 79937 - DNA, 125 bp, Mus musculus
tggagctgtatagttgccagattagcaagactaattctgtagtcatggaaagtaatgttgtatgaagaccagggctccagggctgcaccccacgtaaatgcagcaaggagcctagcttctaagac

SEQ ID NO: 79938 - DNA, 100 bp, Mus musculus
ctgtggaaagatatggatctagactaggtatcacaccctctgacttactgacagaggcggtggctctgattgttgaacaggaccagcacttgctccacag

SEQ ID NO: 79939 - DNA, 116 bp, Mus musculus
tcaaagagaactgaagactttctgccataaaaaagtgtctgtctgtctgtctatctgccttacaaggcttgatcttgacttttttttttaagaactgagagtttctaagtgtttga

SEQ ID NO: 79940 - DNA, 80 bp, Mus musculus
tatctggaacgctcatacaacacacacaggtcagaagatggcatcagatccccttgtagatggttgtgagtcaccaggtg

SEQ ID NO: 79941 - DNA, 137 bp, Mus musculus
atgggagtcagaaagtcttgttccatgtaagtaatggctaaatggtttactagctatctctagcaggttttcaattctgtctaggacactcatagtttttgtgttggtggtctgctaaaagtctgatacagaggtag

SEQ ID NO: 79942 - DNA, 86 bp, Mus musculus
gtgtgtgtgtatctatgcatgtctgtgcatatgtacaaatctgagtgtctgtgtgtgtgtctaggtctgtgtatgtgcatgtgtgt

SEQ ID NO: 79943 - DNA, 107 bp, Mus musculus
tcctgcaaggaagcataaactctcgttccatgtcttattcatgaatatattcatatttgtattcatatattcacaagtgcataaatgggggggtgaagaggcagaga

SEQ ID NO: 79944 - DNA, 84 bp, Mus musculus
tggaggtacataccattctaccatagtgctagccatctcctctttctgtggctcactgtctgaggctatgtggagtatccacca

SEQ ID NO: 79945 - DNA, 96 bp, Mus musculus
aagagaattttattttctggtccagtctagttggtattctataagcttcttgtatgtttataagcattgctttctttaggttgggaaagttttctt

SEQ ID NO: 79946 - DNA, 96 bp, Mus musculus
gatcagctttagtccatggtgatctgataggatgcatgggataatttcaatatttttgtatctgttgaggcctgttttgtgaccaattatatggtc

SEQ ID NO: 79947 - DNA, 85 bp, Mus musculus; identical to SEQ ID NO: 63901

SEQ ID NO: 79948 - DNA, 85 bp, Mus musculus; identical to SEQ ID NO: 57470

SEQ ID NO: 79949 - DNA, 76 bp, Mus musculus
ggctgactagtgtctctactgtgtagtttgagaggtctcttctcttggattccagatgatcacacacttctgagtc

SEQ ID NO: 79950 - DNA, 67 bp, Mus musculus
agagaaactcgatttggagcattttgggttcagtcatctgacctaaagtaaagaagtaagtttttct

SEQ ID NO: 79951 - DNA, 68 bp, Mus musculus
tggggatagaagacttaagtcattttgtaaatgtcttgctttgcacaaggacatgagtttgatcttca

SEQ ID NO: 79952 - DNA, 97 bp, Mus musculus
aagctgcagcctcagtatttggcattttgtattaagctcatatttagtttttgtttaaacttacagtagggtacacaacttccgaatatctcagctt

SEQ ID NO: 79953 - DNA, 120 bp, Mus musculus
ttcgctctgtccagaagctgggaagtttgctatggagtctcctgctcagggacagctgaatctctgcaacaggatctggagctgtcaagggttcatcaagactctgctgtgggaagaagc

SEQ ID NO: 79954 - DNA, 116 bp, Mus musculus
ctgaagatcagccttagtccatggtgatctgataggatgcatggggttatttcaatatttttgtatcagttgaggcctgttctgtggacgattacatggtcagttttggagaaggt

SEQ ID NO: 79955 - DNA, 121 bp, Mus musculus
aactggataatggtattatacttgaactgacatcttctggtcatctctctgtctcccacttagtgttgaggctagaccatgttactgtaaagatgtacttgttcctaagtttatctaggtc

SEQ ID NO: 79956 - DNA, 88 bp, Mus musculus
gggcacacagcactggcgagcctcacactctgagtttctgctccctctgggttagagtgtaagtctctggcaggttgctggatggccc

SEQ ID NO: 79957 - DNA, 101 bp, Mus musculus
cactttcaatctatattatctatgtatccatctatgtatatatgtatgtatatgtatatatgtatgtatgcatctatccatccatccaatgtatatgagtg

SEQ ID NO: 79958 - DNA, 69 bp, Mus musculus
gtaagaggtagcgtatgtatgtatgtatgtatgtatgtatgcatgcatgtatgtccgtaccatgcttgc

SEQ ID NO: 79959 - DNA, 75 bp, Mus musculus
ggagtctcactgtcgctgagtgactactgtgctggtgacctacagttccattgctgcagctgacctgtgcgctgc

SEQ ID NO: 79960 - DNA, 91 bp, Mus musculus
gagtgagagagactgagagactgagagagagtgagagagcaccagagacctgaaatgcagcatgatgtcttccctgggtctctagtcagtt

SEQ ID NO: 79961 - DNA, 70 bp, Mus musculus
ggagcttgtctgtctgtctgtctctctgtagcttcctgtgaggcacagaggtgggcagggagatggctcc

SEQ ID NO: 79962 - DNA, 79 bp, Mus musculus
tcatgacgaacaggaggaacgggtgtggggagacacctgggacgtgtctgtccctctgtctgtccctcctgctttctga

SEQ ID NO: 79963 - DNA, 100 bp, Mus musculus
tttgaaaaactggggtgctggccagagccagacatgggggcctctcggtcagtctgtttgatttggattctgatccagtccccaagtgccttccttcaga

SEQ ID NO: 79964 - DNA, 85 bp, Mus musculus; identical to SEQ ID NO: 57439

SEQ ID NO: 79965 - DNA, 68 bp, Mus musculus
ggggggttggtgcatatcaaaagagagaaggaggctgcgtctctgtctctcatgctcgctgagtcttt

SEQ ID NO: 79966 - DNA, 74 bp, Mus musculus
tcacatccttcatgccacaccctcagagtctctgtgtggtggagagttgtcttgctgagggggaggggatgaga

SEQ ID NO: 79967 - DNA, 72 bp, Mus musculus
ctagccctattctctgtgtttctcagtcattggctgactagcttctttactgacaaatcaggggataattag

SEQ ID NO: 79968 - DNA, 80 bp, Mus musculus
gaatcatcagagaaaaatgtctccataagaccaggctgtaggcaggcaagtctgtagagcattttcttaattagtgattt

SEQ ID NO: 79969 - DNA, 90 bp, Mus musculus
tatacttcagtagggcatcaaaggtcaactttcctgttacagcaaatcaggttgtaggggtgtgtctgtctgtctgtctgcctgtgtgta

SEQ ID NO: 79970 - DNA, 88 bp, Mus musculus
gcctttttcttttatttatttatttatttatttatttatttatttatttatttattttgaacctgagtgagggatgggagggagaggc

SEQ ID NO: 79971 - DNA, 114 bp, Mus musculus
tggggctaccaccttcaaagcctagctgcctaatcaggagaaaactgacttcatcttgaaagcaggaagtagtacagctccatgatcaagcacagaatgaaggaggtctcctca

SEQ ID NO: 79972 - DNA, 68 bp, Mus musculus
aggacattcagaggggtagagagatagtttagcagtttaagagcactgactgctcttccagaagtcct

SEQ ID NO: 79973 - DNA, 108 bp, Mus musculus
ctgcagaagatatgtctgctatgtgatactaagcctggtgtttgagtcagagaagaaagagaccagctactagttttagaaaatgcctagctagacagaataaagtag

SEQ ID NO: 79974 - DNA, 115 bp, Mus musculus
gtcagcattgtgagagactcacaggaaaaggcatagcttatgtgttttctcttccatcagaggagacagtcaggagagcccatcccttcaccctacattatcacacactgttgtc

SEQ ID NO: 79975 - DNA, 112 bp, Mus musculus
aggaaataaaagtaatgagatagagtaaacggggtgaaagggtgagagaacctactaggttctatagattggtttttaaaagtagctttactatcatgctggtatttggcct

SEQ ID NO: 79976 - DNA, 111 bp, Mus musculus
gcatgtgtgcatatatgtgtacatgtacctatgcattatatatatatgcatatatatgtatatgcatatatacacatatacatatatacacgtgcatatatatgtatatgt

SEQ ID NO: 79977 - DNA, 95 bp, Mus musculus
gcacgtgtatatatgtatatgtgtatatatgcatatacatatatatgcatatatatataatgcataggtacatgtacacatatatgcacacatgc

SEQ ID NO: 79978 - DNA, 112 bp, Mus musculus
gatcaatttgggagtcaatacatatcttagaatgatcatgttggctgaaagaagacagacacaacaggtttatattatttaaagccatgtactttaagcccaacgttaggtc

SEQ ID NO: 79979 - DNA, 78 bp, Mus musculus
catgggccacgtcacactcactcacaggccctcgtgttaagagccctaactgtgtggtgctgggggactggttctgtg

SEQ ID NO: 79980 - DNA, 76 bp, Mus musculus
cacatcacccaagcacatgttcctgaacagagagagcctctgtcttgaactttagtcttgtgcatttcatgttgtg

SEQ ID NO: 79981 - DNA, 82 bp, Mus musculus
gagatacatgtgcaattctttgcaagagtgaggatgcctggagacagccaattgccaaaaaaagaagaggcatttgtgttcc

SEQ ID NO: 79982 - DNA, 111 bp, Mus musculus
ccagtgtggccaagttgaatgaccctcctctctctgcgtttggttgtaacttgttttcttaatttgtgtatcacgtagggaaaggtgggtgagcctagcttcttaggctgg

SEQ ID NO: 79983 - DNA, 75 bp, Mus musculus
gatgtcactgggtgcttgtgttctgttctctgctcatcaggagagcagagccacaagagactgagcacagcatct

SEQ ID NO: 79984 - DNA, 74 bp, Mus musculus
tttgcaaatcacagaagttgtgtatatggaagtgctgggctaatgctaacacttttgtatttgttgtttgcaaa

SEQ ID NO: 79985 - DNA, 112 bp, Mus musculus
cacttccattttcatgacatcatatatatatgtgtgtgtagacatatatgtatatatcaatgtgtatatatacatacatatatgtatatatgaatttatatatgagactgtg

SEQ ID NO: 79986 - DNA, 59 bp, Mus musculus
tgcaggttacaacaggaaaaggcctgtcagtaagggtctgtctgtctgtgaatcttgca

SEQ ID NO: 79987 - DNA, 86 bp, Mus musculus
ctgcagaagacagtgagcagattctggagctctctggatctcagaaatgaggactaagctggagatatgaatattgctctatgtag

SEQ ID NO: 79988 - DNA, 64 bp, Mus musculus
tctgaccacggatacagctgagagtcagcagagagtaaataccagcgtatccctgagtggcagg

SEQ ID NO: 79989 - DNA, 116 bp, Mus musculus
ataaatgttttggtgtctgtggcagttgtcacccagagcatatactttgtatactttgaaacagagtttcttattgtgtgttaactgggtataaattgcaaaccaatctatgctat

SEQ ID NO: 79990 - DNA, 81 bp, Mus musculus
acctgagcatctctctgtcactctgtggatccctgccttcagtcagaccaagatgcgcaaagtacacagagaatctcatgt

SEQ ID NO: 79991 - DNA, 80 bp, Mus musculus
attgcctgcctgtctgcctgcctgtctgtctgagaaccctcattttcattttaaggagttgggctttcatcctaggcagt

SEQ ID NO: 79992 - DNA, 113 bp, Mus musculus
gtatctctgtgtttgaaacatgtgatattccagcattgtgctgtgtgtatctgtgtgtgtagatcataagggctggctttaaataaatgtaacaaaattgacctcagtggatg

SEQ ID NO: 79993 - DNA, 95 bp, Mus musculus
tacatatcccaaaaaaatatgtgaatatgtgtatgtgcatgtagtatacatttatgaatatatgcattattatatagttacaacatatatgtgta

SEQ ID NO: 79994 - DNA, 110 bp, Mus musculus
cccagtgcttgtagtaaaccttcaaatgcatcaaacattctccaaacggtattctcctgtctccacagaggatggagaaggtaagatgatcttaagctgcgttattaggg

SEQ ID NO: 79995 - DNA, 75 bp, Mus musculus
cctctgtcagtacactgtgcacagacagcctttggtttgatagccaggttttctgggagaaagtatcacagcagg

SEQ ID NO: 79996 - DNA, 69 bp, Mus musculus
acatgtgcatgcacttaccagcaaacaaactggactcagtagagtgtgtgtgtgtgtgtgtgtgtgtgt

SEQ ID NO: 79997 - DNA, 102 bp, Mus musculus
gagactgctaagctccggctagagagactgctcaactgttaagagcactgactgctcttccagcggtcctgagttcaatccccagcacccacatggtatctc

SEQ ID NO: 79998 - DNA, 115 bp, Mus musculus
tatctcctgctttctgggagtccctctgggatagctctggagacagagatgtctagctccaggactgaggcatctcctgttttctgggagtccttctgggtgagccctggagata

SEQ ID NO: 79999 - DNA, 89 bp, Mus musculus
agacacagacagacagacagactgactgactgactgactgactgacaagcacagatacacatagtcagtctactcttgctgctggcgct

SEQ ID NO: 80000 - DNA, 59 bp, Mus musculus
tcttcgcctggcaggcagattggctgccaagtctccccactctgtctgcctgacacaga

SEQ ID NO: 80001 - DNA, 116 bp, Mus musculus
gtgtatgtgtgtgatagttggcagtgaccatagtgtactagaggaaatcagaggataacttgtgagatagttctcttcttctactatgttggtcttgagaattgaactcagatcat

SEQ ID NO: 80002 - DNA, 83 bp, Mus musculus
tatatatgtgtgtatgtgtgtgtgtacatatatgtatatatgtgtgtatgtatgtatatgtatgtgtgtgttactacatcata

SEQ ID NO: 80003 - DNA, 93 bp, Mus musculus
gttgggtttgtagtcaaatcaagggctggagagatggctcagtggttcagagcgctgactgctcttccagaggtcctgcgttcaattcccagc

SEQ ID NO: 80004 - DNA, 111 bp, Mus musculus
cagaaaatgtttggctgtaaacttggcgtcagaattaaggatgacttttatcttcttcagagaagtaagtcaacaaagagaatttgaggaaagcggttgagcggagacttg

SEQ ID NO: 80005 - DNA, 102 bp, Mus musculus
tatgtgtgtgtgtgtgcatgtgtgtatgcattgtatgtatgtatgtatgtatgtatgtatgtatccatatatggatatatatatatatatatataatatgca

SEQ ID NO: 80006 - DNA, 114 bp, Mus musculus
tgtgtgtattcaaataatatcttggtgttggagagatggctcagcggttaagagcactgactgctcttccagaggtcctgagtttagttcccagcaaccacatggtggctcata

SEQ ID NO: 80007 - DNA, 74 bp, Mus musculus
gtggacagaagggtagttcatctgagagtgacacccagagggtatcagagtagagagacagctctaacacccac

SEQ ID NO: 80008 - DNA, 70 bp, Mus musculus
actgtttcagatagcatgtacaaatgtatatgaatatacatatatatgtatatatgctatatgtagctgt

SEQ ID NO: 80009 - DNA, 64 bp, Mus musculus
gcaggtacctactctcactgcaacttgatatcccatggctggttgacatgcatgggaggcctgc

SEQ ID NO: 80010 - DNA, 71 bp, Mus musculus
agaggagaggggactgtggtttgctggtggagtggtcacatcagagcttctgctgcagtctctttgcttct

SEQ ID NO: 80011 - DNA, 82 bp, Mus musculus
ttgcatcttgtgtctgtctctgtatctcatccatgggcacattcttcatgctgtggtggggtgtcggggacaacagggtcaa

SEQ ID NO: 80012 - DNA, 91 bp, Mus musculus
gatttgccaagtctatccagataagtatccactcaactgaatgaataaggaagaggttgacctgtgatattcttgatgactataggccttc

SEQ ID NO: 80013 - DNA, 98 bp, Mus musculus
tgtgtatgtatatatgtcagaggaaagtcatagggcgtatgggattcgttcagggccctgctccctcctgtttcactgccctcccatgttaagtacca

SEQ ID NO: 80014 - DNA, 63 bp, Mus musculus
ggagacagaagggccaggcagtctaagtcacttgcacaaaggacagacacactgaccctctcc

SEQ ID NO: 80015 - DNA, 64 bp, Mus musculus
gtctctctctctttgtgactctcttgggcagtaacctgaggggacatcatagaagcagctgggc

SEQ ID NO: 80016 - DNA, 86 bp, Mus musculus
ccacaatactaacttcattttctactgttttcttttttttaaaaaagaagaagagtagtttgatggggtaagctaaatattacggg

SEQ ID NO: 80017 - DNA, 99 bp, Mus musculus
ctgggtttggttcctggcagggagtgaacagacaagctgagtttttgtgacttggcctcatgtgtgcttgctttccactatgaggaaaccacaacctag

SEQ ID NO: 80018 - DNA, 93 bp, Mus musculus
tcctgggactggtccttagagattcagctaggcagtctggtgagtgagtcccaaggctcactgctgtctctgtctctccggtgctgaggatta

SEQ ID NO: 80019 - DNA, 112 bp, Mus musculus
gagtggggtcacttcctcgagctattgtgggcgccctacctgggatgaatagaagtttgttcctgtctccccaggagaagttacagagcagcacacaaggagttaccaactc

SEQ ID NO: 80020 - DNA, 82 bp, Mus musculus
tgtaatctgtatgtatgtatgtatgtacgtatatgtgtgtgtgtgtgtgtgtgtgtatatatatatatgcatgcatgctaca

SEQ ID NO: 80021 - DNA, 85 bp, Mus musculus
cagcattgcccttcctgtttctgtctgtgtcactgttgtgtttggtgcactgggaactctggagaagcaggagggtttgagactg

SEQ ID NO: 80022 - DNA, 89 bp, Mus musculus
gcaagaatacagactaccagaggctctctctcactcagtgctggcaggagtgctgaatggtttggtaactttggaaggcagtttcatgc

SEQ ID NO: 80023 - DNA, 101 bp, Mus musculus
ctgctcaatataatttatatatagcatataaagcatggataatgtactttatatataatatatagcatatatgatatactttgtagcaagatataaagcag

SEQ ID NO: 80024 - DNA, 114 bp, Mus musculus
ctcaaacaattactgtttcagctctggcttctgctccttaccagactctgtctctgtgtgcaacacaatggggtcattttcaaaagaggaagtgtgaatggacagtaatttggg

SEQ ID NO: 80025 - DNA, 57 bp, Mus musculus
ggacaacagtggagtaggaaggtcagctgggtgtcttctctgcctctctgagtgttc

SEQ ID NO: 80026 - DNA, 76 bp, Mus musculus
ggtgattaatcttgccatttccccagccccactttctgaggaaagttgtctggatctggaattgagatttcttccc

SEQ ID NO: 80027 - DNA, 115 bp, Mus musculus
tggtgcgacttctgcgtggtttcttctgcctgggcgtgggctgttctgtctctgactcgctgctggctaacgcctcaccaccaggggtctcagcagcagcagccgccgcctccgc

SEQ ID NO: 80028 - DNA, 108 bp, Mus musculus
tggatcaacacttaggaacttgctttgctgggtcacacagtgtctgtatatttaactttatgagaaactgccagtcttattccaaagaagacaggtgtaagaattcca

SEQ ID NO: 80029 - DNA, 67 bp, Mus musculus
ggaacagaggcagctgactgtggccgtccaacttgctgtggaatggatgtctctgtctctctgtgcc

SEQ ID NO: 80030 - DNA, 91 bp, Mus musculus
gtgactagaccctactttgatgagagaaaagaaaggaaactccttgagaagttcttgtatttttctaattcagttctggagttcctagcac

SEQ ID NO: 80031 - DNA, 88 bp, Mus musculus
ccttctcctgggctgagaagtagcagctctctaacagtctgtcagtacctatgtgagaactgctcagtccagcccataggatggaagg

SEQ ID NO: 80032 - DNA, 87 bp, Mus musculus
ggccactaagagaagattgtctccaggcagctaagaggatggtctcaaagcccacctccacagtgacagacttcctccaacaaggcc

SEQ ID NO: 80033 - DNA, 99 bp, Mus musculus
tagaacacagctgtcagtgccatcttataatggcaaatgtgagggcggctcctcacaggcatattttattatttttgatgcacatagtccttttttcta

SEQ ID NO: 80034 - DNA, 72 bp, Mus musculus
tgatactatggggctggagagatggctcagcagttaagaacgctgactgctcttccagaggtcctgagttca

SEQ ID NO: 80035 - DNA, 95 bp, Mus musculus
tctgtctgtctgtctgcctgtctgcctgcctgcctctgagtatgtgcatatgaatgtaagtacctgcagaagccagaggcattggatcatctgga

SEQ ID NO: 80036 - DNA, 85 bp, Mus musculus; identical to SEQ ID NO: 57439

SEQ ID NO: 80037 - DNA, 78 bp, Mus musculus
acagcacttgtcattatgttgttggggcaaacactttgtaaagtctcttgctgtggatgaccttgagtgagttgctgt

SEQ ID NO: 80038 - DNA, 86 bp, Mus musculus
ggcccctaaccaggtcacctcagttcacagtcactgagtgcaccacttgtgaaggaaggtgagcagtaggtcctgaggccaagggt

SEQ ID NO: 80039 - DNA, 99 bp, Mus musculus
ctgtggtagatagaggagagaagccactgcaagaaggcggtgggctgagagtccacacagaggtcttcagtaagtatccaggtcccctccctaacccag

SEQ ID NO: 80040 - DNA, 125 bp, Mus musculus
tctcggggcagaagagttagcaatgaagttatattttaacagaagagaaaacactgaacaatgtctgctgacatggggttagaccattcctttgaaatataggaccttgagcttcgagatggctc

SEQ ID NO: 80041 - DNA, 105 bp, Mus musculus
ctagcatgcctggctctttcttgactaaaccatccccccttcttcccagacactatctctcttacttagtccttgaaggggccacccaaagcatgcgtatgctag

SEQ ID NO: 80042 - DNA, 79 bp, Mus musculus
acatagcaatacattcaaactttcccagaagtgttcagcctgggctctttagtctgtgtgtctgtgtgtgatgctgtgt

SEQ ID NO: 80043 - DNA, 118 bp, Mus musculus
atgcatatgcatatatgtgtatgtttatatataagccagaatatgtatatatgtatgtgaatatatgtatatgtgtctacgtgtatatgtgtatatatgtatatatacatgtctacgt

SEQ ID NO: 80044 - DNA, 80 bp, Mus musculus
cagagagacagacagatagaaagacagagtgagagattcctgagtccaatttcttttctttttcttttgttttttttctg

SEQ ID NO: 80045 - DNA, 81 bp, Mus musculus
cactgttacactatatgttctgacaaagtgatccagacatgacagtcaccacactttgtcccactgtataaggtgagggtg

SEQ ID NO: 80046 - DNA, 78 bp, Mus musculus
gaacattttgccaagtgactgccagtgttgtccctgtgttgtgacaggtcgtgcctcagttctcagtctgtgatgttc

SEQ ID NO: 80047 - DNA, 77 bp, Mus musculus
ccccgactcactctcactgtgcagaagtttgaatttcagcctggctattttcatttgcacttgtctggtgcttgggg

SEQ ID NO: 80048 - DNA, 65 bp, Mus musculus
tgtctgttcacagtgaccacatgccctggagactgcaggctcccatgtggtcacaagaacataca

SEQ ID NO: 80049 - DNA, 89 bp, Mus musculus
ctcaaaggagaagaagtgcccagtcttactgcaacttgatgtgccaaagctgattgatgtctgtgagaggcctttccttctctgaagag

SEQ ID NO: 80050 - DNA, 85 bp, Mus musculus; identical to SEQ ID NO: 57470

SEQ ID NO: 80051 - DNA, 63 bp, Mus musculus
gtctgtctgtcggtctctctttctctgtataaatggggagtgagtgtgcttgtgcaggcacac

SEQ ID NO: 80052 - DNA, 90 bp, Mus musculus
gtatatgtgtgcatttgtgtgtgtagaatgtatgtgcagtgtttatatgtgggtatgtgcatatatatacatatatatgtatatatatgc

SEQ ID NO: 80053 - DNA, 64 bp, Mus musculus
gctgagcctgggagggtgtggtggggatatagttttcaatctgaatttcactctctcagtcagt

SEQ ID NO: 80054 - DNA, 90 bp, Mus musculus
gcttggtgtttcctcaaactatcatgctttaaataataactgatattgtatatgttagtatatctgcatgactgtttgtatatagttagc

SEQ ID NO: 80055 - DNA, 74 bp, Mus musculus
gtagcaggtgtgcagtttggttttcatgagggtcccctaacaattggaacaggggctgtctctcactcagttac

SEQ ID NO: 80056 - DNA, 78 bp, Mus musculus
cagtgccaggaggtgggacaaggttgtttagtacatggaagcatatgtggtggagcatgttgctctgaatggagactg

SEQ ID NO: 80057 - DNA, 84 bp, Mus musculus
gatgttcgatttgaaaaattacattcagattccacacatcctctcctgtgtgtgtctgtttgtcaattcatccttcgctttgtc

SEQ ID NO: 80058 - DNA, 82 bp, Mus musculus
ctgaccgtgagcatccacttctctgtttgctaggccccggcatagtctcagaagaaagtgtggatactttgcccattcttag

SEQ ID NO: 80059 - DNA, 77 bp, Mus musculus
tctgtgaatttctttcttcttctgttcaaaagcatcaagtcaagaagacaagcagaagagtgaagacagtttgcaga

SEQ ID NO: 80060 - DNA, 84 bp, Mus musculus
acacacatatatatacatatatatgtgtatatatatatatacatatatattcatattcacatgtatctgtatcagtatgtgtgt

SEQ ID NO: 80061 - DNA, 88 bp, Mus musculus
cagacttctccaagagagaatacagagaggtcctatttccttaagatagtctgctgaattgtcctctttgtgtccttaaggtagtctg

SEQ ID NO: 80062 - DNA, 96 bp, Mus musculus
tgtatgcatgtatgtgtgtgtatgtatgtatatatatatatatatatatatatatatatatatatatatatatatatatatataaatgacacaaac

SEQ ID NO: 80063 - DNA, 85 bp, Mus musculus; identical to SEQ ID NO: 57439

SEQ ID NO: 80064 - DNA, 85 bp, Mus musculus; identical to SEQ ID NO: 57439

SEQ ID NO: 80065 - DNA, 74 bp, Mus musculus
gcaaatatgtatatgtatgtatatatgtgtatatatacatacatacacatatatacatacacatatatggaagc

SEQ ID NO: 80066 - DNA, 82 bp, Mus musculus
caggatgaccctgctgacatctagattgaatatataattgactcaattttttgttttactaggtgtcagtagaaactacttg

SEQ ID NO: 80067 - DNA, 77 bp, Mus musculus
cactctgtgactgtctctcttcctgtggggcctcaggactgtgctttgggatcgcttggaaggactttcccaggatg

SEQ ID NO: 80068 - DNA, 80 bp, Mus musculus
gtgtgtatatgcttgtgtgtgtgtgtatatatacatatatatatgtgtgtatgtatatatacatatatacatatgcaggc

SEQ ID NO: 80069 - DNA, 73 bp, Mus musculus
atgcattcacacagagagagaattgcatagtgactttctgtctatgcatttctctctgtgtgtctgagtgcgt

SEQ ID NO: 80070 - DNA, 75 bp, Mus musculus
actgaccttgagcagacagacagcagacagaaggcctttctttctcttctgcaatttgactgcttctggatctgt

SEQ ID NO: 80071 - DNA, 64 bp, Mus musculus
tgtgtgcacgtgtgtgtgtctgtgtgttagaaaatggaacgcattttagcaaatactgcacagg

SEQ ID NO: 80072 - DNA, 71 bp, Mus musculus
atgtatgtgtatatgtatgtgaatatatatgtgtataatgtatatgtatgtgtatgtatatacatatatat

SEQ ID NO: 80073 - DNA, 84 bp, Mus musculus
tgcctgcctgtctgcctgcctctcactgttccctggccacctgggtgtcagcagaggatctcaaaggaatgacaggttaggaca

SEQ ID NO: 80074 - DNA, 76 bp, Mus musculus
atgtatgtgtgtattatatatacaaacatgtatatattatatatgcatgtatgtatgtatgcatgcatatatatat

SEQ ID NO: 80075 - DNA, 76 bp, Mus musculus
cctcagacttcaagtcagctgtgtgaccctgacatgattactcaacctctctgggtctcagtttcttggcctgtgg

SEQ ID NO: 80076 - DNA, 112 bp, Mus musculus
gcagacagacaggcatacagacagacagacagacagagacagagacacagtgagagaaatttttaaaacactcttatctaaatgttcatgtgtgctaatgatgcaattctgc

SEQ ID NO: 80077 - DNA, 77 bp, Mus musculus
ggatagagtctgggatctgactgtctctgatactccctcttgacgagatctggggttagacccatacctccatatct

SEQ ID NO: 80078 - DNA, 98 bp, Mus musculus
atgaacactgaggacaatatgctgaatggaaggatgtggtcacaaagacacacactatctgactctacttatatagcaaggaagttttcagtagtcat

SEQ ID NO: 80079 - DNA, 77 bp, Mus musculus
gggagggccgagcacaatgcactctgctcaggaagctcgtcccaggagacagacaggacactgtgctctgcagtgac

SEQ ID NO: 80080 - DNA, 116 bp, Mus musculus
gcatctgccccactcttggaacatacctaatccaatttcatagagaaacccagaattatcactaatactgtctgctaattaatatggatttaggattccctttgtggtaggcctgc

SEQ ID NO: 80081 - DNA, 114 bp, Mus musculus
tggctttaatttagtgtgggcagttatgggaaggaacagacagtactcactcagtgcaggctccccaagagttgtagtgaggtgtctttataatggctatacttaatgattcta

SEQ ID NO: 80082 - DNA, 94 bp, Mus musculus
tctagctgtcctggaacttgctctgtagaccaggctggcctcaaactcataggagcctgcctgactctgcctctgtctcctgagtgctgctggg

SEQ ID NO: 80083 - DNA, 109 bp, Mus musculus
gaagtcatattaaaatttcaggctcatgatcttggatttcttattatcagttatagtttatatatatagtgcacatatgtctgagcatcatgtctgtgttgtgtgtttc

SEQ ID NO: 80084 - DNA, 81 bp, Mus musculus
tgtgggatctctcacactggaagagttgtgtatttatttcatttctgtgtaccaaatgcttagagtgaacaaggcctcaca

SEQ ID NO: 80085 - DNA, 61 bp, Mus musculus
tgaataccatgtgtgtgtgtgtatatatatatgtatatacatatatacacacatatattca

SEQ ID NO: 80086 - DNA, 113 bp, Mus musculus
cacttatatgtgtacgactgttgggttatccacagctactctgcatatgctgagtgtctgtctctctcagcaaccattgactgcaagtggcagattcctgagagatgatagtc

SEQ ID NO: 80087 - DNA, 206 bp, Mus musculus
atcccagcacggaggaggcagaggcaggtggatctctgtgagtttctcagaggtgtgatctctgtgagtttctctgaggtgtgatctctgtgagtttctcagaggtgtgatctctgtgagtttctcagaggtgtgatctctgtgagtttctcagaggtgtgatctctgtgagtttctcagaggtgtgatctctggtctacacagag

SEQ ID NO: 80088 - DNA, 116 bp, Mus musculus
gggaatatctaaacaataagtactgatccatgaaagggcacacaagtgtctttgaagaacattcacatgcactttctcctgtcatgagactagccagtgcttttatgtcagaacct

SEQ ID NO: 80089 - DNA, 111 bp, Mus musculus
tcttttctttattgttttacccaaacacatggactggctactgtttctcttgcttccaggagtactgattttgtacaagtctcattcaatgggtgagtgtaatggcaggga

SEQ ID NO: 80090 - DNA, 64 bp, Mus musculus
gtggttaacagaaagagtgcaggagcaaccagttgaacactagtgttcttattctgtctgccat

SEQ ID NO: 80091 - DNA, 85 bp, Mus musculus; identical to SEQ ID NO: 63114

SEQ ID NO: 80092 - DNA, 85 bp, Mus musculus; identical to SEQ ID NO: 57470

SEQ ID NO: 80093 - DNA, 64 bp, Mus musculus
ccagaacatctgtgaagtaggaaaggctgctttctctgcctctctgagacactacagtgtctgg

SEQ ID NO: 80094 - DNA, 95 bp, Mus musculus
gatcagccttagtccatggtgatctgataggatgcatgggataatttcaatatttttgtatctgctgagaactgtttgtgactgattatatggtc

SEQ ID NO: 80095 - DNA, 85 bp, Mus musculus; identical to SEQ ID NO: 60314

SEQ ID NO: 80096 - DNA, 79 bp, Mus musculus
gggtcaactctgggttgcaggtggaaacaagaaggatcttgtcccaggctgcccatcagaagttagacaccagagaacc

SEQ ID NO: 80097 - DNA, 85 bp, Mus musculus; identical to SEQ ID NO: 57439

SEQ ID NO: 80098 - DNA, 92 bp, Mus musculus
tgtatattgcttttatttgtttaggtaaggggctagaactcctgatctttttgatctattgttattgttcttcagataggatgcattttgca

SEQ ID NO: 80099 - DNA, 85 bp, Mus musculus; identical to SEQ ID NO: 57439

SEQ ID NO: 80100 - DNA, 85 bp, Mus musculus
tggcctggagaaaccacatgtactaagggtgctcataaactttggtagatggtagtatagtggtatatctgccaaatataggcac

SEQ ID NO: 80101 - DNA, 76 bp, Mus musculus
gttggaggaagtaggtaatcaggggcagttctttgggagctgtatctcctcttggtcactctctatttcactcagc

SEQ ID NO: 80102 - DNA, 83 bp, Mus musculus
catgggataatttcaatatttttgtatatgttgcggcctgttttgtgaccgactatatggtcaatattggagaaggtaccatg

SEQ ID NO: 80103 - DNA, 78 bp, Mus musculus
gtgtctgtctgtctgtctgtctgtctgtcgtgctatggtgcgtgcacctgtggaggtcagaagacaacttgcaggagc

SEQ ID NO: 80104 - DNA, 68 bp, Mus musculus
gtctgtgtgtgtatgtctgtgtgtattttacagggatgaacatagggtctcatgcatactaggcagac

SEQ ID NO: 80105 - DNA, 115 bp, Mus musculus
gctcctagtggttattcaacagttaatggaccccaactgaggcctagtgtgtgcctctctcaggcacaaagcttaagggtctgggcctaaattgttagaataaagtaaagggatc

SEQ ID NO: 80106 - DNA, 105 bp, Mus musculus
tggagtacaaaatctaatagacttgatagtgtgtgcactgtatgtctgtgtgtgtgtgtacagtgtgtgcactgacaactttgaaaatgtggaataagtgatcca

SEQ ID NO: 80107 - DNA, 70 bp, Mus musculus
ctgatagatctcagtcagataggcagaggtgggcatcttctttacatctgtctgtctgtctgtctgtgag

SEQ ID NO: 80108 - DNA, 74 bp, Mus musculus
tatatctgtgtatatcatatgaatgtatgcatgtatgcatgtatatatacatatagctatatatcacaagtatg

SEQ ID NO: 80109 - DNA, 97 bp, Mus musculus
tatgagtgtgtgtgcatgcatgtatatgtgtatatgtgtattgtgttatatgggcagatatatgtatatatatgcatgtgtgtattatgtatatatg

SEQ ID NO: 80110 - DNA, 101 bp, Mus musculus
ttttgttttttactatttgcttggaaaagtgttttccagactttcactctgaagtactgtctgtctttttctctgtggtaggtttcctgtaagcagcaaaa

SEQ ID NO: 80111 - DNA, 115 bp, Mus musculus
cttgagggctcagtactagatcctcagctgacctgcctgatagacatcagtcctgagagaagtcaaagtgcagttagccatttgtaatagggtctaacaccttactaggcacagg

SEQ ID NO: 80112 - DNA, 75 bp, Mus musculus
taggagataattgtggttatcacattggtgtccagagccactctggatgtctagtgataaataccaacattcctg

SEQ ID NO: 80113 - DNA, 80 bp, Mus musculus
gagtctggggcactctgagaaggaagacatggcgtctattttatgtttagacacatttcactctgtctcagtgccagacc

SEQ ID NO: 80114 - DNA, 89 bp, Mus musculus
ggtccataggtaaacagactgactgactcactctgggcttggcataggcttttatgtatgtatctgtctgtctgcctgcctgccctacc

SEQ ID NO: 80115 - DNA, 111 bp, Mus musculus
aggccaaaaacatgtaaattatcatatgatagctgtagtgtgtcacactgtgtcccacagtatacccttttgtccacaattgcaatgagtcattgatctggtttgaggcct

SEQ ID NO: 80116 - DNA, 88 bp, Mus musculus
cacatgcctggctctgtggctctcaggctctgaaggagatcccatgatccctttcttctatccttgactctaaagctagaaccatgtg

SEQ ID NO: 80117 - DNA, 87 bp, Mus musculus
aatatatgcatatcccatatatcacatagagatacatagatatatgtatatatgtatacatatatgtgtatatatgatgtgtgtatt

SEQ ID NO: 80118 - DNA, 79 bp, Mus musculus
gattagctctcggggttggagagatggtcagctgttaagagcactgactgctcttccagaggtcctgagttcaaatccc

SEQ ID NO: 80119 - DNA, 77 bp, Mus musculus
gaaagagcctgggagcaggggccgatgcagacccatgctggagggctgctgactggctctctccctgtggctttttc

SEQ ID NO: 80120 - DNA, 93 bp, Mus musculus
ccagcgaggacgccattctaaaacacaggtgagaagctaaaaaggagcccttagagaggtcacagagttcagagtgagtagagtctcagcagg

SEQ ID NO: 80121 - DNA, 96 bp, Mus musculus
ccaagacttagccttctgccatcctcacttctcactccgtcagcttcctggggcacactgaagggatctgaggaaccctggccttcctgagtttgg

SEQ ID NO: 80122 - DNA, 112 bp, Mus musculus
ctccatgcatgcatgcacacactcatactctcacacacagaaataaataataaacattagtttgtatatttattttatgtgtacgagtgtcttgtgtgcacatatgtctgag

SEQ ID NO: 80123 - DNA, 85 bp, Mus musculus
gcatgggacaatttcaatatttttgtatctgtggaggcctgctatgtgtccaataatatggtcaattttggagaaggtaccatgc

SEQ ID NO: 80124 - DNA, 80 bp, Mus musculus
ttccatcaacacttagggaagaatatatatgtatacacattttttatatatgtatgtgcattttttaactgaagggggga

SEQ ID NO: 80125 - DNA, 62 bp, Mus musculus
ctttggcacgctcagtggctcagtgggcacagtcacctccacagctagccctgggaccaagg

SEQ ID NO: 80126 - DNA, 115 bp, Mus musculus
cagtgaactagcagtgtctctgtttggtggaagactgtaccagccatgtcagaactgactgagctggctccttctttatacatacccttctccaaaagggaaacttgctttcctg

SEQ ID NO: 80127 - DNA, 107 bp, Mus musculus
gggagtcttggctagtgaaggagcagtgagggtaagtgctagactctagacagtgagcagtaagactaactacttcatgctgaaagttgatatgccccttagcctgc

SEQ ID NO: 80128 - DNA, 115 bp, Mus musculus
ctactttataatctaaatgtgtgtgattgatatatatatatatatatatatatatatatatatatatatatatatatatatatatatatatacacacacatacagagagagagag

SEQ ID NO: 80129 - DNA, 112 bp, Mus musculus
gatgcatgagtagacgtgtgtgtagatgtatatgatgcatatgatgtgtatttaattgtatatgatgagtggtgtgtgtatgtatatggcacatatggtgtgtattgtgtat

SEQ ID NO: 80130 - DNA, 71 bp, Mus musculus
gagggattggactctctgtctgtctgtctctgaaccttctgtgggagatggatagttaggatcttctcctc

SEQ ID NO: 80131 - DNA, 133 bp, Mus musculus
aaagctctgtagtacacctatgtttgccctgatgagctagttataatatgtgcttcgcataaaattttctatttatagtaaatcaagcaaggaacctattatacagagttttaagttttggtatgaggcatag

SEQ ID NO: 80132 - DNA, 82 bp, Mus musculus
ctttggggatatccatataatcatcggcctcatttagaatttataactagagtctgcacagatgagagtgtggaatacagag

SEQ ID NO: 80133 - DNA, 85 bp, Mus musculus; identical to SEQ ID NO: 57470

SEQ ID NO: 80134 - DNA, 84 bp, Mus musculus
ggggcaaagtgtcctgatttcttcaggatctgttgttatgtttcccttttcatttctgattttgttaattaggatgctttccct

SEQ ID NO: 80135 - DNA, 94 bp, Mus musculus
tttgtgataagctattctaagcttacagtggaaccacagctttcttatcatgtccttttgttttactgttttgactttcatggctgtcaacaag

SEQ ID NO: 80136 - DNA, 74 bp, Mus musculus
ctgttagtttcactgtgtctctgtttagattctgcttccagggtctgtccattgatgagagtgcagtgtaatag

SEQ ID NO: 80137 - DNA, 98 bp, Mus musculus
atatgtatatacatacatacatatgtatatatacataaatatatgtagatgtatatacatacatatatgtatgtatgtgcatatatacacacatatat

SEQ ID NO: 80138 - DNA, 198 bp, Mus musculus
atgtgtgtatatatgcacatacatacatatatgtatgtatatacatctacatatatttatgtatatatacatatgtatgtatgtatatacatatgcatgtatatatatatgtggatatatatatatatacatatatgtatatatgtatatatatatatatatatatatatatatatatatatatatatacacatatac

SEQ ID NO: 80139 - DNA, 106 bp, Mus musculus
gccttagtccatggtggtctgataggatgcacaggacaatttcaatatttttgtatctgttgaggcctgttttttgaccaattatattgtcagttttgaagaaggt

SEQ ID NO: 80140 - DNA, 89 bp, Mus musculus
ctgctatcaattgctagcttcatagagtatagtagtgagcactatggaaacctcacatactgtatatctgtatggctgattcctaccag

SEQ ID NO: 80141 - DNA, 65 bp, Mus musculus
ctggggattcccagggcctgcgagcaggccagggccttctggctctcaggctctcagacacccag

SEQ ID NO: 80142 - DNA, 81 bp, Mus musculus
gagattgagattattattgtaggtggaattgatatcattgttcccagtattatcatttttacttcttatggcttcgttctc

SEQ ID NO: 80143 - DNA, 115 bp, Mus musculus
ctggaagtggatttttttcctttaatcagtagtccttcaggcctgtggtctctgtgtgagagaagagactgtgggcacatggcatggagtgggggagttgaggattttatgcagt

SEQ ID NO: 80144 - DNA, 75 bp, Mus musculus
atgtatatatatatatatatatggatatatatatccaattgatgtatgtatctatgtatgtatgtatgtaggtat

SEQ ID NO: 80145 - DNA, 82 bp, Mus musculus
tctgtctctgtctctgtctatctatctatctatctatctatctatctggatgtagatgtagatagagacagagatagagata

SEQ ID NO: 80146 - DNA, 87 bp, Mus musculus
ggctgacctatgacctgtgagtgtcctgacagtggtgaccagaaagctgtgttgagcgcacaaaagaggagaaatcagagagcagcc

SEQ ID NO: 80147 - DNA, 73 bp, Mus musculus
gagcttctcctgtagaggccagagagaataaaacagggcgtcccccaatttctctctgtctctgagagagttc

SEQ ID NO: 80148 - DNA, 91 bp, Mus musculus
atgtatgtatgtatgtatatatttgtatgtatgaagtttttagagtctggcttttgcttcatttactcagtgtgtgtgtgtgtgtgtgtgt

SEQ ID NO: 80149 - DNA, 85 bp, Mus musculus; identical to SEQ ID NO: 57439

SEQ ID NO: 80150 - DNA, 83 bp, Mus musculus
catgggacaatttcaatatttttgtatctattgaggcctattttgtgtccaattatatggtcaattttggagaaggtcctgtg

SEQ ID NO: 80151 - DNA, 96 bp, Mus musculus
taatattatgtaaattacagtgaaagaattgagtgctaacaaatgttatcttattgaatgaatagtagttattttcatgtattacacataatatta

SEQ ID NO: 80152 - DNA, 93 bp, Mus musculus
gagccatggttaagctcactcatgtatgctctttggtttatgtccagtctctgggagctctgagggttcctgggttagttgatactgttgttc

SEQ ID NO: 80153 - DNA, 93 bp, Mus musculus
ggagatgatagatatagatatagacatagacatagtgagatgtagatatctgactgtgtgttctttatttataattgacctttagatttctcc

SEQ ID NO: 80154 - DNA, 87 bp, Mus musculus
ttcttgctttcctagttagatttatttaagatctcatttctattttagtacttctcttaaatacatctctactataaaagctgagag

SEQ ID NO: 80155 - DNA, 85 bp, Mus musculus; identical to SEQ ID NO: 57470

SEQ ID NO: 80156 - DNA, 85 bp, Mus musculus; identical to SEQ ID NO: 57470

SEQ ID NO: 80157 - DNA, 145 bp, Mus musculus
tatatatgtatatatgtatgtatagatatgtatatatagatatgtatgaatatatatgcctgtacatatatatatatatatatatatatatatatatatatatatatatatacacacacatatacacatatatacatatatacat

SEQ ID NO: 80158 - DNA, 84 bp, Mus musculus
gagtccccgagctctatccattgttttactgtttgggtgtaggtgtctgcatctgtctcagtcagttactgtgtggagcttctc

SEQ ID NO: 80159 - DNA, 91 bp, Mus musculus
gccttagtctgtggtgatatgataggatgcctgggataatttcaatatttttgtatctgttgggacctattttgtgaccagttataaggac

SEQ ID NO: 80160 - DNA, 105 bp, Mus musculus
gggaaagcacacagtgtgtgagattgtaagaaatgtatgtggtcacactgagcattgtgagtcccacacagtgtcacttccttgtggagaggagtcatattgttc

SEQ ID NO: 80161 - DNA, 109 bp, Mus musculus
cttgctgagtattatacatatcttttcctaatatatataaagtgagcattcaatacagccacaatttttattatatatagaggatttgatctgaaatgactcctgtggg

SEQ ID NO: 80162 - DNA, 66 bp, Mus musculus
attaggtaagagaaatgatggggacttttttttttaacaagtctccatctctgtctctaattcagt

SEQ ID NO: 80163 - DNA, 71 bp, Mus musculus
cctgagcaagcagatttcaggctggggaggggaggctacaactctgccacactttgtctctgaatcttggg

SEQ ID NO: 80164 - DNA, 85 bp, Mus musculus; identical to SEQ ID NO: 57439

SEQ ID NO: 80165 - DNA, 108 bp, Mus musculus
gtatgcatgtatgcatgtatgtatgtatgtatgtatgtatgtatatatgtatgtatgtatatgtgtgtatgtatatatgtatacatgatgcatatatgtatatttgta

SEQ ID NO: 80166 - DNA, 81 bp, Mus musculus
cacaagcgggaaagcaagtctcacagacagagtctctggcaggatgcaaggggctgggctggacccacttttcccactgtg

SEQ ID NO: 80167 - DNA, 73 bp, Mus musculus
gactttttcctgatacttcttgaacacaaattgaaagatatttttttcaatttcttggaggcagatgggggtc

SEQ ID NO: 80168 - DNA, 106 bp, Mus musculus
agtatttttagctatgtgtaggtgtgtgtctctgcatgtccatgtgacacatggacgaagttctgtggaggtctgaagagggcatctggacctggagttatagact

SEQ ID NO: 80169 - DNA, 94 bp, Mus musculus
gccagtgactgtggatatcattggtcaaacatatttatggatgcatttgctttgtatagattatttcgctgggatatccacaactcctcgtggc

SEQ ID NO: 80170 - DNA, 86 bp, Mus musculus
cattctgcgtgtgcctgtctgcctgtctgtctgtctgtgcacgcacgtgctcacacacatgtccatgcccatgcatgcacattatg

SEQ ID NO: 80171 - DNA, 72 bp, Mus musculus
tccctgaagaactgacatcagaacggtgatgggaagacagtccggtggccgtcacagactgtcactctggga

SEQ ID NO: 80172 - DNA, 100 bp, Mus musculus
tgtgtgtgtatatgtatgtatgtatgtgtgtatatatatatatatatatatatatacatatatatatatatacacacacacacatatatatgtatatata

SEQ ID NO: 80173 - DNA, 84 bp, Mus musculus
gcactgactgctcttccagaggtcctgagttcaattcccagcaaccacatggtgactcacaatctatatagcaaggtctagtgc

SEQ ID NO: 80174 - DNA, 78 bp, Mus musculus
ggctaagtgatttgtcaggcagcttttaaaactattgcttataaaagcgagaagaaaggtttgccttggtttaaggcc

SEQ ID NO: 80175 - DNA, 91 bp, Mus musculus
aagcccatgtttgatactgagagttttccttgatcattctccagttattcattttgaggcagggtctctctctgtcaaacctagccagctt

SEQ ID NO: 80176 - DNA, 84 bp, Mus musculus
cagtagggaaagtgcttgaccaagtgcaggtgatgaggcaggctccatccctctcatgtctactgttattcatgctctctgctg

SEQ ID NO: 80177 - DNA, 85 bp, Mus musculus
ttggcctgaggcctcagcagatggaaaagctccccttcagcctgaactgtgggagctcagcctcacctttaggtttcttggtcag

SEQ ID NO: 80178 - DNA, 90 bp, Mus musculus
ggtggcagcagccagtacctggggcttgttctctttgctgctgtgagaaccatgctgagacaagtcagacaggaagggaagccaggcacc

SEQ ID NO: 80179 - DNA, 116 bp, Mus musculus
agaaccctgctgagtcacttggaggcctggaacaaattgctttttgctaaataattaatcacagccattttcatttatttagtggctggcagtgtggatcgcccagcagaggctct

SEQ ID NO: 80180 - DNA, 90 bp, Mus musculus
ggagctgctctgcttaaaccctccactgtagaacctagcctgagactctgtctcactgaaatccactgtgagtgagggcaaagagtatcc

SEQ ID NO: 80181 - DNA, 72 bp, Mus musculus
gtatgcatgtgtatatgtatgtataaggatgtatgtatttgtgcatatatgtatgtatacttgtatgtatgt

SEQ ID NO: 80182 - DNA, 84 bp, Mus musculus
gtgcacattgttccgaggctctctctttgcctcaagccctggcttgagtcgactgaagctactctcctactgggagcagagcac

SEQ ID NO: 80183 - DNA, 121 bp, Mus musculus
tcacagctaagctgagatgattctgagtcctctgacctgttcagatgttcagtgtcgctcgctgtctcattcgaatgaggaaacagatggaagatcgggcttgtgtctcctctggattggt

SEQ ID NO: 80184 - DNA, 70 bp, Mus musculus
gtgtatatgtatatatacgtgtatgtatgtatatgtgtatatatatgtgtgtgtgtatgtgcatgtgcat

SEQ ID NO: 80185 - DNA, 70 bp, Mus musculus
gggggcgtgtggaggtctgtgtgtacatagtgtcagaggagacacagtgcagagcctcctcatgagatgc

SEQ ID NO: 80186 - DNA, 87 bp, Mus musculus
actgagccagtcggatgcctttgacctggtttcaccggagctgtcaaagggccgcctgagactgtctggcactgtgactgattcagt

SEQ ID NO: 80187 - DNA, 68 bp, Mus musculus
agtgtgtgcatgtgcatgtgtgtgcgcgtgcatatgtgtgtgtgtgtgtgtgtgtatgctcatgctca

SEQ ID NO: 80188 - DNA, 84 bp, Mus musculus
tgggatcaagttgttcagaggtatcatagctggggagtactactggtgtctgcccttctttctggtaccttgagagctagccta

SEQ ID NO: 80189 - DNA, 57 bp, Mus musculus
agtcagtcagtcagtcagtcagtcagtcaatctgtctgtctgtctgtctgtctgtct

SEQ ID NO: 80190 - DNA, 99 bp, Mus musculus
actgaagcctgttgccacaaacccgtagatccgaacttgtgctgattctgcacacaagcttgtgtctataggtatgtgtctgttaggcgatcccacagt

SEQ ID NO: 80191 - DNA, 112 bp, Mus musculus
gctaattcccttttctttgttaccctagtgatctacaaaccacggactcacacacacagattctgtgcttctcttccgttgccctctgggtcagtagcctgatggtagtagc

SEQ ID NO: 80192 - DNA, 86 bp, Mus musculus
gctagaaatggctgcctgtgtgcctgtaaccccagggctatgcagtctagggggctaagacaggcagctctcaggaactctctagc

SEQ ID NO: 80193 - DNA, 109 bp, Mus musculus
ggaatcgtgttgcgctcccctcagtccctgagaccctaacttgtgatgtttaccgtttaaatccacgggttaggctcttgggagctgcgggtcgtgcctttgcatcgct

SEQ ID NO: 80194 - DNA, 77 bp, Mus musculus
gagcactactagcatatatatatatatatgttcattgctcttgctatggactgtggatgtaaagtgactagctgctt

SEQ ID NO: 80195 - DNA, 61 bp, Mus musculus
cggctgtggttctaggttctatttggtggattcaaagaatgaaacccatggaccacagaag

SEQ ID NO: 80196 - DNA, 62 bp, Mus musculus
atgcatgtttacatgagtgtatgactatggggtggtgggtgtatatgcatgtggatgtgtat

SEQ ID NO: 80197 - DNA, 64 bp, Mus musculus
tgtatatacacacacacacatatatatgtatatatgtgtgtatatatatatgtgtgtatatata

SEQ ID NO: 80198 - DNA, 64 bp, Mus musculus
ggcattgctgtgtgtgtctgtcattccagagctaggggatggagaaagatatctgaggcttgct

SEQ ID NO: 80199 - DNA, 110 bp, Mus musculus
gtggaacgctgctgtaaatgtatatacacctctttctgagaatagtaagctttcttctctctggaagagatgtgtagaagtacattttctgggtcctgtaatgctgccac

SEQ ID NO: 80200 - DNA, 124 bp, Mus musculus
tagataggctagatactaactgtatagtcctgtgttcaaatatatgcattttaaaggtttatttttttttattttactttattatgatgggtgctttgtcagcatgtctgtctgtctgtgtgcc

SEQ ID NO: 80201 - DNA, 115 bp, Mus musculus
taatcatggtgaatgcttgttttgatttgttttttaatttggttggcaagaattttattatttttgcatcaatgtttctagaggagattggtctgaagttttctttccctgtttg

SEQ ID NO: 80202 - DNA, 81 bp, Mus musculus
gcctctctggctgtgtctctggggcatttccaaagacaattaacaaaagggagatgacctactctgaacacacacggaggc

SEQ ID NO: 80203 - DNA, 86 bp, Mus musculus
gtcatcttcttgtgtgcgtgttcacatgtgtgtatgtgttcacatttgtgtgttcacatgtgtgtgcgtgtaggccagaggttgat

SEQ ID NO: 80204 - DNA, 78 bp, Mus musculus
gacagccacacacattccaaatcaggtctcttagtcctcctctgtcactcagactctgagatgggaagtgtgggggtc

SEQ ID NO: 80205 - DNA, 72 bp, Mus musculus
gaagtccttgcctgatatagctttctcctgagaggctctctcagagactgagaaatacaaaggtggatgctc

SEQ ID NO: 80206 - DNA, 81 bp, Mus musculus
ccctaaggctcacaggatctagctagtttagcttaatcagtaagctacaggttgaaaagatcctgtttcaagaggtaggtg

SEQ ID NO: 80207 - DNA, 100 bp, Mus musculus
atgtgtgtatgtatgtttgcatatgtatgtgcatatgtgtgtatgtctctgtgtgattatgtgcaagtgtgtgtgtctgtgtatgtgtgtgtataggtat

SEQ ID NO: 80208 - DNA, 86 bp, Mus musculus
agatagttgggggctggcattgattggaaggagcctttgtaagattatctctggccccttcctgtctctctgactcccagctgttt

SEQ ID NO: 80209 - DNA, 89 bp, Mus musculus
ggttggcctttcaaggctgttggatgttttctttaaaatacattcatctgtttataagccttgtccagctgcctgactcaggccgcgct

SEQ ID NO: 80210 - DNA, 70 bp, Mus musculus
gcttttatgccatttgtcctgcagcatctcatttaatctggtgagagaaaggactgtggacaggaaatgt

SEQ ID NO: 80211 - DNA, 66 bp, Mus musculus
gctgttgttggtggctagactggccgttggcggtttgcacactggctatctgtctgtcttaacagc

SEQ ID NO: 80212 - DNA, 67 bp, Mus musculus
tatgtgtctctcagtgtgtccacaatgtatgtccaagagcccacaggggtcacatgagggcatcata

SEQ ID NO: 80213 - DNA, 61 bp, Mus musculus
tgcatgcatgtatgtatgtatgtgtgaggtttgtgcatgcatatgtatgtacatgtatgta

SEQ ID NO: 80214 - DNA, 83 bp, Mus musculus
ggatgcacaagtatcagttagagactctgctttcaattatttttggaaatagaatctaaaatatgctgggacatatggtatct

SEQ ID NO: 80215 - DNA, 82 bp, Mus musculus
ggacatccctttcaaaattcagagtgactcactcattctgcaggccagcaatgaggactcatctagaagcacgaggatgacc

SEQ ID NO: 80216 - DNA, 98 bp, Mus musculus
atatgtatgtatgtatgtatgtatgtatgcatgtgtgtgtatgtatatgtatatatatgtatgtgtgtgtgtgtgtgtgtgtgtgtgtgtgtgtgtgt

SEQ ID NO: 80217 - DNA, 120 bp, Mus musculus
ggcgagacgtgtgcaggctttatggctctgacagctctgggcctgggttctgtttctgtcacttacagactgggtaatggctctccagctcagttgtcaggtgcagcgtgagactgaccc

SEQ ID NO: 80218 - DNA, 59 bp, Mus musculus
gaatatggaggccagagaggacatctggggtctccctcaatcactctctatctatattt

SEQ ID NO: 80219 - DNA, 97 bp, Mus musculus
catgaaggagactgggttttgaagtataaatagacgttttctcacagggtctgtgagactgtgtttgttgactgctctgtccccagtatctagaatg

SEQ ID NO: 80220 - DNA, 71 bp, Mus musculus
tggtttcttgggctggagagatggctcagcggttaagaacactgactgctcttccagaggccctgagttca

SEQ ID NO: 80221 - DNA, 69 bp, Mus musculus
tcttctgtgtatgttcatgtgtgtatggatgcacgcatgtaagtatacatgtgcacgtgcatatggagg

SEQ ID NO: 80222 - DNA, 99 bp, Mus musculus
ttttctaaattaattttgggtatatgaatttttacaatacatttttgggagtatatatgtatatttggaaatttatatgtacatgattagattggggaa

SEQ ID NO: 80223 - DNA, 89 bp, Mus musculus
tgcagttgggagagtcagcagggtcttccttgagatgtgtggactttgttttgtctggggcttacagatcgtgctgtttttggtttgta

SEQ ID NO: 80224 - DNA, 83 bp, Mus musculus
agacagaatttcttttaatagccctgtctaccttgaactcattttgtagatcagtttggctggaactcacaagagatctgcct

SEQ ID NO: 80225 - DNA, 101 bp, Mus musculus
ggagagagagagagagagagagagagagagagagagagagatgccagtgccagactggatttaaaccctaacttcatcatctcctgactgtcttaatctcc

SEQ ID NO: 80226 - DNA, 81 bp, Mus musculus
taggaagatggtgtctaagccccacccagtgctccgaagggatgtagctggagttctctttatcactctttctgaggctgg

SEQ ID NO: 80227 - DNA, 66 bp, Mus musculus
ttgtatgggggcaggagagagaaaagtcttagatgctgacagatctcagttctgtctctgttacaa

SEQ ID NO: 80228 - DNA, 98 bp, Mus musculus
tgactggaaaggaaagtgagggtacaggctggagagatgattcagtgattaagagcattcactgctcttccagaggaccccatttcaggttcccagca

SEQ ID NO: 80229 - DNA, 90 bp, Mus musculus
gtgttgaggtgagaggtgaccatgcccaatatatatatatttgatttcaggtccttgtgcttgagcaaacactcttatctattcaaacat

SEQ ID NO: 80230 - DNA, 114 bp, Mus musculus
gttgggatggaaaaaacaaatgtgcttggcttattatttcggcttctcagaagagtgtgtgaagttctagcctgtcagccggtactctagccagcctagcagctttgagacatt

SEQ ID NO: 80231 - DNA, 131 bp, Mus musculus
ggcaccaggtggaggacaagaagtgggtctgtgcccctccgcacacccacgcctgggcctccctgcctgcctgcctgccttccagagtgatgagtttatctgcacaggacagagaggtgcgtttgacggct

SEQ ID NO: 80232 - DNA, 93 bp, Mus musculus
ctttcttgtggagtgctgcgtgtgggtcactcactgcctgaggtggctaagtggagatgacagatgagccattactgtgtacctttaagaaag

SEQ ID NO: 80233 - DNA, 77 bp, Mus musculus
gcctaagagtgaataaaaaggaggcaagcggtgttccagacagtatctgtctgtctgtctgtctccttcctgaaggc

SEQ ID NO: 80234 - DNA, 68 bp, Mus musculus
tgacaatcacagtactcagtcacaatactcataagtaccctgtgctgggatcctgtcactgtgggtca

SEQ ID NO: 80235 - DNA, 93 bp, Mus musculus
caccggggtgggggtagtggagatggtggtgaaggtcttggggtgcaatgttgtgtggctggcatggcagcttcctgccccccttctctgttg

SEQ ID NO: 80236 - DNA, 87 bp, Mus musculus
atcagagtttaagagcactcgctgctcgtgcagagggcccatgtttggttcccagtacccatgtcagtgagctcacagggttctgat

SEQ ID NO: 80237 - DNA, 127 bp, Mus musculus
aagtttggactctgaactctgaacatgtcagggtttgataacttgcagtttttgacacaagagtgtctgccaaaaagagagtgaccttgatcatattcattcaggcagaacttccatgctgtgttat

SEQ ID NO: 80238 - DNA, 123 bp, Mus musculus
gtatgtatatgtgtgcatgtatatatatatgtgtgtatgtgtgcatgtgtatgatatgtgtgcatgtatatatatatatatatgtgtgtgtgtgtgtgtgtgtatgtgtgcatgtgtatgtat

SEQ ID NO: 80239 - DNA, 58 bp, Mus musculus
gcatgtgtgtgcatgtatgtatgtatgtatgtatgcatgtatgtatgtatgtatgtgt

SEQ ID NO: 80240 - DNA, 119 bp, Mus musculus
cactctctgagtgcggtctccgagcctcacccaacaaccctggagccaggaggcctgcctgcctgcctgcctgcctctcacctggacaaggctcagccaagactgtgtccagggctgtg

SEQ ID NO: 80241 - DNA, 72 bp, Mus musculus
tatatatggttatatgtatgtatatatgtgtatataaatgtacagatgtatgtatatatgtacccatgtatg

SEQ ID NO: 80242 - DNA, 121 bp, Mus musculus
tatgtgcaaatatatacaatacatatatgtatatgtgtatatgtgcaaatatacatatatttagatatacatatatgtacatatatacaaaaatgtacatacacacacacatatatatatg

SEQ ID NO: 80243 - DNA, 94 bp, Mus musculus
gggaacagcctaggtcggacgtgggggggggggagggggggagaaggggggacacgactcagtccctgcctctgtgtggaagaggcaggttcct

SEQ ID NO: 80244 - DNA, 78 bp, Mus musculus
gtcctggaactcactttgtagaccaggctggcctcgaactcagaaatctgtctgtctctgcctcccaagtgctgggac

SEQ ID NO: 80245 - DNA, 110 bp, Mus musculus
cactcacttcatgcactttgcggtgatgggacttgacagagctgagtgacctcgcactgaaattgcagttctcaaagtcacacctgtaggctgactccttgctgtgggtg

SEQ ID NO: 80246 - DNA, 67 bp, Mus musculus
ggtcaaggatgctggggtgggtggtggaggtaaggtcacctactcaaagcctctctctgtgtcctcc

SEQ ID NO: 80247 - DNA, 69 bp, Mus musculus
gaaagcagactgaagagagatggctcagtggttaagagcactgattgttcctccaaaggtcttgagttc

SEQ ID NO: 80248 - DNA, 105 bp, Mus musculus
tgcggaaggggaaggtgaggtgcaggagttaagccctttccctctgacactctgtgggtgtgctctgctctgtccccctcatccctcaccaagctcatctctgca

SEQ ID NO: 80249 - DNA, 78 bp, Mus musculus
tggacccgggagatccacgctgcagtcctgtccgcttccctcaacctcgctcgctgcctcgctggctctcttgctcca

SEQ ID NO: 80250 - DNA, 81 bp, Mus musculus
gatagaggggctggagagatggtttagtggttaagagcactgactgctcttccagaggtcctgagttcaattcccagcaac

SEQ ID NO: 80251 - DNA, 103 bp, Mus musculus
atctctcctttatgtgtgtgtgtgtgtacatgtatgtatatacatgtatatatgtgtatatatgtatatatatgtgtgtgtgtagatagatagatagatagat

SEQ ID NO: 80252 - DNA, 114 bp, Mus musculus
tcccagtgagacaggaaaagtgtgagctagaatggagcatgacacaagaaagatagctgcttgtagagatgtttaggaggaagataatagctcttatagatccattcaatggga

SEQ ID NO: 80253 - DNA, 75 bp, Mus musculus
aggcaggtgtggtagtctactgttttaattccagtactggggaggcagaagcagttggttctctatagccagcct

SEQ ID NO: 80254 - DNA, 99 bp, Mus musculus
gatcagccttatctgtggtgatctgataggatgcatgggataatttcaatatttttgtatctgttaagtcctgttttgtgaccaattatatggttgatt

SEQ ID NO: 80255 - DNA, 66 bp, Mus musculus
gggtggatcctgtttgtgagagatgcagaagggaaacaccccacgcagcctcacacacagacactc

SEQ ID NO: 80256 - DNA, 114 bp, Mus musculus
tctgaaaaggatgctttatatctttaattaaatgtttagtgcagtgatatctaatttttttttggatatctaatgtttttatttgaatgaggttattgtgcagtttattataga

SEQ ID NO: 80257 - DNA, 137 bp, Mus musculus
ggtcaagagaaggacgatcgtttgggggggaaggggaagggcgcctgtgcatgtctgtctgtctgtctgtctgtctgtggtcatctactgtcagtgctggcctctatgcccgcacagagacgaagtgttgccatagg

SEQ ID NO: 80258 - DNA, 62 bp, Mus musculus
ccacaagctggcttaccctcttttgctcacaagcagcagatagaagagagttagcatgttgg

SEQ ID NO: 80259 - DNA, 63 bp, Mus musculus
tgtgtctctgtcttagtcactcttctgttctgaagagacaatatggccaaggcagctcttaca

SEQ ID NO: 80260 - DNA, 90 bp, Mus musculus
gtaagtagacatggtcctcacacaggaagtaagtttctgtctctctgtggctccagaagcctgcatgtggagggttgtggcagggcttgc

SEQ ID NO: 80261 - DNA, 60 bp, Mus musculus
cagaatgctggagagatggttcaatggttgagagccctgactgctcttccagtggtcctg

SEQ ID NO: 80262 - DNA, 67 bp, Mus musculus
cctcagcactgagataaactgggcctggtggcacacaccagtgaactcagaacttagtaagtagagg

SEQ ID NO: 80263 - DNA, 84 bp, Mus musculus
gacgagaaaagaaggaggctgtgacagattttatgcatttacactttcatgctatctgtctgtctgtctgtctgtctgtctgtc

SEQ ID NO: 80264 - DNA, 141 bp, Mus musculus
atatatacatatatacatatatatgcatgtatgtatatgtacatatgtgtgtatatatgtgtgtatgtgtatatatatgtatatgtgtgtatatgtatgtatatgtgtgtatatatatatatatatatatatatatataca

SEQ ID NO: 80265 - DNA, 75 bp, Mus musculus
attctcagacagacacacccactgaggcagcaggatcggagtagctctcagagaaaggatgtctgtgatgtgagt

SEQ ID NO: 80266 - DNA, 121 bp, Mus musculus
gtgcatatatacacgtatgcatgtatccatatatgcatatgtatatatgtatgtgtatatatgtgtgtatatacatttatatgtgtgtatgtgtatatatgtatatgtgagtgtgtgtata

SEQ ID NO: 80267 - DNA, 68 bp, Mus musculus
tgagcaccgtatctctgatctttgctgtttccactcggaagcagcttctgtcacacggtccctgctca

SEQ ID NO: 80268 - DNA, 83 bp, Mus musculus
agatatttcacagtgggtaacttcagttccaccatgcaggggtgagagtgtcagagaggtgaatggacagtctgtgtgtgtct

SEQ ID NO: 80269 - DNA, 77 bp, Mus musculus
acacttggtatgtgtgtgcatgtgtgtgtgtgtgcatgtccatgtatgtgagcgtgtgtgcatatgtatgtgagtgt

SEQ ID NO: 80270 - DNA, 148 bp, Mus musculus
gtgtatgtatgtgtgcacgtgtgcatgtgtatatgtatatgtgagtatatatgtgtatatgcatgtatgtatgtgtatgcacatatgtgtatatgtatgtgtgcatgtgtatatatgtatatgtaagtatatgtgtctctatatgcat

SEQ ID NO: 80271 - DNA, 96 bp, Mus musculus
gtccaagatacctgccatctgtgcaacactgagtctgcacctctgtctacacagtagctgttgtgctttataaaagagagccaggatatgtttgat

SEQ ID NO: 80272 - DNA, 77 bp, Mus musculus
gtggatgtgagtccctctgtgcctgtggtatgcctctatgtctgacgccatgctgtgctgcgatgacccaaagccac

SEQ ID NO: 80273 - DNA, 80 bp, Mus musculus
gcaaaaccaaggagacagatggtgagaggcagagatgcaagactctctctctttctctctctgtgtgtgtgtgtgtgtgt

SEQ ID NO: 80274 - DNA, 75 bp, Mus musculus
gtcaggatgcatcaggagcagtctagttctgggttctcccagactctctctttccctgagcatcatacatctgac

SEQ ID NO: 80275 - DNA, 59 bp, Mus musculus
tctgtgtgtgtgcatgtgcatgggtatgtatgtgtattcaagtgtgtgtaggtgccagg

SEQ ID NO: 80276 - DNA, 86 bp, Mus musculus
catcatgtcacaagtgccctcacacacacattcacactcgtgcaaaggatgatgatggtgatggtggtgatggtgacgatggtgat

SEQ ID NO: 80277 - DNA, 87 bp, Mus musculus
acacatacacaggagagcagagagccagctttgatgtgacttaccttgtaacttagcttatcctgccttttcttcgtgtgtgtgtgt

SEQ ID NO: 80278 - DNA, 70 bp, Mus musculus
ggtgtcttctctcagagtctctgtttcttattcatccaaggagggagaggatcaggggagtgctttcacc

SEQ ID NO: 80279 - DNA, 78 bp, Mus musculus
gagtgtatgtgtataagtatatgagtgtatgcatgtgcgtatgtgagtgtatgtgtgtgactgtgtgtgcgtgtgttt

SEQ ID NO: 80280 - DNA, 110 bp, Mus musculus
gcttttcggggtctgggcacagagtagtgatgtgctcttggctctaagaacaaagacatctgagagtgtcactgtgtctttgtcctcggcccttcccctgatccataggc

SEQ ID NO: 80281 - DNA, 76 bp, Mus musculus
ccctatttcttgtgtgtgtgcatgttcatgtgtgtgctagtgcatggatgcatgaatgtgcagacctgaatgaggg

SEQ ID NO: 80282 - DNA, 71 bp, Mus musculus
ccttctcagtctctgactgagagtagaggcatagatgtggtgtctggacggtggtctgacttctgagaggg

SEQ ID NO: 80283 - DNA, 105 bp, Mus musculus
ggaatcttctataaggctagcttgtgggcatgacagtgagggaatctatctatctatctgtctgtctgtctgtctgtctatctatctataattatatcattttcc

SEQ ID NO: 80284 - DNA, 88 bp, Mus musculus
cagagccacattgccagcatctgtgccttgggcttctcacctttgttggctagagagtctctgacacactggcagacactgtgttctg

SEQ ID NO: 80285 - DNA, 59 bp, Mus musculus
tgcttgcttgcgtgtgtgtatgtatatatgtatatatgcatgcatactacctgcatgca

SEQ ID NO: 80286 - DNA, 113 bp, Mus musculus
agtccctaggtttgacctccagttttgggtgaagggtgtgagtgtagtgagtcagcatagagagctttggcatatgcttccctttgccttcatgttaaagaacaaacgggagt

SEQ ID NO: 80287 - DNA, 110 bp, Mus musculus
tcaggaacatcctctgcacagtgggaggagactgtaaggagcatcctctgtgcacagtgagaggagacagtcaggagcatcctctgcacagtgggaggagacagtcagga

SEQ ID NO: 80288 - DNA, 79 bp, Mus musculus
ctctccagagaagactgttacgagagactgccatcacaggctacctgagcagctttttgttgggtgtgttctggaagag

SEQ ID NO: 80289 - DNA, 57 bp, Mus musculus
gggcacagagggtcaagtggtcttggcaactcacgtctctgtctgaccctcagtctc

SEQ ID NO: 80290 - DNA, 129 bp, Mus musculus
ccagaggaaccccagtgttcttaactgctgagccatctcttcagtcgcagttgtgtgtctgtgtgtcagtagtgtctataatccagaagagggtcttgggtcccctggcgctagagttaaaggtgattg

SEQ ID NO: 80291 - DNA, 65 bp, Mus musculus
agagagacagagacagagagagacagagagagagtctgtctgactgtctgtctgtctgtctgtct

SEQ ID NO: 80292 - DNA, 64 bp, Mus musculus
tcaggactggagagatgggtctgcggttaagaacactcactgactgctcttccagaggtcctga

SEQ ID NO: 80293 - DNA, 68 bp, Mus musculus
tgcctaggaccaggcagtgtgcagacagcgtgttcttgcttcagctaccaattctaggtacctaggta

SEQ ID NO: 80294 - DNA, 70 bp, Mus musculus
tagttggcacagcaaggagaagtctgctgtagtctgatttcacagccactgttctctctgtctgcaactg

SEQ ID NO: 80295 - DNA, 85 bp, Mus musculus
agagagggtgtgacgctgctttctctggcccggaggctgctattcagtccctctctgtggcagaaaggcacaaaggcaggtcaca

SEQ ID NO: 80296 - DNA, 64 bp, Mus musculus
ctctctctctctctggctgcaggacctgaaccaggggaatgggtttagttggaagagagaggga

SEQ ID NO: 80297 - DNA, 94 bp, Mus musculus
ggtttgctttggatttggacttgggtactaaattgtgagctcacatgtctctgggtgagttcagtgcttgtcctctcaagaggcaaagtgaacc

SEQ ID NO: 80298 - DNA, 112 bp, Mus musculus
ctgggtgactgggtgactgggtgactgggtgacttccatttttttttttttttttggctcttttcaaagaaggttggaggcattaccagccgcaaatttaaagttatcccag

SEQ ID NO: 80299 - DNA, 106 bp, Mus musculus
gccttatttcatgatgatctgataggatgcatgggacaatttcaatatttttgtatatgttgaggcttgttttgtgaccaattatgtggtcaattttggagaaggt

SEQ ID NO: 80300 - DNA, 84 bp, Mus musculus
gcttctctgggtccctgggtgccaaataccaaaaattacatgagatgtggtttctggccttgggtaaggggaccgaaaggcagc

SEQ ID NO: 80301 - DNA, 81 bp, Mus musculus
ggcagatggggttctgaagctgagagaagagagtgtgcctcacatccttgcatctacagttttctcgcagacctacctgct

SEQ ID NO: 80302 - DNA, 83 bp, Mus musculus
gagagaggtcaggcattcggagtgaagaggtctcagacctattgctcagggtgactgaggctcactctctgacctttagtctc

SEQ ID NO: 80303 - DNA, 107 bp, Mus musculus
tagtgtttgccaacctccatgctgatgatctaaagctgccagcctgatgtcactgagctcagacttagagaaagaagaaaacagtggatcttcagcagcttatgctg

SEQ ID NO: 80304 - DNA, 76 bp, Mus musculus
tggagagagagagacattggacttggcttgggctcttgaaacccccaagcccaccctcagtgactcacttcctcta

SEQ ID NO: 80305 - DNA, 109 bp, Mus musculus
tttttttgtggttgtacaactggtgggttagagttgaggtttgaacttaggactgtctgactccaacactctttctatcacacagaattatgggtagcacggggaagaa

SEQ ID NO: 80306 - DNA, 114 bp, Mus musculus
tcatatacatatatatataatggttgatatgagtgaggatatgtatatgtatatagttatgtatatgtatatagttatatgtatgtatatagttgtatatgtatatgtatatga

SEQ ID NO: 80307 - DNA, 96 bp, Mus musculus
cttggctcccgagcctaaccttaatgtctttgctattgtacttcatggcttcagggataaagcaagacagaaaggcggggaagtgaggttgctaag

SEQ ID NO: 80308 - DNA, 83 bp, Mus musculus
atgcatacatatggaagtcagagatcaattttgggtgttattcctcaggaaccatttaccttggtatgtatatatgtatgtat

SEQ ID NO: 80309 - DNA, 98 bp, Mus musculus
gccagtgtgtgtatgagtgcgtgtgtatgtatgtgtgggtgtgtgcaagtgcatgtgtgtgcctctgtgtgtgagtgtgtgtgtgcaagtgcatgtgt

SEQ ID NO: 80310 - DNA, 85 bp, Mus musculus
gtccatggtggtctgataggatgcatgggacaatttcaatatttttgtatctgttgtggcctgttttgtgaccaattatatggtc

SEQ ID NO: 80311 - DNA, 111 bp, Mus musculus
ggtatgattggtggaaatgactgctgacccgctcgctcgctcgctcattggctgatgccctcagtctcttggtagtatgcagcagaaagcacctgtgattccgcccatccc

SEQ ID NO: 80312 - DNA, 96 bp, Mus musculus
tcgttttttagaaggttgacaactttaaaagaaatggtgtgttcctttaacccctagaacattttatttaaatttagtcactggtttggagaacga

SEQ ID NO: 80313 - DNA, 60 bp, Mus musculus
acactgcagacagctggcttctgggttgggggtctctcctctctctatctgtctgtttgt

SEQ ID NO: 80314 - DNA, 59 bp, Mus musculus
cagtgcctagcagacagtgagcactcagcaaagggtgctacttacaatgccaggtactg

SEQ ID NO: 80315 - DNA, 71 bp, Mus musculus
ctgcagtgctgagagagtcaatactagttttaattttattcatgatgcttgtaacttgctctgtgctgcag

SEQ ID NO: 80316 - DNA, 103 bp, Mus musculus
gtgagcttccagtattgatgatgtcacagaagccagagagcacaacccctactaatgactttttgcaacggacatttgcgagtgttagacagactggatatac

SEQ ID NO: 80317 - DNA, 66 bp, Mus musculus
gtgtctgtgtgagtgtgtctgtgtatgtttcgctttgtatacatgcgagataaaactctcaggctc

SEQ ID NO: 80318 - DNA, 114 bp, Mus musculus
ataactctttctgaagcaataaaaaagtcttttctctctcatccagtctctgtcatatgctaaagcaatcagggatgggtgatttcaggtgacgtgatggcagattagatttgt

SEQ ID NO: 80319 - DNA, 101 bp, Mus musculus
tgcattatatgtgtatacatgcattgtatctatgtatatatacatagatatgtatagttatatatacaatatatatgcaatataatacaaatgtatatata

SEQ ID NO: 80320 - DNA, 102 bp, Mus musculus
atttgtattatattgcatatatattgtatatataactatacatatctatgtatatatacatagatacaatgcatgtatacacatataatgcatgtagcagat

SEQ ID NO: 80321 - DNA, 101 bp, Mus musculus
ggcaaaacaagtatttcaactcaggtatgtctcaccaaagctggtgacaggtgtggactgtgtctttatctgtgtgagaggcacctcagtctggagttgcc

SEQ ID NO: 80322 - DNA, 61 bp, Mus musculus
tgcttcaatggcagtatagatctctgtaggaggcacagaggtctgagtgctcacagaggca

SEQ ID NO: 80323 - DNA, 102 bp, Mus musculus
gtgctggaatatcgtgggactaccttgtgcaggtgagagttgagtgtgatgccaccacgtcatgtccatatgtcactatcctcccactgcgcttagtagtcc

SEQ ID NO: 80324 - DNA, 103 bp, Mus musculus
caaaaggtggtttcatgtgtttgttatatgcttgtttatttatgttttacagatgacaggattggatattgagaaggatcagattattgagatggcctgcctg

SEQ ID NO: 80325 - DNA, 74 bp, Mus musculus
gtcttgaatcacatactctgtgtctttttctgaaagctgtgttgccagtaattacagagcttgtggttggtggc

SEQ ID NO: 80326 - DNA, 111 bp, Mus musculus
atttatttttatttactggtatgtatgtacgtacgtatgtatgtatgtatgtatgtatgtatgtatgtatgtatgtatgtatgtatatgtgtgtgccaaatatatgtgagt

SEQ ID NO: 80327 - DNA, 57 bp, Mus musculus
gtcaagtgaaacagtgaagagatgcctttgggtgtccctctcagtgactcacagggc

SEQ ID NO: 80328 - DNA, 83 bp, Mus musculus
ggacatgtcgcagttatcagtggcgtgggcgtgttacaggttctcctatcctcccactgtctgtctggttctagtgactgtct

SEQ ID NO: 80329 - DNA, 113 bp, Mus musculus
cacacctaaaccgagccctggcggcagaaggctctgggttccggtcttgtttgtgtcactcactatgaatcagatccacacccttgttctaacccttgctgctgctgtgtggc

SEQ ID NO: 80330 - DNA, 94 bp, Mus musculus
caatccctggaacccgtgtgaaggtggagagactggaccttttgcagaaaatgtgttgactgtctctgtgcctgagagaggggacctggaggtg

SEQ ID NO: 80331 - DNA, 64 bp, Mus musculus
atttgacactgactgtctgactgtggacaaattcagccgtccgtctctgattgtcagtgcagat

SEQ ID NO: 80332 - DNA, 77 bp, Mus musculus
agagagatgaatgtttctctctcttcggtgaggctatatgctcaaagagtgaacccagagagcacaagagtctctct

SEQ ID NO: 80333 - DNA, 122 bp, Mus musculus
agaggagagaaagcttcgggaccgggatcgtggctctcctgagcagttctgagttctgtgtgtctctcctgtaaaaggcaggggttgcatggtggtgcctcagccttctgccttggagagat

SEQ ID NO: 80334 - DNA, 61 bp, Mus musculus
aagagacacactaagcatgggagggagcagggtgggtccctgtcacactcagtgaactctt

SEQ ID NO: 80335 - DNA, 93 bp, Mus musculus
gaaacagaaagccttcacagtcctggaagatctgcttggataggatccatatttaccacagagaactgacagatgagaaagtccagctgtttc

SEQ ID NO: 80336 - DNA, 105 bp, Mus musculus
attgaagatcagtgctagtccatggtaatctgataggatgcatgggataatttcaatatttttgtatctgttgaggcctgttttgtgactgattatattgtcaat

SEQ ID NO: 80337 - DNA, 72 bp, Mus musculus
gaaaccagactctacagacacattctctcaatgtgtaggtggccaggagataggcgtgtgtgggggggtgtc

SEQ ID NO: 80338 - DNA, 112 bp, Mus musculus
atatatatacatacatacatacatatatatatatgtatatacacatatgtatatgtataggtatatgtatatatatatatatatatatatatatatatatatatatattctg

SEQ ID NO: 80339 - DNA, 122 bp, Mus musculus
cacaggctgtgggccacctcagagctgagggagacagcacagactgtgggccacctcagagctgagggagacagcacagactgtgggccacctcatagctgagggagacagcacaggctgtg

SEQ ID NO: 80340 - DNA, 175 bp, Mus musculus
cacaggctgtgggccacctcagagctgagggagacagcacagactgtgggccacctcagagctgagggagacagcacaggctgtggaccacctcatagctgagggagacagcacagactgtggaccacctcatagctgagggagatagcacaggctgtgggccacctcatagctg

SEQ ID NO: 80341 - DNA, 64 bp, Mus musculus
gcaatttagtcttcatgtgggaccccctaacaactggatcaggggctgtctctgactctgttgc

SEQ ID NO: 80342 - DNA, 85 bp, Mus musculus; identical to SEQ ID NO: 57439

SEQ ID NO: 80343 - DNA, 112 bp, Mus musculus
ggttgaaagtagatgatgtgggccggagagatgactcagcggttaagagcactgactgctcttccagaggtcctgagttcaattcccagcaaccacatggtagctcacaaac

SEQ ID NO: 80344 - DNA, 87 bp, Mus musculus
ttgaatgctcaaggagatataaggtactttagggagactgactcagacactccttcattgagtccatctcagggttagagcatgcaa

SEQ ID NO: 80345 - DNA, 95 bp, Mus musculus
gactcaacaggtaaagatatgtgccatctaccctaaaaatctgaatttgtttttgagacctagatggtatgagcaacactttgtcctctgagctc

SEQ ID NO: 80346 - DNA, 66 bp, Mus musculus
gtacaaattatgcatatcagtgtgtgtatgtatatatatatatacacacacgtatgtatcagagac

SEQ ID NO: 80347 - DNA, 115 bp, Mus musculus
gcactgtctctgatacatatgtgtgtgtgtatatacacacacacatatatatatatatatgtctctgatacatacgtgtgtgtatatatatatatacatacacacactgatatgc

SEQ ID NO: 80348 - DNA, 79 bp, Mus musculus
aggaagggacagttgctcaacacactgtctgaactctcactcacactgtgttagcattgtcatgtcatatttccttcct

SEQ ID NO: 80349 - DNA, 77 bp, Mus musculus
tctctgtgtgtctctatgtgtatgtgtgtgtgtatgtgcacatgtgcacacatatttatgaatatgaggatgtgaga

SEQ ID NO: 80350 - DNA, 58 bp, Mus musculus
ctgcttgcctctgtccctccatctctgtgctaaggagaaggaagaaagcaggaagtag

SEQ ID NO: 80351 - DNA, 76 bp, Mus musculus
ttggcaagcaggctaatagaagcactgaggtgagtcactttctctctgactgctttaattttccacctctagccaa

SEQ ID NO: 80352 - DNA, 67 bp, Mus musculus
tacagatatacaatatacatatgtattatacatacacatacaatatatatgtatgtgtatatatgta

SEQ ID NO: 80353 - DNA, 66 bp, Mus musculus
tatatgtatgtgtatatatgtgtgtacatatatgtaaatgtacacatatatatatatatatatata

SEQ ID NO: 80354 - DNA, 123 bp, Mus musculus
gtcctgtgatcctctgatactgtgatgctgtgatccgggatgtatcagaactcctggtagtacaagtgcatctggatctgggctgagtgtgtaggaatccagaacaaaggctctgctttgggt

SEQ ID NO: 80355 - DNA, 111 bp, Mus musculus
gaagcagccactagatgctacccttgagaagtaaggaaatatcacaacctgtcactctcagtgattgacattccactttgtggggactgaaagcataaatgcagctgcatc

SEQ ID NO: 80356 - DNA, 121 bp, Mus musculus
ttgtgggtctgtcgaaccctgatctggccccaccaggaaggcggaatgtagactcaggaatgagagcagacagtgcagctttgccatcatcgcctgcagctgctcacatcaggggtgtata

SEQ ID NO: 80357 - DNA, 113 bp, Mus musculus
aagaatgttgaagtgacaggtgcctgcccttggatgtgtctgtttgtctgtctcttgctaaggagatcaggaaatgtgcagaacttagggactggcaccctcactctgttttt

SEQ ID NO: 80358 - DNA, 67 bp, Mus musculus
acctgagattctgggtgtttcagagttcttggcagtcaagcttcctctgagaccctgagtccctggt

SEQ ID NO: 80359 - DNA, 108 bp, Mus musculus
tttaggttttatggatggactactactatgtatgtatgtatgtgtgtatgtgtgtatgtatgtatgtatgtatgtacatatgctcttgttgttgttctaatactaaac

SEQ ID NO: 80360 - DNA, 69 bp, Mus musculus
ggaagatctcactgtctcagtgacttgtttacacccaggaacaactgtcactgagcaatcatcacttct

SEQ ID NO: 80361 - DNA, 110 bp, Mus musculus
ggacaggcagtgtgagaaacatggttgatttttttcaccataatagaacaatggtcattttctagatgtgtgggtttgcatgtatctgcctcatttttcttcagcccacc

SEQ ID NO: 80362 - DNA, 94 bp, Mus musculus
gcatgtttgtggaataaattcagatgtagtttgtctgtctgtctgtctgaggagaaagggcagcctggcattttcgttatttagtcacaatgca

SEQ ID NO: 80363 - DNA, 96 bp, Mus musculus
gcatgtgtctgtgtgtgtgtgtaagtatgtgcatgtgcctgtgcaagagtgtgtgtgcatgtgcatgggtatgtgtgtgaatgagtgtgtgtatgc

SEQ ID NO: 80364 - DNA, 87 bp, Mus musculus
tttgggcaggaacagagagtactgtgacagcagagttcaggatgctcatagccttacgtcagcatactctttggagctgggcttgga

SEQ ID NO: 80365 - DNA, 113 bp, Mus musculus
gagtctttgggtggtttagatatcagggtgactgtggcctcatagaataaatttggtgattttcattatttttctactgtgtggaatagtttaaggattattattattaactc

SEQ ID NO: 80366 - DNA, 118 bp, Mus musculus
atgtatggttttatatttctattaaaacacaacttgtgaggtaattatgatcatgtatatttttaataccatttagaagatctattttatgttatgtgtgtgaatgttttgcctgcat

SEQ ID NO: 80367 - DNA, 76 bp, Mus musculus
gtgtgtgtgtgtatgtgtgtgtgtgtgcgtgtatgcatgtgtgtgcatgcacatgtgtttatgtatatgtgtgaac

SEQ ID NO: 80368 - DNA, 108 bp, Mus musculus
gttgtgtgtgtaggtgtgtttgtgtgtgtgtgtatatacgcgtgcacgcatgtatgaatgtatgtatatgtacatacatgcaaaaaggagcctgtggagatcagaagc

SEQ ID NO: 80369 - DNA, 82 bp, Mus musculus
ggaaagtttgcctttggggatgggctttgaggtttcaaaggcccaagccaagcccagtgtctgtctgtctgtctgtctgtct

SEQ ID NO: 80370 - DNA, 118 bp, Mus musculus
ggctgtcctggaacttgctctgtagtccaggctggccctgaacttaagagatttgtctgtctctgtctctgtctcctgccttctgggactaaaggtgtgtgccatcatgcgtccagct

SEQ ID NO: 80371 - DNA, 90 bp, Mus musculus
ccagcgcttggctgataaacgcgtgcaggcgatcactcaccagacactcactgagttactgtgtttaccaggcactgtgccagcctctgg

SEQ ID NO: 80372 - DNA, 112 bp, Mus musculus
gtgtgtgtatgcgtctgtgtctatatgtctgtaagattctatgtgtctgtgtgtctctgtgcaggtacatatgtgtgtgcattgtatatttatatctgtggtatgcatgtgt

SEQ ID NO: 80373 - DNA, 80 bp, Mus musculus
atagatagggttgtaaacctagtggctggcctaatggtgttattctagggattacaattagtgtcactctgcctgtctgt

SEQ ID NO: 80374 - DNA, 88 bp, Mus musculus
tccttgcattcatgtatgaatgtatgtataaatgtatgtatgcatatacgtatatatacatgggtatatggatgggtgtgtatatgga

SEQ ID NO: 80375 - DNA, 67 bp, Mus musculus
gccccggtgactgctgaactaggattctgcatcccttctccatgtggttgtaggaagcaaactgggc

SEQ ID NO: 80376 - DNA, 78 bp, Mus musculus
gtatgtatgtatgtatatgtatgtatatcacccaggaccacctgcccagtgtgtgtgtgtgtgtgtgtgtgtgtgtat

SEQ ID NO: 80377 - DNA, 113 bp, Mus musculus
gcagaggggagttaagtaaggattgttccagttcccttctctatttgcctgggagccacacctctctctctctggccaggtgagagggaggcctgcagcaattaactctttgt

SEQ ID NO: 80378 - DNA, 87 bp, Mus musculus
gagttgccttagggactgcagagatggctcagcggttaggagcactgactgctcttccagaggtcctgagttcaattaccagcaacc

SEQ ID NO: 80379 - DNA, 107 bp, Mus musculus
gcttttttctgagtctagttactaggcagtgtagttagctgattgctaatagtaccaatcactaaccacacagccaggtaaaaagactgaaattcctccgactgagc

SEQ ID NO: 80380 - DNA, 113 bp, Mus musculus
gtggcgggcgcccggtgctcggtttgtaggcagtgtaattagctgattgtagtgcggtgctgacaatcactaactccactgccatcaaaacaaggcacagcatcacccgccgc

SEQ ID NO: 80381 - DNA, 59 bp, Mus musculus
gacaggcactctctgtctccatttataactggacagtggaggccgagagatgttctgtc

SEQ ID NO: 80382 - DNA, 69 bp, Mus musculus
gcggggaactgtctcactgtctgcgcggtacctctcgaatccattgtccagagggtggtcgtacctcgt

SEQ ID NO: 80383 - DNA, 65 bp, Mus musculus
caggtgaaatgggggtagcctggggaagatacgtgtctctcaggctctggcagtctctttacctg

SEQ ID NO: 80384 - DNA, 130 bp, Mus musculus
tatatatatatatagtgtgtgtgtgtgtacttctgatactcttgtatatatgtatatgtatatgtatatgtgtgtgtgtgtgtgtgtgtatatatatatatatatatatatatatatatatagtgtgtat

SEQ ID NO: 80385 - DNA, 68 bp, Mus musculus
ccactctctctctgtgtgtgtgcatgtgcatgtactcatgtatgtaaaagccagagactgacaattgg

SEQ ID NO: 80386 - DNA, 107 bp, Mus musculus
cataaaatctttacttagtggtaggttccaggtttgcatatttattcttaattatgacatgtcataaagttataagaacttagaatttgctttgctgtgatattatg

SEQ ID NO: 80387 - DNA, 145 bp, Mus musculus
gatgggattgtctagagagaatagggaaatgaaaatacagaagtatatgtgtgtatgtctctctgtgtaattatatctatatgtgtgtatgtatgtgtgtatgaggtgtattcatgtccatatatatgaatgtaagtacatatga

SEQ ID NO: 80388 - DNA, 86 bp, Mus musculus
cttttagaagctctcgtagctcctggtatacagtaagaagggagctcacttctctgtcccttggctttcagaccagagcttcttgg

SEQ ID NO: 80389 - DNA, 101 bp, Mus musculus
tatgtgggtttatgtatgcatgtgtgcatgtacatgtgtatatgtatgtatttatatgtgtatacgcacatacttttatatatgtatagttaggacaacat

SEQ ID NO: 80390 - DNA, 81 bp, Mus musculus
gtggtgtataatgggttacttaaggagatttccatatatatatatgtaatatactttgagcataccccatgctgcccccac

SEQ ID NO: 80391 - DNA, 73 bp, Mus musculus
ccattgttgaaagaactgaagagtctgaggacacatcacatgactgtgccccaggagcagagctaggcatcgg

SEQ ID NO: 80392 - DNA, 125 bp, Mus musculus
atgctgggtatatatatatatatatatatatatatatatatatatatatatatatatacatacatatatatgatgtgtgtgatgtatatgtatatatatatgtgtgtgtatatatgtatatgtat

SEQ ID NO: 80393 - DNA, 87 bp, Mus musculus
tgaggcagtgctccgcgtgcagcagtgctctacaccagggctcgctggtgaagagcagtgactgctcttccagagatcctgagttca

SEQ ID NO: 80394 - DNA, 153 bp, Mus musculus
gtatttcacatgacacatgtatcaaatactagaatatatatgtatatgtgtatatgtatatatacatatgtgtattatatacatgtataatatgtattttatatatgtgtaaatatatacacatattcaatatatatatatattgaaataaca

SEQ ID NO: 80395 - DNA, 64 bp, Mus musculus
tctcttaatgtggaggctggcagacttcgccaatatgtccctgccaccctctgtccctgcgaga

SEQ ID NO: 80396 - DNA, 114 bp, Mus musculus
ctttttagtgtggttgagtagggtttcctgcctaggctcgtttgtccactctgtcactcagtctgtggctttgggttaggcctaacttcttgtcttgtcttctctctaatagag

SEQ ID NO: 80397 - DNA, 85 bp, Mus musculus
atcccagcagaaagtactgagggcaggcagcaccgaggtaaccccaccagaacgcagcctcggtctctctctctagcgagtggat

SEQ ID NO: 80398 - DNA, 76 bp, Mus musculus
ggggctggagagatggctcaggggttaagagcaccgactgctcttccagaggtcctgagttcaattcccagcaacc

SEQ ID NO: 80399 - DNA, 98 bp, Mus musculus
gtcatatatacatgatatatatatgcatatatatacacacatatatatacacacacatatatgtatgtatatatgtgtacacatatatataatatggc

SEQ ID NO: 80400 - DNA, 112 bp, Mus musculus
catattatatatatgtgtacacatatatacatacatatatgtgtgtgtatatatatgtgtgtatatatatgcatatatatatcatgtatatatgacatatatgtatgacatg

SEQ ID NO: 80401 - DNA, 118 bp, Mus musculus
gtttgagtgtagtgctgaggtaaaatgagtgacctttggcgtattcctgagaacatggagagtgaagtgactcagggtatagctagatgctgcttaaaattagagagattctattggc

SEQ ID NO: 80402 - DNA, 89 bp, Mus musculus
tgttttaaagtttcccaataatcatcataagggataatgcctgatgcattattcacaatgtgcatgtgcatgttgggaaccttaaaata

SEQ ID NO: 80403 - DNA, 131 bp, Mus musculus
tcccagtcacagcactcataacctttcttactacaaataattccatacctatcacacaccgactctcttagttctcatgtggatgctgggatgtaagagcaagaagatgggaggtggaatggggaacgtgg

SEQ ID NO: 80404 - DNA, 91 bp, Mus musculus
gggtttgatgacaccatcccgcataggactgagagctctgaggtcactcactctctgcaaagtccaattgtgggtctctgtcttatttccc

SEQ ID NO: 80405 - DNA, 85 bp, Mus musculus; identical to SEQ ID NO: 60314

SEQ ID NO: 80406 - DNA, 76 bp, Mus musculus
cctaattgtattagcatgtatgtatgtatgtatgtatgtatgtatgcatgcatgcatgtatgtacttgctcttagg

SEQ ID NO: 80407 - DNA, 75 bp, Mus musculus
ggttagctctttggtttagtttgacttggtttttgtctagttgacacaagttagagtcatctggggagaaaaacc

SEQ ID NO: 80408 - DNA, 114 bp, Mus musculus
cagtgtaaaggagaatattttcagactatatgttttctggtgtggatttgagactcagtctctcataataccaaggtaaaattatatgtgacaaggttattttttgctagtttg

SEQ ID NO: 80409 - DNA, 75 bp, Mus musculus
aacaagatatggacagagacagaagagagcgggatatggtatccttttgtcttatatgatctgtagatgtttgtt

SEQ ID NO: 80410 - DNA, 110 bp, Mus musculus
acttaatagcaatataatgcctcttcgggggtctcagcttacgcatctgttaaatatctatagatctttcttgatgttaaattgctctcccatttggcaattggtgaagt

SEQ ID NO: 80411 - DNA, 73 bp, Mus musculus
gctgtagtatgagagctggattctggtggtaccatattgtattggcttctattgattatgttcttgtgcttgc

SEQ ID NO: 80412 - DNA, 78 bp, Mus musculus
tttgtcattaaagggagccaggacggggacagaggcaaagggcaaagcattctgatgtctgcctctctctgtgacaaa

SEQ ID NO: 80413 - DNA, 72 bp, Mus musculus
gagagtaaggtgtgtgtttctatatgtatgtgtgtgtacacacatatataataaaatgtgcactattttgtc

SEQ ID NO: 80414 - DNA, 112 bp, Mus musculus
caacatcagggcaatccacaacacagaagagggtttaatagtagtaggtagtaaacttatgtcctccattgcttattctacccctccacaacatgtgttttcccctctgctg

SEQ ID NO: 80415 - DNA, 78 bp, Mus musculus
gcgtattcagtgctcttgtgagcggtcatcttcccacaattaaaatgactgccagctttggtgttgtcactatactgc

SEQ ID NO: 80416 - DNA, 85 bp, Mus musculus
tttgaagacttgagttggctctctttggaagtcatttgaaaactaatgaagttaatagtaaattgtgagacttaatgttttcaga

SEQ ID NO: 80417 - DNA, 113 bp, Mus musculus
aagattaagattttcttcttagactttatccattactgttcctatgatccaatttccaggtcatgacacaagacagagtggatttagtagtgaatgtaagcactctttttctt

SEQ ID NO: 80418 - DNA, 105 bp, Mus musculus
acactttataaaaattatgtgtgaactgtatatatttttgtgtatgcatgtgtatgtataggtgtgcatacatgtatatggaggccagaggtcaattatggatgt

SEQ ID NO: 80419 - DNA, 76 bp, Mus musculus
gtattgcacacacacacttgtctgctctttgcttttactctgaaactgaagagtgaacctaaggctgtgtgcatgc

SEQ ID NO: 80420 - DNA, 60 bp, Mus musculus
gccactgtcactgtcactcctacagcactaaacaggtgggtgggggaagaggcatggggc

SEQ ID NO: 80421 - DNA, 107 bp, Mus musculus
tcatttaaagcagttgtaggaactcaggctgggtatttctgtcaatttcaatttatgtgtctattaattgtagagaagctcacttacttcatttaattgtggaaaga

SEQ ID NO: 80422 - DNA, 68 bp, Mus musculus
gagacttctaaagacactcactctctctgggggccaacaagagtggagacagtagtggtagaggtagc

SEQ ID NO: 80423 - DNA, 76 bp, Mus musculus
tcctggaactcattttacagaccaggctggcctcgaactcagaagtctgcctgtctctgcctcccaagtgctggga

SEQ ID NO: 80424 - DNA, 89 bp, Mus musculus
agtgctgcactcaggtcatcgtgcttgttagcggacagcgcctttaccgtctgctcgctcgctcgctcgctggctgccatagcagtact

SEQ ID NO: 80425 - DNA, 90 bp, Mus musculus
gttaagatttgctactttaggactgaagagatagctcagtggttaagagcactgactgctcttccataggtcctcagttcaattcccagc

SEQ ID NO: 80426 - DNA, 96 bp, Mus musculus
ggaaggaaccatgtctagggctctagggctggagagattgctcagcagttaagagcactgactgctcttccagaggtcttgagttcaattcccagc

SEQ ID NO: 80427 - DNA, 74 bp, Mus musculus
cttgtgacctacaatccagctttgcctcaccagcaattgggtggtagaggcaggcagatctctgagagctcaag

SEQ ID NO: 80428 - DNA, 113 bp, Mus musculus
ttgtgcagagtggctcagtggcagtagagaacagaagatggggtcatgaacacactttgtgtctcagtcactgttgtatggctgtgaagagacaccttgaccaaagcaacttt

SEQ ID NO: 80429 - DNA, 93 bp, Mus musculus
cacaagcatgagcgctgagagaaatgagtgagctggggtgctcctcagtgcaccgccgcgttaactccctctctggctggcctgtgtacagtg

SEQ ID NO: 80430 - DNA, 77 bp, Mus musculus
gcagtaattgctgtgtgtcactctgaatttgtggtgaggtgcacttcaggtcagaagtactcagggagcaaagctgc

SEQ ID NO: 80431 - DNA, 75 bp, Mus musculus
tgtgccaagttcaaggtatgtatgtatgtatgtacgtacgtatgtatgtatgtatgtatgtatacattttgcaca

SEQ ID NO: 80432 - DNA, 83 bp, Mus musculus
attagtttcagacctagttttattgttagggatagatttcagtttatgttttgggtgttgactagtgtctgattgtgattaat

SEQ ID NO: 80433 - DNA, 107 bp, Mus musculus
agagcccgtgtagacagcacaggacagcttgctcaggccacaggctggcagagtggcagtctgtggctgagtctgtgggtactgaggctgacacaggaaggggcttt

SEQ ID NO: 80434 - DNA, 97 bp, Mus musculus
ccatccaagtttgatggttccagggtgtggaaccaggtttcattgtggcctcttctgccaagggtcctctccatgctgtaccatgcaggctttatgg

SEQ ID NO: 80435 - DNA, 99 bp, Mus musculus
ttctgtatgatattattttaaaaattgtagtcacatgtatgtatatatgtatgtacatacatacatatatgtaagtattgaatgttattctttacaggg

SEQ ID NO: 80436 - DNA, 92 bp, Mus musculus
aatgacatcctaagaaacaaggtttgacacattttcttgttttttgaagtcagttgagaagaaaaagttaaaaagcactttagggatgcatt

SEQ ID NO: 80437 - DNA, 113 bp, Mus musculus
cctctgatctctgcatgtgggcggtggcaggcacacagacagacagacagacactatttttttaaaaagtccatatcaaggtgtgttctgcttggtcattgtctagattctgg

SEQ ID NO: 80438 - DNA, 84 bp, Mus musculus
tctgtctgtctgtctgtgtgcatctgtgtgtgtgtctaggttttatgtgcacactgagtgcaggttcccacagaggtcatcaga

SEQ ID NO: 80439 - DNA, 80 bp, Mus musculus
ttttaatttccactgttaagaatgaagtcagtgagcaattagaggctgctggagtccccttatcagtggaagtcataaag

SEQ ID NO: 80440 - DNA, 66 bp, Mus musculus
gtccacagcagagagagtgctgaccggggaggcctgtccctctttatgccctcccctgctgtgtcc

SEQ ID NO: 80441 - DNA, 82 bp, Mus musculus
cattctctgtgtgtgtacataagtgtatatatatatatatatatatatatatatatatatatatgtgcatacacagtatgtg

SEQ ID NO: 80442 - DNA, 69 bp, Mus musculus
atgtatgtatgtatatatgtgtgtatatatgttatgtatgtgtatatagatatgtatatatacatatat

SEQ ID NO: 80443 - DNA, 119 bp, Mus musculus
ttaggctggcctgaaatttgctctgttgaccaacctggcctcaaacttatagagagatctgtctgactctgtctcttgagtactagggttaaagatatgcagtagctaccatgcctggt

SEQ ID NO: 80444 - DNA, 84 bp, Mus musculus
ggctagcagaaatatgatcaaaacatattatgtatgtatgtatgtatgtatatacatatatattagaatatcataatgaaaccc

SEQ ID NO: 80445 - DNA, 94 bp, Mus musculus
ctaagccccagtctgtctgtctgtctgtctgtctgcagaagcttacatgtatcacccgtatacaggaaccacagagtccagaagtggtcattgg

SEQ ID NO: 80446 - DNA, 83 bp, Mus musculus
gcaccaacactatcagccagggatgttgctgcagccttcaaagggatgaagggagccagatgaaacatcttcccggtgggtgc

SEQ ID NO: 80447 - DNA, 107 bp, Mus musculus
cttgttcagatcctaacctggaggaagcttctttgcctctctgtgtctctgccatctcatatgtaaaataggagtgttctagttacctaccaaaggactgttgcgag

SEQ ID NO: 80448 - DNA, 93 bp, Mus musculus
gctggtcacattgggtccatggaggctagggagacggctcagcgattaagagcactgacagctcttccagaggactcaggttctatccccagc

SEQ ID NO: 80449 - DNA, 81 bp, Mus musculus
gctaacaccagtgcagctgagtgggcctgtgcctgcctctggctctcacactctttctgctgtgttctgatgcctgttagt

SEQ ID NO: 80450 - DNA, 102 bp, Mus musculus
gacatgagctctcagctgctgcttcagtaccatgcctgcttgcttgcttgcctgcctcctgcctgcctgcctgaatgcctgcctgcctgcctgcctcctgtc

SEQ ID NO: 80451 - DNA, 67 bp, Mus musculus
ggccagcctaggcaatttattgagaacttgtttctaaataaataaatagatggctgggatgtaggcc

SEQ ID NO: 80452 - DNA, 88 bp, Mus musculus
tggggtccccaagatcccctgactctgtcagccactgaaagttctctaagagggtaggtgatgaacaaagttaggggccacttctcca

SEQ ID NO: 80453 - DNA, 75 bp, Mus musculus
gagagttatatgtcctgatctgtagggagctggggagacagacagactgactgacaaggtttggcatgggctttt

SEQ ID NO: 80454 - DNA, 59 bp, Mus musculus
acatacttatgtgtgtgtgtatatatatacatatatgtatatatacatatataacttgt

SEQ ID NO: 80455 - DNA, 76 bp, Mus musculus
cacagaccttagagagggagtggttggtctgagtgacatccttaggactgtctcacactctcatttatttcctgtg

SEQ ID NO: 80456 - DNA, 84 bp, Mus musculus
gtgtgtgtgtgtgcatgtgtgtgtgtatgtgtgtgcgtgtgtgtgtgtgtgtgcatgtgcatgtgcgtgtgcgtgctgatttac

SEQ ID NO: 80457 - DNA, 66 bp, Mus musculus
cctgccactctcagtcgctcccacctgcaagaaacaagagtgggagagctgagcagactggactgg

SEQ ID NO: 80458 - DNA, 110 bp, Mus musculus
gagtcacaatgacacagcctggaaatcaggtctgttcctagcccagggtctgagtctcactgacacagcctggatatcaggtctttccctgtgttgcatatttggggctc

SEQ ID NO: 80459 - DNA, 63 bp, Mus musculus
gttgagggtgtgatttagaagggacagttgttctctcctctgtcaatctttctctctcttaac

SEQ ID NO: 80460 - DNA, 78 bp, Mus musculus
aggctctggtttctcactgtgtgtgtgtgtcccctaaacagaccccctgttcctatacattgaagcattcagagtcct

SEQ ID NO: 80461 - DNA, 85 bp, Mus musculus
gacttctcttagtttcactgtgtctctgtttagtttctgtttccatgattgatctgtccattgatgagagtggggtgttgaagtc

SEQ ID NO: 80462 - DNA, 78 bp, Mus musculus
tctctgacttcagtccaatagttggttgtaaagtatctgtgtctgtctcagtcaactgctggttgggcctctcagagg

SEQ ID NO: 80463 - DNA, 74 bp, Mus musculus
aaggaaagcagagatggttctttcgtgagacatagtgtgttcatctgtgatctgtgtgagtcactctgtccctt

SEQ ID NO: 80464 - DNA, 95 bp, Mus musculus
tagagtgtactactgacatcatcatccactgttcagcaatcttattgttttttaaaggatgagtgggtgaatgtaattatgttgtgtaccttctg

SEQ ID NO: 80465 - DNA, 83 bp, Mus musculus
gagagctggctctgtccctctctggctgcagcattctgaagagcaggccctgcaccttgcctaggtagtacagtagagctctc

SEQ ID NO: 80466 - DNA, 113 bp, Mus musculus
tgtattcatgtaggtatagctgtggagatagctgtatgttgtacacatgtatgtatgtatatatgtgtacacacataaggaaaggtcatcactggctgcttttcttggaggca

SEQ ID NO: 80467 - DNA, 73 bp, Mus musculus
tgccttgtgccatcttctggcctctgtgggtaccagtatacacacggcacacagacagacagacacgcaggca

SEQ ID NO: 80468 - DNA, 95 bp, Mus musculus
ggcaacctgagtcagagtgagagagacagacacagaatgaggcaggaacaccagcctggccttcaccctggctttagtcaccttgtggaccccag

SEQ ID NO: 80469 - DNA, 63 bp, Mus musculus
gggactggattccagggtggacttcaaagcctgtggctcttcctctctgtgtctcagtttccc

SEQ ID NO: 80470 - DNA, 82 bp, Mus musculus
cagaaaaacagtatgtggagaaaggatgaaggtgaatgaggtcatgtctgtctgtctctgtctctctatctctgtctgtctg

SEQ ID NO: 80471 - DNA, 104 bp, Mus musculus
ggcctgtaataccaacgactagggaggctgaggcaggaggatctttagttcaaggcctgtcatgtctcagatgaaaaagtaaaagagggctggagatacaggcc

SEQ ID NO: 80472 - DNA, 108 bp, Mus musculus
gtgtatgtgtgtgtgcatgtgtatgtatatgtatgtttttatatgtgtgtatatgtttatgtatgtatgtatgcatgcatgcatgtatgtatgtatgtatgtatgtgc

SEQ ID NO: 80473 - DNA, 115 bp, Mus musculus
catatgtgtgtgttcgtgtgtgtatgcatgagctcatacacaagtgcatgtgcatgtgtatgtgcgcatgcatgtacgtgctcatgcatgaattggggagggatcagcatatctg

SEQ ID NO: 80474 - DNA, 105 bp, Mus musculus
gggtcaagaatgactttggggttggagaaatggctcagctgttaagagcacagactgttcttccagaggtcctgagttcaactcccagtaaccacatggtggctc

SEQ ID NO: 80475 - DNA, 85 bp, Mus musculus; identical to SEQ ID NO: 57439

SEQ ID NO: 80476 - DNA, 113 bp, Mus musculus
gcacctagtttactctcagagttctgtctttggtgactgaagagagtctgctccgtcaatagctgtagatgtcagtttccagagagagaggttactgcctttaaaagagttgt

SEQ ID NO: 80477 - DNA, 120 bp, Mus musculus
atgcagtgctcagagtggcagtagagggcattggatcccctgagaccagagttacagaagagtgtgagctgccaggtgggttctgtttgactttgggttctctgaaaaagcaactagtgt

SEQ ID NO: 80478 - DNA, 91 bp, Mus musculus
ctcaggtagatagataaatgccgtgaaatggacccaacaccagagagatgacatttgagttctgattttgatgtgtattctatggcttgag

SEQ ID NO: 80479 - DNA, 119 bp, Mus musculus
gcaagctggctcagaccttgcagccactgagaataagaccacctggggtgaagccttcccacctagatggttctattgttctgtcacctgccactgctcttcaagacgcctgctactgc

SEQ ID NO: 80480 - DNA, 60 bp, Mus musculus
ggtgacacatcagggagcatgtgactgaaggcagtgactcgctctctccctgcgtctatc

SEQ ID NO: 80481 - DNA, 117 bp, Mus musculus
gagagactatgtttaaaaataaagctacaggggctggagagatggatcagtggttaagagcactgactgctcttccagaggtcctgagttcaattcccagcaaccacatggtggctc

SEQ ID NO: 80482 - DNA, 97 bp, Mus musculus
cttggagaagggctcaaatccgactcagcagcagtcagagctagttctttctaatcttggagtactgccacagccaaggagtccagctagtcctgag

SEQ ID NO: 80483 - DNA, 104 bp, Mus musculus
tagtaagtatgtgcatgtgcaagtgtgtgctcgtgtgcgtgcacacatacatacatacatacacacacacacacacacacacacacacacacacacacactgac

SEQ ID NO: 80484 - DNA, 81 bp, Mus musculus
tagatatgtgtgtatatatgtgtatatgtatgtgtgtgatatgcatatgtgcaatttatatatgtgtatgtaatttgtctg

SEQ ID NO: 80485 - DNA, 80 bp, Mus musculus
agccccaagctgtgtgagcttatcatcatgggacttttgtgtgtgtgctcgtgactgagagaacacacagacctggggtt

SEQ ID NO: 80486 - DNA, 58 bp, Mus musculus
tgtctgcctgcctgcctgcctgcctgcctgcctgcggatgggtctgtgcaggtgaata

SEQ ID NO: 80487 - DNA, 109 bp, Mus musculus
agtagttgtgtgcttggatcctggtctgagatacattagtgttttatgagatttagttcatgtgtgtagatataaaaataacttagccaggtacgttgggaccaacact

SEQ ID NO: 80488 - DNA, 116 bp, Mus musculus
gaattaaacccatgtcctttgggagaacagacagtgctcataaacagagacatctatattttttattttatgtacactggtgttttgcctggatgtccgtgtggtgtgaggatgtc

SEQ ID NO: 80489 - DNA, 101 bp, Mus musculus
gaaagccagaagaggacattggatcattccctagtactggagtcacagatgattgacagctgtcctgtggtgctgggaatgaaatcaatatcttctggatc

SEQ ID NO: 80490 - DNA, 82 bp, Mus musculus
actgttagccatgggctaggtcttgacaaatggtacccaccactgtttttgttctagagttagccttgactcggctaattgt

SEQ ID NO: 80491 - DNA, 56 bp, Mus musculus
gcagtcaccgggagacccgccttggccctctgggtcctggcttctttggcggttgt

SEQ ID NO: 80492 - DNA, 151 bp, Mus musculus
gtgtgtgtgtgtgtgtgtgtgtgtgtgtgtgtgtgtatatatatatatatatatatatatatatatatatatatatacatatatatatatttatatatatatatacatatatatataggtgtgtatgtatttgtgtaaatgtttgtatata

SEQ ID NO: 80493 - DNA, 73 bp, Mus musculus
agctcagcagtacatggaggcctgcgctgtactggtgcagttgtatctgcctctcagtaactgtgtcagggct

SEQ ID NO: 80494 - DNA, 59 bp, Mus musculus
acagagaggaacggtaggagtggcagcctccctgcctgcctgcctgcctgcctgcctgt

SEQ ID NO: 80495 - DNA, 114 bp, Mus musculus
ctaaaatattcctgagtatgtcattatgcttgttctttgaaatgtatctatgtatgtatctactatgttgtaatttctttaagaacaaaacatggtgtataaggaataatatag

SEQ ID NO: 80496 - DNA, 76 bp, Mus musculus
ggcattttttcttttaatgactgatttttttctttttagtgactgatgaaagaggcagcccattgtgagtggtgcc

SEQ ID NO: 80497 - DNA, 77 bp, Mus musculus
gccaagttcttagggctaggacgtagcttgtatagtactggcctcttaagtgtgcatccttaggttctattacttgc

SEQ ID NO: 80498 - DNA, 64 bp, Mus musculus
atacatatatacatacatacacatatatatttgtatatatatgtgtatgtatgtgtgtgtgtat

SEQ ID NO: 80499 - DNA, 108 bp, Mus musculus
cactgtgcacattggcctcttgggataggccagatagttttaggacctttgcccctggctctgagtgtctctgtctcccagctgcctcaggagccctgactcactctg

SEQ ID NO: 80500 - DNA, 109 bp, Mus musculus
cacacattccccaaggaccctggaaaggcgacagactgaagtgaacatgtgcacagatgtctgtgtgtttactcaagtgagcagcccagatgttggtgcctgtgtgctt

SEQ ID NO: 80501 - DNA, 99 bp, Mus musculus
cctatgaccctgttccctgagaggacatggcatgtcactaaagttagaaacactgtgtgactcacagccaccgtggccctggtaatagtcggtcttggg

SEQ ID NO: 80502 - DNA, 95 bp, Mus musculus
tcacatcccaggcagctgcatggtccttccaggtcttagttctgaggagtcgaaagaagtctggaggcaggttgagcatggggacactggtgtgg

SEQ ID NO: 80503 - DNA, 85 bp, Mus musculus
cttcaagggggtgaggctttcacactgtcattttctcagatattcatttcaggcccaacagcgtggatttctcatgttcttcagg

SEQ ID NO: 80504 - DNA, 115 bp, Mus musculus
agaaaggcttggctccctggaaactgtcttctctgtggtacttgtgagtctgtctccctcagacagaaatcacaagctcagcatcgaccaagccaagagtgccagggccatttct

SEQ ID NO: 80505 - DNA, 124 bp, Mus musculus
ggggtgagagttgctgagattttgtctggcttgaggtttccaggtctgatgcatgctgtcgcagtctctctgagtttgcctgtgcatttgtcttgttgtgtctagaaaccacagttttgaagtc

SEQ ID NO: 80506 - DNA, 59 bp, Mus musculus
gtttttgtctctgtgggtacctgcatacatgtgacatacactcacagagacacacagac

SEQ ID NO: 80507 - DNA, 96 bp, Mus musculus
ctggacttcgtttgctccttacacactcattcactcaggacttcctctgttccccacaattacagtcactgattcatggtcagcaactgaggccgg

SEQ ID NO: 80508 - DNA, 61 bp, Mus musculus
gttccacttggggctggttgagcgtttgtcctggagatgactctgagctcagagctgggac

SEQ ID NO: 80509 - DNA, 95 bp, Mus musculus
acttactcctgggagataagcatgaatgctggccactggctgagttcatcaggagagaaacccacacaaggtccagcacgctcagcaggagaggt

SEQ ID NO: 80510 - DNA, 81 bp, Mus musculus
tacctatgtgagtactttgtctgcatgtacatctgcacaccagaagatggcatcagacaattgtgagctgccatgtgggtg

SEQ ID NO: 80511 - DNA, 94 bp, Mus musculus
acatcttccaagctgtcaagcacagacagatttcagtgtaaactaacatttaaatgctgttaacttatgaattggttttcagggttggtggtgt

SEQ ID NO: 80512 - DNA, 56 bp, Mus musculus
gtgtatgtgtatgtgtatgtgtatgggtatatgtatatgtatatgtatatgtatat

SEQ ID NO: 80513 - DNA, 118 bp, Mus musculus
ctcattggctggcttatagtttagctcatcattgtcatggcagcatacaggttctgcatctggatctgcaggcagcctgaagagacagtgagccaataggcttgacttgagtttctga

SEQ ID NO: 80514 - DNA, 104 bp, Mus musculus
tcattcccagccaggcatgtatggagacagaggcaggtatgtctctgtgagtcagcctgattgagttctgaaacagccagggctacatagagagtccctgtctt

SEQ ID NO: 80515 - DNA, 83 bp, Mus musculus
gtccatggtgatctgataggatacatgggacaatttcaatatttttgtatctgtggaggcctgttttgacaaattacatggtc

SEQ ID NO: 80516 - DNA, 75 bp, Mus musculus
tgtctgtctgtctgtctgtcttctgcgctgtttctctatgaaattggggcaaggcagccagcagctcccagcaca

SEQ ID NO: 80517 - DNA, 64 bp, Mus musculus
acagacagacagacagacagacagacagacaagtgtgagtatgtgtgtgagtgtgtgtgtgtgt

SEQ ID NO: 80518 - DNA, 93 bp, Mus musculus
gttatgacatacaaattattttgttttatttctaagacacatatttgtttttaaatacatgtctcattagagaggaaatagagatgtttaaac

SEQ ID NO: 80519 - DNA, 118 bp, Mus musculus
agtcacctggagttcaactactacagtgtcttttggattatgtaccactgtatgtgtgcatgtgcatgtgcgtgtgtgtgcatgtgtgctgttaatactgagagttagacttgtggct

SEQ ID NO: 80520 - DNA, 112 bp, Mus musculus
ggctgagacctctgagaagatgtaccttcttttaagttgtgatgagaacactaacgttgacaggtgagagtgtgcacacagaagctgacagcttctgggacaggtgggagcc

SEQ ID NO: 80521 - DNA, 79 bp, Mus musculus
gagagtgtgtatgtgcatgtacatgtgtgtatgagagagagagagtgctcgtgcatgtgtgtgtgtgcatgcatgcctc

SEQ ID NO: 80522 - DNA, 83 bp, Mus musculus
tgtaagatcatttgttcatgtagttttcatgtatgtatgtatgtatgtatgtatgtatgtgtcagtgtgggtatgagtttaca

SEQ ID NO: 80523 - DNA, 124 bp, Mus musculus
gccttcgagcaagtctgccagtgctcagacagtgtccaccctgaccccactgggtcttactctctgctctctctgtgtgggcttagcttccaggccaagcctctccccatggagacctcagagg

SEQ ID NO: 80524 - DNA, 126 bp, Mus musculus
ccaggaagctaagagacagatcagagagcggtagagttgtaaccacagtctgtcggtctgtccgtgtctggagtgctcgctgtatcaggacctctcaggttgtcttataggagtacaaagaaagga

SEQ ID NO: 80525 - DNA, 95 bp, Mus musculus
ctagggtgcatggtagatctactttagtttatttgaggaccctaaatactgattttcatgatggctgggatgatttgcatatgaaaaggttctag

SEQ ID NO: 80526 - DNA, 72 bp, Mus musculus
cattgtgtgttcatctgtgatctgtgtgagtcactctgtcccctggctctctttcagacataagtggcagtg

SEQ ID NO: 80527 - DNA, 78 bp, Mus musculus
aattgaggacagcataaatccagaccagccacagctacagagttaagactctgtctgtctgtctgtgtgcccccagtt

SEQ ID NO: 80528 - DNA, 61 bp, Mus musculus
gaatgtatatgtgctgtgtgtgtatatatatatatatacacatacatacatacatacatac

SEQ ID NO: 80529 - DNA, 73 bp, Mus musculus
ctgcatagctgtggctgtcctggaactcagagagatccacctgtctgcctccctgactgctggggtttaaaag

SEQ ID NO: 80530 - DNA, 78 bp, Mus musculus
gtaagtatttctctctggaagagaagtcagtgattttaaccactgaaccttctctccaggtccctaaaatgtacttgc

SEQ ID NO: 80531 - DNA, 64 bp, Mus musculus
gtgaagatgtatagacagagggattttcagtgggacacactgacaggctgcctgtatgtctcgc

SEQ ID NO: 80532 - DNA, 81 bp, Mus musculus
gctttctacctgtgtaaatgaacacatacacgcgggattgtcctccagcgtggattgtgacttttttattttcagtttagc

SEQ ID NO: 80533 - DNA, 114 bp, Mus musculus
tctgccatagatccgcgctgacaccctcatcaggaggatggaattggaaagttatgaagttgagaaaagagatgatccctagaagaggggaaaaatgagatgtgatttaacaga

SEQ ID NO: 80534 - DNA, 93 bp, Mus musculus
tggggtgaggccaggaaggtagggtagggggtgcagaggctaggcttgcggtaaggcttgtgcctcacagtctctgtcccttccagctcccca

SEQ ID NO: 80535 - DNA, 72 bp, Mus musculus
tgatggctctggactactgggaggtacagaattcattatgagttaggttttctacctgtttccaaggtatca

SEQ ID NO: 80536 - DNA, 97 bp, Mus musculus
ggtgtttaagtacttaacattggtttcttacttctatgtattttactgtatatatttaagtgaattttctgagatcaggttgacagaccaaacttcc

SEQ ID NO: 80537 - DNA, 117 bp, Mus musculus
ccttttccacggggagggatttgatgaagacatctcatttagggctcagtgttccaaggtctctcactttgtgtctggctgtgggtctctgtatttatttccatctgctgcagaagg

SEQ ID NO: 80538 - DNA, 91 bp, Mus musculus
gtccttcttaaaatcctctatcatcatcatgagaagtgattttttagatcctttagatcttgcttttccagagtgatagtgtatccaggac

SEQ ID NO: 80539 - DNA, 157 bp, Mus musculus
tgtgtgtgcgtgcatacatacatatatgggtgtgaatatgtgtatatatgtatctgtatatgtatatatgtgtatgtatctgtgtatgtatatgtgtgcctgtgtatgtatatatgtatatgtaagtatgtatctatgtatatatatatatatgtgt

SEQ ID NO: 80540 - DNA, 80 bp, Mus musculus
ctgaggcacatagtgagactctgtctctaaaagagggaggcatcagagtcaggagatagagtgaagggcgtgtgtatcag

SEQ ID NO: 80541 - DNA, 72 bp, Mus musculus
ctccagggagactgaagattctgggcactgggagccatgagaggctccatgaggagaagattcaggctgggg

SEQ ID NO: 80542 - DNA, 85 bp, Mus musculus
tagtgatcaacataaggagatggttaagcagcacataggctccctgggaaatgtgggctcgctctttctctctgtgttattatta

SEQ ID NO: 80543 - DNA, 75 bp, Mus musculus
ctgtctgtgtgtgtgtgtgcctatggacatgtctgtatacctgctgttgtgtgtctgtgtgcacatggaggacag

SEQ ID NO: 80544 - DNA, 73 bp, Mus musculus
agtgcttgctgacaggagcctgatatagctgtctcctgagaggctctgtcagtgcctgacaaatacagaagta

SEQ ID NO: 80545 - DNA, 71 bp, Mus musculus
tgtgtagtctttttcttatagacatttgggctgatcccataatttgtctactgggaacatgcacatacgca

SEQ ID NO: 80546 - DNA, 90 bp, Mus musculus
atatatatgtctgtgtagatgcaatcacttcaaagtttataaataatttaactatgaggattctgagtaaattttcatggatatatatat

SEQ ID NO: 80547 - DNA, 108 bp, Mus musculus
gactgtcctgcaggcaggtccaagtggggctctgcctctcactgactgacgattgattgatgatggaggacacagcaccacatgggcagtgccaccccaccagcagtc

SEQ ID NO: 80548 - DNA, 125 bp, Mus musculus
cacatgaacactgtgaagttgagtcagagcctcggatggggaggtagcttcctcagtcactctgtcaaactcccatagagtcagtgaataccctcatagccccggacatgatgtttaaagtcagc

SEQ ID NO: 80549 - DNA, 68 bp, Mus musculus
tcctataatatgacctcatagttttttttttttttttaaaggaagaggacctctgagggcttgtagga

SEQ ID NO: 80550 - DNA, 83 bp, Mus musculus
ttccactcttcaggcaaaatggaacaaggggagtagtagaggcatcatggattcccagccaagtgactgagcagagagaggag

SEQ ID NO: 80551 - DNA, 110 bp, Mus musculus
tgggggggttggctgtgtaaggatccctgggccttgctggtcagccagtctacccaaatctgagtcagtgagtctgtctcaagaaataaggtggaaagtgactgagggcc

SEQ ID NO: 80552 - DNA, 65 bp, Mus musculus
tcagtcactttccaccttatttcttgagacagactcactgactcagatttgggtagactggctga

SEQ ID NO: 80553 - DNA, 65 bp, Mus musculus
cttccttgcaatgatgggctgacgtcactgtctgttagtgacttctgtccttatggtaatgagag

SEQ ID NO: 80554 - DNA, 91 bp, Mus musculus
gtgcacttcgtcagctgagcccagtacagtgtctttcagcttctagatgtggaaaagtaattcattttaattgctcagtgattaagttcac

SEQ ID NO: 80555 - DNA, 127 bp, Mus musculus
tgtacactggagcacatgttgggtggcttttctggtccattgcgcgctctctctctctctgcgtgtgtgtgtgtatatacatatatacatacatacatacatgtatgtatataagtgtgtttatata

SEQ ID NO: 80556 - DNA, 106 bp, Mus musculus
atatatatgtatgtatgtatgtgtgtgtgtatatatatatatatatatatatatatatatatatatacatacacatacacacacacacacacacacacatatatat

SEQ ID NO: 80557 - DNA, 87 bp, Mus musculus
catctgttgcaaagtgaagcaaacatctgttagtgtgaagatctgacctgatctgaccggacagaggtcactgtgcacaacgtgatg

SEQ ID NO: 80558 - DNA, 77 bp, Mus musculus
aagacaactgactctccctctctttggaagccatcatccatccatagcttcttagtaaggggtaggttagtgcttct

SEQ ID NO: 80559 - DNA, 66 bp, Mus musculus
tgctggtgttcacagtgcatatagaggctggaggaaacttggtgtcttgctctgtcactctctgca

SEQ ID NO: 80560 - DNA, 56 bp, Mus musculus
gtgtctgtgcatccgtctctgtgtctctctggaggccagaggaagttgtcagatgc

SEQ ID NO: 80561 - DNA, 71 bp, Mus musculus
gttccagaagcacggcttccccggagcacataccggatgccgagggtgctctctgacagtctcactgggac

SEQ ID NO: 80562 - DNA, 101 bp, Mus musculus
tactatgggtgtgaaatgggctaagacaaagctcctgccttccagagtctcactgtctcacaggtgggggcggggcacactgcttttcacactataaagtg

SEQ ID NO: 80563 - DNA, 79 bp, Mus musculus
ccctgagagtcagacactctgcttcactgtcttctaaaaaatcacatctggagatgggaagatggggtgggaagatggg

SEQ ID NO: 80564 - DNA, 145 bp, Mus musculus
ggggaaggatctgccaggcttgtccccttggtttctatacctacaccctgagtagccatttccctgtctgtgtctctgtgtgtccaagttctcgattttatgaagacctcatctgcatgggatcaggggtggggtcatcctactc

SEQ ID NO: 80565 - DNA, 115 bp, Mus musculus
ggcacagacaccacatgaagaggggctggagagatagctcagcggttaagagcactggctgctcttccagaggtcctgagttcaattcccagcaaccacatggtggctcacaacc

SEQ ID NO: 80566 - DNA, 115 bp, Mus musculus
tccaaagacaacaatgagcaaaatctctgtctctatctgtctgtctctttcttacagatacagagagagagagagaaaaagtagagagacagggtgcgcgctggtggcagaggga

SEQ ID NO: 80567 - DNA, 92 bp, Mus musculus
gctgaaccttgcttggttgtctcactcactgagtcctttcagtgctttgtgcaaaggaaaggccaggactggaatactaatgcgtatcatgc

SEQ ID NO: 80568 - DNA, 70 bp, Mus musculus
gataggagggtcagagagagtgcacacaagctgtaatgttttatccagtcttcttggctctctttttccc

SEQ ID NO: 80569 - DNA, 60 bp, Mus musculus
gtatgtgcgcctgtgggggccagagatctatgttgggtgtctgtctccctgtgtgattac

SEQ ID NO: 80570 - DNA, 68 bp, Mus musculus
tatgcaaatatatatgtatgtgtatatatgtatatgtacatatatatatatatgtgtatatatatgta

SEQ ID NO: 80571 - DNA, 104 bp, Mus musculus
gtttcctgttccaatgcagaaacagtttgatgactttttcttttatagtaacagaacaaagaaagctgtaagtcaaggtgtgtctcacgtgcattggtggaaat

SEQ ID NO: 80572 - DNA, 118 bp, Mus musculus
agatctgtaataaatgtgtgagtgtgtgtgtgtctgtgtatatacacaaatatatatgtatgtatatatacacccacatatatagatgtacatacatacacacaaacatatatgtaca

SEQ ID NO: 80573 - DNA, 86 bp, Mus musculus
tgtttgtgtgtatgtatgtacatctatatatgtgggtgtatatatacatacatatatatttgtgtatatacacagacacacacaca

SEQ ID NO: 80574 - DNA, 64 bp, Mus musculus
gtatgtatgtattcgtgcacatgtttgtatgcatgtgtgtttatgtgcatttgtatatctgtac

SEQ ID NO: 80575 - DNA, 83 bp, Mus musculus
gaaaggcgtggctactcactctatgtcactgtctgccaggacttcctgctgaggtgactcaagagccccaggtcaagtctccc

SEQ ID NO: 80576 - DNA, 61 bp, Mus musculus
ggctctgtctggctgtgagccactgaggaagtgagtggttcaaccctagtgcactagagcc

SEQ ID NO: 80577 - DNA, 84 bp, Mus musculus
tcttttatctgtgtactctgtcgtcagggcggcgggcataatcaagttttccccagcgagccagatgagagagaggactaagga

SEQ ID NO: 80578 - DNA, 111 bp, Mus musculus
gctagaacggtgctcaggcatccgggacaagtttgttcccaccgtctctccctctcacgctgcatggagagcaagctgtgtctctgagaccaggaacgatgggcacagggt

SEQ ID NO: 80579 - DNA, 75 bp, Mus musculus
gtacatttgtatgtatgtatgtagtagatggtgtatgaatgtatgtatgtattatgtatgtatgtatgtatgtac

SEQ ID NO: 80580 - DNA, 76 bp, Mus musculus
gtatgccttcttcttgctctgtgggctccaggcacttgccagtgcacagacacacacacacagggaaaatgcatat

SEQ ID NO: 80581 - DNA, 92 bp, Mus musculus
agcactgagaccagaggaggatgtctaatgtctcactctgtcactcccaacgttaatctcttgagacaccatctctcactggacctggagct

SEQ ID NO: 80582 - DNA, 86 bp, Mus musculus
gcagctattcaaggctcagactcattctgtctcattagtaatgataggcacaaaacaaggtgaggggaagaacctttgaaggcagc

SEQ ID NO: 80583 - DNA, 65 bp, Mus musculus
gagagagagagagagagagagagagagagagagaatgtctgtctttctgtctgtctcagtgtttc

SEQ ID NO: 80584 - DNA, 105 bp, Mus musculus
catggggaggggtgaatctgcctaaggctgccagatgagtgggtggacagactgaagctggcattgaggcatctggggtgcttagtggggattcctctgggggtg

SEQ ID NO: 80585 - DNA, 62 bp, Mus musculus
gtgtgcatgtatgtgcatatgtgtgtgcttgtgtatgtgcatgtgcatgtgtatatgtgtat

SEQ ID NO: 80586 - DNA, 72 bp, Mus musculus
tcagctgcgtgtgtgtgcatgttcatgtgcacaaacacatatgagcatttgcatgtagaggccacatgttga

SEQ ID NO: 80587 - DNA, 95 bp, Mus musculus
tatgtgtatatgcacacatgtacatgggtgtgcacatgtgtgtgtatgcatggcatggtgtgtgtatgcatgtgcatgtgcatgtgtgtgtatat

SEQ ID NO: 80588 - DNA, 83 bp, Mus musculus
cacagaccatctgagtgaacacacacagcagctgagagcgcttcctcctcaccttgctgggtgtccctccctaagaatctgtg

SEQ ID NO: 80589 - DNA, 83 bp, Mus musculus
cttagatggtaaaacttgtgacagagcagagttagggtcatgttaatgtagctccaggcatttgtctacacctttctgctgag

SEQ ID NO: 80590 - DNA, 69 bp, Mus musculus
tgtatgtatgtatgtatgtatgtatgtatgtgtgtataatatatgtatatacatatatgaatatatata

SEQ ID NO: 80591 - DNA, 136 bp, Mus musculus
catgtgtgcacatggtgtgtaaaataggtgagtatgcatatgtgtatgcagttgtgtttgtgtatatatatatgtgtgtgtgtatatatgcgtgcctgtgtgtttagatatgtatttgtgtatgcatatatgtatg

SEQ ID NO: 80592 - DNA, 135 bp, Mus musculus
acacacacacatatgtgtgtgtatgtgtgtgtatgtatgtataccatatatatgtttgtaagtatgtatatatacatatgtacatacacacgcatatatatgtttgtatgtatatatatatgtatatatacatat

SEQ ID NO: 80593 - DNA, 67 bp, Mus musculus
ggaagtccccgtgcttctgcatgggacagccagtccaactacgtgtcagaagtcagagtggggatcc

SEQ ID NO: 80594 - DNA, 115 bp, Mus musculus
tgattgacaggaacaacatccctgctcttccctttaggcctctgtctgtgcctgtgctggccagaatgccaggacccacagagaggagcatgcttgctggttgcatgtccagtta

SEQ ID NO: 80595 - DNA, 98 bp, Mus musculus
gagttgaatggaggctagagagatggctcagcggataagagcactgactgctcttccagaggttctgagttcaaatcccagcaaccacatagtggctc

SEQ ID NO: 80596 - DNA, 95 bp, Mus musculus
ctggtggttttgcaagatgtgtgtgcatgtgcatgtgtgtgggttcatgcacacatgtgcatgtgtggcagccacaggggtcttcctcttccact

SEQ ID NO: 80597 - DNA, 116 bp, Mus musculus
gctcctctatggcttctgcatcagttcctgtcttcagcttcctaccctgagtctcttcagtgatgagtgtgagctgaaaaattctaagctgaaacaaagtttcctccccaagttgc

SEQ ID NO: 80598 - DNA, 102 bp, Mus musculus
aaatgtatatatataaaatacatatatatgtgtatatatatgtgtgtatatatacacacatatatatgtattatacatatatatgtatatttatacatacat

SEQ ID NO: 80599 - DNA, 125 bp, Mus musculus
gtctgaccatggaataagaaacatgtaggggggctggagagatggctcagcggttaagagcactgactgctcttccaaaggtcctgagttcaaatcccagcaaccacatggtggcttacaaccat

SEQ ID NO: 80600 - DNA, 86 bp, Mus musculus
gacttctctgctggggctctgcaaagacaacagaggtgagagtgcacacagcttagacctttggtgttgtgcccactcccggagtc

SEQ ID NO: 80601 - DNA, 79 bp, Mus musculus
cccagtcactgatcaaggtgggccccgggtcgtcgcactgttcccgttctgcactgactctgtgattctgtgactgtgg

SEQ ID NO: 80602 - DNA, 85 bp, Mus musculus
gaccgtggtgatcagataggatgtatgggataatttcaatatttttgtatctgtggaggcctgttttgtgaccaattatgtggtc

SEQ ID NO: 80603 - DNA, 72 bp, Mus musculus
ggaggaagtgtgtcactgggggtgggctttgaggtttcagatgctcaagccaggctcagtcacactctctct

SEQ ID NO: 80604 - DNA, 77 bp, Mus musculus
caggtcctctgtttatatattatagttttcagatcatttttatgagactactgggtgtgtaaatgagtaggtctctg

SEQ ID NO: 80605 - DNA, 118 bp, Mus musculus
gttctgtaattaggtatgtggcaagatcagtctgctggaggagtgaatagagtatttgttgaattattatcttctacattctgtctcagatgatcccaaagaaaccatgtggaagggc

SEQ ID NO: 80606 - DNA, 76 bp, Mus musculus
ctagacaggagctcagcttctcagggctcttctgtacgacactgaatcactctgagactctgagaaaacccgctgg

SEQ ID NO: 80607 - DNA, 118 bp, Mus musculus
gcaaagattctttgataccacttccccagaggatgtgatatgttgctttccatttgtattcagtgttatacgagtcgggagatcagcatctcagcatcatgggagtgtgtgtgtgtgc

SEQ ID NO: 80608 - DNA, 90 bp, Mus musculus
agggggagagcaggggatagtctaagcacattgactgacataggcccatttggtcagtcagtcattcagtcacttattcattctctacct

SEQ ID NO: 80609 - DNA, 102 bp, Mus musculus
gggcctctaggaaagcgattcccccaggtagaatggattcccatgcaaccgagtctttgggtccctgcctggctctgtggaagctgaagccctgggaggctc

SEQ ID NO: 80610 - DNA, 56 bp, Mus musculus
atgtatgtatgtatgtatgtatgtgtgtacctatacttacatactcatatatacat

SEQ ID NO: 80611 - DNA, 80 bp, Mus musculus
atctgcatctgagtctgcgtgtctgtgagtctgtgagtctgtgacagggctttagacttcagatcctggatcagtgagat

SEQ ID NO: 80612 - DNA, 106 bp, Mus musculus
tgcatgtatgtgtgtacatgtgtatgcaggggtgtgtgagcatgtgcatgtacatgcaggcatgtgcatgcatatgcatttaggtgtgtgtctgcatatgtatgca

SEQ ID NO: 80613 - DNA, 136 bp, Mus musculus
gtgtatgtaggtgtgtaaaagtgtgtgcaggtgtgtgtgcatgtgtatgcaggtgtgtgtgtgagcatgtgcatgtacatgcaggcatgtgcatgcatatgcatttaggtgtgtgtctgcatatgtatgcaggtgt

SEQ ID NO: 80614 - DNA, 72 bp, Mus musculus
acgcacatgcgtatgcatgcgtgtgtgcaggtgcatgtgcatgtgcatgtgtgtgtgtgtgtgtgtgtgtgt

SEQ ID NO: 80615 - DNA, 56 bp, Mus musculus
gcctcctaagtgctggggttaaagttatgtgctaacacacccagcttagataaggc

SEQ ID NO: 80616 - DNA, 88 bp, Mus musculus
tggctggcgctctgggtgtctgtccctcagtgtcacgcgccgtaaggactgagggatccatgctgatgatgcagggatgggctggcca

SEQ ID NO: 80617 - DNA, 85 bp, Mus musculus; identical to SEQ ID NO: 57470

SEQ ID NO: 80618 - DNA, 87 bp, Mus musculus
atgcttgggaaatccccgtgagagagctgggtgttggcttttcctctgagactcagacactccctggtaactattgttcccaagtgt

SEQ ID NO: 80619 - DNA, 113 bp, Mus musculus
cttgagagaagacagaggccttagcacccagaagagtctgtacacacaggttatgctcagtcattctctgggtcacacactcccttctggctaaaaggccctgctgctccagg

SEQ ID NO: 80620 - DNA, 63 bp, Mus musculus
tatgtatgcatgtatgtacatatatgtgtcaatgcataatgtacatatgtgtgagtgcatgta

SEQ ID NO: 80621 - DNA, 70 bp, Mus musculus
tgtatcatctgtaattccaagtccatgtcctcttttggcctttatgggcaccaggtatgcacatggtaca

SEQ ID NO: 80622 - DNA, 87 bp, Mus musculus
gagagaggcccctggaatggggaggcactctaaccacatcccttggctcttggcttagagacactcaccctctgtggggcatggctc

SEQ ID NO: 80623 - DNA, 76 bp, Mus musculus
gtctgtggtgatttgataggttgcatgggataatttcaatatttttgtatctgttgaggcctgttttatgacagat

SEQ ID NO: 80624 - DNA, 74 bp, Mus musculus
cctgtgtgtgcctgtgtgcttgcgcacgtgtgtgtgtgtgtgtgtgtgtgtgtgtgtgtgttggaatagaaagg

SEQ ID NO: 80625 - DNA, 72 bp, Mus musculus
ccacactccttgactggtttgcctacaaagtgctaaatccagcctggtccaactgtcagtcactgtgtgtgg

SEQ ID NO: 80626 - DNA, 97 bp, Mus musculus
ggatccttttccttcagtctgtccagtgctggggttttagacagaaatgtctgtgctcagcttccactgttcttttaacatgatgtgaaaatgctct

SEQ ID NO: 80627 - DNA, 101 bp, Mus musculus
aacttgtgggatcatgtatgagctatcagccacggctccagcacaatatccacctgcctgcctgcctgcctgcctgtcaccatgcatcttgccataatgtt

SEQ ID NO: 80628 - DNA, 67 bp, Mus musculus
tgtctgcatgtctgtgtgtctgtatcagtgtatctacatctgtgcaggagccagcagaggtcagaga

SEQ ID NO: 80629 - DNA, 100 bp, Mus musculus
gcgagagagtgacttggccacatagtgtctctcccctctgcacacataaatgtcacactgtctctatgtggtctcacttcacttaaaaattaaagctcgc

SEQ ID NO: 80630 - DNA, 89 bp, Mus musculus
aggtgaagaatgagacaaagaagaaagtatttactgtgctgttcttgctgtgtttttatttgcctgtctctgtctctgtctttctatct

SEQ ID NO: 80631 - DNA, 117 bp, Mus musculus
caactgtggcaagagctttgagaggcttgtgagcaagagaatggggccacttagaatagagagaagagagtgccctccctcgtgttcatgagactagcaccccaatgagccagtttg

SEQ ID NO: 80632 - DNA, 64 bp, Mus musculus
tatgtatgtatgcatgtatgtatgtatgtatgtatgtatgtatgcatgtatgcatgtatgtatg

SEQ ID NO: 80633 - DNA, 69 bp, Mus musculus
catgcatgtctacaggtcatctgatgagtcagtttccaactgaggtatgtatgtatgtatgtatgcatg

SEQ ID NO: 80634 - DNA, 85 bp, Mus musculus
cccagagtcatatgtgacaccttgattcctgtcagaagaaacacagctgtatggaatgaaagagcaacaggaggtggctctaggg

SEQ ID NO: 80635 - DNA, 75 bp, Mus musculus
tctgggtcactgtcaggagacagctacaaaagcacggcagcctctctgtttgcctgttcagtcaagcgccacaga

SEQ ID NO: 80636 - DNA, 78 bp, Mus musculus
atgtatgtatgtatgtatatgtatatatcaatgccatatataataacattatatatacatatatatacatacatatat

SEQ ID NO: 80637 - DNA, 128 bp, Mus musculus
agtgtatctcactgctgtgctagtattgttgtattgctattatcacatgatagtactatcagtttatcattatatatcaaggccaaaatactatcagcagcagcagcagcatcacttgacagcagcag

SEQ ID NO: 80638 - DNA, 81 bp, Mus musculus
gtgctgctgaaaaccacagagcaggcttaggcttttggaatggattcaaagaaagctttcactctctgacagtcacagtgc

SEQ ID NO: 80639 - DNA, 88 bp, Mus musculus
tggaggccctgatccacactctgtccctgagtagctttatggctggataggccagcatttggtgagggtataaggagaccccaagagt

SEQ ID NO: 80640 - DNA, 75 bp, Mus musculus
tggtatatatgtatatttgtatgtatgtatgtacgtatatatgcgtatatatatgacttataaaacatctatcca

SEQ ID NO: 80641 - DNA, 95 bp, Mus musculus
gttcctctcagaggaatgagatgtgagctcttaacattttctaattctcacaggtagagcacacatttttactacactcctcttgagggtgggac

SEQ ID NO: 80642 - DNA, 80 bp, Mus musculus
gatttggatgaagtgtgccactgggaatgggctttgaggcttgaaaagcccagacaggcccagtgtctttctctctgtct

SEQ ID NO: 80643 - DNA, 90 bp, Mus musculus
atcgtgggcatacagcagcaggctcttgagccctgactctgaaccgcatccctgccgggaatgatcagtggctggagctcccctaacgat

SEQ ID NO: 80644 - DNA, 61 bp, Mus musculus
gatggcagcattaagggctctgagggctccaaagtctctcactctctgcacgttgtccatc

SEQ ID NO: 80645 - DNA, 91 bp, Mus musculus
tatatatcatatgtgtagatattatgtgtgtatatatgtatatgtgatacattatgtatatatacatatatgtgtgtatctatgaaatata

SEQ ID NO: 80646 - DNA, 115 bp, Mus musculus
ggtggccataggtaatgaagtggaaatgagggctagagagatggctcagcagttaagagcactgactgctcttccagaggttctgagttcaattcccagcaaccacatggtggct

SEQ ID NO: 80647 - DNA, 88 bp, Mus musculus
actgtttatgtgtgtgagtctctgcctgtgtgggtctgtgcactgcatgcatgcctagtgcctggtggaggtcaaaagagggtgccag

SEQ ID NO: 80648 - DNA, 84 bp, Mus musculus
gtggcccctacagaggggtgactgtcctcactccatgtttcccaacccatagtgaagagagacagcacagaatgtagggatcat

SEQ ID NO: 80649 - DNA, 89 bp, Mus musculus
gtaactggaaaacatgggctgcagagatggctcagcggttaagagcactgactgctcttccaaaggtcctgagttcaaattccagtgac

SEQ ID NO: 80650 - DNA, 121 bp, Mus musculus
ctctgtttctaagtttgtcagtttgaatgcctgaggcccaggctgtctgtggcactgtctgtctgtctgtctgtctgcttctgttgtctggatttggtaaaaaaaaaaaaatagtagaaat

SEQ ID NO: 80651 - DNA, 78 bp, Mus musculus
actcactctgtagaccaggctggcctcagactcagagctctgcctgcctgcctgcctgcctgcctttgctttctgagt

SEQ ID NO: 80652 - DNA, 80 bp, Mus musculus
gtcagagatacagtcaccctagacttgcttgaggagtttgatccatggagaatcgagcaaaggctgtctctgtctctcac

SEQ ID NO: 80653 - DNA, 102 bp, Mus musculus
tcttgtgtatgtatggatgtctgttggtctctctgtgtatatgtgtgtgtgtactgtgcatattgatgccacaggccaacattagatatcctcttccttcac

SEQ ID NO: 80654 - DNA, 75 bp, Mus musculus
gctctccacaagctctgtctcacactgtccctggagccaccccatgcgctgacactgtgacctgacaagctgagc

SEQ ID NO: 80655 - DNA, 79 bp, Mus musculus
gggtaagctggtgggcttaatcagaaaggggttcccagtgggaagagatctctttctgacagctaaggacagagggccc

SEQ ID NO: 80656 - DNA, 118 bp, Mus musculus
ttacaggggagggagtgggctggagagatggctcagcagtttaagagcactgtctgctcttccagaggtcctgagttcaattcttgacaaccacatggtggctctcaaccatctgtaa

SEQ ID NO: 80657 - DNA, 66 bp, Mus musculus
cattttctgtgtatgtgcatgtacatgtgcctatgggtacatgtggaggccagaggtcagaaactg

SEQ ID NO: 80658 - DNA, 81 bp, Mus musculus
tggtgatctgataggatgcataggacaatttcaatatttttgtatctgttgaggcttgttctgtgaccaattatgttgtca

SEQ ID NO: 80659 - DNA, 97 bp, Mus musculus
cagccaaggttacttagagcctgtctcactccctctttctaaaagaatgtgctgctggagcgagcgggagaagggaagggggttgggtgaagagttg

SEQ ID NO: 80660 - DNA, 81 bp, Mus musculus
gtgtatgtgtgtgtgtccatctacatgtgtgtgtgcacacacgtgccactggaaataccttgaaagaaatgacaaatacgc

SEQ ID NO: 80661 - DNA, 84 bp, Mus musculus
tatatgcatatgtgtgtctatgtatatatatatatgtacatatatatacatacatacatatatatatatatatatatatatata

SEQ ID NO: 80662 - DNA, 68 bp, Mus musculus
ggaacagaacaaggctttgaggagtctgcagcacatgctgtttgttgacaccttctgtctgtctgtct

SEQ ID NO: 80663 - DNA, 60 bp, Mus musculus
atgtatgtatatgtgtgtatatatctatataagtatatatgcatatataaacaaatacat

SEQ ID NO: 80664 - DNA, 74 bp, Mus musculus
gagagctacatacacacacacacacacacttccaggccagggcctgctttcctgtgtgtgggaagtagcttctt

SEQ ID NO: 80665 - DNA, 85 bp, Mus musculus
cccaagtctctctctggctctcagagcccagcaggactccagcttcttcctctgcagcctgagggcaggattagagcttgccagg

SEQ ID NO: 80666 - DNA, 89 bp, Mus musculus
tttgttggcagaagtgtgtcactgggcatggactttgaggtttcaaaagcccatgccaggcccagtgtctctctctctctgcctacagg

SEQ ID NO: 80667 - DNA, 117 bp, Mus musculus
atatgtatatatgtatatgtatgtatgtatatatacacacatatatgtatatatatatatgtatatgtgtatatatatatatatatatatatatatatatatatatatatatatata

SEQ ID NO: 80668 - DNA, 89 bp, Mus musculus
atatatgtgtgtatatatacatacatacatatacatatatacatatgtgtgtatgcatgtatgtatgtttgtatgtgacatgcatgtgt

SEQ ID NO: 80669 - DNA, 111 bp, Mus musculus
ggaagcagggctctctgccccagagttgcctcaccgccctctgtctgactgcctgtttctgttatcagggtagaaggggtgggacatcccttctccttgcctatgaatggc

SEQ ID NO: 80670 - DNA, 66 bp, Mus musculus
gtcactctctctgtcagcccttagtttcctccccagcagaatggggggggggggttaaggaagtgc

SEQ ID NO: 80671 - DNA, 75 bp, Mus musculus
aagccttgagcctctctcactgcctgatgagtttagatcaaccatactggaactgactgggaggctctcaggctt

SEQ ID NO: 80672 - DNA, 83 bp, Mus musculus
ccgaaatggacacgtgggcgagaaggctggggaggaccacagtctgtccctgggtctctcctcacttttggtgtaacttttgg

SEQ ID NO: 80673 - DNA, 75 bp, Mus musculus
actaagatctcaatgcaacttagactcagggcagccaggtgcttacagtctgagcactcagccggggattacagt

SEQ ID NO: 80674 - DNA, 101 bp, Mus musculus
ggcagttctgatttagctagaaatgaagtagtcatggtgttcccaggttctgatttcgttctctaaatcactctgcctcttcaatgcctgggaagtgctat

SEQ ID NO: 80675 - DNA, 109 bp, Mus musculus
ggtcaactccgctcgctctgccctgctcgctccagccctaaagtttatttattattatacataagtacactgtagctgattgggacacatcagaagagggcgtcagatc

SEQ ID NO: 80676 - DNA, 87 bp, Mus musculus
gcatagatcagaaggcagatggcagggtttttgggaagatttatttatttatgcttgtgagtacactgtagctgtactgattgttgc

SEQ ID NO: 80677 - DNA, 84 bp, Mus musculus
aggagagatgttcatttgtttgggacggagatcttgagatatctatctatctatctatctcctggctaatgttgagtttttcct

SEQ ID NO: 80678 - DNA, 92 bp, Mus musculus
gtgacctgggacccagagacactcccactcagggacagtgtggcccaaggccctcttccctgccttgtgatgtctgttgtgccctataaagc

SEQ ID NO: 80679 - DNA, 115 bp, Mus musculus
ttgataaaaagatgtatgcttttatgtgcatttgtattttgcctgcctgcatgtatatatgtgggtcactgtgtgcctgatgatgcctttggatgtcagaagtttttttggttga

SEQ ID NO: 80680 - DNA, 72 bp, Mus musculus
tgatggcagagcagagggagcaggtagacatctggagcagcagctgacagtctgcatctgcatctgtgaaca

SEQ ID NO: 80681 - DNA, 68 bp, Mus musculus
gaatctctagattagagcggacagacactctttctgagtttctgttttgctccagtatcaggcatttc

SEQ ID NO: 80682 - DNA, 74 bp, Mus musculus
aggtgctgactcactcagttactcttaccacctcaaatcctccttgaagtttgagaggctgtctgtgtcaccct

SEQ ID NO: 80683 - DNA, 98 bp, Mus musculus
gtagaacaggctgacttgaacttacagatattctcctgcctctgtctcccagtagtagatctctgattgtctgtctttctgtctgtctgtctgtctat

SEQ ID NO: 80684 - DNA, 128 bp, Mus musculus
aggagatgggggtggggtgggcagaaatcccgtgggtactatcccaggccctctgccagtgtctctccttccctgagaccagacattggctggaaaggcccagaatgttccaggcaataggtatgaca

SEQ ID NO: 80685 - DNA, 130 bp, Mus musculus
gcttgccggggcctaaattcagtaacctggcacttgggaggcagaggcagacagatctctgtgagctcaaggccagcctggtctatgaagtgagttccaggacagccagggctacacagaaaaacctgtc

SEQ ID NO: 80686 - DNA, 73 bp, Mus musculus
gtgtgtgtgtgtgtgtgtgctatatgggtgtgtgatgtatatgagtgtgtgtgcatgtgcatatggtgtatgc

SEQ ID NO: 80687 - DNA, 71 bp, Mus musculus
ctgtactatcaaagctcgcctcaggagagcctgtcctcctcaggctgcctgggagtctctgtcagtcacag

SEQ ID NO: 80688 - DNA, 91 bp, Mus musculus
aagttggtgtttcctgatcctggcagtaacagatattcttttctagagagaaaagacagtgaactgtcgggcataatataatttatcactt

SEQ ID NO: 80689 - DNA, 92 bp, Mus musculus
cagcattgacttctagcttgtagaagtgcacacactgggctggagagatggctcagtggttaagagcactgactgcacttccagaggtcctg

SEQ ID NO: 80690 - DNA, 96 bp, Mus musculus
tatcctggagaggctagagagatggctcagcggttaagagcactgactgctgctcttctgacggtcctgagttcaaatcccagcaaccacacggtg

SEQ ID NO: 80691 - DNA, 105 bp, Mus musculus
tgaggacatatccattgaaaaccttggcttgcttctattttaagaactatgtataaattttcaagtagtaaaggctatttctccattgtggatagcatattctta

SEQ ID NO: 80692 - DNA, 69 bp, Mus musculus
gccgcaggaactcacactcagtctcactgctggggacaacagggactgaggactggggtagactgcagc

SEQ ID NO: 80693 - DNA, 128 bp, Mus musculus
tggaagttcccaccatcctcccagcacaaagaggctggaaaaggacaaggtaacttccatgtgtccctctgagtgtctgggagcacttccactattccggtgggaggatctgccaggtctagaaggga

SEQ ID NO: 80694 - DNA, 121 bp, Mus musculus
agaatacttggcagagggagggcggggctggagggtgtgggctgaatgtcctggtgtttactgtctgactttctgtctctttgcagtagtattttgccgttgagtaagtgtccccagctcc

SEQ ID NO: 80695 - DNA, 107 bp, Mus musculus
gctatctatctgtctgtctgtctacctatctatttttgtttatttatcgatctatttttgtttacttagaagactcaggttggcctcagattccctatgtagatagc

SEQ ID NO: 80696 - DNA, 61 bp, Mus musculus
acagacagacagatgggcagagggggagagagggtgtgtctctgtgtgagtgtgtgtctgt

SEQ ID NO: 80697 - DNA, 90 bp, Mus musculus
attggactctgggctattttaaagaaagtcagaaatagggctcagatggttaagagcactgactgctcttccagaggtcctgagttcaat

SEQ ID NO: 80698 - DNA, 104 bp, Mus musculus
actcaatcactaaatatgtgccacactcatgtatatgtattttattttctaaatctctggacaatttgggataggcatggtagcacacttttgtgagacagagt

SEQ ID NO: 80699 - DNA, 85 bp, Mus musculus; identical to SEQ ID NO: 57439

SEQ ID NO: 80700 - DNA, 69 bp, Mus musculus
agagaaaaaacatctcactgtggaagctgtagtgtggcacagtgtgtctcacagtgtacccttttgtct

SEQ ID NO: 80701 - DNA, 80 bp, Mus musculus
tgtcacccaccctgcctgtgagcctcacctccccaaaaattacagagtaaagatggcctgctaagctgggcatggtggca

SEQ ID NO: 80702 - DNA, 79 bp, Mus musculus
aacagcttgggtgcttatttaacatactgaaaaggccctgcctccaggttctcccagcgtgcctcagtccctacctgtt

SEQ ID NO: 80703 - DNA, 107 bp, Mus musculus
tttttatttactttatttcatgtgtatggggttttttgcttgtatgtatgtatgtatgtatgtatgtataccgtgaacaagcctggtacctgaggaggtcagaaaag

SEQ ID NO: 80704 - DNA, 56 bp, Mus musculus
gcgatgtatgtatgtatgtatgtatgtatgtactatgcatgcatgtgtatggtagc

SEQ ID NO: 80705 - DNA, 91 bp, Mus musculus
ggtagagtgtgacagttaaatcattttaaatatttgtcaaatcctgtcaaatagttaagatgataaatttttgctgaatcttaagtttgct

SEQ ID NO: 80706 - DNA, 71 bp, Mus musculus
agatatcatatatgtgtatctttatatattcacatataaagtgaaatatgtatacatatatatgtatatgt

SEQ ID NO: 80707 - DNA, 67 bp, Mus musculus
agagtctctctgtgtgtgcatgtgtgtgggcatgtgtatatatgcatgtgtgtgtagtagagtctct

SEQ ID NO: 80708 - DNA, 62 bp, Mus musculus
acagacaattacagagagcacacacagagaagtgtggtgtgtgtgtgtgtgtgtgtgtgtgt

SEQ ID NO: 80709 - DNA, 80 bp, Mus musculus
ggtgttgggaactgaatagtaggtgttcttaactgctgagccatctctccagcacttctactatttttcttcatgacacc

SEQ ID NO: 80710 - DNA, 85 bp, Mus musculus
tgtgagtttgaggacagcctagtctacatattgtgttttaggatattcagggctatgtagacagactctgtctcaaacaaaaaca

SEQ ID NO: 80711 - DNA, 91 bp, Mus musculus
ttttgtaaattctattttgtctcatagtaatgtaactcttgtggggagttcacctgagaagactgtgtggacattgtttaaggcaacagaa

SEQ ID NO: 80712 - DNA, 61 bp, Mus musculus
atattcatatatacatgctatatatatatatatgtatatatatatatgtatatatgtatat

SEQ ID NO: 80713 - DNA, 80 bp, Mus musculus
gggggcagggggctgagagatggctcagtggttaaaagcgctcactgactgctcttccagaggtcctgagttcaattccc

SEQ ID NO: 80714 - DNA, 68 bp, Mus musculus
cagagcagagaaatagaggtggaggaaggtttgagggccattcctgagaccctgtctctctgcccctg

SEQ ID NO: 80715 - DNA, 109 bp, Mus musculus
gtgtggtggcacaggtctgtaatctcagcactcagagggtggagacagaagaatcagagttcaagaccatcctcagttacatagttggtggctagcctgggctacctgc

SEQ ID NO: 80716 - DNA, 76 bp, Mus musculus
ctaaaggtgtcttagaaactctcaaaaggcaggatcctatttctgcctttagagatctaaaaaactatctatttgg

SEQ ID NO: 80717 - DNA, 71 bp, Mus musculus
agataaaggcaggaacggaagcagacaccatgaagaaacgtggctcgctgcctcgctctctggcttattct

SEQ ID NO: 80718 - DNA, 56 bp, Mus musculus
gcagttctgagaactgtgtgaggccacaaggcttccagggtcaggtttaaggcagc

SEQ ID NO: 80719 - DNA, 106 bp, Mus musculus
gattttctcttctctttcttttgtgtatatatgtttatgagtttgggtgcatgtgtttctatatatgaatatatgtatgtacacaagtgtgtgggggccagaggtc

SEQ ID NO: 80720 - DNA, 112 bp, Mus musculus
ggaggaaggatgtgtgtgtgtgtgggtggagctttgaggtttcagaagcttaagccaagcccagtgtctctctctcacttcttgctccctgcagacccagatgtagaactct

SEQ ID NO: 80721 - DNA, 73 bp, Mus musculus
acatgttttgtgcatgcacgaatgcacacatgcgtgcctatgtgtgtgtgactgtgagtgtgtgcatgcgtgt

SEQ ID NO: 80722 - DNA, 76 bp, Mus musculus
cagatggttgtgagccaccatgtgtttgctgagaattgaactcatctgaaagaacagtcagtgctcttaaccactg

SEQ ID NO: 80723 - DNA, 108 bp, Mus musculus
ggccattccgcaaaccaccagagcttacccaggactctcagtcacacagacattgtgatcttggaacctggagtcaagtccaagtccttctggtttgtaatttgagct

SEQ ID NO: 80724 - DNA, 115 bp, Mus musculus
tggatttgggaagtctgagcatctctaagagttagatgctaagactcagcctctctctctccacaaacacccagctttacatctcctcgtgagatcctgggatgtctgggagagg

SEQ ID NO: 80725 - DNA, 99 bp, Mus musculus
cttcctatatatggtaaaatcacacacagactctttcacatgctgtcaccttcagtgcttagaatgaattgggataaatggttttgacagtgtaggaag

SEQ ID NO: 80726 - DNA, 86 bp, Mus musculus
tttctatctctgtctgactgtcttcatctgtagagtttgtaggatgggcatacagcattgagattttggggggcgggggatagcga

SEQ ID NO: 80727 - DNA, 96 bp, Mus musculus
ccagaatgttacgtggttggagtcataggctgtagagtcttttcaattgagcttctttgcctctgtgtctcataggcacgttggtacatttcttgg

SEQ ID NO: 80728 - DNA, 104 bp, Mus musculus
gccctgtattgctcaatgcatgcaatataatggtgtagtttatttgaatatatgtactttatcatatgagctgcgttctgttttattgttgtattagtcagggt

SEQ ID NO: 80729 - DNA, 88 bp, Mus musculus
taggccagctgggcaggactttctttctctctctcagaatcttcactggtctcgggaagctgttggctctgagctgtcttgagaggga

SEQ ID NO: 80730 - DNA, 75 bp, Mus musculus
actgtgggatgactgggtgagacctgagagtcagctctgttgacatgttcaaggtgtcactctgatactgatggt

SEQ ID NO: 80731 - DNA, 78 bp, Mus musculus
tatttgcatatatacttgggagggtaaatatgtatttgtgtatgcatgagtatgtctctgtctgtgtatatgcgtatg

SEQ ID NO: 80732 - DNA, 60 bp, Mus musculus
tgtgggtgtatgcacagatgcatgagcgactctgtgtgtgtgtgtgtgcatgtgtgtgca

SEQ ID NO: 80733 - DNA, 116 bp, Mus musculus
gcatgtacacacacacatttaaataaggatgtcaataaattttaatactgtctctttagatctttgggattttaaatattcttctatttcaattttgtgtgtgtgtgtgtgtgtgt

SEQ ID NO: 80734 - DNA, 66 bp, Mus musculus
ctgccaccacatccagctttgtacatgggttccaggggtcaaaccagagttgtcaggctggggcag

SEQ ID NO: 80735 - DNA, 77 bp, Mus musculus
gcatgtgtgagtgcatgtgcatgcacatgttatgtgcctgcctgtgtaggtgtgtgtgcaggtgtgttccctcatgt

SEQ ID NO: 80736 - DNA, 75 bp, Mus musculus
gagtgggaggaagaagttcctgaagtaaaatgacttcagaaattatctgggtcactcagtcgctctcctccattc

SEQ ID NO: 80737 - DNA, 94 bp, Mus musculus
gtggtaaaagttaagctagtatcatagtcttttaaacctggatagattgtaaccatttttccttcactctgacactgtcttattctgctgccac

SEQ ID NO: 80738 - DNA, 72 bp, Mus musculus
ccctgtgtgacggtcagtgcctgcctcctcctcttttgaaagggagagagtgtttatggacagatgacaggg

SEQ ID NO: 80739 - DNA, 113 bp, Mus musculus
agttggaaaggcctatgagtagccatttgtatgtgttcaatgaccacatttgcttctgtgaacctctctctcacacacatgggtgctggaatctgaacttgggccgttatgct

SEQ ID NO: 80740 - DNA, 92 bp, Mus musculus
aggaatcttgtcactgcactgagagcctcacttcaccaggattactctaaagtctagaggaagaaaggtaatgagtcagctaaggctttcct

SEQ ID NO: 80741 - DNA, 85 bp, Mus musculus
gggaaccataaaatcagtgaggccattggtttctctcagtgccttcacgctctctgagtctctaatggcttccattatttttcct

SEQ ID NO: 80742 - DNA, 108 bp, Mus musculus
gttttatggtgctttatgaagtgtgttcccaagctactgtaggaggaagttacctgttcactgtagtgtctgacaacactccacatgagctgatctctcttgtaaaac

SEQ ID NO: 80743 - DNA, 86 bp, Mus musculus
agaaggcatctgccaaaatgtcactggctctgtgactggcaagtagcagccagcacaggctttcccattgtgtcaggttgcctcct

SEQ ID NO: 80744 - DNA, 64 bp, Mus musculus
ggtgtgtgcatgtgcatgagtatgtgtgtgtgtttatatatgatacaatgcacatgtagaggtc

SEQ ID NO: 80745 - DNA, 64 bp, Mus musculus
caagagtgggagagttcctatgagttaatgtgccccactctgcctcactggctctcctttcctg

SEQ ID NO: 80746 - DNA, 98 bp, Mus musculus
atgctatgtatgtatatatatatgtatgtatatatgtatgtatatacacatatatgtatatatttacacatatatgcacatacacacatatatacatg

SEQ ID NO: 80747 - DNA, 108 bp, Mus musculus
tgtatatattatatgcatatcatgtatatatgtgtgtatgtgcatatatgtgtaaatatatacatatatgtgtatatacatacatatatacatacatatatatataca

SEQ ID NO: 80748 - DNA, 85 bp, Mus musculus; identical to SEQ ID NO: 57470

SEQ ID NO: 80749 - DNA, 75 bp, Mus musculus
gtgtgtatctctctctgtctccatctctctgtctctgccatcagcagggattgaatgcaggacctcggggcacac

SEQ ID NO: 80750 - DNA, 90 bp, Mus musculus
gtgttgtttagtttccacgtgaatgttggctttctattatttattttgttattgaaatcagccttagttcatggtgatctgataggatgc

SEQ ID NO: 80751 - DNA, 114 bp, Mus musculus
ctcttttatatagacgaaaatatgtctatgtgtatatgtgtatatgtgtatatatatacatatgttgttatacatatacttctaatggctaaaagtaagtctatgttttgagga

SEQ ID NO: 80752 - DNA, 62 bp, Mus musculus
ggggacatgtctgtgcagcatctgtgtgtacacacagaggccaaaggtcaggtttgctcctc

SEQ ID NO: 80753 - DNA, 69 bp, Mus musculus
gatgatacatgaaaagctcttagcagtgtctgacacacagtcattgttaacctagctatagttatcatt

SEQ ID NO: 80754 - DNA, 122 bp, Mus musculus
gctcagggctgtgtggggtcctgcattggactctgaaataggaaagtactgttagaagaaagagtgctgaaatccagatgaaggcagggcttagccaacagtatcccacaacgttaagtttt

SEQ ID NO: 80755 - DNA, 87 bp, Mus musculus
cactaactacttgctgccaggggtgaggggaggaactgaggtttacaggaagggtctctgcctcactgggtgagtgatatgggagtg

SEQ ID NO: 80756 - DNA, 100 bp, Mus musculus
ccacagtctcattaagaaagcatatgtctgggacactaagtccctagcattcttgctaacagaatagtgtcaccactctttgtttctattgttaccatgg

SEQ ID NO: 80757 - DNA, 97 bp, Mus musculus
tatctatctatctatctatctatctatctatctatgttactttaagctctttcagtgatgtctatgtgttgggggggtggagaattgtgtgtaggtg

SEQ ID NO: 80758 - DNA, 65 bp, Mus musculus
ggagcacagcttaggtgccatacaatggagataaatctctcactgtcacactatactcaggctcc

SEQ ID NO: 80759 - DNA, 88 bp, Mus musculus
ctcccatgtcctgctgagaattgtcctttaatcccttattatctggcaagatgtgtatctaaaacagtatctttttgtgtcatgggag

SEQ ID NO: 80760 - DNA, 84 bp, Mus musculus
ttatttgagaacccggtcttcacacacactctctgggagccctcacagagtgttctagtggagccctgtatgctgtgagaataa

SEQ ID NO: 80761 - DNA, 78 bp, Mus musculus
tctttattctgtgcatgtgcttgtgcatataagtgtgtgtgtcacacatacacccaaatgcatacatatgtacaaaga

SEQ ID NO: 80762 - DNA, 111 bp, Mus musculus
ctctggtgagggacagaaactggaggttcaaagagaaagaagtgacagagcagaattctcagctagtttgttctggctcatgatttttcaaaaggctgaccataccctgag

SEQ ID NO: 80763 - DNA, 82 bp, Mus musculus
tctggtcccactattgagcacttcagagacagcactgagctaatatcttctgctctggtttcaatgtgctgtgggtttgtga

SEQ ID NO: 80764 - DNA, 90 bp, Mus musculus
cagatcaaatttgtattggtgaggctagagagacagctcagtggctaagggctgatcttcctctccatcagctctgactccaggcagctg

SEQ ID NO: 80765 - DNA, 129 bp, Mus musculus
gggcataagggtcatggactagcagacctgtgctggcataactgaagtctagagacccactctcagtggcaccgaggaaggaggggtccgactctttgggctgagccttcctcattgggaaaaaggaga

SEQ ID NO: 80766 - DNA, 59 bp, Mus musculus
gcttattgcatgtgtgcatgtatgtatgtatgtatgtatgtatgtatgcatgtggaggc

SEQ ID NO: 80767 - DNA, 86 bp, Mus musculus
cttcctgggcatgaagagatgtcattatgttcttctgtttctctatggattactaatgggcttctcaggcaccctgctcaagtgag

SEQ ID NO: 80768 - DNA, 95 bp, Mus musculus
aggagacagccattgtcagagctacctacagtctgtaaggcactctaataatctctctttatatatctgtatgcaatgtaccaattctgtttctt

SEQ ID NO: 80769 - DNA, 81 bp, Mus musculus
caccttttgatacagtgtctgtctctctgtttccctagactggctagccagggagcgtcccacggagctgttcgtcctgtg

SEQ ID NO: 80770 - DNA, 116 bp, Mus musculus
tgcacccagaagagagagaagggagatggttcccgaagagaaatcaagtcaagaaaagctgctatgcttgccttgccgtgactgtctgtgggccacttctccctctgatgagagca

SEQ ID NO: 80771 - DNA, 87 bp, Mus musculus
cagcccagtggtcttgcagtccagtggtcccagaggccacacctgttatctggggctggctggctctgtggctgagacccctggctg

SEQ ID NO: 80772 - DNA, 91 bp, Mus musculus
tttgtggcacacacatgtgtgtggtatatatgcatatatgtgtgtgtggtatgcatgtgtgtgtgtgcatgtacatgtgtgtgagcatgaa

SEQ ID NO: 80773 - DNA, 113 bp, Mus musculus
catttcttagaaagcatttaggttgtagtcgttcccatctgtctgtctgtcccagcacataggatcatccttggcagtcgttgggagattgacattatatgttctacgagatg

SEQ ID NO: 80774 - DNA, 70 bp, Mus musculus
tagtcgctcattctctctggctgacaggcagcgatgtgggtcagacacaggcagtatgctaagcacacta

SEQ ID NO: 80775 - DNA, 77 bp, Mus musculus
acacacacacacacacacacagacatgtacttaaaagtcaaattttaaacaatatatgtgtatttgtgtgtgcgtgt

SEQ ID NO: 80776 - DNA, 81 bp, Mus musculus
gatgacttgaaaggactcagtggttttgatgttcttctgaaatgaaaacccttcacgagggcatagcattgggctgtcatt

SEQ ID NO: 80777 - DNA, 73 bp, Mus musculus
gcttataaagggacctaaaggcagcagctgagatggggaaaaccattttttcttcttcttgatggtggtgagc

SEQ ID NO: 80778 - DNA, 118 bp, Mus musculus
ccagtccacgccatgcgttcctaatcagaatgtgtagctcagttcttcacactagagtgagaggtgtgagtaagccagcagccactctgtatgggtatcctgacggtggtgcacatgg

SEQ ID NO: 80779 - DNA, 107 bp, Mus musculus
cctagactcaaggatttgttctcctgctgcagatgtctgtcactttctcttagctgtgacaaaaacacttgatagaatcaacttatgagaggaaagaccactctggg

SEQ ID NO: 80780 - DNA, 73 bp, Mus musculus
tgaggtccatgcatgtctgtaaatgcagaggattactcagtagaaatccatgcaaaacacatgctcattctca

SEQ ID NO: 80781 - DNA, 77 bp, Mus musculus
gggaggcaagctcttcttggtcctgagcctctgctttcttctctttgagtcagggggatcatgatgagtgtcctttc

SEQ ID NO: 80782 - DNA, 90 bp, Mus musculus
gcttatgaaaataatggaatgtgtactgaggaaggaggggattcatgtgtggctccatgctggttttagagcagggcagtgttgataagc

SEQ ID NO: 80783 - DNA, 59 bp, Mus musculus
cccacagaaaacagtgtggtctgtataagagcctggccacattagaagatctggttggg

SEQ ID NO: 80784 - DNA, 123 bp, Mus musculus
tatgtatgtgattgtgtgtgtgtgtgtcctgtgagtatgcttgagtatgcctgtgcatgaattgtctgcctgtctgtcctctttgcagcatctatgggaatgtatctgatacatgtgtataat

SEQ ID NO: 80785 - DNA, 68 bp, Mus musculus
gggtcctgggaaccaaacatgagtcctttgggatgactctcaaactctgactcacttctccagtcctc

SEQ ID NO: 80786 - DNA, 75 bp, Mus musculus
tgtgtggagggtgtacatacatgtacatgggcacggttgagtgtgtacgtacatgtatgtatgtatgtatgtgca

SEQ ID NO: 80787 - DNA, 69 bp, Mus musculus
ctggcactttctgatgagggcgtgctgtgtgctcttagacacagccattaacctctctgtaattcccag

SEQ ID NO: 80788 - DNA, 66 bp, Mus musculus
tgtgtgccagtctctatgtctgtgtaccaggcacaggagccttggaggccagaagagggcatcata

SEQ ID NO: 80789 - DNA, 79 bp, Mus musculus
tttcagtgtgtaatgtttcatttctttccagacaccactttggaaaatagaagacagaagtgagagacccacatggaaa

SEQ ID NO: 80790 - DNA, 108 bp, Mus musculus
tccatccaggttcctttcttgttttaattatgtgtctctgtgtggctgtcacttgggtgctggtgcccacagaggccagaagagaattcctggttccctggagctgga

SEQ ID NO: 80791 - DNA, 74 bp, Mus musculus
gtcatctgtgtctctgtgtatatgtctctgtgtctgcatgtatgtgtttgtgtgcatgtgcatatgagtgtgac

SEQ ID NO: 80792 - DNA, 103 bp, Mus musculus
taacactgaatatttcatggcccaggtaaactgtgtgcatcgctacagtgttggctgtggagttgtttgcagtttggtatgtgactgagatgctgttgtgttg

SEQ ID NO: 80793 - DNA, 78 bp, Mus musculus
tcttttaatttttttcctcttgactcagcagtgattgctttcaaggatgaactggtttgcgagagagagagagagaga

SEQ ID NO: 80794 - DNA, 75 bp, Mus musculus
agggctcctgtgaccctgggacctaaattgtctccatgggagagtagagagtctggagggcatccaaggagaact

SEQ ID NO: 80795 - DNA, 113 bp, Mus musculus
ttctgccattcttacattctttgtgcctctcttctgcaatgttccctgaacctactggtcactagagagtcaccacagtgtcagtaagggcggaaagacttcaggaggagctc

SEQ ID NO: 80796 - DNA, 97 bp, Mus musculus
gggctgttgaggggctgtagtgatgctcagttgttaagagcactgactgctctttcagaggtcctgagttcaagtcccagtacccacatggcagctc

SEQ ID NO: 80797 - DNA, 111 bp, Mus musculus
tgggttccaggacagccagtgctgcacagagaaacaccgtctcaaatgaatgaatgaatgaatgaatgaatcggtcttgtgtgtgtgggtactatacctgctagcaactca

SEQ ID NO: 80798 - DNA, 92 bp, Mus musculus
cataacactgggctggagagatggctcagcggttaagagcactgactgctcttccaaaggttctgagttcaattcccagccaacacatggtg

SEQ ID NO: 80799 - DNA, 114 bp, Mus musculus
tattgtgtgtgagtgcatgtatgtgattgtgagtgtgtgtgtgtgtgcgcgtatgtatgtgagtgtgtgcacacacagagcccttctcactacgtgctttactgacctggaatg

SEQ ID NO: 80800 - DNA, 78 bp, Mus musculus
gctgcacagcagacactgtgaagagaaagaacactgaactgtgagtgcaccttctgacactgctgtctagagttcagc

SEQ ID NO: 80801 - DNA, 85 bp, Mus musculus; identical to SEQ ID NO: 72622

SEQ ID NO: 80802 - DNA, 85 bp, Mus musculus; identical to SEQ ID NO: 72622

SEQ ID NO: 80803 - DNA, 90 bp, Mus musculus
catttacttgtctctaaattttacttggagtgaaatgaatctttttttaaaggtttgtctcttttacttcactacactgagcagtaagtg

SEQ ID NO: 80804 - DNA, 72 bp, Mus musculus
tatactcttcagcttcagctttctagtttgtggagtgaatgcttcagattaggtagtaggttgaaaagcata

SEQ ID NO: 80805 - DNA, 112 bp, Mus musculus
tcaggagatgagctgcccacagattatcccttccaccgttctgcagtcacgcagcactcttctgttgtctggtcttaggtgtggatctgtgatgacagctgtcattttagga

SEQ ID NO: 80806 - DNA, 78 bp, Mus musculus
agaaacatctcgggctggagcgatggctcagtggttaaaagtactgactgctcttccagaggtcctgagttcaattct

SEQ ID NO: 80807 - DNA, 72 bp, Mus musculus
ttaggggcgggagagatggcttagtggttaagagcactgactgctcttccagaggttctgagttcaattccc

SEQ ID NO: 80808 - DNA, 62 bp, Mus musculus
taggtgtatgtctgtctgtctgtgtgtgcacatatgcatgcatgcacagacatgtatgcttg

SEQ ID NO: 80809 - DNA, 87 bp, Mus musculus
gtgtgtatgtgtgtgtacatacacataatacatatgtttacatatatgtatatatatgcatgtgtgtgtgtgcgcgcgtgtgcatgt

SEQ ID NO: 80810 - DNA, 71 bp, Mus musculus
ggagcctacgttaagacatcctgtgcctcacacagacactgtgtcctgtgtctggcagtgtctgtggttcc

SEQ ID NO: 80811 - DNA, 67 bp, Mus musculus
gggctgatgctgactggctgactggctgactgtccagaatatcagttccaggttcagtgaggagccc

SEQ ID NO: 80812 - DNA, 82 bp, Mus musculus
ggtagtcctgactggatcctgtttagaaaatgccgtaggtaagattcttggggtaagttgagagatttgagtgtggactagt

SEQ ID NO: 80813 - DNA, 80 bp, Mus musculus
gcccaatggttgtctgtgagcatctgcttctgtatttgtcaggctctggcagagtctctcaggagacagctatatcaggc

SEQ ID NO: 80814 - DNA, 144 bp, Mus musculus
attctatgtgtgtatacatgcttatacatgtatatatttgtatacatttgtatatgtttatgagtgaataaaatacacagtgaatatataatcttatatatatgtgtacatgtttacctacgagtacacatgtatatgtggtta

SEQ ID NO: 80815 - DNA, 100 bp, Mus musculus
gtgtgtgtgtgtgtgtgtgtgtgtaactcgattgcatggttcttgaggttgaaccttgaaaagtccaatgctgggttgcaatgtcaaaaggcagtcatgc

SEQ ID NO: 80816 - DNA, 154 bp, Mus musculus
tgtatatatatatatatatatatatatatatatatatatatatatatatatatatacatatatgtatgtgtatatatatgcatatatgtgtgtatgtgtatatatgtatatatacatatatgcatgtgtatgtatatgtatatatatgcatgtg

SEQ ID NO: 80817 - DNA, 100 bp, Mus musculus; identical to SEQ ID NO: 80815

SEQ ID NO: 80818 - DNA, 154 bp, Mus musculus; identical to SEQ ID NO: 80816

SEQ ID NO: 80819 - DNA, 100 bp, Mus musculus
gaacttgtcgagtagctaagctagctggccagtgaactccagtcatctgtctgtctctgctttcctagtatttggtttataagtacactccaccatgttt

SEQ ID NO: 80820 - DNA, 82 bp, Mus musculus
tccttgccaagtatgctttcatagccggcatttcctcccctgactccctctaatgatgtgtatgtgtgcttgtgcatgtgga

SEQ ID NO: 80821 - DNA, 102 bp, Mus musculus
ccaacacaaaggattcactgggcttcaacagagacagaagacaatctgctctgtgggtgatgtcttcattctctggaagacactgtgggtttagccccctgg

SEQ ID NO: 80822 - DNA, 82 bp, Mus musculus
gtatgtatgtatgtatgtatgtatatatctatatatctatgtatatatatatatatatatatatatatatatatatatatac

SEQ ID NO: 80823 - DNA, 75 bp, Mus musculus
ggaggaagtgtgtcactgggggtgggctttgaggactcagaagctcaagccaggctcagtgtctcactctcttcc

SEQ ID NO: 80824 - DNA, 86 bp, Mus musculus
taaatgagtgtgagagtgtatgtgtatatatatatatatgtgtgtgtgtgtgtgtgtatatacacacatatatttacatatatatg

SEQ ID NO: 80825 - DNA, 84 bp, Mus musculus
tgggtataagtcagagctcatcttccaagtgtggttgctcaggaactgcccaacttctgagacacagtctctcactggaaccca

SEQ ID NO: 80826 - DNA, 96 bp, Mus musculus
gtgcatgtacatgtgcatgtgtgcagacatgtgcattagtgtgtatacacacacacacacacacacacacacacacacacacacacacgtacgcac

SEQ ID NO: 80827 - DNA, 81 bp, Mus musculus
ctctgcctctctggcactgtgattacagatgcccactggcatgatctctgttttgcatgtgcactaggggtctgaacagag

SEQ ID NO: 80828 - DNA, 75 bp, Mus musculus
cagaaacctcagggtctcactcactcttgctgcatggccagctatagctgtagtgggctgatggccctcacactg

SEQ ID NO: 80829 - DNA, 81 bp, Mus musculus
ttagaaaatacaggtggcattctattccctgcacagatcaagagaagtgagagacaagagtgccaaatgtcaaatcgctag

SEQ ID NO: 80830 - DNA, 116 bp, Mus musculus
ggcttttgactgagaacagacccttaagcacaatgagtatggaatccacagtgagaactgactgaaaactgttgaggcctggatgcttggtgagcctgtgtggcagcccagaggtt

SEQ ID NO: 80831 - DNA, 71 bp, Mus musculus
tgtgtgtgtctgtatgtgtgtgtctgtgtgttgcccttcatatgcagacacattaaatatttccacatgta

SEQ ID NO: 80832 - DNA, 113 bp, Mus musculus
ttcccttgagcttaatgtttctccttgggtgccagcctctgtctatgtctctgccctttagcattaggaccaaagaaaggacagaaggaagggaaggaggaagagggcgggaa

SEQ ID NO: 80833 - DNA, 125 bp, Mus musculus
tttcatgtctacatgtgtgcctgggtgtatatgtgtgcaccatgcatgtgcagtgttcacagagaccagagaagatgtgggacctgctggagctacaggaggttgagcatctgatgtgggagctt

SEQ ID NO: 80834 - DNA, 108 bp, Mus musculus
gtacacccaacttctgaactttagtgtggctatcttgttttttttttttttttttttttttgaaaattataatgataagagctataggagggacagagtttctttgac

SEQ ID NO: 80835 - DNA, 72 bp, Mus musculus
cacgcaggtaatgatagagcactgacttagtccagatccagagcctcactcccagtcagtgtcacttgtgtg

SEQ ID NO: 80836 - DNA, 85 bp, Mus musculus
agaccctgggggtggggaggactcacactccagtgagagcaagttgtctgctctgcactcactgtctgactcactcgctatgtct

SEQ ID NO: 80837 - DNA, 105 bp, Mus musculus
tgtcacaacttgtgggtggaggtcagagaataactttcagggctctgtacagagagaggtcatgggaagacaattttcaggactctgcatgtaggttagaggaga

SEQ ID NO: 80838 - DNA, 82 bp, Mus musculus
tctctatttatattaagaagttgaccttcatgtttctctgggtagagataagtgagagacaacagagaaatgtcactggaga

SEQ ID NO: 80839 - DNA, 70 bp, Mus musculus
atgtatgtatgtatgtatgtatgtatgtatgtgtatgtatgtatgcatgcatgtatatgtatgtgcgtat

SEQ ID NO: 80840 - DNA, 66 bp, Mus musculus
agtctattctgtctggctcactgcttcagtatggtggggaacatggtagggccagaggagtgtcct

SEQ ID NO: 80841 - DNA, 67 bp, Mus musculus
gatatggacacggacacatatactgtatgtatgtatgtatgtatgtatgtatgtatgtgtacatgtc

SEQ ID NO: 80842 - DNA, 119 bp, Mus musculus
tctgttgtatatagtagtttttgagcagatatttgcaataaaaacctgtctttgaataattttatattcagattcctgtttggctagcctgtctttgttgctgtcgtgtgcattgtagg

SEQ ID NO: 80843 - DNA, 114 bp, Mus musculus
cattgctcactttaaaaatgctggatttcctgttagacagtttcactttaaaattttttacttttaaaaatgaaaaaatgggctggagagatggctcagcggttaagagcactg

SEQ ID NO: 80844 - DNA, 56 bp, Mus musculus
tatgtgtgtgtctgtctctgtgtgtgtgtgcacgcacatgagcacacacgcatgta

SEQ ID NO: 80845 - DNA, 88 bp, Mus musculus
gtgtgtttacatcctgctctgctggctaaatctatcatgagtatttctaaatattttttaggagattgcagtagaagaggaaacagac

SEQ ID NO: 80846 - DNA, 77 bp, Mus musculus
gggggctggagagatggctcaggggttaagagcactggctgctcttccagaggtcctgagttcaattcccagcaacc

SEQ ID NO: 80847 - DNA, 86 bp, Mus musculus
cattggtattttgcctctgtgtatgtctgtgtgagggtgtcagatcccctgaaacaggagttatagacagtagtgagctgccagtg

SEQ ID NO: 80848 - DNA, 81 bp, Mus musculus
ggcagaagagagtgggctcagtgggtaaaatgtctgccttgcagatgtgaggaccttagttctagtcccataatccatgtc

SEQ ID NO: 80849 - DNA, 60 bp, Mus musculus
caggggctggagagatggctcagtgggttaagaggactgactgctcttccagaggtcctg

SEQ ID NO: 80850 - DNA, 151 bp, Mus musculus
cagaccacacttagtaaatagacatctttatgttttttaaataagtgtgggggtatctgtgtgtctcagtgtctgtgggtttgcctgcctgcctgcatgtctgtggtaggtatgtatatgtgagtttaggtgtcctgagactagatatctc

SEQ ID NO: 80851 - DNA, 101 bp, Mus musculus
gtttgtgtgtatgtgcacacatactcaagtgtgtgagtacatatgtccatgcactttgtgcaatatgcgtgtgagtactgtttgcatatatatgcgtatgc

SEQ ID NO: 80852 - DNA, 89 bp, Mus musculus
tggtaggtgtgcatcttcctacacacacacacatacacacacacaaacagagatgtgtgagtggacagacagacaggcacatacacaca

SEQ ID NO: 80853 - DNA, 66 bp, Mus musculus
ttagggatctacctcctttgtagagggctttcttagcttgtgtgaggcttgaggttcaatccctag

SEQ ID NO: 80854 - DNA, 89 bp, Mus musculus
gggcaggcagagggtcttgagtttggggtcagactggtttttgaagtaggactttacacctgtctgtctgtctgtctgtctgcttgcct

SEQ ID NO: 80855 - DNA, 114 bp, Mus musculus
ttttttttttttggagacatgatctctttgtgtagttctggctgtcctgaaactcactctgtgggtcagtctgcttggcactcacaaagatcccttgcctcctgagttacggga

SEQ ID NO: 80856 - DNA, 76 bp, Mus musculus
gggtgattgtgagtcaccatgtggttgccgggatttgaactcaggacctttggtagaacagacagtgctcttaccc

SEQ ID NO: 80857 - DNA, 93 bp, Mus musculus
acatgtgtactgtatgtatatgtacatatgtgtatgtgtatatgtgtccatatgtgtatctatatgtatctatatttgcatctgtatgtatgt

SEQ ID NO: 80858 - DNA, 91 bp, Mus musculus
tatgcatggcatgtgtatatattgtgtatgcatgtacatgtatattgtatgtatgtgtatatatgtatgtgtataatatcttgtctgcatg

SEQ ID NO: 80859 - DNA, 95 bp, Mus musculus
aagcatgccatgagacacatacaggttacagcgaagtctaatgttgataagcccaatatttaaaactttattttatcttatgtacatggctgttt

SEQ ID NO: 80860 - DNA, 82 bp, Mus musculus
caccttagtttcgagacagggtctctctctctgaatctagagtttgctggctggtggggcagaccctgggtccttctgtgtg

SEQ ID NO: 80861 - DNA, 85 bp, Mus musculus; identical to SEQ ID NO: 57439

SEQ ID NO: 80862 - DNA, 109 bp, Mus musculus
ctgagttttatatgttgattttgtatcttgccactttactgaattggttgttatgttctaagcattttctggtccagctaagtgtagaatcacgttgcaaatgaatcgg

SEQ ID NO: 80863 - DNA, 112 bp, Mus musculus
ggttgaatgcatccatattcagtagttggattgctggatcatatgacagtcctggttgtaacttttttttttagcaatttccataatgacttctctaaattgcatctccact

SEQ ID NO: 80864 - DNA, 77 bp, Mus musculus
gagaaagtgttgctggattggttggttattaagggttacccaagagatgagtgagtgagttcagtcagccctgtttc

SEQ ID NO: 80865 - DNA, 134 bp, Mus musculus
actcacatatctggaatgatataggtgtatatgtatatgtgtgtatacatgtctgtatgtccgtgtatgagtgtgtatgtctgtgtgtctgtgtatgagtttgtatgtgtgtgtgcatgtgcatgcatgcatgt

SEQ ID NO: 80866 - DNA, 88 bp, Mus musculus
ctaggtagctagtttggaccaattttatacatttatttgaaagttaggaaagaatactggtgtgtgagttctgagatctggcttctag

SEQ ID NO: 80867 - DNA, 93 bp, Mus musculus
agccttagtctgtggtgatcagataggatgcatgggataatttcaatatttttgtatctgtggaggcctgttttgtgaccaattatatggcta

SEQ ID NO: 80868 - DNA, 58 bp, Mus musculus
gcatatgtatgtatatatgtatgtacgtttgtatgtatgtatgtgtgtgtatgtatgt

SEQ ID NO: 80869 - DNA, 87 bp, Mus musculus
tcagtgtaaagggagaagaatggtggtttggggcatgggctctattgtgtcctctgttctgattttgttctaatattctgaacttga

SEQ ID NO: 80870 - DNA, 108 bp, Mus musculus
atttgctgacaggaccgctgcagtgagaagaggctggagattgctgagagacccactgacagccacactttctctcccttttgtatcaggttctacattcgggtaaat

SEQ ID NO: 80871 - DNA, 79 bp, Mus musculus
ttggagagtttgaagaagacactagtgggtggtctgccttttgcttggttctcctcctcatacagtcactctctaactc

SEQ ID NO: 80872 - DNA, 85 bp, Mus musculus; identical to SEQ ID NO: 57439

SEQ ID NO: 80873 - DNA, 68 bp, Mus musculus
gcctcagtaagagaactgagttagatgatgtcctcaatcttgctcaggtctatcactgtatccctggt

SEQ ID NO: 80874 - DNA, 96 bp, Mus musculus
gacaaaaaaagaaattgtatcaatgtatgtgctcatatgtactaaatgtttgtgtgcatgtgcacgtgtacatgtgtgtacaaagcttatagtgtc

SEQ ID NO: 80875 - DNA, 65 bp, Mus musculus
gcgcacatgcataatagagagaaaaatatctccctatgtgagtgtgtctctgtgtgcatgtgtgt

SEQ ID NO: 80876 - DNA, 85 bp, Mus musculus; identical to SEQ ID NO: 57439

SEQ ID NO: 80877 - DNA, 85 bp, Mus musculus; identical to SEQ ID NO: 57439

SEQ ID NO: 80878 - DNA, 65 bp, Mus musculus
agactcagtgtacatgcagagtgttggctactgcctctctgtctgtctccatagcatctcagtct

SEQ ID NO: 80879 - DNA, 87 bp, Mus musculus
gttacagatgttaagtttttccacttcaagcacttgttatctcatatagcaagaaattgctggaagaagacagactgcagatgaagc

SEQ ID NO: 80880 - DNA, 86 bp, Mus musculus
actgactgtgtgcctggctcgttagtcactttattttattacttttttttaatgaaaaaaatttagggccagtgctatggctcggt

SEQ ID NO: 80881 - DNA, 67 bp, Mus musculus
gagttccacaactggttccaggaggcctccccctttttgaggtcagttgtctcagtctgtggaactt

SEQ ID NO: 80882 - DNA, 86 bp, Mus musculus
ggaggaagtgtgtcactgtatagtgtgagctttgaggtcttattcatatgctcaagctacacccagtatgaaacacagtctcctcc

SEQ ID NO: 80883 - DNA, 88 bp, Mus musculus
acacagctctcctgtgctgcctctgtgagtggctgagttctgctcagtcggctggctagtgtaggcaggacctgtgttacaggaggct

SEQ ID NO: 80884 - DNA, 115 bp, Mus musculus
ctggtattgaaattcttcctggagctggagagatggcttagtgattaagagcactgactgctcttccagaggtcctgagttcaattcccagcaaccacatggtggttcacaacca

SEQ ID NO: 80885 - DNA, 92 bp, Mus musculus
gtagggtaaagactgactgaaggactggagagatggctcagcggttaagagcactgagtgctcttccagaggtcctgagttcaattcccagc

SEQ ID NO: 80886 - DNA, 67 bp, Mus musculus
ccaagttttagaactcaaaggtgacagagagatttttgatactctcactcactctttgtgtacttgg

SEQ ID NO: 80887 - DNA, 79 bp, Mus musculus
cagcaagccccagatctctgcctgtctctgcctcctcagtgccagggctacaggcaagtgagatttaacaaaattgttg

SEQ ID NO: 80888 - DNA, 77 bp, Mus musculus
cccagaacttgctatgtagaccaggctaacctcaaactcaacagaagtctgtctgtctctgccacacaagagctggg

SEQ ID NO: 80889 - DNA, 143 bp, Mus musculus
gtatgtatgtatgtatgtatgtgtatatatagagaaattatataataaataattatatttattatttatctctctacatatatatgtataggcatatatacttatgtatatatacatatatatgtgcatattcttaagagata

SEQ ID NO: 80890 - DNA, 101 bp, Mus musculus
acggaatgaaactgcctgtgcttcaattatatcattgagaaatacttcaaaatttgtatttattatcagtgtgtgtatgtgtatgcacaacgtgtgcctgt

SEQ ID NO: 80891 - DNA, 95 bp, Mus musculus
ctgagcatacatccttgtatctgcctgaatccattagtgggtatatatgtatgtatatatactcacacatgggggtacatttgtgtggaagccag

SEQ ID NO: 80892 - DNA, 111 bp, Mus musculus
tccagctctctccaggagccggcagctgtctgttccttttcagcagcgtttgataacttcagagtagctgtagaggagcagcctcatcagaaacgctgcttcagggctgga

SEQ ID NO: 80893 - DNA, 78 bp, Mus musculus
cacaagcgtgaaggaagccagctgcacagaagcagcggcatctatgtgtctctctctctgctgttggctgtggctgtg

SEQ ID NO: 80894 - DNA, 78 bp, Mus musculus
attatttgtgtatatgagtatttctgcctgcaggtatatatatatatatgtaggtagatagatagatagatagatagt

SEQ ID NO: 80895 - DNA, 74 bp, Mus musculus
tatgcatatgtatgtatgtatgtatgtatgcatgcatgtatgcatgtatgcatgtatacatagatatgtgtata

SEQ ID NO: 80896 - DNA, 77 bp, Mus musculus
ggagagagagatcacagtgagtgtagcctcaaatttgtctaaatgtgaggctttaagatgtattggtgataaattcc

SEQ ID NO: 80897 - DNA, 102 bp, Mus musculus
cacttgtaaaatgcatgtgtgtaaacacatgcataaatactgacatatgacagtgctcagaatttttatgtgtgtgaatatgcatatgaatgatgacatttg

SEQ ID NO: 80898 - DNA, 71 bp, Mus musculus
agaggcacatctgtgtgtgtactcatgtgtgcagatacaaatgcacatatgtgtcaagccagaggactttt

SEQ ID NO: 80899 - DNA, 103 bp, Mus musculus
gtttcctgagcatggacataagcatgtgttgacatgtatacaaattctgagctcagttatgtgtcagtacatatgcatgtgttcatacaccaaagttccaagc

SEQ ID NO: 80900 - DNA, 112 bp, Mus musculus
tatgaaatcatgaacattctgtaattttatatgtatatattatataatatataacttatattattttatatacataatatctgttgcataaaataatgtttaatactttata

SEQ ID NO: 80901 - DNA, 65 bp, Mus musculus; identical to SEQ ID NO: 70517

SEQ ID NO: 80902 - DNA, 106 bp, Mus musculus
gaagttagggattatgctggtctaggaaagtggtagtagtaggttcttttctaagatccatgacctcactagccttgcctagttgcctagccttccagcaccaggc

SEQ ID NO: 80903 - DNA, 72 bp, Mus musculus
cccagtcactctgtccctggctgtgaaaaatgcctttgacacttcttcactatccagaaaaagagtggtggg

SEQ ID NO: 80904 - DNA, 92 bp, Mus musculus
attatttctcgtttgtgagggtttcacctgtctctctgtctgtgtaccccatgtgtgtgactggtgctccctgaggtcaacagagggctgat

SEQ ID NO: 80905 - DNA, 93 bp, Mus musculus
catagaccaatgcatcagcttcatggagttagtcacacaggtcttcagacaagacacacagcaggctcttgaaagtagaggtgaaggtctctg

SEQ ID NO: 80906 - DNA, 87 bp, Mus musculus
tatgtgtgtgtgtatctgtgtgtgtgtatttatatatatatatttatatatatgtatttatatatatttgggtaggttcaacacatg

SEQ ID NO: 80907 - DNA, 102 bp, Mus musculus
gtggaggccagaagattaggagtaagtcccagactcagacactgagttagttacattgttggagtttggttttactttgacctaactacaattgtgccctgc

SEQ ID NO: 80908 - DNA, 108 bp, Mus musculus
tattatctaggtaagatttgggacactttatgaaataagagtggagagtgtggagacacacatcttcttccatgttgcaaaagaatactcaatattccccatttaata

SEQ ID NO: 80909 - DNA, 69 bp, Mus musculus
ttctacatcttcatctgaaggctgctaagagaagactcactttcaggcagctagaatgagggttttgaa

SEQ ID NO: 80910 - DNA, 58 bp, Mus musculus
gtctagctttggggattacagttaaatgactggatgaatctcagaagagactctggac

SEQ ID NO: 80911 - DNA, 107 bp, Mus musculus
attcacacagaacagccatggcaagtgttaacagaacatgtaactaagtaactaaatgttttattttctaataagcacttgtcttaccaggcttccatgggatgaat

SEQ ID NO: 80912 - DNA, 60 bp, Mus musculus
gcagacactggacattgattctacggagaaaggagctcagtagtgacagtgcagatctgc

SEQ ID NO: 80913 - DNA, 109 bp, Mus musculus
tctactcttaggcctgtaccctggaaaccaaatgaaatacgagggtaaaatttagtctttttcttcttatatgtcatttttaaaactccactgtgagtagaagagtaga

SEQ ID NO: 80914 - DNA, 77 bp, Mus musculus
gattctatcaggggctggagagatggttcagcagttaagagcactgactgctctttcagaggccctgagttcaagtc

SEQ ID NO: 80915 - DNA, 101 bp, Mus musculus
gtgtaaccgtggctatcctgaacttgctctgtagactagactggtctcaaactcactctgtctgcctctgccttcctagttctgggattgaaggcatatac

SEQ ID NO: 80916 - DNA, 112 bp, Mus musculus
agggggcatattttacctacatagacttgaggcttatgacagaggaaataatgataagacagtcattttgatgtttcattgttgctaaacctggggttagggatggccttct

SEQ ID NO: 80917 - DNA, 78 bp, Mus musculus
tgggtgctgggggttgaatttaaggtctagtgcatggtgagaaacactctgtcactgagctatacctccaggcatgca

SEQ ID NO: 80918 - DNA, 85 bp, Mus musculus; identical to SEQ ID NO: 57470

SEQ ID NO: 80919 - DNA, 99 bp, Mus musculus
atttgtgctttaaatctagtaataatccatccagtaatactttttttttctataaaaaaaaaaaaagaaattggatgtacttgagtttggtgcacttat

SEQ ID NO: 80920 - DNA, 113 bp, Mus musculus
gagccttgggaagatgaaaggcctcctgaccagcacccagtgtgagaggatttgcatgtgcacctgcctgccagaagctgggttcaggccgcctttcttctgttccccatttc

SEQ ID NO: 80921 - DNA, 105 bp, Mus musculus
tcttattgctctagttaagactcaacgactatactgaatagagagagtagacatctgtgtacttaatgtcttttatttttagttttatctcttgatggcattaga

SEQ ID NO: 80922 - DNA, 90 bp, Mus musculus
tccatctcattaatgctcacacattgtctctgtggctccctgaagacagccatggccattctctcccgcaggttgtgggctgtaagtgga

SEQ ID NO: 80923 - DNA, 95 bp, Mus musculus
agaaatgaaccagccaagaggaaggagcatccggctaaggttcattcctctggggtcttgcctgcctgcctgcctgcctatctatctatctatct

SEQ ID NO: 80924 - DNA, 84 bp, Mus musculus
gtagtgagactcgagtctgcttccaactctcaggtgacaaacactccgtcactgagagaagtcagaaaagaacacactcataac

SEQ ID NO: 80925 - DNA, 69 bp, Mus musculus
aggaagggtgtgaccaggggtgggctttgaggttccaaaagcccagagcctgtctgtctatctgtctct

SEQ ID NO: 80926 - DNA, 159 bp, Mus musculus
aatgagtaaattaaaatgagttaagttggtcaaatacatatttgacttattttaatttactcattatatatatgtgtatgtatatatgcatatatatgcatatatatatatatgcatatatatgcacatatatatatatatatatatatatatatgcat

SEQ ID NO: 80927 - DNA, 84 bp, Mus musculus
tatatatatatatatatatatgtgcatatatatgcatatatatatatatgcatatatatgcatatatacatacacatatatata

SEQ ID NO: 80928 - DNA, 105 bp, Mus musculus
ggttgttgggttagctttctcatctgtaactgtgagtcgtgtgtttctctctatgactgtgtcacttgttacttcagataccatgaagctccataattatcaaca

SEQ ID NO: 80929 - DNA, 81 bp, Mus musculus
gtataattgttcctgttttggtgtcctgaacagagtctgtctcacacagattcaccaccatttgcagtgaaataaatatat

SEQ ID NO: 80930 - DNA, 82 bp, Mus musculus
ctctaatggcaggaaggccaaaggcaggggttaggcttgccgtggcttttactgctctctgtctgtctgtcctgcccatgag

SEQ ID NO: 80931 - DNA, 76 bp, Mus musculus
cttacctcacctgtcacagctacaggagccatgatcaccattgcatattacatgagcctgtgcacactggggttag

SEQ ID NO: 80932 - DNA, 78 bp, Mus musculus
gggccatatgggcttatgggctagagagatgactcagtggttaagggtactgactgctcttccagaggacccaggttc

SEQ ID NO: 80933 - DNA, 108 bp, Mus musculus
ttgtaagagttttctgtcctgggaaaagatggctcaccagttaagagcactgactgctcttccacaggtccttagttcaattcccagcaaccacatggtggctcacaa

SEQ ID NO: 80934 - DNA, 111 bp, Mus musculus
gacttcagccgccatgcccaccgttatattgtcagaggtgacatgtgtgtggctgcctctctgaggtagtctcaccttcagcagagggaaaggggtcagaaggctggcatc

SEQ ID NO: 80935 - DNA, 118 bp, Mus musculus
ttagtcttcatcctttgcactatctggagggagaaagtaggaggtggatgacccaaaacctctcagtccgactctctccttgcttagtaaaaacccaccgcgtcatggattgaactag

SEQ ID NO: 80936 - DNA, 99 bp, Mus musculus
caatctcccattaccactaacactgcgctcgttatatatgcttacttcttaactatagaagtaaggtggggctgagtagcagattaggggtaaagatag

SEQ ID NO: 80937 - DNA, 87 bp, Mus musculus
gagacagacgggggtgtgggggtgagtatcttatttctttaaatataaggaatacaatggagtgcttacattaaactgctttgcctc

SEQ ID NO: 80938 - DNA, 80 bp, Mus musculus
ccatctctccagctctcccacagattttttttttaatggaaagaaaaagatactgtaacatttgggaaggaagaggaagg

SEQ ID NO: 80939 - DNA, 72 bp, Mus musculus
tctgtctgtctgagacagtgtttctctgtgtagcttttgctgtcctggaacttgttctgcagactagactgg

SEQ ID NO: 80940 - DNA, 72 bp, Mus musculus
gatatatacatattatatacatagatacatatgtatgtatgtatgtatgtatgtatgtatatatgtataatc

SEQ ID NO: 80941 - DNA, 78 bp, Mus musculus
aagtctatgtacaccacagcattgctggaagtaaatatctttatgatttattatggcaaatgtttggtttgcatactt

SEQ ID NO: 80942 - DNA, 84 bp, Mus musculus
ctggagaactgcaagcatggcactctactccttgaggtctcatttcctcctaaaataaagtcagtgcctctgacagtctctcag

SEQ ID NO: 80943 - DNA, 105 bp, Mus musculus
tctcacgtggttatagagctgcagggagccactctgagtctgtgagggatccacagagcctaagatgtgcacgcctgaaattcagataagtcagtgggggttctc

SEQ ID NO: 80944 - DNA, 85 bp, Mus musculus; identical to SEQ ID NO: 57439

SEQ ID NO: 80945 - DNA, 116 bp, Mus musculus
ggtttggttgtgagggcgttcctccccgcagggtctatatgaaggtctctctctttctgtgaaacctagattatgtaacccaccagcttccgggagatcccctacttctgccttac

SEQ ID NO: 80946 - DNA, 94 bp, Mus musculus
tacatatatatgtatatatatacacatgtatatatatacatatatgtattattatgtatatgtatacatgtgtatatatgtgtatacatatgta

SEQ ID NO: 80947 - DNA, 86 bp, Mus musculus
atatatatgtatgtgtttgtatgaatttatatatatatatatatatatatatatatatatatacatacatatacatgtgtatgtat

SEQ ID NO: 80948 - DNA, 80 bp, Mus musculus
gcaagtaatatttttttgcagagttctgtgaggattgatactttgttgtgtcatttcaatgaacagagtgtgcagtttgc

SEQ ID NO: 80949 - DNA, 69 bp, Mus musculus
gggaggtcagaagacagtctgctttggggaatgggttatcccttccattgtggcttttttgaccagccc

SEQ ID NO: 80950 - DNA, 85 bp, Mus musculus
gattatttgtgaatgtcatggggtaagtttctaactttattctgttttatgcagaagtaaattgcaccatgaagtatgcatagtc

SEQ ID NO: 80951 - DNA, 79 bp, Mus musculus
cctgcctgcctgcctgcctgcctgcctatgggccttctttccctaatgggcttgccttgtctggcctcactgggacagg

SEQ ID NO: 80952 - DNA, 98 bp, Mus musculus
acagaatgaacacagaggctctgggttgcatagtaggtgcccttcatcagagtgaacacactaccagatcccagcttctctgtgtgtgcgtctgctgt

SEQ ID NO: 80953 - DNA, 87 bp, Mus musculus
tatgtgtgtacatatctatgtgtaaatatataatctatgtatatatataatctatgtatatatatacacatatatatgtatgtgtat

SEQ ID NO: 80954 - DNA, 72 bp, Mus musculus
attctcatgtgtgtaggtagggctggtgggtgagatgtcaccctctgtgtctcactgagtttatatgtaaat

SEQ ID NO: 80955 - DNA, 69 bp, Mus musculus
cctctctgtctttgtctctcatttctccactagggagattactgagaagagaaagaaacaaaaagcagg

SEQ ID NO: 80956 - DNA, 82 bp, Mus musculus
gcacaggacagtatcaaggttgtgagagtggtagagctggctctatccctctgcctctcactggcagtggcactggatgggc

SEQ ID NO: 80957 - DNA, 85 bp, Mus musculus; identical to SEQ ID NO: 57439

SEQ ID NO: 80958 - DNA, 86 bp, Mus musculus
gtttttgaatcagggcctctcactgtggctcagtgatgcagctagatgggctgacgagtgagctttggggttctgtccgtctccac

SEQ ID NO: 80959 - DNA, 66 bp, Mus musculus
gtgtgtgtgcatgtgtgtgtatgtgtatgtacacatacacacacaggcacacacatgcgcacatac

SEQ ID NO: 80960 - DNA, 62 bp, Mus musculus
ttttctgtgaagtgggtgtgtcttatatggagaaagaggcacacacacactcacacagagag

SEQ ID NO: 80961 - DNA, 79 bp, Mus musculus
catgcctgccacatttttgtcatagccttgtctaacagaaccaggggccagcgtagatgagagaagaatggctgctgtg

SEQ ID NO: 80962 - DNA, 69 bp, Mus musculus
tgatttcaggctggagagatagcttagaggttaagagcactggctgctcttccagaggtcctgagttca

SEQ ID NO: 80963 - DNA, 86 bp, Mus musculus
tttcctgctgttgtggcaagggtgttacagtgagtatgtatatatatatatacacacatatacatatacttttactatacgggaag

SEQ ID NO: 80964 - DNA, 74 bp, Mus musculus
ggcttcccgtatagtaaaagtatatgtatatgtgtgtatatatatatatacatactcactgtaacacccttgcc

SEQ ID NO: 80965 - DNA, 115 bp, Mus musculus
gttatccaaagtctctcagtctctgcacattagccaactgtgggtctctctctgttaattcccatttaccacaagtttccttaatgagggttgagcactgatctatgtgtatagc

SEQ ID NO: 80966 - DNA, 61 bp, Mus musculus
cactgacttcagtttcagtcacaaaggtagatgctgcctcatgacggagagactagcagtg

SEQ ID NO: 80967 - DNA, 79 bp, Mus musculus
atatgtatatatgtatgcatgcatgtatgtatgtatgtatgcattatgtatacatgcatgtatgcttatgtatgcatgt

SEQ ID NO: 80968 - DNA, 79 bp, Mus musculus
acttctgttagtttcactgtgtctctgtttagtttctgtttccaggatctgtccattaatgagagtgagatgttgaagt

SEQ ID NO: 80969 - DNA, 106 bp, Mus musculus
ggcttcacacagggcggcaggggtgggtcacatgtgaataaggatggtgtctgtgtgtctgtcaatgtttttgtacctgattgctacttgctctttcccaatggcc

SEQ ID NO: 80970 - DNA, 77 bp, Mus musculus
gtgtgtgtgtgtgtgtgtgttgcttttggtttttctgtatcagagaacacagtttgctcaaacaagtagactaacac

SEQ ID NO: 80971 - DNA, 79 bp, Mus musculus
tgtctaatgcagtggctgatttcaggagaattagcagagtgtgtgtactgcctggctttcagccaatgatcagtaggta

SEQ ID NO: 80972 - DNA, 177 bp, Mus musculus
atatatatgtatatatatatgtgtgtgtgtgtttgtatatatatatatatatatatatatatatatatacacatatgtgtatgtatgtatatatatacatatgtgtgtatatatatatatatatatatatatatatatacatacacacacacacatatatatatacatatatacaca

SEQ ID NO: 80973 - DNA, 85 bp, Mus musculus; identical to SEQ ID NO: 57470

SEQ ID NO: 80974 - DNA, 99 bp, Mus musculus
tgtgggagaggtgccatgggagctcagaggcattatgaggacagctgtggacagactcactgtggctggctcacaaactattcattagcacttcacata

SEQ ID NO: 80975 - DNA, 118 bp, Mus musculus
tacatatatgtgtgtgtatgtatacatgtatatgtttatacatatatgtatacaaatacatatatatgtaagtatatatatatatatatatgtgtgtgtgtgtgtatgtacacttaca

SEQ ID NO: 80976 - DNA, 68 bp, Mus musculus
actaaatatttatgtacttctcataggaacttcattagttcctctatgagtaagttattataaagagt

SEQ ID NO: 80977 - DNA, 60 bp, Mus musculus
tagtgtatatatagtatgtgtatatatgtgtgtatatatatatatagtatatatgtgtta

SEQ ID NO: 80978 - DNA, 76 bp, Mus musculus
tgtatatatgtatatgtatgtatatatatgtatgtacatatatacatatatgtatgtacacatatacatatatgca

SEQ ID NO: 80979 - DNA, 107 bp, Mus musculus
gccttagtgcatggtgatctgataggatacatgggacaaatttcaatatttttgaatctgttgaggcctgatttgtgacctattatgtggtcaattttggagaaggt

SEQ ID NO: 80980 - DNA, 87 bp, Mus musculus
gtatttgcaagtgtgttgaatagttatacatatttatagaaaatactctagcaatattatagcttacattttcaagacaacaaatgc

SEQ ID NO: 80981 - DNA, 85 bp, Mus musculus; identical to SEQ ID NO: 57470

SEQ ID NO: 80982 - DNA, 85 bp, Mus musculus; identical to SEQ ID NO: 57470

SEQ ID NO: 80983 - DNA, 99 bp, Mus musculus
tttgcattcattcagttgaagtctacaggccatggaatgaagtcacccacactcagagtgactcttcattcctcagttaagtctttctgtaaatgcaga

SEQ ID NO: 80984 - DNA, 85 bp, Mus musculus; identical to SEQ ID NO: 57470

SEQ ID NO: 80985 - DNA, 79 bp, Mus musculus
gaatgaagctgcattgttgaggcctgagcttcattttaagctctttcgtttttgtggccatacgtgaaagctgaagttc

SEQ ID NO: 80986 - DNA, 85 bp, Mus musculus; identical to SEQ ID NO: 61292

SEQ ID NO: 80987 - DNA, 85 bp, Mus musculus; identical to SEQ ID NO: 58391

SEQ ID NO: 80988 - DNA, 66 bp, Mus musculus
agaaagctctgtggcaggtgaaaggaatgcaaagtctctttcacactctgctaaaatggctcttct

SEQ ID NO: 80989 - DNA, 85 bp, Mus musculus
gccagtgttttcagtagaagtggtacttgtttctggaggattttcataatttttcattagtaaacaagtgctaaaagccaggcac

SEQ ID NO: 80990 - DNA, 85 bp, Mus musculus
acagcagttaaagcatcatttatagaacagaaaggaagggagattctgatttctgtgtgtatgtctgtgtgagtttaagtgctgt

SEQ ID NO: 80991 - DNA, 85 bp, Mus musculus; identical to SEQ ID NO: 57439

SEQ ID NO: 80992 - DNA, 73 bp, Mus musculus
ggaaacaatttttcattgatggtggggagtgcacacttgtaccagcactttgaaaatatatttgattgtttct

SEQ ID NO: 80993 - DNA, 96 bp, Mus musculus
atacatatatatacatgcatacatatacatgtacatatacatatacatggttagattatatgtatatacattatagtatatgtgtatatgtgtata

SEQ ID NO: 80994 - DNA, 115 bp, Mus musculus
gtgttttctgtggaacaggagctcatgactcctttctttgactagtgattttgtggtcctccataattcagtttctctagaattaagagttatgtagcaaaaattctagaattac

SEQ ID NO: 80995 - DNA, 70 bp, Mus musculus
gtatttgtcagactctggcagagcctctcaggagacaggctcctgtcagcaaacactttctggcatctac

SEQ ID NO: 80996 - DNA, 85 bp, Mus musculus; identical to SEQ ID NO: 57439

SEQ ID NO: 80997 - DNA, 85 bp, Mus musculus; identical to SEQ ID NO: 57439

SEQ ID NO: 80998 - DNA, 86 bp, Mus musculus
tatatatacatataaatgtgtttgtatatgtatatatgaatgtatatatatatatatgtgtgtatatatgtatatatagatatata

SEQ ID NO: 80999 - DNA, 92 bp, Mus musculus
gggacaaagatgcagtagggagagtaatctttcatcctaatggaatgaatattagagaatcggagataagtgtggctggggcagagtgttcc

SEQ ID NO: 81000 - DNA, 87 bp, Mus musculus
ggggtgggatttcaggtttcaaaatccatgcaaggcctaccatgtctctctgtgcctgactggatgaggatcaggatataatccctc

SEQ ID NO: 81001 - DNA, 100 bp, Mus musculus
ttgtaggtgtccagaaaattgtccattttatgcagattttcaagtttagtttaatataaacttttgtagtaggatctgatgattctttggatatccacag

SEQ ID NO: 81002 - DNA, 94 bp, Mus musculus
gaccttgttggaataagtgtgtcactgtgtgtgtgtatgttgacgttgcccatgctcaagctatactcagtgtgacacagagtctccttctgtt

SEQ ID NO: 81003 - DNA, 72 bp, Mus musculus
ttattgtgtgtgcatgtgcatgtgtgtgttcccaagatcaggagcaaattgcaacagcatgtctcagagtaa

SEQ ID NO: 81004 - DNA, 60 bp, Mus musculus
actctgttactgctgcggatgggactcagtcagtccctcaatctgcgggagaatcagggt

SEQ ID NO: 81005 - DNA, 77 bp, Mus musculus
tgtgtgtgtgcatgcatgtgtgtgtgtgtgagagagagagagagagagagacagacagacagacagacagacagaca

SEQ ID NO: 81006 - DNA, 99 bp, Mus musculus
tctgtctgtctgtctgtctgtctgtctatctatctatcatttattattgtgttttataaaagaaagaacgaaagggaaacaggagatatgtttggcaga

SEQ ID NO: 81007 - DNA, 80 bp, Mus musculus; identical to SEQ ID NO: 68207

SEQ ID NO: 81008 - DNA, 113 bp, Mus musculus
gagggatttcttttggcatctccctttcacagttaggatgatgctaagattgctcagtagagagagagcagcaaggacattatcatgcgagagagagtgcttttcagtctttt

SEQ ID NO: 81009 - DNA, 99 bp, Mus musculus
gttatgtagaaatgcagatgctgtaatactgtctgctaaaagctattaaatggctttcttggcaggcatattattgtaaatagtctcacactggataat

SEQ ID NO: 81010 - DNA, 78 bp, Mus musculus
gtatttactgtatgcatgtatgtatgtatgtaggtatggtatgtatgtatgtatgtatgtatgtatgtatgtatgtat

SEQ ID NO: 81011 - DNA, 66 bp, Mus musculus
gcagtatcaggggctgtctctgactcggtagcctacctttagatctctttgccctaactgtgctgc

SEQ ID NO: 81012 - DNA, 102 bp, Mus musculus
gtgaacctcactctgttcccagaaactgtcttgtaagagtaggtgagggcctgtttgagacatgaatgacagctctgtagatagtctgaactttgagttggc

SEQ ID NO: 81013 - DNA, 85 bp, Mus musculus; identical to SEQ ID NO: 57439

SEQ ID NO: 81014 - DNA, 109 bp, Mus musculus
tagttgcttaagtattctgtgtcttaattcagtttcatgacttaaaagtttttctttttgtacatcaaattgaattaacaagaattaatttaaaattatttggtgacta

SEQ ID NO: 81015 - DNA, 73 bp, Mus musculus
gtatatatgcatgtatatatgtgtgtatatatatacacacatgtatattatatgtgtgtacaatgcatatatg

SEQ ID NO: 81016 - DNA, 101 bp, Mus musculus
gttagttggttagttgtgccattttgacttttcaatttgttgtagacaaatgttttcaacactaggaaatgtggatctctatggctctagttatcagtaat

SEQ ID NO: 81017 - DNA, 85 bp, Mus musculus; identical to SEQ ID NO: 57470

SEQ ID NO: 81018 - DNA, 85 bp, Mus musculus
gtccatggtggtttgataggatgcatgggacaatttcaatatttttgtatctgttgaggcctgttttgtgaccaattatatggtc

SEQ ID NO: 81019 - DNA, 78 bp, Mus musculus
agttgtgtgagagtagagacagtgagctaagtccaaacatgcaggtgttcactgtctctctgcttggcgaatatgact

SEQ ID NO: 81020 - DNA, 112 bp, Mus musculus
tatgaaatagcgtctgagaattttcttttgtgtgtaaaccactggaaatatatatataaatatatatattgctatttacagcctcacaaattcatctgccttgtatttcatg

SEQ ID NO: 81021 - DNA, 100 bp, Mus musculus
gtgtatgtgtgtggtgtatgcatatatatatatgcatatatatatatatgtatgtgtgtatgagtgtgtgagtatgtgtgtctatggtatatgtgtgtgt

SEQ ID NO: 81022 - DNA, 136 bp, Mus musculus
tatatgtgcatatggtatgtgtgtatgtttatatgtgatatacataagcataatgatatatgtatgtatatatatgtgtgtgtgtttatatggtatgtatgtgtgtatatgatgtgtgtatgtatgtatagtatgt

SEQ ID NO: 81023 - DNA, 72 bp, Mus musculus
aacttgcataaatacatatacattatgtattcatatatggaatgtaacaatgtatctgtgtatatgtaagtt

SEQ ID NO: 81024 - DNA, 85 bp, Mus musculus; identical to SEQ ID NO: 57470

SEQ ID NO: 81025 - DNA, 67 bp, Mus musculus
cacagggcagctctttgcgcagattaacctgcaaactgcaggatgtgtctgtctgtctgtctctgtg

SEQ ID NO: 81026 - DNA, 68 bp, Mus musculus
ggacaagtgtgtgtagagcatgctggctcttgtatgattcccagtctgcctgtctgcctgacttctct

SEQ ID NO: 81027 - DNA, 177 bp, Mus musculus
atatatgattatatgtatatatgatatatatgtatatgtctgtatgtatgtctgtgtgtatatgatgtatatgtatatgtgtatgtatatatgatgtatatgtatatgtctgtttgtgtgtatgtgcatatgtatatgcatatttatatatgtacatatacacagtgcctaaatgtg

SEQ ID NO: 81028 - DNA, 85 bp, Mus musculus; identical to SEQ ID NO: 79488

SEQ ID NO: 81029 - DNA, 80 bp, Mus musculus
cactggtgagaggactgaccgcgtgtaaattttgatcagtgaggagaagatgattcaaggtggaatgttctctgcttgtg

SEQ ID NO: 81030 - DNA, 68 bp, Mus musculus
atatgcacatatatgtatatgtatgtatatgtatatatatgtacacatatacatatatgtatatatgt

SEQ ID NO: 81031 - DNA, 108 bp, Mus musculus
ggagtggtgtggatcatgagggctcccctttcataaatagattaagtagcaaagcttttttatttttttgaccaggctggcctcaaactctaaaatacacctgcctct

SEQ ID NO: 81032 - DNA, 122 bp, Mus musculus
tagttttatactgtaagaaataaatctgtattctctacaagttacttagtcttttgaaaagaagcagctttgaagtggggtaatgggtagagactggaagagcttcaagggttagctataaa

SEQ ID NO: 81033 - DNA, 87 bp, Mus musculus
cagtttttctcagccttctttgacggtggcacggttttaaacttttcagatgtgagtgtgaacaggcgctggggagctagactgaga

SEQ ID NO: 81034 - DNA, 117 bp, Mus musculus
ctctctgtgttgggaattttgtgtggcttgaacttgtgtaggctttgtgcatgctgtcacagtctctgtgagtttatatatgatcaatcatgtttcacctggaagacactttctgag

SEQ ID NO: 81035 - DNA, 79 bp, Mus musculus
gcagcaggatctgagtggagtgagaggacaattgtgattaatttgcacatcttcagtcctcctaattcatcctgctagt

SEQ ID NO: 81036 - DNA, 69 bp, Mus musculus
gtggacctcgggtagcagctgagagaaggtgccatcaaggagcactcagctgtgtcactcttactctgc

SEQ ID NO: 81037 - DNA, 115 bp, Mus musculus
tccagcttgtttctttggaccatttgcttggaaaattgttttccagtctttcactctgaggtaatgtctttctttttccctgagatgggtttcctgtaagcagcaaaatgttggg

SEQ ID NO: 81038 - DNA, 56 bp, Mus musculus
tatatatgtgtgtgtatatatgtgtgtacatatacatatatatatatatatatata

SEQ ID NO: 81039 - DNA, 76 bp, Mus musculus
gttcatatgttacaggtgttaactgtttttgtgggactcctaacaatgggagcagtgtgtctctgactctttggac

SEQ ID NO: 81040 - DNA, 86 bp, Mus musculus
ggtattggaactcagccatgttcattcatgaactttctgctactcttgtgctttattggcagagttgaacatttgagacagacacc

SEQ ID NO: 81041 - DNA, 114 bp, Mus musculus
ccagatttgtactgttacatatatttatatatacaatattctttatttatttgttatatatcttataacaagcatatataaaattgttacatatatttagtataaatatactgg

SEQ ID NO: 81042 - DNA, 97 bp, Mus musculus
tccatagcaaatccccctgctgtttaatattaatatatactgattgagactataaagtagataaatatgtaacaactctgaggatttggctactgga

SEQ ID NO: 81043 - DNA, 72 bp, Mus musculus
ctgcaatttatgtttttcattatgaaggaactggtattgtcccttcaggcatagtaaaaatataaatagtgg

SEQ ID NO: 81044 - DNA, 85 bp, Mus musculus; identical to SEQ ID NO: 57470

SEQ ID NO: 81045 - DNA, 95 bp, Mus musculus
ctatcagtactccaggcagagacaccagagtgtgcagtgcaatggatgtgtgagacagagcgctacacctgggtttcaacaggaagcactcaaag

SEQ ID NO: 81046 - DNA, 114 bp, Mus musculus
ctactgatgatgttattgtagagagttcttcagttgtcactgtgagagaagtttcagaggagtcgataatatcaccatgtagtgattgattattggatactttgttctgtcaca

SEQ ID NO: 81047 - DNA, 85 bp, Mus musculus; identical to SEQ ID NO: 57439

SEQ ID NO: 81048 - DNA, 111 bp, Mus musculus
agatgttaccatgcaaaagatatcctgggtctctgtctcttgctgtctctcatcgacttgtgcatgatgtaatttgagccttaggtgtagcggttgcattggagacgtact

SEQ ID NO: 81049 - DNA, 116 bp, Mus musculus
tcttcactctgcacttctaatcctagaaaattctttcagagatattgtagttctgagaagcacgggtagcagatgatgataatgagagaaacggggaggggagggaaggggacaga

SEQ ID NO: 81050 - DNA, 68 bp, Mus musculus
ggggaggagaacggggtggttggagaccaggctgagagaggccaactcacgacactgtctgtctctct

SEQ ID NO: 81051 - DNA, 109 bp, Mus musculus
tctaactctctcctatctttttctctctctctgtatgcatgtatgaatgtatgcatgcatgtatgtatgtatgcatgcatatatgtatgtgtaaaaggtatttattaga

SEQ ID NO: 81052 - DNA, 164 bp, Mus musculus
acatatatatatatatatatatatatatgtatgtatatatacacacatacatacatatatatgtatatatacacatacatatatgtatatatgtgcatgatatatatgcatacatatatgtatatatatgcatgatatatacatatatgtatatatctgtgtgt

SEQ ID NO: 81053 - DNA, 97 bp, Mus musculus
ttatcccatgtgcagaagtgatcgtcagtcaacttctcattgtaaaccgttgagtgagaagacagtgagatgatagatccacggtgctctaggatga

SEQ ID NO: 81054 - DNA, 115 bp, Mus musculus
gcatataaacatatacacatacatatacatacacatacacacacacatatatatatacacatatatgtatatatatatgtgtgtgtgtgtatgtgtatatatatttgaattatgc

SEQ ID NO: 81055 - DNA, 84 bp, Mus musculus
ttcgatgatcactactgattttcatcagggaaatatacttacttttaaatttttcctgaaggaattcagaatgtgcttaaagaa

SEQ ID NO: 81056 - DNA, 117 bp, Mus musculus
gagcttcggggctggagagatggctcagtggttaagggtactgactgctcttccagaggtcaaaggttcaattcccagcacactcatgacagatcacttcagttctaggactactga

SEQ ID NO: 81057 - DNA, 72 bp, Mus musculus
cacagcttgaaggggacaggggtttgtgtgccagagtctcctctctgcacactgtctgtctgtgggtctgtg

SEQ ID NO: 81058 - DNA, 77 bp, Mus musculus
tgttcactgatgaaagtgagaactctttagggctgttgggaaggacagcaataggtttcactagctttcagctaaca

SEQ ID NO: 81059 - DNA, 91 bp, Mus musculus
tgataaggaaagagggaggagggttggagagatggcgcagcggttaagagcactgactgctcttccaaaggtcctgagttcaaatcccagc

SEQ ID NO: 81060 - DNA, 77 bp, Mus musculus
tagtggctctgtctcagtgtctgcaaagtctaagacacagggaagggtggggatgtagctctgtgacagactgacta

SEQ ID NO: 81061 - DNA, 66 bp, Mus musculus
ggtggactggttattagcattcgtctctctctgtttcagactgtggattcagtgtgaccagctgcc

SEQ ID NO: 81062 - DNA, 94 bp, Mus musculus
tcagtatgtcttttgcatcttggccctagagttagtctctctctctctctctggaactctatacaaggtcagatgtttctcagagccagcatga

SEQ ID NO: 81063 - DNA, 109 bp, Mus musculus
tgagacagtattgcaaccagtgccccgttcggatgcccctgcactctctctctctgagggaatgtagagttatctacaggagagcagactgctattcaatcctgtttca

SEQ ID NO: 81064 - DNA, 78 bp, Mus musculus
ccatgggcacagagtcagcagacacccccaaggtccctagaggactctccatgtgatcttatgaccacctgtgagtgg

SEQ ID NO: 81065 - DNA, 72 bp, Mus musculus
ctgacaaacacaaagaggcaaggtgtatctgtggtggtaggaggatatctgtgtcactgtctgtggttgcag

SEQ ID NO: 81066 - DNA, 70 bp, Mus musculus
gcaagttatcatatatatatgtctgtgtgtataaacatatatatgtatgtatatatgtatgtttccttgc

SEQ ID NO: 81067 - DNA, 82 bp, Mus musculus
tgtatgtatgtatgtatgtatatgatgtgttaatatttagtctttaaaatatatacacagatatatacatatattatatgca

SEQ ID NO: 81068 - DNA, 77 bp, Mus musculus
ggtggtagtctgagagatggggtttgcttcctcattagaaatgcccctagcactctccctccctcactggccccacc

SEQ ID NO: 81069 - DNA, 111 bp, Mus musculus
cttatgaacatggtgggcaggaggataaatctaggctctgaaagtgtgtttttaaatttataacaagattgagaactgactggtttactttattcctacatgaaaattgag

SEQ ID NO: 81070 - DNA, 119 bp, Mus musculus
gattttgtgtatcagacctggagtctgggttgcagtggttctcacttcaaagagggaacagtctgagctgtgatgagcataactgcaagggattaaagtgctttaaatgcataaatttc

SEQ ID NO: 81071 - DNA, 84 bp, Mus musculus
aggttgtcagtctgcaagccccagcctccctactgtctctgtctgcacagtgcttaggctataggtgcacacatggccacacct

SEQ ID NO: 81072 - DNA, 92 bp, Mus musculus
aactgattgtgctgatccctgtctctgtatagccaccttttctctactgtacatagagagctcagaacaggctcattcttctataagaagtt

SEQ ID NO: 81073 - DNA, 80 bp, Mus musculus
gtctccctcagtgcctctctgatttgtagctagtcaatagaatgaataaagatcttagtctggggccaagactgtgagac

SEQ ID NO: 81074 - DNA, 71 bp, Mus musculus
tatatgtatagtgtttatatatgtgtatacattcatatatgtgtgtgtatatatagacatatgtatgtata

SEQ ID NO: 81075 - DNA, 78 bp, Mus musculus
cccctgcctgtcagtctgtctgttgctccaatgtttaacactctgctgtgcatcagaggacaaaatgatgggaggagg

SEQ ID NO: 81076 - DNA, 77 bp, Mus musculus
tccctgtatctgtttccatctacctttgctggatgaagcctctcaggagagagtagacagagacctgtgattgggga

SEQ ID NO: 81077 - DNA, 112 bp, Mus musculus
gtgtgtgtgcatatgtgtgtgcacatatgtgcatgtgtgtgcatatgtgtgtgcacatatgtatgtatgcatgtgtgtgtgtgtatatacacccatgtttatgtgccttgtg

SEQ ID NO: 81078 - DNA, 66 bp, Mus musculus
gcacttatatggattttatgtgtgggggtgctttgcctgtatgtatgtatgtatgtatgtgtgtgc

SEQ ID NO: 81079 - DNA, 91 bp, Mus musculus
cttttcaatcactaggtagccactgggcaacaggcttcatcctcttagtagcacttttcactctcagtgactgattctagagaaagaaaag

SEQ ID NO: 81080 - DNA, 76 bp, Mus musculus
cagtctctgtgactctgaggcactttggctgcagtggcagacaagtgaagtcgtctcaaaaagcaccggagagctg

SEQ ID NO: 81081 - DNA, 58 bp, Mus musculus
ctgggagggtcccagagagtgatgttcgcaccagtcactgtctgtccctgtgatccag

SEQ ID NO: 81082 - DNA, 66 bp, Mus musculus
tgtgcaccgctcagtggacagtttgagtcttaaaatgtttgaatttttgactgagctagctgtata

SEQ ID NO: 81083 - DNA, 73 bp, Mus musculus
cctctcactgtcccagactgtctctgcaaatcaccttggtgcaatgccagctgccttctgacacctggagagg

SEQ ID NO: 81084 - DNA, 81 bp, Mus musculus
cacattgggaaacatggcggcacacagagagacctggtgctagagaggtagctgtgagttctgcatctgcatctggatctg

SEQ ID NO: 81085 - DNA, 85 bp, Mus musculus; identical to SEQ ID NO: 57439

SEQ ID NO: 81086 - DNA, 87 bp, Mus musculus
agacactgtgcgtgcacatatatgtatggaactgtgagtgtgtgtgagtgcatatatgagtgtgtgtgtgtctgtgtatgtatatgt

SEQ ID NO: 81087 - DNA, 87 bp, Mus musculus
ggcaagaaataagagttcattgtggagtgaggagactggggggaatgttctgcccctcactctctcactctagtccttcccattgcc

SEQ ID NO: 81088 - DNA, 68 bp, Mus musculus
ggtatttatcagtaattacagccaagggggtctctcattctccctgactggctgtccattcttaagcc

SEQ ID NO: 81089 - DNA, 70 bp, Mus musculus
gtagctcgctcttctcgaaagcactaggggtgtctcagtctcactcagtcatcgaagagagtgggtctac

SEQ ID NO: 81090 - DNA, 101 bp, Mus musculus
tcaccaggccaatggagtatcctagactccagccagtggctcagttcaccagggtgctgttctgcccttgctggggtcatttatatatcattgttaagtga

SEQ ID NO: 81091 - DNA, 72 bp, Mus musculus
tcttgaacaagtgattgagaaattcttgttgaattttttcatagagtaggttgagcaatcactgtgtcaaga

SEQ ID NO: 81092 - DNA, 100 bp, Mus musculus
gaagtcagatgttgggctggagagatggctcagtggttaagagcattgactgctcctccagaggtcctgagttcaattcccagcaaccacatggtggctc

SEQ ID NO: 81093 - DNA, 81 bp, Mus musculus
ggcttggtttgtggactgtgtctgtcactgaacctgaagttcactgattggttaagctggctggccagctacaagatcacc

SEQ ID NO: 81094 - DNA, 70 bp, Mus musculus
ttctgtcagactcagtgtctctggttttaagttagtctttgatccactgggccttgagttttgtgcaggg

SEQ ID NO: 81095 - DNA, 74 bp, Mus musculus
tatatatatttgtacatatacatttgtataagcataagcatgttcgtgtgtgtgtgtgtgtgtgtgtgtgtgtg

SEQ ID NO: 81096 - DNA, 72 bp, Mus musculus
ggttatatacatttatatagtttatatagctataaggaagaacttatatagctatattgagcttatatagct

SEQ ID NO: 81097 - DNA, 96 bp, Mus musculus
aggtgcatacttgaggtgttttgtatctctgtgtggttatgcacaaatatgtatgtgtgtatctggaggatataaattaaatctatattgggtacc

SEQ ID NO: 81098 - DNA, 132 bp, Mus musculus
tgtatacatcatgtttatatacatttattatgtatgtctatattgtatgtgtacttatatgtgtatataatatgtatgtatataacatatacatatggtaatatataattaataaatataatatcatgtata

SEQ ID NO: 81099 - DNA, 69 bp, Mus musculus
ctgccatagttggcaaaaggtgaggggtaggaaggcatctctctctctttgactcatatcacatggcag

SEQ ID NO: 81100 - DNA, 125 bp, Mus musculus
ctttctgcctcctgccatctcagggactttagggtgacaagaagggcttgtccctcagagagtggatagctggttggtagattgctgtggagggagctaaaggttgctaggacgttcactgtctg

SEQ ID NO: 81101 - DNA, 85 bp, Mus musculus; identical to SEQ ID NO: 58391

SEQ ID NO: 81102 - DNA, 68 bp, Mus musculus
agcttaagggcctggagagatggcttagtggttaagagcactgactgctcttccagaggtcctgagtt

SEQ ID NO: 81103 - DNA, 119 bp, Mus musculus
tgtgttggtgctatgaggtcactgttaagccatcagaagttaaagagaagattgatagcagatttagtttttttctttctcttttgggtatttaagaggatacccacacattctccaac

SEQ ID NO: 81104 - DNA, 69 bp, Mus musculus
tacatatatatatatattggttatatatgtgtatgtatatatacatatatatatgtatatgtgtatgta

SEQ ID NO: 81105 - DNA, 114 bp, Mus musculus
ctatatgatttaagatacaaatgtggggtgtgggggagatggctcagaggttaagagcactgactgctcttccagaggtcctgagttcaattcacaaccatttgttatgggatc

SEQ ID NO: 81106 - DNA, 74 bp, Mus musculus
tgggggggctagagagatggctcagcagttaagggcactgactgctcttccagaggtcctgagttcaatcccca

SEQ ID NO: 81107 - DNA, 103 bp, Mus musculus
ttagctgccttgtttcacggagtctaactaggtctgtcccactcactttcttcagtgagaaggtctttgagagcttgtgtccttttactaaacactcagttga

SEQ ID NO: 81108 - DNA, 81 bp, Mus musculus
ctgtccaatgtttggctctgtgtctctgtatgtttcagtcggctgcctggtggagcctctcagaggacagttatgctaggc

SEQ ID NO: 81109 - DNA, 102 bp, Mus musculus
gcgagggcgctttgaaaccagctcagcatctccttatggcaactatgcaactaagtagatagttagctgttgtccaggttgggaagttcttagtgttctggc

SEQ ID NO: 81110 - DNA, 93 bp, Mus musculus
attcaggaatggcgatgagtagtgacgccatcatctctctgtctctgttatagcaagaagaaggaagaggatgtgaatgcttccatgctgaat

SEQ ID NO: 81111 - DNA, 104 bp, Mus musculus
atgggtttcctgagctctgaggggaggaatttgatggggacatttaaatctgagtgtctcaaggtctctgactctctatgtaatatctggctatgggtctctgt

SEQ ID NO: 81112 - DNA, 72 bp, Mus musculus
acaggagaggtatgaggcagagtggcactaactttacgtattgactgctagtgtgtgtgactctgtcactgt

SEQ ID NO: 81113 - DNA, 85 bp, Mus musculus
gtccatggtggtctgacaggatgcatgggacaatttcaatatttttgtatctgttgaggcctgttttgtgaccaattatatggtc

SEQ ID NO: 81114 - DNA, 78 bp, Mus musculus
gatggtgttttggttttcttcaggatctgttgttaggtctcccttttcatttctgattttgttaattaggatgctgtc

SEQ ID NO: 81115 - DNA, 76 bp, Mus musculus
gtgtgtgtgtgtgtgtgtgtgtgtgtgtgtgtgtatgtgtgtgtgtatacatgtaagtgtgcatatgcatgtgcac

SEQ ID NO: 81116 - DNA, 85 bp, Mus musculus; identical to SEQ ID NO: 57439

SEQ ID NO: 81117 - DNA, 69 bp, Mus musculus
ttctttccacttggatctggagccacgggcatgcgtgggatgcctgggtctctctgtgagtgtggagaa

SEQ ID NO: 81118 - DNA, 90 bp, Mus musculus
gggaggatttaatagatgagtgggctaatagtgttagaatttaagctaaatgtactcactcagtttctctcaccatcaattcaatctcct

SEQ ID NO: 81119 - DNA, 87 bp, Mus musculus
tgcagatcccctttccttatcacttttccagccagctttgtgactctaagtgttggacggagaactgataagggtaggtgactggca

SEQ ID NO: 81120 - DNA, 64 bp, Mus musculus
ctatggtgatcactggaatggtcagtcagtccctgtggtggtcagtcttagtcagtcactatgg

SEQ ID NO: 81121 - DNA, 95 bp, Mus musculus
gctgcatatgtcacacaggttagggttgccaggggatctgtctctgtctgggagacactgatgtctgtgttacagcctgtgtgccatgcctaagc

SEQ ID NO: 81122 - DNA, 115 bp, Mus musculus
aggactgtgttttatatgacatggggaagaagccacagtgccttaatgtttctactaactctgagtctgtctggttaacttaacccaagattctccaataacacttcatgtgcct

SEQ ID NO: 81123 - DNA, 78 bp, Mus musculus
cctctgggtagaagtggtggtcttacctgtgctcacaggattgtcagcactcctgagatacactctctctcccagtgg

SEQ ID NO: 81124 - DNA, 72 bp, Mus musculus
gagcatgaggaagcagagtctcagggaaaggcagtgactcatctgatgtctctgactctgaacccatgtctc

SEQ ID NO: 81125 - DNA, 78 bp, Mus musculus
actctgctggctttctttacaccagccacctgtttccgaggtgaaatctgtctgtgtgtgggagagctgtgctagtgt

SEQ ID NO: 81126 - DNA, 84 bp, Mus musculus
ggctcagaataggggctggagagataggctcagcggttaagagcactgactgctcttccagagttcctaagtttgactcccagc

SEQ ID NO: 81127 - DNA, 113 bp, Mus musculus
tatgtttatggtcgtttagaaagatttcattatgggctggagagatggctcagtggttaagagcactgactgctcttccaaaggtccggaattcaaatctcagcaaccacatg

SEQ ID NO: 81128 - DNA, 84 bp, Mus musculus
ggactttctctatactgtgccagggtgagaggctgtggatgccttgtgtcagcctctctctttgatggggttagggtagtgtct

SEQ ID NO: 81129 - DNA, 106 bp, Mus musculus
agtgaatgctaaaatggccagggcatcttattagcaatttaaaaataattttaaaattatatttgtgggggctggagagataactcagtggttaagagcactgact

SEQ ID NO: 81130 - DNA, 66 bp, Mus musculus
tctgtctgtctctctctctcccaaccccatgtgtgtgtgtgtgtgtgagagagagagagagagaga

SEQ ID NO: 81131 - DNA, 60 bp, Mus musculus
tctctctctctctctctcacacacacacacacacatggggttgggagagagagagacaga

SEQ ID NO: 81132 - DNA, 80 bp, Mus musculus
ctttatgttttttactctgtctgtatcactgtcagtgttctatagatagagttacaaatgacagagtcattaacatattg

SEQ ID NO: 81133 - DNA, 108 bp, Mus musculus
ttatctgttatcatgtgccatctactttgttgcatgtgagaagagagtgactagacactaagcatgtttacatctaatactggaagatggtaaaagcgatggagatag

SEQ ID NO: 81134 - DNA, 93 bp, Mus musculus
gtcatggcctcagcagtcaacttgacagaacacagagtctcctgagaaatgagaactgtggaaggttctgtccctaggcaggtgggtgtggac

SEQ ID NO: 81135 - DNA, 87 bp, Mus musculus
gaaaggcaatgtttgtttatttgtgtatgtgcaagtgtgtatatgtgtatatatgtatatacttgagtgcccttaattcattctttc

SEQ ID NO: 81136 - DNA, 83 bp, Mus musculus
gaagctgcagtggttcacataagattaagccagtcagctattctatgatggagtggaaagatgtttgtggatcactatgtttt

SEQ ID NO: 81137 - DNA, 81 bp, Mus musculus
tagtatgtacttgatttgttcttcctgtaaaggggggtagtttctgcttcgttcccagtatatgaatatttctatatgcta

SEQ ID NO: 81138 - DNA, 85 bp, Mus musculus; identical to SEQ ID NO: 57470

SEQ ID NO: 81139 - DNA, 152 bp, Mus musculus
acacacacacacacaaacacacatatatattcatttcttggtttgaatttttctctggcaaaatttttatatgtatatgtgcatatgtatagatatgtgtgtgtgtatatatatgtatatgtgcaaatgtgtttgtgtttgtgtgtgtgttt

SEQ ID NO: 81140 - DNA, 90 bp, Mus musculus
cactgttttggttctgagacagtctcactctcatttccaggctcagttggaactcattgtgtagttcagactgccttcacacccacagtg

SEQ ID NO: 81141 - DNA, 101 bp, Mus musculus
cagagcaagagtgtacatgctggactcaaactcaaagagatccaccagccttgtttccagagtgctgagtttaaaagtatgtgccaccaccacccagcctg

SEQ ID NO: 81142 - DNA, 114 bp, Mus musculus
aaagtctatttgttatctatctagcatctatctatctatctatctatctatcaatcaaacatcagtgaagatatctggagagatggctcagcagttaaggatggtcacaacttt

SEQ ID NO: 81143 - DNA, 128 bp, Mus musculus
tatatatatatatatatatatatatatatatatatatgtatatatatgtatatatgtatatatgtatatgtatacatatatatatgtgtgtgtgtatgtatatatatatgtgtgtgtgtgtctatgca

SEQ ID NO: 81144 - DNA, 102 bp, Mus musculus
tcattatttcaccataggagtgagtgatatatatgtaaggggaaaagacatattcctagtatgtgtatatatatatgtatgaaatgtggggggaaattatgg

SEQ ID NO: 81145 - DNA, 74 bp, Mus musculus
acatggaggagctcagatcaggcgggaagtgaaactgtttgcacatctctgtctgtctgtgcatctgtctgtgt

SEQ ID NO: 81146 - DNA, 73 bp, Mus musculus
gtatctgtctgtctgtgtctctctgtgcctcgtgtctgtgtagacaagaggagagagaacaagcagaggttac

SEQ ID NO: 81147 - DNA, 85 bp, Mus musculus; identical to SEQ ID NO: 57439

SEQ ID NO: 81148 - DNA, 115 bp, Mus musculus
gattctcccgaatgtgacttccaggcctggctctggaggcagcgggtgaagaaggtttcactctgtggctgtgacagagaccggggaacaatggtagggcggcgaggggagacgc

SEQ ID NO: 81149 - DNA, 118 bp, Mus musculus
gtttgagaaagattttgtagcgtggactaaagagaatcgtatgcttcttaattttatttttttttcagtattaggaatggattccagggtatgctaggcagacactcaatctctgagc

SEQ ID NO: 81150 - DNA, 114 bp, Mus musculus
atgtatttttatttcatgtatatgagtgtttttcatgtatgtatgtatgtatgtatgtatgtgtatgtatctgtactgtgtaactgcctcatatccatggagttatgggtgtgt

SEQ ID NO: 81151 - DNA, 85 bp, Mus musculus; identical to SEQ ID NO: 57439

SEQ ID NO: 81152 - DNA, 85 bp, Mus musculus
gtccatggtggtctgataggatgcatgggacaatttcaatatttttgtatctgttgaggcctgttttgtgaccgattatatggtc

SEQ ID NO: 81153 - DNA, 61 bp, Mus musculus
ctcagccattgccaatgcataggaatgctactgtgtctgtgtgtgtctgtgcatgcctgag

SEQ ID NO: 81154 - DNA, 119 bp, Mus musculus
ttgttttgtttttttgtaaaacccggcatgaaaccactttggcaaatggtacaagcttgtttagaatataagcgatgtgtcgaagcagtaaaggcaggtcagaaagttcttacagaaca

SEQ ID NO: 81155 - DNA, 90 bp, Mus musculus
agggtgggtgtttttgcaactggttactttggagatggaaggtaagtccctattactgaagacactgtgcacttcagaaacagagaccct

SEQ ID NO: 81156 - DNA, 80 bp, Mus musculus
gacttagacatttcaagtgtccccttttgatgcaacaggtattactgtgtgtctctgtgtaacagatgagtgtctatttt

SEQ ID NO: 81157 - DNA, 91 bp, Mus musculus
gctgctcttgggatacactttactgcagaagattgagtacatagccacctttaagtttttctttttcagatagagtgggttttgacagtgc

SEQ ID NO: 81158 - DNA, 84 bp, Mus musculus
tgtctctctgtgtctcatctctctctctctctttctcttagacagagatgagagacagatagaaggagactgaaagagagaaca

SEQ ID NO: 81159 - DNA, 66 bp, Mus musculus
tatggatatttgtgtgtgtatatatatatatgtacatatatatataagcatattacacataccata

SEQ ID NO: 81160 - DNA, 101 bp, Mus musculus
gggagctgggggttggagataggagctgggagttgggggctgggagcgtgccacaggaagactcaggctctctcaaacagagcttacttcataaagctgtc

SEQ ID NO: 81161 - DNA, 75 bp, Mus musculus
tagattgaatggttgagtctgggttccaaggttctaataaaggggcaggcacacgtctctcagccacactctctg

SEQ ID NO: 81162 - DNA, 93 bp, Mus musculus
ggttttgttttgttttagaataagcattttttttccgatgaattaattcttatttataaaggagcatgaatgatatgacaaactaatagaacc

SEQ ID NO: 81163 - DNA, 94 bp, Mus musculus
gggctggacatgtgtacccatgagatatgtgttagaaaggaaacagccaactcttgctctctcttactgtgtgtgtactaaacaaacctagtcc

SEQ ID NO: 81164 - DNA, 107 bp, Mus musculus
agtcaaataatatatgaattgttgaagaaaacagcaaatattgatacttaaaggtagttccttgaaaagttgtcagctgttcatgataaaacacttattatttaact

SEQ ID NO: 81165 - DNA, 96 bp, Mus musculus
catctgaggattgtctgtgggcctcacactgtctctatggaactattcattttacagcagtacttggaagttggccccacattcactctttctgtg

SEQ ID NO: 81166 - DNA, 59 bp, Mus musculus
gagtaatattggcagctgtgtttggggtatttctactgagttcagtgtcagtgtctctc

SEQ ID NO: 81167 - DNA, 73 bp, Mus musculus
ggcactggacatgcaattggtgtgtgcttccttagggagagcccctctctcactcacagcttctctcagtccc

SEQ ID NO: 81168 - DNA, 110 bp, Mus musculus
atcactgtgttggagtcgatctatgatttttaaatatgatattgttcatgatgctgctatccctgtgtttgatacataaatgtttagaattgtaatgtcctctcggtggt

SEQ ID NO: 81169 - DNA, 112 bp, Mus musculus
ttttgtttggtttgggttcattggttggaacattggcaagtgttttagatgttttgtctacatggcacggttcatggatatgatcagaggtgacttggagcccctgatagag

SEQ ID NO: 81170 - DNA, 94 bp, Mus musculus
gaaggaagagctcaccagtcattttgttgatgtcaatgttaaatatcaccatgatatttataactgatttgcaaacactaaatgagttaccttc

SEQ ID NO: 81171 - DNA, 77 bp, Mus musculus
caacggagatcagctgcttctgtccattggttgggtgcaactaactctctgcctgtgacactttcagctgtttgttg

SEQ ID NO: 81172 - DNA, 97 bp, Mus musculus
tacaagtcattccaattccatatatttattctatgtgtgcgtgtgtgtgcgcacgcgtatctatctgtgtctgtgtgtgagtgtgaaatgaaatgta

SEQ ID NO: 81173 - DNA, 127 bp, Mus musculus
accagttggaacatcttctggatatatgcccaggagaggtattgcgggaccctctggtagtactatgtccaattttctgaggaacctccagactgatttccagagtggttgtacaagcttgcaatcc

SEQ ID NO: 81174 - DNA, 86 bp, Mus musculus
gatcaattgtcaccctctcagtgtgtctccaggccctccatggtaggaacacagcttggcgtcagctggcagggtatggcagggtc

SEQ ID NO: 81175 - DNA, 85 bp, Mus musculus; identical to SEQ ID NO: 57439

SEQ ID NO: 81176 - DNA, 117 bp, Mus musculus
tagcccttcagtatgcctggatgagagggtctctggatgctttgacccgatgctcacatggccatctctctctgtgtctgtggggttgtgaaagtcagtctgtgttgtggtctagca

SEQ ID NO: 81177 - DNA, 94 bp, Mus musculus
ttagctaataattagaagaaaggaggataaatgatgaaccatactgatactgtgaagaaatctttttatttttctttctttttttgagtactga

SEQ ID NO: 81178 - DNA, 85 bp, Mus musculus; identical to SEQ ID NO: 57439

SEQ ID NO: 81179 - DNA, 117 bp, Mus musculus
gccagaattgaaatcgaaagcgttatgtcactaacaatattgtgcctggccccctgtatgcaatcagctgtgtgtgagttcatgcttttttcttgtggggatttccaattacctggt

SEQ ID NO: 81180 - DNA, 69 bp, Mus musculus
gggagcatctgtgtctgtatttgtcatgctctggtagagcctctcaggagacagctataacagactcct

SEQ ID NO: 81181 - DNA, 82 bp, Mus musculus
tttgcctaagatgtatgaaatacttggaaacttaagtaggggatactgcaagtccaagtgcatcgggattatatagtgcaga

SEQ ID NO: 81182 - DNA, 85 bp, Mus musculus; identical to SEQ ID NO: 57439

SEQ ID NO: 81183 - DNA, 78 bp, Mus musculus
cacagattctctcacaggctgtgttcttcctagttcattcccactgggcattttgagcatcagctgcagactgctgtg

SEQ ID NO: 81184 - DNA, 60 bp, Mus musculus
agggcagagttgagacagggcctcagcaactgagggcctctctcttgctctcagtgtcct

SEQ ID NO: 81185 - DNA, 96 bp, Mus musculus
gatcagccttagtccatggtgatctgataggatgcatgggaaattttcaatatttttgtatctgttgaggcctgttcagttaccaattatatggtc

SEQ ID NO: 81186 - DNA, 80 bp, Mus musculus
ctgtgaaggagcagtaaaaatgcctgtttacagggctagagggacagctcagtggttaagagcactgactgctcatccag

SEQ ID NO: 81187 - DNA, 85 bp, Mus musculus; identical to SEQ ID NO: 57439

SEQ ID NO: 81188 - DNA, 67 bp, Mus musculus
gaatggcgtctgtctgtctgtctgagatcactttttccctgatagcaagcaagcagctgaggcattc

SEQ ID NO: 81189 - DNA, 67 bp, Mus musculus
gatgatctgtatgctgttgatgatgattgactaaagtcctgtgattatcatcatcatcatcatcgtc

SEQ ID NO: 81190 - DNA, 66 bp, Mus musculus
cagaccctgcaacttagatggaagcatcataccaggtgtttgtctgtctgtctgtctgtctgtctg

SEQ ID NO: 81191 - DNA, 87 bp, Mus musculus
gtttgtggtctgggctgctaccagaaactaagtggaggacattcatctgtgctcctgctgactgtaaagactgaggactacttttgc

SEQ ID NO: 81192 - DNA, 106 bp, Mus musculus
tgtgtgtgtgtctatgtgtgtgtctaggtgtatatgtgcctatatgtgtttatatatacatatatgcatatatatgcgtctatgtgtgtgtataggtgtatatgca

SEQ ID NO: 81193 - DNA, 69 bp, Mus musculus
gagcctatatgtgacaacctccatatagactgtatggcagtctgtctgtgtgtctgtgactacttgctt

SEQ ID NO: 81194 - DNA, 109 bp, Mus musculus
gggtgtcagctgactctcaggaacagcaggtcactgatggcacttgagagaacacttagagcactgaactgtgtcaccttctgctatgtttgtgaggaggttctcaccc

SEQ ID NO: 81195 - DNA, 85 bp, Mus musculus
tggttctctactttgttgtcactttcttaactggagtgaatagatgtatgttcacatctctgtaggaaatgccttagaggagcta

SEQ ID NO: 81196 - DNA, 119 bp, Mus musculus
actaagccttaattggcttctggtttaattcgaggtgtctgaaactgattctatttaataatttaggccccgttattttaggattgaattgaaatgacctttgtatattggggcggggt

SEQ ID NO: 81197 - DNA, 68 bp, Mus musculus
gtatatgtatatgtatatgtatatgtatatgtatatatacacacacacacatatatgtatatatatat

SEQ ID NO: 81198 - DNA, 118 bp, Mus musculus
tgtgggtgatctttctgcctttttctttttgattgtcttgagattttattgctgtgaagagacacaatgaccatggcagccttataaagaaaaaaaaattaattgggtctggtttaca

SEQ ID NO: 81199 - DNA, 102 bp, Mus musculus
ggaaggaaggaaggaaggaaggaagaagctaggactggagagatgactaactggttaagagctctgactgctcttccagaggtcctgagttcaaattccagc

SEQ ID NO: 81200 - DNA, 85 bp, Mus musculus; identical to SEQ ID NO: 57439

SEQ ID NO: 81201 - DNA, 66 bp, Mus musculus
gtgtgtttgtgtgtgcgtgtatgtgtatgaatgtgtatgtatgtatgcatgtatgtacgtatgtat

SEQ ID NO: 81202 - DNA, 99 bp, Mus musculus
tatcttattttagcaagcaaatgttagtatatattttctacttctgttgggtaaatagtatcatagtatgtgctttattttttactaagctgtggggta

SEQ ID NO: 81203 - DNA, 100 bp, Mus musculus
gagtttattcgtgggggctggagagatggctcagcaggtaagagcactgactgctcttccagaggtctaagttcaagtcccagcaactacatggtggctc

SEQ ID NO: 81204 - DNA, 100 bp, Mus musculus
cttagaattttgggaggaatgcattgaacaaaatgtctttgaaagaaaacctttttttttttaaagaggatggagtaatttattaaacaaaattattaag

SEQ ID NO: 81205 - DNA, 77 bp, Mus musculus
gtacatatgcatgtatgcgtatatgcatgtttgtatctatgtatgtatatgtgtatacatgcttgtatgtatgtatg

SEQ ID NO: 81206 - DNA, 85 bp, Mus musculus; identical to SEQ ID NO: 57439

SEQ ID NO: 81207 - DNA, 106 bp, Mus musculus
ctgtgaggggcaagcgcagaatcacaaagactccactcagtgcctgactgtctgttggtctagaaattcatgcagagtgaaggaaaggaggttgtcccttcatcag

SEQ ID NO: 81208 - DNA, 78 bp, Mus musculus
agggcaagtccacagtgaacagtgtgaggtgatacactgtgtcccttttagaaacacccacactctgcactctgcttt

SEQ ID NO: 81209 - DNA, 67 bp, Mus musculus
aggtagtacctgggcagcagaagagtagcgtgttccctctgcctcactctgtggcacagtactacct

SEQ ID NO: 81210 - DNA, 97 bp, Mus musculus
atgtgtatatgtgtatatgtatatgtatctatatttatatgtatgtgcatatgtgtatatgtgtttgtatatatgtgtgtgtgtgtgtgtgtgtgtg

SEQ ID NO: 81211 - DNA, 66 bp, Mus musculus
tcacagtgtcacagtcactgtcagcacatgctcttttatgtctggaaaacagtgctacactgtaga

SEQ ID NO: 81212 - DNA, 62 bp, Mus musculus
cttccttagggctctgtgggtgagaagtggatgcttgaacagaatagagactctacagggag

SEQ ID NO: 81213 - DNA, 85 bp, Mus musculus; identical to SEQ ID NO: 57439

SEQ ID NO: 81214 - DNA, 96 bp, Mus musculus
gtaggttgtatatgtatatatacatatgtatgtatatatgtatgcatgtatgtatgtctatatatatgtgtgtgtatttatgcaaatataacatac

SEQ ID NO: 81215 - DNA, 95 bp, Mus musculus
cagtggccctgaagttccaatgacctgagtcttctgtacttttgagtgacagcttttcagtgaggaagacttctcactttctctccacaccactg

SEQ ID NO: 81216 - DNA, 102 bp, Mus musculus
cttagtccatggtgatctgataggatgcatgggacaatttcaatatttttgtatctgttgaggcctgttttgtgaacaatcatatggtcaattttggagaag

SEQ ID NO: 81217 - DNA, 70 bp, Mus musculus
ctcaaaagagtcttgcttcatgtcggctggaagtctgcctttgacagaagacagagagcttgaggttgag

SEQ ID NO: 81218 - DNA, 132 bp, Mus musculus
tcagtggagtaacacatctggggctgctgattgagacagtgaagggtctgccccatgttctcagagtctctgagtgagaggacagtgaacagtcactatcagggtgactgaggcaggatctgctgggggact

SEQ ID NO: 81219 - DNA, 80 bp, Mus musculus
aggagctgatgcagaggtcatggaggggtgatgtttatgggcttgctattcatttctcagcctgcttccttacagaacct

SEQ ID NO: 81220 - DNA, 76 bp, Mus musculus
ctctcatggcctgtgggtacatgtatgtatgtatgtatgtatgtatgtatgtgacacagtactcactgccagagag

SEQ ID NO: 81221 - DNA, 75 bp, Mus musculus
tgggctgcagggaggtgtgctcagtcagcagtttgtagaaactgacatatgtcttcagagacattgatgtgccta

SEQ ID NO: 81222 - DNA, 105 bp, Mus musculus
actgtgggcggtgccattccctatgtgagtggagagagagaactgagcaccagtcattgttccctgcttcttgactgtggatgagatgtgagcatctcccagagt

SEQ ID NO: 81223 - DNA, 71 bp, Mus musculus
gtatatatatacatatatatacatatacatagcgtgtataatgtatatgtgtatatgtatatatgtatata

SEQ ID NO: 81224 - DNA, 109 bp, Mus musculus
tggatttattttactttgatggtggggaatggctactgacagtgacataatgaagacacaatctttattatttattgaatgcttaagctctatcagctaaaatcatcta

SEQ ID NO: 81225 - DNA, 80 bp, Mus musculus
gaatatgcttggcccagagagtggcactataaggaggtgaggccttatggaaggaagtgtgtcactgtgtgggtgtgttt

SEQ ID NO: 81226 - DNA, 88 bp, Mus musculus
tatttaagacgaacatgcaaaactcttatttttagttatattttattatttagcttagacatgagtgcttgtgtgtttgtatgtgatg

SEQ ID NO: 81227 - DNA, 79 bp, Mus musculus
acaagtgttcatgtatacttacataacacacatatgcctacacctatatgtgtgtatgtatgtatgtatgtatgtatgt

SEQ ID NO: 81228 - DNA, 110 bp, Mus musculus
ggactaggccagaactggtgattagaaagaaaatcagagaaatttgacaggaaaggcactgttgcagtaatccgatttccttctgtctttatctcaggctgaaggtttcc

SEQ ID NO: 81229 - DNA, 98 bp, Mus musculus
gggtgataaactgttcaaataagtcatccacaagaaatattctttaatgctataggaagttctgtatggaattgtacctgtattcagctttgtcattt

SEQ ID NO: 81230 - DNA, 79 bp, Mus musculus
gaagcagtcttcagggccggagagatagcttagcagttaagagctctgactgctcttccagaggtcctgagttcaattc

SEQ ID NO: 81231 - DNA, 68 bp, Mus musculus
tgtcttgggctggagagacggctcagcagttaatagcactgactgctcttccagaggtcctgagttca

SEQ ID NO: 81232 - DNA, 64 bp, Mus musculus
cccagctgagtaggtacagatggctttctgagcactcacacagcctcactgctacacagcaggg

SEQ ID NO: 81233 - DNA, 117 bp, Mus musculus
ctcttctctgtacagccttggacccattatgtagtctagctcaggctgaattcacagagctctgcctgtctctgcttctgtttgctacatgctaggtcctgctggcccagtgttaag

SEQ ID NO: 81234 - DNA, 56 bp, Mus musculus
ggggctgaagagagagctcagtggttaagggcactgactgctcttccagaggtcct

SEQ ID NO: 81235 - DNA, 69 bp, Mus musculus
gtgtctgtgtgcacatggaggtcagagcagcatgtaggttagtctctgaatcactgtctgtcacggcac

SEQ ID NO: 81236 - DNA, 75 bp, Mus musculus
ttctaaggtttctcttactgctggactttagctctctggccagaggagagagtacagagtgagaaaccctcagga

SEQ ID NO: 81237 - DNA, 75 bp, Mus musculus
gaggtcagaggacaattcaaggaattcaagggagctggggctcaattgcactctctgtctctgtctgtctgtctc

SEQ ID NO: 81238 - DNA, 76 bp, Mus musculus
gaaataacttgggttggagagacggctcagcggttaagaacactgactgctcttccagaggtcctgagttcaattc

SEQ ID NO: 81239 - DNA, 106 bp, Mus musculus
tttcatgctatattatagtttttcctccatgggttaaaaacctttggtcatttgttgagactagagagtgaggcagtgggaacctggaagaactctgttcatgaaa

SEQ ID NO: 81240 - DNA, 81 bp, Mus musculus
tactgagctacttactggctcaattttgtaattttatagtacaaaaactacaaagagggtacgcagacacatggctcagtg

SEQ ID NO: 81241 - DNA, 120 bp, Mus musculus
atgtgcaccaccactgcccagcctaaggtccacttcttgctgcttactctcacacagaaatgagtgatctcaaggcagagaccggagagagactcaggagttcagtgctttgcctaacat

SEQ ID NO: 81242 - DNA, 66 bp, Mus musculus
tcatgccattagactctgggactgtgtctcagggccgtaagcgagacaagtgttggtgtggcctga

SEQ ID NO: 81243 - DNA, 99 bp, Mus musculus
gttagagatgagagttggttctcgagggctggagagatggatcagcagttaaaagcactgactgctcttccagaggtcctgagttcaattctcagcaac

SEQ ID NO: 81244 - DNA, 107 bp, Mus musculus
ggacagattagcagggttagctttagtaaaggaaagcttcctgagtctctctggaagttctttattctttttcttgaaaagttgtaatgtctgctaatcttaggttt

SEQ ID NO: 81245 - DNA, 117 bp, Mus musculus
gctgagtgttatatatggagctgtgccttttggttttgtatacaatatatatttaagtatcttaatattatggtaacttaggacaaaatcaaatagctcagtactttagtgaaccac

SEQ ID NO: 81246 - DNA, 81 bp, Mus musculus
tatcattatgtgtgtagagtgtgtgtatatatgttcctatgtacatatatgcatacatatgtgcaggacatgtggtcgatg

SEQ ID NO: 81247 - DNA, 87 bp, Mus musculus
tgatgaccactcaaggccagcagagctttccatcatacacagctgctgcccatagctagctctgacaccctgagtggctcagatgca

SEQ ID NO: 81248 - DNA, 119 bp, Mus musculus
gcgtgaggttcacctgtgggtggagcctgtgcatctgtcttccgctgcggggttctgactctacagtgagagctcattggaccaggggcaaactcctgaccatggaggaaccaatccgc

SEQ ID NO: 81249 - DNA, 87 bp, Mus musculus
ttttcttatgaggtagacaattctggagctgtgactctgggtcactcagttaagtttgctccacaagacccattgcccatgagagaa

SEQ ID NO: 81250 - DNA, 71 bp, Mus musculus
ccacacgctgtcattctctctcccagtagacaggggatctctacagggcagggacagagtatggcgtttgg

SEQ ID NO: 81251 - DNA, 57 bp, Mus musculus
gtcatttggtcatcttcatcttgatgatgttactaaccaagatggaggtcagatggc

SEQ ID NO: 81252 - DNA, 70 bp, Mus musculus
ttgggtgtatatgtatgtgtgtgtatatatatatatatatatatatgtacatatatatataagaacccaa

SEQ ID NO: 81253 - DNA, 115 bp, Mus musculus
atatatatatgtatatatatatatatatgtaaatatgacaaataggctatcataaatttatagaaatatatttgtatatatatgtacatatatgtgtgtatgtgtatatatgtgt

SEQ ID NO: 81254 - DNA, 65 bp, Mus musculus
tctctgacactgacacactggttgctgtgacgtcagtgggagcagcagtgggttctgtaggaaga

SEQ ID NO: 81255 - DNA, 87 bp, Mus musculus
tgatggaagattttccttgtatctatttatgtatattccatgtttttatgtgcatatgcgtatgcaggtacatgtgtgtaactatca

SEQ ID NO: 81256 - DNA, 88 bp, Mus musculus
gtggggtcaggtctcccacactcacaccctgggggctggttcacccacacctccattactgctgcctgggtgaggctcagggccccac

SEQ ID NO: 81257 - DNA, 87 bp, Mus musculus
tgggctgtgcctctgggtctgtctgtgtggctctttctaagagaggtttaactgagggaagacccgctctgaatgtgggcaagccca

SEQ ID NO: 81258 - DNA, 105 bp, Mus musculus
gactcagtggcagggtagtcctattgattggaaagtgtatctctcacacacagatattcttagtgcacttcttcagtggtcatatatagctgtgtatactgtatc

SEQ ID NO: 81259 - DNA, 88 bp, Mus musculus
tgcatgcatgtatactatgtatatatgtatatgtatgtatgcatgcatgcatgtatatatgtacatgtgtatgtatgtatatgtgtat

SEQ ID NO: 81260 - DNA, 96 bp, Mus musculus
ggtctaagctcacagttagttttacagtccagtcttgactatttgttctgcactaagtctgtggaaatgaaagtaatttgactaatgtgttagacc

SEQ ID NO: 81261 - DNA, 71 bp, Mus musculus
ggatggcagtgggttcaccttctgacttctctttgtgtgtcagagtggagagagtgtacttactgaggtct

SEQ ID NO: 81262 - DNA, 109 bp, Mus musculus
catgagctaatgcagctggggctggttgtacacatttgtgtagctacaatggttgactgtgagcacactgagtacaacgggcatcagtggcagggtgagtggctccatg

SEQ ID NO: 81263 - DNA, 80 bp, Mus musculus
gtatatgtatgtgtgtctgtatgtctctctctgtgtatagatagatagatagatagatagatagatatagatacatacac

SEQ ID NO: 81264 - DNA, 82 bp, Mus musculus
tgtaatttgttgatacacacacacacacacatatatacatatatatatatgtatgtatgtatatgtatattaacaagttaca

SEQ ID NO: 81265 - DNA, 91 bp, Mus musculus
ggccttcctaggaaagaggtagacagatgttcagtgtctcatactctgacagagaggatgacagatgtttttacgatttattctagtggct

SEQ ID NO: 81266 - DNA, 66 bp, Mus musculus
ctctctgaccccttctactggatagttttgtgtgtcaacgtgacacaagtgagagtcatcagggag

SEQ ID NO: 81267 - DNA, 94 bp, Mus musculus
ctccagtcctcaaattgtgttaagattctagtctctctcctgaccatgagtgccggtcagtgcactaaatttctgcacaaaatgagagaaggag

SEQ ID NO: 81268 - DNA, 116 bp, Mus musculus
tgctcaaagaagaaacaaaaggagagaaatgagattttttggggggtgtctatctatctatctatctatctatctatccatccccctctatatcctacattttctactatctagta

SEQ ID NO: 81269 - DNA, 112 bp, Mus musculus
tgtgcaggtatatatacatatatatgtatgtgtatacacacgcacacacacacatatatgtgtgtgtgtgtttgtgcaggtatatatacatatatatgtatgtgtatacaca

SEQ ID NO: 81270 - DNA, 106 bp, Mus musculus
aaaactctgactgcctgtctagctttcatattgaccaatagcctgtttagagttctgagagacctcagtgagctcacaggctgtaagcacatgtatgcacagtttt

SEQ ID NO: 81271 - DNA, 117 bp, Mus musculus
gggcataggtgttgcaggatatttgatcacactgtgaaacttgagaatttgttatttactgaaaaaacttatatctagttttggtgtggcttagccttagcacacacctttaattcc

SEQ ID NO: 81272 - DNA, 102 bp, Mus musculus
gggagaatagttgctagtttccgtatcggtttagggttctgtgagacccactcactatgtacagcacctggcccagtgccttccacacagcaactatttcct

SEQ ID NO: 81273 - DNA, 101 bp, Mus musculus
gtgtgtgtgtgtgtgtgtttgaaagatttgtatgtatatatgtgtatatagctttgtgcatatttatacatatatgtatatatgcgtatacatacacatat

SEQ ID NO: 81274 - DNA, 93 bp, Mus musculus
tgcatgtgctagcacatttggagtttcaatttttttctttacagggtaaaaccatagaaagacctcaatattcctttgtgtttacatgttgca

SEQ ID NO: 81275 - DNA, 92 bp, Mus musculus
tatatatgtgtatgtgtatatatatgtatgtatacacatatatacatatacacacacacatatatatacatatatatatacacacatacaca

SEQ ID NO: 81276 - DNA, 93 bp, Mus musculus
aatcaagttttcagttctttctggttttaggatgtattctaccagagatcaaggtattttaagacatctgaaactgggcctgcctgggtggtt

SEQ ID NO: 81277 - DNA, 114 bp, Mus musculus
tgttaagcttctgagtcccacatttgggcaaagccctccatagccttgtctcagctttcattttgtaattctctttatcgaggggcccgacattgtgtaagtttctgaaaaaca

SEQ ID NO: 81278 - DNA, 107 bp, Mus musculus
gtgatccgttaagacctggaccactcaagagccatttgcatattgacactcactctcacagtcagcagaatggccctgcccagcctgtccagatcttgaagggctat

SEQ ID NO: 81279 - DNA, 109 bp, Mus musculus
tgtctgtgtgcgttggtgcacatttatgaaataaaatattgagttggagcttgcttatagtctcagtgtgtgagtccatcatggccagaatcatcccagcaggcaggca

SEQ ID NO: 81280 - DNA, 80 bp, Mus musculus
cagatgagatctggcagcctggaaaaatcagtgctggcttaatccccacaccagtgtctgtctgtctgtctgtctgtctg

SEQ ID NO: 81281 - DNA, 112 bp, Mus musculus
caaacatacttgactttattctctaccatatatatatatatatatatatatatatatatatatatatgatgtgtgtatgtctgtgtgtgtgtgtttcagcatcttgtcaagt

SEQ ID NO: 81282 - DNA, 67 bp, Mus musculus
ggcaagtgtcctctgggagaaaggttggaattttagccctccttactctctcagggactctcttgct

SEQ ID NO: 81283 - DNA, 88 bp, Mus musculus
tgcctcacttctgtctgtctgtgtgtctgctcgtgtcatttgtgaaggtgcacatgcgctatgccacacacatggaggtcagagagca

SEQ ID NO: 81284 - DNA, 119 bp, Mus musculus
tatatatgggagaggaagcatatatatgcatatttattcatatatacatatgtgtatatatacatatatatgtatatgtatgtgtgtatatgcatttatgttatatataattttaattc

SEQ ID NO: 81285 - DNA, 92 bp, Mus musculus
ggtggggctctaatgagaggatttttgtctgtctttctttagttgcagaaaaagaccctacaagtccattcttatagatgcttctcaccacc

SEQ ID NO: 81286 - DNA, 68 bp, Mus musculus
caggatcttctcccgaggacagactccctgtctttctgagtctgagtctgactcggtctctgtctctg

SEQ ID NO: 81287 - DNA, 117 bp, Mus musculus
tcagactgactggcttattgctgtgctctgggtattccagtcatggtggtctcacactagagagagagttcatcccatgagtctggtgtcttagcagcagtatcaacctgggactga

SEQ ID NO: 81288 - DNA, 134 bp, Mus musculus
gagagagagagagagagagagagagagagagagagagcatggtgctgagtatctatctgctgtcactcactggctggctccaggctgaagtcactcaggagacaggatggggagatgcaggtgagacctggacc

SEQ ID NO: 81289 - DNA, 95 bp, Mus musculus
tgcttcaggtcttaatatagctgtctcctgagaggctctgtcagagtctgacaaatacagaggcagatgcttacagccaaccattagactgagca

SEQ ID NO: 81290 - DNA, 57 bp, Mus musculus
gtgtctgtctgtctgtctctctgtgctgggcttagggtaggattaggtggaagatac

SEQ ID NO: 81291 - DNA, 95 bp, Mus musculus
ggaatggtcactgtttgttttttagtttatcttttgtggagcctcctggttttatgaaaataaaacattagactgaaagaccagaaggtctttcc

SEQ ID NO: 81292 - DNA, 92 bp, Mus musculus
tgtatatacatatatttcatgacacatgtatgtatgtgtgtgtctgtgcatgtatgtttatatatatatacacaaacacacgtatatgcatg

SEQ ID NO: 81293 - DNA, 104 bp, Mus musculus
ggtgtaaaaaaattattactggggctggaaagatggctcagcggttaagagcactgactgctcttccagaggtcctgagttcaattcccagcaaccacctggtg

SEQ ID NO: 81294 - DNA, 121 bp, Mus musculus
tccctgacgcgggtggttgattggctgctctgtgtaactgctgctcctgctccagggatctttcctgacttagtcaactctccttcacatggtcctgctagcaagggagttagttttaagt

SEQ ID NO: 81295 - DNA, 79 bp, Mus musculus
atatgcagaatatatagatgatacatgtgtgtgtgtttatatatacatatatgtcttatatgtttatatatatgcatat

SEQ ID NO: 81296 - DNA, 68 bp, Mus musculus
ctttcattttgaatatattttctagacgatatatatatcgtctagaaaacttgtacacaaatgcagag

SEQ ID NO: 81297 - DNA, 105 bp, Mus musculus
tgcacagcctggctctgccctggcctcactggaggcctgggctggggaaggggctcagtcactgcctctcagtgcctgctgggagcagagaattgctgggcacct

SEQ ID NO: 81298 - DNA, 117 bp, Mus musculus
ctctcctgggctggtgagatggctcagtggttaagagcactgactgctcttgcagaggtcctgagttcaaataccagaaaccgcatgagggcttacaaccatctgtaatgagatcag

SEQ ID NO: 81299 - DNA, 87 bp, Mus musculus
ccttcatgaatttgcatctttcttatatagtatgtatgtatgtatgtatgtatgtatgtatggggtctcgatgtgtctctctgatgg

SEQ ID NO: 81300 - DNA, 85 bp, Mus musculus
gactgacaggggctggagagatggctcagcaggttaagagccctgactgctcttccagagatcctgagttcaattcctagcaacc

SEQ ID NO: 81301 - DNA, 76 bp, Mus musculus
tatgtatacatgtatatatgtttgtgtgtatatatatatgtatatgtgtatatatatgtgcgtgcgtgtgtgcata

SEQ ID NO: 81302 - DNA, 71 bp, Mus musculus
agcaacacaccagtcctgggcagctgggtgaacggtgacagtaatggcttgaggaagatggatggattgct

SEQ ID NO: 81303 - DNA, 90 bp, Mus musculus
tctttctgaacagatagtaaaccaaagcatagaataattgttgttctgacacataaaattttatgtttatggtgtacatggtttaaaaga

SEQ ID NO: 81304 - DNA, 88 bp, Mus musculus
agaagcatcaaagtgttctgtcagctgtatccctagacctgggcgctcagctctcacaggctctgtgcgactgctgcgactttctcac

SEQ ID NO: 81305 - DNA, 109 bp, Mus musculus
aggaggctggagagatggctcagaggttaagagtgctggctgctcttccagaggtcctgagttcaattcccacaactatctataatgagatctgatgcccatttctggt

SEQ ID NO: 81306 - DNA, 100 bp, Mus musculus
ctcacagaagcctcgctgttctctgcctctttcagtctctctgcctacaatgatccctgagccttaggtgcaggagttgggttgtaaatatatctgtggg

SEQ ID NO: 81307 - DNA, 75 bp, Mus musculus
gcagatgtatagcttggtcttcatgtgggtcccttagaaattggaatggggactgtctctgactctgttgtctgc

SEQ ID NO: 81308 - DNA, 65 bp, Mus musculus
gagaaactaaaggagctggagagacggcttagcagtctgctcttccagaggtcctgagttcaatc

SEQ ID NO: 81309 - DNA, 116 bp, Mus musculus
atttgtgtgtgtgtgtgtatgtgtgtgtgcatgtgcgcatgtatgtataggtatgggtgtgtgtgcatttgcatgtgtgtgtgcatgtatatatattcatgtgtgtgtgtatgggt

SEQ ID NO: 81310 - DNA, 124 bp, Mus musculus
atgtatgtgtgtgtgtgcacatgtgtaggagcatgcacatgtaaatgtatgtgtgtgcatatgtatacatgtgtgtacatgtgcatgcgtgtgcatgtgcatgcacgtgttcatgtgtgtgtat

SEQ ID NO: 81311 - DNA, 83 bp, Mus musculus
gcctgcctgtctgtctgtctgtctgcctgcctgttgtctgtctgtcacaagtgaaggtacctgcagaggccagaaaagggtgc

SEQ ID NO: 81312 - DNA, 80 bp, Mus musculus
tatgtgtgtgtatatgtgtgtatgtgtgtgtacacatgtgtgtatgtgtgtgtatgtatgcatgtatgtatatatgtata

SEQ ID NO: 81313 - DNA, 117 bp, Mus musculus
ctcttcttgtacaattatttttgatgtgtaagcatgtatgcgagtgtgtgtgcatgtgcatgtgtgtatgtacacattaggtgtgcatgtatgcgagtaagtgtgtgtgctcatgag

SEQ ID NO: 81314 - DNA, 79 bp, Mus musculus
gatttcaagcattttaaaataatgtcctctctctgtgaatgacacaggatttattcattatagcaaaagaattgaaatc

SEQ ID NO: 81315 - DNA, 95 bp, Mus musculus
tagagggtgctttgaagctaagagagagtgaggctacacacaccacacacgtgtgtgagctctctgcctgctacctcaaagcatgagaccctgtg

SEQ ID NO: 81316 - DNA, 64 bp, Mus musculus
tttttaagtgtgtgagcatgtgcgcacatgtgtgtgtgtgtatgtgcatgtgcatgcccagaaa

SEQ ID NO: 81317 - DNA, 108 bp, Mus musculus
tcatggtggtcatgaactatacagacgatgcaggcctgtgtctgtcactgactacaatgatcagattttcctggttactgcttggatctatctggcatgtctccagtg

SEQ ID NO: 81318 - DNA, 81 bp, Mus musculus
gtatatatgtatgaatgtatgtatgtatgtatacgtggatagatatataaggtacttatacatatcatacataatagatat

SEQ ID NO: 81319 - DNA, 96 bp, Mus musculus
ttggtgagtccttcgtgtcccagtccctggagtcagctgagagtgatgatagtgtgccttctcagttaccacaagattggatcactcagtctccaa

SEQ ID NO: 81320 - DNA, 121 bp, Mus musculus
gagaaagttaggctcggggctgcggggggggggggtgctggagagatggctcaggggttaagagcactgactgctcttccgaaggtcctgaattcagatctcagtaaccacatggtggctc

SEQ ID NO: 81321 - DNA, 100 bp, Mus musculus
ctcaaatcaaattgcctccatatattttcatgtatcaatatatcaatattgatatcttatatcttatatgcaaataaaggactagaatttggtctgtgag

SEQ ID NO: 81322 - DNA, 83 bp, Mus musculus
ggatagaagatatagggggctggagagatggttcagaggttaagggcactgtctgctcttccagaggtcctgagttcaattcc

SEQ ID NO: 81323 - DNA, 99 bp, Mus musculus
catagcatttcttagtttcttagattaattgtgggttacttatgatagttctttatattttagtaaaactttaggttgtttgtgaaggtctatgctatg

SEQ ID NO: 81324 - DNA, 82 bp, Mus musculus
ggctgcacctctcttggcctctcttccctgtaagcacgcgctttctcgggatattcagacacaaaacagagagtgcacagcc

SEQ ID NO: 81325 - DNA, 123 bp, Mus musculus
cggttatcagagttcaggtccaggaataaatataggtggtgttctgagaagagagtgatgagaccactcatatacaaaagctcacatctcttatagggatattctctgtactatgctgggact

SEQ ID NO: 81326 - DNA, 59 bp, Mus musculus
atacatgtaggtttgtatgtatatctatataatacatatgcatatatacatgcatgtat

SEQ ID NO: 81327 - DNA, 78 bp, Mus musculus
tatatacgcacacacacatatcttggtatatatatgcatatcttgatatatatatatcttggtggtgatttgtatatg

SEQ ID NO: 81328 - DNA, 65 bp, Mus musculus
catgtacatacaaaaaatgcactccgttgattttattaaaatctttgcatagatgtatgtacatg

SEQ ID NO: 81329 - DNA, 109 bp, Mus musculus
gaaatattgatacctgatagggggtggaagtgaggaaagggaagggggaaacgagagtttctctgtgtctatctctctctcatctgtctgtatctatcatctatatgtc

SEQ ID NO: 81330 - DNA, 87 bp, Mus musculus
ggagcctgggtcatttatgtcttcattgctctctgaataccctagaagtgagtatgtcttgataggattgaagactgtaggttctca

SEQ ID NO: 81331 - DNA, 115 bp, Mus musculus
gcctccatgtctctcccctgtgctcggttcctgccttggtttccctcagtggataagtaatcaaactacactgtttcttccacaggcactcatcacagtagtgaatgactatggc

SEQ ID NO: 81332 - DNA, 117 bp, Mus musculus
cttattgtgtgaatgatgagagaattatttttagtttttgagagcattccttattttgtagtacaggttgacccagaatttactattgacttcttaagtgaaattcatactgctgag

SEQ ID NO: 81333 - DNA, 112 bp, Mus musculus
tatatatttacatatatgcatatatatatgtgtgtgtatttatttatcaatgtatatatgtatatatttatatgtatgcacatatatgtgtgtttctgtgtgtgaatatgtg

SEQ ID NO: 81334 - DNA, 76 bp, Mus musculus
gtgtgtgtgtgtgtgtgtgtgtgaatatgtgtgtgaatgtgtgtatgcatatttgcatgtatacatgtgtattcat

SEQ ID NO: 81335 - DNA, 85 bp, Mus musculus; identical to SEQ ID NO: 57439

SEQ ID NO: 81336 - DNA, 85 bp, Mus musculus
gaccatggtgatcagataggatgcatgggataatttcaatatttttgtatccgttgattcctgttttgtgatcaattatatggtc

SEQ ID NO: 81337 - DNA, 117 bp, Mus musculus
cccacacacctatggtaacttgaccttacgatgttttaattccttattttgataatatttaaactggctccaaaatgtagggtcagtttgaggaaggtgaggaatccttcttaatcg

SEQ ID NO: 81338 - DNA, 85 bp, Mus musculus; identical to SEQ ID NO: 57439

SEQ ID NO: 81339 - DNA, 79 bp, Mus musculus
ggacataaaattgatataacacacagaactatcctacttttgagtaggatagtaatgaaatgtaatgtatttgatgttc

SEQ ID NO: 81340 - DNA, 109 bp, Mus musculus
gaccaatgggtagctgtgagcatccacttctgtgtttgtcatgtacgattcttgtatctttattaataaacaaacttactctgtgggcttacagctacatctgcacgtc

SEQ ID NO: 81341 - DNA, 60 bp, Mus musculus
tctatctctatacatatatatgtatatgtacgtatatatatatatatatatagagagaga

SEQ ID NO: 81342 - DNA, 96 bp, Mus musculus
tcttgatcttttgttttgatttattttattttcatatgaaattgagaattgatctttctatttctgtgaggaattgaattggaattttgaccagga

SEQ ID NO: 81343 - DNA, 123 bp, Mus musculus
tatatatgtatatatatgactatgtgtatatatgtatatatatacatgaatatgtgtatatgtgtatatgaatatatatgaatacatctcacatatataccatatacacatataaatacatat

SEQ ID NO: 81344 - DNA, 99 bp, Mus musculus
tgtttgctgctgttactctcctgacagttttcttcattcataaagttcagttcacagtctggggaatgatgtgtgccacagtagagtgagtagtaatca

SEQ ID NO: 81345 - DNA, 96 bp, Mus musculus
gcttttcacagtgttgttaggatgtttatatgatcatagatttgaatatatcaatttatgtattgttgagagaaaatctaaagctgttaagaaagc

SEQ ID NO: 81346 - DNA, 87 bp, Mus musculus
tgtagatccagtttaaaggaaggatttggggagagggtgcttctgtagtcataaatttaacacttccagctttgaattgattttaca

SEQ ID NO: 81347 - DNA, 106 bp, Mus musculus; identical to SEQ ID NO: 63491

SEQ ID NO: 81348 - DNA, 85 bp, Mus musculus; identical to SEQ ID NO: 57439

SEQ ID NO: 81349 - DNA, 91 bp, Mus musculus
tatatgtgtgtgtatatgtatatgtatgtatctatatgtgcatatatataaagtcacacatataatacacacacacacacacacacacaca

SEQ ID NO: 81350 - DNA, 114 bp, Mus musculus
atatatatatatatatatatatatgtgtgtgtgtgtgtgtgtgtgtgtgtgtgtgtgtgtgtgtgtgtgtgtatgcatatatatgtttatatgtgtaaatatatagagtataca

SEQ ID NO: 81351 - DNA, 66 bp, Mus musculus
tatttatatggtgacactttcatgcacacataaatatgtgtgtatgtctgtgtgtgtgtgtgtata

SEQ ID NO: 81352 - DNA, 75 bp, Mus musculus
accgtttatataagtatgcatgcatgtatgcatgcatgtatgtatgcatgtatgtatttatgtgtgtacatgtgt

SEQ ID NO: 81353 - DNA, 116 bp, Mus musculus
aagattggttagtatttcttgacaaaacaaatgtgtagcaaataatatctaagaaagtttttgaacaggcctcacatatacttgttccaatttgttatagaagtttgcccaaactt

SEQ ID NO: 81354 - DNA, 73 bp, Mus musculus
tagaaggtcttttcattttgtagttctgtagatgaaaggcctttacagaaactggggagaatatgatcatcta

SEQ ID NO: 81355 - DNA, 104 bp, Mus musculus
attatgaatatatatatatatatatatatatatatatatacatacatatgtatatatatgtgtgtgtatatatatatacatatatgtatgtatatatgtgtgat

SEQ ID NO: 81356 - DNA, 56 bp, Mus musculus
gtatgtgtgtatatgtatgtgtgtatatatatacatatatacgtatacatatatat

SEQ ID NO: 81357 - DNA, 78 bp, Mus musculus
atggatatatatgtatatgtatatatgtatatatgtatatgtgtatatgtgcatatatgcatatatgtatatgtgtat

SEQ ID NO: 81358 - DNA, 104 bp, Mus musculus
tgtggcacattttgctgtactatgtagtgtttggctcttcagaaaaattatttatttatcttgggatgtatactaatcatgtgcaacatttacgtggtgcaaca

SEQ ID NO: 81359 - DNA, 113 bp, Mus musculus
ttgaaatgtatagaagaaaagacaggggatacttcaaaatattggagtagtaagcaactatttattattattactattatttgtttattcttctctcataacatgcattccaa

SEQ ID NO: 81360 - DNA, 159 bp, Mus musculus
ggaggtatgggagcagttcttgtggctagtggcattgatatcaaatcacatatttttaatatttattttattatttatgtgtacttggttgtgtgtgagcctctgtgactcactttctcgtgtgtgtatgtgtgtgtgtgtgtgtctgtgtgtgtgtga

SEQ ID NO: 81361 - DNA, 78 bp, Mus musculus
ttcttgtttcttctgtttctgtctctgtctcttgtggagaagaagaaaggggaaggagggagggagagggagggagag

SEQ ID NO: 81362 - DNA, 104 bp, Mus musculus
attgaggattctttcataaattcagcaattagagtaattgttttagtgtgactaggatctatagttactaagaatggagttgaggtgagttacaggagctcagt

SEQ ID NO: 81363 - DNA, 72 bp, Mus musculus
agagagagaggttaggtgagaaaggtctgtgagatccacaggagatatatgtctctctctctctctctctct

SEQ ID NO: 81364 - DNA, 85 bp, Mus musculus; identical to SEQ ID NO: 57439

SEQ ID NO: 81365 - DNA, 153 bp, Mus musculus
tgtatgtatgcatttgtatatgcatgcatgcatgcatgtacatgtgtatatgtatatgtgtgaatgaaagtgtgtatttatgtatgcatgtatgtatgtatgcatgcatggatatatgtatgtgtgtatatgtatatgtatatgtgtatgtgc

SEQ ID NO: 81366 - DNA, 89 bp, Mus musculus
gatctttgctttgctgagagtgggatattgaagtctcccactattattatgtgggctatgatgtgtgctttgagctttagtaaagtttc

SEQ ID NO: 81367 - DNA, 85 bp, Mus musculus; identical to SEQ ID NO: 57439

SEQ ID NO: 81368 - DNA, 116 bp, Mus musculus
gaatctagagcatctttgaaactacgatttgtaaagcaatagtgacacttcagaggtgactgaagagtttgtgcaaatgtagttctcaaaattttcgacagaatcttcatcacttc

SEQ ID NO: 81369 - DNA, 85 bp, Mus musculus; identical to SEQ ID NO: 57439

SEQ ID NO: 81370 - DNA, 85 bp, Mus musculus
gatataacatgaaatggaaactgagcctcatcatagagctgcaatcagtctctgtcttactcagggtttctattcatgcataatc

SEQ ID NO: 81371 - DNA, 85 bp, Mus musculus; identical to SEQ ID NO: 57439

SEQ ID NO: 81372 - DNA, 86 bp, Mus musculus
acattgtgcatacatataaatatataatgcatatatatctatacatacatataggtgcatatgtatatatgtgtgtacatatgtat

SEQ ID NO: 81373 - DNA, 105 bp, Mus musculus
tgcatctgtatatgtgtatgtgtgtatatgtagaataaataggtaatgtatgtatatatattacaaatgtatcttatatatacacattatatgtttatatttgta

SEQ ID NO: 81374 - DNA, 80 bp, Mus musculus
atatgtgtgtatgtatagatatatatgtgtacatatagatatacatgtatgtatatatatgtgtgtgtgtatgagtgtgt

SEQ ID NO: 81375 - DNA, 115 bp, Mus musculus
taggtacagagatatctatagatatagatagatatagaaatgtctaaatatatatttatagacagtagtatattgacctatcatctatctatctatctatctatctatctatcta

SEQ ID NO: 81376 - DNA, 112 bp, Mus musculus
ccttagtgttcagcttcttaggatctgtggagtataacaaggtaattgcattgtatagttaatatctacttatatatgcatgtccttttaggactgggtttcttcactcagg

SEQ ID NO: 81377 - DNA, 69 bp, Mus musculus
ggggatataaacatgacttttataaaacttgtcttgagtgagacaagtgagagaagattgtttttcctt

SEQ ID NO: 81378 - DNA, 100 bp, Mus musculus
tagtcctcagatggtcttatagttcatatacttacttgtatgtatattttatatccatgcttgtatgtgtgttagggtttgacactatttgaaatgatta

SEQ ID NO: 81379 - DNA, 84 bp, Mus musculus
ctggttttatgacctgtccattggtgagagtgggatgttgaaatttcccactattattgtttggttttcaaggtgtgatttgag

SEQ ID NO: 81380 - DNA, 125 bp, Mus musculus
atagtaatatatcctctgcctgttgaccaattgtaatgtatgtatgtatgtatgcatgtatgtatgtatgtttgcatgcatgcatacatgtattgcattcagcattatttattgtacaaagagta

SEQ ID NO: 81381 - DNA, 104 bp, Mus musculus
atataggtaggatatggaaagtgattatatgaatatctacacatatatgtttatatgtgtatagatatgcatataatcacccattatatttacatacattatat

SEQ ID NO: 81382 - DNA, 106 bp, Mus musculus
cttactgcttttaatattctgtctttatttagtgcatttgttgttctgattattatgtgtcaggaggaatttctcatctggtccagtctatttggagttctgtagg

SEQ ID NO: 81383 - DNA, 85 bp, Mus musculus; identical to SEQ ID NO: 57439

SEQ ID NO: 81384 - DNA, 107 bp, Mus musculus
atgtatatatatatatatacatgtttggtgtacgtacataaatatgtatgtcttatgcatatacatatatatatatatatatatatatatgcatatatatttgcata

SEQ ID NO: 81385 - DNA, 87 bp, Mus musculus
gatctacctatctgtctctgtctcagtaccatgcagtttttaatcacaattgctctgtggtacagcttgaggtcaggcatggtgatt

SEQ ID NO: 81386 - DNA, 109 bp, Mus musculus
gttacttatgccattcagctgtgctttaacaggggctgtactgatcctatgaatgtttattcataaatttatatccttgcctggaacgaaacagctgtcttaggataac

SEQ ID NO: 81387 - DNA, 76 bp, Mus musculus
gatctgataggatgcatgggacaatttcaatatttttgtatctgttgaggcctgttttgtgacctattatgtggtc

SEQ ID NO: 81388 - DNA, 58 bp, Mus musculus
gagagtggctgagaaaggcatagcaaaatgttgctaagaactttttttttctactttc

SEQ ID NO: 81389 - DNA, 70 bp, Mus musculus
tcccagtgtgtgtgtctctctccttcatgcttatatctgaagaaagaagcacacagctactgttccaggg

SEQ ID NO: 81390 - DNA, 115 bp, Mus musculus
tattatgtatagatatatgtatgtatatgtatatacaatgtatatatgtgtgtatttctcaaatatatatatatatacattcttttatacatattatatatcatgtcacatatta

SEQ ID NO: 81391 - DNA, 88 bp, Mus musculus
gaaaattaatctctcaggggctggagagatggcccagtggttaagagcactgactgctctttcagagatccttagttcaattttcagc

SEQ ID NO: 81392 - DNA, 56 bp, Mus musculus
tatgtgcatacatgtatatatgtatatacgtatatatgtatatatgtatacacgta

SEQ ID NO: 81393 - DNA, 98 bp, Mus musculus
tgtgttctctttcaaaatattcctgaggacagagtgagtacacatgtttggtgcaaattaattctgtaaagtccttggggttgacagttgaggatgca

SEQ ID NO: 81394 - DNA, 113 bp, Mus musculus
tgggaattctatttgtttgactctaggctagacctctgttaacaatatatatttaagaaacattgaatttggggtttttaatagcttactctggagatatgcaaatttgctta

SEQ ID NO: 81395 - DNA, 65 bp, Mus musculus
catacaccatgcacagtcacacagtctgtataatgttataatgtgtgtgtgtgtgtgtgtgtgtg

SEQ ID NO: 81396 - DNA, 118 bp, Mus musculus
gtgtcctggaggaaaagcaagggcgtttgcagttctttgtggatccagtttgtttcgcgcactctcacagactcacagaaccttccctgctcccaatctttgctggcctccagccctc

SEQ ID NO: 81397 - DNA, 127 bp, Mus musculus
tgaggcctgggatgtggctctgagtaaccagcctaccagttagatttgtggtagaatctcactctatctcacaggaaagtactggagcatctttctatacatcaagagctgctcatcaaactcaccc

SEQ ID NO: 81398 - DNA, 97 bp, Mus musculus
tataatatactgtaatatacatagcttatatatatgtatatatacacataaataatggtttaaatatacactatatgtatacatgcagtatattata

SEQ ID NO: 81399 - DNA, 70 bp, Mus musculus
ggtctcatctggaagcatctaggactttaaaagtttttatttgaagtcctaaaagcgtcaccatgtatcc

SEQ ID NO: 81400 - DNA, 70 bp, Mus musculus
agtatgtatatatgcgtgaacatatatggcatgcatatgtatatacatatatatttatgcagtatatact

SEQ ID NO: 81401 - DNA, 90 bp, Mus musculus
tccttcttcagttattttatgtgtgtacatgtatgtgtcaataggtccagatgtatatttgtgtgcatatgtttgtatatgaatgttgga

SEQ ID NO: 81402 - DNA, 102 bp, Mus musculus
tcagatgcacaaagggttttataaggcaatacatgtgattttgtatataaatacatatgcattatacacacatatgttatatgtatgtccatgcatttctga

SEQ ID NO: 81403 - DNA, 79 bp, Mus musculus
ctgtgactcctactctctgacttaaagctcaaccttgccatttgtagaaggcagagaagtactagagaaagagtcaaag

SEQ ID NO: 81404 - DNA, 64 bp, Mus musculus
gtgagcccatgtcagaggctacttgaccctgcctgtagggagagaccacttgtgacaggcttat

SEQ ID NO: 81405 - DNA, 85 bp, Mus musculus
tttgtacccatgaagtgcacccctctgtcagagctcccaaagctcaagacagaagagtgaaagctttaagatcttttgggtcaga

SEQ ID NO: 81406 - DNA, 63 bp, Mus musculus
cagctgtctcccagactcactgtccaaacaggtcagggtgagtgggagacctacagaaagctg

SEQ ID NO: 81407 - DNA, 107 bp, Mus musculus
tttcaataaaagcattttctgaatggacagttcatgagtagtgtggatattcagagatcatgttctacttataacatgtcacacaatgaaaatacttttagaagaga

SEQ ID NO: 81408 - DNA, 61 bp, Mus musculus
tgtatgacacatgagagtcactagacaactgcagtctggtggcctgtcaccacttcataca

SEQ ID NO: 81409 - DNA, 110 bp, Mus musculus
gttttgagactagtgtaggggttggagagatggctcagcagttaagagcactgactgctctttcagaggccctgagttcaattcccagcaaccacatggtggctcacaac

SEQ ID NO: 81410 - DNA, 85 bp, Mus musculus; identical to SEQ ID NO: 57470

SEQ ID NO: 81411 - DNA, 73 bp, Mus musculus
tagaagtagaagtatgtgacagaggctgttgtctccatcataacctgctcctgtcactgtgttctactcccta

SEQ ID NO: 81412 - DNA, 113 bp, Mus musculus
gtgatcctttaaatattcagttcaaaattttaattatgtgtatgtgcattgtgtctgagcatgtccatgtgtgtacaggtgcttttagagtctagaagaggataccaggatac

SEQ ID NO: 81413 - DNA, 85 bp, Mus musculus; identical to SEQ ID NO: 57470

SEQ ID NO: 81414 - DNA, 111 bp, Mus musculus
actagacactgtgacttctagatgactaattactatatatatatatatatatatatatatatatatatatatatatataaagctagtgtagagaaaaccttatttgtcagt

SEQ ID NO: 81415 - DNA, 85 bp, Mus musculus
tatgcatctatatatgtatgtatgaatgcatgtgtgtgtctccttacacttccagcccctctctccgtgtgtgtgtgtgtgtgtg

SEQ ID NO: 81416 - DNA, 98 bp, Mus musculus
cagctctgacctctaagttctatgtcaaacatgaaaattttgcctaccatcttctggaagtcagaagagtgtctggacattttgatggtccactgctg

SEQ ID NO: 81417 - DNA, 91 bp, Mus musculus
cacagtgtgtgtatattcatgtgtatatatatatatatatatatatatatatatatatatatatatatatgtgcatatcattgtgaagaca

SEQ ID NO: 81418 - DNA, 103 bp, Mus musculus
agtatcataaatcacatggtttactgtatgtatgtatgtatgtatgtatgtatgtatgtatatatgtatgtatgcatgcatctagaaactagaggaggatatt

SEQ ID NO: 81419 - DNA, 85 bp, Mus musculus; identical to SEQ ID NO: 57470

SEQ ID NO: 81420 - DNA, 85 bp, Mus musculus
gggataatgaaaaggcaaattacctcagcaaactgtgagctcactcgtctctcagtgatggtgtaatgtttgcaattttagttcc

SEQ ID NO: 81421 - DNA, 101 bp, Mus musculus
agaaaacataaataaacgtgtactagctggttaatggagtgaattcaagggaaaagttattttatttttctagaaagagtagcatgtttttttttttttct

SEQ ID NO: 81422 - DNA, 117 bp, Mus musculus
ctgataaatctctattaatgaaattgctgagcaaatgttgtgtaggcatgcatgtttctatgtatgtatgtatgtatgtatgtatgcatgtatgtatgtatgtttagaaagaggcag

SEQ ID NO: 81423 - DNA, 85 bp, Mus musculus; identical to SEQ ID NO: 57439

SEQ ID NO: 81424 - DNA, 114 bp, Mus musculus
tccttgaccaaggtatcattgagaagagtgttgttcagtttccacatgaatgttggctttctattatttattttttattgaagatcagccttagtccatggtgatctgatagga

SEQ ID NO: 81425 - DNA, 94 bp, Mus musculus
aggaggtgtcactgaacacaagcttccctgagtacacacagagcacagagacctctgaaagtggggaatggggagcacagtgagtgctcttcct

SEQ ID NO: 81426 - DNA, 101 bp, Mus musculus
gtgtgtgtgcatgcatgtatatatatgtgtgtatgtttatatattttttcgtgtatttggtgtctatatatatgtgtgtgtgtgtgtgtgtgtgtgtgtgt

SEQ ID NO: 81427 - DNA, 80 bp, Mus musculus
gcatattattatacatatatataatgtcatgtgtatatgtggtatatatgtgtgtgtatctgtgtgtgtctgtggtgtgc

SEQ ID NO: 81428 - DNA, 98 bp, Mus musculus
aataatgtgagatatttcttcaaaactcactttagtcacatatttgtttcaatttatatgtgttctggagtttttttctaaaatgattcactgttatt

SEQ ID NO: 81429 - DNA, 72 bp, Mus musculus
catacactcattggatgtatgtatgtatgtatgtatgtatgtatgtataatgtatgtataaatgaatgtatg

SEQ ID NO: 81430 - DNA, 63 bp, Mus musculus
gtgcatatgcacacacatgtgcatgcggtgtttgagtctgtctgtgtgtgtctgtgtgtgcac

SEQ ID NO: 81431 - DNA, 67 bp, Mus musculus
atctttctatgtatctatgtatgtatcaatgtatatattagatagatagatagatagatagatagat

SEQ ID NO: 81432 - DNA, 71 bp, Mus musculus
tatatatgtgtgtacatatatatgtatatatgtatattacatacacatatgtgtgtgtatacacatgtatg

SEQ ID NO: 81433 - DNA, 98 bp, Mus musculus
atatgtgtgtgtatatatatatatgcatatgtgtgtatatatatatatatatatatatatatatatatatatatatatgaatgatatatttgtaaaca

SEQ ID NO: 81434 - DNA, 85 bp, Mus musculus; identical to SEQ ID NO: 57439

SEQ ID NO: 81435 - DNA, 113 bp, Mus musculus
tatgtgtgtgtgtaggtatgtattgtgtgtatgtatacgtatgtatgcatgtgtgtgtgcatatgtgtgtaactctgtatgcatctgcatgtgtgtatatgtgtatgcatatg

SEQ ID NO: 81436 - DNA, 111 bp, Mus musculus
tgtgtgtgtgtgtgtgtatatatatgtatatatatctatatatatgtgtgtgtgtgtgtgtgtgtatacatatatatatatgtatatatatatgtgtgtgtatatatatat

SEQ ID NO: 81437 - DNA, 112 bp, Mus musculus
aagttgttctgaacttagtgtcatgaataaatttctgtacttttcatggattcattatatttatatatgagaagtcagtgtttgcaagctactctgagctcataatagtctt

SEQ ID NO: 81438 - DNA, 100 bp, Mus musculus
aagatgcaaattggggctggagagatggcttagtggttaagagcactgactgctcttccaaaggtactgagttcaaatcccagcaaccacatgatggctt

SEQ ID NO: 81439 - DNA, 110 bp, Mus musculus
ttactgttagaaatgtgatctcctgggggtggagagatgactcagtggttaagagcactgactgctcttcctgagttcctgagttcaattcccagcaaccacatggtgac

SEQ ID NO: 81440 - DNA, 106 bp, Mus musculus
ccttagagtctgaggggagttggctgacactgggtggctattgtgtgtactcagtctgcagacattcaaccatgccagaaagcttgcagttctttctaatctaggg

SEQ ID NO: 81441 - DNA, 75 bp, Mus musculus
taaatattcacacatgtgtgctcatgatcacagacacacacacactgactcagagtacatgtttgtatgtgtttg

SEQ ID NO: 81442 - DNA, 117 bp, Mus musculus
ttaaagtaggaaatcatttccacagagtaagggattccatgtattcatgtatatttattgttcatatggataaattctcttttcatgaaaaattggaagatatgtttcatagtttga

SEQ ID NO: 81443 - DNA, 115 bp, Mus musculus
gcctttctggaacagctctgatttataggaccataactgttgtggatagccctggggctaattatatttgatttaattcagttctcctgtaagtggcttcaaacaaagaatgagt

SEQ ID NO: 81444 - DNA, 85 bp, Mus musculus; identical to SEQ ID NO: 57439

SEQ ID NO: 81445 - DNA, 58 bp, Mus musculus
atacatgtatgtatatatgtatatagtctcatgtgtatgtgtatgtatatgcatgtgt

SEQ ID NO: 81446 - DNA, 94 bp, Mus musculus
atatgtgtgtatataggtgtgtaaacatgtatatatgtgtgcctctctatatacatatatatatgcatatatatgcctgtgtatacatctatat

SEQ ID NO: 81447 - DNA, 90 bp, Mus musculus
tctgagttcttttagttcttgtggtggcgagtgggtggaatgcatatgcaggttttttttttttcatatgaggaattctaagtacttaga

SEQ ID NO: 81448 - DNA, 108 bp, Mus musculus
gtctctatttctgcctgtctgtgtgtctatctgccgatctgactctctctgtctctctgtatgtgggtgttggtgtgggtgtatgttttgggatcgcagagttggcag

SEQ ID NO: 81449 - DNA, 86 bp, Mus musculus
tagggtctgcatgtgtgtgcacatgtgtgtgtatgtatgtatatatgtatgtgcatgcatacatgtgtgtgcatatgtatatcctg

SEQ ID NO: 81450 - DNA, 106 bp, Mus musculus
gccttagtgcatggtgatctgataggatgcatgggacaattttaatatttttgaatctgttgaggcctgttttatgacctattatatggtcaattttggagaaggt

SEQ ID NO: 81451 - DNA, 67 bp, Mus musculus
tggtttttgagacaaggtttcggtgtagctctggctctactggaactcactctcactctgtagacca

SEQ ID NO: 81452 - DNA, 62 bp, Mus musculus
tatatgtatgtatgtatgtatatatgtacatatgtacatatacatgtatatacatatattta

SEQ ID NO: 81453 - DNA, 76 bp, Mus musculus
atatatgtatatacatgtatatgtacatatgtacatatatacatacatacatacatatatatgtgtatatatatat

SEQ ID NO: 81454 - DNA, 115 bp, Mus musculus
gaatggtaatcaaatttccaggtttcttctctctcttctctctttttttatttcaaatgtaaaaatatgaaggttaaggggaattgaagacacagctttgggaaggctgcattcc

SEQ ID NO: 81455 - DNA, 87 bp, Mus musculus
ggggggggggggggcggagcgcgcgtgcgcacacatgaacgcaggcatgtatgcctgcctgcctgcctgcctgtgtgtcctgtgcgt

SEQ ID NO: 81456 - DNA, 92 bp, Mus musculus
tgtagagaggggaataggggctggagagatggctcagtggttaagagtgctgactgctcttccagaggtcctgggttcaattctcagcaacc

SEQ ID NO: 81457 - DNA, 111 bp, Mus musculus
gtctctgtctgcctctcacactcactcttgctctctgcctttctctcaaacacacacagagacacacagacacacacacacccgagagccccagtgtgagcaatcactggc

SEQ ID NO: 81458 - DNA, 77 bp, Mus musculus
gggtttctctgtggctctctcgtgtctggcactctctctgtgcctcaccctagacttgaactcacagagatctgcct

SEQ ID NO: 81459 - DNA, 120 bp, Mus musculus
cattattgagattgctatagactatggggactttggaagctggactaaatgtattttttattatactgtggttaggtatggctcccatgtgctcaagtctatgtatgtggtggtttgaat

SEQ ID NO: 81460 - DNA, 101 bp, Mus musculus
tacaggtacctaggattagtgacattgactcattttgtatatttatttgcctgagtgtaggtgcatgcatagtacaatttgagatcctgtaagtacctgtg

SEQ ID NO: 81461 - DNA, 100 bp, Mus musculus
cttgcattacatggtaaaacacataatctataggtacttatatatagtatattcatatatatgcatttagatgtaggttatatgtgtatgtagttctaag

SEQ ID NO: 81462 - DNA, 86 bp, Mus musculus
ttcactggcccattgggcagtagtttgtcagaggttatattaacatgctgactgaagaatctgagcccactgaagctttccatgaa

SEQ ID NO: 81463 - DNA, 92 bp, Mus musculus
ccagcacagacgctcaagaaatttattaaattttcaagggggctctccgtctaggtctgcttgactattaggaatactcagcgtctgggtgg

SEQ ID NO: 81464 - DNA, 100 bp, Mus musculus
gctttttatattctatctttatttagtgcatttgttgttctgattattatgtgtcggaggaatttctttgctggtctagtctatttggagttctgtaggc

SEQ ID NO: 81465 - DNA, 79 bp, Mus musculus
ggaggctgaaggaaggcagaatgataagccctgggatggccatcctctcatgctctgtctcactgtggacttcacttcc

SEQ ID NO: 81466 - DNA, 83 bp, Mus musculus
gatgacagcgaatagtgaagtttatcatggtagtaacaagcgctacacagaaatgattttctttatttggattgcatgtggtc

SEQ ID NO: 81467 - DNA, 114 bp, Mus musculus
tgtgtgtatatatttacatatgtgtgtgtattttacgtgtatatatgcatatatgtttataagtatacatatattttcacatgaatatatttacatgtatgtatattatatgca

SEQ ID NO: 81468 - DNA, 90 bp, Mus musculus
cacacacacacacacacacacacacacacacagatatatatatatctgtatatatatgcagtgtatgtttatgtggggttaaggggtgtg

SEQ ID NO: 81469 - DNA, 84 bp, Mus musculus
tctacatattccagctctctgccaaagacttcccttaggctgctagctgagcagtgagtcagcagacagaagcagaatggtgga

SEQ ID NO: 81470 - DNA, 64 bp, Mus musculus
tgctattctctccctgcctctgtgcgtcttaccttagacagcacaaaggccaggacaagaagca

SEQ ID NO: 81471 - DNA, 116 bp, Mus musculus
tagatattgatagagatatgtttgtatatgtctatgtatgtgatgtctatgtatatgtttgtatatgcatatgatgtatgtgatgtgtatgacgtatgtgatgtttatgatatgta

SEQ ID NO: 81472 - DNA, 74 bp, Mus musculus
atatatatatgtgtgtgtgtgtacatacatatacatatgtacatatatatgtatatatgcacatatatgtatat

SEQ ID NO: 81473 - DNA, 101 bp, Mus musculus
catatgtgtgtgtatatacatatatatgtatatatatacatatatatgtgtgtatgtatgtatgtatgtatatatatatatatatatatatatatatatgc

SEQ ID NO: 81474 - DNA, 66 bp, Mus musculus
aaatatatatatatgtatatacgtatgtatgtatatacatatatatccatgcatgtatgtgagttt

SEQ ID NO: 81475 - DNA, 85 bp, Mus musculus; identical to SEQ ID NO: 57439

SEQ ID NO: 81476 - DNA, 102 bp, Mus musculus
atacaactgcaggaattatctgcagctggcaaaattgtaccctccacctgagcactggtcaaatcacagtcagcttttgtggataatctgaagcagtcctat

SEQ ID NO: 81477 - DNA, 110 bp, Mus musculus
gtgtccgtgtgtatacatgtatatgtatatgtgtatatatatatacacacatatatgtatatatatacatacacacatatatatgtatatatatgtatacacacacacac

SEQ ID NO: 81478 - DNA, 148 bp, Mus musculus
tgcatatatatatatatatatatatatatgtgtgtgtgtgtgtgtgtgtgtgtgtgtgtgtatacatatatatacatatatatgtgtgtatgtatatatatacatatatgtgtgtatatatatatacacatatacatatacatgtata

SEQ ID NO: 81479 - DNA, 68 bp, Mus musculus
tgtgtgtgtatatatgtgtatgtatatgtatgtatacatacatgtatatatatgtatgtatgtacaca

SEQ ID NO: 81480 - DNA, 106 bp, Mus musculus
agttttactttaaattatttatgtgtctctgtgtgtctgtgtgggtatgttcacctgagtataggtgttggcagagcttacagatgagaatggatcctgtggagct

SEQ ID NO: 81481 - DNA, 98 bp, Mus musculus
taggcatgatctatgagggaatgggtgttatagaggtcagggttgaaccttccaaagtctctcactcactgcacgttgtctagttatgggtctctctg

SEQ ID NO: 81482 - DNA, 150 bp, Mus musculus
cacgcaactattatatatgtatacacacacacacacacacaccaatatatatatatatatatattgtgtgtgtgcatatatatgtgtgtgtgtgtttctattatgtatatcacacacacacacacattcctaatagtcttgagcatatat

SEQ ID NO: 81483 - DNA, 105 bp, Mus musculus
agctccaagtggataagtgttgtaaacaaatcccagaaagcataactagaaggaactagatagagtgctctctgactgtggactttgcattttctacatatcgct

SEQ ID NO: 81484 - DNA, 94 bp, Mus musculus
ccatgtgtagcagatgtgcagtttggtctctattcatttcccaacaattgtaacaagggctgtctctgactcagactctgtttcctgcctttgg

SEQ ID NO: 81485 - DNA, 85 bp, Mus musculus; identical to SEQ ID NO: 57439

SEQ ID NO: 81486 - DNA, 100 bp, Mus musculus
cttttttaattaattgcaagaaaatatatgtatattacataatgtaatatacatgtatatatgtatatataattgtgagaatatatatgtattatatgta

SEQ ID NO: 81487 - DNA, 76 bp, Mus musculus
gttccttcataaaagaagacacatttttttttttttgtatcatgagaaaatgtgactatttttatatctgaggagc

SEQ ID NO: 81488 - DNA, 63 bp, Mus musculus
catggtatgacacagcaaaggagaatgcagggacacctgcctctctgagtgactgtaatcatg

SEQ ID NO: 81489 - DNA, 81 bp, Mus musculus
tgacggtctgataggatgcatgggacaatttcaatatttttgtatctgttgaggcctgttttgtgaccaattatatggtca

SEQ ID NO: 81490 - DNA, 76 bp, Mus musculus
ggggctggagagatgactcagtggttgggaggactgactgctcttccagaggtcctgagttcaattcccagcaacc

SEQ ID NO: 81491 - DNA, 94 bp, Mus musculus
ggctgatgtgtatcgtttggagaagggttgaggatgtatactatagaaaaatttcatgccattcatcctcattttcttgaaaaaaaaaacagtc

SEQ ID NO: 81492 - DNA, 105 bp, Mus musculus
ttcctggtctgataataggtaggtggggtccagtctgcttcttagagcttccttgagaggaaactgagaacagagtgtgtccagtggctacctggggccggagga

SEQ ID NO: 81493 - DNA, 119 bp, Mus musculus
cagagccctttgtacctttgtctccccatttttattcacagggaggagctgagtgtagaaagacacgtgttggctgtgtccctgtttggaggtgggggaggccgggtggggaatgaagg

SEQ ID NO: 81494 - DNA, 97 bp, Mus musculus
gtatgcatgcatgtatgtatgcatgtatgtattatgcatgtatgtatgtatgtatgtatgcatgcatgcatgtatgtatgtgtgcatgcatgcatgc

SEQ ID NO: 81495 - DNA, 69 bp, Mus musculus
tgggactcagcatctgcagagatgtgtctctcatcctgactcacatttttctagttttgcttggcctca

SEQ ID NO: 81496 - DNA, 95 bp, Mus musculus
cacttttgtgtatgtatgtatgtatgtatgtatatgtgtgtatgtatatatacatatatatatatatatatatatatatatatatatatatggtg

SEQ ID NO: 81497 - DNA, 78 bp, Mus musculus
gaacaactgtatcaatggggcaggggagatggctctggggttaagagcactgactgctcctccagcggtcctgagttc

SEQ ID NO: 81498 - DNA, 80 bp, Mus musculus
tatatgtgtgtgtgtgtactatatgtgtacatatgcgtatgcatgtattcacttatatgtatatatacatatatatggca

SEQ ID NO: 81499 - DNA, 109 bp, Mus musculus
tggtttttgttttgttttgttttgtttgactgtctggcatgcaaagattactgttattcatgtttacaactttggatataagaatatcaaaacatgacacttattgcca

SEQ ID NO: 81500 - DNA, 57 bp, Mus musculus
ctgctctggatgactgtgattaggtacagactctgtggctcacacagatcatagcag

SEQ ID NO: 81501 - DNA, 85 bp, Mus musculus
ggcccagagagatggttcagtggttaagagcactgagtgctccttcagagaacacaggttccataaccagtaccacatggtggct

SEQ ID NO: 81502 - DNA, 58 bp, Mus musculus
caggattggagagatggctcagcagttaagagtgctgactgctcttccagaggtcctg

SEQ ID NO: 81503 - DNA, 109 bp, Mus musculus
ggggtgcatggtacaaaattcacgggctggagagatggctcagcggttaagagcactggctgctcttccagaggtcctgagttcaattccagctaccacatggcagctc

SEQ ID NO: 81504 - DNA, 88 bp, Mus musculus
agggaagatgggtgccaggcagcttagcagctctgtcacagtcagtgtcttggcaagattcctttgttgaaggtcactttccttccct

SEQ ID NO: 81505 - DNA, 71 bp, Mus musculus
gggctcttggatgaaaagtatttttatatacttaatgaataattcatgagtgagaaagctttgccaggccc

SEQ ID NO: 81506 - DNA, 105 bp, Mus musculus
atgtatatatatatgtgtgtgtgtgtgcatgcatttatatgtgtatgtatgtgtgtatatatgtatatgtatgtatgtgtgtgtatattgtgtgaatgtatgtac

SEQ ID NO: 81507 - DNA, 62 bp, Mus musculus
gtgactaagagtgtttgctgctcgtgtagttcccagcaccacagtgggtcactcactgtcac

SEQ ID NO: 81508 - DNA, 56 bp, Mus musculus
gtctctctctctctcttgcctggcaaatgaactaatagcttaggagggggagtggc

SEQ ID NO: 81509 - DNA, 123 bp, Mus musculus
tatgtatatatgtatgtgtgcatgtatgtgtgtatatgtgtatatatgtatatgtgtgtatgtatgtgtgtatatatgtatgtatatgtgtgtttatattacatatatatgtaattttcacat

SEQ ID NO: 81510 - DNA, 87 bp, Mus musculus
gtgtgtgtgtgtatcatgtgtatatgatacatgtgtacacatatatgtgtatatgtgtatatatacatgtatattatatacacacac

SEQ ID NO: 81511 - DNA, 76 bp, Mus musculus
agacatttacccacagcgagactcagtgttcaccacacagtgaggacactgcgagtctggataggctgaaaggtct

SEQ ID NO: 81512 - DNA, 58 bp, Mus musculus
tatgtatatgtgattatttacatatgtatgtatatgtgtgaatgaatatatgtgtgtg

SEQ ID NO: 81513 - DNA, 80 bp, Mus musculus
tatgtatacatgtgtatgtatatgtgattatttacatatgtatatgtgtgaatgaatatatgtgtgtgagtgtgtatata

SEQ ID NO: 81514 - DNA, 127 bp, Mus musculus
catataaatatacacacatgtgtatgtatatgtgtatgtgcatatgcatgtgtatatatgtatatacatgtatgtatatgatgtatatgatatatatgtatttgtgtatgtacatatatacacatgt

SEQ ID NO: 81515 - DNA, 107 bp, Mus musculus
tacatacatgtatatacatatatacacatgcatatgcacatacacatatacatacacatgtgtgtatatttatatgtgtgtgcttatatatatatgatatggatgta

SEQ ID NO: 81516 - DNA, 95 bp, Mus musculus
gcctacttaccggcctctggtgccgtgctgactgaaaacagtcagttcttgaaagtttaaaagttcagcactgaagccattcggtggtcctgggc

SEQ ID NO: 81517 - DNA, 68 bp, Mus musculus
ggtctgtgttgtaggtacatcaggtgaagctgggcaccccacagtcagtgagtctctgcactttgacc

SEQ ID NO: 81518 - DNA, 107 bp, Mus musculus
aaagttagaataagagtcctgagactggagagagaggtcactggataaagagtttctgtttctttttctttttctttttctttttctttttctttttctttttcttt

SEQ ID NO: 81519 - DNA, 79 bp, Mus musculus
cagtaggtatatgggagatatatatacacatacacacattcttattatatatgtatatatctcccaaatacataactgc

SEQ ID NO: 81520 - DNA, 85 bp, Mus musculus
gaccatggtggtctgataggatacatgggagaatttcaatatttttgtatctgttgaggcctgttttgttaccaattatatggtc

SEQ ID NO: 81521 - DNA, 108 bp, Mus musculus
tacctatcctatacctataccgatatctatgtctctctatgtctctctatataaaaccaagttaccaaagaggctagttatagactaatgcgtatctgtgggcaggta

SEQ ID NO: 81522 - DNA, 85 bp, Mus musculus; identical to SEQ ID NO: 57439

SEQ ID NO: 81523 - DNA, 85 bp, Mus musculus; identical to SEQ ID NO: 58584

SEQ ID NO: 81524 - DNA, 139 bp, Mus musculus
cacaaagaacacacacacatatatgtgtgtatgtgtgatatatatatatatatatatatatatatatatatatgtgtgtgtgtgtgtgtgtgcatatatatgtatatatgtatgtgtatatatgtgtgtatgtatatat

SEQ ID NO: 81525 - DNA, 85 bp, Mus musculus; identical to SEQ ID NO: 57470

SEQ ID NO: 81526 - DNA, 161 bp, Mus musculus
tatatatacatatacatatacatatacatatacatatacatatacatatacatatatatatatatatatatcatgttatatatatatgttatatatgtgtgtagtatagttcatatatatgtatatatatggtatatgtttctatatgagctacagtatac

SEQ ID NO: 81527 - DNA, 109 bp, Mus musculus
gatagatagatagatagatagatagatagatgagagatgatagtgagtacatatatgtaattgcatgtgcataatgggatatttattactgtgtctggcattattcatc

SEQ ID NO: 81528 - DNA, 81 bp, Mus musculus
tctcacaagacccagatggactctcagggcaattgcaagactagtgttttaatgccctgcctactgtgtctgctgatgaga

SEQ ID NO: 81529 - DNA, 95 bp, Mus musculus
caatgctcagaataaatttagaaattcatgtttaattcttcttgtgaccatgtcacatagagcagaataagccatctgcatttactgaagcaagg

SEQ ID NO: 81530 - DNA, 68 bp, Mus musculus
agtactgaaccaatttacagaagtagcctttgtatgactttcaagctggttctgaattggattggtct

SEQ ID NO: 81531 - DNA, 82 bp, Mus musculus
gtgaggatcatggctggttgtggttcatggttggttgcccaccctccattgaagactacagatccaaattcttcatgactcc

SEQ ID NO: 81532 - DNA, 85 bp, Mus musculus; identical to SEQ ID NO: 60314

SEQ ID NO: 81533 - DNA, 76 bp, Mus musculus
tgaacccacaatcacagaggacccggtggaaactcctgcaggtcgggtgcaggctgcctcagtctctgtgagttca

SEQ ID NO: 81534 - DNA, 73 bp, Mus musculus
ctgtctgtgtgtctctgtgtatgtgcacatgtgtctattatattggcacatattttgtgacattttaatagat

SEQ ID NO: 81535 - DNA, 97 bp, Mus musculus
gaatacacacatgtacacacacattatgtatatgtatatgtatatatacatacatgtatatgtgtatatatatgtgtgtgtgtgtgtgtgtgtgttt

SEQ ID NO: 81536 - DNA, 107 bp, Mus musculus
tgtatatatatatatatatataatatgtatatatatacacacatatatatgtatgtatatatatgcatgtatatatatgtatgtatatgtatatatatcttaatgtg

SEQ ID NO: 81537 - DNA, 83 bp, Mus musculus
ttgtagatgccaacaattgcttgctgacaggagcctgatatagctgtctcctgagaggctctgtcagtgcctgacaaatacag

SEQ ID NO: 81538 - DNA, 119 bp, Mus musculus
tcctcctgtttgcatacattttcttattaatatttgtttattttcttatgtataattttattatttattattatatctttgaaggttgtttgcttttctgagaagagacagaaagagga

SEQ ID NO: 81539 - DNA, 114 bp, Mus musculus
tcctactgggttgcctcatcaaggcttaatataaagggaggtgtctagacttacagcaacttgatatgtcccatttgattgatatccctgggaggcctgcctttttctgaagga

SEQ ID NO: 81540 - DNA, 127 bp, Mus musculus
acatacactgctttggatatatatatatatgtatatatatatatataccattatatatgtgtatatatattccataatgtatatgtgtatatattttcccatatatatatgtatgtatgtatatgta

SEQ ID NO: 81541 - DNA, 85 bp, Mus musculus; identical to SEQ ID NO: 60314

SEQ ID NO: 81542 - DNA, 65 bp, Mus musculus
cacacacacacacacatatatatatatatatatatatatatatatatatatggtgggtggggctg

SEQ ID NO: 81543 - DNA, 111 bp, Mus musculus
ttcaaaagaaacgatgatactgaatctgttcttcatttacactaactgcatctcgaatggatagttttagtgaaacatattggaagcacagagggtgacattcttttagag

SEQ ID NO: 81544 - DNA, 112 bp, Mus musculus
aaccacatgcagaggacctagttcagacctgttcaggctccctgattgtcagttcagtttctgtcagtccctatgagcccatttagttgactctgtggatttttttgtggtt

SEQ ID NO: 81545 - DNA, 68 bp, Mus musculus
gacagacagacagacagacaggcaggcagggagggattccactttacctctgatgtatggtgtctgtc

SEQ ID NO: 81546 - DNA, 68 bp, Mus musculus
gacagacaccatacatcagaggtaaagtggaatccctccctgcctgcctgtctgtctgtctgtctgtc

SEQ ID NO: 81547 - DNA, 116 bp, Mus musculus
tttcctgaagagcatcatccaacacatctgacaattcaaggcgttggtcacacaagatagtctggtgatgagtagacatgaagagtatgaggtgaagttgctggcaagaaaggaag

SEQ ID NO: 81548 - DNA, 107 bp, Mus musculus
ttataagtaggatcatatcatatcatatcataattatttattttaatgtaatatgatacgatatgatatgatatgatatgatatgatatgatataaccttacttata

SEQ ID NO: 81549 - DNA, 105 bp, Mus musculus
agaggagaaaacagtagaggaaaatctaaatatataaatatatatatatatgtatatatatatatatatatcaatatttatctatctctatctatctatctatct

SEQ ID NO: 81550 - DNA, 101 bp, Mus musculus
gatccatccactgtttggctgtgagtgtctgtatctgtgtgagtcagttgataggccgagcctctcagaggacagtcattatagactcctgtcaacaagca

SEQ ID NO: 81551 - DNA, 172 bp, Mus musculus
tatgcatgtgcgttcacatgtgcatgtgtatgcatataagagtgtatatgtgtgtacatgtatttgtgcatgtgcatgtatatatgagagtgtacatatttgtgtatatgtatttatgcatgtgtatgggtatgtgtgtgtgtttgtttgcgtgtgtgtgatcggtcttgac

SEQ ID NO: 81552 - DNA, 87 bp, Mus musculus
cctgggatccatgggtggctgtctgtttgcctgtgatagtaattataggctattacctgtatgtttgaacctgtggatgaacccagg

SEQ ID NO: 81553 - DNA, 115 bp, Mus musculus
tccttgaccaaggtatcattgagaagagtgttgttcagtttccacgtgaatattggctttctattatttattttgttattgaagatcagctttagtccatggtgatctgatagga

SEQ ID NO: 81554 - DNA, 107 bp, Mus musculus
agactttgaacttgggcactgcttgctttaggtggggcactgagggtcatcctctattgagaccaacagcatctgcatctgatcacagcctgccctctgaccagttt

SEQ ID NO: 81555 - DNA, 58 bp, Mus musculus
tatgtgtatgtatgtatgaatgtatgaatgtacgtacatatgtatgtgcatacatatg

SEQ ID NO: 81556 - DNA, 85 bp, Mus musculus; identical to SEQ ID NO: 57470

SEQ ID NO: 81557 - DNA, 75 bp, Mus musculus
tgtgtgtgtgtgtgtgtgtgtgtgtgtgtgtgtgcctacaggtatgtgtatgtttatatatgtgtgttaaccata

SEQ ID NO: 81558 - DNA, 116 bp, Mus musculus
aagtttcagatatgtgtgatgaatataatttaagatcagtggaagtatttatgtctatataaatatactctgaaaaaatatattttgtcatttatatttctaaaatcctgacactt

SEQ ID NO: 81559 - DNA, 81 bp, Mus musculus
catggggtgttataagggtagtgcagaattagagtaagcctctatctgtgtctctgtcttcctagtttttacacttccatg

SEQ ID NO: 81560 - DNA, 85 bp, Mus musculus; identical to SEQ ID NO: 57470

SEQ ID NO: 81561 - DNA, 84 bp, Mus musculus
gctcaacaagacatgtggcagatcacagtgtgcttacatcagggagtctaccagtaggaaagtgaagatgctcctcttgtgtgc

SEQ ID NO: 81562 - DNA, 68 bp, Mus musculus
atgtatgtatgtatgtgtgtgtgtatgcatgtatgtatgtatgtatgcatgcatgcatgaatgtatat

SEQ ID NO: 81563 - DNA, 60 bp, Mus musculus
tatgtacatgtacatagtttaaatatacatatatgtatatatatgatgtatatgtatatg

SEQ ID NO: 81564 - DNA, 188 bp, Mus musculus
atatacatatacatcatatatatacatatatgtatatttaaactatgtacatgtacatatatacacaaatatgtgcatgtatatgtatatgtatatatatatatacatatatatatatatatatatatatatatatatatatacacacacacacacacagatgtgtgtgtgtgtgtgtgtgtgtgtat

SEQ ID NO: 81565 - DNA, 108 bp, Mus musculus
ccttttcccactctgactcactcaatggagactacttttaagtaattatcttggtttaatttttattaatcttttggcaccaagtgagacggggtactttagtgaagg

SEQ ID NO: 81566 - DNA, 64 bp, Mus musculus
atacgttttggggagtatagagaaagttacagacctctctgtgtctctgtccctctgtctgtgt

SEQ ID NO: 81567 - DNA, 82 bp, Mus musculus
gcctaaagggttggggcctcatggccgtctatccatgctggaatgttgactggcttgacctggttgtaagtcttgttcaggt

SEQ ID NO: 81568 - DNA, 69 bp, Mus musculus
gaaaatgggggctagagagatggtttagtggttaagagcactgactgctctttcagaggtcctgagttc

SEQ ID NO: 81569 - DNA, 103 bp, Mus musculus
tctgtaagaccaggctagcctgtaacccacagctccatctggctctatctctgtctctgccttctaaatgctgaggttaaaggtgtgtgccaccactgccagg

SEQ ID NO: 81570 - DNA, 114 bp, Mus musculus
tgaaaaatctatttgggggagctggagagatgattcagcggttaagagcactgactgctcttccggaggtcctgagttcaattcccagcaattcaattcccacatggtggctca

SEQ ID NO: 81571 - DNA, 95 bp, Mus musculus
tgtttccgaatgactaaagtcagttcagaactcagacaatctcactgagtcagtctgaagtctgcagcatggccgtttcctgtagttataagaca

SEQ ID NO: 81572 - DNA, 132 bp, Mus musculus
tacacaaaaaattacacacatacgctcacatatatgtggcatatatatatatttatatatatatgtgtgtgtgtgtgtgtgtgtgtgtgtgtgtgtgtatgtatgccatatatatatatatatctccattca

SEQ ID NO: 81573 - DNA, 120 bp, Mus musculus
atgccataatttattcttgtccattgcttcgggagctggataaaaataggtggggtatctaagcctctgtctctctggcatcctttccagcattgctgaagatggagctaagcttcccac

SEQ ID NO: 81574 - DNA, 107 bp, Mus musculus
ggaaacttctgctggaaaggtgtgttctgagcaaaaggcattagcaccattgtagtgtgtctgtgtctgtgtgtttatctggtctgtgtctgtgtctgtctgtgtct

SEQ ID NO: 81575 - DNA, 73 bp, Mus musculus
tgtagtgtgctctgtggatgatactgtttgaagactattcggtcagacagtcagtcagtcagtgagtcagtca

SEQ ID NO: 81576 - DNA, 85 bp, Mus musculus; identical to SEQ ID NO: 57439

SEQ ID NO: 81577 - DNA, 94 bp, Mus musculus
gtcagggttctctagagtcacagaactgatgggtcgtctctatatagtaagggaatttgttgatgacttatagtctgtaatccaactcccctac

SEQ ID NO: 81578 - DNA, 119 bp, Mus musculus
tatttatttctgatgaattgaatcaggttagctttggcccaacagaggtatatttttaaagttttagttgttgtgtaacatatttggttaaccttttcattctacgtcattaaaaaata

SEQ ID NO: 81579 - DNA, 94 bp, Mus musculus
atatattccatttatatattgtatgtatgtatgtatgtacgtacatatgtacgtacgtacgcatgtatgtatgtatgtatgtatatttgaatgg

SEQ ID NO: 81580 - DNA, 65 bp, Mus musculus
atgcatatatatatatatgtgtgtgtgtatgtatacatatatacagatatatattgtatgtgtat

SEQ ID NO: 81581 - DNA, 68 bp, Mus musculus
ctgtagaatatagatatagatagatacctatatatcaatatatctatctctatctatatagtttatag

SEQ ID NO: 81582 - DNA, 77 bp, Mus musculus
gatggctcagtggttaagaacacagactgctcttccagaggttctgagttcaattcccagcaaccacatggaggctc

SEQ ID NO: 81583 - DNA, 70 bp, Mus musculus
gtgagtgagtgagtgagtgagtgagtgagtgtgtgcgtgcacgtgtgctcacacctgcatactcatgtgc

SEQ ID NO: 81584 - DNA, 103 bp, Mus musculus
gtgtgtgtatatatatatgtgtgtgtgtatatatatacatatatatatatgtgtgtgtctgtatatatatgtatgtatacacacattatatatatatatatat

SEQ ID NO: 81585 - DNA, 131 bp, Mus musculus
tacctaggtctggataactttatgaagaaaggatacttgtttggctcacagttctaagtctgagcatctccatctggtatgtttttctcctgatctatcccgagacactataggtatcaccacagcaaaag

SEQ ID NO: 81586 - DNA, 80 bp, Mus musculus
tactgcggtctgaggcacactgtctgtcactatgggaccagagtcccttgattggctttagaatgtgatgaccataggcc

SEQ ID NO: 81587 - DNA, 66 bp, Mus musculus
tgtttatataagtatatacatatatgtgtatatgtatatacatatatgtgtatatgtatgtgaaga

SEQ ID NO: 81588 - DNA, 82 bp, Mus musculus
tatatatatatatcttgccatatatatgcacacatatatacacatatatatgtatgcatatatgtgtatgtatatatatata

SEQ ID NO: 81589 - DNA, 71 bp, Mus musculus
gaattttctgaccacacagagcacacacagcagttcactgaaaggtgctgcctgtgcaaacatagattttc

SEQ ID NO: 81590 - DNA, 81 bp, Mus musculus
agagcacagtgcgtgcagagactccacctaggtccaaaggatatttaggacaatctaggagaccatgcaaactgctgctct

SEQ ID NO: 81591 - DNA, 85 bp, Mus musculus
gtcagttcatgtgagtcagatgtgagtgaggacttcttatttaggaacacagaatgaggagactctgacatcatcaagaagtggc

SEQ ID NO: 81592 - DNA, 80 bp, Mus musculus
tctattcatatatatacacacatatatacatatactcagtcatatatatgcacatgtatgtgtatatgtatatatgtaga

SEQ ID NO: 81593 - DNA, 90 bp, Mus musculus
gtatatgtgagtatgtgtatatatgtatgtatgtgtgtatatgtgtgtatgtgtgtgcatatgtatgtgtgtatatgtgtgtatatgtat

SEQ ID NO: 81594 - DNA, 100 bp, Mus musculus
gtgtgtgtgtgtgtgtgtgaacatgcacataagcacattaagtgcgtgtatatgtgcatgttcatgtgtgtgtttgcatatgtgcatgtgtgtgtgcttg

SEQ ID NO: 81595 - DNA, 83 bp, Mus musculus
agatcacacaggaatccaagcacattggcttaaatgacgcaatatatgtaattaaagcctctgtcttattctctgtgtgggct

SEQ ID NO: 81596 - DNA, 85 bp, Mus musculus
gaactgagagcactgtgttgagactcgctcattctgtcccaccatctaatccagagagtacgtgtttgctatgtggtttcagctc

SEQ ID NO: 81597 - DNA, 99 bp, Mus musculus
agtcccttgatttctctctctctcccctccctctcatacacacacacacacatacacacacacacagagagagagagagagagagagaaaacacacact

SEQ ID NO: 81598 - DNA, 68 bp, Mus musculus
ccagacgaatgtttgtggcttacggtgggtttatgtggactcagagactcacagcctctcacatctgg

SEQ ID NO: 81599 - DNA, 91 bp, Mus musculus
tgtctctgtgccgggattttgaggggtctgacttgtgcaggtatgagctgccacaagtctttatgttcatgtgccctgctgtagcccgaca

SEQ ID NO: 81600 - DNA, 71 bp, Mus musculus
tggttgtgagtcacactgtgtgttgggaaccaagtccaggtcctccccaagtgctcctcaccactgagcca

SEQ ID NO: 81601 - DNA, 58 bp, Mus musculus
atatatatgtatgtgtgcatatgtatatatatgtgtgtgtgtatatatatatatgtgt

SEQ ID NO: 81602 - DNA, 85 bp, Mus musculus
caccttgataatggactgactctctgaccctgtaaggcagtcccaattaaatgctgtccttataagagttgccttgatcatggtg

SEQ ID NO: 81603 - DNA, 83 bp, Mus musculus
tggagaggcaggagtaagaaagtctgttcacctctttttggggaagtataaaatagaattgcacttatccctgcctagcttca

SEQ ID NO: 81604 - DNA, 125 bp, Mus musculus
tggaggcagcatggctgtgatgaagtagcctcatcctatggctgctataactcactctgtctcacaggaactgggggaagaagggcttaagcttacacagcttccctcagattccctcagattcc

SEQ ID NO: 81605 - DNA, 121 bp, Mus musculus
acacacactcatatatatatatatatatatatatacacacatatgtatatgtatgtatatatgtatagtatgtgtatatacatatacatcataaacatatacatatacatcatatacatat

SEQ ID NO: 81606 - DNA, 85 bp, Mus musculus
gtggcaacagcataaaggtgcatctttatcaatgttacttgtttatcagtgcattgatgagtgcacagtgaaagggctcttgaac

SEQ ID NO: 81607 - DNA, 134 bp, Mus musculus
gtgtatgtgtgtatgtatatgtgtgtacatgcatgtgtctgtgtgtctacacctgtgtgtatgtgtgtctctgtgtgtgtacatgtgtgcattctgtgtgtctgtgcgcatgtgtgtgtatgtgtgtatgtata

SEQ ID NO: 81608 - DNA, 77 bp, Mus musculus
ccatcagtttctctctgactgtggctctagctgtgtcacggacacaagaggacatcgcagaggcaatgagcagatgg

SEQ ID NO: 81609 - DNA, 82 bp, Mus musculus
cctgtttctttatccctgtgttctactggctcaacagcatttggctggcaggcagagaaagagagagagaaagagagagagg

SEQ ID NO: 81610 - DNA, 115 bp, Mus musculus
gtgcgcccgtgtgtgtgcatgtgtttgtatatgcatgtgtgtgtgtgtgtgcatatgcatgtgtgtatgcatgtgtgtgtgtgcatgtgtgtgtgcgtgtgtgtgtgacacatgc

SEQ ID NO: 81611 - DNA, 200 bp, Mus musculus
gtgaggatgttgcacacaagtgtctgagcacacaggggtaaggatgctgcacagaagtgtgtgagcacacaggagtgaggatgttgcacacatgtgtgtgaacacacaggagtgaggatgctgtacacaagtgtgtgagcacacaggcgtgaggatgctgtacacaagtgtgtgagcacacaagggtaaggatgctgcac

SEQ ID NO: 81612 - DNA, 114 bp, Mus musculus
gtgaggatgttgtacacaagtgtgtgagcacacaggagtgaggatgctgtacacaagtgtgtgagcacacaggagtgaggatgctgtacacaagtgtgtgagcacacaggagtg

SEQ ID NO: 81613 - DNA, 197 bp, Mus musculus
ggatgctgtacacaagtgtgtgagcacacaggagtgaggatgctgcacacaagtgtgtgagcacacaggagtgaggatgctgcacacaagtgtctgagtacacaggagtgagcatgctgcacacaggtgtgtgagcacacaggagtgaggatgttgtgcacaaatgtgtgagcacacaggagtgaggatgctgctgc

SEQ ID NO: 81614 - DNA, 109 bp, Mus musculus
ggttaacactgtaacgctgtgtgcatgtatgtatttatgtatgtataacatctaatatgtaacatataatatacaatatatacataacacacaacaataatatgtaacc

SEQ ID NO: 81615 - DNA, 67 bp, Mus musculus
gtgggtagttgagctcaagtctcatgatttggaagtaattttctgctgacttgtgtctctgacccat

SEQ ID NO: 81616 - DNA, 116 bp, Mus musculus
catatctaaagaggtagtgatttactctgcatggcttatagaagggtgaagtgttctgttatagatgttttactgagttatttgttaaaacaagtggataaagctctgtgtgtgtg

SEQ ID NO: 81617 - DNA, 75 bp, Mus musculus
tgtgtgtatatatatatatgagcatatatatgtatatatacagtgtatatatatatgagtgtgtgtatacacaca

SEQ ID NO: 81618 - DNA, 87 bp, Mus musculus
tgttaagttgaaaatgtttcctggggcttcagagatggctcagctctgctgactgctcttccagaggtcctgagttcaaatcccaca

SEQ ID NO: 81619 - DNA, 97 bp, Mus musculus
gttgcactgggaatgaatactcggtgctggagagatggctcagcggttaagagcaccgactgctcttccagtggtcctgagttcaattcccagcaac

SEQ ID NO: 81620 - DNA, 80 bp, Mus musculus
agtggaggatgcaggaacttttctgaagagacccagagagtaaatatctcagtttctgtcagtccgtgacatctgctatt

SEQ ID NO: 81621 - DNA, 95 bp, Mus musculus
ggccaatgctaattagactgcctttgttctagttccctgactttaaaagtctctagctctcactcagaggcaggcggatttctgagttttaggcc

SEQ ID NO: 81622 - DNA, 79 bp, Mus musculus
gtacctagtcttccatggctgctacttcatctgtttcctataaccagtgaagggtttaagctgagtgaagactgtctgc

SEQ ID NO: 81623 - DNA, 65 bp, Mus musculus
ggtctttctgtctctgactgtggcttgtccctcctgcaagcctgtgtcagtactcctgggagacc

SEQ ID NO: 81624 - DNA, 77 bp, Mus musculus
tataagctcttcatttttcaatacgtacatacacacatgtgtgtgtgtgtatctgtgtccatgtctgtgtgtttgta

SEQ ID NO: 81625 - DNA, 85 bp, Mus musculus
tgcccatcagagcttcctctgtaaagtgtgatgaaaaatgaccccattctttaacacacaccctcacacagggagtgaatgggta

SEQ ID NO: 81626 - DNA, 87 bp, Mus musculus
gacagacagacagacagacagacagagaggagtagaggctagggatgggcacgtggacgcttctttctcttgttttatgcctgggtt

SEQ ID NO: 81627 - DNA, 68 bp, Mus musculus
ttggtttggtgcagagattctggagacccaagcctgggcttcagacaaactctctgtcattgaacgga

SEQ ID NO: 81628 - DNA, 88 bp, Mus musculus
ggaaaacagaggcagatcagtgtgataatcataagaaagaggcaaaggggcaaccacccttctttggttttcatgctgtaagtttttc

SEQ ID NO: 81629 - DNA, 62 bp, Mus musculus
ggaccagagtttgtgccccagcccagcccacgctgactctgtcactgaaagacttatggtcc

SEQ ID NO: 81630 - DNA, 91 bp, Mus musculus
catggttaggattccaggggcccagcctccgtctctggctctcatgtatagtcaggatgggtggatgtacctgcttgtgccagacaccgtg

SEQ ID NO: 81631 - DNA, 95 bp, Mus musculus
ttctacccatttagctgactctgtgtgtgtgtgtgcgtgcacatgcatgcgtgtgcatgcacacacacatgcatacaacagggagtgtggcagga

SEQ ID NO: 81632 - DNA, 118 bp, Mus musculus
caaagcccatggaaacacatggccacaggttaaaccccagctctgtctctgactgcctgatttgagtaaatcatttaatttctgtgttctttcatgtatttatctatagggtggagtg

SEQ ID NO: 81633 - DNA, 94 bp, Mus musculus
cgggctcagtccgatggttggctgtgagtatctgcatctgtatttggtcaagtgttggtagaacctctcagagaacagccatgccagactcctg

SEQ ID NO: 81634 - DNA, 110 bp, Mus musculus
aggtacacacacagttttaatgcagtgtcaccattttcacaccagtcaattgctaagaccatgactgaagagagtctgatctgccccgcatgctccaagtgtgtgttctt

SEQ ID NO: 81635 - DNA, 115 bp, Mus musculus
ttccttacaataagttactttatatgtatttacagagatatccatatatttatatctatgcaaagaataaggttctacttctctgtataatgtggattagtatatgtgataggaa

SEQ ID NO: 81636 - DNA, 129 bp, Mus musculus
gcacatgtacatatatacattatatgtatatatacatacatatgtgtatgtatatgtattatatatatatatatgtatatatatatatatatagtgtgtgtgtgtgtgtgtgtgtgtgtgtgtgtgtgt

SEQ ID NO: 81637 - DNA, 71 bp, Mus musculus
gtttctgcatcttgtggagtaaggatcacatgtggagtatttatctcagtgcctggctcccagtgagggat

SEQ ID NO: 81638 - DNA, 85 bp, Mus musculus; identical to SEQ ID NO: 57470

SEQ ID NO: 81639 - DNA, 119 bp, Mus musculus
gtaacccttcgaattggcaaccatcctgcccgagaaggcacgcgtgagatgtgtctcactctgcagtgttcatatcctcattgcttcattgctcatcaggaacagtttggaatatgtac

SEQ ID NO: 81640 - DNA, 78 bp, Mus musculus
ttgctgtggttgtgaacacagagcagacacagcgcagttacaaaatgtgttgatttttctggatgtttaacacaggga

SEQ ID NO: 81641 - DNA, 91 bp, Mus musculus
gagtctggagctaggctccagcatgcttccggtttctgtctcctccccctggtatagagatcacagaaatgtgtgtggtcaggcccatctt

SEQ ID NO: 81642 - DNA, 62 bp, Mus musculus
cccattccctgtgatggcattgcactatgggaccactccctctgactgtatcacattgtggg

SEQ ID NO: 81643 - DNA, 99 bp, Mus musculus
catgttagacagaagtctacacagcttcttggtcactgtctctctttctttctgagatgagggatctcactaagcctggttgacaaactggttagtgtg

SEQ ID NO: 81644 - DNA, 110 bp, Mus musculus
tgagagtaagttaaacccttcagctcctagggaacaatttttttcttttaaagaaagaagtggtgtttatcctatgagtcagtgaaggacagcagtcaaacaggctttca

SEQ ID NO: 81645 - DNA, 67 bp, Mus musculus
gaaacagcagttcctgattggctggcatagtccgctcctgcgatctttggtctttcaggaagtcttc

SEQ ID NO: 81646 - DNA, 118 bp, Mus musculus
gtgtacatacaagtcacattgtacagactgagcagagtgtgtgcgaacgtgtgtatgagtgtatttatatataatgtatatagtatgtgtgcatatatatgtatgtatatttaaaaca

SEQ ID NO: 81647 - DNA, 215 bp, Mus musculus
tataggatgtatatatgtgtgtatatatgtgtatacatgcatgtttatgtatatgtatatgtgtgtatatgtatatgtatgtatatacgtatatatgtgtatatgtatatatatgtttatatgtgtatacatgtatgtttatatatgtatatatgtgtgtatatgggtatatgtatgtgtatatgcgcatatgcatatatgtgtgtacatgtata

SEQ ID NO: 81648 - DNA, 93 bp, Mus musculus
tttgcctggatctcagtgtggacagtgagtttcacgagtcagtcctcagatccactgtctgtatcactgtcttcaaattgcactctacgcaag

SEQ ID NO: 81649 - DNA, 115 bp, Mus musculus
gtgatgatgagcagcttgggggctgggagcctaaagtacagagcacagaggagagtcaggggacagcacacagtggctgtgctaggctttggagcctgaggcattggatcaccac

SEQ ID NO: 81650 - DNA, 106 bp, Mus musculus
gccttagtccatggtgatctgataggatgcatgggataatttcaatatttttgtatatgttgaggcttgttttgtggccaattatgtggtcaattttggagaaggt

SEQ ID NO: 81651 - DNA, 101 bp, Mus musculus
gctatgtgatctttaagggcactacatcatgtgacctggatttcaccaatcagattacagtgctcaggactgtgtctttggggatcgccagcagcacagat

SEQ ID NO: 81652 - DNA, 71 bp, Mus musculus
tatatgtatatgtacatgtacatgtacatgtatatgatgtatatgtatatgtatatgtatatgtatatgta

SEQ ID NO: 81653 - DNA, 109 bp, Mus musculus
ccctcctcctgtttatttatttgaccacattctgtttttctagctgtttgagttgaacttctgtgctaccggctgataacagatccaggcctgagcagggcaggcaggg

SEQ ID NO: 81654 - DNA, 98 bp, Mus musculus
tgggcatcattcgaaatgcttctttttattatactataccgtagcccataacgccattctatgaatatatgtataatgtactttgagtgcatgctcca

SEQ ID NO: 81655 - DNA, 132 bp, Mus musculus
tcatatacatatgcatgtatacacacaaatactatatatgtatatgtgaatatatatgtatattatccgaatgtgtatatatgaatatatatgaataagtatatatatatgcataaatatgtatatatatat

SEQ ID NO: 81656 - DNA, 95 bp, Mus musculus
taagtgtggaagtagaatctgaacgtggtgttatcttccaacgagggaatcctggttgaagtctgtcactgtctctgatatgccctgcccattta

SEQ ID NO: 81657 - DNA, 85 bp, Mus musculus; identical to SEQ ID NO: 57439

SEQ ID NO: 81658 - DNA, 66 bp, Mus musculus
gagactcttgtgtccggccctggtgaggaccaaggctttgccatgtgagtgtggacacttcgtttt

SEQ ID NO: 81659 - DNA, 101 bp, Mus musculus
tggaatgtcttatgtcttattttctctgttgggattgaagttttcctggatagcctggactggcatctgtgatctcttagagtctgaagcacatctgtcca

SEQ ID NO: 81660 - DNA, 71 bp, Mus musculus
ggtgagagggggcaatataactttatgtatttatggtataaaggtgacatattgctgtcttcttaacagcc

SEQ ID NO: 81661 - DNA, 81 bp, Mus musculus
tatatatatatatatatatatatacacacacacatatatgcctatatatgtgtgtatgtatatgtataatatttatgtgta

SEQ ID NO: 81662 - DNA, 92 bp, Mus musculus
atgaagaagctaggcagactgacagaacagagcctggccgggacctgaccctggcctcctgcattgctctgtcaggatgtacgtacctttat

SEQ ID NO: 81663 - DNA, 99 bp, Mus musculus
gtttctctgcggtttctcagctttgctaaggttacctcccagcagacagagtggtacatgcttgtaatcttagcataaggccaaggaagtgtttgatcc

SEQ ID NO: 81664 - DNA, 78 bp, Mus musculus
tgtctgtctgtctgtctcacagccttggccctttggtgagtaaagtgaaagagtaccaagtggagacgatcgtggaca

SEQ ID NO: 81665 - DNA, 75 bp, Mus musculus
ggtactagatggacatttggtgtgctcttcctgtgggaagactatctctcccactcacagatttcctcgggtgct

SEQ ID NO: 81666 - DNA, 82 bp, Mus musculus
ccagaggagttcattggatcccattacagatggttgtgaacctccatgtggttgctggttgaattgaacttaggacctctgg

SEQ ID NO: 81667 - DNA, 71 bp, Mus musculus
gaaaatcaatggagctggagagatggttcaggggttaagagccctgactgctcttccagagatcctgagtc

SEQ ID NO: 81668 - DNA, 97 bp, Mus musculus
cagaaacgacttcaaggtgacgactgactgactgactaaatgaatgaatgaatgacagagacagttcctggtgcaaaggcccgttgaggtcaggctg

SEQ ID NO: 81669 - DNA, 75 bp, Mus musculus
tcaagtgctttccaagtgtgagcacagagaggagacaacactgaacaactcccgggcacgcactgtaagccatga

SEQ ID NO: 81670 - DNA, 79 bp, Mus musculus
gctttactctgtctttctcagtgtctttagagagggtagctcattgccctgggggttccttgagattggcatgtttagc

SEQ ID NO: 81671 - DNA, 143 bp, Mus musculus
gtatgtgtatgtgtatatatgtatatgtgtatatatgtatgtgtatgtgtatatgtatatgtgtatatatgcatgtgtatatatacgtatacgtgtatatgtatatgtttatgtatatgtatacatatatattcatatatata

SEQ ID NO: 81672 - DNA, 101 bp, Mus musculus
atacacacgtgtgcatgtgcatgtgtgtgtgtgcatgtacgtgtgcatgtgcatgtgtgtgtgcatgtgtgtgcatgtgcgtgtgcgtgtgcgtgtgcgtg

SEQ ID NO: 81673 - DNA, 85 bp, Mus musculus
tcttaaccattgagccatctctccagctcctgtttctttttatataaagaaaaatcctggactccaagaagccagaggtctaaga

SEQ ID NO: 81674 - DNA, 73 bp, Mus musculus
gaatgatctttagggttgcagagatggctcagtggttaaaggcactgactgctcttccagaggtcctgagttc

SEQ ID NO: 81675 - DNA, 112 bp, Mus musculus
agatcactaccctgctattcctactctgtgtcttggttatggtttctattgttgtaatgaaacaccatgaccattataagagcaagctggggaggaaagggtttatttgact

SEQ ID NO: 81676 - DNA, 92 bp, Mus musculus
gcttgtttctaaagactagatagtttgcacagaggtaggcttgatggagcatcaatacaagctggcaagtgactagctgaattgaaggaagc

SEQ ID NO: 81677 - DNA, 76 bp, Mus musculus
tctgtttggctagactgggttaccagagagctctgagattcaaagctcacttgtctcactcactctcagctccaga

SEQ ID NO: 81678 - DNA, 70 bp, Mus musculus
tatatatacatatacactcatatatatatatatgtatgtatatgtatatgtgtatgtatatgtatatgta

SEQ ID NO: 81679 - DNA, 110 bp, Mus musculus
gctgcctgactgtgtagtaaaaatatttgtacagtggcatctcctgatactggtgacagtctcactgattgaactgtccaaattcagtgacaaaggacagtatctgcagc

SEQ ID NO: 81680 - DNA, 91 bp, Mus musculus
gctatggactggacttaagctacataagctatggtttgaatgtatttctttccaatggttgttgtactgaaagcttaggggccaataaggt

SEQ ID NO: 81681 - DNA, 80 bp, Mus musculus
ttgctgaactggcctagggtcttgatgatgatgatgatgatgatgaagatgatgatgattgagaggttcagttacggcag

SEQ ID NO: 81682 - DNA, 68 bp, Mus musculus
gtcaaacccagagatgctaagtcctgagaagacagggagtggttgttggatctttgggatcttttggc

SEQ ID NO: 81683 - DNA, 98 bp, Mus musculus
aatctgaccagaatgagcagatagtaaagatgaatgtacattcctgcaatgcagagatataacttcagttgaacttatgccatttttttgaatagatt

SEQ ID NO: 81684 - DNA, 78 bp, Mus musculus
tatatgaacacatatacacatatatatatgtatatatacaagcattcatatatatatatgcatgtgtatatgcatatg

SEQ ID NO: 81685 - DNA, 65 bp, Mus musculus
tatatatatatgaatgcttgtatatatacatatatatatgtgtatatgtgttcatataatatata

SEQ ID NO: 81686 - DNA, 101 bp, Mus musculus
tgtgtgtgtatgtgtatatgcatgtatatgtgtgcatgtgtatgtctgtgtatgtatgtatgtatgtatgtatgtatgtatgtgtgtgatgtgcacacgca

SEQ ID NO: 81687 - DNA, 89 bp, Mus musculus
ttgactctcatcttcatggactgcccacaggtgatctgggagtcactcttctctcactatcagtctatgcgtgtcaaaatctgagtcaa

SEQ ID NO: 81688 - DNA, 85 bp, Mus musculus; identical to SEQ ID NO: 57439

SEQ ID NO: 81689 - DNA, 101 bp, Mus musculus
cttacgcattttaggaaggttcgtggggaggcttacagactgcagtaaggtaaacgcctggtagtaggttctaatgtttgccttctttttgttcaagggcc

SEQ ID NO: 81690 - DNA, 232 bp, Mus musculus
tattatattaattatatataatatacaaacatattatataatttaatatataatatatgattatatagttaactgtatatttgattttacatatataatatatggtatgtaatgtgcaatgtataatgtataatatgtaatgtgtaatatgtaatatatatataaatatatgtacacaattatatatacatatatacatgtgtatatatatgtgtgtgtatatatatatata

SEQ ID NO: 81691 - DNA, 62 bp, Mus musculus
tcacactgacacatggagatacttgtttgcagtcagcgctcctgtgttctctctcggtgtgg

SEQ ID NO: 81692 - DNA, 60 bp, Mus musculus
cactgtcactcactgggtgtcaggaatggcttccttcactcttcagtccgtgaccaagtg

SEQ ID NO: 81693 - DNA, 110 bp, Mus musculus
ttgaagatcagccttagtccatggtgatctgataggatgcatgggacaatttcaatatttttgtatctcttgtggcctgttttatgaccaattatgtggccaattttgga

SEQ ID NO: 81694 - DNA, 68 bp, Mus musculus
ggcttgagagtcaaggatataaagaaggagttgagactctccctctgtgactgtgacttaggaaagcc

SEQ ID NO: 81695 - DNA, 85 bp, Mus musculus
tatacacacacacatatatgtgtgtatgtatatgtgcatatatatacatatatgtgtatatatatgtctgtgagctgggtgtatg

SEQ ID NO: 81696 - DNA, 87 bp, Mus musculus
aaatgctttaacatatgcatatatatatatatgtgtgtgtgtatgtatatattatgtgtgtatatatgtgtctgtgtgtgtgcattt

SEQ ID NO: 81697 - DNA, 102 bp, Mus musculus
gcagatgtatgtgtgtatgtatgcatgcatgtatatatgtgtgtatgtatctatatatgcatgtatgaatgtatgcatgtgtatgtatgtgtgtatgtatgc

SEQ ID NO: 81698 - DNA, 102 bp, Mus musculus
gaagctaagtatttgcatttgtttgggcgtgtgtttttgagacagagtctcactcagaggctttggctctaagaacaggttggccttgcactcatagtgatc

SEQ ID NO: 81699 - DNA, 99 bp, Mus musculus
ctccagctgacgtaggatagttctgcttcactgagtgacatccgcaaataggccactatctgttactcactgtttctctcagatttccttctgctgtag

SEQ ID NO: 81700 - DNA, 98 bp, Mus musculus
caaactgtgcgccctactcaccaagagtttctgagaatgtgttttttttataaaactagacaacaattcatgaaaatgggagggaaagatgctgtttg

SEQ ID NO: 81701 - DNA, 107 bp, Mus musculus
gaacagagcatctcaaggagggttagaatggtgtggaagtgcgcaaagaaatggtggctgactagtctctttgttgttgtttaatatgctgtttactttggaggaga

SEQ ID NO: 81702 - DNA, 69 bp, Mus musculus
acatccagagagtgacagtgtcagcatctactaccttagaataccgcgtctgtctgtctgtctgtctgt

SEQ ID NO: 81703 - DNA, 72 bp, Mus musculus
ctgcctgcctgcctgcctgctgcctgcctgcctgctgcctgcctgcctgcctgcctgcctgccaggtggcag

SEQ ID NO: 81704 - DNA, 155 bp, Mus musculus
atatatatatatgtatgtgtgtgtgcatatatatacatacacacatgtgtgtgcatatgtatacatacacatgtgtgtgcatatatatgtatgtatattcatttatacattgtagatacatacaagatttatgtatatattcttgacagatatat

SEQ ID NO: 81705 - DNA, 133 bp, Mus musculus
gttaatatatatttaaatatatatgtacatatatgtatatgtatataaaagcatatatatgtgtgtgtatgtatatatgtatatacgtgtggatatacatatacatcatatacatatacacatatacatatac

SEQ ID NO: 81706 - DNA, 136 bp, Mus musculus
tgtatatgtatatgatgtatatgtatatgtatatgatgtatatgtgtatgtgtatgtgtatatgtatatgtgtatatgtatatgatgtatatgtatatccacacgtatatacatatatacatacacacacatatat

SEQ ID NO: 81707 - DNA, 108 bp, Mus musculus
tgtgagaactttgatgaagggctggagagatggctcagcagttaagagtactgactgctcttccagaggtcctgagttcaattcccagcagtcacatggtggttcaca

SEQ ID NO: 81708 - DNA, 88 bp, Mus musculus
ggtgggcaaagtgtggatgaatgacagacagacacacacacaggagagtttgtgtggaatctgaatgtaatttttcaaatcgaacatc

SEQ ID NO: 81709 - DNA, 95 bp, Mus musculus
tggaagtatgaagtcttgatatttcaaaggtcatagggctggctggctggctggctcactcttctttgcaaaccattctctgacaatactgaaca

SEQ ID NO: 81710 - DNA, 100 bp, Mus musculus
ccgggctggtttcaaactcagccttctgagtgaggagactgtggggatgcacccctacacctacctctaattttcattgagtgcttgtttgatcttctgg

SEQ ID NO: 81711 - DNA, 65 bp, Mus musculus
agggagcagagagagccgagagaggtgagtgctggtatccagcttatgttctatctttcctcctt

SEQ ID NO: 81712 - DNA, 104 bp, Mus musculus
cgggttatgcttcctgcaggtgtagcatctctttgactctctgctaagggtgaaacaggagctgtcgatctgaaaggctttcaagggcagggggaaatggcctg

SEQ ID NO: 81713 - DNA, 69 bp, Mus musculus
tctttccacagttgacttgtgttgggtgagcaagatgttgtatattgacacactgtctctgtggacaga

SEQ ID NO: 81714 - DNA, 79 bp, Mus musculus
gctgtactctctctcacttgcactctctgaggtcattggtcacctgaggtcactgatcaccttgttcaggtcctacagc

SEQ ID NO: 81715 - DNA, 79 bp, Mus musculus
gtgggactacgggctggagagatggctcaggggttaatagcactgactgctcttccagaggtcctgagttcaaaaccac

SEQ ID NO: 81716 - DNA, 109 bp, Mus musculus
ctcaggctgagggtgtgagctgagagggtacactcaggctgagggtgtgagtgctgagagggtacactcaggctgagggtgtgagctgagagggtacactcaggctgag

SEQ ID NO: 81717 - DNA, 161 bp, Mus musculus
ctcgggctgagggtgtgtgctgagagggtacactcgggctgagggtgtgtgctgagagggtacactcgggctgagggtgtgtgctgagagggtacactcgggctgagggtgtgagctgagaggttacactcaggctgagggtgtgtgctgagagggtacac

SEQ ID NO: 81718 - DNA, 288 bp, Mus musculus
agggtacactcaggctgagggtgtgtgctgagaggatacactcaggtgagggtgtgagctgagagggtacactcaggctgagggtgtgagtgctgagagggtacactcgggctgagggtgtgtgctgagagggtacactcgggctgagggtgtgtgctgagagggtacactcgggctgagggtgtgagctgagaggttacactcaggctgagggtgtgagctgagagggtacactcaggctgagggtgtgtgctgagagggtacactcaggctgagggggtgtgtact

SEQ ID NO: 81719 - DNA, 103 bp, Mus musculus
tgttaagctacaggggctggagagatggctcagcggttaagggcactgactgctcttccagaggtcctgagttcaattcccagcaaccacatggtggctcaca

SEQ ID NO: 81720 - DNA, 77 bp, Mus musculus
cagaaaataagcaggccttaatgaaggacctcctgacaccactgatggagaggttcaaggttctgttggaaaagctg

SEQ ID NO: 81721 - DNA, 112 bp, Mus musculus
gctaccattgggtgggctgactgcagcctctcgagtgtctgtatgtcagtctgtttctgtgtgggcatcagtcaacaacaatgccaagaatggcaagctggcagttcttctc

SEQ ID NO: 81722 - DNA, 74 bp, Mus musculus
gtgtcctctctgtgtgtgtgtgactttttgtacaagtctatgtatgtgttatatgtacatgtttgtgtgggtgc

SEQ ID NO: 81723 - DNA, 89 bp, Mus musculus
gtgcaccaaatagcagaccctgcctgagtgcctgtctggggttgctatatgggagcactcaccatgggcttcctgacagactgagagca

SEQ ID NO: 81724 - DNA, 85 bp, Mus musculus; identical to SEQ ID NO: 57439

SEQ ID NO: 81725 - DNA, 79 bp, Mus musculus
ctctcactcactgggtctctttctccagcacacatataaatttttgatgtgtgtcttagaactcgagcctcatgaagag

SEQ ID NO: 81726 - DNA, 85 bp, Mus musculus
tgtgtgtatatatacatatatatatgtgatatatgtacatatatgtctgtgtatatatataaatatgtgtgtatatgtacacaca

SEQ ID NO: 81727 - DNA, 118 bp, Mus musculus
tgtatccatgataaaacccatgaccgagggctggagagatggctcagtggttaggagcactgactgctcttccagaggtcctgagttcaaaatcccagcacccccatggtggcttaca

SEQ ID NO: 81728 - DNA, 106 bp, Mus musculus
gctccgcctggacgggctgctgggcgctgacctgacacacctgacagtgcagaaggagacagtgcagttatgacaggcaccaccgaccagcctcacacgcatgagc

SEQ ID NO: 81729 - DNA, 107 bp, Mus musculus
cgactgcttggcagtgttggaggagagcagccagcatggtgccacaacccaagggattgtcacactgagtctctggaacctatcaaggccacaccttaagttagttg

SEQ ID NO: 81730 - DNA, 114 bp, Mus musculus
ggctcggggagaggagtgaggtaccctctcaagtgttcttataagtcagctatggcagtctcccacagtctctgcttaccaagttgccttgagaccatttctcttgcccatgtc

SEQ ID NO: 81731 - DNA, 76 bp, Mus musculus
tacatataaactatcaatatagaaagtattttcttatattaaaaaagtactttctcatattgtgtgtacatgtgtg

SEQ ID NO: 81732 - DNA, 71 bp, Mus musculus
agtttatatgtaggtatgcatacatacattatatgtgtatgaatttatgtatatatacaggtatataaatt

SEQ ID NO: 81733 - DNA, 85 bp, Mus musculus; identical to SEQ ID NO: 57439

SEQ ID NO: 81734 - DNA, 119 bp, Mus musculus
ctgggattttaaaggcatataaggaggggctggagagatggctcagcagttaagagcactgactgctcttccagaggtcctgagttcaaatcccagcaaccacgtgatggctcacaacc

SEQ ID NO: 81735 - DNA, 111 bp, Mus musculus
acatatgagtggggggtatgaaatttatatatatatatatgtatatatatgtgtgtgtacatatatatgcatatatatatgtgtgtatatatacatgtatatatgtatata

SEQ ID NO: 81736 - DNA, 88 bp, Mus musculus
tcagaattttcacacacatatatatgtatacatatatatgtgtgtgtatgtatatgaaaatatatacatatatgtatatatgcacaca

SEQ ID NO: 81737 - DNA, 105 bp, Mus musculus
aagatgcggtagggggcacaagtgtgtctggattgtcactgtctgtcacactgggaaagatggtgccatcctagatccattaaaggttttcattatctttatctt

SEQ ID NO: 81738 - DNA, 104 bp, Mus musculus
atgtatgtgtgcatgtgtgtgtgtgtgtgtgtatatatatatatatatatatatatatatatatatatatatatgcatgcatacatacatacatatatgtgtat

SEQ ID NO: 81739 - DNA, 105 bp, Mus musculus
gaccggcaggcaggcaggcaggcagagatggagatagactggtagaccagacactggtcctcagctctctctgtctgccctaagaaatgtcagcagaatttagtc

SEQ ID NO: 81740 - DNA, 89 bp, Mus musculus
tgagtcgatggacatagaaagcaatgaacacgatgatgacactctctctgtgtgtgttctctctcccacaaatctatgtcctctggtca

SEQ ID NO: 81741 - DNA, 95 bp, Mus musculus
tgcatgtgcatgggcacaggtttatgtttgcatgtatgcatgtttgtatgtgcatgcatacatgtgtgtgtttgtgtatatgcatgtttgcatgt

SEQ ID NO: 81742 - DNA, 60 bp, Mus musculus
gaggcatgagggtggagaggaacaggctggtgtgagtagcctgtgatgccacctgagccc

SEQ ID NO: 81743 - DNA, 85 bp, Mus musculus; identical to SEQ ID NO: 57439

SEQ ID NO: 81744 - DNA, 126 bp, Mus musculus
atacatacatacatacatacatacataggtacatagatacatatgcatgtatgtatatatgtatgtgtatatatatatgatatatgggatcacatatatctatatatctacatctacatctatata

SEQ ID NO: 81745 - DNA, 84 bp, Mus musculus
cctctcagctcaccgagtaattgatctgtctgtctgtctgcccacagacctgcagtgattaattacactggtggtcctgcaagg

SEQ ID NO: 81746 - DNA, 66 bp, Mus musculus
tatctgtgtgcatgcatgtgtgtgtgagtgtgtgtttgtgtttgtgtgtgtgcatgtgcatttgtg

SEQ ID NO: 81747 - DNA, 72 bp, Mus musculus
tttctagacaggacagcagccagaatgcttatccgagaatatgggtcagttcactgtctctgtgcttagaag

SEQ ID NO: 81748 - DNA, 108 bp, Mus musculus
atttgtgaagcggtttcatatgaaaagcaagagtacagagagtggacatggactccctgggtttgagtcctgggcctgacactcacagctgggtgaccttcaacaagt

SEQ ID NO: 81749 - DNA, 67 bp, Mus musculus
gtgtgcacagagagtgttttgtcggaatgcagccacactgttcactgaccctctgtctgtggcaggc

SEQ ID NO: 81750 - DNA, 76 bp, Mus musculus
ggggctgtaagtagggacagaatctgtagggcatgactggtcatgtgattggagtcgctgtctgtctgtcagaacc

SEQ ID NO: 81751 - DNA, 71 bp, Mus musculus
gtttctctgttgatgtttttcctggggagattctaacactctctcacacataggaaacacaagcaagggac

SEQ ID NO: 81752 - DNA, 119 bp, Mus musculus
gcgtggtccgccggctcccacaccatggccctggctgaggtagtagtttgtgctgttggtcgggttgtgacattgcccgctgtggagataactgcgcaagctactgccttgctagtgct

SEQ ID NO: 81753 - DNA, 89 bp, Mus musculus
gtgtgtttgcatgtgtgtgtgtgtgcatgtgcatgtgcgtatattgtgtatgtacatgtgcttgtgtatgtacatgtgtgtatgtgtgc

SEQ ID NO: 81754 - DNA, 77 bp, Mus musculus
tgggctggtgagatggctcagtggttaggagcactgactgctcttccagaggtcctgagttcagttcccagcaacca

SEQ ID NO: 81755 - DNA, 82 bp, Mus musculus
acctccacctgtgtgcctgtgtgcctgcatgtgaatgtgtgcacacgtgcacatgctcacacacacacatacatacgagtgt

SEQ ID NO: 81756 - DNA, 112 bp, Mus musculus
aggctgacagctgtctcctttcgttgtgagtggttcccatgtgcaaggtctaactctcactcacttttacatttaccccggaaactagtgacacccaaagctggaacagttt

SEQ ID NO: 81757 - DNA, 72 bp, Mus musculus
gcaactaggtatggagaccaggctggcttagcacttctagagatctgcctgcctgcctgcctgcctgcctgc

SEQ ID NO: 81758 - DNA, 67 bp, Mus musculus
tccctgcacttcattcacttcactccttaggttcctaaagagcccacaagtgactgagcacatgggg

SEQ ID NO: 81759 - DNA, 74 bp, Mus musculus
tgagtgggtgggtgcgtgcgtgcctgtgcacgtgtgcacacacattcacatgcactcgcgcgcgcacacacaca

SEQ ID NO: 81760 - DNA, 61 bp, Mus musculus
aggcaaagtttgaggtctgtcgctctgtttctctggagctgcgggctgagccatccggcct

SEQ ID NO: 81761 - DNA, 108 bp, Mus musculus
tctcccattttcatttctgcatgtcaattactgttgcccttgttaaactcctgtttaagcagtcacaacagtgagagctcaggtgtagcctctgacaatcttaggaga

SEQ ID NO: 81762 - DNA, 60 bp, Mus musculus
acacacacacacacacacacacacagagacagatacagaggtgtgtgcatttgtgtgtgt

SEQ ID NO: 81763 - DNA, 59 bp, Mus musculus
tagaggatttgattcagttcccaggatccacatggattctcacactgtctgtgcctcta

SEQ ID NO: 81764 - DNA, 64 bp, Mus musculus
tctctgtcacacacacacacacacatgtatatatttacatgtgtgtgtgtgtgtgtgtgtgtga

SEQ ID NO: 81765 - DNA, 74 bp, Mus musculus
gtgtagagatgatgatgatgatgatggtgatccatccaatcatccatcattatttaatctcattatttttatgt

SEQ ID NO: 81766 - DNA, 85 bp, Mus musculus; identical to SEQ ID NO: 57439

SEQ ID NO: 81767 - DNA, 107 bp, Mus musculus
aggttttgtgtgcatgaagtcaggtgttatgtgcacgacagcattctcacactctttctgtgtagctcagtgtttatattacagcttgacttttcagttctttccct

SEQ ID NO: 81768 - DNA, 115 bp, Mus musculus
gtcatttttgtgtttcacatctatttttgtttgattgatacaacttcagatttacatgtttataaatatatattggtcaaacaaggcatggatatgttctctgctcagaactgtc

SEQ ID NO: 81769 - DNA, 80 bp, Mus musculus
ttgtgtaaagacagtgccacacctgagaagcatcaacagcccatctcctgccactgtccctcacactgtccctcacacga

SEQ ID NO: 81770 - DNA, 128 bp, Mus musculus
atacatatataatgttatatattgtatgttatatgtctattgtgttatatatacatatatgtgtatatatgtatattatgtgtatatatgtgcatatatgtgtatatgtatatatacaatataatata

SEQ ID NO: 81771 - DNA, 90 bp, Mus musculus
tgtcttaactttctatgtgtcactgtctaagtgaattcgcccaagcatgggtggggagttacttactaggacacaggaaacttatcagca

SEQ ID NO: 81772 - DNA, 85 bp, Mus musculus; identical to SEQ ID NO: 57470

SEQ ID NO: 81773 - DNA, 108 bp, Mus musculus
tatgtatgtgtctttgtatctgttgtatgtatgtatgtgtctatgtgtgcatgtatgtatgtatctatcatctatatgtatctgtcaatgtatctgtgcatgtacata

SEQ ID NO: 81774 - DNA, 110 bp, Mus musculus
catctatatgtatctgtcttgtatgtgtctatgtatgcatgtatgtatatatgtgtctatgtatgcatgcatgtatgtatctatcatctatatctatgtatctatttatg

SEQ ID NO: 81775 - DNA, 85 bp, Mus musculus
ggaagatgttaggatattcacagttagtctgttctgtcactggccaaagggtgacctgcagacacactgattctctcacactttt

SEQ ID NO: 81776 - DNA, 61 bp, Mus musculus
cacatactctcagtgtctctgctactctgataaaaggctctcagaggctgaaagctatgtg

SEQ ID NO: 81777 - DNA, 119 bp, Mus musculus
cctgaaaatgctgaaagtgaagagttcagtctgccagggtctgctgagtgtagtgagaagtgagggtgcagtgagcagtcagggtgcagtgaacagtcagggtacagtgagaagccagg

SEQ ID NO: 81778 - DNA, 69 bp, Mus musculus
acacacacacacacacagacacatatatataaaacgtgtgtgtttatggatctgtgtctgtatgtgtgt

SEQ ID NO: 81779 - DNA, 79 bp, Mus musculus
ggtgtgtgcatggttgtggttgtagcttggttgtttgaatgggacaccgacattgagaaccaatgactatgcttacgct

SEQ ID NO: 81780 - DNA, 85 bp, Mus musculus
gtccatggtgatctgataggatgcatagtacaatttcaatatttttgtatctggtgaggcctgttttgtgatcaattatatggtc

SEQ ID NO: 81781 - DNA, 143 bp, Mus musculus
atatatgtatgtatatgtatatacatgtatatatatacacacagacacatatatatatatatatatatatatatatatatatatacatatatatatatatatatatatatatatatatatatgcatgtgtctgtgcatgtgtg

SEQ ID NO: 81782 - DNA, 64 bp, Mus musculus
tatgtatgtatatatgtatgtatgcatatatatatatatgtgtgtgtgtgtgtgtgtgtgtgtg

SEQ ID NO: 81783 - DNA, 82 bp, Mus musculus
tttaggtttctctggctctgtctctgccagcattctggttacctgagattccattgtaatgccctgataagatgaacttaaa

SEQ ID NO: 81784 - DNA, 100 bp, Mus musculus
tttctctctctgtgtatttgcgtgtatgtatatatgtatgcatatatgtatatatgtatgtatgtatgtatgtatgtatgtatgtatgtatttcaagaag

SEQ ID NO: 81785 - DNA, 85 bp, Mus musculus; identical to SEQ ID NO: 65376

SEQ ID NO: 81786 - DNA, 103 bp, Mus musculus
gtcagatcagctattgattggtaactccagtaagttttgtgctcctattaacctagcacaccttgtaggttgaatgccattgtagatagtgtttgtggctgac

SEQ ID NO: 81787 - DNA, 94 bp, Mus musculus
tgtctgtctgtctggttatgtggatgtttatgtgtgagtatagagtgtgcatatatggttatgtagatgtttgtgtgtgagcacagatgtgata

SEQ ID NO: 81788 - DNA, 75 bp, Mus musculus
aggcagtgtggtggtaaacagtaggggcgcctgtgtggacatatgtgtgtctgtatgtgtgaccaatcattgtgt

SEQ ID NO: 81789 - DNA, 84 bp, Mus musculus
ctgcaggaccagttgaaacatacttgtttttcatttaaagtttatcttgttaaataatgcagatcagtgtttttcaacctgtag

SEQ ID NO: 81790 - DNA, 133 bp, Mus musculus
caggtttttgagatggaactatattaaataccctagagaggctgaagaaatgaccttactgtgaggttgactagtgattctttccaatcagactacccgacaaagcctgagagttggttaaatttgtttcctg

SEQ ID NO: 81791 - DNA, 82 bp, Mus musculus
agtgagtcactgagctccaccttcagtgagagacactgtctcagtgaaggaaggaaggtggtgagtgattggaaaatacact

SEQ ID NO: 81792 - DNA, 58 bp, Mus musculus
tcaccaccttccttccttcactgagacagtgtctctcactgaaggtggagctcagtga

SEQ ID NO: 81793 - DNA, 118 bp, Mus musculus
aaggtactatttattaaattttgctgtattttcaggtctctaaaacatagcagtcaatataaatttttcataaggaatgttttagggactagggctcagtgttgttttgcaagacttt

SEQ ID NO: 81794 - DNA, 72 bp, Mus musculus
acatggtggattatgaagcatttatagacatgtcaaaggcaactttcacatgtgtagtgaatttctacatgt

SEQ ID NO: 81795 - DNA, 73 bp, Mus musculus
tctggctactacattcttttgcttcctctttcccaggcttccctaagccttgagaggagtgttctgtggcaga

SEQ ID NO: 81796 - DNA, 119 bp, Mus musculus
cattgtttgggaaaatgacgtcatggggctggagagatggctcagcagttaagagctctgactgctcttccagaggtcctgagttcatgtttcagtaaccacatggtggctcacaacca

SEQ ID NO: 81797 - DNA, 95 bp, Mus musculus
gtgtgttgttcagtttccacatgaatgttggctttctattatttattttgttattgaagatcagccttaatccatggtgatctgataggatgcat

SEQ ID NO: 81798 - DNA, 80 bp, Mus musculus
ggaactagaggccggaaactagaggcaggaaccgtggataaaccacgcccactggctctctcactggctcacgcttaacc

SEQ ID NO: 81799 - DNA, 93 bp, Mus musculus
cactatactctacaagttatgcacatttatctgaatttttaaaaataaaattacatgagtgtatgaatgtgtgtgtgtgtgtgtgtgtgtgtg

SEQ ID NO: 81800 - DNA, 61 bp, Mus musculus
ccttggctgttgttgagcacaggttgaggaagaaggatcataagttcaaggatagcctggg

SEQ ID NO: 81801 - DNA, 125 bp, Mus musculus
tatatatatgcgcctgggtgtatatataggtctatatatacacacttctgtatgtatgtatgtatgtatgtatgtcgtgtatatttatgcttctgggtgtatgtgtggggtatatatatgcttat

SEQ ID NO: 81802 - DNA, 95 bp, Mus musculus
aggcaggcggatttctgagttcgaggccagcctggactacagagtgtacagagtgagttccaggacagccagggctacacagagaaaccctgtct

SEQ ID NO: 81803 - DNA, 117 bp, Mus musculus
gaaaagtaaagtataaaatatccagtgtgaatgcctgcagacatttagaaatgtaagatgatagagtgctctttgtcttcccacaagtgactgtaagttcatcttgatgtacatttc

SEQ ID NO: 81804 - DNA, 109 bp, Mus musculus
attctaatagatccaggccataagggtggttactagtggtatgcaggtcagtgaagaaagagaggggtgcagctcagagcatcgtaagtggccgtttcttgtgatgagt

SEQ ID NO: 81805 - DNA, 78 bp, Mus musculus
gacaggtgttcagacatacttaaatggtagacatgttccctcagtgtattactgtttttgtttatctgaattcaagtc

SEQ ID NO: 81806 - DNA, 116 bp, Mus musculus
tctgctttggctctagggccgtccgttacacagtgcggagagaagacactgtggccatcgatcgggtcagaggtgcttgtgtaagaggatgaaggatgtgtggagaccaataaaga

SEQ ID NO: 81807 - DNA, 127 bp, Mus musculus
atgtgtgcacacatatatgttcatatatatacacacagatattgaatatatatgtgaatatattcatatgtatattgtgcatatattcatatgtatatttaatatatacacaaatataaatagatat

SEQ ID NO: 81808 - DNA, 71 bp, Mus musculus
gtctgtctgtctgtctgtctgtctaggcatggagctgtcaggtgctagtgaagctaagagatcagactgac

SEQ ID NO: 81809 - DNA, 65 bp, Mus musculus
tcccagaactatcttcacaagcactcatagctatgcatggcttcagtgtgtgtgtgtctgtggga

SEQ ID NO: 81810 - DNA, 92 bp, Mus musculus
gtgtgtgcatgatatgtatgtatacatgatacatgtgtgcattatatgtgtatatatgtatataaaaacatagcatatatacatgtatatat

SEQ ID NO: 81811 - DNA, 116 bp, Mus musculus
aaaaggatatatgtgtgtatatatgtgtgtatatatatatacatatatgtatatatatgtgtgtatatgtgtgtatatgtatatgtatatatgtatatatataatctatctctttt

SEQ ID NO: 81812 - DNA, 116 bp, Mus musculus
gctatgcagaaaaagctgttcaaaaatttcagttacattaatacctcacactcacactcagggtggctctggtaacgacactgttgttttgtgtacccgaagctgtctataatggc

SEQ ID NO: 81813 - DNA, 104 bp, Mus musculus
tcttatttctccacatttgtcatgttgtgcattcaaccaacaatatttctatatgaaaatacgttgttaggtcgtgggggtagatgtcgagtgggagactcaga

SEQ ID NO: 81814 - DNA, 76 bp, Mus musculus
tcctattacccttctttgccaaagtttagccaataaaaatcaataggcagagctcggaggaagtgtagtgaaaggg

SEQ ID NO: 81815 - DNA, 112 bp, Mus musculus
tatgcatatgtgtgcatgtatgtattagtatgtatgtatatgaatttatgcatatgtgtacatgtgcatatgtgtatatttgggtatatgtgtacatgtatgcatatgtgta

SEQ ID NO: 81816 - DNA, 85 bp, Mus musculus; identical to SEQ ID NO: 57439

SEQ ID NO: 81817 - DNA, 100 bp, Mus musculus
tttgtgtgtgtttgtgaatgtatgtcagtgtgcacatgtatgtatatatgtatgtgtatgtatgtgtgcatgtgtgtgtgtgctccccagcacacgtgga

SEQ ID NO: 81818 - DNA, 93 bp, Mus musculus
gctatattatgtgtttatattatatatgtttacaatgctatatagctattttatatatgtttacaatactgtattgtaaatacgtagtgtagt

SEQ ID NO: 81819 - DNA, 105 bp, Mus musculus
atatgtgtgtatgagcatgtgtattgtatatatgtatgtatgtgagtgtatgtgtgtatatatatgtgtatatgtgtgcatatgtgtatgtgtgtatgtgttgca

SEQ ID NO: 81820 - DNA, 85 bp, Mus musculus; identical to SEQ ID NO: 57439

SEQ ID NO: 81821 - DNA, 68 bp, Mus musculus
agactcagtgacctcccacagtgacttccctctgtagccagagaggacagtgttagagaacagggttt

SEQ ID NO: 81822 - DNA, 91 bp, Mus musculus
gttaagaaattgtttcacaggcaatctcagagatcagagtgatctgaacaatttaatttaggttctgtcttcctgtgcatatcaaattgac

SEQ ID NO: 81823 - DNA, 75 bp, Mus musculus
gtctgtctgtctgtctgtatatgtgtgtacatgcatgcacacatgtcccagcacatgtgtggaggtcagaagaca

SEQ ID NO: 81824 - DNA, 76 bp, Mus musculus
tagacatgcacatatatacataaacatatatgtgcatttatgtgtatatgtatgtatgtatatatgtatgtgtgta

SEQ ID NO: 81825 - DNA, 69 bp, Mus musculus
gctatgctgccgttctggctggttttgtgtcaacttgacacaattcagagtcatcagagaggaaggagc

SEQ ID NO: 81826 - DNA, 60 bp, Mus musculus
tatatatatttgtatatatgtatatatatttatatatgtgtatatatgcatatgtgtata

SEQ ID NO: 81827 - DNA, 103 bp, Mus musculus
gtgtgtgtctgtgcatatatttatgtatatatttatatactatgtaaactcaacttcatacattatatatgaaattatatatataaatatatatatcatatat

SEQ ID NO: 81828 - DNA, 72 bp, Mus musculus
acatgcatatatatgtatatatgtatgtatgtgtgtgaaatatatatatatatatacatatatgtatgtata

SEQ ID NO: 81829 - DNA, 77 bp, Mus musculus
tacgtatgtatgcatgtgtatgtgtgtgtgtatgtgtgtatgtacgtatgtacgtatgtatgcatgaatgtatatat

SEQ ID NO: 81830 - DNA, 67 bp, Mus musculus
agaccacggagacatgttcacacagggagacttgatctctctgtgcctctgtctctctgtcctgtct

SEQ ID NO: 81831 - DNA, 145 bp, Mus musculus
tatgtgtacacacacacacacacacatacatacatatatatatatatatatatatatatatatatatatatatatatacatatatatgtgtgtgtgtatgtatgtatgtatatgtgtgtatatatatatatgtatatatatgtat

SEQ ID NO: 81832 - DNA, 82 bp, Mus musculus
tgtgtttgcatatatgtgtatatatgtgtgcatgtgcttgtgtgcatatgtgtgcctatgtgtgtctgtgtgtgtgagtgta

SEQ ID NO: 81833 - DNA, 74 bp, Mus musculus
catcctggactttctgaagtgagttaggacacaatgtgccagagaagtcactatttcaacggagacccagggtg

SEQ ID NO: 81834 - DNA, 96 bp, Mus musculus
ggagcacacatgtctattcactctctcactgttacacatctgctgaggctatagcagtgttatgagtttctgtctctatctggactggctgcatcc

SEQ ID NO: 81835 - DNA, 86 bp, Mus musculus
tgagaagctgagagttctacttctccatctgaagacagacagaagactggctctcacgtgggcaggatgaggggtcttagagctca

SEQ ID NO: 81836 - DNA, 87 bp, Mus musculus
taattctcctctaacagcacctccaactggagattgggtattcaaataccagagtctgggggtggggggtcgggggcgggggaatta

SEQ ID NO: 81837 - DNA, 118 bp, Mus musculus
tcaaagtgtcaactttgggttaatgttttctgagccccaacactaatgaatttgaagatatttgaaatttcagttgttttggagaccacgctttgatgacccagagcatttgagagtt

SEQ ID NO: 81838 - DNA, 75 bp, Mus musculus
tgtatatatacatgtatatgtatataatgtttaggtatatgacatctatgtgtatatatatgatgtatatgtata

SEQ ID NO: 81839 - DNA, 166 bp, Mus musculus
tgtcagcacataagtagtatatatgaatataatgtatgtgtatgtatatgatgtgcatgtatgtttatatgtatatatgtatatgatgtatatgtatatgatttatatgactgatatatatgatgtatatgtagtatatgcatatgtatatgaatatgatgtatat

SEQ ID NO: 81840 - DNA, 90 bp, Mus musculus
aggtgggacttccaggtatgtatgtatgtatgtatgcatgcatgtatgtatatatgtatgtatgtatgcatgcatgtatgtgtcttactt

SEQ ID NO: 81841 - DNA, 104 bp, Mus musculus
gtgtgttgggatttcaagtgggctccaccatgcctggcatttctcagtctctttctctgtgtgtgaatgtgggtatgtgtttgtctatgtgtgtgtgaatgtgt

SEQ ID NO: 81842 - DNA, 86 bp, Mus musculus
tgtatgtatgtatgtatgttttatgtatgtatgcatgtatgttttgtgtatgtatgtatgcatgtttgtatgcatgtgtgtatgca

SEQ ID NO: 81843 - DNA, 67 bp, Mus musculus
cttgtttggagttgaagaactggtgaacatggtaacatacctctgtctctgtctcaaaccaagcaag

SEQ ID NO: 81844 - DNA, 112 bp, Mus musculus
agcattaataaaaatgataaatggctatgttactgctttgtgtgtgtgtatcacagacacacacactgttgtctcagtttcttgctttaaatttatttttaaaattgatgtt

SEQ ID NO: 81845 - DNA, 71 bp, Mus musculus
gtatacatatatatgtgtgtgaatatgtatacacattatatgtgtgtatatatgtatgtatatgtgtatat

SEQ ID NO: 81846 - DNA, 106 bp, Mus musculus
gtgtgtgcatgtgtgtgagagtgtgcatgagtgagagtgtgtgagtatgtgtctgtctatgtgtgagtgtgtgcatgtataaatgtatgtgtgcaagtgtatgcat

SEQ ID NO: 81847 - DNA, 105 bp, Mus musculus
gtataatatgcatattgcatgtatttatgcatattgcacctatactatgcttattgcatgtatagtatgcacattgcatatatactatacatattgcatatatac

SEQ ID NO: 81848 - DNA, 86 bp, Mus musculus
tacatgtgagtatgtatatgcgtgcatgtgtatatgtgtatatatctttatgtgtgtatatgcatgtacatgtatgcatgtacatg

SEQ ID NO: 81849 - DNA, 164 bp, Mus musculus
gtgtatatgtgtgtatatattatatatgtgtgtatatgaatattatatatatgtgtatgtatgtatatatatatatatatatatatgtatatatatatatatggctggagagatggttaagggcactgactgctcttccagaggtcctgagttcaattcccagc

SEQ ID NO: 81850 - DNA, 86 bp, Mus musculus
gtgggctgacttggctcccaactacaacaggagtcaaatgtgacagttctgatgtctgagagtggtgagagtcgagttgatttcac

SEQ ID NO: 81851 - DNA, 89 bp, Mus musculus
ttctgtcaaggttttggtcacggtgatgataaaaggaatcaatacaactatcctacagtgtagacacatgggcctctccatgaccagaa

SEQ ID NO: 81852 - DNA, 86 bp, Mus musculus
gatgagattgaacttgtcattcagtccacactcaaaagtcaagtccaggctgagatgagactgaccacaggaccacagtatacatc

SEQ ID NO: 81853 - DNA, 56 bp, Mus musculus
gcattgagcagcaggcaggagcagctcaaggtctgtctgtctgtctgtctcaaagt

SEQ ID NO: 81854 - DNA, 149 bp, Mus musculus
ggacctacacaagccgtcctgctggaatcccgtacagaaggctactgtggaggctgcggctggattcaagtaatccaggataggctgtgtccgtccatgaggcctgttcttgattacttgtttctggaggcagcgcatggtctgccctc

SEQ ID NO: 81855 - DNA, 95 bp, Mus musculus
ataatgttttagggggctggagagatgactccgtggttaagagcactgtctgctcttccagaggtcctgagttcaattcccagcaaccacattgt

SEQ ID NO: 81856 - DNA, 58 bp, Mus musculus
ggggtcactcactctctctgccagcttcctgagtcggctcagagcttgcttggccacc

SEQ ID NO: 81857 - DNA, 90 bp, Mus musculus
gggaaagagtgcaggttggggtcactggcccttggggaacccatctactgttgaccacctcagtcactggctctgtctgcccttgatctc

SEQ ID NO: 81858 - DNA, 135 bp, Mus musculus
gtgtggaggtcagaggtcaagttggggttgctcctcagaaattgtcaccttaactgtctgagtctctgtctctcactggaacctggggctttccggtcaagccatgctggccggccagtgagtccccaggatcta

SEQ ID NO: 81859 - DNA, 90 bp, Mus musculus
tcagtggaggcgtggccaaagtcatggggaccttgtcagcaggcccagtgtgtgtgtctgtcagtcctgtggccgtgtctgtggggctgg

SEQ ID NO: 81860 - DNA, 120 bp, Mus musculus
acccactgtggctatcctggagctcatcatgtagaccagactggcctaagagtcaagagttctgactgcctgtgtgcctcctaaatgctgggattaagggtgtgtgccaccaggcctggt

SEQ ID NO: 81861 - DNA, 91 bp, Mus musculus
ttatgtatttacttgatatgtagaaatgtcttgcatgtatgtatacatgtatgtatactgcgtgcatttctggtgtctgaggaggtcatag

SEQ ID NO: 81862 - DNA, 118 bp, Mus musculus
tgagaccctgtttgggtgtctgggactggagagatggagagattaagagcactgactgctctttcagaggaccagggttcaaatcccagcagccacatgatagcagcttaaggcggtc

SEQ ID NO: 81863 - DNA, 71 bp, Mus musculus
gtcttgccctgtgtctgtctgtgcttcacacgcatacagtgcttgagtaaggccagaaaacagggttggat

SEQ ID NO: 81864 - DNA, 77 bp, Mus musculus
acagacaagccagcgggtgttagcctagccttctttccgcacctacctcgcttgcctccctctgtctgtctgtctgt

SEQ ID NO: 81865 - DNA, 68 bp, Mus musculus
gaggtaggtgcggaaagaaggctaggctaacacccgctggcttgtctgtctgtctcgcactccttctc

SEQ ID NO: 81866 - DNA, 119 bp, Mus musculus
gtcttgtaaagtgcatcctcaatacctataaaccatttttatatttatgtttttcaagattttattatttttaaaaattatgtgtatctgtgtatgagtgtatgcaggctgctaaagac

SEQ ID NO: 81867 - DNA, 80 bp, Mus musculus
ctaaaagacatggactgcttcactcgctctctttgaatgacagcactcatttgggtgatgaaagtgtaacatgtttagag

SEQ ID NO: 81868 - DNA, 135 bp, Mus musculus
gctccagtgtccagctcactccacttctccctcggtccttgatgagctcattctgagggatgagactgagctgactcaagcagtgtctgggcacgcagaggctcagaagcatccagcggagccacccaggcaggc

SEQ ID NO: 81869 - DNA, 93 bp, Mus musculus
gcataaaaagtctgatgctcgatttgaaaattacactcagattccacacaacttctcctgtgtgtgtctgtttgtcattcatccacgctttgc

SEQ ID NO: 81870 - DNA, 85 bp, Mus musculus
gacttatgctgccactgtgaatgagaccacctagggtggagccttccaacctagatggttctattgttctgtcacctgcactgtt

SEQ ID NO: 81871 - DNA, 73 bp, Mus musculus
gtgctgtgtctcttactctgtatcccatgccttctgtttgcacagcctgggtacagggcacaggacccagtat

SEQ ID NO: 81872 - DNA, 121 bp, Mus musculus
ggaagcttgagacgtagacctctggttctgggtttggaaggctgctctgtgagtttctgtgactcagggttatcagctctaggagtacttgctcattccagagtttctgtccagacagagc

SEQ ID NO: 81873 - DNA, 60 bp, Mus musculus
gtggttaagagcactgactgctcttccagaggtctggtgagttcagtctccagcaaccac

SEQ ID NO: 81874 - DNA, 84 bp, Mus musculus
tgggtaagtatgatagctgcccctgggaaaggcctgagggatgcccagctccctctctggctgactcagcaggggtggggccta

SEQ ID NO: 81875 - DNA, 91 bp, Mus musculus
attttgagggagctggagaaatggctcagcagttaagagcactgactgctctttcagaggtcctgagttcaattcccagcaaccacatagt

SEQ ID NO: 81876 - DNA, 70 bp, Mus musculus
agcagcagtggcagcaagactgtcagcagggtttccacaggacagagctctgagtctgtcactgagtgct

SEQ ID NO: 81877 - DNA, 74 bp, Mus musculus
aggacagccagagctacctgtctgtctgtcagacagacagacagacagacagacagacagacagacactgtcct

SEQ ID NO: 81878 - DNA, 75 bp, Mus musculus
tgatagggggacatctggtagaagagaaagggccctccactctgctctttctctttaaccctctgaatacctaca

SEQ ID NO: 81879 - DNA, 105 bp, Mus musculus
agggaatagggaggccttcgctggggtccggggtcctcagagttctgagagaggagtcttaactgaggctgtggatctccgcaagcaacactctttgtcagctct

SEQ ID NO: 81880 - DNA, 85 bp, Mus musculus
ggctgttaccctcacctgtctggcaagcagcagaggaatgaagtggttctctgtctcactcagtaggtccctagttggagcggct

SEQ ID NO: 81881 - DNA, 76 bp, Mus musculus
tttagctccttgggtactttctgaaagtctatcttttaatcaggaggcagaagcagacagatctcagtgagctgag

SEQ ID NO: 81882 - DNA, 75 bp, Mus musculus
tgtctgtctgtctctgtctctctgttgctgtctcaaaggcacatgcacacgtaaaagacataggcaagccagata

SEQ ID NO: 81883 - DNA, 95 bp, Mus musculus
tgtactgcaggctcactgaggctggatacattgtcacagtctgtgtcacagtctgtgacaatgtatccagcctcagtgggcacctgcacataaca

SEQ ID NO: 81884 - DNA, 79 bp, Mus musculus
tgtctgtctgtctgtctgtcacatttgtgcctggtactcaaggagtccagaataggtgtgagatccgctagaactagca

SEQ ID NO: 81885 - DNA, 86 bp, Mus musculus
gatttttttgaaacagggtctctcactggctgaccaattgtgcttggtcagaaggatggacagtgagcccccataatctgtttgtc

SEQ ID NO: 81886 - DNA, 77 bp, Mus musculus
gctggctgaaccaactacaagggacaagccaaaaagcagtatcctgccatggcctctgtgcctgtgtcagcctctgc

SEQ ID NO: 81887 - DNA, 89 bp, Mus musculus
tctctgcctctgtctctgtctctctcacaagaggagatcttctcagctttgctctagttgactgtaggacaaagaaaagcaggtagagg

SEQ ID NO: 81888 - DNA, 87 bp, Mus musculus
ctacctgcttttctttgtcctacagtcaactagagcaaagctgagaagatctcctcttgtgagagagacagagacagaggcagagag

SEQ ID NO: 81889 - DNA, 80 bp, Mus musculus
gcaggaagagtgagaacatcacagggcagcgtggcctaggcctccccacccactctggctctggctctccttctaactgc

SEQ ID NO: 81890 - DNA, 78 bp, Mus musculus
tctgtctgtctgtctgtctgtctgtctagagtggcatatgcctataactctagcccttgggaggctaaggcagaagga

SEQ ID NO: 81891 - DNA, 75 bp, Mus musculus
tatacatatatatatgtatatatacacatatatatatatgatgtttgtgtgcatgtaagcatgtatgaatgtatg

SEQ ID NO: 81892 - DNA, 85 bp, Mus musculus; identical to SEQ ID NO: 57439

SEQ ID NO: 81893 - DNA, 131 bp, Mus musculus
actattttgcttctttcttagcatgtgtctgtttacaatactggcattttgtgtaattcaatatatgtatatataggtggcagattgcaattgaaacgtgtgtcagaatagttcagcacacagcaggtaga

SEQ ID NO: 81894 - DNA, 106 bp, Mus musculus
gccttaatccatgatggtctgataggatgcatgggacaatttcaatatttttgtatctgttgaggaatgttttgtgaccaattatatggtcaattttggagaaggt

SEQ ID NO: 81895 - DNA, 96 bp, Mus musculus
gatcagccttagtccgtggtaattagatagggtgcatgggataatttcaatatttttgtatctgtggaggcctgttttgtgaccaattatatggtc

SEQ ID NO: 81896 - DNA, 89 bp, Mus musculus
tctgccggttgcatgtacttccacggaggagttgtgagcatccatgaaaacaaacagactcggtctctgtttaagatatggctggtgga

SEQ ID NO: 81897 - DNA, 58 bp, Mus musculus
acatgtgtgcataagtgtgtatgtatgtatgaatgtgtgtatatgtatgtgcatgtgt

SEQ ID NO: 81898 - DNA, 80 bp, Mus musculus
tgtgtgtatatgtatgtgtatatatatgcacacatgtatgagggtacgtgtgtgtatgtgtattcatgtgtgtatgtata

SEQ ID NO: 81899 - DNA, 59 bp, Mus musculus
gtgcttgctgacaggagcctgatgtagctctctcctgagaggctctgtcagtgcctcac

SEQ ID NO: 81900 - DNA, 116 bp, Mus musculus
cagggcccattctcccaagtgctacagcctgtgataggctgacacagtttttcactctcacaccctcagagctgcttcacattcatcatcaaggctagctgcattatgttgtcctg

SEQ ID NO: 81901 - DNA, 144 bp, Mus musculus
agataagtatgtaaggtgggctcaactggtttgaatggagatgtaaaaatggttaatcctgaatttgtatatgaatttatgtaagttggtccatatttgcttatgtaagttttccttctgctagttttccttctcctgattcaa

SEQ ID NO: 81902 - DNA, 145 bp, Mus musculus
cagagactgaaccaacaaccaggcagcatacatgaactggtccaaggcccccagcattatctgtctgtctgtctgtctgtgtatatgcatgtctatgtatatattataaatatgtatatgatgtatatgtatatgtataatcaga

SEQ ID NO: 81903 - DNA, 70 bp, Mus musculus
acagacagacagacagacagataatgctgggggccttggaccagttcatgtatgctgcctggttgttggt

SEQ ID NO: 81904 - DNA, 94 bp, Mus musculus
tttcacaattttttaaaaaatttttatatgtgtgtattgtagattctcttacatacatttcatttgaaaattttttaaaacacagattttgaaa

SEQ ID NO: 81905 - DNA, 110 bp, Mus musculus
gaaattggtctgaagttctctatctttgttgggtcattttgtggtttagatatcagagtaattttggcttcatagaatgagttgggtagagtaccttctgcttttatttt

SEQ ID NO: 81906 - DNA, 127 bp, Mus musculus
acatatatatgtatgtatatgtgtatatgtatatatctgtgtgtgcatgagtatatatatgtatatataaatgtgtgtatatgtatatgtgtatgtttatgcataatatatgtgtacatgtgtatat

SEQ ID NO: 81907 - DNA, 64 bp, Mus musculus
aacctgtcagttgtgagtctgacatccttggattcaaggctgtatggcacgctggtgattggtt

SEQ ID NO: 81908 - DNA, 117 bp, Mus musculus
ccatctacccatacatctaaatgtatatatccatttgtctatatgtttatatgtatgtacatgtatatatgtaagcatacatgaatacttttggagtgtattaaacaggtggttggg

SEQ ID NO: 81909 - DNA, 81 bp, Mus musculus
tgcttgggcactccagcagtgacagaaaaaaatgtagcataatgctctagagttttgcttcttctgagaggcacatcggca

SEQ ID NO: 81910 - DNA, 132 bp, Mus musculus
agactggtcggcacaggtgagagtgtggactgcagaggctaacagcttctgggacagacagaacacacagagcttctggggcagaccgagtttcgagccccagacatctgggctccatccttgccagagaag

SEQ ID NO: 81911 - DNA, 95 bp, Mus musculus
caaggtctgtccataatgtctgactctgagtctccgtgtttgttcccatctcttgcaggaggaagctggtctcatgatggctgaggaaggcactg

SEQ ID NO: 81912 - DNA, 86 bp, Mus musculus
ccattgatctatctgtctgtctgtctctgtaccaaggccatgtggttttttatcactatcgctctgtagtacaggctgaggtctgg

SEQ ID NO: 81913 - DNA, 83 bp, Mus musculus
ctacctatgaatgggtatataagtatagatctatgtattatgtaggtacgcatgaatacttgtagagctgatgagacaggtgg

SEQ ID NO: 81914 - DNA, 86 bp, Mus musculus
ctctttggtaggtagcagatttggcagggcatcatcagtaggaaacaaaacttggtttgcaagttaaaggttgcttagtattagtg

SEQ ID NO: 81915 - DNA, 76 bp, Mus musculus
tatgtatgtgtatatatgtatatctatgtgtgtataatataaattatatacacatatacatacatatgcatacata

SEQ ID NO: 81916 - DNA, 108 bp, Mus musculus
gactgttttagatatattttatcctgcctgcatgtgagcgagaaggcacacagggagacacatgacagtgcacacaccaaggtggtggtggaaactactgagatagtt

SEQ ID NO: 81917 - DNA, 119 bp, Mus musculus
ccatgctaaacaaccacaaagtatttgctaactgatagctccatgattatcacttcagtctctgtgagcccccatgagtccttcttagttgactctttgggctgtgttctcctggtgtg

SEQ ID NO: 81918 - DNA, 72 bp, Mus musculus
caggaattgtgtcactgggaatgggctttgaggtttcaaaagcccacatcagtctcagtctctctttttctg

SEQ ID NO: 81919 - DNA, 107 bp, Mus musculus
cataattgtatgttgggagggggataagtggttgtcttttgttttagaagatgggcttttaggattgaatgtgtactttctattattccttggccccgaggattgtg

SEQ ID NO: 81920 - DNA, 112 bp, Mus musculus
attgtgtttttcttggcaatgttactctttggagatttcattgaaactttatatttatatttggtgagcagctagcacagtaagtccagccagtgcagagggtttacacaat

SEQ ID NO: 81921 - DNA, 84 bp, Mus musculus
gtgtatatgagtgtatgtgtatatgtgcgtgtatgtgtgtatatatatatgtgtatatgtgagagtatgtgaatgagtgtatat

SEQ ID NO: 81922 - DNA, 86 bp, Mus musculus
acagcacaaaactgggaggcagcctcagtgcgtgagtcatcgcctttgatcacagtagctgaaagctgcacaaagcagtaggctgt

SEQ ID NO: 81923 - DNA, 85 bp, Mus musculus
gcagaacaggatgctctgtgagatgtgggaaagaaagccttccaggctgagacacaggtacagaagacacagagcactagtgtgc

SEQ ID NO: 81924 - DNA, 96 bp, Mus musculus
tcactagaaccaggaagtcagataagacagaggacatagcataccttcctaagatcctttgtacagcttgtttaatgacagtgaccaactctgtga

SEQ ID NO: 81925 - DNA, 65 bp, Mus musculus
tacttgtctgtctgtgtttatctgtgtgtaggtacatctgtgtgcaggtacccacagattgggtg

SEQ ID NO: 81926 - DNA, 90 bp, Mus musculus
ggagggtagaagtgtacccatgagaggtgaggagaggcttgggcatggctgtgtccctcactctccctgtggtgcctccatcttccctct

SEQ ID NO: 81927 - DNA, 63 bp, Mus musculus
taaggattaggtgtcaccaagccagcgctgctaagtgtcactctgtgacatttcttttcttta

SEQ ID NO: 81928 - DNA, 82 bp, Mus musculus
gtttaggttattagatggcaacgacattgtctcagacccactctccttgagatggtctccatgctcctgaataccctataac

SEQ ID NO: 81929 - DNA, 72 bp, Mus musculus
atgtgtgtatgtatgcatatatgtatgtatgtatttatgcatgtgtatatgtatgtatgtaagtatatatgt

SEQ ID NO: 81930 - DNA, 87 bp, Mus musculus
ggagggatttgatggagacatcccatttagtactgagtttttaaaggtctctcactctctgaataatgtctacctgtgcatctctgt

SEQ ID NO: 81931 - DNA, 89 bp, Mus musculus
ttagactcagatagtaagctatgtgtgtgtgcatgtgcatgcatgtatatgtaccttaagcataatccttacatattagatttatctaa

SEQ ID NO: 81932 - DNA, 85 bp, Mus musculus
ctcactgtcacacaacagagacagcttccatattgaacgttacatggcgttctcaatagtcagcctccgtgtgtgtgtgtgtgtg

SEQ ID NO: 81933 - DNA, 103 bp, Mus musculus
gaaagtatttcctctggctggagagatggcttagtggttaagagcactgactgctcttccagagctcctgagttcaattcccagcaaccacagggtggctcac

SEQ ID NO: 81934 - DNA, 152 bp, Mus musculus
tatatacatatatatgtatacatatgtacacatatatgtatatctatatatgtatatatgtacacatatacatatatatgtatatctatatatatatagatatacatagataatgttttcattcctgtgtgtctgtgtgtatctgtgtgtgt

SEQ ID NO: 81935 - DNA, 112 bp, Mus musculus
tatgtatatctatatatatatagatatacatatatatgtatatgtgtacatatatacatatatagatatacatatatgtgtacatatgtatacatatatatgtatataatac

SEQ ID NO: 81936 - DNA, 113 bp, Mus musculus
gcacaccactttaaatagagtatggctggaacttaggggtttggacagctggacttcagctccctgactgcctggctgagtctccagtcacagactccaccagaagggaaagc

SEQ ID NO: 81937 - DNA, 85 bp, Mus musculus; identical to SEQ ID NO: 57470

SEQ ID NO: 81938 - DNA, 117 bp, Mus musculus
cataagctcatcaccatcttaatgcatacatacatacatacatatgtatacatatatacatatatgtctatatacatatatatgtgagcttgtgcagaatgaaaactgagttgcatg

SEQ ID NO: 81939 - DNA, 98 bp, Mus musculus
gtcgcttgttgaattcggattggtgtgagggcatgcttgtttggctgattataaaccacatctgaccctctgtgtgtcttcactctataaacagggat

SEQ ID NO: 81940 - DNA, 66 bp, Mus musculus
tccacttgtatctgtctgtctgtgtatgtatgtgcacgtgcgtttagatggccagaaaaagtcaga

SEQ ID NO: 81941 - DNA, 92 bp, Mus musculus
tgcgtgttatgattacggggtagacactggagactgccctttgcttttcacagagaacagacagtgctctctctgctggttttatttattca

SEQ ID NO: 81942 - DNA, 113 bp, Mus musculus
gcaggaactgattttattttaagatggtggagcatgctatgtctgtcactctcagacaatttggccctgttgttataatcacagccgcttaaagtacatagatctatgggcct

SEQ ID NO: 81943 - DNA, 61 bp, Mus musculus
ataaaaaccaaagagtaagagagggtggcccaggaacactctctctgcttgttgttgttgt

SEQ ID NO: 81944 - DNA, 106 bp, Mus musculus; identical to SEQ ID NO: 69283

SEQ ID NO: 81945 - DNA, 89 bp, Mus musculus
tttagaaaagtgcacaataaagcttgcaggatgttttgtgttggccaactactcctgacatgcggaattgcattccactgacctctgga

SEQ ID NO: 81946 - DNA, 105 bp, Mus musculus
tgaacactggtttatgtttgcctctccatcgcatggtgatccacttgattttaaaagctattcatacctatgtgatcgttagtaattcacatgtagcctggttca

SEQ ID NO: 81947 - DNA, 72 bp, Mus musculus
catatacttgtagatgttcagttctgctgttacaatggagaagtgactggacagtgagcagacaggtatatg

SEQ ID NO: 81948 - DNA, 62 bp, Mus musculus
ctgagtgccaggactacaggcactttctattatgtctgtctgtctgtctgtgtggtagttag

SEQ ID NO: 81949 - DNA, 120 bp, Mus musculus
caatatcattgctctctcttgtaaggaaaattgagcatcaacttttctatgtatttatattcactatacattaggagtgtgctaacttttctttatagtattgatagagatcttctgatg

SEQ ID NO: 81950 - DNA, 115 bp, Mus musculus
tgttcatctcttttccagtctgcccctttgctacctgtatttatttatttatttatttatttatttatttatttatttatttacctgtcagcgctgagagcagtgagagtgaaca

SEQ ID NO: 81951 - DNA, 85 bp, Mus musculus; identical to SEQ ID NO: 57439

SEQ ID NO: 81952 - DNA, 87 bp, Mus musculus
tcttcttcttcttcctcttcttcttcctcctcctcctcctcctatagtaggtaggcaggcaagcaggcaggcagacagacagacaga

SEQ ID NO: 81953 - DNA, 85 bp, Mus musculus; identical to SEQ ID NO: 57470

SEQ ID NO: 81954 - DNA, 71 bp, Mus musculus
tatgtatgtgtgtgtgtgcatgtgcatgtgtgtcaatgcattcttgggggttgcatacaagaatataggtg

SEQ ID NO: 81955 - DNA, 85 bp, Mus musculus; identical to SEQ ID NO: 57439

SEQ ID NO: 81956 - DNA, 98 bp, Mus musculus
gtatgcaggtcctgatgatgggaagacatgggaatttgttcaattggtatgaggaaatcattttataaccatcttcattgttacaggaggctgaaatc

SEQ ID NO: 81957 - DNA, 84 bp, Mus musculus
ctgtttgtttaatcctcaattgaagaaaaaatggagtattacttgtattctaaattttttctcttttgatatttatgtgaatag

SEQ ID NO: 81958 - DNA, 78 bp, Mus musculus
cccatgtgctcacagtctctcagtgttataatatgtggatgacagatgttacctgaaaggaacgacgagttacctggg

SEQ ID NO: 81959 - DNA, 86 bp, Mus musculus
ggccatggtggtctgataggatacatgcggacaatttcaatatttttgtatctattgaggcctgttttgtgaccaattatatggtc

SEQ ID NO: 81960 - DNA, 115 bp, Mus musculus
gaaaacaataatgctcagttctgttgcctgaggactttggtagatggatgtatattttgaaggtgtcaagtgcacatcttccacggagtccttaagaacatcaaaaagttatgtc

SEQ ID NO: 81961 - DNA, 103 bp, Mus musculus
gtgatgacaatgatgatgatggtgatggtgatggtgatggtgatggtgatggtgatggtgatgatgatgatgatgatgatggtgatgatggtgaaagaattac

SEQ ID NO: 81962 - DNA, 113 bp, Mus musculus
tctatctctctgtatttctatatctatctatctgtctatgtatctatctattgaaagaaagaaagaaagaaagaaagaaagaaagaaagaaagaagaaagaaagaaagaaaga

SEQ ID NO: 81963 - DNA, 85 bp, Mus musculus; identical to SEQ ID NO: 57439

SEQ ID NO: 81964 - DNA, 96 bp, Mus musculus
gtgttagagttgaattggtcatggtggctaatatttacaatgtgattatatatttacattgtaaatattctactgaacatttccagtctatgttac

SEQ ID NO: 81965 - DNA, 75 bp, Mus musculus
gattccatatgacattgggaaagtttctttatatttcatcaaagatataaatggatatttttggtgtgatgaatc

SEQ ID NO: 81966 - DNA, 190 bp, Mus musculus
gtgaactcaacagcatatatatatgtatatatatacatatatatatgcatatatatatgtgtgtgtgtgtgtatatatatatacatatacgtgtgtatatatgtttgtatatatatatatatatatatgtgtgtgtgtgtgtgtgtatatataaaaagtatatatatatacacacatatatacttttatg

SEQ ID NO: 81967 - DNA, 103 bp, Mus musculus
ccctgtaattctttcagacaggaacaattatgggtcagagatgtgactgaggaatggcaacaccatccctcacttaatgtcttgctttccttctggaggtggg

SEQ ID NO: 81968 - DNA, 106 bp, Mus musculus
acctttgtccatgatgaactgataggatacatgggacaatttcaatatttttgtatatgttgaggcttgttttgtgaccaattatgtggtcaattttggagaaggt

SEQ ID NO: 81969 - DNA, 116 bp, Mus musculus
tcagccaattcaatgaagatgcccagattcatgtcagttatgtctggatacactctcacagacacagcccgtgtttcactaatctaggcaactcttaacatcattaaattgaatga

SEQ ID NO: 81970 - DNA, 130 bp, Mus musculus
tcatgtatatacttgtatttaacctctatgcatatatatatcatagtatagattcatatatatatatatgtgtgtgtgtacatatatatatgcatatatattgtatatgactttctgtttgtacctgtga

SEQ ID NO: 81971 - DNA, 102 bp, Mus musculus
gtatgcaaatatgtgtatatgtgtatatacatgcatctatacatatatatgtgtgtatgtacatgtttatatatatgtgtgtacatatacatatactgtgtg

SEQ ID NO: 81972 - DNA, 70 bp, Mus musculus
gagagagagagagagagagagagagagagagattcaaatctctctcactcactttctcattctctctgtc

SEQ ID NO: 81973 - DNA, 111 bp, Mus musculus
gtatgtattttatctctagctgcatacataaatgactgtttttcattttctttaatgaaatggcttcagttgttttataaatatgtcagtaaaaattaactaaataaatac

SEQ ID NO: 81974 - DNA, 112 bp, Mus musculus
ctagaaagcaaagaagtctaaagaaatgttccacagtgttcacaacttagtgtgcacaccactgagttgtgaagtcagataaatacctttccacacctcttttctgcactag

SEQ ID NO: 81975 - DNA, 67 bp, Mus musculus
ggcttgagacaggaggtctcagaaataataacaactcttttccctgtgtgcctctctctctcaaacc

SEQ ID NO: 81976 - DNA, 89 bp, Mus musculus
atgtatctgaactggcaagtttcccagtagcatgtcggaccttgataaattcactggaatgatgaatggagaccttgtgagggaggcat

SEQ ID NO: 81977 - DNA, 86 bp, Mus musculus
aggggacttggatgtatggacagagaaacagacattggaaagttgcattcaactctgtctatgtctctctctctttcaatgttttc

SEQ ID NO: 81978 - DNA, 94 bp, Mus musculus
aagttccaaagcaggacatccttgcttgatttgagtttcattatatttatatgatagcatcaaaaagcagcaaagccatgtgttttggaaactt

SEQ ID NO: 81979 - DNA, 72 bp, Mus musculus
ctgaaagtagtagaaacagagtggagataaatcacatacctaagtctctgtctctgtctctctgtctctcag

SEQ ID NO: 81980 - DNA, 97 bp, Mus musculus
cagactacgttataccagaaaatataagaggggcctctgaatatttacaaactcagtgtctgcttcttcatattttcaggtcaccatgacacctctg

SEQ ID NO: 81981 - DNA, 105 bp, Mus musculus
cagagaacagggtcactgatgatagccaaatgccaataagaagcatttccaatgtttagtagaaaggcagtatttgctcaatattaatgtaatctctgctctatg

SEQ ID NO: 81982 - DNA, 84 bp, Mus musculus
tctgccagggtgtctgtgtctgtctctaataaagagcttgacattgtctttatcgaaccgcacagaaagccttccatggggaga

SEQ ID NO: 81983 - DNA, 85 bp, Mus musculus
ggcgtagtttgaaaagactgattatcaagggttagatttatccttgttgatcttgtagctctctctctttctctgtcactgtgcc

SEQ ID NO: 81984 - DNA, 89 bp, Mus musculus
tctgcagctgccactgtctctgagtgaaataccttatcaggtgttctgctgtagtattttagccctgagacagaactgagagtagcaga

SEQ ID NO: 81985 - DNA, 117 bp, Mus musculus
gtttcagttgagggacagaaaatataatcttggcatatatcagtttcaagaatgaacatacagtgcagacaaaaggattggtgggcaagatgccagtctgtatttctaactgaatac

SEQ ID NO: 81986 - DNA, 78 bp, Mus musculus
atacatatacgtgtgtatgtgcatatttgtacatatagacatatatgtgcatatttgtatatatacatatatgtgtat

SEQ ID NO: 81987 - DNA, 90 bp, Mus musculus
gaactaatgacatcccccagatgggagtcccaagggatgatttttctgtcaaatccaggtctctcctctctgtgtgtctgtctttctgtc

SEQ ID NO: 81988 - DNA, 74 bp, Mus musculus
catacttgtatatatgcatatatatgtgtgtgtgtgtatatgtacatatatatgtatatatgtatacatgtctg

SEQ ID NO: 81989 - DNA, 87 bp, Mus musculus
caaatgcaaagcaaaactagcaaaataagcggtctctttcctcagtttatttttactttatgtgctggtgttttgcctgtgtgtatg

SEQ ID NO: 81990 - DNA, 96 bp, Mus musculus
gcaaaaacacgtccctgtttatccatgtcttgtgaggactctgaggctatacctgatgatcccatgttgtggaaagtggtccaggatggactttgt

SEQ ID NO: 81991 - DNA, 66 bp, Mus musculus
tgtctgtctgtgtgtctgtctgtcctttcagtgagtgtgggagggacagttagcttcagggaggca

SEQ ID NO: 81992 - DNA, 88 bp, Mus musculus
tgcattgtgatgggtgtccgcacgcccctgcgtgtgcgtgtgcatgtgtgcgtgcgtgcgtgcgtgcgtgcgtgcagccaagtgagca

SEQ ID NO: 81993 - DNA, 92 bp, Mus musculus
tctatctgttatatgtctgtctgtctgtctatgtacatatatgtgccatggcaaatgtgtgttggtcagagggcagcccactaacttataga

SEQ ID NO: 81994 - DNA, 101 bp, Mus musculus
gagagagagagagagagagagagaggatatgtatatgtaggttcacgtgcacacagaggttgaatgttgaaaagtatcttcctcaatcccttctccatctt

SEQ ID NO: 81995 - DNA, 92 bp, Mus musculus
catttattcagcttacacttccacattgctgttcatcactgaaggaagtcaggacaggcactcaaacagggcaggaagctggagcaaggatg

SEQ ID NO: 81996 - DNA, 85 bp, Mus musculus
ggccatggtggtctgataggatgcatgggacaatttcaatatttttgtatctgtcgagacctgttttgtgaccaattatatggtc

SEQ ID NO: 81997 - DNA, 99 bp, Mus musculus
tgggcaggtgatttgccattgagccctaacccctagtcctttcatgatgatgatgatgatgatgatgggttgattttaagacagcatcttatctgctca

SEQ ID NO: 81998 - DNA, 115 bp, Mus musculus
gcaccatatggatctgggagatggctaggcaacccttacatgctagacacagaacacagtgagttctcttagttttcctggaggatacctggtctggctgtctgatctcatttgc

SEQ ID NO: 81999 - DNA, 75 bp, Mus musculus
gatcatctacacacacacatatatatgtatatatatatatgtatatatgtatgtataccacacctagacaagatc

SEQ ID NO: 82000 - DNA, 77 bp, Mus musculus
tatgtataaatgttttgcctgtatgtatgtctgtgtatgtctgtgtatggcatgctcatgtgggatgtgtgtgtgtg

SEQ ID NO: 82001 - DNA, 71 bp, Mus musculus
gtgtgtgtgtgtgtgtgtgtgtgtgtgtgtgtgtgtttctatgtgtgtgcatatgcacacgcaatatctat

SEQ ID NO: 82002 - DNA, 77 bp, Mus musculus
tggcagctcgggagcctgcagtcctctcagcacagggcatccacagctgacagactgtctctgtctcctcatcccca

SEQ ID NO: 82003 - DNA, 94 bp, Mus musculus
cttcccgggccaggtactcacacttggcacagaaagagtaggttgaaagatggagaacagtgaacattctgtgcttacctgggcacccgcagag

SEQ ID NO: 82004 - DNA, 125 bp, Mus musculus
gaagtgtgcacacattctcagacagtggagggagagactcctggatcatgtagtcacagaacactgagacctgtccttcttcccagtgtctgtcctgccttaccttcctcattccttcttcagag

SEQ ID NO: 82005 - DNA, 74 bp, Mus musculus
ggctgcgacagtctcacagtctcgggtttcagtgagtgggagacaagatagtgtggacctggaaggaagcagct

SEQ ID NO: 82006 - DNA, 72 bp, Mus musculus
atgtgagtgataagtgtgcatatgtagtgtgtatgtatatgtggtatgtgtgtgtgtcagtgtctcttgtat

SEQ ID NO: 82007 - DNA, 70 bp, Mus musculus
cagagtctcactgtgtagctctgtccttgaactcacaatgtaggccaggctacattcagagatcactctg

SEQ ID NO: 82008 - DNA, 74 bp, Mus musculus
ggcatggcaaccactagattgctgagtgagagcgtacaatttgagctacacacagtaaacagtgagcagaggtc

SEQ ID NO: 82009 - DNA, 66 bp, Mus musculus
tccactctctgactctcatagttgggtgtctctaccaacaagctgtgtctcttggagatagttgga

SEQ ID NO: 82010 - DNA, 119 bp, Mus musculus
gtgactttaagagtggccctagtcaggctggaaagatggcttagtggttaagagcactgactgctcttccagaggtcctgagttcaattcccagcaactacaaggtggcttacaaccac

SEQ ID NO: 82011 - DNA, 93 bp, Mus musculus
atgtgtctctgcaaatatgtgaatatatatacatatacacacatatatggctgtctgtgtctgtatgtgtatgtgcatcttgctttgattcat

SEQ ID NO: 82012 - DNA, 82 bp, Mus musculus
ccattcttaaatctgatgcatacactttgcaggtcaccaagcctctctgtgactctgtgtgtatgatgatgaataacgttgg

SEQ ID NO: 82013 - DNA, 73 bp, Mus musculus
cgggcactgacttaatgtgatttgattatcatgttgttactcaaagatggtcacagacattggttagtgcctg

SEQ ID NO: 82014 - DNA, 73 bp, Mus musculus
tcatcctgagtgaggtaatccagtcacaaaagaacacacatggtgttcactcactgattcactcactgaatgg

SEQ ID NO: 82015 - DNA, 95 bp, Mus musculus
acttcatgggaaaaacaatggagcaagaagtgacgtcgggcaactctgacctgtagagctttctttctgtctcactgttttttgacatgcgtggt

SEQ ID NO: 82016 - DNA, 112 bp, Mus musculus
cagctgaactggggcttggttgctaatacgagaggcctgatattttttttttcaaactgagcccagctgtcattagttttgtagagaaaggtctcctgagttctggtagctg

SEQ ID NO: 82017 - DNA, 116 bp, Mus musculus
accttctcatggtgggtcttttagttctttgatccattttgtaagtattttgttgagaatgtttatatgtatgttgttaggggaaactgttctgtaattctctctatttgttgggt

SEQ ID NO: 82018 - DNA, 82 bp, Mus musculus
gtgtgtgtgactgtgtatatgtctctgtgtgtggctgtgtgtacatctgtgtatgtgagactgtgtgtatgtctgtgtgtgt

SEQ ID NO: 82019 - DNA, 96 bp, Mus musculus
ggtatggtatgtgtatgtatgtatgtatgtatgtatgtatgtatggatcaatatacatgtgtgtgcatgtgtacagggagattcacgtctggtatc

SEQ ID NO: 82020 - DNA, 102 bp, Mus musculus
gctgggctatgacagatgactgactagctgtgtgatggagaggaggacttccttccaccgggctcactctgtttctcactggctgttttggcatagcccagc

SEQ ID NO: 82021 - DNA, 100 bp, Mus musculus
ccctttagaaatgaaagcatgtctggagagatggctcagtgcttaagagcactgactgctcttccagaggtcctgagttcaattcctagcaaccacaggg

SEQ ID NO: 82022 - DNA, 74 bp, Mus musculus
gggatacaggaaaaaccagctcatttgcaaagcaaaatgcacattttgtagttgtctgggctgggatagggacc

SEQ ID NO: 82023 - DNA, 93 bp, Mus musculus
gtgacactcagagtgtcacttcagactagagggagcagtgacactctgagtgtcacttcagactagagggagcagtgacactcagagtgtcac

SEQ ID NO: 82024 - DNA, 85 bp, Mus musculus
agcaggtgaggtgtgtcactgagtctcttacttgcataactgctccggttgtagctagaagacgtcactcagtatcttgtgtgct

SEQ ID NO: 82025 - DNA, 128 bp, Mus musculus
cataaaagccggatctgggatctcactgcaagaattcagggctctgtgagtttatattttgttttcatatcaaccactgaacccttttgtaacctcctcttttgaatgtttgtgtgttccaatgtgtg

SEQ ID NO: 82026 - DNA, 117 bp, Mus musculus
gtgggtgtgcatgtatgtgtgtgcatgcacatgtgtctgtgtgtgcatgtgcatgtgtgtatgcatgcgtttgtgcatgtgtatgataacatgtgtgtgtgcatgtatgtatgcata

SEQ ID NO: 82027 - DNA, 74 bp, Mus musculus
tccaatgctaacatggttaggaattgttccacaaaggctgcaagcttggtcctcagttcactgtgtgatttgga

SEQ ID NO: 82028 - DNA, 98 bp, Mus musculus
agcttattgctgggactggagagatggctcagcggttaagagcactgactgctcttccagaggtcctgagttcaattcccagaaaccacatggtggct

SEQ ID NO: 82029 - DNA, 80 bp, Mus musculus
ccccactctttgtcgtctcagttcggagagtacagctgcacactgcagttgctgtctgaatttttatgtgtgttctgggg

SEQ ID NO: 82030 - DNA, 68 bp, Mus musculus
gcttcacccaagtcaggcaaggcatgaactgtagcctgcctgcctgcctgcctctgtggttcatgagc

SEQ ID NO: 82031 - DNA, 77 bp, Mus musculus
gcgatctggtgggttgaacatgggtgtccagagggcgggggtttcccagcatgggcctcactctatctcactgcgtg

SEQ ID NO: 82032 - DNA, 71 bp, Mus musculus
gtggactaaagggtgtactgtgggacactctgtgacacaccacagcttccatgataacattttttgtttgc

SEQ ID NO: 82033 - DNA, 97 bp, Mus musculus
agccttttccagcctgtccctgctgtagatagagggtgtgaggacacagtgtacagccaccatgctctgtctatagcctatcactacagaagagtct

SEQ ID NO: 82034 - DNA, 94 bp, Mus musculus
aaagtgaagtttgggttttctgagcaggacagaattgtgtgaggaatgccacccagctgtctgtctctgaggcagatgagaactgtgcttttct

SEQ ID NO: 82035 - DNA, 82 bp, Mus musculus
gaggctgattataacgtggggcatttttgtgggtcacacactggccctggagaaggttgttttgttatgagtggactcggcc

SEQ ID NO: 82036 - DNA, 135 bp, Mus musculus
tatatgcctgtgtatgtgtgcctgtgtgtacctgtgtgtgtatgtgtgcctgtgtgcatgtgtgcctgtgtgtgtgcctacccgtgtatgcctttgtgtgtatgtgcctaggtgtgtgtatgtgtgcttgtgtgt

SEQ ID NO: 82037 - DNA, 92 bp, Mus musculus
atccatgtcaatgttggcctgtatgtatgtatgcatgtatgtgcattacatgcacgccttgtgtactcagagaccaggagaagacatcagat

SEQ ID NO: 82038 - DNA, 110 bp, Mus musculus
catgaaattaatttgtgttccatatacactatctatctgtctgtttgtctgtctgtcctgaggcttatacaacattttttcacagccatgtttggaacacactatttgtg

SEQ ID NO: 82039 - DNA, 100 bp, Mus musculus
ccatgtaaagagctgtgtttggctgcctctgtgcctgtgactccagcgcttggcagacggaggcaggaagtgcaggttcagtggcagaccctgttacagt

SEQ ID NO: 82040 - DNA, 118 bp, Mus musculus
gccacagaggccaggccctcaggactctgggtctaatgattcctaactctctcccactctttcaggacacttcatccctctggttgccggtcagtctgtctcctcataatttttgggc

SEQ ID NO: 82041 - DNA, 121 bp, Mus musculus
tgatcataagaaaaaccttaccatagataagattgaaagaaaatttagatctctgtgaaaataatttattttacattgttaaaagtaaatacaatagtgtctgggtttggtggctgattat

SEQ ID NO: 82042 - DNA, 66 bp, Mus musculus
ttgtggtcctctgcagcacttgtgtggtctgtgcattgcacatagtactgacagaggagagaacaa

SEQ ID NO: 82043 - DNA, 71 bp, Mus musculus
tatctctgagacagagatttgccctgaccccaggctggccttcaactcacaatcccactgtctcagacatg

SEQ ID NO: 82044 - DNA, 56 bp, Mus musculus
tcaaactcactgtgtgtgtgtgtgtgtgtatatatatacacacacagtgactttga

SEQ ID NO: 82045 - DNA, 71 bp, Mus musculus
catatgcttagataagtatgtatgtatgtgtgtaagtatgtatgtatgtgtgtgacgtatgtatgtatgtg

SEQ ID NO: 82046 - DNA, 71 bp, Mus musculus
tctgtctgtctgtctgtgtccaaggatagaaggtgagctcctgagatcctagggggcagaagggtgatggg

SEQ ID NO: 82047 - DNA, 85 bp, Mus musculus; identical to SEQ ID NO: 57470

SEQ ID NO: 82048 - DNA, 68 bp, Mus musculus
agagagagagagagagagagagagagagagaaatgtgcctgtctgtctgtctgtctgtctgtctgtct

SEQ ID NO: 82049 - DNA, 72 bp, Mus musculus
acatatacatcacacagacacacaatttttaagatttatttttaattgtgtgtgtctgcatctgctatttgt

SEQ ID NO: 82050 - DNA, 69 bp, Mus musculus
tgtgatgaagtactagtcttgctctgatatttattagattctatttgtagatctagtttcttgatcaca

SEQ ID NO: 82051 - DNA, 56 bp, Mus musculus
gtatatgtatgtgtatatgtatgtatatatatgcatacatatgaatatatatatac

SEQ ID NO: 82052 - DNA, 78 bp, Mus musculus
gctcttaatccagactctcagtgtctgtggccacggccgggccctgtgctgtgggactgacttgctgtggttgagagt

SEQ ID NO: 82053 - DNA, 101 bp, Mus musculus
atctttccctattagaacctagcagcagatctgttggtgtccagtgtctctcaatgtctgaatcttgccacacaaatctgtacaatctcatgggaaaagat

SEQ ID NO: 82054 - DNA, 68 bp, Mus musculus
gtctgtctgttactctctgtgtagtggtgcatttataggcaccagcccgtcagaggcatgattcgggc

SEQ ID NO: 82055 - DNA, 86 bp, Mus musculus
ggccatggtggtctgataggatacactgggacaatttcaatatttttgtatctgttgaggcctattttgtgaccaattttatggtc

SEQ ID NO: 82056 - DNA, 146 bp, Mus musculus
gtgtatgtatatgcagctatgtgtatgtgtttatgtatatgtgtatatgtgaatatatatgtatgtgtgtatgtatatatgtgtatatatgtgtaggtctataagtgcatttatgtctatgtacatatgtgtatatgtgtatgtat

SEQ ID NO: 82057 - DNA, 107 bp, Mus musculus
atgtgtatgtaagtgtgtagatgtgtatatgtgtacatatatgtgcatatttatatatgtatgtatacatgtgtatgtatatatgtatgtgtgtacgtatatgtata

SEQ ID NO: 82058 - DNA, 100 bp, Mus musculus
aggtctgtattgtagatatcacatagggtgagcactccgtggtcagtcattctctgtgattgaccttgttatttccttcattggatccattgtcatttct

SEQ ID NO: 82059 - DNA, 73 bp, Mus musculus
tagatcctgatgggttgatgagagctgtatgcatgcgtgcgtgcatgtgtctgtctgtctatctggttgtctg

SEQ ID NO: 82060 - DNA, 85 bp, Mus musculus
ctcgggatgctgtaaagtgagactcactgaggctctgcaggtaaataactctaaagctgtaggaagtccctgaaagcggcctgag

SEQ ID NO: 82061 - DNA, 84 bp, Mus musculus
acatatgtatatatacacatacacacactcataatattgagtccagctagtgttacatgtatgtatgtatgtatgtatgtatgt

SEQ ID NO: 82062 - DNA, 111 bp, Mus musculus
cataagcacactcatgtgtgcatgtgtgtgcatgtgtgtgtgtgtgcatgtgcatgtgtgcatgtgcgtgtgtgtgcgtgcgcatgcacgtgtgtgtgtgtgtgtgtgtgt

SEQ ID NO: 82063 - DNA, 82 bp, Mus musculus
tcataaggtatatacagagatcctagctcagacccatacagggtatgtgtttgtctcttcagtctctgtgagctccatatga

SEQ ID NO: 82064 - DNA, 110 bp, Mus musculus
gcctgtggcagccaggacatccattgtaagactcagtataggcatctggggctcagactctagctgtctgtgactgtgtatgtgcaatgaagctgaggttaaatgaaggc

SEQ ID NO: 82065 - DNA, 110 bp, Mus musculus
ccaggttattgttcaattttacaaatttatttacgtttagagaattgtggggattgatgactgttgaccactatctagctatatttgtgtaaggctggtacagtgcctgg

SEQ ID NO: 82066 - DNA, 115 bp, Mus musculus
gctactactttactgctgcatagggtgtttctggtaatgatttgtttcgtcatatagtttatgatttttaacaaatttcttctaaaatcctttctgttttgtggatgaattttgc

SEQ ID NO: 82067 - DNA, 70 bp, Mus musculus
gcagttgggtcttcatgtgggtcttctaacaattggaatgggggctggctgtctcagactcagactctgt

SEQ ID NO: 82068 - DNA, 120 bp, Mus musculus
gatgtttaagactttatgttcagggagctggagagatggctcagcagttaagagcactgactgctcttccagaggtcctgagttcaattcgcagcaaccacatagtgactcccaaccatc

SEQ ID NO: 82069 - DNA, 85 bp, Mus musculus; identical to SEQ ID NO: 57439

SEQ ID NO: 82070 - DNA, 117 bp, Mus musculus
gaaaagagagtatggactgtggaatagtgagcagccagatgtgctaaggagagttgacacactttcagaatgtccatttcaatgcttgagcattttttactccatgtgaatgttttt

SEQ ID NO: 82071 - DNA, 101 bp, Mus musculus
ccagattatagtggctggcctttagttgttggtagtatagttaaacaaggtttatttgccaatagaagtaagacaaaaggttatcgttcacaaaagtttgg

SEQ ID NO: 82072 - DNA, 70 bp, Mus musculus
gaggtctgggttagttgagactgctggtcttcctatgaggtcactctctctcacagcttcttcagtcctt

SEQ ID NO: 82073 - DNA, 93 bp, Mus musculus
agcactattataactgaaagaatgctcatgagtccctgacagacagtgtctgggtgatgtgatggtggcattcgagatggggatgaagatgct

SEQ ID NO: 82074 - DNA, 113 bp, Mus musculus
tgatgatggtgatgatttggcatgtgtgatgatgatggtgatggtttggcatgtgtgatgatgatgatgatgatggtgatggtttggcatgtgtgtgatggtgatgatgatgg

SEQ ID NO: 82075 - DNA, 116 bp, Mus musculus
tggcatgtgtgatgatgatggtgatggtttggcatgtgtgatgatgatgatgatgatgatgatggtgatggtttggcatgtgtatcgtgtattttgtgtggtttacatatttgtta

SEQ ID NO: 82076 - DNA, 91 bp, Mus musculus
tctttgatttggactacagacacacacacacacttccgtgactagaagtattttctgtgtaagtgtgagagactgagtttgaatcctcaga

SEQ ID NO: 82077 - DNA, 73 bp, Mus musculus
gtgcactcactggctatgtgctctcactaactatgtgcactcactggctatgtgtctcactggctatgtgcac

SEQ ID NO: 82078 - DNA, 90 bp, Mus musculus
atgtatctctctctctgtatatatatatatatcctgtgagcatatgtactgacatgtatgtatgtgggggtgggtggggtgggagtatat

SEQ ID NO: 82079 - DNA, 105 bp, Mus musculus
gtgcatgtgtttgcttacattatgtgtgtgtacatgtgtgtgtatttgcttctttatattgtgtgtgtgcatgtgcatatgtatgtgtttgcttacattgtgtgt

SEQ ID NO: 82080 - DNA, 99 bp, Mus musculus
gaagaacaagctctccagccttaactcttggagtcttggaattttttttttctatgaaacaaaatagttataagtagaatatgggtttgagtgttcctc

SEQ ID NO: 82081 - DNA, 96 bp, Mus musculus
tgtatttcatgcaattttgcttccagtgagaagagactttgcatagaacagtgacacaaaaagcatcggttccttggggcgttagtgttaagtaca

SEQ ID NO: 82082 - DNA, 102 bp, Mus musculus
ttatagtttttataataaaactcccatgactggctcacgtcaaccaacatgtgttgaatgttgattgggtgttaggtgagcactaagatgtggaggctataa

SEQ ID NO: 82083 - DNA, 63 bp, Mus musculus
tatgtgtgtatgtatgtgtggtgtgtggcatatgtcatatatatacatatatgtatatgtatg

SEQ ID NO: 82084 - DNA, 73 bp, Mus musculus
tctgagaatgagtgtgtgacactgtgtgtgtatgcctgtatgtgtatgcgttcacatacatttggaggtcaga

SEQ ID NO: 82085 - DNA, 116 bp, Mus musculus
cactggaagtctttcttaatggctattcactgtgtatgctgacatggggtctctctctctcacttgaagccagggctaaccagttcagcagtctagctagccagcttcttccaagg

SEQ ID NO: 82086 - DNA, 87 bp, Mus musculus
attatgaactatatacactatgcagtagatactgtgcacttggtgctaataaagttgaatgcagtgggaacctatatagtacataat

SEQ ID NO: 82087 - DNA, 70 bp, Mus musculus
catctccatgttaggatgtctactgatattgtcattcctcaggcttgtcggaggcagtcgtttgtaggtg

SEQ ID NO: 82088 - DNA, 115 bp, Mus musculus
gttatgagatgggtgtggagggggacccctgggaagagtgggagccagctgttgccatcacagctcactctctctgattctccagagggctctggctctcggctcagatcttagc

SEQ ID NO: 82089 - DNA, 115 bp, Mus musculus
taatcggttaaattctggaggtatcaggtggctgaggcaggcagatctctgtgagctcaagggcagcttggcatatgtaatgagttttgggattatgttcagagaccctgtttca

SEQ ID NO: 82090 - DNA, 107 bp, Mus musculus
tccttcattacaagaaagccttggccagaactgggacaggatccttactcaaatacagtagtaagtatgcagacaccatctaaatggcataaggaggatggtaggga

SEQ ID NO: 82091 - DNA, 112 bp, Mus musculus
agaaaaattggttcaaaaagtcacgttctgggctggagagatggctcagtggttaagagcactgactgctcttcctgaggtcctgaggtccttggatatgattcccttttct

SEQ ID NO: 82092 - DNA, 110 bp, Mus musculus
atttctgaggattcaaagtaaatttataattatacagaatgctgagcaagaaaatgatgctttattttattgtaaattttggatatttttaaagtgttttcttctgagat

SEQ ID NO: 82093 - DNA, 113 bp, Mus musculus
gtaagcttagtctgtacttggttttttctggtaatagttggtttgattctatatttattgatggctcagactctacatttcctccagaaaaatctcatattgtctttgtttac

SEQ ID NO: 82094 - DNA, 96 bp, Mus musculus
gtatgtatgtatgtatgtatgtatatgtatacatatatatatatgtatgctatgttttatatattatatatatacatcacatatatacatacatac

SEQ ID NO: 82095 - DNA, 102 bp, Mus musculus
gcactatgtatgtatgtatatatgtgatgtatatatataatatataaaacatagcatacatatatatatatgtatacatatacatacatacatacatacata

SEQ ID NO: 82096 - DNA, 77 bp, Mus musculus
atataggtcaccagtacaggcctggacaggaggtgtgtttatatatttactttctgtgcctgtgcatgtgcatgtgt

SEQ ID NO: 82097 - DNA, 72 bp, Mus musculus
gggaaagaaaggctcacagtggcaggacaggacctttgccggggcacaaccactcactgtgtctctcctcct

SEQ ID NO: 82098 - DNA, 79 bp, Mus musculus
gtgtgactgcctcactgtgacccaggtaggtctagatatcatgaccttccggttgtctcctcagtggaacacagcagac

SEQ ID NO: 82099 - DNA, 96 bp, Mus musculus
tcccagaactgtttagctataagactgtctctctgtgtcctgagttctaggattataaagccatcttcgttcttttctctttaaacagtgctgggg

SEQ ID NO: 82100 - DNA, 117 bp, Mus musculus
catctccgagtaggactggtgacaagcggtgaagtcgaagaggcggaacgggtaaccgacccactctgtctctgacgtcaggctagaactgctgatcacattcacaattcggtcatg

SEQ ID NO: 82101 - DNA, 66 bp, Mus musculus
atgtgtatttgaatatatatgtacttacatatatgaatatgtatgtatacatgtgtgaatacatgt

SEQ ID NO: 82102 - DNA, 96 bp, Mus musculus
cacaggaggcaggaaaagaaaatgacactgggcctggcttagacttttgaaacctcaaaacccactctcagtgacacactccctcctccctcagtg

SEQ ID NO: 82103 - DNA, 73 bp, Mus musculus
acacatatatatatatatatatatatatacacaaacaaacatacatacatgtatatgtgtatgtatatgtgta

SEQ ID NO: 82104 - DNA, 94 bp, Mus musculus
tacgaaacagtgtgtgcatatgcatgtgtatatgggtgtctgtgtgtgtgtgtgtgtacgtgtgtgtgtgtgtgtgtgtgtgtgtcttgctctg

SEQ ID NO: 82105 - DNA, 90 bp, Mus musculus
acatggtatgtatgtatgcatgtatgtatgtatgtatgcatgtatgtatgcatgtgtatgtatgcatgtatgtatgtatgtatgtatgta

SEQ ID NO: 82106 - DNA, 80 bp, Mus musculus
caatgctggatatgatatgatttttatgaaatgtatgtagtgatacatgtgtatatatatctatatcaataactggcttg

SEQ ID NO: 82107 - DNA, 115 bp, Mus musculus
gttggtcctaccgtgcagagcgcagtgttagttttgaagaatcaactggtcccggagaatggtgagagaagattgagtcaggaagcccacagactgcatgcagtggtcacataac

SEQ ID NO: 82108 - DNA, 99 bp, Mus musculus
tctcagtgaagcagaacctactgtgtgttgctgtcctctctctctcagtgagacagaacctactgtatgttgctgtcctctctctctcagtgagacaga

SEQ ID NO: 82109 - DNA, 66 bp, Mus musculus
ttggataatttaagaagggcacttcagtccactggcactgtctgtgtcttacttagaagtgtgtaa

SEQ ID NO: 82110 - DNA, 99 bp, Mus musculus
gaatgctttcagatgtttccataagtctgttggatggaggagataaaatacactctgtagtttgtatttcattatttatggtggtacttgaaagcattt

SEQ ID NO: 82111 - DNA, 105 bp, Mus musculus
agttgatggcttctgtaggctgtttcacaagagattttgctaatgccagtggcatctggctgtggtagatttcagagtcatagtgagactgacagttcatcatct

SEQ ID NO: 82112 - DNA, 74 bp, Mus musculus
aaagggggacactgtgactcactgtgccacactgtgacagaccacagcttcatggtgagattttgttgttgttt

SEQ ID NO: 82113 - DNA, 119 bp, Mus musculus
caggaggccaggctgcctgctcagggagtctctagagctgccctcagaagaaagtaccaaagtctttttctctctcctagaggttactccttcctgggaatctaaggtggtttcttggt

SEQ ID NO: 82114 - DNA, 110 bp, Mus musculus
gctgtgtttttccagattctactagatcaggagacatatttttattttaagttcctatgacttttagaacatttaatgttgtttttttctacacagaatcttgaaactgc

SEQ ID NO: 82115 - DNA, 92 bp, Mus musculus
gagtgtcgctcggcctggaaggtgtttctagaggagacagaagacactctgcttttactctttgaagaaactgccaagcttttgtaaaactc

SEQ ID NO: 82116 - DNA, 168 bp, Mus musculus
tgtatgtgtatatatatacacacaatcatatatccttttctgataaataaatatatatatatttatatttatttatcagaaaggatatatgattgtgtgtatatatgtatgtgtatatatatcagacagagagaatatatcaggcgggtggggtaggtggggtagtat

SEQ ID NO: 82117 - DNA, 73 bp, Mus musculus
tatatatatatacacgcatatatgtatgtatatatgatatatgtgtatgtatatatgtgtgtatatatgtgtg

SEQ ID NO: 82118 - DNA, 92 bp, Mus musculus
tggtcattaaaaaaagaagtcacagactggagagatggctcagaaattaagagcactgactgctcttccagaggtcttgagttcaatgccca

SEQ ID NO: 82119 - DNA, 84 bp, Mus musculus
tccttgtggttagattctttgggaagactcacctaggagatggggtatcaatgagtggttttcttcagatgattagctcaggga

SEQ ID NO: 82120 - DNA, 69 bp, Mus musculus
tggtgatctgataggatgcatgggattctttcaatatttttgtatctgttgagtcctgttttgtgacca

SEQ ID NO: 82121 - DNA, 113 bp, Mus musculus
ccttcccagcaaccattatctgcctataaattcttaaagagaggtgggaccaggtaagactctccgtctcactcacttcatgggggcattttgatggactcagtttgtgtagg

SEQ ID NO: 82122 - DNA, 83 bp, Mus musculus
actttgttttctgttttgtgacaaggtctcaatacatagcccagggtagccaggaatttgtgagacaacagagtggccagagt

SEQ ID NO: 82123 - DNA, 103 bp, Mus musculus
taagactcacaaaatgggctggagagatggctcagcagttaagagcactgactgctcttccagaggtcctgaattcaattctcagcaaccacagggtggctta

SEQ ID NO: 82124 - DNA, 69 bp, Mus musculus
ttcactaattgttaatgtgtacacgcatgtatgtgtaagtgtgtgtgtgcgctcgagtgcatgtgtgag

SEQ ID NO: 82125 - DNA, 60 bp, Mus musculus
gcaagcacttgtgtgcatgcatgagccccagtctctgtgtgtgtatgtgtgagtgcttgt

SEQ ID NO: 82126 - DNA, 79 bp, Mus musculus
gtgtatgtaaacaacatacatatgtatatacatagcacatatactatatatatatatgtatatgtatatatacatacac

SEQ ID NO: 82127 - DNA, 85 bp, Mus musculus
gtagatgtgtatgtatatatacatatacatatatatatatagtatatgtgctatgtatatacatatgtatgttgtttacatacac

SEQ ID NO: 82128 - DNA, 80 bp, Mus musculus
tatatgtatgtatgtgtgtgtgtgcatgtgcatatatgtatacatgtgtgtgcatgtatgtatgcacatacatatatgtg

SEQ ID NO: 82129 - DNA, 73 bp, Mus musculus
ccaagggtgagagagcagagagtccagatggttcaaaagcaaatagtggttcagggttctgcttgttacctgg

SEQ ID NO: 82130 - DNA, 114 bp, Mus musculus
ttgtattaagccacactccttggtggctggagagatggctcagcggttaagagcactgactgctctttcaaaggtcctgagttcaaatttcagcaaccacatggtggctcacaa

SEQ ID NO: 82131 - DNA, 87 bp, Mus musculus
gggcttggtcttcatgcaggttcccagcaaatagagtggggtcagtccctaaatctgttgcctgcctgcctgcctgcctgcctgcct

SEQ ID NO: 82132 - DNA, 108 bp, Mus musculus
gttcctttttttccatgttttcatacattgtattattgtatttcattatgctttgtctctgcttgatggagatcacagttttttaatgggcatggatgttttctctgc

SEQ ID NO: 82133 - DNA, 79 bp, Mus musculus
acttctgttagtttcactgtgtctgtgtttagtttctgtttccaggatctgtccattgatgagggtggggtgttgaagt

SEQ ID NO: 82134 - DNA, 67 bp, Mus musculus
ggatgaaatctcagagccctaacagtcttttaaatattttttaaaaggcttctgaggatgtacattc

SEQ ID NO: 82135 - DNA, 85 bp, Mus musculus; identical to SEQ ID NO: 58722

SEQ ID NO: 82136 - DNA, 84 bp, Mus musculus
gtgtgtgtgtgtttggtgtttgtggtatacatatgtatctttgtgtctgcatgtgtctgtgaatctctgtgaacatacatgtat

SEQ ID NO: 82137 - DNA, 94 bp, Mus musculus
tgtgcttgcacatgtatgtgcatgtgtgcatgtgtatgtggtgcctgcatgtgcatgtgcttgtggacatatgcatgcgtgcatgtggaggtca

SEQ ID NO: 82138 - DNA, 85 bp, Mus musculus
tgagctgcatgtacataattaataagtgtgaatgtttgcatttgtgtgtgagagggtgtatgtatgtatgtatgtgtggatctca

SEQ ID NO: 82139 - DNA, 123 bp, Mus musculus
ggtctaaaagcagagtctgcagcaagcatttaggataagtgcttagtagagactgagcagagggagcggatgggagaacgtgggacttgatatgactttggtgggagcccagccccatctgcc

SEQ ID NO: 82140 - DNA, 84 bp, Mus musculus
cacatcaagaataacgccatgaagctctgtgtgtgtgtgtgttccatccatgcataaatgggtatacatgtatgtgtctgtgtg

SEQ ID NO: 82141 - DNA, 103 bp, Mus musculus
gcatctgtgagcccagaatgatcgccatacaagatgtcactttgtttatctgaagactcttagggagcaaggtggatctctgaggtgtcatatgtcacagagc

SEQ ID NO: 82142 - DNA, 116 bp, Mus musculus
gtcgtgtcttaagcataagctcttgggctggagagatggctcagcggttaagagcactgactgctcttccagaggtcctgagttcaactcccagcaaccacatggtggctcacaac

SEQ ID NO: 82143 - DNA, 117 bp, Mus musculus
tatatacacacacatatgtatacacacacatatatatacatatatacatatatatatatataaacatatatgtatatagagtatatagtggatgtagtatgtatagtgtatatggtg

SEQ ID NO: 82144 - DNA, 101 bp, Mus musculus
gtatgatgtatgtgtgatatgtatgcaaatgtatatgtatgaaggtgtgtgcattgatgtgtgcatgtgggtgtgaggtgcatgttccagggtacacatac

SEQ ID NO: 82145 - DNA, 91 bp, Mus musculus
gtatgtgtgtgttattcatgtaaatatgtatgtatgaaggtgtgtgtctatgcgtatgatgtgtatgttgtgcatgtaaatgtatatgtat

SEQ ID NO: 82146 - DNA, 101 bp, Mus musculus
tccactggtgtcatacaacttaacatacagagttgatatgtttctaatttttttatgcacttaatttattcattttgtatgtgtgctcacaccgtcatgga

SEQ ID NO: 82147 - DNA, 62 bp, Mus musculus
ggagagatgactcacaggttaagagcactgtctgctcttccagaggacctgagttcaatccc

SEQ ID NO: 82148 - DNA, 87 bp, Mus musculus
cgtgtggagtgtgtgtctgtgtgtctgtatgtcctggtgtggcactgtgaatgcaggtgctccatgaatccatatgagggtgtcagg

SEQ ID NO: 82149 - DNA, 115 bp, Mus musculus
acatttgggaggatagtgtagttgggaatgtgtgtatgtcatatatacattggatctctgtgtgtgtctcagtcacacatttaacactttcagagtgcaaccttctcctttctgt

SEQ ID NO: 82150 - DNA, 86 bp, Mus musculus
gctgttctggctcagaattctttcccaagctgactgattcaatctggcttctctctcagtttgtgactgaactgctctgcctggcc

SEQ ID NO: 82151 - DNA, 72 bp, Mus musculus
gcatatgtatgtgtgtatctgtatatgtatatatgtatgtgtatatgagtgtaggtatatatgtatgtgtgt

SEQ ID NO: 82152 - DNA, 71 bp, Mus musculus
ccaaatcactctgtgcctgtcagtgtggagaaaggttgcgtttcaccctgagaaagggacaggcagcatgg

SEQ ID NO: 82153 - DNA, 99 bp, Mus musculus
cccaaacaagatggatagagcaacagcagagagagaggtctgttggttgcatagtgcttttagattctcctagggcttaggctcttcatagtgtaaggg

SEQ ID NO: 82154 - DNA, 69 bp, Mus musculus
ggctcctacatggaggctggctatgctctctgtccctcacattctcaggcatggcagatctcctatgcc

SEQ ID NO: 82155 - DNA, 89 bp, Mus musculus
cacctcctcctcattcttcctgtattatttggattcctaaaattgtgtatttttttgtttaatgtactttgagagtcgggggacatgtg

SEQ ID NO: 82156 - DNA, 117 bp, Mus musculus
ggggggtggatttaggaggggtaaagacattggttttatgttgcaaatcaaatgatttaaatcataatctgcaaagtctatttcaaacttatgcttacctcggaaaattaaatctct

SEQ ID NO: 82157 - DNA, 104 bp, Mus musculus
caatatatatattgtatatgcagatataggtgtcatatatgtatatatatgtgtatgtgtatatgtatatatatccaaattttcaagtgtgcagtgcattattg

SEQ ID NO: 82158 - DNA, 85 bp, Mus musculus; identical to SEQ ID NO: 57439

SEQ ID NO: 82159 - DNA, 81 bp, Mus musculus
ctgtagtagtcagggttctctagagtcacagaacttaaggttagtctctatatagtaagagaatttgttgatgacttacag

SEQ ID NO: 82160 - DNA, 81 bp, Mus musculus
aggctcccctgaggaaggagcttgataagacatctaaaagtttgctatcatcttttctccagttttcccccagagggacct

SEQ ID NO: 82161 - DNA, 101 bp, Mus musculus
tgattgtttgtttttgtttttgtttttttgagacagggtttctctgtgtagccttggctgtgctagaactcactctgtagactaggctgacctcgaactca

SEQ ID NO: 82162 - DNA, 85 bp, Mus musculus; identical to SEQ ID NO: 57470

SEQ ID NO: 82163 - DNA, 80 bp, Mus musculus
gttgttgtctttatatcctatcagtttgttgatgtgcttactccagagacagagacagagacagagacagagacagagac

SEQ ID NO: 82164 - DNA, 99 bp, Mus musculus
atagtgatagccagaggcctcataccaggctgaatcattgcaataagcatttgtgagcaaagaagtgtggacgaaggggaatactgtggattatactgt

SEQ ID NO: 82165 - DNA, 85 bp, Mus musculus; identical to SEQ ID NO: 57439

SEQ ID NO: 82166 - DNA, 70 bp, Mus musculus
gtaatttgatcttcacataagatcagacctagaccttgtctgtctgtgactgtgtgttatattaaattac

SEQ ID NO: 82167 - DNA, 108 bp, Mus musculus
tatctacatgtttgtatatggacctcctcaatgtggcagttatagttgtgtgtctctctccttcacagcctttgtaagaagaggaggtaatatttactaataatgata

SEQ ID NO: 82168 - DNA, 59 bp, Mus musculus
atgtacatgtacatgtacatgtacatgtatatgatgtatatgtatatgtatatgtatat

SEQ ID NO: 82169 - DNA, 75 bp, Mus musculus
gctgcctttgtgaatgagaccacctggggtggagccttctgacctagatggttctattgttctgtcacctgctgc

SEQ ID NO: 82170 - DNA, 102 bp, Mus musculus
ttttgagtatttcttgcccagtccttcacaaaacagtcaagacactgaggtgacaagcctgtgtgtgttttggagaagagagggcattcaattctttcaaaa

SEQ ID NO: 82171 - DNA, 96 bp, Mus musculus
gatcagccttagtccgtggagatctgatagggtgcatgggattatttcaatatttttgtacctgttgaggcctgttgtgagaccgattatatggtc

SEQ ID NO: 82172 - DNA, 85 bp, Mus musculus; identical to SEQ ID NO: 59376

SEQ ID NO: 82173 - DNA, 114 bp, Mus musculus
tacttttaggtcaaatattactttggatatctgaatttttttaattgtaggactttatacatatgtgtatatatatttctgtgaagaatctcatggtgatgttgactgagagtg

SEQ ID NO: 82174 - DNA, 87 bp, Mus musculus
ctccgcttaggatgtgtcgctccctgattggctgcagcccattggccgagttgtcgtcacggggaaggcagagcacatggagtggag

SEQ ID NO: 82175 - DNA, 70 bp, Mus musculus
tgttgaaatatgtatatatgtatatgtacacatatatgtgtgtaaatacatacatatttggatttcagca

SEQ ID NO: 82176 - DNA, 113 bp, Mus musculus
aggttcagattggcaagggctacatggtaagactgagtccaaaacaggaattttttttcttattaaaggggttcctgtgtgacatagtcaaagtgccttggtcatgtggagtt

SEQ ID NO: 82177 - DNA, 96 bp, Mus musculus
gaaagtaatcatgtactcactgaaaataatctcttattgtagttccctaaattgaatttgtagttgtgtgtgttcagtgtgtgtgtgtgtgttttc

SEQ ID NO: 82178 - DNA, 106 bp, Mus musculus
tacatgcatgcatacttgtatatatgtacatatgtgaatatatatctatgtatagatatatacatacatactacatacatacatacatacatacatgctaactgta

SEQ ID NO: 82179 - DNA, 67 bp, Mus musculus
tcacaccatctctctctcacaaggagacacagagggtgggggtgagagagagagagagagggagaga

SEQ ID NO: 82180 - DNA, 115 bp, Mus musculus
ccctctcatccctaggttatgatgatcttaatcctttgtgatctccactgaatgaattcagacaagacacacagagcagagtttattatgagactatatagggcactctcaaggg

SEQ ID NO: 82181 - DNA, 109 bp, Mus musculus
tatgtgtatataacatgtatgtatgtattttatatttatatatacatatacatgtgtatatagtatatacatatatatgtatgtatgtatgtaaagctagggtacatat

SEQ ID NO: 82182 - DNA, 99 bp, Mus musculus
gcatatatatacatgtaatatatgtttacatatatatatatacatatgtatatatgtatatacatatgtatgtacacatatgcatatatgtatgtttgc

SEQ ID NO: 82183 - DNA, 79 bp, Mus musculus
ctttacttagtatagtctctcttaaagcaccaacaaaagtgtttctgtagttgtattaagtgcgattagactgaggaag

SEQ ID NO: 82184 - DNA, 61 bp, Mus musculus
caggggctggagagatggctaagtggttaagagagtactgactgctcttccagaggtcctg

SEQ ID NO: 82185 - DNA, 75 bp, Mus musculus
ggtcagatgtgagtaggatggatgtgtcttttgtgtctatgtatatatatatatatctgtatgtcatatctaacc

SEQ ID NO: 82186 - DNA, 98 bp, Mus musculus
tctcctgtgctagctggtcttgctgtctctgactgtgacttttccctcctgcaagcctgtatgtcagaactcctggaagaccagttctctccgggagg

SEQ ID NO: 82187 - DNA, 84 bp, Mus musculus
gtatgtatgtatgtatgtatgtatgtatgtgtgtgtgcatatatatatatatatatatatatatatatatatatatatacatat

SEQ ID NO: 82188 - DNA, 112 bp, Mus musculus
cttaaccaagttatcattgagtagagtgttgttcagcttccacttgaatgttggctttctattatttatattgttattgaagatcagccttactccttggtgatctgatagg

SEQ ID NO: 82189 - DNA, 92 bp, Mus musculus
catagattgcagacacagttcagagagtgctgtcacttcaaaggagtctgttgtaggtgctgcatgctgtgtgctgtgaagactgaggactc

SEQ ID NO: 82190 - DNA, 104 bp, Mus musculus
gtgtgcgtctgtgtctgtgtatatacatgtgtgtattgtttgtatgactgtatgtatgtatgtatgtatatgtggctatgtatatgtgtacatgtgtctgtgtc

SEQ ID NO: 82191 - DNA, 125 bp, Mus musculus
caggaaagagctcatctaatctgagttaaaaaaaaattctaatattttggggaagaacacaattcagattttctagaaatgagcgttctctgcaaagatttatagttctttatttgggactgaga

SEQ ID NO: 82192 - DNA, 121 bp, Mus musculus
tatgcatgtatgtttgtatgcatctatgtatgcacgcatgtgtgtatgtgtatatatgtgtatacatgtgtgtgtatcatatatgtctgcatatgcatgtgtgtatgtgtgtgtatgcatg

SEQ ID NO: 82193 - DNA, 91 bp, Mus musculus
tatatatatatatatatatatatatataatgcaaagaagtaaaagcattatgttcggcatccatatgtatgtatgtatatatatgtgtgtg

SEQ ID NO: 82194 - DNA, 67 bp, Mus musculus
ctactgagccaccctcagtctctccatgcggctttaaacgtggagatgtgctggtggttgtttttag

SEQ ID NO: 82195 - DNA, 196 bp, Mus musculus
atgtatatatatacatatatacatgtatatatacaaatatgcatatatatgaatatatatttgtatctgtgcctgtgtatatgaatattaatgtatacatgtatatattacattgtttatatgtatatggttgtatctatgtctgtttgtatgaatatatatgtatatatgtatatattacattgtttatatatat

SEQ ID NO: 82196 - DNA, 70 bp, Mus musculus
gtttctgttactgggtgccaaatgagagtgtgctcactcggccatctgtttgggtcctggtctcggttat

SEQ ID NO: 82197 - DNA, 108 bp, Mus musculus
gggaaaaaaaaaagcatcttgaacaaatggtgatggtctaattggcagtctgaggtagaagaatgtaaattgatccatatttatcatcttgtacaaagctcaagtccc

SEQ ID NO: 82198 - DNA, 85 bp, Mus musculus; identical to SEQ ID NO: 57439

SEQ ID NO: 82199 - DNA, 110 bp, Mus musculus
cagggttgttttgatttccatttccctgatgactaatgattttgaacatttctttagttgcttctcagtcattccagtttcctcagttgagaattccttgcttagcgctg

SEQ ID NO: 82200 - DNA, 74 bp, Mus musculus
gagccctgcacctgtagttaggaatctagtgtggctggagaagccctgctaggagctgattataaatgctgctc

SEQ ID NO: 82201 - DNA, 87 bp, Mus musculus
gaagatattaatggggcaaatattaattttgagcaaatttcctttattgtaagttttgcttatatatatgcttattttgatgtcttt

SEQ ID NO: 82202 - DNA, 89 bp, Mus musculus
gatagatagatacagagtgactgactcacttattgatatggaaacttatccttagttccacatcattgagtttcatggtgatttatttc

SEQ ID NO: 82203 - DNA, 110 bp, Mus musculus
cttgacacaagctagagtcatcagaaatgaaagagcctcagctgaggaaatgtctccatatgagatcaagctgtaagctattttctcaattagtgattaatagtggagag

SEQ ID NO: 82204 - DNA, 112 bp, Mus musculus
gaaaataagctatttcagagctctcctgggaacagaagaaaaaggggagatgtcccactttctctctgactcctatggaaattttcttagctctggttaaaatatctgtgtc

SEQ ID NO: 82205 - DNA, 81 bp, Mus musculus
ttttgtggatgccaacaagagcttgctgacaggagccttacatagctccgtcctgagaggctctgtcagtgcctgacaaaa

SEQ ID NO: 82206 - DNA, 90 bp, Mus musculus
gactatttagttgacattttgttcttgtctctgtctagtaaatgatgctagatatagttcaactagcaaagataatagctagcagaagtc

SEQ ID NO: 82207 - DNA, 102 bp, Mus musculus
gtcaaacaactttttaatggttttctgattttctatttctgtataaattgaaaattaagcacaaatggtagaaatcagcaatatgcttatggagtttgtgat

SEQ ID NO: 82208 - DNA, 100 bp, Mus musculus
atgtgtatacatatgtgtatgtgtgtatatatatacatatatgtagtaacatattttttcttatatatatatgcattcttagcatttgtaatatacacat

SEQ ID NO: 82209 - DNA, 77 bp, Mus musculus
ggtacaactttctcaggaacagatcacacagagcagaccttgtgttctatatgtgaagatctggatttgtagtaacc

SEQ ID NO: 82210 - DNA, 115 bp, Mus musculus
atatgcataattatgtttaaggttttatatacacataaatatatacatgcacttattgatgtatatttatttatgtcacatgcatatatttatgtatatatgcacatacatgtgc

SEQ ID NO: 82211 - DNA, 65 bp, Mus musculus
cccactcaggagagacataacgcagcctaagatagaggtaccagtctgtgtgtctctgggtgagg

SEQ ID NO: 82212 - DNA, 84 bp, Mus musculus
gggctgagaaatgtagacacatgtgagtgagaactgaatatgagtcgttggctcccgctacacatgtttagactgggcaagcct

SEQ ID NO: 82213 - DNA, 108 bp, Mus musculus
tggtttatgtatatgtgtatatgtatgtgtgtttgtgtgtatatgttgcaagtatgtgtatgtatgtatgtatgtatatgtgcatatgtgcatatgtatatgtgtcca

SEQ ID NO: 82214 - DNA, 87 bp, Mus musculus
atgcatatgtttatatgcatatatgcatatatgcatatatgtaatgtgcatatgtatatatgtatatttgcatgtgtatgtatgtat

SEQ ID NO: 82215 - DNA, 87 bp, Mus musculus
tgtatatatgcatatatgtgtatatatacatgtatatatcatatgcataactatatatgcatatatgtatatatacatgtatgtatg

SEQ ID NO: 82216 - DNA, 117 bp, Mus musculus
ctgtttacaatacaaaaaagtttatacatatatatatgtatgcatgtatatgtatgtatatatatatatatatatatatatatatatatatatatagagagagagagagagagagag

SEQ ID NO: 82217 - DNA, 85 bp, Mus musculus; identical to SEQ ID NO: 57439

SEQ ID NO: 82218 - DNA, 85 bp, Mus musculus; identical to SEQ ID NO: 57470

SEQ ID NO: 82219 - DNA, 96 bp, Mus musculus
gatcagtattaggtcatggtggtctgataggatacatggaaaattttcaatatttttgtatctgttgaggcctgttttgtgaccaattatatggtc

SEQ ID NO: 82220 - DNA, 79 bp, Mus musculus
gtatgtatgtatgcatgtatgtaagtgtgtattatgtatgtaagcatgtatgtatgtatgtatgtgtgtatgtatgtat

SEQ ID NO: 82221 - DNA, 108 bp, Mus musculus
atatgtatgtatgtatgtaagtatgtatgcatgtgtgtatatatgtatgtaagtttgtatgtgtgtatatgtatgtaagtacgtatgtgtgtatgtatgtatgcatgt

SEQ ID NO: 82222 - DNA, 61 bp, Mus musculus
gctgtgtctgtctgtctgtctgtgtacatgtatgtatacaaacattagacagaattttagc

SEQ ID NO: 82223 - DNA, 194 bp, Mus musculus; identical to SEQ ID NO: 73209

SEQ ID NO: 82224 - DNA, 93 bp, Mus musculus
acaaattacatacatattctaatgtatattaaatttataaatatggatactgcctatatatatatatacatatacgtatgtatgtatgtatgt

SEQ ID NO: 82225 - DNA, 90 bp, Mus musculus
tgtgcttttagcttctgagctatttctctaagcacctaactttttattactatgtgtgtgtttgagtgagtatgtggaggtcagaagaca

SEQ ID NO: 82226 - DNA, 87 bp, Mus musculus
agtttatatgtttgagtctctcagtctgtttttcaaaaacagctcatttatgatgaagcatgattgagatggagtgatgtatgaact

SEQ ID NO: 82227 - DNA, 124 bp, Mus musculus
agggatgttgttaccattggagacttctttatgcagattgctctacaatggatggctccctgattggcacccctaggtcatccaagaactttccaactctgctagggatatcaacttgggtccc

SEQ ID NO: 82228 - DNA, 94 bp, Mus musculus
atacaacatatatgtatatatgcgtatatgtgtatatatatgtgtatatatgcatatatgtatatatgtatatatgtatatgtgtatatgtgta

SEQ ID NO: 82229 - DNA, 74 bp, Mus musculus
ggaaactgtcatgccttcatccagaaaagaaaatcccagtactgaaagactggatgactagtgaatatgtttcc

SEQ ID NO: 82230 - DNA, 88 bp, Mus musculus
ggggcttctggacctggcttctggacccttcgcccgcatccgggctgcagccgtgtgtgtgtctgtgtctgcaaacaagttcatcccc

SEQ ID NO: 82231 - DNA, 79 bp, Mus musculus
gggcagaggtggatagtgagtgtttttctctctcaatcttatgtttttgagacaggctctcccattgaacctggtgctc

SEQ ID NO: 82232 - DNA, 70 bp, Mus musculus
tgaactgctctaaaactaggataatgtgagagacatctctctctcttactctgcgtgatgagctccttca

SEQ ID NO: 82233 - DNA, 88 bp, Mus musculus
gatgtggcactggagggtctttttgggggtgcacagtatttttttgtctttaaaacagtggttctcaaccttcctaatgttgtggctc

SEQ ID NO: 82234 - DNA, 90 bp, Mus musculus
gctaagcacatagctaagtgttttgcttcagaagctattcaaaatcttgaatatttttttaagcaaaagattccacagctatgaaaaagc

SEQ ID NO: 82235 - DNA, 68 bp, Mus musculus
gtggatatgtgtgtgcatgtgtgtgcatgtgtgtgcatgtgtgttcatgtgtgtgtgcatgtgcatgt

SEQ ID NO: 82236 - DNA, 99 bp, Mus musculus
ctccttttgttgtctaatcaacactccttttgttatctaattgcactagctagcacttcaggtactatgttgaatagatatggaaagagagatggcagc

SEQ ID NO: 82237 - DNA, 99 bp, Mus musculus
atatgtatatgtatgtgtatatatacacatatatatgtacacatgcatatatcatatatatatatatattcgatatatgcatatgtgtgtgtgtgtgtg

SEQ ID NO: 82238 - DNA, 71 bp, Mus musculus
taggttttatatatatatatatatatatatcacatgtgtgtaatatgtatgtatgtatgtatgtgcactta

SEQ ID NO: 82239 - DNA, 101 bp, Mus musculus
aagatttaatggaagggccctggtgctgacagctctatctctgatgcagatacccttaccgagtagatggagatctgtggctcatggtcaagttcaatctt

SEQ ID NO: 82240 - DNA, 92 bp, Mus musculus
acctgccacggactggccccagtcagtctctctcaatccatgggaaattagggttccagatagatgggcatggagttggtgataaaaaaggt

SEQ ID NO: 82241 - DNA, 110 bp, Mus musculus
catgtatatatgtatgtacatatattcctatatatatgatatatgtgtatatgtatatatacatatatatatgtatatatatatatacacatatatatataatctgtata

SEQ ID NO: 82242 - DNA, 76 bp, Mus musculus
tatatatatatatatatatatatatatatatatatatatttatgtgtgtgtgtgtgtgtatgtatgtatgtatgta

SEQ ID NO: 82243 - DNA, 61 bp, Mus musculus
aagccttttgatactgactgtacaggcacctctgtctgtctgtctgtgtgagtttgggctt

SEQ ID NO: 82244 - DNA, 65 bp, Mus musculus
ggcctctcctgctgaattgacagtgcacagtgctctgcactgtcactgtcacagcatgagctgcc

SEQ ID NO: 82245 - DNA, 86 bp, Mus musculus
tctacctcctattctctatctagcccatgcttcactctctctatgtctccaggtgttctgggctgactgagcaataggctcccaga

SEQ ID NO: 82246 - DNA, 80 bp, Mus musculus
tccctgtgtgtgtctgtttgtcactcatccacgctttgcccacccgcgttgagagaccccgttccacgcagacacaggga

SEQ ID NO: 82247 - DNA, 73 bp, Mus musculus
gaacttctgctgtagagccagagagaatagagcagggcgtcccctgatttctctctgtctctggaagagtttc

SEQ ID NO: 82248 - DNA, 113 bp, Mus musculus
gatttaactatgcttcatatgtgtgtgtatatatatatatatatatatatatatttatatgtatatatgtatatattatatcacagtacagatttaattatgcttcatatatc

SEQ ID NO: 82249 - DNA, 114 bp, Mus musculus
cttgggactatgtgttagcccatacaaattagaagtactgtctgattatgttgttctctctagaatcattgggacaaattctttagtgcctcagttcatgggtatagttgcagg

SEQ ID NO: 82250 - DNA, 85 bp, Mus musculus; identical to SEQ ID NO: 57439

SEQ ID NO: 82251 - DNA, 85 bp, Mus musculus; identical to SEQ ID NO: 57439

SEQ ID NO: 82252 - DNA, 78 bp, Mus musculus
ggagaagatgtggccttgtggaagaagtgtgtttaaagaagtgtttaaagtctggctgcctggaagccagtcttctcc

SEQ ID NO: 82253 - DNA, 116 bp, Mus musculus
attgagtagagtgttgttctgcttctacgtgtaagtgggctttctattatttatattgttattgaagatcagtcttagtccatttgatctgataggatgcatgggataatttcaat

SEQ ID NO: 82254 - DNA, 91 bp, Mus musculus
ggtaaacagaacacatctgctatgttacagtgacacaatacaaaaggaatgtatacatcaaaagatggcaggggaccaggctgtgtttacc

SEQ ID NO: 82255 - DNA, 261 bp, Mus musculus
tggattagctggacaaaagtatgtaagtagtaatatatatacatatatttatataaatatatatttgatgttaatatatttatttctatatacatttatatgtaattgtatatctatataaatatgtatgtgtatacatgtataaatgttatatacatatgtgagtatgtgtatatatatatgtatatttatatttatgtttctatacatatgtatatgtatatatataaatatatgtatatattattactatctcatatg

SEQ ID NO: 82256 - DNA, 91 bp, Mus musculus
gctttctctgtgatcctgtgattcctggatcctgtgaacctgagattctcagtgtgtcagagttcttggcagtcaaatcctctgagacagt

SEQ ID NO: 82257 - DNA, 85 bp, Mus musculus
aatttttaatggggttatttgattttctggagttcaccttcttgtgttctttatatatattagatactagtcccatgtaaagatt

SEQ ID NO: 82258 - DNA, 58 bp, Mus musculus
gtaagcgggctaaagaaagaaacacagacactgtgtgagtctgaagttggtcctctgc

SEQ ID NO: 82259 - DNA, 86 bp, Mus musculus
tgttgagtcagttgagagtcagtgcagtgagtgcagagcaaaggtgaggttgttcctgagttcatgcagttcagagaagatcaaca

SEQ ID NO: 82260 - DNA, 113 bp, Mus musculus
ctgtttatgggatgatggatccccgggtggggcagtctctggatggtccttttcgtctcagactttgtctctgtaactgcttcgacagggattttgttctcctttctaaggag

SEQ ID NO: 82261 - DNA, 106 bp, Mus musculus
gctggacaatggtaagagtgttatcagctgatggagtcaaattagaagagatgagtttttgatcttaaaaaaatgaccagctgataccatattttctttgcttagt

SEQ ID NO: 82262 - DNA, 98 bp, Mus musculus
agtaaggttgatccaccaagttccttctccataggaaaatctctcagacctgggtctggtagattagtgttgatggtattgtatggtagctgaagact

SEQ ID NO: 82263 - DNA, 85 bp, Mus musculus
cctaatgtttgtctgtgctgtgtgtctctttatctgtttatatcagcggttgggtgaaggactctcagggcacagttatgatagg

SEQ ID NO: 82264 - DNA, 91 bp, Mus musculus
atcctgggtttggcatggggtttggatggtacaggtgagtcagacagactgtgatattgaccagggcagagcttatggtaaaccacaagat

SEQ ID NO: 82265 - DNA, 91 bp, Mus musculus
agtaacaattttcactgtgactgtgactgtgactaaaacagctggtgacatagttggagtccagctacagctcttttttagaatgaaggct

SEQ ID NO: 82266 - DNA, 113 bp, Mus musculus
ctctctctctctgtgtatgatgcctgcccttctctctctgtgtatgatgcctgcccctctctctctgtgtatgatgcctgaaaggcatggcattggatcatctggagctagag

SEQ ID NO: 82267 - DNA, 99 bp, Mus musculus
ctgtgagtgtgtagtatagttgtgcagtgtatgtatgtatgtatgtatgtatgtatgtatgtatgtatgtatgtgcaaaggtgtgtggagaggccacag

SEQ ID NO: 82268 - DNA, 67 bp, Mus musculus
actgtcagacaggattcaggagccatacatgttggatattggggtgtctgtctgtctgtctgactgt

SEQ ID NO: 82269 - DNA, 92 bp, Mus musculus
ttacattgtttgaggccatttgatatgtttttcttcgggacattgcttgttggtagtaaagaaataatctcaaatgagtaaattcaatgtaa

SEQ ID NO: 82270 - DNA, 84 bp, Mus musculus
gtcgcaggaggtgtgtcactggagataagctttgaggtttcaaacacaagggccaggctcagtctcactctgcctcctgcctgc

SEQ ID NO: 82271 - DNA, 85 bp, Mus musculus; identical to SEQ ID NO: 57439

SEQ ID NO: 82272 - DNA, 120 bp, Mus musculus
atgtagtgaaatttgctgtgaatatatacatatatagatatgtatatatgtgtatatatgtatatgtgcatatatgtacatatgtgtatatgtgtatatatattgaaaaaatatatatat

SEQ ID NO: 82273 - DNA, 85 bp, Mus musculus; identical to SEQ ID NO: 57470

SEQ ID NO: 82274 - DNA, 86 bp, Mus musculus
tctcagggaaatgaagatgcaagcccacaagcattgcacagctagctgtactagcaagccaagctctgtctctgtcactccttgga

SEQ ID NO: 82275 - DNA, 81 bp, Mus musculus
gtgttctgagatgaagcagcttccagggtgggatcagctactcaatgactcactctgagaagtacttcagatattacttac

SEQ ID NO: 82276 - DNA, 114 bp, Mus musculus
ccttagtccctggtgatctgataggacacataggattatttcaatatttttgtaactgttgaggcctgttttgtgactgattatatggtcatttttggagaaagtatcataagg

SEQ ID NO: 82277 - DNA, 114 bp, Mus musculus
tattcccacgttttattgagttttgcctgtagccttgttgtaataaagtgtgacatgtctatatgttcttattttaacatactctcttcagacatgagctagcatgtggaaatg

SEQ ID NO: 82278 - DNA, 88 bp, Mus musculus
gcttttaatagtctgtctttagtgcatttgttgttctgattattatgtgtcaggaggaatgtcttttctggtccagtctatttggagt

SEQ ID NO: 82279 - DNA, 90 bp, Mus musculus
catttcataataaccaacatgtagaataagctcatgtacagtcaacacatggttgaaggatatgatatgtaaacatgggtgaaggaaatg

SEQ ID NO: 82280 - DNA, 70 bp, Mus musculus
agttgtccttcctgaagacactttgtcattcctgggaagacactgtcagtctcattcaggtgcttcgact

SEQ ID NO: 82281 - DNA, 99 bp, Mus musculus
tgaggacaggttttgagtatatgggctattggaatggcaaggttccaggaggctacgtttctgtgaaactctctgccacaggactgcttccaggtttct

SEQ ID NO: 82282 - DNA, 96 bp, Mus musculus
gcgtaaagtgatgagcatgtgtctgtaagttgctaaagcacagactactgtgcacaatgctttgctgtcattttgctcatgagcttgcctatatgc

SEQ ID NO: 82283 - DNA, 85 bp, Mus musculus; identical to SEQ ID NO: 57439

SEQ ID NO: 82284 - DNA, 102 bp, Mus musculus
aggcatcttagctaaggaggggtagagttgagagtgttcacacattacagcagttagatatgagtgtattcattcttctcgcatctttgaggcataatgcct

SEQ ID NO: 82285 - DNA, 71 bp, Mus musculus
tttatgtgtttgtgtctgtatggtatacatgtatacaagtatgtatgtagacatatgagcaaatgtataag

SEQ ID NO: 82286 - DNA, 110 bp, Mus musculus
catgaagctattctttgtcatttggactttatttgacttcgacattttattttagtatcagaggctgttcttttctcagtagtctaaaaggataaaagcagtgttttatg

SEQ ID NO: 82287 - DNA, 75 bp, Mus musculus
ggaggccatatctgagagatgtcagtgaggaaccatccatttactgatcttttcctaatcagaagaccagcctct

SEQ ID NO: 82288 - DNA, 114 bp, Mus musculus
ctgctacttgtgactgcaggggccatgagatgtgaccatatcattgactggagtggtgttacacactctgtcagtttgtactcatacttaaaaatacttttacatcacttagag

SEQ ID NO: 82289 - DNA, 72 bp, Mus musculus
actgtgtcactctgtgatttcaaacctcttccctggatccagtagcaggtgtgagggaactgaagacaaagt

SEQ ID NO: 82290 - DNA, 68 bp, Mus musculus
ttatttgtgtctatgtgtctgtgtgtctacatgagtgtatccacacaaatgtttgtaggtgcacttaa

SEQ ID NO: 82291 - DNA, 112 bp, Mus musculus
ataaaatgtcttagatgagtctatgtctggagggttttccaagtgtctttagttgtttggtcattgataacagtctgataatcacggatagtgatatatctgtgtagtttat

SEQ ID NO: 82292 - DNA, 93 bp, Mus musculus
tccatgttgatctgataggaggcatgggacaatttcaatatttttgtatatgttgaggcttgttctctgaccaattatatggtcaattttgga

SEQ ID NO: 82293 - DNA, 78 bp, Mus musculus
gtggacacaagaggatatcttgggctcactggccacccagtgtagctttctgatcaagccatactctctctgtctcac

SEQ ID NO: 82294 - DNA, 117 bp, Mus musculus
aggcagcttctcagtggtcctacctgcattcacaggcctgtccactttccttggaggctcactctctccctgtgctatttgggtatggagccctgtgtcagaggactgtttccaggc

SEQ ID NO: 82295 - DNA, 91 bp, Mus musculus
aggctgaggagagtcatgattgagagcagagtggatagtaataaattctgaataggttccatatttttgcacgatctgtagtctccagttt

SEQ ID NO: 82296 - DNA, 91 bp, Mus musculus
ctgacctcaaagatttaggtttcatgtgttgtgtgcctgtctgtgtgtatgccagaagtgggcatcacagtccctgatgctgaagttgcag

SEQ ID NO: 82297 - DNA, 78 bp, Mus musculus
tcattgaagagagtcaggacagggactaaacagggcagaaacctgggcaagccttgtgcatgattccacagtctctga

SEQ ID NO: 82298 - DNA, 61 bp, Mus musculus
tacatgtatgttcatgtgtgtgcacatatgtttgtatgtgtgcatgtgtatgtgtgtgtat

SEQ ID NO: 82299 - DNA, 85 bp, Mus musculus; identical to SEQ ID NO: 57470

SEQ ID NO: 82300 - DNA, 68 bp, Mus musculus
ttgtcaaaaactgactggttttgtatgtcaactgtcaagttgacacaagttagagccattagagacaa

SEQ ID NO: 82301 - DNA, 85 bp, Mus musculus; identical to SEQ ID NO: 57470

SEQ ID NO: 82302 - DNA, 155 bp, Mus musculus
agacagacatagatatttattttttgtacatgcatgtatatgtgcaaatatatatatatgtttgttttatatatatttgttatatatgtatatgtatgtgtatatatatatatatatatatatatatatatatatatatatatattcctaacaaa

SEQ ID NO: 82303 - DNA, 85 bp, Mus musculus; identical to SEQ ID NO: 57439

SEQ ID NO: 82304 - DNA, 88 bp, Mus musculus
actttagctgtgtgtctgtgtgtgcctgtgagcctctaaggacccctggggaggcctggagagggtatccatctcttagagctggagt

SEQ ID NO: 82305 - DNA, 67 bp, Mus musculus
ctggtgctgtacagtctctttgtgtgaaacatcccatccaaagtaaatggctgtacagtttctctag

SEQ ID NO: 82306 - DNA, 92 bp, Mus musculus
gctctctcttgaggtcactctcactctgaaataatcctaagtatttggttatttaggatgaaatgcacagatgttgggctcaaatccagagc

SEQ ID NO: 82307 - DNA, 72 bp, Mus musculus
gttttcagttgagactcaccacaaagctgcaggaccaagcctttttgtgtagctgtgagaaaactgcaggac

SEQ ID NO: 82308 - DNA, 79 bp, Mus musculus
gagacagagagacagagagagacagacagagacagagacagagacagagagagactgtctgtctatctgtctcttgttc

SEQ ID NO: 82309 - DNA, 119 bp, Mus musculus
acgattactttcttgctttttctagggtgtagtttccttccttgtattgctttttttttctgttattatcctttggagggctggattcgtggaaagataatgtgtgaatttgtttttgt

SEQ ID NO: 82310 - DNA, 108 bp, Mus musculus
ctagtcaaaggccctgtgggaggtgtgcccttaaaggggatggaaagacctcactcactcagtctcttcctattcctgtcttacttttgccactcagtgttggactgg

SEQ ID NO: 82311 - DNA, 94 bp, Mus musculus
tgaggggaaattttggtgaaggaattctgtcactagaggcaggttttaagaacactgactgctcttccagaggtcctgagttaaagtcccagca

SEQ ID NO: 82312 - DNA, 110 bp, Mus musculus
ggattctaagagctgtgcccaggagagcattaggatgctgcgtatctctggtgacagtcactgtgtcagcgtccttgaatgactttcatcgctttgtggttaaaccttcc

SEQ ID NO: 82313 - DNA, 112 bp, Mus musculus
gggtggtagttggttgtacaattactgtttagaactatcttatgaatttatattatatacctaagtgaaatgtaaaatgagtttggtactgatgtgaaatgtgtatctatcc

SEQ ID NO: 82314 - DNA, 85 bp, Mus musculus
cacagagtctagtgttgtcagttctccacaccctaaagcaacagttgtagggacacccaagagaagacagactgctgtctctgtg

SEQ ID NO: 82315 - DNA, 76 bp, Mus musculus
attggctcagttttttggtgttttttttttttttccagtcattctggagcactggagacactcctgactgactgat

SEQ ID NO: 82316 - DNA, 86 bp, Mus musculus
ggagtgcggaggcaattagaggcttcgtgcagcagtgtgggtttgccactctctctgggtgtgtgcctcttgctcgtttgtatttt

SEQ ID NO: 82317 - DNA, 71 bp, Mus musculus
gcccaccactcttggggaatgatggtgtttcacactcccgtgctgaagacacacatcacagagtgctgagc

SEQ ID NO: 82318 - DNA, 107 bp, Mus musculus
tctggggagagagtctgcatcttttctcatttgtaccgagtatggagtgtgtatctatctctctgtcagaaatgtcaagggaagggttcaccattgacctgatgctc

SEQ ID NO: 82319 - DNA, 73 bp, Mus musculus
gttgtgtagcttgatcttgtgggattcctgacagtgggagcaaggactgtctccctcagactctgttgcctgc

SEQ ID NO: 82320 - DNA, 77 bp, Mus musculus
tgtgtctgtctgtgtgtgtgtctgtggatatgtgcacatgagtgcatatgtccacagaggacagagagaccagatcc

SEQ ID NO: 82321 - DNA, 69 bp, Mus musculus
tctttattaattagggacactatctccaactgctctgttgtactagatagtgatcagagttgctgaggg

SEQ ID NO: 82322 - DNA, 90 bp, Mus musculus
atgagatgtgaccaattttaatttctatatatgaaaatatggcgtttttttcttatatatctggcttatttcagttggttgcatccttat

SEQ ID NO: 82323 - DNA, 119 bp, Mus musculus
ggttttgtcattgaatatcttgcttttttttcattcaggtgacttaaagatttgctgtgtatagtagtatgggctgacatctgtggtctcttggagtttgcaagatttctgcccaggac

SEQ ID NO: 82324 - DNA, 96 bp, Mus musculus
gcctgcgatcagtgtgactgatctgggagccagacttgttcctctgtctgacggctgctgtctgctcttccagggttacttcatgacaagctgggc

SEQ ID NO: 82325 - DNA, 156 bp, Mus musculus
tcactttcatcaaattggctgtgagcgtgcctgttagcgtgcctgtgagcgtgcctgtgagcgtgcctgtgagcgtgcctgtgtgtgtgcctgtgagcgtgcctgtgagcgtgcctgtgagcgtgcctgtgagcgtgcctgtggggcgtgcctggg

SEQ ID NO: 82326 - DNA, 80 bp, Mus musculus
gatcagggaagacgtgagacccacaagcattgcacagcttgctgtaccagcaagccaatctctgtctctgtcactccgtc

SEQ ID NO: 82327 - DNA, 93 bp, Mus musculus
tgtgtgtgtgtgtgtgtgtgtgtgtgtgagcatatgtgtgtgtgtgtgagcatatgtgtatgtgcatgtgcatgcaagtgcctacacatgcat

SEQ ID NO: 82328 - DNA, 79 bp, Mus musculus
acttctcttagtttcactgtgtctctgtttagtttctgtttccaggatttgtccatggatgaaagtggggtgttgaagt

SEQ ID NO: 82329 - DNA, 91 bp, Mus musculus
gactggtgttcgccttgtgacattacattcagattcatcacattctctcatgtgtctgtgtctgtctgtcaatgttcgccaattccatgtc

SEQ ID NO: 82330 - DNA, 84 bp, Mus musculus
tgtgtatatgtatatgtttatgtctgtatatgtatgtgtatgtttatgtctgtatatgtatgtgtaagcgtgtatgtatatgta

SEQ ID NO: 82331 - DNA, 89 bp, Mus musculus
ttttgtcctatctgtctgtctgtctgtcttgacctgaatcagcatgttgttcctcagtgacaagatccccaaataggaggtagccagga

SEQ ID NO: 82332 - DNA, 81 bp, Mus musculus
agaaaccactccactctttgaaatgaattgaagatagttaattttcaaaaaaagtattttgtgggctgttcggtggtttct

SEQ ID NO: 82333 - DNA, 76 bp, Mus musculus
gaaaaaaagaaaaagggctggagagatggctcagtggttcaagactactgactgctcttccagaggtcttgagttc

SEQ ID NO: 82334 - DNA, 98 bp, Mus musculus
cagcacttttacctagtgagacaactttctcagctctagtaactttgtatttttgtttggaggcagggtaccaaggtctcactgtgtaaacctggctg

SEQ ID NO: 82335 - DNA, 75 bp, Mus musculus
gggcagtgagcttccagtgtctgtctgtctgtctctacacccagggttggcattcaggcatgaacagctaagcct

SEQ ID NO: 82336 - DNA, 78 bp, Mus musculus
atatatacacacatatatatacacatatatgtatgtatatatatgcatatatgtgtatgtatgtatgtatgtatgtat

SEQ ID NO: 82337 - DNA, 80 bp, Mus musculus
gaaagagcccaccggtggctatggagatgctcagcagtgaagtccactgactgctctttcagacagcctaggttcagttc

SEQ ID NO: 82338 - DNA, 94 bp, Mus musculus
ctacacactgttcagctgtttatatgtttccattttctgcaggaggaagttgctctgataatggctgtgcaagaagacactgatctctgagtag

SEQ ID NO: 82339 - DNA, 68 bp, Mus musculus
gtgtacatgtgtatacatgtgtgtgtgcatgtgaatgtatgagtgaatgtgtgtatgcatatgtgtgt

SEQ ID NO: 82340 - DNA, 74 bp, Mus musculus
agtgaagcctccagagaatgaccaggcaggcaggggctctctgtcattcactgtgtggctgtcattccatcagg

SEQ ID NO: 82341 - DNA, 102 bp, Mus musculus
tcattcctcctgaaagccactttcattagtttttgttattctatctcagcaatgagagaaaaaaaaaaaaaaactactgcaaagttctacagtatggtatga

SEQ ID NO: 82342 - DNA, 70 bp, Mus musculus
cagctgtgcagagatcagagcttaagcataaccctgagtgtatgtttctctctagtctctgtgtctgctg

SEQ ID NO: 82343 - DNA, 108 bp, Mus musculus
ccactgaatgctgtcctgtctggtataaatgatgcctttagaacatttttttttaaatcagagcctgaatttctcaaggggcatcatccatgccttctgctaagctgg

SEQ ID NO: 82344 - DNA, 107 bp, Mus musculus
agtccatgagcatgagagatctttcaatcttctgagatcttcttgattttgtacttcagaaacttgaagttcttatcatacagatctttcacttacttagttagact

SEQ ID NO: 82345 - DNA, 68 bp, Mus musculus
accttggcactgctctcaaagactctctgttacttagatgacaaagtctttacagaagtgattaaggt

SEQ ID NO: 82346 - DNA, 68 bp, Mus musculus
gtctcctttgtagagtgtgagctctctggtcagtggtcctaagatcatgtggagagtcctctagggac

SEQ ID NO: 82347 - DNA, 115 bp, Mus musculus
aggatatttcagctcctggtaacctgcttggcctgacatcacatgttgagtgagtcattttctctcacttaaatgcagctgacgctaaaattgtgctatcgattctgatgctcct

SEQ ID NO: 82348 - DNA, 82 bp, Mus musculus
gtccaagggctaggaagagctggctctgtccctcactggctctggcacttgggagagcagggccctgcacctcacttggcac

SEQ ID NO: 82349 - DNA, 68 bp, Mus musculus
ctggtggcagatggaggtataagattgtccttgtcctttgcttggccctctcatcctctctgtctcag

SEQ ID NO: 82350 - DNA, 114 bp, Mus musculus
aggtgggctgcccaggccccttcccctagccgtgtggatttcatgggcctcattcataagacacacattcaggtttacatgtctggtgaggggagatggtgtgatccaattact

SEQ ID NO: 82351 - DNA, 92 bp, Mus musculus
agttatcttgctggagctggagagatggcttagtggttaagagctctgactgctcttccagcaattcaatttccagcaacaacatggtggct

SEQ ID NO: 82352 - DNA, 76 bp, Mus musculus
aggtgctgcctttcagctctgtctgtcagactgtcaaagctagagtggccagtgacagcaggaaaggatgtgacct

SEQ ID NO: 82353 - DNA, 106 bp, Mus musculus
gccttagtccatggtgatctgataggacgcgtgggacaatttcaatatttttgtatctgttgaggcctgttttgtgaccaattacatggtcatttttggggaaggt

SEQ ID NO: 82354 - DNA, 101 bp, Mus musculus
gcatatgtaaggtcctgggtttggtcctcagtacacactaactaactaactaactaactaactaactaactaaatcaggccttctatcttgcataacctgc

SEQ ID NO: 82355 - DNA, 90 bp, Mus musculus
gtgtatgtatgtgtatatgtatgtgtgtgtgtatgtatgtatgtatgtacatatgtatgtgtgtacgtatgcatgtacgcatgtgtgcac

SEQ ID NO: 82356 - DNA, 71 bp, Mus musculus
gcagagtgcagagagagtcacactgcagagcacacagcagagtgagtgcagagagagtcacactgcagagc

SEQ ID NO: 82357 - DNA, 72 bp, Mus musculus
cagcagcaggggtctgtgtcaatgtctgtggctcatgttactatcaaaggccatgaggatgtccctgctctg

SEQ ID NO: 82358 - DNA, 100 bp, Mus musculus
tgtacctttttagtctttttttctctatacatttgcatatatatatatatgtcttttgtgtatagtgtatgtagtggtttgaatatgcttgttaggtcca

SEQ ID NO: 82359 - DNA, 72 bp, Mus musculus
gcacgtgtgtgtgtgtgtgtcgctccgtgtgcatgtgtacacactaggtgtgcacaagagggggacatgtgt

SEQ ID NO: 82360 - DNA, 70 bp, Mus musculus
cctgacctgggagagtgtagggcccctctgacctctacacctttgtggctctcatgctctctgtctcagg

SEQ ID NO: 82361 - DNA, 86 bp, Mus musculus
gctggccttgaggaaagagagtagtgagtaatgtcattcgggagtgacatgcgagcacacacaccgtctctctgtgacatgctagc

SEQ ID NO: 82362 - DNA, 111 bp, Mus musculus
gccgagatgaggaacttagccagtcctttgttgctatcagataggtgagtaaagtcagagagcactcactgtacgttggaaatttgtaggttggtgtgtattgagtggggc

SEQ ID NO: 82363 - DNA, 87 bp, Mus musculus
gtgcatgtataaatgcatccatacatccatgcatccatccgtccatgcacatgtatgcatagtagtatgtatgtatatatatttcac

SEQ ID NO: 82364 - DNA, 127 bp, Mus musculus
tatatctgtatatatagataagtgtgtatattctctatgtatacatgtaatatatattatatatactatattatatatatatatatttgtgtgtatgtgtgggcatgcctgtgtggatttgtgtatg

SEQ ID NO: 82365 - DNA, 72 bp, Mus musculus
gcatgcatctgtgcgtcttcactgcccacctgcagcatctgtgggaaggagaggagagccacagttgcacac

SEQ ID NO: 82366 - DNA, 78 bp, Mus musculus
gtgccgatcatgtaactctcagtcactgttttactatggggtccctcagtagcacagtggttctgggcatgggctgca

SEQ ID NO: 82367 - DNA, 84 bp, Mus musculus
gcacagccagtgtccatgcaggagtgcgcacagccagtgtcctcgaaggagtgcgcacagtcagtgtctcacacaggagtgtgc

SEQ ID NO: 82368 - DNA, 125 bp, Mus musculus
gccaagttgtccccagtgtgaagggtgacacgtctccatgttggtgttgctgagagaacacagtgggcactcagggcagccctctctcagaggattagaaaatgtgtgtgtgtcacggagaatac

SEQ ID NO: 82369 - DNA, 116 bp, Mus musculus
tgtgtgtgtggtatgcatgtggtatgtgtgactgtatttgtgatgtgtgtgtatctgtgtgtgtgtaagtgtgatgtgtatttgtgtcatgtatgagtgtgtatggtgtgtgcata

SEQ ID NO: 82370 - DNA, 76 bp, Mus musculus
gggagtcagtctgtcactggttctccagtctcttgggagggaagtgggtgaaccagcatttagatcagtggttctc

SEQ ID NO: 82371 - DNA, 68 bp, Mus musculus
cacatatatatgtgtgcatatatgtatgtgtatatatacatatatatgtgtgcagatatgtatatgtg

SEQ ID NO: 82372 - DNA, 93 bp, Mus musculus
tatatatgtgtctgtatatataggtatgtgtgtgaatatatgtatacacacacacacacacacacacatatatatatatactacatatgtata

SEQ ID NO: 82373 - DNA, 81 bp, Mus musculus
ggggagagaagaagcagagggtttgctgcttatatgctcagcgcaggcgttcaagcagcaggcttctctggggcttacctc

SEQ ID NO: 82374 - DNA, 100 bp, Mus musculus
tatataaaatacttcagatatacatatacatgtatacatttatttacatctcatgtaaattaatatatacatatgtatattatttttgctatatgatata

SEQ ID NO: 82375 - DNA, 64 bp, Mus musculus
ctgactcactgtgtgcctcgccaggacaaaagcaatcctctgggaggcagtatttggtgcacag

SEQ ID NO: 82376 - DNA, 75 bp, Mus musculus
cagtcttcacagagcagccttcttcctgcccaccaggaaagacctggccagtggtttggaagctgatgctgtctt

SEQ ID NO: 82377 - DNA, 88 bp, Mus musculus
agaaaaagagggaggaaggacacatggaggggggggagttcttgcctgtcctttctgcctacctgtctgtctgtctgtctgtctgtct

SEQ ID NO: 82378 - DNA, 111 bp, Mus musculus
tgggatctgtctatagtgttagccacttgcaattgtataaaattatacatatatgttgttggggggggggggttagagtcatggctatcagaaaattcataaaagatttca

SEQ ID NO: 82379 - DNA, 57 bp, Mus musculus
cctgtcacaggctccctgccacagactccatgtctgtcacaggctccctgtcacagg

SEQ ID NO: 82380 - DNA, 150 bp, Mus musculus
tatatatataccatatacatatatgcgtgtatacatatatatgtctagatacacgtgtgtatatataaatatatgtgtgtacatatatatgtatacatatatgtgtatatatatacatctatatatgtatacgagtgtgtgtgtgctatg

SEQ ID NO: 82381 - DNA, 83 bp, Mus musculus
aggcctacgtttatatcaatatgtttttactgagtcaaggcagactcagtaaatggcaatgtgaggtagctcggaaaatgcct

SEQ ID NO: 82382 - DNA, 83 bp, Mus musculus
gatgtgtgtggtgtgcttgtatgtccgtgatgtgtggtatgttgtatatgtgtatgcttatgatgtgtatgtgcccacacatc

SEQ ID NO: 82383 - DNA, 61 bp, Mus musculus
tcaggagtctggggagaggagcagggctagagcactgtctccctctatgtgacttggctga

SEQ ID NO: 82384 - DNA, 85 bp, Mus musculus; identical to SEQ ID NO: 57439

SEQ ID NO: 82385 - DNA, 109 bp, Mus musculus
aggttttccagttctgctcatgttggacttgaactcattaccctcctgactgagctttctgagtcactgagtcactggtcacaagtcatgtctgaagaaaaaaagacct

SEQ ID NO: 82386 - DNA, 126 bp, Mus musculus
attgagagctctgaggggagatcacatggccagcctgggctctagatagagtgagtccctgtcacagtgtcattgtcctggtcagatagctcagtttcctgcttttgtgtatggttggtttgatgt

SEQ ID NO: 82387 - DNA, 74 bp, Mus musculus
ctgcatggagagccacagtctgtccctgtctgctgagagctgcatggagagccacagtctgttcctgtctgcag

SEQ ID NO: 82388 - DNA, 81 bp, Mus musculus
caggttgtctgagaagaaagagtgcattcctcaaggctggtaacatggcttagaggggaagggtgcctgcctccagacctg

SEQ ID NO: 82389 - DNA, 92 bp, Mus musculus; identical to SEQ ID NO: 57641

SEQ ID NO: 82390 - DNA, 88 bp, Mus musculus
tgctgtgacatgctggaattgggacttgtcacgggcactgccagtgtggttacctgcacaaggccaggcagagtcccaacaggcagca

SEQ ID NO: 82391 - DNA, 95 bp, Mus musculus
ggctagatgtatattgtgttcatatgtaagttgaagttattcataggttcagaaaaatgagtttttttttctatacagctggacagtgtcttgtc

SEQ ID NO: 82392 - DNA, 65 bp, Mus musculus
atatatatatattaaacatacatatacatatatatatatgtgtgtgtatgtatatatatgtatgt

SEQ ID NO: 82393 - DNA, 105 bp, Mus musculus
gctcaagttgtttgcttactgacaaatgtgagagagagcatgtgcatgtgtgtgtgtttgtatgtcagtgtatgtgtgtttgtgtgtaagtgtatgtgtgtgagt

SEQ ID NO: 82394 - DNA, 91 bp, Mus musculus
gggctgggaagacgagggcctcgtagttgcttgctttgtttccaagagctttcccagaacaagtagtatgcgcgctctaatctactcacct

SEQ ID NO: 82395 - DNA, 85 bp, Mus musculus
tgtatatgcacatatgtgtgtatgtatatgtgtgcatgtgtatgtctgagtgtatatatattgtgtgtgtgtatgtgtatgtgca

SEQ ID NO: 82396 - DNA, 342 bp, Mus musculus
gcatgtatgtatgcatgtgcaagtatatatgtgttcgtgcatgtgtgtatgtgcatgcatatgtgttcatgtgtgtgcatgtatgtatgcatgtgcatgtatatatgtgtgtgcatacatgtgcatgtatatgtgtgtctctgtgtgtgcatgcatgtgtttatacatgtgcttgcatatgtgcttgtgtgtgtgtatgtatgcatgtgcaagtatatgtgttcatgcatgtgtgtatgtgcatgcatatgtgctcatgtgtgtgtacatgtatgtgtgcatgtgcatgtatatatgtgtgtgcatgcatgtgtacacatgtgcttgcatttgtgtttgtgt

SEQ ID NO: 82397 - DNA, 155 bp, Mus musculus
gtatgcatgtgcaagtatatgtgtgtttgtgtatgtgcatgtgtgcatgtgcatgcatatgtgttcatgtgtgtgtgtgcatgtgcatgtatatatgtttgtgcatgcatgtgcatgtatatgtgtgttcctgtgtgtatgcatgtatgtatgca

SEQ ID NO: 82398 - DNA, 93 bp, Mus musculus
cattacatcataggaagagaaattggggcattaaatggtggcgtttgcacctcaccagtgtctctgtctcaggctctttgatgagatgtaatg

SEQ ID NO: 82399 - DNA, 92 bp, Mus musculus
gcaccttgtcctgttggggccactccctctgtccctctgtcacgcctgctcacagcctagcagaaaaggagataaggctggcttcttggtgc

SEQ ID NO: 82400 - DNA, 78 bp, Mus musculus
tgtctgtctgtctgtctgcttatctgcctgtcttagcctgcagcctgggatcagatgtaagcttacagaaccacttca

SEQ ID NO: 82401 - DNA, 88 bp, Mus musculus
gtcttgatatacatccttgtgtgctagctggttcttttgtcaacctgacacaagctcacactgtgtaggaacaggaccctcagcacca

SEQ ID NO: 82402 - DNA, 101 bp, Mus musculus
cctgatggtcagtacaaagtgtatttcctgagatctgagtgtgttatccacctgtgataacagatacttaggagtctgagacggaacaactgagtttgagg

SEQ ID NO: 82403 - DNA, 114 bp, Mus musculus
gtttttgaaatgtacatgttagtatctgtttctccctacagtttgttccacgtgtgtgtctctgtgcctgtgggggaagggattgtgatttttgaggctgtatggttagaagca

SEQ ID NO: 82404 - DNA, 97 bp, Mus musculus
agatgaaattagacattgtgataaatatcttatgcacacgagttcactgaatcccttttatgcataaggtatcaatagaacaaagcgaaagtcatct

SEQ ID NO: 82405 - DNA, 72 bp, Mus musculus
caagggtcaagatgccaggtatgtatcgctgctgcacccagctcctctcactgcttgtctgtctgtctcttg

SEQ ID NO: 82406 - DNA, 72 bp, Mus musculus
tctttatatattatatgtattatgtgtatatatgctatatgtgtatgtatatgtatgtgtgttacgtgaaga

SEQ ID NO: 82407 - DNA, 68 bp, Mus musculus
cctcttaggctcagatagttggatgtttggtccccaggtgttggtgctgtttggttcagtttaggggg

SEQ ID NO: 82408 - DNA, 86 bp, Mus musculus
ttgttcccgtgcagatgtggggtgaagtgtccgttaaagctattgctcactgatgagacagtggacgtccagatgcgggggagtgg

SEQ ID NO: 82409 - DNA, 64 bp, Mus musculus
gagatagagaggtagagctggtctcgatctggtgtctgtccatctctctgcctgtctctgtctt

SEQ ID NO: 82410 - DNA, 114 bp, Mus musculus
tggaaaatggtctgaagttctctatctgtgttaggtctttatgtggtttagatatcagagtaattgtggcttcgtagaatgaattgggtagagtaccttctgtttctattttgt

SEQ ID NO: 82411 - DNA, 69 bp, Mus musculus
gagtacaagactatccagggaccccttttacagcctcagaggctctctggctctggctcttttctactc

SEQ ID NO: 82412 - DNA, 122 bp, Mus musculus
agtagacagacagaaagttggatgggtggacagacagacagacagacagacagacagacagacatcatatctaaagttgtgtggcctgttcacacacactctcactttgttcacttttatcc

SEQ ID NO: 82413 - DNA, 95 bp, Mus musculus
gtgggctttaggtggtacaaggagtggggttgggctttgagatcaaatgccaatgccagggccagtctcacactctctctgcctgctgcctgcag

SEQ ID NO: 82414 - DNA, 85 bp, Mus musculus; identical to SEQ ID NO: 57439

SEQ ID NO: 82415 - DNA, 109 bp, Mus musculus
gtatcctttctcccctgcattccttctaccagattctgaggttgttgacacaagagtgtgtcgtgcatggttgcaggaactgttcagggaatgtcagaagggagagtgc

SEQ ID NO: 82416 - DNA, 78 bp, Mus musculus
ttaggttcctgttttcgtcaacaatgttcaagtgtcaaaccagaatgactgatgaatgtgaggtgacaggtgtcctaa

SEQ ID NO: 82417 - DNA, 97 bp, Mus musculus
cctgtgagtcagcaggaacacatgcccgctcactctgtctgtgtgcctgggggggcacagatgtgctttgtgaggagaggtgctgcttagacacagg

SEQ ID NO: 82418 - DNA, 72 bp, Mus musculus
gtacttgtctgtgtgtctgtgtctgcatgcatgtgcacgcaacctaggccttcaatcatactaggcaagcac

SEQ ID NO: 82419 - DNA, 116 bp, Mus musculus
tcagcctgagtccatggtggtctgataggatgcatgggacaatttcaatatttttgtatatgttgaggcctgttttgtgaccaattatattgtcaattttggagaaggtcctgtga

SEQ ID NO: 82420 - DNA, 71 bp, Mus musculus
ctcttggaattctccaatatttttcattaaaaagaaatctggcaaatggaggataatgagagatctgagag

SEQ ID NO: 82421 - DNA, 79 bp, Mus musculus
tgaggaaggaggctcacaagttcaaggcctccatgagctgtggagtggagcctgagtgactcagtgagtccctgtctca

SEQ ID NO: 82422 - DNA, 63 bp, Mus musculus
gggactcactgagtcactcaggctccactccacagctcatggaggccttgaacttgtgagcct

SEQ ID NO: 82423 - DNA, 69 bp, Mus musculus
gtgtatatacatgtatatatgtatgtatgtactgtgtgtatagatgtatgtgtgtgagtgtgtatgtgt

SEQ ID NO: 82424 - DNA, 116 bp, Mus musculus
cctctttgtaagttgatctatatatacaaaactctaaggtaagcatcagactgagcagtgagcatgagtcagggttctagaggagggagagaaagaggaagaagaagaggaagagg

SEQ ID NO: 82425 - DNA, 66 bp, Mus musculus
gtctgcggcagggcagggagggggaagagtagtcagtcgctcgctcactcgctcgctcgcacagac

SEQ ID NO: 82426 - DNA, 85 bp, Mus musculus
tgacctgtctcctcatgcagctgcacataatgaacacaatgagtttctctgttgctactgcatctccatgtgagtggacagctca

SEQ ID NO: 82427 - DNA, 104 bp, Mus musculus
ttctcccctactgcttctcacacaagctttggtctgtgtctctctccaaatctcctcttcttataacaacatcagctgtattgtgttaggagctgccctgagga

SEQ ID NO: 82428 - DNA, 104 bp, Mus musculus
ctgaggtgatgccactagcttgcatagaggggaggaccatgaacattgtgctctgctggtggggtttgttgactggaacctctgtgtaaatatatcagctctag

SEQ ID NO: 82429 - DNA, 72 bp, Mus musculus
tctctatgtgtatatatctgcgtgggtctaagtgggcatatctctctctatgtgtgtgtctgtgcgtggggg

SEQ ID NO: 82430 - DNA, 115 bp, Mus musculus
gtgatacaaaattacacaaaatatgcacttctttattgatttattatttttttcttacccaagaacataattgcctcaaaaggagagactttgttgatgtgtcaaagtgtattat

SEQ ID NO: 82431 - DNA, 73 bp, Mus musculus
tgtgcacactcacccagtctcagtgtatatgttcatatgtgtatcagttctgctgtgtctaggtgatgtcaca

SEQ ID NO: 82432 - DNA, 94 bp, Mus musculus
acagtggaactcgtcagatatatgtatgctaagtggttgggtttccttgggaaggactactgtctgtctgtctctctccctgtgcgcgcttgca

SEQ ID NO: 82433 - DNA, 78 bp, Mus musculus
tagactatgcttccttcctttgggtgggtgggtgggcacagagtcctctgtgtgtgtctatctgtctgtgtctgtctg

SEQ ID NO: 82434 - DNA, 83 bp, Mus musculus
ttgatctgcagactaaggttcagagacccacctgcctgttctctacccggcctgctgtctctgtctctgtctcgctgacttaa

SEQ ID NO: 82435 - DNA, 100 bp, Mus musculus
gcctgggttcactcattctcagcttcctatttcctcatcgccacatttggcccccatgctatgacaggcagctttgagagtgtgagtgacaaccttaggc

SEQ ID NO: 82436 - DNA, 61 bp, Mus musculus
gacagtcactgagcctgtgtgtcaggcacgtcctgaagcaggtgttgtcaggtgagctttt

SEQ ID NO: 82437 - DNA, 116 bp, Mus musculus
ccatgaggcttctttgacatggacatcggcggggagcaagttggatgaattgttttagaattgtttacagatattgttcccaaagctgcagacaattttcatgcattgtgtacagg

SEQ ID NO: 82438 - DNA, 116 bp, Mus musculus
gctagaaaatgcttcttagtgatacgtctaaggttagaaaagaaaacatatcctgtgtgaacacagtctgctaagttagatggatttccttgagagtggctttcagcatctttctg

SEQ ID NO: 82439 - DNA, 87 bp, Mus musculus
ggaatagaggtctgtctgtccgtctgtaacaatggtttccagacttaagagctatggcagcacagaggtacgtggagcatctcgtcc

SEQ ID NO: 82440 - DNA, 114 bp, Mus musculus
tgagttataataagttatggtatattgggctggagagatggctcagcggttaagagcactgactgctcttccaaaggttctgagttcaaatcccaacaaccacatggtggctca

SEQ ID NO: 82441 - DNA, 105 bp, Mus musculus
atgtgtctgtgtgtatgtgtgcttgtgcatgtgtctgtgggcggcataactgtatgtctgtgtctgtgtgtatatgtgtctctgtatgcatgtgtgtgtgtgtgt

SEQ ID NO: 82442 - DNA, 68 bp, Mus musculus
agtctggtttagctgagagttggcactgagctcagaaatgcttccacaccttaccgcaggtccaggct

SEQ ID NO: 82443 - DNA, 67 bp, Mus musculus
cagacactgtggcttacacctgtaatgccagcacttgggaggctgaggtaggagcatgaagagtttg

SEQ ID NO: 82444 - DNA, 100 bp, Mus musculus
cgtgctcccaaatacatgttctttatctgttgtctgttttttgttattttttttaagtcataaaacacaagttttggacaatgaggaatatgtatgtatg

SEQ ID NO: 82445 - DNA, 97 bp, Mus musculus
tgctatatcttgctggatcctgtccctcttatcagcctggttatgatggatttccttgagtcaggctgtctctgagtgtgggagggtgtctggagca

SEQ ID NO: 82446 - DNA, 85 bp, Mus musculus; identical to SEQ ID NO: 57439

SEQ ID NO: 82447 - DNA, 85 bp, Mus musculus; identical to SEQ ID NO: 57439

SEQ ID NO: 82448 - DNA, 120 bp, Mus musculus
ctacacggcatgtggatcagctccaaaggcgaaaaccccacttgaagctgctgagttgtctgtctgtcagtagaaagggtctctgggcatctgttttgttagttctgagtattcgctgtg

SEQ ID NO: 82449 - DNA, 116 bp, Mus musculus
gaagagaacattctaagtagaaagcagaagctgatttaaagtttttatatctatcatttcagtgtttaattagattagtatttttcctcagtttttttcttctgaattttctgttt

SEQ ID NO: 82450 - DNA, 83 bp, Mus musculus
cgcttgcatgctgaggaacacaagagagatactagactaaaataaatatttaagaggtttttccctaagccacagcagcagcg

SEQ ID NO: 82451 - DNA, 164 bp, Mus musculus
tatatgtctgttttaaaaattatattatataatatatatttacatatatgtgtgtatatatttacatatatatgtgcatatatatacatatatatgtgtatatatatttacatatatatgtacatatgtatatatatatatatatatatatatatatatatata

SEQ ID NO: 82452 - DNA, 106 bp, Mus musculus
ttatgtgtgtatatgtatatgtgtatatatgtgcatgtatgtttgtatgtatctgtaaatgtataagctttttgtatgatatatatatgtatatatatatatttag

SEQ ID NO: 82453 - DNA, 115 bp, Mus musculus
taagaacaaacaaagaaaaatacaaattgagaggtaagaaaatcagagaagttggaaattaactgtagtgtttttgttcaattctttcacctgtttgtgttttccttatttcttg

SEQ ID NO: 82454 - DNA, 101 bp, Mus musculus
ctgatatccgtgtcatacagaggaatctacatgatacagagaacacttttgaaatgtgtgtctgtgtgtctgtccttcattccttgtgcatccatagtcag

SEQ ID NO: 82455 - DNA, 75 bp, Mus musculus
gaatctgtgtctctcattgtttctgaattgagtcttttaccattcaagaactcggtactcggtgagtataggttt

SEQ ID NO: 82456 - DNA, 111 bp, Mus musculus
gtggaacatgcattggcaatgagactgggactgtaaacctcaagttttatttttatgaaactatattgagtatatatttgtgtttagcatttaggtgaatatatgttgcat

SEQ ID NO: 82457 - DNA, 145 bp, Mus musculus
atatatatatatatatatatatatatatacacacacatatatataaactgtgtgtatgctatatgtataatgtatatgtatatgtatgtatatatacatatacactacacatatacatctatacatatacatgtatatatacata

SEQ ID NO: 82458 - DNA, 115 bp, Mus musculus
tatatatgtatatacatatatacatatatacatatattactattatatacatgtatgcatatatatgtatatacatatatacatatatacatatatacatatattactattatat

SEQ ID NO: 82459 - DNA, 63 bp, Mus musculus
atgtatatgtgtagtgtatatgtatatatacatacatatacatatacattatacatatagcat

SEQ ID NO: 82460 - DNA, 75 bp, Mus musculus
ttggggaccacagtagactgtgatgcatggaaataggtttatatgatgtctatctgtctgtctgtctgtccgtaa

SEQ ID NO: 82461 - DNA, 89 bp, Mus musculus
aaaaaggtagaacaatagaaaagtgttagttaacttaaatctttcttagatcatgaaactttcatttattttattgagtgtgccttttt

SEQ ID NO: 82462 - DNA, 85 bp, Mus musculus; identical to SEQ ID NO: 63901

SEQ ID NO: 82463 - DNA, 77 bp, Mus musculus
tgtgtcattactgctcagagggttctaagctgggtgaggtgagagtgtgcttagtgccttcaaggactatgaacaca

SEQ ID NO: 82464 - DNA, 106 bp, Mus musculus; identical to SEQ ID NO: 64183

SEQ ID NO: 82465 - DNA, 85 bp, Mus musculus; identical to SEQ ID NO: 57470

SEQ ID NO: 82466 - DNA, 91 bp, Mus musculus
gtgttgttcagtttccacgtgaatgttggctttctgttattttttttgttattgaagatcagccttagtgcatggtgatctgataggatac

SEQ ID NO: 82467 - DNA, 65 bp, Mus musculus
gggtctgtggattgtagtgtggttatcctgtactctatggctaatacacctaaatccctagatcc

SEQ ID NO: 82468 - DNA, 106 bp, Mus musculus
agaattcctgagctctgtccaaaatttggctttgggtctctgcatctctctcaatcagcttctctgtggagactgtcagagggacagttatgctaggctcctgtct

SEQ ID NO: 82469 - DNA, 103 bp, Mus musculus
ccctgaaattctttcagacaggaacaattaaaggtcagagttgtgactgtggtgtggcaaccccatccctcacttgacaccttgtcttcctgctggaggtggg

SEQ ID NO: 82470 - DNA, 96 bp, Mus musculus
gatcagccttagtccatggttgtctgacaggatgcatgggacaatttcaatatttttgtatctgttgaggcctgttttgtgaccaattatatggtc

SEQ ID NO: 82471 - DNA, 105 bp, Mus musculus
tgttaccctctatcagcagaccttggagactagctctctcctctgagttttagtggtcagaacagtctctgcaggcaaggtctcctctttcatggaaggtgcaca

SEQ ID NO: 82472 - DNA, 80 bp, Mus musculus
ctgtgctcacatgtgtgtcagcactcttgtgtggccagctcccccctggcagaacacatgtatggaaaagtgtgacgcag

SEQ ID NO: 82473 - DNA, 75 bp, Mus musculus
agcttgcaactctagctccatgtgatatgccactctgttttggcctccatgggtacactacaaaacatgcaggct

SEQ ID NO: 82474 - DNA, 75 bp, Mus musculus
taccactgaatttagtgtgcacacatagcacccttagggttatagttccatgtgtgtcattgtgttctataggta

SEQ ID NO: 82475 - DNA, 100 bp, Mus musculus
gttcctaagcccacagtgaactggttttgccaggagagagctgttcttccaggactgctgtcacaggctcacagactcacaggaggaacaagcttcagcc

SEQ ID NO: 82476 - DNA, 85 bp, Mus musculus; identical to SEQ ID NO: 57470

SEQ ID NO: 82477 - DNA, 85 bp, Mus musculus; identical to SEQ ID NO: 57439

SEQ ID NO: 82478 - DNA, 83 bp, Mus musculus
acataaggaatcctccccaattcattcaatgaagccacagttatgctgtgtattattctttggatatggaatgatttttgtgt

SEQ ID NO: 82479 - DNA, 75 bp, Mus musculus
ggggacaggacattaattcagatctgtataactctcagtctctatgagatgtactcatcctattgcactgtctgc

SEQ ID NO: 82480 - DNA, 92 bp, Mus musculus
ttggtcgtggcggcctcgaaggagctgtgtcaccagggaactgagaggctcctcacagaactgagtgacttggggtatcgagtttcggctaa

SEQ ID NO: 82481 - DNA, 73 bp, Mus musculus
tctctcagccacagtctctgccaagccagtcagccatgggacaggcaagccaaagactcttgtgaccgtggga

SEQ ID NO: 82482 - DNA, 81 bp, Mus musculus
gcagatgttatatgtatatatatatatatatatatatatatatatatatatatatatgtgtgtgtgtgtgtgtgttagata

SEQ ID NO: 82483 - DNA, 102 bp, Mus musculus
tggaaaaacaaatgtctactcttatataattttacataatgcaatatatatataattatatataatttatgtgaatgtgtttaagtgttgcatggtactcca

SEQ ID NO: 82484 - DNA, 92 bp, Mus musculus
tgtagaatggccacacttaagtatgcgaatgttttatatgctttgtatagtacaaagaatgactacattctactttgtgttaggttcctgca

SEQ ID NO: 82485 - DNA, 85 bp, Mus musculus; identical to SEQ ID NO: 57470

SEQ ID NO: 82486 - DNA, 85 bp, Mus musculus
ggccatggtggtctgataggatacaggggacaatttcaatatttttgtatctgttaagacctgttttgtgaccaattatatggtc

SEQ ID NO: 82487 - DNA, 90 bp, Mus musculus
cacatctatattggtcaggatctgtcagtgcctctcaggaatgcctatcaggctcctgtcagcaagcaatttttgacatccacaagagtg

SEQ ID NO: 82488 - DNA, 93 bp, Mus musculus
taccttttaagtttcagcagtgattttgattatttctttccaaccacagttgtggagtatgatttctttttttttgtctagagctttctggtg

SEQ ID NO: 82489 - DNA, 60 bp, Mus musculus
gtatgtttgtatgtatgtatgtatgtatgtatgcatgtatgcatgaatgcatgtacatat

SEQ ID NO: 82490 - DNA, 85 bp, Mus musculus; identical to SEQ ID NO: 57439

SEQ ID NO: 82491 - DNA, 85 bp, Mus musculus; identical to SEQ ID NO: 57439

SEQ ID NO: 82492 - DNA, 114 bp, Mus musculus
tggaatatcttggtttctccatctatggtaactgaaaggtttgctttgtatagtagtctgtgctgtcatttgtgttttctgagtgtctatatgagatctgcccaggatcttcta

SEQ ID NO: 82493 - DNA, 89 bp, Mus musculus
tgtatatgtatatgtatatgtatatatatatgtatctttaaatatctgcagataatatactatatatgtttctatatacatgcagtaca

SEQ ID NO: 82494 - DNA, 102 bp, Mus musculus
attcagcagcatgtaaggatcacagatgggtgtttttgagagagtagtttggtcacatattgattttataaatatctttcgatttttgacatgagggggaat

SEQ ID NO: 82495 - DNA, 76 bp, Mus musculus
aactgaaacagtctgactctgtgacaggcttcaaactagcctaagtttttgtttcccagaattgggcaagtcagtt

SEQ ID NO: 82496 - DNA, 114 bp, Mus musculus
tcagtggtacaagtttcctgtagggattttttagggtaatatatatatatatatatatatatatatatatatatatatatattatcatatcatctgctaagaaaaatactttga

SEQ ID NO: 82497 - DNA, 143 bp, Mus musculus
acaggagatatgtgtgtgtctgtgtatatatatatatatatatatacacacacacacatatttgtatgtatgtaaatgtgtatatatgtatatacatatatgtatatatgtacatattcatatatatatgtgtgtatatgtgt

SEQ ID NO: 82498 - DNA, 72 bp, Mus musculus
gctccatatgcatatgtaagtatggatgtgtactttaagtatgtaactgtaagaatgtatgaatgtgtgtgc

SEQ ID NO: 82499 - DNA, 72 bp, Mus musculus
gactcagtaagctttactgctccacagacactgacagtctcagcatgctggagcctaggaagcttccagagc

SEQ ID NO: 82500 - DNA, 56 bp, Mus musculus
accgtctgtctttctgtcactcagtagcatactgagtttacaaagagcagaagggt

SEQ ID NO: 82501 - DNA, 126 bp, Mus musculus
gggggggggatggggggttgagactgggtttctctgtatatccctggctctcctagaactcactctgcagaccaggctggcctcaaactcagaaatctgcctgcctctgcctcccaagtactggga

SEQ ID NO: 82502 - DNA, 88 bp, Mus musculus
tgcatctatgtattcatgtatgtatgtggtgtatataatctaatttatgtatttatcttcatatgtattatttctttatacatgtgca

SEQ ID NO: 82503 - DNA, 73 bp, Mus musculus
gaggcaggaattgagccagactctgtgtagaaagagtgctccctgtagtctctggcttagtcccaggtagctc

SEQ ID NO: 82504 - DNA, 139 bp, Mus musculus
atatgtgtgtgtgtgtatatgtatgtctgtgtatatatgtgtgtatatatgtatacacacacacatatatatatatatatatatatatatatatatacatatatacatatatatatatataacatacatactgtggtgt

SEQ ID NO: 82505 - DNA, 84 bp, Mus musculus
tctaatgtatgcagtgtagcagctttaggtttattcagatagattttgtttgcctagtcgctctgtctctgtctacatttctga

SEQ ID NO: 82506 - DNA, 80 bp, Mus musculus
tctttgctgcttctgctgacaattgtgtaaggtaattaaattggctgattgaagtcacagtggtcatggggcaataaaga

SEQ ID NO: 82507 - DNA, 109 bp, Mus musculus
aagaacttccaaatgtgctattatcaatgttgggtgcttgagattatatttgtttatctacttggttcagtgtgctcagaatatatagtagcaacatcatgaagctctt

SEQ ID NO: 82508 - DNA, 82 bp, Mus musculus
gttggctatgagcatctgcatctgtattggtcaggatcttgcagagcctattagaagacagctgtatcaggcttctgccagc

SEQ ID NO: 82509 - DNA, 78 bp, Mus musculus
tatatgtatgtgtttctatatgtgtgtatgtgtatctctatgtatatatgtatatatatgtgtttgtgtgtatgtgtg

SEQ ID NO: 82510 - DNA, 64 bp, Mus musculus
atgtatgtatatatgtgtgtgtatgtagatatgtatctatatatgcataaatgtatatatgtat

SEQ ID NO: 82511 - DNA, 58 bp, Mus musculus
gtgtatatatgaatgtatgcatatatatataattatgtgtatatgtacatgtgtatat

SEQ ID NO: 82512 - DNA, 110 bp, Mus musculus
gtggaaaaattcttgtagactatatatatgtatgtatgtatacatatatatatatatatatatatatatatatatatatatatatattgtggttcatgtatttaaaacat

SEQ ID NO: 82513 - DNA, 83 bp, Mus musculus
catgggacattttcaatatttttgtatctgttgaggcttattttgtgtacaattatgtggtcagttttggaaaatgtaccatg

SEQ ID NO: 82514 - DNA, 85 bp, Mus musculus; identical to SEQ ID NO: 57439

SEQ ID NO: 82515 - DNA, 98 bp, Mus musculus
ctgtcacatgtgaacaacccaccacatttttcttttgaatgaatgaatgaatcaatcaatcaatcaatcaatgatgcagtggtcttctatctgtgtag

SEQ ID NO: 82516 - DNA, 111 bp, Mus musculus
gttaagagtataaagatatggagctggagagatggctcagcggttaagagcactgactgctcttccaaaggtcctgagttcaaacccagcaaccatatggtggctcacaac

SEQ ID NO: 82517 - DNA, 105 bp, Mus musculus
ttggacacctgtcctctggtcgggtcggtggccggctgtctgaggcccgcaaagggtgctgcctcagtggctctgtgcctctgcctgtcccagaagctgtccggt

SEQ ID NO: 82518 - DNA, 65 bp, Mus musculus
cagtcatgtagttgcttctatactgataaggtcatcagccaagatggaagagacccacatgactg

SEQ ID NO: 82519 - DNA, 116 bp, Mus musculus
gccttagtgcatggtgatctgataggatgcatgggacaatttcaatatttttgtatctgttgatgcctgttttatgacctattatgtggtctcttttggaaaaggtaccatgaggt

SEQ ID NO: 82520 - DNA, 106 bp, Mus musculus
gccttagttcatggtgctctgataggatgcatgggacaatttcaatatttttgtatctgttgaggcctgttttgtgaccaattatatgaccaattttggagaaggt

SEQ ID NO: 82521 - DNA, 85 bp, Mus musculus; identical to SEQ ID NO: 57470

SEQ ID NO: 82522 - DNA, 99 bp, Mus musculus
catcctcttaggcgtattaagtaaagcatgcacttaatgtgctgtaatagtagtacatttatttatttaattgcgtgtctttctgcctgtatgagtttg

SEQ ID NO: 82523 - DNA, 77 bp, Mus musculus
gtgtcatctgcccgggtattgactgttgaatcttttttttttaccaatcacagttaactggggccagggttactcac

SEQ ID NO: 82524 - DNA, 83 bp, Mus musculus
gggggtaaaaacaactcagagagtgcagacttgtaacctaggtctgatgccatgcctgtgattcaatttttattttagctccc

SEQ ID NO: 82525 - DNA, 92 bp, Mus musculus
agccttagtccatggtaatctgataggacgcataggataatttcaatatttttgtatctgttcaggcctgttttgtgaccaattatatggct

SEQ ID NO: 82526 - DNA, 87 bp, Mus musculus
gcaagacagagagacagagacagaggcaaagacagagacaggatgaaagttaattgactttgcttgttgtttttgttgggactgggc

SEQ ID NO: 82527 - DNA, 117 bp, Mus musculus
aatacagatgacatgcctacgatgatattctgttgtgacaaaaataaagtgattttgtagatgtaattaaggatcaaaatctactgatggagttagtataaggcagtagatcttatt

SEQ ID NO: 82528 - DNA, 111 bp, Mus musculus
gtctgtggtcttgtgtgtacctgtatggtgtgtctgtatatatctgtacatacacacacacacacacacacacggattgatagataggtggatacttgtgtgtatgtgtat

SEQ ID NO: 82529 - DNA, 85 bp, Mus musculus
ccagggtgtcagataaatgagattttgtagtaatctatattgactatccttgaaatctcagctcaaagtgtcacacacactctgg

SEQ ID NO: 82530 - DNA, 116 bp, Mus musculus
gccaacaagtgcttgctgataggagcctgatatagctgtctcctgagaggctctgtcagtgcctgacaaatacctaaggggaggctcacagcaatccattggactgagcacagggt

SEQ ID NO: 82531 - DNA, 131 bp, Mus musculus
tatatatacacacacatatatgtatatgtatatatatacacacacacatatatatatgtgtatatgtatatgtgtatatgtatatgtgtatgtgtatgtgtatgtgtatgtgtatgtgtatgtgtatgtgt

SEQ ID NO: 82532 - DNA, 84 bp, Mus musculus
ctctgtaactcaatccataggtgttttgttcccaattctaagaaggggcaaagtgtccacactgtggttgttgttattcttgag

SEQ ID NO: 82533 - DNA, 85 bp, Mus musculus; identical to SEQ ID NO: 57439

SEQ ID NO: 82534 - DNA, 99 bp, Mus musculus
gcggtgcactcatgtgtgactatatatatgtatatgtatatatatatatatgtacatatatatatatatgcatgtgtgagcacatgtgtgagtgtgagc

SEQ ID NO: 82535 - DNA, 95 bp, Mus musculus
gatccagggcagtatggaaatgatgctggaatatgaaaatgaagcccttggaagaggtttcactgtttgcttatgatctttccctggcctgggtc

SEQ ID NO: 82536 - DNA, 107 bp, Mus musculus
actctgtattttctttatgagtttaggaattctgtcatttttatcatcatttttgaatgaatgaatgaatgaatgaacacaggactgaatgaatatataaaagagtg

SEQ ID NO: 82537 - DNA, 71 bp, Mus musculus
tggttggctgcaagcatctgcctctgtatctgtcatgctctgacagaatctctcaggagacagccatatca

SEQ ID NO: 82538 - DNA, 96 bp, Mus musculus
gatcagccttagtcctttgtgacctgataggatgcatgggataatttcaatatttttgtatctattgaggtctattttgtgactggttatatggtc

SEQ ID NO: 82539 - DNA, 124 bp, Mus musculus
catatatatgcatatatatatatatgtgtgtgtgtatatatatacacatatatatacatgtatgtatatatatacatatatatgtatacatgtatgtatatgtatgtatgtatgtgtgtatgta

SEQ ID NO: 82540 - DNA, 75 bp, Mus musculus
agattctgggacagcccatacctatttggtcaggccctggcttctgacttagtatctctgtctctccctaaatct

SEQ ID NO: 82541 - DNA, 77 bp, Mus musculus
ggcatgtgtctgtgtatctctgtgtgttcggctctcatttacaaatgtcagcgtttagtctgatgatagcacatgcc

SEQ ID NO: 82542 - DNA, 106 bp, Mus musculus; identical to SEQ ID NO: 65977

SEQ ID NO: 82543 - DNA, 103 bp, Mus musculus
gtaacttgcctatggtatacagttcattctgcatatgcatgcatgtatgtatgtatgtatgtatgtatgcttatgtaggcatacattatatatgttttatata

SEQ ID NO: 82544 - DNA, 80 bp, Mus musculus
acttctgttagtttcactgtgtctctgtttactttctgtttccaggatctgtccattgatgagagtgggggtgttgaagt

SEQ ID NO: 82545 - DNA, 76 bp, Mus musculus
gcctggagaaagctggtttcccaagagtgctgacagacctacaattacagactcacaggctcacagactcacaggc

SEQ ID NO: 82546 - DNA, 81 bp, Mus musculus
cagttgtgtagaacatactgttaggtgctgagaagaaagtatattcttttgttctaggttgaaatgttctgtacatatctg

SEQ ID NO: 82547 - DNA, 86 bp, Mus musculus
tattcaaatggatcactggagataacagatgtggctactaaagtgtttttgtagtttactcaacactgactccgtgattctgagtg

SEQ ID NO: 82548 - DNA, 99 bp, Mus musculus
catatacatatctttatgtgcactgtatatatttatatatagctatatttatgctgaatgtgtctatgtgtatatatgatgtagatatttatctgtatg

SEQ ID NO: 82549 - DNA, 113 bp, Mus musculus
ccttcccctggggcctgtcagtattgttcagagaaatgctggtattatataaatgtcattttatttaactgcataatagctttttcacagctgactttttccaaaggaaaagg

SEQ ID NO: 82550 - DNA, 89 bp, Mus musculus
agtctgtattcaggaagaggaggggaatgcatgttggtccttacatgacatgctcttttttatttaatcttgaactgtaccgtatagct

SEQ ID NO: 82551 - DNA, 105 bp, Mus musculus
gcatttgcctcactgataatgaagggcaaatattctgtaaggtatccctgactctcactgtctccctatctaagatgcagccaccatatcgctaggggcaggagc

SEQ ID NO: 82552 - DNA, 85 bp, Mus musculus; identical to SEQ ID NO: 57439

SEQ ID NO: 82553 - DNA, 81 bp, Mus musculus
gcagcaactccagccccggtcactctccagtctctactccttaggttaaaggcgagtgatgtgagggtggaggagagctgt

SEQ ID NO: 82554 - DNA, 87 bp, Mus musculus
tgtagtgggatctgatgtacttttgtggtgtgtgtgaagagagtgtactcacacacattttaaaaaagagcttggggtttcactata

SEQ ID NO: 82555 - DNA, 73 bp, Mus musculus
aaatctgcaaggccttaggacctagtttaagcaagcagtcacactgtctgtctggaatgaaggcagtagattt

SEQ ID NO: 82556 - DNA, 85 bp, Mus musculus; identical to SEQ ID NO: 57439

SEQ ID NO: 82557 - DNA, 87 bp, Mus musculus
gcttcataacttctgttagtttcactgtgtctctgtttagtttctgtttccaggatctgtccattgatgagagtagggttttgaagt

SEQ ID NO: 82558 - DNA, 114 bp, Mus musculus
ctctctctgcgggacaatgggagttctttcacttgatagtgcatcgtctttcatgttctgtggaatgaatcgtgctccatgtgcaggtgtggagtctcccctttgcaggtagag

SEQ ID NO: 82559 - DNA, 82 bp, Mus musculus
ggtagtttccagtccgatgtggtcccttgtctcaacaaacaaggtagttggtgactgacgatgacaggattgttctctggcc

SEQ ID NO: 82560 - DNA, 79 bp, Mus musculus
acatggtggttgtaaaatcacactagctgtgcattgtttcttgctcacttgttaagtgagattttgttgttgtccatgt

SEQ ID NO: 82561 - DNA, 95 bp, Mus musculus
tctgctgtaaaggccttttttacatacattgtcattcccatatctatccgagagggatagagagagacagagagtcagagagacagagacagaga

SEQ ID NO: 82562 - DNA, 107 bp, Mus musculus
gtttgtgctgaaggatgttaataaggatgctgagtaaagattcactgctgtgcagattgcatagatggatgttcattagagcacatggtctcttctcaattataagc

SEQ ID NO: 82563 - DNA, 95 bp, Mus musculus
atcttctgggaaatgtctcttgagagtcagcacacagaagctgtgttctagaggtgaacagctaattttggtactgtaagagtcacccaggtagt

SEQ ID NO: 82564 - DNA, 85 bp, Mus musculus
ctttgattgtgactgggccctggttcttccccattaaagtaagaaagactttatttttgattttacaggagcccatagttgagag

SEQ ID NO: 82565 - DNA, 90 bp, Mus musculus
cataatatgaactatctctgacagcaagttgttatgatacagtaatccctgtataatccatgacctgactgtctgggaggtatcggaatg

SEQ ID NO: 82566 - DNA, 83 bp, Mus musculus
cacacacacacacacacacacacacacacacacatacacacagagaatatgccatggtgtgtgtgtatgtctgtgtgtgtgtg

SEQ ID NO: 82567 - DNA, 118 bp, Mus musculus
agattgccagagatggaaagcagatctcaggcagggcctgttggagttgacttgtgtttttgaagttcctgcgatcaccagcggctgtgtgtctggcttactcctcaaaagcagatct

SEQ ID NO: 82568 - DNA, 67 bp, Mus musculus
catttgtgacacctgtcatactgtgtctctttttcagggaaaagcaaagacaaggtgtcactccatg

SEQ ID NO: 82569 - DNA, 106 bp, Mus musculus
ggactaagaaaatgaggagaggctggtgagatggctcagtgattaagagcactgactgctcttccagaggtcctgagttcaaatcccagcacccatattgtggctc

SEQ ID NO: 82570 - DNA, 112 bp, Mus musculus
cagtgctatttcctctttttgatcagtgtaaatgaatgtgtggtgaatacataacacacacagcacacacactccattcgcgcagctgaagagctaggttatgatggcattg

SEQ ID NO: 82571 - DNA, 57 bp, Mus musculus
gtatgtgcatgagcatatgtgtgtatttgctgtgcctgtgtgtgtctgtgtatgtgc

SEQ ID NO: 82572 - DNA, 71 bp, Mus musculus
actatatatgtaaatatgtgtgtatgtgtatgtatgtatatacatatatatgtacatatttttatgttggt

SEQ ID NO: 82573 - DNA, 115 bp, Mus musculus
gacttcaaacagaaactctgatgggtagtgtgagcatgggtggtgggacaatgaaaacatgtatgtcctagactcctgcagatgcagcgtgggtcaaaggtgagctggatggagc

SEQ ID NO: 82574 - DNA, 108 bp, Mus musculus
gctacttttcttgttgggtgggggttggcgtggtgataggggttgtcacagaagccttctatgtcactctgtctcaactctgcctctgcagtatcactggaaagtagt

SEQ ID NO: 82575 - DNA, 98 bp, Mus musculus
gccttatggtcttccctctggaagcttgagacccaggaaagcaggagctgtctctgggtctcagagactgactctgaaggcctgagatccaagggggc

SEQ ID NO: 82576 - DNA, 77 bp, Mus musculus
ctgaatcccattgaacttgcatgctttggtgagcttaagctataagaggcaggggtgagtgaatacactgggcacag

SEQ ID NO: 82577 - DNA, 79 bp, Mus musculus
tagctctcagactggaagagaaaacagaaggttcatctaggaaaccctttgcctctgcttctgacacactcggagtctg

SEQ ID NO: 82578 - DNA, 116 bp, Mus musculus
ttctgtaagcacagtgcttgcttggtggtgatggagacaatagggcttgtagggtttcctggctgcctgcctgcctgcctgtgtccaggtccattgagtgaccctgtatcacagga

SEQ ID NO: 82579 - DNA, 106 bp, Mus musculus
gccttagtccatggtgatctgataggatgcatgggacaatttcaatatttttgtatatgttgagacctgttttttgaccaattatgtggtcaattttggagaaggt

SEQ ID NO: 82580 - DNA, 85 bp, Mus musculus; identical to SEQ ID NO: 57470

SEQ ID NO: 82581 - DNA, 93 bp, Mus musculus
gtgttcttctaggccagtttctgctctcatcatgatgtagaataacggtgccattcaatgagagcatctgcatgtccttgtactgaaaaatac

SEQ ID NO: 82582 - DNA, 104 bp, Mus musculus
ccctaaaccactgactcatcattgcctgagcatatgatggtctgatttcaaaaagaagagacacattatgcttgttcaactctagatttgcagatatctcaggg

SEQ ID NO: 82583 - DNA, 99 bp, Mus musculus
gaaaatcagggtgacttctaagtcattgctctgcaaacagtaaacagtgagcagtcataagatgtgaatgactagggaagaagctagaacaaggctttc

SEQ ID NO: 82584 - DNA, 139 bp, Mus musculus
atgtatgtatatgtgttcaatgtgtgtatatatatatgtatatgactgatttatgtgattcatatgatatatgtgtgcatgtgcatgcatatgtatatacatatgaatatgcatacatatggtatattatgtgtgtata

SEQ ID NO: 82585 - DNA, 115 bp, Mus musculus
catgttggtaaagcaatatggaaacagctagtaatgttatgaggacacaaaagtgaatttcttgatgtgatacatagcatataagcctatgtccacttgcctgctgaatctagtg

SEQ ID NO: 82586 - DNA, 112 bp, Mus musculus
ttctcctttctggcacattcagatatgatatatataggatatatgttttatatgtacatatatatatatatgatatatggtgagtgagtgtgtgtgtgcgtggggggggggg

SEQ ID NO: 82587 - DNA, 94 bp, Mus musculus
tccaaaaatctgtcagcatatagattgctacctttccttgtatatatttttctaaaggatagataaaagttagtaagctattgctcagaatgga

SEQ ID NO: 82588 - DNA, 62 bp, Mus musculus
tatatgggtatatgaatatgtttatatgtgtatacatgtgtgtgtatctatatatccatgtg

SEQ ID NO: 82589 - DNA, 105 bp, Mus musculus
caggaagtaggcagccaatggcttcaccaaataaatgagttttctagcaccaatggaactttcagatgacagtgaccaaataagtcagggttgaccatctgtctg

SEQ ID NO: 82590 - DNA, 111 bp, Mus musculus
gaaaattgaggtcacaggttttttgcattgactcatttgtgtgtatgtatatatgtatgtgtgtgtctgtacatgtgagtattaatgtgtgtgcttgtgatgacatgcatc

SEQ ID NO: 82591 - DNA, 119 bp, Mus musculus
atcagccttagtccgtgatgatctgataggatgcatgggataatttcaatatttttgtatctgttgaggccctgttttgtgaccaattatgtggtcagttttggaggaggtaccatgat

SEQ ID NO: 82592 - DNA, 70 bp, Mus musculus
cacatataacacatgtactaaatacatacatacatacatacatatatatgtatatatacatgtgtatgtg

SEQ ID NO: 82593 - DNA, 66 bp, Mus musculus
ggaccttcttgggtcagtctgactctgggtgtgagaaaacgtctggagtgtctgggccatacctcc

SEQ ID NO: 82594 - DNA, 96 bp, Mus musculus
gtgcatacaagtggggtttatagtgagtttatgaaatattttaagagtatataattttattctatgaaactatatcatactttgctatttatgtac

SEQ ID NO: 82595 - DNA, 82 bp, Mus musculus
ataaggtgtctttaagatttgcaaggctagtgtaaccaacagatggtcagctactgcatgtgcaagtacacacacatattat

SEQ ID NO: 82596 - DNA, 86 bp, Mus musculus
cttttgtgtgtgtatatgaatatattttaggaagcttctagaatagtaggcttccacaatatattttcaaatgtcatttttaaaag

SEQ ID NO: 82597 - DNA, 77 bp, Mus musculus
aagtcacattatgcatgtatgtatatatgtatgtatgtatgtatgtatgtatgtatgtatgagagatagtgtaattt

SEQ ID NO: 82598 - DNA, 79 bp, Mus musculus
tggtgatttagtgcagacatgtgggtcctggcttgacttgcctcagctcagactctctgataatctgccttaccctcca

SEQ ID NO: 82599 - DNA, 92 bp, Mus musculus; identical to SEQ ID NO: 57641

SEQ ID NO: 82600 - DNA, 139 bp, Mus musculus
agtcatatattctcattatttgtcatacatgcatatattctttatatatgtatgtgtggtgtctctgtatatgtatatgtgcttaggtgtggttcttctatatttatattgtacatgtgtgtatgtttgtatgttatat

SEQ ID NO: 82601 - DNA, 85 bp, Mus musculus; identical to SEQ ID NO: 57470

SEQ ID NO: 82602 - DNA, 85 bp, Mus musculus; identical to SEQ ID NO: 57470

SEQ ID NO: 82603 - DNA, 80 bp, Mus musculus
tttacgtgtgtgcaactgtgtgtgtgcatgtgtatgtgtagtatgtacattatgcatttacattagtttacatatataag

SEQ ID NO: 82604 - DNA, 110 bp, Mus musculus
taatatgattttatatatacgtgtgtgtatatgtgtatatatatatgtatatgtaaatatacatatataaatatacatatatatatttcatcagccttattacaatgtta

SEQ ID NO: 82605 - DNA, 74 bp, Mus musculus
gctggagtaaagagtcagagctcacagctggacaggcaggacacagaccagactgtgcactctcacttctcagc

SEQ ID NO: 82606 - DNA, 98 bp, Mus musculus
ctttgcctattttccttgtcacttaagaagagagctagaaagaagtatacatcagattattctctctctctctaagtgttttggttgaagaggcaaag

SEQ ID NO: 82607 - DNA, 99 bp, Mus musculus
gagcaagtgtatgcccatagaaggaggcatctgctgacagaatttgtttatttttctagtggatcagttccttactataagggcctgcaactaatgttt

SEQ ID NO: 82608 - DNA, 78 bp, Mus musculus
cattgatacacaattaagtgtgtgcatgtatatatgtgtatatatatgtatatgtacatatatataatttcatcaatg

SEQ ID NO: 82609 - DNA, 68 bp, Mus musculus
tgtgtgggtatgtatatatacatatatgtatgtttatatctgtatctgtgtgtgtacatgcttgtgtg

SEQ ID NO: 82610 - DNA, 115 bp, Mus musculus
tatatgttttacctacatgtatgtatatatgtatgtatgttctctctctctctctctttcttctctctctctctctatgtacgtgtgtgtgtgtatgtgtgtatgtgtgtgtgtg

SEQ ID NO: 82611 - DNA, 74 bp, Mus musculus
ctgaggttcctggttgagaagacaacagaaccctatctgttgtgtctgtgtgtctctccattttgattccttgg

SEQ ID NO: 82612 - DNA, 85 bp, Mus musculus; identical to SEQ ID NO: 57439

SEQ ID NO: 82613 - DNA, 67 bp, Mus musculus
acacacacacacacacacacatatatgtatatgttatgtatatgtatgtgtatatgtatatgtatgt

SEQ ID NO: 82614 - DNA, 85 bp, Mus musculus; identical to SEQ ID NO: 57470

SEQ ID NO: 82615 - DNA, 71 bp, Mus musculus
gagagagacaaagagagagagagagagagagagagagagactgtctctgactctgtgtctgtgtctctggc

SEQ ID NO: 82616 - DNA, 75 bp, Mus musculus
atatatatatatatatctttgataaactatctattttataaattctatatatgtagaagatatatgtatatatat

SEQ ID NO: 82617 - DNA, 100 bp, Mus musculus
aggtgttaacaaatgttactaatattataatatattattgatatgttaataacacatgaatgttattgatatgtattgatgtatgtggcattagatccct

SEQ ID NO: 82618 - DNA, 76 bp, Mus musculus
gtctctgtgattctgtcttagactctcaagttttatttttgcttttgagactttgtctgagataacccaagctgac

SEQ ID NO: 82619 - DNA, 106 bp, Mus musculus
gccttagtccatggtgatctgataggatgcatgggacaatttcaatatttttgtatctgttgaggcttgttttatgtacaatattgtggtcagttttggagaaggt

SEQ ID NO: 82620 - DNA, 79 bp, Mus musculus
gacttgaactcaggacctctggaagagcagtcagtgctcataactgctgagtcatctctccagtccctctgtctctgtc

SEQ ID NO: 82621 - DNA, 85 bp, Mus musculus; identical to SEQ ID NO: 57470

SEQ ID NO: 82622 - DNA, 85 bp, Mus musculus; identical to SEQ ID NO: 57439

SEQ ID NO: 82623 - DNA, 64 bp, Mus musculus
gtgtcacacccacaaaccaggatgggtggcagctcagcccttcctgactctgtctgtgtggcat

SEQ ID NO: 82624 - DNA, 70 bp, Mus musculus
acatacagacatatgtgtatgagtatatgcatatatatgtgtgtatatatatatatatgtgtgtgtgtgt

SEQ ID NO: 82625 - DNA, 81 bp, Mus musculus
aagtctttagcctgtgtccaggagtctctgtcatagtaaagattttatgtagacagtctcactgtgacttttgtctgactt

SEQ ID NO: 82626 - DNA, 116 bp, Mus musculus
ggtttcagtgctaagagttggaaatcttagacagaagacacatcagagtcagcattgagactcttactaagttgttaatatggaaaaggaaaattcagttcattgacactgaaatt

SEQ ID NO: 82627 - DNA, 82 bp, Mus musculus
gtgtatgtgtatgtatgtatgtatgtatgaatatatatatacgtatatatttgtgtatatacatacacacacacacacacac

SEQ ID NO: 82628 - DNA, 139 bp, Mus musculus
accttatttttacaagactacatacaatttctcatgctaattttttttaaattatgagaatatgtgtgtctgtctgcctgtctctgtgagtgtattcacaaatgtgtttgtgggcacctgaagagaactgggaatgaca

SEQ ID NO: 82629 - DNA, 95 bp, Mus musculus
actgcgatattgattctccctaagctccaaggctgactgtcagattgtctctatgtcagtggctttcttgcttctcggatccttagtctcatagt

SEQ ID NO: 82630 - DNA, 110 bp, Mus musculus
ttactggttggaacatcttctggatatatgcccaggagaggtattgcgggaccctctggtagtactatgtccaattttctgaggaacctccagactgatttccagagtga

SEQ ID NO: 82631 - DNA, 64 bp, Mus musculus
ctctgtctgtctgtatgtctgactgcccgaaagggcattggatcaccttgtagatggttatgag

SEQ ID NO: 82632 - DNA, 116 bp, Mus musculus
gtcccattcttcaactgagtttaacacagccattctcactgggacatatatttatatatatgccatagaccacatccttagagattccattgctgggatagctgcagtacaaggac

SEQ ID NO: 82633 - DNA, 81 bp, Mus musculus
aggctagaattctgagataagagtgtcagtacagttaagctcctgcagacagtcttggagtccctttgaggatactgacct

SEQ ID NO: 82634 - DNA, 80 bp, Mus musculus
cttgggagctggagagatggctcagtggttaggagcactgactgctcttccagaggtcctgagctcaattcccagtagcc

SEQ ID NO: 82635 - DNA, 92 bp, Mus musculus
gggaaaattcttggagtaggatgtttactattgatgctgctaattctaaagtttcagcagtgtggctgcctgatcccattttctctaagggt

SEQ ID NO: 82636 - DNA, 88 bp, Mus musculus
cagcctctgtgcatgttcaccgaagacagagtcagttcccttgaaattacacacctccgctgctgtctgtctgtctgtctggatgctg

SEQ ID NO: 82637 - DNA, 85 bp, Mus musculus; identical to SEQ ID NO: 57439

SEQ ID NO: 82638 - DNA, 80 bp, Mus musculus
cgtgtttcacaagggttgagtggattgatgactgggagggtgtggcacttgtctgaatttgtaaactgtagccctgcatg

SEQ ID NO: 82639 - DNA, 111 bp, Mus musculus
gtcacattgatgctctgagtagggacagggttcatctaggaaatatattttcactcacactctgtatcttttcctagtttggcatattctagtctgcatttggctctctgt

SEQ ID NO: 82640 - DNA, 78 bp, Mus musculus
tgagttctaattctgtcatctattgacttcagatgcatgtgttcttggttggaagctttgggcagagctagggactta

SEQ ID NO: 82641 - DNA, 87 bp, Mus musculus
gtacccctcagagactagaggacagcgttggagcccttggatctggggttacagatgtttgtgagctgacctgtgagtgctgggaac

SEQ ID NO: 82642 - DNA, 81 bp, Mus musculus
gcttaagtatcaagcagaacattggtgagcaagcactcaaatgtttttatatcaatgtttgttgcattatatgtattaggc

SEQ ID NO: 82643 - DNA, 114 bp, Mus musculus
tatatgtaatatatagaaggcatattattgtatatattatatctgtacatacatatatatgtatatatgcatgtacattgaatagttccagaaatatcaatatttttacatgta

SEQ ID NO: 82644 - DNA, 74 bp, Mus musculus
ctgcagtgttgagaggcagggcttggaggggtaaagtatccagatcatgagagctctgactctgtcagtgatgg

SEQ ID NO: 82645 - DNA, 112 bp, Mus musculus
gctctgcactaagtggacagtgctaccccaagcaataacaaaagggggctcactcagtgggtctgatgcagtggatcctgacttgggaagttgtgtgtattcttctgtgggc

SEQ ID NO: 82646 - DNA, 99 bp, Mus musculus
tgatccagacattatgtatgtatgtatgtatgtatgtatgtatgtatgtatgcatgtatgcatgtacgtatgcatgtgcatatgtatatgtgtctgtca

SEQ ID NO: 82647 - DNA, 77 bp, Mus musculus
cttagggggccatgtctgatgggagagagatgaggcctgcagcggggctcactctgcctctctgtggagctcatgag

SEQ ID NO: 82648 - DNA, 83 bp, Mus musculus
gaggacccctctgtcccaggtgactccagtttgtgtcaaaatgacacaaactaaacagcacctctcccaggcctggtctgtgc

SEQ ID NO: 82649 - DNA, 65 bp, Mus musculus
cttgcctgtccttgcagtgagcgtggcttacccctccggtgaccctcactgtgtcacagacaagc

SEQ ID NO: 82650 - DNA, 114 bp, Mus musculus
cacagtaaaaggctccctgaaaaggactctggggctggagagatggctcagtggttaagagcactgactgctcttccgaaggtcctgagttcgaaacccagcaactacatggtg

SEQ ID NO: 82651 - DNA, 71 bp, Mus musculus
caccattgtactgtctttctgggtgttgaggcaggttgtattagacagcagagagagcagaggtgagggtg

SEQ ID NO: 82652 - DNA, 78 bp, Mus musculus
caggaaaaagtggtgcatcttatgattatatatttctgtggctagaccatggaaatacaagatgcgttaatgaacctg

SEQ ID NO: 82653 - DNA, 85 bp, Mus musculus; identical to SEQ ID NO: 57439

SEQ ID NO: 82654 - DNA, 106 bp, Mus musculus
gtgttttaaactctagtcggtgccacaaactaatggtaacttacaggctatcttgtgattctgttgttttcacaagtttacaggctctgactggaaatgatgactc

SEQ ID NO: 82655 - DNA, 67 bp, Mus musculus
gctcagtctcactcagaggctccttgggtgttgaaagttaaggtcagccagtttgggtagttaatgc

SEQ ID NO: 82656 - DNA, 94 bp, Mus musculus
agaagtcgatggatctgtgagttcaaggacagtctggtctacagagcaagttccagaacagacacaccctgactcactatctatctatctatct

SEQ ID NO: 82657 - DNA, 97 bp, Mus musculus
gtggaaagaatgcatgccatcagtgatatggggatgaaagggataaagatttttttattacaatgtcctgcaccttgctcatgaagcagcatgccac

SEQ ID NO: 82658 - DNA, 82 bp, Mus musculus
tggttaaaggtgagactatatatctatgtcccccttctcagtgatgggatcgtgtgtgtgctgtcacagtctctgtgagcca

SEQ ID NO: 82659 - DNA, 92 bp, Mus musculus
ccattgttgcctgtatggtcctactggctctgcaggactgagtgtccacactgtggaggatcctggaaggtcccagagatagtctaacatgg

SEQ ID NO: 82660 - DNA, 115 bp, Mus musculus
aatgtggtacatttgcatactttctgatatagtttggtaactgactgctcttcctgtcagggtagctataagtcacgttcaaaactctaaatctgaagatgaaagaatttatatt

SEQ ID NO: 82661 - DNA, 73 bp, Mus musculus
aggccccactggtaggttgcatggtagggggaaaagagactctctgactgattgcaacttgagcagggagctt

SEQ ID NO: 82662 - DNA, 63 bp, Mus musculus
gcctggtggtcactcacagtgtctcttcatacccacctgtgagaggttcaggtgagcccaggc

SEQ ID NO: 82663 - DNA, 124 bp, Mus musculus
agataagaagtgtctctgagtgctagagagatggctcagcagttaagagcactgactgctcttccagaggtcctgagttcaattcccagcaaccgcatggtggctcacaaccatctgtaacgag

SEQ ID NO: 82664 - DNA, 91 bp, Mus musculus
gtgtgtctgtctgtctgtgtgtgtatatatgtgtatgtgtctgtctgtctgtctatgtgcattttctgccacacacaaaggcagaacccac

SEQ ID NO: 82665 - DNA, 112 bp, Mus musculus
tatgtacatatatggatatgtgtatatgcatatgtatgcatatctctgtgtgtatatatgtatatgtgtgtatatgtacatatatgtgtatatatttttttctgagtacata

SEQ ID NO: 82666 - DNA, 123 bp, Mus musculus
gacaggagaaagtgcatttgagcaggagtctggggacaatggcaggagtctctcactgtgacagtttttcctggtcaccgtcctgggacaggtgcctgggtgactagccagtgtgcctgccat

SEQ ID NO: 82667 - DNA, 111 bp, Mus musculus
catagactgatcaggttacatttatgaatatgtatgtatgtatgtatgtatgtattcatgtatgtacatatgcatatatgcatgcaataacagtgaaaagagaagccatga

SEQ ID NO: 82668 - DNA, 78 bp, Mus musculus
atgtatgtatgtatgtatgtatgtatgtgtatgtatgtatgtgtatgtatgtatgtgtgtgtatctatgtatgtatgt

SEQ ID NO: 82669 - DNA, 79 bp, Mus musculus
ctgatccacagtctgtaagactttcctctttctatatataaatatagatagacagatgacagttggatggatggatgag

SEQ ID NO: 82670 - DNA, 69 bp, Mus musculus
cctctggctctcacactctttctatgtcctcctccccatagatccctgagctttgatgggggttggggg

SEQ ID NO: 82671 - DNA, 69 bp, Mus musculus
acatataatatatacatgtctgtatatgtgttcacatatatgtatagatgtatgtatatattattaagt

SEQ ID NO: 82672 - DNA, 109 bp, Mus musculus
cacatgaatatgcttatctccacttccacagcttgataccatgaagtgacatgtaaacatgtgtgttcataccactacaacatggtactgtggcatggctaattgtgtg

SEQ ID NO: 82673 - DNA, 112 bp, Mus musculus
cttagttttacttttttactttaaattgtgtgtatgtgcttgtatgtatgtgtgtatgagagacagacagacagacagacacagacacacagagtagatatgggccacaaag

SEQ ID NO: 82674 - DNA, 65 bp, Mus musculus
tgtgtgtctgtgtctgtctgtctgtctgtctctcatacacacatacatacaagcacatacacaca

SEQ ID NO: 82675 - DNA, 70 bp, Mus musculus
aggtagagcaggccaatctcagtgtgtttcaggccagccagggctacacagtcagactgtctcaaaacct

SEQ ID NO: 82676 - DNA, 75 bp, Mus musculus
gcagatatttactgagtgccaacttttagtgaggacttatccgtacactgaagattgtcagcaagtgaaacctgc

SEQ ID NO: 82677 - DNA, 152 bp, Mus musculus
gtgcattgtgcaactgtgtgtacaggaaaaccacagtgtgtgtctgtgcatgcttgcctgtgtgtgcctgtgtgcctgtgtgtacatgtgtgtgtgtgtgtgtgtgtatagcaaagccacagtgtgtggaggtcagaggacaacttgtgggt

SEQ ID NO: 82678 - DNA, 70 bp, Mus musculus
gtgtcttatgagttgtgagttgagttaaggaagaaagaagccattagcacagccagactctctgggtcac

SEQ ID NO: 82679 - DNA, 102 bp, Mus musculus
gatcatcatgcctccatcattcaggtgctagaatggcaggcgtggaccattacgcctagtgtagtctgctgtttgttttgagactgttggggtctgggagtc

SEQ ID NO: 82680 - DNA, 66 bp, Mus musculus
ggaagtcagggtagctgtcacttacagtcactctcatgatcagagtgatgaatgcttctggcttct

SEQ ID NO: 82681 - DNA, 81 bp, Mus musculus
gtaaaagtgcagtaagagaagtgagttagctctggtgttctacagcacagcagagtaactacaatcttttttgcaaattat

SEQ ID NO: 82682 - DNA, 96 bp, Mus musculus
ggccacctcctcccttccctcccaggcaatcagtcacactgtcagggctgctgtcctacggctggctgctgctgagctgaaagactgtggtaggcc

SEQ ID NO: 82683 - DNA, 58 bp, Mus musculus
gccctgggagaggaggaagcagcccgaggtaggctgtctgtctgtctgtcctaagagc

SEQ ID NO: 82684 - DNA, 59 bp, Mus musculus
gtgccgctctctcggtggctcagacggtttaagagtgactgggctgggaagaggggcac

SEQ ID NO: 82685 - DNA, 97 bp, Mus musculus
tagtttatctgttctctgcatgatgtcttaggttatctagaagtaccttgaccttgctgttgtagcctgactgacagttaccaaggaggggttgcta

SEQ ID NO: 82686 - DNA, 103 bp, Mus musculus
tggggcgggggaggctgggattgttgtggtgtggtgtttaaagacagaagggagagtgaacattttcatctccagctctatctgatttcttcctttgcagaca

SEQ ID NO: 82687 - DNA, 102 bp, Mus musculus
agtaaaactggagtgggagctggtgagatggctcagaggttaagagcactgactgctcttccagaggtcccatattcaattcccagcaaccacatggtggct

SEQ ID NO: 82688 - DNA, 100 bp, Mus musculus
gtaagcacgctggactggagagatggctcagtggttaggagcactgactgctcttccagaggtcctgagttcaactcccagtaaacacatggtggctcac

SEQ ID NO: 82689 - DNA, 141 bp, Mus musculus
gtgcatgtggagaagtgtgatatttttaaaaccaaatttgtttaaccttgtctctttttctacatgtatttatgtattttattcgaggagcagataacagtcattcgctaagatgcacaggtgcgtgtgtgaaggtcaggg

SEQ ID NO: 82690 - DNA, 111 bp, Mus musculus
gcctgcagctgccagatcacgagcctggcggagtgccaagccatgagactgggccctccacagtctttgtctctctggccttgtgaggcacagtgattcagcaggataggc

SEQ ID NO: 82691 - DNA, 85 bp, Mus musculus
ggttgcttttgtcttatttggagtctcatgtgtagcggtgaattagttaaccagctttggctccgagcaagtcacaggcatatcc

SEQ ID NO: 82692 - DNA, 128 bp, Mus musculus
gtatatatgtgtatgtatgcatgtgtatatgtgtatatatgtatgtatgtgtatatatgtatatgtgtgtatatatgtatacatgtatatgtgtatatatgtatatgtacacacacatacacatatat

SEQ ID NO: 82693 - DNA, 94 bp, Mus musculus
tctagactactagaatatatattagatatatattatatataatagctatgtatagtatataatatattagaaatatatattactggagccagga

SEQ ID NO: 82694 - DNA, 103 bp, Mus musculus
atatacatatatatgtgtgtgtatatgtatataaatatatgtgggtgtgtatatatatgtatatatgtacacatatatatgtgtgtatatgtatatatatata

SEQ ID NO: 82695 - DNA, 89 bp, Mus musculus
atgaatcctaaagtctatgtctctgtcactcagcctgggaggccagtaatctctgatgctgagggtgcatagggactattggggggcgt

SEQ ID NO: 82696 - DNA, 66 bp, Mus musculus
gggggatctctgtgtgcctcactctaagcattttcatgagggctagggatgccagttaagaccccc

SEQ ID NO: 82697 - DNA, 92 bp, Mus musculus
gatcgcacactgtagcttatacactgtaggatcgcacactgtagctctctcactgtaggtccacacactgtaagctagcacactgtaggatc

SEQ ID NO: 82698 - DNA, 98 bp, Mus musculus
ggtgtttagaaatgtatgcataggggctggagagatggctcagtggttaagagcactgactgcacttccagaggtcctgagttcaaatcccagcaacc

SEQ ID NO: 82699 - DNA, 97 bp, Mus musculus
gtctatgtatgtatgtgtgtctcactctgtctctgtctctgttaaaccacctaaaagtctagcctgtgacagtgagtggggtagggcctacctaggc

SEQ ID NO: 82700 - DNA, 76 bp, Mus musculus
ggatggatggatatggaatgtatatagatatagatatagatgatatagatatatgccttcctgtccccctagcgct

SEQ ID NO: 82701 - DNA, 73 bp, Mus musculus
tcccagagatcaaagtgtgcagtctaggagctgagaagcaactttgtgacaggtaccaggtttcctccgggga

SEQ ID NO: 82702 - DNA, 85 bp, Mus musculus
tgtgtgtgtgtgtgtgtgtgtgtgtatgtgtgtgtgtgagagagagagacagacagacagacagacagacagacagacagagaca

SEQ ID NO: 82703 - DNA, 90 bp, Mus musculus
ctctaggtcacagaagctagcctcagaactttgtacctaaactgaggtcaaggccacttctgtctgagcctctgagtctgggatctagag

SEQ ID NO: 82704 - DNA, 92 bp, Mus musculus
agtaagtgtccttggtgagcatctacctggtcttgggggcccccatgcccaacccttgctccggctctgttctgttgatcaggactcttgct

SEQ ID NO: 82705 - DNA, 100 bp, Mus musculus
gtgcatgtgtgtatgtgtgcacatttatgtgtgtgcatgtgtatgtatgtgtgtgtgcatgtgcatgtgtgtaattgtgtatatatgtgcatacatgtgt

SEQ ID NO: 82706 - DNA, 64 bp, Mus musculus
agtgtggccttgagtcagtgccactgtctgtcacgggagagaaagtgtactacagggtgacagt

SEQ ID NO: 82707 - DNA, 73 bp, Mus musculus
agaaaagagcagaggctagcccaaagccccgcagctacggagtacatgagtgtcagctctctgtctcgcttct

SEQ ID NO: 82708 - DNA, 65 bp, Mus musculus
tagggtcctgctgagtagctcaggctggccttgatctcccagtctccctgcctcagtctcctcta

SEQ ID NO: 82709 - DNA, 82 bp, Mus musculus
gaacagggtctctgtctgactggctttgagcttgccgagtaggctagactggctgaccagtgaggctggggatcctcctgtc

SEQ ID NO: 82710 - DNA, 106 bp, Mus musculus
ctctgaaactgtaagccagccccaactaatgtttttctttattaagagctgtcgtgccgagcggtggtgacgcaagcttttgatcccagcacttgggaggcaagag

SEQ ID NO: 82711 - DNA, 70 bp, Mus musculus
gctagcttaggacattcagtgagctccaggtttggtaacagacggtctcacagagtgatgtaagaacagt

SEQ ID NO: 82712 - DNA, 64 bp, Mus musculus
gcctagagtcattgagaagggaagctcagctctgtgactgtctttctctggttggcctaagagc

SEQ ID NO: 82713 - DNA, 93 bp, Mus musculus
aggatgcacagtttagtacagggaggggctggagagatggctcaggcgttaagagcactcagtgctcttccaatggacccaggtttgattcct

SEQ ID NO: 82714 - DNA, 90 bp, Mus musculus
gcaatgtgggggctgagagatgactcagaggttaagagcactggctgctcttccggaggtcctgagttcaaaccccagcaaccacatggt

SEQ ID NO: 82715 - DNA, 63 bp, Mus musculus
gcagctggaggcaaagatgacctaatgataggttcttgtctgtctgtctgtctcctccattgc

SEQ ID NO: 82716 - DNA, 68 bp, Mus musculus
ggaggctgtcatggatacatggacactgctaaacaatgcatgccctgtctgtctgtctgactgctgac

SEQ ID NO: 82717 - DNA, 62 bp, Mus musculus
agtgtgtctctgtgtatgtgtctgttgcaatgtgtgcgcaggtgcaggtcagaagaaaaact

SEQ ID NO: 82718 - DNA, 83 bp, Mus musculus
gcccgacccaggcatttagataggctcaggtgggttctgactggctgagtgtcttcaaattagggaaaaaaaaaataaggagc

SEQ ID NO: 82719 - DNA, 94 bp, Mus musculus
gcaaaatagacaccagtaccaaccactgacaagatagacagctctgtaggtaccaggcagatgagtgaggtgtagctggtgtttgcttctttgt

SEQ ID NO: 82720 - DNA, 110 bp, Mus musculus
gatggttgtgaattttctgattctaccatggctatgtcccaagtgctgaggtcacagatgtgtgtctccacaattggtttatccattcctaggactgagctcacagcttc

SEQ ID NO: 82721 - DNA, 90 bp, Mus musculus
tatatgtatgtgaatatatatgtatatgagtatatatgcatgttagtatctatgtatatatgagtatatatgtataagtatatgcatatg

SEQ ID NO: 82722 - DNA, 76 bp, Mus musculus
agcttcagaggaagagaggtgagccatgccgcaataaggccgggtgacttgtgcttgtctcactgtctctcttgtt

SEQ ID NO: 82723 - DNA, 79 bp, Mus musculus
ctgtgtccctgactctctggcaagcatgacagcaggactgcaggttgagctacacttcagaagtctgggaaaatcatgg

SEQ ID NO: 82724 - DNA, 103 bp, Mus musculus
gtgatgttaaaaagtagtactgggactggagagatggctcagtgggtaagagcactgactgctcttccagagttcaattcccagcaaccacatgatggctcac

SEQ ID NO: 82725 - DNA, 145 bp, Mus musculus
cactcgtgtatatatgcacatatgtatgtatacatatgtatgtgtgtgtgtgtgtatggatatatgtgtatatatatatgtgtgtatgtatatatgtgtgtatgcatatatatgtatgaatgtatctatgtgtgtatgtgtatat

SEQ ID NO: 82726 - DNA, 158 bp, Mus musculus
tatgtatacacatgtgcatgtgtatgtatatatgcatacacatatgtatatgtatatatacatacatacacatacacatatgtgtgtatatatataaacatacatatatatacacatatatgtatatgtacacacacacacacacatatatatatgta

SEQ ID NO: 82727 - DNA, 67 bp, Mus musculus
gtatacgtgtgtatatatatgtatatatgcatgtattatgtatatatatgtgcatagatatacacac

SEQ ID NO: 82728 - DNA, 114 bp, Mus musculus
gcccccatcctttagaatcggcccgagctggaaaaggcaattctgtgtgtgagcagtgtgatgtcacacagatctgcctagacagatgccgggtccaaccctcgggatgctggc

SEQ ID NO: 82729 - DNA, 71 bp, Mus musculus
tgctgctgctccacagccctggctaagtgaggagagtccgtaagcagagacaggagtgagagagggcagca

SEQ ID NO: 82730 - DNA, 80 bp, Mus musculus
ggtgggggtagtcagatgacagagaagaatgtgggcaagtttttggctttttttttttttttggtcttatagcatccacc

SEQ ID NO: 82731 - DNA, 135 bp, Mus musculus
ggcaggtggtcctgggttgtataagaaaacaaactgagcaagccatgggaagcaagccagtcagtcagtcagtcagtcagcagtgccctcctgtggcctctgcctccgttcctgtcttgagttcctgccctgact

SEQ ID NO: 82732 - DNA, 63 bp, Mus musculus
tctgtctctctaaatctctttctggctctctccagcagccgagcaagatgcccagagggaaga

SEQ ID NO: 82733 - DNA, 74 bp, Mus musculus
ctgagtgtcagtctgtctctttccttctctatgctacatagtggcagcaggctgaatagtaaaggtgacttcag

SEQ ID NO: 82734 - DNA, 100 bp, Mus musculus
gaggcaagtggatctctgtgagttcaaggccagtttggtttctttatatatatatagtgaggtccaggctggccaggactacagagtgagagcctgtctc

SEQ ID NO: 82735 - DNA, 72 bp, Mus musculus
gttctcagcctctcagtctctgtgtgctacacggtcatcagctggggcaggaggccaggagaatgtcagagc

SEQ ID NO: 82736 - DNA, 82 bp, Mus musculus
acatgtatgtatgtatgtatgtatatgtgtgcaagtatgtgtgttatgtatgtattgtgtgtatgtgtgtgtatgtatgtgt

SEQ ID NO: 82737 - DNA, 60 bp, Mus musculus
gcagagcttagtaggtggttacccatttggcacagccagtgtctgtctgtcttcctctgc

SEQ ID NO: 82738 - DNA, 62 bp, Mus musculus
ctcactctctctctctgtgagtttgaggccagcctgagagggaaagggagagagagagggag

SEQ ID NO: 82739 - DNA, 103 bp, Mus musculus
cttgggtaagtctgcagctatatatacaactggatccaagactctctctgcatctctgaaacaatgaggtctgaccatttctattcagcccagacaaccttag

SEQ ID NO: 82740 - DNA, 65 bp, Mus musculus
acacgtatttcattatatatacatgtatatatgcattatatgtgtatatttatataagtatgtgt

SEQ ID NO: 82741 - DNA, 117 bp, Mus musculus
gtatgtatttcattatgtatatatgtataaccatatgtgtatgtatatatatatatgtatatatgtgtgtgtatacatatatgtgtaaatatatatatgtgtgtgtctaatatatat

SEQ ID NO: 82742 - DNA, 114 bp, Mus musculus
tgtgcattggtatgttgtgtgtgcaggaatggatatgtgtgcacatgaatatattcttatatttagtaggtagggcatatatgatattatacatatagaattgcaggagccaca

SEQ ID NO: 82743 - DNA, 66 bp, Mus musculus
tatatatatatatgtatatgtttatgtacacacacgtgtatatgtgtgtatatgtatatatatgta

SEQ ID NO: 82744 - DNA, 82 bp, Mus musculus
aattgattgaggagctggagagatagcttagcaattaagagtcctgactgctcttccagaggtcctgagttcagttcccagc

SEQ ID NO: 82745 - DNA, 68 bp, Mus musculus
gcatgtgtgtatgtatgtatatatatgtgtgtatgtatgcatgtatatgtgtgtgtgtatatgtgtgt

SEQ ID NO: 82746 - DNA, 84 bp, Mus musculus
ttgtgtatgtatatgtatgtctgtgtgtatgtatgtgtgtgtctctgtgtatgtatatttatctctgtatgtgtatgtgtgcga

SEQ ID NO: 82747 - DNA, 67 bp, Mus musculus
ataagtacactgtggctgtcttcagatgcaccagaagagggtgtcagatcttattacaggtgcttgt

SEQ ID NO: 82748 - DNA, 93 bp, Mus musculus
cctcttcccactgcaggatacagtttgcattgtggaaaggctcttctgcaagcagctaactgtgtgtctgtctgtccgttgggaaggtttagg

SEQ ID NO: 82749 - DNA, 85 bp, Mus musculus
agcgacgcatcacaagtgaggatcagtcacacgctctctcttctctagcgggtgagaagtgacatgtttctttggaagcgtccct

SEQ ID NO: 82750 - DNA, 82 bp, Mus musculus
gggtcagtagtctgtcacaggctacctggcttctgacatgaagacaccacttccaggcagtctgagcaacagcatctgaccc

SEQ ID NO: 82751 - DNA, 75 bp, Mus musculus
gctcgggacttgctgagttgcctaggctgtctggaccctgagctccactgtccctgtctctgactcagcaccggc

SEQ ID NO: 82752 - DNA, 82 bp, Mus musculus
gtattagcgcctgtccatgtagtatgtgggatttctctgagcacatggtgactggttccgtgtatggcaggatggggaggac

SEQ ID NO: 82753 - DNA, 84 bp, Mus musculus
gcttttggctcagtctttattctctcgtgtctattgtttctggttgattgtagacagtgagctgtataaaatcagtgcctgtgc

SEQ ID NO: 82754 - DNA, 91 bp, Mus musculus
tgcacaaatgttagttgagtttagtaagggcctacaaatctgtttgctagtagaatgtataggttttttgaaatttgctgaaggcagtgta

SEQ ID NO: 82755 - DNA, 127 bp, Mus musculus
gagccaggcctgacagaagaaactgggttgctctccaggtgtgtagggggtcactggtctgtctgtcagagtctgctccctgagcccctccccaacagagtacacaggaccatgcctctgcagccca

SEQ ID NO: 82756 - DNA, 89 bp, Mus musculus
gtatcaatagcatgcatgtgtgccaccctgcctgcctgtgaatggccatgcctaagtgctggggtgtgtatgtgtgtgtaccatggtac

SEQ ID NO: 82757 - DNA, 80 bp, Mus musculus
tgtctataatctctgtcctcagagacaatctgcctaaacttgttgagactttgtttatctgtgagagagatggttggata

SEQ ID NO: 82758 - DNA, 119 bp, Mus musculus
gtataatgttacttatatgcatgtgtttaggactggccatttgaatatgaatatatatctacatacatacatacacacatataattggctaatatgaccctgcaaatgagaacttgtcc

SEQ ID NO: 82759 - DNA, 110 bp, Mus musculus
accctgtctcaaagaggggctgaagagatggctcagcaggtaagagcactgactgctcttccagaggtcctgagttcatttcccagcaaccatctgtaatgagatctggt

SEQ ID NO: 82760 - DNA, 91 bp, Mus musculus
cacgtatatggtgtttttactgtgtatatatatataacacatatgaacgtgtagtgtgagttacatgcagttttggaacaccatgtaggtg

SEQ ID NO: 82761 - DNA, 63 bp, Mus musculus
tgaactcacagggtggctttgagacgctgtcttagtctcacactgtcttcctgctttggttca

SEQ ID NO: 82762 - DNA, 91 bp, Mus musculus
ggtttgattgccttttctggagttaaggatgttagtgaatcaccatgtgaatgctgggagcaactcctgtgccaggaatgctgctctagcc

SEQ ID NO: 82763 - DNA, 73 bp, Mus musculus
tacctgtgttcctgagtgtgtctgagtctgtgcacctgagcatgtataggtcagaggtcacaggacacttgta

SEQ ID NO: 82764 - DNA, 84 bp, Mus musculus
ggtccccagctgcagtgctggtggctctcccactctctcagggtgggtttcctgctgctctgatgagctaggacttgggagagt

SEQ ID NO: 82765 - DNA, 117 bp, Mus musculus
gtgtatatataacataacatatatgaatatgtgtgtgtatatatacatatatatatacacacacatatacgtatatgtatgtatatatgtatatgtatgtatatgtatgtgtgtgtg

SEQ ID NO: 82766 - DNA, 61 bp, Mus musculus
cacgtgagtcgctccgtctgtgtcttattcactcttgggagtcctgcagagcggcagcgtg

SEQ ID NO: 82767 - DNA, 113 bp, Mus musculus
gttgtaagagtgcttgcctgggggctggagggatggctcagtggttaagagcactgactgctcttccaaaggtactgagttcaattcccagccaccacatggtggctcacaac

SEQ ID NO: 82768 - DNA, 116 bp, Mus musculus
ctgaggcatcctaccagtccctgtctctgtaagattcagggtcagactcacaggaggctcacaggcactcactcattctgtccttacttacagtttgggtttggccaggaccggag

SEQ ID NO: 82769 - DNA, 66 bp, Mus musculus
gatatatgtgtatgtgtttatgtacaggtgtgtatatatgtgtgtgtgtgtatatatatatatgtc

SEQ ID NO: 82770 - DNA, 81 bp, Mus musculus
gggattggtgaataattctgattttcttgttgatgttactgtttgagagagtgtcttactatgtgagttgtacatcatcct

SEQ ID NO: 82771 - DNA, 112 bp, Mus musculus
ttaaatctccagatctaaagacaaagcaagccactctaagtctctgtgtgtgagcacagtactggcgaccagaggctcgggttgttagaatcccttggatctggagttgtag

SEQ ID NO: 82772 - DNA, 157 bp, Mus musculus
gtgtatacatgtatatgtaatgtatacatgtatatgtgtatataatatatacatgtatatgtgtatgtaatgtatacatgtatatgtaatgtatacacgtatatgtatatgtaatatatacatgtatatgtaatgtatacatgtatatgtgtaaaca

SEQ ID NO: 82773 - DNA, 73 bp, Mus musculus
tacagtggccttgatcagggcattgttgagtccctgttaagggataagttaaggtctggtcagttgctatgta

SEQ ID NO: 82774 - DNA, 89 bp, Mus musculus
tcacaaccacccataatgagatctgacaccctcttctggtgtgtctgaagacagtgagaaggtcagctctggaactttgggagtcgtga

SEQ ID NO: 82775 - DNA, 64 bp, Mus musculus
gggacctcatctggcttgaacacggacaggcctgtgtgtgctctcacagtctctgtgaggtcct

SEQ ID NO: 82776 - DNA, 69 bp, Mus musculus
gaacattggggctggagagatggctcagcggttaagagcactgactgctcttccagaggtccagagttc

SEQ ID NO: 82777 - DNA, 113 bp, Mus musculus
ggctgcttggctggtctccccttattccaggcttatctgagagtgactgctgagagtcagcagtctttactgtttacatcctttggggagggagagactgagtgaatctggtc

SEQ ID NO: 82778 - DNA, 78 bp, Mus musculus
gacaggcatggagctggagaaggagctgagagcaacatactgattccctctctctctctctctctctctctctctctc

SEQ ID NO: 82779 - DNA, 100 bp, Mus musculus
aggacgggagggatttggtgaagatatccatttagggctgtgtatcccaaggtctctcactctctgaatagtgtctcactgtggtctctgtgtttgttct

SEQ ID NO: 82780 - DNA, 112 bp, Mus musculus
ggtggcattccctaggtttgcaacctgcacagagagtagtcagtgagcagagtaggaagcatgcaggcactgatgctcttcttgctcttgactgtggatgggactggttccc

SEQ ID NO: 82781 - DNA, 118 bp, Mus musculus
ggttcaatgtaagaagtagttgggactaaataaacttggactcaataaaattcttcttgattattttaaaaagaactgagcaagttgttagacttaatttattcatttgacatttatc

SEQ ID NO: 82782 - DNA, 116 bp, Mus musculus
taggtagccaccagctcaacttctccatgattgatgacatgtgtaagtgttgttttcaaaactagggccttgccatcaggttgtggagagctagcaatggccatggccttcgccta

SEQ ID NO: 82783 - DNA, 85 bp, Mus musculus; identical to SEQ ID NO: 57439

SEQ ID NO: 82784 - DNA, 62 bp, Mus musculus
tgtctgtctctgtctctctctacaacatgcatgcacaaatgagggagaggcagagacagaga

SEQ ID NO: 82785 - DNA, 73 bp, Mus musculus
tccatttccatccctgtaattcttgtaattctttcaaacatgaacaattatgggtcagagatgtgactgtgga

SEQ ID NO: 82786 - DNA, 125 bp, Mus musculus
tcttttgtatatttatatgcatgtatatacctatatattatgtatacttatatatgtgttatatatatatatattggaatatattacatacatgtgttatgtaatatatgatatctgtatgacac

SEQ ID NO: 82787 - DNA, 117 bp, Mus musculus
tgtatccctggcaaggaagcctccttacccctaattctcacagcctctctgtcacgttcctgttcttgtcagctgtaggaattgcaagatggcttcttttgtagggcccagaataca

SEQ ID NO: 82788 - DNA, 106 bp, Mus musculus
acaagtgattttgtatatatgtgtatctttatgcacatatgtatgtaaatttatatacatttatatagatgcatagcataacttcaacatatatgtgcatatttgt

SEQ ID NO: 82789 - DNA, 90 bp, Mus musculus
cccatggccaggtgtcagtcactcagtcattgagcaggaacaaatcgcttgcctgttctgtgcctcacactcagtgataggatctaaggc

SEQ ID NO: 82790 - DNA, 79 bp, Mus musculus
tcaataagtgtatacattgatcaatatatatgtgtgtgtatgtatgtatgtatatatatatgtatgtatacataattga

SEQ ID NO: 82791 - DNA, 105 bp, Mus musculus
tgcacatatttgtatatataatatatgtgtgtgtatatgtatatatacatatatttatgtatacatatatacatacacacatattatatatgttttatacatgca

SEQ ID NO: 82792 - DNA, 62 bp, Mus musculus
atatgtgtgtatgtatatatgtatacataaatatatgtatatatacatatacacacacatat

SEQ ID NO: 82793 - DNA, 67 bp, Mus musculus
tgttcatgtatttatacatgtgaatatgatgtatgtgtctgcatgtagcatgtatgctatatgagca

SEQ ID NO: 82794 - DNA, 60 bp, Mus musculus
tatatacacacacatataaatatgcatgtatctatgtatacatgtatgtatgtgtatata

SEQ ID NO: 82795 - DNA, 113 bp, Mus musculus
acatattcatatgtatatatgcatatgtaggcatatatgtatgtatattatatttgtgtattatgtatattatatatatgtatttatgtgcatatttgtacatactggtatgt

SEQ ID NO: 82796 - DNA, 82 bp, Mus musculus
tctactcctgctttctgtgaggcaagccagtcacacagtctctggcaaagctcgctgtattctgaatggaagatggagtgga

SEQ ID NO: 82797 - DNA, 115 bp, Mus musculus
tgtatgcatgtatgcatgtatgtatgtatgtatgtatgtatgtatgtgtgcatgtatgtatatatgtgtgcatatatgtgtgattatatatatatatgtatatatgtatgcatat

SEQ ID NO: 82798 - DNA, 83 bp, Mus musculus
ttggtgaatagatagttatgtagaagctcagagagttaggtaatatctctatatctcagattctatatctatttgaaaatcaa

SEQ ID NO: 82799 - DNA, 147 bp, Mus musculus
tggatatatatatatatatatatatatatatatatatatatatatatatatatatatatatatacatatatatatatacatatatatgtgtgtgtgtgtatgtatacatatgtgtatatgtatatgtgtatatgtatatatgtatgt

SEQ ID NO: 82800 - DNA, 103 bp, Mus musculus
tcaaggcaagaatttgaaatgttagatttttttttaaatttagttgagtatctttcataggtactttttaaaaaaatgaaactgatatttttttctttcttgg

SEQ ID NO: 82801 - DNA, 71 bp, Mus musculus
gagagagagagagagagagagaatggtatctgtatatgttagattaggttctcttggttctcttaaatgtc

SEQ ID NO: 82802 - DNA, 66 bp, Mus musculus
tcagtgatcatagctgctctataagaaatggtaggaacccctctgtggctgagtctgtgattctga

SEQ ID NO: 82803 - DNA, 69 bp, Mus musculus
gtatgtatgtatatatgaatgtgtacatgtatttgtatgaatatacatatatggtatgtatatatatac

SEQ ID NO: 82804 - DNA, 87 bp, Mus musculus
tgcatgtatataatgtgaatgtatgtatgtacatgtgtatgtatgtatatatgtatatgcatatatatgtgtgtatgtgtatatgca

SEQ ID NO: 82805 - DNA, 159 bp, Mus musculus
tgtatagagtgtatgcgtacatgtgtatgtatgtatgcttgcatatatgtatatatgtatgtgcatgtatgtatatatgtacaaatgtacctatgaatataagtataaatttatgtaggtatgcatgtatatgcatacaaacatatgtgtatgtatgta

SEQ ID NO: 82806 - DNA, 114 bp, Mus musculus
ttctctcataacaaaatataattgttggctctctcagtagatagaggtctagcccagagcctctctctgactgtgatatggcataattgtgtgtctgttagtaagagggaggtt

SEQ ID NO: 82807 - DNA, 73 bp, Mus musculus
cataatatatacatattatatattaaatataaattacacacatgtgtgtatatatatgtatgtatgtattgtg

SEQ ID NO: 82808 - DNA, 62 bp, Mus musculus
tgtgtgtctatgtgcatgtgcaagtgtgcacatgtgtatatgtatgtgtatgcacagatgca

SEQ ID NO: 82809 - DNA, 107 bp, Mus musculus
tcttagcttcagagctctgagcaccagccatgcactgaatgtacaggctgtgcacacaggctgcagcagaacttcagtggataggagcagaagagagaggttcaaga

SEQ ID NO: 82810 - DNA, 111 bp, Mus musculus
cagagctcttcctccagaggtttggcttacatttacatgcaaagttaaagttactttttttttcaaacatgtcttttactgaggttcccctaggaggttccctgctaactg

SEQ ID NO: 82811 - DNA, 85 bp, Mus musculus
ccaggaggtagatctgagctccagacctccctgcaccttccttgccagaggagagcttgactgctgagagtgatctgacccctgg

SEQ ID NO: 82812 - DNA, 126 bp, Mus musculus
atatgtacacatatatgtacatatgtatattgtatatatgtatatatgtatatttatgtgtatgtatatatgtatgtgtatacatatatacacatatgtgcctatacacgtgcatacacacacaca

SEQ ID NO: 82813 - DNA, 76 bp, Mus musculus
atacatatgtacatatatgtgtacatattgatagatatagatatatatcaatatatatgtatatatgcatatgtat

SEQ ID NO: 82814 - DNA, 77 bp, Mus musculus
tgatgctggcagaagagagatgcaacatcacagatgcttcctgaggtcatcgtctctctcgctgtctcatgtatgca

SEQ ID NO: 82815 - DNA, 104 bp, Mus musculus
ttattcgtgtgtttgcatgggtatgtatgtgtgcatgtgtgtgtatgtatgtatgtatgtatgtatgtatgtgtgtgtagaaataagtgcacattcatgggtga

SEQ ID NO: 82816 - DNA, 119 bp, Mus musculus
gtatgtgtctctgtgtgtgcatatctatgtgtatttgggtgtatgtatatgtatttatgtgtatttgtgtgtacctgtgagtgatatacttgtatatttgtgtgtgtatatgtatactt

SEQ ID NO: 82817 - DNA, 73 bp, Mus musculus
ctaaacagtagttctttttgtgtatgtgtatacatgtaggtgcatatgtgtgtaagtgcatgagcatgtgtgg

SEQ ID NO: 82818 - DNA, 118 bp, Mus musculus
ttctagatttctaaagtatgtagaatatatttttgaacacagtaatgattttgttgtccttaagggatgaattatttttcaaagtgtggaaatataaacataaatgagtgttctagga

SEQ ID NO: 82819 - DNA, 79 bp, Mus musculus
ttaaacattgactatggatgtgagggtcctaagcaaagccagggaccctatcatgaacaacactactgtttttgtttaa

SEQ ID NO: 82820 - DNA, 120 bp, Mus musculus
ggtctcaatgaatctgcttaagtttgctgtaagcctccacaggaatctcattatctctctgtctttgtgaagtcaatagctgtaggaagcttctgcctcagatcaaagttcattcaagcc

SEQ ID NO: 82821 - DNA, 106 bp, Mus musculus
atatatatacatacatacatatataggtatgtgtatgtatatataatgtgtgtatacatgtgtgtgtatatatatataatatatatatatatgtgtgtgtatatgt

SEQ ID NO: 82822 - DNA, 145 bp, Mus musculus
atgtgtgtatgtgatatatatatgtgtatatgtgatatatatatgtatatgtgtgtatgttatatatatatatatatatatatatatatatatatatatatatatatgtgtgtgtgtatatgcatgtatacacacaatatgcata

SEQ ID NO: 82823 - DNA, 80 bp, Mus musculus
tacaaatattctagttgagttattgcccataggggcccaacaggaatccctaggcaaactaaactgttgggaatactgta

SEQ ID NO: 82824 - DNA, 102 bp, Mus musculus
tacatataacatatacatatatccaaatgcaatatgtatacatatatattgatatgtgtgtgtatatatatccatacatacatgtgtatgcttttgtatgta

SEQ ID NO: 82825 - DNA, 159 bp, Mus musculus
tatacacacacatatcaatatatatgtatacatattgcatttggatatatgtatatgttatatgtatatatgtatgtacatatgtggtatatgtatactgtatatgtgtttgtgtatatgtgacacacacacacacatatgtatatataatatatatac

SEQ ID NO: 82826 - DNA, 72 bp, Mus musculus
agtctcacagaatctgtcagtcaggacaccacatgtctagccatgtcctgttgatgggattctcctgccact

SEQ ID NO: 82827 - DNA, 72 bp, Mus musculus
gtagtaagatttggcagcaggcttctttgcctcctgtgcaatgttgcagccgagcagccacaatcttaacac

SEQ ID NO: 82828 - DNA, 106 bp, Mus musculus
gccttagtgcatggtgatctgataggatacatgggacaatttcaatatttttgaatttgttgaggcctgttttgtgacctattatgtggtcaattttggagaaggt

SEQ ID NO: 82829 - DNA, 85 bp, Mus musculus; identical to SEQ ID NO: 57439

SEQ ID NO: 82830 - DNA, 111 bp, Mus musculus
atatatgtctgtaatatatgtatgagtatgcatatatctgtatatatatataacatgtactatatatttgtgtgtatatatgcatatttatttgtatatatatgtgtatat

SEQ ID NO: 82831 - DNA, 79 bp, Mus musculus
ccacatagcctactatagagattttgttgacctaaaaccatctggcgaatacaaatgaactcaatggtattctgtgtgg

SEQ ID NO: 82832 - DNA, 79 bp, Mus musculus
tgggttgctggaaagagataattagtatacagtgtgtttatatacatatatatgtatggaaatgtccttatgtaactca

SEQ ID NO: 82833 - DNA, 85 bp, Mus musculus; identical to SEQ ID NO: 57439

SEQ ID NO: 82834 - DNA, 70 bp, Mus musculus
tgtgtgagcaagtgcatgtgcatacatacacatacacatatgtgcacacccacacatgcacgcacacaca

SEQ ID NO: 82835 - DNA, 82 bp, Mus musculus
atgtgtgtatacacacacacacacatatatatatatatatatatgtgtgtgtgtgtgtgtgtgtgtgtgtgtgtgcatagat

SEQ ID NO: 82836 - DNA, 119 bp, Mus musculus
catatatgtgtgtatatctatatatgtatatgtataggtatatatacgtatacatatatgcatacatatatatatatacatatatacacatatatgtatatgtatacatatgcatatat

SEQ ID NO: 82837 - DNA, 102 bp, Mus musculus
agggagagagaacagaaagatagagacagagatgacagacagacagagacagagatatgcttgtatatttgcatgtgtgcatatgtctatgtgtgaatgcct

SEQ ID NO: 82838 - DNA, 92 bp, Mus musculus
tctcatgtgtgatctttaatccttttcagaaagcaaagctttacatccgtcctgaggagagtgagcagtctgtgagaacatacaaaatgagg

SEQ ID NO: 82839 - DNA, 71 bp, Mus musculus
agtgtctctcagcctcagtgtctttatctgtaaaataggcacagataaaacagtgatgtctgtggtcagct

SEQ ID NO: 82840 - DNA, 75 bp, Mus musculus
cccagtttctaagctgagccagagaatgctgtgaaagtaatgtctaaaatgagtgtgagctttgttgagactagg

SEQ ID NO: 82841 - DNA, 136 bp, Mus musculus
gggagaggacatatgacccatgctagttaggggtcagtgctctgtctggtggagcacaggttgtgtcagaacaatgtgagcagggcttgctggaaaatgctgactatcatgggccctggcagagcagacccttcac

SEQ ID NO: 82842 - DNA, 91 bp, Mus musculus
cacatacacacacatatatatatgtatatacatacacacacacacatatatatatgtatatatatatatgtatatatgccaatgccttgtg

SEQ ID NO: 82843 - DNA, 93 bp, Mus musculus
gaaataaaagcagatatatagcaaaactatgtgtatttttaacattcaaatgttgcaaattcacattcatgcgagtaatgtgcttttaccatc

SEQ ID NO: 82844 - DNA, 85 bp, Mus musculus; identical to SEQ ID NO: 57470

SEQ ID NO: 82845 - DNA, 92 bp, Mus musculus
gcttaagggagcaagtgattcaacaaaggtgaaaattcaattgtcatttctcacccattttcttgaaatccccttgcttaaccttgcttagc

SEQ ID NO: 82846 - DNA, 111 bp, Mus musculus
gctctctcaaaacttggccccagtgacatacttcttcctccagtcatgccatactcgaacagcatcagcaactggggatcaagtatgcaaatgtccaagaatatagcagac

SEQ ID NO: 82847 - DNA, 111 bp, Mus musculus
ctcctgttaccttctgacttctccctgggtatggtggcttgaatgtatatatatatatggcccccaggggctcagagagcagcactattaggaggtatggccttgtgggag

SEQ ID NO: 82848 - DNA, 118 bp, Mus musculus
cacatacaagcacacatatgtatgggtccatgcactgtacatcacaagaatatgtttctatatgtgcatatgcatgtgcatgggtccatgcattgcacatcccatgtacatgtatgtg

SEQ ID NO: 82849 - DNA, 66 bp, Mus musculus
gacgacctgagttctgtctctggcactcgcgtagttgaaaaagagaagagactgctgcaagttgtc

SEQ ID NO: 82850 - DNA, 108 bp, Mus musculus
ctcctaaggaacctgacctttgctacagccaagtcagagacagacacagagaaggagcggctatgtttgaagcttagacttatgcagtaagataatagttttcagggg

SEQ ID NO: 82851 - DNA, 78 bp, Mus musculus
gtctggggctgaagagatggcccaacagttaagagcactgactgctcttccagaggtcgtgagttcaattcccagcac

SEQ ID NO: 82852 - DNA, 75 bp, Mus musculus
tttgattacatgtatgtatgtatgtatgcatgtatgtatgtgtatctgtgtattggtatgtgcaagtagttcaga

SEQ ID NO: 82853 - DNA, 91 bp, Mus musculus
accactgtccttagaatcttggcccagaatccaggtagactcagtgtggcccttcgttccctctctctgactgagatgcctgtggaatggt

SEQ ID NO: 82854 - DNA, 74 bp, Mus musculus
ccaatgagatctctgggccagtggatgtaaaagcactagctgtgccagtctgacagtctgagtctgctctttgg

SEQ ID NO: 82855 - DNA, 84 bp, Mus musculus
gttggatttgagcagagagtctcacttagtctcaggcttgcctggagctcagtgtaaaagaggctgtcttagaactcatgcagc

SEQ ID NO: 82856 - DNA, 73 bp, Mus musculus
gttagagagtgctcacagacttaagagaagcgtctgtggttgttagttatgagtagtgtgagtgcacatgagc

SEQ ID NO: 82857 - DNA, 104 bp, Mus musculus
cagggcacaggcaacatgtgtatgttgtatgcatgtatgaatgtgtgttcacatgtatatgtgtatatgtgtgtgcacgtgtgtgtgcatgaattgtgcacatg

SEQ ID NO: 82858 - DNA, 73 bp, Mus musculus
tgcagcagtgttcagatgagcttgcggcagtgtttctcatctgctcccgggagtctgtgtcactgactctgca

SEQ ID NO: 82859 - DNA, 112 bp, Mus musculus
gtgtgtatgtctgtatgtgagtgtatgtgtatgtatgtgtatatatatgtatgtgtgtatgtgcatctgtatgtgtgtgtgatgtgtgtatgtgtgtgtgcacatgtgtgtg

SEQ ID NO: 82860 - DNA, 161 bp, Mus musculus
atgtgtgcatatgtgcgtatgcatgtgtgtatgtgtgtatatatatgtatgtatgtgtgcatatgtatatgtgtatatgtgtgtatatgtgtatgtgtatatgtgtgtatgtatgtatgtgtgtgtatacgtatgtatgcatgtgtgtatatgtgtgtatg

SEQ ID NO: 82861 - DNA, 88 bp, Mus musculus
ttctgtgacttatctgtctgtcactcattgtcctggaagagtctcctggttggggtaatgatgcaattagattggatatattactgaa

SEQ ID NO: 82862 - DNA, 82 bp, Mus musculus
gtgtatgtgtgtgtgcatgtttgtatatgtgcgcatgtgtgggcatgtgtatgtatatgtatgtgtgtatgtatatgtgtgc

SEQ ID NO: 82863 - DNA, 70 bp, Mus musculus
aacatctcgaggcagagggctgtgttttacggcattgcatcttaaagctcagcatctctctgtgtgtgtt

SEQ ID NO: 82864 - DNA, 73 bp, Mus musculus
ggaggagagcgaactgccagtcagagtctctctttgaaatatgtgtgacagactgactgctgtgtctccctct

SEQ ID NO: 82865 - DNA, 70 bp, Mus musculus
gagagggagacacagcagtcagtctgtcacacatatttcaaagagagactctgactggcagttcgctctc

SEQ ID NO: 82866 - DNA, 126 bp, Mus musculus
tgcacgtgcacgcacacacacacacacacacacaccaattccagcttaacatgtttaaattttttattttatttttattgatatgtgtgtgcatgtgcatgtgtgtgcaagcagctgtgtgtgtgt

SEQ ID NO: 82867 - DNA, 84 bp, Mus musculus
tatgtattatgtatgtatgtatgtatgaatgtttgtgatgtgtgtacttgttagtgtggatatgtgcatatgtatatgtatatg

SEQ ID NO: 82868 - DNA, 105 bp, Mus musculus
gtacatgtgctatcatataccatatctgttcgtatgtatgtatgtatgtatgtatgtatgtatctattgatggataatctattatatatgtatgcatgtatgtgt

SEQ ID NO: 82869 - DNA, 78 bp, Mus musculus
ttttatcctggcaaccagataagaaactaaggcacattcgtgtgaggaagtatgttgtttgggttgactgagatgaga

SEQ ID NO: 82870 - DNA, 90 bp, Mus musculus
gataccccctcaccattactgttactctgtatggttatgtgttcttcagtgattcaaatgccatgcttagaagaactggggagatggttc

SEQ ID NO: 82871 - DNA, 121 bp, Mus musculus
agcaagcaaaaatgaggtgttgaggctggaaagaaaggtggctcagtggttaagagcactgactgctcttccaaaagaccagagttcaattcccagcatccatatgacagctcacaactgt

SEQ ID NO: 82872 - DNA, 61 bp, Mus musculus
tctgagcatgagagagtctgaggggcagtagcccatcctcacgcactcactcactctgggg

SEQ ID NO: 82873 - DNA, 115 bp, Mus musculus
gctttttagtgttttggaagtaacattagctgggtgtttgttagtgtctttgtctctctgcatgaaagaattaatgattcaaactctggggctaatgtgatttacacatagcact

SEQ ID NO: 82874 - DNA, 77 bp, Mus musculus
cagatgactgcgtcttacactcactgtgtctcctgttgaggattggcatataccttggggtgtgtatgcatgctctg

SEQ ID NO: 82875 - DNA, 61 bp, Mus musculus
cagccaagctattctgtctccatattggcattcagtgtgagagagcagacacagctctctg

SEQ ID NO: 82876 - DNA, 102 bp, Mus musculus
aagctattgaactgacactgactgataatcatggctgcccttaggtgactttttttttttaattggcaaagtaacgggtttcactgagtcagtttcaagctt

SEQ ID NO: 82877 - DNA, 112 bp, Mus musculus
tgggcaagtgggtgtttcactggatgaaggaagctaatttcagaaggctgtactggatatgactttttgttgttgagtttcagtcacaataggattgaagccatattgctca

SEQ ID NO: 82878 - DNA, 74 bp, Mus musculus
acatatgtatatatgtatgtgtatatgcatgtgtatatatgtgtatgcatgtatatttgtatgtatacatgtgt

SEQ ID NO: 82879 - DNA, 64 bp, Mus musculus
gatggcaggagagggccatgcttgaacgggacaggcaggctggcagcctcaatgcctggctggc

SEQ ID NO: 82880 - DNA, 158 bp, Mus musculus
gtgtgtgtgtgcatatgtgtgtgcatatgtgaatgtgtatgtatgtgtgtatacgtatatgtatgtatgtatgtatgtatgtatgtatgtatgcatgtgtgtgcatatgtatgtgaatatgtatgtatctgtgaatgtgtgtacatatctgtgtatgt

SEQ ID NO: 82881 - DNA, 76 bp, Mus musculus
tttgtatatgtatatgaaattcatatatatatatatatatatatatatatatggaattcagaagacagaagacaag

SEQ ID NO: 82882 - DNA, 87 bp, Mus musculus
tatataatagtacacatgtgtatttgttatattacacacaaatatttattgtgtaccaacatacaagtgcacatatattaatatata

SEQ ID NO: 82883 - DNA, 73 bp, Mus musculus
gtatgtacatatgtatgtacatatatatattatgtatgcaagtatgtatgtatgtatgtatgtatgtatgtat

SEQ ID NO: 82884 - DNA, 124 bp, Mus musculus
gcacacatgcatgtatatattatatgtgtgtatatatgtatgcatactagtatgtatatatgtatgtatatatacatgtgtatattgtgtgtatgtgtgtatatatatgtatatgagtgtatgc

SEQ ID NO: 82885 - DNA, 69 bp, Mus musculus
gctggagagatggctcagtggttaggagcactgactgctcttccagaggtcctgagttcaattcctagc

SEQ ID NO: 82886 - DNA, 79 bp, Mus musculus
tcagtcagtcagtctgtcatttgggacccttttgtggggttagcttgggaagggagatacccaacaggagattgattga

SEQ ID NO: 82887 - DNA, 81 bp, Mus musculus
atgtatatgatgtatatgtatgaatatatataccatcaaggagattggtataaatatgaatttacatatatacatatatgt

SEQ ID NO: 82888 - DNA, 93 bp, Mus musculus
tagttaacactgtcaacttgacaggatctataaccacttaggagataggtctctgggtgtgtctgtggcagaatgtctaagttgggttcactg

SEQ ID NO: 82889 - DNA, 156 bp, Mus musculus
cattatgtgtgcctaaatatatatgtgtatatgatgtgtatgtatatgtgtatatttatatatgtgtgtatatgtgtatatttatatgtatatccacatgatgtgtatgtgtatttatatgtatacatatatttacatgtaaatatacatgcttac

SEQ ID NO: 82890 - DNA, 96 bp, Mus musculus
ttcactatatctatctatctatctatctatatatatatatatatatatatatatatatatatatatatctgcatggggttcagagctaagagtgaa

SEQ ID NO: 82891 - DNA, 79 bp, Mus musculus
acttctgttagtttcactgtgtctctgtttagtttctgtttccagaatctgtccattgatcagagtggggtgttgaagt

SEQ ID NO: 82892 - DNA, 96 bp, Mus musculus
tgcaggaccaagtatgtacacaatgaatgtatgttagtatttttaagtaaaaggaaaacaacgtatcactcataagtgtcattcattggcccctca

SEQ ID NO: 82893 - DNA, 56 bp, Mus musculus
gcaggagagagaagagtctgtgttcccattaacaaaggctttgaattgtcttttgc

SEQ ID NO: 82894 - DNA, 91 bp, Mus musculus
ctcactgacacaaaggagtatacactgttgaaaataagatgtttttaggaaagagacaaagtgtgtttgttcttctgtgagtgtgactggg

SEQ ID NO: 82895 - DNA, 100 bp, Mus musculus
agcagaaaacatggcttaagagcaaagaaaccttgtgatattgttgatgaattatttgagtccagtaaaataggtttcagttaagattatgtttacagct

SEQ ID NO: 82896 - DNA, 113 bp, Mus musculus
acttttatatatgcatgtgtgtgtgtgtgtgtgtgtgtatatatatatatatatatatatatatatatatatatacatatatatatgtgtgtgtgtatgtatatgtatatgta

SEQ ID NO: 82897 - DNA, 109 bp, Mus musculus
actagctgtgtctctatggtcaagttgcctaacctctgtctcactctctccatctaaaatatgaaaattatgtgacttgggtgattatgaacaccggacaaggtcaagt

SEQ ID NO: 82898 - DNA, 117 bp, Mus musculus
tcctttcctcttctagcctcaatacaaaggaaggagactagtcttactgcaacttgatatgccatggttggttgatatccctgggagagctgcccctttctgaagagaaatgaagga

SEQ ID NO: 82899 - DNA, 66 bp, Mus musculus
gtatatctgtgtctgtatatatacatgtgtatatatatgtatgtgtgtgtagggtaatgtatatac

SEQ ID NO: 82900 - DNA, 74 bp, Mus musculus
tgccacagagacatcagtaacaggatgtgcaattcaagagtacaaaagtctgcctctgtgtgtctctgtgtgta

SEQ ID NO: 82901 - DNA, 81 bp, Mus musculus
agtgtgagtgtgtgtgtctgtgtatgtgtgaaggaggaagatattccatattccattttcatgactaatatgattcactct

SEQ ID NO: 82902 - DNA, 76 bp, Mus musculus
aagcttgacccagggagtggcactattagaaggtgtggtcctgttggagtaagtgtgtctctgtgagtgtgggctt

SEQ ID NO: 82903 - DNA, 92 bp, Mus musculus
gtgaagacacatgggaatgttgcacttcatgtcacgagttgtgtcactcaggcacacactcatatatgtgcccacatactcccacatatcac

SEQ ID NO: 82904 - DNA, 72 bp, Mus musculus
gtccactctctgtctcacacttctccagatgttcactccttcaggagtctctgagatgaaacagttatggtc

SEQ ID NO: 82905 - DNA, 85 bp, Mus musculus; identical to SEQ ID NO: 57439

SEQ ID NO: 82906 - DNA, 68 bp, Mus musculus
atatatgtttgtgtgtgtgcatgtgtatatagtctctatgtatgtgtgtagtttatatatacatatat

SEQ ID NO: 82907 - DNA, 87 bp, Mus musculus
tgttcatatatagttcatatatactatatatatagatatatttatttacatggtatatatagttcatatatatactgtatatataca

SEQ ID NO: 82908 - DNA, 110 bp, Mus musculus
cgggccatctgactgagactcactctttgagagaaatgccttttttttttttttttttttttttttttttttttttgtcaagcctggttctccgcagtattttgagcctg

SEQ ID NO: 82909 - DNA, 83 bp, Mus musculus
ggtgaaatgtattaactctgctaaatggatactattttatttactgaaagtaagtaaaaatcagagagcagacagtgatcacc

SEQ ID NO: 82910 - DNA, 112 bp, Mus musculus
gtgtgtgtgtggtgtgcataaatgtgcatgtatatatgtgtgtgtggtatgtataaatatgtatgtatatgtatgtgtgatgtgtataaatgtgtacatattatatgcacat

SEQ ID NO: 82911 - DNA, 56 bp, Mus musculus
atacgtacgtacgtacgtacgtatgtatgtatgtatgtatgtatgtatgtatgtat

SEQ ID NO: 82912 - DNA, 108 bp, Mus musculus
accaaagagttaggaataaatgactgggggtggagagatggctcagaggttaagagcactgactgctgttccagaggtcccgagttcaattcccagaaaccacatggt

SEQ ID NO: 82913 - DNA, 116 bp, Mus musculus
ggttacattaaaatgtgcaatgggagatggagaggtggctcagcggttaagagcactgactgctcttccagaggtcctgagttcaattcccagcaaccacatggtggctcataacc

SEQ ID NO: 82914 - DNA, 63 bp, Mus musculus
caggacctggagagatagatggcttagcagttaagagcactgactgctcttccagaggtcctg

SEQ ID NO: 82915 - DNA, 75 bp, Mus musculus
cacacaggtcagatgagcagcccatcaagcttccagggatctgtctgtctgtctgtctgtctgtctgtctgtctg

SEQ ID NO: 82916 - DNA, 59 bp, Mus musculus
atatataccatgtatatatgtatgcatgtatgtatgtatgcatgtatgtatgtatgtat

SEQ ID NO: 82917 - DNA, 112 bp, Mus musculus
gtgtattaataatgtgtgtttttgaactggtgagatggctcagtggttaagagcactgactgctcttccggaggtcatgagttcaagtaacagcaaccacatggtggctcac

SEQ ID NO: 82918 - DNA, 76 bp, Mus musculus
agagaggtattactactagccactgtctctcagtcactggagacaggccaagaggagagtaatgaagaccttcttt

SEQ ID NO: 82919 - DNA, 118 bp, Mus musculus
atgtgtgtgtgcacaagtatgtgtcagtgtatgtgagtttgcatgcatgtgtgtttgtgtgcatgtgcatgcatacgtgtgcctgtgtgtgtgagtatgtgtgtgcatgcatgtgtgt

SEQ ID NO: 82920 - DNA, 61 bp, Mus musculus
gtatgtatgtatgtttgtatgtgtgtattatgtacatatgtaaaattgtgtatgtatatac

SEQ ID NO: 82921 - DNA, 83 bp, Mus musculus
gcttggctcacagtcagtgcctctcataaagaccgattcaaaaataactcggctctctgaatgcggatgactgttaaaagcca

SEQ ID NO: 82922 - DNA, 77 bp, Mus musculus
cagactggtgtgcaggagcatgcctgaaatctcagcacatgggaggctgaggtagaaggatcctgagttctagattg

SEQ ID NO: 82923 - DNA, 80 bp, Mus musculus
agttgataagtcaaggggctggagagatggctaagtagttgaaagcactgactgctcttccagaggtcctgagttcaatt

SEQ ID NO: 82924 - DNA, 96 bp, Mus musculus
cagtcttttctttctcctggtgtgaaattgccttcctcccttccctccctctaggaaatttcagtagtttgatagcaaaggggaaggatacaattg

SEQ ID NO: 82925 - DNA, 67 bp, Mus musculus
atggcatgcttgggaccactgacattgcccgagtagtgcaacactgtcagtttctcaaaatgctcat

SEQ ID NO: 82926 - DNA, 96 bp, Mus musculus
tcgggactgaacccccacttcctactttaagttgacatatttgatatctcagacattttttttcttatagtagcgtaagttgggaagcagaaatga

SEQ ID NO: 82927 - DNA, 64 bp, Mus musculus
caaccccttagctacaaatcttatgtttgtttttataagactgtgggtaaaaactcaggggttg

SEQ ID NO: 82928 - DNA, 102 bp, Mus musculus
gtatgagtgtgttgcttgcatgtatgtatgtgtatgtatgtatgtatgtatgtatgtatgtatgtacgtaatgtgcagtgcccaaagcaaaggacatcagac

SEQ ID NO: 82929 - DNA, 79 bp, Mus musculus
gtgtgtgtatgtatgtatatatgtatgtatacacacacacaacatacacaaatacacatatgtatgtatatacacacac

SEQ ID NO: 82930 - DNA, 83 bp, Mus musculus
gggaagctttggttctttggctctcactctcagtgaccgaccactaacttacagtcagagccatggtgctaggaagttgttct

SEQ ID NO: 82931 - DNA, 66 bp, Mus musculus
tataaaggtgtatatgtatgtgtgcgcacacgcacactcgcgcacacacacacagagcacacgata

SEQ ID NO: 82932 - DNA, 137 bp, Mus musculus
gagaaaaaaatcaaacttcttcactcaaagcagacgaggagctgatctgatctaataggaactagagagacagctcagtggttaagagttcttggttcctttttttttctttcaattttttattagacattttcttc

SEQ ID NO: 82933 - DNA, 99 bp, Mus musculus
gcgtcctcttgggctagagagatggctcaccggttaagagcattgactgctcttccagagcttctgagttcacttcctagcgaccacatagtagttcac

SEQ ID NO: 82934 - DNA, 99 bp, Mus musculus
ttgagttcagagcatgtgaccatacatgtcctcattgaagacccgcagtgttcacagttgctcttcatgtaaacgtgcttatcatctctctctacacag

SEQ ID NO: 82935 - DNA, 60 bp, Mus musculus
tatatgaatgtatatatgcatgtatatatgtatatgtatgtgtgtatatgtatgcatgta

SEQ ID NO: 82936 - DNA, 67 bp, Mus musculus
ctcatcgtccatgaccagatgacacatgctcagtctagctctgcctctgtgtctgggtgaccatgag

SEQ ID NO: 82937 - DNA, 84 bp, Mus musculus
gaagagtctgatgtctgaaggctgcacttttttttttttttctaactaaggagtttgctcagcaaatcatccatcagatttatc

SEQ ID NO: 82938 - DNA, 100 bp, Mus musculus
atgtagcagtacgtgagatctgagtggatgcagtggttgtagtatgtagtgtaagcattggaccgtggtgaattactagtcatcaatcacgtggcctcat

SEQ ID NO: 82939 - DNA, 113 bp, Mus musculus
gcttctgctcagggagatagataggtaaaaccggcatttccctctctggataggaaacttttttttttagtttgaggacccaaggcctgtcaacatttctttgtgtctgaggc

SEQ ID NO: 82940 - DNA, 85 bp, Mus musculus
tatatgtatatgtaatgtgtaatacatatattgtacattgtatatgtatattgtaaatgtatattacatattacatgtgcatata

SEQ ID NO: 82941 - DNA, 64 bp, Mus musculus
aggtgattggttatcttgctctttaggtagaccacactacttcaagaggtaagatagcttccct

SEQ ID NO: 82942 - DNA, 85 bp, Mus musculus; identical to SEQ ID NO: 58391

SEQ ID NO: 82943 - DNA, 121 bp, Mus musculus
agagagacagagaaagagacacatagagagagacacacacagagagacatagagagacagagagagagactttggcctctgtcgtgagttcgagtttgcctttattttcaaatctctactc

SEQ ID NO: 82944 - DNA, 115 bp, Mus musculus
agagatttgaaaataaaggcaaactcgaactcacgacagaggccaaagtctctctctctgtctctctatgtctctctgtgtgtgtctctctctatgtgtctctttctctgtctct

SEQ ID NO: 82945 - DNA, 56 bp, Mus musculus
gggtgacactctctggctgagctacatggcatggtggcaagaggggtctatggccc

SEQ ID NO: 82946 - DNA, 171 bp, Mus musculus
gaattaatgtgtatatatgtatatgtgtatatatatatgtatatatatatatgtgtgtatatatatatatgtatatatacatatatatatgtgtgtatatatatgtatgtatgtgtgcatatatatatatgtgtgtatatatatatatatatatatatatatatatatata

SEQ ID NO: 82947 - DNA, 88 bp, Mus musculus
gtatgtctgtgtgtgtctgtgtgtgtgtgtatgtgtggtatatgtgtatgtatgtgcatgtgtgcatgcatgtgtgtgtctgtgtatg

SEQ ID NO: 82948 - DNA, 175 bp, Mus musculus
gtatgtatgtgtgctcatatgtatatgtatatgtatattatgtgtatatgtatgtgtatgtatgtatgtgtatgtatgtatgtgtatgtatgtatgtgtatgtatatatgtgtatgtatatatgtatgtgtgtgcatgtatgtatatgcatgcatgtatgcatatgtgtgtatat

SEQ ID NO: 82949 - DNA, 116 bp, Mus musculus
aggtttggaggcatgggatggcaaaaggttttgagagagagttcattctaaatgatgtcagcagagacagtggaatgaagagtttgattgttcttgggtgctaagtgttttttctt

SEQ ID NO: 82950 - DNA, 62 bp, Mus musculus
gtttatatatgtatacatatgtatatatacacatgtatgtttatatatatacatatatatgc

SEQ ID NO: 82951 - DNA, 125 bp, Mus musculus
tgtgtgtgtgcacatgtaagtgtatgtgtgtgcatgtgtgttgatgtgtgtatatatgtatgtatgtatatgtgcaagtacaggtatatatggagatgtgcgtgtgtgtgtgtgtgtgtgtgtgt

SEQ ID NO: 82952 - DNA, 90 bp, Mus musculus
gtgtatctgcatgtgctcacctgtgtgtgctcacctgtgtatctgtgtgtgctcacccgagtgtgctcacctgtgtatctgcgtgtgctc

SEQ ID NO: 82953 - DNA, 72 bp, Mus musculus
atatgcatatgaatgtatatatgtgtttatatacgaatatatgtatgtatatgtatatatgtatgtgcatat

SEQ ID NO: 82954 - DNA, 97 bp, Mus musculus
agctctggataaatcctcaccctgaggctaatttcagtgtctgacacactcagagctcacagggtagtggcatctgcttgtctaggttagacctcga

SEQ ID NO: 82955 - DNA, 114 bp, Mus musculus
gggagggggaggcgggggagctggagagatggctcagcggttgagagcactgactgctcttccagaggtcctgagttcaattcccagcaaccacatggtggctcacaaccatct

SEQ ID NO: 82956 - DNA, 72 bp, Mus musculus
gtgtctatgtgtctatgcatatatgtgtatgtgtgtgtacatgtatgtgtgcatgtgtgtgtttgtgctcac

SEQ ID NO: 82957 - DNA, 213 bp, Mus musculus
tgtatgtacatatgtttgtgtatatatgcatatatgtagatatgcatatatgtatatataaatatgtatatagtgtatatgagtatatgtatatatgagtatatgtgtacatgcatatatatgtaaatatgtatatgcacatataaatatatgtatatatgtttgtatgcatacatttatatatgtatgtatacatttatgtatgcatatatt

SEQ ID NO: 82958 - DNA, 96 bp, Mus musculus
gaatgctgcagtggtcacagagggcaaggacagagaggaagaccccttggtggtctctcctgattcagtctctgcccctcctcctccaagcgggtc

SEQ ID NO: 82959 - DNA, 115 bp, Mus musculus
gggttaagaatcactggggggagggggggtgctggagagatggctctgcggataagagcactgactgctcttccagaggtcctgagttcgattcccagcaaccacatggtggctc

SEQ ID NO: 82960 - DNA, 74 bp, Mus musculus
ttgcatatgccagaaagactttgctgtcaggaccctgatatagctctctctctctctcttgtgaggctatgcaa

SEQ ID NO: 82961 - DNA, 119 bp, Mus musculus
tctccatctatggtaattgagagtttggctgggtatagtagtctgggctggaatttgtgttctctcagtgtctgtataacatctgtccaggctcttctggctttcatagtctctggtga

SEQ ID NO: 82962 - DNA, 106 bp, Mus musculus
atgggtatagagtttctgatttgggcatttttgagggtttggcgttgttccggtctgtttgtcagtctatctgtctgttggtcagtcaatctgcatgtttactcat

SEQ ID NO: 82963 - DNA, 85 bp, Mus musculus
tgggaattgaactcaggacctctgaaagaacagtcagtgctcttaaccactgaaccatctttccagccctgataaagagatctta

SEQ ID NO: 82964 - DNA, 100 bp, Mus musculus
tatatatgtatataaatatacattatattgtcatatatatgtatgcattggcattacatatatgcatatatatatatatatatatatatatatatatata

SEQ ID NO: 82965 - DNA, 111 bp, Mus musculus
tacatatacatatacacatacacacatatgtgtatatatatacatatatatgtgtgtgtgtatatacatatgtatatatatacacatacacgtgtgtgtgtgtgtgtgtgt

SEQ ID NO: 82966 - DNA, 95 bp, Mus musculus
ctggctgccaagaacaggttttataatgacagccaatgaaatccacacactggttttgttgttttgtttttgtttttgttcttggtttttgtttg

SEQ ID NO: 82967 - DNA, 85 bp, Mus musculus; identical to SEQ ID NO: 57439

SEQ ID NO: 82968 - DNA, 118 bp, Mus musculus
acatagcaggtattagagtgaggtttactagaattagtataatgtatatatatgtatatatatatatacacacatatatatatatagtgaaatttactagagttagtattatgtatgt

SEQ ID NO: 82969 - DNA, 68 bp, Mus musculus
cacacagtgtcagacacagagagacagagagtttcagttctcccgcggtgtgtgtgtgagagtgtgtg

SEQ ID NO: 82970 - DNA, 81 bp, Mus musculus
acatattatatatatataatatatatatgtgtatgtatatatatatacacatatatatatcatctatctgtatgtctatgt

SEQ ID NO: 82971 - DNA, 91 bp, Mus musculus
ggcttccagctgtaggtgtgactgtctctgtccctgcttaatccatcagggagtccaggtgggagcaatggattccatcaacagctcagtc

SEQ ID NO: 82972 - DNA, 99 bp, Mus musculus
ttcctgatagcctacaagcagagactgctctctctctcagagcccaataccatgccaggacccattttgtaagggagtgcattttttctgctgcaggag

SEQ ID NO: 82973 - DNA, 94 bp, Mus musculus
cacatgtatgtatatatatatacatgtatatatatacatacatacatacatacatatgtatatatatatatgtgtgtgtgtgtatattcatgtg

SEQ ID NO: 82974 - DNA, 86 bp, Mus musculus
atatatatatatacatatgtatgtatgtatgtatgtatatatatacatgtatatatatatacatacatgtgtatatagatatatat

SEQ ID NO: 82975 - DNA, 85 bp, Mus musculus; identical to SEQ ID NO: 57470

SEQ ID NO: 82976 - DNA, 85 bp, Mus musculus
tgagtgtgtctctctgtgtgtgattatgtctgtgtgtgcgagagtgtgtatgtgcgtgtgtgtacaagagaagacagtgtcctca

SEQ ID NO: 82977 - DNA, 106 bp, Mus musculus
acacaaatgcacctgaatctgttgttatatatgtatgtatgtatgttgatagatagatagatagatagatagatagatagatagatagatagatgggtgtgggtgt

SEQ ID NO: 82978 - DNA, 85 bp, Mus musculus; identical to SEQ ID NO: 57470

SEQ ID NO: 82979 - DNA, 65 bp, Mus musculus
gtatatgtatatatgtatattgtatactaattatatgtatatactatataatgtatgctgtatac

SEQ ID NO: 82980 - DNA, 107 bp, Mus musculus
agatgagccaccatgtggttgcttgaaattgagctcaggacctctgtaagagcagacagtgctcttacccagtgaaccagctctccagctctccactcaacccattt

SEQ ID NO: 82981 - DNA, 98 bp, Mus musculus
cttgagttctggatccaatgtgttggggtaaatttagaatggctctcactctgtctgccatcacaagaggcttcagctgccttggaatagcatggaag

SEQ ID NO: 82982 - DNA, 85 bp, Mus musculus; identical to SEQ ID NO: 57439

SEQ ID NO: 82983 - DNA, 76 bp, Mus musculus
tgatgtgcactcactgataagtggatattagcccagaagttcaaaatatccaagacagaattcagtgaccacatga

SEQ ID NO: 82984 - DNA, 101 bp, Mus musculus
agtagtttctttggccccaggtcacgtggtactaggatctatactgaaaatatctctgaagactgatttgtgctcaggggctttgagccaagggaggagct

SEQ ID NO: 82985 - DNA, 103 bp, Mus musculus
agagttcagtgacaatatctgagtggtgagtgcaacatacatgtttataaatattaaactttgctatgatgtacaggaaaaccacttggcagtcatgaaatct

SEQ ID NO: 82986 - DNA, 79 bp, Mus musculus
ttcacacagtgcgtgtatgtgtgtgtgcgtgcgcacgcgtgcgtgcgtgcgtggacatctgtatatgtacatgtgtgag

SEQ ID NO: 82987 - DNA, 81 bp, Mus musculus
tgtatgttggatgctctggaatggagtaactttttttttttttgagaaaggtttccactacattgagattcctttcagaca

SEQ ID NO: 82988 - DNA, 115 bp, Mus musculus
tgcaatgaatatgtatatgtgtatatatctatatatgtatatggaactatatattatatattacatatatatatgtatatggaaatatatatatatataatgggaatttattgga

SEQ ID NO: 82989 - DNA, 104 bp, Mus musculus
gggggcctcatgtcagctggtatatgctgcctggttggtggctcagtgtctgagtcagcgggtccaggttagttgagactgctggtcttcctatgaggtcaccc

SEQ ID NO: 82990 - DNA, 75 bp, Mus musculus
gaacttctgctgtaggggccagagagaataaagcagggtgtccccctattttctctctgtctctgaaagagtttc

SEQ ID NO: 82991 - DNA, 121 bp, Mus musculus
tggtatgtatatatatatatatatatatatatatatatatacatatatatatatatatatatatatatatatgtatatatatatatgtgtgtgtgtgtgtgtgtatatatctatatctata

SEQ ID NO: 82992 - DNA, 117 bp, Mus musculus
ttcactcttggtgtagacttttctttgtaaccttcaaagatttttattttcttaaaagaataaatgaatgctaatgttgaggttcctaagaatttaattctaggcttccagagagaa

SEQ ID NO: 82993 - DNA, 112 bp, Mus musculus
caaaatcatagagggtagttctgttctgatatacccaatgctggatcattaaagacatttgaatttttctttttcctagtggctatcagttgcaaaatgcttctgggtttgg

SEQ ID NO: 82994 - DNA, 106 bp, Mus musculus
atatacacatatgtgtgtgtgtatatatgtatatatatatgtgtatatatatatatatatatgtatatatatatatatatatacacacacacacatatgtgtgtgt

SEQ ID NO: 82995 - DNA, 73 bp, Mus musculus
agtattgtatgtatgtatatatgtatgtatatgtgtgtacatatacatatataaatatatatacatactcact

SEQ ID NO: 82996 - DNA, 113 bp, Mus musculus
tctctctttttgcatgctgaggatttctagaggaatggacaaattatatgtatcttatttatcttatatttcagttgataattatgactagactcacatagtgctgagggagg

SEQ ID NO: 82997 - DNA, 113 bp, Mus musculus
tacagtttggtgcagagcaacagacctaagttgcaaaatgagttaccatgtctgtgtttgtctgactctgtgatttagtctttgctctggagagccccagtcaatgtgctgtg

SEQ ID NO: 82998 - DNA, 96 bp, Mus musculus
gacacgagctgttgggttaggtagagaaaatactgagcactagggggtaattacacaaccttggtcattttctaaactctggtccacaccctggtc

SEQ ID NO: 82999 - DNA, 112 bp, Mus musculus
aaacactggaaacaagttctattatttcagctctgcttcttagacagttgtttttttctttaatagacaaagaggaagaagctctctggaattctgaaagtatgcaatgttt

SEQ ID NO: 83000 - DNA, 67 bp, Mus musculus
tccagtagtgacacatgagacagtccccaaaaacctgggcgctgtcccaaggtgaaaagttcatgga

SEQ ID NO: 83001 - DNA, 78 bp, Mus musculus
tgtatatatatgtgtgtgtatgtatatatgtgtgtatatttgtgcatgtatgtgtacatatatgtgcatgtgtatgca

SEQ ID NO: 83002 - DNA, 249 bp, Mus musculus
gtatgcatatgtgtatgtatatatgtgcatatatttgtgtgtatatatatatgtattgtatgcatatatgtatgcatatttgtgtgtatgtatatgtatgtatatgtacatataggtgtatatgtgtgtatatttatatgtgtatatatgtgtatatgtattcatatgtgtgtacgtgtgtatgtgtatttatgtatgtgtgcatgtgcatgtgcgtgtgtgtgtttgtgtgtgtgtgtatgtgtgtgt

SEQ ID NO: 83003 - DNA, 80 bp, Mus musculus
gtatatatgtatgtatatgtatatatgtatatgtatgtatgtgtatgtatatatacatatatatatattatatgtgtgtg

SEQ ID NO: 83004 - DNA, 94 bp, Mus musculus
atgtttgtgttctgtgtcaaatttttaaattattttgccagattgttagaggcatcgatttaaaggttaacttgatctacaacaaataaaacat

SEQ ID NO: 83005 - DNA, 120 bp, Mus musculus
tgttttgagaagaacttattctgtgattccttactagcaatagacagacagacagacagatagacagactctgtccttacaaagatttccagtgggaagcacattttcattttctaaaca

SEQ ID NO: 83006 - DNA, 76 bp, Mus musculus
ctttagaattcacagtgaactttctggagcgagcagagcaagctcccactgcagaaggtctacggatagcttgaag

SEQ ID NO: 83007 - DNA, 97 bp, Mus musculus
agactaatgtttcctgtgtataattatttgggtggctgtgtattgaatctatatattttagctaacattacttgataatccctggcgggatgggtct

SEQ ID NO: 83008 - DNA, 65 bp, Mus musculus
aatatatatgtatatgtatacatatatgtgcacacacacatatatatcatgtatacatatatatt

SEQ ID NO: 83009 - DNA, 85 bp, Mus musculus; identical to SEQ ID NO: 57439

SEQ ID NO: 83010 - DNA, 85 bp, Mus musculus; identical to SEQ ID NO: 57439

SEQ ID NO: 83011 - DNA, 140 bp, Mus musculus
ctctgtgtgtgtgtgtgtgtgtgcatgttcacatgtacatgaacagatgtgcaagagcatatatatatatatatatatatatatatatatatgtatgtatgtatacttgggtgtatttacatatgtatgtgtgcatgtgg

SEQ ID NO: 83012 - DNA, 76 bp, Mus musculus
gacctggtccctctgtgtctgtctggcttgtagtatatttttattagctggctttgatacattcaaggaccatgtt

SEQ ID NO: 83013 - DNA, 94 bp, Mus musculus
gcttgttttgacgtgatatccctctgttgtgacatcactttctctcacgttgttcagtgtgtacaagagtggcttactttatggaaattcaagc

SEQ ID NO: 83014 - DNA, 86 bp, Mus musculus
gcatctgtacatatgtgtgtatatatatgtgtgtgtatatatgtgtgtgtatatacacatatgtatgcagatttaaatatgtatgc

SEQ ID NO: 83015 - DNA, 87 bp, Mus musculus
gtgtgtgtgtgtatgtgtgcatgtttgtatgtgcctgtgtgtgtacatgcattgcatgtatgtgtgtgtgcatgtgcatgcatgcat

SEQ ID NO: 83016 - DNA, 126 bp, Mus musculus
agggtaaaccctccccacttgggtacaacatcaccctgagacacctagcaaggactgtctcagtctctgttccctgtggttggattccctgtttgatgtctctgtgtttgatgacataagtaagtg

SEQ ID NO: 83017 - DNA, 62 bp, Mus musculus
atgtatgtatgtatatatgtgtgtgtatgtatgcatgtatgtatgtatgtatgtatgtatgt

SEQ ID NO: 83018 - DNA, 85 bp, Mus musculus; identical to SEQ ID NO: 57470

SEQ ID NO: 83019 - DNA, 79 bp, Mus musculus
tatatatatatatgtgtgtgtgtgcataggtatatataggtatatatataatgtgtgtgtatgtatgtatatatatata

SEQ ID NO: 83020 - DNA, 63 bp, Mus musculus
gtttgtatctatatatgtatgtacatgtgtgtgaatttatgtgcatatattatacatgcaaac

SEQ ID NO: 83021 - DNA, 89 bp, Mus musculus
cagaactcatttgcaaatttgtacttctcaaaactatgcccaggagtgagcattagttctgcagatgtttacaaaacatgtgtgtcctg

SEQ ID NO: 83022 - DNA, 94 bp, Mus musculus
tggagtttattttaccctataccaaacagtttacacagcaataaatcattttttatgtatactgcaagggtattttggggtaaaataaattgta

SEQ ID NO: 83023 - DNA, 72 bp, Mus musculus
tgtgtgtgtgtgcactcacaggtgtttgagatggagaccattcacatatatgtgtagatgtatgtacatgca

SEQ ID NO: 83024 - DNA, 88 bp, Mus musculus
gttaccctacagtgtttctggtcagagatctgatacatttgcctttgtaggcacatctctctctctcaggtttaatattgtgtgtaac

SEQ ID NO: 83025 - DNA, 129 bp, Mus musculus
cccatcccattctcatgtgtatgtatgtgtgcctgtctatacatgtgtgtatgtgtgcatgtgcatgtgggagggtatgtgtccatgtgtgtatatgtgtatatatctgggtgtatgtgtgcatacata

SEQ ID NO: 83026 - DNA, 76 bp, Mus musculus
tgtgcgtctgtgtctgtctgtgtgaggtataaggacgtgagtgcagatgcctgtggagacctgaagaggatgctca

SEQ ID NO: 83027 - DNA, 99 bp, Mus musculus
ctgtaggggtcttttgtgttcctatgtactttagggtactttttctatatatttgaagggtgccattaaaatattgactggaattgctttactctgcag

SEQ ID NO: 83028 - DNA, 68 bp, Mus musculus
ctataacatacagtgtgtatatgtatatatacatatatgtatgtatatatatcctacgtaagttgtag

SEQ ID NO: 83029 - DNA, 110 bp, Mus musculus
ctgtctcctagttcttacctgtgtaaaagtaagcatttgtcatggtttggtttggtgtcaatatttttgtttatgtgcattcctgatggttttctagactggagaagcag

SEQ ID NO: 83030 - DNA, 80 bp, Mus musculus
attgtcttctggatatggatatgtgtgtgtgtgtctgtcccatcacagacacacacacacatatagtttttagagatggt

SEQ ID NO: 83031 - DNA, 74 bp, Mus musculus
tatatatatgtatatatatccatgaatatatatgtgtatatatgtatgtatgtgtgtatgtatatatatatata

SEQ ID NO: 83032 - DNA, 96 bp, Mus musculus
tctatctatctatctatctatctatctatctatctaccttgaacaacaccaagttgattgagtaggaaaggtgagtggatttgcgatattggagga

SEQ ID NO: 83033 - DNA, 75 bp, Mus musculus
cccgttaagggtgagtctgtgggacttcattacccaactatgaagatgcttctctctcagtctctcccttctggg

SEQ ID NO: 83034 - DNA, 97 bp, Mus musculus
gatttgctttttgaggatgtttgtgagtagaatcacagcactcgtggctttgtgtatctgcttttttctacttacgataccatattcgaggtgtgtc

SEQ ID NO: 83035 - DNA, 68 bp, Mus musculus
gacctcagggctggagagatggctcagcggttaagagtactgactcctcttccagaggtcctgagttc

SEQ ID NO: 83036 - DNA, 89 bp, Mus musculus
tcaccaggcagaagcagtgcacaggaagttccacaccttcacaggaagaaaaggaggcacctgtctggctgtgtgtgtgagatctggtc

SEQ ID NO: 83037 - DNA, 118 bp, Mus musculus
caagatggtggtataaagactctgcaagtacaacatccttctgagtcctgtttctgtctgcctgctctttggggaacactgagaaagaaccctgtgctgattggtttctatcaagttg

SEQ ID NO: 83038 - DNA, 56 bp, Mus musculus
tctgtgtggctgtgtggctgccacatgtgtgtgtggagtacctgacggccagaaga

SEQ ID NO: 83039 - DNA, 114 bp, Mus musculus
ctgtgtaagtttttaactccctgccaaaaatctgaatataaagccatgatttgactaaagattttctttttgtaagtgttaagaaaccttggtagaggagggaatggcctgagg

SEQ ID NO: 83040 - DNA, 109 bp, Mus musculus
tggtccagcctgaactacatagcaagacttagtctgacaattctgtttttatttaaaacaatagtaatatcaagtaagagttggtgagatagtgcagcctgacaagcca

SEQ ID NO: 83041 - DNA, 83 bp, Mus musculus
gcacttgttggaggaagtgtgtcactaggggagggctttgaggtctcaaaaggcttggcccagtgtctctctctccctgctgc

SEQ ID NO: 83042 - DNA, 79 bp, Mus musculus
ggagcaccagcacgcagaggtggggtgggcaaagcctgagcgcctgcgcacgaggtcgctctcactcactgccttactt

SEQ ID NO: 83043 - DNA, 59 bp, Mus musculus
tccgggtgacctgcctattggcgagggtcccactgtcagtgtgtgagggtcaacatgga

SEQ ID NO: 83044 - DNA, 119 bp, Mus musculus
actcatgattggttggcgcttgaccacagcaattggcagatccttggctggctgcctgtttaccagggtatttacttaagtttgttcaggttaagtttgtttacatgtcaagctagagt

SEQ ID NO: 83045 - DNA, 88 bp, Mus musculus
ccaagaaagcctcgctcccttgctgtgtggcctcagacttgtggagaaatgcgactctgactgcctctcagcaactgcctagctgtgg

SEQ ID NO: 83046 - DNA, 94 bp, Mus musculus
tgtaactttagggctggatcgatggctcagctggagagatggttcagtagttaagagcactgactgctcttccagaggagaggtcctgagttca

SEQ ID NO: 83047 - DNA, 93 bp, Mus musculus
aacttgcctgtggccgagggcggggattgggaccagggctgcacgaccacctcatctctgcctgcctgactctctgcttttctgtgctaagtt

SEQ ID NO: 83048 - DNA, 61 bp, Mus musculus
gacccacctggtcctctgtggtggccgcctagtaggagtgagtgaacacagagccgaggtc

SEQ ID NO: 83049 - DNA, 81 bp, Mus musculus
gagtcagggcctctagctcaggctgctctcagactcactgagtatgcaaagatgacctttaagttcagatgctcctgcctc

SEQ ID NO: 83050 - DNA, 99 bp, Mus musculus
gggagggagggagggaggacattcggactggagagatggctcagcgattaagagcactgactgctcttccagaggtcctgagttcaatttccaccaacc

SEQ ID NO: 83051 - DNA, 82 bp, Mus musculus
gggctttttagagaagtgtgcccttggccatatcagaatcgctgccgtcccactacagggctttgacactctctccctgtcc

SEQ ID NO: 83052 - DNA, 109 bp, Mus musculus
gcatcttttcattgattattggccgtgtgtgtgcgtgtctgtcagtctgtctttggaaatggcctgttcaggtcattcaccctgctccagtttattggtggaggggtgt

SEQ ID NO: 83053 - DNA, 102 bp, Mus musculus
ctgtgtgtcccaatggctgcatccttcttccagcttggtctctgaggcacctgtcagagtagagactaagctgtgctggggctggagctggaaccactacag

SEQ ID NO: 83054 - DNA, 65 bp, Mus musculus
agcctgtccttgaattcacagagatccacctgcctctgtctctgtgagtattgggatgaaaggct

SEQ ID NO: 83055 - DNA, 74 bp, Mus musculus
cagtgccacactgtttctcacactcagaaggtacaacgcaggccaccttatctgaggggagacacagttcattg

SEQ ID NO: 83056 - DNA, 115 bp, Mus musculus
gcttgtgagaaatcacagtgtggagctggagagatggcttggtggttaagagcactgactgctcttccaaaggtcctgagttcaaatcccagcaaccatatggtggctcacaacc

SEQ ID NO: 83057 - DNA, 71 bp, Mus musculus
acctatatctatatctatatatctatatgtctatatatctaatatctatagctacagatatagatatgggt

SEQ ID NO: 83058 - DNA, 96 bp, Mus musculus
gggagtggggggctggaaagatggcttagtggttgagagcactgactgctcttccagaggtcctgagttcaaatcacagcaacctcatggtggctc

SEQ ID NO: 83059 - DNA, 89 bp, Mus musculus
gtgagctaaggtagctagcgtctcacaagtgtcccactgacagaatctctgtcactgaggttgtgttttgttccatttaaattgttcac

SEQ ID NO: 83060 - DNA, 70 bp, Mus musculus
aagtggagggtcaagctaagccacagtctgccttctccagggcgctcactgtcactctggctcactgctt

SEQ ID NO: 83061 - DNA, 57 bp, Mus musculus
cactgcgtctgtctgtccctcgtagaaggacataggaaggataaccagcaagcagtg

SEQ ID NO: 83062 - DNA, 62 bp, Mus musculus
gctagccttgaacttgtgacctttctgtctgtgtctcacaaacagacttacaggtgtgcagc

SEQ ID NO: 83063 - DNA, 113 bp, Mus musculus
tgtgtgtgtgtgcgtgtgtgtgtgtgtatatatatgtatgtaagtatgtatgtatgtatgtatatacatgtttatacgtatatgtgtatatataccgccactctgagaatagc

SEQ ID NO: 83064 - DNA, 109 bp, Mus musculus
gggcattcaaagaactatccagtggctggagagatggcacagtggttaagagcactgactgctcttccagaggtccagagttcaattcccagcaaccagatggtggctc

SEQ ID NO: 83065 - DNA, 66 bp, Mus musculus
cagaccactgtgagcggccttgtgagtacaggggacctcttgttctcagagagcagacagtgcctg

SEQ ID NO: 83066 - DNA, 70 bp, Mus musculus
cgtgtgtgctcactgtgaaaccatgggtccccacgtagaataggactcggtcactctgacactactcatg

SEQ ID NO: 83067 - DNA, 100 bp, Mus musculus
aagagctttgtgcaccttttgttccggtgcctgtaagcagggcaggctcacctcacagtcactgccactcttgctgcaaactggagcccacaaaggcctt

SEQ ID NO: 83068 - DNA, 85 bp, Mus musculus
aggctgagacaagtgatactggtcagctgggagctgcagaatcagcccagattaggagaccagcagcactgaggtaaattattct

SEQ ID NO: 83069 - DNA, 116 bp, Mus musculus
atatatatatatgtatatgcatatgtatatatgtgtatatgtatatatatgcatatatgtgtaggtatatatatatgtgtgtgtgtgtgtatatatatatatgtatatatatatat

SEQ ID NO: 83070 - DNA, 82 bp, Mus musculus
atatatgtatgtatggtagagatatatatggaagatgcatatatgtgtatatatatgtatatctacatatacacacatatat

SEQ ID NO: 83071 - DNA, 87 bp, Mus musculus
ggtgacatatactgtagggctggcatgaggaggacaaaggacacagtctcactgagtcctaggagtcactgtcacttttctttacag

SEQ ID NO: 83072 - DNA, 117 bp, Mus musculus
actactactgtgctattaaaggtttttattatacagctggtacatatttattctatagaagttagaaaatatggataacttgatttaagaagttgcctctacatagccaggtgtggt

SEQ ID NO: 83073 - DNA, 94 bp, Mus musculus
ccttcattttcattgaagtccagaaactctttatttttattttgacccagtggtcattgagtaagggggtattcagtttcaatgagtttgtagg

SEQ ID NO: 83074 - DNA, 113 bp, Mus musculus
agaaagttgaacactggggctggagagatggctcagcggttaagagcactgactgctcttccagaggtcctgagctcaattcccaacaaccacatggtggctcacaaccatct

SEQ ID NO: 83075 - DNA, 98 bp, Mus musculus
tgagggcctgtgtaactgctggggctagtcagcaccaggggctactgctgtctctgtctgtcagcttctagagaaccaagaaagacacaagtcactca

SEQ ID NO: 83076 - DNA, 133 bp, Mus musculus
gtatatagcatgcatataacataatatgctatgtcatatatgtacatgtgtgtatgtatgtgtatatgtatatgtgtgtatgtgtgttatatattatacatacatatctaacatgtatacatataacatatgt

SEQ ID NO: 83077 - DNA, 73 bp, Mus musculus
gcttcgtggagaagtgggatccttggaaggcattcaatccaagtgtgcttctgtgggtctgtggctcagaggc

SEQ ID NO: 83078 - DNA, 120 bp, Mus musculus
gagagatagagacagaatcagagagagacagagagacagagacagacagagagacagagagattaaacaaaaaggtttctttcttaatcccagccctcactggttcttagtctccttttg

SEQ ID NO: 83079 - DNA, 68 bp, Mus musculus
ggttccacctacattcacccaaagagaattttttttttccttttggagatgagtgttgtgaaggggcc

SEQ ID NO: 83080 - DNA, 88 bp, Mus musculus
gtgtgtgtgtgtgttatgtctgtctgtatgtgtgtccatcctctgactccgttcttttttctgaggcagggaaataatcacaaaacac

SEQ ID NO: 83081 - DNA, 86 bp, Mus musculus
tctccctgtcagggctgtgtgaagccaggtgggggtcaacttgggcgtgcactgccactctggctctgtggcactgggctggggga

SEQ ID NO: 83082 - DNA, 71 bp, Mus musculus
agctaggaagagggagagaaggtccggtcaagcttcccacagccccaggctctcagtctcactcttaagct

SEQ ID NO: 83083 - DNA, 110 bp, Mus musculus
cttgcctggctgctggccacaggtccacccagctccacagccttcctggcctgcagcccccacagtgaagacagtgagctgcccgtgccttcctaggcccagcctgcagg

SEQ ID NO: 83084 - DNA, 92 bp, Mus musculus
tcccagttccctttcctcttgtcagtactcagtgtgctggggcaggtgcccggtctgtgctgcctctgcaggctgagcgtgctgggaagtgg

SEQ ID NO: 83085 - DNA, 101 bp, Mus musculus
gaatgactggttctgggctggagagatggctcagtggttaagagcactgactgctcttccagaggtcctgagttcgattaccagcacctacatagtgactc

SEQ ID NO: 83086 - DNA, 69 bp, Mus musculus
atacctgatggggacagataaagccttgagtgcgcgtgtgtgtgtatgtgtgtctgtctgtctgtgtat

SEQ ID NO: 83087 - DNA, 132 bp, Mus musculus
gacttgaatccaagctggcagagaaagctgcagctctcctgcccagattggtcaaatcgtctgagtcaggacacagggagaaggaggtgcccggagccttacagcttctcgtgcaactgagactacaccatc

SEQ ID NO: 83088 - DNA, 98 bp, Mus musculus
gagtaccttgggagctggagagagggctcagcggttaagagcactgactgctcttccagaggtcttgagttcaattctcagcaaccacatggtggctc

SEQ ID NO: 83089 - DNA, 94 bp, Mus musculus
catcctgtgggagtggcaagtctaggatggggtaggagagggggggtctgttaccctctctgactctcctttgcctcagggaatggcaaggatg

SEQ ID NO: 83090 - DNA, 96 bp, Mus musculus
gagtaccctgggctggagagatggctcaggggttaagagcactggctgctcttccagaggtcctgagttcaattcccagcaaccacatggtagctc

SEQ ID NO: 83091 - DNA, 100 bp, Mus musculus
gagaaactatatatatgagtgaatttatatatatgtgtgtgtatgtgtgtgcgtgtgtatatatacatatatatatgagtgaatttatctatagtttggc

SEQ ID NO: 83092 - DNA, 135 bp, Mus musculus
agatgtgcagagcttcaaaggttggtacattctgtagcctttgtcatggctccctggctgtctctgaggctctcacacagagagtaactcccatgactcatggccatgattcatgtgtgtgagaggctcagtggc

SEQ ID NO: 83093 - DNA, 114 bp, Mus musculus
aggcaatttgtaggaggaaaatttgcggtttgtactggctgggtcggtcagtgtgtcaacttgacagaagctagagccatcagagaggaaggagcctcagtttagaaaatgcct

SEQ ID NO: 83094 - DNA, 89 bp, Mus musculus
gccttagttctgcttttcatgctggcctgtgggtgggtggcctgcccagtagccacagttctctgtgtgtgagcatcctggattctggt

SEQ ID NO: 83095 - DNA, 101 bp, Mus musculus
ccaggagatcttaagtgggacatgggggggggagcagacagacaaggctagcaatgacctgtatctgtgtctgtgtcagtcagcgttgtcctgggaaggtt

SEQ ID NO: 83096 - DNA, 109 bp, Mus musculus
ttggcaggtgggtatgctctagcctgcctggaagtccttagtctcacttgctcctctgttgtctgcctcagtggctgcctggcttgctgcccatattcctaggtgccag

SEQ ID NO: 83097 - DNA, 113 bp, Mus musculus
ctctgcctgtgcagctgtaggtgttcttccccgacccctgcccactgtgtggcccctctgtgacagtctgtgtaagtgggcttttgctaagatcttctgcagcttggtgaggg

SEQ ID NO: 83098 - DNA, 94 bp, Mus musculus
gtgtgtttggtatgtgcatgtctgtgtatgtgtgtaagtgcatgaatatctgtaaatgggcacacatgaggtataggcacatatgagtgtgcat

SEQ ID NO: 83099 - DNA, 100 bp, Mus musculus
tcctagggttgtcgagggcctgcagaaggtgggagactgaacacagggagctgctcctgatagggtatgactcaaagatgaggtcagacagcagacagga

SEQ ID NO: 83100 - DNA, 107 bp, Mus musculus
gggcagtatatgtgcagtgtgtatatgcaatgtgtgtatatagtgtgtacagtgtgtgcagtgtattacagtgtgtacagtatgtgtacagtgtgcatgtggtgtgt

SEQ ID NO: 83101 - DNA, 103 bp, Mus musculus
gggatttccatgcttgtgcactgaggcataagctctcagctactgctccagtaccatgcttgcctgcctgtgtgcctgttggcatggtcccctctacagtggt

SEQ ID NO: 83102 - DNA, 96 bp, Mus musculus
gtgcatgcctctaaatctgcatgtgagcctgtgtacactcacatgagtgtaacaatatctctgtgtctgtctggcttacatgtagtggaaatgcat

SEQ ID NO: 83103 - DNA, 59 bp, Mus musculus
ctgtcccactcactgtctgacgacagcagccccgcagtcatcagcagagacagtgacag

SEQ ID NO: 83104 - DNA, 76 bp, Mus musculus
ccttggaggcttgtggggcacagcgattctcatgaaagtctgtctgtctgtctgtctgtctgtcaaatctctgagg

SEQ ID NO: 83105 - DNA, 64 bp, Mus musculus
ggccttgaacttggagatctgtctctgtctgcctcctcagaactggaattcaagatccagggcc

SEQ ID NO: 83106 - DNA, 81 bp, Mus musculus
tttgggagcaggtgtgtctgtccctctctcagcacagggaactcctggcagacagacagacagacagacagctcaatcaag

SEQ ID NO: 83107 - DNA, 69 bp, Mus musculus
gagctgtctgtctgtctgtctgtctgccaggagttccctgtgctgagagagggacagacacacctgctc

SEQ ID NO: 83108 - DNA, 72 bp, Mus musculus
tgctgcacaccactgaggtgctgactcactccacactccaaggctctgcagtcagtcagtctgtctgcagca

SEQ ID NO: 83109 - DNA, 93 bp, Mus musculus
tagtgtacaattttcagttatctaattttaatatcttattaggaaaaacctatgggaacttgagagttgactctgaggttaaagtacttgcta

SEQ ID NO: 83110 - DNA, 90 bp, Mus musculus
ggaggtcaggagcatctatcagtgtctgtgagacactgtctgccagtgttctcaggcagcagaacacacgctggagaggtcctgggcttc

SEQ ID NO: 83111 - DNA, 117 bp, Mus musculus
ggtcttgtgtctgaaataagagttgatcttgggaccagagagatggctacgcagttaagagcactgactgctcttccagaggtcctgagttcaattctcagcagccacatggtggct

SEQ ID NO: 83112 - DNA, 85 bp, Mus musculus
acacccccattctcagacctcttctttagggtctcatctttgctgcctctgtgtttgccagaagaggctctttgaatctgcttgt

SEQ ID NO: 83113 - DNA, 83 bp, Mus musculus
ctgcttgctagtgctgaggggaggaccatcacgtgaccatagggtggagggttctgtgtctcactctcagcctggctctgtag

SEQ ID NO: 83114 - DNA, 76 bp, Mus musculus
gctggcacgctggtactcacactctcaggcacatacacaggtagggaggtcacggagctggaggaggtgagacagt

SEQ ID NO: 83115 - DNA, 79 bp, Mus musculus
gtagagtagtgtggtagagagctgttgcaggacacaggctctcccagctgctgctggttctctgtctccctgtctctgc

SEQ ID NO: 83116 - DNA, 96 bp, Mus musculus
gtacgtatgtacgtacgtatgtatgtatgtatgtacgtatgtatgtatgtatgtacgtatgtatgtacgtatgtatgtatgtatatatgtatgtat

SEQ ID NO: 83117 - DNA, 85 bp, Mus musculus
gaattgggcacgggaggctggagagatggctcagcggttaagagcactgactgctcttccagaggtcctgagttcaattcccagc

SEQ ID NO: 83118 - DNA, 80 bp, Mus musculus
gaacttctggagctggagagatggctcaggggttaaaagcactgactgctcttccagaggtcctgagttcaattcccagc

SEQ ID NO: 83119 - DNA, 79 bp, Mus musculus
acttctgttagtttcactgtgtctctgtttagtttgtgtttccaggatctgtccattgatgagagtgggatggtgaagt

SEQ ID NO: 83120 - DNA, 76 bp, Mus musculus
ttcttcactgcagtcacagtgttggtgaggccaggaccggctgtcactgctgccacacccactgtccctgaaagaa

SEQ ID NO: 83121 - DNA, 81 bp, Mus musculus
gattcattcagtgttcactcaattgtcacagcaggaaacttacatttcctggtgctaaggtgagtagtgaaattgttgatc

SEQ ID NO: 83122 - DNA, 85 bp, Mus musculus; identical to SEQ ID NO: 57470

SEQ ID NO: 83123 - DNA, 107 bp, Mus musculus
tgtgtatatgagagtgttgtatgaatgtctttgttgtgtgtatttatatctgtttatgggtctcacatgtgaggtgagagggttgtgtatgcatgctttcacacaca

SEQ ID NO: 83124 - DNA, 119 bp, Mus musculus
acatagacacacagacagttatggcctttgtagtcaggaagtactagtaattttatatatttgaaaactagggttatactttattcttcaattttcttaactgcgtacttggtccatgt

SEQ ID NO: 83125 - DNA, 108 bp, Mus musculus
ctttactgctgtgtccctctcggccagtccctctccctctctgagcctggcctcctcgctgaaacaagggaggtgacttggccgacctgagagaaaattacagctgag

SEQ ID NO: 83126 - DNA, 74 bp, Mus musculus
tgtctcttgtcccattcatatcaatggtttatggcacgagtcacacccagactgtgtaaatgtgacaggtaaca

SEQ ID NO: 83127 - DNA, 95 bp, Mus musculus
tcagcttggcagaatctggagtcagtttctttttggcagataatttttttttatctcagcaacagaaatgaaacctgaataggcactgccctggt

SEQ ID NO: 83128 - DNA, 73 bp, Mus musculus
agtgtgcagcttattcttcaagtgggtcctctaacaattggagtgaggactgtctctgactctgttgcctgct

SEQ ID NO: 83129 - DNA, 92 bp, Mus musculus; identical to SEQ ID NO: 57641

SEQ ID NO: 83130 - DNA, 85 bp, Mus musculus; identical to SEQ ID NO: 57439

SEQ ID NO: 83131 - DNA, 78 bp, Mus musculus
tgatctgattggatgcatgggataatttcaatatttttgtatctgttgaggcctgttttgtgaccaattatatggtca

SEQ ID NO: 83132 - DNA, 95 bp, Mus musculus
gctcagattctaataatattaacagtggatcacatgtgggtatgtatgtgtgcgtatttgtgtgtctctgtgtgtgtctttgtatgtgtctgtgt

SEQ ID NO: 83133 - DNA, 85 bp, Mus musculus; identical to SEQ ID NO: 57439

SEQ ID NO: 83134 - DNA, 106 bp, Mus musculus
ggcttacctcctgacgtccgtgacactcgagtgaagtggtggggaactgtctcactgtctcactgtctgcacggtacctctttaatccgttatccggagggcggtc

SEQ ID NO: 83135 - DNA, 68 bp, Mus musculus
ggagctcaccagttgggagaggctagccagcaagcaagtcgcaggaatgcctctgtctctgtgtctcc

SEQ ID NO: 83136 - DNA, 66 bp, Mus musculus
agttcagtaggcatggagagtgttggtgggcccatgctgagtctctctcaaagcctcagtgagtct

SEQ ID NO: 83137 - DNA, 108 bp, Mus musculus
ctcatccatggtcccttctccccttagaggtgtggtggtctctgtctctgagtgttgctctagcaaggtcggtaaagcctaatgtacagaaggaagtggccagttggg

SEQ ID NO: 83138 - DNA, 108 bp, Mus musculus
agaatggtttcacagtccatttcctggtagtctgcctcttacagtctctctgtcccacctttgactaagtctactgagaggtagacgcaggagctgtaaagtccctct

SEQ ID NO: 83139 - DNA, 90 bp, Mus musculus
gctggacaacaggtacaggggctgaggaggggatggcatggccacctgcccccactctggctcagtctctcttgacccttcctccccagc

SEQ ID NO: 83140 - DNA, 85 bp, Mus musculus; identical to SEQ ID NO: 57439

SEQ ID NO: 83141 - DNA, 95 bp, Mus musculus
tgtgctacattgtgagagtgagagagacagacagacagagacagaattatgagctaagccagtgtggccttaaaagctcatcacatcctagcaca

SEQ ID NO: 83142 - DNA, 64 bp, Mus musculus
cttcagctgtctgtgtctctcagcgcctgcctccctgcgtagggctgctggccttcagaggagg

SEQ ID NO: 83143 - DNA, 83 bp, Mus musculus
aactgaaggagctggagagatggcttggtggttaagagcactgactgctcttccagaggtcctgagttcaattcccagcaacc

SEQ ID NO: 83144 - DNA, 107 bp, Mus musculus
gtgtttatttatattgcttttaattatgtctttgtgtgcatctgcatgtgtattcatgcctgtgactgtacatgcggatggatgcccctgaggctggagttagacac

SEQ ID NO: 83145 - DNA, 75 bp, Mus musculus
atgtatgtatgtatgtatgtatgtatcatctatctatccattagtctctttctacatacacatgcatatatacat

SEQ ID NO: 83146 - DNA, 87 bp, Mus musculus
ggctgacaacagtctgtgtctctgtggcacatgggagaccccaagatggtagcccctggtccagggaaaagtggacaaaagccagcc

SEQ ID NO: 83147 - DNA, 114 bp, Mus musculus
ttggggtctgcctgtaagtgaaagagagagaagacctcagggacactatggccactcagacacacccactgtggttttgactctggactcattcattctgtagcagaactccag

SEQ ID NO: 83148 - DNA, 80 bp, Mus musculus
tatttctgtatgtctgtctgtctgtcagtctgtccgttgtgaggtaaggcaggcacgtaggcggcctccgtgcttgaatg

SEQ ID NO: 83149 - DNA, 99 bp, Mus musculus
gcgacctgggtacggcacggggagggtcctagagaaacggggcaagctatcctggttcgcacggtgcctggatccctctcgggtcgtgctaccccgcgc

SEQ ID NO: 83150 - DNA, 71 bp, Mus musculus
gcgctctggaaataagaggcagggataatgtgtgtgtgcgtgctcatgtgtgtgtgtgtctgcgagtgtgt

SEQ ID NO: 83151 - DNA, 72 bp, Mus musculus
gagtcagcaggagggaccagggccaacaggaacgccaggaaaagttctgggctgtgactctctcagtgaatc

SEQ ID NO: 83152 - DNA, 106 bp, Mus musculus
gcagtcttgtgatcactggggaaacatgaagagcacagcttccagatggctcagcggttaagagcactgactgctcttcctagagttcctgagttcaattcccagc

SEQ ID NO: 83153 - DNA, 80 bp, Mus musculus
ccacactcctgagggctgtcactcactcagtttggccccacccatcttctgctctgtgtgcagctcccccaggcctgtgg

SEQ ID NO: 83154 - DNA, 63 bp, Mus musculus
tgctcagctcacagttaagtgtgtgctctgtttgagaagatgcttagtgcactttgggcagca

SEQ ID NO: 83155 - DNA, 121 bp, Mus musculus
aggcccagccctgactctttggcagatgtactgtgtggcctcagataagaccctctgtctctctgggccttgtctctctgtcggcacaggtgctcagcaaaggtagtcaagggcctgaagg

SEQ ID NO: 83156 - DNA, 83 bp, Mus musculus
gggtggcaggtctccagccctgcttcactttgccagtgatctaggcccacgtgctctgcggctctctgaggctctgaccatcc

SEQ ID NO: 83157 - DNA, 84 bp, Mus musculus
gtgtgtggacccacagctgcctgagtgtcatgtgtctccctttgcctgttatccatgtctctctgtccctgtggatttatatgc

SEQ ID NO: 83158 - DNA, 97 bp, Mus musculus
gcccagtcctgacctgtgctgtatgtgcactcaattccctatgcctgcagagtgaccacacagccacctctcaggtctgctcctatggatctgtggt

SEQ ID NO: 83159 - DNA, 65 bp, Mus musculus
ctgggtattcacatctggtagacacacatgaaagtgtgtttgtgtgtgtctgcctgcctgcctgg

SEQ ID NO: 83160 - DNA, 84 bp, Mus musculus
tgtgactgtctgtctgtgtgcatgtgtcagtgtctgaaccaagtgtatagtagcacagagccatgaccagacacctcaggaata

SEQ ID NO: 83161 - DNA, 72 bp, Mus musculus
tggcctgggcaggctggagaagtggctcagcggttaagagcactgactgctcctccagaggtcctgagttca

SEQ ID NO: 83162 - DNA, 113 bp, Mus musculus
gttttcttgagggctggagggctggagagaaatggctcagaggttaagagcactgactgctcttacagaagtcctgagttcaaatcctgacagactttcggaaaaaacaaaac

SEQ ID NO: 83163 - DNA, 132 bp, Mus musculus
gacccaggattccacagcagtactctgcctccccttaggctaaatgcttctttgtctgtagtcagagagttcagaggctgggaggagagacctctgttttccagactgtcacatgggtataggccttggggg

SEQ ID NO: 83164 - DNA, 118 bp, Mus musculus
cttgggccagtgatcctgtgctccctgcctgtttgttcagcgggtcctcgggtgacacccactctctccctgaggagtttgcagacaggaggagtaagctttgagggccctggtttgg

SEQ ID NO: 83165 - DNA, 117 bp, Mus musculus
gcaaggctagcttgagctacagaatgagtccctggtgctggcgaggtggatcggcagttaagagcactgactgctcttgcagaggtcccagtttcaattcccagcaagttacatggc

SEQ ID NO: 83166 - DNA, 159 bp, Mus musculus
tgtgtgagtacatgtgtatatatatatgtgagtgtgtgtaggtatacatatgtatatatgtatgagtattatgtatatgtgtgtatatatgtgtatgtatatgtgtgtgcatatatacatatgtgtgtgtatgtatgtatatgtgtgtatatgtgtgca

SEQ ID NO: 83167 - DNA, 90 bp, Mus musculus
atatatgtttgtgtgtgtatatgtatatgtggatatgtgtataagtgtgtttatgtatgtatatatatgtgtatatgtatatatgtgtgt

SEQ ID NO: 83168 - DNA, 84 bp, Mus musculus
gtgcatgtatgtatatatatgtgtgtgtatgtatgtgtgcatgtacatgtgtgtatgtatgtgtgtgcatgtgtgtgtatgtat

SEQ ID NO: 83169 - DNA, 59 bp, Mus musculus
ctgacagcctgggtggctccctgagacccacgtggtgaacagagagacccagctgagag

SEQ ID NO: 83170 - DNA, 78 bp, Mus musculus
gttgaggttcttgttgaagtcgatgcacagcaggctcagcctcttcttgatgttcttgatcttctgcagagacacagc

SEQ ID NO: 83171 - DNA, 60 bp, Mus musculus
gatggcactgaagactctgtgctctggcctccagcagtgcgggcagcatcttcacccctc

SEQ ID NO: 83172 - DNA, 106 bp, Mus musculus
tagattcctcccccctcccccattgaggtttgtctgtgtctctctggttccctggggccagctcggggcaccccagggcctgctaggaggtgggcgtgggtttctg

SEQ ID NO: 83173 - DNA, 71 bp, Mus musculus
tcccaaagggacctggatcaccctgactaggggatatgccccctccctctctgtgtcaggctgtggtggga

SEQ ID NO: 83174 - DNA, 65 bp, Mus musculus
ccacatgcctcagcctgcacctgacctgggggacattccctagtctgtctgtgtctgtcctgtgg

SEQ ID NO: 83175 - DNA, 198 bp, Mus musculus
ggttttattgctgttttgtgacattaagctgtggcctctctcactcccttgtctgtctctgcctgagtccctggggttacctctgatcttggctatgtccacccaaaactgctgccggctcctctgaggaaaagaatattttatatatctctctctatatatatctctatataaactgtctttaaggagtcaaagggg

SEQ ID NO: 83176 - DNA, 89 bp, Mus musculus
ggtgaagctccagctctgtgtccctcactccatgtggcgggggccgaatgctgtccctggctgaggtggggatggtggtggcacttgcc

SEQ ID NO: 83177 - DNA, 75 bp, Mus musculus
gtgactggagagatggctcagctgttaagagcactgactgctcttccaggggtcctgagttcaattcccagcaac

SEQ ID NO: 83178 - DNA, 89 bp, Mus musculus
ggtggggagaggggagggaggagggaggcagacacgggggcacaggctaaaagttggctgctgtccctctgtccctctggctcgtgact

SEQ ID NO: 83179 - DNA, 75 bp, Mus musculus
ggccgagtaatattccagccagtgatcaaattgcattatttgtctgtctgtctgtctgtgagtaagtgctgggct

SEQ ID NO: 83180 - DNA, 65 bp, Mus musculus
ggtgacttttatgtcagaggcattttgttaaatttttataacagagcctggggcaggaggatccc

SEQ ID NO: 83181 - DNA, 75 bp, Mus musculus
ccggcagtgtgggtggtggctgatggtgacaggagggagggagcctgtgactcagacactgtcatcagcaatagg

SEQ ID NO: 83182 - DNA, 66 bp, Mus musculus
cactgaatgcaaactgggtgggatgggcaggaggtgctcctgcctccctctcagtggctctctttg

SEQ ID NO: 83183 - DNA, 73 bp, Mus musculus
taggtggactaaaaggggcaccgtagtggtttgtctgtttgtgagtcactgagtgcctcggtttccccatctg

SEQ ID NO: 83184 - DNA, 111 bp, Mus musculus
tggtccttcagggagcctgagagctatggacctgagctcagaagacagggtgctgactgccaatgcctgtcccctgccccaactctgcagcgtcagggacttgagaaacta

SEQ ID NO: 83185 - DNA, 93 bp, Mus musculus
aggagtccatgtgttgtgggggaggggaagagactgctgctttcctgacacccaatttctctgtctccatctctctgccgaccatgcagtcct

SEQ ID NO: 83186 - DNA, 101 bp, Mus musculus
atctgtaggtgtctctgggcgtctataggcatctgttggtaactaaacaagtctgtatagtttctgtagcaatctgtacatgcctgtgagaggctgtggat

SEQ ID NO: 83187 - DNA, 100 bp, Mus musculus
aatctataggtattttcaatagtctgtgggtatctataagaatatttaaatatctataagaatttgtgggtatctataaaatctatggtgtctgtagatt

SEQ ID NO: 83188 - DNA, 75 bp, Mus musculus
tgtggatgtctgatgggtaactataggtatctttaggcatctatgtgtgtttgtagttctctgttggagtctata

SEQ ID NO: 83189 - DNA, 103 bp, Mus musculus
tagactgcttcagacaggaggctggatgtgcagcccaggctgtgatcagagctgtgtgtgaccagacactgtcctggggcaagtgtagttcttagcttgtggc

SEQ ID NO: 83190 - DNA, 97 bp, Mus musculus
taccatgcctgcctggaggccttcatgcacctgtctcgatgattatggactgaccctctgactctgtaagccagccccaattgccttggtcatggtg

SEQ ID NO: 83191 - DNA, 77 bp, Mus musculus
atatatatgtacatatatatatgtgtgtatgtatatatatatatacatatatatatatatatatatacatatatata

SEQ ID NO: 83192 - DNA, 85 bp, Mus musculus
gctgctgatgctagggccaaaggggatgtgggcactaagccacaggctgtgcagtccaactctgtctgtctgtctgtctgtctgt

SEQ ID NO: 83193 - DNA, 100 bp, Mus musculus
tgctctgtagaccaggctgccctcaaagtcacagagatctgtctgcctctgcctctcaagtcctggattaaaggtgagagccactgtgtctggctcagta

SEQ ID NO: 83194 - DNA, 68 bp, Mus musculus
cccttttcattgctgattttatttggatactgactgtctctgtgtctcttgattagttttgctaaggg

SEQ ID NO: 83195 - DNA, 112 bp, Mus musculus
aaggacaaggctttagtttcttttgttttttaaatgctaagttaaaaatacttcttattatgctaaatttttatatagtcattctcctagacagaaggaaaaagccttcctt

SEQ ID NO: 83196 - DNA, 106 bp, Mus musculus
gatctagattgtggagtggtgcatatgtatagtgaatcaagaatagaggtgtctaatgaaatgatctatgttatttctacgcattgcaacactcggactttatatt

SEQ ID NO: 83197 - DNA, 115 bp, Mus musculus
caacgagaacaagtggcaactgttagaagcattaaattcttcagaaatcctgaaatgttcaaggatctatagatttgagaaatatacattgtgtgccagagattttcctgtgttg

SEQ ID NO: 83198 - DNA, 73 bp, Mus musculus
gtcttagtctgggggatgtgcctagtcttactgcaacttgatatgcagtgtctggttgatttctctaggaggc

SEQ ID NO: 83199 - DNA, 80 bp, Mus musculus
tgtccttttaagagatgtcttggtcatggtgtctgttcatagcagtaacactctcactaagacaccagtttagattgaca

SEQ ID NO: 83200 - DNA, 106 bp, Mus musculus
gccttagtgcatggtgatctgataggatacatgggacaatttcaatatttttgaatatgttgaggcctgttttgtgacctattatgtggtcaattttggagaaggt

SEQ ID NO: 83201 - DNA, 94 bp, Mus musculus
actacaaactaggggctggagagatggctcaggggttaagagcactgagtgctcttccaaaggtcctgagttcaattctcagcaaccacgtggt

SEQ ID NO: 83202 - DNA, 103 bp, Mus musculus
atgtatgtatgtgtgtatgaatatttatgtatgtgtataggtgtgtatacatgtgtatatatatatatatatatatgtatgtatgtatatatgagtgtgtatg

SEQ ID NO: 83203 - DNA, 97 bp, Mus musculus
ccaccatacttggcagatttatttttagattgcgtatacgagtgctttgcctacatatatatgtaatgtagtatgtaaatgcagtgccagtgggtgg

SEQ ID NO: 83204 - DNA, 78 bp, Mus musculus
gccaacttaagagctctgcctgtctctgcctcccaagtgctagaattaaaggcatgcatcagactcaagagaagtggc

SEQ ID NO: 83205 - DNA, 67 bp, Mus musculus
ggtcttgctgtctctgactgtgacttgtccctcctgcaagcctctgtgtcagtactcctgggagacc

SEQ ID NO: 83206 - DNA, 61 bp, Mus musculus
ctctcagctccgagggtctcgctggccagttcttatcgtgtagagactctctgactcagag

SEQ ID NO: 83207 - DNA, 85 bp, Mus musculus
aatacactctgtatgcatgtgtatgtatgtatgtatgtatacatgtgtgtatatgtatacatgtgtttgtatgcatgtgtgtatt

SEQ ID NO: 83208 - DNA, 80 bp, Mus musculus
gaaaaggacttgatgagctggagagatggttcagtggttaagagcactgactgctcttccggaggtcttgagtttgattc

SEQ ID NO: 83209 - DNA, 85 bp, Mus musculus
tgagctgagcaggaagctgtactctgacttgtgagaagaacagacaggctctctcactgagggtgatcttttctagctctgccca

SEQ ID NO: 83210 - DNA, 77 bp, Mus musculus
ggaagaagaagggctggagagacggttcagtggttcagagcactgactgctcttccagaggtcctgagttcaattcc

SEQ ID NO: 83211 - DNA, 142 bp, Mus musculus
gggggctccagtatagcaaggggagagggagggcccattacttgagtcccttttcatctctgggtctctcattctcacttagtcccccaacagccttatggagttgttagaccgaactctattttacagagggggaaggaga

SEQ ID NO: 83212 - DNA, 73 bp, Mus musculus
ttctattttttgagataggaggctcacggtgtcactgtgtcacccaagtcagtcagtctgtctctaactggag

SEQ ID NO: 83213 - DNA, 76 bp, Mus musculus
gactgcctgccccggggactgaccacaactgggctccatctgcttggatatgagtctgcctcactgcctgccagtt

SEQ ID NO: 83214 - DNA, 77 bp, Mus musculus
tctgtctgtctgtctgtctgtctgtctgggatgtgccactgtgctctgatgcaagcaaccgtgggcagcaagatggg

SEQ ID NO: 83215 - DNA, 99 bp, Mus musculus
tgaggtgcacatctgcagggccagggtggaggcacgggcatcctggtgtatgctagtcagccagtctccctgaatggctgagcttcagagtgtgactca

SEQ ID NO: 83216 - DNA, 83 bp, Mus musculus
ttccttggtagcgcctctggcggtgtcttcagagaggaggaggtgaggctctctctgagtcacttcttgaggtcacttaggga

SEQ ID NO: 83217 - DNA, 71 bp, Mus musculus
gggtgagatgagacaggttgggtgggtgaagcctggtacactgctgtcctgcctcacactccgtctctcct

SEQ ID NO: 83218 - DNA, 94 bp, Mus musculus
ggtggaagttagcctagtgtgtctgtgtatctgtgtgtctgtgtgtctgtctgcactgcaaaagaatagtctctggaacctcctcccttccact

SEQ ID NO: 83219 - DNA, 120 bp, Mus musculus
tctggaagtgatcatgcccaactcctctcagttcccatctgatcaacaagtatttttttttaaaaagccctactatgtgccagtcatgttttcagaggggttaagacagaatagcctaga

SEQ ID NO: 83220 - DNA, 56 bp, Mus musculus
tccagcctccgaggcccagtgacgcaactgcttctctctcagtctctgagcctgga

SEQ ID NO: 83221 - DNA, 99 bp, Mus musculus
ggtcaatgctttgctgtcaggcactttggagcactcagtctttgtctcaaaataagatcagggatcagtgaccccccccccatagcagatcaggaaacc

SEQ ID NO: 83222 - DNA, 74 bp, Mus musculus
gtgagcacactgtccctgtcttcagatgcaccagaagagggcatctgatcccattacagatggttgtgagccac

SEQ ID NO: 83223 - DNA, 74 bp, Mus musculus
agcatccgcatgtctgcccctctctgactgacacccactagccagggaaggtcggagagcgcttgccgcttgct

SEQ ID NO: 83224 - DNA, 87 bp, Mus musculus
aagccctgactggaggaggcctgtctctctgtcactctggttatcagccatgtagccctggcagagttagtgccacactctgggctt

SEQ ID NO: 83225 - DNA, 126 bp, Mus musculus
gtgtcccccaaatctctgtgacagtgcttcagttctttaggacaaatgctctgtttctctcagtggctgggatgcgttaattcactatcagcatagtgagttactggccttgtgttgtactgtgag

SEQ ID NO: 83226 - DNA, 102 bp, Mus musculus
gatgcacttgcagcctgggtgggcatcgttacatcagctccacgggaaccttactccacctctgtctgtcattatctctgtctgtctgtctgtctgtctgtc

SEQ ID NO: 83227 - DNA, 87 bp, Mus musculus
tgtatatatatatatatatatatatatatatatatatataatacacgtgtgtgtgtatgtatatgtgtatgtatgtatatgtatata

SEQ ID NO: 83228 - DNA, 81 bp, Mus musculus
gttatagtcctgagagtgcagtcagcttctctggccctcctgtcagttgaagatctctgaggtgtactaaggatttagtac

SEQ ID NO: 83229 - DNA, 83 bp, Mus musculus
tgaaaccaaaaggaaagaagtgaggctcaaagtttatttatactttttgagcctctactgggcctctttcttgtgtgggatca

SEQ ID NO: 83230 - DNA, 85 bp, Mus musculus; identical to SEQ ID NO: 57470

SEQ ID NO: 83231 - DNA, 101 bp, Mus musculus
gaggctagtgtttagagattgtgtagtgtttgcagaaactataaaattttagtttattctaaaagatgactagacaaattccactgtgagatcctggcttt

SEQ ID NO: 83232 - DNA, 94 bp, Mus musculus
tgtatctgtgattattaagctcttttttaatgtgtcttctattaagtccttttctgatagtcaaagctgcaatgagagcttagtcactctctca

SEQ ID NO: 83233 - DNA, 74 bp, Mus musculus
ctgtaaaggatatgagatgtgttttagaagtaggctcctacagcctggctttggcccactcaccatccgtacag

SEQ ID NO: 83234 - DNA, 65 bp, Mus musculus
tcatgcacatgcaagtatgcacatgtgtgtggcacacacacagtcatacacgtggatgtgcatga

SEQ ID NO: 83235 - DNA, 117 bp, Mus musculus
tagctggggacatcaagtccctactgaaatgctcagagatttcagagtgttcagagagtggactctccatacagctaaccatgtcgaagtttccaggggtttggtgattctcctctg

SEQ ID NO: 83236 - DNA, 114 bp, Mus musculus
cagtcagtgccagccaattcgctgtgtggactctgggagggtgccgcctggtctgagaatacagagagcaaaaacgaccgactgagccagagacgccttgagcaagcctcactg

SEQ ID NO: 83237 - DNA, 66 bp, Mus musculus
gagtctgtccctcagtgagtcagggccatttctcaatggcatttggctctgcttcttatagaactt

SEQ ID NO: 83238 - DNA, 77 bp, Mus musculus
gttagttaagaggcagctgtaacattgtagctgccttttggtagctgtgaggacagacagagctttgaataactgac

SEQ ID NO: 83239 - DNA, 66 bp, Mus musculus
tctgtgtctctgagtgtgactgtctctctcgcgcgcgcgcgagagcggtggagatatagagatata

SEQ ID NO: 83240 - DNA, 74 bp, Mus musculus
tgtcagacaggtgtgggtggtagagtcctactggaaggtcaagggtgatgctggctcactgtgtctgtctgtca

SEQ ID NO: 83241 - DNA, 78 bp, Mus musculus
gatatttttctggctagagacgggcagctttattgtctgtatctcactgcctccctcctagcattcagggaaccaatc

SEQ ID NO: 83242 - DNA, 69 bp, Mus musculus
ctctgtgtgtgtatctgtgtgtgtgtatatatatgtgtgtgtgtgtctgtgtgggtatataagcgtgag

SEQ ID NO: 83243 - DNA, 95 bp, Mus musculus
tccaaatctatactctgcatcctctgtaatgtgtgtgtgcacacacaggcatatgtgggcgcattcctgtgcatgtgggtgggtgtgtacctgga

SEQ ID NO: 83244 - DNA, 80 bp, Mus musculus
gatgagagtctcccctactgaaattgaagttctcattaatacagggttcctccaaatggcgtgtaggggacattagcatc

SEQ ID NO: 83245 - DNA, 140 bp, Mus musculus
tgtggggggtatgcatatgtgtgtgtgttcccttcctaaggtaatatacacatgtgtatctgtttatatctatctatatatgtatgtgtatgcatatatgtgtgtacatgtgcagagtgtgtatatgcatatgtgtgtgt

SEQ ID NO: 83246 - DNA, 76 bp, Mus musculus
tgatgacatgtttgttacacggagggagtagctatgagtatctgtccccctctgtgtctctgctaccacattcaca

SEQ ID NO: 83247 - DNA, 79 bp, Mus musculus
gactagcttaagtctatgtggcagtgatgattaacctctaggaacactagacagtttcttcttcatgctgttggcagtc

SEQ ID NO: 83248 - DNA, 83 bp, Mus musculus
gcctctcaaagtgttagccaaatgaaaccctttcatttactataaatgactcaggcattttgttatcatgctagagacttggc

SEQ ID NO: 83249 - DNA, 80 bp, Mus musculus
gttagagaaagtatgtcagtggggataggctttgaggtttcagatcctcaagccagactcagtggctcactctctcttgc

SEQ ID NO: 83250 - DNA, 125 bp, Mus musculus
ggtgtgtgtgcatgtatgtttgtgtgcatgtgcatgcctctgtgtgtgtgtgtgtgtgtgtgtgtgcacatgtgtgtgcgtgcaagagagtgtgtgtatgtgtgtgtgtaacccatgaagtgcat

SEQ ID NO: 83251 - DNA, 81 bp, Mus musculus
gggacctgtgtagatggcagagagactgtgagagcctagaagtgagagacgactctgaggaaacagtgtcttccagtcacc

SEQ ID NO: 83252 - DNA, 93 bp, Mus musculus
tggggggaatgcaataggcaggctctcacacagactcatgcagaatcaatgagtccttgtcctgtgggcagcaggcagttagtatccatccta

SEQ ID NO: 83253 - DNA, 110 bp, Mus musculus
agtgtgtgagcatgtgtgtgtatatgtgtgtgtgagaacatgtgtatatgtttatatgtgtgtgggagcattgtgtgtgtatgtatgtgtgtgtgagcatgtgtatgtgt

SEQ ID NO: 83254 - DNA, 81 bp, Mus musculus
ttaaaggtgtgtgtcattaccctgacctccccagaatatttttaaatatatggctaagtcaggaaaatggacttcttttaa

SEQ ID NO: 83255 - DNA, 87 bp, Mus musculus
gtatatggtgtatatgtgtatatatatgtgtatatgcatgtatgggtatgtatgtgcatgtgtgtatgtgtgtatgcatgtgtgtgc

SEQ ID NO: 83256 - DNA, 77 bp, Mus musculus
ttctctcctgagaccctggagacatcagagagaagaagaaaacagtctccctgtttgacaggagtcagtgaagagaa

SEQ ID NO: 83257 - DNA, 65 bp, Mus musculus
ggggactcccccatagatcacaagcacagcctttcccaagtgtctgtctgtctgtctgtgtcccc

SEQ ID NO: 83258 - DNA, 79 bp, Mus musculus
ctgtttccccactggaccaggattacagtgaaggcaggactccatctgtcttgctgtctgtctccttcatgtgcagcag

SEQ ID NO: 83259 - DNA, 82 bp, Mus musculus
acgtatgtacagatgtatatatgtttgcatgtatatatgtatgtcatatgtatgtcatatgtatgtatgtatgtatgtatgt

SEQ ID NO: 83260 - DNA, 99 bp, Mus musculus
ctgaaagcacagattgtggaccatctccaccgtcagagaaagttccgttacataacgctgctctgtctgtgtgtgagagacaacaactgggctaggcag

SEQ ID NO: 83261 - DNA, 68 bp, Mus musculus
ggctcgtttgcttatgtatgtatgtatgtatgtatgtatgcatgcatgtatgtatgcatgtatgtgct

SEQ ID NO: 83262 - DNA, 115 bp, Mus musculus
ggacttaagaatgcatcatctggggctggagagatggctcagtggttaagagcactgactgctcttccaaaggtcctgagttcaaatcccagcaaccacatggtggttcacagcc

SEQ ID NO: 83263 - DNA, 113 bp, Mus musculus
cttccgagactcctttctagaccttttgcttgtcccccttatgtgtctttctttatgtgtgttctttctcattgaagttctgctagcaagctggctctggagactcctggatg

SEQ ID NO: 83264 - DNA, 58 bp, Mus musculus
gtgtatatgtgcctgtgtgtctatatatttgtgtataggtgtctatgcatatgtgtgt

SEQ ID NO: 83265 - DNA, 115 bp, Mus musculus
ctggaattactgcagcactctctgaaggccagatgtacccacggtgtctgagacactcagactggatatttgaacatgtcggcctctgatgtcgggtgaacgtgctgaattcaag

SEQ ID NO: 83266 - DNA, 72 bp, Mus musculus
ggagactcctggcagagctacttgaggctagcacagcagtgcctgcctgcctgtctacctgccagaatttcc

SEQ ID NO: 83267 - DNA, 87 bp, Mus musculus
ggatgtagtgccttcttctgaccgttgtgggtaccaggcaatcatgtggtacagacagacagacagacagacagacatccaaggcac

SEQ ID NO: 83268 - DNA, 63 bp, Mus musculus
gtctgtctgtctgtctgtctgtaccacatgattgcctggtacccacaacggtcagaagaaggc

SEQ ID NO: 83269 - DNA, 114 bp, Mus musculus
ggtgactttctcaactgctctccagcttagctctttagacagggtctgtctctccctgagcctagacctcactgactggctagactgcatgaccagtgggctcctggtcttccc

SEQ ID NO: 83270 - DNA, 122 bp, Mus musculus
gcgctacagtaaaccccgatcagagaaagcaaaccacactaagtcacgtcagtgtcacacactctgaggggaggtgacaggagaccactgtggtagtagttttctcttgtatgtgtgagggt

SEQ ID NO: 83271 - DNA, 65 bp, Mus musculus
gcctcagagtggtgagtgtggagaggaagttctgtctaatctccttatcatccattgtctgtagc

SEQ ID NO: 83272 - DNA, 109 bp, Mus musculus
tacgatgaattccagacttctagatttcattttttaaaaaatattaaaatgatttattattttatttttatgtgtgtgaatgttctacctgtctgtctgtctgtctgta

SEQ ID NO: 83273 - DNA, 75 bp, Mus musculus
gtggtaagggtatggtctttttgcattggtggacaaagctgtcagtctcccagtctaactcagtgccgtttctac

SEQ ID NO: 83274 - DNA, 88 bp, Mus musculus
cgtaggtactgtgccatcaagaacacagaaaagagtcagctgttttagaaacacctttactgagttgttgatgactataattcctggg

SEQ ID NO: 83275 - DNA, 92 bp, Mus musculus
tgacagtgacatcacagaagatgtgtgattttgtagtttcatttcacagagagtgggatcctcgaggctcttttgtgttgtagcacttgtca

SEQ ID NO: 83276 - DNA, 78 bp, Mus musculus
gcagagagacagtcagtcagtcaggagtcagtgcagtcagtacagtggagtggactgagttccttcctgagtccatgc

SEQ ID NO: 83277 - DNA, 64 bp, Mus musculus
gagtgattgggagcactttgagctctcagaagccagctttgggagcactgtctctctgtgaccc

SEQ ID NO: 83278 - DNA, 104 bp, Mus musculus
tgtatatgatgtatatgtatatgtatatgtatatgtatatgtatatgtatatgtatatgtatatgtatatgtatatgtatatgtgtgtgagcatagcatgtgca

SEQ ID NO: 83279 - DNA, 71 bp, Mus musculus
tgaaaaatgggggctggagagatggctcagtggttaaagccctgactgctcttccagaggtcctgagttca

SEQ ID NO: 83280 - DNA, 100 bp, Mus musculus
gagtatctccaaagggctggagaggtggctcaggggttaagagcactggctgctcttccagaggtcctgagttcaattcccaggaaccacatggtggctc

SEQ ID NO: 83281 - DNA, 68 bp, Mus musculus
tggtggtaggcaggacacagttaggggatgatacagtgtctgtgagtctgtccctccctggatcacca

SEQ ID NO: 83282 - DNA, 116 bp, Mus musculus
tgttgggaattgctttctggtcttcccagtccattgactagaatatggaatctcgtggttgactccgtgtttgtgtctcccgttactggcgatgggtttaagcatcgttttagata

SEQ ID NO: 83283 - DNA, 76 bp, Mus musculus
gagtgtgtctatctgtctgtgtctgtctgtgtgtgcctgtgcacgcgtacatgtaaacagacaagttacatgtctc

SEQ ID NO: 83284 - DNA, 86 bp, Mus musculus
gatagacacactcacacacaaggggggttaataattaaatgattattttttaaagaaaactaatccctgactgtgaaggtgctatt

SEQ ID NO: 83285 - DNA, 83 bp, Mus musculus
atcgtcatggtattccacacagtattgcttctgaccaaggaactcatttcacagccagaaaagtacgacagtgggcccacgat

SEQ ID NO: 83286 - DNA, 62 bp, Mus musculus
atacatacatacatacacgcatgcacacacatgtgtgtgtatgtatgtaagtatgtatgtat

SEQ ID NO: 83287 - DNA, 102 bp, Mus musculus
atacacacacacacacacacacacacacacacacacacacatatacacgcctgcgtgtgcatgcatgtatgtatgtacgaatgtaagtaactatgtatgtat

SEQ ID NO: 83288 - DNA, 85 bp, Mus musculus; identical to SEQ ID NO: 57439

SEQ ID NO: 83289 - DNA, 72 bp, Mus musculus
ccacttgctaagggctgcctctaccctgtcgccacatccaaccacagagaagagagacagttcttatgatgg

SEQ ID NO: 83290 - DNA, 89 bp, Mus musculus
gctttgttacaggtcatgttcactattgctgttgggtcagttgtcacactgtcagccaggatatggtaaatgtatgctctggatctagc

SEQ ID NO: 83291 - DNA, 111 bp, Mus musculus
ggttatacttcgtggcagtcaggtgttcctccagatgatgtcctgagagctgctgtgacacacactcgctgagggcaaagacgaaggaaccctgatcttgaactcttgacc

SEQ ID NO: 83292 - DNA, 100 bp, Mus musculus
gtgtatatggtgtctgattcgtgtctaagaatgatagacacaacatagtgtgtagagaaatgtcagtttcatagaattgctcttcagatcttcaatacat

SEQ ID NO: 83293 - DNA, 87 bp, Mus musculus
ttgttagaggaagtcggtcactgggggtgggctttcaggtttcaaaagcccgagccaggcccagtgtctctctttctctgtatacag

SEQ ID NO: 83294 - DNA, 70 bp, Mus musculus
aggcacggctcaatgaacatgtcctggagccacacacagccagtgactttgggatttcatgtgcttccct

SEQ ID NO: 83295 - DNA, 100 bp, Mus musculus
acaccattgctctggaagctggagagtagagagggtgcagaaaacaaggcgtactttgctcccacctcacaactgttgacagcttcagcagaatgagtgt

SEQ ID NO: 83296 - DNA, 68 bp, Mus musculus
gtaaggatgtcactggctctctctatttgactaagtcccatgagggcagggccagttcactgatttat

SEQ ID NO: 83297 - DNA, 89 bp, Mus musculus
acagacaatgtatatacatatatatatatttatatttatatatatatatatcctaaatatatatgtatgtatgtatgtatgtatgtatg

SEQ ID NO: 83298 - DNA, 69 bp, Mus musculus
gttgtgggtatgtacatacatgctaagtgagaatgcacggagctccatgctatgtatagaacttagaac

SEQ ID NO: 83299 - DNA, 70 bp, Mus musculus
catcttggtctcatctctctgagtctattggccaaaatgggtcaaaagagacagcctgattcttgggatg

SEQ ID NO: 83300 - DNA, 111 bp, Mus musculus
tggtgttcagcttactttcttcatttgtccctaaccgtaagatttttaatatttcaacacttgtgtgaggtggtggatctcttaattagcttgaagattgtgatcattcca

SEQ ID NO: 83301 - DNA, 73 bp, Mus musculus
cactcgacatcaagcgtaccatgtagcaggctccccaaagtgtttgctgaatgaatgaatgaatgaatgagtg

SEQ ID NO: 83302 - DNA, 116 bp, Mus musculus
tctggttttgacggtgatattataggggattacaattaagagattgcatgaatctcagaagagactgtgaacttttaaacatggttgaggctgtgatagactacagggacttttga

SEQ ID NO: 83303 - DNA, 79 bp, Mus musculus
agggatatcttgcatccaacttaggactgaggaggccaaagtccctcactctctctatgttgtctaaatgtgactccct

SEQ ID NO: 83304 - DNA, 82 bp, Mus musculus
tgaggcatagaagtgacacatgagacagggacctgccaaatatcctcccattctgtgctggttaagcttttcaattgcctta

SEQ ID NO: 83305 - DNA, 70 bp, Mus musculus
gtgtgtgtgtgtgtgtgtgcgtgcatgtatgtgtatacgtaagtatgtatgtatgtatatgtgtatgtgt

SEQ ID NO: 83306 - DNA, 85 bp, Mus musculus; identical to SEQ ID NO: 57470

SEQ ID NO: 83307 - DNA, 82 bp, Mus musculus
tgtcttcctcttagcatgagcacctggaccaccagagagcacactggtcactctgagtgctgggagtattaagtgaaggaca

SEQ ID NO: 83308 - DNA, 112 bp, Mus musculus
tgtggagttagagatggttctcatgaagggaaggcaaagccctagggcctgggctttgcttgcctgcctgcctgcctgcctgcctactcttgagaccagcccttactgcata

SEQ ID NO: 83309 - DNA, 79 bp, Mus musculus
tgctggctgtaactcagtggcagagtgcttgcctagtgtttgaaaggcgctgggttcactctcactgacagacagggta

SEQ ID NO: 83310 - DNA, 102 bp, Mus musculus
ggaaattgaatggaggtgtgtagggcatatatgtatgtatgtatgtatgcatatatatacatatacatacatatatatgtggaaccatttttgttaattgcc

SEQ ID NO: 83311 - DNA, 80 bp, Mus musculus
caggaatgctaaccattttactacttaggcattgtgtgaagcaatcactgcaatgtagtatggtggttggtgtatccctg

SEQ ID NO: 83312 - DNA, 116 bp, Mus musculus
cctgacttgaggaacatggtattctgtgaagtttcagctctcactgactggctcacaggaagcatgctggggccaacagactgattgagctgaatcacactgtgtctaactggtgg

SEQ ID NO: 83313 - DNA, 120 bp, Mus musculus
ggggatatgagctgatgtggtatagaatgtttgtgatgagatggctcaatagtttagagcactgactgctcttccagagggcctgggttcaattcgcagctcaccactgtctgtaactcc

SEQ ID NO: 83314 - DNA, 57 bp, Mus musculus
tctctctctgtgtgtgtgtgtgtacatgctgcatgtgcctatggaggccagaagagg

SEQ ID NO: 83315 - DNA, 67 bp, Mus musculus
taggatttagtctgcctgtgaacgtgtgcagggcctgtgagtgccttcacagtctctctgagtccta

SEQ ID NO: 83316 - DNA, 96 bp, Mus musculus
tttttacactagcataattgtatgtatatgatatgtatatatgtacatatgtatatattatagcagaaggggtctacaaatgtgcaagtgtctagg

SEQ ID NO: 83317 - DNA, 80 bp, Mus musculus
gtggattttcttatgtccctttgtcatcagaccctgcctacccacagagtctgatgagagacaggccatttaatatcttc

SEQ ID NO: 83318 - DNA, 85 bp, Mus musculus; identical to SEQ ID NO: 57439

SEQ ID NO: 83319 - DNA, 131 bp, Mus musculus
atgtgtctatgcatgtttccatgtgtgtgtatgatgtgtgcaggtatagttgcaagtgtgtgtatatatatgtatgagtaatatgtacagatatgtctgcatgtatgtgcatgtatgtttgcacatatgtg

SEQ ID NO: 83320 - DNA, 75 bp, Mus musculus
gcagatgtgcagcttggtcttcatgtgagtctcctaacaattggagtggagactgtctctgactgtgttgcttgc

SEQ ID NO: 83321 - DNA, 102 bp, Mus musculus
ctaatagggaatttgggattaggggcttctgagagaagaaggtgaggagttgagacacttatctccctctgagagctccaaaaactccattactcggactgg

SEQ ID NO: 83322 - DNA, 94 bp, Mus musculus
ggaaaaaaaaggcgttgtttcttccagtttgtcctggatacccaagggtatccagacagaacacagacagcaataatcaactcctctaatttcc

SEQ ID NO: 83323 - DNA, 89 bp, Mus musculus
agtataccatgtatgtatgtatgtatgtatgtatgtgtcatatatatatatatatatatatatatatatgacaatgatggtatttcact

SEQ ID NO: 83324 - DNA, 70 bp, Mus musculus
aggcatggccactgggtcactgtggctctgactgagtggtggagcctgcagtgacgctccttccatctct

SEQ ID NO: 83325 - DNA, 85 bp, Mus musculus; identical to SEQ ID NO: 57439

SEQ ID NO: 83326 - DNA, 88 bp, Mus musculus
gggctcattggatgcacatatcccatttagaggtgagtgttccaaggtctctcactctgtctagttgtgggtctctgtattttttccc

SEQ ID NO: 83327 - DNA, 110 bp, Mus musculus
ttcccgtcccccactttctttaaagggcttattggctggaagccgctctaatttagagacgtgtgattttgctgttgagattttagaccggaaatggtgggaggcggggg

SEQ ID NO: 83328 - DNA, 112 bp, Mus musculus
cccttgaatccatgcatgagcgagcgagcgagcaagtacacacacacacacactgaaaattgactggcttctgtctcttgcttgtgctacaaatgggcctatggaagagcgg

SEQ ID NO: 83329 - DNA, 87 bp, Mus musculus
ctctatgtatatgtatgcatgtgtatttatgtatgtttgtatgtatatgtgcatttatatgtgtgtgcatgtatgtgtgtatgtgag

SEQ ID NO: 83330 - DNA, 78 bp, Mus musculus
ggtacacaggatctttaaagccctaagaaagagaagacacttgatgactcaagtctgcagagggagaggcctggcacc

SEQ ID NO: 83331 - DNA, 101 bp, Mus musculus
tgccaggtgctctcgtatgccacatctgtctcagtctgtgaaggatgccaatagggcgactgtgtctatttgacagatgacaacatggaggtagctttgca

SEQ ID NO: 83332 - DNA, 111 bp, Mus musculus
ggattcccagggtaccagaatgtctcctctaggaaggcttatctgagatcttgctgagtcagtgggaataagaggcagggagagttctgatgaacgtacttcagggacccc

SEQ ID NO: 83333 - DNA, 95 bp, Mus musculus
gagccagacttgcctcagtctcttactctctcggactctcagggggatttgaaggtactgacacatcggtggagacagaggccagttggaaactc

SEQ ID NO: 83334 - DNA, 93 bp, Mus musculus
ctgtatccttgcatgaccactgcacaagaatcttggatgtgagtttgtatttctcagtaagagtagtcagagaggtcaagcagcctgatacag

SEQ ID NO: 83335 - DNA, 85 bp, Mus musculus
taatcaattgtgtgtgtgtatatgtgtgcgcatatgtgcttgtgcatgtgtgcatgtgtgtgagcatgtgcatgggcattgattg

SEQ ID NO: 83336 - DNA, 100 bp, Mus musculus
ggcttcagatttctgatgttattggaacatttgtgaatttcttgttttgaccgtgacttgagttcagcatttgtaaatccaatatctgaagggatgggct

SEQ ID NO: 83337 - DNA, 124 bp, Mus musculus
gtatattgcatatgtatgtgtttgtatatatatatatatatatagatagatacatatatacatatgtgtatatgtatatatatgtgtgtgtatatatatatgtgtgtgtgtgtgtctgtgtgtg

SEQ ID NO: 83338 - DNA, 66 bp, Mus musculus
caagtaagaccatctgcatctggagccatgcctggccacagcctgcagccagcagcctggtccttg

SEQ ID NO: 83339 - DNA, 83 bp, Mus musculus
tgcttctggcatttgctctgctgctgtatttgccttattgtgcgaatcagcactctgcagaatcaatacccacagtaacagag

SEQ ID NO: 83340 - DNA, 115 bp, Mus musculus
ggtaatctagtggttttgtttacaaggttgggagtatgccagctcttggctgagatgcctcagtcagtctctggctcattcatgccaaggttccagctgaagcctaaagaggact

SEQ ID NO: 83341 - DNA, 113 bp, Mus musculus
cacttggggtctcatccctggggaagaatatttctcccactctcagagtctcttagttgcctgtgtagttctttgtgtatggatgaagtcccatgagatttcccccttttgtg

SEQ ID NO: 83342 - DNA, 77 bp, Mus musculus
ggttgagggacgggaggcctgtcagtgagctcagagggacgtgcccctggaatccaggaacttcttggccagagacc

SEQ ID NO: 83343 - DNA, 108 bp, Mus musculus
ttgcctggtcttgcttgctacttactagaatagcatcgagcacgcagccagtgaatagtgaacatagtatgctatcaacagagagtaagtaaacacagagtcaacacc

SEQ ID NO: 83344 - DNA, 79 bp, Mus musculus
acatggtacacacacataatgcagacaaaacaaatatacaaataaatacgtctctgagtatctgtgtgtgttttcatgt

SEQ ID NO: 83345 - DNA, 115 bp, Mus musculus
tccttcttagccttgtcaacctgacgtagtccagagtcacctgcagagagagtcagtgagtcagtttctgtattgggcttgtctgaggacttgtcctgactggttgttagtggga

SEQ ID NO: 83346 - DNA, 132 bp, Mus musculus
catagtggctgtgactgtcattggggtgtgtgtatatatgtgtgcatgtgctttgtgacagagtctcactgtgacactggctagcttggcccattacacagtccaggctggccttgaactcacacttgcctc

SEQ ID NO: 83347 - DNA, 80 bp, Mus musculus
gtgaatatgtgtataaatgtgtgtatttgtgcatgtgtaagtgtatatatatgtataagtatgtgtgtgtgcatgtttgt

SEQ ID NO: 83348 - DNA, 101 bp, Mus musculus
tgtgtgtgtgagtgtatgcagtaatatatcactagcgatgaaaagtaatgaactaactgacatagctacattattaatatctttgccgtgcaaacacgacg

SEQ ID NO: 83349 - DNA, 72 bp, Mus musculus
tggggcataatatgtttgaatacatgtttgtatttcactatgttcaaatgtggttaagcatgtgtctcctca

SEQ ID NO: 83350 - DNA, 98 bp, Mus musculus
gttttcaaaggagaattctcacttttagaggcatgagatgttttcaactttacttgagagaagtctgtgtcctgatgcaagtctccttatttgggaat

SEQ ID NO: 83351 - DNA, 115 bp, Mus musculus
aggtttggtcttttgctgtgtagtacaatgctaagtgtgggcctctagacctggttgacccagagaagagagagtccacacatagacccaagagatactatgcaatcttgcccct

SEQ ID NO: 83352 - DNA, 127 bp, Mus musculus
tatatattatatatgtgtgtgtgtatgtgtatgtatatatatgtgtgtatacatatatatatatatatatatatatatacatatacacaaatgaatatgcatgtatacatacacacacccgtgtgtg

SEQ ID NO: 83353 - DNA, 76 bp, Mus musculus
cgaagacacaagaccgacaagcattgtacagctagctgaactagcaagccaagctctgtctctgtctctgtctctg

SEQ ID NO: 83354 - DNA, 86 bp, Mus musculus
agccagatgacagatgtttgagccaggtaaagcatggggttttagtaacccatcttctgtatggttatctatctatctatctatct

SEQ ID NO: 83355 - DNA, 116 bp, Mus musculus
tgaccactgagagagcagcaggcagtgcccaccgaccactgagtgtgtctgtcacagcatctccagagaatgactcaccccagtgtgaatgtggtcatcccttggtcagtggctca

SEQ ID NO: 83356 - DNA, 78 bp, Mus musculus
ccaaactgtgtctctgtaactctttccatgggtgttttgttcccaattctaagaaggggcaaagtgtccacactttgg

SEQ ID NO: 83357 - DNA, 113 bp, Mus musculus
atagatagatgattgagtggaggaagagcaacagatgaataaaaggagctctgccagagaagtatctatctatctatctatctatctatctatctatctatctatctatctat

SEQ ID NO: 83358 - DNA, 73 bp, Mus musculus
tgtctctgggggaagtgggggatggttgaaggatctaaggctgttgtctcagactttcactctctgaaaggca

SEQ ID NO: 83359 - DNA, 117 bp, Mus musculus
tgagtatagcagaatctcactaggagttttttacttttttaaaatttttttattttttggctagtagtatttgattttaccctaggtttctgggctatctagtctggttcttggtca

SEQ ID NO: 83360 - DNA, 96 bp, Mus musculus
gtgtgtccatgtatgaagggcaggggtcaatgttgagtgtctttctttattattcatcagctcagtgttaagaccatagatttagggtggagagat

SEQ ID NO: 83361 - DNA, 86 bp, Mus musculus
gttactatttatgtgtatatagcatacatatatgtatatatacatatatatgtgtgtggatactatatatgcataaatctagaaat

SEQ ID NO: 83362 - DNA, 101 bp, Mus musculus
ccatttagagctgaatgttccgaggtctctcactctctgtgtaaagtctggctgtgggccttgatttgtctttaacgagatcagggggccaggaatgatgg

SEQ ID NO: 83363 - DNA, 86 bp, Mus musculus
acacctttttatctgttgctctgtgtctctctgtacatatgtgtgtaggtgtatgtgcagggaaaatgtagttgaagttgttgaag

SEQ ID NO: 83364 - DNA, 81 bp, Mus musculus
aggtcagaggatgttttgggggtgttgggtctctccttccactatgtgggttctgaggattgatctcaggtcatcagactt

SEQ ID NO: 83365 - DNA, 128 bp, Mus musculus
gtaacagggcaggcagaaaacccaggtcccacacagtgcttgatgtttctgtttgtctgtcacagtgtcagtggcccactgactgggagagttcaggcaagcttaactcagggccagggtttagagcc

SEQ ID NO: 83366 - DNA, 105 bp, Mus musculus
ttatggagcaaattaaaatgaaactgggaagagattatatatacaaactgacaagcccggtttctctgtgtggttttcattcttagtgtatccaaaatgccataa

SEQ ID NO: 83367 - DNA, 108 bp, Mus musculus
tggaaggtggcactgaactatggctgtagggactgattttgagaggcacaatgtttatttttataaagactagattcctacaaataggttgttaatgtaaaggctcca

SEQ ID NO: 83368 - DNA, 81 bp, Mus musculus
tggtgatgtgataggatgcatgggacaatttcaatatttttgtatctgttgaggcctgttttgtgacctattatatggtca

SEQ ID NO: 83369 - DNA, 117 bp, Mus musculus
gaccataagaaaaaggatattttctagacccaggtgcaaaacagaaattgtatttgtgatacacatttctagacaacgtggcttttacctgtcctagacaatgtccttttacctgtc

SEQ ID NO: 83370 - DNA, 85 bp, Mus musculus
gtccatggtggtctaataggatgcatgggacaatttcaatatttttgtatctgttgaggcctgttttgtgaccaattatatggtc

SEQ ID NO: 83371 - DNA, 80 bp, Mus musculus
gtatgcatgtttatatgtgctatgtatgtatgtatgtatatatgtgtatgtatgtatatatgtattatgaatgtgtatat

SEQ ID NO: 83372 - DNA, 91 bp, Mus musculus
gtgtgggccagctagacacaaggagactcctctgggaggtttctgaaaggatgtttttccacagagaagtttgtgaggaggctacacctag

SEQ ID NO: 83373 - DNA, 100 bp, Mus musculus
tcctgtcattttgttcatctgtctatctgcctatttattttttctttgttttttttttttttttggatgaataaaggaggtggtggctaatggaccagga

SEQ ID NO: 83374 - DNA, 90 bp, Mus musculus
ctgggaagcttagaaatagtggaaatttatttgatatttaacaagaaaaatatctgattaatagaaaatagtccctgtgcagttttctgg

SEQ ID NO: 83375 - DNA, 99 bp, Mus musculus
ttttcatggtcaactatatgagagatgtgtctgtggttaaagtttctcaccaaaggagatattttttccagactctttccccactactgactctggaaa

SEQ ID NO: 83376 - DNA, 68 bp, Mus musculus
caggtatgggtcagagatgtgactgtggtatggcaaccccatccctcacttgatgtcctgtcttcctg

SEQ ID NO: 83377 - DNA, 78 bp, Mus musculus
atgtatatatgtgtgtagatgtatgcatatatgtatgtgtgtgtatgtatatgtgtatatctgcatatatatctgcat

SEQ ID NO: 83378 - DNA, 105 bp, Mus musculus
tatatctattaaacacacacacacatatatgtgtacatatacatatatatgtgtgtatatatatgtatagatatgtatatatgtgtgtgtacatatatacatata

SEQ ID NO: 83379 - DNA, 84 bp, Mus musculus
tctgaatatactagcctttgtgtgtgaatacatatatatacatgtatatatatatgctatttaacagtgaggaaatatatgtga

SEQ ID NO: 83380 - DNA, 112 bp, Mus musculus
tgtaaaggtaatttattcacctaactaaaatgtttatgtatgtatgtaggcatatatgtatgtatgtatgtatgtatgcatattggcatttgtatatgaagcttactctaca

SEQ ID NO: 83381 - DNA, 123 bp, Mus musculus
gtgtgtgtgtacgagcatgtgtggagggtgcatgtactcaagagctcatgcatgtatgtgtgcatgtgtatgtgtgcatgtgtgtgcatgattatgcaggtgcatgcatgcatgtgcatgcat

SEQ ID NO: 83382 - DNA, 89 bp, Mus musculus
gccctgatagagattacgtgggatgtgagggacagaaagggtcaaagatgactccagttgactcactcactctcaaacggacctggctc

SEQ ID NO: 83383 - DNA, 78 bp, Mus musculus
ttacatgtatgtatgtatgtatatatgtatgtatgtatacctgtgtgtgtatgcgtgtgcatgtgtgtgtgtgtgtaa

SEQ ID NO: 83384 - DNA, 81 bp, Mus musculus
gtgtgtctgagagctgtctgtccacctatgtagctgttagttctcagaataagcggaaggcagacattctcactgtctcat

SEQ ID NO: 83385 - DNA, 76 bp, Mus musculus
gaccccctgtcttagtcagtgtttctgttcctgcacaaaacatcaggaccaagaagcaagctggaggaaagggttc

SEQ ID NO: 83386 - DNA, 92 bp, Mus musculus
gtgtctagtatggccttcctaaacattcctgttccctcccattacgatttattatttaatgtgacagtgcagaatgtggtcggtggtatcac

SEQ ID NO: 83387 - DNA, 132 bp, Mus musculus
tatatatatatatatatgatattatatatatatgatattatatatgatatatatcatacatatgataagactatatatatatgtgtgtgtgtgtatatatatatcatatatatatagtcttaacaacctgtg

SEQ ID NO: 83388 - DNA, 87 bp, Mus musculus
cacacacacagatacacacacacacacaaattgaagaaattgagaaaattatttcatttatgatatgtgtgtgtgtgtgtgtgtgtg

SEQ ID NO: 83389 - DNA, 68 bp, Mus musculus
gcacccatatggcagctcacaactgtctgcatctcctgtaccagaaatgtgtgtctgtctgtgtctgt

SEQ ID NO: 83390 - DNA, 75 bp, Mus musculus
ggcccttgttcagtcccacagaggcccacgaaggctccttaattgtcgcttcagtctctgtgagccctatgagcc

SEQ ID NO: 83391 - DNA, 113 bp, Mus musculus
ccttgagcttaggtcctgggttgtataagggtggagaaggtgaggtgattaataggcactcacacactcattctctttgttcttgactatggatgtaaactagcagctccagg

SEQ ID NO: 83392 - DNA, 67 bp, Mus musculus
taccatacatacacatacatatgtttatatacatatatgaatatgtatatgtgtgtgtgcatgtgta

SEQ ID NO: 83393 - DNA, 85 bp, Mus musculus; identical to SEQ ID NO: 57439

SEQ ID NO: 83394 - DNA, 95 bp, Mus musculus
gtcaattttcattgcatgcatatatatgtatatatttctaaaataacctgttgagatcacataatgttacttatatgtatgctttcaaagctgac

SEQ ID NO: 83395 - DNA, 104 bp, Mus musculus
agataggggtgtttaaaattatttgggaggatgtgtataaattatatgtaaagcctacattattttatatataaggaacttgtacttgatagattctgctgtct

SEQ ID NO: 83396 - DNA, 86 bp, Mus musculus
ggcatccttttcccctgaagttccagccatatgatgggcagatatagtatgaaatggagtttctttaaggcataggaagaggagtt

SEQ ID NO: 83397 - DNA, 83 bp, Mus musculus
agggacagatccaagttgttggaccagagccctgtggatcagttcaacacttggactgtctctgtctaagtcactctaggtcc

SEQ ID NO: 83398 - DNA, 83 bp, Mus musculus
gtaggccacgtaattctagggaaggcctttgaaggtttatagcctgagccccacttcctgctttctctctgtgtctgggctgc

SEQ ID NO: 83399 - DNA, 249 bp, Mus musculus
tgtgtgtgtgtgtgtgtgtgtgtatgcatgcccacctgtgtgtgtgtgcatgtgcatatgcatgtgtagtgtctgtgcacagcatgtgtttatattggtgggtgcatacacacacacacacacaaacacacgcacacacacacacacacacacacacatatatatatatatatatatatatatatacatatatatatatatatatatatatatatatatatatatatatattgcgtgcatgcctgtctg

SEQ ID NO: 83400 - DNA, 121 bp, Mus musculus
gtgtgtgtatgtgtgtgtgtgtatgtgtgtgtgtgtgtgtgtgtgagtgtgtgtatgtgtatttgtatatgtgtgcgtatgtttgtgagtatgtatgtatgtatgtatgtatgtatgtatg

SEQ ID NO: 83401 - DNA, 97 bp, Mus musculus
ctctctcttataggctgatgttgaggcgagctaggagaatatcatgcatctatatatctatatttgctcaccaatacaatgctaagtaaatagagag

SEQ ID NO: 83402 - DNA, 113 bp, Mus musculus
gcaaaagttcattgggaaattatcttactgggataaagactcttctatgtttcatttgatcacatgtgtttttgtactggatagctggagatttgatacccaactgctgatgt

SEQ ID NO: 83403 - DNA, 77 bp, Mus musculus
ctgtctgtgaatttgtgaatttcatcgttctgatttatttagacaagaacctgaaagctacatgttcagggccatag

SEQ ID NO: 83404 - DNA, 84 bp, Mus musculus
atggctcacagaagtttgtctccactttatgccttctgtagaggagaaagcatatttctgattaaggcactttctgtgagagat

SEQ ID NO: 83405 - DNA, 68 bp, Mus musculus
gagtgaacaaactgagctcaggcagggacagttctgctgactatgccctggttcatggattgtgactt

SEQ ID NO: 83406 - DNA, 70 bp, Mus musculus
ctgtctgacctttggtcggtgttcagacaagcatgaaaagatgagtgagcacagagaccacagagagtca

SEQ ID NO: 83407 - DNA, 101 bp, Mus musculus
gataaattcactctagtgctttatggctttttattcctatgtgatcgtaataaagtctcatgtagggatggaagccatgaaatacattgtgaaaattcatc

SEQ ID NO: 83408 - DNA, 61 bp, Mus musculus
tgtaggtggaaaggctctctgagccccagtgtctgtcgctcactgtctgtcttcatgtgca

SEQ ID NO: 83409 - DNA, 58 bp, Mus musculus
tgcatatgtgtatacatacatatacatacatatatgtacatgtatatacatatatgta

SEQ ID NO: 83410 - DNA, 69 bp, Mus musculus
tcagagcctttctgtgtctgtctctccaacactgggattaacaggcacatattgcacaccaggctttga

SEQ ID NO: 83411 - DNA, 84 bp, Mus musculus
tgtatatatataacatatgcatattatgtatataatatattatctatatatagttatatatatgtatatgtatatgtgtataca

SEQ ID NO: 83412 - DNA, 80 bp, Mus musculus
ggtttggtcacaagtagtacaaattgttttttattgatctaaggaggagggagatatagttgtgtaatttgttccaaacc

SEQ ID NO: 83413 - DNA, 105 bp, Mus musculus
aattgatgctaaagttaggaaggagctttgaagataatgagtaggcaactcgaatgttcttaaattgtttttctcatatactgcttattaattgtgcagttaatt

SEQ ID NO: 83414 - DNA, 112 bp, Mus musculus
tgtgtgtgtgtgtgtatatgcatatatttacatacatatatatacacatgcatgtatgtgtatatgtatatgatatatatgatgtatatgtatattgcaacctcacattcat

SEQ ID NO: 83415 - DNA, 63 bp, Mus musculus
gtgtgtgtgtgtatgcttgatgtttgtctgtctgactctcacatgcacacatacacacacaca

SEQ ID NO: 83416 - DNA, 67 bp, Mus musculus
gaggacctgggttcaatccccagaacacatgtctgaggaatgacagcttaggttgttctctggcctc

SEQ ID NO: 83417 - DNA, 146 bp, Mus musculus
gacatgccaggcaaggctgtgatgatctatgtatctacatatctgtatgtctgtctgtctgtctgcctgtctgcctgtttgtctgtctgtttctccatactcatccttaggttatacatgataaaggaactcatggcaggcattgc

SEQ ID NO: 83418 - DNA, 82 bp, Mus musculus
gttatttaccagtgttccaagtcacattaagctgtgggttcctactccacagaagtgtgtgacctgaagcatttcactatac

SEQ ID NO: 83419 - DNA, 114 bp, Mus musculus
ttcttcacaagtatgtgtgagtatgtatgtatgtatgtatgtatgtatgtatgtatgtatgtatgtatgtatgtatgtatataggcacatatgtacatgtagataccagaagag

SEQ ID NO: 83420 - DNA, 110 bp, Mus musculus
gagtgcatgggatggacctaggccctctgtacatagtaacagatgagcatctccatgtccatgtgggactcctaacaacaggaccaggagctgtctctgactctggtgct

SEQ ID NO: 83421 - DNA, 90 bp, Mus musculus
ttgctagtaatacactgacagatgtgataagggaggaagagcttacttggctcatgattccagtcacagtctgtcattgtggagaagcaa

SEQ ID NO: 83422 - DNA, 71 bp, Mus musculus
aggagtttgacttgacatctcagtctcaaacggaaactgagaagccagagatgacagtcaactgaatttct

SEQ ID NO: 83423 - DNA, 84 bp, Mus musculus
tatcccctttatctcctacagctgttttattgcatgagctaaaagttcaagtactatcttgaatagatatggagagagtggata

SEQ ID NO: 83424 - DNA, 65 bp, Mus musculus
gagctgttggtctctgcctgacacatctcttgaaaagttcagggcaatgaagggactagatgctc

SEQ ID NO: 83425 - DNA, 115 bp, Mus musculus
tagagagatagagatagagatgatagagataatttcttgcacatgacttctgactttgttcttcatactagattgattggctcgttgaaaatctctcactcttcctttggtccta

SEQ ID NO: 83426 - DNA, 66 bp, Mus musculus
ctgagtcaggagagagaggccactcactgagatgagctcagggacaagggcttgtccctgactgag

SEQ ID NO: 83427 - DNA, 104 bp, Mus musculus
tctttgtaaacagagcagatagataggttttaacgtagaaaacctttgccagcgtgtggtgcaaggttctatagggttataaacatttgagaaactatcaaaga

SEQ ID NO: 83428 - DNA, 85 bp, Mus musculus; identical to SEQ ID NO: 57439

SEQ ID NO: 83429 - DNA, 85 bp, Mus musculus; identical to SEQ ID NO: 57439

SEQ ID NO: 83430 - DNA, 63 bp, Mus musculus
cagggggcttaggttagacccatgcaggctccctgattgtcagtcaatctctgtgtcctcctg

SEQ ID NO: 83431 - DNA, 76 bp, Mus musculus
gcatgtgtggatatatgcacacatatatgttttatatttatatatgtatatacgtatatgtgtatatatgtatata

SEQ ID NO: 83432 - DNA, 85 bp, Mus musculus; identical to SEQ ID NO: 57470

SEQ ID NO: 83433 - DNA, 101 bp, Mus musculus
gtttacgtgtgggtgctatgccttcgtgtctgtctgtgtctcaaccatgtgcgtgatgagtgcccgaggaggccagaagggggcgccagatgccctggaac

SEQ ID NO: 83434 - DNA, 79 bp, Mus musculus
gcacaggtgacatcacacgcagcttacattacagttccttcattggggtgtgtgtgtgtgtgtatttgtgtatgtgtgt

SEQ ID NO: 83435 - DNA, 90 bp, Mus musculus
cgtattagccctttgtctcttcttaggtctttggaaattcatttcaagtgaatgggaaaagtggatgagaggaccagagagcctggtctg

SEQ ID NO: 83436 - DNA, 64 bp, Mus musculus
gtctgcctgcctgcctgcctgtctgcacatgtgtaaatacatgagtgggtgcctgggtgtagat

SEQ ID NO: 83437 - DNA, 199 bp, Mus musculus
gtgtgcatgtgtatgtgtatatatgtatatgtatgtatgtatgtatgtatgtatgtatatatgtgtgtatatgcatgtgtgtatatatatgtgtgtatatatatatatatgtgtgtgtgtgtgtatatatatatgtatgtgtccgtgtgaatatgtggtgtttgtatatgtgtggtgtgtgtatgtgtatatatgtgta

SEQ ID NO: 83438 - DNA, 69 bp, Mus musculus
gtggcttgagagaaccagtggaaggaagctggagctgacagctgacacactgactccctgtgagtccac

SEQ ID NO: 83439 - DNA, 100 bp, Mus musculus
cccctgaccataacatcatttttgttgctactccataactatcatttttctagttatgaattgtaatgtagatatccgtgttttccgatggtcttagggg

SEQ ID NO: 83440 - DNA, 72 bp, Mus musculus
gtatggtgatcaagagtaaaggctgtggggttcagatccagcctgtcctttcactctctgtctgtctatcac

SEQ ID NO: 83441 - DNA, 111 bp, Mus musculus
cttctgaaagttaacagaagagaataagtcacatttgaagagaagtatgttattacatattattactacttgctatccaaaatgcttgctttacttttctggcctcagagg

SEQ ID NO: 83442 - DNA, 121 bp, Mus musculus
tatatgagtgtatgaatgtatatgtgtatatatatgcatatatgtatatatgtgtatatatgtatatacggatgtatttatatgtgtagtatgtatatatggatatatacatgtacataca

SEQ ID NO: 83443 - DNA, 114 bp, Mus musculus
gctggcctgaatgaccaaaacagtgtctctgacgaaagcatctttgtacattctctgtagcagtctctctttctcacaagacagcttttttagttgtttgtattttaagttggc

SEQ ID NO: 83444 - DNA, 118 bp, Mus musculus
attaaaggtgtgcgccactgcgctcagtatatgttctcatttttaaaaggaattatctatttattttatgcataagagtacactgtagagccaggcggtggtggcgcacacctttaat

SEQ ID NO: 83445 - DNA, 102 bp, Mus musculus
ggagtctggttttgtttgggtttgttctaggtatggtcccagggatcccagatcaaaccaggcccctgggcctatcctagaaccaacctaaacccgtgcatc

SEQ ID NO: 83446 - DNA, 66 bp, Mus musculus
tatgtgtgtgtatgtatgtatatgtatatatacacacatatatatttatatttatacacacacata

SEQ ID NO: 83447 - DNA, 130 bp, Mus musculus
gtgggtgtggccttgtgggaggaagaatgtcactgggggtgggctttgaagtttctcttttctcactgcctcactgtcaggatgtaaagctctctgctactgcccagccccatgcctgtctgtttctggc

SEQ ID NO: 83448 - DNA, 91 bp, Mus musculus
gcctctgtttctgggacttgttttggcagagatttagtgagcagaatatgtcactagagtctctctcacagtctttgtcagaagtgggggc

SEQ ID NO: 83449 - DNA, 113 bp, Mus musculus
gtatgagtgtctctgtgagggcctgggatcccctggagacacaacagacagttgtgagctgccgtgtgagtgttggggattgaacacccgtcctctggaagagcagccagtgc

SEQ ID NO: 83450 - DNA, 118 bp, Mus musculus
tagatctgggaagagaagcaaatgatgcactaatagctgcagggcacctggcagtctcgctgtctgttacaaaggttggcgttgcggctagagggcttcggaggtctttgcggatgta

SEQ ID NO: 83451 - DNA, 119 bp, Mus musculus
gtgtgtgtgttatcacatatatatatacataatatatatatatatatatatatatatatatatatatatatatatatatatatattatgtatatatgattatgtatatatcatagatat

SEQ ID NO: 83452 - DNA, 105 bp, Mus musculus
tgatatatacataatcatatatacataatatatatatatatatatatatatatatatatatatatatatatatatatatattatgtatatatatatgtgataaca

SEQ ID NO: 83453 - DNA, 104 bp, Mus musculus
gtgtgtgtgtgtctgtatgtctgtgtgcatctgtgtgtgtgtgtctgtgtgtatgttctgtgcatacactaatgctaatggtcacatgtgaaggtcagtggaca

SEQ ID NO: 83454 - DNA, 62 bp, Mus musculus
tatatatatatatctgtgtatatatatgtgtgtatatgtatgtatgtatgtgtatatatata

SEQ ID NO: 83455 - DNA, 117 bp, Mus musculus
ataaatgtgtatttatatatgtgcatgtatgtgtatgcatatgtgtgtatgtgtatgtatatatgtatgtgtgtgtttgggggtttgtacatgtgtatatacatatatatatgtgtg

SEQ ID NO: 83456 - DNA, 63 bp, Mus musculus
aaggctgaatatatacatacatatacatatgtgtgtgtgtgtctgtatgtgtttgtgtgtctt

SEQ ID NO: 83457 - DNA, 108 bp, Mus musculus
ctcctctctcttgatcagtagtggcagtatctttttcagagtactgtgataggcatggacagaaatgaagaatggtgaagggctctggtgtgtgggtgtgtggtggag

SEQ ID NO: 83458 - DNA, 63 bp, Mus musculus
gatagatatgcaacatgtatacacatatatatgtatgtatgtgtgtatatatacatatatatt

SEQ ID NO: 83459 - DNA, 59 bp, Mus musculus
gcccctggcagggacagggtctgcatagccagctcacctcactgtctctctgcatgggc

SEQ ID NO: 83460 - DNA, 93 bp, Mus musculus
ggactgcattgtgagcagctgtctgcactcaccctctctcaaacagactgcttatcagtcttagtgaaaaagcagcaagctgtcccttctcgc

SEQ ID NO: 83461 - DNA, 118 bp, Mus musculus
tcagtgagtgcataccatgtgtgttcttttgcaattgggttacctcacttgggatgatattttctagttctattcatttgcctaagaatttcatacattcatcatttttaatagctga

SEQ ID NO: 83462 - DNA, 117 bp, Mus musculus
tgtttctctacggtgctgagtccttatgatgcgcactgagacgtgattttgtagatgtcatatctgcatgtaataagcatgtgccttagttagggttcccattgctgtgaagagata

SEQ ID NO: 83463 - DNA, 78 bp, Mus musculus
cccagcggtctgtctgtctctgcctcctcagctctgcgattactggcatgccacacgattatgaacataggtcctggg

SEQ ID NO: 83464 - DNA, 101 bp, Mus musculus
tcttgcatgagtccctgttgccaagactaagtgtgaagcacttttttttttcttaatgtcgcttatttttggtttgcaattaaacgggcacgtaaacaagg

SEQ ID NO: 83465 - DNA, 119 bp, Mus musculus
ctcagtgactgtctgtcagcttatcatccttactgtcaccaccattgttaatactttgaatttttattgtgggcatatttggatattaagtaacctgttgtcttgggagacccattgtg

SEQ ID NO: 83466 - DNA, 97 bp, Mus musculus
aaatatagatgtatgtatgtatagatgtatgtatatataaatggatgtataggttaatgggtgaatagatagatttatagatgatggatttatattt

SEQ ID NO: 83467 - DNA, 67 bp, Mus musculus
aaggtagaggcttgtactcttctgttataaagcagccaatgagagataacagagaggcctctagctt

SEQ ID NO: 83468 - DNA, 69 bp, Mus musculus
gtctcctttgggtcctcttacgtgtgacagatgctcacactgtgcctgtctctgataacctagagaggc

SEQ ID NO: 83469 - DNA, 92 bp, Mus musculus
gctaagaaaagaggatattaggggctggagagatggctcattggttatggacactgactgctcttccagaggtcctgagttcaattcccagc

SEQ ID NO: 83470 - DNA, 56 bp, Mus musculus
gaccgactggcgagatggctcatcggctgagatcactgactgctcttccagaggtc

SEQ ID NO: 83471 - DNA, 60 bp, Mus musculus
gtagaatgtcagtgtctgtacagtggcacagttacagccacacacacactggcactcttc

SEQ ID NO: 83472 - DNA, 69 bp, Mus musculus
gcccataactgctgataaactgagctgcaggggatccgactccctctttcagtctctgtaggcatcggc

SEQ ID NO: 83473 - DNA, 106 bp, Mus musculus
tatatatatacacatacatacatatatatgtgtatatatgtttttatgtgtgtgtgtatatatatgtgtgtgtatatatatacatatatatatatacacacacaca

SEQ ID NO: 83474 - DNA, 80 bp, Mus musculus
gtgtgtctttgagagagtgtatgtgcatgtatgtgtgtgtatatatatgtatgtatgtatgtatctgtaagagagtatgt

SEQ ID NO: 83475 - DNA, 105 bp, Mus musculus
caggtgcctttctgttatcttagtgatttctggttcttgattctttagtatgaacgtaagaactaacttgccagataccacaggggaaactgtagatgttaactg

SEQ ID NO: 83476 - DNA, 64 bp, Mus musculus
tgtgtgcgtgtgtgtgtgtgtgtgtgtgtgttgtgtgcatgcacacattttgtatatgtgtgca

SEQ ID NO: 83477 - DNA, 98 bp, Mus musculus
tgattgacagctctatgcccctttgccatgtgactctcaggctccagtgattggggaaagatgtctgtgtggactctggggcactactctgtttccca

SEQ ID NO: 83478 - DNA, 81 bp, Mus musculus
atatgtctgtttctatatctatatctaaatgtgtgtatgtatgtatgcatatatgtatatgtatggtgggatatatatgtg

SEQ ID NO: 83479 - DNA, 85 bp, Mus musculus
gaatgaacatgagtgatgacggatgagacggggtgaggcatacactcacacacacagttacacactcacacactcatgtacactc

SEQ ID NO: 83480 - DNA, 66 bp, Mus musculus
gggggtgggaagtgggaggggtgtttgattttttttttaaatgagctccactgtgacctcactgtc

SEQ ID NO: 83481 - DNA, 101 bp, Mus musculus
tgtctatgtgtgtgtgcatatgtatgtatatatgtatatgcatgtgtttctgtgcatatgtgtgtacatgtgtgcatatgtattgtatgtgtgggtatata

SEQ ID NO: 83482 - DNA, 152 bp, Mus musculus
tgtggtaggaaggagtgactggttagtatcctaagtgaggtagtagcttgttcagcttccttagtggggacatcgacttggtcagcttgatgctctagaaaggaaagaagacagttgtaggaattcaaagggacgaagttaggccaacccac

SEQ ID NO: 83483 - DNA, 91 bp, Mus musculus
tacaggtgcgtgtgtgtatgtatgtatgtatttgtatatgtgtatatgtgtgaatttatatatgtgaatgtgtctgtatgtatgcatgtgt

SEQ ID NO: 83484 - DNA, 68 bp, Mus musculus
catatatatgtatatatgtatatatgtacatatatgtgtgtatatatatgtacatatacatatatgtg

SEQ ID NO: 83485 - DNA, 196 bp, Mus musculus
tacaatgtatgtgtgtatgtgtatatatatatatatatatatatatatatatatatatttgtgtgtgtatatatgcatatatatgtatatgtatgtgtctatatgtaaatttatgtacatatatatatgtgtatgtgtgcatatatatgtgtgtgtgtatgtatatatgtatatgtatatatatatatatatatgc

SEQ ID NO: 83486 - DNA, 97 bp, Mus musculus
aagcaatcgctttcacatttgcctggccctggatgactccactttacaagtagctcctggcttcattcggagcacaggcagaaaagacagaatgctt

SEQ ID NO: 83487 - DNA, 84 bp, Mus musculus
gtccctgccggactgaaatttagagtttatgctggaaatgtctgctcagttctgttattcatgaagacacactggccagaggac

SEQ ID NO: 83488 - DNA, 153 bp, Mus musculus
gtatatatatatatatatatatatatatatatatatatatatatatgtatatgtatatgtatatatatgtatatgtatatatatatatgtgtgtgtgtgtgtgtgtgtacatatatgtgaacacatatatgtatgtatatatgtatgcacata

SEQ ID NO: 83489 - DNA, 83 bp, Mus musculus
atggatatatatgtatatatatacacgcataacatatgtgtatgcacacatacatgtgtgtatatgtacatatgtatacacat

SEQ ID NO: 83490 - DNA, 109 bp, Mus musculus
tatacatatcatgtataaatccattatatataatatgtatatatatatatatacatatgtatatgatatgcatatatgtgtatgtatgtatatacatattcatacttaa

SEQ ID NO: 83491 - DNA, 115 bp, Mus musculus
gagagatataaaattaagacatattggtgctggagagatggctcagtggttaagagcactgactgctcttccaaaggatctgaattcaattcccagcaaccatatatagtggctc

SEQ ID NO: 83492 - DNA, 81 bp, Mus musculus
gatatttcatatatatgatatttgtgtatctatggcgtatatatgattgtatgtatatatatatgtgtgtgtgtgtatgtc

SEQ ID NO: 83493 - DNA, 120 bp, Mus musculus
ttgtcatggtctgcacacagaggggaaagagaacaacacatgactcctcatttagttgtcctgtctgctctttgctttggctgacagtgtggtgagtccttctgcaggttccttattccc

SEQ ID NO: 83494 - DNA, 93 bp, Mus musculus
tctactcttgtccccagaagcattcagtctttctgactctttcatcatatataaagttaccaagatgatgttactgctggtacgaagagcaga

SEQ ID NO: 83495 - DNA, 60 bp, Mus musculus
ttgtatatgtatgtgatgcatatataattgtatatatatatgtatatgtacatatgtcaa

SEQ ID NO: 83496 - DNA, 90 bp, Mus musculus
ccaatgtgggtcacaatcttgaattttttaaggggaaaggaaaacatgggtgtgtagtcagtgctgattctgtctgtgggccatatctgg

SEQ ID NO: 83497 - DNA, 98 bp, Mus musculus
agctttttgttgggactggagagatggctcagtagttaagagcactgactgctcttccagaggtattgagttcaattcccagcaaccacatggtggct

SEQ ID NO: 83498 - DNA, 114 bp, Mus musculus
tgaggggttacctgctcaagtggacttggactcttctgtcactcaggttctctgactcagaatgtgagttcaactagacgtatttattgtccattgaatagagtgtaccagtca

SEQ ID NO: 83499 - DNA, 149 bp, Mus musculus
aacagaatccagggaataaggaaaataggaggtctgtgcactcagactctctctgggaattcccctaaggaagctgttattctcagtctctgcctctcagggacccctcggttgaattgagattaagaatcctgttatgataacttcct

SEQ ID NO: 83500 - DNA, 123 bp, Mus musculus
tgtttgtatgtatatacatgtgtggacctgtatatattcttttgtgcatgtgtgtatatatatatatatatatatgtatatgtgtttctgtatatgaggaggtatatgtatatgtgtatgtat

SEQ ID NO: 83501 - DNA, 121 bp, Mus musculus
ggctatgtacatatgggtattctgtatatatgtatgaatgtatatttgtatatacatatgtatgtatgtatctatatacatatatatatatatatatatatatatatatactcctgtatgt

SEQ ID NO: 83502 - DNA, 97 bp, Mus musculus
ggaggattttcttttctgttctaatcaatttggtgttctgtaagcttcttgtatgtatatagctatatctttctttaggttggagaagttttcttct

SEQ ID NO: 83503 - DNA, 104 bp, Mus musculus
tacatatatatacatacatacatacacacacacacacatatatatatatgctacatatatgccgtatgtatgtatgtatgtatgtgtatatgtgtatgtgtgta

SEQ ID NO: 83504 - DNA, 108 bp, Mus musculus
ccatcactgaggttaggacaggaattgaaggtaggaaccgcagaggaagcctggttactgactctgtgtgttttcctgcacaagtcaggcctccgtgcctcaggatgg

SEQ ID NO: 83505 - DNA, 122 bp, Mus musculus
tatgcatgtatatgtatattgtgttatatatccatatatatgtatatgtgcatatatatgcatgtatgtttgtatgtatatgtgtatataccatatacatgtgaatgcctgcctgcatgcat

SEQ ID NO: 83506 - DNA, 198 bp, Mus musculus
tatttacctgtgtcttatggaatcatatatatatatatatgcacacacacacatatatatgtatatatgtatatatatatacatgtgtgtatatatgtatatatatgcacacatatatatacacatatatatgcatttatatacatatatacatatatacatatatataatcacatatatgcacatgtgtatatatat

SEQ ID NO: 83507 - DNA, 78 bp, Mus musculus
tggttgactggctggatctgaggtagacatgttcaccattgtgacttaaaaactccctcagtctgtatgtctccacca

SEQ ID NO: 83508 - DNA, 99 bp, Mus musculus
gaaccagagcagtggtttcaaaggaagactgtaaatatattgaaaattcagagagctttcaggatgtttacatacccaaattcaacccctggcaggctc

SEQ ID NO: 83509 - DNA, 71 bp, Mus musculus
cttagccagagaaatggccacagagaggaagaagagaaaactgtgagcctctctcactatttcactctgag

SEQ ID NO: 83510 - DNA, 89 bp, Mus musculus
gtagggagtggaaggctggagagatggcttatcggtgaagagcactgactgctcttccagaggtcctgagttcaattcccaacaaccac

SEQ ID NO: 83511 - DNA, 56 bp, Mus musculus
gagtgtactgtgtcactctggcagtctcgtgctgcccttggtgacaagtgacaccc

SEQ ID NO: 83512 - DNA, 82 bp, Mus musculus
cctcagaagctgtctactttatgagacagtctctcactgaccggggactgactgactaggttaggtagactagcttatgagg

SEQ ID NO: 83513 - DNA, 109 bp, Mus musculus
ggtagtcatcctgctattttacatgtggcctagttttaatttatatatatcccactttgcaggtcagaaaaacagagccataggtgggcaaaaaagcatgacaaatacc

SEQ ID NO: 83514 - DNA, 125 bp, Mus musculus
tgtatatgtatagtgtgtattggcattgtgtgtgcatatacatctctgcatgtttctgtctgtgcatatgcatgtgcatgtgagtctaagcatgcacgcatgtgtgagtgtgtgtgtgtgtgggg

SEQ ID NO: 83515 - DNA, 203 bp, Mus musculus
gtatgtatatacgtatatacaaatatacacatacatacatatatatgtatatgtatggctatgtatatatgtatgtctatgtatatatgtgcgtatatatgtatatgtgtatatatgtatatgtttgtatatatatgtatatatgtgtgtgtgtatgtgcatggatatatatatatgtacatatatatatatatatacatata

SEQ ID NO: 83516 - DNA, 90 bp, Mus musculus
ctttctaaatctgatccagttgataatgaagacctgacattccgggtggaagaggaggtgatgtcagaagatacagatgaactagcaaag

SEQ ID NO: 83517 - DNA, 114 bp, Mus musculus
ctactacttaaggctgtgtagatgagtgttgccagagtaaatgtgtttgaaataaagagaagagagtttgcactggtatttcttttccactcctatagagaatgagtttgatag

SEQ ID NO: 83518 - DNA, 100 bp, Mus musculus
gtatatatatatgtgtgtgtgtacatacacatatatgtgtatatatgtgtgtatatatgtgtgtatatatgtgtttgtatatatacatatatatatatgc

SEQ ID NO: 83519 - DNA, 97 bp, Mus musculus
gatcagtcttaggccatggtggtctgataggatacatgggacaatttcaatatttatgtatctgttgaggcctgttttgtgaccaattgatatggtc

SEQ ID NO: 83520 - DNA, 99 bp, Mus musculus
ttgtccagtattggtgcctgtgatagaagtggtgcctgtgatagaagtgagtgagaaaatgcacagagaaatatttttatataagcattaacaggatag

SEQ ID NO: 83521 - DNA, 90 bp, Mus musculus
ggaactagggtagcagtcaatttgcattaaatggaggacccttttttatttgaagcaaaggaacagttgtgttgatgttgctcctgtatc

SEQ ID NO: 83522 - DNA, 121 bp, Mus musculus
tggaacatcttctggatatatgcccaggagaggtattgcgggaccctctggtagtactatgtccaattttctgaggaacctccagactgatttccagagtggttgtacaagcttgcaatcc

SEQ ID NO: 83523 - DNA, 96 bp, Mus musculus
gaacagtcagagggtggaccaggatgagaagtgtaaaaaaagtgattaaataaaaatttttttaaatgtcatcttatagctagcttactgaagttt

SEQ ID NO: 83524 - DNA, 85 bp, Mus musculus; identical to SEQ ID NO: 65139

SEQ ID NO: 83525 - DNA, 85 bp, Mus musculus
ggccatggtggtctgataggatacatgggaaattttcaatatttttgtatctgttgaggcctgttttgtgaccaattatatggtc

SEQ ID NO: 83526 - DNA, 83 bp, Mus musculus
tttaatcttttatgtatgtatgtatgtatgtatgtatgtatgtatgtatgtatgtatgtaagtgtgtgtgtatgtattttaaa

SEQ ID NO: 83527 - DNA, 73 bp, Mus musculus
gcatctatgtatgtataaacatgaatatatatgcatacatgtgtatgtatatatgtaaatatgtatattatgt

SEQ ID NO: 83528 - DNA, 92 bp, Mus musculus
gtatgtgtttgcatgttcacacctattataatatatatagttatatatagctgtatattatatatagtatgtgtgtgtatataaatatatac

SEQ ID NO: 83529 - DNA, 85 bp, Mus musculus; identical to SEQ ID NO: 57439

SEQ ID NO: 83530 - DNA, 202 bp, Mus musculus
tatgtgtgtgtatatatatatacatatgtgtatatatgtatatatttgtgtgtgtatacatatgtgtatatatgtatatatgtgtgtgtatgtatatacatatgtgtacgtgtgtgtatatatacatatgtgtatatatgtatatatatgtgcgtgtatgtgtgtgtgtatatacatatgtgtatatatgtatatatgtgtg

SEQ ID NO: 83531 - DNA, 77 bp, Mus musculus
aagcaggctgaacaacccatgaagagcaagccagtgtaagcagcactctggcacgctctctgtctcagctcctgctt

SEQ ID NO: 83532 - DNA, 97 bp, Mus musculus
agggctctaagtcttttatgatgtggctcttttctgaatttgtatttcattaaattggagactctagatctgctgcgttatgtatactttgatttct

SEQ ID NO: 83533 - DNA, 106 bp, Mus musculus
gccttagtgcatggtgatctgataggatacatgggacaatttcaatatttttgtatctgttgaagcctgttttgtgacctattatgtggtcaattttggagaaggt

SEQ ID NO: 83534 - DNA, 61 bp, Mus musculus
tatgtcatatatatatacatagaaacatatatatgtttttatgtatctgtatataatcatg

SEQ ID NO: 83535 - DNA, 65 bp, Mus musculus
ggtagttctctggctctttctctgattcatgtttatggatcagatgaaagttctcctctgctgct

SEQ ID NO: 83536 - DNA, 84 bp, Mus musculus
agctccttcttcagcaccattcctggctgcatgttgccatgcttcctgccatgatgatgatgataatgatgatgatgatggact

SEQ ID NO: 83537 - DNA, 82 bp, Mus musculus
tcatcatcatcattatcatcatcatcatggcaggaagcatggcaacatgcagccaggaatggtgctgaagaaggagctgaga

SEQ ID NO: 83538 - DNA, 118 bp, Mus musculus
ggagggagggagggagggagggagggagggagggagggacacagtgactgttataagctaaatttgtaattatttattccttctcagaaccgcctgtgtccgagaaaaccatctctgc

SEQ ID NO: 83539 - DNA, 113 bp, Mus musculus
acatatattatatgtatatatacatatgtataactctgatatatcatatatataaatgtgcttatatatatgtatatatatatatatacacacacatatatgttttgtataca

SEQ ID NO: 83540 - DNA, 85 bp, Mus musculus; identical to SEQ ID NO: 57470

SEQ ID NO: 83541 - DNA, 104 bp, Mus musculus
tgtatgcccactccatgacttcagtcccttgatgccaagtaaatgctattttatttacaaagtatttattgagcctgacctgaagtcactaaggtaggaaaaca

SEQ ID NO: 83542 - DNA, 79 bp, Mus musculus
ggttatccagaggtcccttgcttctgctcatcggtgagctcactcactctgtgtgtttaagtttatggacctcagtgcc

SEQ ID NO: 83543 - DNA, 98 bp, Mus musculus
ggctttctaactatggatttcactggtgctgacagatgaatgagaggtggtccctcgggcactcaaaaagctgaattctagccagtgatggagaagcc

SEQ ID NO: 83544 - DNA, 76 bp, Mus musculus
tgcgtgtgcgtgtgcgtgtgtgtgtgtgtggtctgtgtctgcagcctctgtgtgtgtgcatgtgcatgtgtgtgca

SEQ ID NO: 83545 - DNA, 117 bp, Mus musculus
gtgctctgtctcctgctgtaagagtgccaaagactggccatgtgtcagaagaaatacagcacacacccctgcaacatgaacaatctgccgggtactcttctcttggctctttgtaca

SEQ ID NO: 83546 - DNA, 116 bp, Mus musculus
gattttatatatgtgtatatatatgtgtgtatacatatatagtatgtatatctatatatgtatatatacatatacatatctatatatgtatatacacatatacatatatatatata

SEQ ID NO: 83547 - DNA, 103 bp, Mus musculus
gggagacagactgtgatccaggacagaagttacagtgctcttagaacagtgtcagaacttgaaactggagaggatggctatgtttgatgacggataggttcct

SEQ ID NO: 83548 - DNA, 104 bp, Mus musculus
tatttgtcaatttcattacatgtatgtatgtatgtatgtatacacacatatctgtgtgtatatctgtgtatatatatatacatatatgcatatatatacaaata

SEQ ID NO: 83549 - DNA, 108 bp, Mus musculus
ggacactacctgtgttgtcttctagaagtttcagcatcttgggatttcacactacagtctttggtgtgctctgagttgagttttgtgcagggcagtgggttagagtct

SEQ ID NO: 83550 - DNA, 131 bp, Mus musculus
acattagaatgtgcatgtttatgtacttatgcatatatgtatatatgtgtgtgatatctatatatgtgtatatatatgtgtgatatatgtatatatgtctagatatgtgtgatatatgtgtatgtgtgtgt

SEQ ID NO: 83551 - DNA, 101 bp, Mus musculus
atgtggtatataaaacacatgtgtatatatgtatatatacacataaaatatgtgtgtatatgtatatatatatatatatgtgtgtgtgtgtgtatacacat

SEQ ID NO: 83552 - DNA, 176 bp, Mus musculus
catatgaatggcttatatatggtttatatatctgtatataaagatagatagccatacatgtgtgtgaatatatgtgtgtatgtatatgtgtatatatctataaatgtatatacacatatatatatgtatatatacatatatatatatatatatatatatatatatatatatataac

SEQ ID NO: 83553 - DNA, 102 bp, Mus musculus
gaattgcctgtgctggggctggtgagatggcacagcggttaagagcactgactgctcttctagaggtcctgagttcaaatcccagcaaccacatggtggctc

SEQ ID NO: 83554 - DNA, 88 bp, Mus musculus
gagcttcatgtggtctgtgaattgtgttttggtttctgagcttttgggctaatatccactgatcagtgagtgcataccatgtgtgttc

SEQ ID NO: 83555 - DNA, 86 bp, Mus musculus
ggaaacatcacgtttaaggctgagtgttccaaggtctttcgatctagacatattgtctggctctaggtctctctgtctttgttccc

SEQ ID NO: 83556 - DNA, 59 bp, Mus musculus
tgatttcagagtaagatactccacggctcataaagagtctctctctctctctgaggtca

SEQ ID NO: 83557 - DNA, 115 bp, Mus musculus
ttgtctgcactggggctgtactgagtaaaatgcagaaccaggaggagggagcatgttttgtctgcctgcctgcctgtctgttgaagtgaaaacctattcagccatagatgttcaa

SEQ ID NO: 83558 - DNA, 105 bp, Mus musculus
ggagggtagccatgggtactagaagaacaggagcagagggcagtagaccttgtctgtcaccctctctatgtctggcctcatcttatgagttcctaggcagcttcc

SEQ ID NO: 83559 - DNA, 86 bp, Mus musculus
gaagttgacgaatctcctctgaatttgtgtgtgtgcgtatgtatgtatatatatatgaactttcagcttggagaataatcaacttc

SEQ ID NO: 83560 - DNA, 85 bp, Mus musculus; identical to SEQ ID NO: 57439

SEQ ID NO: 83561 - DNA, 89 bp, Mus musculus
gttccccaaagtgtctctctcacacacacattatcctactacctacaacagtgacttgtgtgtgagatacactgatacagtattggaac

SEQ ID NO: 83562 - DNA, 79 bp, Mus musculus
tatatgtgtatgtatatattatatatgatgtgtatatctattatatatatatgtgtgtgtatgtatatgtatatgtata

SEQ ID NO: 83563 - DNA, 69 bp, Mus musculus
ctggtgtgtctgtctgtgtgtacgtgcatactggtgcaggtgcctggggaggcagtaagacgacatcag

SEQ ID NO: 83564 - DNA, 85 bp, Mus musculus; identical to SEQ ID NO: 66071

SEQ ID NO: 83565 - DNA, 64 bp, Mus musculus
atgttcatagtaaatgcatgtttatatgtactatatatatatatatatgtggatacatgagcat

SEQ ID NO: 83566 - DNA, 116 bp, Mus musculus
gcccaaggaatagtgttccctacattttggtgtcacgtgggttcatccttagttaatttttacatatgtacactcacagagacacgcagaagaggggactcactgatcttctaggt

SEQ ID NO: 83567 - DNA, 76 bp, Mus musculus
cactgctgactggtgatactgtggactgggcaaccagagaaagcccagggaatggtagttgatggagaaggtggtg

SEQ ID NO: 83568 - DNA, 89 bp, Mus musculus
ggtacacaaaggttcgcagagagcaagcagaggagtcaagctctagcccagttctgttgcccccctctctgtgtgtctgtctgtctgtc

SEQ ID NO: 83569 - DNA, 91 bp, Mus musculus
tatgcatatatctatgtacacatgtatgtatatatgtgtatatacacatatattatatgtacatatataggtacttacaaatatatgcata

SEQ ID NO: 83570 - DNA, 84 bp, Mus musculus
ttcatcactttgggcagacagaggccactctttttatttatttgtgctgactcttggctctgttttacaccctgaaaggatggg

SEQ ID NO: 83571 - DNA, 84 bp, Mus musculus
catgactatgagcttaagatatgtatgtgctcttccacggccatggcccaatgttaatgcatgtatatttgtatttgtgtcatg

SEQ ID NO: 83572 - DNA, 103 bp, Mus musculus
gtgagcccagatttgaaagttagacttaactctctttgtgtctcccaaggtccctatttatctgtttggtgatccgaatctgtgcttctggatctgtgcttgc

SEQ ID NO: 83573 - DNA, 56 bp, Mus musculus
gtgtgaagtccagccgtcaaaagtgtacggaagtacactgtcgctgtctctcagac

SEQ ID NO: 83574 - DNA, 73 bp, Mus musculus
agtgagtggatggatggtctgcctggtgccgcctccctttgcacacactctggctccctgtctatttctctct

SEQ ID NO: 83575 - DNA, 82 bp, Mus musculus
acttgtgaacatttcacctctgacagacactgaggccctcctcctaagcccagtgttctcagccaggtttcaagaacaaagt

SEQ ID NO: 83576 - DNA, 127 bp, Mus musculus
tctgtcccttccctctcctgcttagaatttacctgccccagcacagcagtctcttccctgtgtggctgtctctggctcctttccttggcgggaggtggagacagaaggagcgagagccagcccacag

SEQ ID NO: 83577 - DNA, 97 bp, Mus musculus
agaagagggcatcagatcccattacagacagttgtgagccaccacatggttgctgggaattgaactcaggactgctgttaaccactgagccatctct

SEQ ID NO: 83578 - DNA, 115 bp, Mus musculus
agcctgacagataatgaaaatagtaaataatggtgtttgcaagaagaatgtgagctctgatcatagtcactgtgggctcaccatggaggctgctttctggttgaggttagtgctc

SEQ ID NO: 83579 - DNA, 113 bp, Mus musculus
tcactatgtagctgtgtagctgtggctggccctaaactcacaggaatggacctgctctgtctctctctgtgttagggttaaaggtgcttgccaccatgcccagcttctgtggt

SEQ ID NO: 83580 - DNA, 76 bp, Mus musculus
gagcgtgtgtgtgtgtgtgtcagtcagttttctcctttcacctgtgagtgaggtgatgaaactcactcaggtcctc

SEQ ID NO: 83581 - DNA, 73 bp, Mus musculus
gtgtgcgtgcgtgcgtgcgtgcgtgcgtgtgtgcgtggtgtgctcacgcgtgcacgcacgagtgagtggaggc

SEQ ID NO: 83582 - DNA, 76 bp, Mus musculus
agatagtctgacaatagaatagtttgggttctgtgggcttcctcatctcattctctgtctgtctgtctgtctgtct

SEQ ID NO: 83583 - DNA, 93 bp, Mus musculus
cctgaccacatttgttctctttggaagaatgtcatgtgtagcccacactgaagagtgactggtcaggaccctctcttggagggtggagtggtc

SEQ ID NO: 83584 - DNA, 97 bp, Mus musculus
ggtgcaggctgtcagtgtcactctctcatccaagtgggtgcaggctgtcagtgtcactctctcatccaagtgggtgcaggctgtcagtgtcactctc

SEQ ID NO: 83585 - DNA, 89 bp, Mus musculus
ggtgctgggagggtgcttgcactgttctctctgtgccactggctttttatcaacaggaaacactgcaaacccattctccacattaaacc

SEQ ID NO: 83586 - DNA, 75 bp, Mus musculus
gggctggagagatgactcagaggttaagagcactggctgctcttccagaggtcctgagttcaaatcctagcaacc

SEQ ID NO: 83587 - DNA, 79 bp, Mus musculus
cacacatatatatcacatacatatacacacacacacacacatatgtaatgtgtgtgtatatgtatatatgtatgaatga

SEQ ID NO: 83588 - DNA, 81 bp, Mus musculus
catgtgtatgcatgtgtgtgtgcagtgtatacatgtgtgtgcatatatgtatatgtgtgtacatatatatacatccacatg

SEQ ID NO: 83589 - DNA, 78 bp, Mus musculus
agtttactaggagcatgtgactccgaagtgacagggtagtcactgaactgtctgtcactcgaagtcttttgataagct

SEQ ID NO: 83590 - DNA, 68 bp, Mus musculus
gccccgcctgtctgtctgtctgtctcaagcacgcacaagtgcaggcacacacagatctaggagagggt

SEQ ID NO: 83591 - DNA, 66 bp, Mus musculus
cagcagagcagggcgtatgctgtggtcattttggccacggtccttctcagtcacgctgtctgactg

SEQ ID NO: 83592 - DNA, 117 bp, Mus musculus
tactcgtgtgtgtgtttgtgtgtgtctgtatgtatgtgtgtacatggatgtctgtgtgtctctctctctgtgtatctatgtgtttgtgtatacatatatgtctacatgtgtctgtgt

SEQ ID NO: 83593 - DNA, 119 bp, Mus musculus
gatgctacaagagtaatctttgcgggctggagagatggcttagtggttaagagcactgactgctcttccagaggtcctgagttcgattcccagcaaccacatagtcgctcacaaccatc

SEQ ID NO: 83594 - DNA, 91 bp, Mus musculus
ttttgtttacctttagctgtcacctttggactcagttcctttgagggcacagagtgagcacagtccttttggggacttctaggttttgaaa

SEQ ID NO: 83595 - DNA, 118 bp, Mus musculus
taacatacatagaggtagaaatatatatatatatatatatatatatatatatatatatatatatatatatatatatataatatgtggttatatatgtgtgtaacatatatatatatat

SEQ ID NO: 83596 - DNA, 85 bp, Mus musculus
gtcttggaactgactcttgtagaccaggctggccttgaactcacagagatctgtctgcctctgtctcttgagtaagtgatgggat

SEQ ID NO: 83597 - DNA, 72 bp, Mus musculus
tggagttacggggctggagagatggttcagcaagtaagggcactgactgctcttccagaggtcctgagttca

SEQ ID NO: 83598 - DNA, 93 bp, Mus musculus
tttacttgtgggtactaaggcagatagatctcaagttcaaggcatgcctggacaaatgagtgagactctgtctcaaagattttgaaaagtgga

SEQ ID NO: 83599 - DNA, 114 bp, Mus musculus
gaggttagttagcctgagggtgatgctggcagggctgccagtggaaggaggcatggtgacttacagtctctgagattcaggaagcattagcatccccatcttcgctctcacctc

SEQ ID NO: 83600 - DNA, 85 bp, Mus musculus; identical to SEQ ID NO: 57470

SEQ ID NO: 83601 - DNA, 101 bp, Mus musculus
tgcctgtctctgcctatcaagtgctgggattaaagacgtgagccaccaccactcggctgtgtatatatttttaacattgcaaaagaggtcagagatttgca

SEQ ID NO: 83602 - DNA, 118 bp, Mus musculus
tgcgtgcatgcatgtgcatgagtgtgtctgtgcatatgtatgcatgtgtgtgtgtgtatctgtgagtgcatgcttgtgtgtgtgtatatgcatgtatgtgcatgtgtgtattcactga

SEQ ID NO: 83603 - DNA, 71 bp, Mus musculus
ggtcagaagagtgggagctcaggccttagatgcagtcacccatgcctttctcctgtccttgtcttctgacc

SEQ ID NO: 83604 - DNA, 74 bp, Mus musculus
ctgcaaagaggggagagaagcaaagagcagtaaggtcccagcgtttccacactgtctgtctctgtccattgcag

SEQ ID NO: 83605 - DNA, 115 bp, Mus musculus
gcatgcaggcaaaacaccaatgcacatttaaagatttatttatttatttatttatttatttatttaaggtatatgagtacactgtagctgtacagatggttgtaagccttcatgc

SEQ ID NO: 83606 - DNA, 83 bp, Mus musculus
ttttgtctgtttcagaggaatgttgtgtcattctggaccccataacaagtcatatatacataattctccttctccaggcagga

SEQ ID NO: 83607 - DNA, 64 bp, Mus musculus
gctccctcagcaggatttcagaggacagagagctctagcccctgcttctggtctatggaggggc

SEQ ID NO: 83608 - DNA, 69 bp, Mus musculus
cttggtgctacttgcttgtattgtagttccagtacgtaagaggctgaagcaggaaggtaggaacccaag

SEQ ID NO: 83609 - DNA, 91 bp, Mus musculus
tgcttaagagaggaactgaggaggctggagagatggctcagcagttaaaagctgactgctcttccagaggtcctgggtttaatttccagta

SEQ ID NO: 83610 - DNA, 107 bp, Mus musculus
ctactttgtagactggactggcctcaaactcatagagattctgttttgtttttaacaagacagagtctctcagtgagattgagctgaccccaaaatgtgtggaggag

SEQ ID NO: 83611 - DNA, 64 bp, Mus musculus
gcctggtcagagtcactttctgtctcagtacatagtggcaggatagagagagagagacagaggc

SEQ ID NO: 83612 - DNA, 110 bp, Mus musculus
gagttttcaaggttgggggaggggagaacatttactcgcgtcaatatttcctcttacaaatttgagaggagagagagttctcaattcgactcccttgaacttgatttctt

SEQ ID NO: 83613 - DNA, 101 bp, Mus musculus
tctcaaaagggtactttgagtgtatgtctgtcactggctgctattgtgtgtcaacctgacacaagctagagtcctcagacaggaaggagccttggctgaga

SEQ ID NO: 83614 - DNA, 97 bp, Mus musculus
cagggatgccactactaatgctggtttatgcactggagtagactctttgttgttgtttttcaagacaagattgctctgtgtatccatggctatcctg

SEQ ID NO: 83615 - DNA, 85 bp, Mus musculus
ggagggaagagaaagtcaagtagtctagtaattttgttctgtaaacaaactgtgctccataggtacttccttcctccttccttcc

SEQ ID NO: 83616 - DNA, 80 bp, Mus musculus
gtgtatatgtgtgcatatacatatatatacatgtatgtatgtatgtatgtatgtatgtgtgtgattgtaccatgcatgtg

SEQ ID NO: 83617 - DNA, 84 bp, Mus musculus
cctgtaccatatgtctgcagtgaggaagggctcagaagaaggcgtctgatctactgcaactggatgtgcaggcaattgtgaggc

SEQ ID NO: 83618 - DNA, 71 bp, Mus musculus
acatatgtgtgtgtgtgcatgtgtatgcacatatatgtatgtatgtatgtatgtatacacacacagtgtgt

SEQ ID NO: 83619 - DNA, 76 bp, Mus musculus
ggtttggctgtcactgactctgtggggtggggcaggagagactgcctgagcctttagatttcggaaactccaggtt

SEQ ID NO: 83620 - DNA, 119 bp, Mus musculus
gcatgtatatatacatgtgtgtatatatgtatgttcatgtatgttatatatcatttcgtgtgtgtgtatatatatatatatatatatatatatatatatatgtacttattttttaatgt

SEQ ID NO: 83621 - DNA, 79 bp, Mus musculus
atatatatacacacacacgcatatatatatatatatacgtatatatatgtgtgtgtatatatatatatatatatatata

SEQ ID NO: 83622 - DNA, 129 bp, Mus musculus
tatatatatatatatatatatatacacacacatatatatacgtatatatatatatatatgcgtgtgtgtgtatatatatgtgtgtgtatatatatatatatatatatatatatatatatatatatatat

SEQ ID NO: 83623 - DNA, 77 bp, Mus musculus
gtctctgtctctgtgtgtgcgctcgtgcacacttatcacacaaatgttcatgtgtgtgcacatacatgtgttgagac

SEQ ID NO: 83624 - DNA, 84 bp, Mus musculus
ataggaggaggcgttattggcatggacgcagtggcttgtcatcggtgcctgctgtgagtctctctcactaacaatcctcactat

SEQ ID NO: 83625 - DNA, 73 bp, Mus musculus
ggcagaaactagactgtctgtcagtctcactctggggctagaggggagattgggtttgacagtgtacagggtc

SEQ ID NO: 83626 - DNA, 62 bp, Mus musculus
gtatatgtatatgtgtataagtatatacgtatgtgtatatgtatatatgtttgtacatatat

SEQ ID NO: 83627 - DNA, 62 bp, Mus musculus
gtgacatgagcctgtgagatgggaatgggggcacacactcactcactcactcactcactcac

SEQ ID NO: 83628 - DNA, 120 bp, Mus musculus
tggtggagacaggaatagggggtatttgttgtcttggatgagggacgggagagatctgtgtgagctgaggccccaccaggagttgactgctcgccagtctattcaatctccctcccacat

SEQ ID NO: 83629 - DNA, 105 bp, Mus musculus
tcatattattttcctgctgctctaacgcccccacccaatatgtatgtatgtatgtatgtatgtatacatatgtatatttttgtgtagagacttgtgggtgtgtga

SEQ ID NO: 83630 - DNA, 122 bp, Mus musculus
gattgtgatggcaggcagccagggtcccttaatggctttatcctgtcacattgtgtctctctgtcactgaggagggcacatgccccaggaatggctgagaataagtagggtgaagtctaagg

SEQ ID NO: 83631 - DNA, 68 bp, Mus musculus
gaaataagggctggagagatggttcagcgggtaagagaactgactgctcttccagaggtcctgagttc

SEQ ID NO: 83632 - DNA, 120 bp, Mus musculus
gtgtgtgtgtgtgtatgtatatatgtatatgtgtgtatatgtatatgtgtgtatatatgtatgtgtgtatatatgtatatgtgtgtgtatgtgtgtatatatatgtgtgtatatgtatat

SEQ ID NO: 83633 - DNA, 77 bp, Mus musculus
gggttctgggaacagtagtgactctgaacttgtatatagccatgagcacagtccagaggggctactttcaccatcct

SEQ ID NO: 83634 - DNA, 74 bp, Mus musculus
taggtgaatagcccgtaacactgcataaattcctctttagggggtgtgtgtgtgtgtgtgtgtctgtctgtctg

SEQ ID NO: 83635 - DNA, 81 bp, Mus musculus
tggaagcttagttcagtgtcactttctgaaaagacgtgaactcactttgtagaccaagctggcctcgaactcagagatcca

SEQ ID NO: 83636 - DNA, 95 bp, Mus musculus
gggagcaatagtggcaggagagtgagctcacactgcacccactgtcaggaagcagggaggtggcgaaagctctcccctctccccattggtctccc

SEQ ID NO: 83637 - DNA, 70 bp, Mus musculus
gagcttctatccatgcagggcagacccggagctgtctctgtctcagttacttctgtcatggctgcagctc

SEQ ID NO: 83638 - DNA, 72 bp, Mus musculus
gagtcacgctgtctctgtgatcctgtgattctgggatccagcgatcctgagatcctgggtgtgtctgagctc

SEQ ID NO: 83639 - DNA, 85 bp, Mus musculus; identical to SEQ ID NO: 63712

SEQ ID NO: 83640 - DNA, 60 bp, Mus musculus
acagcccctttacagctgagtgtttcgaggtctctcactctctgtgtaaagtctggctgt

SEQ ID NO: 83641 - DNA, 73 bp, Mus musculus
ctcacagaggtctgtctgcctctgcctctgagtgctggagttaacgatggggagggggagaatactgggagag

SEQ ID NO: 83642 - DNA, 111 bp, Mus musculus
gtgtgcttatcataggggtcctctggttgctgggagcctcatttctctctctctctggaatgcagctgctggagggaagtatctggcattgggatcatgctgatagcagat

SEQ ID NO: 83643 - DNA, 69 bp, Mus musculus
tgctgttatgggagaggaaactgaggttgcctttaatggactctctcacgttcactctgtcaattagca

SEQ ID NO: 83644 - DNA, 126 bp, Mus musculus
atatggatatatatatgtgtatgcatacatacatatggatatatatgtatatatgtatgtgtatatatatgtacatatatgtgtgtatatatgcatatatatacatatacacatatatgtatatat

SEQ ID NO: 83645 - DNA, 118 bp, Mus musculus
tatatatatatatatacatatatatgtatgtatgtgtatatatatacatatatgtgtatatgtatatatatgcatatatacacacatatatgtacatatatatacacatacatatata

SEQ ID NO: 83646 - DNA, 99 bp, Mus musculus
ggtaggcagaccagtgctcagcacattaggtcacagaacagagagtgggattggctggatactggttgaggtttatcttctgctgtgtggccttgagca

SEQ ID NO: 83647 - DNA, 82 bp, Mus musculus
agcctctgcagctttttcttaatgtcgggagcagactgaccaatgaaggccatggctacagtggctctctgcccctctgaca

SEQ ID NO: 83648 - DNA, 63 bp, Mus musculus
agcggctttaagtcaggacaccgagagagatatagaatgctctctctgtgactgactgccact

SEQ ID NO: 83649 - DNA, 82 bp, Mus musculus
ttgtgtgcacacagtgatgcttgtgtgcacacagtggtgcttgcttgtgtgcacacagtggtgcttgcttgggtgcacacag

SEQ ID NO: 83650 - DNA, 85 bp, Mus musculus; identical to SEQ ID NO: 57439

SEQ ID NO: 83651 - DNA, 73 bp, Mus musculus
gtcagctactgagttcagatccctcaggcagcaatgtggagactgtctgtgagtctgaaagatggcggttggc

SEQ ID NO: 83652 - DNA, 96 bp, Mus musculus
ggggggggggggggggggacggggacgggacgcgccacagggcctggctggctgctgccgctgcacactctctttgactcagtgcttctcctttct

SEQ ID NO: 83653 - DNA, 92 bp, Mus musculus
tcgcatctcttggtgtctctgtcactgtgttgtttgggtcacacagcccattccttgttatggtctcttcaaagacattttgaattaagtga

SEQ ID NO: 83654 - DNA, 71 bp, Mus musculus
gtggagagagacgtgagaggtcacacagctcgtgggatggcggtgaccaccgacagtcaaaggctctgcac

SEQ ID NO: 83655 - DNA, 100 bp, Mus musculus
agaaaggagtgagagcttcttggatagctttaggttttatatatatatatatgtatatatgtatgtctatctatatatatagatctctctctctctctct

SEQ ID NO: 83656 - DNA, 65 bp, Mus musculus
tagacactcaacatcaagctttgtgtgcacacacacacacacagagttgatctcatggaagtcta

SEQ ID NO: 83657 - DNA, 73 bp, Mus musculus
gagcgggagtggtaaagcctgttcagttggcaggacacggtccctgtcacacacacagactgcctctctcttc

SEQ ID NO: 83658 - DNA, 93 bp, Mus musculus
ggctgcgtgggttgggttaagctgtgtgtcttagtgttctattgctgtgaagagactctgtgactgtaacaactcttacaaaggaaagcagtt

SEQ ID NO: 83659 - DNA, 115 bp, Mus musculus
ctgcaacgtggtttgctgttcccacagccaatttggtcgctgtgaggtagtgttgtgtatttcgagatggtgactgattgactgtctggtttattcacaaatagcggaggtgtgg

SEQ ID NO: 83660 - DNA, 76 bp, Mus musculus
gtgagatccacaagtgttacacagctagctgtaccagcaagccaagctctgtctctgtcactccgtggagtcccat

SEQ ID NO: 83661 - DNA, 70 bp, Mus musculus
gtgggggcctggatgggctgtgccatctctgctccaagttggctgagaacacactgcctctccctctgac

SEQ ID NO: 83662 - DNA, 72 bp, Mus musculus
ctgatgggttcttatttccagacagtccagaaatggcggcatggaatctgagaagaaagacagcaccctcag

SEQ ID NO: 83663 - DNA, 73 bp, Mus musculus
ctacccactggcagaattgagcaggaagagcattattctcagcctgtgggcagttgcagaaccaggagggagg

SEQ ID NO: 83664 - DNA, 100 bp, Mus musculus
ctgttggacaaggagctgatttctgatggggagagggtagatgtgactaagaaaataactttattttttttgcatggacacagctcaagttctgtcagct

SEQ ID NO: 83665 - DNA, 62 bp, Mus musculus
agaaacgtgtatgtatgtatgtatgtatgtacatatgtatatatgtatgtgtatatgtttgt

SEQ ID NO: 83666 - DNA, 111 bp, Mus musculus
tttctaagcgactgtcccacatcgctcgcttcatttcccacaagccttcattcccccgtaaaagggcggagtgaggctggtctgaggtttgtgattcagacgcctgtgaga

SEQ ID NO: 83667 - DNA, 93 bp, Mus musculus
tatgtgtgtgcattcatgcatacgtgtgtgtgtgtgtgtgtgtgtgtgtgtgcatgcgcgcgtgtgcatgtgagcacatgtgtatgtatgtgt

SEQ ID NO: 83668 - DNA, 91 bp, Mus musculus
acagaggttagagaatggctcaggggttaagagcactgactgctcttccaatggtcctgagttcaaaatccgccaactcacaaccatctgt

SEQ ID NO: 83669 - DNA, 89 bp, Mus musculus
gtatagattcttaaaatggtcaagaaatcaatctagaaatagttctgtatttagagtagtgattttctacttgatcctgagaattgaac

SEQ ID NO: 83670 - DNA, 118 bp, Mus musculus
gttcaatgttccacatgtttaacagcacaaaatttttggagaaattatataaattttaaataataaacactgttttctccaaaaatattagggtagctgctcagacagacagacagac

SEQ ID NO: 83671 - DNA, 109 bp, Mus musculus
tgtctgtctgtctgagcagctaccctaatatttttggagaaaacagtgtttattatttaaaatttatataatttctccaaaaattttgtgctgttaaacatgtggaaca

SEQ ID NO: 83672 - DNA, 139 bp, Mus musculus
ctgtggggcgggatggggagggggggtgagagatgctggtgcctcggcgtctctgtctctgtatctctctgtctctgtctcggccctaggaaaggagaggcttgggctggaccgagctggaagggggcctagtgggaga

SEQ ID NO: 83673 - DNA, 77 bp, Mus musculus
gggggctggagagatggcttagcggttaagagcactgactgctcttccaaaggtactgagttcaaatctcagcaacc

SEQ ID NO: 83674 - DNA, 85 bp, Mus musculus; identical to SEQ ID NO: 57439

SEQ ID NO: 83675 - DNA, 85 bp, Mus musculus; identical to SEQ ID NO: 57439

SEQ ID NO: 83676 - DNA, 59 bp, Mus musculus
tgcggaatagacagatggtcaggttcgacaaaaaacgtgactgtgtctgtgtgtctgta

SEQ ID NO: 83677 - DNA, 101 bp, Mus musculus
cggtttgtggtgatggctaaatctcaggaaatttattcttggcaagatatatatatatatacacaagtagtatgtctctagaatgctcatatgaggaactg

SEQ ID NO: 83678 - DNA, 93 bp, Mus musculus
atatacatgtatacatgtattatacatatatacatgtatatatatatatatgtatgcatgtatatatgtgtgtatacatatatatatgtatat

SEQ ID NO: 83679 - DNA, 85 bp, Mus musculus
cggattaggttgccatgctgagagttgtcacagagctggggtctgaccagggccttggacatgctaggcaagcgtgagacctctg

SEQ ID NO: 83680 - DNA, 65 bp, Mus musculus
gtatctgtgtatgtatgcatgtatatatgtatgtatgtatgtatgtattgtatgcatgtatctac

SEQ ID NO: 83681 - DNA, 81 bp, Mus musculus
ctacataattcttgagagactcagacacactctcatctgaagtggcttatggagaatgtgaagtactccaagacttgtgag

SEQ ID NO: 83682 - DNA, 89 bp, Mus musculus
tatgtagtgtatgcatgtatatagtatatgtatatatgtacatatgtagtatatgtatgtatgtagtatatgcatgtatgtatgtagtg

SEQ ID NO: 83683 - DNA, 106 bp, Mus musculus
ctacaggacctggtgccaacacaagtcagctaattagagaagttactcagcagacatttttctgagggaacaaagcttaaattagtggtggttgcacttcctgtgg

SEQ ID NO: 83684 - DNA, 79 bp, Mus musculus
agtgtcacagatggttgtgagtttcttgatgtggattctgggtccaccctgtctcctgaaagagcaaccagtgaatact

SEQ ID NO: 83685 - DNA, 61 bp, Mus musculus
tcaggggctggagagatggctcagcggttaagagcactgactgctcttccagaggtcctga

SEQ ID NO: 83686 - DNA, 112 bp, Mus musculus
aataatcatcactttagtaggaatttttgtgcatatgtatgcatgtttgtatctgtacacaggtacctatgttggtacatgtggaggccagaaattgatattggatgttgtt

SEQ ID NO: 83687 - DNA, 98 bp, Mus musculus
aattcaggccagcccagcttacatgatgaaaacccctgtctcaaaaacaaaagagacaaactgtgtctgtctgtctgtctgtctgtctgtcttgagtt

SEQ ID NO: 83688 - DNA, 93 bp, Mus musculus
aggcagaaagcaaatgggagttttgtaggccctgtgaactcttaatatttttattaggttcccagtgcgaagtctttaatgtgcataatgcct

SEQ ID NO: 83689 - DNA, 66 bp, Mus musculus
tttcattttcttccggtctgggttgtgggtaatttcttgacaactgtgagagagaagacagtgaga

SEQ ID NO: 83690 - DNA, 82 bp, Mus musculus
acagtactaaatgtaatatatatgcatatatatacatatatatgcatatatatgtatatcataggaatgtatatatatatca

SEQ ID NO: 83691 - DNA, 75 bp, Mus musculus
tctgtctgtctgcgtgtgtctgtgtgttcattttcctatgggtacatgtatatgcaagtatgtgcagaggccaga

SEQ ID NO: 83692 - DNA, 153 bp, Mus musculus
gtgtgtgtgtgtgtgtgtgtgtgtatacctttgtatgtgtgcacctgtgcatgtgtgtacctgtgtgtctgtgtgcctgtgcatgtgtgtgcctgtgtgtgtgcctgcacagctgtgcaagtgtgcaggtaaaggccagaggagaatgtcatg

SEQ ID NO: 83693 - DNA, 87 bp, Mus musculus
gtctaaggccattctgggctatgtacacagatgagtgtgtgcgttcatgcatgtgtatgtgtgtgtgtgactagtagtggtagtagc

SEQ ID NO: 83694 - DNA, 107 bp, Mus musculus
ttgagattgttctaattctggaaagtccaaataataatttatctagtgtgatgtgtgtgtgtacacatcacagcacgataatggtaccagatggtagtactatgcaa

SEQ ID NO: 83695 - DNA, 98 bp, Mus musculus
cacatgtgtgtgtgtgtgtgtgtgtgtatatatatatatatatatatatatatatatatatatatatacatacatacacacacacacgcacacatatg

SEQ ID NO: 83696 - DNA, 89 bp, Mus musculus
tccagcctgaggggtgatgagctactgttgtgctctggaaacacagaggcgagaagagcctacagagagagcagagccaggggctgcga

SEQ ID NO: 83697 - DNA, 78 bp, Mus musculus
cggcctgtctcacactagatggaaggcaagaatggcctctctgctttttgtctctatctctgtctgtgatagaggctg

SEQ ID NO: 83698 - DNA, 66 bp, Mus musculus
gtgccatctgctctgatcactgtctctgtcaccgggcaccggctcttgaaccagagcatttggttc

SEQ ID NO: 83699 - DNA, 81 bp, Mus musculus
ccacactatgctctctgtctctctggccctggggaattaacctaataccaggtgaggagtggagccgagcagaagtgcagg

SEQ ID NO: 83700 - DNA, 66 bp, Mus musculus
gggcggggggcatggggtttcaaatggccatgtcagagccagtaactctctctctccctctctccc

SEQ ID NO: 83701 - DNA, 117 bp, Mus musculus
cagttttattcctgttacaggggtgtggaaatatgtcgccgagggctgtgtgaagacagtctccagctgggcttcaggcaaagccctcagcagaagtctgtgccctagatgctgctg

SEQ ID NO: 83702 - DNA, 87 bp, Mus musculus
ttgggaaaaaaaatcaggggctggagagatggctcagcggttaaaagcactgactgctcttccagaggtcctgagttcaattcccag

SEQ ID NO: 83703 - DNA, 76 bp, Mus musculus
atatgtatgtatatatgtgtatatatatgtatgtgcttgtgtgtgtatgtatgtatatatttatgtgtgtacctgt

SEQ ID NO: 83704 - DNA, 97 bp, Mus musculus
tgaggccatgggctggagggatggctcaggggttaagagcactgactgctcttccagaggtcctgagttcaattctcagcacccatatggtggctca

SEQ ID NO: 83705 - DNA, 118 bp, Mus musculus
ctctgggcaaatgcttgaccaagtactgctggcatcaaggttactaagtcactgccactctcactgatgctctggttattagagccccacacccagtcccacttcagcatctcaagag

SEQ ID NO: 83706 - DNA, 61 bp, Mus musculus
cttagcctctctgtgcctcagtttctccttctaggagatgagaacagtagtcatagttgag

SEQ ID NO: 83707 - DNA, 93 bp, Mus musculus
cccagcccctacttccaggaactgccatcctgatctccaccgagttccagagtaacaggcgtgagtagtctgggaggagcaaaggagtctggg

SEQ ID NO: 83708 - DNA, 115 bp, Mus musculus
tgtcagctttttctctttttgtcaggactctagccggtgtctgtctctctcgttcatctcacactagcttaggcctgttttcattgagcagttgcagccgcccctatgttgtgat

SEQ ID NO: 83709 - DNA, 123 bp, Mus musculus
gtgctgagacctagtaaggagttctgtgccagtcaaaggagtgaggcttgagatgtgagtgatcagactgatgggtcttacaggtgtcctatgagctcagacatgaccacatgagccagtcct

SEQ ID NO: 83710 - DNA, 113 bp, Mus musculus
gatctgttttgtccatgtggctacactagcccgggctgtcagcacttctcactgaagtttgtgagggctgactgagctcccgagcctctcagttccacatgtgcatgcagatt

SEQ ID NO: 83711 - DNA, 88 bp, Mus musculus
gtcgttcctgtgccagggtcactctgtccatctgtcggacgagaccagagccaacatcagggggcccagctatggagctttccatgac

SEQ ID NO: 83712 - DNA, 84 bp, Mus musculus
cctgagatctaggaagttctgaaaacatctatagaatctgagtgtcgacagagagatgagggtgagttgaggattagactcggg

SEQ ID NO: 83713 - DNA, 86 bp, Mus musculus
gggttgggagatgggtattgtttctggtgctcagaacggctgagatctgctgtaacccacctactgtgcgtctgtctcccagcact

SEQ ID NO: 83714 - DNA, 96 bp, Mus musculus
gggccaccgaggctgtattgttctgagccagcattgttcaggtctgcgctgacccagaaggtccctggagcccaggggaatccagcccggttgttt

SEQ ID NO: 83715 - DNA, 102 bp, Mus musculus
gccctggttctcctggaactcactctgtagagcaggctggcctcagagatccacctgcctctgcctctctgcctctgcctttgtagtgctgggattacaggc

SEQ ID NO: 83716 - DNA, 61 bp, Mus musculus
cattgtcttgtgagcaatgctgtttggaggggatgcggacagcacactggctgaagcaatg

SEQ ID NO: 83717 - DNA, 118 bp, Mus musculus
taataggttgtttatctttgttcctgtattttttccattgctcctctgttatttttatatttaagactgctaaaaatcgatgggtgtggtggtggaataccattaatcactgctgttg

SEQ ID NO: 83718 - DNA, 67 bp, Mus musculus
tgtctttgtctgagtctgcctgtgtctgtgtctgccacatgtgcatgggttcctctcctagaaggca

SEQ ID NO: 83719 - DNA, 96 bp, Mus musculus
gtcttcttgtggagctggagagatggctcagtggttaagagcactgactgctcttccagaggtcctgagttcaattcacagcaaccacatggtggc

SEQ ID NO: 83720 - DNA, 84 bp, Mus musculus
tccacttttcgttctgtctgtctgtctggggctggtgctccttctcaagctcacagcatgacagacagcacacagtctggtggg

SEQ ID NO: 83721 - DNA, 94 bp, Mus musculus
caagttccagtggcactcagtatccagtgtgctcagccagttccccggggcatcctggagccctggccttgctctgactgagtgctgcctcttg

SEQ ID NO: 83722 - DNA, 70 bp, Mus musculus
tcatattaaggcctgggaagatggctcggctggtaaaggcactgtctgtctgtcaagcctgactgtgtga

SEQ ID NO: 83723 - DNA, 61 bp, Mus musculus
ccactgcctcagtctctgcctcccgagtacagggagtaaaggcgggctccaccacttgtgg

SEQ ID NO: 83724 - DNA, 84 bp, Mus musculus
ctgaaaatacatgcctgtctcactcagtgtttttcttgtgggaacgtgcccacaagtacacctatgtgaagactaatgtatcag

SEQ ID NO: 83725 - DNA, 88 bp, Mus musculus
ggaggatgtcaggtgtcctcggtcactctctggctcactcactgatcctggagggaggctggtggcctacaagttctggtgatcctcc

SEQ ID NO: 83726 - DNA, 99 bp, Mus musculus
gtggcttaggaagacatatgatgtgctggagaggtggctcagcggttaagggctctgactgctcttccagaggtcctgagttcaattcccagaaaccac

SEQ ID NO: 83727 - DNA, 122 bp, Mus musculus
gctctcgttgcttttaagagatgtgtgtccacatatatgtgtatatgtatatatgtgtgcgtgtatatatatatatatatatatatatatatatatatacacacactcctggctcagcaagg

SEQ ID NO: 83728 - DNA, 104 bp, Mus musculus
catgtcttttgcagatttctttcttcctcaattcgttgggtgactgtccctctgtctgaggtcagcagtcactcactgggcagccaagtgtgcagagcatcatg

SEQ ID NO: 83729 - DNA, 84 bp, Mus musculus
gcggggtgcagggtgcgtggaagcacaccttaaaatgttttattttaaacacttggtgtgtagacatgcacacacgtgtgtcgt

SEQ ID NO: 83730 - DNA, 59 bp, Mus musculus
gtctgtctgtctgtctatgtgagggtgttggatcccctagaacataaattacagacagc

SEQ ID NO: 83731 - DNA, 76 bp, Mus musculus
cactggtgttttgtctgtgtgtatgtctgtgagggtgtcgatcttggggttagagacagttgcgagctgccatgtg

SEQ ID NO: 83732 - DNA, 103 bp, Mus musculus
ggactggggttaaatatacatggatcaggggcaggagagatggcttagtggttaagagcactgactgctcttccaaaggtactgagttcaaatcccagcaacc

SEQ ID NO: 83733 - DNA, 68 bp, Mus musculus
tgcggtgtgcagaagatgatgtcattcactcgggtcactgggtcactggctgcctctgggacggagca

SEQ ID NO: 83734 - DNA, 111 bp, Mus musculus
atggttagtatgtagagtagtgggtttcattatggaagaaagccttgttgattattaatattaatacttgcttgtcatagtctctatctatctatctatctatctatctat

SEQ ID NO: 83735 - DNA, 84 bp, Mus musculus
ctatataactttattatagtgttactatagagtacatatatatgtatatctatatatcacatattaacactatataatatgtag

SEQ ID NO: 83736 - DNA, 111 bp, Mus musculus
gtatccatctgagcacgttgaatcctgcggctcatctccagaacatttgtatttttcatgttataatcgacttgggcttccagcattcatcagtagactcagcagacaggc

SEQ ID NO: 83737 - DNA, 116 bp, Mus musculus
catggggccatgatgcctttggggctaggttctcagtgaaagtgttttcactcactcagtgagactggttttcaactgagtctactgtgggcccacacagtctgtcttggtctctg

SEQ ID NO: 83738 - DNA, 120 bp, Mus musculus
ggaagtgcattctaatcaactggccggcctacttagtcaatgagtcccagtgagagaaattagtgtgcacattcaaaaaattagtgtgcacattcctagtgtgcgcttgcgtgtgcacac

SEQ ID NO: 83739 - DNA, 85 bp, Mus musculus; identical to SEQ ID NO: 57439

SEQ ID NO: 83740 - DNA, 97 bp, Mus musculus
gtgtcatttatatgaagctatttgctttgtttctgaggcagcgcccagttttgtctctgtctgtgaaaactgtgtagctctttcatttgaaccatac

SEQ ID NO: 83741 - DNA, 94 bp, Mus musculus
agccccttggaggctctgtaaagctgggctgtcagttgtgagaacagagtaaggtcacacatgacagtatccattcgcagaaatgtccagggct

SEQ ID NO: 83742 - DNA, 91 bp, Mus musculus
ggggtgggatgggggactgagctcaagggaggctctttgctgccctgcatgtaaccgagaactccctcactgtctctctctgcttgacctc

SEQ ID NO: 83743 - DNA, 230 bp, Mus musculus
gtatgtatatacgtatgtatgtatgtatgtatgtatgtatgtacgtatgtatgcatgtatatatgtatgtatatacatatgtatgcatgcatgtatatatatatgtatgtatgcatgtatgtacgtatgcatgtatgtatatatgtattatgcatgtatatatgtatgtatgcatgtgtgtatatacatatgtatgtatgtatgtatgtatataaataaataagtgtaca

SEQ ID NO: 83744 - DNA, 65 bp, Mus musculus
ggttagagagacatggaaggtagctctaaacctgtcatttgggatacctgtctgtctgtctgtct

SEQ ID NO: 83745 - DNA, 80 bp, Mus musculus
tccacataatgtctgtctgtgagtctctgtaccagttcccacctgctggagaagataggttctctcatggtgagtggaca

SEQ ID NO: 83746 - DNA, 103 bp, Mus musculus
tcagcaactagcccatgcctgcccccagagactgtgtgtctctcagccgacaggccacacagaaataagcagggtctttggtctcagcaagggccatagctga

SEQ ID NO: 83747 - DNA, 75 bp, Mus musculus
gacacaaaacaggactgtgaccagagtgtccacagagtctctgtggccttttcatctggtccatgtatgtctttg

SEQ ID NO: 83748 - DNA, 92 bp, Mus musculus
gcatgtctctgttcacaggcagacgcactaggatggtgtctccggagctgagtatctcccgtcactgcgtcactgtgtcactgtgtttctgc

SEQ ID NO: 83749 - DNA, 73 bp, Mus musculus
tgtctgtctgtctgtctgttttgtggtgcttggaattaaacctaggaccactaagtggtttgaaggatgcaca

SEQ ID NO: 83750 - DNA, 81 bp, Mus musculus
tgtgtgtctgtgtgtaagtgtgtgtctgtgtatgtgtctgtgtgtatgtatacaaaccaccttttgtatacatgttgcata

SEQ ID NO: 83751 - DNA, 65 bp, Mus musculus
tatgtatgtatgcatgtatgtatatatgtatgtatgtatgtatgtatgtatgcaacatgtataca

SEQ ID NO: 83752 - DNA, 118 bp, Mus musculus
gtgtgtgtgtgtgtgtgcacattcatgtgtacatgtggtatgtatacatgtgtgtacatgtgtgtgtgcacatgcatgtatacatgtgtacctatggtgtgtatggacatgcatatgt

SEQ ID NO: 83753 - DNA, 81 bp, Mus musculus
gtgtgtttacacacagggcaaatgtttgaccactgagcacatctctagtccgcagacttgtggctctgtctgtctgtccac

SEQ ID NO: 83754 - DNA, 97 bp, Mus musculus
gtataagtatctgatggtgttttggatttcctcagaatctgttgttatgtctcccttttcatttctgattttgtagattaggatgctgtccttgtgc

SEQ ID NO: 83755 - DNA, 117 bp, Mus musculus
aaagaatgtgaattaggggggtaagggtgagggcagtgtccagagtatggaatatatttgtttcattttaaaggtacttcatttaacatttctcctgggataataactctttgcatt

SEQ ID NO: 83756 - DNA, 113 bp, Mus musculus
cctgccatggagggcaacagggtgctggttatgtgagggcagagaagtgagggaccaggcctcgtcccacttcgaggacagacagggaatgcagtatatgacttccaggtgag

SEQ ID NO: 83757 - DNA, 101 bp, Mus musculus
aaagcaagctgtcttttaaaatgttagtcacaggtagtagtttttaaaataagtgaggttttcataaacaattactgtttgacagttttgcagttagtttt

SEQ ID NO: 83758 - DNA, 116 bp, Mus musculus
gaggaagctgttccccttatgaagcagtccacaacacagggacacagatgaaatcacaagagacagagcacaggatgtgaaggtgcaggactgtaatgaggagcctgggttttctt

SEQ ID NO: 83759 - DNA, 81 bp, Mus musculus
agaacacaggaggcggtggggatccagcccaggatccgggaatcgcctggcctgggagactgcctgcctgcctgatgttct

SEQ ID NO: 83760 - DNA, 82 bp, Mus musculus
ctggaaagtatagaaggaagtgtgcaaagccctggccaacgggatgctctcacaccctctctctgacccccactgcccccag

SEQ ID NO: 83761 - DNA, 94 bp, Mus musculus
ttacaggcacacgtgtggctatgcccagtctgtttatttttaaatgtacatgccgaggattcaaacttgggtcatcacacttgtgcagcagtaa

SEQ ID NO: 83762 - DNA, 102 bp, Mus musculus
gtgtatttgtgtgcatgtgcactcctgtgtgagtgcatgtgcatgtgtgtgtgtgcacgtgtgtatgtgcactccaatgtgcatgtgtatgtttgagtgtat

SEQ ID NO: 83763 - DNA, 89 bp, Mus musculus
gtgctgctcaggcctctgttctgtggctgcaggtaactacccccaaggtaaacaaaccccactgcagctgtcttcagagagatgtgcac

SEQ ID NO: 83764 - DNA, 56 bp, Mus musculus
tgtgcatatgtatgtgtatgtatatgtgtatgtgtatgtatatgtatatgtgtagg

SEQ ID NO: 83765 - DNA, 57 bp, Mus musculus
acagatacacacacagagagacacatacacatagtctctgtgtctctgtgtctctgt

SEQ ID NO: 83766 - DNA, 65 bp, Mus musculus
agagacagagagagacagagacacagagacacagagactatgtgtatgtgtctctctgtgtgtgt

SEQ ID NO: 83767 - DNA, 83 bp, Mus musculus
gtcacgactcgggaatcacttgacagacagacagacagacctctggggatgtctatgtggggatttctagactgggttgtgat

SEQ ID NO: 83768 - DNA, 110 bp, Mus musculus
tatgtatgtatgtatgtatgcatgtatgtatgtatgtatgtatgtatgtatatatatatatatgtgtgtgtgtgtgtgtgtgtgtatgtgtatatgtatatatatatata

SEQ ID NO: 83769 - DNA, 82 bp, Mus musculus
agagcatctgccccaaggtgtgtgagcctgttaatctctttatatacagaagtgagacagagcacagtgggaaaggagcttt

SEQ ID NO: 83770 - DNA, 102 bp, Mus musculus
tggtttcctgggaataggagagggtgcaggaagatggcattcagaagaaaatgagcacacatgaccatctggtaggattttgttgaatgtccccaggtttca

SEQ ID NO: 83771 - DNA, 126 bp, Mus musculus
gcaccagagagagcaactgtgctaccagtcaaagtagcacctatgcaccgtggcttgtgcctgcctgcctgcctgaaatcccactgtctggggataaagagttcaagggcagaggctcagggttgt

SEQ ID NO: 83772 - DNA, 59 bp, Mus musculus
gtgtgtctgtgtgtctgtgagtgtgtgtgttacatgcacacacgtatacaggggtgcac

SEQ ID NO: 83773 - DNA, 113 bp, Mus musculus
ggggataacacttgaaatgtaatatatatatatgaaacagtagagatatatttgtatttattcatgaattcaaacatatcttgaatatgcatgtaccatttttgtttttctgc

SEQ ID NO: 83774 - DNA, 96 bp, Mus musculus
tacatagtgagctcctgtctcacccaccctctctgcaaatgtgctatttttttttttaccctttgtttatgtgtgtgggtgttttgcccgcatgta

SEQ ID NO: 83775 - DNA, 146 bp, Mus musculus
tgtctgtctatatgcatgcatgcattgtgtgtacatatgtatgtgtgtatgtatgtatgcactgtgtgtacatatgtatgtgtgtgtatgtatgtatgtatgtatgtatgcatgcatgcatgcatgcatgcattgtgtgtacatat

SEQ ID NO: 83776 - DNA, 103 bp, Mus musculus
gctaaaatgggcttctccttaagtttccactcctcagtcatttggtcacagcagtgagagaggtgactagcacaggaggagactagatgacgaccagtgtggc

SEQ ID NO: 83777 - DNA, 85 bp, Mus musculus
ttgttatgggagctggagagatggttcagtggttaggggcagtgactgctcttccagaggtcctgagttcaattcccagcaacca

SEQ ID NO: 83778 - DNA, 72 bp, Mus musculus
acgagtgttgtgcctgagtgtctgtctgtgtgtggcttgcgtacagtgtctgcagaagccagaagaccttgt

SEQ ID NO: 83779 - DNA, 112 bp, Mus musculus
atatgtatgcatgtatgtgtatatagtgtgtgcatatgcatatgtgtaatgtatatatgtatgtatgcatgtctgtgtgtgtatgtatgcatgtgtctgtctgtgcatgtgt

SEQ ID NO: 83780 - DNA, 66 bp, Mus musculus
gttcaattcccagcactcacatggcagctcacaactgtctgtgactcctgcttcaggggatctgac

SEQ ID NO: 83781 - DNA, 164 bp, Mus musculus
atgtatgtgtgtatatatgtatgtatatatgtgtgtgtgtatatatatatgtgtgtgtatacatatatatgtgtgtgtgtatatatatatgtgtatatatatatgtgtgtgtgtatatatgtgtgtgtatatatatatatatatatgtgtgtgtatacatatat

SEQ ID NO: 83782 - DNA, 98 bp, Mus musculus
ctcaggacctgctttcctggacatctgtcactctcaatgtgttactgaaggtcactgggtacaattcagcaggcaggtagtcagggcaggggtctggg

SEQ ID NO: 83783 - DNA, 64 bp, Mus musculus
tatgtgtgtgtgtgtatgtgttgtgtgtgtgcgcgcatacagacacatgagtgtgcacacatgc

SEQ ID NO: 83784 - DNA, 78 bp, Mus musculus
ctgactgctcttccagaggtcctgagttcaattcccagcaaccacatggtggctcacaaccatctgtaatgagatcag

SEQ ID NO: 83785 - DNA, 76 bp, Mus musculus
ggtagattggaggtacttagcagttgagccaataaggcaagttgaaattggacaactgtgtgtatctgtgtttttc

SEQ ID NO: 83786 - DNA, 200 bp, Mus musculus
tatacatatatatatgtatgtatatttgtgtgtatatatatctctatatatgtatatatctgtgtatgtatatatgtatatgtatgtatatatgtgtatatttatgtgtgtatacatgtgtatatatgtatatatgtgtatgtatatatacacatatatgcatacatatacacatatacatacatgcacatatacacata

SEQ ID NO: 83787 - DNA, 82 bp, Mus musculus
acgcctgtgtttggggggtacttcagggttctcgctgaccaatgacttatagagagctgtcttatgtctgagatagagatgt

SEQ ID NO: 83788 - DNA, 64 bp, Mus musculus
ggtggtcagtctgtctgtctgaggtggccaatctgtgccatccaccacatccagctgctctacc

SEQ ID NO: 83789 - DNA, 103 bp, Mus musculus
ggttcttggcactcatttggttattacgggacacatgtctgcacattggattaaaattaacagtaagaattgtttcccttttccaacggtgggctgggcttcc

SEQ ID NO: 83790 - DNA, 80 bp, Mus musculus
gataaggtggaggggtagagacgggcacgtgggaatggctgcaaatcctctttcacacgtgtctgtcacacacagagatc

SEQ ID NO: 83791 - DNA, 79 bp, Mus musculus
acatacatatatgtgtgtatacgatatacaagtgtatatatgtatatatacatgtatatacacatatgtatatgtgtgt

SEQ ID NO: 83792 - DNA, 110 bp, Mus musculus
tgcatatgtatgcatatgtgtatatgtgtatgtttacatgtgtatatgtgtgtatgtatatgtatatgtgaatgtgtgcatatatatgcatatgtgtatatgtacatgtg

SEQ ID NO: 83793 - DNA, 75 bp, Mus musculus
gtgtgtgtgtgtatctgtctgtctgtctctgtctctctcaagcacacacacacacacacacacacacacacacac

SEQ ID NO: 83794 - DNA, 105 bp, Mus musculus
tgaaaagaggaatggtatgaaattctgctgaaaggctgctgtgacccatagaacagagaaagcacatggccctttaaacacaggacacatgtcatgttcttctca

SEQ ID NO: 83795 - DNA, 96 bp, Mus musculus
agcttgtgtggggctggagagatggctcagcgattaagagcaccgactgctcttccagaggtcctgagttcaattcccagcaaccacatggtggct

SEQ ID NO: 83796 - DNA, 115 bp, Mus musculus
ccttctatcaccatggtcaaatggtttactcgtcaacaatggatatgtaatgttaaagacaaaattgctttgagccactagagagtagaaaccagccataggtaaaaatgtcagg

SEQ ID NO: 83797 - DNA, 90 bp, Mus musculus
tgccatgatgataatggactgaatctctgaaattaaactccaattaaatgtttttctttataagagttgccttagccaggcatggtggca

SEQ ID NO: 83798 - DNA, 73 bp, Mus musculus
catatatatgcatatatatactgaatatatacagtacatatgctgaatatatacatatatatatggaattatg

SEQ ID NO: 83799 - DNA, 83 bp, Mus musculus
ccagacagagatttcacagagttcttacaactttaccaccttgctgaagaggtagagctgagactatggcgggtctataatgg

SEQ ID NO: 83800 - DNA, 57 bp, Mus musculus
ggtttgtctctctgtgtgtatccctggctatcctggaattcacagagatccacggcc

SEQ ID NO: 83801 - DNA, 84 bp, Mus musculus
gtctgtgtcactgactctgtgccaactcacctccaacccccaagagcaggtagggtgagatggagagatatccagggcacaggc

SEQ ID NO: 83802 - DNA, 82 bp, Mus musculus
gctttttttttttttttttttaaggtgtggatattccttagcttgggaaaacccaaactcttgagcagagaattcagagagt

SEQ ID NO: 83803 - DNA, 121 bp, Mus musculus
ctgtgcacagtgtgtctgtgcagtgtgtctgtgcatagtgtgtctgtgcagtgtctgtgcacagtgtgcctgtgtacagtgggttgtgcacagtgtgtctgtgcacagtgtgtctgtgcag

SEQ ID NO: 83804 - DNA, 80 bp, Mus musculus
gaagactaacagggagctagagagatggctcagtgggttaaaagcactgactgctcttccagaggtcctgagttcaattc

SEQ ID NO: 83805 - DNA, 99 bp, Mus musculus
tctgtatgtgtgcctgtgtgtgtgcctgtgtgtgtgtgtgtgtgtagatcatttgcatgttcactagtgtgcaggtacatgtgtgtgcatgtgtggaga

SEQ ID NO: 83806 - DNA, 67 bp, Mus musculus
ctgaaccaggaacctgaaagcagaaattgtagaggaactctgctctctggctcagtctctggctcag

SEQ ID NO: 83807 - DNA, 80 bp, Mus musculus
cagagagatctgtcagttctctgaaagagatgccagtgcagcggacacttgagagaacagagagaccttgagacagtctg

SEQ ID NO: 83808 - DNA, 97 bp, Mus musculus
tactttcatacatatatgggcaaattttgtatgtgagtttacacgtattatatagatatgaaatgtaaatacatactggttaccatgagagagagta

SEQ ID NO: 83809 - DNA, 91 bp, Mus musculus
ggtaacagagagactttctccttgcaggttattttatatttttctgaacttgggaaatggacccatggaaatgtcgcactttgcttttgcc

SEQ ID NO: 83810 - DNA, 105 bp, Mus musculus
gagtataggttttgtagtaagatctgatgattttttatatttcctcagtttctgttgttatgtctcccttttcatttctgattttgctgatttggatactgtctc

SEQ ID NO: 83811 - DNA, 85 bp, Mus musculus; identical to SEQ ID NO: 57470

SEQ ID NO: 83812 - DNA, 85 bp, Mus musculus; identical to SEQ ID NO: 57470

SEQ ID NO: 83813 - DNA, 102 bp, Mus musculus
gtttctgctctgaatgcagtatttgactgactaacactcactgtgtgcagagagggcactgctgagcagttggacagcatccatgcattcagagttctaaac

SEQ ID NO: 83814 - DNA, 106 bp, Mus musculus
ctatgaagtttagataataagtggaccatagtcactcattatgctaggactgcaggtaagaagtgattgtgttgttaaattgccacatttataaaaagcaaaatgg

SEQ ID NO: 83815 - DNA, 59 bp, Mus musculus
tatatgtacatgatgcacatatgtgtgaagattcatgtgtatgtatgtatgtatgtatg

SEQ ID NO: 83816 - DNA, 56 bp, Mus musculus
gtacacacgtatatatgtatgtatgtatgtatgtatgtatgtatatatgtgtgtat

SEQ ID NO: 83817 - DNA, 140 bp, Mus musculus
atgtgtatgtatgcatgtatgtgtatgtatgtatgtgtatgtatgtgtgtgtatgtgtatgtatgtatgtatgtgtgcatgtgtatatatgtgtgtgtatgtatgcatttatgtgtatgtatgcatgtatgtgtatgtat

SEQ ID NO: 83818 - DNA, 117 bp, Mus musculus
ggatccccgatctacaacctgaaaggtgatttctttttcctagtgattgtgttgttcttatgtagtctatgacccttgggagggatattatcacctgaagtaatgcatgggggaaac

SEQ ID NO: 83819 - DNA, 74 bp, Mus musculus
gctctatgtgtttctgtgctggtattttgtgtggcttgaggttgcatagattttgcgtatagtctcacaactgc

SEQ ID NO: 83820 - DNA, 74 bp, Mus musculus
ggaacttgctgtttctttttaaatatttcctgcaacacatgtggtgatatttaacagtctgcagttgtagtttc

SEQ ID NO: 83821 - DNA, 132 bp, Mus musculus
gtctacaaagtcaacctttatgattcagataagggagagaacagatatattagtgtctctttcagtgtctggttaaggattggactcttaggctgtccaggtaacagttgctgatgacatatctccgttttt

SEQ ID NO: 83822 - DNA, 80 bp, Mus musculus
tcaggttagatgtcagtggcacacactgtttcaaaggtgaggacataagttgaggagtccctgacatagggagaacctga

SEQ ID NO: 83823 - DNA, 82 bp, Mus musculus
gtctcctccgttaggaagccaatagcaggcactttgtttgggaatgaatagatgaatgataatgcgcttctcaataggacac

SEQ ID NO: 83824 - DNA, 75 bp, Mus musculus
ctctgtgtgtgtgtgtgtgtgtaggtgtgtgtgcatttatgtatgtacacatgtctatgtgcatgtgtattggag

SEQ ID NO: 83825 - DNA, 190 bp, Mus musculus
atttggtttaatgtaaaaaatatatatatatatatatatatatatatatatatatatatatatgtatagatgtttgcatgtatataaatatatgtatatgtacctgtatatatatatacatatatgtacatatacatatatgtatgtgtgtatatatattcttatatacatatatgtatatttatgtgta

SEQ ID NO: 83826 - DNA, 62 bp, Mus musculus
atacatatatgtatatgtacatatatgtatatatatatacaggtacatatacatatatttat

SEQ ID NO: 83827 - DNA, 99 bp, Mus musculus
tacatatgtgtgtacatgagtgtgtgcaagtgcatgtgtacatatgaatgtatatgtgttgtgttgtatatgtgtatgtgtatatagtgtgtgtgtata

SEQ ID NO: 83828 - DNA, 82 bp, Mus musculus
atatatttttgtgtatatatgtatatgtatacatatatgtatatatacgtatatgtatatatgtgtgtatgtatatatgtat

SEQ ID NO: 83829 - DNA, 109 bp, Mus musculus
atttatgtgtatatatacatttatgtatatatacacgcatatatgcatatatacacatatatatgtatatatgtatgtgtatatatatatgtgtgtctgtgcaatggat

SEQ ID NO: 83830 - DNA, 131 bp, Mus musculus
atgtgtatatatatgtatatgatgtatataaatgtgtgtatacatatatatgtatatgtgtatatgtatatatgtgtgtatgtgtgtatatatatatatatatatatatatatatatatatatatatatgc

SEQ ID NO: 83831 - DNA, 70 bp, Mus musculus
atgtatgtgcaatgtatatgtgcatatatacatgtatacatttatgtatatataaatcgcacatatatat

SEQ ID NO: 83832 - DNA, 68 bp, Mus musculus
tgcctggggagtcttgaggctgacagtagtgttttacttgattgctttacagactagatcctgaggca

SEQ ID NO: 83833 - DNA, 73 bp, Mus musculus
gcatctattgaactatcttgttgatcattgttgtggatcattgcgatctcagctggataggattattgattgc

SEQ ID NO: 83834 - DNA, 64 bp, Mus musculus
cacagcaagcgcactggagggtatcaggtcctcaggagcctgctctctgagtgtgtgtgaagtg

SEQ ID NO: 83835 - DNA, 85 bp, Mus musculus; identical to SEQ ID NO: 57470

SEQ ID NO: 83836 - DNA, 164 bp, Mus musculus
atatatatatatatatatatatatatattatgcaatctgcacctggtatatgctatgttattataatatatacatatttatgtatatgtgtatatatatatatgtgtgtgtgtgtgtgtttaaaacatgtatgtatgtacatatgaatgtatgtatgtatgtat

SEQ ID NO: 83837 - DNA, 59 bp, Mus musculus
tgtctgtctgtctgtctgtctgtctctgaaccagagctagtgacatggctcatcggata

SEQ ID NO: 83838 - DNA, 86 bp, Mus musculus
gtggccagggagttcaagccactgcctgtctgtttggctctgaagtaagaaagcaaaccaggcagggtcagggttcctgttctcac

SEQ ID NO: 83839 - DNA, 104 bp, Mus musculus
agattctgttagcaggcctgcccacgtgtacctcattctactggcaaggcacccttgactgatgattgaaagctctgtgatgatggagcctgacagtggagtct

SEQ ID NO: 83840 - DNA, 83 bp, Mus musculus
agtggccattgaagaaaaagcagtttgagtttttttcctactacggaattttaattgtttttacttcaatgaaagtggtcact

SEQ ID NO: 83841 - DNA, 68 bp, Mus musculus; identical to SEQ ID NO: 59726

SEQ ID NO: 83842 - DNA, 101 bp, Mus musculus
catttgcatgttcctctcaaactaataaccattgctttccatgtgtaaattctggttttgtaattgtgatgagtcaaagatgaggaaccgcttccccgatg

SEQ ID NO: 83843 - DNA, 96 bp, Mus musculus
ggtgaggatgactctgaaagcatctcttgcctagaaactgaaccatatactttgctttcaatatttatgtttgatttgctaggagtcaaatgcact

SEQ ID NO: 83844 - DNA, 113 bp, Mus musculus
tgtatatgagtatgtatatgtatgtgtatacatgtgagggtataggtatgagtacatatttatcattgtttttatttcatatatatgtacatacatattatgcattatatata

SEQ ID NO: 83845 - DNA, 102 bp, Mus musculus
gcagtgcatgctatcaaatagagacagcctggtattattgcagcccctggaggtcacaatagaatcaagatacagagctgagctaagggcagagaacacagc

SEQ ID NO: 83846 - DNA, 87 bp, Mus musculus
ggaacttgcttttggagacaggaatgagagcacagatgttactcgtaagtacctttcctgtgtttccctgccttctctgacagttcc

SEQ ID NO: 83847 - DNA, 86 bp, Mus musculus
atgtaagaggctagagagatgactcagaggttaagagcactgactgctctttcagaggtcctgagttcaaatcccagcaaccacat

SEQ ID NO: 83848 - DNA, 86 bp, Mus musculus
gtactgtgtgtgtgtgtgcgcgcatgtgtgtgcatgtgtgtgtctctgtgtgtatgtgtgtgtgttcagtgtacaggcacatgtat

SEQ ID NO: 83849 - DNA, 70 bp, Mus musculus
gtgttcatatgtatatttgtgtggctgcatgtgtacttctgtgcattagcatatgcatgcatgtagaggc

SEQ ID NO: 83850 - DNA, 75 bp, Mus musculus
atagatagatagatagatagatagatagatagatgagggttgtctgtctatctgtctctctctctctctgtgtgt

SEQ ID NO: 83851 - DNA, 68 bp, Mus musculus
acatagctatatttatttatgtgtatataaagatctctctatatacatatctatgtctatatctgtgt

SEQ ID NO: 83852 - DNA, 62 bp, Mus musculus
gtgtctgtgtctgtgtctgtgtatgtgtatatatatatacacacacacatatatacatacac

SEQ ID NO: 83853 - DNA, 87 bp, Mus musculus
cagaagggacaggtagcctccaagttcctgtgacctcaggtcatcttctatctgtgtctgtctaactctggaatagcatcccttctg

SEQ ID NO: 83854 - DNA, 67 bp, Mus musculus
tatatgtgtatgtatttatgtatacatgtgtgcgtgtgtacacatgtgtgcctgtgtgtatactgtg

SEQ ID NO: 83855 - DNA, 109 bp, Mus musculus
gtgtgtctgtgtagtatgtatgtatgtatgtatagcatgtatgtatagcatgtatgtatgtatgtatgtattatgtatgtatgtattgcatgtgaatgccatagcacat

SEQ ID NO: 83856 - DNA, 105 bp, Mus musculus
gtgacggttggcagggtgcaggtctttgacagtcttgggtgggtcttgctgtctcactgacatactggctggacccatccttgattcctgccctgtgggtctcat

SEQ ID NO: 83857 - DNA, 79 bp, Mus musculus
tgagcttgcggatatgtgtttatgtatgcatgtatacttgtgtatacatgtgtgtgtgtgcatgtgcatgtagaggcca

SEQ ID NO: 83858 - DNA, 82 bp, Mus musculus
gcctgtatacatgtatgtatgcacgtgtgtgaatgtgtgtatgtgtgcatgtgtatacatgtgtgtatatatatgtataggt

SEQ ID NO: 83859 - DNA, 98 bp, Mus musculus
ggcgtctgtcatctgtggagcacacctgtgtgtgtatgtgtctctatggctatttcgacgtgtaatcatctgtgtccatgaagagagaaatataagcc

SEQ ID NO: 83860 - DNA, 60 bp, Mus musculus
tgttctatgagtggatagtcactgcctgtcctaggtaggatttttctttttatttgaaca

SEQ ID NO: 83861 - DNA, 133 bp, Mus musculus
cacaaaaaggacttgttagcagtgtgaacaacacacaaagagaaatgtggtatgtggctgctgacttctttctgtgtctctttaagtctgttagagaccaccttggacttgcagtggaaagggattgtggggg

SEQ ID NO: 83862 - DNA, 90 bp, Mus musculus
cagagcctggctgtcctgctccatgaagcctagtgaatttgttgctctctgcactgagtcaggaggcagagaggttttgactcgggcatc

SEQ ID NO: 83863 - DNA, 114 bp, Mus musculus
attcccagcaaccacatagcagttcacaactgtctgtaactttgttccaggggctctgacaccctcacacagacaagcatgcaggcaaatcaccagtgcatgtaatatgagaat

SEQ ID NO: 83864 - DNA, 112 bp, Mus musculus
ccaccgcccatttctcttccctggggcccccgttttgagtggaatcctgtctgggtggcagcaggagggacacccaatatgggggccagtttgtatctagcctggatagtgg

SEQ ID NO: 83865 - DNA, 76 bp, Mus musculus
tgcttgcatatgtaagcttacgcaccatggttcaatgcccagaacacattagaaaagtcaagcacagaggcaggca

SEQ ID NO: 83866 - DNA, 71 bp, Mus musculus
tgcacattgtgtggatgaatatatatttgtggatatatgtgaatatatatcatatcgtcccatcatgtgta

SEQ ID NO: 83867 - DNA, 70 bp, Mus musculus
ccagaagctgactggcacagggtctctctgagtctggaggtcaccttttgttggggtaaatagtcactgg

SEQ ID NO: 83868 - DNA, 99 bp, Mus musculus
tggggcttcctctgtggagaaggcatctgggagagtatggtttatctggaagggactgaaatcatgctagactctgcccgtgtttgtagggaagaccta

SEQ ID NO: 83869 - DNA, 103 bp, Mus musculus
aggacagacaggaggcaagtgactgaagttgcaaagaatgctgtggttgaacttttttttttttctttcttctgttatttgttttctggcacaatctgtctct

SEQ ID NO: 83870 - DNA, 80 bp, Mus musculus
tgtgctcctgttgatgttaatgatgaatggacaacagcagccttgctggcttcattccgcccatctactcccaggacaca

SEQ ID NO: 83871 - DNA, 70 bp, Mus musculus
gcatatgcctgtgtatgtgtatatgtgcatgtatgtctgtgtgtgtgtgtgtgtgtgtgtgtgcctgtgc

SEQ ID NO: 83872 - DNA, 108 bp, Mus musculus
caatcttttttgtgtatatatgcatatgtgatgtggtgtgtgtgtgtgtgtgtgtgtgcgcgcgcgcgtgcgcgagcgtgtgtgttcataaaggtgcttgtgtatgta

SEQ ID NO: 83873 - DNA, 60 bp, Mus musculus
tgccacccacttggggggaggggctcatttacatgtgcctgtctggctgaatgggtcaca

SEQ ID NO: 83874 - DNA, 59 bp, Mus musculus
actgactctctctgtcccagcagctgtcagttgcacacagcttcttggtgagggtgggt

SEQ ID NO: 83875 - DNA, 109 bp, Mus musculus
ggttcctgaccagagcaggacggactgacttctttatttatttcaggtgagtgtgcacacatgcatgctcgtgtatggagtgggggtcagagcattgcatacaggagtc

SEQ ID NO: 83876 - DNA, 66 bp, Mus musculus
cacacacacacacacacacacacacacacacagagtgagtatgtgtgtgtgtatctgtgagtgtgt

SEQ ID NO: 83877 - DNA, 124 bp, Mus musculus
tgccaccgccagagtcacatggcctactgattgtcactccctgtcttctcatgccacagtcagtgactcattgtccttctgtcaactcgcttgccgtttgtggtattttaagtggatgaaatca

SEQ ID NO: 83878 - DNA, 64 bp, Mus musculus
gctcacacagggtccccaccccagagattctctggagtctcactctgggtcagtctgagtgagc

SEQ ID NO: 83879 - DNA, 57 bp, Mus musculus
ctttgaggggctggtgagatggctcagcggttaagagcactgactgctcttccagag

SEQ ID NO: 83880 - DNA, 74 bp, Mus musculus
gtgtgaatgtgtgtatatacatattcgtgtatgtttgtatctatatatgtgtgtgtatatgtatatgtctatat

SEQ ID NO: 83881 - DNA, 63 bp, Mus musculus
gtctcagcactcaggaggcagaggcaggcagatctctgtgagtttatctgtgagttttgaggc

SEQ ID NO: 83882 - DNA, 91 bp, Mus musculus
tttgccttcagagtccaggattaaaggtgtgtgccaccactcctggtgacagatacttttgagtctgtgagtcagtgaatgaatgagtgga

SEQ ID NO: 83883 - DNA, 58 bp, Mus musculus
cagggctggagagatggttcagcggttaagatcactgactgctcttccagaggtcctg

SEQ ID NO: 83884 - DNA, 135 bp, Mus musculus
acagtaaatgtatgtatgtatgtatatatgtgtgtgtgtatacatacatacatacatatatatatatatatacatacgtatatgtatatatgtttgtgtgtgtagatatacactaaaagtcatttgtatgtgcat

SEQ ID NO: 83885 - DNA, 120 bp, Mus musculus
cagagccacgatgggccagccgtgagaccaacagcttggcctggatgccagacaaggccctctgtgtctgtgtccgtgcctatgtctgtgtctgggatgctctcaaggcttctgctgccc

SEQ ID NO: 83886 - DNA, 118 bp, Mus musculus
atatagagagagagagagagagagagagagaggagagatgtctcatatatatatatatatatcctctcttccttcctctatgtctctctgtatctctctctctgtatctctgtttctc

SEQ ID NO: 83887 - DNA, 68 bp, Mus musculus
catatgtatgtatgtatatatgtatgtatgtatgcatatatatatatatatgtatgtatatatatatg

SEQ ID NO: 83888 - DNA, 74 bp, Mus musculus
aggctgccatgagcttctttggtctgagatcctgggcatttccagatcagagtgagctaactggctttggcgct

SEQ ID NO: 83889 - DNA, 111 bp, Mus musculus
cacagcttcggcaaccccaggcatgaacgctactcatactcacagactcaatcgtggacattctaggaagtagaggcaggctgaccccaggccttctgggttgtctctgtg

SEQ ID NO: 83890 - DNA, 71 bp, Mus musculus
tatgtggggtaggtgtcagagacagagacctggtgagttctgagtctctctctctaacgggtacctctgta

SEQ ID NO: 83891 - DNA, 125 bp, Mus musculus
tatatgtgtatatgtatgtataggtgtgtgtgtagatgtgtatgtgtgtgcataggtatgtatgtatagatgtctgtatatctgtatatatgcgtgtatgtgtagatgtatgtgcagatgtgtgt

SEQ ID NO: 83892 - DNA, 65 bp, Mus musculus
ggtcactgggtgtctttgtcagtctctcaccatctgggtttttgatacagggtcgctcagtgacc

SEQ ID NO: 83893 - DNA, 115 bp, Mus musculus
tgtgtatgtgtatgtgtatgtgcatgtgcatgtgcatatgcatatgtatatgtatatgtatatgcatgtgcatgtgtatatgtatatgatgtatatgtgtatatacatacatatg

SEQ ID NO: 83894 - DNA, 76 bp, Mus musculus
cagacagacagaagacagacagcaacagcggcaggtgttttgttttgctttttgcattttgtttttagtttttttg

SEQ ID NO: 83895 - DNA, 113 bp, Mus musculus
tgcggaggctgagtgggggaagagaatgttatcacagaaacctgatttttctacacactctatcagctccccatctgctccttgattaaacgtattgccgcgctccctcccca

SEQ ID NO: 83896 - DNA, 69 bp, Mus musculus
tgcatgtatgtgttcatatgtatgtatgtatgtatgcatgaatctatatgtacataatgcatgcatgta

SEQ ID NO: 83897 - DNA, 76 bp, Mus musculus
caaccttatatggagtgtgtctggcctttaaggggccttgtcatctctagtgggcagacactctctttcactgttg

SEQ ID NO: 83898 - DNA, 80 bp, Mus musculus
tgcacacacgcacacacacacgtgcgcacatacacacacacttacacacctgttcatgtgccaggcactgtgctgtgtca

SEQ ID NO: 83899 - DNA, 126 bp, Mus musculus
cagggtcacaggctcttgtgggtccttctagctgagcacaccccaaatgtgatcacagtggctatgttgtgctagcttttatgggcaataagcctgggagttttgagagggtgggctatggctgga

SEQ ID NO: 83900 - DNA, 116 bp, Mus musculus
tatgtgtgtgcatgtgcatgcacccatgtgtgtgcacatgtgtatgtgtgcatgagcatgtgtgtgttcatgtgtgcacgtgtgtgtacatgtgtgtgttcatgtgtgtgcatgtg

SEQ ID NO: 83901 - DNA, 127 bp, Mus musculus
gtgtgtgaaagagtgtgagtgtgtgagaatgtgtgtgtgtgtgcatgtgtaacaatgtatgtatgtgtgtgcatttgtgtgtgagtgtaagagtgtgtgagttcatgcgcgtgtgtataagtgtgtg

SEQ ID NO: 83902 - DNA, 72 bp, Mus musculus
ggtctctcagcttgtgcatgtgcagatgtaatttgggggaccaaattaacataatacatgcagcattagacc

SEQ ID NO: 83903 - DNA, 72 bp, Mus musculus
gcacaaaagtgtgtctctgagtgggtctgtgccaccaaccatagcaccctccaccatagaagagcatactgc

SEQ ID NO: 83904 - DNA, 133 bp, Mus musculus
gaggacagagttctaccacaaagcagaaagcaagccttcgcctttctcttgtggtctggctctcttggtctctcacattgcgttcttggctgtaaattggtttttggtagcaagggactgcgtgagaggtcag

SEQ ID NO: 83905 - DNA, 87 bp, Mus musculus
gcagtcctgtggggagtgggcaggtgtggagtagagcctcatttccttttttcttattttaaaatatctgtctatctatctgtctgt

SEQ ID NO: 83906 - DNA, 108 bp, Mus musculus
caggtggaaggtgagaacagagagttgtcctttgaccccatcacgtacattgtgtgtgtgtatgtgtgtgtgtgtgtctgtctgtctgtgtgtatctgtgtgtgtctg

SEQ ID NO: 83907 - DNA, 110 bp, Mus musculus
agaagatggcgttagatctgatgctggacttggaggcagttgtgagtcaccacccagtgtgggtgctggcaactgaactcaggtcctctgcaagagcagcgcatgctttt

SEQ ID NO: 83908 - DNA, 103 bp, Mus musculus
gactcatcctcaaggggggttggagagatggctcagaggttaagagcactgactgctcttccaaaggttctgagttcaaatcccagcaaccacatggtggctc

SEQ ID NO: 83909 - DNA, 72 bp, Mus musculus
gtttagagacagtctcactgtgtggctctgactgacctggaacttgctatgtagaccaggctgtccttgaac

SEQ ID NO: 83910 - DNA, 113 bp, Mus musculus
gggagcagggccccagctgagcccacttgagcccagaggaactttgtgtgtggagagtgtgatgtatgcctaaggatcctgagctcaacacccagctccggtcatctgctctt

SEQ ID NO: 83911 - DNA, 80 bp, Mus musculus
gttcaggacccacgcctgtcggacactggctccctctgtctatgagggtaaagagagtgtctcccagcctggccctggcc

SEQ ID NO: 83912 - DNA, 69 bp, Mus musculus
ggtgtcctgctttctgacacactcagattcataaccgggagagagctggtgtttagaggagaggtcccc

SEQ ID NO: 83913 - DNA, 65 bp, Mus musculus
acagattagcccagtgagaagcccgggtacccactgaccctctctgagtgggtctcagtgtctgt

SEQ ID NO: 83914 - DNA, 73 bp, Mus musculus
gtatctctctctcagtttctgtttgaccctcaaaatggagggtcttggacacacctctaactagaattgatac

SEQ ID NO: 83915 - DNA, 93 bp, Mus musculus
tgcatcttcttgcctcactgtctatcactctgtcccccatttttctatacccaccacagggacagtgactgaccttcccttgggcaggctgca

SEQ ID NO: 83916 - DNA, 88 bp, Mus musculus
aactatgaaacggtattcactgctcttaggtgtcctgtggtgtctctgtgtgtcagagtcggaagaagggcagtgttgactttctgtt

SEQ ID NO: 83917 - DNA, 59 bp, Mus musculus
tctcatactgacaggacacactgagtgactcccccacagtgcctgtgacagtgctggga

SEQ ID NO: 83918 - DNA, 108 bp, Mus musculus
tggcagaccatgacatccagtgtcccaaaatgtttccaaggactgaggtctctccctgtttcacactctcctggactctacatttctggaacctggaaccctctgtca

SEQ ID NO: 83919 - DNA, 84 bp, Mus musculus
aaagggttgtgtgtttgtctctccgtgtgtgtgcacgtgctctcaggtgcacacatacatgtggagattgacattgggtcgttt

SEQ ID NO: 83920 - DNA, 78 bp, Mus musculus
tgtgcatcagagagtaatgagacagtacactctgaaggaatcgagtattaaaggggagctgtttcttttctctgcata

SEQ ID NO: 83921 - DNA, 84 bp, Mus musculus; identical to SEQ ID NO: 83919

SEQ ID NO: 83922 - DNA, 78 bp, Mus musculus; identical to SEQ ID NO: 83920

SEQ ID NO: 83923 - DNA, 84 bp, Mus musculus; identical to SEQ ID NO: 83919

SEQ ID NO: 83924 - DNA, 78 bp, Mus musculus; identical to SEQ ID NO: 83920

SEQ ID NO: 83925 - DNA, 105 bp, Mus musculus
ctctgtggtgtatgtatgtctaaagggttgtgtgtatgtctctccgtgtgtgtgcacacacgtgcacgtgctctcaggtgcacacatacatgtggagattgacat

SEQ ID NO: 83926 - DNA, 89 bp, Mus musculus
cactggatgcagagtcctattgctgtgtttgatgaagtactgacaccattagaattcacagagatattagtcgggcctttcatcttttg

SEQ ID NO: 83927 - DNA, 165 bp, Mus musculus
gtgtgtacaaatgtatggaattcatatatatgtgtatatgtgtatataagcatgcatatgtgtgtgtatatatatatatatacatttatactcaaatgcataggtgtgtctatatacatatatgtacatatatatacatatacatgtatatatcatatgcatgca

SEQ ID NO: 83928 - DNA, 114 bp, Mus musculus
tatatatatgtacatatatgtatatagacacacctatgcatttgagtataaatgtatatatatatatatacacacacatatgcatgcttatatacacatatacacatatatatg

SEQ ID NO: 83929 - DNA, 143 bp, Mus musculus
ctgtgccggacgctcccttctgctcagcactaacactccagcaactccatttaattttattattattattgtgtgcgtctgtctgtgtctgtgtgtatctgggggaagagattagagggagggtgtatctggggggaggggag

SEQ ID NO: 83930 - DNA, 75 bp, Mus musculus
gctggaggtgagcagtgtcccccagggaggcacagccgtcccctcagtgcctccacactgtctgtccctcacagc

SEQ ID NO: 83931 - DNA, 103 bp, Mus musculus
tatctgtgtatgtgtgtgtatgtgattgtgtatatgtgtgtttatgggggtattcttgtatgtatgtatgtatgtacgtgtacatgtatatgtatataaggta

SEQ ID NO: 83932 - DNA, 75 bp, Mus musculus
tgtggtgcatgcttgaatcaagttctttttaaataaatcagagtaagagacacttgggctcaggggatagccaca

SEQ ID NO: 83933 - DNA, 82 bp, Mus musculus
ttgtgggacacttggagaccctctcttgtggtgataaaaagcagggaaccagcaaaacccagaggggagccatgtcatgcag

SEQ ID NO: 83934 - DNA, 85 bp, Mus musculus; identical to SEQ ID NO: 57439

SEQ ID NO: 83935 - DNA, 73 bp, Mus musculus
cacaagtaagatgtctggaactgctaaggacaaaacctgtccaggcagctgtctgtctgtctgtctgtctgtg

SEQ ID NO: 83936 - DNA, 76 bp, Mus musculus
gtgtgggtgtgcatgcagggtggcggccagagtggaaacggctcctcttgctctgtcactctgtcactctccacct

SEQ ID NO: 83937 - DNA, 66 bp, Mus musculus
cacagagcacacacggtgcacagacagatatgtggatatgtgagtgtgtgtgtgtgtgtgtgtgtg

SEQ ID NO: 83938 - DNA, 82 bp, Mus musculus
gcacagctgtggagccccactcttgatcttccacaccttgtaaagggagtgtggtaaggtggtttcaaaggcttctctctgc

SEQ ID NO: 83939 - DNA, 84 bp, Mus musculus
gctgtgcatagtggtgcatgttgcctttgaccccagcaccccagagatcagagagctcagtgaggccagcctagtctacatagt

SEQ ID NO: 83940 - DNA, 86 bp, Mus musculus
ttcattgtatgtatgtaagcatgtgtgtgtatatgtatgtattatgcatgtatgcatgtgtgtatgaatgttgtgtgcatgtatgc

SEQ ID NO: 83941 - DNA, 68 bp, Mus musculus
cagtgctcagactctgtctcaaaatcaaaaccagggctggagagagagctcagcggttaagagcactg

SEQ ID NO: 83942 - DNA, 101 bp, Mus musculus
gccttttctccagagtactgtgctccaaggtgtgtcatgcctggcagtcacacgcacacgcgcacacacacacagtgtcatagtgtataaaagtcagaggc

SEQ ID NO: 83943 - DNA, 116 bp, Mus musculus
agcacttttgtattcaaaagagagtgtagggtccctggaactagtcacagaccacagtgagctgccatgtgggtactggtatcaaactcttgtcctctgggagagcagccagtgct

SEQ ID NO: 83944 - DNA, 85 bp, Mus musculus
ggagagatttaggcatatttatatggagtgtggacaataaggggtgattgtaaatgtctgagcctgtgtgtgtgtctgtctgtct

SEQ ID NO: 83945 - DNA, 64 bp, Mus musculus
gatggagctgcagcaggactggtgtcagacacctggcagcttgtgacgctcgcacactctcatt

SEQ ID NO: 83946 - DNA, 86 bp, Mus musculus
acccactggtgtaactagatcacattttctttatctgtcagctcagcgggcatgaggctgactctgtgtctcgaccctgtgtaggt

SEQ ID NO: 83947 - DNA, 73 bp, Mus musculus
tcgaactgtatgcacgaggggttctgttggtcctgggacaggctcagcatctccaagtggtagtcacacacga

SEQ ID NO: 83948 - DNA, 111 bp, Mus musculus
agctcgggccacatacttggttccatgtgtttaggactgagagcagacagtgagctctcctcactgttacttggttagaactgcccactgtggtgtcagcatggcttggct

SEQ ID NO: 83949 - DNA, 80 bp, Mus musculus
ctgactcctgtaagctggctgctgtctgatcacactcaaggactgtggtatgagagtacacagtgtgcaggtgcatgcag

SEQ ID NO: 83950 - DNA, 73 bp, Mus musculus
tgtctgtctctctctctgagctgccaccacagtgggaactgtacaggacggtacagcacatggggacaggaca

SEQ ID NO: 83951 - DNA, 119 bp, Mus musculus
ctgagccagccaggatgcttgttcttgtaaaacttcccttttcttttcttttatttaaaaaaaaaaaaaaaaaagaggtaaaatagaaaacattagttccaggggctggagagatggct

SEQ ID NO: 83952 - DNA, 95 bp, Mus musculus
gctcccgcccccttgctcaagccttctgtgtccacccttcccacagacccactctgtgggtgctcaggtgcttgttaagcatgcacaacggctgc

SEQ ID NO: 83953 - DNA, 87 bp, Mus musculus
gccagctcattgtcactcgctgtcacttagggtaggccacatggactctgtggccattttccagaaagtactgaaactgatgttggt

SEQ ID NO: 83954 - DNA, 65 bp, Mus musculus
ggccagcctggagaggatgagaggaaggtgtctgtctgtctgtctgtctgtctgcctatctggcc

SEQ ID NO: 83955 - DNA, 139 bp, Mus musculus
ggggtaatcttgtccttctgttaatggattcctgggggcatgacagacccttttttttgagttttttttgttttttttgttttttgttttttgttttttttgagacagggtttctctgtgtatccctggctgtccttga

SEQ ID NO: 83956 - DNA, 104 bp, Mus musculus
ttttccgtgagatatgccctctagtgactataactgtgaggtatagccctggatggtgccagagatgctgttctgggaggagtcctgagggaggggcaggagga

SEQ ID NO: 83957 - DNA, 102 bp, Mus musculus
cgctgtagctatctttagacaccagaagagggcgctgagcatgggctctctgacaccctgtctcaaattgctccccctgcccctggaagagatcagtctgtg

SEQ ID NO: 83958 - DNA, 82 bp, Mus musculus
gttccccgtccctcacactctcagcctaagccactcaaccactggtgcatggcccaggccggcgagtacagaagctggggac

SEQ ID NO: 83959 - DNA, 86 bp, Mus musculus
gagcgagggtgggcacgggcgggcggggcaggtggagggccgctgctgttctctctcactcactccctaggtcttcctctctcctc

SEQ ID NO: 83960 - DNA, 80 bp, Mus musculus
aaacgtataggttagcgtgagacgacggacagatggacatcagtccctgtctcggtctcatgagggacatgtgacagttt

SEQ ID NO: 83961 - DNA, 64 bp, Mus musculus
gtgtgagggtgttggatcctctggaactggagttatagacagttgtgaggcaccacttgggcgc

SEQ ID NO: 83962 - DNA, 76 bp, Mus musculus
gtacatgtaatatatacgtatggtatatggtatgtgctatgtgtagtatatatgtatatctgtatgggatgtgtat

SEQ ID NO: 83963 - DNA, 115 bp, Mus musculus
ggtttgggggttggttttgctctggtccttctggtggctccaaacacagcactatcagtggctctgttctgaactaggggcagcttgaaggcaggactgggatttttctctagct

SEQ ID NO: 83964 - DNA, 108 bp, Mus musculus
gttttttgtgttttgcttcctgttaaatgagttagttggtcattccctggatcaggatggattgtaatgaactatgtctagctggttgtatcacagaaagcttaccac

SEQ ID NO: 83965 - DNA, 82 bp, Mus musculus
agcaacaggaaaagagacaaagacaggcagtgtatactataccttttattctctctgtctctgtctctatctctctgtctct

SEQ ID NO: 83966 - DNA, 70 bp, Mus musculus
ctaacccactgtctgtctgtttgctttgggtaacacccaaggacacacattctgaggcctgtgaaagtag

SEQ ID NO: 83967 - DNA, 75 bp, Mus musculus
gagctcctggggaagttcctctctcgcggccacatatggtgctgctgtgttgagacaagacactcacctgtgctc

SEQ ID NO: 83968 - DNA, 89 bp, Mus musculus
aaggaataccacagctaaacagttctagaaagagtcccttgttgtcatggacaacctttttggttgaatagaaatctgtcagattcctt

SEQ ID NO: 83969 - DNA, 76 bp, Mus musculus
atgcacatgtgtgcctgtgtgcgtgtgtatgtgtgtgcctgtgtgcatgtgtgtgtgcacgcgcgcgcgtgtgcgt

SEQ ID NO: 83970 - DNA, 64 bp, Mus musculus
tatgcattaagattggtgtatgtatgtatgtatgcatgtatgtatgcattgagactggtgtatg

SEQ ID NO: 83971 - DNA, 59 bp, Mus musculus
cctgtctgtctgtctgtgtaccatgtacatacttggtgcccacagaagccagaagaggg

SEQ ID NO: 83972 - DNA, 101 bp, Mus musculus
gtataaggagattgggggtgggagggatgggcagcagaggccactccctctctgacactggctcagtgcagacttactgaatgctaaagtatgaaggggag

SEQ ID NO: 83973 - DNA, 58 bp, Mus musculus
gtctctgtcacacactcccaggtcatgcggtttccctggagagatgtgaacaagggat

SEQ ID NO: 83974 - DNA, 78 bp, Mus musculus
tgaaaaattggaactgctgttagagagatggctcggcggttaagagcactgactgctcttccagaggtcctgagttca

SEQ ID NO: 83975 - DNA, 76 bp, Mus musculus
ctcactcgggtcacatggcttcaaagatactttgtaatttttcatgtgtctgtgtctgtctatgtgcatgggagag

SEQ ID NO: 83976 - DNA, 91 bp, Mus musculus
tctgtaagactcaagctctggggctggagagatggctcgttggctaagagcactgactgctcttccagaggtcctgaggtcaaatcccagc

SEQ ID NO: 83977 - DNA, 116 bp, Mus musculus
tatgccttgtcaaggctcatttggtagttagatcgtcgtgtggtaacaaagttgaaaggaatgaagacagcctacaaaaataaaacgatcacaccaggactggggttaggggtgta

SEQ ID NO: 83978 - DNA, 95 bp, Mus musculus
atgtgtatggtgtgtgtgtgtgtcatgtgtgtgtgtgtatgaatgcgtgtgtggaatatgtgtgtgtgtgcatgtgcatgtctgcctgtacatgt

SEQ ID NO: 83979 - DNA, 75 bp, Mus musculus
caggagtggggctggctgggagggggtgcacgcgtgcatgtgggtgtgtctgtctgtctgtctgtcccacttgtg

SEQ ID NO: 83980 - DNA, 67 bp, Mus musculus
catttacgtgtcatgtctgggtggaggccagagacactgggctcctctagtgctggcagtacacatg

SEQ ID NO: 83981 - DNA, 71 bp, Mus musculus
gagagagagagagagagaatgggtaggccagaagttgacactgagtgtctccctcagtcactctctgcctt

SEQ ID NO: 83982 - DNA, 82 bp, Mus musculus
tgtcactgtctctccctctggctgggatgaaggtcggcagggactgaggcctgactcccagctaaggaggtggggagggaca

SEQ ID NO: 83983 - DNA, 108 bp, Mus musculus
cttgtatattgattaacagtggagctaaagatagaaggaggctgcggagagagatgagagtgcggtgagggggctcttttctagtgagtctttctgtctccacacagg

SEQ ID NO: 83984 - DNA, 83 bp, Mus musculus
agcctgtgtgtgtatctgtctgtgtccgtgtgtgtatatatgtgtgtgttggggcggggaggggtgtgatgtctgctatggct

SEQ ID NO: 83985 - DNA, 112 bp, Mus musculus
tatatatgcaatatatagatatccatatatatgcatgtatttatatctatgtaaacatatagtatttatatatgcacatatatttacatctacctagatacagtcatatata

SEQ ID NO: 83986 - DNA, 59 bp, Mus musculus
ctctgggactagagagacagctcagcaattaagggcactggttgtttgctgttccagag

SEQ ID NO: 83987 - DNA, 88 bp, Mus musculus
acagtgacaatgtgcttgtttacataatacaaataaaatcttttaaaaatgtttatttttattttatgtgtttgggcattgtgactgt

SEQ ID NO: 83988 - DNA, 94 bp, Mus musculus
agcataaggagagcacggtcacggctgtggctggctggctgaatggcccaggacctgaggcacagttcttgttccgtggctctttagagatgct

SEQ ID NO: 83989 - DNA, 80 bp, Mus musculus
gtttcttttcacagcctgcttccagctgccagaactgcgaacactttgagctggtcctttaggactccgagaaaggagat

SEQ ID NO: 83990 - DNA, 98 bp, Mus musculus
gtcttcaggctcttggtgactgaagacagggtccaggcctgctcaggttggctctgaactctggtccttttgccagaagatgggtccctggccatgcc

SEQ ID NO: 83991 - DNA, 109 bp, Mus musculus
ggccaaggctaggaccggtgggcgaggtcaggcaaggcgggcaagttactggaaaccagacagctctgtctgtgtctctgccaagctgcccactgcattctttggtctc

SEQ ID NO: 83992 - DNA, 66 bp, Mus musculus
cttacggataccaaccactgcagcctcatgggttcttccatgtatggctctgtgtgtgtgtgtgag

SEQ ID NO: 83993 - DNA, 67 bp, Mus musculus
gtacagacaggaggagctctgagatgagtgtgatcctcagctgggggacagcctctctgtctgatac

SEQ ID NO: 83994 - DNA, 87 bp, Mus musculus
ctgtagggcactgggcagggcatcctcaggaggcctcaggccgcaagggtctctgggctctgagtcactgtcattgtgtcatgctag

SEQ ID NO: 83995 - DNA, 102 bp, Mus musculus
gccgaaagcctgcagcgggcagctgggctcacacacaatgactctgggggtcttggatgccagagtgcctgtctcccagctctgtagtagggtttctgtgtg

SEQ ID NO: 83996 - DNA, 92 bp, Mus musculus
gctgtgtatgctagctttcagtttgatgtttgcttcctgtgagagcctctgtcacttgcccaggagcctcagtttggtgagcttgacatggc

SEQ ID NO: 83997 - DNA, 80 bp, Mus musculus
gcgaaggaggagtttgagccctggctctgtgtgtgtgtgcgcacgtgcatgctggggaaggggctgcctgcctcctgagc

SEQ ID NO: 83998 - DNA, 106 bp, Mus musculus
gccaggtggctctttcagcctgccccagcaggctcagtgctctcggtttccatgattgttctcactgggtctgttctggaatgaaggtgatgctgccacccctggc

SEQ ID NO: 83999 - DNA, 81 bp, Mus musculus
tgacactcttggtatgtggacatgcctctccctggtgctatgctctgatggcacctgctgtgtctctgcctgtctgtgtca

SEQ ID NO: 84000 - DNA, 79 bp, Mus musculus
ctccatggcctctgcctcagtccctgcctgtggttccttcctccctgctcagaaccagcagtactgagagcaccaggag

SEQ ID NO: 84001 - DNA, 79 bp, Mus musculus
gtgcccggctggctggctggctgactggctgtccctacttctggacgccccagggagctggcacaggctagaaggggat

SEQ ID NO: 84002 - DNA, 107 bp, Mus musculus
tcgtagaaactatgggttcacttgggacaccctcactcactgtttcttactcacagggggtcaggccctttggtgggtcacagttactagggctgagggtggctgag

SEQ ID NO: 84003 - DNA, 136 bp, Mus musculus
gcatatgcatgtatgtgctgtgcacgtgcatatgtgctgtttgtgtgcatgatgtgcatgtgtgtgcatgtgcatgtgggtgctgtgcatgtgcacatgtgtgccatacatgtgcacgtgtgtactatgcatgtgt

SEQ ID NO: 84004 - DNA, 87 bp, Mus musculus
gtttggacacctaacagtctctctttgtctctgtggtgaagagacattacttcttttcattactggccaagaggtcggtagccacac

SEQ ID NO: 84005 - DNA, 74 bp, Mus musculus
ggtgctgccctctgccctctggtttccagtggtcagcagcagtggagttcagagtgagcacaatgagaaagacc

SEQ ID NO: 84006 - DNA, 80 bp, Mus musculus
gggagcatcttgctgggatacactgtcagtctcattgttacaacgggacaagtgagtctgttgttccaagatacactttc

SEQ ID NO: 84007 - DNA, 77 bp, Mus musculus
ggaccacctgtgacatttgaggcttcctggattgtaacacaagagcctctgagagcctcagacccaccggccagttc

SEQ ID NO: 84008 - DNA, 71 bp, Mus musculus
gcagaggtctgcctgcccttcagtctgtgtctctgagaactgggctgaccagggactgagtcaggccctgc

SEQ ID NO: 84009 - DNA, 88 bp, Mus musculus
ggcattctaagcccagctgacagcagagcccctggttgttgtctatatgggagccttgggtctgagaagcctgtgtggtcaggatgcc

SEQ ID NO: 84010 - DNA, 88 bp, Mus musculus
gggctccatcccaagggagttgttgagacatccaagccactggctttggtcccagggtgtcactctctctgcctgggatacatggttc

SEQ ID NO: 84011 - DNA, 81 bp, Mus musculus
tgattgcagctgggccctcttcccatgcctgaccacttttctccctggagcttggcacaggcagtcacagtctgtctatca

SEQ ID NO: 84012 - DNA, 62 bp, Mus musculus
ctgccaggcatcctgtgtccctccctctcagaggatcagggggaatccaggatgcttagcag

SEQ ID NO: 84013 - DNA, 80 bp, Mus musculus
ggcccctgagcaaagaggttcaggccagtttttcccccagaaccctctgccaaaaggctcgctctgtctctgtctctgtc

SEQ ID NO: 84014 - DNA, 68 bp, Mus musculus
gtatgtacatacataagtatttatgtacgtatgtatgtatgtatatttgtatgtatgtatgtatgtat

SEQ ID NO: 84015 - DNA, 116 bp, Mus musculus
tcatttgtgatgccttgaaagctctgaagcaacaaagaaacatgatgacatggtgaagtgtttatgatgtaatgtgaagctctacagcccagcttaaaagtgtgtgtgcagtatga

SEQ ID NO: 84016 - DNA, 89 bp, Mus musculus
tgcctttttaggttggggtctaaggttggtctcttactcctgacgttggggactctctcggtctgcctgtcactgaatctagagtggta

SEQ ID NO: 84017 - DNA, 102 bp, Mus musculus
gggcagcccctgtgggcctgcctgtcaaggagacattgtggcattgagctcttcctctctgtgcctcacttgacagcagcacccccactccaaggagggccc

SEQ ID NO: 84018 - DNA, 62 bp, Mus musculus
cctgtgtgcctgtgtgcctgtgtccctgtgtgcatgcaggtgcagccttaggcagcctcagg

SEQ ID NO: 84019 - DNA, 178 bp, Mus musculus
gtgtgcctgtacctgtgtgcctgtgtgcttgtatgcctgtacctgtgtgcctgtttgcctgtgtacctgtgtgcctgtgtgcctgtgtgcctgggtacctgtgtgcctgtgtgcctgtgtgcctatgtacctgtgtgcctatgtgtgtttgtgtgagtctactggtatgtctgtgtgc

SEQ ID NO: 84020 - DNA, 78 bp, Mus musculus
actctgttataaagacaaatggagcctggcacgcagctgacgtgcgtgcggtgaggaattttttatttttgaacaagt

SEQ ID NO: 84021 - DNA, 108 bp, Mus musculus
ctggttgcctgtctcctctgtaagaggcaagcccagtgtgtagagggtgagcccaggctcatgcagtaaggcagggctggtggccccttcagagcagcagcatctcag

SEQ ID NO: 84022 - DNA, 108 bp, Mus musculus
ctccattccggataaggtacagactgcctcacttcaggctggttcttccagacagatgtctctgagcacaggggttgggggaggggcagctgctactgctaaatggag

SEQ ID NO: 84023 - DNA, 85 bp, Mus musculus
gtggttctctcctttcacctttacatcagttctgacgattgaactcagctgtcaggcatgtggtcagtgtctctctgtgaactat

SEQ ID NO: 84024 - DNA, 117 bp, Mus musculus
tatgtacatgtgtgtaaaacatgcaatcccacttatatgcatacatatatatgcatatatatatgtatgttcatatatatatacatatatatgcatacacaaacattcttgtatgca

SEQ ID NO: 84025 - DNA, 76 bp, Mus musculus
cttctgcaccagtcagtagacagtgaggaccctggtgtccagggctcataccagtctggtcagaccgctgctaaag

SEQ ID NO: 84026 - DNA, 80 bp, Mus musculus
agattctgataccccatgtatatgtctatgtatgttaagttctgcatgtgcatgtgtatgtgacagggccacagattgct

SEQ ID NO: 84027 - DNA, 82 bp, Mus musculus
tatgtatgtgtatacgtatacgtatatgtatatatatgtggcagacgtatatgtatatgatgtatatgtatatgtatatatg

SEQ ID NO: 84028 - DNA, 113 bp, Mus musculus
gcctgcacccgccggctctcagctcgcgctcgctcgctcgctcgctcgctcagacaactgagcccgggccgccgcggcacgagaactcatgcaaatcccggacgtcagcgggc

SEQ ID NO: 84029 - DNA, 90 bp, Mus musculus
cacagcaaattctgggccagccagggctacatagtcagactctgtctcaaagtcaggcctgtgatctggtgctaggctggggtgggggtg

SEQ ID NO: 84030 - DNA, 79 bp, Mus musculus
cctctgtgccccatcctgtggcagcgtgccagaccttactcactcacacactgccaatgtcagggcctctccagggagg

SEQ ID NO: 84031 - DNA, 58 bp, Mus musculus
gtgtgtgtgtgtgtgtgtgtgcatgcacatgtgcatgtatacatgtgtgtacatgtgt

SEQ ID NO: 84032 - DNA, 92 bp, Mus musculus
ggaggagcgacattccacgaagtggacagacttcagcgtatttgtctgtctgtctgtctgtctgcctgtccactgtgtcctgatgcttcttt

SEQ ID NO: 84033 - DNA, 74 bp, Mus musculus
cagctgtaacagtgaatatgctcggtcactcagacagacacaagatgatgtggcccagagctcactgactcctg

SEQ ID NO: 84034 - DNA, 64 bp, Mus musculus
ggagtggggtctctctctctctcatgcacagaagggagagcgagtaagagggagacttccatcc

SEQ ID NO: 84035 - DNA, 113 bp, Mus musculus
gtgggtgtcctatggctacaggcacagtctctgtaaattcaccccctctgtgtgtgtgtgtgtgtatgcgcgcatgtgtgactgagtgtatgtcgtgtggcctcatctcccac

SEQ ID NO: 84036 - DNA, 122 bp, Mus musculus
ctgggacactacactaaatggtggagtgggactcatgtaaaagcctggaataggacagtgaagatggtcagctccattctgtctcagtggtaagacagcaagactacctgggctgtaccatc

SEQ ID NO: 84037 - DNA, 78 bp, Mus musculus
gagacagggtctgtccgtctgtccgtgtggctctgggcatctggagcttgctgtgtagaccaggctgacctcaaactc

SEQ ID NO: 84038 - DNA, 84 bp, Mus musculus
ccaggatagtcggcagctcaggtctgggggtgattgcacactgtgtgtaactgtgagtctctgtttctgcaactatataactgg

SEQ ID NO: 84039 - DNA, 88 bp, Mus musculus
agctgggtataaagggacatgtgcagatgcatagtcttacaatcctgagtactctctgtctgtctgtctgtttccccctgtactggct

SEQ ID NO: 84040 - DNA, 69 bp, Mus musculus
aggaggctttgtgacacagctctcaagcacccaggtccttcaccacagtgtctgtgtcactcagctcct

SEQ ID NO: 84041 - DNA, 71 bp, Mus musculus
gcctggaagtgacagagcagagtgtgactgtagcctctcacggccaggagtcacagcatttccaagagggt

SEQ ID NO: 84042 - DNA, 76 bp, Mus musculus
tgaggaggctcagtcaggctgtcagagcctctcttccttcatttgctcagggctcagcagcagcttctggccctca

SEQ ID NO: 84043 - DNA, 76 bp, Mus musculus
gaggatggcagagctgaggagacgtcaggaggcgaggccaccctgccagagcctgtctcgctcagactcactcctc

SEQ ID NO: 84044 - DNA, 74 bp, Mus musculus
gactcttacaagtagtcctgacttccagacccagaccatggtgtgggctctgtgtctctgtctctgtctgggtc

SEQ ID NO: 84045 - DNA, 102 bp, Mus musculus
gttctgttcttagtagttgggttctgaatggcttcatggtgacagcaatggaatcaaaggaactgtctgaagttaaggaatcattacaaaggcaacagcagc

SEQ ID NO: 84046 - DNA, 77 bp, Mus musculus
gcaagcatctgctatgcactagctctgtctctcttacacatacacacaggcagacagacagacatacagacagctgc

SEQ ID NO: 84047 - DNA, 117 bp, Mus musculus
ctgtgatttatgtcagcatagtacatgtgacagactgcttcctaattctctgtttcagagagaactgagaggagacatggtctgattcaggctatgggattggctctaaaggcgcag

SEQ ID NO: 84048 - DNA, 88 bp, Mus musculus
agctgggctatgttgccagggggcgggtgcctgagctccagcacccgggagaggagtcagatctgtctctctgtgaggtagcacagct

SEQ ID NO: 84049 - DNA, 73 bp, Mus musculus
aggtatgtactaacaggctcagcttttacccctgcccttaaaggggagtctgtctgtctgtctaggttggcct

SEQ ID NO: 84050 - DNA, 84 bp, Mus musculus
tacccttatctagtggtttctttatcctgtacgtgaccagttgcaatcccagacaggagagagtggacagtgagcacatgggtg

SEQ ID NO: 84051 - DNA, 99 bp, Mus musculus
gaaaggtgagcgagcagaattatggaggatgcatctgtgtacctcatgagtgaagtttgtgactacagaccccgtgaagatggctcctgatacctgagc

SEQ ID NO: 84052 - DNA, 84 bp, Mus musculus
tattttagcttgcacatacacatatacacacacacacacaaacttttgtgagtatgtatgtaagtaagtatgtatgcttaaatg

SEQ ID NO: 84053 - DNA, 86 bp, Mus musculus
tgagttcagtcagctcactgtgagcttacagctgaaggcagacccttctccatcagtaggctcacaccagccttgacccgatctta

SEQ ID NO: 84054 - DNA, 101 bp, Mus musculus
tgtcaacctttcttcctcctggattgcctcattgagtgtcggtaggagagaataagtctagtcttactgcaacttgatatgccagggctgattgatatcca

SEQ ID NO: 84055 - DNA, 118 bp, Mus musculus
gccagtcagcaaagctatgtactgtgtaaatgggttctgggtactgtctcactgtctggtaagatagaataccatgtgaaggtgttttcagcagtggctacaagtgtatctacatggc

SEQ ID NO: 84056 - DNA, 82 bp, Mus musculus
ctctggctgcctgcctgcctgcctgctgcttttgagcacatggtgaggttctagatcagggtggggaaggtggaagcagtca

SEQ ID NO: 84057 - DNA, 73 bp, Mus musculus
ggtctcactaagtagatcgggctggccttgaactcacagagatctacctgtctctgcctccctgtgtgagatt

SEQ ID NO: 84058 - DNA, 72 bp, Mus musculus
ctaaagagggtgaactggctgtatgtcagtcaaatcaacgtgactgtagacagagaccactttctccgttag

SEQ ID NO: 84059 - DNA, 101 bp, Mus musculus
ccctgggtctctgcacagcatcttctgcagcagccctgagaacacacagaggccatagatgcaggcctgctgacctagttatcaagaaggggcacagctgt

SEQ ID NO: 84060 - DNA, 93 bp, Mus musculus
agcaccagcttgcagccagcccagaactccacgtgcgtgcactcacacacagacacatacacaccctgttctgtgcctttgtctcagtgtgct

SEQ ID NO: 84061 - DNA, 68 bp, Mus musculus
aaacaaggggctgaagagatggctcagcggctaacagcactgactgctcttccagagatcctgagttt

SEQ ID NO: 84062 - DNA, 85 bp, Mus musculus
gcacagtgctttgaggctggcagttacctgactgagcacacagtgagcccgcacagtgctttcaggctggcagttatatctgtgc

SEQ ID NO: 84063 - DNA, 62 bp, Mus musculus
gtgaggcgtggggtaggcagctggcccgtgtgccactgagtcactgagtctctacgccccgc

SEQ ID NO: 84064 - DNA, 111 bp, Mus musculus
gctccaacgctgcacaggccgtcctccccaacaatatcctggtgctgagtgggtgcacagtgactccagcatcagtgattttgttgaagagggcagctgccagcctcctgc

SEQ ID NO: 84065 - DNA, 77 bp, Mus musculus
gggctgtagggatgcacccacaggtgctggtcgtggccagctggggccactccgagcagtgagtgctgacacagtct

SEQ ID NO: 84066 - DNA, 66 bp, Mus musculus
tcagccagccccgcagccaccaccggccccgcagccactgcgcccggtgactctgtgactctgtga

SEQ ID NO: 84067 - DNA, 78 bp, Mus musculus
ctgaaacccgtctcagatgacagggagcagtgccctccataagggcatgtcctttatctccttgccctggacaggcag

SEQ ID NO: 84068 - DNA, 112 bp, Mus musculus
ccatgaataaagagccaaaaacctatacagacatgtgtgttctgcactggaatttgtcaatgtatgtgcaagagcatgtgttcatgcgtgtatgtgtgtgcttgtcgtatgg

SEQ ID NO: 84069 - DNA, 104 bp, Mus musculus
gagtcctagtccttgtagggctggagagatggctcagcagttaagagcactgactgctcttccagaggtctcgagttcaaatcccagcaaccacatggtgtctc

SEQ ID NO: 84070 - DNA, 74 bp, Mus musculus
cttctgtcagggctcaggctgctgggtctgtgacagacagacagacagacagacagcagtgttctgactgggag

SEQ ID NO: 84071 - DNA, 103 bp, Mus musculus
catggtatgcatgcatgcatgtgtgtgtatatgtatgtatgtatgtatgcatgcatgtatgtgtgtatatgtgtgtacgcatgtatgtatgtgtgtataaatg

SEQ ID NO: 84072 - DNA, 83 bp, Mus musculus
agagtgagaagacagtctggggacaagataagggtgcccagcgaaaccctggggagccgttttcagaaagtgagtatccacct

SEQ ID NO: 84073 - DNA, 85 bp, Mus musculus
ggtccaagaatatatagagacctgtctccaaacaaaatgtacatttttttttcttgagactgggtttctttgtatagccttggct

SEQ ID NO: 84074 - DNA, 63 bp, Mus musculus
tgtgtgtgcatgcattatacatgtatatacatgtatatatatgtatatgtgtgtgtgtataca

SEQ ID NO: 84075 - DNA, 77 bp, Mus musculus
ggtcttagggggccaggtgacagcacttagtgacctcagggtaactgtgcatggtaaagccaccagcttcctgttcc

SEQ ID NO: 84076 - DNA, 117 bp, Mus musculus
acacatgtatgtatatagaatgtatatatactatatatagtgtgtgtacaatatatattgtatgtatatataagtaactatatataagtatatatatagtgtgtgtgtacatgtgtt

SEQ ID NO: 84077 - DNA, 78 bp, Mus musculus
ccgtctactgtatatgaatgctctctctctgtgtataactgaaggccagaagagggcattagactgcactgtacatgg

SEQ ID NO: 84078 - DNA, 95 bp, Mus musculus
tgttttgctgacctgctgttggaccttctatcccagctctctgtgctgtgagtggctgttgttattaaaaggacccgattacctgaagtttgata

SEQ ID NO: 84079 - DNA, 114 bp, Mus musculus
aggcatgcatctgaagggacagtggggacatctgtgtcctgttcagtcacactgactcccactagggaaggcttgctggtcttggataccactcacacaccttctcttgttcct

SEQ ID NO: 84080 - DNA, 78 bp, Mus musculus
gttctcagcctctcactccctccatgccaactcaaattccatttcctggactgtatatgggggtgcagcagtcagagc

SEQ ID NO: 84081 - DNA, 80 bp, Mus musculus
aagctgccaggtgcctgcctgcctgcctgccatggactagctgggtggggcagggtggctgggcaggaactcaggggttt

SEQ ID NO: 84082 - DNA, 85 bp, Mus musculus; identical to SEQ ID NO: 57439

SEQ ID NO: 84083 - DNA, 118 bp, Mus musculus
ggagcatggagttatcaaaagctgctgtagagatggctcagcggttaagagcactgactgctcttccagaggtcctgagttcaattcccagcaaccacatggtggctcacaaccatct

SEQ ID NO: 84084 - DNA, 88 bp, Mus musculus
aggtgccctattctccagtcacagcgtctctctcaccctcagttgacattgatcagaaggtgaaaaagtcctttcattggagaaacct

SEQ ID NO: 84085 - DNA, 101 bp, Mus musculus
gcgcatacatcatgggctggagagatgggctcagaggttaagagcactgagtgctcttccagaggtcctgggctcgactcccagaaaccacatggtggctc

SEQ ID NO: 84086 - DNA, 91 bp, Mus musculus
gggctccatctcctggcattgaggaagtgcctcagacatgcagtcaccctgtctgtcttgaacttcatccctagtggcacccacccagccc

SEQ ID NO: 84087 - DNA, 103 bp, Mus musculus
tggctgcttgtactgagcctgagtcctgatgtgtcccttgccttgaccaggtcaagacacagacagacactctggggactccagctcacggcaagtctctcca

SEQ ID NO: 84088 - DNA, 59 bp, Mus musculus
cgggaagtcaggacaggagccacagaggaacgttgctggctcagtcactcacagtctcg

SEQ ID NO: 84089 - DNA, 114 bp, Mus musculus
tatgaagttgacaatgaaaaccggccatcacagtcaccctaggtttacagaagactagtcattttgaactatctaggggacaccaagatagtatcgatttaatattatttcata

SEQ ID NO: 84090 - DNA, 118 bp, Mus musculus
atttcaccagaactgtagaaataatcatgggcctagctttggctggaggatggcaggcccatctcacccagctttgtagagcaggacaccttatgaataggagcagtatagaggaggt

SEQ ID NO: 84091 - DNA, 82 bp, Mus musculus
tttgcctgtctgtctgtctgtctatctgtctatgcactatttgcatgcctggtgcctacagaggccagcagacaccatcaaa

SEQ ID NO: 84092 - DNA, 115 bp, Mus musculus
ggaagggggctgatgaggtgggccatcgtgtctggaatgttgatggtcaggggtgagatgtgtggctgcacaggcttcactggcgactcaggtgcttcctgcttctctctcttct

SEQ ID NO: 84093 - DNA, 90 bp, Mus musculus
accgttagcaactgaaacagtattttaatatttcaacagtgcaatacaaagataggctgacttgatattgaaatgctggggaataatggt

SEQ ID NO: 84094 - DNA, 115 bp, Mus musculus
aacctggggcctggagagatggctctgcggttaagaacagactgctcttccagaggtcctgagttcaattcccagcatccacatggtagctcagaaccatctgtaatgggatctg

SEQ ID NO: 84095 - DNA, 99 bp, Mus musculus
gagttggcttgggggctggagagatggctcagtggttaggagcactgactgctcttccagaggtcatgagttcaaatcccagcaaccacatggtggctc

SEQ ID NO: 84096 - DNA, 147 bp, Mus musculus
aagagcaacaaagtgctcttaaccactcaaccatttcttcagtactcattttattgtttaaaaatatatttagggctggagagatggcgcagtggttaagagcactgactgctcttccagaggtcctgagttcaaatcccagcaacc

SEQ ID NO: 84097 - DNA, 97 bp, Mus musculus
cagtgctcatgttgactacatgatgtgtgaatgttagggtacttggcaaggaatcctaacattgcaatggaatgaaaggtggtcatagacagcattg

SEQ ID NO: 84098 - DNA, 75 bp, Mus musculus
gaattggaggccagagactggatagatggcttagtggttaagagcactgactgctcttccagaggtcctgagttc

SEQ ID NO: 84099 - DNA, 85 bp, Mus musculus
gcctttagcatttcaagaagtatctgtccttgggcaaggagcttacaggtcagatgcatttttttttttcatggatcgcttaggc

SEQ ID NO: 84100 - DNA, 106 bp, Mus musculus
atgtgggcatacatacatacatatacatatgtgtgtctatatatatacatatatggtgtatatatatatatacatatatatatatgcatatgtaataacaatacat

SEQ ID NO: 84101 - DNA, 72 bp, Mus musculus
tatgtttgtacattacatacacatgggggggggtgcatgtgtctgtctgtctgtgtatttgtggcaaacata

SEQ ID NO: 84102 - DNA, 76 bp, Mus musculus
gcaggcatggaggataccagcagagacagcctcaggctcgaagtctcagtctgtctgcttctctctgtgtctgtct

SEQ ID NO: 84103 - DNA, 113 bp, Mus musculus
tacacccactgcccaccatacacacacactgggaacagggaagacagacaagagtgaggacttaatcataagaatgtagttatgtttctaaaggtatggtttacagaagtgtg

SEQ ID NO: 84104 - DNA, 77 bp, Mus musculus
gacgctagtgctgtccacagtgcctgtctcagtggctgtctcagtggctgtcctcagtgcctgtctcagtgcctgtc

SEQ ID NO: 84105 - DNA, 90 bp, Mus musculus
taggattaaggcctcctgagccttgcccaccccagtccacataagcatgtctattgttcttgttcagctcagctttaggcagtgatgctg

SEQ ID NO: 84106 - DNA, 82 bp, Mus musculus
gcctggctatcttttgtgaatgttcttaaagtactaaatgaaaatttttactttttggtcagatgtctgtggggtggctagc

SEQ ID NO: 84107 - DNA, 96 bp, Mus musculus
gcctccctggtgcccatgaaggtcagaagagagtgccagatcctctgaaactggaattacagacagttgtgagccaccaggcaggtgctgggactc

SEQ ID NO: 84108 - DNA, 82 bp, Mus musculus
agaactcccaggtgcccagggtcatttcatgatgggctgggcagcacacactcactgtgtgattctgtggtgctcctgttct

SEQ ID NO: 84109 - DNA, 59 bp, Mus musculus
gctgtcagtctgtgactcacttgtccccaggcagggctgggtgcctgtcactcactagc

SEQ ID NO: 84110 - DNA, 106 bp, Mus musculus
gcccttgtagctcaggttttctagctttcacaattacgaggaaataatgtctatagtctaagtgcatttgatatcacagtttagagagcactgggctgccttgggc

SEQ ID NO: 84111 - DNA, 78 bp, Mus musculus
gtgtttggttttctagctgatagtccttaatttaaaagttcaaaatctgagaggcttcacagtgggaaacataagcat

SEQ ID NO: 84112 - DNA, 83 bp, Mus musculus
tccaagcttcctctgttaacattcaactctcactcctgaaatggcgtgagatactgaaagactgggtgtattttgagcttgga

SEQ ID NO: 84113 - DNA, 117 bp, Mus musculus
gactgaaggtcacacacagtagcttctggattgatcttgtactgactggtaatgttggccgcagcaaattcctttcctttaaacattcatttccttctgtgaaatgtgagatccgtc

SEQ ID NO: 84114 - DNA, 89 bp, Mus musculus
ttgatgtttgcatgtgggtctctgtatctgtctcctgtaggacttctagagaagggagggggacaacaatccactcacaagaccttcaa

SEQ ID NO: 84115 - DNA, 89 bp, Mus musculus
gcataaaaagtctgatgcttgatttgaaaaatacagattccacacaacctctcctgtgtgtgtctgtttgtcattcatccacgctttgc

SEQ ID NO: 84116 - DNA, 85 bp, Mus musculus; identical to SEQ ID NO: 57470

SEQ ID NO: 84117 - DNA, 90 bp, Mus musculus
catacatacatatataaatgtatgtatgtatgtatgtatgtatatatatatatatatatatatgtgtgtgtgtgtgtgtgtgtgtgtgta

SEQ ID NO: 84118 - DNA, 111 bp, Mus musculus
tgtacatatatgtatatatgtgtgtgtgtatatatatatatatatgtatatatatatgtatgtatatatatatgtatatacatgtatatatatgtatgtatatgtatatat

SEQ ID NO: 84119 - DNA, 97 bp, Mus musculus
agacttagtccatggtgatctgataggatgcatgggacaatttcaatatttttgtatctgtggaggcctgttttaggaacaattatatggtcagttt

SEQ ID NO: 84120 - DNA, 85 bp, Mus musculus; identical to SEQ ID NO: 57470

SEQ ID NO: 84121 - DNA, 72 bp, Mus musculus
agtctgaattatttaaaatgagtggctgttcttgtagggaacaaaaagctagtcattttgatgttctgggct

SEQ ID NO: 84122 - DNA, 67 bp, Mus musculus
ctcagctagaagcttctttcctgttggctattttacagtccaggaatgtgttgctcaggctactgag

SEQ ID NO: 84123 - DNA, 116 bp, Mus musculus
tgagaaacattttgcttctgatcaatgccctgagtatgtcttggagtccctctctgttcctcactgagtttgagtctatgagacacccttgttcctgtcacttttctgtgttctga

SEQ ID NO: 84124 - DNA, 65 bp, Mus musculus
gcgctctggctctctggcgctctggcgcgctggcgctctggctcctaaagatgtaagcggggggc

SEQ ID NO: 84125 - DNA, 105 bp, Mus musculus
ttgtactgtgtgagtaacatctgctttcaaaaagtgcatttattttattgattaaatcatttattgactatcagatatatgtgcaacttgctctcaaagtatcaa

SEQ ID NO: 84126 - DNA, 116 bp, Mus musculus
aaatgaacctcctaaatttgatgtgtgtataatctgtgtatgtggtgtgtctgtgtgtctatgtccagatgagttgtatcatagttgcttgcatgagcatgggtaaagggttattt

SEQ ID NO: 84127 - DNA, 100 bp, Mus musculus
tctttatttcttccatgacattgttttcattgagtagaatgttgtcagcttccacgtgaatgttggctttgtattatttatgttgttattgaattgaaga

SEQ ID NO: 84128 - DNA, 112 bp, Mus musculus
ttttctgtgatgatctcaagcttgaagggacaggctgttttctgattagagctcagcagttcacagtctcttattctcttcatgtttattagttgctgatttctacattaga

SEQ ID NO: 84129 - DNA, 82 bp, Mus musculus
gtctagatgcaggtgacatgaccactgtgtgatgctgaatattcagtatacttgaagtgaacatatcacagccaggatggat

SEQ ID NO: 84130 - DNA, 89 bp, Mus musculus
cctgaccactcttccccactgtcactgtgtctccaacaccaacagacattccctgtgaacacagtaagtgagaaggctagtaacacagg

SEQ ID NO: 84131 - DNA, 82 bp, Mus musculus
ttttgggaaggttcttttccttccagagttaaaggcaaaatactgccataacagttacacagagagaagagtctgaccagga

SEQ ID NO: 84132 - DNA, 68 bp, Mus musculus; identical to SEQ ID NO: 59726

SEQ ID NO: 84133 - DNA, 99 bp, Mus musculus
catgagatagcactcacccaaagaatcacaagagattatcttgatgcaaacacacaaggtagtttaatgatggagctccgggccaataagtatctcatg

SEQ ID NO: 84134 - DNA, 80 bp, Mus musculus
gtctggagccaaagatggcgctgcctcagacccactctcagtcttatcctttcgggtgtgaagtgcttcatttctccagc

SEQ ID NO: 84135 - DNA, 85 bp, Mus musculus; identical to SEQ ID NO: 57439

SEQ ID NO: 84136 - DNA, 83 bp, Mus musculus
tacttggggcataggtaaaagtaagatgatagtgtatatatgtgtttatatacacagttcaagctaaaacctacctccatgta

SEQ ID NO: 84137 - DNA, 79 bp, Mus musculus
tggatgcccgggcggggcagtttcagattggttctttctaccatctcagatctgaactgtgtctctgtaactcattcca

SEQ ID NO: 84138 - DNA, 90 bp, Mus musculus
aaaggagtcggtgagagtgacaaacagccgcagacacaagagagtgtgttaaatttgaatgtattgtccaaatgaaaaccagactttttt

SEQ ID NO: 84139 - DNA, 99 bp, Mus musculus
tacccacaaccatgtatctttaggctgtaccatacactgagggatgctgttttagaaaatgtatgtatgcatgtgtgaatgatgctaatgtacctggta

SEQ ID NO: 84140 - DNA, 128 bp, Mus musculus
ttgtgtatatatgtatgtatttaaagattatatataagtgtattatctatctatctatctatctatctatgtagttagatttagagatatgtatatatataactacattatatataaatattaataca

SEQ ID NO: 84141 - DNA, 119 bp, Mus musculus
gctctatatctaggactacttctcctttaagagttactttttagaagatactcagcacattactctagaaagatgaggaacacggagaggggaggtcagaaatactttagaaattaagt

SEQ ID NO: 84142 - DNA, 76 bp, Mus musculus
gacatgccccactgtctctatttgtctcatttattttgaatctatcagactctatagggagaatgggacctttgtc

SEQ ID NO: 84143 - DNA, 85 bp, Mus musculus
gcaatggaataagcattggaaaatgtcatttgttttcttgggaggaatgggacagatgacagactccagtgtttagaacatgtgc

SEQ ID NO: 84144 - DNA, 116 bp, Mus musculus
tgctttaattgtaatggtgaatatatatgcatataatggtgaatatatatctatatataatggtgaatatatatatatatatatatgtatatgtatatataatatatatttaagta

SEQ ID NO: 84145 - DNA, 89 bp, Mus musculus
gtgtgtgtgtgagagagagagagcacacaggctgtaaatctcaaacatccttggtgttagttttgcttttattcctctcacacctgtac

SEQ ID NO: 84146 - DNA, 82 bp, Mus musculus
gtcacttctgtaagtttcactgtgtctctgtttagtttctgtttccaggatctgtccagtgatgagagtggggtgatgaagt

SEQ ID NO: 84147 - DNA, 99 bp, Mus musculus
taaggagatggtttacattgttttgttagaaagatatagtacagttagaattaagagtagaatgtgtcctctcccttgtagaatagtgacatcttctta

SEQ ID NO: 84148 - DNA, 88 bp, Mus musculus
gggcgatccacagcttttgtcacctcgtgctctcacccctgaggcccgagtagcattagaaaaggtagaaagttgtttagaaaaggcc

SEQ ID NO: 84149 - DNA, 90 bp, Mus musculus
ctggtgttagcttgtcttactgtctctgactgttgcttgtccacctgcaagcctgtatgtcagtactcctgggagactagttctctgcag

SEQ ID NO: 84150 - DNA, 98 bp, Mus musculus
caatttccacacctgtcatctaaatttgcttaggaatttcagaagaataggcaattctgattttgttattctctacttaaattggatattgggaattg

SEQ ID NO: 84151 - DNA, 85 bp, Mus musculus; identical to SEQ ID NO: 58722

SEQ ID NO: 84152 - DNA, 85 bp, Mus musculus; identical to SEQ ID NO: 57439

SEQ ID NO: 84153 - DNA, 76 bp, Mus musculus
gatctacaactccagggtagacaataagaccttgtaggctgcaagagcctgtctctgtctctctggccacaaaatc

SEQ ID NO: 84154 - DNA, 85 bp, Mus musculus; identical to SEQ ID NO: 57439

SEQ ID NO: 84155 - DNA, 113 bp, Mus musculus
gacaacttatatctgaaaatatatgcaacagaatttaagaaaaggcatctgtctcactgaatcagagagaataagaactgagttgaattctattgtcactaattataaggggc

SEQ ID NO: 84156 - DNA, 72 bp, Mus musculus
ctctctatctctatctctatatctctatctatacctatatatatatgtatgtatagatagatagatagatag

SEQ ID NO: 84157 - DNA, 77 bp, Mus musculus
ggctcagtccaatgacagtctctgagtatctgcctctgtcttagtcaggtgcaagcagaacctctcagaggatagcc

SEQ ID NO: 84158 - DNA, 99 bp, Mus musculus
tgggatccagtgctgagtccaatggttggctgtgagcatgcgcctctgtatttgtcacactcacagagcctctcaggagacagcaataacaggctccca

SEQ ID NO: 84159 - DNA, 88 bp, Mus musculus
gatcagccttagtccatggtgatctgataggatgcatggggtaatttcaatatttttgtatctgttgaggcctgttttgagacagatc

SEQ ID NO: 84160 - DNA, 69 bp, Mus musculus
gggtgagaagacaggaagtgagggatggggttgccaccccacagtcacttctcagtcactctctgaccc

SEQ ID NO: 84161 - DNA, 114 bp, Mus musculus
gatgtcagctcactgcccagatagagatcctggcactgggaagtctgttagcttgagtctctcaggcagtgtctcagctgtgtaccttgccatgtctgggaaaaaaaaaaaatc

SEQ ID NO: 84162 - DNA, 85 bp, Mus musculus; identical to SEQ ID NO: 71401

SEQ ID NO: 84163 - DNA, 89 bp, Mus musculus
aggtatgtatgcatgtatgcatgtatgtatgtatagctacatgatcatatgtacatactcacatgtgtacacacacagaatatatatct

SEQ ID NO: 84164 - DNA, 101 bp, Mus musculus
taggcttcagggaacttaaacaacattgccaagacagtacagagtatggagatgacaagactccaggcactgccttctaagcaggtaccctccccagtcta

SEQ ID NO: 84165 - DNA, 85 bp, Mus musculus; identical to SEQ ID NO: 57470

SEQ ID NO: 84166 - DNA, 75 bp, Mus musculus
ggtgactttggtgttttcaaatctggctttagggacattaaaaccaaactgagagttgacagacaccatagtatc

SEQ ID NO: 84167 - DNA, 110 bp, Mus musculus
gcccttactgcttttaatattctgtctttatttagtctatttgttgttctgattattatgtgtcaggaggaatttcttttctggtccagtctatttggagttctgtaggc

SEQ ID NO: 84168 - DNA, 117 bp, Mus musculus
gtaggctggctgagaccttgctgccactgagaatgagaccacctggggtggagccttcccacctagatggttctattgttctgtcaccactggtgctgtcccgctccaagacactgc

SEQ ID NO: 84169 - DNA, 85 bp, Mus musculus; identical to SEQ ID NO: 57439

SEQ ID NO: 84170 - DNA, 91 bp, Mus musculus
ctctgaacctggccaacatagtgcttaaagcttgttaacaaacctagtagaactttgtgtcaattgtttgggaagtagaacaggagcagag

SEQ ID NO: 84171 - DNA, 83 bp, Mus musculus
tctttcctgtatgtctatgtgtctctgtgtgtaactagaatctaaacctgggaccctacacaagtcacacatactagcaaggg

SEQ ID NO: 84172 - DNA, 115 bp, Mus musculus
aagtgtggtctggtagtaacttgtaaagcctaatgactgagctatatttttctttctaaagtgtattttagtgtagcattagagagacaagcaatgattctcttacatactttcc

SEQ ID NO: 84173 - DNA, 85 bp, Mus musculus
agtcctatttatgtcattagttatacatggctgtgttcttcctgaatcttaagaatacatccttcagacttcatgacattgggct

SEQ ID NO: 84174 - DNA, 85 bp, Mus musculus
atggtaaagtacttcaaggtgaccagaaaatagaaacaggccacactctctctctctggtaacctttaagagcaaaaggtgccat

SEQ ID NO: 84175 - DNA, 80 bp, Mus musculus
acaggatcatggctccctctacatatgtagcagaggactgttcatctgacattagtgagagaggaggcacttggtcctgt

SEQ ID NO: 84176 - DNA, 65 bp, Mus musculus
ctcactggggctggagagatggctcagcggttaagagcgctgactgctcttccagaggtcctgag

SEQ ID NO: 84177 - DNA, 119 bp, Mus musculus
ggtctgcagaaatctgctcaaaagggtgggtcagtagctagtgactgttatatatttaattataacaggaaagcatattaatagcagggatcttttcctaagtggatttctcttgggcc

SEQ ID NO: 84178 - DNA, 68 bp, Mus musculus
catgccctctgcctctcacagtctccttgcctgcacttccacaatgagccttggggatggctggtatg

SEQ ID NO: 84179 - DNA, 87 bp, Mus musculus
ctccattggggacctcatactcagtccaatggttggagggagcatacacctctgtatttgttggactctggcacagtctctcaggag

SEQ ID NO: 84180 - DNA, 99 bp, Mus musculus
gaacatatgtagcaaacatgcagctcagtctctgtatgagtcccccgacaactggagtagggactgtccctaaagctgttgcctgactaaaatctgttt

SEQ ID NO: 84181 - DNA, 80 bp, Mus musculus
tggcagaagagcttgggagacatggtctatgccttcaaaagaggcaaataagccacactgtaactctgtggctcttaaca

SEQ ID NO: 84182 - DNA, 83 bp, Mus musculus
tgtccatgtccatgcacaagtggagagcacatgtccctctgtctgtctgtatctgtgtctctgtgtgtacatggccatgaaca

SEQ ID NO: 84183 - DNA, 78 bp, Mus musculus
tgtatgtatgtatgtatgtatgtatgtaagtatgtgtatatggatgtatttatgtgtatgcatgcatgtgtgtatgca

SEQ ID NO: 84184 - DNA, 85 bp, Mus musculus; identical to SEQ ID NO: 57470

SEQ ID NO: 84185 - DNA, 81 bp, Mus musculus
tcatgtgaaagcatatatacacacataaagcttagataagtatacatatatacatgtctatgtgtatatatgctcacatga

SEQ ID NO: 84186 - DNA, 85 bp, Mus musculus; identical to SEQ ID NO: 57439

SEQ ID NO: 84187 - DNA, 94 bp, Mus musculus
tttcggagattcaagtctggataaagtgtatttctagttgactaattgtcctgttgacaaaagcattgtctgttgcagacttacatttcagaga

SEQ ID NO: 84188 - DNA, 115 bp, Mus musculus
atatatgggtaggtatggttttcactgtagagattttgtgggagtagaaatggcttttaatatatttttaatacattcctacatatttttataaaagatctatctatctatctat

SEQ ID NO: 84189 - DNA, 108 bp, Mus musculus
catgaggtgatgaaaagaaagcatattcttttggttttgggtagaaggttctatagatccattagatccatttggtttataatatctattagtttcattgtgtctatg

SEQ ID NO: 84190 - DNA, 102 bp, Mus musculus
tatattctgcttgcttgctatattatgatatctctctgtctctgtccggcttgcttgtgtgtggggattcggtgggattgggggggggtgggtctgtgtata

SEQ ID NO: 84191 - DNA, 78 bp, Mus musculus
cagggagacagaatgcacatacacacaactgaaagttgtgaaccccatggagttagttggtagtattgttcatctctg

SEQ ID NO: 84192 - DNA, 75 bp, Mus musculus
ggatgtctagtgtctactacttacagagctggctgtcaggttagtcttgtgtgtttgtaattgactatgatgtct

SEQ ID NO: 84193 - DNA, 72 bp, Mus musculus
atgtatatacatacacatatatatatcaaatatacacacatacactatatatatgtgtatgtatatgtacat

SEQ ID NO: 84194 - DNA, 115 bp, Mus musculus
tccttgaccaaggtatcattgagaagagtgttgttcaatttccacgtgaatgttggctttctattatttattttgttattgaagatcagccttagtccatggtgatctgatagga

SEQ ID NO: 84195 - DNA, 85 bp, Mus musculus; identical to SEQ ID NO: 57470

SEQ ID NO: 84196 - DNA, 99 bp, Mus musculus
gatgtcagtctatgaatttaagatgaacaaaataaattgagtcagggttatccagaacctactgactctgagtctctcttaatgcagtggtttgaaatc

SEQ ID NO: 84197 - DNA, 81 bp, Mus musculus
gctagaaaactctggtgaccctgtctctgtctgtcccctcctgatagtggtagaatataggtgcacatgactacatctggc

SEQ ID NO: 84198 - DNA, 113 bp, Mus musculus
gaagtgatccaatgctggtgctgctgaagcacagggcagagcccccaaagatgacacaagttgaggggaatgctgtcaatgtgtaaatttagtaaccccacgttagagacttc

SEQ ID NO: 84199 - DNA, 73 bp, Mus musculus
aacacttgttggtctcgagtcttcactggtctttgcttagctgagaaaggcacagttgagaagtcctggtgtt

SEQ ID NO: 84200 - DNA, 86 bp, Mus musculus
gcatgtaagcttcccttactctgtctgtgttcttgtccttcttaggaaaatatcaaatctagagtagtatgaagaagatacactgt

SEQ ID NO: 84201 - DNA, 120 bp, Mus musculus
tttgtgtctgttttaacttctctctctctcagattttccctctaaatacacacacacacacacacacacacatacagagagagagagagagagagagagagagagacaaacagagagaga

SEQ ID NO: 84202 - DNA, 85 bp, Mus musculus; identical to SEQ ID NO: 57439

SEQ ID NO: 84203 - DNA, 68 bp, Mus musculus
ctctgtgtatatgtgtatggtatacgtgggaattaagggcacacatatgctatggcatagatgtggag

SEQ ID NO: 84204 - DNA, 87 bp, Mus musculus
ggcttgtctatttgtttctgtcactcactgtgcattttcatcttttaaaagcatatgaaaatgtgtgatttcaggttcataaaagtc

SEQ ID NO: 84205 - DNA, 88 bp, Mus musculus
tgatagggacatgaacaatttaaagacttttttttagatattaaaactaggagtggggttgctttttttgtaggatatgtgactatca

SEQ ID NO: 84206 - DNA, 101 bp, Mus musculus
gcaatgtttaagtctttctctgatagatgtttgagggacttccaagccattcattcattccctcactcattcactcattttgtattagggagcttgcatgt

SEQ ID NO: 84207 - DNA, 63 bp, Mus musculus
gaggtgtatgcgtgcaccagcccgtgcatgtgtgcgtgcgtgcgtgcgtgcgtgcgtgcactc

SEQ ID NO: 84208 - DNA, 114 bp, Mus musculus
aaacattcatgagtgtgggtattttgcatgcatgtatgtatgtacgtacatatgtatgtatgtatgtatgtatgtatgtatgtatgtatgtatacgtgcatatgtggcatgttt

SEQ ID NO: 84209 - DNA, 63 bp, Mus musculus
gtgcacatgtgtatatggtcagtatgtgtctctgtggagatctctctgtctgtgtctgtgcat

SEQ ID NO: 84210 - DNA, 85 bp, Mus musculus
gtccgtggtggtcagataggatgcatgggataatttcaatatttttgtatctgttgaggcctgttttgtgaccaattatatggtc

SEQ ID NO: 84211 - DNA, 118 bp, Mus musculus
atataagtgtgtgagtgtgtatgtgtgtgtatgtatgtgtgtgtgcatatgcatgtgaatatatatgtatgtgtatgtgagcatatatgtgtatatgtgtgagagtgtgtttgtgtgt

SEQ ID NO: 84212 - DNA, 102 bp, Mus musculus
aatttgttaaaaactgcctatatatgtgtttgcatgatgtgtgtatatgtatgtgtgtatgtatgtatgtatgtaatgtgtgtgtgtgctccctttcaaatt

SEQ ID NO: 84213 - DNA, 88 bp, Mus musculus
atatgcaaatgtgtatatatactgagtctgattactatatgtatatgtatatatgtgcatatatagatacacttatatgtatacacat

SEQ ID NO: 84214 - DNA, 101 bp, Mus musculus
atctgtatgtatgtgacatatgtgtgtgcatatgtggctatgtattcctatgtgtgagtatggtcatgtgtgctactggacatgtgtgggagtcagaggat

SEQ ID NO: 84215 - DNA, 111 bp, Mus musculus
catgtacaaatgatcatgtacacatatatgtatgtatatatgtatgtagattttgtgtatatatacatatatacatatatatattcatatttataatcatttccttgcatg

SEQ ID NO: 84216 - DNA, 109 bp, Mus musculus
tgtacatgtatttgtatatcaatatgtatatgtacatataataatttacatgactttatatatatgtatacatacatatacatatataatatatacacatacatatata

SEQ ID NO: 84217 - DNA, 79 bp, Mus musculus
tatattatatatgtatatgtatgtatacatatatataaagtcatgtaaattattatatgtacatatacatattgatata

SEQ ID NO: 84218 - DNA, 83 bp, Mus musculus
agaggactaagggtcttcatgggaaaatcagaagttagtttcttatttttatagctcgtgattagatgctttcttgggtctct

SEQ ID NO: 84219 - DNA, 93 bp, Mus musculus
gtgatcccattttcctatacaactgtcttggcaggcatgtcagacagacagacagacagacagacagacagatgtgaaagtggtgggcagcac

SEQ ID NO: 84220 - DNA, 73 bp, Mus musculus
taggaggtaactatgctgtgaaggtagatctcctgtggctgagattagacctctcacctctttctgtctcctg

SEQ ID NO: 84221 - DNA, 101 bp, Mus musculus
gcctgctaccctgtgtccttgtatcctagcctgccaccctgtatccttgtaatgactagggggccaaggtgattgttgcctgatgatagtgatggagtggt

SEQ ID NO: 84222 - DNA, 76 bp, Mus musculus
gcatgctggtggatcctgctctcctaactgcgctatcttgtctggcttcagtggaaaaggatgtgcctagtcctgc

SEQ ID NO: 84223 - DNA, 72 bp, Mus musculus
cacagtgtgactgtctcagtgcaggtcagaggcttccaggttacccattgctcagagatagctcgctctgtg

SEQ ID NO: 84224 - DNA, 72 bp, Mus musculus
cagaaggaagtctctggggctgggctttgaggtttcaaaaagctcatgtctggctcagtctctgcccctctg

SEQ ID NO: 84225 - DNA, 63 bp, Mus musculus
gctctgagtcagagagtctctgtgagataagaactgaccagtgagacttcgggggctgagagt

SEQ ID NO: 84226 - DNA, 75 bp, Mus musculus
gctctcttggatcattgtggggtctgaagctctcttgtgaagtacttgggggtctctggctctctctcagggagc

SEQ ID NO: 84227 - DNA, 97 bp, Mus musculus
ggacttctgcattattctatattagttactttttgttgctgtgataaaattctataaccaaaagcaacttacaggagagttgattatgctctggttc

SEQ ID NO: 84228 - DNA, 106 bp, Mus musculus
agacccacaagtgtgagccgattgttgccctgccaagccacggaactttgttcagatctgtctctctaaagcgtctggttggggctttgttgattcctgtgttgct

SEQ ID NO: 84229 - DNA, 97 bp, Mus musculus
aaaggactgaggatgactgactattctgtagagattttcttgagcaaagaaaataactttgccacctccaagaaaataactgcagtctcacaccttt

SEQ ID NO: 84230 - DNA, 59 bp, Mus musculus
gatgtggaggttgggcggtccatgcctgtctgtaggaccagggttcaattcccagcatc

SEQ ID NO: 84231 - DNA, 86 bp, Mus musculus
tcttggagctggtggcagaggaatgttgtcagggtggctgagccaagctctgttcagtctttccgtgtgtcagtggaattctgggg

SEQ ID NO: 84232 - DNA, 117 bp, Mus musculus
atgtaacatatatatatatgtatacatgtacatgtatacatatgtgtgtattatatacaatatgtatatatgtatattatatatgtgtgtgtatatgtataatattataatatatat

SEQ ID NO: 84233 - DNA, 81 bp, Mus musculus
agtccaggccagtttccttcagaacatcaggtgaggatgtttaatctgtcctcacttctgactcagtcagctagcaggtct

SEQ ID NO: 84234 - DNA, 74 bp, Mus musculus
aggtcaggggaagttgcctaagtctcaggtgtgtgcctactgagtctctgggtctcaaactgctctaccttacc

SEQ ID NO: 84235 - DNA, 107 bp, Mus musculus
ttggaaaggaagaagtaaaactatcactatttgcatatgatatgatagtatactatactaagtatcatatgcaaatagtgatagttttactccgaaaacttcatcag

SEQ ID NO: 84236 - DNA, 72 bp, Mus musculus
aggccactgtgaatgagaccacctggggtggagccttccaactagatggttctattgttctgtcacctgcct

SEQ ID NO: 84237 - DNA, 80 bp, Mus musculus
cttcccagccagatgtgttgtaggtacctgatgctcttccagggtcactgtgtctctcacatgcttgtgctgttctgaag

SEQ ID NO: 84238 - DNA, 91 bp, Mus musculus
gtgggttgggtcagtctttctgattataacattagctccatggaagcaggagttgttgtctgtctgtctctgaattctcagcttctaccac

SEQ ID NO: 84239 - DNA, 82 bp, Mus musculus
tgccttctttcatgctgcccaggcctatgagatacttacctgtctatagactgctcagttctctgtgtgaaacagcatggca

SEQ ID NO: 84240 - DNA, 70 bp, Mus musculus
gatgagtcctgaggtgtaaggcctttgcttttgtctagagctgcgccgctcactgtctgtgtgactcgtc

SEQ ID NO: 84241 - DNA, 106 bp, Mus musculus
cacaagaacagttctaattgatgactgatgacaatactgtagaacagtgtcacagtagactgtgaccacgctgcttaaagtctcagatctcagttacttaattgtg

SEQ ID NO: 84242 - DNA, 79 bp, Mus musculus
cttccagccaccaccaccccttccaaacagagcagagggtgtctgtctatgtctgtctgtctgtgtgtgtgcatgggag

SEQ ID NO: 84243 - DNA, 90 bp, Mus musculus
gagcattggtagcctgtagatgtctagtgtttgtctagaaatctctgagaatgtcccgcctccagcactgctctgctgctaaccgatctc

SEQ ID NO: 84244 - DNA, 72 bp, Mus musculus
taattatatatgtgtgtgtgtatgtatatatgtatatatatgtatatataactaggattacatatataatta

SEQ ID NO: 84245 - DNA, 95 bp, Mus musculus
gcagtagggatggtcattatgtaggctgagtcaggagaaatgggtagccatgttctcctcaatcaggaactgcttgtggaaatattccctgatgt

SEQ ID NO: 84246 - DNA, 91 bp, Mus musculus
ggggatggaactgaggttccagggtcagctggggattctttgcacacatgcacgcacacacacagcctcacaggaacacacactcacaccc

SEQ ID NO: 84247 - DNA, 116 bp, Mus musculus
tatctatggatatatatatgtatatacatctatgtgtgtatatatatgtgtgtatacacacacacacacacacacacacacacacacacacacatatatatatatctccatggata

SEQ ID NO: 84248 - DNA, 72 bp, Mus musculus
tctcttgctgggagggacgttcagattgggccagggctggaggtcagtctctctctctctcatctgctgaga

SEQ ID NO: 84249 - DNA, 105 bp, Mus musculus
tcaccattagtccatggtgatctgataggatgcatgggacaatttcaatatttttgtatctcttgaggcctgttttgtgatcaattatatggttaattttggaga

SEQ ID NO: 84250 - DNA, 92 bp, Mus musculus
ggctggagagatggctcagtggttaggagcactcactgctcttccagaggtcctgagttcaattcctagcaaccacatggtggctcacagcc

SEQ ID NO: 84251 - DNA, 79 bp, Mus musculus
acttctgttagtttcactgtgtctctgttcagtttctgtttccaggatctgtccattggtgacagtggggtgttgaagt

SEQ ID NO: 84252 - DNA, 112 bp, Mus musculus
ttttgattattatatggagaggctattttcttgtctagtctatttgatgttctgtatggcttcttgtatcttcttttggttaagaaaattttcttctatgattttgttgaaa

SEQ ID NO: 84253 - DNA, 114 bp, Mus musculus
ggatcagccttaatcagtgttgatctgataggatgcatgggataatttcaatatttttgtatctgttgaggcctgttttgtgaccattataaggtcagttttggagaaggtgcc

SEQ ID NO: 84254 - DNA, 71 bp, Mus musculus
gtgtgtgtgtgtgtgtgtgtgtaccatgtatatatgtgtgtacatgtgtacatgtgtttgcacatgcatac

SEQ ID NO: 84255 - DNA, 134 bp, Mus musculus
ggctgttctctgtacagtgctaaccggttaaaatctgctctggaagcggttagcgtctggctctgtgactgtcagcctgtgctgtgctagctgtcttactgcagtccgtctacagcagtgggcacttggtcaca

SEQ ID NO: 84256 - DNA, 104 bp, Mus musculus
gtgtgtccaaccccctatccactttgtatgtgtgcatgtgcatgtgtgcatggctatgtatgtgtacatgggtacaatgtatagaggccaaaagttggtatcac

SEQ ID NO: 84257 - DNA, 96 bp, Mus musculus
gcaaaactaaggcttctatatgtgtgtgttctgatgtaactttgaaagcactatatattttaatattagagcataaacagtagcaaatggttctgt

SEQ ID NO: 84258 - DNA, 92 bp, Mus musculus
gcacaggaatctgaactgggctggagagatggatggctcaatggttaagagcactgactgctctttcagaggtcctgagttcaagtcctagc

SEQ ID NO: 84259 - DNA, 111 bp, Mus musculus
tctttctttaggaagttagaatttcaaatgttttacatatatatatatatgtaacatatatgtatgttatatatatataaacataggaggtaaaaacaaatagagggcagg

SEQ ID NO: 84260 - DNA, 84 bp, Mus musculus
ggaccagggtcttgagctgaagagatggctcagcgtttaagagcactgactgctcttccagaggtcctgagttcaattcccagc

SEQ ID NO: 84261 - DNA, 112 bp, Mus musculus
gttagtttggtggatttcatttgcatgcattcttcaggaagtaggttttttagttagaatcatatatgtcctggaaggtgacactgtagaatttagtaatatactggaatgc

SEQ ID NO: 84262 - DNA, 69 bp, Mus musculus
cacacacagagagagacagagacagagagacagagcgccgggtttctctgtgtagctctctctgtcctg

SEQ ID NO: 84263 - DNA, 110 bp, Mus musculus
ttgcaagccctagttttagagcatgtccttgggatggggctcctgactgatcacagtagacagacaggagttagccagagcgtgcagttgttcctcaggttctcttgtga

SEQ ID NO: 84264 - DNA, 114 bp, Mus musculus
gaatattttcccctccagctaagatgtcaagtgcaagaatgtatatttttacttacagttgggtccaagggttttagaaaaatgcattcacatcataaagactagtaaatattt

SEQ ID NO: 84265 - DNA, 67 bp, Mus musculus
tagtgagtcaggcacactcactatatctgttgccaggtaactggggtggagcctagactaaatgcta

SEQ ID NO: 84266 - DNA, 95 bp, Mus musculus
gggctagcagaagcctgattcaagcaggctgaggagtaagctgaagagattcacacagaaatgactgagcagggctggaatggtggctcaactgc

SEQ ID NO: 84267 - DNA, 71 bp, Mus musculus
gagtaggcaccagagtcagacacacactcattcacacactcagtgtactggctggttttgtgtgtcaactt

SEQ ID NO: 84268 - DNA, 118 bp, Mus musculus
gcacgttttcccatgtccttcccttttgtttgtgtttggtagtagaggggttaccactgagactcactgacagacatgttctagggggatacataagagggcatgaggattcaggggc

SEQ ID NO: 84269 - DNA, 105 bp, Mus musculus
ctcacatacacacacattcttatacacgcactctcacacacacaaatatgttacattttttgagggggtttatgtgtgtgggcgtgcatgccatgtggaggtgag

SEQ ID NO: 84270 - DNA, 112 bp, Mus musculus
agggagagaagagggactgttgtgtcatatggctctctgagaaattgctcctaaattatttatcacactcacacacacatatataaacctatcgttctctctctctctctct

SEQ ID NO: 84271 - DNA, 72 bp, Mus musculus
cctatctatctgtctgtctgtctgtctatctatctatcatgtgtagatggacactggaggacatgttttagg

SEQ ID NO: 84272 - DNA, 76 bp, Mus musculus
ctatgattgtctgtctgtctgtctctcccaaccaccaccacaaaagggaaagtagaacagtgggatggtgcatcag

SEQ ID NO: 84273 - DNA, 80 bp, Mus musculus
gtaaaagcagggacacaaaaaagaaatcagtggctgtgtgtgtatgtgacagtacagctgtgtgtgtctgtgtgtgtgac

SEQ ID NO: 84274 - DNA, 116 bp, Mus musculus
ggttacttaagaaaactaagtgtcgggctggagagatggctcagtggttaagagcactgactgctcttccagatgtcctgagttcaattcccagtcaccacatggtggtcacaacc

SEQ ID NO: 84275 - DNA, 80 bp, Mus musculus
ctctctcagaaaacgaaaagaaagaagtctatgttactgactgactgactaactttgtttgctcgggttctctggaagag

SEQ ID NO: 84276 - DNA, 66 bp, Mus musculus
gtgtgtcagtgtgtatgtatgcgcatgtgtgtatgcatatatgtgtgtcagtgtgcatgtgcatgt

SEQ ID NO: 84277 - DNA, 70 bp, Mus musculus
tgggctcacctctatgagacactcagtgtgactggggaagactgagtgtcttcctggctctggctgctca

SEQ ID NO: 84278 - DNA, 63 bp, Mus musculus
gtatgtatatatgtatgtatgtattatgtatgtatgcatgtatgcatgtatgtatgtatgtat

SEQ ID NO: 84279 - DNA, 123 bp, Mus musculus
attaggcttgaatcttgagttcctggaagtgtagtcagtctgcataactattgagtcccctcagtggttcttgtttatagacgcactatgctttggaggatggcgagcagctcagtggttcag

SEQ ID NO: 84280 - DNA, 94 bp, Mus musculus
ccattatgacgggctggagagatggttcagtagttaagagcacagactgctcttccaaaagtcctgagttaaatacccagcatccacatggtgg

SEQ ID NO: 84281 - DNA, 83 bp, Mus musculus
cactgactgctcttccagaggtcctgagttcaattcccagcacctacatggtggctcacgaccatctgtaatggcacccagtg

SEQ ID NO: 84282 - DNA, 101 bp, Mus musculus
ttttaagatcttagatcctctgcaactgtgaagcagcctacgtctctgaaccactctctccctctgccatccagttaccaataggatccagtgttttaaga

SEQ ID NO: 84283 - DNA, 112 bp, Mus musculus
gtttgtgtttcctgtgacagtgtgtatgtgtttgggccctggaaggatcacctgagtctgtttctctccatctcactatgcctacccgtcatagcttttacagaagtgctac

SEQ ID NO: 84284 - DNA, 113 bp, Mus musculus
tgagtgttctacatctggatctgtaggcagcagtgtgtgtgtggtgggggtaggagggactgactgactgactgactgactgactgggcctggttttggcttttgaaacctca

SEQ ID NO: 84285 - DNA, 72 bp, Mus musculus
ttttctgtattcctcaggtactgcatgtatacagtgcaggcatgtatacatgcaaaatacccacatagaaaa

SEQ ID NO: 84286 - DNA, 104 bp, Mus musculus
aggctgatggcctcagtttaatccctgggatctaactggtggtgggacacagcacacagtggcactctcagactcggaatgaattgtaaagggctgcagatact

SEQ ID NO: 84287 - DNA, 57 bp, Mus musculus
ctctccatgtgtgtgcatgtgcatgcatatgtatgcctgcacttgaacccacaagag

SEQ ID NO: 84288 - DNA, 108 bp, Mus musculus
cacagagagggaagggagggatggagaacggcccacagaagagaatcagcagtctggacactgactgtcttcacgtgagggctgaggccaaactgctctcactttgtg

SEQ ID NO: 84289 - DNA, 72 bp, Mus musculus
gaggtgaattacagtacatgcactgatattattattttattttgttattttgtgtgtgtgtgtgtttgtctc

SEQ ID NO: 84290 - DNA, 67 bp, Mus musculus
acctgagattctgggtgtgtcagagttcttggcaatcaagctacctctgagacactgagaccctggt

SEQ ID NO: 84291 - DNA, 91 bp, Mus musculus
gcacacatgagtggtaggagccattatggtagggtgtgtgtgtgtgtgtgcgcgcacgcgctttctctctcactctctagaattcaagtgc

SEQ ID NO: 84292 - DNA, 87 bp, Mus musculus
gaacataaacaacagaaagcaggacctgaacaggagtgatctgggatcagactgtagatggagtcctcactgttgctttttatcttc

SEQ ID NO: 84293 - DNA, 84 bp, Mus musculus
tttactgacgctgtctctcattcacgctggatgcgcatgctccgtatcagcatcagagagtgtgttgtgaattttgagttcagc

SEQ ID NO: 84294 - DNA, 75 bp, Mus musculus
gcttagatctgtcccatgcatgctttctggaggttcagttgtgtatctccatctgcatgtgggactccgaatggc

SEQ ID NO: 84295 - DNA, 124 bp, Mus musculus
tctctctctctctctctctctctttctctctctctcacacacacacactttctgtctcacacacataaataaataggtaggtaggtagatagatagatagatagatagatagatagatagatgg

SEQ ID NO: 84296 - DNA, 88 bp, Mus musculus
ggttcaagacaagatttttataggagtatgattatttattaatcacttttgaataacacatactggtattttccttgctctttgagcc

SEQ ID NO: 84297 - DNA, 99 bp, Mus musculus
tgaactgtcaggggctggagagatggctcagcggttaagagcactgactgctcttccagatgtcctgagttcaattcccagcaaccacatggtggctca

SEQ ID NO: 84298 - DNA, 72 bp, Mus musculus
tatgcatgtatgtatgtatgtatacatgtatgtgtgtgtatgtgtgtgtatgtatgtatgtatgtatgtatg

SEQ ID NO: 84299 - DNA, 76 bp, Mus musculus
gttgatacaccacacaagagagtctggaaagaggaaggcaagtccagtcttacttgtatccatgtggcaggtcacc

SEQ ID NO: 84300 - DNA, 117 bp, Mus musculus
acacacatgcctctaacttttatagcagggatctctttatgaaattcagatttatttatttataaacatgttttctgaaagatgtcttagaaaccaagttggctttcttctctgtgt

SEQ ID NO: 84301 - DNA, 74 bp, Mus musculus
tggtggctgtggagagtgtacagaaagtatagagtctggaccttgggtctgtccctctgtcactaccccaacca

SEQ ID NO: 84302 - DNA, 69 bp, Mus musculus
gagtgagtgggacacctgtgggagcgactgttggtggcccccaagtctctgtgtctgactgtgacattt

SEQ ID NO: 84303 - DNA, 68 bp, Mus musculus
gtctctgtctgtctgtctgtctcaggtcgaaagggcccattggagacatctttaagattaacaggaac

SEQ ID NO: 84304 - DNA, 85 bp, Mus musculus
ggatctctcctcatgtgtgtgtctatgtgtctgtgtggcatttgtgaacatatagaagcccaaggacaactcgaggtatcagtcc

SEQ ID NO: 84305 - DNA, 126 bp, Mus musculus
catatgtgtgtgtgtgtatatgtatgtatgtatgtatgtatatgtgtgtatatttgtgtatacatgtatgtgactatgcacatatgtctgtgtgtgtgtgtttgtgtatgtgcacgtgcatgtgtg

SEQ ID NO: 84306 - DNA, 85 bp, Mus musculus; identical to SEQ ID NO: 57470

SEQ ID NO: 84307 - DNA, 75 bp, Mus musculus
actggtcacacaagagacagagtgcaaggtaaaagggtttgccattgagcactgtgcttcgtgggcttgtgagac

SEQ ID NO: 84308 - DNA, 98 bp, Mus musculus
gctttgcttcatgtcagagaatacttcccaagcagcagctccacagctgaaaatgcgtgcagtgtctctctgtctttaaacttggagcagacactggc

SEQ ID NO: 84309 - DNA, 77 bp, Mus musculus
caaagggggataatgaagagaacttttgtagtgaggctcctggtgtgaccttttgcataacttttcatccacctttg

SEQ ID NO: 84310 - DNA, 103 bp, Mus musculus
tagaatgatggcagtaaacatctattaattcctcttgttgtttcatgagacacactctctgatcctcatgggattttgtagtatgcagatgttagaacctcta

SEQ ID NO: 84311 - DNA, 76 bp, Mus musculus
tgggtgtgaggaaagagtgtgagctgagtgcagatgtccaagtggtgggcacttgagtgtctctttccaggactta

SEQ ID NO: 84312 - DNA, 65 bp, Mus musculus
tatatgtatatgtatatgtataatgtatatgtataatgtataatgtatatgtatatgtatatgta

SEQ ID NO: 84313 - DNA, 117 bp, Mus musculus
cacctggttggagaagctgatcctttgagttggggaaggaaaacaatgggagacaagtgattttgatccaaactgaaatttgaacaatgatgggtcatgccctttgaagagacagtg

SEQ ID NO: 84314 - DNA, 83 bp, Mus musculus
ggtaacgaggcttcagggctggcgagatagctcagcagataagggtagtgagtgctcttccagaggtcctgagttcagttctc

SEQ ID NO: 84315 - DNA, 102 bp, Mus musculus
ttgtgtgtgtacacatgggtaggtatttgtgcatgttcatgtgcacatttgtgcatttgtgtgtgtgagtgttcaagagtatgttcatgtgtgtgcatgtgg

SEQ ID NO: 84316 - DNA, 82 bp, Mus musculus
cactcaggagtatgtagcgagaagtacaattgacctagttcacgtctgggctcaaatctgactggctgtgtgactctgagtg

SEQ ID NO: 84317 - DNA, 115 bp, Mus musculus
tagaaggatctgatggtgttttggatttcttcagaatctgttgttatgtctcccttttcatttctgattttgttgattaggatgctgtccctgcgccctctagtgagtctggcta

SEQ ID NO: 84318 - DNA, 64 bp, Mus musculus
tatatatgtatgtgggtacatgtgtatatatgtgtatgtatgtgtgtatatatgtatatgtatg

SEQ ID NO: 84319 - DNA, 58 bp, Mus musculus
tgtatgtatatatatgtgtgtgtatatatatatatatacacacacacgtacacataca

SEQ ID NO: 84320 - DNA, 96 bp, Mus musculus
gatcagccttagtccatggtgatctgatagggtgcatgggattatttcaatatatttgtatatgttgaggcctgtttggtgaccgacttcatgatc

SEQ ID NO: 84321 - DNA, 78 bp, Mus musculus
tacctgtctgtccctgtgtcatactatgcaatttttatcacaattgctctgtagtacagcttgagagcagacatggtg

SEQ ID NO: 84322 - DNA, 85 bp, Mus musculus; identical to SEQ ID NO: 57439

SEQ ID NO: 84323 - DNA, 87 bp, Mus musculus
tcctttgcctgttagagcacctggaagtggtacctcctttggggacattggggctgtctactgtgttcaaaaccaaggtagaccgga

SEQ ID NO: 84324 - DNA, 106 bp, Mus musculus
ctcaactgtagatgtagcaaaatgattaatatatgtgttaatacatataattgtatgtatatgtatgtgtataatcatatgctacttttgtttttacttgtttcag

SEQ ID NO: 84325 - DNA, 87 bp, Mus musculus
gcttctggttcttggtcactgtaatgtgtgagtacagcccattgccctgtcttcatccctgttcctgtgcaccgatacctggacggc

SEQ ID NO: 84326 - DNA, 106 bp, Mus musculus
tgttttacatacactttgctaatttgtggaagttctgaagtgactcaaacacagtgacagagatgagtcggttgttaggactacaccagagaatgtaattgagaca

SEQ ID NO: 84327 - DNA, 71 bp, Mus musculus
ctggtcttactgtgtctgactgtgtcttgtccttcctgcaagcctgtgtttcagtacccttaggagaccag

SEQ ID NO: 84328 - DNA, 57 bp, Mus musculus
gacagcaagagcagcaaagcctgtgtgagaaaacacacagcgcaaacgctttctgtc

SEQ ID NO: 84329 - DNA, 78 bp, Mus musculus
ggagccccagcacagcagggtgtagccagataaaaaggagcaggccatgatgagtctcagtgtgtgtgatgggagccc

SEQ ID NO: 84330 - DNA, 116 bp, Mus musculus
cttcttgatatttattgtgtctggtatgattggtaatattattgaacctatatgtatcaatatttatcatcgtgcttgatgtcatataacaataattttactttatcttcgagggg

SEQ ID NO: 84331 - DNA, 72 bp, Mus musculus
gtcctgccagaatttatattttttattcgtgggatggatgtccctaaatcatgctgattctggttcacggac

SEQ ID NO: 84332 - DNA, 71 bp, Mus musculus
tctgtctgtctgtctatctatctatctacctagatatctatttatagatagatataaatagataggttaga

SEQ ID NO: 84333 - DNA, 113 bp, Mus musculus
gatgagtgcaggcctccagcactgcaggtagagatgtggaacagaagatagagtgcagaggggacagggtattcctgtggctgctatgtttgctgggagaccttgtactttcc

SEQ ID NO: 84334 - DNA, 103 bp, Mus musculus
cttagtccatggtgatctggtaggatgcatgggataatttcaatatttttgtaactgttgaggcctgttttgtgattgattatatggtcagttttggaggaag

SEQ ID NO: 84335 - DNA, 59 bp, Mus musculus
ctggttcatcagtggaggaggaaggtcacctgggtgctttctctgtctctctgagctag

SEQ ID NO: 84336 - DNA, 68 bp, Mus musculus
aggtggaagttttagcttttcatttgtaagaggaaactctcacaggctgacagcttcactcaatacct

SEQ ID NO: 84337 - DNA, 73 bp, Mus musculus
ataggggggagagagattggagccgtactattgaaagggcaagcccttcactgcctccctgtttcccacctat

SEQ ID NO: 84338 - DNA, 83 bp, Mus musculus
aaggtatataggtctgtctgtccatatgcatgcatgcatgtacgtatgtatgtatgtatgtactatacatacgtatgtatttt

SEQ ID NO: 84339 - DNA, 111 bp, Mus musculus
gggatatatctctatagatggtccagaagttcccaatcctgttatacaaagcctgtgcctcacagtctctgtgtgatttatcccctaaacacacatccaaaatatactccc

SEQ ID NO: 84340 - DNA, 85 bp, Mus musculus; identical to SEQ ID NO: 57439

SEQ ID NO: 84341 - DNA, 85 bp, Mus musculus; identical to SEQ ID NO: 57439

SEQ ID NO: 84342 - DNA, 115 bp, Mus musculus
gagtacttttgcattgatattcgtaaggggaattggtctgaatttcttctttttgagtggtttagatatcagagtaattggttggtatggtttagatatcagagtaattgtgttc

SEQ ID NO: 84343 - DNA, 69 bp, Mus musculus
tctgtttgctgctgagagtagtctgtcagatgacagttatcttaggccactgtttgcaagtatagcaga

SEQ ID NO: 84344 - DNA, 101 bp, Mus musculus
ttccctgcaaagaatttatcttcatcagtgtcactgagtctaagaatgatgtttcaaatgctaattttaggcctgtgccctaatgttgaaggttcagggaa

SEQ ID NO: 84345 - DNA, 119 bp, Mus musculus
tctccatctatggtaattgagagtttggctgggtatagtagcctgggctggaatttgtgttctctcagtgtctgtataacatctgtccaggctcttctggctttcatagtctctggtga

SEQ ID NO: 84346 - DNA, 116 bp, Mus musculus
gttctttgtatgtattggatatttgccctctatcagatataggattggtaaagatatttttttaatcatttggctgtcttttgtcttactgacagtatcctttgccttacagaagc

SEQ ID NO: 84347 - DNA, 95 bp, Mus musculus
gattgtcatagtattagatttgggcatggcaatttgattttcattttatctcacaactggaaatcagtggtcttttgcttttaatgctaacaatt

SEQ ID NO: 84348 - DNA, 69 bp, Mus musculus
ggatacagggaaacaaacacagaaaggctctcttgggtgtggatgcctctctgtcattctctgtatgcc

SEQ ID NO: 84349 - DNA, 125 bp, Mus musculus
cgtgcgtctgtatgtgtgaatatgtgctcctgcatgtatgagtatgtgcttctgcatgagtatgtgcatgtgtgtgtatgttatgcatgtttatatgcatgtttgcctgtatatgtattaatgta

SEQ ID NO: 84350 - DNA, 69 bp, Mus musculus
tgagagtaaacagagagcagttgtatgggatcatagtgttctgagagaatgttttcatgtcaactctca

SEQ ID NO: 84351 - DNA, 62 bp, Mus musculus
tatgtatatgtgtatgtatatgcatatacctatgtatgtgtgtatatatacatatatatata

SEQ ID NO: 84352 - DNA, 98 bp, Mus musculus
aaggctcttgacctatacctatgggtatagcattaaaagtattcaacaaagagaacatactttgctgtcagcctattctttaacagctcaaaagtctt

SEQ ID NO: 84353 - DNA, 118 bp, Mus musculus
ggaaggtgaactgcccccagggtaaggaaatcaagagagctggcactgtccctcactgtctacaacacttgggaaagcagtccccatccccacatctgggcagcaggatagagctagc

SEQ ID NO: 84354 - DNA, 74 bp, Mus musculus
gggatagtgaccttggtttttttagagataggatatccaacccagcaccctgtctctctaagtgactctgtccc

SEQ ID NO: 84355 - DNA, 119 bp, Mus musculus
ggatttcagtgtctcagaggaagcttgactaccaagaactctgacacactcagaatctcagcatcacagggtcccagaaccaaaggatcacaaggaaagctggactctgagaagttctg

SEQ ID NO: 84356 - DNA, 71 bp, Mus musculus
tatggatccctgggtggggcagtctctggatggtccttccttccatctcagtccctaactctgtctctgta

SEQ ID NO: 84357 - DNA, 111 bp, Mus musculus
gaaattaatttatttgctatttatgtatatgtgtatctatatatgtatatatatagatacatacatgtatatagacacacacacatgaatgttttgtatgtatgtatgtat

SEQ ID NO: 84358 - DNA, 99 bp, Mus musculus
ggatggctatgagttggtttaatctcagctggcaactgtgagatgtccctatcattcctcacagtggtctctgggattatgctaaacagagcaatttcc

SEQ ID NO: 84359 - DNA, 90 bp, Mus musculus
gtttttgatgttgcagatactgcatcaggaactgactggataagacttaatccccatcagttcctaatgcattgccttcagcatctaaac

SEQ ID NO: 84360 - DNA, 117 bp, Mus musculus
gatattcataagggaaattggtctaaagttctctttctttgttaggtcgtggtgtggtttagatatcagagtaattgtggcttcatagaatgaattgggtagaataccttctgattc

SEQ ID NO: 84361 - DNA, 79 bp, Mus musculus
tgttgggacttcatctaattgcatgatggataggctgggaagtttttattttcttaaatgatggataaaagttccaaca

SEQ ID NO: 84362 - DNA, 86 bp, Mus musculus
gatcttgtatatccctatatgtaaaaatagtatgtatgtatgcatgtatgtatatacatatttacattgtttgtatgtacctgatt

SEQ ID NO: 84363 - DNA, 85 bp, Mus musculus; identical to SEQ ID NO: 57470

SEQ ID NO: 84364 - DNA, 98 bp, Mus musculus
atgcatagatacaccagacacacacacattttctctgtgttacacacaaacacatgtatgtatgtatgtatgtatatgcatgtgtttccaaattgcag

SEQ ID NO: 84365 - DNA, 100 bp, Mus musculus
tctgtgtgaaagagagaaagtgtgtgagtgtgtgggtgtctgtgtttgtgtctgtttctgttttgggttccttcagtctcgttgtctttcttttctcagg

SEQ ID NO: 84366 - DNA, 179 bp, Mus musculus
ggacactcacacatacataggtgtatatgtgtgtatgtatatatatatatatatatatatatatatatatatatatatatatatatatgtgtgtgtgtgtgtgtgtgtgtgtgtgtgtatgtctatatatgtatatgtgtatatgttatatgtatacatgtttgtaagtatatatgtat

SEQ ID NO: 84367 - DNA, 86 bp, Mus musculus
tggttggagtattgctaaatgctgctaataatctcaggatttaattctctttgtattcttgtagtaagtagtaatgttctccatca

SEQ ID NO: 84368 - DNA, 121 bp, Mus musculus
gagaattacttgaagcaatgtttggctgtaggttgatagctcctgactgtagtctgagtgctgtggtgttctgggtcagtagcataacttattcccttgtgaactgtaaaaggtttctgta

SEQ ID NO: 84369 - DNA, 88 bp, Mus musculus
agaccttgctgccactgtgaatgagaccacctggggtggagccttctgacctagatggttctattgttttgccacctgcagctgctct

SEQ ID NO: 84370 - DNA, 111 bp, Mus musculus
tacaagcagtatggtttcctggatgggatcctaaataaaaaggagcatttgaaatctgaatcaagtgtgaatttgtgttaatgatgtatcagcattggaccattaattgta

SEQ ID NO: 84371 - DNA, 73 bp, Mus musculus
ctggtcctgcagatccaaagctgcaatgactcactgaaatgagcatttgcaagtaaagatgtaaggacaaaag

SEQ ID NO: 84372 - DNA, 66 bp, Mus musculus
ggtgctcagccactctgtcagtatctatgacattcctacttgctgtcaaatgtggtactgaatgcc

SEQ ID NO: 84373 - DNA, 80 bp, Mus musculus
ctcttgaaaagtggctgcctcacagggtgctaatttcattatatattgatgagttcactggagcagagttgaagagagag

SEQ ID NO: 84374 - DNA, 106 bp, Mus musculus
ttcataagggaaatttgtctgaagttctctttctttgttgtgtcttcatgtggtttagatatcagagtaattgtggcttcatagagcgaattgggtacttattgaa

SEQ ID NO: 84375 - DNA, 85 bp, Mus musculus; identical to SEQ ID NO: 57470

SEQ ID NO: 84376 - DNA, 105 bp, Mus musculus
gccttagtccatagtgatctgataggatgcatgggacaatttcaatatttttgtatctgttgaggcctgttttgtgaccagttatatttcaatattggaaaaggt

SEQ ID NO: 84377 - DNA, 106 bp, Mus musculus
gccttagtgcatggtgatctgataggatgcatgggacaatttcaatatttttgtatatgttgagacctgttttgtgacctattatgtggtcaattttggagaaggt

SEQ ID NO: 84378 - DNA, 85 bp, Mus musculus; identical to SEQ ID NO: 57470

SEQ ID NO: 84379 - DNA, 111 bp, Mus musculus
gtggattatactgaactttctggctaatgtccatgtataagtgagtgcataccatatgtgtcattctcactctggattacctcactcaggatattttcaagttccatccat

SEQ ID NO: 84380 - DNA, 77 bp, Mus musculus
tgagaaatagcatcaggaactgaggtagaaaccgtggagaaacgctacttcctggtttgctcttcctggcttcctca

SEQ ID NO: 84381 - DNA, 95 bp, Mus musculus
gccagccggcccttcacatctggagactctgcatgtgcttgtggaagggcactggcttgctcatgcagtgtgtcaatagtgggcctgtagttggt

SEQ ID NO: 84382 - DNA, 86 bp, Mus musculus
gggagccatcccagtgtccccaggacctcagcagcagctctccagttaactctcagggtctctggctctctgaaggtgggaatctc

SEQ ID NO: 84383 - DNA, 80 bp, Mus musculus
cctaaaacctctgcattcctttattgagggggaaaaagcctcagacgctgcctctgtcagttacgggcagaggtggtagg

SEQ ID NO: 84384 - DNA, 92 bp, Mus musculus
cctgggatgacttgtcagcaattattacaggtcctcttcatgacagaagagagagagaggatcataggagctgcccagaaattggttccagg

SEQ ID NO: 84385 - DNA, 95 bp, Mus musculus
gcttctatctctgtcaatacaaatctgattttgaagatgataacaaattattgaattttgagaataaaatggattgctttgatggagaagtaggt

SEQ ID NO: 84386 - DNA, 96 bp, Mus musculus
gatcagccttagtccatggtgatttgataggatgcatcggataatttcaatatatttgtatctgttgaggcctgttttgtgaccaattatatggtc

SEQ ID NO: 84387 - DNA, 69 bp, Mus musculus
tcttcactccctgtactggctggttttgtgtgtcaacttgacacaagatagtgtcatcagagaggaagg

SEQ ID NO: 84388 - DNA, 86 bp, Mus musculus
gtctgcctgcctgcctgcctgcctgcctatctgtctgagacagggtctcagacagtcatggttggactggcttcaactatgtagac

SEQ ID NO: 84389 - DNA, 116 bp, Mus musculus
atgcatttgggaggacttgggttttctgatagttccttgttattctagctgcaggcttgaaagggcagaggtaggcaggacaaaggattttcagtactgaacttccaataatgtgt

SEQ ID NO: 84390 - DNA, 94 bp, Mus musculus
tggaatagagtgggagtttggagttaggtacagactctgcctaagctgtctctgtctctcaggccacccttcatagctcccctctgccactcca

SEQ ID NO: 84391 - DNA, 76 bp, Mus musculus
ggctgttctcaataaactaagacttgacttaccttgaatgtactaacccactggggtttgtctcagtctgacagtc

SEQ ID NO: 84392 - DNA, 56 bp, Mus musculus
atatatatatatatatatatatatattcatatatgtgtgtatgtaggtgtatgtat

SEQ ID NO: 84393 - DNA, 110 bp, Mus musculus
ggctcggcagttcagagcacaggctgttctcgatgaggatccaggtttgattcccagcatctacatgattctgcatggaacaactgcagttccgggacaaccttctggcc

SEQ ID NO: 84394 - DNA, 81 bp, Mus musculus
ttttttggtctggccctctacatctttgattttcccaccctgaggaagaataactgtatgtaggtggtatagatattggag

SEQ ID NO: 84395 - DNA, 156 bp, Mus musculus
tcttctgtatggggaggtcagtgtatgtatgtatgtatgtatgtatgtatgtatgtatgtatgtatgtatgtatgtatgtatggatgtgtgtgtgaaaagattctctctctcttacagacacagacacacattattttttgaggactcatccatat

SEQ ID NO: 84396 - DNA, 60 bp, Mus musculus
atgtatgtatgtgtgtatgtgtgtatatatatgtatattcacatatacatatatatatgt

SEQ ID NO: 84397 - DNA, 85 bp, Mus musculus; identical to SEQ ID NO: 57470

SEQ ID NO: 84398 - DNA, 85 bp, Mus musculus; identical to SEQ ID NO: 57470

SEQ ID NO: 84399 - DNA, 108 bp, Mus musculus
ttccatgttcaatcatgaaagcaattttatgaagctttttatagttttacagaacaaagaaagctgtaaatcaatgcaactttaagattctttggtgggacatcagag

SEQ ID NO: 84400 - DNA, 106 bp, Mus musculus
gacgagaggagtttgagtctgagattagctggagctacatggtcatttcaaggcctgcctgcctgcctgcctgcatagtaaaacccatctcaaaaaaacttttgtt

SEQ ID NO: 84401 - DNA, 123 bp, Mus musculus
aggttttctattatttatgttgttattgaagatcagccttagtccatggtacatggggttatttcaatatttttgtatctactgaggtctgtttggtgaccgcttatatggtcaattttggag

SEQ ID NO: 84402 - DNA, 56 bp, Mus musculus
gtgttttgcatgtatgtatgtatgtatgcatatacatatgaatacatgcacatcat

SEQ ID NO: 84403 - DNA, 78 bp, Mus musculus
acaggtttagtctgagtctgactctgtcttctgggcaacaatgaccaggttacttagcctttctagactttagcctgt

SEQ ID NO: 84404 - DNA, 66 bp, Mus musculus
gagctgacactagatagacagcaggagctttgaggatgcttgactgtcactccagtggacacagcc

SEQ ID NO: 84405 - DNA, 80 bp, Mus musculus
aggcctggagtaaagcagcagtggaagaggggagcaaggatgagtcactgtctctctaactgggatgctaatatgtgcct

SEQ ID NO: 84406 - DNA, 76 bp, Mus musculus
agctgagccacagtgtgtcagtgtctgttgccctctagaaacccaattttcagacagataaccaacatgctcagct

SEQ ID NO: 84407 - DNA, 86 bp, Mus musculus
ctgggtgtggtctgtatggcgtggtgtttgggggtggccaggtaggtcttggcatgtctctgtctctgtctcagttcaaatcccag

SEQ ID NO: 84408 - DNA, 86 bp, Mus musculus
agtctcaaggttttctgcgtggagacgtctaatgtagcaggtcttcttttcactggctgtctcactccctggagcaccttgagcct

SEQ ID NO: 84409 - DNA, 114 bp, Mus musculus
ctgtctcataggttaatatttgtttacattcttttacttgctttgaattgttttatttatcataatgagcatggttttgaatttggtgattatattaaaattcctctgggagag

SEQ ID NO: 84410 - DNA, 117 bp, Mus musculus
cttttgaagatcagccttagtccatggtgatctgatagggtgcatgggataatttcaatatttttgtatctgctgaggcctgtttggtgactgattatatggtcagttttgaagaag

SEQ ID NO: 84411 - DNA, 80 bp, Mus musculus
ctgcctggcccagatgctctggctctgtgggcctcagacattttggagggtatcacagagcagggtgggcctatagtcag

SEQ ID NO: 84412 - DNA, 74 bp, Mus musculus
gtgttgtctgtctgtctgtgtatgttttgcacacacatgtgttgggagatcatttggaaaggacaagagaaggc

SEQ ID NO: 84413 - DNA, 131 bp, Mus musculus
tcagggggctggaggatggctctgtggttaagagaacagcaaccacacgggggctcacctctgtctgtgactccaattccagaggatccaatggcttcatctgacctctatgagcactctgtgtatatggt

SEQ ID NO: 84414 - DNA, 76 bp, Mus musculus
cagcagttgagagcactggctgctcttgtagaggaccttggttcccagcactcacacagccactcacaaccacctg

SEQ ID NO: 84415 - DNA, 82 bp, Mus musculus
gtggaaacttgagttctttggaggggtggctcagtggttaagagcactgactgctcttccagaggtcctgagttcagttccc

SEQ ID NO: 84416 - DNA, 66 bp, Mus musculus
cagtgactgagagctgtgagagatgtctgtgtgaagatcatccctggcagtctttattgtcatctg

SEQ ID NO: 84417 - DNA, 96 bp, Mus musculus
gctagaaatgccagccctaaatgacaagccaggcctggagtgagaatccagtggaaggccctggtcactgtctgttagtctgtccagttcctaagc

SEQ ID NO: 84418 - DNA, 79 bp, Mus musculus
agtatggataactcagctgggtgtctgcttctgggggatcgccttttttcagatccagaatctgtctgtctgtctatct

SEQ ID NO: 84419 - DNA, 92 bp, Mus musculus
aggctctgccaaacctgcactttctggcttgctttttttttttttctgttatagttgttggagggacattaaggaggtttcagacagagtct

SEQ ID NO: 84420 - DNA, 82 bp, Mus musculus
ctgggacagaggctgagctggggttaggaatccatgtcaggacgctcctggtctcatccctgtctcacttactctgtctcag

SEQ ID NO: 84421 - DNA, 113 bp, Mus musculus
gctagattagaacagattgctaggggctggagagatggttcggcggcggttaagagcactgactgctcttccagaggtcctgagttcaaatcccagcaaccacatggtggctc

SEQ ID NO: 84422 - DNA, 78 bp, Mus musculus
gtgtgtgtacatgtgcttatgtatgtgaatatatgcatgtgtgtgcatgtgtgtgtgtgtgagtctgtgtgtgtgcat

SEQ ID NO: 84423 - DNA, 86 bp, Mus musculus
gtccaggatgtcttgctctcactgacactgtcttctggtgaacaagagtgcaggaaagtaggggggaaaggcagccatagttgggc

SEQ ID NO: 84424 - DNA, 85 bp, Mus musculus
cacacagtgtgagtgaagtgagtcacaaaagttaacctttttgagatgggtcttgctttgtggttcatctggtcttgaacttgtg

SEQ ID NO: 84425 - DNA, 81 bp, Mus musculus
gtggaggtactggcacaggcttggaaataacatggaagagggctattgatgcttgtgggtctgtctctgtcagtgctgcac

SEQ ID NO: 84426 - DNA, 65 bp, Mus musculus
tgtatgtatgtttatatgtatgcaatgtgtgtgaatgtatgtgtatacatgtctgtgtatatata

SEQ ID NO: 84427 - DNA, 119 bp, Mus musculus
tatcacagacttgtcggcaataaggttttgtcattgatatccttgaatgtttctctatttttttctaaagcttatcaataatatctcttgagtgggcctgtcaattaagctctgtcata

SEQ ID NO: 84428 - DNA, 72 bp, Mus musculus
tctgtctgtctgtctgtctgtctgtttcatttattcattgactcgggatcaggctggtctcagactcataga

SEQ ID NO: 84429 - DNA, 96 bp, Mus musculus
ttggatttatagattactgggccgggcgctggagagatggctcagcgggtaagaacactgactgctcttccagaggtcctgagttcaaattccagc

SEQ ID NO: 84430 - DNA, 88 bp, Mus musculus
cactgcctccacttctgctttctcaaaatgtacacagccaaacacataggacagtagactgaaagcagaggttatgacggggtcagtg

SEQ ID NO: 84431 - DNA, 68 bp, Mus musculus
cctgtgtgtatgtctgtgtgtgtgcctggtgcccttggaagccagaccagggccgcagaagccccagg

SEQ ID NO: 84432 - DNA, 118 bp, Mus musculus
tccctggttcccctctgtctccattctcctctgagcctctccaggagccaactgattttgttaatgactctggaacttcttcctgggctggcctgggagaacttaggagacccaggga

SEQ ID NO: 84433 - DNA, 83 bp, Mus musculus
atgtagggctggagagatgactcagtggttaagagcactgactgctcttccagaggtcctgagttcaattccagcacctacat

SEQ ID NO: 84434 - DNA, 65 bp, Mus musculus
gtgtgcatgtgtatgtgtatgtgcatgtgcaggcatgtgtgtgggcacatgtatatgtgtgtgca

SEQ ID NO: 84435 - DNA, 104 bp, Mus musculus
cggctgagccggtctttgtgagtcccattggtcttctctggctttggcaacatggtcctcagtgaagaaggaaagcagactgaggaagaatcctcgctcagtgg

SEQ ID NO: 84436 - DNA, 119 bp, Mus musculus
gaggctcctacattctcctgctacctggctgactggatctttgagttttcctctgtctctgggtgactcaggggtcaaagagtttgtaaggtgacaataaaagccaggatgggtgcccc

SEQ ID NO: 84437 - DNA, 95 bp, Mus musculus
tgagtctctaaggtcaactgctggcactctctcttgggaagacaagcactccgtctctctttgagtgtgctaaaagagcaggcagtagaggctca

SEQ ID NO: 84438 - DNA, 84 bp, Mus musculus
ggtagacagacagacagacagacacaggcagacaaaagtagatatacagtcaatccttttctatctgtaagtactgcatctgct

SEQ ID NO: 84439 - DNA, 63 bp, Mus musculus
acttacagatagaaaaggattgactgtatatctacttttgtctgcctgtgtctgtctgtctgt

SEQ ID NO: 84440 - DNA, 79 bp, Mus musculus
ctcattcattctctcactcgctcactcgcttgtgaatgccttagaagctttgctgagctctcagtgggggttaaaagag

SEQ ID NO: 84441 - DNA, 80 bp, Mus musculus
aggccagagatcagagtcaggtcttcctctatcactccgcaccttactttttgagacagtcctttccttgaacctggtct

SEQ ID NO: 84442 - DNA, 101 bp, Mus musculus
agaaaccatgtcatggagctggagagatggctcagtggttaagagcactgactgctcttccagaggtccagagttcaattcccagcaaccacatggtggct

SEQ ID NO: 84443 - DNA, 76 bp, Mus musculus
ggaaaatgcttagaaaatgaaagagggtgagcctgccgttgggggagcactgtctcagtctgtgtgagctggatcc

SEQ ID NO: 84444 - DNA, 80 bp, Mus musculus
gatgctttttgttctattattgagtgtaattttatttcattatgtcatagaatatactcaatgattggtcagtcggtctc

SEQ ID NO: 84445 - DNA, 65 bp, Mus musculus
ggggaccgagttgggatagggactcctcagcaactgagggcctctctcttgctctcagtgtcctt

SEQ ID NO: 84446 - DNA, 79 bp, Mus musculus
tcgagtgtaggaaagaatcagcctttgactgattatttctttttgacatgatttatcacctggtattctttaaacttga

SEQ ID NO: 84447 - DNA, 57 bp, Mus musculus
tatacatatatatgtgtgtgtatttatatattatgtacatgtatatatgtatgtata

SEQ ID NO: 84448 - DNA, 59 bp, Mus musculus
tgaaatacacattcagattccacaggacctctcctgtgtgcgtctgtctgtcaaattca

SEQ ID NO: 84449 - DNA, 82 bp, Mus musculus
agaaagaaaacttgctgtggctctgttcacctgcaaccccagtgctgtccaggtagggagagtggggccactggggcttgct

SEQ ID NO: 84450 - DNA, 68 bp, Mus musculus
tcctagagtgaccatgcagagtgggtaaaggtcactgtgtcactgtgtcactgtgtcactgcgcaggg

SEQ ID NO: 84451 - DNA, 88 bp, Mus musculus
gtgcatttgtgtatatatgcatgtatgtatgtgtatgtatgtatgcatatatgtgtgtaggtatatatgtatatatgtatgtatatac

SEQ ID NO: 84452 - DNA, 61 bp, Mus musculus
tgtgtgtgtgtgcatgtgcaagtgtaagtaaacacacacacaaacacagcacacacacaca

SEQ ID NO: 84453 - DNA, 66 bp, Mus musculus
aagcccagcctccacttctgtggatcagctgacttccattgagagaacagagtgagggcagagctt

SEQ ID NO: 84454 - DNA, 120 bp, Mus musculus
ccctgaccactacattcaccagcatttttgcaattatttcccctttttacttggtccatttcaaaacacagggtacctcagggaggggttgtgagggggaggggctgtgacagggagggg

SEQ ID NO: 84455 - DNA, 76 bp, Mus musculus
cctgcctgtctgggtctctgcctgcctctgcacttctgtgagcagtagtccctggcggtggcctcactcttcaggc

SEQ ID NO: 84456 - DNA, 79 bp, Mus musculus
gcgctgctctgtctgcctgtgaccgtgctgggctcgaagttggcataagcgcttccgcaggactacacagaggaaatgc

SEQ ID NO: 84457 - DNA, 75 bp, Mus musculus
gcctctgtgtgtgtgtgtgagcatgtgtacacacacacacacacacacacacacacacacacacacacacacggc

SEQ ID NO: 84458 - DNA, 62 bp, Mus musculus
tgcagatcagcagcatggagcatgtttcagggactgggcctggcactgcatctgcatctgca

SEQ ID NO: 84459 - DNA, 103 bp, Mus musculus
tctattccttcctcagcttctaactcactgctcaggactctccgatctcagaggagtgacagggcagatgaacttgagcagctgagcgactcaagagaacaga

SEQ ID NO: 84460 - DNA, 116 bp, Mus musculus
tagactaagagtgctgaaggatgagggttatcacgctcactctgtgtctttgtgacaggtacctagagacacacgccaacttggtttcccttttctgctccagttttctaagtctg

SEQ ID NO: 84461 - DNA, 86 bp, Mus musculus
ctcagagactcagtgcctcagggatgtgatgtcagcctcagtgtctgtctttcactctgtcactatgtctctgtagcaagttgctg

SEQ ID NO: 84462 - DNA, 76 bp, Mus musculus
cacatccctgaggcactgagtctctgagagattaattctcctgagaatctagggttgtgccttcctcagccagggg

SEQ ID NO: 84463 - DNA, 68 bp, Mus musculus
tgctgaagcagtagaacacagactaaatcatggtgggtgagtgtgtcagtgtttctctctgtatagca

SEQ ID NO: 84464 - DNA, 86 bp, Mus musculus
catgtgtctgtgtgtctgtctgtcctttcttcattcccttgccaaaccttggccagagttctgggacccaagccacacaggacatg

SEQ ID NO: 84465 - DNA, 113 bp, Mus musculus
atcagcatttacctgacagaagtacaattgtgagcagtaggttgcattttttttttaaaaaagccatatcaatttcaaatttacactgtgattcaggaagggaatgtattgat

SEQ ID NO: 84466 - DNA, 93 bp, Mus musculus
tgtgatgttggagcgcagattgtcagtggccacttgtgtgtctgtgttcttgcaaacaaacccatgacccagagtcacagaaggtcactgcca

SEQ ID NO: 84467 - DNA, 87 bp, Mus musculus
acactctcacacaggcataaatacaggcaaaacactaatgcacataaaataatttgtgtgtgtgtgtgtgtgtgtgtgtgtgtgtgt

SEQ ID NO: 84468 - DNA, 115 bp, Mus musculus
gtgagcatggggcagtgcctctggggacctcactgcatacctattctgcagaaaggcagactgacagactgagagaatgagcgtgcagttgtgatctctttggatcctcagccgc

SEQ ID NO: 84469 - DNA, 70 bp, Mus musculus
ctctgaatttttctatttgtttgagcaggcagctcccccagtgtgtggtcacagaaagaataaatcagag

SEQ ID NO: 84470 - DNA, 82 bp, Mus musculus
gagcagcccagggaagtagaagatcctggcattgcagcactctgtgggacaaatcttcatctgcctgtctgtctgtctgttc

SEQ ID NO: 84471 - DNA, 83 bp, Mus musculus
gactgttgattgcaatttactctgtcatctcacagtctgactggctgggaggaagtagtacagctttgaaaagatcagcaatc

SEQ ID NO: 84472 - DNA, 91 bp, Mus musculus
agccgtgtatcccggggtcagccttccacagttacagtaccatgttcaaccatgctgtgtgaacactgagagggacactaagggaacagct

SEQ ID NO: 84473 - DNA, 107 bp, Mus musculus
gctgggggtaggaaagagatggcccgaggggaaagctgggatggaggttgtcagatgaatctgatgcctgcctggaacctccagatccatttttgtttgtttgtagt

SEQ ID NO: 84474 - DNA, 68 bp, Mus musculus
gggggaaggatggagaccagaaattcagttttcttcagttcacttctctgtgtctctgtctctctcct

SEQ ID NO: 84475 - DNA, 116 bp, Mus musculus
tactctgtgactccttccctctttcttaccatggcccagagaagaagacagaagtttgattgctgtctttggcatcagtcagaggaagaagttgacattggaagagtttcgatgta

SEQ ID NO: 84476 - DNA, 82 bp, Mus musculus
ttttgtgtgctgtccagtggaggatttgactgagagctttctttgagccatctcactccctcagagactggagcgcacagga

SEQ ID NO: 84477 - DNA, 77 bp, Mus musculus
ggagactgaggcctgcaatggctgcaggagactgaggagactgaggcctgcaatagctgcaggagactgaggagacc

SEQ ID NO: 84478 - DNA, 71 bp, Mus musculus
ctgtgtactttctgtgctttccctgaaacagccactctgcatctgatcacagagagcacagggagactcag

SEQ ID NO: 84479 - DNA, 69 bp, Mus musculus
ggcgtctctctcactcacagctttacatggcgcagaagagccgggactgtgtgtggaacaagagctgct

SEQ ID NO: 84480 - DNA, 61 bp, Mus musculus
gtgtgtgtgcacatgcatgtgtgcttgagagaggagagtctgtgtgtgtgtgcatgtgtat

SEQ ID NO: 84481 - DNA, 78 bp, Mus musculus
gaaaggtcaaacagccagtgagtctgggctgggactttaggtcccactgacccactgacccactgttgttctcccctc

SEQ ID NO: 84482 - DNA, 71 bp, Mus musculus
agtaaatctcttctgagactgagccactcactgtctgctctgtagatggtgacaggatgagaaatgggact

SEQ ID NO: 84483 - DNA, 99 bp, Mus musculus
gcagagctcaccatgtagggtagattagtttaggctctccggccagtgaattctgagtggatactctgtctctgtctctgtctctgtctctatctctgt

SEQ ID NO: 84484 - DNA, 101 bp, Mus musculus
gccattgagctgactcagtaacctggggcaagcgacgttatcacttagagcttcttcatctgcaaaacagggataaactgggatgaaactcagtgcatggt

SEQ ID NO: 84485 - DNA, 117 bp, Mus musculus
cattgtcacacgaaagcatctcatttgactattaacagattgttgtctgtaaggtttttttttttcttatagaaatatatacctgggttgttgggttattttgttttgttgaaaatg

SEQ ID NO: 84486 - DNA, 82 bp, Mus musculus
acagcactgtgacttgatatttaattatttttagttagttagttagctagttagttaatttttcaagacagggtttctctgt

SEQ ID NO: 84487 - DNA, 116 bp, Mus musculus
taagcacttcactgagtcatctcttcaggccctagattatgaattgtaaacaagaatttgcttcccattcttctagaggctgggataagatcaggagaccagtacagtcaggtttg

SEQ ID NO: 84488 - DNA, 66 bp, Mus musculus
tgagggtccagctctggtgtctggcagcctagggatcaggctcagactctcactggctggctttca

SEQ ID NO: 84489 - DNA, 118 bp, Mus musculus
atgtcttacccagcattgcccagctaaggggaaaagataggagctcgggcagatctgactctctcagagtcaaagctcttgactttcccttaggaggcagtggtcaggacaaagacat

SEQ ID NO: 84490 - DNA, 100 bp, Mus musculus
gcctttggtgcgctcgctcgcctgtgtagttccctcagacagtcagagagaagagacagagcagcgtggcagacaggcgggctctgcaggagctcctggc

SEQ ID NO: 84491 - DNA, 100 bp, Mus musculus
tagcaatccctcctgggctcagtgtacagggcatcctctccagtgtccagagagaagaaagtgtgccctataactagaagtggaccctgcccaggtgtta

SEQ ID NO: 84492 - DNA, 114 bp, Mus musculus
ccagttgccgcggggctttcctttgtgcttgatctaaccatgtggtggaacgatggaaacggaacatggttctgtcaagcaccgcggaaagcatcgctctctcctgcagcatgg

SEQ ID NO: 84493 - DNA, 78 bp, Mus musculus
gcgtgaagagttcagagtcatcagactggacggaggtgagtctgtacagctgagtgaataaacagaacatggcacagc

SEQ ID NO: 84494 - DNA, 136 bp, Mus musculus
gaagagaaatcgcctagccccgagtcagtgccagtcaaagagatggggtagcatgaaggtgctctcttctctctgaatgtgggttcagagaggaggaggtctgtagtccatagccacccccacccctggctgtact

SEQ ID NO: 84495 - DNA, 88 bp, Mus musculus
gacctgggggcaggagttgaagcagagaccgtgaaggaacactgcctaccagttgctctcagtctcacactcagctaagctacctttc

SEQ ID NO: 84496 - DNA, 95 bp, Mus musculus
tactatagtgaggggctggagagatggctcagcggttaagagcactgactgctcttccggaggtcctgagtttgaatctcagcaaccacatggtg

SEQ ID NO: 84497 - DNA, 112 bp, Mus musculus
tgcttggaagttttcttactgccctcggcttctttacagtgctgccttgttgcatatggatcaagcagcattgtacagggctatgaaggcattgagacttgttcttcatgcg

SEQ ID NO: 84498 - DNA, 57 bp, Mus musculus
gctcagtagaccaggctggccttgaactcagtaatctgcctgcctctgtctctgagt

SEQ ID NO: 84499 - DNA, 89 bp, Mus musculus
gaagccttgctgctccgctggccctttcctcttggccgggtcgtgcgactgtcactcagagaagagagggtggacagcgagcgaggctc

SEQ ID NO: 84500 - DNA, 65 bp, Mus musculus
gaggcagtgaggcatgagggggaaagagctcttctgctcccactcactcggagtctccctgcctt

SEQ ID NO: 84501 - DNA, 60 bp, Mus musculus
gggtgaatgcagacattcccaactttgacctatgaagacccagtgtctgtgtgtcactcc

SEQ ID NO: 84502 - DNA, 106 bp, Mus musculus
gaagtgtggcttggaagacctggctctgggagcttcaatgaaacagtcccagaagaggaaacagactgagcactgtccttctagagtagggtagaaggcacgcttc

SEQ ID NO: 84503 - DNA, 86 bp, Mus musculus
tctgcattcaagaagtagagacagacagacagacagacagacagatatgggtgctgtttgtcctgttctttttcttcagtctaaga

SEQ ID NO: 84504 - DNA, 59 bp, Mus musculus
tgaagagggccaaggtccaagagacacgctctctcggacagtggttttcctctgtatca

SEQ ID NO: 84505 - DNA, 85 bp, Mus musculus
ggctactcacctgaattctgtgaagtgtgctgcctctgtctctgactctgaaccagttcttagcgattttgttagatgagtggtt

SEQ ID NO: 84506 - DNA, 58 bp, Mus musculus
ggcagatctctgtgagctcaagaccagtgtggtctacagattgagtttcaggacagcc

SEQ ID NO: 84507 - DNA, 110 bp, Mus musculus
tgccaggtactgtaagtggtaaatatagacatacatacatatatatatatgtatgcatgtatacatatatacatatgtatgatgatagtgtgtgagacacagtagttgca

SEQ ID NO: 84508 - DNA, 108 bp, Mus musculus
gcgtgggttctgcattacggagagtgtcccaggtgccggaccctgtggtggttgtcagttctctgtgtgtataagcccaggcagccaacctagcactgatcattgtag

SEQ ID NO: 84509 - DNA, 140 bp, Mus musculus
tgatgtgtggctgcttctcaggctagggtccttcagcgcaggacccttctgtaagtaccagacacacacgcagtctctggcactggcttcattgacttaatgaaattcctagttttgacaggagctgtaattttgctctg

SEQ ID NO: 84510 - DNA, 200 bp, Mus musculus
tctatgtgtgtatatgtatatgtgtgagtatatgtatttatgtatgaataagcatgtatatgtgtgtatatgtgtatgtgtaagtgtatatacatatgagtgtgcatatttgtgtatgatgtactataagtgtatgtatgtatatatatgtgtgtatatacatatgtgtgatgtgaatatgtgtgtatgagtatgtatgt

SEQ ID NO: 84511 - DNA, 79 bp, Mus musculus
gagttgcaatgtcccaggactggagagatggctcagtggttaacactgactgctcttccagaggtcctgagttcaattc

SEQ ID NO: 84512 - DNA, 62 bp, Mus musculus
gtgtgtgtgaatttacacatatgtttgtatatatacatacaaacatatgtgtatctgtgtat

SEQ ID NO: 84513 - DNA, 84 bp, Mus musculus
ttgaacctggaattcgtgaagatggctagaccagttggacaatgagctccagggatctgtctgtctctcattctccagtgccag

SEQ ID NO: 84514 - DNA, 72 bp, Mus musculus
gtatgcatgtatgtatgtatgtattcctctgtgtgtgtgggcatgcgcatgcacgcacatgtgcatgtgtgc

SEQ ID NO: 84515 - DNA, 65 bp, Mus musculus
tgatgtatatgacatatatgtatatatgtgtattgtatatacatgtgtgtatatatatgagtgtg

SEQ ID NO: 84516 - DNA, 115 bp, Mus musculus
attacggtgtcattgttccgcggtagaaaggttgaattcatttactgtgtggttatgttagttatgattgatgtctcttctccaaatgataaaccaatcaccccgatgatgtaat

SEQ ID NO: 84517 - DNA, 80 bp, Mus musculus
ctgttggcactcacagtcacagactctgttctagctccttcacagctggcaacctctgtacgaccaagtgtttgcaacag

SEQ ID NO: 84518 - DNA, 105 bp, Mus musculus
gccagtatgggctacagatggcagaacaccacatcagagtgagcagtgtcctagaccccgtctccggcaatgctcctggccaaggctgccgcgcctaaacctggt

SEQ ID NO: 84519 - DNA, 57 bp, Mus musculus
tctggtggtgtgagctaggaaaggcttcacgtttctctctttgctatacctgccaga

SEQ ID NO: 84520 - DNA, 106 bp, Mus musculus
gaggagggagaagggaagaggaggtagagaaaacgagaactggagtgttggctcagaggttaagagcactgactgctcttccagaggtcctgagttcaatttccag

SEQ ID NO: 84521 - DNA, 107 bp, Mus musculus
gtcctcagttagtggaactctttgggaagagctaggaggtgtggccttattggagaaggtgtgtcactgagtcactgaggataggctttgaggctcaaaacccccat

SEQ ID NO: 84522 - DNA, 71 bp, Mus musculus
agagagagagagagagagagagagagagagagagtgtatccgtgtctgtatctgtgtctgtgtgtctctgt

SEQ ID NO: 84523 - DNA, 84 bp, Mus musculus
gcatttaactgtgcggtgtgtacctgtgattttttttttaaaggatgcatttgtgtgcaatttatttcgcatatttatttatgt

SEQ ID NO: 84524 - DNA, 97 bp, Mus musculus
gattatgataagagaggaacacagagtatttcttttctagttaattaaaaaaaaaacattagaaactaggcttatgtgttatctctctgtctctgtc

SEQ ID NO: 84525 - DNA, 77 bp, Mus musculus
tgcatatatatgtgtatgtatgtgtgtgtatatatatatgtatatgtgaatgtgtatatatatatacatatatatca

SEQ ID NO: 84526 - DNA, 102 bp, Mus musculus
tcgtgaatgggtgcctgcatttcctagtgtaatgatttagatgtcctatggagagacattggcaggaatgacattaaaacagagaggaggcgctctttaagg

SEQ ID NO: 84527 - DNA, 91 bp, Mus musculus
tctatatctatatcatctatctctatctatagagtgtatatataaatatatactgttagaggatagatagatagatagatagatagataga

SEQ ID NO: 84528 - DNA, 117 bp, Mus musculus
ggctatctgcatcgagaagaacgtggtgggtggcccagctgattattctgttgactagtctccagaatggtaaggacatctcaatatcgcattttctccatctgttctatgctttga

SEQ ID NO: 84529 - DNA, 83 bp, Mus musculus
cctccgtcctgtgtgccctactggaacttcattccctgccggtttcctgcacagactgaagtccctgaggacagagtgtgtgg

SEQ ID NO: 84530 - DNA, 98 bp, Mus musculus
ttcatctaaggaatgactgacggatctgcacagtgtcaccagactgtgacaaacagtgtgggaatgagatagggcagttggataaatgttcaggtgga

SEQ ID NO: 84531 - DNA, 70 bp, Mus musculus
gtgcataaacatgtttaattgtgtgtgtatatatatatatgtatgcatgtacaaatagtcataattgcat

SEQ ID NO: 84532 - DNA, 99 bp, Mus musculus
agagttttaagaaacagatgctgctgtctctctatttcacagatgagaaaataaaggtgatggggagtcaagttgttttcctgaatttttaagaatttt

SEQ ID NO: 84533 - DNA, 109 bp, Mus musculus
tatgcatatgcatatgtgtctatgtacatgtgcttgtacacacacatgcacatggttgtatgtatgtgtgcatgtgtatgccttctatatgagcatgtgtatatgtata

SEQ ID NO: 84534 - DNA, 63 bp, Mus musculus
atgtatatgtatatgtatatgatgtgtgtgtacacacacatatatatgtatatatgtatatac

SEQ ID NO: 84535 - DNA, 91 bp, Mus musculus
tctatgttatagtatgtatgcatacgtgtatatatgtgcctacatgtgcgtgtgcatgtgcatgtgtgtgcatgcatcccctggtactgga

SEQ ID NO: 84536 - DNA, 86 bp, Mus musculus
gaacggtttggaaagagtacatagcagaaagcaatgagatgttctttaactgcaatcttctgttttgtttttttttttttccgatc

SEQ ID NO: 84537 - DNA, 94 bp, Mus musculus
gcctattaacagatgattagtttatttacagttttagatgttgtaaatacagtaagtgtgagtcattgtgaataagcctttttgtttctagtgt

SEQ ID NO: 84538 - DNA, 110 bp, Mus musculus
ttttgctttgtacaatttggcaatgctaaggcagccagtcaggtaaggaggttctcttcatatctgatgatgaagcttatagtttaaaaaaaaattagtgggaagggaag

SEQ ID NO: 84539 - DNA, 97 bp, Mus musculus
agactaaaggagatatttaagagaaatgattatgttctatatacatataatgcatatataattcattgaaggacttaggtaaggactgctctagtct

SEQ ID NO: 84540 - DNA, 114 bp, Mus musculus
atgtgtatgtgtatgtgtatatatatatatgtatatgtatatatatatgtgtgtgtgtgtgtatcacatgtattatacacatgtgtatatatatgtatatatacatatatatat

SEQ ID NO: 84541 - DNA, 85 bp, Mus musculus; identical to SEQ ID NO: 57439

SEQ ID NO: 84542 - DNA, 87 bp, Mus musculus
tccaggttccccaatggcagtggtagatgaaagagacagcccatgtttatctatatcatttattggctgttcattgtggaaaatggg

SEQ ID NO: 84543 - DNA, 69 bp, Mus musculus
gatgttagatttttctttttggtgtacatgagtaaatgcatgagcatgtggagatcagagatcaacatc

SEQ ID NO: 84544 - DNA, 97 bp, Mus musculus
gcaggcacaaaattgaatttatgtctctctgtgtcacttgcctgtgtagactgtgtacctatgatggcactagaggtggcagctttctgtttcctgc

SEQ ID NO: 84545 - DNA, 74 bp, Mus musculus
tcctcacaaagaagagatttgtgtgtgcatgtgcatgtgtgtgtctgtgcattatttatctatttgaagtagga

SEQ ID NO: 84546 - DNA, 113 bp, Mus musculus
tagaaatatgtatgaagttgtgttccagaaatagctgctgggttgtaatgtgtgtgactctctctttcatgtgcatccttccgtttttactgccagacacactctgctctctg

SEQ ID NO: 84547 - DNA, 107 bp, Mus musculus
ctctggttgtacaatcagctagtggcaaatttgaacatttgattttatattaagaagtcattaaaatagctttgccatgtttatattagcatgaatgacagctgtgg

SEQ ID NO: 84548 - DNA, 97 bp, Mus musculus
gtatatatttacatgaatgtatatatgtttctacatccatgtgtgtcatatatacacacatcatatatgtttatatatatgtatatttatgatatac

SEQ ID NO: 84549 - DNA, 105 bp, Mus musculus
ctggtgttactctgctgtgtgtgcctgccaagatgtgtggtgacttctctgtttctatctttcccgtcctggtggcctgacccagtacactatggcagccactgg

SEQ ID NO: 84550 - DNA, 119 bp, Mus musculus
tatgttttctgctgtacataggcaggttaggtggcccataagcttctgggattcttctgtctctgactctcttcttgctataggatctttggaattatacctatgtgctactgttcata

SEQ ID NO: 84551 - DNA, 79 bp, Mus musculus
tgtgtgtgtgtgtgtgcgtgcatgtgtatgtatgcttgtataagtgtatataatacatgtatatatatatgtaactata

SEQ ID NO: 84552 - DNA, 86 bp, Mus musculus
ccagctgtgttttctgtctgtttatgtctgtgcgctcagcacttgggaagctagaagcaggaagatggagctcaaggccagcctgg

SEQ ID NO: 84553 - DNA, 87 bp, Mus musculus
tctggctaatatacactgatcagtgagtgcatatcaagtgacttcttttgtgattgcgttacctcactcaggaacatatcctccaga

SEQ ID NO: 84554 - DNA, 73 bp, Mus musculus
gtgtgtgtctttgtgtgtgtctatgtgtgtgtgagagagagacagagatagacagacacacagagagacagac

SEQ ID NO: 84555 - DNA, 140 bp, Mus musculus
cagaagtggtgggtaacttcaagaagtcagtgttttctggatacaataaggcatttgtacataagaattcacagtcattttgatagcatggccaagttttgtgtgtggaagctcaagccagataaaaatcccagcatgga

SEQ ID NO: 84556 - DNA, 71 bp, Mus musculus
ctgttacacagctagggaagggacaaagtggtgagaggccaagaggtcactgctctgtgtgtgtgtggcag

SEQ ID NO: 84557 - DNA, 118 bp, Mus musculus
gaaaaaattcagcaatgtatcagtcaaatagcctacagtctgtctcactgtgacaatctgcagtcccttaaaggatcagtcacacttggtgacagaatgtaatacactaaatattttc

SEQ ID NO: 84558 - DNA, 68 bp, Mus musculus
gacagaggctctcagtgactctctgctgctaggctggcaagccattgaggtctgagggttgttctgtc

SEQ ID NO: 84559 - DNA, 80 bp, Mus musculus
cagtggctctctcactctgtctcagtctggaaagctggatgtctccgcagtcccagtgtggcgatgcaggaggcctgatg

SEQ ID NO: 84560 - DNA, 75 bp, Mus musculus
gtctgatctctaaagtacacagagaggactccaggcttctgaatgcctgtcagtcagtcagtgagagggctagac

SEQ ID NO: 84561 - DNA, 118 bp, Mus musculus
ttcatctatgataattgaaaggttggctgggtatagtagtctgggctggcatgtgtgttctctcagtgtctctgtaacatctgtccatgatcttctggctttcatagtctctggtgaa

SEQ ID NO: 84562 - DNA, 118 bp, Mus musculus
gcagggaagtaagtgttgtgtcagtgaccaagaaactcagatcaatgtatttaattttaaaagcaaaactaactttctccatttcttggcttcaatgacttttacaaaactattttgt

SEQ ID NO: 84563 - DNA, 114 bp, Mus musculus
atggctatgtatgtatgtatgtgtgtgtgtttatatatatatatatatatatatatatatatatatatatatatattctcatatacatatatattctcatatacatatatattc

SEQ ID NO: 84564 - DNA, 83 bp, Mus musculus
gtgagggagatgtgctgggggccaagttgggatagggactcctcagcaaccgagggcctctctcttgctctcagtgtccttgc

SEQ ID NO: 84565 - DNA, 80 bp, Mus musculus
tgctataaaattcagttagacaagtttaaagaaacattcataggaatgtttatatttgtatatagagagttaggatggca

SEQ ID NO: 84566 - DNA, 85 bp, Mus musculus; identical to SEQ ID NO: 57439

SEQ ID NO: 84567 - DNA, 96 bp, Mus musculus
ctcattttcaactttcccacttgtgtgagtctttcagtgtgactctttgtttaaccctgaatctcacatcagagacttgacaagttgagaggtgag

SEQ ID NO: 84568 - DNA, 77 bp, Mus musculus
tggaagagatagtgggtgtgaatgaacccagaacaagcacctgggttcattcacaaagcaaaaagtctcctttacca

SEQ ID NO: 84569 - DNA, 118 bp, Mus musculus
agagataataaggaaaagtaattgttgcttcatgttatttttgatgttagagttgagattctgttcttgtggctatcttcttttaggattgttgaaggattactttcttgctttttct

SEQ ID NO: 84570 - DNA, 62 bp, Mus musculus
ggggctaagagacagcatcaagctattggcaatctctgtctgtctgtctgtctgtctgtctc

SEQ ID NO: 84571 - DNA, 106 bp, Mus musculus
gccttagtccatggtgatctgataggatgcatgggacaatttcaatatttttgtattggttgaggcttgttttgtgtccaattacatgttcaattttggagaaggt

SEQ ID NO: 84572 - DNA, 99 bp, Mus musculus
ttctctcataaaaagtccaaatcaatagttttgcttacatatgaaagttttcactataatatggttgtatagtattgatttgaaaaagacttagtagaa

SEQ ID NO: 84573 - DNA, 111 bp, Mus musculus
tcataaaaggatcagtaatttcaatatttgacatattgtatatgtgtatgtatatatgtatgtatacatatatatatatatatttaaaggttgttgtaaacacttctgtgg

SEQ ID NO: 84574 - DNA, 110 bp, Mus musculus
attaagtgttacctattgtcagtcctgcctgacttctaatgtctcacagagtgaaaagagagagcagatttttatcccaggattccaacctagttagtgtcccactaaat

SEQ ID NO: 84575 - DNA, 80 bp, Mus musculus
cctgaaagtaaagatcatttgaagtagaaatttatggtctctttggagactgagttaagtcattatgatgtactgttggg

SEQ ID NO: 84576 - DNA, 77 bp, Mus musculus
actatggctgtatgtgtgcaagagcatgtgaacatgtgtgtgtttgtgtgtgtgtgtgtatgtgtgcattcatgtgt

SEQ ID NO: 84577 - DNA, 82 bp, Mus musculus
catatacatatatatatacacacacacatatatatatgtatgtgtgtgtatctgtgtgtatatatatatgtgtgtgtatata

SEQ ID NO: 84578 - DNA, 86 bp, Mus musculus
gttagaaaggattgtcaatttgctctgtgtgatctgagccaaactttgataggagacagaacaaagtctgcattgtccattctgat

SEQ ID NO: 84579 - DNA, 92 bp, Mus musculus
ttgactgagaatagcctcaaaagtcttgtgtattagatgtcttgtttgttagacgatttagaaaggaataggacgtgggaccttttagttga

SEQ ID NO: 84580 - DNA, 100 bp, Mus musculus
accatccttttcagtcccctgtctctctgtctctgaaagaccttcttaataggttgctgtgtagatggttattgaggctaacagaatgtagacagaggga

SEQ ID NO: 84581 - DNA, 85 bp, Mus musculus
gagagagagagagagagagagagagagagagagagagaattagttttcttcatcttatcgtgtctgtctgtctgtctgtctgtct

SEQ ID NO: 84582 - DNA, 113 bp, Mus musculus
ccatctatggtaattgaaactttggctgggtgtagtagcctgggctggcgtttgtgttctctcagtgtctgtataacatctgtccaggatcttctggctttcatagtctctgg

SEQ ID NO: 84583 - DNA, 85 bp, Mus musculus; identical to SEQ ID NO: 57439

SEQ ID NO: 84584 - DNA, 95 bp, Mus musculus
atatatagtagactttaaatgttatatatacatatatgcacatatatgtgcataaatatgcatacatgtgtatatgcatatttatctgtatgtat

SEQ ID NO: 84585 - DNA, 77 bp, Mus musculus
gacttcggagaacgttgtcgcgagaggagaggaaagggacgttactgtctctctgtgcgtgcctgtgtccgagtgtc

SEQ ID NO: 84586 - DNA, 106 bp, Mus musculus
ctattagcacatatgaatagaagattgcagtcacagaagttctttagataatttttgatgtgacactcttgcaaactggatctgttctcaccacatgccatcttag

SEQ ID NO: 84587 - DNA, 85 bp, Mus musculus; identical to SEQ ID NO: 57439

SEQ ID NO: 84588 - DNA, 118 bp, Mus musculus
tttcttaaatttattttcttaggacttactcttattctgggacacacaagagagaatgcacaaaagaattccttaggtgggaggagggtatttcctttaagaaaatcaagacctgaag

SEQ ID NO: 84589 - DNA, 128 bp, Mus musculus
atatataatatagctggttgtatgtatgtatgtatgtatgtatgcatctgcatgtatgtatgcatgtatttctttttgtatgtatttcttattttatgtatttttgtatgtatgtatgtatttatatg

SEQ ID NO: 84590 - DNA, 105 bp, Mus musculus
aggggtcactgacttcagcccaatgattggatgtaagtatctgtgtctgtctcattcagctgccagcagggcttctcagaggacagtcaggccagagtcccatct

SEQ ID NO: 84591 - DNA, 123 bp, Mus musculus
gttggaacatatgtgtatgtatatatgtatgtatgtgtacatatatatatatatacacatacacacacacacacacatatatatatacacacacatatatatgtacatatatgtgtgtgtatg

SEQ ID NO: 84592 - DNA, 85 bp, Mus musculus; identical to SEQ ID NO: 57439

SEQ ID NO: 84593 - DNA, 91 bp, Mus musculus
ctgtcctttcagttggaaaccatagcaacataccacttaggagacacactgtgtaatttgtctgctctttggttagtattctgcaggccag

SEQ ID NO: 84594 - DNA, 85 bp, Mus musculus; identical to SEQ ID NO: 57439

SEQ ID NO: 84595 - DNA, 159 bp, Mus musculus
gtgtgtgtatgtgtatgtgtatatgtgaatgcctatatatgtatatatgtgtgtatgtatataatgtgcatgtgcatgtgtatgtgtacatatatgtgtatatttgtatatgtatgtatacatataaatacacacatgtacatgaatatatgtatatca

SEQ ID NO: 84596 - DNA, 110 bp, Mus musculus
tgtatcattgtcttatgaaagaaagtgttttatggtgtatattctacttatgctgaatcaatataagtatctttatgtaaagcacattttattattgagacaagatgtca

SEQ ID NO: 84597 - DNA, 64 bp, Mus musculus
gtgtgtgtgtgtgttcgtgggcattcagttgtgtgtcagtgctcacagaggacaaagaaggcat

SEQ ID NO: 84598 - DNA, 110 bp, Mus musculus
cttttctcattgacagaactttgaatttgtgtcatgagggagctttataaatatttattaaataaaattgcttgtttggatatgaaatgaatttagagatgggaattaag

SEQ ID NO: 84599 - DNA, 85 bp, Mus musculus; identical to SEQ ID NO: 57439

SEQ ID NO: 84600 - DNA, 114 bp, Mus musculus
ttattgggcactacgtatttggcctgagcataagagagggaagaagctcgctgcactgagtcttttttttttgaattgtagtcacgctggccttgctctctaagtccccggtga

SEQ ID NO: 84601 - DNA, 74 bp, Mus musculus
gtattatatatagatatatatatagatataggtatatgcctatatctatctatatctatatctatatatcaaac

SEQ ID NO: 84602 - DNA, 107 bp, Mus musculus
tatacatatgtatgtatatatgtatgtatagaaagtatatacagatacatacagatatgtgtatatatatatgtgtgtgtgtctatatatgtatattatatatatgc

SEQ ID NO: 84603 - DNA, 69 bp, Mus musculus
tatatgtatatgtatatgtatatgcattatgcattatgtatgtgcatgtgtatgtgtatgtgtatgtat

SEQ ID NO: 84604 - DNA, 106 bp, Mus musculus
gccttagtgcatggtgatctgataggatacataagacaatttcaatatttttgaatctgttgaggcctgttttgtgacctattatgtggtcaattttggagaaggt

SEQ ID NO: 84605 - DNA, 78 bp, Mus musculus
ttgtgtgtgtgcatgcctgcatgcatatgtgtgtgtgttagtgcatgtgcatgtgtctgtttgtgtgcatgtgtgcaa

SEQ ID NO: 84606 - DNA, 85 bp, Mus musculus; identical to SEQ ID NO: 57439

SEQ ID NO: 84607 - DNA, 81 bp, Mus musculus
gagctttgtgtaccctcccttgggtccttcttattatccagtttctttgggtctgtggattgtagtgtggttatcgagctc

SEQ ID NO: 84608 - DNA, 98 bp, Mus musculus
gctccaaccactctttagctgtgggtgtcactatctgtctgagtcagctgctgaacagagcatctcagaggacaacatgctactgtctgtctgcaagc

SEQ ID NO: 84609 - DNA, 72 bp, Mus musculus
ggctccccagataaactctgacacgtgacagtggtcaaaagaaaggtgttgtcatagtctgctgggactgct

SEQ ID NO: 84610 - DNA, 64 bp, Mus musculus
acttgtgcagcttgttcatacacccagcaagcaaggggctgagtgagtgagtgagtgagtgagt

SEQ ID NO: 84611 - DNA, 65 bp, Mus musculus
gtggagacttctcagactgtgagctggtccttccatggagtagctccacttccagaaacattcat

SEQ ID NO: 84612 - DNA, 61 bp, Mus musculus
tacatgtgcataatgtatgcatgcttttgtgtacaggcgtgtgtgtgtgtgtgtgtgtgtg

SEQ ID NO: 84613 - DNA, 121 bp, Mus musculus
gctgtgatgtttaggctagcttggaacactgggtattttgcagagcaatggtctggaggggtttcttctgtggatctagctcattcccatgcacagacctctaaatagcagtcctgctcat

SEQ ID NO: 84614 - DNA, 79 bp, Mus musculus
gactgtgctgggctgtctcaccttctgtgtctcagaaaggctgttagtgacactggggaagaggaagccagttcatgtc

SEQ ID NO: 84615 - DNA, 86 bp, Mus musculus
gatgagatttttttgatatgagaaaaattagacgcttggctgttttcgcagcaagagagagtcttgagagtgttgagaatctcttc

SEQ ID NO: 84616 - DNA, 79 bp, Mus musculus
ctgactgctcttccagaggtcctgagttcaattcccagcaaccacatggtttgctcacaaccatctgtaatgggatcag

SEQ ID NO: 84617 - DNA, 123 bp, Mus musculus
gtgtgtgtacattatgtatgtatgtgtgtatgtatgtatgtatgtatgtatgtatgtatgtatgcatatgtgtgttcatttgtgtgccagtatacatgagcatgtatgtgcacacagcatgca

SEQ ID NO: 84618 - DNA, 117 bp, Mus musculus
gggctgaaatcatgaaaacaaagaaattggggctagagagatgactcagcaggtaagagcactgactgctcttccagaggtcctgagttcaaatcccagcacccacatggtagctca

SEQ ID NO: 84619 - DNA, 109 bp, Mus musculus
tatacatgtatatgtgtgcatatgtatatgtgtgtatatatatgtatacctatggtatatgtttgtatatgtatatatacatatatctatgcatatgtatatttgtatg

SEQ ID NO: 84620 - DNA, 89 bp, Mus musculus
gtccaagctagcctgagggttaactcattctgagaaccttaagacaagatcttgtttgtgtctctctgagtcttcagtggtttgagggc

SEQ ID NO: 84621 - DNA, 77 bp, Mus musculus
aatggtggcacttcccttctctcttactgtctgtgtattcagtcaaggaatacagtctgtgagatgttgctgccatt

SEQ ID NO: 84622 - DNA, 104 bp, Mus musculus
ccttagtccatggtgatctgataggatgcatgggacaatttcaatatttttgtatatgttgaggcttgttttgtggccaattatgtggtcagttttggagaagg

SEQ ID NO: 84623 - DNA, 85 bp, Mus musculus; identical to SEQ ID NO: 57470

SEQ ID NO: 84624 - DNA, 112 bp, Mus musculus
tgcagcttggtcttcatgtgggactcatagtgggagcaggggctctctctgactctattgcctgtctttggatccctgttccctaactgagctgcctcatctagcctctgta

SEQ ID NO: 84625 - DNA, 78 bp, Mus musculus
aattcctctatctcaaaactccagtcactcttagtctctgggatcccaggggacagaagtgataagatcagagtaatt

SEQ ID NO: 84626 - DNA, 95 bp, Mus musculus
tacagcttctaacttcacaaagtataactttgagataatttgcttctaggatgttaagtaaattggtgtggaggaactttgagggtttagttgtg

SEQ ID NO: 84627 - DNA, 124 bp, Mus musculus
cagtcctggtgacacatgctgttgttggggtatacgacccgctgctctgctgtgttgtggctctgtctgtctgtctctggagaaagcagtggtgtggtttctgatggagattgggagaagccat

SEQ ID NO: 84628 - DNA, 95 bp, Mus musculus
tagtatgtttactaattctttgagaatttcatatgcatatttttatttcatatgtgcattttgattattctcactccctgttcttccccgtgctg

SEQ ID NO: 84629 - DNA, 71 bp, Mus musculus
cccagctctgagaactgaattccatgggttatatcaatgtcagacctgtgaaattcagttcttcagctggg

SEQ ID NO: 84630 - DNA, 128 bp, Mus musculus
gagttggagcagaggagcctgagtgaagatctggagatctccattttgcttccccaccctgcctgtttccctgacagcttgccaggttcctaaaagcaggatcctagggaatgtctatgggaattggc

SEQ ID NO: 84631 - DNA, 110 bp, Mus musculus
tctaggtaaacagttatttttaagctaaagcattttaaattgtgtgtgtgcatgtgcacgtgcacgcttgtacatgtgcagttgtgagtggcaagtgtatggagatcaga

SEQ ID NO: 84632 - DNA, 80 bp, Mus musculus
gtccccacaacctctctgtgcctctcttctgaactctaacaatgctgggttggtagtttgacatattgtaagggggggac

SEQ ID NO: 84633 - DNA, 67 bp, Mus musculus
cccatctccagtctggctctctcacaggcgtggagctcaccaaatacgctaggctggtttttcaggg

SEQ ID NO: 84634 - DNA, 96 bp, Mus musculus
gcagtcagcctgttacctaggcacagggattttttttttttttccttcaaagcacaaaagacacactctgagtctcgaaagcaacatctgatctgc

SEQ ID NO: 84635 - DNA, 82 bp, Mus musculus
tgtctatctgtctgtctgtctgcctgtcccatttagtgttgctcttgcatgtggcttagggctgagtacttaggcttagata

SEQ ID NO: 84636 - DNA, 93 bp, Mus musculus
ttcttctccaatccctgaggattctctcactctgacgctgacgaccgaatggttaatgattagaagtgggggaagtctctctgtgcaggagag

SEQ ID NO: 84637 - DNA, 79 bp, Mus musculus
gactgggctatgggtctggctctaagagtctctgtggtcaggggtcgttgagtcacacactgcttgatgtatctcagtc

SEQ ID NO: 84638 - DNA, 80 bp, Mus musculus
tatatgtataggtgtatatgtatatgctttatatatgtctatactttatgtatgtgtatatacatatacatatacatata

SEQ ID NO: 84639 - DNA, 69 bp, Mus musculus
gttggtatacatttgtaatcccaggtactcaggaggctgaggtaggaggatgacaagctggtgaccagc

SEQ ID NO: 84640 - DNA, 99 bp, Mus musculus
ttaaccctgtgcagcctggattctcagcctctgctctctaaagtggtacagagtcagagagaagacagtgggaatcacagatcttcaaggcattgttga

SEQ ID NO: 84641 - DNA, 80 bp, Mus musculus
ggctctaagaaaatgacatggcctggaggagattcggggtacctttcctcagtgagctttgatgtggtccaaaaagagcc

SEQ ID NO: 84642 - DNA, 68 bp, Mus musculus
tgcagggacactgactgtgtcgatcaaacgtggtgagcatttacaacaacttgtctgtgatgcctgca

SEQ ID NO: 84643 - DNA, 121 bp, Mus musculus
gttaaacttctcagtcccaactgcaggcatagctgtctagagtctcagtcaacagagtgggctcagagccacattgctgggatttttttctttgacgttctaatgccacagtccctggaga

SEQ ID NO: 84644 - DNA, 77 bp, Mus musculus
gctgtctgcatctctgtctgtatctactgttgccccatctcctagatagtggatgtcccagggtccttgccacaggc

SEQ ID NO: 84645 - DNA, 111 bp, Mus musculus
agtcactattctgttgctgtaaaaagacatcaagactggacttaatggttaagagcactgactgctcttccagaggtcctgagttcaaatcccaccaaccacatggtggct

SEQ ID NO: 84646 - DNA, 81 bp, Mus musculus
gcttggaaagagaaggaagcgtaacaggacataaagaaaacccttgtcaccccagggtctgtgtgacagtctctcaccagc

SEQ ID NO: 84647 - DNA, 61 bp, Mus musculus
ggagggggtggggctttgaagttttggatgttcacaccaggcccagagtctcactctctct

SEQ ID NO: 84648 - DNA, 78 bp, Mus musculus
gagagaataaaaatagatggagagaaaggtgagacatgttctgtctgtattttctgtctgtctgtctgtctgtctgtc

SEQ ID NO: 84649 - DNA, 71 bp, Mus musculus
gtctgcatgtctgtctgtctgtgtgcatgtatatgtgcagtgccttcagagaccaggagaggccttcagat

SEQ ID NO: 84650 - DNA, 91 bp, Mus musculus
gctgtggtgcttcaggaaaatatctctggttctctgtgtctctccttattcatgagtaggtcccaggatgcctgcctctaagaattgcagc

SEQ ID NO: 84651 - DNA, 73 bp, Mus musculus
tgtgtgtatgagtgtttgcctgtatgtatgtatgtatgtatgtacgtacgtatgtatatacatcatgtacaca

SEQ ID NO: 84652 - DNA, 114 bp, Mus musculus
gctgatgtgaagccggggcattccaataaaacacagagctggaggtgcagtgtcagacacactcagcctcgcttctagctatttgtttcccccccagaacacacacatttatgt

SEQ ID NO: 84653 - DNA, 118 bp, Mus musculus
aagaagtggtttgtatgaaagatcaatatgtataagacttgacttggatatttctatagttttctaggtctatctccattgttctttaagttggctttttagataagtagatttcttc

SEQ ID NO: 84654 - DNA, 80 bp, Mus musculus
agaaacagttttctaatcccagggtaaaaggatccatggcattggtggagccctttctctctctgtgtgtgtctgtttct

SEQ ID NO: 84655 - DNA, 126 bp, Mus musculus
cttgtatacacatacaagtatacatatatgcgtacatacataagtacatgtatttgattatatgcatacatgtatatgtgtgtgcatgtacatatatatattcgtgtatgtgtgtataagttgtgt

SEQ ID NO: 84656 - DNA, 77 bp, Mus musculus
tgtctgtctgtgtctgtcttgtgcatacttgtgtacatgaatgcacacatgtacgtacacacacacacacacacaca

SEQ ID NO: 84657 - DNA, 70 bp, Mus musculus
tgcacagttttgtgtgtgtgtgtgtgtgtgtgtgcgcgagcgcgcacatgtgtgtgtgtacatgtgtgca

SEQ ID NO: 84658 - DNA, 69 bp, Mus musculus
tctgtctgtctgtctgtctgtctgttcatgggggcatacccatgtcagggtatgcatgtagagggcaga

SEQ ID NO: 84659 - DNA, 107 bp, Mus musculus
agtctttacgctgtctttcatcattgtctttgaggacacagttctctctgagtctgtgtactgtattattactggaagctttgccacggaacatgcagccatttgct

SEQ ID NO: 84660 - DNA, 79 bp, Mus musculus
ttcgatctgtctcttgtggaaattagtgagaattacagccagctgcagtgaaactctctgtcttagtagacgagttgag

SEQ ID NO: 84661 - DNA, 93 bp, Mus musculus
gaagatcagccttagtccatggtgatcagataggatgcatgggataatttcaatatttttgtatctgtggaggcctgttttgtgttggtgttt

SEQ ID NO: 84662 - DNA, 90 bp, Mus musculus
aggacctgagagagcaatactgactgtcagtctgtcatttccccatctccagcttgagagtccaactagatgcttctcttactcagttct

SEQ ID NO: 84663 - DNA, 71 bp, Mus musculus
cactgtcacctcagcaggattcacttagctctctgtcacagtcacagagacattgagttctgtgggccgtg

SEQ ID NO: 84664 - DNA, 99 bp, Mus musculus
agaaataatttctacacacatacacacacatatatacacatacatatgtatgcatgtatgtatatgtgtgtgtatctatatattaggtatattattttt

SEQ ID NO: 84665 - DNA, 67 bp, Mus musculus
ggggcttgtgcagcaggacttgtgcacactgtcactatcactgtaagtctgcatgcacattggccct

SEQ ID NO: 84666 - DNA, 85 bp, Mus musculus; identical to SEQ ID NO: 57439

SEQ ID NO: 84667 - DNA, 117 bp, Mus musculus
gtgtgaatgagtgtatgtatgtgtgtgcattgtgtgtgtatgaatgtatatgtatatattcatgtatgtatgtgtatgagtgtgtatataagtgtgtgtatgtgtgagtctgtatat

SEQ ID NO: 84668 - DNA, 81 bp, Mus musculus
tgtgtatatatatgtgtgtgtgtgtgtgtgtgtatatatatatatatatatatacacacatcacacatacacatacacaca

SEQ ID NO: 84669 - DNA, 83 bp, Mus musculus
ttgcccacacactcacacagattcacattatggctaaatgatatagtttaggcaggcgtatgaataggtaggagagtgggcag

SEQ ID NO: 84670 - DNA, 70 bp, Mus musculus
ctgacagatgtgagtgaggagcaccgcttgttggaatactcacaacacactctttctcacatgaaggcag

SEQ ID NO: 84671 - DNA, 89 bp, Mus musculus
gtgattccttaaaatgggacttttgacaagcactcagggaatatttgtatatatttaaggctggtgtcagagcagaagcccgttttcac

SEQ ID NO: 84672 - DNA, 85 bp, Mus musculus; identical to SEQ ID NO: 57470

SEQ ID NO: 84673 - DNA, 89 bp, Mus musculus
tgactctgtctctgtctctctatctctctctttccttcgccatctttgcttcctggccagatcaagatgagtagatttgagctgagtca

SEQ ID NO: 84674 - DNA, 106 bp, Mus musculus
tatgccaggcgcaccagctgtgggtgcatgaactgtccacaactctctctctctctgagttctctttctgttcttttctgccctcatctgtctgcctgtctgtatg

SEQ ID NO: 84675 - DNA, 114 bp, Mus musculus
agaactgttcttccctcagttctgaacactgcttctcactctttttctcagtggaatggggatgagctaagagagtcggggaggcagggtgagacagtcaggtaagaaaaagct

SEQ ID NO: 84676 - DNA, 78 bp, Mus musculus
gtttgtttcacacagtctctctgtgtgtggccctggtttgcctggagctcacactacgtggccagtgtggcctcgaac

SEQ ID NO: 84677 - DNA, 85 bp, Mus musculus; identical to SEQ ID NO: 57470

SEQ ID NO: 84678 - DNA, 67 bp, Mus musculus
ggtgtgtctgtctgtctgtcggtccattcattcattgttttctactgatataacaaatagaggcatc

SEQ ID NO: 84679 - DNA, 91 bp, Mus musculus
aggcagttgctactgaggccgccagtgagatgagtctgagcataccaatgtggagactcccgattgttactgagcccagccaactctgctt

SEQ ID NO: 84680 - DNA, 80 bp, Mus musculus
ccctatcccacttctctgttcattggattctctggtctcccgggagccacagacaagggtttctgagacaatggtgaggg

SEQ ID NO: 84681 - DNA, 72 bp, Mus musculus
agatggggaaaaaagaaggaaccaggctgggaagggctctctctgtctctgtctctgtctctgtctctgtct

SEQ ID NO: 84682 - DNA, 84 bp, Mus musculus
gggtgctaagtcaactgtggctctcttcagatggaggagaaaacactcctcccaaggaggtcagaacacagagagggcaaaact

SEQ ID NO: 84683 - DNA, 80 bp, Mus musculus
gtatgtatgtatgtatgtatgaatgtgtgtgtatgtatatatattacatatacatatacatatacatatatatatattac

SEQ ID NO: 84684 - DNA, 78 bp, Mus musculus
ccacacttctcagtctctgcctctgcctctgcctcttggtttctgagtgaggttagggagggactcacatggttgtgg

SEQ ID NO: 84685 - DNA, 100 bp, Mus musculus
gtgacatgtgtggagtagtagaggcagtctggagtgcttgtctggaaatgacttactccctggctctctctctggctctctgtgacctcccactggtcac

SEQ ID NO: 84686 - DNA, 145 bp, Mus musculus
ctgttaactttaaaggtctggcgagccaagcatagaagactggaagtctgcgagggtggtagagagagcagtgagagagcagagggttttcagcttctgctttccattcttgatttttcccaggcattgcagcagtcatgtcttc

SEQ ID NO: 84687 - DNA, 64 bp, Mus musculus
ctaatccctctgtcagacactgagtcaggtggaggtgatctgagtggatgacagaattagggga

SEQ ID NO: 84688 - DNA, 138 bp, Mus musculus
actcagaaagcatggagccctcccacctcatcaaacccacagtggcatcagaaggtagggagtcactgtctctgagtcacatattcccattcctgagctcagaaggtaacatatgtattcatggaagtctctacctgc

SEQ ID NO: 84689 - DNA, 116 bp, Mus musculus
acccgcaccctgtcaggagacatctaggataggttaaggttagcagggggccttcctagaggtggtacgttggatttttggcatggtgcgcaatgggtgagctttatggtaaggcc

SEQ ID NO: 84690 - DNA, 105 bp, Mus musculus
gtaaagcaaattggcatatgaatgagatacatgttatttttttcatagaaattaaatattgggtctggagagatgtcacagtgactaagcatgtcctgcttatgc

SEQ ID NO: 84691 - DNA, 119 bp, Mus musculus
agatggaaagatgccgcaggatatttgatcacgctgtgaactcttgagattgtgttgtttactgggcaagcctgtttttagttgaggcgtgactcagccctagcacacacctttaatct

SEQ ID NO: 84692 - DNA, 85 bp, Mus musculus; identical to SEQ ID NO: 57439

SEQ ID NO: 84693 - DNA, 85 bp, Mus musculus; identical to SEQ ID NO: 57439

SEQ ID NO: 84694 - DNA, 120 bp, Mus musculus
agaagacagtgtgtttcatgtgtatttcccagatcaaggaactagagcagggattctcaaacactctgattgtctcatgtgattccgcatgccatggggtttacatgttatatgacttct

SEQ ID NO: 84695 - DNA, 62 bp, Mus musculus
gaagagaggatctggggatgcagtgggctaatgaccttgttgactctgtgagtctctgcttc

SEQ ID NO: 84696 - DNA, 88 bp, Mus musculus
gatagttgttgaggtctgtcctgactctgaaggcaaggctagactctctccctctgtgtgctcagtctgaacccagcctcctgctgtc

SEQ ID NO: 84697 - DNA, 85 bp, Mus musculus; identical to SEQ ID NO: 57439

SEQ ID NO: 84698 - DNA, 111 bp, Mus musculus
cttgagagtgctgtttccattcttcatcttcccaggcctttgtcattgccaaccacttttacagaagtgacagaggaccctggccttgggaaagggcagtgctctagctag

SEQ ID NO: 84699 - DNA, 85 bp, Mus musculus; identical to SEQ ID NO: 60314

SEQ ID NO: 84700 - DNA, 59 bp, Mus musculus
tctgagccctgagttacagagtgagcacacagggctcacttcagagtttgcgcttcaga

SEQ ID NO: 84701 - DNA, 66 bp, Mus musculus
tctccactctcaagtgtctctcactgtgagggcaatcaacaccgagagagtcactggaggttgaga

SEQ ID NO: 84702 - DNA, 101 bp, Mus musculus
acaggatctttagacattagtgtgatcatcagacttggggcaaggtaatcaggcatggttttgtctctctgtctgtctagctggttgtttttattgtctgt

SEQ ID NO: 84703 - DNA, 70 bp, Mus musculus
tatgtatatgtatatatgtatacatgcatatctgttgatctgtatatgtgtatatgtatatgtaaatgta

SEQ ID NO: 84704 - DNA, 116 bp, Mus musculus
ccaacggcatggactctgataaaggcactccgagaaacatactcctgtgctcccagactgaggggtgtgaggacacattaggctttctcaggaaagcttatgaaacatctgattgg

SEQ ID NO: 84705 - DNA, 79 bp, Mus musculus
gataaagacaatcaggccgagagagaagcctgtgtgctgagttgctcagcttcccttcggtgtgcatttcctctgtgtc

SEQ ID NO: 84706 - DNA, 92 bp, Mus musculus; identical to SEQ ID NO: 57641

SEQ ID NO: 84707 - DNA, 85 bp, Mus musculus; identical to SEQ ID NO: 57439

SEQ ID NO: 84708 - DNA, 87 bp, Mus musculus
gtttataatgtatatgtgtgtatatataaagatatacatatatatgtatgtatgtatatgtgtgtatatatatatgtgcttgttgat

SEQ ID NO: 84709 - DNA, 111 bp, Mus musculus
ctattgccttggtttcctggccacacatttggaagaggtagaaggatacattcttctggaaaccttccttttttattttattcaaaagtaggtttggcattaagacaaaag

SEQ ID NO: 84710 - DNA, 94 bp, Mus musculus
gatgcatcagcaatatagctgcctaatcaagtctttttggatggctgaatcactgactctcacagaaagatgattcccagaactgccatgcatc

SEQ ID NO: 84711 - DNA, 75 bp, Mus musculus
gttatgtttagtaggactactttctcagtgccctcacacagtcagtgagaaagtgaagcaaactacaaatataac

SEQ ID NO: 84712 - DNA, 70 bp, Mus musculus
gaacaatagtttctggaattgcttgtgacggtctatctgtcagagagtgaaaattctaaaggtggtgttc

SEQ ID NO: 84713 - DNA, 74 bp, Mus musculus
gtgcccaggctataggcagagtaagacaggactccacactctccatctctctgccaggtacctggtcaaagcat

SEQ ID NO: 84714 - DNA, 78 bp, Mus musculus
tttgaaaggcaaaatcaatggtgtgacgtgtaaactaatgttagtagacacagaacacactaggcactgctttgaaag

SEQ ID NO: 84715 - DNA, 76 bp, Mus musculus
cagcagggatgcagagatgctcacatgtatagtctctcattctctctatgtgtgtgtctctctctgtctctctctg

SEQ ID NO: 84716 - DNA, 78 bp, Mus musculus
caccccactcccccgttggtgtgtctctgtccctgtgtcccccaggggatcagaagggatccatctctgtgtgggctg

SEQ ID NO: 84717 - DNA, 60 bp, Mus musculus
cattgggtgtcaagtgagggatgtgcagagtcactcactcactcactcactcactcgatg

SEQ ID NO: 84718 - DNA, 92 bp, Mus musculus
atggcattcttccccgtcctccagctcttacactctttccctctcaccacaggatgtgtgaagagtctgaggaaaaggaggtccagtgctat

SEQ ID NO: 84719 - DNA, 91 bp, Mus musculus
tgatattgcatgaaaccaaggcttgatttctgtcctctctttctcagtcacttcctttgacatcatccagtttctgggcatgtagatgtca

SEQ ID NO: 84720 - DNA, 61 bp, Mus musculus
aggcctaggcatgcagattttgactctgaacctagagtctgtctgtctctgtctgtgtcta

SEQ ID NO: 84721 - DNA, 117 bp, Mus musculus
catcagccttagtccatggtgatctgataggatgcatgggacaagtccaatatttttgtatatattgaggcttgttttgtgaccaattatgtggtcaattttggagaaggtaccatg

SEQ ID NO: 84722 - DNA, 97 bp, Mus musculus
tccggtgtttctgtctctctttttcatttcttacatttctgtctctgatccaggggacagtgtagacagacagcaaacagagggaaggcaagcaatg

SEQ ID NO: 84723 - DNA, 96 bp, Mus musculus
tacatctgttctcaagtaggtcactttctctgtctgttaatgctacccagccctctgactgactttcatgttgggaggggctgcttgatttgtgta

SEQ ID NO: 84724 - DNA, 85 bp, Mus musculus; identical to SEQ ID NO: 57439

SEQ ID NO: 84725 - DNA, 86 bp, Mus musculus
gtgagatgaaaccactgtgagatcatctggatgtggttggcaagtcctcgtgctccaaatgctcctgatccacaaaggaatgccgc

SEQ ID NO: 84726 - DNA, 85 bp, Mus musculus; identical to SEQ ID NO: 57439

SEQ ID NO: 84727 - DNA, 85 bp, Mus musculus; identical to SEQ ID NO: 57439

SEQ ID NO: 84728 - DNA, 84 bp, Mus musculus
gtcctatctagtgctattcctctgcagggccatcacttgtctgtctgtcagagaggctcctggacgaagttctagatcaggtgc

SEQ ID NO: 84729 - DNA, 100 bp, Mus musculus
gtgaagcgaagtccaaggtgggtgggtcccaggtccagcagtgtgtgtgtctatgtctgtgtatggggggggggggctcttctctgatgatttcagttac

SEQ ID NO: 84730 - DNA, 96 bp, Mus musculus
aggatacatgggacaatttcaatatttttgtatctattgaggcctgttttgtgaccaattatatagtcaattttggagaaggtcccgtgaggtgct

SEQ ID NO: 84731 - DNA, 89 bp, Mus musculus
gagatattgtaggatgtactgggatgccttgagtgactatgcgctccttgtcactcagtgtgtctgagtaactgcctatggagtagatc

SEQ ID NO: 84732 - DNA, 66 bp, Mus musculus
agtctttgctgactgcctctctgagtgtgagcactgctgcttcctcatagaaggttctagaagact

SEQ ID NO: 84733 - DNA, 66 bp, Mus musculus
ggggattgaattcaggtcagacttagtggcctgagagtgagtctgcctgcctgcctgtctgtctct

SEQ ID NO: 84734 - DNA, 73 bp, Mus musculus
gtgaacagtgatctagagggcagatgtgggaccaggcaacatggtacctaatcctgctctctctctctttcac

SEQ ID NO: 84735 - DNA, 82 bp, Mus musculus
ctcaggaacacgcgggctcagtgagtgagtgtctgcctcgaaagtccagagcctggcagctgcactgatatttagtgatgag

SEQ ID NO: 84736 - DNA, 91 bp, Mus musculus
tctgagctgtgcctggtcctgtactctatgagtagtgggtgagctctgggggtcatcttaggattcaaatgtcagcgggcttgacctcagg

SEQ ID NO: 84737 - DNA, 99 bp, Mus musculus
ctctctgaggctagtctagtctacttgtcatttagttgtccagaaatcctgtaacaaagattacagaattgaagccaagtggatgctagcagcataggg

SEQ ID NO: 84738 - DNA, 84 bp, Mus musculus
tcccagcattcaggaggcagaggcaggcaggcagatctctgtgaatctgaagtcagcctcactcagcctgagtgagttccagga

SEQ ID NO: 84739 - DNA, 74 bp, Mus musculus
ctgagcactgcagttgctgacgatctctctgtctctccgtttaggggctggggctctacacactgcattcttag

SEQ ID NO: 84740 - DNA, 80 bp, Mus musculus
gtgtgcaagtgctcatgtatacagtatgagttccagagatctccccatctctgcctctctggtgctgagacattgctcac

SEQ ID NO: 84741 - DNA, 114 bp, Mus musculus
acatacaaaacagatgtatttgaaaggagatatgtatccatgttatttttttatttctcaacaggggaggttgagaaatactgtaagcagtttcctaagacattctctgtgtgt

SEQ ID NO: 84742 - DNA, 77 bp, Mus musculus
ggggacagacacactcactgactcacttcaccgattaggcaagggtggctgacaggtgagcttcagggttctgcccc

SEQ ID NO: 84743 - DNA, 79 bp, Mus musculus
gaggggcagaaccctgaagctcacctgtcagccacccttgcctaatcggtgaagtgagtcagtgagtgtgtctgtcccc

SEQ ID NO: 84744 - DNA, 77 bp, Mus musculus; identical to SEQ ID NO: 84742

SEQ ID NO: 84745 - DNA, 79 bp, Mus musculus; identical to SEQ ID NO: 84743

SEQ ID NO: 84746 - DNA, 77 bp, Mus musculus
tttctccacgtcctctcagactgattttgtttttctgtcttcaagtttgcaaactgtgtggtggggacgtggtgggg

SEQ ID NO: 84747 - DNA, 58 bp, Mus musculus
tatatgtgtgtgtgtgtgtattcatatatatgtatatatacacacacacacacatatg

SEQ ID NO: 84748 - DNA, 62 bp, Mus musculus
gtgtgtgtgtgtgtgtgtaaagccaaaggttgatgtcagggtctttctcactcactcaccac

SEQ ID NO: 84749 - DNA, 91 bp, Mus musculus
ggcctgagctggagtctgcactgggcacactgtctgtatgtctcactctggatcacacagtggtcctgccagcactttagtctatgaggtc

SEQ ID NO: 84750 - DNA, 115 bp, Mus musculus
ctcagcatttgatgtgtagtgtatctacaataaatattttcagtacctgttcttgttaaatagaaagtaaagtagtttagagtagtgtttctcaacacacacacactgtggagag

SEQ ID NO: 84751 - DNA, 85 bp, Mus musculus; identical to SEQ ID NO: 57470

SEQ ID NO: 84752 - DNA, 74 bp, Mus musculus
ttcctgactcctctgacttgagactctaccaggttcactggtcaaagctgaagtcaagttctctgttgcgggaa

SEQ ID NO: 84753 - DNA, 101 bp, Mus musculus
tttttgtttttcctttttttctttttccatttatatttttgttttcttggtgggggaattgcaaagaaagagagtggctaagaagaacggtgagatgagag

SEQ ID NO: 84754 - DNA, 99 bp, Mus musculus
gcatacatacaggtatacatgtgtgtatacatgtgtatatgtatacatgtatatgtgcatatatataaatatacatgtgtatgtgatgtatatatgtat

SEQ ID NO: 84755 - DNA, 75 bp, Mus musculus
gagagaagacagagatgtttgctctctaccaatggcgtctgaggttggttgtagatatctttttcattttttctc

SEQ ID NO: 84756 - DNA, 89 bp, Mus musculus
gctaggcagtcacccaccagcctaggtgccgtccacagaggacagaacgggagaatgtggttcgtgtacacagtggggttttagtcagc

SEQ ID NO: 84757 - DNA, 116 bp, Mus musculus
aagctggccccgcccaggcactcaggcaccccatggcagcagggcaactcctgcagccagtgagactgtctctgtctgccttatttgggtaacctgatggggttgaggtgaagttt

SEQ ID NO: 84758 - DNA, 113 bp, Mus musculus
gagagtctgcaagtaagccagtttggttaggtagtgagcctaggggatgtgtctgtctcagtctctccagcactaggagcatgccaccaaggtcacctttcttatgggagttc

SEQ ID NO: 84759 - DNA, 107 bp, Mus musculus
taagcatcagttagagaggcaggtggaaaggagaagaatggtattacctgtgtcagcctctatctctgactttggtagcttgtttacttaaatctcactttaaagcc

SEQ ID NO: 84760 - DNA, 100 bp, Mus musculus
gtggtagagggggatagccaacattgcctctggatgacttcaccgcacacatatgtaggaagctcacccaagcaaacacgggtatctatacagtactcac

SEQ ID NO: 84761 - DNA, 67 bp, Mus musculus
gtgtctgggtcagtgtgtggcacagcttgagctgagccgcgccgctgtgacagactggaccagacac

SEQ ID NO: 84762 - DNA, 85 bp, Mus musculus; identical to SEQ ID NO: 57470

SEQ ID NO: 84763 - DNA, 84 bp, Mus musculus
cagagacaaggctgggaggggcacggagcaggcagagaggacacggagggctctgaatgcatcttctcctagaagatgttactg

SEQ ID NO: 84764 - DNA, 93 bp, Mus musculus
gaagggacctattctggctcactctctcagagcctggggtctgccatgattgagaaggtgtggcagaatggctcccatctgagcagagtgggt

SEQ ID NO: 84765 - DNA, 89 bp, Mus musculus
gtacttggtgtgattataaagcaatgagactgattgtcatatgtcgtttgtgggatccgtctcagttactttatagccatacctggtat

SEQ ID NO: 84766 - DNA, 71 bp, Mus musculus
gtctttttataaagttctcactgtgtatctgactggtgcacccggagtgaagacagagtagtcatgaagac

SEQ ID NO: 84767 - DNA, 89 bp, Mus musculus
agttgtaaggaaagccatgtcttgaaagctgagtcacaagccgcgtttcagaaggttgtggctcactctggctgtcacccattacatct

SEQ ID NO: 84768 - DNA, 108 bp, Mus musculus
tggcagaatttaatctttcttggcaattagtgaacagagtgtgcacatgagcacctcaggtgttactcctgaagccgatgcttataaagacagggtccctcattgcca

SEQ ID NO: 84769 - DNA, 79 bp, Mus musculus
atctgacagttgagagatggaaggcattgcaagcaaacctgggcgatttaatgtctctgtctctcttactctttatgat

SEQ ID NO: 84770 - DNA, 78 bp, Mus musculus
agagcaaggatccagtgagagcgtggccctgacactgagaaggactgtgtggctctgtctccctgaggtccaagctct

SEQ ID NO: 84771 - DNA, 135 bp, Mus musculus
gcatacaaggacttctacccactgagctacttcattagccttttttttttctttaagatttatttatagggcctggagagatggctcagcggttaagagtgctgactgctcttccagaggtcctgagttcaaatc

SEQ ID NO: 84772 - DNA, 83 bp, Mus musculus
gtgtcagtgtcccgtgtcagcactggggttagagatgcaggctgccacactcactcaatcccatgagaactggggttctgcac

SEQ ID NO: 84773 - DNA, 114 bp, Mus musculus
gcagcagcatggctaatgggtggggatcagaaactgtctgtgggcactattttttttttttgacagagttttgttcagtagcccaggctggcctcaaatttgccatactcctgt

SEQ ID NO: 84774 - DNA, 107 bp, Mus musculus
cagaggtgataaaaccgagcttgctgggagctgcctcaagatcagcctcagtgtctcactggaagccctctctccacaggcggaacacagatgctctgtctcctgtg

SEQ ID NO: 84775 - DNA, 110 bp, Mus musculus
gtgtgcattaaacagagtctggggctgaagagatggctcagcggttaagagcactgactgctcttccaaaagtcctgagttcaaatctcagcaaccacgtggtggctcac

SEQ ID NO: 84776 - DNA, 95 bp, Mus musculus
cagggttttagtttgtaggccatgtttaattttgtaggtatcttaaatttgttttttaagataggacctcatagtctacagactcagtctccctg

SEQ ID NO: 84777 - DNA, 68 bp, Mus musculus
gggtgggtgtcttgactcctcaatggtgagtgatgacagtggggactctagaaggttggaagccaccc

SEQ ID NO: 84778 - DNA, 107 bp, Mus musculus
ctttcctctcttcaggtcaccaaagttattgtgtctttctctctgagaactgtctacaagagccaaggaagcttagagtagtcccagtgatggcgtgtggaggttag

SEQ ID NO: 84779 - DNA, 68 bp, Mus musculus
cttctgaggcagtctctctctgagccgactaggacttttgctttctcctctaggctgagcctcagcag

SEQ ID NO: 84780 - DNA, 88 bp, Mus musculus
caccaagggcttgctcctggtacaacctttcatatcctgggacttgcctctgtctctcagtgtgatgcctggcagcctgccctctgtg

SEQ ID NO: 84781 - DNA, 74 bp, Mus musculus
tggaggaattacatgccccggctagacaatgtaagatctacattttatatttttggttgcgagtcatttcttta

SEQ ID NO: 84782 - DNA, 77 bp, Mus musculus
tttctttatttttcaccctgtctctctcaatctcaagctcgagcatcatggagccaggaaagggtgaagataggaaa

SEQ ID NO: 84783 - DNA, 125 bp, Mus musculus
ggtgggtatgcagtatggatcaccagaaaatgtaacctcagcgtttgggacccagtgactgaccctctgagactgagctacttctgtggtcttccggccacggacttacacagtgggaatgctgg

SEQ ID NO: 84784 - DNA, 79 bp, Mus musculus
ttccctctgagctgagggtcttcagtgatgccgtttcactcacactcaggctgatcactggaccatgggagaaggggaa

SEQ ID NO: 84785 - DNA, 64 bp, Mus musculus
cttggtcaagactgtgagctgacagcaggctcagtgccgccagcatcacagctgcgcctccagg

SEQ ID NO: 84786 - DNA, 144 bp, Mus musculus
gccctggcctgcaggacagccatctaaacagtgtgcctatctacagtgtacatgtgtgtatctgtgtctgtgtgtctctgtgtgtagtgggtagcagggcagggcatggtggtgcacacctttaataccagcatttaagagaca

SEQ ID NO: 84787 - DNA, 95 bp, Mus musculus
ggtactattaggcctgaagagtgtctgtctgtctgtctcctagtctggatactgaatgggggtggggaggggggtaagacttgcagctttgtgct

SEQ ID NO: 84788 - DNA, 71 bp, Mus musculus
aggttgccatcacctgtctctatctctgtgtcctcccagagcacagattcccagggattagggatgggcct

SEQ ID NO: 84789 - DNA, 125 bp, Mus musculus
caggatttgctaacttggggaatatatctataagcaaggggaaaggctgttgatgcgaatctttctatttttattagaactttcccggcttctctttcctctgcactgcattaatgagctcctgg

SEQ ID NO: 84790 - DNA, 64 bp, Mus musculus
gacagtcagggcaggctttgaggtttcaaaagcccatgacatacccagtgtctgtctgtctgtc

SEQ ID NO: 84791 - DNA, 94 bp, Mus musculus
atgcacacacacatacatgtatatatgtatttatatgtatgtatatatgtgtgtgtatacatatatgtgtatatgtatatatgtatatgtgtat

SEQ ID NO: 84792 - DNA, 96 bp, Mus musculus
atgtgtatacatatgtgcacagtatatatacatatataaaaatataaaatatatatgtaatttagagaggtgctgtgtatttgtgtgtgtgcacat

SEQ ID NO: 84793 - DNA, 74 bp, Mus musculus
gaatctcaggtaccagctggagagatggctcagcggttaagagcactgacagctcttccagaggtcctgagttc

SEQ ID NO: 84794 - DNA, 85 bp, Mus musculus; identical to SEQ ID NO: 57439

SEQ ID NO: 84795 - DNA, 105 bp, Mus musculus
tgtctctgtctctctctgtatctttctgtctctgtctctgtccatgcatagtatctaacaacatggatcaggaactgaggcaggactcaatgacctgcagtacca

SEQ ID NO: 84796 - DNA, 83 bp, Mus musculus
tgtagtgacattgtatgtatgtatgtatgtatgtatgtgggtatatgtgtgcagatatatacatatatatgctatatgtatgt

SEQ ID NO: 84797 - DNA, 60 bp, Mus musculus
gcacactcagagactcagagactctgcagcgctcagcctgagcctggggccttggggtgc

SEQ ID NO: 84798 - DNA, 114 bp, Mus musculus
ctgagcttgtggtctgtctctttttacacccatgcttcaatctctgtgattctcacttacaggaggaagaagtagcagaggctggggtaagtggcggagcctgtgtacactcag

SEQ ID NO: 84799 - DNA, 61 bp, Mus musculus
acagtgattgagacagggtctcatgttgttcatgcctgtacctgtcagtctcactggctgt

SEQ ID NO: 84800 - DNA, 136 bp, Mus musculus
ggtacactaggacccagaggtcgagggcccggagaccgcgcagcaagctgactttgagaccacacagcgagctgacatttgtctctagctgcttttgtcttattctgtgactgattagctcgtctttcacctggat

SEQ ID NO: 84801 - DNA, 82 bp, Mus musculus
tcctgtgtgtgtctgtttgtcactcattcatccacgctttgcccacctgcgactagagacccgttccacacagacacaggga

SEQ ID NO: 84802 - DNA, 62 bp, Mus musculus
ttcagaggtgacagcaaccattctctgtcctgagagaagaatgtttgctctctaccaatgga

SEQ ID NO: 84803 - DNA, 171 bp, Mus musculus
tatgtatatgtatatgtgtatgtatgtatgtatatgtgtgtttgtgtgtgcacgcgcatgtatatatgtgtattgtttatatgtatttacatatgtgttctgagcctgtcactcggactatctctctgaacccattccacaggctagctggtcctgtgatcgtttctacac

SEQ ID NO: 84804 - DNA, 61 bp, Mus musculus
acctgtcagtctcactggctgtgaacttcctagggttttcaatccagtttgtctttcaggt

SEQ ID NO: 84805 - DNA, 75 bp, Mus musculus
atttgtaaacagttctctcaatcaacaatttatcattatatggatgataacttgttgcttgattacgatacagat

SEQ ID NO: 84806 - DNA, 71 bp, Mus musculus
gaagtagttcactctggagagatggctcagcggttaagagcactgactgctcttccagaggacatgagttc

SEQ ID NO: 84807 - DNA, 77 bp, Mus musculus
gcttcatgacagactctctcacggcctgaccaatggaagctccaggctgaggcatgtgcacaaggtctacatgaagc

SEQ ID NO: 84808 - DNA, 116 bp, Mus musculus
acaggtatgcatgcgtatgtgtacatatatgtgtgcatatatgtatgtaggtatgtgcatgtacaggtgtccatgcatatggtatgtgtatacatgtgtgtacatatatgcatgca

SEQ ID NO: 84809 - DNA, 96 bp, Mus musculus
ctggggagaatggtggacactaacataaacagcatttacactttggaggcctgcagagtgtgagcactgggctggggtccgtccgtctgtttgtag

SEQ ID NO: 84810 - DNA, 90 bp, Mus musculus
aatgcacagcaagctccaggttctgtgagagactctgtctcaaaaaataaggggaagggtcacgggaagggggggcatgctgatgtcatt

SEQ ID NO: 84811 - DNA, 75 bp, Mus musculus
gttcccatttgaaaagtcgcatggacaggaggatggaaggccaggtgactgactgtgtgactgtggtgggtgtgc

SEQ ID NO: 84812 - DNA, 74 bp, Mus musculus
ggtggggaaagaggggcctgacactcactgactttgtccccatcaaatctgtcaatcctctagacttccctccc

SEQ ID NO: 84813 - DNA, 106 bp, Mus musculus
ggtagaggcagtggggctggagacatggctcagcggttcagagcactgactgctcttccagaggtcctgagttcaattctcagcaaccacatggtggctcacaacc

SEQ ID NO: 84814 - DNA, 113 bp, Mus musculus
tgcgttttggaattgatacatttcttagagggttctatgtgtacagaacagtgagtggtgactgggcttacaaagggaccatctgtgctagggaaatgatgagacataagcca

SEQ ID NO: 84815 - DNA, 82 bp, Mus musculus
cagagtcttactgttttgaaacccgggctaatctagaacttgctatttagcccaggttggtctcagaactcagagtgatctg

SEQ ID NO: 84816 - DNA, 86 bp, Mus musculus
gtgtatgtgtatatgtgtgtatatgtgtacatgtgtatgtgtgagtatgtgtgcatgtgtatgtgtacatgtgtgtgagtatgtgc

SEQ ID NO: 84817 - DNA, 90 bp, Mus musculus
gccaggactaactgactgactgactgagaggcaaggggccacgtggcagaggtgaagtagaatagtcgggataatttaagttagatgagc

SEQ ID NO: 84818 - DNA, 108 bp, Mus musculus
cgagtatcttcctcacattggccaagggcattcttgctcctctgtgtgtgtatatctcacaatctaagctatatatgggaaccaaggatgaaataggctggaagcttg

SEQ ID NO: 84819 - DNA, 98 bp, Mus musculus
tcttgggacccttgtttcatttgtttcaatagcctgagagtagtcagagacgagtctctagaccagcttcacctgtaaagactgttagggtcacagga

SEQ ID NO: 84820 - DNA, 91 bp, Mus musculus
tggtaaaaatgatagaatgtaggggctggagagatggcgcagcggctaagaacactgactgctcttccagaggccccctggttgattacca

SEQ ID NO: 84821 - DNA, 105 bp, Mus musculus
cttgaactggttgtgtctgtctgtctgtctgtctttgtgtctgtatatatcagtcccatgcaagtcaccgaatacaggtggaggtcagaggataacttctgtaag

SEQ ID NO: 84822 - DNA, 124 bp, Mus musculus
cagcttggagactttgcattgtgtggggaggagtctgctgttggtacaggtgactcgctcgctcacacacagacaagcattgcaatccagctgctgcactgcagagtgtgagctgtgagcctcc

SEQ ID NO: 84823 - DNA, 80 bp, Mus musculus
tagaacaagatagtgtaaggccagcctgggctacaaagccctgtctcacccaaaagtctgcctgtctgcctgtctgtctg

SEQ ID NO: 84824 - DNA, 96 bp, Mus musculus
tcaagacaggttttctttgtttaacagccttggctgtcctagaactcactctgcagaccaagctggccttaatctcagagatctacctgtctctga

SEQ ID NO: 84825 - DNA, 100 bp, Mus musculus
ggtctcagagaaaacaaaagcacgcacgcacacacgcacgcacgcacacacatatgtatgtatgtatgtgtgtgtgtatgtatagatttatctgaaaacc

SEQ ID NO: 84826 - DNA, 82 bp, Mus musculus
agataaatctatacatacacacacacatacatacatacatatgtgtgtgcgtgcgtgcgtgtgtgcgtgcgtgcttttgttt

SEQ ID NO: 84827 - DNA, 129 bp, Mus musculus
ggagctgcagttcaaggtgattataaacaagaaagcattctttaaattttttaaataagggttggagagatggctcagcggtttagagcactgactgctcttccagaggtcctgagttcaaatcccagc

SEQ ID NO: 84828 - DNA, 85 bp, Mus musculus
tctgagacaggctggaaggatggtggctcagcagctaagagtgctgactgctcttacagggtccttccccggttcatttctcaga

SEQ ID NO: 84829 - DNA, 118 bp, Mus musculus
agtggtataagaaagctggctgaccaggcagaagagcaaggcagctagcagtgacttctgttttagttcttgccttcagattcctgccctggttcagttcctgtcttggcaggctgtt

SEQ ID NO: 84830 - DNA, 83 bp, Mus musculus
ctccttctgcctgcctgcctgcctgcctgcctgcatgggagatttgcagggggagagaaagggagggagggagggaagaagga

SEQ ID NO: 84831 - DNA, 131 bp, Mus musculus
atgtgcaccatgtgctatcctcaccaaatgcatatgctttcgtgcatgcatgtgtgcgtgtgtgcgtgcgtgtgtgcatgcatgcatgtgtatgtgtgtgtgagtgtgcacatgcatgtctgtcctagggt

SEQ ID NO: 84832 - DNA, 83 bp, Mus musculus
gaactcactgggatctctgtcactcccagtcacaggtaaaagcaactcaggaaagggtcaagtgggcaagaccaggaggcgtc

SEQ ID NO: 84833 - DNA, 97 bp, Mus musculus
caggcaacacctgcacagggagtataggtatgtgtattggtgttttacctgtctgtgtgtctgtgtgtgcctgtgtatgttgtgtgtctctctgtgt

SEQ ID NO: 84834 - DNA, 71 bp, Mus musculus
tgagtggacaaaagtgagacatatatatctataatatatagaatctatgcctgtcttctgtctgtctctca

SEQ ID NO: 84835 - DNA, 78 bp, Mus musculus
tatgtgtgtatatatgtatatatatgtgtgcgtgcgcacatgtatatatgtgtattgtatatgtgtatgtatatatgt

SEQ ID NO: 84836 - DNA, 76 bp, Mus musculus
ggccaaaggaatattgaagagcagagagtgaccagagaccactgtggcagcctgcagctttaggtagcctttatcc

SEQ ID NO: 84837 - DNA, 118 bp, Mus musculus
tatatatgcatatgtatatatacacatatgtatacacacatacatatatatgtctccaagtgtgtctgtatatctgtgtgtctaacctgtgatgtgtgtgtgtgtgtatgtgtgtgtg

SEQ ID NO: 84838 - DNA, 108 bp, Mus musculus
gggaacacccaccaggacccacctttctagtgactcagctttggaattcgtcacagaaaagtcagagcaaaagatgtgaagaggaactgagtgggggcgggggagctc

SEQ ID NO: 84839 - DNA, 80 bp, Mus musculus
cctgcagaagagtgggcatccagacattgtggtaccaaggactgaagggcagtgagtggattcatgtgttggagcaggct

SEQ ID NO: 84840 - DNA, 88 bp, Mus musculus
cctctttggtgaggaactgggatttagggatggcattatagtgcatgttaatctgtcttgtgtctcggtcactgtgactgtaaggagg

SEQ ID NO: 84841 - DNA, 114 bp, Mus musculus
gcgtgtatacacccgtgtgcatgtgtatggagttgtgcatgtgtgcatatgtgtgtgtgcatatgcatgtgtgcatgtgtgtgtgtgtgtgcgcgcatgtgtgtgtgtaggcat

SEQ ID NO: 84842 - DNA, 64 bp, Mus musculus
atcagcacatgaggtttcctgagcactgctcacacctgagcctcagtgtccctcagtctctggt

SEQ ID NO: 84843 - DNA, 82 bp, Mus musculus
gcttcctcagtccctctgtggctgggtagaggagctgtcatgggagacagcatcagaacatggacactgggacccttgaagt

SEQ ID NO: 84844 - DNA, 107 bp, Mus musculus
tgtgtgtgtgtatgtcacatatgtgtgtatatatatatatatgtatatgcatatgtatatatacatttatatgtataaatctgttatatatactatatgtatatata

SEQ ID NO: 84845 - DNA, 81 bp, Mus musculus
cagaggctaacggggctgagacaggaacagaaacatgtatgactcactactctctgctactctctctctctgtggctactg

SEQ ID NO: 84846 - DNA, 58 bp, Mus musculus
atatatgtgtgtatgtatgtatatgtatataaacatatacatacatatatatatatgt

SEQ ID NO: 84847 - DNA, 97 bp, Mus musculus
gcccagctgatccgatctcattcactctgtctgagccagtcataggccaactcaacccttaaatactctctcaggtcctgagtgtgagcagtatagc

SEQ ID NO: 84848 - DNA, 90 bp, Mus musculus
aaaaggaagctttgggtctgtagagctgactcagatatataaatcaataagttgtgactgtctcactcagcccttggcttagttactttt

SEQ ID NO: 84849 - DNA, 65 bp, Mus musculus
gggcctaggtcaatcccatgcaggctgctggttgtcagttcagtctctgtgagccctattagccc

SEQ ID NO: 84850 - DNA, 82 bp, Mus musculus
gtagctaaagtcctagagtcagtcagtctgtttgtctgtctgccagcagttctcctttgggtctggttcagattttatttgc

SEQ ID NO: 84851 - DNA, 70 bp, Mus musculus
ggtcagtaggtggggcaggttatgaagggactcagtgagggaagtctgtccctgtctctgtgaagtgacc

SEQ ID NO: 84852 - DNA, 83 bp, Mus musculus
agtcctagaactcactaacatagaccaggctagcctctcaatcacagtggtctgactgcctcagtctctggagtgttgggatt

SEQ ID NO: 84853 - DNA, 97 bp, Mus musculus
gccattcatggaggcctagagagatggctcagtggttaagagcactgactgctcttccaaaggtcctgagttcaattctcagcaaccacatggtggc

SEQ ID NO: 84854 - DNA, 85 bp, Mus musculus
gatagaggcatgaaggtcagaaggtcaagatcaccctcagcaacacagaaaggtcaaggctagtctgtctgtctgtctgtctgtc

SEQ ID NO: 84855 - DNA, 104 bp, Mus musculus
tgaaaaactatgaatggggctggaaagatggctcagcgggtaagagcactgactgctcttccagagatcctgagttcaattctcagcaaccacatggtggctca

SEQ ID NO: 84856 - DNA, 108 bp, Mus musculus
ctgtgtagccctggaaaagcctgtctcgggaggaaatttatttatttatttatttatttatttatttatttatttatttatttattaagacagggtttctctgtgtag

SEQ ID NO: 84857 - DNA, 108 bp, Mus musculus
tcaaaggtatgctctaccacacctggcttcaatgttcagttttttttttaaaacgtgtattagtgttttgcctgaatagtgtgtctgtgtgagggtgtcggcccctgg

SEQ ID NO: 84858 - DNA, 123 bp, Mus musculus
ccacccacccacacacacacacacactatgggctgtcttttcactttaaggtgcattttaattgatttatttttacttctaagggtgttttgcctgtgtgtatgtctgtgtatcacatgggtg

SEQ ID NO: 84859 - DNA, 70 bp, Mus musculus
gaccagtggagggatgatgctcactggcttgctccccatggcttgctcagctcactctctcacacaggtc

SEQ ID NO: 84860 - DNA, 110 bp, Mus musculus
ccacagccttgagaatgacagtaacagagcttcagagaggcagctggcttcttccccgccatcccgccagcctcctcctcctggcagcatgacagtcagggcaagctggg

SEQ ID NO: 84861 - DNA, 256 bp, Mus musculus
gtgtgtgcatatgcatgtgtgtatagatatgtgtgtgcatacgcatgtgtgtatagatgtgtgtgcatatgcatgtatgtatagatatgtgtatagatgtttgtatatgcatgtgtatatagatgcatgtgtgtatagatatgtgtgcatatgcatgtgtgtatagatgcatgtgcatatgcatgtgtgtatagatgtgtgtgcatatgcatgtgtgtatagatgtgtgtatagatgtgtgtgcatatgtgcatgt

SEQ ID NO: 84862 - DNA, 112 bp, Mus musculus
tgaatagattatagcttcatctttacccaggtcccctaactggccaaagtgtcagcctgtctgtctgaaataagggacatggttcagggggataaaaagctcttgctattca

SEQ ID NO: 84863 - DNA, 64 bp, Mus musculus
ggaactcaccagtaagcactaggcacagcctgtctctgcctgtgtgccacactgcttggctttc

SEQ ID NO: 84864 - DNA, 78 bp, Mus musculus
tgtagaggcaggcagatctctgtgagctcaaggccagcttggtctacaaagggagttccagacagacagcaccacaca

SEQ ID NO: 84865 - DNA, 99 bp, Mus musculus
tttcagaaaggcattagagtgggcgggctctggaattcagtggtagagtgctcacttcacacactgaaggccctgggcttgatcctcagcagtaagaaa

SEQ ID NO: 84866 - DNA, 63 bp, Mus musculus
ggcaggatccttgtttctctcacagacccacaagctctgtgagcctctgagacagaccctgtt

SEQ ID NO: 84867 - DNA, 62 bp, Mus musculus
atatgtatatgtatgtatatgtatatatgtgtgtatatatatatatacatacatatatatgt

SEQ ID NO: 84868 - DNA, 74 bp, Mus musculus
tgtgttgagggctggagagatggctcagtgattgagaaagagcactgactgctcttccagaggtcctaagttca

SEQ ID NO: 84869 - DNA, 69 bp, Mus musculus
tcaatgagtgtctgtgatgtgtgtgtgcactagtgcacacgggcatacacatttgcagaggccagaaga

SEQ ID NO: 84870 - DNA, 106 bp, Mus musculus
aggcgtgcaccaccactgcccagctctgactgttcctttttaaaatgttttctgttgatgacacacactctctggctgggacagttgggggtttaaagaagggcct

SEQ ID NO: 84871 - DNA, 93 bp, Mus musculus
tactctagtttgtccttgactaagcctgcaggggccttggacatccccttgagtcattgtacttctgtcttttcaaggaagaaccttagagtg

SEQ ID NO: 84872 - DNA, 69 bp, Mus musculus
ttgagacagggtctctcactgactgattgtctgtctgaccagtaagccccagggatccttctgtctcag

SEQ ID NO: 84873 - DNA, 78 bp, Mus musculus
ctattacatagtgacttagaggccagtctgggataaatgaaatcctcccctgacaccctctctgagtgtatgtgttag

SEQ ID NO: 84874 - DNA, 116 bp, Mus musculus
tattttattttatttgttgtttttttgtagtcctggagattgaacgtaggtcatatatatatatatttgtctgctttaaaaaagcaaaatagaataacaacaacaacaagagaata

SEQ ID NO: 84875 - DNA, 103 bp, Mus musculus
gttagtattgtgcaggcatgaggatgtgagatctgtccttagcattcaaactttttcaaaagctggatgcagatacgtcactcttgtctgtaatttcagtgac

SEQ ID NO: 84876 - DNA, 66 bp, Mus musculus
actcacagagagactctgtccttcactgctctgactgaagggcagccctgcgtcttgtctgttagt

SEQ ID NO: 84877 - DNA, 93 bp, Mus musculus
cattccagtgtgtccttgactaagcctgcaggggccttggacatccccttgagtcattgtacttctgtcttttcaaggaagaaccttagaatg

SEQ ID NO: 84878 - DNA, 76 bp, Mus musculus
gtttctgtgcatgtggagaacagaggaagagatctagtgtccctctctgtcactctccactaaacttcttggagac

SEQ ID NO: 84879 - DNA, 89 bp, Mus musculus
gctcagcgcccagactctctgactgattcaacacagacctggacccccaacctgcccagaacacagaacagtggaagctaggcctgagt

SEQ ID NO: 84880 - DNA, 94 bp, Mus musculus
ccaaggcttggggctgccaaggtctaggattgaggcaccatagggcaagaactgtgtctgtctcactttctccagcacccaacagagaacttgg

SEQ ID NO: 84881 - DNA, 72 bp, Mus musculus
gagagtcccttaactgatcttttatgtgcttccttaaatggacactgagagatgagactcaggaggactctt

SEQ ID NO: 84882 - DNA, 109 bp, Mus musculus
cctgtctgtcactgaagaatgacctactggtacaggtctcaaacccacatctgaaatgtgtgtttatttttgtaaaactggctcattgaccctttcagattataggagg

SEQ ID NO: 84883 - DNA, 78 bp, Mus musculus
caagttagtctcactcactgtgacccacctgcttctgccttcccaggactgggtactgcaagtgtgtgcacatgcttg

SEQ ID NO: 84884 - DNA, 73 bp, Mus musculus
atacatattatgtatgtatatatgtgtgtatgtatgtatacatgtccatatatatgcatgtatttgtgtgtgt

SEQ ID NO: 84885 - DNA, 66 bp, Mus musculus
ggcctgactgtctcttccagtctctcttaccctcttggcctaagagagagagacccagtgagtgcc

SEQ ID NO: 84886 - DNA, 85 bp, Mus musculus
tgcttactttctaccttattctaatcaaagatactttttaattgatcattttctcaagaaggtttagatttggaagaagtgagca

SEQ ID NO: 84887 - DNA, 89 bp, Mus musculus
ggtcagcatgttgagctgttacaacatgttacaaagtctcatgttacaagacttttttatatttattgagacagggtctcttgctggcc

SEQ ID NO: 84888 - DNA, 139 bp, Mus musculus
gaaagaaaaacagaaatggcacacctgaaaaaggaggatatctttctgtctgtctgtctgtctgtctgtctgtctgtctgtctgtctgtttaagcatggtctctttccgtgccattggctgacctggaactcacagaga

SEQ ID NO: 84889 - DNA, 119 bp, Mus musculus
gtaaagcaagctaaaatctatttgaattacctgtgaagacagcaggaaatcttttgtttcaaacaaattttttgtttattcagaagtagttttaacatagatctaaatgccagtggtac

SEQ ID NO: 84890 - DNA, 95 bp, Mus musculus
ggacaactaggaaagcactgtagtgactgtgcagtggtctttcctttgttgaaaggcaagagagagatacaatagatgctatgtgtctggtgttc

SEQ ID NO: 84891 - DNA, 78 bp, Mus musculus
acagccaggtatacacagaggaaaccctgtcttgagagccctttacctggtatatcatctctgtgtgtgtgtgtgtgt

SEQ ID NO: 84892 - DNA, 85 bp, Mus musculus
tttgtgaagactgtgcctggacattggcatcaagatgtcagatcattgagagccattgttgagacttgctgtgagtgtttataaa

SEQ ID NO: 84893 - DNA, 70 bp, Mus musculus
cctgcctcagctggctgagtgctggcattgcaggtatgtatcactcactctgcctggttgtcttgatggg

SEQ ID NO: 84894 - DNA, 124 bp, Mus musculus
tgggctggagaggtttcgggtggggtggggtgagaaatgctgggcagagtcacagagactgagtgatacttgtcctgggtttctttggggcctgacagtatcttgagtacattttatatggact

SEQ ID NO: 84895 - DNA, 86 bp, Mus musculus
ctcaggtttgtgaaggttgtcagagagtgtcatttggcatcagacaaagccactgtgtgtgtgacattcttcttctttgttctggg

SEQ ID NO: 84896 - DNA, 117 bp, Mus musculus
ttgtgactactgtttttctagaaatgggacaatctgtgttcactcctctttctctgactctggagcattggaaggaggtgcgggtcagagcccacaaccagtcggtggaggtcagaa

SEQ ID NO: 84897 - DNA, 77 bp, Mus musculus
tgtctgtctgtctacctgtctctctgtctaggtatactcacatgtatatgagagtctgcagaggccagaataagaca

SEQ ID NO: 84898 - DNA, 101 bp, Mus musculus
gcttcaagatcatgtggtctggtcagtctcacactctcacatggatgccaaatcaggcctccccaccagtgtaaacagctaggtattgtatgctatggagt

SEQ ID NO: 84899 - DNA, 59 bp, Mus musculus
ccactcctggcatgctcactcattctctcaccaactatgtatgaagtgccaggcactgg

SEQ ID NO: 84900 - DNA, 109 bp, Mus musculus
ccctgctcgctgtattggatggttcattgtgaagtgtgtttcttgttgagtaaatcgtgtttaggaaataaagtctaaaatgagaactccttacctcagtgcacagagg

SEQ ID NO: 84901 - DNA, 87 bp, Mus musculus
gagtgcggccatgcctccctgtgtccctgtgaaggttgctgggctttctgagcttctgcaggaaggagggctgggcggagctgactc

SEQ ID NO: 84902 - DNA, 88 bp, Mus musculus
agctgctgtgcatgccagctgtctctctgtgtcccaccaaaaccaggaaggaaaaggtgcacagagtggtcagcgggaaatcagcgct

SEQ ID NO: 84903 - DNA, 74 bp, Mus musculus
caatacgtgtcttctctgtgtctctgcactcatgtgtgtggtgctgggggctccagaggacaaaatcagtaatg

SEQ ID NO: 84904 - DNA, 83 bp, Mus musculus
agatagacagacagacagacagacacacacacacagagagagtctctgtctctgactgtgtctgcctgcctgcctgcctgtct

SEQ ID NO: 84905 - DNA, 57 bp, Mus musculus
ggcaggcaggcagacacagtcagagacagagactctctctgtgtgtgtgtgtctgtc

SEQ ID NO: 84906 - DNA, 128 bp, Mus musculus
atgtatatgtgcatgtgtgcatatgcattgcacgtgtgtgcacatgtgtatgcatgtgtatgtgcatgtacatgtgtgttgcatgcatgcatatatgtgtatgttgtatgtgagcatgtttatgtgta

SEQ ID NO: 84907 - DNA, 121 bp, Mus musculus
cgtctctccctgccctcctatccccctccataagtcagagcactgtcacaggcactgtctatctacctttgcccttgagcttgctgattgatttggttgggctggctatgagtcccgtgga

SEQ ID NO: 84908 - DNA, 65 bp, Mus musculus
aggcctcatatcatagtaaggagaagctgggttgcaatcctctctttctgtctgattctaggcct

SEQ ID NO: 84909 - DNA, 69 bp, Mus musculus
gtctgtctgtctgtctatctatctatctgtgtgttttagcttataaggaggtggaggaaagggacaggc

SEQ ID NO: 84910 - DNA, 64 bp, Mus musculus
ctcatctttgttctctcggtccagctgcttggcagtggacaggagacctggaaaagggatggag

SEQ ID NO: 84911 - DNA, 80 bp, Mus musculus
gtctgtgtctttctctgtcccagggtcttctgccaaccctcccaggtggccctttatgttgcatgagtcttgactttgac

SEQ ID NO: 84912 - DNA, 119 bp, Mus musculus
gtcactgtgggctcaggttcttggaggattttatcatgtgacactacagagtcaccaggctgctagagctccctggcattcagattcattgtcataatttgaaaagctaagctgaacca

SEQ ID NO: 84913 - DNA, 116 bp, Mus musculus
tgcccctcagacataccagtgtgatgttaggggcagggcagggaggatctaggaagttttgttctgatcttatgtgtgcaagcccagtatattgatggtctctgggaatctgggca

SEQ ID NO: 84914 - DNA, 117 bp, Mus musculus
tcttatgaacagtgcagctgggcaggatggttcatggctatcatcacagaactcaggcagctgaggcaggaggactggtgaaagtttgaagtctatcctgagctacccatggtaaga

SEQ ID NO: 84915 - DNA, 116 bp, Mus musculus
gtttctaagcattcaggttctttaatattggaggatgggagagagcagtgagtggggagatggctctggggagttctgccagccttatagttctctatgtcctcctagcaccttgc

SEQ ID NO: 84916 - DNA, 69 bp, Mus musculus
gcctgtgtcactcagactgacttccaacacaacttacagggttggcgttgtcatcgtgtgcacacctgc

SEQ ID NO: 84917 - DNA, 106 bp, Mus musculus
cattttgtctaggagaaactgatagtactggttatatactgaaggtttatattacactggctgaaatatttaacatcaagtttcaatttctcatttgggggaaatg

SEQ ID NO: 84918 - DNA, 85 bp, Mus musculus; identical to SEQ ID NO: 57439

SEQ ID NO: 84919 - DNA, 68 bp, Mus musculus
gcatgtctctctctctgtgtgtgattgtacatgtgtatgcaaaggccagaagaggtcatcagacatgc

SEQ ID NO: 84920 - DNA, 72 bp, Mus musculus
ctagaagtgacagagcaggcatccagatgttttctgaataaacagaatggtcagtcactctctgttatatag

SEQ ID NO: 84921 - DNA, 116 bp, Mus musculus
agtatgaaagcagaattagaacatagttataaatggcctcaaggcacattaacttggttataggttgatatgttaagagaaactataaataacatttctagaaaaaaaatcattct

SEQ ID NO: 84922 - DNA, 136 bp, Mus musculus
tctgtctttctctctcaacacacacacacacacacacacacacacagagagagagagagagagagagagagagagagagagagagagagagcttcttctgtagaagccacactgccttctttgtgtctctcaaatc

SEQ ID NO: 84923 - DNA, 106 bp, Mus musculus
actcagggaaggaaggtttgcgtttggctcatactctcagtctgtcacggcaaataaggcatgggatagctgtggtggcaggtcaggaggcagctggtcacttagt

SEQ ID NO: 84924 - DNA, 85 bp, Mus musculus
tgcacatcagtgtttttgttgattagtctgatgctagggtaataagcactagcattagatgcaaaacgaatgcaaagtagctgta

SEQ ID NO: 84925 - DNA, 67 bp, Mus musculus
cagtgacatatgcatgctcctttcatctgagcacagtgagctcactgaggatagcatctttgtcttg

SEQ ID NO: 84926 - DNA, 75 bp, Mus musculus
caccacaggcactttctctgtgtgtaaaagttcacataaattaacccatttaaacacacagggtgatctatggtg

SEQ ID NO: 84927 - DNA, 95 bp, Mus musculus
ttgaatgctcagttcctagttggtagaattgttttaggaaggattaggaggtgtggtcttgttggaggtggtgtgtcactgggagtgggctttga

SEQ ID NO: 84928 - DNA, 65 bp, Mus musculus
gtatgtgtgacgctatggttcatttccagaaagattggcacagactctggctgtcactgccatgc

SEQ ID NO: 84929 - DNA, 67 bp, Mus musculus
aagcatggcgcagggacagagtgcagccagcacttgcggtggctctcagtatctctgtgtcagtctt

SEQ ID NO: 84930 - DNA, 85 bp, Mus musculus
taacagcttcagctgcagctttgcaggaaaatgttgatcatggcttccagcaaggtaaacagattttatatttatgaagtggtta

SEQ ID NO: 84931 - DNA, 85 bp, Mus musculus; identical to SEQ ID NO: 57439

SEQ ID NO: 84932 - DNA, 100 bp, Mus musculus
ggctgaccgttactgttgtcgggcattgcagtttgagatttgtgtgtctctgtgacacaaccaagcaaaagctaattggcgatgtatgcaaaaaccagtc

SEQ ID NO: 84933 - DNA, 65 bp, Mus musculus
acagagtcccaagaagcaagggaaatgcagaggttctctctgtgtgtctctctgtctgtctctgt

SEQ ID NO: 84934 - DNA, 95 bp, Mus musculus
atatgtgtgtatgtgtatatgtatatatgtatatacatgtatgtgtttggacatgcatgtacaaatgtgcttatacatgcatacatgtacacaca

SEQ ID NO: 84935 - DNA, 119 bp, Mus musculus
atttagtgctatgtgcatgagtgttagaacatggataacctctcatagaccataagaaaactcactctttctctcccagttgccatcactttttaaccaactgtgccttagctaggggt

SEQ ID NO: 84936 - DNA, 72 bp, Mus musculus
atatatatacatatgtatatatgtatacacacatataatatatatatgcatgtatatatgtatatatgtata

SEQ ID NO: 84937 - DNA, 85 bp, Mus musculus; identical to SEQ ID NO: 57470

SEQ ID NO: 84938 - DNA, 81 bp, Mus musculus
ctctgtgtctctgtctctgatctctccctaaccacccccctcccctgcttcctacctgggatcatgatatgaggcactcag

SEQ ID NO: 84939 - DNA, 77 bp, Mus musculus
agacatttccatttgcaggcatacacatacatacttgagtttgcatatggaatatgtgtgtgtgtatctgtctgtct

SEQ ID NO: 84940 - DNA, 109 bp, Mus musculus
gcctgcaaatggaaatgtctctctatataaatacaatgtttttttatttctgtccaagtaaaggcagaactttagttactcccctttagagaacatttcttgttgttgt

SEQ ID NO: 84941 - DNA, 103 bp, Mus musculus
accatatttatatgttgtgtgcaatatatatgtttatatgtgatatgtatatatgtgtgtatgtgtatatatatatatgtgtgtgtgtctgtgtgtgtgacat

SEQ ID NO: 84942 - DNA, 101 bp, Mus musculus
ggtagatagataggtaggtagatagacagacagacagacagacagataaccatttgaatctgtctattgttgcttatatgtacgttgttttagggctgacc

SEQ ID NO: 84943 - DNA, 81 bp, Mus musculus
tgctgtctgtgtttctctgttagaaggttcatgccatgagcacaaggtcttagtgggcttcttggtagcacagaccaggca

SEQ ID NO: 84944 - DNA, 99 bp, Mus musculus
ggggcattttggaaacttaaactgtatgtatatatgtgtctgtgtgtctgtatgtcattatgtgcatgtgagtgcagttaaaacaaggtgctgaacccc

SEQ ID NO: 84945 - DNA, 82 bp, Mus musculus
gtgacccatgtatatattaggtaatgtatgtacgtatgcatgtgtgtatgtatgtatggaatgtatgtatatatgtatgcat

SEQ ID NO: 84946 - DNA, 119 bp, Mus musculus
atatctatacatatatatatgcacatgtgtgtatatatcatatatatgtatataagtatacacatatgttatacatacatatatatgtataatatacatgtatatacatacatatatat

SEQ ID NO: 84947 - DNA, 88 bp, Mus musculus
cacacatatatatatatatatatatgtatgtatatacatgtatattatacatatatatgtatgtataacatatgtgtatacttatata

SEQ ID NO: 84948 - DNA, 78 bp, Mus musculus
tcgcatgattgtctgtctgtctgtctgtgcagcttacactgccatcagttaagaccttgggccagggcagggtttaga

SEQ ID NO: 84949 - DNA, 70 bp, Mus musculus
ggttagagatctctcctgtcatatgatgaagacacattaaactgatcatagagaggagaagacacatgcc

SEQ ID NO: 84950 - DNA, 72 bp, Mus musculus
gtatagacagttgtgaggcaccacatggatcctaggaatggaacccaggtcctctgcgatggatggatgtat

SEQ ID NO: 84951 - DNA, 88 bp, Mus musculus
ctccatctttgatattaacttagtttccagctgagagattctgtctctcagatgtctgctaaactaatgccttagagagcctcaggag

SEQ ID NO: 84952 - DNA, 94 bp, Mus musculus
gactccatgtggccttggctgggactcagtgtgtctgagtgcctccctggtgctggcttgcagctgagtcctctcacgggaatgctgtggggtc

SEQ ID NO: 84953 - DNA, 90 bp, Mus musculus
ggtgacttattagctctcactttgcacttgaaagccagaagagatcttatcagagccattttcttggctttggaattcaggggagccacc

SEQ ID NO: 84954 - DNA, 104 bp, Mus musculus
gagctacacagagaaaccctatcttaaaaataaataaataaaacctgaaagtactgtttcaaattttatatagttattctagagaaggtcttactctaaagctc

SEQ ID NO: 84955 - DNA, 59 bp, Mus musculus
gttttttaagacgtgcttaggttagtagaactcactctgggtgtgtctgtgagggagac

SEQ ID NO: 84956 - DNA, 102 bp, Mus musculus
tgagttgctgctccaggccagcattcagtgaacagccatggtcagtctgtcactgtctcaaccaggctgtgttattactgttaactggggccatgctgccca

SEQ ID NO: 84957 - DNA, 124 bp, Mus musculus
gtatgtgtgttcatgtgtgcacacacttgcatgagcgttcatatgtgcattatgtgtgtgtgcatttgcatgtgtgtttatatgtgtgcatctatgtgcgtgttcatgtgtgtacatacgagca

SEQ ID NO: 84958 - DNA, 121 bp, Mus musculus
ggtctgtcagccctgaggagcatttcttgacagtttcacgatggtttcaccccagtttctaagacagccagcttagctctccttctcagccctttgtaactgcagtcacccttgttctggc

SEQ ID NO: 84959 - DNA, 83 bp, Mus musculus
tgctgagggttgcatgcaagaggctcaccgtaagctcccaggaaaggacttgaactcttggtgagtctctgtgactgtcagca

SEQ ID NO: 84960 - DNA, 122 bp, Mus musculus
gggttttgttttgttttaaagtggtggcttggggctggagagatggctcagcggttaagagcactgactgctcttccagaggtcctgagttcaagtcccagcaaccacttggtagctcacaa

SEQ ID NO: 84961 - DNA, 68 bp, Mus musculus
cagaccaagactgcagagctagctggtgtagaacctccaacctgtctgtctgtctgtctgtctgtctg

SEQ ID NO: 84962 - DNA, 79 bp, Mus musculus
gctagaggaagtgtgtcactgggggtgggctttgaggtttcaaacgctcaagccaggctcagtgtctctctcttcttgc

SEQ ID NO: 84963 - DNA, 104 bp, Mus musculus
gggccggtttgcgcctgggcaaattgaggtcagagaaaagtgtgaggaagttggttcttttctaccatgcaggttctaaggatcaaatccaggtcatcgggctt

SEQ ID NO: 84964 - DNA, 102 bp, Mus musculus
agggttagagtgttgggctaaagtaattccatttttaagctgtaggatttgtgcttatgtgattatatatttaagatggagtctctctctctctctctctct

SEQ ID NO: 84965 - DNA, 65 bp, Mus musculus
cttggtgctctctgtgtctctgtttcctgtctgtgaaacagagaaaacggtcctggaacactaag

SEQ ID NO: 84966 - DNA, 78 bp, Mus musculus
gtgtgtgtgtgtgcacgtgtatctgctgtgctgcctgtgtggaaacagaggctgtgtgtgcatgtgtatctgctgtgc

SEQ ID NO: 84967 - DNA, 103 bp, Mus musculus
gaactactgatgtgggggctgggaagatggttcaactgttaagagcactgactgctcttccagaggtcctgagctcaattcccagcaaaccacatggtggctc

SEQ ID NO: 84968 - DNA, 76 bp, Mus musculus
tgttcagaagtctacactgcattacctaaacccggcagaaggccctgtgtgggtgtgactgtgtggccccaggaca

SEQ ID NO: 84969 - DNA, 81 bp, Mus musculus
cagagagtgtaaaggtaaggggatttggagatgcttcacgacccaggagtcatctacatctactgcaactgcatgtgtttg

SEQ ID NO: 84970 - DNA, 84 bp, Mus musculus
gccatatacccagtctttcattgtgtcttgctttgtatgacccagctggcaagtgacagtgactgtgtccctgggctcactggc

SEQ ID NO: 84971 - DNA, 94 bp, Mus musculus
agctgcttgccatcttcagtcttcagagaacacagattgaagacaattctggaatgattgtgcccttctgctgaggtgctgaagagcgtgtact

SEQ ID NO: 84972 - DNA, 88 bp, Mus musculus
tctgggggagaagacagtgagcagaatggtgcctagctgcctggatgggtgctgcgtgcattagttgtgttgtgtctggggactcaga

SEQ ID NO: 84973 - DNA, 83 bp, Mus musculus
gaggagctggtccacacagtgcttccatgtttaggcctgcctgcctgcctgcctgactgcctgactgcctgcctagctacctt

SEQ ID NO: 84974 - DNA, 76 bp, Mus musculus
acctcttgagccttctctgactctgactctctccaggggcagggcagggagcagttcccacaggaggaacgagggt

SEQ ID NO: 84975 - DNA, 95 bp, Mus musculus
ttctgtaacactggggtcacagacacacaaagtcacatctagctttcacgttaggtgctttggatttgtgctcgggtctgtgtgctcacacagaa

SEQ ID NO: 84976 - DNA, 97 bp, Mus musculus
gcaggcactgctgctcttacaatgtttgtcagaccttcttgaatatatatatatattctaggtaggtcttgctgatttcatggtggtgggtgtctgt

SEQ ID NO: 84977 - DNA, 87 bp, Mus musculus
agagatggagcctgcgtgtcagagccactctcaatgattctcagctcaagagtgaaagttggacagagcactgggcctgttttctct

SEQ ID NO: 84978 - DNA, 90 bp, Mus musculus
cactgagcaagaatgcttctgatgtatatagctggaagagatgcacctgggtaaaccctcacaggctgtgtgtctgggatctggccagtg

SEQ ID NO: 84979 - DNA, 84 bp, Mus musculus
caaaaataaccatagagtttttcttctggatatgttgttgggatgagctagcaactcctgatgaaaacatgtgaggttgtgttg

SEQ ID NO: 84980 - DNA, 132 bp, Mus musculus
tcctgccatcatccagactttgatcacatcctctccaagtccaggcttgtgtgttgtgtgtgaagacagagaggaccttcctgggaagccgatgtgctgagtgtggaagaaggtgggggctgcaggaaaagc

SEQ ID NO: 84981 - DNA, 76 bp, Mus musculus
cctttgttcagtgtagacagtcctcggtgtctaaagtctactgattctgttctccacatgctggaagtgacaaagg

SEQ ID NO: 84982 - DNA, 119 bp, Mus musculus
gaggcgggttcctaaaagagcacagactgggacggtatgaggtgagttgtggagggaaagacagctctcttctctctctcaaggtctcagcactgtatctctgatggtcagcaagcttt

SEQ ID NO: 84983 - DNA, 85 bp, Mus musculus; identical to SEQ ID NO: 57439

SEQ ID NO: 84984 - DNA, 97 bp, Mus musculus
gaattgcacatggaagaggcatttctgaggctgagtaaattctgtctgacactgtttctcactctgctgtgcctactgaaaccttcaagcttagttc

SEQ ID NO: 84985 - DNA, 108 bp, Mus musculus
tggaagaggcatttctgaggctgggtatattctgtctgacactgtttctcactctgctgtccctactgaagccttcaagcttagttcacatccatgtgctattttcca

SEQ ID NO: 84986 - DNA, 62 bp, Mus musculus
agtgcactacccagagtgggagcattccttaaatactgtctctcactctggctatctgggct

SEQ ID NO: 84987 - DNA, 73 bp, Mus musculus
gctcctcctatcagtctgcctctctctatctgatcactagtaccgagggaagtcagctgattgaccatggggc

SEQ ID NO: 84988 - DNA, 57 bp, Mus musculus
tctctgtctttctctgactctgtgcaggtgcttgcagagccagaaagggacatggga

SEQ ID NO: 84989 - DNA, 85 bp, Mus musculus; identical to SEQ ID NO: 57439

SEQ ID NO: 84990 - DNA, 100 bp, Mus musculus
caccacagagctgcactgctggccctggaaaaatacttttatttaaatttattttgtaatagttctttctctcatatgtgtgtgtatgtctgtgcttgtg

SEQ ID NO: 84991 - DNA, 109 bp, Mus musculus
ctattcctgatgattccagagtccaagcttcccagtgtcacatatgactgaagacagagaatgatggctatgggggggagggtgagggggtggctatggggagggatgg

SEQ ID NO: 84992 - DNA, 89 bp, Mus musculus
caccataatgataatggactgactctctgaatctgtaagccagccccaattaagtgttgtcctttataagagttgccacggtcatggtg

SEQ ID NO: 84993 - DNA, 79 bp, Mus musculus
acttctgttagtttcactgtgtctctgtttagtttctgtttccaggatctgtccattgataagagtgaggtgttgaagt

SEQ ID NO: 84994 - DNA, 64 bp, Mus musculus
gtcttcattcactagtgtctcagtcagggtttccatgactgtgaagagacaccaggaccatggc

SEQ ID NO: 84995 - DNA, 105 bp, Mus musculus
tcctctcagatctgaaagagttaagacaatggatacatctgaggtacgttgtatagttatgtcttgttttacattgtgtcttaggacttttgacaattggaaggg

SEQ ID NO: 84996 - DNA, 103 bp, Mus musculus
caggacctcctgcatccctattctctggcactaacacacacaggctgactgtaactggtgcgcctcagaaccttgctgagggatgtctagtgagccaaccctg

SEQ ID NO: 84997 - DNA, 82 bp, Mus musculus
atgcagctcagtcccttttgtccgactgcccggattattatttcaaattcattcctgggcacagacagtcagtgtgtggcgt

SEQ ID NO: 84998 - DNA, 88 bp, Mus musculus
gaacaaatttttagaggctgaggaatggagagaagctcagtgagagaagttgagcaccctctctctgcctgtgtcagccccagtgttc

SEQ ID NO: 84999 - DNA, 79 bp, Mus musculus
gctgccctgtctgagaggggtctcgaggcagccaaggccgtctgtcaggctgtctgtaagccagctcaccacatccagt

SEQ ID NO: 85000 - DNA, 71 bp, Mus musculus
ctgtgttcacagatatcccccagagacagaaaaggaggcagagctccaggctgtggatgtaggtagcatag

SEQ ID NO: 85001 - DNA, 86 bp, Mus musculus
tggagccctggagagtcagtgtctatgacataggtcccatatggtatctctcactctatgtccctaacttctgtccccagaaccca

SEQ ID NO: 85002 - DNA, 100 bp, Mus musculus
gactgtatgtctctgtgtatctgtgtgtctgtatgtgtgtgtatatatatatatatatatatatatatatatatatatatatatataaaatgtgtgtgtc

SEQ ID NO: 85003 - DNA, 78 bp, Mus musculus
ggctgaagacctcaccttagagtcagacatccaacctgccagaccatgatttggatgtctactgtatctgttgttgcc

SEQ ID NO: 85004 - DNA, 75 bp, Mus musculus
gtacatgtgtgctcaggtgtctgtctctgtgtgggtgtgaccatgtacacggtacaggcgtgtgtgcatatgtat

SEQ ID NO: 85005 - DNA, 112 bp, Mus musculus
attttatttgttttacacacacacactcatgcactcacacatgtgcgcacacacatgattgtgtgcacatgtgtgaacatgtatgcaagtgtctatggagaccagaaaggat

SEQ ID NO: 85006 - DNA, 115 bp, Mus musculus
gggggaggtcctgctattgtgtgtgctagacttctacaggctgcgctaaacagcaacagcatctgtaaccttcttctccagttctcacccactatgatgatagctgtcttccctc

SEQ ID NO: 85007 - DNA, 76 bp, Mus musculus
cctggtctctctcaggctctctctggttattttgtcttctctgaggaggtccagaaggagtctttgaagcccttgg

SEQ ID NO: 85008 - DNA, 104 bp, Mus musculus
ccacatatgtgagtagtctgtgacaggtgtgtattgcaggtatatgatagtgctcgtgcatgtgtgtgcaagtccatgtggaagccagagactgacagtggtgg

SEQ ID NO: 85009 - DNA, 95 bp, Mus musculus
ccaaccccactccaggatgtcacccctgccttctgagctcttaaaaacgtatactaggggtgggtgggtaagggggacttttggtatagcattgg

SEQ ID NO: 85010 - DNA, 110 bp, Mus musculus
ggaaagagttccagttcaggctggagagatggctcagcggttaagagcactgactgctcttccagaggacctgagttcaaatcccagcaaccacatggtggctcacaacc

SEQ ID NO: 85011 - DNA, 104 bp, Mus musculus
gtagggtgggtctattaaagaagaggaaagaaagtgggggaaagagaggtcgagagagcatctgtctcagtcactgttctacctctgcgaagagccaccatgac

SEQ ID NO: 85012 - DNA, 57 bp, Mus musculus
cagctgtgtctctctgtccctggagatacaaaccagggcacaggagtccatcagagg

SEQ ID NO: 85013 - DNA, 105 bp, Mus musculus
cctggccagatcattaactgtagctttctggaaataattttgtggttctctactgattatataacctatttcaagacatttgtgcaccagtgaaatggctcagtg

SEQ ID NO: 85014 - DNA, 74 bp, Mus musculus
tcatgtatgtatgtatgtatgtatgtatgcatgcatgtatgtatgcatgcatgcatgatgtatgcagttcatga

SEQ ID NO: 85015 - DNA, 68 bp, Mus musculus
ccgatcagcacctctgagaactcagtgtccagatgtgccatggctgggtatctcggagccagatcagg

SEQ ID NO: 85016 - DNA, 109 bp, Mus musculus
actgcacgtctgtgtcattactgggcaaatgggaagatttacaaagcagaagtcatatcacagcgatctttgagttaggccagagatgttcttctgggcagatgttagt

SEQ ID NO: 85017 - DNA, 92 bp, Mus musculus
tgtcagcaatggaatggtatgatctacgcccatacacaattctctggactgccagagatcaggaggtagaaagagactatcccacagtgata

SEQ ID NO: 85018 - DNA, 104 bp, Mus musculus
ctaggctctgtatgtatgtgtgtgtgcatgtgcgcatgagtgcaagcttcgtctgtctatctctgtgcgtctgtccagatcagatatgcatcacaaaagtttag

SEQ ID NO: 85019 - DNA, 85 bp, Mus musculus
gctctagccattatcaacaccaaggagccttgggagggtggagtcatccatcaagaggaacttggttgctaagttagctagaagc

SEQ ID NO: 85020 - DNA, 62 bp, Mus musculus
tcttgcccagaagccctcagaaagcacagtggtcactatgaacaagtggcttttgggtcaga

SEQ ID NO: 85021 - DNA, 110 bp, Mus musculus
ttttgctgtttcataaaaaacttacgttgatttctcattagtagaaacaatttttgtatttctagtcagttccacatactttcattataaggtttgtgacaatagtgaaa

SEQ ID NO: 85022 - DNA, 68 bp, Mus musculus
gcttgcatgtgcacagaagtgtaaaaaaatttttttaaagattattttacatatgagtacactgtagc

SEQ ID NO: 85023 - DNA, 75 bp, Mus musculus
ctcagatgacccatcctgactgaagggcagccagccaccagctgacatgagacactttcaggagggcttgcagag

SEQ ID NO: 85024 - DNA, 109 bp, Mus musculus
tctttgccagtggcagacatgatggacacctaccttgttgggaggatctctgactctatctctgtggcaagatgtccttcaaggtgctaggtctggggaggggcaaggg

SEQ ID NO: 85025 - DNA, 68 bp, Mus musculus
tgggacaccaagactgcctggatgggcaaggggcatttgtcagccactcggtctctgggcctctccta

SEQ ID NO: 85026 - DNA, 57 bp, Mus musculus
ggtgaggtctgcagagaagtgagagagctgcctgcttgcttcctctgcctgactact

SEQ ID NO: 85027 - DNA, 77 bp, Mus musculus
gggctgggtcgaggaaaacagaagcaggaacatggctcagttcggccagcctctgctcactccctgactctcagctc

SEQ ID NO: 85028 - DNA, 128 bp, Mus musculus
ttctcagttggcaaaagtgttacaaccagattctgaagtgagagactcctttttatatgtctgtgtatttttatcttatctcagtgggaagcgagttaggctggagaatggggggcaagacactggtc

SEQ ID NO: 85029 - DNA, 74 bp, Mus musculus
ctaggccaggaagtccacccagccagcctcactcactcactgaggtttttatgcatgttggcccattggcctgg

SEQ ID NO: 85030 - DNA, 66 bp, Mus musculus
gctagagggcctggagagacagctcagtggttaggagcactgactgctcttccagaggtcctgagt

SEQ ID NO: 85031 - DNA, 72 bp, Mus musculus
tccagccttgtcagaagagggtgtggtcagataacccccaggatatctgtattacttgaggtgaaggatgga

SEQ ID NO: 85032 - DNA, 74 bp, Mus musculus
ggtcctgggatgtttaagaaagtaagagagcaagtcaataagcacggctttcccactgtctctgtttcagtgcc

SEQ ID NO: 85033 - DNA, 68 bp, Mus musculus
aacctttcactctgtctgtctgaaagctgcagctcttctgttgcactgtggaaacagaagatcaggtt

SEQ ID NO: 85034 - DNA, 97 bp, Mus musculus
gtggcctgtggattcttgccgttctggtacgcttctgtcaggctgctccacctgtgagcactgtctcagtgtatctgtgtcaaggtattcacactat

SEQ ID NO: 85035 - DNA, 64 bp, Mus musculus
gagaggctctgagaacagagtctggctactcaagaggttggacaaggctttcccagatgccctt

SEQ ID NO: 85036 - DNA, 70 bp, Mus musculus
gtgtatgctcagaggtgtgtgtgtgtatgtgtgtgtgtgcacgtgtgagtgtgcatctctgtgtgtgtgt

SEQ ID NO: 85037 - DNA, 74 bp, Mus musculus
agagttgagagagctcctgtggtggctgagggttgcaggtgcagctttggccaacagagaactctgtgagaact

SEQ ID NO: 85038 - DNA, 87 bp, Mus musculus
ctgatggcccagggcaagtttcactcagcctctgtgtcaccatctggaaagtgggagcacggggctcttccttgcagggagagttag

SEQ ID NO: 85039 - DNA, 78 bp, Mus musculus
gatgcagagactgtcactgtgtggtaaggggcatgcacatcctcctccagagctcctaagcactagggtacaggcatc

SEQ ID NO: 85040 - DNA, 123 bp, Mus musculus
actttctttgtatttgtgtgtgtttttgtgtgtgtacatgcatgtgtgtgcatgtgcctgtgtgtctgtgtgtgagggccacatgtatgtgggcactgtcagaggccagaagaaggtgttgga

SEQ ID NO: 85041 - DNA, 112 bp, Mus musculus
acaggtgagcagtgtcagaagggaatcgaggaggtggagagccttgctgaactcaggctcagtgtgtctgtgggcttcactgctggtggttgcgtcttatgtttgtttgtct

SEQ ID NO: 85042 - DNA, 122 bp, Mus musculus
gtatgtacgagtgtggcagtgctcagttatcttatgtatgagtgtgtatgagtgtggctgtgctcagttatgtgtgtgtgtgtacgagtgtggctgtgctcagtaccacagtgctcaggtag

SEQ ID NO: 85043 - DNA, 70 bp, Mus musculus
ctgcttgggaagactgagtctgtcattcggtcacactgaggaagaagaatcagtcagttaccctgaggag

SEQ ID NO: 85044 - DNA, 120 bp, Mus musculus
gcccaggctcacatcaaactcctggatttaagcaatcccacctcctcagtctctctgtgcctggcctaggtggagttacctataagacaggtggtgttcttagtgttaatggcgtctggt

SEQ ID NO: 85045 - DNA, 114 bp, Mus musculus
gttcctcaaaatcattttggtcaggctggagagatggctcagcggttaagagcactgactgctcttccagaggtcctgagttcagttcccagcaaccacatggtggctcacaac

SEQ ID NO: 85046 - DNA, 75 bp, Mus musculus
ggtgaaagaggtgtgacccggagatgggctttgaggtttcaaaagcttatgccaggctctgtctctctctctgcc

SEQ ID NO: 85047 - DNA, 73 bp, Mus musculus
gctcactcagtgtctctgtggagcttagtgggagggaaatcactcaacatgtgtggagccctgggttcagagc

SEQ ID NO: 85048 - DNA, 81 bp, Mus musculus
tgctgagataccagtggggtaccaggggaacccttgaggtctccttgaggtgattgttgtctggtcttgatgttctcagca

SEQ ID NO: 85049 - DNA, 70 bp, Mus musculus
aggggctacaggcccagaactggaatcactgtgaggtccacactgtggttctgtcaggggcacagcacct

SEQ ID NO: 85050 - DNA, 90 bp, Mus musculus
tccgtgtgtgtgtgtgtgtgtgtgtgctagtgcatgtgcagtcatgcaagtagatataaagaaaatttaaacagaaataaaagagccggg

SEQ ID NO: 85051 - DNA, 108 bp, Mus musculus
gttttgtcctggttgtcctggaactcactctgtagaccatgctggcctgaatctcagaagtctgcctgtctctgcctcccaagttctgggattagagggattagtgac

SEQ ID NO: 85052 - DNA, 63 bp, Mus musculus
tccactgtcagaggcaagagacacctcaggcagagcaggacttctcttgtctctggctgtgga

SEQ ID NO: 85053 - DNA, 68 bp, Mus musculus
catcaggaacagagtgggagctcagtgagacttgcttgctgactcactggctcactcccaccctgatg

SEQ ID NO: 85054 - DNA, 75 bp, Mus musculus
aattcagcaaggaccctgggctgggctgggctgggctggcctgatcagttaggttaaaggttgattagttgagtt

SEQ ID NO: 85055 - DNA, 93 bp, Mus musculus
agagagaaagagagagagagagagagacagacagactgtgagtgtacatgccccacagtgtgcatgtgttttctcttttctactatggcttct

SEQ ID NO: 85056 - DNA, 91 bp, Mus musculus
atgcacatatatatacacacatatatgtatatatacatatatatatgtataaaacacacatacatatagatgtgtgtgtctgtgtgtgtgt

SEQ ID NO: 85057 - DNA, 88 bp, Mus musculus
acaaatgacatcagttctagacgagcacagagtaagtggttctaaagctgtacggtgtcattctgtctgtctgtctgtttgtctctgt

SEQ ID NO: 85058 - DNA, 113 bp, Mus musculus
gagttaagagccatcttgatgggctggagagatggctcagtggttaagagcactgactgctcttccagaggtcctgagtgcaattcccagcaaccacatggtggctcacaacc

SEQ ID NO: 85059 - DNA, 77 bp, Mus musculus
agatacagtacattatcgtgtgaaaggcacagcggcagggtcaggaggcagctggtcacattcacactgtgtctatg

SEQ ID NO: 85060 - DNA, 156 bp, Mus musculus
gtgtgtgtatgtgtacatgtgtatatatgtatgtgtgtatatatgtgcaaatgtttctgtatgtgtgcatgtgcatgtatgtatacatgtatatatatatgtatacgtgtgcatgtgttcatatgtgtgcatgtatgtatatatgtgtgactgtgt

SEQ ID NO: 85061 - DNA, 110 bp, Mus musculus
acagtaaatgggtctgtgcacatgatcgctttctcagtgtgtttgttgtgagtgaataaaaaggctgctgatttttgtaagttgattttgtactctgccactttagttgt

SEQ ID NO: 85062 - DNA, 76 bp, Mus musculus
tggccgtgctccagctccagtgtatggtcccacacccagaagtacacagacagcacagactggggacaataagcca

SEQ ID NO: 85063 - DNA, 66 bp, Mus musculus
gtctgtgtgtgtgtatctgtgtgtgtagcgtgctttcatgatccatcagccgatagacatccagac

SEQ ID NO: 85064 - DNA, 81 bp, Mus musculus
gccccgctccctcgctgtgtcccaaagatttatttatatgtaagtacactgtaggtgtctttagacacacgggaaaggggc

SEQ ID NO: 85065 - DNA, 120 bp, Mus musculus
ggttagctattattattttctaaaggcaagtgtgtataattttatatttatatatacacattttaatttatgtaaatgtgtctgtgtctgtgtgtatgcactatgtgggtgagggtgacc

SEQ ID NO: 85066 - DNA, 80 bp, Mus musculus
ccagaccctgactgagtctccctgactgtctctggggacactgccctaagctacccagggtgtacctaggtggggtcagg

SEQ ID NO: 85067 - DNA, 62 bp, Mus musculus
gtgtctctgacaccttcctgtttccttcctgcaatggggcacggtggagagtcacgagaagc

SEQ ID NO: 85068 - DNA, 143 bp, Mus musculus
ctatatgtgtatatgtacatgcatatatacacgcacgcgtgtgtgtgtgtatgtgtgtgtgtgtgtgtgtgtgagagagagagagagagagagagagatttttaaaggcatttctctgtgtccctgactgtcttagaactcac

SEQ ID NO: 85069 - DNA, 97 bp, Mus musculus
gcaatcccagtctacttcttgcaggctaagtgatcctggacaaggcacccagtctctctgtgtctctgctggtctataaggtgatggatgggtttgt

SEQ ID NO: 85070 - DNA, 76 bp, Mus musculus
tatggtccccctctctctgagtgtgactctgctgccctcagccccttctgctttgccagactgaggagccaccgtg

SEQ ID NO: 85071 - DNA, 62 bp, Mus musculus
gttaaggtctggagagacggctcagcagttaagagcactgactgctcttccagaggtcctgc

SEQ ID NO: 85072 - DNA, 78 bp, Mus musculus
agtcaactagataggatttacagtcacctagaggtgagtctgggagacacatgtgagtgatcagtgtctggcatgact

SEQ ID NO: 85073 - DNA, 116 bp, Mus musculus
actttattgaactatagacaatagaagaaaagctatttttccatttgttgactatactggaaatttttttctatttactgtgggaaaatggttctaacaagtatgtagcatagggt

SEQ ID NO: 85074 - DNA, 75 bp, Mus musculus
tcacagaatattcatatgtatatatttatgcatatatgcatatatgtatgtatgtatgtataacttgtggaggca

SEQ ID NO: 85075 - DNA, 85 bp, Mus musculus
gcatttatttatttcatgtatctatatatattgtatgtgtgaatgcatgctggagtatatatattgtgtatggggggatgtgtgc

SEQ ID NO: 85076 - DNA, 79 bp, Mus musculus
acttctgttagtttcactgtgtctctgtttagtttctgtttccaggatctgtccattgatgagagtgggatgttgaagt

SEQ ID NO: 85077 - DNA, 112 bp, Mus musculus
gctgggatgtagctcagttggcagaatatttgcctagtgtgcacgaagctctgagttcagtccctgtcactatgtgaaactgggcatggtggtgcaaacctgtaattccagc

SEQ ID NO: 85078 - DNA, 101 bp, Mus musculus
gtggaccccaagaggctggagagatggctcagcggttaagagcactaactgctcttccagaggtcctgagttcaaatctcagcaactacatggtggctcac

SEQ ID NO: 85079 - DNA, 81 bp, Mus musculus
gagggtggtagacacacttcacagtgtgcactcggttaattataaatgagcatacatagtgtatgtgtgaacaacattatt

SEQ ID NO: 85080 - DNA, 84 bp, Mus musculus
acccatctcgagaactgaaactagatgcatgttgtccttcccttgcccctacagctgttcctctctctgtctctgggactgggt

SEQ ID NO: 85081 - DNA, 70 bp, Mus musculus
gagctcctggggctggagagatggctcaggggttaagaccactgactgctcttccagaggtcctgagttc

SEQ ID NO: 85082 - DNA, 64 bp, Mus musculus
agatgaagcactgactctgcctgtctgtgatctccccagagacaagagcagccatgcttttcct

SEQ ID NO: 85083 - DNA, 117 bp, Mus musculus
tgtgacctttccaatctgttgcttctgatcttgggtttcttgccagctttttctggaatggtctgactgactcacaatttccctgtggctgtgtatcttacatgaagcaattacaca

SEQ ID NO: 85084 - DNA, 83 bp, Mus musculus
ccagcgttccagagaagagactggctgggcaaggggctctcaagtggcagaagagagacagcagtcagcctgcctgggcctgg

SEQ ID NO: 85085 - DNA, 65 bp, Mus musculus
ccggtgctggggagtatggacaccttgcaggggcgtcagttcagagtgtgcagatcgggcgcggg

SEQ ID NO: 85086 - DNA, 74 bp, Mus musculus
gtttgacagtcacgctctgtcttgctcttgagcttgtaggctaggctctgaacaagtcattggctgttgtgaac

SEQ ID NO: 85087 - DNA, 95 bp, Mus musculus
gggaagacgctaagaagcaggccttcgagggagagatggctcagcagttaagagcactgactgctcttccagaggtcctgagttcaattcccagc

SEQ ID NO: 85088 - DNA, 103 bp, Mus musculus
gtcacctttgtttatccaggtttcccaaatccaacctgggtgttcacagaacagagagaggtgatgcaacagcaggggggggcagagctggggtggggggagc

SEQ ID NO: 85089 - DNA, 87 bp, Mus musculus
aaactatagaccaatctccctgatgaacatagacacaaaatttcttgattttttgttctagactatattgaggggaaagtcttgttt

SEQ ID NO: 85090 - DNA, 70 bp, Mus musculus
gctgtcagcagcaggtggcacagtggcagctggacctcccagtctcactctgtgcttcccctgccccagc

SEQ ID NO: 85091 - DNA, 56 bp, Mus musculus
catgcctcatcacatgtgtgtgtgcacacatacacacatgaatgaatgaatgaatg

SEQ ID NO: 85092 - DNA, 106 bp, Mus musculus
agtgcagacttggagagctggttcaaaatggcgtggaagacagagtgaagacagactggagtttttcatggtggttacagaatactgctaagtctagggaatggct

SEQ ID NO: 85093 - DNA, 85 bp, Mus musculus; identical to SEQ ID NO: 57439

SEQ ID NO: 85094 - DNA, 118 bp, Mus musculus
tgtctatggttaacaagatatatttttagagaacatcttttccttatgggaactagatttcattttatttcttaaaagaaaaatgagttttcctattctcttgactggaattaagaca

SEQ ID NO: 85095 - DNA, 81 bp, Mus musculus
tccatgtgtgcctctgtgtgtgtgcgcgcgtgtgattcagatgaagctctaacagaaatgtgcacaggaagcagaagcaca

SEQ ID NO: 85096 - DNA, 136 bp, Mus musculus
catctttcttggtgcagacattctgtggtttcccagtggagaggaaggcagggactcatcagaagagagactgaacacactgcaatgctaacggcccctctgaactcggttgctgattgcggtgtcttttgccctt

SEQ ID NO: 85097 - DNA, 88 bp, Mus musculus
ctgagagtctccataagaccagcaagtaccacaggcctctaggtagcttctagagctttctgtcactctcagttttttggagatgcag

SEQ ID NO: 85098 - DNA, 83 bp, Mus musculus
cttggtggtctcttctgtctctatatctgaagtgatgctagaccttttagctcactcttgcatttggtgacacggccattttg

SEQ ID NO: 85099 - DNA, 90 bp, Mus musculus
ctaccaggtaagcaacatcccaaactctagacaatgttttttattatatatacagtgtatatagttagggaagttttatttactaggaag

SEQ ID NO: 85100 - DNA, 77 bp, Mus musculus
tatgtgtgtatatgcatgtgtatgtgcacatatgtgtgtatgcatgtgtgtgtaggcatatgcacatgtgtgtgcac

SEQ ID NO: 85101 - DNA, 97 bp, Mus musculus
ggaaagtatctgagcatcagagagaagtcagattgcacaagtttcccttgtctatacagtcactcactcggcatgcacgggctgtggtttactttcc

SEQ ID NO: 85102 - DNA, 89 bp, Mus musculus
gggtagaagaaagaagcaggggggctagagaggtggctcagcagttaagagtgctgactgctcttccagaggacctgagttcaattccc

SEQ ID NO: 85103 - DNA, 67 bp, Mus musculus
tacatatatgatgtatatgcatatgatgtatgatgtgtatatatatatacgtatacatatatgtgtg

SEQ ID NO: 85104 - DNA, 109 bp, Mus musculus
aacatcatatatgtatatatgtataaatattgtcaacatacatgttatatataaataaatactgttaacacacattataatatacatgatatacatgtatgtatatgtt

SEQ ID NO: 85105 - DNA, 72 bp, Mus musculus
gtgctctatctgcatgtacatctgcttgccagaagagggcatcagatcccactatagacggttgtgagctac

SEQ ID NO: 85106 - DNA, 79 bp, Mus musculus
ttggacttggcctacacttccagactgcagactgccattgtggaactgttagcctctgtgcctgtctgagccagtccaa

SEQ ID NO: 85107 - DNA, 67 bp, Mus musculus
agccttgtgtgtcatctgtgggtctgtccgactgtccccagaggatgggctcagatgagatttggtt

SEQ ID NO: 85108 - DNA, 98 bp, Mus musculus
taagaatatgtgggctgcagagatggctcagagtttgagagcactgactgctcttccagaggtcccgagttcaattctcagtaccacacagtggctta

SEQ ID NO: 85109 - DNA, 111 bp, Mus musculus
gctcgtatgaagatgggaatagaaggacactcccaggagcaacaaaggcagaagacaaagtcagtgactctcagagcatcttttaatattcttttgaactttcattgcagc

SEQ ID NO: 85110 - DNA, 66 bp, Mus musculus
tttgttcagatgggaatgtgtgtgactatgctgccatgggtgaggcacacactctgtctcctcaga

SEQ ID NO: 85111 - DNA, 83 bp, Mus musculus
gattgctaaccagactcatcaatctctcagcctgtgtgattccagttcttggctcagagcaatggtggtggttccatgcagtc

SEQ ID NO: 85112 - DNA, 86 bp, Mus musculus
gcatgactgtctgactgaagaaaggagtgtggcaccctcttatgcaaaggagatgtcacattttttttttaaagcagcacccaagc

SEQ ID NO: 85113 - DNA, 114 bp, Mus musculus
tgacggactgtgatgaagacatttaagttctgtttgccccaagttgctattgatctcccagtcacagcaacaggaactgtaactaagacgcctgccttcccacagaacacgtgg

SEQ ID NO: 85114 - DNA, 60 bp, Mus musculus
cgtcgggccagtccatcaggagagggcctgcctgcccgcctgcctgcctgcctgcctgcg

SEQ ID NO: 85115 - DNA, 120 bp, Mus musculus
gcctccatcagattggactgtagagagctctgttgggacattatcatcatcatcatcatcatcaaattaatatgttaaggcccagctcactgggtgcagtgccacctctggttaggaggt

SEQ ID NO: 85116 - DNA, 88 bp, Mus musculus
tgagtgcttaatttacatgacagaagagagtgtcagatccattacagatggttgtgagccaccttgtggttgctgggaattgaactca

SEQ ID NO: 85117 - DNA, 95 bp, Mus musculus
gatccttagaaatgtggcagtcatgatgcggggagtcttgtctgtctgacttcatttccgttgtccttcagtgactacataaagaagccaggacc

SEQ ID NO: 85118 - DNA, 90 bp, Mus musculus
tttggcactgagtgtccaactctgtatctctctgtcttattgccttgagacaggatctcttactgagcctggagctatacgcagtctgaa

SEQ ID NO: 85119 - DNA, 113 bp, Mus musculus
cacaggacaagctttgggtgctagtcctctcatgtacaccttgtttgaaatagagtcttgtcactgtgtcagccaggcttgctggcctctgagagtctctctttctccatagg

SEQ ID NO: 85120 - DNA, 86 bp, Mus musculus
caggtgaggtctctctctctctgtggcagaactgtgttttattcggtggtctgtggctccaagtgagatggaagagaagcttcctg

SEQ ID NO: 85121 - DNA, 199 bp, Mus musculus
atatatatgtattgtgtgtgtgtatgtatatatatatatatatatatatatatatatacacacatatattgtgtatatgtgtgtatgtatgtatgtatatatacatatgtgtgtgtgtgtatatatatatatatacatatgtatatatatatatatatatatatatatatatatatatatatgtatatatatatatata

SEQ ID NO: 85122 - DNA, 68 bp, Mus musculus
cctagggaggattgttgtgtgctaggaagctccttagagagcaactggggaccaggaatctcactagg

SEQ ID NO: 85123 - DNA, 85 bp, Mus musculus; identical to SEQ ID NO: 57439

SEQ ID NO: 85124 - DNA, 71 bp, Mus musculus
atagaagactctgagtgtctctgtgttttggctggaatctgcctcacaggggcaggtgtggggttttctat

SEQ ID NO: 85125 - DNA, 113 bp, Mus musculus
tgcctctctgctgtatgtgtttgaaagtggcctcaatatatgtttttctttgttctgtaaaactataaaatttcatgaaactgcttccacattggaacatgggatttgaggta

SEQ ID NO: 85126 - DNA, 83 bp, Mus musculus
gagaaggagcttactctggattatctagtgcaggagatgtttagtctgcacataggctgagtacacagtgagctcatgagatc

SEQ ID NO: 85127 - DNA, 70 bp, Mus musculus
attatctcaaaggatagtagagaagtttctattagatggataaaagaaaatctgtactttccttgatgat

SEQ ID NO: 85128 - DNA, 86 bp, Mus musculus
catggcagcggttaatgtgtctctctgagtctgtatttcctggatattaggagctgcatctagaggcttaatctgacttttgtttg

SEQ ID NO: 85129 - DNA, 76 bp, Mus musculus
tgactctgattctctgtgtgttgctgaggctgcagagcggagcatctgctggctatccacacaagaagagggagca

SEQ ID NO: 85130 - DNA, 66 bp, Mus musculus
ggcctaggctggctggccaatgagttcagaaatctgcctctctgcctgtctctgcctgtctctgcc

SEQ ID NO: 85131 - DNA, 116 bp, Mus musculus
gtgtgaatatatatatgtgtgtattataaatatatgcatttgtatatatgcctgtgtacatcaatatatgtatatatgtatgcatctgtatataataaatgtatatatatgaacac

SEQ ID NO: 85132 - DNA, 116 bp, Mus musculus
cggcagggagtgagcgtggtgaagcggtgagtaggggaggttggcagctggcaacaaaggccagtctgctaacaaggagcctggctccctgctctcaggttgcttatccacagtgg

SEQ ID NO: 85133 - DNA, 73 bp, Mus musculus
gacaggcctgtagagtaaggggcatggagaaccaagggcaaagggccttctctgtccctctgccagtctgtca

SEQ ID NO: 85134 - DNA, 119 bp, Mus musculus
atatatgcatgtacatgcctttgttaatatacatagtgacatatatatgcatatatatgtgtatatatatgcagtaataagtatgagtaccttcctgggcatgtgcacacatgtatgtg

SEQ ID NO: 85135 - DNA, 104 bp, Mus musculus
cagagagacagatcgagacagagacacagagacatagagacacagagacacagaaaaagaggtcatttgcatcttagtgggtctttgttactctgggactcctg

SEQ ID NO: 85136 - DNA, 65 bp, Mus musculus
aggctgtaggtagggcataaacatgggaatcagacacagtttctgagtcaatggacttgcagtct

SEQ ID NO: 85137 - DNA, 102 bp, Mus musculus
gctggtttctatgcctgcagagttgagtgtagactggactttggtattattattcatatggctacatcttgtaaacactccctctctaacattctgattggc

SEQ ID NO: 85138 - DNA, 92 bp, Mus musculus
ctctgtatcatctcccaggaaggatggaggtggattagaggggccaatggctgcccactgctcagtctctttctgccagctcatgatgagag

SEQ ID NO: 85139 - DNA, 82 bp, Mus musculus
cttcttgtttattttattttatttgatgtgtgtatgagagctttgcctacatgcacatatgtgcacagagtgtccacagagg

SEQ ID NO: 85140 - DNA, 134 bp, Mus musculus
caagagcccagaacaagactgtgtccatgggggggcaggattacataagaggaacatggctggctcactgtttgcctcacctggtctggtctgtgggagcacttgcctgtaccgtgtggatggagctctaagcc

SEQ ID NO: 85141 - DNA, 83 bp, Mus musculus
tccatggtggtctgataggatacatgggacaatttcaatatttttgtatctgttgaggcctgttttgtgaccaattatatgga

SEQ ID NO: 85142 - DNA, 102 bp, Mus musculus
tagaacctgcccagtagttcacaggtatccacttgtctctgtctctccaactttgagattacgtgtatgtgccaccactcttagctatgaggtttggttttg

SEQ ID NO: 85143 - DNA, 61 bp, Mus musculus
tgtgtgtgcatactatgtatgtatatatgtatgtatgtatgtatgcatgtatgtatgtata

SEQ ID NO: 85144 - DNA, 97 bp, Mus musculus
ggcactcatcgcatgaacatttcagtggatggatgtggacaccttaaatgtgaggtactgcatcaccatctggaggttgcaccctggcagtgaagtc

SEQ ID NO: 85145 - DNA, 80 bp, Mus musculus
gggggagcaaggccacatttgtgtctgtgactggagctggtgcttccctttgacaggctcaaggtggcccttgcttttgc

SEQ ID NO: 85146 - DNA, 86 bp, Mus musculus; identical to SEQ ID NO: 46308

SEQ ID NO: 85147 - DNA, 114 bp, Mus musculus
cactcatcgtgtccactcggatagactgatagttgaagatgcaggcgccaccactacttcattgtttatttattattagtatgtctatagtgtgtgtgtacagagaggtgagtg

SEQ ID NO: 85148 - DNA, 89 bp, Mus musculus
ggtggatctctgtgagttctaggccagcctagtctatatatatatatagagagagagttctagacagccaagtttacacagagaaaccc

SEQ ID NO: 85149 - DNA, 88 bp, Mus musculus
accccccccatgggttcatatatttaaatatttggtccccagttagtggaccagttaggaatatgggtgtggctttgttggagtgggt

SEQ ID NO: 85150 - DNA, 68 bp, Mus musculus
cttcactgatcacactggagtactctggcccattcctctctgggctctgtgactcagtgacagtgcag

SEQ ID NO: 85151 - DNA, 112 bp, Mus musculus
tggtgtggctctactacattatccttatgatctaccactcaagagcccagacagatgagagagtgccacggcatccctggctttgatcaaaagaaagaaatcacagtgccac

SEQ ID NO: 85152 - DNA, 94 bp, Mus musculus
aggagccattataacggcatggggaggggaggggcaggtagactctacagactcaggactctatggcagctcttctcttttgtattgatctctt

SEQ ID NO: 85153 - DNA, 118 bp, Mus musculus
gtgcatctctcaggagcttgctgaagatggagacaggagagagtattcagacagaggagacagagctgggcatgacttctttcccactgtggcctaagataaccctgagttaaggtat

SEQ ID NO: 85154 - DNA, 61 bp, Mus musculus
ggatgtttgcatctgctgaatggcagctctgggagctggcttcatgcaagtgagacagacc

SEQ ID NO: 85155 - DNA, 131 bp, Mus musculus
cccaggcaaggaagtgaggtgtagaaggcacaggaaggatggcaacttctggggctctgggactctcagtctgtgtatgttgctgtaacagaataccaaagactgagtaacttactaagaaaagaagctcc

SEQ ID NO: 85156 - DNA, 123 bp, Mus musculus
gcacttcccctttcttccctgagctcccgaaagcaagggtctctggagtgaagaaactgtgcactcactcacaagggaggcatcattgtggtttccggagcaaaaagtgggtgggaggcgggg

SEQ ID NO: 85157 - DNA, 68 bp, Mus musculus
gtatatgtatatatgtatagatatatgatgtatagatatatgatgtgtgtatgtatgtatgtatgtat

SEQ ID NO: 85158 - DNA, 85 bp, Mus musculus; identical to SEQ ID NO: 57439

SEQ ID NO: 85159 - DNA, 89 bp, Mus musculus
cagataaagtaaatgacagactgtctctatctccctggggttcccatctcatgagcagagctgttccacactgtcattggtgttttctg

SEQ ID NO: 85160 - DNA, 116 bp, Mus musculus
ggattaggaggtgtggcttttcagagtaggtgtggctttgttggaggaagtgtatcactgtgggtgtgctttgaggtttcaaaagctcatgccaggtctgattctctctcttagcc

SEQ ID NO: 85161 - DNA, 112 bp, Mus musculus
ttctagtttcttcagatggctctgctgtccatatcctacaaagatcatgtttttgagactagatactcaccaaggattatctgaaggaatactattcatctattttctggaa

SEQ ID NO: 85162 - DNA, 138 bp, Mus musculus
gtgagaaccagttcaactcaaacacgaactttgtttattatattgccctaggctaagagtagacagtgttgacagttgcttcactttccactgctcttgtttttattcgccccggtgaaagatatacacatttaaagt

SEQ ID NO: 85163 - DNA, 87 bp, Mus musculus
cacaacacttgtacacatgtgtttatttgtatatacatgaacattggtgtgattgtgtatatgtttgtgcatctgtatcagtatgtg

SEQ ID NO: 85164 - DNA, 70 bp, Mus musculus
gtgtgtatttctgtgtatgtatgtatttatgtgtgatcatatgtatgtgtgcatgtttgagagtgtgcac

SEQ ID NO: 85165 - DNA, 109 bp, Mus musculus
agtcctcttgtccttgcagattgtgatgcttgttagactcagtcctaagtcaaacacactgtctctggggtttgtcgccaatcttttgagcagggcagacatgagagct

SEQ ID NO: 85166 - DNA, 75 bp, Mus musculus
caacccagttgtttgtttcttagcacagccagaattgacatggtgctacagcagcaattcttagcctgtgggttg

SEQ ID NO: 85167 - DNA, 66 bp, Mus musculus
ggcagtgaagttagcaggctctgtgggcactagcccagggctacagtgcctctctcattctctgtt

SEQ ID NO: 85168 - DNA, 90 bp, Mus musculus
gatatatatatatatatattcaatcaattgagtgtatactatatctatatttatatactcaatcaattgtgtatatactatctatctatc

SEQ ID NO: 85169 - DNA, 69 bp, Mus musculus
gtggacaggctcaagagcggctcggtggttaagagcactgactgctcttgcagagagcctgggttccat

SEQ ID NO: 85170 - DNA, 90 bp, Mus musculus
tggtcatatatgtgtgtgtgtgcatgtgtatgtgtatatatatacccacacacacgcacacacacacacacacacacacatatatacaca

SEQ ID NO: 85171 - DNA, 63 bp, Mus musculus
gcattttgtgtgtgtgcatgtgcatgtatgagagaatgcatgtgtgtatatatgcttgaaggc

SEQ ID NO: 85172 - DNA, 91 bp, Mus musculus
caggtgatgtacctgcatgtgtttgagcatgtgcatgtgtacatgtgcaagcacacatacacacacacatacacacatgcacttttgtctg

SEQ ID NO: 85173 - DNA, 114 bp, Mus musculus
gtcatcatggccatgtcctcgatcttgtcaaacttaggggggttcatggggaagacttggtcactgttcagagtgagctcctgggtagaacgaggaaaagcaaggcgagggtgc

SEQ ID NO: 85174 - DNA, 68 bp, Mus musculus
aggaggttggaggaacacgggacacaggcctggctgggtaacagtctctgagtctgtgactttctcta

SEQ ID NO: 85175 - DNA, 90 bp, Mus musculus
ggaaagtggtttgagtgtgtgattgaaggttgtgttgttaattagagcagggccctgaatgaagcaccttcgtcaagctgtttgctagcc

SEQ ID NO: 85176 - DNA, 68 bp, Mus musculus
catgtgcctgtgtgcacatatgtgtgtgcgtgcccatgcatgcctctgtgtgtgcctctgtgtgtgtg

SEQ ID NO: 85177 - DNA, 83 bp, Mus musculus
gagccatttcaaggtagggtttctgatgcagagtctcactatgtagtcccgactggtctctgcctctgtctgccgctggtctc

SEQ ID NO: 85178 - DNA, 75 bp, Mus musculus
gagctcttatctgagtggccagtttgaaccacttgacagacacaggtgtttttcttgttgtccctcagtttgttc

SEQ ID NO: 85179 - DNA, 84 bp, Mus musculus
agaatgacccagcctgttgatgttgctgggtataagatagaagagagtgtgctcatctacacaggctaggaactggggaaatct

SEQ ID NO: 85180 - DNA, 83 bp, Mus musculus
ttagtaaatggatcggggctccttggggaggtcctggtgatagccatgcaaacctcaggctgctttgatctggacctggctag

SEQ ID NO: 85181 - DNA, 67 bp, Mus musculus
tatgtgtgtgtgtgtgtgtgtgtcttgtgtgtcttgcctatgcgcatgcaagtgcacatgcatgtgt

SEQ ID NO: 85182 - DNA, 77 bp, Mus musculus
aggcagggctaagcaggaagcagaacggggggggggggggtgcctgtctctctgtgtatgtgtgtgtatgtgtctgt

SEQ ID NO: 85183 - DNA, 66 bp, Mus musculus
gtgtgtatatgtgcatatgtatgtgtcagtgtctgtgtgtgcatgtatatgtgtgtatgtatatgt

SEQ ID NO: 85184 - DNA, 76 bp, Mus musculus
gcatgcactcttgagggttggggtttttatggctgtttcactagaagggatctgtcaggctctcagtcagtcatgc

SEQ ID NO: 85185 - DNA, 83 bp, Mus musculus
agattgtgctctctccctctgtgtctgccatagtaattaaaattatggatagtgtaaactcagagatagtgctggcatcttct

SEQ ID NO: 85186 - DNA, 79 bp, Mus musculus
gttgaagaggtgtgtctctgggggcagactttaaggttccaaaggactcttgctatccccagtctctgtctctctctac

SEQ ID NO: 85187 - DNA, 75 bp, Mus musculus
gtgcatgagattgtgtgtctgtatgtgtgtctctgtacgcacagagaccagaagaaggcatcagatccccagcat

SEQ ID NO: 85188 - DNA, 105 bp, Mus musculus
ggtaataatcatggactggagagatggctcagcggttaagagcacagactgctcttccagaggtcctgagttcaattcccagcaaccacatggtggctcacaacc

SEQ ID NO: 85189 - DNA, 119 bp, Mus musculus
tctcttgttctgttctatgtctccctttctgcttgcttttccctagaaaggtcagacatgattgaaagctcaggccaaggagaatgggggtatggaaaaaaaaaaacaaagaaaacggg

SEQ ID NO: 85190 - DNA, 88 bp, Mus musculus
agatgcagtgtccttggcagcgaggaaagtctaacagaagtagggagattctattttagttcttcagattgctaaggaaatctgcact

SEQ ID NO: 85191 - DNA, 92 bp, Mus musculus
gcctctgtaatgtctccagtcctcaccttggaacacacacacacacactgcatttattccatgggtgagtgaggaaggactcacagagaggc

SEQ ID NO: 85192 - DNA, 99 bp, Mus musculus
gtcaaaggtaatcaaatggccatgtacatatatacatgtatatacatatatgcatgtatacacatacatgtataaacatatatggccctgtctctttgc

SEQ ID NO: 85193 - DNA, 82 bp, Mus musculus
ctcctctgtgtctctgtgtctgccattcttagagaaaaaggatcatctctgcagcgtggttgtgctctctggaaggaaggag

SEQ ID NO: 85194 - DNA, 81 bp, Mus musculus
atgaactatgactctctcagtgggtgacctgtaaacttcagtgataaactttaaatcccacagtgggtaggttatgttcat

SEQ ID NO: 85195 - DNA, 152 bp, Mus musculus
gttttattttcatttacccctgtgcaggtgagcacatgcctgcctgcctgcctgcctgcctgcctgcccgcctgcctgcctgcctgcctgcctttctgtattcctgtatgctacatgccacctgtatgtggagtgcctgcagagattaggag

SEQ ID NO: 85196 - DNA, 75 bp, Mus musculus
cacaatatgtgaccagatccctcatgttccggctgccacgcccttttcacatgacagactgtgtctctcactgtg

SEQ ID NO: 85197 - DNA, 62 bp, Mus musculus
gcatggtcaacagcagctgctctggccggtctggtagacagagcacagtctgctcactgtgt

SEQ ID NO: 85198 - DNA, 80 bp, Mus musculus
tgagcttacggagaagagtctgtttggggtccgtgggggtggggtgttcttgagccaagactctgagcagtgtgagctca

SEQ ID NO: 85199 - DNA, 92 bp, Mus musculus
ggctgggaatgcacacactggctcacttcagctgttgccactgagcaggagacgagggagggagggtaggcctgtggtgtggagtcccttct

SEQ ID NO: 85200 - DNA, 77 bp, Mus musculus
ctgagggtggaagagtgcctgaggcagctcaagggcagccgggatgtcttggagctatgtctctctctctgtctcag

SEQ ID NO: 85201 - DNA, 65 bp, Mus musculus
gtttgtaggcaagacagatgtgaccgctagctacttgttcagtgcctgcctgcctgcctgcctgc

SEQ ID NO: 85202 - DNA, 62 bp, Mus musculus
acatactatgcttgaggggccatgggtttacagtgggtggctccctctctgcatttgtttgt

SEQ ID NO: 85203 - DNA, 73 bp, Mus musculus
ggacggaccaacagcatggttgacagaactggggccctgagccactcactcagtctgttattgttggctttcc

SEQ ID NO: 85204 - DNA, 68 bp, Mus musculus
gaacaaattatgtatgtatgtatgcatgcatatatgtatgcatgtatgtatgtatgtatgtgattgtc

SEQ ID NO: 85205 - DNA, 87 bp, Mus musculus
ggtggaaagattctggggaaatgcctgatactcctacggccatggtagctgtgagaacagtgtgagatacctctgctcctttccatt

SEQ ID NO: 85206 - DNA, 97 bp, Mus musculus
gggccctgcctctccagcctgaggaaaggatagaagtgtgaactggctgttaagtcgcccctctgcccaacccctgaagtgatggacaagctggtct

SEQ ID NO: 85207 - DNA, 105 bp, Mus musculus
cagaggctccgcaggctgtttccatctctgcgtatctctgtctctctgggggggggggtgactgcaggtcatagggaagcagaaagactacctgcaagttctctg

SEQ ID NO: 85208 - DNA, 74 bp, Mus musculus
atacatacatacatacatacatacatacatgtgcatatgcccatatatatgtatgtatgtatgtatgtatgtat

SEQ ID NO: 85209 - DNA, 80 bp, Mus musculus
ggagactctgtgagcaatgatgtgttgtcagaatgctgtattatcagcatcatttgggaggtgattgagacagggtttct

SEQ ID NO: 85210 - DNA, 60 bp, Mus musculus
tgagacaggatttcactgtgtagtccaagctggccttgaactcacagtctctctgcctca

SEQ ID NO: 85211 - DNA, 101 bp, Mus musculus
tcccagttttgccccttgtagtatcccggagtttccctggtaaccctttgctcaggtgaagcaggccaggtggaagctgaacagaattcaaagaaatggga

SEQ ID NO: 85212 - DNA, 58 bp, Mus musculus
gagagagagagagagagagagagagaggagacacacacacactttatctctgtctctc

SEQ ID NO: 85213 - DNA, 89 bp, Mus musculus
ccttggggcccaggaacagagatcaaagagagctctaggtcgggtatattgttttcctggagatttctttctgtttccatgggaaatgg

SEQ ID NO: 85214 - DNA, 97 bp, Mus musculus
caagaactctagtaatgtctgcctgtctgtctgtctgaaggaaaagttgtcagtctaaagaggaccctcaccagaagccagtcaaggtctcatcttg

SEQ ID NO: 85215 - DNA, 84 bp, Mus musculus
tgctctggggcctcgggctgaataaaaggggagaatcgagctgaacaccagatcgcctctcttcactttctgactccagatgca

SEQ ID NO: 85216 - DNA, 93 bp, Mus musculus
tctgcctctgtatgtgtctgcctctgtgtgtgtctatgtctgtaaagttgtctctgattaacagggcttattggctctattttgaggactgga

SEQ ID NO: 85217 - DNA, 104 bp, Mus musculus
gaaagcttgtcttaatcaagtcatcagtcagtcagtcagtcaataaagtgtttattgttgaaaattactaacttatgattaaaatggatgatgaggctgctttt

SEQ ID NO: 85218 - DNA, 139 bp, Mus musculus
gaagggagcagagtggagtagcagataccaagcctgctttaggccacatgtagatagggtgtgtctgtctgtctgtctgtgctcatcctttaacttgtagaaatgcactcaggggagaggcctgtgctggaaatacaga

SEQ ID NO: 85219 - DNA, 89 bp, Mus musculus
gatccccgaagttgtgtggtatcttctctgacaagttctatagacatcgtgagtgttagatcaaatgctgctgctatggccagtgggtc

SEQ ID NO: 85220 - DNA, 76 bp, Mus musculus
cctggaggccgggcactcacacactgagaggcagcatacccggtgctgacgatgggcgtgaggagcccagcccagg

SEQ ID NO: 85221 - DNA, 88 bp, Mus musculus
tctctgtctgtctgtctgtctgtctttgtcgggcctgggtattgaacctagagctctgtgtttgcttggcaaaaggtactgacactga

SEQ ID NO: 85222 - DNA, 75 bp, Mus musculus
gccttagaagcagggtgtgacgctgcctgtcaccctaggactcaggagggtgcaggaggatcacaagtttggggc

SEQ ID NO: 85223 - DNA, 94 bp, Mus musculus
cttccttcctcttgattatctccagttatgtgcctctgtgtgtgtgtgtatgtgtgctatgcatgttggtgcccttggaggctagaaaaggctg

SEQ ID NO: 85224 - DNA, 66 bp, Mus musculus
ctctttgttctgacttctatctgggtgttgataggcagtgtggatagatcgttggctactgaagag

SEQ ID NO: 85225 - DNA, 116 bp, Mus musculus
gggacttgggggagcggccagctgtgcaccatggcgaggttaataacacccgcgcgtgtctgtctctgtgtctccctcattgccctcctctgcacgtccatccggcctcctgtctc

SEQ ID NO: 85226 - DNA, 64 bp, Mus musculus
gagaaatgcagagggataccattagctgcctgctatgggagtgtgagtctctctgtgtgtgctt

SEQ ID NO: 85227 - DNA, 82 bp, Mus musculus
agaaaggagcttaacatttggtgtttgggtcatttaaaaattagtcttttagagttgaggccaatgtagtgagaccctttct

SEQ ID NO: 85228 - DNA, 115 bp, Mus musculus
ttctgggctgtttctaacagttctgacttgttctttcctgcatacccattcatcttttgtatctttctatgtatgtcagtggctgaataacaacagtcaagttaatcgccctgag

SEQ ID NO: 85229 - DNA, 117 bp, Mus musculus
gacctttttcttcagtgctcaaatgaatggaagcttctttcaagtgaatttgtaaaactgagggattttgaatgtaagtgaacaaattgagaggagttggacactgcccagaaagtc

SEQ ID NO: 85230 - DNA, 129 bp, Mus musculus
ctcagaaagccttgtcctgtgccagtgagttcaaggctatcccccagtctctcttctctcaggctcagtgtatctggttttattttgaggtcttagatccccttggagctgagttttgtgcaggatgag

SEQ ID NO: 85231 - DNA, 105 bp, Mus musculus
gggaactgagctcagtcctctgcaacagcagtatgtgatattaatctttcagggggggcttaagagcactgactgctcttccagattgtcctgagttcaaatccc

SEQ ID NO: 85232 - DNA, 66 bp, Mus musculus
accatcacaagtatgtaaaaatatgtatgtatgtttgtgcatttgtgtgtgtatgcttgtgtgtgt

SEQ ID NO: 85233 - DNA, 77 bp, Mus musculus
tggggatgggaccagccttctttgaccccgggagtctctggggaagttgggggtgggggggagaaggtgacacctca

SEQ ID NO: 85234 - DNA, 86 bp, Mus musculus
atgtatgtatgagtgtatgtatgtatatatgtaggtgtgtgtatgaatgtatgtacgaacgtatgtatgtatgtgtgtgtatgtat

SEQ ID NO: 85235 - DNA, 76 bp, Mus musculus
gtcctgagtctattctggatcccacgccccagatattttcttcttctgatcagtggggttctgaacatcttttgac

SEQ ID NO: 85236 - DNA, 77 bp, Mus musculus
tccttattgtagtcagctggaggcggtagtcggacatccccaaagggaatctgtctctcactctgccagctatagga

SEQ ID NO: 85237 - DNA, 137 bp, Mus musculus
atgaggtcgcgacataacgtgggaaagaggcggctgcgcggcccggagccggctggtctggctgcctccctgtgtcgggcagggcgtgcgagcgagggttccggagagttctggcggtaccactcgcgacaagcagg

SEQ ID NO: 85238 - DNA, 91 bp, Mus musculus
ggtctaagcactgaatgtgcctcgctgtgtgcctgtgtctaggctctgtgcagacagagatgggagatgcaaatagtgaacaggtgttgcc

SEQ ID NO: 85239 - DNA, 133 bp, Mus musculus
tgcttgtctttttgtgttgaagatgtcctggtgattgggtattctccacggtcttgacacagtctgtctctaagcatctggcctttggtaacttgcaaaggtaatctttcttgcctcaaaggccagaagagtc

SEQ ID NO: 85240 - DNA, 111 bp, Mus musculus
ggctactgagttaaattctatgtcacagtttggagcaatggctcagagcactgactgctcttccagaggtcctgagttcaattcccagcaaccacatggtggctcacaacc

SEQ ID NO: 85241 - DNA, 111 bp, Mus musculus
gctgagcgtggcctttaatcttagtgcttggggtacagaagcaggctgatctctgtgagctcaaggctggcttggtctgcacagagttctaggtagtgaggactgaatagt

SEQ ID NO: 85242 - DNA, 74 bp, Mus musculus
ccgtgcctctgtgtgtgtgtgcgtgcatatgtgtgtgtgtgcgcgcgcatgcgtgtgtattacgggagggaagg

SEQ ID NO: 85243 - DNA, 98 bp, Mus musculus
cgcttgggcagtgggcacccgactctcactgactgccagacctcaggcggggcctgcagggaagtgggagcttagagagactgcgacgcgccgaagcg

SEQ ID NO: 85244 - DNA, 92 bp, Mus musculus
cactcacaccccgaaggcgccgctgcctccctcttagcctcgccagcaggcgcacagctgggcccgtggatgggggcaagttcgtgggtagc

SEQ ID NO: 85245 - DNA, 77 bp, Mus musculus
agtttctttgggagactgtgactctgtctatatttatgtctacctgtaggggcagagtggctgactcacagggtgct

SEQ ID NO: 85246 - DNA, 64 bp, Mus musculus
cacagcacacaggcagaggacccagtgcagacttatgccaggtcagtctctgtgagtctctgtg

SEQ ID NO: 85247 - DNA, 109 bp, Mus musculus
tccagaagagaactgactatgcctcctcgcatcccctagggcattggtgtaaagctggagacccactgccccaggtgctgctgggggttgtagtctgacccaactgtga

SEQ ID NO: 85248 - DNA, 85 bp, Mus musculus
ctttatgtgtgtctctgtgtgtctgtatattagcgtgtgcacatgggtgcagtgcctatagatacagagaccagaagctgtggag

SEQ ID NO: 85249 - DNA, 58 bp, Mus musculus
ggggctcaatgggctcaagccaggtccggttggaccactccctgactcactgagtccc

SEQ ID NO: 85250 - DNA, 127 bp, Mus musculus
gcctcccttctgagatctgcccacatcgtgtcttctcccatgacatcctctatgaacacagactcagactgtggctgagagtggatgggataggcaaaagccagttcattcacttgtcaggtgctag

SEQ ID NO: 85251 - DNA, 76 bp, Mus musculus
gtatgtatgtatgtgtatatgcatgtgtttatatatgtatgtgtatatatgtatgtgtgtatacatatatgcatat

SEQ ID NO: 85252 - DNA, 76 bp, Mus musculus
ctcaggttccctctgtgccagtactaggtagggctcttgcacacacagtgacactctgcctcacagagacccagag

SEQ ID NO: 85253 - DNA, 82 bp, Mus musculus
gaccgtgacagcatatatagatttggtggagttgcatgtggactcgaaaatactgtgcattctgtcactgtcactgtgtcac

SEQ ID NO: 85254 - DNA, 80 bp, Mus musculus
ttctcaggttccctctgtgccagcactaggcagggctcttgcacacacagtgacactctgcctcacagagacccagaggg

SEQ ID NO: 85255 - DNA, 119 bp, Mus musculus
cagtgggcacagatggagccatctctgtcccagaattggtgatctgtctgtctgtctgttggtcctgttggttggtccacctttctttccagtggtggctgtattcatatcatctgtct

SEQ ID NO: 85256 - DNA, 79 bp, Mus musculus
gtacctggttgtgatggagtgcacaggcttttggatgctctcactggctgtgtgtatctccactgttagaactgattgc

SEQ ID NO: 85257 - DNA, 86 bp, Mus musculus
gcatgtgtatattatgtgtatatgtacgtgtatatgtatatgcatatgtgtgtatatgtatatgtataatgtgtgtgtgtgtataa

SEQ ID NO: 85258 - DNA, 64 bp, Mus musculus
gtgtgtgtgtatatagatacatagatatctatcaggttctctgtgtgtgtgtgtgtgtagatac

SEQ ID NO: 85259 - DNA, 75 bp, Mus musculus
gctctgtgtcagactcagactctgcagaaaactcctcctcccacagagtgcttcagcacagtttgcgcttagagc

SEQ ID NO: 85260 - DNA, 79 bp, Mus musculus
gaggggaaatgggtaagagtagaaggaagagaccgaagaggagaaaaacctgtctctgtcagtcacccttttcaccctc

SEQ ID NO: 85261 - DNA, 67 bp, Mus musculus
gagagagagagagagaacgtcaatctctggtacatgtgcatgagtgtacagtctgtctgtctgtctc

SEQ ID NO: 85262 - DNA, 70 bp, Mus musculus
gagggacaagcagaagatgaacaggccaagggaagaaacaaatatcccgatctctgtctctgtgtctctc

SEQ ID NO: 85263 - DNA, 116 bp, Mus musculus
tgtgtctagctgcagtactccgtcccagtgttctcaataatgtgtcattattttattatgtagatagaattatcgattgacatttggttagttctgctttatggcttttatgaaca

SEQ ID NO: 85264 - DNA, 113 bp, Mus musculus
agccactgagccagatattgttccacaacctccagtgctgcagagactcctacactgtccctctttctctgtgattatgaacgaaggcaaacctggatgtgagtctggttgct

SEQ ID NO: 85265 - DNA, 109 bp, Mus musculus
tagcctggaagaagctctgttcctccaaaggactgtctgtctgactgtaagctggggctgggaccagaggtggagaaggttctaaggagggaataagaaccaagggctg

SEQ ID NO: 85266 - DNA, 73 bp, Mus musculus
cctagaccgtggggagaggaaggcgctcctgggttagaaagtaggagctctgattttctttttgtattgtagg

SEQ ID NO: 85267 - DNA, 68 bp, Mus musculus
tatatacaggtcgcagtggagatgcgagcacatggaagctgacctgtccgtctgtcaggctgtgtgta

SEQ ID NO: 85268 - DNA, 122 bp, Mus musculus
ggcttcatggtaagattgctacaacttgggctggtgagatggctcagtggttaagagcacagactgctcttccgaaggtccctagttcaaatcccagcaaccacatggtggctgataaccat

SEQ ID NO: 85269 - DNA, 87 bp, Mus musculus
gaggcagaatcacactctgtggctctgcctgactagactttacatgtagacgtgagtaggctccacttgagtgtgtcctcttgcctc

SEQ ID NO: 85270 - DNA, 82 bp, Mus musculus
gtgttatatatatatgtgtgtgtgtgtgcgtgtgtatgtgtatatgtgtgtatgcatgtatgtatgtatgtatgtattacat

SEQ ID NO: 85271 - DNA, 111 bp, Mus musculus
gcatggtgctgcttgcctgcactcccaacactctagagactgagctaagagggtcatgaatttaaagccagatggaatgtgtaaggagttccaggccagcctgggcaacat

SEQ ID NO: 85272 - DNA, 116 bp, Mus musculus
gaaatgctttgtggagcacattctttgtacaaagccattgccgtgcaggtgaggaagaaccttctttacttgtaggagcatcatggttaccaggtgtttgtttatctaaagccttc

SEQ ID NO: 85273 - DNA, 87 bp, Mus musculus
gtaagttgctaagacccaaaatggttgaaatgtatttaggggccactattgaaacatttgagcatttgtatggtcctgcacactgac

SEQ ID NO: 85274 - DNA, 116 bp, Mus musculus
gtcttaggttgccccctgcaacaatgctccttacctgtcatcagaagacagacagcagtggtctgatccctgtcttaggttggtaacatgtccagggagtcttacctgtcattgac

SEQ ID NO: 85275 - DNA, 62 bp, Mus musculus
aggcagagtgctgtggtggtctgtgaggtcagtgagagctctccaccctgctccatctgctt

SEQ ID NO: 85276 - DNA, 85 bp, Mus musculus; identical to SEQ ID NO: 60314

SEQ ID NO: 85277 - DNA, 58 bp, Mus musculus
ggctcagtctggggatgaacagacctgctctctgtttctctcaggctgattgcaagcc

SEQ ID NO: 85278 - DNA, 83 bp, Mus musculus
gcatctacttccttatgttccagttcctctcaccccctgagtgacaatggcttactgaacagtccagggatgtcagtacctgc

SEQ ID NO: 85279 - DNA, 85 bp, Mus musculus; identical to SEQ ID NO: 57439

SEQ ID NO: 85280 - DNA, 85 bp, Mus musculus
catgacaagcactaaagcatatccgaccatgggacctgggaagacctctagtggctcactgtttctgtgtctggtgatgtgtctg

SEQ ID NO: 85281 - DNA, 85 bp, Mus musculus; identical to SEQ ID NO: 57470

SEQ ID NO: 85282 - DNA, 88 bp, Mus musculus
gtgggagtgtgagaggttgatgggacgtggacagagtctctctgcctctgctatatccttttaggtgctttcatgttcatagaaccat

SEQ ID NO: 85283 - DNA, 108 bp, Mus musculus
aggtgtgtcgtggaactcagccccaaaggtggctgtgaatgggcagtgacctgtgtcagtgattctctgccatgtgcagaccacgggggttggggggggggatcactt

SEQ ID NO: 85284 - DNA, 87 bp, Mus musculus
gacatgttctgtagaaaagacagtcattttggggagactctttctctctctctctggaagggtgcttctgcttggtatagtaatgtc

SEQ ID NO: 85285 - DNA, 130 bp, Mus musculus
gaccagtaagcttcagcttcagggcagctggattccggcctgaacttaacctgtctctgggtctctgtctgccctgacagcgccatgctgggagctttcgtgggtaagctaggcagactttgggaatggt

SEQ ID NO: 85286 - DNA, 56 bp, Mus musculus
cttggttccatctgggctttggagagagaacttagaaagcagtgggtggaatgaag

SEQ ID NO: 85287 - DNA, 82 bp, Mus musculus
caccaggctctgtgttcaaaccagggatagtcagagcagtgagaggtgacttctaccctacaggagctcagagtggatggtg

SEQ ID NO: 85288 - DNA, 74 bp, Mus musculus
ggcctcccacccctgatggctgggaatcgggtgctctagagatccctgccccactctgtctctctgggatagcc

SEQ ID NO: 85289 - DNA, 107 bp, Mus musculus
caggagtggagagtggagactggactgggaagagaacacgtggaaaggtggtcaggtaataggttctatcttaatctgctatacctgaggctctgggtgccactgtg

SEQ ID NO: 85290 - DNA, 80 bp, Mus musculus
tttctggctgtgtctctgtatgtggtcccatccgctgcaggaggaagcagttctgaagatgactgggcaaggcactgacc

SEQ ID NO: 85291 - DNA, 109 bp, Mus musculus
gctggggtgtagtggggagccaggaaaagtaaggtgcatgtgtgtgtgtgtgtgacacgcgcacgcgcccgcatgatttttcctattggtcttgcacactgtcctatgc

SEQ ID NO: 85292 - DNA, 111 bp, Mus musculus
tctctaaagagacatgatatgaggcatgtatgtatttcaaataaaaaagggagtttcaatttttcaaagtttatgaaatgaagcagccccaaggcatgtcttgcaatgagg

SEQ ID NO: 85293 - DNA, 63 bp, Mus musculus
cccccacctgtctgctaaggcttgtgtgactcagactcagtgtgagctcagcaggggtggggg

SEQ ID NO: 85294 - DNA, 89 bp, Mus musculus
actcatatgctctcactgtgtcactcgctctattctggctgtagtcaacagtttgttaagatgttacactaggtagctgagagatgagt

SEQ ID NO: 85295 - DNA, 115 bp, Mus musculus
tgtagacttgtatgttcatgggtatctctttctttaggttagggaagttttcttctcattttgttgaagatatttactggccctttaagttgggaatctttgctctcttctatac

SEQ ID NO: 85296 - DNA, 113 bp, Mus musculus
ctctgccttcgtcacaggtggacacagcagcaaggtgctgtcttgaaacagagagaactgactctgcaggcatgctatctgcctctgcttgacttggaaccctggagctggag

SEQ ID NO: 85297 - DNA, 146 bp, Mus musculus
tatatatatatatatatatatatatatatatatatatgtgtgtgtgtgtgtgtgtgtgtgtgtgtgtatacacatatatacacacatatatatgtatatatatgtgtgtgtgtatgtatatatacatatatatatttatacagata

SEQ ID NO: 85298 - DNA, 79 bp, Mus musculus
ggcactgatgaagggctggagagatggctcagcggttaagaggactgactgctcttccagaggtcccgagttcaatgcc

SEQ ID NO: 85299 - DNA, 82 bp, Mus musculus
ggagttccaggctcaagtttgccctgatttgctgtgtgaccttaggtagatagatctatcaccctctctgagtctctcctcc

SEQ ID NO: 85300 - DNA, 82 bp, Mus musculus
cttccttaagatctgctgactcagcctctggctcagtgataccacaacagaccagaacaaggtgaagagtgcttggaggagg

SEQ ID NO: 85301 - DNA, 90 bp, Mus musculus
cttggcagatcttgtcagttgatctatgcctgtgttctgtctggctcagccacagtgggcaggaacagtggaggggatgagggaaacaag

SEQ ID NO: 85302 - DNA, 108 bp, Mus musculus
gtggatatattttagtaaatgagttgtgtgtatgtatgtatgtatgtataaatctttcatgtgtacaatgctatacacatgtatattcaggttgaatatgtattgaac

SEQ ID NO: 85303 - DNA, 71 bp, Mus musculus
gccttatatatatatcataagcatgtacatatatgtatgtatgtacgtatgtatgtatgtatgtatgtggt

SEQ ID NO: 85304 - DNA, 73 bp, Mus musculus
ggagctataaagctataaacagtatgctttttttttttaaaagacagtctctgtatatagtcctgtctgttcc

SEQ ID NO: 85305 - DNA, 70 bp, Mus musculus
aggcacacaagtgcacgtgcaggtacaggagtactctctgctctgtctctgtctgtctgtctgtctgtct

SEQ ID NO: 85306 - DNA, 104 bp, Mus musculus
aggatcatgttctatctgtctgtctgtctgtctgtctatctgtatgtgggagggacatgtgaatacaggtgttggtcagaggacaacttgcaaatattggttct

SEQ ID NO: 85307 - DNA, 78 bp, Mus musculus
ctgttcccagtatgtgagtacagagatagctgagtgggacaaggtgacacatagctatagtctcagcagctggggcag

SEQ ID NO: 85308 - DNA, 176 bp, Mus musculus
tgtgtgtgtgtgtacatacatatatatgtatgtatatgtgtgtgtgtatatacacatacatatatatgtatgtatatatgtgtgtgtatatacacatacatatatgtatgtatatatgtgtatatatacacatatatatgtatgtatatatgtgtgtatatacacacatgtatgtg

SEQ ID NO: 85309 - DNA, 58 bp, Mus musculus
atgtgtgtgtgcatatgcatgtactcgctcgcgagtgtgtgtctgtgtgtgtgtgtgt

SEQ ID NO: 85310 - DNA, 78 bp, Mus musculus
tcatcctcaactgttattatagtctctctctctctctctaagggcctcatccagagtcttgaatgacattgaggttga

SEQ ID NO: 85311 - DNA, 80 bp, Mus musculus
tcaggcccctgggtttctttcactgggcaccgtgagtcgagggtcactctgtgcctcagtctgctcctttccactcttga

SEQ ID NO: 85312 - DNA, 118 bp, Mus musculus
ggtggtggtggtggtagtgatggtagtggtggtagtgtgtataaacggtgggtggctctgtgtttccctgggtccttctgagcacagctattgctaggctacagctagtgtcccagca

SEQ ID NO: 85313 - DNA, 76 bp, Mus musculus
ggcctcgctactcatgctgtcaggcagatgtataggtaggtccctggctgcctgtgtgtgctgtaatcaaggggct

SEQ ID NO: 85314 - DNA, 75 bp, Mus musculus
caacacaaaacagactccatagtgtgtgtgtgtctgtgtgtatgtgtgcatgtattgtgctgtattgtggtgttg

SEQ ID NO: 85315 - DNA, 71 bp, Mus musculus
caccctgatttgcccagtgctgatatttggaaagcagactcctgcctctgtctatggctctgcatcaggtg

SEQ ID NO: 85316 - DNA, 110 bp, Mus musculus
ccatgtttaacatgtgaacagtagccccgagccttccagagagatgacagagtgctagagatgctttcaatcaaatcctggtttcctcctgatcactgtgtgccatctgg

SEQ ID NO: 85317 - DNA, 96 bp, Mus musculus
cagtgagtaaattctgagagagagaaaaaaagcactctattgagggaatgagagtttgtttttctctttaacagttagaaggaagatagttacctg

SEQ ID NO: 85318 - DNA, 94 bp, Mus musculus
ctgtcactgctctgtgtctctctgtctctcttgtgtatgtacggtttatacgtgaggtgtatgtgaatgtgggcacagaggacagaggggacac

SEQ ID NO: 85319 - DNA, 85 bp, Mus musculus
gtacgacaaatgtatgtatgtatgaatgtatgcatatatgcatgcatgcatgcaatgtgtatatacacttgtctgttatatgtac

SEQ ID NO: 85320 - DNA, 68 bp, Mus musculus
ttggttggtcattcagtctctgtgagtccctataggcccaggctagttgattctgaaggttgaccaat

SEQ ID NO: 85321 - DNA, 85 bp, Mus musculus; identical to SEQ ID NO: 57439

SEQ ID NO: 85322 - DNA, 97 bp, Mus musculus
gtaggatgagtggccagtctcttgattttcatgttctgtaagaggctgtgtccaatcaatggttcctatcatgattgtgtgcagtgtccagatggtg

SEQ ID NO: 85323 - DNA, 83 bp, Mus musculus
gtttgtctgtcatctcttggaagtatatttttttttctgaagtagaaatgaagggggacattccagttttgttgactataagc

SEQ ID NO: 85324 - DNA, 99 bp, Mus musculus
tttccttacaaatattctctgtgatattaaatcgattatttcaagtgattgtacattgatttatgtcattatttataactgagattaacagggaggaga

SEQ ID NO: 85325 - DNA, 85 bp, Mus musculus; identical to SEQ ID NO: 57470

SEQ ID NO: 85326 - DNA, 75 bp, Mus musculus
cagtctgttagtctctgtctctttattggggaatttagtccattgatattgagagatattcaagaccaatggttg

SEQ ID NO: 85327 - DNA, 68 bp, Mus musculus
aatatgcatatgtgtatatatgtatatgtgtaagtgcacatgtatatgttatatacatagaacgtatt

SEQ ID NO: 85328 - DNA, 68 bp, Mus musculus
tgtatatagctggttctgttgctgtggctaatataagtttagggacagaagacagacagtagtataca

SEQ ID NO: 85329 - DNA, 85 bp, Mus musculus
ggccatggtggtctgataggatacatgggtcaatttcaatatttttgtatctgttgaggcctgttttgtgaccaattatatggtc

SEQ ID NO: 85330 - DNA, 108 bp, Mus musculus
agaagcaacagcaacagccctaccagcattggcaccagcagcaggaggaggaacagcaacttcatctgctcttgggaatctagtgggtttttttgtttttttgttttt

SEQ ID NO: 85331 - DNA, 119 bp, Mus musculus
tctccatctatggtaattgagagtttggcggggtatagtagcctgggctggcatttgtgttctctcagtgtctgtataacatctgtccagtctcttctggctttcatagtctctggtga

SEQ ID NO: 85332 - DNA, 127 bp, Mus musculus
tgtttctctgtctgtctgcctgtctgcctgcctgcctgtctttgtctgtctctcacagacacagagacacacagacacagacagacaggcaggcagacaaacacacacactaaaacagacacagcag

SEQ ID NO: 85333 - DNA, 119 bp, Mus musculus; identical to SEQ ID NO: 85331

SEQ ID NO: 85334 - DNA, 111 bp, Mus musculus
ggacaaaaaggttttctagatatttcttatggtgtgtgttgactggagcatctggaattaggttgtttattgtagtctttagccagggtgatatggtggacttggtggttt

SEQ ID NO: 85335 - DNA, 90 bp, Mus musculus
gtcacagtagaagtggttgaccacattagggccacagaaatccagcacagacactgccactgtgtgagtcagagcattaatgaaggagac

SEQ ID NO: 85336 - DNA, 68 bp, Mus musculus
gtgtttgtgtgtctctgagtctgattgatgccattgctttgtatcagtaactgctggatacatcacac

SEQ ID NO: 85337 - DNA, 118 bp, Mus musculus
aagagatattaaagaaatgtaattgtttttcttcctgttatttttgcttttagagttgagattttgttcttgcggctatcttaggtttgttgaagaattattttcttgcttttttttt

SEQ ID NO: 85338 - DNA, 76 bp, Mus musculus
ttgatgtcactcatcaaacatgggacagaatggacaagtcagtctgtatgtctgagtcttgaagttgtaatatcaa

SEQ ID NO: 85339 - DNA, 80 bp, Mus musculus
atatatgtatatgtatgtatgtatgtatatgtatatatacatacatatatatatatatgtatatatatatatgcacttac

SEQ ID NO: 85340 - DNA, 74 bp, Mus musculus
tgtaagtggatattttgataggtatgtgtatatatgtatatatacttacctatctaagaatctttctatataca

SEQ ID NO: 85341 - DNA, 64 bp, Mus musculus
cagacaattggggtgggacagctgtccattgctatccatctctgtctctctccctggctgtgtg

SEQ ID NO: 85342 - DNA, 72 bp, Mus musculus
tgtgtgggtctgtgtgtgtgtatgtatgtatgtatgtatgtatgtatgtatgtatgtatttgtgcttatata

SEQ ID NO: 85343 - DNA, 85 bp, Mus musculus; identical to SEQ ID NO: 57439

SEQ ID NO: 85344 - DNA, 117 bp, Mus musculus
agtttaaatagtaaccttgcaaaagatcataactttattttacagaatatatttaaatttttgctaggcatgttttgttttagaaaaggtctatgtagcataggttggccttagact

SEQ ID NO: 85345 - DNA, 98 bp, Mus musculus
ggtttattcagcttacatttccacattgctgttcatcactgaagaaagtcaggactggaactcaagcaggtcaggaagcaggagctgatggagaggcc

SEQ ID NO: 85346 - DNA, 125 bp, Mus musculus
ttggaagtcataggcctggctggtggcctgctgtggcttggatgccagtctctctgactgtcagtgggtctttcccctggaccgcagctgctggggaaagattgaggccagaaaggaagtctggc

SEQ ID NO: 85347 - DNA, 125 bp, Mus musculus
agcctgaccacatagctagtcagggttgatgctgggagtgaagttcaggcctgtcagacactcacactggtgctcttgtaagtctgtctccctccctcaggctggcgctcggctctctaacatgt

SEQ ID NO: 85348 - DNA, 80 bp, Mus musculus
gtccacttctgtctgtccatctgtctgtctgtaggcaagtctacagggcatttcttgattcatggttgatatgggagggc

SEQ ID NO: 85349 - DNA, 80 bp, Mus musculus
gcagcaatgccacaactctctctgtgtctgtggataaaacagcagcaaaacctcaggcaggcttagtggtgggcacctgc

SEQ ID NO: 85350 - DNA, 105 bp, Mus musculus
caaaaaaaaaaataagtatgcctatgcctatgcctgtctgcctgcctgcctgcctggccagccagaaagcagcatcctggttcctgtcatgcttctttgactgtg

SEQ ID NO: 85351 - DNA, 83 bp, Mus musculus
ctgaaagtgaggctgtctctgaagcatacatccatatgttttcatgtatgtattaaagaaagttggcgtgacagttgcaccag

SEQ ID NO: 85352 - DNA, 72 bp, Mus musculus
gtccgtccgtccgtccgtccgtccgtctactgttgctaagcattagtctgggaagaggacatagggatagac

SEQ ID NO: 85353 - DNA, 79 bp, Mus musculus
ttgtttttacttttaattatatgtatgtatatatggcatgtacgcacatgtgtatatgagtgagtgagtgagtgagtga

SEQ ID NO: 85354 - DNA, 106 bp, Mus musculus
acagaactggctttcaaaaattcttcctacagtgcattcatgttcacagtgcatacagtgcagtgtgtgtatgaatggatggatgaatgtatgtatgtatgtatgt

SEQ ID NO: 85355 - DNA, 65 bp, Mus musculus
gtgagaagactgagtctcagccactgtcagacaccagctaacggcacctgctcgagtcttttcat

SEQ ID NO: 85356 - DNA, 70 bp, Mus musculus
ccagtcacttcagagctccagctgtctacactgggctgtcacagtgtagagagtgtgcagtgctggctgg

SEQ ID NO: 85357 - DNA, 70 bp, Mus musculus
tgacaagcctgagtctcaggcactcacaaaaatggacggaagctaatacagtggttgggaagggccctca

SEQ ID NO: 85358 - DNA, 115 bp, Mus musculus
tatattcataaggccctggcttcagtgtccattgcagacagatatgtgtgtgcactcatgtgcacacacacatatgggggaggagggtgggggggaaagggaatgattgaaggtg

SEQ ID NO: 85359 - DNA, 111 bp, Mus musculus
ggtcattcctatacctctgtataggttgagctcacagggacacaaaatgctgtctgtctgtctccctcagcactgtgcttcttgttcggccaaacaagaggtttagaggcc

SEQ ID NO: 85360 - DNA, 86 bp, Mus musculus
tgtttggttgtgagtctctgtatctgtttctgtcagctgctgggtggagcctctcagaggatagttatgctaggctcttatctgca

SEQ ID NO: 85361 - DNA, 86 bp, Mus musculus
gcctgcatgtatgtatgtatgtatgtatgagggtgtcagatcccctggaactgaaattacagacatttgtgagctgccatgtgggt

SEQ ID NO: 85362 - DNA, 91 bp, Mus musculus
gggcagcgcgccggcaccttggctctagactgcttactgcccgggccgccttcagtaacagtctccagtcacggccaccgacgcctggccc

SEQ ID NO: 85363 - DNA, 101 bp, Mus musculus
aggttgcctgactgctcccctgcctgccctgggactcagcccctctctctgcctgtgactgcctgagccagcacagagctaggagactcttgtcacagcct

SEQ ID NO: 85364 - DNA, 77 bp, Mus musculus
tagtcagacagacagacagagaggcagacagacagagatactgggaatgtcgtagctatttgtagagtccaggacta

SEQ ID NO: 85365 - DNA, 74 bp, Mus musculus
ctttggggttcattatgcaatgtatacatgtgtgggtgcaagatgtaagctgtgcatatgtgtgggggccaaag

SEQ ID NO: 85366 - DNA, 106 bp, Mus musculus
atatgtctgtgtatgtgtctgtgtctgtgtgtatgtatatgtatatttatgtgtgtctgtgtgtgtctatgtatgtgtgtatgtgtggatgtggatgtgggtgtgt

SEQ ID NO: 85367 - DNA, 92 bp, Mus musculus; identical to SEQ ID NO: 57641

SEQ ID NO: 85368 - DNA, 85 bp, Mus musculus
ggaaggctgtgtggtgttggaggaggaccaggaggatgaagtcacgggaacatccgagctcactctgtctgacacgatgctgtcc

SEQ ID NO: 85369 - DNA, 93 bp, Mus musculus; identical to SEQ ID NO: 46393

SEQ ID NO: 85370 - DNA, 71 bp, Mus musculus
tgaaaacagaggctggagagatggctcagcggttaagaacactgactgctcttccagaggtcctgagttca

SEQ ID NO: 85371 - DNA, 71 bp, Mus musculus
agaatagcaagagtaggaagagggtgatggagccccacgatactccacacccaccctgtctctgtctgtct

SEQ ID NO: 85372 - DNA, 76 bp, Mus musculus
ttggggagctttgtcactatgtgtctttttccaggggcagtggggacccagcctctgggtgtgtgacagtcaacaa

SEQ ID NO: 85373 - DNA, 76 bp, Mus musculus
accctgccacagtcactgtctctgttcctcccttatttgcagtggtagagagcaaacccagggccttgggctaggt

SEQ ID NO: 85374 - DNA, 118 bp, Mus musculus
cacctgagtgctgggactaaaggcatgcatcaccatgccctacttatttatttagccctacttaatttatttttatgtgcattgatgttttgcctgcatttgtgtctttgtgagggtg

SEQ ID NO: 85375 - DNA, 134 bp, Mus musculus
ggtcatgtttacactgcatgttctacactgcagttttctatttttagaatatctgtgtgtctgtctgtctgtctatatggccagggtttaactgcatgggcctgggtaccttggattttctatgccgaccaggc

SEQ ID NO: 85376 - DNA, 61 bp, Mus musculus
tgtgtgtatgtatgtacatgtgtgtatatgtgtgtatgtatgtatatatgtatatgcatgc

SEQ ID NO: 85377 - DNA, 81 bp, Mus musculus
tactgtggttgaaggcaatgttctctgctgctcggtaaacaggtggtgtagggacctcagtctgtgccttcaattactgtg

SEQ ID NO: 85378 - DNA, 103 bp, Mus musculus
gtggagcatcttatctttccgtagccccaggctctagagaatacctggctccctgacagccaggcgtgctttaagcttgtgaatatggctgggtggtgcctgc

SEQ ID NO: 85379 - DNA, 71 bp, Mus musculus
tcctagggggtctactggactcgatgtctagctctgcaacgggcatctgtctctcagacacacacctggga

SEQ ID NO: 85380 - DNA, 79 bp, Mus musculus
ctcacgtgcccactaaatgggaagggggacatacttccacatatgtctgtctgtctgtctgtctatctgtggctgtaag

SEQ ID NO: 85381 - DNA, 85 bp, Mus musculus
ggaaaagtaagagtccagggctggagagatggctcagctgttaagggcactgactgctcttccagaggacctgggtttgatttcc

SEQ ID NO: 85382 - DNA, 142 bp, Mus musculus
gtgtgtgcatgtgtgtatatatataaaatatgtgtgtgtgtgtgaacgtgtgtgcatgtgtctgtaagtatgtctgtgtgtatatatgtgtatgtttgtatatgtatatgtgtgtatgtgtgtagaggccagaggttgacac

SEQ ID NO: 85383 - DNA, 82 bp, Mus musculus
gaaatctagaaagatagaaggtggctttgttgagatcctggctctgcctcttcctggacatgtcacactctctctgggtttc

SEQ ID NO: 85384 - DNA, 74 bp, Mus musculus
gcccaccacaggcaagacccctgctgctcaggctgggcacaccagcactcacacagtctgtctcctccatgggc

SEQ ID NO: 85385 - DNA, 93 bp, Mus musculus
gttggtgtggccgcaggcggcttcagaaggttctttctgacgcacagtctcagagtagtcagtctgaggttacctggcctcatgtgtttcaac

SEQ ID NO: 85386 - DNA, 90 bp, Mus musculus
aggcagagaatgcactggagtctgctgagggtttcatctccacacagatgacactctgcagtgactttatctatccacctatctcttcct

SEQ ID NO: 85387 - DNA, 67 bp, Mus musculus
gtagcgagtgacctcagataccaggctctggtgtgagagtgctgagtgtgctgagtgccattgttcc

SEQ ID NO: 85388 - DNA, 89 bp, Mus musculus
ggtggaagcctgcctgcctgcctgcctgcctgcctgcctgctgaccacagtttccattaggtgggagaagagtaccagaggagtaaacc

SEQ ID NO: 85389 - DNA, 70 bp, Mus musculus
tgtgagttctaagacagcctggactacatagagaaagaaaccccatctctgtctgtcgcagactctcaca

SEQ ID NO: 85390 - DNA, 89 bp, Mus musculus
ggaactagactccctggctggcagacttgcagtcatctcccagaactctgtgcctgtctgtccgtctttcctgcatccccatttagtcc

SEQ ID NO: 85391 - DNA, 81 bp, Mus musculus
cggagctgaggttgtcttagcattaggtatgaagctcaggctagccttgagttctgattttcatgcaccagttccagcctt

SEQ ID NO: 85392 - DNA, 97 bp, Mus musculus
ggctggcactctcttgccttgaggtgcagctctccagactctgtccctctctgccccagctgctccttgcccccacctcaggcctgaggggatagcc

SEQ ID NO: 85393 - DNA, 114 bp, Mus musculus
aagggcgatgggcccatccttgcatcctaagggcagcgaggcttttgcctgtcaagacagatgttagggtccagctggcattagatgcatagtgagcaggggttttggctcctt

SEQ ID NO: 85394 - DNA, 67 bp, Mus musculus
tgttgtcgtaggcgtgtcactgtgggtgtgtcactataagacccccatcctagctgcctggaaatca

SEQ ID NO: 85395 - DNA, 85 bp, Mus musculus; identical to SEQ ID NO: 57470

SEQ ID NO: 85396 - DNA, 80 bp, Mus musculus
gacttgcgtgtatgtctctctcacagatccaggcaaccctcagagtaaagtgctaggtccctgaaagaacatagtgagtc

SEQ ID NO: 85397 - DNA, 75 bp, Mus musculus
gctgccactgtgaatgagaccatctagggtggagccttctgacctagatggttctattgttctgtcacctgctgc

SEQ ID NO: 85398 - DNA, 117 bp, Mus musculus
ggtgagataaagagttctattctggggctggagagatggctcagtggttaagagcactgactgctcttccagaggtcttgagttaaattcccagcaaccacatggtggctcacaacc

SEQ ID NO: 85399 - DNA, 93 bp, Mus musculus
tgttctccaaagcttttctttcttacatgtatgtatgtatgtatgtatgtatgtatgtatgtgtctatgtgcatgtatggagatcagaggaca

SEQ ID NO: 85400 - DNA, 70 bp, Mus musculus
actttttctgcatcacagacattagccttcacataaagggaaggctgtggctctgtggctctgacttggt

SEQ ID NO: 85401 - DNA, 78 bp, Mus musculus
agaagatagagcagggcagtgttgtgaggcaggagcaccgagtctgcaggctgctgagcagtcctggctctgagtctg

SEQ ID NO: 85402 - DNA, 103 bp, Mus musculus
ctgtgttagatcacgtcccccatggccagagaacatacagagcagggctccctcctttaaatctgtttgtatgtgtctgcaaagcatgtgtactctgctgcag

SEQ ID NO: 85403 - DNA, 110 bp, Mus musculus
gttaaaagctcttgttctggggctggagagatggctcggctcttaagagcactgactgctcttccagagggtcctgagttccattcccagcaaccacacagtggctcaac

SEQ ID NO: 85404 - DNA, 93 bp, Mus musculus
gagttggttttccttccttttaaatctctcctgccaggtgagacagtgcacacttgttttccagtgctggggagatagaagcaggaagaactt

SEQ ID NO: 85405 - DNA, 75 bp, Mus musculus
agctggtcttgctgtctctgactgtgacttgcctctcctgtaagcctgtgtgtcagtactcctgggaggccagct

SEQ ID NO: 85406 - DNA, 79 bp, Mus musculus
ggcagacaaggaaattttaacaacaagcagaattctaactaagaatgtgtaagagtgctgagtgtggtgatggtctgcc

SEQ ID NO: 85407 - DNA, 120 bp, Mus musculus
caggttgagcatcccttgacaagccttggttcagcacccctgagagcactgtgtgtgcacatatgatgctgggaactggagcccagagtttattgcacagtggacaagtgctcagcactg

SEQ ID NO: 85408 - DNA, 75 bp, Mus musculus
gactattgggctggagagatggctcagcagttaagggcactgactgctcttccagaggtcctgagttcaattctc

SEQ ID NO: 85409 - DNA, 69 bp, Mus musculus
ctctcctctctgttggcttggaggaagccctgcactattctctctctttctcagtcacagattggtgag

SEQ ID NO: 85410 - DNA, 80 bp, Mus musculus
gaagtacaactagggggctggagagatggcgcagcagttatgagcactgactgctcttccagaggtcctaagttcaattc

SEQ ID NO: 85411 - DNA, 71 bp, Mus musculus
gtatcttcagaatatttttctatttttctgctgaggggaagagttcattaggaaagaagaggtgaggatgc

SEQ ID NO: 85412 - DNA, 112 bp, Mus musculus
tgtgcataaaagctttgatgtggggctggagagatggctcagtggctaagagcattgactgctcttccagaggtcctgagttcaattcctagcaaccacatggtggctcaca

SEQ ID NO: 85413 - DNA, 85 bp, Mus musculus; identical to SEQ ID NO: 78864

SEQ ID NO: 85414 - DNA, 117 bp, Mus musculus
caccatgaaatatatatatatatatatatacacacacatatatatgtgcatatatatacatatatgtgtatatatacatatgtgtgtatgtatatgtatgtataaagcatttaggtg

SEQ ID NO: 85415 - DNA, 114 bp, Mus musculus
gccttcaaaggaatgcgccactactgtagggtgatatttttcagtatgtaatatttgaagatataatataaatattttttctttttataaaaatagtggggttggagagatggc

SEQ ID NO: 85416 - DNA, 91 bp, Mus musculus
tggagtgggaattttaggggctcctaagaaagttaatccttgatctttagaaaaccacaggatcctctctgtctctctgattctctctcta

SEQ ID NO: 85417 - DNA, 120 bp, Mus musculus
agtgctgggattaaagacatgtgccaccactgcccagattctctctctctctcaaacaaaacaaaacaacaacaaagaaacatactaagcatggtggtgtaagcctataatcgcagcatt

SEQ ID NO: 85418 - DNA, 86 bp, Mus musculus
tagatctttgatcagcatgcacagaagtcacggttgtaagcagtgtgtcatttgtgttctgtgtctctgtatcaatttcctatctg

SEQ ID NO: 85419 - DNA, 112 bp, Mus musculus
tagccacgtgtcatgtcctccttcgggtcttcttgctgaatgagcatctggaagtcaggtgacactactttctgtttataggtgaagaagtggggactctgaactatgcctg

SEQ ID NO: 85420 - DNA, 142 bp, Mus musculus
tatgcatatatataagtatatatgcatatatgtgtgtatatatatgtatatatgtacatatatgtgtgtatacatatgtatatacatatatgtgtgtatatatatatgtgtgtgtgtgtgtatatatatatatattctcaca

SEQ ID NO: 85421 - DNA, 100 bp, Mus musculus
tgacaagctctggggctggagagatggctcagcggttaagagcactaactgctcttccagaggtcctgagttcaattcctggcaaccacatggtggctca

SEQ ID NO: 85422 - DNA, 118 bp, Mus musculus
ccttccatgtgggtgctaagaaccaacctaggggctggagagatggctcagcggttaagagcactgactgctcttccagaggtcctgagttcagttcccagtagccacatggtggctc

SEQ ID NO: 85423 - DNA, 70 bp, Mus musculus
gggagatggagagattgctcggtggttaagagcactgtctgctcttccagaggtcttgatttcaattccc

SEQ ID NO: 85424 - DNA, 85 bp, Mus musculus; identical to SEQ ID NO: 57439

SEQ ID NO: 85425 - DNA, 81 bp, Mus musculus
ggaccttggctgggatatcatcatatactgtaagtttgtgatgagacactacagtatagatgatgtactagtctgggtacc

SEQ ID NO: 85426 - DNA, 88 bp, Mus musculus
gaaaaagaagctagggctagagagatagatggctgcttctgacgttaagaacactgactgctcttccagaggtcctgaggtcaatttc

SEQ ID NO: 85427 - DNA, 102 bp, Mus musculus
gcacgtacattttggttcacgactgtctgtcacttcagtttcagggaatctgatgtcagggaccaggggtgtttgtagtgcagacatggaggtaaagcatgc

SEQ ID NO: 85428 - DNA, 104 bp, Mus musculus
gaggaggaggaaaacaatgattaggtttggagagacagttcaagaaggctcagaggttaagagcactgactgctcttccaaaggtcctgagttcaaatcccagc

SEQ ID NO: 85429 - DNA, 97 bp, Mus musculus
gcttggaccgagctaatcagaggaaaagtgagctgtgctgtggctcccgcggctgactggctgagtgactggctgagtataggtaaggtctccaagc

SEQ ID NO: 85430 - DNA, 82 bp, Mus musculus
agttatgaacagctgtgagctaccatgtagacgctggaatctaaacccagattctctgcaagagcaactgatgttcccaact

SEQ ID NO: 85431 - DNA, 65 bp, Mus musculus
gctcctgtctcaactcaagctttgctggtcagcaagtgacctggtcagtcagtgagtcagtgagc

SEQ ID NO: 85432 - DNA, 112 bp, Mus musculus
cagccttatgtcccagccaggatagcaaaagtgtcaagcctcctctagctagacagtacactgtgtggtgacagagggcctcaacttctgctaagcatggctgaccacactg

SEQ ID NO: 85433 - DNA, 58 bp, Mus musculus
gtgtgcatgagcatgtgtatgtatgtatatatgtatgtatgtatgtatgtatgtatac

SEQ ID NO: 85434 - DNA, 86 bp, Mus musculus
gtaagggtgaggttggagagacagttcagtggttaagagcccagactgctcttgcagaggacctggcttatggacctggctcatgc

SEQ ID NO: 85435 - DNA, 109 bp, Mus musculus
accatgctaggattgttgtaacttaatttgctgttagttttgagaaagtagcttttaaagtaattaaagcttagtcagcatgttgaagattattttatttgaatttggt

SEQ ID NO: 85436 - DNA, 67 bp, Mus musculus
accttaagaggaggtgagtgtgagaagctaaaataccactctctcacaggctcactgtcactgaggt

SEQ ID NO: 85437 - DNA, 100 bp, Mus musculus
ctgagacctggaatgtttgttgcctggcaggggcgtgggggtgggaaacctgaagtgactgagctctgagctgagagagccacaaatatctggggcacag

SEQ ID NO: 85438 - DNA, 71 bp, Mus musculus
catatatgtgtgtgtgcatgttcatatgcatgtgtatatgacatatgtatgtatgtacatatgcatatatg

SEQ ID NO: 85439 - DNA, 82 bp, Mus musculus
tgtagggctggggagatggctcagtggttaggagcactgactgctcttccagaggtcctgagttcaattcccagcaatcaca

SEQ ID NO: 85440 - DNA, 65 bp, Mus musculus
gcagcagcaaggggtcctggaaatgagctgctttcttagtttatttttatgctctctctctctgt

SEQ ID NO: 85441 - DNA, 163 bp, Mus musculus
atgtgtgtataggtgtgtgtgtgtaggtattggtatgtatatgtgtgtataggcatatgtgtatatataggtatgtgtatgtatattgtgtgcccacatataagtatgtatgtatgtgtgtacaagtgtgtgtgtataggggtgtgtgtgtgtgtgtgtatgt

SEQ ID NO: 85442 - DNA, 97 bp, Mus musculus
gctcacagaccacggatgaatatgccacagctccgatgtcagggaattcccagattccctctctctgtgaggcactgcacccttgtggtcctcgagc

SEQ ID NO: 85443 - DNA, 79 bp, Mus musculus
tatatatatataatataaaaagaaacacacacatatatacatatatatgtgtatatatatgtgtgtgtgtgtatatata

SEQ ID NO: 85444 - DNA, 81 bp, Mus musculus
cctagtctatatagtgctcagtctgtcattcactgtcatgcaaaaaacacgcacctaatggggattcagcacaggactagg

SEQ ID NO: 85445 - DNA, 74 bp, Mus musculus
gaggggtaaggtttgtttgtttgtttatttatttaatgtaagtgagtacactgtacagatggttgtgagccttc

SEQ ID NO: 85446 - DNA, 71 bp, Mus musculus
tggtttctctgtgtcaccctgactgtcccagaacgctgctaagcaggctgaccccatgcgcagagatccca

SEQ ID NO: 85447 - DNA, 115 bp, Mus musculus
ctgctttggaggttggcagaagcagcacagacaagagaaaaggaacaattcgtgagggcttccactctgaatctctctccttcctgtaaaccctcctaaccatgctgtgaagtag

SEQ ID NO: 85448 - DNA, 114 bp, Mus musculus
ttctatagatcaaggaccctggggcccccaagggtgtcctcattcaggcactggccacacagtctgtctgggtctaaccaagaacccacaggtctcagtgttcctgctaatgaa

SEQ ID NO: 85449 - DNA, 58 bp, Mus musculus
cagtggggacagaggttgggggtattgaggttcctctcagcatctctctgtccctctg

SEQ ID NO: 85450 - DNA, 75 bp, Mus musculus
catggtggctcacaaccgtctgtaatgggatctgacgccctcttctggtgtgtctgaagacagacagctacagtg

SEQ ID NO: 85451 - DNA, 90 bp, Mus musculus
cctttcaccttgccttttatctttcccactctcggatggagtgtgtctctgtcacagacggagtgccatgggtaagttaggtatggaagg

SEQ ID NO: 85452 - DNA, 80 bp, Mus musculus
gtatatatgtgtgtgtgtgcatctctatgtgtgtgtctatgtacatattagtatgagcttgcacataccatatgtgtgtc

SEQ ID NO: 85453 - DNA, 142 bp, Mus musculus
acagacagagacagagaatatgggacagaaaggcagagggtgatttgggaatctggctcactcttttttttttttttttggtttttcgagacagggtttctctatagtcctggctgtcctggaactcactttgtagaccagg

SEQ ID NO: 85454 - DNA, 73 bp, Mus musculus
gaggaggtgtgtcactgtggatggactttgctgtctcaaaaagcccatgccaggcccagtctctgtctctctc

SEQ ID NO: 85455 - DNA, 79 bp, Mus musculus
gctcatttgtccctcacactgactctgacctagactgctctgacacccaactttcagatgagtggggaggactcacagc

SEQ ID NO: 85456 - DNA, 78 bp, Mus musculus
gtgtttggttctaggatctatgctttttgttcctagtgacaataggtcaaaggtactggtattcttggctttaaccac

SEQ ID NO: 85457 - DNA, 101 bp, Mus musculus
acacaagaaaaaatggggctggagagatggctcagaggttaagagcactgactgcacttccaaaggttctgagttcaaatcccagcaaccacatggtgtct

SEQ ID NO: 85458 - DNA, 75 bp, Mus musculus
gctcctttcagcctgtctctcgctctgtaacccagtaggctccctcactgcggagtggcgcggggtgaaaacagt

SEQ ID NO: 85459 - DNA, 98 bp, Mus musculus
cctgctttgtgtggaagctgcttgttttaggtgatctggtgttatgttacatgaacactagtgtttttccacaagtatggcttccttctgccaagagg

SEQ ID NO: 85460 - DNA, 89 bp, Mus musculus
gggattaaaggcgtgctgggtcactatgtatatgtatatctttttaaatgggtatggggcacataagttctcagtatttcctggctcct

SEQ ID NO: 85461 - DNA, 98 bp, Mus musculus
gtgcagggttatagggcaaaaaatatgagctttatttttagatacaaaaaccatgatctcacaggctctctgtttttaactgtgtattttcaacgcac

SEQ ID NO: 85462 - DNA, 108 bp, Mus musculus
acagttaaaaacagagagcctgtgagatcatggtttttgtatctaaaaataaagctcatattttttgccctataaccctgcactttacctgggccctgccttaactgt

SEQ ID NO: 85463 - DNA, 77 bp, Mus musculus
ggtgaggggctgactctgtggctcagttggtagagtgttacctagcatgtaaaagccctggttcagcccctagcacc

SEQ ID NO: 85464 - DNA, 78 bp, Mus musculus
cagtgtgtgtgtggccagagagagcagagtatggaggggtctttcaaagtcaagctgtatggaacccaccaccagctg

SEQ ID NO: 85465 - DNA, 79 bp, Mus musculus
tagaggctgtgtgtacatgcagggcctgtggtcgtgtggctgcctgcctgctgtctctgtatgtgttaaccagtcacta

SEQ ID NO: 85466 - DNA, 113 bp, Mus musculus
ctttgaggccctgactatgtcctaaaggctgtgtgtgtgtgtgtgagagagagagagacagagagacagagagacagagacagagagacagagagagacagggtcagataaag

SEQ ID NO: 85467 - DNA, 82 bp, Mus musculus
gtatatatatatatatatatatatatgtgtgtgtgtgtgtacatatatatgtatatatgtgtgtatatatgtatgtgtatat

SEQ ID NO: 85468 - DNA, 100 bp, Mus musculus
caacaacaacaacaatctcattatggaagctgtagtgtgtcacagtgtgtcacacagaatacccttttgtccatacatcttgagttgccaatgtttgttg

SEQ ID NO: 85469 - DNA, 92 bp, Mus musculus
cattttatgtacatgggtgttttgtctgtctgcctgtctgtctggtggctatgcggtttagaagcaggcatctgatccctggaactggagtg

SEQ ID NO: 85470 - DNA, 86 bp, Mus musculus
tctatcttgtctgtctgtctgcctgcctgcctatctatctatattggaagtgtgcagaagttagactatgaataaacaactgtaga

SEQ ID NO: 85471 - DNA, 118 bp, Mus musculus
ttgagtcaccttgtaatgtaatgtcccctatttttgtgtgtgcatgttctctctatctctctctctgtaagacccccgaagctggaactccgctcaagtcccgggatgagctggccag

SEQ ID NO: 85472 - DNA, 61 bp, Mus musculus
gctctgaggcactcactggctggcttaatatgtggtgttttatagatgggtgctttggagt

SEQ ID NO: 85473 - DNA, 120 bp, Mus musculus
ttgcagatagcagtggttggcttgatctcagggctggattctgtgtcactgtgtggctgtgttaactgatctgttgctggtgggatatttccagtttggggctgctatgctcaggcagtg

SEQ ID NO: 85474 - DNA, 85 bp, Mus musculus
ttagtgagtgggaaaatggactgcagagggtcaggtggggaacagactcagttcctgctctctgctgtctgcctctccacactga

SEQ ID NO: 85475 - DNA, 77 bp, Mus musculus
taggatcagagatgactgtgtggagggcaattgcccaataaggcttggtccttgtcagagtgaactatttcctcctg

SEQ ID NO: 85476 - DNA, 140 bp, Mus musculus
atatatatatatatgtatgtatgtgtgtgtgtatgtgtatatatattgtgtatataatatatatatatatactgtgtatgtatgtatgtatgtgtatgtatatatattcatatacatacacatatatacatatatatata

SEQ ID NO: 85477 - DNA, 60 bp, Mus musculus
tatatatgtatatatgtgtatgtatatgaatatatatacatacacatacatacatacata

SEQ ID NO: 85478 - DNA, 84 bp, Mus musculus
ttgcactgtgaaccatagagtctcactgtctatgttctattttctgatgttataggaatacagtggcttggttatagagagcaa

SEQ ID NO: 85479 - DNA, 108 bp, Mus musculus
caataggtggatttttttttctgtgagctttaattttgaaaatttctaaatgtgtagaaaagttcacacatttagaacttgtgtaacattcacatatcctatatattg

SEQ ID NO: 85480 - DNA, 93 bp, Mus musculus
acaaatggccttgcccacttaattttagcattgaggcaaaagggagttgggtaccagacagatgtctcagtgattaagagcaattttttttgt

SEQ ID NO: 85481 - DNA, 88 bp, Mus musculus
acgatgggtctgaaaagatggctcagcggttaagagcactgactgctcttccaaagttcctgagtttaattcccagcaaccacatggt

SEQ ID NO: 85482 - DNA, 85 bp, Mus musculus
acttttgtgtctgtctgtctgtctgtctgtctgtgtacgtgcacgcacgcatacgcgcaggggcacagatgtcttcctagatcac

SEQ ID NO: 85483 - DNA, 81 bp, Mus musculus
gctgaaagtactgactgagctgtctcacgagccccgggaaccttattcctaggtagccagatagtcagtcctttatatagc

SEQ ID NO: 85484 - DNA, 77 bp, Mus musculus
tttgtttttgagacagggtttctctgtgtatctctggctgtcccgggactcagaaatccacctgcctctgccccaag

SEQ ID NO: 85485 - DNA, 82 bp, Mus musculus
tatatatttatgtgtacatatgtgtgtatggtgtgtgtatatatatatacataatatatatgtgtgtatacatgtatgtgtg

SEQ ID NO: 85486 - DNA, 118 bp, Mus musculus
gatgtttggccccataaaaccaaggcagacattaggagatatcactctttttttttttttttcaaaattacatttagagtgtgagtttaatgtctgtccgtctgtctgtccgtccgtc

SEQ ID NO: 85487 - DNA, 86 bp, Mus musculus
tctggaactagctctgtagatctgtctgtctgtctctgcctcccagggactggggttaaaggcatgtctataaaaaaagtttaaga

SEQ ID NO: 85488 - DNA, 61 bp, Mus musculus
catgtgaaggtggagggagagctcactcctgcaagctgctctctctctcactctgtctatg

SEQ ID NO: 85489 - DNA, 69 bp, Mus musculus
gcctgcctgcatgtctctgtgaggctgtctggttccctggaacagaagatagagacagttgtgagctgc

SEQ ID NO: 85490 - DNA, 86 bp, Mus musculus
tgagtactgctttataatttttgtatcacagttttatttttttaagctagctggaaggtgacagtgattgaaatgagcagttttca

SEQ ID NO: 85491 - DNA, 117 bp, Mus musculus
gcctcctaatgctgggattaaaagtgtatgctaccgggctggagagatggctcagcggttaagagcactgactgctcttcagaaggtcccaagttcaaatcccagcagccacatggt

SEQ ID NO: 85492 - DNA, 91 bp, Mus musculus
gccaaggaaggaagctcactgtcactcagggtctgtctagatacctcatggagaactctgggctctctgttatgtgactggttgtcatggc

SEQ ID NO: 85493 - DNA, 68 bp, Mus musculus
agctttggggctggagagatggctcagaggtttaagaacactgactgctcttccagaggtcctgagtt

SEQ ID NO: 85494 - DNA, 112 bp, Mus musculus
ggcctctacaggctcatatatttgaatactttatctctagttggttgaattgtttaggaagaactatggccttgctggaggaattgtgtcactgggggtgggctttaaggtt

SEQ ID NO: 85495 - DNA, 116 bp, Mus musculus
agcttcatcctgaatcaggaaatactgagagtaattattatattagggaattttgtttttgcttgaatagtagttaatttgggtccgaaatttttctgtataaaagggaacaagtt

SEQ ID NO: 85496 - DNA, 79 bp, Mus musculus
gagagaatccctgggctggagagatggctcagtggttaaaagccactgactgctcttccagaggtcctgagttcaactc

SEQ ID NO: 85497 - DNA, 115 bp, Mus musculus
tcctagtgcacaggaaaacacggactcagaccctaagagaagattgagaccacacccatgcccagtgattcttcacttggggtccatctcactttgttcgtgatagactttagga

SEQ ID NO: 85498 - DNA, 146 bp, Mus musculus
cctggatatgtatgtgtggtgtgaatgtatatgtatatatttgtgtgcatgtatagtggcacatgtatgtatataggcacatgtatatatgtgtgtgtgtgtatatatatctatgtatgtgtgtgtgtgtgtgtgtgtgtgtgtgt

SEQ ID NO: 85499 - DNA, 74 bp, Mus musculus
gctaccaccagtttctcacccatctgctcatttaatatatatgtatggtatctgtgtgagccactgcaggaagc

SEQ ID NO: 85500 - DNA, 111 bp, Mus musculus
agacatggatacacacacatgcacaaacatatgtatatgtgtatgtatatatgatgcatatgtatccatctctatatatgtaaatatatatgtatatgtgtgcacatatat

SEQ ID NO: 85501 - DNA, 113 bp, Mus musculus
cctgaggactcatgtgtgggttagtttttgtttgtttgtttgtttgtttgtttttaaaatgacttgacacagaatcacctaggaatagtgaaggtcacatgaggaagtgcctc

SEQ ID NO: 85502 - DNA, 109 bp, Mus musculus
caataaatgccactgtttagagatgtgttggtgccacgggcacagatcagctcagcctactgtgtctatgtctgtgtgtgcagtctgcagaaataaagggattgttttg

SEQ ID NO: 85503 - DNA, 81 bp, Mus musculus
acagggacgggacagtgggcagagctggaggctgatctccaaagagatgagatcgctctgtgtgtctgtctatgtctatgt

SEQ ID NO: 85504 - DNA, 107 bp, Mus musculus
tttaaatgttatattttgagggtatctgatgctttaaaaactatctatctatatatagtatatttgaactgttaaagcttgactactcttagttaattttatttgaa

SEQ ID NO: 85505 - DNA, 82 bp, Mus musculus
tctctgtgtgtgtgtgtgtgtgtgtatgtgtgtgtgtatgtgtgtgtgcatgcacccatgtaccacagcacacctgtggagg

SEQ ID NO: 85506 - DNA, 122 bp, Mus musculus
aagccattcccatcttactgcaactgccccggcgtgctgtcctcaagctgcctgtgtgagcacagtgcgggcagggcacacaggaggactccagcacctgcagttgtcagtagcttagggga

SEQ ID NO: 85507 - DNA, 83 bp, Mus musculus
ccacgttttattagtggatgggagtcactgaaaggatcatatatgtttgttgtctcttctgtagtctgatcattgggaagtgg

SEQ ID NO: 85508 - DNA, 84 bp, Mus musculus
acgagctctgtctcagtcactgttctatatactgtgccatgaccaaggtaatgtctacaagaaaacattgaactgagggcttgt

SEQ ID NO: 85509 - DNA, 78 bp, Mus musculus
gtacatgtgtgtatatgtatatacatgtacacatatgtgtgcatatatgtatatgtgtgtatatgtatatgtatgtat

SEQ ID NO: 85510 - DNA, 84 bp, Mus musculus
atatagatatacacagaagtttgtgtgcatatatatgtgtgtgtatataaatgtgcacgcatatgtgtctgtgtatatatgtat

SEQ ID NO: 85511 - DNA, 96 bp, Mus musculus
tacacgtgtacatgagtgtatgtgcatgtgcatgtctatggatgcgtgtatgtacgtgtgggtgggtgggtgggtgcactcatgtacacttgtgtg

SEQ ID NO: 85512 - DNA, 77 bp, Mus musculus
ttgtattgatgggtcttgctgtcttggttggggtgtgaagtaccaaagagtctcagacagtgtgtctctcgttataa

SEQ ID NO: 85513 - DNA, 112 bp, Mus musculus
ggggagacatttgtttcaggagtgaagctgtgacaaggaaacctgtggtatgacaatctctcactcttactgcaccttatatctttgtagctcctcaagtcagcccctcccc

SEQ ID NO: 85514 - DNA, 120 bp, Mus musculus
gtgtgtgtgtgtgtgcacgcatgtgcaggtgtatatgtctgtctatctgtgtgtgtgtgcgcgcgtgcacgcatgtgcaagtgtatgtgtctgtctatctgtgtgtgtgtgtgtgtgtgt

SEQ ID NO: 85515 - DNA, 79 bp, Mus musculus
gcagctcaggtctctctcactgcctcttacctgacacagctcaggtgggacacagatttggagttccttgagagtatgc

SEQ ID NO: 85516 - DNA, 117 bp, Mus musculus
tatgtatatgatagacatgaacatgtatgtatagatgttcacatgtgtgtgagcacacatgcatgggtaggtgtgtgggtatgcatgtgcacacatgtgtgtgcacacatgtgaagg

SEQ ID NO: 85517 - DNA, 86 bp, Mus musculus
ttgcttgttttatggctggagtttgctgtcttgccatatggtgagtccctgtaaggcactgaaggagcagagccatgtgcaggcag

SEQ ID NO: 85518 - DNA, 79 bp, Mus musculus
tgtacatatgtgtgggtaaatgtgtatgtcacacactgtcacaaactcagaaatatacccttactcccacatatgccca

SEQ ID NO: 85519 - DNA, 101 bp, Mus musculus
accaaatatgccctttgtgcgtagtgtgtgcaagtgcatgtgcctgagtgtgcaggagacatgtctgcacatgctatggaagcctaaggacaacctctggt

SEQ ID NO: 85520 - DNA, 111 bp, Mus musculus
ggagaaagagctgagaaatggagaagagtttgctggaggcaaattaaccacagagcaaggtcagccaggtttcttgactccctctgtagccgctgatcctgggctgcctgt

SEQ ID NO: 85521 - DNA, 70 bp, Mus musculus
gtgtatgtatatgtgtgtgtatgtatgtgtatgtctgtgtgtgtatatatatatgtgtgtgtatctatgt

SEQ ID NO: 85522 - DNA, 93 bp, Mus musculus
tctgatatgcaagcatgaggacctaagcttgtatgtatgtatgtatgtatgtatgtatgtatgtatgtatcctcagtgcttgtagagacaaga

SEQ ID NO: 85523 - DNA, 69 bp, Mus musculus
gtgaaccagcagcctactgtttcagctaggcctttggcctgtaagctctcagtatctgtctgtttccac

SEQ ID NO: 85524 - DNA, 104 bp, Mus musculus
gtgtgtgtgtatgtaaacctatgtgtgtgtttgtatgtacatctatgtgtatgtgcatgtgcacctatgtgtgtgtatgcatgcatgtggatgctaacagtcaa

SEQ ID NO: 85525 - DNA, 89 bp, Mus musculus
agcttccttgcctcatgcaggctgaagcataatgtatttaaatttctttaactgcattattttacttagcataatgcccttagggagct

SEQ ID NO: 85526 - DNA, 91 bp, Mus musculus
gcctgtaactcaaggtcctgaggacctgatgccacctactagcctctgaaggcactgagcacaatcatggtacacagacctacaagcaggc

SEQ ID NO: 85527 - DNA, 85 bp, Mus musculus; identical to SEQ ID NO: 57470

SEQ ID NO: 85528 - DNA, 82 bp, Mus musculus
ggttctcagacttctggctttggatttagaaccatgacaccagtttttctagttctgaacctgacctaagtctgtgagggcc

SEQ ID NO: 85529 - DNA, 68 bp, Mus musculus
gtgtgtatgtgcatgtgtatgtgtgtgtgtgatatgccacaggacacatatggagggcagaggatcac

SEQ ID NO: 85530 - DNA, 110 bp, Mus musculus
atcatctctcctacagggctcaggatcttttgaaggctgtagttcatcttagatctctttctgtctggtggacttagtgcttcagtatccatttctgtaataaactgggt

SEQ ID NO: 85531 - DNA, 60 bp, Mus musculus
tgtatgtatgtatgtgtgcatgtgtgtgtgtgaatgtatgtgcatgtgtatgtgtgtgcg

SEQ ID NO: 85532 - DNA, 97 bp, Mus musculus
ggctccctctgggccttgtgctgtggctctctgaggctctgccatattggcatcatctggaggccatgggctctggtttaagttccaggtggcagcc

SEQ ID NO: 85533 - DNA, 112 bp, Mus musculus
ttttccctttgtcccatgactttgatcctcaggttgggcttcagaccagagagatgacacaggcctctagggaagaaacagcaatcatgtgaccctgctggcttgtgcagtc

SEQ ID NO: 85534 - DNA, 72 bp, Mus musculus
gcatgtgtgtgtgcatgtgtatgtgcacatgtgtgtattcacatgtgtacatgcacatgtgtttgcatgtgt

SEQ ID NO: 85535 - DNA, 77 bp, Mus musculus
agagcctatgtctgccagtctgtctgcatctgtgaccccaggattgcctccagaggctcatgaagacaagaggcttt

SEQ ID NO: 85536 - DNA, 73 bp, Mus musculus
ggagcaaggcacagacctggggagtagaaatactgtattctgtctgtctctgtctgtctgcctatctgtctct

SEQ ID NO: 85537 - DNA, 108 bp, Mus musculus
ggcttcatgtatcccagactggtttagaacttagtatggatctaataatgattttgaacttctgatccttctgccttcatctcctgggtgctgggattgcaggcttgc

SEQ ID NO: 85538 - DNA, 95 bp, Mus musculus
ggacaccctcaaagttgtgcgtgtgcatgtgcatgtgcacatgcgcatgtgtgcgtatatgtgtccatgtgtatgtgtccatgtatataagcata

SEQ ID NO: 85539 - DNA, 111 bp, Mus musculus
ggtgatgatgaggttcccagcaggggaagggtttgatgtgtgaagacagagaccaaagcagaaacattaaatctttctgctcagagctgcgagagggccctggcaggcgcc

SEQ ID NO: 85540 - DNA, 114 bp, Mus musculus
gcttggggtggtctttgtaggcccaatgtgatgtcagatcagtgagtgcacagaggccttcaaggctggggcttcactggctgtattttttgagtaactgtgtcttttctgggt

SEQ ID NO: 85541 - DNA, 104 bp, Mus musculus
gggagctgtctgcatcccccaaggagtgcttcaggccacggtggcgttcctctgtctgactgtgtgtaccctgctttgtcctctctgtcctgctgcaagccccc

SEQ ID NO: 85542 - DNA, 116 bp, Mus musculus
tggtttgaatgtgaatggctcccataggtccatatgcttgaattctagttggtagaattgtttaataaggattacagggtgtgatcttgttagtggaggtatgtcaccgaggatgg

SEQ ID NO: 85543 - DNA, 91 bp, Mus musculus
agggggacccagatgggtgaagggatgggggagggaggctgtctctgtcactctggcttgctctggctggcaatctcaacaggcagtctct

SEQ ID NO: 85544 - DNA, 106 bp, Mus musculus
gccttagtgcatggtgatctgataggatgcataggacaatttcaatatttttgtatctgttgaggcctgttttgtgacctattatgtggtcaattttggagaaggt

SEQ ID NO: 85545 - DNA, 89 bp, Mus musculus
gagcaagcctctgagactgtgagtgttcagctgcttccatggctccctctttggcagtttgagtgtccaagtcccagttcacctgcctc

SEQ ID NO: 85546 - DNA, 73 bp, Mus musculus
actctgagcctctttgaactgagtcaggtcaggtaggccaatgaaaaactgacagtccagtgaggagtacagt

SEQ ID NO: 85547 - DNA, 85 bp, Mus musculus; identical to SEQ ID NO: 57470

SEQ ID NO: 85548 - DNA, 80 bp, Mus musculus
tgagatccccgtgaggtatgctctctttccatgcttatttaatatagagggagtcagagggttacacacacacactctca

SEQ ID NO: 85549 - DNA, 76 bp, Mus musculus
atcatgtcatttaggattctcatcagggcagcacatacatagctagctttctggagtggctcctgggtacattggt

SEQ ID NO: 85550 - DNA, 137 bp, Mus musculus
gtgctccatttttatgtctcttgtcgatatacttcctgtcatgggtttcagggagatcacagagtggtcagagtggtggatgacgtcagggtagaatgatcattgagagcagtctggaaggtggtgggcaaggaggc

SEQ ID NO: 85551 - DNA, 89 bp, Mus musculus
gctcagcctctgtgactgtctgttgagtctcagctgacatcactctgccaatcagcctgagtcctcggaaagaacaaaaagctaccagc

SEQ ID NO: 85552 - DNA, 56 bp, Mus musculus
ctgcctctctgagcctctgactctaattttagttggagagagggacagatgggaag

SEQ ID NO: 85553 - DNA, 90 bp, Mus musculus
tttttatttttaggaccaaaataatgatgatgatgatgatgatgatgatcatcatcatcatcatcatcataataataccaaaaataaaag

SEQ ID NO: 85554 - DNA, 61 bp, Mus musculus
cacagcctaggctgagtctgaggaagctacacgcctcttgctgactgacagtcactctgtg

SEQ ID NO: 85555 - DNA, 86 bp, Mus musculus
ccccaacagtatgccatatgtatgtatatatatacatgcatatgtgtgtgtatatgtatgtatgtgtatatatatgagagatgggg

SEQ ID NO: 85556 - DNA, 65 bp, Mus musculus
cctcggagagcctttactgagagcagccaggtcaaactgttcagaggactcagtgagctcagagg

SEQ ID NO: 85557 - DNA, 91 bp, Mus musculus
agtcttgctaagattgaacttttcctattctgagatttttgtatcaatatttctcatagtgggggcttgagagagatgactcagcaggact

SEQ ID NO: 85558 - DNA, 86 bp, Mus musculus
ttgtttgttcttggtttgaagagttgtcatattcttctcctcttgttgagtctggaatgtgaagattgtcaatctggtacgaatgg

SEQ ID NO: 85559 - DNA, 89 bp, Mus musculus
ggcatcagagtattgcaggcataggacagaagcttcagggtgtgtgtgtgtgtgtgtttgtgtgtgtgtgtgtgtgtgtaaatggtgtc

SEQ ID NO: 85560 - DNA, 106 bp, Mus musculus
gtgggtgtgtggtagctgtgcatctgtgtgtgtgtgccttggtatgcatgcatgtgtgtgtatgtgtgtctgtctgtgtgcatgtgtgtggtatctgtgcatccat

SEQ ID NO: 85561 - DNA, 60 bp, Mus musculus
agatttgatatctgcaggaggcagatataaaagcttgtctgtctgtctgtctgtctgtct

SEQ ID NO: 85562 - DNA, 137 bp, Mus musculus
ggggcagtctccttacctttttggagcttcaaactcctcatccgtaacaaaagaagactgtgagcagactgggccctgttccatgcctttgtcacgagctgagctgtcacgccggcctggtacgtgctatttcttct

SEQ ID NO: 85563 - DNA, 82 bp, Mus musculus
tggaggaatgggctggaaagatggatggctcagcggttaagagtcctgactgctcttccagaggtcctgagttcaattccca

SEQ ID NO: 85564 - DNA, 93 bp, Mus musculus
agactcttgctttgttccactctccttggatttcaagagactaaaagacaagagtctcaccagagagctgagatgcgtggagcccgagttgct

SEQ ID NO: 85565 - DNA, 99 bp, Mus musculus
catatgtgtatatatatgtgtatatgtagacgtgtgtataatgtatatatatgtgtgtgtatatgtatatatatgtgtgtgtgtgtgtatagtagtctg

SEQ ID NO: 85566 - DNA, 56 bp, Mus musculus
ctctctgtgtgtgtgtatgtgcatgtgcatgcatgcgtgtgcgcgtgcgtgggaag

SEQ ID NO: 85567 - DNA, 116 bp, Mus musculus
agatttagtcacttcattttatgtgtgagtgccttgcctgtatgtatgtatgtatgtatgtatgtatgtgcgctacatgcatgtttggtgcctacagaagtcagggcattggattt

SEQ ID NO: 85568 - DNA, 95 bp, Mus musculus
acctcactgtttaactagctagagtagtctttgtgtagttgacaagtgaaccaagtgttttgtgggctatattaggagtaatactggttaggggt

SEQ ID NO: 85569 - DNA, 71 bp, Mus musculus
ctgtctgtctgtctgtctgtctgtctgtctacatgcaagtgcagatgctcacagggttcagaagaggatgg

SEQ ID NO: 85570 - DNA, 75 bp, Mus musculus
accaacttcagaaggtgcagtacacaaacggccctcacacagtggctgtcacccttgctgggcttaggtcttggt

SEQ ID NO: 85571 - DNA, 78 bp, Mus musculus
tgctgctgtttgtgattctgtctgtctgtccatatttatattagaagtgatggactgtctgtcttcatgatagcagca

SEQ ID NO: 85572 - DNA, 105 bp, Mus musculus
cagaagagggcatcagatctcatcacagacagttgtgagtcaccaggtggttgctgggaattgaactcgggacttctagatgagcagtcaatgctctacccactg

SEQ ID NO: 85573 - DNA, 95 bp, Mus musculus
gtgttctcacgggcttgcgacagattttctgctctgacatttctcagttatcttgctgtggttagatgggactgtctctctccagtgcctggcat

SEQ ID NO: 85574 - DNA, 63 bp, Mus musculus
ctctttgtctgtcagtctgtctgtgtcgaagttgtctttggcattcagaagagagagctggag

SEQ ID NO: 85575 - DNA, 106 bp, Mus musculus
ggctctggccagagccacccccacccccagtcttcatacgcgcgcgtgcatgcgtgcgtgtgtgcgtgcgtgtgtgcatgtgtcgtgggcctccctgagttagacc

SEQ ID NO: 85576 - DNA, 82 bp, Mus musculus
ttatggggggaactggggaacatagttagagggatccacctagctggatcctccctgacagtctccctgattctctgcatga

SEQ ID NO: 85577 - DNA, 70 bp, Mus musculus
tcacctctaggaccttggacacctgggaaagggaccagcatctcttgtctctctgtctgggcctctgtga

SEQ ID NO: 85578 - DNA, 118 bp, Mus musculus
cttattttgagatagggtctatccatcatttatctatccatctgtctgtctgtctatctattttggatagggtctctctgtgtagcccttgtactagaactagctcagtagaccaggc

SEQ ID NO: 85579 - DNA, 100 bp, Mus musculus
gtgtcttgtggacatcgattcctcttctacggtatgtcaaggaaggattcaatgaaattgtatgtaaaaatgggtgaatgggagtttcctaaagagacac

SEQ ID NO: 85580 - DNA, 85 bp, Mus musculus
gggtatacactgtctttttctgtgtcctcgatgttcccttctgaataatggagcagagcctgcttcaaaaaggcttctcttatcc

SEQ ID NO: 85581 - DNA, 85 bp, Mus musculus
cagggtttctttgtgtagctatggctgtcctggcacctgctctgtagaccaggctggctgcctgtaactcacagagatccacctg

SEQ ID NO: 85582 - DNA, 71 bp, Mus musculus
gactgtacctccaagtcagcaacgtgaggtgaagagactgtctcactgtctccttgtctgtggtgtgagtc

SEQ ID NO: 85583 - DNA, 74 bp, Mus musculus
tctgagctctggttaggttggcttgggagtgggatgatatagtcctggtctcttgtctctgggtgagtgtggga

SEQ ID NO: 85584 - DNA, 105 bp, Mus musculus
ggagaggatgggacacacccacacttgtgtagtacttgctgatggacgataagcagtgtaaagatgtcagcactcagtactgatgcaggagtcgggatgctcttt

SEQ ID NO: 85585 - DNA, 83 bp, Mus musculus
acacacacacacacacacatatatatatacatacatatacatgtgtgtatatggtatatatgtgtatgtatatatatgtatat

SEQ ID NO: 85586 - DNA, 79 bp, Mus musculus
gcaggccttcagtggacacagtgtggactgtcactctttgtgttcagtgggtggaagtttcaagctgggccactcttgc

SEQ ID NO: 85587 - DNA, 62 bp, Mus musculus
catggctgagtctgtgtgtgtgtgtgtcactgggtacagctccacatgtgcagatcgctgtg

SEQ ID NO: 85588 - DNA, 100 bp, Mus musculus
actttctatgtctctgttggtctgtctgtctgtctgtgcgtgtggctttaccacccacgtgcacatactaactcatactctgacctttctatagaaatgt

SEQ ID NO: 85589 - DNA, 116 bp, Mus musculus
gtagacaatagaggtgtaaggtttgattgctgggtttgggtttgggtttgggtttgttttattttgttttgaaacttggtgtccaagacagaatatatgtatatgtatatgtgtat

SEQ ID NO: 85590 - DNA, 74 bp, Mus musculus
gtgtgtgtgtgtgtgtacatatatatgtatgtgtgtgtacatatatatttatatgtgtgtgtacacatacatat

SEQ ID NO: 85591 - DNA, 127 bp, Mus musculus
acatacacatatatgtatgtatatacacacatatgtgtgcattatatgtatatacatgtatgtatatatgtatatatgtgtgtgcattatatatacatgtatataagaatgcatacacatatataca

SEQ ID NO: 85592 - DNA, 71 bp, Mus musculus
gtctctttccccccataacctggtagttgagtttatctttctttattgatggtggaggtggggaacgtggc

SEQ ID NO: 85593 - DNA, 67 bp, Mus musculus
ggatctacaggtgctggagtcaggcagtctctcacagacattttctcactccagtgtaagcaggtcc

SEQ ID NO: 85594 - DNA, 81 bp, Mus musculus
gcatagatcagtttggccagacagtctctgcgtgtgtcacactcggctcgggagcagggcttctggaacacctgctgctgc

SEQ ID NO: 85595 - DNA, 112 bp, Mus musculus
ctctggaagaacagccagtgctcttaactgctgagccatctccccagcccctgttttttttttttttttcaagagtttctcagtatattcttggctgtccttgaatttagag

SEQ ID NO: 85596 - DNA, 98 bp, Mus musculus
gagaccaatttccatttattcacacaactgttttacatggtataacatggaagttatacctcattaaaaatgaaaaatcgtagctgggcggtggtggc

SEQ ID NO: 85597 - DNA, 115 bp, Mus musculus
tggttaagagtgcttactatcgggctggagagatggctcagaggttaagagcactgactgctcttccagaggtcctgagttcaaatctcagcaaccacatggtggctcacaacca

SEQ ID NO: 85598 - DNA, 109 bp, Mus musculus
gtttctattagacaactagggcagaagtgtcctcatctgtttttgacattatgtgagtacagagtgtccaaagatgtgtgttgtctctgtcacttggttgctgtagtac

SEQ ID NO: 85599 - DNA, 88 bp, Mus musculus
gggactgttcccaggcatagaatttgaaatgtgagttaggatggacattagatgtgattatgatgatctagggaaggtctgcagtcct

SEQ ID NO: 85600 - DNA, 74 bp, Mus musculus
tgtttggttgtgtgtgtgtatgtgcatgcatgcatgtatgtatgtatgtatgtatcacatacatgctttgtgca

SEQ ID NO: 85601 - DNA, 70 bp, Mus musculus
tgtgtgtgtgtgcctgtgtgtgctcaggggtacactgacgactgtgagcacacacatgtacatatgaaca

SEQ ID NO: 85602 - DNA, 80 bp, Mus musculus
taccttcagtgtctctgtcacacttggagggatgtgaacataacagacacggggacaggctggcaagatgacagagggta

SEQ ID NO: 85603 - DNA, 80 bp, Mus musculus
gctaagccattattgtcatgtattctgtcaccaggggattctcacatactctctcagaatatgtgcaatgacgcttatgt

SEQ ID NO: 85604 - DNA, 76 bp, Mus musculus
tatttatgtgaagaatatgcatcatgtttagagggtgtatagtcactctctgtctgtctcactttttccatgaata

SEQ ID NO: 85605 - DNA, 81 bp, Mus musculus
gaatgtgctgtgtgtccccaggaagctgctagggcttcttctcagagagtccctcactcactcggaacgggcagctgaatc

SEQ ID NO: 85606 - DNA, 97 bp, Mus musculus
tctttcaactaaagcagccaggccacactgtgctgatactgaccaagggtctgctcactcggtgtcactgtgcctggtgggcgagtatatgactgga

SEQ ID NO: 85607 - DNA, 87 bp, Mus musculus
gaggaggtcagagcctttgagactggagtcacagcagttgtcaactgccattgttttgcattcttaagaactaagatcctgaacttc

SEQ ID NO: 85608 - DNA, 101 bp, Mus musculus
tgttgactggtattctatgacactgatggaccacggaagtttcacctgttggaggacatttggacattgttgtcttcagttcatggcagtttcaagtaaca

SEQ ID NO: 85609 - DNA, 63 bp, Mus musculus
tcacactgcctctgtcgctgcttacaactatgcagttgtatttcagagacagagaagtgatgg

SEQ ID NO: 85610 - DNA, 99 bp, Mus musculus
cagccgcctataacctcctggctttactgcaaaggaagaaggatctttgtgcttactctcctctgtctctgtaacagtcttgctatgtaatgctggctg

SEQ ID NO: 85611 - DNA, 75 bp, Mus musculus
ttgctttagtctcctgagtgctgagatgacagatgtgaggcaccacctggcattacagagcttaaagaacagcag

SEQ ID NO: 85612 - DNA, 69 bp, Mus musculus
gcagcatttcccacccactcactcacaggttgaagcgctttcttctgagatacagtctggagatgctgt

SEQ ID NO: 85613 - DNA, 112 bp, Mus musculus
atgccaagtaataaaggaggtgaatgtttctgttattagattctttcattgtataaatctatttaataagctggcttggaatctctgatagaaaacagacttagtgtggtgt

SEQ ID NO: 85614 - DNA, 94 bp, Mus musculus
tggaaggggaaggattggggtggggtggtctggagaggtgttcgtggaggctgagctgaacacacacactgacacagattcacttctttttcta

SEQ ID NO: 85615 - DNA, 108 bp, Mus musculus
gctttgactgtttgtttgtgtggcttgagacagcacacagtgaggagactagagccggtgagtttcagatcagtgtgagagggggtgccaggtgagcagatgggcggc

SEQ ID NO: 85616 - DNA, 89 bp, Mus musculus
gtcccagaattagctctgtagaccaggctggcctccaacttggagataaatctgtctctgcctctgcctctgcctctgagtgctgggat

SEQ ID NO: 85617 - DNA, 74 bp, Mus musculus
agtatgtgcatttagtgtggctagtggggctcagctgtctgtctctctctgttggtcgtaaatggtgtacatct

SEQ ID NO: 85618 - DNA, 94 bp, Mus musculus
gacaacctaagttgaatcctcggaccacgcatgatgtaaagagaggaccaactcatgcaggttgtcctcctactgcacacatgtaccatggcac

SEQ ID NO: 85619 - DNA, 85 bp, Mus musculus
agtcttatcttatttttgattacatttatgtgtagagatgtgcacatgactgtaggtgtttgtggtcataaaaggatgccagatt

SEQ ID NO: 85620 - DNA, 117 bp, Mus musculus
gtttgtgtttctgactccttttaatagactcggatttccagagtagtgaggactttgcttaccttgagtactgtcgtcacttttactcagatctttgctataaaatgacattcaagc

SEQ ID NO: 85621 - DNA, 85 bp, Mus musculus; identical to SEQ ID NO: 57439

SEQ ID NO: 85622 - DNA, 59 bp, Mus musculus
ttttgcctgtatgtatgtatgtatgtgtgtgtaccacatgtatgcctagtgcagcagag

SEQ ID NO: 85623 - DNA, 71 bp, Mus musculus
gtgtggactttggaagcacaggccgactgggtagtaaggccaggggttgagctctgtgtctctgtctgcat

SEQ ID NO: 85624 - DNA, 89 bp, Mus musculus
caggggctaagatggagagtggtggatacacacacacacacacacacacacacacacacacacacacaccctcgctgtctgtgtctctg

SEQ ID NO: 85625 - DNA, 110 bp, Mus musculus
ggggttgggatccgcatctgcctctccttctccacatgtctctcatcgtagacatacagtctgtgtctcaatgtggagccctgaggagtgaggggcgctggagcatcctc

SEQ ID NO: 85626 - DNA, 57 bp, Mus musculus
agggtctggagagacagctcagcggttaagagcactgactgctcttccagaggtcct

SEQ ID NO: 85627 - DNA, 70 bp, Mus musculus
gaatgcttcgggctggagagatggctcaatggttaaaggcactgactgctcttccagaggtcctgagttc

SEQ ID NO: 85628 - DNA, 80 bp, Mus musculus
atgctcagcttcaagccaggtattcaatgacactgtgacctctctctgtctgtgtgcctgtcttgtgtctctgtctgtat

SEQ ID NO: 85629 - DNA, 84 bp, Mus musculus
ctgggctcctactagctagacttaagtagtagtatctttggagacatataactatatatttatgatagtggttaatgaaaccag

SEQ ID NO: 85630 - DNA, 96 bp, Mus musculus
ctttgggatagacagagtcagtcaaggtacacagggccaggacctggattatcatacagccacactcttactcagacagcctttctccacccaaag

SEQ ID NO: 85631 - DNA, 111 bp, Mus musculus
agtgtttctttgggtaatttaagcttttgcatttgaaactatttatataacatgtccatcttaattccatttggtctttaaatgcttttgttttgccttgggggattgtct

SEQ ID NO: 85632 - DNA, 85 bp, Mus musculus
gagctacatgggtggtgggggggggttggcgtgtcagtttttttctttagtattacagcatgacttccagtataaaagtaagctt

SEQ ID NO: 85633 - DNA, 119 bp, Mus musculus
gaaagtaaaagacacaaagaaggggctggagagatggctcagtggttaagagcactggctgctcttccagaggtcctgagttcaattcccagccacctacatggcagttcacaactatc

SEQ ID NO: 85634 - DNA, 56 bp, Mus musculus
tctgtgtgtctgtgtgtatctatgccatgtgcaagggggtgcccatgggagccaga

SEQ ID NO: 85635 - DNA, 67 bp, Mus musculus
tctttctgtcacctctgtctgtcactggcaagccagaaggcaggccaagctagagggtgaaatgaga

SEQ ID NO: 85636 - DNA, 110 bp, Mus musculus
gagctataaaagaggtaactgggagttggagagatggctcagtggttaagagcactgactgctcttccagaaggtcctgagttcaattcccagtaaccacatggtggctc

SEQ ID NO: 85637 - DNA, 86 bp, Mus musculus
tggtggtgaacttgggggagtctctgtctctgggtcccatctcgctcttggagcattggaattctcattgtgagctactaccctaa

SEQ ID NO: 85638 - DNA, 75 bp, Mus musculus
tttttaaaggcaaaatggagtttttgttgtacttttgaaaggatgacaaaaaccccatttgtctgcatttaagga

SEQ ID NO: 85639 - DNA, 92 bp, Mus musculus
tagcagagccagcatttgtttgtttgtatctgtgcatgtgtgtgtgcacacacttgtgcacctgtgccgttcctgcacgtgcttatgtgctg

SEQ ID NO: 85640 - DNA, 74 bp, Mus musculus
aagtctctgtgtctgtctgcagtctccttccaaacagtgcttttgtgaactctgactgggccagcacagtattt

SEQ ID NO: 85641 - DNA, 99 bp, Mus musculus
gaaatagcagagggactggagagatggctcagcggttaagagcactggctgctcttccagaggtcctgagttcagttcccagcaaccacatggtgtctc

SEQ ID NO: 85642 - DNA, 82 bp, Mus musculus
gaaagctggcaatgtacacatttggagacgctcttttcccaagagagaacagtgtgagtggagatgacaaggccctgccttc

SEQ ID NO: 85643 - DNA, 119 bp, Mus musculus
gaactcactttgtaggccagactggtccaactcacagactgcctgcctctctgcctctggagtgctgggattaaaggtgtgtgttaccatgcctggctctttctaatctctgtaggttc

SEQ ID NO: 85644 - DNA, 105 bp, Mus musculus
ctggagtgagtggggccaatggagttgactggagtgagcagagtgagcagaggtcctaaattcaattcccaacaaccacatgaaggctcacaaccatctgtacag

SEQ ID NO: 85645 - DNA, 83 bp, Mus musculus
agccagaagtgacagacctcacagggcccttaggtctctggccactaagtaagacctttgtgtgacctcatgtctacatggct

SEQ ID NO: 85646 - DNA, 113 bp, Mus musculus
ggtctgtgggtgccaagggaagggtagtgtggacataagggaagctcaacccatgatctggagacttctctgtgagtcagtgtgcccagccaagctggatggaggtcaaggcc

SEQ ID NO: 85647 - DNA, 84 bp, Mus musculus
gcttgcctctgactccacgcccagacaactttgtttgtttttgataaactctcctgcagctggtgagcctgtgagtcggtcagt

SEQ ID NO: 85648 - DNA, 121 bp, Mus musculus
tctcagcacttgggaagtggagctaggaggtcatctgcggttaacacactgaccgactcacaggctcaccagctgcaggagagtttatcaaaaacaaacaaagttgtctgggcgtggagtc

SEQ ID NO: 85649 - DNA, 110 bp, Mus musculus
agttctagtcactcaagttctagtacagtttcctttgaagcagtaggaaaccagcctagctgcctgtgagcctctgtgcgtggactgctagatcttcccagtgctgggtt

SEQ ID NO: 85650 - DNA, 80 bp, Mus musculus
tccagaagagggtgtcagatctcattatgatgttgtgagccaccatgtgattgctgggatttgaactcaggacctttgga

SEQ ID NO: 85651 - DNA, 85 bp, Mus musculus
gggcttgttctcagaaccagggactcggtagtgaataatacaagtctgtgagctctctgagctttgcctgtagtaaattactggg

SEQ ID NO: 85652 - DNA, 61 bp, Mus musculus
gtgtgtctgtctgtcggtgcctgtctctcttctgctgaggatagcatcaggaccagcgctc

SEQ ID NO: 85653 - DNA, 71 bp, Mus musculus
gcattgggagagcgtggggtgtggatgccatttggttggggctcagcatttcactgggtctctctctgtgc

SEQ ID NO: 85654 - DNA, 92 bp, Mus musculus
atgtgccccaggtggcagtgcctgtgtctctgtgagatagggcctgaagtcctgaaaagcaggggacacgtaaaatggccagctgcccctgg

SEQ ID NO: 85655 - DNA, 64 bp, Mus musculus
gtttctcccactctctgagcctcatcgacaagataaacagattgggcctggtgggtcctgaagc

SEQ ID NO: 85656 - DNA, 115 bp, Mus musculus
cgtggacagacagacagtgcagtcacccataaagtagaaagcactactaacagcactggagggtgtagtgtttcctactttatggatgagtgcactgtgggcttcggagaccacg

SEQ ID NO: 85657 - DNA, 102 bp, Mus musculus
gttgacctagttctctgcaaccctggcctgtggagcaagggaaagatgtctgcatccagtgctctcactttgtcttgcttattagagaccacattggtcgac

SEQ ID NO: 85658 - DNA, 76 bp, Mus musculus
gtgagagtctcattttcaactgtagaatgtcaaacttctgtttgattaagaaagtctgcaaatgtgattctaaaac

SEQ ID NO: 85659 - DNA, 70 bp, Mus musculus
gaaattcaggagctggagaggtggctcagcggttgagagcactgactgctcttccagaggtcctgagttc

SEQ ID NO: 85660 - DNA, 64 bp, Mus musculus
tggtttttcaagacagggtttttctgtatagctctggctgtcctagaactcactctggagacca

SEQ ID NO: 85661 - DNA, 90 bp, Mus musculus
atgtttatgaggctggagggatgactcagtggttaggagcactgactgctcttccagacaacctgagttcagttcccagcaccaagatgt

SEQ ID NO: 85662 - DNA, 67 bp, Mus musculus
gggagagaggacacagaggcctggaaaatccataaacggagtcgtcagcccctgtgtcttggctcct

SEQ ID NO: 85663 - DNA, 79 bp, Mus musculus
cagggttcaagcagggttggggacttagggtctgagtcagtcagggtctctgagcccttcccaggttctttggtctctg

SEQ ID NO: 85664 - DNA, 135 bp, Mus musculus
ctcatttatgtgtgccatacatccccataatattttatgccattattttgaagtatgtgtgtgtgtgtctgtgtatgggtggagggacccacaaaggccagaagatggcgttgcctcctctagagctggagatac

SEQ ID NO: 85665 - DNA, 80 bp, Mus musculus
ggcagaggatctgctacaaatggaaaaggaaactggaaggttcctgtctgtctgtctgtctgtctgtctgtctgtctgtc

SEQ ID NO: 85666 - DNA, 77 bp, Mus musculus
gcagacagaagccaggtgctgaggctgggggaataaaacacagaaatgtggctgccttactctgtctgtctgtctgt

SEQ ID NO: 85667 - DNA, 84 bp, Mus musculus
ctagaggggctcactctctcactgggttggcagcggaaggctcctctgccttcgggggagtacactatcagagagagctcagag

SEQ ID NO: 85668 - DNA, 119 bp, Mus musculus
tgtgtgtgtgtgtgtatgggggggggggagggctggagagacggctcagcagttaagagcactgactgctcttccagagatcctgagttcaattcccagcaaccacatggtggctcaca

SEQ ID NO: 85669 - DNA, 106 bp, Mus musculus
aatgtgcctctggggctggagagatggggctcagcggttaagagcactgactgctcttccagaggtcctgagttcaattcccagcaaccacatggtggctcacatt

SEQ ID NO: 85670 - DNA, 112 bp, Mus musculus
gctctaagatgctgaagagttatttatccatgtagtatgtatgtatgtatgtatacatgcatgcatgcatatgtgtgttcaagacaggatttttctgtgtagcccttgatgt

SEQ ID NO: 85671 - DNA, 81 bp, Mus musculus
gtgaggctggtgagaggggctgtggttgggcatctgtttagctcaagtgctatctgctgtgggtctcactcacttacttgc

SEQ ID NO: 85672 - DNA, 77 bp, Mus musculus
tgcccttcaggttttacagtaaccagggggttcagagtgaacaaagacagcagggttgcacggtgggaggaggggca

SEQ ID NO: 85673 - DNA, 86 bp, Mus musculus
aagctatagtaatacttactaagtttttaaaaaggcttctgcaatacaggggaggaaaaaggaaaataaagaagtgctattagctt

SEQ ID NO: 85674 - DNA, 87 bp, Mus musculus
ttggtaataggtgtgtctgtgcctgtgtgtctctgtacatttgtgtatgggaatgcacgtgtgagttttgttgcctgtaaaagccag

SEQ ID NO: 85675 - DNA, 62 bp, Mus musculus
tatgtatgtgtgtgtgtacatatatatgtgaatatatgtgtatgtatatgtatatatgcatg

SEQ ID NO: 85676 - DNA, 66 bp, Mus musculus
acagggtatgggagattctcaatcatagaatactgacttctatggggtgtgtgtctctctctgtgt

SEQ ID NO: 85677 - DNA, 93 bp, Mus musculus
agacattatactgcatgtattcaaatgcatttttataaaataggtcatcttgaatatatatatgtttctatgtatatgtgcactcatatgtct

SEQ ID NO: 85678 - DNA, 81 bp, Mus musculus
gactctttagagcctccctgcctctctcagaatgagtaccactctggccatctggttttggagagttggtcttgactgagg

SEQ ID NO: 85679 - DNA, 76 bp, Mus musculus
gtgcagatcagcagggagcttccaatctggctggcactccaacacgtggcacctgtctctctctctgacctggcat

SEQ ID NO: 85680 - DNA, 80 bp, Mus musculus
gccagagctgtttatctggcttcactgagtctctgtcatttacagggccttaggtagaagacattggcagtggtgctggc

SEQ ID NO: 85681 - DNA, 61 bp, Mus musculus
ggggttttcacagtctcccttccagtgtactaacagtgcacagctctgtgacagtgacctc

SEQ ID NO: 85682 - DNA, 60 bp, Mus musculus
gaggcaggtcagaagggagtgtgcagacaagattagctcagactcagctgatccagtctc

SEQ ID NO: 85683 - DNA, 56 bp, Mus musculus
gggagtgacaggtgctaaggagcggctgctctcaggctccttgcttctttcatcct

SEQ ID NO: 85684 - DNA, 132 bp, Mus musculus
atatacacatgtgtatgtatatacatatatacacatgtgtatgtgtatacacatatatgtatatatatgtgtgtgtgtatatatgtgtatatatgtgtgtatatatatgtgtgtatatatatgtgtatatat

SEQ ID NO: 85685 - DNA, 114 bp, Mus musculus
atatatatacatatatgtgtatacacatacacatgtgtatatatgtatatacatacacatgtgtatatatgtatacacacatgtgtatatatgtatacacacatgtatatatgt

SEQ ID NO: 85686 - DNA, 65 bp, Mus musculus
ttggccctgatagggggaggatgtgttctggacagctgttcacacaccctctctgtcagaactag

SEQ ID NO: 85687 - DNA, 97 bp, Mus musculus
ttcaagaatattcctctgcagcagcgccatgctagtctgaggcttggccttgaccatgcttatctctggcagctatgaaaactggacactcattgga

SEQ ID NO: 85688 - DNA, 97 bp, Mus musculus
tgatcattatcatgtatgtatgtatatgtgtatatatatacatatatgtgtatatatatcctgaaatgacacactgtaccctacaaatatgtataat

SEQ ID NO: 85689 - DNA, 71 bp, Mus musculus
tatttcctactacaaaatgctgcctgcctgtctgcctgccaagggagggaggagacagtttccaggaaatg

SEQ ID NO: 85690 - DNA, 110 bp, Mus musculus
ctttcaaaaaaaggaacaagatggaagagactggcaacaagcaatttccttttaagcaatcactgtgatgtttgctgcacatactacttctagccttgcctcagtggaag

SEQ ID NO: 85691 - DNA, 107 bp, Mus musculus
ggagagaaggaacaaacacaattggtcggcctcacactgattctgtctcttgcaaatgactgaatgggacatgcagtgggagggctgtctgtgtggatgttctgccc

SEQ ID NO: 85692 - DNA, 83 bp, Mus musculus
gtgtgttatcagccactgccttatagtttaagttaatccatccttctttaactggtatgagtcagatgtatgctggtgagtgc

SEQ ID NO: 85693 - DNA, 57 bp, Mus musculus
cctcagcctgcctgcctgtgtggcttaggggataagcacagaacaggcaaaggaggg

SEQ ID NO: 85694 - DNA, 80 bp, Mus musculus
acccacctgtctgtctgtctgtcttgcatatatgtcatgctgtgaacctggaagtcagaggacagcttgcctgagtcggt

SEQ ID NO: 85695 - DNA, 90 bp, Mus musculus
cctcatactctggggagttgcggggggggggggagggtcgagcacaccctcactctctttcatcttggagctagtacgaaggaggtgagg

SEQ ID NO: 85696 - DNA, 80 bp, Mus musculus
tatgcccaggtagctagagcagcttaccctgcttgtagtcaaactacaaaactagctgtaactctctctctctgtacata

SEQ ID NO: 85697 - DNA, 59 bp, Mus musculus
atacatacatatgtgtatgtatatgtatgtatatatatgtatgtatatgtgtgtgtgta

SEQ ID NO: 85698 - DNA, 74 bp, Mus musculus
tcttgactcagtggtacatactttccatcccagcactctagaggcagaggtagatggatcttctgagttcaagg

SEQ ID NO: 85699 - DNA, 60 bp, Mus musculus
tcagaggacagtgggacctctctcggcccaatggtcttcagaggacacttctgtccctga

SEQ ID NO: 85700 - DNA, 122 bp, Mus musculus
atatgtatatatgtgtgtgtatgcatgtgcatgtgtgtgcatgcccgtgtgcatatatatatatatatgtatatatgcatgcatgcatatgtgtatgtatgtgtgtatgcgtgaatatatgt

SEQ ID NO: 85701 - DNA, 114 bp, Mus musculus
gcagtagataactccgcattacccaaagcccagtgtacccagcccataggcaagttcttgctgtgtctgtgtctctcccatgtcctgggcatgtgtgtgtgtacctatgtgtgt

SEQ ID NO: 85702 - DNA, 64 bp, Mus musculus
tgtgtgtgtgtgtgtgtgtgtgtacatgtgaatatttatgtatgtatgcatatatgtgtgtaga

SEQ ID NO: 85703 - DNA, 127 bp, Mus musculus
ctcatttgcttggacatcttctgaggcttttaaaaaatgggactgagttttctctttctatttgaaagttagacttacaatccttttagttgcttaaataaaatcttttagaatgagagcttagtgc

SEQ ID NO: 85704 - DNA, 84 bp, Mus musculus
catgttgccctcattcatagtttcaaagtttatgtaattgtctgccaggccccaattccaaagttgtgagtgaggagtaaaatg

SEQ ID NO: 85705 - DNA, 135 bp, Mus musculus
tattggcccgtggaacattttcttgattggtgatggatggtggggggtggggtgtctagatcactgtgggtgatgttattcctgggctggtggtcctggctgctataaaaaagcagggtgagcaagccatgggga

SEQ ID NO: 85706 - DNA, 71 bp, Mus musculus
atatgtatacgtatatgatgtatatgtatacaatgtatatgatgtatatgtatatattaatgtgtgcatgt

SEQ ID NO: 85707 - DNA, 83 bp, Mus musculus
gaaggggctcttgagtcacaggtgataattcttcccctccactaaggtggtgcagagctcactggctgcctcactgtcccttt

SEQ ID NO: 85708 - DNA, 85 bp, Mus musculus; identical to SEQ ID NO: 57439

SEQ ID NO: 85709 - DNA, 103 bp, Mus musculus
tgggagggtgagagctttggtgttctaagccttagacccatgagagagtctcactcactcatatatccagagtgcttctatatcaaggctagtagccacctca

SEQ ID NO: 85710 - DNA, 177 bp, Mus musculus
gataaaaatatatgaaatgttcaaagattaatatatatgcatacatatatacatatatttatatgtgcatatatatgtatatctattatacacacatgtatatatatgtatatctattatacacacatgtatatatatatgtgtatatatatatatgtatatatatatatatatatg

SEQ ID NO: 85711 - DNA, 76 bp, Mus musculus
gtgtgagaggatgagagatgtcacagtggtctcgtgaggcccactcactgatgggaacttctccatcctgctctgc

SEQ ID NO: 85712 - DNA, 101 bp, Mus musculus
aagggaaagatgcagccattttgagtgacaggaagactgggaccccacataaacagtttttttttttaaaaagtcagacttgagacactgcactttgcctt

SEQ ID NO: 85713 - DNA, 133 bp, Mus musculus
tatacatatgtgtgtgtgtgtgtataatatatgtgtgtataatatatatatacatataatatgtattatatgtatatatttatgtgtgtgcatatgtatgcatatacatatgtgtgtgtgtatatatatatat

SEQ ID NO: 85714 - DNA, 76 bp, Mus musculus
atgtgtatatatgtgtgtgcatgtgtatgtgtatgtatatatacaagtatatatatgtacatatatatatatatat

SEQ ID NO: 85715 - DNA, 71 bp, Mus musculus
gccatgggaagacacactgtcacacacttccactgtcctgggagccattcttgacaccgtgctctcactgc

SEQ ID NO: 85716 - DNA, 92 bp, Mus musculus
caaaccgtaaaagagtggtacttagtctccgggagctgcttcttcgctgtttctgagaacagagtctggtgtatacattttctaaatatttg

SEQ ID NO: 85717 - DNA, 67 bp, Mus musculus
cttggggtagaaggagctggtgtcaaaagactcacactctctgtttgacctggtactgttccctaag

SEQ ID NO: 85718 - DNA, 87 bp, Mus musculus
tgcaaatgagacatctgcttcttatgtgcagatggtgcaggcatctttcacatctttgtcaaatagagtaggaagtctcatatagca

SEQ ID NO: 85719 - DNA, 83 bp, Mus musculus
gccatggtggtcggataggatacatgggacaatttcaatatttttgtatctgttgaggcctgttttgtgaccgattatatggt

SEQ ID NO: 85720 - DNA, 115 bp, Mus musculus
cagggctagtctcttgcccagaccttttagcaagctttatcccggtacttcctgctagggagactctgtgactctgaggacttgcggttgatattaaagagctcatttttccctg

SEQ ID NO: 85721 - DNA, 64 bp, Mus musculus
tctctgtgtatgtgcatgtacatatgggtgtatctttattcatgtacatgtgtgaggtcagagg

SEQ ID NO: 85722 - DNA, 68 bp, Mus musculus
atgtgtgtgtatacacacgcgtatacatgtatatgtgtatatatgtatgtatatgtatacacacacat

SEQ ID NO: 85723 - DNA, 81 bp, Mus musculus
gtgtgtgcatgctactatttgaggcatgcatgcatgcatatgcatgtgcatgtatgtatgtatgtgtgggcatgtgtaggc

SEQ ID NO: 85724 - DNA, 85 bp, Mus musculus
ggccatggtggtcggataggatacatgggacaatttcaatatttttgtatctgttgaggcctgttttgtgaccaattatatggtc

SEQ ID NO: 85725 - DNA, 69 bp, Mus musculus
acaggagggtgtggacagttgtgaggttctacttgctaaaagaagactgccccgactcttccctcaggt

SEQ ID NO: 85726 - DNA, 76 bp, Mus musculus
tatgcatgtgtgcatgtgcatgtgtgtatgtatgtgcatgttcatatttgtgtgcatgtatgtatgtatgtatgtg

SEQ ID NO: 85727 - DNA, 82 bp, Mus musculus
ctggacacggaatcagaagataaggtgtgagtctcatccctgggatgggctgctctgtctctctgaaccactgtttctccag

SEQ ID NO: 85728 - DNA, 82 bp, Mus musculus
cacttgaaatagctacagtgagcagcttctgctgtgtcttccaagttaagcactgtcacagtctggctcactcttctcagtg

SEQ ID NO: 85729 - DNA, 96 bp, Mus musculus
gggaagaactgccttgttcttggagaggaggacattggagagtcattggtttcttgaagtagcttgtttaattaagtgagtgacagtttgggtttc

SEQ ID NO: 85730 - DNA, 110 bp, Mus musculus
gccctgtctgtcccaggctgctcttcaccctccttgatgtgacatacagagacatctgacacaacagagagaactgggtgtccagacatccctggcagagagagaggcag

SEQ ID NO: 85731 - DNA, 74 bp, Mus musculus
catgagctcatggtcccctcttattcaaatcactccagggatcagatgttgagagaagagagactgagctgatg

SEQ ID NO: 85732 - DNA, 130 bp, Mus musculus
tgcttatatacatatatactcacctataatttatgtatgtgtatatatgtatatatgtgtatatatatgcatgtacataaatatgctgatatttgcatatacacatataatgcatatatatacatgtata

SEQ ID NO: 85733 - DNA, 84 bp, Mus musculus
gattgcatgtatagatgtatatacatatatgttttcaagaataacatgttgagtccatataatgtgacatatgtgtatgttttc

SEQ ID NO: 85734 - DNA, 105 bp, Mus musculus
tagacactggggcacattaaagtgtggttggttctctccctgtctcactttttcctgagtgctggacttcaaatatgaactactacattcagatttcagtgttta

SEQ ID NO: 85735 - DNA, 82 bp, Mus musculus
ttgacagggcctggagagatggatcagcagctaagagcactgactgctcttccagagatcctgagttcaattcccagcaacc

SEQ ID NO: 85736 - DNA, 63 bp, Mus musculus
gcttgtgtctgtctctgtgagtgctagtgtatatatgagcacatgattatggaggccacaggc

SEQ ID NO: 85737 - DNA, 81 bp, Mus musculus
tgatcctgggtttgagtctgggtagacaaaactgtaactctctcattgagagtgaagcctgaccctcactctgtcccatca

SEQ ID NO: 85738 - DNA, 102 bp, Mus musculus
tagctttccattaacattgagcagacaggagtgttagcagagtgaatgaatgaatgaatgaatgaatgaatactcaaatctaaactcaacttaatgtagtta

SEQ ID NO: 85739 - DNA, 85 bp, Mus musculus; identical to SEQ ID NO: 57439

SEQ ID NO: 85740 - DNA, 77 bp, Mus musculus
gaagtaactaggagctggagaaacggctcagcgattaaaaacactgactgctcttccagaggtcctgagttcaattc

SEQ ID NO: 85741 - DNA, 85 bp, Mus musculus; identical to SEQ ID NO: 57439

SEQ ID NO: 85742 - DNA, 96 bp, Mus musculus
tatacttgtatacttgtatatgtatgtatgcatatatatataattgtttacttgtatatgtatgtatgcatatatatataattgtttacttgtata

SEQ ID NO: 85743 - DNA, 88 bp, Mus musculus
acttgtatacttgtatatgtatgtatgcatatatatataattgtttacttgtatatgtatgtatgcatatatataattgtatacttgt

SEQ ID NO: 85744 - DNA, 130 bp, Mus musculus
caagtatacaagtgtatatatatgtatatatatatgtatatatatatatatgtatatgtatatatatatgtatatatatatgtgtatatatatatatatatatgcatgcatatatgtgtgtaggggtatg

SEQ ID NO: 85745 - DNA, 131 bp, Mus musculus
tatgtatatgttatgtgtgtctgtctgtatgtatatattatatatatatatatatatatatatatatatatacagatctgtatatatatatgtgtgtgtgtgtctatgaatcttaggtataataaaaacag

SEQ ID NO: 85746 - DNA, 71 bp, Mus musculus
ggtgtatgttgtgtggctggtgttccagtatctgagagatcttgggagtccagtcctcctacagggtcacc

SEQ ID NO: 85747 - DNA, 98 bp, Mus musculus
agtgaacatcctcaaagctgatgtaaaatcctgatgtggtgaccatgtctgaaacttcaggacagagtagagtgtcaggagtatcttgggagctcatt

SEQ ID NO: 85748 - DNA, 95 bp, Mus musculus
gcttcctcttcaataggagatgagtcttactgcaacttgatatgctaatgctggttaatatccatgtgaggcttccacttttctaaagagaaagt

SEQ ID NO: 85749 - DNA, 109 bp, Mus musculus
gcctcctctgtgcctaactagtaaacaagccttgtacacaggcgctagagtgaactcactcttagtcactccctattctcggggcgtaatagtggggtgatgagcgagc

SEQ ID NO: 85750 - DNA, 95 bp, Mus musculus
gtgtgtgtgtgtggtgttggtgtccatgagtgctcctacactctcagtctgtgtggtagtacttaagagacattggaagggccatctgcatacac

SEQ ID NO: 85751 - DNA, 81 bp, Mus musculus
gataaaggcagattgtgtgtggggagggggtgtggggggtgtgtatctacgtctctgtcactgcctctctctgtctgtgtt

SEQ ID NO: 85752 - DNA, 75 bp, Mus musculus
gtaacagatgtatagtttgatctttatgtgaatcccccggacaactggagcatggactgtctctgactctgttgc

SEQ ID NO: 85753 - DNA, 104 bp, Mus musculus
gccttatcatggtgttctgataggatgcatgggacattctcaatatttttgtatcttttgaggcctgttttgtgaccaattgtatggacagttttggagaaggt

SEQ ID NO: 85754 - DNA, 58 bp, Mus musculus
tatatatatatgtatatgtatatatgcacatgtgtatgtatgtatatatgtatgtgta

SEQ ID NO: 85755 - DNA, 68 bp, Mus musculus
cacatataaatatatatgtatgcatacatgtgtatgtacacatgtatgtatatatatgcatatatgtg

SEQ ID NO: 85756 - DNA, 106 bp, Mus musculus
gcttgtctacacagctcatctgacagcaaaggctgctgctaagatttaaaatgtaaatcatatttatggaaagccctggtgtttgactagtatgtggtgacgatgc

SEQ ID NO: 85757 - DNA, 67 bp, Mus musculus
gagaaagtgtcacaacaaagagtggagagtaaactctcaggtaaactgtgggtatgtgtgatgtctc

SEQ ID NO: 85758 - DNA, 87 bp, Mus musculus
cccactgatgtgccttgactgtttatttttctatagtgggaaaatttactttgcctcattgtttgagagagtagagtttatcatggg

SEQ ID NO: 85759 - DNA, 89 bp, Mus musculus
cactgctatgggctaaaattgtgtgaaaacaggagcagaaagcaggctttcctctcaatttgtttttctcatggagttagatcacagtg

SEQ ID NO: 85760 - DNA, 102 bp, Mus musculus
catgtgtgtgtgtgtgagtgtacatatgtgcatgagtgtgcatgtatgtttgtatatgtgtgtgtgcatgtatttgtgcttctatttatatgtgtgtccatg

SEQ ID NO: 85761 - DNA, 116 bp, Mus musculus
tgcaaagtgttttgatggacttcttttaggttttgtatctgtattaattaccatgtatctaatgtatagatgttattataatacatatactacatctctaatccacaagctctgta

SEQ ID NO: 85762 - DNA, 85 bp, Mus musculus; identical to SEQ ID NO: 57439

SEQ ID NO: 85763 - DNA, 130 bp, Mus musculus
taacaaaatggtagagctaagaacccatcggagagggcacgtgaaagtcaacaaaacttttgagattttcttgatggcatcattaaattgaagcagaattttgttgtttgtttgtttgtttgtttttttc

SEQ ID NO: 85764 - DNA, 66 bp, Mus musculus
atgagaaatgaacaggaatcgagggacaagcctaccacgtgttctctgattctctgtgtttttcat

SEQ ID NO: 85765 - DNA, 154 bp, Mus musculus
tgtgtatgtgtgtggaatatatacatatgtgtgtatatatatatatgtacatacacacacacacacacacacacacacacacacatatatatatatatatatttgtatgtatgagtgtgcatttgtatgtgtgtgtcattaggaaaggaacatg

SEQ ID NO: 85766 - DNA, 85 bp, Mus musculus; identical to SEQ ID NO: 57439

SEQ ID NO: 85767 - DNA, 103 bp, Mus musculus
acgcacgtatatacatatatatatgtgtgtgtgtatatatgtatatatgtgcatatatgtgcatatatgtgtatatatatgtgtgtgtgtgtgtatttattca

SEQ ID NO: 85768 - DNA, 81 bp, Mus musculus
tatgtgtatgtgtatatgctgtgttgtgtatatatatttgtataatgtatgtatttgtgcatgtgtatgcatatgtgtgtg

SEQ ID NO: 85769 - DNA, 113 bp, Mus musculus
gcactgctggactagtagatagaaatggcttaaatgtattttaactataaatgtttttatttctctgttgattagataatagttttgcctggtattgtagtctgagctggtgt

SEQ ID NO: 85770 - DNA, 92 bp, Mus musculus
tatgtttaatggaaaatgtgactatggtaattctgaccttgcagagtgttggtgagaactacagagagaacacacatgcttctaataacata

SEQ ID NO: 85771 - DNA, 80 bp, Mus musculus
cagttggaagaggcttaaactgaagaaatatttttcttttcttgaaaggtagtacttttcagtctgcctcatcatacctg

SEQ ID NO: 85772 - DNA, 68 bp, Mus musculus
gcccctaatccatctgtgcttcactgatttttatatttaacatagtgtgtgtgtgtggggggggggac

SEQ ID NO: 85773 - DNA, 83 bp, Mus musculus
gtatggagatacaaggttaaatagtttaggtactctgaatacgaactgccttttaaaaatttcaatctgcaggatttccatac

SEQ ID NO: 85774 - DNA, 85 bp, Mus musculus
gtccatggtggtctgataggatgcatgggacaatttcattatttttgtatctgttgaggcctgttttgtgaccaattatatggtc

SEQ ID NO: 85775 - DNA, 80 bp, Mus musculus
gcagtgaaagagaactagaaatacagatcggcagttaggcgtgctcgctgctcttgcagagactctgttccttttccagc

SEQ ID NO: 85776 - DNA, 94 bp, Mus musculus
gatgtaatttctgatgctcacttcctgcctggatgccactctggagttttgttagatggggcgaagggctgggggaagcctgaggaagcctgtc

SEQ ID NO: 85777 - DNA, 85 bp, Mus musculus; identical to SEQ ID NO: 57439

SEQ ID NO: 85778 - DNA, 66 bp, Mus musculus
ggagttctgggaagagtctgaggattgagaaaaagactctctttgtctctctgactctctctctct

SEQ ID NO: 85779 - DNA, 83 bp, Mus musculus
tggggtccttgggacatagaagagagagagctgagttcaagcattcaccttgctcagctcttctgactgtggaaagtacaaca

SEQ ID NO: 85780 - DNA, 97 bp, Mus musculus
gtgtatatatatacatatatatgtgtgtatatatcatgaaacatatgtatatatgtatgtacgtatatgtctcatgattgtttcaagatgtaagctc

SEQ ID NO: 85781 - DNA, 82 bp, Mus musculus
gtgtatatgcatatattatgtgtatgtgcatatattatgtatagttataagcaccatatgtatatatgtgtatatatacata

SEQ ID NO: 85782 - DNA, 74 bp, Mus musculus
atatatacatatgtatgtatgtatgtatgtatgtatatatacatatatacacacatatatacatatgtatatgt

SEQ ID NO: 85783 - DNA, 117 bp, Mus musculus
caggtagaagaaagcattagggctggagagatggctcagtggttaagagcactgactgctcttccagaggtcctgagttcaattcccagcaaccacatagtggctcgcaaccatctg

SEQ ID NO: 85784 - DNA, 85 bp, Mus musculus
ggccatggtggtctgataggatacatgggacaatttcaatatttttgtatctggtgaggcctgttttgagaccaattatatggtc

SEQ ID NO: 85785 - DNA, 77 bp, Mus musculus
agatgtcagaagaattattgctgaatttcagggctcaagcttggagcggtgagtgtctgttattctctctgatagct

SEQ ID NO: 85786 - DNA, 58 bp, Mus musculus
gctctgaggggagggattttatggagacctccaattgagactctctctctctccatgt

SEQ ID NO: 85787 - DNA, 87 bp, Mus musculus
gaacatcttgccgttgaagctgtagtgtgtcaaggtgtgtcacacagtgtcacccttttgcccaaatagctttacttgcaaatgttc

SEQ ID NO: 85788 - DNA, 109 bp, Mus musculus
cccatgccccctccaaaaggaaggccctttctcacaaatgcttcttgtaacgtttatttatttataggataggatgctgttggggggtgggggcgggggtgggggtggg

SEQ ID NO: 85789 - DNA, 80 bp, Mus musculus
ctggttgtcttagaactcactctgcagaccaggctgatctcgaactacctacccctgcctcctgagtgctaggattaaag

SEQ ID NO: 85790 - DNA, 70 bp, Mus musculus
caagcatgatgatacatgcctttaattctagtactagggaggcagaggtagatgtatctccatgaatttg

SEQ ID NO: 85791 - DNA, 97 bp, Mus musculus
tcctgaggccttagattaaaggcagtcagaatgctgtctagtttaactttatttttgaatcaagatttctgtagcctgcactgccttgaactcagga

SEQ ID NO: 85792 - DNA, 81 bp, Mus musculus
ctgtgtcatctgagtgtccacacacaggtccccttgctccgcatctggaggagccccagtgtgcacaagttggtgttgcag

SEQ ID NO: 85793 - DNA, 116 bp, Mus musculus
cacgtcccaactccagatgagctcaacagccacctacactcatgcagtcaccccaccgttcactcactgacacactgtgagtagtagctgctgtccgcacagctcttccccacgtg

SEQ ID NO: 85794 - DNA, 110 bp, Mus musculus
acccccctctgttagttaacctagggtctgtcacaggcttacggggtggggttgaatagctctctccctctctgtgcctgtttcctagtgtgcaaggtaaagggtcgggt

SEQ ID NO: 85795 - DNA, 79 bp, Mus musculus
gcagaaccttgtgagctcacttctgagtcattcaggtctgtctagacatagctgagccagaagttgagcaggttagggc

SEQ ID NO: 85796 - DNA, 60 bp, Mus musculus
cagacatggagtcagcttgtggtgtgtatgagcatgtgtgcctgtgtgcctctgtgtgtg

SEQ ID NO: 85797 - DNA, 140 bp, Mus musculus
ttgtgtgtgtctgtgtgtgtgtgtgcctgtgtgtgtatgcctttgtgtgtgtgcctgtgtgcgtgcctatgtgtatgccagtatgtgtgcctgtgtgtatatgtctgtgagtgtgtgtgtctgtatgtgtgtgtgcctat

SEQ ID NO: 85798 - DNA, 86 bp, Mus musculus
gtaaatgggatcagactagagaggtagctcagtggttaggagcaccaaatgctcttccagaggtcctgagttcaaatcccagcaac

SEQ ID NO: 85799 - DNA, 88 bp, Mus musculus
gctagggacaacaggttctcactctcggtcatcccagacaccactgtatgtcagggaagaactgagaacagagtgaggaccctcaggc

SEQ ID NO: 85800 - DNA, 119 bp, Mus musculus
tatcgggtctcagcatggccatgccgccgtccacctcccccatgatgatgagtggtgtctcacccactgtcacgttggggcaaggacaggtccagtctacatgaagcagggtgacttcc

SEQ ID NO: 85801 - DNA, 94 bp, Mus musculus
acgtggaatagagtccagagtcctcaccagatgctacaatatgcatgcgaacatgcacactgtctatctctcattgactctggtctagccatgt

SEQ ID NO: 85802 - DNA, 150 bp, Mus musculus
gtgtgtctgtgtgtgtctgtgtgtgtctgtgtatgtatgtatgttcatacatgtgatatatacatacatgtgatgtatatatgtatgtatgtatatgtatgtatgtgtgtgtatatatatatatatgtatacacacacacatatatatac

SEQ ID NO: 85803 - DNA, 85 bp, Mus musculus
gtagccccgtgtcacactctgcctgtgaggctgagattgtgtccccagttgctttgcctggtggaggaacaagtgctgaggctgc

SEQ ID NO: 85804 - DNA, 78 bp, Mus musculus
ggagagcagacagacagcagacgggcagatggtgagcactcagacacgcccatagcctttgccctgctaaacccctcc

SEQ ID NO: 85805 - DNA, 87 bp, Mus musculus
gatcctgtgtgggggctggacagtactgttttccctgaatctggccaggagtctcagtgtcactgtgactagtgcattgccagggtc

SEQ ID NO: 85806 - DNA, 70 bp, Mus musculus
gtcagtctctgtctgtcaggctggaaggtgggaacttctaccatccacttagaggacacaggccattggc

SEQ ID NO: 85807 - DNA, 77 bp, Mus musculus
actttgaggaaactcagcagactgactggctctctgtgtccacggtcccaagtggtgtgactgctcagcctccaggt

SEQ ID NO: 85808 - DNA, 109 bp, Mus musculus
gagagtgtgtcagatttccctgaagctggagttatagacagttgtgagttacctgatgtgggtgctgggaacagagcttgggccctctggaagagcagtatgcactctt

SEQ ID NO: 85809 - DNA, 75 bp, Mus musculus
gtgtctcctcagagcacagactgactgtctcactgtccagcagacagtttgttgacttttgctttccccagtcac

SEQ ID NO: 85810 - DNA, 107 bp, Mus musculus
gcatgtggcctgctggatctgttcactgggggtcctgggtaaaatatgtttctatatatattaggaactgattcttaggaatgagaatggtctaggagaggaggggc

SEQ ID NO: 85811 - DNA, 96 bp, Mus musculus
tgagtgtggggctggagagatggcttagcggttaagagcactgactgctcttccaaaggtcctgagttcaaatctcagcaaccacatggtggctca

SEQ ID NO: 85812 - DNA, 106 bp, Mus musculus
gtgtaggtaccacactttcttttcagaagttacagggcaaaggggggaacagctgttctccagtgtctatctctgtgacattttaaatgtaagctgagccaaacac

SEQ ID NO: 85813 - DNA, 73 bp, Mus musculus
cttcagaatggtctactgctttcttggccctacgctgttctgtatgaggcttagactcagtctcactctgaag

SEQ ID NO: 85814 - DNA, 161 bp, Mus musculus
gtgtatgtatatgtgtatttatgtgtgtatgtatgtatgcatgtatacatgtgtatgtatatatgtgtgtatgtatatgtgtgtatacatgtgtattatatatgtatgtatatatgtgtatgtatgtgtacatgtgtatacatgtgtgtatatgtgtgtgt

SEQ ID NO: 85815 - DNA, 115 bp, Mus musculus
agctgccccagtattctaaggaactaataggtcaaactgcagcctcagattctgtcagtctcatagagtccttgggagagtgcagtggctctcggttcttcctttggggtctgct

SEQ ID NO: 85816 - DNA, 67 bp, Mus musculus
ccttcccgtgtgtgcatgtgtgcattcgtgcatgcttgtgtgtgtgcatatgcatgtattgggctgg

SEQ ID NO: 85817 - DNA, 88 bp, Mus musculus
ggaaatgtagacgctcaaagggctgacgcaaggagccgtccactaaaacccatcatcattctttctcagtcagtgtctccgcattttc

SEQ ID NO: 85818 - DNA, 103 bp, Mus musculus
gtgtcagtgggaatgggctttgaggtttcaaaagcgcatgccaggctcagtctctctgtgcctgcagatcaggatgtaacttctctagcaccacctctgtcat

SEQ ID NO: 85819 - DNA, 56 bp, Mus musculus
ccagaaagaactgactgtgcacaggaaatgccttagtgtgccggtgcactttctgg

SEQ ID NO: 85820 - DNA, 114 bp, Mus musculus
ctctttttatgaacctactaagtacagagtctacagattccactcagtgagtcagtcacacactgtgtgcacctgtggtttgtgtgtgtgtttgggtgtgctacaattgagggg

SEQ ID NO: 85821 - DNA, 61 bp, Mus musculus
cctgtggggctgctcagttaccatggtccctctgtgtgtgagtgtgtgtgtgcgccagagg

SEQ ID NO: 85822 - DNA, 113 bp, Mus musculus
acaggaagatgctataaggggcaaggccattcacaccctgcctgtctctgtgtttcttgtctgctctgtgagagggggaggagaggtgttctgtgccatagcagacttcctgt

SEQ ID NO: 85823 - DNA, 73 bp, Mus musculus
gagggtagggtgggagcaggactcggcctcactctccttagcctaagacttctgagtctctgactctatcctc

SEQ ID NO: 85824 - DNA, 75 bp, Mus musculus
tctagttctgccactgacttgctctgtgactgccacctagttttagggcaccgtgaggtgtgtaatctctctgga

SEQ ID NO: 85825 - DNA, 90 bp, Mus musculus
agtatccgatggggagagttgacagtgtgcagttctctggagggctaaggggttcacacttttgattggttgctccttgtcttaggtagt

SEQ ID NO: 85826 - DNA, 59 bp, Mus musculus
gctctgtggaatgagtgttcttgatttcttgacaggagtctcaagagagtcagcagagc

SEQ ID NO: 85827 - DNA, 85 bp, Mus musculus
gctgatctccttccaaatgcctggctctctaactcagtctatcagacctcagaagagctacaccagctgacagggagaacatagc

SEQ ID NO: 85828 - DNA, 86 bp, Mus musculus
tgccgctctttggggactctcaggctgtggctctgcaagcaacaacatgtaaacaccaccttccagaagtacacaaatggagcgca

SEQ ID NO: 85829 - DNA, 58 bp, Mus musculus
ctgcaatggagatctggtgctgtctgaagacagtgacagtgtattcacatacatgcag

SEQ ID NO: 85830 - DNA, 62 bp, Mus musculus
tcctagcactgagatggtgggagacgggagaatctccctgtagactcactcacaggctctga

SEQ ID NO: 85831 - DNA, 81 bp, Mus musculus
tctatcagttacaggttttactaccaaggttctcactaaggagatctggttagagtcattggttttgtaggtgtgatgagg

SEQ ID NO: 85832 - DNA, 185 bp, Mus musculus
atatagatatagatataaatatatatatatgggggtatatatatatgtatatatatgtgtgtgtgtgtatatatatgtatgtgaatatatgtgtatatacatatgtgtatatatatatatatacatgtatatatatgtgtgtgtatatatatatacacacatacacatatatataaacatatata

SEQ ID NO: 85833 - DNA, 86 bp, Mus musculus
gccattgtcacctccctccacagacttctgccctgtcagtctgtgagactggcagatggtaccagcctcctggaggaggcctgggc

SEQ ID NO: 85834 - DNA, 149 bp, Mus musculus
ccagggttctgatcacttacccagagaactcgggctaggggtgagtagtgactgtggaaagggtctcagagatgagttggtttataattttttaaagattaattaattaatttatgtactttgagacagtgtctcactatgtagccctg

SEQ ID NO: 85835 - DNA, 83 bp, Mus musculus
atatgtgtgtgtgtgtgtatatatatgtgtatatgtatatatatgtatatatatatatatatatatatacacacacacatata

SEQ ID NO: 85836 - DNA, 118 bp, Mus musculus
tcgtgtgcagatccgtctgggtagagtgtagcaggagttcaatcaatggtagttggtgaggaagtagcttgttttaggaagtatgagctgctgcccaaggaagacaaggcagaaagga

SEQ ID NO: 85837 - DNA, 82 bp, Mus musculus
gaagaacagtgaagacccacaagcatcgcacagctggctgtcccagcaagccaagctctgtgtctgtcgctcagtgtccttt

SEQ ID NO: 85838 - DNA, 83 bp, Mus musculus
tgtgggtgaagccaacctcaaattcctgatcctcctgcctcagtctcctgactgctgtgtgatgacagatgagtgctaccaca

SEQ ID NO: 85839 - DNA, 72 bp, Mus musculus
gtctgtctctgtctgtcagtccctaacaaaggacttcactgtgtctttactgaacagcacagaaggcatcac

SEQ ID NO: 85840 - DNA, 105 bp, Mus musculus
gagttcagggttacatagagagttccgggaagttagtgctacatagtgagtctctgtctcaaagcaacacacatatatggcataggagatgggaaacctgatttc

SEQ ID NO: 85841 - DNA, 65 bp, Mus musculus
tctcagcctctgtctgtctgtctgtctttggcacaaaggaaaacggacatacagaaccaactgga

SEQ ID NO: 85842 - DNA, 120 bp, Mus musculus
gtggggtttttctttacgatttatgtatttaatgtataggaatgctctatctgcatgtgcacctgcatgccagaagagggcatcagatcacatacattacggatggttgtaagccgccat

SEQ ID NO: 85843 - DNA, 119 bp, Mus musculus
ggttttgaaaaatctaagcctacagaaggagctggagagatggctccatggttaagagcagtgactgctcttccagaggatccagcacccacactgtggctcactagatctgaaattcc

SEQ ID NO: 85844 - DNA, 81 bp, Mus musculus
aggcatagcatcaagtagcccggggtatccttgaatttgctatgtaaataaggatgttcttgaattgctgatctcctgcct

SEQ ID NO: 85845 - DNA, 62 bp, Mus musculus
caagggcctcagggtgagagcaagatggtgtatttccttctaagcctcagtctgtgtctctg

SEQ ID NO: 85846 - DNA, 120 bp, Mus musculus
aggcagcttgagccgggactgttgagtgaagtaggtagtttcatgttgttgggcctggctttctgaacacaacgacatcaaaccacctgattcatggcagttactgcttcttgcttagct

SEQ ID NO: 85847 - DNA, 71 bp, Mus musculus
gaaggatcaagaggctactctcccttatgtctggccttgctggactgtgtgtgtgtccctgagtccgtgtc

SEQ ID NO: 85848 - DNA, 97 bp, Mus musculus
tgtctgtcttctgtatataccctgtagatccgaatttgtgtaaggaattttgtggtcacaaattcgtatctaggggaatatgtagttgacataaaca

SEQ ID NO: 85849 - DNA, 139 bp, Mus musculus
gtgtgtgtatatatgtgtgtgtatgtatgtatatatatgtatgtgtatatgcatgtgtatatatgtgtgtatatatatatatatgcatgtatatatgtgtgtatgtgtgtgtatatatgtgtgtgtatgtgtatatgca

SEQ ID NO: 85850 - DNA, 64 bp, Mus musculus
tgtgtgtgtctctgcctctgtctctcactctttttaagtaagaaccagagaaggaggtgcagca

SEQ ID NO: 85851 - DNA, 82 bp, Mus musculus
tatatatatacatatatatatatatatgtatatatatatgtgtgtgtgtgtgtatgtatatatatatgtgtgtgtgtgtatg

SEQ ID NO: 85852 - DNA, 75 bp, Mus musculus
ggctgcctcagactcagtggtatatgccatggttgcggaattgtttgaattggcgtgtctgactctgtcactgct

SEQ ID NO: 85853 - DNA, 72 bp, Mus musculus
agaaatgacaggggcaggagcagaagagttcatactgcgtgtatctctctgtctgtctgtgtctgtctgtct

SEQ ID NO: 85854 - DNA, 75 bp, Mus musculus
gtcctccttcccagtggcagagctgtgttctgtgagtgtctcgccacaggatagagcctgccaggaattctgggc

SEQ ID NO: 85855 - DNA, 108 bp, Mus musculus
ttggtcaagcagcaatggtgggcgtcttcagccccatgcttttttttttttaagcacgtttggaatgaagaatgttctggagctgggttttaccggtgtggctctcag

SEQ ID NO: 85856 - DNA, 119 bp, Mus musculus
aactttgtgatgttattgctaatgtatatcttacatctaatatgttacatattatatattatatgttgcatactacatattgtttattatatactttattgtagagcatatatttagtt

SEQ ID NO: 85857 - DNA, 79 bp, Mus musculus
aacgtctcaggcactctccttctgtgtggctgctgtatcttggtggttggcagaaccagcaggttaagttttgggtgtt

SEQ ID NO: 85858 - DNA, 84 bp, Mus musculus
gttccccgggcctaggttctgtgatacactccgactcgggctctggagcagtcagtgcatgacagaacttgggcccggtaggac

SEQ ID NO: 85859 - DNA, 83 bp, Mus musculus
ccttatactgtttgctagctgtggggtctgaggccagctagaatctctctctgggtctctgcttctcatctataacatgaagg

SEQ ID NO: 85860 - DNA, 85 bp, Mus musculus; identical to SEQ ID NO: 78415

SEQ ID NO: 85861 - DNA, 85 bp, Mus musculus
gctctgctctgttctctgtgtgtgaggtgccattggtgggagtacactcataagtgtggctacggcagagattccgcagacgggc

SEQ ID NO: 85862 - DNA, 79 bp, Mus musculus
gaggatgaaggcagagagtgcggtgagtcacgggcggagctggcctcgctcgctcgctcgctcgctcgcttactcgctc

SEQ ID NO: 85863 - DNA, 65 bp, Mus musculus
gggggtggatatcagattgtcaggctcctacagcgggcactctgagtctctgagtctcacccacc

SEQ ID NO: 85864 - DNA, 79 bp, Mus musculus
gaaaaaacaaacagggctggagagatggctaagtggttaagagcactgactgctcttccagaggtcctgagtttaattc

SEQ ID NO: 85865 - DNA, 65 bp, Mus musculus
ttggctgtggcaggattttcagtgtggtgttttcaagcctcactcactcatcctctcattcccaa

SEQ ID NO: 85866 - DNA, 73 bp, Mus musculus
gtcagtctgtctgtctgtctctgcattttaagacaacatctcactatgcagtcctggctgatttggaactggc

SEQ ID NO: 85867 - DNA, 113 bp, Mus musculus
cactaactttaaggaagctggcccgagttaataaatctggaaggtgtgcgcactgagtgaagacattgaggaaaaagcagtacagatttgcttacaggttattgaggtttatg

SEQ ID NO: 85868 - DNA, 105 bp, Mus musculus
ctgggattaaaggcatacaccaccatgcctagctaaataaagaagtattttcaaaaaatattatgaaagcaggcagtggtggagcatatctgtctataatcctgg

SEQ ID NO: 85869 - DNA, 111 bp, Mus musculus
gaactaccatgcccagcctgcattttatttttaggtattggacttgtccccgcccagctagactagactaccaaggaagagtaccagcactcaggcagaggcaggtggatc

SEQ ID NO: 85870 - DNA, 79 bp, Mus musculus
atgagtgctctaactgcatgtacatctgtgtgtcagaagagggcatcagatcccattacagatggttgtgagccaccat

SEQ ID NO: 85871 - DNA, 89 bp, Mus musculus
ggccagatgggacagggtgaccatcaatcagcgtaggtgggagcagcctgcctgcctcacctcactgactctctgcccctgcttcagcc

SEQ ID NO: 85872 - DNA, 81 bp, Mus musculus
gagacagaaatctgtgaggtcaaactagcctagtctatagaatgagtcccaggctggccacagctacagaaactctgtctc

SEQ ID NO: 85873 - DNA, 68 bp, Mus musculus
gtgtaagtgtctctgtgtgtgtgcacgtgtaagtacaggtatcactggaggccagagatggcagacgc

SEQ ID NO: 85874 - DNA, 84 bp, Mus musculus
gtcagtgtgaggacagttgtgtgacaccttcagagaactgcatcactgggcagtttctgtgtgtgaccatcatggtacacttac

SEQ ID NO: 85875 - DNA, 94 bp, Mus musculus
gttggtatgcacacatgtatgtatatatgtatgtatgtatgtatgtatgtatggatggatggatggatggatggatggatgtgttttagacatg

SEQ ID NO: 85876 - DNA, 102 bp, Mus musculus
gagctctaggtgggcagtgtgtgtcacctgaagagcacagagtcctgaagcaatcaggtgctgctcagtgtgtgtctgtcaccatcctgcttatatgtggtc

SEQ ID NO: 85877 - DNA, 73 bp, Mus musculus
ggggaccagagtagaacctaccgcttgggttagtacccctatgcttagctctcagtgtgtctctgccagcccc

SEQ ID NO: 85878 - DNA, 125 bp, Mus musculus
ggggtgagggaccaagggcttggtgtagacatggagctctggaggtcagccacttactctgtctttcagtgcctctcgtgaaggagccgttagtgaaggaatcaccagagttgctgaggggatga

SEQ ID NO: 85879 - DNA, 81 bp, Mus musculus
ggaccgatctgtgctcttgtcttcatgactgtctggtcctgggcttcctgggagcctcagttctccaggaacacagaatcc

SEQ ID NO: 85880 - DNA, 78 bp, Mus musculus
ctgtgtgtctctgtgcctctgtgggcatgtgcgtgcacatgcatgaatgttgatgctgaggtagctagtgtggctcag

SEQ ID NO: 85881 - DNA, 97 bp, Mus musculus
tctttaaattcacccggacctttctctctctcagtttccccaactagtgcacagctagaaggctcagcgagcaaacaggaaggctggttgctatgga

SEQ ID NO: 85882 - DNA, 68 bp, Mus musculus
tatgtatgtgtatatatatatatatatgcgtgcatgtatgtatatctgtgtgtgtgtatctgtgtgtg

SEQ ID NO: 85883 - DNA, 112 bp, Mus musculus
cttttggtgttgccactccacaaagactgtgtggtattgtgagtttcttcatctgtgaaaaggaggttacgatttttggccatgcagagttgctatggggcttgaccagaag

SEQ ID NO: 85884 - DNA, 103 bp, Mus musculus
gaaatgctgagaagtggggctggagagatggctcagcggttaagagcactgactgctcttccagaggtcctgagttcaattcccagcaacctcatggtggttc

SEQ ID NO: 85885 - DNA, 90 bp, Mus musculus
ggtcctctggaaaagcattaaaagctctcaatccgggggctggagagatggctcagtggttaagagcactgactgctcttccaaaggtcc

SEQ ID NO: 85886 - DNA, 88 bp, Mus musculus
cttactcactgacagcttagggggcatgccacagaggactgactgacagactgactgacggaggactgactgactgcttaagagtgag

SEQ ID NO: 85887 - DNA, 79 bp, Mus musculus
gtgtgtctctctcgctctgtcactggcacgataatgggacaggctatttttagcaggagggagagtgggggatgggctc

SEQ ID NO: 85888 - DNA, 73 bp, Mus musculus
gagtcaggctgagccggtctgtgcagctgacataaacctctcttgtctctgtcttaggtctcctcagcgactt

SEQ ID NO: 85889 - DNA, 110 bp, Mus musculus
gtggcatttaaattaatctggttggtccatagaaaataagtatgtatatttggtttttcctatgtacatatatatatttatatatatatagatttatttataaaacccac

SEQ ID NO: 85890 - DNA, 69 bp, Mus musculus
gaggcccaagtgggacagtcaaagggacaggtggtaggcctgtgtcccagtgtctctctggaaggtttc

SEQ ID NO: 85891 - DNA, 98 bp, Mus musculus
ggatcctactctgatatagtccgtttctgtctccgtgtgtgtctctggacacaggcacacacaaggcaagcagtcacatggagtaccttcagaagccc

SEQ ID NO: 85892 - DNA, 79 bp, Mus musculus
gcagcagacagggagagcctctggacaggtgggggatgcattccgtattgaccgtctgtctgtctgtctgtctgtctgt

SEQ ID NO: 85893 - DNA, 83 bp, Mus musculus
gaaaataaactcaagggggctggagagatggctcagtggttaagggtgctgactgctcttccagaggtccctagttcaatttc

SEQ ID NO: 85894 - DNA, 66 bp, Mus musculus
gagatctttgggctttggtagaacttagtggaactttgactagcactggcaaggccttgggttctt

SEQ ID NO: 85895 - DNA, 89 bp, Mus musculus
catgtgtgtgtgtgtatgtatatatgtatataaataatatacaaatgtgtgtgtacatacacatgtatgtatgtttatatatgtgagta

SEQ ID NO: 85896 - DNA, 116 bp, Mus musculus
cccttgcttgcctagcctctgccatccccgccactgcctggcaccctgtaggccaccaccagaaagcacgggaaacactaggctgtcaccgcttgggtggtaaaggggtcttgggg

SEQ ID NO: 85897 - DNA, 117 bp, Mus musculus
ccacaaagcatgttgtaaccattgtttggaaatgtgcaatgatgggtctctatctgtcagtctgtcctcctgtccgtccatccatccatccatccattggttcctttgttgattcgg

SEQ ID NO: 85898 - DNA, 88 bp, Mus musculus
gggtcagggggtgtctctgtctctctgggcatctgtattcttgttttggggggctgtgtaacaagggagaatgagggttcttttgctt

SEQ ID NO: 85899 - DNA, 56 bp, Mus musculus
gtgccaacctggagagccagagtgaggaagtatttctcaggcactcacaggctcac

SEQ ID NO: 85900 - DNA, 121 bp, Mus musculus
tcagcttggagaggagtttgaggcagagcagctgagttgaatcagccagtcagagctcagtgagcacaagaaagggtgagcttattcagcagcaagtctcagaggctgaaacattctaggc

SEQ ID NO: 85901 - DNA, 117 bp, Mus musculus
acccgtccttgttgtgtttcagcttcccaggtatcatagagtccttctcagtcattgtctcagtcagcgtcttctgtgtagcttaggttggccttgacattgctatagatctgaggt

SEQ ID NO: 85902 - DNA, 111 bp, Mus musculus
ctgcctagtgctttgaggctctcttggcaaagagcatccctggctgtccaggctagagccaagagagtcagctcagtgctggcccagggaagctcacagcctagtaggcag

SEQ ID NO: 85903 - DNA, 75 bp, Mus musculus
gtgtgtgtgtgtgtgtgtttcatctgtgcacctgcttcacgggacagtgcagagagagagcacaaaaccatctat

SEQ ID NO: 85904 - DNA, 107 bp, Mus musculus
atagctgtcgagtgggagccagcaaagacaggcaacagggcacagacttgggtttaaaacctacctctgtctgtctgtctgtctgtctgtgcctatctgactgttat

SEQ ID NO: 85905 - DNA, 80 bp, Mus musculus
agacaggcgactggaatcagcctctgcttgtgtgtgtttgtgtatatgttcccgtggggtgtgtctctgtgtgcctgtgt

SEQ ID NO: 85906 - DNA, 117 bp, Mus musculus
acagactgtatgtaacttggctgagtttaatgagtgcaaccttgagtttctcactgtttctgagagcctcagttgagaacttccttgacttccctgcctatctcaaaggctctctgt

SEQ ID NO: 85907 - DNA, 80 bp, Mus musculus
acgtgagtgtgcaagtccatgtggacagagttctcagcgaggtcggggtgatgctgaggaacatggctgcaggcgaaggt

SEQ ID NO: 85908 - DNA, 116 bp, Mus musculus
gcagggagtaaaagttaaactcggggctggagagatggctcagcggttaagagcactgactgctcttccagagatcctgagttcaaattccagagatcctgagttcaaatcccagc

SEQ ID NO: 85909 - DNA, 73 bp, Mus musculus
gaactaatataggggctggagagatggctcagtagttaaaagcactgactgctcttccagaggtcctaagttc

SEQ ID NO: 85910 - DNA, 118 bp, Mus musculus
tacatatacttatgtgtatgtatatatacctatgtgtttgtacatatacttatgtgtatgtgtatatatatatatatatatatatatgtatatgtgtgtatatgtgtgtgtatatata

SEQ ID NO: 85911 - DNA, 149 bp, Mus musculus
gtatatatgtatacatatgtatgtgtatgtatatatgtatgtgtatgtacatatatgtatgtgtatgtatatatgtatatttatatatttatgtgtgtatgtatatgtgtgtatgtatatatgtgtatgtgtgtgtgtatttgtatgtg

SEQ ID NO: 85912 - DNA, 180 bp, Mus musculus
gtgtgtatatgtgtgtatatgtatgtgtgtatatatttgtgtgtatgtatatctatgtgtgtatatgtatgtatatatgtgtgtgtatataatgtgtgtatatatgtgtgtgtatgtatatatgtgtgtatatgtatgtgtatggtgtatgtctatgtgtgtgtgtatgtatatatatac

SEQ ID NO: 85913 - DNA, 139 bp, Mus musculus
gcatgtcagggatgtcgccaggaaggagcaggcagggttccaagtttgctcggtcccctcctctgagtctgtctctgcctgtgagacataggaattgctgtctggctagcctgcgtcaggagttgctgagactgaagtc

SEQ ID NO: 85914 - DNA, 90 bp, Mus musculus
gaggcgtaagctggcaagtggctgagtgagtgaggtgtatttttgacttggaatttctctcttaactctgtctctctcagttgctgtctt

SEQ ID NO: 85915 - DNA, 74 bp, Mus musculus
ggtgaatttctgagtcaacagagtgagctccaggacagccagggctacacagagaaactctgtctcgaaaaacc

SEQ ID NO: 85916 - DNA, 74 bp, Mus musculus
ggaggactgggtgttcttgagctctgtgttttatctttagctagtataatgacttacggtcagtcagtccgtcc

SEQ ID NO: 85917 - DNA, 76 bp, Mus musculus
ggacaaattggctcattcagttagagtccccactggcttcctggctttgacactcactggctgtgtaagtttggac

SEQ ID NO: 85918 - DNA, 76 bp, Mus musculus
agagagcagaaagaagagaaaaggctgtgaatatgtattaaagaaataccaccgccctgcctctcagtctctctgt

SEQ ID NO: 85919 - DNA, 82 bp, Mus musculus
agggtctgtgagagagagagacagacagacagacagacagacacatgttcaatgtccttcatctccaaattctccagattct

SEQ ID NO: 85920 - DNA, 116 bp, Mus musculus
gagtattaaaagctagtgttgctagggctggcgaggtggtccagcggttaagagcactgactgctcttccagaggtcctgagttcaattcccagcccttcaatcacatggtgactc

SEQ ID NO: 85921 - DNA, 81 bp, Mus musculus
cctatggtgtgtgtctgtgtctctccatgtacgtacttgccacagtgtgcatgaggaggtcaaaggccagcaagctttggg

SEQ ID NO: 85922 - DNA, 95 bp, Mus musculus
aggtagagtgacaaccagatggttcctgaattgcttctctgcactatttttagacagagtctctctcagtgaaactagagcttgctattttagct

SEQ ID NO: 85923 - DNA, 82 bp, Mus musculus
ctgtctgtctgtctgtctgcatgtattatgtatatatgtatgtgtaccacttgcatgcctggtgcttgcagaggttaagaga

SEQ ID NO: 85924 - DNA, 62 bp, Mus musculus
gtgtgtgtgtgtgcacgtgcgtgtgcatgtctgcatgtgtgtgtgcttgtgcatgtgtgtgc

SEQ ID NO: 85925 - DNA, 93 bp, Mus musculus
cagtatctctaaatgctcagaactctgtctcagtcagtgataaaaaaccaaaatgttctgattggaggtggtttgggccctggaaagagcctg

SEQ ID NO: 85926 - DNA, 97 bp, Mus musculus
gatgctgggatggaaatgagagctttgggcctgcttgtgaagcactctacaaagcaagtgacacccacagtctctatcttcaattaattaatgcatt

SEQ ID NO: 85927 - DNA, 97 bp, Mus musculus
ggatgaacaatgctccagaatcaggttttctttagtcgtctgtggtgctttgagtgagatgttccctgtaagtcttgggcatatgagtgcttggtcc

SEQ ID NO: 85928 - DNA, 118 bp, Mus musculus
gttgttgttgttgttgttgagacaagatcttgggggctggagagacggttcagttgttaagagcactgactgctcttccagaggtcctgatttcaattcccagcaaccacatggtggc

SEQ ID NO: 85929 - DNA, 82 bp, Mus musculus
tctgtctgtctgtctgcctgcctatctatctattgaaacttactttgttagtggtggtggtggggtagaagacaggaaaagg

SEQ ID NO: 85930 - DNA, 120 bp, Mus musculus
cagtgaattctactccctttctggcaggagcataggaccagtgcagggagagacacactgaagactgagtccacctagcagtaaggccttactgtgcaaagcttcctctctctctgtgct

SEQ ID NO: 85931 - DNA, 85 bp, Mus musculus
tctttgtctctgtctctcactacactgttcttgtagacagacagacacacacacacacacagagagagagagagagagagagaga

SEQ ID NO: 85932 - DNA, 110 bp, Mus musculus
tgattgggttctttagggttttggtgattaacttcttgagttctttatatattttggataaagcgcttgctagctagatggtaagaccctattgctgcagacaccataca

SEQ ID NO: 85933 - DNA, 86 bp, Mus musculus
aggctgacaacagaccacgagcgcaggagatcttaggaaccggtgctgctgtaattgtgaacttgtggtctttaaatccattgcct

SEQ ID NO: 85934 - DNA, 77 bp, Mus musculus
tcttgagtcagaaatcaagggcttcagatccagagagatgactcagtggttaagagcacttgcaactcttgccaagg

SEQ ID NO: 85935 - DNA, 74 bp, Mus musculus
atgtatgtccatatatatgtatatgtgtatgtgtgtatatatatatatatatgtgtgtgtgtgtgtgtgtgcat

SEQ ID NO: 85936 - DNA, 72 bp, Mus musculus
cacacacacatacatgcatatatacatatatatacatatatgcatatgtatgtgcatgtgcatatacatgta

SEQ ID NO: 85937 - DNA, 60 bp, Mus musculus
tatatacctacataaatgtatgtatgcatgtatgtatatatgcatgtgtgtatgtgtgta

SEQ ID NO: 85938 - DNA, 81 bp, Mus musculus
tgtttgtatgtatgtatgtatgtatgtatgcatatagcaatttatttatatacaatgtatataagtatatacatacttata

SEQ ID NO: 85939 - DNA, 70 bp, Mus musculus
gtgtatgtatatatgaatgtatttatgtacatatgtacctatgtatgtatgtatgtatgtatgcatacat

SEQ ID NO: 85940 - DNA, 109 bp, Mus musculus
atatatatgtacacacacacacacacacacacacacacacacacacacacacacacacatatatatatcccgcccctctcaggatgtgtttgtgtgtgcatgttaatat

SEQ ID NO: 85941 - DNA, 90 bp, Mus musculus
gagagacatcttagcccagaagtttatttgatcttcatttttgtgtaaggacaaagatgagggagctgactggactgcattttgcttctt

SEQ ID NO: 85942 - DNA, 85 bp, Mus musculus; identical to SEQ ID NO: 57439

SEQ ID NO: 85943 - DNA, 91 bp, Mus musculus
agcacttaatggtagatccacatgctcaaaagacttttggttgtacaatataatatagtctctgtgtgtgtgtctctatttctctgtggct

SEQ ID NO: 85944 - DNA, 114 bp, Mus musculus
acagaagcagagggtcaagacttccacctccctcttacttactaaaataattgtttttatttttcttttgtttcgtgttagagttgttgtctgtctgtctgtctgtctgtctgt

SEQ ID NO: 85945 - DNA, 77 bp, Mus musculus
cacacacacatatatatacatgtgtgtgtatatatatgtatgtgtgtatatatgtatgtgtatatatggaatatgtg

SEQ ID NO: 85946 - DNA, 98 bp, Mus musculus
agacagtctctagtccccagtatctctctctgagaccctccctggccatcccccatagagctggtcagtgagaagacggtgctgctccctggctttct

SEQ ID NO: 85947 - DNA, 89 bp, Mus musculus
ggggataagcctggcttggggctgagtgttgagactgtggacggttcactgttcatctctatgcagtctgcccacaccaccaactcccc

SEQ ID NO: 85948 - DNA, 83 bp, Mus musculus
ggaacattctaccacagtgagcacacagcctcagttggccttgctgggcacctcttctctgtgcttgttcttggtgacattcc

SEQ ID NO: 85949 - DNA, 116 bp, Mus musculus
gcaaggaagccaagagcacagaggagagagacatgaacacagaacagagagtcctgagtgagaattcccagaagattgaaactgtgtaaacaagtacccggctcagaagcttgtgc

SEQ ID NO: 85950 - DNA, 75 bp, Mus musculus
gatttctgagagtcagggcaggggaggtgggtaattgattagtttgtctgagtctctgtcatagtttttagtatc

SEQ ID NO: 85951 - DNA, 71 bp, Mus musculus
tatatctgtacatgttgaatatacatatgaatgtatatgtatgtatgtatgtgtgatgtgtgcctggtgtg

SEQ ID NO: 85952 - DNA, 138 bp, Mus musculus
cacacacacacacacacacacacacacacacacatatacatacatacatacatgtgtgcagattatatatatgtatgtatgtatgtgtgtgtatgtgcccatatatgtatgtatgtatgtatgtatgtatgtgtgtgt

SEQ ID NO: 85953 - DNA, 73 bp, Mus musculus
tgtctggacattctaagttggtggttcagttaaaaatatggcttcaccttctagcttgtgttgtttccagaga

SEQ ID NO: 85954 - DNA, 85 bp, Mus musculus
ggctctgcaacactctcatccgcccatctgcgtggctcagggctcgccaggctgactggctgactgacacagcagggccagatga

SEQ ID NO: 85955 - DNA, 105 bp, Mus musculus
ccaactacctctgtatctcctcacaaactgacatcactatcagtctgtcactcccctcccttgggtgggctggagaggctgattgtctcaggacagttttgttgg

SEQ ID NO: 85956 - DNA, 65 bp, Mus musculus
ggcgtaggcctgcaggtcgctgaaatggggaacctcagactcagtgagaccctgtctcagacgct

SEQ ID NO: 85957 - DNA, 70 bp, Mus musculus
acctagctgtctgtctgtctgacaggctagctcacagacaaaccagcagcagcacaggcaagacacaggt

SEQ ID NO: 85958 - DNA, 58 bp, Mus musculus
ctgtgtgagcagagtgaggagtgactgttggttaccctgaactcagaaagtcatacag

SEQ ID NO: 85959 - DNA, 71 bp, Mus musculus
gcacatgtgtgtgtgtatatatgtatatatatgcctgtatgtttgtgtgatatgtgtgcattcatgtgtgc

SEQ ID NO: 85960 - DNA, 69 bp, Mus musculus
tggatttgggctcgagagagagctcagcggttgaaagcactgactgctcttccagaggtcctgagttca

SEQ ID NO: 85961 - DNA, 107 bp, Mus musculus
tctgcagggatgaggtattgtgtatgtgtgcatgtgtatgtatgtatgtatgtatgtatgtatgtatgtatgtatgtatgcatgtatgatatatatacccctgggga

SEQ ID NO: 85962 - DNA, 94 bp, Mus musculus
ctggtcccactgtgatatatataggctgatgtatgtccttatttgtagacacacattcaaatactcatgtatatctgaagaaacgggagagcag

SEQ ID NO: 85963 - DNA, 77 bp, Mus musculus
ttgtctgtatctgtgtctctgtttcaggttaattctgtttcaggtttaatctggaggccaagagggacaaagcagac

SEQ ID NO: 85964 - DNA, 75 bp, Mus musculus
atatgtatatatatgcatgtgtgtatatatgtatgttcattgtatatgtgtgtgtgcatgtgtgtgtatatgtat

SEQ ID NO: 85965 - DNA, 126 bp, Mus musculus
gttggaggaagtgtgtcactggggttgggattcgaggtttcaaagtccccacaccattcccagcgtctctctctgcctcttgcttgtgggttataatgtgggctctcagctgcggctccagtgcat

SEQ ID NO: 85966 - DNA, 69 bp, Mus musculus
ggtgagtttatgtaacctgagctcgtgtacatctgagctggagtgtgtgcatgaggaagtgatctcatc

SEQ ID NO: 85967 - DNA, 88 bp, Mus musculus
gtggatacagggcaagaattaagtgagacaagtgagtgacttgtgtggtgcacagaactgaaggttcattttattcttggcagttgac

SEQ ID NO: 85968 - DNA, 64 bp, Mus musculus
gtgtgtgtgtgtgtgtgtgtgagtatgtgcgtgtgtgtatgctcacgcacgcatgcatgtgtgt

SEQ ID NO: 85969 - DNA, 93 bp, Mus musculus
ttttattttcaaacacaatttacggtttacagtgtggtaagagactgttctcactgagtgatcttttagaatgctgtgccttgcaaaatggga

SEQ ID NO: 85970 - DNA, 86 bp, Mus musculus
ttgagtaggcccctcggattctctctgactctgacttgggaaggtatcttcagtcagagcattgctgaggaggacctttggctcaa

SEQ ID NO: 85971 - DNA, 116 bp, Mus musculus
agcaccgggctgttctcaccacaggcaacaaatgtaggcactcaggtctgcctggtctgtcagtctgactggggccagaagagagtcctggatttgtcctcgagagtcaggggtct

SEQ ID NO: 85972 - DNA, 69 bp, Mus musculus
tagtatatatacatatatatttgtgtatagacatatatttgtgcatacatatatgtgtatgtaatatta

SEQ ID NO: 85973 - DNA, 89 bp, Mus musculus
gtctctagagttcatgcactctgagtcagaagtgactctgcaccacagagttcttctaactctccagggaccgcatgtggacacaggac

SEQ ID NO: 85974 - DNA, 102 bp, Mus musculus
gagggtgggctttaagagtaggagtcttcatgtcacttccagttcattatgctttgtgtctgtggttaagatgtgctctctctctctctctctctctctctc

SEQ ID NO: 85975 - DNA, 70 bp, Mus musculus
gagcaaaagcttcagagggaaagttgggcattaagaaagggtctggctgtctctgtcatgcagtgtggtc

SEQ ID NO: 85976 - DNA, 82 bp, Mus musculus
gggaaagttgggtcaggaactcaaagccagtactcatggtgggatgctgcttgctgggtcactcactcacaggcttatgctc

SEQ ID NO: 85977 - DNA, 78 bp, Mus musculus
gtgtgtctctgtgtgtgcatatgcatgtacatgtgtgtgttcatgtatttatgtgtatgtgtgtgtatgtgagcatgt

SEQ ID NO: 85978 - DNA, 69 bp, Mus musculus
tgtatctctgtctctctgtcccttgtaacccagcctggtcccaggggagcaagcttgatagcagactca

SEQ ID NO: 85979 - DNA, 81 bp, Mus musculus
gcatttaagtaagaaagaaattctctctgtgtgtcagtaactacttagggtgatgacacatctttcctttgtcgtgggtgc

SEQ ID NO: 85980 - DNA, 57 bp, Mus musculus
gattctctgttctctatcacccagcgggtgggtgagaggagacagtgaagaagaatc

SEQ ID NO: 85981 - DNA, 103 bp, Mus musculus
gtagttagacttcttgcctctggtcccagacagaagaaggtgaggagagcccagactcctgactgtagcttctgtcttcgcacagggcacgctgtctggccac

SEQ ID NO: 85982 - DNA, 112 bp, Mus musculus
ggcggttggagaagcctttcatctcagagtcaaccccagccacctctgatgtcagtgttgtttggtgtttgaactcggagctgagctggcatgactttagactccaagagct

SEQ ID NO: 85983 - DNA, 87 bp, Mus musculus
ggtggaccagttggtaatggaaagtcagttaggagcctcattcctgaggacgactgattctcacactctcagcattccttagccacc

SEQ ID NO: 85984 - DNA, 90 bp, Mus musculus
gctgactttagtggcagcgggtagaaaagtgtcatttttttttctaaaaatgtagcttacatctcccttattccttcatacaaggtcagt

SEQ ID NO: 85985 - DNA, 72 bp, Mus musculus
atatgcatattcaggtgggtaggtgtgtatgtatgtatgcctgtatgtatgtctgcctgtctgtttgtctgt

SEQ ID NO: 85986 - DNA, 66 bp, Mus musculus
taagacactgatcaatcatttgggggctgggaggaccactcactctgtctcaaggtctgtgtctta

SEQ ID NO: 85987 - DNA, 65 bp, Mus musculus
gtgctacacagatggtagaatgttctcagcagaaagcacggggacattctgtctctgcctctcac

SEQ ID NO: 85988 - DNA, 88 bp, Mus musculus
tatgtctctctctctctctctctggaactaattatcaagtcttaggaggatttgacaagatgtccagaggattgggtgtttgggtgtg

SEQ ID NO: 85989 - DNA, 112 bp, Mus musculus
gagtatggccccagatccatcttcatctatactgaggagcaggaagccacgttcacacacacagtcaggctatgttgctcaggagagagatcccaagtttggaaatagattc

SEQ ID NO: 85990 - DNA, 107 bp, Mus musculus
tcacatcctggctaggtagacactatattcccagaccttgataattttttttttttgtttttgaattaatattgtgtcttcttgagcagagagtaaaggagaggtgg

SEQ ID NO: 85991 - DNA, 81 bp, Mus musculus
agctagttcctcagcccagagaggttggagaacttatggaaggttcctgaggtctctatctgtctgtctgtctgtctatct

SEQ ID NO: 85992 - DNA, 86 bp, Mus musculus
gagagctgagaataaagagagttcagacaaggagaggaaggcccctggagggactagaccttactgggttcacttattcagaactc

SEQ ID NO: 85993 - DNA, 77 bp, Mus musculus
gggttttcacactgtccctgtgtctaaggggtacttgggttggagaacagatctagacacgaacttagtgtgtgccc

SEQ ID NO: 85994 - DNA, 70 bp, Mus musculus
gtgtgtgtgtgtgtatctgcatgtatatgtgtttgtgagggcatgtatatggatgtatgtgtacgtgcat

SEQ ID NO: 85995 - DNA, 125 bp, Mus musculus
acacacattttctctgtctgtccctttgctgatgggcacctgagctgattctgtgtctcagtgactatgaacagtacagcagtaaacaaagacgtgcatgggtcgctgacgtgttgactggagtc

SEQ ID NO: 85996 - DNA, 117 bp, Mus musculus
acagaaagagagagagagatatacacagggagatatatgtatatatctatatcattctaagataaatactaacacatattaattgttcactgagttggggctctccttattgtttgt

SEQ ID NO: 85997 - DNA, 86 bp, Mus musculus
tatacacacacacatacatacacatatgtatacacacacacaattgtgtgtatgtatgtatgtatgtatgtatgtatgtatgtatg

SEQ ID NO: 85998 - DNA, 68 bp, Mus musculus
ctggtatctgtgtgtatatatatatgtatgttcatatgcattcccctgtgtacacacatagaggccag

SEQ ID NO: 85999 - DNA, 124 bp, Mus musculus
tatatatatatacatacatacatatatatatatatatatgtatatgtatatatatatatacacatatatacacatatgcatatatgtatattgtgtatatgtatatgtgtgtatatatgtatat

SEQ ID NO: 86000 - DNA, 116 bp, Mus musculus
gggcttgagggagtatgcaaggtaacttgccaatagctaaatggcctcatcagtatctgcttctccttctgcagctcaaggctttagacaattcaggaggaacatagggagggagg

SEQ ID NO: 86001 - DNA, 81 bp, Mus musculus
tctcctttagagagcagagcaggactctagagtgcttctatcttcaatctatgatgagctcactgtcactctcagagggga

SEQ ID NO: 86002 - DNA, 90 bp, Mus musculus
ttctaattagaacagaggagcagaagttgaaccgattgtgtaactttgaacattcggtgtgatgtcatgtgtctgactgggtctatagga

SEQ ID NO: 86003 - DNA, 101 bp, Mus musculus
cacacacacacacacacacacacacacacacacacacacacacacgtttgtctgcagtctctaggtcactgtgtgaatagtgtgtgggtactagattagtg

SEQ ID NO: 86004 - DNA, 79 bp, Mus musculus
ctgggtcccactgtggctctgtctaggctcctcattcacatcttagtctagcatactcctctcacccttggggactcag

SEQ ID NO: 86005 - DNA, 79 bp, Mus musculus
acgcgtgaggctcttgcttgtttagttctttgcaggtttatttttgcatgatttattttttaagtatttgtctatgtgt

SEQ ID NO: 86006 - DNA, 66 bp, Mus musculus
tccactgtccctctgtgtctgttcctcacagccatggtgaggtccagcagaggggacagtcaaggg

SEQ ID NO: 86007 - DNA, 77 bp, Mus musculus
gccctgtactctgtcactcactgagtggccatcagctccctgggctgtttatggccaagggacttcagaaatggggt

SEQ ID NO: 86008 - DNA, 77 bp, Mus musculus
gccgctcctgcagaagatatgggtttggttggttctcagcactcacacagtgcctcacaatcatctgtagctctggt

SEQ ID NO: 86009 - DNA, 114 bp, Mus musculus
tccccattcccttgcatgcatgtatgtctacatgtctgtggcctgcatgcctctgtgcctgactgagtgcctttctacgtacatatgttcataagtgcatgtatgggggcgggg

SEQ ID NO: 86010 - DNA, 102 bp, Mus musculus
ggactgttcaggctggagatctgtgtgctcaggagtcaggaatgagaacagagaaaatcacagcttactctgtctctctgagaggtcccccgccactgtgcc

SEQ ID NO: 86011 - DNA, 114 bp, Mus musculus
ggacctctcactctgtttgtctgtgcattataggcttacacactttgttgttctatatatagacatttaaaatgttttcaattctagtgcactgaactcatagtatagagtgcc

SEQ ID NO: 86012 - DNA, 94 bp, Mus musculus
caacaacactgggcctatttttactgatacctgaatggggagaacagaagtgtttttcatgtcctggtcagtgacttgtctgcttctgatgttg

SEQ ID NO: 86013 - DNA, 76 bp, Mus musculus
tgtccttttccagaggaacaatgcatttgagtgacctcctaatgcatctctcgttctctctctgatacactggata

SEQ ID NO: 86014 - DNA, 104 bp, Mus musculus
caatacttaaaatggaagcacccgggctgcttgtctctcagtctgacagcctcgggaactgagaacttgaagataggacaccaacgtggttttcatttctattg

SEQ ID NO: 86015 - DNA, 99 bp, Mus musculus
agaggggagagtgagctgagacagacagaagacagaagccacactaactctttaaaaggtcttttgtaacctgtatccccagagactgccttccttact

SEQ ID NO: 86016 - DNA, 158 bp, Mus musculus
gtgtgtgtgtgtgtatacatgtatgtgtgtgagaatctgtgaatgatgtacatgtgtatgtatatatatatatatgtttgtatatgtatgtgtatgtatatgtgtatatatatatatttgtgtatctgtgcttgatgtttaagtgtatgtgtgtgtac

SEQ ID NO: 86017 - DNA, 97 bp, Mus musculus
tgaaggctagggaaggtgaagtagctgtttttgtagttctgttgtcagtgaagtgtaggaccaggagcaacggcgatgtcacagtagcccggtttca

SEQ ID NO: 86018 - DNA, 145 bp, Mus musculus
cttcagctgattgctgccttcatctcctcctagccgcctgtttactcactgtgagggtgcagccagatgtgagagaagacactgcctgaagtaccctagaaggtgttcctgagactttggcctctagtgtagctctcccataagc

SEQ ID NO: 86019 - DNA, 115 bp, Mus musculus
catgtatacaggttgccatggagaactgtttggagaactgggtttcgactcagatgggctcaacctctgactctgtcacttgtttgcacccttcagtgtctctcagtcagacatg

SEQ ID NO: 86020 - DNA, 114 bp, Mus musculus
gtgtatatggtatttctctgtgtgtgtctctctgtgtggtatgcatgtgtgtgtctgtgactctgtgtgtgtgtgtgtgtggtgtggtatgcatatgtgtgaatttgtgtgtgt

SEQ ID NO: 86021 - DNA, 115 bp, Mus musculus
acacacacacacacacacacactatatatatatatacatatatatatatatatagtatgtgtatatatatgtgtgtatatatgtgtgtatatatgtatatgtatatgtatatgta

SEQ ID NO: 86022 - DNA, 100 bp, Mus musculus
catcttaagaacaggagagattgagttgtggtagggagatgggacgactgcaaagggtaactgtgtctctctgagactagactattcctgaacatgggtg

SEQ ID NO: 86023 - DNA, 116 bp, Mus musculus
aaggtagaccaggatgcagactagtgatgtggcaccaggggtagagctcactcctcctctctgtgcctcagtttctccacttgcctaggttgcatgaaacccagggttcagtcctt

SEQ ID NO: 86024 - DNA, 116 bp, Mus musculus
atatatgtatatcatgtgtatgtatatatatgcatatatatacatgcatgcatatatatatatatatatatatatatatatatatacatatatacccatacacatgcatacatatg

SEQ ID NO: 86025 - DNA, 73 bp, Mus musculus
tgggggtgggggagtagctgaggccggaggactagaaatgatcctaagagagcctctctgtcactcactgtca

SEQ ID NO: 86026 - DNA, 135 bp, Mus musculus
tagtagtggaagcccagatctacgttctgagctaagcgtgagctggcacagcttgtctgtctgtctgtctgtctgtctgtgtgcctgcctgcctggagggctttgggtactccagttggcttgcctctaaaggga

SEQ ID NO: 86027 - DNA, 89 bp, Mus musculus
atgaacagataggtgagaggtagctagttgtatagatatacaaatagataaacaggtaggtgacagtgcttttgcttatgtgtgttcat

SEQ ID NO: 86028 - DNA, 62 bp, Mus musculus
cctgtgatcagagcccagggcagttggcaggcaagccagtctcactgcctctctgacccagg

SEQ ID NO: 86029 - DNA, 144 bp, Mus musculus
tatgtatgtgatatgtgtacgtgcatatatgtgtgtctctgtgtgtatgtggtaagtatgtgtgatgtatgtgtgcatacatgtgtgtgtctctgtgtgtatgtggtgtgtgtgtgcgatgtatgtgtgcatacatgtgtgtgt

SEQ ID NO: 86030 - DNA, 88 bp, Mus musculus
agcatttggaccagacacagcagcacacggacagacacacagactcctggactgtgtggctctactgctgtacctatggcaacaggct

SEQ ID NO: 86031 - DNA, 112 bp, Mus musculus
gccattcacacagaggcttttctgtgcacaagctagggtgatctgtggtattttattctatatttagtgagcgaggaatcggggcggggggggggggcatgctggtaatggc

SEQ ID NO: 86032 - DNA, 58 bp, Mus musculus
gcacagacagtcaaactcactctctgcccaggaggctggaagttgaatgtcagggtgc

SEQ ID NO: 86033 - DNA, 108 bp, Mus musculus
gcactgtacctctgggtagaggcccaagcagccgtgccttccggtaccctgagtgtgcatgggtgcctgtctgcctgtttggggtcctaccaccttgctggctcttgc

SEQ ID NO: 86034 - DNA, 76 bp, Mus musculus
cttgtcaggtgagactcagcacacagcaacaggggccagggccaggtcatgggatgactgaagctttaactgtagg

SEQ ID NO: 86035 - DNA, 119 bp, Mus musculus
gggaggaagggtggtaaagagggaggagagcagggctaaagagatggcttagcggttaagagcactgactgctcttccagaggtcccgagttcaaatcccagcaaccacatggtggctc

SEQ ID NO: 86036 - DNA, 81 bp, Mus musculus
ccctggctgcctgcctctatgcaatggtgaccttttctgaaaatttcctcccttgtaaactcagacacaggaatgtggggg

SEQ ID NO: 86037 - DNA, 127 bp, Mus musculus
ctttccatccagatgactgtggctctaagatgtacttgccacgggcttctgagactgggtgagtctctctctgtgcatcgtggctaatgccagagttttaaagggggagggagggttgcctttctta

SEQ ID NO: 86038 - DNA, 70 bp, Mus musculus
cacgtgcgtgcacgtgtgtgtatgtatatatgtgtgttcatgtgtgtgtatttgcatgtgcatgtgtgtg

SEQ ID NO: 86039 - DNA, 76 bp, Mus musculus
gtctgtctgtctgtctgtctctgtctgggaatatgcacagatgtgtaggtacccatggaggccagaggtgtcagat

SEQ ID NO: 86040 - DNA, 101 bp, Mus musculus
gggtagtctgtctggttcataaactcagggcaagaataagatgggaaggaaaatgacagaggctgtggaagaagtttgtggagagattaggcatgtgaccc

SEQ ID NO: 86041 - DNA, 113 bp, Mus musculus
atgcatgaatatatatgtgtatatacatatgcatatatatgtatatatatgtgtgtgtaatattacattctacatgtatatgcatatatatacacatatatacacacatacat

SEQ ID NO: 86042 - DNA, 108 bp, Mus musculus
tgtacatagcacagatatgtatgtgtgtatatatgtgtatatatatgcatatacatgtagaatgtaatattacacacacatatatatacatatatatgcatatgtata

SEQ ID NO: 86043 - DNA, 95 bp, Mus musculus
cagaactgaagatgcttaagtctcctagagattttcaaggcctttcaacaattgatgaaatgtttagagaaaatagtgaggacatagaagttctg

SEQ ID NO: 86044 - DNA, 105 bp, Mus musculus
gtgaaaatgggctcaaggtgaggggtgctatctgtgattgagggacatggtcaatggaattgtctcacacagaaatcgcacccgtcaccttggcctgctgagcac

SEQ ID NO: 86045 - DNA, 109 bp, Mus musculus
ttatgtatatatacatatgtgtgtgatattaaaaatatttggtagccaataatttaagttatattttcttatttttggtgtgaatgtacatatgagtgactatatataa

SEQ ID NO: 86046 - DNA, 109 bp, Mus musculus
gaagccgacacccaagtccaggcctgctgacccctagtccagtgcttgtggtggctactgggccctgaactaggggtctggagacctgggtttgatctccacaggcttt

SEQ ID NO: 86047 - DNA, 79 bp, Mus musculus
tgagaacagacacacacaggctggagagatggcttggtggttacaagtactgactgctcttcctgaggtcctgagttca

SEQ ID NO: 86048 - DNA, 87 bp, Mus musculus
gctgtcaagggctctctgtttcacttccagcacatcaggtctctaggacagagactaggttgttgtgtttactgaggagtcctacgc

SEQ ID NO: 86049 - DNA, 67 bp, Mus musculus
ccccacactctctcgctgagtctccagggaggcaggaggcctctctgccccaggaatggagcggggg

SEQ ID NO: 86050 - DNA, 106 bp, Mus musculus
ctccatgtgggtcggtctcgggagtcaaactcagactgtcagactgacatggcaggcatctttacccactgacgttacccactgagccggcccactaaccctggag

SEQ ID NO: 86051 - DNA, 85 bp, Mus musculus
tgtgcgtatgtgtgtgagtatgtatgatgtatgtatgtatgtatgtatgtatgtatgtatgtatgccaccagtcacatgtgtgca

SEQ ID NO: 86052 - DNA, 117 bp, Mus musculus
gtccttgggggttaagtttgttcccgctggtgtgaggtgagacacctagggaggcctgttgtctgtctgtctgtctgtccgtctctgtcggcgatgctggtgtagccctggcctcgg

SEQ ID NO: 86053 - DNA, 114 bp, Mus musculus
gcctagaggggagggattggtgaagacattcaacttaggactgagtatgccagggtctctcattctctgcacatcttctagttgtgggtctctgcacttgcccttatctcctgc

SEQ ID NO: 86054 - DNA, 85 bp, Mus musculus; identical to SEQ ID NO: 60894

SEQ ID NO: 86055 - DNA, 129 bp, Mus musculus
gtagccctgttggagtagctttgccactgtgggtgtgggctagaagaaccttaccctggctgcctggaagccagtcttttgctagcagccttcagataaaaatgtaaaattctcagctactcctgcacc

SEQ ID NO: 86056 - DNA, 100 bp, Mus musculus
ctttttggtatctcacccaacactgagtctctcagggtctcacccatgcaacattgactctgggagggtctcttgggtcttcactcaaataccaagtaag

SEQ ID NO: 86057 - DNA, 89 bp, Mus musculus
aatcgatgtccctacgacattggggacctacgaggagtgcctccttcactctctctgggtgtctggagtcccgttgggtttttttggtt

SEQ ID NO: 86058 - DNA, 102 bp, Mus musculus
tcagtggaatgttttactttgttttagtggggactgatgcacagaatacttattatttttgcatatctagctctactaagttcaatcagatagatagcttga

SEQ ID NO: 86059 - DNA, 160 bp, Mus musculus
gggtcccagtgtagtgagaagttggggggtgggaacggcgtcatgcaggagttgattgcacagccattcagctcctatatgatgcctttcttcacccccttcaaccgcgtgaggcctccggaccctcctccgcgcaccttgggccgcttagggacgcgtc

SEQ ID NO: 86060 - DNA, 112 bp, Mus musculus
cctggtgggacattccctggggctgggccaagggtcaccctctgactctgtggccaagggtagacaggtcagaggtcgatcctgggcctactctggggctcctcccactggg

SEQ ID NO: 86061 - DNA, 129 bp, Mus musculus
tcgggccccagactcgtaaaagacgccgctttgatcactgtctccagcctgctgaagctcagagggctctgattcagaaagatcatcggatccgtctgagcttggctggtcggaagtctcatcatctgc

SEQ ID NO: 86062 - DNA, 149 bp, Mus musculus
ttcaacggtgttggatgagccctcggaggactccatttgttttgatgatggattcttaagctccatcatcgtctcaaatgagtcttcagagggttctatcatgtcgtcggttggaaaggagtgtgctctgaagactggtaagattgtga

SEQ ID NO: 86063 - DNA, 120 bp, Mus musculus
tagggtgaggttagggttaaaatgatgatgtcagttggccggtcggccgatcgctcggtctgtcagtcagtcggtcggtcgatcggtcggtcggtcagtcggcttcctgtcttcgaactg

SEQ ID NO: 86064 - DNA, 92 bp, Mus musculus
cagttacacagctcatgagtgcctgctggggtggaacctggtttgtctgtctgtctgtcaccatcgctcgggtgctgctgctgctgctgctg

SEQ ID NO: 86065 - DNA, 77 bp, Mus musculus
gtagtgtcagtctctcactgagcaaatgacctcagactttacccaggcgttgccaaaagtgttgactcagacagggc

SEQ ID NO: 86066 - DNA, 93 bp, Mus musculus
agtctctggagtagtttggtgttagaaagtgacttacaaacttacttctgttaatgttcttgtctaattataaaggaagactattcctagact

SEQ ID NO: 86067 - DNA, 58 bp, Mus musculus
ttttcatgtgtgtgtgcatgtgtatgtgctcacatgggcatgctcatgtgtatgaggg

SEQ ID NO: 86068 - DNA, 84 bp, Mus musculus
gcagttagagacactacagaattggattatatctatttgaatttctgtgcttcctccaatgctgctgtgtctctccaaatctgt

SEQ ID NO: 86069 - DNA, 79 bp, Mus musculus
ggtacttggagagaggtggtccgtggcgcgttcgcttcatttatggcgcacattacacggtcgacctctttgcggtatc

SEQ ID NO: 86070 - DNA, 104 bp, Mus musculus
gcttctggtaccggaagagaggttttctgggtctctgtttctttgatgagaatgaaacacacccagctaacctttttttcagtatcaaatcccatcttggaggc

SEQ ID NO: 86071 - DNA, 115 bp, Mus musculus
ccagcgctccttatcgtttgctacttgaagagaggttatcctttgtgtgtttgctttacgcgaaatgaatatgcaagggcaagctctcttcgaggagcaaatgctgcctggaagc

SEQ ID NO: 86072 - DNA, 71 bp, Mus musculus
agggtgtgtgactggttgaccagaggggcgtgcactctgttcaccctgtgggccacctagtcaccaaccct

SEQ ID NO: 86073 - DNA, 129 bp, Mus musculus
ggtgcttgaagataggttatccgtgttgccttcgctttattcgtgacgaatcatacacggttgacctatttttcagtaccaaatcccgccttggaggaatttctggggtgggactgtggtgttagcgtc

SEQ ID NO: 86074 - DNA, 57 bp, Mus musculus
gtatgtatatatatatgtgtgtgtatatttatatacatatatgtgtcatgtatatat

SEQ ID NO: 86075 - DNA, 75 bp, Mus musculus
tacatgtgtctgtgtacgtgcatatgcatgcatatgtctgtgtggtgtgtgtgcctgcgtgtctgggtgtgtgta

SEQ ID NO: 86076 - DNA, 86 bp, Mus musculus
ggcttcgtttcagtacataccatccagtgacactctctctctgaggtcctctagagtgtgtggcacagatcttggattgtggagcc

SEQ ID NO: 86077 - DNA, 109 bp, Mus musculus
gcattcattttcattgaattctagaaagtaacttttttttttaaaaatttgtctcttgacccactggtaattaggtagaaagttgtttagtttggatgaatttgtaggc

SEQ ID NO: 86078 - DNA, 91 bp, Mus musculus
tctagactctcttttgagtacctcattccaggttcattcttaatatggaaacaaagaatgtttattaatgtttactctcagagacattaga

SEQ ID NO: 86079 - DNA, 82 bp, Mus musculus
catattgggtaagacactggcactagaaggcttacttaccctaaccctctgtgactctctttgaccagtgactatgcatgtg

SEQ ID NO: 86080 - DNA, 112 bp, Mus musculus
atgggggtgcatgggtgagaatgtgtgcgtgtgtgagtgtgcatgtatatgtgtgtgtgcatgtccatgtgcatgtgtgcctatgtggtgtgtatgtgtggtttgcatgtgt

SEQ ID NO: 86081 - DNA, 79 bp, Mus musculus
cccacttgcctgcctgcctgcctgcctagctggacccagataaggatgaggcctgtggggaacctcacaggcaagaggg

SEQ ID NO: 86082 - DNA, 105 bp, Mus musculus
tttagcattttaccccacttccatctctggcggttccgaggtcagtggctgctgcagtctggctcactgattccctgctgagagtccacgattggttctgttgag

SEQ ID NO: 86083 - DNA, 101 bp, Mus musculus
gtgtgcacatagacatgctcatgtgcatgtgcacgtgcacgtgcgcacgcgcacgcgcatacacacacacacacagtatagggaggatgtgatcatgccac

SEQ ID NO: 86084 - DNA, 89 bp, Mus musculus
gcttgtctgtctgtctttctgtctgtcacaagcagagacgtcgaggcgatgtgaggtcaagagagaagcacagtccttagcagactggc

SEQ ID NO: 86085 - DNA, 78 bp, Mus musculus
tctggcgtgatgagcaggactcctgtgtgcctcccatcctgtcttagacacttagggtctgtctgtctcacactcaga

SEQ ID NO: 86086 - DNA, 79 bp, Mus musculus
gagagaacgcactctgagtctctggttccctgggagaaatccattttcagaatctggaggtgtagacatgtgttctttt

SEQ ID NO: 86087 - DNA, 72 bp, Mus musculus
atccccaaagcaggaagtgaagcagaaagggccctgaattctgtcagcctgtgtctctcctggttgggtgat

SEQ ID NO: 86088 - DNA, 87 bp, Mus musculus
gaggggtattgttagggagctggagagatggctcagcggttaagagcactgactgctcttccagaggtcctgagttcaattccctgc

SEQ ID NO: 86089 - DNA, 81 bp, Mus musculus
gtgggccatgtgtatatttttgtgtatacatatgtatatttgtatgtgtatacacatatatatgtgagtatgtgttcacaa

SEQ ID NO: 86090 - DNA, 84 bp, Mus musculus
gccgggcaccaccctgccccactctctgactctgggcggatcagctcatcctctagacagtaacagtggtcaggctgcctgtgc

SEQ ID NO: 86091 - DNA, 58 bp, Mus musculus
ctctggggagggtcaggttctcacatactcttggggtctctctctctctcttccaggg

SEQ ID NO: 86092 - DNA, 80 bp, Mus musculus
ctcttctgtgattgtatttgtgtgatgatgggcattggggaaaagtacttggccgtgttactgggatgctgtgcggcgag

SEQ ID NO: 86093 - DNA, 66 bp, Mus musculus
tgtcagatgtgagtgagcgcatccttcctgtcagctaatggaaaggggtgctgctcacaaaaggca

SEQ ID NO: 86094 - DNA, 125 bp, Mus musculus
ggatgaagaaatgaagagacatccagctctccggagcctgaaggctcacgctgagtctctgtgtgtccactaggtcatgttgccccggcactcctcactctgcacccggggacatgactatggca

SEQ ID NO: 86095 - DNA, 76 bp, Mus musculus
atagattgggttattcatataggtctaatttttgtttccaagacaggggtctgtctgtctgtgtagctctgactgt

SEQ ID NO: 86096 - DNA, 63 bp, Mus musculus
tgtgtcactgtgtcactccctttaaggaagattaatgtggtcttgaggggagtgacgggcgca

SEQ ID NO: 86097 - DNA, 68 bp, Mus musculus
ggtgagttttccctgttgtttttgagacacagtctcactgtgtagctctgactattctggaactcact

SEQ ID NO: 86098 - DNA, 78 bp, Mus musculus
tcacttttgttatttttaaataagcacagaaagctggcgatatggctcagtggctgagtgcttgcctagcagatatga

SEQ ID NO: 86099 - DNA, 68 bp, Mus musculus
gtgcgggtgctcttggcctgagtgctgctcacttgggatgggtagctctcttctgtgagtgtctggac

SEQ ID NO: 86100 - DNA, 71 bp, Mus musculus
agcatcagtccaacccaggaggcacagtaagtatgcagaaggctgcctcactgagtgtctctgaacaggct

SEQ ID NO: 86101 - DNA, 89 bp, Mus musculus
gctaggacctgggtggggtggggcccacgacaggaggacctacacataccaactcaggctcctggccactttcaaccctggctctgctc

SEQ ID NO: 86102 - DNA, 84 bp, Mus musculus
atgtcatgtgtatgagctctcagcctgcctgtgtgtctgcggtctgtgtcccacccatatgcctggtgctggggatactggcat

SEQ ID NO: 86103 - DNA, 67 bp, Mus musculus
actgtgtgtgtgcatgtccatgtgcattgtttagtcatgtggtacgtgcacttgtgcacacacgtgt

SEQ ID NO: 86104 - DNA, 121 bp, Mus musculus
gctctgtgtctgtctttgtgcccaggctactttgcttgagatgtgttccccctcagcagtgttgagacttggtgatcatctcggatggtgtggcaggcagagcggctgtgccaggcaccag

SEQ ID NO: 86105 - DNA, 85 bp, Mus musculus
gcccagggagctggtcccagaagaacccgcagggctgtcggagcattccgactcactgcgtgcctctatgagactggcccatggc

SEQ ID NO: 86106 - DNA, 67 bp, Mus musculus
tccagtcgggaagcatagaaggtgaatgctggttctcagctcacactctctgtgcgtgcatgctggg

SEQ ID NO: 86107 - DNA, 76 bp, Mus musculus
gaggaggcgtgccactgggggtgggctttgaggttttaaaagcatcctcccattcccagtctctctgtgtctcctc

SEQ ID NO: 86108 - DNA, 80 bp, Mus musculus
aggcctagaaggagggcaccaggagtgggtgtgtgccctccaaggggtatttgtcactttctctctctctctagtttcct

SEQ ID NO: 86109 - DNA, 92 bp, Mus musculus
gtgcacagatgtaaatgcagtacaaagatgtaaatacatcttcccaaaaagtgtgtgtgtgtgtatctgtgtgtgtgtgtgtgtctgtgtat

SEQ ID NO: 86110 - DNA, 90 bp, Mus musculus
gtaccatgtggactgcggcatgaaaagcaaaggccttgaggtcagtgagcactcagggaggccagtgtgactacagccaggagtgggggc

SEQ ID NO: 86111 - DNA, 108 bp, Mus musculus
ccaggtcgcctttctcctcagctgtgtagaagggtcagtgagcagaggggaaatgggtccctgtctgcctcattcctaaacaccaagcagagagaacaaccgccctgg

SEQ ID NO: 86112 - DNA, 64 bp, Mus musculus
gttctcagcagctcggtgtgctgattacgttgttgacagttgtcactgtgctgaccaggggggt

SEQ ID NO: 86113 - DNA, 106 bp, Mus musculus
tgattatgatgtggactcttgggatggagatggcttggtggttaagagcactgactgctcttccagaggtcctgagttcaaatcccaacaaccacatggtggctca

SEQ ID NO: 86114 - DNA, 57 bp, Mus musculus
gggcagcgcaggcggagacggccagacccttaacgtttctctcagtctgtgtccacc

SEQ ID NO: 86115 - DNA, 84 bp, Mus musculus
ctgagctcacggtgacacagtgtctgccttggggcttcgtatggaatctgtggtctgtgcctagcgtcaggttggatatgcgtg

SEQ ID NO: 86116 - DNA, 74 bp, Mus musculus
ggtgtgtatgtatatgattatgtatatgtatgtatatggtgtatatgtatatacattcattctcatgccccgcc

SEQ ID NO: 86117 - DNA, 126 bp, Mus musculus
atatatatgtgtatgtttatgtgtacatgtgcatatgtatatgatgtatatgtatatgattatgtatatgtgtgtatatggtatatatttacacgtatatgatatacacatgtatgtgtatatgta

SEQ ID NO: 86118 - DNA, 78 bp, Mus musculus
tccggggaggagatggccatctcctaggggtaagtgtcagccggtggctcactccctctgtcatctgcttgcccagga

SEQ ID NO: 86119 - DNA, 81 bp, Mus musculus
ctgtgggtaccagactccctcgctcactgctttgaggacatcatttttcagagtccctgagagtagggatttagcccacag

SEQ ID NO: 86120 - DNA, 99 bp, Mus musculus
gactagtgctacaataagcttgcatatttgggcatgtatacagattttgtttctttatatgtacgttctggagtgatgtaacaaggtcatagtctagtt

SEQ ID NO: 86121 - DNA, 80 bp, Mus musculus
gttatatatatgtatatcaatgtttctcaacctgtgggtcaacaccccccttgggatcacatatcagatatttgtataac

SEQ ID NO: 86122 - DNA, 70 bp, Mus musculus
atacacacacatacattatgtatatatttttcaagacaaggggttttgtgtgttttgtgtgtgtgtgtgt

SEQ ID NO: 86123 - DNA, 97 bp, Mus musculus
ggtctaacttggaggtggtgatgagagtgaggactgtgcaaagatttgttcagtaaacaaatccacacttcatcttctcgttgggatttgttggatt

SEQ ID NO: 86124 - DNA, 104 bp, Mus musculus
tggtgagaaggcccagggttcccactttgcctgctctgttcactgtgtctcatctaaatttaaatgaacagctgtaggtagatggttataggcagacctcagta

SEQ ID NO: 86125 - DNA, 86 bp, Mus musculus
ctctgctttgtcagtctgtcactgttttctgtttctgtttaaagagcccaggctataggttattaagtttatctggaagagggggg

SEQ ID NO: 86126 - DNA, 79 bp, Mus musculus
ggaagagcgcagatgctcagatagaagtctcctgggatgctgctagagatgttacggagagagtctctgtgtgtgcctg

SEQ ID NO: 86127 - DNA, 97 bp, Mus musculus
cacaaacccactatgaacacagcagagctctgcctcacttgggaaaatggaccaaaagagcttctctgtgtctctctcagtggtggctgtgcagtgc

SEQ ID NO: 86128 - DNA, 115 bp, Mus musculus
gggcagagccctggctccatctctgcagggttgatgtctgatcactgccaggattgaggaacaaagtgggcggagggtgaccatgtctgagctgtggaagggagggatgaggctc

SEQ ID NO: 86129 - DNA, 80 bp, Mus musculus
ggttctgtgcgtgtgtctgtccgtgtgtgggaatgtgcacatgagtgcaggtgcccacagagatcagaggcgtagagtcc

SEQ ID NO: 86130 - DNA, 105 bp, Mus musculus
taaaaagcacagtgtgggaggggcgtttcctgtgaggttggttgtctgggaggtgctgccaagcagctcttatcagaaccccggtgaactgcactggtctggttg

SEQ ID NO: 86131 - DNA, 80 bp, Mus musculus
gatgagaccacagagacagactggagagtgtgcagaaagagcaacactggagcacccagtcctaagtgggatgttttgtc

SEQ ID NO: 86132 - DNA, 80 bp, Mus musculus
tgggatgctggtgagatggcttaatgggttcagctgcttccttccaagcctgataacctgagttctgtctctgagaccca

SEQ ID NO: 86133 - DNA, 64 bp, Mus musculus
gagcaagcctcgctctcactgacactgccccgggtggacaggagagcagggagcagacatgttc

SEQ ID NO: 86134 - DNA, 81 bp, Mus musculus
tgagagactgaacctctgtgagcctctgagtctcttccaagcatggggagagggagagcagaggacacctccagtggtcag

SEQ ID NO: 86135 - DNA, 94 bp, Mus musculus
ccatgtctctacaggatcagaacaaacagaattaatatctgtcaatctatcacctatttgtctgtctgtctgtctcagatgtattagaatgtgg

SEQ ID NO: 86136 - DNA, 87 bp, Mus musculus
aggtgcacatgcacatgtgtgttcacatgtgggattgtggaggtcacagaacagttttacatgtcaggctccaggtgctgcctacct

SEQ ID NO: 86137 - DNA, 122 bp, Mus musculus
gccgttgctctatgctagccctgtgaccttgggcagattgggtaacctcctcagacacagtcactgtaccaatccctgtgtgagggcctccccacatgcctgggccctgagcacagcagtaa

SEQ ID NO: 86138 - DNA, 93 bp, Mus musculus
gcaggcgcgcctggtccagtggttcttgacagttcaacagttctgtagcacaattgtgaaatgtttaggaccactagacccggcgcgcacggc

SEQ ID NO: 86139 - DNA, 82 bp, Mus musculus
gtgcatgtgcatgtgtgtgtgcatgtgtgtgtgcatgtgcatgtgtgaacaatgcatgtgtgtgtgccatagtgcatgtgta

SEQ ID NO: 86140 - DNA, 134 bp, Mus musculus
gtgtatgtatgtgtgtatgtatatgtatgtatgtgtgcatgtatgtgtgcatgtatgtatgcatgtatgtatgtgtgcatgtatgtatgcatgtgcatgtatgaatgttatgtatgtgcatgtatgtatgtatg

SEQ ID NO: 86141 - DNA, 117 bp, Mus musculus
ggctgagcttctgggcagccctggggaggagaggagggtgcttagggtgtaccaacagctacctctgtcactctgtcaccgtgcctaggaccacagcaggctgccccagctcagact

SEQ ID NO: 86142 - DNA, 98 bp, Mus musculus
aagatcccaaggagcagaattttgtatgtatgtatagatgtatgtatgtatgtatgcatgcatgtatgtgtgtatttccttattcatttgatagtctt

SEQ ID NO: 86143 - DNA, 73 bp, Mus musculus
tgtccagagtcggcaccagcaaagccaggaccacaaatcagtgagggcagtgtctgtgcgtctctgccaggca

SEQ ID NO: 86144 - DNA, 89 bp, Mus musculus
cctgctgccacttggtaagacttctgaggcctggagacagagccccacacaggcctcgtcttcctctgtgtctgtgtcagtgcaggggg

SEQ ID NO: 86145 - DNA, 92 bp, Mus musculus
atatatatatatgcatatagtgtgtgtacgtgtgcttatatacatgtatatgtataatatatatgcatatatatatattatatacacacatt

SEQ ID NO: 86146 - DNA, 85 bp, Mus musculus
gggtagcagtttagggggaggcggtacacatttgatcaggctatgtccctgagctgctctctctgtccctgagtacctggtaccc

SEQ ID NO: 86147 - DNA, 90 bp, Mus musculus
agtttctgcagacagactctttctgtgtcacgcgatctcattttccaatctgcacatggtgacacagggcccagcttcgtcttcaagact

SEQ ID NO: 86148 - DNA, 58 bp, Mus musculus
ccgaggagcagcagagtcctgagacagaggggacattgctctcaagtctggctcttgg

SEQ ID NO: 86149 - DNA, 104 bp, Mus musculus
gtccttgtccagctcacgtttgggaagtcacgttggtcagactgtacgggtatagcttctgacacagtctcacactaacgcacccccatcccctgttccttggc

SEQ ID NO: 86150 - DNA, 107 bp, Mus musculus
atctgctttggcaggtgtgttctgaagatgggtctgtcagcagggacatacacctccttgttcacacacactctctctctcaaccagcattgtagccataatcagat

SEQ ID NO: 86151 - DNA, 93 bp, Mus musculus
cacacataacagcatatacatatacatacacatatatacatacatatatgtatgtatatatgtgtatatatatgtggctatgcaatctgtgtg

SEQ ID NO: 86152 - DNA, 72 bp, Mus musculus
gcatagccacatatatatacacatatatacatacatatatgtatgtatatatgtgtatgtatatgtatatgc

SEQ ID NO: 86153 - DNA, 58 bp, Mus musculus
tgcatgtatgtatgtatgtatgtatgtgtgtatgtgtgtatgtatatgtgtgtgtgta

SEQ ID NO: 86154 - DNA, 67 bp, Mus musculus
gccccaagctctcagtctgtcaccctcaccagtcctggacagggctgactcccactgaccctccggc

SEQ ID NO: 86155 - DNA, 113 bp, Mus musculus
gttgtgtcagctgctaacggtgagagcatagagggatagtgtggctcctggggactttccagcaaaaggccacagacatgaatcctgtctgtgtggtttgatgttggcgcagc

SEQ ID NO: 86156 - DNA, 118 bp, Mus musculus
gatgatgagatcataaaggtaagaaggaagactcatgttttaaggttttattgctgtgaagagacactatgagcttgacaactttaattttttcaccttttaaattttttctgtcatc

SEQ ID NO: 86157 - DNA, 114 bp, Mus musculus
ggagagatggctaggggctggagggcgggcgggtcttgcgtgctttcggaccttcgctggctctgtgggtctctgcatctcgcttgcacttgtgcctgcctcgtgcttttcacc

SEQ ID NO: 86158 - DNA, 84 bp, Mus musculus
ctgactgttgacctgaggctgtacctcggctgacacccccgttttccactaggccctgctgactgccagcctctcagccttaag

SEQ ID NO: 86159 - DNA, 86 bp, Mus musculus
acagtgacacattgctctgtgctgggtggtgaaggattcccgtcttacaccattcagccaatagagagtgagctgtgtggagctgt

SEQ ID NO: 86160 - DNA, 98 bp, Mus musculus
tggggtggggggcaggccagcaggcagagccagggtacgctgacaaggacttctgtgtggctgcctgactcagcctacctgccctgcctcccagctca

SEQ ID NO: 86161 - DNA, 68 bp, Mus musculus
caggggagtgaatctggctcactctgcaagagcaagtgctctcaaccttgagccatctctccagcctg

SEQ ID NO: 86162 - DNA, 93 bp, Mus musculus
gttgctcactaccacggatagagttagaacacaggggtgtagggaggtggacagtgctgagtgaggacagtccgtaggagataggtgagtagc

SEQ ID NO: 86163 - DNA, 76 bp, Mus musculus
tctgttacatttatttttttacatgtatgtatgcacatgtacacacatgcaacagtgcacacatgtagagatcaga

SEQ ID NO: 86164 - DNA, 69 bp, Mus musculus
gtccagagggtctgtcagtctgtggccagctgaaatgaatattgtctgacattgcagccctattggggc

SEQ ID NO: 86165 - DNA, 172 bp, Mus musculus
gtgcatgtttatgtgtgtatgcatgtggtctgtgggggcctgtttatgtttgtatgtatgtatgtatgtatgtatgcatgtatatgtatatatgtatgtgagtatgagtatatatgtatatgtatatgtgtgcatttttgtgtatatatgtgcatgtttgtgtgtgtgcatg

SEQ ID NO: 86166 - DNA, 87 bp, Mus musculus
gccagattctcaggcccccagatgagagaggacacactgtggctccctgagcaggccttggttcagtctgttgtctgggctctggcc

SEQ ID NO: 86167 - DNA, 83 bp, Mus musculus
ttcctttcttttcttgcttataaaatagcaacaactttaattttttaatgtgtgcatatttaggcatattgggaagtttggaa

SEQ ID NO: 86168 - DNA, 71 bp, Mus musculus
gaagtgagcacacgtgtgggcgctttatgcgtgtgcgtgttcacgtatgtgtctgtgtgtgtgtgtaggtc

SEQ ID NO: 86169 - DNA, 99 bp, Mus musculus
gagtctgaggggtgttcacacatggctctggtgcatggctctcatctgtgtgtgtgtgtgccacaggctccatttgagtgctcggttggctccattgct

SEQ ID NO: 86170 - DNA, 119 bp, Mus musculus
ggggtcagggacactggttggcagaggtacccaggacatagagtgctcagagtgcagttggggacatgctgagcactgttcctctgtgaggggacaggctgagacagggactgaagtcc

SEQ ID NO: 86171 - DNA, 92 bp, Mus musculus
cagacagtggatctgaaagacagaaggccgtgcaagaccacaattcccttgaatctcacactctgtcttcccaaagttcctaactgcatctg

SEQ ID NO: 86172 - DNA, 84 bp, Mus musculus
ctcagtggctcctgtacctgctagggcccaacagaggctatgaagctcaggccctctgagtgtctctctaggtcatccactgag

SEQ ID NO: 86173 - DNA, 66 bp, Mus musculus
gaggacactcagtcagtcagtgacgtgaagggcttctaagccagtccacatgctctgtgtgaactc

SEQ ID NO: 86174 - DNA, 85 bp, Mus musculus
ggccatgatggtctgataggatgcatgggacaatttcaatatttttgtatctgttgaggcctgttttgtgaccaattatatggtc

SEQ ID NO: 86175 - DNA, 91 bp, Mus musculus
gtctgtgtgtgtatgggtgtctgtgtgtctgtgcatattcaattgcagttgccatgtctgcaggttcatatgaatatctgtgcatgtggat

SEQ ID NO: 86176 - DNA, 78 bp, Mus musculus
gcacaagcaatcacttgagattttgatcttaaccattggtacagatataagatataatctcagagtgttttgatttgc

SEQ ID NO: 86177 - DNA, 67 bp, Mus musculus
agtgcagatgaaggagtcaggacctgaccttgtgcagccatcacagactctgtctctcacctgcact

SEQ ID NO: 86178 - DNA, 69 bp, Mus musculus
tctctctctctctctaacatcattttcacacacatggatggaactaatgatggcagagcaagacagaga

SEQ ID NO: 86179 - DNA, 81 bp, Mus musculus
agcttatattagaaaaccatgcagaacccctatgaagagacagttggtcagttgagtttttcatggtttctgatttaggtt

SEQ ID NO: 86180 - DNA, 113 bp, Mus musculus
attgggatccagctcaacaggaggctccaagatctgacactatcactgattctatggtgtacttattgacaggagcctagtatggctgcccagtaagaagctgaaagagtcag

SEQ ID NO: 86181 - DNA, 93 bp, Mus musculus
agcaggctgattcagaccttgctgccactgtgaatgagaccacctggggtggagccttctgacatagatggttctattgttctgtcacttgct

SEQ ID NO: 86182 - DNA, 57 bp, Mus musculus
cttttcctctcagtccctctgacagaggccccttcctgtcagaagtgggagggtagg

SEQ ID NO: 86183 - DNA, 140 bp, Mus musculus
tacatctaatgaatatgtatatataggtagacatatacatatatattataaatgtatatatgtattatccatatatgtatgtacatgtgtatatgtatatatgcatatacatatatacacatatatgtgtgcatgtatat

SEQ ID NO: 86184 - DNA, 99 bp, Mus musculus
gtcagtgaggtacatttcctatgtgtagtgaagtgctgggttctgtttgcttatctaccttatcctatgtcttcttattgaggaaatgattccattgat

SEQ ID NO: 86185 - DNA, 107 bp, Mus musculus
gtggttattgtgatgggagttgtttccttaatcatttttctcagcctgtttatccttgtagagaggaagactagtgatttatttgaggtaattttacatctggccac

SEQ ID NO: 86186 - DNA, 85 bp, Mus musculus; identical to SEQ ID NO: 57439

SEQ ID NO: 86187 - DNA, 85 bp, Mus musculus; identical to SEQ ID NO: 57470

SEQ ID NO: 86188 - DNA, 92 bp, Mus musculus
actattgtggatgccaaacaagtgctttctgacaggagcctgatatacctgtctcctgagaggctctgtcagtgcctgacaaacataaaggt

SEQ ID NO: 86189 - DNA, 85 bp, Mus musculus; identical to SEQ ID NO: 57470

SEQ ID NO: 86190 - DNA, 85 bp, Mus musculus
gctctgataagggtttggctgtgaccatttgattctttatttttcagattctgacagagaattttgggagatagccatatcaggc

SEQ ID NO: 86191 - DNA, 116 bp, Mus musculus
ttgaaaatcagccttagtccgtggtgatcagataggatgcatgaaataatttcaatatgtttttatctgttgagtcctgttttgtgaccgagtatatggtcgattttggagaaggt

SEQ ID NO: 86192 - DNA, 86 bp, Mus musculus
gcttagcgtagattggtactattataaggtgtgttcctgttggaataggtgtctcacactgtgtgtggtatataaaactcttagct

SEQ ID NO: 86193 - DNA, 72 bp, Mus musculus
agagtggtactattagtaggtgtggtactgttagaataggtgtctcacactgtgtgtggtatataaaactct

SEQ ID NO: 86194 - DNA, 96 bp, Mus musculus
ttagcaaaacacctagaagtcacttaagactgaagactgtgtgctctcctgtactgttgcagaatcttgtgtttccagtggccttgggcctgctga

SEQ ID NO: 86195 - DNA, 117 bp, Mus musculus
gcaaagtaacaaaattattgaagtggtccttggatactgtgagccaggtcttcagagaagtctgtgagtacaggaaaatatcacaagaaatcctttttttaaatcttgtttggttgt

SEQ ID NO: 86196 - DNA, 85 bp, Mus musculus; identical to SEQ ID NO: 57470

SEQ ID NO: 86197 - DNA, 110 bp, Mus musculus
ttgaagatcagccttagtccttggtgatctgataggatgcatgggataatttcaatatttttgtatcggttgaggcctgttttgtgatcaatgatatggtcagttttgga

SEQ ID NO: 86198 - DNA, 90 bp, Mus musculus
ttacagatgtaactgactatgatagtgatgaccaaacatttgacacatcatgtttgaaactctctgtcattctgtcatttgcatatgtaa

SEQ ID NO: 86199 - DNA, 80 bp, Mus musculus
tgactgctgtagcctgtcctgattttcctgacctgattttcctgatctgtagagagtgtacagactcagccacgtggtca

SEQ ID NO: 86200 - DNA, 100 bp, Mus musculus
cccatttgtttgcttttcttttgtattatttttagattctgttttctaagtttattaagaaacagagtagagatgaaagaagatcgtgaaggtgttaggg

SEQ ID NO: 86201 - DNA, 72 bp, Mus musculus
ggctgtgctggaggatgtgtctgaagtcagtgtggccttgcccttgaacttctcattgtactcagtataacc

SEQ ID NO: 86202 - DNA, 90 bp, Mus musculus
gccttagtccttggtgatctgataggatgcatgggataatttcaatatttttgtatcagttgaggcctgttttgtgaccaatgatatggt

SEQ ID NO: 86203 - DNA, 85 bp, Mus musculus; identical to SEQ ID NO: 57439

SEQ ID NO: 86204 - DNA, 89 bp, Mus musculus
tgggtgtatttgctcagagatagggagtgcattgtaaaactatattattatatccatgttgctgttaatatgagcacatataattacca

SEQ ID NO: 86205 - DNA, 106 bp, Mus musculus
tattcccatttgcttgcttttctttttttatttttagattctgttttctatttttataaggaaacagagtagagctgggaaaagattgcgaaggtgttggggaatg

SEQ ID NO: 86206 - DNA, 105 bp, Mus musculus
tcagtctttcctatttcagaggttagctgcttcagtcccctggttgggtgcaactctctgcctctgactcagaagcttgttggatctctcagagggcagtcatga

SEQ ID NO: 86207 - DNA, 85 bp, Mus musculus; identical to SEQ ID NO: 57470

SEQ ID NO: 86208 - DNA, 94 bp, Mus musculus
tatatgtatgtgtctgtatatatatatacatatatgtatgctgtatatatacatatacatatgtatatacatatatatatatacatatatatgt

SEQ ID NO: 86209 - DNA, 107 bp, Mus musculus
cctgaaataatgtatggctgaaaactgaggctgtgtcaatgtactgtagtctgtgagcacagtagtatgtgacagaaacttcagtgtccacacagatgatcttgagg

SEQ ID NO: 86210 - DNA, 97 bp, Mus musculus
catcatgtatatacatgtatacatagtatatgtatatgtatatacatatgtatatgtatatgtatatgtatatacatatgtatatgtatatgtatat

SEQ ID NO: 86211 - DNA, 76 bp, Mus musculus
tgcatctcagacactctgtccgtggagtaagggcataaatgtatgatgttgatttaagactgtgttatgagaagca

SEQ ID NO: 86212 - DNA, 75 bp, Mus musculus
gtgtacatggacgacacaaccttttaaaaatgctttttattattttcagaagtgtatgtgtgtgtgtgtgtgtgt

SEQ ID NO: 86213 - DNA, 91 bp, Mus musculus
attgcagctcactagttactggttttgatttcctggttctggtttattttatgccaccctctatcagtcagggtttgtctgtgagcttaat

SEQ ID NO: 86214 - DNA, 146 bp, Mus musculus
atgtattttgttttttatgtgtgttagtgtattgctcatatatatatacatacatatatatatatatatacacacacacacacacacacacacacatatatatatatatatatatatatatatgatgtggatgtgtgtatatatat

SEQ ID NO: 86215 - DNA, 113 bp, Mus musculus
gaatttcaaaagttaaaaacactaataaatactagtttcctttgttgactgaatttttttttaaagttcatagtaacaagtgtggataataggaaactgtagctttctgtttc

SEQ ID NO: 86216 - DNA, 110 bp, Mus musculus
gggcaaatgtgagagcctgcatggtctcatggttctgttagttctcagagggacttctttttgttgagcaactaactcatggtctaggagcagagctggggcagatgccc

SEQ ID NO: 86217 - DNA, 82 bp, Mus musculus
agcagggggcagagagaagagcctgaccaggttttctgaaacctaaaagcctgtcctcagttctctctctctctctctctct

SEQ ID NO: 86218 - DNA, 118 bp, Mus musculus
taaagtagttttaatttgcatttccctgatggctgatgtcctagctagttttatgtcaacttgacacaagctagagtccattggacaagagggaacctcaattgaaaaattgccttta

SEQ ID NO: 86219 - DNA, 108 bp, Mus musculus
ctcaactgttccagagaagctgctagaaagtccttttaattgggtcgcatatgtttgacagtgcctgttcttatctgagagagatatggtcagtctgcccaaagtgag

SEQ ID NO: 86220 - DNA, 61 bp, Mus musculus
ggaactctgtgtggctctgtctctgagctccttaaagacagatgttcagtgcagctgttcc

SEQ ID NO: 86221 - DNA, 113 bp, Mus musculus
gtgactctcacagacaccagctccatgttcagaacctagctcaatagtgttacacccaagacagacagaacacagagagggccaggacaaagaaatatgggtcaagcggtcac

SEQ ID NO: 86222 - DNA, 67 bp, Mus musculus
gcacagtctctctctctcactgagacccaaccaggcaagtccaggaaggagaaggggatcaaatggc

SEQ ID NO: 86223 - DNA, 128 bp, Mus musculus
gggaggctactctctctctctgcctcagtcttccttgggtaggtatagggaaactgctctctctgcctcagtctctaatgggtagatgttggaagtctgttctttctgcctcagttcacaaggtttac

SEQ ID NO: 86224 - DNA, 85 bp, Mus musculus; identical to SEQ ID NO: 57439

SEQ ID NO: 86225 - DNA, 76 bp, Mus musculus
ccatgttggaggaagtgtgtcatgggcttttgaaacctcaaaagctcaagatcactatctctctctcagcctatgg

SEQ ID NO: 86226 - DNA, 79 bp, Mus musculus
gctgggtcgcactctctgctgctgcctgccaggctgtccagaccactgagagcacacagcgttcacggagcacgtactc

SEQ ID NO: 86227 - DNA, 106 bp, Mus musculus
tatatgtatatatgtacatgtatgtatgtataatatatatatacatatatatatatatacatatatatatatatatatacatatatatatatatatatatatatac

SEQ ID NO: 86228 - DNA, 82 bp, Mus musculus
cctctagaacgacctatgcgtggggcctttcactgaagcctcagtctccctctcagtgctagagtgttgtggaatcatgagg

SEQ ID NO: 86229 - DNA, 106 bp, Mus musculus
ggaagagaacagctggagctctcctccacaacctgcttgagtgtctgactgtcagaggctcagtgattaaagcaatggtggaagcagtggccaagggatgtctgcc

SEQ ID NO: 86230 - DNA, 92 bp, Mus musculus
tagattcattatatataataaaatacatatgtatatttatatatatgtatgtatatatacatgtgtgtatatatgtatgtatatgaagactg

SEQ ID NO: 86231 - DNA, 57 bp, Mus musculus
gtctcagggtctgtcagacactctcttagtctgctttgatgtgctatgccttgagac

SEQ ID NO: 86232 - DNA, 105 bp, Mus musculus
ctgtctgtctgtctgtctgtctgtctgtgtgcccactaccaacaacagtaagaaacacacacacacacacacacacacacacacacagagagagagagagagaga

SEQ ID NO: 86233 - DNA, 66 bp, Mus musculus
gtgtgtgtgtgtgtgtgtgtgtttcttactgttgttggtagtgggcacacagacagacagacagac

SEQ ID NO: 86234 - DNA, 70 bp, Mus musculus
ttgtaccatatggaattgtcaatatctattatttttgatataggataacagcagtttcaatatggttcag

SEQ ID NO: 86235 - DNA, 112 bp, Mus musculus
catggacgcaggatcaccccactttctaaggcttatcgtggctcatctgtccctctgccactcagtactagggttacttagccacttatgttttatgagtgttactgctatg

SEQ ID NO: 86236 - DNA, 77 bp, Mus musculus
gcagcaggtgagcatcttcgatgtcacccagggaagtgagtcactttctcagtgaggttaagcacaccatgcggggc

SEQ ID NO: 86237 - DNA, 66 bp, Mus musculus
gctagagctagggtcaggttactgtgcctgtgagcccaggcccctgtctctgtctctgtctttagc

SEQ ID NO: 86238 - DNA, 126 bp, Mus musculus
aggtttccaggtcactgagatgtgggaggacactccctcatccatttttctgactccctcattctctgctcagggctatcaaatagctgtagccttcagaggcaggtgataagggcaagctgaaaa

SEQ ID NO: 86239 - DNA, 114 bp, Mus musculus
ctttgccagctacttagcggtggccggtgtcatttttgtgacgttgcagctagtaatatgagcccagttgcatagtcacaaaagtgatcattggaaactgtgactgcagcaggg

SEQ ID NO: 86240 - DNA, 77 bp, Mus musculus
tctgtgcactctatgtgactctgacttttttgccccagtccagggtagaggagcactcctccaaggggccccacaga

SEQ ID NO: 86241 - DNA, 103 bp, Mus musculus
gcaccatgagtcagtcacccaagatctgaaatacacagaagcgagtgtgcaaactacatgcaaatctgggggcattttgtgcaaggatctgctgattgggtgt

SEQ ID NO: 86242 - DNA, 68 bp, Mus musculus
tgcatgcatgatgtacatgtgtgtgcacatgtgccttgtgtgcacacatgtgtgtgcctgtgtgtgca

SEQ ID NO: 86243 - DNA, 67 bp, Mus musculus
ttatatatatatacatgtatgcatgtatacatatatgtatataatatatacatgtacacatatataa

SEQ ID NO: 86244 - DNA, 109 bp, Mus musculus
gacagcctgctactctatgctcaaggttacaattgtaacacaggctgttttcttgacaaggtgttaagaaattgtgttacctgtaaaaccccttgagattcactctgtc

SEQ ID NO: 86245 - DNA, 80 bp, Mus musculus
catacacatgtacacacagacacagagacacacatacaatttatgagtccatttgtgatgtttgtatttatatgtttatg

SEQ ID NO: 86246 - DNA, 106 bp, Mus musculus
tgtgtgtacatgtgtatgtatctgtatgtatgtgtatgaatgtatgtgtgcatgtgtatgtgtgcatgtgtatgtgtgcatatgtgtatgtatgtgtgtatgtgta

SEQ ID NO: 86247 - DNA, 92 bp, Mus musculus
caacacatgtttctcaggactcaacagtcagaacactgtgtccacaggctcatggatgcattgtgttttgcacagtcccggggagggtattg

SEQ ID NO: 86248 - DNA, 81 bp, Mus musculus
gtgggtcactctgagctggtaaataactcctagcctgtttgtcatgacccttgggttagcctgtctctctgagtgcctcac

SEQ ID NO: 86249 - DNA, 87 bp, Mus musculus
gctgagttcttattagaggcagttgcttgtaaagatgccatgccatcattaaagcatgtttacagggaatagaaggtcctgcttagc

SEQ ID NO: 86250 - DNA, 115 bp, Mus musculus
tatacacattaactatagttattaaaatatgaaggtagatggctattcatatatatatattgtagttgtctgatccacacaccactggttttgtttcctatatcttgagtgtata

SEQ ID NO: 86251 - DNA, 99 bp, Mus musculus
gaggagccgaagtccctacatctaactttctattctccgttactctgttcaaagagtgtgagttttagatctaagactttgccactacctgccatcctc

SEQ ID NO: 86252 - DNA, 110 bp, Mus musculus
taactgttgagcgttagtctcttcatttttaagtgggtctaagagtagtaatatagttgttataagaatagaataagcttagaattgtaccaggctcatactgacagttg

SEQ ID NO: 86253 - DNA, 125 bp, Mus musculus
ctggctcaccatggggagtggaagcagtaggaacttgagctgccagtcatccagtgtatgtcaggagacagggtggacagacgaaggcatgccggctgctgctcagctctcctccagttatgtgg

SEQ ID NO: 86254 - DNA, 71 bp, Mus musculus
gtatgtgaatatatgtgtgtatataggtatgtgtatgaatatatgtatgtgtgtgtatttaatttatgtgc

SEQ ID NO: 86255 - DNA, 74 bp, Mus musculus
tatagatgtatagatatatatcatatatgtatgtatacatatatgtatgcatgtatatatgtatgtttgtacgt

SEQ ID NO: 86256 - DNA, 110 bp, Mus musculus
tggaattttccaggaggccttgagggattatgggctcatgttgggaaggtacagtctcagcactcaggaacaccctgtaatctctgtggcttccttgactgaatttttca

SEQ ID NO: 86257 - DNA, 87 bp, Mus musculus
gcagctccagagaagcacacgcacagcctcacagcctgccagtctttgctgtcctgtgtctgtgtctgctttctccagcggagcagc

SEQ ID NO: 86258 - DNA, 82 bp, Mus musculus
ctaggagtctgactgtctctccttagtctttgggaatttgtctgtctctccttagtcttctgggagtctgtctgtctcttag

SEQ ID NO: 86259 - DNA, 97 bp, Mus musculus
ccccattagaattttaggtcatctgtaagttccacagaaaaatttttgtttatttctagggtggaaaacctgtacgtgaaaatgctgtctcgtgggg

SEQ ID NO: 86260 - DNA, 113 bp, Mus musculus
ctgttttacatccctaggtcaaatcccctttgttgtggtctgtatagtagtttgaatatagattgatacagtcattgtggaaacaagtgccaggttcttggatgtgaaaatag

SEQ ID NO: 86261 - DNA, 182 bp, Mus musculus
acatatgtatatatatgaatatatatgcatatatgtacatatgcatatatatgcatatatgaacatatgtatatatgtatatatgtacatattatatatgtatatgtgtatatatgtatatgtgtacatatgtacatatgtatatatgtgtgtatatatgtatatgtgtatgtatgtatgta

SEQ ID NO: 86262 - DNA, 87 bp, Mus musculus
tccagacacctggtactggttgagccactctgtctacttaaacagaagagagtgagaagccaggaatttctttggccaggggtacga

SEQ ID NO: 86263 - DNA, 71 bp, Mus musculus
ctgagtatgtatatgtatgtgtatgtatgtatgtatgtatgtatgtatgtatatgtatgtagaaatgttag

SEQ ID NO: 86264 - DNA, 82 bp, Mus musculus
tcaaggaagacacccttggtgagagcaagtctagctgtggcaatgggaacctgaggcagctgctcactctgtgtgtgtgtga

SEQ ID NO: 86265 - DNA, 85 bp, Mus musculus; identical to SEQ ID NO: 57439

SEQ ID NO: 86266 - DNA, 77 bp, Mus musculus
tctgtcactctctgccttcttcccttgggccaggctctctcactgaccctggaatgaagctggcagcaagtcccagg

SEQ ID NO: 86267 - DNA, 69 bp, Mus musculus
tatatattctatactctatgatatgtgtatacatgtgtatgtatacatgtatgtatgtatgtatgtatg

SEQ ID NO: 86268 - DNA, 58 bp, Mus musculus
ggctcagagtctctgtctctctactttaggcctgtggatcagatataagctctcagcc

SEQ ID NO: 86269 - DNA, 95 bp, Mus musculus
catactcctgggctggggttaagagcactgactgctcttccagaggacccacagggcagctcacaactgctgtaactcctgttccaaggggtatg

SEQ ID NO: 86270 - DNA, 86 bp, Mus musculus
ttgggcacactgtgtagacagtcagcaagcagagtgactgctactgcttatcctgctttcttcctcttacacagtcctggacccaa

SEQ ID NO: 86271 - DNA, 78 bp, Mus musculus
cttggcagaaatcatacagatgtcgattcaaactatttaattagagaatgaacatctgggtgatggtttatgtacgag

SEQ ID NO: 86272 - DNA, 61 bp, Mus musculus
gcggcccaggagcagtgcacagtgggactcgaaccactgcctgcctgcctgtctgtctgtc

SEQ ID NO: 86273 - DNA, 137 bp, Mus musculus
gtgtgtgtgtataaatgtatacgtatatatatttgtgtatatctatgtatatatatttggtatatacatgctatacatgtttatatatatttatatacacttatatttatatatttatatacattcatgtttatgta

SEQ ID NO: 86274 - DNA, 74 bp, Mus musculus
gaaatggaaggtagtacatgccttagaatatgtgacttctgttgcaaattactatttatgattatttccatttt

SEQ ID NO: 86275 - DNA, 113 bp, Mus musculus
ggctgattcagaccttgctgccactgtaaatgagatgacctggggtggagcctccccacctaggtggttctattgttctgtcactagcaaaggctgctacctgatgataggct

SEQ ID NO: 86276 - DNA, 75 bp, Mus musculus
tctgtctgtctctctctctcataggcgcatgtgtacacacacacacacacacacagagagagagagagagagaga

SEQ ID NO: 86277 - DNA, 96 bp, Mus musculus
gatcagccttagtccatggtgatctgataggatgcatgggacaatttcaatatttttgtatctgttgaggcctactttgtgactaattatatggtc

SEQ ID NO: 86278 - DNA, 71 bp, Mus musculus
ttagtggatggaaccatgagtaacagaaacagggtttaaaccctagctctgtcactcactgtgtcaactga

SEQ ID NO: 86279 - DNA, 96 bp, Mus musculus
gatcagtcttagtccatggtggtctgataggatgcatgggacaatttcaatatttttgtatctgttgaggcctcttttgtgaccaattatatggtc

SEQ ID NO: 86280 - DNA, 96 bp, Mus musculus; identical to SEQ ID NO: 86279

SEQ ID NO: 86281 - DNA, 67 bp, Mus musculus
gcaagaatgtgtatttatatgtatgtctttattgtttgagaatgtatatgtgtgtgcatgtatgtgc

SEQ ID NO: 86282 - DNA, 112 bp, Mus musculus
gatcagtctcaggccatggtggtctgataggatacatgggacaatttcaatatttttgtatctgttgaggcctgttttttgaccaattatattgtcaattttggagaaggtc

SEQ ID NO: 86283 - DNA, 78 bp, Mus musculus
ggatctgtggaagccatcttggttctgagactcagccgaaagaagtctgcacagatgagagtgtggactacagaatct

SEQ ID NO: 86284 - DNA, 85 bp, Mus musculus; identical to SEQ ID NO: 57439

SEQ ID NO: 86285 - DNA, 81 bp, Mus musculus
tatatgtatatgtacatgatgtatatgtatatatatatatatatatatatatatatatgcttctatgtatatgtatatatg

SEQ ID NO: 86286 - DNA, 103 bp, Mus musculus
aagatcagccttagtctgtggtaatctgatagaatgcatgggtaatttcaatatttttgtatctgttgaggcctgttttgtgattaattatatggttgatttt

SEQ ID NO: 86287 - DNA, 117 bp, Mus musculus
tggatggttttagctcccttgtcaaagatcaagtggccatagttgtgtggattcatttctgggtcttcacttctattccattggtctacctgtctgtcgctgtaccaataccatgca

SEQ ID NO: 86288 - DNA, 97 bp, Mus musculus
gcaatagaaaaaataacccctgctctctgtgtgtatatgtgtgtgcatgtatgtgtatgccacagcacatatgtggaggtaagaggttagcttgtgt

SEQ ID NO: 86289 - DNA, 83 bp, Mus musculus
gggatttgatgctgacatctgtttagggttgagtgttccatggtctctctctctctctttgtacaatgtctgtatttgttccc

SEQ ID NO: 86290 - DNA, 79 bp, Mus musculus
acttctgttagtttcactgtgtctctgtttagtttctgttttcagggtctgtccattgatgagagtgaggtgttgaagt

SEQ ID NO: 86291 - DNA, 72 bp, Mus musculus
catgtgtgtgtgtgtgtatgtgtgtgtgtgtgtgtttgtatgtgcatgtgcatgtgcatgtgcatgtgcatg

SEQ ID NO: 86292 - DNA, 105 bp, Mus musculus
gggctacactttctgctggagactatatgaggacattggaagaagggagtctcactctcactctttcgcctgtttgttgtgtgggactgagcaactgctagatcc

SEQ ID NO: 86293 - DNA, 76 bp, Mus musculus
tgcatatatgcatgaatatatgtatatatatatatgtctaaatatatatgtatatttgtaaatatgtataattgta

SEQ ID NO: 86294 - DNA, 74 bp, Mus musculus
acctctcacactcagtctgtactatgggtgaccccagatcacccatcacacactgacttgaagtgggttatggt

SEQ ID NO: 86295 - DNA, 79 bp, Mus musculus
attgcctctggcagaatgttctagatttgggtccattgtctctgtctctctgaatgtggagcttactatgctgggtagt

SEQ ID NO: 86296 - DNA, 116 bp, Mus musculus
ttgaagatcagccttagtgcatggtgatctgataggatgcatgggacaatttcaatatttttgtatgtgttgaggcctgttatgtgacctattatgtggttaattttcgagaaggt

SEQ ID NO: 86297 - DNA, 110 bp, Mus musculus
gcaacatggctttgtgataaatagaccagagttcagggactacagacacactcactctaagctctgtcattgctgggttccatggttgatgacattgaggtctcacttgc

SEQ ID NO: 86298 - DNA, 116 bp, Mus musculus
ccaggagtacgtttcattagtaagttgactcagcaggacagagactgctggtttgaaagtagtgtgcgagcagccatgcttctgtctgggaacaatatataatgttgctatggtgg

SEQ ID NO: 86299 - DNA, 63 bp, Mus musculus
ggaggcacagaggtcagtgctctttctgtcctgctgaaatcacacaccctctgttagcattcc

SEQ ID NO: 86300 - DNA, 82 bp, Mus musculus
tgtctgtctatctgtctgttagactgtctgtgtgtctggctgtctatgtcagcatccacattgtgttaggcagtgatagata

SEQ ID NO: 86301 - DNA, 121 bp, Mus musculus
cagcacttttatccttttatgggcagattcaggaagaagccagcctgcctgcctgcctgccacaaaggctctttccctgagctgccacaggagtgggggtgctgagggttggctgcagtcc

SEQ ID NO: 86302 - DNA, 122 bp, Mus musculus
cttgtccatgattggcatgtgctgatgcttcagagagctgtttggatggacagatgtcactgtggacaggatgacgaggttaataacaaaattctgtgcattcttcttccagatgaaaggct

SEQ ID NO: 86303 - DNA, 88 bp, Mus musculus
tctctgcttaggaagagaggaacagtcagggatgtaggttgtaacaattgctctctgacactgagttactggtaccctgagagtgaga

SEQ ID NO: 86304 - DNA, 96 bp, Mus musculus
ctggattgtgaagaagtcagacacatgagtctgaggagaggtaatgaggcttctcgcagacatagaatagtttagactggtcatgtaagttaccag

SEQ ID NO: 86305 - DNA, 98 bp, Mus musculus
ctcagttgattcacagataacaccaggtccttaggagtcaaactctctctctcaatgactgaagcagctggtgaccaagtttctgcagaacacatgag

SEQ ID NO: 86306 - DNA, 107 bp, Mus musculus
gggaagaagtaaacggttggcatagtatgtggggcagactgtactttgagaggtcttgggcctctcttcagggttactcagtatgtccctataagtggcgccatccc

SEQ ID NO: 86307 - DNA, 70 bp, Mus musculus
gagacagaaatcatctgggtgcacgtgtatcagtgtgtgtccatgtgtgtccgtgtgtgtgtctgtgttc

SEQ ID NO: 86308 - DNA, 83 bp, Mus musculus
gctggtgaagtagatggatggcagcttgtcccaaagactacacaaagccaggccgagcctttctctctctgcttatcatcagt

SEQ ID NO: 86309 - DNA, 118 bp, Mus musculus
gttccactctgcatctttcttgttgtgtgacccccaactctcacagtctcagtttcattctctgcaaaataagactagcgagattaatctaaaagcaagaagccgcagaagggcggag

SEQ ID NO: 86310 - DNA, 82 bp, Mus musculus
cagagacagagacagagacagagacagctcagtggagtcaaagcatttgccaccaagcttgactgcctgaatttgatccctg

SEQ ID NO: 86311 - DNA, 82 bp, Mus musculus
cagggatcaaattcaggcagtcaagcttggtggcaaatgctttgactccactgagctgtctctgtctctgtctctgtctctg

SEQ ID NO: 86312 - DNA, 117 bp, Mus musculus
ggaggggaggggaggggaggaaagggaaggaaaggaagaaagagggtcggggtggcttgagtacagtttttcatctagccctgtttctttttgtccaagtcttttatgctttattct

SEQ ID NO: 86313 - DNA, 78 bp, Mus musculus
ctatctgtctgtctctgtgccaatactatgtggcttttatcactactgctttgtagtacagcttgaggtcagtgatgg

SEQ ID NO: 86314 - DNA, 83 bp, Mus musculus
tagagtgagctactgatttggtaggtgaaattgtattctagtgacaaactctttctctctcacttgctgtcagtcttgctcta

SEQ ID NO: 86315 - DNA, 76 bp, Mus musculus
gtttgtttatggtttatacatatgtatctatgtatgtgaatatatgcccatacatggtgtgtgtgcctgtgcatgc

SEQ ID NO: 86316 - DNA, 120 bp, Mus musculus
ccttggaagggggagggcttatttggcttacacttccacatcacattccatcactgaagggagtcagcacaggaacacagacaagggtggaacctgtaggccttagctgatgctccaggg

SEQ ID NO: 86317 - DNA, 98 bp, Mus musculus
tctatggtctgctgagatgacattaatggttgcattgtttttcttataccagtgtattaaagcattgctaaactcaggctttatctttagtctttaga

SEQ ID NO: 86318 - DNA, 94 bp, Mus musculus
ccatttaccttgcgttgcagatggatcccttattgctgtgtctttgtaagtcagagaacactgacagaggaaacagatgttgctagtcttttgg

SEQ ID NO: 86319 - DNA, 104 bp, Mus musculus
tatagctttttttccagcaactccaaacagtgcagaaggcaagttttaaaatgcagtcttctgtctctgtaagaagcattggggtgattgaagatatcattatg

SEQ ID NO: 86320 - DNA, 96 bp, Mus musculus
tgaggcataatgatatatatatatatatatatatatatatatatatacatatatatatgcatatatatgtgtgtgtacatatatataatttgttca

SEQ ID NO: 86321 - DNA, 67 bp, Mus musculus
ccaagtaggactctggctctgtctgactatagcatagatttctatagccagtagagaaagtgcttgg

SEQ ID NO: 86322 - DNA, 60 bp, Mus musculus
gtagaacactggaaagattagggcacttgtgggcactgagtgtctctgtcagtcttctgc

SEQ ID NO: 86323 - DNA, 106 bp, Mus musculus
ccttgccagcatttattgtcttgattttagccattttgaccagggtagaatagaatctcaatgtggttttgatttgaatttacctggtggataaggacattgatca

SEQ ID NO: 86324 - DNA, 101 bp, Mus musculus
agggcggggcctggagagcatcttccttacgtgtgagagactttgaagacaatttaaattgtttttcaaatgttggattatctttctatttccctgtacct

SEQ ID NO: 86325 - DNA, 87 bp, Mus musculus
ctggctgctcactagctctgtgactcagtgtctctgtgttctcacctttgaaagtggaaggcacttggagaggattagtaagcaaag

SEQ ID NO: 86326 - DNA, 89 bp, Mus musculus
tcattcacaaaattgatggctctctggggtcagatactgccttctcattatgaatatttgtttctggttgtggtcaggaatgtcaatga

SEQ ID NO: 86327 - DNA, 82 bp, Mus musculus
cctggccttaaagggacaagaggaaaggaaatgatttgggttcaaattctaagtctttttctttatatccaggggcttcagg

SEQ ID NO: 86328 - DNA, 85 bp, Mus musculus; identical to SEQ ID NO: 57470

SEQ ID NO: 86329 - DNA, 80 bp, Mus musculus
tctagagtctaaccacaaacatatatgtgtatatgtatatatgtatatgcatctgtatatgtatgtaatggatctcctga

SEQ ID NO: 86330 - DNA, 64 bp, Mus musculus
gctgaacattgtatgggaactggaagtagcttcttttattcacagcttctctcacagcctcagc

SEQ ID NO: 86331 - DNA, 85 bp, Mus musculus; identical to SEQ ID NO: 57470

SEQ ID NO: 86332 - DNA, 104 bp, Mus musculus
tacaatacagcttgaacaaattgagaatcctaaaacatgatcctaaaatatatgtatatatgtcatatacaaggattgttcttatgctctaggccaatgttgta

SEQ ID NO: 86333 - DNA, 95 bp, Mus musculus
gcaaaatttgaatcctgcaattgctgaagtgataaatggttgtaaactgacattagattaacgactattttcagagcgcagtgaattcagcatgc

SEQ ID NO: 86334 - DNA, 118 bp, Mus musculus
agctctgaaatagtattgtatgggactatgtaccggacgtgttacaaagtatattttcatatattttggtgtatcacatgatccttgtatcaggaccttactttataagctggtatca

SEQ ID NO: 86335 - DNA, 81 bp, Mus musculus
gggtaagcatctggggaagaaaagtcaatgagttttgttcagggcataaatactggttgcttgatttttcactgtttatac

SEQ ID NO: 86336 - DNA, 81 bp, Mus musculus
caatattgtgggtgccaacaagagtttgctgacaggagcctgatatagctgtctcctgagtggctctgacagtgcctgaca

SEQ ID NO: 86337 - DNA, 76 bp, Mus musculus
ggtgacatattatatatactacatgtatatatattagatactatataagctatacatgtaatgtgtaatgtttatt

SEQ ID NO: 86338 - DNA, 85 bp, Mus musculus; identical to SEQ ID NO: 57470

SEQ ID NO: 86339 - DNA, 103 bp, Mus musculus
gagacatgtttgaggaactgttgcaataaactaggtgaagaggggacttcggttctccctgagtgtagacagtgagctgcatccttccttaaaatctgtctta

SEQ ID NO: 86340 - DNA, 85 bp, Mus musculus; identical to SEQ ID NO: 57439

SEQ ID NO: 86341 - DNA, 107 bp, Mus musculus
gccttagtccatggtgatctgataggatgcataggataatttcaatattttttgtaactgttgaggcctgttttgtgaccacttatatggtcaattatggagaaggt

SEQ ID NO: 86342 - DNA, 76 bp, Mus musculus
tgtgttctttgagaaaagagactgtggtcataagggcctaagcagatggcattagttaatttcttctttgagcata

SEQ ID NO: 86343 - DNA, 85 bp, Mus musculus; identical to SEQ ID NO: 57470

SEQ ID NO: 86344 - DNA, 70 bp, Mus musculus
ctgtccttgccaagtttctgtaggcatgtgttcatcagagacacaaatacagagaactcactgaggtcag

SEQ ID NO: 86345 - DNA, 85 bp, Mus musculus; identical to SEQ ID NO: 57439

SEQ ID NO: 86346 - DNA, 118 bp, Mus musculus
tatgtatgtatgtatgcatgtatgcatgcatgtatgtttatgtatgtatgtatgtatgcatgcatgcatgtttatgtatgtatgtatgtatgcatgtgtaaatagataggtaacagac

SEQ ID NO: 86347 - DNA, 104 bp, Mus musculus
actgcaatgaagtgtattgattagagttaatggatattgaatgataataacctatattgtcatattgttattctgttaaatatttattcttatgtttctgtggt

SEQ ID NO: 86348 - DNA, 85 bp, Mus musculus; identical to SEQ ID NO: 57439

SEQ ID NO: 86349 - DNA, 88 bp, Mus musculus
ggaagtctttagcttagtagaatgtatatatatatatggggaatatatatgaacatatatatatatggggaattgcaggctggtatcc

SEQ ID NO: 86350 - DNA, 63 bp, Mus musculus
ctgattttctcagtgtcacagtggtagccagtggtgtgacagaacccactgttgacacttcag

SEQ ID NO: 86351 - DNA, 112 bp, Mus musculus
gatagatagatagatagatagagacatgtaaagtatatatatatatatatatatatatatatatatatatatatatatatatacaagaatgatagttatcctatagcttatc

SEQ ID NO: 86352 - DNA, 65 bp, Mus musculus
ttttgcatcagttcagcatggcagcagcttggtactcaggctgtcccactctcactgatgaggaa

SEQ ID NO: 86353 - DNA, 85 bp, Mus musculus; identical to SEQ ID NO: 57439

SEQ ID NO: 86354 - DNA, 74 bp, Mus musculus
tgtgcataaggtgtgtgtgtgcatgtgcttgtaaggtgtatgtctgtgcatatgtatgtgcatctgtggtgtgc

SEQ ID NO: 86355 - DNA, 89 bp, Mus musculus
cagtcatctcttttctgtccaagagaatggggcaaatggcaggttttcttccctcccattgactgactgactgactgactgactgactg

SEQ ID NO: 86356 - DNA, 58 bp, Mus musculus
ttacacactgtgcagtttcccgagactctcagagtctcaggacttgttagtgctgtga

SEQ ID NO: 86357 - DNA, 66 bp, Mus musculus
gacatagtagagatctgagtctgttgttctgaagtaaggcctggcagtctgcttttctcatgtgtc

SEQ ID NO: 86358 - DNA, 85 bp, Mus musculus
gagaaatgaagagggaatttgtgcagatctaatacataacagagacacctacaaaccctggtctgtgcctctctctctgggtctt

SEQ ID NO: 86359 - DNA, 59 bp, Mus musculus
gcatacagcataatacactgatctgcttctgtgtagtgtgtgtgtgtgtgtgtgtgtgt

SEQ ID NO: 86360 - DNA, 90 bp, Mus musculus
cttccagtgttctacagagacagcagtgactgtgcagaaaggcagggcatgtgatcagctccaggcacagaagcttctcctcacaggaag

SEQ ID NO: 86361 - DNA, 70 bp, Mus musculus
gcacctacatcagtgtctggcagagatgaggcttgctgtctctccattgagacacagagagagagagtgc

SEQ ID NO: 86362 - DNA, 59 bp, Mus musculus
atggatcactttgagtgtcaagtggatctggaatccactgagacaagagtgagatctgt

SEQ ID NO: 86363 - DNA, 85 bp, Mus musculus; identical to SEQ ID NO: 57439

SEQ ID NO: 86364 - DNA, 72 bp, Mus musculus
gagctagaagggaggttgaagtaaagtaggttttgaaaaatctaagcctacacctctgtctctctatctctc

SEQ ID NO: 86365 - DNA, 81 bp, Mus musculus
tgtctctctgtctctctctgatttatacatgtgagcgtacatacatttgctcatacatgtatgagtggaggccagaagtca

SEQ ID NO: 86366 - DNA, 76 bp, Mus musculus
ctgctcttccagaagatgtaaattcagttctcagcaccgatcccaaggtgttcacagtgactgtctgtcagtgcag

SEQ ID NO: 86367 - DNA, 63 bp, Mus musculus
ggcatcagatttcctggtgctgcactgacagacagtcactgtgaacaccttgggatcggtgct

SEQ ID NO: 86368 - DNA, 87 bp, Mus musculus
agacaaagtcttgtcaatttgttcaagttgcccatgagctcccactgtgtaaagtgggttagctttgaactgatgaccctcctgtct

SEQ ID NO: 86369 - DNA, 109 bp, Mus musculus
tgggatatgctgtgttttcattcctgttttgtctagctgcatcttttccagtccaagagctgattatgttgtacagtttacagtacaggctcctcggtaccccatctcc

SEQ ID NO: 86370 - DNA, 98 bp, Mus musculus
ttgaggttagtgtgtatgtctcttaggattacccttgtcatgagattgtcactgcttcacagtacatccgtaaggggaggaggaatagatactctcag

SEQ ID NO: 86371 - DNA, 81 bp, Mus musculus
tatacatcgctgagtgtgagcatagcccacggtgggggcctaagcccacagtgtgtgtttctacattcattgctgagtgtg

SEQ ID NO: 86372 - DNA, 85 bp, Mus musculus
gggagatcagaggagggcacagagagtgttcacgtttttagagctctggatgctagtgactgtctgtctgtctatctatctatcc

SEQ ID NO: 86373 - DNA, 88 bp, Mus musculus
ataggggccagtgtgatcgaggtgcactatatatatatgcctatgcaaaatatatatgcatatatatattgcaatacaatgtcagtgt

SEQ ID NO: 86374 - DNA, 68 bp, Mus musculus
cagtctgtctgactgagtcccttctgtccataagcatagctttacagaatggctcactcatgcctctg

SEQ ID NO: 86375 - DNA, 71 bp, Mus musculus
tatgtatgtatgtatgtatgtgtgtacataggtattatatatagtacacattgcattagaatatgtatata

SEQ ID NO: 86376 - DNA, 62 bp, Mus musculus
ccatctgtctgtctgtctgtctattggtgtgtgagacagtgacagacaacagattagcatgg

SEQ ID NO: 86377 - DNA, 74 bp, Mus musculus
ctggaggaaggagacagtagaggagcagggcattggtctgtggatgctgtgctgtcacagctcttgtctcacag

SEQ ID NO: 86378 - DNA, 268 bp, Mus musculus
gtgtgcatgtgcttgtgtgtgccttggcatgtgtgtgtttgtgtgtgtataccttggcatgtatgtgtgcatgtgcttgtgtgtgccttggcatgtgtgtgtttgtgtgtgtataccttggcatgtatgtgtgcatgtgcttgtgtgtgccttggcatgtgtgtgtttgtgtgtgtatatcttggcatgtatgtgtgcatgtgcttgtgtgtgccttggcatgtgtgtgtttgtgtgtgtataccttggcatgtatgtgtgcatgtgc

SEQ ID NO: 86379 - DNA, 99 bp, Mus musculus
tcatgggcccacctgctgtggctgtctggctgtctgagactcccacccaggtgctttctaactctagctcctcagctgagaagctgtgtgggaccatgg

SEQ ID NO: 86380 - DNA, 105 bp, Mus musculus
aaaatcaagttgagtacccacgatccttacagtaggtggagagaaagataacgtttttttctttatgaactttcaggatggtgggtttgtggctggcttcatttt

SEQ ID NO: 86381 - DNA, 69 bp, Mus musculus
ctctgcctctggcactctctgggtgatggtctgaggttcaagttgtttgaagaggaggctggaggggag

SEQ ID NO: 86382 - DNA, 132 bp, Mus musculus
atatatatacccatacaatatatatgtatatatgtacacacatatgtgtatatatatatatatatatatatatatatatatacacaccgtgtgtgtgtatgtgtgtgtatgtgtgtgtgtatgtgtgtgtac

SEQ ID NO: 86383 - DNA, 62 bp, Mus musculus
gtgtatgtatgtatatatgtatatgtgtgtgtaatgcacacatatatatacatatcacacac

SEQ ID NO: 86384 - DNA, 106 bp, Mus musculus
agagagttggctttagagagagatttggcaaagatgttttttttttctaactagatccgtgacattcatatttcttgccagactagactctctaccatcactcttt

SEQ ID NO: 86385 - DNA, 72 bp, Mus musculus
agaagcaaatcacacccagcttgcttggatgggatcccagagcagaaaggagctggagtgacagtgatgtct

SEQ ID NO: 86386 - DNA, 77 bp, Mus musculus
actgtgggcctcagtgtgactctgtgtaggacctatgtccacaaaagctgcctggggttgttgggaggctcctcagt

SEQ ID NO: 86387 - DNA, 114 bp, Mus musculus
actaaacactgagttttaattatgaactttgatttttggggtgtgcatctttttagctttagaaatcagtgaataatgaacaggtttttgtaatgagtagagtcagaggagggt

SEQ ID NO: 86388 - DNA, 121 bp, Mus musculus
atatatattatgtatgcagctttatatatgtgcatgtgtatacatgtatatttatacatcatatgtgcttaaatacatgtcttcacatacatgtttacatgtataatatatatgcatatat

SEQ ID NO: 86389 - DNA, 87 bp, Mus musculus
cagggagagagacagacacactgaggcagagagagaaggaatatcctggagtcccttggtgttgctgaggtctggaggtatcctctg

SEQ ID NO: 86390 - DNA, 110 bp, Mus musculus
taggaaaagaccttaaacttgtctatggtcagcatcctgtctttagccaggcctttggcaggcagtgaggacactcagaggtggatgctctggttcaaggtcacctcctg

SEQ ID NO: 86391 - DNA, 78 bp, Mus musculus
gaggggtcctgaacttcagtccaatggttgggtgtaagtatctgtgtctgtctcagtcagctgttggttgggcctctc

SEQ ID NO: 86392 - DNA, 85 bp, Mus musculus
gctgaggaggaaagcttctatttgacttacacttctacactgtggtccatcactgaagggagtcagggcaggaatccaacagggc

SEQ ID NO: 86393 - DNA, 120 bp, Mus musculus
gacacaaaggcaggaagccgaaaacaggaactgaagcagagagcacaaaggaactctgcctcctggcttgcttccttgctcctgttgtcacctttcttatacaacctaggaccgcctgcc

SEQ ID NO: 86394 - DNA, 69 bp, Mus musculus
cagagagagagagagagagagagagagagagagagagagagatcctctctgactccctgactcattttg

SEQ ID NO: 86395 - DNA, 111 bp, Mus musculus
gggagggtatgtgcttccatgtagctgctacctgcctgccttttctgaggtaacagtagacagggagcagccataaaatactaaacgttagcacagtattaatattgtccc

SEQ ID NO: 86396 - DNA, 107 bp, Mus musculus
cacagacgtgccaggcagcatctcagccaactgggctccagctctatctactctgtctctctcttttacctgtgaagcctgagtttctgaatctccaacactttgtg

SEQ ID NO: 86397 - DNA, 92 bp, Mus musculus
ggctaaatgggctggcaggcactctgtgtgcctcagaactaactagggtgttagaactaaggtcgctcctgttcctgcccctcatgtttacc

SEQ ID NO: 86398 - DNA, 90 bp, Mus musculus
aggatgtaggctaggctaacctctgactcacaaagatctgcttacttctgtcgctgcctctgactcagagagatctgcttgcctctgcct

SEQ ID NO: 86399 - DNA, 80 bp, Mus musculus
acatacatgtatatatgtatgtatgtgtatatatatacatatatatatatatatatatattacacacatatatgtataca

SEQ ID NO: 86400 - DNA, 69 bp, Mus musculus
agtataaggagagagagagagcaagtcaggtttgggacaccagcttgttacacagtctctctgtgtatt

SEQ ID NO: 86401 - DNA, 67 bp, Mus musculus
gtgggatatagagattttcttgttctggtaccaacctctatttagagctgatgtctttggggtccac

SEQ ID NO: 86402 - DNA, 93 bp, Mus musculus
ctggctctccgaggcctctggctctcagagtcacaccctgtttgggaactcacctcccagggttgctctagaccagtgtgcctatgtagccag

SEQ ID NO: 86403 - DNA, 116 bp, Mus musculus
gctatactgggagaacagttgtatggaattatgtgatatatttgtgttgcctacaaagtgagtccctgactccctggctctaaggtgcatccttccatccctgcccaagacatagc

SEQ ID NO: 86404 - DNA, 63 bp, Mus musculus
tcacctagagtatacaggacatacgttaccttgaggctggctccctgtgtgtgtgctgggcga

SEQ ID NO: 86405 - DNA, 140 bp, Mus musculus
gtgcccagaactatgagatcctggagctgtagaaccccaggatacaggatagccaggactgtcacaacacagggtgcaggtgctcagggctgttggagcatggggtgcagagcacctggagttgtttctatggttttgag

SEQ ID NO: 86406 - DNA, 72 bp, Mus musculus
gtgcatgcatgtttgtgtctgtgtgtctatgtgtgtgtgtgggctcgcccgcaggtacattcatgagtgtgc

SEQ ID NO: 86407 - DNA, 87 bp, Mus musculus
gggcggctcctcacatctcccccttttcttttatttaaaaggcaacaggccacccagtactgagagtggagatagaggtcaaatccc

SEQ ID NO: 86408 - DNA, 85 bp, Mus musculus; identical to SEQ ID NO: 57470

SEQ ID NO: 86409 - DNA, 63 bp, Mus musculus
ggcaggctctctgggtccctctcagtaattagctggagatggaagcccagcaaggccaagacc

SEQ ID NO: 86410 - DNA, 89 bp, Mus musculus
tttttagcgtatgtatgtatgtatgtatgtatgtatgtatgtatttacttattgcttatctgcataagatgtacatgctatgttcaaag

SEQ ID NO: 86411 - DNA, 75 bp, Mus musculus
tgtgtgtgtgtgtgtgtgtgtgtatgagtgtgtgtgagagggagacagagacagacagacaaacagacagacaga

SEQ ID NO: 86412 - DNA, 76 bp, Mus musculus
agagtttctcaagacacactgagataggtgctcagtgctctcagctctctgtctgtctgtttgtctgtctgtctct

SEQ ID NO: 86413 - DNA, 78 bp, Mus musculus
gtgcacttgtgcatgtgtgtgtgtgtgtgcatgtgtatgtgtgcacttgtacatgcgtgtgcatgtgtgtgagtgtgt

SEQ ID NO: 86414 - DNA, 59 bp, Mus musculus
tgctttatgtatgtctgtgtaccacatgtgtgcagtgctctcagatatcagagagggca

SEQ ID NO: 86415 - DNA, 91 bp, Mus musculus
cctgatctgctgcaaactcatctgtgagtggagagtgctgtgtgtcactcacttttacatcactatggtgaaatgaaagaatcaatttagg

SEQ ID NO: 86416 - DNA, 101 bp, Mus musculus
tagatgtgggagggcccagccaattgagggtgctatcatctctggctggtggtcctaggttctataagaaagcaggctgagcaagccaggaggaacaaacc

SEQ ID NO: 86417 - DNA, 80 bp, Mus musculus
cacctgcatgaatgtctgtgttacactgtctgatatcctcgagctagagttacagacagttgtaaactgccatgtgggtg

SEQ ID NO: 86418 - DNA, 87 bp, Mus musculus
atggattatttgcttatcggaaggttttgcatatatatttattactattcgatgtgcaatatctaagtcttgtaagtctatatacat

SEQ ID NO: 86419 - DNA, 113 bp, Mus musculus
ggtgaccagatagaccggatagacacctggacagatagaagacgtcagctgtaccacagacacacactctgagattctgacatccatcaatatttagtctgtagtgagttgct

SEQ ID NO: 86420 - DNA, 85 bp, Mus musculus; identical to SEQ ID NO: 57470

SEQ ID NO: 86421 - DNA, 74 bp, Mus musculus
gatggctcctgtgctgactgagcagagaggctgaacttgcaatgctttgctgaatcagttccccacagcctgtc

SEQ ID NO: 86422 - DNA, 76 bp, Mus musculus
ggggggatgattcagaggttgagagcaggttcaacgcccagcacagaagtttacaatcatctgtcattccagttcc

SEQ ID NO: 86423 - DNA, 59 bp, Mus musculus; identical to SEQ ID NO: 86414

SEQ ID NO: 86424 - DNA, 82 bp, Mus musculus
agctacccacactgtctcactggcactttcctgaggttctggtggggaattcaggggttctgaggctaacggtgggattggg

SEQ ID NO: 86425 - DNA, 85 bp, Mus musculus
tagcttgagcactgaaggtttctctgtggaagctagatggtcagtcagtcccactgagagtattcacagctgcctgcctgagctg

SEQ ID NO: 86426 - DNA, 116 bp, Mus musculus
gccaatcaacatatgtttctgtaattatgtcccttagaataggactttgatctctcagaacagagagagccctgactaatacagagggattttagacagtatgtagaatgctgagc

SEQ ID NO: 86427 - DNA, 71 bp, Mus musculus
agacacactgagataggtgctcagtactctcagctctctgtctgtctgtctacctctttctctctctgtct

SEQ ID NO: 86428 - DNA, 83 bp, Mus musculus
tgcctaggcttacctcctgacgtccgtactcgacactcaagtgaagtgtcagtggactgtctcactgtttctctgtctgcgcg

SEQ ID NO: 86429 - DNA, 85 bp, Mus musculus; identical to SEQ ID NO: 57470

SEQ ID NO: 86430 - DNA, 68 bp, Mus musculus
tatatatctataaatatatgtgtgtgtgtatatacatatatacatatatatatatatatatatatata

SEQ ID NO: 86431 - DNA, 112 bp, Mus musculus
gactctatcatagccagatggtagtgaggctctcctttaatcccagtactcatgaggcagtggtagatggatctgtgtgagttccaagccagcctggtcttcagagggagtt

SEQ ID NO: 86432 - DNA, 119 bp, Mus musculus
tggtttgtaacagcacaggtaatcccatggctatgtcacatgtctattcagaatttttttttaagtctagattattttatgtgcatgaatgttttgcctgcatgtatatgtgtgtacca

SEQ ID NO: 86433 - DNA, 66 bp, Mus musculus
gtctgtctgtctgtctgtgcggcctgtggctcaatggaacctcacagacttcttcacacaggcaga

SEQ ID NO: 86434 - DNA, 163 bp, Mus musculus
gcaaccaggttcctagactatgttaaagctcaaattaatgatctcattgattgagttccagacagagcagactctggaggcaatgaaggttttttttttttttttttttttttcctcagtgaaacgcttctagcctttagaccatgagcgtgaggaatggcga

SEQ ID NO: 86435 - DNA, 69 bp, Mus musculus
tatatatggtctctacacacatcttgatctgtgccttctaaggcagaggtgtgtgtgtgtctgtgtatg

SEQ ID NO: 86436 - DNA, 99 bp, Mus musculus
agacacacatttggggctggagagacggctcagcagttaagagcactgactgctcttccagaggtcctgagttcaattcctggcaaccgcatggtgcct

SEQ ID NO: 86437 - DNA, 79 bp, Mus musculus
gcagtttcttacaggcaggtgagcactctccactgtattctagcacagtacccagaactctccctctctgtctgtctgt

SEQ ID NO: 86438 - DNA, 91 bp, Mus musculus
gtacataaagctgacagaagacagacaggacggcatctccgttcagcacgggcgtcccttctgtgtgtgattaagtcagcagcaaaagtac

SEQ ID NO: 86439 - DNA, 111 bp, Mus musculus
actatgagtttccttagtgtgggatgtgaatactcacgtgactgaagagtctcagggaagaggcagatagtgcagggagtggacgatgaagagcctaggagctcctgtagt

SEQ ID NO: 86440 - DNA, 107 bp, Mus musculus
gaaaatgttggttcttggtgtttggtaaaattgctttgttaaattattttctaaattgttcaacttttaacaaatgacatttgatactaacactggaaagcaatttc

SEQ ID NO: 86441 - DNA, 117 bp, Mus musculus
gtgagtgtctggtttttttctaagtaggttttcctctagcttttcttttgctgatctggagagagagacacacacagacagagaggcggaactgactaaggaccagacgtctaaggc

SEQ ID NO: 86442 - DNA, 105 bp, Mus musculus
gctacaagctaccttttagtgctaagaacgagaggtgtgttactcactgacacagacgctgccctatgtgacgtgcctttatgtgctagtattgagcttctaagc

SEQ ID NO: 86443 - DNA, 71 bp, Mus musculus
atggttgtgcaatactgaggcagcatgccctggtccagcccttctatctgtctcagtttctcacacacgat

SEQ ID NO: 86444 - DNA, 101 bp, Mus musculus
cagtttttcctgtgtgaaaatcagactgagctatgcattatagacacagacacacactgacatgcagcctcagaaataatggtgactcggggatccatctg

SEQ ID NO: 86445 - DNA, 82 bp, Mus musculus
gtccctagcatgagtgtggagggttagaggacagatcctgggagcaggttctgtcccttcactctgtcaatcagtcggggcc

SEQ ID NO: 86446 - DNA, 67 bp, Mus musculus
aggatgcagagagaagggactgtcctcagactctccaagggggctgtcacttttctatgtgcacact

SEQ ID NO: 86447 - DNA, 75 bp, Mus musculus
cagctgagtctgactcactctcgttcctggaaccgtctgaaggcgggagaggatgctgtgggtaggctccaactg

SEQ ID NO: 86448 - DNA, 105 bp, Mus musculus
cagtgtgacgggggtggggggtggtggggggtgggggggtggggggggcgtttctgtctctgtctgcctgtctttatcctcgtgggctttgctgatgtcagggtg

SEQ ID NO: 86449 - DNA, 63 bp, Mus musculus
gatagtctgagttcagtcactctgtctctatggaagaaggacagactgactccaccggttgtc

SEQ ID NO: 86450 - DNA, 84 bp, Mus musculus
tggcagacttgagctagacatttcttcttgattcctactcacattgtagaagcttctatcagaacactggctcacttcagacca

SEQ ID NO: 86451 - DNA, 73 bp, Mus musculus
tgtggtaatgagagctatcttctctgagtctccaggcacatgattctggagaaggacctgggtctcagctaga

SEQ ID NO: 86452 - DNA, 83 bp, Mus musculus
agcagggcagcatgtcagaacagagaggcctgacctctgggtgaaggcagggacatctgtgtagggataagaagggatgctct

SEQ ID NO: 86453 - DNA, 74 bp, Mus musculus
gcaattggtgatcacttggagtattgtatggcagaggtctgctacctactctgtctgactgactcactgtgtgt

SEQ ID NO: 86454 - DNA, 71 bp, Mus musculus
gtctgactccctttgctggcttctgtgggtatccacatacttgtgacagacagacagtcagttggatagac

SEQ ID NO: 86455 - DNA, 96 bp, Mus musculus
gtgcggctgcatagatgcctggatgggtggatgaatgtatgcatagatgtatgaatgtgtggatgtgctcattaatgtatggatgaccagatgtat

SEQ ID NO: 86456 - DNA, 115 bp, Mus musculus
cagcaaccgaaagcatactagtccagatgctctgtggccgctgtctctctcagtgcctgtgagaggtaagggcatgggaaaagggatgagtggttaaggagttgaagggagaagt

SEQ ID NO: 86457 - DNA, 74 bp, Mus musculus
tgtgcatcctagtgaagttctatactgtttgaatagtgattttgaagccatggaacttcacaatggattgtata

SEQ ID NO: 86458 - DNA, 78 bp, Mus musculus
agagtctgtctttcactcattgtgtattcttggcacttggggaaacatctatgatacataagaaaagctgacagctct

SEQ ID NO: 86459 - DNA, 81 bp, Mus musculus
tgtctgtctgtatgtctgtctgtctgtatgtatgtaagtacattgtaggtaccttcagaggatggaagatggtatcagata

SEQ ID NO: 86460 - DNA, 79 bp, Mus musculus
gctccatgtttattgatgtcagtctgtcactctcttttggaaccgagttccatgtcagttagaaaagtacacttggagt

SEQ ID NO: 86461 - DNA, 89 bp, Mus musculus
ggtgtgtatgtgtaaatgtgtatatatgtgtgaacatatatttgtatatgtgtgtgtagatgtatgtgtgtgcatatatagtatgtgtc

SEQ ID NO: 86462 - DNA, 149 bp, Mus musculus
gtgcatgtgcacacatgcatgtgtgtgcgcatgtgtttgtatacatgtatgtatgtgtgcatgtgtttgtgtacatgcatgtgtgtgtgcatgcatgtttgtgcacgtgccagtgtgtgcatgtgcatatgcatacacacatgtgtata

SEQ ID NO: 86463 - DNA, 76 bp, Mus musculus
atattatttcaacaaatgtgttttgtaaagaagtaggaagtaagtcttctgtctttgcacagatacgtgatagtat

SEQ ID NO: 86464 - DNA, 131 bp, Mus musculus
gtatgtatgtatatgtgtctgtgtatatatatatatatatatatatatatatatatatatatatatatatatgtatgtatgtctctgtgtgtattatatgtatgtgtctgtgtgtatatatgtatatgtgt

SEQ ID NO: 86465 - DNA, 80 bp, Mus musculus
ttttgtctaaatactgtgtagtctcagagtagggattttgatattctctcgtctctgaacaaaggattgtttagatggaa

SEQ ID NO: 86466 - DNA, 92 bp, Mus musculus
gcacagagacagaataagggctgggtctctgtccctgtcacggatgacaggactcacacccaagaccccataatattgtacatcctctctgc

SEQ ID NO: 86467 - DNA, 76 bp, Mus musculus
cactgaagcaaggtggctatgcccttcaatgccccagtgaggtggctaagagggattcagacactttctctcagtg

SEQ ID NO: 86468 - DNA, 112 bp, Mus musculus
tatacttacaacaatatatatttgaatatatatagttgagggatatatatatatatccctatatatatatatatacatatatatatacatatatgttgtttaggaaggtgtg

SEQ ID NO: 86469 - DNA, 61 bp, Mus musculus
agagacagacagagagacaaagagagacagagactgtctctctgagtctgtgtctgtctct

SEQ ID NO: 86470 - DNA, 68 bp, Mus musculus
ggagagtcctagaatccagaagaagaagctcacgcaagcccagttctgtctctgtctctccgactccc

SEQ ID NO: 86471 - DNA, 91 bp, Mus musculus
cacttataacaagtgaaccaagacaatgagaggggacacgctgcaccactaagattgttttctgaaattgttcatgttacacagtttggtg

SEQ ID NO: 86472 - DNA, 146 bp, Mus musculus
acatacatacatacatatatacacatataagtatatatgtgtatacatataagtatatgtatgtatgcatgtatgtatgcatgtgtgtatatatatgtatatacatgcatatatacatatatacacatatatatacatatatatat

SEQ ID NO: 86473 - DNA, 86 bp, Mus musculus
tatgcatgtatgtatgtatacaagcatgtctctctctcactctctgtgtgggtgtgtgtgtaagtatgtgtaagcatgagtgcata

SEQ ID NO: 86474 - DNA, 110 bp, Mus musculus
gtacatatacatatatatgtgtgtatatacatgtatatatgtgtacatatatatacatatatgtgtgtatacatatatgtatgtatatatgtatgtatgtgtatatatgt

SEQ ID NO: 86475 - DNA, 110 bp, Mus musculus
tggatatgtatggatgtgaaatgtatatgtatgtgtgcgtgtgtgtgcatgtgcatgtgggtgtgtgcatgtgcatatgtgtgtgtgttttacaaacacaaaaataggca

SEQ ID NO: 86476 - DNA, 83 bp, Mus musculus
acacacacacacacacacacacacgtagatatgtgaacaaatgtttgtacatacatgtatggtgtgtgtgtgtctctctctgt

SEQ ID NO: 86477 - DNA, 116 bp, Mus musculus
tgactttacactcaagtattatagagccaagaagacctattttcagtagtgaacaggctcagacccactgtgtctatgttctgacttcatgaggtattggagcatttgaaaagcca

SEQ ID NO: 86478 - DNA, 141 bp, Mus musculus
gtatgtgtgtgcacatgtgtgtgtgcctgtgcatgagtgtgctcgtataccctcatgtgtctgattgtgcatgtgtatgtggagaccaaagattgatatcaggtgtctttctccattgctcacctccattaattttgagac

SEQ ID NO: 86479 - DNA, 99 bp, Mus musculus
ctgggtctatagtattggtattttttcaatgtatatatgtgtgttcctacttgtctgtatgtatgcacatcccatgcacgaaatgcccacaaagtccag

SEQ ID NO: 86480 - DNA, 83 bp, Mus musculus
ttggagcagagactgaccactgttgggacatcagaggacagagcaggctgatacccgtgaggtgagaagcatgtctccttcag

SEQ ID NO: 86481 - DNA, 62 bp, Mus musculus
gacttttacagtgcacagtggagttgaggtctcctgacagagaccacacagcctggaaagtc

SEQ ID NO: 86482 - DNA, 97 bp, Mus musculus
ggaataacatgtttgatgtgtataagagccatggttcctaagtgtgtgacagatcacagggatcaaagagcttttctactcattcacatttactttc

SEQ ID NO: 86483 - DNA, 76 bp, Mus musculus
ttgcacagtcctgagcaagccttaactcagtggaataaaatttaccttcactgacagcttgttgatttctgtgtga

SEQ ID NO: 86484 - DNA, 73 bp, Mus musculus
cagagatggagtgagctaggctctgtcatacacattcatgcggcacagaccctcgctgtcacactgactgctg

SEQ ID NO: 86485 - DNA, 66 bp, Mus musculus
atgtgtgtgtatgagtgtctctctgtgtatagctcaaaagacagtctcagacactgtcactcacat

SEQ ID NO: 86486 - DNA, 106 bp, Mus musculus
tatgttgttactgaagatcagccttagtttgtggtgatctgataggatgcatgggattatttcaatatttttgtacatgttgaggcctgtttagtgacaaataata

SEQ ID NO: 86487 - DNA, 117 bp, Mus musculus
aggtcagatctctacaacttatgcaaaaatgtttcaattaccacaaagttttatgtctggaagactagagttttattgcttcctggaacacatttttgaatgttctgatcttggcct

SEQ ID NO: 86488 - DNA, 101 bp, Mus musculus
gctggaagagtttgtggattgatcagtttcctttcttcctcagaactgttaactccacctctggctctcttcagttccttggtagatgacttcgttctaca

SEQ ID NO: 86489 - DNA, 61 bp, Mus musculus
gtgcatatgtgtgcatgtgaatctttgtgtatagaaagtatacatgtatatgcgtgtgcac

SEQ ID NO: 86490 - DNA, 86 bp, Mus musculus
catgggcagagtcataggagtaggcaagagctgcatagtagttgctttcctccatatgtgtctatgtgtctgtctttctgtccatg

SEQ ID NO: 86491 - DNA, 120 bp, Mus musculus
atagactgtagcaatgcatgatagtagctaaggaaagacatcaacacttcacagaacagagtgtggatgccagcacatcgcctcctcctgtcagaagcatgtaccatcctacagctttat

SEQ ID NO: 86492 - DNA, 61 bp, Mus musculus
tgtctgtctgtctgtctcactctccacgcgtgcgtgttggggtgggggagaaagagagaga

SEQ ID NO: 86493 - DNA, 73 bp, Mus musculus
tatgtatatgtttatgtgtgtatgcatctatgcttattatgagtgtgcctgtttatatatatgtatgtacatg

SEQ ID NO: 86494 - DNA, 62 bp, Mus musculus
tatgtatatgtatgtatgtatgtatgtatgtatgtatgtatgtatacttgtgcatgtgtgtg

SEQ ID NO: 86495 - DNA, 72 bp, Mus musculus
ggctcctgcgagcttctgtgtgtctgtctgagttagcctggacagcaccacccatgagtgtgcggtggggcc

SEQ ID NO: 86496 - DNA, 62 bp, Mus musculus
ttcagacactgtccctctctgcctgtgaccttgggccaggtactgactgtactgtgtctgaa

SEQ ID NO: 86497 - DNA, 115 bp, Mus musculus
tgtggcacagctttcttgctctgtggttttaatgagagtcagacacacactctattttgatgagttattatccatggcttccatacttccaaaagaacttgaagctgtttccagg

SEQ ID NO: 86498 - DNA, 74 bp, Mus musculus
agaatgccacggtggatgcagggctgctcagacttggtgtggtcttccctttgtcatccttggctgatagttct

SEQ ID NO: 86499 - DNA, 126 bp, Mus musculus
cttggggagaaaatgtcttatttggctttctagacttctacattgtagtccatcactgaaggaagtcaggacaggagatcaaacagggctggaacctgacgagagttgatgcacagatgatagagg

SEQ ID NO: 86500 - DNA, 105 bp, Mus musculus
ggtaaatacactgtttgaaacataaaaatcggggctggagagatggctcagtggttaagagcactgactgctcttccaaaggttctgagttcaaatgccagcaac

SEQ ID NO: 86501 - DNA, 116 bp, Mus musculus
tgtccccaccagaagtcagaagtgggtgtcagataccctggactggaattatgttacagatgattgtcagctgtcatatggaagttgggatttgaacttaacactgaggtcagaca

SEQ ID NO: 86502 - DNA, 77 bp, Mus musculus
gcctccagtctcagagtctcccagtctgtggtgtttcttttgacaacctgagactcctgactctgcagaggagctgc

SEQ ID NO: 86503 - DNA, 79 bp, Mus musculus
gcagagaattgaagctgggagctagatctactaacgtgtggtgtatggtttcctcactcagctcttggtgactttctgt

SEQ ID NO: 86504 - DNA, 100 bp, Mus musculus
cagtgagcacacagagcacagtgagcacacggagcacagtgagcatagtgagcacagtgagtcgattgagctcagtgtgcctaggagtagagttcacctg

SEQ ID NO: 86505 - DNA, 85 bp, Mus musculus
agggtaatataaatggtggaatcaaacatcgggggatacatgattagtcctcccttgactctgtgactgtttctatattgcacct

SEQ ID NO: 86506 - DNA, 105 bp, Mus musculus
gaccaatcttaacttatggacatacagaataggccagacttgactagtactcactctctcagcctctggccagcttttgtggagaacccaaggattgatatagtc

SEQ ID NO: 86507 - DNA, 64 bp, Mus musculus
ctgaaagtaaagatgctacactgtccctgccacttgctggggcacagtgatgttcggctcacag

SEQ ID NO: 86508 - DNA, 78 bp, Mus musculus
ctgctgcccacagttctgtctcattctcctgaagggaaactctaacccaggacacatgtgctgactgtgaggcagggg

SEQ ID NO: 86509 - DNA, 95 bp, Mus musculus
gcatctctcagccaatgtgccacgctcattctcactgtttcataaccgacaccctgtaccctgagtgctgcccatggcttcctaatatacgatgc

SEQ ID NO: 86510 - DNA, 108 bp, Mus musculus
gctaatgaaccaattatttttaattgtaggatgcttgattgtttcagaaatataattgattgtaatcaagaatcaattaaatgttgatagtaattatgtttatcaagc

SEQ ID NO: 86511 - DNA, 72 bp, Mus musculus
tcctcattgtggtggtcagtgacttacactgggggacatcctcactgtgatgagagactgcacactagagga

SEQ ID NO: 86512 - DNA, 90 bp, Mus musculus
ggaaatgttatcacaagtcagtgaccactcaattgtcactaaataagtcagatatcatgagtatgtggctgacggtgtgcaaggaatacc

SEQ ID NO: 86513 - DNA, 130 bp, Mus musculus
gtatatgtgcatgtgcatatgggtatatttatgtgtgtgcataaataggtatatgtgcatgtacatgtggttgaatatgtatgtatacacatgcactcacacacgcatgcacagatgcaagcatgcacac

SEQ ID NO: 86514 - DNA, 64 bp, Mus musculus
gatgagttacctcagggacggggctttgctgctctctgcactgtctctccctccttggcttgtc

SEQ ID NO: 86515 - DNA, 87 bp, Mus musculus
tattttatatgtgttttgcttgtatgtatgtatgtatgtatgtatgtatgtatgtatgtatgtatgcatgttgcccagaagagagtg

SEQ ID NO: 86516 - DNA, 93 bp, Mus musculus
cacatctggctgcctcacacactccctctctgatcttgtgctaagggttgacacctgccgagaaggacagggtggaagcaggtgtgtagaggt

SEQ ID NO: 86517 - DNA, 95 bp, Mus musculus
ggaacagagacatgtctgattctgtgcttagtgcccttaagctgtggctcacactggggttctcagaagaaacacaggacacttctccaagttcc

SEQ ID NO: 86518 - DNA, 88 bp, Mus musculus
ccccagatgacagaactgagtgggctctctgagtacattgtcctagtccaggtcgagggattggtgcccgctgagtcctcacaagggg

SEQ ID NO: 86519 - DNA, 67 bp, Mus musculus
catggggatgagacacacacatatatatgtgtgtgtatgtatatatatgtgtgtgtgtatgtgcatg

SEQ ID NO: 86520 - DNA, 90 bp, Mus musculus
gcatgtgtgtgactgaatgtttgttcatgtgcacatgcatgtgtatttgtatgtgtgcatgtgcatgcatatgtaaacacacacatgcat

SEQ ID NO: 86521 - DNA, 78 bp, Mus musculus
tctctgactcacacactcatgcctgcctttggatctctttgttctagctgggttgccgtgtctggcctcagtgggaga

SEQ ID NO: 86522 - DNA, 65 bp, Mus musculus
gtgcagtatgtatgtatgtatgtatgcccatatctgtgtttgtacatatgcacatgcatgtgtgt

SEQ ID NO: 86523 - DNA, 115 bp, Mus musculus
tatatacatatatatgcttgtatatatgtgcatatatgtacatatgtacttttcggtttggaatatatatatatatatatatacacatacatatgtatacatatatatgtttgta

SEQ ID NO: 86524 - DNA, 101 bp, Mus musculus
ggagtcaggctcagtagagcctcattttgacactagactgagaggtgtctatcatattccattcagactcctaagctaggctctgaccactgagcaactcc

SEQ ID NO: 86525 - DNA, 64 bp, Mus musculus
ctgctcactgctctctgactcagtgacctgctggggtacacgtgtgtgggggggggggaggcag

SEQ ID NO: 86526 - DNA, 131 bp, Mus musculus
tgcaaacatgccaaaggcttcacatggagactgcctactccagtgatggaagtctgtagacagtgagcccaggctaccagagcatccagatgcacttgcttctgtaagcagtgggtgcacatcacagcatc

SEQ ID NO: 86527 - DNA, 77 bp, Mus musculus
ctgcaggctgccatgcatgtgtgtaagggactcagatctgagtccctctctgtgtaaatgtgaatgtagcctgatag

SEQ ID NO: 86528 - DNA, 66 bp, Mus musculus
gtgtatgtgtgtgtgtgtatctgtgtgtatatctgtgtgtgtgcttgtgcatgtgcatgtatgtgt

SEQ ID NO: 86529 - DNA, 103 bp, Mus musculus
ctgtgttggggtattagaagcaggcagtaggttgtattgtgaaccatgtaaaacatagtggatggcagcaacaatgtactcagtgtgaagaagacccccggag

SEQ ID NO: 86530 - DNA, 86 bp, Mus musculus
cattcaagtgtcctctccttgaaatacattctgaaaaaaaatttttttttcatgagaactagatttggggaagggcacctagaatg

SEQ ID NO: 86531 - DNA, 71 bp, Mus musculus
gaagtaagtgtgtcactcagtgtgtgctcgcagaccctctgtggtaggaaaggtgagtagagatgccattc

SEQ ID NO: 86532 - DNA, 91 bp, Mus musculus
gcatactctatcacactctgacacacacattttgcactgggatgctcctagtgccccgtcaaagtgcatcagatttgacttggagtttagt

SEQ ID NO: 86533 - DNA, 85 bp, Mus musculus
ggcaagcctgtacagccagattctcttgtgggtaggcttgggcaagtgtcttgtgtctgtctgtgtgtctgtctgtgtgtctgtc

SEQ ID NO: 86534 - DNA, 127 bp, Mus musculus
catgtatatgtgtatatatgtatatgtgtatatgtatatatatgtatatgtgtatatgagtatatatgtatgtgtatatatatacatatatatatgcatgtatgaatatatgtgtgtatatatatat

SEQ ID NO: 86535 - DNA, 119 bp, Mus musculus
ggtgtcaccttagcaagatggcactgctaattatgaatctagaaacacttgattgactactttgagagatcacagtgaggtgacaggttctagggttggaagtgttagatgtggcctcc

SEQ ID NO: 86536 - DNA, 62 bp, Mus musculus
tgtatatacatacacatatacatgtatatatgtatatgtatgtatatgtgtgtctatgtata

SEQ ID NO: 86537 - DNA, 101 bp, Mus musculus
tatatttatatgtgtatatgcgtgtgtatgcatacatgtatatgcatatgtatatgtgtctatgtatatgtatgtatatgtatgtgtctatgtatatatgt

SEQ ID NO: 86538 - DNA, 77 bp, Mus musculus
tccctttgcttgtcacagacactcagtgctacaaattcagtcaagctgttagagaggaagctggagagagaaaggga

SEQ ID NO: 86539 - DNA, 117 bp, Mus musculus
accccacctttgcccagttgcttggtattagtgaagagagtgtgtgaagagtgtctggttgccccatatgctgtgtgctcacttctgatggatcctgggatgagctctaagtggagt

SEQ ID NO: 86540 - DNA, 135 bp, Mus musculus
cactgaacctagacctggtcatgtgggctaaactggctggccagtgaattgtaaaggtctgcctggctctgtctctcggtgctggggttctaggtaggtgtgccatgcctggttttccacataggtgctgttgat

SEQ ID NO: 86541 - DNA, 84 bp, Mus musculus
ggcccgtgtgacacagacagactctgggaatcggcctttacacttgggcctcatcctaggaggatgagactctgtacatatacc

SEQ ID NO: 86542 - DNA, 76 bp, Mus musculus
atagaaagaaaatattaggtggataagacagaggtataaacaaaccctctgtctgtctgtctgtctgtctgtctgt

SEQ ID NO: 86543 - DNA, 67 bp, Mus musculus
ctgtcactctgagctggttctggcctccccgtgtggcagccagaactcagtgagctaatgtgcacag

SEQ ID NO: 86544 - DNA, 82 bp, Mus musculus
atcagagttctctgactttaagattatatatttcagtatactgatagtcatttttttttctatgttagaggacatatctgat

SEQ ID NO: 86545 - DNA, 91 bp, Mus musculus
gaggataaccaagatggagttcttcaaagggtaagcacactcttgctgagcaagtctcatgtctgcctgtctgactggctccatctgcctc

SEQ ID NO: 86546 - DNA, 91 bp, Mus musculus
gtacactactatatccactgtgtaagaggaagggtggcccttcacctcactgcctgcctctctgtccatgatggtgggttttgtgtgtcac

SEQ ID NO: 86547 - DNA, 106 bp, Mus musculus
tgttattatttccatttcatatatatatgaatatctatatgtctgtctgtatctcttatatataatatattatatattatatatatatgagagagagattctatca

SEQ ID NO: 86548 - DNA, 81 bp, Mus musculus
caccatgctgaggtccctccctccctcaggtccaacacccttgtaccccaaaagggagatgtgagtgtctcagtctgtgtg

SEQ ID NO: 86549 - DNA, 90 bp, Mus musculus
tgaaagtatatcaattctctttgtatctctctgtaagtctttgaagtcaaagattaaataacatgggaggggcaatgaagatactttaca

SEQ ID NO: 86550 - DNA, 79 bp, Mus musculus
gtacatactatataccaatgtgtctgtgtgtgtgcacatgcatgcgtgcgcacacagacatatatgtatatttatatac

SEQ ID NO: 86551 - DNA, 86 bp, Mus musculus
tcatctcaagggtgtcttaggaggtggtgctgagcacatccctcagggccaggcacccattgcctctctgtgtctcacttgaatga

SEQ ID NO: 86552 - DNA, 85 bp, Mus musculus
ttcctttcaccttgtgaacagcctctgttgccagtaacagctactccctgtggttccaggggctctgtcataaaagcaactggaa

SEQ ID NO: 86553 - DNA, 58 bp, Mus musculus
gtatcaggatggctgagaggttggctggcttcaggctctcagtctctctgtttcttac

SEQ ID NO: 86554 - DNA, 84 bp, Mus musculus
gtctctagggcccttactatccaactgatggacacagccatttgctgttattattggagctgagaggctctctctctctgagac

SEQ ID NO: 86555 - DNA, 85 bp, Mus musculus; identical to SEQ ID NO: 57439

SEQ ID NO: 86556 - DNA, 110 bp, Mus musculus
ttgaagatcagccttagtccatggtggtctgataggatgcatgggacaatttcaatatttttgtatctgttgaggcctgttatgtgaccaattctatggtcagttttgga

SEQ ID NO: 86557 - DNA, 76 bp, Mus musculus
aggaaaaggcttgtacagagagactttcttttttttttaaagagaagccagataaatctctctatagacttttctt

SEQ ID NO: 86558 - DNA, 69 bp, Mus musculus
cgttggaagagcagtcagtgctcggttaagctgagccatctcaccagctctatataattatatctaatg

SEQ ID NO: 86559 - DNA, 59 bp, Mus musculus
tcgggctggagagatgggtcagcagttaagagcactgactgctcttccagaggtcctga

SEQ ID NO: 86560 - DNA, 113 bp, Mus musculus
tcctggcatactatgacctggctggtgttcctgccctctggtgaggacagtcattttctctctttcattgccagctgccaacaggaacaccaggcacgaggcaagagcaaggg

SEQ ID NO: 86561 - DNA, 93 bp, Mus musculus
ggctatatcataccctcccccaaaagcaaaggtgacatatgttaatgacacaattccacagtagtcattttgttttactaggtccctatagcc

SEQ ID NO: 86562 - DNA, 92 bp, Mus musculus
gtatgtgtgtagagacgtacgtgcatgtgtgtgtgtgtgtctgtatatgtgggtgtgcgtgtgcacatgcgcgtgcgtgtgtgtgcgtgtgc

SEQ ID NO: 86563 - DNA, 84 bp, Mus musculus
ctagagacatgaaggacatcaagcagcctgttccattgctctctacctttttgaccttctgacaggctctttcactgactctgg

SEQ ID NO: 86564 - DNA, 70 bp, Mus musculus
cagagacaggtggatctctgtaagttcaaggccagcctgctctctgtctgtctgtccatctgtctgtctg

SEQ ID NO: 86565 - DNA, 70 bp, Mus musculus
acttaaaattgtgtgtatacacatctgtgtgtgcatgcacacacaacattgtgtgcatgtgagttctggt

SEQ ID NO: 86566 - DNA, 71 bp, Mus musculus
gcatctgacataaaacaatgttatttcgatatatatatatatttcaggtagattgttttactgttacatgc

SEQ ID NO: 86567 - DNA, 56 bp, Mus musculus
acatcagagtgagaggatgaggcaggaggattgtgatctctctctctctcagatgt

SEQ ID NO: 86568 - DNA, 63 bp, Mus musculus
gtatgtatgtatgtatgtatgtatgtatgtataatataaacatatatacatatatcactttac

SEQ ID NO: 86569 - DNA, 103 bp, Mus musculus
gatgctgtctcaaaagactaaaactagagcccaaaataaaacatttattttgatataaatgtcactggctgttttgtttgtttaatttttttaagacagtgtc

SEQ ID NO: 86570 - DNA, 59 bp, Mus musculus
gtccttggacatacagataattactcctgtcagcactgagtccctgtgtgtctgagagc

SEQ ID NO: 86571 - DNA, 109 bp, Mus musculus
tatggaaaagttcctgtatgaaagattatcgcctcaaatgactgtgagctctgtgatgacacagacagatttcaaaggctaaatctttcagataaatttttaatctata

SEQ ID NO: 86572 - DNA, 120 bp, Mus musculus
atctctggggctgccctgctgtgtccagaagtatctaaaagtcaggagtcactcactgcctctggcttttatacaattcctgctttttcttctgcagtggtatcagaaccttgtggagat

SEQ ID NO: 86573 - DNA, 116 bp, Mus musculus
accccccctgtggatctggaaataatttgaggctaaaggaaaacctgtgtttgtttttgtatacatgggtctgacctggacggcttgtaaatggttcccttcccacacttctaggt

SEQ ID NO: 86574 - DNA, 69 bp, Mus musculus
ccagcccccagacagactcactgtgtgagcactttgtggcttggctcctatggtgagcctgggtgctgg

SEQ ID NO: 86575 - DNA, 96 bp, Mus musculus
acaggggaatcttgttgcacatactgattttgctggtattaagagtagtccttttcttgttggcagtctcatcagcttggccacaggctctgctgt

SEQ ID NO: 86576 - DNA, 73 bp, Mus musculus
gtccaatcaggaaagaggactgagggcatttgctggactcagtaaccacacagttctcagtctctgtgtgttc

SEQ ID NO: 86577 - DNA, 73 bp, Mus musculus; identical to SEQ ID NO: 86576

SEQ ID NO: 86578 - DNA, 83 bp, Mus musculus
tatgggatggatccccaggtggggcagtctctagatggtctttccttcagtttctgctccacactttgtctctgtatctcata

SEQ ID NO: 86579 - DNA, 136 bp, Mus musculus
gttcattatatctatgtatgtatataatgtatacacatgtgtatgtataatatattacaaaatatatgtgtgtacattacatgtgtatatatgtatatatgcatatatgtatatatacggtgtacatatatacatt

SEQ ID NO: 86580 - DNA, 74 bp, Mus musculus
acacacacagtgacacaatacagctttcacagtgagatgttttctatgctttgtgtgtgtgtgtgtgtgtgtgt

SEQ ID NO: 86581 - DNA, 102 bp, Mus musculus
gcttgaacaggtacataattgtgtctggcaaagaaaccattctgggaaaaattcacaagtctcacagtggctctcagtgttagacaatatggctgaaaaggc

SEQ ID NO: 86582 - DNA, 122 bp, Mus musculus
tatgtgtgtatatatgtgtatatgtatatatgcatgtgtgtatatatatataggcatatgtatatatatatatatatagacatatgtgtatatatgtatataggcatatatatttatacaca

SEQ ID NO: 86583 - DNA, 70 bp, Mus musculus
ctctctctgtctgtctgagattggtgttcttgtggtttgtgaggcaatttctggactctgactggaaggg

SEQ ID NO: 86584 - DNA, 78 bp, Mus musculus
tctcaagtacactgtgtgtgtctgtgaaagtgtcttagtaaaggctgaggtagagtcaccaagtgggacagcttggga

SEQ ID NO: 86585 - DNA, 74 bp, Mus musculus
agagaggtggtgcagccatttcccacttcgcccggtgtgtctgtgtctgtgtgaatgacagccttcccttctct

SEQ ID NO: 86586 - DNA, 77 bp, Mus musculus
ggaagaagagatacactgcagagggagccagctcttcacacccatctcctctatcagcatcagcatctccatcttcc

SEQ ID NO: 86587 - DNA, 71 bp, Mus musculus
ggagctcagtcactgtgagtgtggctgttgggtctcttaacgttcactcagctggttgacttggggtctcc

SEQ ID NO: 86588 - DNA, 117 bp, Mus musculus
gccaggtggcttcctgtgcagcctctcccatgagcaaggtgtgcctgtgtcagctgctcttctgtttctgctgtcatggcacaggtgctcaacgagatcacaaagcactaggcacct

SEQ ID NO: 86589 - DNA, 69 bp, Mus musculus
tgtgtgtgagagagagtggcccccggcgtcctccatgcttctctctctctctctaaataaatacacaca

SEQ ID NO: 86590 - DNA, 123 bp, Mus musculus
agcctgtgcaccagccgtccctctgaagtagctcagcccttctgctctccagcccctgccagtctgcctcactgtctagggctgaagctgaggcttgcaacctccctggtacccactgctcac

SEQ ID NO: 86591 - DNA, 74 bp, Mus musculus
atgtgcatgtgtgtgtatatgtatgtgtgcacatatgtatgtgcatatatatgtatgtatatacatatgtatat

SEQ ID NO: 86592 - DNA, 82 bp, Mus musculus
gctggattatatgtatgtatgtacgtatgtatgtatgtatgtatgtatgtgtatatacatatgtgtgtgtgcgtaaaaaagc

SEQ ID NO: 86593 - DNA, 91 bp, Mus musculus
gaagttctgtgtttgccatcggggtcagaggtagttggatgtagacagctctctgccttattggatgcactccacatagcttctgccatga

SEQ ID NO: 86594 - DNA, 92 bp, Mus musculus
gatgtgctttcagtcaccgctgatcgccaaaccaacttcatatttatatttacaacttcagaggtgagcccggctgtttcaggaagtggatc

SEQ ID NO: 86595 - DNA, 67 bp, Mus musculus
gcacacatgagtgtgtggtcagaggactacttttggagtcaattctgtcattccaccctcttgatgc

SEQ ID NO: 86596 - DNA, 74 bp, Mus musculus
gaaaataatatatatatacacatatgtatatgtatatatatgtatgaatgtatgtgtctatatatatttttttc

SEQ ID NO: 86597 - DNA, 90 bp, Mus musculus
agcaaattttatcttctgaacttaaagagatataaataacatatatggagtaggtaaattatttttttaagtacagtatttgaagttgct

SEQ ID NO: 86598 - DNA, 68 bp, Mus musculus
gcatatatatatatatatatatatatatatatatatatatatgtatatgtatatgtatatatatatac

SEQ ID NO: 86599 - DNA, 93 bp, Mus musculus
tctatggtgatctgataggatgcatgggacaatttcaatatttttgtatctattgaggcctgttttgtgatcaaatatatggtcacttttgga

SEQ ID NO: 86600 - DNA, 85 bp, Mus musculus; identical to SEQ ID NO: 57470

SEQ ID NO: 86601 - DNA, 106 bp, Mus musculus
atgaacattggcaagtaaagctgtttgggctaaaggttatatagactgtgtgacacactgtgactgcagccttcatggcaagatgtgttttgttgttggtgttggt

SEQ ID NO: 86602 - DNA, 106 bp, Mus musculus
cttactgcttttaatattctgtctttatttagtgcatttgttgttctgattattatgtgtcgggaggaatttcttttctggaacagtctatttggagttctgtagg

SEQ ID NO: 86603 - DNA, 85 bp, Mus musculus; identical to SEQ ID NO: 57470

SEQ ID NO: 86604 - DNA, 72 bp, Mus musculus
gcaccaatttgtttcattttgaatatgctcgcacggacagggctgacttcagagtgtgtgcacaatgtgggc

SEQ ID NO: 86605 - DNA, 116 bp, Mus musculus
atgaaaaactccaacctcatcacttctggattgcaggggaatatttgctaggtttttatgttctagagttatttgtgttaactgcatccagggggaggaaattctgggtttgccat

SEQ ID NO: 86606 - DNA, 157 bp, Mus musculus
gtatgtgtgtgtgtgtgtgtgtgtatgtgtatatatatatatatatatatatatatgtgtgtgtgtgtgtgtgtgtgtgtgtgtgtgtgtatgcatgtatgtacggatatgtctgtgtatgtgtgatatctctgtgtgtatatgtgtgtatgtatat

SEQ ID NO: 86607 - DNA, 68 bp, Mus musculus
gagcaaactctctgactctcacttccctggcctctcaggccaggccagatgaagagacagataccctc

SEQ ID NO: 86608 - DNA, 146 bp, Mus musculus
tgtatgtatgaatatatgtatgtatatgtatattttgtctacatatatatacatatatgaatgcctgtatgtgtgcaaagtatgtgtatatatatatatatatatatatatatatatatatatatatatacagacacacacacacg

SEQ ID NO: 86609 - DNA, 126 bp, Mus musculus
aataaactatccctcattctctttgagttaaaggctgtgttttttcgcagacagaaccaagtgtgcactacaaattagttggcaattcatgtttgtgttatggtttgttatgactgcttaattcaa

SEQ ID NO: 86610 - DNA, 68 bp, Mus musculus
gtgtgtgtgtgcctgtgtgtgcctgtgcactcccttatgtgcatactcacacacactgtgtaaaccat

SEQ ID NO: 86611 - DNA, 85 bp, Mus musculus
tccaatcatacacaagtgttttctaaggttgtatgcctgtagcacaggagtcccagagaagagagagagcattagggaaattgga

SEQ ID NO: 86612 - DNA, 107 bp, Mus musculus
aaaaggagcctgtctttcattcctatagaacacattaagacattttttttttaagtaaggagaaatttcatttttgtaagggaatgttgaagaattaggattttttt

SEQ ID NO: 86613 - DNA, 118 bp, Mus musculus
agttttagttacaaacttgggcatgtaaatttcacacagctaccactttttctgacacactgtcagaatgtcacagtttttaaataatgatagtacgtgccacgccaccactactact

SEQ ID NO: 86614 - DNA, 96 bp, Mus musculus
ccatcatctgtgcttcttggaccagtttcaggttggcccctcactctctggcgctgtcagtcccagcctgcactgggaaagtacagagtgttttgg

SEQ ID NO: 86615 - DNA, 150 bp, Mus musculus
gggtgcctggctagactggcttgtccataaccccagggatgctactgtctctgtcactgtgcctattttgtttggttgggtttttctttttttttttaatatgagttctgggaatcccaattcaagcccttaggtttgtatggcaagcac

SEQ ID NO: 86616 - DNA, 71 bp, Mus musculus
gcctgatgtgagtagacagtgatgtcacctgtgaccatggtgagatcctaccctgtgctgccactgggggc

SEQ ID NO: 86617 - DNA, 117 bp, Mus musculus
cagtgtgggtgagacaggccctggctaaaaggaatgaatgtggtataattttttttttaaatatttcacacagcagcatcttgtccttttgttaaagtttaattctcatcttgtctg

SEQ ID NO: 86618 - DNA, 93 bp, Mus musculus
atgcttactgtgtgtcctctacacaaagcccacctcttctagtatggattggttagaggtagagttgtgtgaaagcagagacaatgtcagcat

SEQ ID NO: 86619 - DNA, 107 bp, Mus musculus
ggcttatttaatttatactctctgtttatcactgaaggaagtcaggacaggaactaagatcagggactttgaggctggtgatgcagaggccatggaagagtactgct

SEQ ID NO: 86620 - DNA, 154 bp, Mus musculus
gctatggatatatgtaatatgtatgtatgtatgtgtgtatgtgtgtatgtatgcatgcatgtgtgtatgtatgtgtgtatgtatgtatatatgtatgtatgtgtgtgtatgtatgtgtgtgtatgtatgtatgcatgtgtgtgtatgtatgtgt

SEQ ID NO: 86621 - DNA, 86 bp, Mus musculus
ggctcagagttgagagtctgcagtcaggaatgagggaagtccctttaaagatgctgctgagagacttgtcattcactgtgaggtcc

SEQ ID NO: 86622 - DNA, 75 bp, Mus musculus
ttgagtctgtctttcttgttttctcgcaatcctctggacaactgtgagaggcaaagtgtcaggagacagtctgga

SEQ ID NO: 86623 - DNA, 93 bp, Mus musculus
gttccagtactcaatgtcacccacagactcactcaatgagcttaagaaacttttccagctttagaattgataatctggggtttgggattgaac

SEQ ID NO: 86624 - DNA, 81 bp, Mus musculus
ccacttcacagactgtctcagtgtgagtatgaagacatttaaagatcttttaccataacaaaaggcaggctatgaagctgg

SEQ ID NO: 86625 - DNA, 94 bp, Mus musculus
ggatgaacttcttcatttggtataagcaggaatatgtatatttatatatgcatgcacctgaagtcatttatatacttttctaggttatacatcc

SEQ ID NO: 86626 - DNA, 88 bp, Mus musculus
cccgccccaggcccctgtcactcacgctcagccactcccagccctcgctcaggctccgtccctggcctgtctgtcagtgcctcttggg

SEQ ID NO: 86627 - DNA, 75 bp, Mus musculus
ggtaaagctggattctagacttcactgcagaaaggaattaaaggatgtcagtataaggtagagttcaggtttact

SEQ ID NO: 86628 - DNA, 68 bp, Mus musculus
tcagagaagggaacactctgttccagatggggacatttacatggaagagaagtgagtcaggtctagga

SEQ ID NO: 86629 - DNA, 85 bp, Mus musculus; identical to SEQ ID NO: 57439

SEQ ID NO: 86630 - DNA, 95 bp, Mus musculus
aacgttattacatgccatgctgtagtctgtcattttctctctcataggttcctggttctcagaaagaccacatcccagtacctggcacatacgtt

SEQ ID NO: 86631 - DNA, 110 bp, Mus musculus
ctgtaagaaagttagagctgtatagaaatgcttggctgaggaggaggagtgcttagagcctctctctgtttctgttaagcatctaatttggcttggtaggtaaagtgcag

SEQ ID NO: 86632 - DNA, 108 bp, Mus musculus
ccatatacaggaagtggtatcttatttggtaatgacttgtattttcttaattaatacttgatgtgaaaatattttcatatgattattgaccatttaaaaagtatgtgg

SEQ ID NO: 86633 - DNA, 88 bp, Mus musculus
gttgttggtggccgactagtggttttgttttcctcatgaggagagggagaaggtacatggctttgggtcttgcctctgctccagcaat

SEQ ID NO: 86634 - DNA, 84 bp, Mus musculus
ggggccttattagaggaagtgagctttagggtttcaaatgtttgagccacgcccaatgtctctgtctctctgtctctgggtctc

SEQ ID NO: 86635 - DNA, 117 bp, Mus musculus
atgtatatgtatgtgtatattaatatatgtgatctatattgcatgcatatatatatatatatatatgtatatatatatatatatatatatatatatatatatatatatatatgtgta

SEQ ID NO: 86636 - DNA, 118 bp, Mus musculus
gtgtatctggggtaggaggatggataaaagtcaaggtcacagttctgacagtgcacagcctcagactgtgcaaatgtgcctgctgcagccctggctggcctactttgtgaagagccat

SEQ ID NO: 86637 - DNA, 66 bp, Mus musculus
tcttctgaaacagtctcatggagtcagtcaggctggtctctgactgactcactatgtacccgagga

SEQ ID NO: 86638 - DNA, 86 bp, Mus musculus
aggttcgttgtgttctttgttctgtagcacagcagtgatattgtttgatgagaatgagtgacagacagagagacaaaaatgttcct

SEQ ID NO: 86639 - DNA, 106 bp, Mus musculus
gggtttctggttgcaggtgagcaagggtcagcataaatgaggtgacaggcatgacacaagagagtgtgctgaatctgaatgcaatgtcattttgagcatcaaactt

SEQ ID NO: 86640 - DNA, 75 bp, Mus musculus
tcatgggctgtgtgacatgcttgctggaaactcataaatcattcattatgagaccacagtgagaacagaaaatga

SEQ ID NO: 86641 - DNA, 58 bp, Mus musculus
atatgtgtatatgtatatatgcctgtctctatacatgtatgtatatgtgtatatatgt

SEQ ID NO: 86642 - DNA, 85 bp, Mus musculus; identical to SEQ ID NO: 57439

SEQ ID NO: 86643 - DNA, 112 bp, Mus musculus
gttcctgtgcaaaacagggtctgcttctccagactgcccgactggtgccctctccctgactcactatcaatcagccatcagaaccaaaggcctgtctcttttgtcctggaat

SEQ ID NO: 86644 - DNA, 97 bp, Mus musculus
tggcctcctgagtttctaccacggctgtctttcctcaggttagagattagaactggcactgactactacctgaatgcttgtacctctcagttctcca

SEQ ID NO: 86645 - DNA, 85 bp, Mus musculus
ttctgcaaactatgtatgtatgtatatgtgtgtgtatatatatgtgtgcatatataatatatataattaaactttgttcaatgaa

SEQ ID NO: 86646 - DNA, 116 bp, Mus musculus
agatctgacctggactgaatattattaccatgaataaaataaacagactctctgactggctctggagtcaacaagaactctgtccatgctgacaatgtttgacctggcttgtatct

SEQ ID NO: 86647 - DNA, 73 bp, Mus musculus
ctacactagtgacaaggtctgatgtctgtcagcagacaagaaaggcacaggcacatttgttgcatatgtttag

SEQ ID NO: 86648 - DNA, 85 bp, Mus musculus; identical to SEQ ID NO: 57470

SEQ ID NO: 86649 - DNA, 59 bp, Mus musculus
cagtgtgcatgtatgtatgtatgtatgtatgtatgtatgtaatgtatgtgagtacactg

SEQ ID NO: 86650 - DNA, 111 bp, Mus musculus
agggaggaagagagggaggcagggagggagggagggagggagggagggaagaagagagacacacactgtttctctctctctctctaagacagggtttctctgtgaagccct

SEQ ID NO: 86651 - DNA, 85 bp, Mus musculus; identical to SEQ ID NO: 60314

SEQ ID NO: 86652 - DNA, 99 bp, Mus musculus
tcacctgtagaaagaggatgtcgggctggagagatggctcagtggttaagagcactgactgctcttccagaggtcctgagttcaattccctcatggtga

SEQ ID NO: 86653 - DNA, 85 bp, Mus musculus; identical to SEQ ID NO: 57439

SEQ ID NO: 86654 - DNA, 114 bp, Mus musculus
aaatttccttagtggcagctgttatgtcaccctttcattacagattttgtttatgggtactgtctctctgtctcttggttaggttggctaagggtttgtctatcttgttgattt

SEQ ID NO: 86655 - DNA, 85 bp, Mus musculus; identical to SEQ ID NO: 57439

SEQ ID NO: 86656 - DNA, 79 bp, Mus musculus
gcccctttcagccctacccagactccttactagtcagtctctctgtctctcaggatttgttgtattttaaattaggggc

SEQ ID NO: 86657 - DNA, 66 bp, Mus musculus
cacctccagctctagtttcttgaagtaaatatttttctttaattgagaatttggagaaggaaggtg

SEQ ID NO: 86658 - DNA, 116 bp, Mus musculus
caagatgatcagcctttacctttattcttaggttttgggatcttaagaaatatttttttctattaagagattaaaagttgtagggtggggatgtagcacagcctgaagagtgcttg

SEQ ID NO: 86659 - DNA, 66 bp, Mus musculus; identical to SEQ ID NO: 64611

SEQ ID NO: 86660 - DNA, 103 bp, Mus musculus
tagagacattagcagggacagaatcttgcatgtgcattttctatgtttttattgaaatgagcattctgagatgcactaaacatttccttccttggtatttcta

SEQ ID NO: 86661 - DNA, 116 bp, Mus musculus
tggactcagcagtgtatgttttatatgtgtgaatatatatatatatgtgtgtgtgtgaacatatatatatatatatatatatatatatatatatatataacacactgctaaattca

SEQ ID NO: 86662 - DNA, 80 bp, Mus musculus
gacattgggaagatgaaaacaggagagattttgttgataatacgcaaaatgccacatctgtttttattcactcggtgctc

SEQ ID NO: 86663 - DNA, 80 bp, Mus musculus
gatagaaggcacgtgagtaggtatatcataggaggcatcccttactgtactatgacagtctcactgactgctttctactc

SEQ ID NO: 86664 - DNA, 110 bp, Mus musculus
ttgaagatcagccttagtccatggtgatctgataggatgcatgggataatttcaatatttttgtatctgctgaggcctgtttggtgaccgattatatggtcaattttgga

SEQ ID NO: 86665 - DNA, 85 bp, Mus musculus
cttcaaactttagtgtatttcaccaagtgagagttttcggctctgcccaggacacctttcacagaagatagactacagactgagg

SEQ ID NO: 86666 - DNA, 106 bp, Mus musculus
atgtttttgcttaaatggttataataacacatgctgtggaagttttctatatttattttggaattactgctatgtgcatatgtattattcttggtaggatgggcat

SEQ ID NO: 86667 - DNA, 90 bp, Mus musculus
caaggcaagaagtgagagccatgtaattggagactgttgactgagacaagtttcaatgccattcgggaagaagtacttctttaatccatg

SEQ ID NO: 86668 - DNA, 96 bp, Mus musculus
ttgatgactgactactatagatacgtcacataaatgcaattatgctgtatttgttcttctgtgatggctttgtttcactgagtaccatgtcctcag

SEQ ID NO: 86669 - DNA, 69 bp, Mus musculus
atgtgtgcatatgtattatatatgtgtatatatgtgtgtatatatatacatatatatgtatgcatatat

SEQ ID NO: 86670 - DNA, 73 bp, Mus musculus
ttggagatttacccggagagggaagacataccctgaactttggtgacactctctcactctctgaagtctctga

SEQ ID NO: 86671 - DNA, 93 bp, Mus musculus
gagaagtaggactgaaaatcaatagtgcattgtattagagtacttcaaagcctctgccctctctgcctgtctgtctctctgtctttctgtctc

SEQ ID NO: 86672 - DNA, 82 bp, Mus musculus
gattggatctcactctgtatctctgtctgtcctggaactcattatgtagaccaggctagccccagatttagagagatctttc

SEQ ID NO: 86673 - DNA, 78 bp, Mus musculus
tgacctgataggatgcatgggacaatttcaatatttttgtatctattgaggcctgttttgtgacgaattatatggtca

SEQ ID NO: 86674 - DNA, 109 bp, Mus musculus
tgtgaagccattaaaacattgaagaaacttggactggagtggttaagagcactgactgctcttccaaaggtcctgagttcaaatcccagcaaccacatggtggcttaca

SEQ ID NO: 86675 - DNA, 95 bp, Mus musculus
catttatgtagacgaaatttacatgtatgtatgtatgtatgtatgtatgtatttagtgtgcatgtattctggtgagggttgtcacacatgcaatg

SEQ ID NO: 86676 - DNA, 94 bp, Mus musculus
gcaggatctagttgaatcaaaagcacacaaggaagagaccacagaacttcaaatctcccttgtatcttgttttgtgttcatcatggaatcctgt

SEQ ID NO: 86677 - DNA, 85 bp, Mus musculus
ctgggttcttctagcctccctgagagcctgtctgggcctgtgtggcaccagactggttgtcatctcaggctagctcactgtccag

SEQ ID NO: 86678 - DNA, 90 bp, Mus musculus
gatcagtcttaggtggtctgataggaaacatgggacaatttcaatatttttgtatctgttgaggcctgttttgtgaccaattatatggtc

SEQ ID NO: 86679 - DNA, 126 bp, Mus musculus
ggaatatcaaacagaagtacctgagcggttgggccagatgtgtgcagggttgtgtcttacactcagactgtcagtgtgtgtgcccctggggtacatggttgtttagttcttaccctgactgtctga

SEQ ID NO: 86680 - DNA, 82 bp, Mus musculus
gggctgctgttccacagtcagatcacagtgtgctgatgtggtcccatgctgggtgttcactgccttctgatggatacagctc

SEQ ID NO: 86681 - DNA, 112 bp, Mus musculus
cgtgtgcactgctgggtgttacatggttgaagatgactctgacattttgatgatctgaaatcatatgaacaattttatcggcaacagtatgagcattgagcacttgacatgc

SEQ ID NO: 86682 - DNA, 68 bp, Mus musculus
gagagaggtgatgtgtgctatcctaaccatctgggacctgggtacagagcaagggtagcatgtctctt

SEQ ID NO: 86683 - DNA, 95 bp, Mus musculus
catgtagcattatatgtgtatgtgtatgtatatatgtgtatatatacatgtatatgtatttttatgtatatgagtgtgtatatgtatatatatgt

SEQ ID NO: 86684 - DNA, 118 bp, Mus musculus
gttgagctatgtagtccattgctattctcatttgtaatgatatctttgtatctttgtatatttaaactgagatatgtatatccttataaagtgtatacatcttcatactctgcttttc

SEQ ID NO: 86685 - DNA, 66 bp, Mus musculus
tagataggcaaacagagagatcagcaaatgcaatgttatatgtctgtctgtctgtctgtctgtctg

SEQ ID NO: 86686 - DNA, 74 bp, Mus musculus
gctggactcaatagcacacaccttttttccccaacacttgggaggcagaggcagttggatctatagatgccagc

SEQ ID NO: 86687 - DNA, 88 bp, Mus musculus
ggcctagttagagaagataagttggaaggggtctttgagctttcaaaagcccatgccaggtccagtctcactctctctgactactacc

SEQ ID NO: 86688 - DNA, 108 bp, Mus musculus
gcatgtttgcattccatagttactggtgctttgctgtgatggttgcttgtttggttttgacacagggtctcttgtagctaactttgaacttactatgtaattaagtgt

SEQ ID NO: 86689 - DNA, 70 bp, Mus musculus
aaggtcccgactttatctgttcaacagaattcctcaggaactgtgagagctgacagacgtcacgggcctt

SEQ ID NO: 86690 - DNA, 111 bp, Mus musculus
gctgtcttttaaattctttttcatagaaaagatacgagtttaaacactgcattttagcatatgtaatgtaaacacttgaagcatctataaaaggaaagtaattgatttggt

SEQ ID NO: 86691 - DNA, 76 bp, Mus musculus
ttgaatgtttgggttactacttggttgctaattcttcactggcttctacccatgttgtagtagtttgaatatttga

SEQ ID NO: 86692 - DNA, 86 bp, Mus musculus
ctaatgtttcctatcatgatagagactgagctgagtggcccactagcaagactcacatcaggcttgtgtcagacaggaagggtcag

SEQ ID NO: 86693 - DNA, 111 bp, Mus musculus
tcggatttgtttttattttatcatattattggtttttcagatgcttgtttatattttaatgaaagagaagcagtgtgcatttgggtgagtggtgaactgggcaagatctga

SEQ ID NO: 86694 - DNA, 93 bp, Mus musculus
gttgttttgcattcaaagaaaacagccatgagagtggagtgtcaggacacggtgtccaccttggcttttcttctctaaaggatgtgggaaagc

SEQ ID NO: 86695 - DNA, 70 bp, Mus musculus
ttctggacttcagagctgtgagtgagcacatttcaatgtgataagacacacagtttgtgggaatttagag

SEQ ID NO: 86696 - DNA, 75 bp, Mus musculus
tgtctggctgtgaggtttgctggatcagcccctgcccttgggcacttgccagcttttcctcagctggcacagata

SEQ ID NO: 86697 - DNA, 58 bp, Mus musculus
ccagaagaggcagcatgagagccaggatgaacacaggctgactcaatgcctctgtagg

SEQ ID NO: 86698 - DNA, 73 bp, Mus musculus
ttcatatgtgtgtctgtctgtctgtctgtttctctgtctccatggatgtggacatcagatgacagcttgtgag

SEQ ID NO: 86699 - DNA, 101 bp, Mus musculus
acatactatatatatgtatatgtgtatacatactatatatatatatatatatatatatatatatatatatatatatgtatatacacatggaacatgctata

SEQ ID NO: 86700 - DNA, 76 bp, Mus musculus
acttaggttaaaattctttgatagagagatggctcaatggttaagagcactgactgctcttccaaaggtcctgagt

SEQ ID NO: 86701 - DNA, 88 bp, Mus musculus
caggtctatcagcaggcctcctagctatacaagagagcatgcatttctttgtgtctctctatctctgtctgcctgtctgtctgtcctg

SEQ ID NO: 86702 - DNA, 93 bp, Mus musculus
ggaatgttgttgtagcagccatgaaccaggttgagatcaagggccaggcagtccctctcagtttcactgtcagggctgtgacccagatatccc

SEQ ID NO: 86703 - DNA, 118 bp, Mus musculus
tctcataatttcagatttgtacattttaaccaacgggtatctctaatgccatattctcaaaatcttgagacactttgaggttgcccctttttaaaggttctattctgagtctgtaagg

SEQ ID NO: 86704 - DNA, 170 bp, Mus musculus
acatggaaaaatagaagaaatcgtctttgcttgaaaattaatactgttgttatgtgttgtcattttcatttactgagatgacttttaaaagagtctattgagtgtctgtgtgtctgtgtgcatgtaggccatatgtgtggatgctcatgtaggccagaagaggatgccaa

SEQ ID NO: 86705 - DNA, 72 bp, Mus musculus
tggaccaggaaacagaaacagactagaagtaacgtgacgtgttaaactctgtcactttctgacagatggcca

SEQ ID NO: 86706 - DNA, 85 bp, Mus musculus
tcatacaagcttgagatgccaggtctcagagcttattgtgaaataacacagtgatcagagacaccgagttctcagctgaccgtgg

SEQ ID NO: 86707 - DNA, 96 bp, Mus musculus
gctaatgttaactaatcacattcctcagagatgtgtttatgatgttagctgtcttggtgtaatcaccatcctcagagatgtgtttatgatgttagc

SEQ ID NO: 86708 - DNA, 87 bp, Mus musculus
gccacgtggaggttcagaatggcccattgagctagctaaggtatattaaataggctggtgtgtgtgtctatgtgtgtctgtgtgtgc

SEQ ID NO: 86709 - DNA, 101 bp, Mus musculus
cctggctcctcacatgagcttgtttcctccaaagcagcaagagacagaacagtgagagtacccagggccacagggccaaactgtgccctctgcgcgtctct

SEQ ID NO: 86710 - DNA, 63 bp, Mus musculus
ggagagaacttggatgatgagattagggttctctggagaccctgactgtgtccgtgtctctct

SEQ ID NO: 86711 - DNA, 94 bp, Mus musculus
tctcttaagctgactcaagcagaatacatctaggagctatggtctcgaaaattagctttctggatcaaggtagtttactagttggcagtagaga

SEQ ID NO: 86712 - DNA, 94 bp, Mus musculus
tgttttgtgtttatttgggtctggaagttttaactgcgtgaagaagaacacagtttatttatttcataaaaggactagatactaacagagttca

SEQ ID NO: 86713 - DNA, 92 bp, Mus musculus
tgtccaaagaaccctgtaaccgataggtagtcattactaagcaactgaagatcatgtagacttgagactcattttggttccttccttggaca

SEQ ID NO: 86714 - DNA, 62 bp, Mus musculus
gcctctgtctctgcctctgcctcccgagtgctggggttaaaggagtgcacaccaccgagtgc

SEQ ID NO: 86715 - DNA, 155 bp, Mus musculus
atatgagtatgaatttgtgctggcctgagggttctcttgtggatctctccctctgtctgtatgtctgcttgtatctatctctctgtgtgtctatccctgattaagggctttgttttgtctttattaaacagcatggaaaacaaccaatgggatgg

SEQ ID NO: 86716 - DNA, 83 bp, Mus musculus
ccagaaccaaggagttgagagagctgggatccacacacttgggatctaggctgtgtggacagagtgagcaacaatggttaagg

SEQ ID NO: 86717 - DNA, 72 bp, Mus musculus
tcaggatcacagaccaaagagagcagttagaacccaattctaatgtctagtcaaggggatgttagaacctga

SEQ ID NO: 86718 - DNA, 64 bp, Mus musculus
gtatgtatatatgtatgtatgtatatatatatatatgtatatgtatatgtatatgtatatgtat

SEQ ID NO: 86719 - DNA, 114 bp, Mus musculus
tatctatctatgtatatatatcatatgtatatatatatatatatatatatatatatatatatatatatataatatgtgtgtgtgcatgtgtatacctgtgtgtctgtgtgtgta

SEQ ID NO: 86720 - DNA, 56 bp, Mus musculus
tatacaaacacacacatatatatatatgtgtgtgtgtgtgtgtgtgtgcttgtatg

SEQ ID NO: 86721 - DNA, 85 bp, Mus musculus; identical to SEQ ID NO: 57470

SEQ ID NO: 86722 - DNA, 111 bp, Mus musculus
gataggaacatctcattcaagaccaaatgctccaaggtctgtcactctctgcatatggtttgactgtgggtctctgcatttgttctcatttgctgtatgaggaatcttctc

SEQ ID NO: 86723 - DNA, 89 bp, Mus musculus
gagaacacagaagagaaacgtgaggacgtccagaatggtcagagctgtgaaagtgttctgtgtttgctgatgtgaaattctgagtactc

SEQ ID NO: 86724 - DNA, 80 bp, Mus musculus
agcaactttgctggattatgagtgagaactctcgggttggctctgctctgagcagtctcagtcagttggtgcctgttgct

SEQ ID NO: 86725 - DNA, 82 bp, Mus musculus
tcttcccatgtatgagtgttttgatgcatgtatgtatgtatatttactacatgcatgctttgtgctcacagaggccagaaga

SEQ ID NO: 86726 - DNA, 60 bp, Mus musculus
tataattacagtacatgccgtgtgtgtatatatatatatgtgtgtgtgcatgtatgtgtg

SEQ ID NO: 86727 - DNA, 91 bp, Mus musculus
gtgcatatggctctccctcctactcagtggatgctctatgactcacacccactgtgggttctggggctgagctgctgtagagtcctatgac

SEQ ID NO: 86728 - DNA, 85 bp, Mus musculus; identical to SEQ ID NO: 57439

SEQ ID NO: 86729 - DNA, 118 bp, Mus musculus
gctgagcttagtccaatgattggctattagtgagcttcctcttctgtatttgtcaggctctgtcagagcctctcaggagacaggcatatcaggctcatgtcagcaagcacttctcagc

SEQ ID NO: 86730 - DNA, 86 bp, Mus musculus
gttttcttccatcattgtatgcagtttctagatatgatcctagtaccgggagcatacagagagcatacagagagcatacagagagc

SEQ ID NO: 86731 - DNA, 90 bp, Mus musculus
gttcaggcagcaaacatttagttgaactcactttttacatcccaaggatgctgacagaagtcagtggtcagctaggtgtgctgtctgtcc

SEQ ID NO: 86732 - DNA, 85 bp, Mus musculus; identical to SEQ ID NO: 57470

SEQ ID NO: 86733 - DNA, 69 bp, Mus musculus
acttccttttcttgtctatttgccctagctagaacttcaagtactatgttgaatagataggaagagagt

SEQ ID NO: 86734 - DNA, 71 bp, Mus musculus
ccctggatctaggttttagaagtatctgagctagtcagccttctggctctctcactctcaagcctccaggg

SEQ ID NO: 86735 - DNA, 58 bp, Mus musculus
gggtggctgtgtgtctgcctcactgcggaggtgccagagtattgcaggcaagttgctc

SEQ ID NO: 86736 - DNA, 116 bp, Mus musculus
ccattgttgtttcaagtggggcaaaagtttagtatagtatgatctcttcaaatctatttgattttatagaagggctgtaattatcagctttaatgcacattaacaatatcttctgg

SEQ ID NO: 86737 - DNA, 105 bp, Mus musculus
acttgacctttttcccttactgcttttagtatgtctatgctttatttagtgcatttgatgttctgattattatgtgtgcgggaggaatttcttttctggtccagt

SEQ ID NO: 86738 - DNA, 107 bp, Mus musculus
ccaaagagagagagacagacagacagacagacagacagacagacagacagatatatagacagacacagacacacagttttgtattgtccatcttctactctctatgg

SEQ ID NO: 86739 - DNA, 79 bp, Mus musculus
ctgtgtctgtctcagtcacctgctggttgggcctctcagaggacatccatgctagaccctgtctgtaggcacatcatag

SEQ ID NO: 86740 - DNA, 68 bp, Mus musculus
ggttagagcttgttccactagtgattctgttattctctaacagcagacggtggagactagctctctcc

SEQ ID NO: 86741 - DNA, 116 bp, Mus musculus
gtatgtatgtatgtatgtattttaatgaggggaatttattttgctgtcaaacagaaaaatttattttttaatcagtgattaattttggttatgtgagtgctcgcatgtgtgcatat

SEQ ID NO: 86742 - DNA, 83 bp, Mus musculus
tctacatttatactatatctatatttatccatggctatggctatggctatgggtatggagatgtagatggtgatggagataga

SEQ ID NO: 86743 - DNA, 93 bp, Mus musculus
cccaaactttttttaagaccccctaaagtcaagagtttataaatatatgtcttatgtttaagaatagacttggtctgtattgatgaggaaggg

SEQ ID NO: 86744 - DNA, 69 bp, Mus musculus
tctgttccaagtacccaggcaggccagtttggactctcagactcactgttaccttggaccccttgcaga

SEQ ID NO: 86745 - DNA, 67 bp, Mus musculus
gtgtactgcacaggagacctggcttcttggcttccaagatgccactctgtgtcacactgtgttctgc

SEQ ID NO: 86746 - DNA, 94 bp, Mus musculus
ttctgggttttgtgaccttctaaaaacatactgaggtagctgtctgtctctctgtgagaagctcagagactgagtcagagaaagagctttggtg

SEQ ID NO: 86747 - DNA, 85 bp, Mus musculus
ggccatggtggtctgataggatacatcggacaatttcaatatttttgtatctgttgaggcctgttttgtgaccaattatatggtc

SEQ ID NO: 86748 - DNA, 75 bp, Mus musculus
tgtgtcaccagggaactgagaggctcctcacagaactgagtgacttggggtatcgagtttcgctaaaaaggcaca

SEQ ID NO: 86749 - DNA, 95 bp, Mus musculus
agcataaaataaaattgctgttcagacagacctcacagagacactgccaagtggtcttccaagggagttacaacagtttactattttctattgct

SEQ ID NO: 86750 - DNA, 109 bp, Mus musculus
gcagtctcaagagttaacatacttggccctttatgaagtcttgtggggaaatgacacaagagacagagttcttgatactaaggcgcttgcagtgtagtggagatgatgc

SEQ ID NO: 86751 - DNA, 84 bp, Mus musculus
gataggtaaatcttacagaacagtgtgtggtcctatcagctctgtattagttaccattcatatcactctgaaaggttacctgac

SEQ ID NO: 86752 - DNA, 101 bp, Mus musculus
ggagatattgtgtgatttacagacaggaagacaattgtacctttggaaggccaagtagtccagtgattttttttttctgaatggtatcaacatggaaattc

SEQ ID NO: 86753 - DNA, 83 bp, Mus musculus
ccagctcttccaaaggtgaaccagcttctgtgtcctgctccctttggggactgtcactgtctgggattcatttcatttgttgg

SEQ ID NO: 86754 - DNA, 110 bp, Mus musculus
tgtattgacaattctggttgggttctttaaaaacacagaaaagctataagaatatgtctttatttttctctaggtgggggatatggggctgagccaggttgttcagagca

SEQ ID NO: 86755 - DNA, 111 bp, Mus musculus
tgagatgaacttgaggagataggtcaatggctctgtggagatcttaaagattatctgtctgtctgtctgtctatcatgtacctatcatctgctcatcaattatctatctca

SEQ ID NO: 86756 - DNA, 91 bp, Mus musculus
ctgggggaaggatcctggttacaagtgcctctggaagtctcactgtgtctcttgggccagttgaaccagcagaaaaagccatttgacctgg

SEQ ID NO: 86757 - DNA, 80 bp, Mus musculus
atgaacatacatatatataatatatattatatatgtgtgtatatatacatgtatatatatatatgtgtgtgtgtgtatat

SEQ ID NO: 86758 - DNA, 85 bp, Mus musculus; identical to SEQ ID NO: 57439

SEQ ID NO: 86759 - DNA, 81 bp, Mus musculus
atacatgtgtatatgatatatacacatatgaatatatgtgtatgatatacatatgtatatatgtacatatttatatacaca

SEQ ID NO: 86760 - DNA, 85 bp, Mus musculus; identical to SEQ ID NO: 57470

SEQ ID NO: 86761 - DNA, 101 bp, Mus musculus
tcccaggctctgagcctttcttatctccatactgtctctgtctggtttccatggacaccaagatctgttacaagagcagcgtgagaagctctgagcaggga

SEQ ID NO: 86762 - DNA, 89 bp, Mus musculus
tcaagtatattggatgatgcaaaataaaggttatcctctattagccagacaatgaccatatgttttcatttttattccttatggcttga

SEQ ID NO: 86763 - DNA, 76 bp, Mus musculus
gtctctccattggctggtgagtgggaagagtacagttattctgagcagaccaccctcactcagtggctggctgggc

SEQ ID NO: 86764 - DNA, 115 bp, Mus musculus
catgaatgtactggaacattagaaaccagtgcaaggaaaaatgatattcaaacactactgtttttgtatataaataagtctttgacctaagattcctgtgttctctggtaccatg

SEQ ID NO: 86765 - DNA, 83 bp, Mus musculus
catcatctagtgagagtcagctctcagggaggacccagcactggctgttgtaccttggggcttctctgcttagacctggggtg

SEQ ID NO: 86766 - DNA, 81 bp, Mus musculus
acagagcaccagtagcccaggctctaagatcacatttatatgcaagtgtctgtctgtctgcctgtctgtctgtatgtatgt

SEQ ID NO: 86767 - DNA, 85 bp, Mus musculus; identical to SEQ ID NO: 57439

SEQ ID NO: 86768 - DNA, 118 bp, Mus musculus
tcaatgtggccccttaggaaccctactgctatgaagagtcttcttgtctgtctccctcactgggtgagttctccaaagtggaaaatgatggcatgtcccctgtgtttggcctcatcgg

SEQ ID NO: 86769 - DNA, 114 bp, Mus musculus
gggacttccctatagctgaacagcttctgttgtaaggagacagttgtatgagtccagacatctccaggacatcttctccatcttgctggcagagttaaacaagttcatgttccc

SEQ ID NO: 86770 - DNA, 69 bp, Mus musculus
tctacctgagccacagtgaaaggagctactgattgttgcctagtgctttcttctgtgggtcgaggagga

SEQ ID NO: 86771 - DNA, 100 bp, Mus musculus
gacagagcagcatacacccataggacttatcactacacacagtttcaggcataagcaagaggcaatggaatgtagcctgtgggtgtggggccactgtgtt

SEQ ID NO: 86772 - DNA, 73 bp, Mus musculus
cacataggatgtatgtatgtatgtatgtatgtatgtatgtatgtatgtatgtataagtatactgccatatgtg

SEQ ID NO: 86773 - DNA, 113 bp, Mus musculus
gaaacctctcatgtaggactgagtgctccaaagtttctcattctctgcacattttctagttgtggatttctgcagagaaagtttctccaagcgttggttacatgggtgtattt

SEQ ID NO: 86774 - DNA, 85 bp, Mus musculus; identical to SEQ ID NO: 58391

SEQ ID NO: 86775 - DNA, 73 bp, Mus musculus
gtcagggctcaacagacacttattaatcgggtgaacaaactgtttccccttacagtgtctgactcactctgtc

SEQ ID NO: 86776 - DNA, 113 bp, Mus musculus
tggaaagtccatatcttttcatcaggcaccaatgaacaaattagggaagtaaatgataaatttatctttttgaaacctcatgagtttgggaaaattaaaaaagacttttacca

SEQ ID NO: 86777 - DNA, 85 bp, Mus musculus
ggccatgttggtctgataggatacatgggacaatttcaatatttttgtatctgttgaggcctattttgtgaccaattatatggtc

SEQ ID NO: 86778 - DNA, 101 bp, Mus musculus
cttagtccatgttgatctgataggatgcatgggacaatttcaatatttttgtatctgttgaggcttgttttgtgaccaattatggtcaattttgggagaag

SEQ ID NO: 86779 - DNA, 100 bp, Mus musculus
gattatatggtaaattttgtagaaggtaccatgaggtgatgagaagaaggtatattcttttattttaaggtaaaatgttctattagatacctgataaatc

SEQ ID NO: 86780 - DNA, 70 bp, Mus musculus
agatatatatatatatatatatatatatatacatatcaatatatatgtatatgtatatacatatctatct

SEQ ID NO: 86781 - DNA, 109 bp, Mus musculus
cttttatagtgccaacagaaatcattatttgaggcttcacactgattcactgtatcattacatgtgcactgtactcattaaaggtaatgtttgttgcaacatataaaag

SEQ ID NO: 86782 - DNA, 117 bp, Mus musculus
tggagaacatttaggactaatgttttcaacctgatcattatggatgatgatgatgatgatgatgatgatgatgatgatgataatgagggagaagaggcacgggacttaaaatttcca

SEQ ID NO: 86783 - DNA, 118 bp, Mus musculus
catggctatattgcttcagttaccaaggccacaaaccattattttcaaaggctcattgctctgtatgagcatcaggatttgatgggaagataaggcagtgtgggctgaaaattgtctg

SEQ ID NO: 86784 - DNA, 81 bp, Mus musculus
gctcaatggctacatcacagcctcttttcttctctttgagttagtacagaaggttgtcagtctctgtgtagtcagtatggc

SEQ ID NO: 86785 - DNA, 93 bp, Mus musculus
gcaggaggatgggcagatagccttggtgctatgtgaggtttgtcagccaagtctctttgtctctctccagtgctctccaaagcaccaccgggc

SEQ ID NO: 86786 - DNA, 90 bp, Mus musculus
tgtatatatgtgaatatatttgtcttttcatatgtgcccttgtgtatgtacatgcacatgggcatgtacacatgtgtgaccatgtatata

SEQ ID NO: 86787 - DNA, 108 bp, Mus musculus
gtgtattgtgtatgtactgtgtatgtatatgtgcatatttgtggatgtgtgtatatatatatattcatgtgtgtatgtgtatatatatatgtgtgtgtgtgtgtgtgt

SEQ ID NO: 86788 - DNA, 80 bp, Mus musculus
tctctctcactctcttgctctctcttggtcttcctccctcttggtagggataccattagagagaaggagataacataaga

SEQ ID NO: 86789 - DNA, 90 bp, Mus musculus
gtattgttcagtttccacctgcatgttggctttctatcattgattttttttattgaagataagccttagtccatggtgatctgataggac

SEQ ID NO: 86790 - DNA, 66 bp, Mus musculus
acttgaagactggatagtgaaagtatattaatatttacataatgtactattatccagatgttaagt

SEQ ID NO: 86791 - DNA, 73 bp, Mus musculus
ccaactaaggagaggctgggagcatggagagactgcagtgatctctccatccctccctctgtctgtcatgtgg

SEQ ID NO: 86792 - DNA, 73 bp, Mus musculus
ccaaaactagcaatgaaatgtatacaagactgcatttggggtaattgtataccatctttcattaatgttttgg

SEQ ID NO: 86793 - DNA, 110 bp, Mus musculus
tctctgtgtgtgtgtgtgtggttttgttaaggaattaataaataatactagtatattttttaatgctagtattacatgtccaaatgatttcataatgtaaatgcttagga

SEQ ID NO: 86794 - DNA, 114 bp, Mus musculus
ggatacgttatatgattaaagtcccaaagggacagttgcaacattaaacaatggaaagactactgaaattggtgttggaactgattctggactcatttatgggctgaactgtct

SEQ ID NO: 86795 - DNA, 85 bp, Mus musculus; identical to SEQ ID NO: 57470

SEQ ID NO: 86796 - DNA, 85 bp, Mus musculus
gtccatggtggtctgataggatgcatgggaaattttcaatatttttgtatctgttgaggcctgttttgtgaccaattatatggtc

SEQ ID NO: 86797 - DNA, 111 bp, Mus musculus
aattcttattctacaggtgaatgcattctttatcccattagaatatatatataatctttgaaatgttttggatatgggggaataatctgcattatcaagttgatgagaatt

SEQ ID NO: 86798 - DNA, 109 bp, Mus musculus
tgtatatatgtacatatgtatatatgtatatacgtatatacgtacatacatatatatgtacatatgtatatgtatatgtatgtacatatatacgtatgtacatatatat

SEQ ID NO: 86799 - DNA, 126 bp, Mus musculus
atatgtacatatgcatatatgtatatacgtacatatgcatatatgcatatatgcatatatgtatatatgcatatatgcatatatgcatatatgcatatatgtataagcatgtacgtatgtatgtat

SEQ ID NO: 86800 - DNA, 102 bp, Mus musculus
cttagtccatggtgatctgataggatgcatgggacaatttcaatatttttgtatatgttgaggcttgtttgtaaccaattatgtggtcagttttggagaaag

SEQ ID NO: 86801 - DNA, 72 bp, Mus musculus
tcctctctcggtctctctatatatatatatgtatatataaatatatatatacatatatagagagagagtgga

SEQ ID NO: 86802 - DNA, 88 bp, Mus musculus
atgtcttgttaatcttcttgtgttctgtggattgtagcctggacattctgtcctttttgggctaatatccacttattagtgagtacat

SEQ ID NO: 86803 - DNA, 112 bp, Mus musculus
tgggtattctaagtttctgggctaaatatccacttatcagtgagtgcatatctaatgaatatttttgtgattgggttacctcgctaaggatgatatcctccagatacaccca

SEQ ID NO: 86804 - DNA, 81 bp, Mus musculus
gttacctcagataatgcaaagtgaagaaagtgagctgagcagaagtcttcattgctctttctcggcttcttctgatgtgat

SEQ ID NO: 86805 - DNA, 92 bp, Mus musculus
tgcatatgtatatatatatgtatatgtatatgtatatgtatatgcatatgcatatgcatatgcatatgcatatgcatatgttcatgtatgta

SEQ ID NO: 86806 - DNA, 101 bp, Mus musculus
caggagttagggtcacagtatatatgtatatatgtatgtgtgtgtgtaatacatacatatatatttttttttttgctgaatttcccatttttgcatatgtg

SEQ ID NO: 86807 - DNA, 116 bp, Mus musculus
tgttcagagagtttagctcagtacagtggatcagttgggagtcagtacagtgcgtgcagtgcagtggagttgagttcattcatgagtttatgctgttcagttgaagccagagaata

SEQ ID NO: 86808 - DNA, 123 bp, Mus musculus
gtaggcgcgggcgcccctcggccccgacgagcaagcacggtgaccttggccagcctgtcagcctctctgaatcttgttcactgggacagcgaaatgggggcgacctaggcatgcctttctgtg

SEQ ID NO: 86809 - DNA, 84 bp, Mus musculus
ggccatggtggtctgataggatacatgaacaatttcaatatttttgtatctgttgaggcctgttttgtgaccaattatatggtc

SEQ ID NO: 86810 - DNA, 85 bp, Mus musculus; identical to SEQ ID NO: 57470

SEQ ID NO: 86811 - DNA, 75 bp, Mus musculus
cctatgtgtctgtctgtctgtctgtttataaggtttataaagctataaacttgagagcgagtggaatgcgctggg

SEQ ID NO: 86812 - DNA, 93 bp, Mus musculus
aggagtacacggccattctcttctctctgtctcacctcctctgctgaagttgggtctaggacagaaaaaaccagggaacaagaagtggctctt

SEQ ID NO: 86813 - DNA, 85 bp, Mus musculus; identical to SEQ ID NO: 57470

SEQ ID NO: 86814 - DNA, 95 bp, Mus musculus
actagactctccccctgtatgtgtgtatgtgcatgtgcatgggcatgggcgtgggcgtggacatgggcatgggcatgtgtgtgtgtattgtgtgc

SEQ ID NO: 86815 - DNA, 106 bp, Mus musculus
gccttagtccatggtgatctgataggacgcatgggacaatttcaatatttttgtatctgttgaggcctgttttgtgacctattatgtggtcaattttggagaaggt

SEQ ID NO: 86816 - DNA, 75 bp, Mus musculus
gctagagacacagtgaagaaggcccggccactggcctgattctgtgtggctccctctctgacctgttctctgagt

SEQ ID NO: 86817 - DNA, 137 bp, Mus musculus
acacacatcatatatatatatatatgtgtgtgtgtgtgtatatatatgtatacacatatgtatatatatgtgtgtatatatgtgtgtatatatatatatatatgtgtgtgtgtgtgtgtgtgtgtgtgtgtatatat

SEQ ID NO: 86818 - DNA, 78 bp, Mus musculus
gacagtgtttgtctctgtgtgtaagtttattcatatgtacatgagtgtacgtagatgtggaggctcaagcttgatgtc

SEQ ID NO: 86819 - DNA, 85 bp, Mus musculus; identical to SEQ ID NO: 57470

SEQ ID NO: 86820 - DNA, 85 bp, Mus musculus; identical to SEQ ID NO: 57439

SEQ ID NO: 86821 - DNA, 80 bp, Mus musculus
tatatatttacacacatagatgtatgtatacacacatgtgtgtatatattatttcggtaatgtatgtatgtatttatgta

SEQ ID NO: 86822 - DNA, 85 bp, Mus musculus; identical to SEQ ID NO: 57470

SEQ ID NO: 86823 - DNA, 195 bp, Mus musculus
tgtgtgtgtgtgtacgtatatatagtgtgtatatatgcatatatatagtgtgtgtgtatatatttgtataatgtgtgtgtatataggtatgtgtgtatatatacatatagaagtgtatatatacatatatgtgtgtgtatatgtatgtgcgcatgcagacacacacacacacatacatatgtatatatatatgac

SEQ ID NO: 86824 - DNA, 63 bp, Mus musculus
ggagtgaagacactgaggactgtaccacaagaactgtgcagaccttgacagtctcttccctct

SEQ ID NO: 86825 - DNA, 115 bp, Mus musculus
atgagccttaatccatgatgatctgataggatgcgtgggacaatttcaatatttttgtatctgttgaggctttttttgtgaccaattatgttgtcaattttggagaaggtaccat

SEQ ID NO: 86826 - DNA, 70 bp, Mus musculus
ctggaagtcctccctggctacaggagatggccacttcagtctctatatctctgtctggtaggaatttcag

SEQ ID NO: 86827 - DNA, 100 bp, Mus musculus
ttcctttatccctctcatttattccacctctatttgagaaaatacagtctcagctgagaggttctagggggtggtgcactgagatggaaggccagaggaa

SEQ ID NO: 86828 - DNA, 94 bp, Mus musculus
tgtgtgtgtgtgctgtatgtatgtatgtatgtacatatgtatgtatgttgcaaatacatgtgtccatgcatggatatatggagtcctgatatca

SEQ ID NO: 86829 - DNA, 79 bp, Mus musculus
ttgaccttctggggcattatctccttttaagaaggctgcctttgcctgagacagatgacagtgactccaaagggctcag

SEQ ID NO: 86830 - DNA, 64 bp, Mus musculus
atattatttcatattgagtatattgatcatttcatattgattatatatcaatatgaaaggatat

SEQ ID NO: 86831 - DNA, 78 bp, Mus musculus
aatggtgacgagctttttttgttgctactgtaatatgtacagtattcattcaagtcagagagctgtctgaatgccatt

SEQ ID NO: 86832 - DNA, 67 bp, Mus musculus
ccagccccagtcagcctctctcaatctgtgggaaaatagggttccagagaggtgggcatggagttgg

SEQ ID NO: 86833 - DNA, 70 bp, Mus musculus
atatatgaatatatgtatatgtatatatatgcatacatgtatgtatatatgtatgtgtatatctgtatgt

SEQ ID NO: 86834 - DNA, 80 bp, Mus musculus
gtccattcaaggtctgtaaagaattttgttgtaatcttggtggagattgcatggaatctgtaggttaattttggtaggat

SEQ ID NO: 86835 - DNA, 102 bp, Mus musculus
ccagttcagctgattatccatgctctaagatgtagtaagttgatttgtagctctcaacttcgatctgtgaatgtaaccttatttgaaatggatcactgaagg

SEQ ID NO: 86836 - DNA, 86 bp, Mus musculus
gtactggggtgagagaagacactgcggaggatgagagccctggtatgagtctttgccagcattctctgcatgttggaacccagtgc

SEQ ID NO: 86837 - DNA, 82 bp, Mus musculus
aggggaaaagttcaaatcacaggaattttgaaatttgtcggaattggtcaatgcagttgctgtggttgaatgcttttgtcct

SEQ ID NO: 86838 - DNA, 85 bp, Mus musculus
atttcctgcagctttaagcatatatatgtatataattcatattttggtatgatatataaatcttatgtatcttaaattaggaaat

SEQ ID NO: 86839 - DNA, 76 bp, Mus musculus
gctgcatgtatcgttatctgtattggccaggctctctcagagcctctcaggacagctataccatgctcctgtcagc

SEQ ID NO: 86840 - DNA, 107 bp, Mus musculus
ggtgaactgtttgggaaaatgaaggcgtgaccttggtgaagaaggagtatctctcactctgagactttgaggtttaaaaagttcatgccattcccagttaaatctct

SEQ ID NO: 86841 - DNA, 74 bp, Mus musculus
tatatgtgtatgtgtgtgcatgtgtgtatatatatgtgtgtatgtgtctatatatgtatatatgtatgtatatg

SEQ ID NO: 86842 - DNA, 62 bp, Mus musculus
tggcgctctagagcagcctggctccctaggagactggtgctttgtcactgtttctgagctca

SEQ ID NO: 86843 - DNA, 117 bp, Mus musculus
tacatagggagttccaggacagccagggctacatctctctgtctctgtctctgtgtctctctgtgtgtgtatatatatatagtgtgtgtgtgtgtgtgtgtgataatggagaggaga

SEQ ID NO: 86844 - DNA, 111 bp, Mus musculus
agcctggctatctttgtttgaatatttatggttagatacgaatatatatatatatatagtgtgtgtgtgggggggggggtttggacagggtttctctgtgtagccctggct

SEQ ID NO: 86845 - DNA, 107 bp, Mus musculus
tcaagatccttctggaaataatgatttctcttagttctcaaagtaaattatgaaatagtcatgtgtctggaagaattcacagagatttttaaaatcagatgtcttga

SEQ ID NO: 86846 - DNA, 88 bp, Mus musculus
gtgagcatgggaaatcatgtgtgtggtgctgtggacagttagcggtgttctgattttgttattattacacatactttcatattctggc

SEQ ID NO: 86847 - DNA, 106 bp, Mus musculus
gccttagtgcatggtgatctgataggatgcatgagacaatttcaatatttttgtatctgttgaggcctgttttgtgacctattatgtggtcaattttggagaaggt

SEQ ID NO: 86848 - DNA, 107 bp, Mus musculus
ggaaggaaggaaggaaggaagaaatcaatctcaagcagagagataaggatcagaggaatgatttatgggctctcaaaagggtgctggtgccttcctgacatcagacc

SEQ ID NO: 86849 - DNA, 79 bp, Mus musculus
ctatcacagaattcagtgtatacactctaatattgtctcatggaagacaaaattaggatgttatgctgctctgtggtag

SEQ ID NO: 86850 - DNA, 82 bp, Mus musculus
ctggagctgtggtctggaagagaacagaagccactgatgattgtaagcatactgttttctcaccaggaaggaagactcgcag

SEQ ID NO: 86851 - DNA, 95 bp, Mus musculus
tttactgcattaggatatgtatattcaaatggattaaatacatttttggtaaagtgatgtatttatgtgtgtacataaatgacttagggagtgga

SEQ ID NO: 86852 - DNA, 96 bp, Mus musculus
gggtgatgtccacttctgatcccagtttgttttcagatctggcaggatataggtgattttgacagcatgctgaaagcaaattgttgtgggttgtcc

SEQ ID NO: 86853 - DNA, 73 bp, Mus musculus
ggacatctcggttgactagtgtctgtgttctagtgatttacaacacatgatacataactcaaattccatgtcc

SEQ ID NO: 86854 - DNA, 114 bp, Mus musculus
tttggagttaatttttgtataaggtgatgaatatggatctgatttcatttttttttcatgtgaacattcaattttcatagcatcatgtgctaaagattatttattttttccagg

SEQ ID NO: 86855 - DNA, 100 bp, Mus musculus
ctcgtgtccgcccttgttgtgtctactgtttttctagaaatgggacaatctgtgtccactcccctttctctaactttggagcattggaaggaggtgcggg

SEQ ID NO: 86856 - DNA, 109 bp, Mus musculus
tgtgaaattgactataagggggctggagagatggctcagcggttaagagcactgactgctcttccagagatcctgaggtcaattcctagcaaccacatggtggcttaca

SEQ ID NO: 86857 - DNA, 87 bp, Mus musculus
gtgtggatgtgccatgggtgcatgggggtgagaggacactctccagtgttggtcctcagttctctttttgttaatggctgttctcac

SEQ ID NO: 86858 - DNA, 97 bp, Mus musculus
gctattgttagtagcttattcactggctgggatcctggtccagacagacagacagacagacagacagacagacagagagcttgcactgaacagcagc

SEQ ID NO: 86859 - DNA, 86 bp, Mus musculus
tctgagttacacagtgagactctgtctcaaaataacaagaaagtttagaaagatacattgaggcagtgttaccggtggataccaga

SEQ ID NO: 86860 - DNA, 225 bp, Mus musculus
atatatatatatatgtatatatgtgtgtgtatatgtatatatacatatatatgtgtgtgtatatgtatatgtatatatatacatatatgtgtgtatatgtatatacatatatatgtgtgtgtgtatatgtatatatatacatatatgtgtgtatatgtatatatatacatatatatgtgtgtgtgtatgtatatatatacatatatatgtatatatatatatatg

SEQ ID NO: 86861 - DNA, 132 bp, Mus musculus
caagggtatgtgtgtgtatgtatgtatgtatgtgtgtgtgtatatatatacatatatatacatatatatatgtgtgtgtgtatatacatatatatatgcatatatatatatatacacatacatacatatgtg

SEQ ID NO: 86862 - DNA, 135 bp, Mus musculus
gactcaccccctctgacagggaggggttgctttcccattcctccctgggtctgagggtctggagtccttgctatggctgtgcctgtgtcacacattcactcaggacttacaccactaaggtctccctcctctcct

SEQ ID NO: 86863 - DNA, 83 bp, Mus musculus
tacagaaggctcagtgtgtgtgtctttcattcacgaatccaaaacattaggcaggtgttgaggaacacacgctgtagctggta

SEQ ID NO: 86864 - DNA, 60 bp, Mus musculus
ggctggctggctgggtggctgcctcatgaactctgtggctctgcctgcttttgcctctcc

SEQ ID NO: 86865 - DNA, 109 bp, Mus musculus
tttttgaactgttaacacgatgtcagtgtggaatagagaagatatatacagtatattattatatatacagtacttctgccagacatgtatcatatagatagcttggaga

SEQ ID NO: 86866 - DNA, 85 bp, Mus musculus; identical to SEQ ID NO: 57439

SEQ ID NO: 86867 - DNA, 93 bp, Mus musculus
agcaattctctcttaaggttttaatgaggaacaaatgaaggtttattcattcattggctcattcactcactcagacattactggaggatagct

SEQ ID NO: 86868 - DNA, 85 bp, Mus musculus; identical to SEQ ID NO: 57470

SEQ ID NO: 86869 - DNA, 80 bp, Mus musculus
cagatttcagttattgttgttcccgatatctaactacataagtacataagggagattggagcacaacagagtgtggtctg

SEQ ID NO: 86870 - DNA, 114 bp, Mus musculus
ggaaagaaaattgacaaaaattcagacatctcagtgacaattttaacagtccagtggtatggaatgtattgaaatatccctggaagggtgaaggagaagttggtgtttctggct

SEQ ID NO: 86871 - DNA, 95 bp, Mus musculus
ttgtgaagctagggagaccatgagagaacatactgagggcattcagcattcagccatgggaatgtgatcttgggaagaagtcctagaagcagcag

SEQ ID NO: 86872 - DNA, 90 bp, Mus musculus
ccagttcagtggtctttcacgacagactgacgcgttgacactaactgttttgcactgtagtaagatcattgctatttcttcttaagctgg

SEQ ID NO: 86873 - DNA, 98 bp, Mus musculus
atgtagtttaagcaactacctatgtctgtgttactgtgtgtgtggcatgtgagtcctgggtcacagtaataagaggacttagtctgggtcttgatcat

SEQ ID NO: 86874 - DNA, 117 bp, Mus musculus
tcctccccactgggagaattagtgttctgataacatgctgcattttatgtatttcacatgtagcacttttttttttaatgatgtaggcaatactgtgagttaaccaatgaggatggg

SEQ ID NO: 86875 - DNA, 118 bp, Mus musculus
agcctgggctactaagtgaaaatgtgtctgaggggggaaatgttcaagtttctggaactatctgtctctgacacacttggcttgctcctctctctaggttacctctttgctaatccag

SEQ ID NO: 86876 - DNA, 88 bp, Mus musculus
agagtcaactgacataaagagagatcagagacagcaaaacgctgaataaatttagcctgtccttgatagatttgggttagtaagcttt

SEQ ID NO: 86877 - DNA, 95 bp, Mus musculus
ctgaggctgctcttttcaggtgagaagacactgagcttaggagctgcagctgttgggagtgtgtgtgtgggcggggcgggggggggggcataaag

SEQ ID NO: 86878 - DNA, 106 bp, Mus musculus
gttggaccatggtgtgcgtatgtatgtatgtatgtatgtatgtatgtatgtatgtatatgtgtgtatgtatgtatctatatgtgtgtgtgtatatcaagtccacac

SEQ ID NO: 86879 - DNA, 72 bp, Mus musculus
attattggtgcactgtatcagaaactatagacagacatgtctgtgtgtctctgtcagaattcactcagtaat

SEQ ID NO: 86880 - DNA, 82 bp, Mus musculus
gtattattaatttatctctggccttggaagcctcttggagctgggagctagttgaagctagattagatgaatgaattagaac

SEQ ID NO: 86881 - DNA, 103 bp, Mus musculus
tctcgacagggtctcactttgtagcctagactagccttgcatttgtgattttcttgctgtagcccaagtgctaggatttcaggcacgtgttatcatattgggg

SEQ ID NO: 86882 - DNA, 111 bp, Mus musculus
tatgtatacatatatatgtttgtatgtatatatatatatgtttgtatgtatacatgtatatatacatatatacatataatatatgtatacatatatacacataatatatgt

SEQ ID NO: 86883 - DNA, 102 bp, Mus musculus
cttagtccgtgttgatctggtaggatgcatgggacaatttcaatatttttgtatctgttgaggactgttttgtgaccaattatatggtcaattttggagaag

SEQ ID NO: 86884 - DNA, 61 bp, Mus musculus
aggagacaggcagcctggcgagtctatgcccaccatgagactgtctgtgaatctgtgtcct

SEQ ID NO: 86885 - DNA, 107 bp, Mus musculus
acaaacaggcaaatacttaaaaagtgtggttggtagattttatgattaggtgtgcatatttaattttgtaaaaaggtagctatcttccaaagtggttggttggttgt

SEQ ID NO: 86886 - DNA, 96 bp, Mus musculus
ctcactctcactctgtctcccctccctctcttacacacacacacacacacacacacacagagagagagagagagaaagagagagagagagagagag

SEQ ID NO: 86887 - DNA, 81 bp, Mus musculus
gctgtgtgtttgaaagtgtaggtcaatgagggtgattgcattcagaatttcatgatctgtgtagtggaacaaattgaaagc

SEQ ID NO: 86888 - DNA, 77 bp, Mus musculus
ttgccccccctcactctgtgtgtgtatgtgtgtgcgtgcgcgcacgcacgtgctcaggctgtcgtgcttggtagcaa

SEQ ID NO: 86889 - DNA, 70 bp, Mus musculus
gctgacactcagggtctgtctcagagtgtggctggacttaccaagacagacagactgagcatcttgaggc

SEQ ID NO: 86890 - DNA, 114 bp, Mus musculus
gacagtatttccaggcatatctcctattctctggctcttacattctttctgtgctctctactgtgtgagtgtgttctttgtggggagggggagaatgcaggtgttctagctatc

SEQ ID NO: 86891 - DNA, 80 bp, Mus musculus
cttaaccgcattgtctggcacgggcgtgtgcattccgaggcacctgtagagagtgtgcagagtgcaggcatgctgatggg

SEQ ID NO: 86892 - DNA, 118 bp, Mus musculus
gataaaacaggatggattgaagctgttttgaaagttggttttctcccttcagacatgaatatttatttatgtcgaaagtatttgcctctttggggacgtggtagatagttctgttctc

SEQ ID NO: 86893 - DNA, 80 bp, Mus musculus
agctatctctctctctctgtgtaatgtctggctatgagtttctatatttgtttcagggggaagattctctgatgatggct

SEQ ID NO: 86894 - DNA, 65 bp, Mus musculus
ggggacctgatgtcttcagatggggtgcatgaaattacctcgcaccctctgtgtcacagtgtacc

SEQ ID NO: 86895 - DNA, 104 bp, Mus musculus
gtcactctgacttttttttgtgtgtgtgtgtggaggtcttgattgtaaaatcactggaatgaagtctgcatttttagtcatgtagaagctaaaggaaagatgac

SEQ ID NO: 86896 - DNA, 74 bp, Mus musculus
aaagcaggagcctgaaggcagaaccatggagcaacactgcttgctgactcactctcaggctcatacttagcttt

SEQ ID NO: 86897 - DNA, 113 bp, Mus musculus
ggttgatgtgagtacatgcatgggtatgtgtaggggtgtgtgtgtgtgtgtgtgtgcgcacacacacacacacacggatacgtgaacacctgtgtgaagcaacataattggct

SEQ ID NO: 86898 - DNA, 81 bp, Mus musculus
gataaagcaggagcttgaggaatggctcagcagttaagagcactgactgctcttccagaggtcctgagttcaattcccagc

SEQ ID NO: 86899 - DNA, 59 bp, Mus musculus
gagtctactccaggaacggggtgccccatgggcctctgtgagcctgtctgagtgcactt

SEQ ID NO: 86900 - DNA, 91 bp, Mus musculus
ttatctgatagcttagcatctttggagtatgtatgtatgtatgtatgtatgtatgtatgtatggcatccctgactgcaggaagtcttatag

SEQ ID NO: 86901 - DNA, 70 bp, Mus musculus
ggctcaccgtgactcagtcttagaggtgaatttgatgcaaaatagactctgatgatgactggtcacagcc

SEQ ID NO: 86902 - DNA, 123 bp, Mus musculus
gacacgctgtttatcatcttcaggatgggctaggggagggtgtaagccaggcctattctgcagtgagaattcagagtgtccagcagttactttgaaccctgccatggtcacagtactggtaga

SEQ ID NO: 86903 - DNA, 73 bp, Mus musculus
gcagagacattaacatttaaggggtgatacatagtctccactgatggagtgctgggtgactcagtgtctcagt

SEQ ID NO: 86904 - DNA, 74 bp, Mus musculus
attggcttgtgtgggtgtgagttctgtgagagcagaggcaggtttggtaggtaccataccaggataaggccaat

SEQ ID NO: 86905 - DNA, 102 bp, Mus musculus
ctgattaaattgccgatgtgaagtcacactgtgtctgtgccagggctccagtgcatctgtgagtctggtcccaccagagtcggcttctcacaatcgtatcag

SEQ ID NO: 86906 - DNA, 66 bp, Mus musculus
gccccataagtagacagaatacttatcccctgcatctggactcctgagtctcattctgtctggggc

SEQ ID NO: 86907 - DNA, 94 bp, Mus musculus
ctaacatgtcaggctggagagatggctcagtggttaagagcactgactgctcttccaaaggtcctgagttcaaatctcagcaaccacatggtgg

SEQ ID NO: 86908 - DNA, 118 bp, Mus musculus
tgatcctgtgtggctggctgaattcctgcgactgacactacagactctctgtgaccctccctgggcagagagcttagtggggctgtccagtggaaagtcccgccagttctccaagtca

SEQ ID NO: 86909 - DNA, 111 bp, Mus musculus
catccttctatacactattacacttcagagaatcctctttcatataatatatttttttaaagacatgtatgcgtctgtatgattgtctctgtgtgtctgtatgtgtgggtg

SEQ ID NO: 86910 - DNA, 81 bp, Mus musculus
tgggatggcaggagaaagtctctggctgtgcctctctcaatgaagtgaagagcagcgaagatgaagactcactcgagacca

SEQ ID NO: 86911 - DNA, 70 bp, Mus musculus
atgcgtacatatgtgtgtatgtatgtatatgtgtgtatgtatgtatatatgtatgtgcatgtgtatgtgt

SEQ ID NO: 86912 - DNA, 75 bp, Mus musculus
ctcagatatcattcctcaggcagtgaccatcttgtttttgaagcagggtctctcactggctgagaactttctaag

SEQ ID NO: 86913 - DNA, 67 bp, Mus musculus
tgagtgactaaaggcaggcagagctgtgggcatggacacgcagtctggttaagtggatggttattca

SEQ ID NO: 86914 - DNA, 85 bp, Mus musculus
tcaggccacagagctatgctacttcactttctattaatgtgacaaacagcacagtcaagtgacagaggaaaggtttaggggctga

SEQ ID NO: 86915 - DNA, 104 bp, Mus musculus
gtggtccatgaagaatctctgtgttttatacctaactctgtgtggtaaagagatcccattgtaccatagacagacagctgagcacacgggagcaggagacccgc

SEQ ID NO: 86916 - DNA, 115 bp, Mus musculus
gttaggactggaattttgggtcatccaatactgaatgatgaaagcatgtagtgtctctttctctctgtcaatggttcttgtcatgatgtgatggcaagctgactttccaggtagc

SEQ ID NO: 86917 - DNA, 71 bp, Mus musculus
atggaaagaacagagagatgacactggtaccagtgaccccactgggacatggtttgctctccagcttccgt

SEQ ID NO: 86918 - DNA, 102 bp, Mus musculus
tatatatgttgtatgtaaatatatgtatatacactgtatatttatatatgtgtgcttagatatttgtacatacattatgtttatatatatgtgtagatcata

SEQ ID NO: 86919 - DNA, 97 bp, Mus musculus
agaatgttatgctagaggctggcttagcagttaagaacactgactcctcttccagaggacctggctgtaagtcccacatggcagtttacaaccttct

SEQ ID NO: 86920 - DNA, 90 bp, Mus musculus
gatgaaataagcatgtgatgtggtatattctttttatattaaggaaaggagaagtggagcgttaaaagaatgaattgctagtatttcgtc

SEQ ID NO: 86921 - DNA, 58 bp, Mus musculus
atgcatgcatgtatgtatgtatatatgcctgtatgtatgcatgtatgtatgcatgtat

SEQ ID NO: 86922 - DNA, 132 bp, Mus musculus
tgtggcattgcccttggtctgcttctgtctggtgccctctcctccactttcttccccaatggcactgtcagtctgtcattgaggacagctgccgcactggggtaaggttcccagtctgcactctggctacca

SEQ ID NO: 86923 - DNA, 116 bp, Mus musculus
ggagttaagagtatgtgttccgggggctggagagatggctcagaggttaagagcactgactgctcttccaaaggttctgagttcaaatcccagcaatcacatggtggctcacatcc

SEQ ID NO: 86924 - DNA, 115 bp, Mus musculus
gcttcaaacaaactatgaagacctggactcaaactcataactctctgtctctgcctctgctgggatcaagggtgtgaggccatcaagcctggctctcttccttttgtttgcttgt

SEQ ID NO: 86925 - DNA, 84 bp, Mus musculus
cacgattactgtcactatctctgagccacctgaggttttactccttagctgagctcttaagaggcatcatggcagagctcagtg

SEQ ID NO: 86926 - DNA, 119 bp, Mus musculus
gcttttcctgtgatgtatcgcttcttcagagagtattaaagatgttttgaatctattttttaggaatcttgaaaccgccagtggaacatttttgatgttgtagtaatgcttcgagctgc

SEQ ID NO: 86927 - DNA, 89 bp, Mus musculus
gactgaaaaagactacattagaggggctggagagatggctcagcggttaaaagcactgtctgctcttccagaggtcctgagttcaagtc

SEQ ID NO: 86928 - DNA, 75 bp, Mus musculus
tgcaccttgtccaatttgctgctgtctgctccctcccaggagcacaggcagacacagacacagacacagacagca

SEQ ID NO: 86929 - DNA, 81 bp, Mus musculus
cagtggctaaaccacagaagagagagagctatgggtgctggctaaggaattcatgatgtccctgaaggttgcagctcactg

SEQ ID NO: 86930 - DNA, 86 bp, Mus musculus
cttgggtactgaggatttgaactcaagtcttcgtgtttgcacaggaagttctcttacacactgagtcagttccttagcctctcaag

SEQ ID NO: 86931 - DNA, 65 bp, Mus musculus
tctgtctgtctgtctgtctgtcagtctcacgcacgcgtgcacacacacacacacactcagagaga

SEQ ID NO: 86932 - DNA, 83 bp, Mus musculus
agtataggatatatgcttgaaatctcagcacttaggaaacaaaaatatggggcttggaagttcaagaccatccatcctctgct

SEQ ID NO: 86933 - DNA, 70 bp, Mus musculus
gttatagcttgtctctggaagactagtggcttctctcagagaaaaccagtttcagggatatgccaagagc

SEQ ID NO: 86934 - DNA, 70 bp, Mus musculus
ctggctggctggctggctggctggctaggtgggtgggtaggtggctggctggctggctgggtggcttgcc

SEQ ID NO: 86935 - DNA, 96 bp, Mus musculus
gggagagatgtgatggagacaacctacttaggactgagtgttcggatgtctctcactctctgcacatagtccgacagtggatctctatttgttccc

SEQ ID NO: 86936 - DNA, 114 bp, Mus musculus
tagcatagttgaaataatatccttggtagccatttaaagttacaatgattttttttcttagagttgacagttattgcacagaatttgtactgagggtatctggtaaagttgttg

SEQ ID NO: 86937 - DNA, 90 bp, Mus musculus
gctgcaaccacatctgtcttggtcaggctctgacagtttctcagaaaacaactatcaggcgcctgtcagcaagcacttcttggtatcagc

SEQ ID NO: 86938 - DNA, 103 bp, Mus musculus
gaatcatcctaaatgggggctgagagatggctcagtggttaagagcactaactgctcttccagaggtcctgagttcaaatctcagcaaccacttaggtggctc

SEQ ID NO: 86939 - DNA, 81 bp, Mus musculus
gtttttgtctgctcattttgtagttcttttatttgagttaaatagaagtaactgggagtcaagaggagaaagatagaagac

SEQ ID NO: 86940 - DNA, 94 bp, Mus musculus
tgttggattatagatatggttcagtgaaagtatgtaaggcacacagcatgtagcataatatgattgaatagtagtatttaataaccttccagca

SEQ ID NO: 86941 - DNA, 96 bp, Mus musculus
cagtaaatggatagcatgcattgaagcatacacagtatttgaggttacaaatcactctgtctgtctgtctgcctgcagctcttctttccatttttg

SEQ ID NO: 86942 - DNA, 106 bp, Mus musculus
ctgaatcttggaaggaaaaagtatatgtgtgaggtatgcatatatacatctatatgtatatatttatgcattatatacaatatattagtgttctattgatgtgaag

SEQ ID NO: 86943 - DNA, 77 bp, Mus musculus
gcatccataagtctggttgtagggtattttcttgattagtgactgattacagagggtccaatccattttattggtgc

SEQ ID NO: 86944 - DNA, 118 bp, Mus musculus
ctgttacaatttttccctgagagattaatttcttttgtttcttttccatcttacaagtctattttttagattgttttgtctattaggcaaatgtgttgagctcagtgagtatacacag

SEQ ID NO: 86945 - DNA, 64 bp, Mus musculus
ctcagagtcagtcactgtgtggctcccaggctccaggatctagacagtccttctccctcttgag

SEQ ID NO: 86946 - DNA, 73 bp, Mus musculus
gtgtatgtgtatgtgtatgcatatgtgtatatgtatatgatgtatatgtatatgtatatatgtgtctgtgtgt

SEQ ID NO: 86947 - DNA, 88 bp, Mus musculus
tttgtctcatgctctctctctctctaagatacaggaccaaagcagactgaatggctccaattatcagaatgtgaaagcatgagtcgga

SEQ ID NO: 86948 - DNA, 139 bp, Mus musculus
agcatgctagcctcttaaaacacgtttctcaagattaaagttcttcttaatttatttattaaaagtgataggaatggagagatggctcagaggttaagagcactgactgctcttccagaggtcctgagttcaatcccca

SEQ ID NO: 86949 - DNA, 68 bp, Mus musculus
gtgtgtgtgtgtgcactcatgagttcacgtgtttgtgtgcatgtgtgtgtgtgtgtgtgtgtgtgtgt

SEQ ID NO: 86950 - DNA, 104 bp, Mus musculus
actgagtggagatcagaacttcgcctgagacttgctcacagaagatactgtgctctgctccgtgatgaggaaccttcatcctcacgggcaagaagtgttctctg

SEQ ID NO: 86951 - DNA, 69 bp, Mus musculus
agagtgagtagttagtgaacacaaaaggaactcaatgtttggggttcttttgtggacctgtttcatttt

SEQ ID NO: 86952 - DNA, 81 bp, Mus musculus
gttatctgtctgtctgtctgtcttgtctgtccattcatttgagaagactaaaaaaggcaataaaagcagggcagcagtggc

SEQ ID NO: 86953 - DNA, 94 bp, Mus musculus
gctgcctctgggaccctgagatccttgtgtgaccaagttcctgggatcatgtaatcctgtgagcctgtgtccctgggtgtgttagagtgcctgc

SEQ ID NO: 86954 - DNA, 109 bp, Mus musculus
gcaagcttacctgaacagctgtgcctggcatccctgtctctgtgtgtccctgcagaaggtggtcctcacgggagaagatgctatttattactcctcagccgagctgagc

SEQ ID NO: 86955 - DNA, 90 bp, Mus musculus
acttaatgaataatccagagagcacacacagggctgcaggtgacagaaagccgtggcttccactgatttttctctgctactcatggtagt

SEQ ID NO: 86956 - DNA, 103 bp, Mus musculus
tgggttatgaggaacagcaaccaagcctctggagcaagcttttatctttattaataaagttgaatcactcaagaaagcactggtgcatcttgtcatgttccca

SEQ ID NO: 86957 - DNA, 96 bp, Mus musculus
atatgtgtgtgtatgtgtatgtatgtatatatataatgtgtgtatgtatatatatacatatatataaaatatgtatgtgtatatatattactaacg

SEQ ID NO: 86958 - DNA, 105 bp, Mus musculus
ccaattaaatacattcaaggcaagggtatttaagtatgcaaatagtatgtaaaatgcaaagatgctgtgtgtattttaaagatttcttctatggggtagtgctgg

SEQ ID NO: 86959 - DNA, 114 bp, Mus musculus
gagttaacgcaaccacaacagtgtgtattccctgagcttcaacgtctctcaaactctgactcatgggagactttggaaagctttgggagagctgctagttagtgcagttatttc

SEQ ID NO: 86960 - DNA, 76 bp, Mus musculus
atgtatgtatgtatgtatgcatgtgtgtatgtatgtgtatatgtatgtatatatatgtgtgtgtgtgtatatgcat

SEQ ID NO: 86961 - DNA, 93 bp, Mus musculus
gtttgcctgcctgtctgcctgcctgcctgtctgtctgtccatgtgcaggagcgtgggactggccaacagagctggggtaggtataggcaaaac

SEQ ID NO: 86962 - DNA, 100 bp, Mus musculus
tcctatgacttggcttaacagagtgctagtagcttctatagacgaacgtctagaatatcagatggagggatggaggattgtggcaggtggccaacaagga

SEQ ID NO: 86963 - DNA, 92 bp, Mus musculus
ccagccctgccttccaaaacagctcctgttctgagcacaacaggcagaaagcaaacctggacagactgcagagagtgtggacttaaactggg

SEQ ID NO: 86964 - DNA, 88 bp, Mus musculus
tgtatgtatgtatgtatgtatgtatatctagtaataatctatatgattatatactaaatgatatattatatatgtgtgtatacacaca

SEQ ID NO: 86965 - DNA, 88 bp, Mus musculus
tgctatgaacatagaggaacacttgagtttttgatcctagtcattctgattggtgtgaggtggaatctcagggtcgttttgattggca

SEQ ID NO: 86966 - DNA, 105 bp, Mus musculus
aaagaaaaaatataattcagctggtattctatccagtatcattagagattattttctttttgaatgcacgggatcaagaatgaagtttaagtatataatgttttt

SEQ ID NO: 86967 - DNA, 103 bp, Mus musculus
ggagtattcaatcattttctccttttaatgaaaaattgtttgtagttattggtagagccagagttacagttattgttctcggaagatagataattattgctcc

SEQ ID NO: 86968 - DNA, 66 bp, Mus musculus
tcctacttgtgtctgttactcactctcaaaattagagggggttgacaggacatgaatacagtggga

SEQ ID NO: 86969 - DNA, 138 bp, Mus musculus
gtatacaaaatgtctgtgtatatatgtatatgtatatatataaatgtatatatgtatatatatacacatacatatatatatgtatatatacatatatacagacattgtgtgtgtgtgtgtgtgtgtgtgtgtgtgtgt

SEQ ID NO: 86970 - DNA, 67 bp, Mus musculus
atatatacatacatatatatataaatatatatacatatatgtatatgtatgtgtatatatatatatg

SEQ ID NO: 86971 - DNA, 113 bp, Mus musculus
tggagttacagactgttgtgagccactgtgtaggtactgacaatcaaaatttaggtctctggaagaattgtgagtgctcttaactgctgagctccggcttgtatgtgttttta

SEQ ID NO: 86972 - DNA, 112 bp, Mus musculus
acattttaaggtaggttattaaaagaggcaaatgcatttctccaaatggtgggagctggctagattccacgtacacaggagaaggtgcttgcttgcttctttcttggagtgt

SEQ ID NO: 86973 - DNA, 61 bp, Mus musculus
gctatcacagtcagtgtgctgagaaggatacaatccagtctctcaggctgtctgttccagc

SEQ ID NO: 86974 - DNA, 78 bp, Mus musculus
aagcaacatttgtctctgtctctgagtgtttaaggatttaacatgaatatagggtcagtgttcagcagatggtggctt

SEQ ID NO: 86975 - DNA, 85 bp, Mus musculus; identical to SEQ ID NO: 57439

SEQ ID NO: 86976 - DNA, 116 bp, Mus musculus
taaaaactctttaacttttttcttatttcttctttgacccagtggtcattgagtagagaatttgttcaatttcctggagtttgaggtttgtaggctttctgttgtttctgttattg

SEQ ID NO: 86977 - DNA, 85 bp, Mus musculus
ggctatggtggtctgataggatacataagacaatttcaatatttttgtatctgttgaggcctgttttgtgaccaattatatggtc

SEQ ID NO: 86978 - DNA, 117 bp, Mus musculus
tcttcccttggcttcctttggttttcttatctgtatatttttctgaattataacactgtcagcttaggattgatttgcagaagatagaaaactactttcagagcaaaggagatttga

SEQ ID NO: 86979 - DNA, 85 bp, Mus musculus; identical to SEQ ID NO: 57439

SEQ ID NO: 86980 - DNA, 81 bp, Mus musculus
tagctgtgtctgtgtctgtgtgttataagaaaaaggctgggtttcatttcttaaagcaatcaaatggccacagaagcacta

SEQ ID NO: 86981 - DNA, 102 bp, Mus musculus
aagttgccttggtcatggtgttttgtcacagcagtcaaaagttactgtgacagccactgtcacagtgataactctgttgatacatgtacatgaggggcactt

SEQ ID NO: 86982 - DNA, 56 bp, Mus musculus
ggggctggggagatggcatgatagttaagagaactgactgctcttccagaggtccc

SEQ ID NO: 86983 - DNA, 86 bp, Mus musculus
ctggtgagtgcagacagagtgcagacatgtgctggggatgaggggtatcactaaaggagtgcctggactctgtgggggcttctcag

SEQ ID NO: 86984 - DNA, 102 bp, Mus musculus
atgagattttactgattgatttgattgaatagagtgtggacatggtgcagaatttggctgttaagtgatgcagttgttcatcaaatatcacagtatgcttat

SEQ ID NO: 86985 - DNA, 96 bp, Mus musculus
tctctgaacacttggtaactcaagaggcagctgcaatgaagtgagaaatttattttttcattctgaaagactgagatctggactggaccacaggga

SEQ ID NO: 86986 - DNA, 85 bp, Mus musculus; identical to SEQ ID NO: 57439

SEQ ID NO: 86987 - DNA, 117 bp, Mus musculus
ttctgtggcctatgtttatgtttatctttttcatatgtatgtaagatttctccaagtttgtttttttttaagcatcttttgtagtgctgctctgttgagggtaaaaatagtccagga

SEQ ID NO: 86988 - DNA, 90 bp, Mus musculus
caggacatattgtgctagaatagttgtctctacaactgagagaacatacagtggagaagatgactacaatgctaagaacaagtaaaactg

SEQ ID NO: 86989 - DNA, 80 bp, Mus musculus
cagggacccacatagaaacttaactgcatgtctgctacatatgtgcctgggacctcagttcagtctctatgtgctctttg

SEQ ID NO: 86990 - DNA, 112 bp, Mus musculus
ttatatacattctctctctctccatatatatacgtgtatgtgtgtgtatgtatatatatgtgtgtatgtatatatatgtgtatgtatatatatgcttctcattatgtagtaa

SEQ ID NO: 86991 - DNA, 85 bp, Mus musculus; identical to SEQ ID NO: 57439

SEQ ID NO: 86992 - DNA, 104 bp, Mus musculus
tatatgtatatatgtgtgtatagtgtgtatatgtatatatagtatacagtatatgtataaattatatatatatatacacaaaagatatttgataaatgcaaata

SEQ ID NO: 86993 - DNA, 85 bp, Mus musculus; identical to SEQ ID NO: 57470

SEQ ID NO: 86994 - DNA, 101 bp, Mus musculus
ggtaaactgtgtgaaggtggcaagataccactggggtgatactgcagtgtctgcacatctgtcttgctgtcagactcactctgcaagttctctttcctcag

SEQ ID NO: 86995 - DNA, 85 bp, Mus musculus; identical to SEQ ID NO: 57439

SEQ ID NO: 86996 - DNA, 85 bp, Mus musculus; identical to SEQ ID NO: 60912

SEQ ID NO: 86997 - DNA, 85 bp, Mus musculus; identical to SEQ ID NO: 57470

SEQ ID NO: 86998 - DNA, 78 bp, Mus musculus; identical to SEQ ID NO: 63566

SEQ ID NO: 86999 - DNA, 106 bp, Mus musculus
tccacgtctgctgtcgtctgctcgtgtgtgttcttgtactaggttgtgtctgtctcactcattcacatttcctgcttacattatgccttgccatgcggtccttgga

SEQ ID NO: 87000 - DNA, 115 bp, Mus musculus
cccttgcctacctatctaaacagagagtcaatctgcagctcactgctgactctgtgttggagtcacagacatgggagacctcccctgcctagggggaggtgactttaaggactcc

SEQ ID NO: 87001 - DNA, 83 bp, Mus musculus
cagtaggtatggtttcaaaagatgtctggagagtcagtacccatcttgttttctgggacactacagatatttctatgtcattg

SEQ ID NO: 87002 - DNA, 107 bp, Mus musculus
ggctttatagtaggtttttgcctttacttgatgtgactgggtgtagcatatatatatatgtctgtacaccctatgtgtacagtgcctttggaggacagaagggagcc

SEQ ID NO: 87003 - DNA, 72 bp, Mus musculus
cctgagctatgtgaaactgtctcaaaaacgaagctgttcattcagacagtgagcacagaggctacactatgg

SEQ ID NO: 87004 - DNA, 108 bp, Mus musculus
tgaatttttatatccacaagccccaaaggtctcctctttccatcaagtaacaactctgagagtcaagagtgtgtcctgagaactgcttatgtccaggatactaattca

SEQ ID NO: 87005 - DNA, 87 bp, Mus musculus; identical to SEQ ID NO: 60417

SEQ ID NO: 87006 - DNA, 64 bp, Mus musculus
tatgtacatgcatatatgtatttatgtgtgcttgtacgtgtgtgtgtgtgtgtgtgtgtgtgtg

SEQ ID NO: 87007 - DNA, 94 bp, Mus musculus
tgaggtagatgttggagtgggccaactcaaagccctgaatctgtatctggatctggatggaaactgagatggtcagccctacagctctcctgca

SEQ ID NO: 87008 - DNA, 70 bp, Mus musculus
catgtttgtctgtgagcatctgcatctgtcccagtcagctgctagtagagcctctcagaggacagccatg

SEQ ID NO: 87009 - DNA, 115 bp, Mus musculus
gacctgggcagttataccttggaaattttggttgttaaaggtaagcaaagaatagatagacatctgataatgttgaaaattaaccaaagttgagttccacaagtgattgaagttc

SEQ ID NO: 87010 - DNA, 114 bp, Mus musculus
aaggcacctcaaacccttatttattcaagttgaattgggatgcttgtctgaacattctgaccacacagccagaaagaccaatgccaataagctttgaacagggccccaggactt

SEQ ID NO: 87011 - DNA, 122 bp, Mus musculus
ttgaaatgtactctctctgtctctatctctgtctctcacacgagctggcatgcacagtgtgtgtgtgtgtgtgtgtgtcacagtgtggaatggatgtcagaggacaaatggatgtcagagga

SEQ ID NO: 87012 - DNA, 114 bp, Mus musculus
tatgtgtgtatatatgtgtgtgtatatatatgtgtgtgtattatatatgtgtatatatatgtgtgtgtatacatatacattgtatatatgtatatatgcatatataaatatcat

SEQ ID NO: 87013 - DNA, 61 bp, Mus musculus
atgcataatatatatttatatagatacatatgtgtatgtatgtatgtatgtatgtatgtat

SEQ ID NO: 87014 - DNA, 85 bp, Mus musculus
ggccatggtggtctgataggatacaagggacaatttcaatatttttgtatctgttgaggcctgttttgtgaccaattatatggtc

SEQ ID NO: 87015 - DNA, 118 bp, Mus musculus
ctgagcttctagatttttagctggatggatagtttaatgtggaaattaacaaaaggaagttctctctctttctctctggatgcactatggttcaacttttctatctggtctcaggatt

SEQ ID NO: 87016 - DNA, 88 bp, Mus musculus
gtcaaggtgagggcatcagataatgttagtgtcctattaaagagagtacacagagggctctattcctgctgccatgatttactgagac

SEQ ID NO: 87017 - DNA, 120 bp, Mus musculus
gtatatgtgtgtatatgtatatgtgtatatgtatatgatgtatgtgtatatgtatatatacaatcggtatatatatgtatacacacatatatatttgcacatatatttacaatgcatata

SEQ ID NO: 87018 - DNA, 87 bp, Mus musculus
cagtgattgcttttcttgtgaggcagaattttgttttattttctaagactaaagacagaagtggggaaacaagattgcaaaacactg

SEQ ID NO: 87019 - DNA, 106 bp, Mus musculus
tagaagtaagagaaagaattgtgccaatctcattctcagtcactcaggctctagatgtcagccacagtgaaggaatcggccttttactacctcctctccctgtctg

SEQ ID NO: 87020 - DNA, 102 bp, Mus musculus
gtttgaagatgtacttataccagtatcttgtggttagttggacattttatttacttatgagcatagtctctctctgtctactgaattgtatatgtttcaaac

SEQ ID NO: 87021 - DNA, 58 bp, Mus musculus
accagggctgtgactacagcctgtggagagactctttctcacaggctgattccctggt

SEQ ID NO: 87022 - DNA, 104 bp, Mus musculus
ggatgtcctggagctgctctgtaaccaaattggcattgaactcacagagatctgcctgcctctgtctcccagtgctgggattaaagttgtgagctcccataccc

SEQ ID NO: 87023 - DNA, 110 bp, Mus musculus
gaaggggtaccaggaatggggagggaacatttggaatgtaaataagtaaggcaacttaattaaaaagttactttgtttaattgctcatggctccctttcattctctcctg

SEQ ID NO: 87024 - DNA, 107 bp, Mus musculus
gccaatgtgaggataatgggagatgttcactctaaactccgaagaagctcattgttgtgtggatggagctggcaaacaacatctttgtttagattagtacatgctgc

SEQ ID NO: 87025 - DNA, 85 bp, Mus musculus; identical to SEQ ID NO: 58391

SEQ ID NO: 87026 - DNA, 75 bp, Mus musculus
gtgtttatgtctgtctgtctgtctgtctgtgtgagttatgcacaaatgactgcagatgcccacagatatgggcac

SEQ ID NO: 87027 - DNA, 98 bp, Mus musculus
aggagcattttctcttctggtctagtctaaatggtgttctataagctttttgtatgtttatagacatctctttctttagtttgggaatgttttcttct

SEQ ID NO: 87028 - DNA, 85 bp, Mus musculus; identical to SEQ ID NO: 57470

SEQ ID NO: 87029 - DNA, 85 bp, Mus musculus
gtccatggtggtctgataggatgcatgagacaatttcaatatttttgtatctgttgaggcctgttttgtgaccaattatatggtc

SEQ ID NO: 87030 - DNA, 85 bp, Mus musculus; identical to SEQ ID NO: 57439

SEQ ID NO: 87031 - DNA, 86 bp, Mus musculus
ggccatggtggtctgataggatacatgggacaatttcaatatttttgtatctattgaaggcctgttttgtgaccaattatatggtc

SEQ ID NO: 87032 - DNA, 67 bp, Mus musculus
tatgtagctctattctagaacattctataacatgctatatatagaacattctagaacatgctatata

SEQ ID NO: 87033 - DNA, 94 bp, Mus musculus
gggttataatgttttgcagtatatttcattattttctggtagaatttgtagtgttattaaagttactttcagaaatgctgcatgggcagaactt

SEQ ID NO: 87034 - DNA, 78 bp, Mus musculus
ggctcctctccatttccatccctgtaattctttcagacaggaaaaattatagatcagagatgtgactgaggaatggcc

SEQ ID NO: 87035 - DNA, 111 bp, Mus musculus
ccctgagaggcactgccagaacatgactaatacagatgaggatactctcagccaaacatcagactgagcacagggactccaatgtagaagttagggcaaggactgtaaggg

SEQ ID NO: 87036 - DNA, 72 bp, Mus musculus
tagcagacatgcagcttagtctctgtgtgagtcccccatcaactggagagggagctgtccctaaagctgttg

SEQ ID NO: 87037 - DNA, 85 bp, Mus musculus; identical to SEQ ID NO: 57439

SEQ ID NO: 87038 - DNA, 84 bp, Mus musculus
ctgagctttggggccattaaccacttttcagatatatatatatataccatgtgtgttctcttgtgtctgggttacctcactcag

SEQ ID NO: 87039 - DNA, 78 bp, Mus musculus
gcatatgtctatttgtctacatgtatgtgtatacatatgtgtatatgtatatatgtaggtatatatatggacacttgt

SEQ ID NO: 87040 - DNA, 91 bp, Mus musculus
gtgaagaaatatgaactatcaggctgcagagatggctcagtggttaagagcactgactgctcttccagaggtcctgagttcagttcccagc

SEQ ID NO: 87041 - DNA, 111 bp, Mus musculus
aacagatgcatcttctggagaagatcctaggtgaatctctcctcagcagctttttgtcagatgtttcctatcctagctgatgtttctctcagatatcttctgctttctgtt

SEQ ID NO: 87042 - DNA, 119 bp, Mus musculus
tttgcaagttaagtggaagttttgcaaattgataggctgaattaagtcagaatttttcattattgtttcaaacttttgttccatttcttatctttgggttcattcactattcttgggga

SEQ ID NO: 87043 - DNA, 119 bp, Mus musculus
atttcctttacctacttgtttcagttcttttgtttacacgatagctatgtcctttcatcagggtgtggtagctgtttgtaacacacttaagcactcatgacacaggggcactcagaaat

SEQ ID NO: 87044 - DNA, 85 bp, Mus musculus
agggagacttctatgactctgaggttaacatgatgttacatgtctgggaaagtaaaatgttggaagattctagaagatagcccct

SEQ ID NO: 87045 - DNA, 102 bp, Mus musculus
ttattcagtttagtcatcagtatttggcttgtccttaagtatatgtttctatatatctacttgtgggatatcaaccaaggacattaaatgctaaatgaatag

SEQ ID NO: 87046 - DNA, 116 bp, Mus musculus
ttgactttttaaaaacagtttgatgtgggcactggagagatggcttagagtttaagagcactgactgctcttccagaggtcctgagttcagttcccagaaaacacatggtggttaa

SEQ ID NO: 87047 - DNA, 90 bp, Mus musculus
ggtatgcctatgctccttcctgtggtataaggacatgaaatgattttatttcttaacttatagctacataaggtaaatatatgcaagact

SEQ ID NO: 87048 - DNA, 96 bp, Mus musculus
gatcagtcttaggccatggtggtctgataggatacatgggacaatttcaatatttttgtatctgttgaggcctgttttgtgacctattatatggtc

SEQ ID NO: 87049 - DNA, 105 bp, Mus musculus
acttagtgcatggtgatctgataggatgcatgggacaatttcaatatttttgtatctgttgaggcctgttttgtgacctattatgtggtcaattttggagaaagt

SEQ ID NO: 87050 - DNA, 85 bp, Mus musculus; identical to SEQ ID NO: 57439

SEQ ID NO: 87051 - DNA, 85 bp, Mus musculus; identical to SEQ ID NO: 57439

SEQ ID NO: 87052 - DNA, 79 bp, Mus musculus
gcagcctctctgtcacagtctgttacctgtaccatgagagattcagagcagccatctacagactcgtacattaagctgc

SEQ ID NO: 87053 - DNA, 85 bp, Mus musculus; identical to SEQ ID NO: 57439

SEQ ID NO: 87054 - DNA, 64 bp, Mus musculus
agccacattgagctataggttgctcctcactggaatgtatagctttgtgtatcttaaaatggct

SEQ ID NO: 87055 - DNA, 99 bp, Mus musculus
cagaggcctcatatcagctagtgtatgatgtctggttggtggctcagtgtctgagagatctctggaatccagattagttgagactgaatttggtctgtg

SEQ ID NO: 87056 - DNA, 83 bp, Mus musculus
tcactcacataacacatatatatacatatgtatatatatatatgtgttcatatatatgtgtatatatatgcatatgaacatga

SEQ ID NO: 87057 - DNA, 102 bp, Mus musculus
agatcagccttattccatggtggtctgataggatgcataggaaaatgtcaatatttttatatctgttgaggcctgttttgcgaccaattatatggtcaattt

SEQ ID NO: 87058 - DNA, 108 bp, Mus musculus
aatccaagtcatcaatatacaatgtttgttctgtctgtctgtctgcctctagggtgcacagtaacagttcacagagaagaatacaataatggcagttggcattgggtt

SEQ ID NO: 87059 - DNA, 107 bp, Mus musculus
tgtatatatatatgccatcattattgctactatatatcacaacaataatgtatatatattattataataaatatatattagcaataatgatggcatatatatataca

SEQ ID NO: 87060 - DNA, 85 bp, Mus musculus; identical to SEQ ID NO: 57470

SEQ ID NO: 87061 - DNA, 102 bp, Mus musculus
tccctcctggcagagatgaaggcctgaaataggacctgtcccagaagctgttatcttctgtagatcctacactctcacctgcacagactagtctcagaggga

SEQ ID NO: 87062 - DNA, 65 bp, Mus musculus
tgctatatatacatgtgtgtgtctgtgtgtgtatgaatatcagaacacacatatatatgtataca

SEQ ID NO: 87063 - DNA, 118 bp, Mus musculus
ccacttaaggctgagcattcaacagtgcaattattatgagagtttttatgtctttgtttaacatagaaattgttcagtgttttcttctctagttgtgccatcccattttggttttagg

SEQ ID NO: 87064 - DNA, 118 bp, Mus musculus
gagagagagagagagagagagagagagagagcatgtagttgattgaagctttttttttcatttttgagagttttcattctaaattacttttttcctccctattcttttcccctatctc

SEQ ID NO: 87065 - DNA, 93 bp, Mus musculus
ttactttttgttgagttctgcttgaacttaagaacatagagttataaaattgtccatgtttttaatttttttcaagcagttattagtaagtga

SEQ ID NO: 87066 - DNA, 85 bp, Mus musculus; identical to SEQ ID NO: 57439

SEQ ID NO: 87067 - DNA, 85 bp, Mus musculus; identical to SEQ ID NO: 57439

SEQ ID NO: 87068 - DNA, 67 bp, Mus musculus
tctgtgaggaaagggaaataagcatgtgacacatactgtgtcactcagtgtggtctgtgcttacaga

SEQ ID NO: 87069 - DNA, 104 bp, Mus musculus
ttactatatttagtatttttacatgaatattataattttgttatatatatttatattgagtatataattaatgtgatattcatgtgttatataaattataataa

SEQ ID NO: 87070 - DNA, 108 bp, Mus musculus
tctgtaccccatatttaatagaggtatttgattctcgggattctaacttcttgaattctttgaatatattaaatatcagccctatattgaatgtaggattggtaaaga

SEQ ID NO: 87071 - DNA, 85 bp, Mus musculus
tctgtctgtctgtctgtctgcctgtctcatctgtgtaatggcaggggtaagaaaatgtgaaggcttaatggagaagggaaccaga

SEQ ID NO: 87072 - DNA, 111 bp, Mus musculus
tgtcatttgcttatatcaacaatttcttaatttgcctcatcataagaattttaataaatcttaattgagatgttcatattaagagaggatttgatccaccttcagatgaga

SEQ ID NO: 87073 - DNA, 91 bp, Mus musculus
ggccttcctctagtttacaatgcttctttccttctatgagatgaagtagactgcttctctcacagtgactgacagtggattggcatatgcc

SEQ ID NO: 87074 - DNA, 87 bp, Mus musculus
tgtactataatctgtgtgagaacgttgggtattttgtcagtgctatcaatgtacacaaacactgacacaccctctcacactggtaca

SEQ ID NO: 87075 - DNA, 115 bp, Mus musculus
gagacattttctgcatccaaatatgaataaatcagatattcatggtaacctgcctgttttcattttgaagttctgtttgtgtgagagtgtttcatgctgcagaaatgaagctggc

SEQ ID NO: 87076 - DNA, 115 bp, Mus musculus
gttgagggtttagtgagtggtacttaaattctctgaaagcctttgagtacagagagaccacatacttgggataggttaaattataggatttagtaaatttattacataagttgac

SEQ ID NO: 87077 - DNA, 64 bp, Mus musculus
gtgtgtgtgtgtgtgtatatgtacatgtgggtatacatgtgtatatatgtatatacatgtatgc

SEQ ID NO: 87078 - DNA, 134 bp, Mus musculus
acacatgtatatatgtgtgtatacatttgtgtgcatgtatatacaagtatggcatatgtgtatatatgtatatgtacatgtgtctgtgtgtgtgcatgtgtgtgtgcgcacatgtgtatgttagaagccagtgt

SEQ ID NO: 87079 - DNA, 104 bp, Mus musculus
ataggcctcaggagaagaaaagcttgtatgtatgtatgtatgtatgtatgtatgtatgtatgtatgtatgtatgtattatctatctatctatctatctatctat

SEQ ID NO: 87080 - DNA, 85 bp, Mus musculus; identical to SEQ ID NO: 58174

SEQ ID NO: 87081 - DNA, 79 bp, Mus musculus
gattccaagtctgaggaagcagcaagaaactgtagctcagcagcagaagtttttggtgagtctctctctctatggagtt

SEQ ID NO: 87082 - DNA, 59 bp, Mus musculus
gtttactgttgttacacacacacacacacatgtgtgtgtgtgtgcctctgagtgtgagc

SEQ ID NO: 87083 - DNA, 111 bp, Mus musculus
tctctatctaactatcatctaaggacataatacatacatatacatatatatgtatccatgtatatctatatatatgtatgtgtaatgtggatatctagccaaaaataaaga

SEQ ID NO: 87084 - DNA, 64 bp, Mus musculus
ctaatatgagagtgagctatgtcaaggagccatacccttggcagacactcacacacatacttgg

SEQ ID NO: 87085 - DNA, 76 bp, Mus musculus
ggtctctgatgtgacagagctcaggtgcagggagaatattttacatagggagctttgtcagctacaatcaggaatt

SEQ ID NO: 87086 - DNA, 77 bp, Mus musculus
gagagtcagggagttggttcaatagttagtgctgtttgcatttgtacctgatgaccagagtttgacccctggcaatc

SEQ ID NO: 87087 - DNA, 82 bp, Mus musculus
ggctgagatctaacatccaagtattgactttctatggagggaaggaagttgaatggaggttaaggttgtaggttgcaaagcc

SEQ ID NO: 87088 - DNA, 72 bp, Mus musculus
gtatatatatgtgtgtgtgtgtttgtatatatatgtgtgtgtgtgtgtttgtctatatatatgtgtgtgtat

SEQ ID NO: 87089 - DNA, 66 bp, Mus musculus
tgactacagatgcaatgtggcaagctggttcccaggtcttgctccatccttctctgcctgttgtca

SEQ ID NO: 87090 - DNA, 73 bp, Mus musculus
ttctcaactgaggaatgttgaatggctgagaagcaccttaaaaaaatgttcaacattctcagtcatcagggaa

SEQ ID NO: 87091 - DNA, 109 bp, Mus musculus
actaggataaaagtaggtatcagagagggagattgctattatgatagatctgaccacggtaagtctgtctgtctgtctgcctgtttttatttatttatttttggagggt

SEQ ID NO: 87092 - DNA, 116 bp, Mus musculus
ttcagaggatttaatacacatctctcaaataccatggagtcaggatgaagaacagtattttaatatttgtttctaggttcactggccccatgctatgtttgtggtttggttctgga

SEQ ID NO: 87093 - DNA, 85 bp, Mus musculus; identical to SEQ ID NO: 57439

SEQ ID NO: 87094 - DNA, 61 bp, Mus musculus
ggtttgaggctgaggtagtaggattattagcctgcttctgctacctagtaagactctagcc

SEQ ID NO: 87095 - DNA, 82 bp, Mus musculus
ttgccatggaaaagttcttttctggtcaagtctatttgatgttgtaaatgcctttatgattagagttgcatttccattgcag

SEQ ID NO: 87096 - DNA, 98 bp, Mus musculus
aggctgcagaaacatttttgtatgagtcttttgtggatctgtatttttatttctgtgagaagaattgctgaaatatacagaaattggttttgaagtgt

SEQ ID NO: 87097 - DNA, 117 bp, Mus musculus
ggagcctgtctttcctgtgatcctggttgtgtcagaacttctctgagtcaaactgtctctgtgatcctgtgattttgggattctgcaatcctgagatcctgggtgtgtcctagctct

SEQ ID NO: 87098 - DNA, 107 bp, Mus musculus
cagcattcatggggaaagtttttaattcatatcttttaaaaattaatcaaactggcagaaaacagtgagttcagaaagagctgagtatcattccaaaatgaagcctg

SEQ ID NO: 87099 - DNA, 83 bp, Mus musculus
ctgtatggctactcagtgagcagacaatctcagttatccatgtgacaaaccatggttgaactctgcaatctgctgatgcccag

SEQ ID NO: 87100 - DNA, 104 bp, Mus musculus
tgtgcattgtgtggtgctgtccttgtaaatgtcagagtctctggtgtttgtcatcatctatgtattttaatttatcaggagttacctattgcttgaatgtcaca

SEQ ID NO: 87101 - DNA, 82 bp, Mus musculus
ggagagttgaaaggcagctggagagatggctcagtggttaagagcactgactgctcttccagaggtcctgagttcaattccc

SEQ ID NO: 87102 - DNA, 60 bp, Mus musculus
tgcatatatgtttgtgtacatgcatatacatatttatgtatatatgcatacatatatgca

SEQ ID NO: 87103 - DNA, 85 bp, Mus musculus; identical to SEQ ID NO: 57439

SEQ ID NO: 87104 - DNA, 85 bp, Mus musculus; identical to SEQ ID NO: 57439

SEQ ID NO: 87105 - DNA, 116 bp, Mus musculus
aggtgtgtcactggaggtggactttgaggtttcaaaagctgatgtcagactcagtctctttctctctgcctatggatcaggataaaactctcagattcttctccagtatcatggct

SEQ ID NO: 87106 - DNA, 82 bp, Mus musculus
gggggtagtggaggagagcaaccttttcaaactgtctttctgtcttccactgtgtgtctgtttctctctcaccaccaccccc

SEQ ID NO: 87107 - DNA, 115 bp, Mus musculus
ggcaatttcctgggtgctagggatagaactgtcctaactgcaagactagtcattttacagggtcagctgtctttcctgccacttcaggtttgttcttttcctacagttttgcagt

SEQ ID NO: 87108 - DNA, 86 bp, Mus musculus
taaagtctttaaaatgcttgtatgtatgtatgtatgtatgtattcatttacatacaacacacatttaaaggcacagacatacttta

SEQ ID NO: 87109 - DNA, 72 bp, Mus musculus
gtcattaccacacggcaggagacagagagcacacagcataatgcaatgcactaggtccagccatgtcatgac

SEQ ID NO: 87110 - DNA, 88 bp, Mus musculus
cctttgtggtacagaacacagacaggagactgctgggagggctctggcatcagtgttcatggtctccttctgcattaactacgagagg

SEQ ID NO: 87111 - DNA, 83 bp, Mus musculus
tggcctgtcacttgctgctccactgtaaagaacacactgttgtagttcagacatgagagtgagggcataatgtaacagatcca

SEQ ID NO: 87112 - DNA, 114 bp, Mus musculus
aagtgtacaccagtctactagacccatagcttcagtgggttctcctgaatcactccctgtctcactataggagtccctacactgcagaggggcactgtgcatctggttcaattt

SEQ ID NO: 87113 - DNA, 112 bp, Mus musculus
ggagatgtcatatatcaaatactataacattgtgacagacaagacagtgcagaagttccttcattttctatcttgctgaggtcatctcaggtttaattagaatttgatctcc

SEQ ID NO: 87114 - DNA, 75 bp, Mus musculus
ggagccaaagactaatgagagctctctattgacactgatcattgcctctcagagagttctcttttctccttgtcc

SEQ ID NO: 87115 - DNA, 59 bp, Mus musculus
cacacacatatccacacgcacagatgcccactgtctctgtgtgtatctgtatgtgtgtg

SEQ ID NO: 87116 - DNA, 68 bp, Mus musculus
gtgtctgtctctgtgtgtctgtgtgtctgtgcagggagtggggcatgtagatatagggagacattcac

SEQ ID NO: 87117 - DNA, 92 bp, Mus musculus
caaaaaacagggctggagagatggctcagaggttaagagcactgactgctcttccggaggttctgagttcaactcccagaaactacatggtg

SEQ ID NO: 87118 - DNA, 92 bp, Mus musculus
tgtatgtatatatgaatgtctgtatatatgtgtatgcatatatgtatgtataaatgtatatattaaaccttaacattttatgtattaaaaca

SEQ ID NO: 87119 - DNA, 111 bp, Mus musculus
cccaatatgctggttatgaagacttgttcctgtaatactgtttggtaaagagttcaaggccactctggctaaatagaaagactttgaatctcctcatcatgcattaatggg

SEQ ID NO: 87120 - DNA, 132 bp, Mus musculus
caggtgaatccttggacactcacaggctggctggtctgcagtgtgaacaagtgtctctctggctctctcaaataaggaggtaagcaaaaacctgaacaggttctgattcctcctgcccactctagcatgcac

SEQ ID NO: 87121 - DNA, 97 bp, Mus musculus
tatgccccgctctggctctctctctctctatgtatgttagataaaaagatagagatagaaacagagacatagacagagacagagatagagatacata

SEQ ID NO: 87122 - DNA, 69 bp, Mus musculus
ctctgtctctgtctatgtctctgtttctatctctatctttttatctaacatacatagagagagagagag

SEQ ID NO: 87123 - DNA, 77 bp, Mus musculus
gggggctggagagatgactcagctgttaagggtgctgactgctcttacagaggtcctgagttcaatttccagtgact

SEQ ID NO: 87124 - DNA, 83 bp, Mus musculus
ggcttccggaagaaattttttaaatttaggacatcatagtgaacacattgaatgttaataagtttgtatttctaacggtagct

SEQ ID NO: 87125 - DNA, 85 bp, Mus musculus
atgaggaaggactgaatgcaggtatagacaggaattttggaagaggatatacagaaaactgtttttctagttctagccctctcat

SEQ ID NO: 87126 - DNA, 72 bp, Mus musculus
ggtttattttgcatgtatgtaggtatgtatgtatgcatgtatgtatgtattgtgtatgcatgtatacaagcc

SEQ ID NO: 87127 - DNA, 85 bp, Mus musculus; identical to SEQ ID NO: 57439

SEQ ID NO: 87128 - DNA, 79 bp, Mus musculus
acttctgttagtgtcactctgtctctgtgtaatttctgtttccaggattggtccattgatgagagtggggtaatgaagt

SEQ ID NO: 87129 - DNA, 118 bp, Mus musculus
tatgtatatatggatatatgtgtgcacatatattcacatgaatatacatatacatatatatgtatatacatttatatatacttatatgcatatatatatatatatatatatatatata

SEQ ID NO: 87130 - DNA, 85 bp, Mus musculus; identical to SEQ ID NO: 57439

SEQ ID NO: 87131 - DNA, 85 bp, Mus musculus; identical to SEQ ID NO: 60314

SEQ ID NO: 87132 - DNA, 85 bp, Mus musculus; identical to SEQ ID NO: 57439

SEQ ID NO: 87133 - DNA, 97 bp, Mus musculus
gattgctcccacattttaaaacagggatcaggaacatttatttagaactatgattggtctcagcaatgttctctggttcttattgtagggatctttc

SEQ ID NO: 87134 - DNA, 100 bp, Mus musculus
gctgatggttataaaggctctcgttttctgcatactgtctgactgtgagtctctgtacttgctcacatctgctacagaagagagcttttctgatggtggc

SEQ ID NO: 87135 - DNA, 84 bp, Mus musculus
ccttagatgaaatgtcagacagtagagagagggaacttatggagccctccttcagcaggaagacaggaaatggattattaaagg

SEQ ID NO: 87136 - DNA, 118 bp, Mus musculus
ctcctaaaggtcaaagtcacagagtaagggcctcggaacgactggacgctgtgattttcttcttctgatacagcaaccatcctagccgagccctcttcagtgcattagttgcgtggag

SEQ ID NO: 87137 - DNA, 72 bp, Mus musculus
cagttctgcctgcctccctggaagcctgttgtcacttggataaccaggtctatctggaatactagaggactg

SEQ ID NO: 87138 - DNA, 94 bp, Mus musculus
atacattgtatatgcatatctatgtatttgtgtttaaatctttgaattttagatttgaagataacatagatgatatttaacatattcaatgtgt

SEQ ID NO: 87139 - DNA, 78 bp, Mus musculus
tatatatgtgtatgcacacatgtatatgtatatatgtctgtatatgtatatatgtatatgtgtgtagatatagatata

SEQ ID NO: 87140 - DNA, 86 bp, Mus musculus
gtggttctttctgagtgactgtgtctgacattgcagttgtcatcccttgctgatgtccagactccagctctttcagcctcctacac

SEQ ID NO: 87141 - DNA, 91 bp, Mus musculus
caatttctgagccaaaagaagtttgatgaggattgcatttatatctatagatcgattttgattgtatactcattatcctggctagatgttg

SEQ ID NO: 87142 - DNA, 79 bp, Mus musculus
tgctggagagatggctcagcagttaagagcactgactgctcttccagagtttcagaggtcctgagttcaattcccagca

SEQ ID NO: 87143 - DNA, 91 bp, Mus musculus
gtggggttgttgtgtctgtcaatactataaccattaattatatttgtattaacaaattattttatgtcctcaggctcaaaacaattcccac

SEQ ID NO: 87144 - DNA, 74 bp, Mus musculus
tgtgtgtgtgcatgtgtatgtatatgtgtgtatatatgtatatatacatgtatatatgtgtattcatatactca

SEQ ID NO: 87145 - DNA, 89 bp, Mus musculus
gcaatgtcttttgcccaccaggagatgtgagccctgcttctcagtgtctctgtctccttgagcaccatggagggctagaagatgcctgc

SEQ ID NO: 87146 - DNA, 108 bp, Mus musculus
gaagagcaatcatcatttactactattaagtgaaatgcagcaatatcattgatctttattattaaatattgcagccattgttgatgtgtataaatgatgaagtacttc

SEQ ID NO: 87147 - DNA, 79 bp, Mus musculus
cctcatctcgttaggcatttggagaaggacagtcacttggatggcactgcttgtttctctgactctgtctggtatgagg

SEQ ID NO: 87148 - DNA, 116 bp, Mus musculus
ccagaggccagtgttgggttccttctgtctctgcccatcttattttcttagacagtgtctctcactaaatctggggtgctcagattcagacaggctatctagcagtgagctcctgg

SEQ ID NO: 87149 - DNA, 84 bp, Mus musculus
gcagtaagagtgctctgtgagacctttcttcgggctgttgctcacaggcttaataaagactctcaaactcagactctgttttgt

SEQ ID NO: 87150 - DNA, 80 bp, Mus musculus
ggagagaagtcattttgttgttggcagctcctatttgacagaggctctcagtggcttccaatgaaagatagcttcattcc

SEQ ID NO: 87151 - DNA, 115 bp, Mus musculus
ctttcatggagtccactaagttatatgcttggtaaacacaaattatgtgaggagacagagaggtcatgctgcttccataggtgagtctgagctatggctttggatatcatgactg

SEQ ID NO: 87152 - DNA, 59 bp, Mus musculus
gtggtgtgtgtgtgtgtgtgtgtgtgtgcgtgcacacacacttactcactcacactcac

SEQ ID NO: 87153 - DNA, 96 bp, Mus musculus
gatcagccttagtccatggtgatctgataggatgcatgggacaatttcaatatttttgtatctgttgaggcttgttttgtcaccaattatatggtc

SEQ ID NO: 87154 - DNA, 138 bp, Mus musculus
tctgcagtatatatgtgtgtatatgtatatgtgtgtgtgcatatatacatatatatacatatatttgactaagatatatatatatatgactaagaatatgtatttagtatttgactaaggtatatatgtgtgtgtgta

SEQ ID NO: 87155 - DNA, 88 bp, Mus musculus
caggttgcctgggtccacaggagaaccagtgcacaatttcaaaccagtttaggagttgcactctctccgacactcactggctcctggc

SEQ ID NO: 87156 - DNA, 113 bp, Mus musculus
agggcagagaaggggctgtcgggagttggttctttgtcttctactctgaccacactcagactgtcaggctttgtggcaaacgtccatacctgtggctccctctcgccagctct

SEQ ID NO: 87157 - DNA, 100 bp, Mus musculus
gaaatgcacatttgggctggagagacagctcagcggttaagagcactgactgctcttccgaaggtcctgagttcaattcccagcaaccacatggtggctc

SEQ ID NO: 87158 - DNA, 74 bp, Mus musculus
gtcatcagacatggagatgcagaatttggagtttgcccagttgttatctgtctgtctgtctgtctgtctgtctg

SEQ ID NO: 87159 - DNA, 73 bp, Mus musculus
gattcccagacagcactgtccttttagttccagcagtctgcctggccactctcagtctgtctgtggctctgtc

SEQ ID NO: 87160 - DNA, 69 bp, Mus musculus
gttctgcttgtatgtatgtatgtatgtatgtatgtatgtatgtatgtatgtatggtgtacatcctggac

SEQ ID NO: 87161 - DNA, 74 bp, Mus musculus
tatgtacatgaatgttttgcatatatacatgtgtgtgtatgtatatatgtatgtgtgtgtatatatatatgcat

SEQ ID NO: 87162 - DNA, 81 bp, Mus musculus
tcagactacaattaagactgtcaggtaaagtacacaattaaagttcattgtgaatgctgtcgacagactggtgttagctgg

SEQ ID NO: 87163 - DNA, 63 bp, Mus musculus
gctagggctggagagatggctcagcggttaagagcactgactgctcttctagaggtcctgagt

SEQ ID NO: 87164 - DNA, 104 bp, Mus musculus
tatacacatgtgtgtgcatgtgtgggtgtgtatgtgtatatgtctatgtgtgtgcatatgcatgtgtatatgtgtgtctatgagtgtgtgtatacatgtgtgtg

SEQ ID NO: 87165 - DNA, 119 bp, Mus musculus
ctccatgaaggagcatgaaggagctgtggggctggcaagaaggtgggtgtacttatttatttattaagacagggtcttgctatgtggcctgggcaattctcctgcattaactttctgag

SEQ ID NO: 87166 - DNA, 77 bp, Mus musculus
ccatacacacacacacacatatgtatgtatatatatatctatatgtatatatggcgtatttttgtgtgcacatgtgg

SEQ ID NO: 87167 - DNA, 87 bp, Mus musculus
agaccagcagctggcaggcagctgacaccgacccagagctagctcctagttctctctctctatctgtctgtctgtctcactctgtct

SEQ ID NO: 87168 - DNA, 76 bp, Mus musculus
gccccatgttatggagcgagctgtgtacgagctactgcacgcaaagctgcacacactcagcctgtctgcctggggc

SEQ ID NO: 87169 - DNA, 112 bp, Mus musculus
ggtgtgtgtgggtgtgtgtgggggatgggaagagggaagaataaaataaaaacattttttatatatttttaatataaaatcctttctattcttcaggcattctacaaatgtc

SEQ ID NO: 87170 - DNA, 72 bp, Mus musculus
ggtgtgtgcgcgtgcatgtgtgtgtgtgtgtgtttgtgtgggtgcatgtatgttcatgtgcatgtggatgcc

SEQ ID NO: 87171 - DNA, 74 bp, Mus musculus
ccacctacacacagggaatggctgtgatagttggggcaccagagtgacagcacactgcctctcaggtgaggagg

SEQ ID NO: 87172 - DNA, 87 bp, Mus musculus
gtgtgcatatatatgtatgtatgtatatgtatacatatatatatgtgtgtgtgtgtgtacgcatatatttagagagatacatatgca

SEQ ID NO: 87173 - DNA, 133 bp, Mus musculus
gttgttctgtatttgttagcatgtatatatatatatatacacacacacacatatgtgtatatatatatatatatatatatatatatatacacatacatacatacgtatatacatacatacctatatatgtaca

SEQ ID NO: 87174 - DNA, 82 bp, Mus musculus
tggcttatctgtgacacactcactcctccagaataggggacagggccactggggatgagcagggtcaaggacagatgagtta

SEQ ID NO: 87175 - DNA, 111 bp, Mus musculus
ggtagcgttctgttgtatgaacgtactgactggtatttatttgtttattcaatcctggttgaaggatatttggattgtttccagtgtggggtgattatacatgaagccgct

SEQ ID NO: 87176 - DNA, 72 bp, Mus musculus
tgtgcacatatggtgtgtgtgtatacatatgtgtttgtatgtgtatatatatacatgtgcatacatacacat

SEQ ID NO: 87177 - DNA, 85 bp, Mus musculus
gacttgtctggaggatgtgatcaaagctatggctagatacaaagctatggtgtagttacttctttgttaataattacagaatgtt

SEQ ID NO: 87178 - DNA, 72 bp, Mus musculus
gatgggagttgtgtctgcctctctcagttttagaccccaactagtgcggatccggaggacatgatttttatc

SEQ ID NO: 87179 - DNA, 73 bp, Mus musculus
ggatggcagttcctggcctggagagagctcagcggctaagagccctgactgctcttccagaggtcctgagttc

SEQ ID NO: 87180 - DNA, 93 bp, Mus musculus
ggttgaggagtcctgggagagagaccagctccagctgcggcaggcagcccagggtggaacgggtcactcacactgagtctgcagtctggaagc

SEQ ID NO: 87181 - DNA, 85 bp, Mus musculus
gacattacacagggtggggggtgggggtgtcaaaggtgtgcattgttgtgaattctgatcatttctgtctgtctgtctgtctgtc

SEQ ID NO: 87182 - DNA, 56 bp, Mus musculus
gggggggggggcagttaggaaagctcccatgtgtctgactgtctgtctattctccc

SEQ ID NO: 87183 - DNA, 68 bp, Mus musculus
cttgtgtaaagaaaccagaggagacataggtgttctcctgtctgtgtcgctctctgtcttgaaacagg

SEQ ID NO: 87184 - DNA, 85 bp, Mus musculus; identical to SEQ ID NO: 57439

SEQ ID NO: 87185 - DNA, 99 bp, Mus musculus
tccagattccaagaaaataatgttagatttcagatgagctgctgcccagggcatgcctcatctcatctctctatctcagcactcatagttgaatctgga

SEQ ID NO: 87186 - DNA, 71 bp, Mus musculus
agggattctgggacagcctacacctatttagtcaggcactggctcctggcttactgtctctgtctctccct

SEQ ID NO: 87187 - DNA, 85 bp, Mus musculus; identical to SEQ ID NO: 57470

SEQ ID NO: 87188 - DNA, 95 bp, Mus musculus
gctgatgggaagtagaagggaggtggtgctctggctgagagggcctgggcaggggaaaggggcactcagtcagtcagtcccaatatgactggagc

SEQ ID NO: 87189 - DNA, 87 bp, Mus musculus
tcctgtaaccatatctggggccacagtgttgacctgagttgaacttaactgagtcaacactcagacctcactgaggacatgatagga

SEQ ID NO: 87190 - DNA, 111 bp, Mus musculus
ggaaaggagatgagaggtacattcatgtagctggacaaacagatgagtatcatacatctatctatctatctatctatctatctatctatctatctatctatctacctatct

SEQ ID NO: 87191 - DNA, 117 bp, Mus musculus
tattttgctggtcagaaatgcagttctgaagtgccctgttgaaacatttattttataaagacttattaaaaacaaatgcctacagtggttgaaaagaaaatgtactaacccaggatg

SEQ ID NO: 87192 - DNA, 85 bp, Mus musculus
tagcatatttcctctgtcctctgtcaccttctctcagtctcctttgtctgactggcaagagtggtagaggttcagcaggatgctg

SEQ ID NO: 87193 - DNA, 92 bp, Mus musculus
gaaattctgggactggaatttagttcttactgaaggtgaagcaaggtgttgacaagagactcagctcaggcagctggttcctccagactttc

SEQ ID NO: 87194 - DNA, 66 bp, Mus musculus
agtctgagtctctttctctgagaacgtgtgattcccaagagtatctcaagtgacagagctctgatt

SEQ ID NO: 87195 - DNA, 106 bp, Mus musculus
cctcaggttccttccagctctctgctactgtaactccaggtggatgtgccacccatcagagtggggtgtgttttctttcagcttctcagagagccactgaggaatc

SEQ ID NO: 87196 - DNA, 72 bp, Mus musculus
atgtgggaaaggggaacggttttctggagctgtaatcagattgcaagtagcttcttttgtttctgctcacgt

SEQ ID NO: 87197 - DNA, 91 bp, Mus musculus
tggatagtacacaatttacttatctgtctgtctgtctgtctgtcttttacggacagacaggacttggctgaggtttattcacaggctgcca

SEQ ID NO: 87198 - DNA, 74 bp, Mus musculus
cttttaaagtttgcgtgcgtgcctgcgtgcgtgcatgtgtgcgcgtgtgcgtgtgtgtagcacacgtgtggaag

SEQ ID NO: 87199 - DNA, 85 bp, Mus musculus; identical to SEQ ID NO: 57439

SEQ ID NO: 87200 - DNA, 68 bp, Mus musculus
gggtctcaagagcaggtggaagagtcagagagagacacacacactccattcccacagttaggagatcc

SEQ ID NO: 87201 - DNA, 81 bp, Mus musculus
cacacacacacacacacagtgtttaagcagccgggtaagaaactttttttggatttatttacttctgtgtgtgtgtgtgtg

SEQ ID NO: 87202 - DNA, 75 bp, Mus musculus
atgccatcaaatgtatgtagaggtcagagaacagcctgtgcagtcacttctctgtctgtctgtatatgatgggat

SEQ ID NO: 87203 - DNA, 67 bp, Mus musculus
gaattggggctggagagatggctcagtagttaaaagcactgactgctcttccagaggtcctgagttc

SEQ ID NO: 87204 - DNA, 99 bp, Mus musculus
ttcccccaaatttaaaggagtcagtgtttacattcaaaaatgtaagatacaagtctggtttgtaaagatgtttgaaaagtaacttggttccctggggaa

SEQ ID NO: 87205 - DNA, 83 bp, Mus musculus
tcaatgggctgcatggttggccaggcaacaaaagagaagctgactggctgactgactggctggctggctggctgaccgactga

SEQ ID NO: 87206 - DNA, 62 bp, Mus musculus
gaggtgtggtgctcacaagagggatgggtgtcttcacactctcacactgtgaactgtgcctt

SEQ ID NO: 87207 - DNA, 63 bp, Mus musculus
gagactgggtctctcactgagtcaggtaggttagccaaggactttcagggacccaactgtctc

SEQ ID NO: 87208 - DNA, 61 bp, Mus musculus
ggtcagcatctgcggttccagatccacggaggcaggcagcctcactgtcccactgctgacc

SEQ ID NO: 87209 - DNA, 74 bp, Mus musculus
tgctttggaggtgctgtgcttgggcctgacagctctcctctcctgtgtggtttgtagtctgcatacttcctgca

SEQ ID NO: 87210 - DNA, 82 bp, Mus musculus
tttggctgtagggagagagctcagttggtaaggtacttgccttaaaaacaagaagactgaagttcaatgtcccagagccaaa

SEQ ID NO: 87211 - DNA, 74 bp, Mus musculus
ccactgggtccctgtcttcactgtctctgaaagactcacttgaagcctgtgcagacagacaccttgaaaagtgg

SEQ ID NO: 87212 - DNA, 57 bp, Mus musculus
tacacatgtttgtatgtatgcatgtatgtaatgcatgcgtgtatacatgtatttgta

SEQ ID NO: 87213 - DNA, 85 bp, Mus musculus; identical to SEQ ID NO: 57439

SEQ ID NO: 87214 - DNA, 59 bp, Mus musculus
gcctgcctgcctgcctcacagcctgatgctagggatgtggggccatttcaaaggcaggc

SEQ ID NO: 87215 - DNA, 80 bp, Mus musculus
tcaggctatgtggagtgattacattcttgtatgtaattatataaagcatacagtcatgagttgcttatctatggatctga

SEQ ID NO: 87216 - DNA, 79 bp, Mus musculus
tttatgttttgaggcagagtctctcactaagtctggaacatactcttttgactagagtgactggtcagcaaagcatagg

SEQ ID NO: 87217 - DNA, 114 bp, Mus musculus
tagatgcttgtattagggttctctagaggaacagatccagtaaaatgaacacgtaaatatatatatgtataaaatttattgtatcagtttttgtggaaatagtaacagcagctg

SEQ ID NO: 87218 - DNA, 63 bp, Mus musculus
tctgagtggtgagtgaggagacagaggcatgcacacatctctgtattttgctcatcggtaaga

SEQ ID NO: 87219 - DNA, 115 bp, Mus musculus
gagaaaatgtgccactgggggtgggctttgaggtttcaaatgttctagccaggccctgtgtcactctctctattcctgcagcctgcagatctagatagatgtagaacacttggct

SEQ ID NO: 87220 - DNA, 75 bp, Mus musculus
tctgcctctgtctctgtctctgtctctgtctgcttgtacgtttctttagggaaccctgactaagacactggttga

SEQ ID NO: 87221 - DNA, 69 bp, Mus musculus
tgtatgtacgcatgcatgtatgtatatatatatagtatatatatatatatgcatgtatgtattcataca

SEQ ID NO: 87222 - DNA, 111 bp, Mus musculus
cagtttcccaccgttcatgaaagtgtctttatgtctacagagttgtgagtgagcactcaaaacaaagctcactgcaatctcacagccacacttctttaccactacctgctg

SEQ ID NO: 87223 - DNA, 90 bp, Mus musculus
tgaagactcttagtcaagcatggtagcacacacctttcatcccagcacttgggaggcagaggttgttgaatctgtatgagttcgaggtca

SEQ ID NO: 87224 - DNA, 132 bp, Mus musculus
ttgtctcaagtcacttgtgcttctgtaagaccaaatgagcctgcattccaggatgtctcactcacagaaacacagagacggagatggatgcaataagcaagaggttaattgatccggcttgtcgggctgtgt

SEQ ID NO: 87225 - DNA, 81 bp, Mus musculus
tctccgtctctgtgtttctgtgagtgagacatcctggaatgcaggctcatttggtcttacagaagcacaagtgacttgaga

SEQ ID NO: 87226 - DNA, 88 bp, Mus musculus
ggggtaagaagttcaaagccgggctggagagatggctcagcggttaagagcactgactgctcttccagaggttctgagttcaaatccc

SEQ ID NO: 87227 - DNA, 80 bp, Mus musculus
tctgactgctcttccagaggtcctgagttcaattcccagcaaccacatggtggctcatgaccatctgtaagagaatctga

SEQ ID NO: 87228 - DNA, 67 bp, Mus musculus
ctctgagacatcaagtttactgagcagagtaaagttctgtttttcttgaaatggatgtctttaggag

SEQ ID NO: 87229 - DNA, 68 bp, Mus musculus
tatgtatgcacacatgcattcctacatgcatgcatgcatgtatgtatgaatgtatgcatgtatgtatg

SEQ ID NO: 87230 - DNA, 107 bp, Mus musculus
ggtgaagtgaccgggtttggaccgatgcaccacagctctttcgcggaatcctgccgttgcccctctctgtctgtctgtatgtctgtctccttgtttctcagctcact

SEQ ID NO: 87231 - DNA, 77 bp, Mus musculus
cagggccccaagcaaatccatggaatccggatctctcgagataaggtcagagcactagtgatttggttgaagtcttg

SEQ ID NO: 87232 - DNA, 70 bp, Mus musculus
gtctctgtctctgtctctgtgtgtgtgtgtgcgcgtgcgcgtgcgcgcgcacttgtgacactgtcaagtc

SEQ ID NO: 87233 - DNA, 114 bp, Mus musculus
tctaaatgtctttgcttttacccattgacttttgctgctcattttttggtcagataaatgtcattttgtagtagacaattgttaatgcagataaaacatgcatagaataaatga

SEQ ID NO: 87234 - DNA, 89 bp, Mus musculus
tatacatgcatatatatatatatatgcattcttcacatgcccatatataaataacatgaggtgcatatatatatgtgtatatatgtata

SEQ ID NO: 87235 - DNA, 115 bp, Mus musculus
gccattagattttttttgttacattttgtgtgtgtgtgtgtacgtacgtacgtacgtatgtatgtatgtatgtatatacaagagtgccatagtgcatataaagaggtcagaggac

SEQ ID NO: 87236 - DNA, 66 bp, Mus musculus
gttgtaagtgctcagtagaaagtgaccagtggtaaccacaggggacagtattgatctacatacagc

SEQ ID NO: 87237 - DNA, 56 bp, Mus musculus
gtagaccacaggtagatggattttgtttcttaattcattcatctgcctgcctctgc

SEQ ID NO: 87238 - DNA, 88 bp, Mus musculus
gtctctcttgcatacctttctctctctctgactctcattcttcataagaaaagaagagagagagacagagagacagagagagagagac

SEQ ID NO: 87239 - DNA, 96 bp, Mus musculus
cttgggttaggcactttacgggaggcagtgaggagcctggcagcaggcaggtctctgcatgtctgctctctctctctgcctgtgccttctcctttg

SEQ ID NO: 87240 - DNA, 91 bp, Mus musculus
atactcaaaatggcatatatatatatatatatatatatatatatatatatatatatgtgtgtgtgtatgtatatatattcatatatagtgt

SEQ ID NO: 87241 - DNA, 119 bp, Mus musculus
tgcttaaggagggtggtggccttgcttctgtgggagctgtgaggagggcagtcacactcagactgaaagttctcaaaccccgaggcctctctgaagttggtcacttgaattagcaagca

SEQ ID NO: 87242 - DNA, 90 bp, Mus musculus
gtgtgtatgtgctatatgtgtctgtgtatatatatgtgtatctatgtgtgtctgtgtgtatgtagtatatgtgtgtctgtgtgtatatat

SEQ ID NO: 87243 - DNA, 115 bp, Mus musculus
tatatatatatatatatgtgtgtgtgtgtgtgtgtgtgtgtgctatttatatgttcattataatatttatatgtgtcatatatgtacatgtgctatacatttgtttgtatgtata

SEQ ID NO: 87244 - DNA, 94 bp, Mus musculus
actacatatgtgtaatatatatatatgtatatatatatacacacaaatatatgtatatatatacacacatatacatatatatatgtatgtatgt

SEQ ID NO: 87245 - DNA, 92 bp, Mus musculus
gtgtccatgatggtggcgatctggttgagagatcttttttgttttaaatgacagtagtttttctgccaaaggataatgctctttaaaggcac

SEQ ID NO: 87246 - DNA, 93 bp, Mus musculus
aatccaaaccctgcataaaaacttccctggtttatgttgagagaacagtctgaacacaagctaccgggcaccgggttttcagatggtgtgatt

SEQ ID NO: 87247 - DNA, 96 bp, Mus musculus
aaataaaaatgtaaagtgcttgactgttttgtacatgcagatgtttgttacaacatcgatgacagaaaaatgtgaggtgtgacttgctgttcgttt

SEQ ID NO: 87248 - DNA, 89 bp, Mus musculus
atatctatatctatatatctatatctatatctgtatctatagctggcttccttagggcttgtagatgtgtgtgtgtgtgtgtgtgtgtg

SEQ ID NO: 87249 - DNA, 144 bp, Mus musculus
atagatagacagacagacagacagacagacagacaggcactgtttgtgtgtgtgtgtgtgtgtgtgtgtgtgtgtgtgtgtgtgtgtgtgattgtggtagttttaatgaaaatggccccatagctcatagtagctcatagggac

SEQ ID NO: 87250 - DNA, 78 bp, Mus musculus
gggcagtcatgtcggtgagactttgtgtgtagcttccgatgttactaggagacacaatctctgactctctttctaccc

SEQ ID NO: 87251 - DNA, 111 bp, Mus musculus
gtcttcaccttttcccttgctgcctttcatagcagtggttttcctgtcttacacactgattgacacaaacccatagccagtgaacctaaacagcccattggaggagaagat

SEQ ID NO: 87252 - DNA, 72 bp, Mus musculus
tatacatacacatatatacatacacacacatatatacatatatacacatacatgtatatatgtatatgtata

SEQ ID NO: 87253 - DNA, 72 bp, Mus musculus
tgtgtgtgtctctgtgtctctgtgtgtgtaagagagagaggagagagagagagagagagagaggcataagca

SEQ ID NO: 87254 - DNA, 187 bp, Mus musculus
tttttcaataattataattacatatatgtatttatatgtgtcttgtgaaatataattattattataaagcatacatatgttttacatatatatatgattgatgttaaatatacatacatacatacatacatacatacatacacacatacatgtatgcatgtatgtatttatttattcccaaacacaa

SEQ ID NO: 87255 - DNA, 81 bp, Mus musculus
atatataatatatctttcatatgtataattatatataatcaatataagtataatgatgtatatgtagatgtgtgtatatat

SEQ ID NO: 87256 - DNA, 85 bp, Mus musculus
ttgctcagggattgtactgtatatatatatgtgtatactgtatacacatacacacatatatactatgcatataatacacatgcaa

SEQ ID NO: 87257 - DNA, 110 bp, Mus musculus
tgttgtatagaactgagattctcactatttttgtgtcctatgtatgtatatatgtatgtatggatgaatgggtagatgaatagttggatgaatgggtagatgaatagata

SEQ ID NO: 87258 - DNA, 87 bp, Mus musculus
gcgttgcagatccctttagctccttgggtatgttctctggctcctccactgggggccctgtgatccacccaatagctgactgtgcgc

SEQ ID NO: 87259 - DNA, 174 bp, Mus musculus
gcaacattaaatgaactcagcaagttgtattaatatatgtatgcaagtatgcatatatgtatgtatgtattatgcatgcatgatggactcagcaggttgtgttaatgtatgtatgtatgcatgcatgcatgtatgtatgtatatatgcatgcatgtatgtgtgcaacagtaata

SEQ ID NO: 87260 - DNA, 114 bp, Mus musculus
gatggaaaagcatgtcaggaaagtttcaggacttgactggtgaacacaggcaaagggagtctagtctggtaccaggaaaggacagaagcgggcatcactggctgtgactctatt

SEQ ID NO: 87261 - DNA, 78 bp, Mus musculus
ggggaagacagaaagcagtgaagatagttggccaaggagccagaccatgtggctgaattcacagtctattgcttgctc

SEQ ID NO: 87262 - DNA, 78 bp, Mus musculus
gtcttgattgtatgactgtagtaggcctttatttttttgtagtttgaggtctacgagttaattttttcttttcaagat

SEQ ID NO: 87263 - DNA, 68 bp, Mus musculus
atgaaggactcagacagcagagactgggcaaatgattgtctacatttcttctccctcagtccattcat

SEQ ID NO: 87264 - DNA, 82 bp, Mus musculus
ggtttaggtgaattgtggcgatgctttcccctttgctggtgatttggtagatttaggtagcatacattactcacttgtgact

SEQ ID NO: 87265 - DNA, 87 bp, Mus musculus
acctctgctttcttagtgcagggactataggtgtgcgacaccaatgcctggctcactctatggcttctgaagttaagtgcttagtgt

SEQ ID NO: 87266 - DNA, 85 bp, Mus musculus; identical to SEQ ID NO: 57439

SEQ ID NO: 87267 - DNA, 114 bp, Mus musculus
catatatatatatatatatatatatatatatatatatatatacacatatatatatatatgtgtgtatatgtatatatatgcatatatgtatatatacacacacatataaatatg

SEQ ID NO: 87268 - DNA, 73 bp, Mus musculus
tctgtatgtctgtctgtctgtctgtctgtccttggagcaataagggaggaacagctgaccagcagaggaaaga

SEQ ID NO: 87269 - DNA, 81 bp, Mus musculus
tgatttacacttctgtgtgtgtgagtgcatgtgcacatgcacgcgtgcatgatgtgcacacaggtatagaaggtaaaatca

SEQ ID NO: 87270 - DNA, 77 bp, Mus musculus
acatccaggtagtcagtgtctacaagaagtttaagatgaggcaaaggccctatctgtctgtctgtctgtctgtctgt

SEQ ID NO: 87271 - DNA, 70 bp, Mus musculus
catgaccagggctggagagatggctcagcggttaagaccactgactgctcttccagaggtcctgagttca

SEQ ID NO: 87272 - DNA, 115 bp, Mus musculus
tgggattaaagatgtgtgctacctgggactggagagatgcctcagcagttaagagcactgactgctcttccagaggtcctgagttcaattcccagcaaccacatggtgactccca

SEQ ID NO: 87273 - DNA, 74 bp, Mus musculus
gcggttacaattggttgtatgtatgtatgtatgtatgtatgtatgcatgcatgcatgtgctaggaacggaaccc

SEQ ID NO: 87274 - DNA, 75 bp, Mus musculus
aggaagctctggtttcttatctctttccaaaagcgctgcctgcaggctctgcatgaggaagtgaccggaagtcct

SEQ ID NO: 87275 - DNA, 85 bp, Mus musculus
gtccatggtggtctgataggatgcatgggacaatttaaatatttttgtatctcttgaagcctgttttgtgaccaattatatggtc

SEQ ID NO: 87276 - DNA, 73 bp, Mus musculus
gcctctgcctcctagagtgctggggttaaaggcatgtgcctttttaatcttttatttttagtgatctgagtgt

SEQ ID NO: 87277 - DNA, 107 bp, Mus musculus
ggcacctgaaatcatttacacagacacacgcacacagacacagagttaaaacataagttttaatttttttggttaagatctatgtctcagtcagggtttctattgct

SEQ ID NO: 87278 - DNA, 81 bp, Mus musculus
agtgagaaggagaagccctgtatgcaccatgcacacgcatgagcacctgtgcacatggtcatgtgttctctctctctcact

SEQ ID NO: 87279 - DNA, 72 bp, Mus musculus
atctgtctgtctctctctctgtgtcccatgtacacagctgatacctgcagaggccagaagagggcatcggat

SEQ ID NO: 87280 - DNA, 83 bp, Mus musculus
ccaggctggcctcaaactcatatagatctgtctgtttctgtctcctaagtactgagattaaaggtgtatgccaccatgcctgg

SEQ ID NO: 87281 - DNA, 93 bp, Mus musculus
tgttttgcatgtgtagtgcatgtatgtatgtatgtatgtatgtatgtatgcatatgggcatgtatgtatgcatgcatggtatctattagagca

SEQ ID NO: 87282 - DNA, 91 bp, Mus musculus
taatatatgtgtgtgtatatatgtatgtatatgtataggtgtatgtatgtatatatatgtacacatatatatacatatatatgttatatat

SEQ ID NO: 87283 - DNA, 118 bp, Mus musculus
gtttggcggcaagtcctgacctgaccttgttctcaaaagtgtagctgctggcatcattctgcctagacacgggctacctgaggagtccaacctcagaaacccagcatagccgcttgtc

SEQ ID NO: 87284 - DNA, 76 bp, Mus musculus
tcccgctgtctgcagtgagctatgtaagatgctcgtgtaggaacagcactggcagtcactcactcagtggcaggga

SEQ ID NO: 87285 - DNA, 81 bp, Mus musculus
agagagagagacagacagagaaggagatcagtagaaacccaagcactgtgccttctacagactccctgggtttcttgctct

SEQ ID NO: 87286 - DNA, 72 bp, Mus musculus
caggtctgattctcagagagagcacagagcgcccctgcgcaagtctagactagaatctgggagagctacctg

SEQ ID NO: 87287 - DNA, 127 bp, Mus musculus
atgacgctgcagagatgctgtggagagagcagaaccttctagtggctctctcttgctctctgtgtgtgtggtaatctgcatgtgtatgtgtgtgtgtgtgtgtgtgcgcgtgctcatctgcgtatgt

SEQ ID NO: 87288 - DNA, 111 bp, Mus musculus
tgtcaggggttacgcttaagagtttgccttgagtctcagaagagactgtgaactttaaaacagcactgaaactcaggggcgatgggggcttttgaagtgggaccgaatgca

SEQ ID NO: 87289 - DNA, 89 bp, Mus musculus
gttctaagaaaaaagtatatatgtgtatatataaacatatgtgtgtctgtgtgtgtgtgtatatatatatatgctcagtttcttattac

SEQ ID NO: 87290 - DNA, 79 bp, Mus musculus
ccagcatgctttttatgtaggctctgtgagtctgtgtatggattcttcaagtatagaagtttgcttttgggcattgtgg

SEQ ID NO: 87291 - DNA, 81 bp, Mus musculus
cttcagttccttctgagtgcccagggatacagatgtgtgacaccacacctagtttatgtggcactgaagactgaactggag

SEQ ID NO: 87292 - DNA, 87 bp, Mus musculus
gctgagcagctctcatctagatggcaactttgaggagccgtttgatgtcaggctcgatgttgatggtctggaagctgcggctgtagc

SEQ ID NO: 87293 - DNA, 82 bp, Mus musculus
tgtgtgtctgtgtctatgtttctgtgtgtatatttatatgtgtgtatacgtatgccaactaaggctagacaagggcgtcaca

SEQ ID NO: 87294 - DNA, 75 bp, Mus musculus
gttggaggaagtacaacactaggggcttgaggtctcagaagcttaaactaagcccagtgtctcactctctcttcc

SEQ ID NO: 87295 - DNA, 88 bp, Mus musculus
tttattcgtgaattaactatgacatttgtagtgttctctggggagagaggagagacaagtgacagagcaggatgtgttcaaggatgag

SEQ ID NO: 87296 - DNA, 94 bp, Mus musculus
gtgtgtgtgtgtgtgtgtgtgtgtgtgtgtgtgtgtatatatatatatatatatatatatgtatataatctatcacatgtacacacacacacac

SEQ ID NO: 87297 - DNA, 71 bp, Mus musculus
ggctcacaggtgcagggaggcttcaggtctgcaacctttcggtctctcagactgacttctcaccaaatgtc

SEQ ID NO: 87298 - DNA, 137 bp, Mus musculus
gctgcatcctcttttcctaaggccaagtacaagctccccaaacccacaggggtcccaggagtgagtggtgagtgtggagaaggagatgcagcgtgggcgtgggtaggcttgtttctaagttgcatacctttctgcca

SEQ ID NO: 87299 - DNA, 88 bp, Mus musculus
ttgtatcacattgatctcctttcattgttgaattgctctggctacgacttcaagtacaatgttgaatagttaaggaggaagtgggcag

SEQ ID NO: 87300 - DNA, 72 bp, Mus musculus
caggatgtaggtgaggcaaaccaggtggggataatccggctgcctccctggttccctctcaatgccactctg

SEQ ID NO: 87301 - DNA, 89 bp, Mus musculus
acgctcctacccaatacctgttgatctccaaggtcagagagcacacagagatcttgccttgggcttttcaatatctcgtttgagggtgt

SEQ ID NO: 87302 - DNA, 76 bp, Mus musculus
cctgacctgtcaatcccctcagagtgccctggctaaagaggacagacggctctgagatgggagagagcagacacgg

SEQ ID NO: 87303 - DNA, 99 bp, Mus musculus
gtgtacatgtatatgtatgtgtatgtatatatgtatgtgtatatatatgtatgtgtatatgtatacgtttgtgtgtgtgtgtatgtgtatatatatata

SEQ ID NO: 87304 - DNA, 97 bp, Mus musculus
ggatataggtgtgctccactgctccctgctcattttcacagcctaagcttaaggcgtctgagagatgagtctgtgctggaaggacttgaccttttcc

SEQ ID NO: 87305 - DNA, 85 bp, Mus musculus
tgcatgtgtgtgtgcatgtgtatgtgtgcatgcatgtgtgtgtatatatatatgcatatatatatatacacacacacacttggta

SEQ ID NO: 87306 - DNA, 78 bp, Mus musculus
gtgtcctatcctgtgtgcatatttgtgtgggtgcatgtgtatagcagtgcacatatacttgggataggcaggggacat

SEQ ID NO: 87307 - DNA, 63 bp, Mus musculus
gttcctggcagggactgaggcaggcactgggtgaccatctgtctgtgactctgtggcaggagc

SEQ ID NO: 87308 - DNA, 114 bp, Mus musculus
tgagcccctgtcagaggcagtcaggaaccaagtgaagagatgcacccccaccactcactgcctgtcttctgcagtatggctttgttactggaacctgatagcctcagatcttca

SEQ ID NO: 87309 - DNA, 75 bp, Mus musculus
tctctgggatttctctctgccactctctgtcctgggacgacagtgctggacgtgtcaggatgacatcttcgggga

SEQ ID NO: 87310 - DNA, 122 bp, Mus musculus
atcatagcttagatcttaaataccaacctcaagatcctatagactgaaggcttccttgtctgtctgtgtcactatcaggaggttgtggagcctttaggagtgaggcctggtgatagaaagat

SEQ ID NO: 87311 - DNA, 134 bp, Mus musculus
agctttctgtagtcattttcctctctgtgtctgtccagattatgtgtttaaacttttgagaagacattttgttctggtgctgaacacaaaggccagagatcaagagaactagtccgctgaagctggagagatgc

SEQ ID NO: 87312 - DNA, 71 bp, Mus musculus
tttctctgtatctgtctcagtactttacctgtgggaatccctggagggagagagagagggagggagggaga

SEQ ID NO: 87313 - DNA, 100 bp, Mus musculus
gtgtgtatatgtatgtgtgtgtatatgtgtgtgaatatatatgtgtatatgtaaatgtgtatatgtatgcatatgtgtatacatatgtgcatgtgtgcat

SEQ ID NO: 87314 - DNA, 97 bp, Mus musculus
ttttcagttgcattacgttgtttgttgatgtctaatatcttgaattatttacatattttagatattagtcatctgtcagacatagggctggtggaaa

SEQ ID NO: 87315 - DNA, 78 bp, Mus musculus
tttacattgtcagccattttgatgagtaccagaatgtgtgccctctgtgcttcatcatggttttactggcgatttgaa

SEQ ID NO: 87316 - DNA, 107 bp, Mus musculus
ggtgggatattaattgtgaaattttgtgaagcctgcacagactgaattgagactccagagtgctcgatttgatatgcagtggcctctattttgaattagagctctcc

SEQ ID NO: 87317 - DNA, 78 bp, Mus musculus
gcccacaagataactaaaagcagggcaaaagcctggcacctccgcctttcttctgtgtctgtctgctttactttgggt

SEQ ID NO: 87318 - DNA, 177 bp, Mus musculus
gtatgtataaatgcatgtatgtgcatatatacatatatatgtgtgtggtgtgtctgtatgtatatgtgattatatatgtatgtgaatgcatatatatgtattcatatgtgtttatgagtatatgtatatatatatatatatgagtaggcatgtatgtatatgtgtgtatggatgtat

SEQ ID NO: 87319 - DNA, 103 bp, Mus musculus
atgtatgcatatgtatacatatatatgtgtatgcatgtatatatgtatgactatgtatatatatgtgtgtgtatatatatatgtatatgcatatgttttgcat

SEQ ID NO: 87320 - DNA, 97 bp, Mus musculus
actttggttttatgtgcatgagtgttttgcatgtatgtatgtatgtacgtatgtatgtatgtatgtatgtgcaccatgtatgagcctggtttgcaca

SEQ ID NO: 87321 - DNA, 102 bp, Mus musculus
gtccattagatttctttcatgtatgtatgcatgtatgtatgtatgtatgtatgtatgtatgtatgtatgtatgtatgtattttaggaagcttctacagtgat

SEQ ID NO: 87322 - DNA, 80 bp, Mus musculus
tccatttgtgtctgcctgtgtctgtctgtctgtatgtgcagcagcacacaagtaaaggtcagaggacaactggcagtcat

SEQ ID NO: 87323 - DNA, 99 bp, Mus musculus
acgactgcaagagttctcggtctctgacatggaaaatttttttattactgaggctgtgagcttcttgcttgtatgctgtgtttccccagtacaggcacc

SEQ ID NO: 87324 - DNA, 118 bp, Mus musculus
tccttgaccaaggtatcattgagaagagtgttgttcagtttccacgtgaatgttggctttctattatttattttgttattgaagatgagccttagtccatggtgatctgataggatgc

SEQ ID NO: 87325 - DNA, 60 bp, Mus musculus
gtgtgcttctgtgcatgtgtgcatctatacctgtgtatgtgtacatgtgcatgtgtatgc

SEQ ID NO: 87326 - DNA, 85 bp, Mus musculus; identical to SEQ ID NO: 57470

SEQ ID NO: 87327 - DNA, 111 bp, Mus musculus
cgggaattgtatctacttaagggtataaagaaaattgtaattgttttggagtcccccatcttcttttaaagttttctttaaatgaaaacctttacagttaaacagcttttg

SEQ ID NO: 87328 - DNA, 81 bp, Mus musculus
gatgagagatgagactgaggagaggctccggaggctgcctgagcacaccccatgccccttctcgtggcagctgttcttttc

SEQ ID NO: 87329 - DNA, 85 bp, Mus musculus; identical to SEQ ID NO: 57470

SEQ ID NO: 87330 - DNA, 113 bp, Mus musculus
tacatctttgtatgatcacagtcactgccattaccttagttaattatatataattctgacctatgtgtaagtggctttgggctcatggtaggtgctaaagtatacagaatgtg

SEQ ID NO: 87331 - DNA, 107 bp, Mus musculus
gaagatacagtgaattctgccaggggaagagtctatagtgatggcatgatacttataatgtctaactgtctctctgtgaaaagttcccatgtacctgtcagtctctc

SEQ ID NO: 87332 - DNA, 85 bp, Mus musculus; identical to SEQ ID NO: 57470

SEQ ID NO: 87333 - DNA, 150 bp, Mus musculus
tatatatattctttctttataacaaatatatgagtttttacttttttagatttttaaaaagtttttatgtatatgagtgttttgcttgtatgtatgtatgtatgtatgtatgtgtatatgtgcaccacatgcatgcaggccagaagtcat

SEQ ID NO: 87334 - DNA, 110 bp, Mus musculus
gaaaaactggctgtccttaaacaacaagctaggaaatatggtagagggaaaatgaaagttcagtctccctgtctgtgtgcgccttttgctatatgtgctatgctgttttc

SEQ ID NO: 87335 - DNA, 117 bp, Mus musculus
ataaatatgagacatatatgaaacacatatatttatatatatatatgtatatatataagtatatacatgtgtgtatatatatgtgtgtgtatatatatgtatatctgtatatatata

SEQ ID NO: 87336 - DNA, 104 bp, Mus musculus
caccactgcctaactcagtcacacactgtcagcatcctgaaagcaacaacatgaaagcccttgatttgggggaggggacagtgtttggaggccaggcagtcctg

SEQ ID NO: 87337 - DNA, 89 bp, Mus musculus
aagcagaactgaatgacacaacagtcacagcacttaacatagttctcgtgtgttttaaagtaacacctgtggcttactgttatctgttt

SEQ ID NO: 87338 - DNA, 107 bp, Mus musculus
agtcaaaagaagttctagggagggatggagagatggctcagcggttaagagcactgactgctcttccagaggtcttaagttcaaatcccagcaaccacatggtggct

SEQ ID NO: 87339 - DNA, 103 bp, Mus musculus
gaccaccaagatttctttcctaggacctgacatctctcagccactctctctgctcagggcagttgattcagacatcagaggctgggatagttcccaggtgatc

SEQ ID NO: 87340 - DNA, 83 bp, Mus musculus
gtaattaaaggcaatgttatctcagtcagtctctcattagccatataattagactgctgaaaataattaacattccttttgac

SEQ ID NO: 87341 - DNA, 70 bp, Mus musculus
cattcatgtcaccctgtgcctctgtctctaagctcaggcatcagtagaggccagaagaaggacttggatg

SEQ ID NO: 87342 - DNA, 96 bp, Mus musculus
ttcttggattctggcctggtttagagacctctgggtccctgggtgtcaaccccaggggttgagagtgttgacagtgaggaagggagagccacaggg

SEQ ID NO: 87343 - DNA, 95 bp, Mus musculus
agcacaggcttcactgagccttgttgggccttaaaatgacacaggaagggtgcagactggctctgtccctgcctgtgctagtccagtgtgagagg

SEQ ID NO: 87344 - DNA, 113 bp, Mus musculus
gtgacatggggacaaacaagttacaggtctaagtgtgatagaagacacagagctcctatctctctgtgtctctgtctcaatgttgctgtctctctccccctccctgaacccac

SEQ ID NO: 87345 - DNA, 84 bp, Mus musculus
gaatgaagaagatgggctggagaggtagctcagtggttaagagcactgactgctctttcagaggtcctgagttcaattcccagc

SEQ ID NO: 87346 - DNA, 86 bp, Mus musculus
cacagcacagaagagactatgcacactcaacccagcaagcgcaggggtagactaagcaaggttcttaagacgttcatctggctgtg

SEQ ID NO: 87347 - DNA, 96 bp, Mus musculus
tatatatatatatatatatatatatatatatacacatatacatatacatatatatgtgtatgtgtgtatatacatatgtatatatatatgtgtgta

SEQ ID NO: 87348 - DNA, 141 bp, Mus musculus
cactcatatgtgtgtatatatatatacatatatatatatatatatgtatatatatatacatatacatatatacatatatacatatatatgtatgtatgtatatatatatgtgtgtgtgtgcatatatatatatatatatat

SEQ ID NO: 87349 - DNA, 84 bp, Mus musculus
ccaggagcagcagccgcggagaactcagctgacgatgacctagacagggtctctgagtctgaagcttggtggacaggctcctgg

SEQ ID NO: 87350 - DNA, 73 bp, Mus musculus
ggcgtgtctccctagagttgctgtgacgatgacttgtgatcataccacagtgaatgctaagtgagttagtgcc

SEQ ID NO: 87351 - DNA, 122 bp, Mus musculus
gtgtgtgtgtgtgtgtgtgtgtggtatgtgtgtgtgtgtgcacacacatgagtgcatgagcaagtgcatgtgtgttactgggcttgaacctagggcctcgtgtgtcaggcaagggctgagct

SEQ ID NO: 87352 - DNA, 78 bp, Mus musculus
gcacgtgtttttatgcatatgtgtttataatatgtacatattatgcttatatatttatgcatataataacatttatgc

SEQ ID NO: 87353 - DNA, 102 bp, Mus musculus
caacaacaaacagcacaaaacaaacaaacaaaacaaagtattttctttatttttgaaagatagatgatggaacattgttattgtttgtgcttgattctgttg

SEQ ID NO: 87354 - DNA, 67 bp, Mus musculus
aaggcctgatgtgtagtcagatatgatgtgaaactcacggtctatcactcactgtcattgtggcctt

SEQ ID NO: 87355 - DNA, 68 bp, Mus musculus
tgtggatgatgacaatgacaatggcaaggacaacagcagttctgtcagactctgtctaagcatttaca

SEQ ID NO: 87356 - DNA, 94 bp, Mus musculus
tgatagtattttataatttctctctgcaatgcatgcacatcctagggctgaggacgtagcttgattagtagagggcttacctaacatgttgtga

SEQ ID NO: 87357 - DNA, 76 bp, Mus musculus
tagggagcctggtttctagaaggtgatgggcagctggtaccactctgtgtcagtcagtatttaggaagggcctgtg

SEQ ID NO: 87358 - DNA, 78 bp, Mus musculus
gatctggctgagggtctgtctgtgtctggccagtatctggccaagttgcaactctacccccgaccctcttctggtgtc

SEQ ID NO: 87359 - DNA, 97 bp, Mus musculus
tgtgggtttataagcacattctggctgcttctagcttgaatagattaaatttgtccttctgttctgcgaaagagctgcaaagtgtctctggcctcca

SEQ ID NO: 87360 - DNA, 78 bp, Mus musculus
gtgtacacccgtatcatttgtatgcctgcttgcttatgtgattatgtctgcttacaagtgtatattgtatgggttcac

SEQ ID NO: 87361 - DNA, 90 bp, Mus musculus
tggacatgaatagcagatgtgctgttcctgttctaggctatctgggttagtcctagagaagacagacagacagacagacagacatgtcca

SEQ ID NO: 87362 - DNA, 125 bp, Mus musculus
ggggctgtgtttgttaaggacattggaggggttggagagatggctcagtggttaagggcactgactgctcttccagaggtcctgagttcaattcccagtaaccacatggtggctcacaaccacct

SEQ ID NO: 87363 - DNA, 77 bp, Mus musculus
ccgggatcctgtgattgtccacagagccgcaaagcattccttgtctctctgggtcttcattttgtggggactcctgg

SEQ ID NO: 87364 - DNA, 71 bp, Mus musculus
gctgggggactgagtgaagtcatacattttctatttcttacatagaccttgctttttcactctcttctggt

SEQ ID NO: 87365 - DNA, 87 bp, Mus musculus
tgggctgttgatcagttccagctgaggagtcgtctctctgcctcacagaatgtcagccctctcctctacctttgatagaaatgccca

SEQ ID NO: 87366 - DNA, 105 bp, Mus musculus
gaaagcctagaatgcttttgctaagagggaattaaatatcacagtgccacttctctagaaggtggttggttacaatgattcactgttagttcaggaaccggactc

SEQ ID NO: 87367 - DNA, 81 bp, Mus musculus
ggacattctcaggctggagagatggctcaggggttgagagtactgactgctcttccagaggtcctgagttcaattccctgc

SEQ ID NO: 87368 - DNA, 100 bp, Mus musculus
aaacagttgtttccttggccgagagcttagagaagacacagtgctgacggtaacaatggcatgaacgtgtgtggctgactcgtgactgggggatctgttt

SEQ ID NO: 87369 - DNA, 66 bp, Mus musculus
gtgcatgcgtgcgtgcgtgtgtacgtgcatgtgtgcatgtgtgcgtgcgtgcgtgcgtgcgtgcgc

SEQ ID NO: 87370 - DNA, 111 bp, Mus musculus
accttcttggctcagttttatatgggctgttgtatatctatatgtttatatgtgttgcatatatatatttatatgttgcatgcttatatgggctggtttttgctgagttgt

SEQ ID NO: 87371 - DNA, 96 bp, Mus musculus
gtgtacttatcaggctgcatatatgtgtagacaatatcgcttcctttattctgtgtgtgtgtgcatgtgcacaaaggtcagaggacagcctgcaca

SEQ ID NO: 87372 - DNA, 69 bp, Mus musculus
gggatcctctgcctctgtctctgtctcccgaatgaatgctgggataagaggcaggtggcaacactgcct

SEQ ID NO: 87373 - DNA, 63 bp, Mus musculus
gcaagtttgagagctgggaatggtggcaccagccttcaaaaccagcatgtagaagactgaggc

SEQ ID NO: 87374 - DNA, 85 bp, Mus musculus
ctgtgtcaacagcctgcagcctaagcagagacagaagctgtctcaatagagtgtgctcagggtgcagctaaaggtgctggctcgg

SEQ ID NO: 87375 - DNA, 115 bp, Mus musculus
gagagcatgctggatactggcaaagacctggtgtgagttgagactggccagactgggcaagtctagatactggaggatcttaaatgccaggagcagagtggacagggtggtgctt

SEQ ID NO: 87376 - DNA, 105 bp, Mus musculus
ggcttcctcagcacccgagtgatgggtgacgggtgattgtcttcctgtgtcactggctgcctgtaaggccttctctttgtgggtcacctcacacagatcaattgc

SEQ ID NO: 87377 - DNA, 81 bp, Mus musculus
tatattatatatgtattatacatatacattatgtatatgtatatgtgtataggtgtgtgtatgtatgtgtgtgtatatata

SEQ ID NO: 87378 - DNA, 80 bp, Mus musculus
gccaaaatcaaaaagacagtaacgagtgttgtcagggtgcacacacatgggagccctcacacattgctggtggtagtggc

SEQ ID NO: 87379 - DNA, 65 bp, Mus musculus
gacagtaggctagtccttcaggtgagtgacaggtgacagggtggaggggctgagagtctgaggtc

SEQ ID NO: 87380 - DNA, 84 bp, Mus musculus
caggagaagccacacactttggtggcaaaagactttgactcacagtgtcagagtgtttgtccactgaatgacaccactttcctg

SEQ ID NO: 87381 - DNA, 64 bp, Mus musculus
gggtttgtccagcttacacttccatgtcactgttcatcactgaaggaagtgaggacaggaactc

SEQ ID NO: 87382 - DNA, 92 bp, Mus musculus
ttgggaggtggtagaagaggaagagatgttttctagatggagaaggacatacacagagaacagtgtgctcaaggttatcaaaatatgcctgg

SEQ ID NO: 87383 - DNA, 71 bp, Mus musculus
ctttaaaaaccctgaggctagagaggtggctcgaagttaagagcactgactgctctttcagaggtcctgag

SEQ ID NO: 87384 - DNA, 84 bp, Mus musculus
gtctggtgttacgcctggaatgtcgctttggaggattcagaacctcactatgactgaactcacagaggactggcgccacctggc

SEQ ID NO: 87385 - DNA, 72 bp, Mus musculus
tttgagacaagtctctctgtgtgtaactctgacactcttagaatttgctgtatagatgaggctggcctcaaa

SEQ ID NO: 87386 - DNA, 77 bp, Mus musculus
atcccgaactcactttgtagaccaggctggcctcaaactcagaaatctgtctgtctctgcctcccaagtgctgggat

SEQ ID NO: 87387 - DNA, 120 bp, Mus musculus
ctgcctctgcttcccaagtgttgggattaaattcgtgtgccaccaccacccagcaattttattttcttaatactcttgttgcccactgtatacatcctgcactggtccttgtttcggcgg

SEQ ID NO: 87388 - DNA, 80 bp, Mus musculus
cagtcccagaatttcctcagtgtctctctttgtggcttattctattcagccacatgtaataaagaggatcagtagaactg

SEQ ID NO: 87389 - DNA, 108 bp, Mus musculus
ccttcctcctgacttcagagcactgcgtgtgcagcccctcagtcactgtctgtgctgctttcccgagtcccgtagagttttgaccttgtggtctggagcgatcatagg

SEQ ID NO: 87390 - DNA, 104 bp, Mus musculus
agattagcattgcaatggaagtaagatgtgtgagagtagagattaagtactaggctggacctggacctgactatgtacccggaatggcattggatggatgatct

SEQ ID NO: 87391 - DNA, 100 bp, Mus musculus
gcatgggtatgtacatatatgtgtgcttgtctttgtgcatatgcatgtgtttatgcatgtgtatatgtgtgcttatacctatatgtgtgtatgcctatgc

SEQ ID NO: 87392 - DNA, 133 bp, Mus musculus
ctattcccattgcctaaggagaagacatgcctagcactctactccagaaacatgctagtgtctatgttcttgtgaagtgggtcaaatggcataaatcagatcccctactacataaagatagtgctgagcaatg

SEQ ID NO: 87393 - DNA, 121 bp, Mus musculus
gggggctgagttgagatagggactcctcagcaaccgagggcctctctcttgctctcagtgtccttgctggggtgggtggtccagggtttcttactccttggaggccatgtcggccatgagg

SEQ ID NO: 87394 - DNA, 119 bp, Mus musculus
ggggatggggatatgagttcttgggtagaattttgggggtcacatatgtatattattatatcatctgcaaatagtgatattttgacttcttcctttccaatttgtatctctttgacctc

SEQ ID NO: 87395 - DNA, 101 bp, Mus musculus
ctgcttccctgtcctttgttgaagccttggactgtttgcttggggaagtgagtgagcactgagcaggcagtcagggctgtgaagggcttgtctgggaatag

SEQ ID NO: 87396 - DNA, 109 bp, Mus musculus
ggaattctgggattaaacccctggctcatcactttgttcataggctctgttaagtcactcatactcagtgagtctatgttctgtgtcttgtttatttcaccaacattcc

SEQ ID NO: 87397 - DNA, 114 bp, Mus musculus
tggttttcgagacagggtttctctgtgtagtcctggctgtcctggactgtatatatatttgtataagtcttaggatttatatggattgttcattatttgctgtctccttgatga

SEQ ID NO: 87398 - DNA, 67 bp, Mus musculus
tatatgtatgtatatgtatgtgtatatgtatatacacacatataacacacacacacacacacatata

SEQ ID NO: 87399 - DNA, 100 bp, Mus musculus
tatatataaacatgtatatgtgtatatatgtgtgtacatatatgtgtatgtatatatgtgtgtgtacatatatgtgtatatatgtatatatgtgtatgta

SEQ ID NO: 87400 - DNA, 72 bp, Mus musculus
gcctatgaccacacctagctttcatgtgggttctgagttctgaactcaggtcctcatgatggtacagaaagc

SEQ ID NO: 87401 - DNA, 108 bp, Mus musculus
aaggttctaacggatggtttcttatctctttacatttccccaggtaacagtactgaaaatgtacttttatggggccactgtgcttctgagaggctgtacgtaaatctt

SEQ ID NO: 87402 - DNA, 114 bp, Mus musculus
atgttttcgactcggtgatgttagagtccctttctccccaaacaaccttcagtcctacacacaagacactcaggtctgggaagaactgccactgtagcttattttgtaatacat

SEQ ID NO: 87403 - DNA, 102 bp, Mus musculus
ctgtaagtcgccatacccttctggaactgtgtatcagtggatcctgttactctgcagggagagaggacactgagatgacagcagtgggtcatagatgttcag

SEQ ID NO: 87404 - DNA, 73 bp, Mus musculus
gacttggctgatctcagagttctgtctgcctgtttcccagtgtgtattgaaggcagagctcccgtggccggtc

SEQ ID NO: 87405 - DNA, 83 bp, Mus musculus
aggaagcatatttttgtaattaactaaactagtatctaaaatgaccataagtttagttgactaactactaacatgtgtttctt

SEQ ID NO: 87406 - DNA, 88 bp, Mus musculus
gacagggtctctcactgacagactggctggccaagaggctccagggattcccgcgtctctgctggtcctccatggtggagctactgtt

SEQ ID NO: 87407 - DNA, 103 bp, Mus musculus
agcagcatgctcctggacgtcctttctgtggtgctggtccagtcgcctgtgcctcacactctgtgttacagaagctttaggtccggcttgtggtagccttgct

SEQ ID NO: 87408 - DNA, 82 bp, Mus musculus
gtgctattgggcagtctcacgttgaatagtagagtttgatgttgtctttaaactgttgactgtgagctcacttattgagtac

SEQ ID NO: 87409 - DNA, 95 bp, Mus musculus
cagacaggagttctctgcggctgagagaagagtgtctccaggaagagttcatgtggatgcacatttgtaggatgtagagatcaaacaccaggatg

SEQ ID NO: 87410 - DNA, 100 bp, Mus musculus
tctgtgacattgtcttttgcatggtctgtctctctttctcattctctgttccagggggcctcagcaggtaatttaaaagactaacaaactttggcataga

SEQ ID NO: 87411 - DNA, 82 bp, Mus musculus
cttgggcacagagaaacccaggatctgatgtctggagccctcagctctgtgactcaggatctctcagtgtcagaatcttggg

SEQ ID NO: 87412 - DNA, 70 bp, Mus musculus
gcaaggagtggttagacagagtctacgtagccttggctgtcctagaactcagtctgcagaccgagccggc

SEQ ID NO: 87413 - DNA, 73 bp, Mus musculus
gcaggaagtgatgagcaggatggactggaatctgcgtgcacgagtcagtctcagtctctgccctcctctgcac

SEQ ID NO: 87414 - DNA, 77 bp, Mus musculus
gtgtctgtctgtctgtctgcctgcctgcctgcctctcgcttgagagcgtgcacacacacacacacacacacacacac

SEQ ID NO: 87415 - DNA, 79 bp, Mus musculus
aagtctcagcatctgttttctgactgcacagggatggctttgagtcatcctctctgacactctgcagaagttgtgactt

SEQ ID NO: 87416 - DNA, 119 bp, Mus musculus
gggatgcctccctgttcctcagtgtgctgcctggcactgtagagtgatgcaaagaccttgagctcactgatcactgtgagggcaggcttcctttgtcacttgggtaaatagctcagtac

SEQ ID NO: 87417 - DNA, 68 bp, Mus musculus
gtatatatgtatgtatgtatatatgtgtgtatgtatatgcatatatgtatatatatgtatgtgtgtat

SEQ ID NO: 87418 - DNA, 126 bp, Mus musculus
tctcactcaggcagcttgctactcagaagaacactggagtgggaaggcaccccaggctgtaagtgatgagactgattgagcacactttcaggtaaccagagtgtcaccccagaatatccccctgtc

SEQ ID NO: 87419 - DNA, 105 bp, Mus musculus
gtttccaagttcttctcttgaaccaaatggccttttcagtatggaatctatccaagtttctttgatgcaaagcccatgaaatttgtgcagagagctctggcagac

SEQ ID NO: 87420 - DNA, 108 bp, Mus musculus
cttaattcgttttgctgttgtccatgtgatatgtgtactgtttttatttaatacctttgaaagcactgttgtaaaatattcacaggttttgggggtggcttggttggg

SEQ ID NO: 87421 - DNA, 118 bp, Mus musculus
gtggtgcttacacaccacactctctcacacactttattttgtgcatgcgtgtgtgtgtgtgtgtgtgtgtacacaatccacacatatacctttactgaagtaatacaatggatgacga

SEQ ID NO: 87422 - DNA, 81 bp, Mus musculus
ggatttcatatgtgtgtaccacatgtgtgttacacacgtgagcacactcacatacacactcacacacagcatatgatgttt

SEQ ID NO: 87423 - DNA, 83 bp, Mus musculus
tggactttgtggcagaagtgacagtggactcatgtctgtgagaccagcacctcctgtttccctttgcttgattggttagtcta

SEQ ID NO: 87424 - DNA, 113 bp, Mus musculus
gaatgtgtctcccccatcctctgtgtatgcatgcatatatgtatatgtctgtcttttactctgtgcatatacgtctctgtgtgtgcatgtgtgtatgtggttgtatatatgtc

SEQ ID NO: 87425 - DNA, 76 bp, Mus musculus
ttctgcctcagcctctgactcacttggagggcagacacctttgctttcttagagagctccttgttgatgagcagaa

SEQ ID NO: 87426 - DNA, 115 bp, Mus musculus
tgccactatgggagtgggctttcagttctatgcttaagctacccccagtgggacacacagtctctttctactgcctgtggatcaagatgtagaactctcggcttctcctccagca

SEQ ID NO: 87427 - DNA, 76 bp, Mus musculus
cttaaactggggggactgcgtatctctgtgaggttttcaggaaaacctttcacagtaaagtcaataaagctttgag

SEQ ID NO: 87428 - DNA, 80 bp, Mus musculus
ggaagggtggtggatcttttggccagagtgactcctaaaacaattaattcacccgtttggctctctgtctctgtccctct

SEQ ID NO: 87429 - DNA, 73 bp, Mus musculus
gttgttgagtatttgtatttctcatgtttccagtgagatcatgcactggaatgtggtgaaaacagccaacagc

SEQ ID NO: 87430 - DNA, 94 bp, Mus musculus
ccagagtgagggccttgtatgagaagttcagactgtgcacacatgcgagcaaagtatgctgtgatctccttttccctttacaagaacattctgg

SEQ ID NO: 87431 - DNA, 115 bp, Mus musculus
gagggatattagagaggactcatttgaatttatgaacttaaagcttgattagttctgaaacttaaagtcatgtgctgtgatgaaataattttattcttctgtctatctatctatc

SEQ ID NO: 87432 - DNA, 63 bp, Mus musculus
aacctcagtgagcacacaggcacctttgggcaaaagtcataggtgaccgtctctggctgggtt

SEQ ID NO: 87433 - DNA, 119 bp, Mus musculus
ttctgagcaacattttctggctgtttgtttctagataatgtgtgtgtgtacacacacaagtgtgtgtgcatatttgtggcatggctcatgtatggaggtcagaggacaacttgcaggag

SEQ ID NO: 87434 - DNA, 119 bp, Mus musculus
acatatatacatacatgtatatacacattatatatatgtgtgtgtgtgtatatatatatatatgtatatatatgcacatgcatatgtataagtatgtgtatgtatgtgtatatgtatat

SEQ ID NO: 87435 - DNA, 157 bp, Mus musculus
atatacatatacacatacatacacatacttatacatatgcatgtgcatatatatacatatatatatatatacacacacacacatatatataatgtgtatatacatgtatgtatatatgtctgtgtgtatgtatgtatgtatgtatgtatgtgtgtat

SEQ ID NO: 87436 - DNA, 94 bp, Mus musculus
atatacgtttatgaatgtgcacatatgtgtgtgtatatatgtatgtgtatatgtgtatatatatatgtgtgtgtatatatatatatatgtgtgt

SEQ ID NO: 87437 - DNA, 72 bp, Mus musculus
ccagctgccctgtgtctctttgtgtatgacgagcttcgattcctaactacaaggacaaatttggagggctgg

SEQ ID NO: 87438 - DNA, 108 bp, Mus musculus
cttgccttgaaagcatcttttgaggattaattgatgtctgctctttgctttgaagaggagagagagagagagaaagagagagagagagagaagagagagaggaaagag

SEQ ID NO: 87439 - DNA, 63 bp, Mus musculus
gtggtgtgtatgttgcacatgtgcatgtatgtgcatgtatatgtgcatgtgcatgtgcaagac

SEQ ID NO: 87440 - DNA, 101 bp, Mus musculus
tggaaggtcccttcggaggacggttaaagctatgctcagtggagcatccctctgcctctctgggtctctccacttggtgtctctggtagtagatgaaccac

SEQ ID NO: 87441 - DNA, 82 bp, Mus musculus
cctgtacatcctcagacctgggcttgggaattttgaactggctgagccagtgggtcaggtaggaggttctgtttgtaccagg

SEQ ID NO: 87442 - DNA, 69 bp, Mus musculus
tgtcctggctcccctaggcagggactgtgatggcccctctctatctcagtcactgtgggtgtgctaaca

SEQ ID NO: 87443 - DNA, 84 bp, Mus musculus
atgtgtatgtatgtatgtatgtatatgtgtgtatatatacatacacacacatacacatatatatatatatatatacatacacac

SEQ ID NO: 87444 - DNA, 75 bp, Mus musculus
gctatggtctaagctgctaggacagcagaggagctgtgggcagtgtctgtgtgtctgtgtggcaagggtcagcgc

SEQ ID NO: 87445 - DNA, 70 bp, Mus musculus
ggacgagtggcaggcagctgccacattgcaggtctgtggtggcctgtaggtgtctgtctgtctgtctgtc

SEQ ID NO: 87446 - DNA, 100 bp, Mus musculus
tgtgtgtgtgtgtgtgtgtgtgtgatatatatatatatatatatacatacatacatatataatatatatatatgtacacacacacacacacacatatata

SEQ ID NO: 87447 - DNA, 113 bp, Mus musculus
ttaattgttaagagtaaatttgcattagtgaaatatactacatgctttaaaagttttagattagatatgtagggaatttaatcatatgctatgtatttattctttatagttgg

SEQ ID NO: 87448 - DNA, 70 bp, Mus musculus
ttggttgtgtgtgtgtgtgtgtgtgcatatatatatgtatgtatgtatgtatgtatgtatgtatggttgg

SEQ ID NO: 87449 - DNA, 65 bp, Mus musculus
cgggagccggtgttcatcagggtatgagacgagtcttgtgtagctccctgacttcccagcttttg

SEQ ID NO: 87450 - DNA, 81 bp, Mus musculus
gtcatggtggagagggcaggatggggtttgaggttttaaaaggctgtgccaggtccagtatctgtctctctgcctctggac

SEQ ID NO: 87451 - DNA, 90 bp, Mus musculus
tcagattttaagtctcttacactcactcttttggctccaacatgatgcaagagttggagagacaagtttgggaaatagacctggatttga

SEQ ID NO: 87452 - DNA, 91 bp, Mus musculus
ttgtgtgtgcatgcatgtgtgtgttcgtgtatctgtgtgtctgtgtgtgcaggcacacatgtgcaaacacacacataagtgcaggagccaa

SEQ ID NO: 87453 - DNA, 65 bp, Mus musculus
tgctgggaagtgctagaaggttctatgaggggctcctggtggaacaaggctaggcttcagctgca

SEQ ID NO: 87454 - DNA, 92 bp, Mus musculus
gttgtgtggggggctggagagatggctcagcggttaagagcactgactgctcttctgaaggtcctaagttcaaatctcagcaaccacatggt

SEQ ID NO: 87455 - DNA, 63 bp, Mus musculus
taggggaaaaagatagggaacacacgtgtctgtcatctgtgtgtctctgtctgtattcttctg

SEQ ID NO: 87456 - DNA, 131 bp, Mus musculus
gagcgcttgtccaaatccttcccttcctgctggtgctagggtgactcagtgtcctcagtccgtctgtccctgcgatttccacaaatgaaaacaaaggagtgcacggacttagagctctctcgccgttctcc

SEQ ID NO: 87457 - DNA, 79 bp, Mus musculus
catgtggatctggatctagcagcacactcggctacctctccagtaccgtgtctgcctgtgtgccaggctcccctccatg

SEQ ID NO: 87458 - DNA, 103 bp, Mus musculus
aaggattttcagcttctctgttgagcatgactgcacttcagattcttaaatggagctgtagagagatgacagtgatcagtttaaaactcagctggatgccctt

SEQ ID NO: 87459 - DNA, 90 bp, Mus musculus
ggaaaataagccacacatggtgttttgtgtctgtatctcacagcttggagctaggtgctgcagaaagaggattgttgagcgtttaaggcc

SEQ ID NO: 87460 - DNA, 69 bp, Mus musculus
ctgacatgaggtctagggttcattcctctaccgagccggcagagagagaagcttgtctcctcagttcag

SEQ ID NO: 87461 - DNA, 92 bp, Mus musculus
tacttcttgattagcttctttgggtctgtggagtgaagtggtgatgtcgaatttcttaagttctttatatatcttagaaattagtagaggta

SEQ ID NO: 87462 - DNA, 81 bp, Mus musculus
gagtgtgcagagcaaactcggtcgcctccacaaggacaactctcatctgtcctgtctgtgtgactctggctcctcctgctc

SEQ ID NO: 87463 - DNA, 76 bp, Mus musculus
gcttggtttggtttggttttgagacagtctctctgtgtatccctggctgtcctagaacttgctgtgcagaccaggc

SEQ ID NO: 87464 - DNA, 114 bp, Mus musculus
ctgttgtgtctatgtgcctgtgtctgtgcctgttcctgtgtctgtctgtgtctgtgtggatacatgggagtggaggggcttgaggaactcagaagaggatgttggatgccctgg

SEQ ID NO: 87465 - DNA, 111 bp, Mus musculus
gttcaccaaatgtactccttttcttatggttttataaaacacaaaagtcatgaagcctgactttctctgtgtcagagaaaccatctttgagatggggtttctctgtgtagc

SEQ ID NO: 87466 - DNA, 92 bp, Mus musculus
tctggccagaattctacaggaggactggagagatggctcagtggttaagagcactgactgctcttccagaggtcctgagttcaattcccaga

SEQ ID NO: 87467 - DNA, 81 bp, Mus musculus
tcttgatatatgtatatatttacatatgaacatctaatttttatttatttgtgtgtatgtgtgtatgcaggtgtctgtaga

SEQ ID NO: 87468 - DNA, 85 bp, Mus musculus; identical to SEQ ID NO: 57470

SEQ ID NO: 87469 - DNA, 83 bp, Mus musculus
ccttagctgtgagtcagaactactccagagctcctctcagatgccagggtagctgtgtgatgtgtgtgatgtctcacagcagg

SEQ ID NO: 87470 - DNA, 101 bp, Mus musculus
cattggaagatctggctatggaatatgcctgtaattcttgggacccaggaagctgtggtaggaggttggagagttcgaggccagtatgagcagacacagtg

SEQ ID NO: 87471 - DNA, 81 bp, Mus musculus
gcaggtactagtgatggctcttctactaggggacttccatggtcccgttccgtgtgactggcactcactgacaggcactgc

SEQ ID NO: 87472 - DNA, 109 bp, Mus musculus
gctctgggccaagcatagcagaaggaggagatccactggctctcccacacaggagacagaagacacactggtctctaccttcctcaaagctgttccctgaccccctagc

SEQ ID NO: 87473 - DNA, 88 bp, Mus musculus
gtctccatgtggtttggggaccaacactgaaatgggagggtgtcatacactctgtgtctattctcatctcccaaactgcctggaaggc

SEQ ID NO: 87474 - DNA, 105 bp, Mus musculus
acagtgaggttttggaggtgaactcagagtcaagtaagacaccacatcttattcgggaagcgcttgtcatgggatctctgatgtgtactcttcccatttggctgt

SEQ ID NO: 87475 - DNA, 80 bp, Mus musculus
cagaggcttctgtgggtgtggatgaggatgctgtctgaacacagctgggctctctctctctggcaccctccaagtctctg

SEQ ID NO: 87476 - DNA, 108 bp, Mus musculus
aaggctgaacatgagcaataatttttccaagttgaccacttggtatagtatttaactatttataagttattcttcaacagaggctgagtttgcttttgtttttgtttt

SEQ ID NO: 87477 - DNA, 63 bp, Mus musculus
ctctagagctgaagagatggcttggtggttaagagcactgactgctcttccagaggtcctgag

SEQ ID NO: 87478 - DNA, 101 bp, Mus musculus
gtcctagcactgtgaagcaggagcaggtgagtctctgtctgagtttgaggccaggctgttctatagagctagtttcaggacagccagaactatgtagagac

SEQ ID NO: 87479 - DNA, 114 bp, Mus musculus
agctttgtccttgatctaagtgtaagctttgtccttgatctatagtatatgtttctatttacataaacatagtcatcaggcaatatggaaattcaaaagtaggtatgtcaggct

SEQ ID NO: 87480 - DNA, 65 bp, Mus musculus
ccagggccagctgtgtgctttggaaagcggcttctctaatttcttagcacacactctctctctgg

SEQ ID NO: 87481 - DNA, 104 bp, Mus musculus
gagagacaggtgagccttgtggggcttagggttcttttttttatcttaatgaagggttctcagagaccctgagttatgaccaacaaaggcacatcaagtctggc

SEQ ID NO: 87482 - DNA, 66 bp, Mus musculus
ggcatgagggtgtgggagacagagggtgggcaaccttgcttcacactcagactcacatcctctgct

SEQ ID NO: 87483 - DNA, 65 bp, Mus musculus
gggtggccagacatcctcagggacaacccctaagatgtgtgtctctgcctggctctttgccaccc

SEQ ID NO: 87484 - DNA, 87 bp, Mus musculus
aagacagggtttctctgtgtgtctctggctgtcctagaactcattttgtagaccagactgtcctcagactcagagatctgcctgctt

SEQ ID NO: 87485 - DNA, 76 bp, Mus musculus
atatatatatatatacacacacacatacatacacacacacacacatatatatgtctgtgtgtatatgtatatgtat

SEQ ID NO: 87486 - DNA, 102 bp, Mus musculus
tttcttactgtttttctttagaagtaggatattaaagattagcttttagcatgaaaagttaaatttcacaagatgtctttttttaacagaacatgcaagggg

SEQ ID NO: 87487 - DNA, 86 bp, Mus musculus
tcggggatagctagctggatagctagcatatatatataactagtatatatatatatatgcttcctgtctatatttagcaccataga

SEQ ID NO: 87488 - DNA, 58 bp, Mus musculus
tctagacagacagacagacagacaaaaagattcattctatctgttctgttcctctaga

SEQ ID NO: 87489 - DNA, 103 bp, Mus musculus
aagatgtattatttacgtatataggtactttgtctgcatgtccatctgcccagcagaaggtggcatcagacaagcctgagctgtcatgtggatgctgggactt

SEQ ID NO: 87490 - DNA, 86 bp, Mus musculus
gtatgtgtgtatgtgtatgtgcatgtatatgtgtgtgtgtgtgcatgtatgtatgtatatgtatgtgtatacatgtatgtgtatat

SEQ ID NO: 87491 - DNA, 87 bp, Mus musculus
ctgagctctcggaatgctcaagatctggcctggtttctgctcttcttctgggaccagccttctttctccacattcaggcttgcttgg

SEQ ID NO: 87492 - DNA, 91 bp, Mus musculus
cttgaggctgggacaggaggaagccctggaactgatctccatggatactgagagatggttatgcattgttaacattctggacctacttagg

SEQ ID NO: 87493 - DNA, 88 bp, Mus musculus
agagcctaagggcaggagcatggtaggaagtgtgggtactcaccaggtgaagggtgtcggctttctgtgtctgtctctgtcggctctt

SEQ ID NO: 87494 - DNA, 63 bp, Mus musculus
ggcttctttgaagtagaataggggtgctgtcaggagctgacatgtctcactgtcaaaaaagcc

SEQ ID NO: 87495 - DNA, 59 bp, Mus musculus
cctaaggtcacaggcacatgtttttttttttaaagacagagctgggctatgatcttagg

SEQ ID NO: 87496 - DNA, 71 bp, Mus musculus
ggaaacctggaggtgaataaaggaaccccccccttaagggcgggctgactgtcactcactcttggttggcc

SEQ ID NO: 87497 - DNA, 115 bp, Mus musculus
ggctcccaggggctggttctgccctgcctgtgagacagtagaatgagtgctcccaagagactgctttggccttatttctattccaactaacaagctgaattacccactggcagtt

SEQ ID NO: 87498 - DNA, 92 bp, Mus musculus
gcaggaggaaggagataggcattcattcatattcataccccctccttttccctctgtatctgtctgcctgcctgcctgcctgcctgcttgcc

SEQ ID NO: 87499 - DNA, 107 bp, Mus musculus
ttaccttaaaaatgtacttcctggggatggagagatgacttagaggttaagagcactgactgctcttccagaggtcctgagttcaattcccagcaaccacatggtgg

SEQ ID NO: 87500 - DNA, 85 bp, Mus musculus; identical to SEQ ID NO: 57470

SEQ ID NO: 87501 - DNA, 114 bp, Mus musculus
tctgaaggctgcttagtggggaaacaattgttcttaaaagacttttaaaatgtatgtgcatgtaaatttattcatatatatgtaagatcatgtgagtgctcctatgcctggaga

SEQ ID NO: 87502 - DNA, 77 bp, Mus musculus
gggagtactaggggctggagagacggctcagcggttaagaccagactgctcttccagaggtcctgagttcaattccc

SEQ ID NO: 87503 - DNA, 68 bp, Mus musculus
gtgtatatgtgtgtatgtgtctgtttatctctgtgatgaggtggagaggtacatactcaggtatgcat

SEQ ID NO: 87504 - DNA, 101 bp, Mus musculus
tgagaaacagagggggaggggagcacgggtccggagggaacaacgcaacaatcaagggctgtgtggttctctctctgtcccctcagctgctgcaattttca

SEQ ID NO: 87505 - DNA, 82 bp, Mus musculus
aagcagtccccagtcagtcactgtcagtcacctcagcccattgaaatgttctgcagaatgctatagttttgggtatttgctt

SEQ ID NO: 87506 - DNA, 177 bp, Mus musculus
tatataagtgtatacgtgtatatgtatatatgtgtataagtgtatatgtgtgtaagtgtagatgtatatatgtgtataagtgtatatgtatatgtgtataagtgtatatgtataaatgcatataagtgtatatgtatatatgtgtatatatgcatatgtatacatgtgtatatgtgt

SEQ ID NO: 87507 - DNA, 107 bp, Mus musculus
agaatgatgcttgagaagaccggctgcgcttccagtcatgttacagagcacacaatggcactgtggctctctgcctggctatagaaaacaggcttctttcatctgct

SEQ ID NO: 87508 - DNA, 81 bp, Mus musculus
agtgagtgactctctgaaaagcggaatgaagagtggcaggagttaactttacaggatttgttagatctctgagcattcact

SEQ ID NO: 87509 - DNA, 85 bp, Mus musculus
tctggaggtgagttctctgactcactcacttactagtgtagatgtgtatgtacatttgtgtggtagtcagaggacaacttctggg

SEQ ID NO: 87510 - DNA, 67 bp, Mus musculus
agtccctgcagtctgatgaagctgactgtcactttcacacaaagctttccgtcaccacagcagggct

SEQ ID NO: 87511 - DNA, 100 bp, Mus musculus
tgttattcagcccacattttcatcctttgttttaaagtagttcaaattctgtaaaaacccagagctttgaaatagtcttgagtttcagggttgatttcca

SEQ ID NO: 87512 - DNA, 84 bp, Mus musculus
ctggggtgtgaggggaacagaggtcggcagtgtgcaccaagcaccttaagtgctgacttctctggctgtccctgggatccatag

SEQ ID NO: 87513 - DNA, 68 bp, Mus musculus
ctgttaaattcactcaggctctgcttgtctttccttcggctgcccacagagctgagtgaggtcaacag

SEQ ID NO: 87514 - DNA, 95 bp, Mus musculus
gagaccattcttattcaaaccaccacagtctctccctatctctctgtgggggagttggggcatggggtgggcatggggtgaattggggtaacctc

SEQ ID NO: 87515 - DNA, 80 bp, Mus musculus
tttttatatttgtgtgtgtgtgtgagtgcgcatgtgcacatgcacagacacagtcacagacacacacacagacatagaga

SEQ ID NO: 87516 - DNA, 88 bp, Mus musculus
tgtgtatgcatgtatgtatgtatgtatgtatgtgcatgcgggtgcccgcatgcacgcgagctcgcgcacagacacacacacacacaca

SEQ ID NO: 87517 - DNA, 111 bp, Mus musculus
cctagatgaggggtggagcgggggaacatggatttcaattcacacttggctactcactatctgtgtgactttgagatagttacttatgttctctgattcatctaaaatagg

SEQ ID NO: 87518 - DNA, 74 bp, Mus musculus
gtcaaggttgaggcacatggacagggtggtgtggggaaagctcaaactgtcactgtcattgtctgaccacaggc

SEQ ID NO: 87519 - DNA, 73 bp, Mus musculus
gtcttcctgtctcagtctctatgattccccacaggcatacccaggggtcattctaagatcctgtcgggctgac

SEQ ID NO: 87520 - DNA, 155 bp, Mus musculus
atgtatgtatgtatctatcctatgtatgtatctactgggtatctatctatctatactatgtatgtatttatatatgtatctatctggctacctatctataccatgtatatatgtatgtatgtatgtatgtattcataaggtctcattatgtagcc

SEQ ID NO: 87521 - DNA, 142 bp, Mus musculus
agaaatctgcccctatctctggattctagaaggccccaatttgatagtctagttttctgactgtgtgtctgtctcagtcttttagctggggagttgtttgggggtggagctatagacatggggtagaaatgagattagtggc

SEQ ID NO: 87522 - DNA, 94 bp, Mus musculus
acggtgggttctgtgctggagagatggctcagtggttaagagcactgactgctcttccagaggccatgagttcaaatcccagcaaccacatggt

SEQ ID NO: 87523 - DNA, 77 bp, Mus musculus
cctcacctggaactggaagtgaacatagatgtgtgtgtgcacagaacacatttgccccacccttcagcatcaagagg

SEQ ID NO: 87524 - DNA, 94 bp, Mus musculus
cccacatctgtgtacagcgccattcactcagactctgacaggtctgtcctcgtaggctctatggtgagttgggggttttctttgacagtgtggg

SEQ ID NO: 87525 - DNA, 99 bp, Mus musculus
cccttgctgttctggaacttgctatttagaccaggctagcctcaaattcacagaactctgcctgtgtctgcctcccaagtgctggattaaaagcatggg

SEQ ID NO: 87526 - DNA, 80 bp, Mus musculus
tgtgggcgtctctcaggctgtgagactttctcactgaggacagttctgaagctagcagcccctgtgagaggcaaccagca

SEQ ID NO: 87527 - DNA, 92 bp, Mus musculus
tggctcactgtgatggaaagtctttggccctctaggttggactgacaagagtctgaggacaagagagagaacctttccatcagggagaggca

SEQ ID NO: 87528 - DNA, 62 bp, Mus musculus
gtacatgcatgcatgtatgtaagtatgaataagcatacatgccagtgcatatgtgtgtgtat

SEQ ID NO: 87529 - DNA, 93 bp, Mus musculus
gagagacagtgaatccagactttagacatgcagatattggtgtatatgttgtatccatgtctgtctgtctgcctgtctgcctgcctgtccatc

SEQ ID NO: 87530 - DNA, 90 bp, Mus musculus
gtggttaagacaactgactgctcttccagaggacctgggttcaatgcccagcatccatgtggcagctcacaattgtctgtaactaactac

SEQ ID NO: 87531 - DNA, 59 bp, Mus musculus
ttgtacatggtgtctgtcttagtcactgttccactgctatgaagagacaccatgaccaa

SEQ ID NO: 87532 - DNA, 63 bp, Mus musculus
tacgggtcattaccatgtgcatgcatgcatgcatgtgcgtgtgcgtgtgcatgtgcatctgtg

SEQ ID NO: 87533 - DNA, 116 bp, Mus musculus
gtgtgtgtgcacgagtgtgtgtatgtgtgcatgtgtgtgtgtgcacatgtgtgtatgtatgtatgcatgtgtgtgcgcgtgtgtgtgcatgtgtgtgtgtgcatgtgtgtgtgcat

SEQ ID NO: 87534 - DNA, 64 bp, Mus musculus
gtgctctgtttcttgacttgacagagtggacagaggcatggcaaacaagggagagacagagtgc

SEQ ID NO: 87535 - DNA, 83 bp, Mus musculus
aggtctttgacaagatccatagcctgctcactggaaagcctgtccaatcgtgtgggcattctgtgtctgtcactcttagccct

SEQ ID NO: 87536 - DNA, 86 bp, Mus musculus
tctggtaaaattagtttgcattcagctgtcctcaatcatctcttatgactctgagactctgagaatgggcaggtttttggcccaga

SEQ ID NO: 87537 - DNA, 85 bp, Mus musculus
gtggcagctagctgacgggtgttgaaatggtgtatgtgcgtgcgaatgtgcacacgcacacacacacactctctggtggctccac

SEQ ID NO: 87538 - DNA, 105 bp, Mus musculus
tgggtttgtgtaatcccacataaagattagttacttattattttgataaaatatcttagctaaataatttaagaggagaagaatttatttggggtcacagtttca

SEQ ID NO: 87539 - DNA, 111 bp, Mus musculus
ttgttaggtagtggaatggggaaggagttctggaaagagaaaacagtgtgagcaaaggtgctctggtttgtacaagcattctaaaaatccttggtcctcagcttgtggcag

SEQ ID NO: 87540 - DNA, 110 bp, Mus musculus
gacagaggtgcttgggttggagctatcgttggatgcttgaaggcaggatggggcaaagatcttgaaccatttgattacagtattcttcctttaacaataatttctctttc

SEQ ID NO: 87541 - DNA, 113 bp, Mus musculus
gtctgttcttcagggaactgggagatggctcagttggacaaatttttgcactgcacatatgagtgcctaagttcagctgctcaggacccatatagaaatatgaggatagcagc

SEQ ID NO: 87542 - DNA, 88 bp, Mus musculus
gtctgcagggtaggtgtgactttttctattttataatggataagtccaacatttggaggagtaggtaacctgcctgaagtttgcacac

SEQ ID NO: 87543 - DNA, 94 bp, Mus musculus
ggctccttgataaatgtatccgagtctcagtctaattctgactctgtcagtgtaaagataaggaactctcaggataaaactgtgcaatggaaac

SEQ ID NO: 87544 - DNA, 90 bp, Mus musculus
ttatacacacacatatatatatacacatacacacatacatatatatacacatatgtatgtatatttgtatctatgtagaaagtagtatag

SEQ ID NO: 87545 - DNA, 114 bp, Mus musculus
tttggggttattttcagaagtgggtttaggaatatatttgtatacataggatgatgtgcatatgtatgcatttctgttgctgtatttcctaggagtagaatcacagaatgtacc

SEQ ID NO: 87546 - DNA, 86 bp, Mus musculus
ccatgagtgatttgataagtagtatatttccattctgaccacagggactgtcaagatgtgactctatatctctctcatcaccatgg

SEQ ID NO: 87547 - DNA, 106 bp, Mus musculus
ctagtactttgtgcatattttcatgaagataaatgggataatgtctacagtagtcacctcattggagatgctcataaatagcgttaggatggagacaaagtcatgg

SEQ ID NO: 87548 - DNA, 83 bp, Mus musculus
agcctcatagcatcccagagagtacatgtgtgtcttttaataaacaagttctttttttcattaaatgatgttgtgtgaaggct

SEQ ID NO: 87549 - DNA, 108 bp, Mus musculus
tatacatatgtgtatatatgtgtgtgtgtgtatatatatatgtatctaactttactaattaatatactgtacatatacacccacccttaatcttgtacatattgtata

SEQ ID NO: 87550 - DNA, 117 bp, Mus musculus
tcttcctttgtaaaaggtgtgtagagacgggcctattcatagagatctgacagagctgacacctgcttctccaaaagtgtagcttctctctaaccacactccactgacatttataga

SEQ ID NO: 87551 - DNA, 106 bp, Mus musculus
tatatattcacatacatgtacagatgcatattcatgtatatatatttacatggtgagatacatatatacatatatattcatgtgtgtatatgtatgtgtgtatata

SEQ ID NO: 87552 - DNA, 82 bp, Mus musculus
ataaacatatgtatgtatgtatgtatgtatgtatgtatgtatgtatatacgcatgcatgcatgtgtatatgtatatgtttgt

SEQ ID NO: 87553 - DNA, 85 bp, Mus musculus; identical to SEQ ID NO: 57439

SEQ ID NO: 87554 - DNA, 68 bp, Mus musculus
taggaatgtaggattctgaagagaggcactggtggtgaaactctccctctgactctctaaattcctac

SEQ ID NO: 87555 - DNA, 73 bp, Mus musculus
atgtatatgtatgtgtaagtatgtgttgcgtacacatgtgtatgtgattgtgtgtgtgtgtgtgtgtgtgtgt

SEQ ID NO: 87556 - DNA, 106 bp, Mus musculus
ttcctagtgatgatttaacaaactggatgatttcaaacaacagtagtatatttttattagtactggagatgaacctggaattaaaatatcatcaaagccataggaa

SEQ ID NO: 87557 - DNA, 117 bp, Mus musculus
atatatatgtatatatgtggatatacatatatgtatacatatatatatatatatatatatatatatatatatatatatatatatatatatatatcaggtatacataatctgtgtgta

SEQ ID NO: 87558 - DNA, 66 bp, Mus musculus
catgcatacatatgtatatatatatgtatgtgttcatatatgtgtgtgtgagagtgtgtgtgtgtg

SEQ ID NO: 87559 - DNA, 93 bp, Mus musculus
aacagaaagagtagatgatcttcagaccctacccttaactgaaaagctgttgacagcacataggtttggtgagagggagaattattgtttgtt

SEQ ID NO: 87560 - DNA, 91 bp, Mus musculus
acatgtaactgatacagcaaacatgcaatgcgaagtccttgctgtgtgtgaagcctgagttcacagagcatgcccatgtgtaattacttgt

SEQ ID NO: 87561 - DNA, 110 bp, Mus musculus
gcacccagtgatcagtatatctggggaaatcattctgtcattctgtccctcatatccctaggctctaaggtagcaatgatgttcctcattcccaagagttactgtggagc

SEQ ID NO: 87562 - DNA, 108 bp, Mus musculus
acagctggtcgaagctctttggatgctagccttagatggaaaggattttctgtctatatctatttcttactatggttggaatctatggtggtgccatggcccctctgt

SEQ ID NO: 87563 - DNA, 76 bp, Mus musculus
gaaagacaggtagtgcaatatttttgatgaatgcagaatgtagagctgcaaaagaatgtgtgtctgtctgtctgtc

SEQ ID NO: 87564 - DNA, 107 bp, Mus musculus
ttgtagtgtttacatgagttattaatattgaagattttcttgtggtgtctgatgactttcaaagattatttttcaaatattaaagtaatattcttgtttccctacaa

SEQ ID NO: 87565 - DNA, 98 bp, Mus musculus
gtatatatatctgtatgtgtatatatatatatatgtatatatatatatatatatatatatatatatatatatatatatatatataatagtacatatgc

SEQ ID NO: 87566 - DNA, 97 bp, Mus musculus
ggcttcaatccagtttttccagtatcctttgtgcttgatctttgcatgatggttcttgggagcagtgagtgtatgtgctgagaagttgcgaggagcc

SEQ ID NO: 87567 - DNA, 72 bp, Mus musculus
tggagacagtgtctctgactgaatgtggagctagtctgatggacagcaacttcatccagcctcctgtttcca

SEQ ID NO: 87568 - DNA, 85 bp, Mus musculus
tgtctatgtatgtatgtatgtatgtatccatctatctgcataaaaaatacagatgaatgggtttataggctatatatgttagata

SEQ ID NO: 87569 - DNA, 109 bp, Mus musculus
tttctgtatttttttaaattcccttttctagatgtttctttatatatatggaacccccttcaatatggagttaaatatcagaacttcaaggttgcataaggtgaagaaa

SEQ ID NO: 87570 - DNA, 117 bp, Mus musculus
acatataaatctatgtatatatttatgtgttttgtaaatgtacatacatatttgtatatatgtttgcatgtatgtatgcatatatgtatgtatgtatatatatttccatggcatatg

SEQ ID NO: 87571 - DNA, 74 bp, Mus musculus
atgcatgtatgtatgtatgtatgtatgcatgcatgtgtatatgtatgtatgtatgcatgtatgtatgtatgtat

SEQ ID NO: 87572 - DNA, 59 bp, Mus musculus
gtgtgtgtctctgtgtgtatgttatatacatgtatgtatgtatgcatggtggcatatat

SEQ ID NO: 87573 - DNA, 88 bp, Mus musculus
agaagtggtaatagtttttatttcttactaaccctgccagtgactcctggttggataatataaagatgttccaacttgccttacttct

SEQ ID NO: 87574 - DNA, 107 bp, Mus musculus
tagttgtgtgcacatacaggtgtgagcctctgctgctgtgtgtggaggctgaggacagacctgcacagctggctctcgcctgttacctgtgtgaaatctgcagactg

SEQ ID NO: 87575 - DNA, 88 bp, Mus musculus
atgtgcctgtgtgtgtgcatgtggaggccaggtgtcaatgatgagtgtctccctcagtcactctccacctcatgcaagtcaagcacgt

SEQ ID NO: 87576 - DNA, 113 bp, Mus musculus
ctggtacttgtgggccaaccaacaaagctgaaattccatgccacaggttcagcagacagaccctgtctcacagagccaggtggagaaagagcaaagctggtgctcattgccag

SEQ ID NO: 87577 - DNA, 85 bp, Mus musculus; identical to SEQ ID NO: 57470

SEQ ID NO: 87578 - DNA, 72 bp, Mus musculus
gaagagggccgtcactgggactctctctgaggcttggaaatggctcagggagatgtgaagaggatttttttt

SEQ ID NO: 87579 - DNA, 116 bp, Mus musculus
cctttatattatttttattcacatctttatgcttctttgtctctgtcatacacacacatacacacatgcatgcagagagagagagagagagagagagagagagagagagaagaggg

SEQ ID NO: 87580 - DNA, 118 bp, Mus musculus
tttattcagtttagcaaatatgaatattgaatcatcttaggattctgtcttctagagagaagacacaggggtaatgaagagatttaaaagtaccattgttttgcttcagttgcttaga

SEQ ID NO: 87581 - DNA, 84 bp, Mus musculus
ctcagggaagtgaagatcaatgaacaggcattgcacagctagctgtaccagcaagccaatctctgtctctgtcactccgttgag

SEQ ID NO: 87582 - DNA, 75 bp, Mus musculus
gtgtgtatatatatatatatgtgtgtgtatacacacacacacacacacacacacacacacacatataatacacat

SEQ ID NO: 87583 - DNA, 85 bp, Mus musculus; identical to SEQ ID NO: 57439

SEQ ID NO: 87584 - DNA, 69 bp, Mus musculus
gttctctcgggatacagtcttctagagctgggttgcttctcccacagtgcctgagtctctgagatgaat

SEQ ID NO: 87585 - DNA, 111 bp, Mus musculus
gtcctggggaatcttttggatctgaataccagtgctattgttgggacagactctctgaccctgataggcctgggcctggcgtttgcagatgccaaacttgctgagcaggat

SEQ ID NO: 87586 - DNA, 70 bp, Mus musculus
tcaaaactcagtctcactggggctgtcatagggtactgtgtaatccttccctcaggaggcagagacagga

SEQ ID NO: 87587 - DNA, 93 bp, Mus musculus
actaacattgctgttgtttctttcttgagtgtgatgtttgtgtgcacacatgcaggtgtagatgctcatggaccatggtgcatgcatggaagt

SEQ ID NO: 87588 - DNA, 73 bp, Mus musculus
aggtgtgagccactactgtctggctgtgtgtctcttttaaagacacactttttgttagattgaggtcctgcct

SEQ ID NO: 87589 - DNA, 79 bp, Mus musculus
tgctatagttctgtctgtctgtcagggcgtgtgtccagttcccgagggtgagtctgtggcagtggtggggagcatggca

SEQ ID NO: 87590 - DNA, 62 bp, Mus musculus
gctgtctgacagtcactcacccatcagtctctttggcatgagtgggcagtgctggctgcagc

SEQ ID NO: 87591 - DNA, 125 bp, Mus musculus
gtggctcccccggtttttttatcctagcgccatctagtggacactggctgcgactgttccctctgtcactcactcggatgatacctactgtagtacatagagccgagctgcagctgcccgtccac

SEQ ID NO: 87592 - DNA, 79 bp, Mus musculus
ctgtgtctgtgtctatgtctgtgtgtctgggtgtgcctgtttcggtatgccatgtgtgagcatgtgctgatacagaggc

SEQ ID NO: 87593 - DNA, 80 bp, Mus musculus
tggaagtccaaggatctagcagttactcactctcacacagcaagcaggcgaaggagcaagagctagactcccttcttcca

SEQ ID NO: 87594 - DNA, 117 bp, Mus musculus
gtactcatttccctctgatggcttggcacctgtgttccatcccctgttctccctgtgaggctctctctaagaaagtagaccagtaggatggcagtgttctccattatctgtgcatga

SEQ ID NO: 87595 - DNA, 112 bp, Mus musculus
agtctccaagggtcactggttccactctggtcccattaaggttcagcatctgcatctgcagcctcatctgcaacctttccagctcctgcgaccagttccccttcaggtaatt

SEQ ID NO: 87596 - DNA, 75 bp, Mus musculus
gtatgtatgtgtgtgtgcttgtacatgttcatgcttgtgtacatgtatataatgtgttcccatgcctgtatatac

SEQ ID NO: 87597 - DNA, 85 bp, Mus musculus; identical to SEQ ID NO: 60314

SEQ ID NO: 87598 - DNA, 133 bp, Mus musculus
gtatatgtgtatatatatgtataatacatatgtgtgtgtgtgtgtgtgtgtgtatatatatatgtatatatacagatatgtacatgtaaagatatgtataggtatatgtgtatatatacatatatatatgtat

SEQ ID NO: 87599 - DNA, 103 bp, Mus musculus
agagttatgagtgaaggcttgaagcttatcaacctagttgctacctgtgtctcttccttcacaagctgcttgtctgaacatctgtctcctcatttattcctct

SEQ ID NO: 87600 - DNA, 132 bp, Mus musculus
tatatgtatataaatgcatatgcacaggtatatatgtctttgtataggtatatatgtatatgtgtatatatatgtattaatatatttataaacatgtgtatgtatatgtgtatatgtatatgtatatatgac

SEQ ID NO: 87601 - DNA, 116 bp, Mus musculus
tatatatgcatatatatgcacatatatatgtatataatatatatgtgagtatatgtatatataggtatatgttataaacatacctatatatttatatgtaactaaagaatgtatgt

SEQ ID NO: 87602 - DNA, 85 bp, Mus musculus; identical to SEQ ID NO: 57439

SEQ ID NO: 87603 - DNA, 79 bp, Mus musculus
tttctgaccttcacaaatgcatacatacgtgtgcatggacaccatcacaagtgtgtgagcacacaggaacacacagaga

SEQ ID NO: 87604 - DNA, 107 bp, Mus musculus
atccctgtagttctttcagacaggaacaattatgggtcagagatgtgactgtggaatggtaaccctatccctcatttgatgtcctgccttcctgatggaggtggggt

SEQ ID NO: 87605 - DNA, 79 bp, Mus musculus
gcgagactcatggggactcccaaactctgtctcctaaagaagtttacagtgaggcagtgggaagtctgagacttcttgt

SEQ ID NO: 87606 - DNA, 111 bp, Mus musculus
gatcagccttagtccatggtgatctgataggatgcataggacaatttcaatatttttgtatctcttgaggcctgttttatgaccaattatatgatcaattttgaagaaggt

SEQ ID NO: 87607 - DNA, 86 bp, Mus musculus
gtggaactggataagagttattatacatgtgtgtatatatttgtatgcatttgtatatttagtaatagctcactgtcttttctgac

SEQ ID NO: 87608 - DNA, 85 bp, Mus musculus; identical to SEQ ID NO: 57439

SEQ ID NO: 87609 - DNA, 77 bp, Mus musculus
tcttgccatgaggaaaggcatggctgcagtatgaggcagcttctgtgtcacactgcgtctgtattcaggaagcaggg

SEQ ID NO: 87610 - DNA, 101 bp, Mus musculus
gtgggtttatgaaacttcctctatttgtctcacactgagtcactaagctgtagtttaaggagtcatgtaacgcagcagaggcctcttgatagacacatcac

SEQ ID NO: 87611 - DNA, 67 bp, Mus musculus
tagtaatcaggtgagacactctgtctaacagtgaaataaactgttgactctgctcatttgaccacta

SEQ ID NO: 87612 - DNA, 108 bp, Mus musculus
cagagatccaccgccaatcactgtgaggagaataacagactatggttttgtagctctaaatgagatatctaccttatagtcccttctcacaaggcttatgggtctttg

SEQ ID NO: 87613 - DNA, 61 bp, Mus musculus
gtttattggtagccttgtgttttacttgaatctattcagtaaggccactgctgtcatgagc

SEQ ID NO: 87614 - DNA, 101 bp, Mus musculus
aggtgtatcagataggtaagcatttatctgtatctatcgatctatctatctatctatctatctatctatctatctatctatgcttcctatctgatatattt

SEQ ID NO: 87615 - DNA, 67 bp, Mus musculus
tgttcatatcagtggtgtatgtatgcaggtatgtatgtatgtatatttgcatatataggtcagagca

SEQ ID NO: 87616 - DNA, 85 bp, Mus musculus; identical to SEQ ID NO: 57470

SEQ ID NO: 87617 - DNA, 75 bp, Mus musculus
tatatatgtatgtgtatgtatatgaatgtatatgactatatataaaatatatgaatacacacacatacatatgta

SEQ ID NO: 87618 - DNA, 93 bp, Mus musculus
aggtgtctgtctgtctgtctgcctgtgtctgtgtggaggtatcctgccaatcagcctttctcagaaaagaaatgccagtagtcttacctctgc

SEQ ID NO: 87619 - DNA, 78 bp, Mus musculus
tgactcagctatggtaatgagagagggaaaaaacatttagcatttcagacactctctcagattaaggaaatagagtca

SEQ ID NO: 87620 - DNA, 96 bp, Mus musculus
gtgtgacataaactgtgcagtgtgtgtgtgtctgtgcatgggtgcgcacgcgtgcgtgtgcacacgcacacacacacctaaacatccacattacac

SEQ ID NO: 87621 - DNA, 117 bp, Mus musculus
gacatttgctctggtcctccctggggaacactgtttctgcaactattaagattccttagtttctatttttctttgtgtagggttgaggctttgtgaccctctctgactcattttgtc

SEQ ID NO: 87622 - DNA, 65 bp, Mus musculus
gtgtataaatatgtatgtatgtatgtgtatatatatacatatatatatatatatatatgatacat

SEQ ID NO: 87623 - DNA, 118 bp, Mus musculus
agctgggatatggagcataattgcttgcattttatatgtatattccatgtatataagtatatatacatagaatatatgagatgcaactgcacatctgagattcatcatcatatttgct

SEQ ID NO: 87624 - DNA, 85 bp, Mus musculus; identical to SEQ ID NO: 57470

SEQ ID NO: 87625 - DNA, 94 bp, Mus musculus
gtaggttatgttttttatggcacagtatgatatttacattattattctatttagatgtgtagttgtaaggcttcctgaagacatcataacttat

SEQ ID NO: 87626 - DNA, 74 bp, Mus musculus
tggcagatgccaataagagtctgctgacaggagcctgatatagctctcttgagaggctctgtcagtgcctgact

SEQ ID NO: 87627 - DNA, 94 bp, Mus musculus
taaaggaattacctgtttgtttacatcttccaccatagtatgaatgtgctgatcagagaagtcaatgtgctgagcatggtagtgcacaccttta

SEQ ID NO: 87628 - DNA, 118 bp, Mus musculus
gtgttgagtcctttcgatttgagtaatcagatagctgagttgatgtgtctggctctcagtctctagatgagtagcgcataattgctttctctttttcaaagaaagtgctcattttcat

SEQ ID NO: 87629 - DNA, 133 bp, Mus musculus
gaagatgaagcaaagcagagcaggagcacatgactttgtgaatccacaagtttctaaggatgtggaagatggtagtttagtggtaggtctgctcaatctaggcacatgttttcattctggggcatatttggga

SEQ ID NO: 87630 - DNA, 104 bp, Mus musculus
aagatcagccttattccatggtggtctgaaaggatgcatggaagaatttcaatatatttgtatctgttgaggcctgttttgtgacaaattataaggtcaatttt

SEQ ID NO: 87631 - DNA, 64 bp, Mus musculus
tatgtatatgatgtacatgtatatatatatgttgtgtgtatgtgcatgtacatgtttgtgtgtg

SEQ ID NO: 87632 - DNA, 79 bp, Mus musculus
gaatacaggctcttctggaagtcactctgtatgtctgtagacctggctggcttacaactcacagacatctgcctgtctc

SEQ ID NO: 87633 - DNA, 68 bp, Mus musculus
gtctggagaagtcatgatctgataaaaagtcagtttttttttttagtatcaggttaacttctctggcc

SEQ ID NO: 87634 - DNA, 75 bp, Mus musculus
actcatatacacaagcaagcacacatgttcacaaatgcatgtatgtagcatgtatgtttgtatgtatgtataggt

SEQ ID NO: 87635 - DNA, 79 bp, Mus musculus
agttgctaggcaccacctgtgtctcactcactcacaaaaaaatgctgagttacatataggtgtgctagaatagtgaact

SEQ ID NO: 87636 - DNA, 80 bp, Mus musculus
ggttcctgcttttagaggagggtatatataacctctcagctactgcgcaagagatatgcctgcctgcctgcctgcctgcc

SEQ ID NO: 87637 - DNA, 71 bp, Mus musculus
tctgtcaccctctttctctgactggtcactttgtcaagcactcagttagaagtcatttgggggatgaaaga

SEQ ID NO: 87638 - DNA, 71 bp, Mus musculus
ctcagtctatttctgtctcatattctctaccatgttcccatgcagaaatcctggacaggggatgatctgag

SEQ ID NO: 87639 - DNA, 84 bp, Mus musculus
ttaaatgttgactggattggtgttcatcatataagcaatatttgctctctggatgaattctgattacagattcaatttctttaa

SEQ ID NO: 87640 - DNA, 81 bp, Mus musculus
tttatttatgtatgtacatgtgtaaagtggtggaagatttgctacacccatcaaaaatatatgtatgtttatatatgtaaa

SEQ ID NO: 87641 - DNA, 140 bp, Mus musculus
catgatcattatatatatatatatatatatatatatatatacacacacatatatatgtgtgtgtatatatgtatctatatatgtatgtatgtatatatacatatgtatatatgtatgtgtatatatatgtatgtatatac

SEQ ID NO: 87642 - DNA, 86 bp, Mus musculus
cagaaatctccaatgaagcagtttgaaattttctttttcactgctgagagatgaaagtcacaacaatgctaaggtggggaagtgtg

SEQ ID NO: 87643 - DNA, 95 bp, Mus musculus
aggatccgatggtattttggatttcttcaggatctgttgttatgtctcccttttcatttctgattttgttaattagaatgctgtccctgtgtcct

SEQ ID NO: 87644 - DNA, 78 bp, Mus musculus
tgagcgtcttctgattatattgctggaggcaatgttaaataatacagcttctttggaatatagtctggtagcagctca

SEQ ID NO: 87645 - DNA, 105 bp, Mus musculus
gggaaaagattcttttgagaatgtgtgagtgctaaagttcatattttttttaatctagaatgagatgggatggtagcattaacatagtaaaatggccatcttacc

SEQ ID NO: 87646 - DNA, 105 bp, Mus musculus
cataggtgattttttttcctaatatttcaagagcagcaaaataaaatacatctttgtgagtctttatctctgtgtgaattttaaggagtataaagtctatctttg

SEQ ID NO: 87647 - DNA, 116 bp, Mus musculus
ttcctgacactatgaatgatactttgttatgcttgtggacaggagcatagcattaatgtctgatgagagactccaccccgcagctgactataacagaccacagccattaaatggag

SEQ ID NO: 87648 - DNA, 85 bp, Mus musculus; identical to SEQ ID NO: 57470

SEQ ID NO: 87649 - DNA, 82 bp, Mus musculus
gtactgcaggagccccagatgagagggagcacaggttgtttaccaactaatgaacttttgtttgttgccattttttgagtac

SEQ ID NO: 87650 - DNA, 92 bp, Mus musculus
gtctgcatatatatatatatgtagtatatatatatatatttgtagtatatatatatactacaaatagacatactatatatatgtatgtttac

SEQ ID NO: 87651 - DNA, 85 bp, Mus musculus; identical to SEQ ID NO: 57439

SEQ ID NO: 87652 - DNA, 95 bp, Mus musculus
ttctctttcaggaattcttttgtgtgtgactcactgtatttcttcctcgtatgatggtagcttgagtttaggaaagataatttcatgaaagagga

SEQ ID NO: 87653 - DNA, 117 bp, Mus musculus
ccacaccacgctgtctgtggaaaagggacctcggacaaggcaggctcatcctgactggctctcactgaaacatcccaagtttctcacagagactctagctggagactttggtctgct

SEQ ID NO: 87654 - DNA, 95 bp, Mus musculus
ctctgtctctgtctttatctctctctctctgaccccccccccacacacacacacacatggtacatggaaagaagaggagggaagaactggaagag

SEQ ID NO: 87655 - DNA, 61 bp, Mus musculus
acacacacactcacacatatatatgtgtggtgtgtgtgtgtgtgtgtgtgtgtgtgtgtgt

SEQ ID NO: 87656 - DNA, 79 bp, Mus musculus
gatggaggttcacagagactgatcttcctgtgagctcaccaacgtttggagcagggtctgtctctgactcatcctcttc

SEQ ID NO: 87657 - DNA, 114 bp, Mus musculus
gtatatatgtatgtatatgaagtatatgagaactcttggttatatatgatgtatgtgtgtatatgtatatttatatgtatatgattttatgcatatgaacttgtatatgtatat

SEQ ID NO: 87658 - DNA, 79 bp, Mus musculus
tcatagcagctacatgatcattgtttttcaaataaaatgtgctttcattttatttgaaaattattcatgaagaagtgga

SEQ ID NO: 87659 - DNA, 151 bp, Mus musculus
acagagagagagagagagagagagagagagagagagagagagagactatataatctatctctatctctctctatgtctctgtatctttctgtctctttttctgtctttctctatagatagatagatagatagatagatagatagatagata

SEQ ID NO: 87660 - DNA, 117 bp, Mus musculus
gtgagagtcactgaatgatgtcctgcactcatggtagagaagtataatttgagcaaaattctgattatttttcatgagtgaactataaagggtgtaattataatttatcagctacac

SEQ ID NO: 87661 - DNA, 85 bp, Mus musculus; identical to SEQ ID NO: 57439

SEQ ID NO: 87662 - DNA, 85 bp, Mus musculus; identical to SEQ ID NO: 57439

SEQ ID NO: 87663 - DNA, 86 bp, Mus musculus
ggccatggtggtctgataggatacatcgggaaaatttcaatatttttgtatctgttgaggcctgttttgtgaccaattatatggtc

SEQ ID NO: 87664 - DNA, 87 bp, Mus musculus
tggagtaggttctatgaggtgctgagaaggtacattcttttgtttttaggatgaaatgttctatagatatctgttaaatctatttga

SEQ ID NO: 87665 - DNA, 103 bp, Mus musculus
tccattttttgtccctgcagttctttcagacaggaacaattctgagtcagtgtcagtcagtcccatccctcacttgttgctctgtctttctgctggaggtgga

SEQ ID NO: 87666 - DNA, 96 bp, Mus musculus
gatcagccttagtccatggtgatataataggatgcattggacaatttcaatatttttgtatctgttgaggcctgttttgtgaccaattatatggtc

SEQ ID NO: 87667 - DNA, 84 bp, Mus musculus
gtctgttggggattgagaatgcttcctgagagggcacacaactccaaaatgcatttaaactagttcttatatcctgagccaggc

SEQ ID NO: 87668 - DNA, 102 bp, Mus musculus
gctagcccatcaaattcaatgagctttcaattatgacatgtgattttgtagctgcataccacatgtcaatatggtgtaaagcacatggaagtagaataatgc

SEQ ID NO: 87669 - DNA, 122 bp, Mus musculus
acattatgctatgcatatgtatatatatatatatatatatatatatatatatatatatatatatgtgtgtgtgtgtgtgtgtgtgtatgtatatatatgtgtgtgtattgttttatatatgt

SEQ ID NO: 87670 - DNA, 84 bp, Mus musculus
ctgggtcaatcttctctatatttattgatttaaggtatctcactaaatcaagtgtttgcttattataggttggttggcatccag

SEQ ID NO: 87671 - DNA, 83 bp, Mus musculus
gtgtgtgtatatttgaatctagattctgcatatgagaaataacatatttatatatccatgtgtagactccagactgcacacat

SEQ ID NO: 87672 - DNA, 107 bp, Mus musculus
tctatctatctatctatctatctatctatctatgtatctatctatctctacatctatatatgagagagggttgtacttagaagagtgatatcacagtagatgtgaga

SEQ ID NO: 87673 - DNA, 74 bp, Mus musculus
ctgtggtaagaatgatcattcaaatgtaaatttagcagagcataaacattgcatttgaaatgtttttaacacag

SEQ ID NO: 87674 - DNA, 75 bp, Mus musculus
agctggtcttactgtctctgactttgtcatgcccctcctgcatgcctgtgtgttagtactcctgggagaccagtt

SEQ ID NO: 87675 - DNA, 116 bp, Mus musculus
ctgttgctataccccttgaagaaattagttctgctatattatttgattctataaaataggtttcatgggttttatagctgggttggtgtccagatttctctttccatggctggcag

SEQ ID NO: 87676 - DNA, 84 bp, Mus musculus
gtgcatgcatgtgtttaggtgcatacatatactatgtatgtatttaatgtatgtatgtatgtatgtatgtatgtatgtatgtac

SEQ ID NO: 87677 - DNA, 127 bp, Mus musculus
catatatatatatatatatacatatacatatatgtatgtatgtatatacacatatgtatgtatgtatgtatgtatatgtatgtatgtatacatatatctatatatacatgttacatattgtacatat

SEQ ID NO: 87678 - DNA, 65 bp, Mus musculus
gtgtgtgtgtgtgtgtgtgtgtatggggtgggggtggtatcacacacacacatacatacacacac

SEQ ID NO: 87679 - DNA, 71 bp, Mus musculus
ggggatgtcactgtggctctcactgggctaggctgtttggccagtacgccccaatgatcaacctaatcccc

SEQ ID NO: 87680 - DNA, 99 bp, Mus musculus
gagaatgatatttgcttcctggaaacaatggatttgaaatgatttcactaagatattattacttatatcctgattcaagaggcggtatatattattacc

SEQ ID NO: 87681 - DNA, 120 bp, Mus musculus
tggatgtgtgtatatgtatatggatgtgtatatgtgtgtatatgcacatgatatatttacatatattatgtatatacacatatgttatatatgtgaatatgtatatgtgtatatatgtat

SEQ ID NO: 87682 - DNA, 80 bp, Mus musculus
ccagtgtattgctttgcaaagaagtatgttttgagaattctgtgaaaatcctctttgttttctgagcagtaaaaaattgg

SEQ ID NO: 87683 - DNA, 107 bp, Mus musculus
ttgtggatgccaacaagtgcttgctgacaggagcctgatatagctatctcctgagaggctctgtcagtgcctgacaaatacagaagtgggtgctcacagccatccat

SEQ ID NO: 87684 - DNA, 89 bp, Mus musculus
attcctacagtgagggtgaccaagtttgaaaaatactttgaatattatatcttttttaaaaatgttcacataccttaaggtaaaggaat

SEQ ID NO: 87685 - DNA, 111 bp, Mus musculus
gttttcttacactgaaacctcttgtctcctgtctcctgtctgtgtctctggctgaggagcccaggcagaaggcaaagaacacagagacagagagagagactctttgagaac

SEQ ID NO: 87686 - DNA, 83 bp, Mus musculus
tcataaggggaaatgtattatgtgtgcatgtatgtatatatatatatatgtgtgtgtgtgtgtgcatctatttgtctgtctga

SEQ ID NO: 87687 - DNA, 133 bp, Mus musculus
atgtgtctcatgccaccaaagaatgtatgtatatatatatatatatatatatatatatatatatatatatatatatatatatatatatatatataggctgtatgtatgtatgtatgtatgtatgtatgagaca

SEQ ID NO: 87688 - DNA, 84 bp, Mus musculus
gcagtaatgagaggaatggtgtctgggtagcgatttctagtctttgcattgatatttgacaacatcctcctcagcgacagctgc

SEQ ID NO: 87689 - DNA, 77 bp, Mus musculus
ggttgggatggatctcaaagtgggtagtctctggatggtcatcccttcaggctctgctctgaactctgtctgtaacc

SEQ ID NO: 87690 - DNA, 85 bp, Mus musculus; identical to SEQ ID NO: 58584

SEQ ID NO: 87691 - DNA, 97 bp, Mus musculus
gatcagccttaatccatggtgatcagataggatgcaatgggataaatttcaatatttttgtatctgtggaggctgttttgttaccaattatatggtc

SEQ ID NO: 87692 - DNA, 101 bp, Mus musculus; identical to SEQ ID NO: 59975

SEQ ID NO: 87693 - DNA, 76 bp, Mus musculus
gtactacattccatccagagactgtcagctcagagtggccaaccatataatgtagtctcaaggtggaagctagaac

SEQ ID NO: 87694 - DNA, 67 bp, Mus musculus
cctggggtcaagtggcaatctccgaatagcatccctcatctgctctctctgggtgtctgactttggg

SEQ ID NO: 87695 - DNA, 77 bp, Mus musculus
tcttctgcttcttctttgacctcagtgctgaggtagtcctgagaaatgagacagaactcaaagggaagacagataga

SEQ ID NO: 87696 - DNA, 96 bp, Mus musculus
tgagacctcaggctggagagatggctcaacggttaagagcactgactgctcttccaaaggtcttgagtgcaaatcccagcaaccactggtggctca

SEQ ID NO: 87697 - DNA, 73 bp, Mus musculus
tgcacatctgtctccctgagtcccatattggtatttgatcagtctttaagggagactttgacccagatgtcca

SEQ ID NO: 87698 - DNA, 87 bp, Mus musculus
gcttttagaggctcacaggcacaaaattgtcagtctctgtgtctgatggtttcacatagaaattgatgatggcagctgggcaggggc

SEQ ID NO: 87699 - DNA, 73 bp, Mus musculus
acatggacagatgataacatctgggacacagtaggtgtgctcagtgaatggttcttgatattactgttcctgt

SEQ ID NO: 87700 - DNA, 110 bp, Mus musculus
ggaattagatttgttaaatacccagtttgatgagataattgtatgtttatctgtttatgtatatattttactcttatctgttatgctgtatattgcattgtctaatgtcc

SEQ ID NO: 87701 - DNA, 138 bp, Mus musculus
tgtatatatatatgtgcatgtgtgtatgtgcatatgtaaacatgtgtgtatatgcatgtatatgtatacatgtatatatgcacatatatatgcacatatacatgtacatgtatatatgtacatatgtaaatatgtata

SEQ ID NO: 87702 - DNA, 68 bp, Mus musculus
gacagtggtgaacagccggatagacctcaggactcaattgttgtctgggactagctgtttactgtgtc

SEQ ID NO: 87703 - DNA, 66 bp, Mus musculus
ctctgtctctctctcatgtgcctggtgtgcgtgtgcatgtgtgcgtgtgcatctgcatgtacggag

SEQ ID NO: 87704 - DNA, 102 bp, Mus musculus
ttcctttgctttttatggaaaagcattgattaaggctttcttaatgtttgaaatgtaaagaagtgtgaaaaactaatgctgtttcagaaacggtctgaggaa

SEQ ID NO: 87705 - DNA, 120 bp, Mus musculus
aaatcaatctcttcctttgataattctgtgctaatcctagctgaggctctcagacactcttagttcataacgttggcagggtttttggttagttggttggttggtttatgggttggttgg

SEQ ID NO: 87706 - DNA, 64 bp, Mus musculus
tcctctgtgtgactgagtggctgacgaaaggccaacccctctcactgccaatcaccagccagga

SEQ ID NO: 87707 - DNA, 117 bp, Mus musculus
ggagtatatgtatgtatgtatgcatgtgtgtgtatgtatgtgtgtatgcatgtatatgtatatatgtatacatgtgtgtatgtatatatctctgcatgtctgcatgtctgcatgtat

SEQ ID NO: 87708 - DNA, 78 bp, Mus musculus
ggcagccttaccatttgatgagttgaaatacgtggtttggagactggcaagctgtctcagcaagtggaagtgcttgcc

SEQ ID NO: 87709 - DNA, 67 bp, Mus musculus
tgttaaaggcttcgtcttagaggttctcagctccaactgtcagaacagactgagatggcctatgaca

SEQ ID NO: 87710 - DNA, 96 bp, Mus musculus
gaacttgcttgtagatctgtctgttaaggcggttggtatcacagcctgctattatgcttgtgttcccgtcttatcttctttctatatcttaagtcc

SEQ ID NO: 87711 - DNA, 98 bp, Mus musculus
gtgactgatgtaggagctggagagatggctcagtggttaagagcactgtctgctcttccagaggtcctgagttcaattcccagcaactacatggtggc

SEQ ID NO: 87712 - DNA, 80 bp, Mus musculus
gcagacatcatcaaatagctttgtgcagtgatgacagtaaacacagacactgtcactgtgcaagcaataagtgtgtctgt

SEQ ID NO: 87713 - DNA, 88 bp, Mus musculus
gggatcaagagagcaaggccaggctggagagatggctcagcggttaagaacactgactgctcttccagaggtcctgagttcaattccc

SEQ ID NO: 87714 - DNA, 125 bp, Mus musculus
tctcatcaaatggagcagaacggtggctccactttatgaggaatcgcaggctgtgtttcttctttatttgtaaatgtgacagcccccaaagatgccttattttatgagagacagctgattgaaca

SEQ ID NO: 87715 - DNA, 116 bp, Mus musculus
tagcttttggtcctggactatacaagagtagagagggctatctgagaacaaagtgagcaaagattggtgcctttgtttctctgtgctcttgactgtggatgagatgtgacaagctg

SEQ ID NO: 87716 - DNA, 149 bp, Mus musculus
caaatggtcagctctgaagacatatacataaaagcaacactaaatagacttagcaggttggtgtgtctgtctgtctgtctgtctgtctgtctgtctgtgtgggcagtaataaaatggttccatggaggctagtcctcagagaggaggat

SEQ ID NO: 87717 - DNA, 91 bp, Mus musculus
cttcattgaacaagtgcccttgagtgcatgtcctcgctagagtttgttgcttgctttgttgatgtgctctcatttagtagctggagtggag

SEQ ID NO: 87718 - DNA, 113 bp, Mus musculus
gcttgaacatttcgtagatgctccttctgcagacgggagtgtcaagggcaagggggacaactcactctctcacagcctctcttgtcaaatcgggacagtacgaaggccatggt

SEQ ID NO: 87719 - DNA, 99 bp, Mus musculus
tggcgtgctctcaaaggaggagttaacagatgaattcacaaaggtgggcaggtctatacagaacactgaatgctgtgtgtaactcctcatgacatccca

SEQ ID NO: 87720 - DNA, 76 bp, Mus musculus
tggcagaaacgttagggtttctctctgactgggtcactcctcagggcatgaagggaaagttggatgtctgtgtcca

SEQ ID NO: 87721 - DNA, 66 bp, Mus musculus
gcaggctgagaagagctgggcacccgggtgacactgcagtggccactcatgtctggctgcagctgc

SEQ ID NO: 87722 - DNA, 80 bp, Mus musculus
ctgtctactcatgtgctaggttcatatttttatatgtatgcatgtattgtgtgtgtgcataccatggctcacgtgtgcag

SEQ ID NO: 87723 - DNA, 117 bp, Mus musculus
agtgacttgagagtctgtctgtgtattttactgtgactaagttttattttttaatgacacttttcacaacctcagaaataaaaattagatataatagatccctcaaaagcagctctc

SEQ ID NO: 87724 - DNA, 93 bp, Mus musculus
ccaagcccacgggcagggactctccctctggctctgatggtggtgtgcacccagagagggatgggagggacccctgtaacagaactgggaagg

SEQ ID NO: 87725 - DNA, 75 bp, Mus musculus
tgctgtgttgacacacgtagactagtgtttttatctgcttagtcagagaagctttgttctacaatggtcacagta

SEQ ID NO: 87726 - DNA, 72 bp, Mus musculus
tatgtgtatgtatatgtatatgtatgtatgtgtgtgtatgtatatatgtgtgtatatatgtgtgtatatgta

SEQ ID NO: 87727 - DNA, 116 bp, Mus musculus
tacaccctgctaaaggcatttcattcattcagtcaatcattcattccgtcattgagtcagtcagtcgctgagtcttgtgggtgtgtgcgtgaatatgtggtgtatgcaattgtgta

SEQ ID NO: 87728 - DNA, 111 bp, Mus musculus
tctgaggatggctgagcaaggcactgatctgtgagtgcagcagaatgtcattaggagtcattttgttgttgttttagagcaatagtatttagttttaccccaggtctcagg

SEQ ID NO: 87729 - DNA, 72 bp, Mus musculus
cattcagtcattctgtccctccctcaagcgtttatggaacttctgttgtgtgtcagggacagacactggatg

SEQ ID NO: 87730 - DNA, 85 bp, Mus musculus
tgctcctccgtcctctcagccctgactctaggcagtgccctcaagctcctcacagcctgtgtctgtcagccctgggtggtcagca

SEQ ID NO: 87731 - DNA, 78 bp, Mus musculus
agagagagagagagagaggagagagagagagagagagcgaacaggtgtcctgctctatcactctctgtcttattctct

SEQ ID NO: 87732 - DNA, 78 bp, Mus musculus
gggagttggagagatagctcagaagttagagtgtactggtggctcttccagaagacctgggtttgatttcaagcaccc

SEQ ID NO: 87733 - DNA, 119 bp, Mus musculus
gctgcaccctcctggttcacatgaggctgcccttgaagacgctggtcctccgagggactccctgactcactggcttccacagtagcaccttcaggtgcagccaggttggtgctggtcag

SEQ ID NO: 87734 - DNA, 65 bp, Mus musculus
tcagagcttgcagagactgtgcgactctgtgtctggcatgagagcacagagactgtgagctctgg

SEQ ID NO: 87735 - DNA, 88 bp, Mus musculus
aattttctctatatatctcaaactccatgtccaagtgtgtttctgccaccacatatgtgtggaggtcagaggtcaggtggtgggaatt

SEQ ID NO: 87736 - DNA, 64 bp, Mus musculus
ttatgtagaggctgactatacattgcagcctcttctgcctgcctgtctgtctgcctgtacatag

SEQ ID NO: 87737 - DNA, 79 bp, Mus musculus
gcacaaaatatctatgatggatgatctgggcctgaatttcaggtctctctttcacactggatcatttggcacatagtat

SEQ ID NO: 87738 - DNA, 110 bp, Mus musculus
ctggaaaactcagggcaggttgtgtggcctctggtattgggtgggtgtcgtagagaagacagactgcagacccagaactggataaacacacagtgagccgcaggagtcag

SEQ ID NO: 87739 - DNA, 112 bp, Mus musculus
tatttatttatctaccatctgtctgtctttctgtctgtctgcatgtgcatatgtgtattcatgtgatgcatgaatgtggaggccagaggttgatttgaggaagatatagata

SEQ ID NO: 87740 - DNA, 63 bp, Mus musculus
ttctggtcgtccctgatgctccgggaagccctgtccttcccagcctctgtgtctgactcagag

SEQ ID NO: 87741 - DNA, 63 bp, Mus musculus
tctgtgtgtctgtgtgcctgtctgtgtgtatttgcatggtgcctgttgcccatagaggccaga

SEQ ID NO: 87742 - DNA, 117 bp, Mus musculus
ggaggaaatagagcagggaccatgactgagatgtcactggcctcagtgtctctgactatgagtgggtggaaggtggctgtgataaactggggggtggttttctgtggtgataggcct

SEQ ID NO: 87743 - DNA, 75 bp, Mus musculus
cctaactgtcactgtcactgttacatggaagccactgcaggctgaacaggggtgaagcagttaaaggaccttagg

SEQ ID NO: 87744 - DNA, 101 bp, Mus musculus
agccaaaaatacattcctgtgatatatctgtgtatatatggtgtatatatatggtgtatatatatatctgtatatggtagtcagaatgtgggagaaaggtt

SEQ ID NO: 87745 - DNA, 83 bp, Mus musculus
tctccacagagctgccactgttactgtctgacttttaaaaagcacttccaaagaggacaggaaagagcatctcattgtgttga

SEQ ID NO: 87746 - DNA, 62 bp, Mus musculus
ggaaggactaggaggaatgtctctgggtggtcaggcccagggtccctctctctctgcctgct

SEQ ID NO: 87747 - DNA, 75 bp, Mus musculus
tggtaaggaaggtttcccatgcttggcactgagtttctctgagtctatggctcttaggggagatcattattacca

SEQ ID NO: 87748 - DNA, 70 bp, Mus musculus
gcagcagcagacgaattgatagctgatagcaagagaggaatggagtctgtctgtctgtctgtctgtctgt

SEQ ID NO: 87749 - DNA, 160 bp, Mus musculus
atacaaatacatgtacaaatgcatatacatgcacatacacacacatgtatatgtatatatatatgtgtgtgtgtatgcatgtgtgtatatatttgtatatatatgtgtatatatgtgtgtatatatgtgcatatatacacatatatacatatatgcatat

SEQ ID NO: 87750 - DNA, 87 bp, Mus musculus
gagggagaggttggctctgctgagtgtgagcacaggtgatgaggtgactgagctgaacatttgagactgggtgagaatttgtccttt

SEQ ID NO: 87751 - DNA, 70 bp, Mus musculus
tccgaccttcatatgtgtatgaagctatgtatgtgtgtatatatatatatagctttaaaaatgacttgga

SEQ ID NO: 87752 - DNA, 76 bp, Mus musculus
tgcacatgagcagacagaggtgacagacgtctgagagttccaacaggtttcctgtgtgtctccttggctgtgagca

SEQ ID NO: 87753 - DNA, 72 bp, Mus musculus
atgtcgttagtactggtagctggaattcttcatgggagactgatgagagacagatgacagtaaaaagggcat

SEQ ID NO: 87754 - DNA, 101 bp, Mus musculus
ggaaggaaggaaggaaggaaggaaggaaggaagacctatttttttaaataaaaaataaaaaagtggtttagccttggagccttctgtctaacactctgtct

SEQ ID NO: 87755 - DNA, 75 bp, Mus musculus
gggctggagagatggctcaggggttaagagcactggctgctcttccagaggtcctgagttcaattcccagcaacc

SEQ ID NO: 87756 - DNA, 113 bp, Mus musculus
agatcgcttctgcctttgagcctttgtgaatgatgcagttaggaacacggatgcgtaaaagtgtagtgaatttcttgctctgcatcctttggggcacatacctgaagtgggct

SEQ ID NO: 87757 - DNA, 80 bp, Mus musculus
acagacagacagacagagacagaactgtatccattcttgtgtgtgagagtgtgtgcatcccattctgtgtgtgagtgggt

SEQ ID NO: 87758 - DNA, 89 bp, Mus musculus
tatatatgtatattatgtgcatgtatatatgtgtatatgtatatatgtatgcatatatatgtgtatacacacacacacatacatatata

SEQ ID NO: 87759 - DNA, 82 bp, Mus musculus
tctgagcatccgtttctccttctataaagtgaaacaatgtaacaatcactttatggaacatggttatgaaatgtaaatgaga

SEQ ID NO: 87760 - DNA, 91 bp, Mus musculus
gccctagttctgatctgtctgcctcactctgttacttcagcccactcttcgttctgtttaatggaaaggctgctattaagttactggtggc

SEQ ID NO: 87761 - DNA, 91 bp, Mus musculus
aacatttatttgctctctctgtgtgtgtgtacgtgcatgtatacacatgtgccagcatacatatggaggtcagggggcaaatgcagtagtt

SEQ ID NO: 87762 - DNA, 117 bp, Mus musculus
ctcgacaccgcctggggctgccaggtagggaacagggctgggtggtgggtcatgtggcgcctgagccactgtcggtctgtgttccagctgctctcccggctcaaggggaacttagag

SEQ ID NO: 87763 - DNA, 74 bp, Mus musculus
gtagaaatgttatagctctctctctgtctggcaggaagcatgctgtcacctgcagaggagagaggagatactgc

SEQ ID NO: 87764 - DNA, 73 bp, Mus musculus
ggctgtagacaggctgtaaacaggctagtagggtttccttagactctgccactgactcagactgtccagggtt

SEQ ID NO: 87765 - DNA, 77 bp, Mus musculus
gcctctggaatgctaggcagacattgcatctgagctacaccctgtgcctcagacggtccctgccagcctgtcagggc

SEQ ID NO: 87766 - DNA, 91 bp, Mus musculus
gcaggagtggcagggtggacagagggtagagatggtaatggtagtgaatgcattcaatatatatgtatgataatgtccatgaaacttatgc

SEQ ID NO: 87767 - DNA, 68 bp, Mus musculus
gtatgtatgtatgtatgtatgtatgtatttaatgtataagtgctgtatgtgcatatacacctgcatat

SEQ ID NO: 87768 - DNA, 111 bp, Mus musculus
gctaataggagcctgataaacctgtctcctgagaggctctgtcagtgcctgacaaatacaggatggagcacagggtcctcaaggaaagagctagagaaagggcccatgagc

SEQ ID NO: 87769 - DNA, 111 bp, Mus musculus; identical to SEQ ID NO: 87768

SEQ ID NO: 87770 - DNA, 82 bp, Mus musculus
tgctgatgcccccttgttggtgatggtgtgaaccaggagaaatatgtcaactcactcaagattgtcagcagtgcatcatgca

SEQ ID NO: 87771 - DNA, 101 bp, Mus musculus
tatatatatgtatttatgacacacacacatatatgtgtatatctatgtatatatttactacacacacatatatgtatgtatgtatgtatttactatattta

SEQ ID NO: 87772 - DNA, 72 bp, Mus musculus
atggttgtgagtcactctgtgggtgagaaccaaattctggtcctctaggagagtggcaaatactcataggca

SEQ ID NO: 87773 - DNA, 107 bp, Mus musculus
gtttgtgataacctcctccagagaaatttaaggaagcagaaaaaacagactagtctctctgactcactttttaaaggtaatctggggtagtctttgatcattgtaac

SEQ ID NO: 87774 - DNA, 116 bp, Mus musculus
ctggatgaggtatagatagatgattttagaggccttgttggccagcaagtctagctgaaacaggttgttggttgtttaggctcagtcagagattatatatcaataaaataaggcgg

SEQ ID NO: 87775 - DNA, 85 bp, Mus musculus; identical to SEQ ID NO: 57439

SEQ ID NO: 87776 - DNA, 97 bp, Mus musculus
atcaagtcacagaatccttgaaaattatgggcatatgtgactggttatatttcctttattgctatgtgattgtattattttctggactggacctgat

SEQ ID NO: 87777 - DNA, 85 bp, Mus musculus; identical to SEQ ID NO: 57439

SEQ ID NO: 87778 - DNA, 117 bp, Mus musculus
tatatatatatatatatatatatatatatatatatatgtatgtatgtatgtatgtgtatgtatgtatatatgtatgtatatatatatatatatatgcatatgcatgtatctatctac

SEQ ID NO: 87779 - DNA, 130 bp, Mus musculus
tatatatatatgtgtgtgtgtgtgtatgtatacatatatacacatacacacacatatatatgtacatatatatacacacatacacacacatatacacatatgtgtgtacatacatgtgtgtacatatata

SEQ ID NO: 87780 - DNA, 101 bp, Mus musculus
tatagcacatggtctatatatctatatatgactttatattttgctacttattgttagtagtactgcagtaaatgtggatatgcagctgtctctttgctata

SEQ ID NO: 87781 - DNA, 81 bp, Mus musculus
gagacagggtctctcactgagccagaagctcaccaattcagctaagctggctggccagtaaatttgagggatccctgtctc

SEQ ID NO: 87782 - DNA, 90 bp, Mus musculus
ctagttaagggagtgatctgagaggccagcaagggtcacactaaaggacctaatttccttgtctgtctgtctgtctgtctccctctagta

SEQ ID NO: 87783 - DNA, 78 bp, Mus musculus
atgtatgtatgtatatatgtgtatgtatgtgtatgtgtgaacgtgtgtgtaaatgtatgtgtgtgtgtgtatgtatgt

SEQ ID NO: 87784 - DNA, 78 bp, Mus musculus
atgtatgtatgtatatatgtgtatgtatgtgtatgtgtgatcgtgtgtgtaaatgtatgtgtgtgtgtgtgtgtgtgt

SEQ ID NO: 87785 - DNA, 117 bp, Mus musculus
tgttgtcactttagaatacacggcatgtgtccatgttgaagtgtgtaagttctctcacagtagagagtttccacccttgagccacaatgactgggtgtgtgtccttaactgtatgca

SEQ ID NO: 87786 - DNA, 72 bp, Mus musculus
cttgggtgttcactctctctgcgtgtctgctgcagggatgcagccttggatgctaagtgtggtccactcaag

SEQ ID NO: 87787 - DNA, 71 bp, Mus musculus
ggaggacactacacactgtgaacacaggaggacattacactctgtgaacacagtgaggacactaggtctct

SEQ ID NO: 87788 - DNA, 72 bp, Mus musculus
tgatgaaggggtgctggagagatggctcagcagttaagagtgctgactgctcttccagaggcccagagttca

SEQ ID NO: 87789 - DNA, 88 bp, Mus musculus
tgtacctacatgtatatttgggtgcatgtgcatgcatgctcacatgcacacacacatggacacacacagacacacatgtatatctaca

SEQ ID NO: 87790 - DNA, 129 bp, Mus musculus
cactccactgattttattctctacattttatgtgtctcgtgtatacatgtgcatacgtatgtatgtatgtatgtgagcatgtgtatgcttgtgtataagtgtgaatgagtgtgtgtgtgtgtgtgtgtg

SEQ ID NO: 87791 - DNA, 92 bp, Mus musculus
ctcttgcgagccttgagaatccagaagagtgtgaggttactggattctcagcaggacaagagaacacagtgatgcccttcctcacccacttt

SEQ ID NO: 87792 - DNA, 85 bp, Mus musculus; identical to SEQ ID NO: 57439

SEQ ID NO: 87793 - DNA, 118 bp, Mus musculus
cagtgatctgtgtggccttgagcaagttgcttgagcttctgtctctccctcagtggttcgcagggttcgcctggcatgagtccaggtaacttatgcccactgcctgctgagctctgtg

SEQ ID NO: 87794 - DNA, 68 bp, Mus musculus
gcatgaacacacaagtgtgtgaatacacagatgtgcttgcgcacatgcatacacacaaaagtgcatgt

SEQ ID NO: 87795 - DNA, 66 bp, Mus musculus
gcgagcaccggatctgtatttcatactctgcgacagtgctgagagaaagcacagacccagctcagc

SEQ ID NO: 87796 - DNA, 84 bp, Mus musculus
caaagaactagtagagtctcacgctctcttagaggaggctcagtagatttccctcattgaaagcagtcgctctctggttctatg

SEQ ID NO: 87797 - DNA, 87 bp, Mus musculus
gccagtgtcagagcctagccatgtggatgtgtctaggatgttaagtttaaagaatggcagctaaggatggcttctgatgacactgtc

SEQ ID NO: 87798 - DNA, 94 bp, Mus musculus
gagatggaacgattgtaagtgccagaagatagagaggactagaagaaaagggtgtcttctgtacactgctacatttgtgaacttacagcatctc

SEQ ID NO: 87799 - DNA, 66 bp, Mus musculus
gcctgcatgtatgtatgtatgtatgtatgtatgtatgtatgtatgtgcaccttgtacatgcagtgc

SEQ ID NO: 87800 - DNA, 81 bp, Mus musculus
aatcaagtgttttgtttagtgtgtatgtgggcacacgcaggtacatgtgtgtgcatgtggatctggaggacaaccttgatt

SEQ ID NO: 87801 - DNA, 90 bp, Mus musculus
gctcgaggttcacagcctggtatgagaggcctactactcctcctgcctcatctcccacctctctgcctgtctctgtggcatcacctctgc

SEQ ID NO: 87802 - DNA, 102 bp, Mus musculus
cactgagatagcctgtatcctttaacaaaaagtttcattacatttatttatgtatgcatgaatgtgtgtatgtgtgtgggtacaagcctattacgacacgtg

SEQ ID NO: 87803 - DNA, 127 bp, Mus musculus
ctatggggccagggaccacaaaggctagctttcactatcaaggagcatgtgagcctccctgaaacccactagctctcgccaggaatatttggggtattcctgtcggggtgtttttgttcagatcggg

SEQ ID NO: 87804 - DNA, 80 bp, Mus musculus
cagagatgagatgatctggtaagaaaggaaagggagtgtcataagcaagacatgtctgtctgtctgtctgtctgtctctg

SEQ ID NO: 87805 - DNA, 89 bp, Mus musculus
gtgggctaaagccattgagctggcaccggctcttgtgaatttcttcaagtcacgtaggtttagtggtttctcagttgtcctagccatac

SEQ ID NO: 87806 - DNA, 116 bp, Mus musculus
ccagacgctaaggtctgctggcagctatgtcttatttgcaatcttgggctctcacacacacagtgcctacaggctgtgtctcaggccactatgctcacagtgtccctcaagcctgg

SEQ ID NO: 87807 - DNA, 79 bp, Mus musculus
ctcagtgccatatggatgacaacctgtggtgagtgaggaccccacagactgtgtctctgtgtggcccctggctgctgag

SEQ ID NO: 87808 - DNA, 104 bp, Mus musculus
tgtgtgtaattagtgtgggttttgttgggaccctgtagattctggagtagagttactcactcagtcacagggcctaaggaacttagactttagtgttagaaaca

SEQ ID NO: 87809 - DNA, 77 bp, Mus musculus
ggagagatcagagggggtgggggtggggggtagaaaatgccagccaggcctcactgctcactcactctggtcactgc

SEQ ID NO: 87810 - DNA, 118 bp, Mus musculus
ggttgatggtcacaacaagagcaactgtattaactgtttacagcatgaagaaggttgaaaactactgtcttaaatgttagggaacttagcctacagttttaggggacccagtttttcc

SEQ ID NO: 87811 - DNA, 84 bp, Mus musculus
gcatccatatatatatgtatacatatgtgtatatatatatgtacatatacatatatgtgtacatatatatatatatgtgtgtgt

SEQ ID NO: 87812 - DNA, 109 bp, Mus musculus
acagcatggccaacatggtgagcattttttttttatcgaagtctttggagatgtccagatgtgtttatgaatatttatgatgccgagcagcaggcttggagaatgttgt

SEQ ID NO: 87813 - DNA, 60 bp, Mus musculus
tgttctagaacagtccctcagtcattgtgtagaacagtccctcagtcactgtgtagaaca

SEQ ID NO: 87814 - DNA, 78 bp, Mus musculus
tgtgtgcaggtgagtggacacaggtgagtgtgtgcaggtgagtagacacaggtgagtgtgtgcaggtgagtgggcaca

SEQ ID NO: 87815 - DNA, 78 bp, Mus musculus
gtggacacaggtgagtggacacaggtgagtgtgtacaggtgagtgaacacaggtgagtgtgtgcaggtgagtggacac

SEQ ID NO: 87816 - DNA, 63 bp, Mus musculus
tctgtctgtctgtctgtctgtctgtctgcctggggcagagagatacccactttagccagaaga

SEQ ID NO: 87817 - DNA, 112 bp, Mus musculus
tgaggactggagaggggccctgaagctgttggagcttcttcatactagctctgtcactgcctcagttttcctcagtacccctgcaaagacgattaccaggtgggcaggctgg

SEQ ID NO: 87818 - DNA, 67 bp, Mus musculus
tggtgcagaggctctgccactctgactgtccctagctcacgcagctaatggcagggtctgaacacta

SEQ ID NO: 87819 - DNA, 74 bp, Mus musculus
tatatgtatatgtatatgtatatatatatatatatatatgtgtgtgtgtgtgtgtgtgtgtatgtgtatatata

SEQ ID NO: 87820 - DNA, 106 bp, Mus musculus
atatatatattacacatatatatgtgtgcatatgtgtgtatgtatatatatatatggatgcatatgtaagtgtatatatatgtatatatacatatattcatatatg

SEQ ID NO: 87821 - DNA, 118 bp, Mus musculus
tgtgctatgtaaatgatgtcacacttccatgatttagaacaacagatagtgatatatatatatatgtgtgtgtgtatgtagttactattgatatattaaatatattgttatatacata

SEQ ID NO: 87822 - DNA, 72 bp, Mus musculus
tgcatgcatatctgcctgcctgcctgcctgcataccttcctgcatgcatgcatgcttgcatatttatctgca

SEQ ID NO: 87823 - DNA, 114 bp, Mus musculus
tcaaaacattgtcttgaaagatttataaaggggctggagagatggctcagcggttaagagcactgactgctcttctaaaggtcctgagttcaaatcccaacaacgacatggtgg

SEQ ID NO: 87824 - DNA, 77 bp, Mus musculus
tgtgtatatatgtatatataggtatatatatgtgtgttatatacatatatgtgtgtacatacatacatgtatacata

SEQ ID NO: 87825 - DNA, 85 bp, Mus musculus; identical to SEQ ID NO: 57439

SEQ ID NO: 87826 - DNA, 69 bp, Mus musculus
gggtaagggtctatgaggaagtctactcattttgatgacctcaatgatgggctcccaaggcacctacct

SEQ ID NO: 87827 - DNA, 68 bp, Mus musculus
ggtgccatctgaagggcgagtggctccgtagtgggggaggggtatcagtcagtcagtcagtcagtatc

SEQ ID NO: 87828 - DNA, 69 bp, Mus musculus
tttcagactttcatctgtcaagctgactccaccggactgctgtggcagagaagccagtgagctctgaaa

SEQ ID NO: 87829 - DNA, 69 bp, Mus musculus; identical to SEQ ID NO: 87828

SEQ ID NO: 87830 - DNA, 116 bp, Mus musculus
catgtagctcatggtttctcacaggcagcagagcccagaactcagagtgcacaggtcctctgatctgtggagcacgctctaggacagctgggtcctggagacctagcagcaatgtg

SEQ ID NO: 87831 - DNA, 116 bp, Mus musculus
catgtagctcatggtttctcacaggcagcagagcccagaactcagagtgcacaggtcctctgatctgtggagcacactctaggacagctgggtcctggagacctagcagcaatatg

SEQ ID NO: 87832 - DNA, 116 bp, Mus musculus
caggtagctcatggtttctcacaggcagcagagcccagaactcagagtgcacaggtcctctgatctgtggagcacactctaggacagctgggtcctggagacctagcagcaatgtg

SEQ ID NO: 87833 - DNA, 68 bp, Mus musculus
tgtgtagtgtaaagtatggtgtgaacatgtgttatgtatacatatatacatatatgtacacatacaca

SEQ ID NO: 87834 - DNA, 74 bp, Mus musculus
agctcattagtgtctgtgtgtctgtcccctctccttccacttgagctgaagtcagtcagagcacaccatgggct

SEQ ID NO: 87835 - DNA, 89 bp, Mus musculus
cagaggttgtttgtaggagactgatggcaggctggacttctcccagtgcagaggtccttcccacagttttccttttagagagagcactg

SEQ ID NO: 87836 - DNA, 106 bp, Mus musculus
tcagcttttgagttgtcacagcaatccaggcatcttcagtcactcagagtgtctgttagtgtgacatatgctgaattggagaaagcatggtacttgatgaagctga

SEQ ID NO: 87837 - DNA, 95 bp, Mus musculus
acaatcattatatttctctaaatgaatctctaatcctgggaccatatatttcattatttgtatgccaggttttgagcttgtcttggagtgactgt

SEQ ID NO: 87838 - DNA, 68 bp, Mus musculus
aggcctgattttactgtggtttttgttcttcacaatatgtgacaatctcacacagtgagatgaggttt

SEQ ID NO: 87839 - DNA, 81 bp, Mus musculus
ctgatagcatatatatatatatatatatatatatatatattactgtatatgtgtatgtgtatatgtatatgtatatatcag

SEQ ID NO: 87840 - DNA, 127 bp, Mus musculus
tatgatatatagatatatatatgtgtgtttttatatatgtacatatgtgtatatatatatatgcgtgtgtgtgtttatgggaaacaacaaatgtgtatatatatatatatatatatctgatatgtat

SEQ ID NO: 87841 - DNA, 71 bp, Mus musculus
ttatgttctgtctaaatgtttttgttttaatcccaagtgtgggatatgaggctgctttagatcgtccatag

SEQ ID NO: 87842 - DNA, 65 bp, Mus musculus
tgtgtgtgtgtgtgtgtgtgtgtgttttgtgggtttgcaaatacatatgtgtgagtgcacacaga

SEQ ID NO: 87843 - DNA, 64 bp, Mus musculus
tccatacatgtatgtatgtatgtatgtatggatggatggatacatggatagatggatggatgga

SEQ ID NO: 87844 - DNA, 82 bp, Mus musculus
cctggacagatccttgaaagcagagtgctagccatctttccccttagtggctgccactctcagagtcaaggcttgcagcagg

SEQ ID NO: 87845 - DNA, 80 bp, Mus musculus
atatatatgtgtgtgtgtgtgtgtgtgtatgtgtgtatgcatatacacacatacacacacagatatatatgtatgtatgt

SEQ ID NO: 87846 - DNA, 82 bp, Mus musculus
gctggaggtgcccactagcaggaagaacagacagaggacaccagggacctgggaacatgtttcctctaggtggctcttcagc

SEQ ID NO: 87847 - DNA, 82 bp, Mus musculus
cagagtttgagtctctcccactgcctcaggcggcgcagcctctgtctgtctcaagggatgagaagttaaatcggtttctctg

SEQ ID NO: 87848 - DNA, 68 bp, Mus musculus
aggaagaagagaaggaagaaaaaggatctgagaaacttcattttctcagtgactctctctctcctcct

SEQ ID NO: 87849 - DNA, 101 bp, Mus musculus
tgtatgtgtgagtgtgtgtatgtatgtgtatatgtgtgtgagtgtgtatgtatgtatgcatgtgtgtgtacatgtatgtgaagtgcactcatggtcatata

SEQ ID NO: 87850 - DNA, 129 bp, Mus musculus
gtgcatcttgctggaggaggggctgggcatagccatctggacccagaaaatgactgcctgcctgcctgcctgctgcatctttctactgggacccatcagaggcactggcgggcccccagggagggacag

SEQ ID NO: 87851 - DNA, 84 bp, Mus musculus
gtaatcacgctgctgattgggcaatctgtctcggcctcctgaatgagatcccaggtgtggctctcagcgcctgactgtgagtac

SEQ ID NO: 87852 - DNA, 117 bp, Mus musculus
gaggacattcattgctgggcttgggctggttctcataattgtacaaattctgaatgggatatgaggtagttggttgtacaggtatttcctgcttgaagtaattcagctgatttcctt

SEQ ID NO: 87853 - DNA, 86 bp, Mus musculus
acagccaccgcagacacacacattttctctctctgtccaatagaggtcatgagtattaaaactgacactgatttgcgaaaggttgt

SEQ ID NO: 87854 - DNA, 112 bp, Mus musculus
ccagtgtgtgcaagtgtggggccagaagtcagcagtgatgttcttgtccagctctctcactctgtgaggcaggaactctccctggaactgagctcagcatcagtaacactgg

SEQ ID NO: 87855 - DNA, 74 bp, Mus musculus
gatttcatttttcattctggagagatgccttagtggttaagagcactgactgctcttccagaggtcctgagttc

SEQ ID NO: 87856 - DNA, 118 bp, Mus musculus
ggtccagcatgagtggaggttgacctttgagatgatagaagaaggttgtttgcttaagagctaactctgtagctatctgtccttcatttattttgagacagcgtctcactatgcagcc

SEQ ID NO: 87857 - DNA, 74 bp, Mus musculus
gtgtgtgtgtatgtatatatgtatgtatacatgtgcgtgcattggtatgcatgcatatgtgtttgcgtgtacac

SEQ ID NO: 87858 - DNA, 79 bp, Mus musculus
tgagccatctcaccagcccctagtatagagatttttttgattgagataagaactttaaactgcccagtgtggtggcgca

SEQ ID NO: 87859 - DNA, 65 bp, Mus musculus
ttgggctggatggacatgggccctggaacaaggcttctcttctcctgtgtctgtctgtctcccaa

SEQ ID NO: 87860 - DNA, 96 bp, Mus musculus
agcttttggggggctggagagatggctcagtggttaggagcactgactgctcttccagaggtcctgagttcaaatcccagcaaccacatggtggct

SEQ ID NO: 87861 - DNA, 118 bp, Mus musculus
gccgagcaggataagtaagaagaaacgtggactctaatatcagactgagatttcacacaaataagagagagaagactcagagtggacttgattagggaggtcttccctgtacaatggc

SEQ ID NO: 87862 - DNA, 79 bp, Mus musculus
caagctggcctcaaactcacagagtctcacttgcctctgcctcctgggattaaggtgtgggcccttttatgccatcttg

SEQ ID NO: 87863 - DNA, 97 bp, Mus musculus
tatgtgtgtatacatgtgtatgcatgcatatgtgtgtatgcattgtatgtatatatatgtgtatgtatgtatgtgtctatgtttgtatatgcatgta

SEQ ID NO: 87864 - DNA, 71 bp, Mus musculus
ttccactccatttccatccctgtaattcttttagacaggaacaattatgggtcagagatgtgactgtggaa

SEQ ID NO: 87865 - DNA, 107 bp, Mus musculus
ggactcacgttgggaaagacacgaagtttgttttttagatactgtagcatcaaagaacagtgtgtggagactaagacatggtagaggctcagcggaaagaggaagcc

SEQ ID NO: 87866 - DNA, 87 bp, Mus musculus
tgatgtcagcaagggtaggacatagtttgagctgagagcctagagccctgtgtctctgggtcactgtgtccactcatgaacctatca

SEQ ID NO: 87867 - DNA, 81 bp, Mus musculus
gtgggggggcagactagagagatggttcagcagttaaaagcactgactgctcttccagaggtcctgagttcaattcccagc

SEQ ID NO: 87868 - DNA, 82 bp, Mus musculus
aggttacagagagaagagtcagaggtgcttagcttagtccctggcattgggagcacctcacagagtcccctccagtaggcct

SEQ ID NO: 87869 - DNA, 82 bp, Mus musculus
ccattcttgctatatgaagttcctctctaggcccctggattcttcaagactgacacaggagtgagagggctcagccagatgg

SEQ ID NO: 87870 - DNA, 97 bp, Mus musculus
tatgtttgtgtacatacctgttcatatgtgcatatgtgtgtgtgtgtatacaagtgtgtgcatttgcatgtgtgtgtgtctgtgtaacattcaggtg

SEQ ID NO: 87871 - DNA, 96 bp, Mus musculus
gaccagccttagtctgtggtgatctgataggatgcatgggataatttcaatatttttgtatctgttgaggcctgttttgtgaccaattatatggtc

SEQ ID NO: 87872 - DNA, 75 bp, Mus musculus
attgacatctggggctggagagatggctcagaggttaagagtgctgactgctcttccagaggtcctaagttcaat

SEQ ID NO: 87873 - DNA, 71 bp, Mus musculus
taggactcatcacggctgtctggggtcagcgctgtgcccactggttcagtgtcagcagacagccttgcctg

SEQ ID NO: 87874 - DNA, 88 bp, Mus musculus
gggcacttgccatccacaagcagggcaggtgcttacacacctccgtaccttgtttccatagccctgctcctgaaatgcgcatgtgctc

SEQ ID NO: 87875 - DNA, 81 bp, Mus musculus
ggcagtgtaggaggacagaggagaggactgtagcttggcactaactgcctccactgtcactgtcactgtcacggagtctcc

SEQ ID NO: 87876 - DNA, 115 bp, Mus musculus
gaggcaggacccctgggccagttaagagctttgtatgctgagtgaagagacagaacaatggacagtttcgacaaaggaggagtgggtgatgttcttagctggtggtgctgagatc

SEQ ID NO: 87877 - DNA, 120 bp, Mus musculus
ctcacggcacctgtaattacacacaatcacagagtggtgtggggcagggctgctcatgaggctccacccttctctgagaatttatttgactttcatgcttgatggtgggggtatgggtag

SEQ ID NO: 87878 - DNA, 108 bp, Mus musculus
gttttaacagctgagccatctcacccagtccctatttatcattattacttttaattatgtgtctgtgtgtatgtctgtgtgtgagtatgtacaggtgtcctttgagac

SEQ ID NO: 87879 - DNA, 57 bp, Mus musculus
ggagtactgggagccaaccccagcatgtctggaaggttgtctggctctaagtgatcc

SEQ ID NO: 87880 - DNA, 79 bp, Mus musculus
tggacgtgaggatgtttcaatatttgtatttactaatgtatttcacattagtacatcagataggaaaatcagatgacca

SEQ ID NO: 87881 - DNA, 64 bp, Mus musculus
gtccacccatctgtctgtctgtctatcagcgtcaagcttgaaggctataagcacagaggtggac

SEQ ID NO: 87882 - DNA, 64 bp, Mus musculus
gtgtacatgtacatatggggatatgtatatatgtatatgagtatatgtatatgtatgtgtatat

SEQ ID NO: 87883 - DNA, 113 bp, Mus musculus
ctggagcctgtccttcctgtgatcctggttgtgtcagaactcctccaagtcaagctgtctctgtgattctgtgattctgtgatcctgggatcctgggtgtgtctgagctcctg

SEQ ID NO: 87884 - DNA, 95 bp, Mus musculus
tgcaaagaagatgttcaggctggagagatggctcagtggttaagagcactgactgctcttccaaaggtcctgaattcaaatcccagcaaccacat

SEQ ID NO: 87885 - DNA, 62 bp, Mus musculus
cagttgcaaggagacagttgtctgagtccagctatctcatgtacaacttctctgtcttgctg

SEQ ID NO: 87886 - DNA, 81 bp, Mus musculus
agctctagcatagactctgtctgagactcagattttcttaagattttctgtgtcacatataagaccgtgcttcaaagagtt

SEQ ID NO: 87887 - DNA, 116 bp, Mus musculus
gactggagatatgcctttaaatcatctatatgataatgaatttgtatctatattataaagaactcttaaaattcaacaaattgaaatcacaagatgagcagagatacatctctgtt

SEQ ID NO: 87888 - DNA, 70 bp, Mus musculus
tgtgtgtgtatatgtatatatgttcatatatgtgtgtgtgtgtgtgtatatatatatatatatatatata

SEQ ID NO: 87889 - DNA, 63 bp, Mus musculus
acataaatatatatgtatatatataatatagatatatatgtgtgtatatatatgtgtgtgtgt

SEQ ID NO: 87890 - DNA, 85 bp, Mus musculus
ctgaactttagatgaggattgttgtgtggctctggttcctgaaagcaagccagagccgtgcttagaagcagcatctgagccacag

SEQ ID NO: 87891 - DNA, 79 bp, Mus musculus
gcatgccatgtgtgtatgtgtttctaaatgtatgtatgtatgcatgcatgcatgtatacgcatatgaaaacatcaatgt

SEQ ID NO: 87892 - DNA, 62 bp, Mus musculus
gacgagtgtctctcagtctgtgggcaagcttagcaagctggagagtgtggggcacatttgtc

SEQ ID NO: 87893 - DNA, 88 bp, Mus musculus
agggacaaggcctacttcggggatccttcgcacaatgagggtacaggcaaacaacagagtgaggagtctcaggttagcaagtttacct

SEQ ID NO: 87894 - DNA, 85 bp, Mus musculus; identical to SEQ ID NO: 57470

SEQ ID NO: 87895 - DNA, 68 bp, Mus musculus
atgcatgtgtgtgagtgcacgtgtgtgtatgtgtctgcatgtgtgtgtgtgtgcatgtacatgtgcat

SEQ ID NO: 87896 - DNA, 86 bp, Mus musculus
ccaggcattggcatagactcacaagagagagagctatttcagggtcctgtcagcaaaatctttctggcatatgcaatagtgcctgg

SEQ ID NO: 87897 - DNA, 138 bp, Mus musculus
tcactgagggaagtcagtgtaggaactcaaggcagaatccgtggagtaaggctgctcgctggctcactcactgactcatgcaccactatctcacttgcccaggctgacctgcctaggaatggtgccaccaacagtggg

SEQ ID NO: 87898 - DNA, 115 bp, Mus musculus
aggcaggattggcataagtttgaggcaagcctaggttatatatatagtggggatatgtctgtctgtccgtctgtctgtctatcatctgtctgtcttatctatctagcatctgtct

SEQ ID NO: 87899 - DNA, 68 bp, Mus musculus
gtgtatgtgcatgtgcatgtgtctgtgtgtatatgcgtgcatgtggatgtgtgtgtgtgtgagtgcat

SEQ ID NO: 87900 - DNA, 77 bp, Mus musculus
aggagactgtggagagcagcagatctctgagcagccatgcaagactgtcacagatgtttgctggttctgcttcttct

SEQ ID NO: 87901 - DNA, 115 bp, Mus musculus
agatcgttgtgaaacctgaaatcttcatgtattctctgtgttcccaggagatatgtgaatgtctagcaccttaacatatctctacttagagagtttttgacttagtaaatgacct

SEQ ID NO: 87902 - DNA, 105 bp, Mus musculus
ccgcagaaaggctacttaagctattattcaattaccttgtcaaaagagattttgttgattggcagataattcctaaagtgaggtggttttgagagcagttctagg

SEQ ID NO: 87903 - DNA, 111 bp, Mus musculus
ggcattgtttaccacagccaaagtccagtgagtagtctttgtgattgtgtctctgaatctgtgagagtggagacaaagctgcaatgaagactacaggaagctgaagatgcc

SEQ ID NO: 87904 - DNA, 73 bp, Mus musculus
catcatcatcatcatcatcatcatcatgagaagtgactttagttccatgttttgattttctggtgtgatggtg

SEQ ID NO: 87905 - DNA, 108 bp, Mus musculus
gaggctggtggagtagatatatcagagagaagatagagccctggacctgcttgccatagtggtagaaggttggttggattcttgtaattttttacatacatatgtgtc

SEQ ID NO: 87906 - DNA, 105 bp, Mus musculus
cacaatgcttggattacacttctctataagttcaacctctgctcattcttaagaactatgaacaactttgtctggcagttatgagctttgtgatctctgtttgtg

SEQ ID NO: 87907 - DNA, 106 bp, Mus musculus
tttataagctaatgagattgatgtacttgtttatttttacataaagaattaaatcttggctgaatatttgataatgcagggtgcagtgtcttctaagctttgtagg

SEQ ID NO: 87908 - DNA, 95 bp, Mus musculus
gcatccaccttggtatttgtcaggcactgtcagagcctctcaagagacagatcaggctcctgtcagcaagcacctgatggcatccacaatagtgt

SEQ ID NO: 87909 - DNA, 77 bp, Mus musculus
gtgagtaaaagttttttctttttgtaagcatgactttcttttcctggcttacaaaggggtattgaaagccctcttac

SEQ ID NO: 87910 - DNA, 117 bp, Mus musculus
ttgaagatcagctttagtccatggtgatctgataggatgcatggaacaatttcaatatttttgtttctgttgaggcctgttttgtgaccaattatattgtcaattttggagaaggtc

SEQ ID NO: 87911 - DNA, 72 bp, Mus musculus
tctctctctctctatatatatatatatatatatatatatacatgtgtgtgtatctgatagagagatgataga

SEQ ID NO: 87912 - DNA, 116 bp, Mus musculus; identical to SEQ ID NO: 67358

SEQ ID NO: 87913 - DNA, 75 bp, Mus musculus
gggctaactggtgggtaggtactggaaagtaaatctcctctaaaagatcagccagtgctatctgtctgtctgtct

SEQ ID NO: 87914 - DNA, 85 bp, Mus musculus
gtccatggtgatctgataggatgcatgggaaaatttcaatatttttgtatctctggaggcctgttttgtgaatgattatgtgggc

SEQ ID NO: 87915 - DNA, 85 bp, Mus musculus; identical to SEQ ID NO: 57470

SEQ ID NO: 87916 - DNA, 61 bp, Mus musculus
cgttctctttgtctgcagtgtcatctgaggaacacacacacacactcagacaaataggccg

SEQ ID NO: 87917 - DNA, 115 bp, Mus musculus
ttttgaatttctcgtccttacaactaaaggactttgattaaaatgtttgaattattctatatgctaagtctgaacattaatcaaagatctatgagcacagggataagaatcagag

SEQ ID NO: 87918 - DNA, 112 bp, Mus musculus
caaatggcatatcatatatacatatatagacatatgtatatatgtgtatatatgtataggtgtatatatgtatatatgcatatgtatatttgtatatatgtatatatgtata

SEQ ID NO: 87919 - DNA, 117 bp, Mus musculus
atagaaaggtagatagtgactgaggcttgatctctggcttagacaagttctatctatcatctatccaactatctatctatccatccatctatctatctatctatctatctatctatc

SEQ ID NO: 87920 - DNA, 117 bp, Mus musculus
gtgccaaatcgcaggagcaggactgtcacagtctttggagcgagcctcatctggaagtcagacactgtctctttcaaacatggtggcagctcttgactcattctaaattacaggcat

SEQ ID NO: 87921 - DNA, 85 bp, Mus musculus; identical to SEQ ID NO: 57470

SEQ ID NO: 87922 - DNA, 85 bp, Mus musculus; identical to SEQ ID NO: 57470

SEQ ID NO: 87923 - DNA, 82 bp, Mus musculus
cccagggtatgtgtcatgtcttgcaatctgtatgagctgacttaggtgagcagtgttattgtagttgaataaatgcactggg

SEQ ID NO: 87924 - DNA, 90 bp, Mus musculus
agggcttgcaaccatgtcttcaaatcttctgagtggctcttctttatccagaaggataaactcagaccactactgagaaagaaaagctct

SEQ ID NO: 87925 - DNA, 93 bp, Mus musculus
tctgtacatgtgtctgtgtgtctctctcttcgtttgctccatgccactagtcagagttccagagcctaagccacgcaggatgctgatgacaga

SEQ ID NO: 87926 - DNA, 92 bp, Mus musculus
gttctctcatagctctgtcagctgggtgcaggtctgcttgtctgaaaaccacagagtctctgcctctctgaccctctgggatctgcttgaac

SEQ ID NO: 87927 - DNA, 63 bp, Mus musculus
acagagcccagtgaggcacgtgcaggaggattgtctgtctctctgaccctgtctgtcctctgt

SEQ ID NO: 87928 - DNA, 59 bp, Mus musculus
caggacctagagcaacggcttagcggttaggagtgcagactgctcttgctgaggacctg

SEQ ID NO: 87929 - DNA, 104 bp, Mus musculus
ttctagagaaagttaattaacttatggactttagtctgagtttttctttttattaagatggggatagtagacttattgttttggttcatcaacttgttttcgaa

SEQ ID NO: 87930 - DNA, 138 bp, Mus musculus
tatgtgtatttgtatgtctgaatatatttgtatgttgtgtatatatgtgtatatacatgtacatgtatatttttatacatatatgtatgtatttgcatgcatttgtatgtgaacatatttgtgtgtatttgtatatgt

SEQ ID NO: 87931 - DNA, 89 bp, Mus musculus
ctgctttccaacagaacagagacaccagactccatccgtgctcactctgatcccacagatgtagacgttgcgtgtctcctcagagtcag

SEQ ID NO: 87932 - DNA, 106 bp, Mus musculus
cactctggtgactgggccactgcaaatgtctgctccatttttaccagttcactgaacacagtgagaagataaggtgcatatgatatgcatccaggcatcatgggtg

SEQ ID NO: 87933 - DNA, 81 bp, Mus musculus
cttgccgaggaaagggtttatttgtcctactcttctgttcatcactgaaggaagtcaggacagaaactcaaacagggcatg

SEQ ID NO: 87934 - DNA, 112 bp, Mus musculus
catatatatgtatgtgtgtgtatttatatatgtatgtatgtatatatgtgtattcatatatatgattatatgtatgtatacataatatttatacccatatatgtatatgtac

SEQ ID NO: 87935 - DNA, 85 bp, Mus musculus
gcaacttcacaaacgtttgagctcagttctgtgtctgtagccacacgtcccccagacagaagaggcaagcctggtgagaggtagc

SEQ ID NO: 87936 - DNA, 62 bp, Mus musculus
gtggagctctgtctctctgtctgctgtatcctcagcagactcagtaccagacaaccgttccc

SEQ ID NO: 87937 - DNA, 116 bp, Mus musculus
gtttgtttgtttgtttgtttgtttggagtcactagaacactactgatttgcatgttgttttcataaatttgcatagtgcgtttaagaggctctgtctctccagcaactctcactgc

SEQ ID NO: 87938 - DNA, 85 bp, Mus musculus
tcttgtgaagtggagagataaggatttgtgggattaagcaaaggggtcttcttccacccatcactctctctctgcttcatcaagg

SEQ ID NO: 87939 - DNA, 83 bp, Mus musculus
ctgtgctgtggcagagagaactgactcaggtgctgccggcttgtcagctgtgactgtgtctacatcttctgtttctaggacag

SEQ ID NO: 87940 - DNA, 108 bp, Mus musculus
agccttagtccatagtgatctgataggatgcatgggacaatttcaatatttttgtatctgttgaggcttgttttatgaccaattatgtggtcaattttggagaaggtt

SEQ ID NO: 87941 - DNA, 85 bp, Mus musculus; identical to SEQ ID NO: 57470

SEQ ID NO: 87942 - DNA, 83 bp, Mus musculus
gagctccagagatctgtatgtctcagctacgcagttctcaccactgctccacatctgggatttttgtgtagtttctggggatc

SEQ ID NO: 87943 - DNA, 74 bp, Mus musculus
agctgagcaagtctcagtaagggcaggatgcttcgccagaaggacccaggtctcactcagacccactgacagct

SEQ ID NO: 87944 - DNA, 82 bp, Mus musculus
ggctccaatgtctcttcctgactctctcagaaacagaacgtgtttagaaggaagataagcagacttcgggaagtgagtagcc

SEQ ID NO: 87945 - DNA, 79 bp, Mus musculus
tgtttgtgtctgtggtatgtatgtatgtatgtatgtatgcatgcatgcatgtatgtatgtatatatgtgcagatattca

SEQ ID NO: 87946 - DNA, 89 bp, Mus musculus
aaacatatgtatgtgtatatgtatgtatatatatgtgtgtatatacacacacacatatatatacatatacacacacatatatacagttt

SEQ ID NO: 87947 - DNA, 128 bp, Mus musculus
tgagactgtctttcctttccttgttcccatgtgttagcaatgaggtagaaattatttctttatatttggctttgtggaccatattaaattaaggagctagaagtggtgttctcaggtaagttactggg

SEQ ID NO: 87948 - DNA, 97 bp, Mus musculus
atatgctaattatatgtagaaacatccacacatgtatgtatgaatatatgaatgtgtatatataagtgtgtgtgtgtatacatatacatgtacatat

SEQ ID NO: 87949 - DNA, 87 bp, Mus musculus
gctagcctgtctgtctgtctgtctgtctattcctgatgagaacgtggttctcaggactgggcaagcgaactgggtcagggaggaggc

SEQ ID NO: 87950 - DNA, 69 bp, Mus musculus
agagagagtcacaagacagtgcgtgcagacagaaactgacagccgcagcctgcaatgtttgacctctct

SEQ ID NO: 87951 - DNA, 94 bp, Mus musculus
ggggacctgggttgtggcactggtagaagacagtgtctggtccttttggtccttcattgctctctgttccagtgccccagactccggtagatcc

SEQ ID NO: 87952 - DNA, 111 bp, Mus musculus
tcaggagacgtttcctcttaaaatattcttagtttaacatctggtcttaaaggtagattacaaatgtcaagaagttaagccagtaagaagtgaagataaatgaatctctgg

SEQ ID NO: 87953 - DNA, 75 bp, Mus musculus
gaatgccctacagcagcagaagggtgtcagcacagactggggaacatccataccgctgaacccagggcagaactc

SEQ ID NO: 87954 - DNA, 117 bp, Mus musculus
tattctaatattctcaagacccttcataatttatgctttcagaaacttttttgtgtatatatagagtagcttcaaataggtcacactgcagagcaaagggcatacagtggcagaata

SEQ ID NO: 87955 - DNA, 119 bp, Mus musculus
ctgtctttatgatacacttgtactaccggggaagtgcatgtttgtgactctgactctgtgataaactcggggaataaacaatgcacggaaccatgccaaccacagtgtgctgctcacag

SEQ ID NO: 87956 - DNA, 66 bp, Mus musculus
cctgtgagattcttggttctttccttccattttgtaggctctggggattgaacaaaggtcacaagg

SEQ ID NO: 87957 - DNA, 71 bp, Mus musculus
ggaaggacagagcagtacctgaagagttgcagtgaggtgcagtgtttgtctgtctgtctgtctgtctgtct

SEQ ID NO: 87958 - DNA, 94 bp, Mus musculus
tcatgaagtggggctggatagatggctcagtggttaagagcactgactgctcttccagaggtcctgagttcaatccccagcaaccacatggtgg

SEQ ID NO: 87959 - DNA, 96 bp, Mus musculus
tcaggaccatatcaggagtgtgttctaggggctggggagacggctcagcggttaagagaactgactgctcttccagaggtcctgagttcagtttcc

SEQ ID NO: 87960 - DNA, 91 bp, Mus musculus
ccattcttatatttttctataggaagaaaactgtttctgttgttgaattttatgaagctcaaattatagtacatatagaaaatgagaatgg

SEQ ID NO: 87961 - DNA, 96 bp, Mus musculus
ttgctaataatgtgtgtgtgtgtgtgtgtgtgtgtgaaagagagagagagagagacagagacacagacagagagatagaggcagacagagagacag

SEQ ID NO: 87962 - DNA, 215 bp, Mus musculus
gttcttcagatgtgtgtgcccgcagacagatgtgtgtgtgtgcccgcagacagatgtgtgtgtgccctcggacagatgtgtgtgtgtgccggcggacagatgtgtgtgtgcccgcagacagatgtgtgtgtgtgcccgcagacagatgtgtgtgtgccctcggacagatgtgtgtgtgtgcccgcggacagatgtgtgtgtgcccgcagacagat

SEQ ID NO: 87963 - DNA, 103 bp, Mus musculus
ctcttcccctgcaattatctaccttctgtcctgtgtgtatgcatgtatgtatgtatgtacgtatgtgtgctgtgtggttagatgtagattctgcacatagagg

SEQ ID NO: 87964 - DNA, 64 bp, Mus musculus
gtgctcactgatcagtctgaccaatcaaaggagagaagggccaggacgctggttcagtggatac

SEQ ID NO: 87965 - DNA, 97 bp, Mus musculus
gttatagttgggaggcttcattgctttaaacctggggtcaggcagtgtagagagtgtggagtgtttggactgaagcagcttatgtctgatacctggg

SEQ ID NO: 87966 - DNA, 68 bp, Mus musculus
tcactttcatacacacacacacacttcatattattactgtacttgtgatgtgtgaatgtgggatgtgg

SEQ ID NO: 87967 - DNA, 110 bp, Mus musculus
gctggtgagggagggatggggaattttagccttgatagctagctgaaagacagttttttgttttttaaggaagataatgctgagtattgcttaaaaccgtttttgtttgt

SEQ ID NO: 87968 - DNA, 85 bp, Mus musculus; identical to SEQ ID NO: 57439

SEQ ID NO: 87969 - DNA, 113 bp, Mus musculus
gaagatgtagaaccattccatctccatttggtcaaagccacatgctgtaatttctaaagtgtacagtgtgtgctcagaccaaaagtgacatgattgttttgagaatagtcttt

SEQ ID NO: 87970 - DNA, 84 bp, Mus musculus
tatatatgtatatataattatatttatgtaatgtataaaatgtgtgtacctctgtgtgtgactgtgaatatgtatatgtatgtg

SEQ ID NO: 87971 - DNA, 86 bp, Mus musculus
ggccataggtggtctgataggatacatgggacaatttcaatatttttgtatctgttgaggcctgttttgtgaccaattatatggtc

SEQ ID NO: 87972 - DNA, 108 bp, Mus musculus
gagtaggtaatctcagtctcactagcctagggcttttgtttgtatctctagcagcaaatgtaagcagtagcttgatctaggttacagtgtgatttgtactgcttgctt

SEQ ID NO: 87973 - DNA, 95 bp, Mus musculus
atctataatctatctgtgtatatctgtatatatatatatatatgtatatgtatgtgtatatatatacacacatgcactaattggactcaatagat

SEQ ID NO: 87974 - DNA, 77 bp, Mus musculus
tgtgtgtgtgtgtgtatatatatatgtatatatatatgtatatatacatgtgtatacatatatatgtatgtatattc

SEQ ID NO: 87975 - DNA, 103 bp, Mus musculus
cagaggaaagccgattcttgatttcactaggaaagtttctatatgacagaagattgtgaggcttatctggaaaataggttgagatgatgaagttgctattttg

SEQ ID NO: 87976 - DNA, 166 bp, Mus musculus
acatatgtatatgtgtttatatacacatatgtacatatgtatatatatgtatatgtgtgtatatatacacatatgtacatgtgtatatatatgtatgtatgtgtgtatatatatgtgtgtgtatatatatatatatatatatatatatatatatatatatatatat

SEQ ID NO: 87977 - DNA, 62 bp, Mus musculus
atgtatgtatgcatgtatgtatgtatgcatgtatgtatgtgtgcatgcatgtatgtgtgcat

SEQ ID NO: 87978 - DNA, 91 bp, Mus musculus
gccttctaccttttattagtgatattattcaaatcgcttctcggccttttggctaagatcaagtgtagtgatattattcaaaataagtggc

SEQ ID NO: 87979 - DNA, 114 bp, Mus musculus
tatatgagagtgtatacatatacatatatatgtgtgtatatgtatatatgtatatgacagtgtatatttgtacttgaatttataaagtatatttatatacacactgtcatatat

SEQ ID NO: 87980 - DNA, 221 bp, Mus musculus
atataatttatggatataagtataaatacacactatcatgtacatatatatatgtatatatatatatgtatatatatatatatacacacacacttgtcatatactgtatacatatatatgtacctatgtatgtatatatgtatgtatgcatatgtgtatgtgtgtgtgtatatatatatatgtgtatatatatatatgggtatatgtgtgcatgtgtatat

SEQ ID NO: 87981 - DNA, 96 bp, Mus musculus
tacagtatgtatacgtgtctgtgtctatgtgtctctatgtgtatttttcctgaacacatcaatacaacctgcacagtgtgtataacattccttgtg

SEQ ID NO: 87982 - DNA, 85 bp, Mus musculus; identical to SEQ ID NO: 57470

SEQ ID NO: 87983 - DNA, 57 bp, Mus musculus
cacgcaggcgcacacttccaagaggctttctgtctctctctgagtgtgttcttagtg

SEQ ID NO: 87984 - DNA, 73 bp, Mus musculus
gggcctctcctccagtatgtatgtatgtatgtagcaatcctctgctacatatgcagctagagacacgagttcc

SEQ ID NO: 87985 - DNA, 85 bp, Mus musculus
gtatgtgtatgtgtatgtgtatgtatatgtatatgatataatacacatatattagtatatgtatattgcatatatatacacatat

SEQ ID NO: 87986 - DNA, 87 bp, Mus musculus
agggtatccatgatacactatatgtgtatgtatatgcatatatgtgtatacatctgtgaatatatatatgtgtacgtgtgatattgt

SEQ ID NO: 87987 - DNA, 102 bp, Mus musculus
acttaatgtcaacagtataaatggagtagcagaaccaagtatgatatatttcactgctatcagaatggttgttctaagtcctatcagtgctgtaccctgagt

SEQ ID NO: 87988 - DNA, 89 bp, Mus musculus
tgtgtgtgcacgtgtctgtgtatctgtgtgtgcgctcaactgtgagtgtatgtatacatatgtacattaacatggcacaagcatgcaca

SEQ ID NO: 87989 - DNA, 103 bp, Mus musculus
gatgctaagtgcatttgttttcgagtactcccctctctgagactgtcagtaactcatggaggacaacagtaatcctcaagatgaacaaagcccaagaaccatc

SEQ ID NO: 87990 - DNA, 113 bp, Mus musculus
ggctggcaagcaattgtagggctctgcatgccttgacctctccaggactgtcattctcagtgtctttacaggggttttggtgcttgtgtggtcaacaatttcctggctaagct

SEQ ID NO: 87991 - DNA, 99 bp, Mus musculus
gccatagccacttgggattgatttttcatggtatagcactgttgtttattaatgtatatgaatgatttacacagaaacatcaagtcctattgatatagc

SEQ ID NO: 87992 - DNA, 100 bp, Mus musculus
agtgctgggattaaaggtatgccccaccatgcccactgctaaatttatattttaaaatgcaaatttcagctgtagaggtggctcagcagttaagagcact

SEQ ID NO: 87993 - DNA, 112 bp, Mus musculus
atcacgagagcatggggggggaggggctggagagatggctcagcagttaagagcactgaacactgactgctcttccagaggttctgagttcaaatcccagcaaacacgtggt

SEQ ID NO: 87994 - DNA, 94 bp, Mus musculus
tacctacttgcctcttgtctctgtgcctcagtctcatcagatataacatctgtgaagctagggtgtttgagagtcaaattagataacacaggta

SEQ ID NO: 87995 - DNA, 78 bp, Mus musculus
ggaacataagggtgagcccatcaaacaggacatttagtcactctgaatgtctgaagagagtcaccttgcaggtgtacc

SEQ ID NO: 87996 - DNA, 87 bp, Mus musculus
actttatagacaaagacggtaggttctggaaaagctgattgacagaagtcagtgagctaaggctttattgtgtattgttcctgaagt

SEQ ID NO: 87997 - DNA, 85 bp, Mus musculus; identical to SEQ ID NO: 57439

SEQ ID NO: 87998 - DNA, 70 bp, Mus musculus
tatatgtagatatttcatatatatatatatgaaaaatgttcgtgtgtatgtatgtatgtatgtatgtatg

SEQ ID NO: 87999 - DNA, 82 bp, Mus musculus
tctctctgtgtctctgcctctttctgaacctgttacacacacagcacaagaaggaaacgaggagacattttgttatgagaga

SEQ ID NO: 88000 - DNA, 104 bp, Mus musculus
gcaagttgtgagagccaatttaaagaaagcaaaatacttggttatttactgtttgacaactctatcaccatttgaattcatttagaagtttggaaacaacttgt

SEQ ID NO: 88001 - DNA, 78 bp, Mus musculus
agtcacacacctggatacattccccacatggctctaggatgtaacatcacagaggcaagttgggtttcaggtgaggct

SEQ ID NO: 88002 - DNA, 85 bp, Mus musculus; identical to SEQ ID NO: 57470

SEQ ID NO: 88003 - DNA, 115 bp, Mus musculus
ctgtaactcatgcctggaagacctcgtgtagcatatgtattgtctctgtactctctgtgactcacggcaagacccatcacatccttgtgctcagaaatcccaggcaatattccag

SEQ ID NO: 88004 - DNA, 83 bp, Mus musculus
tggttggagtaggtgtgtcactgtgggtgtgggcttaagaccctcaccctagttgcatatctatctatctatctatctatcca

SEQ ID NO: 88005 - DNA, 98 bp, Mus musculus
caccatacatgcacactcccgggagaggtagaacacagttctgattctgtcaaaactaattttatctctatagaaagtatcagttatatagtgtggtg

SEQ ID NO: 88006 - DNA, 78 bp, Mus musculus
ccaaactgtgtctctgtcactccttaaatgggtgttttgttcccaattctaagaaggggcaaagtgtccacactttgg

SEQ ID NO: 88007 - DNA, 84 bp, Mus musculus
gtatttggagcaggagaggaatgaaatggagaaagatgaaatctgtataatttgctcttcagtctgtctctgcctatcttatac

SEQ ID NO: 88008 - DNA, 128 bp, Mus musculus
tagaaacatggcttctcaatcaagtcaaagcttggccttgcagagaggagttctctctatatctcacagtgcctgttttaattactttggttattatgtcaatatatctaagaggaaactttgtaagg

SEQ ID NO: 88009 - DNA, 98 bp, Mus musculus
gaaagtcattaggggctataggtctatttattttgtttatctgaccttgatttaactttggtaagtggtatctatctgtaagattgcccatttctttc

SEQ ID NO: 88010 - DNA, 94 bp, Mus musculus
tcaggcaaaatgaagtgacagctgagagagaggactcaggtccacgcagttgcctctactttacagacttgatttttctctcagcatcaacgtt

SEQ ID NO: 88011 - DNA, 80 bp, Mus musculus
acagattgcgtgactatgtcttgaaggtgggcattttctcattgtctttgttcagtttctctatgtgtgtctgtctctgt

SEQ ID NO: 88012 - DNA, 116 bp, Mus musculus
tagagtatatttccctgagtggaatgtctataccacacaccttccagactcaaggagtatcacagaagagtggcaggagagattctaagggccacatgttagggaagactgctctg

SEQ ID NO: 88013 - DNA, 59 bp, Mus musculus
cgtgcacccatgtatatgtatgtatcccatgtatgtatgtatgtatgcatgtatgtgtg

SEQ ID NO: 88014 - DNA, 101 bp, Mus musculus
ctcctgtgagcatccatttaatggaatgggaagtcctcgtagaagctaatttctctgtgagtctctgagaggccattcagattgagttaaaggagacggga

SEQ ID NO: 88015 - DNA, 118 bp, Mus musculus
tctgtgttcttactgcttaggttttgtctatttttagtcatttatggttctatattgcattcttacattgtttttatacatatgtgacatatggcatctaagtttttataagcattga

SEQ ID NO: 88016 - DNA, 86 bp, Mus musculus
gtatatgcatacatgtacacatgtacacatgtacatatgtacatatgtacgtatgtacgtatgtatgtatgtatgtatgtatgtat

SEQ ID NO: 88017 - DNA, 83 bp, Mus musculus; identical to SEQ ID NO: 57504

SEQ ID NO: 88018 - DNA, 137 bp, Mus musculus
tgtgtgtgtgatatattctgtatatatatacatatatatatataatatatatacacaatacacccacacacacacacacacacatacacacacacacacacatatatatatgtgtgtgtgtatgtatctgtgtgtgt

SEQ ID NO: 88019 - DNA, 96 bp, Mus musculus
gttggtcttgtctaatttactgtttatcatttttaatatcagaagtattttttcaatattacaagttgcacaagcagcaaattaattaagtccagc

SEQ ID NO: 88020 - DNA, 114 bp, Mus musculus
gtgtatatctcattatatcacaaattgaattgagaagacgtgtgtcaggtactttaagtgtctgacacacagttagactccatcagtgtcagttgtgctggctgtgagtatcat

SEQ ID NO: 88021 - DNA, 84 bp, Mus musculus
ccttgggggctctcagagtctgaatcaccaaccaaagagcacactttcttgtgtatttgagactagactgtgagcctcatatgg

SEQ ID NO: 88022 - DNA, 63 bp, Mus musculus
tgctgatctatgagtagagcagaatgatattagaagtcattttgttgctctgttctgtcagta

SEQ ID NO: 88023 - DNA, 87 bp, Mus musculus
ctccacccactgtttggctgtgagtgtctgtatctgagtcagcttttgtgtgaagcctctcagaggacagtcatgttagaggtggag

SEQ ID NO: 88024 - DNA, 86 bp, Mus musculus
gttgggtcctgtttgtgtagccagtctctcagtctatgtctttttattggagaattgagtccattgatgttgtagtaggatctgat

SEQ ID NO: 88025 - DNA, 91 bp, Mus musculus
tggcgtggtaacccaatggggtatcgacagactctctcactggaattaggaccttaaagagagagactccagtgtggggtgcaagagacca

SEQ ID NO: 88026 - DNA, 80 bp, Mus musculus
gttcagaaatctgctaagtagcctgtgagtacataagctgtgcatcctcgcacctcatctctggctgtctcagactgttc

SEQ ID NO: 88027 - DNA, 64 bp, Mus musculus
tatgtgtgtgtgtgcatgtacatgtgtgtatgtgtgtgtatatgtgtgtgcatgtacatgtgtg

SEQ ID NO: 88028 - DNA, 83 bp, Mus musculus
ctccccacactctgtgtgtctgcccagcagttgtagacttacttttcatttaacaggctggacatgaccatcctatatgggag

SEQ ID NO: 88029 - DNA, 80 bp, Mus musculus
gtcaccaactgtcacagtctctcaactagggaacagggctcatgagtccttctctagtccatactgaaatgttgactggc

SEQ ID NO: 88030 - DNA, 101 bp, Mus musculus
atatatgcttatatattatatatgtgtatatatatgtatgtaaacacatatgtatagatgtgtgtatatatgtattacacacacatgtgtatataaatgtt

SEQ ID NO: 88031 - DNA, 131 bp, Mus musculus
gggctcacacacaagaaacagacactctcacactgcctcgtgctacagctcatgcatgcgtgggtgggtgcgtgcgtgcgtgttgaatggtcacacgtgtttcttccactggctttcaaatgtttgcatgc

SEQ ID NO: 88032 - DNA, 62 bp, Mus musculus
tccttgtctatgcagcatgtttgaggccagcctaagcacactgacacacacacaggcagggg

SEQ ID NO: 88033 - DNA, 66 bp, Mus musculus
ctgtatgtgtatactggtacacacctgtgtacagttgtgtgtgtgtgtgtgtcaatgcatttgggg

SEQ ID NO: 88034 - DNA, 74 bp, Mus musculus
ttactctgttttagattgaattgtgtcctgaggatggtgacatacattcaacatagatagctgttgcagagtga

SEQ ID NO: 88035 - DNA, 112 bp, Mus musculus
aaaagcagcctaggttgaagaactggcccagtggttaagagcacatactgctgttgcagatgacctgagtttgactgcaggcacccacatcaggcagctgacaactgctttt

SEQ ID NO: 88036 - DNA, 79 bp, Mus musculus
cctgaagactgaaaggcatgccgggatggcaaagctaatctgaagaggctaccctgtgtctgtctctgccactttcagg

SEQ ID NO: 88037 - DNA, 109 bp, Mus musculus
atatgtattatatgtatgtatatatgtgttatatgcatatatgtgtatatatgtattattatatatatataatacttacatataatatatgtaataaatgtatagtgca

SEQ ID NO: 88038 - DNA, 71 bp, Mus musculus
gcagagacagtgtgtgtgtgtgtttgtgcatgagtacaatcatgtatgtttatgtgtgcatgtttgtatgc

SEQ ID NO: 88039 - DNA, 72 bp, Mus musculus
agtgaagaccagtgtcagcagagagcggccaggcaacgccaccgtgtcatctgctgtctgtttggctaaact

SEQ ID NO: 88040 - DNA, 65 bp, Mus musculus
gtcaaaccctctgtctgtggctgtctggtgtctgcagatgcagttgatatagacagcaagttgac

SEQ ID NO: 88041 - DNA, 68 bp, Mus musculus
gtatgtatgtatgtatgtgtgtatgctgtatgtgtgtatgctgtatacacatgtatgagtataggtac

SEQ ID NO: 88042 - DNA, 75 bp, Mus musculus
gtcgacaaaccctggagttggggcgcccgcgcactccaagggcaggctgtgtgtgtgtgtctcagagggtgagac

SEQ ID NO: 88043 - DNA, 92 bp, Mus musculus; identical to SEQ ID NO: 57641

SEQ ID NO: 88044 - DNA, 108 bp, Mus musculus
gccttgccaaggactgtgtatcccagaatgccttgcagtgaagtgtgtgagctgtggtttagagaaactgcacgtctagatacagataagtacagtggcccagagggt

SEQ ID NO: 88045 - DNA, 89 bp, Mus musculus
gtgaagaggcgttgcaacttcttgcaggtgtgtacttagaggagaaattgctgggtcacacaccgactctgtggttaatgtttctaaac

SEQ ID NO: 88046 - DNA, 92 bp, Mus musculus
ctgaaatccctttttcttttacttactaatgtgtgcatgacagaaacagacagacagacagacaggggtgggtatgagcagagggagctcag

SEQ ID NO: 88047 - DNA, 106 bp, Mus musculus
tgtatatgtatatgtatatgtatgtgtatgtatatttgtatatacatatatgtgtgtgtatatatatatacatatatatgtgtgtgtgtataactagataagctca

SEQ ID NO: 88048 - DNA, 108 bp, Mus musculus
ggggcttcctaagccttaaaactacccagttggaagaactaagagatgtcaagagaggccacagacactctgacactctcagtccaggctgggaagaaaaggccaccc

SEQ ID NO: 88049 - DNA, 83 bp, Mus musculus
gagcagtggttggctgaacaccaaggtctttgtgcccagggaagcatatctgggtggtttcttgtctggaagctgacccttcc

SEQ ID NO: 88050 - DNA, 106 bp, Mus musculus
tatgtatgtgggcatgtatgtataatgtatgtataatttatacacataaatatatgtatgtatataaatctgtgcatagatgtgtgtgtgtatgcttgtgtgtgtg

SEQ ID NO: 88051 - DNA, 88 bp, Mus musculus
aaagtcatccttccacgggccaagtaggctgtgagattcattgccatcatcagactcacagcctgtcagtctgtgtgagtgtggcttt

SEQ ID NO: 88052 - DNA, 72 bp, Mus musculus
agtgctcctggggatgaaggcgaggcaagacatcgagcctttagcctcactctctgtcacccacatagtact

SEQ ID NO: 88053 - DNA, 85 bp, Mus musculus
atttcaaagtcatacactgtgactgacagaggagtttagaactcaattttaattcagcgttgtcagggcgaggtaggatggaaat

SEQ ID NO: 88054 - DNA, 139 bp, Mus musculus
ggagagggctgctgctgaccaatcaggatctgcctttgcgatgcatcaacatgggatccccagagtgaagacagagacctgagaggagaagcttccctgcttccttctccagatctgagtggagtcttggacactctgg

SEQ ID NO: 88055 - DNA, 112 bp, Mus musculus
gacctaggctggccagtcagtgagctgccacctgtctccgtatctctctctctcctcagagctgggatcacagaacggcgccatgtcatctgatgtgtgggttttagaggtc

SEQ ID NO: 88056 - DNA, 70 bp, Mus musculus
ggcctcggaagagcaagatctctggctcactgagtcacctctccaaacccagagaccctctttagacccc

SEQ ID NO: 88057 - DNA, 63 bp, Mus musculus
gtgaggatatatgggcgaattgacaagtgctcttcccatggggagtgtcactctcagtctcac

SEQ ID NO: 88058 - DNA, 104 bp, Mus musculus
gaggaagtcaggacaggaactcaagcagggcaggaaagtccattctcatgggcccaactcacaccttctctgtctctgtctacgtccttgtctgtggctatgtc

SEQ ID NO: 88059 - DNA, 114 bp, Mus musculus
gaaagtgttagaaactacagatccttataaacatagacccatgctctactaggatgtaaagttatactagaagaaattaaagctggtctgaatctgcggctgcttacgagattc

SEQ ID NO: 88060 - DNA, 80 bp, Mus musculus
agacagacagacagacagacagacagacagacatttttaaagattcgtgtgtgtgtgtgtgtgtgtgtgtgtgtgtgttt

SEQ ID NO: 88061 - DNA, 109 bp, Mus musculus
tacgtgcgtgtgttgccgtatccagctaccaacaaaagtttcatgcatttgaaatgaaaatcagtgggattctgtggttggtattgagtatcagcaagataccttcgta

SEQ ID NO: 88062 - DNA, 73 bp, Mus musculus
gttcgagacagggtctgtgtgttccctagcctgggcatcaactcctgggctcaggcactctttctgtctcagc

SEQ ID NO: 88063 - DNA, 96 bp, Mus musculus
tctttcctacaatagtccacagaacagacagacatcaagctagaattgcctgggtgttggaggtcgggtctccctgtgggccctgtctagcccaga

SEQ ID NO: 88064 - DNA, 63 bp, Mus musculus
tacacacacacacatatatgtgtgtgtgtgatatgtatgtatatatgtatgtgtgtgtgtgtg

SEQ ID NO: 88065 - DNA, 123 bp, Mus musculus
ctctccatgctgaacagacttttttcccccaaggcctgtacttagagtcaatcccaacagacactgcctgagtctcagcttgaaggacctattattcagctttggcagagtgcttgctgtgtc

SEQ ID NO: 88066 - DNA, 105 bp, Mus musculus
tcttctctccattgtacaagtacactgttcatggcacagcctcagtctctttctcagttagatttgcaggttaaaccctaggaatagtgatgacctttgagaaga

SEQ ID NO: 88067 - DNA, 96 bp, Mus musculus
gaacttgccagactcgggtaggcagtgttgttagctggctgcgttgggtcaggccagcagccacagctaccctgccacttccttctggctgggttc

SEQ ID NO: 88068 - DNA, 75 bp, Mus musculus
agtggcaggaaaggcatatcagcagtaagaaacaatcctgggatgaagtctctggtgtctgtgtctcactgagct

SEQ ID NO: 88069 - DNA, 105 bp, Mus musculus
tcttgtggcccacagctttgcaatttgacagttcagtgtcaggtcagtttgactttcaatggagacttgtgcctgctctgtgtcaggtcatggaggtgggaggga

SEQ ID NO: 88070 - DNA, 68 bp, Mus musculus
atgacagttcagttgagtctctgtgaggccctatgggcctgggcagatattcaatccttccttctcat

SEQ ID NO: 88071 - DNA, 82 bp, Mus musculus
tgctgatcttggatttaaggagagtcatgtctttggctctcatgagctgagggaagctgtctctacctcactctctcatgta

SEQ ID NO: 88072 - DNA, 113 bp, Mus musculus
ctcttagaatgtggggtcccaggggaaggaagtaggtcagtgggagtgtctttgaagatatatttttatctttggactctgctgtgctctctgctccctggtcgccatgaggg

SEQ ID NO: 88073 - DNA, 67 bp, Mus musculus
gagggtgtgtgacctgttgcttagccttgtagctctttacaatgtttgtaaatgtgtcttcaccctt

SEQ ID NO: 88074 - DNA, 102 bp, Mus musculus
tctgtcaactatatttatctatatatgcatatcatttatctctacatatacctatctataaatatatagatatgtagatagatagatagacagataggcaga

SEQ ID NO: 88075 - DNA, 194 bp, Mus musculus
atatatgtatatgtgtatacacatagtatacatgtatgtgtgtgtgtatatatatatatatatgtatatatatatgtatatatatgtatgtgtatatatatatatacgtatatatatatgtgtgtatatatatatgtgtgtgtatatatatatatatatatatatatatatatatatatatatatagtcctgac

SEQ ID NO: 88076 - DNA, 81 bp, Mus musculus
ggtgtatgcacatgcatgagacgttaatttgaatatattttcaaattcgatgtatatgtttccatgtgtgtaactgaagcc

SEQ ID NO: 88077 - DNA, 106 bp, Mus musculus
atgtttaactagtgtgtactaactgatttaattgtgtgttgaaatgatttgagcttagtcagaaacagaaaacaatgaatataaatgatacatactgtgggtgcat

SEQ ID NO: 88078 - DNA, 95 bp, Mus musculus
gtcaagatccaggcaaaaagcttgatgtacagccagactggccatgacagactggctgtctgtatggcttgtgtgcttaaggcaggatagagggc

SEQ ID NO: 88079 - DNA, 119 bp, Mus musculus
gctagctcccagtgacagtgagacctagtcgggagtgccagtcaggttccagaagacaacctgcttctctcactctcacttagcctgccgactatgaggtcaccactggaatgcttggc

SEQ ID NO: 88080 - DNA, 76 bp, Mus musculus
ggatatgtatatgtatatgtatatgaatatgaatattatgtatatgtatattgtgtatatatatatatatatagtc

SEQ ID NO: 88081 - DNA, 66 bp, Mus musculus
gacgacacaagtggccagttctgctgaaagccgactactgtctttcagcgtctctgtgtctcatgt

SEQ ID NO: 88082 - DNA, 77 bp, Mus musculus
gcaaatatcggtagagttcagatctctgaggctctcggtagagttcggatctctgaggctctctgagtgtgaagtct

SEQ ID NO: 88083 - DNA, 103 bp, Mus musculus
tatatatatatttacacacacacatatatatatataatgtgtatatatatgatgtgcatatatatgtatatatgtatatgtattatatatataagtatacaca

SEQ ID NO: 88084 - DNA, 85 bp, Mus musculus
catgtgccatgtatgcatatatgtatgtatgtacatatgcatttatgtatatgtataggcatgtctgaatatgcacacacatatg

SEQ ID NO: 88085 - DNA, 78 bp, Mus musculus
agacagagtagggaaagagagaaatagcagaacccaccagcttcatctacatctgtctgtctgtctgcctgtctgtct

SEQ ID NO: 88086 - DNA, 91 bp, Mus musculus
agtttccatttctaaaattacagtgaaaaaaatccttttgtttcagatagttggacttcttcacttgtgattttcctgttttgtgggagct

SEQ ID NO: 88087 - DNA, 106 bp, Mus musculus
acatgggtatgtgactatacatacatatatacatatacatatgtatatatgtatatctgtaattatctatgttatatatgtatgtgtatattatgtatatatacac

SEQ ID NO: 88088 - DNA, 113 bp, Mus musculus
tactatgtacgctggaagaaatccctctgagggctggagagacagctcagcggttaagagcactgactgctcttctaaaggtcctgagttcaaatcccagcaaccatatggtg

SEQ ID NO: 88089 - DNA, 91 bp, Mus musculus
tgggtgcaagctggtttgaggagcagccgagtgaggactacagggaaagccacactcacttacactgtgtctttctctggtaagcgtccca

SEQ ID NO: 88090 - DNA, 89 bp, Mus musculus
gcattgagctacagtcatataggctgagaaggcagtgaggaccatggtaccatactcgttactgtcctcctgtgggagtggttgggtgt

SEQ ID NO: 88091 - DNA, 83 bp, Mus musculus
aagcagtgacagagctgagagaagacaaaacacctcaacacagagctcacaactctctctctaacccactctgccatttgctt

SEQ ID NO: 88092 - DNA, 71 bp, Mus musculus
gatttagtcagacagacagacagacatgaacacacggtgcacacgctctgtctgtctgtctgtctcccttc

SEQ ID NO: 88093 - DNA, 103 bp, Mus musculus
ctgagtgtttactgtgcaaggaaaggctgatggaagttcacactgaagctagagtgcacagcctccttaagcctcagtcttctgcatcctcacattaacttgg

SEQ ID NO: 88094 - DNA, 101 bp, Mus musculus
aattatttacttcctcatttgcatttgtgtgagcatgtgcatgtgtgtgcacgtgtgtgtgcattgaagcacacaggtgtaggtcagaggtctggctggtt

SEQ ID NO: 88095 - DNA, 112 bp, Mus musculus
tagtataaagatatgttgtggggctggagagatggctcaatggttaagagcattgactgctcttccagaggtcctgagttcaattcccagaaaccacatagtggctgctgac

SEQ ID NO: 88096 - DNA, 85 bp, Mus musculus
aatccagtgggaactctgactcattatctgacaggtctcttctcagcctgccagcctctggtggtcaccggcttcccgttgggtt

SEQ ID NO: 88097 - DNA, 89 bp, Mus musculus
ggactgtacatacacgtgcatatataatatgtaatatatatatatatactaaaagtattttaaaattatgtgtgtgtgtgtgtgtgtct

SEQ ID NO: 88098 - DNA, 75 bp, Mus musculus
gtctttctatcaagaagccccagttttctttaaaactgaggaatgatgtcagggttgaaactgggtgtgaagggc

SEQ ID NO: 88099 - DNA, 75 bp, Mus musculus
ttgaaaacatttatacacacacacatacatgtatgtatgtatgtatgtatgtatgtatgtatgtatatggttcag

SEQ ID NO: 88100 - DNA, 116 bp, Mus musculus
agttttccttttagtattttctatagggctggattaatggatagatattatttgaatttgaattcgtcttaaaatatcttgtttattttctatgtatggtgattgagagttttgct

SEQ ID NO: 88101 - DNA, 76 bp, Mus musculus
gtgtgtgtgtgtgatgtacatgtgtgtgtttgcatggttctgtgtttgagcattagcatgtgcatgctacatatgt

SEQ ID NO: 88102 - DNA, 124 bp, Mus musculus
atatacatacatacacatgtatacatatatatacatgttaatatatatacacacattacatatatatgtgtatatatatgtgtgtatatgtgtatatatgtatatatatatatatatatatatg

SEQ ID NO: 88103 - DNA, 78 bp, Mus musculus
cttgaacccgtgcaggtcttgtgcgctctgccacagtctctgtgagtacatatgtgcatcagtcttgtcggtctgaag

SEQ ID NO: 88104 - DNA, 97 bp, Mus musculus
tgtgtatatatgtgtgtggtatgtgtatgcatgtgtgtatatatgtgtgtgtatatatgtatgtatgtgtgtgcatacccacactgaaatgtataca

SEQ ID NO: 88105 - DNA, 105 bp, Mus musculus
tttattgcatcaacatatgtatatatatatatatatatatatatatatatatgtgtgtgtgtatatgcatatatatgtgtatatgaatatatgtgtttataagta

SEQ ID NO: 88106 - DNA, 76 bp, Mus musculus
gtgtgtgtgtgtgcatgcatgtgtgtgtgtgtctctgtatgtgttcatgcatgtgtctgtgtgtgtatatgcatgt

SEQ ID NO: 88107 - DNA, 75 bp, Mus musculus
tggagaactgttggggaaatctttgtgctgacagaagcggatgcagcaagtcagacaacagacagcagacttcca

SEQ ID NO: 88108 - DNA, 108 bp, Mus musculus
ctgttttgatgtatgaagagctgttggaacatgagcacagataccctgacttggtctctgtgtctgagtttgcgttataacaaccgagtgaagtagttgctgcagaat

SEQ ID NO: 88109 - DNA, 88 bp, Mus musculus
ttctcctttttcctatgtaggtaggaatttttgtgtacatagatttttgtttaaaacttccccattttaccttgatgaagagggtgaa

SEQ ID NO: 88110 - DNA, 93 bp, Mus musculus
taatttttacctgactgcaaagaaaagcagtgtctatttttatttaatgtacagagctaattctgaggatgcaatcagacctggtagaaatta

SEQ ID NO: 88111 - DNA, 99 bp, Mus musculus
acatatatgtatgtatgtatatatatgtgtgtgtgtatatatatacatatgtgcgtgtatatatatatatatgtgtgtgtgtgtgtgtgtgtgtgtgtg

SEQ ID NO: 88112 - DNA, 72 bp, Mus musculus
acacacatatatatatgcacatatttatatgtattatatataaaggtcatgtgcatatgtgtgcatgtctgt

SEQ ID NO: 88113 - DNA, 110 bp, Mus musculus
gtgtacaaacacatgcacacaaacatatacatatatatgtatatttacaaagatttctttgtgaattgtaatatgtgtgtgcgcgtgggtctgtgtatgagcatgtgcac

SEQ ID NO: 88114 - DNA, 113 bp, Mus musculus
ggtgttgaatgcttcacccacaggaaatggcattatttggaggtgtgtccttattggaagagatgtggttttgttggaagaagtgtgtcactgtgggggcaggcttggaggtc

SEQ ID NO: 88115 - DNA, 64 bp, Mus musculus
catgtgtgcatttttatgcatgcacgcacatgtgtgtgtgtgtgtgtgtgtgtgtgtgtgtgtg

SEQ ID NO: 88116 - DNA, 107 bp, Mus musculus
tattgcatacatatataaattagtgtgtgtgtgtatgtatatatatatatatatatatatatatatatatatatgtatatatgtgtgtgtgtgttgtatacatatac

SEQ ID NO: 88117 - DNA, 140 bp, Mus musculus
gattatacatatacatgtatatgcttatatgcatatacacacaattatatgtatatgtgtatcaatatatatgtattatatacaatatgtatatgtatacaacacacacatatatatgcatatgtgtatcaatatatatg

SEQ ID NO: 88118 - DNA, 83 bp, Mus musculus
catacatacacacacatatatatgtatatattatgcatgtatatatgtatatgtatatatatgtgtgtatatatgtatgtatg

SEQ ID NO: 88119 - DNA, 58 bp, Mus musculus
tagggctggagagatagctcagtggttcagagcactgactgctctaccagaggtcctg

SEQ ID NO: 88120 - DNA, 85 bp, Mus musculus; identical to SEQ ID NO: 57439

SEQ ID NO: 88121 - DNA, 100 bp, Mus musculus
gtccacaccagcacaagggtaccttgggagtagagtctgtggacacccgtaaggtatacacacgacactccacaggatctttagacctctgtgagtggat

SEQ ID NO: 88122 - DNA, 117 bp, Mus musculus
agtgaataatggacatttctgagtgaaattggagtgatttttctgtagggaaagtatataagttagttgtaccttagtcttctgcctcccacattattcgtgttcatgtttttctct

SEQ ID NO: 88123 - DNA, 115 bp, Mus musculus
ggagatgtctaattcaaactctgggctttgatctctgcttcacccaatatttattaggtttattttttaaaagaatggagagggaaagtctcttgaaagctggaggagacagtct

SEQ ID NO: 88124 - DNA, 110 bp, Mus musculus
ctggctgcaagtgtcctaggcacctattgccttttctcaagtgtaagtaaggtctctctttgtgtcactcttagagactgcaatggaagtgtttgcaatgttttcaggat

SEQ ID NO: 88125 - DNA, 129 bp, Mus musculus
cagatgctcagtttggtcttcatgtgggtccccccaaaattggagccagggctgtctctgactcagactctgttgcctctctttggatccctttcccatagctgggctgccttgtctggcctctcagtg

SEQ ID NO: 88126 - DNA, 86 bp, Mus musculus
tgtatgtatgtgtatgtatatatgtatacatatgtgtatatgtgtgtatgcatatatgtgtatgtgtatatgtatgcatatgtata

SEQ ID NO: 88127 - DNA, 66 bp, Mus musculus
atacttacacacacacatacatatatgtatgtatatatgtatatatgtatgtgtgtgtatatatat

SEQ ID NO: 88128 - DNA, 95 bp, Mus musculus
ggaagcaggtccgcccctgtgaacagttttaaagatttttaaagaatttatatttattgatttttaagtgtgtgtgtctgtgcctgtgtgtgtcc

SEQ ID NO: 88129 - DNA, 72 bp, Mus musculus
gagattgagggctggagagatggttcagtggttagtacgagcactgactgctcttccagaggtcctgagttc

SEQ ID NO: 88130 - DNA, 73 bp, Mus musculus
taagttgattactgagctgacaaagttcttgagttctgtcgctctctctttctgtagcttaagaattgacttg

SEQ ID NO: 88131 - DNA, 69 bp, Mus musculus
gcttggctgtgagtctatctgtctcagtcggctgctgggagatcttatcagaggacagacatgccaggc

SEQ ID NO: 88132 - DNA, 100 bp, Mus musculus
cagtttagatgcgtatgtgtgtgtatgtgtgtatgtatgtatgtatgtgtgtgtatgtgtctgtatgtgtgtgtatatatttatatgtgtgtgcatgtat

SEQ ID NO: 88133 - DNA, 113 bp, Mus musculus
tccaaggttgatattgaaagttaatgtatgtatatatgcatatatgcaaatgtatatgttattagaatatatatatatattattcctttaaatattcaaagattgatattgga

SEQ ID NO: 88134 - DNA, 78 bp, Mus musculus
gtgtgtgtatatatatgtatatatgtacgtatgtatgtacatatatatatatgtgtatatatatacatatatatgtgt

SEQ ID NO: 88135 - DNA, 99 bp, Mus musculus
gtgtggggagaggctgctgtcaggagctgtagggtgtgagcagagtgagaggtacacatgggcctaccagtgtagtagtgaaggggtgtgtatgtgcac

SEQ ID NO: 88136 - DNA, 89 bp, Mus musculus
aggatcaagcaatgtacagggttgttgactggcaggtgggcaaggcaacaggggcctggctgagttggacttcacatagttctgaacct

SEQ ID NO: 88137 - DNA, 94 bp, Mus musculus
tggttcataacttcagttactgtcactttgtcactgtttagtttctgtttccatgatctgtccattgatgagagtgaggtgctgaagtctatca

SEQ ID NO: 88138 - DNA, 102 bp, Mus musculus
cctgctctttcatacatgcaaaatctgtgtctctgtgtctgtctgcttctataaatatagactaacgtgagcagagtatttattgtaataaacagagcaagg

SEQ ID NO: 88139 - DNA, 79 bp, Mus musculus
cttcaccttgtgcacaggtgaagtttaaagttcactattaacttatgaagagcttggtttactaggtgtatgagtgaag

SEQ ID NO: 88140 - DNA, 116 bp, Mus musculus
aacatgtgcttaataagtgctagttgttatacatgttaattcaagagaactagtaattgttcatttttattgatactattaacatgtacatacttggatgtagtggttaaaatgtt

SEQ ID NO: 88141 - DNA, 102 bp, Mus musculus
gggaaatggtgctcttagcacattggttaaactgctcacagtggctgttcatttagataaacattataccatgagtggggggctttgtgcaaacttctttcc

SEQ ID NO: 88142 - DNA, 107 bp, Mus musculus
cccagaggagagggattcgatggagacattcggtttacagttgagtgttctttgcatcatgtctgactgtcagtctctgtatttgttcacatctgctgtagggggaa

SEQ ID NO: 88143 - DNA, 98 bp, Mus musculus
tgtgattcagtgttccatatttgactagtgaagtatatttttatatcattgagggcaggattttttcactggaaagattactggcccattcagtctca

SEQ ID NO: 88144 - DNA, 91 bp, Mus musculus
tcccatgaaaaatttctgtggattttgctttagtcttctcagtaagagaattattattagtgcagagtgagcagaatgtgagaaaatgtga

SEQ ID NO: 88145 - DNA, 68 bp, Mus musculus
atacatacgtacgtacgtacgtacgtatgtgcgtgcgtgcgtgcgtgcgtgagtgcgtgcgtgtgtgt

SEQ ID NO: 88146 - DNA, 124 bp, Mus musculus
tgtatatgtatatgtatctgtatctgtatctgtatatgtttatgtatatatatttatatgtacatatacatatatatacatatagatagatagatagatagatagatagatagatagatagaga

SEQ ID NO: 88147 - DNA, 70 bp, Mus musculus
gtttccaggaagtactagataagagtgggaggtggtgatacaaacatacagtgtcactctgtctggaagc

SEQ ID NO: 88148 - DNA, 76 bp, Mus musculus
gctgatatatattttcacacacatgtgtgtgagcacacacacacacacatatgagtgcattttgaaggcaaaaggc

SEQ ID NO: 88149 - DNA, 108 bp, Mus musculus
ggaagatagttatatctttctagcaaaattaatatatcatgacaatttgttcttgaatattgtttacagagtatattaaaattgtctaatatggctttcaaattttcc

SEQ ID NO: 88150 - DNA, 116 bp, Mus musculus
gtctgtcataataagcttaaacattgaaggttgtatttagtagacttctgacaagattgagagctgatatctattaagttagacaattgtttctgtttcaattatttactccagat

SEQ ID NO: 88151 - DNA, 89 bp, Mus musculus
ggaaacgtggatgagcgagaatctcagtagtggcgtgcagtctgtcttaatcactcactgttccattactgtgaagaaacaccatggcc

SEQ ID NO: 88152 - DNA, 128 bp, Mus musculus
ctcaatattgacaaaacaaagagtaaaaatgccttcggggtagcttctcaaaaaggatgagtaactgtgtgtggtattgtacatcttttttcccagtgctgaggaggcagaagcagacaaagctttgt

SEQ ID NO: 88153 - DNA, 98 bp, Mus musculus
gggacatgtgtgctacatatacaatcatgtcagatttctgagatataataggttgaattgtatctccttaagtttctggtgttgtggtcataaccccc

SEQ ID NO: 88154 - DNA, 95 bp, Mus musculus
gtggaggtcttgtttaggcagtagtgtgctttcctggtatctctaaaagaaatctcaaaatcacactctcacagtagccatcctttgacttttac

SEQ ID NO: 88155 - DNA, 68 bp, Mus musculus
agggtgctgcctcagtgactctgtgcttccgcctgtcccagaagctgtccggttctctggcgcaccct

SEQ ID NO: 88156 - DNA, 75 bp, Mus musculus
atagaggaggtattagacttgatggaaagtcgcaaaccatttaagtgggagctggcttctttggggatcctctgt

SEQ ID NO: 88157 - DNA, 81 bp, Mus musculus
ttcttcaccatcatcatcttcttcatcgtgacaactctgatttgagagaataacaggaaaggaggatatgatgagagagaa

SEQ ID NO: 88158 - DNA, 118 bp, Mus musculus
gctaaatataaattagatgctggtttgcatgggatcttacattgtgcttaagattttatatttgtctaatttggaaaatgtttgtacttccatgagattttctacctttataactagt

SEQ ID NO: 88159 - DNA, 107 bp, Mus musculus
tgtgtgtagagttggtgcctgtatgtgcatgtgtcttgctcatgtgtgtttcagtactgagagaccagaagaaggcattgaatcaccaagaactgtagttacatata

SEQ ID NO: 88160 - DNA, 83 bp, Mus musculus
accactagcctttcagatgaaagtgaccagagaacctcagggaaacctcctgtctctgagtcccaagtgttgaggttacaggt

SEQ ID NO: 88161 - DNA, 64 bp, Mus musculus
atctctctagtctgtcactcacaggatcactcctggtgctgttcagttgctgctgctaggagat

SEQ ID NO: 88162 - DNA, 107 bp, Mus musculus
tctcattgtggtgtagtgttaggctgaatccgcaggtcatgtgtaggaatttggtccattagaaatctgtaatgcagctggagttttaatactaaatctgtggtgga

SEQ ID NO: 88163 - DNA, 117 bp, Mus musculus
ggtgcctgtccttcctgtgatcctggttgtatcataactcctcagagtccagctgtctctgtgattctgtgagtctgggatcctgtgattctgagatcctgggtgtgtcagagctcc

SEQ ID NO: 88164 - DNA, 79 bp, Mus musculus
agagatccaactcaggtcaccagagttgtagggcaagagcctctagccatttaagatgtgtgtcactgtgcctgtctct

SEQ ID NO: 88165 - DNA, 119 bp, Mus musculus
tctccatctatggtaattgagagtttggccgggtatattagcctgggctgacatttgtgttctctcagtgtctgtataacatctgtccaggctcttctggctttcatagtctctggtga

SEQ ID NO: 88166 - DNA, 89 bp, Mus musculus
aagttttaaagatcagggtaaagcagatttcaacactgagtatggttggtggtttgcaattatatttgatctttttaaaaaaaggactt

SEQ ID NO: 88167 - DNA, 85 bp, Mus musculus; identical to SEQ ID NO: 57470

SEQ ID NO: 88168 - DNA, 72 bp, Mus musculus
tctgtatataaatgtctgcctgcctgtatgtgtctgtgccagtcatgtgcctggccaaaggagcacagcaga

SEQ ID NO: 88169 - DNA, 116 bp, Mus musculus
gttgcatgttctcactcatatgtggttctagtgttgattctttaaatgtatgtattaaactatacctatagaatctaggaaattaaaaagagaccattgtctgtgcatgggatcat

SEQ ID NO: 88170 - DNA, 85 bp, Mus musculus; identical to SEQ ID NO: 57470

SEQ ID NO: 88171 - DNA, 85 bp, Mus musculus; identical to SEQ ID NO: 57439

SEQ ID NO: 88172 - DNA, 85 bp, Mus musculus; identical to SEQ ID NO: 57439

SEQ ID NO: 88173 - DNA, 65 bp, Mus musculus
tgcgtagtggtaaccttgttagtgtgacagtcccactgtctccaagacacactgccaactgtgca

SEQ ID NO: 88174 - DNA, 109 bp, Mus musculus
ggaagtgggcttgtttagaaattggattttttttttggagcaaatcccatctgggttgtcaggaaattggtagtttagtttataggaatcgttagcagtagctccatcc

SEQ ID NO: 88175 - DNA, 70 bp, Mus musculus
tgaaagtggggctggagagatggctcagaggttaacagcgctgactgctcttccagaggtcctgagttca

SEQ ID NO: 88176 - DNA, 86 bp, Mus musculus
agagagagagagagagagagagcgagagagagagagaggggggggtgtctgtctagtctatctatctgtctctaattctctgtctc

SEQ ID NO: 88177 - DNA, 89 bp, Mus musculus
tctctctcatgtatgtatgtatgtatgtatgtatgtatgtgtatgtgcatatgtacatgtgcgtgtgcattcaggcatgcatgtggagg

SEQ ID NO: 88178 - DNA, 68 bp, Mus musculus
ctagtatgtatgtatatatgtgaacatatatgtatatatatgtgtgtatatagctacatacatatagg

SEQ ID NO: 88179 - DNA, 103 bp, Mus musculus
ttggggactgagttgggacagggactcttcagcaactgagggcctctctcttgctctcagtatccttgctggggtgggtggtccagggtttcttactccttgg

SEQ ID NO: 88180 - DNA, 88 bp, Mus musculus
acatgttcatgtatatgcacacatgcatgtttttatgtgtgtacttgtgcatatatacatgcatgtgtgcatgtatgtttttgcgtgt

SEQ ID NO: 88181 - DNA, 75 bp, Mus musculus
tttgtgtatttctgtgtgtcagatgtgtatgtggtgagctcacacatgtcacagtgcacacgtggaagtgacagg

SEQ ID NO: 88182 - DNA, 111 bp, Mus musculus
tatatcatgcatacctcagatcaccactcagacaagaatgcatcatgatactttataaatgttttaaactcttagaaatggttaatttgctatttgaggtagcacactgta

SEQ ID NO: 88183 - DNA, 73 bp, Mus musculus
acagcttgtggtttctgctctgtatatatgtatatatgtgtagtagaacatccaggggaaaattgcatgctgt

SEQ ID NO: 88184 - DNA, 91 bp, Mus musculus
agttacagacagtagtgttggtgtatgtattatgtatgtacggatatatgtatgtatgtatgtatgtatttacttactattttattgagct

SEQ ID NO: 88185 - DNA, 62 bp, Mus musculus
gcttgccagaactgagagtcggccagaagaagccctgtgtgtgtgactcacaggctgtgagc

SEQ ID NO: 88186 - DNA, 74 bp, Mus musculus
tgcctcatggtcgggatgacatggtggcagaagcaagagtctgagctgtcacattacatcccactcaggaagca

SEQ ID NO: 88187 - DNA, 80 bp, Mus musculus
tctgtctctctctgtgtctctctgtgtgtgtatgtgcacgtatgcatgtacatgtatacatggtatatgtagaggtcaga

SEQ ID NO: 88188 - DNA, 104 bp, Mus musculus
tatataagagtggatgctcacattctgggtctctctgtgcctgagccaagcttgaatactctggtacactgctgtcttctaatgtgtgtgtgtgtgtgtgtgtg

SEQ ID NO: 88189 - DNA, 62 bp, Mus musculus
atatgcatctgcatgctcgagtgcatgcgtgcgtgtgcacgagtctctgtgtgtgtgtgtgt

SEQ ID NO: 88190 - DNA, 76 bp, Mus musculus
tccacagtgggctgtgacctggctggaccgtcctaaagaccttccttacatccagtctcactcactgactcctgga

SEQ ID NO: 88191 - DNA, 108 bp, Mus musculus
gagctttgcttcatctaatctatttgtgaatatgtatatgtcagtctgtatgcatgcatgtatgtatgcatgtatgtatttgtaggtcttggagtctgccttttgctt

SEQ ID NO: 88192 - DNA, 105 bp, Mus musculus
gctcactggcgggtactggacctttactgaagagtcagagcaatgtggagttgtatctctggatcactaatcctcatcaccatggttttgtagctctagagaagc

SEQ ID NO: 88193 - DNA, 96 bp, Mus musculus
cataccactttaactaattgtaaaaattgaacatttattgtatatgtgtaggcacatatataccatggctgtgcatgctacgaatattagaggatg

SEQ ID NO: 88194 - DNA, 211 bp, Mus musculus
tgtatatatgtatgagtatgtatgtgtgtgtgcgtgcacatgtatgtatatatatatgtgtgtgtttatgtgtacaaatgcatgtatgcatgtatgtatttatgtatgtgtgtacatgtatatatgtgtatatgtgtatgtatgtgtatatatgtatatgtgtgtatgtatgtgtgtatatgtattcgtgtatatgtatgtatatgtgtac

SEQ ID NO: 88195 - DNA, 72 bp, Mus musculus
tgagacagggtctctcactgaatctggagctaggctggcagccagcaagccccagtgattctcctgtctaca

SEQ ID NO: 88196 - DNA, 99 bp, Mus musculus
gtttaaactgctggattatagaatatttacattctctctgtttatctgtgtcagtcccagagcagatgtttccatactctgtaaatcctgcaaaagagc

SEQ ID NO: 88197 - DNA, 114 bp, Mus musculus
actctttggggaaaaaaaccatttagctatgtatctgtgtgtgtgtatgtatgtatgtatgtatgtatgtatgtatctacctatctatctatgttgagggtgagtgccacaggt

SEQ ID NO: 88198 - DNA, 79 bp, Mus musculus
tatgtgcatgtatgtatgtatgtatgttcatgtgtgtatgtatgtatgtatatgaatgtatgtgggtgttatgtatgta

SEQ ID NO: 88199 - DNA, 101 bp, Mus musculus
gggaagatagaccctgagatcattatgttaagcaaaatatgtatgtatgtatgtatgtatgtatgtatgtatgacttgaaagtagatgtggggatggtcct

SEQ ID NO: 88200 - DNA, 115 bp, Mus musculus
tgtcattaatgtattctctgatatatatatatatatgcatatgtatagacatatattcattttaaatatatgcatgtatatatttatacacatatattcttatatatcatgggca

SEQ ID NO: 88201 - DNA, 118 bp, Mus musculus
cctggctgacacataggacaaacagatcttgctcactctggttcactgaactttgtatccaagtggtttagctagcgtagtgtagggcatgtagagtctctgggaaaacttagtctgg

SEQ ID NO: 88202 - DNA, 81 bp, Mus musculus
gggagacaggatgaggggagagatgtggaggaaggaagaatttaatatgagcacacctctctcagtcagccagtctattcc

SEQ ID NO: 88203 - DNA, 113 bp, Mus musculus
tatcccatgaattagagtgtggtttataatttcaaggaacctgagtgactttttttttttaaagcagttgtaagatttaggttagatagaaaacagaccagaggcaggagatg

SEQ ID NO: 88204 - DNA, 115 bp, Mus musculus
actactcttttctgcaagagatatgtgtgctatgacactggatgtggtagttagtactaaactgtatatatataatttcctgtcctacatgtagatatctatgatgaagtgtagt

SEQ ID NO: 88205 - DNA, 70 bp, Mus musculus
gtgtacgtatgcatgcctatgtatgtgtatgtgaccagtatatatatgtatatatagtgtatatgtatgt

SEQ ID NO: 88206 - DNA, 88 bp, Mus musculus
gctttgttttgcttttaagtgaggtgcccacttgtgtgtctgtcaccacatgtgtgcctggtgcctgtggaggccagaagagagcatc

SEQ ID NO: 88207 - DNA, 73 bp, Mus musculus
tggctggactcagtctctctgtgtgtatggggaaggcttccaggaggaataagcagcgtgactgagttttcca

SEQ ID NO: 88208 - DNA, 96 bp, Mus musculus
ctccattcctagaattccacaaatgggagagcaaggagttatcttgccagaaactcacagcttcttgttattagtctgggattgcttaccaaagag

SEQ ID NO: 88209 - DNA, 64 bp, Mus musculus
gagaaagttccagacagagcagcatagtggactgactgtctgtgtgtgtgtgtctctctctctc

SEQ ID NO: 88210 - DNA, 119 bp, Mus musculus
gcagatgaactctaagtgctacagcaaggcatataagaaaatacatatcacaggcatgttgacaccacacatacaatgagatagatccccctgccatgtgtaaggacactttttcatgc

SEQ ID NO: 88211 - DNA, 104 bp, Mus musculus
catgggttgggatcttggattaaataaagagaagacagtgagctgagtgtgtttatctctcctgcttcttgtcatatggttatccacctccttactacatcatg

SEQ ID NO: 88212 - DNA, 82 bp, Mus musculus
gaatccagctgtgtgtctctttctgtttaaactaagaatcacctttacttatgacttaataaggcacacactgagacatttc

SEQ ID NO: 88213 - DNA, 92 bp, Mus musculus
ttctaaattatttaggagtgtggtatctaagcactgtgtctgctgactgcaatccagtgactcagtctgtgtatcttgatctgtgtttggaa

SEQ ID NO: 88214 - DNA, 85 bp, Mus musculus
gtcttccacactgctgggaaaccagacaaataagttcacatatgtttgtgtttctactgtgtgtctgtgtgtgtccatggaagac

SEQ ID NO: 88215 - DNA, 115 bp, Mus musculus
gtagggaattcttaaaccccaccaccatctgtctgtctgtctgtctgtttgtctctctatcttttcaggactggggacctaacccaagaccatgcatgttaggttagttctctac

SEQ ID NO: 88216 - DNA, 75 bp, Mus musculus
ttgcaggaccctctggtagtactatgtccaagtttttgaggaaccgccagactgctttccagagtggttgtacaa

SEQ ID NO: 88217 - DNA, 85 bp, Mus musculus; identical to SEQ ID NO: 57470

SEQ ID NO: 88218 - DNA, 84 bp, Mus musculus
tcaatatacctgtgtgtctgtctgtctgtctgggtgtttctagagagggttatgagagtatagcagacccactgtgaatatgga

SEQ ID NO: 88219 - DNA, 84 bp, Mus musculus
cagcttgtatctatattagttgagtgctgagttctctgtgtgggcattttgggggttgaggatttactgttataaatctggctg

SEQ ID NO: 88220 - DNA, 92 bp, Mus musculus
tgtgagctttctgtcatttttacagttattgttgatgtctacctgtaatccacagtgtacagaatgtagaatgtgacttcaagttgcttata

SEQ ID NO: 88221 - DNA, 66 bp, Mus musculus; identical to SEQ ID NO: 63027

SEQ ID NO: 88222 - DNA, 106 bp, Mus musculus
gccttagtgcatggtgatctgataggatgcatgggacaatttcaatatttttgtatatgttgaggcttgttttgtgaccaattatggggtcaattttggagaaggt

SEQ ID NO: 88223 - DNA, 106 bp, Mus musculus
gccttagtccatggtgatctgataggatgcatgggacaatttcaatatttttgtatatgttgaggcttgttttttgaccaattatggggtcaattttggagaaggt

SEQ ID NO: 88224 - DNA, 85 bp, Mus musculus; identical to SEQ ID NO: 57439

SEQ ID NO: 88225 - DNA, 61 bp, Mus musculus
ctagataacacatacatgtgtatgtatgtatgtatgtatgtatacatgtatgtatgtgtgg

SEQ ID NO: 88226 - DNA, 85 bp, Mus musculus; identical to SEQ ID NO: 58391

SEQ ID NO: 88227 - DNA, 79 bp, Mus musculus
acttctcttagtttcactgtgtctctgtttagtttctgtttccatgagctgtccattagtgagagtgggatgttgaagt

SEQ ID NO: 88228 - DNA, 85 bp, Mus musculus; identical to SEQ ID NO: 57439

SEQ ID NO: 88229 - DNA, 113 bp, Mus musculus
aagatcagccttagtgcatggtgatctgataggatgcatgggacaatttcaatatttttgtatctgttgaggcctgttttttgatctattatgtggtcagttttgtagaaggt

SEQ ID NO: 88230 - DNA, 116 bp, Mus musculus
tgcttgtgatttgctgggaaatgtggtgtgtgtatgtactcactctctgtgtttcaatatatccttaatgttattcagtttggtataaacagacctttgtctttgtctacacagta

SEQ ID NO: 88231 - DNA, 74 bp, Mus musculus
taggggctggagagatgtctcagtggttaagagcactgactgctctaccagaggtcctgagttcaattcctagc

SEQ ID NO: 88232 - DNA, 114 bp, Mus musculus
ctgagttcctgtcttggtgttcataagggatgggccataagccaaacaaacttttttcttttaaatcccaatttgcttctggtcagtgttttagaacagtaggaaaggagagag

SEQ ID NO: 88233 - DNA, 70 bp, Mus musculus
gtttccacaatggttgagtgttctcagggcacagacttctgtctgcctccctgtcaccattccgtttgac

SEQ ID NO: 88234 - DNA, 97 bp, Mus musculus
gccaacctgtttgttattgtaacagtctctctcattttgttttctactgaaaagaaattcccaagatttagagttgtttgctgtcaggaaggctggc

SEQ ID NO: 88235 - DNA, 56 bp, Mus musculus
cacacacacacacacacacatgtgtgtctttgtgtgtgtctgtgtgtctctgtgtg

SEQ ID NO: 88236 - DNA, 82 bp, Mus musculus
cagacactattgcagatgccaacaagagcttgctgacaggagactgatatagctttctccagagtggctctgtcagtgcctg

SEQ ID NO: 88237 - DNA, 77 bp, Mus musculus
gattcagtgtatggttttatgtggagttccttgatccacttggatttgagctttgtacaggggtataagactgtatc

SEQ ID NO: 88238 - DNA, 122 bp, Mus musculus
tgcctctaaatgtttttacacatatgtacatatgtgtgtatgcatgtctatgcctatgtgtatatatgtatatatgtgtatatgtgtacgtatgtataatgtgtgagtgtacctgtgtttgg

SEQ ID NO: 88239 - DNA, 82 bp, Mus musculus
cagctggacaggtctccagacagaggagagtgaacaatgactcatactccaaggactggagcctatctgaaagtgaagactg

SEQ ID NO: 88240 - DNA, 112 bp, Mus musculus
atacatacacattaattacatattttttaaatcttatacatatgtgagagtatgtatgtatgtatttatgtatgtattgtatgtatgtatgtatatatgtatgtatatacat

SEQ ID NO: 88241 - DNA, 87 bp, Mus musculus
gtgtgtgtgtgtgtgtgtgtgtgtgtgtgtgtgatttctgctagaaatagagcaatcagcatcctttatgtgtgcacagaggatcac

SEQ ID NO: 88242 - DNA, 114 bp, Mus musculus
catgaggataagagcttctcatttctctttcgagttaccaagacctgtgaccctctctctatgagagataagcatcttctgggttgaaatcactggaaagctgtcattttcctg

SEQ ID NO: 88243 - DNA, 111 bp, Mus musculus
ctgaccttctcgtggtttcagttttctttggtttaaacatagaagcaataggacagaatgtggatgtggatgtggatgctgaccattgagactgagagtggtaaaggagag

SEQ ID NO: 88244 - DNA, 84 bp, Mus musculus
tgacagaatgctcttcttttggggggtatcatagtctcctgtcaatgatatttatgattttttccatagagatgcgtgccctca

SEQ ID NO: 88245 - DNA, 119 bp, Mus musculus
gctagtacttccagtactatattgaataggtagggagagagtgagcaatgttgtctagtccccgactttagtggaattcttcgaggttctctgcatttagtttggtgttggctacttgt

SEQ ID NO: 88246 - DNA, 114 bp, Mus musculus
ggaggcatagtgactgttccgtgtgtctgaagtcaggagtcagagagagagagagagattctggtgctttcctctgatgtctaagttatggaaaaatggcatagccaagccaac

SEQ ID NO: 88247 - DNA, 154 bp, Mus musculus
gtgtgtgtgtgtgtgtgtgtgtgtgtgtgtgtgcgcgtgcgtatgtatatatatatatatatatatatatatatatatatatatatatatatacatatatgtgtgtgtgtgtatatatacatatatatgtgtgtatatatatgtatgtatatac

SEQ ID NO: 88248 - DNA, 73 bp, Mus musculus
gtttagaaggagatcactgtcctgacagtacaaccatatttgttattgtcttagtcagggtttctattcctgc

SEQ ID NO: 88249 - DNA, 77 bp, Mus musculus
agtaaagcagacttgatgatgtgaatatttatgtttagtataagatattcaacattgttagggtctctagttttgct

SEQ ID NO: 88250 - DNA, 141 bp, Mus musculus
catgctaccaggaactcactagtgaacaggcttgccgtgatcgcgagtgttaccttttaacatctgtttttcatgttgtgatatttacttgagatttggtattatgaaaaaatgaggaaagtatctgttaccatgggtaac

SEQ ID NO: 88251 - DNA, 105 bp, Mus musculus
ttattgttgaagtgttacattttcttttttgtctgtcatgctggggattgaatcagacatgacattttgaagttcaaatattccacagtaagttgatacaaagaa

SEQ ID NO: 88252 - DNA, 85 bp, Mus musculus; identical to SEQ ID NO: 57439

SEQ ID NO: 88253 - DNA, 85 bp, Mus musculus; identical to SEQ ID NO: 57470

SEQ ID NO: 88254 - DNA, 83 bp, Mus musculus
gcttccattctagagtctgtcactgtctggcattaattttatcaatgattagtggatgtgtgctactttattagaatgtaagt

SEQ ID NO: 88255 - DNA, 93 bp, Mus musculus
gaaattttttcctagctctttactctgagggtagtgtctgtctaagtcactgagatgcatttcctataagtagcaaaatgctgggtccttttc

SEQ ID NO: 88256 - DNA, 82 bp, Mus musculus
cctgtgctcacaagtgtgtctgcactcctggaaggccagctctctcttggcagtatttgtgtatgaggcactgtggaacagg

SEQ ID NO: 88257 - DNA, 85 bp, Mus musculus; identical to SEQ ID NO: 57439

SEQ ID NO: 88258 - DNA, 85 bp, Mus musculus
tttgtatatcctttatctccttcacttgtcttattgttctagataagacgttaagtacaagaacgaatagatatggagagacaga

SEQ ID NO: 88259 - DNA, 72 bp, Mus musculus
ggcagggaaggtgcccggatgtctggaccccaaaatggggtctgtcccagaatctgtgtcactctgcctgtc

SEQ ID NO: 88260 - DNA, 83 bp, Mus musculus
catgggacaatttcaatatttttgtatctgttgaggcctgttttatgtccaattatatggtcaattttggagaaggtcccgtg

SEQ ID NO: 88261 - DNA, 85 bp, Mus musculus; identical to SEQ ID NO: 57470

SEQ ID NO: 88262 - DNA, 73 bp, Mus musculus
cccgaagggagaaagtagaatgcagaaccacaagggagtgagtgtgtctctgactctttttcctgttcttggg

SEQ ID NO: 88263 - DNA, 113 bp, Mus musculus
tacataattaaaaattaaaatagtagaaagactgttggagagacatagtttatttttgattactaggctttaaagggtcttttaaactgacagtttatcctatcttaaatgtg

SEQ ID NO: 88264 - DNA, 58 bp, Mus musculus
agcctgcctgcgtgcctccctggctggctgggaaggaaggagggagggcgggctggct

SEQ ID NO: 88265 - DNA, 78 bp, Mus musculus
tgctacccactgctcagccaaagaatttatttttaattcacaactgtgaaaaattgtcttcaatgtcagtgaggagca

SEQ ID NO: 88266 - DNA, 92 bp, Mus musculus
ctgagctcgtccctgtgggtctatgtctgtctgagtcagcccttccagcatggttctaagaagaaggctgccaacagctactgtttcctcag

SEQ ID NO: 88267 - DNA, 85 bp, Mus musculus; identical to SEQ ID NO: 57439

SEQ ID NO: 88268 - DNA, 114 bp, Mus musculus
ctttgtggattgatggtttgttttccagggactcacagttaagagcttacctagaatctaagaagagactgtggactttgcactttgagatttattagaactattaacacttgg

SEQ ID NO: 88269 - DNA, 97 bp, Mus musculus
tttgtttttgtttttgttttttttttttttatgtgtctctcagtgtgtgcatgtatgcatgtatgcatgaaaacatgtgtgcaaatatacatccaaa

SEQ ID NO: 88270 - DNA, 102 bp, Mus musculus
gaactagtgatgcagcaacctcactgatttttctacaatgtggtcacaagacattgttcagagaaaatacagtggtcaagagcataaagaaaatatgggttc

SEQ ID NO: 88271 - DNA, 85 bp, Mus musculus; identical to SEQ ID NO: 57439

SEQ ID NO: 88272 - DNA, 176 bp, Mus musculus
cacactgtgtatagagatgcgcacagacatgtagatcacatatatatgtgtatatatatatatacacgggtgggacacacacacacacacacacacaaatatgtatatgtatatatgtgtgtacatgtgtatgtgtgtcacacacatgtatatatatataaatacacatatatatg

SEQ ID NO: 88273 - DNA, 92 bp, Mus musculus
gtccacatgtgatcctgtctgcctcagtgtgtgagatagggctcataacttgtttatcacaaatagaatatgtcaggtgtcatggaaaggat

SEQ ID NO: 88274 - DNA, 85 bp, Mus musculus; identical to SEQ ID NO: 57470

SEQ ID NO: 88275 - DNA, 135 bp, Mus musculus
tggtgtatgcatatatatgtatgtatgtatatgtatatatacacacacatatatacacatacatacatatgtatacacacacacacacacacacacatataggcatgagtgggagtgaaccatggtgtatgcata

SEQ ID NO: 88276 - DNA, 158 bp, Mus musculus
catatgaagcatctctccatgggaagtgtgtctctgtgtgatacatgcctccatatgaagcatctctccatgggaagtgtgtgtctctgtgtgatacatgcctccatatgaagcatctctccatgggaagtgtgtgtctctgtgtgatacatgcctcc

SEQ ID NO: 88277 - DNA, 92 bp, Mus musculus
gacatgcccacaggccactgatggaggcagctcctcacttgaggttttctctttctaggtgactcctgtttgtgtctagttgactgtaagca

SEQ ID NO: 88278 - DNA, 85 bp, Mus musculus; identical to SEQ ID NO: 57439

SEQ ID NO: 88279 - DNA, 76 bp, Mus musculus
gtggactgtgtgagtctctgtctgttcctggctggagcctcctgctttagcttcagatgtctcctctcacccccat

SEQ ID NO: 88280 - DNA, 101 bp, Mus musculus
gtaacagtagatataatggctcccttaatgtatatgtatttgaatttgaacccggaccgcattgtgtgtctcctaaggaagctagggaattttacgtttac

SEQ ID NO: 88281 - DNA, 112 bp, Mus musculus
gtcagagaactatgggtgccttagatgaccacctatacaatggaagactactgtaataactgagaattacaggctgctctttgtgttctggaagggggtaacatgcacagac

SEQ ID NO: 88282 - DNA, 88 bp, Mus musculus
gccacccctctctgatcatctgtgtgtatttggcacccccttgaggtgactgagagcagacactactcagagaagtgagcaagtgggg

SEQ ID NO: 88283 - DNA, 90 bp, Mus musculus
gactgcacagtagtaggtggcttcatcttctttcttcaagtaatttattttcaaggttgaggtagaagtttgaaaatctttacttgcttc

SEQ ID NO: 88284 - DNA, 90 bp, Mus musculus; identical to SEQ ID NO: 88283

SEQ ID NO: 88285 - DNA, 78 bp, Mus musculus
ggatgtctcgcagagaagcgtgtgagctctggctccccgtcagagtgttctccatgtgttctggaagatggttcatcc

SEQ ID NO: 88286 - DNA, 76 bp, Mus musculus
tggggcctgaggggaggaatttgatggagacatcccatttagggatatgttccagggtctctcactctctgtgcca

SEQ ID NO: 88287 - DNA, 67 bp, Mus musculus
caggcagaaagttctcagactacccagcacccgtctctgtgtctctgtgtctgtctgtctctgtctg

SEQ ID NO: 88288 - DNA, 95 bp, Mus musculus
acatatatatgtaactatatatatatgtaactatatatatgtgtaaatatatatatatatatatatatatatatatatatatatatatatatgta

SEQ ID NO: 88289 - DNA, 95 bp, Mus musculus
gccttagtccatggtgatctgataggatacatgggacaatttcaatatttttgtattctgtaatgcaaaagacaccatcaataagacaaaaaggc

SEQ ID NO: 88290 - DNA, 81 bp, Mus musculus
gtgttgtacttagagccacatgtcagaagagagagagtgaaccgactctaagttgtcctctggcctccacacaggcaacac

SEQ ID NO: 88291 - DNA, 124 bp, Mus musculus
acaaacacacacacacacacacacacacacacacacacacacacacacatatagaagaggggtgtatgtatgtctatattgtgtgtgtctctgtgtatgtatgtctctagtgtgtgtgtgtgtg

SEQ ID NO: 88292 - DNA, 93 bp, Mus musculus
ctgatatacttgagcctgatttgtttacaatggttttcaacctgtaggttgcaacccctttgtgggtcacatatcagctatcctacatatcag

SEQ ID NO: 88293 - DNA, 83 bp, Mus musculus
ttggtgtatgcatgcacatgtgtatttgtgtgtatatgcatgcatgggcatgtgtgcatatgcatgtgtatgtttaaaactag

SEQ ID NO: 88294 - DNA, 85 bp, Mus musculus; identical to SEQ ID NO: 58391

SEQ ID NO: 88295 - DNA, 114 bp, Mus musculus
gggaaattagtgtgaagttttctatctttgttggatctttctgtggtttagatatcagagtaattgtggcttcatagaatgagttgggtagagtaccttctacttctattttgt

SEQ ID NO: 88296 - DNA, 85 bp, Mus musculus; identical to SEQ ID NO: 57439

SEQ ID NO: 88297 - DNA, 118 bp, Mus musculus
ttgtttaatgttatgggcagctactaatttgtggtgtctctgtatatttttgtaaagattctcattttttatgcttgaagtatttggtgaaaagatgttggttgaccataatttgcaa

SEQ ID NO: 88298 - DNA, 116 bp, Mus musculus
agggctagggggagcacagggtggagaagagtaaggctgttgggaatttatatttagttttaacacaatctcttgttttgttaatctcctgctttttgatgtctttctttaatcct

SEQ ID NO: 88299 - DNA, 93 bp, Mus musculus
gcagccaggctttgttagaagagagtgtggagtaggatggaggtagacatggggcctgatccctgcaacactgaggaagccactttgtgctgc

SEQ ID NO: 88300 - DNA, 81 bp, Mus musculus
gcagttctgagtgacttaggacggagaaaaaggagcctggagcctgcctagttttgtccttcagtctctctgattctgtcc

SEQ ID NO: 88301 - DNA, 80 bp, Mus musculus
tcttgccctgacgggcacagctgtgctctgcctccccaaacacaaggaaggcagtgagcagacactgcctgtcagcaaga

SEQ ID NO: 88302 - DNA, 66 bp, Mus musculus
gtatgtatgcatgtatgtatgtatgtatgtatgcatgtatgtatgtatgtatatctgtctgcatgc

SEQ ID NO: 88303 - DNA, 99 bp, Mus musculus
aagcctttacagtgctcatgtgttaagactgcattgagccgttattctaacgctgtgttctgtctccctcttacattgtgatttattgtatttaggctt

SEQ ID NO: 88304 - DNA, 116 bp, Mus musculus
actctctgtgtctttgatggctcttatcatcattacttttttaaaactttatacatttacttataaaggaagtactgttcaataagcaggtcaaccagaagatggaaagaaagagt

SEQ ID NO: 88305 - DNA, 67 bp, Mus musculus
atctgatactctgtcactgtgtttttaggtcccaagccagaaagctctttgtgacagggataaagat

SEQ ID NO: 88306 - DNA, 74 bp, Mus musculus
gagagaagtgtgtgagaagaggaactgagggccaaggcttggccagtgccttctctgttcttacatgttatctt

SEQ ID NO: 88307 - DNA, 85 bp, Mus musculus
ggccatggtggtctgatagaatacgtgggacaatttcaatatttttgtatctgttgaggcctgttttgtgaccaattatatggtc

SEQ ID NO: 88308 - DNA, 118 bp, Mus musculus
gggcattatgccagcaagataagatatttgtataacatatatgtatgtatgtatgtatgtatgtatgtatatgtataaatgaagtgcatttactgttgttgtttttaaaatggggcct

SEQ ID NO: 88309 - DNA, 84 bp, Mus musculus
aggcatgtaatatgtttgacatgtagctgactgcttagaggctgtgagaagtgtcagaagacaaagtacaaatatataaggcct

SEQ ID NO: 88310 - DNA, 85 bp, Mus musculus; identical to SEQ ID NO: 57439

SEQ ID NO: 88311 - DNA, 85 bp, Mus musculus; identical to SEQ ID NO: 57439

SEQ ID NO: 88312 - DNA, 119 bp, Mus musculus
gatttggttttgatattatagtgggttacagttaagagattgccttgagtctcagaagagactctggacttttaaacaatgttgtgactgtgaaggactatggggacttttgaagttgg

SEQ ID NO: 88313 - DNA, 85 bp, Mus musculus; identical to SEQ ID NO: 57439

SEQ ID NO: 88314 - DNA, 100 bp, Mus musculus
tctacagtcttgaatgacattagtctgtgtcttattctgtctgtgttgagtgtaatagtcacaaacacttgtacagactcgttatttttatattctgagg

SEQ ID NO: 88315 - DNA, 101 bp, Mus musculus
agtgtgtgtgtgtgtgtagagtgggattgacgatgaatttgatacattgaatacatgtatgaaattggaaaaaatgctattctattaaacaagacaatgct

SEQ ID NO: 88316 - DNA, 81 bp, Mus musculus
tttagaatgttcaggaagtgacagtgacttgggatggcacccatccctcaagaggctctgtggctctcagtgagatttgaa

SEQ ID NO: 88317 - DNA, 71 bp, Mus musculus
gggcactagagatctgggctcagactctcacacttagatggtaagcgagaaatgagccattcacttagccc

SEQ ID NO: 88318 - DNA, 98 bp, Mus musculus
gatggagacatcccgtttagagttatgcatgtgtgtgttccgaggtctctcactctctgtgtaatgtctggctgtgggtctaagtatttgtttccatc

SEQ ID NO: 88319 - DNA, 68 bp, Mus musculus
tcagagctgttgtcagggtttggtcagtgtggttattgctcactgactcaagagactcagctatatga

SEQ ID NO: 88320 - DNA, 117 bp, Mus musculus
tatgtatgtatgtatgtatgtatgtatgtatgtatgtattatgtatgtatatacatatgtatgtatatgtgtgtgcatgtgtatatatatgtacacacacacacacacacacacaca

SEQ ID NO: 88321 - DNA, 78 bp, Mus musculus
gaagcgcactcctgactgcatccctgtctcctctcaagagtcactgaagagtctgagatttcgtgttctgtgggtttc

SEQ ID NO: 88322 - DNA, 93 bp, Mus musculus
gggaacgctcttgcttctaattgtgtctgctaatgatatgatgaatgtagggaaatgtccgtagacatgcgttaaagtctggagagcttgctc

SEQ ID NO: 88323 - DNA, 117 bp, Mus musculus
ttttgaactacctctgaatctgttggtattgggcaaatcatttaaactgaatttatttttaactgaattaattttagttgttgagtaagaacatgttctaaatatgggctggcaaga

SEQ ID NO: 88324 - DNA, 80 bp, Mus musculus
atatgcatatataattagtatgtatatataatgtatatatagtatacgtatatagtatatatattagtgtgtatgtatat

SEQ ID NO: 88325 - DNA, 105 bp, Mus musculus
aaagatttattaatttttccaattaaataggtattagatatattttctaatgaaactatatatttaaaagtatttcttggtagttggatgtggttgcgtgtcttt

SEQ ID NO: 88326 - DNA, 91 bp, Mus musculus
gcatccttatgttttgcatagttgagaagtcctgtttatatatttttgaacttgagttttcagagttctttccaaaagccttaagggctgt

SEQ ID NO: 88327 - DNA, 102 bp, Mus musculus
gaaataaatatgtggaagaatactattaaccatgagactatgttttctttttttaaaagaatatatcttaccatggcatgtgtttctcttccttgtttgttc

SEQ ID NO: 88328 - DNA, 75 bp, Mus musculus
gtggtggtggtggtggtggtggtagggtttggggggtgttcccctcgtactctctctccctctttctcctctcat

SEQ ID NO: 88329 - DNA, 87 bp, Mus musculus
agaccagccaagacaatgtaaggccctgtgtatgtatgtatacatgtgtgtgtatgtatatatgtatgtctgtgtgtctgtctgtct

SEQ ID NO: 88330 - DNA, 89 bp, Mus musculus
aggacttgctctgaaagtatgcaagttgatgcattaagaaaggtttgttttgatctgtattgattttcatgttgcttttgaggcgttct

SEQ ID NO: 88331 - DNA, 92 bp, Mus musculus
agtctgttgaggaaggcaggcaattcactgagacaagacgctctcctctgcgtctctgtgtctctgtcatgaacctttgtttcaatatgatt

SEQ ID NO: 88332 - DNA, 66 bp, Mus musculus
catgtatatatgtgtatgtatttgtatctatgtgaatatatatgtatacatatatatttatatatg

SEQ ID NO: 88333 - DNA, 85 bp, Mus musculus; identical to SEQ ID NO: 74034

SEQ ID NO: 88334 - DNA, 85 bp, Mus musculus; identical to SEQ ID NO: 57526

SEQ ID NO: 88335 - DNA, 106 bp, Mus musculus
gccttagtgcatggtgatctgataggaagcatgggacaatttcaatatttttgtatatgttgaggcttgttttgtgaccaattatgtggtcaattttggagaaggt

SEQ ID NO: 88336 - DNA, 85 bp, Mus musculus; identical to SEQ ID NO: 57439

SEQ ID NO: 88337 - DNA, 85 bp, Mus musculus; identical to SEQ ID NO: 57470

SEQ ID NO: 88338 - DNA, 85 bp, Mus musculus; identical to SEQ ID NO: 57439

SEQ ID NO: 88339 - DNA, 78 bp, Mus musculus
ttggtccatggtgatcagataggatgcatgggataatttcaatatttttgtatctgttgaggcctgttttgtgaccaa

SEQ ID NO: 88340 - DNA, 68 bp, Mus musculus
tcagacagaggacactctggtcagctctcagctcatggggagttctgtagagaaccttggagttctga

SEQ ID NO: 88341 - DNA, 85 bp, Mus musculus; identical to SEQ ID NO: 57470

SEQ ID NO: 88342 - DNA, 81 bp, Mus musculus
gcatgtatatatgtatttgtatgtatgaggttattggagtctgccttttgcttcatccacttgggatgtgtgtgtgtgtgt

SEQ ID NO: 88343 - DNA, 81 bp, Mus musculus
tgtgtgtgtgtgtgtgtaacatagtagcaactagcatactccagcattttgcacatatatatgtatatacatatatgcaca

SEQ ID NO: 88344 - DNA, 103 bp, Mus musculus
gtggcttggagggagaggaaacagttttcagcatgtaatgtgtacttatttttatattactgactcagtgtagtgtttcaaatcaatcccttatagttttcac

SEQ ID NO: 88345 - DNA, 117 bp, Mus musculus
ctattaaagatcagccttagtccatggtggtctgataggatgcatatcacaatttcaatatttttgtatctgttcaggcctgtttcatgacaaatgatatggtcaattttggagtag

SEQ ID NO: 88346 - DNA, 76 bp, Mus musculus
ggacacacacacactgtcccagagtctccctggaacgggagtgtcagggatctcatctgcaacattgcatgtgtcc

SEQ ID NO: 88347 - DNA, 83 bp, Mus musculus
tgtagaaggtaaggttaccagacctgagagatgctgcaggtgcacagggtttctcagtgtctgtgtgtgatgtggggaaggca

SEQ ID NO: 88348 - DNA, 113 bp, Mus musculus
gggctggactgagggaggagaatggagacaggaaaagtggctggaatggtaggatctttgagaggctcagtctctgtcttagagtttaactgctgtgaacagacaccatgacc

SEQ ID NO: 88349 - DNA, 108 bp, Mus musculus
acctttgaacgcgggactcaggatggaagtgcttcatggttgtctcacggaaaaccagactctgtctggtaaccatgttagctgtccatcgtgttacatacaagaggt

SEQ ID NO: 88350 - DNA, 88 bp, Mus musculus
tatatacatatacatgaaaatatgtgtatatacatatatgtacataaatatatgtttatattcacatatacttgtgggtttgtgtatg

SEQ ID NO: 88351 - DNA, 91 bp, Mus musculus
catgatctgtgaatgagtctgtgttgagtctcattcagagtcaccctggagagatgtgttacatgcggctgtgggtcacaggttgaacatg

SEQ ID NO: 88352 - DNA, 83 bp, Mus musculus
gcacaaaatggttagaagtatgtcaaagatgctgtggaattagaatcacaggcagttttgaacagactgataagggtgttggc

SEQ ID NO: 88353 - DNA, 114 bp, Mus musculus
ttggcactaacacatgggaatcagaggcacaaagatggctgcaagtccaagaccaactggtctgcacagtgacttccaggtcaaccagggctactgagaaagatcctttgtcaa

SEQ ID NO: 88354 - DNA, 74 bp, Mus musculus
gggacaatgaatcacagtgagctctcagcttggcttgtaaattagcactgattacagctcagatgacggtgccc

SEQ ID NO: 88355 - DNA, 77 bp, Mus musculus
tggagaaaacaccttaagaaagtgaacagagaaagctaagagcacagttctcaggcagtttctgtgtgttaggtcca

SEQ ID NO: 88356 - DNA, 107 bp, Mus musculus
ttcagcactccaagagttagacatgtaaagaatcattccaagaaaagagaattgattttctagttttcattcagtgcttctttgggtttcaatttattggatttgga

SEQ ID NO: 88357 - DNA, 77 bp, Mus musculus
agagcacagagccttctgtctgacacagtgagagaaatggtcagtcttgctggttttggatggttttgttttgtttt

SEQ ID NO: 88358 - DNA, 71 bp, Mus musculus
tcaaaggcaaagaatattctgagctgagtccacaggaccctttccggggctctctcagactcagtacttga

SEQ ID NO: 88359 - DNA, 85 bp, Mus musculus
tcaattttacttgtgtatatatatgtgtgttagtgtgtgtgtgtgtgtgtgtttgtatatatgtgtggtatacatgagagataga

SEQ ID NO: 88360 - DNA, 82 bp, Mus musculus
agaatatacaaaccatgacaggaggtttagtataacattatctcccttgattgctatccaccttctgtctgtctgtctgtct

SEQ ID NO: 88361 - DNA, 107 bp, Mus musculus
ggaaacctgtataagcagactcaaaaacctgtatgaacccactgagcacagtacactggccaacagtgagtcaggaacttgcaggagggagtctgcacacatggtcc

SEQ ID NO: 88362 - DNA, 107 bp, Mus musculus
catggagttactgtacaaactaagaagtagcctctgctctgtgtgtctctctttatgagaccagaacgagcactaattcttcctcagatgtttggaagttttctatg

SEQ ID NO: 88363 - DNA, 80 bp, Mus musculus
tggttcagtgggtagagaaagtgtttttgccagggtactagattgtttttctttattgtacatttgtccactgtgtgcca

SEQ ID NO: 88364 - DNA, 61 bp, Mus musculus
taaatcatatatatgcatctgtacatatatataaatatgtacatatacatatgtgtgttta

SEQ ID NO: 88365 - DNA, 84 bp, Mus musculus
tgtgtcgggttgcaaatattagtattataagggtgagctctcagttccattttatgtacttctttatgaaggacccttgatgca

SEQ ID NO: 88366 - DNA, 83 bp, Mus musculus
gtggacaatgagtgaccattaaagagattacagagagctcaagataatcttggctctgaatttgtaacattcctactctccac

SEQ ID NO: 88367 - DNA, 78 bp, Mus musculus
gtctgtcaatctgtctgtctgtgtctgtatgtgcacttgagtgcaggtgcctttggaggccagaagagggcattagat

SEQ ID NO: 88368 - DNA, 109 bp, Mus musculus
gcacgtgccaagactgactgccctggggaaagatgatacttattttttaaaaaatgagtgaatttgttccaaacacctgctagtctcttcagtcttaggcactagaggc

SEQ ID NO: 88369 - DNA, 64 bp, Mus musculus
gtgtatatgtgtatatatatatgcatatacctttgtgtgtgtgtatacatgtacacatgtacac

SEQ ID NO: 88370 - DNA, 110 bp, Mus musculus
accagtttccttatgtgtaaaggaatgctaataactgtcactcccaattcacaggctgctatgaggcctaaggacttgggaacatgcaggctatactcatgagctatggt

SEQ ID NO: 88371 - DNA, 105 bp, Mus musculus
gagatagagacagacagaggaggcagagtggtttggaacatgctgtgatcttcctgtctcagcctctcaagcactcggatgcctgccttgcccggttgttgtctt

SEQ ID NO: 88372 - DNA, 106 bp, Mus musculus
agacaggttttatgtgagtgggcagattgacacagagctatgaccgccattgaaagtgcctatgtagatttattttgtatctgagtgcttgccttcatgtatgtct

SEQ ID NO: 88373 - DNA, 66 bp, Mus musculus
tatgccagaaatcacactgaacttacaaagaaggactggtctttgaaggtaggtgtttctggggtg

SEQ ID NO: 88374 - DNA, 87 bp, Mus musculus
gctgcctgtgggtcaggatgcagagctttcagccattcctccagcaccacaccgtgcctgcctgcctgcctgcctgcccgctgctgc

SEQ ID NO: 88375 - DNA, 86 bp, Mus musculus
tttttgctattatttattcatgtgtatgtatgtatgtatgtatgtatgtatgtatgtatgtatgtgagtgcaaatgccagtggaaa

SEQ ID NO: 88376 - DNA, 107 bp, Mus musculus
gtgaaacatgtttaactggggctggagagatggctcagtggttaagagcactgactgctcttccagaggtcctgagttcaattcccagcaaccacgtggtggctcac

SEQ ID NO: 88377 - DNA, 99 bp, Mus musculus
gcagaaggccagctgggcattgggaagctctgtgtctcccacactgtgcggcagcttcacagtgcactcagggcctcggtgtacggacacggatttctc

SEQ ID NO: 88378 - DNA, 102 bp, Mus musculus
aaagctccattcttgtgaagaaaatgatgggccatgaactctctgtgtaaatctcacagacagctttagagtccaacagtgcagtcagaacaagcaagtttt

SEQ ID NO: 88379 - DNA, 85 bp, Mus musculus; identical to SEQ ID NO: 63114

SEQ ID NO: 88380 - DNA, 85 bp, Mus musculus; identical to SEQ ID NO: 57439

SEQ ID NO: 88381 - DNA, 85 bp, Mus musculus
gagtgagtcctcataagacagtgactctgtggaaaccatgaatccgagcttcacagtttcttgtactgtgtggaatagtttgctc

SEQ ID NO: 88382 - DNA, 85 bp, Mus musculus; identical to SEQ ID NO: 57470

SEQ ID NO: 88383 - DNA, 93 bp, Mus musculus
attcttgaacattttaaggtagaatgttctttagttgggatttcttgatatgtcattatcattagattcagagcatatgcttttcttaagaat

SEQ ID NO: 88384 - DNA, 69 bp, Mus musculus
cctggagataggccagtggagaagaacagtgctggctgtctctctctccgtcttgtgtgttggctcagg

SEQ ID NO: 88385 - DNA, 97 bp, Mus musculus
tatgcttgtatgtatgtatgtatatatgatgtatatatgtatgtatgtatatatgtatgtatgtatgatgtatgtatgtatgtatatatgatgtata

SEQ ID NO: 88386 - DNA, 65 bp, Mus musculus
gatgtatatatgtatgtatgtatatatgatgtatatatttatgtatgtatgtatgtatgtgggtc

SEQ ID NO: 88387 - DNA, 74 bp, Mus musculus
gctctctcactgcctctgttgctgtgagctagagacgctctaggattgcacctcagaggccagtgcccggaagt

SEQ ID NO: 88388 - DNA, 115 bp, Mus musculus
tgttgccatcagatcatttggagcagatgtgcagccagctgtgtttctctctctatggagcagatgtgcagcctgctgtgcttctctttcctgggcccctaatgctgtggtaagg

SEQ ID NO: 88389 - DNA, 112 bp, Mus musculus
tctgccttcacagcctctgtcatcacaggactggaaagggcactgtctctgtttctctcagaaagtgcttctagtgttgcccagcagatgtcaagagtatgttccaggcaga

SEQ ID NO: 88390 - DNA, 80 bp, Mus musculus
ttctactacaagttgtaggtcttgcacatgagatcacagtctctctgagtttatgtgtatcagtcctattgtgtctggaa

SEQ ID NO: 88391 - DNA, 77 bp, Mus musculus
gaggaaggtgagcactgtatacttatctacatgctagatttcaccctggcttgtctgtgtctgtgactctattcttc

SEQ ID NO: 88392 - DNA, 120 bp, Mus musculus
tagagaaggtttgtgggatgtggtattgcccaagggagtaagtcactagagggtgagctcaagagctgaatgcctcatggtccttcaggtttacttagtaggtttcatgattatgatctg

SEQ ID NO: 88393 - DNA, 89 bp, Mus musculus
gctgcataagggtggttaacttggggtctgattgctctattagaggcacctctatgagactctctcagtggtatggctacctgtgtagt

SEQ ID NO: 88394 - DNA, 60 bp, Mus musculus
tatgtatgcatgcatgcatacatgtatatatgtatgtatgtatgcatgtatgtatgtata

SEQ ID NO: 88395 - DNA, 82 bp, Mus musculus
tttgttgactgctgttatttgagttccccagatgtcttctgatttaacagaatcatctgctctctcagactgtcactgcaaa

SEQ ID NO: 88396 - DNA, 98 bp, Mus musculus
tatatgaacgtatatgtatgtgtgtagatgtgcatatctttgcatgtgtgtttaaatatatgtgctgaggtgtttaggtgtgcatgtatgtgaatgta

SEQ ID NO: 88397 - DNA, 69 bp, Mus musculus
gcctctgtgtctctgtgtgtgtgcacatgtacatatgtgtatatacaagaatgcagtgtcctcagaggc

SEQ ID NO: 88398 - DNA, 83 bp, Mus musculus
tataacatataacacaacatataacatatacatatacatatatcagtgtgtgtgtgtgcatgtgcttgtgcatgtgtgtaata

SEQ ID NO: 88399 - DNA, 78 bp, Mus musculus
tatatatatatatatgtagtctatgtatgcatatgtgaatatatgtaagcatatatacataatatatgtatgtatata

SEQ ID NO: 88400 - DNA, 123 bp, Mus musculus
gtatatatgtatttgtgaatgtatatgaatttatatgcatgtgcatttgtacagatttgtgtttatatttatatatttatgaatatatatgtatttgtgtgtatgcatatctgtttgtgctac

SEQ ID NO: 88401 - DNA, 85 bp, Mus musculus; identical to SEQ ID NO: 57439

SEQ ID NO: 88402 - DNA, 102 bp, Mus musculus
tcttttttgtgtaggtattttgcctgcatatgtatacatatacattaaagaatatgtatatatgtatatcacatgcatgcagtaccaaaaaacaatgagaga

SEQ ID NO: 88403 - DNA, 85 bp, Mus musculus; identical to SEQ ID NO: 57470

SEQ ID NO: 88404 - DNA, 124 bp, Mus musculus
gcaatgaaaagaaattcctcaaaggcatatgctggctcagctgatcagggcaagttgtcagttgaaagtctgccttccccagtgcttttatttttgtttgcaactttaccagtcaagctatggc

SEQ ID NO: 88405 - DNA, 117 bp, Mus musculus
attaacattgggtctacatatgcctggccagagaaagagttgtactttcattatgactgtgggacttctttgctcctgagaaattgtttatgcattaatctactacccagtattaat

SEQ ID NO: 88406 - DNA, 82 bp, Mus musculus
caactgttgtacaaattgctgctaacactttagacacagactgagtctctgtgtctgggatttcagtatgtctcttcagttg

SEQ ID NO: 88407 - DNA, 80 bp, Mus musculus
tccttggtgagtatgctttctgcttgttgaaaggttctccgaatgcacctgagacaggctgtaatattggtattagagga

SEQ ID NO: 88408 - DNA, 68 bp, Mus musculus
acaatgtgctgagtgctcacacactatgctgagtgatcacagagtgtgcagagtaactcacacagtgt

SEQ ID NO: 88409 - DNA, 112 bp, Mus musculus
gcacactgtgtgagcactcaccacattgtgtgagtacttactgaactgtgtgagcactcagcacactgcatgagcactcagcacactgtatgagaactcagcacactgtgtg

SEQ ID NO: 88410 - DNA, 105 bp, Mus musculus
tcacaaattcatagctgacatcacaagtattttgttacaatatttataatggtttcaaagtgagggaattgtgactactcttaaggcagtcttaggggtttgtga

SEQ ID NO: 88411 - DNA, 85 bp, Mus musculus; identical to SEQ ID NO: 57439

SEQ ID NO: 88412 - DNA, 118 bp, Mus musculus
tattcgtgccatgttaaatggtggacttatctcggaggtagaccattattgtaatccatatggttcactagctggttgagactgatgattcctttctgctctgataatatgcatagta

SEQ ID NO: 88413 - DNA, 85 bp, Mus musculus; identical to SEQ ID NO: 57439

SEQ ID NO: 88414 - DNA, 70 bp, Mus musculus
atgtatatacatatgtatgtatgtatgtatgtacgtatgtatgtatgtatgtatgtatgtatgtatgtat

SEQ ID NO: 88415 - DNA, 85 bp, Mus musculus; identical to SEQ ID NO: 63243

SEQ ID NO: 88416 - DNA, 115 bp, Mus musculus
tatatgtatatacatacatatgtatgtatgtttgtacacctgtgtgtaggagagagagacagagacagagaaggagcacagggacaggtacatatgttttttaaggtacattata

SEQ ID NO: 88417 - DNA, 62 bp, Mus musculus
atgtatatgtatatgtatatatgtatatgtatatatgtatatgtgtatatgtatatgtatat

SEQ ID NO: 88418 - DNA, 85 bp, Mus musculus; identical to SEQ ID NO: 57439

SEQ ID NO: 88419 - DNA, 85 bp, Mus musculus; identical to SEQ ID NO: 57439

SEQ ID NO: 88420 - DNA, 93 bp, Mus musculus
aaagaatgaagctcttatgattgtatatattttcaaatgttttaaatatttggggcatgtatttcctagtacatgaaactgcctttattcttt

SEQ ID NO: 88421 - DNA, 100 bp, Mus musculus
aacatatgtattcaagcattttttgatgtacattggaaagataattatttcattttctttgaatgtcagtcaaattcttctgatttgaggtacttgtgtt

SEQ ID NO: 88422 - DNA, 78 bp, Mus musculus
gcttcagtagaaataaacaagcctgcctgagtgaagactcacttggatctgttcagcttgttccttgttttctagagc

SEQ ID NO: 88423 - DNA, 96 bp, Mus musculus
tcagagtgaactgtcatgcaaagaaaagcagaaagcatttatggaggccacccctagtaagtcatagtaattttctttgacatggggttctgttga

SEQ ID NO: 88424 - DNA, 67 bp, Mus musculus
ggtgattatatgtatatgtatacgtatacgtatatgtatatgtatatgtgaacaaatatgatagacc

SEQ ID NO: 88425 - DNA, 91 bp, Mus musculus
gggaccatttgcttgttttacaaccctttactctgagacagtgtctctgacagtgaagtgtgtttcctgtatgcagcaaaatgctgggcct

SEQ ID NO: 88426 - DNA, 83 bp, Mus musculus
tttatggttggtctgtacttctgggattatagaaagggtcattctctgtctctcagagtcgtacatttatgtaccaccatgaa

SEQ ID NO: 88427 - DNA, 71 bp, Mus musculus
atgccaatctgggaccaactggagtctgaaccctagaatgcagagtagtctccagattgaaaaccaagcat

SEQ ID NO: 88428 - DNA, 71 bp, Mus musculus
tgtggagtctgttctctatttgatttttacctaggtttggggaatcaaactcaagtcatcagactaccaca

SEQ ID NO: 88429 - DNA, 85 bp, Mus musculus; identical to SEQ ID NO: 57439

SEQ ID NO: 88430 - DNA, 94 bp, Mus musculus
cacaccatcgtaactgccatttgtgggcacagtgccagggcattgccatgatcctgtgtgcctgcctcactcacgcacctgcttcaacggtgtg

SEQ ID NO: 88431 - DNA, 68 bp, Mus musculus
gtatgtattatagtatatacatattctagtatactacataatatgtatatattatatcatgtatatat

SEQ ID NO: 88432 - DNA, 105 bp, Mus musculus
agattaattcatatatatgggaatgtttgtctgcatgtccatctgtacatcggaagatggcatcagacagttgcaagctgccatgtgggtgctgggaattgaact

SEQ ID NO: 88433 - DNA, 56 bp, Mus musculus
agcactcaacagaaaagtggccttgtcgagtggctgtcactctctgcttgtgtgtt

SEQ ID NO: 88434 - DNA, 82 bp, Mus musculus
ctgcctgtctgcctgtctgtctacctgtctaccctgtgtcatctcttgagtttgtgggcatggagcgagcgtcaacagggag

SEQ ID NO: 88435 - DNA, 84 bp, Mus musculus
ggctttaataacaatgcactgtacaactgaaattgctaagagaagccagtgagctcagcgggtaacagtgcttgctactgaacc

SEQ ID NO: 88436 - DNA, 194 bp, Mus musculus
gtatcatatatatacatatatatatgtatatgtatgtgtatatacatgtatatacgtgtatatatatatacacatgtatatatgtatatatgtgtatatatgtatatatacacatacatatacatatatatatacatatatatatacatatatatatatatatatatatatatatatacacacatacatataca

SEQ ID NO: 88437 - DNA, 198 bp, Mus musculus
tatatatatgtgtgtgtatgtgtgtatatgtatgtgtgtatatatatatatatatatatatatatatatgtatatatatatgtatatatatatgtatatgtatgtgtatatatacatatatacacatatatacatatatacatgtgtatatatatatacacgtatatacatgtatatacacatacatatacatatata

SEQ ID NO: 88438 - DNA, 84 bp, Mus musculus
tgtgtgtgtgtgtgtgtatgcacgcatgtgtatgtatatgtgtgtgtctcacacacacatacacatgtgtgcatacacactcac

SEQ ID NO: 88439 - DNA, 62 bp, Mus musculus
ctgggttgagaggccagcaagctgagcccatgggatctgtctgtctgtctctccagcactag

SEQ ID NO: 88440 - DNA, 110 bp, Mus musculus
gtgttgaagaactttgagattccaagtgctcaagccaggcccagtgtctctctctctcttttagccgcctgcagatctggacatagaactctcagctacctcttcagcac

SEQ ID NO: 88441 - DNA, 75 bp, Mus musculus
aggcaggcagatctttttgagtttgaggacatacagggatatgtagaaagatcctctctctctgtctgtctgtct

SEQ ID NO: 88442 - DNA, 83 bp, Mus musculus
tggatcagatgtaagctcttggtagcagtttcagcatgatgcctacctgcctgcctgcctgcctgtcaccatgctttctgcca

SEQ ID NO: 88443 - DNA, 108 bp, Mus musculus
tctgtgtgtgtgtgtgtgtgtgtaaaatctaagttgtatctatatatctatctataggtagatagatgctttaagatcccctatgacaaactatggtattatcatgga

SEQ ID NO: 88444 - DNA, 63 bp, Mus musculus
ctccacatagtggctgggtgaatttttctttttaaaaagaaagttctatgctcatttgtgggg

SEQ ID NO: 88445 - DNA, 101 bp, Mus musculus
gggtgagtgtagttgtcacctatcagctgtgagagcaggggatactgtgggactcagtgtctctgagcctccaggttgaagtggtgttgagcacgaaactt

SEQ ID NO: 88446 - DNA, 86 bp, Mus musculus
ctcaagcccagaaaaacagaactgactctggacacatgatgaggttaaaggcacattgtgtgaacttcagacagtgggcaaatgag

SEQ ID NO: 88447 - DNA, 72 bp, Mus musculus
tatatatgtatgtatatatgtatgtatgtattatgtgtgtatatatgtatgatgtatgtatgtatatatgtg

SEQ ID NO: 88448 - DNA, 112 bp, Mus musculus
ttgacattttctcagttgaggctctcctctctgatgactgtagtttgtgtggagttgacctaaaaccagacagaacattcttctcttcagcttttcatgagtgtaacatcaa

SEQ ID NO: 88449 - DNA, 73 bp, Mus musculus
cttttattttaatgtatgcatgtgtatgcatatgtgtgaactatatatatatatgtatgtgtacatgtgaaag

SEQ ID NO: 88450 - DNA, 72 bp, Mus musculus
cacacacacacacacacacacacacacctgcacataaatacataggtatgtgtacatgtgtatgtatgtatg

SEQ ID NO: 88451 - DNA, 81 bp, Mus musculus
ttggtgtgcatgctgaagacattgtgtagttgtgaaattattatatatggtgaatatacttcagcacagatgtggctccag

SEQ ID NO: 88452 - DNA, 71 bp, Mus musculus
tgtgtctgcctgcctccttcccagcgttgtggcattctgcaagcatttccaaggctctggctgcagacata

SEQ ID NO: 88453 - DNA, 105 bp, Mus musculus
ttcctctgatagctctgggcctggatgtgtatcactcagtgacagtctgcatttactttaacactgttgctgtggctggagagatggctcagttgtttggaggga

SEQ ID NO: 88454 - DNA, 112 bp, Mus musculus
tagaacagtctgttagatatgcttgggtgtagaaacagcagtttatttgtttttcagtaaaataagctggaaagtcatttgctgagacccctatgtaggagaggctgtgtta

SEQ ID NO: 88455 - DNA, 80 bp, Mus musculus
tgcagcagattggagctgataagtacttgcacctgcgctttcagacgctggtgtgcctctatccctctcagtctgtctca

SEQ ID NO: 88456 - DNA, 93 bp, Mus musculus
ggaggctcaaatacatgggaggcttgtgccaagccagtgaatgagttcctggcagcctgaaagccaagtcccatttatttaaccagtgcctct

SEQ ID NO: 88457 - DNA, 77 bp, Mus musculus
tatggccattgcatatatgtgtgtgtgtacatatatatatatatacgtaaacatatacacatatacatatctacata

SEQ ID NO: 88458 - DNA, 58 bp, Mus musculus
tgtatatgtgtatatgtttacgtatatatatatatatgtacacacacacatatatgca

SEQ ID NO: 88459 - DNA, 110 bp, Mus musculus
gacgtatttagatgtcttttagttgtatgtgtttcactcctgtgtatctttgtctgtggtgagtgtgcattaggaagtgaggcaaactctgatggcttctttgggtagtc

SEQ ID NO: 88460 - DNA, 72 bp, Mus musculus
ggaagaggtgtgtcactcagggtgggcttcgaagtttccaaactggatgcactcccagtgtcactctctttc

SEQ ID NO: 88461 - DNA, 114 bp, Mus musculus
ggaaaattgatctgaagttctctatctttgttgggtctttatgtggtttagatatcagagtaattctggcttcatagaatgaattgggtagagtaccttctgcttctattttgt

SEQ ID NO: 88462 - DNA, 106 bp, Mus musculus
aaatcagctgtctgctagtgcagcagaagtcatgtctttttttaacatagatattcgtgtttttttttttttatttgcctctgtgaacggctgcgggcagtggttt

SEQ ID NO: 88463 - DNA, 91 bp, Mus musculus
ccgtgtatcgctggctgatctagaactccatttgcagatcaggctggcttcgtactcggatctgtctgcctctgtctctggacttctgggt

SEQ ID NO: 88464 - DNA, 87 bp, Mus musculus
acacacctttattgcatgtatgtatatatgtatgtatgtatgtatatatgtatgtatgtatgtgcacacatgtgcgtatatatgtgg

SEQ ID NO: 88465 - DNA, 138 bp, Mus musculus
ggttatctaccagggttgatgcttggtgactctgactagtctcattagtctcaagcatattcctgtgtgtgtctctctgtgtgtatgcatgtgtatatatgtgtgtttatatgtatgcatgtacacttaagagtacat

SEQ ID NO: 88466 - DNA, 58 bp, Mus musculus
gtgtgtgtctctgtgtgagtgtgtgtgtatttacacagtcaggcttggtggcaagcgc

SEQ ID NO: 88467 - DNA, 110 bp, Mus musculus
gttgctaagacagccaagagtttcagtacagccactgacactctggctgtctcttaaccgacactgacatgttgctagtgtttgagagactagcaatgtgagaggttgag

SEQ ID NO: 88468 - DNA, 119 bp, Mus musculus
caaaatgcggagtcctgtttacatttccagtctgttagtcaatgtctttttattttaattgagtccattgatgttaagagatattaaggaatagtgattgttgattcctgttaattttg

SEQ ID NO: 88469 - DNA, 118 bp, Mus musculus
tatgtatgtatgtatgcatgcatatgtgtatgtatgtatgtatgcatacatgtatgtattatgtatgtatgcatgcatgcatgcatgtatgtatgtatgtatgcatatgtgtatgatg

SEQ ID NO: 88470 - DNA, 102 bp, Mus musculus
atctattatatgtgtgtgtatgtatgtgtatgtatatatatatatatatatatatatacatatatatatatatatacatatatatatatgtttatagtaggt

SEQ ID NO: 88471 - DNA, 111 bp, Mus musculus
ctggtagagtacattcctagctttcataagacctagtttcaatccctaaaactcccaaaagaaaagaagtctgtataattgaaagctaaagagctgtatttagtctgagag

SEQ ID NO: 88472 - DNA, 92 bp, Mus musculus
agatggttgtgagccactgtgtgcttgctgggagtcaaacctggtttctctgcaagagcaagtgcttttaaacactgagccatctctccagc

SEQ ID NO: 88473 - DNA, 87 bp, Mus musculus
tatctatctatctatctatctatctatctatctatctatgtatctatgaatgatagctagataacagatagatataaatggatgata

SEQ ID NO: 88474 - DNA, 59 bp, Mus musculus
gcagcaggcctctctctgtgtgtgtggagccctcagggacccagggaaggtgtggttgc

SEQ ID NO: 88475 - DNA, 117 bp, Mus musculus
cagggtatacagccagatcaggtagggcaagggctgtagctcacaagctcacactctgattctccatgcttgctctacagccctgtcctaatgttttctattaccatgatgaatgcc

SEQ ID NO: 88476 - DNA, 93 bp, Mus musculus
tatatacatatatatttatatatgtatatacgtatatgcatgtatgcatatatgtgtgtatatatgtgtatatgtatgtatgtgtatatgtgt

SEQ ID NO: 88477 - DNA, 104 bp, Mus musculus
ttgtgcaggaatagaaaccctgactaagacaactatatttcgtttttagaactttaaatgaacattaaggttgtaaaggaagggaacatgttttattctgccaa

SEQ ID NO: 88478 - DNA, 80 bp, Mus musculus
tacaatgtgcttaggaatgcctacagtaactcctgtgaattccactcagagtgcagactgtgagctcctgtgcttttgtg

SEQ ID NO: 88479 - DNA, 68 bp, Mus musculus
gttacactggttagtgtggatctgtttacctgtgcatgcaggtgtactgagggtgcacacagtgtggc

SEQ ID NO: 88480 - DNA, 96 bp, Mus musculus
gctatagtatttgatagtttagtaaacatctcttacattttttcttacaaagataggtgtgtgaagagtgtgaccttgaacttctgacccttttgc

SEQ ID NO: 88481 - DNA, 93 bp, Mus musculus
ggccactaagctctgtgagacagtctgccaggggcagcctccttagccttggctctctggcctgcctccctcactgcctctctttatgtgtcc

SEQ ID NO: 88482 - DNA, 85 bp, Mus musculus; identical to SEQ ID NO: 57439

SEQ ID NO: 88483 - DNA, 87 bp, Mus musculus
atatgtatgtatgtatatacatatatataatgggtttctatatattatgcattatgtattacatattatatactatacataacatat

SEQ ID NO: 88484 - DNA, 85 bp, Mus musculus; identical to SEQ ID NO: 57439

SEQ ID NO: 88485 - DNA, 111 bp, Mus musculus
gtatccgttttatttctgtgtctcgctgtgttgcttttgccaagagtctgagcactctgctgagtctcttgtgagactatgccggggcctagcaaacacagaagtggatgc

SEQ ID NO: 88486 - DNA, 93 bp, Mus musculus
tatagttgtgtctgtctgtctatcggtctgcctgtctgtctgcatctatgtgtatatatcagccagatttctactgttcagagatcacctatg

SEQ ID NO: 88487 - DNA, 150 bp, Mus musculus
tttcattacagtaataggattttgattaaagctcttgtagtgttctctctctctatgtgtgggagagagagggggggagggagggagagagagagagagagagagagagagagagagagagagagagagagagagagaagagtgtcagag

SEQ ID NO: 88488 - DNA, 116 bp, Mus musculus
tcactttgtgggaaagtgaatctgagtgagcaagaaattacaaggaaaagacagaccacagtgatgacagtgcttactcactcactgcagtaactccatttattagaacagagaga

SEQ ID NO: 88489 - DNA, 67 bp, Mus musculus
aagaacttgaggcctaccagagagggagaactggcccagccactcacactctgacagcctttctctt

SEQ ID NO: 88490 - DNA, 85 bp, Mus musculus; identical to SEQ ID NO: 57439

SEQ ID NO: 88491 - DNA, 100 bp, Mus musculus
tatgtatgttatcaggactgaccaattggtgtgatctcccctaaggaagactctctctttcactcgcagcattctttggttgcctgtagacttttgtgta

SEQ ID NO: 88492 - DNA, 114 bp, Mus musculus
ctcacgaaaaagactacagataccaaggttggtcacacttttccaatattgagtggctggaggaccaagtcaagttggagaccaaaagatctgagtggctgttgttcatcaggg

SEQ ID NO: 88493 - DNA, 114 bp, Mus musculus
gccggcagcatatgcagggtccaactccttcactcctccattaatcttggatatatatttatttctgatctagtgagtacgaggtgtcgttttgagatatgtttttctgatggc

SEQ ID NO: 88494 - DNA, 83 bp, Mus musculus
gttgagtggatggattgcatgtcttggggttgtgacactctttctctcagagacattagcctcagacgtttcctagactcagc

SEQ ID NO: 88495 - DNA, 75 bp, Mus musculus
tgccaatagcagcccaagaacagtgccagcactcagccataggagtgctgtgtgccacctgcagggcctctggca

SEQ ID NO: 88496 - DNA, 90 bp, Mus musculus
gatggtatctgcaaatgtatagatccctctcccaggctagacggggcttcccacagtgcctgtcacagggcatgcaggtgcagtgttgtc

SEQ ID NO: 88497 - DNA, 64 bp, Mus musculus
catgctgcacctgggggctgggggtgggaactttatgtgctctctctctctctctgtgtgtgtg

SEQ ID NO: 88498 - DNA, 103 bp, Mus musculus
gcctttcaacactaggcccacatttcctggttgagttgtctgctgactggcctaggtcagagtagattgacagctggcaaagtgactagaacagctaaagggc

SEQ ID NO: 88499 - DNA, 77 bp, Mus musculus
ggctgtaagactctgtctctgtctcctgctgtggggatggcaaaggcaggcagagcagatctcctggtggtcttgca

SEQ ID NO: 88500 - DNA, 65 bp, Mus musculus
tacagacagacagacagacagacagacagaaagagactgtctgtctgtctgtctgtctgtctgtg

SEQ ID NO: 88501 - DNA, 63 bp, Mus musculus
acagacagacagacagacagacagacagtctctttctgtctgtctgtctgtctgtctgtctgt

SEQ ID NO: 88502 - DNA, 79 bp, Mus musculus
ccaggacagtgagggcaatgcccacagaagtcacctacttgactatcttacaggcagtgtctgtgactgtctttatagg

SEQ ID NO: 88503 - DNA, 113 bp, Mus musculus
tgtcagattacacttcaaggagtcagggcctcaagagtgaagagagtcagtataggatctgattattgcttgggacttttgagagaggggggagagggagggagggagggagg

SEQ ID NO: 88504 - DNA, 141 bp, Mus musculus
gtatgtgtatgtgtgatgtgtgtatatatacaaagtattatatagatagatatgtatatacatacatatatatatattatagtatctgtatatagaacaaagtatatatagagtatgtatcatttatatatatatgtggta

SEQ ID NO: 88505 - DNA, 67 bp, Mus musculus
gtgtatgtatttatgtatgtatgaatgtacatagttatgtatatatgtacatatatatatagtatat

SEQ ID NO: 88506 - DNA, 79 bp, Mus musculus
tcatactatacagcaagttcttttatctgtggagtaccttgctgctattgcacaagtaagtgtgtgtctgtgtgtgtga

SEQ ID NO: 88507 - DNA, 99 bp, Mus musculus
gcctcagcacagtagtttggctagattggttgtaccttgaacagttatgttactaccatagtcgttttatagccagcttaaggacttaatctgtaaggc

SEQ ID NO: 88508 - DNA, 82 bp, Mus musculus
ccatgtctgactgcttgttcattttttagtatctgcagatgtcttcatagtgaggaaaatcaagacttgtcaggtgttatgg

SEQ ID NO: 88509 - DNA, 64 bp, Mus musculus
tctagtcattttgtactgctgacactttcttgacctcagagtgtcagcgttccagagaaacaga

SEQ ID NO: 88510 - DNA, 99 bp, Mus musculus
gtttttaatagctatgttaattcaagtgagatgatgtaggaaaataaatggttcattagttttttatattcaaatacttgaaagcagtttcctgaagac

SEQ ID NO: 88511 - DNA, 85 bp, Mus musculus
ccacagttcacctcagtgttcttcctgaatgcctgagaccttccagtctctggtctttggacatgccaaactgatgtgaccctgg

SEQ ID NO: 88512 - DNA, 87 bp, Mus musculus
ccctacagactctaactgactgtcttagtcaggatttctatttctgcacaaacatcatgactaagaagcaagttggggaggaaaggg

SEQ ID NO: 88513 - DNA, 93 bp, Mus musculus
acagtcttggcttgcatcacagtcactagcggaggctggctttcccagacagcccagagaagggagtgagcacctgttgcaagtatatactgt

SEQ ID NO: 88514 - DNA, 88 bp, Mus musculus
actccaccatgcccacgtgacagattagattctgttcttcggggcttcccacatggtctctctgtcacactgtgcatgtatgttgagt

SEQ ID NO: 88515 - DNA, 73 bp, Mus musculus
ttggtgacagaggtaaggctgaagctagaagacattagaagatgtcacatgctcagtcacactctctcaacaa

SEQ ID NO: 88516 - DNA, 113 bp, Mus musculus
tgagtcatgctatcccctgcttgtgccttgcatttgaacaaacagtaggatgacatagtttcattgtatttcttattcataaaagagacttggggcggggaagtggtgatgca

SEQ ID NO: 88517 - DNA, 69 bp, Mus musculus
tctatctctgtctgtcagagtggatgccttccatctatgtgaaggctcctgtgaaagtcagaagatgga

SEQ ID NO: 88518 - DNA, 99 bp, Mus musculus
atggcttctttttaaattaattgttacaaacatacacatatatgtatatataaacatatgtatgtatatgtacaagtatgtaagtacaactcaggctgt

SEQ ID NO: 88519 - DNA, 113 bp, Mus musculus
ctttgtctctgtatctccttccatgggtgttgacttgtatatttctgaatatttctatttaatatcagccacagttgacctaaaccataggaaatgaaactgaatattcaaag

SEQ ID NO: 88520 - DNA, 90 bp, Mus musculus
ggaattgagaaggagtatttttttaaatgtagagaacattccaaatgaaagttaatgtttgcatatacagtactgggctttctcaagttc

SEQ ID NO: 88521 - DNA, 96 bp, Mus musculus
tgaagctggctggagtggcttctccatgtagacactcaagagtgagtagacataactcaagagtgctggatagaaaaggtatagagctgagtttca

SEQ ID NO: 88522 - DNA, 56 bp, Mus musculus
ctcctccttctccctcttcttctcctgcctcagaagtcagagtggagaatgtgggg

SEQ ID NO: 88523 - DNA, 115 bp, Mus musculus
gtgtaacgaatacttcccagaggctggagaaatggcttagtggttaagagcactgactgctcttccagaggtcctgagttcaattcccagcaaccacatggtggctcccagacat

SEQ ID NO: 88524 - DNA, 105 bp, Mus musculus
gggacaatgtaagatgtcagaatttggagggatagagagatggctcagtggttaagagcactgactgctcttccaaaggtcctgagttcaattcccagcaacctc

SEQ ID NO: 88525 - DNA, 62 bp, Mus musculus
gttccctggtctgtgttccactgggctaatctgctctgtgtagagagtgtggtcttgggggt

SEQ ID NO: 88526 - DNA, 88 bp, Mus musculus
agctgtgtaaaccaaagacagaagtgagtctgggctgagatgccagatcagctggttgtgtctgtgagaaagctttggaaagatagtt

SEQ ID NO: 88527 - DNA, 81 bp, Mus musculus
ataaagtactgtttatcatgtttagattgagctattagttgactattctgcacagtgtgtccattttgaacagtattttgt

SEQ ID NO: 88528 - DNA, 93 bp, Mus musculus
tccatggtgatcggataggatgcatgggacaatttcaatatttttgtatctgatgaggcttgtcttgtgtccaattatgtggtcagttttgga

SEQ ID NO: 88529 - DNA, 110 bp, Mus musculus
ggcatggctttactgaatgacaatcatgatattaaatgtggtgagactttgtgatagaatcattctctctgtgtcaatgtgcattatcaagaaagtagagagaacatatc

SEQ ID NO: 88530 - DNA, 110 bp, Mus musculus
ggcatggctttactgaatgacaatcatgatattaaatgtggtgagactttgtgaaagaatcattctctctgtgtcaatgtgcattatcaagaaagtaaagagaacatgtc

SEQ ID NO: 88531 - DNA, 115 bp, Mus musculus
tgagtcttagaaattggaacttgggggctggagagatggctcagcggttaagagcactgactgctctttcgaaggtcctgagttcaaatcccagcaactacatgatggctcacaa

SEQ ID NO: 88532 - DNA, 110 bp, Mus musculus
ggcatggctttactgaatgacaatcatgatattaaatgtggtgagactttgtgaaagaatcattctctctgtgtcaatgtgcattatcaagaaagtagagagaacatgtc

SEQ ID NO: 88533 - DNA, 118 bp, Mus musculus
ttggtctgttaatcacataacatgaaacactctgcggtcttataacctggcaaagggcacagatgaatgtcaggacagggggaactgaatgtgggcatcataagtgtaggctgacagg

SEQ ID NO: 88534 - DNA, 81 bp, Mus musculus
gaccctactaggcaagaattagtcaggttgatctgggagtctatctctcaccttctctgaccttccctgtcttctttcgtc

SEQ ID NO: 88535 - DNA, 116 bp, Mus musculus
ttgaaaatcagccttagtgcttggtgatctgataggatgcattggacaatttcaatatttttgaatatgttgaggcctgttttgtgacctattatgtggtcaattttggagaaggt

SEQ ID NO: 88536 - DNA, 74 bp, Mus musculus
gtctgtatactattgtatgtatatattttcaggactgaccattaaatatttgcataactaattggtgtgctgac

SEQ ID NO: 88537 - DNA, 85 bp, Mus musculus; identical to SEQ ID NO: 57470

SEQ ID NO: 88538 - DNA, 92 bp, Mus musculus
gctctgacttggtgaacaagagacagatacagcatggaaagtaaaggcacatgcacaaagtgtccatccttgtcgatatagcaagtccaggc

SEQ ID NO: 88539 - DNA, 111 bp, Mus musculus
ttgaggctgtgcgttcatctgagattgtaggagttagttaattactttggaaatccaaagtatagtaagatttaattctatttatctcagaggttggttagttttgaacag

SEQ ID NO: 88540 - DNA, 80 bp, Mus musculus
ccagactgctcttccagaggtcctgagttcaaattccagcaaccacatggtagctcacaaccatctataatgagatctgg

SEQ ID NO: 88541 - DNA, 74 bp, Mus musculus
catctctgcccccaggtttccacctcaagtttttgctctgatttctctcagggtagagtgtgacctgagagttg

SEQ ID NO: 88542 - DNA, 77 bp, Mus musculus
ctttatgactgtgcatgtgcgtgtaaggtgaggatgtgaatgtgtgctcacacatgtcacagtgcacacttgtggag

SEQ ID NO: 88543 - DNA, 91 bp, Mus musculus
gatctagaaatcgatagatttgagctgtggcttgagtccctcagatgactgtgaccacaatagatgacttaaattctgtcagcttctagtc

SEQ ID NO: 88544 - DNA, 70 bp, Mus musculus
tctctgagtggatcttgaggccaaacttgtctgcagagtgagttccaggacaatcagggctacacagaga

SEQ ID NO: 88545 - DNA, 89 bp, Mus musculus
tcttatgtgtatgtgttttgtctctgtatatgtgtgtgtgccacatgcatacagtccccccagagttcagaaggcataaatctcctgga

SEQ ID NO: 88546 - DNA, 97 bp, Mus musculus
aagatcagccatggtggtctgataggatacatgggacaatttcaatatttttgtatctattgaggcctgttttgtgaccaattatatggtcaatttt

SEQ ID NO: 88547 - DNA, 104 bp, Mus musculus
tgctctgcctgtatatgtcccagtcttgtatgtgtacctgtgtgtacatacactgtgtgtgtgtgtgtcgtactcatgagtggacacttatatgctgtggtgca

SEQ ID NO: 88548 - DNA, 99 bp, Mus musculus
tgggtgttagaaaaagagaagtaggactggagagatggctcagtggttaagagcactgactgctcttccagaggtcctgagttcaattcttagcaacca

SEQ ID NO: 88549 - DNA, 84 bp, Mus musculus
gtagaatgcatgcatagggctagagagatggctcagcggttaggaacactgactgctcttccagaggtcctgagttcaatccac

SEQ ID NO: 88550 - DNA, 89 bp, Mus musculus
agagatggggccaagtcagagtaagtcagcaagggtgctgggagttgcccttgaaaatgctagatctctgtctctctgtctctgtctct

SEQ ID NO: 88551 - DNA, 67 bp, Mus musculus
gacacccaggtttcatgaggagaggcatggaagctctttgttgccaattatacatggcccaggggtc

SEQ ID NO: 88552 - DNA, 84 bp, Mus musculus
agacattgacatatattgacatggtctcttagacatctacatctaagcccttagatctctgtctgtctgtctgtctgtctgtct

SEQ ID NO: 88553 - DNA, 87 bp, Mus musculus
gcctccaaactctatgagcatctcgatgaggtcaacgttctttaccttggctgcatgatgaagcgcagtctcatgaagtttggctgc

SEQ ID NO: 88554 - DNA, 97 bp, Mus musculus
ggcattttctttatacctggtattatttctgagctcttgttttacaaatggcagatgtgctttgtaaagaactttgcttaaatgtaatttagggctt

SEQ ID NO: 88555 - DNA, 81 bp, Mus musculus
gctctggtgatctgacacccttttctggcttcccatgggcactgcatgcatgtgcacagacagacagacagacagacaggc

SEQ ID NO: 88556 - DNA, 84 bp, Mus musculus
ctggcagtagtcttggagctgtagaaagcaggctgaggcttcagcttcccaggtctgctgagtctctcactctccctgtgctag

SEQ ID NO: 88557 - DNA, 115 bp, Mus musculus
atatatatatgtgtatgtatgtatatgtatatatatacatgtatatatgtatgtatatgtatatatacacatatatacatatatatacacatatacacacatatatatttatata

SEQ ID NO: 88558 - DNA, 73 bp, Mus musculus
tgtgtgtgcggtggtggcagggggtgggagtcgggtgagcgtgagtctctcagtgtgtcaaaccagctggcca

SEQ ID NO: 88559 - DNA, 84 bp, Mus musculus
tccattgatctatctctctgtcactgtaccaataccatgcagtttttatcacaattgctctgtagtacagcttgaggtcaggga

SEQ ID NO: 88560 - DNA, 86 bp, Mus musculus
cccacagtctgactggttgtagtagtggtcactgtctgtcactctggtttacatgtggccagtactgagcaccatggggctcaggg

SEQ ID NO: 88561 - DNA, 85 bp, Mus musculus
gctgaccacttgggattgaggattagacatcctatgtggtatttcttcccagggggatattaattctctctctctctctgtcagc

SEQ ID NO: 88562 - DNA, 94 bp, Mus musculus
catatccatgtgagcaatactaaatgcacttatcaaattgtatttataactgtgtgtacatatgtgtgtgtgtgtgtgtgcgctcatgtgtatg

SEQ ID NO: 88563 - DNA, 76 bp, Mus musculus
gttcctcttagtggctcactgggtctctgagtttctgaggttcttcaggagtcatcttgtgagttctattccctgc

SEQ ID NO: 88564 - DNA, 111 bp, Mus musculus
tgctggacaaggggtcattcacatgctgtgcagagccaagtgaggtagctctacactactcagaacagtgtgtgatctgaaataaattgattgcctaaaattttccatgca

SEQ ID NO: 88565 - DNA, 85 bp, Mus musculus
gtccatggtggtctgataggatgcatgggacaatttcaatatttttgtatcttgtgaggcctgttttgtgaccaattatatggtc

SEQ ID NO: 88566 - DNA, 69 bp, Mus musculus
gactgaacacggactagaactttgaaagctgtgagcctctttctggttctgtctgtctctttctatgtc

SEQ ID NO: 88567 - DNA, 75 bp, Mus musculus
atttctgtgattgcaactggaagaattcagtgttcattaataaactattcttgcaggtatgtaaggcataggggt

SEQ ID NO: 88568 - DNA, 75 bp, Mus musculus
tgacagaagggaaagacagacagacagacagacagactgactgactgactgactgactgactgacaaaagggtca

SEQ ID NO: 88569 - DNA, 64 bp, Mus musculus
gggtgcttgggccaatctgcactcctggcagcaatgcatgagagtgtctgtggctcactgtcct

SEQ ID NO: 88570 - DNA, 115 bp, Mus musculus
cttcctgattagaaatgagacttgagatgttcaaggggccattctgaccttatttgatggatatggaatgaatcttagccacggagctcagggtcacacattcagttcatggcag

SEQ ID NO: 88571 - DNA, 116 bp, Mus musculus
ttgttattgaagatcagccttagtccatgatgttctgataggatgcatgggacaatttcaatatttttgtatctcaaactcagattcttattattcacaaggcaaacagttaacag

SEQ ID NO: 88572 - DNA, 81 bp, Mus musculus
caggggcccttcccatgtcctcaagttccacggcacgcagggcagtactctgtggattcttctgtgcatgagagccctctg

SEQ ID NO: 88573 - DNA, 85 bp, Mus musculus; identical to SEQ ID NO: 57439

SEQ ID NO: 88574 - DNA, 77 bp, Mus musculus
gtcagtctgtgagtgagtgctttcagagctgttatggttggtctatgtctgtgcaagcaattcttcaatgtcctgac

SEQ ID NO: 88575 - DNA, 118 bp, Mus musculus
atagctcctagacatacacacagattcattcattctttgtgtgtatgtctgtctgtctgtctcagtctgcctgtgttgtgatatgtgtgtaactgcatagagcctgggagtacataga

SEQ ID NO: 88576 - DNA, 100 bp, Mus musculus
gtgggtaagctggagacccataagagctaattttttagatttatttcccccagtgctgggtttactctttgaaaatttgcttccctacctagctacctgc

SEQ ID NO: 88577 - DNA, 70 bp, Mus musculus
tactagaatagtgttttacatgggaatcaggtcactgggatcagtcactgtcttagtcactgttctagtg

SEQ ID NO: 88578 - DNA, 87 bp, Mus musculus
ctcagacactttgaccttgtttttgagaccaggcctctcacacacactctccaccttgttgtttaagacggggtcagggtctttcag

SEQ ID NO: 88579 - DNA, 116 bp, Mus musculus
ggaggtcgaggcaggaactcaagcagataaggaaacagaatccacagagaaacagtgttcactggctcactctatggctcctggtcagctaaatttcttaaacagcccaggcccac

SEQ ID NO: 88580 - DNA, 110 bp, Mus musculus
aagcctatagtgcctatatgtcacaaagggggtgtgagatcagtgagaccagaatggactccacatctgcctgaatccacgtaggtcccaccatagcttcccacatttcc

SEQ ID NO: 88581 - DNA, 105 bp, Mus musculus
tatggctctcagacctcagcagacaattctttgttcagtgggtggtggttaaaacaaaactcacaagtcagagagcagagagtatctgtgaaacactcagccata

SEQ ID NO: 88582 - DNA, 79 bp, Mus musculus
gagagagagagagaggagggggagggggagggggagagaaatgcctgcctgcctgcctgcctgcctgtgtagatagatc

SEQ ID NO: 88583 - DNA, 73 bp, Mus musculus
agggctttttgggacttctggagtaggaatgtcacctgggtgctttctctgcctctctgagccagcaggcttt

SEQ ID NO: 88584 - DNA, 81 bp, Mus musculus
gttttgatggaatatacatgtatgtaagtgtatgtatgtatgtatgtatgtgtgtgtgtatgaatagtcccatcctaagac

SEQ ID NO: 88585 - DNA, 89 bp, Mus musculus
gattgctagcacatccctgactccctggttgcctgttctacttacaaggaaggacccttgggatctcacggtccccaccctaagtaatc

SEQ ID NO: 88586 - DNA, 115 bp, Mus musculus
ggagtgggctttgaggtttcaaaatcccatgatgggcccagtctctctctgtgtgcctgcagatgggatatagatggtgttgggcacattcagggttgacctttcctcttcagct

SEQ ID NO: 88587 - DNA, 94 bp, Mus musculus
gggttcacagagcagtgacagcaatggactggaaggcgtagagttttatactattcagttctgtagagaaaatgttgttgtgactgcctctcct

SEQ ID NO: 88588 - DNA, 95 bp, Mus musculus
tctgagcactgactagaagtacacaaacatattgtttatgtgtgcatgtgcatctatatatgtatgtgtgcttgtgcatcctggttagtcttaga

SEQ ID NO: 88589 - DNA, 95 bp, Mus musculus
ctgggacaagaggagggaggggggctgtgatcaggatgtaaaatgaatgaatgaatgaatgaatgaatgaatatgagtacttcctgcttgtccag

SEQ ID NO: 88590 - DNA, 86 bp, Mus musculus
gaccttgtttcccctctggctcttacactctgtctgcctcttcttttacagggttccaggatcctgaggagaaggtcctgatggag

SEQ ID NO: 88591 - DNA, 85 bp, Mus musculus
cccaagagtcccagggagagccaccagacccagcatcttggtgggagactgagcctgtgtggctctctggcagaccaaaattggg

SEQ ID NO: 88592 - DNA, 80 bp, Mus musculus
aggtatattgcatgttcatgtgcttgctcagctcatatactcactctctcactgctgataccaagtcacagcagcagcct

SEQ ID NO: 88593 - DNA, 98 bp, Mus musculus
atatatacacacatacacatatatatgtatatatacacatatatatgtatacatatatatgtatatgtatatatatatatgtgtgtgtgtgtgtgtgt

SEQ ID NO: 88594 - DNA, 59 bp, Mus musculus
gagagagagagagagagagagagagagagagactcactcactcactcactcactcactt

SEQ ID NO: 88595 - DNA, 89 bp, Mus musculus
atatatgtatatatatgtgtgtgcatatatatatatgtatatatgtacatatatacatatatatatatcgttcgttatacgcacacaca

SEQ ID NO: 88596 - DNA, 115 bp, Mus musculus
gggtattcagttttcttgtaaaattcccctctggcagagaagacactgagctctggatgagagtgcattggctctggaagaaggcagacataggaggagaaaaaggagagagctc

SEQ ID NO: 88597 - DNA, 93 bp, Mus musculus
gagccaaagctacggaaaaactgcccaagaggcacaggtcttaacctgctgaagcctgtgcctctcactgtcgcagaacacatatcttggttc

SEQ ID NO: 88598 - DNA, 91 bp, Mus musculus
ggattgcaggttgagtgttgactgactggaggtatcttctgtggctaccataggcaggttttatgtcatctttacagtacccttgttattt

SEQ ID NO: 88599 - DNA, 67 bp, Mus musculus
gcttaatgtgcagagaagagagtgggctgagattattatcactgttcctgtctttttagcaatgagc

SEQ ID NO: 88600 - DNA, 88 bp, Mus musculus
tcccatcaggcttggttgcttctccaattcttgctaacagatctgaagggcacaagagtagagagagagcagtgacacactgactgga

SEQ ID NO: 88601 - DNA, 76 bp, Mus musculus
aagacaacttacctaagagtgcagaatgtctttatttattaaaataattatattttgtgttctttattaaagtctt

SEQ ID NO: 88602 - DNA, 93 bp, Mus musculus
catggatgtagcttccctgtcatttcttggagacatttttttttttaaagaaaggcttttcctggattttaatgtacattgaagtctgacatg

SEQ ID NO: 88603 - DNA, 81 bp, Mus musculus
ctataaatactgactcaagaaacacagctggtccatggggtggtggatggacatagctggttgatgagaagcagtggatgg

SEQ ID NO: 88604 - DNA, 99 bp, Mus musculus
tctcccactgaggccagaccaggcagtcctctgctgtgtgtgtgtcaggggcctcatatcagctggtgtgtgctgtggttggtggctcagtgtctgaga

SEQ ID NO: 88605 - DNA, 81 bp, Mus musculus
gtgtgtatatacatatacatgtatatatatatacttgtatacacacatgtataaatgtatgtatatataaatatataatgt

SEQ ID NO: 88606 - DNA, 72 bp, Mus musculus
agtcagaatctagtggcctgggggtcagttcaaggagtatgtttccctctgtttctatctctgactctgact

SEQ ID NO: 88607 - DNA, 75 bp, Mus musculus
gtctgtctgcctgtctgtctgtctgtctttcatgcacacaaacgcagagagactcagacagacacacacacatgc

SEQ ID NO: 88608 - DNA, 61 bp, Mus musculus
tgtgtgtctgtctgagtctctctgcgtttgtgtgcatgaaagacagacagacagacaggca

SEQ ID NO: 88609 - DNA, 111 bp, Mus musculus
acactgagtgtctggtttcttccagtgccgcctctgtgcctgcctctctctatgcacagctttgaaaagggctgtgtagcaaggaacactgggaagagttaatgcccctgt

SEQ ID NO: 88610 - DNA, 70 bp, Mus musculus
tgctctgtctctctgtctccggcacactcaatcctgtgctttatattggtggcagatgatgagccaggca

SEQ ID NO: 88611 - DNA, 118 bp, Mus musculus
tcatcagagtgacatggacctggagcagaagctgctggctgctgtcctgtctgcctgtgagcctctgtccccagcccctaagcaaagtggcgacctacagtgggtacttggtaaacag

SEQ ID NO: 88612 - DNA, 76 bp, Mus musculus
gataggaagataagcattctgactctggggctcacacacgcagtcactaacctagtagtcagcttttcttcttttt

SEQ ID NO: 88613 - DNA, 103 bp, Mus musculus
actgagtgtacacgtgggtggactgtgggcacacactctcactctgctggggctgcctccaccaggagagaggagagctggcctctccctcacagctgtcagt

SEQ ID NO: 88614 - DNA, 118 bp, Mus musculus
gtgagtgtgtgcatgtgtctgagtgtgtatgtgcctaagtatgtgtgcatgagcatgtgtgtgtgtgtgtataagtgtgtatctaagtgtgtatgtgcctaagtatgtgtgcatgagc

SEQ ID NO: 88615 - DNA, 111 bp, Mus musculus
acatgtctctttctctgaatctctaataatgattcttaaagtgggagtagactttttttatttttaaaaccacttaacaaagactgtcaagggaactctggaaagaactgt

SEQ ID NO: 88616 - DNA, 95 bp, Mus musculus
ttggacatcatagggctagagagatggctcagtggttaagagcactgactgctcttccagaggtcctgagttcaattcttagcaaccacatggtg

SEQ ID NO: 88617 - DNA, 95 bp, Mus musculus
tgcaatacacacataacacacgcacacacatacacacatatacatgctacatatttatgtaagtgtgtatactgagtccatttattgtggttgta

SEQ ID NO: 88618 - DNA, 94 bp, Mus musculus
cctggggtggtcaacgtgtctgtgtctgactggctgtctgtgtaagcaagcagacaggagagaggttcagacgaggtgacactaggcaagccct

SEQ ID NO: 88619 - DNA, 98 bp, Mus musculus
ggtttattcagcttacatttctacattgctgttcatctctcaagaaagtcaggactgaaactcaagcaggttaggaagcaggagctgatgcagaggcc

SEQ ID NO: 88620 - DNA, 134 bp, Mus musculus
acagtcacaagacaacaagctctgtgtgtgtgtgtgcgcgcacacacatcagtctgtctgtctgtctgtctgtctctgtttagcaaactgtgtgaggcaaaagcatgtttttccttagaggcatatagacaaca

SEQ ID NO: 88621 - DNA, 89 bp, Mus musculus
cacacctacagtgcagtgtgtgtgtgtgtgtgtgtacatatatatatatatatatatatatatatatatatatatatcctaaacttgtg

SEQ ID NO: 88622 - DNA, 89 bp, Mus musculus
gctgtgtgtggcagaacttgggaggtagaggctggaggatcaagatttttgaggccaatcttgactgcaccaggcactggaattacagc

SEQ ID NO: 88623 - DNA, 105 bp, Mus musculus
gagcgagagatcaggagttaaaagctcataatgcccttgcggaagacccgaggtcagttctcattctctgcattgggtggcttacagctaccgtagctccagctc

SEQ ID NO: 88624 - DNA, 78 bp, Mus musculus
gtctctggaatataagattatgccatcgataggattgggatactgtactttcagtggatagttgtgtgcagtggagac

SEQ ID NO: 88625 - DNA, 125 bp, Mus musculus
tgtggagggctgctgtgaaatcctgtcttctggagatgacatggctgtgaatgaactcacccagctatgatgacattcacaagaccaagccagcaagatcagcaaacattccaacaggcagcgct

SEQ ID NO: 88626 - DNA, 68 bp, Mus musculus
ggtttgctgagccacagtctctcactgagcctacagatcactgacaaagactggctggccagcaagcc

SEQ ID NO: 88627 - DNA, 86 bp, Mus musculus
gtatatgtatatgtatgtgcatatgtgtgtgtgtgtatatatatatatatatatatatatatatatatatatatatatgacattca

SEQ ID NO: 88628 - DNA, 98 bp, Mus musculus
actgtctgtgtacaccagtgccgactttacgttcagattgttttctcatcattgggagtgttgtctgggaggaggagagtgcactgagggcaggcagt

SEQ ID NO: 88629 - DNA, 106 bp, Mus musculus
gccttaggccgtggtgatctgataaggtgcatgtgataatttcaatatttttgtatctgttgaggcctgttttgtgaccgattatattgtcaattttggaggaggt

SEQ ID NO: 88630 - DNA, 109 bp, Mus musculus
gatgtcacttcctacaggctctgccctcctgccacaggtttaggatggtgactcctgtttgtgtcttcagcctcgaagggggatgagagaagttaggtgcagagacgtc

SEQ ID NO: 88631 - DNA, 149 bp, Mus musculus
tatgtatgtgtctgcatgtgtatgtgtgtatgcatttatatatgcatgtgtctgcatgtgtatgtatgtatgaatgtatgcatgtgtctgcatgtgtatgtatgtatgtatgtatgaatgtatgtatgtatgtatgtatgtatatgtat

SEQ ID NO: 88632 - DNA, 72 bp, Mus musculus
gtgtatgtatgtatgtatatatgtatctgcatgtgtatgtgtgtatgcatgtatatatacatgtgtctgcat

SEQ ID NO: 88633 - DNA, 96 bp, Mus musculus
gctgaggaccctgttcaccctactaccctcacacaaagccctcactcactctccctgtcctctgatgaagtgctttcagttgtgaattccctcagc

SEQ ID NO: 88634 - DNA, 107 bp, Mus musculus
tttgctatgtacgtatgtatgtattatgtatgtatgtatgtatgtatgtatgatgcatgtatgtatgtaatagcaacataatatatatgtatgttcatatatgtaaa

SEQ ID NO: 88635 - DNA, 74 bp, Mus musculus
gtatcactgtatcgagtcacagggcaacaacgtgggaccctgaatggctctggaaatggcttgaactttgatgc

SEQ ID NO: 88636 - DNA, 113 bp, Mus musculus
tgcaagtatattatatgtatgtatgtgtgtgtgtgtgtgtgtgtgtatatatatatatatgtatgtatatataaatatatgcatacatatatatgtatatatacatatgtgtg

SEQ ID NO: 88637 - DNA, 110 bp, Mus musculus
acaaacactgtcccaggcaaagcattgtctccaagctggcccactgtgccactcactgaccctgtgcagtagccaggtatggcggcatgtagtacctgggaggtggaagt

SEQ ID NO: 88638 - DNA, 88 bp, Mus musculus
gtgttcaatatacattctattcatgtatgaaattctctcagagaataaataagaagcaaggggaatagaaatgtgtatgcaggagagc

SEQ ID NO: 88639 - DNA, 74 bp, Mus musculus
ctgcacggattcatcaaatggtcctcttgatgacggacaccctcactccctccgtctcataggcctccaagtag

SEQ ID NO: 88640 - DNA, 71 bp, Mus musculus
gaagcattttccttagaggtgtccttgctttccccacaagctggagagtgaacacactgagcctgtccttc

SEQ ID NO: 88641 - DNA, 88 bp, Mus musculus
tgtgtgtgtgtctctgtgtgtgtgaaagagagagagacagagagatagatagagagagacaggcacacagacagacacagagacagac

SEQ ID NO: 88642 - DNA, 64 bp, Mus musculus
tgtctgtgtctgtgtgtctgtgtgtgtctctgtgtgatggtatgcatacagatgtcagaagata

SEQ ID NO: 88643 - DNA, 104 bp, Mus musculus
gtttaccctttgaaatgatgtggtttctctcaggctctggctgtgtgaaactcaatgctgatggcctctgccttgaattggagctttactggtggatctgggga

SEQ ID NO: 88644 - DNA, 80 bp, Mus musculus
gcttgtatttgtattgtatgttgtattgtaacttacgtgaatgtatacatgtatgttacattaatgatagaaaaactggc

SEQ ID NO: 88645 - DNA, 119 bp, Mus musculus
ttagtctcttgctgtgcttatgtatacattaagtcttgtatgtatgtatgtatgtatgtatgtatgtatgtatgtatgttcagatatatagaatgtaattttgtatagagaaggttaga

SEQ ID NO: 88646 - DNA, 111 bp, Mus musculus
gcttgtaggatgtgagaaaagctttattcttggaatcttaaaatctcttatgcgcacataagataagagattttcttgaccaccaagaactctttgtgcctatctttaagc

SEQ ID NO: 88647 - DNA, 94 bp, Mus musculus
tagggctaggcagagatggagatcatttctgatattcttgattttgatcaaaatgaacatgggactgttatctccagagaaatatgtttccttg

SEQ ID NO: 88648 - DNA, 101 bp, Mus musculus
gcaactggagcttacctcccttagtcacccagtataatcagtatatatatatatatgctagccagtgaagaaggagggtaaaaaagaagaagctacagttc

SEQ ID NO: 88649 - DNA, 92 bp, Mus musculus
tccctggtgttttacattccttgggacaggcagtgctgtttcctctcaggtattgtgctgtgcttgcctgcctgtaagccactcctcaggga

SEQ ID NO: 88650 - DNA, 66 bp, Mus musculus
tgtaagtcccagcagctctaggagcagggcatgcaacctttctctcagagactcactgggtggtca

SEQ ID NO: 88651 - DNA, 91 bp, Mus musculus
tctgtatgtatgtatgtatgtatgtatgtatgtatgtatgtgtgtgtatgaatgttcacacatgtgcatgtgtgtgcattgtgcatgtgga

SEQ ID NO: 88652 - DNA, 85 bp, Mus musculus; identical to SEQ ID NO: 57439

SEQ ID NO: 88653 - DNA, 66 bp, Mus musculus
cactgacacagatagctccaggagtcaccattctgtgagtgcttcctgactctctgtctcactgtg

SEQ ID NO: 88654 - DNA, 85 bp, Mus musculus; identical to SEQ ID NO: 57470

SEQ ID NO: 88655 - DNA, 80 bp, Mus musculus
tgctggactgcagcgttatgtggattgatgtttgggttccttggactcccctgcagaattctcttcccacattccagaca

SEQ ID NO: 88656 - DNA, 75 bp, Mus musculus
cagctctgaactgacagaagtcaatttgaggttctttggccacatctgactgactctgtggaagtttcaatgctg

SEQ ID NO: 88657 - DNA, 120 bp, Mus musculus
gtgtgtgagtgtgtgtgtgtatatataaatttccactgtatatactatgtggtaaaatgcaaatgtattgtatacatggtgaagatagatctgggcatgcatatggaacagttttaacat

SEQ ID NO: 88658 - DNA, 73 bp, Mus musculus
cattgagaagtgtgagaggtgactcagttatgggtgacatggacctcatgagtatattcatgcttctctcatg

SEQ ID NO: 88659 - DNA, 68 bp, Mus musculus
gctatgtgagggaaaggtaactgagaaggccatggggagccagtctcagtctctgcttcagccactgc

SEQ ID NO: 88660 - DNA, 80 bp, Mus musculus
tatatgcatatatatatatgtatatatatgcttatgtatgtgtatatatatgcatatatatgcatatatatatttgagta

SEQ ID NO: 88661 - DNA, 89 bp, Mus musculus
tgtgggtataccctgcaccagtcaaagtcacagtctgtcagaatacatgtggttgatgtgagttccactgaagggagctgtgctccata

SEQ ID NO: 88662 - DNA, 85 bp, Mus musculus
tgtatatgcatatgatatatatacatatatatgtatatatatacatatatatgtgtgtgtatgtatgtatggttatgcatgtata

SEQ ID NO: 88663 - DNA, 80 bp, Mus musculus
cagtgtctcagtcttgggggtagggtgggggtgggtctgacactctgacactctgacagccttcttggtcattgacattg

SEQ ID NO: 88664 - DNA, 74 bp, Mus musculus
ggttgtctgtcagtgtgtgtctttgtgtatatgccctaaggcatgtgcctgcacatttgcgtttaggtgtttcc

SEQ ID NO: 88665 - DNA, 66 bp, Mus musculus
gggctgcttgttctggctgctcagatagtagggcagtgcattgtgtgagaccatgtccaagtgctc

SEQ ID NO: 88666 - DNA, 94 bp, Mus musculus
cacttacagggtgttggtttgtgggtgagtcacttgacttttgctggtctcagtaactgcatctggaacttaaggacttgatagtttgtatatg

SEQ ID NO: 88667 - DNA, 105 bp, Mus musculus
ttgcttgcctgcgtgctcccacccatgcggtctaacagtctgtccgtgcgtgtgtgcgtgcgtgcgagcgaacgaatgaatatgtgtgtgtgtgtgtgtgtatgt

SEQ ID NO: 88668 - DNA, 78 bp, Mus musculus
tatatatgtatggatataatatatatgtcatatacatcatatatgtgtatatatacatatatattacatacatatata

SEQ ID NO: 88669 - DNA, 62 bp, Mus musculus
gctttgtgaatgagagaaatggcaggtaaaataaagacctttctctctctctgccacagagt

SEQ ID NO: 88670 - DNA, 85 bp, Mus musculus
cgacagaccaactggatctacacaatctctcaactgaggtttctcctctcagatgactgagtgctgtgtccagttgacgatggag

SEQ ID NO: 88671 - DNA, 101 bp, Mus musculus
tggctccacacacttgatgagtggcagactcactctgccaatgtggacctcaccttgcacattgaggccaggagctttccactcgtgaagatatatagtca

SEQ ID NO: 88672 - DNA, 90 bp, Mus musculus
tccatcagaatgccatgagtgtgttacaaaagcagtcttattattagcctgtttaattgttactttttgaatatattccttcaggatgga

SEQ ID NO: 88673 - DNA, 85 bp, Mus musculus; identical to SEQ ID NO: 57439

SEQ ID NO: 88674 - DNA, 121 bp, Mus musculus
agtatgtagtttataaaattctctgaggggctggagagatggctcagcggttaagagcactgactgctcttccagaggtcctgagttcaaatcccagcaaccacatggagacttacaactg

SEQ ID NO: 88675 - DNA, 69 bp, Mus musculus
gggaggggaggagaaggagttaggaggaagagaggttaaattaagactcactctctcccactgaggccc

SEQ ID NO: 88676 - DNA, 109 bp, Mus musculus
ttcccacactattttgtgtctggtagaggaatggccacaaagacatcaaacacacactgggtctctgtgaccgccccctgcacctgtcatccctcaaaaagtgggcgaa

SEQ ID NO: 88677 - DNA, 91 bp, Mus musculus
gctcatgaatatatatattgagtgaatgaataaatatatgtatgaatgtatatgtttattcttgtttgcatgggtgtgtgtgtgtgtgtgt

SEQ ID NO: 88678 - DNA, 126 bp, Mus musculus
ccgggaggcggctcaggtttgtccttcaatccagtcctgggcactgtgggtgtctgagtgcctctgagccatagaagacagatgagatgaggaacagatatggaagccggtgtctggggaactgga

SEQ ID NO: 88679 - DNA, 87 bp, Mus musculus
caggtcaaagtgcagagaagtgactgtggaatgcttatccctaagtagaacatctacatcacccctcccaaggctcggggacatctg

SEQ ID NO: 88680 - DNA, 85 bp, Mus musculus
gtccatggtgatctgataggatgcatggtacaatttcaatatttttgtatctgttgaggcctgttttgtgaccaattatatggac

SEQ ID NO: 88681 - DNA, 85 bp, Mus musculus; identical to SEQ ID NO: 57470

SEQ ID NO: 88682 - DNA, 82 bp, Mus musculus
ctgagtccaaagtgtgccgatgccttccaaagaaatgctgtgacattttatatatgttttgaggagcatggttcagggccag

SEQ ID NO: 88683 - DNA, 75 bp, Mus musculus
aaggagagggctctgagatctgactgaccacattatgggtcttggcttgttaggtctaccaagtccttgggcctt

SEQ ID NO: 88684 - DNA, 128 bp, Mus musculus
cagtctgtaagggagacaacggagtggctgctggtctgtctgtctgtctgtctgtctgtctgtctgttttgatcaagtacccatggaatctcttgaagagagcagaatgctgggatcagagaggcaga

SEQ ID NO: 88685 - DNA, 113 bp, Mus musculus
gagtgttgctggcactttcgtgctgctggaagagggagtggtgtttcaggttacagctgattttgttgttctgcggcattctgctgttctgtgcagaaggtgctgtgattttt

SEQ ID NO: 88686 - DNA, 85 bp, Mus musculus; identical to SEQ ID NO: 57439

SEQ ID NO: 88687 - DNA, 85 bp, Mus musculus; identical to SEQ ID NO: 57439

SEQ ID NO: 88688 - DNA, 88 bp, Mus musculus
ttctgcatgtcagatatttatattttgattcataacaatagtaaaattatagttatgaagtagtaatgtaaatagttacactgtgggg

SEQ ID NO: 88689 - DNA, 116 bp, Mus musculus
tttgataagtgttgtgtccaagatgtagtatggcttgtatgtcacactctcacactctcattccgagtagaaagggtgacacacgcctttacccctgtgtccaactaacgctcaag

SEQ ID NO: 88690 - DNA, 66 bp, Mus musculus
ggattccctttggtctgagttactgttggagctcctagctcagcgtctctctctgagtggctatcc

SEQ ID NO: 88691 - DNA, 86 bp, Mus musculus
tgtgtatgtgtatatgtatatatgtacgtatatgtatatatacatatgtatatatgtacgtatatgtgtatatatatatgtatata

SEQ ID NO: 88692 - DNA, 92 bp, Mus musculus
ggcggactctgcagtgcctcactcactgtgtgattcgataggaccagggctcatcagatcaccgccgagatgaagtacaaggtaagagtgcc

SEQ ID NO: 88693 - DNA, 87 bp, Mus musculus
ctggtggacagcataaatctatggcgaggcaccatactgataccctttctctgtctttgtatctctgtctctgttatttgttcccag

SEQ ID NO: 88694 - DNA, 84 bp, Mus musculus
gacctgcagatactacccattctcagtgactctcattcacagcatcctgggtggggcctaggaatggaccattttagcaacttc

SEQ ID NO: 88695 - DNA, 80 bp, Mus musculus
tcctgaagcttcttaggttttaagagcatatacgtatttttggcttctaaaagtttgtattttttttccagaggccagga

SEQ ID NO: 88696 - DNA, 73 bp, Mus musculus
ccagctcagactcactgtcactgaatgggcacgcacgcctaagttagggatgaacaaggtctgtgtttttagg

SEQ ID NO: 88697 - DNA, 87 bp, Mus musculus
tgaagtccaggtaggaatctaaagtagcatgttctcagtcaacagcagaaaataattacatgaatattttttcctgcctagttctca

SEQ ID NO: 88698 - DNA, 75 bp, Mus musculus
tgaatttgtctgcctgcctgtctgtctgtattgaggcaaggtcttaatatatagccctggctggcttcaaactca

SEQ ID NO: 88699 - DNA, 59 bp, Mus musculus
tctgtctctctctgtgtatgcatgttcacatgtggagtggtgtacatgtgggggtcaga

SEQ ID NO: 88700 - DNA, 116 bp, Mus musculus
cactgcaatgaacatttgcaactgaagatgtgtggacagaggaatataccgtgggacacactgtgacacactgagacatacaacagcttccacaatgagatgttttctatgctttg

SEQ ID NO: 88701 - DNA, 126 bp, Mus musculus
ctcctatctctatcttttcaaacatttgaaacatttaagatctctctgggtctctgtctgcctctgtgtggtgtgtgtgtgtgtgtgtgtgtgtgtgagagagagagagagagagagagagagaac

SEQ ID NO: 88702 - DNA, 89 bp, Mus musculus
ctggtgacagtcaagatagtctcctctgtgggtgctgctaggaggcagcgcagcaggtggccaaaggacggaatcctggctctagccgg

SEQ ID NO: 88703 - DNA, 99 bp, Mus musculus
cttgcttagacaactagtaggagcccagaaatttgttaatgagtcctaaacttgtgaattaatttatggtttcttagctttacagttgtgttacatgag

SEQ ID NO: 88704 - DNA, 107 bp, Mus musculus
ttgatgtgatgtgaatttatagaaaagtgtattgtcaagtttatgagacacaaaatcaagactgagagcactgacagttttttaaaatatattttctatcatatgga

SEQ ID NO: 88705 - DNA, 80 bp, Mus musculus
ccattctgtgagaaaacactgtggacacatctgcatgtatacccacatagatgttttcctgttttctgaattagggttgg

SEQ ID NO: 88706 - DNA, 102 bp, Mus musculus
gaacagtgatgtgtaagcagtgctattgtcctttgttatcatgaccaagaattatgtgttgaacagaactgagtgtgcacagactacattcacgggcagttc

SEQ ID NO: 88707 - DNA, 74 bp, Mus musculus
tcaacgtcagattttgaggaggacatggggggccatggagaaaggtcatctgtcattctgtcattctgtcttga

SEQ ID NO: 88708 - DNA, 67 bp, Mus musculus
ttttgtgtgtgcatgtagtatgtatgtatgtatgtatgtatgtatgtatgtatgtatgtcaccaaga

SEQ ID NO: 88709 - DNA, 110 bp, Mus musculus
tggctgccatgataaagttctcaacctgtgtctctctccctgccactgctgacaggagacagtacagagggaccagaaaaaggctggagaatgttaacaagtgataacca

SEQ ID NO: 88710 - DNA, 83 bp, Mus musculus
gatgacgtcatgtgtttgtagtggaagcgaagtcactgcaaggattgctggtgtttgtttacagttgagactctggtgtcatc

SEQ ID NO: 88711 - DNA, 73 bp, Mus musculus
tcagtgctggtgacagtctgtctctcacaacgttgtcatattttggagccatgtgactgagacccagctttgg

SEQ ID NO: 88712 - DNA, 114 bp, Mus musculus
tcgattgtaatagaacattgctgaggataaaggaaaagacaacaccaagagagtgggtagtttcattctcactgtctcccaatctcccaacagaatgctgatcttgctgctaga

SEQ ID NO: 88713 - DNA, 115 bp, Mus musculus
gtctgacatctgatctttatgtgcctcctgttctgtctggttttatgtgtccacttgacacaagttagtcaccagagaggaaggagcctctgttgaagaaatgcctccgtgagat

SEQ ID NO: 88714 - DNA, 105 bp, Mus musculus
tatacactcacacacatatatatgtgtttgtatagtcatgctacatatatatacatatatagtcatatatatatacactcacacacatatatatgtgtttgtata

SEQ ID NO: 88715 - DNA, 86 bp, Mus musculus
gattatatatatatatatatatacatacacacatacatatatatatacatatatgtgtgtatacatatgtatatatatacataatc

SEQ ID NO: 88716 - DNA, 107 bp, Mus musculus
tgtctgtgatacaaatccactgtgatctttttctgtctctatctgacaatttcctctgctatctggtggtcggtcagactattggttactgttgtttgactgcagca

SEQ ID NO: 88717 - DNA, 75 bp, Mus musculus
ctttcacatgtgtgtgtgcacacatgagcatgaaagtatagtatatgtgcatgtgtgtggtcataggtgtggagg

SEQ ID NO: 88718 - DNA, 65 bp, Mus musculus
gccctgctctgaggtgcagtggtacacacgactctgtctgtctgtctgtccatctggagctatgc

SEQ ID NO: 88719 - DNA, 69 bp, Mus musculus
gatctttccattgcaatccatagtagtatcaaaattacagttattgggtagcaacaaagggggggggtc

SEQ ID NO: 88720 - DNA, 115 bp, Mus musculus
aagagctttaccattgaagatatttatattgtagacaatgttttaatttttaaaatttatttttgaatggaagaattaaaaatatagatatgtaatcatgaatggagagggtttt

SEQ ID NO: 88721 - DNA, 117 bp, Mus musculus
ggtggtgggaaagaaattagtcaaatggtttggaatatagagtgtgaagacacagagcatgaaattcaacggcccagtccccagacatcattttccaagtgcagattgtcctctgcc

SEQ ID NO: 88722 - DNA, 64 bp, Mus musculus
tgtgtatgtgtatgtgtatgtgtatatgtatatgtatatatgtatacacacatacacacacaca

SEQ ID NO: 88723 - DNA, 64 bp, Mus musculus
ctcagtgatgtattgtgacctttgccttggtgagagaggacagagaacagtgctcatgtgtgag

SEQ ID NO: 88724 - DNA, 68 bp, Mus musculus
gtgttgttgttgatgatgatgatgatgtggttgttttatcacattccaaaggatcatgaactctgcac

SEQ ID NO: 88725 - DNA, 72 bp, Mus musculus
tgagttcacgggtctgtcctcagggagattagtaggaactagagtgaccctttggatgactagtgatattca

SEQ ID NO: 88726 - DNA, 163 bp, Mus musculus
atatacatatatacatatatacatatgcacatatatgtatacatacatgtatacgtatatatgtatatatatacatatatgtgtgtatatatgtgtgtgtgtgtgtgtatatatatatatatatatatatatatatatatatatatatatatatatatatttg

SEQ ID NO: 88727 - DNA, 76 bp, Mus musculus
atgtatatatatacatatatacgtatacatgtatgtatacatatatgtgcatatgtatatatgtatatatgtatat

SEQ ID NO: 88728 - DNA, 109 bp, Mus musculus
gcgcagcaaggggctgcctgcattgagctttgtcgaggaatcacctgtaagtcttcttgactcacaggcactcagtaagtctagatgcagctggagtcctgtgttgggc

SEQ ID NO: 88729 - DNA, 115 bp, Mus musculus
ggctgcttagtttctaataagaaaaatatgcatgctgtcactctgagtcactttgtggacaggtttcatcagactgggtttgacagtgcgcacatgcaaggtgttgtctgggccc

SEQ ID NO: 88730 - DNA, 106 bp, Mus musculus
gctgtcctgaggaagccaagcccatagatgctcaaaaatgcaacaccacttcgggcttagcgtctgtgagtctgtctatctgcttgtctgcctcaaataaacctgc

SEQ ID NO: 88731 - DNA, 78 bp, Mus musculus
tgggaacagtgtctctggctccctgttataacctgaattacaatgaaggatgaacccactgaggtgagccaggtccca

SEQ ID NO: 88732 - DNA, 141 bp, Mus musculus
ctttggcaggggcattatgatagctcagtgttactgagactttaggggattgtaatggaacctgacagaagtaagaatggacttaggtatgagggagccttcatagcaattctaaactctgtaggtaatagcaagcctttg

SEQ ID NO: 88733 - DNA, 91 bp, Mus musculus
tgtctatttatttacttactgccaagtgtgtctctgtgtgcctgtgggcacgcatgtggtacagttgcctgtatgaaggtcagagtacaca

SEQ ID NO: 88734 - DNA, 103 bp, Mus musculus
gctcacatacatttctacacacacacatccaggcccacactcactctgccagaaggaatttcgagcagctgttggaagggttagagtagagatacccatcggc

SEQ ID NO: 88735 - DNA, 116 bp, Mus musculus
cttgtcaagaatccacctctatggggctggaagagatggctcagcggttaagagcactgactgctcttccgaaggtcctgagttcaaatcccagcaaccacatggtggctcacaag

SEQ ID NO: 88736 - DNA, 63 bp, Mus musculus
tgtatgcatgtatatattcatataatacatatatatatgtatgtgtatatgtatatgcataca

SEQ ID NO: 88737 - DNA, 64 bp, Mus musculus
tatatgatgtatatatgtatatttgcatatgcatatgtgtatatatatgtatatatgtaatata

SEQ ID NO: 88738 - DNA, 75 bp, Mus musculus
ctgaaattgagatgacacacaagagcaggcacacggtccccatgctgatggcctttcagtcagtgtcactcacgg

SEQ ID NO: 88739 - DNA, 115 bp, Mus musculus
tcactggttagaggacagctcaagctgtagtgcagcttagtctctcacagtatcacagcggccctggaagaccttgtctcaaagcaaactacggaatgatggaactatacgagga

SEQ ID NO: 88740 - DNA, 76 bp, Mus musculus
gcaagtgtgcagtaactctctggctccctcaattcataacgaacaggagaggcctggaggtttgagcaagccttgc

SEQ ID NO: 88741 - DNA, 72 bp, Mus musculus
ttctttatgcaggagctatgttattatatatgtatatgatgtatataatgtatatggttatatgtatatgaa

SEQ ID NO: 88742 - DNA, 67 bp, Mus musculus
gctttctgagtggctctgtgcctccataccagcagggtgtctagcatattgcaggaattcaatgagt

SEQ ID NO: 88743 - DNA, 59 bp, Mus musculus
accctcagagtttctcagtcactgtactgtctacaatgacaagagatttctctctgggt

SEQ ID NO: 88744 - DNA, 78 bp, Mus musculus
ggtagaactggtgatgtgacagcagtgacaggtgagaaagaggcctgaagtcactggtggatcaagtcattgcccagt

SEQ ID NO: 88745 - DNA, 69 bp, Mus musculus
gggtgccatgggtgtcggggagaggccttggcagatactgctggagtctcacccacagacactgcactt

SEQ ID NO: 88746 - DNA, 67 bp, Mus musculus
gctggctcactcactctgtgccttgagcattctggattgctgcatcaaggacttgggtttagctagc

SEQ ID NO: 88747 - DNA, 114 bp, Mus musculus
tctgtactgcttgttgcctgaggctacggtgatatcctaattcatgacagccaccagaagacatgtctggatccaggatactattgtagtaaaggttgatgtccataccataga

SEQ ID NO: 88748 - DNA, 75 bp, Mus musculus
gccttattacagaggccaggctggcgtggcacgagaggatctcctccctcagtctctcagtctggaattgcaggc

SEQ ID NO: 88749 - DNA, 114 bp, Mus musculus
attgttacaaaccaagcatgtgaggctggagagatggctcagcagttaagagcactgactgctcttccagaagtcctgagttcaattcccagcaaccacatgatggctgacaat

SEQ ID NO: 88750 - DNA, 77 bp, Mus musculus
gaggggtggggtgggagggttggggggggtaagcttgaagaggaggagcaccgctctgtctgtctctctgagctttc

SEQ ID NO: 88751 - DNA, 82 bp, Mus musculus
tgccagccgcctgcttgcctgcctgcctgcctgcccctctttagcagcacagcagagttggtctttaagcactatgggggta

SEQ ID NO: 88752 - DNA, 84 bp, Mus musculus
ggcaactgtacctgccatctcacctgttccccaacacaaaagcactatgcactggaagggagagaagagtggcaccacagagct

SEQ ID NO: 88753 - DNA, 77 bp, Mus musculus
gagggcatagtgtctcttggaatcacaggcaattgtgaacagatgtgtgtgtgtattgagagtagagctctgtcctc

SEQ ID NO: 88754 - DNA, 86 bp, Mus musculus
gctcatcagttagatgcgttctgtgacagtttcatgtgtgtctggtacgttcttactgtcactgtgactctctctgacctccctgc

SEQ ID NO: 88755 - DNA, 117 bp, Mus musculus
ggccactaaataacgctccagggatgcccacagaactgctcgaggagatagatgtctgcgtgtagccagtctcccagggtcatcaaatccctcagccaagaatttatttgaatgtcc

SEQ ID NO: 88756 - DNA, 83 bp, Mus musculus
tctcctgtgtgtgtgtctgtctgtcattcatccacgctttgtccacccgagtcgagagaccccgttccacgcagacacaggga

SEQ ID NO: 88757 - DNA, 66 bp, Mus musculus
cctgggtaatcggacactgagttggttttgcttggttcagactgtgactctgtgactgtgccctgg

SEQ ID NO: 88758 - DNA, 68 bp, Mus musculus
gtctgtgtgtatgctcacgtgtgcacatatgtttgtatatatgtgtgtgcatgtgtacatgtgaaggc

SEQ ID NO: 88759 - DNA, 77 bp, Mus musculus
gtatatgtgtttgtatatgtgcatgtatgtatgtatgtatgtatgtatgtatgtatatgcttatcttaccaatgtac

SEQ ID NO: 88760 - DNA, 85 bp, Mus musculus
gtccatggtggtctgataggatgcaagggacaatttcaatatttttgtatctgttgaggcctgttttgtgaccaattatatggtc

SEQ ID NO: 88761 - DNA, 163 bp, Mus musculus
tatatatatatatacacacatatatatgtacatagatatatgtatatatctttatatatacatatagaaatatctctatataaatatatgtgcatgtatatatgtatgtatgtatgtatgtatgtatgtatatacatatacacatatgtatgcatgcatgtat

SEQ ID NO: 88762 - DNA, 89 bp, Mus musculus
gagttacttgagggactggagaaactcaagagcactgactgctcttccagagatcctgagttcaattcccagcaaccacatggtggctc

SEQ ID NO: 88763 - DNA, 95 bp, Mus musculus
tgtcccaatgatgagcattaatgggcccaggcttctgatataatcacagctgctgagtgttcagagagagcaaaaacccactcattcctggatca

SEQ ID NO: 88764 - DNA, 79 bp, Mus musculus
agggaaggttgtggtagttgcttctttcatccctatgaacaaatacctgacaagaagcaacgagatctgttctgtccct

SEQ ID NO: 88765 - DNA, 90 bp, Mus musculus
cgtatgggtgctttacctgtctgtctgtctgtgtgctgtgtacatgcaaggccttcagaggccagaagaggacgtagatcccttggaacg

SEQ ID NO: 88766 - DNA, 79 bp, Mus musculus
gctagctctgtcactgtagcttgtgaggcctaggtgatgtgcaagcctggctttacatacatccaccatgacagttagc

SEQ ID NO: 88767 - DNA, 78 bp, Mus musculus
gactggagtttggatcccagcatccagataacaagccaggtatctctgaaaatgtctgtgaccctgactcccagagtc

SEQ ID NO: 88768 - DNA, 86 bp, Mus musculus
tctagggcagaattccaaagaggctttgtgtacagatcattaacctttaacccataatttcacaggcagctttgttttgcttcagg

SEQ ID NO: 88769 - DNA, 76 bp, Mus musculus
tatatgtatgtgtgtgtatatgtacatgtatatatgtatgtgtatgtatatgtatatgtgtgtatgtatatgtgtg

SEQ ID NO: 88770 - DNA, 73 bp, Mus musculus
ctgtctgcctgtctgtctgactgactgtctttctcaaatattggacatcatacccaggtagaactgcagccag

SEQ ID NO: 88771 - DNA, 74 bp, Mus musculus
atgttagataatactatagtaaatgacatgggtgttctgaaccctgtgtctttgctgtctgtagagtctgaggt

SEQ ID NO: 88772 - DNA, 118 bp, Mus musculus
gacagctgcagggagggcccaccaacactcctggaactccaacctgagcatgaatttgactgtgagctgtcaggaatccagtcaggtgctcaggcaggactgtgggcttagcagaatc

SEQ ID NO: 88773 - DNA, 77 bp, Mus musculus
atagatgtacagaggctagagttgacctcaaatgtctttctggattgctgtcaacatctgtctgtctgtctgtctgt

SEQ ID NO: 88774 - DNA, 112 bp, Mus musculus
gctcaattcttcaacagcatcacgggtggtagtatggaggagtggctgcagggagatgagactgaagactcagccgcaccttcattcatctctcctgagtgttcagaacagc

SEQ ID NO: 88775 - DNA, 130 bp, Mus musculus
gtcttatggggagagaggctatcttcagatcttttgaaaatgaaggcgggatgtgtaaagtactgaggatgaagctctttgaggagaaggcagctgagtctgtcattcactctgacaaggtttctcagtg

SEQ ID NO: 88776 - DNA, 76 bp, Mus musculus
tacagctctgtcactgtatctgactccccataataaacttatggcagttgctgacacgtgaccccatggggatgta

SEQ ID NO: 88777 - DNA, 108 bp, Mus musculus
ggccctctacatccagacatgagttaaagataattttctatttatatgtgtgtgtaaacacacataacacatacagaagttttttcctcaagatccaggacgacagtc

SEQ ID NO: 88778 - DNA, 89 bp, Mus musculus
gggcaaaaaatgggggcttacatttaagagaaaatagcaagctctggcaactgacttctctatctctctgtacactagagcccctaccc

SEQ ID NO: 88779 - DNA, 95 bp, Mus musculus
acacaagtgtgtgtgcatatatatatatatatatatatatatatatatatatatatacacacatatatgtgtatgtatatatatatgaacttgta

SEQ ID NO: 88780 - DNA, 98 bp, Mus musculus
gcctgggtgtatgtgtggactcacgtgtgagagcacacgtgagcatgttagtgagtgcatgtgcatgcatatgtgggggccagaaattgacatcaggt

SEQ ID NO: 88781 - DNA, 96 bp, Mus musculus
tgtgtgtgtgtgtgtgtgtgtgtccagctgtttgtctgtctgtgtctctgtgtatgatgtggcaatgtggcaggggtctatcaccactctgtgcca

SEQ ID NO: 88782 - DNA, 99 bp, Mus musculus
tgagtccaagaaaagcagccagtttctgtcggtgtctctgtgggttctcatggattttgcatgtggacaccaggcacgaaacttggatgtcactactca

SEQ ID NO: 88783 - DNA, 69 bp, Mus musculus
gaagcaccagaagatgcgatgtttgatgaggactcagtctccctgtctcactgggcttgctggtgcttc

SEQ ID NO: 88784 - DNA, 65 bp, Mus musculus
tcttgacttttcttggttttgagacacggtctctcactgacccaaaactctccaagaagagtaga

SEQ ID NO: 88785 - DNA, 116 bp, Mus musculus
tgattgcttgcataaatatatatatacacacacacacacttatatatacatgcatgtatgtatatttatatgcatctgtatatatgtgtgtatttgtatgttattgatatgtttca

SEQ ID NO: 88786 - DNA, 64 bp, Mus musculus
caggttatcaacttcagaagtcgtggggcgtgggaagccacactctgacactccctgttgcctg

SEQ ID NO: 88787 - DNA, 61 bp, Mus musculus
atgggataggtctcaagttagactggttattggttggccagtctctcagtctctgttccat

SEQ ID NO: 88788 - DNA, 134 bp, Mus musculus
agatttgcttccttcccttacagatggtactttcagtttctgattatacgtgtatctatgtgtgcatgtgcatctaagtgaaggtgcctgtgcaggccagaagagggtgtcagatctccaggagctgaaattat

SEQ ID NO: 88789 - DNA, 106 bp, Mus musculus
gtctattgcttttgggggagggaggggtgcattgttagcatagatggaaaatttttatttaaactatgcatgtatatgcatacataaacttacatgtagtatagat

SEQ ID NO: 88790 - DNA, 85 bp, Mus musculus
gcatcactaaggtgaaatcttctgggatgtgagagtacagagaagctgtgtttcagaggcagctatggttttacctcgtgttggc

SEQ ID NO: 88791 - DNA, 79 bp, Mus musculus
acactcttctggatttgttgtgatgatgcccacccaggcaaccacatttggcacatttgcagatgtagacctagagagt

SEQ ID NO: 88792 - DNA, 71 bp, Mus musculus
atgtatgtgtatatacatgtatgtgtgtgtggtgtataagtatgtacgtgtgtgtgtgtgtgtgtgtgtgt

SEQ ID NO: 88793 - DNA, 119 bp, Mus musculus
ggcttgaatccttttccttcaggggttaactgagggctctgtgtgtctgtctgtgtatgttgctaaggtcaccatggctgacagggctgccgctgaaagggcctgcaaggatcccaacc

SEQ ID NO: 88794 - DNA, 77 bp, Mus musculus
gctgcaaaatatatattgatatatactatatctatctagataaagatagatatcgtaggtaattttttcattgtggc

SEQ ID NO: 88795 - DNA, 74 bp, Mus musculus
aagattccggtttgttgcgtctttcctggccggtcgcgagaacacgtgtaagacacacacactctgagagtttt

SEQ ID NO: 88796 - DNA, 117 bp, Mus musculus
aactgaaggctccccaccccccaccccaccccgtatgttgttctaaatgtttgaaagtatttaatttggaaccttacttttaagtatggcatgaagtggggattcattggttgtttt

SEQ ID NO: 88797 - DNA, 86 bp, Mus musculus
gccaagcttaaggccctgtctcagtcacttgctctgtttaaatacctaataagagcaattgcaaaaaaggatggatttattttggc

SEQ ID NO: 88798 - DNA, 114 bp, Mus musculus
ataatgctgattaatttctgtctgttgtagatgagaagaccttggcagctatatcatattatatttaagtcatctctaaataatcaaatgaacagggtctattttgagtattgt

SEQ ID NO: 88799 - DNA, 83 bp, Mus musculus
gtgggtagatggatggatggatagacagacagacagacgtatgccatctgtttgtctgtctatctatctatctatctatctat

SEQ ID NO: 88800 - DNA, 91 bp, Mus musculus
agtgcgttgtgaggtgtgtgtgcacacagccaccaacagcatggcttgtccgcgtcactgtctctgacacacatacttgaaataccgctct

SEQ ID NO: 88801 - DNA, 59 bp, Mus musculus
ggtgggggtacagagtagtgtccacccctttcctgaagactggctctgtctctcccact

SEQ ID NO: 88802 - DNA, 105 bp, Mus musculus
atatatatatatatatatatatgtatgtatgtatatgtatatgtatgtatatgtatatatatacatatacatatgcatatacatatatatatgtatgtatgtata

SEQ ID NO: 88803 - DNA, 96 bp, Mus musculus
atacatacatatatatatgtatatgcatatgtatatgtatatatatacatatacatacatatacatatacatacatacatatatatatatatatat

SEQ ID NO: 88804 - DNA, 62 bp, Mus musculus
gagacacagagacagagtttttttttttttttaaagaaagatttctggatgctttgtttctc

SEQ ID NO: 88805 - DNA, 103 bp, Mus musculus
tatatgcatgtgtgtatgtatatgtgtaagtgtgtatgtctgtgtgtgtatgtgtgtatatataggtatatgtgcatattatgtgcatatgtatatgtgtgta

SEQ ID NO: 88806 - DNA, 70 bp, Mus musculus
tcacgctgagcttcaggttcgctacagtacttgtacatactgtgtgtgtgactctgtgtgtgactgcgga

SEQ ID NO: 88807 - DNA, 86 bp, Mus musculus
gaagtttgggctgtgtggtcaccatttttattctttgactctctgtctctaatgatagcagtggagagatccgctctaaaagattc

SEQ ID NO: 88808 - DNA, 124 bp, Mus musculus
agttttggtttttgtttggctgttttttttgtttgtattttttaagtcacggtgtctctctgagtccttggctgtcttagaacttcctttctagaccaggctggcctcaaactcagagatccac

SEQ ID NO: 88809 - DNA, 116 bp, Mus musculus
gtctgtcgctgctggcctgtgcatgcttgtgtgtgcactggctggggcgctcgatcactcactcactcgcacgcacgcacgcacgcacgcacgcacgcacgcacgcacgcacacac

SEQ ID NO: 88810 - DNA, 102 bp, Mus musculus
acaagaggccattcacagggtaagagtgactggggtggacatgggctccctgaggcctgttctctctctgtgttatattatatcacaggcatgttctcttgt

SEQ ID NO: 88811 - DNA, 100 bp, Mus musculus
cctctattgctctctaccttgagtatgtatgtatgtatgtacgtatgtatgtatgtatgtatgcatgtatttgagattgagtctcactatgtagtcaagg

SEQ ID NO: 88812 - DNA, 81 bp, Mus musculus
cgctgaggtgttccgctttcactgtgtccctctctgcctctgcaagctgtggcaagatcacaggggccagtcacttcagtg

SEQ ID NO: 88813 - DNA, 99 bp, Mus musculus
atacacatataattgaatgcatgcatgtttatatacttgtttatatgcaaatattcatgtttacaatacacgtatatgtaagtgcatgtatgtgtgtat

SEQ ID NO: 88814 - DNA, 83 bp, Mus musculus
gctggaggaggtttgtttctggggctgagctttgaggtttcaaaagcccacagcaggtccagactcatactctctctgcctcc

SEQ ID NO: 88815 - DNA, 78 bp, Mus musculus
gtgtgtatgtatgtatgtatgtgtatatatgtgtgtatgtctgcatgtatgtatatgtgtgtgtatgtgtgtacacgc

SEQ ID NO: 88816 - DNA, 98 bp, Mus musculus
cctctctgacaacaccactgagcaagtctctgataagaaactggagaaggatgtgcagtctttgagaagagagtctgctcagaaaaggtactgagagg

SEQ ID NO: 88817 - DNA, 111 bp, Mus musculus
tatagtatgtatatgtatgtgtatgtatagtacatgtatattataggtatgttatatgtatattatatttatatattatatgtatattatatgcacattataagcatacta

SEQ ID NO: 88818 - DNA, 119 bp, Mus musculus
ggtccggacggtggccgggtgtctgtggcccgaaaagtgtgctgtctcagcggctctgtgcctctgcctgtcccagaagctgtccggttctgtggtgcaccctctcacctgttcagact

SEQ ID NO: 88819 - DNA, 88 bp, Mus musculus
tccctatcagatgacagtgtgcacagcagcccggagttaaaggaaacattgaagcaaagagcaagctgtgactgacagctgatatgga

SEQ ID NO: 88820 - DNA, 79 bp, Mus musculus
ggatggtaatgatatgtcatatgtttaattttctttccagattgaaagtcatttaaatatttatatctcagggccaacc

SEQ ID NO: 88821 - DNA, 92 bp, Mus musculus
cttaaccagaaagtcaccaaagagaactaactcttaaaatgtatgaaaggatgtggtagttagttctctacaattgatggtttctggtgggg

SEQ ID NO: 88822 - DNA, 164 bp, Mus musculus
gcatattttctcagcttaaatatatatacatatatatgcatacacatatatacatatgtatatatgtgtgtatatatgtgtatatatatgtgtgtgtgtgtatatgtatatatacatatgtatatatgtgtgtgtatgtatatatatgtgtgtgtgtgtgtata

SEQ ID NO: 88823 - DNA, 87 bp, Mus musculus
tgtatgtatattatatatatgtacatatatatatacacatatatatgtgtgtgtgtatatatatgtgtgtgtgtgtgtatatatata

SEQ ID NO: 88824 - DNA, 83 bp, Mus musculus
acacacccctctgagagatcagtgtgtggactccttcagtaggaagagtctatgatgcaccatgagctgtcctttctttgtgt

SEQ ID NO: 88825 - DNA, 118 bp, Mus musculus
aagtctgtgccaagtcattttgactgaaccgtaggtctgaaaaggtaccagctctgactcgctgactggctgacctcatcaggaaatcatggagtaggaggatgtcttggaagcttgc

SEQ ID NO: 88826 - DNA, 92 bp, Mus musculus
ttacaagtcatgacaaagccctgacagaacccaagggacaggacgactctctcattctttgtgtctgtccagagctgctgttctcattgtaa

SEQ ID NO: 88827 - DNA, 99 bp, Mus musculus
aaagtaaaagcttaagagagtgagagtttagagagtgaggagggaccaaatagcctctcttataggagctgtgttatcttactgttgctagataacttt

SEQ ID NO: 88828 - DNA, 107 bp, Mus musculus
gcatagagaccagtccttttcccgtattgatcttttgggctgtgatttctgagtcactcagactcatacttgactgtactagactgtgaatggctgtatcattatgt

SEQ ID NO: 88829 - DNA, 71 bp, Mus musculus
gggggaagtgtggttacaggagacagggtactatgcacacccagtttgtctgtcctctctctcactctgcc

SEQ ID NO: 88830 - DNA, 110 bp, Mus musculus
ggagaagatgctgcctggtgtctacagagactggcagagcgcatgcaacttttactttgccacgctcactgtctgcctctgctctctgcaagaaggaaggagatttatcc

SEQ ID NO: 88831 - DNA, 99 bp, Mus musculus
ctctcttaaagcttctgtcttattcttcaatggttttattatttaattctgagagagagagagagagagagagagagagagagagagagagagagagag

SEQ ID NO: 88832 - DNA, 102 bp, Mus musculus
gctatctctcatggtacctcaggcatcacagttgctccacgcatgtttggtgatgggatggcactggcttctgatccatggtgatcaatccatggagattgc

SEQ ID NO: 88833 - DNA, 116 bp, Mus musculus
tctcaagttgaatttgctattgatgcaggtgtccaatgagcacgtaaatttgaaatgtatgtatatatcatatttaaagtctttgttcctcaccaatcgaagtatctcaaattaga

SEQ ID NO: 88834 - DNA, 111 bp, Mus musculus
ttgcatatttttcttgtttctttattgtacgagtcataaaatgtaaaaggtgtttctcactcacactgaaaataattttacgacatgtgcagctgaggcgggtggtggtgg

SEQ ID NO: 88835 - DNA, 90 bp, Mus musculus
gttgggagggatcactgtagactgagaacacagctcctccccgaaggaagatgactatgtagctctctgtttgcagagatgctttgagac

SEQ ID NO: 88836 - DNA, 98 bp, Mus musculus
tgtttctcttatagtatttgaggttatggtaattatgtgtaaaatgtactgaatatatgaatataattacaaactgatgtaacttctatagaggcgca

SEQ ID NO: 88837 - DNA, 82 bp, Mus musculus
tcaggatgtggcaaaggcctgttcctcttgacagcccaacgtcattttaaatctctcaggctctcgcacacatcatgtctga

SEQ ID NO: 88838 - DNA, 92 bp, Mus musculus
atgtgtgtgtatgtgtgtatgcatatgaatgtgtatgtatatgtgtacatgtgtgtatacatgtacatgtgtgtgcatatatacgtgtatat

SEQ ID NO: 88839 - DNA, 116 bp, Mus musculus
cacttttatagttcctagttgaatttggccagaagatgtgatatgatctgaagtacagtagactttttcttcttgtatcaaggtcaaaacaggtggctggtagctactaaatgtga

SEQ ID NO: 88840 - DNA, 120 bp, Mus musculus
ttgcctcccgagtgctgggattaaagatgtaattcagggctggagagatggctcagtggttaagagcactgactgctcttccgaaggtcctgagttcaaatcctagcaaccacatggtgg

SEQ ID NO: 88841 - DNA, 200 bp, Mus musculus
acatatgtatatcattatatatataattatcattatgtatataatataatataatatataatgtatatatctgaatataatgtaaatatgtatgtattttatcattttatgtatgtgtgtaaatatatgtatatatgtatgtgtatatacatatatgtatatttataatcatacatttatgtatatgtatacatatatat

SEQ ID NO: 88842 - DNA, 114 bp, Mus musculus
gactgtgtgtgtatttctgtgtgtgcaagcttacgtgtgtgtaggtgtacacatgtgtctgtgagtgtgtgagtgtgtgtgtgtgcacacacccatgcccatgcgccctgagga

SEQ ID NO: 88843 - DNA, 96 bp, Mus musculus
aaacctgcatggcttgctctgctcagccctgtctccctgtgagagtctctgcactggtccagggcccctcttcctgtaggctcacagggtttcagg

SEQ ID NO: 88844 - DNA, 69 bp, Mus musculus
ggtagaggcaggtgaggacgctggagctgcctcccatcctgcaaagctctgcctgcctgcctgtctgcc

SEQ ID NO: 88845 - DNA, 75 bp, Mus musculus
gatataacagacatgcagaggacctggtgcagacccatgcaggccgtttgctctctgcttctgtctctgtgaatc

SEQ ID NO: 88846 - DNA, 103 bp, Mus musculus
aatgggttcctaggaagaggtagtaggttgcatagttttagggcagagattttgcccacaaggagttaactatacgacctgctgcctttcttagggccttatt

SEQ ID NO: 88847 - DNA, 96 bp, Mus musculus
ctctatcagagtgaggtagtagattgtatagttgtggggtagtgattttaccctgtttaggagataactatacaatctattgccttccctgaggag

SEQ ID NO: 88848 - DNA, 91 bp, Mus musculus
gtgatgctcagctgtgattactttcaacattcaccctggatgttctcttcactgtgggatgaggtagtaggttgtatagttttagggtcac

SEQ ID NO: 88849 - DNA, 91 bp, Mus musculus
cttgcaggctacagtgggggcagagagcacacagtggggagtctgccttacttggtgtcttcaacagttggcgtccacaatgcttttcagg

SEQ ID NO: 88850 - DNA, 77 bp, Mus musculus
ggaagctcacaactgtctgtcattccagttccaggggatctgacaccctcacacagacctacaggcaggcaagcccc

SEQ ID NO: 88851 - DNA, 96 bp, Mus musculus
gcatataaacatatgtgatatgtataacttgtatatatatatatatacatatattatgtacatggtcatatgatatgcaatatgtatatgtgtgtg

SEQ ID NO: 88852 - DNA, 82 bp, Mus musculus
atatatatacacacatacacacatatgtatatgtatgtatatacacacatatacatatgtgtgtatgtatatgtatatttat

SEQ ID NO: 88853 - DNA, 96 bp, Mus musculus
gatcagccttagtctgtggtgatctgataggatgcatcagataatttcaatatttttgtatctcttacggcctgttttgttaccaattatatggtc

SEQ ID NO: 88854 - DNA, 76 bp, Mus musculus
gtgcgtggctgtttgcctgtctgtatgtctgtgcaccagaagagtgattcaagatggcaacctctgcgccccgcac

SEQ ID NO: 88855 - DNA, 65 bp, Mus musculus
tcatgtgtgtgtgtgtgtgcatgtgcatattttatgtgttttggcacatactactgtgtacggga

SEQ ID NO: 88856 - DNA, 85 bp, Mus musculus; identical to SEQ ID NO: 57439

SEQ ID NO: 88857 - DNA, 116 bp, Mus musculus
gtctgtctctctcagctggcctctcacccagaaagtactcactctgtgtctctatgatcagggattactaatgccctgagctgcccttcagggtgggagagtagaatttgacaggc

SEQ ID NO: 88858 - DNA, 81 bp, Mus musculus
cttggtaaaatggttgggcctggggtgggggcggggactgccgctttttctctcacacagactcatcttcagggacccagg

SEQ ID NO: 88859 - DNA, 119 bp, Mus musculus
cactatggttagatttcgtttgtaccttttgtgtatgcatatttatgtgtatgtatgtatgtatgtatgtgtacatgtgtgtgcatatgcttatggtggctagatgtcaaaaccaggtg

SEQ ID NO: 88860 - DNA, 64 bp, Mus musculus
gcctgcctgcctgcctgcctgcctgccatagtggttagtagggagcaaagaggtcagagaaggc

SEQ ID NO: 88861 - DNA, 77 bp, Mus musculus
acagaaacatctggatgctgcctaactaagcttacacatctgtaggcttctgtgtgtgtatctgtctgtctgtctgt

SEQ ID NO: 88862 - DNA, 116 bp, Mus musculus
ctcactgtgttgtgcctctaatcctcgttttatttgtgtatgtgcgtgtgcatgtgcatgcatatgtgtgttcagatgcatgtaggtacctagaagaggccaaaagagggcgtcag

SEQ ID NO: 88863 - DNA, 93 bp, Mus musculus
ctggaagcatgaggtggtggtccctaaggatgctctattcacccttgtggtctgtgaagagagtctgcaggcttcctaatgcctcatgcccgg

SEQ ID NO: 88864 - DNA, 121 bp, Mus musculus
ctggattttgctgtcagtggcttttacactccagttctgggtctttctgctctcaactcacagaagagagagtccacagtcccaaatgccctgggtagacctctgaggagccagacttatc

SEQ ID NO: 88865 - DNA, 106 bp, Mus musculus
gtttgtgtgctgcagaacaaaatacagttttcatgttttttataaatctaaaacgtctgaaaaataaatgcaccagaaaactgactacgccagcatgtacccaaac

SEQ ID NO: 88866 - DNA, 81 bp, Mus musculus
agaagagtgttcatagttcaagttcctggtctgggaagtctgaaatcctggccatatttgagtctgatgtttgctatttct

SEQ ID NO: 88867 - DNA, 87 bp, Mus musculus
tgctgtaagagctgtggcattgtaggtgggccgtgggcacacacagttgcctgcctgcctgcctgcctgcctgcctgccagcactct

SEQ ID NO: 88868 - DNA, 103 bp, Mus musculus
gataaaactgaataaaaggtggggagggaagcagaaagatagctattgctgccattcattctgtctgtctctgtctccttactttgcttccttcctgcttatc

SEQ ID NO: 88869 - DNA, 78 bp, Mus musculus
aactgccctcagcagggggagagagacacacacaataaatgaatgagtttgtctcaatctctcagtctgaatcatgtt

SEQ ID NO: 88870 - DNA, 84 bp, Mus musculus
tgtctggtgcctgtctcgctctgtctctaacaatggagtcttcctacttaagatgcatggagctacacagagatggaccggaca

SEQ ID NO: 88871 - DNA, 101 bp, Mus musculus
tctgagaaaggttcccaagattttacacatttatgcatacatatatttatatatgtagcctttgagaggtgtcaggacagggcctcactttgtagcttagg

SEQ ID NO: 88872 - DNA, 79 bp, Mus musculus
ggcaaacctcattgtacttcagaagattcatagccaggagagattctatgtatgtactgagtgtgcacaggcctttgct

SEQ ID NO: 88873 - DNA, 102 bp, Mus musculus
tgaggcagaagcaatgctgaacttatcctgctccatcactgtaggacagaaaacactgtgctgaaagataggagcaggaaccaggaagcagctcctgcctgg

SEQ ID NO: 88874 - DNA, 96 bp, Mus musculus
agagatggtggtctaccaggatatcttatagcttgagtatgggtgagctcagatctgtgtgtatcttcctgagacaattacctagtaccatattct

SEQ ID NO: 88875 - DNA, 98 bp, Mus musculus
tccaatatcctctgcttgctagggtccaggcttcataggggtcaggacctcggttcacacatcttctactttgccttgggcctcttgaggattagcga

SEQ ID NO: 88876 - DNA, 72 bp, Mus musculus
tgtcctttgaaatctgcagtgagacaaggatgtctgctctctacattcttatccacttagagccaaaggaca

SEQ ID NO: 88877 - DNA, 85 bp, Mus musculus; identical to SEQ ID NO: 68432

SEQ ID NO: 88878 - DNA, 85 bp, Mus musculus; identical to SEQ ID NO: 70941

SEQ ID NO: 88879 - DNA, 107 bp, Mus musculus
atggagcaagcattactgcttgccaaggttccaacaagactgagacacaggctgcagctgctgtcattctgtctgtcactttggggtttggtctgtgtgtgctgcat

SEQ ID NO: 88880 - DNA, 72 bp, Mus musculus
agtccgtgttgccagggttggtttgcagttggtaatgatgtctgtgtccctctctcagtggtagagcaggct

SEQ ID NO: 88881 - DNA, 78 bp, Mus musculus
atgtccccaccgagcaagcactcaatgtgttcctgaaactggagaagaggaacacttgtgtgttagatctgagtccat

SEQ ID NO: 88882 - DNA, 117 bp, Mus musculus
gcatcacccacaagaacactgtctacttaccaggggctctcagagaaatctcggagaaaactgtctctctctttctcccggcagcctccgtagtgccacagggttgggactgtgtgc

SEQ ID NO: 88883 - DNA, 62 bp, Mus musculus
ttgcattctctgtctgtgtctgtctgtgtgtgcaccattcttagacagatacttgcatgcaa

SEQ ID NO: 88884 - DNA, 94 bp, Mus musculus
gtatgtgtgtttttcatgtgtatataggtgcctgtgtacatgtgtgtatgttcatgtgtgtgcagttgcctgtgcacatgttcgagtggaggtc

SEQ ID NO: 88885 - DNA, 84 bp, Mus musculus
gacatggaacgctcaaccatgctctctggctgactgcctcagcttccccagtcgagtgtctgctagatgtgagtggatggtgtc

SEQ ID NO: 88886 - DNA, 117 bp, Mus musculus
ccaaagactagggtatatcatactgccttgagaagcctgtccctggtgcctatgagaaaacactgagcacacaacgattgcagccaaggacagaactgaggtactatgttcacatgg

SEQ ID NO: 88887 - DNA, 81 bp, Mus musculus
ggatgtggaagtttcttttttaaagtgtatgggggagggcctcagtggctctctgatactgtggaggaggactgcacaacc

SEQ ID NO: 88888 - DNA, 61 bp, Mus musculus
tacagtgtcctcactattttggtgggagattagtgtctcactgtgtgagtgtcagactgta

SEQ ID NO: 88889 - DNA, 74 bp, Mus musculus
gctgtcagagacagctctccacagagtttgggaattctctttgaagctctttgtctgtctgtctgtctgtctgt

SEQ ID NO: 88890 - DNA, 77 bp, Mus musculus
gtaaatatgtagaattagactggacaagaggcagccctgtttatattgtctctctgtctgtaattgtatctgtttgc

SEQ ID NO: 88891 - DNA, 84 bp, Mus musculus
tatggctctgtgcttctcttcagatgaaccgaatcagaagcaccgaacagttcggaaatctgtaggagaaaagcatttgccatg

SEQ ID NO: 88892 - DNA, 80 bp, Mus musculus
atgcctgtaagtgtgggttacctgtgtcagtgtgtgtgtgtattcatgcctgtgagtgtgagttacctgtgtcagtgtgt

SEQ ID NO: 88893 - DNA, 86 bp, Mus musculus
gattgaactccagtctcagtttgtctgtccttagtgacatcatgccaactgactcattagaatggtgacagatggaaagaccaatc

SEQ ID NO: 88894 - DNA, 80 bp, Mus musculus
ccagtgtgtgcacacacagaaggatctctcacatcagtgtgaacacacagaagagctctcacatgagcgtgcacacatgg

SEQ ID NO: 88895 - DNA, 95 bp, Mus musculus
tgtgtatgtgcatgtgcatgtgcatgcatgtgtgtgtgtgtgtgtttgtatgtgtgtagctgtgtgtgtgtgtgtgtgtgtgtgtgtaaagagca

SEQ ID NO: 88896 - DNA, 104 bp, Mus musculus
ccagcttctgcccagaattgagctttggagatacacacacactggctgtttttcccaggtccgtgtgtgctcagctccacgctccagtctttgggagcagctgg

SEQ ID NO: 88897 - DNA, 96 bp, Mus musculus
ctgtgggtatctacaaccttgagagagacacacagagagacagtgtcttagctttcgttgggtggtttaccttaaggaatgacaaaaatgccccag

SEQ ID NO: 88898 - DNA, 68 bp, Mus musculus
acgtctctgtgtgtgtgtgagtgtgcgtgcgtgcgcgcatacgtgtgcatatgtgagtgtgcacaggg

SEQ ID NO: 88899 - DNA, 161 bp, Mus musculus
atgcatgcatgtttatgtatgtatgtgtgtatacatgtatgtatctatgtatgaatgtgtatgtcaatatgtgtgtatgtgtgtatatatgtatgtatgcatgtgtgtatgtatgtttgtgcatatatatgtatatatatgtgtatgtatgcatgtatata

SEQ ID NO: 88900 - DNA, 78 bp, Mus musculus
gtctgtctgtctgtctgtctgagggtagatttgtggacatgagtgaaggtgcccttaagccagagatgaagactgtac

SEQ ID NO: 88901 - DNA, 82 bp, Mus musculus
gtatgtatgtatgtatgtatgtatgtgtgtatgtatgtatatgtgtgtatatacatatatatacacacacatgtatacacac

SEQ ID NO: 88902 - DNA, 169 bp, Mus musculus
atacatatatatatgtgtgtgtgtgtgtatatacatatgtgtgcgtatatatatatatatacacacacacatatatatgtatatatatatacatgtgtgtgtatacatgtgtgtgtatatatatgtatatacacacatatacatacatacacacatacatacatacata

SEQ ID NO: 88903 - DNA, 70 bp, Mus musculus
tatatatgtgtgtgtgtatatatatatatatacgcacacatatgtatatacacacacacacacatatata

SEQ ID NO: 88904 - DNA, 72 bp, Mus musculus
agacggtgagagactgggaacacgtatgcctgtgtgcacacacgagtgtgtgtgttcagactctctacttct

SEQ ID NO: 88905 - DNA, 102 bp, Mus musculus
gcatccagagttaaacttgtaagagccagtcattttctctgagtctgaatgtgcctaactgtgaacacggggatgcaaatccagagagatgaccctggtctt

SEQ ID NO: 88906 - DNA, 116 bp, Mus musculus
actgtggagcttcatggggatctggagtaacttctgtgtgcttatactgtgttgtaatgaagtaagttgccaggcactgtgacagcaaaagtctacagatccttgacttctgctgt

SEQ ID NO: 88907 - DNA, 92 bp, Mus musculus
ttgtaaggagaaataacaggggctggtgagatggctcaatggttaagagcattgactgctcctccagaggtcctgagttcaaatcccagcaa

SEQ ID NO: 88908 - DNA, 128 bp, Mus musculus
cggactgagccactctgcccggctctgactgccacaggctggctgtgtgccactctgatctctctgtgtgtctttcacttttcctttctagagatagatttctgggtgagcagatgctgctgagagat

SEQ ID NO: 88909 - DNA, 116 bp, Mus musculus
ggtctggggtaagcagcttcctgggggtaggggaagtgactgggcaggtgatgtgtgggcctgcctgcctgcctgcctgcctgcctgcctgctcttctgattctgggtcttgggtt

SEQ ID NO: 88910 - DNA, 118 bp, Mus musculus
aggttctgcagccgagtctgcttcacatttgggctcatgctcagctctcattctctctgtatttacaggcattgcatgctgggtactgattgcagaggaaggcagtggcaaagggctt

SEQ ID NO: 88911 - DNA, 72 bp, Mus musculus
tgctgttgtctgtctgtctgtctgtctgtaaaccacctcttctaatacacttcaggcagagcaacagcagca

SEQ ID NO: 88912 - DNA, 104 bp, Mus musculus
tcgatcctggcgttttgactgcaggattctaacagaacccctcaggtgtttttgctaacccttatcacacccaagtttgaagaacctttagtggaccagggaga

SEQ ID NO: 88913 - DNA, 119 bp, Mus musculus
ggctgtagcgcatgggtgagctttgcaaatcacagtcggaacggatgtgaggagtgagtgagcactctctggctttcctctgactctaggtcacttgcaagctttcctgtgggctcgct

SEQ ID NO: 88914 - DNA, 79 bp, Mus musculus
cactctctcccagtctgtgtactcagcttagctctgcacccccgagtgcttagagctcccctgcagacatagaggtgtg

SEQ ID NO: 88915 - DNA, 85 bp, Mus musculus
gtggggcacccatgaacagatctcactgaggagacagagtcctgtcctcctcctgcaatttaaggcctggtcatatgtcactggc

SEQ ID NO: 88916 - DNA, 66 bp, Mus musculus
acttgtgtatgtgcatgtatgtatgtatgtatgtatgtatgtgtgtgtgtgcctgtgtacacgagt

SEQ ID NO: 88917 - DNA, 82 bp, Mus musculus
gcatatgtacatgcccagtctttctctgtgtgaatgtatgcatcttgcatctctgcatggaagtgtgtgtgtgtgtgtgtgt

SEQ ID NO: 88918 - DNA, 102 bp, Mus musculus
gggttcttgatctccatgcctcagtctagtaaaattgggtgtcagagtacagagagagtacagagatccatttataaatcctgatgcgtggcccttcctccc

SEQ ID NO: 88919 - DNA, 83 bp, Mus musculus
ctcgaggatgccattctaactattttccaagagagatgaaaatttgcatctactcagaaagaaatgtatagaagtttccagag

SEQ ID NO: 88920 - DNA, 88 bp, Mus musculus
gccatctgtgtgccacagcagtgcgggcatcttcaacataggcaagagagacagctctctgtgagtgctttacatggttcaccttggc

SEQ ID NO: 88921 - DNA, 87 bp, Mus musculus
ttgggggggggggtgaggagctgaagagatggctcagcggttaagaacactgactgctcttccagaggtcctgagttcaaatcccag

SEQ ID NO: 88922 - DNA, 64 bp, Mus musculus
gcttaaggtggagagcaggaaggggtacagatctcttctgtccacactcactgtttgtcaaagc

SEQ ID NO: 88923 - DNA, 116 bp, Mus musculus
catgtagcattatacatatggcatattaatgactcatatggaatatacactatatatatgcatttttatatatggttcatatccgttctatatatgctatacatgtggcatacatg

SEQ ID NO: 88924 - DNA, 79 bp, Mus musculus
gctgtgcagtgactgtctctgagactgctgttgatccaggaaagatggcggtgcttgatgaacacagtcctgaacctgc

SEQ ID NO: 88925 - DNA, 117 bp, Mus musculus
gcgcgcgcgcgtatgtgtgagtgtgcgtgcatatttgtacatgtgtatatgtatatgtgtgtatatgtgtatatatgtatgtgtgtacatacacacacacatacacaaacactgtgc

SEQ ID NO: 88926 - DNA, 80 bp, Mus musculus
gcactacagtcgctctgacactgccctccatagtcataggagagctggggaggtgcacaggtgtcaaggtactgcagagc

SEQ ID NO: 88927 - DNA, 79 bp, Mus musculus
ggaatgagacagtaactgttgtgagcctcctgggccacggcgaaagccgagttcagtcagtcagtcagtctgtcttccc

SEQ ID NO: 88928 - DNA, 69 bp, Mus musculus
agacagactgactgactgactgaactcggctttcgccgtggcccaggaggctcacaacagttactgtct

SEQ ID NO: 88929 - DNA, 63 bp, Mus musculus
catttctctcacacacatacacatatgtgtgtgtctgtatgtgtgtctgtgtgtgtctgtgtg

SEQ ID NO: 88930 - DNA, 101 bp, Mus musculus
gtgtacatatctatttatctgtactgtgtatgtctgtcattctgtgtggaagcacaatttaccagcacatgaacctacagtgcagacatggccatgtgcat

SEQ ID NO: 88931 - DNA, 89 bp, Mus musculus
atgtacatactgtgggtgcacatatatacaggcatgtgttataaatatgtgtgtgtttgtatgcatttcatatgtatatgtgtgtgcat

SEQ ID NO: 88932 - DNA, 64 bp, Mus musculus
tgtgggaatacatatatatatatgtatacgtatacatatacgtatatgtatatgtatacacaca

SEQ ID NO: 88933 - DNA, 68 bp, Mus musculus
cttctgaggctgtgtctctcagaggtggtgggaggggattacactcaaggcagaggcaacctgggcgg

SEQ ID NO: 88934 - DNA, 118 bp, Mus musculus
ctctacccatggtatttgttagttggcaagattccaagtagatttctttttaattaaaatgtcctaaaatctgtctgcaaaacacagggaatttgcacagaaaaccgtccatgaagag

SEQ ID NO: 88935 - DNA, 72 bp, Mus musculus
ttggcagaattcgtggatggcgccttgactctttgccctgtgaagtgtcactccctctctcggattctacaa

SEQ ID NO: 88936 - DNA, 119 bp, Mus musculus
cctggtgcattgcctgggcctctgactgagtcacttatgggcttgaaaacgtagcatcagtgctgagaggagagagagtccagcagaaagacccacattcagacctaggcaggcaaagg

SEQ ID NO: 88937 - DNA, 84 bp, Mus musculus
ttccatggctgggctaaggctaggagagcggttctccagaatgggtggtgatctctccctggctctcagggtctgttataggag

SEQ ID NO: 88938 - DNA, 86 bp, Mus musculus
cagtgggcactgactctcactgtggctactagggttagtggttcagtgaccccaagatagatgtcagtttgagataaggccgagtg

SEQ ID NO: 88939 - DNA, 69 bp, Mus musculus
gtgggtcacacccagtctctctaggcaggcctgtgattctggaggcaccagggtaggctaagtgcccat

SEQ ID NO: 88940 - DNA, 134 bp, Mus musculus
ttatatatgcatgtgtgtgtatcccacatgtgtgtatatatgtgtatgtgtgtatgtatatatgtatatgtgtgtatgcatatgagtgtatataatacacatatgtgtgtatagaaatgcatgtatgtgagtat

SEQ ID NO: 88941 - DNA, 89 bp, Mus musculus
cacatgactgttagtgctgggcagtcttggacacgattttggcttctgtgttctgtctgagtctgttttttctgacaggtctcactgtg

SEQ ID NO: 88942 - DNA, 113 bp, Mus musculus
tggttccacttgtgacttcctggccagctgggtggtgatgaagtgttgggtctttctctccttctcactgtgtgtagccagtattgactgccaggaaccaagggtggatgcta

SEQ ID NO: 88943 - DNA, 115 bp, Mus musculus
aggagacgagccagttgggaggagagttagtgcgaagaaagagagatgtgtgtgtgaactaacaagttaagaagtcaaagcaccacctcctagaatcaagtgagaagagactcct

SEQ ID NO: 88944 - DNA, 72 bp, Mus musculus
gtgtgagtatatgtatgtgtgtgtgtatgagtgtatgtgtttatgtatgtatgtatgtatgtatgcttacat

SEQ ID NO: 88945 - DNA, 108 bp, Mus musculus
ggttccttgtagaggggtttgtgaaggtctatggaagggagggtctggggagatttttgacacactctctctctctgagtgttcttaaatgtccttgtgggagggtct

SEQ ID NO: 88946 - DNA, 78 bp, Mus musculus
catagatgacgttgtgctgtgtgtggcacacacacacacaagcgtgcgtgtgccacacacagcacaacgtcatctatg

SEQ ID NO: 88947 - DNA, 59 bp, Mus musculus
gttccaggttaatgagagtctctgtctcaaatatgatagaggttcattagaaatggtac

SEQ ID NO: 88948 - DNA, 95 bp, Mus musculus
tgctgacataagcacatgggatcaggctggagagacggctcagcagttaagagcactgactgctcttccagaggtcctgagttcaaatcccagca

SEQ ID NO: 88949 - DNA, 80 bp, Mus musculus
cacacagacacacagcctctctgccagccggataaggaggagtaggatgggggagggggttgtcaagtgggccagctgtg

SEQ ID NO: 88950 - DNA, 89 bp, Mus musculus
tgtgtataagtaccttgtctgtatatatatatgtgtgtgtgtatgtatatatgtacatatatacacctacatatgtgtatatgtataca

SEQ ID NO: 88951 - DNA, 67 bp, Mus musculus
gtacccaggacctgctaggtctgtgtaaagttttattgaactgggctcagtctgtgagtctgtggac

SEQ ID NO: 88952 - DNA, 74 bp, Mus musculus
gtacagcttcagggaactaaagcagaccagagtcggatgccctgatctttgactctgtggtttacctgctgtgc

SEQ ID NO: 88953 - DNA, 105 bp, Mus musculus
gtctgaggctgtgtctgaggctgtgtctgtgtctgtgtctgaggctgtgtctgaggctgtgtctgaggctgtgtctgaggctgtgtctgaggctgtgtctgaggc

SEQ ID NO: 88954 - DNA, 96 bp, Mus musculus
gccataggaccagcatgtctgatgcatcatagtcaatgtcatcaatatttgacataggaaatgaaatgttaatatagagaagacttgaacaatggc

SEQ ID NO: 88955 - DNA, 112 bp, Mus musculus
cataaaggatgtagggaaggatgggaggacttgaagccagggaggggaatgaggtcagtggctccctgtttggctcctggttcatcacatctgatctctgtgatctctgatg

SEQ ID NO: 88956 - DNA, 64 bp, Mus musculus
actgtgtatgggacacttgtgccccagatgtgtctgtctgtggagagtgtgatcagcaaacagt

SEQ ID NO: 88957 - DNA, 89 bp, Mus musculus
gaactgatggacagggtctggagagatggctcagaagttaagagcactgactgctcttccagaggtcctgagttcaattcccagcaacc

SEQ ID NO: 88958 - DNA, 63 bp, Mus musculus
tctctctctctctctctgttgcatctggccaagggccagactggacatctgggcctgaggagg

SEQ ID NO: 88959 - DNA, 195 bp, Mus musculus
gtatgtatgtatatatatgtatgtacatataagtatgtgtgtatatatataagtgtatgtatatatgttgtatataaatatatatgtatatgtgtatgtatgtaagtatgcatatgtgtatatatgtgtttatatctatatatgtatatacatatatatgtatatattatataagtatgtgtgtatatatgtata

SEQ ID NO: 88960 - DNA, 84 bp, Mus musculus
cactgggcggattgtaggaaaagctattagtaatcaggaaaactctgggctctatagtgtttttcttgtgcagattgacaggtg

SEQ ID NO: 88961 - DNA, 106 bp, Mus musculus
gccttagtgcatggtgatctgataggatacatggtacaatttcaatatttttgaatatgttgaggcctgttttgtgacctattatgtggtcaattttggagaaggt

SEQ ID NO: 88962 - DNA, 116 bp, Mus musculus
gtctcagtcagtctctctctctcagtctcttgtctacacacacacacacacacacacacacacacacacacacacactcacatacatcgagacaggggtggggagcagatggagtc

SEQ ID NO: 88963 - DNA, 66 bp, Mus musculus
ccctggagtggcctcctccaaaggctcagttactgtgtctctgggtgtcttgcttgttgtctaggg

SEQ ID NO: 88964 - DNA, 74 bp, Mus musculus
gaggaggaaaaggaggagacagaaggctggaggccactggggtcaccactctgtctttctcagagtcattcttt

SEQ ID NO: 88965 - DNA, 89 bp, Mus musculus
agctctagtatctcattacctgacattgtgaggctgtttgtcacatgacagaacagtgtttgcaatggattgctgtaggtgctgccgct

SEQ ID NO: 88966 - DNA, 116 bp, Mus musculus
aggctctaagaaaacaccattggggctggagatttggctcagtggttaagagcattgactgctcttccagaggtcctgagttcaattcccagcaaccacatggtggctcacaacct

SEQ ID NO: 88967 - DNA, 96 bp, Mus musculus
ggagcagttgccgcacctcgaagtcactgaagcagaccacacacctgaggaggggcacagtgtcagcacagtgacagctgaggcagcggagggccc

SEQ ID NO: 88968 - DNA, 98 bp, Mus musculus
accctgacagccatcagtctgagcagactctgtgagtgtcaccctggaagcccagggagggccctccgctgcctcagctgtcactgtgctgacactgt

SEQ ID NO: 88969 - DNA, 61 bp, Mus musculus
ggtggtgacagtgttacctatgcctgtcacatctgcgtgactgctgtctctctgtcactcc

SEQ ID NO: 88970 - DNA, 117 bp, Mus musculus
cgtcccttcccttcccttcctctggttccctatcttgtcatgtgatctctctgtgtcatacaggaccccatcatgtgattcagtatactatcaagtcctcacagggcacagtggatg

SEQ ID NO: 88971 - DNA, 116 bp, Mus musculus
tagaactgacgctctaccctcatcgtcctgtttgagctcaagtcagctatctggtcctgaaacagagagaacagactcaggcttaggagacactccagggggaacgactcagtctg

SEQ ID NO: 88972 - DNA, 75 bp, Mus musculus
ggagaaggctggctggctggctggctggctgggagagccagcttccactccccccagtaaacaggcctgagctcc

SEQ ID NO: 88973 - DNA, 84 bp, Mus musculus
agggttagtatctgcatctgcatctgtctcctaacatcccaatgttaagaataaaggtgagacaggcataatggtgcacacctt

SEQ ID NO: 88974 - DNA, 90 bp, Mus musculus
atgtatgtgtgtgcatatgtgtgtgtatatatgtgtgtgtgtatatgtatgtatgtatgtgtgtatatatatatatatcttcaaacacac

SEQ ID NO: 88975 - DNA, 77 bp, Mus musculus
agcaaagagggttcctttgactgcctccatgtctgtacttcagaagagatgtgtgactgtagacaggggactttgct

SEQ ID NO: 88976 - DNA, 83 bp, Mus musculus
ggaggaggtgtgtcactggggatggggggtgggctttgtggtttcaaaactcatgccaggcccagactcactctctctgtctt

SEQ ID NO: 88977 - DNA, 87 bp, Mus musculus
tgatggagagacagagacacagacagagactgcagcaatctcctttggagacatttcaaagctatgtcttgttttccctctccacca

SEQ ID NO: 88978 - DNA, 81 bp, Mus musculus
tggagagggaaaacaagacatagctttgaaatgtctccaaaggagattgctgcagtctctgtctgtgtctctgtctctcca

SEQ ID NO: 88979 - DNA, 94 bp, Mus musculus
tgtatatatatatgtaaatgtgtgtgaatgtatatatatgcaagtgtatatagatgtgtattcatatatatgtatatatatgcaaatgtgtaca

SEQ ID NO: 88980 - DNA, 108 bp, Mus musculus
tgcaccaggaggggctggcagccagctgagtctctggagcctcacttctctttgtctctgcggtgctctgacttgctttaggctcagtgctggccagcttgttggtca

SEQ ID NO: 88981 - DNA, 92 bp, Mus musculus
tctgtcttcctgtcttgctctatcttctcatgtgtctgtctctcagccgtcacatgctcctggctggagccagcggttcagagacaaactca

SEQ ID NO: 88982 - DNA, 100 bp, Mus musculus
gttccaaccagagttccagaaatgagcctcggtgaatgggctcagaccagtgctcactctgtgcctgtctcggtagttcatgggatcttgggtgttgatc

SEQ ID NO: 88983 - DNA, 80 bp, Mus musculus
cctcccaacaggcacctagaacaagagagccatttcgatatgaccctgtgccctgtctccctgcctgtctggccctgagg

SEQ ID NO: 88984 - DNA, 69 bp, Mus musculus
gaggaactctcagtcactctgattctccactgtgcctttccggaagtcacggcggctgtgagtatcagc

SEQ ID NO: 88985 - DNA, 117 bp, Mus musculus
gcgggcggctgacgtgagtaggacttgctgcgctgatcgatagagaggcaggaggctggggcacccactctctgcctcacatcccgcagggggatccgtgcccatccagctctgagc

SEQ ID NO: 88986 - DNA, 88 bp, Mus musculus
ccctcactctgcccaggaccacagcgagctatgaacaggtctcaggattgttaactggatcgttggggtgacctaacaattagaaggg

SEQ ID NO: 88987 - DNA, 102 bp, Mus musculus
gtatggtggcagagactcagagttcagtgacagcatcagctagtacattgtttagttccaagccaatctgagctacatgaaactgtctcaaaaaacgaatgc

SEQ ID NO: 88988 - DNA, 74 bp, Mus musculus
ggctgttgatagcttcccaagccagggcatgaaacacactgtctcaccctgagttctggagctcctcagcggcc

SEQ ID NO: 88989 - DNA, 103 bp, Mus musculus
ggaggcctttgttgtacaggtatgttctctttctatatatttatgtgcacacacatgcacacaatatatatctataaacataaccctcatatcaacaggatct

SEQ ID NO: 88990 - DNA, 105 bp, Mus musculus
caccgccctctggtacagttcatttccctcttcctgcatctgagaaactccctgactctttctcagtcactggggctgagtgtttttgttctcccttttctggtg

SEQ ID NO: 88991 - DNA, 108 bp, Mus musculus
tcctgaggtgtcagaatcccccagcctcactttctctctctgactgcctatgggtgattacagatgatcacaccattatggagactgagtgtggtcacaccattagga

SEQ ID NO: 88992 - DNA, 98 bp, Mus musculus
tgcatagagtataagtctatgcatatgcacacagtatatgtctatgtatttgcatactatatatatatctatgcatttgcatagtctatgtctatgca

SEQ ID NO: 88993 - DNA, 76 bp, Mus musculus
catgaccaaggcgcatatatatgtatatatatacatgtatatgtatatatatatgtgtgtgtgtgtaatacatatg

SEQ ID NO: 88994 - DNA, 85 bp, Mus musculus
gcctttcagattaggggttttcagtttgtacttgtgatatataacgatggtaggagttaagaatacgcctgattctgggtctggt

SEQ ID NO: 88995 - DNA, 87 bp, Mus musculus
ctcacacaaggcaaccaggttaaaaagactatatatatatttgataaccaaaaatggaagaggattttttgtttgctttgttttgag

SEQ ID NO: 88996 - DNA, 71 bp, Mus musculus
acacacacacacacactcacacctgatcgcagcttttctgtatttgtgtcagtgtgtctgtgtcagtgtgt

SEQ ID NO: 88997 - DNA, 128 bp, Mus musculus
gtatatatgtatatgtgtatgtgtatgtatatacatatttgtatgtgtatatatgtatatacatatatgtgtatacatatgtatatatgtatgtatatatacatattatatacatatgtatatagata

SEQ ID NO: 88998 - DNA, 66 bp, Mus musculus
ggagtgacagaggggagagcttgggcaccatggggcttactctgtggctctctctcccccactctg

SEQ ID NO: 88999 - DNA, 62 bp, Mus musculus
ggcagcactttgctttatggaagctctgggcagagatctgtcccaggctcactgtggctgtc

SEQ ID NO: 89000 - DNA, 108 bp, Mus musculus
tcctgcaagtagcttagcaaccagctctggccccagcatcacatttctctgccagcttgcttgctgtacttaaggattgctttcgctgtcagcctggaaaggaggtgc

SEQ ID NO: 89001 - DNA, 68 bp, Mus musculus
gcaacagggaattgagagggaaaaagatttaattgctagtgttcttctctctcacagtccctcactgc

SEQ ID NO: 89002 - DNA, 116 bp, Mus musculus
tgccacacaagcatctataaagtccctggctttgcctgtctcactgtgagtctgagctcagtacttaggagatcaaggtgaagatctttctgcatggagaccttgaccctgttgta

SEQ ID NO: 89003 - DNA, 76 bp, Mus musculus
gtgcatatgagtgtctgtgtgtctgtatgttctgtttgcttccatgtggtcacgcctgtggccacacagactgcac

SEQ ID NO: 89004 - DNA, 112 bp, Mus musculus
gtttgtgtggccttgctgttctaggagcaatgactgagaggaacagctatgtgtctcacagacagacacctcggcacattgtgagcctgcagctctgtggtacacataggtg

SEQ ID NO: 89005 - DNA, 81 bp, Mus musculus
agaggcacctatgtgtaccacagagctgcaggctcacaatgtgccgaggtgtctgtctgtgagacacatagctgttcctct

SEQ ID NO: 89006 - DNA, 70 bp, Mus musculus
caggctccagaggacagagaggactctgtgcccagacccagttcttgcccagccccctctctccggcctg

SEQ ID NO: 89007 - DNA, 80 bp, Mus musculus
gtgaggttcaccacgggaatggtgtgaggttcaccacgggaacggtgtgaggttcaccacgggaacggtgtgaggttcac

SEQ ID NO: 89008 - DNA, 80 bp, Mus musculus
gtgaggttcaccacggaaatggtgtgaggttcaccacgggaacggtgtgaggttcaccacgggaatggtgtgaggctcac

SEQ ID NO: 89009 - DNA, 66 bp, Mus musculus
gagggtgaggaggggccactgaggagacgttgataggctgtgtgcctctgtgtgtgtctcagcttc

SEQ ID NO: 89010 - DNA, 88 bp, Mus musculus
cctcagctgagcaactctctatttctctctcacagccatgagcagtggcagggcgtagggtagatgggtgggcaggatagctaagagg

SEQ ID NO: 89011 - DNA, 75 bp, Mus musculus
ggaagaactgagggagaaatggaatgggatttcgctctggcaacccagggagcctctcccagtctctctgtctcc

SEQ ID NO: 89012 - DNA, 91 bp, Mus musculus
gtatgtatgcatgtattatgtattatacacatgcattatgtatgtatttacttattcatttatttgtgtatgtttacacatgttcacatgc

SEQ ID NO: 89013 - DNA, 104 bp, Mus musculus
tatatgctatgtatgtatgtatgtgatgtatgtatatgtctgtgcatgtacatattcatatatccatgtacatatacatatacacatacacacatatacatata

SEQ ID NO: 89014 - DNA, 119 bp, Mus musculus
gcaaatcttccaacgagatccggacgtgtgacagctatggctgtggacagtactctgctcaaaggtatgaacgaccacaaacagctgccatgttgttggttcctctcttcttgaattgt

SEQ ID NO: 89015 - DNA, 71 bp, Mus musculus
tctggaagtctccctgctctgagtttacattgcctgagtgaagaatcagagcatcaggaagagatgtcaga

SEQ ID NO: 89016 - DNA, 81 bp, Mus musculus
gtgtgcacacaaatgaacatgtgtacacaaattaacatgtgcacatgtgcacacatgtgcacgcacacactctcacacaca

SEQ ID NO: 89017 - DNA, 67 bp, Mus musculus
gctctttactgctactacagagctgacatggtgagcatgtgtgcgtctgtgtggctctggaatgagc

SEQ ID NO: 89018 - DNA, 65 bp, Mus musculus
cctgcaggctgtgtctctgtctgtcctgcaggctgtatgtgcgccacagagtcccagccctcggg

SEQ ID NO: 89019 - DNA, 84 bp, Mus musculus
acagcgatagttagatctggagcctgaataagcacagtaaaagtgtgccatggacagcctagctcagtctgtcactgtcactgt

SEQ ID NO: 89020 - DNA, 70 bp, Mus musculus
gaatgtatatatatgtatgtatatatgtgtacatatgtgtgtatatatgtatgtatatgtatataaaatc

SEQ ID NO: 89021 - DNA, 57 bp, Mus musculus
gtctgagctcagggttgatgtgatctggtggtctctcaggctctctgggcctcagtc

SEQ ID NO: 89022 - DNA, 111 bp, Mus musculus
ctgaggatacaaagtatcttttatttatgaagtgcacagactcagtatctcattagcgctattgaaacgttctgagacatgtgatgcttctgaaacaaggttggatcccag

SEQ ID NO: 89023 - DNA, 106 bp, Mus musculus
tccatttgtgagttctctaatgtactttgacacaacaaaattgaattcctcacaatagattcttttttgttattaactgtcatgcatttactgtgagcccagtgga

SEQ ID NO: 89024 - DNA, 103 bp, Mus musculus
tgccttaagtttacgtgtgcagttgtcttgctgtgtccccgagatgtgtttttcttgtagttatcccctggggagagcattactctgctacatggacgtggca

SEQ ID NO: 89025 - DNA, 116 bp, Mus musculus
cactgagattgtaaactgtagaccgaagggggtgggtgctaatgactgtagacagtttcctctggcgagcctccctccaggatttattttgggttatagtgatgagcaaatcaagg

SEQ ID NO: 89026 - DNA, 81 bp, Mus musculus
ccagtggatggcgcagttaccaatgcagaaggtgattctccagttcctcccagtctctctgcctgtgtccaagcctcctgg

SEQ ID NO: 89027 - DNA, 92 bp, Mus musculus
ttgtattcaaaggtataaatatatatatgtgtgtatgtgtatttacttctatttaatacagatctatatatgtagatgacctttggatgtgg

SEQ ID NO: 89028 - DNA, 100 bp, Mus musculus
tttttgttacaaatgctagacagtagtgagctcagtgaggggacacagggtgacttgtgtccttgctggggacactagtcactggggaagtaggcactga

SEQ ID NO: 89029 - DNA, 69 bp, Mus musculus
gccaggctcagtctctgtctttctctccgggctgcctgtggatcaggatggaactctgggctccagggc

SEQ ID NO: 89030 - DNA, 108 bp, Mus musculus
ctgtgtaaatgtgtttttgagtctctgtatgtgtgaatgtatgtatgtatgtgtgtgcatgcatgtgtgactgtgttcgtaaagaggctagggaaaatttttcctcgg

SEQ ID NO: 89031 - DNA, 111 bp, Mus musculus
gcagcatggacatggcctggagctctcacttcttgctctctctctgagattctgtgtcctggggggggagggggaggtaattttactttgttctaggatatttgaacctgt

SEQ ID NO: 89032 - DNA, 82 bp, Mus musculus
ccttgtatttctgacacagactctctcgctgaactgggagcccaccggtttgtcatgattctgtggtatgagagttccaggg

SEQ ID NO: 89033 - DNA, 84 bp, Mus musculus
cagtctcttttcagacttttctgaggactttcagagcaagagcccgcagtcaggctctctgtttctcaggcaagaaaggggctg

SEQ ID NO: 89034 - DNA, 89 bp, Mus musculus
gtgtcctatgagatccgtggctgtggaggtgactttcctctctataattgtttctctctgtcacagccactcttgagcctccccatcat

SEQ ID NO: 89035 - DNA, 94 bp, Mus musculus
gaggcaatctctcttcccaggtgactccagtttgtgtccagctgatgatagatctaaccaggatgcaagtcaagtggtaggaagttagagactc

SEQ ID NO: 89036 - DNA, 117 bp, Mus musculus
aggatgtcactgtgagcctcccagggaagcaatatgtcagccactgcagtcttcacacttcctgtttcttagacctgcagaggggtaaagcctccagccggagctccaggacaaact

SEQ ID NO: 89037 - DNA, 74 bp, Mus musculus
catggctgaaagtcactgttcctaaggcagcaagcagcagaccttgagatcacacggtgctttctacaggcatg

SEQ ID NO: 89038 - DNA, 78 bp, Mus musculus
ctgtctgtctgtctgtctgtctgtctatctatctatctagatatagatatagatataggtatagatatagatatatag

SEQ ID NO: 89039 - DNA, 92 bp, Mus musculus
tctattatttcccatgtacttgcacaatgaatattatttaatcttatgtaataagactaatgttagtgtcagagctgagatgggaatgtagg

SEQ ID NO: 89040 - DNA, 100 bp, Mus musculus
acctgaccttgacacacacacacacacacacacctatatatatgtcactcatacatatatatgtgtatatatgtatgtatgtgtgtaaatacaggtatag

SEQ ID NO: 89041 - DNA, 129 bp, Mus musculus
gtacatatatgtgtatatgtgtgtgtactatgtgtttatacttatgtgtgtatctgtgtgcctgcgtgtatgcgtgtttgtatatgtgtatatgtgcatatgataaatgtgtgtatgtgcatgcacata

SEQ ID NO: 89042 - DNA, 70 bp, Mus musculus
caacaggcacgcacatggtgcatcttcaaatagacaagctcttcagtgagcactgtgtgtctgtgtgttg

SEQ ID NO: 89043 - DNA, 85 bp, Mus musculus; identical to SEQ ID NO: 58391

SEQ ID NO: 89044 - DNA, 107 bp, Mus musculus
tggagtatttaatttagaaagcaaagatcattatttttctttctttattttgtttgtgtagaaaaacaatgggacagatagatttgtgttttacttcaagtattcca

SEQ ID NO: 89045 - DNA, 76 bp, Mus musculus
gaaggaagcatttcctggaagacccgggctgtaagtcactgcacactctgggcctctgtctgtggtctgctccttt

SEQ ID NO: 89046 - DNA, 60 bp, Mus musculus
ttagcattttggctagacgccccaggatctgcctgtctctgtctggctatctggtgctgg

SEQ ID NO: 89047 - DNA, 115 bp, Mus musculus
gcattgtgtatgtatgtatgtatgtgtggggtaagctgggcactgtgtatgtatgtatgtatgtgtggggtaagctgggcactgtgtatgtatgtgtgtgtggggtgagctgggt

SEQ ID NO: 89048 - DNA, 77 bp, Mus musculus
ggcacccagcatgccccctgaggctgggttgctatggacaaccagaggctgcctctcagtctcagagcctgcctgcc

SEQ ID NO: 89049 - DNA, 74 bp, Mus musculus
gtgtgttttctgtgagcatgggctataaggagctccctctggacaccggctctcagtctctctgcttaccacac

SEQ ID NO: 89050 - DNA, 68 bp, Mus musculus
tgtgtgtctgtctgtctctatgtgtatatatatatatatatgtatacacatagagacagagacacaca

SEQ ID NO: 89051 - DNA, 56 bp, Mus musculus
ttggcgacagttggtctcactcttaagtccaatctgagaggactgactgtcgtcag

SEQ ID NO: 89052 - DNA, 92 bp, Mus musculus
agccagcacccagccacagatgccagtgaggtcatgcataggtttgagccccaacaccacaaaggcagctctaagtcgcaggtttgctcgct

SEQ ID NO: 89053 - DNA, 79 bp, Mus musculus
ggtgtgtgcatgtatgtgcttgctcatgcatattatgcatgtgtgtatatttatgtatgtgtgcatgtgtgtgtgtgcc

SEQ ID NO: 89054 - DNA, 104 bp, Mus musculus
tggatgttggcctagttctgtgtggaagactagtgattttgttgtttttagataactaaaacgacaacaaatcacagtctgccatatggcacaggccacctcta

SEQ ID NO: 89055 - DNA, 123 bp, Mus musculus
tcaggagccataatgtagctttgggttgtgttgtgtgtgccagacatgagcttttgtgagtggagacagtgaccagggtgttggccccagaggcccagaacttgttttcctgacctgtcccca

SEQ ID NO: 89056 - DNA, 60 bp, Mus musculus
atacacacacatatacatatacatgtgtgtgtgtgtgtgtgtgtgtgtgtgtgtgtgtgt

SEQ ID NO: 89057 - DNA, 100 bp, Mus musculus
tctcacactgtccttggagagaagagtcacagcagagtcacagcaacgaagctgatgatgcttcctgcttgtgctcccatttggaaaaggaacatggaga

SEQ ID NO: 89058 - DNA, 59 bp, Mus musculus
ggaccctgtggttgtaggttttaatcatgaacttgactcgccaataactatctgggtct

SEQ ID NO: 89059 - DNA, 83 bp, Mus musculus
ggggctaatgggaatgagcttgccttcagtggtttagcacagagggaaagcctgtgtggtaagcaggttagacctattgctct

SEQ ID NO: 89060 - DNA, 102 bp, Mus musculus
tcttggccataccttccactggcagcgtttctagagggcacggaagaagaagcttgcttggtctctctctcactgccaagtccattccttcactggcttaga

SEQ ID NO: 89061 - DNA, 74 bp, Mus musculus
tccagccattgcaggataataatgcttcctattacactgtgggtccagtttgtgtctctctgtgtgtgctgaga

SEQ ID NO: 89062 - DNA, 134 bp, Mus musculus
gcatttatatgtgtgtgtgtacttgcatgtacatgcatgtgcatgcatccacacttgcacagaagtgaatgtgctcacagaagccagagacattagatcccaggaatctggaattatgggtgcttggtgagcca

SEQ ID NO: 89063 - DNA, 87 bp, Mus musculus
gtatgtatacatttatgtgtgtgtatattacagaatatgtgcctatatattgtatttatataaaaatatacataatatgttacatat

SEQ ID NO: 89064 - DNA, 114 bp, Mus musculus
tgtgtgcgtttgtgtgtatgtgtttaggtcatgaaagtaggaaagggctcacacatgagagtgagcggaggatggatcctaggttttgacaaagagagggtaatggggcaggca

SEQ ID NO: 89065 - DNA, 81 bp, Mus musculus
ctgccaccagggaccctgtctgtgtctgtggcccctgtaggccccaagaccctgtggatgtccttggcctgtgctgagcag

SEQ ID NO: 89066 - DNA, 103 bp, Mus musculus
agccagagcgagatgctgggtgtatttctccctcactctgtgaattattgccttggaacaatcttcactgagcaggaagcttaccttcttgtctaggctggct

SEQ ID NO: 89067 - DNA, 100 bp, Mus musculus
taggtctggttgcatgtgtatgggagggacaaaaaccacagcggtgattgttgctgtcgcactgtctctctgcccagtcccatcatcccatcctgacctg

SEQ ID NO: 89068 - DNA, 75 bp, Mus musculus
gtgcaggtgattctatatatgttttattgaacctgctagggctttaagaaaaacgtgttttggattatacctcac

SEQ ID NO: 89069 - DNA, 79 bp, Mus musculus
accagagccatgggtgggagcaaagcagtaagccatccctccacactccctgcttcagtctctgcctcagactcatggt

SEQ ID NO: 89070 - DNA, 90 bp, Mus musculus
agagtgtgtgcagtcaggggcggagtcacacagtcacactgaggaactgtcaggattctgctcaatccagaatttgtaaacatccgctct

SEQ ID NO: 89071 - DNA, 95 bp, Mus musculus
gtatctgtgactatatgtgtctgtgtgtatatctctgtgtatatctctgtctatgggttcattgctgattatgcagaccagtgtgttgcttctgc

SEQ ID NO: 89072 - DNA, 69 bp, Mus musculus
ggcttgtcacacagaagagtcaccagaggagtcagaacacactctggaaaacctaaagtgatggcagcc

SEQ ID NO: 89073 - DNA, 73 bp, Mus musculus
gatgcccatttaagctgtttctgaattgacagcatttggtagatgtcacacttcagattttgaacttggcatc

SEQ ID NO: 89074 - DNA, 77 bp, Mus musculus
acacagtcttttcctgtttacaagccagcacctatctgtgaaggtcagtgtagagtgtgacgaaaggaaaagcgtgt

SEQ ID NO: 89075 - DNA, 72 bp, Mus musculus
gcagactcaagacaaggagggtttgggttgctgagtagagcatgcctgtctgtctgtctgtcgtctgtctgt

SEQ ID NO: 89076 - DNA, 111 bp, Mus musculus
gtactgggtgagagagtataatatgaggcttggttactggtgagatgtgtctgtgattatgaagatatttgtcttattggtccaataccatagctaaattccatggagtat

SEQ ID NO: 89077 - DNA, 119 bp, Mus musculus
gtgtgtgtgtgtgtgctcatgtttatatatgtatgtgtatatgtatgtgtgtgtacatatatgtgtgtgtatgagtatatatatatatgtgtgtacatatatatgtgtatgtgtatata

SEQ ID NO: 89078 - DNA, 113 bp, Mus musculus
catgtaggggaaccttcccaactcaattaatccattctagaaactccctctctgacactttaagacgattgttttctgggtgcttgagttgggggtagagggaacccttactg

SEQ ID NO: 89079 - DNA, 60 bp, Mus musculus
acacacacacagtctctatcttccaatggtgcatctgttagattctcactgtgtgtgagt

SEQ ID NO: 89080 - DNA, 69 bp, Mus musculus
ggagagatatcacagtctactatggacttcctgtttcaccatgtaaacgtgtggctttcctatctctcc

SEQ ID NO: 89081 - DNA, 68 bp, Mus musculus
tggggtgggggcagggatgtgacaggggctgggggataggacacacacacacactctctcacacacca

SEQ ID NO: 89082 - DNA, 103 bp, Mus musculus
tctgagtagctctggccgacctggaactcattctgtaggccaggctggtctcaagctcagatctgtctgcctcaggagtgctaggatgtgctaggattgaagg

SEQ ID NO: 89083 - DNA, 140 bp, Mus musculus
cttcctgacccatgtgcttgccagccaggtctttggtagtaacaaggtggttttgaaggagaggagtgaagactgggtgcagcaccaggtagaaaggaagccagccggggctagaaaccatgtgccttctgtccctttga

SEQ ID NO: 89084 - DNA, 91 bp, Mus musculus
cgagtcattaaaatgagttctagtagacatttttgatagggtcaaggtgcaggcttctgtgggagagtttctggtactggtggtgtgctgg

SEQ ID NO: 89085 - DNA, 81 bp, Mus musculus
ggagcactgattcagcttctgcatgtgggcaagtaggcacttctagcaaatcatagtcgagctcctgtcagacactgctct

SEQ ID NO: 89086 - DNA, 77 bp, Mus musculus
tcacaaatgagacagtgcagaaagtcacctctgagctgctgccagactccagagggatgtgcaatggcggtctgtga

SEQ ID NO: 89087 - DNA, 76 bp, Mus musculus
gagaacaatgtctatctgtctcttactctgcctgtacactctgaggaatagagcaagaaggtggatggctgtttgc

SEQ ID NO: 89088 - DNA, 83 bp, Mus musculus
tagactctgacactgtcgctactggacttgatggctatctaactctctgtctttctcacggtatgtgtctctgtctctgtctg

SEQ ID NO: 89089 - DNA, 95 bp, Mus musculus
tgtggtttatgattgctattcatatcatagggtgttagtaaccacagagacaagacactgtagagccatataatgtgagcacacatagacacaca

SEQ ID NO: 89090 - DNA, 88 bp, Mus musculus
atgaatatgtatgtatgtatgtgtgtgtatatgtatatgtatgtatatacatgtgtgtatatatgtatgtgtgtatgtatatatgtat

SEQ ID NO: 89091 - DNA, 108 bp, Mus musculus
ggggagggactttagtggaagaaatagataggtaggtgttaggccttgaaattttttttttagaacatccttatttactatctgtctctgctttttttaactacctac

SEQ ID NO: 89092 - DNA, 64 bp, Mus musculus
tatgcatgtatgtatatatctatgtatgatgcatgcatctatgtgtgtatacgtattatgcatg

SEQ ID NO: 89093 - DNA, 105 bp, Mus musculus
ctgagctcagggcctgagagagatctgactgcctgagaagtaactgtgcacacaagtgttgctccccattgtcagatcaaacatccctctggtctccaagctaag

SEQ ID NO: 89094 - DNA, 68 bp, Mus musculus
agcagggcaaaggaatccacagctgcatgctggccccagctgcctctgtgtctgagactggctctgct

SEQ ID NO: 89095 - DNA, 78 bp, Mus musculus
gccttttgcttacggtaaagacagccctaggttagttgtatctggctgggtctctgtccctgtctgcagacactgggt

SEQ ID NO: 89096 - DNA, 91 bp, Mus musculus
tgtcattgtgggggtgggctttgaggtctcctagtggtcaagctccatccagctctgaagagagtctcctcatggccaccttcagaagata

SEQ ID NO: 89097 - DNA, 58 bp, Mus musculus
cacatgacagaggagagagacaactgacacaagttgtcctctgatgtccccacatgtg

SEQ ID NO: 89098 - DNA, 111 bp, Mus musculus
gctgatgtggtccccaggacaaaagccggatggcttatcaaagatggctgcccccaccctctgtgcctgcctggcttcctcaagcctttgtctcaggatttgtactaaagc

SEQ ID NO: 89099 - DNA, 74 bp, Mus musculus
cctctcaaatgtatgatcatacatgtatgtatatatacatatatacacatgtatatggatggtcacatgaatgg

SEQ ID NO: 89100 - DNA, 82 bp, Mus musculus
atctgagacaggaactgctataaagatgcaggtatatttttctcattttgtacatttcttgtagatgtttctggttacagat

SEQ ID NO: 89101 - DNA, 94 bp, Mus musculus
atacacttttgtatgagcgtggtgtgtgtatatatatggtctgtggtatatgtgcatgtgcttgtgtgtgtgcacgcactgctgtgtagtgtat

SEQ ID NO: 89102 - DNA, 69 bp, Mus musculus
tgaacttgggctggagagatggctcagctgttaacagcactgactgctcttccagaggtcctgagttca

SEQ ID NO: 89103 - DNA, 82 bp, Mus musculus
ttctcagtccctgtggagtgagtgctgtaaggcagtcagttcactgagagcactgtttggcctgacttacaggagcaaggag

SEQ ID NO: 89104 - DNA, 102 bp, Mus musculus
catatatttgtatcatacaaaacatatgtatatatgatatatgtccatcaaatatatctatatatgtctgtctatatgtatgtgtgtaggtacatgtgtatg

SEQ ID NO: 89105 - DNA, 73 bp, Mus musculus
agccagacctgcattgtggagtggtgacactgagactgtgtgtcagcatgtaaattcatgttttaatatggct

SEQ ID NO: 89106 - DNA, 86 bp, Mus musculus
cacaaacctaggctttctctgatctcttgggaagttaccaatcgaaagaactgtgtacttccagggcaggtctgtgcagccctgtg

SEQ ID NO: 89107 - DNA, 87 bp, Mus musculus
ttctctaaaggctagcaatgacagcattaatctctggctctcgtggacgctgttgtgttgttattgttcctgctttcctttggagaa

SEQ ID NO: 89108 - DNA, 82 bp, Mus musculus
gactgcttgtggaactgtctcagtatttgtcaacccaggaccatttctggagccagagctgctcagttacctcagagcagcc

SEQ ID NO: 89109 - DNA, 117 bp, Mus musculus
tggtcctagcatgagctttggggacttcagtggagccctcgaattttgtcatagcccgtgtcacccactgacagtccctgtatcccatgaaggagcatccctggggcacactggctg

SEQ ID NO: 89110 - DNA, 92 bp, Mus musculus
catgtgtgtgtttggatatatgcacatatgtgattatatatgtattaatgtgtacttatgagtgtgcatatatatatgcatctatatatatg

SEQ ID NO: 89111 - DNA, 85 bp, Mus musculus; identical to SEQ ID NO: 57470

SEQ ID NO: 89112 - DNA, 120 bp, Mus musculus
cacactttggtcttccttcttcttgagtttcatgtgttttgcaaattgtatctttggtattctaagtgtctgggcactatctacttatcagtgagtgcatatcatgtgtgttgttttgag

SEQ ID NO: 89113 - DNA, 75 bp, Mus musculus
ttacagattgttttgattgagacttgtttgcgcaccacccagagtgttgtttgacctctcactctcattctgtga

SEQ ID NO: 89114 - DNA, 100 bp, Mus musculus
tctgttaacagttcaggttattggctatgaacaagatatctttgaatagttgtatgattattttgaaggactttttggtatagaaatgggaaataacaga

SEQ ID NO: 89115 - DNA, 124 bp, Mus musculus
ccacctgccacaacatcagattatgtcaactgaaaagagatgtagctaggcttatgtctggaagtatgttctatacttgaccagtaagtggcaatgatgactaggtgtgtggaatgtgccagat

SEQ ID NO: 89116 - DNA, 124 bp, Mus musculus; identical to SEQ ID NO: 89115

SEQ ID NO: 89117 - DNA, 77 bp, Mus musculus
gcttatgtctggaagtatgttctatacttggccagtaagtggcaatgatgactaggtgtgtggaatgtgccagatgc

SEQ ID NO: 89118 - DNA, 114 bp, Mus musculus
actctctgctatattttgaaatcagatatactgacagtgcccacagttctcattttgttcaagattgccttgggtatttcagttctttgtacattcataatatttttagactgt

SEQ ID NO: 89119 - DNA, 98 bp, Mus musculus
tttggagaaaagaggttgacattggttatctttctctatcactcattaccttatttgagggagtggtaacaaagtctctcactgacccttgatctgga

SEQ ID NO: 89120 - DNA, 95 bp, Mus musculus
tcctaattaccatccccatagtttagatgttctactcaggtggttctcggatgtattggcttgaggttgaagaatgtatgtattagtatttagga

SEQ ID NO: 89121 - DNA, 114 bp, Mus musculus
ctctacagatgttaactgcccttgctgtctctgactaaatcctgtcccttctgtgtgcctgtgagcctgtcagcctgattgtgacaaagcacctggcagtcagctgtctatgag

SEQ ID NO: 89122 - DNA, 106 bp, Mus musculus
gccttagtgcatggtgatctgataggatgcatgggacaatttcaatatttttgtatctgttgaggcctgttttgtgacctattatgtggtcaaatttggagaaggt

SEQ ID NO: 89123 - DNA, 88 bp, Mus musculus
aatatatgtatatgtgtatgtgtacgtgtgtgtgtatgtatatatatatatatatatatatacatacatacatatatatttatattta

SEQ ID NO: 89124 - DNA, 88 bp, Mus musculus
gggtagacttctatttttgttctacagatggtaacactgagggtcacacagttaagttgcttctgaatatacttaattggaactgttc

SEQ ID NO: 89125 - DNA, 72 bp, Mus musculus
ttctcaactgaggaatgtagaatggccaagaagcacgtaaagaattattctgcatccttggtcatcagggaa

SEQ ID NO: 89126 - DNA, 97 bp, Mus musculus
catatatacttgatcaactttatatatatattcatacatatgtatatataagtatatacgtgtatataggtatgtgtgtatatatgcatatatatat

SEQ ID NO: 89127 - DNA, 110 bp, Mus musculus
acctatgtgagcacttctgtgcatgtgtatgcacttgggtgtttgtgtgtgtgcatatatatgtatgtatgcaagtgtgtgaacctgtgtacaggagtgttcatatatgt

SEQ ID NO: 89128 - DNA, 122 bp, Mus musculus
agctccatggcctttgtttccctaatgaagtcaaatcccccaggccagaaacgaatttcactgcctctctctcacttccttgggagatgaacatacctttccacttgggcttttcttgttgg

SEQ ID NO: 89129 - DNA, 80 bp, Mus musculus
ggctaagccttactagagaaagctagggacatgtatattagaagtgatgactccctcactgtttcgctgtgttcttagcc

SEQ ID NO: 89130 - DNA, 112 bp, Mus musculus
agggcttctctgtatttcccatataccctggatcacttctgatgatgttcttgttctagcaagacagcctcagcacatagatttatgagtatgtgaactggaagagaacctt

SEQ ID NO: 89131 - DNA, 110 bp, Mus musculus
agttagggctttactgaaggactcctccttggggaggggtcactgagcctatgctgtgctgttactctcagtggctctttgccatgtcccagacagtatggccttgtgct

SEQ ID NO: 89132 - DNA, 127 bp, Mus musculus
tctctggtcttcttcccttttcccaccctttctattgtcatattttcactgtgtgtgtgtgtgtgtgtgagagagagagagagagacagagaaagagagacagagacagacagagagagagagagag

SEQ ID NO: 89133 - DNA, 63 bp, Mus musculus
tttctggtacgaggacagattttgtacttgtcatgtgcatgctcagtctttccttcccagaga

SEQ ID NO: 89134 - DNA, 78 bp, Mus musculus
ctgactgctcttccagaggtcctgagttcaaatcccagcaaccacatggtggttcacaaccatctgtaatgaggtcgg

SEQ ID NO: 89135 - DNA, 103 bp, Mus musculus
atgtttgtatgagtgtatgtggtgtacatgaatatatatatatatatatatatatgtatatagattcatgtatgtatgtgagcatacttgtctgtgagagcat

SEQ ID NO: 89136 - DNA, 83 bp, Mus musculus
ggatcaaagatctactctgtgtgtgtctgtttctatgccttggataggaaggcgacctggagcatagtacagtctctggtacc

SEQ ID NO: 89137 - DNA, 94 bp, Mus musculus
ctctctcctttccccttcatttttacttcatgttcactggtgttttgttctcatgtgtgtctgtgtgagggtgtcgggtcccctggaattagag

SEQ ID NO: 89138 - DNA, 82 bp, Mus musculus
acggtctctccagccatactgaattttattatatgtacttaaaagacatacctcagtgtggctggccactgaaagaagctgt

SEQ ID NO: 89139 - DNA, 78 bp, Mus musculus
tgtatgtctgtctcagtgactcttacttgtagttcccttagaaataagtgactcagatgagagagatgagcaccatgc

SEQ ID NO: 89140 - DNA, 118 bp, Mus musculus
cacaggatagttcttagctggtgaaataagagagctgctgactgaaatgactgaggataagacccaaaaagccagagttgtgccttgccatttaagactactaagggcctttcctgcg
